United States Patent 7,901,882 (ANALYSIS OF METHYLATION USING NUCLEIC ACID ARRAYS) - sequence listing, part 14

SEQ ID NO: 509470 - DNA, 25 bp, Rattus norvegicus
tccgatcccagctccagcttgggtt

SEQ ID NO: 509471 - DNA, 25 bp, Rattus norvegicus
agcttgggttctcgctccacaggac

SEQ ID NO: 509472 - DNA, 25 bp, Rattus norvegicus
ctccgagatggtggcagaggcaacc

SEQ ID NO: 509473 - DNA, 25 bp, Rattus norvegicus
gcagaggcaaccagcgaagaaggaa

SEQ ID NO: 509474 - DNA, 25 bp, Rattus norvegicus
cgcacgacgtgtacgcggcagagcc

SEQ ID NO: 509475 - DNA, 25 bp, Rattus norvegicus
tccacgctgcgatgccagcagaatc

SEQ ID NO: 509476 - DNA, 25 bp, Rattus norvegicus
gactctgcactttgggttctcgccc

SEQ ID NO: 509477 - DNA, 25 bp, Rattus norvegicus
gccctcccggggagctcatcaaggg

SEQ ID NO: 509478 - DNA, 25 bp, Rattus norvegicus
agccgtgtgctctctatccttttgg

SEQ ID NO: 509479 - DNA, 25 bp, Rattus norvegicus
tatccttttggtcgctgctctggtc

SEQ ID NO: 509480 - DNA, 25 bp, Rattus norvegicus
gtccctctgttcttggcctgagctg

SEQ ID NO: 509481 - DNA, 25 bp, Rattus norvegicus
tgatggcgacgtcccgcgctagcct

SEQ ID NO: 509482 - DNA, 25 bp, Rattus norvegicus
gctctgggccggcatcaccaggctg

SEQ ID NO: 509483 - DNA, 25 bp, Rattus norvegicus
tccacaggactcagctccgagatgg

SEQ ID NO: 509484 - DNA, 25 bp, Rattus norvegicus
ctgggtgtagccgtctcccagcgac

SEQ ID NO: 509485 - DNA, 25 bp, Rattus norvegicus
tcccgaaagagcagtaggccaaacc

SEQ ID NO: 509486 - DNA, 25 bp, Rattus norvegicus
tacgcggcacctgtgagtccatttc

SEQ ID NO: 509487 - DNA, 25 bp, Rattus norvegicus
caccggaaacagcagcaagcctctt

SEQ ID NO: 509488 - DNA, 25 bp, Rattus norvegicus
agcaagcctcttcagggccagaacc

SEQ ID NO: 509489 - DNA, 25 bp, Rattus norvegicus
gccaggccaccacggacatgcgtga

SEQ ID NO: 509490 - DNA, 25 bp, Rattus norvegicus
gccaccacggacatgcgtgaccatg

SEQ ID NO: 509491 - DNA, 25 bp, Rattus norvegicus
agtccatttccactcagctccgggt

SEQ ID NO: 509492 - DNA, 25 bp, Rattus norvegicus
acgctgtagtccatttcccgaaaga

SEQ ID NO: 509493 - DNA, 25 bp, Rattus norvegicus
ctccatagctgcagtttggcagcgc

SEQ ID NO: 509494 - DNA, 25 bp, Rattus norvegicus
gtacccgctccatagctgcagtttg

SEQ ID NO: 509495 - DNA, 25 bp, Rattus norvegicus
cagggtccggaggtacccgctccat

SEQ ID NO: 509496 - DNA, 25 bp, Rattus norvegicus
gcaggctgcaacagcttctcagggt

SEQ ID NO: 509497 - DNA, 25 bp, Rattus norvegicus
tccaggggtgcaggctgcaacagct

SEQ ID NO: 509498 - DNA, 25 bp, Rattus norvegicus
tctcctccctcagacaattctgcac

SEQ ID NO: 509499 - DNA, 25 bp, Rattus norvegicus
aattctgcacgtaactcacagcgcc

SEQ ID NO: 509500 - DNA, 25 bp, Rattus norvegicus
caattctgcacgtaactcacagcgc

SEQ ID NO: 509501 - DNA, 25 bp, Rattus norvegicus
acaattctgcacgtaactcacagcg

SEQ ID NO: 509502 - DNA, 25 bp, Rattus norvegicus
gacaattctgcacgtaactcacagc

SEQ ID NO: 509503 - DNA, 25 bp, Rattus norvegicus
agacaattctgcacgtaactcacag

SEQ ID NO: 509504 - DNA, 25 bp, Rattus norvegicus
cagacaattctgcacgtaactcaca

SEQ ID NO: 509505 - DNA, 25 bp, Rattus norvegicus
tcagacaattctgcacgtaactcac

SEQ ID NO: 509506 - DNA, 25 bp, Rattus norvegicus
ctcagacaattctgcacgtaactca

SEQ ID NO: 509507 - DNA, 25 bp, Rattus norvegicus
cctcagacaattctgcacgtaactc

SEQ ID NO: 509508 - DNA, 25 bp, Rattus norvegicus
ccctcagacaattctgcacgtaact

SEQ ID NO: 509509 - DNA, 25 bp, Rattus norvegicus
tccctcagacaattctgcacgtaac

SEQ ID NO: 509510 - DNA, 25 bp, Rattus norvegicus
attctgcacgtaactcacagcgccg

SEQ ID NO: 509511 - DNA, 25 bp, Rattus norvegicus
ctccctcagacaattctgcacgtaa

SEQ ID NO: 509512 - DNA, 25 bp, Rattus norvegicus
tcctgcacttgcgtcacggaaaagg

SEQ ID NO: 509513 - DNA, 25 bp, Rattus norvegicus
ccgcaactcggctgctgaaagctcg

SEQ ID NO: 509514 - DNA, 25 bp, Rattus norvegicus
agaagctactctgggcgcccgcaac

SEQ ID NO: 509515 - DNA, 25 bp, Rattus norvegicus
cagtgagaagctactctgggcgccc

SEQ ID NO: 509516 - DNA, 25 bp, Rattus norvegicus
ccaagtcaaggaggcgaagctcggc

SEQ ID NO: 509517 - DNA, 25 bp, Rattus norvegicus
ggcagatggatgaccaagtcaagga

SEQ ID NO: 509518 - DNA, 25 bp, Rattus norvegicus
acttgcgtcacggaaaaggcagatg

SEQ ID NO: 509519 - DNA, 25 bp, Rattus norvegicus
agttttcctgcacttgcgtcacgga

SEQ ID NO: 509520 - DNA, 25 bp, Rattus norvegicus
tcggagttttcctgcacttgcgtca

SEQ ID NO: 509521 - DNA, 25 bp, Rattus norvegicus
tgcgctccgcaaactttcggagttt

SEQ ID NO: 509522 - DNA, 25 bp, Rattus norvegicus
tctgcgctccgcaaactttcggagt

SEQ ID NO: 509523 - DNA, 25 bp, Rattus norvegicus
ggcgcccgcaactcggctgctgaaa

SEQ ID NO: 509524 - DNA, 25 bp, Rattus norvegicus
cacggaaaaggcagatggatgacca

SEQ ID NO: 509525 - DNA, 25 bp, Rattus norvegicus
aactcggctgctgaaagctcgcagc

SEQ ID NO: 509526 - DNA, 25 bp, Rattus norvegicus
gcccgaaatccaagcgcgggtccgc

SEQ ID NO: 509527 - DNA, 25 bp, Rattus norvegicus
ccacgatgcttctcagcccgggaca

SEQ ID NO: 509528 - DNA, 25 bp, Rattus norvegicus
gccttacaagtccagacgcccaacc

SEQ ID NO: 509529 - DNA, 25 bp, Rattus norvegicus
tgttccctcgccttacaagtccaga

SEQ ID NO: 509530 - DNA, 25 bp, Rattus norvegicus
agactcggcacgctctgttccctcg

SEQ ID NO: 509531 - DNA, 25 bp, Rattus norvegicus
gctgtccagactcggcacgctctgt

SEQ ID NO: 509532 - DNA, 25 bp, Rattus norvegicus
gactcgctgctgtccagactcggca

SEQ ID NO: 509533 - DNA, 25 bp, Rattus norvegicus
acttgcgactcgctgctgtccagac

SEQ ID NO: 509534 - DNA, 25 bp, Rattus norvegicus
ttgtgacttgcgactcgctgctgtc

SEQ ID NO: 509535 - DNA, 25 bp, Rattus norvegicus
ttgacttgtgacttgcgactcgctg

SEQ ID NO: 509536 - DNA, 25 bp, Rattus norvegicus
ctcccttgacttgcgacttgacttg

SEQ ID NO: 509537 - DNA, 25 bp, Rattus norvegicus
cctgctcccttgacttgcgacttga

SEQ ID NO: 509538 - DNA, 25 bp, Rattus norvegicus
aggagccctgctcccttgacttgcg

SEQ ID NO: 509539 - DNA, 25 bp, Rattus norvegicus
agttaagtaccggacagcccctgcg

SEQ ID NO: 509540 - DNA, 25 bp, Rattus norvegicus
ttcgcgaacttcacgcagctgctca

SEQ ID NO: 509541 - DNA, 25 bp, Rattus norvegicus
gactgcctgccgtcttcgcgaactt

SEQ ID NO: 509542 - DNA, 25 bp, Rattus norvegicus
aacttcacgcagctgctcaccatta

SEQ ID NO: 509543 - DNA, 25 bp, Rattus norvegicus
ttgagtggcggcacgtgcagcccac

SEQ ID NO: 509544 - DNA, 25 bp, Rattus norvegicus
cagcccacgctggacctgacagagg

SEQ ID NO: 509545 - DNA, 25 bp, Rattus norvegicus
agctgcgcaagtcccaggtactgtt

SEQ ID NO: 509546 - DNA, 25 bp, Rattus norvegicus
cccaggtactgttcagcgtgagcca

SEQ ID NO: 509547 - DNA, 25 bp, Rattus norvegicus
ttcagcgtgagccagggtgcacgcc

SEQ ID NO: 509548 - DNA, 25 bp, Rattus norvegicus
tggagctagacatcccgggagccca

SEQ ID NO: 509549 - DNA, 25 bp, Rattus norvegicus
cgaaaaatgtttacactgttggacg

SEQ ID NO: 509550 - DNA, 25 bp, Rattus norvegicus
acactgttggacgtggtgaaccgaa

SEQ ID NO: 509551 - DNA, 25 bp, Rattus norvegicus
cgtggtgaaccgaaaggctcgcttt

SEQ ID NO: 509552 - DNA, 25 bp, Rattus norvegicus
aaccgaaaggctcgctttgttcacg

SEQ ID NO: 509553 - DNA, 25 bp, Rattus norvegicus
gtgtgttcctgagccgggactgcct

SEQ ID NO: 509554 - DNA, 25 bp, Rattus norvegicus
tccgggttagggttgcaatccctca

SEQ ID NO: 509555 - DNA, 25 bp, Rattus norvegicus
gcccaggaacgtccaggtctgatcc

SEQ ID NO: 509556 - DNA, 25 bp, Rattus norvegicus
agagaagagtgatcggcccaggaac

SEQ ID NO: 509557 - DNA, 25 bp, Rattus norvegicus
ctcggcacctagcaatctcagggct

SEQ ID NO: 509558 - DNA, 25 bp, Rattus norvegicus
cttggccgtcttaaattggtcagga

SEQ ID NO: 509559 - DNA, 25 bp, Rattus norvegicus
ggtactgcgcagagcttcacaaagg

SEQ ID NO: 509560 - DNA, 25 bp, Rattus norvegicus
ccactactggccaggagaggtactg

SEQ ID NO: 509561 - DNA, 25 bp, Rattus norvegicus
aacaacccttgcattggaccagata

SEQ ID NO: 509562 - DNA, 25 bp, Rattus norvegicus
tctcagggctcacagtaagctgtca

SEQ ID NO: 509563 - DNA, 25 bp, Rattus norvegicus
taagctgtcaggcaaacaacccttg

SEQ ID NO: 509564 - DNA, 25 bp, Rattus norvegicus
ccagataatggagtacagggacaag

SEQ ID NO: 509565 - DNA, 25 bp, Rattus norvegicus
cagggacaaggaaccaacctgcttc

SEQ ID NO: 509566 - DNA, 25 bp, Rattus norvegicus
aacctgcttcctgcgtttatctgga

SEQ ID NO: 509567 - DNA, 25 bp, Rattus norvegicus
gacaggcgtcagcagaggttactga

SEQ ID NO: 509568 - DNA, 25 bp, Rattus norvegicus
acttccgtgcgtcctggccgggctg

SEQ ID NO: 509569 - DNA, 25 bp, Rattus norvegicus
gccagggtgccaccgccggccttcc

SEQ ID NO: 509570 - DNA, 25 bp, Rattus norvegicus
gccaccgccggccttccgctcactt

SEQ ID NO: 509571 - DNA, 25 bp, Rattus norvegicus
ttccgctcactttccttctggcggg

SEQ ID NO: 509572 - DNA, 25 bp, Rattus norvegicus
cgctcactttccttctggcgggcgc

SEQ ID NO: 509573 - DNA, 25 bp, Rattus norvegicus
cactttccttctggcgggcgccctc

SEQ ID NO: 509574 - DNA, 25 bp, Rattus norvegicus
ctctctcgggttcagtccgggtggc

SEQ ID NO: 509575 - DNA, 25 bp, Rattus norvegicus
tctctcgggttcagtccgggtggcc

SEQ ID NO: 509576 - DNA, 25 bp, Rattus norvegicus
ctctcgggttcagtccgggtggcca

SEQ ID NO: 509577 - DNA, 25 bp, Rattus norvegicus
gttcagtccgggtggccaggatcca

SEQ ID NO: 509578 - DNA, 25 bp, Rattus norvegicus
ttcagtccgggtggccaggatccag

SEQ ID NO: 509579 - DNA, 25 bp, Rattus norvegicus
agtccgggtggccaggatccaggaa

SEQ ID NO: 509580 - DNA, 25 bp, Rattus norvegicus
cgccctctctctctcgggttcagtc

SEQ ID NO: 509581 - DNA, 25 bp, Rattus norvegicus
ctcccgcggccagggtgccaccgcc

SEQ ID NO: 509582 - DNA, 25 bp, Rattus norvegicus
cgagctttcagcagccgagttgcgg

SEQ ID NO: 509583 - DNA, 25 bp, Rattus norvegicus
gttgcgggcgcccagagtagcttct

SEQ ID NO: 509584 - DNA, 25 bp, Rattus norvegicus
tgcgagctttcagcagccgagttgc

SEQ ID NO: 509585 - DNA, 25 bp, Rattus norvegicus
gccgagcttcgcctccttgacttgg

SEQ ID NO: 509586 - DNA, 25 bp, Rattus norvegicus
cctccttgacttggtcatccatctg

SEQ ID NO: 509587 - DNA, 25 bp, Rattus norvegicus
tggtcatccatctgccttttccgtg

SEQ ID NO: 509588 - DNA, 25 bp, Rattus norvegicus
atccatctgccttttccgtgacgca

SEQ ID NO: 509589 - DNA, 25 bp, Rattus norvegicus
tctgccttttccgtgacgcaagtgc

SEQ ID NO: 509590 - DNA, 25 bp, Rattus norvegicus
ccttttccgtgacgcaagtgcagga

SEQ ID NO: 509591 - DNA, 25 bp, Rattus norvegicus
ccgtgacgcaagtgcaggaaaactc

SEQ ID NO: 509592 - DNA, 25 bp, Rattus norvegicus
tgacgcaagtgcaggaaaactccga

SEQ ID NO: 509593 - DNA, 25 bp, Rattus norvegicus
actccgaaagtttgcggagcgcaga

SEQ ID NO: 509594 - DNA, 25 bp, Rattus norvegicus
agagtagcttctcactggggttgga

SEQ ID NO: 509595 - DNA, 25 bp, Rattus norvegicus
ggcgcccagagtagcttctcactgg

SEQ ID NO: 509596 - DNA, 25 bp, Rattus norvegicus
gtcacgtccgcgtgggcccagacgt

SEQ ID NO: 509597 - DNA, 25 bp, Rattus norvegicus
tcactagaactctgcgactccgtct

SEQ ID NO: 509598 - DNA, 25 bp, Rattus norvegicus
tacgcatggcacagcatctccaggc

SEQ ID NO: 509599 - DNA, 25 bp, Rattus norvegicus
gcttttgtggagcagggtcacgtcc

SEQ ID NO: 509600 - DNA, 25 bp, Rattus norvegicus
cttgcctactttgctcctcaagcta

SEQ ID NO: 509601 - DNA, 25 bp, Rattus norvegicus
acgcgcggctcactagaactctgcg

SEQ ID NO: 509602 - DNA, 25 bp, Rattus norvegicus
acaagttgtacgctctgggcctggt

SEQ ID NO: 509603 - DNA, 25 bp, Rattus norvegicus
cggcgctgttggacaagttgtacgc

SEQ ID NO: 509604 - DNA, 25 bp, Rattus norvegicus
gctacaaccagctgagccgggccgt

SEQ ID NO: 509605 - DNA, 25 bp, Rattus norvegicus
ggcgcgaggagtacacacgctacaa

SEQ ID NO: 509606 - DNA, 25 bp, Rattus norvegicus
cgtactgcgacggtacgggctccag

SEQ ID NO: 509607 - DNA, 25 bp, Rattus norvegicus
ccttcacgagctgcgcgtactgcga

SEQ ID NO: 509608 - DNA, 25 bp, Rattus norvegicus
gaccataaccttcacgagctgcgcg

SEQ ID NO: 509609 - DNA, 25 bp, Rattus norvegicus
tttgctcctcaagctacgcatggca

SEQ ID NO: 509610 - DNA, 25 bp, Rattus norvegicus
ccggccagtcttgcgggtctcggat

SEQ ID NO: 509611 - DNA, 25 bp, Rattus norvegicus
ggtctcggatttggccatctttctg

SEQ ID NO: 509612 - DNA, 25 bp, Rattus norvegicus
ggaagtaatggcctgccgcgactca

SEQ ID NO: 509613 - DNA, 25 bp, Rattus norvegicus
ccggaagtttgcgtgacaagtctga

SEQ ID NO: 509614 - DNA, 25 bp, Rattus norvegicus
ctagctccgctagggcacctaattg

SEQ ID NO: 509615 - DNA, 25 bp, Rattus norvegicus
ggcacctaattggtcaatcggcgta

SEQ ID NO: 509616 - DNA, 25 bp, Rattus norvegicus
tggtcaatcggcgtaggcaccagcg

SEQ ID NO: 509617 - DNA, 25 bp, Rattus norvegicus
caccttggtgtggtaagtctggcct

SEQ ID NO: 509618 - DNA, 25 bp, Rattus norvegicus
tctggccttgtctactttggagttc

SEQ ID NO: 509619 - DNA, 25 bp, Rattus norvegicus
tggagttctctctcagcgcaagctg

SEQ ID NO: 509620 - DNA, 25 bp, Rattus norvegicus
agctgtaacttcttccgacggattc

SEQ ID NO: 509621 - DNA, 25 bp, Rattus norvegicus
gtcccttagctcagggcggaagtaa

SEQ ID NO: 509622 - DNA, 25 bp, Rattus norvegicus
tcaccgctgttacctgtggaggccg

SEQ ID NO: 509623 - DNA, 25 bp, Rattus norvegicus
acggattctggcttcaccgctgtta

SEQ ID NO: 509624 - DNA, 25 bp, Rattus norvegicus
tgtgtccgagtctccgaggcctagg

SEQ ID NO: 509625 - DNA, 25 bp, Rattus norvegicus
ttgtgaatgagatgctcagtttctc

SEQ ID NO: 509626 - DNA, 25 bp, Rattus norvegicus
ccgtaggggagttgcctctcagccc

SEQ ID NO: 509627 - DNA, 25 bp, Rattus norvegicus
tcagtttctcaatggagccgcgggg

SEQ ID NO: 509628 - DNA, 25 bp, Rattus norvegicus
ccgcctcggcttttgaggaactggg

SEQ ID NO: 509629 - DNA, 25 bp, Rattus norvegicus
aactgggccgcgaggccaccgagca

SEQ ID NO: 509630 - DNA, 25 bp, Rattus norvegicus
cgccttcgcggtgggctgtaaaagt

SEQ ID NO: 509631 - DNA, 25 bp, Rattus norvegicus
ggctgtaaaagttgtggattcctta

SEQ ID NO: 509632 - DNA, 25 bp, Rattus norvegicus
gaccgggagctgctgttagtttctc

SEQ ID NO: 509633 - DNA, 25 bp, Rattus norvegicus
gctgttagtttctcgcccgcacttt

SEQ ID NO: 509634 - DNA, 25 bp, Rattus norvegicus
aaataggcatttcctctccgcggga

SEQ ID NO: 509635 - DNA, 25 bp, Rattus norvegicus
cgggaagcgacagccggttctccgc

SEQ ID NO: 509636 - DNA, 25 bp, Rattus norvegicus
cccggcgcctgtttgtgaatgagat

SEQ ID NO: 509637 - DNA, 25 bp, Rattus norvegicus
tcagcgctcttgctcacatttcagg

SEQ ID NO: 509638 - DNA, 25 bp, Rattus norvegicus
taggaactcggcagattcaattcgc

SEQ ID NO: 509639 - DNA, 25 bp, Rattus norvegicus
cgcttgctgagtgtaggaaaagctc

SEQ ID NO: 509640 - DNA, 25 bp, Rattus norvegicus
atttagcaagtattcggcgccagtg

SEQ ID NO: 509641 - DNA, 25 bp, Rattus norvegicus
gccggtgtgtacgaactcctgaacc

SEQ ID NO: 509642 - DNA, 25 bp, Rattus norvegicus
ccggagaggttccagccactagcat

SEQ ID NO: 509643 - DNA, 25 bp, Rattus norvegicus
ggctgcgccgcccaatttattttac

SEQ ID NO: 509644 - DNA, 25 bp, Rattus norvegicus
tttctgccggcaaacttggagggtc

SEQ ID NO: 509645 - DNA, 25 bp, Rattus norvegicus
gccgccctgagcgtttgtttctgcc

SEQ ID NO: 509646 - DNA, 25 bp, Rattus norvegicus
ggtctttctccgctaatcacgctag

SEQ ID NO: 509647 - DNA, 25 bp, Rattus norvegicus
cgaccgctggagtttaggagcaagc

SEQ ID NO: 509648 - DNA, 25 bp, Rattus norvegicus
gccgcagcctggttagtcgaaccca

SEQ ID NO: 509649 - DNA, 25 bp, Rattus norvegicus
tgggccgacagaaaaccaactgctc

SEQ ID NO: 509650 - DNA, 25 bp, Rattus norvegicus
actaagcagtcggtttcggcaggtc

SEQ ID NO: 509651 - DNA, 25 bp, Rattus norvegicus
tgggaaaacagactccacgcttgga

SEQ ID NO: 509652 - DNA, 25 bp, Rattus norvegicus
ctaccggcgccaagatagtccaatc

SEQ ID NO: 509653 - DNA, 25 bp, Rattus norvegicus
ggccttggaacgctgagcttcagtc

SEQ ID NO: 509654 - DNA, 25 bp, Rattus norvegicus
gcttcagtctccagtgtaaacattc

SEQ ID NO: 509655 - DNA, 25 bp, Rattus norvegicus
ttccacaaaaggactgctaaggttc

SEQ ID NO: 509656 - DNA, 25 bp, Rattus norvegicus
taaggttcagcatcctcgcgcaggg

SEQ ID NO: 509657 - DNA, 25 bp, Rattus norvegicus
ggaatggtctccttcctggaccggc

SEQ ID NO: 509658 - DNA, 25 bp, Rattus norvegicus
cttaccttcctagggctatgagaga

SEQ ID NO: 509659 - DNA, 25 bp, Rattus norvegicus
tccaatgagatgtgacgaggtaccc

SEQ ID NO: 509660 - DNA, 25 bp, Rattus norvegicus
ttcggcaatcagtctccaataggcg

SEQ ID NO: 509661 - DNA, 25 bp, Rattus norvegicus
tgcggcacggtgattggctaaacca

SEQ ID NO: 509662 - DNA, 25 bp, Rattus norvegicus
cggcagagacggtttctccatcttc

SEQ ID NO: 509663 - DNA, 25 bp, Rattus norvegicus
cctgtgaccgcttcgtaggcgcaaa

SEQ ID NO: 509664 - DNA, 25 bp, Rattus norvegicus
cgcaaaggaggttgccagtccgctc

SEQ ID NO: 509665 - DNA, 25 bp, Rattus norvegicus
tcggcctcacttaaggacattttta

SEQ ID NO: 509666 - DNA, 25 bp, Rattus norvegicus
aggtcgccgatcctccgcctgggaa

SEQ ID NO: 509667 - DNA, 25 bp, Rattus norvegicus
cggcctgacctcaggactcggggtc

SEQ ID NO: 509668 - DNA, 25 bp, Rattus norvegicus
gtgcttcttctcctcagcggggtcc

SEQ ID NO: 509669 - DNA, 25 bp, Rattus norvegicus
cttcctttccggtgtcgcgtgagct

SEQ ID NO: 509670 - DNA, 25 bp, Rattus norvegicus
ccatctttgattggggcagtcgtgc

SEQ ID NO: 509671 - DNA, 25 bp, Rattus norvegicus
tcggtgccacactccgaggagcagc

SEQ ID NO: 509672 - DNA, 25 bp, Rattus norvegicus
gtgagctcatttccgctagaactga

SEQ ID NO: 509673 - DNA, 25 bp, Rattus norvegicus
agtaaaggcccgtccagccagctcg

SEQ ID NO: 509674 - DNA, 25 bp, Rattus norvegicus
cctggagctttcttagccctaaacg

SEQ ID NO: 509675 - DNA, 25 bp, Rattus norvegicus
cagagtcaactgctccctggagctt

SEQ ID NO: 509676 - DNA, 25 bp, Rattus norvegicus
ccggcggagttcaccagagtcaact

SEQ ID NO: 509677 - DNA, 25 bp, Rattus norvegicus
gtaaggttcaccacgggctcctcca

SEQ ID NO: 509678 - DNA, 25 bp, Rattus norvegicus
tccgaggccgcttcagcttgggccg

SEQ ID NO: 509679 - DNA, 25 bp, Rattus norvegicus
actgaagcgacggtgccatctttga

SEQ ID NO: 509680 - DNA, 25 bp, Rattus norvegicus
aaagcccgctgtagcgtctggcagg

SEQ ID NO: 509681 - DNA, 25 bp, Rattus norvegicus
cgggatttccgcctccttagctgtg

SEQ ID NO: 509682 - DNA, 25 bp, Rattus norvegicus
atttccgcctccttagctgtgaagc

SEQ ID NO: 509683 - DNA, 25 bp, Rattus norvegicus
tccgcctccttagctgtgaagcata

SEQ ID NO: 509684 - DNA, 25 bp, Rattus norvegicus
gaaggccgcttgtagactgggagcg

SEQ ID NO: 509685 - DNA, 25 bp, Rattus norvegicus
cgcctccttagctgtgaagcatagc

SEQ ID NO: 509686 - DNA, 25 bp, Rattus norvegicus
tccttagctgtgaagcatagctggg

SEQ ID NO: 509687 - DNA, 25 bp, Rattus norvegicus
ctgtgaagcatagctggggaaagcc

SEQ ID NO: 509688 - DNA, 25 bp, Rattus norvegicus
tgaagcatagctggggaaagcccgc

SEQ ID NO: 509689 - DNA, 25 bp, Rattus norvegicus
gcgtccggggctgtgatgccacgcc

SEQ ID NO: 509690 - DNA, 25 bp, Rattus norvegicus
ggaaagcccgctgtagcgtctggca

SEQ ID NO: 509691 - DNA, 25 bp, Rattus norvegicus
gccctgcgtccctgtaggtgggaag

SEQ ID NO: 509692 - DNA, 25 bp, Rattus norvegicus
tctggcaggggtcagggttccgtgt

SEQ ID NO: 509693 - DNA, 25 bp, Rattus norvegicus
catagctggggaaagcccgctgtag

SEQ ID NO: 509694 - DNA, 25 bp, Rattus norvegicus
aagcactggcgcaccacttttgagc

SEQ ID NO: 509695 - DNA, 25 bp, Rattus norvegicus
tgtagagcccgcagaccacatccgt

SEQ ID NO: 509696 - DNA, 25 bp, Rattus norvegicus
gcggcagcgccgttcttgaagcact

SEQ ID NO: 509697 - DNA, 25 bp, Rattus norvegicus
tgcgctcttcccttccggagggaaa

SEQ ID NO: 509698 - DNA, 25 bp, Rattus norvegicus
gaacgtttggttctaagcggtgcaa

SEQ ID NO: 509699 - DNA, 25 bp, Rattus norvegicus
tggcccttggcctgtagagcccgca

SEQ ID NO: 509700 - DNA, 25 bp, Rattus norvegicus
ccgactgtaaccttcgcggcaggtg

SEQ ID NO: 509701 - DNA, 25 bp, Rattus norvegicus
cgatctacttcaccgactgtaacct

SEQ ID NO: 509702 - DNA, 25 bp, Rattus norvegicus
gcaccacttttgagcgggtggagaa

SEQ ID NO: 509703 - DNA, 25 bp, Rattus norvegicus
ccgttcttgaagcactggcgcacca

SEQ ID NO: 509704 - DNA, 25 bp, Rattus norvegicus
gcaccaaggatcttccgggaaggga

SEQ ID NO: 509705 - DNA, 25 bp, Rattus norvegicus
gagtcggcagcaccaaggatcttcc

SEQ ID NO: 509706 - DNA, 25 bp, Rattus norvegicus
ttctaagcggtgcaaggagtcggca

SEQ ID NO: 509707 - DNA, 25 bp, Rattus norvegicus
tggagaagttcgtgtccccgatcta

SEQ ID NO: 509708 - DNA, 25 bp, Rattus norvegicus
cacacgtgtgaaagcgctgggagac

SEQ ID NO: 509709 - DNA, 25 bp, Rattus norvegicus
gctgggagacccaaagatcgacgcc

SEQ ID NO: 509710 - DNA, 25 bp, Rattus norvegicus
ccgccgactgcactgagatccagaa

SEQ ID NO: 509711 - DNA, 25 bp, Rattus norvegicus
ctgcggccagagagtgagtcaagca

SEQ ID NO: 509712 - DNA, 25 bp, Rattus norvegicus
gtcaagcagtggctaggaaaccgca

SEQ ID NO: 509713 - DNA, 25 bp, Rattus norvegicus
gtccagttccaacagggctggttca

SEQ ID NO: 509714 - DNA, 25 bp, Rattus norvegicus
accaggcccagggagcatccaaatc

SEQ ID NO: 509715 - DNA, 25 bp, Rattus norvegicus
tccaaatcctggcaaagtctgggca

SEQ ID NO: 509716 - DNA, 25 bp, Rattus norvegicus
ggctaggcgagctcctaccttcaga

SEQ ID NO: 509717 - DNA, 25 bp, Rattus norvegicus
aggcaactagcccagagcgacgttc

SEQ ID NO: 509718 - DNA, 25 bp, Rattus norvegicus
ctcttccttagttcgggcacacgtg

SEQ ID NO: 509719 - DNA, 25 bp, Rattus norvegicus
agctgttcctgcacgtatatgcatg

SEQ ID NO: 509720 - DNA, 25 bp, Rattus norvegicus
tgccgccacgcatgcaaagctgttc

SEQ ID NO: 509721 - DNA, 25 bp, Rattus norvegicus
ttcagagcaccaagcttctggcggc

SEQ ID NO: 509722 - DNA, 25 bp, Rattus norvegicus
cgagaaggaaggcacagtcgcctcc

SEQ ID NO: 509723 - DNA, 25 bp, Rattus norvegicus
accgcttagctgcagaaaggtagtc

SEQ ID NO: 509724 - DNA, 25 bp, Rattus norvegicus
tccactagtgctcgcgagaaggaag

SEQ ID NO: 509725 - DNA, 25 bp, Rattus norvegicus
ggctgttccactagtgctcgcgaga

SEQ ID NO: 509726 - DNA, 25 bp, Rattus norvegicus
tcgtaaggctgttccactagtgctc

SEQ ID NO: 509727 - DNA, 25 bp, Rattus norvegicus
ctcagctcgtaaggctgttccacta

SEQ ID NO: 509728 - DNA, 25 bp, Rattus norvegicus
ctcccactcagctcgtaaggctgtt

SEQ ID NO: 509729 - DNA, 25 bp, Rattus norvegicus
gcctgctgcaaccactctcgcgaga

SEQ ID NO: 509730 - DNA, 25 bp, Rattus norvegicus
cgcgcgttcccgtgcctccctgcct

SEQ ID NO: 509731 - DNA, 25 bp, Rattus norvegicus
tgcgatgcaccaggcgatcaggcgc

SEQ ID NO: 509732 - DNA, 25 bp, Rattus norvegicus
tgagctgcgatgcaccaggcgatca

SEQ ID NO: 509733 - DNA, 25 bp, Rattus norvegicus
ctgcactgagctgcgatgcaccagg

SEQ ID NO: 509734 - DNA, 25 bp, Rattus norvegicus
agtcgcgttgcgctgcactgagctg

SEQ ID NO: 509735 - DNA, 25 bp, Rattus norvegicus
aaaggtagtcgcgttgcgctgcact

SEQ ID NO: 509736 - DNA, 25 bp, Rattus norvegicus
tcaggacgcccgacttgatgctaca

SEQ ID NO: 509737 - DNA, 25 bp, Rattus norvegicus
ttgatgctacacagaaactcgtcgg

SEQ ID NO: 509738 - DNA, 25 bp, Rattus norvegicus
gtataccttgaggacgtccgtcttc

SEQ ID NO: 509739 - DNA, 25 bp, Rattus norvegicus
aggacgtccgtcttctgccggaacg

SEQ ID NO: 509740 - DNA, 25 bp, Rattus norvegicus
cttctgccggaacgggacgaagagc

SEQ ID NO: 509741 - DNA, 25 bp, Rattus norvegicus
ggacgaagagcgtgtagatgaccac

SEQ ID NO: 509742 - DNA, 25 bp, Rattus norvegicus
tgtagatgaccacggggaccagcag

SEQ ID NO: 509743 - DNA, 25 bp, Rattus norvegicus
accagcagggcgtacactaggaggt

SEQ ID NO: 509744 - DNA, 25 bp, Rattus norvegicus
cactaggaggttaatgaggctgagc

SEQ ID NO: 509745 - DNA, 25 bp, Rattus norvegicus
gcagctggaagatgccgaccgcgat

SEQ ID NO: 509746 - DNA, 25 bp, Rattus norvegicus
cgaccgcgatgagcttgcactggaa

SEQ ID NO: 509747 - DNA, 25 bp, Rattus norvegicus
cttgcactggaagctatcggggatg

SEQ ID NO: 509748 - DNA, 25 bp, Rattus norvegicus
atggtgctgtcgttcctcaggacgc

SEQ ID NO: 509749 - DNA, 25 bp, Rattus norvegicus
ctacacagaaactcgtcggagagcg

SEQ ID NO: 509750 - DNA, 25 bp, Rattus norvegicus
ctcccaggcggagcttctgctaaag

SEQ ID NO: 509751 - DNA, 25 bp, Rattus norvegicus
cggccgccagtctcagtgtacttaa

SEQ ID NO: 509752 - DNA, 25 bp, Rattus norvegicus
acttaagaatgtaccgagcctcgcc

SEQ ID NO: 509753 - DNA, 25 bp, Rattus norvegicus
gagcctcgccatcctactttcaaag

SEQ ID NO: 509754 - DNA, 25 bp, Rattus norvegicus
gacgcactggatccacgacagcttg

SEQ ID NO: 509755 - DNA, 25 bp, Rattus norvegicus
gtcacgtgcgccgagattctcaagc

SEQ ID NO: 509756 - DNA, 25 bp, Rattus norvegicus
aagatccgcaacctgctggccttcg

SEQ ID NO: 509757 - DNA, 25 bp, Rattus norvegicus
ctggtgctgtacacatgcgggtcaa

SEQ ID NO: 509758 - DNA, 25 bp, Rattus norvegicus
tctggcccttttgcagatctggcgc

SEQ ID NO: 509759 - DNA, 25 bp, Rattus norvegicus
cgacggcgcatggagaacttccgta

SEQ ID NO: 509760 - DNA, 25 bp, Rattus norvegicus
gcaaaacctgcgatcccagcgacga

SEQ ID NO: 509761 - DNA, 25 bp, Rattus norvegicus
ctgggctgaagactccgcgttccct

SEQ ID NO: 509762 - DNA, 25 bp, Rattus norvegicus
cgggcttacaccaggtcacgcggct

SEQ ID NO: 509763 - DNA, 25 bp, Rattus norvegicus
actaccctgtagaagtctgggctga

SEQ ID NO: 509764 - DNA, 25 bp, Rattus norvegicus
tagtgaccggcgaccgcatggtgcc

SEQ ID NO: 509765 - DNA, 25 bp, Rattus norvegicus
cgggtcgctaacgacagggctcatc

SEQ ID NO: 509766 - DNA, 25 bp, Rattus norvegicus
tcaggtgtatggacctgcccgggtc

SEQ ID NO: 509767 - DNA, 25 bp, Rattus norvegicus
ccggatacacgaccggtcaggtgta

SEQ ID NO: 509768 - DNA, 25 bp, Rattus norvegicus
gccacttcctgatgccggatacacg

SEQ ID NO: 509769 - DNA, 25 bp, Rattus norvegicus
ccgtctggagttatgtgggagactc

SEQ ID NO: 509770 - DNA, 25 bp, Rattus norvegicus
cgcagggtatccactgccgtctgga

SEQ ID NO: 509771 - DNA, 25 bp, Rattus norvegicus
cttggcgaaggtgacattgagcctc

SEQ ID NO: 509772 - DNA, 25 bp, Rattus norvegicus
gagctctgcagagggccggccttat

SEQ ID NO: 509773 - DNA, 25 bp, Rattus norvegicus
cagggctcatcacttcctttcagtc

SEQ ID NO: 509774 - DNA, 25 bp, Rattus norvegicus
cgcagacgtggtttgtcctcgacgc

SEQ ID NO: 509775 - DNA, 25 bp, Rattus norvegicus
accagcactgactcggcgcagacgt

SEQ ID NO: 509776 - DNA, 25 bp, Rattus norvegicus
tcctttcagtctctgggccgtgacc

SEQ ID NO: 509777 - DNA, 25 bp, Rattus norvegicus
tgtccttgctgtgacctgggctccc

SEQ ID NO: 509778 - DNA, 25 bp, Rattus norvegicus
ctaaaggagtgtacgtcttgtcatt

SEQ ID NO: 509779 - DNA, 25 bp, Rattus norvegicus
cgtggaccctacttggtgacgcgcg

SEQ ID NO: 509780 - DNA, 25 bp, Rattus norvegicus
gagaagcgtggaccctacttggtga

SEQ ID NO: 509781 - DNA, 25 bp, Rattus norvegicus
ccgccacggagaagcgtggacccta

SEQ ID NO: 509782 - DNA, 25 bp, Rattus norvegicus
agctgcggggctgccctccagacag

SEQ ID NO: 509783 - DNA, 25 bp, Rattus norvegicus
agcctggtgcggctcccgacagcgt

SEQ ID NO: 509784 - DNA, 25 bp, Rattus norvegicus
gtacgtcttgtcatttgttcttccc

SEQ ID NO: 509785 - DNA, 25 bp, Rattus norvegicus
gtcgccatctttctaaaggagtgta

SEQ ID NO: 509786 - DNA, 25 bp, Rattus norvegicus
ctgcgcgtcgccatctttctaaagg

SEQ ID NO: 509787 - DNA, 25 bp, Rattus norvegicus
ccggaaagcgccaagggaagcctgc

SEQ ID NO: 509788 - DNA, 25 bp, Rattus norvegicus
tctccgcagcaggacgccggaaagc

SEQ ID NO: 509789 - DNA, 25 bp, Rattus norvegicus
gaaccttggtgctctctccgcagca

SEQ ID NO: 509790 - DNA, 25 bp, Rattus norvegicus
tagggcggaaccttggtgctctctc

SEQ ID NO: 509791 - DNA, 25 bp, Rattus norvegicus
cccgcaccgggctggccactggcaa

SEQ ID NO: 509792 - DNA, 25 bp, Rattus norvegicus
gctaggtcctgccagtattgggccc

SEQ ID NO: 509793 - DNA, 25 bp, Rattus norvegicus
acctcgcggattcgccatcctagtt

SEQ ID NO: 509794 - DNA, 25 bp, Rattus norvegicus
gattcgccatcctagttgcctgaga

SEQ ID NO: 509795 - DNA, 25 bp, Rattus norvegicus
cctagttgcctgagacccggcttca

SEQ ID NO: 509796 - DNA, 25 bp, Rattus norvegicus
ttcaggaacgtaagcccttcccagc

SEQ ID NO: 509797 - DNA, 25 bp, Rattus norvegicus
ccaagatagccaacaccagtaaacg

SEQ ID NO: 509798 - DNA, 25 bp, Rattus norvegicus
cagtaaacggctcacctcgcggatt

SEQ ID NO: 509799 - DNA, 25 bp, Rattus norvegicus
cagaacgcgaccaccaccaagatag

SEQ ID NO: 509800 - DNA, 25 bp, Rattus norvegicus
acggcccgctaggtcctgccagtat

SEQ ID NO: 509801 - DNA, 25 bp, Rattus norvegicus
ccacgggaatgatcacggcccgcta

SEQ ID NO: 509802 - DNA, 25 bp, Rattus norvegicus
tgcccagagtccacgggaatgatca

SEQ ID NO: 509803 - DNA, 25 bp, Rattus norvegicus
ccagatcccgtactgtgcccagagt

SEQ ID NO: 509804 - DNA, 25 bp, Rattus norvegicus
tgattcgagcgcacgcaccattctc

SEQ ID NO: 509805 - DNA, 25 bp, Rattus norvegicus
gaagtgattcgagcgcacgcaccat

SEQ ID NO: 509806 - DNA, 25 bp, Rattus norvegicus
tggcacgtacgccacggtgtacaag

SEQ ID NO: 509807 - DNA, 25 bp, Rattus norvegicus
cgtacgccacggtgtacaaggccta

SEQ ID NO: 509808 - DNA, 25 bp, Rattus norvegicus
ccacggtgtacaaggcctacgccaa

SEQ ID NO: 509809 - DNA, 25 bp, Rattus norvegicus
ttgtgcccgaagtgtccgggcgctg

SEQ ID NO: 509810 - DNA, 25 bp, Rattus norvegicus
ggctggacggtttcatccttaccga

SEQ ID NO: 509811 - DNA, 25 bp, Rattus norvegicus
gtctccctcggctggacggtttcat

SEQ ID NO: 509812 - DNA, 25 bp, Rattus norvegicus
agtcgcgcttccggcgggcagcact

SEQ ID NO: 509813 - DNA, 25 bp, Rattus norvegicus
cgcctgggcagtggcacgtacgcca

SEQ ID NO: 509814 - DNA, 25 bp, Rattus norvegicus
tcatccttaccgagcgcctgggcag

SEQ ID NO: 509815 - DNA, 25 bp, Rattus norvegicus
gtttcatccttaccgagcgcctggg

SEQ ID NO: 509816 - DNA, 25 bp, Rattus norvegicus
tggacggtttcatccttaccgagcg

SEQ ID NO: 509817 - DNA, 25 bp, Rattus norvegicus
ctcggctggacggtttcatccttac

SEQ ID NO: 509818 - DNA, 25 bp, Rattus norvegicus
caaaccaggaaacacctggcggcgg

SEQ ID NO: 509819 - DNA, 25 bp, Rattus norvegicus
gctgtgtggagtcccgccttgccgc

SEQ ID NO: 509820 - DNA, 25 bp, Rattus norvegicus
cctggaggcgttccgctaactcggt

SEQ ID NO: 509821 - DNA, 25 bp, Rattus norvegicus
cgccggcagacactgggtctgtcaa

SEQ ID NO: 509822 - DNA, 25 bp, Rattus norvegicus
ggagactccgcagccacggaccgga

SEQ ID NO: 509823 - DNA, 25 bp, Rattus norvegicus
tgtcaaccaacttcaggccggtcgc

SEQ ID NO: 509824 - DNA, 25 bp, Rattus norvegicus
ctccactcgaggatcgtgggctgtc

SEQ ID NO: 509825 - DNA, 25 bp, Rattus norvegicus
aagggtccgctcacgtcggagactc

SEQ ID NO: 509826 - DNA, 25 bp, Rattus norvegicus
agcggctcagagaaggacctttacc

SEQ ID NO: 509827 - DNA, 25 bp, Rattus norvegicus
cgggacgctgttcgcgcgccacgat

SEQ ID NO: 509828 - DNA, 25 bp, Rattus norvegicus
gccacgatccgcactattgtttccg

SEQ ID NO: 509829 - DNA, 25 bp, Rattus norvegicus
gcgtggcgcacatggacccgtccga

SEQ ID NO: 509830 - DNA, 25 bp, Rattus norvegicus
gtccgacgcactagagcggctcaga

SEQ ID NO: 509831 - DNA, 25 bp, Rattus norvegicus
gtgggatccgcctcgtctgtccgtc

SEQ ID NO: 509832 - DNA, 25 bp, Rattus norvegicus
ggagggtcccgaggactccactcga

SEQ ID NO: 509833 - DNA, 25 bp, Rattus norvegicus
agacactgggtctgtcaaccaactt

SEQ ID NO: 509834 - DNA, 25 bp, Rattus norvegicus
cgccctctgctggaccttgaaggaa

SEQ ID NO: 509835 - DNA, 25 bp, Rattus norvegicus
ggcggcatcagtggcctacaggaca

SEQ ID NO: 509836 - DNA, 25 bp, Rattus norvegicus
aagctcgcaggcctagtgagaggaa

SEQ ID NO: 509837 - DNA, 25 bp, Rattus norvegicus
cgatcacggtctgcggggcttgtct

SEQ ID NO: 509838 - DNA, 25 bp, Rattus norvegicus
cccgggcgttcgatcacggtctgcg

SEQ ID NO: 509839 - DNA, 25 bp, Rattus norvegicus
aggaaacaatgtagccggcgcggcc

SEQ ID NO: 509840 - DNA, 25 bp, Rattus norvegicus
acaaagaggtgtatggatgcgaaaa

SEQ ID NO: 509841 - DNA, 25 bp, Rattus norvegicus
tacaggacagtccatgcggccaagg

SEQ ID NO: 509842 - DNA, 25 bp, Rattus norvegicus
tcagtggcctacaggacagtccatg

SEQ ID NO: 509843 - DNA, 25 bp, Rattus norvegicus
ctgctggaccttgaaggaaatgcgg

SEQ ID NO: 509844 - DNA, 25 bp, Rattus norvegicus
ttctagggggcattcggacacccac

SEQ ID NO: 509845 - DNA, 25 bp, Rattus norvegicus
aacacttacctctctgggggcactg

SEQ ID NO: 509846 - DNA, 25 bp, Rattus norvegicus
acgagcgacctcctcccttctaggg

SEQ ID NO: 509847 - DNA, 25 bp, Rattus norvegicus
ctatagaggcgggacgagcgacctc

SEQ ID NO: 509848 - DNA, 25 bp, Rattus norvegicus
ggtcagctcggtttgctttttaggc

SEQ ID NO: 509849 - DNA, 25 bp, Rattus norvegicus
ggctcctcccagtgtcaacggaagt

SEQ ID NO: 509850 - DNA, 25 bp, Rattus norvegicus
tcccagtgtcaacggaagtgacatc

SEQ ID NO: 509851 - DNA, 25 bp, Rattus norvegicus
cgtgcgtgctcatgaagagtgtgtg

SEQ ID NO: 509852 - DNA, 25 bp, Rattus norvegicus
gtgctttttaggctgcgggcttcca

SEQ ID NO: 509853 - DNA, 25 bp, Rattus norvegicus
aagtgacatcattcgcgttggccca

SEQ ID NO: 509854 - DNA, 25 bp, Rattus norvegicus
ttgctttttaggctgcgggcttcca

SEQ ID NO: 509855 - DNA, 25 bp, Rattus norvegicus
gacatcattcgcgttggcccagacg

SEQ ID NO: 509856 - DNA, 25 bp, Rattus norvegicus
cgcttccgggtggtcagctcggttt

SEQ ID NO: 509857 - DNA, 25 bp, Rattus norvegicus
ccagacagtgaacttgagggaggcc

SEQ ID NO: 509858 - DNA, 25 bp, Rattus norvegicus
gcaggcggccagacagtgaacttga

SEQ ID NO: 509859 - DNA, 25 bp, Rattus norvegicus
acgtcttggtgtgctgtgcagcgca

SEQ ID NO: 509860 - DNA, 25 bp, Rattus norvegicus
tggctgctcctgtgtctgtggaggt

SEQ ID NO: 509861 - DNA, 25 bp, Rattus norvegicus
ttggcccagacgcaggggcgtttcc

SEQ ID NO: 509862 - DNA, 25 bp, Rattus norvegicus
accaatcgcatggtaggcggttccg

SEQ ID NO: 509863 - DNA, 25 bp, Rattus norvegicus
gttggcttctctgcatgcaccgccc

SEQ ID NO: 509864 - DNA, 25 bp, Rattus norvegicus
gcttactgctctgttggcttctctg

SEQ ID NO: 509865 - DNA, 25 bp, Rattus norvegicus
tgctgcgcttactgctctgttggct

SEQ ID NO: 509866 - DNA, 25 bp, Rattus norvegicus
gtcatcttccacactccggctgctg

SEQ ID NO: 509867 - DNA, 25 bp, Rattus norvegicus
gaaacgccatccgaccaatcgcatg

SEQ ID NO: 509868 - DNA, 25 bp, Rattus norvegicus
aggtggccctccttgtcatcttcca

SEQ ID NO: 509869 - DNA, 25 bp, Rattus norvegicus
cttggagccaatcgccgatccggca

SEQ ID NO: 509870 - DNA, 25 bp, Rattus norvegicus
tgtacatcgctcttggagccaatcg

SEQ ID NO: 509871 - DNA, 25 bp, Rattus norvegicus
aaggtggctgtacatcgctcttgga

SEQ ID NO: 509872 - DNA, 25 bp, Rattus norvegicus
gttttacgaaaggtggctgtacatc

SEQ ID NO: 509873 - DNA, 25 bp, Rattus norvegicus
caggagaggtctcgtctaacaaggg

SEQ ID NO: 509874 - DNA, 25 bp, Rattus norvegicus
ctccacgcaggagaggtctcgtcta

SEQ ID NO: 509875 - DNA, 25 bp, Rattus norvegicus
cgatccggcacaccaggtggccctc

SEQ ID NO: 509876 - DNA, 25 bp, Rattus norvegicus
ccctctccgtgtagtggtgcacgta

SEQ ID NO: 509877 - DNA, 25 bp, Rattus norvegicus
gccagcctcttcctgcgcgaggaga

SEQ ID NO: 509878 - DNA, 25 bp, Rattus norvegicus
gcgcgcaagaagcaaacgacacatt

SEQ ID NO: 509879 - DNA, 25 bp, Rattus norvegicus
acgacacattctgctctcggcttgt

SEQ ID NO: 509880 - DNA, 25 bp, Rattus norvegicus
gaggaccggcattgttctcccggga

SEQ ID NO: 509881 - DNA, 25 bp, Rattus norvegicus
ttcccttgaacacagcgtcttgctt

SEQ ID NO: 509882 - DNA, 25 bp, Rattus norvegicus
gctctaggcctaaaggaggaaccca

SEQ ID NO: 509883 - DNA, 25 bp, Rattus norvegicus
aggtacccgtaccagcttggctgtc

SEQ ID NO: 509884 - DNA, 25 bp, Rattus norvegicus
gtacacaccgagacccgaccgagtg

SEQ ID NO: 509885 - DNA, 25 bp, Rattus norvegicus
ggccgaagagggaaacaggtacaca

SEQ ID NO: 509886 - DNA, 25 bp, Rattus norvegicus
gcaatgaccgccctccgggagagaa

SEQ ID NO: 509887 - DNA, 25 bp, Rattus norvegicus
ggctcggagcccaaagtggatcctc

SEQ ID NO: 509888 - DNA, 25 bp, Rattus norvegicus
gctcgactccgcttgcgcgcaagaa

SEQ ID NO: 509889 - DNA, 25 bp, Rattus norvegicus
tagccgccaactcgcagactctggg

SEQ ID NO: 509890 - DNA, 25 bp, Rattus norvegicus
tgctcctaggatctcaaagtgctcg

SEQ ID NO: 509891 - DNA, 25 bp, Rattus norvegicus
gcgggacaaccaacaagcttcaaaa

SEQ ID NO: 509892 - DNA, 25 bp, Rattus norvegicus
gaagtgcgtctacatcgaaagggcc

SEQ ID NO: 509893 - DNA, 25 bp, Rattus norvegicus
cttcaaaaatatcccagagagcgcg

SEQ ID NO: 509894 - DNA, 25 bp, Rattus norvegicus
cggactattgactgcttacgaaaac

SEQ ID NO: 509895 - DNA, 25 bp, Rattus norvegicus
ccgagtttccctacctcagctggta

SEQ ID NO: 509896 - DNA, 25 bp, Rattus norvegicus
cgcctcctaggaaccggaagcatta

SEQ ID NO: 509897 - DNA, 25 bp, Rattus norvegicus
ggaagcattaccactagccactgga

SEQ ID NO: 509898 - DNA, 25 bp, Rattus norvegicus
cactggacggccatttataaggggc

SEQ ID NO: 509899 - DNA, 25 bp, Rattus norvegicus
gcggggcctcagtgaaaactatagc

SEQ ID NO: 509900 - DNA, 25 bp, Rattus norvegicus
gtttccggcaagaggaccagagtga

SEQ ID NO: 509901 - DNA, 25 bp, Rattus norvegicus
gtgagtgtttacaccggcggcttgc

SEQ ID NO: 509902 - DNA, 25 bp, Rattus norvegicus
agcgcgggaatcatcggactattga

SEQ ID NO: 509903 - DNA, 25 bp, Rattus norvegicus
agtgctcgaacacacgcctcctagg

SEQ ID NO: 509904 - DNA, 25 bp, Rattus norvegicus
cggcaatgcacgtgaccatcttgtc

SEQ ID NO: 509905 - DNA, 25 bp, Rattus norvegicus
gcattgcaccgccttggcagtcgct

SEQ ID NO: 509906 - DNA, 25 bp, Rattus norvegicus
tacctcgcagggaccgcacgagagc

SEQ ID NO: 509907 - DNA, 25 bp, Rattus norvegicus
agccgcctgggatcgctccaagcaa

SEQ ID NO: 509908 - DNA, 25 bp, Rattus norvegicus
tccaagcaacacagggcgcacgagc

SEQ ID NO: 509909 - DNA, 25 bp, Rattus norvegicus
cttgagcgcgcagggacaacaacgt

SEQ ID NO: 509910 - DNA, 25 bp, Rattus norvegicus
cgtgccgggaacaaagctagctctc

SEQ ID NO: 509911 - DNA, 25 bp, Rattus norvegicus
ctcggctacgggaaccgagctcttc

SEQ ID NO: 509912 - DNA, 25 bp, Rattus norvegicus
cggtgggctccttcagcaagaagtc

SEQ ID NO: 509913 - DNA, 25 bp, Rattus norvegicus
gaagtccgagaacacgtactccgtg

SEQ ID NO: 509914 - DNA, 25 bp, Rattus norvegicus
agcagaggcagacccacggcaatgc

SEQ ID NO: 509915 - DNA, 25 bp, Rattus norvegicus
ggcctcaccgatggagatctcctga

SEQ ID NO: 509916 - DNA, 25 bp, Rattus norvegicus
atctcctgagcgaaggccagcgaga

SEQ ID NO: 509917 - DNA, 25 bp, Rattus norvegicus
cgagctcttccggaacctacgcggg

SEQ ID NO: 509918 - DNA, 25 bp, Rattus norvegicus
agcacctgggcgctgtctctgtaat

SEQ ID NO: 509919 - DNA, 25 bp, Rattus norvegicus
ctgcctcgctgaggctctttggctc

SEQ ID NO: 509920 - DNA, 25 bp, Rattus norvegicus
gtctactatacaggacccttctttc

SEQ ID NO: 509921 - DNA, 25 bp, Rattus norvegicus
gctccaagtccaacggcagctctga

SEQ ID NO: 509922 - DNA, 25 bp, Rattus norvegicus
cgtgtgcgcagctctgcgggtctca

SEQ ID NO: 509923 - DNA, 25 bp, Rattus norvegicus
ccacgggcaaagctagaaaaggctg

SEQ ID NO: 509924 - DNA, 25 bp, Rattus norvegicus
tggggtcaggcgcttgactccgcct

SEQ ID NO: 509925 - DNA, 25 bp, Rattus norvegicus
tgactccgcctcctggcgctaggtt

SEQ ID NO: 509926 - DNA, 25 bp, Rattus norvegicus
ttcttctggcaggtcgccgcacaag

SEQ ID NO: 509927 - DNA, 25 bp, Rattus norvegicus
ctcagtctcggctgcttgccgctgt

SEQ ID NO: 509928 - DNA, 25 bp, Rattus norvegicus
cgtatctccgccgtctggaaaggta

SEQ ID NO: 509929 - DNA, 25 bp, Rattus norvegicus
ccgccacggggtctactatacagga

SEQ ID NO: 509930 - DNA, 25 bp, Rattus norvegicus
tgagtgtacgtactgtcacgccgga

SEQ ID NO: 509931 - DNA, 25 bp, Rattus norvegicus
gcccagctaagtggcgctccaagtc

SEQ ID NO: 509932 - DNA, 25 bp, Rattus norvegicus
gccacacatgagctgttcacactcg

SEQ ID NO: 509933 - DNA, 25 bp, Rattus norvegicus
tactgtcgaggaattcgcgcactga

SEQ ID NO: 509934 - DNA, 25 bp, Rattus norvegicus
cgcgcactgagttgtcgcggagctc

SEQ ID NO: 509935 - DNA, 25 bp, Rattus norvegicus
cgggcctcgtgtttgaggtaccact

SEQ ID NO: 509936 - DNA, 25 bp, Rattus norvegicus
tgcatcaaagcacttgccacacatg

SEQ ID NO: 509937 - DNA, 25 bp, Rattus norvegicus
gttcacactcgaaacaccagaagtc

SEQ ID NO: 509938 - DNA, 25 bp, Rattus norvegicus
agaagtcagccaactctttgcagcg

SEQ ID NO: 509939 - DNA, 25 bp, Rattus norvegicus
tctttgcagcgagtgcacgcagcct

SEQ ID NO: 509940 - DNA, 25 bp, Rattus norvegicus
ggcgcctccaggcatccggagcata

SEQ ID NO: 509941 - DNA, 25 bp, Rattus norvegicus
cgccgctgcaggctctcgaagaaca

SEQ ID NO: 509942 - DNA, 25 bp, Rattus norvegicus
cgaagaacacgttatccagggcctc

SEQ ID NO: 509943 - DNA, 25 bp, Rattus norvegicus
ccagggcctccgcattagcattggc

SEQ ID NO: 509944 - DNA, 25 bp, Rattus norvegicus
tgcgcatccacaatctgccggaaca

SEQ ID NO: 509945 - DNA, 25 bp, Rattus norvegicus
aggtaccactggtgtgcatcaaagc

SEQ ID NO: 509946 - DNA, 25 bp, Rattus norvegicus
ttctgggttcgcagaagggttgctt

SEQ ID NO: 509947 - DNA, 25 bp, Rattus norvegicus
aagctctgggcgtgtcccagttaga

SEQ ID NO: 509948 - DNA, 25 bp, Rattus norvegicus
ggatcccgcctgattcctgatccta

SEQ ID NO: 509949 - DNA, 25 bp, Rattus norvegicus
ttcctgatcctacgcagccactgtt

SEQ ID NO: 509950 - DNA, 25 bp, Rattus norvegicus
tacgcagccactgttgtggtggtgc

SEQ ID NO: 509951 - DNA, 25 bp, Rattus norvegicus
agggcaggctcccagtggaagctct

SEQ ID NO: 509952 - DNA, 25 bp, Rattus norvegicus
ggcgtgtcccagttagaagtcatgc

SEQ ID NO: 509953 - DNA, 25 bp, Rattus norvegicus
agtcatgcttggcaggtcgggctac

SEQ ID NO: 509954 - DNA, 25 bp, Rattus norvegicus
cgggctaccgggcactgcccttagg

SEQ ID NO: 509955 - DNA, 25 bp, Rattus norvegicus
ctgcccttaggggattttgatcgtt

SEQ ID NO: 509956 - DNA, 25 bp, Rattus norvegicus
gggattttgatcgtttccagcaatc

SEQ ID NO: 509957 - DNA, 25 bp, Rattus norvegicus
agcttcggctttctgggttcgcaga

SEQ ID NO: 509958 - DNA, 25 bp, Rattus norvegicus
gcgggcatggatcccgcctgattcc

SEQ ID NO: 509959 - DNA, 25 bp, Rattus norvegicus
ttccagcaatcgagcttcggctttc

SEQ ID NO: 509960 - DNA, 25 bp, Rattus norvegicus
tgcaccaggacgcacaggcaggctc

SEQ ID NO: 509961 - DNA, 25 bp, Rattus norvegicus
atcagggtaggcctgctcgaatccc

SEQ ID NO: 509962 - DNA, 25 bp, Rattus norvegicus
tcgaatcccggggtgccttcattgt

SEQ ID NO: 509963 - DNA, 25 bp, Rattus norvegicus
cttcattgtacaggctatgcgagta

SEQ ID NO: 509964 - DNA, 25 bp, Rattus norvegicus
tatgcgagtaacgacggtcaaggcc

SEQ ID NO: 509965 - DNA, 25 bp, Rattus norvegicus
cgcggtagtacacgtagccctgttc

SEQ ID NO: 509966 - DNA, 25 bp, Rattus norvegicus
agccctgttcataggtccgcgacgc

SEQ ID NO: 509967 - DNA, 25 bp, Rattus norvegicus
cgacgcggggtcatagttctcatat

SEQ ID NO: 509968 - DNA, 25 bp, Rattus norvegicus
ctcatattggttcacgaagggcgcc

SEQ ID NO: 509969 - DNA, 25 bp, Rattus norvegicus
ctccagttgtctggcacctggccga

SEQ ID NO: 509970 - DNA, 25 bp, Rattus norvegicus
gcctgccagtagcaccctggagcta

SEQ ID NO: 509971 - DNA, 25 bp, Rattus norvegicus
ggcacgtactcagagcccgaattga

SEQ ID NO: 509972 - DNA, 25 bp, Rattus norvegicus
tgttctcccactggatcagctgccg

SEQ ID NO: 509973 - DNA, 25 bp, Rattus norvegicus
gagcaagctgtacacctgcccgttg

SEQ ID NO: 509974 - DNA, 25 bp, Rattus norvegicus
cctgccctgtgctaggagggcggat

SEQ ID NO: 509975 - DNA, 25 bp, Rattus norvegicus
tgcgttcctgccctgtgctaggagg

SEQ ID NO: 509976 - DNA, 25 bp, Rattus norvegicus
gcggatgtgcgttcctgccctgtgc

SEQ ID NO: 509977 - DNA, 25 bp, Rattus norvegicus
gtgcgttcctgccctgtgctaggag

SEQ ID NO: 509978 - DNA, 25 bp, Rattus norvegicus
aggagggcggatgtgcgttcctgcc

SEQ ID NO: 509979 - DNA, 25 bp, Rattus norvegicus
tgccctgtgctaggagggcggatgt

SEQ ID NO: 509980 - DNA, 25 bp, Rattus norvegicus
cgttcctgccctgtgctaggagggc

SEQ ID NO: 509981 - DNA, 25 bp, Rattus norvegicus
gggcggatgtgcgttcctgccctgt

SEQ ID NO: 509982 - DNA, 25 bp, Rattus norvegicus
ccctgtgctaggagggcggatgtgc

SEQ ID NO: 509983 - DNA, 25 bp, Rattus norvegicus
gagggcggatgtgcgttcctgccct

SEQ ID NO: 509984 - DNA, 25 bp, Rattus norvegicus
ggagggcggatgtgcgttcctgccc

SEQ ID NO: 509985 - DNA, 25 bp, Rattus norvegicus
gcgttcctgccctgtgctaggaggg

SEQ ID NO: 509986 - DNA, 25 bp, Rattus norvegicus
ctgccctgtgctaggagggcggatg

SEQ ID NO: 509987 - DNA, 25 bp, Rattus norvegicus
gttcctgccctgtgctaggagggcg

SEQ ID NO: 509988 - DNA, 25 bp, Rattus norvegicus
gccaccgtcggtagagcagccgcga

SEQ ID NO: 509989 - DNA, 25 bp, Rattus norvegicus
ccgtggatcagggtgccggtgccct

SEQ ID NO: 509990 - DNA, 25 bp, Rattus norvegicus
tgccctgcgggtaagggcctccgag

SEQ ID NO: 509991 - DNA, 25 bp, Rattus norvegicus
gagttcccagctccctgcaccagga

SEQ ID NO: 509992 - DNA, 25 bp, Rattus norvegicus
caggagcctgagcgcgtgcgatcca

SEQ ID NO: 509993 - DNA, 25 bp, Rattus norvegicus
gatccaggcgcggccgcacacaaag

SEQ ID NO: 509994 - DNA, 25 bp, Rattus norvegicus
gccctagagccctagcggtgaccgt

SEQ ID NO: 509995 - DNA, 25 bp, Rattus norvegicus
cggggcgcagcacaatcgccgccac

SEQ ID NO: 509996 - DNA, 25 bp, Rattus norvegicus
gaggcctgagttcgcctgctgggca

SEQ ID NO: 509997 - DNA, 25 bp, Rattus norvegicus
gacggccggaggaagctgaaggcca

SEQ ID NO: 509998 - DNA, 25 bp, Rattus norvegicus
cccagaggctggattggcctggcgg

SEQ ID NO: 509999 - DNA, 25 bp, Rattus norvegicus
agatcccagggtgaggcctgagttc

SEQ ID NO: 510000 - DNA, 25 bp, Rattus norvegicus
gccacgcaagcactcaccgcgccgc

SEQ ID NO: 510001 - DNA, 25 bp, Rattus norvegicus
agccctagcggtgaccgtggatcag

SEQ ID NO: 510002 - DNA, 25 bp, Rattus norvegicus
caggcgctgctcagaacggtaagcc

SEQ ID NO: 510003 - DNA, 25 bp, Rattus norvegicus
ggagacaggcgttcgagttcgagct

SEQ ID NO: 510004 - DNA, 25 bp, Rattus norvegicus
cccggggctctgtagacaggtccgc

SEQ ID NO: 510005 - DNA, 25 bp, Rattus norvegicus
cgctgctcagaacggtaagccgagg

SEQ ID NO: 510006 - DNA, 25 bp, Rattus norvegicus
gccctctcgctcttgctggtctctg

SEQ ID NO: 510007 - DNA, 25 bp, Rattus norvegicus
agacttcgggcgagggcctcttctc

SEQ ID NO: 510008 - DNA, 25 bp, Rattus norvegicus
gagaacccggctccgctggcgctga

SEQ ID NO: 510009 - DNA, 25 bp, Rattus norvegicus
ctaggccaatcagtctctgcagggg

SEQ ID NO: 510010 - DNA, 25 bp, Rattus norvegicus
ctttcgctaggccaatcagtctctg

SEQ ID NO: 510011 - DNA, 25 bp, Rattus norvegicus
tgcacgtgacctccctttcgctagg

SEQ ID NO: 510012 - DNA, 25 bp, Rattus norvegicus
agaagcgccctttgcacgtgacctc

SEQ ID NO: 510013 - DNA, 25 bp, Rattus norvegicus
gcgagggcctcttctcgcgagcctt

SEQ ID NO: 510014 - DNA, 25 bp, Rattus norvegicus
catcacgtggccagaagcgcccttt

SEQ ID NO: 510015 - DNA, 25 bp, Rattus norvegicus
tgtcggagagagaacccggctccgc

SEQ ID NO: 510016 - DNA, 25 bp, Rattus norvegicus
tgaggcagcgaaggacgagtcctcc

SEQ ID NO: 510017 - DNA, 25 bp, Rattus norvegicus
gtccctggcaccatggacaagctgc

SEQ ID NO: 510018 - DNA, 25 bp, Rattus norvegicus
gctctacagccttccgcagcaggtg

SEQ ID NO: 510019 - DNA, 25 bp, Rattus norvegicus
gtccatgcgcaagcggctctacagc

SEQ ID NO: 510020 - DNA, 25 bp, Rattus norvegicus
ctcagctcgaggaggcaaagcgaga

SEQ ID NO: 510021 - DNA, 25 bp, Rattus norvegicus
cttcatgaatattccggggcgcggg

SEQ ID NO: 510022 - DNA, 25 bp, Rattus norvegicus
agctgcggcggcttcatgaatattc

SEQ ID NO: 510023 - DNA, 25 bp, Rattus norvegicus
aaggcgctcctatggcaacccgcga

SEQ ID NO: 510024 - DNA, 25 bp, Rattus norvegicus
ctgcagaaggcgctcctatggcaac

SEQ ID NO: 510025 - DNA, 25 bp, Rattus norvegicus
aggacccaagccgaaggagcattcg

SEQ ID NO: 510026 - DNA, 25 bp, Rattus norvegicus
acaagcacaggagtaaggacgcctc

SEQ ID NO: 510027 - DNA, 25 bp, Rattus norvegicus
tacctcagtcccaaaggtctggcga

SEQ ID NO: 510028 - DNA, 25 bp, Rattus norvegicus
caaaggtctggcgaggttccgccct

SEQ ID NO: 510029 - DNA, 25 bp, Rattus norvegicus
cagcaggaatcattacaagcacagg

SEQ ID NO: 510030 - DNA, 25 bp, Rattus norvegicus
ctctccagcaatgggagccgaggcg

SEQ ID NO: 510031 - DNA, 25 bp, Rattus norvegicus
agaactggaccccagagctccgggc

SEQ ID NO: 510032 - DNA, 25 bp, Rattus norvegicus
tgcccgctccgctttcagccacgcg

SEQ ID NO: 510033 - DNA, 25 bp, Rattus norvegicus
tttcagccacgcgagaccctttttc

SEQ ID NO: 510034 - DNA, 25 bp, Rattus norvegicus
ttcagccacgcgagaccctttttct

SEQ ID NO: 510035 - DNA, 25 bp, Rattus norvegicus
ccctttttctctccagcaatgggag

SEQ ID NO: 510036 - DNA, 25 bp, Rattus norvegicus
ttctctccagcaatgggagccgagg

SEQ ID NO: 510037 - DNA, 25 bp, Rattus norvegicus
gttcccctctggatcctaaacaaca

SEQ ID NO: 510038 - DNA, 25 bp, Rattus norvegicus
gaagttcctgcacgttcccctctgg

SEQ ID NO: 510039 - DNA, 25 bp, Rattus norvegicus
ggcggagaagttcctgcacgttccc

SEQ ID NO: 510040 - DNA, 25 bp, Rattus norvegicus
gaggcggagaagttcctgcacgttc

SEQ ID NO: 510041 - DNA, 25 bp, Rattus norvegicus
ttttctctccagcaatgggagccga

SEQ ID NO: 510042 - DNA, 25 bp, Rattus norvegicus
gtacaaagcgcagaactggacccca

SEQ ID NO: 510043 - DNA, 25 bp, Rattus norvegicus
agccgaggcggagaagttcctgcac

SEQ ID NO: 510044 - DNA, 25 bp, Rattus norvegicus
cggcttcaaagggtacggagacctg

SEQ ID NO: 510045 - DNA, 25 bp, Rattus norvegicus
gcggggagtccactccatcgcgtgc

SEQ ID NO: 510046 - DNA, 25 bp, Rattus norvegicus
ctcagacaaaggtgcggggagtcca

SEQ ID NO: 510047 - DNA, 25 bp, Rattus norvegicus
ccgcctggactgtggtgtcccgcgt

SEQ ID NO: 510048 - DNA, 25 bp, Rattus norvegicus
tgtgctcgccaaaaacaatagaggg

SEQ ID NO: 510049 - DNA, 25 bp, Rattus norvegicus
ggtcggcgcacggatttatgtgctc

SEQ ID NO: 510050 - DNA, 25 bp, Rattus norvegicus
ccgggcctctatatagggcctcaga

SEQ ID NO: 510051 - DNA, 25 bp, Rattus norvegicus
agctgctcacggaggccgcgagcct

SEQ ID NO: 510052 - DNA, 25 bp, Rattus norvegicus
agacctgaggcagagtcgctcggac

SEQ ID NO: 510053 - DNA, 25 bp, Rattus norvegicus
atcgcgtgcccaggccaagatccaa

SEQ ID NO: 510054 - DNA, 25 bp, Rattus norvegicus
cgctcctaacccgagggagagattt

SEQ ID NO: 510055 - DNA, 25 bp, Rattus norvegicus
aatcccggcggtcgcttcgcgggca

SEQ ID NO: 510056 - DNA, 25 bp, Rattus norvegicus
gcctcagaggaaaccgaatggcctc

SEQ ID NO: 510057 - DNA, 25 bp, Rattus norvegicus
agagtcgctcggacgcctgagctgc

SEQ ID NO: 510058 - DNA, 25 bp, Rattus norvegicus
cctcttggcggaaagtgtcggacgt

SEQ ID NO: 510059 - DNA, 25 bp, Rattus norvegicus
ctccagtgcggcagtgtgtccacat

SEQ ID NO: 510060 - DNA, 25 bp, Rattus norvegicus
ggatctcgtagtctccagtgcggca

SEQ ID NO: 510061 - DNA, 25 bp, Rattus norvegicus
gcgcgagccgagaaaggatctcgta

SEQ ID NO: 510062 - DNA, 25 bp, Rattus norvegicus
ctacgctcgctctggagctcgctga

SEQ ID NO: 510063 - DNA, 25 bp, Rattus norvegicus
gagctgccgggcacagcgctacgct

SEQ ID NO: 510064 - DNA, 25 bp, Rattus norvegicus
ggatagtcagcatatttactctcga

SEQ ID NO: 510065 - DNA, 25 bp, Rattus norvegicus
tccacatggcgctgtggcgcggctc

SEQ ID NO: 510066 - DNA, 25 bp, Rattus norvegicus
ttcgtcatcgctgcagggatagtca

SEQ ID NO: 510067 - DNA, 25 bp, Rattus norvegicus
tgtcggacgtgtgagacgaaccttt

SEQ ID NO: 510068 - DNA, 25 bp, Rattus norvegicus
ggttgccctcttggcggaaagtgtc

SEQ ID NO: 510069 - DNA, 25 bp, Rattus norvegicus
gaacctttttcgtcatcgctgcagg

SEQ ID NO: 510070 - DNA, 25 bp, Rattus norvegicus
ttgggatgccctcatcgtgcagccc

SEQ ID NO: 510071 - DNA, 25 bp, Rattus norvegicus
acgttccgcgcgtgtacgtcagcac

SEQ ID NO: 510072 - DNA, 25 bp, Rattus norvegicus
gtcagtcaagtttgactgtcttctc

SEQ ID NO: 510073 - DNA, 25 bp, Rattus norvegicus
cagaagggcaacaccctcaggggtc

SEQ ID NO: 510074 - DNA, 25 bp, Rattus norvegicus
cgcggcaccgacaccgcccgcacgc

SEQ ID NO: 510075 - DNA, 25 bp, Rattus norvegicus
gagggactcacacagaccctagagg

SEQ ID NO: 510076 - DNA, 25 bp, Rattus norvegicus
ggactcacacagaccctagaggacg

SEQ ID NO: 510077 - DNA, 25 bp, Rattus norvegicus
tcacacagaccctagaggacggacg

SEQ ID NO: 510078 - DNA, 25 bp, Rattus norvegicus
acagaccctagaggacggacggagc

SEQ ID NO: 510079 - DNA, 25 bp, Rattus norvegicus
gagcgagctccggtcctctcggtct

SEQ ID NO: 510080 - DNA, 25 bp, Rattus norvegicus
ggtcctctcggtctctccgttaatg

SEQ ID NO: 510081 - DNA, 25 bp, Rattus norvegicus
gaccacccggctggcgatccaaggg

SEQ ID NO: 510082 - DNA, 25 bp, Rattus norvegicus
ctctagtcagtcaagtttgactgtc

SEQ ID NO: 510083 - DNA, 25 bp, Rattus norvegicus
gggaccacccggctggcgatccaag

SEQ ID NO: 510084 - DNA, 25 bp, Rattus norvegicus
cgctgagtatgagggagagcgggca

SEQ ID NO: 510085 - DNA, 25 bp, Rattus norvegicus
tcggtctctccgttaatggtccttc

SEQ ID NO: 510086 - DNA, 25 bp, Rattus norvegicus
taaggaattaagctgccgagtggaa

SEQ ID NO: 510087 - DNA, 25 bp, Rattus norvegicus
aagcttctcctcagccatcttggct

SEQ ID NO: 510088 - DNA, 25 bp, Rattus norvegicus
aagcgctgcataggttcgcattcgc

SEQ ID NO: 510089 - DNA, 25 bp, Rattus norvegicus
tcgcattcgccaaaacgccaggcgg

SEQ ID NO: 510090 - DNA, 25 bp, Rattus norvegicus
tcccgcagggactactcggcgtacg

SEQ ID NO: 510091 - DNA, 25 bp, Rattus norvegicus
ccacagggactcagctcggaaggaa

SEQ ID NO: 510092 - DNA, 25 bp, Rattus norvegicus
tcggagaatctcctggctcaccatc

SEQ ID NO: 510093 - DNA, 25 bp, Rattus norvegicus
gctctgcaccgggttggacgaactg

SEQ ID NO: 510094 - DNA, 25 bp, Rattus norvegicus
accgtttcccggacgaccagctgag

SEQ ID NO: 510095 - DNA, 25 bp, Rattus norvegicus
aggaacctgagccagtaaggaatta

SEQ ID NO: 510096 - DNA, 25 bp, Rattus norvegicus
gtgagttccaggagtctcggccaca

SEQ ID NO: 510097 - DNA, 25 bp, Rattus norvegicus
agggaactcgcagccggagattaga

SEQ ID NO: 510098 - DNA, 25 bp, Rattus norvegicus
gccggagattagacagctctgcacc

SEQ ID NO: 510099 - DNA, 25 bp, Rattus norvegicus
aggcagccacgacgcctcggagaat

SEQ ID NO: 510100 - DNA, 25 bp, Rattus norvegicus
caaggctcaaatttgggtcccagta

SEQ ID NO: 510101 - DNA, 25 bp, Rattus norvegicus
tgtatttgtattgagaccctgtttc

SEQ ID NO: 510102 - DNA, 25 bp, Rattus norvegicus
ggatggatggatgcaaacaaacaag

SEQ ID NO: 510103 - DNA, 25 bp, Rattus norvegicus
aacaaggctcaaatttgggtcccag

SEQ ID NO: 510104 - DNA, 25 bp, Rattus norvegicus
aggctcaaatttgggtcccagtatc

SEQ ID NO: 510105 - DNA, 25 bp, Rattus norvegicus
acggagacaatgcctcccgtcagca

SEQ ID NO: 510106 - DNA, 25 bp, Rattus norvegicus
gcaccccccacggagacaatgcctc

SEQ ID NO: 510107 - DNA, 25 bp, Rattus norvegicus
cccacggagacaatgcctcccgtca

SEQ ID NO: 510108 - DNA, 25 bp, Rattus norvegicus
cacggagacaatgcctcccgtcagc

SEQ ID NO: 510109 - DNA, 25 bp, Rattus norvegicus
ggagacaatgcctcccgtcagcacc

SEQ ID NO: 510110 - DNA, 25 bp, Rattus norvegicus
gtcagcaccccccacggagacaatg

SEQ ID NO: 510111 - DNA, 25 bp, Rattus norvegicus
gagacaatgcctcccgtcagcaccc

SEQ ID NO: 510112 - DNA, 25 bp, Rattus norvegicus
gatggatggatgcaaacaaacaagg

SEQ ID NO: 510113 - DNA, 25 bp, Rattus norvegicus
cggagacaatgcctcccgtcagcac

SEQ ID NO: 510114 - DNA, 25 bp, Rattus norvegicus
ccctgcgtagtaattgaggagaccc

SEQ ID NO: 510115 - DNA, 25 bp, Rattus norvegicus
cccggatacattccaccatgtgctg

SEQ ID NO: 510116 - DNA, 25 bp, Rattus norvegicus
ccgtgagcacctcgtagcggtaatc

SEQ ID NO: 510117 - DNA, 25 bp, Rattus norvegicus
cacctcgccgagatccaggttatca

SEQ ID NO: 510118 - DNA, 25 bp, Rattus norvegicus
ccaggttatcatcgtccggctcatc

SEQ ID NO: 510119 - DNA, 25 bp, Rattus norvegicus
ctcgtcctcgtcgaactcgtagttg

SEQ ID NO: 510120 - DNA, 25 bp, Rattus norvegicus
aactcgtagttgtagccctcgtccg

SEQ ID NO: 510121 - DNA, 25 bp, Rattus norvegicus
ggggccgcttactgccggcctcaat

SEQ ID NO: 510122 - DNA, 25 bp, Rattus norvegicus
atcgcgtcggtcctctgtacgtcac

SEQ ID NO: 510123 - DNA, 25 bp, Rattus norvegicus
gatgacctcgttgacctcccggata

SEQ ID NO: 510124 - DNA, 25 bp, Rattus norvegicus
cggtggccagtctagactgagaagc

SEQ ID NO: 510125 - DNA, 25 bp, Rattus norvegicus
actgagaagctgtaggtccttgacg

SEQ ID NO: 510126 - DNA, 25 bp, Rattus norvegicus
gctaccgctactgagccaacaaagg

SEQ ID NO: 510127 - DNA, 25 bp, Rattus norvegicus
ccatgtgctgcaggatctgttcggc

SEQ ID NO: 510128 - DNA, 25 bp, Rattus norvegicus
actgaactgtgggaactctgggcta

SEQ ID NO: 510129 - DNA, 25 bp, Rattus norvegicus
attggccggcatcacgccgggtccg

SEQ ID NO: 510130 - DNA, 25 bp, Rattus norvegicus
tcgttaccatggagtgcgacgcctc

SEQ ID NO: 510131 - DNA, 25 bp, Rattus norvegicus
ttcgggccggcgtcgttaccatgga

SEQ ID NO: 510132 - DNA, 25 bp, Rattus norvegicus
tttctcctgcagagcacctgcagtc

SEQ ID NO: 510133 - DNA, 25 bp, Rattus norvegicus
tccagcgagggctttctcctgcaga

SEQ ID NO: 510134 - DNA, 25 bp, Rattus norvegicus
cagagctggccaatgagcgccgccg

SEQ ID NO: 510135 - DNA, 25 bp, Rattus norvegicus
ggcggcccacgtgaactgaactgtg

SEQ ID NO: 510136 - DNA, 25 bp, Rattus norvegicus
cgccctacctcagtgtccgaaagga

SEQ ID NO: 510137 - DNA, 25 bp, Rattus norvegicus
cgcgacgacgcgcagagctggccaa

SEQ ID NO: 510138 - DNA, 25 bp, Rattus norvegicus
tccgaaaggacgtgatgccgacacg

SEQ ID NO: 510139 - DNA, 25 bp, Rattus norvegicus
tgccgacacggaggcgaagtgccca

SEQ ID NO: 510140 - DNA, 25 bp, Rattus norvegicus
ggacgccacaccctctacgttactc

SEQ ID NO: 510141 - DNA, 25 bp, Rattus norvegicus
ctactccagacccagcggccgccat

SEQ ID NO: 510142 - DNA, 25 bp, Rattus norvegicus
cccaccgggtctggagctttggaat

SEQ ID NO: 510143 - DNA, 25 bp, Rattus norvegicus
aaacgttcgcaaacatcgagcccgc

SEQ ID NO: 510144 - DNA, 25 bp, Rattus norvegicus
tcgacgaggcctttcgacgctaccg

SEQ ID NO: 510145 - DNA, 25 bp, Rattus norvegicus
ttcttccctccgaggaggctgcctt

SEQ ID NO: 510146 - DNA, 25 bp, Rattus norvegicus
ggcctttcgacgctaccgtagcctg

SEQ ID NO: 510147 - DNA, 25 bp, Rattus norvegicus
gctgccttccgtgcgtgggtcagcc

SEQ ID NO: 510148 - DNA, 25 bp, Rattus norvegicus
tccagttccggtaccatgccggttc

SEQ ID NO: 510149 - DNA, 25 bp, Rattus norvegicus
cgttggcttgcttggccacggcgct

SEQ ID NO: 510150 - DNA, 25 bp, Rattus norvegicus
gctgcaggctctgggtttcgctgct

SEQ ID NO: 510151 - DNA, 25 bp, Rattus norvegicus
tcacctgaccgggtcctcacgtggg

SEQ ID NO: 510152 - DNA, 25 bp, Rattus norvegicus
tgaccctccgattgtcacgcgggcg

SEQ ID NO: 510153 - DNA, 25 bp, Rattus norvegicus
tctggagctttggaatcagtcgcca

SEQ ID NO: 510154 - DNA, 25 bp, Rattus norvegicus
atcagtcgccaaacgttcgcaaaca

SEQ ID NO: 510155 - DNA, 25 bp, Rattus norvegicus
caagtgagtcactgcccgcttcttc

SEQ ID NO: 510156 - DNA, 25 bp, Rattus norvegicus
agagctggagcgcttgagcccagac

SEQ ID NO: 510157 - DNA, 25 bp, Rattus norvegicus
ccctgctagctgtctgacgtcacta

SEQ ID NO: 510158 - DNA, 25 bp, Rattus norvegicus
acttgcgtagactcgccctgctagc

SEQ ID NO: 510159 - DNA, 25 bp, Rattus norvegicus
ctcattatgcaaatcacttgcgtag

SEQ ID NO: 510160 - DNA, 25 bp, Rattus norvegicus
ggccactgctatctcattatgcaaa

SEQ ID NO: 510161 - DNA, 25 bp, Rattus norvegicus
ctgattggccactgctatctcatta

SEQ ID NO: 510162 - DNA, 25 bp, Rattus norvegicus
gctcaaccaactccctctctgattg

SEQ ID NO: 510163 - DNA, 25 bp, Rattus norvegicus
ccacacacagggcagctgagggtcc

SEQ ID NO: 510164 - DNA, 25 bp, Rattus norvegicus
ccatccactgccacgcccgcacacc

SEQ ID NO: 510165 - DNA, 25 bp, Rattus norvegicus
tgacgaagctacttcccatccactg

SEQ ID NO: 510166 - DNA, 25 bp, Rattus norvegicus
gcgccacgcatgacgaagctacttc

SEQ ID NO: 510167 - DNA, 25 bp, Rattus norvegicus
ctgtctgacgtcactaagctcgggg

SEQ ID NO: 510168 - DNA, 25 bp, Rattus norvegicus
tccgactccagcagacagcgccacg

SEQ ID NO: 510169 - DNA, 25 bp, Rattus norvegicus
gacagcgccacgcatgacgaagcta

SEQ ID NO: 510170 - DNA, 25 bp, Rattus norvegicus
tcaccggcctccacaaaggtgcgcg

SEQ ID NO: 510171 - DNA, 25 bp, Rattus norvegicus
ccgctgtgcccatgaaggaccacga

SEQ ID NO: 510172 - DNA, 25 bp, Rattus norvegicus
cggcccgcgcttggctttcagcacc

SEQ ID NO: 510173 - DNA, 25 bp, Rattus norvegicus
catgagcgggctgaacccaggtccc

SEQ ID NO: 510174 - DNA, 25 bp, Rattus norvegicus
gggctgaacccaggtcccgctgtgc

SEQ ID NO: 510175 - DNA, 25 bp, Rattus norvegicus
aggtcccgctgtgcccatgaaggac

SEQ ID NO: 510176 - DNA, 25 bp, Rattus norvegicus
tgcccatgaaggaccacgacgccat

SEQ ID NO: 510177 - DNA, 25 bp, Rattus norvegicus
ggggcttggacgagcaggacctcaa

SEQ ID NO: 510178 - DNA, 25 bp, Rattus norvegicus
cctcaagccgctgttcgaggagttc

SEQ ID NO: 510179 - DNA, 25 bp, Rattus norvegicus
ctgttcgaggagttcggccgcatct

SEQ ID NO: 510180 - DNA, 25 bp, Rattus norvegicus
cgcatctacgagctgacggtactga

SEQ ID NO: 510181 - DNA, 25 bp, Rattus norvegicus
tacgagctgacggtactgaaggacc

SEQ ID NO: 510182 - DNA, 25 bp, Rattus norvegicus
ggtactgaaggaccggctcaccggc

SEQ ID NO: 510183 - DNA, 25 bp, Rattus norvegicus
ctgacggtactgaaggaccggctca

SEQ ID NO: 510184 - DNA, 25 bp, Rattus norvegicus
aggtgtcctcgctagcatcttggtc

SEQ ID NO: 510185 - DNA, 25 bp, Rattus norvegicus
gtgacttcgtccgagcatgcgtaga

SEQ ID NO: 510186 - DNA, 25 bp, Rattus norvegicus
acacctggagaagaggcctcaggca

SEQ ID NO: 510187 - DNA, 25 bp, Rattus norvegicus
catcttggtcttcttcctctgcggg

SEQ ID NO: 510188 - DNA, 25 bp, Rattus norvegicus
aggcactgccctgcatgcgcaggtg

SEQ ID NO: 510189 - DNA, 25 bp, Rattus norvegicus
cgatgagcggcaaacggcttcttaa

SEQ ID NO: 510190 - DNA, 25 bp, Rattus norvegicus
acaaggtccgccctgcctgagggac

SEQ ID NO: 510191 - DNA, 25 bp, Rattus norvegicus
catgcgtagagtggcccagcgtgcc

SEQ ID NO: 510192 - DNA, 25 bp, Rattus norvegicus
aggacacctgatctcagtgacttcg

SEQ ID NO: 510193 - DNA, 25 bp, Rattus norvegicus
gctcacaccgcggttggtcggaaga

SEQ ID NO: 510194 - DNA, 25 bp, Rattus norvegicus
gggacacgcccaggtgcagctcaca

SEQ ID NO: 510195 - DNA, 25 bp, Rattus norvegicus
tcaacaacggatcactgcgcacgcg

SEQ ID NO: 510196 - DNA, 25 bp, Rattus norvegicus
tccgggacacaaggcgcatgcgcca

SEQ ID NO: 510197 - DNA, 25 bp, Rattus norvegicus
ccgtgagtactctctaggctggcga

SEQ ID NO: 510198 - DNA, 25 bp, Rattus norvegicus
gcagcagtgataaccttgaggccca

SEQ ID NO: 510199 - DNA, 25 bp, Rattus norvegicus
taccctgcgactctctcagaaggtg

SEQ ID NO: 510200 - DNA, 25 bp, Rattus norvegicus
accctgcgactctctcagaaggtgc

SEQ ID NO: 510201 - DNA, 25 bp, Rattus norvegicus
ccctgcgactctctcagaaggtgcg

SEQ ID NO: 510202 - DNA, 25 bp, Rattus norvegicus
cagaaggtgcgggtgcctgttgaga

SEQ ID NO: 510203 - DNA, 25 bp, Rattus norvegicus
ctgctgcccggattgggcgaggggc

SEQ ID NO: 510204 - DNA, 25 bp, Rattus norvegicus
ctgcggagggattgcggcggcccgc

SEQ ID NO: 510205 - DNA, 25 bp, Rattus norvegicus
ggcggcccgcagcagtgataacctt

SEQ ID NO: 510206 - DNA, 25 bp, Rattus norvegicus
cggcccgcagcagtgataaccttga

SEQ ID NO: 510207 - DNA, 25 bp, Rattus norvegicus
ggcccgcagcagtgataaccttgag

SEQ ID NO: 510208 - DNA, 25 bp, Rattus norvegicus
cccgcagcagtgataaccttgaggc

SEQ ID NO: 510209 - DNA, 25 bp, Rattus norvegicus
cgcagcagtgataaccttgaggccc

SEQ ID NO: 510210 - DNA, 25 bp, Rattus norvegicus
agcagtgataaccttgaggcccagt

SEQ ID NO: 510211 - DNA, 25 bp, Rattus norvegicus
ctaccctgcgactctctcagaaggt

SEQ ID NO: 510212 - DNA, 25 bp, Rattus norvegicus
aacaggatctgaagtacgcccgagg

SEQ ID NO: 510213 - DNA, 25 bp, Rattus norvegicus
accttgaggcccagtctgcgcagcc

SEQ ID NO: 510214 - DNA, 25 bp, Rattus norvegicus
aggatctgaagtacgcccgaggtga

SEQ ID NO: 510215 - DNA, 25 bp, Rattus norvegicus
agcagcgacccgtcctaagtcgaca

SEQ ID NO: 510216 - DNA, 25 bp, Rattus norvegicus
gcaacaggatctgaagtacgcccga

SEQ ID NO: 510217 - DNA, 25 bp, Rattus norvegicus
ctttaggtattgcaacaggatctga

SEQ ID NO: 510218 - DNA, 25 bp, Rattus norvegicus
cctctttaggtattgcaacaggatc

SEQ ID NO: 510219 - DNA, 25 bp, Rattus norvegicus
cgtcctctttaggtattgcaacagg

SEQ ID NO: 510220 - DNA, 25 bp, Rattus norvegicus
cgacagacgtcctctttaggtattg

SEQ ID NO: 510221 - DNA, 25 bp, Rattus norvegicus
agtcgacagacgtcctctttaggta

SEQ ID NO: 510222 - DNA, 25 bp, Rattus norvegicus
gtcctaagtcgacagacgtcctctt

SEQ ID NO: 510223 - DNA, 25 bp, Rattus norvegicus
gacccgtcctaagtcgacagacgtc

SEQ ID NO: 510224 - DNA, 25 bp, Rattus norvegicus
cagcgacccgtcctaagtcgacaga

SEQ ID NO: 510225 - DNA, 25 bp, Rattus norvegicus
gacgtcctctttaggtattgcaaca

SEQ ID NO: 510226 - DNA, 25 bp, Rattus norvegicus
cgacgttcatcctcctttcaggtca

SEQ ID NO: 510227 - DNA, 25 bp, Rattus norvegicus
tattgctatcctcgccaccttgttc

SEQ ID NO: 510228 - DNA, 25 bp, Rattus norvegicus
gtgctctccttgtaatctctccttg

SEQ ID NO: 510229 - DNA, 25 bp, Rattus norvegicus
tcttcccgcgcctgggttagcagct

SEQ ID NO: 510230 - DNA, 25 bp, Rattus norvegicus
cctcctttcaggtcagcgtgctctt

SEQ ID NO: 510231 - DNA, 25 bp, Rattus norvegicus
ctgggttagcagctccttgtcgccc

SEQ ID NO: 510232 - DNA, 25 bp, Rattus norvegicus
gtaatctctccttgaaataactccc

SEQ ID NO: 510233 - DNA, 25 bp, Rattus norvegicus
gcccttatcattcggtgctctcctt

SEQ ID NO: 510234 - DNA, 25 bp, Rattus norvegicus
agctctgtgcccttatcattcggtg

SEQ ID NO: 510235 - DNA, 25 bp, Rattus norvegicus
tcgaccttcatcttagctctgtgcc

SEQ ID NO: 510236 - DNA, 25 bp, Rattus norvegicus
ttcactagtactttcgaccttcatc

SEQ ID NO: 510237 - DNA, 25 bp, Rattus norvegicus
gctcatcctcctacattcactagta

SEQ ID NO: 510238 - DNA, 25 bp, Rattus norvegicus
ttgttccaatgctcatcctcctaca

SEQ ID NO: 510239 - DNA, 25 bp, Rattus norvegicus
tttcaggtcagcgtgctcttcccgc

SEQ ID NO: 510240 - DNA, 25 bp, Rattus norvegicus
ggacccaaggcatcccgctggggct

SEQ ID NO: 510241 - DNA, 25 bp, Rattus norvegicus
cagagcagcagagccaaggcttgga

SEQ ID NO: 510242 - DNA, 25 bp, Rattus norvegicus
cccgaggcccatgcaggggcgatac

SEQ ID NO: 510243 - DNA, 25 bp, Rattus norvegicus
catgcaggggcgatacagcccgctg

SEQ ID NO: 510244 - DNA, 25 bp, Rattus norvegicus
tgctcactcatgaggcctccgcggt

SEQ ID NO: 510245 - DNA, 25 bp, Rattus norvegicus
tgctcgcgttctgggtagctaccgc

SEQ ID NO: 510246 - DNA, 25 bp, Rattus norvegicus
agctaccgcccgctgtctgcagagt

SEQ ID NO: 510247 - DNA, 25 bp, Rattus norvegicus
agtaagtgcctgactgggagacctc

SEQ ID NO: 510248 - DNA, 25 bp, Rattus norvegicus
cagtgatgcgcgttagggtcatttc

SEQ ID NO: 510249 - DNA, 25 bp, Rattus norvegicus
ggtcatttcaccgtctctaggctgg

SEQ ID NO: 510250 - DNA, 25 bp, Rattus norvegicus
cccgctgtctgcagagtaagtgcct

SEQ ID NO: 510251 - DNA, 25 bp, Rattus norvegicus
tttcaccgtctctaggctggcgggg

SEQ ID NO: 510252 - DNA, 25 bp, Rattus norvegicus
tgcgcgttagggtcatttcaccgtc

SEQ ID NO: 510253 - DNA, 25 bp, Rattus norvegicus
ccctatggttctgtcgggaggccac

SEQ ID NO: 510254 - DNA, 25 bp, Rattus norvegicus
atgactgccctgagccgtagcgaac

SEQ ID NO: 510255 - DNA, 25 bp, Rattus norvegicus
ctgagccgtagcgaacctgtcgaga

SEQ ID NO: 510256 - DNA, 25 bp, Rattus norvegicus
cgaacctgtcgagacgagccggtaa

SEQ ID NO: 510257 - DNA, 25 bp, Rattus norvegicus
tgggcacttcccaaccgcaagaatt

SEQ ID NO: 510258 - DNA, 25 bp, Rattus norvegicus
ccgcaagaatttcggctcaggtcaa

SEQ ID NO: 510259 - DNA, 25 bp, Rattus norvegicus
ctccgccggactgaggtatgcgagt

SEQ ID NO: 510260 - DNA, 25 bp, Rattus norvegicus
agcactgggtctggcgcacggcctc

SEQ ID NO: 510261 - DNA, 25 bp, Rattus norvegicus
tatgcgagtccggtgcgatgtgtcc

SEQ ID NO: 510262 - DNA, 25 bp, Rattus norvegicus
tccgagggtatagatagtggtttca

SEQ ID NO: 510263 - DNA, 25 bp, Rattus norvegicus
ttcaggtgagcggaaggcacactct

SEQ ID NO: 510264 - DNA, 25 bp, Rattus norvegicus
aggcacactcttgggctcacctcgt

SEQ ID NO: 510265 - DNA, 25 bp, Rattus norvegicus
tgcgatgtgtccgagggtatagata

SEQ ID NO: 510266 - DNA, 25 bp, Rattus norvegicus
ttcggctcaggtcaagccgtgccga

SEQ ID NO: 510267 - DNA, 25 bp, Rattus norvegicus
gtctcggagcgagtagccaataggc

SEQ ID NO: 510268 - DNA, 25 bp, Rattus norvegicus
ctctctcggaccctgaggcggctgg

SEQ ID NO: 510269 - DNA, 25 bp, Rattus norvegicus
ctaaagcctagcgaacgccggaata

SEQ ID NO: 510270 - DNA, 25 bp, Rattus norvegicus
cgctcggctctttggctcccggagg

SEQ ID NO: 510271 - DNA, 25 bp, Rattus norvegicus
gctttctccggcctgaccctggaaa

SEQ ID NO: 510272 - DNA, 25 bp, Rattus norvegicus
aagcgcatgcagcacgctccagcgg

SEQ ID NO: 510273 - DNA, 25 bp, Rattus norvegicus
caggccgggcggagtctctctgaca

SEQ ID NO: 510274 - DNA, 25 bp, Rattus norvegicus
cgttccaacgcgtgctctctgggcg

SEQ ID NO: 510275 - DNA, 25 bp, Rattus norvegicus
gaccgcgatttaggcggccgttcca

SEQ ID NO: 510276 - DNA, 25 bp, Rattus norvegicus
gggcaagagcagagaccgcgattta

SEQ ID NO: 510277 - DNA, 25 bp, Rattus norvegicus
agatacgggtcccacgggcaagagc

SEQ ID NO: 510278 - DNA, 25 bp, Rattus norvegicus
actgcggcggagatacgggtcccac

SEQ ID NO: 510279 - DNA, 25 bp, Rattus norvegicus
gctgtcggaaagtcctggcaggaca

SEQ ID NO: 510280 - DNA, 25 bp, Rattus norvegicus
ctgctcgactgctgctggagagccg

SEQ ID NO: 510281 - DNA, 25 bp, Rattus norvegicus
cggcgcagccagaggtaagacccgc

SEQ ID NO: 510282 - DNA, 25 bp, Rattus norvegicus
tcaccggcccgggtggtgtccgtca

SEQ ID NO: 510283 - DNA, 25 bp, Rattus norvegicus
ccacagttagcaccggagaggtttc

SEQ ID NO: 510284 - DNA, 25 bp, Rattus norvegicus
gggccagagtactccgcagccgcta

SEQ ID NO: 510285 - DNA, 25 bp, Rattus norvegicus
atgcgccacccgatccgctgggtgg

SEQ ID NO: 510286 - DNA, 25 bp, Rattus norvegicus
gccggaatttccgagcgattcaaga

SEQ ID NO: 510287 - DNA, 25 bp, Rattus norvegicus
tccgagcgattcaagaaagatcacc

SEQ ID NO: 510288 - DNA, 25 bp, Rattus norvegicus
tcaagaaagatcacccgtcagttgc

SEQ ID NO: 510289 - DNA, 25 bp, Rattus norvegicus
ctcttccagggctcggtcgaccgag

SEQ ID NO: 510290 - DNA, 25 bp, Rattus norvegicus
cgttaccctaggagcctcgggccag

SEQ ID NO: 510291 - DNA, 25 bp, Rattus norvegicus
tccgtcaggtcgtggttggccgctc

SEQ ID NO: 510292 - DNA, 25 bp, Rattus norvegicus
ggatggacactgacgccggaatttc

SEQ ID NO: 510293 - DNA, 25 bp, Rattus norvegicus
tcggtcgaccgagcggctccaagaa

SEQ ID NO: 510294 - DNA, 25 bp, Rattus norvegicus
caacccagggctcggtccacagtta

SEQ ID NO: 510295 - DNA, 25 bp, Rattus norvegicus
cctagccggcttccgagatgctgct

SEQ ID NO: 510296 - DNA, 25 bp, Rattus norvegicus
tcccggggatatccacacgcaggca

SEQ ID NO: 510297 - DNA, 25 bp, Rattus norvegicus
tgcccgtccgcgcttcgggtcccga

SEQ ID NO: 510298 - DNA, 25 bp, Rattus norvegicus
cgggtcccgaccactgcgtcgtcat

SEQ ID NO: 510299 - DNA, 25 bp, Rattus norvegicus
gaccactgcgtcgtcatccctgggc

SEQ ID NO: 510300 - DNA, 25 bp, Rattus norvegicus
cgtcgtcatccctgggccggccgcg

SEQ ID NO: 510301 - DNA, 25 bp, Rattus norvegicus
ggcgcctttcctcggtaagggctgc

SEQ ID NO: 510302 - DNA, 25 bp, Rattus norvegicus
ctgagcggggtaagcttcggccgac

SEQ ID NO: 510303 - DNA, 25 bp, Rattus norvegicus
cggccgacggccctttttgtgcgct

SEQ ID NO: 510304 - DNA, 25 bp, Rattus norvegicus
gccgacggccctttttgtgcgctca

SEQ ID NO: 510305 - DNA, 25 bp, Rattus norvegicus
acggccctttttgtgcgctcacgct

SEQ ID NO: 510306 - DNA, 25 bp, Rattus norvegicus
ggccctttttgtgcgctcacgcttt

SEQ ID NO: 510307 - DNA, 25 bp, Rattus norvegicus
actcccggggatatccacacgcagg

SEQ ID NO: 510308 - DNA, 25 bp, Rattus norvegicus
cggggatatccacacgcaggcacgc

SEQ ID NO: 510309 - DNA, 25 bp, Rattus norvegicus
agactcccggggatatccacacgca

SEQ ID NO: 510310 - DNA, 25 bp, Rattus norvegicus
tccagagtggccgacttctcagccc

SEQ ID NO: 510311 - DNA, 25 bp, Rattus norvegicus
cccgcgcggcctcccgctgtcacct

SEQ ID NO: 510312 - DNA, 25 bp, Rattus norvegicus
ccgacgtacccacgcgcgccaatct

SEQ ID NO: 510313 - DNA, 25 bp, Rattus norvegicus
caatctgccgcgctgcccggagctc

SEQ ID NO: 510314 - DNA, 25 bp, Rattus norvegicus
ctagagcgcgatccgcgcgccctgc

SEQ ID NO: 510315 - DNA, 25 bp, Rattus norvegicus
agtctgagggcctagagcgcgatcc

SEQ ID NO: 510316 - DNA, 25 bp, Rattus norvegicus
agtgcccagcgcaaggctcaggcgc

SEQ ID NO: 510317 - DNA, 25 bp, Rattus norvegicus
gcgtgcttcccgagcgccgccgcat

SEQ ID NO: 510318 - DNA, 25 bp, Rattus norvegicus
accgtggcgggccaagctttgcgat

SEQ ID NO: 510319 - DNA, 25 bp, Rattus norvegicus
ggctagtccagagtggccgacttct

SEQ ID NO: 510320 - DNA, 25 bp, Rattus norvegicus
ctgggctagtccagagtggccgact

SEQ ID NO: 510321 - DNA, 25 bp, Rattus norvegicus
agctttgcgatctgctcacctgggc

SEQ ID NO: 510322 - DNA, 25 bp, Rattus norvegicus
cgggccaagctttgcgatctgctca

SEQ ID NO: 510323 - DNA, 25 bp, Rattus norvegicus
ccgccgcatggacggccgcccgccc

SEQ ID NO: 510324 - DNA, 25 bp, Rattus norvegicus
agtcgtccctgcgtgagcgctcagg

SEQ ID NO: 510325 - DNA, 25 bp, Rattus norvegicus
gcgagtccagccctaagccagaagc

SEQ ID NO: 510326 - DNA, 25 bp, Rattus norvegicus
gtgcgcgacaactcgccagggcaga

SEQ ID NO: 510327 - DNA, 25 bp, Rattus norvegicus
cgggcacaggtaggctccgtagctc

SEQ ID NO: 510328 - DNA, 25 bp, Rattus norvegicus
agcccggtacctcagtcctggctgg

SEQ ID NO: 510329 - DNA, 25 bp, Rattus norvegicus
tcgccatccaggaggccgaggatgt

SEQ ID NO: 510330 - DNA, 25 bp, Rattus norvegicus
cggtgcagatccgtgtcgccatcca

SEQ ID NO: 510331 - DNA, 25 bp, Rattus norvegicus
agggcccgagaccacggtgcagatc

SEQ ID NO: 510332 - DNA, 25 bp, Rattus norvegicus
aacagactctgccagggcccgagac

SEQ ID NO: 510333 - DNA, 25 bp, Rattus norvegicus
cagctcggcgaacagactctgccag

SEQ ID NO: 510334 - DNA, 25 bp, Rattus norvegicus
cgcgatcgtcgctatcgctggctgc

SEQ ID NO: 510335 - DNA, 25 bp, Rattus norvegicus
ttttaccctgggacaggcctgtgga

SEQ ID NO: 510336 - DNA, 25 bp, Rattus norvegicus
ccagaagccagctgagcggcatctc

SEQ ID NO: 510337 - DNA, 25 bp, Rattus norvegicus
ggcacagggaccctgccagccatgg

SEQ ID NO: 510338 - DNA, 25 bp, Rattus norvegicus
ctcactttggcctttgcggagtacc

SEQ ID NO: 510339 - DNA, 25 bp, Rattus norvegicus
ttgggagagacgttgtgtgtcctcc

SEQ ID NO: 510340 - DNA, 25 bp, Rattus norvegicus
ccgcggctttcaggcgtgccagagt

SEQ ID NO: 510341 - DNA, 25 bp, Rattus norvegicus
ggacccaccattctccgcggctttc

SEQ ID NO: 510342 - DNA, 25 bp, Rattus norvegicus
gcctttgcggagtaccctattccca

SEQ ID NO: 510343 - DNA, 25 bp, Rattus norvegicus
ccgcggccatgaagagcctcaagtc

SEQ ID NO: 510344 - DNA, 25 bp, Rattus norvegicus
acttctcggagaagtcctgcgtccc

SEQ ID NO: 510345 - DNA, 25 bp, Rattus norvegicus
ccagccaggcgacgggcccaattgg

SEQ ID NO: 510346 - DNA, 25 bp, Rattus norvegicus
tcatagcagatcagaacttctcgga

SEQ ID NO: 510347 - DNA, 25 bp, Rattus norvegicus
tgcgcctctcatagcagatcagaac

SEQ ID NO: 510348 - DNA, 25 bp, Rattus norvegicus
tctctcttgcgcctctcatagcaga

SEQ ID NO: 510349 - DNA, 25 bp, Rattus norvegicus
gaccagttcggtgagcagctcttga

SEQ ID NO: 510350 - DNA, 25 bp, Rattus norvegicus
tcccaccgcggtgaccagttcggtg

SEQ ID NO: 510351 - DNA, 25 bp, Rattus norvegicus
gctcttcgcttgtccggtcgcgctg

SEQ ID NO: 510352 - DNA, 25 bp, Rattus norvegicus
agggtccttgggagcaccactgccc

SEQ ID NO: 510353 - DNA, 25 bp, Rattus norvegicus
agggcgccatccgagccagtccgaa

SEQ ID NO: 510354 - DNA, 25 bp, Rattus norvegicus
ttgcaccagctcacgctgactagta

SEQ ID NO: 510355 - DNA, 25 bp, Rattus norvegicus
ccagtccgaagggagactgagaaga

SEQ ID NO: 510356 - DNA, 25 bp, Rattus norvegicus
ggcgctcggcaaaaccgcatccatc

SEQ ID NO: 510357 - DNA, 25 bp, Rattus norvegicus
gaaagcccaaggcatcggctgccgc

SEQ ID NO: 510358 - DNA, 25 bp, Rattus norvegicus
cgcgtagactcgacctgaaagccca

SEQ ID NO: 510359 - DNA, 25 bp, Rattus norvegicus
tctgtacacagttcgcgtagactcg

SEQ ID NO: 510360 - DNA, 25 bp, Rattus norvegicus
tgcggcgcttttctgtacacagttc

SEQ ID NO: 510361 - DNA, 25 bp, Rattus norvegicus
ctcacgctgactagtagggtccttg

SEQ ID NO: 510362 - DNA, 25 bp, Rattus norvegicus
aatgtggagtctgccttgcaccagc

SEQ ID NO: 510363 - DNA, 25 bp, Rattus norvegicus
tcacaggagaactcaatgtggagtc

SEQ ID NO: 510364 - DNA, 25 bp, Rattus norvegicus
gcgcctgggttcacaggagaactca

SEQ ID NO: 510365 - DNA, 25 bp, Rattus norvegicus
tcacgctcatcctccgtgtggcagg

SEQ ID NO: 510366 - DNA, 25 bp, Rattus norvegicus
gcgcgctcccagctactcattaaga

SEQ ID NO: 510367 - DNA, 25 bp, Rattus norvegicus
gctagccgcactactgagccagttg

SEQ ID NO: 510368 - DNA, 25 bp, Rattus norvegicus
cacagctgaggaaaccgccttggca

SEQ ID NO: 510369 - DNA, 25 bp, Rattus norvegicus
cccgggcagaccagcaggccaagaa

SEQ ID NO: 510370 - DNA, 25 bp, Rattus norvegicus
tcgaatgtttattcctccttgggtg

SEQ ID NO: 510371 - DNA, 25 bp, Rattus norvegicus
actaatggatgctttggccagatgc

SEQ ID NO: 510372 - DNA, 25 bp, Rattus norvegicus
caggagtgtatgcttgcgtgcaagc

SEQ ID NO: 510373 - DNA, 25 bp, Rattus norvegicus
tcgcatctgtcgagctaggcttctc

SEQ ID NO: 510374 - DNA, 25 bp, Rattus norvegicus
tgcaaacgcgaaactcaggctccta

SEQ ID NO: 510375 - DNA, 25 bp, Rattus norvegicus
cagtcgctcttctacgggtggctgt

SEQ ID NO: 510376 - DNA, 25 bp, Rattus norvegicus
cggtgcgcatcgtacacgatttatg

SEQ ID NO: 510377 - DNA, 25 bp, Rattus norvegicus
gccaagccagagttctcagacttcc

SEQ ID NO: 510378 - DNA, 25 bp, Rattus norvegicus
tcaggctcctaatgaggggaaaata

SEQ ID NO: 510379 - DNA, 25 bp, Rattus norvegicus
cgtgacccttgtctgcgagcattta

SEQ ID NO: 510380 - DNA, 25 bp, Rattus norvegicus
ccgactctgggatttcgctgcgaga

SEQ ID NO: 510381 - DNA, 25 bp, Rattus norvegicus
gagcagcaggctctcttctccgagg

SEQ ID NO: 510382 - DNA, 25 bp, Rattus norvegicus
ttgctacctttatggtgcgcgcgcg

SEQ ID NO: 510383 - DNA, 25 bp, Rattus norvegicus
ggcagtttatctagcacctccattt

SEQ ID NO: 510384 - DNA, 25 bp, Rattus norvegicus
tctatcatggcagggtaaacgaggc

SEQ ID NO: 510385 - DNA, 25 bp, Rattus norvegicus
ccggtgagtaattgcaagtaggctt

SEQ ID NO: 510386 - DNA, 25 bp, Rattus norvegicus
tcagcgcttccaagctctcggaatc

SEQ ID NO: 510387 - DNA, 25 bp, Rattus norvegicus
gccggccgagccttaggcgcacaaa

SEQ ID NO: 510388 - DNA, 25 bp, Rattus norvegicus
ttctgacactgtccacgcagccggg

SEQ ID NO: 510389 - DNA, 25 bp, Rattus norvegicus
atgatgtccacgcagacccggcttc

SEQ ID NO: 510390 - DNA, 25 bp, Rattus norvegicus
cctcatcgtgctgattgacccgtga

SEQ ID NO: 510391 - DNA, 25 bp, Rattus norvegicus
ggtcctcaagccgtcacctcggtgg

SEQ ID NO: 510392 - DNA, 25 bp, Rattus norvegicus
gcgccgtagagagccaagggtaatt

SEQ ID NO: 510393 - DNA, 25 bp, Rattus norvegicus
ccgcaaggcagacatccggtgagta

SEQ ID NO: 510394 - DNA, 25 bp, Rattus norvegicus
gggccgccattcacgtgtctcaagt

SEQ ID NO: 510395 - DNA, 25 bp, Rattus norvegicus
gtaggcctcccagtcacgaatatcc

SEQ ID NO: 510396 - DNA, 25 bp, Rattus norvegicus
tccaagaatgtgactagtccgagcg

SEQ ID NO: 510397 - DNA, 25 bp, Rattus norvegicus
cgcggttatccacgcacttaccgtg

SEQ ID NO: 510398 - DNA, 25 bp, Rattus norvegicus
cacctcgtcgtcgtgcaggatgagg

SEQ ID NO: 510399 - DNA, 25 bp, Rattus norvegicus
agatgcaggcaagctcagagacaga

SEQ ID NO: 510400 - DNA, 25 bp, Rattus norvegicus
aagccatgttgtggactgccggcac

SEQ ID NO: 510401 - DNA, 25 bp, Rattus norvegicus
cacggtgctagtcgccggatgaagt

SEQ ID NO: 510402 - DNA, 25 bp, Rattus norvegicus
aacgcggccttagcttcctcggaag

SEQ ID NO: 510403 - DNA, 25 bp, Rattus norvegicus
tgtctcaagttggatcccgtgggga

SEQ ID NO: 510404 - DNA, 25 bp, Rattus norvegicus
gaaaggatcacatgcgcctgcgcgc

SEQ ID NO: 510405 - DNA, 25 bp, Rattus norvegicus
ggggtctgcataacgtagttccgga

SEQ ID NO: 510406 - DNA, 25 bp, Rattus norvegicus
gttccggatttgtgcgttcgatttc

SEQ ID NO: 510407 - DNA, 25 bp, Rattus norvegicus
ttcctcggaaggaccgagcaccttg

SEQ ID NO: 510408 - DNA, 25 bp, Rattus norvegicus
ctcagaaacgagcacggacacggaa

SEQ ID NO: 510409 - DNA, 25 bp, Rattus norvegicus
ggaacagcaatgaaggcgaagcctc

SEQ ID NO: 510410 - DNA, 25 bp, Rattus norvegicus
gagccctggctgaagtcgatgcgct

SEQ ID NO: 510411 - DNA, 25 bp, Rattus norvegicus
cagacgcgccaggttctgcgacata

SEQ ID NO: 510412 - DNA, 25 bp, Rattus norvegicus
ttctgcgacatagacagcggctgca

SEQ ID NO: 510413 - DNA, 25 bp, Rattus norvegicus
tgcaggtacgtctcggtgccatcaa

SEQ ID NO: 510414 - DNA, 25 bp, Rattus norvegicus
cgggtgacttgccagagactcagaa

SEQ ID NO: 510415 - DNA, 25 bp, Rattus norvegicus
acggaaggctggacaccaatctctc

SEQ ID NO: 510416 - DNA, 25 bp, Rattus norvegicus
cgcgcagcgtttcgcggaacactaa

SEQ ID NO: 510417 - DNA, 25 bp, Rattus norvegicus
cggagagccagctgcccggacactt

SEQ ID NO: 510418 - DNA, 25 bp, Rattus norvegicus
gctgcactctagagccggaaacttc

SEQ ID NO: 510419 - DNA, 25 bp, Rattus norvegicus
gacacttccggtacgctgcactcta

SEQ ID NO: 510420 - DNA, 25 bp, Rattus norvegicus
ggccgactcgatgctgatgcgcaca

SEQ ID NO: 510421 - DNA, 25 bp, Rattus norvegicus
cactaagagcagacgcggagagcca

SEQ ID NO: 510422 - DNA, 25 bp, Rattus norvegicus
atcagcgaccgcctgcggcgaagag

SEQ ID NO: 510423 - DNA, 25 bp, Rattus norvegicus
gcgacgctgcaagcccaagtgtgcg

SEQ ID NO: 510424 - DNA, 25 bp, Rattus norvegicus
gactcaatctgaagagagcccggcg

SEQ ID NO: 510425 - DNA, 25 bp, Rattus norvegicus
cggggacccggactcaatctgaaga

SEQ ID NO: 510426 - DNA, 25 bp, Rattus norvegicus
tcatgaccgcagtctccgtgctgtc

SEQ ID NO: 510427 - DNA, 25 bp, Rattus norvegicus
tcctggtactcacgccgacttcatg

SEQ ID NO: 510428 - DNA, 25 bp, Rattus norvegicus
gcagagtacggagctccggcctaca

SEQ ID NO: 510429 - DNA, 25 bp, Rattus norvegicus
agccaccagagctctgcgcagagta

SEQ ID NO: 510430 - DNA, 25 bp, Rattus norvegicus
acaccgggatcagcagccaccagag

SEQ ID NO: 510431 - DNA, 25 bp, Rattus norvegicus
cccgaattcggagtcagccttcgcg

SEQ ID NO: 510432 - DNA, 25 bp, Rattus norvegicus
gtcagcccaaaggatggcaagccga

SEQ ID NO: 510433 - DNA, 25 bp, Rattus norvegicus
tagacttgccacctgcacagcgggc

SEQ ID NO: 510434 - DNA, 25 bp, Rattus norvegicus
ggggtccctagacttgccacctgca

SEQ ID NO: 510435 - DNA, 25 bp, Rattus norvegicus
tttcaaacaggccaatcagcgaccg

SEQ ID NO: 510436 - DNA, 25 bp, Rattus norvegicus
cgaggttctcattgcttcgtgcttt

SEQ ID NO: 510437 - DNA, 25 bp, Rattus norvegicus
gcacgcagactagctgcagcgcaga

SEQ ID NO: 510438 - DNA, 25 bp, Rattus norvegicus
ctaccgagacgaactgcgggccaga

SEQ ID NO: 510439 - DNA, 25 bp, Rattus norvegicus
cagagcggcccacgcgaaactgacg

SEQ ID NO: 510440 - DNA, 25 bp, Rattus norvegicus
ggcgacgtactagagcctcagcctc

SEQ ID NO: 510441 - DNA, 25 bp, Rattus norvegicus
agcgcctcgacggtccacatcattg

SEQ ID NO: 510442 - DNA, 25 bp, Rattus norvegicus
gtagttcatcacgtcggagcagtca

SEQ ID NO: 510443 - DNA, 25 bp, Rattus norvegicus
agtagcctctatcctagcgcctcga

SEQ ID NO: 510444 - DNA, 25 bp, Rattus norvegicus
ctcacccagggacatatcgattttg

SEQ ID NO: 510445 - DNA, 25 bp, Rattus norvegicus
cggccagttcttgttacgacgactc

SEQ ID NO: 510446 - DNA, 25 bp, Rattus norvegicus
gtcccgcggggtaagaagacagcac

SEQ ID NO: 510447 - DNA, 25 bp, Rattus norvegicus
cagctgctggctttagtcatttgca

SEQ ID NO: 510448 - DNA, 25 bp, Rattus norvegicus
gcacttctgggcacttcttgtcaca

SEQ ID NO: 510449 - DNA, 25 bp, Rattus norvegicus
gacaagccattctcgcagctgctgg

SEQ ID NO: 510450 - DNA, 25 bp, Rattus norvegicus
ccctccttcacgtgggctcggggtg

SEQ ID NO: 510451 - DNA, 25 bp, Rattus norvegicus
ggtgcaaatgtctgccctggcagtt

SEQ ID NO: 510452 - DNA, 25 bp, Rattus norvegicus
cgtagagacgagtcaagagcagatc

SEQ ID NO: 510453 - DNA, 25 bp, Rattus norvegicus
gagcagatccgagacaggccaccct

SEQ ID NO: 510454 - DNA, 25 bp, Rattus norvegicus
ccaagcgcctgggaactgcacctgg

SEQ ID NO: 510455 - DNA, 25 bp, Rattus norvegicus
tgaattctgaggctcactggcgtcc

SEQ ID NO: 510456 - DNA, 25 bp, Rattus norvegicus
ccgccctcggttacctgaattctga

SEQ ID NO: 510457 - DNA, 25 bp, Rattus norvegicus
actggccaggagttccgccctcggt

SEQ ID NO: 510458 - DNA, 25 bp, Rattus norvegicus
actggcgtccagtggatagagcgta

SEQ ID NO: 510459 - DNA, 25 bp, Rattus norvegicus
tggcagttacctgatgcacgccgtc

SEQ ID NO: 510460 - DNA, 25 bp, Rattus norvegicus
gcacgccgtccaagagcaaactttt

SEQ ID NO: 510461 - DNA, 25 bp, Rattus norvegicus
tcatctctaagtagcacccgggctc

SEQ ID NO: 510462 - DNA, 25 bp, Rattus norvegicus
ctccatggctcagcgacggagagta

SEQ ID NO: 510463 - DNA, 25 bp, Rattus norvegicus
actgcacctggagcaccaggcgcgg

SEQ ID NO: 510464 - DNA, 25 bp, Rattus norvegicus
tcaaagcgcctcacatcccgggagc

SEQ ID NO: 510465 - DNA, 25 bp, Rattus norvegicus
gcagctccagcctctcggcgaggaa

SEQ ID NO: 510466 - DNA, 25 bp, Rattus norvegicus
ccagagccctgaggaaaactgaagc

SEQ ID NO: 510467 - DNA, 25 bp, Rattus norvegicus
ttgccgtggccgctctgggtcgcct

SEQ ID NO: 510468 - DNA, 25 bp, Rattus norvegicus
ggcggagagtcctcgaatgacagtc

SEQ ID NO: 510469 - DNA, 25 bp, Rattus norvegicus
ctcgaatgacagtctcgaaaacctg

SEQ ID NO: 510470 - DNA, 25 bp, Rattus norvegicus
tcgaaaacctgtcagcggcggcagc

SEQ ID NO: 510471 - DNA, 25 bp, Rattus norvegicus
tctcaggacacaggaagcgctcttg

SEQ ID NO: 510472 - DNA, 25 bp, Rattus norvegicus
cctctcggcgaggaagcgctcgtgt

SEQ ID NO: 510473 - DNA, 25 bp, Rattus norvegicus
tatgccagcacacgggctctcagga

SEQ ID NO: 510474 - DNA, 25 bp, Rattus norvegicus
cagaaccgcgttatgccagcacacg

SEQ ID NO: 510475 - DNA, 25 bp, Rattus norvegicus
atctccaagtcccagaaccgcgtta

SEQ ID NO: 510476 - DNA, 25 bp, Rattus norvegicus
ggatcgccagaaaccatctccaagt

SEQ ID NO: 510477 - DNA, 25 bp, Rattus norvegicus
tccctcacctgaggcgcattggcgg

SEQ ID NO: 510478 - DNA, 25 bp, Rattus norvegicus
cccgcaacggttggcccaatgaatg

SEQ ID NO: 510479 - DNA, 25 bp, Rattus norvegicus
acacagcacggactaagagtggctc

SEQ ID NO: 510480 - DNA, 25 bp, Rattus norvegicus
tccgccatccgacgggaacgtcctg

SEQ ID NO: 510481 - DNA, 25 bp, Rattus norvegicus
ccagaaaggacgaaggccatagcca

SEQ ID NO: 510482 - DNA, 25 bp, Rattus norvegicus
cggactaagagtggctcggactaga

SEQ ID NO: 510483 - DNA, 25 bp, Rattus norvegicus
gcgcatgcgtgttgggacacagcac

SEQ ID NO: 510484 - DNA, 25 bp, Rattus norvegicus
caacggttggcccaatgaatggatg

SEQ ID NO: 510485 - DNA, 25 bp, Rattus norvegicus
gatgtcagggcctaccgtcccacgt

SEQ ID NO: 510486 - DNA, 25 bp, Rattus norvegicus
atgggcgtcgttcacagcactccgc

SEQ ID NO: 510487 - DNA, 25 bp, Rattus norvegicus
cttcatgggcgtcgttcacagcact

SEQ ID NO: 510488 - DNA, 25 bp, Rattus norvegicus
gaccacgggcttcatgggcgtcgtt

SEQ ID NO: 510489 - DNA, 25 bp, Rattus norvegicus
caggagcgcaactaggaccacgggc

SEQ ID NO: 510490 - DNA, 25 bp, Rattus norvegicus
ggccatagccacaggagcgcaacta

SEQ ID NO: 510491 - DNA, 25 bp, Rattus norvegicus
ctcggactagaagtggctcgacggc

SEQ ID NO: 510492 - DNA, 25 bp, Rattus norvegicus
gggaccgacccagtctacattcttg

SEQ ID NO: 510493 - DNA, 25 bp, Rattus norvegicus
ctcggtcccttcttctcttggggtg

SEQ ID NO: 510494 - DNA, 25 bp, Rattus norvegicus
agccattcggcgcttggttaataaa

SEQ ID NO: 510495 - DNA, 25 bp, Rattus norvegicus
atcggagcatgtttcgtccgccgtc

SEQ ID NO: 510496 - DNA, 25 bp, Rattus norvegicus
ggaaactttatcagaacccgagctg

SEQ ID NO: 510497 - DNA, 25 bp, Rattus norvegicus
gcgtcgctaatgtaagttgcccgga

SEQ ID NO: 510498 - DNA, 25 bp, Rattus norvegicus
tgtgcaaatgctcagataatcctcg

SEQ ID NO: 510499 - DNA, 25 bp, Rattus norvegicus
ccacctttgggccagatgctgtctt

SEQ ID NO: 510500 - DNA, 25 bp, Rattus norvegicus
tacctttgtcgtgttcgtgaacgcg

SEQ ID NO: 510501 - DNA, 25 bp, Rattus norvegicus
gatgggctgcctcctggattaaaca

SEQ ID NO: 510502 - DNA, 25 bp, Rattus norvegicus
tcccacgacgcgcatctggatggaa

SEQ ID NO: 510503 - DNA, 25 bp, Rattus norvegicus
actgactacctgtgcgtgtgctccc

SEQ ID NO: 510504 - DNA, 25 bp, Rattus norvegicus
tgcccttggtgtgtgactgactacc

SEQ ID NO: 510505 - DNA, 25 bp, Rattus norvegicus
gcagttcgtctgaccgtagccgtta

SEQ ID NO: 510506 - DNA, 25 bp, Rattus norvegicus
aggcgaaatgatcgcgctggtgttt

SEQ ID NO: 510507 - DNA, 25 bp, Rattus norvegicus
aaggatcccgaagctgtcgtagccc

SEQ ID NO: 510508 - DNA, 25 bp, Rattus norvegicus
ggagcgagaagcttgcgccatcgcc

SEQ ID NO: 510509 - DNA, 25 bp, Rattus norvegicus
tactcattcggccttataggagctc

SEQ ID NO: 510510 - DNA, 25 bp, Rattus norvegicus
attcggccttataggagctcccacc

SEQ ID NO: 510511 - DNA, 25 bp, Rattus norvegicus
cttataggagctcccacccagggtc

SEQ ID NO: 510512 - DNA, 25 bp, Rattus norvegicus
ggagctcccacccagggtccaagga

SEQ ID NO: 510513 - DNA, 25 bp, Rattus norvegicus
agggtccaaggatcccgaagctgtc

SEQ ID NO: 510514 - DNA, 25 bp, Rattus norvegicus
ccgaaaaggtgacagtctaccttat

SEQ ID NO: 510515 - DNA, 25 bp, Rattus norvegicus
tgacagtctaccttatcgagcgccc

SEQ ID NO: 510516 - DNA, 25 bp, Rattus norvegicus
cggttttccgccgtggctcctgctg

SEQ ID NO: 510517 - DNA, 25 bp, Rattus norvegicus
gctcctgctgcgctcggcacgtagt

SEQ ID NO: 510518 - DNA, 25 bp, Rattus norvegicus
tcggcacgtagtgaaaggtggcctt

SEQ ID NO: 510519 - DNA, 25 bp, Rattus norvegicus
aggtggccttgaaggcgaaatgatc

SEQ ID NO: 510520 - DNA, 25 bp, Rattus norvegicus
gcctgccgagctgctttgtacgcag

SEQ ID NO: 510521 - DNA, 25 bp, Rattus norvegicus
cctgacggctggacctatgagccag

SEQ ID NO: 510522 - DNA, 25 bp, Rattus norvegicus
tgctttgtacgcagcagcaaaaatc

SEQ ID NO: 510523 - DNA, 25 bp, Rattus norvegicus
caagtaatgaggatggcgtcaccgc

SEQ ID NO: 510524 - DNA, 25 bp, Rattus norvegicus
gccctcctgcctccaagtaatgagg

SEQ ID NO: 510525 - DNA, 25 bp, Rattus norvegicus
tggaagcgtccctagcaccgactac

SEQ ID NO: 510526 - DNA, 25 bp, Rattus norvegicus
tatgagccagcctgatcttcctcgg

SEQ ID NO: 510527 - DNA, 25 bp, Rattus norvegicus
cggtctggtgcagtcgcagcctgcc

SEQ ID NO: 510528 - DNA, 25 bp, Rattus norvegicus
ctacaagagcgagtcactgggctgg

SEQ ID NO: 510529 - DNA, 25 bp, Rattus norvegicus
aggagtcggctacaagagcgagtca

SEQ ID NO: 510530 - DNA, 25 bp, Rattus norvegicus
tcacccgactgagctaggaggagtg

SEQ ID NO: 510531 - DNA, 25 bp, Rattus norvegicus
caccgactactcttgcggggaagca

SEQ ID NO: 510532 - DNA, 25 bp, Rattus norvegicus
tttccagtgagtggaagcgtcccta

SEQ ID NO: 510533 - DNA, 25 bp, Rattus norvegicus
ggaagcaaaggcgaagtcacccgac

SEQ ID NO: 510534 - DNA, 25 bp, Rattus norvegicus
gccgcggccgagcatctataataga

SEQ ID NO: 510535 - DNA, 25 bp, Rattus norvegicus
ctgaagtcacaagctggacgggcgc

SEQ ID NO: 510536 - DNA, 25 bp, Rattus norvegicus
cgccggctgaagtcacaagctggac

SEQ ID NO: 510537 - DNA, 25 bp, Rattus norvegicus
cttccttgccgcgttggctctgggc

SEQ ID NO: 510538 - DNA, 25 bp, Rattus norvegicus
catctataatagatgaggccgccgc

SEQ ID NO: 510539 - DNA, 25 bp, Rattus norvegicus
ctctggaggccgctggctgatgtca

SEQ ID NO: 510540 - DNA, 25 bp, Rattus norvegicus
tgtgacagtcatgcagaaagcgggc

SEQ ID NO: 510541 - DNA, 25 bp, Rattus norvegicus
gctgcttacctttgtgacagtcatg

SEQ ID NO: 510542 - DNA, 25 bp, Rattus norvegicus
atctgagctgcttacctttgtgaca

SEQ ID NO: 510543 - DNA, 25 bp, Rattus norvegicus
tggcgacgatctgagctgcttacct

SEQ ID NO: 510544 - DNA, 25 bp, Rattus norvegicus
cccagcgtggcgacgatctgagctg

SEQ ID NO: 510545 - DNA, 25 bp, Rattus norvegicus
gggctacagcatccgtgggtcccca

SEQ ID NO: 510546 - DNA, 25 bp, Rattus norvegicus
cccgagggccaagcgactcctggga

SEQ ID NO: 510547 - DNA, 25 bp, Rattus norvegicus
accggggactcgctacaaagaggag

SEQ ID NO: 510548 - DNA, 25 bp, Rattus norvegicus
ccggcaggcaaacgaggctatccta

SEQ ID NO: 510549 - DNA, 25 bp, Rattus norvegicus
attgcttcctaaaccgaccggcagg

SEQ ID NO: 510550 - DNA, 25 bp, Rattus norvegicus
tggagttgggatgtacctacccgtc

SEQ ID NO: 510551 - DNA, 25 bp, Rattus norvegicus
gcctcaggaaaaccgcgggcactcg

SEQ ID NO: 510552 - DNA, 25 bp, Rattus norvegicus
gccgctggaggcacaactgtgaccc

SEQ ID NO: 510553 - DNA, 25 bp, Rattus norvegicus
tgccagtctgctgggtctgcacacg

SEQ ID NO: 510554 - DNA, 25 bp, Rattus norvegicus
tcgctggccgccttgtacacataac

SEQ ID NO: 510555 - DNA, 25 bp, Rattus norvegicus
agccagagtgagcaccttgccctcg

SEQ ID NO: 510556 - DNA, 25 bp, Rattus norvegicus
gtgttcacggaacgctcccgcagct

SEQ ID NO: 510557 - DNA, 25 bp, Rattus norvegicus
tgcacacggtagtgttctaacagca

SEQ ID NO: 510558 - DNA, 25 bp, Rattus norvegicus
ctaaagaaaggttccgctgtgcgca

SEQ ID NO: 510559 - DNA, 25 bp, Rattus norvegicus
tgaccggttaaggagcaaggcagcc

SEQ ID NO: 510560 - DNA, 25 bp, Rattus norvegicus
gcggatatcgctttctgaccggtta

SEQ ID NO: 510561 - DNA, 25 bp, Rattus norvegicus
catagcccagcaggtagcggatatc

SEQ ID NO: 510562 - DNA, 25 bp, Rattus norvegicus
cgcatccgtctctcctcccggaagg

SEQ ID NO: 510563 - DNA, 25 bp, Rattus norvegicus
ctccgcgcggcacgcgcatccgtct

SEQ ID NO: 510564 - DNA, 25 bp, Rattus norvegicus
ccagagtttgagagacctcgccagg

SEQ ID NO: 510565 - DNA, 25 bp, Rattus norvegicus
ctgctctggggaagactgtgacttt

SEQ ID NO: 510566 - DNA, 25 bp, Rattus norvegicus
ccaagttttcaggaacctcctgctc

SEQ ID NO: 510567 - DNA, 25 bp, Rattus norvegicus
cttccaagttttcaggaacctcctg

SEQ ID NO: 510568 - DNA, 25 bp, Rattus norvegicus
tgccacttccaagttttcaggaacc

SEQ ID NO: 510569 - DNA, 25 bp, Rattus norvegicus
cccgtgccacttccaagttttcagg

SEQ ID NO: 510570 - DNA, 25 bp, Rattus norvegicus
gtcatcccggccagctctgctgagt

SEQ ID NO: 510571 - DNA, 25 bp, Rattus norvegicus
cctcgccagggttaggggaactgca

SEQ ID NO: 510572 - DNA, 25 bp, Rattus norvegicus
gggtaggctactcggaggtcatccc

SEQ ID NO: 510573 - DNA, 25 bp, Rattus norvegicus
cccggtgtcgcgttcttgcaggcca

SEQ ID NO: 510574 - DNA, 25 bp, Rattus norvegicus
taggctactcggaggtcatcccggc

SEQ ID NO: 510575 - DNA, 25 bp, Rattus norvegicus
tactcggaggtcatcccggccagct

SEQ ID NO: 510576 - DNA, 25 bp, Rattus norvegicus
ctctcgtaggcctaggagcagcgga

SEQ ID NO: 510577 - DNA, 25 bp, Rattus norvegicus
ccaggctccggccttccgcagaccg

SEQ ID NO: 510578 - DNA, 25 bp, Rattus norvegicus
aaacggcgctctcgtaggcctagga

SEQ ID NO: 510579 - DNA, 25 bp, Rattus norvegicus
ccggaaacggcgctctcgtaggcct

SEQ ID NO: 510580 - DNA, 25 bp, Rattus norvegicus
ttcgtctggggtgctccggtctacg

SEQ ID NO: 510581 - DNA, 25 bp, Rattus norvegicus
agagcgctcttttcggcgcggcgaa

SEQ ID NO: 510582 - DNA, 25 bp, Rattus norvegicus
ctgctgggcgcgagagcgctctttt

SEQ ID NO: 510583 - DNA, 25 bp, Rattus norvegicus
gcgagatttcatcctagtcctagtc

SEQ ID NO: 510584 - DNA, 25 bp, Rattus norvegicus
tgccctcacgcgagatttcatccta

SEQ ID NO: 510585 - DNA, 25 bp, Rattus norvegicus
cacggacgtgccctcacgcgagatt

SEQ ID NO: 510586 - DNA, 25 bp, Rattus norvegicus
gcacgcataaccacgcccacggacg

SEQ ID NO: 510587 - DNA, 25 bp, Rattus norvegicus
gcccatcacagagtccgcacgcata

SEQ ID NO: 510588 - DNA, 25 bp, Rattus norvegicus
tcctagtcctagtcaggctgctggg

SEQ ID NO: 510589 - DNA, 25 bp, Rattus norvegicus
ctgggcctggaaggcgtttttagtg

SEQ ID NO: 510590 - DNA, 25 bp, Rattus norvegicus
ggagaggctatcagtcggggctgtt

SEQ ID NO: 510591 - DNA, 25 bp, Rattus norvegicus
acggccttacagtccggatgcgtcc

SEQ ID NO: 510592 - DNA, 25 bp, Rattus norvegicus
agggatgacacgcagtgcggagcgc

SEQ ID NO: 510593 - DNA, 25 bp, Rattus norvegicus
cggccttacagtccggatgcgtccg

SEQ ID NO: 510594 - DNA, 25 bp, Rattus norvegicus
cgagacggccttacagtccggatgc

SEQ ID NO: 510595 - DNA, 25 bp, Rattus norvegicus
cttacagtccggatgcgtccggagg

SEQ ID NO: 510596 - DNA, 25 bp, Rattus norvegicus
cccgagacggccttacagtccggat

SEQ ID NO: 510597 - DNA, 25 bp, Rattus norvegicus
cgcgggaatggatcttggcggcggc

SEQ ID NO: 510598 - DNA, 25 bp, Rattus norvegicus
tggagcctctcttcggccccgagac

SEQ ID NO: 510599 - DNA, 25 bp, Rattus norvegicus
aacgcctgccggaggagagcaggtg

SEQ ID NO: 510600 - DNA, 25 bp, Rattus norvegicus
tggcagggcagggatgacacgcagt

SEQ ID NO: 510601 - DNA, 25 bp, Rattus norvegicus
gtgccctggctgtcgaagcggcctg

SEQ ID NO: 510602 - DNA, 25 bp, Rattus norvegicus
gctgtcgaagcggcctggagcctct

SEQ ID NO: 510603 - DNA, 25 bp, Rattus norvegicus
agacggccttacagtccggatgcgt

SEQ ID NO: 510604 - DNA, 25 bp, Rattus norvegicus
gaaacagtaacgtcccgcctgggca

SEQ ID NO: 510605 - DNA, 25 bp, Rattus norvegicus
gccatcttgcgtctgtcagcgcaag

SEQ ID NO: 510606 - DNA, 25 bp, Rattus norvegicus
ttacctttagttccgcactgtccgc

SEQ ID NO: 510607 - DNA, 25 bp, Rattus norvegicus
tcgagctgcgctttacctttagttc

SEQ ID NO: 510608 - DNA, 25 bp, Rattus norvegicus
agaagtgaattcgagctgcgcttta

SEQ ID NO: 510609 - DNA, 25 bp, Rattus norvegicus
cgcggccgaatattagaagtgaatt

SEQ ID NO: 510610 - DNA, 25 bp, Rattus norvegicus
gcctacaactccagacccgggtgga

SEQ ID NO: 510611 - DNA, 25 bp, Rattus norvegicus
gggatcgcgcattcccactggccgg

SEQ ID NO: 510612 - DNA, 25 bp, Rattus norvegicus
tccgggctcgctaaactttccaaga

SEQ ID NO: 510613 - DNA, 25 bp, Rattus norvegicus
gcccggaatcaagagagaaacagta

SEQ ID NO: 510614 - DNA, 25 bp, Rattus norvegicus
tcagcgcaagcgcagtgaagctcgc

SEQ ID NO: 510615 - DNA, 25 bp, Rattus norvegicus
tctccgcggccgaatattagaagtg

SEQ ID NO: 510616 - DNA, 25 bp, Rattus norvegicus
actttccaagagcttctccctcgta

SEQ ID NO: 510617 - DNA, 25 bp, Rattus norvegicus
gcagcggggcagttttcccaatccc

SEQ ID NO: 510618 - DNA, 25 bp, Rattus norvegicus
aactgcgggtgcacaccctggccgg

SEQ ID NO: 510619 - DNA, 25 bp, Rattus norvegicus
gagggcggccagctttccgttccca

SEQ ID NO: 510620 - DNA, 25 bp, Rattus norvegicus
ctccagggcgccctaggacttggag

SEQ ID NO: 510621 - DNA, 25 bp, Rattus norvegicus
aagtgcactttgttcccgagtgggg

SEQ ID NO: 510622 - DNA, 25 bp, Rattus norvegicus
cccaaccgcagaagtgcactttgtt

SEQ ID NO: 510623 - DNA, 25 bp, Rattus norvegicus
agtgctttcggtttgctggaatgtt

SEQ ID NO: 510624 - DNA, 25 bp, Rattus norvegicus
ccgcagtgctttcggtttgctggaa

SEQ ID NO: 510625 - DNA, 25 bp, Rattus norvegicus
accaggtcatcaccgcagtgctttc

SEQ ID NO: 510626 - DNA, 25 bp, Rattus norvegicus
gcagaggattccttgcgtgcaactg

SEQ ID NO: 510627 - DNA, 25 bp, Rattus norvegicus
gggcagtcccacgatgttctctcgc

SEQ ID NO: 510628 - DNA, 25 bp, Rattus norvegicus
cagctttccgttcccagggtgcctt

SEQ ID NO: 510629 - DNA, 25 bp, Rattus norvegicus
ccttgcgtgcaactgcgggtgcaca

SEQ ID NO: 510630 - DNA, 25 bp, Rattus norvegicus
cgggaagcagccaccaggtcatcac

SEQ ID NO: 510631 - DNA, 25 bp, Rattus norvegicus
gcctgtcctggccaagcatcactaa

SEQ ID NO: 510632 - DNA, 25 bp, Rattus norvegicus
agagagagtcgcaccaaccacgttg

SEQ ID NO: 510633 - DNA, 25 bp, Rattus norvegicus
gagtcgcaccaaccacgttggtcgc

SEQ ID NO: 510634 - DNA, 25 bp, Rattus norvegicus
gtgcccgaggctgtatttacaacgg

SEQ ID NO: 510635 - DNA, 25 bp, Rattus norvegicus
cccgaggctgtatttacaacggttg

SEQ ID NO: 510636 - DNA, 25 bp, Rattus norvegicus
acaacggttgggtcctaatggcttg

SEQ ID NO: 510637 - DNA, 25 bp, Rattus norvegicus
gggtcctaatggcttgttcctcgct

SEQ ID NO: 510638 - DNA, 25 bp, Rattus norvegicus
tatttacagaaaggagcagcacggc

SEQ ID NO: 510639 - DNA, 25 bp, Rattus norvegicus
cgcggccaagccagcgctagggcaa

SEQ ID NO: 510640 - DNA, 25 bp, Rattus norvegicus
aagccagcgctagggcaacagcgga

SEQ ID NO: 510641 - DNA, 25 bp, Rattus norvegicus
gcttgaaggagcagttgcctgtgca

SEQ ID NO: 510642 - DNA, 25 bp, Rattus norvegicus
tgcagtgccggggtgtcagcatctt

SEQ ID NO: 510643 - DNA, 25 bp, Rattus norvegicus
agcatcttgcaggagaagtggtgca

SEQ ID NO: 510644 - DNA, 25 bp, Rattus norvegicus
agcttctggagagagagtcgcacca

SEQ ID NO: 510645 - DNA, 25 bp, Rattus norvegicus
ggtgtcagcatcttgcaggagaagt

SEQ ID NO: 510646 - DNA, 25 bp, Rattus norvegicus
tgacccggatactgcagagcggcct

SEQ ID NO: 510647 - DNA, 25 bp, Rattus norvegicus
cggatactgcagagcggcctcggtt

SEQ ID NO: 510648 - DNA, 25 bp, Rattus norvegicus
ctgcacaaggtctgctccattccgg

SEQ ID NO: 510649 - DNA, 25 bp, Rattus norvegicus
attaaaaacgtcgtggccgcctctg

SEQ ID NO: 510650 - DNA, 25 bp, Rattus norvegicus
gcgacctacattgtgtgagcagata

SEQ ID NO: 510651 - DNA, 25 bp, Rattus norvegicus
gtggccgcctctggttcccggctgt

SEQ ID NO: 510652 - DNA, 25 bp, Rattus norvegicus
tctggttcccggctgtgcgcccagg

SEQ ID NO: 510653 - DNA, 25 bp, Rattus norvegicus
ccaggaaaagatcaagacaagcagc

SEQ ID NO: 510654 - DNA, 25 bp, Rattus norvegicus
aaagatcaagacaagcagctgagcc

SEQ ID NO: 510655 - DNA, 25 bp, Rattus norvegicus
ccagggacaagcgacctacattgtg

SEQ ID NO: 510656 - DNA, 25 bp, Rattus norvegicus
ttgtgtgagcagatactggggcacc

SEQ ID NO: 510657 - DNA, 25 bp, Rattus norvegicus
tgtccgcgccacttcagcggagatc

SEQ ID NO: 510658 - DNA, 25 bp, Rattus norvegicus
gagcccaccagggacaagcgaccta

SEQ ID NO: 510659 - DNA, 25 bp, Rattus norvegicus
aaggtctgctccattccgggctaca

SEQ ID NO: 510660 - DNA, 25 bp, Rattus norvegicus
tggagtcgtttggtaggatagaaaa

SEQ ID NO: 510661 - DNA, 25 bp, Rattus norvegicus
aagcacaagcgaagggccgcactcg

SEQ ID NO: 510662 - DNA, 25 bp, Rattus norvegicus
acctgagccaggagcgtccacctga

SEQ ID NO: 510663 - DNA, 25 bp, Rattus norvegicus
ccaggagcgtccacctgaagctggg

SEQ ID NO: 510664 - DNA, 25 bp, Rattus norvegicus
ccaaagggtttctggccttggagct

SEQ ID NO: 510665 - DNA, 25 bp, Rattus norvegicus
gagctcagagaagtggggaacccta

SEQ ID NO: 510666 - DNA, 25 bp, Rattus norvegicus
ttcgagggccaaagaagaaagcaca

SEQ ID NO: 510667 - DNA, 25 bp, Rattus norvegicus
actcggcgacaaggagcagcggtca

SEQ ID NO: 510668 - DNA, 25 bp, Rattus norvegicus
ggcccgaagaagaagcagaagccta

SEQ ID NO: 510669 - DNA, 25 bp, Rattus norvegicus
gaacgaaacagcagttcgagggcca

SEQ ID NO: 510670 - DNA, 25 bp, Rattus norvegicus
gatagaaaacaacagccacagagtc

SEQ ID NO: 510671 - DNA, 25 bp, Rattus norvegicus
gccacagagtctaaaggagaagtca

SEQ ID NO: 510672 - DNA, 25 bp, Rattus norvegicus
agaagtcaacgaaaggagcgctgcg

SEQ ID NO: 510673 - DNA, 25 bp, Rattus norvegicus
tcgcgatcgcgggtactcaccgtgc

SEQ ID NO: 510674 - DNA, 25 bp, Rattus norvegicus
aaggctgacacgtaggagcttttgc

SEQ ID NO: 510675 - DNA, 25 bp, Rattus norvegicus
tcgtagctcatagccgccgttcggt

SEQ ID NO: 510676 - DNA, 25 bp, Rattus norvegicus
agggctatcgccatccgcagagtct

SEQ ID NO: 510677 - DNA, 25 bp, Rattus norvegicus
cgtctgcgcctgaggatgtgacaga

SEQ ID NO: 510678 - DNA, 25 bp, Rattus norvegicus
atagctcgagctgccctcgctcaga

SEQ ID NO: 510679 - DNA, 25 bp, Rattus norvegicus
cgctcagaaagtccgggctcacgta

SEQ ID NO: 510680 - DNA, 25 bp, Rattus norvegicus
cgcgcactgccgtagagcttagcga

SEQ ID NO: 510681 - DNA, 25 bp, Rattus norvegicus
gcccgcaaggctctcgtagctcata

SEQ ID NO: 510682 - DNA, 25 bp, Rattus norvegicus
ttcactacgggtcggaaggctgaca

SEQ ID NO: 510683 - DNA, 25 bp, Rattus norvegicus
cagaacattgttccgccaccagggc

SEQ ID NO: 510684 - DNA, 25 bp, Rattus norvegicus
tagctggctccgcaccgtccaaaga

SEQ ID NO: 510685 - DNA, 25 bp, Rattus norvegicus
ccgctacggccttagcttggctctg

SEQ ID NO: 510686 - DNA, 25 bp, Rattus norvegicus
cagaacatgggaaacgtcgggtaca

SEQ ID NO: 510687 - DNA, 25 bp, Rattus norvegicus
ttagcgatgctctccgcgtccttca

SEQ ID NO: 510688 - DNA, 25 bp, Rattus norvegicus
tgcccatcaatgaccagtgacacga

SEQ ID NO: 510689 - DNA, 25 bp, Rattus norvegicus
gagccatttttagcgctgctaccta

SEQ ID NO: 510690 - DNA, 25 bp, Rattus norvegicus
tgaccggcttccagggacaacagta

SEQ ID NO: 510691 - DNA, 25 bp, Rattus norvegicus
acccagagacggagagtgacttgcc

SEQ ID NO: 510692 - DNA, 25 bp, Rattus norvegicus
cagagagtgtccagctgggtttaca

SEQ ID NO: 510693 - DNA, 25 bp, Rattus norvegicus
ctcggtgttccttgagcagagagtg

SEQ ID NO: 510694 - DNA, 25 bp, Rattus norvegicus
tgtacctctcttctgacgccttgcg

SEQ ID NO: 510695 - DNA, 25 bp, Rattus norvegicus
tgcacctagcttcgtgatgaccggc

SEQ ID NO: 510696 - DNA, 25 bp, Rattus norvegicus
ccctttccaaagcttgtcgcgtgca

SEQ ID NO: 510697 - DNA, 25 bp, Rattus norvegicus
gcccatcaccaaactgcgggatgta

SEQ ID NO: 510698 - DNA, 25 bp, Rattus norvegicus
ggtttgcgtgccttcagctacctca

SEQ ID NO: 510699 - DNA, 25 bp, Rattus norvegicus
ctttccagccggcactcaggtttgc

SEQ ID NO: 510700 - DNA, 25 bp, Rattus norvegicus
tcccgagtagggctgcaactcttgc

SEQ ID NO: 510701 - DNA, 25 bp, Rattus norvegicus
tcgcgtgcaccacgaacctcggatg

SEQ ID NO: 510702 - DNA, 25 bp, Rattus norvegicus
tttcggaggtgcaccggtgccgcca

SEQ ID NO: 510703 - DNA, 25 bp, Rattus norvegicus
accggtgccgccagccctccaccag

SEQ ID NO: 510704 - DNA, 25 bp, Rattus norvegicus
ggatcggccgactgaggccctcgtc

SEQ ID NO: 510705 - DNA, 25 bp, Rattus norvegicus
ctgaggccctcgtcccggcggcgaa

SEQ ID NO: 510706 - DNA, 25 bp, Rattus norvegicus
aaggcggccgctagaccgctgttac

SEQ ID NO: 510707 - DNA, 25 bp, Rattus norvegicus
caaaacgcgatggcgccggaacccg

SEQ ID NO: 510708 - DNA, 25 bp, Rattus norvegicus
gccgctagaccgctgttactccgga

SEQ ID NO: 510709 - DNA, 25 bp, Rattus norvegicus
gctagaccgctgttactccggaacc

SEQ ID NO: 510710 - DNA, 25 bp, Rattus norvegicus
ggagccgacaagtgggacccgcctc

SEQ ID NO: 510711 - DNA, 25 bp, Rattus norvegicus
tagaccgctgttactccggaaccaa

SEQ ID NO: 510712 - DNA, 25 bp, Rattus norvegicus
tactccggaaccaaaacgcgatggc

SEQ ID NO: 510713 - DNA, 25 bp, Rattus norvegicus
tccggaaccaaaacgcgatggcgcc

SEQ ID NO: 510714 - DNA, 25 bp, Rattus norvegicus
gaaccaaaacgcgatggcgccggaa

SEQ ID NO: 510715 - DNA, 25 bp, Rattus norvegicus
ggcggccgctagaccgctgttactc

SEQ ID NO: 510716 - DNA, 25 bp, Rattus norvegicus
tgaagtgcgaaaggccgaactggtc

SEQ ID NO: 510717 - DNA, 25 bp, Rattus norvegicus
gttttgcgcggccaggtcttgccag

SEQ ID NO: 510718 - DNA, 25 bp, Rattus norvegicus
ccggcaccggccaattgaagtgcga

SEQ ID NO: 510719 - DNA, 25 bp, Rattus norvegicus
ttgatgaccttgagcgcggtgaaga

SEQ ID NO: 510720 - DNA, 25 bp, Rattus norvegicus
cgaactggtcgttgtggaccgcact

SEQ ID NO: 510721 - DNA, 25 bp, Rattus norvegicus
gaccgcactgtagggcacgcagaag

SEQ ID NO: 510722 - DNA, 25 bp, Rattus norvegicus
aggtgccgcgtcagcacctccgagg

SEQ ID NO: 510723 - DNA, 25 bp, Rattus norvegicus
caatggtacttgatgaaggggaagc

SEQ ID NO: 510724 - DNA, 25 bp, Rattus norvegicus
gtgcttgtgggccagcgaccgccct

SEQ ID NO: 510725 - DNA, 25 bp, Rattus norvegicus
gatgcgaagaactggccctggaagc

SEQ ID NO: 510726 - DNA, 25 bp, Rattus norvegicus
tcaggagggcttgcgcatgcgcctt

SEQ ID NO: 510727 - DNA, 25 bp, Rattus norvegicus
ggcgccttggagcaatggtacttga

SEQ ID NO: 510728 - DNA, 25 bp, Rattus norvegicus
aagagtgccgcggtcaggccgccac

SEQ ID NO: 510729 - DNA, 25 bp, Rattus norvegicus
ctccgcaggggctccatagccaagg

SEQ ID NO: 510730 - DNA, 25 bp, Rattus norvegicus
tttctcccgggcactaccggagctg

SEQ ID NO: 510731 - DNA, 25 bp, Rattus norvegicus
tgactgctccgaaggtgtccgcgcc

SEQ ID NO: 510732 - DNA, 25 bp, Rattus norvegicus
ggtgttccttgtgcgctggtcacca

SEQ ID NO: 510733 - DNA, 25 bp, Rattus norvegicus
tgcaacgtaagtaaccgggctcctg

SEQ ID NO: 510734 - DNA, 25 bp, Rattus norvegicus
gaccggctggtgcaacgtaagtaac

SEQ ID NO: 510735 - DNA, 25 bp, Rattus norvegicus
ggccggtgatttctcccgggcacta

SEQ ID NO: 510736 - DNA, 25 bp, Rattus norvegicus
cttcaccggggaccggctggtgcaa

SEQ ID NO: 510737 - DNA, 25 bp, Rattus norvegicus
tgtgcgctggtcaccagctgctccg

SEQ ID NO: 510738 - DNA, 25 bp, Rattus norvegicus
agtcactatagcaacgcggcgcgcg

SEQ ID NO: 510739 - DNA, 25 bp, Rattus norvegicus
ctagaagcaggcaccagtcactata

SEQ ID NO: 510740 - DNA, 25 bp, Rattus norvegicus
ggccttctccggagcgcttctagaa

SEQ ID NO: 510741 - DNA, 25 bp, Rattus norvegicus
tggctccggaggtatggccttctcc

SEQ ID NO: 510742 - DNA, 25 bp, Rattus norvegicus
tcaggctctgactgctccgaaggtg

SEQ ID NO: 510743 - DNA, 25 bp, Rattus norvegicus
aaccggcgtgctccacaggaggagc

SEQ ID NO: 510744 - DNA, 25 bp, Rattus norvegicus
tcagctctgccaagtgccgcgggac

SEQ ID NO: 510745 - DNA, 25 bp, Rattus norvegicus
aatgcacttggtgttcacgttctgc

SEQ ID NO: 510746 - DNA, 25 bp, Rattus norvegicus
tcacgttctgcgtggtgatggcctt

SEQ ID NO: 510747 - DNA, 25 bp, Rattus norvegicus
attagactcgcagggaacaggcacg

SEQ ID NO: 510748 - DNA, 25 bp, Rattus norvegicus
tgatggccttctccagctcgtccaa

SEQ ID NO: 510749 - DNA, 25 bp, Rattus norvegicus
cgtcttcttgagcttcttcaccaag

SEQ ID NO: 510750 - DNA, 25 bp, Rattus norvegicus
cgaacttcgcttttaactctggaga

SEQ ID NO: 510751 - DNA, 25 bp, Rattus norvegicus
tctggagaacttgcccaggcgtccc

SEQ ID NO: 510752 - DNA, 25 bp, Rattus norvegicus
cccaagacgttcagatgtagttgca

SEQ ID NO: 510753 - DNA, 25 bp, Rattus norvegicus
tcccggccaggatagcggcactgca

SEQ ID NO: 510754 - DNA, 25 bp, Rattus norvegicus
gctcccaagtctacgtttcacgcag

SEQ ID NO: 510755 - DNA, 25 bp, Rattus norvegicus
ggatggctttggtgcgcagatccct

SEQ ID NO: 510756 - DNA, 25 bp, Rattus norvegicus
actccgagtgccagtagaaagtttg

SEQ ID NO: 510757 - DNA, 25 bp, Rattus norvegicus
ccaaactttgctggcctggatggct

SEQ ID NO: 510758 - DNA, 25 bp, Rattus norvegicus
tatcctgatgaagggttccgcggcc

SEQ ID NO: 510759 - DNA, 25 bp, Rattus norvegicus
tcccgtgcttttctcgcaggcggcc

SEQ ID NO: 510760 - DNA, 25 bp, Rattus norvegicus
gggccgctctgtacttatcctgatg

SEQ ID NO: 510761 - DNA, 25 bp, Rattus norvegicus
cgcggccctaatggccgggcgggct

SEQ ID NO: 510762 - DNA, 25 bp, Rattus norvegicus
acagccggcccagccggtcccgtgc

SEQ ID NO: 510763 - DNA, 25 bp, Rattus norvegicus
tttccagggccgctctgtacttatc

SEQ ID NO: 510764 - DNA, 25 bp, Rattus norvegicus
gccgctctgtacttatcctgatgaa

SEQ ID NO: 510765 - DNA, 25 bp, Rattus norvegicus
cgctctgtacttatcctgatgaagg

SEQ ID NO: 510766 - DNA, 25 bp, Rattus norvegicus
ctgtacttatcctgatgaagggttc

SEQ ID NO: 510767 - DNA, 25 bp, Rattus norvegicus
acttatcctgatgaagggttccgcg

SEQ ID NO: 510768 - DNA, 25 bp, Rattus norvegicus
tgatgaagggttccgcggccctaat

SEQ ID NO: 510769 - DNA, 25 bp, Rattus norvegicus
gcctggctctcagcccagtggggac

SEQ ID NO: 510770 - DNA, 25 bp, Rattus norvegicus
gttcagggcgggcacagccggccca

SEQ ID NO: 510771 - DNA, 25 bp, Rattus norvegicus
tggctctcagcccagtggggaccgc

SEQ ID NO: 510772 - DNA, 25 bp, Rattus norvegicus
ccgcgtgcgggcaggagcggtccaa

SEQ ID NO: 510773 - DNA, 25 bp, Rattus norvegicus
ccggccgagcccgtccaacgcgccg

SEQ ID NO: 510774 - DNA, 25 bp, Rattus norvegicus
gcttcagcccgcgaagaagctgcgg

SEQ ID NO: 510775 - DNA, 25 bp, Rattus norvegicus
ctcctccacgccgagcttcagcccg

SEQ ID NO: 510776 - DNA, 25 bp, Rattus norvegicus
gccctgctcctccacgccgagcttc

SEQ ID NO: 510777 - DNA, 25 bp, Rattus norvegicus
cctcctcctgcacggccggacccac

SEQ ID NO: 510778 - DNA, 25 bp, Rattus norvegicus
gagcccgtccaacgcgccgggcgcc

SEQ ID NO: 510779 - DNA, 25 bp, Rattus norvegicus
tctcctgctgctgcctgcggggccc

SEQ ID NO: 510780 - DNA, 25 bp, Rattus norvegicus
gcagaagcctacgtgggctgccctc

SEQ ID NO: 510781 - DNA, 25 bp, Rattus norvegicus
cgcagaagcctacgtgggctgccct

SEQ ID NO: 510782 - DNA, 25 bp, Rattus norvegicus
tgccgcagaagcctacgtgggctgc

SEQ ID NO: 510783 - DNA, 25 bp, Rattus norvegicus
ggcaggagcggtccaactccggcag

SEQ ID NO: 510784 - DNA, 25 bp, Rattus norvegicus
ttcagcccgcgaagaagctgcgggc

SEQ ID NO: 510785 - DNA, 25 bp, Rattus norvegicus
gctgccgcagaagcctacgtgggct

SEQ ID NO: 510786 - DNA, 25 bp, Rattus norvegicus
tcgttacttccgtcattcaaacggc

SEQ ID NO: 510787 - DNA, 25 bp, Rattus norvegicus
cactcacctgacagcgtgtgtggtc

SEQ ID NO: 510788 - DNA, 25 bp, Rattus norvegicus
cggatgccacagaaaaggccgagct

SEQ ID NO: 510789 - DNA, 25 bp, Rattus norvegicus
agctcactgcaggaccggcctcggg

SEQ ID NO: 510790 - DNA, 25 bp, Rattus norvegicus
ttaaagggccggaaggctcgccagc

SEQ ID NO: 510791 - DNA, 25 bp, Rattus norvegicus
gcctgcttggagaaccctgacgggc

SEQ ID NO: 510792 - DNA, 25 bp, Rattus norvegicus
ggagaaccctgacgggcctccgtca

SEQ ID NO: 510793 - DNA, 25 bp, Rattus norvegicus
acagcgtgtgtggtcggacctcaca

SEQ ID NO: 510794 - DNA, 25 bp, Rattus norvegicus
ggacctcacagcacacaggaatctg

SEQ ID NO: 510795 - DNA, 25 bp, Rattus norvegicus
acaggaatctgcaccctgccagtta

SEQ ID NO: 510796 - DNA, 25 bp, Rattus norvegicus
ctgccagttacccagcagccgtttg

SEQ ID NO: 510797 - DNA, 25 bp, Rattus norvegicus
cagccgtttgggtacctgctggaca

SEQ ID NO: 510798 - DNA, 25 bp, Rattus norvegicus
ccgatctcgttacttccgtcattca

SEQ ID NO: 510799 - DNA, 25 bp, Rattus norvegicus
ggtacctgctggacagccatggccc

SEQ ID NO: 510800 - DNA, 25 bp, Rattus norvegicus
tcgaacaccttgatggagtagcccg

SEQ ID NO: 510801 - DNA, 25 bp, Rattus norvegicus
tgacagcctggtcatacaccgcata

SEQ ID NO: 510802 - DNA, 25 bp, Rattus norvegicus
ccctgaggtaggtcgtagaagatgc

SEQ ID NO: 510803 - DNA, 25 bp, Rattus norvegicus
aggcagaagccgctgccctgaggta

SEQ ID NO: 510804 - DNA, 25 bp, Rattus norvegicus
gactcactgcgctgctccaggttga

SEQ ID NO: 510805 - DNA, 25 bp, Rattus norvegicus
gccaaaaccgatcttgctccgtgtg

SEQ ID NO: 510806 - DNA, 25 bp, Rattus norvegicus
acgccatcgggctccttgctgagca

SEQ ID NO: 510807 - DNA, 25 bp, Rattus norvegicus
ggaggatctccagccaacaggggca

SEQ ID NO: 510808 - DNA, 25 bp, Rattus norvegicus
cctgagcgctcaaagtcgaacacct

SEQ ID NO: 510809 - DNA, 25 bp, Rattus norvegicus
ccttggcgaagctgatgcgcacgct

SEQ ID NO: 510810 - DNA, 25 bp, Rattus norvegicus
atgaactgtcgcgagtagcagggtc

SEQ ID NO: 510811 - DNA, 25 bp, Rattus norvegicus
atctgtggttgttgaggaggatctc

SEQ ID NO: 510812 - DNA, 25 bp, Rattus norvegicus
ttgctgagcaggatgccaaaaccga

SEQ ID NO: 510813 - DNA, 25 bp, Rattus norvegicus
ggcagccgctttgctatctgtggtt

SEQ ID NO: 510814 - DNA, 25 bp, Rattus norvegicus
aaagcaattccgtctccaggtcccg

SEQ ID NO: 510815 - DNA, 25 bp, Rattus norvegicus
caccggcgaaacgatgctagagaca

SEQ ID NO: 510816 - DNA, 25 bp, Rattus norvegicus
ccttcaaaagttgcgcggctggtac

SEQ ID NO: 510817 - DNA, 25 bp, Rattus norvegicus
ctggtacaccaacacaaagcgcttg

SEQ ID NO: 510818 - DNA, 25 bp, Rattus norvegicus
cgctatgctacatgggctttccctg

SEQ ID NO: 510819 - DNA, 25 bp, Rattus norvegicus
ctgcaggatccgaaactaaggcttg

SEQ ID NO: 510820 - DNA, 25 bp, Rattus norvegicus
atgcttggatttgcacgcacgaaaa

SEQ ID NO: 510821 - DNA, 25 bp, Rattus norvegicus
cgcggcgctgattgttgcgcaaaca

SEQ ID NO: 510822 - DNA, 25 bp, Rattus norvegicus
agtctctcctgaacgcgggtgtcaa

SEQ ID NO: 510823 - DNA, 25 bp, Rattus norvegicus
cccaaagagctgctaggaatcctta

SEQ ID NO: 510824 - DNA, 25 bp, Rattus norvegicus
gagtcattggctgcctcccatcata

SEQ ID NO: 510825 - DNA, 25 bp, Rattus norvegicus
agtctagacactttggcggctccgc

SEQ ID NO: 510826 - DNA, 25 bp, Rattus norvegicus
gaacacgtcccattgctgagcccga

SEQ ID NO: 510827 - DNA, 25 bp, Rattus norvegicus
ctaaggcttgtggataactcccaga

SEQ ID NO: 510828 - DNA, 25 bp, Rattus norvegicus
ccgcggaagtaacagcggtataatc

SEQ ID NO: 510829 - DNA, 25 bp, Rattus norvegicus
gcggaagtaacagcggtataatcta

SEQ ID NO: 510830 - DNA, 25 bp, Rattus norvegicus
ggcccgcggaagtaacagcggtata

SEQ ID NO: 510831 - DNA, 25 bp, Rattus norvegicus
cactctgacgcctccaggggcccgc

SEQ ID NO: 510832 - DNA, 25 bp, Rattus norvegicus
tgttcactctgacgcctccaggggc

SEQ ID NO: 510833 - DNA, 25 bp, Rattus norvegicus
agtgttcactctgacgcctccaggg

SEQ ID NO: 510834 - DNA, 25 bp, Rattus norvegicus
cagtgttcactctgacgcctccagg

SEQ ID NO: 510835 - DNA, 25 bp, Rattus norvegicus
tccggggccaggctcagacatccgg

SEQ ID NO: 510836 - DNA, 25 bp, Rattus norvegicus
cggcagacagtgataaggcggctcc

SEQ ID NO: 510837 - DNA, 25 bp, Rattus norvegicus
gcacagctgagagccaggcggcggc

SEQ ID NO: 510838 - DNA, 25 bp, Rattus norvegicus
gagccggcacagctgagagccaggc

SEQ ID NO: 510839 - DNA, 25 bp, Rattus norvegicus
agccagctcggccagcgctcagccc

SEQ ID NO: 510840 - DNA, 25 bp, Rattus norvegicus
ggacccagagccagctcggccagcg

SEQ ID NO: 510841 - DNA, 25 bp, Rattus norvegicus
aggctcagacatccggccgctcggg

SEQ ID NO: 510842 - DNA, 25 bp, Rattus norvegicus
atccattgggagtcgcgagtcccgg

SEQ ID NO: 510843 - DNA, 25 bp, Rattus norvegicus
cgccggggccacaggggtgacggct

SEQ ID NO: 510844 - DNA, 25 bp, Rattus norvegicus
acgatccattgggagtcgcgagtcc

SEQ ID NO: 510845 - DNA, 25 bp, Rattus norvegicus
ggaggtaggctcagtcagccctcgc

SEQ ID NO: 510846 - DNA, 25 bp, Rattus norvegicus
ggtaggctcagtcagccctcgccag

SEQ ID NO: 510847 - DNA, 25 bp, Rattus norvegicus
ccagcacggcgtccgataaggcggc

SEQ ID NO: 510848 - DNA, 25 bp, Rattus norvegicus
aacgccaggtccctgagtgcgccag

SEQ ID NO: 510849 - DNA, 25 bp, Rattus norvegicus
ctcagtcagccctcgccagcacggc

SEQ ID NO: 510850 - DNA, 25 bp, Rattus norvegicus
ccggcgcccgagactgcgagacgcc

SEQ ID NO: 510851 - DNA, 25 bp, Rattus norvegicus
taacgcccggcgctccggcgcccga

SEQ ID NO: 510852 - DNA, 25 bp, Rattus norvegicus
cggagcgcagataacgcccggcgct

SEQ ID NO: 510853 - DNA, 25 bp, Rattus norvegicus
gctcggcccggagcgcagataacgc

SEQ ID NO: 510854 - DNA, 25 bp, Rattus norvegicus
cggctcggcccggagcgcagataac

SEQ ID NO: 510855 - DNA, 25 bp, Rattus norvegicus
ccaggtccctgagtgcgccaggtcg

SEQ ID NO: 510856 - DNA, 25 bp, Rattus norvegicus
cgcgcccagacgctgacatcagaga

SEQ ID NO: 510857 - DNA, 25 bp, Rattus norvegicus
agctaaactgaactgcgcgcccaga

SEQ ID NO: 510858 - DNA, 25 bp, Rattus norvegicus
ttgcggtgcagctaaactgaactgc

SEQ ID NO: 510859 - DNA, 25 bp, Rattus norvegicus
gctccattgcggtgcagctaaactg

SEQ ID NO: 510860 - DNA, 25 bp, Rattus norvegicus
cgatcgctccattgcggtgcagcta

SEQ ID NO: 510861 - DNA, 25 bp, Rattus norvegicus
atgcctctgtccgatcgctccattg

SEQ ID NO: 510862 - DNA, 25 bp, Rattus norvegicus
ttcaaacgcacccacatgcctctgt

SEQ ID NO: 510863 - DNA, 25 bp, Rattus norvegicus
ctcggctgcgcgattcaaacgcacc

SEQ ID NO: 510864 - DNA, 25 bp, Rattus norvegicus
agcataaaactcctcggctgcgcga

SEQ ID NO: 510865 - DNA, 25 bp, Rattus norvegicus
tcactgtagaagacgagcataaaac

SEQ ID NO: 510866 - DNA, 25 bp, Rattus norvegicus
cccgaccacaactcactgtagaaga

SEQ ID NO: 510867 - DNA, 25 bp, Rattus norvegicus
gagggacaagtactatcccattccc

SEQ ID NO: 510868 - DNA, 25 bp, Rattus norvegicus
gccgggagggacaagtactatccca

SEQ ID NO: 510869 - DNA, 25 bp, Rattus norvegicus
acgctgacatcagagagcatgaccc

SEQ ID NO: 510870 - DNA, 25 bp, Rattus norvegicus
cagcgcgcgccaagtagaaggcagc

SEQ ID NO: 510871 - DNA, 25 bp, Rattus norvegicus
agcaggtttaccttctgagcccacg

SEQ ID NO: 510872 - DNA, 25 bp, Rattus norvegicus
agtagacctcctccggtttagcagg

SEQ ID NO: 510873 - DNA, 25 bp, Rattus norvegicus
gagctccggtccactagtagacctc

SEQ ID NO: 510874 - DNA, 25 bp, Rattus norvegicus
cgcggcaagtagagctccggtccac

SEQ ID NO: 510875 - DNA, 25 bp, Rattus norvegicus
tcaaggtgagcgtgcagccctccag

SEQ ID NO: 510876 - DNA, 25 bp, Rattus norvegicus
accgtctcaaggtgagcgtgcagcc

SEQ ID NO: 510877 - DNA, 25 bp, Rattus norvegicus
tgaccaactgaaccgtctcaaggtg

SEQ ID NO: 510878 - DNA, 25 bp, Rattus norvegicus
aaggcagccctgcatgaccaactga

SEQ ID NO: 510879 - DNA, 25 bp, Rattus norvegicus
agaccctgctgcgtctaaaggcagc

SEQ ID NO: 510880 - DNA, 25 bp, Rattus norvegicus
ggtttaccttctgagcccacgtcca

SEQ ID NO: 510881 - DNA, 25 bp, Rattus norvegicus
catgttgagtcggttgcaggagctc

SEQ ID NO: 510882 - DNA, 25 bp, Rattus norvegicus
ccctcgctgatttcggtggtcggaa

SEQ ID NO: 510883 - DNA, 25 bp, Rattus norvegicus
gaggaagagaccctgctgcgtctaa

SEQ ID NO: 510884 - DNA, 25 bp, Rattus norvegicus
gctggtcccgttaaccgcggagcca

SEQ ID NO: 510885 - DNA, 25 bp, Rattus norvegicus
ggtcggtgagtcaggcacacaatca

SEQ ID NO: 510886 - DNA, 25 bp, Rattus norvegicus
tcaggcacacaatcagtgcttagtc

SEQ ID NO: 510887 - DNA, 25 bp, Rattus norvegicus
agtgcttagtcactgatagcctggc

SEQ ID NO: 510888 - DNA, 25 bp, Rattus norvegicus
atagcctggcggtaggagttcctcg

SEQ ID NO: 510889 - DNA, 25 bp, Rattus norvegicus
cactcggccgagctggtcccgttaa

SEQ ID NO: 510890 - DNA, 25 bp, Rattus norvegicus
tcagcgcacgctttccttgggctcg

SEQ ID NO: 510891 - DNA, 25 bp, Rattus norvegicus
gcgtcggcttcttcttgggcatctt

SEQ ID NO: 510892 - DNA, 25 bp, Rattus norvegicus
ttgggcatcttgcagccgggaaaca

SEQ ID NO: 510893 - DNA, 25 bp, Rattus norvegicus
cgggaaacagcctgcaactcagcag

SEQ ID NO: 510894 - DNA, 25 bp, Rattus norvegicus
cctgcaactcagcagggagcgcgcg

SEQ ID NO: 510895 - DNA, 25 bp, Rattus norvegicus
caacccacgcggagaactagctgcg

SEQ ID NO: 510896 - DNA, 25 bp, Rattus norvegicus
cggagaactagctgcgcgcgctcgc

SEQ ID NO: 510897 - DNA, 25 bp, Rattus norvegicus
ggccgtacgtgacggagcctagcct

SEQ ID NO: 510898 - DNA, 25 bp, Rattus norvegicus
gcccagactgctttgctcgcttcgg

SEQ ID NO: 510899 - DNA, 25 bp, Rattus norvegicus
ttctcccgcttctgcagcatgctgg

SEQ ID NO: 510900 - DNA, 25 bp, Rattus norvegicus
ccctggaaggtcctcagcagcagca

SEQ ID NO: 510901 - DNA, 25 bp, Rattus norvegicus
gatcctcagcgtccggccctggaag

SEQ ID NO: 510902 - DNA, 25 bp, Rattus norvegicus
atagtgttcgcgcacgatcctcagc

SEQ ID NO: 510903 - DNA, 25 bp, Rattus norvegicus
tgggccgcagatagtgttcgcgcac

SEQ ID NO: 510904 - DNA, 25 bp, Rattus norvegicus
ctgttgcaaggtacgctgggccgca

SEQ ID NO: 510905 - DNA, 25 bp, Rattus norvegicus
tgggtccggcttccttcactagggc

SEQ ID NO: 510906 - DNA, 25 bp, Rattus norvegicus
gcttcggctgcctacggtccgcgag

SEQ ID NO: 510907 - DNA, 25 bp, Rattus norvegicus
tcctgggctgcccagactgctttgc

SEQ ID NO: 510908 - DNA, 25 bp, Rattus norvegicus
gcactgcggacgctccagggcgtct

SEQ ID NO: 510909 - DNA, 25 bp, Rattus norvegicus
atcactaggaaggacgaccggacgc

SEQ ID NO: 510910 - DNA, 25 bp, Rattus norvegicus
acaagctgcggctctccggtctcgt

SEQ ID NO: 510911 - DNA, 25 bp, Rattus norvegicus
tgctgtctgcttccgatcactagga

SEQ ID NO: 510912 - DNA, 25 bp, Rattus norvegicus
gctctcgagaaaaccggtccaagtg

SEQ ID NO: 510913 - DNA, 25 bp, Rattus norvegicus
gaaggaacctgccagctctgcatga

SEQ ID NO: 510914 - DNA, 25 bp, Rattus norvegicus
cggtgccacgcgcaacgtgaactca

SEQ ID NO: 510915 - DNA, 25 bp, Rattus norvegicus
aaggaatcccggacactctgcagtc

SEQ ID NO: 510916 - DNA, 25 bp, Rattus norvegicus
tcccggccgagagccattctagatg

SEQ ID NO: 510917 - DNA, 25 bp, Rattus norvegicus
ctctgcatgaatctggggtctcccg

SEQ ID NO: 510918 - DNA, 25 bp, Rattus norvegicus
cccactgtcgtagcgtctcagaatc

SEQ ID NO: 510919 - DNA, 25 bp, Rattus norvegicus
caccatccgtctgtagtctgggagc

SEQ ID NO: 510920 - DNA, 25 bp, Rattus norvegicus
gcagccaccttcctctaagacttga

SEQ ID NO: 510921 - DNA, 25 bp, Rattus norvegicus
tcacagtggtcctagcggcaaccct

SEQ ID NO: 510922 - DNA, 25 bp, Rattus norvegicus
cccaatcgcgagcagtagtgttgta

SEQ ID NO: 510923 - DNA, 25 bp, Rattus norvegicus
ttctagatgtgctggaccttcgccc

SEQ ID NO: 510924 - DNA, 25 bp, Rattus norvegicus
gatgacatacctccgacccttggtg

SEQ ID NO: 510925 - DNA, 25 bp, Rattus norvegicus
cccgcaggtcgtccctgatgacata

SEQ ID NO: 510926 - DNA, 25 bp, Rattus norvegicus
cgtcattcgagacagggagaggcgc

SEQ ID NO: 510927 - DNA, 25 bp, Rattus norvegicus
cgatgtagctagcaaagcggtcatt

SEQ ID NO: 510928 - DNA, 25 bp, Rattus norvegicus
gcggtcattgagctccatcatctcc

SEQ ID NO: 510929 - DNA, 25 bp, Rattus norvegicus
ggaccttctcgatgtagctagcaaa

SEQ ID NO: 510930 - DNA, 25 bp, Rattus norvegicus
catcatctccgcacgctcgctggcc

SEQ ID NO: 510931 - DNA, 25 bp, Rattus norvegicus
gctggcccgagtctctttgaagccg

SEQ ID NO: 510932 - DNA, 25 bp, Rattus norvegicus
cgagtctctttgaagccggcattga

SEQ ID NO: 510933 - DNA, 25 bp, Rattus norvegicus
cccggccagggagaagtctaccctg

SEQ ID NO: 510934 - DNA, 25 bp, Rattus norvegicus
cggaatggtacccaggtgtctggta

SEQ ID NO: 510935 - DNA, 25 bp, Rattus norvegicus
tacccaggtgtctggtaggaccatg

SEQ ID NO: 510936 - DNA, 25 bp, Rattus norvegicus
caggtgtctggtaggaccatggccc

SEQ ID NO: 510937 - DNA, 25 bp, Rattus norvegicus
ccctgaccatcgtctcggaggaggc

SEQ ID NO: 510938 - DNA, 25 bp, Rattus norvegicus
ccatcgtctcggaggaggcatagga

SEQ ID NO: 510939 - DNA, 25 bp, Rattus norvegicus
cggcgtgcagaggtgatacgtctcc

SEQ ID NO: 510940 - DNA, 25 bp, Rattus norvegicus
tgagctgctgggagcgctgacgcag

SEQ ID NO: 510941 - DNA, 25 bp, Rattus norvegicus
tgcacagcggcgattccccggctga

SEQ ID NO: 510942 - DNA, 25 bp, Rattus norvegicus
gctgtccagtgctgaccaccgttgc

SEQ ID NO: 510943 - DNA, 25 bp, Rattus norvegicus
ccggctgaactctgatctttcgggc

SEQ ID NO: 510944 - DNA, 25 bp, Rattus norvegicus
cggctgaactctgatctttcgggct

SEQ ID NO: 510945 - DNA, 25 bp, Rattus norvegicus
gctgaactctgatctttcgggctga

SEQ ID NO: 510946 - DNA, 25 bp, Rattus norvegicus
tgaactctgatctttcgggctgagg

SEQ ID NO: 510947 - DNA, 25 bp, Rattus norvegicus
aactctgatctttcgggctgagggg

SEQ ID NO: 510948 - DNA, 25 bp, Rattus norvegicus
tgggcagaacctgtcggcgccgccc

SEQ ID NO: 510949 - DNA, 25 bp, Rattus norvegicus
ctgggagcgctgacgcagagcgccg

SEQ ID NO: 510950 - DNA, 25 bp, Rattus norvegicus
cccagggtgctcggaccagagcctg

SEQ ID NO: 510951 - DNA, 25 bp, Rattus norvegicus
tgtccagtgctgaccaccgttgcct

SEQ ID NO: 510952 - DNA, 25 bp, Rattus norvegicus
gctgaccaccgttgcctccgagccc

SEQ ID NO: 510953 - DNA, 25 bp, Rattus norvegicus
ggccaccttaggagctgtccagtgc

SEQ ID NO: 510954 - DNA, 25 bp, Rattus norvegicus
agcggaacaagcctgcgcctcagcg

SEQ ID NO: 510955 - DNA, 25 bp, Rattus norvegicus
gcggtgtctttgtagttggcccgtc

SEQ ID NO: 510956 - DNA, 25 bp, Rattus norvegicus
ctgtggctttctttctctcggcgca

SEQ ID NO: 510957 - DNA, 25 bp, Rattus norvegicus
cctaccgaggtgctcaggcaagacc

SEQ ID NO: 510958 - DNA, 25 bp, Rattus norvegicus
tgccgcacgtacacctaccgaggtg

SEQ ID NO: 510959 - DNA, 25 bp, Rattus norvegicus
gggccggccctcttggcttacgtca

SEQ ID NO: 510960 - DNA, 25 bp, Rattus norvegicus
cgccttctgaaaggagcgctgcctc

SEQ ID NO: 510961 - DNA, 25 bp, Rattus norvegicus
tgaagcacctcctcagtccgcaatg

SEQ ID NO: 510962 - DNA, 25 bp, Rattus norvegicus
ccactgacaggagagtcactcactc

SEQ ID NO: 510963 - DNA, 25 bp, Rattus norvegicus
acacgatgggccgtgccactgacag

SEQ ID NO: 510964 - DNA, 25 bp, Rattus norvegicus
cgtccgccacgcgatgaacacgatg

SEQ ID NO: 510965 - DNA, 25 bp, Rattus norvegicus
tcagcgtggtgactctcgaacccgc

SEQ ID NO: 510966 - DNA, 25 bp, Rattus norvegicus
gacagccgttccctggggcaacttc

SEQ ID NO: 510967 - DNA, 25 bp, Rattus norvegicus
gcctaggaccggcttgcgaaggccc

SEQ ID NO: 510968 - DNA, 25 bp, Rattus norvegicus
ggtactcacggcaagggctgccagc

SEQ ID NO: 510969 - DNA, 25 bp, Rattus norvegicus
gcgagtgcctctgcgcaccaggcta

SEQ ID NO: 510970 - DNA, 25 bp, Rattus norvegicus
gcgcactggcgagtgcctctgcgca

SEQ ID NO: 510971 - DNA, 25 bp, Rattus norvegicus
tgtcagtgccaccacggcgctagct

SEQ ID NO: 510972 - DNA, 25 bp, Rattus norvegicus
gctgccagctgctctgtcagtgcca

SEQ ID NO: 510973 - DNA, 25 bp, Rattus norvegicus
gcccggtactcacggcaagggctgc

SEQ ID NO: 510974 - DNA, 25 bp, Rattus norvegicus
gtgaggaattctgcgcgcccggtac

SEQ ID NO: 510975 - DNA, 25 bp, Rattus norvegicus
tatcaccggcgcctgcgtatgcgcc

SEQ ID NO: 510976 - DNA, 25 bp, Rattus norvegicus
tgtgcaaccctatcaccggcgcctg

SEQ ID NO: 510977 - DNA, 25 bp, Rattus norvegicus
aacggcgccttgtgcaaccctatca

SEQ ID NO: 510978 - DNA, 25 bp, Rattus norvegicus
tcagaacggcgccttgtgcaaccct

SEQ ID NO: 510979 - DNA, 25 bp, Rattus norvegicus
tgtcagtgtcagaacggcgccttgt

SEQ ID NO: 510980 - DNA, 25 bp, Rattus norvegicus
gcgctgtgaggaattctgcgcgccc

SEQ ID NO: 510981 - DNA, 25 bp, Rattus norvegicus
agctgctctgtcagtgccaccacgg

SEQ ID NO: 510982 - DNA, 25 bp, Rattus norvegicus
acacgcgggaacacgcgcggtccgc

SEQ ID NO: 510983 - DNA, 25 bp, Rattus norvegicus
ttcccggctcagtgcgaaactccgg

SEQ ID NO: 510984 - DNA, 25 bp, Rattus norvegicus
tctcattcccggctcagtgcgaaac

SEQ ID NO: 510985 - DNA, 25 bp, Rattus norvegicus
tgggaccgcatgaagcacgcacacc

SEQ ID NO: 510986 - DNA, 25 bp, Rattus norvegicus
gacggtatgtgtcgggtgttccgaa

SEQ ID NO: 510987 - DNA, 25 bp, Rattus norvegicus
tcacactgcggtgcgtttgtcctgg

SEQ ID NO: 510988 - DNA, 25 bp, Rattus norvegicus
ttcacctcacactgcggtgcgtttg

SEQ ID NO: 510989 - DNA, 25 bp, Rattus norvegicus
tggtttcctgcgtcgcgggctccag

SEQ ID NO: 510990 - DNA, 25 bp, Rattus norvegicus
tggccctcgtggcattcggggtccc

SEQ ID NO: 510991 - DNA, 25 bp, Rattus norvegicus
tggcctcttccctgctgcggcccag

SEQ ID NO: 510992 - DNA, 25 bp, Rattus norvegicus
ctggattcggcttcccggcggcaga

SEQ ID NO: 510993 - DNA, 25 bp, Rattus norvegicus
gttagggagctggattcggcttccc

SEQ ID NO: 510994 - DNA, 25 bp, Rattus norvegicus
gccccctagcgtttaagagaatctc

SEQ ID NO: 510995 - DNA, 25 bp, Rattus norvegicus
cgcgacgcgagggtctcctcacccg

SEQ ID NO: 510996 - DNA, 25 bp, Rattus norvegicus
taaagaggtagtcgtactcgtcgtc

SEQ ID NO: 510997 - DNA, 25 bp, Rattus norvegicus
gagacgcccgaaggaactgcaccgc

SEQ ID NO: 510998 - DNA, 25 bp, Rattus norvegicus
cccaggcggactctgtcctgggcag

SEQ ID NO: 510999 - DNA, 25 bp, Rattus norvegicus
ccgggagtgtctccggccccaaatg

SEQ ID NO: 511000 - DNA, 25 bp, Rattus norvegicus
cccaaatgggctatcggtggtccac

SEQ ID NO: 511001 - DNA, 25 bp, Rattus norvegicus
ggctatcggtggtccacggcctcac

SEQ ID NO: 511002 - DNA, 25 bp, Rattus norvegicus
cacggcctcacctttaaagaggtag

SEQ ID NO: 511003 - DNA, 25 bp, Rattus norvegicus
tcgctgcaggggtaacccgagcgaa

SEQ ID NO: 511004 - DNA, 25 bp, Rattus norvegicus
agtcgtactcgtcgtcgcgggtgcc

SEQ ID NO: 511005 - DNA, 25 bp, Rattus norvegicus
gcgccgcggcctgacaggcctccca

SEQ ID NO: 511006 - DNA, 25 bp, Rattus norvegicus
cgaaggaactgcaccgccgtgagga

SEQ ID NO: 511007 - DNA, 25 bp, Rattus norvegicus
acccgagcgaagagcttgagcggcc

SEQ ID NO: 511008 - DNA, 25 bp, Rattus norvegicus
caggggtaacccgagcgaagagctt

SEQ ID NO: 511009 - DNA, 25 bp, Rattus norvegicus
tggtccacggcctcacctttaaaga

SEQ ID NO: 511010 - DNA, 25 bp, Rattus norvegicus
ggggtgtcctttcagactggccatt

SEQ ID NO: 511011 - DNA, 25 bp, Rattus norvegicus
tcagactggccattcggtgctgcct

SEQ ID NO: 511012 - DNA, 25 bp, Rattus norvegicus
tcctgaggctgggattttgacaagc

SEQ ID NO: 511013 - DNA, 25 bp, Rattus norvegicus
tgacaagcccgttacgtaaggttgc

SEQ ID NO: 511014 - DNA, 25 bp, Rattus norvegicus
tacgtaaggttgcttcctggaatcc

SEQ ID NO: 511015 - DNA, 25 bp, Rattus norvegicus
tggaatcccacctgctctgggtttc

SEQ ID NO: 511016 - DNA, 25 bp, Rattus norvegicus
gcaagggctcaggttccacgtgagc

SEQ ID NO: 511017 - DNA, 25 bp, Rattus norvegicus
acatagggagctgtcacggccctga

SEQ ID NO: 511018 - DNA, 25 bp, Rattus norvegicus
catctcgggctcttcccggtgcttg

SEQ ID NO: 511019 - DNA, 25 bp, Rattus norvegicus
gtgagtggataggatcccgcatctc

SEQ ID NO: 511020 - DNA, 25 bp, Rattus norvegicus
tttaccgtcactcccaagatggcgc

SEQ ID NO: 511021 - DNA, 25 bp, Rattus norvegicus
ctcgggtcaggctaagcctgtgatt

SEQ ID NO: 511022 - DNA, 25 bp, Rattus norvegicus
ggacgccgagccaggctaaggactc

SEQ ID NO: 511023 - DNA, 25 bp, Rattus norvegicus
cctgtgattggtttttgtggccata

SEQ ID NO: 511024 - DNA, 25 bp, Rattus norvegicus
tctctgggcgctggttccaaggcct

SEQ ID NO: 511025 - DNA, 25 bp, Rattus norvegicus
ctccgggtaagtcagggaatctgtg

SEQ ID NO: 511026 - DNA, 25 bp, Rattus norvegicus
tttcttgtaagcagcgagatttcgc

SEQ ID NO: 511027 - DNA, 25 bp, Rattus norvegicus
tttaagcagacggacagaggctgga

SEQ ID NO: 511028 - DNA, 25 bp, Rattus norvegicus
aatctgtgtgttgagggctgtgttt

SEQ ID NO: 511029 - DNA, 25 bp, Rattus norvegicus
gggttacaggggaaggaacagcata

SEQ ID NO: 511030 - DNA, 25 bp, Rattus norvegicus
cggaaggtttaagcagacggacaga

SEQ ID NO: 511031 - DNA, 25 bp, Rattus norvegicus
gcgcggcccttaagttccggctatg

SEQ ID NO: 511032 - DNA, 25 bp, Rattus norvegicus
tggttccaaggcctgcgaccgacct

SEQ ID NO: 511033 - DNA, 25 bp, Rattus norvegicus
ttccctctgtgtggcccaggtcttc

SEQ ID NO: 511034 - DNA, 25 bp, Rattus norvegicus
cccaggtcttcagcgtgtttcttgt

SEQ ID NO: 511035 - DNA, 25 bp, Rattus norvegicus
cttcagcgtgtttcttgtaagcagc

SEQ ID NO: 511036 - DNA, 25 bp, Rattus norvegicus
cttaagttccggctatggcgcgtgg

SEQ ID NO: 511037 - DNA, 25 bp, Rattus norvegicus
taagcagcgagatttcgcgcttggg

SEQ ID NO: 511038 - DNA, 25 bp, Rattus norvegicus
ggccactgtcaagccacactttaga

SEQ ID NO: 511039 - DNA, 25 bp, Rattus norvegicus
cagcctccaggacaccgctgtggtt

SEQ ID NO: 511040 - DNA, 25 bp, Rattus norvegicus
gggtgtcgatttccatcactgaacg

SEQ ID NO: 511041 - DNA, 25 bp, Rattus norvegicus
tgacgtccagccacggcctaacagg

SEQ ID NO: 511042 - DNA, 25 bp, Rattus norvegicus
gccacactttagatccacggagctc

SEQ ID NO: 511043 - DNA, 25 bp, Rattus norvegicus
cggagctcatcccacaactcagagg

SEQ ID NO: 511044 - DNA, 25 bp, Rattus norvegicus
ttgggatccgaagcgttcctgctca

SEQ ID NO: 511045 - DNA, 25 bp, Rattus norvegicus
ctagcgggcacaccacgtgattagc

SEQ ID NO: 511046 - DNA, 25 bp, Rattus norvegicus
cggctgtctcgagatgctccacgct

SEQ ID NO: 511047 - DNA, 25 bp, Rattus norvegicus
ttacctccgcctatgagccgctgga

SEQ ID NO: 511048 - DNA, 25 bp, Rattus norvegicus
cggcgtcagcacttgagtctccatg

SEQ ID NO: 511049 - DNA, 25 bp, Rattus norvegicus
atacagctcgcggtgtcgctgagcc

SEQ ID NO: 511050 - DNA, 25 bp, Rattus norvegicus
tgcctaccaggaacaaaggggatac

SEQ ID NO: 511051 - DNA, 25 bp, Rattus norvegicus
ccagcgactggccttgagaacgtca

SEQ ID NO: 511052 - DNA, 25 bp, Rattus norvegicus
ggccgctagccttcctctgtcggag

SEQ ID NO: 511053 - DNA, 25 bp, Rattus norvegicus
gaggccgccaacgttcgctaggcgc

SEQ ID NO: 511054 - DNA, 25 bp, Rattus norvegicus
ctctgattgcgaggccgccaacgtt

SEQ ID NO: 511055 - DNA, 25 bp, Rattus norvegicus
aagaggaagcgcacactctgattgc

SEQ ID NO: 511056 - DNA, 25 bp, Rattus norvegicus
ggaaggtgcagtatccgcccgctct

SEQ ID NO: 511057 - DNA, 25 bp, Rattus norvegicus
cgctccatagcgcatcgggacggtc

SEQ ID NO: 511058 - DNA, 25 bp, Rattus norvegicus
tgaagcggcgtaggcccgctccata

SEQ ID NO: 511059 - DNA, 25 bp, Rattus norvegicus
gaggcctccggtgctgtcttctccg

SEQ ID NO: 511060 - DNA, 25 bp, Rattus norvegicus
catcctttcttggtccggccgctag

SEQ ID NO: 511061 - DNA, 25 bp, Rattus norvegicus
tcggactcgcacgtccgttatcttg

SEQ ID NO: 511062 - DNA, 25 bp, Rattus norvegicus
cggaggtgagagtcatcctttcttg

SEQ ID NO: 511063 - DNA, 25 bp, Rattus norvegicus
agtcccttcgttcgccgcctgggtg

SEQ ID NO: 511064 - DNA, 25 bp, Rattus norvegicus
taagacagtccatttggcgcgcctc

SEQ ID NO: 511065 - DNA, 25 bp, Rattus norvegicus
cgttatcttgatagagcctggctcg

SEQ ID NO: 511066 - DNA, 25 bp, Rattus norvegicus
ctgcactggctgcacgacggggccc

SEQ ID NO: 511067 - DNA, 25 bp, Rattus norvegicus
aaggcaacgccgctgagcagctccg

SEQ ID NO: 511068 - DNA, 25 bp, Rattus norvegicus
cgactcgggtcaaggcaacgccgct

SEQ ID NO: 511069 - DNA, 25 bp, Rattus norvegicus
agaacagcgcgggaaccgcctgtgc

SEQ ID NO: 511070 - DNA, 25 bp, Rattus norvegicus
ctaccagtgcgtagcggagaacagc

SEQ ID NO: 511071 - DNA, 25 bp, Rattus norvegicus
ctggttactaccagtgcgtagcgga

SEQ ID NO: 511072 - DNA, 25 bp, Rattus norvegicus
tcggcctgcaggactctggttacta

SEQ ID NO: 511073 - DNA, 25 bp, Rattus norvegicus
ctcagatcggcctgcaggactctgg

SEQ ID NO: 511074 - DNA, 25 bp, Rattus norvegicus
cttggtcatcactcagatcggcctg

SEQ ID NO: 511075 - DNA, 25 bp, Rattus norvegicus
cgttgcgacccaacgggcgcgtcaa

SEQ ID NO: 511076 - DNA, 25 bp, Rattus norvegicus
ggagccacgacctacgctgcactgg

SEQ ID NO: 511077 - DNA, 25 bp, Rattus norvegicus
agcactgcgcgcttcgtttgccgcg

SEQ ID NO: 511078 - DNA, 25 bp, Rattus norvegicus
gctgtcgcggaccagggccagcact

SEQ ID NO: 511079 - DNA, 25 bp, Rattus norvegicus
cggcagcttggtcatcactcagatc

SEQ ID NO: 511080 - DNA, 25 bp, Rattus norvegicus
gagcccagcggaccgagagaccgat

SEQ ID NO: 511081 - DNA, 25 bp, Rattus norvegicus
agagaccgatggctgagccgcgcac

SEQ ID NO: 511082 - DNA, 25 bp, Rattus norvegicus
ctacctgtgccaagcctgggtgagc

SEQ ID NO: 511083 - DNA, 25 bp, Rattus norvegicus
actccgcctgggctgccagtagttt

SEQ ID NO: 511084 - DNA, 25 bp, Rattus norvegicus
tagtttgaaggactgcgggagatta

SEQ ID NO: 511085 - DNA, 25 bp, Rattus norvegicus
ctcaggatggttcagggcaggaccc

SEQ ID NO: 511086 - DNA, 25 bp, Rattus norvegicus
ctggcattgcggattggaggaaaca

SEQ ID NO: 511087 - DNA, 25 bp, Rattus norvegicus
tggaggaaacaagcccgaggagaaa

SEQ ID NO: 511088 - DNA, 25 bp, Rattus norvegicus
cgagtcccaacagaggaaggcgatc

SEQ ID NO: 511089 - DNA, 25 bp, Rattus norvegicus
ggaccctgagtagcccgaggcgaac

SEQ ID NO: 511090 - DNA, 25 bp, Rattus norvegicus
cccgaggcgaacgaagccggaagca

SEQ ID NO: 511091 - DNA, 25 bp, Rattus norvegicus
ccggaagcagcagatcagggtccca

SEQ ID NO: 511092 - DNA, 25 bp, Rattus norvegicus
cgggaccctgtgagcccgtgagact

SEQ ID NO: 511093 - DNA, 25 bp, Rattus norvegicus
ctactgttgccgctacctgtgccaa

SEQ ID NO: 511094 - DNA, 25 bp, Rattus norvegicus
atcaaaccctcgtttggcgtgcgag

SEQ ID NO: 511095 - DNA, 25 bp, Rattus norvegicus
gtgaagcagatggtcccacttactc

SEQ ID NO: 511096 - DNA, 25 bp, Rattus norvegicus
cacaaagcaatgacctcggaggagt

SEQ ID NO: 511097 - DNA, 25 bp, Rattus norvegicus
atggggagcttgacacaaagcaatg

SEQ ID NO: 511098 - DNA, 25 bp, Rattus norvegicus
tgagtcccgggagtcaaagggcaaa

SEQ ID NO: 511099 - DNA, 25 bp, Rattus norvegicus
tctctccctttgagtcccgggagtc

SEQ ID NO: 511100 - DNA, 25 bp, Rattus norvegicus
ctttcatcagaacctcaagtgcttc

SEQ ID NO: 511101 - DNA, 25 bp, Rattus norvegicus
cttgcgctctggctgcggagattcc

SEQ ID NO: 511102 - DNA, 25 bp, Rattus norvegicus
gcagctgcggccacttcaaaggggc

SEQ ID NO: 511103 - DNA, 25 bp, Rattus norvegicus
ggattctctcattcacccgcggtgg

SEQ ID NO: 511104 - DNA, 25 bp, Rattus norvegicus
tcgccttgcacaatgtcggattctc

SEQ ID NO: 511105 - DNA, 25 bp, Rattus norvegicus
tgtcttattttctccattcgccttg

SEQ ID NO: 511106 - DNA, 25 bp, Rattus norvegicus
ttactcctgccgctgagcgagcgag

SEQ ID NO: 511107 - DNA, 25 bp, Rattus norvegicus
gcgtgcgaggacaatggctgtctta

SEQ ID NO: 511108 - DNA, 25 bp, Rattus norvegicus
tgagctggcgtccttccgtaacgtg

SEQ ID NO: 511109 - DNA, 25 bp, Rattus norvegicus
atatcggtggagagaggcgcggtaa

SEQ ID NO: 511110 - DNA, 25 bp, Rattus norvegicus
ctggcgtccttccgtaacgtgggct

SEQ ID NO: 511111 - DNA, 25 bp, Rattus norvegicus
tatcggtggagagaggcgcggtaat

SEQ ID NO: 511112 - DNA, 25 bp, Rattus norvegicus
gcgcggtaatgagctggcgtccttc

SEQ ID NO: 511113 - DNA, 25 bp, Rattus norvegicus
cgcggtaatgagctggcgtccttcc

SEQ ID NO: 511114 - DNA, 25 bp, Rattus norvegicus
gcggtaatgagctggcgtccttccg

SEQ ID NO: 511115 - DNA, 25 bp, Rattus norvegicus
cggtaatgagctggcgtccttccgt

SEQ ID NO: 511116 - DNA, 25 bp, Rattus norvegicus
taatgagctggcgtccttccgtaac

SEQ ID NO: 511117 - DNA, 25 bp, Rattus norvegicus
agctggcgtccttccgtaacgtggg

SEQ ID NO: 511118 - DNA, 25 bp, Rattus norvegicus
atgagctggcgtccttccgtaacgt

SEQ ID NO: 511119 - DNA, 25 bp, Rattus norvegicus
gagctggcgtccttccgtaacgtgg

SEQ ID NO: 511120 - DNA, 25 bp, Rattus norvegicus
gctggcgtccttccgtaacgtgggc

SEQ ID NO: 511121 - DNA, 25 bp, Rattus norvegicus
aatgagctggcgtccttccgtaacg

SEQ ID NO: 511122 - DNA, 25 bp, Rattus norvegicus
ggtcctggcactttgaaataagagt

SEQ ID NO: 511123 - DNA, 25 bp, Rattus norvegicus
gggtcctggcactttgaaataagag

SEQ ID NO: 511124 - DNA, 25 bp, Rattus norvegicus
cgccggctgttgctccggcagcgca

SEQ ID NO: 511125 - DNA, 25 bp, Rattus norvegicus
agcgcagggctcagcccgccacgct

SEQ ID NO: 511126 - DNA, 25 bp, Rattus norvegicus
cctccagatggtgctgtcctgcgcg

SEQ ID NO: 511127 - DNA, 25 bp, Rattus norvegicus
tccagatggtgctgtcctgcgcgcc

SEQ ID NO: 511128 - DNA, 25 bp, Rattus norvegicus
cagatggtgctgtcctgcgcgccct

SEQ ID NO: 511129 - DNA, 25 bp, Rattus norvegicus
gatggtgctgtcctgcgcgccctcg

SEQ ID NO: 511130 - DNA, 25 bp, Rattus norvegicus
gccctcgccgcccacagtcgacctc

SEQ ID NO: 511131 - DNA, 25 bp, Rattus norvegicus
cgcccacagtcgacctcggccaccc

SEQ ID NO: 511132 - DNA, 25 bp, Rattus norvegicus
gggcccactgggatcgctccgccct

SEQ ID NO: 511133 - DNA, 25 bp, Rattus norvegicus
gcccactgggatcgctccgccctct

SEQ ID NO: 511134 - DNA, 25 bp, Rattus norvegicus
agggtcctggcactttgaaataaga

SEQ ID NO: 511135 - DNA, 25 bp, Rattus norvegicus
gtcctggcactttgaaataagagtc

SEQ ID NO: 511136 - DNA, 25 bp, Rattus norvegicus
ctctagacccgggaccctgggactg

SEQ ID NO: 511137 - DNA, 25 bp, Rattus norvegicus
atcggtttcctcctagggctgtggc

SEQ ID NO: 511138 - DNA, 25 bp, Rattus norvegicus
taaggacttcgaggccctggtgagt

SEQ ID NO: 511139 - DNA, 25 bp, Rattus norvegicus
cggtgcaatagccactcctctagac

SEQ ID NO: 511140 - DNA, 25 bp, Rattus norvegicus
gtgagttcgtcctgatccaccgttg

SEQ ID NO: 511141 - DNA, 25 bp, Rattus norvegicus
agatcccgtgtttcccgtactgagc

SEQ ID NO: 511142 - DNA, 25 bp, Rattus norvegicus
actgagcgaccgagcccagtgtcct

SEQ ID NO: 511143 - DNA, 25 bp, Rattus norvegicus
agtgtcctgcagaggacgctcgcca

SEQ ID NO: 511144 - DNA, 25 bp, Rattus norvegicus
gccagcgcgtttctcatcactgtta

SEQ ID NO: 511145 - DNA, 25 bp, Rattus norvegicus
acgagcccgggatgcagctctccaa

SEQ ID NO: 511146 - DNA, 25 bp, Rattus norvegicus
agctctccaacagggcggcagccag

SEQ ID NO: 511147 - DNA, 25 bp, Rattus norvegicus
cgctgcagagctacaagcgggactc

SEQ ID NO: 511148 - DNA, 25 bp, Rattus norvegicus
acgcccgccacgactgtaaggactt

SEQ ID NO: 511149 - DNA, 25 bp, Rattus norvegicus
caggatattaccctagcccggtgca

SEQ ID NO: 511150 - DNA, 25 bp, Rattus norvegicus
aactttgggttcactgcttgccgta

SEQ ID NO: 511151 - DNA, 25 bp, Rattus norvegicus
ggcctgactgcctagtgggaaaaac

SEQ ID NO: 511152 - DNA, 25 bp, Rattus norvegicus
agcgtaacactcgagcggcacaatc

SEQ ID NO: 511153 - DNA, 25 bp, Rattus norvegicus
cctctcgatcatcagggcgcgaagc

SEQ ID NO: 511154 - DNA, 25 bp, Rattus norvegicus
ctccgcgcagagaggtaacgaagta

SEQ ID NO: 511155 - DNA, 25 bp, Rattus norvegicus
cctacttgaggcctgtcacttttgg

SEQ ID NO: 511156 - DNA, 25 bp, Rattus norvegicus
cacttttggggagtcactacgtgcc

SEQ ID NO: 511157 - DNA, 25 bp, Rattus norvegicus
tacgtgccctgttgtccgactagtt

SEQ ID NO: 511158 - DNA, 25 bp, Rattus norvegicus
ggcacgcaagggtgtcactgtcatt

SEQ ID NO: 511159 - DNA, 25 bp, Rattus norvegicus
tcactgtcattgtgcggtcggcgac

SEQ ID NO: 511160 - DNA, 25 bp, Rattus norvegicus
acgttagtcttcacgcatgcgcagc

SEQ ID NO: 511161 - DNA, 25 bp, Rattus norvegicus
gacatttggcaaacttggggtccca

SEQ ID NO: 511162 - DNA, 25 bp, Rattus norvegicus
agctcgctggccttccagacatttg

SEQ ID NO: 511163 - DNA, 25 bp, Rattus norvegicus
tcggcgacgataggacgtaaacaca

SEQ ID NO: 511164 - DNA, 25 bp, Rattus norvegicus
gctgcacccgaagaagcatctggtt

SEQ ID NO: 511165 - DNA, 25 bp, Rattus norvegicus
gcgccaccgccttaccgtgttggaa

SEQ ID NO: 511166 - DNA, 25 bp, Rattus norvegicus
ctatggcgaccgcttcaggctcagg

SEQ ID NO: 511167 - DNA, 25 bp, Rattus norvegicus
ctggttcccgtcgtccaagaagttg

SEQ ID NO: 511168 - DNA, 25 bp, Rattus norvegicus
caagaagttgttcacctccgggcaa

SEQ ID NO: 511169 - DNA, 25 bp, Rattus norvegicus
ccgggcaattgctcaacggggtctg

SEQ ID NO: 511170 - DNA, 25 bp, Rattus norvegicus
gctccggtctcagtccgaagtaatt

SEQ ID NO: 511171 - DNA, 25 bp, Rattus norvegicus
tccgaagtaattctgggtggtcgta

SEQ ID NO: 511172 - DNA, 25 bp, Rattus norvegicus
agtttacggacatcgctgaggcttc

SEQ ID NO: 511173 - DNA, 25 bp, Rattus norvegicus
aggcttcccgccatggcctcagaga

SEQ ID NO: 511174 - DNA, 25 bp, Rattus norvegicus
ctctggcctcactactacacttggt

SEQ ID NO: 511175 - DNA, 25 bp, Rattus norvegicus
tggtagttgccaaggtccgttgcta

SEQ ID NO: 511176 - DNA, 25 bp, Rattus norvegicus
ccgtgttggaaaaggccagcccagc

SEQ ID NO: 511177 - DNA, 25 bp, Rattus norvegicus
aaggctgaggattgctgcgctcatc

SEQ ID NO: 511178 - DNA, 25 bp, Rattus norvegicus
gcctccgcaccggtctgcttccctc

SEQ ID NO: 511179 - DNA, 25 bp, Rattus norvegicus
aagatccgcccatcctggctagctg

SEQ ID NO: 511180 - DNA, 25 bp, Rattus norvegicus
cagtccagtgcctccaagatccgcc

SEQ ID NO: 511181 - DNA, 25 bp, Rattus norvegicus
gcggtcagtgcccagtccagtgcct

SEQ ID NO: 511182 - DNA, 25 bp, Rattus norvegicus
actggcgcggtcagtgcccagtcca

SEQ ID NO: 511183 - DNA, 25 bp, Rattus norvegicus
agtactggcgcggtcagtgcccagt

SEQ ID NO: 511184 - DNA, 25 bp, Rattus norvegicus
gaactccctagtactggcgcggtca

SEQ ID NO: 511185 - DNA, 25 bp, Rattus norvegicus
ctccctagtactggcgcggtcagtg

SEQ ID NO: 511186 - DNA, 25 bp, Rattus norvegicus
ccggccggcaccgttggcctctggt

SEQ ID NO: 511187 - DNA, 25 bp, Rattus norvegicus
ggtctgcttccctccagccggaact

SEQ ID NO: 511188 - DNA, 25 bp, Rattus norvegicus
ttggcctctggtccccaatgggttg

SEQ ID NO: 511189 - DNA, 25 bp, Rattus norvegicus
ccatcctggctagctgcggcccgcc

SEQ ID NO: 511190 - DNA, 25 bp, Rattus norvegicus
tccagccggaactccctagtactgg

SEQ ID NO: 511191 - DNA, 25 bp, Rattus norvegicus
agccggaactccctagtactggcgc

SEQ ID NO: 511192 - DNA, 25 bp, Rattus norvegicus
tatacacgtcatttccgcctaaaac

SEQ ID NO: 511193 - DNA, 25 bp, Rattus norvegicus
ctagccgagcggctgcagccactag

SEQ ID NO: 511194 - DNA, 25 bp, Rattus norvegicus
ccactgcgagcggagctagccgagc

SEQ ID NO: 511195 - DNA, 25 bp, Rattus norvegicus
tgggtctccctgcacgctcaggcgg

SEQ ID NO: 511196 - DNA, 25 bp, Rattus norvegicus
agcctgggacagtccctacgcgagg

SEQ ID NO: 511197 - DNA, 25 bp, Rattus norvegicus
gctacgcagcctgggacagtcccta

SEQ ID NO: 511198 - DNA, 25 bp, Rattus norvegicus
ttgcgtgccgctttgcgcctggtgc

SEQ ID NO: 511199 - DNA, 25 bp, Rattus norvegicus
acgtgctcggagacgcggccctgca

SEQ ID NO: 511200 - DNA, 25 bp, Rattus norvegicus
tcagccgaagcctctcgcggtggcg

SEQ ID NO: 511201 - DNA, 25 bp, Rattus norvegicus
gccgcagcactacagacagacatgg

SEQ ID NO: 511202 - DNA, 25 bp, Rattus norvegicus
actgtcactgctagccgcagcacta

SEQ ID NO: 511203 - DNA, 25 bp, Rattus norvegicus
acagattactgtcactgctagccgc

SEQ ID NO: 511204 - DNA, 25 bp, Rattus norvegicus
cccggataaagaagtacacagatta

SEQ ID NO: 511205 - DNA, 25 bp, Rattus norvegicus
ggtcgcgcattatacacgtcatttc

SEQ ID NO: 511206 - DNA, 25 bp, Rattus norvegicus
accatgtactccaccacggcagtga

SEQ ID NO: 511207 - DNA, 25 bp, Rattus norvegicus
atccgtcgcggatgaaaagcgcagc

SEQ ID NO: 511208 - DNA, 25 bp, Rattus norvegicus
tgccaccagctcgtgtgatccgtcg

SEQ ID NO: 511209 - DNA, 25 bp, Rattus norvegicus
cgtgctcaccgccacatatgtgctg

SEQ ID NO: 511210 - DNA, 25 bp, Rattus norvegicus
tcctcgtccaggaagcacatggtgc

SEQ ID NO: 511211 - DNA, 25 bp, Rattus norvegicus
cccactatgtagagcttgttgccca

SEQ ID NO: 511212 - DNA, 25 bp, Rattus norvegicus
ccaccttgggtcatagcagaagctc

SEQ ID NO: 511213 - DNA, 25 bp, Rattus norvegicus
caccaatggcatagaggcggccttc

SEQ ID NO: 511214 - DNA, 25 bp, Rattus norvegicus
tccagcaacctgtagccggatcata

SEQ ID NO: 511215 - DNA, 25 bp, Rattus norvegicus
tgaccgtagctctgcgaacgacaca

SEQ ID NO: 511216 - DNA, 25 bp, Rattus norvegicus
tgggccaccataaagtgaccgtagc

SEQ ID NO: 511217 - DNA, 25 bp, Rattus norvegicus
gaaggtccgtttcgtactacataga

SEQ ID NO: 511218 - DNA, 25 bp, Rattus norvegicus
cagtgcaggaaatcatcggaaggtc

SEQ ID NO: 511219 - DNA, 25 bp, Rattus norvegicus
agctcatgggtgtcttctggaattc

SEQ ID NO: 511220 - DNA, 25 bp, Rattus norvegicus
cctggctatccttgggcgccgcgga

SEQ ID NO: 511221 - DNA, 25 bp, Rattus norvegicus
taacctggctatccttgggcgccgc

SEQ ID NO: 511222 - DNA, 25 bp, Rattus norvegicus
taggggcgtgcaactagcagacctt

SEQ ID NO: 511223 - DNA, 25 bp, Rattus norvegicus
ctagcagaccttcgggctgaagacc

SEQ ID NO: 511224 - DNA, 25 bp, Rattus norvegicus
tgcaactagcagaccttcgggctga

SEQ ID NO: 511225 - DNA, 25 bp, Rattus norvegicus
ggtggccatctgcagtttcgccatg

SEQ ID NO: 511226 - DNA, 25 bp, Rattus norvegicus
gaccggggtggccatctgcagtttc

SEQ ID NO: 511227 - DNA, 25 bp, Rattus norvegicus
catctgcagtttcgccatgtcctca

SEQ ID NO: 511228 - DNA, 25 bp, Rattus norvegicus
tgactaggggcgtgcaactagcaga

SEQ ID NO: 511229 - DNA, 25 bp, Rattus norvegicus
ggttaacctggctatccttgggcgc

SEQ ID NO: 511230 - DNA, 25 bp, Rattus norvegicus
catgtcctcagtgttcggcaagccc

SEQ ID NO: 511231 - DNA, 25 bp, Rattus norvegicus
cagtttcgccatgtcctcagtgttc

SEQ ID NO: 511232 - DNA, 25 bp, Rattus norvegicus
cccacagcgtgcctctggaggttaa

SEQ ID NO: 511233 - DNA, 25 bp, Rattus norvegicus
gcctctggaggttaacctggctatc

SEQ ID NO: 511234 - DNA, 25 bp, Rattus norvegicus
ttcagcgggaaggaccgccgaagct

SEQ ID NO: 511235 - DNA, 25 bp, Rattus norvegicus
cctgggaaccagtacttggcgaggc

SEQ ID NO: 511236 - DNA, 25 bp, Rattus norvegicus
cggagctcctgtggctcctgcagca

SEQ ID NO: 511237 - DNA, 25 bp, Rattus norvegicus
cccaagccagctggggtcctgggaa

SEQ ID NO: 511238 - DNA, 25 bp, Rattus norvegicus
ctgcacgctgccaggtatcgaggcg

SEQ ID NO: 511239 - DNA, 25 bp, Rattus norvegicus
tgttcttcggcaccgaccactttgc

SEQ ID NO: 511240 - DNA, 25 bp, Rattus norvegicus
tccgcgagaagccaccttggcgggt

SEQ ID NO: 511241 - DNA, 25 bp, Rattus norvegicus
cagtcacctgctgggttcagcggga

SEQ ID NO: 511242 - DNA, 25 bp, Rattus norvegicus
ttcctgtcagtcacctgctgggttc

SEQ ID NO: 511243 - DNA, 25 bp, Rattus norvegicus
gccgaggtgatgcttcttccgcggc

SEQ ID NO: 511244 - DNA, 25 bp, Rattus norvegicus
ttaggcctttgagccctatgctccg

SEQ ID NO: 511245 - DNA, 25 bp, Rattus norvegicus
tgcgtgtgcttaggcctttgagccc

SEQ ID NO: 511246 - DNA, 25 bp, Rattus norvegicus
cgcctcgtcctctgcgtgtgcttag

SEQ ID NO: 511247 - DNA, 25 bp, Rattus norvegicus
cgggtgctgttcttcggcaccgacc

SEQ ID NO: 511248 - DNA, 25 bp, Rattus norvegicus
gactacatccgctgcgcccaaatag

SEQ ID NO: 511249 - DNA, 25 bp, Rattus norvegicus
cctggggagctgccggttctagact

SEQ ID NO: 511250 - DNA, 25 bp, Rattus norvegicus
aagagccgtctaggctggaaagaaa

SEQ ID NO: 511251 - DNA, 25 bp, Rattus norvegicus
tccgctgcgcccaaataggggcgaa

SEQ ID NO: 511252 - DNA, 25 bp, Rattus norvegicus
ccttcctcgccatctggtcccgcct

SEQ ID NO: 511253 - DNA, 25 bp, Rattus norvegicus
ctgccggttctagacttgggaggcg

SEQ ID NO: 511254 - DNA, 25 bp, Rattus norvegicus
ccctctgcccgctgctcccaagggg

SEQ ID NO: 511255 - DNA, 25 bp, Rattus norvegicus
ctcccaaggggcctctgctctgcag

SEQ ID NO: 511256 - DNA, 25 bp, Rattus norvegicus
aggggcctctgctctgcagccgccc

SEQ ID NO: 511257 - DNA, 25 bp, Rattus norvegicus
actacatccgctgcgcccaaatagg

SEQ ID NO: 511258 - DNA, 25 bp, Rattus norvegicus
tgcgcccaaataggggcgaagagcc

SEQ ID NO: 511259 - DNA, 25 bp, Rattus norvegicus
ccaaataggggcgaagagccgtcta

SEQ ID NO: 511260 - DNA, 25 bp, Rattus norvegicus
cgaagagccgtctaggctggaaaga

SEQ ID NO: 511261 - DNA, 25 bp, Rattus norvegicus
tctaggctggaaagaaagggacgcg

SEQ ID NO: 511262 - DNA, 25 bp, Rattus norvegicus
gaagggcggccacgctgtttcccac

SEQ ID NO: 511263 - DNA, 25 bp, Rattus norvegicus
ccgatgaatgtgatgacaccgagct

SEQ ID NO: 511264 - DNA, 25 bp, Rattus norvegicus
tcagtccagtgcagccggaggaact

SEQ ID NO: 511265 - DNA, 25 bp, Rattus norvegicus
ccgagactttgtcacgatcagtcca

SEQ ID NO: 511266 - DNA, 25 bp, Rattus norvegicus
tctgcccgtgcgcaattgctcggtc

SEQ ID NO: 511267 - DNA, 25 bp, Rattus norvegicus
tgcaactgctgctctctgactgtcc

SEQ ID NO: 511268 - DNA, 25 bp, Rattus norvegicus
agtcctggagggcaacctcgcaagc

SEQ ID NO: 511269 - DNA, 25 bp, Rattus norvegicus
agttgggcgcagcactttgcgactc

SEQ ID NO: 511270 - DNA, 25 bp, Rattus norvegicus
ttgatgctgcgactgcaggcacccg

SEQ ID NO: 511271 - DNA, 25 bp, Rattus norvegicus
aatgaacgccgcgagttgatgctgc

SEQ ID NO: 511272 - DNA, 25 bp, Rattus norvegicus
ctgagcctaggtcggaatgaacgcc

SEQ ID NO: 511273 - DNA, 25 bp, Rattus norvegicus
tctgcgcgccgcagagctgagccta

SEQ ID NO: 511274 - DNA, 25 bp, Rattus norvegicus
gtgctgcggccaccaaggctccaga

SEQ ID NO: 511275 - DNA, 25 bp, Rattus norvegicus
ggctggctcagtgcaactgctgctc

SEQ ID NO: 511276 - DNA, 25 bp, Rattus norvegicus
agagtagttccgcttccagcagggc

SEQ ID NO: 511277 - DNA, 25 bp, Rattus norvegicus
acatctgaccggactgcggaccgga

SEQ ID NO: 511278 - DNA, 25 bp, Rattus norvegicus
ggagacgcccgggaaacatctgacc

SEQ ID NO: 511279 - DNA, 25 bp, Rattus norvegicus
ctagcgaagtcaaataggttgcggg

SEQ ID NO: 511280 - DNA, 25 bp, Rattus norvegicus
gccgcgtcaccgactagcgaagtca

SEQ ID NO: 511281 - DNA, 25 bp, Rattus norvegicus
gggtttcattacctcaactcctcta

SEQ ID NO: 511282 - DNA, 25 bp, Rattus norvegicus
gaactctccacagggctggctccta

SEQ ID NO: 511283 - DNA, 25 bp, Rattus norvegicus
ggctggctcctaagtccgacttcac

SEQ ID NO: 511284 - DNA, 25 bp, Rattus norvegicus
ttcaccgaagcgttcgagcccgcta

SEQ ID NO: 511285 - DNA, 25 bp, Rattus norvegicus
ccgctagccacgtcaggagaactcg

SEQ ID NO: 511286 - DNA, 25 bp, Rattus norvegicus
ggatgtgtagcacctcctgcggccc

SEQ ID NO: 511287 - DNA, 25 bp, Rattus norvegicus
caacctgacagagtagttccgcttc

SEQ ID NO: 511288 - DNA, 25 bp, Rattus norvegicus
cccggaattccggatgtgtagcacc

SEQ ID NO: 511289 - DNA, 25 bp, Rattus norvegicus
cgcattcctgaaaaccacaacctga

SEQ ID NO: 511290 - DNA, 25 bp, Rattus norvegicus
cggagagccgagtggcggagagaac

SEQ ID NO: 511291 - DNA, 25 bp, Rattus norvegicus
taagaaaagttctctgaaagagttc

SEQ ID NO: 511292 - DNA, 25 bp, Rattus norvegicus
agttctctgaaagagttcatcaaag

SEQ ID NO: 511293 - DNA, 25 bp, Rattus norvegicus
catcaaagtttaaaaacttgtcttg

SEQ ID NO: 511294 - DNA, 25 bp, Rattus norvegicus
gaaaacgcccgagctgaggaaggca

SEQ ID NO: 511295 - DNA, 25 bp, Rattus norvegicus
acgcccgagctgaggaaggcaaaga

SEQ ID NO: 511296 - DNA, 25 bp, Rattus norvegicus
caaagaggccggagcgtcgcggccc

SEQ ID NO: 511297 - DNA, 25 bp, Rattus norvegicus
attggctgcgcgttcccccggagac

SEQ ID NO: 511298 - DNA, 25 bp, Rattus norvegicus
ccgccctctggggatctaggagggc

SEQ ID NO: 511299 - DNA, 25 bp, Rattus norvegicus
gcgtcggccgccatccgcgtgtccc

SEQ ID NO: 511300 - DNA, 25 bp, Rattus norvegicus
cgccgcgggcgtcctacgcccgctg

SEQ ID NO: 511301 - DNA, 25 bp, Rattus norvegicus
cgggtccggcttgcgcttcgcctga

SEQ ID NO: 511302 - DNA, 25 bp, Rattus norvegicus
tccggcttgcgcttcgcctgaggcg

SEQ ID NO: 511303 - DNA, 25 bp, Rattus norvegicus
ttcgcctgaggcgcgcctcctgggt

SEQ ID NO: 511304 - DNA, 25 bp, Rattus norvegicus
ggtgtgctcgcgacagcctacacct

SEQ ID NO: 511305 - DNA, 25 bp, Rattus norvegicus
aacgtgcgggtcacctcaagctcca

SEQ ID NO: 511306 - DNA, 25 bp, Rattus norvegicus
gggatgcaacgtgcgggtcacctca

SEQ ID NO: 511307 - DNA, 25 bp, Rattus norvegicus
catctgggcatgaaactgggagccc

SEQ ID NO: 511308 - DNA, 25 bp, Rattus norvegicus
ctacacctccacatctgggcatgaa

SEQ ID NO: 511309 - DNA, 25 bp, Rattus norvegicus
gcgaacggtgtgctcgcgacagcct

SEQ ID NO: 511310 - DNA, 25 bp, Rattus norvegicus
cgcgaagagaagtgctgacccggac

SEQ ID NO: 511311 - DNA, 25 bp, Rattus norvegicus
gccgccacgcgcgaagagaagtgct

SEQ ID NO: 511312 - DNA, 25 bp, Rattus norvegicus
ccagaacccggtcccagccgccacg

SEQ ID NO: 511313 - DNA, 25 bp, Rattus norvegicus
tccagatcaggtgtttgccgccctc

SEQ ID NO: 511314 - DNA, 25 bp, Rattus norvegicus
gccacgctccagatcaggtgtttgc

SEQ ID NO: 511315 - DNA, 25 bp, Rattus norvegicus
ccacgcgcgaagagaagtgctgacc

SEQ ID NO: 511316 - DNA, 25 bp, Rattus norvegicus
acctccacatctgggcatgaaactg

SEQ ID NO: 511317 - DNA, 25 bp, Rattus norvegicus
tgctgacccggaccggacaagaatt

SEQ ID NO: 511318 - DNA, 25 bp, Rattus norvegicus
caggggctcgcttcgtttcccctgt

SEQ ID NO: 511319 - DNA, 25 bp, Rattus norvegicus
gctgaggcaagaggagggctctcgg

SEQ ID NO: 511320 - DNA, 25 bp, Rattus norvegicus
ctcatccgggtttcctcctcgcccg

SEQ ID NO: 511321 - DNA, 25 bp, Rattus norvegicus
gagctttgaaatcgggcctccttcc

SEQ ID NO: 511322 - DNA, 25 bp, Rattus norvegicus
cctgccacccgagctttgaaatcgg

SEQ ID NO: 511323 - DNA, 25 bp, Rattus norvegicus
ccaggacaggtaacggcccggcgca

SEQ ID NO: 511324 - DNA, 25 bp, Rattus norvegicus
tgataaacacccaggacaggtaacg

SEQ ID NO: 511325 - DNA, 25 bp, Rattus norvegicus
ccgaggatgataaacacccaggaca

SEQ ID NO: 511326 - DNA, 25 bp, Rattus norvegicus
agccaccgaggatgataaacaccca

SEQ ID NO: 511327 - DNA, 25 bp, Rattus norvegicus
cagagccaccgaggatgataaacac

SEQ ID NO: 511328 - DNA, 25 bp, Rattus norvegicus
cacccactcgtccacctacccactc

SEQ ID NO: 511329 - DNA, 25 bp, Rattus norvegicus
gacagggacttagcccgcagagacc

SEQ ID NO: 511330 - DNA, 25 bp, Rattus norvegicus
cggcctgacagggacttagcccgca

SEQ ID NO: 511331 - DNA, 25 bp, Rattus norvegicus
cgagctttgaaatcgggcctccttc

SEQ ID NO: 511332 - DNA, 25 bp, Rattus norvegicus
cggagcctcagaaaactctctggcc

SEQ ID NO: 511333 - DNA, 25 bp, Rattus norvegicus
agcctcagaaaactctctggcctgc

SEQ ID NO: 511334 - DNA, 25 bp, Rattus norvegicus
ggccgcgcacacgtcctgctttcaa

SEQ ID NO: 511335 - DNA, 25 bp, Rattus norvegicus
agcggagcctcagaaaactctctgg

SEQ ID NO: 511336 - DNA, 25 bp, Rattus norvegicus
tcagcggagcctcagaaaactctct

SEQ ID NO: 511337 - DNA, 25 bp, Rattus norvegicus
cctcagcggagcctcagaaaactct

SEQ ID NO: 511338 - DNA, 25 bp, Rattus norvegicus
tgctttcaacccgacgctcccgacg

SEQ ID NO: 511339 - DNA, 25 bp, Rattus norvegicus
taccacctggccagaccagagacta

SEQ ID NO: 511340 - DNA, 25 bp, Rattus norvegicus
acctggccagaccagagactatcct

SEQ ID NO: 511341 - DNA, 25 bp, Rattus norvegicus
ccagagactatcctgggtaccgccg

SEQ ID NO: 511342 - DNA, 25 bp, Rattus norvegicus
taccgccgccctcagcccgaaccgc

SEQ ID NO: 511343 - DNA, 25 bp, Rattus norvegicus
gggccacgctttgaacttcacctca

SEQ ID NO: 511344 - DNA, 25 bp, Rattus norvegicus
gccacgctttgaacttcacctcagg

SEQ ID NO: 511345 - DNA, 25 bp, Rattus norvegicus
tcaacccgacgctcccgacgctccc

SEQ ID NO: 511346 - DNA, 25 bp, Rattus norvegicus
ctggaccctccgtggccaacgataa

SEQ ID NO: 511347 - DNA, 25 bp, Rattus norvegicus
gcgcctggtcggaaacgcgcacgct

SEQ ID NO: 511348 - DNA, 25 bp, Rattus norvegicus
aggcggagaacgaggtgtctatcca

SEQ ID NO: 511349 - DNA, 25 bp, Rattus norvegicus
tccgcattgcttcgcagggagaacg

SEQ ID NO: 511350 - DNA, 25 bp, Rattus norvegicus
ttgccgtgaccgctcttgctgctgc

SEQ ID NO: 511351 - DNA, 25 bp, Rattus norvegicus
tgcgcctctcggagcgcaatatgaa

SEQ ID NO: 511352 - DNA, 25 bp, Rattus norvegicus
gggctccgttgtcttccttttgctg

SEQ ID NO: 511353 - DNA, 25 bp, Rattus norvegicus
ctggggtgcgtagtctttctttcta

SEQ ID NO: 511354 - DNA, 25 bp, Rattus norvegicus
gccaacgataagaagaagggaccta

SEQ ID NO: 511355 - DNA, 25 bp, Rattus norvegicus
agtcacagtcaaggtctgggctccc

SEQ ID NO: 511356 - DNA, 25 bp, Rattus norvegicus
gtctggcccagtagttccgaccgga

SEQ ID NO: 511357 - DNA, 25 bp, Rattus norvegicus
tccgaccggagcgtccttgttctcg

SEQ ID NO: 511358 - DNA, 25 bp, Rattus norvegicus
atatgaaggtgctcttcgccgccgc

SEQ ID NO: 511359 - DNA, 25 bp, Rattus norvegicus
tctatccaatgagagggctgtaacg

SEQ ID NO: 511360 - DNA, 25 bp, Rattus norvegicus
cgtctcccgcgttcgcagtgagggc

SEQ ID NO: 511361 - DNA, 25 bp, Rattus norvegicus
ggtggacgaagactgacagtcggcc

SEQ ID NO: 511362 - DNA, 25 bp, Rattus norvegicus
gtgtctgctgggcccgaaccgtacc

SEQ ID NO: 511363 - DNA, 25 bp, Rattus norvegicus
gacccgcgtgggctacggtcaaggc

SEQ ID NO: 511364 - DNA, 25 bp, Rattus norvegicus
tcctgtcaccctgcgaggcgcggac

SEQ ID NO: 511365 - DNA, 25 bp, Rattus norvegicus
ctttaggtgcggctcctgtcaccct

SEQ ID NO: 511366 - DNA, 25 bp, Rattus norvegicus
ccttagcctttaggtgcggctcctg

SEQ ID NO: 511367 - DNA, 25 bp, Rattus norvegicus
agagaatagctccttagcctttagg

SEQ ID NO: 511368 - DNA, 25 bp, Rattus norvegicus
cccggagttcagagaatagctcctt

SEQ ID NO: 511369 - DNA, 25 bp, Rattus norvegicus
cgcgcggtccgagaccctgtctccc

SEQ ID NO: 511370 - DNA, 25 bp, Rattus norvegicus
ttgcagtctgcctgctttccgcgcg

SEQ ID NO: 511371 - DNA, 25 bp, Rattus norvegicus
tcggagttgcagtctgcctgctttc

SEQ ID NO: 511372 - DNA, 25 bp, Rattus norvegicus
acagtcggccgtcggagttgcagtc

SEQ ID NO: 511373 - DNA, 25 bp, Rattus norvegicus
tccctgcgcgcgcactgagcactgg

SEQ ID NO: 511374 - DNA, 25 bp, Rattus norvegicus
gggtgttccctgcagctctaaagtc

SEQ ID NO: 511375 - DNA, 25 bp, Rattus norvegicus
cccgcttgtgtagagcatggaactc

SEQ ID NO: 511376 - DNA, 25 bp, Rattus norvegicus
gtccgctgtacagcacctctacttg

SEQ ID NO: 511377 - DNA, 25 bp, Rattus norvegicus
cctctacttggaacacctggcgggc

SEQ ID NO: 511378 - DNA, 25 bp, Rattus norvegicus
gacgcgcccaatttctggtgtttga

SEQ ID NO: 511379 - DNA, 25 bp, Rattus norvegicus
tttgaaaggcacaaagccgacctgg

SEQ ID NO: 511380 - DNA, 25 bp, Rattus norvegicus
gcccagaccatcgtccaagggactg

SEQ ID NO: 511381 - DNA, 25 bp, Rattus norvegicus
ccgaacctttgcaacgaatgtccta

SEQ ID NO: 511382 - DNA, 25 bp, Rattus norvegicus
agccctgaattctgggtcccttttg

SEQ ID NO: 511383 - DNA, 25 bp, Rattus norvegicus
gcacgtactcttcgtccattgctca

SEQ ID NO: 511384 - DNA, 25 bp, Rattus norvegicus
ccatgtggcctttctctggactctg

SEQ ID NO: 511385 - DNA, 25 bp, Rattus norvegicus
accgaggggatgtgaacttccagca

SEQ ID NO: 511386 - DNA, 25 bp, Rattus norvegicus
gcagcctctcctggatcgagcgcta

SEQ ID NO: 511387 - DNA, 25 bp, Rattus norvegicus
gtcctgaagcgggaagataacaccg

SEQ ID NO: 511388 - DNA, 25 bp, Rattus norvegicus
ccacccgtggcggaagcagcaacaa

SEQ ID NO: 511389 - DNA, 25 bp, Rattus norvegicus
cgagcaaagcgctccagctgtgtga

SEQ ID NO: 511390 - DNA, 25 bp, Rattus norvegicus
aaagcgctccagctgtgtgaggtgc

SEQ ID NO: 511391 - DNA, 25 bp, Rattus norvegicus
tccggatccattccagggaagggcg

SEQ ID NO: 511392 - DNA, 25 bp, Rattus norvegicus
gagggagtcgctccgaagcgctaca

SEQ ID NO: 511393 - DNA, 25 bp, Rattus norvegicus
gagtcgctccgaagcgctacagcca

SEQ ID NO: 511394 - DNA, 25 bp, Rattus norvegicus
accacctcccgacgccatcttcctc

SEQ ID NO: 511395 - DNA, 25 bp, Rattus norvegicus
ccgtggcggaagcagcaacaacaac

SEQ ID NO: 511396 - DNA, 25 bp, Rattus norvegicus
caactttatagacagtgccgcgagc

SEQ ID NO: 511397 - DNA, 25 bp, Rattus norvegicus
agacagtgccgcgagcaaagcgctc

SEQ ID NO: 511398 - DNA, 25 bp, Rattus norvegicus
tgccgcgagcaaagcgctccagctg

SEQ ID NO: 511399 - DNA, 25 bp, Rattus norvegicus
tcggactccggatccattccaggga

SEQ ID NO: 511400 - DNA, 25 bp, Rattus norvegicus
cgcgagggccgttacagacccggag

SEQ ID NO: 511401 - DNA, 25 bp, Rattus norvegicus
tgaaaatatcctccccctcggtgtc

SEQ ID NO: 511402 - DNA, 25 bp, Rattus norvegicus
catccaggccctcacctcggggcgg

SEQ ID NO: 511403 - DNA, 25 bp, Rattus norvegicus
ggcgcacgtcctgccctccgcacat

SEQ ID NO: 511404 - DNA, 25 bp, Rattus norvegicus
ccggaggccagtctgcacgctgcta

SEQ ID NO: 511405 - DNA, 25 bp, Rattus norvegicus
acgagggaacctgttggtcgcctga

SEQ ID NO: 511406 - DNA, 25 bp, Rattus norvegicus
gaacctgttggtcgcctgagcatcc

SEQ ID NO: 511407 - DNA, 25 bp, Rattus norvegicus
ttggtcgcctgagcatccaggccct

SEQ ID NO: 511408 - DNA, 25 bp, Rattus norvegicus
ccttctgtggtttgtgcgctgtggc

SEQ ID NO: 511409 - DNA, 25 bp, Rattus norvegicus
cagagctgagaggatcgccgcgcac

SEQ ID NO: 511410 - DNA, 25 bp, Rattus norvegicus
ctccgcacatgcagcgcagcctctc

SEQ ID NO: 511411 - DNA, 25 bp, Rattus norvegicus
tctcgccgtgagtagcgcccgggct

SEQ ID NO: 511412 - DNA, 25 bp, Rattus norvegicus
gtagccgggcattgcctgtctagga

SEQ ID NO: 511413 - DNA, 25 bp, Rattus norvegicus
ccgggcattgcctgtctaggatatg

SEQ ID NO: 511414 - DNA, 25 bp, Rattus norvegicus
atatggcccttctgtggtttgtgcg

SEQ ID NO: 511415 - DNA, 25 bp, Rattus norvegicus
gcctgtctaggatatggcccttctg

SEQ ID NO: 511416 - DNA, 25 bp, Rattus norvegicus
cctgggaagccttttagaagccgtg

SEQ ID NO: 511417 - DNA, 25 bp, Rattus norvegicus
gtcgcgactccggtgcttccagtcg

SEQ ID NO: 511418 - DNA, 25 bp, Rattus norvegicus
tttatcttggggagagtcgcgactc

SEQ ID NO: 511419 - DNA, 25 bp, Rattus norvegicus
ggctctccgcgctctttatcttggg

SEQ ID NO: 511420 - DNA, 25 bp, Rattus norvegicus
agcgctgctccctcagctgggactg

SEQ ID NO: 511421 - DNA, 25 bp, Rattus norvegicus
gccgccgctgcagcaaaaatataaa

SEQ ID NO: 511422 - DNA, 25 bp, Rattus norvegicus
aaaatataaaggacgcggctagcgc

SEQ ID NO: 511423 - DNA, 25 bp, Rattus norvegicus
tccacctcccgagtgtgcttggctg

SEQ ID NO: 511424 - DNA, 25 bp, Rattus norvegicus
gtaggcaggaccagcgctcctgatc

SEQ ID NO: 511425 - DNA, 25 bp, Rattus norvegicus
tttagaagccgtgccacccgtctga

SEQ ID NO: 511426 - DNA, 25 bp, Rattus norvegicus
cctgaataagcttgcagtctgcgcc

SEQ ID NO: 511427 - DNA, 25 bp, Rattus norvegicus
ctttatccgctaacgagcgctgctc

SEQ ID NO: 511428 - DNA, 25 bp, Rattus norvegicus
cgtctttccctttgacaagtcgccg

SEQ ID NO: 511429 - DNA, 25 bp, Rattus norvegicus
tctgctcacggtaggtaacacttcc

SEQ ID NO: 511430 - DNA, 25 bp, Rattus norvegicus
ttcggaggctcctcgccaacctagt

SEQ ID NO: 511431 - DNA, 25 bp, Rattus norvegicus
tccacgtgaaatgtctgcagcgcgc

SEQ ID NO: 511432 - DNA, 25 bp, Rattus norvegicus
gcagcagtcgcgctaagcagtcatc

SEQ ID NO: 511433 - DNA, 25 bp, Rattus norvegicus
agcagtcatccgtgacgtggccgca

SEQ ID NO: 511434 - DNA, 25 bp, Rattus norvegicus
cagcccgaaagcgtgacggacgcca

SEQ ID NO: 511435 - DNA, 25 bp, Rattus norvegicus
ccgcgctcaggatcaggttcggaca

SEQ ID NO: 511436 - DNA, 25 bp, Rattus norvegicus
cacgcggcggctgatccggtatcat

SEQ ID NO: 511437 - DNA, 25 bp, Rattus norvegicus
ttctcaatagaaacccgtgggatga

SEQ ID NO: 511438 - DNA, 25 bp, Rattus norvegicus
cgctcgtttaatagtgcgcacattc

SEQ ID NO: 511439 - DNA, 25 bp, Rattus norvegicus
cgctttactggcatccgctcgttta

SEQ ID NO: 511440 - DNA, 25 bp, Rattus norvegicus
agagaaccacagaacgctttactgg

SEQ ID NO: 511441 - DNA, 25 bp, Rattus norvegicus
ggcgagtaagaacgcgccctacagg

SEQ ID NO: 511442 - DNA, 25 bp, Rattus norvegicus
ttgcggcagaagtccacgtgaaatg

SEQ ID NO: 511443 - DNA, 25 bp, Rattus norvegicus
agccctgccgctagggcgagtaaga

SEQ ID NO: 511444 - DNA, 25 bp, Rattus norvegicus
tgcgcacccactaaagtctccgaga

SEQ ID NO: 511445 - DNA, 25 bp, Rattus norvegicus
tctggatccagcaggtctcaagaga

SEQ ID NO: 511446 - DNA, 25 bp, Rattus norvegicus
agccatatctctgtgtctggatcca

SEQ ID NO: 511447 - DNA, 25 bp, Rattus norvegicus
gcctcggacggacacagccatatct

SEQ ID NO: 511448 - DNA, 25 bp, Rattus norvegicus
agccgttaaggactggcctcggacg

SEQ ID NO: 511449 - DNA, 25 bp, Rattus norvegicus
tgggcctcagaatataggtgttctc

SEQ ID NO: 511450 - DNA, 25 bp, Rattus norvegicus
cgctacgcgcctttgctggaaaatg

SEQ ID NO: 511451 - DNA, 25 bp, Rattus norvegicus
tggagaaatcgccaggtccgaacgc

SEQ ID NO: 511452 - DNA, 25 bp, Rattus norvegicus
cccgggaagaactgctaggcaaact

SEQ ID NO: 511453 - DNA, 25 bp, Rattus norvegicus
gcgccagtctatgttcccgggaaga

SEQ ID NO: 511454 - DNA, 25 bp, Rattus norvegicus
tctcaagagaaaaggccggccgatc

SEQ ID NO: 511455 - DNA, 25 bp, Rattus norvegicus
cggccgatcgcaccgatggaagatc

SEQ ID NO: 511456 - DNA, 25 bp, Rattus norvegicus
caacaggccgctcacgtgacgtgtc

SEQ ID NO: 511457 - DNA, 25 bp, Rattus norvegicus
ccagaagcgcgtcgctagggcaaca

SEQ ID NO: 511458 - DNA, 25 bp, Rattus norvegicus
ccggcccttatgtttgtggagcctt

SEQ ID NO: 511459 - DNA, 25 bp, Rattus norvegicus
aacagtaggcttccgccttctcggg

SEQ ID NO: 511460 - DNA, 25 bp, Rattus norvegicus
cctaaggggatgtgaactgactttc

SEQ ID NO: 511461 - DNA, 25 bp, Rattus norvegicus
tctgccacggtccagaaacagtagg

SEQ ID NO: 511462 - DNA, 25 bp, Rattus norvegicus
aactgactttcccaactctgactgc

SEQ ID NO: 511463 - DNA, 25 bp, Rattus norvegicus
ccggcagtccagacaaagctgcgtc

SEQ ID NO: 511464 - DNA, 25 bp, Rattus norvegicus
tcgggccgcgcgaaacaaaggagcc

SEQ ID NO: 511465 - DNA, 25 bp, Rattus norvegicus
accgctgcagcaccaggacgacggg

SEQ ID NO: 511466 - DNA, 25 bp, Rattus norvegicus
acgctagagctgaggtgcggacact

SEQ ID NO: 511467 - DNA, 25 bp, Rattus norvegicus
tgcggacactccatggccacgagga

SEQ ID NO: 511468 - DNA, 25 bp, Rattus norvegicus
gggtcccgagcctttgcgtcaaaga

SEQ ID NO: 511469 - DNA, 25 bp, Rattus norvegicus
ccagagaacgtggaaatccggactc

SEQ ID NO: 511470 - DNA, 25 bp, Rattus norvegicus
aatccggactcctggttctgccacg

SEQ ID NO: 511471 - DNA, 25 bp, Rattus norvegicus
ggaaacgcagtctaaaggggctcgc

SEQ ID NO: 511472 - DNA, 25 bp, Rattus norvegicus
gtgtccgggactcggcttaacctca

SEQ ID NO: 511473 - DNA, 25 bp, Rattus norvegicus
agccagcatgcagtgcgagctcaga

SEQ ID NO: 511474 - DNA, 25 bp, Rattus norvegicus
tccaagacccgtcagagccagcatg

SEQ ID NO: 511475 - DNA, 25 bp, Rattus norvegicus
gcggggcttcgagtttctccaagac

SEQ ID NO: 511476 - DNA, 25 bp, Rattus norvegicus
taaatcggtgcgaggtctgagccta

SEQ ID NO: 511477 - DNA, 25 bp, Rattus norvegicus
aggtgtcccactcccagttaaatcg

SEQ ID NO: 511478 - DNA, 25 bp, Rattus norvegicus
gcgtggcttcggatacacagatcca

SEQ ID NO: 511479 - DNA, 25 bp, Rattus norvegicus
aaagaacaccgcagccgtcatgacg

SEQ ID NO: 511480 - DNA, 25 bp, Rattus norvegicus
ttagcccttggacgatcccacaagc

SEQ ID NO: 511481 - DNA, 25 bp, Rattus norvegicus
gagcctcgggttctcttagcccttg

SEQ ID NO: 511482 - DNA, 25 bp, Rattus norvegicus
cctcccaggaacagaagagcctcgg

SEQ ID NO: 511483 - DNA, 25 bp, Rattus norvegicus
tagcctacgggcctgctcttctcag

SEQ ID NO: 511484 - DNA, 25 bp, Rattus norvegicus
tggagatgctctaaagccgaaggcc

SEQ ID NO: 511485 - DNA, 25 bp, Rattus norvegicus
ggttgcgaaactccgctgcggtcag

SEQ ID NO: 511486 - DNA, 25 bp, Rattus norvegicus
gcactttccggccaatcagaacctg

SEQ ID NO: 511487 - DNA, 25 bp, Rattus norvegicus
caaccgaagaacacgggcgctgtca

SEQ ID NO: 511488 - DNA, 25 bp, Rattus norvegicus
tcatggtacccgcagaagtcagtcc

SEQ ID NO: 511489 - DNA, 25 bp, Rattus norvegicus
atccaaggtgcatgggacgctgtct

SEQ ID NO: 511490 - DNA, 25 bp, Rattus norvegicus
tcttagcgggatatgggaccggaca

SEQ ID NO: 511491 - DNA, 25 bp, Rattus norvegicus
gccaggtgctccgagcgcaattaga

SEQ ID NO: 511492 - DNA, 25 bp, Rattus norvegicus
gcctcgagatgctccgggattttcc

SEQ ID NO: 511493 - DNA, 25 bp, Rattus norvegicus
tcgtgaacaaggacctcggggtgct

SEQ ID NO: 511494 - DNA, 25 bp, Rattus norvegicus
ggtgctccaaggcacgtccgtgcag

SEQ ID NO: 511495 - DNA, 25 bp, Rattus norvegicus
tgagcttcttcccagcaaggcagga

SEQ ID NO: 511496 - DNA, 25 bp, Rattus norvegicus
gcttgtagtgctcaactgtcaattg

SEQ ID NO: 511497 - DNA, 25 bp, Rattus norvegicus
ggtagttccagaaggtgctccaggc

SEQ ID NO: 511498 - DNA, 25 bp, Rattus norvegicus
tggacgtgctctactgcctgtcaga

SEQ ID NO: 511499 - DNA, 25 bp, Rattus norvegicus
actgtcaattgtagaggggtgtcca

SEQ ID NO: 511500 - DNA, 25 bp, Rattus norvegicus
gtacgtcttcgccatcttctcgctc

SEQ ID NO: 511501 - DNA, 25 bp, Rattus norvegicus
atttgtagtacgctgggagagccgc

SEQ ID NO: 511502 - DNA, 25 bp, Rattus norvegicus
cgcgcggctttatgggatttgtagt

SEQ ID NO: 511503 - DNA, 25 bp, Rattus norvegicus
gcgccttgtcatcaccctccgcggc

SEQ ID NO: 511504 - DNA, 25 bp, Rattus norvegicus
ggccctctctgaccgcccagagcaa

SEQ ID NO: 511505 - DNA, 25 bp, Rattus norvegicus
cggagtcgccgatgagcagcagctt

SEQ ID NO: 511506 - DNA, 25 bp, Rattus norvegicus
ttgccaacgccggagtcgccgatga

SEQ ID NO: 511507 - DNA, 25 bp, Rattus norvegicus
gtgttgaaggcgtcctctgagaagc

SEQ ID NO: 511508 - DNA, 25 bp, Rattus norvegicus
taaaggtggtgttgaaggcgtcctc

SEQ ID NO: 511509 - DNA, 25 bp, Rattus norvegicus
cgaccgctccctcaccgatggtgga

SEQ ID NO: 511510 - DNA, 25 bp, Rattus norvegicus
ttcgtccatccgcagttccgcgtcc

SEQ ID NO: 511511 - DNA, 25 bp, Rattus norvegicus
attgctccggttccctttcgtccat

SEQ ID NO: 511512 - DNA, 25 bp, Rattus norvegicus
acaggaggcaggtcttgccaacgcc

SEQ ID NO: 511513 - DNA, 25 bp, Rattus norvegicus
ttccagccaatctgcccgcgccttg

SEQ ID NO: 511514 - DNA, 25 bp, Rattus norvegicus
tttgactttggtcttgggcttactc

SEQ ID NO: 511515 - DNA, 25 bp, Rattus norvegicus
tgggcttactctccttcaggttttc

SEQ ID NO: 511516 - DNA, 25 bp, Rattus norvegicus
aagttgctgctaggcgctcgaaagc

SEQ ID NO: 511517 - DNA, 25 bp, Rattus norvegicus
gttttctgttagtctggcgcctctg

SEQ ID NO: 511518 - DNA, 25 bp, Rattus norvegicus
tggcgcctctgtaggcggctaagcc

SEQ ID NO: 511519 - DNA, 25 bp, Rattus norvegicus
atctcagagatctggagcggccgcg

SEQ ID NO: 511520 - DNA, 25 bp, Rattus norvegicus
acggagtgcagctcctagcccactg

SEQ ID NO: 511521 - DNA, 25 bp, Rattus norvegicus
gggcttcagggttctgctggttaac

SEQ ID NO: 511522 - DNA, 25 bp, Rattus norvegicus
gctggttaaccctcgcagcttctga

SEQ ID NO: 511523 - DNA, 25 bp, Rattus norvegicus
gacacgttcattccactccgggcga

SEQ ID NO: 511524 - DNA, 25 bp, Rattus norvegicus
gaaagcgagcacctcatctcagaga

SEQ ID NO: 511525 - DNA, 25 bp, Rattus norvegicus
gtcgtaccacagagacggcagccta

SEQ ID NO: 511526 - DNA, 25 bp, Rattus norvegicus
cggagctgtcaccatgcctgtgagt

SEQ ID NO: 511527 - DNA, 25 bp, Rattus norvegicus
gcctctatcccggaagttgctgcta

SEQ ID NO: 511528 - DNA, 25 bp, Rattus norvegicus
gcgaatattatctgcctgcaccagc

SEQ ID NO: 511529 - DNA, 25 bp, Rattus norvegicus
tctggaagtacaggggcgccctacg

SEQ ID NO: 511530 - DNA, 25 bp, Rattus norvegicus
ctgcaccagcgctccaaagaagatg

SEQ ID NO: 511531 - DNA, 25 bp, Rattus norvegicus
tgtccgtcaggctgcgaatattatc

SEQ ID NO: 511532 - DNA, 25 bp, Rattus norvegicus
gtaacacgtgtgtccgtcaggctgc

SEQ ID NO: 511533 - DNA, 25 bp, Rattus norvegicus
ccaccgaggacctgcgtaacacgtg

SEQ ID NO: 511534 - DNA, 25 bp, Rattus norvegicus
aggcaaccctggaagccaccgagga

SEQ ID NO: 511535 - DNA, 25 bp, Rattus norvegicus
tagctcgttgtgattgagcaccacg

SEQ ID NO: 511536 - DNA, 25 bp, Rattus norvegicus
tccgcgaagctgctgcgcttgtttt

SEQ ID NO: 511537 - DNA, 25 bp, Rattus norvegicus
aacttcagctccgtgagacccacga

SEQ ID NO: 511538 - DNA, 25 bp, Rattus norvegicus
ggggtagagcacacagcccaacttc

SEQ ID NO: 511539 - DNA, 25 bp, Rattus norvegicus
cactgtcggtgcttaaggtctggaa

SEQ ID NO: 511540 - DNA, 25 bp, Rattus norvegicus
tgagcaccacggagtccaggcaacc

SEQ ID NO: 511541 - DNA, 25 bp, Rattus norvegicus
cgctccaaagaagatggcactgtcg

SEQ ID NO: 511542 - DNA, 25 bp, Rattus norvegicus
tagcttcctagcttagccagcggcc

SEQ ID NO: 511543 - DNA, 25 bp, Rattus norvegicus
gccggtgacctcagctgctacttga

SEQ ID NO: 511544 - DNA, 25 bp, Rattus norvegicus
agcccgcggccagacaatcggaaaa

SEQ ID NO: 511545 - DNA, 25 bp, Rattus norvegicus
gcagatcgcggctgctctctatggc

SEQ ID NO: 511546 - DNA, 25 bp, Rattus norvegicus
cggcccatccaaggctcagcatagg

SEQ ID NO: 511547 - DNA, 25 bp, Rattus norvegicus
ccgtagcccgagatgtcacgcttga

SEQ ID NO: 511548 - DNA, 25 bp, Rattus norvegicus
gtcacgcttgacaggaaccggtaca

SEQ ID NO: 511549 - DNA, 25 bp, Rattus norvegicus
gagccagctgcttcctagcttccta

SEQ ID NO: 511550 - DNA, 25 bp, Rattus norvegicus
cactgggtccgcaccttgatccggt

SEQ ID NO: 511551 - DNA, 25 bp, Rattus norvegicus
ccgcccaccaggaggacaaaattct

SEQ ID NO: 511552 - DNA, 25 bp, Rattus norvegicus
ggacaaaattctgctcggattgccc

SEQ ID NO: 511553 - DNA, 25 bp, Rattus norvegicus
gctggactcgctctctaaaggggaa

SEQ ID NO: 511554 - DNA, 25 bp, Rattus norvegicus
aaccggtacatgtcgcctccgcaga

SEQ ID NO: 511555 - DNA, 25 bp, Rattus norvegicus
tgctcatgcggcagctcagtagcgc

SEQ ID NO: 511556 - DNA, 25 bp, Rattus norvegicus
tgatgggtggatcccttacggtttc

SEQ ID NO: 511557 - DNA, 25 bp, Rattus norvegicus
aggagggcgtttgcatccattccgc

SEQ ID NO: 511558 - DNA, 25 bp, Rattus norvegicus
gctaccgcaggagggcgtttgcatc

SEQ ID NO: 511559 - DNA, 25 bp, Rattus norvegicus
ctctgggctgctttgcctagagcga

SEQ ID NO: 511560 - DNA, 25 bp, Rattus norvegicus
tacccttggaaccactgcgcgtgcg

SEQ ID NO: 511561 - DNA, 25 bp, Rattus norvegicus
gaggaactggctacccttggaacca

SEQ ID NO: 511562 - DNA, 25 bp, Rattus norvegicus
agaagcagcccggaagtcacggccc

SEQ ID NO: 511563 - DNA, 25 bp, Rattus norvegicus
ctcctgcagttacggagcccaggtc

SEQ ID NO: 511564 - DNA, 25 bp, Rattus norvegicus
tgaggctgtgctctgcctccgcgct

SEQ ID NO: 511565 - DNA, 25 bp, Rattus norvegicus
agcgagctgctacccgccatggcga

SEQ ID NO: 511566 - DNA, 25 bp, Rattus norvegicus
tgcaggctccggatctttctccgca

SEQ ID NO: 511567 - DNA, 25 bp, Rattus norvegicus
tctgcctgttcctgcaggctccgga

SEQ ID NO: 511568 - DNA, 25 bp, Rattus norvegicus
ctggtccagctctcgctgcaggctg

SEQ ID NO: 511569 - DNA, 25 bp, Rattus norvegicus
ccctgcggctaagaagcagcccgga

SEQ ID NO: 511570 - DNA, 25 bp, Rattus norvegicus
ttcccggactgagagactgacgcgg

SEQ ID NO: 511571 - DNA, 25 bp, Rattus norvegicus
cggtcttccgcagccttcttgtcag

SEQ ID NO: 511572 - DNA, 25 bp, Rattus norvegicus
agacgcagacctgcttgctccggtc

SEQ ID NO: 511573 - DNA, 25 bp, Rattus norvegicus
tgctctgctcgatccaaggcgttct

SEQ ID NO: 511574 - DNA, 25 bp, Rattus norvegicus
gcgttctctttgtcgagcttcagca

SEQ ID NO: 511575 - DNA, 25 bp, Rattus norvegicus
ctgctgctccctgatatgtactttc

SEQ ID NO: 511576 - DNA, 25 bp, Rattus norvegicus
gggcgaccgcattccttaggacagc

SEQ ID NO: 511577 - DNA, 25 bp, Rattus norvegicus
ccttaggacagccaatacttttttg

SEQ ID NO: 511578 - DNA, 25 bp, Rattus norvegicus
gcctcccagttgacggtggatatga

SEQ ID NO: 511579 - DNA, 25 bp, Rattus norvegicus
tatgactatatatggggacccgagc

SEQ ID NO: 511580 - DNA, 25 bp, Rattus norvegicus
cgaggccgtcctatttctaaacctg

SEQ ID NO: 511581 - DNA, 25 bp, Rattus norvegicus
aacctgcacgcctgggaaagagctc

SEQ ID NO: 511582 - DNA, 25 bp, Rattus norvegicus
aagagctcccggacctcgctggaga

SEQ ID NO: 511583 - DNA, 25 bp, Rattus norvegicus
tgggcgagagtctctagccacctcc

SEQ ID NO: 511584 - DNA, 25 bp, Rattus norvegicus
ggagtccagcaacccgcaggtctca

SEQ ID NO: 511585 - DNA, 25 bp, Rattus norvegicus
tggggacatccaccttttagctcgc

SEQ ID NO: 511586 - DNA, 25 bp, Rattus norvegicus
cttagcctctgtaaaaacccactga

SEQ ID NO: 511587 - DNA, 25 bp, Rattus norvegicus
gccggcgcgaaatctcggctcctga

SEQ ID NO: 511588 - DNA, 25 bp, Rattus norvegicus
tcccaacgacaatcgctcaggcttt

SEQ ID NO: 511589 - DNA, 25 bp, Rattus norvegicus
ggcagcccggagtgtcttctccaca

SEQ ID NO: 511590 - DNA, 25 bp, Rattus norvegicus
gacttgtttgcaaagtggcgcttga

SEQ ID NO: 511591 - DNA, 25 bp, Rattus norvegicus
agtgttggaatgaagccgctctgct

SEQ ID NO: 511592 - DNA, 25 bp, Rattus norvegicus
gcccgagaagggatcagctgcctaa

SEQ ID NO: 511593 - DNA, 25 bp, Rattus norvegicus
aggctagggatcagctctcggactc

SEQ ID NO: 511594 - DNA, 25 bp, Rattus norvegicus
ggactccggctgcaagactgtttgc

SEQ ID NO: 511595 - DNA, 25 bp, Rattus norvegicus
ttgagtgcagcgaaacctacatgtg

SEQ ID NO: 511596 - DNA, 25 bp, Rattus norvegicus
tcacttacgagatgcaaacccgaga

SEQ ID NO: 511597 - DNA, 25 bp, Rattus norvegicus
atatggcgcccttgaacgtcgttcc

SEQ ID NO: 511598 - DNA, 25 bp, Rattus norvegicus
gcaaggcgcggagcttgcagtcact

SEQ ID NO: 511599 - DNA, 25 bp, Rattus norvegicus
gttttccgaacgactttgagcatgc

SEQ ID NO: 511600 - DNA, 25 bp, Rattus norvegicus
tccgaacgactttgagcatgcactg

SEQ ID NO: 511601 - DNA, 25 bp, Rattus norvegicus
tgagcatgcactgtccgattctata

SEQ ID NO: 511602 - DNA, 25 bp, Rattus norvegicus
cgattctatagaaaagctcgaaccc

SEQ ID NO: 511603 - DNA, 25 bp, Rattus norvegicus
tgggctcgaacccacggcttggcct

SEQ ID NO: 511604 - DNA, 25 bp, Rattus norvegicus
ggcttggcctccactgcggacgaat

SEQ ID NO: 511605 - DNA, 25 bp, Rattus norvegicus
actttggaactgtccgccggtgtca

SEQ ID NO: 511606 - DNA, 25 bp, Rattus norvegicus
ccgcctggatatagtgcggcaaggc

SEQ ID NO: 511607 - DNA, 25 bp, Rattus norvegicus
cgcggagcttgcagtcactttgcga

SEQ ID NO: 511608 - DNA, 25 bp, Rattus norvegicus
tggcagctgaaggttctctctccgg

SEQ ID NO: 511609 - DNA, 25 bp, Rattus norvegicus
ctctctccggggctggacttaataa

SEQ ID NO: 511610 - DNA, 25 bp, Rattus norvegicus
gctggacttaataactttggaactg

SEQ ID NO: 511611 - DNA, 25 bp, Rattus norvegicus
tccactgcggacgaatcccggggct

SEQ ID NO: 511612 - DNA, 25 bp, Rattus norvegicus
tcctgagcctgccttttccaacgtg

SEQ ID NO: 511613 - DNA, 25 bp, Rattus norvegicus
gagcctgccttttccaacgtgctca

SEQ ID NO: 511614 - DNA, 25 bp, Rattus norvegicus
gggccgcatcccagagttctgcatc

SEQ ID NO: 511615 - DNA, 25 bp, Rattus norvegicus
ttgcctgtgccggacgctcccgaat

SEQ ID NO: 511616 - DNA, 25 bp, Rattus norvegicus
ccgacctatggccacgcacccatga

SEQ ID NO: 511617 - DNA, 25 bp, Rattus norvegicus
cccatgacggccgtgagaatggtga

SEQ ID NO: 511618 - DNA, 25 bp, Rattus norvegicus
ggcgcgcacggtttacggcttctgt

SEQ ID NO: 511619 - DNA, 25 bp, Rattus norvegicus
ggtttcgccaccgtgcgcatacctg

SEQ ID NO: 511620 - DNA, 25 bp, Rattus norvegicus
accgtgcgcatacctgcgcgtggca

SEQ ID NO: 511621 - DNA, 25 bp, Rattus norvegicus
gcatacctgcgcgtggcagcgccga

SEQ ID NO: 511622 - DNA, 25 bp, Rattus norvegicus
gcagcgccgagcctcagattctgag

SEQ ID NO: 511623 - DNA, 25 bp, Rattus norvegicus
gctcccgatggtctgttgagccgcg

SEQ ID NO: 511624 - DNA, 25 bp, Rattus norvegicus
gagcctcagattctgagctcgccgc

SEQ ID NO: 511625 - DNA, 25 bp, Rattus norvegicus
ctcttgcgcgctcccgatggtctgt

SEQ ID NO: 511626 - DNA, 25 bp, Rattus norvegicus
aggcatcgcgcagcgcagccgaagc

SEQ ID NO: 511627 - DNA, 25 bp, Rattus norvegicus
caagagccgctccagacaccacatc

SEQ ID NO: 511628 - DNA, 25 bp, Rattus norvegicus
agaaacccatctcggtcccgcaaga

SEQ ID NO: 511629 - DNA, 25 bp, Rattus norvegicus
acgccgcggacgaacgagccttgga

SEQ ID NO: 511630 - DNA, 25 bp, Rattus norvegicus
cacgtttgcgcacgccgcggacgaa

SEQ ID NO: 511631 - DNA, 25 bp, Rattus norvegicus
gtctggagtgagcacgtttgcgcac

SEQ ID NO: 511632 - DNA, 25 bp, Rattus norvegicus
aacctcggcgggatgcaaaactctg

SEQ ID NO: 511633 - DNA, 25 bp, Rattus norvegicus
actccacgtccgcagcccaggcatc

SEQ ID NO: 511634 - DNA, 25 bp, Rattus norvegicus
agccgaagccgtgctaggctccaac

SEQ ID NO: 511635 - DNA, 25 bp, Rattus norvegicus
tccgagactcggtgcgggctcgcat

SEQ ID NO: 511636 - DNA, 25 bp, Rattus norvegicus
gcaaaactctgggatgcggtctgga

SEQ ID NO: 511637 - DNA, 25 bp, Rattus norvegicus
ccgcgccatcgtcggactccacgtc

SEQ ID NO: 511638 - DNA, 25 bp, Rattus norvegicus
aggctccaacctcggcgggatgcaa

SEQ ID NO: 511639 - DNA, 25 bp, Rattus norvegicus
cagaagccgtaaacggtacgcgcgc

SEQ ID NO: 511640 - DNA, 25 bp, Rattus norvegicus
tcccggtcccgccatggtgttggag

SEQ ID NO: 511641 - DNA, 25 bp, Rattus norvegicus
agtcggtggtcgctgacttgctgaa

SEQ ID NO: 511642 - DNA, 25 bp, Rattus norvegicus
gtggtcgctgacttgctgaatcgct

SEQ ID NO: 511643 - DNA, 25 bp, Rattus norvegicus
gacttgctgaatcgcttcctagggg

SEQ ID NO: 511644 - DNA, 25 bp, Rattus norvegicus
ctgaatcgcttcctaggggactacg

SEQ ID NO: 511645 - DNA, 25 bp, Rattus norvegicus
tcggtcccctgtaatcctgtaagtg

SEQ ID NO: 511646 - DNA, 25 bp, Rattus norvegicus
ccggtcccgccatggtgttggagtc

SEQ ID NO: 511647 - DNA, 25 bp, Rattus norvegicus
ggtcgctgacttgctgaatcgcttc

SEQ ID NO: 511648 - DNA, 25 bp, Rattus norvegicus
ctgacttgctgaatcgcttcctagg

SEQ ID NO: 511649 - DNA, 25 bp, Rattus norvegicus
cgctgacttgctgaatcgcttccta

SEQ ID NO: 511650 - DNA, 25 bp, Rattus norvegicus
cggggcgggcctcagctgtcagtct

SEQ ID NO: 511651 - DNA, 25 bp, Rattus norvegicus
cttgctgaatcgcttcctaggggac

SEQ ID NO: 511652 - DNA, 25 bp, Rattus norvegicus
cctgtaatcctgtaagtgggggcga

SEQ ID NO: 511653 - DNA, 25 bp, Rattus norvegicus
tgctgaatcgcttcctaggggacta

SEQ ID NO: 511654 - DNA, 25 bp, Rattus norvegicus
cttttctactgcagctctccgggtc

SEQ ID NO: 511655 - DNA, 25 bp, Rattus norvegicus
ccgggcaaaagggagaagcgcaact

SEQ ID NO: 511656 - DNA, 25 bp, Rattus norvegicus
caactttgtaacctgctgcgggttc

SEQ ID NO: 511657 - DNA, 25 bp, Rattus norvegicus
cactccacgcgcgatcggagggagc

SEQ ID NO: 511658 - DNA, 25 bp, Rattus norvegicus
cgaagcgggcagcttttctactgca

SEQ ID NO: 511659 - DNA, 25 bp, Rattus norvegicus
ctgcaaagaccagctatccaaatta

SEQ ID NO: 511660 - DNA, 25 bp, Rattus norvegicus
tcgaggcgtgtgttcgaatcctccc

SEQ ID NO: 511661 - DNA, 25 bp, Rattus norvegicus
ccttttctgcttttgacagtttctc

SEQ ID NO: 511662 - DNA, 25 bp, Rattus norvegicus
agctccagccgaggtaggagacgca

SEQ ID NO: 511663 - DNA, 25 bp, Rattus norvegicus
cgagcgttgacagctaggcgactcc

SEQ ID NO: 511664 - DNA, 25 bp, Rattus norvegicus
caggcagagctatgcgagctccagc

SEQ ID NO: 511665 - DNA, 25 bp, Rattus norvegicus
gtctgtttgtggctactcgcttcct

SEQ ID NO: 511666 - DNA, 25 bp, Rattus norvegicus
ctcgcttcctcagttaccttttctg

SEQ ID NO: 511667 - DNA, 25 bp, Rattus norvegicus
tgcaaacttttgaaagccagtgctg

SEQ ID NO: 511668 - DNA, 25 bp, Rattus norvegicus
tggcgtctccttagccgctgtcact

SEQ ID NO: 511669 - DNA, 25 bp, Rattus norvegicus
gggccacggcagagtagccactaga

SEQ ID NO: 511670 - DNA, 25 bp, Rattus norvegicus
agccggtcacatggagcctcttatg

SEQ ID NO: 511671 - DNA, 25 bp, Rattus norvegicus
gcctcttatggctcgggatggctct

SEQ ID NO: 511672 - DNA, 25 bp, Rattus norvegicus
caccgcggcgtaaaggatgtatttt

SEQ ID NO: 511673 - DNA, 25 bp, Rattus norvegicus
atcgcagcgatgaaaggtgagctcc

SEQ ID NO: 511674 - DNA, 25 bp, Rattus norvegicus
ccaaagaaagtttgccgagagtcgc

SEQ ID NO: 511675 - DNA, 25 bp, Rattus norvegicus
agtcgcagctcttggaacgcatagg

SEQ ID NO: 511676 - DNA, 25 bp, Rattus norvegicus
aacgcatagggaggatctggcaact

SEQ ID NO: 511677 - DNA, 25 bp, Rattus norvegicus
cccgggacaactctggcctatgtgg

SEQ ID NO: 511678 - DNA, 25 bp, Rattus norvegicus
aggccgagccctgaatgcgaacgct

SEQ ID NO: 511679 - DNA, 25 bp, Rattus norvegicus
atgcgaacgctagtggtgtcatccc

SEQ ID NO: 511680 - DNA, 25 bp, Rattus norvegicus
cccaggactggttagcgttccaggc

SEQ ID NO: 511681 - DNA, 25 bp, Rattus norvegicus
agctcacgtacagcccaggggcagc

SEQ ID NO: 511682 - DNA, 25 bp, Rattus norvegicus
gcagcaattgtgagcaccctgaagg

SEQ ID NO: 511683 - DNA, 25 bp, Rattus norvegicus
aggcagcaattgtgagcaccctgaa

SEQ ID NO: 511684 - DNA, 25 bp, Rattus norvegicus
agcaccctgaaggtcttgccggggt

SEQ ID NO: 511685 - DNA, 25 bp, Rattus norvegicus
tcttgccggggttttgccctccagc

SEQ ID NO: 511686 - DNA, 25 bp, Rattus norvegicus
tgccggggttttgccctccagcgcg

SEQ ID NO: 511687 - DNA, 25 bp, Rattus norvegicus
ccggtgctctttaaacgtttgctag

SEQ ID NO: 511688 - DNA, 25 bp, Rattus norvegicus
cggtgctctttaaacgtttgctagg

SEQ ID NO: 511689 - DNA, 25 bp, Rattus norvegicus
gattattttgtcgttgcaatccagg

SEQ ID NO: 511690 - DNA, 25 bp, Rattus norvegicus
tttgtcgttgcaatccaggatgaag

SEQ ID NO: 511691 - DNA, 25 bp, Rattus norvegicus
cgttgcaatccaggatgaaggacac

SEQ ID NO: 511692 - DNA, 25 bp, Rattus norvegicus
ggatgaaggacacccgtaccgtatc

SEQ ID NO: 511693 - DNA, 25 bp, Rattus norvegicus
tgaaggacacccgtaccgtatctac

SEQ ID NO: 511694 - DNA, 25 bp, Rattus norvegicus
ggtttaggattattttgtcgttgca

SEQ ID NO: 511695 - DNA, 25 bp, Rattus norvegicus
ctcagaggcagcaattgtgagcacc

SEQ ID NO: 511696 - DNA, 25 bp, Rattus norvegicus
acaggcgcctcgacctttgcagatg

SEQ ID NO: 511697 - DNA, 25 bp, Rattus norvegicus
cggcggataatctgcccaagcaatg

SEQ ID NO: 511698 - DNA, 25 bp, Rattus norvegicus
taatctgcccaagcaatgtgcaggc

SEQ ID NO: 511699 - DNA, 25 bp, Rattus norvegicus
cggcttggggatttaaagctccatc

SEQ ID NO: 511700 - DNA, 25 bp, Rattus norvegicus
ggatttaaagctccatctgtctgtg

SEQ ID NO: 511701 - DNA, 25 bp, Rattus norvegicus
gcgatcgtgcgcctgctgggtcctc

SEQ ID NO: 511702 - DNA, 25 bp, Rattus norvegicus
agcactctgcgcgatcgtgcgcctg

SEQ ID NO: 511703 - DNA, 25 bp, Rattus norvegicus
tggaaagactcagcccgcagcactc

SEQ ID NO: 511704 - DNA, 25 bp, Rattus norvegicus
ctcgacctttgcagatggccctgga

SEQ ID NO: 511705 - DNA, 25 bp, Rattus norvegicus
agggagaaatcgaaacaggcgcctc

SEQ ID NO: 511706 - DNA, 25 bp, Rattus norvegicus
taaagctccatctgtctgtggcaca

SEQ ID NO: 511707 - DNA, 25 bp, Rattus norvegicus
tgtctgtggcacagtgaccgctcct

SEQ ID NO: 511708 - DNA, 25 bp, Rattus norvegicus
ctgctgggtcctcccggcggataat

SEQ ID NO: 511709 - DNA, 25 bp, Rattus norvegicus
ttgcagatggccctggaaagactca

SEQ ID NO: 511710 - DNA, 25 bp, Rattus norvegicus
tccagccgctgtgccgaggataacg

SEQ ID NO: 511711 - DNA, 25 bp, Rattus norvegicus
gtaaatggaagtggaatccaacttg

SEQ ID NO: 511712 - DNA, 25 bp, Rattus norvegicus
cccccctctggctgagcgggagaga

SEQ ID NO: 511713 - DNA, 25 bp, Rattus norvegicus
tgcttggcgcgatttgtctgacact

SEQ ID NO: 511714 - DNA, 25 bp, Rattus norvegicus
gtgccgaggataacggaataccacc

SEQ ID NO: 511715 - DNA, 25 bp, Rattus norvegicus
cacttgtaaatggaagtggaatcca

SEQ ID NO: 511716 - DNA, 25 bp, Rattus norvegicus
accgggattcaggtccggagcgcaa

SEQ ID NO: 511717 - DNA, 25 bp, Rattus norvegicus
ccaacttggaagtaaacgcgccaga

SEQ ID NO: 511718 - DNA, 25 bp, Rattus norvegicus
gcagagaaagggttcttccatcctc

SEQ ID NO: 511719 - DNA, 25 bp, Rattus norvegicus
gggttcttccatcctcagcctagtc

SEQ ID NO: 511720 - DNA, 25 bp, Rattus norvegicus
tcagcctagtccagtgtccctccct

SEQ ID NO: 511721 - DNA, 25 bp, Rattus norvegicus
ccgctgtgccgaggataacggaata

SEQ ID NO: 511722 - DNA, 25 bp, Rattus norvegicus
cggaataccaccaccgggattcagg

SEQ ID NO: 511723 - DNA, 25 bp, Rattus norvegicus
gcgcgatttgtctgacacttgtaaa

SEQ ID NO: 511724 - DNA, 25 bp, Rattus norvegicus
gtctgaggcagcgagcgcctcaccg

SEQ ID NO: 511725 - DNA, 25 bp, Rattus norvegicus
tctcggggccggagccgcttgggac

SEQ ID NO: 511726 - DNA, 25 bp, Rattus norvegicus
atggggccttcctaggcgggaagca

SEQ ID NO: 511727 - DNA, 25 bp, Rattus norvegicus
cgtgtgtggaagtgtcggcttttct

SEQ ID NO: 511728 - DNA, 25 bp, Rattus norvegicus
gtgtgtggaagtgtcggcttttctc

SEQ ID NO: 511729 - DNA, 25 bp, Rattus norvegicus
tgtgtggaagtgtcggcttttctcg

SEQ ID NO: 511730 - DNA, 25 bp, Rattus norvegicus
cttttctcggggccggagccgcttg

SEQ ID NO: 511731 - DNA, 25 bp, Rattus norvegicus
ggcgggagagggaacatggcgaccc

SEQ ID NO: 511732 - DNA, 25 bp, Rattus norvegicus
gagagggaacatggcgacccggtct

SEQ ID NO: 511733 - DNA, 25 bp, Rattus norvegicus
gaacatggcgacccggtctgaggca

SEQ ID NO: 511734 - DNA, 25 bp, Rattus norvegicus
ccggtctgaggcagcgagcgcctca

SEQ ID NO: 511735 - DNA, 25 bp, Rattus norvegicus
tcagcaaagcgtgtgtggaagtgtc

SEQ ID NO: 511736 - DNA, 25 bp, Rattus norvegicus
ctgaggtgggcggaaaggcggctgc

SEQ ID NO: 511737 - DNA, 25 bp, Rattus norvegicus
cggtctgaggcagcgagcgcctcac

SEQ ID NO: 511738 - DNA, 25 bp, Rattus norvegicus
atgcccgctatggcctcggggttgc

SEQ ID NO: 511739 - DNA, 25 bp, Rattus norvegicus
caacagagttgcaaagtgtcccgcg

SEQ ID NO: 511740 - DNA, 25 bp, Rattus norvegicus
gcgggcccagcaacagagttgcaaa

SEQ ID NO: 511741 - DNA, 25 bp, Rattus norvegicus
cttcagctgatctgcgggcccagca

SEQ ID NO: 511742 - DNA, 25 bp, Rattus norvegicus
cccacccagcccagtcgggccgctc

SEQ ID NO: 511743 - DNA, 25 bp, Rattus norvegicus
ctcggagagggaccggccccttcag

SEQ ID NO: 511744 - DNA, 25 bp, Rattus norvegicus
ccagtcgggccgctcggcttctagg

SEQ ID NO: 511745 - DNA, 25 bp, Rattus norvegicus
gggcaggctccagcgatgcggaccc

SEQ ID NO: 511746 - DNA, 25 bp, Rattus norvegicus
cggcttctagggaggctctctgcaa

SEQ ID NO: 511747 - DNA, 25 bp, Rattus norvegicus
tctgcaataggtgcccggcccaggt

SEQ ID NO: 511748 - DNA, 25 bp, Rattus norvegicus
tctctgcaataggtgcccggcccag

SEQ ID NO: 511749 - DNA, 25 bp, Rattus norvegicus
aggctctctgcaataggtgcccggc

SEQ ID NO: 511750 - DNA, 25 bp, Rattus norvegicus
cccagcaacagagttgcaaagtgtc

SEQ ID NO: 511751 - DNA, 25 bp, Rattus norvegicus
gaggatggggcggatataaaagccc

SEQ ID NO: 511752 - DNA, 25 bp, Rattus norvegicus
ccggaggactggtcggatctgaaaa

SEQ ID NO: 511753 - DNA, 25 bp, Rattus norvegicus
tgagcggcagcatcttctccggaga

SEQ ID NO: 511754 - DNA, 25 bp, Rattus norvegicus
ctcaggccgagacacagatataggg

SEQ ID NO: 511755 - DNA, 25 bp, Rattus norvegicus
tggtctgacttgagcaccttgaagc

SEQ ID NO: 511756 - DNA, 25 bp, Rattus norvegicus
aacttgtagatttcgctgagcggca

SEQ ID NO: 511757 - DNA, 25 bp, Rattus norvegicus
tctccggagagctctggatggccat

SEQ ID NO: 511758 - DNA, 25 bp, Rattus norvegicus
atcttcttgcttggccacttgctca

SEQ ID NO: 511759 - DNA, 25 bp, Rattus norvegicus
tgcagagacaccaacgagagcactc

SEQ ID NO: 511760 - DNA, 25 bp, Rattus norvegicus
ggggattcaggtgccagcaactttg

SEQ ID NO: 511761 - DNA, 25 bp, Rattus norvegicus
tttgcgcactaaactggatggaccc

SEQ ID NO: 511762 - DNA, 25 bp, Rattus norvegicus
accgtgagcagcagagaggtttgca

SEQ ID NO: 511763 - DNA, 25 bp, Rattus norvegicus
ccaagttactggtccgcatccggga

SEQ ID NO: 511764 - DNA, 25 bp, Rattus norvegicus
ggactcagcccggtagagctcctct

SEQ ID NO: 511765 - DNA, 25 bp, Rattus norvegicus
ccgccgcgggatcttaatgaagcaa

SEQ ID NO: 511766 - DNA, 25 bp, Rattus norvegicus
gccgcggaacaacaacacagacaca

SEQ ID NO: 511767 - DNA, 25 bp, Rattus norvegicus
tggcggtgaactgctgaattaaccc

SEQ ID NO: 511768 - DNA, 25 bp, Rattus norvegicus
ctcttaccggtgatggcggtgaact

SEQ ID NO: 511769 - DNA, 25 bp, Rattus norvegicus
gtaaccgcgtctcttaccggtgatg

SEQ ID NO: 511770 - DNA, 25 bp, Rattus norvegicus
gtcgtctgttcctcaggagagggca

SEQ ID NO: 511771 - DNA, 25 bp, Rattus norvegicus
cgcacgataccaagagaaggtgatg

SEQ ID NO: 511772 - DNA, 25 bp, Rattus norvegicus
cgggccgcacgataccaagagaagg

SEQ ID NO: 511773 - DNA, 25 bp, Rattus norvegicus
gggacgcactgcaccgccttgtcgg

SEQ ID NO: 511774 - DNA, 25 bp, Rattus norvegicus
atggcatgaggggacgcactgcacc

SEQ ID NO: 511775 - DNA, 25 bp, Rattus norvegicus
gttaaagcaagacggccctcacacg

SEQ ID NO: 511776 - DNA, 25 bp, Rattus norvegicus
ccggcctcaccgttaaagcaagacg

SEQ ID NO: 511777 - DNA, 25 bp, Rattus norvegicus
taaagacgcggcagaacccaccggc

SEQ ID NO: 511778 - DNA, 25 bp, Rattus norvegicus
ggatgtgtaaagacgcggcagaacc

SEQ ID NO: 511779 - DNA, 25 bp, Rattus norvegicus
caggttttgcgcaggcgtacttccc

SEQ ID NO: 511780 - DNA, 25 bp, Rattus norvegicus
gtccggagcagaacaaagaaacttg

SEQ ID NO: 511781 - DNA, 25 bp, Rattus norvegicus
ctgcaagagaatccgccaggccagg

SEQ ID NO: 511782 - DNA, 25 bp, Rattus norvegicus
accggcgtcagtccggagcagaaca

SEQ ID NO: 511783 - DNA, 25 bp, Rattus norvegicus
tccgtgttcctaaccggcgtcagtc

SEQ ID NO: 511784 - DNA, 25 bp, Rattus norvegicus
tagccacgtttgttccgtgttccta

SEQ ID NO: 511785 - DNA, 25 bp, Rattus norvegicus
cttccttttccgtctgtggccgaga

SEQ ID NO: 511786 - DNA, 25 bp, Rattus norvegicus
tgcctcggacgctggtgccagtctt

SEQ ID NO: 511787 - DNA, 25 bp, Rattus norvegicus
cagctggagggctgcaagagaatcc

SEQ ID NO: 511788 - DNA, 25 bp, Rattus norvegicus
tccacagccgaccaagggcagcggg

SEQ ID NO: 511789 - DNA, 25 bp, Rattus norvegicus
ctgcagctgagaccgtccgggaaaa

SEQ ID NO: 511790 - DNA, 25 bp, Rattus norvegicus
cactgaatccgggtcagctgctgcc

SEQ ID NO: 511791 - DNA, 25 bp, Rattus norvegicus
cggcgtgctcactgaatccgggtca

SEQ ID NO: 511792 - DNA, 25 bp, Rattus norvegicus
cgctggggattttaggataacgcca

SEQ ID NO: 511793 - DNA, 25 bp, Rattus norvegicus
agaaacttgggcgtgtagtgcaccc

SEQ ID NO: 511794 - DNA, 25 bp, Rattus norvegicus
ggagacacctctgaagactcacccg

SEQ ID NO: 511795 - DNA, 25 bp, Rattus norvegicus
gccctgcgcatcagcatgcagttaa

SEQ ID NO: 511796 - DNA, 25 bp, Rattus norvegicus
agttaaccctttcgcgtccagagtg

SEQ ID NO: 511797 - DNA, 25 bp, Rattus norvegicus
tccagagtgtcacacggggcacgca

SEQ ID NO: 511798 - DNA, 25 bp, Rattus norvegicus
cagcactatcccatgcttatccatg

SEQ ID NO: 511799 - DNA, 25 bp, Rattus norvegicus
tgcttatccatggagtggttgctcc

SEQ ID NO: 511800 - DNA, 25 bp, Rattus norvegicus
tggttgctccaaggtcacatcgaca

SEQ ID NO: 511801 - DNA, 25 bp, Rattus norvegicus
cacatcgacagtccctgcgggagca

SEQ ID NO: 511802 - DNA, 25 bp, Rattus norvegicus
ccacccagttcgctgcagggagtcg

SEQ ID NO: 511803 - DNA, 25 bp, Rattus norvegicus
tgcttgtgtccagaggatgcccaga

SEQ ID NO: 511804 - DNA, 25 bp, Rattus norvegicus
tctgaagactcacccgcgcgcggat

SEQ ID NO: 511805 - DNA, 25 bp, Rattus norvegicus
aaatagcctttctgcgacgccgcgg

SEQ ID NO: 511806 - DNA, 25 bp, Rattus norvegicus
gagcacccgctgcttgtgtccagag

SEQ ID NO: 511807 - DNA, 25 bp, Rattus norvegicus
gatgcaataccacttgcgctctgcg

SEQ ID NO: 511808 - DNA, 25 bp, Rattus norvegicus
ggtctacatgccacaactctccgag

SEQ ID NO: 511809 - DNA, 25 bp, Rattus norvegicus
aggagaccgcgttccaaccctagtg

SEQ ID NO: 511810 - DNA, 25 bp, Rattus norvegicus
ccctgtgtggggtaaacacctcctg

SEQ ID NO: 511811 - DNA, 25 bp, Rattus norvegicus
ctgcacaaaggcaggcaggggctcc

SEQ ID NO: 511812 - DNA, 25 bp, Rattus norvegicus
agactctgttctcctccagcgaagg

SEQ ID NO: 511813 - DNA, 25 bp, Rattus norvegicus
tgtccgttttcacccgcatagtcgt

SEQ ID NO: 511814 - DNA, 25 bp, Rattus norvegicus
ccagagagtgtgtatgtccgttttc

SEQ ID NO: 511815 - DNA, 25 bp, Rattus norvegicus
tgaagtgactttctgcgccggcaaa

SEQ ID NO: 511816 - DNA, 25 bp, Rattus norvegicus
ccaagggtggcaaggaaaactctct

SEQ ID NO: 511817 - DNA, 25 bp, Rattus norvegicus
gagctctgatttcctgccgtttgca

SEQ ID NO: 511818 - DNA, 25 bp, Rattus norvegicus
ggagtatgcacttctggagctctga

SEQ ID NO: 511819 - DNA, 25 bp, Rattus norvegicus
cgggcacctaccttgggcaagctgc

SEQ ID NO: 511820 - DNA, 25 bp, Rattus norvegicus
caggaagctccagagcgggcaccta

SEQ ID NO: 511821 - DNA, 25 bp, Rattus norvegicus
gctgccagctgtctgaagccagaga

SEQ ID NO: 511822 - DNA, 25 bp, Rattus norvegicus
aagccgggcctctggaccgctctgg

SEQ ID NO: 511823 - DNA, 25 bp, Rattus norvegicus
gcctgggtccgcgattcaaataccg

SEQ ID NO: 511824 - DNA, 25 bp, Rattus norvegicus
ggtccgcgattcaaataccgcgccg

SEQ ID NO: 511825 - DNA, 25 bp, Rattus norvegicus
acgcaccattgggtggacgcacgca

SEQ ID NO: 511826 - DNA, 25 bp, Rattus norvegicus
gtctcagggccttgccgctctgcgt

SEQ ID NO: 511827 - DNA, 25 bp, Rattus norvegicus
acaccgttgggagtctcagggcctt

SEQ ID NO: 511828 - DNA, 25 bp, Rattus norvegicus
atccgcgacaccgttgggagtctca

SEQ ID NO: 511829 - DNA, 25 bp, Rattus norvegicus
cgccgctcacgcaccattgggtgga

SEQ ID NO: 511830 - DNA, 25 bp, Rattus norvegicus
actccgatccgcgacaccgttggga

SEQ ID NO: 511831 - DNA, 25 bp, Rattus norvegicus
aagtgcggacgaggcactgccactc

SEQ ID NO: 511832 - DNA, 25 bp, Rattus norvegicus
ccatgagggccgctctggcaagtgc

SEQ ID NO: 511833 - DNA, 25 bp, Rattus norvegicus
agcgaactcaccgtcgggcgtcgga

SEQ ID NO: 511834 - DNA, 25 bp, Rattus norvegicus
agcgcctcgcctgtagctttccggg

SEQ ID NO: 511835 - DNA, 25 bp, Rattus norvegicus
tccacggcctgggtccgcgattcaa

SEQ ID NO: 511836 - DNA, 25 bp, Rattus norvegicus
agcggcggccacagggagcaatccc

SEQ ID NO: 511837 - DNA, 25 bp, Rattus norvegicus
aaagcgagcgcgtcgaaccctcacg

SEQ ID NO: 511838 - DNA, 25 bp, Rattus norvegicus
actccctcccaagaggctgtgggtg

SEQ ID NO: 511839 - DNA, 25 bp, Rattus norvegicus
tgtcgccgggacacaatgagccact

SEQ ID NO: 511840 - DNA, 25 bp, Rattus norvegicus
gctgtcctcaggagggcgtttgaca

SEQ ID NO: 511841 - DNA, 25 bp, Rattus norvegicus
tttacgacagttcggaaagcgagcg

SEQ ID NO: 511842 - DNA, 25 bp, Rattus norvegicus
tctcacagcagcatgtctgcgcatg

SEQ ID NO: 511843 - DNA, 25 bp, Rattus norvegicus
attggctttcgcgaactgttggccc

SEQ ID NO: 511844 - DNA, 25 bp, Rattus norvegicus
ctgttggcccagtggaacgaagtta

SEQ ID NO: 511845 - DNA, 25 bp, Rattus norvegicus
agctgattgcgttcactttcttccg

SEQ ID NO: 511846 - DNA, 25 bp, Rattus norvegicus
ttccgtgatttcgaactcaacagta

SEQ ID NO: 511847 - DNA, 25 bp, Rattus norvegicus
ctcaacagtacttcgacataattcc

SEQ ID NO: 511848 - DNA, 25 bp, Rattus norvegicus
cggggttaccttcctcactccattg

SEQ ID NO: 511849 - DNA, 25 bp, Rattus norvegicus
cttcctctttgcattggctttcgcg

SEQ ID NO: 511850 - DNA, 25 bp, Rattus norvegicus
ggccacgctagaggctgaaccaatg

SEQ ID NO: 511851 - DNA, 25 bp, Rattus norvegicus
cgggaaccgtagcacagaggatagc

SEQ ID NO: 511852 - DNA, 25 bp, Rattus norvegicus
ctcatgaggcgatggctctaggttc

SEQ ID NO: 511853 - DNA, 25 bp, Rattus norvegicus
tgaaccaatggtccgctcggagctc

SEQ ID NO: 511854 - DNA, 25 bp, Rattus norvegicus
tccatgcctgcttagtgcgcacgcg

SEQ ID NO: 511855 - DNA, 25 bp, Rattus norvegicus
gcagcgcgttgctttcccaagatgg

SEQ ID NO: 511856 - DNA, 25 bp, Rattus norvegicus
tgcgggtcatcgacctcaggtccga

SEQ ID NO: 511857 - DNA, 25 bp, Rattus norvegicus
cgcaacttggacatcaacggggtca

SEQ ID NO: 511858 - DNA, 25 bp, Rattus norvegicus
agacggtactggtctcccggctgaa

SEQ ID NO: 511859 - DNA, 25 bp, Rattus norvegicus
tggctttccagcaacctcgcgagct

SEQ ID NO: 511860 - DNA, 25 bp, Rattus norvegicus
tactctgtactatggggtgcctctc

SEQ ID NO: 511861 - DNA, 25 bp, Rattus norvegicus
cgcgcgaggacagttaagaggccac

SEQ ID NO: 511862 - DNA, 25 bp, Rattus norvegicus
tacttccgggaaggcttgcgtacac

SEQ ID NO: 511863 - DNA, 25 bp, Rattus norvegicus
ccctcatttaggaggagtactactc

SEQ ID NO: 511864 - DNA, 25 bp, Rattus norvegicus
ctggtcctatagacaccgcggccgg

SEQ ID NO: 511865 - DNA, 25 bp, Rattus norvegicus
ctcgacgacgcgctgttcttcaagt

SEQ ID NO: 511866 - DNA, 25 bp, Rattus norvegicus
ctcctcgctattgaactcagagcta

SEQ ID NO: 511867 - DNA, 25 bp, Rattus norvegicus
ctcagagctactggggaaagaatgc

SEQ ID NO: 511868 - DNA, 25 bp, Rattus norvegicus
actccagggagtccaagctaggcga

SEQ ID NO: 511869 - DNA, 25 bp, Rattus norvegicus
ctcggccaggcacgtcaccgtagag

SEQ ID NO: 511870 - DNA, 25 bp, Rattus norvegicus
tgccctcttgaaggcgcctccgagg

SEQ ID NO: 511871 - DNA, 25 bp, Rattus norvegicus
ccgcagcgccactaggaaaataatc

SEQ ID NO: 511872 - DNA, 25 bp, Rattus norvegicus
tgttcttcaagtccgagcccgcgct

SEQ ID NO: 511873 - DNA, 25 bp, Rattus norvegicus
cccgagttccaaaggctgtgggctg

SEQ ID NO: 511874 - DNA, 25 bp, Rattus norvegicus
ccgacgccatgacagcggctctgta

SEQ ID NO: 511875 - DNA, 25 bp, Rattus norvegicus
tgagacgctccgacccactcaggga

SEQ ID NO: 511876 - DNA, 25 bp, Rattus norvegicus
tcccgctttttcaggcctgggaagc

SEQ ID NO: 511877 - DNA, 25 bp, Rattus norvegicus
ggtcaccttgtgctgccctcttgaa

SEQ ID NO: 511878 - DNA, 25 bp, Rattus norvegicus
ccacccgaagacaaggggagcagga

SEQ ID NO: 511879 - DNA, 25 bp, Rattus norvegicus
ggatgaccagagatctccgagcgcc

SEQ ID NO: 511880 - DNA, 25 bp, Rattus norvegicus
gtgtcctcggtggtcttcctttcaa

SEQ ID NO: 511881 - DNA, 25 bp, Rattus norvegicus
tgtggagcggcaccgggttctccat

SEQ ID NO: 511882 - DNA, 25 bp, Rattus norvegicus
ctactgccgactgtggagcggcacc

SEQ ID NO: 511883 - DNA, 25 bp, Rattus norvegicus
ttgcaccgctactgccgactgtgga

SEQ ID NO: 511884 - DNA, 25 bp, Rattus norvegicus
ctctaggcagcttgcaccgctactg

SEQ ID NO: 511885 - DNA, 25 bp, Rattus norvegicus
tctcgcgtctgctctaggcagcttg

SEQ ID NO: 511886 - DNA, 25 bp, Rattus norvegicus
ggagcgatttctcgcgtctgctcta

SEQ ID NO: 511887 - DNA, 25 bp, Rattus norvegicus
cagcctgccgggaggagcgatttct

SEQ ID NO: 511888 - DNA, 25 bp, Rattus norvegicus
gtcccaacgcgcagccctgatcaca

SEQ ID NO: 511889 - DNA, 25 bp, Rattus norvegicus
ctttcaagcctagggcgagctggcc

SEQ ID NO: 511890 - DNA, 25 bp, Rattus norvegicus
ggtcttcctttcaagcctagggcga

SEQ ID NO: 511891 - DNA, 25 bp, Rattus norvegicus
agagatctccgagcgccacccgaag

SEQ ID NO: 511892 - DNA, 25 bp, Rattus norvegicus
cctgctcgccggcagcggacaggaa

SEQ ID NO: 511893 - DNA, 25 bp, Rattus norvegicus
cgcgcagactcgcagcaacttgcga

SEQ ID NO: 511894 - DNA, 25 bp, Rattus norvegicus
gtcaggtctcctcagcttctgtcag

SEQ ID NO: 511895 - DNA, 25 bp, Rattus norvegicus
cgcgtgtcaggtctcctcagcttct

SEQ ID NO: 511896 - DNA, 25 bp, Rattus norvegicus
aattctgctcctctcctgggcggcg

SEQ ID NO: 511897 - DNA, 25 bp, Rattus norvegicus
ggcagcgcggcgcttgcattgttct

SEQ ID NO: 511898 - DNA, 25 bp, Rattus norvegicus
tgcattgttctggaagcgagcgagc

SEQ ID NO: 511899 - DNA, 25 bp, Rattus norvegicus
atggtgttgccgacagtgttaattc

SEQ ID NO: 511900 - DNA, 25 bp, Rattus norvegicus
atgcaccgcggttaacccgtgagga

SEQ ID NO: 511901 - DNA, 25 bp, Rattus norvegicus
ctcaggatcgatgcaccgcggttaa

SEQ ID NO: 511902 - DNA, 25 bp, Rattus norvegicus
cagcaacttgcgaggttggcagcgc

SEQ ID NO: 511903 - DNA, 25 bp, Rattus norvegicus
tcgcggctccctcaggatcgatgca

SEQ ID NO: 511904 - DNA, 25 bp, Rattus norvegicus
tacggatgcgtcacgtggcgagaaa

SEQ ID NO: 511905 - DNA, 25 bp, Rattus norvegicus
gtgttaattctgctcctctcctggg

SEQ ID NO: 511906 - DNA, 25 bp, Rattus norvegicus
acctgcctatatacagcgagcgcgc

SEQ ID NO: 511907 - DNA, 25 bp, Rattus norvegicus
ccggtcccaaccagaaggcaatgcg

SEQ ID NO: 511908 - DNA, 25 bp, Rattus norvegicus
cctccggagtgtggggagcatctat

SEQ ID NO: 511909 - DNA, 25 bp, Rattus norvegicus
aaggctctctcggtctgctccggac

SEQ ID NO: 511910 - DNA, 25 bp, Rattus norvegicus
cgcgcacggccgtatgcaaatgtcc

SEQ ID NO: 511911 - DNA, 25 bp, Rattus norvegicus
tgcaaatgtcctcatgggccggccc

SEQ ID NO: 511912 - DNA, 25 bp, Rattus norvegicus
gtgggccgcacgtccaataagaagc

SEQ ID NO: 511913 - DNA, 25 bp, Rattus norvegicus
acgcccaacctcgagatcaagtaca

SEQ ID NO: 511914 - DNA, 25 bp, Rattus norvegicus
gtacaccaaggtaaagccgtcctgc

SEQ ID NO: 511915 - DNA, 25 bp, Rattus norvegicus
gccgtcctgcggacgctgcctagaa

SEQ ID NO: 511916 - DNA, 25 bp, Rattus norvegicus
agcgtcctctagatctcttcggtga

SEQ ID NO: 511917 - DNA, 25 bp, Rattus norvegicus
gcttctgaagttcctccctggcttg

SEQ ID NO: 511918 - DNA, 25 bp, Rattus norvegicus
gagagtctgagggaaccggtcccaa

SEQ ID NO: 511919 - DNA, 25 bp, Rattus norvegicus
ggccgcccatgacttccagcgagat

SEQ ID NO: 511920 - DNA, 25 bp, Rattus norvegicus
taggcgcggcccgagtaggtacaca

SEQ ID NO: 511921 - DNA, 25 bp, Rattus norvegicus
agtcgatctattaggcgcggcccga

SEQ ID NO: 511922 - DNA, 25 bp, Rattus norvegicus
cgctgtcaagccagtcgatctatta

SEQ ID NO: 511923 - DNA, 25 bp, Rattus norvegicus
ctcagactcgctgtcaagccagtcg

SEQ ID NO: 511924 - DNA, 25 bp, Rattus norvegicus
ccgggtctcaagacccagcggctca

SEQ ID NO: 511925 - DNA, 25 bp, Rattus norvegicus
acttccgtgtcgcagttgcagtgga

SEQ ID NO: 511926 - DNA, 25 bp, Rattus norvegicus
tcgggccgccgctggacttccgtgt

SEQ ID NO: 511927 - DNA, 25 bp, Rattus norvegicus
caagatcacccggaaaccgggctcg

SEQ ID NO: 511928 - DNA, 25 bp, Rattus norvegicus
cggagaccgccgctccaagatcacc

SEQ ID NO: 511929 - DNA, 25 bp, Rattus norvegicus
ctccagtgcccacgctccagcttct

SEQ ID NO: 511930 - DNA, 25 bp, Rattus norvegicus
gcgccacagaaggtcgcatccagct

SEQ ID NO: 511931 - DNA, 25 bp, Rattus norvegicus
ttgcagtggaggcagccctccagtg

SEQ ID NO: 511932 - DNA, 25 bp, Rattus norvegicus
tcttacttagtggaggacccgcctc

SEQ ID NO: 511933 - DNA, 25 bp, Rattus norvegicus
gaggacccgcctctttgcgcgaggc

SEQ ID NO: 511934 - DNA, 25 bp, Rattus norvegicus
tccgagccgaatggagctttattga

SEQ ID NO: 511935 - DNA, 25 bp, Rattus norvegicus
cgaacatggaatcgagggcgctgct

SEQ ID NO: 511936 - DNA, 25 bp, Rattus norvegicus
cagcatggagccatgcccgcgcata

SEQ ID NO: 511937 - DNA, 25 bp, Rattus norvegicus
cgcaaggtcaccttcgcgcgacagg

SEQ ID NO: 511938 - DNA, 25 bp, Rattus norvegicus
agagcccgttccctgatccctattt

SEQ ID NO: 511939 - DNA, 25 bp, Rattus norvegicus
tgatccctatttcgggcaaccgcga

SEQ ID NO: 511940 - DNA, 25 bp, Rattus norvegicus
ttcgcctgcgctttgagaaagtata

SEQ ID NO: 511941 - DNA, 25 bp, Rattus norvegicus
accgcttactcgttgcgcaaaagtc

SEQ ID NO: 511942 - DNA, 25 bp, Rattus norvegicus
tgcatcaccgccgaagcctctgggt

SEQ ID NO: 511943 - DNA, 25 bp, Rattus norvegicus
gaagagcacggcttctccgagccga

SEQ ID NO: 511944 - DNA, 25 bp, Rattus norvegicus
ttcaaagctacagtgcgaacatgga

SEQ ID NO: 511945 - DNA, 25 bp, Rattus norvegicus
gcgggctttctctggatgtgtcctt

SEQ ID NO: 511946 - DNA, 25 bp, Rattus norvegicus
ggagtcgccattttcccggaagagc

SEQ ID NO: 511947 - DNA, 25 bp, Rattus norvegicus
gctttattgaaatgccggaaacgga

SEQ ID NO: 511948 - DNA, 25 bp, Rattus norvegicus
agttcccgggcagcgcttgtgctct

SEQ ID NO: 511949 - DNA, 25 bp, Rattus norvegicus
gcggccaccagcctgttctaaggga

SEQ ID NO: 511950 - DNA, 25 bp, Rattus norvegicus
cagcctgttctaagggacggtcata

SEQ ID NO: 511951 - DNA, 25 bp, Rattus norvegicus
gacggtcataaagagcacgctaaga

SEQ ID NO: 511952 - DNA, 25 bp, Rattus norvegicus
taagatcaaactgcagggaagggtc

SEQ ID NO: 511953 - DNA, 25 bp, Rattus norvegicus
ccgcagctgtcactagagccctgta

SEQ ID NO: 511954 - DNA, 25 bp, Rattus norvegicus
caggttcgccgccaactgttctgcg

SEQ ID NO: 511955 - DNA, 25 bp, Rattus norvegicus
actgttctgcgcgtctgcggtactg

SEQ ID NO: 511956 - DNA, 25 bp, Rattus norvegicus
ccggattccacgaccgacgcttagg

SEQ ID NO: 511957 - DNA, 25 bp, Rattus norvegicus
ccacgaccgacgcttaggctgagca

SEQ ID NO: 511958 - DNA, 25 bp, Rattus norvegicus
ttaggctgagcactgcgcaaaactg

SEQ ID NO: 511959 - DNA, 25 bp, Rattus norvegicus
agagccctgtacaggttcgccgcca

SEQ ID NO: 511960 - DNA, 25 bp, Rattus norvegicus
gggcagtcccagacgctccctagaa

SEQ ID NO: 511961 - DNA, 25 bp, Rattus norvegicus
cgcaaaactgcaagagctcgagccc

SEQ ID NO: 511962 - DNA, 25 bp, Rattus norvegicus
acacacggtgacctcgggcctcgga

SEQ ID NO: 511963 - DNA, 25 bp, Rattus norvegicus
tcggaaagccgcagctaaggctgca

SEQ ID NO: 511964 - DNA, 25 bp, Rattus norvegicus
ctgccgggaacgtcggaaagccgca

SEQ ID NO: 511965 - DNA, 25 bp, Rattus norvegicus
aagtaattggattccgggctgccgg

SEQ ID NO: 511966 - DNA, 25 bp, Rattus norvegicus
tcctcagggaaaagtaattggattc

SEQ ID NO: 511967 - DNA, 25 bp, Rattus norvegicus
tgcgcccaggaaaaggccacagaac

SEQ ID NO: 511968 - DNA, 25 bp, Rattus norvegicus
aaatagtcccgtcggctgctctgcg

SEQ ID NO: 511969 - DNA, 25 bp, Rattus norvegicus
atctcctgccactcatcctggagga

SEQ ID NO: 511970 - DNA, 25 bp, Rattus norvegicus
ggccacagaacacacggtgacctcg

SEQ ID NO: 511971 - DNA, 25 bp, Rattus norvegicus
acagggaagggctagctcgcttgcc

SEQ ID NO: 511972 - DNA, 25 bp, Rattus norvegicus
gggtgtacgaagctcctcagggaaa

SEQ ID NO: 511973 - DNA, 25 bp, Rattus norvegicus
actcatcctggaggacgctggcgtt

SEQ ID NO: 511974 - DNA, 25 bp, Rattus norvegicus
gagtgctgcgcccaggaaaaggcca

SEQ ID NO: 511975 - DNA, 25 bp, Rattus norvegicus
ccgcacgcggaaggacaaatagtcc

SEQ ID NO: 511976 - DNA, 25 bp, Rattus norvegicus
ctattgttgctgagcgagtgagtca

SEQ ID NO: 511977 - DNA, 25 bp, Rattus norvegicus
gggtggcgaatccagatgctgccca

SEQ ID NO: 511978 - DNA, 25 bp, Rattus norvegicus
agcacagcacttcagggcgcagcga

SEQ ID NO: 511979 - DNA, 25 bp, Rattus norvegicus
tgctgaggccgcttcagcgaaaaaa

SEQ ID NO: 511980 - DNA, 25 bp, Rattus norvegicus
aaatgtccgcctgaggagacccaca

SEQ ID NO: 511981 - DNA, 25 bp, Rattus norvegicus
tgaggagacccacaagttctatcgg

SEQ ID NO: 511982 - DNA, 25 bp, Rattus norvegicus
gcgctcccgaccaaagtgaacttta

SEQ ID NO: 511983 - DNA, 25 bp, Rattus norvegicus
actttaatcgggaaggttggatgcg

SEQ ID NO: 511984 - DNA, 25 bp, Rattus norvegicus
cgtgcggaactcaggtccctttgta

SEQ ID NO: 511985 - DNA, 25 bp, Rattus norvegicus
actcaggtccctttgtaccgcgcgg

SEQ ID NO: 511986 - DNA, 25 bp, Rattus norvegicus
cccgcaacttgtcagctctattgtt

SEQ ID NO: 511987 - DNA, 25 bp, Rattus norvegicus
tgagtcacttggtcttcgggtcgcc

SEQ ID NO: 511988 - DNA, 25 bp, Rattus norvegicus
ccgaagccgagccaccttggaaact

SEQ ID NO: 511989 - DNA, 25 bp, Rattus norvegicus
gagcccgcctcattgttccgcgagt

SEQ ID NO: 511990 - DNA, 25 bp, Rattus norvegicus
agggcccgcaacacggtgcacatgc

SEQ ID NO: 511991 - DNA, 25 bp, Rattus norvegicus
ttcgagggcccgcaacacggtgcac

SEQ ID NO: 511992 - DNA, 25 bp, Rattus norvegicus
catgcccgcgcttgtctcccgcgtt

SEQ ID NO: 511993 - DNA, 25 bp, Rattus norvegicus
aggccgacccggagcttacccatga

SEQ ID NO: 511994 - DNA, 25 bp, Rattus norvegicus
ccggagcttacccatgaggcaacgc

SEQ ID NO: 511995 - DNA, 25 bp, Rattus norvegicus
tcctcagggctccagtcaggccgag

SEQ ID NO: 511996 - DNA, 25 bp, Rattus norvegicus
gctgtgctctcaggggacgactccc

SEQ ID NO: 511997 - DNA, 25 bp, Rattus norvegicus
gagccgctccgctcacggtaagcgt

SEQ ID NO: 511998 - DNA, 25 bp, Rattus norvegicus
gcccacagtacaggccgctcagcct

SEQ ID NO: 511999 - DNA, 25 bp, Rattus norvegicus
tcagcctttgcctggcctcgttgcg

SEQ ID NO: 512000 - DNA, 25 bp, Rattus norvegicus
cgcccgtcgctttctcctcagcccg

SEQ ID NO: 512001 - DNA, 25 bp, Rattus norvegicus
ctcagcccggctgtgctctcagggg

SEQ ID NO: 512002 - DNA, 25 bp, Rattus norvegicus
agggctccagtcaggccgagccgct

SEQ ID NO: 512003 - DNA, 25 bp, Rattus norvegicus
ccagggcacgactggcctgggcctt

SEQ ID NO: 512004 - DNA, 25 bp, Rattus norvegicus
cggttgccgggacacagcataaaca

SEQ ID NO: 512005 - DNA, 25 bp, Rattus norvegicus
cgcattttggcggttgccgggacac

SEQ ID NO: 512006 - DNA, 25 bp, Rattus norvegicus
gccaataggagggtgcgtcctgctt

SEQ ID NO: 512007 - DNA, 25 bp, Rattus norvegicus
tggacactgcgccagccaataggag

SEQ ID NO: 512008 - DNA, 25 bp, Rattus norvegicus
gactctccgtgctgattggacactg

SEQ ID NO: 512009 - DNA, 25 bp, Rattus norvegicus
tgcctagcaacgaagactctccgtg

SEQ ID NO: 512010 - DNA, 25 bp, Rattus norvegicus
cactcaagacccaagcgtgtatagg

SEQ ID NO: 512011 - DNA, 25 bp, Rattus norvegicus
gtagcgtccgaacttcgcgcttttg

SEQ ID NO: 512012 - DNA, 25 bp, Rattus norvegicus
ctctccctaggacgtagcgtccgaa

SEQ ID NO: 512013 - DNA, 25 bp, Rattus norvegicus
cgggacacagcataaacactcaaga

SEQ ID NO: 512014 - DNA, 25 bp, Rattus norvegicus
gcgctcctgcctagcaacgaagact

SEQ ID NO: 512015 - DNA, 25 bp, Rattus norvegicus
ggtcctattgaagaagcgctcctgc

SEQ ID NO: 512016 - DNA, 25 bp, Rattus norvegicus
cccaagcgtgtatagggttcggctg

SEQ ID NO: 512017 - DNA, 25 bp, Rattus norvegicus
cgcgcttttggcttggtcctattga

SEQ ID NO: 512018 - DNA, 25 bp, Rattus norvegicus
ttccacgccgcacggtggcacgggt

SEQ ID NO: 512019 - DNA, 25 bp, Rattus norvegicus
gtttcaccttacacactaggaagca

SEQ ID NO: 512020 - DNA, 25 bp, Rattus norvegicus
gaccgaattagctcagggcgctagc

SEQ ID NO: 512021 - DNA, 25 bp, Rattus norvegicus
tcagggcgctagctcttcgaaaagc

SEQ ID NO: 512022 - DNA, 25 bp, Rattus norvegicus
tcttcgaaaagctctcacctgcttc

SEQ ID NO: 512023 - DNA, 25 bp, Rattus norvegicus
cacctgcttcagcacggtccggtgg

SEQ ID NO: 512024 - DNA, 25 bp, Rattus norvegicus
tccggtggctgagctaggaagcaat

SEQ ID NO: 512025 - DNA, 25 bp, Rattus norvegicus
ctgagctaggaagcaatactgacta

SEQ ID NO: 512026 - DNA, 25 bp, Rattus norvegicus
gggcgtgtagattcgtttcacctta

SEQ ID NO: 512027 - DNA, 25 bp, Rattus norvegicus
cgagagacctgtcgggttggatttt

SEQ ID NO: 512028 - DNA, 25 bp, Rattus norvegicus
ccgtgacgagaaccgcaaggagaac

SEQ ID NO: 512029 - DNA, 25 bp, Rattus norvegicus
ggcggccagagaaagcgactcactc

SEQ ID NO: 512030 - DNA, 25 bp, Rattus norvegicus
gaccactgacctcgttcttcagacg

SEQ ID NO: 512031 - DNA, 25 bp, Rattus norvegicus
tactgactagctgagggaaacgttc

SEQ ID NO: 512032 - DNA, 25 bp, Rattus norvegicus
tgctcagggccttgggcctcccagg

SEQ ID NO: 512033 - DNA, 25 bp, Rattus norvegicus
cattacgagtcgtggcaggcatccg

SEQ ID NO: 512034 - DNA, 25 bp, Rattus norvegicus
tgcggaagagccacgtttctcgtcc

SEQ ID NO: 512035 - DNA, 25 bp, Rattus norvegicus
atggcagccgacgacactgaggccc

SEQ ID NO: 512036 - DNA, 25 bp, Rattus norvegicus
tatgagctcggacatggcagccgac

SEQ ID NO: 512037 - DNA, 25 bp, Rattus norvegicus
gcggttcgtccagtatgagctcgga

SEQ ID NO: 512038 - DNA, 25 bp, Rattus norvegicus
gagtgggcctcctccgctgcagcga

SEQ ID NO: 512039 - DNA, 25 bp, Rattus norvegicus
cggagctccttgtttctggagtccc

SEQ ID NO: 512040 - DNA, 25 bp, Rattus norvegicus
cgctcctgcggagctccttgtttct

SEQ ID NO: 512041 - DNA, 25 bp, Rattus norvegicus
caggcatccggggagacctgttgtt

SEQ ID NO: 512042 - DNA, 25 bp, Rattus norvegicus
gggagacctgttgttgagcaaaacc

SEQ ID NO: 512043 - DNA, 25 bp, Rattus norvegicus
tgttgagcaaaaccgcaaggtagtt

SEQ ID NO: 512044 - DNA, 25 bp, Rattus norvegicus
caaggtagtttctttgcggaagagc

SEQ ID NO: 512045 - DNA, 25 bp, Rattus norvegicus
gcctaatctgcaggcgacattacga

SEQ ID NO: 512046 - DNA, 25 bp, Rattus norvegicus
tcagaagattcggaggaagagcgac

SEQ ID NO: 512047 - DNA, 25 bp, Rattus norvegicus
gactacgaggtgctgcacagcatcg

SEQ ID NO: 512048 - DNA, 25 bp, Rattus norvegicus
gggtggccgctcgtcatgccgtccc

SEQ ID NO: 512049 - DNA, 25 bp, Rattus norvegicus
cgctcgtcatgccgtcccgggtgga

SEQ ID NO: 512050 - DNA, 25 bp, Rattus norvegicus
catgccgtcccgggtggaggactac

SEQ ID NO: 512051 - DNA, 25 bp, Rattus norvegicus
gaggactacgaggtgctgcacagca

SEQ ID NO: 512052 - DNA, 25 bp, Rattus norvegicus
ggactacgaggtgctgcacagcatc

SEQ ID NO: 512053 - DNA, 25 bp, Rattus norvegicus
ctacgaggtgctgcacagcatcggc

SEQ ID NO: 512054 - DNA, 25 bp, Rattus norvegicus
acagcatcggcaccggctcctacgg

SEQ ID NO: 512055 - DNA, 25 bp, Rattus norvegicus
ctcctacggccgctgtcagaagatt

SEQ ID NO: 512056 - DNA, 25 bp, Rattus norvegicus
tcctacggccgctgtcagaagattc

SEQ ID NO: 512057 - DNA, 25 bp, Rattus norvegicus
cctacggccgctgtcagaagattcg

SEQ ID NO: 512058 - DNA, 25 bp, Rattus norvegicus
tacggccgctgtcagaagattcgga

SEQ ID NO: 512059 - DNA, 25 bp, Rattus norvegicus
ctacggccgctgtcagaagattcgg

SEQ ID NO: 512060 - DNA, 25 bp, Rattus norvegicus
cagtggggttcctccaggtctcacc

SEQ ID NO: 512061 - DNA, 25 bp, Rattus norvegicus
gtccaggcgatctcagcgtgtccct

SEQ ID NO: 512062 - DNA, 25 bp, Rattus norvegicus
cccaggggccagatgtagaaagtag

SEQ ID NO: 512063 - DNA, 25 bp, Rattus norvegicus
cccatgcgagtgtgcgcgaccgtgc

SEQ ID NO: 512064 - DNA, 25 bp, Rattus norvegicus
accggccaggattctctcgggatgc

SEQ ID NO: 512065 - DNA, 25 bp, Rattus norvegicus
gattctctcgggatgcgcgctctca

SEQ ID NO: 512066 - DNA, 25 bp, Rattus norvegicus
ggccgagtctccctggagccgctgt

SEQ ID NO: 512067 - DNA, 25 bp, Rattus norvegicus
cctgctcatgccattgtccgagctg

SEQ ID NO: 512068 - DNA, 25 bp, Rattus norvegicus
gccattgtccgagctgcagccagct

SEQ ID NO: 512069 - DNA, 25 bp, Rattus norvegicus
gcggccgcacgtggttttatttata

SEQ ID NO: 512070 - DNA, 25 bp, Rattus norvegicus
gccgcacgtggttttatttatattg

SEQ ID NO: 512071 - DNA, 25 bp, Rattus norvegicus
tcctgagtggcagactcgccacgca

SEQ ID NO: 512072 - DNA, 25 bp, Rattus norvegicus
tttccagggattgcagtggggttcc

SEQ ID NO: 512073 - DNA, 25 bp, Rattus norvegicus
ttgcgcgccgtttccagggattgca

SEQ ID NO: 512074 - DNA, 25 bp, Rattus norvegicus
gcgccatctgccctcagtgaggcgg

SEQ ID NO: 512075 - DNA, 25 bp, Rattus norvegicus
atgacctcaggcgcagcatccaatc

SEQ ID NO: 512076 - DNA, 25 bp, Rattus norvegicus
ctcaacccgcatggcggatcccggg

SEQ ID NO: 512077 - DNA, 25 bp, Rattus norvegicus
tctaggcgaggcttggcctcccgcg

SEQ ID NO: 512078 - DNA, 25 bp, Rattus norvegicus
ctccggtctctaggcgaggcttggc

SEQ ID NO: 512079 - DNA, 25 bp, Rattus norvegicus
ccatctgccctcagtgaggcggggc

SEQ ID NO: 512080 - DNA, 25 bp, Rattus norvegicus
aacagtcacttccgggctgagaggc

SEQ ID NO: 512081 - DNA, 25 bp, Rattus norvegicus
atcaagcttagggagcgaggcgcct

SEQ ID NO: 512082 - DNA, 25 bp, Rattus norvegicus
tgggcgtgcgcccttgcttcttgcc

SEQ ID NO: 512083 - DNA, 25 bp, Rattus norvegicus
gcatccaatcccatcaagcttaggg

SEQ ID NO: 512084 - DNA, 25 bp, Rattus norvegicus
gcagcatccaatcccatcaagctta

SEQ ID NO: 512085 - DNA, 25 bp, Rattus norvegicus
ggtggcgcgtagtgatgacctcagg

SEQ ID NO: 512086 - DNA, 25 bp, Rattus norvegicus
ttcttgccctcaacccgcatggcgg

SEQ ID NO: 512087 - DNA, 25 bp, Rattus norvegicus
gagcgaggcgcctccaccgaacagt

SEQ ID NO: 512088 - DNA, 25 bp, Rattus norvegicus
caatagacacctcggggcgaaaaag

SEQ ID NO: 512089 - DNA, 25 bp, Rattus norvegicus
tgcttcccaccacacatcacaatag

SEQ ID NO: 512090 - DNA, 25 bp, Rattus norvegicus
cccactttgtgtgcagacgtgcagc

SEQ ID NO: 512091 - DNA, 25 bp, Rattus norvegicus
tgcagacgtgcagcgatcagcatcc

SEQ ID NO: 512092 - DNA, 25 bp, Rattus norvegicus
tgagcccggcagaacccggctgagc

SEQ ID NO: 512093 - DNA, 25 bp, Rattus norvegicus
gtgcagcgatcagcatcccttccta

SEQ ID NO: 512094 - DNA, 25 bp, Rattus norvegicus
cgctgaagagagttagaggtaacct

SEQ ID NO: 512095 - DNA, 25 bp, Rattus norvegicus
gcccatcgcgctgaagagagttaga

SEQ ID NO: 512096 - DNA, 25 bp, Rattus norvegicus
caaggagcccatcgcgctgaagaga

SEQ ID NO: 512097 - DNA, 25 bp, Rattus norvegicus
tcagcagaacaggacaaggagccca

SEQ ID NO: 512098 - DNA, 25 bp, Rattus norvegicus
ggcggtcggtaatgtcagcagaaca

SEQ ID NO: 512099 - DNA, 25 bp, Rattus norvegicus
ccatgcgcggcggtcggtaatgtca

SEQ ID NO: 512100 - DNA, 25 bp, Rattus norvegicus
aggggccgccgcatcaaagacaccg

SEQ ID NO: 512101 - DNA, 25 bp, Rattus norvegicus
catcacaatagacacctcggggcga

SEQ ID NO: 512102 - DNA, 25 bp, Rattus norvegicus
cgggtgcggctgcatctatatgcta

SEQ ID NO: 512103 - DNA, 25 bp, Rattus norvegicus
ttccagtgtggcagcccgtctccat

SEQ ID NO: 512104 - DNA, 25 bp, Rattus norvegicus
tctgacgaaggcgtgggtcttctta

SEQ ID NO: 512105 - DNA, 25 bp, Rattus norvegicus
cggaaagcagcaccaaggacgaagc

SEQ ID NO: 512106 - DNA, 25 bp, Rattus norvegicus
ggacgaagccagaacgatccgagtc

SEQ ID NO: 512107 - DNA, 25 bp, Rattus norvegicus
tccgagtcgcataaactgcaatttc

SEQ ID NO: 512108 - DNA, 25 bp, Rattus norvegicus
aggtggatggaaaccctctgtcttc

SEQ ID NO: 512109 - DNA, 25 bp, Rattus norvegicus
agtcgtagttctttctcctcgccgc

SEQ ID NO: 512110 - DNA, 25 bp, Rattus norvegicus
ccggaggtgcagaaggtacttcaat

SEQ ID NO: 512111 - DNA, 25 bp, Rattus norvegicus
ccgcgagcaggttgttgtttttatg

SEQ ID NO: 512112 - DNA, 25 bp, Rattus norvegicus
ttttatgaggcgtcactggcgtctg

SEQ ID NO: 512113 - DNA, 25 bp, Rattus norvegicus
aggctttctcctggtggacgccttg

SEQ ID NO: 512114 - DNA, 25 bp, Rattus norvegicus
tatatgctaagatgccgggtgcgta

SEQ ID NO: 512115 - DNA, 25 bp, Rattus norvegicus
cgggctgcaactcgtgtcttcagga

SEQ ID NO: 512116 - DNA, 25 bp, Rattus norvegicus
gagccgccgtcgcttcgctgctccg

SEQ ID NO: 512117 - DNA, 25 bp, Rattus norvegicus
acggcgccgagagcgcttctcctga

SEQ ID NO: 512118 - DNA, 25 bp, Rattus norvegicus
tcttgtaggtggacacatgccacta

SEQ ID NO: 512119 - DNA, 25 bp, Rattus norvegicus
cactttcttgtaggtggacacatgc

SEQ ID NO: 512120 - DNA, 25 bp, Rattus norvegicus
gatcgcgggtctcgggctccatcct

SEQ ID NO: 512121 - DNA, 25 bp, Rattus norvegicus
ttgcggaaggccgtgctgtgatcgc

SEQ ID NO: 512122 - DNA, 25 bp, Rattus norvegicus
gcagcttcatctctccagagctgct

SEQ ID NO: 512123 - DNA, 25 bp, Rattus norvegicus
gtggacttcctcttccgcagcttca

SEQ ID NO: 512124 - DNA, 25 bp, Rattus norvegicus
cacatactgcgtggacttcctcttc

SEQ ID NO: 512125 - DNA, 25 bp, Rattus norvegicus
agcgatcacatactgcgtggacttc

SEQ ID NO: 512126 - DNA, 25 bp, Rattus norvegicus
ttctcctgagcgatcacatactgcg

SEQ ID NO: 512127 - DNA, 25 bp, Rattus norvegicus
agcgcttctcctgagcgatcacata

SEQ ID NO: 512128 - DNA, 25 bp, Rattus norvegicus
cgagagcgcttctcctgagcgatca

SEQ ID NO: 512129 - DNA, 25 bp, Rattus norvegicus
gacacatgccactaagattgggccc

SEQ ID NO: 512130 - DNA, 25 bp, Rattus norvegicus
aaaccgggtgagcactgcgatctga

SEQ ID NO: 512131 - DNA, 25 bp, Rattus norvegicus
tcagcaggctgggaatctagtacta

SEQ ID NO: 512132 - DNA, 25 bp, Rattus norvegicus
cgcggggacagcacccgacagagca

SEQ ID NO: 512133 - DNA, 25 bp, Rattus norvegicus
gcgctctcctctacgggaagtgatg

SEQ ID NO: 512134 - DNA, 25 bp, Rattus norvegicus
cccgacagagcaccaaaccgggtga

SEQ ID NO: 512135 - DNA, 25 bp, Rattus norvegicus
tctagtactacagggacgcaacacc

SEQ ID NO: 512136 - DNA, 25 bp, Rattus norvegicus
agcacggcaaggactcagcaggctg

SEQ ID NO: 512137 - DNA, 25 bp, Rattus norvegicus
agtacctaagggatagagcacggca

SEQ ID NO: 512138 - DNA, 25 bp, Rattus norvegicus
ctccactcggaagggagtacctaag

SEQ ID NO: 512139 - DNA, 25 bp, Rattus norvegicus
tcggggtcccgagctccactcggaa

SEQ ID NO: 512140 - DNA, 25 bp, Rattus norvegicus
tagcgctaagcacccaaaaaaggcc

SEQ ID NO: 512141 - DNA, 25 bp, Rattus norvegicus
ggccggacggaaaatagcgctaagc

SEQ ID NO: 512142 - DNA, 25 bp, Rattus norvegicus
tctcctctacgggaagtgatgtggg

SEQ ID NO: 512143 - DNA, 25 bp, Rattus norvegicus
acagggacgcaacaccgcggggaca

SEQ ID NO: 512144 - DNA, 25 bp, Rattus norvegicus
tatggccgccagtaaggcgaccacc

SEQ ID NO: 512145 - DNA, 25 bp, Rattus norvegicus
gtaaggcgaccacccagccgactcc

SEQ ID NO: 512146 - DNA, 25 bp, Rattus norvegicus
tcttatggccgccagtaaggcgacc

SEQ ID NO: 512147 - DNA, 25 bp, Rattus norvegicus
cgtgaggctgccacgcagcagactc

SEQ ID NO: 512148 - DNA, 25 bp, Rattus norvegicus
gactcccgtgaaggtccgcgacgct

SEQ ID NO: 512149 - DNA, 25 bp, Rattus norvegicus
agccgactcccgtgaaggtccgcga

SEQ ID NO: 512150 - DNA, 25 bp, Rattus norvegicus
gtccgtgaggctgccacgcagcaga

SEQ ID NO: 512151 - DNA, 25 bp, Rattus norvegicus
tgcaggtccgtgaggctgccacgca

SEQ ID NO: 512152 - DNA, 25 bp, Rattus norvegicus
cacgaggtagccacccagcccgttc

SEQ ID NO: 512153 - DNA, 25 bp, Rattus norvegicus
gcaggtccacgaggtagccacccag

SEQ ID NO: 512154 - DNA, 25 bp, Rattus norvegicus
ctccggtgcaggtccacgaggtagc

SEQ ID NO: 512155 - DNA, 25 bp, Rattus norvegicus
cacgcagcagactcccgtggaggtc

SEQ ID NO: 512156 - DNA, 25 bp, Rattus norvegicus
acgcagcagactcccgtggaggtcg

SEQ ID NO: 512157 - DNA, 25 bp, Rattus norvegicus
tgccatccagccggctcccgtgaag

SEQ ID NO: 512158 - DNA, 25 bp, Rattus norvegicus
gaggcgcctttacgctcagctagca

SEQ ID NO: 512159 - DNA, 25 bp, Rattus norvegicus
gttgctgtcagacgcacatcccatc

SEQ ID NO: 512160 - DNA, 25 bp, Rattus norvegicus
cgaggtctcctcgttgctgtcagac

SEQ ID NO: 512161 - DNA, 25 bp, Rattus norvegicus
ttcactgctggcgaggtctcctcgt

SEQ ID NO: 512162 - DNA, 25 bp, Rattus norvegicus
ctggacccggccttggttcactgct

SEQ ID NO: 512163 - DNA, 25 bp, Rattus norvegicus
tgttcgtccgcaacgattgcaaggt

SEQ ID NO: 512164 - DNA, 25 bp, Rattus norvegicus
aagtgttatttctgctccgggccga

SEQ ID NO: 512165 - DNA, 25 bp, Rattus norvegicus
tatgaggatcgagaagtgttatttc

SEQ ID NO: 512166 - DNA, 25 bp, Rattus norvegicus
cccacgcggtgtcaatatgaggatc

SEQ ID NO: 512167 - DNA, 25 bp, Rattus norvegicus
agtgacgtactacttcctctcacgc

SEQ ID NO: 512168 - DNA, 25 bp, Rattus norvegicus
gcggccaggaagtgacgtactactt

SEQ ID NO: 512169 - DNA, 25 bp, Rattus norvegicus
tacataccatttccgggtcgggtca

SEQ ID NO: 512170 - DNA, 25 bp, Rattus norvegicus
ccaggccacggcatgatgttcgtcc

SEQ ID NO: 512171 - DNA, 25 bp, Rattus norvegicus
atgcagctgcgcacacgtggtttgg

SEQ ID NO: 512172 - DNA, 25 bp, Rattus norvegicus
gcggcctagcttaggctctgcctgc

SEQ ID NO: 512173 - DNA, 25 bp, Rattus norvegicus
ctggagggcagcttcaccgggtcct

SEQ ID NO: 512174 - DNA, 25 bp, Rattus norvegicus
tcgcggcctggagggcagcttcacc

SEQ ID NO: 512175 - DNA, 25 bp, Rattus norvegicus
ccggctccagaaggaggtcgcggcc

SEQ ID NO: 512176 - DNA, 25 bp, Rattus norvegicus
ccggtgcacacgctgccttgcccgg

SEQ ID NO: 512177 - DNA, 25 bp, Rattus norvegicus
acagccggtgcacacgctgccttgc

SEQ ID NO: 512178 - DNA, 25 bp, Rattus norvegicus
gggtcacagccggtgcacacgctgc

SEQ ID NO: 512179 - DNA, 25 bp, Rattus norvegicus
cctcggggctcgaggtgggtcacag

SEQ ID NO: 512180 - DNA, 25 bp, Rattus norvegicus
ggggtgggcagccaacgcggccagc

SEQ ID NO: 512181 - DNA, 25 bp, Rattus norvegicus
gcctagcttaggctctgcctgccgg

SEQ ID NO: 512182 - DNA, 25 bp, Rattus norvegicus
accggccagcggaggggctcaggcc

SEQ ID NO: 512183 - DNA, 25 bp, Rattus norvegicus
agggcagcttcaccgggtcctagcg

SEQ ID NO: 512184 - DNA, 25 bp, Rattus norvegicus
gggcggcctagcttaggctctgcct

SEQ ID NO: 512185 - DNA, 25 bp, Rattus norvegicus
ctagcttaggctctgcctgccgggg

SEQ ID NO: 512186 - DNA, 25 bp, Rattus norvegicus
caagcccaggcagctattcaaatgc

SEQ ID NO: 512187 - DNA, 25 bp, Rattus norvegicus
ttctcgggtccataacaagcccagg

SEQ ID NO: 512188 - DNA, 25 bp, Rattus norvegicus
caaatgcccggctggcctgagcaaa

SEQ ID NO: 512189 - DNA, 25 bp, Rattus norvegicus
ctcgctctcgggttcctgaattagc

SEQ ID NO: 512190 - DNA, 25 bp, Rattus norvegicus
acagacttgtgtgtgccagcgaacc

SEQ ID NO: 512191 - DNA, 25 bp, Rattus norvegicus
cagcgaccttgcaggaatcctcagg

SEQ ID NO: 512192 - DNA, 25 bp, Rattus norvegicus
gacaggctgcgcttactttttccgg

SEQ ID NO: 512193 - DNA, 25 bp, Rattus norvegicus
gggctgtttgtttcctcgtttctca

SEQ ID NO: 512194 - DNA, 25 bp, Rattus norvegicus
actcaggtttcccttgctcctagga

SEQ ID NO: 512195 - DNA, 25 bp, Rattus norvegicus
gctcctaggaggcaaagctgaaacc

SEQ ID NO: 512196 - DNA, 25 bp, Rattus norvegicus
accttgtcgcgtgtcagaagcaacc

SEQ ID NO: 512197 - DNA, 25 bp, Rattus norvegicus
ctgccgtgaaattcgttaatgcgcc

SEQ ID NO: 512198 - DNA, 25 bp, Rattus norvegicus
ggtaagccagcctctcaggtccacg

SEQ ID NO: 512199 - DNA, 25 bp, Rattus norvegicus
cccgcgagtttaaagcagcaaatga

SEQ ID NO: 512200 - DNA, 25 bp, Rattus norvegicus
gtgagctgcgcgctatcgcagtgtc

SEQ ID NO: 512201 - DNA, 25 bp, Rattus norvegicus
ttccacccacttccagaatcttctg

SEQ ID NO: 512202 - DNA, 25 bp, Rattus norvegicus
gcctccagagggctctcccagcgga

SEQ ID NO: 512203 - DNA, 25 bp, Rattus norvegicus
ccctcctggacactgcgggccggcc

SEQ ID NO: 512204 - DNA, 25 bp, Rattus norvegicus
tggccgcagaggtgccgcctcctgt

SEQ ID NO: 512205 - DNA, 25 bp, Rattus norvegicus
aagtcctggccgcagaggtgccgcc

SEQ ID NO: 512206 - DNA, 25 bp, Rattus norvegicus
aacctaggctgaagtcctggccgca

SEQ ID NO: 512207 - DNA, 25 bp, Rattus norvegicus
gcaaccggtgccaagccaacccagg

SEQ ID NO: 512208 - DNA, 25 bp, Rattus norvegicus
cacaggaggctgtagcgtttgaccc

SEQ ID NO: 512209 - DNA, 25 bp, Rattus norvegicus
acccacaggaggctgtagcgtttga

SEQ ID NO: 512210 - DNA, 25 bp, Rattus norvegicus
ccctggacccacaggaggctgtagc

SEQ ID NO: 512211 - DNA, 25 bp, Rattus norvegicus
gcgcgccggtctccttccacccact

SEQ ID NO: 512212 - DNA, 25 bp, Rattus norvegicus
cagcaggccctggacccacaggagg

SEQ ID NO: 512213 - DNA, 25 bp, Rattus norvegicus
gctgcgcgctatcgcagtgtccagc

SEQ ID NO: 512214 - DNA, 25 bp, Rattus norvegicus
tctagacagatcagcgcacgatgtg

SEQ ID NO: 512215 - DNA, 25 bp, Rattus norvegicus
gtagccgtagcatcgtgtgatctcg

SEQ ID NO: 512216 - DNA, 25 bp, Rattus norvegicus
ccgcgatgctgtggactgggcatat

SEQ ID NO: 512217 - DNA, 25 bp, Rattus norvegicus
tcgcccacgggacttgggctatcta

SEQ ID NO: 512218 - DNA, 25 bp, Rattus norvegicus
tgccaagcttagtcagccctccagg

SEQ ID NO: 512219 - DNA, 25 bp, Rattus norvegicus
agccctccaggtcttatgatctcca

SEQ ID NO: 512220 - DNA, 25 bp, Rattus norvegicus
ctccatgttccggattcacggtatc

SEQ ID NO: 512221 - DNA, 25 bp, Rattus norvegicus
tcacggtatcgggttcatgtctcca

SEQ ID NO: 512222 - DNA, 25 bp, Rattus norvegicus
cacgtatccggggtctctagacaga

SEQ ID NO: 512223 - DNA, 25 bp, Rattus norvegicus
ggggcttgctctggttcttatacgc

SEQ ID NO: 512224 - DNA, 25 bp, Rattus norvegicus
ttatacgccagggtccagagccact

SEQ ID NO: 512225 - DNA, 25 bp, Rattus norvegicus
agccactgccagtcgttgtgctcga

SEQ ID NO: 512226 - DNA, 25 bp, Rattus norvegicus
ttgtgctcgaggtctcgcttctaca

SEQ ID NO: 512227 - DNA, 25 bp, Rattus norvegicus
tctccaagtctcgtcggggcagcat

SEQ ID NO: 512228 - DNA, 25 bp, Rattus norvegicus
ttccttctaagacgcctgctgagtg

SEQ ID NO: 512229 - DNA, 25 bp, Rattus norvegicus
gtatttcgtgcgtgggttcaccgcc

SEQ ID NO: 512230 - DNA, 25 bp, Rattus norvegicus
cagtgagtatttcgtgcgtgggttc

SEQ ID NO: 512231 - DNA, 25 bp, Rattus norvegicus
cctgcgggagcagtgagtatttcgt

SEQ ID NO: 512232 - DNA, 25 bp, Rattus norvegicus
cggcagcggcaactgctgtccagga

SEQ ID NO: 512233 - DNA, 25 bp, Rattus norvegicus
atctgatgccccagagcgagtaggc

SEQ ID NO: 512234 - DNA, 25 bp, Rattus norvegicus
ccgcaagtgctaaaataatctgatg

SEQ ID NO: 512235 - DNA, 25 bp, Rattus norvegicus
cgttccttccgcaagtgctaaaata

SEQ ID NO: 512236 - DNA, 25 bp, Rattus norvegicus
tgtgacttcagtttccgtccgttcc

SEQ ID NO: 512237 - DNA, 25 bp, Rattus norvegicus
gaggtctccatgtgacttcagtttc

SEQ ID NO: 512238 - DNA, 25 bp, Rattus norvegicus
cctgctgagtgctgagtcgctgaga

SEQ ID NO: 512239 - DNA, 25 bp, Rattus norvegicus
gcggtggcagttccttctaagacgc

SEQ ID NO: 512240 - DNA, 25 bp, Rattus norvegicus
gttcaccgccgagcatcgcgagcat

SEQ ID NO: 512241 - DNA, 25 bp, Rattus norvegicus
agaggcgaggtctccatgtgacttc

SEQ ID NO: 512242 - DNA, 25 bp, Rattus norvegicus
caggtatgagcatgcccaccaccta

SEQ ID NO: 512243 - DNA, 25 bp, Rattus norvegicus
cgcacagctgaccatggaggcgatc

SEQ ID NO: 512244 - DNA, 25 bp, Rattus norvegicus
acccgcgttccatgggcatggcgtc

SEQ ID NO: 512245 - DNA, 25 bp, Rattus norvegicus
catgaccatggcctgtgaaactccc

SEQ ID NO: 512246 - DNA, 25 bp, Rattus norvegicus
aacgtgagcggtagtttcacactta

SEQ ID NO: 512247 - DNA, 25 bp, Rattus norvegicus
tttcacacttatgcgggatgagcgc

SEQ ID NO: 512248 - DNA, 25 bp, Rattus norvegicus
ggctggcctccatgaataacctcta

SEQ ID NO: 512249 - DNA, 25 bp, Rattus norvegicus
tcgggtctgggcagcattcacaact

SEQ ID NO: 512250 - DNA, 25 bp, Rattus norvegicus
cgcggctatgcccaccgacaagatg

SEQ ID NO: 512251 - DNA, 25 bp, Rattus norvegicus
ggcatggtacccatcaacggccttc

SEQ ID NO: 512252 - DNA, 25 bp, Rattus norvegicus
cgcaggtcagcaatggaagtaattc

SEQ ID NO: 512253 - DNA, 25 bp, Rattus norvegicus
gtatcaccaccgagctcaaacgtta

SEQ ID NO: 512254 - DNA, 25 bp, Rattus norvegicus
gggaccctttcggacctgctgcgaa

SEQ ID NO: 512255 - DNA, 25 bp, Rattus norvegicus
gcggaggcagcgattaccaccacca

SEQ ID NO: 512256 - DNA, 25 bp, Rattus norvegicus
cggcggcgttgccataacaaccggc

SEQ ID NO: 512257 - DNA, 25 bp, Rattus norvegicus
ccagagtagtgttttgacagggcaa

SEQ ID NO: 512258 - DNA, 25 bp, Rattus norvegicus
tgagacccttgtcccgcaagacggg

SEQ ID NO: 512259 - DNA, 25 bp, Rattus norvegicus
tgaagcctcggcgaggttagccaga

SEQ ID NO: 512260 - DNA, 25 bp, Rattus norvegicus
ttgccataacaaccggcgcgcgcag

SEQ ID NO: 512261 - DNA, 25 bp, Rattus norvegicus
ttggctgttgttgagacacgtgacc

SEQ ID NO: 512262 - DNA, 25 bp, Rattus norvegicus
tgttgagacacgtgaccagagtagt

SEQ ID NO: 512263 - DNA, 25 bp, Rattus norvegicus
cagggcaaacagtgagagaaagagt

SEQ ID NO: 512264 - DNA, 25 bp, Rattus norvegicus
ctcagtgcccggaggctacaggacc

SEQ ID NO: 512265 - DNA, 25 bp, Rattus norvegicus
ggctgaggacatgcccagactctgc

SEQ ID NO: 512266 - DNA, 25 bp, Rattus norvegicus
agactctgctgctgaccggctccgg

SEQ ID NO: 512267 - DNA, 25 bp, Rattus norvegicus
ctccggctggaacccggctactgaa

SEQ ID NO: 512268 - DNA, 25 bp, Rattus norvegicus
ggctactgaagcctcggcgaggtta

SEQ ID NO: 512269 - DNA, 25 bp, Rattus norvegicus
cagttccacggctgcttaggcgcgc

SEQ ID NO: 512270 - DNA, 25 bp, Rattus norvegicus
gagttgaaacttaacgattctctcc

SEQ ID NO: 512271 - DNA, 25 bp, Rattus norvegicus
cggtaatctgtcttctcctggcgtc

SEQ ID NO: 512272 - DNA, 25 bp, Rattus norvegicus
gccgcaacctttgagggaaagagga

SEQ ID NO: 512273 - DNA, 25 bp, Rattus norvegicus
gcccgtgtcgtcacaaggcggcagc

SEQ ID NO: 512274 - DNA, 25 bp, Rattus norvegicus
gtgtcgtcacaaggcggcagccgcc

SEQ ID NO: 512275 - DNA, 25 bp, Rattus norvegicus
aaggtggcgggcagtcttgcctccc

SEQ ID NO: 512276 - DNA, 25 bp, Rattus norvegicus
ttgcctcccggtaatctgtcttctc

SEQ ID NO: 512277 - DNA, 25 bp, Rattus norvegicus
tcttctgcagaaggagcaccatgtc

SEQ ID NO: 512278 - DNA, 25 bp, Rattus norvegicus
cggcgagttgaaacttaacgattct

SEQ ID NO: 512279 - DNA, 25 bp, Rattus norvegicus
cgcgagccgcaacctttgagggaaa

SEQ ID NO: 512280 - DNA, 25 bp, Rattus norvegicus
ctcctggcgtctcttctgcagaagg

SEQ ID NO: 512281 - DNA, 25 bp, Rattus norvegicus
cccatgaacggaagtgaggtgaggc

SEQ ID NO: 512282 - DNA, 25 bp, Rattus norvegicus
ggagcaccatgtccgcggaagtccc

SEQ ID NO: 512283 - DNA, 25 bp, Rattus norvegicus
aggtgaggcgcgagccgcaaccttt

SEQ ID NO: 512284 - DNA, 25 bp, Rattus norvegicus
acaagatggccaggctctgactggt

SEQ ID NO: 512285 - DNA, 25 bp, Rattus norvegicus
cactcggggaaacttctggacaaga

SEQ ID NO: 512286 - DNA, 25 bp, Rattus norvegicus
agccgtggcactcggggaaacttct

SEQ ID NO: 512287 - DNA, 25 bp, Rattus norvegicus
gggcgagcaccaatccgactgccaa

SEQ ID NO: 512288 - DNA, 25 bp, Rattus norvegicus
ggctgcgggcgagcaccaatccgac

SEQ ID NO: 512289 - DNA, 25 bp, Rattus norvegicus
tgcacctgcccggacctgtggagga

SEQ ID NO: 512290 - DNA, 25 bp, Rattus norvegicus
ttctggacaagatggccaggctctg

SEQ ID NO: 512291 - DNA, 25 bp, Rattus norvegicus
ctctgactggttgggcgcgcacagt

SEQ ID NO: 512292 - DNA, 25 bp, Rattus norvegicus
gtggccgagctctacgcgcaggtag

SEQ ID NO: 512293 - DNA, 25 bp, Rattus norvegicus
ggcgcggggacacatctgtgcacct

SEQ ID NO: 512294 - DNA, 25 bp, Rattus norvegicus
ggacacatctgtgcacctgcccgga

SEQ ID NO: 512295 - DNA, 25 bp, Rattus norvegicus
tggcactcggggaaacttctggaca

SEQ ID NO: 512296 - DNA, 25 bp, Rattus norvegicus
atctgtgcacctgcccggacctgtg

SEQ ID NO: 512297 - DNA, 25 bp, Rattus norvegicus
cggggaaacttctggacaagatggc

SEQ ID NO: 512298 - DNA, 25 bp, Rattus norvegicus
tttgcgtttctctcccggctgcatc

SEQ ID NO: 512299 - DNA, 25 bp, Rattus norvegicus
atgggctgcacgagaacgagacgct

SEQ ID NO: 512300 - DNA, 25 bp, Rattus norvegicus
acctgcgtgggaccgattccaacgt

SEQ ID NO: 512301 - DNA, 25 bp, Rattus norvegicus
accgattccaacgtccctgatggga

SEQ ID NO: 512302 - DNA, 25 bp, Rattus norvegicus
agaacgagacgctggcgtcgctgaa

SEQ ID NO: 512303 - DNA, 25 bp, Rattus norvegicus
cgaagatggcaaccgatgggctgca

SEQ ID NO: 512304 - DNA, 25 bp, Rattus norvegicus
tcccggctgcatccggacgaagatg

SEQ ID NO: 512305 - DNA, 25 bp, Rattus norvegicus
tccctgatgggaggatgccgagccc

SEQ ID NO: 512306 - DNA, 25 bp, Rattus norvegicus
acaatctcccgctttgcgtttctct

SEQ ID NO: 512307 - DNA, 25 bp, Rattus norvegicus
agctctcggccggagtggaccagac

SEQ ID NO: 512308 - DNA, 25 bp, Rattus norvegicus
gtggaccagactctccaaggggctg

SEQ ID NO: 512309 - DNA, 25 bp, Rattus norvegicus
gaggagagaccgctttacagttcca

SEQ ID NO: 512310 - DNA, 25 bp, Rattus norvegicus
ggagccagcagagtctgtcaccgca

SEQ ID NO: 512311 - DNA, 25 bp, Rattus norvegicus
agcagagtctgtcaccgcagcgctc

SEQ ID NO: 512312 - DNA, 25 bp, Rattus norvegicus
tttccgaggctctcgctttgccgca

SEQ ID NO: 512313 - DNA, 25 bp, Rattus norvegicus
gctccaagtgaggaggcctgtaacc

SEQ ID NO: 512314 - DNA, 25 bp, Rattus norvegicus
catcagggtgtttttccggatcaca

SEQ ID NO: 512315 - DNA, 25 bp, Rattus norvegicus
cgtccggaaaggtgtcaggagccct

SEQ ID NO: 512316 - DNA, 25 bp, Rattus norvegicus
gtccgattataacaagctccaagtg

SEQ ID NO: 512317 - DNA, 25 bp, Rattus norvegicus
gcgccggaatttccaacgcccgtga

SEQ ID NO: 512318 - DNA, 25 bp, Rattus norvegicus
aggagcagagcgctacgcaacgtgc

SEQ ID NO: 512319 - DNA, 25 bp, Rattus norvegicus
gctacgcaacgtgccgggagacttt

SEQ ID NO: 512320 - DNA, 25 bp, Rattus norvegicus
ctggagtcagctgaggccgagtcac

SEQ ID NO: 512321 - DNA, 25 bp, Rattus norvegicus
gacggggactcgaacccgcgtagca

SEQ ID NO: 512322 - DNA, 25 bp, Rattus norvegicus
ccggagggtcacacacaatggacgc

SEQ ID NO: 512323 - DNA, 25 bp, Rattus norvegicus
cgggacttctccgactcatcgagag

SEQ ID NO: 512324 - DNA, 25 bp, Rattus norvegicus
tcaggagccctgtctcaggccggtc

SEQ ID NO: 512325 - DNA, 25 bp, Rattus norvegicus
ccaggcacaaacttgggcggactta

SEQ ID NO: 512326 - DNA, 25 bp, Rattus norvegicus
tccgtgcacacttggccgattgatg

SEQ ID NO: 512327 - DNA, 25 bp, Rattus norvegicus
tctgtgcctggacggttagagaccg

SEQ ID NO: 512328 - DNA, 25 bp, Rattus norvegicus
acgacacgtcgtgcgtggactgctc

SEQ ID NO: 512329 - DNA, 25 bp, Rattus norvegicus
tcaactacccatcgggcgtgataac

SEQ ID NO: 512330 - DNA, 25 bp, Rattus norvegicus
tgctccggccgtaaagcaggctcga

SEQ ID NO: 512331 - DNA, 25 bp, Rattus norvegicus
agcaggctcgagtcgaccaggccaa

SEQ ID NO: 512332 - DNA, 25 bp, Rattus norvegicus
acccagctgccatggcggacatgga

SEQ ID NO: 512333 - DNA, 25 bp, Rattus norvegicus
gacctcttcgggagcgaagctgaga

SEQ ID NO: 512334 - DNA, 25 bp, Rattus norvegicus
ctctcccgagacacgggcgcggagt

SEQ ID NO: 512335 - DNA, 25 bp, Rattus norvegicus
ttagagaccggcctgggctcgttgt

SEQ ID NO: 512336 - DNA, 25 bp, Rattus norvegicus
cagaatgagaacgagtggcttgtgc

SEQ ID NO: 512337 - DNA, 25 bp, Rattus norvegicus
agtggcttgtgcacctccgtgcaca

SEQ ID NO: 512338 - DNA, 25 bp, Rattus norvegicus
tggggtggctgttcaactacccatc

SEQ ID NO: 512339 - DNA, 25 bp, Rattus norvegicus
cgcggttccgggcaacgtgattgcc

SEQ ID NO: 512340 - DNA, 25 bp, Rattus norvegicus
cctgctttctaaggccctgtgtttt

SEQ ID NO: 512341 - DNA, 25 bp, Rattus norvegicus
cgcatcgtcaagtggtcggacggaa

SEQ ID NO: 512342 - DNA, 25 bp, Rattus norvegicus
acgcccgcatcgtcaagtggtcgga

SEQ ID NO: 512343 - DNA, 25 bp, Rattus norvegicus
aagcaacgcccgcatcgtcaagtgg

SEQ ID NO: 512344 - DNA, 25 bp, Rattus norvegicus
taaagaaagcaacgcccgcatcgtc

SEQ ID NO: 512345 - DNA, 25 bp, Rattus norvegicus
gaaggaaacgagattaaagaaagca

SEQ ID NO: 512346 - DNA, 25 bp, Rattus norvegicus
agagatgaggaaggaaacgagatta

SEQ ID NO: 512347 - DNA, 25 bp, Rattus norvegicus
ctataagatggaggatgcgcagaga

SEQ ID NO: 512348 - DNA, 25 bp, Rattus norvegicus
caggtagaaaacactataagatgga

SEQ ID NO: 512349 - DNA, 25 bp, Rattus norvegicus
tctccggctgcgtctctccggggag

SEQ ID NO: 512350 - DNA, 25 bp, Rattus norvegicus
atgcacttactctccggctgcgtct

SEQ ID NO: 512351 - DNA, 25 bp, Rattus norvegicus
gtcagcacatgcacttactctccgg

SEQ ID NO: 512352 - DNA, 25 bp, Rattus norvegicus
ggttcccgtcagcacatgcacttac

SEQ ID NO: 512353 - DNA, 25 bp, Rattus norvegicus
cactataagatggaggatgcgcaga

SEQ ID NO: 512354 - DNA, 25 bp, Rattus norvegicus
gagttgccgaatgctcccgccagct

SEQ ID NO: 512355 - DNA, 25 bp, Rattus norvegicus
ggccggtcccgaacactaagtggca

SEQ ID NO: 512356 - DNA, 25 bp, Rattus norvegicus
cagtcgaccggtcccgaacactagg

SEQ ID NO: 512357 - DNA, 25 bp, Rattus norvegicus
ccgccgacggacttcctggaaagca

SEQ ID NO: 512358 - DNA, 25 bp, Rattus norvegicus
gacttcctggaaagcaccgtgctga

SEQ ID NO: 512359 - DNA, 25 bp, Rattus norvegicus
accgtgctgaactcacctgtctggc

SEQ ID NO: 512360 - DNA, 25 bp, Rattus norvegicus
ccactgcacagtccgccgggtttga

SEQ ID NO: 512361 - DNA, 25 bp, Rattus norvegicus
cgccgggtttgaatcgctcttctct

SEQ ID NO: 512362 - DNA, 25 bp, Rattus norvegicus
gggccagtcccaaatcctacgtaga

SEQ ID NO: 512363 - DNA, 25 bp, Rattus norvegicus
tgcctcaagttcagggagttgccga

SEQ ID NO: 512364 - DNA, 25 bp, Rattus norvegicus
ccgcgctgtctctattgctggttcc

SEQ ID NO: 512365 - DNA, 25 bp, Rattus norvegicus
agccacgccgttttcgaagcaccga

SEQ ID NO: 512366 - DNA, 25 bp, Rattus norvegicus
acactccgcggtgcctcaagttcag

SEQ ID NO: 512367 - DNA, 25 bp, Rattus norvegicus
gtagacagtcccgaactccaggagg

SEQ ID NO: 512368 - DNA, 25 bp, Rattus norvegicus
gtgcttcagacaggctgcccggaca

SEQ ID NO: 512369 - DNA, 25 bp, Rattus norvegicus
gccatggagcatcttcccgcggaca

SEQ ID NO: 512370 - DNA, 25 bp, Rattus norvegicus
aatctagagctttgtgcgccagcgc

SEQ ID NO: 512371 - DNA, 25 bp, Rattus norvegicus
tgcttgcgcccatcccgaagcggaa

SEQ ID NO: 512372 - DNA, 25 bp, Rattus norvegicus
gaaggtcctggccagcagccttaga

SEQ ID NO: 512373 - DNA, 25 bp, Rattus norvegicus
ccagcagccttagagcccggagtac

SEQ ID NO: 512374 - DNA, 25 bp, Rattus norvegicus
cggagtacgcgggtccgacaatcag

SEQ ID NO: 512375 - DNA, 25 bp, Rattus norvegicus
acaatcaggggcgttgccgtagccc

SEQ ID NO: 512376 - DNA, 25 bp, Rattus norvegicus
cctctctgcatctgcgcgtggattg

SEQ ID NO: 512377 - DNA, 25 bp, Rattus norvegicus
cgggccgctgagtctactgatgaca

SEQ ID NO: 512378 - DNA, 25 bp, Rattus norvegicus
tctactgatgacacgctggcctctc

SEQ ID NO: 512379 - DNA, 25 bp, Rattus norvegicus
tctcagggtcctcccgtagaatcta

SEQ ID NO: 512380 - DNA, 25 bp, Rattus norvegicus
tctagagctgagatcaacaggcggc

SEQ ID NO: 512381 - DNA, 25 bp, Rattus norvegicus
cagggcacagtgcaatccgtaacca

SEQ ID NO: 512382 - DNA, 25 bp, Rattus norvegicus
cgttctgtccgggtcaccgtggaag

SEQ ID NO: 512383 - DNA, 25 bp, Rattus norvegicus
cgcaaggagcgttctgtccgggtca

SEQ ID NO: 512384 - DNA, 25 bp, Rattus norvegicus
tctcaggaacctggagttacagggg

SEQ ID NO: 512385 - DNA, 25 bp, Rattus norvegicus
gcctggctgctcctctgggcagctg

SEQ ID NO: 512386 - DNA, 25 bp, Rattus norvegicus
aggttcctcccgtgaccgcagcttg

SEQ ID NO: 512387 - DNA, 25 bp, Rattus norvegicus
ctgcgtgctcaggttcctcccgtga

SEQ ID NO: 512388 - DNA, 25 bp, Rattus norvegicus
gcaggctcgccgcagacatcagcga

SEQ ID NO: 512389 - DNA, 25 bp, Rattus norvegicus
gcccgcacgcatccggttgaggaca

SEQ ID NO: 512390 - DNA, 25 bp, Rattus norvegicus
ccggcctctcaggaacctggagtta

SEQ ID NO: 512391 - DNA, 25 bp, Rattus norvegicus
ttctctaggcaacagcggggcgcgc

SEQ ID NO: 512392 - DNA, 25 bp, Rattus norvegicus
cccaaagatcgttctctaggcaaca

SEQ ID NO: 512393 - DNA, 25 bp, Rattus norvegicus
gtcctaaagcagctcgtcgggtcca

SEQ ID NO: 512394 - DNA, 25 bp, Rattus norvegicus
gcggcgaatgcggtcctaaagcagc

SEQ ID NO: 512395 - DNA, 25 bp, Rattus norvegicus
acgcatccggttgaggacaggaagc

SEQ ID NO: 512396 - DNA, 25 bp, Rattus norvegicus
tccggcaggaaatctatggtacacc

SEQ ID NO: 512397 - DNA, 25 bp, Rattus norvegicus
cagcacacagcaccggtggagaatt

SEQ ID NO: 512398 - DNA, 25 bp, Rattus norvegicus
agcacaaagcgagcgcggctcttcc

SEQ ID NO: 512399 - DNA, 25 bp, Rattus norvegicus
tccgcccgagtgtatctcatctata

SEQ ID NO: 512400 - DNA, 25 bp, Rattus norvegicus
tccactgtgctcacctctaggagtc

SEQ ID NO: 512401 - DNA, 25 bp, Rattus norvegicus
gaatggcgctcctgtgctacaaccg

SEQ ID NO: 512402 - DNA, 25 bp, Rattus norvegicus
tctgcgcctgtgcaaccggaacgtt

SEQ ID NO: 512403 - DNA, 25 bp, Rattus norvegicus
tcgggaagattcctgaagcagtacc

SEQ ID NO: 512404 - DNA, 25 bp, Rattus norvegicus
cagtaccggcggcttccggaagcta

SEQ ID NO: 512405 - DNA, 25 bp, Rattus norvegicus
tagctgcggcctgaacagtagtgcc

SEQ ID NO: 512406 - DNA, 25 bp, Rattus norvegicus
gtgattcacttctactcctgggtgg

SEQ ID NO: 512407 - DNA, 25 bp, Rattus norvegicus
tcgccgggaaaacggaatggcgctc

SEQ ID NO: 512408 - DNA, 25 bp, Rattus norvegicus
ctacaaccgcggctgtggccagcgt

SEQ ID NO: 512409 - DNA, 25 bp, Rattus norvegicus
tcatctatagctgtccgggtccacc

SEQ ID NO: 512410 - DNA, 25 bp, Rattus norvegicus
gtcatcgagcgccatgtggagcacc

SEQ ID NO: 512411 - DNA, 25 bp, Rattus norvegicus
cagctattgcatggcgttcccagta

SEQ ID NO: 512412 - DNA, 25 bp, Rattus norvegicus
tcaggtcgtttctgtcgcgcgagaa

SEQ ID NO: 512413 - DNA, 25 bp, Rattus norvegicus
aatgggcgtctaagctgctgctgca

SEQ ID NO: 512414 - DNA, 25 bp, Rattus norvegicus
cgctgctgcaactgcaatgggcgtc

SEQ ID NO: 512415 - DNA, 25 bp, Rattus norvegicus
cgcgctcaagtacggagtcacggtg

SEQ ID NO: 512416 - DNA, 25 bp, Rattus norvegicus
cacgcttcagggcatcgcgctcaag

SEQ ID NO: 512417 - DNA, 25 bp, Rattus norvegicus
ggacccatggcggatctctcgcctg

SEQ ID NO: 512418 - DNA, 25 bp, Rattus norvegicus
cagccgcagccctagtgaggaggaa

SEQ ID NO: 512419 - DNA, 25 bp, Rattus norvegicus
aaaagctggctcagagcggcgcacg

SEQ ID NO: 512420 - DNA, 25 bp, Rattus norvegicus
ttatcgccatcagcacggggacctc

SEQ ID NO: 512421 - DNA, 25 bp, Rattus norvegicus
agggccttctctggcaggacccgca

SEQ ID NO: 512422 - DNA, 25 bp, Rattus norvegicus
aagacccgctcgtacggcagcacgg

SEQ ID NO: 512423 - DNA, 25 bp, Rattus norvegicus
tcgcgcgagaaacactagggaggcc

SEQ ID NO: 512424 - DNA, 25 bp, Rattus norvegicus
tgaagttcttgcgtcgcctgcggac

SEQ ID NO: 512425 - DNA, 25 bp, Rattus norvegicus
cgcgtattttccatgccgcagtctt

SEQ ID NO: 512426 - DNA, 25 bp, Rattus norvegicus
gggcacaggcatgctcgcgtatttt

SEQ ID NO: 512427 - DNA, 25 bp, Rattus norvegicus
cagcgctactccaatcccgcgggaa

SEQ ID NO: 512428 - DNA, 25 bp, Rattus norvegicus
atggcgtcagcgacccagcgctact

SEQ ID NO: 512429 - DNA, 25 bp, Rattus norvegicus
catgcaaaccagaggcgtgaggatg

SEQ ID NO: 512430 - DNA, 25 bp, Rattus norvegicus
ccgcgggtgctgaagttcttgcgtc

SEQ ID NO: 512431 - DNA, 25 bp, Rattus norvegicus
tgctccatgcaaaccagaggcgtga

SEQ ID NO: 512432 - DNA, 25 bp, Rattus norvegicus
tatgtttctacatccgaggccggtc

SEQ ID NO: 512433 - DNA, 25 bp, Rattus norvegicus
ggaggaggcgcatgctccatgcaaa

SEQ ID NO: 512434 - DNA, 25 bp, Rattus norvegicus
ctagctccaggagaggaaatgagga

SEQ ID NO: 512435 - DNA, 25 bp, Rattus norvegicus
gctttactctactagctccaggaga

SEQ ID NO: 512436 - DNA, 25 bp, Rattus norvegicus
gggcctgggcgtagctttactctac

SEQ ID NO: 512437 - DNA, 25 bp, Rattus norvegicus
ccgcagtcttgggtatgtttctaca

SEQ ID NO: 512438 - DNA, 25 bp, Rattus norvegicus
cgggactcaggtgcccgctgcaccc

SEQ ID NO: 512439 - DNA, 25 bp, Rattus norvegicus
cctgcttgggcgttgcccagaaccg

SEQ ID NO: 512440 - DNA, 25 bp, Rattus norvegicus
cgccgccgcagtgcagctcggaccc

SEQ ID NO: 512441 - DNA, 25 bp, Rattus norvegicus
ggccgcgggatccagcaccgcccgc

SEQ ID NO: 512442 - DNA, 25 bp, Rattus norvegicus
caccgcccgcggcaccaaggctgct

SEQ ID NO: 512443 - DNA, 25 bp, Rattus norvegicus
tgctgccatggggaatctaccatct

SEQ ID NO: 512444 - DNA, 25 bp, Rattus norvegicus
tggggaatctaccatctgctgcgaa

SEQ ID NO: 512445 - DNA, 25 bp, Rattus norvegicus
tctaccatctgctgcgaagcactgc

SEQ ID NO: 512446 - DNA, 25 bp, Rattus norvegicus
gaagcactgcctcaactaccagcag

SEQ ID NO: 512447 - DNA, 25 bp, Rattus norvegicus
cagcttctccgcgagcatctctgga

SEQ ID NO: 512448 - DNA, 25 bp, Rattus norvegicus
tctccgcgagcatctctggagcgga

SEQ ID NO: 512449 - DNA, 25 bp, Rattus norvegicus
tctctggagcggagaatcagtggca

SEQ ID NO: 512450 - DNA, 25 bp, Rattus norvegicus
ggacccggcgcaggtaccacctcgc

SEQ ID NO: 512451 - DNA, 25 bp, Rattus norvegicus
ggaatctaccatctgctgcgaagca

SEQ ID NO: 512452 - DNA, 25 bp, Rattus norvegicus
gacgtgaaaagttcctgagccaatg

SEQ ID NO: 512453 - DNA, 25 bp, Rattus norvegicus
ctgcgatcaggacccactcatattc

SEQ ID NO: 512454 - DNA, 25 bp, Rattus norvegicus
ttcccgatgagagccacgacgaaca

SEQ ID NO: 512455 - DNA, 25 bp, Rattus norvegicus
tgagccaatgtctccagagccctgc

SEQ ID NO: 512456 - DNA, 25 bp, Rattus norvegicus
gactcacccaggacgttcccgatga

SEQ ID NO: 512457 - DNA, 25 bp, Rattus norvegicus
ttcggctcagtgctgcaagcttgtc

SEQ ID NO: 512458 - DNA, 25 bp, Rattus norvegicus
tcctccaatttggtgctggacatca

SEQ ID NO: 512459 - DNA, 25 bp, Rattus norvegicus
cagctccgaagcagatgaccagttg

SEQ ID NO: 512460 - DNA, 25 bp, Rattus norvegicus
aaacggctcttgagtttcattcagc

SEQ ID NO: 512461 - DNA, 25 bp, Rattus norvegicus
tcgtcatagtctgtggggtttaaaa

SEQ ID NO: 512462 - DNA, 25 bp, Rattus norvegicus
cgcaggaattcctcgtcgtcatagt

SEQ ID NO: 512463 - DNA, 25 bp, Rattus norvegicus
tccctccacaggtaccgcaggaatt

SEQ ID NO: 512464 - DNA, 25 bp, Rattus norvegicus
ttcgggtgtaggtattccctccaca

SEQ ID NO: 512465 - DNA, 25 bp, Rattus norvegicus
cgacgaacacgatgatataccctgc

SEQ ID NO: 512466 - DNA, 25 bp, Rattus norvegicus
gacgcgggagcaagtccggacacct

SEQ ID NO: 512467 - DNA, 25 bp, Rattus norvegicus
tacacacagcactctttcttttcct

SEQ ID NO: 512468 - DNA, 25 bp, Rattus norvegicus
gccctgtctgaactcaaaatcccag

SEQ ID NO: 512469 - DNA, 25 bp, Rattus norvegicus
cagcgccctgtctgaactcaaaatc

SEQ ID NO: 512470 - DNA, 25 bp, Rattus norvegicus
gtccggacacctgcgcgctggagca

SEQ ID NO: 512471 - DNA, 25 bp, Rattus norvegicus
aggccagcgccctgtctgaactcaa

SEQ ID NO: 512472 - DNA, 25 bp, Rattus norvegicus
acagagcagcgcacacaggccagcg

SEQ ID NO: 512473 - DNA, 25 bp, Rattus norvegicus
gctacacagagcagcgcacacaggc

SEQ ID NO: 512474 - DNA, 25 bp, Rattus norvegicus
gttccgagtcgctacacagagcagc

SEQ ID NO: 512475 - DNA, 25 bp, Rattus norvegicus
aacaggttccgagtcgctacacaga

SEQ ID NO: 512476 - DNA, 25 bp, Rattus norvegicus
gagcaagtccggacacctgcgcgct

SEQ ID NO: 512477 - DNA, 25 bp, Rattus norvegicus
ggcggcgagttacaacaggttccga

SEQ ID NO: 512478 - DNA, 25 bp, Rattus norvegicus
gcgctccactcacccgcagctactg

SEQ ID NO: 512479 - DNA, 25 bp, Rattus norvegicus
agttacaacaggttccgagtcgcta

SEQ ID NO: 512480 - DNA, 25 bp, Rattus norvegicus
ttgcaccgccacaggggaatgcagt

SEQ ID NO: 512481 - DNA, 25 bp, Rattus norvegicus
tagaccagcgagcagtggcgcttgt

SEQ ID NO: 512482 - DNA, 25 bp, Rattus norvegicus
tgcgggcatagcgatagatctcctc

SEQ ID NO: 512483 - DNA, 25 bp, Rattus norvegicus
aacaccagagtcgtgtcccgccgag

SEQ ID NO: 512484 - DNA, 25 bp, Rattus norvegicus
tcgcaagggctccacggttccgaac

SEQ ID NO: 512485 - DNA, 25 bp, Rattus norvegicus
ttccgaacgttctgaggaagccgcg

SEQ ID NO: 512486 - DNA, 25 bp, Rattus norvegicus
gccggagatgctccgctccgggttt

SEQ ID NO: 512487 - DNA, 25 bp, Rattus norvegicus
cgcacagcgtgcgactctagaggga

SEQ ID NO: 512488 - DNA, 25 bp, Rattus norvegicus
aggccagagagagcaaaactacttc

SEQ ID NO: 512489 - DNA, 25 bp, Rattus norvegicus
ggagttttcattttactcaccgtgc

SEQ ID NO: 512490 - DNA, 25 bp, Rattus norvegicus
gaatgcagtggaacatcgccgcctc

SEQ ID NO: 512491 - DNA, 25 bp, Rattus norvegicus
tggcgcttgtcgatggcctccacat

SEQ ID NO: 512492 - DNA, 25 bp, Rattus norvegicus
atggcctccacatgacggttgcacc

SEQ ID NO: 512493 - DNA, 25 bp, Rattus norvegicus
atctcctccgggacgtagaccagcg

SEQ ID NO: 512494 - DNA, 25 bp, Rattus norvegicus
atgcccaacagcgtgtcccgcgagt

SEQ ID NO: 512495 - DNA, 25 bp, Rattus norvegicus
caacccggagctcaacgagtggatg

SEQ ID NO: 512496 - DNA, 25 bp, Rattus norvegicus
aatgcatccagtgcttcaacccgga

SEQ ID NO: 512497 - DNA, 25 bp, Rattus norvegicus
tctcggcgttgcacggccgagccta

SEQ ID NO: 512498 - DNA, 25 bp, Rattus norvegicus
tttagtcccgtagctcgccagtgga

SEQ ID NO: 512499 - DNA, 25 bp, Rattus norvegicus
ctcaccgtggagagctttagtcccg

SEQ ID NO: 512500 - DNA, 25 bp, Rattus norvegicus
ggctacatcggcagcgcgtactcgc

SEQ ID NO: 512501 - DNA, 25 bp, Rattus norvegicus
ggcagcccaaagctccgctcgaggt

SEQ ID NO: 512502 - DNA, 25 bp, Rattus norvegicus
cgtggatccacctgggcagcatgaa

SEQ ID NO: 512503 - DNA, 25 bp, Rattus norvegicus
tggagtgctacgtgccctccaccaa

SEQ ID NO: 512504 - DNA, 25 bp, Rattus norvegicus
tgagcgtgttcaacgggctcctgta

SEQ ID NO: 512505 - DNA, 25 bp, Rattus norvegicus
acgcacttcagcctgagcgtgttca

SEQ ID NO: 512506 - DNA, 25 bp, Rattus norvegicus
gcatgaaccagaagcgcacgcactt

SEQ ID NO: 512507 - DNA, 25 bp, Rattus norvegicus
cctccgtgccggtcagtatctgaac

SEQ ID NO: 512508 - DNA, 25 bp, Rattus norvegicus
cccgcgcagagtgttgagtcacggt

SEQ ID NO: 512509 - DNA, 25 bp, Rattus norvegicus
ttcacaggatctcagcgaagaagcc

SEQ ID NO: 512510 - DNA, 25 bp, Rattus norvegicus
gacgcccggggaacgacgcacacat

SEQ ID NO: 512511 - DNA, 25 bp, Rattus norvegicus
ggggaacgacgcacacatctgaaac

SEQ ID NO: 512512 - DNA, 25 bp, Rattus norvegicus
cacacatctgaaacggctgctacga

SEQ ID NO: 512513 - DNA, 25 bp, Rattus norvegicus
tgaaacggctgctacgacaacggcc

SEQ ID NO: 512514 - DNA, 25 bp, Rattus norvegicus
cgcggcagcctatactcggaccgga

SEQ ID NO: 512515 - DNA, 25 bp, Rattus norvegicus
ccgatggtcacgtggccagcgctac

SEQ ID NO: 512516 - DNA, 25 bp, Rattus norvegicus
gtggccagcgctaccacaactacgg

SEQ ID NO: 512517 - DNA, 25 bp, Rattus norvegicus
ctaccacaactacggcgggcatgcg

SEQ ID NO: 512518 - DNA, 25 bp, Rattus norvegicus
aagacccagagcttcttctcgtcgg

SEQ ID NO: 512519 - DNA, 25 bp, Rattus norvegicus
ttctcgtcggaagagctgacccgga

SEQ ID NO: 512520 - DNA, 25 bp, Rattus norvegicus
tgacccggatgagcccgtgatcgtt

SEQ ID NO: 512521 - DNA, 25 bp, Rattus norvegicus
cggggaacgcggcagcctatactcg

SEQ ID NO: 512522 - DNA, 25 bp, Rattus norvegicus
tatgtgaatatctgcctcccggcga

SEQ ID NO: 512523 - DNA, 25 bp, Rattus norvegicus
cgcagccttgggtcgcaagtaggaa

SEQ ID NO: 512524 - DNA, 25 bp, Rattus norvegicus
agtaggaagcccgtgcacgacaccg

SEQ ID NO: 512525 - DNA, 25 bp, Rattus norvegicus
tgtcccaaggctcgccactgagctg

SEQ ID NO: 512526 - DNA, 25 bp, Rattus norvegicus
gagacacggcatcctccagttcctg

SEQ ID NO: 512527 - DNA, 25 bp, Rattus norvegicus
cgaccacgtgcggagacacggcatc

SEQ ID NO: 512528 - DNA, 25 bp, Rattus norvegicus
ttcgccttggagatgagtgtgaacg

SEQ ID NO: 512529 - DNA, 25 bp, Rattus norvegicus
ttccagtccggacgaaagccgctcg

SEQ ID NO: 512530 - DNA, 25 bp, Rattus norvegicus
ggtgactcggggctcattcattcca

SEQ ID NO: 512531 - DNA, 25 bp, Rattus norvegicus
accggcacaaggacgtgctcaagtg

SEQ ID NO: 512532 - DNA, 25 bp, Rattus norvegicus
taccacgcagtcaaggaccggcaca

SEQ ID NO: 512533 - DNA, 25 bp, Rattus norvegicus
agttcctgcacatctaccacgcagt

SEQ ID NO: 512534 - DNA, 25 bp, Rattus norvegicus
cgtagcctataaaatccggagcgcg

SEQ ID NO: 512535 - DNA, 25 bp, Rattus norvegicus
gagtgtgaacgggaccgacttgccc

SEQ ID NO: 512536 - DNA, 25 bp, Rattus norvegicus
gactgccagtccctccggcgtgatt

SEQ ID NO: 512537 - DNA, 25 bp, Rattus norvegicus
tggcacaccaggagctgctaccgct

SEQ ID NO: 512538 - DNA, 25 bp, Rattus norvegicus
cccttcagtccgaactacgatctta

SEQ ID NO: 512539 - DNA, 25 bp, Rattus norvegicus
cgactcacctctgactgtccgggga

SEQ ID NO: 512540 - DNA, 25 bp, Rattus norvegicus
tccgcgctgtaagagcactaaacta

SEQ ID NO: 512541 - DNA, 25 bp, Rattus norvegicus
gtaccaggactcattccgcgctgta

SEQ ID NO: 512542 - DNA, 25 bp, Rattus norvegicus
ctgcgaccttaatggactggttctg

SEQ ID NO: 512543 - DNA, 25 bp, Rattus norvegicus
gtccgctgcctcgatggcaacctaa

SEQ ID NO: 512544 - DNA, 25 bp, Rattus norvegicus
gtaggaaaccaagctccataccttc

SEQ ID NO: 512545 - DNA, 25 bp, Rattus norvegicus
tctacacggccgcagtaggaaacca

SEQ ID NO: 512546 - DNA, 25 bp, Rattus norvegicus
ccggcgtgattctgcgagtctcaga

SEQ ID NO: 512547 - DNA, 25 bp, Rattus norvegicus
agtctatcagggtccgagcccgttg

SEQ ID NO: 512548 - DNA, 25 bp, Rattus norvegicus
gtccggggacatgactggcacacca

SEQ ID NO: 512549 - DNA, 25 bp, Rattus norvegicus
taaactaggctaatgtctctcaggg

SEQ ID NO: 512550 - DNA, 25 bp, Rattus norvegicus
cctccctggctcaaggggttctgcg

SEQ ID NO: 512551 - DNA, 25 bp, Rattus norvegicus
cattgccgaaggctcctgccctccc

SEQ ID NO: 512552 - DNA, 25 bp, Rattus norvegicus
ctcacagcctcggtagcgacggccg

SEQ ID NO: 512553 - DNA, 25 bp, Rattus norvegicus
cgggccgtcgccattgccgaaggct

SEQ ID NO: 512554 - DNA, 25 bp, Rattus norvegicus
gacctttcctctctggtaagtgcga

SEQ ID NO: 512555 - DNA, 25 bp, Rattus norvegicus
ggagacctttcctctctggtaagtg

SEQ ID NO: 512556 - DNA, 25 bp, Rattus norvegicus
tcctctctggtaagtgcgaacaccg

SEQ ID NO: 512557 - DNA, 25 bp, Rattus norvegicus
cgccctgccatcctccctctctgct

SEQ ID NO: 512558 - DNA, 25 bp, Rattus norvegicus
cagcacagtgctcgcccgcgtcggc

SEQ ID NO: 512559 - DNA, 25 bp, Rattus norvegicus
tcaaggggttctgcgcctcacagcc

SEQ ID NO: 512560 - DNA, 25 bp, Rattus norvegicus
gggcggagacctttcctctctggta

SEQ ID NO: 512561 - DNA, 25 bp, Rattus norvegicus
cagaggcagcggttgttccgcttcc

SEQ ID NO: 512562 - DNA, 25 bp, Rattus norvegicus
ccccagggttgtggccacgcgcaga

SEQ ID NO: 512563 - DNA, 25 bp, Rattus norvegicus
tggctcaaggggttctgcgcctcac

SEQ ID NO: 512564 - DNA, 25 bp, Rattus norvegicus
tcagctcagactgcccagctcggcg

SEQ ID NO: 512565 - DNA, 25 bp, Rattus norvegicus
gcccaccagtactagcgccttggag

SEQ ID NO: 512566 - DNA, 25 bp, Rattus norvegicus
ccacccgcagcgatcgcccaccagt

SEQ ID NO: 512567 - DNA, 25 bp, Rattus norvegicus
tatgcgtcattgagacagagagaga

SEQ ID NO: 512568 - DNA, 25 bp, Rattus norvegicus
cgcgggtatgcgtcattgagacaga

SEQ ID NO: 512569 - DNA, 25 bp, Rattus norvegicus
cagtactagcgccttggagcctggg

SEQ ID NO: 512570 - DNA, 25 bp, Rattus norvegicus
ctggtgtgcactgcttgccaggtcc

SEQ ID NO: 512571 - DNA, 25 bp, Rattus norvegicus
ccgcctggtgtgcactgcttgccag

SEQ ID NO: 512572 - DNA, 25 bp, Rattus norvegicus
attctccgcaggcatggagggagct

SEQ ID NO: 512573 - DNA, 25 bp, Rattus norvegicus
gcaggcgggcattctccgcaggcat

SEQ ID NO: 512574 - DNA, 25 bp, Rattus norvegicus
gttaacaaggcctggagtcaccgga

SEQ ID NO: 512575 - DNA, 25 bp, Rattus norvegicus
cctacaagggcgttaacaaggcctg

SEQ ID NO: 512576 - DNA, 25 bp, Rattus norvegicus
gggcccacagcctacaagggcgtta

SEQ ID NO: 512577 - DNA, 25 bp, Rattus norvegicus
gtcaccggagcaggcgggcattctc

SEQ ID NO: 512578 - DNA, 25 bp, Rattus norvegicus
ctgttttggcaagaactgcgtgttc

SEQ ID NO: 512579 - DNA, 25 bp, Rattus norvegicus
ttctacctaagctgttttggcaaga

SEQ ID NO: 512580 - DNA, 25 bp, Rattus norvegicus
cccgcccggcagttgggcagtggag

SEQ ID NO: 512581 - DNA, 25 bp, Rattus norvegicus
ttcgagtgcctcatgaagaaccatt

SEQ ID NO: 512582 - DNA, 25 bp, Rattus norvegicus
gtgcctcatgaagaaccattcggtg

SEQ ID NO: 512583 - DNA, 25 bp, Rattus norvegicus
gtagataagagcatgggccactaga

SEQ ID NO: 512584 - DNA, 25 bp, Rattus norvegicus
agagcatgggccactagagctttca

SEQ ID NO: 512585 - DNA, 25 bp, Rattus norvegicus
atgggccactagagctttcatcttg

SEQ ID NO: 512586 - DNA, 25 bp, Rattus norvegicus
gcggccgtcccggaacccacacagc

SEQ ID NO: 512587 - DNA, 25 bp, Rattus norvegicus
acccgggctgcgacttctacctaag

SEQ ID NO: 512588 - DNA, 25 bp, Rattus norvegicus
gggctgcgacttctacctaagctgt

SEQ ID NO: 512589 - DNA, 25 bp, Rattus norvegicus
gcgacttctacctaagctgttttgg

SEQ ID NO: 512590 - DNA, 25 bp, Rattus norvegicus
ttggcaagaactgcgtgttcgtgta

SEQ ID NO: 512591 - DNA, 25 bp, Rattus norvegicus
cctaagctgttttggcaagaactgc

SEQ ID NO: 512592 - DNA, 25 bp, Rattus norvegicus
ctggaatttacaatcacgaaagttc

SEQ ID NO: 512593 - DNA, 25 bp, Rattus norvegicus
tgcgtcccacgcaggcttattagga

SEQ ID NO: 512594 - DNA, 25 bp, Rattus norvegicus
ggattggctccaagaccgcatgaca

SEQ ID NO: 512595 - DNA, 25 bp, Rattus norvegicus
ttgatcctgcctccgggctcggatt

SEQ ID NO: 512596 - DNA, 25 bp, Rattus norvegicus
ccgcatgacatcatagcgcttgatc

SEQ ID NO: 512597 - DNA, 25 bp, Rattus norvegicus
gcggcacgcttggatcttcctcaga

SEQ ID NO: 512598 - DNA, 25 bp, Rattus norvegicus
agagctttctccgagcgaccgtatg

SEQ ID NO: 512599 - DNA, 25 bp, Rattus norvegicus
gctgcacaccacatcggattctgga

SEQ ID NO: 512600 - DNA, 25 bp, Rattus norvegicus
ttaggaagaagcgagaaaactgccc

SEQ ID NO: 512601 - DNA, 25 bp, Rattus norvegicus
tggcagccactttggtgcactgaca

SEQ ID NO: 512602 - DNA, 25 bp, Rattus norvegicus
ctgtcgcacctgttcgtgggtggca

SEQ ID NO: 512603 - DNA, 25 bp, Rattus norvegicus
cctgctacaggaacttggcggatgc

SEQ ID NO: 512604 - DNA, 25 bp, Rattus norvegicus
ccgcgccattgtgacgtcacggtca

SEQ ID NO: 512605 - DNA, 25 bp, Rattus norvegicus
tccactcctttgctgctaccaggga

SEQ ID NO: 512606 - DNA, 25 bp, Rattus norvegicus
agttctcggtcggagaagcgcacca

SEQ ID NO: 512607 - DNA, 25 bp, Rattus norvegicus
tgagcgaccgaagcgggcctttcct

SEQ ID NO: 512608 - DNA, 25 bp, Rattus norvegicus
tctcagctcgggcagtcttgagcga

SEQ ID NO: 512609 - DNA, 25 bp, Rattus norvegicus
tcgggcagtcttgagcgaccgaagc

SEQ ID NO: 512610 - DNA, 25 bp, Rattus norvegicus
cgctgtccgtcaaaccctgtcctca

SEQ ID NO: 512611 - DNA, 25 bp, Rattus norvegicus
ggctgctgcccggtgtctactcctg

SEQ ID NO: 512612 - DNA, 25 bp, Rattus norvegicus
ggtgtctactcctgcccgtctgctg

SEQ ID NO: 512613 - DNA, 25 bp, Rattus norvegicus
actgcagccgcctgcttggctagca

SEQ ID NO: 512614 - DNA, 25 bp, Rattus norvegicus
cggcttagcagagttctcggtcgga

SEQ ID NO: 512615 - DNA, 25 bp, Rattus norvegicus
cgcaccaggcagcggcagtaactgc

SEQ ID NO: 512616 - DNA, 25 bp, Rattus norvegicus
gggcccggcgtacggcagccatctt

SEQ ID NO: 512617 - DNA, 25 bp, Rattus norvegicus
tacggcagccatcttcgcgggacag

SEQ ID NO: 512618 - DNA, 25 bp, Rattus norvegicus
gaagacccgagcgtcggcccagcag

SEQ ID NO: 512619 - DNA, 25 bp, Rattus norvegicus
ctgcagcgcggcttagcagagttct

SEQ ID NO: 512620 - DNA, 25 bp, Rattus norvegicus
acttgccgggttcgcccgctcggat

SEQ ID NO: 512621 - DNA, 25 bp, Rattus norvegicus
ccctctgccgagcatccgggagatg

SEQ ID NO: 512622 - DNA, 25 bp, Rattus norvegicus
ccaagaaggctagggactgcggttt

SEQ ID NO: 512623 - DNA, 25 bp, Rattus norvegicus
ctgcagggcagcttttccagggaaa

SEQ ID NO: 512624 - DNA, 25 bp, Rattus norvegicus
ctaggagccactccgccttttgttt

SEQ ID NO: 512625 - DNA, 25 bp, Rattus norvegicus
ttgtttgttttgctgccggaggccg

SEQ ID NO: 512626 - DNA, 25 bp, Rattus norvegicus
gttcctgctggatgccacgcgctgc

SEQ ID NO: 512627 - DNA, 25 bp, Rattus norvegicus
cccggctgtgatcgccgccagtaag

SEQ ID NO: 512628 - DNA, 25 bp, Rattus norvegicus
tggagggctacaacgtgacctgtcg

SEQ ID NO: 512629 - DNA, 25 bp, Rattus norvegicus
tacaacgtgacctgtcgctgggtgc

SEQ ID NO: 512630 - DNA, 25 bp, Rattus norvegicus
gactgcggtttctcggtggacccgc

SEQ ID NO: 512631 - DNA, 25 bp, Rattus norvegicus
cgagcgaactcacggccaagaaggc

SEQ ID NO: 512632 - DNA, 25 bp, Rattus norvegicus
tgggtcttctttgccgagagaactc

SEQ ID NO: 512633 - DNA, 25 bp, Rattus norvegicus
ctcggtgcaacccaggagctcagcg

SEQ ID NO: 512634 - DNA, 25 bp, Rattus norvegicus
cgcgttcaacgcgttccggttggag

SEQ ID NO: 512635 - DNA, 25 bp, Rattus norvegicus
tctcgtggccttctgtggggccgta

SEQ ID NO: 512636 - DNA, 25 bp, Rattus norvegicus
cacgagcctctcgtggccttctgtg

SEQ ID NO: 512637 - DNA, 25 bp, Rattus norvegicus
ggtagacacagagcatctgcggcct

SEQ ID NO: 512638 - DNA, 25 bp, Rattus norvegicus
cggagggtagacacagagcatctgc

SEQ ID NO: 512639 - DNA, 25 bp, Rattus norvegicus
tgttgccacctctgccaaggcgagc

SEQ ID NO: 512640 - DNA, 25 bp, Rattus norvegicus
tgtctgtgtcacgtctccatcccgt

SEQ ID NO: 512641 - DNA, 25 bp, Rattus norvegicus
tgggttcttcgccttcggtgtgtgt

SEQ ID NO: 512642 - DNA, 25 bp, Rattus norvegicus
tctccatcccgtggccgaagtgaca

SEQ ID NO: 512643 - DNA, 25 bp, Rattus norvegicus
agctacgtccgttccaccgcctgat

SEQ ID NO: 512644 - DNA, 25 bp, Rattus norvegicus
ccttcggtgtgtgttgccacctctg

SEQ ID NO: 512645 - DNA, 25 bp, Rattus norvegicus
ccgaagtgacacacagaagcaagta

SEQ ID NO: 512646 - DNA, 25 bp, Rattus norvegicus
ttagaagaatgtgatgcgcccggtc

SEQ ID NO: 512647 - DNA, 25 bp, Rattus norvegicus
gccgtagttgtctgtgtcacgtctc

SEQ ID NO: 512648 - DNA, 25 bp, Rattus norvegicus
acgctaggcctcaagccggacacga

SEQ ID NO: 512649 - DNA, 25 bp, Rattus norvegicus
gctgccgcgtcctccattttgagct

SEQ ID NO: 512650 - DNA, 25 bp, Rattus norvegicus
ttttgagctccttgcaacagggccc

SEQ ID NO: 512651 - DNA, 25 bp, Rattus norvegicus
gagcggccatctttccgcgcaagca

SEQ ID NO: 512652 - DNA, 25 bp, Rattus norvegicus
ggtaggctaaactcacgcccgattg

SEQ ID NO: 512653 - DNA, 25 bp, Rattus norvegicus
ttgcttcggaaagccacaggcctcg

SEQ ID NO: 512654 - DNA, 25 bp, Rattus norvegicus
tagcccatgctgctggaaggcaatc

SEQ ID NO: 512655 - DNA, 25 bp, Rattus norvegicus
ggcaaggccctcttcctttgtgtgg

SEQ ID NO: 512656 - DNA, 25 bp, Rattus norvegicus
gccactcgaagtgggaatgctcaca

SEQ ID NO: 512657 - DNA, 25 bp, Rattus norvegicus
ggacgacactcgcatatcagcccgg

SEQ ID NO: 512658 - DNA, 25 bp, Rattus norvegicus
cactcacctgcgttctgacggcaaa

SEQ ID NO: 512659 - DNA, 25 bp, Rattus norvegicus
ggcgactaccgcacttatataccgt

SEQ ID NO: 512660 - DNA, 25 bp, Rattus norvegicus
ttgtgtgctctgatctacccgcgct

SEQ ID NO: 512661 - DNA, 25 bp, Rattus norvegicus
cgtaagcttcatgggctccttaaga

SEQ ID NO: 512662 - DNA, 25 bp, Rattus norvegicus
taggcttcagaagagaagagcgttt

SEQ ID NO: 512663 - DNA, 25 bp, Rattus norvegicus
ccagaccgcagtgactttccactga

SEQ ID NO: 512664 - DNA, 25 bp, Rattus norvegicus
tttccactgagacgtgcggctgagc

SEQ ID NO: 512665 - DNA, 25 bp, Rattus norvegicus
tgcggctgagccctttttaaatgcc

SEQ ID NO: 512666 - DNA, 25 bp, Rattus norvegicus
ctttctttgcacgtggtcgctgtga

SEQ ID NO: 512667 - DNA, 25 bp, Rattus norvegicus
ccctttctctagacaaagaaatcta

SEQ ID NO: 512668 - DNA, 25 bp, Rattus norvegicus
tctaggttttgctaatcaggttccc

SEQ ID NO: 512669 - DNA, 25 bp, Rattus norvegicus
gtccgctaaggcgtgagtcaaactc

SEQ ID NO: 512670 - DNA, 25 bp, Rattus norvegicus
tgagtcaaactcgtgcttccgtagc

SEQ ID NO: 512671 - DNA, 25 bp, Rattus norvegicus
cttccgtagctctgtaagcgcttgc

SEQ ID NO: 512672 - DNA, 25 bp, Rattus norvegicus
cccggtgcaaatccgagtttctgtg

SEQ ID NO: 512673 - DNA, 25 bp, Rattus norvegicus
gaagagcgtttgtgcgctttaaaaa

SEQ ID NO: 512674 - DNA, 25 bp, Rattus norvegicus
cggcagggaaattgtcgtaggcttc

SEQ ID NO: 512675 - DNA, 25 bp, Rattus norvegicus
tccggggccaaaagattcacgcgga

SEQ ID NO: 512676 - DNA, 25 bp, Rattus norvegicus
acaggcagctctgtccggtcctaca

SEQ ID NO: 512677 - DNA, 25 bp, Rattus norvegicus
cggtcctacaggcttacacctgcta

SEQ ID NO: 512678 - DNA, 25 bp, Rattus norvegicus
tgtcactagcaacctcccggtggtc

SEQ ID NO: 512679 - DNA, 25 bp, Rattus norvegicus
ccgcttcgatctgccgggcgctagg

SEQ ID NO: 512680 - DNA, 25 bp, Rattus norvegicus
ggtgctgtccgagctttcctcatca

SEQ ID NO: 512681 - DNA, 25 bp, Rattus norvegicus
gagctttcctcatcatcgtttcccg

SEQ ID NO: 512682 - DNA, 25 bp, Rattus norvegicus
cgaagcaggggcctcatgacgcctg

SEQ ID NO: 512683 - DNA, 25 bp, Rattus norvegicus
atgacgcctggagagcagatgtgcc

SEQ ID NO: 512684 - DNA, 25 bp, Rattus norvegicus
cagatgtgccactatcgttgcttgg

SEQ ID NO: 512685 - DNA, 25 bp, Rattus norvegicus
ccactatcgttgcttggctgacaga

SEQ ID NO: 512686 - DNA, 25 bp, Rattus norvegicus
tcgttgcttggctgacagagatctc

SEQ ID NO: 512687 - DNA, 25 bp, Rattus norvegicus
tgacagagatctcggcaggacagcc

SEQ ID NO: 512688 - DNA, 25 bp, Rattus norvegicus
atcccgaattgcttcggccgggcca

SEQ ID NO: 512689 - DNA, 25 bp, Rattus norvegicus
ctgcccggaacgctgtcactagcaa

SEQ ID NO: 512690 - DNA, 25 bp, Rattus norvegicus
ccgcttttctcagccacgggacgcg

SEQ ID NO: 512691 - DNA, 25 bp, Rattus norvegicus
tgcccaccttctcagcgtgtgcgtg

SEQ ID NO: 512692 - DNA, 25 bp, Rattus norvegicus
gatgcgcaatccgaggctcctgagc

SEQ ID NO: 512693 - DNA, 25 bp, Rattus norvegicus
caggcagacgccgagatgcgcaatc

SEQ ID NO: 512694 - DNA, 25 bp, Rattus norvegicus
ctaaaccctggtgtgaagcgggaca

SEQ ID NO: 512695 - DNA, 25 bp, Rattus norvegicus
tttcagtttgctaaaccctggtgtg

SEQ ID NO: 512696 - DNA, 25 bp, Rattus norvegicus
ggcgcgcccatttcagtttgctaaa

SEQ ID NO: 512697 - DNA, 25 bp, Rattus norvegicus
cctctgcttttaggcgcgcccattt

SEQ ID NO: 512698 - DNA, 25 bp, Rattus norvegicus
gtctcaatttagattcctctgcttt

SEQ ID NO: 512699 - DNA, 25 bp, Rattus norvegicus
ggtggagccatcaagtctcaattta

SEQ ID NO: 512700 - DNA, 25 bp, Rattus norvegicus
ggagaagccagaagcgccattgtga

SEQ ID NO: 512701 - DNA, 25 bp, Rattus norvegicus
ctagggagaagccagaagcgccatt

SEQ ID NO: 512702 - DNA, 25 bp, Rattus norvegicus
accttctcagcgtgtgcgtggtcgc

SEQ ID NO: 512703 - DNA, 25 bp, Rattus norvegicus
acgcgcgacgttagctagggagaag

SEQ ID NO: 512704 - DNA, 25 bp, Rattus norvegicus
cagcgttcgtccaggcagaagatta

SEQ ID NO: 512705 - DNA, 25 bp, Rattus norvegicus
tgcagtacaaacctcgaaatccaga

SEQ ID NO: 512706 - DNA, 25 bp, Rattus norvegicus
aaagcaggccggagccctggtcgct

SEQ ID NO: 512707 - DNA, 25 bp, Rattus norvegicus
ctagtcacgcccttcgcacaagggg

SEQ ID NO: 512708 - DNA, 25 bp, Rattus norvegicus
tgaagatcgttgtcagcctcccagc

SEQ ID NO: 512709 - DNA, 25 bp, Rattus norvegicus
acctcgaaatccagaccgccagaaa

SEQ ID NO: 512710 - DNA, 25 bp, Rattus norvegicus
tccttcctttgcagtacaaacctcg

SEQ ID NO: 512711 - DNA, 25 bp, Rattus norvegicus
aggcccgcatgcaggccgcctagtg

SEQ ID NO: 512712 - DNA, 25 bp, Rattus norvegicus
cagcccaggctaggagacgtccgca

SEQ ID NO: 512713 - DNA, 25 bp, Rattus norvegicus
caaagaaagtaggtaagcgggagca

SEQ ID NO: 512714 - DNA, 25 bp, Rattus norvegicus
ttaggtgccgggagcaaagaaagta

SEQ ID NO: 512715 - DNA, 25 bp, Rattus norvegicus
tcgtccaggcagaagattaggtgcc

SEQ ID NO: 512716 - DNA, 25 bp, Rattus norvegicus
ggtcccagacgctgcagcgttcgtc

SEQ ID NO: 512717 - DNA, 25 bp, Rattus norvegicus
tcggggaaagccttgcctgaagatc

SEQ ID NO: 512718 - DNA, 25 bp, Rattus norvegicus
ccgcgccgcgggctacttaatagag

SEQ ID NO: 512719 - DNA, 25 bp, Rattus norvegicus
ttcgagcattccttcggcgtgaggt

SEQ ID NO: 512720 - DNA, 25 bp, Rattus norvegicus
aggtctacttttgggaacgtgtgca

SEQ ID NO: 512721 - DNA, 25 bp, Rattus norvegicus
ctcctcggcggtgaaggaggtctac

SEQ ID NO: 512722 - DNA, 25 bp, Rattus norvegicus
cacgggtgatgtatgctcctcggcg

SEQ ID NO: 512723 - DNA, 25 bp, Rattus norvegicus
ctcggttacgaaacgcctgagaagg

SEQ ID NO: 512724 - DNA, 25 bp, Rattus norvegicus
cttaatagagggctgttcccggctc

SEQ ID NO: 512725 - DNA, 25 bp, Rattus norvegicus
tttgctgactgggaagagactccgc

SEQ ID NO: 512726 - DNA, 25 bp, Rattus norvegicus
cagcgccgcctttgctgactgggaa

SEQ ID NO: 512727 - DNA, 25 bp, Rattus norvegicus
gagcacccaggagcagcgcccaagg

SEQ ID NO: 512728 - DNA, 25 bp, Rattus norvegicus
gcgtccagcagtctccgcgtgggac

SEQ ID NO: 512729 - DNA, 25 bp, Rattus norvegicus
aacgtgtgcatacttcgagcattcc

SEQ ID NO: 512730 - DNA, 25 bp, Rattus norvegicus
cggctctcagtttactcggttacga

SEQ ID NO: 512731 - DNA, 25 bp, Rattus norvegicus
tggcgatcgccgtagtagcaatgcc

SEQ ID NO: 512732 - DNA, 25 bp, Rattus norvegicus
cgcgtgctaccgagatggccaaata

SEQ ID NO: 512733 - DNA, 25 bp, Rattus norvegicus
tcagaactcgctccgcggatttccg

SEQ ID NO: 512734 - DNA, 25 bp, Rattus norvegicus
catgcatttgtgagctcagaactcg

SEQ ID NO: 512735 - DNA, 25 bp, Rattus norvegicus
gacggattcatacatgcatttgtga

SEQ ID NO: 512736 - DNA, 25 bp, Rattus norvegicus
aagcgctcgaagacggattcataca

SEQ ID NO: 512737 - DNA, 25 bp, Rattus norvegicus
cgacggtatccgaaaagcgctcgaa

SEQ ID NO: 512738 - DNA, 25 bp, Rattus norvegicus
gtccagtagtcacacgacggtatcc

SEQ ID NO: 512739 - DNA, 25 bp, Rattus norvegicus
atgggaggaagcgtccagtagtcac

SEQ ID NO: 512740 - DNA, 25 bp, Rattus norvegicus
ttgtacaagacgcatgggaggaagc

SEQ ID NO: 512741 - DNA, 25 bp, Rattus norvegicus
gcacttgaagttgccaaattgtaca

SEQ ID NO: 512742 - DNA, 25 bp, Rattus norvegicus
acgcagtgggagtctggcacttgaa

SEQ ID NO: 512743 - DNA, 25 bp, Rattus norvegicus
ccagcactcaggctttttctgtgtc

SEQ ID NO: 512744 - DNA, 25 bp, Rattus norvegicus
gctgaacacgccagcactcaggctt

SEQ ID NO: 512745 - DNA, 25 bp, Rattus norvegicus
atggccaaataggagctgaacacgc

SEQ ID NO: 512746 - DNA, 25 bp, Rattus norvegicus
actctcggggcttcttcacgaggcg

SEQ ID NO: 512747 - DNA, 25 bp, Rattus norvegicus
gatctctgtacccaaaccctgtggg

SEQ ID NO: 512748 - DNA, 25 bp, Rattus norvegicus
tgaactggttccacagatctctgta

SEQ ID NO: 512749 - DNA, 25 bp, Rattus norvegicus
gcctgttctcactcagctgcgcaga

SEQ ID NO: 512750 - DNA, 25 bp, Rattus norvegicus
gcagttttttgactctcggggcttc

SEQ ID NO: 512751 - DNA, 25 bp, Rattus norvegicus
tcacgaggcgttgatcccatttctc

SEQ ID NO: 512752 - DNA, 25 bp, Rattus norvegicus
tttctccttccgctcatgtggcttg

SEQ ID NO: 512753 - DNA, 25 bp, Rattus norvegicus
ccgctcatgtggcttgagagccatg

SEQ ID NO: 512754 - DNA, 25 bp, Rattus norvegicus
gagagccatgtccttctccagggcc

SEQ ID NO: 512755 - DNA, 25 bp, Rattus norvegicus
accggagtgcggcaggctctcagcc

SEQ ID NO: 512756 - DNA, 25 bp, Rattus norvegicus
aggcagacctagaagtaaattctta

SEQ ID NO: 512757 - DNA, 25 bp, Rattus norvegicus
ggtgtgaatgaaccttgaaaatctt

SEQ ID NO: 512758 - DNA, 25 bp, Rattus norvegicus
ttagtggtttctgcttgtgcaaaga

SEQ ID NO: 512759 - DNA, 25 bp, Rattus norvegicus
cagctgcgcagatgggcagtttttt

SEQ ID NO: 512760 - DNA, 25 bp, Rattus norvegicus
aggggctcgcgctcccgaccataga

SEQ ID NO: 512761 - DNA, 25 bp, Rattus norvegicus
gcgactactgaacgccaaaaatcga

SEQ ID NO: 512762 - DNA, 25 bp, Rattus norvegicus
aagagtgctcgttcccggaagagga

SEQ ID NO: 512763 - DNA, 25 bp, Rattus norvegicus
ctcccgaccatagagagcggaggga

SEQ ID NO: 512764 - DNA, 25 bp, Rattus norvegicus
agggagagccagagcgactcctcga

SEQ ID NO: 512765 - DNA, 25 bp, Rattus norvegicus
gcgactcctcgaagcggccggtcta

SEQ ID NO: 512766 - DNA, 25 bp, Rattus norvegicus
gaatccatctgtacctcctgtctcg

SEQ ID NO: 512767 - DNA, 25 bp, Rattus norvegicus
tgtacctcctgtctcggccctgtgg

SEQ ID NO: 512768 - DNA, 25 bp, Rattus norvegicus
ggcacccgcagtgggacctagaatc

SEQ ID NO: 512769 - DNA, 25 bp, Rattus norvegicus
gggacctagaatcacaactgaaagc

SEQ ID NO: 512770 - DNA, 25 bp, Rattus norvegicus
ctgaaagcaaatgccgcccgcaatg

SEQ ID NO: 512771 - DNA, 25 bp, Rattus norvegicus
gaggcgtgatgtctgcagccctctt

SEQ ID NO: 512772 - DNA, 25 bp, Rattus norvegicus
gtgcgtcaaggaagagtgctcgttc

SEQ ID NO: 512773 - DNA, 25 bp, Rattus norvegicus
ccgcccgcaatggaggcgtgatgtc

SEQ ID NO: 512774 - DNA, 25 bp, Rattus norvegicus
tgacaggagacacgcagtcgccgct

SEQ ID NO: 512775 - DNA, 25 bp, Rattus norvegicus
tgtcaccttccgtgagccagggatc

SEQ ID NO: 512776 - DNA, 25 bp, Rattus norvegicus
atgccgatgccgatgggaatgaaga

SEQ ID NO: 512777 - DNA, 25 bp, Rattus norvegicus
ccgttgctgtttgaaggccgtgtta

SEQ ID NO: 512778 - DNA, 25 bp, Rattus norvegicus
tgttatccggcctccgggtcttggc

SEQ ID NO: 512779 - DNA, 25 bp, Rattus norvegicus
tgcctgccgatcctgacaggagaca

SEQ ID NO: 512780 - DNA, 25 bp, Rattus norvegicus
cacctcgatctcacggatgttgttg

SEQ ID NO: 512781 - DNA, 25 bp, Rattus norvegicus
ggacacgcttctgcggacggccgct

SEQ ID NO: 512782 - DNA, 25 bp, Rattus norvegicus
aagcgggagtcttcaggagacgccc

SEQ ID NO: 512783 - DNA, 25 bp, Rattus norvegicus
aaaggcggacgcaccctgatcatct

SEQ ID NO: 512784 - DNA, 25 bp, Rattus norvegicus
tctgccctgtgacgacaaagtgagg

SEQ ID NO: 512785 - DNA, 25 bp, Rattus norvegicus
tgcgcactgggacaatagcgtctta

SEQ ID NO: 512786 - DNA, 25 bp, Rattus norvegicus
cgctatagttcatcgccattggccc

SEQ ID NO: 512787 - DNA, 25 bp, Rattus norvegicus
ctgccaggcaggcaaccgttgctgt

SEQ ID NO: 512788 - DNA, 25 bp, Rattus norvegicus
ctcgctgctccagcagtggccgccg

SEQ ID NO: 512789 - DNA, 25 bp, Rattus norvegicus
cgcccaggcgtcagagcatcagccc

SEQ ID NO: 512790 - DNA, 25 bp, Rattus norvegicus
agcgcgttccctgcccgccatcgac

SEQ ID NO: 512791 - DNA, 25 bp, Rattus norvegicus
tcccgggccgtaaaatggccgcagc

SEQ ID NO: 512792 - DNA, 25 bp, Rattus norvegicus
tgggtttcttctcctcaggcgccta

SEQ ID NO: 512793 - DNA, 25 bp, Rattus norvegicus
acacaaaagcgggcctgtcgcgggc

SEQ ID NO: 512794 - DNA, 25 bp, Rattus norvegicus
cttcttactccatggccggcaccgc

SEQ ID NO: 512795 - DNA, 25 bp, Rattus norvegicus
ctcgcgccagcctgcccgagccttt

SEQ ID NO: 512796 - DNA, 25 bp, Rattus norvegicus
tgaggaagacccgaacgcacctttc

SEQ ID NO: 512797 - DNA, 25 bp, Rattus norvegicus
cagctgagtatctcggcccgagaga

SEQ ID NO: 512798 - DNA, 25 bp, Rattus norvegicus
cccggagcacacagctgagtatctc

SEQ ID NO: 512799 - DNA, 25 bp, Rattus norvegicus
aagtccacccggagcacacagctga

SEQ ID NO: 512800 - DNA, 25 bp, Rattus norvegicus
ctcaggcgcctaccggggaccgtga

SEQ ID NO: 512801 - DNA, 25 bp, Rattus norvegicus
aggcctcggcgactgtccatgtgga

SEQ ID NO: 512802 - DNA, 25 bp, Rattus norvegicus
tcaccggcagctagctgcttgcaga

SEQ ID NO: 512803 - DNA, 25 bp, Rattus norvegicus
caactcttgaggtcccgcctttatc

SEQ ID NO: 512804 - DNA, 25 bp, Rattus norvegicus
ccgagacccaacgaattgcgagtcc

SEQ ID NO: 512805 - DNA, 25 bp, Rattus norvegicus
cccggagctcgttgccttgaggcca

SEQ ID NO: 512806 - DNA, 25 bp, Rattus norvegicus
tagctctttggtctctcctccctag

SEQ ID NO: 512807 - DNA, 25 bp, Rattus norvegicus
gcctctctcaactctagctctttgg

SEQ ID NO: 512808 - DNA, 25 bp, Rattus norvegicus
ctttatcttgcctcacgccattagg

SEQ ID NO: 512809 - DNA, 25 bp, Rattus norvegicus
tcgttgccttgaggccaggtccctc

SEQ ID NO: 512810 - DNA, 25 bp, Rattus norvegicus
ctagctgcttgcagagatgccggga

SEQ ID NO: 512811 - DNA, 25 bp, Rattus norvegicus
acttcgtgaggggtcaccggcagct

SEQ ID NO: 512812 - DNA, 25 bp, Rattus norvegicus
ctatcactgcgaagaagggaacttc

SEQ ID NO: 512813 - DNA, 25 bp, Rattus norvegicus
cattggaagcaactatcactgcgaa

SEQ ID NO: 512814 - DNA, 25 bp, Rattus norvegicus
gttctctgctcctatccaactcttg

SEQ ID NO: 512815 - DNA, 25 bp, Rattus norvegicus
gatgcggtcagagcctcggttctct

SEQ ID NO: 512816 - DNA, 25 bp, Rattus norvegicus
ccaagatgagaggtaatgccgcgta

SEQ ID NO: 512817 - DNA, 25 bp, Rattus norvegicus
ggatagaccagacaagaccaagatg

SEQ ID NO: 512818 - DNA, 25 bp, Rattus norvegicus
atgccgcgtagacggggatagacca

SEQ ID NO: 512819 - DNA, 25 bp, Rattus norvegicus
tagaccagacaagaccaagatgaga

SEQ ID NO: 512820 - DNA, 25 bp, Rattus norvegicus
aagatgagaggtaatgccgcgtaga

SEQ ID NO: 512821 - DNA, 25 bp, Rattus norvegicus
cgtagacggggatagaccagacaag

SEQ ID NO: 512822 - DNA, 25 bp, Rattus norvegicus
agaccaagatgagaggtaatgccgc

SEQ ID NO: 512823 - DNA, 25 bp, Rattus norvegicus
acggggatagaccagacaagaccaa

SEQ ID NO: 512824 - DNA, 25 bp, Rattus norvegicus
gacggggatagaccagacaagacca

SEQ ID NO: 512825 - DNA, 25 bp, Rattus norvegicus
agacggggatggaacagacaagacc

SEQ ID NO: 512826 - DNA, 25 bp, Rattus norvegicus
tagacggggatggaacagacaagac

SEQ ID NO: 512827 - DNA, 25 bp, Rattus norvegicus
caagaccaagatgagaggtaatgcc

SEQ ID NO: 512828 - DNA, 25 bp, Rattus norvegicus
cggggatagaccagacaagaccaag

SEQ ID NO: 512829 - DNA, 25 bp, Rattus norvegicus
agacggggatagaccagacaagacc

SEQ ID NO: 512830 - DNA, 25 bp, Rattus norvegicus
gtctgagactcgcactttgacttgg

SEQ ID NO: 512831 - DNA, 25 bp, Rattus norvegicus
cgcactttgacttggttcacgtaca

SEQ ID NO: 512832 - DNA, 25 bp, Rattus norvegicus
tgacttggttcacgtacacaggaga

SEQ ID NO: 512833 - DNA, 25 bp, Rattus norvegicus
ttggttcacgtacacaggagacccg

SEQ ID NO: 512834 - DNA, 25 bp, Rattus norvegicus
ttcacgtacacaggagacccggact

SEQ ID NO: 512835 - DNA, 25 bp, Rattus norvegicus
gtacacaggagacccggactcactg

SEQ ID NO: 512836 - DNA, 25 bp, Rattus norvegicus
gagactcgcactttgacttggttca

SEQ ID NO: 512837 - DNA, 25 bp, Rattus norvegicus
ctcactgggcacctccggaacccgg

SEQ ID NO: 512838 - DNA, 25 bp, Rattus norvegicus
ccgggagttaatggaggtgaccgag

SEQ ID NO: 512839 - DNA, 25 bp, Rattus norvegicus
gacgtggatcctggagagtctgtta

SEQ ID NO: 512840 - DNA, 25 bp, Rattus norvegicus
atcctggagagtctgttatcaactg

SEQ ID NO: 512841 - DNA, 25 bp, Rattus norvegicus
ctggagagtctgttatcaactgggc

SEQ ID NO: 512842 - DNA, 25 bp, Rattus norvegicus
ggagacccggactcactgggcacct

SEQ ID NO: 512843 - DNA, 25 bp, Rattus norvegicus
gagtctgttatcaactgggctcggg

SEQ ID NO: 512844 - DNA, 25 bp, Rattus norvegicus
acggactgtactcttcacgggtcga

SEQ ID NO: 512845 - DNA, 25 bp, Rattus norvegicus
gaacgctacgctgcttcgagtccta

SEQ ID NO: 512846 - DNA, 25 bp, Rattus norvegicus
cccggtattcgctgagctccacgta

SEQ ID NO: 512847 - DNA, 25 bp, Rattus norvegicus
ggaggccacccgacatgatgcagaa

SEQ ID NO: 512848 - DNA, 25 bp, Rattus norvegicus
acaggaatcacgacgcggccaaggc

SEQ ID NO: 512849 - DNA, 25 bp, Rattus norvegicus
tcgtcatcatgcagcgccgactcgt

SEQ ID NO: 512850 - DNA, 25 bp, Rattus norvegicus
gcgtatacagtgtgcctcgggttcc

SEQ ID NO: 512851 - DNA, 25 bp, Rattus norvegicus
aggtcaggtatcctcccttcagtga

SEQ ID NO: 512852 - DNA, 25 bp, Rattus norvegicus
cgccaacgcgtaagcacggactgta

SEQ ID NO: 512853 - DNA, 25 bp, Rattus norvegicus
gcctcgcggttcaaggacactttca

SEQ ID NO: 512854 - DNA, 25 bp, Rattus norvegicus
taaagctgcaactgcgcggccacga

SEQ ID NO: 512855 - DNA, 25 bp, Rattus norvegicus
actcacagccttcgcgttgctaaag

SEQ ID NO: 512856 - DNA, 25 bp, Rattus norvegicus
ctgaacaacccgcatctagtggagc

SEQ ID NO: 512857 - DNA, 25 bp, Rattus norvegicus
acctcagcattctcgggtcatcaga

SEQ ID NO: 512858 - DNA, 25 bp, Rattus norvegicus
cagcttctctcaggttccctggagg

SEQ ID NO: 512859 - DNA, 25 bp, Rattus norvegicus
atagctctcctcgtcctggctgcgg

SEQ ID NO: 512860 - DNA, 25 bp, Rattus norvegicus
ggaatctgcagactccgcccgcagg

SEQ ID NO: 512861 - DNA, 25 bp, Rattus norvegicus
tctctgggtctaatgggacctctta

SEQ ID NO: 512862 - DNA, 25 bp, Rattus norvegicus
aaatgtagtcgtcggcgctgcagtt

SEQ ID NO: 512863 - DNA, 25 bp, Rattus norvegicus
ggcggagcgcactgaataccctgct

SEQ ID NO: 512864 - DNA, 25 bp, Rattus norvegicus
accgaagcttgcaggccagtgcaga

SEQ ID NO: 512865 - DNA, 25 bp, Rattus norvegicus
tttgctggctgtgcagaccgaagct

SEQ ID NO: 512866 - DNA, 25 bp, Rattus norvegicus
taacccgggcgctccggaatctgca

SEQ ID NO: 512867 - DNA, 25 bp, Rattus norvegicus
gcggagcgcagctcttgaacatgga

SEQ ID NO: 512868 - DNA, 25 bp, Rattus norvegicus
ctttggctagccagttccgtgggtt

SEQ ID NO: 512869 - DNA, 25 bp, Rattus norvegicus
ccaattgctcaggtctcagattctc

SEQ ID NO: 512870 - DNA, 25 bp, Rattus norvegicus
gcctgtgttctcagccgaaaggaga

SEQ ID NO: 512871 - DNA, 25 bp, Rattus norvegicus
tgggttcctcagtaaactcctccgc

SEQ ID NO: 512872 - DNA, 25 bp, Rattus norvegicus
ggtcctaccgccctctctcgcagct

SEQ ID NO: 512873 - DNA, 25 bp, Rattus norvegicus
tcgctgccacagacttagtgagggc

SEQ ID NO: 512874 - DNA, 25 bp, Rattus norvegicus
acccacgcccttagtcgctgccaca

SEQ ID NO: 512875 - DNA, 25 bp, Rattus norvegicus
ctccgcagtcaacccacgcccttag

SEQ ID NO: 512876 - DNA, 25 bp, Rattus norvegicus
tgagagtctgcgctccgcagtcaac

SEQ ID NO: 512877 - DNA, 25 bp, Rattus norvegicus
ctgagaggtttgagagtctgcgctc

SEQ ID NO: 512878 - DNA, 25 bp, Rattus norvegicus
tcctgttcttgcctctgagaggttt

SEQ ID NO: 512879 - DNA, 25 bp, Rattus norvegicus
ggacgtcctgttcttgcctctgaga

SEQ ID NO: 512880 - DNA, 25 bp, Rattus norvegicus
cgggaaatgggacgtcctgttcttg

SEQ ID NO: 512881 - DNA, 25 bp, Rattus norvegicus
tggagtcgcctttcaagcggggaac

SEQ ID NO: 512882 - DNA, 25 bp, Rattus norvegicus
ccctgaaacttggagtcgcctttca

SEQ ID NO: 512883 - DNA, 25 bp, Rattus norvegicus
agctttcttcaccttgtcctttctc

SEQ ID NO: 512884 - DNA, 25 bp, Rattus norvegicus
tctctcgcagctttcttcaccttgt

SEQ ID NO: 512885 - DNA, 25 bp, Rattus norvegicus
ccacagacttagtgagggcgtccgg

SEQ ID NO: 512886 - DNA, 25 bp, Rattus norvegicus
ggcacgcatgctggcccacgggctt

SEQ ID NO: 512887 - DNA, 25 bp, Rattus norvegicus
caaagcccgccggagccctccgcag

SEQ ID NO: 512888 - DNA, 25 bp, Rattus norvegicus
tgcatggcacgcatgctggcccacg

SEQ ID NO: 512889 - DNA, 25 bp, Rattus norvegicus
tgcatccgcgtgcatggcacgcatg

SEQ ID NO: 512890 - DNA, 25 bp, Rattus norvegicus
ggtctgcgcttgcatccgcgtgcat

SEQ ID NO: 512891 - DNA, 25 bp, Rattus norvegicus
taccagcggtctgcgcttgcatccg

SEQ ID NO: 512892 - DNA, 25 bp, Rattus norvegicus
aggctctggcgcctaccagcggtct

SEQ ID NO: 512893 - DNA, 25 bp, Rattus norvegicus
acccagaggagtggcgcccaaggct

SEQ ID NO: 512894 - DNA, 25 bp, Rattus norvegicus
agaaaacccagaggagtggcgccca

SEQ ID NO: 512895 - DNA, 25 bp, Rattus norvegicus
ttggcactgaaagaaaacccagagg

SEQ ID NO: 512896 - DNA, 25 bp, Rattus norvegicus
cttgattggcactgaaagaaaaccc

SEQ ID NO: 512897 - DNA, 25 bp, Rattus norvegicus
ctcccacttgattggcactgaaaga

SEQ ID NO: 512898 - DNA, 25 bp, Rattus norvegicus
aggcttctggggcttgtggtctccg

SEQ ID NO: 512899 - DNA, 25 bp, Rattus norvegicus
cctccaaggcgatggcgcagaggct

SEQ ID NO: 512900 - DNA, 25 bp, Rattus norvegicus
ggcccataggtagggagaccactcc

SEQ ID NO: 512901 - DNA, 25 bp, Rattus norvegicus
gaagacgcgggcctcaaaaagtgta

SEQ ID NO: 512902 - DNA, 25 bp, Rattus norvegicus
gcgtggctcctcaccagattacttc

SEQ ID NO: 512903 - DNA, 25 bp, Rattus norvegicus
agattacttcgctcgccagctgtgg

SEQ ID NO: 512904 - DNA, 25 bp, Rattus norvegicus
cagctgtggagcgttcatgattttt

SEQ ID NO: 512905 - DNA, 25 bp, Rattus norvegicus
cgaaaaactcgggagactgaggctc

SEQ ID NO: 512906 - DNA, 25 bp, Rattus norvegicus
actgaggctccacctgcagagacgc

SEQ ID NO: 512907 - DNA, 25 bp, Rattus norvegicus
tgcagagacgcaaatcctaaaggcc

SEQ ID NO: 512908 - DNA, 25 bp, Rattus norvegicus
tcttcgcgactactgaaggtgccgc

SEQ ID NO: 512909 - DNA, 25 bp, Rattus norvegicus
tggaaaagcccgagccgcgttatcg

SEQ ID NO: 512910 - DNA, 25 bp, Rattus norvegicus
gtgtaaaatctccaggtaccgcctg

SEQ ID NO: 512911 - DNA, 25 bp, Rattus norvegicus
cgccagccgctagcctagacgagag

SEQ ID NO: 512912 - DNA, 25 bp, Rattus norvegicus
gaacctcgtgttcgcctgtgcgtga

SEQ ID NO: 512913 - DNA, 25 bp, Rattus norvegicus
tccggctcggcaagcttccttgctg

SEQ ID NO: 512914 - DNA, 25 bp, Rattus norvegicus
gcctctgaggagcaacggaactcca

SEQ ID NO: 512915 - DNA, 25 bp, Rattus norvegicus
tgttttcttccaccacagtgtcctc

SEQ ID NO: 512916 - DNA, 25 bp, Rattus norvegicus
ccagagccgggaagtgtaagagacc

SEQ ID NO: 512917 - DNA, 25 bp, Rattus norvegicus
tgatccgaccgtttggaagacgttc

SEQ ID NO: 512918 - DNA, 25 bp, Rattus norvegicus
ggaaggtaacaccaccgacagcact

SEQ ID NO: 512919 - DNA, 25 bp, Rattus norvegicus
cagacctaggaagtgcaaccgctga

SEQ ID NO: 512920 - DNA, 25 bp, Rattus norvegicus
gcgccgatccgcctattcctaaaaa

SEQ ID NO: 512921 - DNA, 25 bp, Rattus norvegicus
tatcgccagcgtctcatccagcttg

SEQ ID NO: 512922 - DNA, 25 bp, Rattus norvegicus
agaaggtggcaacgccctctcaaca

SEQ ID NO: 512923 - DNA, 25 bp, Rattus norvegicus
tgccgtatttccgatgacacattcg

SEQ ID NO: 512924 - DNA, 25 bp, Rattus norvegicus
acgtgcaaagaggatgccgtatttc

SEQ ID NO: 512925 - DNA, 25 bp, Rattus norvegicus
acacacgcgtttacatgcacacaga

SEQ ID NO: 512926 - DNA, 25 bp, Rattus norvegicus
tccagcttgatgaccaccgagatgg

SEQ ID NO: 512927 - DNA, 25 bp, Rattus norvegicus
ggaccggttccgactcctgatccga

SEQ ID NO: 512928 - DNA, 25 bp, Rattus norvegicus
agcggcgtccacagtgagcagctcc

SEQ ID NO: 512929 - DNA, 25 bp, Rattus norvegicus
cgcgggtgttcatggaactggttcc

SEQ ID NO: 512930 - DNA, 25 bp, Rattus norvegicus
tcggccgtagaagcgcagcccgtcg

SEQ ID NO: 512931 - DNA, 25 bp, Rattus norvegicus
agatctcggccgtagaagcgcagcc

SEQ ID NO: 512932 - DNA, 25 bp, Rattus norvegicus
aaaaccaccagatctcggccgtaga

SEQ ID NO: 512933 - DNA, 25 bp, Rattus norvegicus
gccgggaaaaccaccagatctcggc

SEQ ID NO: 512934 - DNA, 25 bp, Rattus norvegicus
atggaactggttccctgggctgacc

SEQ ID NO: 512935 - DNA, 25 bp, Rattus norvegicus
ctgcatcgcgggtgttcatggaact

SEQ ID NO: 512936 - DNA, 25 bp, Rattus norvegicus
ccagctatgtcgctgcaacccgccc

SEQ ID NO: 512937 - DNA, 25 bp, Rattus norvegicus
agttgctatggcaacgcagttgccc

SEQ ID NO: 512938 - DNA, 25 bp, Rattus norvegicus
ccgtcgacccggagttgctatggca

SEQ ID NO: 512939 - DNA, 25 bp, Rattus norvegicus
aagcgcggtagccaaacgtcactcc

SEQ ID NO: 512940 - DNA, 25 bp, Rattus norvegicus
gcatcctccgcgctgaacaagcaag

SEQ ID NO: 512941 - DNA, 25 bp, Rattus norvegicus
ctgaacaagcaagcgcggtagccaa

SEQ ID NO: 512942 - DNA, 25 bp, Rattus norvegicus
cgagcgaggtcagcaacaggcatct

SEQ ID NO: 512943 - DNA, 25 bp, Rattus norvegicus
cgcctggctcctctgaatgctttca

SEQ ID NO: 512944 - DNA, 25 bp, Rattus norvegicus
ccgggagactcctctcattgctttc

SEQ ID NO: 512945 - DNA, 25 bp, Rattus norvegicus
ccaccctgagaacaacctgagtttg

SEQ ID NO: 512946 - DNA, 25 bp, Rattus norvegicus
ctgcgactggcaagagatggaaacc

SEQ ID NO: 512947 - DNA, 25 bp, Rattus norvegicus
gtccctggagggaaagtaacactca

SEQ ID NO: 512948 - DNA, 25 bp, Rattus norvegicus
cctgagttattaggcgcatcgctgc

SEQ ID NO: 512949 - DNA, 25 bp, Rattus norvegicus
gggacttacctttctcttcggcata

SEQ ID NO: 512950 - DNA, 25 bp, Rattus norvegicus
tcggcataatgactacgttggtaca

SEQ ID NO: 512951 - DNA, 25 bp, Rattus norvegicus
gctactcctgcaatgggctcggcta

SEQ ID NO: 512952 - DNA, 25 bp, Rattus norvegicus
cccattggctaagagaacgttctaa

SEQ ID NO: 512953 - DNA, 25 bp, Rattus norvegicus
gttctaaattccacgagggcacgcc

SEQ ID NO: 512954 - DNA, 25 bp, Rattus norvegicus
gctggcgtaaggaaacatggctttc

SEQ ID NO: 512955 - DNA, 25 bp, Rattus norvegicus
agcgcaggggacttactccgagcac

SEQ ID NO: 512956 - DNA, 25 bp, Rattus norvegicus
accacgacccgcgaggactgttgct

SEQ ID NO: 512957 - DNA, 25 bp, Rattus norvegicus
tcagccattggtccgcagctgaggc

SEQ ID NO: 512958 - DNA, 25 bp, Rattus norvegicus
agacctagagtacccggacgctgca

SEQ ID NO: 512959 - DNA, 25 bp, Rattus norvegicus
gcggctgcggggagtttaaactcac

SEQ ID NO: 512960 - DNA, 25 bp, Rattus norvegicus
tcactcactgtagggaccacggctg

SEQ ID NO: 512961 - DNA, 25 bp, Rattus norvegicus
ccgagttcccattggttactaactg

SEQ ID NO: 512962 - DNA, 25 bp, Rattus norvegicus
ggttactaactgcatacggccattt

SEQ ID NO: 512963 - DNA, 25 bp, Rattus norvegicus
tctattggttactgtggcatcggaa

SEQ ID NO: 512964 - DNA, 25 bp, Rattus norvegicus
ggcgagacgagaggcatcagccatt

SEQ ID NO: 512965 - DNA, 25 bp, Rattus norvegicus
tccttctggaagagggacgccgact

SEQ ID NO: 512966 - DNA, 25 bp, Rattus norvegicus
agaatgccaatccttctggaagagg

SEQ ID NO: 512967 - DNA, 25 bp, Rattus norvegicus
cccggactgaacgaaagaatgccaa

SEQ ID NO: 512968 - DNA, 25 bp, Rattus norvegicus
tgcacctgcccggatcatgggccga

SEQ ID NO: 512969 - DNA, 25 bp, Rattus norvegicus
cgaggactgttgcttcgcggagccc

SEQ ID NO: 512970 - DNA, 25 bp, Rattus norvegicus
cacctgcgtgtacgattaatttacc

SEQ ID NO: 512971 - DNA, 25 bp, Rattus norvegicus
tcatgctcaggcttcgtggcggtga

SEQ ID NO: 512972 - DNA, 25 bp, Rattus norvegicus
gtaagctggcttcccgccacatagc

SEQ ID NO: 512973 - DNA, 25 bp, Rattus norvegicus
ccggttgacgcgctggggtcacact

SEQ ID NO: 512974 - DNA, 25 bp, Rattus norvegicus
gtccttcctaaaccacctgcgtgta

SEQ ID NO: 512975 - DNA, 25 bp, Rattus norvegicus
cgtgttcgtcgcctcatgctcaggc

SEQ ID NO: 512976 - DNA, 25 bp, Rattus norvegicus
cgatccctgacgcagcgagaggatg

SEQ ID NO: 512977 - DNA, 25 bp, Rattus norvegicus
tgtccgtgtcaacaacgatccctga

SEQ ID NO: 512978 - DNA, 25 bp, Rattus norvegicus
agcagcctcagtcgcgttcagcttc

SEQ ID NO: 512979 - DNA, 25 bp, Rattus norvegicus
tctgcggtctttcccgacggtcgct

SEQ ID NO: 512980 - DNA, 25 bp, Rattus norvegicus
gcgttcagcttctgtgtccgtgtca

SEQ ID NO: 512981 - DNA, 25 bp, Rattus norvegicus
ctggtcactctaggcgccacggaaa

SEQ ID NO: 512982 - DNA, 25 bp, Rattus norvegicus
ctaggcgccacggaaactacaactc

SEQ ID NO: 512983 - DNA, 25 bp, Rattus norvegicus
gccagacgtgtctctgcggtctttc

SEQ ID NO: 512984 - DNA, 25 bp, Rattus norvegicus
caacccaaggagcagcgagaggaga

SEQ ID NO: 512985 - DNA, 25 bp, Rattus norvegicus
agtgcacagatgctctgcggggacc

SEQ ID NO: 512986 - DNA, 25 bp, Rattus norvegicus
cctcgactgtacctgcaatggacca

SEQ ID NO: 512987 - DNA, 25 bp, Rattus norvegicus
ccaggtccagcggtagaactccacg

SEQ ID NO: 512988 - DNA, 25 bp, Rattus norvegicus
gaactccacggtgtcgttgaacgcc

SEQ ID NO: 512989 - DNA, 25 bp, Rattus norvegicus
tcgttgaacgccgtggacactgcgt

SEQ ID NO: 512990 - DNA, 25 bp, Rattus norvegicus
gaccctgatggcagcggcgactcct

SEQ ID NO: 512991 - DNA, 25 bp, Rattus norvegicus
cgagcagcggagacaagaagcccga

SEQ ID NO: 512992 - DNA, 25 bp, Rattus norvegicus
gcgcgctaaagccagccctgggcta

SEQ ID NO: 512993 - DNA, 25 bp, Rattus norvegicus
ctgggctaccacctgagccaaagga

SEQ ID NO: 512994 - DNA, 25 bp, Rattus norvegicus
ggttacctctgctccaccggatgca

SEQ ID NO: 512995 - DNA, 25 bp, Rattus norvegicus
ccaccggatgcaacgtgggaaaccg

SEQ ID NO: 512996 - DNA, 25 bp, Rattus norvegicus
acactgcgttcaggacgctgccggg

SEQ ID NO: 512997 - DNA, 25 bp, Rattus norvegicus
cgctcgcatccgattaaccagtgca

SEQ ID NO: 512998 - DNA, 25 bp, Rattus norvegicus
gatctgtgcaccactccagagccgg

SEQ ID NO: 512999 - DNA, 25 bp, Rattus norvegicus
tccgtagatctgtgcaccactccag

SEQ ID NO: 513000 - DNA, 25 bp, Rattus norvegicus
ggggcgattagcaccgataccctat

SEQ ID NO: 513001 - DNA, 25 bp, Rattus norvegicus
ttagcaccgataccctatgcaagga

SEQ ID NO: 513002 - DNA, 25 bp, Rattus norvegicus
ccgataccctatgcaaggagggctg

SEQ ID NO: 513003 - DNA, 25 bp, Rattus norvegicus
ccctatgcaaggagggctgtgcgca

SEQ ID NO: 513004 - DNA, 25 bp, Rattus norvegicus
tgcgcagagcggagccacgcgacgc

SEQ ID NO: 513005 - DNA, 25 bp, Rattus norvegicus
cacgcgacgcagtgcccaccacgca

SEQ ID NO: 513006 - DNA, 25 bp, Rattus norvegicus
gtagatctgtgcaccactccagagc

SEQ ID NO: 513007 - DNA, 25 bp, Rattus norvegicus
tgcaccactccagagccggtcgttt

SEQ ID NO: 513008 - DNA, 25 bp, Rattus norvegicus
tcgaatccccgcctacagctgaagg

SEQ ID NO: 513009 - DNA, 25 bp, Rattus norvegicus
agctgaagggacctgcggtctgagg

SEQ ID NO: 513010 - DNA, 25 bp, Rattus norvegicus
tctgagggctgtgacgctgccccct

SEQ ID NO: 513011 - DNA, 25 bp, Rattus norvegicus
ccaccacgcagggacgcgtcacagc

SEQ ID NO: 513012 - DNA, 25 bp, Rattus norvegicus
taattcccaaggacgctggaagtgg

SEQ ID NO: 513013 - DNA, 25 bp, Rattus norvegicus
cctggatttctgaggtgggtacagc

SEQ ID NO: 513014 - DNA, 25 bp, Rattus norvegicus
atgcggtaccgctgttttgtctgca

SEQ ID NO: 513015 - DNA, 25 bp, Rattus norvegicus
tgacgagccgtaaccaatgggaggt

SEQ ID NO: 513016 - DNA, 25 bp, Rattus norvegicus
gccacgtgacgagccgtaaccaatg

SEQ ID NO: 513017 - DNA, 25 bp, Rattus norvegicus
aggacccgcgctgccacgtgacgag

SEQ ID NO: 513018 - DNA, 25 bp, Rattus norvegicus
aaggagccaatcaggacccgcgctg

SEQ ID NO: 513019 - DNA, 25 bp, Rattus norvegicus
gcgagctaaaagactagcccactca

SEQ ID NO: 513020 - DNA, 25 bp, Rattus norvegicus
gcggcgcaaggagccaatcaggacc

SEQ ID NO: 513021 - DNA, 25 bp, Rattus norvegicus
gtcggtaattcccaaggacgctgga

SEQ ID NO: 513022 - DNA, 25 bp, Rattus norvegicus
agcaggcgtcggtaattcccaagga

SEQ ID NO: 513023 - DNA, 25 bp, Rattus norvegicus
gcccactcagcaggcgtcggtaatt

SEQ ID NO: 513024 - DNA, 25 bp, Rattus norvegicus
ctgttttgtctgcagcctggatttc

SEQ ID NO: 513025 - DNA, 25 bp, Rattus norvegicus
gccagccgggcgagctaaaagacta

SEQ ID NO: 513026 - DNA, 25 bp, Rattus norvegicus
ggcttcttgcaacccgctgtcgatg

SEQ ID NO: 513027 - DNA, 25 bp, Rattus norvegicus
cgctgtcgatgacgcgtcccagaag

SEQ ID NO: 513028 - DNA, 25 bp, Rattus norvegicus
gtgcaaggcttcttgcaacccgctg

SEQ ID NO: 513029 - DNA, 25 bp, Rattus norvegicus
cgccggccgccaggtcctagcgtct

SEQ ID NO: 513030 - DNA, 25 bp, Rattus norvegicus
tgtcgatgacgcgtcccagaagcgg

SEQ ID NO: 513031 - DNA, 25 bp, Rattus norvegicus
tgcaacccgctgtcgatgacgcgtc

SEQ ID NO: 513032 - DNA, 25 bp, Rattus norvegicus
tcttgcaacccgctgtcgatgacgc

SEQ ID NO: 513033 - DNA, 25 bp, Rattus norvegicus
aaggcttcttgcaacccgctgtcga

SEQ ID NO: 513034 - DNA, 25 bp, Rattus norvegicus
cggtgcctgagaacccgggatggcg

SEQ ID NO: 513035 - DNA, 25 bp, Rattus norvegicus
cacccaatgaggaggccgcgtctca

SEQ ID NO: 513036 - DNA, 25 bp, Rattus norvegicus
cacctccgattggtctttttcacgg

SEQ ID NO: 513037 - DNA, 25 bp, Rattus norvegicus
ttccacctccgattggtctttttca

SEQ ID NO: 513038 - DNA, 25 bp, Rattus norvegicus
cgccaggtcctagcgtctccgtccc

SEQ ID NO: 513039 - DNA, 25 bp, Rattus norvegicus
tcgatgacgcgtcccagaagcggcg

SEQ ID NO: 513040 - DNA, 25 bp, Rattus norvegicus
cgagcgcactcgcagttcctgcgaa

SEQ ID NO: 513041 - DNA, 25 bp, Rattus norvegicus
tcagagatacttttggtgcggggct

SEQ ID NO: 513042 - DNA, 25 bp, Rattus norvegicus
tccagatgcatcagagatacttttg

SEQ ID NO: 513043 - DNA, 25 bp, Rattus norvegicus
gtgctttccagatgcatcagagata

SEQ ID NO: 513044 - DNA, 25 bp, Rattus norvegicus
tcgcttgtgctttccagatgcatca

SEQ ID NO: 513045 - DNA, 25 bp, Rattus norvegicus
cagacgggactctcgcttgtgcttt

SEQ ID NO: 513046 - DNA, 25 bp, Rattus norvegicus
ccgcctccaggtgacacagacggga

SEQ ID NO: 513047 - DNA, 25 bp, Rattus norvegicus
ctcgcctgcgctcctagaaggggcg

SEQ ID NO: 513048 - DNA, 25 bp, Rattus norvegicus
agttcctgcgaagtgtgtccgcctc

SEQ ID NO: 513049 - DNA, 25 bp, Rattus norvegicus
cgcagagaagtctcgggccgctgcc

SEQ ID NO: 513050 - DNA, 25 bp, Rattus norvegicus
gatacttttggtgcggggctgctct

SEQ ID NO: 513051 - DNA, 25 bp, Rattus norvegicus
gggactctcgcttgtgctttccaga

SEQ ID NO: 513052 - DNA, 25 bp, Rattus norvegicus
aagtgtgtccgcctcgcggttcctc

SEQ ID NO: 513053 - DNA, 25 bp, Rattus norvegicus
caggtgacacagacgggactctcgc

SEQ ID NO: 513054 - DNA, 25 bp, Rattus norvegicus
gccgaagtcaccacccagagggatg

SEQ ID NO: 513055 - DNA, 25 bp, Rattus norvegicus
ctcctacgtgtagatctgtccattt

SEQ ID NO: 513056 - DNA, 25 bp, Rattus norvegicus
gcctcaaatgtgatagatgtccatc

SEQ ID NO: 513057 - DNA, 25 bp, Rattus norvegicus
gacagatgcctgtggctcctacgtg

SEQ ID NO: 513058 - DNA, 25 bp, Rattus norvegicus
ctggctaatgtgcacagacagatgc

SEQ ID NO: 513059 - DNA, 25 bp, Rattus norvegicus
accctctcatttgcatagagcaccg

SEQ ID NO: 513060 - DNA, 25 bp, Rattus norvegicus
gcacactcgcgtctctggagcttta

SEQ ID NO: 513061 - DNA, 25 bp, Rattus norvegicus
gccacttggccttggtcagtcctaa

SEQ ID NO: 513062 - DNA, 25 bp, Rattus norvegicus
tctcagccatgtagtgcccgccgaa

SEQ ID NO: 513063 - DNA, 25 bp, Rattus norvegicus
tcagctcgtcctctgccatggcaaa

SEQ ID NO: 513064 - DNA, 25 bp, Rattus norvegicus
tggggctttcgcaatagtccgagca

SEQ ID NO: 513065 - DNA, 25 bp, Rattus norvegicus
atctgtccatttctgcacgtccgca

SEQ ID NO: 513066 - DNA, 25 bp, Rattus norvegicus
aggagacactttgcctcaaatgtga

SEQ ID NO: 513067 - DNA, 25 bp, Rattus norvegicus
tggcaaagtacccttcgctctcagc

SEQ ID NO: 513068 - DNA, 25 bp, Rattus norvegicus
ccgcgcagggactcatccttagtga

SEQ ID NO: 513069 - DNA, 25 bp, Rattus norvegicus
gcagcgaaagcgacagccgcgacta

SEQ ID NO: 513070 - DNA, 25 bp, Rattus norvegicus
cagctcggcgacgtagcacttcgcg

SEQ ID NO: 513071 - DNA, 25 bp, Rattus norvegicus
acttcgcgggacaaggccattcatt

SEQ ID NO: 513072 - DNA, 25 bp, Rattus norvegicus
gcgggacaaggccattcattagctg

SEQ ID NO: 513073 - DNA, 25 bp, Rattus norvegicus
gccattcattagctggcaggggccg

SEQ ID NO: 513074 - DNA, 25 bp, Rattus norvegicus
gaactagaaaagcaacgtcgctgga

SEQ ID NO: 513075 - DNA, 25 bp, Rattus norvegicus
ccagtcgctagatgaaggtgcgccg

SEQ ID NO: 513076 - DNA, 25 bp, Rattus norvegicus
tagaaaagcaacgtcgctggagggc

SEQ ID NO: 513077 - DNA, 25 bp, Rattus norvegicus
ctcatccttagtgaaagctaccggg

SEQ ID NO: 513078 - DNA, 25 bp, Rattus norvegicus
tagtgaaagctaccggggacaacga

SEQ ID NO: 513079 - DNA, 25 bp, Rattus norvegicus
ccgggatgcccgagtcagctccgga

SEQ ID NO: 513080 - DNA, 25 bp, Rattus norvegicus
acagccgcgactatcggcgccggga

SEQ ID NO: 513081 - DNA, 25 bp, Rattus norvegicus
cgccctcaccagtcgctagatgaag

SEQ ID NO: 513082 - DNA, 25 bp, Rattus norvegicus
ctggatgccgattgattccgtagcg

SEQ ID NO: 513083 - DNA, 25 bp, Rattus norvegicus
tcggttcccgggacctggatgccga

SEQ ID NO: 513084 - DNA, 25 bp, Rattus norvegicus
cgagtcggaatccttccggaataga

SEQ ID NO: 513085 - DNA, 25 bp, Rattus norvegicus
tccgtttatcgagtcggaatccttc

SEQ ID NO: 513086 - DNA, 25 bp, Rattus norvegicus
cgcggttcacttccgtttatcgagt

SEQ ID NO: 513087 - DNA, 25 bp, Rattus norvegicus
aagccacaccggaagagacggaggc

SEQ ID NO: 513088 - DNA, 25 bp, Rattus norvegicus
ccgcgcgaagccacaccggaagaga

SEQ ID NO: 513089 - DNA, 25 bp, Rattus norvegicus
ctactgtcgagaaaaagagaacggg

SEQ ID NO: 513090 - DNA, 25 bp, Rattus norvegicus
gcctgctactgtcgagaaaaagaga

SEQ ID NO: 513091 - DNA, 25 bp, Rattus norvegicus
gccggcctgctactgtcgagaaaaa

SEQ ID NO: 513092 - DNA, 25 bp, Rattus norvegicus
cagccggcctgctactgtcgagaaa

SEQ ID NO: 513093 - DNA, 25 bp, Rattus norvegicus
ccagcctcaccagaacccgcccagc

SEQ ID NO: 513094 - DNA, 25 bp, Rattus norvegicus
tgccaccgaggccacacccgggcct

SEQ ID NO: 513095 - DNA, 25 bp, Rattus norvegicus
cgggacctggatgccgattgattcc

SEQ ID NO: 513096 - DNA, 25 bp, Rattus norvegicus
tgagagaggcgccaacaaaggagtt

SEQ ID NO: 513097 - DNA, 25 bp, Rattus norvegicus
cgaggaaagtttgccgtcgacgctt

SEQ ID NO: 513098 - DNA, 25 bp, Rattus norvegicus
cagctttggcgtcccttccttggct

SEQ ID NO: 513099 - DNA, 25 bp, Rattus norvegicus
cggggttagccaagttccagctttg

SEQ ID NO: 513100 - DNA, 25 bp, Rattus norvegicus
gacccgccgtgcgtactcactggag

SEQ ID NO: 513101 - DNA, 25 bp, Rattus norvegicus
acaaaggagttgaggaggtgccacc

SEQ ID NO: 513102 - DNA, 25 bp, Rattus norvegicus
catccgatccttccctgagagaggc

SEQ ID NO: 513103 - DNA, 25 bp, Rattus norvegicus
acttggttaatactgggaagccgcg

SEQ ID NO: 513104 - DNA, 25 bp, Rattus norvegicus
cccggaagaggaaggcttagcgctc

SEQ ID NO: 513105 - DNA, 25 bp, Rattus norvegicus
agggcaatccggctagaagccaggc

SEQ ID NO: 513106 - DNA, 25 bp, Rattus norvegicus
tcgctcgcaacccaacctgggaggg

SEQ ID NO: 513107 - DNA, 25 bp, Rattus norvegicus
ccttggctcccacgcgaggaaagtt

SEQ ID NO: 513108 - DNA, 25 bp, Rattus norvegicus
aagaagggctcggaagagtccagta

SEQ ID NO: 513109 - DNA, 25 bp, Rattus norvegicus
cagtaacccgaaacttcgctcgcaa

SEQ ID NO: 513110 - DNA, 25 bp, Rattus norvegicus
agagtacgcactgccaaggcaccga

SEQ ID NO: 513111 - DNA, 25 bp, Rattus norvegicus
tagcagcgcgctctggagccgtctc

SEQ ID NO: 513112 - DNA, 25 bp, Rattus norvegicus
ccaccttttgggcagagtacgcact

SEQ ID NO: 513113 - DNA, 25 bp, Rattus norvegicus
ggagcgccaccttttgggcagagta

SEQ ID NO: 513114 - DNA, 25 bp, Rattus norvegicus
tctgtcggctggagcgccacctttt

SEQ ID NO: 513115 - DNA, 25 bp, Rattus norvegicus
cgtggcaagccgctggcttcctggc

SEQ ID NO: 513116 - DNA, 25 bp, Rattus norvegicus
cagttaccagaactgggactgggtg

SEQ ID NO: 513117 - DNA, 25 bp, Rattus norvegicus
ggaacacgcgtgtttccgcctcaac

SEQ ID NO: 513118 - DNA, 25 bp, Rattus norvegicus
gcacttccaggaacacgcgtgtttc

SEQ ID NO: 513119 - DNA, 25 bp, Rattus norvegicus
gtgcacgcgcctactgtccggttcg

SEQ ID NO: 513120 - DNA, 25 bp, Rattus norvegicus
tgtgccacgcacacgagcaccagtc

SEQ ID NO: 513121 - DNA, 25 bp, Rattus norvegicus
accagtctcctcgtctcgctcacgg

SEQ ID NO: 513122 - DNA, 25 bp, Rattus norvegicus
cccaggattagcagcgcgctctgga

SEQ ID NO: 513123 - DNA, 25 bp, Rattus norvegicus
ggaccgagcccgcagttaccagaac

SEQ ID NO: 513124 - DNA, 25 bp, Rattus norvegicus
agcccgtggcaggtaacagcgtccc

SEQ ID NO: 513125 - DNA, 25 bp, Rattus norvegicus
ccttttaggattgaggcgacgcgga

SEQ ID NO: 513126 - DNA, 25 bp, Rattus norvegicus
gccgtctccgcgatcgcccgcggga

SEQ ID NO: 513127 - DNA, 25 bp, Rattus norvegicus
accgaggccgccgacgtcgacgccg

SEQ ID NO: 513128 - DNA, 25 bp, Rattus norvegicus
ggtgcacgctggtagctgtcactag

SEQ ID NO: 513129 - DNA, 25 bp, Rattus norvegicus
tagctgtcactaggccctcggctgg

SEQ ID NO: 513130 - DNA, 25 bp, Rattus norvegicus
tgtcactaggccctcggctggcggc

SEQ ID NO: 513131 - DNA, 25 bp, Rattus norvegicus
cgcggttgccaagagagcggtgcca

SEQ ID NO: 513132 - DNA, 25 bp, Rattus norvegicus
cagagcccgtggcaggtaacagcgt

SEQ ID NO: 513133 - DNA, 25 bp, Rattus norvegicus
ccggcgcctttgttggaggcttcct

SEQ ID NO: 513134 - DNA, 25 bp, Rattus norvegicus
cgcctttgttggaggcttcctggca

SEQ ID NO: 513135 - DNA, 25 bp, Rattus norvegicus
gagccttcctcagggatggaaacgg

SEQ ID NO: 513136 - DNA, 25 bp, Rattus norvegicus
ctttgttggaggcttcctggcaccc

SEQ ID NO: 513137 - DNA, 25 bp, Rattus norvegicus
tgggtcccttttaggattgaggcga

SEQ ID NO: 513138 - DNA, 25 bp, Rattus norvegicus
gcgcagtgtgcacctaaccagctca

SEQ ID NO: 513139 - DNA, 25 bp, Rattus norvegicus
gcaagaacgttctctccaaaggcga

SEQ ID NO: 513140 - DNA, 25 bp, Rattus norvegicus
ctcacctagatctggagcaagaacg

SEQ ID NO: 513141 - DNA, 25 bp, Rattus norvegicus
acatcgtgaggacagcaggcacctg

SEQ ID NO: 513142 - DNA, 25 bp, Rattus norvegicus
aaccagctcactcagatctcgcaga

SEQ ID NO: 513143 - DNA, 25 bp, Rattus norvegicus
gcgccgagtagatcccgcagtcatc

SEQ ID NO: 513144 - DNA, 25 bp, Rattus norvegicus
ctctccaaaggcgagatgcggccgc

SEQ ID NO: 513145 - DNA, 25 bp, Rattus norvegicus
gttagctcccgggttggacagctgc

SEQ ID NO: 513146 - DNA, 25 bp, Rattus norvegicus
actgcttggcttgagtgagctgaaa

SEQ ID NO: 513147 - DNA, 25 bp, Rattus norvegicus
ccaatcgcggcgagttggtttctgt

SEQ ID NO: 513148 - DNA, 25 bp, Rattus norvegicus
actcagatctcgcagacgtggccga

SEQ ID NO: 513149 - DNA, 25 bp, Rattus norvegicus
cccgcactacatcgtgaggacagca

SEQ ID NO: 513150 - DNA, 25 bp, Rattus norvegicus
ggtctctaaagaacgggagcgttga

SEQ ID NO: 513151 - DNA, 25 bp, Rattus norvegicus
gggttggacagctgcgcctttcagc

SEQ ID NO: 513152 - DNA, 25 bp, Rattus norvegicus
ccctacagattaagatcggacccaa

SEQ ID NO: 513153 - DNA, 25 bp, Rattus norvegicus
ctccgcggcctccacacctgcggct

SEQ ID NO: 513154 - DNA, 25 bp, Rattus norvegicus
ccggaccggacagccgccgctctgt

SEQ ID NO: 513155 - DNA, 25 bp, Rattus norvegicus
cctcccggcggcgactccagcaggg

SEQ ID NO: 513156 - DNA, 25 bp, Rattus norvegicus
ctcctctcgcttgcctggctcctcg

SEQ ID NO: 513157 - DNA, 25 bp, Rattus norvegicus
agcgcccagccaagcgccgggttgc

SEQ ID NO: 513158 - DNA, 25 bp, Rattus norvegicus
caaagagcacctgaagaggagcagc

SEQ ID NO: 513159 - DNA, 25 bp, Rattus norvegicus
tcggaatgttcctccagagcttccc

SEQ ID NO: 513160 - DNA, 25 bp, Rattus norvegicus
cttcggaatgttcctccagagcttc

SEQ ID NO: 513161 - DNA, 25 bp, Rattus norvegicus
gcccgcttcggaatgttcctccaga

SEQ ID NO: 513162 - DNA, 25 bp, Rattus norvegicus
gacccaagcccgcttcggaatgttc

SEQ ID NO: 513163 - DNA, 25 bp, Rattus norvegicus
agatcggacccaagcccgcttcgga

SEQ ID NO: 513164 - DNA, 25 bp, Rattus norvegicus
gattaagatcggacccaagcccgct

SEQ ID NO: 513165 - DNA, 25 bp, Rattus norvegicus
cggctccgccgcaaagttcccgcga

SEQ ID NO: 513166 - DNA, 25 bp, Rattus norvegicus
caccctcagggaaaacgctcgattc

SEQ ID NO: 513167 - DNA, 25 bp, Rattus norvegicus
cgcccgcctgccaccctcagggaaa

SEQ ID NO: 513168 - DNA, 25 bp, Rattus norvegicus
ggaaaacgctcgattcccacactgg

SEQ ID NO: 513169 - DNA, 25 bp, Rattus norvegicus
aaaacgctcgattcccacactggtc

SEQ ID NO: 513170 - DNA, 25 bp, Rattus norvegicus
cacactggtccaccctgcccttccc

SEQ ID NO: 513171 - DNA, 25 bp, Rattus norvegicus
cctgcccttcccgggatgggagaag

SEQ ID NO: 513172 - DNA, 25 bp, Rattus norvegicus
ggcagacaaagaagtgcgggccaca

SEQ ID NO: 513173 - DNA, 25 bp, Rattus norvegicus
aagtgcgggccacaagttacatcgc

SEQ ID NO: 513174 - DNA, 25 bp, Rattus norvegicus
gcgggccacaagttacatcgcaacc

SEQ ID NO: 513175 - DNA, 25 bp, Rattus norvegicus
gccacaagttacatcgcaacccgtg

SEQ ID NO: 513176 - DNA, 25 bp, Rattus norvegicus
agttacatcgcaacccgtggtcccg

SEQ ID NO: 513177 - DNA, 25 bp, Rattus norvegicus
gcaacccgtggtcccgcatcgggat

SEQ ID NO: 513178 - DNA, 25 bp, Rattus norvegicus
aaggcacgtcgcggctgacctggcc

SEQ ID NO: 513179 - DNA, 25 bp, Rattus norvegicus
ccgtggtcccgcatcgggatgctga

SEQ ID NO: 513180 - DNA, 25 bp, Rattus norvegicus
ccgagcgtgcgacctgggcaccgac

SEQ ID NO: 513181 - DNA, 25 bp, Rattus norvegicus
cggcccgcgagaagcgctgagtcac

SEQ ID NO: 513182 - DNA, 25 bp, Rattus norvegicus
ccgcgagaagcgctgagtcacggcg

SEQ ID NO: 513183 - DNA, 25 bp, Rattus norvegicus
ctcggggatccatggccagctccgt

SEQ ID NO: 513184 - DNA, 25 bp, Rattus norvegicus
tcccgcgtcagcaggtagccgcgct

SEQ ID NO: 513185 - DNA, 25 bp, Rattus norvegicus
tagccgcgctggtgggcgtgtcggc

SEQ ID NO: 513186 - DNA, 25 bp, Rattus norvegicus
ggccggcgcccgtgcgacggaaggc

SEQ ID NO: 513187 - DNA, 25 bp, Rattus norvegicus
ggctcggggatccatggccagctcc

SEQ ID NO: 513188 - DNA, 25 bp, Rattus norvegicus
tgcgacctgggcaccgacgggtgag

SEQ ID NO: 513189 - DNA, 25 bp, Rattus norvegicus
cgccggccaagctggtgagcgccga

SEQ ID NO: 513190 - DNA, 25 bp, Rattus norvegicus
ccaagctggtgagcgccgagcgtgc

SEQ ID NO: 513191 - DNA, 25 bp, Rattus norvegicus
tcacggcggcatcggccgagccgcc

SEQ ID NO: 513192 - DNA, 25 bp, Rattus norvegicus
atccatggccagctccgtggcgggg

SEQ ID NO: 513193 - DNA, 25 bp, Rattus norvegicus
cgggccgcctcgcttcctccgctcg

SEQ ID NO: 513194 - DNA, 25 bp, Rattus norvegicus
tttaaacgcgaggagggctgcacgc

SEQ ID NO: 513195 - DNA, 25 bp, Rattus norvegicus
cacccttctcggctaggatttgaga

SEQ ID NO: 513196 - DNA, 25 bp, Rattus norvegicus
cctcggagccgtggctttaaacgcg

SEQ ID NO: 513197 - DNA, 25 bp, Rattus norvegicus
tcaggtgacggcagccgacgaaccc

SEQ ID NO: 513198 - DNA, 25 bp, Rattus norvegicus
gcgccctgggattatccctcgaatc

SEQ ID NO: 513199 - DNA, 25 bp, Rattus norvegicus
gaggggacccatacggcccagcgta

SEQ ID NO: 513200 - DNA, 25 bp, Rattus norvegicus
cgctagcgtgccacggagctgtcac

SEQ ID NO: 513201 - DNA, 25 bp, Rattus norvegicus
cagagctgcagcgtgtctcccacgg

SEQ ID NO: 513202 - DNA, 25 bp, Rattus norvegicus
gcacacctttcgctgtccagagctg

SEQ ID NO: 513203 - DNA, 25 bp, Rattus norvegicus
gccggccgcaggatagtccttgcat

SEQ ID NO: 513204 - DNA, 25 bp, Rattus norvegicus
agcccagttggtctatcgcggtcca

SEQ ID NO: 513205 - DNA, 25 bp, Rattus norvegicus
cagcgacgcgccaagcccagttggt

SEQ ID NO: 513206 - DNA, 25 bp, Rattus norvegicus
tggcaccgcctctagggaccagcga

SEQ ID NO: 513207 - DNA, 25 bp, Rattus norvegicus
tagtccttgcatcgtgccacggtcc

SEQ ID NO: 513208 - DNA, 25 bp, Rattus norvegicus
ctgttctaggctaatctgggcgcgc

SEQ ID NO: 513209 - DNA, 25 bp, Rattus norvegicus
cctactgacccgttgtcctgttcta

SEQ ID NO: 513210 - DNA, 25 bp, Rattus norvegicus
gcagtcctattgacccgttgtcctg

SEQ ID NO: 513211 - DNA, 25 bp, Rattus norvegicus
tctaggctaatctgggcgcgcttct

SEQ ID NO: 513212 - DNA, 25 bp, Rattus norvegicus
tgacccgttgtcctgttctaggcta

SEQ ID NO: 513213 - DNA, 25 bp, Rattus norvegicus
actgacccgttgtcctgttctaggc

SEQ ID NO: 513214 - DNA, 25 bp, Rattus norvegicus
cctgttctaggctaatctgggcgcg

SEQ ID NO: 513215 - DNA, 25 bp, Rattus norvegicus
gcagtcctactgacccgttgtcctg

SEQ ID NO: 513216 - DNA, 25 bp, Rattus norvegicus
gttctaggctaatctgggcgcgctt

SEQ ID NO: 513217 - DNA, 25 bp, Rattus norvegicus
ttctaggctaatctgggcgcgcttc

SEQ ID NO: 513218 - DNA, 25 bp, Rattus norvegicus
attgacccgttgtcctgttctaggc

SEQ ID NO: 513219 - DNA, 25 bp, Rattus norvegicus
gacccgttgtcctgttctaggctaa

SEQ ID NO: 513220 - DNA, 25 bp, Rattus norvegicus
tccctgcagtcctattgacccgttg

SEQ ID NO: 513221 - DNA, 25 bp, Rattus norvegicus
tactgacccgttgtcctgttctagg

SEQ ID NO: 513222 - DNA, 25 bp, Rattus norvegicus
ctcacgttctttgtgcgcggcttgc

SEQ ID NO: 513223 - DNA, 25 bp, Rattus norvegicus
aactcctggcgagaaagaggagctg

SEQ ID NO: 513224 - DNA, 25 bp, Rattus norvegicus
tctggagaccgtgggttagaactcc

SEQ ID NO: 513225 - DNA, 25 bp, Rattus norvegicus
ggcttgcgcttgctatcctgcaggt

SEQ ID NO: 513226 - DNA, 25 bp, Rattus norvegicus
tgccctagctaagttcgagttgagt

SEQ ID NO: 513227 - DNA, 25 bp, Rattus norvegicus
gtgcccagtgccctagctaagttcg

SEQ ID NO: 513228 - DNA, 25 bp, Rattus norvegicus
gagagcgcgcacagcccagcacgtt

SEQ ID NO: 513229 - DNA, 25 bp, Rattus norvegicus
ataccacggagagcgccgagagcgc

SEQ ID NO: 513230 - DNA, 25 bp, Rattus norvegicus
gtcgtccggccatggataccacgga

SEQ ID NO: 513231 - DNA, 25 bp, Rattus norvegicus
taaagccgagctgcgacgctgaagc

SEQ ID NO: 513232 - DNA, 25 bp, Rattus norvegicus
tgcgaaggtctgcaagggctagata

SEQ ID NO: 513233 - DNA, 25 bp, Rattus norvegicus
ccgggtacctatcagcctggatcca

SEQ ID NO: 513234 - DNA, 25 bp, Rattus norvegicus
ctatcctgcaggtccgagggcttct

SEQ ID NO: 513235 - DNA, 25 bp, Rattus norvegicus
ctgccgttttgtttatgcggagcga

SEQ ID NO: 513236 - DNA, 25 bp, Rattus norvegicus
agcaaggtaagtggcgacggccgtt

SEQ ID NO: 513237 - DNA, 25 bp, Rattus norvegicus
ttggcctcggccaggccaaggagcc

SEQ ID NO: 513238 - DNA, 25 bp, Rattus norvegicus
ccaaggagccggcacagatagtggt

SEQ ID NO: 513239 - DNA, 25 bp, Rattus norvegicus
tggccgctggagtccggccaaccga

SEQ ID NO: 513240 - DNA, 25 bp, Rattus norvegicus
tggagtccggccaaccgagcctgtc

SEQ ID NO: 513241 - DNA, 25 bp, Rattus norvegicus
ccaaccgagcctgtccggtggcgga

SEQ ID NO: 513242 - DNA, 25 bp, Rattus norvegicus
gggcccaggatgctgaacgtccctt

SEQ ID NO: 513243 - DNA, 25 bp, Rattus norvegicus
aggatgctgaacgtcccttcccagg

SEQ ID NO: 513244 - DNA, 25 bp, Rattus norvegicus
tgctgaacgtcccttcccaggcttt

SEQ ID NO: 513245 - DNA, 25 bp, Rattus norvegicus
ctcccaggggcgtagcaaggtaagt

SEQ ID NO: 513246 - DNA, 25 bp, Rattus norvegicus
cccgtctcccgtgagcgtgattgcg

SEQ ID NO: 513247 - DNA, 25 bp, Rattus norvegicus
tcccgtgagcgtgattgcgtcacca

SEQ ID NO: 513248 - DNA, 25 bp, Rattus norvegicus
cgtgattgcgtcaccacgctcctga

SEQ ID NO: 513249 - DNA, 25 bp, Rattus norvegicus
cagcgcgttgcctcccaggggcgta

SEQ ID NO: 513250 - DNA, 25 bp, Rattus norvegicus
cgcagtcgcgccctttttcgggtgg

SEQ ID NO: 513251 - DNA, 25 bp, Rattus norvegicus
ggtactggtcgtgacgtcacttcca

SEQ ID NO: 513252 - DNA, 25 bp, Rattus norvegicus
ccacgttggagctctccaggctaga

SEQ ID NO: 513253 - DNA, 25 bp, Rattus norvegicus
aggtctcagagctcgcagaaaaggg

SEQ ID NO: 513254 - DNA, 25 bp, Rattus norvegicus
ggacaaacgccgagaaggtctcaga

SEQ ID NO: 513255 - DNA, 25 bp, Rattus norvegicus
tgtggagagccctcggacaaacgcc

SEQ ID NO: 513256 - DNA, 25 bp, Rattus norvegicus
tcctcaccgagctgtgtggagagcc

SEQ ID NO: 513257 - DNA, 25 bp, Rattus norvegicus
tcgggccgccgcacctggaaaggct

SEQ ID NO: 513258 - DNA, 25 bp, Rattus norvegicus
atttccgccttggagttctcggcca

SEQ ID NO: 513259 - DNA, 25 bp, Rattus norvegicus
tgagactagaaaagagccgagaggt

SEQ ID NO: 513260 - DNA, 25 bp, Rattus norvegicus
gtcgaggtcagaagcgagaccttga

SEQ ID NO: 513261 - DNA, 25 bp, Rattus norvegicus
cccggtggagatgcagctgacaaaa

SEQ ID NO: 513262 - DNA, 25 bp, Rattus norvegicus
tcaccgaatcctcaccgagctgtgt

SEQ ID NO: 513263 - DNA, 25 bp, Rattus norvegicus
tgacgtcacttccatttccgccttg

SEQ ID NO: 513264 - DNA, 25 bp, Rattus norvegicus
agcttcgaagtgacgctgctgcgcc

SEQ ID NO: 513265 - DNA, 25 bp, Rattus norvegicus
tacggccgccatgctgctgccctga

SEQ ID NO: 513266 - DNA, 25 bp, Rattus norvegicus
ctgctgccctgagccaggctctgca

SEQ ID NO: 513267 - DNA, 25 bp, Rattus norvegicus
aggctctgcaactggaggccccaga

SEQ ID NO: 513268 - DNA, 25 bp, Rattus norvegicus
ccagagatatctgtgcaagtgaacc

SEQ ID NO: 513269 - DNA, 25 bp, Rattus norvegicus
gatatctgtgcaagtgaaccggtcc

SEQ ID NO: 513270 - DNA, 25 bp, Rattus norvegicus
tctgtgcaagtgaaccggtccaagc

SEQ ID NO: 513271 - DNA, 25 bp, Rattus norvegicus
caagtgaaccggtccaagccgcgga

SEQ ID NO: 513272 - DNA, 25 bp, Rattus norvegicus
gtacgagctgacgtgtctacggccg

SEQ ID NO: 513273 - DNA, 25 bp, Rattus norvegicus
agtcggcggacaagcgcgagaaact

SEQ ID NO: 513274 - DNA, 25 bp, Rattus norvegicus
tgtgcaagtgaaccggtccaagccg

SEQ ID NO: 513275 - DNA, 25 bp, Rattus norvegicus
cgcctatcgagtcggcggacaagcg

SEQ ID NO: 513276 - DNA, 25 bp, Rattus norvegicus
ccgcgcctatcgagtcggcggacaa

SEQ ID NO: 513277 - DNA, 25 bp, Rattus norvegicus
ctgacgtgtctacggccgccatgct

SEQ ID NO: 513278 - DNA, 25 bp, Rattus norvegicus
agcgcactatttcggggctcagatc

SEQ ID NO: 513279 - DNA, 25 bp, Rattus norvegicus
ccgatcagtgcctccaccgagaagg

SEQ ID NO: 513280 - DNA, 25 bp, Rattus norvegicus
ggaagcacagctccgttcggcgtcc

SEQ ID NO: 513281 - DNA, 25 bp, Rattus norvegicus
aaggcatgcgccttgaggcttagca

SEQ ID NO: 513282 - DNA, 25 bp, Rattus norvegicus
catctgatgcggtttccgcgcttta

SEQ ID NO: 513283 - DNA, 25 bp, Rattus norvegicus
cgcacccagcttcggggcatctgat

SEQ ID NO: 513284 - DNA, 25 bp, Rattus norvegicus
cagcgctccgcattccggagggcaa

SEQ ID NO: 513285 - DNA, 25 bp, Rattus norvegicus
gatacagagtgagaaaagccagccc

SEQ ID NO: 513286 - DNA, 25 bp, Rattus norvegicus
gttgctgcttttcggcgccgatcag

SEQ ID NO: 513287 - DNA, 25 bp, Rattus norvegicus
cctgaagcgaggcaccttctggaaa

SEQ ID NO: 513288 - DNA, 25 bp, Rattus norvegicus
cctgcgcagcaaacgctacggaatc

SEQ ID NO: 513289 - DNA, 25 bp, Rattus norvegicus
aagtccgcatgtcgcagagccaggt

SEQ ID NO: 513290 - DNA, 25 bp, Rattus norvegicus
tctagggtcccaccaagtccgcatg

SEQ ID NO: 513291 - DNA, 25 bp, Rattus norvegicus
ggcctcgccgcacaacggatacaga

SEQ ID NO: 513292 - DNA, 25 bp, Rattus norvegicus
cgcaatgtggcctccgtggctatag

SEQ ID NO: 513293 - DNA, 25 bp, Rattus norvegicus
gtggtcctgaccctcggccttgaac

SEQ ID NO: 513294 - DNA, 25 bp, Rattus norvegicus
cggcctaatcggtgccgggcgcaat

SEQ ID NO: 513295 - DNA, 25 bp, Rattus norvegicus
gtggctataggcttcgtccttctta

SEQ ID NO: 513296 - DNA, 25 bp, Rattus norvegicus
gtccttcttagcgtctgtcactagc

SEQ ID NO: 513297 - DNA, 25 bp, Rattus norvegicus
cactagcgcccagctgcctgttgag

SEQ ID NO: 513298 - DNA, 25 bp, Rattus norvegicus
cctgttgagcggcaaagccagccct

SEQ ID NO: 513299 - DNA, 25 bp, Rattus norvegicus
agccagccctgggttacaattccca

SEQ ID NO: 513300 - DNA, 25 bp, Rattus norvegicus
ttacaattcccacggcaagggcgta

SEQ ID NO: 513301 - DNA, 25 bp, Rattus norvegicus
acggcaagggcgtacagctaacagc

SEQ ID NO: 513302 - DNA, 25 bp, Rattus norvegicus
cagctaacagcgcaggtccaaacca

SEQ ID NO: 513303 - DNA, 25 bp, Rattus norvegicus
aggtccaaaccatcaggaaggtctg

SEQ ID NO: 513304 - DNA, 25 bp, Rattus norvegicus
tcggccttgaaccacgcacctgtgg

SEQ ID NO: 513305 - DNA, 25 bp, Rattus norvegicus
agcctgagaaggtggcttgacgctt

SEQ ID NO: 513306 - DNA, 25 bp, Rattus norvegicus
tcgcaatgcactatgggccaccgct

SEQ ID NO: 513307 - DNA, 25 bp, Rattus norvegicus
tcgttcgacgctcaccggacaggaa

SEQ ID NO: 513308 - DNA, 25 bp, Rattus norvegicus
agcgcctcgaagagagtctgcgacc

SEQ ID NO: 513309 - DNA, 25 bp, Rattus norvegicus
cgcctctaggtgagacagaagccaa

SEQ ID NO: 513310 - DNA, 25 bp, Rattus norvegicus
aagtgcttccgggtccctcagctaa

SEQ ID NO: 513311 - DNA, 25 bp, Rattus norvegicus
ctgcactgtacgcatgcgtgctttg

SEQ ID NO: 513312 - DNA, 25 bp, Rattus norvegicus
tcaagctccctacggagtcaacgtc

SEQ ID NO: 513313 - DNA, 25 bp, Rattus norvegicus
agtcaacgtcctgatccttggggtt

SEQ ID NO: 513314 - DNA, 25 bp, Rattus norvegicus
tccttagcgccgattccgcgggaag

SEQ ID NO: 513315 - DNA, 25 bp, Rattus norvegicus
accggcgcgtcttacccagagagac

SEQ ID NO: 513316 - DNA, 25 bp, Rattus norvegicus
cagagagacgctgtacctggagccc

SEQ ID NO: 513317 - DNA, 25 bp, Rattus norvegicus
agctcccgggtctctctgaaagatg

SEQ ID NO: 513318 - DNA, 25 bp, Rattus norvegicus
gctgtgactcccatttccgttcgtg

SEQ ID NO: 513319 - DNA, 25 bp, Rattus norvegicus
ctctgtgttttgtttccgctggtcc

SEQ ID NO: 513320 - DNA, 25 bp, Rattus norvegicus
tgctacggcacccaagtggctgctt

SEQ ID NO: 513321 - DNA, 25 bp, Rattus norvegicus
caaacgacgtgcacagccggctaga

SEQ ID NO: 513322 - DNA, 25 bp, Rattus norvegicus
cgctcctagagaaatcggtgccatc

SEQ ID NO: 513323 - DNA, 25 bp, Rattus norvegicus
tgtgtcctcaaacctacgtagcgtc

SEQ ID NO: 513324 - DNA, 25 bp, Rattus norvegicus
gcgatgactccaccaagtgcctcaa

SEQ ID NO: 513325 - DNA, 25 bp, Rattus norvegicus
ctgggagctcacgatcctgcacaca

SEQ ID NO: 513326 - DNA, 25 bp, Rattus norvegicus
ctgtggcccacagccaaatcctggg

SEQ ID NO: 513327 - DNA, 25 bp, Rattus norvegicus
caagtggctgcttctcgcgctaagc

SEQ ID NO: 513328 - DNA, 25 bp, Rattus norvegicus
tcggtgccatcgagagtgaagatca

SEQ ID NO: 513329 - DNA, 25 bp, Rattus norvegicus
acacaagccgctatacgctcctaga

SEQ ID NO: 513330 - DNA, 25 bp, Rattus norvegicus
cttcggaggagtcacagagcaacac

SEQ ID NO: 513331 - DNA, 25 bp, Rattus norvegicus
cgggcgggatctggatccctctcta

SEQ ID NO: 513332 - DNA, 25 bp, Rattus norvegicus
tggtgtgtccaggtcccaccaaggc

SEQ ID NO: 513333 - DNA, 25 bp, Rattus norvegicus
gtgcctcaacgcaagcctgtgtgtg

SEQ ID NO: 513334 - DNA, 25 bp, Rattus norvegicus
cgggccaacggctggtacctgttga

SEQ ID NO: 513335 - DNA, 25 bp, Rattus norvegicus
cccatctcagtccacgaagcggagg

SEQ ID NO: 513336 - DNA, 25 bp, Rattus norvegicus
ccgggagtgctcagactgacgttct

SEQ ID NO: 513337 - DNA, 25 bp, Rattus norvegicus
accgctggagtacccgggagtgctc

SEQ ID NO: 513338 - DNA, 25 bp, Rattus norvegicus
acagctaggcgcagccgcacaaggc

SEQ ID NO: 513339 - DNA, 25 bp, Rattus norvegicus
agcttcacagctaggcgcagccgca

SEQ ID NO: 513340 - DNA, 25 bp, Rattus norvegicus
cgaagcggaggacttgccgccctca

SEQ ID NO: 513341 - DNA, 25 bp, Rattus norvegicus
tgacggcaaatctcgcgtcccacgt

SEQ ID NO: 513342 - DNA, 25 bp, Rattus norvegicus
acagcggatactgacggcaaatctc

SEQ ID NO: 513343 - DNA, 25 bp, Rattus norvegicus
ctggtacctgttgaggagcagcgaa

SEQ ID NO: 513344 - DNA, 25 bp, Rattus norvegicus
ttccaagcccacagtgcacagtgcg

SEQ ID NO: 513345 - DNA, 25 bp, Rattus norvegicus
caaatcggggcgcaacttcggacgt

SEQ ID NO: 513346 - DNA, 25 bp, Rattus norvegicus
gtgaccgcccacaaatcggggcgca

SEQ ID NO: 513347 - DNA, 25 bp, Rattus norvegicus
caggaagcagaacagcggatactga

SEQ ID NO: 513348 - DNA, 25 bp, Rattus norvegicus
tccctcgctagctctctcggcccgt

SEQ ID NO: 513349 - DNA, 25 bp, Rattus norvegicus
tcgctgctccctgtgtccggcgcga

SEQ ID NO: 513350 - DNA, 25 bp, Rattus norvegicus
ctccgagcgcgctcccagtgcgcgc

SEQ ID NO: 513351 - DNA, 25 bp, Rattus norvegicus
ccagctttcccactcccgtccgcgg

SEQ ID NO: 513352 - DNA, 25 bp, Rattus norvegicus
gcggccgctcaagcacgagtggccg

SEQ ID NO: 513353 - DNA, 25 bp, Rattus norvegicus
tcgctggctctctggctcacgccct

SEQ ID NO: 513354 - DNA, 25 bp, Rattus norvegicus
cgcgctgacgtgacgacgcagccga

SEQ ID NO: 513355 - DNA, 25 bp, Rattus norvegicus
gctgacgtgacgacgcagccgacgc

SEQ ID NO: 513356 - DNA, 25 bp, Rattus norvegicus
gacgacgcagccgacgcctcaggac

SEQ ID NO: 513357 - DNA, 25 bp, Rattus norvegicus
ggggaacgcgtgctcgctgctccct

SEQ ID NO: 513358 - DNA, 25 bp, Rattus norvegicus
tctgtgcggacactccctcgcgctc

SEQ ID NO: 513359 - DNA, 25 bp, Rattus norvegicus
cccaacacccgtgtgccggccgtcg

SEQ ID NO: 513360 - DNA, 25 bp, Rattus norvegicus
gccgagtcgctctttctctctcccg

SEQ ID NO: 513361 - DNA, 25 bp, Rattus norvegicus
cgagtgaatgggagacccgccctct

SEQ ID NO: 513362 - DNA, 25 bp, Rattus norvegicus
tcctccttcttgcaccgattggacg

SEQ ID NO: 513363 - DNA, 25 bp, Rattus norvegicus
cggccgctgaaagtaccttggagga

SEQ ID NO: 513364 - DNA, 25 bp, Rattus norvegicus
gctgtgtattcagcccggccgctga

SEQ ID NO: 513365 - DNA, 25 bp, Rattus norvegicus
ggtgaccagccctgtgctgtgtatt

SEQ ID NO: 513366 - DNA, 25 bp, Rattus norvegicus
ctgcttcgagcctagtcggcacgga

SEQ ID NO: 513367 - DNA, 25 bp, Rattus norvegicus
gaggtcactgcctgcttcgagccta

SEQ ID NO: 513368 - DNA, 25 bp, Rattus norvegicus
cagtctcttcagagtctggcgggcc

SEQ ID NO: 513369 - DNA, 25 bp, Rattus norvegicus
tgccgcgtgcctgtctatttcttcg

SEQ ID NO: 513370 - DNA, 25 bp, Rattus norvegicus
gcagctccttttatagctccctttg

SEQ ID NO: 513371 - DNA, 25 bp, Rattus norvegicus
tttcttgaagcaacgcgtgggagcc

SEQ ID NO: 513372 - DNA, 25 bp, Rattus norvegicus
cgcgggtgaaaatcgaaaagctctc

SEQ ID NO: 513373 - DNA, 25 bp, Rattus norvegicus
atagctccctttgcgcgagatcgag

SEQ ID NO: 513374 - DNA, 25 bp, Rattus norvegicus
agccggcgcctggactctctctttt

SEQ ID NO: 513375 - DNA, 25 bp, Rattus norvegicus
tccgtcgtaaaagaaagagcctggc

SEQ ID NO: 513376 - DNA, 25 bp, Rattus norvegicus
aacatcaacccgcaatcggggtccg

SEQ ID NO: 513377 - DNA, 25 bp, Rattus norvegicus
atcaacccgcaatcggggtccgagc

SEQ ID NO: 513378 - DNA, 25 bp, Rattus norvegicus
cgtcatgaccgcctcccaacatcaa

SEQ ID NO: 513379 - DNA, 25 bp, Rattus norvegicus
taccaggccaagaccgtcatgaccg

SEQ ID NO: 513380 - DNA, 25 bp, Rattus norvegicus
cgagtaccaggccaagaccgtcatg

SEQ ID NO: 513381 - DNA, 25 bp, Rattus norvegicus
tgtcctacaacttccttcaacggaa

SEQ ID NO: 513382 - DNA, 25 bp, Rattus norvegicus
aatgtcctacaacttccttcaacgg

SEQ ID NO: 513383 - DNA, 25 bp, Rattus norvegicus
ctgcgccttcaaatgtcctacaact

SEQ ID NO: 513384 - DNA, 25 bp, Rattus norvegicus
gctctgcgccttcaaatgtcctaca

SEQ ID NO: 513385 - DNA, 25 bp, Rattus norvegicus
gtgctctgcgccttcaaatgtccta

SEQ ID NO: 513386 - DNA, 25 bp, Rattus norvegicus
aacacgtgctctgcgccttcaaatg

SEQ ID NO: 513387 - DNA, 25 bp, Rattus norvegicus
gaaacacgtgctctgcgccttcaaa

SEQ ID NO: 513388 - DNA, 25 bp, Rattus norvegicus
ttagaaacacgtgctctgcgccttc

SEQ ID NO: 513389 - DNA, 25 bp, Rattus norvegicus
cgtctccgccgtgacacatggctct

SEQ ID NO: 513390 - DNA, 25 bp, Rattus norvegicus
cgcctcaggaacgagtggccgccct

SEQ ID NO: 513391 - DNA, 25 bp, Rattus norvegicus
ctctgacctgaacacgcagccgtcg

SEQ ID NO: 513392 - DNA, 25 bp, Rattus norvegicus
tgtcacggagctccgacccccaagt

SEQ ID NO: 513393 - DNA, 25 bp, Rattus norvegicus
ctgtccgaccgggtccgactgtgtc

SEQ ID NO: 513394 - DNA, 25 bp, Rattus norvegicus
tgtccgaccgggtccgactgtgtcc

SEQ ID NO: 513395 - DNA, 25 bp, Rattus norvegicus
ccgggtccgactgtgtccggcgcga

SEQ ID NO: 513396 - DNA, 25 bp, Rattus norvegicus
ccagcttcccaactccggcccgcag

SEQ ID NO: 513397 - DNA, 25 bp, Rattus norvegicus
agccgcctcaggaacgagtggccgc

SEQ ID NO: 513398 - DNA, 25 bp, Rattus norvegicus
gctggttcccagtccccgccgagtc

SEQ ID NO: 513399 - DNA, 25 bp, Rattus norvegicus
ccgccgagtcgctccaactctgtca

SEQ ID NO: 513400 - DNA, 25 bp, Rattus norvegicus
aactctgtcacgctctgacctgaac

SEQ ID NO: 513401 - DNA, 25 bp, Rattus norvegicus
actctgtcacgctctgacctgaaca

SEQ ID NO: 513402 - DNA, 25 bp, Rattus norvegicus
tgaacacgcagccgtcgcctcagga

SEQ ID NO: 513403 - DNA, 25 bp, Rattus norvegicus
cgcagccgcctcaggaacgagtggc

SEQ ID NO: 513404 - DNA, 25 bp, Rattus norvegicus
gcaccctccaaaatgtcacggagct

SEQ ID NO: 513405 - DNA, 25 bp, Rattus norvegicus
ggagggcgttccgccgccaagcaca

SEQ ID NO: 513406 - DNA, 25 bp, Rattus norvegicus
ccgccaagcacacgcccgcgggagc

SEQ ID NO: 513407 - DNA, 25 bp, Rattus norvegicus
cgggagccgagcaccgcccaagccc

SEQ ID NO: 513408 - DNA, 25 bp, Rattus norvegicus
tcgcgggacagcacccgcgcctctc

SEQ ID NO: 513409 - DNA, 25 bp, Rattus norvegicus
cgccggccacgacagcaccaagtcc

SEQ ID NO: 513410 - DNA, 25 bp, Rattus norvegicus
gccgaggcgcctcctcccggagcgc

SEQ ID NO: 513411 - DNA, 25 bp, Rattus norvegicus
gcccagacccggcagcacatggaga

SEQ ID NO: 513412 - DNA, 25 bp, Rattus norvegicus
cagacccggcagcacatggagagga

SEQ ID NO: 513413 - DNA, 25 bp, Rattus norvegicus
gcgaccgcggcctactctctcgcag

SEQ ID NO: 513414 - DNA, 25 bp, Rattus norvegicus
tggaatccattttccagaaaagccg

SEQ ID NO: 513415 - DNA, 25 bp, Rattus norvegicus
caagcaccctccaaaatgtcacgga

SEQ ID NO: 513416 - DNA, 25 bp, Rattus norvegicus
tccctggcgcgtccgcttctctcac

SEQ ID NO: 513417 - DNA, 25 bp, Rattus norvegicus
cggcgcgagtggagctgttgtaaaa

SEQ ID NO: 513418 - DNA, 25 bp, Rattus norvegicus
cctgaagctacctgtggttatttgc

SEQ ID NO: 513419 - DNA, 25 bp, Rattus norvegicus
ctgtggttatttgctgtgggtcttt

SEQ ID NO: 513420 - DNA, 25 bp, Rattus norvegicus
gctacctgtggttatttgctgtggg

SEQ ID NO: 513421 - DNA, 25 bp, Rattus norvegicus
cctctcgcgccgattggacgggaga

SEQ ID NO: 513422 - DNA, 25 bp, Rattus norvegicus
gcccacatttcgcttggtcaaccgg

SEQ ID NO: 513423 - DNA, 25 bp, Rattus norvegicus
cacatttcgcttggtcaaccggcca

SEQ ID NO: 513424 - DNA, 25 bp, Rattus norvegicus
tttcgcttggtcaaccggccaacta

SEQ ID NO: 513425 - DNA, 25 bp, Rattus norvegicus
tcgcttggtcaaccggccaactaaa

SEQ ID NO: 513426 - DNA, 25 bp, Rattus norvegicus
ggccaactaaaccactcacccttga

SEQ ID NO: 513427 - DNA, 25 bp, Rattus norvegicus
gagtgcagcacagcttccgtggatc

SEQ ID NO: 513428 - DNA, 25 bp, Rattus norvegicus
gcagcacagcttccgtggatcgaga

SEQ ID NO: 513429 - DNA, 25 bp, Rattus norvegicus
gcacagcttccgtggatcgagatcc

SEQ ID NO: 513430 - DNA, 25 bp, Rattus norvegicus
tggatcgagatccaggctgcccctc

SEQ ID NO: 513431 - DNA, 25 bp, Rattus norvegicus
gctttcctgaagctacctgtggtta

SEQ ID NO: 513432 - DNA, 25 bp, Rattus norvegicus
ttcttgcgatgcctgcagttttgta

SEQ ID NO: 513433 - DNA, 25 bp, Rattus norvegicus
tctagccgccttccagattcctttt

SEQ ID NO: 513434 - DNA, 25 bp, Rattus norvegicus
tgaatgctctctgagctcccatctg

SEQ ID NO: 513435 - DNA, 25 bp, Rattus norvegicus
tctctccggccgctgtgaatgctct

SEQ ID NO: 513436 - DNA, 25 bp, Rattus norvegicus
ccctgtaggcccgaagcctgggacg

SEQ ID NO: 513437 - DNA, 25 bp, Rattus norvegicus
agctcgctgagaggcggtccctgta

SEQ ID NO: 513438 - DNA, 25 bp, Rattus norvegicus
cagttttgtagttcgcagtgccttt

SEQ ID NO: 513439 - DNA, 25 bp, Rattus norvegicus
tccactgcacaacccagcgattgtg

SEQ ID NO: 513440 - DNA, 25 bp, Rattus norvegicus
taggcccgattcttttcttgcgatg

SEQ ID NO: 513441 - DNA, 25 bp, Rattus norvegicus
agtgacgcctacataggcccgattc

SEQ ID NO: 513442 - DNA, 25 bp, Rattus norvegicus
gcagtgcctttcttcaccagcggtc

SEQ ID NO: 513443 - DNA, 25 bp, Rattus norvegicus
ttccagattccttttccagcacaga

SEQ ID NO: 513444 - DNA, 25 bp, Rattus norvegicus
accagcggtccatccttacgtctag

SEQ ID NO: 513445 - DNA, 25 bp, Rattus norvegicus
atccttacgtctagggagtcgctga

SEQ ID NO: 513446 - DNA, 25 bp, Rattus norvegicus
gctccggaacttccgagggagtatg

SEQ ID NO: 513447 - DNA, 25 bp, Rattus norvegicus
ctgtggatagctccggaacttccga

SEQ ID NO: 513448 - DNA, 25 bp, Rattus norvegicus
gctctgtggatagctccggaacttc

SEQ ID NO: 513449 - DNA, 25 bp, Rattus norvegicus
ccaggaaggttgagctcgcgtgtct

SEQ ID NO: 513450 - DNA, 25 bp, Rattus norvegicus
ttaaacgccaggaaggttgagctcg

SEQ ID NO: 513451 - DNA, 25 bp, Rattus norvegicus
gaagattgccgggagttaaacgcca

SEQ ID NO: 513452 - DNA, 25 bp, Rattus norvegicus
cctcctcacacagaaggtgcgggaa

SEQ ID NO: 513453 - DNA, 25 bp, Rattus norvegicus
tgcgccagtctcacctcctcacaca

SEQ ID NO: 513454 - DNA, 25 bp, Rattus norvegicus
cgaggaacggctgcgccagtctcac

SEQ ID NO: 513455 - DNA, 25 bp, Rattus norvegicus
ctgaagcagcgcttgcgagctttgg

SEQ ID NO: 513456 - DNA, 25 bp, Rattus norvegicus
taaacagcgccaagcggggcctgcg

SEQ ID NO: 513457 - DNA, 25 bp, Rattus norvegicus
cggtcaccgtaaacagcgccaagcg

SEQ ID NO: 513458 - DNA, 25 bp, Rattus norvegicus
cacacagaaggtgcgggaagattgc

SEQ ID NO: 513459 - DNA, 25 bp, Rattus norvegicus
gaaatggcggcggtcaccgtaaaca

SEQ ID NO: 513460 - DNA, 25 bp, Rattus norvegicus
tccgctcaagtacactcaaatacgg

SEQ ID NO: 513461 - DNA, 25 bp, Rattus norvegicus
cgctcaagtacactcaaatacgggg

SEQ ID NO: 513462 - DNA, 25 bp, Rattus norvegicus
ccgctcaagtacactcaaatacggg

SEQ ID NO: 513463 - DNA, 25 bp, Rattus norvegicus
ttccgctcaagtacactcaaatacg

SEQ ID NO: 513464 - DNA, 25 bp, Rattus norvegicus
aacccttccgctcaagtacactcaa

SEQ ID NO: 513465 - DNA, 25 bp, Rattus norvegicus
ccttccgctcaagtacactcaaata

SEQ ID NO: 513466 - DNA, 25 bp, Rattus norvegicus
gaaacccttccgctcaagtacactc

SEQ ID NO: 513467 - DNA, 25 bp, Rattus norvegicus
acccttccgctcaagtacactcaaa

SEQ ID NO: 513468 - DNA, 25 bp, Rattus norvegicus
cttccgctcaagtacactcaaatac

SEQ ID NO: 513469 - DNA, 25 bp, Rattus norvegicus
aaacccttccgctcaagtacactca

SEQ ID NO: 513470 - DNA, 25 bp, Rattus norvegicus
tcctccagccgttgcactggggtga

SEQ ID NO: 513471 - DNA, 25 bp, Rattus norvegicus
tggctctgctcatgctcacgcgact

SEQ ID NO: 513472 - DNA, 25 bp, Rattus norvegicus
atcctttccgagcacagcagacgcg

SEQ ID NO: 513473 - DNA, 25 bp, Rattus norvegicus
ctcggccttggactacgaagtgacc

SEQ ID NO: 513474 - DNA, 25 bp, Rattus norvegicus
cttctgtaaaatcgcgccagcagtg

SEQ ID NO: 513475 - DNA, 25 bp, Rattus norvegicus
ctgggcctcccgtggtgattataaa

SEQ ID NO: 513476 - DNA, 25 bp, Rattus norvegicus
aggaccttgttcctggaggcgtgca

SEQ ID NO: 513477 - DNA, 25 bp, Rattus norvegicus
cgggtgcagaccacctgggatatca

SEQ ID NO: 513478 - DNA, 25 bp, Rattus norvegicus
tgggatatcaatcggtccatctctg

SEQ ID NO: 513479 - DNA, 25 bp, Rattus norvegicus
gggctgcctagaggacacgatgtcc

SEQ ID NO: 513480 - DNA, 25 bp, Rattus norvegicus
cgccttccaaggagccggctcagta

SEQ ID NO: 513481 - DNA, 25 bp, Rattus norvegicus
gagctaccgcgctgaagaccctctt

SEQ ID NO: 513482 - DNA, 25 bp, Rattus norvegicus
tgaggcgacaccacctagacaaagc

SEQ ID NO: 513483 - DNA, 25 bp, Rattus norvegicus
tcacgcgactggactcgtggcctca

SEQ ID NO: 513484 - DNA, 25 bp, Rattus norvegicus
ttaagacgtatgtgtgcccgctgcc

SEQ ID NO: 513485 - DNA, 25 bp, Rattus norvegicus
gcggcgcaccagtagccgggtaaaa

SEQ ID NO: 513486 - DNA, 25 bp, Rattus norvegicus
tagggccgcacctggtaatccagag

SEQ ID NO: 513487 - DNA, 25 bp, Rattus norvegicus
agagagaacttcacgccctgctcca

SEQ ID NO: 513488 - DNA, 25 bp, Rattus norvegicus
cacctcttcgtggaagcactgcttg

SEQ ID NO: 513489 - DNA, 25 bp, Rattus norvegicus
cagctcgaaggtgagctcagcgccc

SEQ ID NO: 513490 - DNA, 25 bp, Rattus norvegicus
gcagcatcagcatctggaaggatga

SEQ ID NO: 513491 - DNA, 25 bp, Rattus norvegicus
cggaacctcgttgcccatgatgctc

SEQ ID NO: 513492 - DNA, 25 bp, Rattus norvegicus
ccatgatgctctgggccttgtcttc

SEQ ID NO: 513493 - DNA, 25 bp, Rattus norvegicus
cttgtcttctctaggctccggtgga

SEQ ID NO: 513494 - DNA, 25 bp, Rattus norvegicus
cctccgaagagacgtggcgcgagct

SEQ ID NO: 513495 - DNA, 25 bp, Rattus norvegicus
cagcgattctgtgcgcagccgcaca

SEQ ID NO: 513496 - DNA, 25 bp, Rattus norvegicus
tgcgcctgcgcatcactgagcttaa

SEQ ID NO: 513497 - DNA, 25 bp, Rattus norvegicus
gtgggcggcatcctttcctcctgct

SEQ ID NO: 513498 - DNA, 25 bp, Rattus norvegicus
cggataaatgccgtgtaactgtgta

SEQ ID NO: 513499 - DNA, 25 bp, Rattus norvegicus
gctatttgaaggctcccatggtccc

SEQ ID NO: 513500 - DNA, 25 bp, Rattus norvegicus
gcgcagctatttgaaggctcccatg

SEQ ID NO: 513501 - DNA, 25 bp, Rattus norvegicus
gaggacacccgtcccggctgcaaac

SEQ ID NO: 513502 - DNA, 25 bp, Rattus norvegicus
gctgcaaactgtcagcgccgggcgc

SEQ ID NO: 513503 - DNA, 25 bp, Rattus norvegicus
ttcccggtttcaacgaggccgctgc

SEQ ID NO: 513504 - DNA, 25 bp, Rattus norvegicus
tgccctctgcggcagacggcgatgc

SEQ ID NO: 513505 - DNA, 25 bp, Rattus norvegicus
gacgttctcggataaatgccgtgta

SEQ ID NO: 513506 - DNA, 25 bp, Rattus norvegicus
ccgtgtaactgtgtaggcgaattga

SEQ ID NO: 513507 - DNA, 25 bp, Rattus norvegicus
tgtaggcgaattgaagctaaaaata

SEQ ID NO: 513508 - DNA, 25 bp, Rattus norvegicus
gaacggaaaatctatcattaaggta

SEQ ID NO: 513509 - DNA, 25 bp, Rattus norvegicus
cattaaggtatcattgcgccagcgc

SEQ ID NO: 513510 - DNA, 25 bp, Rattus norvegicus
ggcgctgtgacgttctcggataaat

SEQ ID NO: 513511 - DNA, 25 bp, Rattus norvegicus
ttgcgccagcgcagctatttgaagg

SEQ ID NO: 513512 - DNA, 25 bp, Rattus norvegicus
ctgcggagggaagagctttcagcaa

SEQ ID NO: 513513 - DNA, 25 bp, Rattus norvegicus
tccgcgctgctgaaacgggctcttc

SEQ ID NO: 513514 - DNA, 25 bp, Rattus norvegicus
ccctgggactgctggcccagagaga

SEQ ID NO: 513515 - DNA, 25 bp, Rattus norvegicus
tggcgtcatatgactccgcctgctg

SEQ ID NO: 513516 - DNA, 25 bp, Rattus norvegicus
ctttcagcaaggaggggtccaccta

SEQ ID NO: 513517 - DNA, 25 bp, Rattus norvegicus
gggtccacctaggagctcagcggca

SEQ ID NO: 513518 - DNA, 25 bp, Rattus norvegicus
gctcagcggcagatctcaaagtgta

SEQ ID NO: 513519 - DNA, 25 bp, Rattus norvegicus
ggtgcctctcggagatgtttagtgc

SEQ ID NO: 513520 - DNA, 25 bp, Rattus norvegicus
atgtttagtgcgtgaggtctctctg

SEQ ID NO: 513521 - DNA, 25 bp, Rattus norvegicus
gctcttcgagggattggcgtcatat

SEQ ID NO: 513522 - DNA, 25 bp, Rattus norvegicus
accatgcagaaagccatccgactga

SEQ ID NO: 513523 - DNA, 25 bp, Rattus norvegicus
catccgactgaacgatggccacgtc

SEQ ID NO: 513524 - DNA, 25 bp, Rattus norvegicus
atggccacgtcgtgtccctgggact

SEQ ID NO: 513525 - DNA, 25 bp, Rattus norvegicus
gagcgttcagcgagcgccagagaac

SEQ ID NO: 513526 - DNA, 25 bp, Rattus norvegicus
ggggacagtacagagagcataaaag

SEQ ID NO: 513527 - DNA, 25 bp, Rattus norvegicus
cgggaacagtacagagagcataaaa

SEQ ID NO: 513528 - DNA, 25 bp, Rattus norvegicus
gtacagagagcataaaagcggggtt

SEQ ID NO: 513529 - DNA, 25 bp, Rattus norvegicus
ttcggggacagtacagagagcataa

SEQ ID NO: 513530 - DNA, 25 bp, Rattus norvegicus
gggacagtacagagagcataaaagc

SEQ ID NO: 513531 - DNA, 25 bp, Rattus norvegicus
acagagagcataaaagcggggttcg

SEQ ID NO: 513532 - DNA, 25 bp, Rattus norvegicus
cggggacagtacagagagcataaaa

SEQ ID NO: 513533 - DNA, 25 bp, Rattus norvegicus
acagtacagagagcataaaagcggg

SEQ ID NO: 513534 - DNA, 25 bp, Rattus norvegicus
agtacagagagcataaaagcggggt

SEQ ID NO: 513535 - DNA, 25 bp, Rattus norvegicus
gttcgggaacagtacagagagcata

SEQ ID NO: 513536 - DNA, 25 bp, Rattus norvegicus
tcgggaacagtacagagagcataaa

SEQ ID NO: 513537 - DNA, 25 bp, Rattus norvegicus
cagtacagagagcataaaagcgggg

SEQ ID NO: 513538 - DNA, 25 bp, Rattus norvegicus
tacagagagcataaaagcggggttc

SEQ ID NO: 513539 - DNA, 25 bp, Rattus norvegicus
ttcgggaacagtacagagagcataa

SEQ ID NO: 513540 - DNA, 25 bp, Rattus norvegicus
tcaacattcccatcatcacaggcgg

SEQ ID NO: 513541 - DNA, 25 bp, Rattus norvegicus
catatctcccttcggcaaaaccacg

SEQ ID NO: 513542 - DNA, 25 bp, Rattus norvegicus
tacactcgcccatatctcccttcgg

SEQ ID NO: 513543 - DNA, 25 bp, Rattus norvegicus
acggctacaccaacatacactcgcc

SEQ ID NO: 513544 - DNA, 25 bp, Rattus norvegicus
tggaactggcttcgctcgggtgccc

SEQ ID NO: 513545 - DNA, 25 bp, Rattus norvegicus
caaggcgctggaactggcttcgctc

SEQ ID NO: 513546 - DNA, 25 bp, Rattus norvegicus
ggagatgcccccaagtcgcctcgtg

SEQ ID NO: 513547 - DNA, 25 bp, Rattus norvegicus
ttcccatcatcacaggcggcaaggc

SEQ ID NO: 513548 - DNA, 25 bp, Rattus norvegicus
gaagttgtctctcaacattcccatc

SEQ ID NO: 513549 - DNA, 25 bp, Rattus norvegicus
cgccggaagttgtctctcaacattc

SEQ ID NO: 513550 - DNA, 25 bp, Rattus norvegicus
gcccttggccatcggcacttcgtcc

SEQ ID NO: 513551 - DNA, 25 bp, Rattus norvegicus
agccgcaagttctcctcgccgccgc

SEQ ID NO: 513552 - DNA, 25 bp, Rattus norvegicus
aagtcgcctcgtgccagccgcaagt

SEQ ID NO: 513553 - DNA, 25 bp, Rattus norvegicus
catcacaggcggcaaggcgctggaa

SEQ ID NO: 513554 - DNA, 25 bp, Rattus norvegicus
accgctgagctgaccgtgaatgcca

SEQ ID NO: 513555 - DNA, 25 bp, Rattus norvegicus
ggggacatgcatcttgtgcgatccg

SEQ ID NO: 513556 - DNA, 25 bp, Rattus norvegicus
tagtctcgggggacatgcatcttgt

SEQ ID NO: 513557 - DNA, 25 bp, Rattus norvegicus
atgccataggtatgagggagaaagt

SEQ ID NO: 513558 - DNA, 25 bp, Rattus norvegicus
ccgtgaatgccataggtatgaggga

SEQ ID NO: 513559 - DNA, 25 bp, Rattus norvegicus
ctgaccgtgaatgccataggtatga

SEQ ID NO: 513560 - DNA, 25 bp, Rattus norvegicus
gagctgaccgtgaatgccataggta

SEQ ID NO: 513561 - DNA, 25 bp, Rattus norvegicus
gctgagctgaccgtgaatgccatag

SEQ ID NO: 513562 - DNA, 25 bp, Rattus norvegicus
ccgctgagctgaccgtgaatgccat

SEQ ID NO: 513563 - DNA, 25 bp, Rattus norvegicus
ggccaccgctgagctgaccgtgaat

SEQ ID NO: 513564 - DNA, 25 bp, Rattus norvegicus
cgccgcgatgtggactgcgctgccc

SEQ ID NO: 513565 - DNA, 25 bp, Rattus norvegicus
gaccgagcagtgagcgccgcgatgt

SEQ ID NO: 513566 - DNA, 25 bp, Rattus norvegicus
ctgagctgaccgtgaatgccatagg

SEQ ID NO: 513567 - DNA, 25 bp, Rattus norvegicus
ccaccgctgagctgaccgtgaatgc

SEQ ID NO: 513568 - DNA, 25 bp, Rattus norvegicus
tataacgcagttctcccgccgcggg

SEQ ID NO: 513569 - DNA, 25 bp, Rattus norvegicus
agctctacatcctgggcgcgatttg

SEQ ID NO: 513570 - DNA, 25 bp, Rattus norvegicus
cgccatttataagtgattcgccgcc

SEQ ID NO: 513571 - DNA, 25 bp, Rattus norvegicus
tgcacactcaccctcctggaattta

SEQ ID NO: 513572 - DNA, 25 bp, Rattus norvegicus
gtcgccaaatgacgcactgaagtta

SEQ ID NO: 513573 - DNA, 25 bp, Rattus norvegicus
gttgccgcggccattttataacgca

SEQ ID NO: 513574 - DNA, 25 bp, Rattus norvegicus
gggatccttcggctttgcctgtgcc

SEQ ID NO: 513575 - DNA, 25 bp, Rattus norvegicus
tttgccatacgcacggggatccttc

SEQ ID NO: 513576 - DNA, 25 bp, Rattus norvegicus
cgggcacctccctacaatagacttt

SEQ ID NO: 513577 - DNA, 25 bp, Rattus norvegicus
tacagtagaactccacagaacgctg

SEQ ID NO: 513578 - DNA, 25 bp, Rattus norvegicus
actgaagttacccaccgcaatgcgc

SEQ ID NO: 513579 - DNA, 25 bp, Rattus norvegicus
gccgggattggtagttcagcctcca

SEQ ID NO: 513580 - DNA, 25 bp, Rattus norvegicus
gtgtccaacagcctcgaaccttcag

SEQ ID NO: 513581 - DNA, 25 bp, Rattus norvegicus
cgccacgaagcactgtcgccaaatg

SEQ ID NO: 513582 - DNA, 25 bp, Rattus norvegicus
cagcgttcctccgagtgggctgaac

SEQ ID NO: 513583 - DNA, 25 bp, Rattus norvegicus
actagccaggacactgttggggacc

SEQ ID NO: 513584 - DNA, 25 bp, Rattus norvegicus
acggcttctcacactctccttttgg

SEQ ID NO: 513585 - DNA, 25 bp, Rattus norvegicus
cgatttgcgagagacacggcttctc

SEQ ID NO: 513586 - DNA, 25 bp, Rattus norvegicus
attctggccatgcaccgtggtctga

SEQ ID NO: 513587 - DNA, 25 bp, Rattus norvegicus
cacgtcctcggacctgcatcaggtg

SEQ ID NO: 513588 - DNA, 25 bp, Rattus norvegicus
gctgagtgcatctctcccgggacag

SEQ ID NO: 513589 - DNA, 25 bp, Rattus norvegicus
ctccttttggtgactctcctggaaa

SEQ ID NO: 513590 - DNA, 25 bp, Rattus norvegicus
ttgcccttggagtgagcttgtgctc

SEQ ID NO: 513591 - DNA, 25 bp, Rattus norvegicus
ttcagttgtccactcagctggcgtc

SEQ ID NO: 513592 - DNA, 25 bp, Rattus norvegicus
agatgagcctctgggacccttctga

SEQ ID NO: 513593 - DNA, 25 bp, Rattus norvegicus
aaagctgcactcaccgggagccatc

SEQ ID NO: 513594 - DNA, 25 bp, Rattus norvegicus
tttaccctgggattagggatcagcc

SEQ ID NO: 513595 - DNA, 25 bp, Rattus norvegicus
gtctgaatctcctcctgatcctgtg

SEQ ID NO: 513596 - DNA, 25 bp, Rattus norvegicus
ggtagtacggactcctcttgacaga

SEQ ID NO: 513597 - DNA, 25 bp, Rattus norvegicus
gtgggagaacgcgagtagcccttta

SEQ ID NO: 513598 - DNA, 25 bp, Rattus norvegicus
ccgaggctttatggtttcgggctga

SEQ ID NO: 513599 - DNA, 25 bp, Rattus norvegicus
ctgtcgtaaagtccgtcttagccgc

SEQ ID NO: 513600 - DNA, 25 bp, Rattus norvegicus
agtagccctttacgcctcgtcgcag

SEQ ID NO: 513601 - DNA, 25 bp, Rattus norvegicus
ctcttgacagagaggtcctgaggtg

SEQ ID NO: 513602 - DNA, 25 bp, Rattus norvegicus
ctgaggtccgcacaggtagtacgga

SEQ ID NO: 513603 - DNA, 25 bp, Rattus norvegicus
ctccgcgagcaattccgaggcttta

SEQ ID NO: 513604 - DNA, 25 bp, Rattus norvegicus
gggccggctttctagttcaatctcc

SEQ ID NO: 513605 - DNA, 25 bp, Rattus norvegicus
aacaggaagtaacgtcatgcgggcc

SEQ ID NO: 513606 - DNA, 25 bp, Rattus norvegicus
gcacacctccggaagcaaaacagga

SEQ ID NO: 513607 - DNA, 25 bp, Rattus norvegicus
tctggaagtccgcacacctccggaa

SEQ ID NO: 513608 - DNA, 25 bp, Rattus norvegicus
aggtgaagccggacttctggaagtc

SEQ ID NO: 513609 - DNA, 25 bp, Rattus norvegicus
tcgggagcgtcgtaaaactgtcgta

SEQ ID NO: 513610 - DNA, 25 bp, Rattus norvegicus
ccttacccgagagcttctgcaagta

SEQ ID NO: 513611 - DNA, 25 bp, Rattus norvegicus
gtagagcgtcctgcgggctcttgaa

SEQ ID NO: 513612 - DNA, 25 bp, Rattus norvegicus
gatcgccctaccttgagcaccgtga

SEQ ID NO: 513613 - DNA, 25 bp, Rattus norvegicus
cacaccggcgctgtgcacctggaag

SEQ ID NO: 513614 - DNA, 25 bp, Rattus norvegicus
tcggctcctggctccgcagcctcat

SEQ ID NO: 513615 - DNA, 25 bp, Rattus norvegicus
cctcatcgcggccctggtagctgaa

SEQ ID NO: 513616 - DNA, 25 bp, Rattus norvegicus
ctgaagcaggcgtcggcgatgtcta

SEQ ID NO: 513617 - DNA, 25 bp, Rattus norvegicus
tcctgcgggctcttgaagtagtaga

SEQ ID NO: 513618 - DNA, 25 bp, Rattus norvegicus
tcttgaagtagtagaggtagcagcg

SEQ ID NO: 513619 - DNA, 25 bp, Rattus norvegicus
agcagcggcgcgagtcaaacacgaa

SEQ ID NO: 513620 - DNA, 25 bp, Rattus norvegicus
cgagtcaaacacgaaccagcggctg

SEQ ID NO: 513621 - DNA, 25 bp, Rattus norvegicus
agcgggcccttacccgagagcttct

SEQ ID NO: 513622 - DNA, 25 bp, Rattus norvegicus
gcttctgcaagtagccgcacagccg

SEQ ID NO: 513623 - DNA, 25 bp, Rattus norvegicus
acgaaccagcggctgcggtagccgc

SEQ ID NO: 513624 - DNA, 25 bp, Rattus norvegicus
tcagctgtggcgttgcggtcattgt

SEQ ID NO: 513625 - DNA, 25 bp, Rattus norvegicus
cacgcacattttaagcctggctttt

SEQ ID NO: 513626 - DNA, 25 bp, Rattus norvegicus
cgtttattttctaagtacacgcaca

SEQ ID NO: 513627 - DNA, 25 bp, Rattus norvegicus
aggcggtggcgtttgtctcgtttat

SEQ ID NO: 513628 - DNA, 25 bp, Rattus norvegicus
cccgccggaccgtcgaagaggagct

SEQ ID NO: 513629 - DNA, 25 bp, Rattus norvegicus
aacaagacctctacgacttcctcgg

SEQ ID NO: 513630 - DNA, 25 bp, Rattus norvegicus
ggaatcctgaagaacaagacctcta

SEQ ID NO: 513631 - DNA, 25 bp, Rattus norvegicus
caccggcccatcaagggaatcctga

SEQ ID NO: 513632 - DNA, 25 bp, Rattus norvegicus
ccagcagccggagcgaccggcaatg

SEQ ID NO: 513633 - DNA, 25 bp, Rattus norvegicus
ctccacggctgcctggagggtctct

SEQ ID NO: 513634 - DNA, 25 bp, Rattus norvegicus
aggtgcgactgctttagcccggcct

SEQ ID NO: 513635 - DNA, 25 bp, Rattus norvegicus
tttccgcgacagcaggtgcgactgc

SEQ ID NO: 513636 - DNA, 25 bp, Rattus norvegicus
gcttttgaacttcgtgtccttcgga

SEQ ID NO: 513637 - DNA, 25 bp, Rattus norvegicus
gacgctggtagtggtttccgcgaca

SEQ ID NO: 513638 - DNA, 25 bp, Rattus norvegicus
tccttactagctagagtccggagtc

SEQ ID NO: 513639 - DNA, 25 bp, Rattus norvegicus
agtgtgcggacctcaaactccattc

SEQ ID NO: 513640 - DNA, 25 bp, Rattus norvegicus
ctgaggcgcgctatccagcgaggcc

SEQ ID NO: 513641 - DNA, 25 bp, Rattus norvegicus
cctcgcagactttccttactagcta

SEQ ID NO: 513642 - DNA, 25 bp, Rattus norvegicus
acgcagcctggatttcagcttttta

SEQ ID NO: 513643 - DNA, 25 bp, Rattus norvegicus
acgcgggaacgcagcctggatttca

SEQ ID NO: 513644 - DNA, 25 bp, Rattus norvegicus
actccctcagtgtgcggacctcaaa

SEQ ID NO: 513645 - DNA, 25 bp, Rattus norvegicus
ctttgaggaaagacgcgggaacgca

SEQ ID NO: 513646 - DNA, 25 bp, Rattus norvegicus
ttgggccttggtctttgaggaaaga

SEQ ID NO: 513647 - DNA, 25 bp, Rattus norvegicus
gcttctttgggccttggtctttgag

SEQ ID NO: 513648 - DNA, 25 bp, Rattus norvegicus
cgcgccaaatgagaaggcttctttg

SEQ ID NO: 513649 - DNA, 25 bp, Rattus norvegicus
tttagcccgcgccaaatgagaaggc

SEQ ID NO: 513650 - DNA, 25 bp, Rattus norvegicus
atttcagctttttactcagcgaccc

SEQ ID NO: 513651 - DNA, 25 bp, Rattus norvegicus
tagagtccggagtctagctcccggc

SEQ ID NO: 513652 - DNA, 25 bp, Rattus norvegicus
cgcaggtttcccgagcctctgctgg

SEQ ID NO: 513653 - DNA, 25 bp, Rattus norvegicus
aaaacacgtcccagctggcggaggc

SEQ ID NO: 513654 - DNA, 25 bp, Rattus norvegicus
cttaattcttgtagtggcggccgca

SEQ ID NO: 513655 - DNA, 25 bp, Rattus norvegicus
cctctgctggcattgtgaactcact

SEQ ID NO: 513656 - DNA, 25 bp, Rattus norvegicus
gtgaactcacttaaaccagcgcggt

SEQ ID NO: 513657 - DNA, 25 bp, Rattus norvegicus
ccagcgcggtttgaaaacaaacacg

SEQ ID NO: 513658 - DNA, 25 bp, Rattus norvegicus
tgaaaacaaacacgtgcggcttccc

SEQ ID NO: 513659 - DNA, 25 bp, Rattus norvegicus
gcactattttgggagtcaggccaga

SEQ ID NO: 513660 - DNA, 25 bp, Rattus norvegicus
atgcgcactgctggttcgactagag

SEQ ID NO: 513661 - DNA, 25 bp, Rattus norvegicus
tcaggccagagactttcacaggcgg

SEQ ID NO: 513662 - DNA, 25 bp, Rattus norvegicus
ttcacaggcgggagcttccgcgatt

SEQ ID NO: 513663 - DNA, 25 bp, Rattus norvegicus
tattcattagcacgtggagccctgg

SEQ ID NO: 513664 - DNA, 25 bp, Rattus norvegicus
gagccctgggctgcatgccgcgcat

SEQ ID NO: 513665 - DNA, 25 bp, Rattus norvegicus
ggaacctgaaaacacgtcccagctg

SEQ ID NO: 513666 - DNA, 25 bp, Rattus norvegicus
tgtcgctagtgtgcacgtgcatgtg

SEQ ID NO: 513667 - DNA, 25 bp, Rattus norvegicus
gggcctcggagtcacctcacttatt

SEQ ID NO: 513668 - DNA, 25 bp, Rattus norvegicus
cttgcaaaggtagggcttgtcgcta

SEQ ID NO: 513669 - DNA, 25 bp, Rattus norvegicus
gcctgctcgctcttgactaacagga

SEQ ID NO: 513670 - DNA, 25 bp, Rattus norvegicus
ctaacaggagcaatggccgcgctta

SEQ ID NO: 513671 - DNA, 25 bp, Rattus norvegicus
cttaccgcagctgcgctgacagcgg

SEQ ID NO: 513672 - DNA, 25 bp, Rattus norvegicus
agtgagtttaattggcctctggtgc

SEQ ID NO: 513673 - DNA, 25 bp, Rattus norvegicus
gcctctggtgcgactatctttcccg

SEQ ID NO: 513674 - DNA, 25 bp, Rattus norvegicus
ctcaaccgagtgaaaccgtttgcct

SEQ ID NO: 513675 - DNA, 25 bp, Rattus norvegicus
ccggctcgagcacagaaaaggcttc

SEQ ID NO: 513676 - DNA, 25 bp, Rattus norvegicus
ccagaccgcggcgttaccttcatgt

SEQ ID NO: 513677 - DNA, 25 bp, Rattus norvegicus
tgtaggacttatcgcacatcttgca

SEQ ID NO: 513678 - DNA, 25 bp, Rattus norvegicus
accttcatgtgtttgcgcagagagc

SEQ ID NO: 513679 - DNA, 25 bp, Rattus norvegicus
acgtgcatgtgcttcttgcggtcgc

SEQ ID NO: 513680 - DNA, 25 bp, Rattus norvegicus
tgctccggctcgatccatttacaga

SEQ ID NO: 513681 - DNA, 25 bp, Rattus norvegicus
ctaacgaagtctcagccagcaggca

SEQ ID NO: 513682 - DNA, 25 bp, Rattus norvegicus
ctcgcccgccaaggagggaagatca

SEQ ID NO: 513683 - DNA, 25 bp, Rattus norvegicus
tggtcacaccgatcgctggatactg

SEQ ID NO: 513684 - DNA, 25 bp, Rattus norvegicus
ccgggatgcaccaaaggtggtcaca

SEQ ID NO: 513685 - DNA, 25 bp, Rattus norvegicus
ggttgatacccaggcccacgtctct

SEQ ID NO: 513686 - DNA, 25 bp, Rattus norvegicus
cccgggtagaattgaaagcagcgct

SEQ ID NO: 513687 - DNA, 25 bp, Rattus norvegicus
tgcggaacagaaagtcccgggtaga

SEQ ID NO: 513688 - DNA, 25 bp, Rattus norvegicus
ccggccgaagcagcgaagagactgt

SEQ ID NO: 513689 - DNA, 25 bp, Rattus norvegicus
ccgcctgctcgtgaagcccagaaaa

SEQ ID NO: 513690 - DNA, 25 bp, Rattus norvegicus
ctgcccgttgaccacgttgggcgaa

SEQ ID NO: 513691 - DNA, 25 bp, Rattus norvegicus
gaaacctagccgcatctgcccgttg

SEQ ID NO: 513692 - DNA, 25 bp, Rattus norvegicus
tcatgggcccatagccgtgaagctg

SEQ ID NO: 513693 - DNA, 25 bp, Rattus norvegicus
ctcttgcttgatgggttggcgcata

SEQ ID NO: 513694 - DNA, 25 bp, Rattus norvegicus
gtgagcgcgagactgatagcagcaa

SEQ ID NO: 513695 - DNA, 25 bp, Rattus norvegicus
agcgcgagactgatagcagcaatca

SEQ ID NO: 513696 - DNA, 25 bp, Rattus norvegicus
gcgagactgatagcagcaatcattc

SEQ ID NO: 513697 - DNA, 25 bp, Rattus norvegicus
gactgatagcagcaatcattcctgc

SEQ ID NO: 513698 - DNA, 25 bp, Rattus norvegicus
cagcaatcattcctgcagataaatg

SEQ ID NO: 513699 - DNA, 25 bp, Rattus norvegicus
cattcctgcagataaatgaattgaa

SEQ ID NO: 513700 - DNA, 25 bp, Rattus norvegicus
aatgaattgaaaggacgacaccgtc

SEQ ID NO: 513701 - DNA, 25 bp, Rattus norvegicus
gaattgaaaggacgacaccgtcgtc

SEQ ID NO: 513702 - DNA, 25 bp, Rattus norvegicus
ggtcacgtgcgaccgacgcgggcga

SEQ ID NO: 513703 - DNA, 25 bp, Rattus norvegicus
cgaggattggtgagtcggcaatccc

SEQ ID NO: 513704 - DNA, 25 bp, Rattus norvegicus
ttggtgagtcggcaatccccccaca

SEQ ID NO: 513705 - DNA, 25 bp, Rattus norvegicus
cgcgccaacgaagggcgcgcggtgg

SEQ ID NO: 513706 - DNA, 25 bp, Rattus norvegicus
cgcgcgctgctcattggcccgcccg

SEQ ID NO: 513707 - DNA, 25 bp, Rattus norvegicus
ccccccctgatgaatgggagcaggg

SEQ ID NO: 513708 - DNA, 25 bp, Rattus norvegicus
atggcccgcggcgacactctggcaa

SEQ ID NO: 513709 - DNA, 25 bp, Rattus norvegicus
tggcggcatgaacctgaccatgaac

SEQ ID NO: 513710 - DNA, 25 bp, Rattus norvegicus
ctctgcacggttatggcggcatgaa

SEQ ID NO: 513711 - DNA, 25 bp, Rattus norvegicus
tggcaacagccacagctctgcacgg

SEQ ID NO: 513712 - DNA, 25 bp, Rattus norvegicus
ggaaccttttgcaccagggcctatg

SEQ ID NO: 513713 - DNA, 25 bp, Rattus norvegicus
catgtatgcgaggtcggaacctttt

SEQ ID NO: 513714 - DNA, 25 bp, Rattus norvegicus
tcctttgaacggactcctgcgtctg

SEQ ID NO: 513715 - DNA, 25 bp, Rattus norvegicus
tgtttccgggccttcatgagcagcc

SEQ ID NO: 513716 - DNA, 25 bp, Rattus norvegicus
tagcagctgtggacaccatgggccc

SEQ ID NO: 513717 - DNA, 25 bp, Rattus norvegicus
ttgtctcgacaacaggtagcagctg

SEQ ID NO: 513718 - DNA, 25 bp, Rattus norvegicus
ccgcttctcatgcacgttgtttgtc

SEQ ID NO: 513719 - DNA, 25 bp, Rattus norvegicus
accggggaaagtgcgaagctcacgc

SEQ ID NO: 513720 - DNA, 25 bp, Rattus norvegicus
tatgcgccagcccatcaaacaggag

SEQ ID NO: 513721 - DNA, 25 bp, Rattus norvegicus
tggggatccctggagacatgtatgc

SEQ ID NO: 513722 - DNA, 25 bp, Rattus norvegicus
ggcgatcaggagcagatttcttagc

SEQ ID NO: 513723 - DNA, 25 bp, Rattus norvegicus
gatttcttagctgagattctcccga

SEQ ID NO: 513724 - DNA, 25 bp, Rattus norvegicus
tcccgaaagtgactcccaggcctgg

SEQ ID NO: 513725 - DNA, 25 bp, Rattus norvegicus
tttcactgacagagaccggggaaca

SEQ ID NO: 513726 - DNA, 25 bp, Rattus norvegicus
ttcatttcctcgagtcgcggaagcg

SEQ ID NO: 513727 - DNA, 25 bp, Rattus norvegicus
cagaaaatggcgctggcctagaggc

SEQ ID NO: 513728 - DNA, 25 bp, Rattus norvegicus
cggagtcatggcgaaaacagaccca

SEQ ID NO: 513729 - DNA, 25 bp, Rattus norvegicus
actgaggctgtgctcgctttggagc

SEQ ID NO: 513730 - DNA, 25 bp, Rattus norvegicus
cccaagcgaagtccggaggctcgcg

SEQ ID NO: 513731 - DNA, 25 bp, Rattus norvegicus
tcccgggtactgaagagtctccata

SEQ ID NO: 513732 - DNA, 25 bp, Rattus norvegicus
agtctccatacctgctcttttcttc

SEQ ID NO: 513733 - DNA, 25 bp, Rattus norvegicus
cccgtttctcgtctggagcgaaata

SEQ ID NO: 513734 - DNA, 25 bp, Rattus norvegicus
aaatacttgtctagtttacgcgacg

SEQ ID NO: 513735 - DNA, 25 bp, Rattus norvegicus
aacagacccagctacaagtgccaga

SEQ ID NO: 513736 - DNA, 25 bp, Rattus norvegicus
ctgcgtttcctcctccaggcgagaa

SEQ ID NO: 513737 - DNA, 25 bp, Rattus norvegicus
cgagaaacctttcagatgtgagttc

SEQ ID NO: 513738 - DNA, 25 bp, Rattus norvegicus
tgtgagcggcgtttcgccaacagca

SEQ ID NO: 513739 - DNA, 25 bp, Rattus norvegicus
gtgcacacgagcgacaagccttata

SEQ ID NO: 513740 - DNA, 25 bp, Rattus norvegicus
tctctgcgaaagcacatgaaagttc

SEQ ID NO: 513741 - DNA, 25 bp, Rattus norvegicus
tgaaagttcatggtcgctcgccgcc

SEQ ID NO: 513742 - DNA, 25 bp, Rattus norvegicus
ggctacgactcagctatcacgtctg

SEQ ID NO: 513743 - DNA, 25 bp, Rattus norvegicus
tatgccggtttcgagtctaggcccg

SEQ ID NO: 513744 - DNA, 25 bp, Rattus norvegicus
cgacctcgttagaaagcggccgtga

SEQ ID NO: 513745 - DNA, 25 bp, Rattus norvegicus
tgagccctcagtggcttgctctgcg

SEQ ID NO: 513746 - DNA, 25 bp, Rattus norvegicus
accgccgccttcaatatcaggactg

SEQ ID NO: 513747 - DNA, 25 bp, Rattus norvegicus
tcaggactgtttctcagcgagctgc

SEQ ID NO: 513748 - DNA, 25 bp, Rattus norvegicus
agctgctctggtttatgccggtttc

SEQ ID NO: 513749 - DNA, 25 bp, Rattus norvegicus
gtctgctctcacgtcgacctcgtta

SEQ ID NO: 513750 - DNA, 25 bp, Rattus norvegicus
agccacaggtggttgctgcacaact

SEQ ID NO: 513751 - DNA, 25 bp, Rattus norvegicus
cgagcgcagtcagcaatcgcctgta

SEQ ID NO: 513752 - DNA, 25 bp, Rattus norvegicus
tgcggctcagccacaggtggttgct

SEQ ID NO: 513753 - DNA, 25 bp, Rattus norvegicus
tcctctggcgcccacaacttgttta

SEQ ID NO: 513754 - DNA, 25 bp, Rattus norvegicus
tggcgcccacaacttgtttaccctg

SEQ ID NO: 513755 - DNA, 25 bp, Rattus norvegicus
aacttgtttaccctgcgcttggctg

SEQ ID NO: 513756 - DNA, 25 bp, Rattus norvegicus
ttaccctgcgcttggctggggttca

SEQ ID NO: 513757 - DNA, 25 bp, Rattus norvegicus
tggttgctgcacaactttcactttg

SEQ ID NO: 513758 - DNA, 25 bp, Rattus norvegicus
gcaggacaaccgagcgcagtcagca

SEQ ID NO: 513759 - DNA, 25 bp, Rattus norvegicus
gcaatcgcctgtagctgcgagctta

SEQ ID NO: 513760 - DNA, 25 bp, Rattus norvegicus
tcgcctgtagctgcgagcttagagc

SEQ ID NO: 513761 - DNA, 25 bp, Rattus norvegicus
cgggaaccgaggcatcggaagaggc

SEQ ID NO: 513762 - DNA, 25 bp, Rattus norvegicus
caactttcactttgtggagcggggc

SEQ ID NO: 513763 - DNA, 25 bp, Rattus norvegicus
cccagcttcccagcgcctcccgcct

SEQ ID NO: 513764 - DNA, 25 bp, Rattus norvegicus
cttgactagcggatggaactggaaa

SEQ ID NO: 513765 - DNA, 25 bp, Rattus norvegicus
ccggctgaggaaagctacacgccta

SEQ ID NO: 513766 - DNA, 25 bp, Rattus norvegicus
atagacgccttgtaggcccggctga

SEQ ID NO: 513767 - DNA, 25 bp, Rattus norvegicus
gccaggggaagacgaacagcaaacc

SEQ ID NO: 513768 - DNA, 25 bp, Rattus norvegicus
gactgactaggcctgactagcttga

SEQ ID NO: 513769 - DNA, 25 bp, Rattus norvegicus
gacgaccgtttggaggaccagacta

SEQ ID NO: 513770 - DNA, 25 bp, Rattus norvegicus
tgccgaggatccctaccttcctagg

SEQ ID NO: 513771 - DNA, 25 bp, Rattus norvegicus
aaacagcgtcgccatggtccagccg

SEQ ID NO: 513772 - DNA, 25 bp, Rattus norvegicus
caccaagtctgggaggtcaaacagc

SEQ ID NO: 513773 - DNA, 25 bp, Rattus norvegicus
actagcctcttccagcggtgacaga

SEQ ID NO: 513774 - DNA, 25 bp, Rattus norvegicus
tcaggtcgacgtgtcgccacagcca

SEQ ID NO: 513775 - DNA, 25 bp, Rattus norvegicus
tcccgcgtaccgtgtagagcgtcag

SEQ ID NO: 513776 - DNA, 25 bp, Rattus norvegicus
cttcctaggaaagtgcctgaggccc

SEQ ID NO: 513777 - DNA, 25 bp, Rattus norvegicus
gtgacgagctcaggcagatagacgc

SEQ ID NO: 513778 - DNA, 25 bp, Rattus norvegicus
tcccgtggattctccggcgctgctt

SEQ ID NO: 513779 - DNA, 25 bp, Rattus norvegicus
gcattgccagttgggctgtcgcagt

SEQ ID NO: 513780 - DNA, 25 bp, Rattus norvegicus
gcgcgcaagctttctgggcatcctt

SEQ ID NO: 513781 - DNA, 25 bp, Rattus norvegicus
gccgttgcagtcttcgcggctgcta

SEQ ID NO: 513782 - DNA, 25 bp, Rattus norvegicus
gcatccttgcgggtcacttagttcc

SEQ ID NO: 513783 - DNA, 25 bp, Rattus norvegicus
caagatgaagatgacggtggatttc

SEQ ID NO: 513784 - DNA, 25 bp, Rattus norvegicus
tcgaggagtgtctgaaggactcgcc

SEQ ID NO: 513785 - DNA, 25 bp, Rattus norvegicus
ccgtttcaggtaaccactgtgtctg

SEQ ID NO: 513786 - DNA, 25 bp, Rattus norvegicus
cactgtgtctgctagtgcctcccgg

SEQ ID NO: 513787 - DNA, 25 bp, Rattus norvegicus
gcatcgtatgatcagggaacaccct

SEQ ID NO: 513788 - DNA, 25 bp, Rattus norvegicus
ctccagggtacaccggcagatctgt

SEQ ID NO: 513789 - DNA, 25 bp, Rattus norvegicus
cagggcaccgccgaatcccaaaagt

SEQ ID NO: 513790 - DNA, 25 bp, Rattus norvegicus
cctttccttccgctgcgcgttggag

SEQ ID NO: 513791 - DNA, 25 bp, Rattus norvegicus
tgtcgcagtgttggtccaccacccg

SEQ ID NO: 513792 - DNA, 25 bp, Rattus norvegicus
cgtgtcgaggaagcttctggaacgc

SEQ ID NO: 513793 - DNA, 25 bp, Rattus norvegicus
tgcttcatcgctgcctgacctgcgg

SEQ ID NO: 513794 - DNA, 25 bp, Rattus norvegicus
tgtttcctctttgcgtgcttcatcg

SEQ ID NO: 513795 - DNA, 25 bp, Rattus norvegicus
agggagctgggcatgtttcctcttt

SEQ ID NO: 513796 - DNA, 25 bp, Rattus norvegicus
gtgagctctgcatgccggcttccat

SEQ ID NO: 513797 - DNA, 25 bp, Rattus norvegicus
tctcgcgagaagtcctcgccgcagg

SEQ ID NO: 513798 - DNA, 25 bp, Rattus norvegicus
caatcgctttggtacccacgcagtc

SEQ ID NO: 513799 - DNA, 25 bp, Rattus norvegicus
cgctcagtgttctccaatcgctttg

SEQ ID NO: 513800 - DNA, 25 bp, Rattus norvegicus
gctccgcgctagtccgctcagtgtt

SEQ ID NO: 513801 - DNA, 25 bp, Rattus norvegicus
ggggcgcacgttccgcaagcaagct

SEQ ID NO: 513802 - DNA, 25 bp, Rattus norvegicus
gccggcttccatcggccggtctaga

SEQ ID NO: 513803 - DNA, 25 bp, Rattus norvegicus
tgctttgcgacttatggggacattc

SEQ ID NO: 513804 - DNA, 25 bp, Rattus norvegicus
ttggctgctcttaagcccgcgccgg

SEQ ID NO: 513805 - DNA, 25 bp, Rattus norvegicus
tcgcgcatcccagcaggtgagctct

SEQ ID NO: 513806 - DNA, 25 bp, Rattus norvegicus
agctcgttgcgctgccaagaggcga

SEQ ID NO: 513807 - DNA, 25 bp, Rattus norvegicus
ggctcgccgtactgcgcgaagtaca

SEQ ID NO: 513808 - DNA, 25 bp, Rattus norvegicus
agtacacgttcttcacgttgaggaa

SEQ ID NO: 513809 - DNA, 25 bp, Rattus norvegicus
gtctcgaagcccacctggccgttga

SEQ ID NO: 513810 - DNA, 25 bp, Rattus norvegicus
ccgttgaggaaacggcggcaccagc

SEQ ID NO: 513811 - DNA, 25 bp, Rattus norvegicus
ttattgagctgcaggaaacgccggt

SEQ ID NO: 513812 - DNA, 25 bp, Rattus norvegicus
atcagcaccaacaggctgccgagcg

SEQ ID NO: 513813 - DNA, 25 bp, Rattus norvegicus
gccgccagcttcagtgcacgggaca

SEQ ID NO: 513814 - DNA, 25 bp, Rattus norvegicus
acaggcggcccagcttcaggggcac

SEQ ID NO: 513815 - DNA, 25 bp, Rattus norvegicus
gatcggctgtctccacaactccggg

SEQ ID NO: 513816 - DNA, 25 bp, Rattus norvegicus
tccttgcccgccaagttatagaggc

SEQ ID NO: 513817 - DNA, 25 bp, Rattus norvegicus
ctctcactccagaagctacggtgtg

SEQ ID NO: 513818 - DNA, 25 bp, Rattus norvegicus
taacggttactctggtgtgactgtg

SEQ ID NO: 513819 - DNA, 25 bp, Rattus norvegicus
agcacgccgggcacttattgagctg

SEQ ID NO: 513820 - DNA, 25 bp, Rattus norvegicus
ggctgcttcttccatcacccggagg

SEQ ID NO: 513821 - DNA, 25 bp, Rattus norvegicus
tgggttctcggtgactgcacaactc

SEQ ID NO: 513822 - DNA, 25 bp, Rattus norvegicus
ccaggattcgctgtgaagaagagtt

SEQ ID NO: 513823 - DNA, 25 bp, Rattus norvegicus
tgcacagccggagacttgggttctc

SEQ ID NO: 513824 - DNA, 25 bp, Rattus norvegicus
ccgtggccgcagactggcccagaaa

SEQ ID NO: 513825 - DNA, 25 bp, Rattus norvegicus
ctggcccagaaaagactctgtacgg

SEQ ID NO: 513826 - DNA, 25 bp, Rattus norvegicus
ctctgtacgggtagctggaggcaaa

SEQ ID NO: 513827 - DNA, 25 bp, Rattus norvegicus
ctggaggcaaaagagcgggatccca

SEQ ID NO: 513828 - DNA, 25 bp, Rattus norvegicus
ccgggaggatgctgctacccgactc

SEQ ID NO: 513829 - DNA, 25 bp, Rattus norvegicus
ctggagatgcgacccggttcaaggc

SEQ ID NO: 513830 - DNA, 25 bp, Rattus norvegicus
ctccagccgctagtcgcagaactga

SEQ ID NO: 513831 - DNA, 25 bp, Rattus norvegicus
cagaactgagctctaggtgcgcccg

SEQ ID NO: 513832 - DNA, 25 bp, Rattus norvegicus
ttctgcccttcgaggtcccgaggca

SEQ ID NO: 513833 - DNA, 25 bp, Rattus norvegicus
tgcacaactcggctcccaggattcg

SEQ ID NO: 513834 - DNA, 25 bp, Rattus norvegicus
accggaccactgtctgaatcactgg

SEQ ID NO: 513835 - DNA, 25 bp, Rattus norvegicus
tccctctggtcttccggtgaattgc

SEQ ID NO: 513836 - DNA, 25 bp, Rattus norvegicus
ggcccagtagccgaatgccgaaata

SEQ ID NO: 513837 - DNA, 25 bp, Rattus norvegicus
tgtcggccatcttgagctttgctcc

SEQ ID NO: 513838 - DNA, 25 bp, Rattus norvegicus
gccttctgagatccgcctggcgttt

SEQ ID NO: 513839 - DNA, 25 bp, Rattus norvegicus
ctacctttgaactggccttctgaga

SEQ ID NO: 513840 - DNA, 25 bp, Rattus norvegicus
cccactgactgacggagatctctaa

SEQ ID NO: 513841 - DNA, 25 bp, Rattus norvegicus
agggatttctgtaggctcctgacca

SEQ ID NO: 513842 - DNA, 25 bp, Rattus norvegicus
tgccaggcccactatggcgaacagg

SEQ ID NO: 513843 - DNA, 25 bp, Rattus norvegicus
agctgcgacacaaggacaccggacc

SEQ ID NO: 513844 - DNA, 25 bp, Rattus norvegicus
aattgcggcgtctagtcacgtcacg

SEQ ID NO: 513845 - DNA, 25 bp, Rattus norvegicus
gtgacttccgcgtcaagtcgcttca

SEQ ID NO: 513846 - DNA, 25 bp, Rattus norvegicus
taagctctcgaaggccagggatttc

SEQ ID NO: 513847 - DNA, 25 bp, Rattus norvegicus
gtcgagcaccgaaagaacagatatc

SEQ ID NO: 513848 - DNA, 25 bp, Rattus norvegicus
gtctctaagcgggtaccgcagtgcc

SEQ ID NO: 513849 - DNA, 25 bp, Rattus norvegicus
cacctccgcaggttacagttagagc

SEQ ID NO: 513850 - DNA, 25 bp, Rattus norvegicus
ccaggctcggatctggacaccgtct

SEQ ID NO: 513851 - DNA, 25 bp, Rattus norvegicus
tcggatctggacaccgtctctaagc

SEQ ID NO: 513852 - DNA, 25 bp, Rattus norvegicus
acaccgtctctaagcgggtaccgca

SEQ ID NO: 513853 - DNA, 25 bp, Rattus norvegicus
ctgccacctccgcaggttacagtta

SEQ ID NO: 513854 - DNA, 25 bp, Rattus norvegicus
ggttacagttagagcatccctccgc

SEQ ID NO: 513855 - DNA, 25 bp, Rattus norvegicus
tagagcatccctccgcccagtcggg

SEQ ID NO: 513856 - DNA, 25 bp, Rattus norvegicus
cctgtgtcctctagaacgccggcgt

SEQ ID NO: 513857 - DNA, 25 bp, Rattus norvegicus
cggccgcgtctctggccagcctccc

SEQ ID NO: 513858 - DNA, 25 bp, Rattus norvegicus
cggcgtggctgtcgcgcttcgaacc

SEQ ID NO: 513859 - DNA, 25 bp, Rattus norvegicus
tgtcctctagaacgccggcgtggct

SEQ ID NO: 513860 - DNA, 25 bp, Rattus norvegicus
tctggacaccgtctctaagcgggta

SEQ ID NO: 513861 - DNA, 25 bp, Rattus norvegicus
tccgcaggttacagttagagcatcc

SEQ ID NO: 513862 - DNA, 25 bp, Rattus norvegicus
tgctgctgaccttcgccatgagctg

SEQ ID NO: 513863 - DNA, 25 bp, Rattus norvegicus
gtggccgccttcttcaacgtgagca

SEQ ID NO: 513864 - DNA, 25 bp, Rattus norvegicus
agagagctggctcttcgacctgcga

SEQ ID NO: 513865 - DNA, 25 bp, Rattus norvegicus
gcctgcactgtagcctgctgcaaga

SEQ ID NO: 513866 - DNA, 25 bp, Rattus norvegicus
agctactacggcttcggcagcaccg

SEQ ID NO: 513867 - DNA, 25 bp, Rattus norvegicus
cgacgacttcgtggagtgcttcatc

SEQ ID NO: 513868 - DNA, 25 bp, Rattus norvegicus
aagttctgccgcctcttcttcctgg

SEQ ID NO: 513869 - DNA, 25 bp, Rattus norvegicus
cgctgctgctgttcctcagtaagtt

SEQ ID NO: 513870 - DNA, 25 bp, Rattus norvegicus
gacgctcaacttctggacgcacttc

SEQ ID NO: 513871 - DNA, 25 bp, Rattus norvegicus
tgctgaagcccaccaacgagacgct

SEQ ID NO: 513872 - DNA, 25 bp, Rattus norvegicus
agtgcttcatcctgtccggctaccg

SEQ ID NO: 513873 - DNA, 25 bp, Rattus norvegicus
gcggcagtgatgtgcccttccacca

SEQ ID NO: 513874 - DNA, 25 bp, Rattus norvegicus
cgccagagtcatgacgccatacgtg

SEQ ID NO: 513875 - DNA, 25 bp, Rattus norvegicus
ttcgtcttcgtcatgccgctcagca

SEQ ID NO: 513876 - DNA, 25 bp, Rattus norvegicus
cgcgtctgcagcgtctttgagcacc

SEQ ID NO: 513877 - DNA, 25 bp, Rattus norvegicus
gcctagcatcctgggcgcgtctgca

SEQ ID NO: 513878 - DNA, 25 bp, Rattus norvegicus
agcgtctttgagcacctgagcgccg

SEQ ID NO: 513879 - DNA, 25 bp, Rattus norvegicus
tctctggtcggtcgcctagcatcct

SEQ ID NO: 513880 - DNA, 25 bp, Rattus norvegicus
gagacagaggttcgcggctttctcc

SEQ ID NO: 513881 - DNA, 25 bp, Rattus norvegicus
ggctttctcctcacgtcatcctcag

SEQ ID NO: 513882 - DNA, 25 bp, Rattus norvegicus
cttcagggctgacgcgcctctctgg

SEQ ID NO: 513883 - DNA, 25 bp, Rattus norvegicus
ggccacatctgtgtgcggcccgttg

SEQ ID NO: 513884 - DNA, 25 bp, Rattus norvegicus
cagtacgtctggctccggagctgtg

SEQ ID NO: 513885 - DNA, 25 bp, Rattus norvegicus
agcgctttgcagtacgtctggctcc

SEQ ID NO: 513886 - DNA, 25 bp, Rattus norvegicus
ggaaccagcattcgccctccaccga

SEQ ID NO: 513887 - DNA, 25 bp, Rattus norvegicus
ccagagaggtccgtgctcgggtaca

SEQ ID NO: 513888 - DNA, 25 bp, Rattus norvegicus
tgctcgggtacagggccgccatcat

SEQ ID NO: 513889 - DNA, 25 bp, Rattus norvegicus
gtgagtcgttcccacggccacatct

SEQ ID NO: 513890 - DNA, 25 bp, Rattus norvegicus
ccgcgcccgcttgcgcgtcctgaca

SEQ ID NO: 513891 - DNA, 25 bp, Rattus norvegicus
cgcacgcttgaaatccacttgccgg

SEQ ID NO: 513892 - DNA, 25 bp, Rattus norvegicus
cgcttgaaatccacttgccgggttt

SEQ ID NO: 513893 - DNA, 25 bp, Rattus norvegicus
tgccgggttttagttgccgcaccca

SEQ ID NO: 513894 - DNA, 25 bp, Rattus norvegicus
cgccactgcgcatgctcgtcccgca

SEQ ID NO: 513895 - DNA, 25 bp, Rattus norvegicus
ggtccactctgctgcggctacttct

SEQ ID NO: 513896 - DNA, 25 bp, Rattus norvegicus
cgctggtctggtccactctgctgcg

SEQ ID NO: 513897 - DNA, 25 bp, Rattus norvegicus
tttagttgccgcacccaggggagtg

SEQ ID NO: 513898 - DNA, 25 bp, Rattus norvegicus
agccaagcttggctttcccgcacgg

SEQ ID NO: 513899 - DNA, 25 bp, Rattus norvegicus
cgccaagcgcggctaagccaagctt

SEQ ID NO: 513900 - DNA, 25 bp, Rattus norvegicus
caagcgctcgccaagcgcggctaag

SEQ ID NO: 513901 - DNA, 25 bp, Rattus norvegicus
caggtgtcggagacgcccgcgtcca

SEQ ID NO: 513902 - DNA, 25 bp, Rattus norvegicus
gccgttcggcagctactgcccgaga

SEQ ID NO: 513903 - DNA, 25 bp, Rattus norvegicus
ctgcggcggccgttcggcagctact

SEQ ID NO: 513904 - DNA, 25 bp, Rattus norvegicus
actaacagcggcttccgggaggagt

SEQ ID NO: 513905 - DNA, 25 bp, Rattus norvegicus
tgctctctcacagtggcagttggtc

SEQ ID NO: 513906 - DNA, 25 bp, Rattus norvegicus
cctgtgggcgctgctctctcacagt

SEQ ID NO: 513907 - DNA, 25 bp, Rattus norvegicus
caggtagggccacgcgtcgtcgcca

SEQ ID NO: 513908 - DNA, 25 bp, Rattus norvegicus
atgattcccgccctgcgggagttgg

SEQ ID NO: 513909 - DNA, 25 bp, Rattus norvegicus
gctggagctggcgtccatgattccc

SEQ ID NO: 513910 - DNA, 25 bp, Rattus norvegicus
cgctcggtgtcaccatgggtgacca

SEQ ID NO: 513911 - DNA, 25 bp, Rattus norvegicus
ttttgagagccgctcggtgtcacca

SEQ ID NO: 513912 - DNA, 25 bp, Rattus norvegicus
gactgtagagaagcccggcactggc

SEQ ID NO: 513913 - DNA, 25 bp, Rattus norvegicus
ggagttttggacctcgcgtgcctcc

SEQ ID NO: 513914 - DNA, 25 bp, Rattus norvegicus
aggtcccaacagcaactaacagcgg

SEQ ID NO: 513915 - DNA, 25 bp, Rattus norvegicus
cactcgcttaggaggaaaagtaggc

SEQ ID NO: 513916 - DNA, 25 bp, Rattus norvegicus
agggttcacgcactcgcttaggagg

SEQ ID NO: 513917 - DNA, 25 bp, Rattus norvegicus
tccgggcgcgactgtagagaagccc

SEQ ID NO: 513918 - DNA, 25 bp, Rattus norvegicus
gcgtttggtttcgtttctgcaccga

SEQ ID NO: 513919 - DNA, 25 bp, Rattus norvegicus
tgtcgacggtcaaaatgggagtccc

SEQ ID NO: 513920 - DNA, 25 bp, Rattus norvegicus
tcttgcgccgtcaccaacgagtaag

SEQ ID NO: 513921 - DNA, 25 bp, Rattus norvegicus
tctggcggaccttgtgttgtcatcc

SEQ ID NO: 513922 - DNA, 25 bp, Rattus norvegicus
gtgagctcaggccatggcgcaagaa

SEQ ID NO: 513923 - DNA, 25 bp, Rattus norvegicus
ccaagttttaccgatggatctcgga

SEQ ID NO: 513924 - DNA, 25 bp, Rattus norvegicus
ctcagcgaagtggtgaaggagcatc

SEQ ID NO: 513925 - DNA, 25 bp, Rattus norvegicus
ttctgcaccgactggaattagtgtc

SEQ ID NO: 513926 - DNA, 25 bp, Rattus norvegicus
tgtgttgtcatcctccgagcgacgg

SEQ ID NO: 513927 - DNA, 25 bp, Rattus norvegicus
agtttactctatggtctggcggacc

SEQ ID NO: 513928 - DNA, 25 bp, Rattus norvegicus
ctctaggcccacagtttactctatg

SEQ ID NO: 513929 - DNA, 25 bp, Rattus norvegicus
cgggatagataggacccaccgccca

SEQ ID NO: 513930 - DNA, 25 bp, Rattus norvegicus
tcaccaacgagtaaggaagagcaga

SEQ ID NO: 513931 - DNA, 25 bp, Rattus norvegicus
taccgatggatctcggagcgatacc

SEQ ID NO: 513932 - DNA, 25 bp, Rattus norvegicus
aacctaggacctagcggctgcgatg

SEQ ID NO: 513933 - DNA, 25 bp, Rattus norvegicus
cacggtcacgattggctcccggcag

SEQ ID NO: 513934 - DNA, 25 bp, Rattus norvegicus
ggtgcgctcgcactactgcgcactg

SEQ ID NO: 513935 - DNA, 25 bp, Rattus norvegicus
agtgtgcgccttctactacctgggc

SEQ ID NO: 513936 - DNA, 25 bp, Rattus norvegicus
ttctccagcgccaccaagaggctga

SEQ ID NO: 513937 - DNA, 25 bp, Rattus norvegicus
ctccggtgccaaggccaagaacctg

SEQ ID NO: 513938 - DNA, 25 bp, Rattus norvegicus
ggtggactaccacctgctcatgatg

SEQ ID NO: 513939 - DNA, 25 bp, Rattus norvegicus
tgctcatgatgttcaccaaggcgga

SEQ ID NO: 513940 - DNA, 25 bp, Rattus norvegicus
tcaccaaggcggagcacaacgcggc

SEQ ID NO: 513941 - DNA, 25 bp, Rattus norvegicus
acaacgcggcgctgcaggccaaggc

SEQ ID NO: 513942 - DNA, 25 bp, Rattus norvegicus
gccctttaggtgtccacggtcacga

SEQ ID NO: 513943 - DNA, 25 bp, Rattus norvegicus
cacttcgtgagcgaagaggccagcc

SEQ ID NO: 513944 - DNA, 25 bp, Rattus norvegicus
aggtgcttaacctccacttcgtgag

SEQ ID NO: 513945 - DNA, 25 bp, Rattus norvegicus
tcgccaagttcgagccgcacgaggt

SEQ ID NO: 513946 - DNA, 25 bp, Rattus norvegicus
agcgtcggcttaaatccactcttag

SEQ ID NO: 513947 - DNA, 25 bp, Rattus norvegicus
agatcgcgggaagctgccaagactt

SEQ ID NO: 513948 - DNA, 25 bp, Rattus norvegicus
cgtcgctaggttcgaggacattgga

SEQ ID NO: 513949 - DNA, 25 bp, Rattus norvegicus
gattcagcgttcgagctacaagttg

SEQ ID NO: 513950 - DNA, 25 bp, Rattus norvegicus
gccggtgtttccgttatatcacttc

SEQ ID NO: 513951 - DNA, 25 bp, Rattus norvegicus
caaatctttgctagcccggaacccg

SEQ ID NO: 513952 - DNA, 25 bp, Rattus norvegicus
attgaaactgtagactggggctgca

SEQ ID NO: 513953 - DNA, 25 bp, Rattus norvegicus
agctcctccagactgcgcaacagaa

SEQ ID NO: 513954 - DNA, 25 bp, Rattus norvegicus
tacaagttgtgtcgtcgctaggttc

SEQ ID NO: 513955 - DNA, 25 bp, Rattus norvegicus
gaataccagttctagcgtcggctta

SEQ ID NO: 513956 - DNA, 25 bp, Rattus norvegicus
ctttaggtctcttccacaattaagg

SEQ ID NO: 513957 - DNA, 25 bp, Rattus norvegicus
acgccgccgctgagatcctttaggt

SEQ ID NO: 513958 - DNA, 25 bp, Rattus norvegicus
tgcgcaacagaatcgcaaatctttg

SEQ ID NO: 513959 - DNA, 25 bp, Rattus norvegicus
tttccagccctaaatccggtcagga

SEQ ID NO: 513960 - DNA, 25 bp, Rattus norvegicus
gggtgcctgtcgctcgcttcctgtc

SEQ ID NO: 513961 - DNA, 25 bp, Rattus norvegicus
tgccacgtctatgaccggacggcgc

SEQ ID NO: 513962 - DNA, 25 bp, Rattus norvegicus
cacggtgatccgctgccacgtctat

SEQ ID NO: 513963 - DNA, 25 bp, Rattus norvegicus
gccctctcgcttcgtgctggggctg

SEQ ID NO: 513964 - DNA, 25 bp, Rattus norvegicus
tttataggtctacgctggccggcca

SEQ ID NO: 513965 - DNA, 25 bp, Rattus norvegicus
tcggggtctggcgtttataggtcta

SEQ ID NO: 513966 - DNA, 25 bp, Rattus norvegicus
tgccaatttcccaggagccgctcgg

SEQ ID NO: 513967 - DNA, 25 bp, Rattus norvegicus
cgccatctttgccaatttcccagga

SEQ ID NO: 513968 - DNA, 25 bp, Rattus norvegicus
gcggtaaacgccatctttgccaatt

SEQ ID NO: 513969 - DNA, 25 bp, Rattus norvegicus
cagcactatgctgcggtaaacgcca

SEQ ID NO: 513970 - DNA, 25 bp, Rattus norvegicus
aaccgtgacatccagcactatgctg

SEQ ID NO: 513971 - DNA, 25 bp, Rattus norvegicus
ggtcgctgaaccgtgacatccagca

SEQ ID NO: 513972 - DNA, 25 bp, Rattus norvegicus
tctggggttctgactgtatcgtcgc

SEQ ID NO: 513973 - DNA, 25 bp, Rattus norvegicus
tgactgtatcgtcgctcttcctgca

SEQ ID NO: 513974 - DNA, 25 bp, Rattus norvegicus
gggtttctctgcagctcagccaagc

SEQ ID NO: 513975 - DNA, 25 bp, Rattus norvegicus
cctcttgtcccggtggcgagcctgg

SEQ ID NO: 513976 - DNA, 25 bp, Rattus norvegicus
cccgaatacctgatgaggctcccga

SEQ ID NO: 513977 - DNA, 25 bp, Rattus norvegicus
agcttgtcctcagggtttctctgca

SEQ ID NO: 513978 - DNA, 25 bp, Rattus norvegicus
aatcgcagcttgtcctcagggtttc

SEQ ID NO: 513979 - DNA, 25 bp, Rattus norvegicus
ccctgtctcgggaatcgcagcttgt

SEQ ID NO: 513980 - DNA, 25 bp, Rattus norvegicus
tctgcaacgagctgcggtaaggtcc

SEQ ID NO: 513981 - DNA, 25 bp, Rattus norvegicus
gcctctctgcaacgagctgcggtaa

SEQ ID NO: 513982 - DNA, 25 bp, Rattus norvegicus
tctgccttgaggaacggcggcttgc

SEQ ID NO: 513983 - DNA, 25 bp, Rattus norvegicus
atccgacctggctctgccttgagga

SEQ ID NO: 513984 - DNA, 25 bp, Rattus norvegicus
cgggcgtgagctcgctccgatccga

SEQ ID NO: 513985 - DNA, 25 bp, Rattus norvegicus
gcaggcttccgacgcgcgcgaagac

SEQ ID NO: 513986 - DNA, 25 bp, Rattus norvegicus
ggcggcttgcgaagaagcgtctccc

SEQ ID NO: 513987 - DNA, 25 bp, Rattus norvegicus
gccaatcggcgggtaccgtgctgct

SEQ ID NO: 513988 - DNA, 25 bp, Rattus norvegicus
cggaagtctgcagggcacagagacc

SEQ ID NO: 513989 - DNA, 25 bp, Rattus norvegicus
cagcgccgccgagtcacaagatagc

SEQ ID NO: 513990 - DNA, 25 bp, Rattus norvegicus
gcgggcagtggaaatttcctctccc

SEQ ID NO: 513991 - DNA, 25 bp, Rattus norvegicus
ctcgggtccgcaaagcggccgccca

SEQ ID NO: 513992 - DNA, 25 bp, Rattus norvegicus
cgggcaatgaatggggccgtccgcc

SEQ ID NO: 513993 - DNA, 25 bp, Rattus norvegicus
gcgcggcccgaaggcccagaacctc

SEQ ID NO: 513994 - DNA, 25 bp, Rattus norvegicus
ccacatctccaaggcccgtccatga

SEQ ID NO: 513995 - DNA, 25 bp, Rattus norvegicus
cccgggctacttgcgcctgtagccc

SEQ ID NO: 513996 - DNA, 25 bp, Rattus norvegicus
ggaggcgaagcgctctccactgaag

SEQ ID NO: 513997 - DNA, 25 bp, Rattus norvegicus
ccgcccaggtgcgaggaagccagcg

SEQ ID NO: 513998 - DNA, 25 bp, Rattus norvegicus
cgtaggaggcgaagcgctctccact

SEQ ID NO: 513999 - DNA, 25 bp, Rattus norvegicus
ccgagtcacaagatagcgggcagtg

SEQ ID NO: 514000 - DNA, 25 bp, Rattus norvegicus
cactgaagcccaggccgtggcccgc

SEQ ID NO: 514001 - DNA, 25 bp, Rattus norvegicus
ggcccgcagcttgcgacgtagtagt

SEQ ID NO: 514002 - DNA, 25 bp, Rattus norvegicus
atcacctggaccctgcagatggcgc

SEQ ID NO: 514003 - DNA, 25 bp, Rattus norvegicus
atcttgtcgcctcccgacttggagc

SEQ ID NO: 514004 - DNA, 25 bp, Rattus norvegicus
ttggagcctgcgctcccagaatgcg

SEQ ID NO: 514005 - DNA, 25 bp, Rattus norvegicus
ctcccagaatgcgaggaaaggacgc

SEQ ID NO: 514006 - DNA, 25 bp, Rattus norvegicus
tcttgagggagaacatcttgtcgcc

SEQ ID NO: 514007 - DNA, 25 bp, Rattus norvegicus
tggcgcaggtatcgcactcaacgtc

SEQ ID NO: 514008 - DNA, 25 bp, Rattus norvegicus
ggctaccgcgttccacttcttgagg

SEQ ID NO: 514009 - DNA, 25 bp, Rattus norvegicus
gtgcatcgcttacccatcacctgga

SEQ ID NO: 514010 - DNA, 25 bp, Rattus norvegicus
agcggtcccgacttcgcgtgcatcg

SEQ ID NO: 514011 - DNA, 25 bp, Rattus norvegicus
tctggaggcccggtccagcattcgc

SEQ ID NO: 514012 - DNA, 25 bp, Rattus norvegicus
gaactatccggtgtctggaggcccg

SEQ ID NO: 514013 - DNA, 25 bp, Rattus norvegicus
cttcctgcaggaactatccggtgtc

SEQ ID NO: 514014 - DNA, 25 bp, Rattus norvegicus
tggccgctaggctgcccaggaaaac

SEQ ID NO: 514015 - DNA, 25 bp, Rattus norvegicus
atccgctgtgggatttgctggccgc

SEQ ID NO: 514016 - DNA, 25 bp, Rattus norvegicus
ccctcacgccggtgcgcgcgtgcag

SEQ ID NO: 514017 - DNA, 25 bp, Rattus norvegicus
cctgcgtagcccgtcaaggcggagc

SEQ ID NO: 514018 - DNA, 25 bp, Rattus norvegicus
ctcccgcgtccaggccgcgctccag

SEQ ID NO: 514019 - DNA, 25 bp, Rattus norvegicus
gcttacagatcctgccgcgcaggct

SEQ ID NO: 514020 - DNA, 25 bp, Rattus norvegicus
ctgcatccgcctcgcccaacctccc

SEQ ID NO: 514021 - DNA, 25 bp, Rattus norvegicus
aggccggatcgagcctcgctctagc

SEQ ID NO: 514022 - DNA, 25 bp, Rattus norvegicus
cagtcccaccagtcccgggcggccg

SEQ ID NO: 514023 - DNA, 25 bp, Rattus norvegicus
accgcagccctaccgcctgcgtagc

SEQ ID NO: 514024 - DNA, 25 bp, Rattus norvegicus
ttaaagccgccgcagcaggcgctgc

SEQ ID NO: 514025 - DNA, 25 bp, Rattus norvegicus
ggcgcctcggttaaagccgccgcag

SEQ ID NO: 514026 - DNA, 25 bp, Rattus norvegicus
tctcccgtctcgggttctgcggtgc

SEQ ID NO: 514027 - DNA, 25 bp, Rattus norvegicus
acgactgtcctcgtctcccgtctcg

SEQ ID NO: 514028 - DNA, 25 bp, Rattus norvegicus
tgcagcactcggacctcacgactgt

SEQ ID NO: 514029 - DNA, 25 bp, Rattus norvegicus
ctgtgcccgccctgcatccgcctcg

SEQ ID NO: 514030 - DNA, 25 bp, Rattus norvegicus
gtccatggcgcttccggacctgcga

SEQ ID NO: 514031 - DNA, 25 bp, Rattus norvegicus
tgcgggccgcaaagcttcagcacag

SEQ ID NO: 514032 - DNA, 25 bp, Rattus norvegicus
tgcagagccaggctcgcacagggct

SEQ ID NO: 514033 - DNA, 25 bp, Rattus norvegicus
cacagggctgcgcagccacagaaca

SEQ ID NO: 514034 - DNA, 25 bp, Rattus norvegicus
aggcccgacggtcgctagacctcgg

SEQ ID NO: 514035 - DNA, 25 bp, Rattus norvegicus
cgcagcgccgcccagaaaatggacg

SEQ ID NO: 514036 - DNA, 25 bp, Rattus norvegicus
cctggtccgccactggtgcagtgca

SEQ ID NO: 514037 - DNA, 25 bp, Rattus norvegicus
gctgactgctccgtaagctccgctg

SEQ ID NO: 514038 - DNA, 25 bp, Rattus norvegicus
tcaggaagcagctcgggtttgtgct

SEQ ID NO: 514039 - DNA, 25 bp, Rattus norvegicus
caacgcgatccggtagggtcaggaa

SEQ ID NO: 514040 - DNA, 25 bp, Rattus norvegicus
actagaatctcaacgcgatccggta

SEQ ID NO: 514041 - DNA, 25 bp, Rattus norvegicus
ggcttggtgtcgcactagaatctca

SEQ ID NO: 514042 - DNA, 25 bp, Rattus norvegicus
ccggttcaattccaggggcttggtg

SEQ ID NO: 514043 - DNA, 25 bp, Rattus norvegicus
cccagaaaatggacgccggcggctg

SEQ ID NO: 514044 - DNA, 25 bp, Rattus norvegicus
gtgccgcgcggactcaaaactgtca

SEQ ID NO: 514045 - DNA, 25 bp, Rattus norvegicus
aatcgctgaagtgcgtgctccggtg

SEQ ID NO: 514046 - DNA, 25 bp, Rattus norvegicus
ccgcgccgcggatctaatcgctgaa

SEQ ID NO: 514047 - DNA, 25 bp, Rattus norvegicus
tagacccgtcccagccttggcgtgg

SEQ ID NO: 514048 - DNA, 25 bp, Rattus norvegicus
gtgcttctccctacgccggacttag

SEQ ID NO: 514049 - DNA, 25 bp, Rattus norvegicus
tcggagcgcacaaggcctgtgcttc

SEQ ID NO: 514050 - DNA, 25 bp, Rattus norvegicus
gtcgtggaaagcacgcgcactcgga

SEQ ID NO: 514051 - DNA, 25 bp, Rattus norvegicus
cggtctcggagtgtccaaactgcca

SEQ ID NO: 514052 - DNA, 25 bp, Rattus norvegicus
cactccgggccttggaagcggacac

SEQ ID NO: 514053 - DNA, 25 bp, Rattus norvegicus
cctccgttgctctgcgtagggttct

SEQ ID NO: 514054 - DNA, 25 bp, Rattus norvegicus
cctgcgaggagcttcacaaccgctg

SEQ ID NO: 514055 - DNA, 25 bp, Rattus norvegicus
cccgcatcacggagacctctttggg

SEQ ID NO: 514056 - DNA, 25 bp, Rattus norvegicus
aaagagcttgttggtggggatcaca

SEQ ID NO: 514057 - DNA, 25 bp, Rattus norvegicus
actgtcaagatcctagccaccgtgc

SEQ ID NO: 514058 - DNA, 25 bp, Rattus norvegicus
aggcggtcgtcatcctttacgaaga

SEQ ID NO: 514059 - DNA, 25 bp, Rattus norvegicus
ggcatggccaaccttgcctcggatg

SEQ ID NO: 514060 - DNA, 25 bp, Rattus norvegicus
tgcctcggatgccatctgtgctctg

SEQ ID NO: 514061 - DNA, 25 bp, Rattus norvegicus
ttacgaagacattgagggatcggtc

SEQ ID NO: 514062 - DNA, 25 bp, Rattus norvegicus
gatcggtcctcagggttccacgcgt

SEQ ID NO: 514063 - DNA, 25 bp, Rattus norvegicus
cacgcgtgtctcagctgtacagcca

SEQ ID NO: 514064 - DNA, 25 bp, Rattus norvegicus
aagcccgctgcaggcatgtctagca

SEQ ID NO: 514065 - DNA, 25 bp, Rattus norvegicus
tctaagcctcggagctcccgcttgg

SEQ ID NO: 514066 - DNA, 25 bp, Rattus norvegicus
tgtctagcagctggtctagccgtgc

SEQ ID NO: 514067 - DNA, 25 bp, Rattus norvegicus
agaggcggctacgacccaggtccca

SEQ ID NO: 514068 - DNA, 25 bp, Rattus norvegicus
cgactcggagtcactgcctaccagt

SEQ ID NO: 514069 - DNA, 25 bp, Rattus norvegicus
ctgcctaccagtgcggtgtaaccca

SEQ ID NO: 514070 - DNA, 25 bp, Rattus norvegicus
tgtaacccacagagtgcaaaggggc

SEQ ID NO: 514071 - DNA, 25 bp, Rattus norvegicus
ggccaatggatctgccatgcatgca

SEQ ID NO: 514072 - DNA, 25 bp, Rattus norvegicus
cgcctcagcggcaaaaacgcggttg

SEQ ID NO: 514073 - DNA, 25 bp, Rattus norvegicus
tgctagattcaaccggtgtgcgttc

SEQ ID NO: 514074 - DNA, 25 bp, Rattus norvegicus
gtgtggcgagcaaagcggatttcaa

SEQ ID NO: 514075 - DNA, 25 bp, Rattus norvegicus
aggccgaaatcttgaatgaagcgaa

SEQ ID NO: 514076 - DNA, 25 bp, Rattus norvegicus
cgaaggagagtacttggcagtaata

SEQ ID NO: 514077 - DNA, 25 bp, Rattus norvegicus
ggctgaagatcaaacgcgtccgatg

SEQ ID NO: 514078 - DNA, 25 bp, Rattus norvegicus
tgcgggacaggtgactgtaagtctc

SEQ ID NO: 514079 - DNA, 25 bp, Rattus norvegicus
cacgccgggatcagctaaccgagta

SEQ ID NO: 514080 - DNA, 25 bp, Rattus norvegicus
ctaaccgagtagaacgcagacgatg

SEQ ID NO: 514081 - DNA, 25 bp, Rattus norvegicus
cagacgatgaaaaggcaatgtgcac

SEQ ID NO: 514082 - DNA, 25 bp, Rattus norvegicus
tgcacgcaatgaatatgctagattc

SEQ ID NO: 514083 - DNA, 25 bp, Rattus norvegicus
cgtggtccacggctgaagatcaaac

SEQ ID NO: 514084 - DNA, 25 bp, Rattus norvegicus
cgcggttgttctttctggcgttcac

SEQ ID NO: 514085 - DNA, 25 bp, Rattus norvegicus
cgcgtccgatggagcccataattca

SEQ ID NO: 514086 - DNA, 25 bp, Rattus norvegicus
ggctcccttcctgtggggttcgcaa

SEQ ID NO: 514087 - DNA, 25 bp, Rattus norvegicus
agaaaggtcgtgagtccgcagcctc

SEQ ID NO: 514088 - DNA, 25 bp, Rattus norvegicus
tgagccttcgcagagcaagatgagc

SEQ ID NO: 514089 - DNA, 25 bp, Rattus norvegicus
tcgaccctgagaccgacgagcaact

SEQ ID NO: 514090 - DNA, 25 bp, Rattus norvegicus
caggagaagtccgagcacaccgagc

SEQ ID NO: 514091 - DNA, 25 bp, Rattus norvegicus
ccgacactaagaaggctggggacca

SEQ ID NO: 514092 - DNA, 25 bp, Rattus norvegicus
tgggactaggattccggagagactc

SEQ ID NO: 514093 - DNA, 25 bp, Rattus norvegicus
ccgggacgtccaagcactttctgaa

SEQ ID NO: 514094 - DNA, 25 bp, Rattus norvegicus
ggaggaaacggcttccgccctctga

SEQ ID NO: 514095 - DNA, 25 bp, Rattus norvegicus
tttctacagcaagcttcggagtgcg

SEQ ID NO: 514096 - DNA, 25 bp, Rattus norvegicus
ccggttcgtaatttctgattggctc

SEQ ID NO: 514097 - DNA, 25 bp, Rattus norvegicus
cccgttgtcctgattggttagattc

SEQ ID NO: 514098 - DNA, 25 bp, Rattus norvegicus
tgcggtgctcagctcccaactcgag

SEQ ID NO: 514099 - DNA, 25 bp, Rattus norvegicus
acccggagccttcgcagtttctaca

SEQ ID NO: 514100 - DNA, 25 bp, Rattus norvegicus
ggcctcactcttgctccagatcttg

SEQ ID NO: 514101 - DNA, 25 bp, Rattus norvegicus
tcttgcccaccgctaggtcagtaca

SEQ ID NO: 514102 - DNA, 25 bp, Rattus norvegicus
cctcgctggtgatgtgcagcttctt

SEQ ID NO: 514103 - DNA, 25 bp, Rattus norvegicus
tttgcccgggcaagctcgaaaaata

SEQ ID NO: 514104 - DNA, 25 bp, Rattus norvegicus
gtgcaggctcacagcgtagccctta

SEQ ID NO: 514105 - DNA, 25 bp, Rattus norvegicus
tcgaacttgtgcttcttccacggca

SEQ ID NO: 514106 - DNA, 25 bp, Rattus norvegicus
tcatcttagtcccttgacggccggc

SEQ ID NO: 514107 - DNA, 25 bp, Rattus norvegicus
ctggaactcttcttcagcgaacgtg

SEQ ID NO: 514108 - DNA, 25 bp, Rattus norvegicus
taaaactcgagctgggaggacctcc

SEQ ID NO: 514109 - DNA, 25 bp, Rattus norvegicus
ttcttgcgcttggagcggaacatgc

SEQ ID NO: 514110 - DNA, 25 bp, Rattus norvegicus
ctcggccaaaacaaccgggatggtg

SEQ ID NO: 514111 - DNA, 25 bp, Rattus norvegicus
acacacaagtcttgggccagggcca

SEQ ID NO: 514112 - DNA, 25 bp, Rattus norvegicus
cgcactcacggtcagcttcatctta

SEQ ID NO: 514113 - DNA, 25 bp, Rattus norvegicus
ttcagcttcgagtgtgcaaaagaga

SEQ ID NO: 514114 - DNA, 25 bp, Rattus norvegicus
gccctaaagcttggcgcctgacctg

SEQ ID NO: 514115 - DNA, 25 bp, Rattus norvegicus
agcccttgccctggtggccctaaag

SEQ ID NO: 514116 - DNA, 25 bp, Rattus norvegicus
caggagctggagagcacttaccata

SEQ ID NO: 514117 - DNA, 25 bp, Rattus norvegicus
acgttcttggagaagttgacgctca

SEQ ID NO: 514118 - DNA, 25 bp, Rattus norvegicus
gcggagacatttccaccgacccgga

SEQ ID NO: 514119 - DNA, 25 bp, Rattus norvegicus
gctgcagctgaaagccgatccggct

SEQ ID NO: 514120 - DNA, 25 bp, Rattus norvegicus
agtgcccgactacgctgatctcaga

SEQ ID NO: 514121 - DNA, 25 bp, Rattus norvegicus
gacgcgtcctctcagttgtacccgg

SEQ ID NO: 514122 - DNA, 25 bp, Rattus norvegicus
ccataaaagagaagacgagcgcccg

SEQ ID NO: 514123 - DNA, 25 bp, Rattus norvegicus
tgcttctcagtcagcgacgcgtcct

SEQ ID NO: 514124 - DNA, 25 bp, Rattus norvegicus
tggcgcggacgccattcactcatct

SEQ ID NO: 514125 - DNA, 25 bp, Rattus norvegicus
aggccactaatccaatagccgcgga

SEQ ID NO: 514126 - DNA, 25 bp, Rattus norvegicus
ctgagctcatccctgaaggccacta

SEQ ID NO: 514127 - DNA, 25 bp, Rattus norvegicus
aatctcgcactcagggcactcgggc

SEQ ID NO: 514128 - DNA, 25 bp, Rattus norvegicus
ctgctctggtttctcgggcagcatc

SEQ ID NO: 514129 - DNA, 25 bp, Rattus norvegicus
tgccgtccaattggcgtctcgattg

SEQ ID NO: 514130 - DNA, 25 bp, Rattus norvegicus
atcggctaagcgcaccaaaaagggt

SEQ ID NO: 514131 - DNA, 25 bp, Rattus norvegicus
gcttgccgggttggagcatccaata

SEQ ID NO: 514132 - DNA, 25 bp, Rattus norvegicus
gacgtagcttccagacgagccaatc

SEQ ID NO: 514133 - DNA, 25 bp, Rattus norvegicus
tgagccaatcaacagcggcgctggt

SEQ ID NO: 514134 - DNA, 25 bp, Rattus norvegicus
agtcgcagctcaggtacctcttagg

SEQ ID NO: 514135 - DNA, 25 bp, Rattus norvegicus
atcaccgtcctgcttcgggcatgga

SEQ ID NO: 514136 - DNA, 25 bp, Rattus norvegicus
agatctggcctcctccgcggcataa

SEQ ID NO: 514137 - DNA, 25 bp, Rattus norvegicus
tggcggacctccgagaaaggcttga

SEQ ID NO: 514138 - DNA, 25 bp, Rattus norvegicus
tctgcacctcggagttcccttgaga

SEQ ID NO: 514139 - DNA, 25 bp, Rattus norvegicus
gcaggagccagtcaaataagcacta

SEQ ID NO: 514140 - DNA, 25 bp, Rattus norvegicus
acgggcccggaaagccagatactga

SEQ ID NO: 514141 - DNA, 25 bp, Rattus norvegicus
gtggagcgcccttttgacgcttaaa

SEQ ID NO: 514142 - DNA, 25 bp, Rattus norvegicus
tacagacaggctaggccgcgactca

SEQ ID NO: 514143 - DNA, 25 bp, Rattus norvegicus
agtagtggctcgtcttgccctcgca

SEQ ID NO: 514144 - DNA, 25 bp, Rattus norvegicus
ccgcgggcaagagcactgcaatacc

SEQ ID NO: 514145 - DNA, 25 bp, Rattus norvegicus
tgcctccgctgtcgcgcagtacaga

SEQ ID NO: 514146 - DNA, 25 bp, Rattus norvegicus
cggcaaacagatgcaccagcgtgtc

SEQ ID NO: 514147 - DNA, 25 bp, Rattus norvegicus
agcgtgtccctctggctcattctct

SEQ ID NO: 514148 - DNA, 25 bp, Rattus norvegicus
ttctctcttctgcatgtcctcaggg

SEQ ID NO: 514149 - DNA, 25 bp, Rattus norvegicus
gctgggttcctgctccagcgagctc

SEQ ID NO: 514150 - DNA, 25 bp, Rattus norvegicus
tgaggagtcggaggtccctacataa

SEQ ID NO: 514151 - DNA, 25 bp, Rattus norvegicus
gtccctacataaacagaagctccta

SEQ ID NO: 514152 - DNA, 25 bp, Rattus norvegicus
cagaagctcctattgggttaggcta

SEQ ID NO: 514153 - DNA, 25 bp, Rattus norvegicus
attgggttaggctacgtgacgtcac

SEQ ID NO: 514154 - DNA, 25 bp, Rattus norvegicus
gtgacgtcacgagattcgcacgccc

SEQ ID NO: 514155 - DNA, 25 bp, Rattus norvegicus
ggagaccgaacctgctcccattttg

SEQ ID NO: 514156 - DNA, 25 bp, Rattus norvegicus
tgaggaccttctgtagagacacagg

SEQ ID NO: 514157 - DNA, 25 bp, Rattus norvegicus
gtgatgcgccctttgaaccgacctc

SEQ ID NO: 514158 - DNA, 25 bp, Rattus norvegicus
accctaccgtgatgcgccctttgaa

SEQ ID NO: 514159 - DNA, 25 bp, Rattus norvegicus
acacaggcgaccctaccgtgatgcg

SEQ ID NO: 514160 - DNA, 25 bp, Rattus norvegicus
ttctgtagagacacaggcgacccta

SEQ ID NO: 514161 - DNA, 25 bp, Rattus norvegicus
tgatcacccgcttcctgaggacctt

SEQ ID NO: 514162 - DNA, 25 bp, Rattus norvegicus
accaagtgatcacccgcttcctgag

SEQ ID NO: 514163 - DNA, 25 bp, Rattus norvegicus
tgcgagcgccaccaccaagtgatca

SEQ ID NO: 514164 - DNA, 25 bp, Rattus norvegicus
ggctttccaaactgccgccgcgagg

SEQ ID NO: 514165 - DNA, 25 bp, Rattus norvegicus
ctccaggggagccttagggcctggc

SEQ ID NO: 514166 - DNA, 25 bp, Rattus norvegicus
gcccgctccggagggcacccttgcg

SEQ ID NO: 514167 - DNA, 25 bp, Rattus norvegicus
atcaggctgggtcaggcgcccgctc

SEQ ID NO: 514168 - DNA, 25 bp, Rattus norvegicus
gctcactcgcgtgatcaggctgggt

SEQ ID NO: 514169 - DNA, 25 bp, Rattus norvegicus
agagacacaggcgaccctaccgtga

SEQ ID NO: 514170 - DNA, 25 bp, Rattus norvegicus
tcggatccctcctgcagcacgtata

SEQ ID NO: 514171 - DNA, 25 bp, Rattus norvegicus
tccattggcctaactggcttccagc

SEQ ID NO: 514172 - DNA, 25 bp, Rattus norvegicus
ggcttccagcgactggtcataacga

SEQ ID NO: 514173 - DNA, 25 bp, Rattus norvegicus
gtcataacgaggagcgtgccaccca

SEQ ID NO: 514174 - DNA, 25 bp, Rattus norvegicus
aacagccttgactgctgcccgcgtg

SEQ ID NO: 514175 - DNA, 25 bp, Rattus norvegicus
ttctgacggacaggatcgggttgac

SEQ ID NO: 514176 - DNA, 25 bp, Rattus norvegicus
ttacagcgtattgtccggtgttctc

SEQ ID NO: 514177 - DNA, 25 bp, Rattus norvegicus
acgaggccctgagtccgacgtacct

SEQ ID NO: 514178 - DNA, 25 bp, Rattus norvegicus
caaagctcggttcggacacccagga

SEQ ID NO: 514179 - DNA, 25 bp, Rattus norvegicus
ccacagcgggaagctgggagctcaa

SEQ ID NO: 514180 - DNA, 25 bp, Rattus norvegicus
ggagctcaaggtcaagttcactctg

SEQ ID NO: 514181 - DNA, 25 bp, Rattus norvegicus
gtctagcccgtgacctgattctcca

SEQ ID NO: 514182 - DNA, 25 bp, Rattus norvegicus
tccactctggtcgagcagcagattc

SEQ ID NO: 514183 - DNA, 25 bp, Rattus norvegicus
gcgccgcgcagttaagcacagccaa

SEQ ID NO: 514184 - DNA, 25 bp, Rattus norvegicus
agcaacgagaatttcgaggagtacc

SEQ ID NO: 514185 - DNA, 25 bp, Rattus norvegicus
aatttcgaggagtacctgcgtgcgc

SEQ ID NO: 514186 - DNA, 25 bp, Rattus norvegicus
ttcgaggagtacctgcgtgcgctcg

SEQ ID NO: 514187 - DNA, 25 bp, Rattus norvegicus
aacgagaatttcgaggagtacctgc

SEQ ID NO: 514188 - DNA, 25 bp, Rattus norvegicus
gcccttcacccggagcgcattggca

SEQ ID NO: 514189 - DNA, 25 bp, Rattus norvegicus
ccgccttctccgtgtcgggcgatcc

SEQ ID NO: 514190 - DNA, 25 bp, Rattus norvegicus
cccaaaatgcctgtggacttcaacg

SEQ ID NO: 514191 - DNA, 25 bp, Rattus norvegicus
taagcgtgacccgcgcggtgcacaa

SEQ ID NO: 514192 - DNA, 25 bp, Rattus norvegicus
aaatgcctgtggacttcaacgggta

SEQ ID NO: 514193 - DNA, 25 bp, Rattus norvegicus
cctgtggacttcaacgggtactgga

SEQ ID NO: 514194 - DNA, 25 bp, Rattus norvegicus
cttcaacgggtactggaagatgctg

SEQ ID NO: 514195 - DNA, 25 bp, Rattus norvegicus
cgggtactggaagatgctgagcaac

SEQ ID NO: 514196 - DNA, 25 bp, Rattus norvegicus
agatgctgagcaacgagaatttcga

SEQ ID NO: 514197 - DNA, 25 bp, Rattus norvegicus
agccacagtcccagcggagcccaca

SEQ ID NO: 514198 - DNA, 25 bp, Rattus norvegicus
cgtgaactcctacaacggcctggga

SEQ ID NO: 514199 - DNA, 25 bp, Rattus norvegicus
gaagggctggcagaatagcatccgc

SEQ ID NO: 514200 - DNA, 25 bp, Rattus norvegicus
tactcgcgcgtgcagagcatggcgc

SEQ ID NO: 514201 - DNA, 25 bp, Rattus norvegicus
tgcaatcggggttcctcaacaactc

SEQ ID NO: 514202 - DNA, 25 bp, Rattus norvegicus
ttcgagaagggcaactaccggcgcc

SEQ ID NO: 514203 - DNA, 25 bp, Rattus norvegicus
agcctcaacgagtgcttcatcaagg

SEQ ID NO: 514204 - DNA, 25 bp, Rattus norvegicus
ttcccgttctacgagaagaacaaga

SEQ ID NO: 514205 - DNA, 25 bp, Rattus norvegicus
gtacatcatcgctaagttcccgttc

SEQ ID NO: 514206 - DNA, 25 bp, Rattus norvegicus
gtccggcatctaccagtacatcatc

SEQ ID NO: 514207 - DNA, 25 bp, Rattus norvegicus
agaggctcactctgtccggcatcta

SEQ ID NO: 514208 - DNA, 25 bp, Rattus norvegicus
tgagagcgccgagaagaggctcact

SEQ ID NO: 514209 - DNA, 25 bp, Rattus norvegicus
ccgtactcgtacgtggcgctcatcg

SEQ ID NO: 514210 - DNA, 25 bp, Rattus norvegicus
atcgccatggcgatccgtgagagcg

SEQ ID NO: 514211 - DNA, 25 bp, Rattus norvegicus
ggacagcgccagagaagccggaccc

SEQ ID NO: 514212 - DNA, 25 bp, Rattus norvegicus
tgagattccgccctgactgattttg

SEQ ID NO: 514213 - DNA, 25 bp, Rattus norvegicus
ccgccctgactgattttgttccatt

SEQ ID NO: 514214 - DNA, 25 bp, Rattus norvegicus
gaggaataatttgtttcgtattgga

SEQ ID NO: 514215 - DNA, 25 bp, Rattus norvegicus
tcgtattggaatcaaagcgcctctc

SEQ ID NO: 514216 - DNA, 25 bp, Rattus norvegicus
atcaaagcgcctctcgcggttcgtg

SEQ ID NO: 514217 - DNA, 25 bp, Rattus norvegicus
cctctcgcggttcgtgcgttttatc

SEQ ID NO: 514218 - DNA, 25 bp, Rattus norvegicus
gtgcgttttatctcggccgctctca

SEQ ID NO: 514219 - DNA, 25 bp, Rattus norvegicus
gctgcttcccattaggcccagcatg

SEQ ID NO: 514220 - DNA, 25 bp, Rattus norvegicus
attacgcgcccgactccgtgcggag

SEQ ID NO: 514221 - DNA, 25 bp, Rattus norvegicus
cccgctaactggacgcagctgaccc

SEQ ID NO: 514222 - DNA, 25 bp, Rattus norvegicus
cagctgacccgcctgtgcgtggcga

SEQ ID NO: 514223 - DNA, 25 bp, Rattus norvegicus
tgtgcgtggcgacacccaggacccg

SEQ ID NO: 514224 - DNA, 25 bp, Rattus norvegicus
gaatgacggccgtgagattccgccc

SEQ ID NO: 514225 - DNA, 25 bp, Rattus norvegicus
ctgattttgttccattccgggagga

SEQ ID NO: 514226 - DNA, 25 bp, Rattus norvegicus
cagcaagggcgggattggtcccaaa

SEQ ID NO: 514227 - DNA, 25 bp, Rattus norvegicus
gggagatgagaaccgcctacacgaa

SEQ ID NO: 514228 - DNA, 25 bp, Rattus norvegicus
tgaagccgctgctgattgcgtccct

SEQ ID NO: 514229 - DNA, 25 bp, Rattus norvegicus
ccgagtcttgaagccgctgctgatt

SEQ ID NO: 514230 - DNA, 25 bp, Rattus norvegicus
ggcttcggacctctccgagtcttga

SEQ ID NO: 514231 - DNA, 25 bp, Rattus norvegicus
tgcagcagcggacccttcggtgcct

SEQ ID NO: 514232 - DNA, 25 bp, Rattus norvegicus
tcggcagacaccaaaccgcggtggc

SEQ ID NO: 514233 - DNA, 25 bp, Rattus norvegicus
cggactccgaaatgcgtggtgccca

SEQ ID NO: 514234 - DNA, 25 bp, Rattus norvegicus
cggctcgaccgagcggactccgaaa

SEQ ID NO: 514235 - DNA, 25 bp, Rattus norvegicus
ggcgcatctagctcggctcgaccga

SEQ ID NO: 514236 - DNA, 25 bp, Rattus norvegicus
cagctgctgactacgtcgtgggatc

SEQ ID NO: 514237 - DNA, 25 bp, Rattus norvegicus
cacacactagcgcaagctcagtaga

SEQ ID NO: 514238 - DNA, 25 bp, Rattus norvegicus
ctacacgaacctcccgggttgcagg

SEQ ID NO: 514239 - DNA, 25 bp, Rattus norvegicus
gtaggcagggtaattggctttccgc

SEQ ID NO: 514240 - DNA, 25 bp, Rattus norvegicus
gtatttcagccaaggccgcgcgggt

SEQ ID NO: 514241 - DNA, 25 bp, Rattus norvegicus
ctcgaaaggaggtgccaccagcctc

SEQ ID NO: 514242 - DNA, 25 bp, Rattus norvegicus
gcgacctctgtggtcgcccactggg

SEQ ID NO: 514243 - DNA, 25 bp, Rattus norvegicus
ccgcaacgacactggctgggccgtt

SEQ ID NO: 514244 - DNA, 25 bp, Rattus norvegicus
ccgaggcacctgagggtctacagcc

SEQ ID NO: 514245 - DNA, 25 bp, Rattus norvegicus
aattgcgccgcgaacgctgagccga

SEQ ID NO: 514246 - DNA, 25 bp, Rattus norvegicus
gcaccgggactctgaccggtccgaa

SEQ ID NO: 514247 - DNA, 25 bp, Rattus norvegicus
tcccgcttcagggtatttcagccaa

SEQ ID NO: 514248 - DNA, 25 bp, Rattus norvegicus
agtattcacagttcccgcttcaggg

SEQ ID NO: 514249 - DNA, 25 bp, Rattus norvegicus
caacctcgggaggtgagtattcaca

SEQ ID NO: 514250 - DNA, 25 bp, Rattus norvegicus
gaggttagctcggtctcccgcaacc

SEQ ID NO: 514251 - DNA, 25 bp, Rattus norvegicus
actcaccgtgcaaggctcggcctgg

SEQ ID NO: 514252 - DNA, 25 bp, Rattus norvegicus
tctgaccggtccgaaaccggagagc

SEQ ID NO: 514253 - DNA, 25 bp, Rattus norvegicus
tgtgccgctgactgtgccgcgttcc

SEQ ID NO: 514254 - DNA, 25 bp, Rattus norvegicus
ttcgaagcagacaccgacaaggcgc

SEQ ID NO: 514255 - DNA, 25 bp, Rattus norvegicus
tcactgggtcgggtacttatccggc

SEQ ID NO: 514256 - DNA, 25 bp, Rattus norvegicus
atacgctgttatgggccggagaaga

SEQ ID NO: 514257 - DNA, 25 bp, Rattus norvegicus
ggttcgtgctgctgatacgctgtta

SEQ ID NO: 514258 - DNA, 25 bp, Rattus norvegicus
caacgaagccgcagtcaccgtcata

SEQ ID NO: 514259 - DNA, 25 bp, Rattus norvegicus
agcctcacgcgctgagaagtggttc

SEQ ID NO: 514260 - DNA, 25 bp, Rattus norvegicus
tatccggcatcagactcaacgaagc

SEQ ID NO: 514261 - DNA, 25 bp, Rattus norvegicus
tcacgcctgaacaggaattcgaagc

SEQ ID NO: 514262 - DNA, 25 bp, Rattus norvegicus
agttgtagctagaagtcacgcctga

SEQ ID NO: 514263 - DNA, 25 bp, Rattus norvegicus
gagcctccatgctacaaaagttgta

SEQ ID NO: 514264 - DNA, 25 bp, Rattus norvegicus
ccgtctcgttctgagagcctccatg

SEQ ID NO: 514265 - DNA, 25 bp, Rattus norvegicus
aacgtccgtgctctccatattcttc

SEQ ID NO: 514266 - DNA, 25 bp, Rattus norvegicus
ccgtcatactgactcctgggtaaga

SEQ ID NO: 514267 - DNA, 25 bp, Rattus norvegicus
tcctgggtaagaacgtccgtgctct

SEQ ID NO: 514268 - DNA, 25 bp, Rattus norvegicus
cactgggaggccatcgaccgcatcg

SEQ ID NO: 514269 - DNA, 25 bp, Rattus norvegicus
ctagctaggaattgcgcgtgcaggt

SEQ ID NO: 514270 - DNA, 25 bp, Rattus norvegicus
ggctcattcgcgctagctaggaatt

SEQ ID NO: 514271 - DNA, 25 bp, Rattus norvegicus
gagcgtcccaatgagcagccagggc

SEQ ID NO: 514272 - DNA, 25 bp, Rattus norvegicus
cttctccggagtgcggagcgtccca

SEQ ID NO: 514273 - DNA, 25 bp, Rattus norvegicus
cctaaaggtggcttctccggagtgc

SEQ ID NO: 514274 - DNA, 25 bp, Rattus norvegicus
tgcacgccctaaaggtggcttctcc

SEQ ID NO: 514275 - DNA, 25 bp, Rattus norvegicus
ctttcaggtgcacgccctaaaggtg

SEQ ID NO: 514276 - DNA, 25 bp, Rattus norvegicus
aggactttgcgtgggcccctttcag

SEQ ID NO: 514277 - DNA, 25 bp, Rattus norvegicus
ctacaagcagcgactgaggtgagtg

SEQ ID NO: 514278 - DNA, 25 bp, Rattus norvegicus
cgggcgcgattctagctacaagcag

SEQ ID NO: 514279 - DNA, 25 bp, Rattus norvegicus
cgattggtcagcctggttgcgctaa

SEQ ID NO: 514280 - DNA, 25 bp, Rattus norvegicus
cgcatcggttcgattggtcagcctg

SEQ ID NO: 514281 - DNA, 25 bp, Rattus norvegicus
ggccatcgaccgcatcggttcgatt

SEQ ID NO: 514282 - DNA, 25 bp, Rattus norvegicus
tgtcacgcccttcgctagctcttaa

SEQ ID NO: 514283 - DNA, 25 bp, Rattus norvegicus
gctcttaaatcaacaggcgggtgga

SEQ ID NO: 514284 - DNA, 25 bp, Rattus norvegicus
cccacgactgcggaatccgggaata

SEQ ID NO: 514285 - DNA, 25 bp, Rattus norvegicus
tcaagctcggagctcggttctacca

SEQ ID NO: 514286 - DNA, 25 bp, Rattus norvegicus
gcgatcaactttgcggtgtcctgga

SEQ ID NO: 514287 - DNA, 25 bp, Rattus norvegicus
gtggccgtcttgtcctctccaaaag

SEQ ID NO: 514288 - DNA, 25 bp, Rattus norvegicus
gggtggaagaatcgccctctgtttc

SEQ ID NO: 514289 - DNA, 25 bp, Rattus norvegicus
tggcgtctttctgggacatctggac

SEQ ID NO: 514290 - DNA, 25 bp, Rattus norvegicus
ggctccaagcagcaaccaggtgacg

SEQ ID NO: 514291 - DNA, 25 bp, Rattus norvegicus
cgcgctcgtgctccaggaattcgaa

SEQ ID NO: 514292 - DNA, 25 bp, Rattus norvegicus
ggctcacccaggctggcaaatgctg

SEQ ID NO: 514293 - DNA, 25 bp, Rattus norvegicus
tgagccttggcccttacgtgaagcc

SEQ ID NO: 514294 - DNA, 25 bp, Rattus norvegicus
tcctggacgcccagttttgatcctg

SEQ ID NO: 514295 - DNA, 25 bp, Rattus norvegicus
tgcgcacatctgtcctcaaggcacg

SEQ ID NO: 514296 - DNA, 25 bp, Rattus norvegicus
gacggacttcggtactctctcgagc

SEQ ID NO: 514297 - DNA, 25 bp, Rattus norvegicus
cagttcgttttgcagacaagtccca

SEQ ID NO: 514298 - DNA, 25 bp, Rattus norvegicus
tgtcgcgaacccagacagttcgttt

SEQ ID NO: 514299 - DNA, 25 bp, Rattus norvegicus
cggtgtcactcaggactgtcgcgaa

SEQ ID NO: 514300 - DNA, 25 bp, Rattus norvegicus
tacagactctggaatgcgggtgaca

SEQ ID NO: 514301 - DNA, 25 bp, Rattus norvegicus
atccctctgtggattcgggaccagg

SEQ ID NO: 514302 - DNA, 25 bp, Rattus norvegicus
gataaccctgaaggggatccctctg

SEQ ID NO: 514303 - DNA, 25 bp, Rattus norvegicus
gagctccgagactcttttctcctgg

SEQ ID NO: 514304 - DNA, 25 bp, Rattus norvegicus
cctcggcactcaagatgtcgctatc

SEQ ID NO: 514305 - DNA, 25 bp, Rattus norvegicus
cctcgcgggctcagctttataaggc

SEQ ID NO: 514306 - DNA, 25 bp, Rattus norvegicus
tcccaacgcatggtttgactcacaa

SEQ ID NO: 514307 - DNA, 25 bp, Rattus norvegicus
cgtgtcaggccgaagaaaattcaca

SEQ ID NO: 514308 - DNA, 25 bp, Rattus norvegicus
gacctgcactgagccggtccctggt

SEQ ID NO: 514309 - DNA, 25 bp, Rattus norvegicus
cccgcgacgtacagagagcagtgag

SEQ ID NO: 514310 - DNA, 25 bp, Rattus norvegicus
aggaccagcgcggaacgggccacaa

SEQ ID NO: 514311 - DNA, 25 bp, Rattus norvegicus
tgcagcgtagcgcagcaggaccagc

SEQ ID NO: 514312 - DNA, 25 bp, Rattus norvegicus
gtagggacagaggccacgcacagcc

SEQ ID NO: 514313 - DNA, 25 bp, Rattus norvegicus
caccgttacgccagagcgggtggta

SEQ ID NO: 514314 - DNA, 25 bp, Rattus norvegicus
ctgcacaccgttacgccagagcggg

SEQ ID NO: 514315 - DNA, 25 bp, Rattus norvegicus
ggtcggagtgacgagcgacttctcc

SEQ ID NO: 514316 - DNA, 25 bp, Rattus norvegicus
tacgccattttaagccgggagagcc

SEQ ID NO: 514317 - DNA, 25 bp, Rattus norvegicus
agcccatctccctgccgagtcctta

SEQ ID NO: 514318 - DNA, 25 bp, Rattus norvegicus
cctcctacttgggtcggagtgacga

SEQ ID NO: 514319 - DNA, 25 bp, Rattus norvegicus
ccggaacggaacaaagcgcagggct

SEQ ID NO: 514320 - DNA, 25 bp, Rattus norvegicus
gccaggccctcctacttgggtcgga

SEQ ID NO: 514321 - DNA, 25 bp, Rattus norvegicus
tcaaaggagtctgtctgagcgccgg

SEQ ID NO: 514322 - DNA, 25 bp, Rattus norvegicus
ccaggatgactacaatcaaaggagt

SEQ ID NO: 514323 - DNA, 25 bp, Rattus norvegicus
tgacgagcgacttctccgctgcaca

SEQ ID NO: 514324 - DNA, 25 bp, Rattus norvegicus
ggcactttccgagtggctgcgacga

SEQ ID NO: 514325 - DNA, 25 bp, Rattus norvegicus
caggcctcaaaattagtgcgaattg

SEQ ID NO: 514326 - DNA, 25 bp, Rattus norvegicus
agaatcccaggtttccgagggcctg

SEQ ID NO: 514327 - DNA, 25 bp, Rattus norvegicus
gtcctcgaagactcctgtcgcttca

SEQ ID NO: 514328 - DNA, 25 bp, Rattus norvegicus
ccttgggctgccaacttcgggacct

SEQ ID NO: 514329 - DNA, 25 bp, Rattus norvegicus
atctttaactctctgccttgggctg

SEQ ID NO: 514330 - DNA, 25 bp, Rattus norvegicus
cggctttaaaagagccagagcttca

SEQ ID NO: 514331 - DNA, 25 bp, Rattus norvegicus
ctgggacacctaatcggaattcgcc

SEQ ID NO: 514332 - DNA, 25 bp, Rattus norvegicus
cgctgatgagcctgggacacctaat

SEQ ID NO: 514333 - DNA, 25 bp, Rattus norvegicus
cccaaacactgtgggccctggaaga

SEQ ID NO: 514334 - DNA, 25 bp, Rattus norvegicus
tgcgaattggctagtgacctggaca

SEQ ID NO: 514335 - DNA, 25 bp, Rattus norvegicus
ggtcacacaccgtttagctgttcca

SEQ ID NO: 514336 - DNA, 25 bp, Rattus norvegicus
tgcaagcactcaccgcagggaccta

SEQ ID NO: 514337 - DNA, 25 bp, Rattus norvegicus
ctaggtgcgaggcttcaggcctcaa

SEQ ID NO: 514338 - DNA, 25 bp, Rattus norvegicus
gggacgccgcgaaccacagcgagaa

SEQ ID NO: 514339 - DNA, 25 bp, Rattus norvegicus
caagcgtccacagggacgccgcgaa

SEQ ID NO: 514340 - DNA, 25 bp, Rattus norvegicus
caggggaagagggacgcgaaacagt

SEQ ID NO: 514341 - DNA, 25 bp, Rattus norvegicus
gcacaggggaagagggacgcgaaac

SEQ ID NO: 514342 - DNA, 25 bp, Rattus norvegicus
gcacctcggcgggtctaccaccctc

SEQ ID NO: 514343 - DNA, 25 bp, Rattus norvegicus
acgccgcgaaccacagcgagaagtg

SEQ ID NO: 514344 - DNA, 25 bp, Rattus norvegicus
ggacgccgcgaaccacagcgagaag

SEQ ID NO: 514345 - DNA, 25 bp, Rattus norvegicus
cacagcgagaagtgcgcgcgggtca

SEQ ID NO: 514346 - DNA, 25 bp, Rattus norvegicus
cgaaccacagcgagaagtgcgcgcg

SEQ ID NO: 514347 - DNA, 25 bp, Rattus norvegicus
gcgaaccacagcgagaagtgcgcgc

SEQ ID NO: 514348 - DNA, 25 bp, Rattus norvegicus
ccgcgaaccacagcgagaagtgcgc

SEQ ID NO: 514349 - DNA, 25 bp, Rattus norvegicus
cgccgcgaaccacagcgagaagtgc

SEQ ID NO: 514350 - DNA, 25 bp, Rattus norvegicus
gacgccgcgaaccacagcgagaagt

SEQ ID NO: 514351 - DNA, 25 bp, Rattus norvegicus
gccgcgaaccacagcgagaagtgcg

SEQ ID NO: 514352 - DNA, 25 bp, Rattus norvegicus
aaagcttggccaaacgcaagccgcg

SEQ ID NO: 514353 - DNA, 25 bp, Rattus norvegicus
agctctcgagaaggagacgcctccg

SEQ ID NO: 514354 - DNA, 25 bp, Rattus norvegicus
ccggagtaatgctgtgggcagaacc

SEQ ID NO: 514355 - DNA, 25 bp, Rattus norvegicus
ctcaccgagaggacgctcatgcgga

SEQ ID NO: 514356 - DNA, 25 bp, Rattus norvegicus
ggggtctccaacaggcacgccatct

SEQ ID NO: 514357 - DNA, 25 bp, Rattus norvegicus
gcactttcgacagccacctatggga

SEQ ID NO: 514358 - DNA, 25 bp, Rattus norvegicus
agcagctactctcggatggggtcag

SEQ ID NO: 514359 - DNA, 25 bp, Rattus norvegicus
agccacctatgggaccagcagccgg

SEQ ID NO: 514360 - DNA, 25 bp, Rattus norvegicus
cagccggcgcctctgtagaaagcca

SEQ ID NO: 514361 - DNA, 25 bp, Rattus norvegicus
agccaggcaaactgcccagaaccga

SEQ ID NO: 514362 - DNA, 25 bp, Rattus norvegicus
cccaggcgtcgctcgaacacggaag

SEQ ID NO: 514363 - DNA, 25 bp, Rattus norvegicus
ccggcttacgaatcgtcctctcaga

SEQ ID NO: 514364 - DNA, 25 bp, Rattus norvegicus
gtcctctcagaaacagcagctactc

SEQ ID NO: 514365 - DNA, 25 bp, Rattus norvegicus
ctccgtccggagaagcaacagcgca

SEQ ID NO: 514366 - DNA, 25 bp, Rattus norvegicus
gccggaagttacataaaggaatcta

SEQ ID NO: 514367 - DNA, 25 bp, Rattus norvegicus
gctgcatggccgtgccgcccaaata

SEQ ID NO: 514368 - DNA, 25 bp, Rattus norvegicus
gcaatgaggccgacctgcgctgcat

SEQ ID NO: 514369 - DNA, 25 bp, Rattus norvegicus
tggatctccttctgtgctgtggcga

SEQ ID NO: 514370 - DNA, 25 bp, Rattus norvegicus
caagatctacgagactctggcgcta

SEQ ID NO: 514371 - DNA, 25 bp, Rattus norvegicus
ccacggcgagctggacaagatctac

SEQ ID NO: 514372 - DNA, 25 bp, Rattus norvegicus
ttccgtggcccaacgtcacgatgcg

SEQ ID NO: 514373 - DNA, 25 bp, Rattus norvegicus
cggcttgtccgctcttctctgctgt

SEQ ID NO: 514374 - DNA, 25 bp, Rattus norvegicus
ggaatctaaactctccgcggctctg

SEQ ID NO: 514375 - DNA, 25 bp, Rattus norvegicus
cgcgagacttggaagccggaagtta

SEQ ID NO: 514376 - DNA, 25 bp, Rattus norvegicus
gccacatgcagaccttctaccggtg

SEQ ID NO: 514377 - DNA, 25 bp, Rattus norvegicus
ttcgcgtgaggttccaggtcctcct

SEQ ID NO: 514378 - DNA, 25 bp, Rattus norvegicus
gctctgttaatgttggcgggatacg

SEQ ID NO: 514379 - DNA, 25 bp, Rattus norvegicus
gttggcccggctcttcccaatctgt

SEQ ID NO: 514380 - DNA, 25 bp, Rattus norvegicus
gctggcagcatcgtgcggctgcatt

SEQ ID NO: 514381 - DNA, 25 bp, Rattus norvegicus
cctgcggggaaagaacccgtatgct

SEQ ID NO: 514382 - DNA, 25 bp, Rattus norvegicus
cggattgttcaggaatgaggtaccc

SEQ ID NO: 514383 - DNA, 25 bp, Rattus norvegicus
catcccagcggcctcggattgttca

SEQ ID NO: 514384 - DNA, 25 bp, Rattus norvegicus
cgtggccgagagtgcctcacgacgt

SEQ ID NO: 514385 - DNA, 25 bp, Rattus norvegicus
aagctaggaaccgagctgcgtggcc

SEQ ID NO: 514386 - DNA, 25 bp, Rattus norvegicus
ggctgcagtcgccaagctaggaacc

SEQ ID NO: 514387 - DNA, 25 bp, Rattus norvegicus
gttaaacattagtggctgcagtcgc

SEQ ID NO: 514388 - DNA, 25 bp, Rattus norvegicus
cgctgcgcgcgcaggttaaacatta

SEQ ID NO: 514389 - DNA, 25 bp, Rattus norvegicus
ttccaggcggagctactcggccgct

SEQ ID NO: 514390 - DNA, 25 bp, Rattus norvegicus
tatgcctggaatccagccgggagcc

SEQ ID NO: 514391 - DNA, 25 bp, Rattus norvegicus
ggaaaactatgcctggaatccagcc

SEQ ID NO: 514392 - DNA, 25 bp, Rattus norvegicus
gaacccgtatgcttggaggcaagga

SEQ ID NO: 514393 - DNA, 25 bp, Rattus norvegicus
catcgtgcggctgcattgcaggaga

SEQ ID NO: 514394 - DNA, 25 bp, Rattus norvegicus
gctgcaaagtgtgcacaagtccctg

SEQ ID NO: 514395 - DNA, 25 bp, Rattus norvegicus
gccgcgggtttagagcgtaggaaga

SEQ ID NO: 514396 - DNA, 25 bp, Rattus norvegicus
ggcagaagtgagctcgcgtttatgc

SEQ ID NO: 514397 - DNA, 25 bp, Rattus norvegicus
agctcgcgtttatgcgggtatccga

SEQ ID NO: 514398 - DNA, 25 bp, Rattus norvegicus
cgtttatgcgggtatccgaaataca

SEQ ID NO: 514399 - DNA, 25 bp, Rattus norvegicus
tccgaaatacacaagctgcaaagtg

SEQ ID NO: 514400 - DNA, 25 bp, Rattus norvegicus
aaagtgtgcacaagtccctggatca

SEQ ID NO: 514401 - DNA, 25 bp, Rattus norvegicus
cctggatcaggctcgggaaaacagc

SEQ ID NO: 514402 - DNA, 25 bp, Rattus norvegicus
gggaaaacagcgatgggattctgtc

SEQ ID NO: 514403 - DNA, 25 bp, Rattus norvegicus
tgggattctgtcttggggttcaaac

SEQ ID NO: 514404 - DNA, 25 bp, Rattus norvegicus
ttcaaacggtgtgtgggtggatttc

SEQ ID NO: 514405 - DNA, 25 bp, Rattus norvegicus
cccggagattattttaggtctggag

SEQ ID NO: 514406 - DNA, 25 bp, Rattus norvegicus
agattattttaggtctggagaaccg

SEQ ID NO: 514407 - DNA, 25 bp, Rattus norvegicus
cgggtatccgaaatacacaagctgc

SEQ ID NO: 514408 - DNA, 25 bp, Rattus norvegicus
cgaactcgcaaagggaccgggtgct

SEQ ID NO: 514409 - DNA, 25 bp, Rattus norvegicus
cccgctctggaactgggactacctg

SEQ ID NO: 514410 - DNA, 25 bp, Rattus norvegicus
agagtattgtctggcttgggaaccg

SEQ ID NO: 514411 - DNA, 25 bp, Rattus norvegicus
agagcccgacaataggccaggctgg

SEQ ID NO: 514412 - DNA, 25 bp, Rattus norvegicus
gtctgcatctccttcggcctgtgga

SEQ ID NO: 514413 - DNA, 25 bp, Rattus norvegicus
actgggactacctggagcgctgctt

SEQ ID NO: 514414 - DNA, 25 bp, Rattus norvegicus
atgctccacgcagagcccgacaata

SEQ ID NO: 514415 - DNA, 25 bp, Rattus norvegicus
ttggccgcgccagagtattgtctgg

SEQ ID NO: 514416 - DNA, 25 bp, Rattus norvegicus
ggccctcctttgtgctgcggccgag

SEQ ID NO: 514417 - DNA, 25 bp, Rattus norvegicus
gcgacctgcaggtagctcgagtccg

SEQ ID NO: 514418 - DNA, 25 bp, Rattus norvegicus
agactgggcgctactcgcctcggct

SEQ ID NO: 514419 - DNA, 25 bp, Rattus norvegicus
ccacacgctgtaatggggacgggac

SEQ ID NO: 514420 - DNA, 25 bp, Rattus norvegicus
tggatcgctgcccacacgctgtaat

SEQ ID NO: 514421 - DNA, 25 bp, Rattus norvegicus
ttcggcctgtggatctgcgccgcct

SEQ ID NO: 514422 - DNA, 25 bp, Rattus norvegicus
cctaccaccgtagcgctagggctga

SEQ ID NO: 514423 - DNA, 25 bp, Rattus norvegicus
ttggctcctaccaccgtagcgctag

SEQ ID NO: 514424 - DNA, 25 bp, Rattus norvegicus
ttctctctcattcactttccttggc

SEQ ID NO: 514425 - DNA, 25 bp, Rattus norvegicus
tgctgtggaaagtccggagctgcac

SEQ ID NO: 514426 - DNA, 25 bp, Rattus norvegicus
cgagctctttcccttaggagcagca

SEQ ID NO: 514427 - DNA, 25 bp, Rattus norvegicus
gggccctccgaagcacgagctcttt

SEQ ID NO: 514428 - DNA, 25 bp, Rattus norvegicus
ctctttcccttaggagcagcaggcg

SEQ ID NO: 514429 - DNA, 25 bp, Rattus norvegicus
cccaagattctctctcattcacttt

SEQ ID NO: 514430 - DNA, 25 bp, Rattus norvegicus
acttgtcgaggtagaggcgcagccc

SEQ ID NO: 514431 - DNA, 25 bp, Rattus norvegicus
taacttgtcgaggtagaggcgcagc

SEQ ID NO: 514432 - DNA, 25 bp, Rattus norvegicus
ttgagtgtgctaacttgtcgaggta

SEQ ID NO: 514433 - DNA, 25 bp, Rattus norvegicus
actcggttgagtgtgctaacttgtc

SEQ ID NO: 514434 - DNA, 25 bp, Rattus norvegicus
tccggagctgcactcggttgagtgt

SEQ ID NO: 514435 - DNA, 25 bp, Rattus norvegicus
aaagtccggagctgcactcggttga

SEQ ID NO: 514436 - DNA, 25 bp, Rattus norvegicus
ggaattcgggctctacggacccgca

SEQ ID NO: 514437 - DNA, 25 bp, Rattus norvegicus
acagccacacgcacggggaattcgg

SEQ ID NO: 514438 - DNA, 25 bp, Rattus norvegicus
acaggttctgaaggagcagtgctcc

SEQ ID NO: 514439 - DNA, 25 bp, Rattus norvegicus
ggacacccgagctgcacaggttctg

SEQ ID NO: 514440 - DNA, 25 bp, Rattus norvegicus
agcaatggcacctgctgaggggaca

SEQ ID NO: 514441 - DNA, 25 bp, Rattus norvegicus
ggaaaaggttccctgaagcaatggc

SEQ ID NO: 514442 - DNA, 25 bp, Rattus norvegicus
cgcgcaacgcagaaaggatcagttt

SEQ ID NO: 514443 - DNA, 25 bp, Rattus norvegicus
tccggtcctaggaaacgttggcaga

SEQ ID NO: 514444 - DNA, 25 bp, Rattus norvegicus
tgccgccgccaaaatttaagaatga

SEQ ID NO: 514445 - DNA, 25 bp, Rattus norvegicus
gctgagacagactgccgccgccaaa

SEQ ID NO: 514446 - DNA, 25 bp, Rattus norvegicus
agtgctcccgggttgtgggactcct

SEQ ID NO: 514447 - DNA, 25 bp, Rattus norvegicus
tggcagacacatctcccgcagagtg

SEQ ID NO: 514448 - DNA, 25 bp, Rattus norvegicus
tctacggacccgcaaactgggtggc

SEQ ID NO: 514449 - DNA, 25 bp, Rattus norvegicus
cgcagagcgggtggcagacacatct

SEQ ID NO: 514450 - DNA, 25 bp, Rattus norvegicus
cattcggcgcctaggcgtttgctga

SEQ ID NO: 514451 - DNA, 25 bp, Rattus norvegicus
tcctgagcccgggactctgaagtcc

SEQ ID NO: 514452 - DNA, 25 bp, Rattus norvegicus
ctgaaggtttggacatggtcccggc

SEQ ID NO: 514453 - DNA, 25 bp, Rattus norvegicus
catgggcctcttgatgtggtctgaa

SEQ ID NO: 514454 - DNA, 25 bp, Rattus norvegicus
cttgggattttcctgggccatcttg

SEQ ID NO: 514455 - DNA, 25 bp, Rattus norvegicus
ctgcctcggacaggagcttccattc

SEQ ID NO: 514456 - DNA, 25 bp, Rattus norvegicus
tctggatggcactggaactaaattg

SEQ ID NO: 514457 - DNA, 25 bp, Rattus norvegicus
cttcgtcgatgtaaggccgcttctc

SEQ ID NO: 514458 - DNA, 25 bp, Rattus norvegicus
gcgcgcagccttttggcttcgtcga

SEQ ID NO: 514459 - DNA, 25 bp, Rattus norvegicus
ttcttgagcaggttcttcggcttgc

SEQ ID NO: 514460 - DNA, 25 bp, Rattus norvegicus
aactaaattgcgcagggtccagcag

SEQ ID NO: 514461 - DNA, 25 bp, Rattus norvegicus
tggggcacttcacccatcttctgga

SEQ ID NO: 514462 - DNA, 25 bp, Rattus norvegicus
ccgaaggcgccgttctgatagccca

SEQ ID NO: 514463 - DNA, 25 bp, Rattus norvegicus
gacatacctgtctttcttgagcagg

SEQ ID NO: 514464 - DNA, 25 bp, Rattus norvegicus
aagcctcgatggcatcatcctcctt

SEQ ID NO: 514465 - DNA, 25 bp, Rattus norvegicus
cttcctgaagcctcgatggcatcat

SEQ ID NO: 514466 - DNA, 25 bp, Rattus norvegicus
ctccccccttccgatccgctcggct

SEQ ID NO: 514467 - DNA, 25 bp, Rattus norvegicus
ctgcagctactcggtcgctccacac

SEQ ID NO: 514468 - DNA, 25 bp, Rattus norvegicus
gctgcagctactcggtcgctccaca

SEQ ID NO: 514469 - DNA, 25 bp, Rattus norvegicus
cttcgccgccgggctgcagctactc

SEQ ID NO: 514470 - DNA, 25 bp, Rattus norvegicus
ttcctgaagcctcgatggcatcatc

SEQ ID NO: 514471 - DNA, 25 bp, Rattus norvegicus
ccttcgccgccgggctgcagctact

SEQ ID NO: 514472 - DNA, 25 bp, Rattus norvegicus
ccttcctgaagcctcgatggcatca

SEQ ID NO: 514473 - DNA, 25 bp, Rattus norvegicus
agcctcgatggcatcatcctccttc

SEQ ID NO: 514474 - DNA, 25 bp, Rattus norvegicus
cctgaagcctcgatggcatcatcct

SEQ ID NO: 514475 - DNA, 25 bp, Rattus norvegicus
tcctgaagcctcgatggcatcatcc

SEQ ID NO: 514476 - DNA, 25 bp, Rattus norvegicus
gcctcgatggcatcatcctccttcc

SEQ ID NO: 514477 - DNA, 25 bp, Rattus norvegicus
tgagccgctccctgattgggcgaac

SEQ ID NO: 514478 - DNA, 25 bp, Rattus norvegicus
gggctttctgagaaccgccgagaca

SEQ ID NO: 514479 - DNA, 25 bp, Rattus norvegicus
ctgttcagtgagctgaggctgcgca

SEQ ID NO: 514480 - DNA, 25 bp, Rattus norvegicus
gggcgaacgggcttgtcactcaagc

SEQ ID NO: 514481 - DNA, 25 bp, Rattus norvegicus
ccacagaccgcgacagggctttctg

SEQ ID NO: 514482 - DNA, 25 bp, Rattus norvegicus
attcgtcagaggaatgagccgctcc

SEQ ID NO: 514483 - DNA, 25 bp, Rattus norvegicus
ttgcgggcaggaaacccgctccaca

SEQ ID NO: 514484 - DNA, 25 bp, Rattus norvegicus
tgcgccgccgcgtagctctcagaga

SEQ ID NO: 514485 - DNA, 25 bp, Rattus norvegicus
gccgttaccgcacgaggcctgtgct

SEQ ID NO: 514486 - DNA, 25 bp, Rattus norvegicus
cggctccagtcacctgaggactgca

SEQ ID NO: 514487 - DNA, 25 bp, Rattus norvegicus
cagcgcggacagactaggagaccga

SEQ ID NO: 514488 - DNA, 25 bp, Rattus norvegicus
ggaagcgaccagagactagcaggca

SEQ ID NO: 514489 - DNA, 25 bp, Rattus norvegicus
agcagggctcgtagctcaggccaga

SEQ ID NO: 514490 - DNA, 25 bp, Rattus norvegicus
aagcgcggcgctcactgttcagtga

SEQ ID NO: 514491 - DNA, 25 bp, Rattus norvegicus
cgcaggagtaaggaggtccagttca

SEQ ID NO: 514492 - DNA, 25 bp, Rattus norvegicus
acgtctttcgtgctgtgtgtctagc

SEQ ID NO: 514493 - DNA, 25 bp, Rattus norvegicus
tgcaggcaatcatcacgtctttcgt

SEQ ID NO: 514494 - DNA, 25 bp, Rattus norvegicus
tggctgtcaacaatgcaggcaatca

SEQ ID NO: 514495 - DNA, 25 bp, Rattus norvegicus
cagtgaaaacggtgcttccgcccgc

SEQ ID NO: 514496 - DNA, 25 bp, Rattus norvegicus
acgtctgtgttcctctggctgtcaa

SEQ ID NO: 514497 - DNA, 25 bp, Rattus norvegicus
gctggaagcgccgatccaagatgga

SEQ ID NO: 514498 - DNA, 25 bp, Rattus norvegicus
atcgggaataacacaccggagactt

SEQ ID NO: 514499 - DNA, 25 bp, Rattus norvegicus
cgggttaggattgcagctccgttga

SEQ ID NO: 514500 - DNA, 25 bp, Rattus norvegicus
cgtgtggaaaatgccaccagatggc

SEQ ID NO: 514501 - DNA, 25 bp, Rattus norvegicus
tcctgtcagcgaggcagtgagcacc

SEQ ID NO: 514502 - DNA, 25 bp, Rattus norvegicus
tctcaccctagagagaatgtcttta

SEQ ID NO: 514503 - DNA, 25 bp, Rattus norvegicus
aggcgccgaagagtccgtccttccg

SEQ ID NO: 514504 - DNA, 25 bp, Rattus norvegicus
aaaggccacgtttcccgctccagtg

SEQ ID NO: 514505 - DNA, 25 bp, Rattus norvegicus
ctcgttaactgagaccggctggctg

SEQ ID NO: 514506 - DNA, 25 bp, Rattus norvegicus
cactcgcttgtgctgtgcgtcgatg

SEQ ID NO: 514507 - DNA, 25 bp, Rattus norvegicus
tgcgtcgatgcgtcgctggcctcct

SEQ ID NO: 514508 - DNA, 25 bp, Rattus norvegicus
agcagcgcggcatggcgcttgtttt

SEQ ID NO: 514509 - DNA, 25 bp, Rattus norvegicus
cgcttgttttcgatgcgctcgttaa

SEQ ID NO: 514510 - DNA, 25 bp, Rattus norvegicus
ttcgatgcgctcgttaactgagacc

SEQ ID NO: 514511 - DNA, 25 bp, Rattus norvegicus
tgcggaggccgcagttcagaactct

SEQ ID NO: 514512 - DNA, 25 bp, Rattus norvegicus
actctgagcctcgttccagctgcca

SEQ ID NO: 514513 - DNA, 25 bp, Rattus norvegicus
tccagctgccatcgcccgaatccga

SEQ ID NO: 514514 - DNA, 25 bp, Rattus norvegicus
ccgaatccgaatcgccgccgccatt

SEQ ID NO: 514515 - DNA, 25 bp, Rattus norvegicus
ttttttaactctgccagcgtgccac

SEQ ID NO: 514516 - DNA, 25 bp, Rattus norvegicus
agcgtagccatagcgggtctgcgcc

SEQ ID NO: 514517 - DNA, 25 bp, Rattus norvegicus
cccaggtaccgcgcctattggctgg

SEQ ID NO: 514518 - DNA, 25 bp, Rattus norvegicus
ggccgcagttcagaactctgagcct

SEQ ID NO: 514519 - DNA, 25 bp, Rattus norvegicus
ctgagcatgctctgtgctaggagcc

SEQ ID NO: 514520 - DNA, 25 bp, Rattus norvegicus
agtctcggggatgacagtgtctttg

SEQ ID NO: 514521 - DNA, 25 bp, Rattus norvegicus
gatgacagtgtctttgcccgttggg

SEQ ID NO: 514522 - DNA, 25 bp, Rattus norvegicus
tcgtccgtgctgtgccgaaaagatg

SEQ ID NO: 514523 - DNA, 25 bp, Rattus norvegicus
gctggcactagacccgggaagccga

SEQ ID NO: 514524 - DNA, 25 bp, Rattus norvegicus
ttgtgcatgcgcagttgagccggca

SEQ ID NO: 514525 - DNA, 25 bp, Rattus norvegicus
gagcgtccgactcgcactgagcatg

SEQ ID NO: 514526 - DNA, 25 bp, Rattus norvegicus
caaagcgcacgcgtaagggcgaaag

SEQ ID NO: 514527 - DNA, 25 bp, Rattus norvegicus
ctaatgtgtttatccggttttctgg

SEQ ID NO: 514528 - DNA, 25 bp, Rattus norvegicus
cgtgagcgggctaatgtgtttatcc

SEQ ID NO: 514529 - DNA, 25 bp, Rattus norvegicus
catgcgcagtgaactcagggtgtgc

SEQ ID NO: 514530 - DNA, 25 bp, Rattus norvegicus
cgtaagtggagagccagacatgcgc

SEQ ID NO: 514531 - DNA, 25 bp, Rattus norvegicus
ctttgcgcatgcgtgcaagggctag

SEQ ID NO: 514532 - DNA, 25 bp, Rattus norvegicus
ctctgtgctaggagccgtaagtgga

SEQ ID NO: 514533 - DNA, 25 bp, Rattus norvegicus
ccacctttgtacagcggctttaacg

SEQ ID NO: 514534 - DNA, 25 bp, Rattus norvegicus
ttgcccggcgtttcagaaaggccga

SEQ ID NO: 514535 - DNA, 25 bp, Rattus norvegicus
tgtacagcggctttaacgttcaaaa

SEQ ID NO: 514536 - DNA, 25 bp, Rattus norvegicus
cagccacctttgtacagcggcttta

SEQ ID NO: 514537 - DNA, 25 bp, Rattus norvegicus
tttttcagccacctttgtacagcgg

SEQ ID NO: 514538 - DNA, 25 bp, Rattus norvegicus
gcctttttcagccacctttgtacag

SEQ ID NO: 514539 - DNA, 25 bp, Rattus norvegicus
agagcctttttcagccacctttgta

SEQ ID NO: 514540 - DNA, 25 bp, Rattus norvegicus
cgagagcctttttcagccacctttg

SEQ ID NO: 514541 - DNA, 25 bp, Rattus norvegicus
gccgagagcctttttcagccacctt

SEQ ID NO: 514542 - DNA, 25 bp, Rattus norvegicus
aggccgagagcctttttcagccacc

SEQ ID NO: 514543 - DNA, 25 bp, Rattus norvegicus
ttcagaaaggccgagagcctttttc

SEQ ID NO: 514544 - DNA, 25 bp, Rattus norvegicus
cagggacttttgcccggcgtttcag

SEQ ID NO: 514545 - DNA, 25 bp, Rattus norvegicus
gcccggcgtttcagaaaggccgaga

SEQ ID NO: 514546 - DNA, 25 bp, Rattus norvegicus
gcgtttcagaaaggccgagagcctt

SEQ ID NO: 514547 - DNA, 25 bp, Rattus norvegicus
ttgaaactcgcccagggacttttgc

SEQ ID NO: 514548 - DNA, 25 bp, Rattus norvegicus
cgagccgcctagtgctcaactacga

SEQ ID NO: 514549 - DNA, 25 bp, Rattus norvegicus
cccaaggcgtttacagagattaaca

SEQ ID NO: 514550 - DNA, 25 bp, Rattus norvegicus
cagagattaacaggctcttgcctta

SEQ ID NO: 514551 - DNA, 25 bp, Rattus norvegicus
ggctcttgccttacttccgacagtc

SEQ ID NO: 514552 - DNA, 25 bp, Rattus norvegicus
ttccgacagtccctctcgtgctgtg

SEQ ID NO: 514553 - DNA, 25 bp, Rattus norvegicus
tctcgtgctgtgtttgcggtgagac

SEQ ID NO: 514554 - DNA, 25 bp, Rattus norvegicus
gcggtgagacgcttctttattgttc

SEQ ID NO: 514555 - DNA, 25 bp, Rattus norvegicus
tgcttgttttctaaagtccctctgg

SEQ ID NO: 514556 - DNA, 25 bp, Rattus norvegicus
tccctctggcagtagtaacgtgaac

SEQ ID NO: 514557 - DNA, 25 bp, Rattus norvegicus
gcagtagtaacgtgaacggttggcc

SEQ ID NO: 514558 - DNA, 25 bp, Rattus norvegicus
tcgttttaagtggtggtactgtgca

SEQ ID NO: 514559 - DNA, 25 bp, Rattus norvegicus
cagtggtagtacacggtcgttagtt

SEQ ID NO: 514560 - DNA, 25 bp, Rattus norvegicus
tactgtgcagtggtagtacacggtc

SEQ ID NO: 514561 - DNA, 25 bp, Rattus norvegicus
ccctagagtcctcaggcgtgcattc

SEQ ID NO: 514562 - DNA, 25 bp, Rattus norvegicus
ttctttggccaagtcgggccgaggc

SEQ ID NO: 514563 - DNA, 25 bp, Rattus norvegicus
gagctcccaggccaccgttctccac

SEQ ID NO: 514564 - DNA, 25 bp, Rattus norvegicus
aggtgctcgcagctcagccactccg

SEQ ID NO: 514565 - DNA, 25 bp, Rattus norvegicus
ccgccttctacctttgtttcaggtg

SEQ ID NO: 514566 - DNA, 25 bp, Rattus norvegicus
agagtgctgggatcccgccctcagc

SEQ ID NO: 514567 - DNA, 25 bp, Rattus norvegicus
ggtgacacatccttctttggccaag

SEQ ID NO: 514568 - DNA, 25 bp, Rattus norvegicus
ggaaggaaaataaagcctcagcgcc

SEQ ID NO: 514569 - DNA, 25 bp, Rattus norvegicus
aataaagcctcagcgcctaacgacg

SEQ ID NO: 514570 - DNA, 25 bp, Rattus norvegicus
gcgcctaacgacgtgactctcagtt

SEQ ID NO: 514571 - DNA, 25 bp, Rattus norvegicus
gactctcagttcttccagaaccttg

SEQ ID NO: 514572 - DNA, 25 bp, Rattus norvegicus
tcttccagaaccttggcatttgctg

SEQ ID NO: 514573 - DNA, 25 bp, Rattus norvegicus
gccaagctttcctgttaacaagttc

SEQ ID NO: 514574 - DNA, 25 bp, Rattus norvegicus
gctgccctgccaagctttcctgtta

SEQ ID NO: 514575 - DNA, 25 bp, Rattus norvegicus
agacccggtactgtctgggagcacg

SEQ ID NO: 514576 - DNA, 25 bp, Rattus norvegicus
tcggacatcacttctctgggaaggg

SEQ ID NO: 514577 - DNA, 25 bp, Rattus norvegicus
ctcgaccgggatcggacatcacttc

SEQ ID NO: 514578 - DNA, 25 bp, Rattus norvegicus
tacggctacttcctcgaccgggatc

SEQ ID NO: 514579 - DNA, 25 bp, Rattus norvegicus
taccaggtggatctacggctacttc

SEQ ID NO: 514580 - DNA, 25 bp, Rattus norvegicus
ggcgtctctgttcccacagccggag

SEQ ID NO: 514581 - DNA, 25 bp, Rattus norvegicus
cttgttttcgccctgccgggctgca

SEQ ID NO: 514582 - DNA, 25 bp, Rattus norvegicus
gggtggccgcttcgcagcgcatacc

SEQ ID NO: 514583 - DNA, 25 bp, Rattus norvegicus
gtgacctcacatccggcgcgggagt

SEQ ID NO: 514584 - DNA, 25 bp, Rattus norvegicus
gaggcaatcacgtgacctcacatcc

SEQ ID NO: 514585 - DNA, 25 bp, Rattus norvegicus
ctagcggttcttgcttaggcgggct

SEQ ID NO: 514586 - DNA, 25 bp, Rattus norvegicus
atcccgctagcggttcttgcttagg

SEQ ID NO: 514587 - DNA, 25 bp, Rattus norvegicus
gtgtcctaaagagcatcccgctagc

SEQ ID NO: 514588 - DNA, 25 bp, Rattus norvegicus
taccgcaaaacgtgtcctaaagagc

SEQ ID NO: 514589 - DNA, 25 bp, Rattus norvegicus
ccctggccgttgtgcattactttgt

SEQ ID NO: 514590 - DNA, 25 bp, Rattus norvegicus
atagctgtcctgctcttctgggagg

SEQ ID NO: 514591 - DNA, 25 bp, Rattus norvegicus
ggccgttgtgcattactttgtgtaa

SEQ ID NO: 514592 - DNA, 25 bp, Rattus norvegicus
ttgtgtaatgcaaaaaggctattcg

SEQ ID NO: 514593 - DNA, 25 bp, Rattus norvegicus
aaaggctattcgcaccatttgggga

SEQ ID NO: 514594 - DNA, 25 bp, Rattus norvegicus
caccatttggggactgagtttcctg

SEQ ID NO: 514595 - DNA, 25 bp, Rattus norvegicus
ctgagtttcctgttaagagtgtacg

SEQ ID NO: 514596 - DNA, 25 bp, Rattus norvegicus
gagtgtacgttttatgatgaccatc

SEQ ID NO: 514597 - DNA, 25 bp, Rattus norvegicus
gagagccgccctggccgttgtgcat

SEQ ID NO: 514598 - DNA, 25 bp, Rattus norvegicus
atcatttttattattacgcttctta

SEQ ID NO: 514599 - DNA, 25 bp, Rattus norvegicus
cacctggcagcgcaggattcctccc

SEQ ID NO: 514600 - DNA, 25 bp, Rattus norvegicus
acgcttcttactgtcctccttgata

SEQ ID NO: 514601 - DNA, 25 bp, Rattus norvegicus
tcctccttgatagctgtcctgctct

SEQ ID NO: 514602 - DNA, 25 bp, Rattus norvegicus
tctgggctgcttacgccgcgcgtga

SEQ ID NO: 514603 - DNA, 25 bp, Rattus norvegicus
ccaggctctctaagccggagatgtc

SEQ ID NO: 514604 - DNA, 25 bp, Rattus norvegicus
ccaggaggaacagcagcaggcaatc

SEQ ID NO: 514605 - DNA, 25 bp, Rattus norvegicus
ggtacgttaccttccatcgcggcca

SEQ ID NO: 514606 - DNA, 25 bp, Rattus norvegicus
tgtgcccagactcggggatatcctc

SEQ ID NO: 514607 - DNA, 25 bp, Rattus norvegicus
gaggtgtcgcttcccagaccagctt

SEQ ID NO: 514608 - DNA, 25 bp, Rattus norvegicus
taccgactctaggagcccaagggcc

SEQ ID NO: 514609 - DNA, 25 bp, Rattus norvegicus
tccaggcccgggatagaaagagccg

SEQ ID NO: 514610 - DNA, 25 bp, Rattus norvegicus
tgccgagcccagagtccggaaacct

SEQ ID NO: 514611 - DNA, 25 bp, Rattus norvegicus
ccagtagaagcttctgtgatttccc

SEQ ID NO: 514612 - DNA, 25 bp, Rattus norvegicus
gcagccacttgctggggtaccagta

SEQ ID NO: 514613 - DNA, 25 bp, Rattus norvegicus
aaccgggcagcttctaggactgatc

SEQ ID NO: 514614 - DNA, 25 bp, Rattus norvegicus
cctcgctcttgctgtccctggaaga

SEQ ID NO: 514615 - DNA, 25 bp, Rattus norvegicus
gccgagtttaagcaccgccagcact

SEQ ID NO: 514616 - DNA, 25 bp, Rattus norvegicus
ccaccaagttgctccgcgaagggta

SEQ ID NO: 514617 - DNA, 25 bp, Rattus norvegicus
gggtcctcaggatccctgggcacct

SEQ ID NO: 514618 - DNA, 25 bp, Rattus norvegicus
tgcagcctaggcagcctcgcgagca

SEQ ID NO: 514619 - DNA, 25 bp, Rattus norvegicus
attgtgcactccgagaagcggcgcg

SEQ ID NO: 514620 - DNA, 25 bp, Rattus norvegicus
ggcgccacagcacttgcgttccttg

SEQ ID NO: 514621 - DNA, 25 bp, Rattus norvegicus
cgctgctgcaaaaccgaggaggtaa

SEQ ID NO: 514622 - DNA, 25 bp, Rattus norvegicus
atgctgctcattgtgcactccgaga

SEQ ID NO: 514623 - DNA, 25 bp, Rattus norvegicus
gtggccatcgacatgctgctcattg

SEQ ID NO: 514624 - DNA, 25 bp, Rattus norvegicus
cagcaacgctgtggccatcgacatg

SEQ ID NO: 514625 - DNA, 25 bp, Rattus norvegicus
ggagctgaagaaggacagcaacgct

SEQ ID NO: 514626 - DNA, 25 bp, Rattus norvegicus
cttgcgttccttggcaacgcacagc

SEQ ID NO: 514627 - DNA, 25 bp, Rattus norvegicus
acggggccatttgcagcctaggcag

SEQ ID NO: 514628 - DNA, 25 bp, Rattus norvegicus
tcctaatggtgaatttggcagagtc

SEQ ID NO: 514629 - DNA, 25 bp, Rattus norvegicus
gtcagcgaaactgcgcccggcggac

SEQ ID NO: 514630 - DNA, 25 bp, Rattus norvegicus
tttggcagagtcagcgaaactgcgc

SEQ ID NO: 514631 - DNA, 25 bp, Rattus norvegicus
ttcagagtcgttcagcgcttccaga

SEQ ID NO: 514632 - DNA, 25 bp, Rattus norvegicus
agagccacttctttactgcacgctg

SEQ ID NO: 514633 - DNA, 25 bp, Rattus norvegicus
agtgtctccgcgtaaagcgttgtta

SEQ ID NO: 514634 - DNA, 25 bp, Rattus norvegicus
cttgcacttccgcacgtagtagctc

SEQ ID NO: 514635 - DNA, 25 bp, Rattus norvegicus
tggttctgcgtctagtgacccaaga

SEQ ID NO: 514636 - DNA, 25 bp, Rattus norvegicus
agcgttcgccctcgacttcagagtc

SEQ ID NO: 514637 - DNA, 25 bp, Rattus norvegicus
ctacagcagcgaatggactcaccta

SEQ ID NO: 514638 - DNA, 25 bp, Rattus norvegicus
acgcgcgcacgtcacaataaatcga

SEQ ID NO: 514639 - DNA, 25 bp, Rattus norvegicus
cacgctgagtggctaatgctaaggc

SEQ ID NO: 514640 - DNA, 25 bp, Rattus norvegicus
gggaaccctgcggacttcacgctga

SEQ ID NO: 514641 - DNA, 25 bp, Rattus norvegicus
gcctgcgaaggccaattttagtatc

SEQ ID NO: 514642 - DNA, 25 bp, Rattus norvegicus
ctacgaacattacgagggaaccctg

SEQ ID NO: 514643 - DNA, 25 bp, Rattus norvegicus
cccgggtttctgagagtagccaagc

SEQ ID NO: 514644 - DNA, 25 bp, Rattus norvegicus
cgttccgcaattcgcctgcatcagg

SEQ ID NO: 514645 - DNA, 25 bp, Rattus norvegicus
agcgagtcaccagcgcagcagcctt

SEQ ID NO: 514646 - DNA, 25 bp, Rattus norvegicus
ccctggaaacaatggcgctgtgcgc

SEQ ID NO: 514647 - DNA, 25 bp, Rattus norvegicus
gcgcaggagacctatgctcagggta

SEQ ID NO: 514648 - DNA, 25 bp, Rattus norvegicus
ctgcggaatgagattccggccctcc

SEQ ID NO: 514649 - DNA, 25 bp, Rattus norvegicus
ccttccgccgaagacccatgttggt

SEQ ID NO: 514650 - DNA, 25 bp, Rattus norvegicus
tggccggtagcaagatctgtagatt

SEQ ID NO: 514651 - DNA, 25 bp, Rattus norvegicus
tagattgaaatacgtccgctgaccg

SEQ ID NO: 514652 - DNA, 25 bp, Rattus norvegicus
cgctgaccgccgcagaaacaggtct

SEQ ID NO: 514653 - DNA, 25 bp, Rattus norvegicus
gcttcctgccgaaggtactcccaga

SEQ ID NO: 514654 - DNA, 25 bp, Rattus norvegicus
accttgggtgtatgcaccttgttcc

SEQ ID NO: 514655 - DNA, 25 bp, Rattus norvegicus
agcagccttgaggtctctgtggtcc

SEQ ID NO: 514656 - DNA, 25 bp, Rattus norvegicus
tgatgcgcagaacgtgttcactttc

SEQ ID NO: 514657 - DNA, 25 bp, Rattus norvegicus
tcccagaccttggatcggggccagt

SEQ ID NO: 514658 - DNA, 25 bp, Rattus norvegicus
tggtcctcagcctttccctggagtt

SEQ ID NO: 514659 - DNA, 25 bp, Rattus norvegicus
ccgggagcaccagccgggagcacta

SEQ ID NO: 514660 - DNA, 25 bp, Rattus norvegicus
aagcttcgggttctgcataggagga

SEQ ID NO: 514661 - DNA, 25 bp, Rattus norvegicus
cttcgggttctgcataggaggagca

SEQ ID NO: 514662 - DNA, 25 bp, Rattus norvegicus
gagcaccaagctgcggtgcggctcc

SEQ ID NO: 514663 - DNA, 25 bp, Rattus norvegicus
atgtgaccgactgcagaggccgcgc

SEQ ID NO: 514664 - DNA, 25 bp, Rattus norvegicus
accagccgggagcactacagggcgc

SEQ ID NO: 514665 - DNA, 25 bp, Rattus norvegicus
gcgagcagacgcgtggacaaggcct

SEQ ID NO: 514666 - DNA, 25 bp, Rattus norvegicus
cccagcttcggtcagaaacgaaact

SEQ ID NO: 514667 - DNA, 25 bp, Rattus norvegicus
cggtcagaaacgaaactgaaagagg

SEQ ID NO: 514668 - DNA, 25 bp, Rattus norvegicus
cttcagccaccatggctcaggatgg

SEQ ID NO: 514669 - DNA, 25 bp, Rattus norvegicus
ccaccatggctcaggatggcgtgga

SEQ ID NO: 514670 - DNA, 25 bp, Rattus norvegicus
gacagccgcgccaccggcgacaagc

SEQ ID NO: 514671 - DNA, 25 bp, Rattus norvegicus
cgacgccacccaggcttgcgaggcc

SEQ ID NO: 514672 - DNA, 25 bp, Rattus norvegicus
ggacatgtgaccgactgcagaggcc

SEQ ID NO: 514673 - DNA, 25 bp, Rattus norvegicus
gcgtcctggacgacacccaagggga

SEQ ID NO: 514674 - DNA, 25 bp, Rattus norvegicus
ttcggtcgcagtggagaattgtctc

SEQ ID NO: 514675 - DNA, 25 bp, Rattus norvegicus
ggagaattgtctcattgttcccaga

SEQ ID NO: 514676 - DNA, 25 bp, Rattus norvegicus
tctcattgttcccagactcagcggc

SEQ ID NO: 514677 - DNA, 25 bp, Rattus norvegicus
ccacggctggagatcttttcaccct

SEQ ID NO: 514678 - DNA, 25 bp, Rattus norvegicus
ggctggagatcttttcaccctggca

SEQ ID NO: 514679 - DNA, 25 bp, Rattus norvegicus
ttttcaccctggcagccgggcgtcc

SEQ ID NO: 514680 - DNA, 25 bp, Rattus norvegicus
cgccatctgtcgtctgaacgccatt

SEQ ID NO: 514681 - DNA, 25 bp, Rattus norvegicus
atctgtcgtctgaacgccattgtca

SEQ ID NO: 514682 - DNA, 25 bp, Rattus norvegicus
ggggaccaacaccgcaccagtaatc

SEQ ID NO: 514683 - DNA, 25 bp, Rattus norvegicus
ctggcgtcctggacgacacccaagg

SEQ ID NO: 514684 - DNA, 25 bp, Rattus norvegicus
tccgctggcgcgtggccgagtacca

SEQ ID NO: 514685 - DNA, 25 bp, Rattus norvegicus
cgcaccagtaatccgctctcctccg

SEQ ID NO: 514686 - DNA, 25 bp, Rattus norvegicus
tgaacgccattgtcagcagccacgc

SEQ ID NO: 514687 - DNA, 25 bp, Rattus norvegicus
gccgaagcatcggttggttcgcctg

SEQ ID NO: 514688 - DNA, 25 bp, Rattus norvegicus
agcatcggttggttcgcctgcaaca

SEQ ID NO: 514689 - DNA, 25 bp, Rattus norvegicus
tccctcggtgcatgtaaggatgacg

SEQ ID NO: 514690 - DNA, 25 bp, Rattus norvegicus
agtcgtccctcggtgcatgtaagga

SEQ ID NO: 514691 - DNA, 25 bp, Rattus norvegicus
gcttatccctggaagtcgtccctcg

SEQ ID NO: 514692 - DNA, 25 bp, Rattus norvegicus
cgttcgaggcttatccctggaagtc

SEQ ID NO: 514693 - DNA, 25 bp, Rattus norvegicus
ccaccaccgggcgttcgaggcttat

SEQ ID NO: 514694 - DNA, 25 bp, Rattus norvegicus
ttgcagccaccaccgggcgttcgag

SEQ ID NO: 514695 - DNA, 25 bp, Rattus norvegicus
tcccgccatctccaaaaagccacag

SEQ ID NO: 514696 - DNA, 25 bp, Rattus norvegicus
aaagtgctttgcagtcctcccgcca

SEQ ID NO: 514697 - DNA, 25 bp, Rattus norvegicus
ctgggcggatgtaaagtgctttgca

SEQ ID NO: 514698 - DNA, 25 bp, Rattus norvegicus
tgcaacacggcccaagctgggcgga

SEQ ID NO: 514699 - DNA, 25 bp, Rattus norvegicus
tggttcgcctgcaacacggcccaag

SEQ ID NO: 514700 - DNA, 25 bp, Rattus norvegicus
catgtaaggatgacgggtgagaacc

SEQ ID NO: 514701 - DNA, 25 bp, Rattus norvegicus
cgcgatcagcccgactctttctgga

SEQ ID NO: 514702 - DNA, 25 bp, Rattus norvegicus
tctttctggagatcggagctggagt

SEQ ID NO: 514703 - DNA, 25 bp, Rattus norvegicus
cctgggtgtctgtctagcctaggct

SEQ ID NO: 514704 - DNA, 25 bp, Rattus norvegicus
gggacactgtgcaccctttcgagga

SEQ ID NO: 514705 - DNA, 25 bp, Rattus norvegicus
tagcctaggctgctcgcgcttttgt

SEQ ID NO: 514706 - DNA, 25 bp, Rattus norvegicus
ggtgaggacacgattctccgaccca

SEQ ID NO: 514707 - DNA, 25 bp, Rattus norvegicus
ctccgacccactggggctggaggaa

SEQ ID NO: 514708 - DNA, 25 bp, Rattus norvegicus
atcagtgtttgggagtgtgcgtctc

SEQ ID NO: 514709 - DNA, 25 bp, Rattus norvegicus
tctcgtacggggcaagtgaatagct

SEQ ID NO: 514710 - DNA, 25 bp, Rattus norvegicus
caagtgaatagctgctgtaggcata

SEQ ID NO: 514711 - DNA, 25 bp, Rattus norvegicus
tgctgtaggcatatctcgccgaata

SEQ ID NO: 514712 - DNA, 25 bp, Rattus norvegicus
tatctcgccgaatacggggtcaccg

SEQ ID NO: 514713 - DNA, 25 bp, Rattus norvegicus
tgcaccctttcgaggattgatcctg

SEQ ID NO: 514714 - DNA, 25 bp, Rattus norvegicus
ctttcgaggattgatcctgggtgtc

SEQ ID NO: 514715 - DNA, 25 bp, Rattus norvegicus
ctgcgtggtgccatcgaggaccaga

SEQ ID NO: 514716 - DNA, 25 bp, Rattus norvegicus
aactgctggagcaggctctgggcaa

SEQ ID NO: 514717 - DNA, 25 bp, Rattus norvegicus
ggaactcaaagccttgcgcgcgcag

SEQ ID NO: 514718 - DNA, 25 bp, Rattus norvegicus
gcctggagcaggaactcaaagcctt

SEQ ID NO: 514719 - DNA, 25 bp, Rattus norvegicus
caagaagcaggcctacgtggagaag

SEQ ID NO: 514720 - DNA, 25 bp, Rattus norvegicus
caggctctgggcaacgcgcagagcc

SEQ ID NO: 514721 - DNA, 25 bp, Rattus norvegicus
tgcagcaggcgctgggacagttgca

SEQ ID NO: 514722 - DNA, 25 bp, Rattus norvegicus
gacagttgcaggctgcttgtgaaaa

SEQ ID NO: 514723 - DNA, 25 bp, Rattus norvegicus
ctgcttgtgaaaagcgggagcagct

SEQ ID NO: 514724 - DNA, 25 bp, Rattus norvegicus
agcagctggagctgcgtctgcgcac

SEQ ID NO: 514725 - DNA, 25 bp, Rattus norvegicus
ctgcgcacgcgcctggagcaggaac

SEQ ID NO: 514726 - DNA, 25 bp, Rattus norvegicus
cacgcgcctggagcaggaactcaaa

SEQ ID NO: 514727 - DNA, 25 bp, Rattus norvegicus
accagaggcgacgggctgaactgct

SEQ ID NO: 514728 - DNA, 25 bp, Rattus norvegicus
aggagctacgcaagaagcaggccta

SEQ ID NO: 514729 - DNA, 25 bp, Rattus norvegicus
tccgcagtgcaatggcccagagtca

SEQ ID NO: 514730 - DNA, 25 bp, Rattus norvegicus
ttccttcatgtgagctgcgtgactc

SEQ ID NO: 514731 - DNA, 25 bp, Rattus norvegicus
gaccctccaaccgaaaatgctctga

SEQ ID NO: 514732 - DNA, 25 bp, Rattus norvegicus
gcggcatcacctggagctcctaggc

SEQ ID NO: 514733 - DNA, 25 bp, Rattus norvegicus
agaccctgccaggagacgtgttcgc

SEQ ID NO: 514734 - DNA, 25 bp, Rattus norvegicus
tgagcataaccagctgaagaccctg

SEQ ID NO: 514735 - DNA, 25 bp, Rattus norvegicus
agcggcccaatagctcgcagtcctg

SEQ ID NO: 514736 - DNA, 25 bp, Rattus norvegicus
cgtgacggtgcagcttgagcataac

SEQ ID NO: 514737 - DNA, 25 bp, Rattus norvegicus
ttccgtaacctcagcagcctcgtga

SEQ ID NO: 514738 - DNA, 25 bp, Rattus norvegicus
cgctgcacaccaatgccctggagga

SEQ ID NO: 514739 - DNA, 25 bp, Rattus norvegicus
ttccgcaacctgagcggcctgcaga

SEQ ID NO: 514740 - DNA, 25 bp, Rattus norvegicus
gccttcgacagcctcggaaacctga

SEQ ID NO: 514741 - DNA, 25 bp, Rattus norvegicus
gagcaccttgactctgtccggaaac

SEQ ID NO: 514742 - DNA, 25 bp, Rattus norvegicus
tgaccctgttcgagaaccctctgga

SEQ ID NO: 514743 - DNA, 25 bp, Rattus norvegicus
acgggtggccgctccttaggctgct

SEQ ID NO: 514744 - DNA, 25 bp, Rattus norvegicus
tccgtcatgtctgcacggtggtccc

SEQ ID NO: 514745 - DNA, 25 bp, Rattus norvegicus
agacttcaagtctgcgacgcgctct

SEQ ID NO: 514746 - DNA, 25 bp, Rattus norvegicus
agaggatgccatgagctttccgtca

SEQ ID NO: 514747 - DNA, 25 bp, Rattus norvegicus
atgagctttccgtcatgtctgcacg

SEQ ID NO: 514748 - DNA, 25 bp, Rattus norvegicus
cagcgtgagcctctacctgagcgag

SEQ ID NO: 514749 - DNA, 25 bp, Rattus norvegicus
tgagcctctacctgagcgaggacga

SEQ ID NO: 514750 - DNA, 25 bp, Rattus norvegicus
tccggacacgggtggccgctcctta

SEQ ID NO: 514751 - DNA, 25 bp, Rattus norvegicus
cgcgcgtgctttctggttagcgagt

SEQ ID NO: 514752 - DNA, 25 bp, Rattus norvegicus
caaggtgagccggacgccctaagtt

SEQ ID NO: 514753 - DNA, 25 bp, Rattus norvegicus
gccctaagttgtgtggcatcctgca

SEQ ID NO: 514754 - DNA, 25 bp, Rattus norvegicus
tgtggcatcctgcacaccttggggc

SEQ ID NO: 514755 - DNA, 25 bp, Rattus norvegicus
ggcatcctgcacaccttggggccga

SEQ ID NO: 514756 - DNA, 25 bp, Rattus norvegicus
ctccctgcgcgtgtcactctaggcc

SEQ ID NO: 514757 - DNA, 25 bp, Rattus norvegicus
acaggtcgagtcctagagcctctgg

SEQ ID NO: 514758 - DNA, 25 bp, Rattus norvegicus
gggcgctcactctctggctcagtct

SEQ ID NO: 514759 - DNA, 25 bp, Rattus norvegicus
gtctcagagccatcaccggaaccga

SEQ ID NO: 514760 - DNA, 25 bp, Rattus norvegicus
tcctcggtcccagacagacgttgtc

SEQ ID NO: 514761 - DNA, 25 bp, Rattus norvegicus
aagcaccggagtcccgcagaacctg

SEQ ID NO: 514762 - DNA, 25 bp, Rattus norvegicus
acttataaaaacttctgggcgctca

SEQ ID NO: 514763 - DNA, 25 bp, Rattus norvegicus
gcgtttcatcatcggccgccactta

SEQ ID NO: 514764 - DNA, 25 bp, Rattus norvegicus
agtcgcgactccagggcccaagaca

SEQ ID NO: 514765 - DNA, 25 bp, Rattus norvegicus
tgcagacacgcagagcccggctctg

SEQ ID NO: 514766 - DNA, 25 bp, Rattus norvegicus
tgtcaccaccaccaaaggctagggg

SEQ ID NO: 514767 - DNA, 25 bp, Rattus norvegicus
cagccagggctcacacaggtcgagt

SEQ ID NO: 514768 - DNA, 25 bp, Rattus norvegicus
tcgcctcggtcactatggggctcct

SEQ ID NO: 514769 - DNA, 25 bp, Rattus norvegicus
ggtctctctattggcctgcagcctc

SEQ ID NO: 514770 - DNA, 25 bp, Rattus norvegicus
gcacctctgacacccgaggaagaga

SEQ ID NO: 514771 - DNA, 25 bp, Rattus norvegicus
actcggcttattctctcggctcgga

SEQ ID NO: 514772 - DNA, 25 bp, Rattus norvegicus
tgagtactcggcttattctctcggc

SEQ ID NO: 514773 - DNA, 25 bp, Rattus norvegicus
tcggcttattctctcggctcggagc

SEQ ID NO: 514774 - DNA, 25 bp, Rattus norvegicus
tctcggctcggagccgagtcttttc

SEQ ID NO: 514775 - DNA, 25 bp, Rattus norvegicus
ccggctcgccaaggcccttccacgc

SEQ ID NO: 514776 - DNA, 25 bp, Rattus norvegicus
cccggtagaggagagggatgcagat

SEQ ID NO: 514777 - DNA, 25 bp, Rattus norvegicus
cggcggctagctcgccggctctagg

SEQ ID NO: 514778 - DNA, 25 bp, Rattus norvegicus
ggctcgcaggctcgctgactagctc

SEQ ID NO: 514779 - DNA, 25 bp, Rattus norvegicus
aggctcgctgactagctcgcactgc

SEQ ID NO: 514780 - DNA, 25 bp, Rattus norvegicus
tcgctgactagctcgcactgcggca

SEQ ID NO: 514781 - DNA, 25 bp, Rattus norvegicus
ctagctcgcactgcggcacaggctg

SEQ ID NO: 514782 - DNA, 25 bp, Rattus norvegicus
cactgcggcacaggctgcggagcac

SEQ ID NO: 514783 - DNA, 25 bp, Rattus norvegicus
agcactgtgcaggtgtctgggtgcc

SEQ ID NO: 514784 - DNA, 25 bp, Rattus norvegicus
atgtgggtaccggtacccggtgcag

SEQ ID NO: 514785 - DNA, 25 bp, Rattus norvegicus
aagaactaggtcagttcagcgtccc

SEQ ID NO: 514786 - DNA, 25 bp, Rattus norvegicus
atcacggctacgagccatggggagc

SEQ ID NO: 514787 - DNA, 25 bp, Rattus norvegicus
ttctttggggttatcacggctacga

SEQ ID NO: 514788 - DNA, 25 bp, Rattus norvegicus
tccaaagatacgtggccctaggctc

SEQ ID NO: 514789 - DNA, 25 bp, Rattus norvegicus
cttcccgggtctccaaagatacgtg

SEQ ID NO: 514790 - DNA, 25 bp, Rattus norvegicus
catgaaggaggtccgtggtcttccc

SEQ ID NO: 514791 - DNA, 25 bp, Rattus norvegicus
ttcgcggaagccatgaaggaggtcc

SEQ ID NO: 514792 - DNA, 25 bp, Rattus norvegicus
ccaacacgccgggtgttcgcggaag

SEQ ID NO: 514793 - DNA, 25 bp, Rattus norvegicus
tcctgtcgcaaggagtcgaggtaag

SEQ ID NO: 514794 - DNA, 25 bp, Rattus norvegicus
tctgctgcagctcctgtcgcaagga

SEQ ID NO: 514795 - DNA, 25 bp, Rattus norvegicus
acggacagcagcgtcggatccctct

SEQ ID NO: 514796 - DNA, 25 bp, Rattus norvegicus
ttcgaccctgctcgggtctggaaga

SEQ ID NO: 514797 - DNA, 25 bp, Rattus norvegicus
aagtactcctgtcccaagaactagg

SEQ ID NO: 514798 - DNA, 25 bp, Rattus norvegicus
gagaggagaacccagccgtctgcct

SEQ ID NO: 514799 - DNA, 25 bp, Rattus norvegicus
cctttcggacgagcgtgcacgacct

SEQ ID NO: 514800 - DNA, 25 bp, Rattus norvegicus
cacttctgcacgttctggacttctg

SEQ ID NO: 514801 - DNA, 25 bp, Rattus norvegicus
aggccctggccatgaaccatgagtc

SEQ ID NO: 514802 - DNA, 25 bp, Rattus norvegicus
acttctgctgatcggtccggcagcc

SEQ ID NO: 514803 - DNA, 25 bp, Rattus norvegicus
accgcgctctgcgttgtctttaagc

SEQ ID NO: 514804 - DNA, 25 bp, Rattus norvegicus
agcaaatcttgtgggctgtaccagc

SEQ ID NO: 514805 - DNA, 25 bp, Rattus norvegicus
tccgttaacttaggagcaaatcttg

SEQ ID NO: 514806 - DNA, 25 bp, Rattus norvegicus
ggctgcttgcgttcaaagtccgtta

SEQ ID NO: 514807 - DNA, 25 bp, Rattus norvegicus
acgaccttgcacagtggctgcttgc

SEQ ID NO: 514808 - DNA, 25 bp, Rattus norvegicus
ggcctggacgttcctttccctgaga

SEQ ID NO: 514809 - DNA, 25 bp, Rattus norvegicus
agagcgtacaaggaacgccctcttc

SEQ ID NO: 514810 - DNA, 25 bp, Rattus norvegicus
cagacatctccggaaagagcgtaca

SEQ ID NO: 514811 - DNA, 25 bp, Rattus norvegicus
ttccgggtactgcagcgttaacctc

SEQ ID NO: 514812 - DNA, 25 bp, Rattus norvegicus
cgccgcatacacaaatccatagagt

SEQ ID NO: 514813 - DNA, 25 bp, Rattus norvegicus
acaaggaagacgcgcaccggcgagc

SEQ ID NO: 514814 - DNA, 25 bp, Rattus norvegicus
ccgacgtgcgaagcccgaatcacgt

SEQ ID NO: 514815 - DNA, 25 bp, Rattus norvegicus
gaccctcaccttcgttatggccttg

SEQ ID NO: 514816 - DNA, 25 bp, Rattus norvegicus
tccctcttggcgaagaagttgtcca

SEQ ID NO: 514817 - DNA, 25 bp, Rattus norvegicus
tcttcttgtccctcttggcgaagaa

SEQ ID NO: 514818 - DNA, 25 bp, Rattus norvegicus
cgactgctccgctccttcttcttct

SEQ ID NO: 514819 - DNA, 25 bp, Rattus norvegicus
agcccgaatcacgtgggctcccggg

SEQ ID NO: 514820 - DNA, 25 bp, Rattus norvegicus
accggcgagcgctcggctaacgacg

SEQ ID NO: 514821 - DNA, 25 bp, Rattus norvegicus
tggtacgatcctcgccgggaccgcg

SEQ ID NO: 514822 - DNA, 25 bp, Rattus norvegicus
ctcgcggttcggagctctgggtcaa

SEQ ID NO: 514823 - DNA, 25 bp, Rattus norvegicus
ctccgctcctcggtctcggccatgg

SEQ ID NO: 514824 - DNA, 25 bp, Rattus norvegicus
gaagaagttgtccaggctccgctcc

SEQ ID NO: 514825 - DNA, 25 bp, Rattus norvegicus
tcgttatggccttgccgccggggcc

SEQ ID NO: 514826 - DNA, 25 bp, Rattus norvegicus
ggtcccgccgtctcccgacctggca

SEQ ID NO: 514827 - DNA, 25 bp, Rattus norvegicus
ctagcaaaccaagcgcggcagcagg

SEQ ID NO: 514828 - DNA, 25 bp, Rattus norvegicus
tttagggtgagactgtgctcgcgca

SEQ ID NO: 514829 - DNA, 25 bp, Rattus norvegicus
cagctggcccagacgtgtgtttagg

SEQ ID NO: 514830 - DNA, 25 bp, Rattus norvegicus
cagttgcgcgcgcagctggcccaga

SEQ ID NO: 514831 - DNA, 25 bp, Rattus norvegicus
ggctgctatgctggctcatgagctg

SEQ ID NO: 514832 - DNA, 25 bp, Rattus norvegicus
tcctgctgcagttgcgcgcgcagct

SEQ ID NO: 514833 - DNA, 25 bp, Rattus norvegicus
cgcagctggcccagacgtgtgttta

SEQ ID NO: 514834 - DNA, 25 bp, Rattus norvegicus
gcgcgctctgctagcaaaccaagcg

SEQ ID NO: 514835 - DNA, 25 bp, Rattus norvegicus
cgcgcttcggcctccgcacccagcg

SEQ ID NO: 514836 - DNA, 25 bp, Rattus norvegicus
tgcgcatgctcacggagctgctcct

SEQ ID NO: 514837 - DNA, 25 bp, Rattus norvegicus
gctggctcatgagctgcgcatgctc

SEQ ID NO: 514838 - DNA, 25 bp, Rattus norvegicus
cgaggaggctgctatgctggctcat

SEQ ID NO: 514839 - DNA, 25 bp, Rattus norvegicus
ctctgctagcaaaccaagcgcggca

SEQ ID NO: 514840 - DNA, 25 bp, Rattus norvegicus
catgagctgcgcatgctcacggagc

SEQ ID NO: 514841 - DNA, 25 bp, Rattus norvegicus
cggggcggacaccatccatgtgagc

SEQ ID NO: 514842 - DNA, 25 bp, Rattus norvegicus
ccatccatgtgagcaggggcggata

SEQ ID NO: 514843 - DNA, 25 bp, Rattus norvegicus
ggcggacaccatccatgtgagcagg

SEQ ID NO: 514844 - DNA, 25 bp, Rattus norvegicus
cggacactatccatgtgggcagggg

SEQ ID NO: 514845 - DNA, 25 bp, Rattus norvegicus
cggacatcatccatgtgggcggggc

SEQ ID NO: 514846 - DNA, 25 bp, Rattus norvegicus
acaccatccatgtgagcaggggcgg

SEQ ID NO: 514847 - DNA, 25 bp, Rattus norvegicus
gagcaggggcggataccacccatgt

SEQ ID NO: 514848 - DNA, 25 bp, Rattus norvegicus
tgagcaggggcggataccacccatg

SEQ ID NO: 514849 - DNA, 25 bp, Rattus norvegicus
atccatgtgagcaggggcggatacc

SEQ ID NO: 514850 - DNA, 25 bp, Rattus norvegicus
gggcggacaccatccatgtgagcag

SEQ ID NO: 514851 - DNA, 25 bp, Rattus norvegicus
ggcggacactatccatgtgggcagg

SEQ ID NO: 514852 - DNA, 25 bp, Rattus norvegicus
catccatgtgagcaggggcggatac

SEQ ID NO: 514853 - DNA, 25 bp, Rattus norvegicus
ggggcggacaccatccatgtgagca

SEQ ID NO: 514854 - DNA, 25 bp, Rattus norvegicus
agcaggggcggataccacccatgtg

SEQ ID NO: 514855 - DNA, 25 bp, Rattus norvegicus
cccgcatcgaggcagaaggatcatc

SEQ ID NO: 514856 - DNA, 25 bp, Rattus norvegicus
cgctaggaattctgcttcgctctca

SEQ ID NO: 514857 - DNA, 25 bp, Rattus norvegicus
ttcgctctcagtcgccggattagtt

SEQ ID NO: 514858 - DNA, 25 bp, Rattus norvegicus
attagttcgggtctcaagggctcga

SEQ ID NO: 514859 - DNA, 25 bp, Rattus norvegicus
gggctcgaaccaaagtgacactacg

SEQ ID NO: 514860 - DNA, 25 bp, Rattus norvegicus
tttcgttctcccatgcgacaggtcc

SEQ ID NO: 514861 - DNA, 25 bp, Rattus norvegicus
gggttcggttgctaccttgtagagc

SEQ ID NO: 514862 - DNA, 25 bp, Rattus norvegicus
tcccgctgcatggaagccacatttc

SEQ ID NO: 514863 - DNA, 25 bp, Rattus norvegicus
gggcaagcctcttcgggcacagcca

SEQ ID NO: 514864 - DNA, 25 bp, Rattus norvegicus
cccaggaccaggcatcagagggacc

SEQ ID NO: 514865 - DNA, 25 bp, Rattus norvegicus
ggatcatcagatgcgctaggaattc

SEQ ID NO: 514866 - DNA, 25 bp, Rattus norvegicus
aaccaatcgtgtcgcgtggacggcc

SEQ ID NO: 514867 - DNA, 25 bp, Rattus norvegicus
ggtcacgtggcctcacaagccaatc

SEQ ID NO: 514868 - DNA, 25 bp, Rattus norvegicus
gtccgtcagagtccgcgagaaccaa

SEQ ID NO: 514869 - DNA, 25 bp, Rattus norvegicus
ggccaagctggacacggagaacaag

SEQ ID NO: 514870 - DNA, 25 bp, Rattus norvegicus
gcatcatgggcacagcctcgtcgtt

SEQ ID NO: 514871 - DNA, 25 bp, Rattus norvegicus
agtgaagcccaaggctcgcctgctg

SEQ ID NO: 514872 - DNA, 25 bp, Rattus norvegicus
ctgctgcgtagctcgttccgcaggg

SEQ ID NO: 514873 - DNA, 25 bp, Rattus norvegicus
ctgctgggcgccagcttcaagtcca

SEQ ID NO: 514874 - DNA, 25 bp, Rattus norvegicus
gcttcaagtccaccggctcgtctgt

SEQ ID NO: 514875 - DNA, 25 bp, Rattus norvegicus
tctgtgcccgagctagagtatgcgg

SEQ ID NO: 514876 - DNA, 25 bp, Rattus norvegicus
ttcgagcggctcaagaaagagtacg

SEQ ID NO: 514877 - DNA, 25 bp, Rattus norvegicus
gagtacgagatcttccgggtcagca

SEQ ID NO: 514878 - DNA, 25 bp, Rattus norvegicus
atcttccgggtcagcaagaaccagg

SEQ ID NO: 514879 - DNA, 25 bp, Rattus norvegicus
ccatgggtcgccgagaggccaagct

SEQ ID NO: 514880 - DNA, 25 bp, Rattus norvegicus
ggagctgcaggtaacacgggaccca

SEQ ID NO: 514881 - DNA, 25 bp, Rattus norvegicus
aaactgagacccgagagcgtcgctc

SEQ ID NO: 514882 - DNA, 25 bp, Rattus norvegicus
aaccaggagttgctgtccatgggtc

SEQ ID NO: 514883 - DNA, 25 bp, Rattus norvegicus
tgcctccctcttgttgatccggcag

SEQ ID NO: 514884 - DNA, 25 bp, Rattus norvegicus
ccttcagcttgaacgcaattccctg

SEQ ID NO: 514885 - DNA, 25 bp, Rattus norvegicus
gcaattccctgatgatgcgcccaga

SEQ ID NO: 514886 - DNA, 25 bp, Rattus norvegicus
ttccctgatgatgcgcccagaggct

SEQ ID NO: 514887 - DNA, 25 bp, Rattus norvegicus
ctgctggtaagtgggtgcccgccct

SEQ ID NO: 514888 - DNA, 25 bp, Rattus norvegicus
tgactcacgaggggccgtttaaatg

SEQ ID NO: 514889 - DNA, 25 bp, Rattus norvegicus
cctcttgttgatccggcagccgcgt

SEQ ID NO: 514890 - DNA, 25 bp, Rattus norvegicus
ggaggacccagaaggccctcactca

SEQ ID NO: 514891 - DNA, 25 bp, Rattus norvegicus
agaaggccctcactcatgctgcagt

SEQ ID NO: 514892 - DNA, 25 bp, Rattus norvegicus
gccctcactcatgctgcagtcttga

SEQ ID NO: 514893 - DNA, 25 bp, Rattus norvegicus
gctgcagtcttgagcctgtcctggt

SEQ ID NO: 514894 - DNA, 25 bp, Rattus norvegicus
ctggtcctcctcctctcttcgctgc

SEQ ID NO: 514895 - DNA, 25 bp, Rattus norvegicus
tcttcgctgcctccctcttgttgat

SEQ ID NO: 514896 - DNA, 25 bp, Rattus norvegicus
gcttgaacgcaattccctgatgatg

SEQ ID NO: 514897 - DNA, 25 bp, Rattus norvegicus
aaattcgggagacagccttagatcc

SEQ ID NO: 514898 - DNA, 25 bp, Rattus norvegicus
tgccgagcagctgtacaaacaggcc

SEQ ID NO: 514899 - DNA, 25 bp, Rattus norvegicus
ctgcccgtgaacttgaggcgcttgc

SEQ ID NO: 514900 - DNA, 25 bp, Rattus norvegicus
tacggtgcggaccatccacacgctg

SEQ ID NO: 514901 - DNA, 25 bp, Rattus norvegicus
tggtgcctttgcagaggtccctaga

SEQ ID NO: 514902 - DNA, 25 bp, Rattus norvegicus
aaacaggccctggagatctcagaga

SEQ ID NO: 514903 - DNA, 25 bp, Rattus norvegicus
tctctcgtgcgcctttgttcccagg

SEQ ID NO: 514904 - DNA, 25 bp, Rattus norvegicus
aagaagttcagcgatgccgagcagc

SEQ ID NO: 514905 - DNA, 25 bp, Rattus norvegicus
gtgtacgtgcagtggaagaagttca

SEQ ID NO: 514906 - DNA, 25 bp, Rattus norvegicus
accagctggccggtgtgtacgtgca

SEQ ID NO: 514907 - DNA, 25 bp, Rattus norvegicus
tagatcccgatcacccgagagtagc

SEQ ID NO: 514908 - DNA, 25 bp, Rattus norvegicus
tgcagaggtccctagaaattcggga

SEQ ID NO: 514909 - DNA, 25 bp, Rattus norvegicus
cctttgttcccaggccgtggtgcct

SEQ ID NO: 514910 - DNA, 25 bp, Rattus norvegicus
agatctcagagaacgcctacggtgc

SEQ ID NO: 514911 - DNA, 25 bp, Rattus norvegicus
ctcatcttctggatgcgggtccggc

SEQ ID NO: 514912 - DNA, 25 bp, Rattus norvegicus
ggaggccggctgaatccttcaacca

SEQ ID NO: 514913 - DNA, 25 bp, Rattus norvegicus
atccttcaaccagagcgtggccctg

SEQ ID NO: 514914 - DNA, 25 bp, Rattus norvegicus
cgtcccgccatggatcacctgtagg

SEQ ID NO: 514915 - DNA, 25 bp, Rattus norvegicus
atcacctgtagggattggaatccac

SEQ ID NO: 514916 - DNA, 25 bp, Rattus norvegicus
cacctcgtcgctcatcttctggatg

SEQ ID NO: 514917 - DNA, 25 bp, Rattus norvegicus
aagttcaggaggactagacacagcc

SEQ ID NO: 514918 - DNA, 25 bp, Rattus norvegicus
ggactagacacagccttcctgatcc

SEQ ID NO: 514919 - DNA, 25 bp, Rattus norvegicus
ttcctgatccctacaccggggaagc

SEQ ID NO: 514920 - DNA, 25 bp, Rattus norvegicus
ggaagcgactccaatggtcccagta

SEQ ID NO: 514921 - DNA, 25 bp, Rattus norvegicus
atggtcccagtaagacacgtctccg

SEQ ID NO: 514922 - DNA, 25 bp, Rattus norvegicus
gtaagacacgtctccggcatgccca

SEQ ID NO: 514923 - DNA, 25 bp, Rattus norvegicus
ggattggaatccaccacctcgtcgc

SEQ ID NO: 514924 - DNA, 25 bp, Rattus norvegicus
tctgctgggctcacgaagttcagga

SEQ ID NO: 514925 - DNA, 25 bp, Rattus norvegicus
cggctccacgtcttgagtgggatga

SEQ ID NO: 514926 - DNA, 25 bp, Rattus norvegicus
cccagggcggaggatcactgctttg

SEQ ID NO: 514927 - DNA, 25 bp, Rattus norvegicus
tcgagcctcagcaacttaaacgccg

SEQ ID NO: 514928 - DNA, 25 bp, Rattus norvegicus
agcggccatcgcagaaacccaaagc

SEQ ID NO: 514929 - DNA, 25 bp, Rattus norvegicus
aggcggctttaccttcgcaggaggc

SEQ ID NO: 514930 - DNA, 25 bp, Rattus norvegicus
cgttccgcctctcgggaagtacgcg

SEQ ID NO: 514931 - DNA, 25 bp, Rattus norvegicus
aaagagagctttgggccaagcagcg

SEQ ID NO: 514932 - DNA, 25 bp, Rattus norvegicus
actgctttggcagcttcgagcctca

SEQ ID NO: 514933 - DNA, 25 bp, Rattus norvegicus
ttccaccaggctgcgagcgctgaac

SEQ ID NO: 514934 - DNA, 25 bp, Rattus norvegicus
ccctgaatagatggagacacgcctc

SEQ ID NO: 514935 - DNA, 25 bp, Rattus norvegicus
cgctgaacaccaacgcgcgtgcgtg

SEQ ID NO: 514936 - DNA, 25 bp, Rattus norvegicus
cgtgcgcacagcgaaagagagcttt

SEQ ID NO: 514937 - DNA, 25 bp, Rattus norvegicus
tccctttgcggtccattcgctgtct

SEQ ID NO: 514938 - DNA, 25 bp, Rattus norvegicus
gtccattcgctgtcttccgggaagc

SEQ ID NO: 514939 - DNA, 25 bp, Rattus norvegicus
agcagcaatatcaccaggatcccgg

SEQ ID NO: 514940 - DNA, 25 bp, Rattus norvegicus
cggtgctgcttcacggagacacatc

SEQ ID NO: 514941 - DNA, 25 bp, Rattus norvegicus
gtctgatcagatgttccgatacacg

SEQ ID NO: 514942 - DNA, 25 bp, Rattus norvegicus
accggaagtcggctgtctgatcaga

SEQ ID NO: 514943 - DNA, 25 bp, Rattus norvegicus
caggcaaaacgtagtggcaaggatg

SEQ ID NO: 514944 - DNA, 25 bp, Rattus norvegicus
tgcttcacggagacacatcaccgga

SEQ ID NO: 514945 - DNA, 25 bp, Rattus norvegicus
cgatacacgtctctctgccagcagg

SEQ ID NO: 514946 - DNA, 25 bp, Rattus norvegicus
tctctctgccagcagggtccgtggc

SEQ ID NO: 514947 - DNA, 25 bp, Rattus norvegicus
tggcggatgagaacaagcagcaata

SEQ ID NO: 514948 - DNA, 25 bp, Rattus norvegicus
cgtgaaattgatgcgtcaagaaccc

SEQ ID NO: 514949 - DNA, 25 bp, Rattus norvegicus
tatcaccaggatcccggttaccagg

SEQ ID NO: 514950 - DNA, 25 bp, Rattus norvegicus
cgagaaatacacgtgaaattgatgc

SEQ ID NO: 514951 - DNA, 25 bp, Rattus norvegicus
tggcaaggatgaccctcagcactgc

SEQ ID NO: 514952 - DNA, 25 bp, Rattus norvegicus
ctcagcactgcggaacgagaaatac

SEQ ID NO: 514953 - DNA, 25 bp, Rattus norvegicus
cagcgatgcgtgagctttggtagtc

SEQ ID NO: 514954 - DNA, 25 bp, Rattus norvegicus
tcgcgagcctggcatcagccaatta

SEQ ID NO: 514955 - DNA, 25 bp, Rattus norvegicus
gcgcatcgggatgcggccaaacagc

SEQ ID NO: 514956 - DNA, 25 bp, Rattus norvegicus
tgtgcatgcgatgtcctcaccagca

SEQ ID NO: 514957 - DNA, 25 bp, Rattus norvegicus
cagggaagcccagtcgcccgtcgaa

SEQ ID NO: 514958 - DNA, 25 bp, Rattus norvegicus
tccaggcagctgtcctgtgcgtcca

SEQ ID NO: 514959 - DNA, 25 bp, Rattus norvegicus
agctcctcgcgcagttcacggttca

SEQ ID NO: 514960 - DNA, 25 bp, Rattus norvegicus
agctttggtagtccgagcgttcgac

SEQ ID NO: 514961 - DNA, 25 bp, Rattus norvegicus
tcagccaattaggatgggtctctcg

SEQ ID NO: 514962 - DNA, 25 bp, Rattus norvegicus
cgtttggcatagaagtgggccacca

SEQ ID NO: 514963 - DNA, 25 bp, Rattus norvegicus
tccatctggaggctcgcacttccgg

SEQ ID NO: 514964 - DNA, 25 bp, Rattus norvegicus
cagggcttcgctgagctccactttc

SEQ ID NO: 514965 - DNA, 25 bp, Rattus norvegicus
acttccgggttcctgcacaggccag

SEQ ID NO: 514966 - DNA, 25 bp, Rattus norvegicus
cgttcgacgcggaaggcagacaccg

SEQ ID NO: 514967 - DNA, 25 bp, Rattus norvegicus
aggaagagccctctgcttctccgag

SEQ ID NO: 514968 - DNA, 25 bp, Rattus norvegicus
gctactaccacccggcacgaaagta

SEQ ID NO: 514969 - DNA, 25 bp, Rattus norvegicus
tgctggggaaataagccggacgccc

SEQ ID NO: 514970 - DNA, 25 bp, Rattus norvegicus
acgcctctgcggatctgccgtttct

SEQ ID NO: 514971 - DNA, 25 bp, Rattus norvegicus
tcctgtttccgctcgaggtcttcca

SEQ ID NO: 514972 - DNA, 25 bp, Rattus norvegicus
tcgtttctggcacttcctgtttccg

SEQ ID NO: 514973 - DNA, 25 bp, Rattus norvegicus
aggcttcccagtgacgtcgtttctg

SEQ ID NO: 514974 - DNA, 25 bp, Rattus norvegicus
tggctcaagcttctacaccaagcta

SEQ ID NO: 514975 - DNA, 25 bp, Rattus norvegicus
gagacgcatggctcaagcttctaca

SEQ ID NO: 514976 - DNA, 25 bp, Rattus norvegicus
ggcagctgtgagacgcatggctcaa

SEQ ID NO: 514977 - DNA, 25 bp, Rattus norvegicus
agcagaagcgcctgggagcctatga

SEQ ID NO: 514978 - DNA, 25 bp, Rattus norvegicus
cgctcaagccaagcagaagcgcctg

SEQ ID NO: 514979 - DNA, 25 bp, Rattus norvegicus
gaagtcgacgttcggcgctcaagcc

SEQ ID NO: 514980 - DNA, 25 bp, Rattus norvegicus
ttctccgagccaggcttcccagtga

SEQ ID NO: 514981 - DNA, 25 bp, Rattus norvegicus
taaatacccggaatcctccctggca

SEQ ID NO: 514982 - DNA, 25 bp, Rattus norvegicus
tcacagagtcgcctgggcgctctct

SEQ ID NO: 514983 - DNA, 25 bp, Rattus norvegicus
gcgccctacgggcaagagacgttcc

SEQ ID NO: 514984 - DNA, 25 bp, Rattus norvegicus
tccaagctgcgaggactcactcgcg

SEQ ID NO: 514985 - DNA, 25 bp, Rattus norvegicus
tttgtcgctaccacttccgccggga

SEQ ID NO: 514986 - DNA, 25 bp, Rattus norvegicus
ctgcgggccctaatggacgttgtct

SEQ ID NO: 514987 - DNA, 25 bp, Rattus norvegicus
tctggaagtctctcccaactcacag

SEQ ID NO: 514988 - DNA, 25 bp, Rattus norvegicus
ggcgctctctgcacagctctggaag

SEQ ID NO: 514989 - DNA, 25 bp, Rattus norvegicus
acagccatagccgtgtcacagagtc

SEQ ID NO: 514990 - DNA, 25 bp, Rattus norvegicus
cgagaccgagacaggcacagccata

SEQ ID NO: 514991 - DNA, 25 bp, Rattus norvegicus
tcacaatctcctcggacgacgcaga

SEQ ID NO: 514992 - DNA, 25 bp, Rattus norvegicus
cgacgcagagagaagctggtgttcc

SEQ ID NO: 514993 - DNA, 25 bp, Rattus norvegicus
aaggctaacccttgggctctcagga

SEQ ID NO: 514994 - DNA, 25 bp, Rattus norvegicus
gggctctcaggatagcgcctgccca

SEQ ID NO: 514995 - DNA, 25 bp, Rattus norvegicus
cggaaattggccacgcagtgcgtaa

SEQ ID NO: 514996 - DNA, 25 bp, Rattus norvegicus
cagcagctcagcctggatgtgcggc

SEQ ID NO: 514997 - DNA, 25 bp, Rattus norvegicus
gcagcgtccagcagctcagcctgga

SEQ ID NO: 514998 - DNA, 25 bp, Rattus norvegicus
ctctgagtctcttgcacggaagtga

SEQ ID NO: 514999 - DNA, 25 bp, Rattus norvegicus
ctttcgtgttcacgcgaggccgagc

SEQ ID NO: 515000 - DNA, 25 bp, Rattus norvegicus
ggcgggtcttggaacctctcaccgc

SEQ ID NO: 515001 - DNA, 25 bp, Rattus norvegicus
gtaagctccgtgctctctgagtctc

SEQ ID NO: 515002 - DNA, 25 bp, Rattus norvegicus
gcagtgcgtaagctccgtgctctct

SEQ ID NO: 515003 - DNA, 25 bp, Rattus norvegicus
taaggcccgctggatgacctcagag

SEQ ID NO: 515004 - DNA, 25 bp, Rattus norvegicus
ctcttgcacggaagtgaacggtgtg

SEQ ID NO: 515005 - DNA, 25 bp, Rattus norvegicus
gaagcgactacaggggctgcctcgt

SEQ ID NO: 515006 - DNA, 25 bp, Rattus norvegicus
tgcctcgtggagaagcaggcagcat

SEQ ID NO: 515007 - DNA, 25 bp, Rattus norvegicus
agtcccgacatcagaagcgcgctcg

SEQ ID NO: 515008 - DNA, 25 bp, Rattus norvegicus
gcacagccgcactctttcgtgttca

SEQ ID NO: 515009 - DNA, 25 bp, Rattus norvegicus
tagtcaccaccgtacttgtaaaagc

SEQ ID NO: 515010 - DNA, 25 bp, Rattus norvegicus
agagcccgaacaccacgcaggacga

SEQ ID NO: 515011 - DNA, 25 bp, Rattus norvegicus
cgcagcctctttcggcggcgattga

SEQ ID NO: 515012 - DNA, 25 bp, Rattus norvegicus
gcgattgactgtctgccgagcgcgt

SEQ ID NO: 515013 - DNA, 25 bp, Rattus norvegicus
tgcccgcctaccgtgaaagttgatt

SEQ ID NO: 515014 - DNA, 25 bp, Rattus norvegicus
tcccagccgctttgtttgagcccta

SEQ ID NO: 515015 - DNA, 25 bp, Rattus norvegicus
cctaccgtgaaagttgattggtgca

SEQ ID NO: 515016 - DNA, 25 bp, Rattus norvegicus
aggtaggtgaaggaaagctgattat

SEQ ID NO: 515017 - DNA, 25 bp, Rattus norvegicus
aaagctgattatggagcgctccctc

SEQ ID NO: 515018 - DNA, 25 bp, Rattus norvegicus
ggaaagtcacgtggcgcttcactcc

SEQ ID NO: 515019 - DNA, 25 bp, Rattus norvegicus
taaaagctttcttaaagagctcgcg

SEQ ID NO: 515020 - DNA, 25 bp, Rattus norvegicus
tgagccctacctgcagatcccttta

SEQ ID NO: 515021 - DNA, 25 bp, Rattus norvegicus
tttgtttgagccctacctgcagatc

SEQ ID NO: 515022 - DNA, 25 bp, Rattus norvegicus
cccaatgggaaagtcacgtggcgct

SEQ ID NO: 515023 - DNA, 25 bp, Rattus norvegicus
tcctgcagaagctgcgagacgacgg

SEQ ID NO: 515024 - DNA, 25 bp, Rattus norvegicus
gagctcttcgaatcgtcgcacattg

SEQ ID NO: 515025 - DNA, 25 bp, Rattus norvegicus
attgccggccgcacgagctcttcga

SEQ ID NO: 515026 - DNA, 25 bp, Rattus norvegicus
tcgcacattgagacggccatcaacc

SEQ ID NO: 515027 - DNA, 25 bp, Rattus norvegicus
attcccaaccatgccgacaaggagc

SEQ ID NO: 515028 - DNA, 25 bp, Rattus norvegicus
gacaaggagcgcttcgccacgcgct

SEQ ID NO: 515029 - DNA, 25 bp, Rattus norvegicus
cggccaccgtgctgctttacgacga

SEQ ID NO: 515030 - DNA, 25 bp, Rattus norvegicus
cggttctcggcctgctcctgcagaa

SEQ ID NO: 515031 - DNA, 25 bp, Rattus norvegicus
gctgtttcctttccactcgcttggc

SEQ ID NO: 515032 - DNA, 25 bp, Rattus norvegicus
tggcgccctcgctgcaggctgtttc

SEQ ID NO: 515033 - DNA, 25 bp, Rattus norvegicus
cctccaaggtaagggcagaacctag

SEQ ID NO: 515034 - DNA, 25 bp, Rattus norvegicus
tgccaggcctactacctccaaggta

SEQ ID NO: 515035 - DNA, 25 bp, Rattus norvegicus
gagacgacggctgccaggcctacta

SEQ ID NO: 515036 - DNA, 25 bp, Rattus norvegicus
gctgctttacgacgaggccacggct

SEQ ID NO: 515037 - DNA, 25 bp, Rattus norvegicus
cagggtctgcattcaggctcgaacc

SEQ ID NO: 515038 - DNA, 25 bp, Rattus norvegicus
tgccgccaggagcaaagcccagctt

SEQ ID NO: 515039 - DNA, 25 bp, Rattus norvegicus
cggcgatttcctctcagggcactga

SEQ ID NO: 515040 - DNA, 25 bp, Rattus norvegicus
agggcactgaattatgagacactgc

SEQ ID NO: 515041 - DNA, 25 bp, Rattus norvegicus
gacactgcgctttcggtttgccaca

SEQ ID NO: 515042 - DNA, 25 bp, Rattus norvegicus
cagacacccgatctcaaggcaggga

SEQ ID NO: 515043 - DNA, 25 bp, Rattus norvegicus
taggaacggtctaccagtgacagtc

SEQ ID NO: 515044 - DNA, 25 bp, Rattus norvegicus
cgcatctcaagattcaagctccttg

SEQ ID NO: 515045 - DNA, 25 bp, Rattus norvegicus
tccttgatggggaggatcgtgtcct

SEQ ID NO: 515046 - DNA, 25 bp, Rattus norvegicus
agcatcgtgatcctgcgtgggccac

SEQ ID NO: 515047 - DNA, 25 bp, Rattus norvegicus
ctgctccgtgtgcaagtggaagatc

SEQ ID NO: 515048 - DNA, 25 bp, Rattus norvegicus
aagatccgccgcaccctgactgtgt

SEQ ID NO: 515049 - DNA, 25 bp, Rattus norvegicus
cgccgccgaggaaactgacagagct

SEQ ID NO: 515050 - DNA, 25 bp, Rattus norvegicus
cctcgaactgggtgtctctcgtatc

SEQ ID NO: 515051 - DNA, 25 bp, Rattus norvegicus
atccgattccatccgtgattgtacg

SEQ ID NO: 515052 - DNA, 25 bp, Rattus norvegicus
tcattgcttgcgtttgagaggtagg

SEQ ID NO: 515053 - DNA, 25 bp, Rattus norvegicus
ggcgtcggccctatttcccgtgctg

SEQ ID NO: 515054 - DNA, 25 bp, Rattus norvegicus
tatttcccgtgctgcacagcgggcc

SEQ ID NO: 515055 - DNA, 25 bp, Rattus norvegicus
acagcgggcctttctctttctcttc

SEQ ID NO: 515056 - DNA, 25 bp, Rattus norvegicus
tcttccggtcccaggcgctgcggga

SEQ ID NO: 515057 - DNA, 25 bp, Rattus norvegicus
gtgttggccttacggcatccgattc

SEQ ID NO: 515058 - DNA, 25 bp, Rattus norvegicus
tgattgtacggcgactgtgggtcac

SEQ ID NO: 515059 - DNA, 25 bp, Rattus norvegicus
tcacgggcatgcgacacgggtcgca

SEQ ID NO: 515060 - DNA, 25 bp, Rattus norvegicus
gcccggtcgtcctcagggaatggat

SEQ ID NO: 515061 - DNA, 25 bp, Rattus norvegicus
gaatggatgaaggaaaaagcggccc

SEQ ID NO: 515062 - DNA, 25 bp, Rattus norvegicus
ctggggccggcaaacttagtttcag

SEQ ID NO: 515063 - DNA, 25 bp, Rattus norvegicus
ttagtttcaggacctcattgcttgc

SEQ ID NO: 515064 - DNA, 25 bp, Rattus norvegicus
cggcttaccgtgagtgttggcctta

SEQ ID NO: 515065 - DNA, 25 bp, Rattus norvegicus
cccttgcagcctccggatagggcga

SEQ ID NO: 515066 - DNA, 25 bp, Rattus norvegicus
agcctccggatagggcgagaaaaga

SEQ ID NO: 515067 - DNA, 25 bp, Rattus norvegicus
gaccgccagcccaggatggtcccgc

SEQ ID NO: 515068 - DNA, 25 bp, Rattus norvegicus
gggtcctcctcactgaggccagctc

SEQ ID NO: 515069 - DNA, 25 bp, Rattus norvegicus
tggatccgggatccacccactgggt

SEQ ID NO: 515070 - DNA, 25 bp, Rattus norvegicus
aactggaagcttggatccgggatcc

SEQ ID NO: 515071 - DNA, 25 bp, Rattus norvegicus
cgctgggtaactggaagcttggatc

SEQ ID NO: 515072 - DNA, 25 bp, Rattus norvegicus
gcctgcgctgggtaactggaagctt

SEQ ID NO: 515073 - DNA, 25 bp, Rattus norvegicus
gcgccgttgtccctgccaggctctg

SEQ ID NO: 515074 - DNA, 25 bp, Rattus norvegicus
gctgtcccagttcccgtggcggagc

SEQ ID NO: 515075 - DNA, 25 bp, Rattus norvegicus
tatatgggctgtcccagttcccgtg

SEQ ID NO: 515076 - DNA, 25 bp, Rattus norvegicus
accgaagactatatgggctgtccca

SEQ ID NO: 515077 - DNA, 25 bp, Rattus norvegicus
gcggagaccgaagactatatgggct

SEQ ID NO: 515078 - DNA, 25 bp, Rattus norvegicus
ggggcctggcgctaaaagtcaccgc

SEQ ID NO: 515079 - DNA, 25 bp, Rattus norvegicus
gaagtccagccacccaggcgcgctt

SEQ ID NO: 515080 - DNA, 25 bp, Rattus norvegicus
ggtaagctggcgaccgaagtccagc

SEQ ID NO: 515081 - DNA, 25 bp, Rattus norvegicus
tcctccttggtaagctggcgaccga

SEQ ID NO: 515082 - DNA, 25 bp, Rattus norvegicus
cgttatggcacagcctcctccttgg

SEQ ID NO: 515083 - DNA, 25 bp, Rattus norvegicus
ctagcgcgttatggcacagcctcct

SEQ ID NO: 515084 - DNA, 25 bp, Rattus norvegicus
acagcctagcgcgttatggcacagc

SEQ ID NO: 515085 - DNA, 25 bp, Rattus norvegicus
ctgccaaacagcctagcgcgttatg

SEQ ID NO: 515086 - DNA, 25 bp, Rattus norvegicus
ggagccaactgccaaacagcctagc

SEQ ID NO: 515087 - DNA, 25 bp, Rattus norvegicus
gtgcctccttccctggggacactca

SEQ ID NO: 515088 - DNA, 25 bp, Rattus norvegicus
agatctcgggacaacctgcgtgcct

SEQ ID NO: 515089 - DNA, 25 bp, Rattus norvegicus
caaggatggcagatctcgggacaac

SEQ ID NO: 515090 - DNA, 25 bp, Rattus norvegicus
cgcttgcgccttccgaaggactctg

SEQ ID NO: 515091 - DNA, 25 bp, Rattus norvegicus
ttgccttgcgcttgcgccttccgaa

SEQ ID NO: 515092 - DNA, 25 bp, Rattus norvegicus
ttccgaaggactctgccccaagcgg

SEQ ID NO: 515093 - DNA, 25 bp, Rattus norvegicus
tttcccggggacaatgtgggactga

SEQ ID NO: 515094 - DNA, 25 bp, Rattus norvegicus
cgagagccacacaaggaagatccgg

SEQ ID NO: 515095 - DNA, 25 bp, Rattus norvegicus
ccgccgcgctgtaatcggatccggg

SEQ ID NO: 515096 - DNA, 25 bp, Rattus norvegicus
ttgagaagctttgccaggatcctcc

SEQ ID NO: 515097 - DNA, 25 bp, Rattus norvegicus
aagccttccctagagcgtgctggca

SEQ ID NO: 515098 - DNA, 25 bp, Rattus norvegicus
tgctggcattcccacagactcggga

SEQ ID NO: 515099 - DNA, 25 bp, Rattus norvegicus
tcgggagaatgcatcccagggcgcc

SEQ ID NO: 515100 - DNA, 25 bp, Rattus norvegicus
cagggcgccctaaaacttacgatca

SEQ ID NO: 515101 - DNA, 25 bp, Rattus norvegicus
cttacgatcaacctacagctgtagg

SEQ ID NO: 515102 - DNA, 25 bp, Rattus norvegicus
cccggtgtgacagccataccatctg

SEQ ID NO: 515103 - DNA, 25 bp, Rattus norvegicus
ccatctggatggctgacaagaaccc

SEQ ID NO: 515104 - DNA, 25 bp, Rattus norvegicus
tcattgttcgcagctgatgtcactc

SEQ ID NO: 515105 - DNA, 25 bp, Rattus norvegicus
atgtcactcgcagttgtgagcggcc

SEQ ID NO: 515106 - DNA, 25 bp, Rattus norvegicus
actccagagtgaaggatggtgaaga

SEQ ID NO: 515107 - DNA, 25 bp, Rattus norvegicus
ccaggcttgcggtgtgcaagctttc

SEQ ID NO: 515108 - DNA, 25 bp, Rattus norvegicus
cacctctacgagaaccgccaggata

SEQ ID NO: 515109 - DNA, 25 bp, Rattus norvegicus
accacgagcagagtgccgttgccca

SEQ ID NO: 515110 - DNA, 25 bp, Rattus norvegicus
tagaaggcatcttgcaggtccggcg

SEQ ID NO: 515111 - DNA, 25 bp, Rattus norvegicus
acaagtgcgccaggtagaaggcatc

SEQ ID NO: 515112 - DNA, 25 bp, Rattus norvegicus
gccagcaggtccacaacacacaagt

SEQ ID NO: 515113 - DNA, 25 bp, Rattus norvegicus
agccagcaggcccagaggcatgatg

SEQ ID NO: 515114 - DNA, 25 bp, Rattus norvegicus
cgaaggctagcatcgcccaaagtgg

SEQ ID NO: 515115 - DNA, 25 bp, Rattus norvegicus
gcgccaccaggaagatgctaccgta

SEQ ID NO: 515116 - DNA, 25 bp, Rattus norvegicus
cagcaggctgcaaactggcccacgg

SEQ ID NO: 515117 - DNA, 25 bp, Rattus norvegicus
caaacacgcgcaggcataaggcagc

SEQ ID NO: 515118 - DNA, 25 bp, Rattus norvegicus
gtaggctacccaggtgacagcagcc

SEQ ID NO: 515119 - DNA, 25 bp, Rattus norvegicus
ccgcgagttcggtgacgcttagccc

SEQ ID NO: 515120 - DNA, 25 bp, Rattus norvegicus
cagaccatagagaaaggggtgagcc

SEQ ID NO: 515121 - DNA, 25 bp, Rattus norvegicus
cgtggctaactgaaccggtccaata

SEQ ID NO: 515122 - DNA, 25 bp, Rattus norvegicus
ccaatagacgattggaggcgtgaca

SEQ ID NO: 515123 - DNA, 25 bp, Rattus norvegicus
tcttctaaagggtccaatggagctg

SEQ ID NO: 515124 - DNA, 25 bp, Rattus norvegicus
cgccgtgggaccctatcagtgtttc

SEQ ID NO: 515125 - DNA, 25 bp, Rattus norvegicus
tcagtgtttcgggtcttgccatgtg

SEQ ID NO: 515126 - DNA, 25 bp, Rattus norvegicus
catgtggccggggtttagcagccat

SEQ ID NO: 515127 - DNA, 25 bp, Rattus norvegicus
tagcagccatgtgagttcttcagta

SEQ ID NO: 515128 - DNA, 25 bp, Rattus norvegicus
ttcttcagtagaggctgcggcacct

SEQ ID NO: 515129 - DNA, 25 bp, Rattus norvegicus
ggcaccttgatgaacagtatgtcga

SEQ ID NO: 515130 - DNA, 25 bp, Rattus norvegicus
gtcgaccgccgtggcaactcgtaaa

SEQ ID NO: 515131 - DNA, 25 bp, Rattus norvegicus
ctcgtaaacgggcaaagccagctcc

SEQ ID NO: 515132 - DNA, 25 bp, Rattus norvegicus
cgaaaggtgagcatggagttttcct

SEQ ID NO: 515133 - DNA, 25 bp, Rattus norvegicus
gacggagcctataggagttcttgga

SEQ ID NO: 515134 - DNA, 25 bp, Rattus norvegicus
tggaggcgtgacaggatcttctaaa

SEQ ID NO: 515135 - DNA, 25 bp, Rattus norvegicus
tgtctccttgcctgtgccaggtgcc

SEQ ID NO: 515136 - DNA, 25 bp, Rattus norvegicus
accgaggcgcctcaaggtacagacg

SEQ ID NO: 515137 - DNA, 25 bp, Rattus norvegicus
agtagcagacagagaaggcggtacc

SEQ ID NO: 515138 - DNA, 25 bp, Rattus norvegicus
tatgcgagcaatgcgattggtcttg

SEQ ID NO: 515139 - DNA, 25 bp, Rattus norvegicus
gcccgagataagtgccaagcagatg

SEQ ID NO: 515140 - DNA, 25 bp, Rattus norvegicus
cgcgatgaggagcacattgtaggcc

SEQ ID NO: 515141 - DNA, 25 bp, Rattus norvegicus
acttcccgccgttcaggggctgtct

SEQ ID NO: 515142 - DNA, 25 bp, Rattus norvegicus
ggttacagcgcaatgtcaccacttc

SEQ ID NO: 515143 - DNA, 25 bp, Rattus norvegicus
catgctcgcgtcacggtggttacag

SEQ ID NO: 515144 - DNA, 25 bp, Rattus norvegicus
tgtaggccagtgagccgagcatgct

SEQ ID NO: 515145 - DNA, 25 bp, Rattus norvegicus
caccagccaggcagcgacaatgagc

SEQ ID NO: 515146 - DNA, 25 bp, Rattus norvegicus
gacaatgagcagctggcccgagata

SEQ ID NO: 515147 - DNA, 25 bp, Rattus norvegicus
tcgttgaagttctccgggcacttgc

SEQ ID NO: 515148 - DNA, 25 bp, Rattus norvegicus
cacttgcgggtcttgaaggcataga

SEQ ID NO: 515149 - DNA, 25 bp, Rattus norvegicus
tcagaagtggccacgcagatgttgc

SEQ ID NO: 515150 - DNA, 25 bp, Rattus norvegicus
acccatgtgaagctggcgttgaggc

SEQ ID NO: 515151 - DNA, 25 bp, Rattus norvegicus
gccacccatgtgaagctggcgttga

SEQ ID NO: 515152 - DNA, 25 bp, Rattus norvegicus
cacgggcatcctcggaccgggtgaa

SEQ ID NO: 515153 - DNA, 25 bp, Rattus norvegicus
accgggtgaagagcacagccacacg

SEQ ID NO: 515154 - DNA, 25 bp, Rattus norvegicus
agcacagccacacgggcactgggtt

SEQ ID NO: 515155 - DNA, 25 bp, Rattus norvegicus
gcactgggtttctgcaacagggctc

SEQ ID NO: 515156 - DNA, 25 bp, Rattus norvegicus
gggtttctgcaacagggctcgcacc

SEQ ID NO: 515157 - DNA, 25 bp, Rattus norvegicus
gccctcgaaggcagcgcggctcatg

SEQ ID NO: 515158 - DNA, 25 bp, Rattus norvegicus
accttctcagaagtggccacgcaga

SEQ ID NO: 515159 - DNA, 25 bp, Rattus norvegicus
cacgcagatgttgcgtgcccgagcc

SEQ ID NO: 515160 - DNA, 25 bp, Rattus norvegicus
gttgcgtgcccgagcctcgagctcg

SEQ ID NO: 515161 - DNA, 25 bp, Rattus norvegicus
gctgcaagcagctcacgggcatcct

SEQ ID NO: 515162 - DNA, 25 bp, Rattus norvegicus
tggcacggcccaccttctcagaagt

SEQ ID NO: 515163 - DNA, 25 bp, Rattus norvegicus
tgggactggccacaagcggccctag

SEQ ID NO: 515164 - DNA, 25 bp, Rattus norvegicus
ccctgtggacaaatgtggacatgca

SEQ ID NO: 515165 - DNA, 25 bp, Rattus norvegicus
cagcgcctccctgtggacaaatgtg

SEQ ID NO: 515166 - DNA, 25 bp, Rattus norvegicus
tggccgctgcctagagcggccagac

SEQ ID NO: 515167 - DNA, 25 bp, Rattus norvegicus
accggaagcccgtgtagaagaggct

SEQ ID NO: 515168 - DNA, 25 bp, Rattus norvegicus
acgcagctctcagcccgggtaaaga

SEQ ID NO: 515169 - DNA, 25 bp, Rattus norvegicus
gtcggcatctcgaagtcctactcca

SEQ ID NO: 515170 - DNA, 25 bp, Rattus norvegicus
cgccagtcggcatctcgaagtccta

SEQ ID NO: 515171 - DNA, 25 bp, Rattus norvegicus
acttactcaaagtcgccagtcggca

SEQ ID NO: 515172 - DNA, 25 bp, Rattus norvegicus
gccaccgaacacttactcaaagtcg

SEQ ID NO: 515173 - DNA, 25 bp, Rattus norvegicus
acctggtcggcccagctgggcttcg

SEQ ID NO: 515174 - DNA, 25 bp, Rattus norvegicus
gacatgcatgttttgcgtgccgcaa

SEQ ID NO: 515175 - DNA, 25 bp, Rattus norvegicus
cacaagcggccctagcctgtgcgtg

SEQ ID NO: 515176 - DNA, 25 bp, Rattus norvegicus
gccctagcctgtgcgtgggcatccg

SEQ ID NO: 515177 - DNA, 25 bp, Rattus norvegicus
tcagggctaaaaaaggttggcagtg

SEQ ID NO: 515178 - DNA, 25 bp, Rattus norvegicus
gtgcctgggacggtcttcccgcttc

SEQ ID NO: 515179 - DNA, 25 bp, Rattus norvegicus
ctctctcgctggctctgcgctctct

SEQ ID NO: 515180 - DNA, 25 bp, Rattus norvegicus
gttcccgcttgctggctctctcgct

SEQ ID NO: 515181 - DNA, 25 bp, Rattus norvegicus
cacaggctaaccctacctggcgcgc

SEQ ID NO: 515182 - DNA, 25 bp, Rattus norvegicus
agtgacggcggcaccacaggctaac

SEQ ID NO: 515183 - DNA, 25 bp, Rattus norvegicus
ctaaaaaaggttggcagtgacggcg

SEQ ID NO: 515184 - DNA, 25 bp, Rattus norvegicus
cgtgcgttctcttgggaagaaaggc

SEQ ID NO: 515185 - DNA, 25 bp, Rattus norvegicus
tgctccagaactctaggacccgcgg

SEQ ID NO: 515186 - DNA, 25 bp, Rattus norvegicus
gtctcggcccgggtgctccagaact

SEQ ID NO: 515187 - DNA, 25 bp, Rattus norvegicus
aagcgctgtctggacgtctcggccc

SEQ ID NO: 515188 - DNA, 25 bp, Rattus norvegicus
ccagaaagcgctgtctggacgtctc

SEQ ID NO: 515189 - DNA, 25 bp, Rattus norvegicus
ccggagctcccagaaagcgctgtct

SEQ ID NO: 515190 - DNA, 25 bp, Rattus norvegicus
cccgggtgctccagaactctaggac

SEQ ID NO: 515191 - DNA, 25 bp, Rattus norvegicus
gcgcgcctacgggagcggctcctgg

SEQ ID NO: 515192 - DNA, 25 bp, Rattus norvegicus
ctggccgaggcttgccctgcgccag

SEQ ID NO: 515193 - DNA, 25 bp, Rattus norvegicus
cctgcgccagcatctgtacctaatt

SEQ ID NO: 515194 - DNA, 25 bp, Rattus norvegicus
tgcgccagcatctgtacctaattaa

SEQ ID NO: 515195 - DNA, 25 bp, Rattus norvegicus
cgccagcatctgtacctaattaatg

SEQ ID NO: 515196 - DNA, 25 bp, Rattus norvegicus
tctgtacctaattaatgctggcggc

SEQ ID NO: 515197 - DNA, 25 bp, Rattus norvegicus
tacctaattaatgctggcggctgcc

SEQ ID NO: 515198 - DNA, 25 bp, Rattus norvegicus
cctaattaatgctggcggctgcctc

SEQ ID NO: 515199 - DNA, 25 bp, Rattus norvegicus
ctaattaatgctggcggctgcctct

SEQ ID NO: 515200 - DNA, 25 bp, Rattus norvegicus
ctccgcgcctgacgttagacgtgct

SEQ ID NO: 515201 - DNA, 25 bp, Rattus norvegicus
ctgacgttagacgtgctggggaaac

SEQ ID NO: 515202 - DNA, 25 bp, Rattus norvegicus
cgttagacgtgctggggaaacgcct

SEQ ID NO: 515203 - DNA, 25 bp, Rattus norvegicus
gtgctggggaaacgcctgcagccac

SEQ ID NO: 515204 - DNA, 25 bp, Rattus norvegicus
gcgctgcggggaaagctccgggctc

SEQ ID NO: 515205 - DNA, 25 bp, Rattus norvegicus
aggctgctcacgtgcgctccgcgga

SEQ ID NO: 515206 - DNA, 25 bp, Rattus norvegicus
cctgcgccggcaaacttggatgcta

SEQ ID NO: 515207 - DNA, 25 bp, Rattus norvegicus
tcacggcctcgtgcatctctgcaac

SEQ ID NO: 515208 - DNA, 25 bp, Rattus norvegicus
tctgcaacttcagagacgctaaagt

SEQ ID NO: 515209 - DNA, 25 bp, Rattus norvegicus
ttcagagacgctaaagtttgtagtc

SEQ ID NO: 515210 - DNA, 25 bp, Rattus norvegicus
ctaaagtttgtagtcgcgacgaggc

SEQ ID NO: 515211 - DNA, 25 bp, Rattus norvegicus
tcccgcaccctacaccgaggcaaga

SEQ ID NO: 515212 - DNA, 25 bp, Rattus norvegicus
cgcggagaggtcaggaccgcctcac

SEQ ID NO: 515213 - DNA, 25 bp, Rattus norvegicus
ctttcaggcccaggaaccaggccgg

SEQ ID NO: 515214 - DNA, 25 bp, Rattus norvegicus
ccagcagtgagccagacgcggtgca

SEQ ID NO: 515215 - DNA, 25 bp, Rattus norvegicus
cgacaggaacgccttgcatctggct

SEQ ID NO: 515216 - DNA, 25 bp, Rattus norvegicus
aggaacgccttgcatctggctccgc

SEQ ID NO: 515217 - DNA, 25 bp, Rattus norvegicus
aagaaggggctcagtcccggagcct

SEQ ID NO: 515218 - DNA, 25 bp, Rattus norvegicus
gcaggcttccggaggctgctcacgt

SEQ ID NO: 515219 - DNA, 25 bp, Rattus norvegicus
tcccgtgccacggatccgggccgca

SEQ ID NO: 515220 - DNA, 25 bp, Rattus norvegicus
ccggcagggagtaaggggaccgcag

SEQ ID NO: 515221 - DNA, 25 bp, Rattus norvegicus
ggacgggaacacaagccacccgcag

SEQ ID NO: 515222 - DNA, 25 bp, Rattus norvegicus
ggccgtaggacctcgcgttctgccg

SEQ ID NO: 515223 - DNA, 25 bp, Rattus norvegicus
cgcgttctgccgcacccgcctggac

SEQ ID NO: 515224 - DNA, 25 bp, Rattus norvegicus
cgcggtccgcgccagaaagcttccc

SEQ ID NO: 515225 - DNA, 25 bp, Rattus norvegicus
ccgcacccgcctggacggtgtctgc

SEQ ID NO: 515226 - DNA, 25 bp, Rattus norvegicus
acaagccacccgcagcaaagttccg

SEQ ID NO: 515227 - DNA, 25 bp, Rattus norvegicus
ctccgctcgcggtccgcgccagaaa

SEQ ID NO: 515228 - DNA, 25 bp, Rattus norvegicus
ctctggccgagggtcggtcttctcc

SEQ ID NO: 515229 - DNA, 25 bp, Rattus norvegicus
ggcggcgctctcagcctccgctcgc

SEQ ID NO: 515230 - DNA, 25 bp, Rattus norvegicus
gctgggccgtaggacctcgcgttct

SEQ ID NO: 515231 - DNA, 25 bp, Rattus norvegicus
ggaacacaagccacccgcagcaaag

SEQ ID NO: 515232 - DNA, 25 bp, Rattus norvegicus
agaagcgactgaggcgggaagcagc

SEQ ID NO: 515233 - DNA, 25 bp, Rattus norvegicus
tctctgttcctcacgagacgagggg

SEQ ID NO: 515234 - DNA, 25 bp, Rattus norvegicus
tgacaagactttccgctttccgacc

SEQ ID NO: 515235 - DNA, 25 bp, Rattus norvegicus
cgcgcgcacagtacgtagcatgcga

SEQ ID NO: 515236 - DNA, 25 bp, Rattus norvegicus
cgtagcatgcgagtgacgtataata

SEQ ID NO: 515237 - DNA, 25 bp, Rattus norvegicus
tgggccctgggcctgacaagacttt

SEQ ID NO: 515238 - DNA, 25 bp, Rattus norvegicus
acttcatttcccaggagcgctttga

SEQ ID NO: 515239 - DNA, 25 bp, Rattus norvegicus
tccaggttcttccaccagtcttgta

SEQ ID NO: 515240 - DNA, 25 bp, Rattus norvegicus
ccagtcttgtaatgaagcttcttta

SEQ ID NO: 515241 - DNA, 25 bp, Rattus norvegicus
agagtaactcttccgcccgggcgtg

SEQ ID NO: 515242 - DNA, 25 bp, Rattus norvegicus
ggggcagggtatgctctctacctga

SEQ ID NO: 515243 - DNA, 25 bp, Rattus norvegicus
tctctacctgaaggaggtgctcttt

SEQ ID NO: 515244 - DNA, 25 bp, Rattus norvegicus
ggtgctcttttgaatttctctcgtc

SEQ ID NO: 515245 - DNA, 25 bp, Rattus norvegicus
aacctcaatcacctgggcgggcttt

SEQ ID NO: 515246 - DNA, 25 bp, Rattus norvegicus
cgtataatatgtgggccgctcagga

SEQ ID NO: 515247 - DNA, 25 bp, Rattus norvegicus
gctttcgtctctcttcccagggctt

SEQ ID NO: 515248 - DNA, 25 bp, Rattus norvegicus
ggaaaggctcctccgctttcgtctc

SEQ ID NO: 515249 - DNA, 25 bp, Rattus norvegicus
tcctcccgcggtcactggaaaggct

SEQ ID NO: 515250 - DNA, 25 bp, Rattus norvegicus
caccactccggcttcgcactgagcg

SEQ ID NO: 515251 - DNA, 25 bp, Rattus norvegicus
ctcataaggggagtgagttgtcctc

SEQ ID NO: 515252 - DNA, 25 bp, Rattus norvegicus
ccgttcctcataaggggagtgagtt

SEQ ID NO: 515253 - DNA, 25 bp, Rattus norvegicus
tgctccgttcctcataaggggagtg

SEQ ID NO: 515254 - DNA, 25 bp, Rattus norvegicus
cagggcttggctatgctccggtccc

SEQ ID NO: 515255 - DNA, 25 bp, Rattus norvegicus
gtccgagcctcgctcagactgctgc

SEQ ID NO: 515256 - DNA, 25 bp, Rattus norvegicus
ggtcactggaaaggctcctccgctt

SEQ ID NO: 515257 - DNA, 25 bp, Rattus norvegicus
cccagcgctcaccactccggcttcg

SEQ ID NO: 515258 - DNA, 25 bp, Rattus norvegicus
cttggtcctgctccgttcctcataa

SEQ ID NO: 515259 - DNA, 25 bp, Rattus norvegicus
gtcctgctccgttcctcataagggg

SEQ ID NO: 515260 - DNA, 25 bp, Rattus norvegicus
agtgagttgtcctcccgcggtcact

SEQ ID NO: 515261 - DNA, 25 bp, Rattus norvegicus
gctctaccttgagcgggcggtcgta

SEQ ID NO: 515262 - DNA, 25 bp, Rattus norvegicus
agagcgctgcttgtactggtagccc

SEQ ID NO: 515263 - DNA, 25 bp, Rattus norvegicus
cgcgcaggtacacgggctctacctt

SEQ ID NO: 515264 - DNA, 25 bp, Rattus norvegicus
ccgccatcttggacaaaaggactcg

SEQ ID NO: 515265 - DNA, 25 bp, Rattus norvegicus
tcgtagagcagcagctgacgggcca

SEQ ID NO: 515266 - DNA, 25 bp, Rattus norvegicus
aggctgatctcaccgaaccgcttga

SEQ ID NO: 515267 - DNA, 25 bp, Rattus norvegicus
aaccgcttgaactggtggaagagcc

SEQ ID NO: 515268 - DNA, 25 bp, Rattus norvegicus
tggaagagccggtcctccaagtgct

SEQ ID NO: 515269 - DNA, 25 bp, Rattus norvegicus
tgctgatgaggagcgtcttgtactc

SEQ ID NO: 515270 - DNA, 25 bp, Rattus norvegicus
ctgcttgctcggtgattcgcatccc

SEQ ID NO: 515271 - DNA, 25 bp, Rattus norvegicus
ggcttgtcacgagcccgcgctggaa

SEQ ID NO: 515272 - DNA, 25 bp, Rattus norvegicus
cgcttggcggacgatgacgagccac

SEQ ID NO: 515273 - DNA, 25 bp, Rattus norvegicus
ctggagtctcgctcgttctgccgct

SEQ ID NO: 515274 - DNA, 25 bp, Rattus norvegicus
tctgccgcttcattgcgccggcttg

SEQ ID NO: 515275 - DNA, 25 bp, Rattus norvegicus
gcggcccacaggatccctatctata

SEQ ID NO: 515276 - DNA, 25 bp, Rattus norvegicus
cgtagcgcccgactgtcaggcagaa

SEQ ID NO: 515277 - DNA, 25 bp, Rattus norvegicus
ttcgttgggtttagcgcctccaggc

SEQ ID NO: 515278 - DNA, 25 bp, Rattus norvegicus
cgccctcaccctctcggtttcgttg

SEQ ID NO: 515279 - DNA, 25 bp, Rattus norvegicus
gcccgactgtcaggcagaacgctca

SEQ ID NO: 515280 - DNA, 25 bp, Rattus norvegicus
ttctccagcggactctccgggatgg

SEQ ID NO: 515281 - DNA, 25 bp, Rattus norvegicus
ggatccctatctataatttcaaaag

SEQ ID NO: 515282 - DNA, 25 bp, Rattus norvegicus
aaaggacaaaaactcccgcgatgtg

SEQ ID NO: 515283 - DNA, 25 bp, Rattus norvegicus
aaaactcccgcgatgtgggctgccg

SEQ ID NO: 515284 - DNA, 25 bp, Rattus norvegicus
ggctgccggccaagttttcaacgcg

SEQ ID NO: 515285 - DNA, 25 bp, Rattus norvegicus
agttttcaacgcgactgaaccgtcg

SEQ ID NO: 515286 - DNA, 25 bp, Rattus norvegicus
tcctaggcccgggaaataactctga

SEQ ID NO: 515287 - DNA, 25 bp, Rattus norvegicus
ggaaataactctgaggccctttctc

SEQ ID NO: 515288 - DNA, 25 bp, Rattus norvegicus
tctgaggccctttctccagcggact

SEQ ID NO: 515289 - DNA, 25 bp, Rattus norvegicus
gtcggctgctgtcctggacttatga

SEQ ID NO: 515290 - DNA, 25 bp, Rattus norvegicus
ttatgaggacctcgcgacaaggctg

SEQ ID NO: 515291 - DNA, 25 bp, Rattus norvegicus
ccaatcttggaaagcgtccactttc

SEQ ID NO: 515292 - DNA, 25 bp, Rattus norvegicus
tcctggacttatgaggacctcgcga

SEQ ID NO: 515293 - DNA, 25 bp, Rattus norvegicus
ggacctcgcgacaaggctgcgaaca

SEQ ID NO: 515294 - DNA, 25 bp, Rattus norvegicus
tctagacctgcctagtcggctgctg

SEQ ID NO: 515295 - DNA, 25 bp, Rattus norvegicus
tcttaaacgaaaggctctagacctg

SEQ ID NO: 515296 - DNA, 25 bp, Rattus norvegicus
tagactgcggaaacctcttaaacga

SEQ ID NO: 515297 - DNA, 25 bp, Rattus norvegicus
cgcgagcaagggtcagaagcagttt

SEQ ID NO: 515298 - DNA, 25 bp, Rattus norvegicus
tttcttgttttgaactaccacgtga

SEQ ID NO: 515299 - DNA, 25 bp, Rattus norvegicus
ttttgaactaccacgtgaattgacg

SEQ ID NO: 515300 - DNA, 25 bp, Rattus norvegicus
tcctgggatagactgcggaaacctc

SEQ ID NO: 515301 - DNA, 25 bp, Rattus norvegicus
agcgtccactttcattcgccggctg

SEQ ID NO: 515302 - DNA, 25 bp, Rattus norvegicus
cgtgaattgacgaaccaatcttgga

SEQ ID NO: 515303 - DNA, 25 bp, Rattus norvegicus
ctgaccgaccgcgagattccacggg

SEQ ID NO: 515304 - DNA, 25 bp, Rattus norvegicus
cgggactcgggtacatgcccctgaa

SEQ ID NO: 515305 - DNA, 25 bp, Rattus norvegicus
cctacgccgtatttctcctcctctg

SEQ ID NO: 515306 - DNA, 25 bp, Rattus norvegicus
ctcctcctctgtgggggtccacatg

SEQ ID NO: 515307 - DNA, 25 bp, Rattus norvegicus
agtaggcggcgcatccctcacaggc

SEQ ID NO: 515308 - DNA, 25 bp, Rattus norvegicus
gccacctccggatgccacgtcctga

SEQ ID NO: 515309 - DNA, 25 bp, Rattus norvegicus
ggcaacacgggcgaaggctcaccac

SEQ ID NO: 515310 - DNA, 25 bp, Rattus norvegicus
gggcgaaggctcaccacctgtccgt

SEQ ID NO: 515311 - DNA, 25 bp, Rattus norvegicus
tcggtccctcacagctcagtcgctg

SEQ ID NO: 515312 - DNA, 25 bp, Rattus norvegicus
tctgcgagaggcgattggatagcct

SEQ ID NO: 515313 - DNA, 25 bp, Rattus norvegicus
agagcctttggctgcagctaccgca

SEQ ID NO: 515314 - DNA, 25 bp, Rattus norvegicus
tgcagctaccgcagaacggggtcgc

SEQ ID NO: 515315 - DNA, 25 bp, Rattus norvegicus
cgcgagattccacgggcagccgaag

SEQ ID NO: 515316 - DNA, 25 bp, Rattus norvegicus
ccgaggccgcacagtctgcaggcag

SEQ ID NO: 515317 - DNA, 25 bp, Rattus norvegicus
acaaaagattaggaggcgcctagcc

SEQ ID NO: 515318 - DNA, 25 bp, Rattus norvegicus
ctcagcggacaaaagattaggaggc

SEQ ID NO: 515319 - DNA, 25 bp, Rattus norvegicus
ccgaactccgactctcgagccgccg

SEQ ID NO: 515320 - DNA, 25 bp, Rattus norvegicus
gctgctcgcaccacagcctttcagt

SEQ ID NO: 515321 - DNA, 25 bp, Rattus norvegicus
ttccgggaagggctgggactcagcg

SEQ ID NO: 515322 - DNA, 25 bp, Rattus norvegicus
ggactcagcggacaaaagattagga

SEQ ID NO: 515323 - DNA, 25 bp, Rattus norvegicus
aagcccgcggttctaggaagatgcg

SEQ ID NO: 515324 - DNA, 25 bp, Rattus norvegicus
cggacaaaagattaggaggcgccta

SEQ ID NO: 515325 - DNA, 25 bp, Rattus norvegicus
aaagcccgcggttctaggaagatgc

SEQ ID NO: 515326 - DNA, 25 bp, Rattus norvegicus
ccctcgttcttccaagctgctcgca

SEQ ID NO: 515327 - DNA, 25 bp, Rattus norvegicus
ggcacccactggctcctttcttctt

SEQ ID NO: 515328 - DNA, 25 bp, Rattus norvegicus
cgtcccgccgaactccgactctcga

SEQ ID NO: 515329 - DNA, 25 bp, Rattus norvegicus
tcccgactgctgcaaagcccgcggt

SEQ ID NO: 515330 - DNA, 25 bp, Rattus norvegicus
tgggactcagcggacaaaagattag

SEQ ID NO: 515331 - DNA, 25 bp, Rattus norvegicus
caccaggggatgagcgtgttgaatt

SEQ ID NO: 515332 - DNA, 25 bp, Rattus norvegicus
cacttgtatgttgggcaggtcacgc

SEQ ID NO: 515333 - DNA, 25 bp, Rattus norvegicus
tcacgccaatccgatcctggggaca

SEQ ID NO: 515334 - DNA, 25 bp, Rattus norvegicus
atgtgccgcatacgggcagccacca

SEQ ID NO: 515335 - DNA, 25 bp, Rattus norvegicus
aggtcttgccttccgcacaggagca

SEQ ID NO: 515336 - DNA, 25 bp, Rattus norvegicus
gttatgacgccatctctcagccgca

SEQ ID NO: 515337 - DNA, 25 bp, Rattus norvegicus
ttgaattgtctggaagcagggtcgc

SEQ ID NO: 515338 - DNA, 25 bp, Rattus norvegicus
agacgcccgtagaggccagcccagt

SEQ ID NO: 515339 - DNA, 25 bp, Rattus norvegicus
cggtggtactgaagaagccatccca

SEQ ID NO: 515340 - DNA, 25 bp, Rattus norvegicus
cttgcttgcccatgggctcagggtt

SEQ ID NO: 515341 - DNA, 25 bp, Rattus norvegicus
gcagccgttcttcgtgtcgtggaaa

SEQ ID NO: 515342 - DNA, 25 bp, Rattus norvegicus
aaagccttgggagcgagcacattcc

SEQ ID NO: 515343 - DNA, 25 bp, Rattus norvegicus
accggtaggtatctggaaagccttg

SEQ ID NO: 515344 - DNA, 25 bp, Rattus norvegicus
actcacgacccggtgctgctcggga

SEQ ID NO: 515345 - DNA, 25 bp, Rattus norvegicus
agttttcttctagacaccgtgtaga

SEQ ID NO: 515346 - DNA, 25 bp, Rattus norvegicus
aagcgcctctggagatcgcgaaagc

SEQ ID NO: 515347 - DNA, 25 bp, Rattus norvegicus
cgcctctggcttgaggttggcgttt

SEQ ID NO: 515348 - DNA, 25 bp, Rattus norvegicus
cgaaagcgcctctggcttgaggttg

SEQ ID NO: 515349 - DNA, 25 bp, Rattus norvegicus
aagaccgcccgggtagatcacggag

SEQ ID NO: 515350 - DNA, 25 bp, Rattus norvegicus
tctggagatcgcgaaagcgcctctg

SEQ ID NO: 515351 - DNA, 25 bp, Rattus norvegicus
cggcaggatgggagaagaccgcccg

SEQ ID NO: 515352 - DNA, 25 bp, Rattus norvegicus
cgaaagcgcctctggagatcgcgaa

SEQ ID NO: 515353 - DNA, 25 bp, Rattus norvegicus
tagatcgcgaaagcgcctctggaga

SEQ ID NO: 515354 - DNA, 25 bp, Rattus norvegicus
cgtgtagatcgcgaaagcgcctctg

SEQ ID NO: 515355 - DNA, 25 bp, Rattus norvegicus
acaccgtgtagatcgcgaaagcgcc

SEQ ID NO: 515356 - DNA, 25 bp, Rattus norvegicus
tagacaccgtgtagatcgcgaaagc

SEQ ID NO: 515357 - DNA, 25 bp, Rattus norvegicus
ccgcccgggtagatcacggagccag

SEQ ID NO: 515358 - DNA, 25 bp, Rattus norvegicus
gagatcgcgaaagcgcctctggctt

SEQ ID NO: 515359 - DNA, 25 bp, Rattus norvegicus
gccaatgctggtcggcctttaggcg

SEQ ID NO: 515360 - DNA, 25 bp, Rattus norvegicus
ccagctcaggttgtcagccggcgca

SEQ ID NO: 515361 - DNA, 25 bp, Rattus norvegicus
ggagcggagctatatccgagcgaca

SEQ ID NO: 515362 - DNA, 25 bp, Rattus norvegicus
ctatatccgagcgacaggcgagtga

SEQ ID NO: 515363 - DNA, 25 bp, Rattus norvegicus
gtgagccaatgctggtcggccttta

SEQ ID NO: 515364 - DNA, 25 bp, Rattus norvegicus
cgggaggcaaggtactccggctcct

SEQ ID NO: 515365 - DNA, 25 bp, Rattus norvegicus
cggcgcaggctaatactagctgatt

SEQ ID NO: 515366 - DNA, 25 bp, Rattus norvegicus
actagctgattcctgctcgctcgca

SEQ ID NO: 515367 - DNA, 25 bp, Rattus norvegicus
agcttctcagactgagctcggcgcc

SEQ ID NO: 515368 - DNA, 25 bp, Rattus norvegicus
ggaccttacttgagtccgacctgtc

SEQ ID NO: 515369 - DNA, 25 bp, Rattus norvegicus
tcctgcccgtcgctaccacccttag

SEQ ID NO: 515370 - DNA, 25 bp, Rattus norvegicus
accacccttagcttctcagactgag

SEQ ID NO: 515371 - DNA, 25 bp, Rattus norvegicus
tgtcagccggcgcaggctaatacta

SEQ ID NO: 515372 - DNA, 25 bp, Rattus norvegicus
acaggcgagtgagccaatgctggtc

SEQ ID NO: 515373 - DNA, 25 bp, Rattus norvegicus
gtgtcccagactttggcctcctgcg

SEQ ID NO: 515374 - DNA, 25 bp, Rattus norvegicus
gcacatgcgcggagcaaccgcctgg

SEQ ID NO: 515375 - DNA, 25 bp, Rattus norvegicus
gaccgacgcacatgcgcggagcaac

SEQ ID NO: 515376 - DNA, 25 bp, Rattus norvegicus
ctggaccgacgcacatgcgcggagc

SEQ ID NO: 515377 - DNA, 25 bp, Rattus norvegicus
agcaccacctggaccgacgcacatg

SEQ ID NO: 515378 - DNA, 25 bp, Rattus norvegicus
gcagcgctgctggagctcgccgctg

SEQ ID NO: 515379 - DNA, 25 bp, Rattus norvegicus
ctttggcctcctgcgggcaacgggc

SEQ ID NO: 515380 - DNA, 25 bp, Rattus norvegicus
ccagactttggcctcctgcgggcaa

SEQ ID NO: 515381 - DNA, 25 bp, Rattus norvegicus
ttccggtgtcccagactttggcctc

SEQ ID NO: 515382 - DNA, 25 bp, Rattus norvegicus
ctattccggtgtcccagactttggc

SEQ ID NO: 515383 - DNA, 25 bp, Rattus norvegicus
ccactattccggtgtcccagacttt

SEQ ID NO: 515384 - DNA, 25 bp, Rattus norvegicus
tctgtgcgtccccactattccggtg

SEQ ID NO: 515385 - DNA, 25 bp, Rattus norvegicus
ccggttctaccgctctgtgcgtccc

SEQ ID NO: 515386 - DNA, 25 bp, Rattus norvegicus
agactttggcctcctgcgggcaacg

SEQ ID NO: 515387 - DNA, 25 bp, Rattus norvegicus
ccgtgggctggcagccagggtcccg

SEQ ID NO: 515388 - DNA, 25 bp, Rattus norvegicus
gggtcccatggcatgctgcaagtga

SEQ ID NO: 515389 - DNA, 25 bp, Rattus norvegicus
tgggtcccatggcatgctgcaagtg

SEQ ID NO: 515390 - DNA, 25 bp, Rattus norvegicus
tcccatggcatgctgcaagtgaggt

SEQ ID NO: 515391 - DNA, 25 bp, Rattus norvegicus
ccatggcatgctgcaagtgaggttg

SEQ ID NO: 515392 - DNA, 25 bp, Rattus norvegicus
ctgcaagtgaggttggaggctacaa

SEQ ID NO: 515393 - DNA, 25 bp, Rattus norvegicus
caagtgaggttggaggctacaaacc

SEQ ID NO: 515394 - DNA, 25 bp, Rattus norvegicus
ttctggctgcgtcgcgaaacttcct

SEQ ID NO: 515395 - DNA, 25 bp, Rattus norvegicus
ggctgcgtcgcgaaacttccttgcg

SEQ ID NO: 515396 - DNA, 25 bp, Rattus norvegicus
tgcgtcgcgaaacttccttgcggtg

SEQ ID NO: 515397 - DNA, 25 bp, Rattus norvegicus
gtcgcgaaacttccttgcggtgccc

SEQ ID NO: 515398 - DNA, 25 bp, Rattus norvegicus
gagcttctggctgcgtcgcgaaact

SEQ ID NO: 515399 - DNA, 25 bp, Rattus norvegicus
tgcggtgcccctgcttcccatagat

SEQ ID NO: 515400 - DNA, 25 bp, Rattus norvegicus
ctctgggtcccatggcatgctgcaa

SEQ ID NO: 515401 - DNA, 25 bp, Rattus norvegicus
acgccatcatcgactgcggaaactg

SEQ ID NO: 515402 - DNA, 25 bp, Rattus norvegicus
tgcagctgttgctcctcctaggcct

SEQ ID NO: 515403 - DNA, 25 bp, Rattus norvegicus
ctgcaggaagatacctcagactgtg

SEQ ID NO: 515404 - DNA, 25 bp, Rattus norvegicus
ctgctgacagctgcgagcctttacc

SEQ ID NO: 515405 - DNA, 25 bp, Rattus norvegicus
tgttttgactacaatgcgacggtga

SEQ ID NO: 515406 - DNA, 25 bp, Rattus norvegicus
gaggcccgcacatctgttttgacta

SEQ ID NO: 515407 - DNA, 25 bp, Rattus norvegicus
tgcagagaccgcgataccgaagagg

SEQ ID NO: 515408 - DNA, 25 bp, Rattus norvegicus
gccggctgctacaaaaggagacaca

SEQ ID NO: 515409 - DNA, 25 bp, Rattus norvegicus
ccaaccttctgttcgtggtggcgga

SEQ ID NO: 515410 - DNA, 25 bp, Rattus norvegicus
ccaggctgttccacgcgcagagact

SEQ ID NO: 515411 - DNA, 25 bp, Rattus norvegicus
ggtgaacgcgtcctataacgccatc

SEQ ID NO: 515412 - DNA, 25 bp, Rattus norvegicus
cccagtactacttcggctcggtgaa

SEQ ID NO: 515413 - DNA, 25 bp, Rattus norvegicus
gcagagactgaccaacaccaacctt

SEQ ID NO: 515414 - DNA, 25 bp, Rattus norvegicus
gagcagctgcgtcatgaaacaaacc

SEQ ID NO: 515415 - DNA, 25 bp, Rattus norvegicus
ccggcaagaaggctttctcctcgct

SEQ ID NO: 515416 - DNA, 25 bp, Rattus norvegicus
gccaacgcccgccaggaagatgcaa

SEQ ID NO: 515417 - DNA, 25 bp, Rattus norvegicus
aggaagatgcaacgcgccctgcccg

SEQ ID NO: 515418 - DNA, 25 bp, Rattus norvegicus
gtgcccgccagcatctgggggccat

SEQ ID NO: 515419 - DNA, 25 bp, Rattus norvegicus
acggaaccggcagacaggcgtgccc

SEQ ID NO: 515420 - DNA, 25 bp, Rattus norvegicus
gccacccagggcctaacgtcaggtc

SEQ ID NO: 515421 - DNA, 25 bp, Rattus norvegicus
agaaggctttctcctcgctttggaa

SEQ ID NO: 515422 - DNA, 25 bp, Rattus norvegicus
ctcgctttggaactacagccggatc

SEQ ID NO: 515423 - DNA, 25 bp, Rattus norvegicus
tttggaactacagccggatcagacc

SEQ ID NO: 515424 - DNA, 25 bp, Rattus norvegicus
cggatcagaccggaaccagagccgt

SEQ ID NO: 515425 - DNA, 25 bp, Rattus norvegicus
accggaaccagagccgtcacacgga

SEQ ID NO: 515426 - DNA, 25 bp, Rattus norvegicus
ccgtcacacggaacagaagccagtg

SEQ ID NO: 515427 - DNA, 25 bp, Rattus norvegicus
agaagccagtgaagtagccgggccc

SEQ ID NO: 515428 - DNA, 25 bp, Rattus norvegicus
aaccggcagacaggcgtgcccaagc

SEQ ID NO: 515429 - DNA, 25 bp, Rattus norvegicus
tcactagctgctagtccgctacagc

SEQ ID NO: 515430 - DNA, 25 bp, Rattus norvegicus
cgcaaaggcctacagtgcgcgcgtg

SEQ ID NO: 515431 - DNA, 25 bp, Rattus norvegicus
caagtccacacggtcggctagcctg

SEQ ID NO: 515432 - DNA, 25 bp, Rattus norvegicus
ccgctacgaactcactagctgctag

SEQ ID NO: 515433 - DNA, 25 bp, Rattus norvegicus
catgtcggcggagccagaactcatt

SEQ ID NO: 515434 - DNA, 25 bp, Rattus norvegicus
ggagccagaactcattgaactacga

SEQ ID NO: 515435 - DNA, 25 bp, Rattus norvegicus
tgaactacgagagttggcaccgtcc

SEQ ID NO: 515436 - DNA, 25 bp, Rattus norvegicus
tcggtccaggccgtacccggctgga

SEQ ID NO: 515437 - DNA, 25 bp, Rattus norvegicus
ggagcgtgccaacgctctgcgcatc

SEQ ID NO: 515438 - DNA, 25 bp, Rattus norvegicus
gggcacaacacgcaatccgtcacag

SEQ ID NO: 515439 - DNA, 25 bp, Rattus norvegicus
acagcagcacgtcccgggtcgtggc

SEQ ID NO: 515440 - DNA, 25 bp, Rattus norvegicus
acgcacacgtggtgcgacctctgtg

SEQ ID NO: 515441 - DNA, 25 bp, Rattus norvegicus
cgacctctgtggagacttcatctgg

SEQ ID NO: 515442 - DNA, 25 bp, Rattus norvegicus
ctagcctgggtttccagcgcgtcct

SEQ ID NO: 515443 - DNA, 25 bp, Rattus norvegicus
aggtgcggactccacgccaaatcta

SEQ ID NO: 515444 - DNA, 25 bp, Rattus norvegicus
agcctctcggttggtccagacaaaa

SEQ ID NO: 515445 - DNA, 25 bp, Rattus norvegicus
tggaagctctccacgcagtggacta

SEQ ID NO: 515446 - DNA, 25 bp, Rattus norvegicus
ctcggcatcacagacgctagttttg

SEQ ID NO: 515447 - DNA, 25 bp, Rattus norvegicus
tcccgacgccgtgcacattgaacat

SEQ ID NO: 515448 - DNA, 25 bp, Rattus norvegicus
tgggcgaggctgaaacaccttcctt

SEQ ID NO: 515449 - DNA, 25 bp, Rattus norvegicus
cgggctgcctacgtttcagtcctaa

SEQ ID NO: 515450 - DNA, 25 bp, Rattus norvegicus
aggtcattcctccagctgtagcgtt

SEQ ID NO: 515451 - DNA, 25 bp, Rattus norvegicus
gagccaggttgagatgcctctgaga

SEQ ID NO: 515452 - DNA, 25 bp, Rattus norvegicus
ccctgaggcaacatcggtgcacatg

SEQ ID NO: 515453 - DNA, 25 bp, Rattus norvegicus
taccgaccgcaaagacgcgccttgg

SEQ ID NO: 515454 - DNA, 25 bp, Rattus norvegicus
gctagttttgcttgcgggtttgcca

SEQ ID NO: 515455 - DNA, 25 bp, Rattus norvegicus
cagagctcgagcagtacttcacggc

SEQ ID NO: 515456 - DNA, 25 bp, Rattus norvegicus
ccttcgaaatgacctggagcagcac

SEQ ID NO: 515457 - DNA, 25 bp, Rattus norvegicus
ggctccaaagctcggggcctctggc

SEQ ID NO: 515458 - DNA, 25 bp, Rattus norvegicus
agcagtgcctcccttcgtattcacg

SEQ ID NO: 515459 - DNA, 25 bp, Rattus norvegicus
cgagcagtgcctcccttcgtattca

SEQ ID NO: 515460 - DNA, 25 bp, Rattus norvegicus
tgcggtctcgagcccgagcagtgcc

SEQ ID NO: 515461 - DNA, 25 bp, Rattus norvegicus
agcaatctttggtgcggtctcgagc

SEQ ID NO: 515462 - DNA, 25 bp, Rattus norvegicus
gctgagcaatctttggtgcggtctc

SEQ ID NO: 515463 - DNA, 25 bp, Rattus norvegicus
gcaggcgctgagcaatctttggtgc

SEQ ID NO: 515464 - DNA, 25 bp, Rattus norvegicus
aagctcggggcctctggccctttgc

SEQ ID NO: 515465 - DNA, 25 bp, Rattus norvegicus
cggcgctgacatgggcgccagcggc

SEQ ID NO: 515466 - DNA, 25 bp, Rattus norvegicus
cacctgcgagtggaagctggggcag

SEQ ID NO: 515467 - DNA, 25 bp, Rattus norvegicus
aggtttccgtggagacagcagagcc

SEQ ID NO: 515468 - DNA, 25 bp, Rattus norvegicus
gaagtaaggtttccgtggagacagc

SEQ ID NO: 515469 - DNA, 25 bp, Rattus norvegicus
cctcccttcgtattcacgcgccgcg

SEQ ID NO: 515470 - DNA, 25 bp, Rattus norvegicus
aggcggcaggcgctgagcaatcttt

SEQ ID NO: 515471 - DNA, 25 bp, Rattus norvegicus
gaactcaaaacgcagcactggcaga

SEQ ID NO: 515472 - DNA, 25 bp, Rattus norvegicus
tctgaatctctaggggcgccctctt

SEQ ID NO: 515473 - DNA, 25 bp, Rattus norvegicus
acccacctccgaggcaggattctta

SEQ ID NO: 515474 - DNA, 25 bp, Rattus norvegicus
aggcaggattcttaaagggcccgcg

SEQ ID NO: 515475 - DNA, 25 bp, Rattus norvegicus
ctccctgtgagctgggctctgaatc

SEQ ID NO: 515476 - DNA, 25 bp, Rattus norvegicus
ggggtcccgcacaaagaccagagtg

SEQ ID NO: 515477 - DNA, 25 bp, Rattus norvegicus
tcgcgagtgcttgcagtttcgtggt

SEQ ID NO: 515478 - DNA, 25 bp, Rattus norvegicus
cgagcaccgcagtgggaagtccgct

SEQ ID NO: 515479 - DNA, 25 bp, Rattus norvegicus
cactggcagaaaggaaggcggacac

SEQ ID NO: 515480 - DNA, 25 bp, Rattus norvegicus
tcggtgcccgagactaagtcctgac

SEQ ID NO: 515481 - DNA, 25 bp, Rattus norvegicus
aggcggacacgccttccctgcgagg

SEQ ID NO: 515482 - DNA, 25 bp, Rattus norvegicus
tcctagcctaagagagtgtcggtgc

SEQ ID NO: 515483 - DNA, 25 bp, Rattus norvegicus
gggcgccctcttaagtgacccagga

SEQ ID NO: 515484 - DNA, 25 bp, Rattus norvegicus
gtgcaagcctggtgactctctccct

SEQ ID NO: 515485 - DNA, 25 bp, Rattus norvegicus
gctaatctgtgtacgctgacgcctg

SEQ ID NO: 515486 - DNA, 25 bp, Rattus norvegicus
agctgtttttcgaaatcccgcgccg

SEQ ID NO: 515487 - DNA, 25 bp, Rattus norvegicus
cacgtgtgcgcctcacttgagctca

SEQ ID NO: 515488 - DNA, 25 bp, Rattus norvegicus
ctcgcacgtgcctcagctggcattg

SEQ ID NO: 515489 - DNA, 25 bp, Rattus norvegicus
agaactctgctaaggctcgcacgtg

SEQ ID NO: 515490 - DNA, 25 bp, Rattus norvegicus
cggtcctgagttgacgatcttccca

SEQ ID NO: 515491 - DNA, 25 bp, Rattus norvegicus
ctcgtaagggcaatgcgctccgcaa

SEQ ID NO: 515492 - DNA, 25 bp, Rattus norvegicus
gttcaggaatgcctcgcgctcgtaa

SEQ ID NO: 515493 - DNA, 25 bp, Rattus norvegicus
gctcagcacacggaccagcgtttcg

SEQ ID NO: 515494 - DNA, 25 bp, Rattus norvegicus
gatctgaacttggtggccgggaact

SEQ ID NO: 515495 - DNA, 25 bp, Rattus norvegicus
agtggactactactcccgtcgtgca

SEQ ID NO: 515496 - DNA, 25 bp, Rattus norvegicus
agcggcgtcggctaatttgtctcca

SEQ ID NO: 515497 - DNA, 25 bp, Rattus norvegicus
tacatagtttagctggagcggcgtc

SEQ ID NO: 515498 - DNA, 25 bp, Rattus norvegicus
tgtcgtcttcgcgagtctcagctca

SEQ ID NO: 515499 - DNA, 25 bp, Rattus norvegicus
cgggcctgctgagcgagccaccttg

SEQ ID NO: 515500 - DNA, 25 bp, Rattus norvegicus
atctggttgcacttagaagcccgga

SEQ ID NO: 515501 - DNA, 25 bp, Rattus norvegicus
cgcccatctggttgcacttagaagc

SEQ ID NO: 515502 - DNA, 25 bp, Rattus norvegicus
gcccgcccatctggttgcacttaga

SEQ ID NO: 515503 - DNA, 25 bp, Rattus norvegicus
ctgagcgagccaccttggccgcagg

SEQ ID NO: 515504 - DNA, 25 bp, Rattus norvegicus
ttgcacttagaagcccggaggaagc

SEQ ID NO: 515505 - DNA, 25 bp, Rattus norvegicus
tcctgccagaaagcagccgggcctg

SEQ ID NO: 515506 - DNA, 25 bp, Rattus norvegicus
tgggagctattcatttcctgccaga

SEQ ID NO: 515507 - DNA, 25 bp, Rattus norvegicus
gcctgagctcatctgggagctattc

SEQ ID NO: 515508 - DNA, 25 bp, Rattus norvegicus
tcaggttgcctgagctcatctggga

SEQ ID NO: 515509 - DNA, 25 bp, Rattus norvegicus
gccgttctcacgacctctcaggttg

SEQ ID NO: 515510 - DNA, 25 bp, Rattus norvegicus
gctcatctgggagctattcatttcc

SEQ ID NO: 515511 - DNA, 25 bp, Rattus norvegicus
tctcacgacctctcaggttgcctga

SEQ ID NO: 515512 - DNA, 25 bp, Rattus norvegicus
atttcctgccagaaagcagccgggc

SEQ ID NO: 515513 - DNA, 25 bp, Rattus norvegicus
tatgcccgaacggagtgcgcatgcg

SEQ ID NO: 515514 - DNA, 25 bp, Rattus norvegicus
cgaccggaagcacagcccgcgccaa

SEQ ID NO: 515515 - DNA, 25 bp, Rattus norvegicus
atgtaccacacagggcaagagagtg

SEQ ID NO: 515516 - DNA, 25 bp, Rattus norvegicus
gcagcatgtaccacacagggcaaga

SEQ ID NO: 515517 - DNA, 25 bp, Rattus norvegicus
gcgcaagcggaagcagcatgtacca

SEQ ID NO: 515518 - DNA, 25 bp, Rattus norvegicus
tcgcgcgcgcggaaaccaattggga

SEQ ID NO: 515519 - DNA, 25 bp, Rattus norvegicus
cgacaggacagctctgaacgagacc

SEQ ID NO: 515520 - DNA, 25 bp, Rattus norvegicus
cttgcaggttgcagacgacaggaca

SEQ ID NO: 515521 - DNA, 25 bp, Rattus norvegicus
tcgtgctggcatcttgcaggttgca

SEQ ID NO: 515522 - DNA, 25 bp, Rattus norvegicus
gagctgttcgtgctggcatcttgca

SEQ ID NO: 515523 - DNA, 25 bp, Rattus norvegicus
tacctaccgcctgcggacatggtcg

SEQ ID NO: 515524 - DNA, 25 bp, Rattus norvegicus
cactttgtgtggtacctaccgcctg

SEQ ID NO: 515525 - DNA, 25 bp, Rattus norvegicus
aataaatgcctccgcatcggtcccg

SEQ ID NO: 515526 - DNA, 25 bp, Rattus norvegicus
gaagacaatgctatgcccgaacgga

SEQ ID NO: 515527 - DNA, 25 bp, Rattus norvegicus
tgtgccgcactcagcacgtgcagca

SEQ ID NO: 515528 - DNA, 25 bp, Rattus norvegicus
ctacgtggtccacgttcagcacgca

SEQ ID NO: 515529 - DNA, 25 bp, Rattus norvegicus
ttcagcacgcagctcagagacatgc

SEQ ID NO: 515530 - DNA, 25 bp, Rattus norvegicus
agagacatgcatccgcctgttgcga

SEQ ID NO: 515531 - DNA, 25 bp, Rattus norvegicus
cctgttgcgacccttacgacgtgaa

SEQ ID NO: 515532 - DNA, 25 bp, Rattus norvegicus
cccttacgacgtgaatctgctgcca

SEQ ID NO: 515533 - DNA, 25 bp, Rattus norvegicus
atctgctgccacagagtggggcccg

SEQ ID NO: 515534 - DNA, 25 bp, Rattus norvegicus
cacattcgcagggagtttgcacctc

SEQ ID NO: 515535 - DNA, 25 bp, Rattus norvegicus
agtcgttcagcctgtgccgcactca

SEQ ID NO: 515536 - DNA, 25 bp, Rattus norvegicus
cacgtgcagcaccaggcgacgcagt

SEQ ID NO: 515537 - DNA, 25 bp, Rattus norvegicus
cgcagtggttgtgaaaagccttgtt

SEQ ID NO: 515538 - DNA, 25 bp, Rattus norvegicus
aagccttgttcaaccgcgacgcaca

SEQ ID NO: 515539 - DNA, 25 bp, Rattus norvegicus
cgcacagatacacgccagagtcctg

SEQ ID NO: 515540 - DNA, 25 bp, Rattus norvegicus
accagagtttaggacctggtggtgc

SEQ ID NO: 515541 - DNA, 25 bp, Rattus norvegicus
ttgtgtcaagcgttcgccacgggac

SEQ ID NO: 515542 - DNA, 25 bp, Rattus norvegicus
tcgtccggattgcagacgtagcccg

SEQ ID NO: 515543 - DNA, 25 bp, Rattus norvegicus
ccttgtcgtccggattgcagacgta

SEQ ID NO: 515544 - DNA, 25 bp, Rattus norvegicus
tttcgccttgtcgtccggattgcag

SEQ ID NO: 515545 - DNA, 25 bp, Rattus norvegicus
cagttggggccggtctttcgccttg

SEQ ID NO: 515546 - DNA, 25 bp, Rattus norvegicus
gccggcgaaagaggcctcggagccc

SEQ ID NO: 515547 - DNA, 25 bp, Rattus norvegicus
caagcgttcgccacgggacccggtg

SEQ ID NO: 515548 - DNA, 25 bp, Rattus norvegicus
ctgcttttgtgtcaagcgttcgcca

SEQ ID NO: 515549 - DNA, 25 bp, Rattus norvegicus
cacaaagctgcttttgtgtcaagcg

SEQ ID NO: 515550 - DNA, 25 bp, Rattus norvegicus
ccagtgccacacaaagctgcttttg

SEQ ID NO: 515551 - DNA, 25 bp, Rattus norvegicus
ctccagtgccacacaaagctgcttt

SEQ ID NO: 515552 - DNA, 25 bp, Rattus norvegicus
acccggtgacgtcagtctgcgtgac

SEQ ID NO: 515553 - DNA, 25 bp, Rattus norvegicus
tgacgtcagtctgcgtgaccagctc

SEQ ID NO: 515554 - DNA, 25 bp, Rattus norvegicus
gtctgcgtgaccagctcagcagctg

SEQ ID NO: 515555 - DNA, 25 bp, Rattus norvegicus
tccctaggcccagcagtaacggaca

SEQ ID NO: 515556 - DNA, 25 bp, Rattus norvegicus
ctgggcaccgggacgtagcgatccc

SEQ ID NO: 515557 - DNA, 25 bp, Rattus norvegicus
gatcccggaagtgccctccctaggc

SEQ ID NO: 515558 - DNA, 25 bp, Rattus norvegicus
ctaggcccagcagtaacggacattc

SEQ ID NO: 515559 - DNA, 25 bp, Rattus norvegicus
ggcccagcagtaacggacattccgc

SEQ ID NO: 515560 - DNA, 25 bp, Rattus norvegicus
agcagtaacggacattccgccgccg

SEQ ID NO: 515561 - DNA, 25 bp, Rattus norvegicus
cgcgtcgacacccactcactgcttg

SEQ ID NO: 515562 - DNA, 25 bp, Rattus norvegicus
ccactcactgcttgccgcactcgca

SEQ ID NO: 515563 - DNA, 25 bp, Rattus norvegicus
agagacaggaagaggcaagcgccca

SEQ ID NO: 515564 - DNA, 25 bp, Rattus norvegicus
aggcaagcgcccaacgcaaagcagc

SEQ ID NO: 515565 - DNA, 25 bp, Rattus norvegicus
agcagtggagcggatgccattttga

SEQ ID NO: 515566 - DNA, 25 bp, Rattus norvegicus
ggagcggatgccattttgaaacctc

SEQ ID NO: 515567 - DNA, 25 bp, Rattus norvegicus
cattttgaaacctccggggctgtgc

SEQ ID NO: 515568 - DNA, 25 bp, Rattus norvegicus
ggacgtagcgatcccggaagtgccc

SEQ ID NO: 515569 - DNA, 25 bp, Rattus norvegicus
tcgatcatcttagagcgctcggctg

SEQ ID NO: 515570 - DNA, 25 bp, Rattus norvegicus
tcttgtcgatcatcttagagcgctc

SEQ ID NO: 515571 - DNA, 25 bp, Rattus norvegicus
gcaggttcttgtcgatcatcttaga

SEQ ID NO: 515572 - DNA, 25 bp, Rattus norvegicus
gatcatcttagagcgctcggctgcc

SEQ ID NO: 515573 - DNA, 25 bp, Rattus norvegicus
ccgcaggttcttgtcgatcatctta

SEQ ID NO: 515574 - DNA, 25 bp, Rattus norvegicus
tgcagcccatcctgccgtccgccgg

SEQ ID NO: 515575 - DNA, 25 bp, Rattus norvegicus
cgtcctcccgcaggttcttgtcgat

SEQ ID NO: 515576 - DNA, 25 bp, Rattus norvegicus
ctctgcgggaagctctcaggtccgc

SEQ ID NO: 515577 - DNA, 25 bp, Rattus norvegicus
ctcccgcaggttcttgtcgatcatc

SEQ ID NO: 515578 - DNA, 25 bp, Rattus norvegicus
ggccctctgcgggaagctctcaggt

SEQ ID NO: 515579 - DNA, 25 bp, Rattus norvegicus
ctcaggtccgcagttccgagcgact

SEQ ID NO: 515580 - DNA, 25 bp, Rattus norvegicus
tccgcagttccgagcgactgcggga

SEQ ID NO: 515581 - DNA, 25 bp, Rattus norvegicus
ccacacggcccacggcccggctcgg

SEQ ID NO: 515582 - DNA, 25 bp, Rattus norvegicus
cgacccactccgctcccaccgccgg

SEQ ID NO: 515583 - DNA, 25 bp, Rattus norvegicus
gatctccttcacatcacgtcgcatg

SEQ ID NO: 515584 - DNA, 25 bp, Rattus norvegicus
cttctcggagaaaacgtccttcttg

SEQ ID NO: 515585 - DNA, 25 bp, Rattus norvegicus
gtgccttttttatcttctcggagaa

SEQ ID NO: 515586 - DNA, 25 bp, Rattus norvegicus
cagatgctgaggtgtgcctttttta

SEQ ID NO: 515587 - DNA, 25 bp, Rattus norvegicus
tcaccatcgtaatcgggaaagcaga

SEQ ID NO: 515588 - DNA, 25 bp, Rattus norvegicus
cggtcgggactagggatctcaccat

SEQ ID NO: 515589 - DNA, 25 bp, Rattus norvegicus
tctctctgtgaggaaaggctttttc

SEQ ID NO: 515590 - DNA, 25 bp, Rattus norvegicus
ccggcatcgtcgtaagtgttaggtc

SEQ ID NO: 515591 - DNA, 25 bp, Rattus norvegicus
gtcgcatgttaagctccaggaactg

SEQ ID NO: 515592 - DNA, 25 bp, Rattus norvegicus
cgcaggtcatgtgggaatagatctc

SEQ ID NO: 515593 - DNA, 25 bp, Rattus norvegicus
acttgacgttctgtgtgtcggtagc

SEQ ID NO: 515594 - DNA, 25 bp, Rattus norvegicus
ggtgacggcgtcaaagacaaacttg

SEQ ID NO: 515595 - DNA, 25 bp, Rattus norvegicus
tccttcttgttgaggaagagcacga

SEQ ID NO: 515596 - DNA, 25 bp, Rattus norvegicus
gcactttgatgtagttgccggcatc

SEQ ID NO: 515597 - DNA, 25 bp, Rattus norvegicus
accggtcccgcacacgtacaggtgt

SEQ ID NO: 515598 - DNA, 25 bp, Rattus norvegicus
ttgtaggcaccggtcccgcacacgt

SEQ ID NO: 515599 - DNA, 25 bp, Rattus norvegicus
cacatggggttgtaggcaccggtcc

SEQ ID NO: 515600 - DNA, 25 bp, Rattus norvegicus
tcacataggtgcacatggggttgta

SEQ ID NO: 515601 - DNA, 25 bp, Rattus norvegicus
cacgtacaggtgtgtccggttccag

SEQ ID NO: 515602 - DNA, 25 bp, Rattus norvegicus
cgacggccacggttcacataggtgc

SEQ ID NO: 515603 - DNA, 25 bp, Rattus norvegicus
agtctgacgaagttcccacactctc

SEQ ID NO: 515604 - DNA, 25 bp, Rattus norvegicus
gccacggttcacataggtgcacatg

SEQ ID NO: 515605 - DNA, 25 bp, Rattus norvegicus
ggatgagtctgacgaagttcccaca

SEQ ID NO: 515606 - DNA, 25 bp, Rattus norvegicus
tccctgtggccggatagaaagctgt

SEQ ID NO: 515607 - DNA, 25 bp, Rattus norvegicus
ccggatagaaagctgtgtagatgtc

SEQ ID NO: 515608 - DNA, 25 bp, Rattus norvegicus
agctgtgtagatgtcccaacacccg

SEQ ID NO: 515609 - DNA, 25 bp, Rattus norvegicus
ccatgtccgtccctctcggaggcca

SEQ ID NO: 515610 - DNA, 25 bp, Rattus norvegicus
tccagggctggatgagtctgacgaa

SEQ ID NO: 515611 - DNA, 25 bp, Rattus norvegicus
tgtctctccgtggatacaccgcgca

SEQ ID NO: 515612 - DNA, 25 bp, Rattus norvegicus
aagggagcaaccaacctgcactcac

SEQ ID NO: 515613 - DNA, 25 bp, Rattus norvegicus
agcgcaagggagcaaccaacctgca

SEQ ID NO: 515614 - DNA, 25 bp, Rattus norvegicus
gctggagcgcaagggagcaaccaac

SEQ ID NO: 515615 - DNA, 25 bp, Rattus norvegicus
ttcagctccctggtgagaagggctg

SEQ ID NO: 515616 - DNA, 25 bp, Rattus norvegicus
cgggcattcagctccctggtgagaa

SEQ ID NO: 515617 - DNA, 25 bp, Rattus norvegicus
acccgggcattcagctccctggtga

SEQ ID NO: 515618 - DNA, 25 bp, Rattus norvegicus
gtttacccgggcattcagctccctg

SEQ ID NO: 515619 - DNA, 25 bp, Rattus norvegicus
gcctggtgtttacccgggcattcag

SEQ ID NO: 515620 - DNA, 25 bp, Rattus norvegicus
ccgcgcacatcgcgcctggtgttta

SEQ ID NO: 515621 - DNA, 25 bp, Rattus norvegicus
ttcctacttgctgccagccacggcc

SEQ ID NO: 515622 - DNA, 25 bp, Rattus norvegicus
ctggctttgtctctccgtggataca

SEQ ID NO: 515623 - DNA, 25 bp, Rattus norvegicus
ctcagggttcccaggcggtgggcaa

SEQ ID NO: 515624 - DNA, 25 bp, Rattus norvegicus
ttccgcgttcctccttcctacttgc

SEQ ID NO: 515625 - DNA, 25 bp, Rattus norvegicus
gcgcggccctcaaacgctagcttag

SEQ ID NO: 515626 - DNA, 25 bp, Rattus norvegicus
cgagattcagttgcagacgcagggc

SEQ ID NO: 515627 - DNA, 25 bp, Rattus norvegicus
ggcttaagagattgccaggcgcttc

SEQ ID NO: 515628 - DNA, 25 bp, Rattus norvegicus
cgacctatgaaagccggcagaacca

SEQ ID NO: 515629 - DNA, 25 bp, Rattus norvegicus
cgctagcttagttttagtcccttca

SEQ ID NO: 515630 - DNA, 25 bp, Rattus norvegicus
tcaaagacgcggctgagcagtcacc

SEQ ID NO: 515631 - DNA, 25 bp, Rattus norvegicus
gagcagtcacctctggcggctgaca

SEQ ID NO: 515632 - DNA, 25 bp, Rattus norvegicus
ccaatggcaaaatcactggggcgta

SEQ ID NO: 515633 - DNA, 25 bp, Rattus norvegicus
gcggctctgcgtctcagaacctaga

SEQ ID NO: 515634 - DNA, 25 bp, Rattus norvegicus
ttcggccgctgcacaaaatggcgtc

SEQ ID NO: 515635 - DNA, 25 bp, Rattus norvegicus
aaatggcgtctccaccgaccgtctt

SEQ ID NO: 515636 - DNA, 25 bp, Rattus norvegicus
catccaatcagcgaaggtgcccgtc

SEQ ID NO: 515637 - DNA, 25 bp, Rattus norvegicus
gcagactcaagggacagcaccaatg

SEQ ID NO: 515638 - DNA, 25 bp, Rattus norvegicus
tccgaaggactggatcgccacagct

SEQ ID NO: 515639 - DNA, 25 bp, Rattus norvegicus
gctgctagccactgcccaatgagaa

SEQ ID NO: 515640 - DNA, 25 bp, Rattus norvegicus
ctaggctgtcttcgcgagcgaggcc

SEQ ID NO: 515641 - DNA, 25 bp, Rattus norvegicus
cgtgtcttcgaagtcacgactccta

SEQ ID NO: 515642 - DNA, 25 bp, Rattus norvegicus
aagtcacgactcctaggccgcgcgg

SEQ ID NO: 515643 - DNA, 25 bp, Rattus norvegicus
cgcgggccgacgattaccagagccg

SEQ ID NO: 515644 - DNA, 25 bp, Rattus norvegicus
ggcacgccctctctcgtatcctggg

SEQ ID NO: 515645 - DNA, 25 bp, Rattus norvegicus
cctgggcccttaccaaggcagcgta

SEQ ID NO: 515646 - DNA, 25 bp, Rattus norvegicus
tgggctccggcttccacaaaggcgt

SEQ ID NO: 515647 - DNA, 25 bp, Rattus norvegicus
ccaatggaaaggcacgctgctagcc

SEQ ID NO: 515648 - DNA, 25 bp, Rattus norvegicus
tagccactgcccaatgagaaggcgc

SEQ ID NO: 515649 - DNA, 25 bp, Rattus norvegicus
accaccgctaggctgtcttcgcgag

SEQ ID NO: 515650 - DNA, 25 bp, Rattus norvegicus
ggagatgaagtacgggcgcaaatcc

SEQ ID NO: 515651 - DNA, 25 bp, Rattus norvegicus
gaagtacgggcgcaaatcccgccgc

SEQ ID NO: 515652 - DNA, 25 bp, Rattus norvegicus
tggtggagccgctacccaatggaaa

SEQ ID NO: 515653 - DNA, 25 bp, Rattus norvegicus
ccacgcagacggcagccgtggagcc

SEQ ID NO: 515654 - DNA, 25 bp, Rattus norvegicus
aacagcggtcagtgcccgcctccgg

SEQ ID NO: 515655 - DNA, 25 bp, Rattus norvegicus
ttccgctggcgcgtcggtgtgcact

SEQ ID NO: 515656 - DNA, 25 bp, Rattus norvegicus
cgcgtcggtgtgcactgtccgcttc

SEQ ID NO: 515657 - DNA, 25 bp, Rattus norvegicus
cactgtccgcttccgccacgcagac

SEQ ID NO: 515658 - DNA, 25 bp, Rattus norvegicus
cgcgaggcgcccaatcagagcactg

SEQ ID NO: 515659 - DNA, 25 bp, Rattus norvegicus
gcgtccccaacaacagcggtcagtg

SEQ ID NO: 515660 - DNA, 25 bp, Rattus norvegicus
cgaggcgcccaatcagagcactgcg

SEQ ID NO: 515661 - DNA, 25 bp, Rattus norvegicus
gaggcgcccaatcagagcactgcgc

SEQ ID NO: 515662 - DNA, 25 bp, Rattus norvegicus
cccacgcgctcgcttggaaggcgga

SEQ ID NO: 515663 - DNA, 25 bp, Rattus norvegicus
cacgcgctcgcttggaaggcggact

SEQ ID NO: 515664 - DNA, 25 bp, Rattus norvegicus
gcgcatgcgcgtagcgggcgctggt

SEQ ID NO: 515665 - DNA, 25 bp, Rattus norvegicus
ccggtgcccggtggcagctgcggag

SEQ ID NO: 515666 - DNA, 25 bp, Rattus norvegicus
gtcggtgtgcactgtccgcttccgc

SEQ ID NO: 515667 - DNA, 25 bp, Rattus norvegicus
ctgcccaacttgcagggtgcgctgc

SEQ ID NO: 515668 - DNA, 25 bp, Rattus norvegicus
cgacactgcgttaggacccaccgag

SEQ ID NO: 515669 - DNA, 25 bp, Rattus norvegicus
aaagacgggtcaccgaacagccctg

SEQ ID NO: 515670 - DNA, 25 bp, Rattus norvegicus
ggtcccgctgttgctggtgtagacc

SEQ ID NO: 515671 - DNA, 25 bp, Rattus norvegicus
cctccacatggagtccgcagtgagc

SEQ ID NO: 515672 - DNA, 25 bp, Rattus norvegicus
ggcaccacttggaagccgccaaaaa

SEQ ID NO: 515673 - DNA, 25 bp, Rattus norvegicus
ttgatctgggtcatgcagttggcca

SEQ ID NO: 515674 - DNA, 25 bp, Rattus norvegicus
cgagtgcgcacctcggtgttaacgc

SEQ ID NO: 515675 - DNA, 25 bp, Rattus norvegicus
gtgttaacgccctcacacgtggaca

SEQ ID NO: 515676 - DNA, 25 bp, Rattus norvegicus
tcacacgtggacaggaagcgggtca

SEQ ID NO: 515677 - DNA, 25 bp, Rattus norvegicus
aagcgggtcacctcgttcatgcact

SEQ ID NO: 515678 - DNA, 25 bp, Rattus norvegicus
cgttcatgcactcgctgaagccggc

SEQ ID NO: 515679 - DNA, 25 bp, Rattus norvegicus
ctgcaggccagaaggagaaaagacg

SEQ ID NO: 515680 - DNA, 25 bp, Rattus norvegicus
aattggccgtcaggagccggcacca

SEQ ID NO: 515681 - DNA, 25 bp, Rattus norvegicus
tgcggagagttacggactacatttc

SEQ ID NO: 515682 - DNA, 25 bp, Rattus norvegicus
aggccggtgaaagctgtcttcctgc

SEQ ID NO: 515683 - DNA, 25 bp, Rattus norvegicus
tttcccacaatgcacccaggggcgg

SEQ ID NO: 515684 - DNA, 25 bp, Rattus norvegicus
gtgaaagctgtcttcctgcgccggt

SEQ ID NO: 515685 - DNA, 25 bp, Rattus norvegicus
caccagaggccggtgaaagctgtct

SEQ ID NO: 515686 - DNA, 25 bp, Rattus norvegicus
tggaacggggcctccgccaccagag

SEQ ID NO: 515687 - DNA, 25 bp, Rattus norvegicus
tccaagaggctggaacggggcctcc

SEQ ID NO: 515688 - DNA, 25 bp, Rattus norvegicus
aaagctgtcttcctgcgccggtggc

SEQ ID NO: 515689 - DNA, 25 bp, Rattus norvegicus
tctggcatcgccaggctcccgagcc

SEQ ID NO: 515690 - DNA, 25 bp, Rattus norvegicus
gaaccgctcccgcagtgcttttggc

SEQ ID NO: 515691 - DNA, 25 bp, Rattus norvegicus
ctcccgcagtgcttttggctgcgga

SEQ ID NO: 515692 - DNA, 25 bp, Rattus norvegicus
agtgcttttggctgcggagagttac

SEQ ID NO: 515693 - DNA, 25 bp, Rattus norvegicus
cttcctgcgccggtggccggtaaag

SEQ ID NO: 515694 - DNA, 25 bp, Rattus norvegicus
tacatttcccacaatgcacccaggg

SEQ ID NO: 515695 - DNA, 25 bp, Rattus norvegicus
gaagccaggagcgtctccatagcga

SEQ ID NO: 515696 - DNA, 25 bp, Rattus norvegicus
aggcagcactctccgggctccttat

SEQ ID NO: 515697 - DNA, 25 bp, Rattus norvegicus
gggctccttatcaggccgaggaatg

SEQ ID NO: 515698 - DNA, 25 bp, Rattus norvegicus
ccgaggaatgcgtggtatccagatt

SEQ ID NO: 515699 - DNA, 25 bp, Rattus norvegicus
tatccagattcgctcgcgctggggc

SEQ ID NO: 515700 - DNA, 25 bp, Rattus norvegicus
acgcgcgcagaatgtccctatcctg

SEQ ID NO: 515701 - DNA, 25 bp, Rattus norvegicus
tgtccctatcctgcacaaggcaata

SEQ ID NO: 515702 - DNA, 25 bp, Rattus norvegicus
ggggaggcgacactctgcatcccac

SEQ ID NO: 515703 - DNA, 25 bp, Rattus norvegicus
ccacatctagattcccggggcaaag

SEQ ID NO: 515704 - DNA, 25 bp, Rattus norvegicus
aggagagagtagctaccagtaacta

SEQ ID NO: 515705 - DNA, 25 bp, Rattus norvegicus
tgtcgcctcgggtatctaacaagga

SEQ ID NO: 515706 - DNA, 25 bp, Rattus norvegicus
gtgagtcaacccgtgctgtagaagg

SEQ ID NO: 515707 - DNA, 25 bp, Rattus norvegicus
tccaagctgtgtagcccgcgacgac

SEQ ID NO: 515708 - DNA, 25 bp, Rattus norvegicus
tccatagcgacgacagtaagacccg

SEQ ID NO: 515709 - DNA, 25 bp, Rattus norvegicus
ctggcgcaggagctactgtacatct

SEQ ID NO: 515710 - DNA, 25 bp, Rattus norvegicus
tgcacctgcttttcaacctcattag

SEQ ID NO: 515711 - DNA, 25 bp, Rattus norvegicus
gaggcgctgcgcacaccttactaca

SEQ ID NO: 515712 - DNA, 25 bp, Rattus norvegicus
ccgcttcctggaacgcattcgaaag

SEQ ID NO: 515713 - DNA, 25 bp, Rattus norvegicus
aggacttcttcgcagtctctgactg

SEQ ID NO: 515714 - DNA, 25 bp, Rattus norvegicus
ctccactgaccgtgaggacttcttc

SEQ ID NO: 515715 - DNA, 25 bp, Rattus norvegicus
ctcccgtgtgcctgccaaagttcaa

SEQ ID NO: 515716 - DNA, 25 bp, Rattus norvegicus
tcgtgcgccgcaaggaccaattcct

SEQ ID NO: 515717 - DNA, 25 bp, Rattus norvegicus
tgctggcccgcaaccagctagtggc

SEQ ID NO: 515718 - DNA, 25 bp, Rattus norvegicus
agcctggtcttttccatcctgctgg

SEQ ID NO: 515719 - DNA, 25 bp, Rattus norvegicus
tgctgcagctaatggctcgagaccc

SEQ ID NO: 515720 - DNA, 25 bp, Rattus norvegicus
cggatcaccgataacctgctgcagc

SEQ ID NO: 515721 - DNA, 25 bp, Rattus norvegicus
agattctgagcctccttaccggcgc

SEQ ID NO: 515722 - DNA, 25 bp, Rattus norvegicus
ttccagcagaagcagaactacgacc

SEQ ID NO: 515723 - DNA, 25 bp, Rattus norvegicus
tgtgaccgaccagcgttgcaggtgc

SEQ ID NO: 515724 - DNA, 25 bp, Rattus norvegicus
gggtcccaagcaggggcacatcgca

SEQ ID NO: 515725 - DNA, 25 bp, Rattus norvegicus
gttatcgcttcctgcctgtgaccga

SEQ ID NO: 515726 - DNA, 25 bp, Rattus norvegicus
tgcgaatccgctgccagagagcgac

SEQ ID NO: 515727 - DNA, 25 bp, Rattus norvegicus
gggcacatcgcacggtttctgcaga

SEQ ID NO: 515728 - DNA, 25 bp, Rattus norvegicus
gatgcgcgcaatcgccgcgaggact

SEQ ID NO: 515729 - DNA, 25 bp, Rattus norvegicus
ggactgtttccctggttagagaatc

SEQ ID NO: 515730 - DNA, 25 bp, Rattus norvegicus
agggcgcctcctggatgcacgttgg

SEQ ID NO: 515731 - DNA, 25 bp, Rattus norvegicus
ttcctgcctgtgaccgaccagcgtt

SEQ ID NO: 515732 - DNA, 25 bp, Rattus norvegicus
ccggttatcgcttcctgcctgtgac

SEQ ID NO: 515733 - DNA, 25 bp, Rattus norvegicus
cctgctgagccggttatcgcttcct

SEQ ID NO: 515734 - DNA, 25 bp, Rattus norvegicus
ccgcgtgcccggagcggattctgcc

SEQ ID NO: 515735 - DNA, 25 bp, Rattus norvegicus
ctgccagagagcgactggcgatgct

SEQ ID NO: 515736 - DNA, 25 bp, Rattus norvegicus
cgcacggtttctgcagatgcgaggt

SEQ ID NO: 515737 - DNA, 25 bp, Rattus norvegicus
gcactatctgctccgatttcttcga

SEQ ID NO: 515738 - DNA, 25 bp, Rattus norvegicus
ttgttatgacttccggttcactgcc

SEQ ID NO: 515739 - DNA, 25 bp, Rattus norvegicus
tgagccgagccatcatgcctatccg

SEQ ID NO: 515740 - DNA, 25 bp, Rattus norvegicus
ctctgtgctgcttgagccgagccat

SEQ ID NO: 515741 - DNA, 25 bp, Rattus norvegicus
tgctggctctctgtgctgcttgagc

SEQ ID NO: 515742 - DNA, 25 bp, Rattus norvegicus
ctatccgcgcgctgtgcactatctg

SEQ ID NO: 515743 - DNA, 25 bp, Rattus norvegicus
tgtgtctgttgctggctgctggctc

SEQ ID NO: 515744 - DNA, 25 bp, Rattus norvegicus
ttccggttcactgccggaagtcgtg

SEQ ID NO: 515745 - DNA, 25 bp, Rattus norvegicus
ccgatttcttcgatcactcccgtga

SEQ ID NO: 515746 - DNA, 25 bp, Rattus norvegicus
cagaagtgggtttgttatgacttcc

SEQ ID NO: 515747 - DNA, 25 bp, Rattus norvegicus
ggttgtttatcgcagccgtcccagc

SEQ ID NO: 515748 - DNA, 25 bp, Rattus norvegicus
attccacacggctggcgggttgttt

SEQ ID NO: 515749 - DNA, 25 bp, Rattus norvegicus
gtcccaggattccacacggctggcg

SEQ ID NO: 515750 - DNA, 25 bp, Rattus norvegicus
gttcggccacccaactgtgtctgtt

SEQ ID NO: 515751 - DNA, 25 bp, Rattus norvegicus
tccttggttactatgacgcccggcc

SEQ ID NO: 515752 - DNA, 25 bp, Rattus norvegicus
ctttcgccgagccttccagatgttg

SEQ ID NO: 515753 - DNA, 25 bp, Rattus norvegicus
ggtagcgggaaacctgcctttcaga

SEQ ID NO: 515754 - DNA, 25 bp, Rattus norvegicus
ctttcagaccgaatccctgggtgtc

SEQ ID NO: 515755 - DNA, 25 bp, Rattus norvegicus
gtctcagacccggagtgctgtgata

SEQ ID NO: 515756 - DNA, 25 bp, Rattus norvegicus
gccgtaacgttcctccaaatcagtg

SEQ ID NO: 515757 - DNA, 25 bp, Rattus norvegicus
ctaacgagccaagcagggtggtatc

SEQ ID NO: 515758 - DNA, 25 bp, Rattus norvegicus
gttgttgatccgtacccagtgggca

SEQ ID NO: 515759 - DNA, 25 bp, Rattus norvegicus
aagaattccttcaggcgttccgaga

SEQ ID NO: 515760 - DNA, 25 bp, Rattus norvegicus
acgcccggactgacggaacagttga

SEQ ID NO: 515761 - DNA, 25 bp, Rattus norvegicus
tgcgtcaattcgtgccgtcacagtc

SEQ ID NO: 515762 - DNA, 25 bp, Rattus norvegicus
tccgcggctagcaaaccagagaatg

SEQ ID NO: 515763 - DNA, 25 bp, Rattus norvegicus
ttcgacagcaaaagctccgcggcta

SEQ ID NO: 515764 - DNA, 25 bp, Rattus norvegicus
tgggacatcattccagcgtcctggt

SEQ ID NO: 515765 - DNA, 25 bp, Rattus norvegicus
cccatggcagtccagcgcgtgggaa

SEQ ID NO: 515766 - DNA, 25 bp, Rattus norvegicus
cctgttacgtcactggatgcgccgc

SEQ ID NO: 515767 - DNA, 25 bp, Rattus norvegicus
cacgtagttaacagccgattggctc

SEQ ID NO: 515768 - DNA, 25 bp, Rattus norvegicus
ggcggccctgccacgtagttaacag

SEQ ID NO: 515769 - DNA, 25 bp, Rattus norvegicus
ccgcagcgtaaagcctgggcgatcg

SEQ ID NO: 515770 - DNA, 25 bp, Rattus norvegicus
acgtctgccgcagcgtaaagcctgg

SEQ ID NO: 515771 - DNA, 25 bp, Rattus norvegicus
aattggctacgtctgccgcagcgta

SEQ ID NO: 515772 - DNA, 25 bp, Rattus norvegicus
tccagcgcgtgggaaatccaattgg

SEQ ID NO: 515773 - DNA, 25 bp, Rattus norvegicus
ttctgactcgcgagttctccgggtc

SEQ ID NO: 515774 - DNA, 25 bp, Rattus norvegicus
ccaatgggcttctgactcgcgagtt

SEQ ID NO: 515775 - DNA, 25 bp, Rattus norvegicus
tttagatccgccaatgggcttctga

SEQ ID NO: 515776 - DNA, 25 bp, Rattus norvegicus
gttccgcctttagatccgccaatgg

SEQ ID NO: 515777 - DNA, 25 bp, Rattus norvegicus
tccgataggaagttaagcttgcttt

SEQ ID NO: 515778 - DNA, 25 bp, Rattus norvegicus
tgggaaatccaattggctacgtctg

SEQ ID NO: 515779 - DNA, 25 bp, Rattus norvegicus
caggggcctcgaagggagtcaccgg

SEQ ID NO: 515780 - DNA, 25 bp, Rattus norvegicus
tgggagccctataccgcaggccgcg

SEQ ID NO: 515781 - DNA, 25 bp, Rattus norvegicus
gctgggagccctataccgcaggccg

SEQ ID NO: 515782 - DNA, 25 bp, Rattus norvegicus
aggccgcggcactgtcgcactggat

SEQ ID NO: 515783 - DNA, 25 bp, Rattus norvegicus
cactgtcgcactggatcggccaggg

SEQ ID NO: 515784 - DNA, 25 bp, Rattus norvegicus
gacccgcccggctcgtagccaggcc

SEQ ID NO: 515785 - DNA, 25 bp, Rattus norvegicus
tagccaggccgcctctcactcaccc

SEQ ID NO: 515786 - DNA, 25 bp, Rattus norvegicus
cagcctccgcgaccggctcacaaca

SEQ ID NO: 515787 - DNA, 25 bp, Rattus norvegicus
ggctcacaacatccgcccagctttt

SEQ ID NO: 515788 - DNA, 25 bp, Rattus norvegicus
acatccgcccagcttttcagctacg

SEQ ID NO: 515789 - DNA, 25 bp, Rattus norvegicus
tttcagctacggcacccgtccaggg

SEQ ID NO: 515790 - DNA, 25 bp, Rattus norvegicus
tccagggccaaaccgcgtgcccgct

SEQ ID NO: 515791 - DNA, 25 bp, Rattus norvegicus
agccgcgcacgcgcatatgcacaga

SEQ ID NO: 515792 - DNA, 25 bp, Rattus norvegicus
cggcactgtcgcactggatcggcca

SEQ ID NO: 515793 - DNA, 25 bp, Rattus norvegicus
ccatactgcgtggtgacctccggac

SEQ ID NO: 515794 - DNA, 25 bp, Rattus norvegicus
acacaccagtgtgcacggtccgata

SEQ ID NO: 515795 - DNA, 25 bp, Rattus norvegicus
tggtgacctccggacccaggcaggc

SEQ ID NO: 515796 - DNA, 25 bp, Rattus norvegicus
ggacacaccagggtcaggctcagcc

SEQ ID NO: 515797 - DNA, 25 bp, Rattus norvegicus
tcagcccgggctacggaggccacag

SEQ ID NO: 515798 - DNA, 25 bp, Rattus norvegicus
cctgacgctccatagtcgatctttc

SEQ ID NO: 515799 - DNA, 25 bp, Rattus norvegicus
gtcgatctttctgtagcgcctaagt

SEQ ID NO: 515800 - DNA, 25 bp, Rattus norvegicus
tctgtagcgcctaagtcccggaagt

SEQ ID NO: 515801 - DNA, 25 bp, Rattus norvegicus
ctaagtcccggaagtgaggctccga

SEQ ID NO: 515802 - DNA, 25 bp, Rattus norvegicus
cagtttccgctacacccagtggcga

SEQ ID NO: 515803 - DNA, 25 bp, Rattus norvegicus
acccagtggcgacctgggacctgca

SEQ ID NO: 515804 - DNA, 25 bp, Rattus norvegicus
acctgcagggcccagcaaagctcgg

SEQ ID NO: 515805 - DNA, 25 bp, Rattus norvegicus
caaagctcgggccaaccagctgggg

SEQ ID NO: 515806 - DNA, 25 bp, Rattus norvegicus
ctcagcagcacctgcgcaggggaca

SEQ ID NO: 515807 - DNA, 25 bp, Rattus norvegicus
catcttcgatgggtgacaggttact

SEQ ID NO: 515808 - DNA, 25 bp, Rattus norvegicus
gctgcttcgcttcttctagccgctg

SEQ ID NO: 515809 - DNA, 25 bp, Rattus norvegicus
aagagtcctcaatggtgggcagcag

SEQ ID NO: 515810 - DNA, 25 bp, Rattus norvegicus
ctcctcggaagagtcctcaatggtg

SEQ ID NO: 515811 - DNA, 25 bp, Rattus norvegicus
cgcatcttctcttgctcacgcagca

SEQ ID NO: 515812 - DNA, 25 bp, Rattus norvegicus
ttcgaattcgctgctgttccacctc

SEQ ID NO: 515813 - DNA, 25 bp, Rattus norvegicus
ctgtgcttcgaattcgctgctgttc

SEQ ID NO: 515814 - DNA, 25 bp, Rattus norvegicus
gtcttgcgggctgtgcttcgaattc

SEQ ID NO: 515815 - DNA, 25 bp, Rattus norvegicus
tcttccttgtcacgccgggtcttgc

SEQ ID NO: 515816 - DNA, 25 bp, Rattus norvegicus
cgaagttcttccttgtcacgccggg

SEQ ID NO: 515817 - DNA, 25 bp, Rattus norvegicus
gccgctgagcccgaagttcttcctt

SEQ ID NO: 515818 - DNA, 25 bp, Rattus norvegicus
cggtgtcttggagcgctcacgccgc

SEQ ID NO: 515819 - DNA, 25 bp, Rattus norvegicus
ttactaggcggtgtcttggagcgct

SEQ ID NO: 515820 - DNA, 25 bp, Rattus norvegicus
tgacaggttactaggcggtgtcttg

SEQ ID NO: 515821 - DNA, 25 bp, Rattus norvegicus
atagcagctgctgtgctcgagcctg

SEQ ID NO: 515822 - DNA, 25 bp, Rattus norvegicus
ggatttgagcgaggccgaaacctcc

SEQ ID NO: 515823 - DNA, 25 bp, Rattus norvegicus
agcgcacgcccaggagtggcgatcg

SEQ ID NO: 515824 - DNA, 25 bp, Rattus norvegicus
ccctggccaaggtcagcccttccgg

SEQ ID NO: 515825 - DNA, 25 bp, Rattus norvegicus
agccctttaagagctccaccagccg

SEQ ID NO: 515826 - DNA, 25 bp, Rattus norvegicus
cagctgctgtgctcgagcctgggaa

SEQ ID NO: 515827 - DNA, 25 bp, Rattus norvegicus
tccaccagccgagctgcagtttgac

SEQ ID NO: 515828 - DNA, 25 bp, Rattus norvegicus
gccaagaaggtaaatagcagctgct

SEQ ID NO: 515829 - DNA, 25 bp, Rattus norvegicus
ggatgttttattgccgccgcggctg

SEQ ID NO: 515830 - DNA, 25 bp, Rattus norvegicus
cgtgccaggatgttttattgccgcc

SEQ ID NO: 515831 - DNA, 25 bp, Rattus norvegicus
cggagcacgtgccaggatgttttat

SEQ ID NO: 515832 - DNA, 25 bp, Rattus norvegicus
agtttgacatcagccggccggcgag

SEQ ID NO: 515833 - DNA, 25 bp, Rattus norvegicus
tgcagtttgacatcagccggccggc

SEQ ID NO: 515834 - DNA, 25 bp, Rattus norvegicus
tccggcctgggcgagccaggaatcc

SEQ ID NO: 515835 - DNA, 25 bp, Rattus norvegicus
gacccgaacctgctgtccacaagat

SEQ ID NO: 515836 - DNA, 25 bp, Rattus norvegicus
tgggtcgctcacctcgaccaccaag

SEQ ID NO: 515837 - DNA, 25 bp, Rattus norvegicus
agcttggctcacacagccgcctggt

SEQ ID NO: 515838 - DNA, 25 bp, Rattus norvegicus
caggattcgagtgcagacagacccg

SEQ ID NO: 515839 - DNA, 25 bp, Rattus norvegicus
gcccgcgaagactcgtgtccacgca

SEQ ID NO: 515840 - DNA, 25 bp, Rattus norvegicus
tgctgtccacaagatcgtgggattc

SEQ ID NO: 515841 - DNA, 25 bp, Rattus norvegicus
ccacaagatcgtgggattccaggcc

SEQ ID NO: 515842 - DNA, 25 bp, Rattus norvegicus
ccagattcagaccacagctccctgc

SEQ ID NO: 515843 - DNA, 25 bp, Rattus norvegicus
cagacgcgcgctcttacctgcccgg

SEQ ID NO: 515844 - DNA, 25 bp, Rattus norvegicus
ctgtccgccgccagctagtgctgaa

SEQ ID NO: 515845 - DNA, 25 bp, Rattus norvegicus
cgccagctagtgctgaaggcggctt

SEQ ID NO: 515846 - DNA, 25 bp, Rattus norvegicus
ctgaaggcggcttccctgctccggg

SEQ ID NO: 515847 - DNA, 25 bp, Rattus norvegicus
acactctccgctccaccgcagctgc

SEQ ID NO: 515848 - DNA, 25 bp, Rattus norvegicus
tcacgccaatctggcaggattcgag

SEQ ID NO: 515849 - DNA, 25 bp, Rattus norvegicus
gacaccgtaggtgggttcaagaagc

SEQ ID NO: 515850 - DNA, 25 bp, Rattus norvegicus
gtgctccttcccacaacgaggggta

SEQ ID NO: 515851 - DNA, 25 bp, Rattus norvegicus
gggtacgctctcagctccagcagtc

SEQ ID NO: 515852 - DNA, 25 bp, Rattus norvegicus
cagcagtctccctctaagtccgaag

SEQ ID NO: 515853 - DNA, 25 bp, Rattus norvegicus
cctttaagtctgagcggtagctctc

SEQ ID NO: 515854 - DNA, 25 bp, Rattus norvegicus
tagctctcgcgggatccgacgcttc

SEQ ID NO: 515855 - DNA, 25 bp, Rattus norvegicus
ccgacgcttcgactctcgcgagaga

SEQ ID NO: 515856 - DNA, 25 bp, Rattus norvegicus
gcgagagaggcattcggctcccatt

SEQ ID NO: 515857 - DNA, 25 bp, Rattus norvegicus
ccattggccgtgagggttgaatgta

SEQ ID NO: 515858 - DNA, 25 bp, Rattus norvegicus
ttgaatgtaagatggcgcccaggga

SEQ ID NO: 515859 - DNA, 25 bp, Rattus norvegicus
gaagcacgcttgtaaacctaggaca

SEQ ID NO: 515860 - DNA, 25 bp, Rattus norvegicus
cgccctgctgttggtttggttgctc

SEQ ID NO: 515861 - DNA, 25 bp, Rattus norvegicus
gtacggagaacgtccctcggctcgc

SEQ ID NO: 515862 - DNA, 25 bp, Rattus norvegicus
aaaatcctgtcggtcttggagcagc

SEQ ID NO: 515863 - DNA, 25 bp, Rattus norvegicus
tccggctgcgacttgcaatgaattc

SEQ ID NO: 515864 - DNA, 25 bp, Rattus norvegicus
atggtggatgatcggtcccttcggt

SEQ ID NO: 515865 - DNA, 25 bp, Rattus norvegicus
gtgcaacgcctgtacgagcgcctga

SEQ ID NO: 515866 - DNA, 25 bp, Rattus norvegicus
cctggcctgagtggccttggcgtct

SEQ ID NO: 515867 - DNA, 25 bp, Rattus norvegicus
cccgggacagccagtggctgacttt

SEQ ID NO: 515868 - DNA, 25 bp, Rattus norvegicus
tgtgctcggtctatgtcccggagtt

SEQ ID NO: 515869 - DNA, 25 bp, Rattus norvegicus
tgaattccagatgtggccctccagt

SEQ ID NO: 515870 - DNA, 25 bp, Rattus norvegicus
tcccttcggtgcagcagaacctgga

SEQ ID NO: 515871 - DNA, 25 bp, Rattus norvegicus
cagaacctggagcagcgcgtgcaac

SEQ ID NO: 515872 - DNA, 25 bp, Rattus norvegicus
gccctccagttagccagagcgtgca

SEQ ID NO: 515873 - DNA, 25 bp, Rattus norvegicus
agagcatggtccctttgtccgcacc

SEQ ID NO: 515874 - DNA, 25 bp, Rattus norvegicus
ccactcgtgagaactgccgtcgcat

SEQ ID NO: 515875 - DNA, 25 bp, Rattus norvegicus
tcgcatgatgtcacggccgcgtgac

SEQ ID NO: 515876 - DNA, 25 bp, Rattus norvegicus
ctgactttggtgactgttggctgtg

SEQ ID NO: 515877 - DNA, 25 bp, Rattus norvegicus
aacaggtcccggcagttacctatca

SEQ ID NO: 515878 - DNA, 25 bp, Rattus norvegicus
gctgaagctctacggatggggaaca

SEQ ID NO: 515879 - DNA, 25 bp, Rattus norvegicus
ggcctgacctacaagtgcgggtcta

SEQ ID NO: 515880 - DNA, 25 bp, Rattus norvegicus
cagctcttcaactgcggggacggcc

SEQ ID NO: 515881 - DNA, 25 bp, Rattus norvegicus
gtctagtttatattggcgcggtcca

SEQ ID NO: 515882 - DNA, 25 bp, Rattus norvegicus
ttcttacgtgccagacgacgggctc

SEQ ID NO: 515883 - DNA, 25 bp, Rattus norvegicus
acctgattagcggaggcacttctta

SEQ ID NO: 515884 - DNA, 25 bp, Rattus norvegicus
tcctctgaggcacgcgtccgtgttc

SEQ ID NO: 515885 - DNA, 25 bp, Rattus norvegicus
cacgcgacgtgtgacggagtagtct

SEQ ID NO: 515886 - DNA, 25 bp, Rattus norvegicus
tctacagggcgtggcaccatacgca

SEQ ID NO: 515887 - DNA, 25 bp, Rattus norvegicus
aagcacgcgtttatcctccgctagc

SEQ ID NO: 515888 - DNA, 25 bp, Rattus norvegicus
ccctgtaaacgggataagcacgcgt

SEQ ID NO: 515889 - DNA, 25 bp, Rattus norvegicus
gccctctggccttagtccctgtaaa

SEQ ID NO: 515890 - DNA, 25 bp, Rattus norvegicus
ttcctcgttggtcatggcggactac

SEQ ID NO: 515891 - DNA, 25 bp, Rattus norvegicus
tgcgcacctggtcctgttatgaaca

SEQ ID NO: 515892 - DNA, 25 bp, Rattus norvegicus
caggcccttaatcccaggctttgga

SEQ ID NO: 515893 - DNA, 25 bp, Rattus norvegicus
ctaaggtttccctagctagtctcga

SEQ ID NO: 515894 - DNA, 25 bp, Rattus norvegicus
ggccagatggtttctccttaaaatg

SEQ ID NO: 515895 - DNA, 25 bp, Rattus norvegicus
ccggaccagacgtgaagtagacagc

SEQ ID NO: 515896 - DNA, 25 bp, Rattus norvegicus
tcagccattattcgggctcccaggg

SEQ ID NO: 515897 - DNA, 25 bp, Rattus norvegicus
cgtccgctggtataactcatcgtca

SEQ ID NO: 515898 - DNA, 25 bp, Rattus norvegicus
cgggctcctcctgcggaggtctaaa

SEQ ID NO: 515899 - DNA, 25 bp, Rattus norvegicus
aacggcgcgtaatgacccggtctca

SEQ ID NO: 515900 - DNA, 25 bp, Rattus norvegicus
agagttgtctgtctcaaatcggcca

SEQ ID NO: 515901 - DNA, 25 bp, Rattus norvegicus
agggcaacgcgcaccttagctgtcg

SEQ ID NO: 515902 - DNA, 25 bp, Rattus norvegicus
ccctagtgcggttcttatgtcagca

SEQ ID NO: 515903 - DNA, 25 bp, Rattus norvegicus
cagggtattgtttaggccaccgcca

SEQ ID NO: 515904 - DNA, 25 bp, Rattus norvegicus
cacggcctgttcctcggattctcag

SEQ ID NO: 515905 - DNA, 25 bp, Rattus norvegicus
acctagtacgggtgctgcgcgctca

SEQ ID NO: 515906 - DNA, 25 bp, Rattus norvegicus
tgctagtggccgatcacctagtacg

SEQ ID NO: 515907 - DNA, 25 bp, Rattus norvegicus
atacgctccgattgagccagctgcg

SEQ ID NO: 515908 - DNA, 25 bp, Rattus norvegicus
ccggcactgcgctgtaatccagata

SEQ ID NO: 515909 - DNA, 25 bp, Rattus norvegicus
tcgaacatgtactcggtgccctggc

SEQ ID NO: 515910 - DNA, 25 bp, Rattus norvegicus
cggcccgcagtcttcgaacatgtac

SEQ ID NO: 515911 - DNA, 25 bp, Rattus norvegicus
gcgggcttatcgctccaactacagc

SEQ ID NO: 515912 - DNA, 25 bp, Rattus norvegicus
tcgggcatgtctagccggaaacacg

SEQ ID NO: 515913 - DNA, 25 bp, Rattus norvegicus
tcttggcaccgcgaagcgcgctaca

SEQ ID NO: 515914 - DNA, 25 bp, Rattus norvegicus
gtccgagacttcttggcaccgcgaa

SEQ ID NO: 515915 - DNA, 25 bp, Rattus norvegicus
atgcccgacaccttcgtgtccgaga

SEQ ID NO: 515916 - DNA, 25 bp, Rattus norvegicus
ggtttaaggaaacgcatgcccgaca

SEQ ID NO: 515917 - DNA, 25 bp, Rattus norvegicus
ctgcaggcccttaacgccgctgtag

SEQ ID NO: 515918 - DNA, 25 bp, Rattus norvegicus
gaacctcccggaagctctaaggata

SEQ ID NO: 515919 - DNA, 25 bp, Rattus norvegicus
gcagcatggaggctgtacaccaata

SEQ ID NO: 515920 - DNA, 25 bp, Rattus norvegicus
gctgtagctgcctcggacaagaaga

SEQ ID NO: 515921 - DNA, 25 bp, Rattus norvegicus
agggcaagaggtcagccagaacttc

SEQ ID NO: 515922 - DNA, 25 bp, Rattus norvegicus
tttccacgctggctgcaatttatga

SEQ ID NO: 515923 - DNA, 25 bp, Rattus norvegicus
gagaggctagttcttctcccgctag

SEQ ID NO: 515924 - DNA, 25 bp, Rattus norvegicus
ccatgacgttccttaagctgctgta

SEQ ID NO: 515925 - DNA, 25 bp, Rattus norvegicus
agggcatccctttgtccggtgcgac

SEQ ID NO: 515926 - DNA, 25 bp, Rattus norvegicus
ttctcgcgagaaccagcaatctgga

SEQ ID NO: 515927 - DNA, 25 bp, Rattus norvegicus
tccggagccttagctacaggtagca

SEQ ID NO: 515928 - DNA, 25 bp, Rattus norvegicus
attggccggatcagagagtcacacc

SEQ ID NO: 515929 - DNA, 25 bp, Rattus norvegicus
gctggaagccctgtagttttattta

SEQ ID NO: 515930 - DNA, 25 bp, Rattus norvegicus
cgtgaatgtaggaactgcgcctttc

SEQ ID NO: 515931 - DNA, 25 bp, Rattus norvegicus
cgagccatctcctgctggaacaagg

SEQ ID NO: 515932 - DNA, 25 bp, Rattus norvegicus
tagcacgatcagagccgaccaagcc

SEQ ID NO: 515933 - DNA, 25 bp, Rattus norvegicus
gcagggccagcacattgcccaagta

SEQ ID NO: 515934 - DNA, 25 bp, Rattus norvegicus
tcaccatcgcctggtctggtcgctg

SEQ ID NO: 515935 - DNA, 25 bp, Rattus norvegicus
ttgaggcctcctcgatcgtctcagc

SEQ ID NO: 515936 - DNA, 25 bp, Rattus norvegicus
tgcacgaacaccatcagtaccaaga

SEQ ID NO: 515937 - DNA, 25 bp, Rattus norvegicus
ttgcccaagtacaggtgcacgaaca

SEQ ID NO: 515938 - DNA, 25 bp, Rattus norvegicus
cccgttgctgtagtgcacgaagagc

SEQ ID NO: 515939 - DNA, 25 bp, Rattus norvegicus
tgaggatgttcttaccttgatgccc

SEQ ID NO: 515940 - DNA, 25 bp, Rattus norvegicus
caatgcttaaagagcgagcggctca

SEQ ID NO: 515941 - DNA, 25 bp, Rattus norvegicus
tctggctccgcttggcaatgcttaa

SEQ ID NO: 515942 - DNA, 25 bp, Rattus norvegicus
tcagggcgcgacagtaggaaagtaa

SEQ ID NO: 515943 - DNA, 25 bp, Rattus norvegicus
tggcagcggccactgaagatttgag

SEQ ID NO: 515944 - DNA, 25 bp, Rattus norvegicus
actaggagaccgtgctttgggatgc

SEQ ID NO: 515945 - DNA, 25 bp, Rattus norvegicus
cgcgtgacccgcacacagtgatgcg

SEQ ID NO: 515946 - DNA, 25 bp, Rattus norvegicus
ccaagaagtaggcacgggaacagat

SEQ ID NO: 515947 - DNA, 25 bp, Rattus norvegicus
ggcctccgacctctcggtgagctaa

SEQ ID NO: 515948 - DNA, 25 bp, Rattus norvegicus
taccgggccaaactactgagcgttc

SEQ ID NO: 515949 - DNA, 25 bp, Rattus norvegicus
cctcgcggtcctaggttgagatcta

SEQ ID NO: 515950 - DNA, 25 bp, Rattus norvegicus
ggcttctgacaaatgcgtagactga

SEQ ID NO: 515951 - DNA, 25 bp, Rattus norvegicus
gtcgtcggtgaagctaacaggcttc

SEQ ID NO: 515952 - DNA, 25 bp, Rattus norvegicus
cagctccggaagtgttctgcgcagc

SEQ ID NO: 515953 - DNA, 25 bp, Rattus norvegicus
aagccggaccaaaagaatctgactg

SEQ ID NO: 515954 - DNA, 25 bp, Rattus norvegicus
tgtctctaggacagcggggaacatc

SEQ ID NO: 515955 - DNA, 25 bp, Rattus norvegicus
gcctccaaggtggtgcgttttcctg

SEQ ID NO: 515956 - DNA, 25 bp, Rattus norvegicus
gctgcaaaagctcccaaacacgata

SEQ ID NO: 515957 - DNA, 25 bp, Rattus norvegicus
gacgggcgttaacaaacagtgcacc

SEQ ID NO: 515958 - DNA, 25 bp, Rattus norvegicus
gctgcaccctgttcctcaggagatc

SEQ ID NO: 515959 - DNA, 25 bp, Rattus norvegicus
cctctcttgaggctagaccagtggc

SEQ ID NO: 515960 - DNA, 25 bp, Rattus norvegicus
cccgaggccagtcaagagtaaacaa

SEQ ID NO: 515961 - DNA, 25 bp, Rattus norvegicus
gtacagtacgcgctgcttcacctaa

SEQ ID NO: 515962 - DNA, 25 bp, Rattus norvegicus
tgtgcctggtgtttgtggggcaccc

SEQ ID NO: 515963 - DNA, 25 bp, Rattus norvegicus
cgaggtgctgcctctggacagaagt

SEQ ID NO: 515964 - DNA, 25 bp, Rattus norvegicus
cccttggacacggtcaaggtgcgca

SEQ ID NO: 515965 - DNA, 25 bp, Rattus norvegicus
acacggtcaaggtgcgcaaagtgtg

SEQ ID NO: 515966 - DNA, 25 bp, Rattus norvegicus
cgcaaagtgtggattggggagcttg

SEQ ID NO: 515967 - DNA, 25 bp, Rattus norvegicus
acgtggaaagtagggaccgctgcga

SEQ ID NO: 515968 - DNA, 25 bp, Rattus norvegicus
tggatgcttccgtgggaagtttacg

SEQ ID NO: 515969 - DNA, 25 bp, Rattus norvegicus
atgcttccgtgggaagtttacggag

SEQ ID NO: 515970 - DNA, 25 bp, Rattus norvegicus
ggttggtatgtaatttactagtaca

SEQ ID NO: 515971 - DNA, 25 bp, Rattus norvegicus
ttactagtacagtacgcgctgcttc

SEQ ID NO: 515972 - DNA, 25 bp, Rattus norvegicus
gcttaagaacctccttgccggcggc

SEQ ID NO: 515973 - DNA, 25 bp, Rattus norvegicus
aagaacctccttgccggcggctttg

SEQ ID NO: 515974 - DNA, 25 bp, Rattus norvegicus
ctgcctctggacagaagtggagccg

SEQ ID NO: 515975 - DNA, 25 bp, Rattus norvegicus
agactgtgggaaaacgctgctccgc

SEQ ID NO: 515976 - DNA, 25 bp, Rattus norvegicus
gcacgcctagctcgccaagggttaa

SEQ ID NO: 515977 - DNA, 25 bp, Rattus norvegicus
tgtgggaaaacgctgctccgctcac

SEQ ID NO: 515978 - DNA, 25 bp, Rattus norvegicus
gagccgggaaacaggagccgcccgc

SEQ ID NO: 515979 - DNA, 25 bp, Rattus norvegicus
cctcccagcagctggcccgcgcccg

SEQ ID NO: 515980 - DNA, 25 bp, Rattus norvegicus
cccagactgtgggaaaacgctgctc

SEQ ID NO: 515981 - DNA, 25 bp, Rattus norvegicus
gtgtgagcgccatgtgtcaccgccc

SEQ ID NO: 515982 - DNA, 25 bp, Rattus norvegicus
cgagcggcccagcacgaccttctcc

SEQ ID NO: 515983 - DNA, 25 bp, Rattus norvegicus
tggaatgtgtgagcgccatgtgtca

SEQ ID NO: 515984 - DNA, 25 bp, Rattus norvegicus
tgccttgactcaccgccaggcctgg

SEQ ID NO: 515985 - DNA, 25 bp, Rattus norvegicus
agtcggaacctgctctcggcagctc

SEQ ID NO: 515986 - DNA, 25 bp, Rattus norvegicus
gtgccaaagtcggaacctgctctcg

SEQ ID NO: 515987 - DNA, 25 bp, Rattus norvegicus
ctagctcgccaagggttaaccggcg

SEQ ID NO: 515988 - DNA, 25 bp, Rattus norvegicus
cgcctagctcgccaagggttaaccg

SEQ ID NO: 515989 - DNA, 25 bp, Rattus norvegicus
aggtgcttcggcagcagccgcccga

SEQ ID NO: 515990 - DNA, 25 bp, Rattus norvegicus
ccggccagaacaaggcgcgacgcaa

SEQ ID NO: 515991 - DNA, 25 bp, Rattus norvegicus
aagcgtgcgcgttctttggtccgcg

SEQ ID NO: 515992 - DNA, 25 bp, Rattus norvegicus
ttctgccttgaatgaagcgtgcgcg

SEQ ID NO: 515993 - DNA, 25 bp, Rattus norvegicus
cgacttcgcggtggagtacttcaca

SEQ ID NO: 515994 - DNA, 25 bp, Rattus norvegicus
gagtacttcacacgcctgcgcgagg

SEQ ID NO: 515995 - DNA, 25 bp, Rattus norvegicus
cgacgacctttcacgcgcaggagtc

SEQ ID NO: 515996 - DNA, 25 bp, Rattus norvegicus
gacccgagagctctccagctgcttg

SEQ ID NO: 515997 - DNA, 25 bp, Rattus norvegicus
ccggcgtgcgaggattccaaattga

SEQ ID NO: 515998 - DNA, 25 bp, Rattus norvegicus
ttccaaattgagctccgcggttctc

SEQ ID NO: 515999 - DNA, 25 bp, Rattus norvegicus
ctgagcccgagcgttcacagagagt

SEQ ID NO: 516000 - DNA, 25 bp, Rattus norvegicus
tcacagagagtgatttgtcagattc

SEQ ID NO: 516001 - DNA, 25 bp, Rattus norvegicus
gtcgccggcatgagccacatccaga

SEQ ID NO: 516002 - DNA, 25 bp, Rattus norvegicus
atgtgggcaccgaacgaagggttca

SEQ ID NO: 516003 - DNA, 25 bp, Rattus norvegicus
taccgcgcgctgtatgcgttccgct

SEQ ID NO: 516004 - DNA, 25 bp, Rattus norvegicus
atgtaccgcgcgctgtatgcgttcc

SEQ ID NO: 516005 - DNA, 25 bp, Rattus norvegicus
aatgctggagccgactcatccctgg

SEQ ID NO: 516006 - DNA, 25 bp, Rattus norvegicus
ctggagccgactcatccctggggcg

SEQ ID NO: 516007 - DNA, 25 bp, Rattus norvegicus
ggcttcccggcactgcaaccttcgt

SEQ ID NO: 516008 - DNA, 25 bp, Rattus norvegicus
tgcaaccttcgtcgcgtacccagca

SEQ ID NO: 516009 - DNA, 25 bp, Rattus norvegicus
agcacgcactggtggttagcggcac

SEQ ID NO: 516010 - DNA, 25 bp, Rattus norvegicus
cggcctcatgtaccgcgcgctgtat

SEQ ID NO: 516011 - DNA, 25 bp, Rattus norvegicus
agaccgggtacgtgccgcctgccta

SEQ ID NO: 516012 - DNA, 25 bp, Rattus norvegicus
tgctggagcgcagcagcacgcactg

SEQ ID NO: 516013 - DNA, 25 bp, Rattus norvegicus
aggcgaaaccttcctggtgctggag

SEQ ID NO: 516014 - DNA, 25 bp, Rattus norvegicus
ccatggcgttcgctgcaggcgaaac

SEQ ID NO: 516015 - DNA, 25 bp, Rattus norvegicus
ggagcccaacgccatggcgttcgct

SEQ ID NO: 516016 - DNA, 25 bp, Rattus norvegicus
tcgctgcaggcgaaaccttcctggt

SEQ ID NO: 516017 - DNA, 25 bp, Rattus norvegicus
tgctactgggccaagagctcaaatc

SEQ ID NO: 516018 - DNA, 25 bp, Rattus norvegicus
ccaacgtaatggtaggagaagcatc

SEQ ID NO: 516019 - DNA, 25 bp, Rattus norvegicus
cttcggaacttctggctcagcctga

SEQ ID NO: 516020 - DNA, 25 bp, Rattus norvegicus
ccaggggattctgatctgaggaaca

SEQ ID NO: 516021 - DNA, 25 bp, Rattus norvegicus
agagatctcctcttgtgggcggaca

SEQ ID NO: 516022 - DNA, 25 bp, Rattus norvegicus
tgttatgttggcacccagagatctc

SEQ ID NO: 516023 - DNA, 25 bp, Rattus norvegicus
ccaggcattaggtagtcgcgagcaa

SEQ ID NO: 516024 - DNA, 25 bp, Rattus norvegicus
gggttcagcacctcacgagtctcgg

SEQ ID NO: 516025 - DNA, 25 bp, Rattus norvegicus
cagggaacctgtcttcatgaagctc

SEQ ID NO: 516026 - DNA, 25 bp, Rattus norvegicus
cctttcgctgctgcgggaaactatg

SEQ ID NO: 516027 - DNA, 25 bp, Rattus norvegicus
tggtgctgaagccaagcgaatactc

SEQ ID NO: 516028 - DNA, 25 bp, Rattus norvegicus
tcccggattcccgactggtgctgaa

SEQ ID NO: 516029 - DNA, 25 bp, Rattus norvegicus
tgagagatccgcgacttccacagtg

SEQ ID NO: 516030 - DNA, 25 bp, Rattus norvegicus
gctccgagtaggtaggcaaaacgcc

SEQ ID NO: 516031 - DNA, 25 bp, Rattus norvegicus
tcacgtggagctgatccaaagcctc

SEQ ID NO: 516032 - DNA, 25 bp, Rattus norvegicus
tcgagtctctccgaggctttgagca

SEQ ID NO: 516033 - DNA, 25 bp, Rattus norvegicus
acacactgagttggcaccgaaagta

SEQ ID NO: 516034 - DNA, 25 bp, Rattus norvegicus
acgtcatcagtcatcgccgcgagcg

SEQ ID NO: 516035 - DNA, 25 bp, Rattus norvegicus
tgcggccagccgagatttcagagcc

SEQ ID NO: 516036 - DNA, 25 bp, Rattus norvegicus
ggcggccaatcgcattcgtgacgtg

SEQ ID NO: 516037 - DNA, 25 bp, Rattus norvegicus
ttttccaggtcatcagctctctagc

SEQ ID NO: 516038 - DNA, 25 bp, Rattus norvegicus
gagagcacctctaactccggcctgt

SEQ ID NO: 516039 - DNA, 25 bp, Rattus norvegicus
tgcgcaagtgtgagcttccgatacc

SEQ ID NO: 516040 - DNA, 25 bp, Rattus norvegicus
tcctagaccctgtattgcgcaagtg

SEQ ID NO: 516041 - DNA, 25 bp, Rattus norvegicus
tcattcgaaatgctgcggttgttcc

SEQ ID NO: 516042 - DNA, 25 bp, Rattus norvegicus
gccggcgcacatacgacgtcatcag

SEQ ID NO: 516043 - DNA, 25 bp, Rattus norvegicus
cctcctgcgtgacgagatttcattc

SEQ ID NO: 516044 - DNA, 25 bp, Rattus norvegicus
cgcaggtgaaatggccgagatcata

SEQ ID NO: 516045 - DNA, 25 bp, Rattus norvegicus
caacgtgagcttctcagcgctggca

SEQ ID NO: 516046 - DNA, 25 bp, Rattus norvegicus
ctggcttcacaggagacttctgcga

SEQ ID NO: 516047 - DNA, 25 bp, Rattus norvegicus
tgctcgacgtgctaccctttgacga

SEQ ID NO: 516048 - DNA, 25 bp, Rattus norvegicus
ccctttgacgacaacgtgtgcctgc

SEQ ID NO: 516049 - DNA, 25 bp, Rattus norvegicus
ctggacactgaagctggacgctgtg

SEQ ID NO: 516050 - DNA, 25 bp, Rattus norvegicus
ctcaaccattcggaggacgagggga

SEQ ID NO: 516051 - DNA, 25 bp, Rattus norvegicus
ggcgtgcctacagacagctcaacca

SEQ ID NO: 516052 - DNA, 25 bp, Rattus norvegicus
tacatgaaatgcgtgtcagtcctcc

SEQ ID NO: 516053 - DNA, 25 bp, Rattus norvegicus
cttctgcgagacagagctcgacctc

SEQ ID NO: 516054 - DNA, 25 bp, Rattus norvegicus
gccctggttcagctccgaagagcta

SEQ ID NO: 516055 - DNA, 25 bp, Rattus norvegicus
cggagggactcttttctgaggctac

SEQ ID NO: 516056 - DNA, 25 bp, Rattus norvegicus
gctactcgaacccttgtcgcaatgg

SEQ ID NO: 516057 - DNA, 25 bp, Rattus norvegicus
agttccttcgtcatgttccgcggtc

SEQ ID NO: 516058 - DNA, 25 bp, Rattus norvegicus
tgcgcgagccgtgcgagaactacat

SEQ ID NO: 516059 - DNA, 25 bp, Rattus norvegicus
tcccggcctgggtcaattcaggaag

SEQ ID NO: 516060 - DNA, 25 bp, Rattus norvegicus
gagctgtctgaaaaagccgcacacg

SEQ ID NO: 516061 - DNA, 25 bp, Rattus norvegicus
cgaagcgctggtagttctgtgactc

SEQ ID NO: 516062 - DNA, 25 bp, Rattus norvegicus
accctctgagggtcatgggactgcc

SEQ ID NO: 516063 - DNA, 25 bp, Rattus norvegicus
ggaaccggaatttcccggctgcaga

SEQ ID NO: 516064 - DNA, 25 bp, Rattus norvegicus
tgcagagccttggtttagcaccttg

SEQ ID NO: 516065 - DNA, 25 bp, Rattus norvegicus
agcaccttgccgattttccgcagga

SEQ ID NO: 516066 - DNA, 25 bp, Rattus norvegicus
ttccgcaggaggttatccatcaata

SEQ ID NO: 516067 - DNA, 25 bp, Rattus norvegicus
cccagctcttgagggttgtactgaa

SEQ ID NO: 516068 - DNA, 25 bp, Rattus norvegicus
gttgtactgaacgtccctggagtgc

SEQ ID NO: 516069 - DNA, 25 bp, Rattus norvegicus
cctggagtgctaataagggtgctgc

SEQ ID NO: 516070 - DNA, 25 bp, Rattus norvegicus
aaccgctgcaagacgggctctagcc

SEQ ID NO: 516071 - DNA, 25 bp, Rattus norvegicus
tctagccgggctgtggaccaacagc

SEQ ID NO: 516072 - DNA, 25 bp, Rattus norvegicus
tccgaattcctcgtgtccgcgaagc

SEQ ID NO: 516073 - DNA, 25 bp, Rattus norvegicus
agtgtttgccagtcctccagatgag

SEQ ID NO: 516074 - DNA, 25 bp, Rattus norvegicus
ctgcgcatgcgtagcgcggctttac

SEQ ID NO: 516075 - DNA, 25 bp, Rattus norvegicus
cggctttacgctgacggaagttaga

SEQ ID NO: 516076 - DNA, 25 bp, Rattus norvegicus
tctgggacgcaagcgctacttcgca

SEQ ID NO: 516077 - DNA, 25 bp, Rattus norvegicus
cttggatgtgagagtcgaggtccca

SEQ ID NO: 516078 - DNA, 25 bp, Rattus norvegicus
atgggtatcttctcgggcttggatg

SEQ ID NO: 516079 - DNA, 25 bp, Rattus norvegicus
gatcgagcaccaactcttccttaca

SEQ ID NO: 516080 - DNA, 25 bp, Rattus norvegicus
tcgcatcctacctgcacggtgagtg

SEQ ID NO: 516081 - DNA, 25 bp, Rattus norvegicus
tcagcgtattggacaacgggctgcg

SEQ ID NO: 516082 - DNA, 25 bp, Rattus norvegicus
tgccggagacacaggtcagcgtatt

SEQ ID NO: 516083 - DNA, 25 bp, Rattus norvegicus
tgccttgcggggtaccgcaaccttc

SEQ ID NO: 516084 - DNA, 25 bp, Rattus norvegicus
acagtggtcaccttcttcctttagc

SEQ ID NO: 516085 - DNA, 25 bp, Rattus norvegicus
ggcttggagagcagttcttacagtg

SEQ ID NO: 516086 - DNA, 25 bp, Rattus norvegicus
gctcagggctttggcacgcagatga

SEQ ID NO: 516087 - DNA, 25 bp, Rattus norvegicus
cgggcctgcgagaagattgacaaga

SEQ ID NO: 516088 - DNA, 25 bp, Rattus norvegicus
aaaattgggcatgcgtactcgtagg

SEQ ID NO: 516089 - DNA, 25 bp, Rattus norvegicus
gggcctgcataatccgggtgtcaaa

SEQ ID NO: 516090 - DNA, 25 bp, Rattus norvegicus
ccgggtgtcaaacgcagttggtact

SEQ ID NO: 516091 - DNA, 25 bp, Rattus norvegicus
cagttggtactgagcatgcgctgta

SEQ ID NO: 516092 - DNA, 25 bp, Rattus norvegicus
atgcgctgtatcagcactggcaacg

SEQ ID NO: 516093 - DNA, 25 bp, Rattus norvegicus
aacgacggacaaggcgtgcttagtc

SEQ ID NO: 516094 - DNA, 25 bp, Rattus norvegicus
gtgagaagcagcgtagtccgattca

SEQ ID NO: 516095 - DNA, 25 bp, Rattus norvegicus
cgtgcttagtccaaaagaggagata

SEQ ID NO: 516096 - DNA, 25 bp, Rattus norvegicus
gtactcgtaggctagtgcctcttta

SEQ ID NO: 516097 - DNA, 25 bp, Rattus norvegicus
ctttagtttgggtggagcctattag

SEQ ID NO: 516098 - DNA, 25 bp, Rattus norvegicus
agcctattagtactggggcgggcct

SEQ ID NO: 516099 - DNA, 25 bp, Rattus norvegicus
attgacaagagttggagccgctaga

SEQ ID NO: 516100 - DNA, 25 bp, Rattus norvegicus
tagtccgattcatcccagcctgggg

SEQ ID NO: 516101 - DNA, 25 bp, Rattus norvegicus
ggtcctgggcttgatgcgtctgttt

SEQ ID NO: 516102 - DNA, 25 bp, Rattus norvegicus
caccgtggtcctgggcttggtcctg

SEQ ID NO: 516103 - DNA, 25 bp, Rattus norvegicus
ggcttgatgcgtctgtttgtccgtc

SEQ ID NO: 516104 - DNA, 25 bp, Rattus norvegicus
cttggtcctgggcttgatgcgtctg

SEQ ID NO: 516105 - DNA, 25 bp, Rattus norvegicus
gcttgatgcgtctgtttgtccgtcc

SEQ ID NO: 516106 - DNA, 25 bp, Rattus norvegicus
tcctgggcttgatgcgtctgtttgt

SEQ ID NO: 516107 - DNA, 25 bp, Rattus norvegicus
ttgatgcgtctgtttgtccgtccgt

SEQ ID NO: 516108 - DNA, 25 bp, Rattus norvegicus
gatgcgtctgtttgtccgtccgtcc

SEQ ID NO: 516109 - DNA, 25 bp, Rattus norvegicus
gcgccctctccgtggaccctttcgc

SEQ ID NO: 516110 - DNA, 25 bp, Rattus norvegicus
ctccgtggaccctttcgctgctgct

SEQ ID NO: 516111 - DNA, 25 bp, Rattus norvegicus
gtcgcggaggttgtggctgcaccgt

SEQ ID NO: 516112 - DNA, 25 bp, Rattus norvegicus
ctgcaccgtggtcctgggcttggtc

SEQ ID NO: 516113 - DNA, 25 bp, Rattus norvegicus
tagagccgcgctggtcgcggaggtt

SEQ ID NO: 516114 - DNA, 25 bp, Rattus norvegicus
caaggaggctagagccgcgctggtc

SEQ ID NO: 516115 - DNA, 25 bp, Rattus norvegicus
ccgagacagaccgaggaaaggctcc

SEQ ID NO: 516116 - DNA, 25 bp, Rattus norvegicus
gtgcaagcagccagtaccaaagcta

SEQ ID NO: 516117 - DNA, 25 bp, Rattus norvegicus
gacgcgaggatgtccagttcctcta

SEQ ID NO: 516118 - DNA, 25 bp, Rattus norvegicus
ctaggtcgtccgcagtaaattccgc

SEQ ID NO: 516119 - DNA, 25 bp, Rattus norvegicus
taaattccgcgtgctcgccgaatgg

SEQ ID NO: 516120 - DNA, 25 bp, Rattus norvegicus
tccggaactgtggtctcagagaagc

SEQ ID NO: 516121 - DNA, 25 bp, Rattus norvegicus
ggagtcccggccatgactaccttca

SEQ ID NO: 516122 - DNA, 25 bp, Rattus norvegicus
ccaagcacaggttgatcggcagaaa

SEQ ID NO: 516123 - DNA, 25 bp, Rattus norvegicus
tcggcagaaagcctgagatggccca

SEQ ID NO: 516124 - DNA, 25 bp, Rattus norvegicus
tgcgggccaatcagctgccagctac

SEQ ID NO: 516125 - DNA, 25 bp, Rattus norvegicus
ccgggcacagatgggtgacgtatac

SEQ ID NO: 516126 - DNA, 25 bp, Rattus norvegicus
gtgacgtatacagagcgcgccgtta

SEQ ID NO: 516127 - DNA, 25 bp, Rattus norvegicus
tcgatcgggtgctatttcgttttta

SEQ ID NO: 516128 - DNA, 25 bp, Rattus norvegicus
tcgcagcatctgaggacgccaagca

SEQ ID NO: 516129 - DNA, 25 bp, Rattus norvegicus
cgcagggtagcctggaaaatccagc

SEQ ID NO: 516130 - DNA, 25 bp, Rattus norvegicus
gcctggaaaatccagcgcccagatc

SEQ ID NO: 516131 - DNA, 25 bp, Rattus norvegicus
ctttggaagcggcagttaaggatca

SEQ ID NO: 516132 - DNA, 25 bp, Rattus norvegicus
cagctgaagccgtggacccggactc

SEQ ID NO: 516133 - DNA, 25 bp, Rattus norvegicus
cccagatcccagctgaagccgtgga

SEQ ID NO: 516134 - DNA, 25 bp, Rattus norvegicus
atcagccgggactttggaagcggca

SEQ ID NO: 516135 - DNA, 25 bp, Rattus norvegicus
cactgattaggatcagccgggactt

SEQ ID NO: 516136 - DNA, 25 bp, Rattus norvegicus
gggcgctcctttcccacactgatta

SEQ ID NO: 516137 - DNA, 25 bp, Rattus norvegicus
gataaagtttatgaaaagaggcggc

SEQ ID NO: 516138 - DNA, 25 bp, Rattus norvegicus
tgcaccgcggcgataaagtttatga

SEQ ID NO: 516139 - DNA, 25 bp, Rattus norvegicus
tatggtgctttatcaggggctgtgc

SEQ ID NO: 516140 - DNA, 25 bp, Rattus norvegicus
ccggcctgctcgtttatttatggtg

SEQ ID NO: 516141 - DNA, 25 bp, Rattus norvegicus
gcacactccggcctgctcgtttatt

SEQ ID NO: 516142 - DNA, 25 bp, Rattus norvegicus
gtgccgggagctggctcgccttcct

SEQ ID NO: 516143 - DNA, 25 bp, Rattus norvegicus
tttgccacctgtgggcgacacgagc

SEQ ID NO: 516144 - DNA, 25 bp, Rattus norvegicus
tttttgccacctgtgggcgacacga

SEQ ID NO: 516145 - DNA, 25 bp, Rattus norvegicus
gtccttacctcgtccatctccttgg

SEQ ID NO: 516146 - DNA, 25 bp, Rattus norvegicus
ttggcctgcttcttgggctgtttca

SEQ ID NO: 516147 - DNA, 25 bp, Rattus norvegicus
ggcctgcttcttgggctgtttcagg

SEQ ID NO: 516148 - DNA, 25 bp, Rattus norvegicus
ttcttgggctgtttcaggggcttct

SEQ ID NO: 516149 - DNA, 25 bp, Rattus norvegicus
cttgggctgtttcaggggcttcttt

SEQ ID NO: 516150 - DNA, 25 bp, Rattus norvegicus
ctgtttcaggggcttctttttgcca

SEQ ID NO: 516151 - DNA, 25 bp, Rattus norvegicus
ttctttttgccacctgtgggcgaca

SEQ ID NO: 516152 - DNA, 25 bp, Rattus norvegicus
caaccttaccttcgcggcccgacat

SEQ ID NO: 516153 - DNA, 25 bp, Rattus norvegicus
cgccatccatcgcccttccatttcc

SEQ ID NO: 516154 - DNA, 25 bp, Rattus norvegicus
ggcgacacgagcatgctcggcccat

SEQ ID NO: 516155 - DNA, 25 bp, Rattus norvegicus
tccgctcccgtccttacctcgtcca

SEQ ID NO: 516156 - DNA, 25 bp, Rattus norvegicus
acctgtgggcgacacgagcatgctc

SEQ ID NO: 516157 - DNA, 25 bp, Rattus norvegicus
tcctttgttcccagcggaggcagcg

SEQ ID NO: 516158 - DNA, 25 bp, Rattus norvegicus
caccgcctgtaacgcgattgggaga

SEQ ID NO: 516159 - DNA, 25 bp, Rattus norvegicus
cccggtgtaaggctagcaaccatgg

SEQ ID NO: 516160 - DNA, 25 bp, Rattus norvegicus
taaggctagcaaccatggccgcagc

SEQ ID NO: 516161 - DNA, 25 bp, Rattus norvegicus
accctacatgtctgcgttgccatgg

SEQ ID NO: 516162 - DNA, 25 bp, Rattus norvegicus
taatgagaggggttgatcaactccc

SEQ ID NO: 516163 - DNA, 25 bp, Rattus norvegicus
ttcacaaactcggatcccgcgggac

SEQ ID NO: 516164 - DNA, 25 bp, Rattus norvegicus
gtctccgggtaacagctgcggctcc

SEQ ID NO: 516165 - DNA, 25 bp, Rattus norvegicus
agagccgcgcgcacccaggtggaac

SEQ ID NO: 516166 - DNA, 25 bp, Rattus norvegicus
cggcttcggtccacagagttgggac

SEQ ID NO: 516167 - DNA, 25 bp, Rattus norvegicus
cagagttgggaccacattcgcgcgc

SEQ ID NO: 516168 - DNA, 25 bp, Rattus norvegicus
attcgcgcgcgcgaaggcaaactct

SEQ ID NO: 516169 - DNA, 25 bp, Rattus norvegicus
cgcagatctgagctagcccggagct

SEQ ID NO: 516170 - DNA, 25 bp, Rattus norvegicus
gaaggcaaactctggcggcaccgcc

SEQ ID NO: 516171 - DNA, 25 bp, Rattus norvegicus
ttagtccggtcggtggcctcaagac

SEQ ID NO: 516172 - DNA, 25 bp, Rattus norvegicus
cctcgggatgacctagcaggaagca

SEQ ID NO: 516173 - DNA, 25 bp, Rattus norvegicus
tcaccatggaccagctggaagggct

SEQ ID NO: 516174 - DNA, 25 bp, Rattus norvegicus
tgtcaccaacctgacggtcaccatg

SEQ ID NO: 516175 - DNA, 25 bp, Rattus norvegicus
cgcgtcagctgctggcggactgtcc

SEQ ID NO: 516176 - DNA, 25 bp, Rattus norvegicus
tcgtgtttgtgtttgacccgcgggc

SEQ ID NO: 516177 - DNA, 25 bp, Rattus norvegicus
ccgcgtctctgaaccgcggggtcgt

SEQ ID NO: 516178 - DNA, 25 bp, Rattus norvegicus
aagcaccggtgcttgtgcctggcgc

SEQ ID NO: 516179 - DNA, 25 bp, Rattus norvegicus
acagagagagaagcaccggtgcttg

SEQ ID NO: 516180 - DNA, 25 bp, Rattus norvegicus
gcctacgggcctcgcgggacacaga

SEQ ID NO: 516181 - DNA, 25 bp, Rattus norvegicus
gatttaatcttgaggttgcaggcgc

SEQ ID NO: 516182 - DNA, 25 bp, Rattus norvegicus
tggctccgcggagtttgtttggatt

SEQ ID NO: 516183 - DNA, 25 bp, Rattus norvegicus
ggcctcaagactctggctccgcgga

SEQ ID NO: 516184 - DNA, 25 bp, Rattus norvegicus
ccctggttctggtgcccggatccgg

SEQ ID NO: 516185 - DNA, 25 bp, Rattus norvegicus
cctacgggcttgaccttcggagtct

SEQ ID NO: 516186 - DNA, 25 bp, Rattus norvegicus
tgacactaccatcctctctgctgga

SEQ ID NO: 516187 - DNA, 25 bp, Rattus norvegicus
ggagaacccaactcgagcccttgtg

SEQ ID NO: 516188 - DNA, 25 bp, Rattus norvegicus
cctctctgctggaaaaggaagcggc

SEQ ID NO: 516189 - DNA, 25 bp, Rattus norvegicus
ctgaggctcgccattcgctgagaca

SEQ ID NO: 516190 - DNA, 25 bp, Rattus norvegicus
cgtgccgctttcacggagaggtcga

SEQ ID NO: 516191 - DNA, 25 bp, Rattus norvegicus
tagctctgtggcttctgcggctcct

SEQ ID NO: 516192 - DNA, 25 bp, Rattus norvegicus
ccgagagattgtttcagggcttctg

SEQ ID NO: 516193 - DNA, 25 bp, Rattus norvegicus
ctcaggctgggcatgtgctgagtcc

SEQ ID NO: 516194 - DNA, 25 bp, Rattus norvegicus
ggtcgtttctctttaagcttcagga

SEQ ID NO: 516195 - DNA, 25 bp, Rattus norvegicus
taagcttcaggaggagcgtcagtga

SEQ ID NO: 516196 - DNA, 25 bp, Rattus norvegicus
aactgaggcgagctccgcgtgtcct

SEQ ID NO: 516197 - DNA, 25 bp, Rattus norvegicus
cttggccagcttttcgcacgggccg

SEQ ID NO: 516198 - DNA, 25 bp, Rattus norvegicus
ggatcctaaggtcgggctcctcact

SEQ ID NO: 516199 - DNA, 25 bp, Rattus norvegicus
ccagcccagctctccatcactcgcg

SEQ ID NO: 516200 - DNA, 25 bp, Rattus norvegicus
ggctttagaccatcagaccgacctc

SEQ ID NO: 516201 - DNA, 25 bp, Rattus norvegicus
accatcagaccgacctctacgtaga

SEQ ID NO: 516202 - DNA, 25 bp, Rattus norvegicus
ggggaccgcttttgcctgtctagct

SEQ ID NO: 516203 - DNA, 25 bp, Rattus norvegicus
ttgcctgtctagctcgcttgcacta

SEQ ID NO: 516204 - DNA, 25 bp, Rattus norvegicus
tctagctcgcttgcactaaagccgg

SEQ ID NO: 516205 - DNA, 25 bp, Rattus norvegicus
cgcttgcactaaagccgggagcagc

SEQ ID NO: 516206 - DNA, 25 bp, Rattus norvegicus
actaaagccgggagcagcccagtgc

SEQ ID NO: 516207 - DNA, 25 bp, Rattus norvegicus
ccagtgcgcgctcgcctccagtcag

SEQ ID NO: 516208 - DNA, 25 bp, Rattus norvegicus
ttaaaccaatccctgggcgcaattc

SEQ ID NO: 516209 - DNA, 25 bp, Rattus norvegicus
caatgccggggccttcaccagggct

SEQ ID NO: 516210 - DNA, 25 bp, Rattus norvegicus
gggccttcaccagggctgcgccgaa

SEQ ID NO: 516211 - DNA, 25 bp, Rattus norvegicus
cccagaaggctttagaccatcagac

SEQ ID NO: 516212 - DNA, 25 bp, Rattus norvegicus
cccgatcaccgcctctgtcaccgcc

SEQ ID NO: 516213 - DNA, 25 bp, Rattus norvegicus
tagtcaaggacgtcgcagccaaatc

SEQ ID NO: 516214 - DNA, 25 bp, Rattus norvegicus
agcttgatgagaagccgcgcgagca

SEQ ID NO: 516215 - DNA, 25 bp, Rattus norvegicus
agcagtaccgtacgccctctgctgg

SEQ ID NO: 516216 - DNA, 25 bp, Rattus norvegicus
ctcagcaaccggtagcagtaccgta

SEQ ID NO: 516217 - DNA, 25 bp, Rattus norvegicus
accttcgagggctcagcaaccggta

SEQ ID NO: 516218 - DNA, 25 bp, Rattus norvegicus
ctagaccgcgacagtaccttcgagg

SEQ ID NO: 516219 - DNA, 25 bp, Rattus norvegicus
gaagccgcgcgagcatccttgtcgc

SEQ ID NO: 516220 - DNA, 25 bp, Rattus norvegicus
catcggggcggacaaagcttgatga

SEQ ID NO: 516221 - DNA, 25 bp, Rattus norvegicus
tcggcagcttcctgagtgccatcgg

SEQ ID NO: 516222 - DNA, 25 bp, Rattus norvegicus
ctgattcgacctcggcagcttcctg

SEQ ID NO: 516223 - DNA, 25 bp, Rattus norvegicus
taggggccacctctgattcgacctc

SEQ ID NO: 516224 - DNA, 25 bp, Rattus norvegicus
aaggacgtcgcagccaaatctcagc

SEQ ID NO: 516225 - DNA, 25 bp, Rattus norvegicus
tgcttttcttccctagtcaaggacg

SEQ ID NO: 516226 - DNA, 25 bp, Rattus norvegicus
tgtcctcaccgttcaccatgcttcc

SEQ ID NO: 516227 - DNA, 25 bp, Rattus norvegicus
cccgaccgtggcaggctgcttcaag

SEQ ID NO: 516228 - DNA, 25 bp, Rattus norvegicus
gtcgagccaatgaagccgcctctct

SEQ ID NO: 516229 - DNA, 25 bp, Rattus norvegicus
ccagccaggggaaaaccgagcatcc

SEQ ID NO: 516230 - DNA, 25 bp, Rattus norvegicus
tctcgggcactcgagagacttcctc

SEQ ID NO: 516231 - DNA, 25 bp, Rattus norvegicus
agcccaattcacctgttgttacaga

SEQ ID NO: 516232 - DNA, 25 bp, Rattus norvegicus
tgttacagatgtgaaacaagcctcg

SEQ ID NO: 516233 - DNA, 25 bp, Rattus norvegicus
acaagcctcggtgcacggcgcatga

SEQ ID NO: 516234 - DNA, 25 bp, Rattus norvegicus
ctttcgcctagccacctgtgcggga

SEQ ID NO: 516235 - DNA, 25 bp, Rattus norvegicus
acctgtgcgggatgtcgcttcttag

SEQ ID NO: 516236 - DNA, 25 bp, Rattus norvegicus
gtggcctaggttgtctctaatgttc

SEQ ID NO: 516237 - DNA, 25 bp, Rattus norvegicus
tctaatgttcctgagctcacagcgc

SEQ ID NO: 516238 - DNA, 25 bp, Rattus norvegicus
ctcacagcgcgaggcgctcagtctg

SEQ ID NO: 516239 - DNA, 25 bp, Rattus norvegicus
tgtagcctcagacgcaggcgggact

SEQ ID NO: 516240 - DNA, 25 bp, Rattus norvegicus
gaacggtcctgaccgcacagtggga

SEQ ID NO: 516241 - DNA, 25 bp, Rattus norvegicus
cagctcgctcgctcttatatgcaga

SEQ ID NO: 516242 - DNA, 25 bp, Rattus norvegicus
ctctgggcgtagcaggaattgctta

SEQ ID NO: 516243 - DNA, 25 bp, Rattus norvegicus
gaattgcttactagcgctcagggtg

SEQ ID NO: 516244 - DNA, 25 bp, Rattus norvegicus
tgggccctcggctagtacggtataa

SEQ ID NO: 516245 - DNA, 25 bp, Rattus norvegicus
cgtagacggctttctcaaacagtga

SEQ ID NO: 516246 - DNA, 25 bp, Rattus norvegicus
acagtgatacagaacctccttgagg

SEQ ID NO: 516247 - DNA, 25 bp, Rattus norvegicus
cctccttgaggttgttgaccgccta

SEQ ID NO: 516248 - DNA, 25 bp, Rattus norvegicus
tgaccgcctaacgaatagacgaagg

SEQ ID NO: 516249 - DNA, 25 bp, Rattus norvegicus
acgaaggaagcatggggagtcattc

SEQ ID NO: 516250 - DNA, 25 bp, Rattus norvegicus
agtcattcgtggtgtccggcaagag

SEQ ID NO: 516251 - DNA, 25 bp, Rattus norvegicus
agcgcctgtccgttgcagctccagg

SEQ ID NO: 516252 - DNA, 25 bp, Rattus norvegicus
acacgacggacggtgactatggcca

SEQ ID NO: 516253 - DNA, 25 bp, Rattus norvegicus
gctgggcaagcactacaagaaggtg

SEQ ID NO: 516254 - DNA, 25 bp, Rattus norvegicus
gtcccagctagattcggtgcgagtc

SEQ ID NO: 516255 - DNA, 25 bp, Rattus norvegicus
ctccgctctttccacactgggggcg

SEQ ID NO: 516256 - DNA, 25 bp, Rattus norvegicus
tctgactgtcccctggcgaggagga

SEQ ID NO: 516257 - DNA, 25 bp, Rattus norvegicus
cgtgccagaggggtctgactgtccc

SEQ ID NO: 516258 - DNA, 25 bp, Rattus norvegicus
acgtcccgtgccagaggggtctgac

SEQ ID NO: 516259 - DNA, 25 bp, Rattus norvegicus
tctccacgtcccgtgccagaggggt

SEQ ID NO: 516260 - DNA, 25 bp, Rattus norvegicus
gccgcgcgtgcatcgctctccacgt

SEQ ID NO: 516261 - DNA, 25 bp, Rattus norvegicus
cccagtggctctgctaccgcgccgc

SEQ ID NO: 516262 - DNA, 25 bp, Rattus norvegicus
ctgccaacggtgcacctgtcggctt

SEQ ID NO: 516263 - DNA, 25 bp, Rattus norvegicus
gtgggctgccaacggtgcacctgtc

SEQ ID NO: 516264 - DNA, 25 bp, Rattus norvegicus
cgctctcagcattgggagcgcaggc

SEQ ID NO: 516265 - DNA, 25 bp, Rattus norvegicus
gagcgctctcagcattgggagcgca

SEQ ID NO: 516266 - DNA, 25 bp, Rattus norvegicus
ccgagcctgcgggtgtcggagcccg

SEQ ID NO: 516267 - DNA, 25 bp, Rattus norvegicus
tgccaacggtgcacctgtcggcttc

SEQ ID NO: 516268 - DNA, 25 bp, Rattus norvegicus
gttcctcggaggtccgcggcggagc

SEQ ID NO: 516269 - DNA, 25 bp, Rattus norvegicus
cgtgcaagattgcatccgggatctg

SEQ ID NO: 516270 - DNA, 25 bp, Rattus norvegicus
ggagcgagatcacgcacgcgcactt

SEQ ID NO: 516271 - DNA, 25 bp, Rattus norvegicus
cttgggccttcattcttcctgtaga

SEQ ID NO: 516272 - DNA, 25 bp, Rattus norvegicus
caaccctaagcctgattggctgacg

SEQ ID NO: 516273 - DNA, 25 bp, Rattus norvegicus
tgcgcagaatcatcacaaccctaag

SEQ ID NO: 516274 - DNA, 25 bp, Rattus norvegicus
tggctcagctttacgagcatacgtg

SEQ ID NO: 516275 - DNA, 25 bp, Rattus norvegicus
acgcgcactttctcgcgtgcgagca

SEQ ID NO: 516276 - DNA, 25 bp, Rattus norvegicus
cggctgccgtaaaccgagggcatct

SEQ ID NO: 516277 - DNA, 25 bp, Rattus norvegicus
tgcctaaatgaggtatcgctctctg

SEQ ID NO: 516278 - DNA, 25 bp, Rattus norvegicus
acgagaactgcacaattgtccattg

SEQ ID NO: 516279 - DNA, 25 bp, Rattus norvegicus
gtgaatccacacctaacgagaactg

SEQ ID NO: 516280 - DNA, 25 bp, Rattus norvegicus
agggaggatcggcaccaagtgaatc

SEQ ID NO: 516281 - DNA, 25 bp, Rattus norvegicus
actcgctcgctcgtgctaaatcgtg

SEQ ID NO: 516282 - DNA, 25 bp, Rattus norvegicus
catacgtgctcatgcgcttgcgcag

SEQ ID NO: 516283 - DNA, 25 bp, Rattus norvegicus
agggcgttcatttacactcgccata

SEQ ID NO: 516284 - DNA, 25 bp, Rattus norvegicus
ccgaacccggaatagaatgacattt

SEQ ID NO: 516285 - DNA, 25 bp, Rattus norvegicus
tgtcaaatagcctgcaacagcggtt

SEQ ID NO: 516286 - DNA, 25 bp, Rattus norvegicus
cgaggggattagtctggttgtcaaa

SEQ ID NO: 516287 - DNA, 25 bp, Rattus norvegicus
tgcctattcagaagcgaggggatta

SEQ ID NO: 516288 - DNA, 25 bp, Rattus norvegicus
cccacggctcgtgcctattcagaag

SEQ ID NO: 516289 - DNA, 25 bp, Rattus norvegicus
gtgcccacggaagagcagaacctta

SEQ ID NO: 516290 - DNA, 25 bp, Rattus norvegicus
gaatgacatttctttccctgttgcc

SEQ ID NO: 516291 - DNA, 25 bp, Rattus norvegicus
tcgtcgtaccagaccgccgatgttg

SEQ ID NO: 516292 - DNA, 25 bp, Rattus norvegicus
acggcgacgcccttcagagggtaca

SEQ ID NO: 516293 - DNA, 25 bp, Rattus norvegicus
ctcgccatatttatagacactgggg

SEQ ID NO: 516294 - DNA, 25 bp, Rattus norvegicus
gcagaaccttaccttagggcgttca

SEQ ID NO: 516295 - DNA, 25 bp, Rattus norvegicus
tataacgccatggtcagtgcccacg

SEQ ID NO: 516296 - DNA, 25 bp, Rattus norvegicus
cggtggtcgtcaggttataacgcca

SEQ ID NO: 516297 - DNA, 25 bp, Rattus norvegicus
tggcaatgccagactgcgcatgcgc

SEQ ID NO: 516298 - DNA, 25 bp, Rattus norvegicus
cgctggcaatgccagactgcgcatg

SEQ ID NO: 516299 - DNA, 25 bp, Rattus norvegicus
cggtagtgtggcaggggaccaccag

SEQ ID NO: 516300 - DNA, 25 bp, Rattus norvegicus
atgcgcacgccgctggaagcacgtg

SEQ ID NO: 516301 - DNA, 25 bp, Rattus norvegicus
tgcgcacgccgctggaagcacgtgt

SEQ ID NO: 516302 - DNA, 25 bp, Rattus norvegicus
agagggcgggctcgaaacaccggat

SEQ ID NO: 516303 - DNA, 25 bp, Rattus norvegicus
ctcgaaacaccggatcgcgggccag

SEQ ID NO: 516304 - DNA, 25 bp, Rattus norvegicus
cgaaacaccggatcgcgggccagga

SEQ ID NO: 516305 - DNA, 25 bp, Rattus norvegicus
cccgggagctgcctcgccgccacag

SEQ ID NO: 516306 - DNA, 25 bp, Rattus norvegicus
cgggcgtgggcgctgtccagcagcc

SEQ ID NO: 516307 - DNA, 25 bp, Rattus norvegicus
ccagcagccggagggcggctccgga

SEQ ID NO: 516308 - DNA, 25 bp, Rattus norvegicus
ctccggagaccgcagtctggagcgg

SEQ ID NO: 516309 - DNA, 25 bp, Rattus norvegicus
aacccgggccgctggcaatgccaga

SEQ ID NO: 516310 - DNA, 25 bp, Rattus norvegicus
ccgggccgctggcaatgccagactg

SEQ ID NO: 516311 - DNA, 25 bp, Rattus norvegicus
ctcaggagaactgggaaagactgtc

SEQ ID NO: 516312 - DNA, 25 bp, Rattus norvegicus
tcggcgtgtccatggcccttgtcaa

SEQ ID NO: 516313 - DNA, 25 bp, Rattus norvegicus
caccgcctgagacggagatagtgcc

SEQ ID NO: 516314 - DNA, 25 bp, Rattus norvegicus
tggttacgacttcagccgtctggtg

SEQ ID NO: 516315 - DNA, 25 bp, Rattus norvegicus
atgactatggctacgcaccgcctga

SEQ ID NO: 516316 - DNA, 25 bp, Rattus norvegicus
tctttggggaccagccagacctcac

SEQ ID NO: 516317 - DNA, 25 bp, Rattus norvegicus
tgctctgcccgcgaaactacgggca

SEQ ID NO: 516318 - DNA, 25 bp, Rattus norvegicus
ctctgccctcagctcatatcttgtg

SEQ ID NO: 516319 - DNA, 25 bp, Rattus norvegicus
agaccggggactgcctcactcgcat

SEQ ID NO: 516320 - DNA, 25 bp, Rattus norvegicus
ccaagtctgcgtgtgggatgcacag

SEQ ID NO: 516321 - DNA, 25 bp, Rattus norvegicus
cctcacacaggacatcgagtgtctg

SEQ ID NO: 516322 - DNA, 25 bp, Rattus norvegicus
tgtcaacatagcaccctcacacagg

SEQ ID NO: 516323 - DNA, 25 bp, Rattus norvegicus
cggagagctgccttgcgatgactat

SEQ ID NO: 516324 - DNA, 25 bp, Rattus norvegicus
tgtggccgctctagagactctggtt

SEQ ID NO: 516325 - DNA, 25 bp, Rattus norvegicus
gtgtgctcaccttcttcacagcaga

SEQ ID NO: 516326 - DNA, 25 bp, Rattus norvegicus
acgcctggcccgacctgtgacggaa

SEQ ID NO: 516327 - DNA, 25 bp, Rattus norvegicus
gatgcgcatcgaaggtgtgctcacc

SEQ ID NO: 516328 - DNA, 25 bp, Rattus norvegicus
gccatcctaagggaaaacgcctggc

SEQ ID NO: 516329 - DNA, 25 bp, Rattus norvegicus
ttgcacatgcgctgtcctctttgcg

SEQ ID NO: 516330 - DNA, 25 bp, Rattus norvegicus
tcacagcagactggaagtgaaagtc

SEQ ID NO: 516331 - DNA, 25 bp, Rattus norvegicus
aagtgaaagtcaccggcctccttca

SEQ ID NO: 516332 - DNA, 25 bp, Rattus norvegicus
caggtccagccagatcatgggcatc

SEQ ID NO: 516333 - DNA, 25 bp, Rattus norvegicus
gcctccattgcggacagcgcttagc

SEQ ID NO: 516334 - DNA, 25 bp, Rattus norvegicus
ccggaagctgctcgtcacgcggaat

SEQ ID NO: 516335 - DNA, 25 bp, Rattus norvegicus
gcggaatgacgcagcctccacaagg

SEQ ID NO: 516336 - DNA, 25 bp, Rattus norvegicus
cccggtagtcctttgcacatgcgct

SEQ ID NO: 516337 - DNA, 25 bp, Rattus norvegicus
tcctctttgcgcatgctcagtcttc

SEQ ID NO: 516338 - DNA, 25 bp, Rattus norvegicus
gcagacgacggagatgcgcatcgaa

SEQ ID NO: 516339 - DNA, 25 bp, Rattus norvegicus
gtgcagccaccgtactcacaaagtc

SEQ ID NO: 516340 - DNA, 25 bp, Rattus norvegicus
ttcacactaaccagggcggggcaag

SEQ ID NO: 516341 - DNA, 25 bp, Rattus norvegicus
caagggagcacgctgacggcagtcc

SEQ ID NO: 516342 - DNA, 25 bp, Rattus norvegicus
gcacgctgacggcagtccggaacgc

SEQ ID NO: 516343 - DNA, 25 bp, Rattus norvegicus
aagtcctctacaccggaagtctcgc

SEQ ID NO: 516344 - DNA, 25 bp, Rattus norvegicus
gtccggaacgcgaagccagaatctc

SEQ ID NO: 516345 - DNA, 25 bp, Rattus norvegicus
acgcgaagccagaatctcactggcc

SEQ ID NO: 516346 - DNA, 25 bp, Rattus norvegicus
tccgacacggagaaatgcaccaagt

SEQ ID NO: 516347 - DNA, 25 bp, Rattus norvegicus
cgcgactaggcaactccgacacgga

SEQ ID NO: 516348 - DNA, 25 bp, Rattus norvegicus
tccatgacgccgtagccgcgactag

SEQ ID NO: 516349 - DNA, 25 bp, Rattus norvegicus
tggccggcaggcttcacactaacca

SEQ ID NO: 516350 - DNA, 25 bp, Rattus norvegicus
tcacgtcgcatagcttgccctgccg

SEQ ID NO: 516351 - DNA, 25 bp, Rattus norvegicus
gtactcacaaagtcctctacaccgg

SEQ ID NO: 516352 - DNA, 25 bp, Rattus norvegicus
gaaatgcaccaagtcttccagctcc

SEQ ID NO: 516353 - DNA, 25 bp, Rattus norvegicus
gaagcctcaggctaggcccagcttg

SEQ ID NO: 516354 - DNA, 25 bp, Rattus norvegicus
tgggctcccagtgcgtgtctcttta

SEQ ID NO: 516355 - DNA, 25 bp, Rattus norvegicus
tactgttgccgcgtcctcagtcggc

SEQ ID NO: 516356 - DNA, 25 bp, Rattus norvegicus
tctccgagggcttcgaaggatggaa

SEQ ID NO: 516357 - DNA, 25 bp, Rattus norvegicus
agccttcaggccaggctctccgagg

SEQ ID NO: 516358 - DNA, 25 bp, Rattus norvegicus
cgtgtctctttaaggggctgggcct

SEQ ID NO: 516359 - DNA, 25 bp, Rattus norvegicus
tcctcatgaagcagctgccgtcgca

SEQ ID NO: 516360 - DNA, 25 bp, Rattus norvegicus
tgagtaagtctcaggtccgcggcct

SEQ ID NO: 516361 - DNA, 25 bp, Rattus norvegicus
ggcgtcccgagcttctgttgcaaac

SEQ ID NO: 516362 - DNA, 25 bp, Rattus norvegicus
cttctgttgcaaaccgcggtgcata

SEQ ID NO: 516363 - DNA, 25 bp, Rattus norvegicus
tgcatagtcggaggcacccgctaag

SEQ ID NO: 516364 - DNA, 25 bp, Rattus norvegicus
ccgctaaggccaacgccggcgagag

SEQ ID NO: 516365 - DNA, 25 bp, Rattus norvegicus
cgccagctagtataggccgagaatc

SEQ ID NO: 516366 - DNA, 25 bp, Rattus norvegicus
gatttctacgatcccgagcacccga

SEQ ID NO: 516367 - DNA, 25 bp, Rattus norvegicus
gcactaaggcaaacgtggtcgcgta

SEQ ID NO: 516368 - DNA, 25 bp, Rattus norvegicus
ggcggccctgagaacacaggagttc

SEQ ID NO: 516369 - DNA, 25 bp, Rattus norvegicus
caggagttcttacaacgccggccga

SEQ ID NO: 516370 - DNA, 25 bp, Rattus norvegicus
gacctgcagaaggaagccgcactca

SEQ ID NO: 516371 - DNA, 25 bp, Rattus norvegicus
ccgcggccagtaagacgttaaggtg

SEQ ID NO: 516372 - DNA, 25 bp, Rattus norvegicus
actcgggatttggagctacgccttc

SEQ ID NO: 516373 - DNA, 25 bp, Rattus norvegicus
ctgttccgggctttgataccgtgtg

SEQ ID NO: 516374 - DNA, 25 bp, Rattus norvegicus
accgtgtgttttaacctgcagtgca

SEQ ID NO: 516375 - DNA, 25 bp, Rattus norvegicus
cggctcgtaggttgggaaatcctgt

SEQ ID NO: 516376 - DNA, 25 bp, Rattus norvegicus
cgtggtcgcgtagctaaagtgactc

SEQ ID NO: 516377 - DNA, 25 bp, Rattus norvegicus
aagtgactcaggctcgtgaactggc

SEQ ID NO: 516378 - DNA, 25 bp, Rattus norvegicus
tgaactggcctcaaaacgcctggga

SEQ ID NO: 516379 - DNA, 25 bp, Rattus norvegicus
acgcctgggaaaacggaatgcactc

SEQ ID NO: 516380 - DNA, 25 bp, Rattus norvegicus
cagtgcacctttaagggcggcaacc

SEQ ID NO: 516381 - DNA, 25 bp, Rattus norvegicus
tagaacctttctgggcggaccttca

SEQ ID NO: 516382 - DNA, 25 bp, Rattus norvegicus
tgtggctcaactgcagcactaactg

SEQ ID NO: 516383 - DNA, 25 bp, Rattus norvegicus
gatcctcctgcttgttctgaaagta

SEQ ID NO: 516384 - DNA, 25 bp, Rattus norvegicus
gtgggctcatccgaactttccgtga

SEQ ID NO: 516385 - DNA, 25 bp, Rattus norvegicus
tggtggacatccgagagcctgaaac

SEQ ID NO: 516386 - DNA, 25 bp, Rattus norvegicus
ctggagacctcgctacgccgaaacg

SEQ ID NO: 516387 - DNA, 25 bp, Rattus norvegicus
cgcagagaggatcacagggccaatt

SEQ ID NO: 516388 - DNA, 25 bp, Rattus norvegicus
gccgaagtttcgtaggcgagccacc

SEQ ID NO: 516389 - DNA, 25 bp, Rattus norvegicus
cgagcgagcctcacattgaccttgc

SEQ ID NO: 516390 - DNA, 25 bp, Rattus norvegicus
aacttcaccttgagctgcagggtcc

SEQ ID NO: 516391 - DNA, 25 bp, Rattus norvegicus
ttggcagcctgtaggtgagaacttc

SEQ ID NO: 516392 - DNA, 25 bp, Rattus norvegicus
atcgggtagagctagtgcctctgcc

SEQ ID NO: 516393 - DNA, 25 bp, Rattus norvegicus
agcggagtttttggtcccttgcaga

SEQ ID NO: 516394 - DNA, 25 bp, Rattus norvegicus
gggccaatttctcatgcctcgcgga

SEQ ID NO: 516395 - DNA, 25 bp, Rattus norvegicus
ccgcctctcctaggactgtgcaaag

SEQ ID NO: 516396 - DNA, 25 bp, Rattus norvegicus
agcagacactgcgtgcgccaatctg

SEQ ID NO: 516397 - DNA, 25 bp, Rattus norvegicus
ggtctcgctggggacttgcaattca

SEQ ID NO: 516398 - DNA, 25 bp, Rattus norvegicus
gacttgcaattcagcgcgcactcgc

SEQ ID NO: 516399 - DNA, 25 bp, Rattus norvegicus
ttcagcgcgcactcgcgaacgctgt

SEQ ID NO: 516400 - DNA, 25 bp, Rattus norvegicus
cacgtgtgcgcggagctgaagtccc

SEQ ID NO: 516401 - DNA, 25 bp, Rattus norvegicus
acccggacgcaggtgcagcagacac

SEQ ID NO: 516402 - DNA, 25 bp, Rattus norvegicus
ctcacctgcgcgtagtagagcagcc

SEQ ID NO: 516403 - DNA, 25 bp, Rattus norvegicus
tagagcagccacaactcgtagagcc

SEQ ID NO: 516404 - DNA, 25 bp, Rattus norvegicus
tcgtagagccgctccgaggcggcca

SEQ ID NO: 516405 - DNA, 25 bp, Rattus norvegicus
cggccatagcctgaccgggctctgg

SEQ ID NO: 516406 - DNA, 25 bp, Rattus norvegicus
ctgtcgcacttagccaccaaagtct

SEQ ID NO: 516407 - DNA, 25 bp, Rattus norvegicus
cttcctacacttggctgtctgtggc

SEQ ID NO: 516408 - DNA, 25 bp, Rattus norvegicus
cgcctggcttcctacacttggctgt

SEQ ID NO: 516409 - DNA, 25 bp, Rattus norvegicus
ctctccgggagaaaactgggcgcaa

SEQ ID NO: 516410 - DNA, 25 bp, Rattus norvegicus
ggggcctctgaaaagatggcggctg

SEQ ID NO: 516411 - DNA, 25 bp, Rattus norvegicus
ccgcctcgaggaagaggcgctgcga

SEQ ID NO: 516412 - DNA, 25 bp, Rattus norvegicus
gcgctgcgacggaaagaacgactaa

SEQ ID NO: 516413 - DNA, 25 bp, Rattus norvegicus
gaacgactaaaagctctccgggaga

SEQ ID NO: 516414 - DNA, 25 bp, Rattus norvegicus
actacagcgaaagtgcgcgtgcgcg

SEQ ID NO: 516415 - DNA, 25 bp, Rattus norvegicus
cgcaaggtgaggaacatggagagat

SEQ ID NO: 516416 - DNA, 25 bp, Rattus norvegicus
agatgcgggtatggcggccagtgct

SEQ ID NO: 516417 - DNA, 25 bp, Rattus norvegicus
ggccagtgctttgggtcagtgggaa

SEQ ID NO: 516418 - DNA, 25 bp, Rattus norvegicus
tggaggactactagggaaccactac

SEQ ID NO: 516419 - DNA, 25 bp, Rattus norvegicus
ggactactagggaaccactacagcg

SEQ ID NO: 516420 - DNA, 25 bp, Rattus norvegicus
ctagggaaccactacagcgaaagtg

SEQ ID NO: 516421 - DNA, 25 bp, Rattus norvegicus
tgcgacggaaagaacgactaaaagc

SEQ ID NO: 516422 - DNA, 25 bp, Rattus norvegicus
aaccactacagcgaaagtgcgcgtg

SEQ ID NO: 516423 - DNA, 25 bp, Rattus norvegicus
aggggcactcacgtagcctacggcg

SEQ ID NO: 516424 - DNA, 25 bp, Rattus norvegicus
ctcacgtagcctacggcggcagcgg

SEQ ID NO: 516425 - DNA, 25 bp, Rattus norvegicus
gcgcgatgatgtgcaactcttcctc

SEQ ID NO: 516426 - DNA, 25 bp, Rattus norvegicus
gctgtgagccgtaataggggacatc

SEQ ID NO: 516427 - DNA, 25 bp, Rattus norvegicus
ccgtaataggggacatcacgcagcg

SEQ ID NO: 516428 - DNA, 25 bp, Rattus norvegicus
taaacgacaggaacatgtgcatgtg

SEQ ID NO: 516429 - DNA, 25 bp, Rattus norvegicus
tcgcggcgcgcagcataaacgacag

SEQ ID NO: 516430 - DNA, 25 bp, Rattus norvegicus
ccttcacgaagatgctcgcggcgcg

SEQ ID NO: 516431 - DNA, 25 bp, Rattus norvegicus
gagcacagcgtccttcacgaagatg

SEQ ID NO: 516432 - DNA, 25 bp, Rattus norvegicus
agagtagagcacagcgtccttcacg

SEQ ID NO: 516433 - DNA, 25 bp, Rattus norvegicus
atccagcgtgaagccagagtagagc

SEQ ID NO: 516434 - DNA, 25 bp, Rattus norvegicus
tctgtgaggcgctcggcctcatcca

SEQ ID NO: 516435 - DNA, 25 bp, Rattus norvegicus
actcttcctctgtgaggcgctcggc

SEQ ID NO: 516436 - DNA, 25 bp, Rattus norvegicus
gcctgcgggcgtgtgacatcaccgt

SEQ ID NO: 516437 - DNA, 25 bp, Rattus norvegicus
gcttcttcagggctcaaagcaaagc

SEQ ID NO: 516438 - DNA, 25 bp, Rattus norvegicus
aggctcgcagcctggcttcttcagg

SEQ ID NO: 516439 - DNA, 25 bp, Rattus norvegicus
agcgggtgccggtcgtccaccagaa

SEQ ID NO: 516440 - DNA, 25 bp, Rattus norvegicus
cgtccaccagaacgcgacacaaagg

SEQ ID NO: 516441 - DNA, 25 bp, Rattus norvegicus
cgacacaaaggtctccttgtgggtc

SEQ ID NO: 516442 - DNA, 25 bp, Rattus norvegicus
gagcaccgagcctccgggtgactca

SEQ ID NO: 516443 - DNA, 25 bp, Rattus norvegicus
ttgccatttcctttgtgcgtcctgc

SEQ ID NO: 516444 - DNA, 25 bp, Rattus norvegicus
ccgccgagcgctttcatgtgggcag

SEQ ID NO: 516445 - DNA, 25 bp, Rattus norvegicus
cccagcaggcgttgctctgctgctg

SEQ ID NO: 516446 - DNA, 25 bp, Rattus norvegicus
tcagctgcggagcaacaggctcgca

SEQ ID NO: 516447 - DNA, 25 bp, Rattus norvegicus
agcacccgcccttggggatgcatgt

SEQ ID NO: 516448 - DNA, 25 bp, Rattus norvegicus
tgctctgctgctggtctcctccgag

SEQ ID NO: 516449 - DNA, 25 bp, Rattus norvegicus
gcgtgtccttgtggaaaagtgaaaa

SEQ ID NO: 516450 - DNA, 25 bp, Rattus norvegicus
gcgcacagcctagctggatcagctg

SEQ ID NO: 516451 - DNA, 25 bp, Rattus norvegicus
agaagttaattgaccgcgtctcttg

SEQ ID NO: 516452 - DNA, 25 bp, Rattus norvegicus
tgcctgagcacacgctgtctggcca

SEQ ID NO: 516453 - DNA, 25 bp, Rattus norvegicus
cgtgcgtgtgactgcctgagcacac

SEQ ID NO: 516454 - DNA, 25 bp, Rattus norvegicus
cgctagcgtctttgcgcgtgcgtgt

SEQ ID NO: 516455 - DNA, 25 bp, Rattus norvegicus
ttttacttagcagaggcgcgctagc

SEQ ID NO: 516456 - DNA, 25 bp, Rattus norvegicus
cgcagagttttgctggttttactta

SEQ ID NO: 516457 - DNA, 25 bp, Rattus norvegicus
gtctccaattggctgcgcagagttt

SEQ ID NO: 516458 - DNA, 25 bp, Rattus norvegicus
ctttcaggccaaggagtctccaatt

SEQ ID NO: 516459 - DNA, 25 bp, Rattus norvegicus
accgcgtctcttggcggcagctgct

SEQ ID NO: 516460 - DNA, 25 bp, Rattus norvegicus
ccggctgcagggagaagttaattga

SEQ ID NO: 516461 - DNA, 25 bp, Rattus norvegicus
acgcagagaacttggaggcctggaa

SEQ ID NO: 516462 - DNA, 25 bp, Rattus norvegicus
tggagctacgagacgcagagaactt

SEQ ID NO: 516463 - DNA, 25 bp, Rattus norvegicus
gcaagcccacgcctggccgtgtagg

SEQ ID NO: 516464 - DNA, 25 bp, Rattus norvegicus
cagctgctcgggctttcaggccaag

SEQ ID NO: 516465 - DNA, 25 bp, Rattus norvegicus
acgtctgcttgtcagtcggtcctta

SEQ ID NO: 516466 - DNA, 25 bp, Rattus norvegicus
gggcgaccaggctgttatttttagc

SEQ ID NO: 516467 - DNA, 25 bp, Rattus norvegicus
cgagagaacgaaccggcgcaatgga

SEQ ID NO: 516468 - DNA, 25 bp, Rattus norvegicus
tgcctcggagcggagaaatcacatc

SEQ ID NO: 516469 - DNA, 25 bp, Rattus norvegicus
aaatcacatccatatggctgggccc

SEQ ID NO: 516470 - DNA, 25 bp, Rattus norvegicus
aactgggagccgtggcttcgctcca

SEQ ID NO: 516471 - DNA, 25 bp, Rattus norvegicus
actgagccctttggcgttcctgccg

SEQ ID NO: 516472 - DNA, 25 bp, Rattus norvegicus
ggggatgccatcctgacttttgcaa

SEQ ID NO: 516473 - DNA, 25 bp, Rattus norvegicus
cttttgcaacgacactgagcccttt

SEQ ID NO: 516474 - DNA, 25 bp, Rattus norvegicus
cgacgctgaggctgcacgtctgctt

SEQ ID NO: 516475 - DNA, 25 bp, Rattus norvegicus
ttccaaaaaagccaccgaactgagc

SEQ ID NO: 516476 - DNA, 25 bp, Rattus norvegicus
tggcgactccacagggctccgagga

SEQ ID NO: 516477 - DNA, 25 bp, Rattus norvegicus
cgcagactgacacggagacggagca

SEQ ID NO: 516478 - DNA, 25 bp, Rattus norvegicus
ttatttttagctccgcggcagtggg

SEQ ID NO: 516479 - DNA, 25 bp, Rattus norvegicus
gtcttagttccatccgctccgggtc

SEQ ID NO: 516480 - DNA, 25 bp, Rattus norvegicus
cctggcttttcagagaccttggccg

SEQ ID NO: 516481 - DNA, 25 bp, Rattus norvegicus
ccctggctgacctcatggggatgac

SEQ ID NO: 516482 - DNA, 25 bp, Rattus norvegicus
tgaccaccgcctgtttttaataagc

SEQ ID NO: 516483 - DNA, 25 bp, Rattus norvegicus
ctcttggcacaaacacccgagtttc

SEQ ID NO: 516484 - DNA, 25 bp, Rattus norvegicus
acgacccttggctgctcggcggaat

SEQ ID NO: 516485 - DNA, 25 bp, Rattus norvegicus
gtcgcctggctgtcttagttccatc

SEQ ID NO: 516486 - DNA, 25 bp, Rattus norvegicus
cccggtggcatctctgcttttcatc

SEQ ID NO: 516487 - DNA, 25 bp, Rattus norvegicus
taaccagctccagatgcggcgagcg

SEQ ID NO: 516488 - DNA, 25 bp, Rattus norvegicus
gcttctgtgtggagtccgcttagca

SEQ ID NO: 516489 - DNA, 25 bp, Rattus norvegicus
cgccagcgacacaacactgcagttt

SEQ ID NO: 516490 - DNA, 25 bp, Rattus norvegicus
ctcgtgttctcaggccgtccgatag

SEQ ID NO: 516491 - DNA, 25 bp, Rattus norvegicus
gtccgatagggtcctgcagctctcc

SEQ ID NO: 516492 - DNA, 25 bp, Rattus norvegicus
cagctctttctcctcttggcacaaa

SEQ ID NO: 516493 - DNA, 25 bp, Rattus norvegicus
ctggctcttgctgcttcagacgcga

SEQ ID NO: 516494 - DNA, 25 bp, Rattus norvegicus
ttctcctctcccgtcagagaatggc

SEQ ID NO: 516495 - DNA, 25 bp, Rattus norvegicus
agggacgctaccgtctctttctcct

SEQ ID NO: 516496 - DNA, 25 bp, Rattus norvegicus
ttccagggacgctaccgtctctttc

SEQ ID NO: 516497 - DNA, 25 bp, Rattus norvegicus
atggttccagggacgctaccgtctc

SEQ ID NO: 516498 - DNA, 25 bp, Rattus norvegicus
ccctatggttccagggacgctaccg

SEQ ID NO: 516499 - DNA, 25 bp, Rattus norvegicus
cttgctgcttcagacgcgattgggc

SEQ ID NO: 516500 - DNA, 25 bp, Rattus norvegicus
tcttggtctggctcttgctgcttca

SEQ ID NO: 516501 - DNA, 25 bp, Rattus norvegicus
tccgcctcttggtctggctcttgct

SEQ ID NO: 516502 - DNA, 25 bp, Rattus norvegicus
ggctgtgactccctccgcctcttgg

SEQ ID NO: 516503 - DNA, 25 bp, Rattus norvegicus
gcgtagccaaggcaaccgccgcgag

SEQ ID NO: 516504 - DNA, 25 bp, Rattus norvegicus
gtttccggtgcgtagccaaggcaac

SEQ ID NO: 516505 - DNA, 25 bp, Rattus norvegicus
cgcccgtttccggtgcgtagccaag

SEQ ID NO: 516506 - DNA, 25 bp, Rattus norvegicus
cttcagacgcgattgggcaaagccc

SEQ ID NO: 516507 - DNA, 25 bp, Rattus norvegicus
acgcaggctgggcaccagagcgcca

SEQ ID NO: 516508 - DNA, 25 bp, Rattus norvegicus
cacaggctgcttggccgcaggagaa

SEQ ID NO: 516509 - DNA, 25 bp, Rattus norvegicus
gctcgtgaccttccacaggctgctt

SEQ ID NO: 516510 - DNA, 25 bp, Rattus norvegicus
tggccgcctctgacccgctcgtgac

SEQ ID NO: 516511 - DNA, 25 bp, Rattus norvegicus
ccagcgccctccctagtacgcccac

SEQ ID NO: 516512 - DNA, 25 bp, Rattus norvegicus
ctgctcctgcctcggcggccagcag

SEQ ID NO: 516513 - DNA, 25 bp, Rattus norvegicus
ggccctcagggtcccggtgtgcctg

SEQ ID NO: 516514 - DNA, 25 bp, Rattus norvegicus
ttgtggaggaacctagcggcgcaat

SEQ ID NO: 516515 - DNA, 25 bp, Rattus norvegicus
ccagagcgccatgaggcgcccgatg

SEQ ID NO: 516516 - DNA, 25 bp, Rattus norvegicus
cgacgctgtccaccgcagtcccgac

SEQ ID NO: 516517 - DNA, 25 bp, Rattus norvegicus
agcgtaccagcgcatgccatccagg

SEQ ID NO: 516518 - DNA, 25 bp, Rattus norvegicus
cctttggcgggagcgtaccagcgca

SEQ ID NO: 516519 - DNA, 25 bp, Rattus norvegicus
cgccattgtggaggaacctagcggc

SEQ ID NO: 516520 - DNA, 25 bp, Rattus norvegicus
tcgtgaccttccacaggctgcttgg

SEQ ID NO: 516521 - DNA, 25 bp, Rattus norvegicus
tgcgaggcgacacccgccaggcaag

SEQ ID NO: 516522 - DNA, 25 bp, Rattus norvegicus
atcccgagccctccgtgatgcgatg

SEQ ID NO: 516523 - DNA, 25 bp, Rattus norvegicus
tccgtgatgcgatgcctcacctcta

SEQ ID NO: 516524 - DNA, 25 bp, Rattus norvegicus
ctcacctctaccagctgcgaggcga

SEQ ID NO: 516525 - DNA, 25 bp, Rattus norvegicus
tgcctggacggtgccatcatcccga

SEQ ID NO: 516526 - DNA, 25 bp, Rattus norvegicus
ggccatgttctcctgtttgccgcgg

SEQ ID NO: 516527 - DNA, 25 bp, Rattus norvegicus
gttctcctgtttgccgcgggctccg

SEQ ID NO: 516528 - DNA, 25 bp, Rattus norvegicus
cgcgggctccgctacaggtcctgag

SEQ ID NO: 516529 - DNA, 25 bp, Rattus norvegicus
gggctgatgcacagagctaccaggt

SEQ ID NO: 516530 - DNA, 25 bp, Rattus norvegicus
tgcacagagctaccaggtgactgcc

SEQ ID NO: 516531 - DNA, 25 bp, Rattus norvegicus
cgggcggttgagtccgcatcattta

SEQ ID NO: 516532 - DNA, 25 bp, Rattus norvegicus
ccgcatcatttattcatcttgggtg

SEQ ID NO: 516533 - DNA, 25 bp, Rattus norvegicus
attcatcttgggtgtcaggttcccg

SEQ ID NO: 516534 - DNA, 25 bp, Rattus norvegicus
tgatgcgatgcctcacctctaccag

SEQ ID NO: 516535 - DNA, 25 bp, Rattus norvegicus
agccgtccatcttcgggctcagctt

SEQ ID NO: 516536 - DNA, 25 bp, Rattus norvegicus
taagaggcgaaaagacagcctgggt

SEQ ID NO: 516537 - DNA, 25 bp, Rattus norvegicus
agagttgtttgcttagggacattcc

SEQ ID NO: 516538 - DNA, 25 bp, Rattus norvegicus
ttgcttagggacattccgaggccgc

SEQ ID NO: 516539 - DNA, 25 bp, Rattus norvegicus
cttagggacattccgaggccgcgcc

SEQ ID NO: 516540 - DNA, 25 bp, Rattus norvegicus
cccgcgcgagcaacacctcggggcg

SEQ ID NO: 516541 - DNA, 25 bp, Rattus norvegicus
gctgccatggtcacgagccgtccat

SEQ ID NO: 516542 - DNA, 25 bp, Rattus norvegicus
acccagctccggtttaaacgcagcg

SEQ ID NO: 516543 - DNA, 25 bp, Rattus norvegicus
agctccggtttaaacgcagcgcggg

SEQ ID NO: 516544 - DNA, 25 bp, Rattus norvegicus
acgcagcgcggggtccaacacgtag

SEQ ID NO: 516545 - DNA, 25 bp, Rattus norvegicus
aacacgtagcagcagtgcggagtgc

SEQ ID NO: 516546 - DNA, 25 bp, Rattus norvegicus
ggggtccaacacgtagcagcagtgc

SEQ ID NO: 516547 - DNA, 25 bp, Rattus norvegicus
ttttcgaagtctggcgggagaggct

SEQ ID NO: 516548 - DNA, 25 bp, Rattus norvegicus
tccgggtcccgtggacacccagctc

SEQ ID NO: 516549 - DNA, 25 bp, Rattus norvegicus
cagcccagatcagctggcgcgcgcc

SEQ ID NO: 516550 - DNA, 25 bp, Rattus norvegicus
tgcgcagccaccaatgcgcatgggc

SEQ ID NO: 516551 - DNA, 25 bp, Rattus norvegicus
agtatgagtgcgcagccaccaatgc

SEQ ID NO: 516552 - DNA, 25 bp, Rattus norvegicus
tggcgagtatgagtgcgcagccacc

SEQ ID NO: 516553 - DNA, 25 bp, Rattus norvegicus
ccatgggcagccatggtggcgagta

SEQ ID NO: 516554 - DNA, 25 bp, Rattus norvegicus
agcaacaacagcacgctgagcgtgg

SEQ ID NO: 516555 - DNA, 25 bp, Rattus norvegicus
acttcactctgacctgccgtgcaga

SEQ ID NO: 516556 - DNA, 25 bp, Rattus norvegicus
cgggagctctcaacctcggtctctc

SEQ ID NO: 516557 - DNA, 25 bp, Rattus norvegicus
ggcctggcggaaacttcactctgac

SEQ ID NO: 516558 - DNA, 25 bp, Rattus norvegicus
gacctgccgtgcagaggcctggcct

SEQ ID NO: 516559 - DNA, 25 bp, Rattus norvegicus
caagcgtgcggcctggcggaaactt

SEQ ID NO: 516560 - DNA, 25 bp, Rattus norvegicus
ggaaacttcactctgacctgccgtg

SEQ ID NO: 516561 - DNA, 25 bp, Rattus norvegicus
acgcacggcgcatcacggtgcgcgt

SEQ ID NO: 516562 - DNA, 25 bp, Rattus norvegicus
tctccagcaacaacagcacgctgag

SEQ ID NO: 516563 - DNA, 25 bp, Rattus norvegicus
ggtgttcttcgtgcggctgtaaaca

SEQ ID NO: 516564 - DNA, 25 bp, Rattus norvegicus
acaggcacggtagcccttccgcagg

SEQ ID NO: 516565 - DNA, 25 bp, Rattus norvegicus
cttcgaaaacggattacagcgtggc

SEQ ID NO: 516566 - DNA, 25 bp, Rattus norvegicus
aaacggattacagcgtggcggcttg

SEQ ID NO: 516567 - DNA, 25 bp, Rattus norvegicus
ttgcgaccagggactgactgtcagc

SEQ ID NO: 516568 - DNA, 25 bp, Rattus norvegicus
ggactgactgtcagcgcccactagc

SEQ ID NO: 516569 - DNA, 25 bp, Rattus norvegicus
tgtcagcgcccactagcacagggaa

SEQ ID NO: 516570 - DNA, 25 bp, Rattus norvegicus
cccactagcacagggaaggtgagtg

SEQ ID NO: 516571 - DNA, 25 bp, Rattus norvegicus
agcgccggtcttgcgactgcgcaga

SEQ ID NO: 516572 - DNA, 25 bp, Rattus norvegicus
cttgcgactgcgcagaagctgagta

SEQ ID NO: 516573 - DNA, 25 bp, Rattus norvegicus
tgctgagcccgcgttgtgcgctttg

SEQ ID NO: 516574 - DNA, 25 bp, Rattus norvegicus
gtgcgctttggctgtttacgtcacc

SEQ ID NO: 516575 - DNA, 25 bp, Rattus norvegicus
tggctgtttacgtcaccaggtgtgc

SEQ ID NO: 516576 - DNA, 25 bp, Rattus norvegicus
ggctgtaaacagcttcgaaaacgga

SEQ ID NO: 516577 - DNA, 25 bp, Rattus norvegicus
agattagtaatggtgtttcggtatt

SEQ ID NO: 516578 - DNA, 25 bp, Rattus norvegicus
ccagaggcaggctaaagggcgaaac

SEQ ID NO: 516579 - DNA, 25 bp, Rattus norvegicus
ttcaacggaaagcaaagtgtccaga

SEQ ID NO: 516580 - DNA, 25 bp, Rattus norvegicus
gcagagcgtcacttcaacggaaagc

SEQ ID NO: 516581 - DNA, 25 bp, Rattus norvegicus
ttggtctcagcagagcgtcacttca

SEQ ID NO: 516582 - DNA, 25 bp, Rattus norvegicus
cgtttttatcattggtctcagcaga

SEQ ID NO: 516583 - DNA, 25 bp, Rattus norvegicus
tgaggcccgagcgtttttatcattg

SEQ ID NO: 516584 - DNA, 25 bp, Rattus norvegicus
cgaatgaggcccgagcgtttttatc

SEQ ID NO: 516585 - DNA, 25 bp, Rattus norvegicus
gcaaagtgtccagaggcaggctaaa

SEQ ID NO: 516586 - DNA, 25 bp, Rattus norvegicus
ggtattttcgcctttcgcctgccgc

SEQ ID NO: 516587 - DNA, 25 bp, Rattus norvegicus
aggcaggctaaagggcgaaacgtct

SEQ ID NO: 516588 - DNA, 25 bp, Rattus norvegicus
cactcacggaaagtgggaagaggaa

SEQ ID NO: 516589 - DNA, 25 bp, Rattus norvegicus
cacgcgcacactcacggaaagtggg

SEQ ID NO: 516590 - DNA, 25 bp, Rattus norvegicus
tcgcctgccgcggttcgaatgaggc

SEQ ID NO: 516591 - DNA, 25 bp, Rattus norvegicus
tccgggtacttaaacattcgcgaga

SEQ ID NO: 516592 - DNA, 25 bp, Rattus norvegicus
caagggcatagagcagccgccgagt

SEQ ID NO: 516593 - DNA, 25 bp, Rattus norvegicus
gggtcggtcacctgcacattcagga

SEQ ID NO: 516594 - DNA, 25 bp, Rattus norvegicus
ttcgcgagaattctcaaagagctcc

SEQ ID NO: 516595 - DNA, 25 bp, Rattus norvegicus
agcggccctcagcaacaagggcata

SEQ ID NO: 516596 - DNA, 25 bp, Rattus norvegicus
tggacttccgcaagatccggctggg

SEQ ID NO: 516597 - DNA, 25 bp, Rattus norvegicus
tcaggaagtagtgatgggtcaaccc

SEQ ID NO: 516598 - DNA, 25 bp, Rattus norvegicus
agaccacacacaggcgccgagacgg

SEQ ID NO: 516599 - DNA, 25 bp, Rattus norvegicus
tgctccagcaatgacccaggaagcg

SEQ ID NO: 516600 - DNA, 25 bp, Rattus norvegicus
cgagtccctcccaatggcgcatgga

SEQ ID NO: 516601 - DNA, 25 bp, Rattus norvegicus
acaggaacgctaggcaggctgcaca

SEQ ID NO: 516602 - DNA, 25 bp, Rattus norvegicus
ctgcacaaatgtgccgcggataacg

SEQ ID NO: 516603 - DNA, 25 bp, Rattus norvegicus
acataacggggccaggtcgcaggcc

SEQ ID NO: 516604 - DNA, 25 bp, Rattus norvegicus
gatggcccagaacgtgacataacgg

SEQ ID NO: 516605 - DNA, 25 bp, Rattus norvegicus
cctcgatggtggaaaaactctgggc

SEQ ID NO: 516606 - DNA, 25 bp, Rattus norvegicus
gcatttacaggttgttacaaatgtt

SEQ ID NO: 516607 - DNA, 25 bp, Rattus norvegicus
cccatggaagttgatgttaagattc

SEQ ID NO: 516608 - DNA, 25 bp, Rattus norvegicus
ctgcacctcagtaccccatggaagt

SEQ ID NO: 516609 - DNA, 25 bp, Rattus norvegicus
gttgatgttaagattctgctctgtg

SEQ ID NO: 516610 - DNA, 25 bp, Rattus norvegicus
tgttaagattctgctctgtgcattt

SEQ ID NO: 516611 - DNA, 25 bp, Rattus norvegicus
tgacgcgggcttgccgtcctcagat

SEQ ID NO: 516612 - DNA, 25 bp, Rattus norvegicus
ggcttgccgtcctcagatcgtgttt

SEQ ID NO: 516613 - DNA, 25 bp, Rattus norvegicus
tgccgtcctcagatcgtgtttctca

SEQ ID NO: 516614 - DNA, 25 bp, Rattus norvegicus
cccaaggagtcgaacaccgtgttcg

SEQ ID NO: 516615 - DNA, 25 bp, Rattus norvegicus
ctcctcgatggtggaaaaactctgg

SEQ ID NO: 516616 - DNA, 25 bp, Rattus norvegicus
tatgtctctctgagttgtaaaaata

SEQ ID NO: 516617 - DNA, 25 bp, Rattus norvegicus
acaaggacggccagctcctcgatgg

SEQ ID NO: 516618 - DNA, 25 bp, Rattus norvegicus
gctgtcttttatcccccactaggtc

SEQ ID NO: 516619 - DNA, 25 bp, Rattus norvegicus
gctcatcccgggttgcgttcgccgt

SEQ ID NO: 516620 - DNA, 25 bp, Rattus norvegicus
tcagtacggttacgaaacgctcgga

SEQ ID NO: 516621 - DNA, 25 bp, Rattus norvegicus
aggcgctccgcggtccagccagtaa

SEQ ID NO: 516622 - DNA, 25 bp, Rattus norvegicus
aacgctcggataccagcgctcggga

SEQ ID NO: 516623 - DNA, 25 bp, Rattus norvegicus
atcatctggtgcgagccaggcgctc

SEQ ID NO: 516624 - DNA, 25 bp, Rattus norvegicus
gccacaactacttccgggtgagcgg

SEQ ID NO: 516625 - DNA, 25 bp, Rattus norvegicus
gaagccacctggttcagtacggtta

SEQ ID NO: 516626 - DNA, 25 bp, Rattus norvegicus
tgtgactacacggtcgtccgcagcg

SEQ ID NO: 516627 - DNA, 25 bp, Rattus norvegicus
aagggcgccctgagtgtgactacac

SEQ ID NO: 516628 - DNA, 25 bp, Rattus norvegicus
caccagaccgtttagaagccacctg

SEQ ID NO: 516629 - DNA, 25 bp, Rattus norvegicus
ctgtcagccgctccatcatctggtg

SEQ ID NO: 516630 - DNA, 25 bp, Rattus norvegicus
gagggtctccggctagcttctcccg

SEQ ID NO: 516631 - DNA, 25 bp, Rattus norvegicus
catcacttgggacagctgggtgctc

SEQ ID NO: 516632 - DNA, 25 bp, Rattus norvegicus
ccgcgccacacgcaggtaagggcag

SEQ ID NO: 516633 - DNA, 25 bp, Rattus norvegicus
atcgcctcttacgtcagttcctggg

SEQ ID NO: 516634 - DNA, 25 bp, Rattus norvegicus
tggggtatctgttccgccctaaaca

SEQ ID NO: 516635 - DNA, 25 bp, Rattus norvegicus
tatcccttggcctccgcagaatgtg

SEQ ID NO: 516636 - DNA, 25 bp, Rattus norvegicus
cgcttgcgcgtcaaagttcacggtc

SEQ ID NO: 516637 - DNA, 25 bp, Rattus norvegicus
ccttcccagcggcaagtgctgattg

SEQ ID NO: 516638 - DNA, 25 bp, Rattus norvegicus
tcggctcctcaagcgcaagttcttc

SEQ ID NO: 516639 - DNA, 25 bp, Rattus norvegicus
gctccctgcatggtagccgactgca

SEQ ID NO: 516640 - DNA, 25 bp, Rattus norvegicus
acggtccgctcttcctattggctca

SEQ ID NO: 516641 - DNA, 25 bp, Rattus norvegicus
ctggataacttctcccgccgctatg

SEQ ID NO: 516642 - DNA, 25 bp, Rattus norvegicus
ggcgccgaataactcctgctacaaa

SEQ ID NO: 516643 - DNA, 25 bp, Rattus norvegicus
ctctttgatagcattggccggccgc

SEQ ID NO: 516644 - DNA, 25 bp, Rattus norvegicus
ggcgcccgattttgccatcagccaa

SEQ ID NO: 516645 - DNA, 25 bp, Rattus norvegicus
gcctctactcgggaacgcgacgtga

SEQ ID NO: 516646 - DNA, 25 bp, Rattus norvegicus
gcgccactacgaagccgaacacgaa

SEQ ID NO: 516647 - DNA, 25 bp, Rattus norvegicus
tttccgaaagcctcggagcgacctc

SEQ ID NO: 516648 - DNA, 25 bp, Rattus norvegicus
cacaacctggctcgaggtgtgcgaa

SEQ ID NO: 516649 - DNA, 25 bp, Rattus norvegicus
ccattctccggagggagcctctcag

SEQ ID NO: 516650 - DNA, 25 bp, Rattus norvegicus
gggcctcagtgtcacctgcgcgcat

SEQ ID NO: 516651 - DNA, 25 bp, Rattus norvegicus
ggaacacggactcggcctgcgctgc

SEQ ID NO: 516652 - DNA, 25 bp, Rattus norvegicus
ccgcagccgcgtgggaacacggact

SEQ ID NO: 516653 - DNA, 25 bp, Rattus norvegicus
accaggcgatacgtgacggccctcg

SEQ ID NO: 516654 - DNA, 25 bp, Rattus norvegicus
tcctcggagcaaaggcgacaccttc

SEQ ID NO: 516655 - DNA, 25 bp, Rattus norvegicus
ggacgggacactctcctcggagcaa

SEQ ID NO: 516656 - DNA, 25 bp, Rattus norvegicus
gcctccgaggagacgcagctcgaga

SEQ ID NO: 516657 - DNA, 25 bp, Rattus norvegicus
cttgccgagcgatggcttccaggac

SEQ ID NO: 516658 - DNA, 25 bp, Rattus norvegicus
gcctccgcgagcttgccgagcgatg

SEQ ID NO: 516659 - DNA, 25 bp, Rattus norvegicus
acgagcgtcgcgcagctcggagctt

SEQ ID NO: 516660 - DNA, 25 bp, Rattus norvegicus
cccgcgtgacaggaactcggcatga

SEQ ID NO: 516661 - DNA, 25 bp, Rattus norvegicus
gcagcaaccaaagggaagaggagac

SEQ ID NO: 516662 - DNA, 25 bp, Rattus norvegicus
ctcgggtaagtaccctcggtgactg

SEQ ID NO: 516663 - DNA, 25 bp, Rattus norvegicus
ccctgcgcctgctatctcgggtaag

SEQ ID NO: 516664 - DNA, 25 bp, Rattus norvegicus
agccaggccgctagccatgccagcc

SEQ ID NO: 516665 - DNA, 25 bp, Rattus norvegicus
ggagctgctacctgcagccaggccg

SEQ ID NO: 516666 - DNA, 25 bp, Rattus norvegicus
gcagcgcggttgtcaggctccctct

SEQ ID NO: 516667 - DNA, 25 bp, Rattus norvegicus
cctctggggagaccgtccttgcgct

SEQ ID NO: 516668 - DNA, 25 bp, Rattus norvegicus
ctgcggccagcagcaaccaaaggga

SEQ ID NO: 516669 - DNA, 25 bp, Rattus norvegicus
tcaggctccctctggggagaccgtc

SEQ ID NO: 516670 - DNA, 25 bp, Rattus norvegicus
ggccaggtcccggagctgctacctg

SEQ ID NO: 516671 - DNA, 25 bp, Rattus norvegicus
ctctgtgcagcaagtagttagtccc

SEQ ID NO: 516672 - DNA, 25 bp, Rattus norvegicus
cgcctgctatctcgggtaagtaccc

SEQ ID NO: 516673 - DNA, 25 bp, Rattus norvegicus
agccgctctgtgcagcaagtagtta

SEQ ID NO: 516674 - DNA, 25 bp, Rattus norvegicus
cgtccttgcgctgtggctgcggcca

SEQ ID NO: 516675 - DNA, 25 bp, Rattus norvegicus
gcgccacttggagggatcatcttgg

SEQ ID NO: 516676 - DNA, 25 bp, Rattus norvegicus
ctccgacagtgtgggagatcagctc

SEQ ID NO: 516677 - DNA, 25 bp, Rattus norvegicus
gcgcccactccgacagtgtgggaga

SEQ ID NO: 516678 - DNA, 25 bp, Rattus norvegicus
tgcgcgcctctagtcgtgactgccg

SEQ ID NO: 516679 - DNA, 25 bp, Rattus norvegicus
agattgcgcgcctctagtcgtgact

SEQ ID NO: 516680 - DNA, 25 bp, Rattus norvegicus
ctgtggccacctcgctggagattgc

SEQ ID NO: 516681 - DNA, 25 bp, Rattus norvegicus
cccgggatgtccatcgtgccaggcg

SEQ ID NO: 516682 - DNA, 25 bp, Rattus norvegicus
ttgctcgctcgctcagtgccgtgtc

SEQ ID NO: 516683 - DNA, 25 bp, Rattus norvegicus
gttcgctcgacttcttgctcgctcg

SEQ ID NO: 516684 - DNA, 25 bp, Rattus norvegicus
taccttggattccaggctgctggtg

SEQ ID NO: 516685 - DNA, 25 bp, Rattus norvegicus
agggatcatcttggccgcgggaact

SEQ ID NO: 516686 - DNA, 25 bp, Rattus norvegicus
gcggctgctctgtgccggttgcctc

SEQ ID NO: 516687 - DNA, 25 bp, Rattus norvegicus
tgtgggagatcagctctgagcgccc

SEQ ID NO: 516688 - DNA, 25 bp, Rattus norvegicus
gggaaccgcaggttcgctcgacttc

SEQ ID NO: 516689 - DNA, 25 bp, Rattus norvegicus
ctgctagagagcctgtatgtcactc

SEQ ID NO: 516690 - DNA, 25 bp, Rattus norvegicus
gcacagcgctggtggggaacgcgtg

SEQ ID NO: 516691 - DNA, 25 bp, Rattus norvegicus
acgcgtggctgcgactgcccggact

SEQ ID NO: 516692 - DNA, 25 bp, Rattus norvegicus
cgtggctgcgactgcccggactgtc

SEQ ID NO: 516693 - DNA, 25 bp, Rattus norvegicus
cgactgcccggactgtcgccgctcc

SEQ ID NO: 516694 - DNA, 25 bp, Rattus norvegicus
aggtcgtcgctgctagagagcctgt

SEQ ID NO: 516695 - DNA, 25 bp, Rattus norvegicus
tcgctgctagagagcctgtatgtca

SEQ ID NO: 516696 - DNA, 25 bp, Rattus norvegicus
gctagagagcctgtatgtcactcca

SEQ ID NO: 516697 - DNA, 25 bp, Rattus norvegicus
tagagagcctgtatgtcactccagg

SEQ ID NO: 516698 - DNA, 25 bp, Rattus norvegicus
agagcctgtatgtcactccaggctg

SEQ ID NO: 516699 - DNA, 25 bp, Rattus norvegicus
cctgtatgtcactccaggctgttga

SEQ ID NO: 516700 - DNA, 25 bp, Rattus norvegicus
tgtatgtcactccaggctgttgagc

SEQ ID NO: 516701 - DNA, 25 bp, Rattus norvegicus
gtatgtcactccaggctgttgagct

SEQ ID NO: 516702 - DNA, 25 bp, Rattus norvegicus
tcgtcgctgctagagagcctgtatg

SEQ ID NO: 516703 - DNA, 25 bp, Rattus norvegicus
ggagcccgcagtgtctcggatactt

SEQ ID NO: 516704 - DNA, 25 bp, Rattus norvegicus
caggctgttgagctcctgtctattt

SEQ ID NO: 516705 - DNA, 25 bp, Rattus norvegicus
tcggatactttgctactttgcgctc

SEQ ID NO: 516706 - DNA, 25 bp, Rattus norvegicus
gcccgcagtgtctcggatactttgc

SEQ ID NO: 516707 - DNA, 25 bp, Rattus norvegicus
actttgctactttgcgctccggcca

SEQ ID NO: 516708 - DNA, 25 bp, Rattus norvegicus
tcccgccagcaatgcggggagcccg

SEQ ID NO: 516709 - DNA, 25 bp, Rattus norvegicus
gccagtccttgcgctgatctgtccg

SEQ ID NO: 516710 - DNA, 25 bp, Rattus norvegicus
gtaggcaccgtctcctgcagccagt

SEQ ID NO: 516711 - DNA, 25 bp, Rattus norvegicus
tccggagtaggcaccgtctcctgca

SEQ ID NO: 516712 - DNA, 25 bp, Rattus norvegicus
tgatgtccaggttttgctccgctcc

SEQ ID NO: 516713 - DNA, 25 bp, Rattus norvegicus
ctcctgtctatttgcctgtctgtca

SEQ ID NO: 516714 - DNA, 25 bp, Rattus norvegicus
tgttgagctcctgtctatttgcctg

SEQ ID NO: 516715 - DNA, 25 bp, Rattus norvegicus
gagctcctgtctatttgcctgtctg

SEQ ID NO: 516716 - DNA, 25 bp, Rattus norvegicus
gtgtctcggatactttgctactttg

SEQ ID NO: 516717 - DNA, 25 bp, Rattus norvegicus
gctggagacaaagcgcatgagccac

SEQ ID NO: 516718 - DNA, 25 bp, Rattus norvegicus
tgcgccaccacgcaaagccgaggct

SEQ ID NO: 516719 - DNA, 25 bp, Rattus norvegicus
aggcttgagcgcagccggcacctgc

SEQ ID NO: 516720 - DNA, 25 bp, Rattus norvegicus
gagcgcagccggcacctgctctgtg

SEQ ID NO: 516721 - DNA, 25 bp, Rattus norvegicus
tgctctgtgcgccgggcgctgccat

SEQ ID NO: 516722 - DNA, 25 bp, Rattus norvegicus
gccacccctgggctggagacaaagc

SEQ ID NO: 516723 - DNA, 25 bp, Rattus norvegicus
acaaagcgcatgagccacgcgcgtg

SEQ ID NO: 516724 - DNA, 25 bp, Rattus norvegicus
gtggcagcgcgagcatcattaatca

SEQ ID NO: 516725 - DNA, 25 bp, Rattus norvegicus
ggcagcgcgagcatcattaatcaga

SEQ ID NO: 516726 - DNA, 25 bp, Rattus norvegicus
gcgcgagcatcattaatcagagagg

SEQ ID NO: 516727 - DNA, 25 bp, Rattus norvegicus
atgcccggtcgctgcgccaccacgc

SEQ ID NO: 516728 - DNA, 25 bp, Rattus norvegicus
atcagagaggaaactggcgcgctgc

SEQ ID NO: 516729 - DNA, 25 bp, Rattus norvegicus
cagagaggaaactggcgcgctgccc

SEQ ID NO: 516730 - DNA, 25 bp, Rattus norvegicus
ttaatcagagaggaaactggcgcgc

SEQ ID NO: 516731 - DNA, 25 bp, Rattus norvegicus
agaagggagagtacaacgtccagga

SEQ ID NO: 516732 - DNA, 25 bp, Rattus norvegicus
agggtctgcgcctacaggtccatgg

SEQ ID NO: 516733 - DNA, 25 bp, Rattus norvegicus
gccggcctggccttctacgtgcagt

SEQ ID NO: 516734 - DNA, 25 bp, Rattus norvegicus
tgcagtccaccgcttgcaagaaggg

SEQ ID NO: 516735 - DNA, 25 bp, Rattus norvegicus
ttgcaagaagggagagtacaacgtc

SEQ ID NO: 516736 - DNA, 25 bp, Rattus norvegicus
tacaggtccatggctgtgggtcgct

SEQ ID NO: 516737 - DNA, 25 bp, Rattus norvegicus
gagtacaacgtccaggaggctgaga

SEQ ID NO: 516738 - DNA, 25 bp, Rattus norvegicus
ctcaggcgaggcggtgtgtctcaat

SEQ ID NO: 516739 - DNA, 25 bp, Rattus norvegicus
gacaccgggtgcagaaggcggagca

SEQ ID NO: 516740 - DNA, 25 bp, Rattus norvegicus
aaggcggagcagagacccccggcac

SEQ ID NO: 516741 - DNA, 25 bp, Rattus norvegicus
cggcactgccgagtcacctgcagat

SEQ ID NO: 516742 - DNA, 25 bp, Rattus norvegicus
tgccgagtcacctgcagatggcgag

SEQ ID NO: 516743 - DNA, 25 bp, Rattus norvegicus
ccaccgcttgcaagaagggagagta

SEQ ID NO: 516744 - DNA, 25 bp, Rattus norvegicus
tacgtgcagtccaccgcttgcaaga

SEQ ID NO: 516745 - DNA, 25 bp, Rattus norvegicus
gcgcggcagtactgggcctgctcct

SEQ ID NO: 516746 - DNA, 25 bp, Rattus norvegicus
aggtccacctccgaggtcttcttca

SEQ ID NO: 516747 - DNA, 25 bp, Rattus norvegicus
tggatgaacttgaccagcggcttgg

SEQ ID NO: 516748 - DNA, 25 bp, Rattus norvegicus
gggcccacctcagcagcgtctccag

SEQ ID NO: 516749 - DNA, 25 bp, Rattus norvegicus
acctggtctagccagtgtggcgcct

SEQ ID NO: 516750 - DNA, 25 bp, Rattus norvegicus
tgaccagcggcttggccaggtccac

SEQ ID NO: 516751 - DNA, 25 bp, Rattus norvegicus
gaggtcttcttcagctgcacccaga

SEQ ID NO: 516752 - DNA, 25 bp, Rattus norvegicus
tgcacccagatgaacgacgccatgg

SEQ ID NO: 516753 - DNA, 25 bp, Rattus norvegicus
atgaacgacgccatggtgagcgccc

SEQ ID NO: 516754 - DNA, 25 bp, Rattus norvegicus
cttggagccggccacttccgggagc

SEQ ID NO: 516755 - DNA, 25 bp, Rattus norvegicus
tcggtcacgtgaccgtgccaccaaa

SEQ ID NO: 516756 - DNA, 25 bp, Rattus norvegicus
gtgaccgtgccaccaaagcgtcgct

SEQ ID NO: 516757 - DNA, 25 bp, Rattus norvegicus
aagcgtcgctcacctggtctagcca

SEQ ID NO: 516758 - DNA, 25 bp, Rattus norvegicus
gggtacgtctgctggatgaacttga

SEQ ID NO: 516759 - DNA, 25 bp, Rattus norvegicus
actgcagcgcagagaactcttgttc

SEQ ID NO: 516760 - DNA, 25 bp, Rattus norvegicus
ccttgtaggtagaaggcaccgcgca

SEQ ID NO: 516761 - DNA, 25 bp, Rattus norvegicus
tcaccgttcaccgtgccagagtaga

SEQ ID NO: 516762 - DNA, 25 bp, Rattus norvegicus
cagctgctgaccaaaggcgtccaga

SEQ ID NO: 516763 - DNA, 25 bp, Rattus norvegicus
tgcagactgagagctccgaaacttc

SEQ ID NO: 516764 - DNA, 25 bp, Rattus norvegicus
tctggctgcatgacaccgcacactg

SEQ ID NO: 516765 - DNA, 25 bp, Rattus norvegicus
ttagacggttagacgcgcagagctt

SEQ ID NO: 516766 - DNA, 25 bp, Rattus norvegicus
tgaaagttcttgcagagctcgcagc

SEQ ID NO: 516767 - DNA, 25 bp, Rattus norvegicus
gcagccaaaagctccgggtcactta

SEQ ID NO: 516768 - DNA, 25 bp, Rattus norvegicus
tcacttagaaaaaggctgcgccggc

SEQ ID NO: 516769 - DNA, 25 bp, Rattus norvegicus
ccgagtagttaatggctccgcactg

SEQ ID NO: 516770 - DNA, 25 bp, Rattus norvegicus
cgctcaggcctagtgacagcaccta

SEQ ID NO: 516771 - DNA, 25 bp, Rattus norvegicus
gcgctggctgaatgaagaactcctc

SEQ ID NO: 516772 - DNA, 25 bp, Rattus norvegicus
ggcctgctccggatgcttaaaattc

SEQ ID NO: 516773 - DNA, 25 bp, Rattus norvegicus
ggccaagacagtggacgcgctcacc

SEQ ID NO: 516774 - DNA, 25 bp, Rattus norvegicus
acgcctgcgctgagacagggcgttt

SEQ ID NO: 516775 - DNA, 25 bp, Rattus norvegicus
gcttgaagactttgtaacgtttgta

SEQ ID NO: 516776 - DNA, 25 bp, Rattus norvegicus
cttgtggccaaaggcttgaagactt

SEQ ID NO: 516777 - DNA, 25 bp, Rattus norvegicus
ttggcgcttcgcaaagtggtaactt

SEQ ID NO: 516778 - DNA, 25 bp, Rattus norvegicus
ctcgagcaactaccgggtgagcggc

SEQ ID NO: 516779 - DNA, 25 bp, Rattus norvegicus
tacttctgcgcccaagtgctgcaga

SEQ ID NO: 516780 - DNA, 25 bp, Rattus norvegicus
tcctcagtaacgctacaggccgcag

SEQ ID NO: 516781 - DNA, 25 bp, Rattus norvegicus
agcccaacgctctggtcctcagtaa

SEQ ID NO: 516782 - DNA, 25 bp, Rattus norvegicus
tctggggtcgcccacgcgagtcaac

SEQ ID NO: 516783 - DNA, 25 bp, Rattus norvegicus
ccgggattcccacaggggctttctg

SEQ ID NO: 516784 - DNA, 25 bp, Rattus norvegicus
ttctttcagtcttgatgatggaggc

SEQ ID NO: 516785 - DNA, 25 bp, Rattus norvegicus
aggagctgctgctttacctcggcgc

SEQ ID NO: 516786 - DNA, 25 bp, Rattus norvegicus
tcggcgctttaactctggcgcgctg

SEQ ID NO: 516787 - DNA, 25 bp, Rattus norvegicus
cgctggcgcctacagcatgaggtaa

SEQ ID NO: 516788 - DNA, 25 bp, Rattus norvegicus
gccgctctcgtctcagccgcgtccc

SEQ ID NO: 516789 - DNA, 25 bp, Rattus norvegicus
cgccgcaggtgaccactcgccgcgc

SEQ ID NO: 516790 - DNA, 25 bp, Rattus norvegicus
gccggaggcttcacccgcgtcctcc

SEQ ID NO: 516791 - DNA, 25 bp, Rattus norvegicus
ggaagatggcctgggtgctcagtat

SEQ ID NO: 516792 - DNA, 25 bp, Rattus norvegicus
tgctcagtatggacgaggtgatcga

SEQ ID NO: 516793 - DNA, 25 bp, Rattus norvegicus
cagtatggacgaggtgatcgagtcc

SEQ ID NO: 516794 - DNA, 25 bp, Rattus norvegicus
cgagtccgggctggtgcacgacttc

SEQ ID NO: 516795 - DNA, 25 bp, Rattus norvegicus
tccgggctggtgcacgacttcgact

SEQ ID NO: 516796 - DNA, 25 bp, Rattus norvegicus
cagcctgtccggcatcggacaagag

SEQ ID NO: 516797 - DNA, 25 bp, Rattus norvegicus
catcggacaagagctgggcgctggc

SEQ ID NO: 516798 - DNA, 25 bp, Rattus norvegicus
ctggcgcctacagcatgaggtaagg

SEQ ID NO: 516799 - DNA, 25 bp, Rattus norvegicus
gcgccgtagcctcggaggacgatgg

SEQ ID NO: 516800 - DNA, 25 bp, Rattus norvegicus
cctgtccggcatcggacaagagctg

SEQ ID NO: 516801 - DNA, 25 bp, Rattus norvegicus
tctaggcgcccagcatttccacagc

SEQ ID NO: 516802 - DNA, 25 bp, Rattus norvegicus
cccagactcaccatggccgcgagcg

SEQ ID NO: 516803 - DNA, 25 bp, Rattus norvegicus
tgatccgtaggcgagcccttcggcc

SEQ ID NO: 516804 - DNA, 25 bp, Rattus norvegicus
cacatgatccgtaggcgagcccttc

SEQ ID NO: 516805 - DNA, 25 bp, Rattus norvegicus
cttctgacacatgatccgtaggcga

SEQ ID NO: 516806 - DNA, 25 bp, Rattus norvegicus
gcccgcttctgacacatgatccgta

SEQ ID NO: 516807 - DNA, 25 bp, Rattus norvegicus
attggcccgcttctgacacatgatc

SEQ ID NO: 516808 - DNA, 25 bp, Rattus norvegicus
cgttgtcctggtgacgccagcccgg

SEQ ID NO: 516809 - DNA, 25 bp, Rattus norvegicus
tgggctcggagaccgccattggccc

SEQ ID NO: 516810 - DNA, 25 bp, Rattus norvegicus
gacgcccgttgtcctggtgacgcca

SEQ ID NO: 516811 - DNA, 25 bp, Rattus norvegicus
gcctgaagtcacacggcgccggcga

SEQ ID NO: 516812 - DNA, 25 bp, Rattus norvegicus
acagcctgaagtcacacggcgccgg

SEQ ID NO: 516813 - DNA, 25 bp, Rattus norvegicus
cgagcgcgcccacagcctgaagtca

SEQ ID NO: 516814 - DNA, 25 bp, Rattus norvegicus
cctcaaggtgggctcggagaccgcc

SEQ ID NO: 516815 - DNA, 25 bp, Rattus norvegicus
ggggatacccactgccggccctcag

SEQ ID NO: 516816 - DNA, 25 bp, Rattus norvegicus
tcgtttaaagaagggtctgtctata

SEQ ID NO: 516817 - DNA, 25 bp, Rattus norvegicus
gtcaaccctgcgtagcgaccgtcct

SEQ ID NO: 516818 - DNA, 25 bp, Rattus norvegicus
ccagcgctcccgctgtgactcccgc

SEQ ID NO: 516819 - DNA, 25 bp, Rattus norvegicus
cggacgtcaccaccatgagcgcggg

SEQ ID NO: 516820 - DNA, 25 bp, Rattus norvegicus
tggagatgccgtccggaactggcca

SEQ ID NO: 516821 - DNA, 25 bp, Rattus norvegicus
gcatcactagcccttctccgcgctc

SEQ ID NO: 516822 - DNA, 25 bp, Rattus norvegicus
ccgcctcttgcccagagagagagct

SEQ ID NO: 516823 - DNA, 25 bp, Rattus norvegicus
tcttgcccagagagagagctctgga

SEQ ID NO: 516824 - DNA, 25 bp, Rattus norvegicus
gagagctctggagtcacgtctaggc

SEQ ID NO: 516825 - DNA, 25 bp, Rattus norvegicus
ggctgccctcgaacttcctctgctg

SEQ ID NO: 516826 - DNA, 25 bp, Rattus norvegicus
ttcctctgctgggatcgctttttca

SEQ ID NO: 516827 - DNA, 25 bp, Rattus norvegicus
ctctgctgggatcgctttttcatcc

SEQ ID NO: 516828 - DNA, 25 bp, Rattus norvegicus
ggtctgtctataagcctgcgcgccc

SEQ ID NO: 516829 - DNA, 25 bp, Rattus norvegicus
agctgtagcgctcatactgcgcgcg

SEQ ID NO: 516830 - DNA, 25 bp, Rattus norvegicus
agctgcggaagctgtagcgctcata

SEQ ID NO: 516831 - DNA, 25 bp, Rattus norvegicus
agtgctcgccgctgtactggtcgag

SEQ ID NO: 516832 - DNA, 25 bp, Rattus norvegicus
aggccgactcgagcggcatcagctc

SEQ ID NO: 516833 - DNA, 25 bp, Rattus norvegicus
tgcttgcagcgcttgaggcactgcg

SEQ ID NO: 516834 - DNA, 25 bp, Rattus norvegicus
agccgcaggctcacctctaggtagc

SEQ ID NO: 516835 - DNA, 25 bp, Rattus norvegicus
gggcgagcgcacttaccttgaagta

SEQ ID NO: 516836 - DNA, 25 bp, Rattus norvegicus
cttaccttgaagtaggcgaactgca

SEQ ID NO: 516837 - DNA, 25 bp, Rattus norvegicus
aactgcaggaatttgtagggctcgc

SEQ ID NO: 516838 - DNA, 25 bp, Rattus norvegicus
caggatgcgctacgcggcaggccta

SEQ ID NO: 516839 - DNA, 25 bp, Rattus norvegicus
agggctcgcgctgctgaaagtcagc

SEQ ID NO: 516840 - DNA, 25 bp, Rattus norvegicus
ctgaaagtcagccagcaccgcgcgg

SEQ ID NO: 516841 - DNA, 25 bp, Rattus norvegicus
gcagcacgccgccaaagaggcgcag

SEQ ID NO: 516842 - DNA, 25 bp, Rattus norvegicus
caaagaggcgcagctccctgtggct

SEQ ID NO: 516843 - DNA, 25 bp, Rattus norvegicus
tttcctcttagggtttggcagtgcg

SEQ ID NO: 516844 - DNA, 25 bp, Rattus norvegicus
tgcgcctgagtctttccagcttcgg

SEQ ID NO: 516845 - DNA, 25 bp, Rattus norvegicus
tcctggcaaagggtcctcagtaacc

SEQ ID NO: 516846 - DNA, 25 bp, Rattus norvegicus
cccactgcagagtggagcggtccca

SEQ ID NO: 516847 - DNA, 25 bp, Rattus norvegicus
gggcgctgcgcacagtttctatgta

SEQ ID NO: 516848 - DNA, 25 bp, Rattus norvegicus
tctatgtaagtctccggtgccaccg

SEQ ID NO: 516849 - DNA, 25 bp, Rattus norvegicus
atgcttagaccacagcggctccgga

SEQ ID NO: 516850 - DNA, 25 bp, Rattus norvegicus
cagagttcgggcttcacagagcgct

SEQ ID NO: 516851 - DNA, 25 bp, Rattus norvegicus
tggggtcaccggaacatttgctttc

SEQ ID NO: 516852 - DNA, 25 bp, Rattus norvegicus
ttctcccttttcaagcgtactgttc

SEQ ID NO: 516853 - DNA, 25 bp, Rattus norvegicus
tgttcacgtttctcgctaagccacc

SEQ ID NO: 516854 - DNA, 25 bp, Rattus norvegicus
tgaggtgtgcatcgccttgttggaa

SEQ ID NO: 516855 - DNA, 25 bp, Rattus norvegicus
gaggcccgcacggaacctgcgaata

SEQ ID NO: 516856 - DNA, 25 bp, Rattus norvegicus
ctaagccacctgctggcagctttta

SEQ ID NO: 516857 - DNA, 25 bp, Rattus norvegicus
tacttattcaggaagacgccgtcgg

SEQ ID NO: 516858 - DNA, 25 bp, Rattus norvegicus
gacgatcaatccttccggggtgacc

SEQ ID NO: 516859 - DNA, 25 bp, Rattus norvegicus
cgctgccttgagcaccgaacttgca

SEQ ID NO: 516860 - DNA, 25 bp, Rattus norvegicus
tctgcacacggtgatttctggaatc

SEQ ID NO: 516861 - DNA, 25 bp, Rattus norvegicus
atgattgtctttgtcggccaccacg

SEQ ID NO: 516862 - DNA, 25 bp, Rattus norvegicus
cctgtggtcgcaggaactgcccatt

SEQ ID NO: 516863 - DNA, 25 bp, Rattus norvegicus
caggagccgatggttgttgaaatca

SEQ ID NO: 516864 - DNA, 25 bp, Rattus norvegicus
tgccctcagagttgaccgctacatc

SEQ ID NO: 516865 - DNA, 25 bp, Rattus norvegicus
gagagatccctcgaagccatactta

SEQ ID NO: 516866 - DNA, 25 bp, Rattus norvegicus
ccctcgaaggtgaagatctggatgc

SEQ ID NO: 516867 - DNA, 25 bp, Rattus norvegicus
cgggtgtctgaaaccaggatcttgc

SEQ ID NO: 516868 - DNA, 25 bp, Rattus norvegicus
gccgttggcctcaaacatctgcaca

SEQ ID NO: 516869 - DNA, 25 bp, Rattus norvegicus
ccaggtgaccttcatggttgaaagc

SEQ ID NO: 516870 - DNA, 25 bp, Rattus norvegicus
tgattcgcccttcctggtctacagc

SEQ ID NO: 516871 - DNA, 25 bp, Rattus norvegicus
gcggcgcaaaacaatttggtcccga

SEQ ID NO: 516872 - DNA, 25 bp, Rattus norvegicus
gtctcagggaacgaagccatttgca

SEQ ID NO: 516873 - DNA, 25 bp, Rattus norvegicus
gcggctcactcagcagagcgcatca

SEQ ID NO: 516874 - DNA, 25 bp, Rattus norvegicus
cgggtttgcactgctactccgcaga

SEQ ID NO: 516875 - DNA, 25 bp, Rattus norvegicus
tactccgcagaaaacgagcgcctgc

SEQ ID NO: 516876 - DNA, 25 bp, Rattus norvegicus
tcaaagtccgccgtggaatccggtc

SEQ ID NO: 516877 - DNA, 25 bp, Rattus norvegicus
tctccttgcacagcaggcagatctg

SEQ ID NO: 516878 - DNA, 25 bp, Rattus norvegicus
tcccgacgagtcttgcttgtgttgc

SEQ ID NO: 516879 - DNA, 25 bp, Rattus norvegicus
tttgccctcgggctaaatggattga

SEQ ID NO: 516880 - DNA, 25 bp, Rattus norvegicus
tcctggagtcgcaacagtcctagtc

SEQ ID NO: 516881 - DNA, 25 bp, Rattus norvegicus
ccgcgggccgccctgaattattcat

SEQ ID NO: 516882 - DNA, 25 bp, Rattus norvegicus
aagatattggatgtacccgccgccc

SEQ ID NO: 516883 - DNA, 25 bp, Rattus norvegicus
gtcgtgcaatgctatccgcgttccg

SEQ ID NO: 516884 - DNA, 25 bp, Rattus norvegicus
gcgcctgcacaagtctcaaagtccg

SEQ ID NO: 516885 - DNA, 25 bp, Rattus norvegicus
tcgtcgtctagcaacagcaccaaca

SEQ ID NO: 516886 - DNA, 25 bp, Rattus norvegicus
ccacgggctgaggaagtgacgaact

SEQ ID NO: 516887 - DNA, 25 bp, Rattus norvegicus
cttcggtcgcctctggttcggtcct

SEQ ID NO: 516888 - DNA, 25 bp, Rattus norvegicus
tcttcaactcaagccggcttcggtc

SEQ ID NO: 516889 - DNA, 25 bp, Rattus norvegicus
ttccctgcaggtggcgtggccctga

SEQ ID NO: 516890 - DNA, 25 bp, Rattus norvegicus
tcggctcgagttcttccctgcaggt

SEQ ID NO: 516891 - DNA, 25 bp, Rattus norvegicus
gaactcactgttcgtcgtctagcaa

SEQ ID NO: 516892 - DNA, 25 bp, Rattus norvegicus
tgcaggcttgtctgcagccatcttc

SEQ ID NO: 516893 - DNA, 25 bp, Rattus norvegicus
tagcgcccaaggaagacagtacttc

SEQ ID NO: 516894 - DNA, 25 bp, Rattus norvegicus
gcttccgttctgtagcgcccaagga

SEQ ID NO: 516895 - DNA, 25 bp, Rattus norvegicus
gccatccacggcttccgttctgtag

SEQ ID NO: 516896 - DNA, 25 bp, Rattus norvegicus
agcaccaacacatccgccagtggag

SEQ ID NO: 516897 - DNA, 25 bp, Rattus norvegicus
ggaaaactcttcaactcaagccggc

SEQ ID NO: 516898 - DNA, 25 bp, Rattus norvegicus
tccgccagtggaggactgttttccc

SEQ ID NO: 516899 - DNA, 25 bp, Rattus norvegicus
ataaacccgaggatgagagagaggc

SEQ ID NO: 516900 - DNA, 25 bp, Rattus norvegicus
ggcccagctgtggaatctctctgcc

SEQ ID NO: 516901 - DNA, 25 bp, Rattus norvegicus
actgtgggcccagctgtggaatctc

SEQ ID NO: 516902 - DNA, 25 bp, Rattus norvegicus
tgccgcctccatgcccactgtgggc

SEQ ID NO: 516903 - DNA, 25 bp, Rattus norvegicus
ggtctcgagcttgtgccgcctccat

SEQ ID NO: 516904 - DNA, 25 bp, Rattus norvegicus
tcaggtctcgagcttgtgccgcctc

SEQ ID NO: 516905 - DNA, 25 bp, Rattus norvegicus
ccagaagttcctgcgggcgcgtcag

SEQ ID NO: 516906 - DNA, 25 bp, Rattus norvegicus
acaaggtggcgccagaagttcctgc

SEQ ID NO: 516907 - DNA, 25 bp, Rattus norvegicus
tccagacaaggtggcgccagaagtt

SEQ ID NO: 516908 - DNA, 25 bp, Rattus norvegicus
actcggtgtccagacaaggtggcgc

SEQ ID NO: 516909 - DNA, 25 bp, Rattus norvegicus
cggagtgactcggtgtccagacaag

SEQ ID NO: 516910 - DNA, 25 bp, Rattus norvegicus
gggtcgactcttccggagtgactcg

SEQ ID NO: 516911 - DNA, 25 bp, Rattus norvegicus
cccagggataaacccgaggatgaga

SEQ ID NO: 516912 - DNA, 25 bp, Rattus norvegicus
agggtgatgacgatgggcgccacct

SEQ ID NO: 516913 - DNA, 25 bp, Rattus norvegicus
ctgctgctggctccgtaacaccgga

SEQ ID NO: 516914 - DNA, 25 bp, Rattus norvegicus
tcgcccgctcttttgttggtttctc

SEQ ID NO: 516915 - DNA, 25 bp, Rattus norvegicus
gctcagggagtctccgaagcggctt

SEQ ID NO: 516916 - DNA, 25 bp, Rattus norvegicus
gaagcggcttgagctaggtgacacc

SEQ ID NO: 516917 - DNA, 25 bp, Rattus norvegicus
cgtgccggagcgacaagttgcttct

SEQ ID NO: 516918 - DNA, 25 bp, Rattus norvegicus
cgctggagatccacactgccaagga

SEQ ID NO: 516919 - DNA, 25 bp, Rattus norvegicus
gaccagcgggaatacgacgaccaga

SEQ ID NO: 516920 - DNA, 25 bp, Rattus norvegicus
tccaggaattcaccaggcacgacca

SEQ ID NO: 516921 - DNA, 25 bp, Rattus norvegicus
tgccttcccggagctggatttcagg

SEQ ID NO: 516922 - DNA, 25 bp, Rattus norvegicus
gggctgcaacaacaagcctgccttc

SEQ ID NO: 516923 - DNA, 25 bp, Rattus norvegicus
cgctcggcgcgttttgcatgaagat

SEQ ID NO: 516924 - DNA, 25 bp, Rattus norvegicus
tttcggcgctggtgaatttcacatt

SEQ ID NO: 516925 - DNA, 25 bp, Rattus norvegicus
tgccaaggatttcatcttttccatg

SEQ ID NO: 516926 - DNA, 25 bp, Rattus norvegicus
ccggcagcttgttgatttcggcgct

SEQ ID NO: 516927 - DNA, 25 bp, Rattus norvegicus
gcccactgcctttgtgcggacagtc

SEQ ID NO: 516928 - DNA, 25 bp, Rattus norvegicus
gctagcctcgacttacgccagcgga

SEQ ID NO: 516929 - DNA, 25 bp, Rattus norvegicus
gcagaacctttggtaaggaccgcac

SEQ ID NO: 516930 - DNA, 25 bp, Rattus norvegicus
gggttatctcctcgccagggcggac

SEQ ID NO: 516931 - DNA, 25 bp, Rattus norvegicus
ggtgtgattcccgaccaagatggcg

SEQ ID NO: 516932 - DNA, 25 bp, Rattus norvegicus
gctgctgggtaagtgatctctgctg

SEQ ID NO: 516933 - DNA, 25 bp, Rattus norvegicus
gttcggttcatctccacccgggcta

SEQ ID NO: 516934 - DNA, 25 bp, Rattus norvegicus
ctcccgaccgggaagaacgtgctgc

SEQ ID NO: 516935 - DNA, 25 bp, Rattus norvegicus
tgcactttgggcagcgtttcagctt

SEQ ID NO: 516936 - DNA, 25 bp, Rattus norvegicus
caaacgtataatcagcccgcgcatg

SEQ ID NO: 516937 - DNA, 25 bp, Rattus norvegicus
ggaagaccagcgttaccacagtgca

SEQ ID NO: 516938 - DNA, 25 bp, Rattus norvegicus
cgtttcagcttggagacacagggaa

SEQ ID NO: 516939 - DNA, 25 bp, Rattus norvegicus
gcttcgctcttctagccctgtcagg

SEQ ID NO: 516940 - DNA, 25 bp, Rattus norvegicus
cgacgatgaggacgggcagaacctt

SEQ ID NO: 516941 - DNA, 25 bp, Rattus norvegicus
ttcccttcctgccagggaaggaggc

SEQ ID NO: 516942 - DNA, 25 bp, Rattus norvegicus
aagcagccgtttccacactccagtt

SEQ ID NO: 516943 - DNA, 25 bp, Rattus norvegicus
gttcgggaagcagccgtttccacac

SEQ ID NO: 516944 - DNA, 25 bp, Rattus norvegicus
gctcggcctcctcgttcgggaagca

SEQ ID NO: 516945 - DNA, 25 bp, Rattus norvegicus
ggcgcatcctcaagggcttgcagct

SEQ ID NO: 516946 - DNA, 25 bp, Rattus norvegicus
tatcggcgcatcctcaagggcttgc

SEQ ID NO: 516947 - DNA, 25 bp, Rattus norvegicus
ggctcccatggtatcggcgcatcct

SEQ ID NO: 516948 - DNA, 25 bp, Rattus norvegicus
tgtacagtcccaccacggaggcggc

SEQ ID NO: 516949 - DNA, 25 bp, Rattus norvegicus
gcgtggcaaatggagggaaattcta

SEQ ID NO: 516950 - DNA, 25 bp, Rattus norvegicus
agaacggagcggtgtacagtcccac

SEQ ID NO: 516951 - DNA, 25 bp, Rattus norvegicus
acatcccggcggagacttttgctgg

SEQ ID NO: 516952 - DNA, 25 bp, Rattus norvegicus
ggaggcgttgcggtccgcctcctac

SEQ ID NO: 516953 - DNA, 25 bp, Rattus norvegicus
ttttgctgggcgagcgagtatttgc

SEQ ID NO: 516954 - DNA, 25 bp, Rattus norvegicus
ttcctgggccggctcccatggtatc

SEQ ID NO: 516955 - DNA, 25 bp, Rattus norvegicus
cggccagctgatgcaggtgagcact

SEQ ID NO: 516956 - DNA, 25 bp, Rattus norvegicus
cacatggtgacaacttcgaagaagc

SEQ ID NO: 516957 - DNA, 25 bp, Rattus norvegicus
ctcttaccgacagcggccagctgat

SEQ ID NO: 516958 - DNA, 25 bp, Rattus norvegicus
ggccaggcctccctcttaccgacag

SEQ ID NO: 516959 - DNA, 25 bp, Rattus norvegicus
ctgatgcaggtgagcactcggtaga

SEQ ID NO: 516960 - DNA, 25 bp, Rattus norvegicus
gtggaccaggtaaaagaccaggatc

SEQ ID NO: 516961 - DNA, 25 bp, Rattus norvegicus
tcaggtcgcacatggtgacaacttc

SEQ ID NO: 516962 - DNA, 25 bp, Rattus norvegicus
aggcgaagaaacgagtggccacgtc

SEQ ID NO: 516963 - DNA, 25 bp, Rattus norvegicus
caacttcgaagaagctgtgggcgcc

SEQ ID NO: 516964 - DNA, 25 bp, Rattus norvegicus
gaaacgagtggccacgtcccaattc

SEQ ID NO: 516965 - DNA, 25 bp, Rattus norvegicus
tgtgggcgccatagtcgatcggaaa

SEQ ID NO: 516966 - DNA, 25 bp, Rattus norvegicus
cgccatagtcgatcggaaaggagct

SEQ ID NO: 516967 - DNA, 25 bp, Rattus norvegicus
gtcgatcggaaaggagcttcgcacg

SEQ ID NO: 516968 - DNA, 25 bp, Rattus norvegicus
accaggatcattatcaggtcgcaca

SEQ ID NO: 516969 - DNA, 25 bp, Rattus norvegicus
atcccggccaggtgcaaccctgtgt

SEQ ID NO: 516970 - DNA, 25 bp, Rattus norvegicus
cccagacacgcggaagttggactgg

SEQ ID NO: 516971 - DNA, 25 bp, Rattus norvegicus
atcccacttcccagctgtggcggga

SEQ ID NO: 516972 - DNA, 25 bp, Rattus norvegicus
acctctggcccgtaaagctgggacg

SEQ ID NO: 516973 - DNA, 25 bp, Rattus norvegicus
ttcttaccatctgcgccactttgag

SEQ ID NO: 516974 - DNA, 25 bp, Rattus norvegicus
caggaactttctaggggacaccagg

SEQ ID NO: 516975 - DNA, 25 bp, Rattus norvegicus
ccactttgagcagggcgccctgggt

SEQ ID NO: 516976 - DNA, 25 bp, Rattus norvegicus
aacagcaaaggggtgcgcgaagccc

SEQ ID NO: 516977 - DNA, 25 bp, Rattus norvegicus
cctgcgggctgttccaggaactttc

SEQ ID NO: 516978 - DNA, 25 bp, Rattus norvegicus
agagattcaaaagccaacccgagcc

SEQ ID NO: 516979 - DNA, 25 bp, Rattus norvegicus
ctccctgtcccgagcagagattcaa

SEQ ID NO: 516980 - DNA, 25 bp, Rattus norvegicus
tgatcttaaaggcagcgcgtctccc

SEQ ID NO: 516981 - DNA, 25 bp, Rattus norvegicus
aggggacctggcgatgatcttaaag

SEQ ID NO: 516982 - DNA, 25 bp, Rattus norvegicus
ccgctgctgcacgtggtccggacga

SEQ ID NO: 516983 - DNA, 25 bp, Rattus norvegicus
ctgctcttccatggtcgcgccggga

SEQ ID NO: 516984 - DNA, 25 bp, Rattus norvegicus
gcgagctagccgagtccacctgctt

SEQ ID NO: 516985 - DNA, 25 bp, Rattus norvegicus
ggcccgacacttacgatctcagcta

SEQ ID NO: 516986 - DNA, 25 bp, Rattus norvegicus
tctcagctatgatcaggagccctgg

SEQ ID NO: 516987 - DNA, 25 bp, Rattus norvegicus
cggaggaactctcggtcgtaagcga

SEQ ID NO: 516988 - DNA, 25 bp, Rattus norvegicus
tctcggtcgtaagcgaagctgctgc

SEQ ID NO: 516989 - DNA, 25 bp, Rattus norvegicus
gaagttctccgcgaaggagctggaa

SEQ ID NO: 516990 - DNA, 25 bp, Rattus norvegicus
tcgcaggccagagaatcgcggctga

SEQ ID NO: 516991 - DNA, 25 bp, Rattus norvegicus
ccagggtcaggtcagcgagtgtccc

SEQ ID NO: 516992 - DNA, 25 bp, Rattus norvegicus
tcgacgcgcgcactccgggtttgct

SEQ ID NO: 516993 - DNA, 25 bp, Rattus norvegicus
ctgtctcccgcggactgagagctct

SEQ ID NO: 516994 - DNA, 25 bp, Rattus norvegicus
tcgctaagggtgagcggcacctcct

SEQ ID NO: 516995 - DNA, 25 bp, Rattus norvegicus
tgagcggcacctcctggtcgcactt

SEQ ID NO: 516996 - DNA, 25 bp, Rattus norvegicus
ctgctggtggtagagaagttctccg

SEQ ID NO: 516997 - DNA, 25 bp, Rattus norvegicus
tgcacactttcagaggcgccgctgc

SEQ ID NO: 516998 - DNA, 25 bp, Rattus norvegicus
ggagcccacgatgcacactttcaga

SEQ ID NO: 516999 - DNA, 25 bp, Rattus norvegicus
gccgtaaccgcagggttaccaatgc

SEQ ID NO: 517000 - DNA, 25 bp, Rattus norvegicus
acctcgtgcactggtgcctcggcgt

SEQ ID NO: 517001 - DNA, 25 bp, Rattus norvegicus
tgcccaaccgggacaagcgatcgca

SEQ ID NO: 517002 - DNA, 25 bp, Rattus norvegicus
tgtccacgccgaagcagcaagcaag

SEQ ID NO: 517003 - DNA, 25 bp, Rattus norvegicus
ttaccaatgcgcagacaggtgcccg

SEQ ID NO: 517004 - DNA, 25 bp, Rattus norvegicus
gccaagccggatcgctgctgcaagc

SEQ ID NO: 517005 - DNA, 25 bp, Rattus norvegicus
aagccggatcgctgcagcacacaca

SEQ ID NO: 517006 - DNA, 25 bp, Rattus norvegicus
acctccactggaacggcctagtata

SEQ ID NO: 517007 - DNA, 25 bp, Rattus norvegicus
acggcctagtatagccgctccgggc

SEQ ID NO: 517008 - DNA, 25 bp, Rattus norvegicus
gccacagctgacagcccggaggatc

SEQ ID NO: 517009 - DNA, 25 bp, Rattus norvegicus
tccgggctggtagcttggtcagcct

SEQ ID NO: 517010 - DNA, 25 bp, Rattus norvegicus
caagccgggtagctgctgtacacag

SEQ ID NO: 517011 - DNA, 25 bp, Rattus norvegicus
ccgatgtagggcgtacccaccctgt

SEQ ID NO: 517012 - DNA, 25 bp, Rattus norvegicus
ccgacacaccgagagggagcgtgct

SEQ ID NO: 517013 - DNA, 25 bp, Rattus norvegicus
aagggcgtgcggagatttccctgtc

SEQ ID NO: 517014 - DNA, 25 bp, Rattus norvegicus
tttccctgtcaggatccaagtccgg

SEQ ID NO: 517015 - DNA, 25 bp, Rattus norvegicus
caagtccggggcaacaaaaggctag

SEQ ID NO: 517016 - DNA, 25 bp, Rattus norvegicus
atgtagggcgtacccaccctgtctg

SEQ ID NO: 517017 - DNA, 25 bp, Rattus norvegicus
cccaagcaactgcaagggcccagga

SEQ ID NO: 517018 - DNA, 25 bp, Rattus norvegicus
cgaacttgcccgagaagtggctgga

SEQ ID NO: 517019 - DNA, 25 bp, Rattus norvegicus
ggccgcagctgcatccagcccggct

SEQ ID NO: 517020 - DNA, 25 bp, Rattus norvegicus
ttcttcctcctgtatgagtcaggca

SEQ ID NO: 517021 - DNA, 25 bp, Rattus norvegicus
gtatgagtcaggcatttcccgggga

SEQ ID NO: 517022 - DNA, 25 bp, Rattus norvegicus
gcatttcccggggaatcggagcagc

SEQ ID NO: 517023 - DNA, 25 bp, Rattus norvegicus
ccaggagcatccctagcccgggtcc

SEQ ID NO: 517024 - DNA, 25 bp, Rattus norvegicus
tcaggatccaagtccggggcaacaa

SEQ ID NO: 517025 - DNA, 25 bp, Rattus norvegicus
gagctcaggcaacctttgactccgc

SEQ ID NO: 517026 - DNA, 25 bp, Rattus norvegicus
agacgacttgtgcttgctctccggg

SEQ ID NO: 517027 - DNA, 25 bp, Rattus norvegicus
ctgtcacagagcgacaggtccgtta

SEQ ID NO: 517028 - DNA, 25 bp, Rattus norvegicus
gcgtgcaccaacaggagcgcgagca

SEQ ID NO: 517029 - DNA, 25 bp, Rattus norvegicus
tggctcggagcagcaatgacattcc

SEQ ID NO: 517030 - DNA, 25 bp, Rattus norvegicus
ggggcttcggctgaatggccctccc

SEQ ID NO: 517031 - DNA, 25 bp, Rattus norvegicus
ggagtctccgcctcagcagtagccg

SEQ ID NO: 517032 - DNA, 25 bp, Rattus norvegicus
tcagcaccgcgaggccgggacactg

SEQ ID NO: 517033 - DNA, 25 bp, Rattus norvegicus
agagcaaagactgccacccggccgg

SEQ ID NO: 517034 - DNA, 25 bp, Rattus norvegicus
atggtgaaggagagcaaagactgcc

SEQ ID NO: 517035 - DNA, 25 bp, Rattus norvegicus
tgatgctctcgaagcggatgacggc

SEQ ID NO: 517036 - DNA, 25 bp, Rattus norvegicus
gggcacactcaccacgggtcgaact

SEQ ID NO: 517037 - DNA, 25 bp, Rattus norvegicus
ccatgaggccgctccacggggacga

SEQ ID NO: 517038 - DNA, 25 bp, Rattus norvegicus
ggtcgaactcgtggatgatgctctc

SEQ ID NO: 517039 - DNA, 25 bp, Rattus norvegicus
ctctcgtgcgctcacaaaggggtca

SEQ ID NO: 517040 - DNA, 25 bp, Rattus norvegicus
atcgtgctggcgatgcgcgtccaca

SEQ ID NO: 517041 - DNA, 25 bp, Rattus norvegicus
aaggagcgaggagccctagtgaacc

SEQ ID NO: 517042 - DNA, 25 bp, Rattus norvegicus
gccgactgtcagtcgctgccctggg

SEQ ID NO: 517043 - DNA, 25 bp, Rattus norvegicus
tcctgctcttttgcgagagatcttc

SEQ ID NO: 517044 - DNA, 25 bp, Rattus norvegicus
ctcacccgacttgggaacgtgcggc

SEQ ID NO: 517045 - DNA, 25 bp, Rattus norvegicus
ctcacaaaggggtcaggagcgtccc

SEQ ID NO: 517046 - DNA, 25 bp, Rattus norvegicus
tccacaggacgatgtgcagcggcca

SEQ ID NO: 517047 - DNA, 25 bp, Rattus norvegicus
aacagctgggcaggacctctcgccg

SEQ ID NO: 517048 - DNA, 25 bp, Rattus norvegicus
gaaactcctcgccaacagctgggca

SEQ ID NO: 517049 - DNA, 25 bp, Rattus norvegicus
gagggaaacaggaaactcctcgcca

SEQ ID NO: 517050 - DNA, 25 bp, Rattus norvegicus
gactcactcatcaactttacccggg

SEQ ID NO: 517051 - DNA, 25 bp, Rattus norvegicus
gcgcgcgagtgactcactcatcaac

SEQ ID NO: 517052 - DNA, 25 bp, Rattus norvegicus
cccgcaagtggactgtcctgctctt

SEQ ID NO: 517053 - DNA, 25 bp, Rattus norvegicus
tgccattaacgtgcatgaggaggga

SEQ ID NO: 517054 - DNA, 25 bp, Rattus norvegicus
cctaaatcgtcgcattaatctaaca

SEQ ID NO: 517055 - DNA, 25 bp, Rattus norvegicus
agcacgcctggctgtaaaattcgta

SEQ ID NO: 517056 - DNA, 25 bp, Rattus norvegicus
ttcgtatgtccgcaaagcaatttca

SEQ ID NO: 517057 - DNA, 25 bp, Rattus norvegicus
ctggtgccgcggatttaatagctta

SEQ ID NO: 517058 - DNA, 25 bp, Rattus norvegicus
agcttaattttctagggactgacaa

SEQ ID NO: 517059 - DNA, 25 bp, Rattus norvegicus
ctgacaatgtccgtcccaaggagcc

SEQ ID NO: 517060 - DNA, 25 bp, Rattus norvegicus
tcgggacaagggtacatgccacatc

SEQ ID NO: 517061 - DNA, 25 bp, Rattus norvegicus
acatgccacatcactcggtaccgag

SEQ ID NO: 517062 - DNA, 25 bp, Rattus norvegicus
ctcggtaccgagtgcttacataacc

SEQ ID NO: 517063 - DNA, 25 bp, Rattus norvegicus
ttacataaccgcacacacgcgtacg

SEQ ID NO: 517064 - DNA, 25 bp, Rattus norvegicus
cacgcgtacgtatcagaaccacttc

SEQ ID NO: 517065 - DNA, 25 bp, Rattus norvegicus
cgtatcagaaccacttcggagggtg

SEQ ID NO: 517066 - DNA, 25 bp, Rattus norvegicus
cccttgcggaatgcctcgggacaag

SEQ ID NO: 517067 - DNA, 25 bp, Rattus norvegicus
tccattttctcgtttgcaggggaaa

SEQ ID NO: 517068 - DNA, 25 bp, Rattus norvegicus
tgaccgaatgctacagctttagggc

SEQ ID NO: 517069 - DNA, 25 bp, Rattus norvegicus
ctttagggctgggatactgaggacc

SEQ ID NO: 517070 - DNA, 25 bp, Rattus norvegicus
actgaggaccgtattggggagagaa

SEQ ID NO: 517071 - DNA, 25 bp, Rattus norvegicus
tgctacagctttagggctgggatac

SEQ ID NO: 517072 - DNA, 25 bp, Rattus norvegicus
gatgggattgatgcgccgttccagt

SEQ ID NO: 517073 - DNA, 25 bp, Rattus norvegicus
tgatgcgccgttccagtccaatcca

SEQ ID NO: 517074 - DNA, 25 bp, Rattus norvegicus
gcgccgttccagtccaatccatttt

SEQ ID NO: 517075 - DNA, 25 bp, Rattus norvegicus
ccaatccattttctcgtttgcaggg

SEQ ID NO: 517076 - DNA, 25 bp, Rattus norvegicus
gtccggcgtttatttttagcagcgc

SEQ ID NO: 517077 - DNA, 25 bp, Rattus norvegicus
agcagcgctttcctgtgaccgaatg

SEQ ID NO: 517078 - DNA, 25 bp, Rattus norvegicus
agcgctttcctgtgaccgaatgcta

SEQ ID NO: 517079 - DNA, 25 bp, Rattus norvegicus
ttttagcagcgctttcctgtgaccg

SEQ ID NO: 517080 - DNA, 25 bp, Rattus norvegicus
cctgtgaccgaatgctacagcttta

SEQ ID NO: 517081 - DNA, 25 bp, Rattus norvegicus
atcgcagcgtttgatcgccgtgtga

SEQ ID NO: 517082 - DNA, 25 bp, Rattus norvegicus
ccgtgtgaggtcacgtacttgatcc

SEQ ID NO: 517083 - DNA, 25 bp, Rattus norvegicus
gccgctactctaatcgcagcgtttg

SEQ ID NO: 517084 - DNA, 25 bp, Rattus norvegicus
ccacgtgaccggaagaccgagtatc

SEQ ID NO: 517085 - DNA, 25 bp, Rattus norvegicus
gccatgataggccacgtgaccggaa

SEQ ID NO: 517086 - DNA, 25 bp, Rattus norvegicus
gtcctagatgttactgccgcgtgcc

SEQ ID NO: 517087 - DNA, 25 bp, Rattus norvegicus
cctgtagacccgaacgtcctagatg

SEQ ID NO: 517088 - DNA, 25 bp, Rattus norvegicus
tcgcctgtaaacacacgagtgggtg

SEQ ID NO: 517089 - DNA, 25 bp, Rattus norvegicus
gacaaacggtgcaggtgctgagccc

SEQ ID NO: 517090 - DNA, 25 bp, Rattus norvegicus
gaacaccacgttgaccctggggaca

SEQ ID NO: 517091 - DNA, 25 bp, Rattus norvegicus
ttgccagagcggtccacgaacacca

SEQ ID NO: 517092 - DNA, 25 bp, Rattus norvegicus
acgctgggccagatgaagaacattg

SEQ ID NO: 517093 - DNA, 25 bp, Rattus norvegicus
gcccagctctatgtacctgtagacc

SEQ ID NO: 517094 - DNA, 25 bp, Rattus norvegicus
tacttgatccagctgaacttccggc

SEQ ID NO: 517095 - DNA, 25 bp, Rattus norvegicus
ggcgagtctgacgacgagtttgaca

SEQ ID NO: 517096 - DNA, 25 bp, Rattus norvegicus
tgaacatcgcgtcaccaggcacagt

SEQ ID NO: 517097 - DNA, 25 bp, Rattus norvegicus
caggcacagtgcacaagcgctacca

SEQ ID NO: 517098 - DNA, 25 bp, Rattus norvegicus
tgagccggctgaagatgaacatcgc

SEQ ID NO: 517099 - DNA, 25 bp, Rattus norvegicus
tggcggtcagagcaaacctagcggc

SEQ ID NO: 517100 - DNA, 25 bp, Rattus norvegicus
tgcagcagctctgagaccagcgatg

SEQ ID NO: 517101 - DNA, 25 bp, Rattus norvegicus
accagcgatgatgactctgagagcc

SEQ ID NO: 517102 - DNA, 25 bp, Rattus norvegicus
caaggacagtggcttggcttactcg

SEQ ID NO: 517103 - DNA, 25 bp, Rattus norvegicus
tgcgccggaagccatcagtcaccaa

SEQ ID NO: 517104 - DNA, 25 bp, Rattus norvegicus
cggtgctcaatcagatcttcgagga

SEQ ID NO: 517105 - DNA, 25 bp, Rattus norvegicus
cgagtttgacatggacgagaaccta

SEQ ID NO: 517106 - DNA, 25 bp, Rattus norvegicus
gcttactcgtggcaccggcgtgaca

SEQ ID NO: 517107 - DNA, 25 bp, Rattus norvegicus
gacgagaacctaccacccaagctga

SEQ ID NO: 517108 - DNA, 25 bp, Rattus norvegicus
aaccgcctgacatctcgaaagagtg

SEQ ID NO: 517109 - DNA, 25 bp, Rattus norvegicus
cggaggtgtcagagcgaaacttgac

SEQ ID NO: 517110 - DNA, 25 bp, Rattus norvegicus
ggtacccaaggcgtccatcagagcg

SEQ ID NO: 517111 - DNA, 25 bp, Rattus norvegicus
aggcgtccatcagagcgggccctgc

SEQ ID NO: 517112 - DNA, 25 bp, Rattus norvegicus
gacacaagtccagagccggccgaca

SEQ ID NO: 517113 - DNA, 25 bp, Rattus norvegicus
gctggctctcacacccttgtggatc

SEQ ID NO: 517114 - DNA, 25 bp, Rattus norvegicus
tgccgcgtctcttttccgggtccga

SEQ ID NO: 517115 - DNA, 25 bp, Rattus norvegicus
agaaccaggcccgtagcgctaaggc

SEQ ID NO: 517116 - DNA, 25 bp, Rattus norvegicus
acaggaggcgtcaacaaccgggcag

SEQ ID NO: 517117 - DNA, 25 bp, Rattus norvegicus
gccttccggctgtcattcggtctgg

SEQ ID NO: 517118 - DNA, 25 bp, Rattus norvegicus
atcacagtgaaaggggcggtgcctt

SEQ ID NO: 517119 - DNA, 25 bp, Rattus norvegicus
ggcggtgccttagctgttgtaaatc

SEQ ID NO: 517120 - DNA, 25 bp, Rattus norvegicus
tagctgttgtaaatccggaggaagg

SEQ ID NO: 517121 - DNA, 25 bp, Rattus norvegicus
cgccagctgtcatgaggcgtgttga

SEQ ID NO: 517122 - DNA, 25 bp, Rattus norvegicus
aaacttgactggctgtcgctcagga

SEQ ID NO: 517123 - DNA, 25 bp, Rattus norvegicus
cagtcggcctgtcagccggcttcga

SEQ ID NO: 517124 - DNA, 25 bp, Rattus norvegicus
gcatgcgtatctgtgaggcccggct

SEQ ID NO: 517125 - DNA, 25 bp, Rattus norvegicus
acctcccgctgccttgtgcgctccc

SEQ ID NO: 517126 - DNA, 25 bp, Rattus norvegicus
gcagcgcatgcgtatctgtgaggcc

SEQ ID NO: 517127 - DNA, 25 bp, Rattus norvegicus
tcgggctgaccttcctaaccagtgc

SEQ ID NO: 517128 - DNA, 25 bp, Rattus norvegicus
gcgtcgggctgaccttcctaaccag

SEQ ID NO: 517129 - DNA, 25 bp, Rattus norvegicus
ggatgactacctaggctcccgcggc

SEQ ID NO: 517130 - DNA, 25 bp, Rattus norvegicus
tctcccggtccgtcggggctgacag

SEQ ID NO: 517131 - DNA, 25 bp, Rattus norvegicus
ttctgatggatgactacctaggctc

SEQ ID NO: 517132 - DNA, 25 bp, Rattus norvegicus
ttaatggtcattattctgatggatg

SEQ ID NO: 517133 - DNA, 25 bp, Rattus norvegicus
ccggcggaatgacgcattaatggtc

SEQ ID NO: 517134 - DNA, 25 bp, Rattus norvegicus
cggcccggcggaatgacgcattaat

SEQ ID NO: 517135 - DNA, 25 bp, Rattus norvegicus
ttcgaggtgccttcctgcgcttgcg

SEQ ID NO: 517136 - DNA, 25 bp, Rattus norvegicus
tcagccggcttcgaggtgccttcct

SEQ ID NO: 517137 - DNA, 25 bp, Rattus norvegicus
tcagcggcccgtggcacgcatggct

SEQ ID NO: 517138 - DNA, 25 bp, Rattus norvegicus
acaccgcggaccttaccttgctctc

SEQ ID NO: 517139 - DNA, 25 bp, Rattus norvegicus
tcgccgttgggtctcgcctccggat

SEQ ID NO: 517140 - DNA, 25 bp, Rattus norvegicus
tgggtctcgcctccggatcgtcgct

SEQ ID NO: 517141 - DNA, 25 bp, Rattus norvegicus
atcgtcgctgtcctcggcgcccgca

SEQ ID NO: 517142 - DNA, 25 bp, Rattus norvegicus
actctcgctgggcacttcatcctga

SEQ ID NO: 517143 - DNA, 25 bp, Rattus norvegicus
tgggcacttcatcctgagccagctg

SEQ ID NO: 517144 - DNA, 25 bp, Rattus norvegicus
acttcatcctgagccagctgctgct

SEQ ID NO: 517145 - DNA, 25 bp, Rattus norvegicus
gggcgcggagaaactccctccacat

SEQ ID NO: 517146 - DNA, 25 bp, Rattus norvegicus
tctccatcttcccattcactggagg

SEQ ID NO: 517147 - DNA, 25 bp, Rattus norvegicus
cactggagggcaagacaaaagcgga

SEQ ID NO: 517148 - DNA, 25 bp, Rattus norvegicus
cgtgtccttggagcgctggccttca

SEQ ID NO: 517149 - DNA, 25 bp, Rattus norvegicus
cggcagtcccgctacaccgagcgca

SEQ ID NO: 517150 - DNA, 25 bp, Rattus norvegicus
ttcccattcactggagggcaagaca

SEQ ID NO: 517151 - DNA, 25 bp, Rattus norvegicus
ccatttagctttcgctgctcaggga

SEQ ID NO: 517152 - DNA, 25 bp, Rattus norvegicus
gtgcacctgtgacggccaccttgac

SEQ ID NO: 517153 - DNA, 25 bp, Rattus norvegicus
ttcctgggacccagacgcgcatcag

SEQ ID NO: 517154 - DNA, 25 bp, Rattus norvegicus
ggctgccacaggctcttccatttag

SEQ ID NO: 517155 - DNA, 25 bp, Rattus norvegicus
gaccgccctacgtagccagggttca

SEQ ID NO: 517156 - DNA, 25 bp, Rattus norvegicus
ggtttcgttacgctgcgctggcaca

SEQ ID NO: 517157 - DNA, 25 bp, Rattus norvegicus
cccgcagagactcacgggacctgta

SEQ ID NO: 517158 - DNA, 25 bp, Rattus norvegicus
agactcacgggactcgtagtgcgcc

SEQ ID NO: 517159 - DNA, 25 bp, Rattus norvegicus
ccactgggactggtagtacgtacgc

SEQ ID NO: 517160 - DNA, 25 bp, Rattus norvegicus
gcaggcctgcgacgctttctcagct

SEQ ID NO: 517161 - DNA, 25 bp, Rattus norvegicus
ggacccacctcacggaatccgagtg

SEQ ID NO: 517162 - DNA, 25 bp, Rattus norvegicus
gttaacacctcctcggtgacgcgcg

SEQ ID NO: 517163 - DNA, 25 bp, Rattus norvegicus
acgcgcatcagctctcgggttaaca

SEQ ID NO: 517164 - DNA, 25 bp, Rattus norvegicus
tggccagacgcacgtcgttttccgc

SEQ ID NO: 517165 - DNA, 25 bp, Rattus norvegicus
agcctaagctggactgcgcgcgcag

SEQ ID NO: 517166 - DNA, 25 bp, Rattus norvegicus
gcgcgacctccgctgtgagaacaga

SEQ ID NO: 517167 - DNA, 25 bp, Rattus norvegicus
tgtcaccgagagtggaaacccagcc

SEQ ID NO: 517168 - DNA, 25 bp, Rattus norvegicus
agatggacggcctgtcaccgagagt

SEQ ID NO: 517169 - DNA, 25 bp, Rattus norvegicus
cccagcgagcagcagatggacggcc

SEQ ID NO: 517170 - DNA, 25 bp, Rattus norvegicus
ccgggctgaatgaggtgctaactgc

SEQ ID NO: 517171 - DNA, 25 bp, Rattus norvegicus
gtgctaactgcggaagccacgcatc

SEQ ID NO: 517172 - DNA, 25 bp, Rattus norvegicus
agccacgcatccttggagcacctga

SEQ ID NO: 517173 - DNA, 25 bp, Rattus norvegicus
ctgcggggtccagcgccatctcgga

SEQ ID NO: 517174 - DNA, 25 bp, Rattus norvegicus
taccctcggtttgttctacgcctgc

SEQ ID NO: 517175 - DNA, 25 bp, Rattus norvegicus
agtggaaacccagccgccgggctga

SEQ ID NO: 517176 - DNA, 25 bp, Rattus norvegicus
tttgttctacgcctgcgcccgactg

SEQ ID NO: 517177 - DNA, 25 bp, Rattus norvegicus
tgccctctacgggaatcctgcggta

SEQ ID NO: 517178 - DNA, 25 bp, Rattus norvegicus
gagaagcagcaagccactcgccggc

SEQ ID NO: 517179 - DNA, 25 bp, Rattus norvegicus
cgtagcagctaaacaatgagttagc

SEQ ID NO: 517180 - DNA, 25 bp, Rattus norvegicus
tcggagcaaacagcacctattttct

SEQ ID NO: 517181 - DNA, 25 bp, Rattus norvegicus
tgacgccaccacgtgctttgccgta

SEQ ID NO: 517182 - DNA, 25 bp, Rattus norvegicus
tctggacttgtgcaacgcagtttca

SEQ ID NO: 517183 - DNA, 25 bp, Rattus norvegicus
cagcggcgaatagaaaactaaaacg

SEQ ID NO: 517184 - DNA, 25 bp, Rattus norvegicus
acagcacctattttctggacttgtg

SEQ ID NO: 517185 - DNA, 25 bp, Rattus norvegicus
tagcattaattttagccaccacgtg

SEQ ID NO: 517186 - DNA, 25 bp, Rattus norvegicus
ggatcaccagtgtcgcgactgtgca

SEQ ID NO: 517187 - DNA, 25 bp, Rattus norvegicus
acgtgctttgccgtatgtgcgtgcg

SEQ ID NO: 517188 - DNA, 25 bp, Rattus norvegicus
gtatgtgcgtgcgtgacgccaccac

SEQ ID NO: 517189 - DNA, 25 bp, Rattus norvegicus
cacggacaccaccattcggagcaaa

SEQ ID NO: 517190 - DNA, 25 bp, Rattus norvegicus
tgtcgcgactgtgcacggacaccac

SEQ ID NO: 517191 - DNA, 25 bp, Rattus norvegicus
tgctttgccgtacgtaggtgcatgc

SEQ ID NO: 517192 - DNA, 25 bp, Rattus norvegicus
cgcagtttcaaaccagcggcgaata

SEQ ID NO: 517193 - DNA, 25 bp, Rattus norvegicus
gcatgcccatgttcgtgcttcccgg

SEQ ID NO: 517194 - DNA, 25 bp, Rattus norvegicus
gccagctcccgggttctttgaacca

SEQ ID NO: 517195 - DNA, 25 bp, Rattus norvegicus
ggtgtcgttccaaatcgcttgaaaa

SEQ ID NO: 517196 - DNA, 25 bp, Rattus norvegicus
cttgaaaacctttgcgagcgcccaa

SEQ ID NO: 517197 - DNA, 25 bp, Rattus norvegicus
cacccagcatccgaatccttaaagg

SEQ ID NO: 517198 - DNA, 25 bp, Rattus norvegicus
ttggacccaggttggaaagcttcgc

SEQ ID NO: 517199 - DNA, 25 bp, Rattus norvegicus
gaaagcttcgcggttccactgctgg

SEQ ID NO: 517200 - DNA, 25 bp, Rattus norvegicus
tccactgctggcgtctgagcgctta

SEQ ID NO: 517201 - DNA, 25 bp, Rattus norvegicus
gagcgcttagcagatcccgcggcca

SEQ ID NO: 517202 - DNA, 25 bp, Rattus norvegicus
ggccacctcatctgttctaggcaaa

SEQ ID NO: 517203 - DNA, 25 bp, Rattus norvegicus
ctaggcaaaagtttcccgtgtgatc

SEQ ID NO: 517204 - DNA, 25 bp, Rattus norvegicus
atctcgaccggaaaatgcgctcctg

SEQ ID NO: 517205 - DNA, 25 bp, Rattus norvegicus
tcctggagcgactactgcaggcgtc

SEQ ID NO: 517206 - DNA, 25 bp, Rattus norvegicus
agacccactacactttcctatcgaa

SEQ ID NO: 517207 - DNA, 25 bp, Rattus norvegicus
cagctactggtgagctccgtgaacc

SEQ ID NO: 517208 - DNA, 25 bp, Rattus norvegicus
agaacctcggctgtggccaagcccg

SEQ ID NO: 517209 - DNA, 25 bp, Rattus norvegicus
cggctgccgtctgcgattcgctaaa

SEQ ID NO: 517210 - DNA, 25 bp, Rattus norvegicus
tgcgattcgctaaagcatgcagttg

SEQ ID NO: 517211 - DNA, 25 bp, Rattus norvegicus
acagcctgagctcggagcgctacta

SEQ ID NO: 517212 - DNA, 25 bp, Rattus norvegicus
gcgcgctactccatggacagcctga

SEQ ID NO: 517213 - DNA, 25 bp, Rattus norvegicus
gacaccttcgaaagaacctcggctg

SEQ ID NO: 517214 - DNA, 25 bp, Rattus norvegicus
tccaagaagtttccgggcagtctcc

SEQ ID NO: 517215 - DNA, 25 bp, Rattus norvegicus
ttagacaaagcgtccaagaagtttc

SEQ ID NO: 517216 - DNA, 25 bp, Rattus norvegicus
cccagaggctggacttagacaaagc

SEQ ID NO: 517217 - DNA, 25 bp, Rattus norvegicus
accttaccctcggaagagggcgctg

SEQ ID NO: 517218 - DNA, 25 bp, Rattus norvegicus
ggcgcgcacttctactcgctggaga

SEQ ID NO: 517219 - DNA, 25 bp, Rattus norvegicus
gcatgcagttgggagagcagctact

SEQ ID NO: 517220 - DNA, 25 bp, Rattus norvegicus
ttctactcgctggagagtgctcgcg

SEQ ID NO: 517221 - DNA, 25 bp, Rattus norvegicus
ctcggaagccgagacgtgcggtccc

SEQ ID NO: 517222 - DNA, 25 bp, Rattus norvegicus
gacgtgcggtccctgatgcccaact

SEQ ID NO: 517223 - DNA, 25 bp, Rattus norvegicus
tgcccaactcgcaccggccaccgcg

SEQ ID NO: 517224 - DNA, 25 bp, Rattus norvegicus
cgcgtccgaagcgtgcctgcaggat

SEQ ID NO: 517225 - DNA, 25 bp, Rattus norvegicus
cctgcaggatggtcgggacacatcg

SEQ ID NO: 517226 - DNA, 25 bp, Rattus norvegicus
atcgggcaaaggtggcccgcacgtc

SEQ ID NO: 517227 - DNA, 25 bp, Rattus norvegicus
cccagttctcgatggtgcgagtggc

SEQ ID NO: 517228 - DNA, 25 bp, Rattus norvegicus
gcgcggtccaaagagctgctcacgt

SEQ ID NO: 517229 - DNA, 25 bp, Rattus norvegicus
aaagagctgctcacgtccgcggtgt

SEQ ID NO: 517230 - DNA, 25 bp, Rattus norvegicus
tcacgtccgcggtgttcaccatgtc

SEQ ID NO: 517231 - DNA, 25 bp, Rattus norvegicus
gcggtgttcaccatgtctcgggccg

SEQ ID NO: 517232 - DNA, 25 bp, Rattus norvegicus
gagccagctgttccggcccgagcag

SEQ ID NO: 517233 - DNA, 25 bp, Rattus norvegicus
gcccggatctctccgctcgagggaa

SEQ ID NO: 517234 - DNA, 25 bp, Rattus norvegicus
tccgctcgagggaaggaactgtagt

SEQ ID NO: 517235 - DNA, 25 bp, Rattus norvegicus
actcgcttctgacgcttggcggcct

SEQ ID NO: 517236 - DNA, 25 bp, Rattus norvegicus
gtagccctgaagtcacccgcgctgt

SEQ ID NO: 517237 - DNA, 25 bp, Rattus norvegicus
gtgagtgtgtgtagccctgaagtca

SEQ ID NO: 517238 - DNA, 25 bp, Rattus norvegicus
acagcccaagcggtgagccgacgtc

SEQ ID NO: 517239 - DNA, 25 bp, Rattus norvegicus
agcctgaggtccagcgacagcccaa

SEQ ID NO: 517240 - DNA, 25 bp, Rattus norvegicus
gcatatgctgcagtgcctctgtgga

SEQ ID NO: 517241 - DNA, 25 bp, Rattus norvegicus
cgctttctctgaagaaaggagtgca

SEQ ID NO: 517242 - DNA, 25 bp, Rattus norvegicus
catgaagattcttgcgctttctctg

SEQ ID NO: 517243 - DNA, 25 bp, Rattus norvegicus
cgcgcgagtctctccatgaagattc

SEQ ID NO: 517244 - DNA, 25 bp, Rattus norvegicus
ccatcgccgggtctcaggagtagcc

SEQ ID NO: 517245 - DNA, 25 bp, Rattus norvegicus
acgtctccgggacgtgccatgggct

SEQ ID NO: 517246 - DNA, 25 bp, Rattus norvegicus
gcccggcgaacgaatttcacgtctc

SEQ ID NO: 517247 - DNA, 25 bp, Rattus norvegicus
tgaaagtcccaaagtgtcgcgcgga

SEQ ID NO: 517248 - DNA, 25 bp, Rattus norvegicus
tccttgtgacttgctagggcggcct

SEQ ID NO: 517249 - DNA, 25 bp, Rattus norvegicus
ttagtcacttcgcataacttgggcg

SEQ ID NO: 517250 - DNA, 25 bp, Rattus norvegicus
ccctgattgaggcactgagttgagc

SEQ ID NO: 517251 - DNA, 25 bp, Rattus norvegicus
ctgcttccaaaccaaaccctgattg

SEQ ID NO: 517252 - DNA, 25 bp, Rattus norvegicus
caggtccctgtaagtctcctgcttc

SEQ ID NO: 517253 - DNA, 25 bp, Rattus norvegicus
tgcacccggaatagccaggtccctg

SEQ ID NO: 517254 - DNA, 25 bp, Rattus norvegicus
ccctccgtgttcactggacattgca

SEQ ID NO: 517255 - DNA, 25 bp, Rattus norvegicus
ggtaagggaccctgactctagagtg

SEQ ID NO: 517256 - DNA, 25 bp, Rattus norvegicus
gtcctgcgtgggatgtttctcttac

SEQ ID NO: 517257 - DNA, 25 bp, Rattus norvegicus
gaagggacccgtcgcgacatttgac

SEQ ID NO: 517258 - DNA, 25 bp, Rattus norvegicus
ccgtctaggtcgtgtaggaaccctg

SEQ ID NO: 517259 - DNA, 25 bp, Rattus norvegicus
tagcaggcccttggcaagctccacg

SEQ ID NO: 517260 - DNA, 25 bp, Rattus norvegicus
attgtccaccgtggcgttccgtagc

SEQ ID NO: 517261 - DNA, 25 bp, Rattus norvegicus
cagcccaggtcctctgtgatattta

SEQ ID NO: 517262 - DNA, 25 bp, Rattus norvegicus
ccaagcctgtcacgagttagtcact

SEQ ID NO: 517263 - DNA, 25 bp, Rattus norvegicus
aactggcgctcagtgtgttccaggc

SEQ ID NO: 517264 - DNA, 25 bp, Rattus norvegicus
cttagtgattggttggtagaggccc

SEQ ID NO: 517265 - DNA, 25 bp, Rattus norvegicus
taacggacacgtcggccgccatctt

SEQ ID NO: 517266 - DNA, 25 bp, Rattus norvegicus
tctcgggagtttccgcttcggcctc

SEQ ID NO: 517267 - DNA, 25 bp, Rattus norvegicus
gcgatcgacggtctcgggagtttcc

SEQ ID NO: 517268 - DNA, 25 bp, Rattus norvegicus
actcttgttcgggtgtccggcgatc

SEQ ID NO: 517269 - DNA, 25 bp, Rattus norvegicus
acaagagcgttggtaccgccctgtt

SEQ ID NO: 517270 - DNA, 25 bp, Rattus norvegicus
atcgagcggcggcaactcttgttcg

SEQ ID NO: 517271 - DNA, 25 bp, Rattus norvegicus
atctcttccggatcgagcggcggca

SEQ ID NO: 517272 - DNA, 25 bp, Rattus norvegicus
ttccaggcgtttccggatctcttcc

SEQ ID NO: 517273 - DNA, 25 bp, Rattus norvegicus
ctattggctggacccagcgccgcga

SEQ ID NO: 517274 - DNA, 25 bp, Rattus norvegicus
cgctcagtgtgttccaggcgtttcc

SEQ ID NO: 517275 - DNA, 25 bp, Rattus norvegicus
gaggcctcggatcagtatcttgcgg

SEQ ID NO: 517276 - DNA, 25 bp, Rattus norvegicus
cggatcagtatcttgcggcggttac

SEQ ID NO: 517277 - DNA, 25 bp, Rattus norvegicus
tcctagcagcttacaggtctcgggg

SEQ ID NO: 517278 - DNA, 25 bp, Rattus norvegicus
ctgcttacgtaagaacggagcttta

SEQ ID NO: 517279 - DNA, 25 bp, Rattus norvegicus
actgacctcggcactatgcgcattg

SEQ ID NO: 517280 - DNA, 25 bp, Rattus norvegicus
cggcactatgcgcattgcttacgta

SEQ ID NO: 517281 - DNA, 25 bp, Rattus norvegicus
ttgcttacgtaagaacggagcttta

SEQ ID NO: 517282 - DNA, 25 bp, Rattus norvegicus
ttataaaggcgtccgtatcccgcga

SEQ ID NO: 517283 - DNA, 25 bp, Rattus norvegicus
atcccgcgacgcctgcttacgtaag

SEQ ID NO: 517284 - DNA, 25 bp, Rattus norvegicus
ggagctttatcaaggcatccgtata

SEQ ID NO: 517285 - DNA, 25 bp, Rattus norvegicus
tccgtataccgtgacgcctgctgta

SEQ ID NO: 517286 - DNA, 25 bp, Rattus norvegicus
gcctgctgtaggtgtcgtaggttta

SEQ ID NO: 517287 - DNA, 25 bp, Rattus norvegicus
gtcgtaggtttatcagttagcaggc

SEQ ID NO: 517288 - DNA, 25 bp, Rattus norvegicus
ttatcagttagcaggcggcttccgg

SEQ ID NO: 517289 - DNA, 25 bp, Rattus norvegicus
gaggttctccgctcactagttcatc

SEQ ID NO: 517290 - DNA, 25 bp, Rattus norvegicus
gttggcctttgaggttctccgctca

SEQ ID NO: 517291 - DNA, 25 bp, Rattus norvegicus
tttaaatgtccaacggccacgctga

SEQ ID NO: 517292 - DNA, 25 bp, Rattus norvegicus
ctccatcggagagcgcagagctctc

SEQ ID NO: 517293 - DNA, 25 bp, Rattus norvegicus
gacccactccatcggagagcgcaga

SEQ ID NO: 517294 - DNA, 25 bp, Rattus norvegicus
cacgctgacatcctggcctgctctc

SEQ ID NO: 517295 - DNA, 25 bp, Rattus norvegicus
tcccgaggagccgatttaaatgtcc

SEQ ID NO: 517296 - DNA, 25 bp, Rattus norvegicus
gccgcctcccgaggagccgatttaa

SEQ ID NO: 517297 - DNA, 25 bp, Rattus norvegicus
tggatcctcgactccggtgcggcca

SEQ ID NO: 517298 - DNA, 25 bp, Rattus norvegicus
gacaacacgcgctggtgagtgtacc

SEQ ID NO: 517299 - DNA, 25 bp, Rattus norvegicus
gctacgcggtgctggagcacttcca

SEQ ID NO: 517300 - DNA, 25 bp, Rattus norvegicus
cgggctccttcttcggctacgcggt

SEQ ID NO: 517301 - DNA, 25 bp, Rattus norvegicus
ggcgggcgcctacaacatcgacgcg

SEQ ID NO: 517302 - DNA, 25 bp, Rattus norvegicus
tcagacttggagtgcacagctcgcg

SEQ ID NO: 517303 - DNA, 25 bp, Rattus norvegicus
cagcgtcccgggctcagacttggag

SEQ ID NO: 517304 - DNA, 25 bp, Rattus norvegicus
tggagcacttccacgacaacacgcg

SEQ ID NO: 517305 - DNA, 25 bp, Rattus norvegicus
cccaccggttgacagcgctgcaagt

SEQ ID NO: 517306 - DNA, 25 bp, Rattus norvegicus
tgcgggtgccaaaaggctcagactc

SEQ ID NO: 517307 - DNA, 25 bp, Rattus norvegicus
tcagactctccgaagctggtgggca

SEQ ID NO: 517308 - DNA, 25 bp, Rattus norvegicus
ggcacttgctcacacccatgctttg

SEQ ID NO: 517309 - DNA, 25 bp, Rattus norvegicus
caacagcctgatgctcatgtacttg

SEQ ID NO: 517310 - DNA, 25 bp, Rattus norvegicus
tgcccatagtatcacgtgccaagag

SEQ ID NO: 517311 - DNA, 25 bp, Rattus norvegicus
tctcgaggactcactgttctgcaca

SEQ ID NO: 517312 - DNA, 25 bp, Rattus norvegicus
tgccaagaggtctagtctcgaggac

SEQ ID NO: 517313 - DNA, 25 bp, Rattus norvegicus
cccggttgcttatgcggacaacaca

SEQ ID NO: 517314 - DNA, 25 bp, Rattus norvegicus
tgcggaaccctccattcctagttcg

SEQ ID NO: 517315 - DNA, 25 bp, Rattus norvegicus
tcctagttcgaacgtcaggacgtcc

SEQ ID NO: 517316 - DNA, 25 bp, Rattus norvegicus
tgcaaacgtctctcacggtgtctgg

SEQ ID NO: 517317 - DNA, 25 bp, Rattus norvegicus
ctggcctcggggtgaataaatctcc

SEQ ID NO: 517318 - DNA, 25 bp, Rattus norvegicus
tcatgtacttgagtcctggcccaac

SEQ ID NO: 517319 - DNA, 25 bp, Rattus norvegicus
agctactattcctgctgcccgggta

SEQ ID NO: 517320 - DNA, 25 bp, Rattus norvegicus
cccgagacctttggtgccatctgga

SEQ ID NO: 517321 - DNA, 25 bp, Rattus norvegicus
gcgcacccgtgttttgggaagcttc

SEQ ID NO: 517322 - DNA, 25 bp, Rattus norvegicus
cttggtggtctaaggatgctgttcc

SEQ ID NO: 517323 - DNA, 25 bp, Rattus norvegicus
cggaggagcccagacttttatgaac

SEQ ID NO: 517324 - DNA, 25 bp, Rattus norvegicus
gcccaaggttgttgtacccagcgcg

SEQ ID NO: 517325 - DNA, 25 bp, Rattus norvegicus
ctgaggttttccaggatcccgcaaa

SEQ ID NO: 517326 - DNA, 25 bp, Rattus norvegicus
gtcttctgagaaacgcgtgcttgcc

SEQ ID NO: 517327 - DNA, 25 bp, Rattus norvegicus
aatgcggccgaaggagctactattc

SEQ ID NO: 517328 - DNA, 25 bp, Rattus norvegicus
gtcaggaagtccctacccgagtcca

SEQ ID NO: 517329 - DNA, 25 bp, Rattus norvegicus
ttcacttgagcaacaaccgagcggc

SEQ ID NO: 517330 - DNA, 25 bp, Rattus norvegicus
gcgcccggccagaaatagtcagatc

SEQ ID NO: 517331 - DNA, 25 bp, Rattus norvegicus
cagcctgctccagcgtcttctgaga

SEQ ID NO: 517332 - DNA, 25 bp, Rattus norvegicus
ttggtctctccggtggtttaaatgc

SEQ ID NO: 517333 - DNA, 25 bp, Rattus norvegicus
tcctcagagaccatgtgggaatcta

SEQ ID NO: 517334 - DNA, 25 bp, Rattus norvegicus
gcttgcccgagtcttccgaaacttg

SEQ ID NO: 517335 - DNA, 25 bp, Rattus norvegicus
gcgcacgcaggatatctcccatctg

SEQ ID NO: 517336 - DNA, 25 bp, Rattus norvegicus
ccgaaacttgtacaccgcccaggtg

SEQ ID NO: 517337 - DNA, 25 bp, Rattus norvegicus
ggtccttgaccgtcttcaccgatta

SEQ ID NO: 517338 - DNA, 25 bp, Rattus norvegicus
cccaggaagtccttgcggtccttga

SEQ ID NO: 517339 - DNA, 25 bp, Rattus norvegicus
gtagcgtctctgttgccatggaacc

SEQ ID NO: 517340 - DNA, 25 bp, Rattus norvegicus
atgcgcgccacgaagagttcctgga

SEQ ID NO: 517341 - DNA, 25 bp, Rattus norvegicus
tcctggaccagctgcagcaggtata

SEQ ID NO: 517342 - DNA, 25 bp, Rattus norvegicus
ctcgcccaggataagctcaggatgc

SEQ ID NO: 517343 - DNA, 25 bp, Rattus norvegicus
tgccgcgccaaagcgaagaacccta

SEQ ID NO: 517344 - DNA, 25 bp, Rattus norvegicus
gtgtaaatgacacctccagcgcgtt

SEQ ID NO: 517345 - DNA, 25 bp, Rattus norvegicus
cgtttctctgcgagcaagcgcatta

SEQ ID NO: 517346 - DNA, 25 bp, Rattus norvegicus
ccgcccaggtgatcggagatgactt

SEQ ID NO: 517347 - DNA, 25 bp, Rattus norvegicus
tgcatcgcggaggtgcgtcccaccg

SEQ ID NO: 517348 - DNA, 25 bp, Rattus norvegicus
atgcatcgcggaggtgcgtcccacc

SEQ ID NO: 517349 - DNA, 25 bp, Rattus norvegicus
gcaccaccaccacgtcggaggccga

SEQ ID NO: 517350 - DNA, 25 bp, Rattus norvegicus
tcaacacggccgacagaagctcgtc

SEQ ID NO: 517351 - DNA, 25 bp, Rattus norvegicus
cgatgcatcgcggaggtgcgtccca

SEQ ID NO: 517352 - DNA, 25 bp, Rattus norvegicus
ggggtgcgccgtccgtgcaccacca

SEQ ID NO: 517353 - DNA, 25 bp, Rattus norvegicus
cctgcagccgatgcatcgcggaggt

SEQ ID NO: 517354 - DNA, 25 bp, Rattus norvegicus
agcagggcgcggcttgcagcgcgga

SEQ ID NO: 517355 - DNA, 25 bp, Rattus norvegicus
gtggcccagcactacctgcagccga

SEQ ID NO: 517356 - DNA, 25 bp, Rattus norvegicus
agcactacctgcagccgatgcatcg

SEQ ID NO: 517357 - DNA, 25 bp, Rattus norvegicus
ctacctgcagccgatgcatcgcgga

SEQ ID NO: 517358 - DNA, 25 bp, Rattus norvegicus
tacctgcagccgatgcatcgcggag

SEQ ID NO: 517359 - DNA, 25 bp, Rattus norvegicus
gtcaacacggccgacagaagctcgt

SEQ ID NO: 517360 - DNA, 25 bp, Rattus norvegicus
acacggccgacagaagctcgtcggg

SEQ ID NO: 517361 - DNA, 25 bp, Rattus norvegicus
tgccgctctgctttgccttcattgg

SEQ ID NO: 517362 - DNA, 25 bp, Rattus norvegicus
tcacggccaactaggataaaaggtc

SEQ ID NO: 517363 - DNA, 25 bp, Rattus norvegicus
tcgagtcctcggacatgacggctgc

SEQ ID NO: 517364 - DNA, 25 bp, Rattus norvegicus
cggcaccgcgaagagagcttcttcc

SEQ ID NO: 517365 - DNA, 25 bp, Rattus norvegicus
ccggagagagtagaagtcgattttt

SEQ ID NO: 517366 - DNA, 25 bp, Rattus norvegicus
aatactgctcgtagaggagttcacg

SEQ ID NO: 517367 - DNA, 25 bp, Rattus norvegicus
agcagagcttcctctagcgggtcgg

SEQ ID NO: 517368 - DNA, 25 bp, Rattus norvegicus
acgtgtggatgtcagtcatacttta

SEQ ID NO: 517369 - DNA, 25 bp, Rattus norvegicus
tcatactttagtcccgcctccgagg

SEQ ID NO: 517370 - DNA, 25 bp, Rattus norvegicus
gagcttgactcgctgttcctccgga

SEQ ID NO: 517371 - DNA, 25 bp, Rattus norvegicus
tcctccggagcgctaaaacctttca

SEQ ID NO: 517372 - DNA, 25 bp, Rattus norvegicus
ttctctgaggtgacgtcacggcgtc

SEQ ID NO: 517373 - DNA, 25 bp, Rattus norvegicus
tgcagctcgtagtcgtccctgttga

SEQ ID NO: 517374 - DNA, 25 bp, Rattus norvegicus
gcggccaccgaatgccaaaccgagg

SEQ ID NO: 517375 - DNA, 25 bp, Rattus norvegicus
ttgagcgcgaccaacggtagagaga

SEQ ID NO: 517376 - DNA, 25 bp, Rattus norvegicus
ccaacaaactgcgagtgggatcggg

SEQ ID NO: 517377 - DNA, 25 bp, Rattus norvegicus
ggggcgcgtctcaaactcgcggatc

SEQ ID NO: 517378 - DNA, 25 bp, Rattus norvegicus
ctcgcggatctccaagtactcgaaa

SEQ ID NO: 517379 - DNA, 25 bp, Rattus norvegicus
gatctccaagtactcgaaacccatc

SEQ ID NO: 517380 - DNA, 25 bp, Rattus norvegicus
gttgtccgcgggttcaagaacagcg

SEQ ID NO: 517381 - DNA, 25 bp, Rattus norvegicus
cggcgcctcactcccacgttgagcg

SEQ ID NO: 517382 - DNA, 25 bp, Rattus norvegicus
ctgccaggcatccaacaaactgcga

SEQ ID NO: 517383 - DNA, 25 bp, Rattus norvegicus
cgaccaacggtagagagaacaagta

SEQ ID NO: 517384 - DNA, 25 bp, Rattus norvegicus
tagagagaacaagtaggagtccacg

SEQ ID NO: 517385 - DNA, 25 bp, Rattus norvegicus
ggagtccacggacacggatcccacg

SEQ ID NO: 517386 - DNA, 25 bp, Rattus norvegicus
agacatggcaagcaaccctgggccc

SEQ ID NO: 517387 - DNA, 25 bp, Rattus norvegicus
gggcctcccgcagacatggcaagca

SEQ ID NO: 517388 - DNA, 25 bp, Rattus norvegicus
ttcaagaacagcgagaggcggcgcc

SEQ ID NO: 517389 - DNA, 25 bp, Rattus norvegicus
gccgggacggacctcctaatcttca

SEQ ID NO: 517390 - DNA, 25 bp, Rattus norvegicus
ttggaggggcttctgtaaactactg

SEQ ID NO: 517391 - DNA, 25 bp, Rattus norvegicus
gtctcccgctctctttgcagtgctg

SEQ ID NO: 517392 - DNA, 25 bp, Rattus norvegicus
atttcgtagacctcacccagccggg

SEQ ID NO: 517393 - DNA, 25 bp, Rattus norvegicus
gcgcagcgatgacctgatcccaagc

SEQ ID NO: 517394 - DNA, 25 bp, Rattus norvegicus
ctaatcttcagaaccgcgggccaca

SEQ ID NO: 517395 - DNA, 25 bp, Rattus norvegicus
gcgggccacagggagttaaattgct

SEQ ID NO: 517396 - DNA, 25 bp, Rattus norvegicus
gccttcctcttctctgtcgcggttg

SEQ ID NO: 517397 - DNA, 25 bp, Rattus norvegicus
ggcacgcttctagcctcggtccaga

SEQ ID NO: 517398 - DNA, 25 bp, Rattus norvegicus
tccagactctgccttgtaaacgggt

SEQ ID NO: 517399 - DNA, 25 bp, Rattus norvegicus
ttggacaccttacaacgcttgcgcc

SEQ ID NO: 517400 - DNA, 25 bp, Rattus norvegicus
ggggcacggcttgttattttggaca

SEQ ID NO: 517401 - DNA, 25 bp, Rattus norvegicus
ttggggtacaaacgtctacttcgca

SEQ ID NO: 517402 - DNA, 25 bp, Rattus norvegicus
acttttcgcctcttggaattccaga

SEQ ID NO: 517403 - DNA, 25 bp, Rattus norvegicus
tccgcgatgcatcggctgcaggtag

SEQ ID NO: 517404 - DNA, 25 bp, Rattus norvegicus
ttctgtcggccgtgttgaccgcggt

SEQ ID NO: 517405 - DNA, 25 bp, Rattus norvegicus
ccgacgagcttctgtcggccgtgtt

SEQ ID NO: 517406 - DNA, 25 bp, Rattus norvegicus
tgcaggacaccacccccgacgagct

SEQ ID NO: 517407 - DNA, 25 bp, Rattus norvegicus
gtggtgcacggacggcgcaccccca

SEQ ID NO: 517408 - DNA, 25 bp, Rattus norvegicus
ggcctccgacgtggtggtggtgcac

SEQ ID NO: 517409 - DNA, 25 bp, Rattus norvegicus
cgatgcatcggctgcaggtagtgct

SEQ ID NO: 517410 - DNA, 25 bp, Rattus norvegicus
ctccgcgatgcatcggctgcaggta

SEQ ID NO: 517411 - DNA, 25 bp, Rattus norvegicus
acctccgcgatgcatcggctgcagg

SEQ ID NO: 517412 - DNA, 25 bp, Rattus norvegicus
tgggacgcacctccgcgatgcatcg

SEQ ID NO: 517413 - DNA, 25 bp, Rattus norvegicus
tcggtgggacgcacctccgcgatgc

SEQ ID NO: 517414 - DNA, 25 bp, Rattus norvegicus
acgagcttctgtcggccgtgttgac

SEQ ID NO: 517415 - DNA, 25 bp, Rattus norvegicus
cggctgcaggtagtgctgggccacc

SEQ ID NO: 517416 - DNA, 25 bp, Rattus norvegicus
tcggccgtgttgaccgcggttctcc

SEQ ID NO: 517417 - DNA, 25 bp, Rattus norvegicus
gaaacctccggtgccttcctgcaga

SEQ ID NO: 517418 - DNA, 25 bp, Rattus norvegicus
cctagatccggtttacaactgagcg

SEQ ID NO: 517419 - DNA, 25 bp, Rattus norvegicus
gacgtgtgcgcgcatgcataaccta

SEQ ID NO: 517420 - DNA, 25 bp, Rattus norvegicus
cactcggcgaaaacggcagagccca

SEQ ID NO: 517421 - DNA, 25 bp, Rattus norvegicus
gactggaatacgagacactcggcga

SEQ ID NO: 517422 - DNA, 25 bp, Rattus norvegicus
gtcccggttgcagatgactggaata

SEQ ID NO: 517423 - DNA, 25 bp, Rattus norvegicus
ccgagaacaagagcacgaacacgta

SEQ ID NO: 517424 - DNA, 25 bp, Rattus norvegicus
gcctagcgatgcctgccagcgagac

SEQ ID NO: 517425 - DNA, 25 bp, Rattus norvegicus
tgggacttcagcacgcagcaggtac

SEQ ID NO: 517426 - DNA, 25 bp, Rattus norvegicus
acacatggacgcacggacgcacaga

SEQ ID NO: 517427 - DNA, 25 bp, Rattus norvegicus
tgactccagtccagagtcctgccgg

SEQ ID NO: 517428 - DNA, 25 bp, Rattus norvegicus
agagggcagtcccacctcgtgactc

SEQ ID NO: 517429 - DNA, 25 bp, Rattus norvegicus
tgcaccggtagcgaccaccaagtgc

SEQ ID NO: 517430 - DNA, 25 bp, Rattus norvegicus
cacgaacacgtagccgggcgaaagt

SEQ ID NO: 517431 - DNA, 25 bp, Rattus norvegicus
agctcacggtcctacattcctattg

SEQ ID NO: 517432 - DNA, 25 bp, Rattus norvegicus
gaggcctctccgattggacgttcga

SEQ ID NO: 517433 - DNA, 25 bp, Rattus norvegicus
ccattggctgcctgaaatgcgcatg

SEQ ID NO: 517434 - DNA, 25 bp, Rattus norvegicus
caagcggaatcgatgaggcctctcc

SEQ ID NO: 517435 - DNA, 25 bp, Rattus norvegicus
ctagtcgtgatttgttggtgcggca

SEQ ID NO: 517436 - DNA, 25 bp, Rattus norvegicus
ggggattattctagtcgtgatttgt

SEQ ID NO: 517437 - DNA, 25 bp, Rattus norvegicus
acggcggcactcagtatgttgatga

SEQ ID NO: 517438 - DNA, 25 bp, Rattus norvegicus
tcatcgtataagaacggcggcactc

SEQ ID NO: 517439 - DNA, 25 bp, Rattus norvegicus
ctctccgattggacgttcgaggtga

SEQ ID NO: 517440 - DNA, 25 bp, Rattus norvegicus
ggtcctacattcctattggtcatcg

SEQ ID NO: 517441 - DNA, 25 bp, Rattus norvegicus
aatgcgcatgccctttggctgcagt

SEQ ID NO: 517442 - DNA, 25 bp, Rattus norvegicus
gctgcctgaaatgcgcatgcccttt

SEQ ID NO: 517443 - DNA, 25 bp, Rattus norvegicus
ggagccgctggaagtccaccgccta

SEQ ID NO: 517444 - DNA, 25 bp, Rattus norvegicus
tcctattggtcatcgtataagaacg

SEQ ID NO: 517445 - DNA, 25 bp, Rattus norvegicus
tccgcgtcgcgatcctcatgcgagt

SEQ ID NO: 517446 - DNA, 25 bp, Rattus norvegicus
aacaggtctcagatcgctccggccg

SEQ ID NO: 517447 - DNA, 25 bp, Rattus norvegicus
ttgaagaggcgaaccaacaggtctc

SEQ ID NO: 517448 - DNA, 25 bp, Rattus norvegicus
tcctcatgcgagtggctcctacctg

SEQ ID NO: 517449 - DNA, 25 bp, Rattus norvegicus
gacggcttttcacagcccgcctgga

SEQ ID NO: 517450 - DNA, 25 bp, Rattus norvegicus
tcgcaaagcgaagcggacggctttt

SEQ ID NO: 517451 - DNA, 25 bp, Rattus norvegicus
ctgagagtcagaggtgtcgcaaagc

SEQ ID NO: 517452 - DNA, 25 bp, Rattus norvegicus
gcggccaagccaggcgggcatctaa

SEQ ID NO: 517453 - DNA, 25 bp, Rattus norvegicus
attctggctcgctgaagtgctaggt

SEQ ID NO: 517454 - DNA, 25 bp, Rattus norvegicus
gctctgctcgcgatcctagaggcga

SEQ ID NO: 517455 - DNA, 25 bp, Rattus norvegicus
tcgcccttctctggggatcgctgtg

SEQ ID NO: 517456 - DNA, 25 bp, Rattus norvegicus
cgcgcgtctggaagcgagacccaga

SEQ ID NO: 517457 - DNA, 25 bp, Rattus norvegicus
cacgctgcctgggaaccgaagcgca

SEQ ID NO: 517458 - DNA, 25 bp, Rattus norvegicus
gctttccttgcagcgggccgcagat

SEQ ID NO: 517459 - DNA, 25 bp, Rattus norvegicus
ctgagactcgggagtgcatctacta

SEQ ID NO: 517460 - DNA, 25 bp, Rattus norvegicus
tgcatctactacaacgccaactggg

SEQ ID NO: 517461 - DNA, 25 bp, Rattus norvegicus
tacaacgccaactgggagctggagc

SEQ ID NO: 517462 - DNA, 25 bp, Rattus norvegicus
ggagctggagcgcaccaaccagagc

SEQ ID NO: 517463 - DNA, 25 bp, Rattus norvegicus
agcgcaccaaccagagcggcctgga

SEQ ID NO: 517464 - DNA, 25 bp, Rattus norvegicus
caggacaagcggctgcactgctatg

SEQ ID NO: 517465 - DNA, 25 bp, Rattus norvegicus
ctgcactgctatgcctcgtggcgca

SEQ ID NO: 517466 - DNA, 25 bp, Rattus norvegicus
gctatgcctcgtggcgcaacagctc

SEQ ID NO: 517467 - DNA, 25 bp, Rattus norvegicus
ggcgcaacagctcgggcaccatcga

SEQ ID NO: 517468 - DNA, 25 bp, Rattus norvegicus
accatcgagctggtgaagaagggct

SEQ ID NO: 517469 - DNA, 25 bp, Rattus norvegicus
agggctgctggctagatgacttcaa

SEQ ID NO: 517470 - DNA, 25 bp, Rattus norvegicus
agatgacttcaattgctacgacagg

SEQ ID NO: 517471 - DNA, 25 bp, Rattus norvegicus
ctacgacaggtacccggggcacatt

SEQ ID NO: 517472 - DNA, 25 bp, Rattus norvegicus
ccggggcacatttccgctgctgctg

SEQ ID NO: 517473 - DNA, 25 bp, Rattus norvegicus
cagttcctccagcgtcgggacgcgg

SEQ ID NO: 517474 - DNA, 25 bp, Rattus norvegicus
gggctgacggcgctgcagttcctcc

SEQ ID NO: 517475 - DNA, 25 bp, Rattus norvegicus
gtttctgaatggcttcttggccggg

SEQ ID NO: 517476 - DNA, 25 bp, Rattus norvegicus
cgcggaggtttctgaatggcttctt

SEQ ID NO: 517477 - DNA, 25 bp, Rattus norvegicus
gtctcagggactcgcggaggtttct

SEQ ID NO: 517478 - DNA, 25 bp, Rattus norvegicus
aagggcttcgcttcgcgtctcaggg

SEQ ID NO: 517479 - DNA, 25 bp, Rattus norvegicus
tgcaaagggcttcgcttcgcgtctc

SEQ ID NO: 517480 - DNA, 25 bp, Rattus norvegicus
aatcatggctgcaaagggcttcgct

SEQ ID NO: 517481 - DNA, 25 bp, Rattus norvegicus
ctggcggcccagaatcatggctgca

SEQ ID NO: 517482 - DNA, 25 bp, Rattus norvegicus
gcagagacaaagtgctggcggccca

SEQ ID NO: 517483 - DNA, 25 bp, Rattus norvegicus
attggacctttctggccgcgaagtc

SEQ ID NO: 517484 - DNA, 25 bp, Rattus norvegicus
tcccgagcgggcgattggacctttc

SEQ ID NO: 517485 - DNA, 25 bp, Rattus norvegicus
gaggccctcagcagaggaagcctct

SEQ ID NO: 517486 - DNA, 25 bp, Rattus norvegicus
gcgcacgaggccctcagcagaggaa

SEQ ID NO: 517487 - DNA, 25 bp, Rattus norvegicus
ctgcgccgagagaagttcccattca

SEQ ID NO: 517488 - DNA, 25 bp, Rattus norvegicus
aagtctgcaagatcttcgctgcggc

SEQ ID NO: 517489 - DNA, 25 bp, Rattus norvegicus
tatagtcagacgcacgcaccgggag

SEQ ID NO: 517490 - DNA, 25 bp, Rattus norvegicus
tgacgtaagcgaagttggccatgcc

SEQ ID NO: 517491 - DNA, 25 bp, Rattus norvegicus
catcatgtaggcgatgaggccctcc

SEQ ID NO: 517492 - DNA, 25 bp, Rattus norvegicus
tcaggggcatcctcatcggagaggc

SEQ ID NO: 517493 - DNA, 25 bp, Rattus norvegicus
tcctcgtgctttctcctcagggtgg

SEQ ID NO: 517494 - DNA, 25 bp, Rattus norvegicus
cctccatctggatcttcagggcatc

SEQ ID NO: 517495 - DNA, 25 bp, Rattus norvegicus
accctcttggtgaaagcgaacagta

SEQ ID NO: 517496 - DNA, 25 bp, Rattus norvegicus
tccatacagtggatacggtctccgc

SEQ ID NO: 517497 - DNA, 25 bp, Rattus norvegicus
gagcggctcagacaaggcatctgca

SEQ ID NO: 517498 - DNA, 25 bp, Rattus norvegicus
gtcggacagggccagatactcaatg

SEQ ID NO: 517499 - DNA, 25 bp, Rattus norvegicus
ttggcgaaggtctggaagttgaaca

SEQ ID NO: 517500 - DNA, 25 bp, Rattus norvegicus
atgccggcctcccacttgacgtaag

SEQ ID NO: 517501 - DNA, 25 bp, Rattus norvegicus
aggtgagcgtgcgtttacacaaccc

SEQ ID NO: 517502 - DNA, 25 bp, Rattus norvegicus
gacagttccctgagcggaacaaccc

SEQ ID NO: 517503 - DNA, 25 bp, Rattus norvegicus
acaacacgacagttccctgagcgga

SEQ ID NO: 517504 - DNA, 25 bp, Rattus norvegicus
gctaagcacttactccacaacacga

SEQ ID NO: 517505 - DNA, 25 bp, Rattus norvegicus
tttttcccacgctaagcacttactc

SEQ ID NO: 517506 - DNA, 25 bp, Rattus norvegicus
gccactcgatgtggttacctttttc

SEQ ID NO: 517507 - DNA, 25 bp, Rattus norvegicus
cgatgcaaattagccactcgatgtg

SEQ ID NO: 517508 - DNA, 25 bp, Rattus norvegicus
gtcattaggccgtttgtccagtgaa

SEQ ID NO: 517509 - DNA, 25 bp, Rattus norvegicus
tgcgtttacacaaccctatacgatg

SEQ ID NO: 517510 - DNA, 25 bp, Rattus norvegicus
ctaagctcaacgcagcctcagcgtg

SEQ ID NO: 517511 - DNA, 25 bp, Rattus norvegicus
ccgtttgtccagtgaaggtgagcgt

SEQ ID NO: 517512 - DNA, 25 bp, Rattus norvegicus
aggtgatacgcacgcacggaccgcg

SEQ ID NO: 517513 - DNA, 25 bp, Rattus norvegicus
caaccctatacgatgcaaattagcc

SEQ ID NO: 517514 - DNA, 25 bp, Rattus norvegicus
gtctggagaggtgatacgcacgcac

SEQ ID NO: 517515 - DNA, 25 bp, Rattus norvegicus
gcgatctcgtctaaccgagggcaca

SEQ ID NO: 517516 - DNA, 25 bp, Rattus norvegicus
agaggagatccgaccgcttcaaggc

SEQ ID NO: 517517 - DNA, 25 bp, Rattus norvegicus
cgatcagagacgaacaggggaaccc

SEQ ID NO: 517518 - DNA, 25 bp, Rattus norvegicus
atctcagcccattggcgagtctgcg

SEQ ID NO: 517519 - DNA, 25 bp, Rattus norvegicus
cgggaatccgggtcccaatctcagc

SEQ ID NO: 517520 - DNA, 25 bp, Rattus norvegicus
tcgctgctctgaccttggggtctcc

SEQ ID NO: 517521 - DNA, 25 bp, Rattus norvegicus
tagtcctggtcagtgcccgctcaac

SEQ ID NO: 517522 - DNA, 25 bp, Rattus norvegicus
gcttcaaggcgacaacagggcacca

SEQ ID NO: 517523 - DNA, 25 bp, Rattus norvegicus
gcccagggaaaacgagcgctcggcc

SEQ ID NO: 517524 - DNA, 25 bp, Rattus norvegicus
ttccttgcaagggtgcagcgatctc

SEQ ID NO: 517525 - DNA, 25 bp, Rattus norvegicus
cccaatagagtgcacagattccttg

SEQ ID NO: 517526 - DNA, 25 bp, Rattus norvegicus
acagggcgcactcttagatctgacc

SEQ ID NO: 517527 - DNA, 25 bp, Rattus norvegicus
cagggcaccaagatctcggcgtagt

SEQ ID NO: 517528 - DNA, 25 bp, Rattus norvegicus
ggcctgctccctagtcctggtcagt

SEQ ID NO: 517529 - DNA, 25 bp, Rattus norvegicus
cgtgtccgcgaagtctgagagggca

SEQ ID NO: 517530 - DNA, 25 bp, Rattus norvegicus
gccacgttgaagttctccagaatca

SEQ ID NO: 517531 - DNA, 25 bp, Rattus norvegicus
cgttgaagttctccagaatcactgc

SEQ ID NO: 517532 - DNA, 25 bp, Rattus norvegicus
gaagttctccagaatcactgcgatg

SEQ ID NO: 517533 - DNA, 25 bp, Rattus norvegicus
agttctccagaatcactgcgatgta

SEQ ID NO: 517534 - DNA, 25 bp, Rattus norvegicus
ctccagaatcactgcgatgtacatg

SEQ ID NO: 517535 - DNA, 25 bp, Rattus norvegicus
cagaatcactgcgatgtacatgttg

SEQ ID NO: 517536 - DNA, 25 bp, Rattus norvegicus
atgccggcctcgtccacgacgttag

SEQ ID NO: 517537 - DNA, 25 bp, Rattus norvegicus
cggcctcgtccacgacgttagcgaa

SEQ ID NO: 517538 - DNA, 25 bp, Rattus norvegicus
ctcgtccacgacgttagcgaagctg

SEQ ID NO: 517539 - DNA, 25 bp, Rattus norvegicus
cacgacgttagcgaagctggccatg

SEQ ID NO: 517540 - DNA, 25 bp, Rattus norvegicus
ctgagagggcagaaaaggcaatgaa

SEQ ID NO: 517541 - DNA, 25 bp, Rattus norvegicus
cgacgttagcgaagctggccatgcc

SEQ ID NO: 517542 - DNA, 25 bp, Rattus norvegicus
tccacgacgttagcgaagctggcca

SEQ ID NO: 517543 - DNA, 25 bp, Rattus norvegicus
gccaggctgagagcgtcccgcagcc

SEQ ID NO: 517544 - DNA, 25 bp, Rattus norvegicus
ccacagcttggcgtcagggaagccc

SEQ ID NO: 517545 - DNA, 25 bp, Rattus norvegicus
ccgaagcgcgcgagccagaccgcct

SEQ ID NO: 517546 - DNA, 25 bp, Rattus norvegicus
gctgcaaggctcaccgcacgccgaa

SEQ ID NO: 517547 - DNA, 25 bp, Rattus norvegicus
aatgcaccggagtccagtacggagg

SEQ ID NO: 517548 - DNA, 25 bp, Rattus norvegicus
gccggaaatgcaccggagtccagta

SEQ ID NO: 517549 - DNA, 25 bp, Rattus norvegicus
gcacggagacctcggcgcacgccca

SEQ ID NO: 517550 - DNA, 25 bp, Rattus norvegicus
tgatccacgctcacgtcggccatgg

SEQ ID NO: 517551 - DNA, 25 bp, Rattus norvegicus
ttggactgatccacgctcacgtcgg

SEQ ID NO: 517552 - DNA, 25 bp, Rattus norvegicus
ggcaacttggactgatccacgctca

SEQ ID NO: 517553 - DNA, 25 bp, Rattus norvegicus
acgccgggcaacttggactgatcca

SEQ ID NO: 517554 - DNA, 25 bp, Rattus norvegicus
ccggccacagcttggcgtcagggaa

SEQ ID NO: 517555 - DNA, 25 bp, Rattus norvegicus
ggctcgcggcgttcacagctggccc

SEQ ID NO: 517556 - DNA, 25 bp, Rattus norvegicus
cttcacgccgggcaacttggactga

SEQ ID NO: 517557 - DNA, 25 bp, Rattus norvegicus
caaccaaagaataggacgggacatc

SEQ ID NO: 517558 - DNA, 25 bp, Rattus norvegicus
cttcctccggaacagccgcgacccg

SEQ ID NO: 517559 - DNA, 25 bp, Rattus norvegicus
aataggacgggacatccgccggtgc

SEQ ID NO: 517560 - DNA, 25 bp, Rattus norvegicus
agaaaagtgcaggtatggcggcccg

SEQ ID NO: 517561 - DNA, 25 bp, Rattus norvegicus
gcaaccagcccggaaagcctacgcc

SEQ ID NO: 517562 - DNA, 25 bp, Rattus norvegicus
acctgcctctgctctcggccgcctt

SEQ ID NO: 517563 - DNA, 25 bp, Rattus norvegicus
tcggctccggctccattagcgttac

SEQ ID NO: 517564 - DNA, 25 bp, Rattus norvegicus
gtgccgcgactctcccggaagtgac

SEQ ID NO: 517565 - DNA, 25 bp, Rattus norvegicus
ccggaagtgacgtcggagtgtcaac

SEQ ID NO: 517566 - DNA, 25 bp, Rattus norvegicus
cgtcggagtgtcaacatgcaagatg

SEQ ID NO: 517567 - DNA, 25 bp, Rattus norvegicus
tcaacatgcaagatggcggcccatc

SEQ ID NO: 517568 - DNA, 25 bp, Rattus norvegicus
atggcggcccatcaccggcagaaca

SEQ ID NO: 517569 - DNA, 25 bp, Rattus norvegicus
caccggcagaacacagccgggcgga

SEQ ID NO: 517570 - DNA, 25 bp, Rattus norvegicus
gccatgggcctactgcccgctcacc

SEQ ID NO: 517571 - DNA, 25 bp, Rattus norvegicus
gccctcccggatgtcacagttctta

SEQ ID NO: 517572 - DNA, 25 bp, Rattus norvegicus
gcggccagagctgggaatcccgctc

SEQ ID NO: 517573 - DNA, 25 bp, Rattus norvegicus
gggaatcccgctcagccgggcatca

SEQ ID NO: 517574 - DNA, 25 bp, Rattus norvegicus
tcagccgggcatcacctgaagccgg

SEQ ID NO: 517575 - DNA, 25 bp, Rattus norvegicus
tgaacttccggctgtgagctgggct

SEQ ID NO: 517576 - DNA, 25 bp, Rattus norvegicus
ggacgcgcgcgccttgaacttccgg

SEQ ID NO: 517577 - DNA, 25 bp, Rattus norvegicus
cagccaggttgccaaggacgcgcgc

SEQ ID NO: 517578 - DNA, 25 bp, Rattus norvegicus
aacaggccggcagccaggttgccaa

SEQ ID NO: 517579 - DNA, 25 bp, Rattus norvegicus
cagttcttagcaacaggccggcagc

SEQ ID NO: 517580 - DNA, 25 bp, Rattus norvegicus
ccggatgtcacagttcttagcaaca

SEQ ID NO: 517581 - DNA, 25 bp, Rattus norvegicus
cccgtgcagatggaagccctcgccg

SEQ ID NO: 517582 - DNA, 25 bp, Rattus norvegicus
ctccctcatggtgcgtgagcgctgg

SEQ ID NO: 517583 - DNA, 25 bp, Rattus norvegicus
cagcgatgactcctccctcatggtg

SEQ ID NO: 517584 - DNA, 25 bp, Rattus norvegicus
cagccatgagcagcgatgactcctc

SEQ ID NO: 517585 - DNA, 25 bp, Rattus norvegicus
tgccaagtcctcctctacagaagcg

SEQ ID NO: 517586 - DNA, 25 bp, Rattus norvegicus
ttctcctctcggtcaatccttcgaa

SEQ ID NO: 517587 - DNA, 25 bp, Rattus norvegicus
ggtcaatccttcgaacaccggaagc

SEQ ID NO: 517588 - DNA, 25 bp, Rattus norvegicus
atccttcgaacaccggaagcgcgaa

SEQ ID NO: 517589 - DNA, 25 bp, Rattus norvegicus
tcgaacaccggaagcgcgaagtagg

SEQ ID NO: 517590 - DNA, 25 bp, Rattus norvegicus
ggcgtagcgcctgcagctcgcgctt

SEQ ID NO: 517591 - DNA, 25 bp, Rattus norvegicus
tggatagggctgtaggaaattcgct

SEQ ID NO: 517592 - DNA, 25 bp, Rattus norvegicus
ggctgtaggaaattcgcttcctcca

SEQ ID NO: 517593 - DNA, 25 bp, Rattus norvegicus
acctgccacggccactgccaagtcc

SEQ ID NO: 517594 - DNA, 25 bp, Rattus norvegicus
ctcctctacagaagcgtcatcgatg

SEQ ID NO: 517595 - DNA, 25 bp, Rattus norvegicus
ctacagaagcgtcatcgatggcgtc

SEQ ID NO: 517596 - DNA, 25 bp, Rattus norvegicus
agcgtcatcgatggcgtccactgtg

SEQ ID NO: 517597 - DNA, 25 bp, Rattus norvegicus
ttcgcttcctccaggcggccacctg

SEQ ID NO: 517598 - DNA, 25 bp, Rattus norvegicus
tcatcgatggcgtccactgtgagcg

SEQ ID NO: 517599 - DNA, 25 bp, Rattus norvegicus
ggtgcgtctcgtcctcatcgtccga

SEQ ID NO: 517600 - DNA, 25 bp, Rattus norvegicus
cggcctggctaagaggtcagaactc

SEQ ID NO: 517601 - DNA, 25 bp, Rattus norvegicus
atcgtccgacacctcgatgtgatcc

SEQ ID NO: 517602 - DNA, 25 bp, Rattus norvegicus
aacaggctggccgtgtctatgttgg

SEQ ID NO: 517603 - DNA, 25 bp, Rattus norvegicus
acctggtgccgccagcggaacaggc

SEQ ID NO: 517604 - DNA, 25 bp, Rattus norvegicus
ccgggcgctgaacagggacccacaa

SEQ ID NO: 517605 - DNA, 25 bp, Rattus norvegicus
ccaggagtacgtggtgcggccttct

SEQ ID NO: 517606 - DNA, 25 bp, Rattus norvegicus
ggtcatctttaaagggccaggagta

SEQ ID NO: 517607 - DNA, 25 bp, Rattus norvegicus
cattggcaaccggaggtcatcttta

SEQ ID NO: 517608 - DNA, 25 bp, Rattus norvegicus
ttcgtccttagcaacgggagtcggc

SEQ ID NO: 517609 - DNA, 25 bp, Rattus norvegicus
cccacaagggctagagagtccgctc

SEQ ID NO: 517610 - DNA, 25 bp, Rattus norvegicus
atcttcgcctcggaggcccggactg

SEQ ID NO: 517611 - DNA, 25 bp, Rattus norvegicus
cgatgtgatcccaaacgctgtagtc

SEQ ID NO: 517612 - DNA, 25 bp, Rattus norvegicus
tcggcgcatgacgttcgtccttagc

SEQ ID NO: 517613 - DNA, 25 bp, Rattus norvegicus
gacaagaaagggcactgagtcctcc

SEQ ID NO: 517614 - DNA, 25 bp, Rattus norvegicus
cccgacgcggtgtgatctctaggaa

SEQ ID NO: 517615 - DNA, 25 bp, Rattus norvegicus
ctgggcacactggtgaatccctggc

SEQ ID NO: 517616 - DNA, 25 bp, Rattus norvegicus
gctgaaagggacaagaaagggcact

SEQ ID NO: 517617 - DNA, 25 bp, Rattus norvegicus
tgatgccatcgaaggccacgtgacc

SEQ ID NO: 517618 - DNA, 25 bp, Rattus norvegicus
ccgcgggaaatagtagacagtgatg

SEQ ID NO: 517619 - DNA, 25 bp, Rattus norvegicus
aactgctcctgtttaaactcggcta

SEQ ID NO: 517620 - DNA, 25 bp, Rattus norvegicus
ttaaactcggctaaggagaagaggc

SEQ ID NO: 517621 - DNA, 25 bp, Rattus norvegicus
cggcaggtgctatgacgagaagcca

SEQ ID NO: 517622 - DNA, 25 bp, Rattus norvegicus
gacgagaagccatgcccagggtaca

SEQ ID NO: 517623 - DNA, 25 bp, Rattus norvegicus
tgcccagggtacagccaccatggct

SEQ ID NO: 517624 - DNA, 25 bp, Rattus norvegicus
agccaccatggctgggcacactggt

SEQ ID NO: 517625 - DNA, 25 bp, Rattus norvegicus
tgaatccctggcaccgcgggaaata

SEQ ID NO: 517626 - DNA, 25 bp, Rattus norvegicus
tgatctctaggaagattcggacccg

SEQ ID NO: 517627 - DNA, 25 bp, Rattus norvegicus
ccgggccacgcgagtaacttctgaa

SEQ ID NO: 517628 - DNA, 25 bp, Rattus norvegicus
agctggagtgacagcgccactcacc

SEQ ID NO: 517629 - DNA, 25 bp, Rattus norvegicus
cgtcagtggaaaactccggggctca

SEQ ID NO: 517630 - DNA, 25 bp, Rattus norvegicus
aggcgaccaatgtcacctgcccggg

SEQ ID NO: 517631 - DNA, 25 bp, Rattus norvegicus
ccggcactcacctaaactagcagtg

SEQ ID NO: 517632 - DNA, 25 bp, Rattus norvegicus
tcggctactgcgatcgccgagctga

SEQ ID NO: 517633 - DNA, 25 bp, Rattus norvegicus
tccggaggacccaagggagatcagc

SEQ ID NO: 517634 - DNA, 25 bp, Rattus norvegicus
cgcgcaatctccagtcgggctggga

SEQ ID NO: 517635 - DNA, 25 bp, Rattus norvegicus
gcctggacatctcggggtaaccaca

SEQ ID NO: 517636 - DNA, 25 bp, Rattus norvegicus
ttctcaggcaactaggtcaaaagga

SEQ ID NO: 517637 - DNA, 25 bp, Rattus norvegicus
tgactcacggtagtggcctctgcgt

SEQ ID NO: 517638 - DNA, 25 bp, Rattus norvegicus
tgacggtgacaggtgaacatacgac

SEQ ID NO: 517639 - DNA, 25 bp, Rattus norvegicus
tccaagggtccgtgactcaccaagc

SEQ ID NO: 517640 - DNA, 25 bp, Rattus norvegicus
gcccagctttgggacgcctggacat

SEQ ID NO: 517641 - DNA, 25 bp, Rattus norvegicus
ccggaaccttctgggaattctcagc

SEQ ID NO: 517642 - DNA, 25 bp, Rattus norvegicus
tcgatgacctcacgccggtgacttc

SEQ ID NO: 517643 - DNA, 25 bp, Rattus norvegicus
tcacgccggtgacttcacatccgga

SEQ ID NO: 517644 - DNA, 25 bp, Rattus norvegicus
cggtgacttcacatccggaaccttc

SEQ ID NO: 517645 - DNA, 25 bp, Rattus norvegicus
acttcacatccggaaccttctggga

SEQ ID NO: 517646 - DNA, 25 bp, Rattus norvegicus
catccggaaccttctgggaattctc

SEQ ID NO: 517647 - DNA, 25 bp, Rattus norvegicus
aaccttctgggaattctcagccgca

SEQ ID NO: 517648 - DNA, 25 bp, Rattus norvegicus
ctcagccgcactttttcgtaagaaa

SEQ ID NO: 517649 - DNA, 25 bp, Rattus norvegicus
gccgcactttttcgtaagaaatcta

SEQ ID NO: 517650 - DNA, 25 bp, Rattus norvegicus
ttcgtaagaaatctagcaggggtgg

SEQ ID NO: 517651 - DNA, 25 bp, Rattus norvegicus
ggcggagctttgcagactcagctgc

SEQ ID NO: 517652 - DNA, 25 bp, Rattus norvegicus
agctttgcagactcagctgcgcgcc

SEQ ID NO: 517653 - DNA, 25 bp, Rattus norvegicus
gctctcgatgacctcacgccggtga

SEQ ID NO: 517654 - DNA, 25 bp, Rattus norvegicus
tgggaattctcagccgcactttttc

SEQ ID NO: 517655 - DNA, 25 bp, Rattus norvegicus
gcccgcgacgtcaccgtcaccttga

SEQ ID NO: 517656 - DNA, 25 bp, Rattus norvegicus
tttcgaactctacagcccgcgacgt

SEQ ID NO: 517657 - DNA, 25 bp, Rattus norvegicus
ccggcatccgtttggaatctgggag

SEQ ID NO: 517658 - DNA, 25 bp, Rattus norvegicus
ccggcgtctgctcgcggagccagcc

SEQ ID NO: 517659 - DNA, 25 bp, Rattus norvegicus
ctggcagcacgcctgccgggcgttt

SEQ ID NO: 517660 - DNA, 25 bp, Rattus norvegicus
tgccgggcgtttcctggcaaccagc

SEQ ID NO: 517661 - DNA, 25 bp, Rattus norvegicus
agccaccgcctgaacgtttcgaact

SEQ ID NO: 517662 - DNA, 25 bp, Rattus norvegicus
ccgcctgaacgtttcgaactctaca

SEQ ID NO: 517663 - DNA, 25 bp, Rattus norvegicus
aacgtttcgaactctacagcccgcg

SEQ ID NO: 517664 - DNA, 25 bp, Rattus norvegicus
cttctgctccgattgctctgcagcg

SEQ ID NO: 517665 - DNA, 25 bp, Rattus norvegicus
ggaacacgccctgtcagctctgggg

SEQ ID NO: 517666 - DNA, 25 bp, Rattus norvegicus
gccgtgggaacacgccctgtcagct

SEQ ID NO: 517667 - DNA, 25 bp, Rattus norvegicus
cggaaccggcatccgtttggaatct

SEQ ID NO: 517668 - DNA, 25 bp, Rattus norvegicus
tcaccttgacgacggccgtgggaac

SEQ ID NO: 517669 - DNA, 25 bp, Rattus norvegicus
aaacattcgttgtcctttctctttg

SEQ ID NO: 517670 - DNA, 25 bp, Rattus norvegicus
cccagactgatggtgacgccgtgtt

SEQ ID NO: 517671 - DNA, 25 bp, Rattus norvegicus
cgaggtaccggtcgatgctgatgac

SEQ ID NO: 517672 - DNA, 25 bp, Rattus norvegicus
ctgtccggttgttcatggagttggc

SEQ ID NO: 517673 - DNA, 25 bp, Rattus norvegicus
ccgtgttgcactgtccggttgttca

SEQ ID NO: 517674 - DNA, 25 bp, Rattus norvegicus
ctttgtgaacatgaactggggcgac

SEQ ID NO: 517675 - DNA, 25 bp, Rattus norvegicus
ctcggggtaatcacccaaacattcg

SEQ ID NO: 517676 - DNA, 25 bp, Rattus norvegicus
tttcctgcaggacctcggggtaatc

SEQ ID NO: 517677 - DNA, 25 bp, Rattus norvegicus
agttgcggagcacgggccagatttc

SEQ ID NO: 517678 - DNA, 25 bp, Rattus norvegicus
aggatgttgacctccgagttgcgga

SEQ ID NO: 517679 - DNA, 25 bp, Rattus norvegicus
caggacgaagcccaggatgttgacc

SEQ ID NO: 517680 - DNA, 25 bp, Rattus norvegicus
ctcatgataagcaagggcaggacga

SEQ ID NO: 517681 - DNA, 25 bp, Rattus norvegicus
acgatgcggaagtagcaaaagctca

SEQ ID NO: 517682 - DNA, 25 bp, Rattus norvegicus
ctggggcgacgccactaagatggcc

SEQ ID NO: 517683 - DNA, 25 bp, Rattus norvegicus
ggaccatactgaaggacgtgcactc

SEQ ID NO: 517684 - DNA, 25 bp, Rattus norvegicus
ctccggctcaggtccacactgaagg

SEQ ID NO: 517685 - DNA, 25 bp, Rattus norvegicus
tacactgaaggatgtgcgctccggc

SEQ ID NO: 517686 - DNA, 25 bp, Rattus norvegicus
tctacactgaaggatgtgcgctccg

SEQ ID NO: 517687 - DNA, 25 bp, Rattus norvegicus
tgctccggctcaggtccacactgaa

SEQ ID NO: 517688 - DNA, 25 bp, Rattus norvegicus
tccacactgaaggatgtgcgctccg

SEQ ID NO: 517689 - DNA, 25 bp, Rattus norvegicus
ggtccacactgaaggacgtgctctc

SEQ ID NO: 517690 - DNA, 25 bp, Rattus norvegicus
tccacactgaaggacgtgctctccg

SEQ ID NO: 517691 - DNA, 25 bp, Rattus norvegicus
cgtgcgctcgtgttcaggtccacac

SEQ ID NO: 517692 - DNA, 25 bp, Rattus norvegicus
tctccggctcaggtccacactgaag

SEQ ID NO: 517693 - DNA, 25 bp, Rattus norvegicus
cacactgaaggacgtgctctccggc

SEQ ID NO: 517694 - DNA, 25 bp, Rattus norvegicus
tgcgctcgtgttcaggtccacactg

SEQ ID NO: 517695 - DNA, 25 bp, Rattus norvegicus
tccacactgaaggacgtgcgctcgt

SEQ ID NO: 517696 - DNA, 25 bp, Rattus norvegicus
gctccggctcaggtccacactgaag

SEQ ID NO: 517697 - DNA, 25 bp, Rattus norvegicus
tgctgcctccgcgtccgcaaggaga

SEQ ID NO: 517698 - DNA, 25 bp, Rattus norvegicus
tgagctcacacaggcacaggctttg

SEQ ID NO: 517699 - DNA, 25 bp, Rattus norvegicus
gtagactctgtagactgagctcaca

SEQ ID NO: 517700 - DNA, 25 bp, Rattus norvegicus
cacaggcacaggctttgaccgggcg

SEQ ID NO: 517701 - DNA, 25 bp, Rattus norvegicus
cgggcgtgccttggatgctgcctcc

SEQ ID NO: 517702 - DNA, 25 bp, Rattus norvegicus
tcctactaaatcagagagcagcgcc

SEQ ID NO: 517703 - DNA, 25 bp, Rattus norvegicus
tccgcaaggagacgcgcagatctca

SEQ ID NO: 517704 - DNA, 25 bp, Rattus norvegicus
tcactggcagctccggcggattaga

SEQ ID NO: 517705 - DNA, 25 bp, Rattus norvegicus
caccgcgccaggtagactctgtaga

SEQ ID NO: 517706 - DNA, 25 bp, Rattus norvegicus
ccttgtttgacagcctcctactaaa

SEQ ID NO: 517707 - DNA, 25 bp, Rattus norvegicus
taggcacgcacgtcaccttgtttga

SEQ ID NO: 517708 - DNA, 25 bp, Rattus norvegicus
ttgggcggctccctaggcacgcacg

SEQ ID NO: 517709 - DNA, 25 bp, Rattus norvegicus
atctcacgtcccagtgcgggtgtct

SEQ ID NO: 517710 - DNA, 25 bp, Rattus norvegicus
gacgcgcagatctcacgtcccagtg

SEQ ID NO: 517711 - DNA, 25 bp, Rattus norvegicus
gcaggacagtgcttctagaacgttc

SEQ ID NO: 517712 - DNA, 25 bp, Rattus norvegicus
tatacgtcaccggaagcgggatctc

SEQ ID NO: 517713 - DNA, 25 bp, Rattus norvegicus
cccggaaatatagggcggcttgtct

SEQ ID NO: 517714 - DNA, 25 bp, Rattus norvegicus
gcggagcctcggagcctctcagtcg

SEQ ID NO: 517715 - DNA, 25 bp, Rattus norvegicus
ctgccgtcgcaggatgtagaggaca

SEQ ID NO: 517716 - DNA, 25 bp, Rattus norvegicus
cgctcatggtgagctcgtgggaaca

SEQ ID NO: 517717 - DNA, 25 bp, Rattus norvegicus
ttcgtcgccggatgtatacgtcacc

SEQ ID NO: 517718 - DNA, 25 bp, Rattus norvegicus
tctaaaactctctaacggtaactga

SEQ ID NO: 517719 - DNA, 25 bp, Rattus norvegicus
taactgataaaagcgcctccgggca

SEQ ID NO: 517720 - DNA, 25 bp, Rattus norvegicus
ccctgcaggtggctgcttcagcttt

SEQ ID NO: 517721 - DNA, 25 bp, Rattus norvegicus
gctttccaggttcgccaaggtcacg

SEQ ID NO: 517722 - DNA, 25 bp, Rattus norvegicus
tcacagccaatcatagacggaggtg

SEQ ID NO: 517723 - DNA, 25 bp, Rattus norvegicus
tgtagaggacacagtggagacgctc

SEQ ID NO: 517724 - DNA, 25 bp, Rattus norvegicus
agcgggatctcacctttttgactgg

SEQ ID NO: 517725 - DNA, 25 bp, Rattus norvegicus
ctcgagaggcctgtcggcaagatgc

SEQ ID NO: 517726 - DNA, 25 bp, Rattus norvegicus
tggcttatttaaggacgtcatttcc

SEQ ID NO: 517727 - DNA, 25 bp, Rattus norvegicus
tgcttgattactggcggcggcgcca

SEQ ID NO: 517728 - DNA, 25 bp, Rattus norvegicus
cgtgtgtcggagctgcttgattact

SEQ ID NO: 517729 - DNA, 25 bp, Rattus norvegicus
tctcgagcttcctgccacatggatg

SEQ ID NO: 517730 - DNA, 25 bp, Rattus norvegicus
cggcgttgttcttggtgagtctcat

SEQ ID NO: 517731 - DNA, 25 bp, Rattus norvegicus
cggcaagatgctgggaaaagtgttc

SEQ ID NO: 517732 - DNA, 25 bp, Rattus norvegicus
ttaacgtgtgttgctattggctctc

SEQ ID NO: 517733 - DNA, 25 bp, Rattus norvegicus
ctgccctctttctgtttaacgtgtg

SEQ ID NO: 517734 - DNA, 25 bp, Rattus norvegicus
tccgtaacggaagctctgccctctt

SEQ ID NO: 517735 - DNA, 25 bp, Rattus norvegicus
gctcgctgaatctgcgcgtgcgcca

SEQ ID NO: 517736 - DNA, 25 bp, Rattus norvegicus
gcagcggacccgctcgctgaatctg

SEQ ID NO: 517737 - DNA, 25 bp, Rattus norvegicus
accacgattggaaccgagcaggcgc

SEQ ID NO: 517738 - DNA, 25 bp, Rattus norvegicus
attggctctctgtggcttatttaag

SEQ ID NO: 517739 - DNA, 25 bp, Rattus norvegicus
cagcacggtccacatgactctttta

SEQ ID NO: 517740 - DNA, 25 bp, Rattus norvegicus
tctgaagatgtcgtgcgcgcggttc

SEQ ID NO: 517741 - DNA, 25 bp, Rattus norvegicus
tcttaatgtttgtaaaatggggcta

SEQ ID NO: 517742 - DNA, 25 bp, Rattus norvegicus
ctaattagggactcgccgaaggtca

SEQ ID NO: 517743 - DNA, 25 bp, Rattus norvegicus
ccgatggccacgtagcgctcgggct

SEQ ID NO: 517744 - DNA, 25 bp, Rattus norvegicus
gactcttttagactcttaatgtttg

SEQ ID NO: 517745 - DNA, 25 bp, Rattus norvegicus
ccttgctaagggattcgcgcaccgg

SEQ ID NO: 517746 - DNA, 25 bp, Rattus norvegicus
gcgccgcgcaccttgctaagggatt

SEQ ID NO: 517747 - DNA, 25 bp, Rattus norvegicus
cgggacatggccagcctgactctgc

SEQ ID NO: 517748 - DNA, 25 bp, Rattus norvegicus
ccctgccacgttgcggcaacttttg

SEQ ID NO: 517749 - DNA, 25 bp, Rattus norvegicus
cccgggtgagtcctcgagtcctctt

SEQ ID NO: 517750 - DNA, 25 bp, Rattus norvegicus
cggtgactctaagcctggccgccat

SEQ ID NO: 517751 - DNA, 25 bp, Rattus norvegicus
atccgaggcgcggtgactctaagcc

SEQ ID NO: 517752 - DNA, 25 bp, Rattus norvegicus
gactgtggggacttggacttagccc

SEQ ID NO: 517753 - DNA, 25 bp, Rattus norvegicus
gggcttccgccgcttcattgatttc

SEQ ID NO: 517754 - DNA, 25 bp, Rattus norvegicus
cgtagctaaatacgcggcgccggcc

SEQ ID NO: 517755 - DNA, 25 bp, Rattus norvegicus
gcgtttctcgccgttgcacccggaa

SEQ ID NO: 517756 - DNA, 25 bp, Rattus norvegicus
cgccggccattttgtgcgagaagcc

SEQ ID NO: 517757 - DNA, 25 bp, Rattus norvegicus
atacggccctaagcgggcctgcaac

SEQ ID NO: 517758 - DNA, 25 bp, Rattus norvegicus
attgatttccgtttctcgccgctgc

SEQ ID NO: 517759 - DNA, 25 bp, Rattus norvegicus
agcctcctgacacggtgatccgggc

SEQ ID NO: 517760 - DNA, 25 bp, Rattus norvegicus
accggcctcacactagtgtcgcatg

SEQ ID NO: 517761 - DNA, 25 bp, Rattus norvegicus
tgtcgcatgtccactatccagaacc

SEQ ID NO: 517762 - DNA, 25 bp, Rattus norvegicus
cccatatgatgcgagggcccggccg

SEQ ID NO: 517763 - DNA, 25 bp, Rattus norvegicus
tccaatctttcggtaaggtccagtc

SEQ ID NO: 517764 - DNA, 25 bp, Rattus norvegicus
ttcggtaaggtccagtcgctggccg

SEQ ID NO: 517765 - DNA, 25 bp, Rattus norvegicus
tgtctcggcgcccagaagatggcga

SEQ ID NO: 517766 - DNA, 25 bp, Rattus norvegicus
ccagaagatggcgacggggtctccc

SEQ ID NO: 517767 - DNA, 25 bp, Rattus norvegicus
aactagcagagaggccactgcgccc

SEQ ID NO: 517768 - DNA, 25 bp, Rattus norvegicus
ccgacagctcgaaggagcgcttcct

SEQ ID NO: 517769 - DNA, 25 bp, Rattus norvegicus
ccgcaaggaactagcagagaggcca

SEQ ID NO: 517770 - DNA, 25 bp, Rattus norvegicus
tcatcatggtaatgggagggcatca

SEQ ID NO: 517771 - DNA, 25 bp, Rattus norvegicus
gagggcatcatctccgcaagctttg

SEQ ID NO: 517772 - DNA, 25 bp, Rattus norvegicus
cgcaagctttgcgtcagctgtttgc

SEQ ID NO: 517773 - DNA, 25 bp, Rattus norvegicus
gctgtttgctgacgtccgctgacgt

SEQ ID NO: 517774 - DNA, 25 bp, Rattus norvegicus
gctgacgtcacatacacccttggga

SEQ ID NO: 517775 - DNA, 25 bp, Rattus norvegicus
cccttgggagagatgagcgagcaat

SEQ ID NO: 517776 - DNA, 25 bp, Rattus norvegicus
ccgcacaccgcagctatttcgggga

SEQ ID NO: 517777 - DNA, 25 bp, Rattus norvegicus
tatttcggggattttgggtgtagca

SEQ ID NO: 517778 - DNA, 25 bp, Rattus norvegicus
tttgggtgtagcagaaagcccgaca

SEQ ID NO: 517779 - DNA, 25 bp, Rattus norvegicus
gcagaaagcccgacagctcgaagga

SEQ ID NO: 517780 - DNA, 25 bp, Rattus norvegicus
gcgcgcgtgcgtcacctgtcatcat

SEQ ID NO: 517781 - DNA, 25 bp, Rattus norvegicus
gaggcgcctccgcttttcagcgatc

SEQ ID NO: 517782 - DNA, 25 bp, Rattus norvegicus
acccggcacagcttcccacagagga

SEQ ID NO: 517783 - DNA, 25 bp, Rattus norvegicus
tcgctccgcctcttaggctcccgcg

SEQ ID NO: 517784 - DNA, 25 bp, Rattus norvegicus
gctgggcactgtcatctgacaggca

SEQ ID NO: 517785 - DNA, 25 bp, Rattus norvegicus
caggtaaggtctggaccggcgcgca

SEQ ID NO: 517786 - DNA, 25 bp, Rattus norvegicus
cttttcagcgatccgcagcgagcgc

SEQ ID NO: 517787 - DNA, 25 bp, Rattus norvegicus
aggcacaggacaccgcgtcacgaaa

SEQ ID NO: 517788 - DNA, 25 bp, Rattus norvegicus
tcatctgacaggcacaggacaccgc

SEQ ID NO: 517789 - DNA, 25 bp, Rattus norvegicus
aaacccggggagctgggcactgtca

SEQ ID NO: 517790 - DNA, 25 bp, Rattus norvegicus
cacagaggaccgcaggctggagccg

SEQ ID NO: 517791 - DNA, 25 bp, Rattus norvegicus
agcagggagagaaggacccggcaca

SEQ ID NO: 517792 - DNA, 25 bp, Rattus norvegicus
ctgcgccacccacgccacctcgctc

SEQ ID NO: 517793 - DNA, 25 bp, Rattus norvegicus
tcagcgatccgcagcgagcgcagcg

SEQ ID NO: 517794 - DNA, 25 bp, Rattus norvegicus
tctgacaggcacaggacaccgcgtc

SEQ ID NO: 517795 - DNA, 25 bp, Rattus norvegicus
ggcaccgccatgtcattacctactg

SEQ ID NO: 517796 - DNA, 25 bp, Rattus norvegicus
taaacgcacgcacgttccctgtcga

SEQ ID NO: 517797 - DNA, 25 bp, Rattus norvegicus
gcacgttccctgtcgaccaatcggt

SEQ ID NO: 517798 - DNA, 25 bp, Rattus norvegicus
ccaatcggtggttacgctggacgta

SEQ ID NO: 517799 - DNA, 25 bp, Rattus norvegicus
gagcttccgccgacacatgcgcacg

SEQ ID NO: 517800 - DNA, 25 bp, Rattus norvegicus
tgagcgccgccaacatggtgagtgt

SEQ ID NO: 517801 - DNA, 25 bp, Rattus norvegicus
cgccaacatggtgagtgtgtctgct

SEQ ID NO: 517802 - DNA, 25 bp, Rattus norvegicus
tgtgtctgctgagggctccgagcac

SEQ ID NO: 517803 - DNA, 25 bp, Rattus norvegicus
caccgcggtccggacgctcgtcttc

SEQ ID NO: 517804 - DNA, 25 bp, Rattus norvegicus
tcgtcttccgctccgagcgggcgag

SEQ ID NO: 517805 - DNA, 25 bp, Rattus norvegicus
acccagccctcgtggagcgtggctc

SEQ ID NO: 517806 - DNA, 25 bp, Rattus norvegicus
agcatgcgtaaacgcacgcacgttc

SEQ ID NO: 517807 - DNA, 25 bp, Rattus norvegicus
tacctactgagcatgcgtaaacgca

SEQ ID NO: 517808 - DNA, 25 bp, Rattus norvegicus
ttccctgtcgaccaatcggtggtta

SEQ ID NO: 517809 - DNA, 25 bp, Rattus norvegicus
gtgttatcaccgagatgaggcctcc

SEQ ID NO: 517810 - DNA, 25 bp, Rattus norvegicus
cgttgacttaactgcagctggtgct

SEQ ID NO: 517811 - DNA, 25 bp, Rattus norvegicus
tccggcgagttggtcgttgacttaa

SEQ ID NO: 517812 - DNA, 25 bp, Rattus norvegicus
agcggccgaagtgtgttgtacttcc

SEQ ID NO: 517813 - DNA, 25 bp, Rattus norvegicus
cgcaggcgccttgagacacatcaaa

SEQ ID NO: 517814 - DNA, 25 bp, Rattus norvegicus
ttcctttaaacaagtgcgcaggcgc

SEQ ID NO: 517815 - DNA, 25 bp, Rattus norvegicus
cggagcctgcgtgttagttccttta

SEQ ID NO: 517816 - DNA, 25 bp, Rattus norvegicus
tcagagcagatgtgccggagcctgc

SEQ ID NO: 517817 - DNA, 25 bp, Rattus norvegicus
gcacctctgtgatcttcagagcaga

SEQ ID NO: 517818 - DNA, 25 bp, Rattus norvegicus
agatgtcctaaagcgcacctctgtg

SEQ ID NO: 517819 - DNA, 25 bp, Rattus norvegicus
agcgagcaacgctcaccacttgctg

SEQ ID NO: 517820 - DNA, 25 bp, Rattus norvegicus
tgtataatttatgcccggagcgagc

SEQ ID NO: 517821 - DNA, 25 bp, Rattus norvegicus
gggatcttccctctgcgttcctaga

SEQ ID NO: 517822 - DNA, 25 bp, Rattus norvegicus
gccttgtagagtgttccggcgagtt

SEQ ID NO: 517823 - DNA, 25 bp, Rattus norvegicus
gtgcaatcggcaggcgccatcaatt

SEQ ID NO: 517824 - DNA, 25 bp, Rattus norvegicus
tcctgttggcgagccagaggctgcc

SEQ ID NO: 517825 - DNA, 25 bp, Rattus norvegicus
cgagcgtgcacccgcttgttgaagc

SEQ ID NO: 517826 - DNA, 25 bp, Rattus norvegicus
aatcctcagccgtccgtcctgttgg

SEQ ID NO: 517827 - DNA, 25 bp, Rattus norvegicus
acgcggcttcccactcaacacaatc

SEQ ID NO: 517828 - DNA, 25 bp, Rattus norvegicus
tcattacagtcaggcccacgcggct

SEQ ID NO: 517829 - DNA, 25 bp, Rattus norvegicus
tcctcatttctcattacagtcaggc

SEQ ID NO: 517830 - DNA, 25 bp, Rattus norvegicus
aatttttcagcactttcctcatttc

SEQ ID NO: 517831 - DNA, 25 bp, Rattus norvegicus
tcagccgtccgtcctgttggcgagc

SEQ ID NO: 517832 - DNA, 25 bp, Rattus norvegicus
cggcaggcgccatcaatttttcagc

SEQ ID NO: 517833 - DNA, 25 bp, Rattus norvegicus
cgcgccagcctgtgcaatcggcagg

SEQ ID NO: 517834 - DNA, 25 bp, Rattus norvegicus
gcatagcgcacagggcgtgcagact

SEQ ID NO: 517835 - DNA, 25 bp, Rattus norvegicus
attagcatagcgcacagggcgtgca

SEQ ID NO: 517836 - DNA, 25 bp, Rattus norvegicus
gcgccatcaatttttcagcactttc

SEQ ID NO: 517837 - DNA, 25 bp, Rattus norvegicus
aaatcgctccttgtgcggcgccatc

SEQ ID NO: 517838 - DNA, 25 bp, Rattus norvegicus
tagtgttctgtgcagcccgcggccc

SEQ ID NO: 517839 - DNA, 25 bp, Rattus norvegicus
tgtgcggcgccatcttaagccctcg

SEQ ID NO: 517840 - DNA, 25 bp, Rattus norvegicus
cgccgcttataaatcgctccttgtg

SEQ ID NO: 517841 - DNA, 25 bp, Rattus norvegicus
aggatacacggtgccgcgccgctta

SEQ ID NO: 517842 - DNA, 25 bp, Rattus norvegicus
gagcacgcacagataggtctttttt

SEQ ID NO: 517843 - DNA, 25 bp, Rattus norvegicus
ccctgcaacgatctgactgtgagtt

SEQ ID NO: 517844 - DNA, 25 bp, Rattus norvegicus
tctgactgtgagtttgaatccaaac

SEQ ID NO: 517845 - DNA, 25 bp, Rattus norvegicus
ccgtggagtcgccaaacttggatgc

SEQ ID NO: 517846 - DNA, 25 bp, Rattus norvegicus
tcgccaaacttggatgcggcgtgcg

SEQ ID NO: 517847 - DNA, 25 bp, Rattus norvegicus
gaattcgggaccgtggacgagtcac

SEQ ID NO: 517848 - DNA, 25 bp, Rattus norvegicus
gaccgtggacgagtcaccggccact

SEQ ID NO: 517849 - DNA, 25 bp, Rattus norvegicus
gtccctcgtggagcacgcacagata

SEQ ID NO: 517850 - DNA, 25 bp, Rattus norvegicus
gccgcgtcagctagtgttctgtgca

SEQ ID NO: 517851 - DNA, 25 bp, Rattus norvegicus
cggaacccaggagacccagatgctg

SEQ ID NO: 517852 - DNA, 25 bp, Rattus norvegicus
ctgggcgcaggaccaaatgctcaga

SEQ ID NO: 517853 - DNA, 25 bp, Rattus norvegicus
cgcaaggaagggctagccctgcagc

SEQ ID NO: 517854 - DNA, 25 bp, Rattus norvegicus
ccgcgatcggggcttcccaagacta

SEQ ID NO: 517855 - DNA, 25 bp, Rattus norvegicus
ggccacagactccacccaccgcggt

SEQ ID NO: 517856 - DNA, 25 bp, Rattus norvegicus
cttcagcgccctggtccaagcggaa

SEQ ID NO: 517857 - DNA, 25 bp, Rattus norvegicus
ggagacccagatgctggcagccttc

SEQ ID NO: 517858 - DNA, 25 bp, Rattus norvegicus
cgcaggaccaaatgctcagagcagg

SEQ ID NO: 517859 - DNA, 25 bp, Rattus norvegicus
gtccaagcggaacccaggagaccca

SEQ ID NO: 517860 - DNA, 25 bp, Rattus norvegicus
taggcgcacggttgtacgcaagatc

SEQ ID NO: 517861 - DNA, 25 bp, Rattus norvegicus
gactagcctcttactttccgccgca

SEQ ID NO: 517862 - DNA, 25 bp, Rattus norvegicus
ctctgcacacctaggcgcacggttg

SEQ ID NO: 517863 - DNA, 25 bp, Rattus norvegicus
tgctcagagcaggtactgcgcctct

SEQ ID NO: 517864 - DNA, 25 bp, Rattus norvegicus
agagcaggtactgcgcctctgcaca

SEQ ID NO: 517865 - DNA, 25 bp, Rattus norvegicus
cgtgcccatccagcgacactaagga

SEQ ID NO: 517866 - DNA, 25 bp, Rattus norvegicus
gagcgcttccggctctatgggctga

SEQ ID NO: 517867 - DNA, 25 bp, Rattus norvegicus
tctccatggcaacaagcagagggcc

SEQ ID NO: 517868 - DNA, 25 bp, Rattus norvegicus
gctggcgagcatccctcagtatttg

SEQ ID NO: 517869 - DNA, 25 bp, Rattus norvegicus
ctcgtgagcagttcccaggtgtgct

SEQ ID NO: 517870 - DNA, 25 bp, Rattus norvegicus
ctggcctaagggaagactagaagct

SEQ ID NO: 517871 - DNA, 25 bp, Rattus norvegicus
ggacctcgcactacttctgaaatga

SEQ ID NO: 517872 - DNA, 25 bp, Rattus norvegicus
aagtgaccgagtttacgtgcccatc

SEQ ID NO: 517873 - DNA, 25 bp, Rattus norvegicus
accttgattggctgatcgctaccca

SEQ ID NO: 517874 - DNA, 25 bp, Rattus norvegicus
tgcgtcaccataacaacctgcgaga

SEQ ID NO: 517875 - DNA, 25 bp, Rattus norvegicus
tgggtgagccctctgcgtcaccata

SEQ ID NO: 517876 - DNA, 25 bp, Rattus norvegicus
gagttgcacgcgctctgccttgcca

SEQ ID NO: 517877 - DNA, 25 bp, Rattus norvegicus
atgtaaccagaaacggagccgcagc

SEQ ID NO: 517878 - DNA, 25 bp, Rattus norvegicus
atgaaatgatctcgctggcctaagg

SEQ ID NO: 517879 - DNA, 25 bp, Rattus norvegicus
ctaggtgatagtccggcgaccttca

SEQ ID NO: 517880 - DNA, 25 bp, Rattus norvegicus
gcgcgcgcagcacccacattctcac

SEQ ID NO: 517881 - DNA, 25 bp, Rattus norvegicus
tccgcgtgtactttaattctgggcc

SEQ ID NO: 517882 - DNA, 25 bp, Rattus norvegicus
ccagacgcacgctccggagtgctga

SEQ ID NO: 517883 - DNA, 25 bp, Rattus norvegicus
tcgccgcccgaacttcgtgtaaatg

SEQ ID NO: 517884 - DNA, 25 bp, Rattus norvegicus
cccggcagcctaggtgatagtccgg

SEQ ID NO: 517885 - DNA, 25 bp, Rattus norvegicus
gcggctccgcgtgtactttaattct

SEQ ID NO: 517886 - DNA, 25 bp, Rattus norvegicus
gaaggtgccctaaggccaccgtgtc

SEQ ID NO: 517887 - DNA, 25 bp, Rattus norvegicus
tcctgcgggtaagtcaccagagctc

SEQ ID NO: 517888 - DNA, 25 bp, Rattus norvegicus
cgcacacgaggactgtcgcgcaggt

SEQ ID NO: 517889 - DNA, 25 bp, Rattus norvegicus
accgaggacggtcgcacacgaggac

SEQ ID NO: 517890 - DNA, 25 bp, Rattus norvegicus
cccaaaggctctgggaccgaggacg

SEQ ID NO: 517891 - DNA, 25 bp, Rattus norvegicus
acgctccggagtgctgagtaggcta

SEQ ID NO: 517892 - DNA, 25 bp, Rattus norvegicus
aacttcgtgtaaatgacgtcgtgcg

SEQ ID NO: 517893 - DNA, 25 bp, Rattus norvegicus
tgcgccgagagaactacctatctga

SEQ ID NO: 517894 - DNA, 25 bp, Rattus norvegicus
tctccgagttcacgggcttctccgg

SEQ ID NO: 517895 - DNA, 25 bp, Rattus norvegicus
tgcccgagaagctgcagatcgtgaa

SEQ ID NO: 517896 - DNA, 25 bp, Rattus norvegicus
acttaggcggctatccctgcgccga

SEQ ID NO: 517897 - DNA, 25 bp, Rattus norvegicus
tccctgcgccgagagaactacctat

SEQ ID NO: 517898 - DNA, 25 bp, Rattus norvegicus
ctacctatctgagcggaggttcttc

SEQ ID NO: 517899 - DNA, 25 bp, Rattus norvegicus
tatctgagcggaggttcttcgagga

SEQ ID NO: 517900 - DNA, 25 bp, Rattus norvegicus
ggagagctgcacagtggctcgctca

SEQ ID NO: 517901 - DNA, 25 bp, Rattus norvegicus
accgagagcatcatgtccctgggca

SEQ ID NO: 517902 - DNA, 25 bp, Rattus norvegicus
actcacgcttctccgagttcacggg

SEQ ID NO: 517903 - DNA, 25 bp, Rattus norvegicus
aagctgcagatcgtgaagccactcg

SEQ ID NO: 517904 - DNA, 25 bp, Rattus norvegicus
tcctacctgcccgagaagctgcaga

SEQ ID NO: 517905 - DNA, 25 bp, Rattus norvegicus
ggcttctccggcatgtccttcagca

SEQ ID NO: 517906 - DNA, 25 bp, Rattus norvegicus
agcatcatgtccctgggcacacact

SEQ ID NO: 517907 - DNA, 25 bp, Rattus norvegicus
tcccagccggtggaggaaaggataa

SEQ ID NO: 517908 - DNA, 25 bp, Rattus norvegicus
agggcgcctgctgccaggactgcca

SEQ ID NO: 517909 - DNA, 25 bp, Rattus norvegicus
tgaaccaaaggctgatctcggcggc

SEQ ID NO: 517910 - DNA, 25 bp, Rattus norvegicus
caaaaggcgaggagcgtgaaccaaa

SEQ ID NO: 517911 - DNA, 25 bp, Rattus norvegicus
tcatatctatgggaagcaaaaggcg

SEQ ID NO: 517912 - DNA, 25 bp, Rattus norvegicus
acacgccgcacttcatatctatggg

SEQ ID NO: 517913 - DNA, 25 bp, Rattus norvegicus
aaggataaagattggagccgcggca

SEQ ID NO: 517914 - DNA, 25 bp, Rattus norvegicus
agcttctacagggactaccggctgc

SEQ ID NO: 517915 - DNA, 25 bp, Rattus norvegicus
tgctccatagggtccacagcttcta

SEQ ID NO: 517916 - DNA, 25 bp, Rattus norvegicus
tgtccggtcggagcacagccctcag

SEQ ID NO: 517917 - DNA, 25 bp, Rattus norvegicus
atgtatcgggctagcagtgcgccca

SEQ ID NO: 517918 - DNA, 25 bp, Rattus norvegicus
acctgctggatgtatcgggctagca

SEQ ID NO: 517919 - DNA, 25 bp, Rattus norvegicus
ggggagcggacatccttacctttgc

SEQ ID NO: 517920 - DNA, 25 bp, Rattus norvegicus
cttacctttgcggacctgctggatg

SEQ ID NO: 517921 - DNA, 25 bp, Rattus norvegicus
agtcagctggcttggcggtttccaa

SEQ ID NO: 517922 - DNA, 25 bp, Rattus norvegicus
gacacgtgctcagaggcagccactg

SEQ ID NO: 517923 - DNA, 25 bp, Rattus norvegicus
cagtccggcaggacacgtgctcaga

SEQ ID NO: 517924 - DNA, 25 bp, Rattus norvegicus
tacccagtgctgacgcagtccggca

SEQ ID NO: 517925 - DNA, 25 bp, Rattus norvegicus
ctgtttacccagtgctgacgcagtc

SEQ ID NO: 517926 - DNA, 25 bp, Rattus norvegicus
cagccagtcatctgtttacccagtg

SEQ ID NO: 517927 - DNA, 25 bp, Rattus norvegicus
gcccggtactcagccagtcatctgt

SEQ ID NO: 517928 - DNA, 25 bp, Rattus norvegicus
cggcagggcgactcctcttaaatag

SEQ ID NO: 517929 - DNA, 25 bp, Rattus norvegicus
gcagccactggagagaccaccgatc

SEQ ID NO: 517930 - DNA, 25 bp, Rattus norvegicus
ctgtccagctaagttgagggcaggc

SEQ ID NO: 517931 - DNA, 25 bp, Rattus norvegicus
aacggctgctgtccagctaagttga

SEQ ID NO: 517932 - DNA, 25 bp, Rattus norvegicus
cttggcggtttccaacggctgctgt

SEQ ID NO: 517933 - DNA, 25 bp, Rattus norvegicus
gagagaccaccgatcgaagtggccc

SEQ ID NO: 517934 - DNA, 25 bp, Rattus norvegicus
gtttccaacggctgctgtccagcta

SEQ ID NO: 517935 - DNA, 25 bp, Rattus norvegicus
gcaactccggatttaggtgccggaa

SEQ ID NO: 517936 - DNA, 25 bp, Rattus norvegicus
catccgggctcagctagagccggga

SEQ ID NO: 517937 - DNA, 25 bp, Rattus norvegicus
gctctttgctcgttcgctcggcacg

SEQ ID NO: 517938 - DNA, 25 bp, Rattus norvegicus
gtcacggcaactccggatttaggtg

SEQ ID NO: 517939 - DNA, 25 bp, Rattus norvegicus
ggctccgattgtttactcgcctgaa

SEQ ID NO: 517940 - DNA, 25 bp, Rattus norvegicus
agccatccgggctcagctagagccg

SEQ ID NO: 517941 - DNA, 25 bp, Rattus norvegicus
atggggacgcgctcggattcccact

SEQ ID NO: 517942 - DNA, 25 bp, Rattus norvegicus
gattcccactcgctctttgctcgtt

SEQ ID NO: 517943 - DNA, 25 bp, Rattus norvegicus
actcgctctttgctcgttcgctcgg

SEQ ID NO: 517944 - DNA, 25 bp, Rattus norvegicus
ccgattgtttactcgcctgaaaacg

SEQ ID NO: 517945 - DNA, 25 bp, Rattus norvegicus
ttgctcgttcgctcggcacggcgct

SEQ ID NO: 517946 - DNA, 25 bp, Rattus norvegicus
cgggagcgtgagtcacggcaactcc

SEQ ID NO: 517947 - DNA, 25 bp, Rattus norvegicus
cgtgagtcacggcaactccggattt

SEQ ID NO: 517948 - DNA, 25 bp, Rattus norvegicus
gaagaggctccgattgtttactcgc

SEQ ID NO: 517949 - DNA, 25 bp, Rattus norvegicus
gcgtccctgcaaggagccgagagaa

SEQ ID NO: 517950 - DNA, 25 bp, Rattus norvegicus
ctggagccgacgactagaggaactc

SEQ ID NO: 517951 - DNA, 25 bp, Rattus norvegicus
aaagccatctgcacgggttccctga

SEQ ID NO: 517952 - DNA, 25 bp, Rattus norvegicus
ctgcagcccttctcgttcaggaatc

SEQ ID NO: 517953 - DNA, 25 bp, Rattus norvegicus
ttccagcagcgtgattcgcggaccc

SEQ ID NO: 517954 - DNA, 25 bp, Rattus norvegicus
ggactcccttgtcgcagacggttcc

SEQ ID NO: 517955 - DNA, 25 bp, Rattus norvegicus
agtgctctgagtgcaccctgccctg

SEQ ID NO: 517956 - DNA, 25 bp, Rattus norvegicus
aatcctggagacacagcgcgggaca

SEQ ID NO: 517957 - DNA, 25 bp, Rattus norvegicus
acgcgtgttagcgagcagctccaaa

SEQ ID NO: 517958 - DNA, 25 bp, Rattus norvegicus
gcgccgcacgctagcaccgaataat

SEQ ID NO: 517959 - DNA, 25 bp, Rattus norvegicus
ggttccctgaaaagtcgcgcgcaaa

SEQ ID NO: 517960 - DNA, 25 bp, Rattus norvegicus
attggctaacctctccgccggtcag

SEQ ID NO: 517961 - DNA, 25 bp, Rattus norvegicus
cgacgcgcacctctagcgggacttt

SEQ ID NO: 517962 - DNA, 25 bp, Rattus norvegicus
aatccgagccctaaggacaagcgtc

SEQ ID NO: 517963 - DNA, 25 bp, Rattus norvegicus
aggggtgggcctgaacagcccagcc

SEQ ID NO: 517964 - DNA, 25 bp, Rattus norvegicus
cctgcactgccgctgacagcgggga

SEQ ID NO: 517965 - DNA, 25 bp, Rattus norvegicus
tggagcctgcactgccgctgacagc

SEQ ID NO: 517966 - DNA, 25 bp, Rattus norvegicus
ggatctttcagctggagcctgcact

SEQ ID NO: 517967 - DNA, 25 bp, Rattus norvegicus
cggtggcgcactggatctttcagct

SEQ ID NO: 517968 - DNA, 25 bp, Rattus norvegicus
agacgccgcttggagcaggcgccga

SEQ ID NO: 517969 - DNA, 25 bp, Rattus norvegicus
tggaccgggcacagagcccggcttc

SEQ ID NO: 517970 - DNA, 25 bp, Rattus norvegicus
ctggaccccaggctcggagtggacc

SEQ ID NO: 517971 - DNA, 25 bp, Rattus norvegicus
cagcagggcaagcacaccgggaaca

SEQ ID NO: 517972 - DNA, 25 bp, Rattus norvegicus
atttgagctcgccagcagggcaagc

SEQ ID NO: 517973 - DNA, 25 bp, Rattus norvegicus
tccagaatttgagctcgccagcagg

SEQ ID NO: 517974 - DNA, 25 bp, Rattus norvegicus
tccagatccagaatttgagctcgcc

SEQ ID NO: 517975 - DNA, 25 bp, Rattus norvegicus
cgcacgcgctccagatccagaattt

SEQ ID NO: 517976 - DNA, 25 bp, Rattus norvegicus
cgcactggatctttcagctggagcc

SEQ ID NO: 517977 - DNA, 25 bp, Rattus norvegicus
agggattcaaatggcctctcaccaa

SEQ ID NO: 517978 - DNA, 25 bp, Rattus norvegicus
cacctgccgagggattcaaatggcc

SEQ ID NO: 517979 - DNA, 25 bp, Rattus norvegicus
tcaggtccacgccaagcctttctca

SEQ ID NO: 517980 - DNA, 25 bp, Rattus norvegicus
taggcgagcctagggcccacgagaa

SEQ ID NO: 517981 - DNA, 25 bp, Rattus norvegicus
cccaggtaggcgagcctagggccca

SEQ ID NO: 517982 - DNA, 25 bp, Rattus norvegicus
ccacttcagacagcgcccaggtagg

SEQ ID NO: 517983 - DNA, 25 bp, Rattus norvegicus
agcccaggcgtcaggcccacaatgg

SEQ ID NO: 517984 - DNA, 25 bp, Rattus norvegicus
gtggcttcttctcgcccaggcttca

SEQ ID NO: 517985 - DNA, 25 bp, Rattus norvegicus
ccgcccagggtcacaccttctgtgg

SEQ ID NO: 517986 - DNA, 25 bp, Rattus norvegicus
cagcgtcctcttcccgcccaggcat

SEQ ID NO: 517987 - DNA, 25 bp, Rattus norvegicus
gtgtcacaccctcaagtggcctctt

SEQ ID NO: 517988 - DNA, 25 bp, Rattus norvegicus
tgcccaagtgtcacaccctcaagtg

SEQ ID NO: 517989 - DNA, 25 bp, Rattus norvegicus
aggtcgttgaccggaaatacgctcg

SEQ ID NO: 517990 - DNA, 25 bp, Rattus norvegicus
cagcggcctcttcctgcccaagtgt

SEQ ID NO: 517991 - DNA, 25 bp, Rattus norvegicus
ctcggcttgcttaagccgggcttgc

SEQ ID NO: 517992 - DNA, 25 bp, Rattus norvegicus
tgcaagaaccacgaggcaaccgggg

SEQ ID NO: 517993 - DNA, 25 bp, Rattus norvegicus
tcacgtctgacacgaacagcgcgcg

SEQ ID NO: 517994 - DNA, 25 bp, Rattus norvegicus
cttctgattggctggggcaagcagt

SEQ ID NO: 517995 - DNA, 25 bp, Rattus norvegicus
gcgaagccggtgttctagcactcgg

SEQ ID NO: 517996 - DNA, 25 bp, Rattus norvegicus
gctggactgaaagggacgtctcctc

SEQ ID NO: 517997 - DNA, 25 bp, Rattus norvegicus
agggacgtctcctctccgtaagtga

SEQ ID NO: 517998 - DNA, 25 bp, Rattus norvegicus
agaaggcaacgatggcagacaggca

SEQ ID NO: 517999 - DNA, 25 bp, Rattus norvegicus
caggcaccgagctggtgccagcttc

SEQ ID NO: 518000 - DNA, 25 bp, Rattus norvegicus
gcaccagcgtcggtgtccagccaag

SEQ ID NO: 518001 - DNA, 25 bp, Rattus norvegicus
cacccggggtttgcgcagaccttag

SEQ ID NO: 518002 - DNA, 25 bp, Rattus norvegicus
gcagaccttaggtgaccctgtgtca

SEQ ID NO: 518003 - DNA, 25 bp, Rattus norvegicus
cggaatgcgaatgcctctgacaagg

SEQ ID NO: 518004 - DNA, 25 bp, Rattus norvegicus
ctcggcgaacgggttgcaagaacca

SEQ ID NO: 518005 - DNA, 25 bp, Rattus norvegicus
gacagtaggacagggctcaagattg

SEQ ID NO: 518006 - DNA, 25 bp, Rattus norvegicus
gcacacacttcaggacagctgactg

SEQ ID NO: 518007 - DNA, 25 bp, Rattus norvegicus
agtaaggtacaacttcctcccagca

SEQ ID NO: 518008 - DNA, 25 bp, Rattus norvegicus
tggcagcttgaacacagtaaggtac

SEQ ID NO: 518009 - DNA, 25 bp, Rattus norvegicus
ccatcatggagtgttggcagcttga

SEQ ID NO: 518010 - DNA, 25 bp, Rattus norvegicus
ggctcttctccacagtccatcatgg

SEQ ID NO: 518011 - DNA, 25 bp, Rattus norvegicus
gggtctatgtcatctggctcttctc

SEQ ID NO: 518012 - DNA, 25 bp, Rattus norvegicus
atacaaggaatcatgggtctatgtc

SEQ ID NO: 518013 - DNA, 25 bp, Rattus norvegicus
ccacggagggtgaagatacaaggaa

SEQ ID NO: 518014 - DNA, 25 bp, Rattus norvegicus
tcatcggtggaatgtgagtgtactt

SEQ ID NO: 518015 - DNA, 25 bp, Rattus norvegicus
gctcaagattgagctcgccaaaatg

SEQ ID NO: 518016 - DNA, 25 bp, Rattus norvegicus
ctgtgggttagaagacagtaggaca

SEQ ID NO: 518017 - DNA, 25 bp, Rattus norvegicus
agtcacgcttcaatgttaagttctg

SEQ ID NO: 518018 - DNA, 25 bp, Rattus norvegicus
agctcgccaaaatgatgtagatttc

SEQ ID NO: 518019 - DNA, 25 bp, Rattus norvegicus
agagtggagccaacagtgaggaacc

SEQ ID NO: 518020 - DNA, 25 bp, Rattus norvegicus
cagcgtgtggcctctctttggggtc

SEQ ID NO: 518021 - DNA, 25 bp, Rattus norvegicus
aactaagatccggaggcgtggctgc

SEQ ID NO: 518022 - DNA, 25 bp, Rattus norvegicus
gccaacagtgaggaaccaaaacagg

SEQ ID NO: 518023 - DNA, 25 bp, Rattus norvegicus
acctggagccgagcgaggatcgaac

SEQ ID NO: 518024 - DNA, 25 bp, Rattus norvegicus
ggaaaccgaacctggagccgagcga

SEQ ID NO: 518025 - DNA, 25 bp, Rattus norvegicus
ccgcggtaagtgcaggaagactgag

SEQ ID NO: 518026 - DNA, 25 bp, Rattus norvegicus
tgccaaggcagcacatgccggcgtc

SEQ ID NO: 518027 - DNA, 25 bp, Rattus norvegicus
cctggtgatagttgccaaggcagca

SEQ ID NO: 518028 - DNA, 25 bp, Rattus norvegicus
gctggtttccctggtgatagttgcc

SEQ ID NO: 518029 - DNA, 25 bp, Rattus norvegicus
accgtgctggtttccctggtgatag

SEQ ID NO: 518030 - DNA, 25 bp, Rattus norvegicus
tacacgcgcgcgaccgtgctggttt

SEQ ID NO: 518031 - DNA, 25 bp, Rattus norvegicus
ggagccgagcaggaaaccgaacctg

SEQ ID NO: 518032 - DNA, 25 bp, Rattus norvegicus
caggggaacgaactaagatccggag

SEQ ID NO: 518033 - DNA, 25 bp, Rattus norvegicus
gtaccttgcgcaacagctcaggctg

SEQ ID NO: 518034 - DNA, 25 bp, Rattus norvegicus
tccagcgcgatctccgatgtgtaca

SEQ ID NO: 518035 - DNA, 25 bp, Rattus norvegicus
tcagccaggaaacgcgcacggaagt

SEQ ID NO: 518036 - DNA, 25 bp, Rattus norvegicus
cgccgcggcaaacaggtcctgaacg

SEQ ID NO: 518037 - DNA, 25 bp, Rattus norvegicus
atctggaatcgatgcgccgcggcaa

SEQ ID NO: 518038 - DNA, 25 bp, Rattus norvegicus
gcaattagccaagcacaggcgcttc

SEQ ID NO: 518039 - DNA, 25 bp, Rattus norvegicus
accagcgggaaacgtgcgcagatga

SEQ ID NO: 518040 - DNA, 25 bp, Rattus norvegicus
ctgagagtcccaggaagtcgttgtc

SEQ ID NO: 518041 - DNA, 25 bp, Rattus norvegicus
cttctccacgttgaggccatcgctg

SEQ ID NO: 518042 - DNA, 25 bp, Rattus norvegicus
cacgcggctctccaggaaagcacga

SEQ ID NO: 518043 - DNA, 25 bp, Rattus norvegicus
tgcgtccttcaccatctgtaccttg

SEQ ID NO: 518044 - DNA, 25 bp, Rattus norvegicus
gggacactacatcaggcgacacctc

SEQ ID NO: 518045 - DNA, 25 bp, Rattus norvegicus
tgctctcgaagaccgtgggcaacgc

SEQ ID NO: 518046 - DNA, 25 bp, Rattus norvegicus
tgaacgcttgcctcgtccagcgcga

SEQ ID NO: 518047 - DNA, 25 bp, Rattus norvegicus
cgttcaccagcagtttggacgtgta

SEQ ID NO: 518048 - DNA, 25 bp, Rattus norvegicus
agtttggacgtgtagatgaagttca

SEQ ID NO: 518049 - DNA, 25 bp, Rattus norvegicus
cacgttggccgcgttcaccagcagt

SEQ ID NO: 518050 - DNA, 25 bp, Rattus norvegicus
cgctgagcacctcgtgcacgttggc

SEQ ID NO: 518051 - DNA, 25 bp, Rattus norvegicus
aatgtcagccatctgcagcagcgag

SEQ ID NO: 518052 - DNA, 25 bp, Rattus norvegicus
aggcggcaatgtcagccatctgcag

SEQ ID NO: 518053 - DNA, 25 bp, Rattus norvegicus
gccagggaccgagcgtccagcagct

SEQ ID NO: 518054 - DNA, 25 bp, Rattus norvegicus
cttgatgtcacagtagtagggtggt

SEQ ID NO: 518055 - DNA, 25 bp, Rattus norvegicus
tgtctgcctcctgcttgatgtcaca

SEQ ID NO: 518056 - DNA, 25 bp, Rattus norvegicus
tcagggccctcacgggcgtagatct

SEQ ID NO: 518057 - DNA, 25 bp, Rattus norvegicus
cacagagtacgggtcagggccctca

SEQ ID NO: 518058 - DNA, 25 bp, Rattus norvegicus
atcctccacacgcacagagtacggg

SEQ ID NO: 518059 - DNA, 25 bp, Rattus norvegicus
ttctcctccttgaagagcgtctgtg

SEQ ID NO: 518060 - DNA, 25 bp, Rattus norvegicus
tgaagttcaggatctgctgcaggcc

SEQ ID NO: 518061 - DNA, 25 bp, Rattus norvegicus
tttcagatgacctacctggaacagc

SEQ ID NO: 518062 - DNA, 25 bp, Rattus norvegicus
cttctctgctgggaagttcgtccgg

SEQ ID NO: 518063 - DNA, 25 bp, Rattus norvegicus
cagggctcctagactccgtaccggg

SEQ ID NO: 518064 - DNA, 25 bp, Rattus norvegicus
cctacctggggcctctggctgcaga

SEQ ID NO: 518065 - DNA, 25 bp, Rattus norvegicus
agcctcccacgcgatttgctctgtg

SEQ ID NO: 518066 - DNA, 25 bp, Rattus norvegicus
accgaagcctttcagatgacctacc

SEQ ID NO: 518067 - DNA, 25 bp, Rattus norvegicus
tctcaacccttctctgctgggaagt

SEQ ID NO: 518068 - DNA, 25 bp, Rattus norvegicus
acgtgagagcgtttggaccgtgcaa

SEQ ID NO: 518069 - DNA, 25 bp, Rattus norvegicus
tcacgatgcagctgccctcgggaga

SEQ ID NO: 518070 - DNA, 25 bp, Rattus norvegicus
ggacacgcgccgtcacgatgcagct

SEQ ID NO: 518071 - DNA, 25 bp, Rattus norvegicus
tggacgcttaaagggccaggccgcc

SEQ ID NO: 518072 - DNA, 25 bp, Rattus norvegicus
gccgccgtctggacgcttaaagggc

SEQ ID NO: 518073 - DNA, 25 bp, Rattus norvegicus
acaggcagggccctgcgtaccatgg

SEQ ID NO: 518074 - DNA, 25 bp, Rattus norvegicus
gctctgtgtctttgggacctacctg

SEQ ID NO: 518075 - DNA, 25 bp, Rattus norvegicus
tctgcagcatcacagcgcgggtgca

SEQ ID NO: 518076 - DNA, 25 bp, Rattus norvegicus
ctcccgtgcacctttcgggaggcgg

SEQ ID NO: 518077 - DNA, 25 bp, Rattus norvegicus
cccgccacgcacagaaccaggtgag

SEQ ID NO: 518078 - DNA, 25 bp, Rattus norvegicus
cccgacgcctggaggcgctctccac

SEQ ID NO: 518079 - DNA, 25 bp, Rattus norvegicus
gcccgcaccgcatcctggcccgacg

SEQ ID NO: 518080 - DNA, 25 bp, Rattus norvegicus
cagaaccaggtgagccccggacaca

SEQ ID NO: 518081 - DNA, 25 bp, Rattus norvegicus
tgctctctgcagcatcacagcgcgg

SEQ ID NO: 518082 - DNA, 25 bp, Rattus norvegicus
cgcgcttacccaggcacgtgggtgt

SEQ ID NO: 518083 - DNA, 25 bp, Rattus norvegicus
gctgagggcgcgcttacccaggcac

SEQ ID NO: 518084 - DNA, 25 bp, Rattus norvegicus
aagctgcggcggagacgccaaggag

SEQ ID NO: 518085 - DNA, 25 bp, Rattus norvegicus
gcgcccggtctcagaagctgcggcg

SEQ ID NO: 518086 - DNA, 25 bp, Rattus norvegicus
ctgagcctcgggaacgccctcccgt

SEQ ID NO: 518087 - DNA, 25 bp, Rattus norvegicus
cgcaagcgtgctcgccagcacggtt

SEQ ID NO: 518088 - DNA, 25 bp, Rattus norvegicus
ctcgccagcacggttcgcagaggcg

SEQ ID NO: 518089 - DNA, 25 bp, Rattus norvegicus
acagccaagaggcacgtccctggcg

SEQ ID NO: 518090 - DNA, 25 bp, Rattus norvegicus
ggcggacgtgacaccgcattttctc

SEQ ID NO: 518091 - DNA, 25 bp, Rattus norvegicus
tgggtggttaatagccggcttccca

SEQ ID NO: 518092 - DNA, 25 bp, Rattus norvegicus
gtgacaccgcattttctccgaattc

SEQ ID NO: 518093 - DNA, 25 bp, Rattus norvegicus
tttctccgaattcctgccatctagg

SEQ ID NO: 518094 - DNA, 25 bp, Rattus norvegicus
tcctgccatctaggatggtgcaacc

SEQ ID NO: 518095 - DNA, 25 bp, Rattus norvegicus
catctaggatggtgcaaccgaggga

SEQ ID NO: 518096 - DNA, 25 bp, Rattus norvegicus
gggatccgctctctctgcagagaac

SEQ ID NO: 518097 - DNA, 25 bp, Rattus norvegicus
ctctctgcagagaactggagcatga

SEQ ID NO: 518098 - DNA, 25 bp, Rattus norvegicus
ctggagcatgaacagcgcgaaactc

SEQ ID NO: 518099 - DNA, 25 bp, Rattus norvegicus
cagcgcgaaactccgaaggcgttca

SEQ ID NO: 518100 - DNA, 25 bp, Rattus norvegicus
actccgaaggcgttcacatttaagg

SEQ ID NO: 518101 - DNA, 25 bp, Rattus norvegicus
tcacatttaagggaaaagcaacgcc

SEQ ID NO: 518102 - DNA, 25 bp, Rattus norvegicus
gcatcgcggcggacgtgacaccgca

SEQ ID NO: 518103 - DNA, 25 bp, Rattus norvegicus
tcggatctagccaccctggtgatct

SEQ ID NO: 518104 - DNA, 25 bp, Rattus norvegicus
acgcctctgagtcgtcccaagcttg

SEQ ID NO: 518105 - DNA, 25 bp, Rattus norvegicus
tgatcttcgagcctccacggggacc

SEQ ID NO: 518106 - DNA, 25 bp, Rattus norvegicus
agccaccctggtgatcttcgagcct

SEQ ID NO: 518107 - DNA, 25 bp, Rattus norvegicus
gcagccctctccctaggctctgagg

SEQ ID NO: 518108 - DNA, 25 bp, Rattus norvegicus
ggctctgaggcacgccagcactgac

SEQ ID NO: 518109 - DNA, 25 bp, Rattus norvegicus
cagcactgacctctgatctccgagg

SEQ ID NO: 518110 - DNA, 25 bp, Rattus norvegicus
gctgagtgtcgcgacgcctctgagt

SEQ ID NO: 518111 - DNA, 25 bp, Rattus norvegicus
acggctgcccagaacccagctttgc

SEQ ID NO: 518112 - DNA, 25 bp, Rattus norvegicus
tgagtcgtcccaagcttggccctgg

SEQ ID NO: 518113 - DNA, 25 bp, Rattus norvegicus
tgctccggcctgtggtgcttttcct

SEQ ID NO: 518114 - DNA, 25 bp, Rattus norvegicus
tgtggtgcttttcctccagggttcg

SEQ ID NO: 518115 - DNA, 25 bp, Rattus norvegicus
aactccagggtgaaaaccacacgca

SEQ ID NO: 518116 - DNA, 25 bp, Rattus norvegicus
tctgatctccgaggtggcaccctcg

SEQ ID NO: 518117 - DNA, 25 bp, Rattus norvegicus
ctatgcgtgcttgctgctccaaagg

SEQ ID NO: 518118 - DNA, 25 bp, Rattus norvegicus
ggatgtctccgtcctgatgccatta

SEQ ID NO: 518119 - DNA, 25 bp, Rattus norvegicus
acaagccgtcatggtcctgcgtgca

SEQ ID NO: 518120 - DNA, 25 bp, Rattus norvegicus
tgatagatgcggctgagtgacaccc

SEQ ID NO: 518121 - DNA, 25 bp, Rattus norvegicus
tctagagccgaggatacgacagccc

SEQ ID NO: 518122 - DNA, 25 bp, Rattus norvegicus
cgtcttcttggcacgaggaccactc

SEQ ID NO: 518123 - DNA, 25 bp, Rattus norvegicus
ctggcttgcagacaccgcgtcttct

SEQ ID NO: 518124 - DNA, 25 bp, Rattus norvegicus
ttaactctttggtccctatgcgtgc

SEQ ID NO: 518125 - DNA, 25 bp, Rattus norvegicus
ccaaagggctcttggagattggcgc

SEQ ID NO: 518126 - DNA, 25 bp, Rattus norvegicus
aaggggccacgtgcgttcacatccc

SEQ ID NO: 518127 - DNA, 25 bp, Rattus norvegicus
ccaagcggcatcgaaaacatagaca

SEQ ID NO: 518128 - DNA, 25 bp, Rattus norvegicus
tcctgcgtgcaatactgctggcttg

SEQ ID NO: 518129 - DNA, 25 bp, Rattus norvegicus
cccacaagacagagcgggagccatg

SEQ ID NO: 518130 - DNA, 25 bp, Rattus norvegicus
cctcggaaaggagcctgtctctctc

SEQ ID NO: 518131 - DNA, 25 bp, Rattus norvegicus
aataggcacactccgcaccctgtga

SEQ ID NO: 518132 - DNA, 25 bp, Rattus norvegicus
tccgcggaggcgtgctagacctccg

SEQ ID NO: 518133 - DNA, 25 bp, Rattus norvegicus
gcaccctgtgatccgaccatccgcg

SEQ ID NO: 518134 - DNA, 25 bp, Rattus norvegicus
agacgtccggccacctcaataggca

SEQ ID NO: 518135 - DNA, 25 bp, Rattus norvegicus
gggtgggctgccatcacctgaccgc

SEQ ID NO: 518136 - DNA, 25 bp, Rattus norvegicus
accatccgcggaggcgtgctagacc

SEQ ID NO: 518137 - DNA, 25 bp, Rattus norvegicus
ctgcccagtcgggaggtcacgtgtt

SEQ ID NO: 518138 - DNA, 25 bp, Rattus norvegicus
cagcgggagttccaatcagagcgcg

SEQ ID NO: 518139 - DNA, 25 bp, Rattus norvegicus
gtggtagcgtctgctcggttacaaa

SEQ ID NO: 518140 - DNA, 25 bp, Rattus norvegicus
gcgtctgctcggttacaaatggccc

SEQ ID NO: 518141 - DNA, 25 bp, Rattus norvegicus
agctgcccaggtcccattgccctac

SEQ ID NO: 518142 - DNA, 25 bp, Rattus norvegicus
ggcgatcagaccacctcagagggca

SEQ ID NO: 518143 - DNA, 25 bp, Rattus norvegicus
gggcacgctcagatacccagacgtc

SEQ ID NO: 518144 - DNA, 25 bp, Rattus norvegicus
ttactgcagcgggagttccaatcag

SEQ ID NO: 518145 - DNA, 25 bp, Rattus norvegicus
tagcctgtgtcctgcagcgggagca

SEQ ID NO: 518146 - DNA, 25 bp, Rattus norvegicus
tctgggctttccagagaggctgcgt

SEQ ID NO: 518147 - DNA, 25 bp, Rattus norvegicus
ccaccacggcgccagggcgtcaagg

SEQ ID NO: 518148 - DNA, 25 bp, Rattus norvegicus
cctgagaaagcgaggccttcgactg

SEQ ID NO: 518149 - DNA, 25 bp, Rattus norvegicus
aaagcgaggccttcgactgacgcca

SEQ ID NO: 518150 - DNA, 25 bp, Rattus norvegicus
cgaggccttcgactgacgccagagc

SEQ ID NO: 518151 - DNA, 25 bp, Rattus norvegicus
tgaccacgaggccctcagccggttg

SEQ ID NO: 518152 - DNA, 25 bp, Rattus norvegicus
ccctagggcgtctgggctttccaga

SEQ ID NO: 518153 - DNA, 25 bp, Rattus norvegicus
tgggcagtagcctgtgtcctgcagc

SEQ ID NO: 518154 - DNA, 25 bp, Rattus norvegicus
cgtctgggctttccagagaggctgc

SEQ ID NO: 518155 - DNA, 25 bp, Rattus norvegicus
cagggtccgaagccaggccaggcca

SEQ ID NO: 518156 - DNA, 25 bp, Rattus norvegicus
tcctgttgcgtcgggtacagggtcc

SEQ ID NO: 518157 - DNA, 25 bp, Rattus norvegicus
cccagccgagcccaggccgtccact

SEQ ID NO: 518158 - DNA, 25 bp, Rattus norvegicus
ggccttcgactgacgccagagccag

SEQ ID NO: 518159 - DNA, 25 bp, Rattus norvegicus
tgctttaaatcgcagcgccgggcgg

SEQ ID NO: 518160 - DNA, 25 bp, Rattus norvegicus
tgtcccagagaactccaccacttct

SEQ ID NO: 518161 - DNA, 25 bp, Rattus norvegicus
gacccttgtggggatttggccacga

SEQ ID NO: 518162 - DNA, 25 bp, Rattus norvegicus
gagcaggggtatcagcgctaacctc

SEQ ID NO: 518163 - DNA, 25 bp, Rattus norvegicus
gggtatcagcgctaacctcctggct

SEQ ID NO: 518164 - DNA, 25 bp, Rattus norvegicus
agcgctaacctcctggctgagactc

SEQ ID NO: 518165 - DNA, 25 bp, Rattus norvegicus
gctgagactccatcaccttcgggga

SEQ ID NO: 518166 - DNA, 25 bp, Rattus norvegicus
agcccaagcgcgcactttgcaaact

SEQ ID NO: 518167 - DNA, 25 bp, Rattus norvegicus
aggggcggagctgctttaaatcgca

SEQ ID NO: 518168 - DNA, 25 bp, Rattus norvegicus
cctgcgaggacccttgtggggattt

SEQ ID NO: 518169 - DNA, 25 bp, Rattus norvegicus
taacctcctggctgagactccatca

SEQ ID NO: 518170 - DNA, 25 bp, Rattus norvegicus
tggggatttggccacgaaaccacca

SEQ ID NO: 518171 - DNA, 25 bp, Rattus norvegicus
aagtcatccgcgaccacgcaggagg

SEQ ID NO: 518172 - DNA, 25 bp, Rattus norvegicus
gagactccatcaccttcggggagcc

SEQ ID NO: 518173 - DNA, 25 bp, Rattus norvegicus
gagatctttcaaatccggctgcatc

SEQ ID NO: 518174 - DNA, 25 bp, Rattus norvegicus
gaggaaggtcggtccgccttagcca

SEQ ID NO: 518175 - DNA, 25 bp, Rattus norvegicus
ccatgcgcaggcgttctaggaggaa

SEQ ID NO: 518176 - DNA, 25 bp, Rattus norvegicus
ccgatgtcctggctgggagccgctt

SEQ ID NO: 518177 - DNA, 25 bp, Rattus norvegicus
acacggacaagtgcggctttgaagc

SEQ ID NO: 518178 - DNA, 25 bp, Rattus norvegicus
ctcagacctagtcggcgggaagaac

SEQ ID NO: 518179 - DNA, 25 bp, Rattus norvegicus
tcggaaacccgcagatagcggggta

SEQ ID NO: 518180 - DNA, 25 bp, Rattus norvegicus
atctttttctctcagacctagtcgg

SEQ ID NO: 518181 - DNA, 25 bp, Rattus norvegicus
tcagctaggactgcgtcaccagagc

SEQ ID NO: 518182 - DNA, 25 bp, Rattus norvegicus
actaccaacggctcctcagctagga

SEQ ID NO: 518183 - DNA, 25 bp, Rattus norvegicus
tctgggaagccgaccaaaactacca

SEQ ID NO: 518184 - DNA, 25 bp, Rattus norvegicus
tcaaatccggctgcatctgggaagc

SEQ ID NO: 518185 - DNA, 25 bp, Rattus norvegicus
aacctgcttgtgtctcccgaagctc

SEQ ID NO: 518186 - DNA, 25 bp, Rattus norvegicus
gcgggaagaacctgcttgtgtctcc

SEQ ID NO: 518187 - DNA, 25 bp, Rattus norvegicus
gggactggtcactgcaactgtgccc

SEQ ID NO: 518188 - DNA, 25 bp, Rattus norvegicus
cggaagtacacttctgctgttcgtc

SEQ ID NO: 518189 - DNA, 25 bp, Rattus norvegicus
tgcagggcggcaccgttccaaccat

SEQ ID NO: 518190 - DNA, 25 bp, Rattus norvegicus
ctgctgttcgtctaggaaacccgga

SEQ ID NO: 518191 - DNA, 25 bp, Rattus norvegicus
ccaaccatcgctgttccctggagaa

SEQ ID NO: 518192 - DNA, 25 bp, Rattus norvegicus
ctctctaggagagcggaagtacact

SEQ ID NO: 518193 - DNA, 25 bp, Rattus norvegicus
ccactggggactggtcactgcaact

SEQ ID NO: 518194 - DNA, 25 bp, Rattus norvegicus
gtcactcacctactctcagcggaga

SEQ ID NO: 518195 - DNA, 25 bp, Rattus norvegicus
gagaactccgcgctcctcctgatga

SEQ ID NO: 518196 - DNA, 25 bp, Rattus norvegicus
ccgcgctcctcctgatgactgttag

SEQ ID NO: 518197 - DNA, 25 bp, Rattus norvegicus
cctcctgatgactgttagctcgctg

SEQ ID NO: 518198 - DNA, 25 bp, Rattus norvegicus
atgactgttagctcgctgggcccac

SEQ ID NO: 518199 - DNA, 25 bp, Rattus norvegicus
tcctccgcgggcctctctaggagag

SEQ ID NO: 518200 - DNA, 25 bp, Rattus norvegicus
ccctggactacgacgccactgggga

SEQ ID NO: 518201 - DNA, 25 bp, Rattus norvegicus
gcggtgactctggagcgagccccac

SEQ ID NO: 518202 - DNA, 25 bp, Rattus norvegicus
attcaagagataccggaagtgacgt

SEQ ID NO: 518203 - DNA, 25 bp, Rattus norvegicus
cacgtgagctcgcaccactgatgtg

SEQ ID NO: 518204 - DNA, 25 bp, Rattus norvegicus
cgtcagcgctgcacgggtcagacgc

SEQ ID NO: 518205 - DNA, 25 bp, Rattus norvegicus
ttgttggcgcccgtgcgtcagcgct

SEQ ID NO: 518206 - DNA, 25 bp, Rattus norvegicus
cctcgcgctcgggtcgcttggcttg

SEQ ID NO: 518207 - DNA, 25 bp, Rattus norvegicus
agccatcgcgcatgcgggtggcgac

SEQ ID NO: 518208 - DNA, 25 bp, Rattus norvegicus
tttcttagtgtcctggaggtgtgtg

SEQ ID NO: 518209 - DNA, 25 bp, Rattus norvegicus
ttgccatttcttagtgtcctggagg

SEQ ID NO: 518210 - DNA, 25 bp, Rattus norvegicus
cgcaccactgatgtgcagcgagatc

SEQ ID NO: 518211 - DNA, 25 bp, Rattus norvegicus
gtcccgccattgttgccatttctta

SEQ ID NO: 518212 - DNA, 25 bp, Rattus norvegicus
tgatgtgcagcgagatcagccgcta

SEQ ID NO: 518213 - DNA, 25 bp, Rattus norvegicus
gcagcgagatcagccgctaaccact

SEQ ID NO: 518214 - DNA, 25 bp, Rattus norvegicus
gccattgttgccatttcttagtgtc

SEQ ID NO: 518215 - DNA, 25 bp, Rattus norvegicus
acccaaccgcagagctgtgtccaag

SEQ ID NO: 518216 - DNA, 25 bp, Rattus norvegicus
tagcgctctgggagccaagaactcc

SEQ ID NO: 518217 - DNA, 25 bp, Rattus norvegicus
ctgggagccaagaactcccgcgggt

SEQ ID NO: 518218 - DNA, 25 bp, Rattus norvegicus
gtgccgccctgatctcggggtgcct

SEQ ID NO: 518219 - DNA, 25 bp, Rattus norvegicus
gggtgcctgcctttgtccagcatct

SEQ ID NO: 518220 - DNA, 25 bp, Rattus norvegicus
gcctttgtccagcatctcctgtaat

SEQ ID NO: 518221 - DNA, 25 bp, Rattus norvegicus
ttgtccagcatctcctgtaattgtg

SEQ ID NO: 518222 - DNA, 25 bp, Rattus norvegicus
cagcatctcctgtaattgtggagga

SEQ ID NO: 518223 - DNA, 25 bp, Rattus norvegicus
ctcctgtaattgtggaggattatca

SEQ ID NO: 518224 - DNA, 25 bp, Rattus norvegicus
ttgtggaggattatcaggacctgcc

SEQ ID NO: 518225 - DNA, 25 bp, Rattus norvegicus
ttatcaggacctgccaaggcgtcgg

SEQ ID NO: 518226 - DNA, 25 bp, Rattus norvegicus
ctggacgacccaaccgcagagctgt

SEQ ID NO: 518227 - DNA, 25 bp, Rattus norvegicus
gacacgcagcagtagcgctctggga

SEQ ID NO: 518228 - DNA, 25 bp, Rattus norvegicus
caaggcgtcggggaccaggctctcc

SEQ ID NO: 518229 - DNA, 25 bp, Rattus norvegicus
aagcccagcgcgaggcacttcctgt

SEQ ID NO: 518230 - DNA, 25 bp, Rattus norvegicus
cgtagattcattcctagagaggccg

SEQ ID NO: 518231 - DNA, 25 bp, Rattus norvegicus
cgaggcacttcctgtccggtcattg

SEQ ID NO: 518232 - DNA, 25 bp, Rattus norvegicus
ccggtcattgttctcggcccggttg

SEQ ID NO: 518233 - DNA, 25 bp, Rattus norvegicus
ttctcggcccggttgctgctgagag

SEQ ID NO: 518234 - DNA, 25 bp, Rattus norvegicus
ctgagaggcggtggaatctcagtcc

SEQ ID NO: 518235 - DNA, 25 bp, Rattus norvegicus
ggtggaatctcagtccgcgaagcta

SEQ ID NO: 518236 - DNA, 25 bp, Rattus norvegicus
tctcagtccgcgaagctatcgccgg

SEQ ID NO: 518237 - DNA, 25 bp, Rattus norvegicus
cgagaggcgtgggattgtcctccac

SEQ ID NO: 518238 - DNA, 25 bp, Rattus norvegicus
tgggattgtcctccaccgaccatcg

SEQ ID NO: 518239 - DNA, 25 bp, Rattus norvegicus
accatcgcggacaatcgcggggccg

SEQ ID NO: 518240 - DNA, 25 bp, Rattus norvegicus
tcctgtgcagatggctccggcctgc

SEQ ID NO: 518241 - DNA, 25 bp, Rattus norvegicus
ttcattcctagagaggccggcctgc

SEQ ID NO: 518242 - DNA, 25 bp, Rattus norvegicus
gcagctgcctaaccggctaatgccc

SEQ ID NO: 518243 - DNA, 25 bp, Rattus norvegicus
cgccaagttcaaatctgcggccatc

SEQ ID NO: 518244 - DNA, 25 bp, Rattus norvegicus
agttcctcacggagccttgggtcca

SEQ ID NO: 518245 - DNA, 25 bp, Rattus norvegicus
tggctcctggctgcaaatgtaagtt

SEQ ID NO: 518246 - DNA, 25 bp, Rattus norvegicus
gtcctggcgtaagcgaatctcggca

SEQ ID NO: 518247 - DNA, 25 bp, Rattus norvegicus
acgtcatccgaacacgcccaagagg

SEQ ID NO: 518248 - DNA, 25 bp, Rattus norvegicus
tgtaccgtgtccgtgacgtcatccg

SEQ ID NO: 518249 - DNA, 25 bp, Rattus norvegicus
cgccgacttctgacgtgtaccgtgt

SEQ ID NO: 518250 - DNA, 25 bp, Rattus norvegicus
actcttggccgggtccaaagtgtcg

SEQ ID NO: 518251 - DNA, 25 bp, Rattus norvegicus
tgataaacagcactcgccactcttg

SEQ ID NO: 518252 - DNA, 25 bp, Rattus norvegicus
cacctggttccgcttgctcatggta

SEQ ID NO: 518253 - DNA, 25 bp, Rattus norvegicus
gggccgcacatacgacacctggttc

SEQ ID NO: 518254 - DNA, 25 bp, Rattus norvegicus
ccgactcgctctttgaagcgggaca

SEQ ID NO: 518255 - DNA, 25 bp, Rattus norvegicus
gcgggctcaccttggtctctacggt

SEQ ID NO: 518256 - DNA, 25 bp, Rattus norvegicus
aatctcggcagaggtcgccatggct

SEQ ID NO: 518257 - DNA, 25 bp, Rattus norvegicus
cccaaggttcgcctgagtcgcaggc

SEQ ID NO: 518258 - DNA, 25 bp, Rattus norvegicus
gaggaggccgctcaacctcggtttc

SEQ ID NO: 518259 - DNA, 25 bp, Rattus norvegicus
ttctggggcgtgttcaactgtatgt

SEQ ID NO: 518260 - DNA, 25 bp, Rattus norvegicus
ctcgcctacagaagggcgcgatgcg

SEQ ID NO: 518261 - DNA, 25 bp, Rattus norvegicus
tggagttacccgctcgcctacagaa

SEQ ID NO: 518262 - DNA, 25 bp, Rattus norvegicus
ttaccctgactcacccgtggagtta

SEQ ID NO: 518263 - DNA, 25 bp, Rattus norvegicus
ccggattccctgcttcggcagattc

SEQ ID NO: 518264 - DNA, 25 bp, Rattus norvegicus
tttattcgtaggctcgcttcggtgc

SEQ ID NO: 518265 - DNA, 25 bp, Rattus norvegicus
ggctcggctccagattccctttatt

SEQ ID NO: 518266 - DNA, 25 bp, Rattus norvegicus
ttgcatcagctgcaggggctcggct

SEQ ID NO: 518267 - DNA, 25 bp, Rattus norvegicus
agtcgcaggctctccttagtctccg

SEQ ID NO: 518268 - DNA, 25 bp, Rattus norvegicus
aggtcctcgctaacagattcccatc

SEQ ID NO: 518269 - DNA, 25 bp, Rattus norvegicus
ttcagtggcgcaaggtcctcgctaa

SEQ ID NO: 518270 - DNA, 25 bp, Rattus norvegicus
ttagtctccggtttgcatcagctgc

SEQ ID NO: 518271 - DNA, 25 bp, Rattus norvegicus
gctctcgagctgaagaagtcttagc

SEQ ID NO: 518272 - DNA, 25 bp, Rattus norvegicus
aggtctacatcgttcatggagtgca

SEQ ID NO: 518273 - DNA, 25 bp, Rattus norvegicus
ttccgccttccagaggtgtctcacg

SEQ ID NO: 518274 - DNA, 25 bp, Rattus norvegicus
ggctacttagactccggcccgagcg

SEQ ID NO: 518275 - DNA, 25 bp, Rattus norvegicus
accgtcaatctggaggcagctcgta

SEQ ID NO: 518276 - DNA, 25 bp, Rattus norvegicus
agaggcccatggagctccaggcagt

SEQ ID NO: 518277 - DNA, 25 bp, Rattus norvegicus
cggctcctgaggctgcagtttaatg

SEQ ID NO: 518278 - DNA, 25 bp, Rattus norvegicus
ctaagcgaggctgagaaggtctaca

SEQ ID NO: 518279 - DNA, 25 bp, Rattus norvegicus
cgaacgtgcgtccagtatgcctaga

SEQ ID NO: 518280 - DNA, 25 bp, Rattus norvegicus
tatgcctagatctccacagctctcg

SEQ ID NO: 518281 - DNA, 25 bp, Rattus norvegicus
agtcttagctcatcagggagcggca

SEQ ID NO: 518282 - DNA, 25 bp, Rattus norvegicus
ctctgcacacgctgagagtgctgtg

SEQ ID NO: 518283 - DNA, 25 bp, Rattus norvegicus
agtgctgtgcccgagatcctgtaat

SEQ ID NO: 518284 - DNA, 25 bp, Rattus norvegicus
atcctgtaatcgaaatcgcggcgcg

SEQ ID NO: 518285 - DNA, 25 bp, Rattus norvegicus
cggcagaggacgacgcgttcctgcc

SEQ ID NO: 518286 - DNA, 25 bp, Rattus norvegicus
ccagcaaggccgtctgtggggctcc

SEQ ID NO: 518287 - DNA, 25 bp, Rattus norvegicus
tgcgttctccagcaaggccgtctgt

SEQ ID NO: 518288 - DNA, 25 bp, Rattus norvegicus
ttctgcgttctccagcaaggccgtc

SEQ ID NO: 518289 - DNA, 25 bp, Rattus norvegicus
cgaggccattctgcgttctccagca

SEQ ID NO: 518290 - DNA, 25 bp, Rattus norvegicus
ctcaggccacgggttcgaggccatt

SEQ ID NO: 518291 - DNA, 25 bp, Rattus norvegicus
tgtgcgccgctcaggccacgggttc

SEQ ID NO: 518292 - DNA, 25 bp, Rattus norvegicus
cttccgaggcggcatacaggactgg

SEQ ID NO: 518293 - DNA, 25 bp, Rattus norvegicus
aggctcttccgaggcggcatacagg

SEQ ID NO: 518294 - DNA, 25 bp, Rattus norvegicus
ctacagacgcctgaggctcttccga

SEQ ID NO: 518295 - DNA, 25 bp, Rattus norvegicus
gcacacctccgacgccctacagacg

SEQ ID NO: 518296 - DNA, 25 bp, Rattus norvegicus
gtgtccgcgttcttcagcagcacac

SEQ ID NO: 518297 - DNA, 25 bp, Rattus norvegicus
ctcggtgtccgcgttcttcagcagc

SEQ ID NO: 518298 - DNA, 25 bp, Rattus norvegicus
gaggacgacgcgttcctgcccggac

SEQ ID NO: 518299 - DNA, 25 bp, Rattus norvegicus
ggcaagtggttcgacaagcgatgtc

SEQ ID NO: 518300 - DNA, 25 bp, Rattus norvegicus
cgccgcagtctgagctagagaatga

SEQ ID NO: 518301 - DNA, 25 bp, Rattus norvegicus
agaatgaggcgctgttcgagtatgc

SEQ ID NO: 518302 - DNA, 25 bp, Rattus norvegicus
gcgctgttcgagtatgcgcgccaga

SEQ ID NO: 518303 - DNA, 25 bp, Rattus norvegicus
agctctggctgggtctcaacgacat

SEQ ID NO: 518304 - DNA, 25 bp, Rattus norvegicus
tgggtctcaacgacatggcttcgga

SEQ ID NO: 518305 - DNA, 25 bp, Rattus norvegicus
gagcgaggactgcatctcacaaggg

SEQ ID NO: 518306 - DNA, 25 bp, Rattus norvegicus
acgacatggcttcggaaggcgcctg

SEQ ID NO: 518307 - DNA, 25 bp, Rattus norvegicus
gccgcctggcctacaagaactggga

SEQ ID NO: 518308 - DNA, 25 bp, Rattus norvegicus
gcctacaagaactgggagacggaga

SEQ ID NO: 518309 - DNA, 25 bp, Rattus norvegicus
ggagacggagattacgacgcaaccc

SEQ ID NO: 518310 - DNA, 25 bp, Rattus norvegicus
acgacgcaacccgacggcggcaaag

SEQ ID NO: 518311 - DNA, 25 bp, Rattus norvegicus
tccggcgcagccaacggcaagtggt

SEQ ID NO: 518312 - DNA, 25 bp, Rattus norvegicus
gcacgctgggcacgccgcagtctga

SEQ ID NO: 518313 - DNA, 25 bp, Rattus norvegicus
cgcagctgccagagccagcgtctgg

SEQ ID NO: 518314 - DNA, 25 bp, Rattus norvegicus
caccgtgtcagcgaagacgtgcgca

SEQ ID NO: 518315 - DNA, 25 bp, Rattus norvegicus
ggtgctcgaacgagcgcgctgctcc

SEQ ID NO: 518316 - DNA, 25 bp, Rattus norvegicus
ttcttccgcgcggtgctcgaacgag

SEQ ID NO: 518317 - DNA, 25 bp, Rattus norvegicus
cgggacctagaagccgcgctgcgca

SEQ ID NO: 518318 - DNA, 25 bp, Rattus norvegicus
actacagcggcgactacgaaggtgc

SEQ ID NO: 518319 - DNA, 25 bp, Rattus norvegicus
tggctgcctactacagcggcgacta

SEQ ID NO: 518320 - DNA, 25 bp, Rattus norvegicus
tacgctagcggcgtggctgcctact

SEQ ID NO: 518321 - DNA, 25 bp, Rattus norvegicus
acctgctctacgctagcggcgtggc

SEQ ID NO: 518322 - DNA, 25 bp, Rattus norvegicus
cgctgcagcccttcgacctgctcta

SEQ ID NO: 518323 - DNA, 25 bp, Rattus norvegicus
gcgcgctagctctcggagccagagc

SEQ ID NO: 518324 - DNA, 25 bp, Rattus norvegicus
ctgtcgtgcagcaggaccgcggcaa

SEQ ID NO: 518325 - DNA, 25 bp, Rattus norvegicus
tcacctgggactgtcgtgcagcagg

SEQ ID NO: 518326 - DNA, 25 bp, Rattus norvegicus
aagacgtgcgcagcgacttccagcg

SEQ ID NO: 518327 - DNA, 25 bp, Rattus norvegicus
cctacggtgctaccaggtcaggatc

SEQ ID NO: 518328 - DNA, 25 bp, Rattus norvegicus
cacgattgtggcctgtgtctgcgag

SEQ ID NO: 518329 - DNA, 25 bp, Rattus norvegicus
tctccctagggcacgattgtggcct

SEQ ID NO: 518330 - DNA, 25 bp, Rattus norvegicus
cctgtgtctgcgagtggcctcagcg

SEQ ID NO: 518331 - DNA, 25 bp, Rattus norvegicus
gctaccaggtcaggatcgcgcaacc

SEQ ID NO: 518332 - DNA, 25 bp, Rattus norvegicus
accatctacctacggtgctaccagg

SEQ ID NO: 518333 - DNA, 25 bp, Rattus norvegicus
catgactcgggggtcaccgcagtct

SEQ ID NO: 518334 - DNA, 25 bp, Rattus norvegicus
aacccgcaggccgagcgggccatga

SEQ ID NO: 518335 - DNA, 25 bp, Rattus norvegicus
agcgactgagaacccgcaggccgag

SEQ ID NO: 518336 - DNA, 25 bp, Rattus norvegicus
ctggccacaggttgctcttacctgt

SEQ ID NO: 518337 - DNA, 25 bp, Rattus norvegicus
ccagcagagcgactgagaacccgca

SEQ ID NO: 518338 - DNA, 25 bp, Rattus norvegicus
ggttgctcttacctgtcccgcgcag

SEQ ID NO: 518339 - DNA, 25 bp, Rattus norvegicus
cggggaccttgctccaccatctacc

SEQ ID NO: 518340 - DNA, 25 bp, Rattus norvegicus
ccgcagtctccctagggcacgattg

SEQ ID NO: 518341 - DNA, 25 bp, Rattus norvegicus
gcaatgatgggcaccggccagatga

SEQ ID NO: 518342 - DNA, 25 bp, Rattus norvegicus
tgctccatgccgttgggcaagaagc

SEQ ID NO: 518343 - DNA, 25 bp, Rattus norvegicus
acgctccacaccacgatgacaaggg

SEQ ID NO: 518344 - DNA, 25 bp, Rattus norvegicus
tgacaagggtcatgaagcaggccac

SEQ ID NO: 518345 - DNA, 25 bp, Rattus norvegicus
tccaggctgaagtccaggcagcaga

SEQ ID NO: 518346 - DNA, 25 bp, Rattus norvegicus
ccaggcagcagaagtgacgaggctc

SEQ ID NO: 518347 - DNA, 25 bp, Rattus norvegicus
cacgcacaggcgcaggtcttgctgc

SEQ ID NO: 518348 - DNA, 25 bp, Rattus norvegicus
aagagcagcaggtcgcactgcaagc

SEQ ID NO: 518349 - DNA, 25 bp, Rattus norvegicus
cgcacgagcagggagctcagcatct

SEQ ID NO: 518350 - DNA, 25 bp, Rattus norvegicus
atctgccgttgcacgctgatgttgc

SEQ ID NO: 518351 - DNA, 25 bp, Rattus norvegicus
gaaggaagcattggccgaagcattt

SEQ ID NO: 518352 - DNA, 25 bp, Rattus norvegicus
gcgtcccagaaaggccgggcgcatc

SEQ ID NO: 518353 - DNA, 25 bp, Rattus norvegicus
aaggccgaggcttgttgctgccagc

SEQ ID NO: 518354 - DNA, 25 bp, Rattus norvegicus
gctgccagcgtgttgggacgacact

SEQ ID NO: 518355 - DNA, 25 bp, Rattus norvegicus
catctgaagctgtaagtcccgtgtg

SEQ ID NO: 518356 - DNA, 25 bp, Rattus norvegicus
atttagtcagacgtccgaagggccg

SEQ ID NO: 518357 - DNA, 25 bp, Rattus norvegicus
gggtccttcttagggcgcagcaata

SEQ ID NO: 518358 - DNA, 25 bp, Rattus norvegicus
ttcgcaggcagagcaaacctttctc

SEQ ID NO: 518359 - DNA, 25 bp, Rattus norvegicus
ggagaggcctttttgactggacgtc

SEQ ID NO: 518360 - DNA, 25 bp, Rattus norvegicus
ctccgtccagtctggctgcagcgta

SEQ ID NO: 518361 - DNA, 25 bp, Rattus norvegicus
gcggccacagcctacgagcatctga

SEQ ID NO: 518362 - DNA, 25 bp, Rattus norvegicus
tggctcactggtttgtccgccaccg

SEQ ID NO: 518363 - DNA, 25 bp, Rattus norvegicus
tcatcggaggcgtacctcgcagatc

SEQ ID NO: 518364 - DNA, 25 bp, Rattus norvegicus
ggtctgctccaatccgctcatcgga

SEQ ID NO: 518365 - DNA, 25 bp, Rattus norvegicus
agaggcgacgtcactccgttctttg

SEQ ID NO: 518366 - DNA, 25 bp, Rattus norvegicus
ttgaatgtcgcaactcagcgcaacg

SEQ ID NO: 518367 - DNA, 25 bp, Rattus norvegicus
gagctgctgcagacaactttccctg

SEQ ID NO: 518368 - DNA, 25 bp, Rattus norvegicus
tcgtcgcaatgacgggtccttctta

SEQ ID NO: 518369 - DNA, 25 bp, Rattus norvegicus
gtcctgcacctgctggaaccacagt

SEQ ID NO: 518370 - DNA, 25 bp, Rattus norvegicus
gacttcagagctcggggaaaggatc

SEQ ID NO: 518371 - DNA, 25 bp, Rattus norvegicus
gctaatctcattaacgcgcacgaga

SEQ ID NO: 518372 - DNA, 25 bp, Rattus norvegicus
ggctcgcccgccttttaattgctaa

SEQ ID NO: 518373 - DNA, 25 bp, Rattus norvegicus
cgcttctcgtcagggcctggtctct

SEQ ID NO: 518374 - DNA, 25 bp, Rattus norvegicus
ttgaggccgtgccttctccatgtcc

SEQ ID NO: 518375 - DNA, 25 bp, Rattus norvegicus
cgaaaacgaactgcagcggattgcc

SEQ ID NO: 518376 - DNA, 25 bp, Rattus norvegicus
aacccacggcgtaggagatacaggc

SEQ ID NO: 518377 - DNA, 25 bp, Rattus norvegicus
ctccgccgtacatctggcacaggta

SEQ ID NO: 518378 - DNA, 25 bp, Rattus norvegicus
cccttgaagtgcgtgggacaaaaca

SEQ ID NO: 518379 - DNA, 25 bp, Rattus norvegicus
tcggggtaacctgcccttgaagtgc

SEQ ID NO: 518380 - DNA, 25 bp, Rattus norvegicus
cggcgttctctgtcatcggggtaac

SEQ ID NO: 518381 - DNA, 25 bp, Rattus norvegicus
ggaaccacagttgggactcaggacc

SEQ ID NO: 518382 - DNA, 25 bp, Rattus norvegicus
gcaaaagtccctctgccgcggcgtt

SEQ ID NO: 518383 - DNA, 25 bp, Rattus norvegicus
cttcctggaaacctactaggctttg

SEQ ID NO: 518384 - DNA, 25 bp, Rattus norvegicus
cgcggcacttacacgctcgtgggtc

SEQ ID NO: 518385 - DNA, 25 bp, Rattus norvegicus
caccgctgggcagaaacgaaacttt

SEQ ID NO: 518386 - DNA, 25 bp, Rattus norvegicus
cggcggccatgaagcgcccagtaca

SEQ ID NO: 518387 - DNA, 25 bp, Rattus norvegicus
atgaagcgcccagtacacccagagc

SEQ ID NO: 518388 - DNA, 25 bp, Rattus norvegicus
cgactcccggtatgcttcacaggtg

SEQ ID NO: 518389 - DNA, 25 bp, Rattus norvegicus
tcacaggtggcctacaactcccata

SEQ ID NO: 518390 - DNA, 25 bp, Rattus norvegicus
acagcctcagcaacaggtgacaacc

SEQ ID NO: 518391 - DNA, 25 bp, Rattus norvegicus
aactcccatagggtgcaactggccg

SEQ ID NO: 518392 - DNA, 25 bp, Rattus norvegicus
gcaactggccgatggacaataacta

SEQ ID NO: 518393 - DNA, 25 bp, Rattus norvegicus
gatggacaataactacgactcccgg

SEQ ID NO: 518394 - DNA, 25 bp, Rattus norvegicus
actcccggcatgcttcacgacgtga

SEQ ID NO: 518395 - DNA, 25 bp, Rattus norvegicus
acgacgtgacgccacttcctggaaa

SEQ ID NO: 518396 - DNA, 25 bp, Rattus norvegicus
actaggctttgcatacgcggaagtc

SEQ ID NO: 518397 - DNA, 25 bp, Rattus norvegicus
cgatctgagacttggaagtggcaca

SEQ ID NO: 518398 - DNA, 25 bp, Rattus norvegicus
ttggaagtggcacagctcgacgtca

SEQ ID NO: 518399 - DNA, 25 bp, Rattus norvegicus
agtggcacagctcgacgtcaggctg

SEQ ID NO: 518400 - DNA, 25 bp, Rattus norvegicus
aagtgggcgctcagtttcccagggc

SEQ ID NO: 518401 - DNA, 25 bp, Rattus norvegicus
agtttcccagggctcttctgcaaga

SEQ ID NO: 518402 - DNA, 25 bp, Rattus norvegicus
agggctcttctgcaagagggagaca

SEQ ID NO: 518403 - DNA, 25 bp, Rattus norvegicus
tgctcgcgtcccgtggagggccaca

SEQ ID NO: 518404 - DNA, 25 bp, Rattus norvegicus
cggtgccggcgattactgtcacctc

SEQ ID NO: 518405 - DNA, 25 bp, Rattus norvegicus
cggcgattactgtcacctcgggcct

SEQ ID NO: 518406 - DNA, 25 bp, Rattus norvegicus
ggtgcagcgccgcacaccctctctt

SEQ ID NO: 518407 - DNA, 25 bp, Rattus norvegicus
acaccctctcttgcagcagctggtc

SEQ ID NO: 518408 - DNA, 25 bp, Rattus norvegicus
gcgcttggctctcatgcgctccagt

SEQ ID NO: 518409 - DNA, 25 bp, Rattus norvegicus
ggctctcatgcgctccagtgcagca

SEQ ID NO: 518410 - DNA, 25 bp, Rattus norvegicus
gcacacggtggcgatctgagacttg

SEQ ID NO: 518411 - DNA, 25 bp, Rattus norvegicus
actaggtgccactcgtctcgatctg

SEQ ID NO: 518412 - DNA, 25 bp, Rattus norvegicus
cactcgtctcgatctggctcatatc

SEQ ID NO: 518413 - DNA, 25 bp, Rattus norvegicus
acattggcgcgactaggtgccactc

SEQ ID NO: 518414 - DNA, 25 bp, Rattus norvegicus
tatctgcgaaggacatgatgcaccg

SEQ ID NO: 518415 - DNA, 25 bp, Rattus norvegicus
cccgctccggatggtattcattggt

SEQ ID NO: 518416 - DNA, 25 bp, Rattus norvegicus
ccggatggtattcattggtgtaatc

SEQ ID NO: 518417 - DNA, 25 bp, Rattus norvegicus
tggtgtaatcatccgccactcattc

SEQ ID NO: 518418 - DNA, 25 bp, Rattus norvegicus
gccactcattcctctccgggtagta

SEQ ID NO: 518419 - DNA, 25 bp, Rattus norvegicus
tcctctccgggtagtaacattctgc

SEQ ID NO: 518420 - DNA, 25 bp, Rattus norvegicus
acattctgccgagttaagccggtta

SEQ ID NO: 518421 - DNA, 25 bp, Rattus norvegicus
taagccggttagtcccatcaaagcc

SEQ ID NO: 518422 - DNA, 25 bp, Rattus norvegicus
cccactgcatacagcaagcggttga

SEQ ID NO: 518423 - DNA, 25 bp, Rattus norvegicus
gatcctccgcgtcaacattggcgcg

SEQ ID NO: 518424 - DNA, 25 bp, Rattus norvegicus
atctggctcatatctgcgaaggaca

SEQ ID NO: 518425 - DNA, 25 bp, Rattus norvegicus
gctgcgggcagtcgtatttgaccca

SEQ ID NO: 518426 - DNA, 25 bp, Rattus norvegicus
ctcgcagcgcacgttcagatcatcg

SEQ ID NO: 518427 - DNA, 25 bp, Rattus norvegicus
tgcacgcatggaacacctcggactc

SEQ ID NO: 518428 - DNA, 25 bp, Rattus norvegicus
atttgacccagtcgatgcacgcatg

SEQ ID NO: 518429 - DNA, 25 bp, Rattus norvegicus
cccgactgcgtagatgtggccatct

SEQ ID NO: 518430 - DNA, 25 bp, Rattus norvegicus
ttgcgcggcacgctcatagaggcac

SEQ ID NO: 518431 - DNA, 25 bp, Rattus norvegicus
accactggttggtcatggggttgta

SEQ ID NO: 518432 - DNA, 25 bp, Rattus norvegicus
gccaggagccattgctcgggttgta

SEQ ID NO: 518433 - DNA, 25 bp, Rattus norvegicus
tgcagcgtgagctcctggaagatct

SEQ ID NO: 518434 - DNA, 25 bp, Rattus norvegicus
tgcaccaggtagtccttgcagcgcg

SEQ ID NO: 518435 - DNA, 25 bp, Rattus norvegicus
tcggcctgcaggatctcgcactttt

SEQ ID NO: 518436 - DNA, 25 bp, Rattus norvegicus
tctcgcacttttgcagctgtgtctg

SEQ ID NO: 518437 - DNA, 25 bp, Rattus norvegicus
gcccgtagcagtgcctgcacgtaga

SEQ ID NO: 518438 - DNA, 25 bp, Rattus norvegicus
taaccgcccgcagtgtagatgaggc

SEQ ID NO: 518439 - DNA, 25 bp, Rattus norvegicus
ctcggatcggggcagcggtgctgcg

SEQ ID NO: 518440 - DNA, 25 bp, Rattus norvegicus
gagggcggaaacaggcggcgggcac

SEQ ID NO: 518441 - DNA, 25 bp, Rattus norvegicus
caccctacgcgggtgcacgggctgg

SEQ ID NO: 518442 - DNA, 25 bp, Rattus norvegicus
ccgccacgcgccgcgcttccgggag

SEQ ID NO: 518443 - DNA, 25 bp, Rattus norvegicus
cacgcgtccaatccgcaccgccggg

SEQ ID NO: 518444 - DNA, 25 bp, Rattus norvegicus
cgggcgctcgctcacctccgtccca

SEQ ID NO: 518445 - DNA, 25 bp, Rattus norvegicus
cccgggtgtctctgttggtgccacg

SEQ ID NO: 518446 - DNA, 25 bp, Rattus norvegicus
gtctctgttggtgccacgcgtccaa

SEQ ID NO: 518447 - DNA, 25 bp, Rattus norvegicus
ctctgttggtgccacgcgtccaatc

SEQ ID NO: 518448 - DNA, 25 bp, Rattus norvegicus
ctgttggtgccacgcgtccaatccg

SEQ ID NO: 518449 - DNA, 25 bp, Rattus norvegicus
ttggtgccacgcgtccaatccgcac

SEQ ID NO: 518450 - DNA, 25 bp, Rattus norvegicus
cctcggccaccaccctacgcgggtg

SEQ ID NO: 518451 - DNA, 25 bp, Rattus norvegicus
cacttggaggggtcacgcgcttccc

SEQ ID NO: 518452 - DNA, 25 bp, Rattus norvegicus
tcccgggcggcacgcgtgggaggag

SEQ ID NO: 518453 - DNA, 25 bp, Rattus norvegicus
ggcttccaggcgtcccaagcagttc

SEQ ID NO: 518454 - DNA, 25 bp, Rattus norvegicus
ctccagcacgatgaaagcgcacaca

SEQ ID NO: 518455 - DNA, 25 bp, Rattus norvegicus
ccagcgagcaggtccgacaaggtaa

SEQ ID NO: 518456 - DNA, 25 bp, Rattus norvegicus
cacataggccttggcgtagagcggc

SEQ ID NO: 518457 - DNA, 25 bp, Rattus norvegicus
aggccagcacgcagaagagcacata

SEQ ID NO: 518458 - DNA, 25 bp, Rattus norvegicus
gttggcccgcacctgacagtaaatc

SEQ ID NO: 518459 - DNA, 25 bp, Rattus norvegicus
aaggccaggagcaccacgctaagcg

SEQ ID NO: 518460 - DNA, 25 bp, Rattus norvegicus
caccggaaggcccaacagcacttgg

SEQ ID NO: 518461 - DNA, 25 bp, Rattus norvegicus
gctgggcacgcgacatccagtaata

SEQ ID NO: 518462 - DNA, 25 bp, Rattus norvegicus
agcacttggggatcgctgcaaactg

SEQ ID NO: 518463 - DNA, 25 bp, Rattus norvegicus
cttgcagaagcacaggacacgcgcg

SEQ ID NO: 518464 - DNA, 25 bp, Rattus norvegicus
ttcagcagcgagttagccatggcta

SEQ ID NO: 518465 - DNA, 25 bp, Rattus norvegicus
tccttgcatagagcgcacagatggc

SEQ ID NO: 518466 - DNA, 25 bp, Rattus norvegicus
atggcggcccagcaccaagagcaca

SEQ ID NO: 518467 - DNA, 25 bp, Rattus norvegicus
cttcagagtgtagcgcgcatgcttg

SEQ ID NO: 518468 - DNA, 25 bp, Rattus norvegicus
cagcccgaggctgcctggttttatc

SEQ ID NO: 518469 - DNA, 25 bp, Rattus norvegicus
gtctatattctgcaccagcccgctg

SEQ ID NO: 518470 - DNA, 25 bp, Rattus norvegicus
ctttgccaccgccagagtagagttg

SEQ ID NO: 518471 - DNA, 25 bp, Rattus norvegicus
ccgcgtagacaaggtagcccacttt

SEQ ID NO: 518472 - DNA, 25 bp, Rattus norvegicus
ctgccgtccacagtgcctctgtaga

SEQ ID NO: 518473 - DNA, 25 bp, Rattus norvegicus
caggacccacgcaagagcggcttca

SEQ ID NO: 518474 - DNA, 25 bp, Rattus norvegicus
aaactcgttcggactctgcccagga

SEQ ID NO: 518475 - DNA, 25 bp, Rattus norvegicus
gacatgcaggatgcgtgaagaccca

SEQ ID NO: 518476 - DNA, 25 bp, Rattus norvegicus
aagccctcgcgggtgtagacatgca

SEQ ID NO: 518477 - DNA, 25 bp, Rattus norvegicus
ctagaactactgtgcaccgaggggc

SEQ ID NO: 518478 - DNA, 25 bp, Rattus norvegicus
tcccgcgttcccagctggcgagaaa

SEQ ID NO: 518479 - DNA, 25 bp, Rattus norvegicus
agcagcagcaaggacgcccactcga

SEQ ID NO: 518480 - DNA, 25 bp, Rattus norvegicus
tgccagttctgtgcgtcgcctagaa

SEQ ID NO: 518481 - DNA, 25 bp, Rattus norvegicus
ttccttcttcctgcggaagcgcctt

SEQ ID NO: 518482 - DNA, 25 bp, Rattus norvegicus
tcgcccgtcgaaccacgatcccttg

SEQ ID NO: 518483 - DNA, 25 bp, Rattus norvegicus
gaaccacgatcccttgccctctgcc

SEQ ID NO: 518484 - DNA, 25 bp, Rattus norvegicus
caccttgcccttgacgtccagaatg

SEQ ID NO: 518485 - DNA, 25 bp, Rattus norvegicus
ccttgcccttgacgtccagaatgaa

SEQ ID NO: 518486 - DNA, 25 bp, Rattus norvegicus
ttgcccttgacgtccagaatgaaga

SEQ ID NO: 518487 - DNA, 25 bp, Rattus norvegicus
cccttgacgtccagaatgaagactg

SEQ ID NO: 518488 - DNA, 25 bp, Rattus norvegicus
tgacgtccagaatgaagactgccga

SEQ ID NO: 518489 - DNA, 25 bp, Rattus norvegicus
tgaagactgccgaggccgacatggt

SEQ ID NO: 518490 - DNA, 25 bp, Rattus norvegicus
tgggccctcgtgctcgcccgtcgaa

SEQ ID NO: 518491 - DNA, 25 bp, Rattus norvegicus
ggccgccaggtgaatgcgtcttaaa

SEQ ID NO: 518492 - DNA, 25 bp, Rattus norvegicus
cccagctcccggtcctgtgccctgg

SEQ ID NO: 518493 - DNA, 25 bp, Rattus norvegicus
ctgctgcttccttcttcctgcggaa

SEQ ID NO: 518494 - DNA, 25 bp, Rattus norvegicus
cgcccggtgaagctaggaggcgaga

SEQ ID NO: 518495 - DNA, 25 bp, Rattus norvegicus
ctgcaggcaggacgaaggcccttct

SEQ ID NO: 518496 - DNA, 25 bp, Rattus norvegicus
aaaacaaaacgctcgtggctgcagg

SEQ ID NO: 518497 - DNA, 25 bp, Rattus norvegicus
ggacgaaggcccttctgtccgcgtc

SEQ ID NO: 518498 - DNA, 25 bp, Rattus norvegicus
ccttaaaacaaaacgctcgtggctg

SEQ ID NO: 518499 - DNA, 25 bp, Rattus norvegicus
ggaagggcgacatctgagagcctta

SEQ ID NO: 518500 - DNA, 25 bp, Rattus norvegicus
taggtcgcctgtgcggacttggaaa

SEQ ID NO: 518501 - DNA, 25 bp, Rattus norvegicus
gcctccggcctgtaggtcgcctgtg

SEQ ID NO: 518502 - DNA, 25 bp, Rattus norvegicus
atggtaggagtagcctccggcctgt

SEQ ID NO: 518503 - DNA, 25 bp, Rattus norvegicus
cgcagtgtatggtaggagtagcctc

SEQ ID NO: 518504 - DNA, 25 bp, Rattus norvegicus
ccatggaggacgatcggaaggacgc

SEQ ID NO: 518505 - DNA, 25 bp, Rattus norvegicus
agctcccctcggttgcggccatgga

SEQ ID NO: 518506 - DNA, 25 bp, Rattus norvegicus
tcgctctggcttcggactcagctcc

SEQ ID NO: 518507 - DNA, 25 bp, Rattus norvegicus
ggctcagccggagcgcttggcccta

SEQ ID NO: 518508 - DNA, 25 bp, Rattus norvegicus
ctgcatcccgcgctggctcagccgg

SEQ ID NO: 518509 - DNA, 25 bp, Rattus norvegicus
ccctgctccattgcgtcacgtgata

SEQ ID NO: 518510 - DNA, 25 bp, Rattus norvegicus
gacaaggctgttgctatcccgccga

SEQ ID NO: 518511 - DNA, 25 bp, Rattus norvegicus
ttctcccacttgtcagcgaagtctg

SEQ ID NO: 518512 - DNA, 25 bp, Rattus norvegicus
cttctcgccattgcagttgggactg

SEQ ID NO: 518513 - DNA, 25 bp, Rattus norvegicus
ggcctaggttgatcgcccacgtgac

SEQ ID NO: 518514 - DNA, 25 bp, Rattus norvegicus
ccagtcgctaagtcaacgtcacgtg

SEQ ID NO: 518515 - DNA, 25 bp, Rattus norvegicus
gtcacgcaatcagacccagtcgcta

SEQ ID NO: 518516 - DNA, 25 bp, Rattus norvegicus
tgtgaccgaccaaacccgtgagaga

SEQ ID NO: 518517 - DNA, 25 bp, Rattus norvegicus
aagccagccactgtcatgtgaccga

SEQ ID NO: 518518 - DNA, 25 bp, Rattus norvegicus
ctcatcaggtgatacgggtctacca

SEQ ID NO: 518519 - DNA, 25 bp, Rattus norvegicus
ggatcttccatctttcagcgtctcg

SEQ ID NO: 518520 - DNA, 25 bp, Rattus norvegicus
tcgctcgagaaaaaccgcctttgga

SEQ ID NO: 518521 - DNA, 25 bp, Rattus norvegicus
tcacatgatgagagcgaagccagcc

SEQ ID NO: 518522 - DNA, 25 bp, Rattus norvegicus
ctggagtcctcataagggcccatcc

SEQ ID NO: 518523 - DNA, 25 bp, Rattus norvegicus
gcacgttggccgtcttggggttcat

SEQ ID NO: 518524 - DNA, 25 bp, Rattus norvegicus
gggccgcgagagcagaaaagctttc

SEQ ID NO: 518525 - DNA, 25 bp, Rattus norvegicus
accagaaactcaatggaccggttca

SEQ ID NO: 518526 - DNA, 25 bp, Rattus norvegicus
caagagggtagttaacgcggctcca

SEQ ID NO: 518527 - DNA, 25 bp, Rattus norvegicus
cggctccacgggacactccagtgga

SEQ ID NO: 518528 - DNA, 25 bp, Rattus norvegicus
gcgttgtccttacctgtcgcgagtg

SEQ ID NO: 518529 - DNA, 25 bp, Rattus norvegicus
ttgcgaagcctcatgggcacggtct

SEQ ID NO: 518530 - DNA, 25 bp, Rattus norvegicus
tcatgacggcgttgaaaagcgcttc

SEQ ID NO: 518531 - DNA, 25 bp, Rattus norvegicus
aaaagcgcttccaggtcggtctccg

SEQ ID NO: 518532 - DNA, 25 bp, Rattus norvegicus
ggcggcgtcccaactgagacagaaa

SEQ ID NO: 518533 - DNA, 25 bp, Rattus norvegicus
ctgagacagaaacttcggctctaga

SEQ ID NO: 518534 - DNA, 25 bp, Rattus norvegicus
ttcggctctagacgcccaaactaaa

SEQ ID NO: 518535 - DNA, 25 bp, Rattus norvegicus
ctaaaaagttgcgaggagcgcccgc

SEQ ID NO: 518536 - DNA, 25 bp, Rattus norvegicus
agtcgggcagcttgcgaagcctcat

SEQ ID NO: 518537 - DNA, 25 bp, Rattus norvegicus
gcttgagtccgctccacgaatcatg

SEQ ID NO: 518538 - DNA, 25 bp, Rattus norvegicus
ctcatctccttgtccgaggtgacgg

SEQ ID NO: 518539 - DNA, 25 bp, Rattus norvegicus
cggcttccagatggtgtctctcatc

SEQ ID NO: 518540 - DNA, 25 bp, Rattus norvegicus
aggctcgatctcctgacagctttgc

SEQ ID NO: 518541 - DNA, 25 bp, Rattus norvegicus
cccacaatctgctgacggtgagttg

SEQ ID NO: 518542 - DNA, 25 bp, Rattus norvegicus
agctcacggtcttcacggtttcatg

SEQ ID NO: 518543 - DNA, 25 bp, Rattus norvegicus
acagggtccggagctgatccagaaa

SEQ ID NO: 518544 - DNA, 25 bp, Rattus norvegicus
ggcctaactttttctccatcacagg

SEQ ID NO: 518545 - DNA, 25 bp, Rattus norvegicus
taagcacactgctggggctcaccca

SEQ ID NO: 518546 - DNA, 25 bp, Rattus norvegicus
gccgggacacgcctcaggaaatgtc

SEQ ID NO: 518547 - DNA, 25 bp, Rattus norvegicus
acacctaccatctggggttgaggcc

SEQ ID NO: 518548 - DNA, 25 bp, Rattus norvegicus
gccgcatctgcttgggcaacaccta

SEQ ID NO: 518549 - DNA, 25 bp, Rattus norvegicus
ccatgaagggtatcaccgcggagca

SEQ ID NO: 518550 - DNA, 25 bp, Rattus norvegicus
ccctgtgttcatgcctgtgggtaca

SEQ ID NO: 518551 - DNA, 25 bp, Rattus norvegicus
gacgccttcagctccatcggtcaga

SEQ ID NO: 518552 - DNA, 25 bp, Rattus norvegicus
agcaggaggaagcaacggccacaga

SEQ ID NO: 518553 - DNA, 25 bp, Rattus norvegicus
aatggcggaactgcggctcgcggac

SEQ ID NO: 518554 - DNA, 25 bp, Rattus norvegicus
ctgccacctggacctgccgcagatc

SEQ ID NO: 518555 - DNA, 25 bp, Rattus norvegicus
ctccatcggtcagagctgccacctg

SEQ ID NO: 518556 - DNA, 25 bp, Rattus norvegicus
cttcagctccatcggtcagagctgc

SEQ ID NO: 518557 - DNA, 25 bp, Rattus norvegicus
cccgctggttaacaagctgcaggac

SEQ ID NO: 518558 - DNA, 25 bp, Rattus norvegicus
atcccgctggttaacaagctgcagg

SEQ ID NO: 518559 - DNA, 25 bp, Rattus norvegicus
ggaggcgggcaccatgggcaaccgc

SEQ ID NO: 518560 - DNA, 25 bp, Rattus norvegicus
agacgcatcgggaccgcgagtcgta

SEQ ID NO: 518561 - DNA, 25 bp, Rattus norvegicus
aagcaacggccacagacgcatcggg

SEQ ID NO: 518562 - DNA, 25 bp, Rattus norvegicus
gtgtcgcctgagaaccggatgaggc

SEQ ID NO: 518563 - DNA, 25 bp, Rattus norvegicus
tgcaggacgccttcagctccatcgg

SEQ ID NO: 518564 - DNA, 25 bp, Rattus norvegicus
ccacagacgcatcgggaccgcgagt

SEQ ID NO: 518565 - DNA, 25 bp, Rattus norvegicus
tctcacctggtactcggtctcaaga

SEQ ID NO: 518566 - DNA, 25 bp, Rattus norvegicus
tagccacagggccagtgctacggcc

SEQ ID NO: 518567 - DNA, 25 bp, Rattus norvegicus
cctactgctggcaggagtagccaca

SEQ ID NO: 518568 - DNA, 25 bp, Rattus norvegicus
cccactcctactgctggcaggagta

SEQ ID NO: 518569 - DNA, 25 bp, Rattus norvegicus
cgtgaactcgccgtcctggatgggc

SEQ ID NO: 518570 - DNA, 25 bp, Rattus norvegicus
agaaacgtgaactcgccgtcctgga

SEQ ID NO: 518571 - DNA, 25 bp, Rattus norvegicus
ccggcgggaagcagaaacgtgaact

SEQ ID NO: 518572 - DNA, 25 bp, Rattus norvegicus
aacactgcttcctcccggcgggaag

SEQ ID NO: 518573 - DNA, 25 bp, Rattus norvegicus
gcggactgatagaaacactgcttcc

SEQ ID NO: 518574 - DNA, 25 bp, Rattus norvegicus
ttggccggtgcggactgatagaaac

SEQ ID NO: 518575 - DNA, 25 bp, Rattus norvegicus
gtactcggtctcaagactagcattg

SEQ ID NO: 518576 - DNA, 25 bp, Rattus norvegicus
tactgctctattccgagccgggacc

SEQ ID NO: 518577 - DNA, 25 bp, Rattus norvegicus
atccgggtcaccctctactcacggg

SEQ ID NO: 518578 - DNA, 25 bp, Rattus norvegicus
tctcaagactagcattggccggtgc

SEQ ID NO: 518579 - DNA, 25 bp, Rattus norvegicus
gcagagcgcctccttctggagaatg

SEQ ID NO: 518580 - DNA, 25 bp, Rattus norvegicus
ggcggctaagccacctcacaaagca

SEQ ID NO: 518581 - DNA, 25 bp, Rattus norvegicus
tctgttcgcaaaacgcggcctcggg

SEQ ID NO: 518582 - DNA, 25 bp, Rattus norvegicus
gctgtggcacaaagcgcctctgttc

SEQ ID NO: 518583 - DNA, 25 bp, Rattus norvegicus
ggagaatgcctcactcccatgcgta

SEQ ID NO: 518584 - DNA, 25 bp, Rattus norvegicus
tcagccctcgaggaggcgtttcctt

SEQ ID NO: 518585 - DNA, 25 bp, Rattus norvegicus
atttggctaataaccgtcccttctg

SEQ ID NO: 518586 - DNA, 25 bp, Rattus norvegicus
agatgcagagctccgccagtatttg

SEQ ID NO: 518587 - DNA, 25 bp, Rattus norvegicus
ctggctatccgacctctccgaggga

SEQ ID NO: 518588 - DNA, 25 bp, Rattus norvegicus
tacaaagcgctgtggttcacgggtc

SEQ ID NO: 518589 - DNA, 25 bp, Rattus norvegicus
ggaccgcctcctgaaacaccaggtg

SEQ ID NO: 518590 - DNA, 25 bp, Rattus norvegicus
acagtggcacaaagcatggtcgttc

SEQ ID NO: 518591 - DNA, 25 bp, Rattus norvegicus
tttcttgagctaccctcacagtggc

SEQ ID NO: 518592 - DNA, 25 bp, Rattus norvegicus
gggtagtacgcagtacgctggccta

SEQ ID NO: 518593 - DNA, 25 bp, Rattus norvegicus
accttggagcccgaagaggggcgcg

SEQ ID NO: 518594 - DNA, 25 bp, Rattus norvegicus
gcgcccgcctcctcactatcggcga

SEQ ID NO: 518595 - DNA, 25 bp, Rattus norvegicus
tcactatcggcgacgcgaacggcga

SEQ ID NO: 518596 - DNA, 25 bp, Rattus norvegicus
cgcgaacggcgagatccagcggcac

SEQ ID NO: 518597 - DNA, 25 bp, Rattus norvegicus
agatccagcggcacgcggagcagca

SEQ ID NO: 518598 - DNA, 25 bp, Rattus norvegicus
gtactcgggccgatcttgtacacgc

SEQ ID NO: 518599 - DNA, 25 bp, Rattus norvegicus
gggcatcgccctctacagccgtgag

SEQ ID NO: 518600 - DNA, 25 bp, Rattus norvegicus
atcgccctctacagccgtgagtgct

SEQ ID NO: 518601 - DNA, 25 bp, Rattus norvegicus
gatcttgtacacgcggctcccgctg

SEQ ID NO: 518602 - DNA, 25 bp, Rattus norvegicus
aacaagagtcgcgggcctgagattt

SEQ ID NO: 518603 - DNA, 25 bp, Rattus norvegicus
ctgcccgcgggtgagatggcagaga

SEQ ID NO: 518604 - DNA, 25 bp, Rattus norvegicus
cctgcgcgacagtgtcggtgttccc

SEQ ID NO: 518605 - DNA, 25 bp, Rattus norvegicus
cgggccgatcttgtacacgcggctc

SEQ ID NO: 518606 - DNA, 25 bp, Rattus norvegicus
ctctacagccgtgagtgctggggac

SEQ ID NO: 518607 - DNA, 25 bp, Rattus norvegicus
gtccgtttcctattgtcttccagtg

SEQ ID NO: 518608 - DNA, 25 bp, Rattus norvegicus
ttctcgacgcaacggcaacatccgg

SEQ ID NO: 518609 - DNA, 25 bp, Rattus norvegicus
acttcctgtatcttgcgcttgcgca

SEQ ID NO: 518610 - DNA, 25 bp, Rattus norvegicus
gcgcttgcgcaggatctactctcca

SEQ ID NO: 518611 - DNA, 25 bp, Rattus norvegicus
ctcgactgaggaaccgccggaaaat

SEQ ID NO: 518612 - DNA, 25 bp, Rattus norvegicus
ctgaagagattctggtcccgtggac

SEQ ID NO: 518613 - DNA, 25 bp, Rattus norvegicus
tggcccaagtggctgaatcattgtc

SEQ ID NO: 518614 - DNA, 25 bp, Rattus norvegicus
gaggaggccttgcttgacgcatcaa

SEQ ID NO: 518615 - DNA, 25 bp, Rattus norvegicus
aagttctctcttgctgttggcgccg

SEQ ID NO: 518616 - DNA, 25 bp, Rattus norvegicus
accgccactcggaagagttcttgca

SEQ ID NO: 518617 - DNA, 25 bp, Rattus norvegicus
ctgcgtcacgtgaacctggggttct

SEQ ID NO: 518618 - DNA, 25 bp, Rattus norvegicus
tgggtcctgaagaaccgcatgcatg

SEQ ID NO: 518619 - DNA, 25 bp, Rattus norvegicus
tgcgacatcaacgacgacgagtttc

SEQ ID NO: 518620 - DNA, 25 bp, Rattus norvegicus
tcattgtcactgcagcgcttctttc

SEQ ID NO: 518621 - DNA, 25 bp, Rattus norvegicus
aggctgacgtcaggggcctgaattc

SEQ ID NO: 518622 - DNA, 25 bp, Rattus norvegicus
gaagcctttgctacaatacctgggg

SEQ ID NO: 518623 - DNA, 25 bp, Rattus norvegicus
ggagcgaacccacagacaaaaagtg

SEQ ID NO: 518624 - DNA, 25 bp, Rattus norvegicus
caggggcctgaattcctgactttgc

SEQ ID NO: 518625 - DNA, 25 bp, Rattus norvegicus
gaattcctgactttgcctgcacgca

SEQ ID NO: 518626 - DNA, 25 bp, Rattus norvegicus
tcctgactttgcctgcacgcatttg

SEQ ID NO: 518627 - DNA, 25 bp, Rattus norvegicus
ttgcctgcacgcatttgtccatgta

SEQ ID NO: 518628 - DNA, 25 bp, Rattus norvegicus
catttgtccatgtaaggtatgggga

SEQ ID NO: 518629 - DNA, 25 bp, Rattus norvegicus
acttatcccgggaaagctcgagcgg

SEQ ID NO: 518630 - DNA, 25 bp, Rattus norvegicus
gccgctaacgctacttatcccggga

SEQ ID NO: 518631 - DNA, 25 bp, Rattus norvegicus
tgctggcccttaccttgcagcggcc

SEQ ID NO: 518632 - DNA, 25 bp, Rattus norvegicus
acgggaggaagcctttgctacaata

SEQ ID NO: 518633 - DNA, 25 bp, Rattus norvegicus
tgcacgcatttgtccatgtaaggta

SEQ ID NO: 518634 - DNA, 25 bp, Rattus norvegicus
ccctgagcgctggaggctgacgtca

SEQ ID NO: 518635 - DNA, 25 bp, Rattus norvegicus
aggagaagcgagacgcccactctgt

SEQ ID NO: 518636 - DNA, 25 bp, Rattus norvegicus
tcttgaacataagtgtgcgcttgcg

SEQ ID NO: 518637 - DNA, 25 bp, Rattus norvegicus
cgcctgagggtcaagaagccttgcg

SEQ ID NO: 518638 - DNA, 25 bp, Rattus norvegicus
tccaggtaaggaatggagactcccg

SEQ ID NO: 518639 - DNA, 25 bp, Rattus norvegicus
ggcccaatttcgtgtcttgaacata

SEQ ID NO: 518640 - DNA, 25 bp, Rattus norvegicus
caatatgggcggtgcaccaggatct

SEQ ID NO: 518641 - DNA, 25 bp, Rattus norvegicus
accaggatctcgtgcggcctctgga

SEQ ID NO: 518642 - DNA, 25 bp, Rattus norvegicus
ttctcactacctcaaaggaccagtg

SEQ ID NO: 518643 - DNA, 25 bp, Rattus norvegicus
gcgcatgcgcacaacgaatggctga

SEQ ID NO: 518644 - DNA, 25 bp, Rattus norvegicus
ctgagcatgcgcacagagagcggaa

SEQ ID NO: 518645 - DNA, 25 bp, Rattus norvegicus
cgcgcgaggctttcccactagcttg

SEQ ID NO: 518646 - DNA, 25 bp, Rattus norvegicus
cgacggcttctttgtttcgtgagga

SEQ ID NO: 518647 - DNA, 25 bp, Rattus norvegicus
tgctcaggccgcagtgcagcgagac

SEQ ID NO: 518648 - DNA, 25 bp, Rattus norvegicus
tgcccttcggcttgaggcccaattt

SEQ ID NO: 518649 - DNA, 25 bp, Rattus norvegicus
tgccacccaggttttgcagctgaga

SEQ ID NO: 518650 - DNA, 25 bp, Rattus norvegicus
gattgcagcccgcataccgtggggc

SEQ ID NO: 518651 - DNA, 25 bp, Rattus norvegicus
acccgtgatcctgtgtttgcagcgg

SEQ ID NO: 518652 - DNA, 25 bp, Rattus norvegicus
agtcagtcaccagttgacccagtgc

SEQ ID NO: 518653 - DNA, 25 bp, Rattus norvegicus
caccagttgacccagtgcggcgtag

SEQ ID NO: 518654 - DNA, 25 bp, Rattus norvegicus
acccagtgcggcgtaggattgcagc

SEQ ID NO: 518655 - DNA, 25 bp, Rattus norvegicus
gcgtaggattgcagcccgcataccg

SEQ ID NO: 518656 - DNA, 25 bp, Rattus norvegicus
agcccgcataccgtggggcttgcca

SEQ ID NO: 518657 - DNA, 25 bp, Rattus norvegicus
ataccgtggggcttgccacccaggt

SEQ ID NO: 518658 - DNA, 25 bp, Rattus norvegicus
gggcttgccacccaggttttgcagc

SEQ ID NO: 518659 - DNA, 25 bp, Rattus norvegicus
tgggacccgtgatcctgtgtttgca

SEQ ID NO: 518660 - DNA, 25 bp, Rattus norvegicus
ctgagacaccgtgggacccgtgatc

SEQ ID NO: 518661 - DNA, 25 bp, Rattus norvegicus
acccaggttttgcagctgagacacc

SEQ ID NO: 518662 - DNA, 25 bp, Rattus norvegicus
ttttgcagctgagacaccgtgggac

SEQ ID NO: 518663 - DNA, 25 bp, Rattus norvegicus
agaagaagatgaggtgcaggggcgt

SEQ ID NO: 518664 - DNA, 25 bp, Rattus norvegicus
cctcgcccaatggaagaagaagatg

SEQ ID NO: 518665 - DNA, 25 bp, Rattus norvegicus
ccctcgcccaatggaagaagaagat

SEQ ID NO: 518666 - DNA, 25 bp, Rattus norvegicus
ggcgagactcgagccactcccctcg

SEQ ID NO: 518667 - DNA, 25 bp, Rattus norvegicus
aacaggcgagactcgagccactccc

SEQ ID NO: 518668 - DNA, 25 bp, Rattus norvegicus
gaacaggcgagactcgagccactcc

SEQ ID NO: 518669 - DNA, 25 bp, Rattus norvegicus
cttgcctgagtctccggggtcgggt

SEQ ID NO: 518670 - DNA, 25 bp, Rattus norvegicus
ctcgcccaatggaagaagaagatga

SEQ ID NO: 518671 - DNA, 25 bp, Rattus norvegicus
aggggcgtggcttgcctgagtctcc

SEQ ID NO: 518672 - DNA, 25 bp, Rattus norvegicus
cggaacaggcgagactcgagccact

SEQ ID NO: 518673 - DNA, 25 bp, Rattus norvegicus
tcgggtggggctacacatcctggcc

SEQ ID NO: 518674 - DNA, 25 bp, Rattus norvegicus
ggtggggctacacatcctggccgcc

SEQ ID NO: 518675 - DNA, 25 bp, Rattus norvegicus
ggaacaggcgagactcgagccactc

SEQ ID NO: 518676 - DNA, 25 bp, Rattus norvegicus
gtggggctacacatcctggccgccc

SEQ ID NO: 518677 - DNA, 25 bp, Rattus norvegicus
aatcagcgagtggacagagagcttc

SEQ ID NO: 518678 - DNA, 25 bp, Rattus norvegicus
gagcggccattttgtggagaaccta

SEQ ID NO: 518679 - DNA, 25 bp, Rattus norvegicus
agcaggctcagtagcccgtagctca

SEQ ID NO: 518680 - DNA, 25 bp, Rattus norvegicus
ggctgcttcagtacgagtctgttgc

SEQ ID NO: 518681 - DNA, 25 bp, Rattus norvegicus
gcgtgcgtcaattctcccgctctga

SEQ ID NO: 518682 - DNA, 25 bp, Rattus norvegicus
tggccagtccgcgtttggcccagta

SEQ ID NO: 518683 - DNA, 25 bp, Rattus norvegicus
accaatcatcgtagggagggcgtgc

SEQ ID NO: 518684 - DNA, 25 bp, Rattus norvegicus
cactcaggtgtgaggaccaatcatc

SEQ ID NO: 518685 - DNA, 25 bp, Rattus norvegicus
gtccgtcttctgcaggactcaatca

SEQ ID NO: 518686 - DNA, 25 bp, Rattus norvegicus
ttggatcgttcctacgtccgtcttc

SEQ ID NO: 518687 - DNA, 25 bp, Rattus norvegicus
ttcccagagagcctaagactcattg

SEQ ID NO: 518688 - DNA, 25 bp, Rattus norvegicus
cgcgcaaatttgtctcaccgtggcc

SEQ ID NO: 518689 - DNA, 25 bp, Rattus norvegicus
gaaagccgccatgactgaccgccta

SEQ ID NO: 518690 - DNA, 25 bp, Rattus norvegicus
tgtggagaacctaagaaacgccttc

SEQ ID NO: 518691 - DNA, 25 bp, Rattus norvegicus
gccaggaccgccatgttaactaaga

SEQ ID NO: 518692 - DNA, 25 bp, Rattus norvegicus
gcgtggcatcttcttcgcatccggg

SEQ ID NO: 518693 - DNA, 25 bp, Rattus norvegicus
atgaacgcaccctttgacggcctgg

SEQ ID NO: 518694 - DNA, 25 bp, Rattus norvegicus
cctggcgtttatcgggcaaagaagt

SEQ ID NO: 518695 - DNA, 25 bp, Rattus norvegicus
cagcacggaaacgttgttcgtattc

SEQ ID NO: 518696 - DNA, 25 bp, Rattus norvegicus
actgagcgtgcatgtgaaaggtacc

SEQ ID NO: 518697 - DNA, 25 bp, Rattus norvegicus
gcttgcttttcttacacgacaggga

SEQ ID NO: 518698 - DNA, 25 bp, Rattus norvegicus
cccgagttctggtggaaagaggcca

SEQ ID NO: 518699 - DNA, 25 bp, Rattus norvegicus
ccagtcacaacgttcgggatttgca

SEQ ID NO: 518700 - DNA, 25 bp, Rattus norvegicus
tgcaatcgaccaatcaccgcgctga

SEQ ID NO: 518701 - DNA, 25 bp, Rattus norvegicus
tggtcaggacgtcactagtgttttc

SEQ ID NO: 518702 - DNA, 25 bp, Rattus norvegicus
gtcgtcgactgcgtgcgcacaaatg

SEQ ID NO: 518703 - DNA, 25 bp, Rattus norvegicus
ctggggaagcttttgccttagcatt

SEQ ID NO: 518704 - DNA, 25 bp, Rattus norvegicus
gcgctgagccgagtttgcaacctaa

SEQ ID NO: 518705 - DNA, 25 bp, Rattus norvegicus
ggcacccaccgaacaggaaattcca

SEQ ID NO: 518706 - DNA, 25 bp, Rattus norvegicus
ggccaggcacccaccgaacaggaaa

SEQ ID NO: 518707 - DNA, 25 bp, Rattus norvegicus
ggaaattccacctgtgcacccgagc

SEQ ID NO: 518708 - DNA, 25 bp, Rattus norvegicus
tcagggtgtggcctcctggtcgccc

SEQ ID NO: 518709 - DNA, 25 bp, Rattus norvegicus
caggtagtttcagggtgtggcctcc

SEQ ID NO: 518710 - DNA, 25 bp, Rattus norvegicus
ggcggcggaggctcccgatctcatc

SEQ ID NO: 518711 - DNA, 25 bp, Rattus norvegicus
accgactaccatgacccgcggggtg

SEQ ID NO: 518712 - DNA, 25 bp, Rattus norvegicus
cgatcgccggtctcagacgcgtggt

SEQ ID NO: 518713 - DNA, 25 bp, Rattus norvegicus
agtccggcgccgaagtcctgcgagc

SEQ ID NO: 518714 - DNA, 25 bp, Rattus norvegicus
agttgtacttgagtccggcgccgaa

SEQ ID NO: 518715 - DNA, 25 bp, Rattus norvegicus
gatcgggactgtgaacgcccggtcc

SEQ ID NO: 518716 - DNA, 25 bp, Rattus norvegicus
cacccacgggccatagagcggagct

SEQ ID NO: 518717 - DNA, 25 bp, Rattus norvegicus
acgcgtggtctctgccggcaaccga

SEQ ID NO: 518718 - DNA, 25 bp, Rattus norvegicus
acctctagccgggagttgtacttga

SEQ ID NO: 518719 - DNA, 25 bp, Rattus norvegicus
tacacagtgactcgcaatcatctgt

SEQ ID NO: 518720 - DNA, 25 bp, Rattus norvegicus
cacagtgactcgcaatcatctgtaa

SEQ ID NO: 518721 - DNA, 25 bp, Rattus norvegicus
ctacacagtgactcgcaatcatctg

SEQ ID NO: 518722 - DNA, 25 bp, Rattus norvegicus
aactacacagtgactcgcaatcatc

SEQ ID NO: 518723 - DNA, 25 bp, Rattus norvegicus
gcaactacacagtgactcgcaatca

SEQ ID NO: 518724 - DNA, 25 bp, Rattus norvegicus
agcaactacacagtgactcgcaatc

SEQ ID NO: 518725 - DNA, 25 bp, Rattus norvegicus
ccagcaactacacagtgactcgcaa

SEQ ID NO: 518726 - DNA, 25 bp, Rattus norvegicus
ttcccagcaactacacagtgactcg

SEQ ID NO: 518727 - DNA, 25 bp, Rattus norvegicus
tgtgttttagttggggcagagagat

SEQ ID NO: 518728 - DNA, 25 bp, Rattus norvegicus
aaatgtgttttagttggggcagaga

SEQ ID NO: 518729 - DNA, 25 bp, Rattus norvegicus
cataaaatgtgttttagttggggca

SEQ ID NO: 518730 - DNA, 25 bp, Rattus norvegicus
gtatttcttaaacacataaaatgtg

SEQ ID NO: 518731 - DNA, 25 bp, Rattus norvegicus
gagtatttcttaaacacataaaatg

SEQ ID NO: 518732 - DNA, 25 bp, Rattus norvegicus
cagtgactcgcaatcatctgtaatg

SEQ ID NO: 518733 - DNA, 25 bp, Rattus norvegicus
atggctacctcaagtggcgcttcga

SEQ ID NO: 518734 - DNA, 25 bp, Rattus norvegicus
tcgggacccatcctctgccaagtgt

SEQ ID NO: 518735 - DNA, 25 bp, Rattus norvegicus
cggcgcattgcctacaagcgttgtg

SEQ ID NO: 518736 - DNA, 25 bp, Rattus norvegicus
agcgttgtgttacctgtcgcctcaa

SEQ ID NO: 518737 - DNA, 25 bp, Rattus norvegicus
ccacaatggccatgacacggtcagc

SEQ ID NO: 518738 - DNA, 25 bp, Rattus norvegicus
gtcgcctcaacctgtgcaatgactg

SEQ ID NO: 518739 - DNA, 25 bp, Rattus norvegicus
tcatagacgcctgctccgagaggtc

SEQ ID NO: 518740 - DNA, 25 bp, Rattus norvegicus
ctgcaagatcgctttccacaatggc

SEQ ID NO: 518741 - DNA, 25 bp, Rattus norvegicus
gctactctgcgccttctgcaagatc

SEQ ID NO: 518742 - DNA, 25 bp, Rattus norvegicus
gtcgcagcgacaaccagctactctg

SEQ ID NO: 518743 - DNA, 25 bp, Rattus norvegicus
tccagccgcatcaacgagtactgtc

SEQ ID NO: 518744 - DNA, 25 bp, Rattus norvegicus
acaccagcgccgaggatcaggatga

SEQ ID NO: 518745 - DNA, 25 bp, Rattus norvegicus
tgtggccatgcaggatcacgtcttc

SEQ ID NO: 518746 - DNA, 25 bp, Rattus norvegicus
tcaaggccttccactcggatgtggc

SEQ ID NO: 518747 - DNA, 25 bp, Rattus norvegicus
tacccgaattgattgatcgcctcgc

SEQ ID NO: 518748 - DNA, 25 bp, Rattus norvegicus
cacggagacctcagcgagctccttg

SEQ ID NO: 518749 - DNA, 25 bp, Rattus norvegicus
gacctcagcgagctccttgtcggca

SEQ ID NO: 518750 - DNA, 25 bp, Rattus norvegicus
tgtcccacacagctccgtactgggg

SEQ ID NO: 518751 - DNA, 25 bp, Rattus norvegicus
cgccttccgcccttataaagagact

SEQ ID NO: 518752 - DNA, 25 bp, Rattus norvegicus
cgctcaattaagaagcacttgtggc

SEQ ID NO: 518753 - DNA, 25 bp, Rattus norvegicus
gaatttggtggcgttgagctcacaa

SEQ ID NO: 518754 - DNA, 25 bp, Rattus norvegicus
cacttgtggcgctagggatgctaaa

SEQ ID NO: 518755 - DNA, 25 bp, Rattus norvegicus
aggtaagagcccagcgagaacaaga

SEQ ID NO: 518756 - DNA, 25 bp, Rattus norvegicus
agaacaagagctggggccgcgccca

SEQ ID NO: 518757 - DNA, 25 bp, Rattus norvegicus
ctggccgggaaggatcgactctgcc

SEQ ID NO: 518758 - DNA, 25 bp, Rattus norvegicus
atcgactctgcctgctggggataca

SEQ ID NO: 518759 - DNA, 25 bp, Rattus norvegicus
tggggatacaccctccgctcaatta

SEQ ID NO: 518760 - DNA, 25 bp, Rattus norvegicus
agctccgggtgacgccaaggtaaga

SEQ ID NO: 518761 - DNA, 25 bp, Rattus norvegicus
acacaaaggcctcaattccagcgtg

SEQ ID NO: 518762 - DNA, 25 bp, Rattus norvegicus
aggcctcaattccagcgtgactcca

SEQ ID NO: 518763 - DNA, 25 bp, Rattus norvegicus
cgcgtgcgcaggcacgtcacgtgac

SEQ ID NO: 518764 - DNA, 25 bp, Rattus norvegicus
cgggccgaagcgtcacgtgacgtcc

SEQ ID NO: 518765 - DNA, 25 bp, Rattus norvegicus
gaagcgtcacgtgacgtcctccggc

SEQ ID NO: 518766 - DNA, 25 bp, Rattus norvegicus
gccaatggataatcccgacgcagga

SEQ ID NO: 518767 - DNA, 25 bp, Rattus norvegicus
cccgacgcaggatttcgaatgtggc

SEQ ID NO: 518768 - DNA, 25 bp, Rattus norvegicus
gagccggaggctgcatcgacttgta

SEQ ID NO: 518769 - DNA, 25 bp, Rattus norvegicus
gaggctgcatcgacttgtaggactt

SEQ ID NO: 518770 - DNA, 25 bp, Rattus norvegicus
atcgacttgtaggacttgagcggcc

SEQ ID NO: 518771 - DNA, 25 bp, Rattus norvegicus
tatccgacgggaggacgcattcctt

SEQ ID NO: 518772 - DNA, 25 bp, Rattus norvegicus
gaggacgcattcctttcgcgaaagc

SEQ ID NO: 518773 - DNA, 25 bp, Rattus norvegicus
attcctttcgcgaaagcgagcaccc

SEQ ID NO: 518774 - DNA, 25 bp, Rattus norvegicus
tccggccagccaatggataatcccg

SEQ ID NO: 518775 - DNA, 25 bp, Rattus norvegicus
ccagcctgtgcagcctcagcgaaga

SEQ ID NO: 518776 - DNA, 25 bp, Rattus norvegicus
cgcgcacgccttcgaggaagagcgc

SEQ ID NO: 518777 - DNA, 25 bp, Rattus norvegicus
tgatgaccgcgaacgcgctccagtc

SEQ ID NO: 518778 - DNA, 25 bp, Rattus norvegicus
cagctcaggtagctggcgtccgcga

SEQ ID NO: 518779 - DNA, 25 bp, Rattus norvegicus
tagctccagcgtgagcacgtccagc

SEQ ID NO: 518780 - DNA, 25 bp, Rattus norvegicus
gagcagtaagccaccagcaccggcg

SEQ ID NO: 518781 - DNA, 25 bp, Rattus norvegicus
taccgtactggcgtcggtagctgtg

SEQ ID NO: 518782 - DNA, 25 bp, Rattus norvegicus
tcagcgaagagcacctcggcctctt

SEQ ID NO: 518783 - DNA, 25 bp, Rattus norvegicus
cttcccagcgccaggttaggtacca

SEQ ID NO: 518784 - DNA, 25 bp, Rattus norvegicus
tgaccacactgatgaggcccaccgg

SEQ ID NO: 518785 - DNA, 25 bp, Rattus norvegicus
agactaaggcgccaactctcggtga

SEQ ID NO: 518786 - DNA, 25 bp, Rattus norvegicus
tcgcgaaccttctggcgtagactaa

SEQ ID NO: 518787 - DNA, 25 bp, Rattus norvegicus
agaatggccactccgtcgcgaacct

SEQ ID NO: 518788 - DNA, 25 bp, Rattus norvegicus
ctcggcctcttcacgggagcagtaa

SEQ ID NO: 518789 - DNA, 25 bp, Rattus norvegicus
acccccggtgttccgagcggcagtg

SEQ ID NO: 518790 - DNA, 25 bp, Rattus norvegicus
aggccgagctttgctacagcgaaga

SEQ ID NO: 518791 - DNA, 25 bp, Rattus norvegicus
ctacagcgaagacgccgacgtcacg

SEQ ID NO: 518792 - DNA, 25 bp, Rattus norvegicus
ggtcgccttgtagtcgcgcgcgccc

SEQ ID NO: 518793 - DNA, 25 bp, Rattus norvegicus
ccctcttatgtcaccgaatagcaaa

SEQ ID NO: 518794 - DNA, 25 bp, Rattus norvegicus
ccgagctttgctacagcgaagacgc

SEQ ID NO: 518795 - DNA, 25 bp, Rattus norvegicus
tccagaggccgagctttgctacagc

SEQ ID NO: 518796 - DNA, 25 bp, Rattus norvegicus
attccagaggccgagctttgctaca

SEQ ID NO: 518797 - DNA, 25 bp, Rattus norvegicus
tcagaattccagaggccgagctttg

SEQ ID NO: 518798 - DNA, 25 bp, Rattus norvegicus
ttctcagaattccagaggccgagct

SEQ ID NO: 518799 - DNA, 25 bp, Rattus norvegicus
ttagttctcagaattccagaggccg

SEQ ID NO: 518800 - DNA, 25 bp, Rattus norvegicus
accgaatagcaaattagttctcaga

SEQ ID NO: 518801 - DNA, 25 bp, Rattus norvegicus
atgtcaccgaatagcaaattagttc

SEQ ID NO: 518802 - DNA, 25 bp, Rattus norvegicus
ttgctacagcgaagacgccgacgtc

SEQ ID NO: 518803 - DNA, 25 bp, Rattus norvegicus
ctgctgcgctacaggtaaaaacata

SEQ ID NO: 518804 - DNA, 25 bp, Rattus norvegicus
ctagtatggcccaggcagagcctta

SEQ ID NO: 518805 - DNA, 25 bp, Rattus norvegicus
tcctcagcctcgctgggcccgtccc

SEQ ID NO: 518806 - DNA, 25 bp, Rattus norvegicus
tgttccacgagagcccggcagactg

SEQ ID NO: 518807 - DNA, 25 bp, Rattus norvegicus
caggcccggcgtgttccacgagagc

SEQ ID NO: 518808 - DNA, 25 bp, Rattus norvegicus
cattctcttgctggtcgggccaggc

SEQ ID NO: 518809 - DNA, 25 bp, Rattus norvegicus
tcacccgcgggtcacccgccggctc

SEQ ID NO: 518810 - DNA, 25 bp, Rattus norvegicus
cgcacacccgtcgttccctctccgg

SEQ ID NO: 518811 - DNA, 25 bp, Rattus norvegicus
tatggcccaggcagagccttagctc

SEQ ID NO: 518812 - DNA, 25 bp, Rattus norvegicus
tactaacggtgaaaaagcgcctcgc

SEQ ID NO: 518813 - DNA, 25 bp, Rattus norvegicus
gggagccctgctgcgctacaggtaa

SEQ ID NO: 518814 - DNA, 25 bp, Rattus norvegicus
tgcgcactagtatggcccaggcaga

SEQ ID NO: 518815 - DNA, 25 bp, Rattus norvegicus
gcagagccttagctctcgggcgtcc

SEQ ID NO: 518816 - DNA, 25 bp, Rattus norvegicus
cgcatgcgcactagtatggcccagg

SEQ ID NO: 518817 - DNA, 25 bp, Rattus norvegicus
cgaagccacacccaggtcggtgttg

SEQ ID NO: 518818 - DNA, 25 bp, Rattus norvegicus
atgggccacccttggattccggcgc

SEQ ID NO: 518819 - DNA, 25 bp, Rattus norvegicus
gctggcggggatcaataggtcccta

SEQ ID NO: 518820 - DNA, 25 bp, Rattus norvegicus
ataggtccctatcagcagcaagtgg

SEQ ID NO: 518821 - DNA, 25 bp, Rattus norvegicus
tgggaacttgatatcgcagaccgga

SEQ ID NO: 518822 - DNA, 25 bp, Rattus norvegicus
ccggagagaatgtggatcgccagtc

SEQ ID NO: 518823 - DNA, 25 bp, Rattus norvegicus
cgccagtcctgggtcagagagaaag

SEQ ID NO: 518824 - DNA, 25 bp, Rattus norvegicus
tcttctgcacccacagaggtgtttg

SEQ ID NO: 518825 - DNA, 25 bp, Rattus norvegicus
tttgggaacacaagcggaccctgct

SEQ ID NO: 518826 - DNA, 25 bp, Rattus norvegicus
cccgatcgtttggagaccaccgcta

SEQ ID NO: 518827 - DNA, 25 bp, Rattus norvegicus
aggagcgctctgtgaccgcagtcac

SEQ ID NO: 518828 - DNA, 25 bp, Rattus norvegicus
gagaccaccgctattccgaaccgaa

SEQ ID NO: 518829 - DNA, 25 bp, Rattus norvegicus
ccgcatggaccaaggggagtacgac

SEQ ID NO: 518830 - DNA, 25 bp, Rattus norvegicus
ggagtacgaccacaaggaccgagga

SEQ ID NO: 518831 - DNA, 25 bp, Rattus norvegicus
gttcccaggtccttgacgttgtctc

SEQ ID NO: 518832 - DNA, 25 bp, Rattus norvegicus
cagagaagagtcgaagtgcttaagc

SEQ ID NO: 518833 - DNA, 25 bp, Rattus norvegicus
ctttgagtcgatgaagaaacagaga

SEQ ID NO: 518834 - DNA, 25 bp, Rattus norvegicus
agacgcgcgctctttgagtcgatga

SEQ ID NO: 518835 - DNA, 25 bp, Rattus norvegicus
ggtccttgacgttgtctctcttttc

SEQ ID NO: 518836 - DNA, 25 bp, Rattus norvegicus
ttcattgacacttccggttcccagg

SEQ ID NO: 518837 - DNA, 25 bp, Rattus norvegicus
ccagtgtgtcgggtttcttcattga

SEQ ID NO: 518838 - DNA, 25 bp, Rattus norvegicus
ttctaccagtgtgtcgggtttcttc

SEQ ID NO: 518839 - DNA, 25 bp, Rattus norvegicus
catacgcccttagtccagccttttt

SEQ ID NO: 518840 - DNA, 25 bp, Rattus norvegicus
gacgtataagacatacgcccttagt

SEQ ID NO: 518841 - DNA, 25 bp, Rattus norvegicus
ggcgcgcgtctgatgacgtataaga

SEQ ID NO: 518842 - DNA, 25 bp, Rattus norvegicus
gagctccggagccagtcaactcagg

SEQ ID NO: 518843 - DNA, 25 bp, Rattus norvegicus
tgctccacagcgaacgggcttactc

SEQ ID NO: 518844 - DNA, 25 bp, Rattus norvegicus
tttgggcggagtaaaccagacgcgc

SEQ ID NO: 518845 - DNA, 25 bp, Rattus norvegicus
tcacaacagtactaccagcagattc

SEQ ID NO: 518846 - DNA, 25 bp, Rattus norvegicus
cagcagattcaccacggggagccca

SEQ ID NO: 518847 - DNA, 25 bp, Rattus norvegicus
gagcccaccgactttattaacctgc

SEQ ID NO: 518848 - DNA, 25 bp, Rattus norvegicus
tttattaacctgcacaatgcgcggg

SEQ ID NO: 518849 - DNA, 25 bp, Rattus norvegicus
acaatgcgcgggctctcaagtcctc

SEQ ID NO: 518850 - DNA, 25 bp, Rattus norvegicus
tcaagtcctcctgcctggacgagca

SEQ ID NO: 518851 - DNA, 25 bp, Rattus norvegicus
ccctcatgagccatggctctcagta

SEQ ID NO: 518852 - DNA, 25 bp, Rattus norvegicus
atggctctcagtatggaatgcaccc

SEQ ID NO: 518853 - DNA, 25 bp, Rattus norvegicus
tggaatgcacccagatcaaagactc

SEQ ID NO: 518854 - DNA, 25 bp, Rattus norvegicus
acccagatcaaagactcctgccagg

SEQ ID NO: 518855 - DNA, 25 bp, Rattus norvegicus
ggagccgacgacttgcaggtaaata

SEQ ID NO: 518856 - DNA, 25 bp, Rattus norvegicus
cgacttgcaggtaaataagcgtgca

SEQ ID NO: 518857 - DNA, 25 bp, Rattus norvegicus
aataagcgtgcagcggatttgtctg

SEQ ID NO: 518858 - DNA, 25 bp, Rattus norvegicus
acgacctgtccctcatgagccatgg

SEQ ID NO: 518859 - DNA, 25 bp, Rattus norvegicus
cgaagcttcgagaaatcagaggatc

SEQ ID NO: 518860 - DNA, 25 bp, Rattus norvegicus
ccagcgtgtgggcatttttaacgaa

SEQ ID NO: 518861 - DNA, 25 bp, Rattus norvegicus
ttttaacgaagtctgcccgcacgtc

SEQ ID NO: 518862 - DNA, 25 bp, Rattus norvegicus
cggactccacgggtcgcttccggag

SEQ ID NO: 518863 - DNA, 25 bp, Rattus norvegicus
cgcttccggagtccgcgtcgaacga

SEQ ID NO: 518864 - DNA, 25 bp, Rattus norvegicus
agggtgtcccgctgcccttgcagct

SEQ ID NO: 518865 - DNA, 25 bp, Rattus norvegicus
gacagatgcgcgatcccgcgccata

SEQ ID NO: 518866 - DNA, 25 bp, Rattus norvegicus
tcccgcgccatagctcgggagctgg

SEQ ID NO: 518867 - DNA, 25 bp, Rattus norvegicus
aaggcagagatgagacccggacttc

SEQ ID NO: 518868 - DNA, 25 bp, Rattus norvegicus
gctcaagaggaaaggaaagtaagtc

SEQ ID NO: 518869 - DNA, 25 bp, Rattus norvegicus
gagggaagaaagactccgaagcttc

SEQ ID NO: 518870 - DNA, 25 bp, Rattus norvegicus
agtaagtctcaaggggacgtcgaga

SEQ ID NO: 518871 - DNA, 25 bp, Rattus norvegicus
tggagagcccagattccgtaacggg

SEQ ID NO: 518872 - DNA, 25 bp, Rattus norvegicus
ccacccggcagaggtggagagccca

SEQ ID NO: 518873 - DNA, 25 bp, Rattus norvegicus
ccggcatgggcgacagcctctcatt

SEQ ID NO: 518874 - DNA, 25 bp, Rattus norvegicus
caagccatagctcgagactctctca

SEQ ID NO: 518875 - DNA, 25 bp, Rattus norvegicus
tgcattccgcacaccacggcctgga

SEQ ID NO: 518876 - DNA, 25 bp, Rattus norvegicus
aagggactaccactctgtccgccgg

SEQ ID NO: 518877 - DNA, 25 bp, Rattus norvegicus
gtgggttcagaagccggctctctcc

SEQ ID NO: 518878 - DNA, 25 bp, Rattus norvegicus
gatggcgtcccaagccatagctcga

SEQ ID NO: 518879 - DNA, 25 bp, Rattus norvegicus
acgccaagaagtgggttcagaagcc

SEQ ID NO: 518880 - DNA, 25 bp, Rattus norvegicus
cggccttgggcatcccggcatggaa

SEQ ID NO: 518881 - DNA, 25 bp, Rattus norvegicus
ggggcaacgacaacgccaagaagtg

SEQ ID NO: 518882 - DNA, 25 bp, Rattus norvegicus
cgctgtcccacacgccatcatcgga

SEQ ID NO: 518883 - DNA, 25 bp, Rattus norvegicus
gtctcaaggaccttactcgagcgcc

SEQ ID NO: 518884 - DNA, 25 bp, Rattus norvegicus
gagactctctcagctgggctctgtg

SEQ ID NO: 518885 - DNA, 25 bp, Rattus norvegicus
gcctctcattgcacggccttgggca

SEQ ID NO: 518886 - DNA, 25 bp, Rattus norvegicus
tgggctctgtgtctcaaggacctta

SEQ ID NO: 518887 - DNA, 25 bp, Rattus norvegicus
ggaaaccccatcagccgtgtctcat

SEQ ID NO: 518888 - DNA, 25 bp, Rattus norvegicus
tgactcctccctggcgcgaaaactt

SEQ ID NO: 518889 - DNA, 25 bp, Rattus norvegicus
taaaaacgtgtgtgactcctccctg

SEQ ID NO: 518890 - DNA, 25 bp, Rattus norvegicus
tccagcactacggtacccgccatgc

SEQ ID NO: 518891 - DNA, 25 bp, Rattus norvegicus
cgcagctccacgtcgtccagcacta

SEQ ID NO: 518892 - DNA, 25 bp, Rattus norvegicus
aagtagtctctctgcgcttcgcgca

SEQ ID NO: 518893 - DNA, 25 bp, Rattus norvegicus
aggaagtccaagtagtctctctgcg

SEQ ID NO: 518894 - DNA, 25 bp, Rattus norvegicus
tcgtccaggaagtccaagtagtctc

SEQ ID NO: 518895 - DNA, 25 bp, Rattus norvegicus
cctcgtcgtccaggaagtccaagta

SEQ ID NO: 518896 - DNA, 25 bp, Rattus norvegicus
ccgaatttcacctcgtcgtccagga

SEQ ID NO: 518897 - DNA, 25 bp, Rattus norvegicus
tcagccactccgtcacccgcgggaa

SEQ ID NO: 518898 - DNA, 25 bp, Rattus norvegicus
caccgtgcccggtcaccaacagaga

SEQ ID NO: 518899 - DNA, 25 bp, Rattus norvegicus
tttagctgtgctccggcacccgcgg

SEQ ID NO: 518900 - DNA, 25 bp, Rattus norvegicus
gtgtctcatcacccgggccaagtca

SEQ ID NO: 518901 - DNA, 25 bp, Rattus norvegicus
gccgctcctggtattggtaagtccc

SEQ ID NO: 518902 - DNA, 25 bp, Rattus norvegicus
caccgagatgctggggagcctctgc

SEQ ID NO: 518903 - DNA, 25 bp, Rattus norvegicus
tgctctcgggtgcagagccctcggc

SEQ ID NO: 518904 - DNA, 25 bp, Rattus norvegicus
tcggccgctcctggtattggtaagt

SEQ ID NO: 518905 - DNA, 25 bp, Rattus norvegicus
tcccggctgctctcgggtgcagagc

SEQ ID NO: 518906 - DNA, 25 bp, Rattus norvegicus
gctcctggtattggtaagtcccgtc

SEQ ID NO: 518907 - DNA, 25 bp, Rattus norvegicus
tcctggtattggtaagtcccgtctg

SEQ ID NO: 518908 - DNA, 25 bp, Rattus norvegicus
tggtattggtaagtcccgtctgtgg

SEQ ID NO: 518909 - DNA, 25 bp, Rattus norvegicus
accgggcagggtgcagatctccacc

SEQ ID NO: 518910 - DNA, 25 bp, Rattus norvegicus
ggcagggtgcagatctccaccgaga

SEQ ID NO: 518911 - DNA, 25 bp, Rattus norvegicus
agggtgcagatctccaccgagatgc

SEQ ID NO: 518912 - DNA, 25 bp, Rattus norvegicus
tgcagatctccaccgagatgctggg

SEQ ID NO: 518913 - DNA, 25 bp, Rattus norvegicus
ctccaccgagatgctggggagcctc

SEQ ID NO: 518914 - DNA, 25 bp, Rattus norvegicus
gagctcggccgctcctggtattggt

SEQ ID NO: 518915 - DNA, 25 bp, Rattus norvegicus
atgcaccgtcccagaaaccgacgtg

SEQ ID NO: 518916 - DNA, 25 bp, Rattus norvegicus
cgcctgagcaccctgtctgtgagcg

SEQ ID NO: 518917 - DNA, 25 bp, Rattus norvegicus
gcagctgcgtcgtctgcccaagatt

SEQ ID NO: 518918 - DNA, 25 bp, Rattus norvegicus
cccaagattctggaagaagggcttc

SEQ ID NO: 518919 - DNA, 25 bp, Rattus norvegicus
gaagggcttcccaagatgccatgca

SEQ ID NO: 518920 - DNA, 25 bp, Rattus norvegicus
cagctctttcgggagccgtacatcc

SEQ ID NO: 518921 - DNA, 25 bp, Rattus norvegicus
gggagccgtacatccacgcaggcta

SEQ ID NO: 518922 - DNA, 25 bp, Rattus norvegicus
aggctaccgtcccacggggcacgag

SEQ ID NO: 518923 - DNA, 25 bp, Rattus norvegicus
cgagtggcgttactacttcttcagc

SEQ ID NO: 518924 - DNA, 25 bp, Rattus norvegicus
tcagcctctttcagaagcacaacga

SEQ ID NO: 518925 - DNA, 25 bp, Rattus norvegicus
aacgtctggacccacttgctcgcgg

SEQ ID NO: 518926 - DNA, 25 bp, Rattus norvegicus
gggaccaccgctaccatgacgactg

SEQ ID NO: 518927 - DNA, 25 bp, Rattus norvegicus
acaacgaggtggtcaacgtctggac

SEQ ID NO: 518928 - DNA, 25 bp, Rattus norvegicus
atgacgactgccatcctggagcgcc

SEQ ID NO: 518929 - DNA, 25 bp, Rattus norvegicus
tctctgctcgcttgcaaactgcctt

SEQ ID NO: 518930 - DNA, 25 bp, Rattus norvegicus
agggtcttggccagccagcccagag

SEQ ID NO: 518931 - DNA, 25 bp, Rattus norvegicus
cggttttttgcacctgcggcgcttt

SEQ ID NO: 518932 - DNA, 25 bp, Rattus norvegicus
cccagcccgaggaaggaggcttgaa

SEQ ID NO: 518933 - DNA, 25 bp, Rattus norvegicus
attctttcttggttggagtcgaggc

SEQ ID NO: 518934 - DNA, 25 bp, Rattus norvegicus
gatcttcccaaggagagacagtgtt

SEQ ID NO: 518935 - DNA, 25 bp, Rattus norvegicus
ttggcttgctttctctgctcgcttg

SEQ ID NO: 518936 - DNA, 25 bp, Rattus norvegicus
tgccttgcacccgagccgggagtca

SEQ ID NO: 518937 - DNA, 25 bp, Rattus norvegicus
tgcaagccaactcctcggctggttg

SEQ ID NO: 518938 - DNA, 25 bp, Rattus norvegicus
tggtcataaagccagatgaagtatc

SEQ ID NO: 518939 - DNA, 25 bp, Rattus norvegicus
atgaagtatcgtgtctgtagtttcc

SEQ ID NO: 518940 - DNA, 25 bp, Rattus norvegicus
ctgtagtttcctttgagagccgtga

SEQ ID NO: 518941 - DNA, 25 bp, Rattus norvegicus
gagagccgtgatcttcccaaggaga

SEQ ID NO: 518942 - DNA, 25 bp, Rattus norvegicus
tcagttctcccggtgcccgcgttgg

SEQ ID NO: 518943 - DNA, 25 bp, Rattus norvegicus
ttaccttggagtcagcagaggcccg

SEQ ID NO: 518944 - DNA, 25 bp, Rattus norvegicus
ccagcccgaagggttctccgcttgg

SEQ ID NO: 518945 - DNA, 25 bp, Rattus norvegicus
gtttggcgttaccttggagtcagca

SEQ ID NO: 518946 - DNA, 25 bp, Rattus norvegicus
cgtctgttctccttcatcctgcagg

SEQ ID NO: 518947 - DNA, 25 bp, Rattus norvegicus
ccctccactagtgtgtttggcgtta

SEQ ID NO: 518948 - DNA, 25 bp, Rattus norvegicus
aagggttctccgcttggcgcacgtc

SEQ ID NO: 518949 - DNA, 25 bp, Rattus norvegicus
tcgtcctttacggactccacggtga

SEQ ID NO: 518950 - DNA, 25 bp, Rattus norvegicus
cagcgatggtgaccaacccggtgca

SEQ ID NO: 518951 - DNA, 25 bp, Rattus norvegicus
cagaaggcaaccgtggcggcaactg

SEQ ID NO: 518952 - DNA, 25 bp, Rattus norvegicus
aacccgagcggcagaaggcaaccgt

SEQ ID NO: 518953 - DNA, 25 bp, Rattus norvegicus
ttgttgccagggcaacccgagcggc

SEQ ID NO: 518954 - DNA, 25 bp, Rattus norvegicus
cgagtgctgtttgttgccagggcaa

SEQ ID NO: 518955 - DNA, 25 bp, Rattus norvegicus
cagaggcccgcgagtgctgtttgtt

SEQ ID NO: 518956 - DNA, 25 bp, Rattus norvegicus
tggcgcacgtctgttctccttcatc

SEQ ID NO: 518957 - DNA, 25 bp, Rattus norvegicus
gcgttgaggttgtggtcgccactct

SEQ ID NO: 518958 - DNA, 25 bp, Rattus norvegicus
cctacggcacggaggacgtcgtgca

SEQ ID NO: 518959 - DNA, 25 bp, Rattus norvegicus
cgtgaggcgagctcgcctacggcac

SEQ ID NO: 518960 - DNA, 25 bp, Rattus norvegicus
tttttgatcgggatgtggcgcgtga

SEQ ID NO: 518961 - DNA, 25 bp, Rattus norvegicus
gccaaaaataacgcgcgcgcgccgg

SEQ ID NO: 518962 - DNA, 25 bp, Rattus norvegicus
ggcgctcaccgacgagcgccgcgtc

SEQ ID NO: 518963 - DNA, 25 bp, Rattus norvegicus
caggcggagtcacctctgggtgcct

SEQ ID NO: 518964 - DNA, 25 bp, Rattus norvegicus
agctcccgcgcggtctagcggcggg

SEQ ID NO: 518965 - DNA, 25 bp, Rattus norvegicus
cggcggaggcccaaggcggcttctg

SEQ ID NO: 518966 - DNA, 25 bp, Rattus norvegicus
cccaggcccactgcgacctacccgc

SEQ ID NO: 518967 - DNA, 25 bp, Rattus norvegicus
cggagtcacctctgggtgcctgccg

SEQ ID NO: 518968 - DNA, 25 bp, Rattus norvegicus
ggagacccgtccaggctcggggcgc

SEQ ID NO: 518969 - DNA, 25 bp, Rattus norvegicus
ttgaggttgtggtcgccactctcct

SEQ ID NO: 518970 - DNA, 25 bp, Rattus norvegicus
cactgcgacctacccgcggccatcg

SEQ ID NO: 518971 - DNA, 25 bp, Rattus norvegicus
aaagccatggcagcgggcgtgcacc

SEQ ID NO: 518972 - DNA, 25 bp, Rattus norvegicus
gggcccgaaccctcgctcagcagct

SEQ ID NO: 518973 - DNA, 25 bp, Rattus norvegicus
gctcagcagctgcagcgaaaacttc

SEQ ID NO: 518974 - DNA, 25 bp, Rattus norvegicus
tgcagcgaaaacttctctggcccgg

SEQ ID NO: 518975 - DNA, 25 bp, Rattus norvegicus
tcctcctacggaaagccatggcagc

SEQ ID NO: 518976 - DNA, 25 bp, Rattus norvegicus
cataagcccgatgaggacacagagc

SEQ ID NO: 518977 - DNA, 25 bp, Rattus norvegicus
gacacagagcaccaagaagaagacg

SEQ ID NO: 518978 - DNA, 25 bp, Rattus norvegicus
gcaccaagaagaagacgatgtctgc

SEQ ID NO: 518979 - DNA, 25 bp, Rattus norvegicus
acgatgtctgcatggttgtggatga

SEQ ID NO: 518980 - DNA, 25 bp, Rattus norvegicus
ctgcatggttgtggatgacgaactc

SEQ ID NO: 518981 - DNA, 25 bp, Rattus norvegicus
tggatgacgaactcctggctgaaga

SEQ ID NO: 518982 - DNA, 25 bp, Rattus norvegicus
ctcctggctgaagagcgggtaactt

SEQ ID NO: 518983 - DNA, 25 bp, Rattus norvegicus
gctgaagagcgggtaacttttcgtc

SEQ ID NO: 518984 - DNA, 25 bp, Rattus norvegicus
ttcgtcctcctacggaaagccatgg

SEQ ID NO: 518985 - DNA, 25 bp, Rattus norvegicus
cttcctccgcaggaagggcccaggg

SEQ ID NO: 518986 - DNA, 25 bp, Rattus norvegicus
tcccactcctaacacccagcttctt

SEQ ID NO: 518987 - DNA, 25 bp, Rattus norvegicus
aggaagtgggccaggatcccactcc

SEQ ID NO: 518988 - DNA, 25 bp, Rattus norvegicus
tcccaagctgctggacaggaagtgg

SEQ ID NO: 518989 - DNA, 25 bp, Rattus norvegicus
cggctcccaagctgctggacaggaa

SEQ ID NO: 518990 - DNA, 25 bp, Rattus norvegicus
gcaatggaagccctgtcctccggct

SEQ ID NO: 518991 - DNA, 25 bp, Rattus norvegicus
gaccggcaatggaagccctgtcctc

SEQ ID NO: 518992 - DNA, 25 bp, Rattus norvegicus
caagaccggcaatggaagccctgtc

SEQ ID NO: 518993 - DNA, 25 bp, Rattus norvegicus
acctcgccaagaccggcaatggaag

SEQ ID NO: 518994 - DNA, 25 bp, Rattus norvegicus
gtaaacctcgccaagaccggcaatg

SEQ ID NO: 518995 - DNA, 25 bp, Rattus norvegicus
tcatctgtaaacctcgccaagaccg

SEQ ID NO: 518996 - DNA, 25 bp, Rattus norvegicus
tcagccggggtacattcatctgtaa

SEQ ID NO: 518997 - DNA, 25 bp, Rattus norvegicus
ggttcagccggggtacattcatctg

SEQ ID NO: 518998 - DNA, 25 bp, Rattus norvegicus
gagccgggtgcgcttaaccctcgcg

SEQ ID NO: 518999 - DNA, 25 bp, Rattus norvegicus
ctttcctttagtccggtggctgcca

SEQ ID NO: 519000 - DNA, 25 bp, Rattus norvegicus
catgccgctgcccagagtgaggaaa

SEQ ID NO: 519001 - DNA, 25 bp, Rattus norvegicus
gttgatttctcaaccacatctgtta

SEQ ID NO: 519002 - DNA, 25 bp, Rattus norvegicus
atggcatcaccacgggcaccgcgag

SEQ ID NO: 519003 - DNA, 25 bp, Rattus norvegicus
gtccggatttctgccgcttccaatt

SEQ ID NO: 519004 - DNA, 25 bp, Rattus norvegicus
tccaattccaaatccggacctgttg

SEQ ID NO: 519005 - DNA, 25 bp, Rattus norvegicus
gtgaggtgtccctcgctttccttta

SEQ ID NO: 519006 - DNA, 25 bp, Rattus norvegicus
acccagctggcttcgagtctgtctg

SEQ ID NO: 519007 - DNA, 25 bp, Rattus norvegicus
atcccaagtcggtctcccaggctga

SEQ ID NO: 519008 - DNA, 25 bp, Rattus norvegicus
ggctgagtttggctcggttcttcct

SEQ ID NO: 519009 - DNA, 25 bp, Rattus norvegicus
agggttaagtcctcctggtgcctcg

SEQ ID NO: 519010 - DNA, 25 bp, Rattus norvegicus
ctggtgcctcgagaacaaactggac

SEQ ID NO: 519011 - DNA, 25 bp, Rattus norvegicus
acgagtgggtctctgggcttctcac

SEQ ID NO: 519012 - DNA, 25 bp, Rattus norvegicus
ggcgtcactttgtgaggtgtccctc

SEQ ID NO: 519013 - DNA, 25 bp, Rattus norvegicus
caccacagacttggggacacgtttg

SEQ ID NO: 519014 - DNA, 25 bp, Rattus norvegicus
agtagtcctgggagcgccctttctc

SEQ ID NO: 519015 - DNA, 25 bp, Rattus norvegicus
accctgccattgtcgcgtttctcag

SEQ ID NO: 519016 - DNA, 25 bp, Rattus norvegicus
cgctgcggtacctagtctggtactc

SEQ ID NO: 519017 - DNA, 25 bp, Rattus norvegicus
cttcaccgggtagcgagccaggtta

SEQ ID NO: 519018 - DNA, 25 bp, Rattus norvegicus
tgcatgcgcatctgctgctcctctg

SEQ ID NO: 519019 - DNA, 25 bp, Rattus norvegicus
ctcagcgagtcgttccgcagcatgc

SEQ ID NO: 519020 - DNA, 25 bp, Rattus norvegicus
acggactcggactgatcggagctca

SEQ ID NO: 519021 - DNA, 25 bp, Rattus norvegicus
gctcaccgacatctgacgtctcttg

SEQ ID NO: 519022 - DNA, 25 bp, Rattus norvegicus
agctcgtgtactccggtgtggacac

SEQ ID NO: 519023 - DNA, 25 bp, Rattus norvegicus
tccggcgcatctctcaggcgcaggt

SEQ ID NO: 519024 - DNA, 25 bp, Rattus norvegicus
tgtgcgtctggtacgcagggacatc

SEQ ID NO: 519025 - DNA, 25 bp, Rattus norvegicus
ctctaagtgcggctcacaggcatgc

SEQ ID NO: 519026 - DNA, 25 bp, Rattus norvegicus
tcacaggcatgcctgcaggggaatg

SEQ ID NO: 519027 - DNA, 25 bp, Rattus norvegicus
gctcgccgacgtgcatacttcaccg

SEQ ID NO: 519028 - DNA, 25 bp, Rattus norvegicus
tggctctcacctttcggattcacgc

SEQ ID NO: 519029 - DNA, 25 bp, Rattus norvegicus
aggacatttttcgtggcctgcccgc

SEQ ID NO: 519030 - DNA, 25 bp, Rattus norvegicus
ggctctggctctcacctttcggatt

SEQ ID NO: 519031 - DNA, 25 bp, Rattus norvegicus
tgctttccaacgctcacagcgaagc

SEQ ID NO: 519032 - DNA, 25 bp, Rattus norvegicus
cccacggccgaggacatttttcgtg

SEQ ID NO: 519033 - DNA, 25 bp, Rattus norvegicus
ccgagcccggatgctgcctttgttt

SEQ ID NO: 519034 - DNA, 25 bp, Rattus norvegicus
atgctgcctttgtttgggtcgccct

SEQ ID NO: 519035 - DNA, 25 bp, Rattus norvegicus
gcggagtctcggagcttcgctcccg

SEQ ID NO: 519036 - DNA, 25 bp, Rattus norvegicus
cggagcttcgctcccgggtgatgct

SEQ ID NO: 519037 - DNA, 25 bp, Rattus norvegicus
ggtgatgctgctgctctcgcagaca

SEQ ID NO: 519038 - DNA, 25 bp, Rattus norvegicus
tgctgctctcgcagacataagctgc

SEQ ID NO: 519039 - DNA, 25 bp, Rattus norvegicus
tcgcagacataagctgccagccact

SEQ ID NO: 519040 - DNA, 25 bp, Rattus norvegicus
cggggacagcgaggacccagtctct

SEQ ID NO: 519041 - DNA, 25 bp, Rattus norvegicus
tgaacggttcgctcctcgaggatca

SEQ ID NO: 519042 - DNA, 25 bp, Rattus norvegicus
ttcccccgggttcttgagcgagcgc

SEQ ID NO: 519043 - DNA, 25 bp, Rattus norvegicus
gtgtgtagccggagtcgcttcctat

SEQ ID NO: 519044 - DNA, 25 bp, Rattus norvegicus
ctccccacgggctgagctcattgga

SEQ ID NO: 519045 - DNA, 25 bp, Rattus norvegicus
gtcccgacgtctgattgggctgccc

SEQ ID NO: 519046 - DNA, 25 bp, Rattus norvegicus
cctattggcctccttgccgggcgtc

SEQ ID NO: 519047 - DNA, 25 bp, Rattus norvegicus
cggttcgctcctcgaggatcagggc

SEQ ID NO: 519048 - DNA, 25 bp, Rattus norvegicus
ctatgaacggttcgctcctcgagga

SEQ ID NO: 519049 - DNA, 25 bp, Rattus norvegicus
cccacctctgggctatgaacggttc

SEQ ID NO: 519050 - DNA, 25 bp, Rattus norvegicus
aggtcccacctctgggctatgaacg

SEQ ID NO: 519051 - DNA, 25 bp, Rattus norvegicus
aggatcaggtcccacctctgggcta

SEQ ID NO: 519052 - DNA, 25 bp, Rattus norvegicus
ctgggcggcaggatcaggtcccacc

SEQ ID NO: 519053 - DNA, 25 bp, Rattus norvegicus
cccggccggactggacttgctctgg

SEQ ID NO: 519054 - DNA, 25 bp, Rattus norvegicus
ctctgggctatgaacggttcgctcc

SEQ ID NO: 519055 - DNA, 25 bp, Rattus norvegicus
gcgctgcttgaccttggaccaatga

SEQ ID NO: 519056 - DNA, 25 bp, Rattus norvegicus
tttaaccgcttagatcacctcgtcg

SEQ ID NO: 519057 - DNA, 25 bp, Rattus norvegicus
tggaccaatgatttaaccgcttaga

SEQ ID NO: 519058 - DNA, 25 bp, Rattus norvegicus
gaccttggaccaatgatttaaccgc

SEQ ID NO: 519059 - DNA, 25 bp, Rattus norvegicus
tgcttgaccttggaccaatgattta

SEQ ID NO: 519060 - DNA, 25 bp, Rattus norvegicus
agatcacctcgtcggggatctggga

SEQ ID NO: 519061 - DNA, 25 bp, Rattus norvegicus
ctggcgctgcttgaccttggaccaa

SEQ ID NO: 519062 - DNA, 25 bp, Rattus norvegicus
ctgcttgcgactggcgctgcttgac

SEQ ID NO: 519063 - DNA, 25 bp, Rattus norvegicus
cgcagagctgcgctgcttgcgactg

SEQ ID NO: 519064 - DNA, 25 bp, Rattus norvegicus
ttagaaggtcgcagagctgcgctgc

SEQ ID NO: 519065 - DNA, 25 bp, Rattus norvegicus
agaacaaatacaagtgcggtcgggc

SEQ ID NO: 519066 - DNA, 25 bp, Rattus norvegicus
cgcttagatcacctcgtcggggatc

SEQ ID NO: 519067 - DNA, 25 bp, Rattus norvegicus
acaaatacaagtgcggtcgggcgag

SEQ ID NO: 519068 - DNA, 25 bp, Rattus norvegicus
gatctgggaggcgagagctgctccg

SEQ ID NO: 519069 - DNA, 25 bp, Rattus norvegicus
acgaacgccgagcatcccgccctgc

SEQ ID NO: 519070 - DNA, 25 bp, Rattus norvegicus
ggccagcagcgaaccaccgggcgat

SEQ ID NO: 519071 - DNA, 25 bp, Rattus norvegicus
agcagcgaaccaccgggcgatcctg

SEQ ID NO: 519072 - DNA, 25 bp, Rattus norvegicus
tctgccaagtggaagcccaatcctc

SEQ ID NO: 519073 - DNA, 25 bp, Rattus norvegicus
aggtaccggcgccacgaacgccgag

SEQ ID NO: 519074 - DNA, 25 bp, Rattus norvegicus
gggcgatcctgaacaccgcaggctc

SEQ ID NO: 519075 - DNA, 25 bp, Rattus norvegicus
ccctccctcgtactgggcgaactgc

SEQ ID NO: 519076 - DNA, 25 bp, Rattus norvegicus
gggcctccaagtcggtctgccaagt

SEQ ID NO: 519077 - DNA, 25 bp, Rattus norvegicus
ccaagtcggtctgccaagtggaagc

SEQ ID NO: 519078 - DNA, 25 bp, Rattus norvegicus
cgcgctccgctcgtttcgggtgcag

SEQ ID NO: 519079 - DNA, 25 bp, Rattus norvegicus
ttgcccattgaagaaggcggcgccg

SEQ ID NO: 519080 - DNA, 25 bp, Rattus norvegicus
cccgccgagcaggttgcccattgaa

SEQ ID NO: 519081 - DNA, 25 bp, Rattus norvegicus
ctcccaggtggtgggctccgcgaaa

SEQ ID NO: 519082 - DNA, 25 bp, Rattus norvegicus
tggaagcccaatcctcccaggtggt

SEQ ID NO: 519083 - DNA, 25 bp, Rattus norvegicus
cgagcagtgctacgacgaggatggg

SEQ ID NO: 519084 - DNA, 25 bp, Rattus norvegicus
gcagcgagttctgcgaggcttgcca

SEQ ID NO: 519085 - DNA, 25 bp, Rattus norvegicus
caccgcagcgagttctgcgaggctt

SEQ ID NO: 519086 - DNA, 25 bp, Rattus norvegicus
cggattgcaccgcagcgagttctgc

SEQ ID NO: 519087 - DNA, 25 bp, Rattus norvegicus
cgacaccggattgcaccgcagcgag

SEQ ID NO: 519088 - DNA, 25 bp, Rattus norvegicus
gggccagtatcgcatccacgtggcc

SEQ ID NO: 519089 - DNA, 25 bp, Rattus norvegicus
agggcctggtggacaacctcatcac

SEQ ID NO: 519090 - DNA, 25 bp, Rattus norvegicus
aacatcgagggcctggtggacaacc

SEQ ID NO: 519091 - DNA, 25 bp, Rattus norvegicus
tgcggcacctcacggctggacgagt

SEQ ID NO: 519092 - DNA, 25 bp, Rattus norvegicus
taccagtgcggcacctcacggctgg

SEQ ID NO: 519093 - DNA, 25 bp, Rattus norvegicus
tgtgctaccagtgcggcacctcacg

SEQ ID NO: 519094 - DNA, 25 bp, Rattus norvegicus
gcagctgtgctaccagtgcggcacc

SEQ ID NO: 519095 - DNA, 25 bp, Rattus norvegicus
cagcgtgttggctcagtgcgcatgc

SEQ ID NO: 519096 - DNA, 25 bp, Rattus norvegicus
gtatcgcatccacgtggccagccgg

SEQ ID NO: 519097 - DNA, 25 bp, Rattus norvegicus
cgcatttcggaactcggcttcctca

SEQ ID NO: 519098 - DNA, 25 bp, Rattus norvegicus
agagccgggcgcttctcgaaaacca

SEQ ID NO: 519099 - DNA, 25 bp, Rattus norvegicus
ttgtagccgcacctaagagccgggc

SEQ ID NO: 519100 - DNA, 25 bp, Rattus norvegicus
gccaatcttttgtagccgcacctaa

SEQ ID NO: 519101 - DNA, 25 bp, Rattus norvegicus
agcaccgcgaatgcttctgcagcca

SEQ ID NO: 519102 - DNA, 25 bp, Rattus norvegicus
tccgtgacacggaaagaatggtgga

SEQ ID NO: 519103 - DNA, 25 bp, Rattus norvegicus
gggaactcgcgccttctgcgcaggc

SEQ ID NO: 519104 - DNA, 25 bp, Rattus norvegicus
gctagcaccgttcggcaccgggaac

SEQ ID NO: 519105 - DNA, 25 bp, Rattus norvegicus
atggtggagaccataccgccggctc

SEQ ID NO: 519106 - DNA, 25 bp, Rattus norvegicus
gcggactgccttacttgttgctctc

SEQ ID NO: 519107 - DNA, 25 bp, Rattus norvegicus
aactctccggatcccgggcggactg

SEQ ID NO: 519108 - DNA, 25 bp, Rattus norvegicus
agcgtcagcgcacgcgcatccaggt

SEQ ID NO: 519109 - DNA, 25 bp, Rattus norvegicus
gagcctgcgccctcgcatttcggaa

SEQ ID NO: 519110 - DNA, 25 bp, Rattus norvegicus
gctctccagacgaaagccatccgtg

SEQ ID NO: 519111 - DNA, 25 bp, Rattus norvegicus
agcaaactggtcagcgacggccaag

SEQ ID NO: 519112 - DNA, 25 bp, Rattus norvegicus
gttcccgcgagaacgagaggcttgc

SEQ ID NO: 519113 - DNA, 25 bp, Rattus norvegicus
tcaagatttgttctcctttcccggc

SEQ ID NO: 519114 - DNA, 25 bp, Rattus norvegicus
cgccggcgccaactgagatttcaag

SEQ ID NO: 519115 - DNA, 25 bp, Rattus norvegicus
ggagcgctacctgcgttcaacaggt

SEQ ID NO: 519116 - DNA, 25 bp, Rattus norvegicus
gcaaagccaggagccggttcgtcac

SEQ ID NO: 519117 - DNA, 25 bp, Rattus norvegicus
gaaggcgtccttacccaggtccgca

SEQ ID NO: 519118 - DNA, 25 bp, Rattus norvegicus
cgggcaacgaggagctcacctctca

SEQ ID NO: 519119 - DNA, 25 bp, Rattus norvegicus
ggctccgactgaggccagagcgcca

SEQ ID NO: 519120 - DNA, 25 bp, Rattus norvegicus
atgcacagtcgagggaagcaacctt

SEQ ID NO: 519121 - DNA, 25 bp, Rattus norvegicus
cgagaggcttgcgtcaataaaatgc

SEQ ID NO: 519122 - DNA, 25 bp, Rattus norvegicus
aagcaaccttcgcagagctgggccg

SEQ ID NO: 519123 - DNA, 25 bp, Rattus norvegicus
gaccaccgaggccaaagggcacacg

SEQ ID NO: 519124 - DNA, 25 bp, Rattus norvegicus
agcgacggccaaggggttatcgact

SEQ ID NO: 519125 - DNA, 25 bp, Rattus norvegicus
ccatcagcaggtgccggcaaccggg

SEQ ID NO: 519126 - DNA, 25 bp, Rattus norvegicus
ggggacctcaaggctgacatgtaaa

SEQ ID NO: 519127 - DNA, 25 bp, Rattus norvegicus
gggacctcaaggctgacatgtaaat

SEQ ID NO: 519128 - DNA, 25 bp, Rattus norvegicus
aggggacctcaaggctgacatgtaa

SEQ ID NO: 519129 - DNA, 25 bp, Rattus norvegicus
atgatagtggccgggtttccaacca

SEQ ID NO: 519130 - DNA, 25 bp, Rattus norvegicus
tatgatagtggccgggtttccaacc

SEQ ID NO: 519131 - DNA, 25 bp, Rattus norvegicus
cttagcggcactaagggagggcgcg

SEQ ID NO: 519132 - DNA, 25 bp, Rattus norvegicus
ccttagcggcactaagggagggcgc

SEQ ID NO: 519133 - DNA, 25 bp, Rattus norvegicus
gccttagcggcactaagggagggcg

SEQ ID NO: 519134 - DNA, 25 bp, Rattus norvegicus
ggccttagcggcactaagggagggc

SEQ ID NO: 519135 - DNA, 25 bp, Rattus norvegicus
atcagcaggtgccggcaaccggggc

SEQ ID NO: 519136 - DNA, 25 bp, Rattus norvegicus
catcagcaggtgccggcaaccgggg

SEQ ID NO: 519137 - DNA, 25 bp, Rattus norvegicus
ctccgcgtgggaatgcgtaactgca

SEQ ID NO: 519138 - DNA, 25 bp, Rattus norvegicus
cccgcgtgacctggacgtacaaaca

SEQ ID NO: 519139 - DNA, 25 bp, Rattus norvegicus
tgcagcaccgttttgacattttctt

SEQ ID NO: 519140 - DNA, 25 bp, Rattus norvegicus
cagcatatgacagagaccgggcttg

SEQ ID NO: 519141 - DNA, 25 bp, Rattus norvegicus
cgacatcaagcccaaacagccggtg

SEQ ID NO: 519142 - DNA, 25 bp, Rattus norvegicus
cgcagcttaccttgggttggtgtca

SEQ ID NO: 519143 - DNA, 25 bp, Rattus norvegicus
gcgggacgcatctctgcccttattc

SEQ ID NO: 519144 - DNA, 25 bp, Rattus norvegicus
gcacaggtcgaagagggtaactcca

SEQ ID NO: 519145 - DNA, 25 bp, Rattus norvegicus
cgagccacattataggaagcgtatc

SEQ ID NO: 519146 - DNA, 25 bp, Rattus norvegicus
ccagcttgtgcgtcctggctttctc

SEQ ID NO: 519147 - DNA, 25 bp, Rattus norvegicus
ccgcatcagcatcgcatacagttct

SEQ ID NO: 519148 - DNA, 25 bp, Rattus norvegicus
ctcagccaactcgtgcccaggtttt

SEQ ID NO: 519149 - DNA, 25 bp, Rattus norvegicus
ctgatctggccaaatgcaccgggtc

SEQ ID NO: 519150 - DNA, 25 bp, Rattus norvegicus
ccggcagaattcgtagcttgctcta

SEQ ID NO: 519151 - DNA, 25 bp, Rattus norvegicus
cagttcccaccgctgaggctggtgg

SEQ ID NO: 519152 - DNA, 25 bp, Rattus norvegicus
cgagggcgcgagatagtaaagctgt

SEQ ID NO: 519153 - DNA, 25 bp, Rattus norvegicus
gcacgtctggccaagagatcttttc

SEQ ID NO: 519154 - DNA, 25 bp, Rattus norvegicus
caagagatcttttctgcgcctggga

SEQ ID NO: 519155 - DNA, 25 bp, Rattus norvegicus
cgcctgggaggttttcgcttcctca

SEQ ID NO: 519156 - DNA, 25 bp, Rattus norvegicus
gaggttttcgcttcctcagttccca

SEQ ID NO: 519157 - DNA, 25 bp, Rattus norvegicus
aagctgtttgaatgccgggcgagga

SEQ ID NO: 519158 - DNA, 25 bp, Rattus norvegicus
agccgtttgcttggtgcgccctcct

SEQ ID NO: 519159 - DNA, 25 bp, Rattus norvegicus
ggccaagaagccaagaaagcgctga

SEQ ID NO: 519160 - DNA, 25 bp, Rattus norvegicus
caccgctgaggctggtggctaccaa

SEQ ID NO: 519161 - DNA, 25 bp, Rattus norvegicus
gctaccaagtgtaggagaaagtccc

SEQ ID NO: 519162 - DNA, 25 bp, Rattus norvegicus
ccaagaaagcgctgagaagtggccg

SEQ ID NO: 519163 - DNA, 25 bp, Rattus norvegicus
ctgccaggtactgatggacggagcg

SEQ ID NO: 519164 - DNA, 25 bp, Rattus norvegicus
caacaaacggattggccaagaagcc

SEQ ID NO: 519165 - DNA, 25 bp, Rattus norvegicus
gtgacgacactacggcctgcctgcg

SEQ ID NO: 519166 - DNA, 25 bp, Rattus norvegicus
aagggaggccaccaagtgcccgtcg

SEQ ID NO: 519167 - DNA, 25 bp, Rattus norvegicus
gccactcacccgctccgcagacgag

SEQ ID NO: 519168 - DNA, 25 bp, Rattus norvegicus
acgagcgctgccaccggcagctaga

SEQ ID NO: 519169 - DNA, 25 bp, Rattus norvegicus
ccaccggcagctagaggaagatgga

SEQ ID NO: 519170 - DNA, 25 bp, Rattus norvegicus
cgccgccgtggtgacgacactacgg

SEQ ID NO: 519171 - DNA, 25 bp, Rattus norvegicus
cccgtccgagctgcagtcgctgctt

SEQ ID NO: 519172 - DNA, 25 bp, Rattus norvegicus
gtcgctcgcctcgtggagcttgtgc

SEQ ID NO: 519173 - DNA, 25 bp, Rattus norvegicus
agagcccgcagccatcggcgtgcga

SEQ ID NO: 519174 - DNA, 25 bp, Rattus norvegicus
gcgtcacgtgacaccactgtttacc

SEQ ID NO: 519175 - DNA, 25 bp, Rattus norvegicus
cacgtgacaccactgtttaccgttc

SEQ ID NO: 519176 - DNA, 25 bp, Rattus norvegicus
ggagcctctgccaggcctctgccgc

SEQ ID NO: 519177 - DNA, 25 bp, Rattus norvegicus
gccgctccgggctcgcggtccaaac

SEQ ID NO: 519178 - DNA, 25 bp, Rattus norvegicus
cagtcgctgcttccctgagcccggg

SEQ ID NO: 519179 - DNA, 25 bp, Rattus norvegicus
catagccgcgaggtccgcaatcacg

SEQ ID NO: 519180 - DNA, 25 bp, Rattus norvegicus
tagagccgcgagttcgtctccactt

SEQ ID NO: 519181 - DNA, 25 bp, Rattus norvegicus
cgtctccacttggaacgccgcttag

SEQ ID NO: 519182 - DNA, 25 bp, Rattus norvegicus
ttaggcgagaggaaccctgtagccc

SEQ ID NO: 519183 - DNA, 25 bp, Rattus norvegicus
tagcccgaggctatagctctgtcgc

SEQ ID NO: 519184 - DNA, 25 bp, Rattus norvegicus
ccatgcagtgagctgcccgaggagc

SEQ ID NO: 519185 - DNA, 25 bp, Rattus norvegicus
tcgctcaacaggagtcgcgcagttg

SEQ ID NO: 519186 - DNA, 25 bp, Rattus norvegicus
ggggcaccagacgaccatgcagtga

SEQ ID NO: 519187 - DNA, 25 bp, Rattus norvegicus
ggcctaatcatacagccgatcccga

SEQ ID NO: 519188 - DNA, 25 bp, Rattus norvegicus
ctactcattgaagattgtggcctaa

SEQ ID NO: 519189 - DNA, 25 bp, Rattus norvegicus
cgcggtactcacaggaatatgtcta

SEQ ID NO: 519190 - DNA, 25 bp, Rattus norvegicus
tttagccgcccgctgtaacaaaggc

SEQ ID NO: 519191 - DNA, 25 bp, Rattus norvegicus
tgccaccggtgcgaaccggttgatg

SEQ ID NO: 519192 - DNA, 25 bp, Rattus norvegicus
ccgtgcggcttctcggaacaaaggc

SEQ ID NO: 519193 - DNA, 25 bp, Rattus norvegicus
gcgagcgctccgctgggtagaaact

SEQ ID NO: 519194 - DNA, 25 bp, Rattus norvegicus
tgcttccgaatgctggagcgcagcg

SEQ ID NO: 519195 - DNA, 25 bp, Rattus norvegicus
tgtctctgagagctgcttccgaatg

SEQ ID NO: 519196 - DNA, 25 bp, Rattus norvegicus
tccgctgggtagaaactgtctctga

SEQ ID NO: 519197 - DNA, 25 bp, Rattus norvegicus
aggcgctagagctgcgctcaccgca

SEQ ID NO: 519198 - DNA, 25 bp, Rattus norvegicus
cgctcaccgcaggaaggacggttcc

SEQ ID NO: 519199 - DNA, 25 bp, Rattus norvegicus
cacgcgtcgcgccttctggcggaag

SEQ ID NO: 519200 - DNA, 25 bp, Rattus norvegicus
ggatagccttgatccatcttttgtg

SEQ ID NO: 519201 - DNA, 25 bp, Rattus norvegicus
aatacttgcctgagctgatggcaga

SEQ ID NO: 519202 - DNA, 25 bp, Rattus norvegicus
tgggagaagagaaatacttgcctga

SEQ ID NO: 519203 - DNA, 25 bp, Rattus norvegicus
ggccacggtccgaagtccgcgctat

SEQ ID NO: 519204 - DNA, 25 bp, Rattus norvegicus
ctgatggcagagaaggatagccttg

SEQ ID NO: 519205 - DNA, 25 bp, Rattus norvegicus
ccgaagtccgcgctatgggagaaga

SEQ ID NO: 519206 - DNA, 25 bp, Rattus norvegicus
gatccatcttttgtgcacgcgtcgc

SEQ ID NO: 519207 - DNA, 25 bp, Rattus norvegicus
tagtgagcccgctgcatctccgcat

SEQ ID NO: 519208 - DNA, 25 bp, Rattus norvegicus
ccagtcggtcttgtagtgagcccgc

SEQ ID NO: 519209 - DNA, 25 bp, Rattus norvegicus
aacgccacccggcaggtgatgcagg

SEQ ID NO: 519210 - DNA, 25 bp, Rattus norvegicus
tgatgcaggtgtacgtcgccattgt

SEQ ID NO: 519211 - DNA, 25 bp, Rattus norvegicus
gccggaaggaagagacgacctagcc

SEQ ID NO: 519212 - DNA, 25 bp, Rattus norvegicus
ggtcaccggggccatattagccacc

SEQ ID NO: 519213 - DNA, 25 bp, Rattus norvegicus
gctcctggaagccttcggcggtcac

SEQ ID NO: 519214 - DNA, 25 bp, Rattus norvegicus
ggcgaacttcttgctgcacacggtg

SEQ ID NO: 519215 - DNA, 25 bp, Rattus norvegicus
taggcgttgaacgtggcgaacttct

SEQ ID NO: 519216 - DNA, 25 bp, Rattus norvegicus
atcatctccacttggcggctcacgg

SEQ ID NO: 519217 - DNA, 25 bp, Rattus norvegicus
ctccaagttcttctcgttcatcatc

SEQ ID NO: 519218 - DNA, 25 bp, Rattus norvegicus
ggcgttcatggcatccttgttcaca

SEQ ID NO: 519219 - DNA, 25 bp, Rattus norvegicus
catgaagggcgctttcttgggagac

SEQ ID NO: 519220 - DNA, 25 bp, Rattus norvegicus
tcctggattcgtccgtgggcatgaa

SEQ ID NO: 519221 - DNA, 25 bp, Rattus norvegicus
cacccacccgacaccacctgccact

SEQ ID NO: 519222 - DNA, 25 bp, Rattus norvegicus
gccactcggtcccaccaagtcaact

SEQ ID NO: 519223 - DNA, 25 bp, Rattus norvegicus
ctgccactcggtcccaccaagtcaa

SEQ ID NO: 519224 - DNA, 25 bp, Rattus norvegicus
cctgccactcggtcccaccaagtca

SEQ ID NO: 519225 - DNA, 25 bp, Rattus norvegicus
acctgccactcggtcccaccaagtc

SEQ ID NO: 519226 - DNA, 25 bp, Rattus norvegicus
ccacctgccactcggtcccaccaag

SEQ ID NO: 519227 - DNA, 25 bp, Rattus norvegicus
accacctgccactcggtcccaccaa

SEQ ID NO: 519228 - DNA, 25 bp, Rattus norvegicus
acaccacctgccactcggtcccacc

SEQ ID NO: 519229 - DNA, 25 bp, Rattus norvegicus
gacaccacctgccactcggtcccac

SEQ ID NO: 519230 - DNA, 25 bp, Rattus norvegicus
cccgacaccacctgccactcggtcc

SEQ ID NO: 519231 - DNA, 25 bp, Rattus norvegicus
acccgacaccacctgccactcggtc

SEQ ID NO: 519232 - DNA, 25 bp, Rattus norvegicus
cacccgacaccacctgccactcggt

SEQ ID NO: 519233 - DNA, 25 bp, Rattus norvegicus
ccacccacccgacaccacctgccac

SEQ ID NO: 519234 - DNA, 25 bp, Rattus norvegicus
acccacccgacaccacctgccactc

SEQ ID NO: 519235 - DNA, 25 bp, Rattus norvegicus
actggacgaaacacccgcgctgaca

SEQ ID NO: 519236 - DNA, 25 bp, Rattus norvegicus
ccacagtttctctccgctccaaaca

SEQ ID NO: 519237 - DNA, 25 bp, Rattus norvegicus
gctccaaacaaacccgcaggatatt

SEQ ID NO: 519238 - DNA, 25 bp, Rattus norvegicus
aacccgcaggatattctttaaccag

SEQ ID NO: 519239 - DNA, 25 bp, Rattus norvegicus
ccgcaggatattctttaaccagcca

SEQ ID NO: 519240 - DNA, 25 bp, Rattus norvegicus
cagcaaccaaactggacgaaacacc

SEQ ID NO: 519241 - DNA, 25 bp, Rattus norvegicus
aaactggacgaaacacccgcgctga

SEQ ID NO: 519242 - DNA, 25 bp, Rattus norvegicus
ctggacgaaacacccgcgctgacag

SEQ ID NO: 519243 - DNA, 25 bp, Rattus norvegicus
tccctgtggcgggagagttcatttg

SEQ ID NO: 519244 - DNA, 25 bp, Rattus norvegicus
gagagttcatttggggccggaagcg

SEQ ID NO: 519245 - DNA, 25 bp, Rattus norvegicus
gaagtgaggcgctaaggtcccaccc

SEQ ID NO: 519246 - DNA, 25 bp, Rattus norvegicus
cccgggcatccagcccaccgcggtg

SEQ ID NO: 519247 - DNA, 25 bp, Rattus norvegicus
accaagtcaactcgcaagcttccaa

SEQ ID NO: 519248 - DNA, 25 bp, Rattus norvegicus
gctgacagccgctctttccctgtgg

SEQ ID NO: 519249 - DNA, 25 bp, Rattus norvegicus
cagaagtctctggcggctgccaccg

SEQ ID NO: 519250 - DNA, 25 bp, Rattus norvegicus
ccgtcagtttctgcagaagtctctg

SEQ ID NO: 519251 - DNA, 25 bp, Rattus norvegicus
gcggacctgcgtctagactgaccca

SEQ ID NO: 519252 - DNA, 25 bp, Rattus norvegicus
ctcgatagcggctgaaggagacgct

SEQ ID NO: 519253 - DNA, 25 bp, Rattus norvegicus
tgaaggagacgctactggagtcgtc

SEQ ID NO: 519254 - DNA, 25 bp, Rattus norvegicus
ctactggagtcgtctctgctgcctg

SEQ ID NO: 519255 - DNA, 25 bp, Rattus norvegicus
ctgctgcctgcggacctgcgtctag

SEQ ID NO: 519256 - DNA, 25 bp, Rattus norvegicus
tctagactgacccaccgcgctcaag

SEQ ID NO: 519257 - DNA, 25 bp, Rattus norvegicus
ctcaagctcggctgtctgaggcagg

SEQ ID NO: 519258 - DNA, 25 bp, Rattus norvegicus
caggggagatgctgtcctgccgtct

SEQ ID NO: 519259 - DNA, 25 bp, Rattus norvegicus
agatgctgtcctgccgtctccagtg

SEQ ID NO: 519260 - DNA, 25 bp, Rattus norvegicus
cgcgctctgcatcgtcctggctttg

SEQ ID NO: 519261 - DNA, 25 bp, Rattus norvegicus
cccagactccgtcagtttctgcaga

SEQ ID NO: 519262 - DNA, 25 bp, Rattus norvegicus
atcgtcctggctttgggcggtgtca

SEQ ID NO: 519263 - DNA, 25 bp, Rattus norvegicus
tttgcgcatccacgcgagatgctcg

SEQ ID NO: 519264 - DNA, 25 bp, Rattus norvegicus
gtttgcgcatccacgcgagatgctc

SEQ ID NO: 519265 - DNA, 25 bp, Rattus norvegicus
tcagtttgcgcatccacgcgagatg

SEQ ID NO: 519266 - DNA, 25 bp, Rattus norvegicus
cttcagtttgcgcatccacgcgaga

SEQ ID NO: 519267 - DNA, 25 bp, Rattus norvegicus
tgacttcagtttgcgcatccacgcg

SEQ ID NO: 519268 - DNA, 25 bp, Rattus norvegicus
aatgacttcagtttgcgcatccacg

SEQ ID NO: 519269 - DNA, 25 bp, Rattus norvegicus
ggaatgacttcagtttgcgcatcca

SEQ ID NO: 519270 - DNA, 25 bp, Rattus norvegicus
ctgcaggaatgacttcagtttgcgc

SEQ ID NO: 519271 - DNA, 25 bp, Rattus norvegicus
acgaaaaaggagctgcaggaatgac

SEQ ID NO: 519272 - DNA, 25 bp, Rattus norvegicus
tgacgaaaaaggagctgcaggaatg

SEQ ID NO: 519273 - DNA, 25 bp, Rattus norvegicus
caggaatgacttcagtttgcgcatc

SEQ ID NO: 519274 - DNA, 25 bp, Rattus norvegicus
ttcctgacgaaaaaggagctgcagg

SEQ ID NO: 519275 - DNA, 25 bp, Rattus norvegicus
tcttcctgacgaaaaaggagctgca

SEQ ID NO: 519276 - DNA, 25 bp, Rattus norvegicus
atcttcctgacgaaaaaggagctgc

SEQ ID NO: 519277 - DNA, 25 bp, Rattus norvegicus
aggagctggccgtgtccgctttgcc

SEQ ID NO: 519278 - DNA, 25 bp, Rattus norvegicus
gctttattggcctcgccgctctggt

SEQ ID NO: 519279 - DNA, 25 bp, Rattus norvegicus
tataggggctcgctttattggcctc

SEQ ID NO: 519280 - DNA, 25 bp, Rattus norvegicus
tggcctcgccgctctggttccaggt

SEQ ID NO: 519281 - DNA, 25 bp, Rattus norvegicus
cgcagctttcatcttcctgacgaaa

SEQ ID NO: 519282 - DNA, 25 bp, Rattus norvegicus
tcgttctattagcatcgcagctttc

SEQ ID NO: 519283 - DNA, 25 bp, Rattus norvegicus
tgtccgctttgcctctgacacaatg

SEQ ID NO: 519284 - DNA, 25 bp, Rattus norvegicus
gggcgctttataggggctcgcttta

SEQ ID NO: 519285 - DNA, 25 bp, Rattus norvegicus
atcagggtaacaggctccggaggtt

SEQ ID NO: 519286 - DNA, 25 bp, Rattus norvegicus
cgctgcagcaagaatcagggtaaca

SEQ ID NO: 519287 - DNA, 25 bp, Rattus norvegicus
ttcccacgctgcagcaagaatcagg

SEQ ID NO: 519288 - DNA, 25 bp, Rattus norvegicus
gcaaacggcaaacattcccacgctg

SEQ ID NO: 519289 - DNA, 25 bp, Rattus norvegicus
ggctgccgtgcaaacggcaaacatt

SEQ ID NO: 519290 - DNA, 25 bp, Rattus norvegicus
tttgcctctgacacaatgactgccc

SEQ ID NO: 519291 - DNA, 25 bp, Rattus norvegicus
acgagtggctccgtgaacccggata

SEQ ID NO: 519292 - DNA, 25 bp, Rattus norvegicus
gtggctccgtgaacccggatactaa

SEQ ID NO: 519293 - DNA, 25 bp, Rattus norvegicus
cgctagagactcttaatcgttctga

SEQ ID NO: 519294 - DNA, 25 bp, Rattus norvegicus
atccctaccggcgtcggcgacgagt

SEQ ID NO: 519295 - DNA, 25 bp, Rattus norvegicus
cgaggtggcgcatgctcctcagcgc

SEQ ID NO: 519296 - DNA, 25 bp, Rattus norvegicus
cgcagacgaggtggcgcatgctcct

SEQ ID NO: 519297 - DNA, 25 bp, Rattus norvegicus
cccggatactaataaagttcgctag

SEQ ID NO: 519298 - DNA, 25 bp, Rattus norvegicus
tactaataaagttcgctagagactc

SEQ ID NO: 519299 - DNA, 25 bp, Rattus norvegicus
cttaatcgttctgaaagagcggagc

SEQ ID NO: 519300 - DNA, 25 bp, Rattus norvegicus
ctctgctcccgcgtcctcgtgggga

SEQ ID NO: 519301 - DNA, 25 bp, Rattus norvegicus
ctcgtggggaccgttccgcgctgac

SEQ ID NO: 519302 - DNA, 25 bp, Rattus norvegicus
ctccggctgggacgatcctgtgcct

SEQ ID NO: 519303 - DNA, 25 bp, Rattus norvegicus
gggacgatcctgtgccttctgtaac

SEQ ID NO: 519304 - DNA, 25 bp, Rattus norvegicus
atcctgtgccttctgtaacgggccg

SEQ ID NO: 519305 - DNA, 25 bp, Rattus norvegicus
tctcgaggtagttctgagtccacgc

SEQ ID NO: 519306 - DNA, 25 bp, Rattus norvegicus
tgttgagggctacacacagacgtgc

SEQ ID NO: 519307 - DNA, 25 bp, Rattus norvegicus
cgctagcttccagcgccgctttgta

SEQ ID NO: 519308 - DNA, 25 bp, Rattus norvegicus
acttggagctcagcgctaacctgcg

SEQ ID NO: 519309 - DNA, 25 bp, Rattus norvegicus
cggaccgccattgttgagggctaca

SEQ ID NO: 519310 - DNA, 25 bp, Rattus norvegicus
ctaacctgcgtctccggaagatggc

SEQ ID NO: 519311 - DNA, 25 bp, Rattus norvegicus
tgagtccacgcgaaatctcgttctg

SEQ ID NO: 519312 - DNA, 25 bp, Rattus norvegicus
cacgcgaaatctcgttctgctgccg

SEQ ID NO: 519313 - DNA, 25 bp, Rattus norvegicus
ggctacacacagacgtgcaccaggc

SEQ ID NO: 519314 - DNA, 25 bp, Rattus norvegicus
cggctgaggcccaaagctgagaata

SEQ ID NO: 519315 - DNA, 25 bp, Rattus norvegicus
gagttgtagtttccaccggcctgga

SEQ ID NO: 519316 - DNA, 25 bp, Rattus norvegicus
gctgagaatacaaaccaaacccttc

SEQ ID NO: 519317 - DNA, 25 bp, Rattus norvegicus
gcgaggacttggagctcagcgctaa

SEQ ID NO: 519318 - DNA, 25 bp, Rattus norvegicus
tgcgtgagcgcccacgcagctgacg

SEQ ID NO: 519319 - DNA, 25 bp, Rattus norvegicus
cctcagcgagtgatgctcgttttgc

SEQ ID NO: 519320 - DNA, 25 bp, Rattus norvegicus
taccgctgttctatgtcctcctctg

SEQ ID NO: 519321 - DNA, 25 bp, Rattus norvegicus
tcagagctccgggaacgcgtcctac

SEQ ID NO: 519322 - DNA, 25 bp, Rattus norvegicus
tcccgtgtcatcctcctcagagctc

SEQ ID NO: 519323 - DNA, 25 bp, Rattus norvegicus
gctaatgcttctcccgtgtcatcct

SEQ ID NO: 519324 - DNA, 25 bp, Rattus norvegicus
ggtcgctaatgcttctcccgtgtca

SEQ ID NO: 519325 - DNA, 25 bp, Rattus norvegicus
agcgagcggtcgctaatgcttctcc

SEQ ID NO: 519326 - DNA, 25 bp, Rattus norvegicus
cgagtgatgctcgttttgcgagcga

SEQ ID NO: 519327 - DNA, 25 bp, Rattus norvegicus
cgtaatcgatgatcctcagcgagtg

SEQ ID NO: 519328 - DNA, 25 bp, Rattus norvegicus
tcctcctctgcggatttttctgacg

SEQ ID NO: 519329 - DNA, 25 bp, Rattus norvegicus
gctgttctatgtcctcctctgcgga

SEQ ID NO: 519330 - DNA, 25 bp, Rattus norvegicus
ggcagagtgatcgtaatcgatgatc

SEQ ID NO: 519331 - DNA, 25 bp, Rattus norvegicus
cgttttgcgagcgagcggtcgctaa

SEQ ID NO: 519332 - DNA, 25 bp, Rattus norvegicus
gggaacgcgtcctaccgctgttcta

SEQ ID NO: 519333 - DNA, 25 bp, Rattus norvegicus
cccaaatagaaaccgcgctgagacc

SEQ ID NO: 519334 - DNA, 25 bp, Rattus norvegicus
ttcagcccggggttgctgacgcctc

SEQ ID NO: 519335 - DNA, 25 bp, Rattus norvegicus
gccgatccttcagcccggggttgct

SEQ ID NO: 519336 - DNA, 25 bp, Rattus norvegicus
tagaaaccgcgctgagacccgcggc

SEQ ID NO: 519337 - DNA, 25 bp, Rattus norvegicus
cggggttgctgacgcctccacccgg

SEQ ID NO: 519338 - DNA, 25 bp, Rattus norvegicus
gtcccaaatagaaaccgcgctgaga

SEQ ID NO: 519339 - DNA, 25 bp, Rattus norvegicus
cggcacctgttgtgggtcccaaata

SEQ ID NO: 519340 - DNA, 25 bp, Rattus norvegicus
tgtgggtcccaaatagaaaccgcgc

SEQ ID NO: 519341 - DNA, 25 bp, Rattus norvegicus
ccgaggctttgttttccggcacctg

SEQ ID NO: 519342 - DNA, 25 bp, Rattus norvegicus
aggctttgttttccggcacctgttg

SEQ ID NO: 519343 - DNA, 25 bp, Rattus norvegicus
tgttttccggcacctgttgtgggtc

SEQ ID NO: 519344 - DNA, 25 bp, Rattus norvegicus
ccggcacctgttgtgggtcccaaat

SEQ ID NO: 519345 - DNA, 25 bp, Rattus norvegicus
tgggtcccaaatagaaaccgcgctg

SEQ ID NO: 519346 - DNA, 25 bp, Rattus norvegicus
gcgccgatccttcagcccggggttg

SEQ ID NO: 519347 - DNA, 25 bp, Rattus norvegicus
ggccgagaggaacatccagcattta

SEQ ID NO: 519348 - DNA, 25 bp, Rattus norvegicus
ctcgcccaaagccaaaacctggtga

SEQ ID NO: 519349 - DNA, 25 bp, Rattus norvegicus
tttccaccggaagatcaagagcctg

SEQ ID NO: 519350 - DNA, 25 bp, Rattus norvegicus
gacggttttaaggaccagctccgca

SEQ ID NO: 519351 - DNA, 25 bp, Rattus norvegicus
tagtccgagagaagcaggccatcca

SEQ ID NO: 519352 - DNA, 25 bp, Rattus norvegicus
cacgcccagttgcttcagaatatta

SEQ ID NO: 519353 - DNA, 25 bp, Rattus norvegicus
gcaggcagctcaaccagacgacgga

SEQ ID NO: 519354 - DNA, 25 bp, Rattus norvegicus
aggatcaggcccaggaacgctactc

SEQ ID NO: 519355 - DNA, 25 bp, Rattus norvegicus
ggctcggttgctgaaagacaaactg

SEQ ID NO: 519356 - DNA, 25 bp, Rattus norvegicus
cgtcgtcagaggaaaaggctcggtt

SEQ ID NO: 519357 - DNA, 25 bp, Rattus norvegicus
cggtccagctcgaaaaggcgtcgtc

SEQ ID NO: 519358 - DNA, 25 bp, Rattus norvegicus
gttttcgtgtagagagagcgctgca

SEQ ID NO: 519359 - DNA, 25 bp, Rattus norvegicus
gtcaggcaggaagcaaacgatctca

SEQ ID NO: 519360 - DNA, 25 bp, Rattus norvegicus
ctcacgcggcagaatcaggaaacca

SEQ ID NO: 519361 - DNA, 25 bp, Rattus norvegicus
gatccctccgggatatctgaacccg

SEQ ID NO: 519362 - DNA, 25 bp, Rattus norvegicus
gctgatgtcaccaagctgttgcatt

SEQ ID NO: 519363 - DNA, 25 bp, Rattus norvegicus
gatgtcaccaagctgttgcattaca

SEQ ID NO: 519364 - DNA, 25 bp, Rattus norvegicus
gtcaccaagctgttgcattacaacc

SEQ ID NO: 519365 - DNA, 25 bp, Rattus norvegicus
aagctgttgcattacaacctcgagg

SEQ ID NO: 519366 - DNA, 25 bp, Rattus norvegicus
ctgttgcattacaacctcgaggttc

SEQ ID NO: 519367 - DNA, 25 bp, Rattus norvegicus
tgcattacaacctcgaggttcctcc

SEQ ID NO: 519368 - DNA, 25 bp, Rattus norvegicus
ctgagttgggcaggatgattgcaaa

SEQ ID NO: 519369 - DNA, 25 bp, Rattus norvegicus
ggcaggatgattgcaaagttaagtc

SEQ ID NO: 519370 - DNA, 25 bp, Rattus norvegicus
ttgcaaagttaagtcacgggagggc

SEQ ID NO: 519371 - DNA, 25 bp, Rattus norvegicus
gggatatctgaacccggctgccctc

SEQ ID NO: 519372 - DNA, 25 bp, Rattus norvegicus
cgcctgtgtcaggttgccgcctctg

SEQ ID NO: 519373 - DNA, 25 bp, Rattus norvegicus
ccgcgctgatgtcaccaagctgttg

SEQ ID NO: 519374 - DNA, 25 bp, Rattus norvegicus
cggctgccctctcccagctgcagac

SEQ ID NO: 519375 - DNA, 25 bp, Rattus norvegicus
tgcacatttacggtttcccttacca

SEQ ID NO: 519376 - DNA, 25 bp, Rattus norvegicus
ggccagatcccttggcggtgcgatc

SEQ ID NO: 519377 - DNA, 25 bp, Rattus norvegicus
ggtttagccgttcctgccggccaga

SEQ ID NO: 519378 - DNA, 25 bp, Rattus norvegicus
agacctggatccatgcctggaggtg

SEQ ID NO: 519379 - DNA, 25 bp, Rattus norvegicus
gcagagacctggatccatgcctgga

SEQ ID NO: 519380 - DNA, 25 bp, Rattus norvegicus
ttggtgttcctcctggcagagacct

SEQ ID NO: 519381 - DNA, 25 bp, Rattus norvegicus
caccgtctggtctcgggttggtgtt

SEQ ID NO: 519382 - DNA, 25 bp, Rattus norvegicus
cacgggacgggacaccgtctggtct

SEQ ID NO: 519383 - DNA, 25 bp, Rattus norvegicus
gctcttgctgtgaaatgcacattta

SEQ ID NO: 519384 - DNA, 25 bp, Rattus norvegicus
cattaccatgtatccctcgaaaggc

SEQ ID NO: 519385 - DNA, 25 bp, Rattus norvegicus
cgcgaaaacgggcagctcttgctgt

SEQ ID NO: 519386 - DNA, 25 bp, Rattus norvegicus
atgtggcgctctcgcgaaaacgggc

SEQ ID NO: 519387 - DNA, 25 bp, Rattus norvegicus
tatccctcgaaaggcacacgggacg

SEQ ID NO: 519388 - DNA, 25 bp, Rattus norvegicus
gtttcccttaccattaccatgtatc

SEQ ID NO: 519389 - DNA, 25 bp, Rattus norvegicus
cccgcaccacgaagtatcaaggtta

SEQ ID NO: 519390 - DNA, 25 bp, Rattus norvegicus
gagtttcctaccagtcgtctggaga

SEQ ID NO: 519391 - DNA, 25 bp, Rattus norvegicus
caaatacagggtaagcgtctcaggc

SEQ ID NO: 519392 - DNA, 25 bp, Rattus norvegicus
caagcggttccaagttgagcagatc

SEQ ID NO: 519393 - DNA, 25 bp, Rattus norvegicus
ataccgcacctttgtctttgacagg

SEQ ID NO: 519394 - DNA, 25 bp, Rattus norvegicus
gaggctcatataaccggctcccagg

SEQ ID NO: 519395 - DNA, 25 bp, Rattus norvegicus
ccgcagggcatctgcgaggctcata

SEQ ID NO: 519396 - DNA, 25 bp, Rattus norvegicus
tctgctgcagcaggggcatccctgt

SEQ ID NO: 519397 - DNA, 25 bp, Rattus norvegicus
ggtactcatcgacgtccctctgctg

SEQ ID NO: 519398 - DNA, 25 bp, Rattus norvegicus
cggacgctgacaaaatcgaagatga

SEQ ID NO: 519399 - DNA, 25 bp, Rattus norvegicus
ctactatgaattcgtggccgctcta

SEQ ID NO: 519400 - DNA, 25 bp, Rattus norvegicus
tgacagagacggagatgggtacatc

SEQ ID NO: 519401 - DNA, 25 bp, Rattus norvegicus
agcgccgtggcagacatctttgaca

SEQ ID NO: 519402 - DNA, 25 bp, Rattus norvegicus
ccaagtgtaagtgcgccaagcggtt

SEQ ID NO: 519403 - DNA, 25 bp, Rattus norvegicus
tgtgccacactcgtagcacagctgc

SEQ ID NO: 519404 - DNA, 25 bp, Rattus norvegicus
gaactctccgcggtgtcgccggttg

SEQ ID NO: 519405 - DNA, 25 bp, Rattus norvegicus
gttgtcctgcctgctggccacatgg

SEQ ID NO: 519406 - DNA, 25 bp, Rattus norvegicus
tgtcctgcctgctggccacatggat

SEQ ID NO: 519407 - DNA, 25 bp, Rattus norvegicus
gtcctgcctgctggccacatggatg

SEQ ID NO: 519408 - DNA, 25 bp, Rattus norvegicus
ctgcctgctggccacatggatgcgg

SEQ ID NO: 519409 - DNA, 25 bp, Rattus norvegicus
ctgctggccacatggatgcggtagt

SEQ ID NO: 519410 - DNA, 25 bp, Rattus norvegicus
acatggatgcggtagtggccaccac

SEQ ID NO: 519411 - DNA, 25 bp, Rattus norvegicus
ggatgcggtagtggccaccacgctc

SEQ ID NO: 519412 - DNA, 25 bp, Rattus norvegicus
accacgctcgccgtagcactgctcg

SEQ ID NO: 519413 - DNA, 25 bp, Rattus norvegicus
gtgatgaggttatccaccaggcttt

SEQ ID NO: 519414 - DNA, 25 bp, Rattus norvegicus
cagccgtgctgtgccacactcgtag

SEQ ID NO: 519415 - DNA, 25 bp, Rattus norvegicus
cgtgctgtgccacactcgtagcaca

SEQ ID NO: 519416 - DNA, 25 bp, Rattus norvegicus
gccgtgctgtgccacactcgtagca

SEQ ID NO: 519417 - DNA, 25 bp, Rattus norvegicus
tagcttctggaacggaacatttctc

SEQ ID NO: 519418 - DNA, 25 bp, Rattus norvegicus
gtccaggaagccatccacgcagttg

SEQ ID NO: 519419 - DNA, 25 bp, Rattus norvegicus
gcgcagcgatccgttcaggagaaga

SEQ ID NO: 519420 - DNA, 25 bp, Rattus norvegicus
ggatggtgaccctatgtattctcta

SEQ ID NO: 519421 - DNA, 25 bp, Rattus norvegicus
gttccgtcagcgaccgaatagtccg

SEQ ID NO: 519422 - DNA, 25 bp, Rattus norvegicus
tgcgacgccattcgccattttaaga

SEQ ID NO: 519423 - DNA, 25 bp, Rattus norvegicus
gtcggtctgaccaatcaccttgcga

SEQ ID NO: 519424 - DNA, 25 bp, Rattus norvegicus
ggacttatttatcagggcggcctta

SEQ ID NO: 519425 - DNA, 25 bp, Rattus norvegicus
gtgaagccacggacggacttattta

SEQ ID NO: 519426 - DNA, 25 bp, Rattus norvegicus
gcctacgccgcgagtacttgtaccg

SEQ ID NO: 519427 - DNA, 25 bp, Rattus norvegicus
cctgactggctcaagcgttggtgaa

SEQ ID NO: 519428 - DNA, 25 bp, Rattus norvegicus
aacggcctgcatgagggttagcttc

SEQ ID NO: 519429 - DNA, 25 bp, Rattus norvegicus
gttcctaatcgtggcccggaagtca

SEQ ID NO: 519430 - DNA, 25 bp, Rattus norvegicus
gatccgcccttaggaggcgttccta

SEQ ID NO: 519431 - DNA, 25 bp, Rattus norvegicus
ccgcagccacaggaacggacagatc

SEQ ID NO: 519432 - DNA, 25 bp, Rattus norvegicus
tgcacagcagccgaagtactcgagg

SEQ ID NO: 519433 - DNA, 25 bp, Rattus norvegicus
tgaggacttcactagttgcacagca

SEQ ID NO: 519434 - DNA, 25 bp, Rattus norvegicus
catattccgctgtcgcggggctgta

SEQ ID NO: 519435 - DNA, 25 bp, Rattus norvegicus
ccggccttcattggctgctaggata

SEQ ID NO: 519436 - DNA, 25 bp, Rattus norvegicus
ctataggtgtcgttgtcgagctccc

SEQ ID NO: 519437 - DNA, 25 bp, Rattus norvegicus
cgggttgcagtatgagtcgccaatc

SEQ ID NO: 519438 - DNA, 25 bp, Rattus norvegicus
aatcctcgcccgtgagttcagcgtg

SEQ ID NO: 519439 - DNA, 25 bp, Rattus norvegicus
gtgagtgacactccagccatcaagc

SEQ ID NO: 519440 - DNA, 25 bp, Rattus norvegicus
cccacggctgtccaactgtgcaatg

SEQ ID NO: 519441 - DNA, 25 bp, Rattus norvegicus
cccgcaggtgtccaaagggtgaagt

SEQ ID NO: 519442 - DNA, 25 bp, Rattus norvegicus
gagcaaaccttatcccaagcggggc

SEQ ID NO: 519443 - DNA, 25 bp, Rattus norvegicus
tctaaactctctgggtcggagcgct

SEQ ID NO: 519444 - DNA, 25 bp, Rattus norvegicus
ctgtgcaatgtgaaagccctgcctt

SEQ ID NO: 519445 - DNA, 25 bp, Rattus norvegicus
cgggaacgtctaagcgccacgcgga

SEQ ID NO: 519446 - DNA, 25 bp, Rattus norvegicus
aggtggctccacgtatccagcggcc

SEQ ID NO: 519447 - DNA, 25 bp, Rattus norvegicus
gtgctcagcgctttcacttcctctg

SEQ ID NO: 519448 - DNA, 25 bp, Rattus norvegicus
cgctctcataaggttcgggaacgtc

SEQ ID NO: 519449 - DNA, 25 bp, Rattus norvegicus
agggcgagcacctgttcgtccgttc

SEQ ID NO: 519450 - DNA, 25 bp, Rattus norvegicus
gtgtcacacaccgaaaacgcgcagg

SEQ ID NO: 519451 - DNA, 25 bp, Rattus norvegicus
atctacagccaggtggctccacgta

SEQ ID NO: 519452 - DNA, 25 bp, Rattus norvegicus
gacacttacgctgtggtgcagaagc

SEQ ID NO: 519453 - DNA, 25 bp, Rattus norvegicus
cttcccatggctgacacttacgctg

SEQ ID NO: 519454 - DNA, 25 bp, Rattus norvegicus
ggagcatctcggtgcctgggccacc

SEQ ID NO: 519455 - DNA, 25 bp, Rattus norvegicus
tccgctacaggagcatctcggtgcc

SEQ ID NO: 519456 - DNA, 25 bp, Rattus norvegicus
gcttacggtccgctacaggagcatc

SEQ ID NO: 519457 - DNA, 25 bp, Rattus norvegicus
gctttcacttcctctgcttacggtc

SEQ ID NO: 519458 - DNA, 25 bp, Rattus norvegicus
aaacgcgcaggggacaacggcactg

SEQ ID NO: 519459 - DNA, 25 bp, Rattus norvegicus
gctccacacaaagcgcttccccgtg

SEQ ID NO: 519460 - DNA, 25 bp, Rattus norvegicus
ccgggagctccacacaaagcgcttc

SEQ ID NO: 519461 - DNA, 25 bp, Rattus norvegicus
gggagctccacacaaagcgcttccc

SEQ ID NO: 519462 - DNA, 25 bp, Rattus norvegicus
gccgggagctccacacaaagcgctt

SEQ ID NO: 519463 - DNA, 25 bp, Rattus norvegicus
cacaaagcgcttccccgtgtcgcgg

SEQ ID NO: 519464 - DNA, 25 bp, Rattus norvegicus
cgggagctccacacaaagcgcttcc

SEQ ID NO: 519465 - DNA, 25 bp, Rattus norvegicus
tcagtacccgcctctgttccaggag

SEQ ID NO: 519466 - DNA, 25 bp, Rattus norvegicus
tgaagcgagttcgtagtgtggattc

SEQ ID NO: 519467 - DNA, 25 bp, Rattus norvegicus
gctgttttcatctccgcaaaacgcg

SEQ ID NO: 519468 - DNA, 25 bp, Rattus norvegicus
gcaaaacgcgtgctcccttgactta

SEQ ID NO: 519469 - DNA, 25 bp, Rattus norvegicus
gcgtgctcccttgacttaccgtttg

SEQ ID NO: 519470 - DNA, 25 bp, Rattus norvegicus
tgacttaccgtttgggggcagcact

SEQ ID NO: 519471 - DNA, 25 bp, Rattus norvegicus
ggcagcactgagttgtcctgctcta

SEQ ID NO: 519472 - DNA, 25 bp, Rattus norvegicus
agttgtcctgctctagctcagtgca

SEQ ID NO: 519473 - DNA, 25 bp, Rattus norvegicus
tgctctagctcagtgcaggtggcgc

SEQ ID NO: 519474 - DNA, 25 bp, Rattus norvegicus
ggcagccggccaagttcagtacccg

SEQ ID NO: 519475 - DNA, 25 bp, Rattus norvegicus
gagccttccacggtgatagctgtga

SEQ ID NO: 519476 - DNA, 25 bp, Rattus norvegicus
agctgtgaacacgaatgattcttga

SEQ ID NO: 519477 - DNA, 25 bp, Rattus norvegicus
ccacggtgatagctgtgaacacgaa

SEQ ID NO: 519478 - DNA, 25 bp, Rattus norvegicus
cacgaatgattcttgaagcgagttc

SEQ ID NO: 519479 - DNA, 25 bp, Rattus norvegicus
cgctgctcgccagcgtcctccggtc

SEQ ID NO: 519480 - DNA, 25 bp, Rattus norvegicus
ggggaattattgagtgcgctttctg

SEQ ID NO: 519481 - DNA, 25 bp, Rattus norvegicus
ccggggaattattgagtgcgctttc

SEQ ID NO: 519482 - DNA, 25 bp, Rattus norvegicus
accggggaattattgagtgcgcttt

SEQ ID NO: 519483 - DNA, 25 bp, Rattus norvegicus
tcgctagtcctcgtcgggagctagg

SEQ ID NO: 519484 - DNA, 25 bp, Rattus norvegicus
cctcgctagtcctcgtcgggagcta

SEQ ID NO: 519485 - DNA, 25 bp, Rattus norvegicus
ctgcctcgctagtcctcgtcgggag

SEQ ID NO: 519486 - DNA, 25 bp, Rattus norvegicus
tgcgttggtccctgcctcgctagtc

SEQ ID NO: 519487 - DNA, 25 bp, Rattus norvegicus
gagaggctgcgttggtccctgcctc

SEQ ID NO: 519488 - DNA, 25 bp, Rattus norvegicus
cactcgctgcctggctcgggcaggg

SEQ ID NO: 519489 - DNA, 25 bp, Rattus norvegicus
tggccgtggtgctgacgcgaggctc

SEQ ID NO: 519490 - DNA, 25 bp, Rattus norvegicus
cgcggaacctggagctggccgtggt

SEQ ID NO: 519491 - DNA, 25 bp, Rattus norvegicus
ggaattattgagtgcgctttctgcg

SEQ ID NO: 519492 - DNA, 25 bp, Rattus norvegicus
cccgccctcccaagcgcggcggagc

SEQ ID NO: 519493 - DNA, 25 bp, Rattus norvegicus
tgtttggacaagtccctgcggactc

SEQ ID NO: 519494 - DNA, 25 bp, Rattus norvegicus
tccttggcggtccagggcagaccat

SEQ ID NO: 519495 - DNA, 25 bp, Rattus norvegicus
tagtgcccgggtggcaccatgctca

SEQ ID NO: 519496 - DNA, 25 bp, Rattus norvegicus
accatgctcagtgtggtgcacttcc

SEQ ID NO: 519497 - DNA, 25 bp, Rattus norvegicus
tgtggtgcacttccttcgaagcttc

SEQ ID NO: 519498 - DNA, 25 bp, Rattus norvegicus
gcacttccttcgaagcttctttaag

SEQ ID NO: 519499 - DNA, 25 bp, Rattus norvegicus
tcgaagcttctttaaggtgagagac

SEQ ID NO: 519500 - DNA, 25 bp, Rattus norvegicus
ctttaaggtgagagacgacctcccg

SEQ ID NO: 519501 - DNA, 25 bp, Rattus norvegicus
ggcttacttgcggagttttgctagg

SEQ ID NO: 519502 - DNA, 25 bp, Rattus norvegicus
tgctgaggggacatcagcgcgcaac

SEQ ID NO: 519503 - DNA, 25 bp, Rattus norvegicus
tgaggggacatcagcgcgcaacgct

SEQ ID NO: 519504 - DNA, 25 bp, Rattus norvegicus
ccctggactgtttgtgggtgactgc

SEQ ID NO: 519505 - DNA, 25 bp, Rattus norvegicus
tgactgcgaggtacccgagaacgat

SEQ ID NO: 519506 - DNA, 25 bp, Rattus norvegicus
ggacaagtccctgcggactcgcacg

SEQ ID NO: 519507 - DNA, 25 bp, Rattus norvegicus
accccgccggcctgtggttggagct

SEQ ID NO: 519508 - DNA, 25 bp, Rattus norvegicus
ggacccggagccacggctgtgcggc

SEQ ID NO: 519509 - DNA, 25 bp, Rattus norvegicus
gttggagctcggagccgcttgcccc

SEQ ID NO: 519510 - DNA, 25 bp, Rattus norvegicus
agcgagtccagtggccctaccagcg

SEQ ID NO: 519511 - DNA, 25 bp, Rattus norvegicus
gtccagtggccctaccagcggcgat

SEQ ID NO: 519512 - DNA, 25 bp, Rattus norvegicus
agtggccctaccagcggcgatctgg

SEQ ID NO: 519513 - DNA, 25 bp, Rattus norvegicus
taccagcggcgatctgggcacaagc

SEQ ID NO: 519514 - DNA, 25 bp, Rattus norvegicus
ccggttccgactcggacagcagcga

SEQ ID NO: 519515 - DNA, 25 bp, Rattus norvegicus
ggttccgactcggacagcagcgacg

SEQ ID NO: 519516 - DNA, 25 bp, Rattus norvegicus
ccgcgctgcatgcatgcgcgcgccc

SEQ ID NO: 519517 - DNA, 25 bp, Rattus norvegicus
tcccggagcctggagagcctgcgct

SEQ ID NO: 519518 - DNA, 25 bp, Rattus norvegicus
agcctggagagcctgcgctcggcct

SEQ ID NO: 519519 - DNA, 25 bp, Rattus norvegicus
aagggcgccgcctgctctcccgcac

SEQ ID NO: 519520 - DNA, 25 bp, Rattus norvegicus
cagcggcgatctgggcacaagcagc

SEQ ID NO: 519521 - DNA, 25 bp, Rattus norvegicus
tcctactggccttccgctgagctgt

SEQ ID NO: 519522 - DNA, 25 bp, Rattus norvegicus
cgggttgcctgctcattcagcgagc

SEQ ID NO: 519523 - DNA, 25 bp, Rattus norvegicus
ctcattcagcgagcagtgtgggaag

SEQ ID NO: 519524 - DNA, 25 bp, Rattus norvegicus
cttgagctgggatctcccgcccgta

SEQ ID NO: 519525 - DNA, 25 bp, Rattus norvegicus
cccagcgcgtggtggtctccgctgt

SEQ ID NO: 519526 - DNA, 25 bp, Rattus norvegicus
ggcgctgctggtcctcatcaatgcc

SEQ ID NO: 519527 - DNA, 25 bp, Rattus norvegicus
cagctgctgtcaccgcaggaacgtg

SEQ ID NO: 519528 - DNA, 25 bp, Rattus norvegicus
ctggtcctcatcaatgccgtgctga

SEQ ID NO: 519529 - DNA, 25 bp, Rattus norvegicus
caatgccgtgctgatattcctactg

SEQ ID NO: 519530 - DNA, 25 bp, Rattus norvegicus
gagtggcaccttccagctgctgtca

SEQ ID NO: 519531 - DNA, 25 bp, Rattus norvegicus
gatattcctactggccttccgctga

SEQ ID NO: 519532 - DNA, 25 bp, Rattus norvegicus
gaccacgcagggtgagtggcacctt

SEQ ID NO: 519533 - DNA, 25 bp, Rattus norvegicus
cctagagcccgggttgcctgctcat

SEQ ID NO: 519534 - DNA, 25 bp, Rattus norvegicus
cgtgctgatattcctactggccttc

SEQ ID NO: 519535 - DNA, 25 bp, Rattus norvegicus
ccgcacacgtgggtttgttatgggt

SEQ ID NO: 519536 - DNA, 25 bp, Rattus norvegicus
tcacccggccgagggagaagagccc

SEQ ID NO: 519537 - DNA, 25 bp, Rattus norvegicus
caggtgcctccggacctcacccggc

SEQ ID NO: 519538 - DNA, 25 bp, Rattus norvegicus
agcccagcctggtgctcaactccgc

SEQ ID NO: 519539 - DNA, 25 bp, Rattus norvegicus
tctttgttagggtcgggcagtgcca

SEQ ID NO: 519540 - DNA, 25 bp, Rattus norvegicus
cgattctctttgttagggtcgggca

SEQ ID NO: 519541 - DNA, 25 bp, Rattus norvegicus
cgcgcagcccgattctctttgttag

SEQ ID NO: 519542 - DNA, 25 bp, Rattus norvegicus
ggaatacctccctgcgcaaccctgc

SEQ ID NO: 519543 - DNA, 25 bp, Rattus norvegicus
ccaccggcgcaacacggaatacctc

SEQ ID NO: 519544 - DNA, 25 bp, Rattus norvegicus
gcggcgactcccaccggcgcaacac

SEQ ID NO: 519545 - DNA, 25 bp, Rattus norvegicus
tggacgggcgacagacatccccagc

SEQ ID NO: 519546 - DNA, 25 bp, Rattus norvegicus
aggctgccttgccaggggaggccaa

SEQ ID NO: 519547 - DNA, 25 bp, Rattus norvegicus
tttgttatgggtgcgcaggctgcct

SEQ ID NO: 519548 - DNA, 25 bp, Rattus norvegicus
agaagagcccgggactcaagctccg

SEQ ID NO: 519549 - DNA, 25 bp, Rattus norvegicus
gcacgtgtgaaccttttcattagca

SEQ ID NO: 519550 - DNA, 25 bp, Rattus norvegicus
ttcattagcaaacctccgtgcacgc

SEQ ID NO: 519551 - DNA, 25 bp, Rattus norvegicus
gtgcacgcaaaaacactccaagttg

SEQ ID NO: 519552 - DNA, 25 bp, Rattus norvegicus
tccaagttgtgtacgtgagtgatta

SEQ ID NO: 519553 - DNA, 25 bp, Rattus norvegicus
gcgctaccaggacgtccttctcttt

SEQ ID NO: 519554 - DNA, 25 bp, Rattus norvegicus
cttcggaaggagatgtacgccggtt

SEQ ID NO: 519555 - DNA, 25 bp, Rattus norvegicus
tcggctcagacaatgcaagaaaacc

SEQ ID NO: 519556 - DNA, 25 bp, Rattus norvegicus
tcatggaacgtagtcatggtccgta

SEQ ID NO: 519557 - DNA, 25 bp, Rattus norvegicus
cggctgcgatcctcagcacaggttc

SEQ ID NO: 519558 - DNA, 25 bp, Rattus norvegicus
ctgggacgcttacctcggctgcgat

SEQ ID NO: 519559 - DNA, 25 bp, Rattus norvegicus
tgcttcccgtactcacggtagcctg

SEQ ID NO: 519560 - DNA, 25 bp, Rattus norvegicus
tttcctgcaggagaaggatcgcccg

SEQ ID NO: 519561 - DNA, 25 bp, Rattus norvegicus
ttgctaaggtaacctccgaagccta

SEQ ID NO: 519562 - DNA, 25 bp, Rattus norvegicus
tttttcctaatgaacctgggccatg

SEQ ID NO: 519563 - DNA, 25 bp, Rattus norvegicus
cctgatccctgtctggcggccagaa

SEQ ID NO: 519564 - DNA, 25 bp, Rattus norvegicus
tctggcggccagaacattcgcaggt

SEQ ID NO: 519565 - DNA, 25 bp, Rattus norvegicus
cggccagaacattcgcaggtgactg

SEQ ID NO: 519566 - DNA, 25 bp, Rattus norvegicus
aacattcgcaggtgactgtgcccgc

SEQ ID NO: 519567 - DNA, 25 bp, Rattus norvegicus
ctggctctgaggaacgccagcctta

SEQ ID NO: 519568 - DNA, 25 bp, Rattus norvegicus
tcccaggacctcctcggtccgagta

SEQ ID NO: 519569 - DNA, 25 bp, Rattus norvegicus
tgaggaacgccagccttactggccg

SEQ ID NO: 519570 - DNA, 25 bp, Rattus norvegicus
tgacgcaggacctggactcgcgcgt

SEQ ID NO: 519571 - DNA, 25 bp, Rattus norvegicus
tctcagcctgatccctgtctggcgg

SEQ ID NO: 519572 - DNA, 25 bp, Rattus norvegicus
ggcgaccttgcactctcagcctgat

SEQ ID NO: 519573 - DNA, 25 bp, Rattus norvegicus
agaagccggcgaccttgcactctca

SEQ ID NO: 519574 - DNA, 25 bp, Rattus norvegicus
actcgcgcgtccagcggagaagcag

SEQ ID NO: 519575 - DNA, 25 bp, Rattus norvegicus
gagtaccctgttcggccctgctcac

SEQ ID NO: 519576 - DNA, 25 bp, Rattus norvegicus
tccaagcctggctctgaggaacgcc

SEQ ID NO: 519577 - DNA, 25 bp, Rattus norvegicus
gtgatagtcttcctgcatatccaga

SEQ ID NO: 519578 - DNA, 25 bp, Rattus norvegicus
ctgcgcatagcctgggcgccgagta

SEQ ID NO: 519579 - DNA, 25 bp, Rattus norvegicus
ctggaccgaactcaccaactgtgtt

SEQ ID NO: 519580 - DNA, 25 bp, Rattus norvegicus
agtgcacctgctatcggcccaatcg

SEQ ID NO: 519581 - DNA, 25 bp, Rattus norvegicus
acctagtgcagaacgtgcgcctcga

SEQ ID NO: 519582 - DNA, 25 bp, Rattus norvegicus
catgaagggcgacgacgtgatagtc

SEQ ID NO: 519583 - DNA, 25 bp, Rattus norvegicus
tgttcccggtgtgctagaccgccgc

SEQ ID NO: 519584 - DNA, 25 bp, Rattus norvegicus
cgctcgctgcgcttcgacatgaagg

SEQ ID NO: 519585 - DNA, 25 bp, Rattus norvegicus
aaagtactacttcccggtgcgcgag

SEQ ID NO: 519586 - DNA, 25 bp, Rattus norvegicus
cacgccggacccacattacgagaaa

SEQ ID NO: 519587 - DNA, 25 bp, Rattus norvegicus
tgctcatcctctaccagtacgcggg

SEQ ID NO: 519588 - DNA, 25 bp, Rattus norvegicus
cggcgtgcttcatgctcatcctcta

SEQ ID NO: 519589 - DNA, 25 bp, Rattus norvegicus
ttgagcgcgccagcaagttcgtgct

SEQ ID NO: 519590 - DNA, 25 bp, Rattus norvegicus
cgcccgggccagaagaagtgcacct

SEQ ID NO: 519591 - DNA, 25 bp, Rattus norvegicus
gcacatcgaggagctcaacgacctg

SEQ ID NO: 519592 - DNA, 25 bp, Rattus norvegicus
gcagtacctatttgagcggacgttc

SEQ ID NO: 519593 - DNA, 25 bp, Rattus norvegicus
ccaaggacctcttccagcagcgtta

SEQ ID NO: 519594 - DNA, 25 bp, Rattus norvegicus
gcgttaccagtacaagagacagctg

SEQ ID NO: 519595 - DNA, 25 bp, Rattus norvegicus
gcgcaatcgcgaagagcgcctcctg

SEQ ID NO: 519596 - DNA, 25 bp, Rattus norvegicus
aacgacctggacatgcagctttatg

SEQ ID NO: 519597 - DNA, 25 bp, Rattus norvegicus
tcctgcatcgctccaaggaagcgct

SEQ ID NO: 519598 - DNA, 25 bp, Rattus norvegicus
cagctttatgactatgccaaggacc

SEQ ID NO: 519599 - DNA, 25 bp, Rattus norvegicus
tgaggacactatccggcacatcgag

SEQ ID NO: 519600 - DNA, 25 bp, Rattus norvegicus
tccggcccttcatgcagtacaacag

SEQ ID NO: 519601 - DNA, 25 bp, Rattus norvegicus
gcggacgttcaacctcaagttcatc

SEQ ID NO: 519602 - DNA, 25 bp, Rattus norvegicus
ctggagagcgccaagaagaacctgc

SEQ ID NO: 519603 - DNA, 25 bp, Rattus norvegicus
gcatggccttcttcggcctcacgga

SEQ ID NO: 519604 - DNA, 25 bp, Rattus norvegicus
gttccagcgcaagacgcagtaccta

SEQ ID NO: 519605 - DNA, 25 bp, Rattus norvegicus
cctagaggcgaaggcaagacgactt

SEQ ID NO: 519606 - DNA, 25 bp, Rattus norvegicus
tacacttccgcttcctagaggcgaa

SEQ ID NO: 519607 - DNA, 25 bp, Rattus norvegicus
cagtgagaagccgacacgcgccttt

SEQ ID NO: 519608 - DNA, 25 bp, Rattus norvegicus
aagcaataacccagttgccagctgc

SEQ ID NO: 519609 - DNA, 25 bp, Rattus norvegicus
cctcacaagccggtttctcaaagca

SEQ ID NO: 519610 - DNA, 25 bp, Rattus norvegicus
gcaagacgacttccggctaccgagt

SEQ ID NO: 519611 - DNA, 25 bp, Rattus norvegicus
aacagaagaccgctgaggacagaca

SEQ ID NO: 519612 - DNA, 25 bp, Rattus norvegicus
acagacagcttgaggcgctcgcaga

SEQ ID NO: 519613 - DNA, 25 bp, Rattus norvegicus
aggcgctcgcagagagaacactgga

SEQ ID NO: 519614 - DNA, 25 bp, Rattus norvegicus
ccgagtcagagtacaagaggaagcc

SEQ ID NO: 519615 - DNA, 25 bp, Rattus norvegicus
aggaagcccaaggtgactcggactc

SEQ ID NO: 519616 - DNA, 25 bp, Rattus norvegicus
aaggtgactcggactcacgctcgcc

SEQ ID NO: 519617 - DNA, 25 bp, Rattus norvegicus
actccagtgcctgcaacgacgtctg

SEQ ID NO: 519618 - DNA, 25 bp, Rattus norvegicus
caagccggtttctcaaagcaataac

SEQ ID NO: 519619 - DNA, 25 bp, Rattus norvegicus
ataccatcgtggaacgtggagcgcc

SEQ ID NO: 519620 - DNA, 25 bp, Rattus norvegicus
ccagcgttgaccttggcgaagagcc

SEQ ID NO: 519621 - DNA, 25 bp, Rattus norvegicus
gccgctggctgaacacgataccatc

SEQ ID NO: 519622 - DNA, 25 bp, Rattus norvegicus
ctgtgctccgctggtcatccagatg

SEQ ID NO: 519623 - DNA, 25 bp, Rattus norvegicus
atccagatgcacctgtgcgcccgtg

SEQ ID NO: 519624 - DNA, 25 bp, Rattus norvegicus
cccgtggaaactaagagcctctcgg

SEQ ID NO: 519625 - DNA, 25 bp, Rattus norvegicus
actaagagcctctcggggcacctcg

SEQ ID NO: 519626 - DNA, 25 bp, Rattus norvegicus
agtgctacacgctcaccgggccata

SEQ ID NO: 519627 - DNA, 25 bp, Rattus norvegicus
tcgtgtctcagcacgcgcagtgcta

SEQ ID NO: 519628 - DNA, 25 bp, Rattus norvegicus
ctctggaagcaacgctgcccaagtg

SEQ ID NO: 519629 - DNA, 25 bp, Rattus norvegicus
cgcacgaacgaagccctctggaagc

SEQ ID NO: 519630 - DNA, 25 bp, Rattus norvegicus
gcgaagagccatcctctacggttca

SEQ ID NO: 519631 - DNA, 25 bp, Rattus norvegicus
gaccagcacgtctttgcgcaacaag

SEQ ID NO: 519632 - DNA, 25 bp, Rattus norvegicus
ggttcacccagaagcagaccacatt

SEQ ID NO: 519633 - DNA, 25 bp, Rattus norvegicus
ggcttcccaggcgtttatctcgaaa

SEQ ID NO: 519634 - DNA, 25 bp, Rattus norvegicus
ctgcggtcccgattcctgaaagtga

SEQ ID NO: 519635 - DNA, 25 bp, Rattus norvegicus
ggcccatttgttgtgacagctgtca

SEQ ID NO: 519636 - DNA, 25 bp, Rattus norvegicus
cggtttcaatctcgagctgctctgg

SEQ ID NO: 519637 - DNA, 25 bp, Rattus norvegicus
cacacttcctgctgcggtttcaatc

SEQ ID NO: 519638 - DNA, 25 bp, Rattus norvegicus
gaaattcactgagccgcccacactt

SEQ ID NO: 519639 - DNA, 25 bp, Rattus norvegicus
ctcgggctctggactgaaattcact

SEQ ID NO: 519640 - DNA, 25 bp, Rattus norvegicus
ttatctcgaaactctcctctcgggc

SEQ ID NO: 519641 - DNA, 25 bp, Rattus norvegicus
tctcttctcgtggaaactcggggcg

SEQ ID NO: 519642 - DNA, 25 bp, Rattus norvegicus
tctgcgtgctctcttctcgtggaaa

SEQ ID NO: 519643 - DNA, 25 bp, Rattus norvegicus
ggcaacccgagtgtctgcgtgctct

SEQ ID NO: 519644 - DNA, 25 bp, Rattus norvegicus
tccatcaatggaagctcagagcgcg

SEQ ID NO: 519645 - DNA, 25 bp, Rattus norvegicus
cccgccctagaaaaaggatccatca

SEQ ID NO: 519646 - DNA, 25 bp, Rattus norvegicus
ctgtgcgcatcgagggtctccggac

SEQ ID NO: 519647 - DNA, 25 bp, Rattus norvegicus
ccgggacagagacgtccttcctcta

SEQ ID NO: 519648 - DNA, 25 bp, Rattus norvegicus
gccttaggaggcctcaggaggcctc

SEQ ID NO: 519649 - DNA, 25 bp, Rattus norvegicus
tcatcccgagttcccggcgaggagg

SEQ ID NO: 519650 - DNA, 25 bp, Rattus norvegicus
gcgctcgccggagctggatcacagt

SEQ ID NO: 519651 - DNA, 25 bp, Rattus norvegicus
gcgccacgggctccgaggaaaacgc

SEQ ID NO: 519652 - DNA, 25 bp, Rattus norvegicus
aggaaaacgcggaagtggattgctc

SEQ ID NO: 519653 - DNA, 25 bp, Rattus norvegicus
aagtggattgctcttccggaactgc

SEQ ID NO: 519654 - DNA, 25 bp, Rattus norvegicus
ggcaaagagctaagcagttcagaca

SEQ ID NO: 519655 - DNA, 25 bp, Rattus norvegicus
gatccgcgacctcgctggcctgtgg

SEQ ID NO: 519656 - DNA, 25 bp, Rattus norvegicus
cgtccttcctctacgttttctgtgg

SEQ ID NO: 519657 - DNA, 25 bp, Rattus norvegicus
ctctacgttttctgtggggaaagtg

SEQ ID NO: 519658 - DNA, 25 bp, Rattus norvegicus
gtgagggcaaagagctaagcagttc

SEQ ID NO: 519659 - DNA, 25 bp, Rattus norvegicus
attgctcttccggaactgcgcggcg

SEQ ID NO: 519660 - DNA, 25 bp, Rattus norvegicus
actcggccaaggtcatcccgagttc

SEQ ID NO: 519661 - DNA, 25 bp, Rattus norvegicus
ccgacctcccattggttcctggaga

SEQ ID NO: 519662 - DNA, 25 bp, Rattus norvegicus
tggcccaacccattggcctgcggaa

SEQ ID NO: 519663 - DNA, 25 bp, Rattus norvegicus
cgccggcccttcatcaaaaagcccg

SEQ ID NO: 519664 - DNA, 25 bp, Rattus norvegicus
ccaccaggagggtcttggagccgcc

SEQ ID NO: 519665 - DNA, 25 bp, Rattus norvegicus
aggagaaagagcaaaagcctggccc

SEQ ID NO: 519666 - DNA, 25 bp, Rattus norvegicus
ctcccattggttcctggagagtccc

SEQ ID NO: 519667 - DNA, 25 bp, Rattus norvegicus
gcttgacccgccctgacatgcagcg

SEQ ID NO: 519668 - DNA, 25 bp, Rattus norvegicus
ttcaagtattccaccgcttgacccg

SEQ ID NO: 519669 - DNA, 25 bp, Rattus norvegicus
tgctcccgtttcaagtattccaccg

SEQ ID NO: 519670 - DNA, 25 bp, Rattus norvegicus
ttcgacagcgagtgctcccgtttca

SEQ ID NO: 519671 - DNA, 25 bp, Rattus norvegicus
ctcaccctggtagggcttcgacagc

SEQ ID NO: 519672 - DNA, 25 bp, Rattus norvegicus
gcgcctcaccctggtagggcttcga

SEQ ID NO: 519673 - DNA, 25 bp, Rattus norvegicus
cctgtccttgggacctgtggctctt

SEQ ID NO: 519674 - DNA, 25 bp, Rattus norvegicus
caccgctgccaccaggagggtcttg

SEQ ID NO: 519675 - DNA, 25 bp, Rattus norvegicus
atcagtctttacaggctagcgggga

SEQ ID NO: 519676 - DNA, 25 bp, Rattus norvegicus
ttccggcgaagggtcaagagaacgc

SEQ ID NO: 519677 - DNA, 25 bp, Rattus norvegicus
agggtcaagagaacgcgtcctggcc

SEQ ID NO: 519678 - DNA, 25 bp, Rattus norvegicus
ccttcggggtgactgtggcagcaaa

SEQ ID NO: 519679 - DNA, 25 bp, Rattus norvegicus
tggcagcaaacccaagagccgcttc

SEQ ID NO: 519680 - DNA, 25 bp, Rattus norvegicus
agagccgcttcttaattaaagcttc

SEQ ID NO: 519681 - DNA, 25 bp, Rattus norvegicus
taaagcttcttccagcgtgggcccg

SEQ ID NO: 519682 - DNA, 25 bp, Rattus norvegicus
gcactctccgggctgaagtctggcc

SEQ ID NO: 519683 - DNA, 25 bp, Rattus norvegicus
tctggccgcggattacctctataga

SEQ ID NO: 519684 - DNA, 25 bp, Rattus norvegicus
tcggaagcgcgcgtcattttgactc

SEQ ID NO: 519685 - DNA, 25 bp, Rattus norvegicus
gtcattttgactcgcgcgccggaag

SEQ ID NO: 519686 - DNA, 25 bp, Rattus norvegicus
tttcgccgccgtcctgtggcgggaa

SEQ ID NO: 519687 - DNA, 25 bp, Rattus norvegicus
ccggtctggatgttatcagtcttta

SEQ ID NO: 519688 - DNA, 25 bp, Rattus norvegicus
cggcgacaactgtaagtgaccggtc

SEQ ID NO: 519689 - DNA, 25 bp, Rattus norvegicus
agacctccttaagcccggagcgcga

SEQ ID NO: 519690 - DNA, 25 bp, Rattus norvegicus
ggcgggacctcgcatgcaaataagg

SEQ ID NO: 519691 - DNA, 25 bp, Rattus norvegicus
ccagcagagcgtgatcctaggcatg

SEQ ID NO: 519692 - DNA, 25 bp, Rattus norvegicus
tgcaacaagtcgtgcgggatgaacc

SEQ ID NO: 519693 - DNA, 25 bp, Rattus norvegicus
gatggcatcatcttcgtgtccgagg

SEQ ID NO: 519694 - DNA, 25 bp, Rattus norvegicus
gcagcacggtgaacttgaggctcta

SEQ ID NO: 519695 - DNA, 25 bp, Rattus norvegicus
cttgaggctctacggccacagactg

SEQ ID NO: 519696 - DNA, 25 bp, Rattus norvegicus
ctgggcgagatctctagcaacctga

SEQ ID NO: 519697 - DNA, 25 bp, Rattus norvegicus
acctgatctccttcaccgaggtgga

SEQ ID NO: 519698 - DNA, 25 bp, Rattus norvegicus
ccctagaacggagcaacagagtgca

SEQ ID NO: 519699 - DNA, 25 bp, Rattus norvegicus
cctggagctcaccaaggacttagtg

SEQ ID NO: 519700 - DNA, 25 bp, Rattus norvegicus
gtgattaccaagttcctgcggagga

SEQ ID NO: 519701 - DNA, 25 bp, Rattus norvegicus
catgaagctgtacgcgctgtgcacc

SEQ ID NO: 519702 - DNA, 25 bp, Rattus norvegicus
gacgacgccgagacggtccacaact

SEQ ID NO: 519703 - DNA, 25 bp, Rattus norvegicus
gcttggccaacagttcctggacctg

SEQ ID NO: 519704 - DNA, 25 bp, Rattus norvegicus
cgggactgctgagcttctgcacgga

SEQ ID NO: 519705 - DNA, 25 bp, Rattus norvegicus
accgtggaggacgtgctcacgccgc

SEQ ID NO: 519706 - DNA, 25 bp, Rattus norvegicus
ccggaggccactttgtgcttgcgac

SEQ ID NO: 519707 - DNA, 25 bp, Rattus norvegicus
ggccactttgtgcttgcgactcttc

SEQ ID NO: 519708 - DNA, 25 bp, Rattus norvegicus
ttgtgcttgcgactcttctgcccag

SEQ ID NO: 519709 - DNA, 25 bp, Rattus norvegicus
tctgcccaggcttggccaacagttc

SEQ ID NO: 519710 - DNA, 25 bp, Rattus norvegicus
caacagttcctggacctgggtagcc

SEQ ID NO: 519711 - DNA, 25 bp, Rattus norvegicus
cggtgctactcaccttgccggtggc

SEQ ID NO: 519712 - DNA, 25 bp, Rattus norvegicus
cctacagcgacctcagcaagggagt

SEQ ID NO: 519713 - DNA, 25 bp, Rattus norvegicus
ctaccggaccgtggaggacgtgctc

SEQ ID NO: 519714 - DNA, 25 bp, Rattus norvegicus
gctgggtgcttgctgcgttctgtct

SEQ ID NO: 519715 - DNA, 25 bp, Rattus norvegicus
tgcgttctgtctgggcagcaccgca

SEQ ID NO: 519716 - DNA, 25 bp, Rattus norvegicus
gctgctgcttctggccagcctggca

SEQ ID NO: 519717 - DNA, 25 bp, Rattus norvegicus
ttcctgccgtgctttgaagccagcc

SEQ ID NO: 519718 - DNA, 25 bp, Rattus norvegicus
ttatgtcgcattcgccagaaccgag

SEQ ID NO: 519719 - DNA, 25 bp, Rattus norvegicus
tggcccgtctggtaatgtttatgtc

SEQ ID NO: 519720 - DNA, 25 bp, Rattus norvegicus
acggttcatgcaaccgcgccttgta

SEQ ID NO: 519721 - DNA, 25 bp, Rattus norvegicus
gggcgcccgaggctaacaaagcaca

SEQ ID NO: 519722 - DNA, 25 bp, Rattus norvegicus
ttgctgccctgctaccaccagaggg

SEQ ID NO: 519723 - DNA, 25 bp, Rattus norvegicus
caggatagactgagccttgctgccc

SEQ ID NO: 519724 - DNA, 25 bp, Rattus norvegicus
cttagcttagcaaccaatgagagtg

SEQ ID NO: 519725 - DNA, 25 bp, Rattus norvegicus
ttctcgcccagggaaaccaatcctg

SEQ ID NO: 519726 - DNA, 25 bp, Rattus norvegicus
tagttgaccttcgagtcccgccttc

SEQ ID NO: 519727 - DNA, 25 bp, Rattus norvegicus
ggctgaccactccacgtccgtagtt

SEQ ID NO: 519728 - DNA, 25 bp, Rattus norvegicus
agtccatctcttccagtgtctgctg

SEQ ID NO: 519729 - DNA, 25 bp, Rattus norvegicus
ccttcagtccacgttcccggagatg

SEQ ID NO: 519730 - DNA, 25 bp, Rattus norvegicus
cggaagctccaaactcggttcgagg

SEQ ID NO: 519731 - DNA, 25 bp, Rattus norvegicus
gccgcgctagggaaatccgatccca

SEQ ID NO: 519732 - DNA, 25 bp, Rattus norvegicus
gcgcgctggacagcccaagggtctc

SEQ ID NO: 519733 - DNA, 25 bp, Rattus norvegicus
ctccggccaatggagctgcaggcac

SEQ ID NO: 519734 - DNA, 25 bp, Rattus norvegicus
actgcttgccttgatgccgatcgtc

SEQ ID NO: 519735 - DNA, 25 bp, Rattus norvegicus
actcgagagggacccggatcggaca

SEQ ID NO: 519736 - DNA, 25 bp, Rattus norvegicus
cccagctccggggatttgaatgcaa

SEQ ID NO: 519737 - DNA, 25 bp, Rattus norvegicus
ctgccaattaccctaggctggggtc

SEQ ID NO: 519738 - DNA, 25 bp, Rattus norvegicus
tgcacacacggtcgtgagtcgcggc

SEQ ID NO: 519739 - DNA, 25 bp, Rattus norvegicus
ccagctcttcccaaggcaagggaca

SEQ ID NO: 519740 - DNA, 25 bp, Rattus norvegicus
tctgcctgcgtagtgatgacccaac

SEQ ID NO: 519741 - DNA, 25 bp, Rattus norvegicus
cgcgctccgagaatctgcctgcgta

SEQ ID NO: 519742 - DNA, 25 bp, Rattus norvegicus
caagcctggcaaagattcggaccgc

SEQ ID NO: 519743 - DNA, 25 bp, Rattus norvegicus
aacgggagcagtttgcaagcctggc

SEQ ID NO: 519744 - DNA, 25 bp, Rattus norvegicus
atttgaatgcaaacaaagcggcagc

SEQ ID NO: 519745 - DNA, 25 bp, Rattus norvegicus
tgaccaccttagtctccgggagccg

SEQ ID NO: 519746 - DNA, 25 bp, Rattus norvegicus
ccatggcttctggaggtaggtgact

SEQ ID NO: 519747 - DNA, 25 bp, Rattus norvegicus
ccgcccggtcttgctgtaatttcgg

SEQ ID NO: 519748 - DNA, 25 bp, Rattus norvegicus
ggtcggccattagagctccctcgag

SEQ ID NO: 519749 - DNA, 25 bp, Rattus norvegicus
agcagcaagcggaacagtcacgata

SEQ ID NO: 519750 - DNA, 25 bp, Rattus norvegicus
tagccacaaggtatcacggtaactg

SEQ ID NO: 519751 - DNA, 25 bp, Rattus norvegicus
ctgactgggcgttgttagacaccta

SEQ ID NO: 519752 - DNA, 25 bp, Rattus norvegicus
taatttcggccgctctcccgattga

SEQ ID NO: 519753 - DNA, 25 bp, Rattus norvegicus
accggcgaagagtcagagctgcgca

SEQ ID NO: 519754 - DNA, 25 bp, Rattus norvegicus
tcccggaagtgcatctgcttgtctc

SEQ ID NO: 519755 - DNA, 25 bp, Rattus norvegicus
tgtcttgctctgtctgttcccggaa

SEQ ID NO: 519756 - DNA, 25 bp, Rattus norvegicus
agcgagatggcttcaaggttacttc

SEQ ID NO: 519757 - DNA, 25 bp, Rattus norvegicus
tacctttagcgcttcttcggctggc

SEQ ID NO: 519758 - DNA, 25 bp, Rattus norvegicus
tgcgcatgtgcaacatctaccttta

SEQ ID NO: 519759 - DNA, 25 bp, Rattus norvegicus
aggaccggcaggctacaaggctcgc

SEQ ID NO: 519760 - DNA, 25 bp, Rattus norvegicus
gcgactccagacaccgcgccgctcc

SEQ ID NO: 519761 - DNA, 25 bp, Rattus norvegicus
cagtgcgctgcctacgcgaacgcgg

SEQ ID NO: 519762 - DNA, 25 bp, Rattus norvegicus
tggacggacgcgactccagacaccg

SEQ ID NO: 519763 - DNA, 25 bp, Rattus norvegicus
agacctggacggacgcgactccaga

SEQ ID NO: 519764 - DNA, 25 bp, Rattus norvegicus
ggctacaaggctcgcggggagacct

SEQ ID NO: 519765 - DNA, 25 bp, Rattus norvegicus
tgtcgtaggactccatggcccggcc

SEQ ID NO: 519766 - DNA, 25 bp, Rattus norvegicus
ttagcgatgatgtcgtaggactcca

SEQ ID NO: 519767 - DNA, 25 bp, Rattus norvegicus
accacgggctggttagcgatgatgt

SEQ ID NO: 519768 - DNA, 25 bp, Rattus norvegicus
attgtcgatgaccacgggctggtta

SEQ ID NO: 519769 - DNA, 25 bp, Rattus norvegicus
ctgcccggcctcacattgtcgatga

SEQ ID NO: 519770 - DNA, 25 bp, Rattus norvegicus
tcacattgtcgatgaccacgggctg

SEQ ID NO: 519771 - DNA, 25 bp, Rattus norvegicus
atgatgtcgtaggactccatggccc

SEQ ID NO: 519772 - DNA, 25 bp, Rattus norvegicus
gcctcacattgtcgatgaccacggg

SEQ ID NO: 519773 - DNA, 25 bp, Rattus norvegicus
agctctgccagttctactcgcagga

SEQ ID NO: 519774 - DNA, 25 bp, Rattus norvegicus
ggcgcatctgccattcttctacgga

SEQ ID NO: 519775 - DNA, 25 bp, Rattus norvegicus
taagccatgcaaccggccgccggga

SEQ ID NO: 519776 - DNA, 25 bp, Rattus norvegicus
gacggactgccctgcaatctgcgta

SEQ ID NO: 519777 - DNA, 25 bp, Rattus norvegicus
cttcgactgcctgcgcgatgctatg

SEQ ID NO: 519778 - DNA, 25 bp, Rattus norvegicus
gcacgtacgccatcgcgggcggcaa

SEQ ID NO: 519779 - DNA, 25 bp, Rattus norvegicus
tcgagcgccaactcaatggcacgta

SEQ ID NO: 519780 - DNA, 25 bp, Rattus norvegicus
cgctagtacacgacgtgcgcttcca

SEQ ID NO: 519781 - DNA, 25 bp, Rattus norvegicus
cggctacgtgctgtcgctagtacac

SEQ ID NO: 519782 - DNA, 25 bp, Rattus norvegicus
gacggactgttcctcctgcgccagt

SEQ ID NO: 519783 - DNA, 25 bp, Rattus norvegicus
acctgaagctggcaggcatggccga

SEQ ID NO: 519784 - DNA, 25 bp, Rattus norvegicus
ccgaggccgaggagcacctgaagct

SEQ ID NO: 519785 - DNA, 25 bp, Rattus norvegicus
attcttctacggaagcatctcgcgg

SEQ ID NO: 519786 - DNA, 25 bp, Rattus norvegicus
gccctgcaatctgcgtaagccatgc

SEQ ID NO: 519787 - DNA, 25 bp, Rattus norvegicus
catgcgcaagtatgacggatccttc

SEQ ID NO: 519788 - DNA, 25 bp, Rattus norvegicus
cgtatgtatacccagcacgcttaga

SEQ ID NO: 519789 - DNA, 25 bp, Rattus norvegicus
ggagtctaccgcatgcgcaagtatg

SEQ ID NO: 519790 - DNA, 25 bp, Rattus norvegicus
ctcagtgcgccagggagtctaccgc

SEQ ID NO: 519791 - DNA, 25 bp, Rattus norvegicus
ttgcggcaactttggctcagtgcgc

SEQ ID NO: 519792 - DNA, 25 bp, Rattus norvegicus
cgacatcgaacttggttgcggcaac

SEQ ID NO: 519793 - DNA, 25 bp, Rattus norvegicus
tcgtggccgacatcgaacttggttg

SEQ ID NO: 519794 - DNA, 25 bp, Rattus norvegicus
gagagaacctcctcgtggccgacat

SEQ ID NO: 519795 - DNA, 25 bp, Rattus norvegicus
aagtatgacggatccttccgcctcg

SEQ ID NO: 519796 - DNA, 25 bp, Rattus norvegicus
gaactcaaggacaagaagctcttcc

SEQ ID NO: 519797 - DNA, 25 bp, Rattus norvegicus
tggacacgagcgtgtacgagagccc

SEQ ID NO: 519798 - DNA, 25 bp, Rattus norvegicus
acgaccgatgcccatggacacgagc

SEQ ID NO: 519799 - DNA, 25 bp, Rattus norvegicus
gcttagacaagccacgaccgatgcc

SEQ ID NO: 519800 - DNA, 25 bp, Rattus norvegicus
gctcttcctgaagcgagagaacctc

SEQ ID NO: 519801 - DNA, 25 bp, Rattus norvegicus
agtagcaagaacctacgagagctcg

SEQ ID NO: 519802 - DNA, 25 bp, Rattus norvegicus
gtgtttcccgaggactccgtgagct

SEQ ID NO: 519803 - DNA, 25 bp, Rattus norvegicus
tcggcatcggcatcgactacgaaga

SEQ ID NO: 519804 - DNA, 25 bp, Rattus norvegicus
agtgtcagtcacagcctcggcatcg

SEQ ID NO: 519805 - DNA, 25 bp, Rattus norvegicus
cgtgggagcgatagtgtcagtcaca

SEQ ID NO: 519806 - DNA, 25 bp, Rattus norvegicus
ggcgcgacccttctccgcgaggtga

SEQ ID NO: 519807 - DNA, 25 bp, Rattus norvegicus
accacgagggtcatcaccaggtgca

SEQ ID NO: 519808 - DNA, 25 bp, Rattus norvegicus
gacggggctcgacccagcaacttcg

SEQ ID NO: 519809 - DNA, 25 bp, Rattus norvegicus
tcacggagcagctacagagccgcgc

SEQ ID NO: 519810 - DNA, 25 bp, Rattus norvegicus
actgacagcagacgaggggaagacc

SEQ ID NO: 519811 - DNA, 25 bp, Rattus norvegicus
ttttgaaatgggcactgacagcaga

SEQ ID NO: 519812 - DNA, 25 bp, Rattus norvegicus
cgagagctcgggaagttttgaaatg

SEQ ID NO: 519813 - DNA, 25 bp, Rattus norvegicus
tccacaccacatagcgggccaagta

SEQ ID NO: 519814 - DNA, 25 bp, Rattus norvegicus
ggcttcaccgacctgacgggccgga

SEQ ID NO: 519815 - DNA, 25 bp, Rattus norvegicus
cctaactctgcgcaagccggcgtga

SEQ ID NO: 519816 - DNA, 25 bp, Rattus norvegicus
gccgctggcggcaaataaaccttcg

SEQ ID NO: 519817 - DNA, 25 bp, Rattus norvegicus
ttacggtccagggtgatcgtcctct

SEQ ID NO: 519818 - DNA, 25 bp, Rattus norvegicus
ggacccggttatcctgccctaagca

SEQ ID NO: 519819 - DNA, 25 bp, Rattus norvegicus
ggcagcggccaagatgtcacaatgt

SEQ ID NO: 519820 - DNA, 25 bp, Rattus norvegicus
tctggagtcctaccatcatggaagc

SEQ ID NO: 519821 - DNA, 25 bp, Rattus norvegicus
ggagactgtgtgtgccctaagaaaa

SEQ ID NO: 519822 - DNA, 25 bp, Rattus norvegicus
aaaagcccgcatacctgcagtgtgg

SEQ ID NO: 519823 - DNA, 25 bp, Rattus norvegicus
ccgcgggtgctagtgaccttcacta

SEQ ID NO: 519824 - DNA, 25 bp, Rattus norvegicus
caggagcgccgtacctgttgtaatc

SEQ ID NO: 519825 - DNA, 25 bp, Rattus norvegicus
ttgtaatccgcggagccaccagaca

SEQ ID NO: 519826 - DNA, 25 bp, Rattus norvegicus
cagcgttcctggagatccatgaatc

SEQ ID NO: 519827 - DNA, 25 bp, Rattus norvegicus
ctgggactctttgatttcggcggaa

SEQ ID NO: 519828 - DNA, 25 bp, Rattus norvegicus
ttcggcggaagaatattgcagcagc

SEQ ID NO: 519829 - DNA, 25 bp, Rattus norvegicus
agtgtagtctaagtcgtcgccgacg

SEQ ID NO: 519830 - DNA, 25 bp, Rattus norvegicus
agaccgcacccacttgagagctgga

SEQ ID NO: 519831 - DNA, 25 bp, Rattus norvegicus
gccggatcccgagccatgctgtgat

SEQ ID NO: 519832 - DNA, 25 bp, Rattus norvegicus
cggtgtcttagcaactgaggcgatg

SEQ ID NO: 519833 - DNA, 25 bp, Rattus norvegicus
gacggtcccagttggttccgcaaca

SEQ ID NO: 519834 - DNA, 25 bp, Rattus norvegicus
gttgtcaacagaaactggactcctg

SEQ ID NO: 519835 - DNA, 25 bp, Rattus norvegicus
tggactcctgcaactctgtgcccga

SEQ ID NO: 519836 - DNA, 25 bp, Rattus norvegicus
ttcgccagcatcagggagtcacagc

SEQ ID NO: 519837 - DNA, 25 bp, Rattus norvegicus
acagccttgtccagcagtgggatgc

SEQ ID NO: 519838 - DNA, 25 bp, Rattus norvegicus
ccttctgctctggttagtgaggccc

SEQ ID NO: 519839 - DNA, 25 bp, Rattus norvegicus
tctagcccagaaccttccagctttg

SEQ ID NO: 519840 - DNA, 25 bp, Rattus norvegicus
caagtttgcaatttccgaggtggac

SEQ ID NO: 519841 - DNA, 25 bp, Rattus norvegicus
aggtggacctcgcttctgctgcgaa

SEQ ID NO: 519842 - DNA, 25 bp, Rattus norvegicus
ccatgctgtgattggcggtgtctta

SEQ ID NO: 519843 - DNA, 25 bp, Rattus norvegicus
cagtggcacagcctagcggttctct

SEQ ID NO: 519844 - DNA, 25 bp, Rattus norvegicus
agcgagccggccagaaaacaagtcc

SEQ ID NO: 519845 - DNA, 25 bp, Rattus norvegicus
aaacaagtcccgtccagtcttcagg

SEQ ID NO: 519846 - DNA, 25 bp, Rattus norvegicus
cagtcttcaggactgggcagcagcc

SEQ ID NO: 519847 - DNA, 25 bp, Rattus norvegicus
agctggatacactggggatttggcc

SEQ ID NO: 519848 - DNA, 25 bp, Rattus norvegicus
cgcgtctttggagcgcggtcttaga

SEQ ID NO: 519849 - DNA, 25 bp, Rattus norvegicus
ggagctctgtgatgctctacatcga

SEQ ID NO: 519850 - DNA, 25 bp, Rattus norvegicus
tacatcgagcctgccggcagcatct

SEQ ID NO: 519851 - DNA, 25 bp, Rattus norvegicus
ggcagcatctctactggatcccaca

SEQ ID NO: 519852 - DNA, 25 bp, Rattus norvegicus
ggatcccacaggcatccaacgctgg

SEQ ID NO: 519853 - DNA, 25 bp, Rattus norvegicus
tggtggaagacaccgactctgcgtc

SEQ ID NO: 519854 - DNA, 25 bp, Rattus norvegicus
cgggtaaaaataaacatgcgtcttg

SEQ ID NO: 519855 - DNA, 25 bp, Rattus norvegicus
aactcttcgagcatttttctgtccg

SEQ ID NO: 519856 - DNA, 25 bp, Rattus norvegicus
gcggtatctcgggtgtcaacacacc

SEQ ID NO: 519857 - DNA, 25 bp, Rattus norvegicus
tgctgggtaaatccaaagacgcccg

SEQ ID NO: 519858 - DNA, 25 bp, Rattus norvegicus
gctcaagtcctaggcccgccgtgaa

SEQ ID NO: 519859 - DNA, 25 bp, Rattus norvegicus
tcgcaacctggcatctgagcggctg

SEQ ID NO: 519860 - DNA, 25 bp, Rattus norvegicus
gccgtttccacggtcagttcgcaac

SEQ ID NO: 519861 - DNA, 25 bp, Rattus norvegicus
cgtgacgtaaatacagagcgccgca

SEQ ID NO: 519862 - DNA, 25 bp, Rattus norvegicus
cgcccgtttacgttggaatcgcagg

SEQ ID NO: 519863 - DNA, 25 bp, Rattus norvegicus
ctagaggcgagagtaggagaaatcc

SEQ ID NO: 519864 - DNA, 25 bp, Rattus norvegicus
gggctacgcccactgacaagctaga

SEQ ID NO: 519865 - DNA, 25 bp, Rattus norvegicus
ggcttgtcctcataataccggggca

SEQ ID NO: 519866 - DNA, 25 bp, Rattus norvegicus
tacctggagcacacaggccgactgc

SEQ ID NO: 519867 - DNA, 25 bp, Rattus norvegicus
ggctaagctctaccacccagattcg

SEQ ID NO: 519868 - DNA, 25 bp, Rattus norvegicus
catggagccagtctcggctaagctc

SEQ ID NO: 519869 - DNA, 25 bp, Rattus norvegicus
tgacctccctggcaggccaacatgg

SEQ ID NO: 519870 - DNA, 25 bp, Rattus norvegicus
aacttccggcgggattgtgactctt

SEQ ID NO: 519871 - DNA, 25 bp, Rattus norvegicus
gaaactcgcaggtaccgctccaggc

SEQ ID NO: 519872 - DNA, 25 bp, Rattus norvegicus
ggacccttgaacacgtgcacctctt

SEQ ID NO: 519873 - DNA, 25 bp, Rattus norvegicus
gcacctctttaagtacctgagaacg

SEQ ID NO: 519874 - DNA, 25 bp, Rattus norvegicus
tgagaacgtactcagaccagcctta

SEQ ID NO: 519875 - DNA, 25 bp, Rattus norvegicus
gaccagccttacttccattagtctc

SEQ ID NO: 519876 - DNA, 25 bp, Rattus norvegicus
attagtctccgctccagctcggcgg

SEQ ID NO: 519877 - DNA, 25 bp, Rattus norvegicus
ccagctcggcggaactgttggacaa

SEQ ID NO: 519878 - DNA, 25 bp, Rattus norvegicus
cggaactgttggacaatggtgttta

SEQ ID NO: 519879 - DNA, 25 bp, Rattus norvegicus
ggacaatggtgtttagctcagagga

SEQ ID NO: 519880 - DNA, 25 bp, Rattus norvegicus
ctcagaggagcgctgagatatccta

SEQ ID NO: 519881 - DNA, 25 bp, Rattus norvegicus
agatatcctatgttcggccactcga

SEQ ID NO: 519882 - DNA, 25 bp, Rattus norvegicus
tcggccactcgaagacgttctttta

SEQ ID NO: 519883 - DNA, 25 bp, Rattus norvegicus
ctcgaagacgttcttttaaagcgag

SEQ ID NO: 519884 - DNA, 25 bp, Rattus norvegicus
gctccaggcggacccttgaacacgt

SEQ ID NO: 519885 - DNA, 25 bp, Rattus norvegicus
ttccgctgccagcaggtgggtgctc

SEQ ID NO: 519886 - DNA, 25 bp, Rattus norvegicus
atcggacgcagacctcgggatgccc

SEQ ID NO: 519887 - DNA, 25 bp, Rattus norvegicus
gggctcgctcctccgtacctccgac

SEQ ID NO: 519888 - DNA, 25 bp, Rattus norvegicus
tccgtacctccgacacatcttagtc

SEQ ID NO: 519889 - DNA, 25 bp, Rattus norvegicus
cccagccctccagccgcggggtcct

SEQ ID NO: 519890 - DNA, 25 bp, Rattus norvegicus
gcggggtcctgcccgcaactcttga

SEQ ID NO: 519891 - DNA, 25 bp, Rattus norvegicus
actgcacttttccggaccgcccgag

SEQ ID NO: 519892 - DNA, 25 bp, Rattus norvegicus
ccaccgggagggagcgcagcacgga

SEQ ID NO: 519893 - DNA, 25 bp, Rattus norvegicus
cccgccgtattccgcctggccgctc

SEQ ID NO: 519894 - DNA, 25 bp, Rattus norvegicus
cgcgatcggacgcagacctcgggat

SEQ ID NO: 519895 - DNA, 25 bp, Rattus norvegicus
tcggacgcagacctcgggatgcccg

SEQ ID NO: 519896 - DNA, 25 bp, Rattus norvegicus
ggatgcccgggttccgctgccagca

SEQ ID NO: 519897 - DNA, 25 bp, Rattus norvegicus
cagcaggtgggtgctcggcggaccc

SEQ ID NO: 519898 - DNA, 25 bp, Rattus norvegicus
tgcgcgcgcgatcggacgcagacct

SEQ ID NO: 519899 - DNA, 25 bp, Rattus norvegicus
cgcgtgctgcgtgcccacgccactt

SEQ ID NO: 519900 - DNA, 25 bp, Rattus norvegicus
gtctgcgttccacgcgtgctgcgtg

SEQ ID NO: 519901 - DNA, 25 bp, Rattus norvegicus
cctgggtctgcgttccacgcgtgct

SEQ ID NO: 519902 - DNA, 25 bp, Rattus norvegicus
ttgctccctccaacctccctgggtc

SEQ ID NO: 519903 - DNA, 25 bp, Rattus norvegicus
gcgacttcaggaacgcgtcagactc

SEQ ID NO: 519904 - DNA, 25 bp, Rattus norvegicus
cgtccggacgcgacttcaggaacgc

SEQ ID NO: 519905 - DNA, 25 bp, Rattus norvegicus
tccacgtccggacgcgacttcagga

SEQ ID NO: 519906 - DNA, 25 bp, Rattus norvegicus
ctgagctctgctcgccaccacctcc

SEQ ID NO: 519907 - DNA, 25 bp, Rattus norvegicus
gggactacctgagctctgctcgcca

SEQ ID NO: 519908 - DNA, 25 bp, Rattus norvegicus
gccagggactacctgagctctgctc

SEQ ID NO: 519909 - DNA, 25 bp, Rattus norvegicus
cgtccaaagggccagggactacctg

SEQ ID NO: 519910 - DNA, 25 bp, Rattus norvegicus
caccgaccatggtgtcgtggacgtg

SEQ ID NO: 519911 - DNA, 25 bp, Rattus norvegicus
ttcaggaacgcgtcagactcttccc

SEQ ID NO: 519912 - DNA, 25 bp, Rattus norvegicus
gtctggcttttcttggccccaccga

SEQ ID NO: 519913 - DNA, 25 bp, Rattus norvegicus
ccttatgggtccgagcgtctgaagg

SEQ ID NO: 519914 - DNA, 25 bp, Rattus norvegicus
ggacgtgcacatatggataaaagta

SEQ ID NO: 519915 - DNA, 25 bp, Rattus norvegicus
cgtgcacatatggataaaagtaaaa

SEQ ID NO: 519916 - DNA, 25 bp, Rattus norvegicus
cacatatggataaaagtaaaagttg

SEQ ID NO: 519917 - DNA, 25 bp, Rattus norvegicus
tcgtaaccttatgggtccgagcgtc

SEQ ID NO: 519918 - DNA, 25 bp, Rattus norvegicus
gtaaccttatgggtccgagcgtctg

SEQ ID NO: 519919 - DNA, 25 bp, Rattus norvegicus
taaccttatgggtccgagcgtctga

SEQ ID NO: 519920 - DNA, 25 bp, Rattus norvegicus
ctgaaggctaatgggggaaactgcc

SEQ ID NO: 519921 - DNA, 25 bp, Rattus norvegicus
ttatgggtccgagcgtctgaaggct

SEQ ID NO: 519922 - DNA, 25 bp, Rattus norvegicus
tgggtccgagcgtctgaaggctaat

SEQ ID NO: 519923 - DNA, 25 bp, Rattus norvegicus
tccgagcgtctgaaggctaatgggg

SEQ ID NO: 519924 - DNA, 25 bp, Rattus norvegicus
ggagggacgtgcacatatggataaa

SEQ ID NO: 519925 - DNA, 25 bp, Rattus norvegicus
agggacgtgcacatatggataaaag

SEQ ID NO: 519926 - DNA, 25 bp, Rattus norvegicus
aaccttatgggtccgagcgtctgaa

SEQ ID NO: 519927 - DNA, 25 bp, Rattus norvegicus
aggccttgggtcacgccggccgcca

SEQ ID NO: 519928 - DNA, 25 bp, Rattus norvegicus
cccaggccctagtcaggggcggctt

SEQ ID NO: 519929 - DNA, 25 bp, Rattus norvegicus
cccagcactgtacctcgcgcatgcc

SEQ ID NO: 519930 - DNA, 25 bp, Rattus norvegicus
actgcaggagtaggccttgggtcac

SEQ ID NO: 519931 - DNA, 25 bp, Rattus norvegicus
cttgctgactttgcggcctacacaa

SEQ ID NO: 519932 - DNA, 25 bp, Rattus norvegicus
ggccttgctgactttgcggcctaca

SEQ ID NO: 519933 - DNA, 25 bp, Rattus norvegicus
gtcatggccttgctgactttgcggc

SEQ ID NO: 519934 - DNA, 25 bp, Rattus norvegicus
gggagtcatggccttgctgactttg

SEQ ID NO: 519935 - DNA, 25 bp, Rattus norvegicus
ttccaccggacctccggccgccatc

SEQ ID NO: 519936 - DNA, 25 bp, Rattus norvegicus
cgccgccgcggcgttttgcccgttg

SEQ ID NO: 519937 - DNA, 25 bp, Rattus norvegicus
acggctccgctgtctccgaggccct

SEQ ID NO: 519938 - DNA, 25 bp, Rattus norvegicus
gccacgctcgcttcacggctccgct

SEQ ID NO: 519939 - DNA, 25 bp, Rattus norvegicus
ccctcacgtactcgtgggcgacgtg

SEQ ID NO: 519940 - DNA, 25 bp, Rattus norvegicus
caggccctagtcaggggcggcttcc

SEQ ID NO: 519941 - DNA, 25 bp, Rattus norvegicus
tgcgcacgcgtacttggctcgacac

SEQ ID NO: 519942 - DNA, 25 bp, Rattus norvegicus
agtggctctcttctagcccagcgca

SEQ ID NO: 519943 - DNA, 25 bp, Rattus norvegicus
ggttactccctagagctgctccggt

SEQ ID NO: 519944 - DNA, 25 bp, Rattus norvegicus
ctagctgagggaggcggttactccc

SEQ ID NO: 519945 - DNA, 25 bp, Rattus norvegicus
ctctgtacctgagcggggctctcct

SEQ ID NO: 519946 - DNA, 25 bp, Rattus norvegicus
gaactacggatcgtgcgcgcgcacc

SEQ ID NO: 519947 - DNA, 25 bp, Rattus norvegicus
ccactatggggcctatggccttgcc

SEQ ID NO: 519948 - DNA, 25 bp, Rattus norvegicus
cgagcacgtagcgacgtagacagca

SEQ ID NO: 519949 - DNA, 25 bp, Rattus norvegicus
tatggccttgccagagatccagccc

SEQ ID NO: 519950 - DNA, 25 bp, Rattus norvegicus
tcagggctccgacttgaggcctttt

SEQ ID NO: 519951 - DNA, 25 bp, Rattus norvegicus
gaggccttttcctggtccatccgcg

SEQ ID NO: 519952 - DNA, 25 bp, Rattus norvegicus
gacccgtgcgtccagtctcttagta

SEQ ID NO: 519953 - DNA, 25 bp, Rattus norvegicus
agtctcttagtaaccatcctccagc

SEQ ID NO: 519954 - DNA, 25 bp, Rattus norvegicus
ggcgggttacccacgacacagctgc

SEQ ID NO: 519955 - DNA, 25 bp, Rattus norvegicus
gctctaggtcccacgtgtgttgatt

SEQ ID NO: 519956 - DNA, 25 bp, Rattus norvegicus
ttgcggaggcacattctgagcagga

SEQ ID NO: 519957 - DNA, 25 bp, Rattus norvegicus
ttctttgcgggttgcggaggcacat

SEQ ID NO: 519958 - DNA, 25 bp, Rattus norvegicus
aagcagatccggtaggttctttgcg

SEQ ID NO: 519959 - DNA, 25 bp, Rattus norvegicus
ggtgaaaccggaagcagatccggta

SEQ ID NO: 519960 - DNA, 25 bp, Rattus norvegicus
tttgcagaaacgctgctgcgggcgc

SEQ ID NO: 519961 - DNA, 25 bp, Rattus norvegicus
acaagtgctctaggtcccacgtgtg

SEQ ID NO: 519962 - DNA, 25 bp, Rattus norvegicus
tctcgcaggacaagtgctctaggtc

SEQ ID NO: 519963 - DNA, 25 bp, Rattus norvegicus
agcgtctcgcaggacaagtgctcta

SEQ ID NO: 519964 - DNA, 25 bp, Rattus norvegicus
tagccagcgacagcgtctcgcagga

SEQ ID NO: 519965 - DNA, 25 bp, Rattus norvegicus
gagaggaatagccagcgacagcgtc

SEQ ID NO: 519966 - DNA, 25 bp, Rattus norvegicus
agcacgcgtgcgtcgcggagcacgc

SEQ ID NO: 519967 - DNA, 25 bp, Rattus norvegicus
cccacgtgtgttgattgagctttaa

SEQ ID NO: 519968 - DNA, 25 bp, Rattus norvegicus
tgagctttaatttgcagaaacgctg

SEQ ID NO: 519969 - DNA, 25 bp, Rattus norvegicus
cccaatgaggtacagcagcaacagg

SEQ ID NO: 519970 - DNA, 25 bp, Rattus norvegicus
cccgtgtcactatcagcaaaggctg

SEQ ID NO: 519971 - DNA, 25 bp, Rattus norvegicus
ttcctcagctgccactttccgggag

SEQ ID NO: 519972 - DNA, 25 bp, Rattus norvegicus
atcgccgcctgggacatcacacgag

SEQ ID NO: 519973 - DNA, 25 bp, Rattus norvegicus
agcgatacacttcacctccgaggcg

SEQ ID NO: 519974 - DNA, 25 bp, Rattus norvegicus
cgggcagccagtcagacaacggaac

SEQ ID NO: 519975 - DNA, 25 bp, Rattus norvegicus
aagtgaaacgtcagaggttcgcgcc

SEQ ID NO: 519976 - DNA, 25 bp, Rattus norvegicus
ggaatgtccaccaatcacgaggttc

SEQ ID NO: 519977 - DNA, 25 bp, Rattus norvegicus
tcacgaggttccttcccgattccga

SEQ ID NO: 519978 - DNA, 25 bp, Rattus norvegicus
cgattccgaccaattgcttgagaga

SEQ ID NO: 519979 - DNA, 25 bp, Rattus norvegicus
cttgagagagatccttacgtggtta

SEQ ID NO: 519980 - DNA, 25 bp, Rattus norvegicus
ttaccagtctggaaactacgccatg

SEQ ID NO: 519981 - DNA, 25 bp, Rattus norvegicus
tacgccatgtgcacacgtgacgcgc

SEQ ID NO: 519982 - DNA, 25 bp, Rattus norvegicus
cgctgctgtaggaaaccggaatgtc

SEQ ID NO: 519983 - DNA, 25 bp, Rattus norvegicus
gccgtcttctatggcgctttgtgaa

SEQ ID NO: 519984 - DNA, 25 bp, Rattus norvegicus
ggaactgaaggcgttgcttggtttc

SEQ ID NO: 519985 - DNA, 25 bp, Rattus norvegicus
cattcggagtggacacagcggtcgc

SEQ ID NO: 519986 - DNA, 25 bp, Rattus norvegicus
ctccgttccgctccttccggctgct

SEQ ID NO: 519987 - DNA, 25 bp, Rattus norvegicus
tgtgtcgcgctggtccggctgcctc

SEQ ID NO: 519988 - DNA, 25 bp, Rattus norvegicus
ctgttacggcaacggcgcggtttgt

SEQ ID NO: 519989 - DNA, 25 bp, Rattus norvegicus
tgaaggcgttgcttggtttcacacg

SEQ ID NO: 519990 - DNA, 25 bp, Rattus norvegicus
accaaagaatcgtatgcactgttac

SEQ ID NO: 519991 - DNA, 25 bp, Rattus norvegicus
tttcacggaaccaaagaatcgtatg

SEQ ID NO: 519992 - DNA, 25 bp, Rattus norvegicus
ttctatggcgctttgtgaatggacc

SEQ ID NO: 519993 - DNA, 25 bp, Rattus norvegicus
gcctgcgccgtcttctatggcgctt

SEQ ID NO: 519994 - DNA, 25 bp, Rattus norvegicus
cacacgtgacgccactgcgcctgcg

SEQ ID NO: 519995 - DNA, 25 bp, Rattus norvegicus
ggcgctttgtgaatggaccggaaca

SEQ ID NO: 519996 - DNA, 25 bp, Rattus norvegicus
tatgcactgttacggcaacggcgcg

SEQ ID NO: 519997 - DNA, 25 bp, Rattus norvegicus
gcctcggagaagctcttatccttcg

SEQ ID NO: 519998 - DNA, 25 bp, Rattus norvegicus
ctggattattggtgaagcctacgga

SEQ ID NO: 519999 - DNA, 25 bp, Rattus norvegicus
ggaggacgctagttcgcactaactg

SEQ ID NO: 520000 - DNA, 25 bp, Rattus norvegicus
gcagccgatgtgtgtccttcatcta

SEQ ID NO: 520001 - DNA, 25 bp, Rattus norvegicus
ccttcatctacacggggacgcagtg

SEQ ID NO: 520002 - DNA, 25 bp, Rattus norvegicus
accctctgccgtacctggattattg

SEQ ID NO: 520003 - DNA, 25 bp, Rattus norvegicus
accgaccaggttcacgcaggtttca

SEQ ID NO: 520004 - DNA, 25 bp, Rattus norvegicus
gcaggtttcaacctcacagcaattg

SEQ ID NO: 520005 - DNA, 25 bp, Rattus norvegicus
cacagcaattgttaagggcggcgaa

SEQ ID NO: 520006 - DNA, 25 bp, Rattus norvegicus
agctccaccttttcattggctacag

SEQ ID NO: 520007 - DNA, 25 bp, Rattus norvegicus
ttggctacagccctctcgcgatata

SEQ ID NO: 520008 - DNA, 25 bp, Rattus norvegicus
tcgcgatataacctgcggaaggggc

SEQ ID NO: 520009 - DNA, 25 bp, Rattus norvegicus
ccggaactactgacttctgagccta

SEQ ID NO: 520010 - DNA, 25 bp, Rattus norvegicus
tggcaagatcggctacagaaccctc

SEQ ID NO: 520011 - DNA, 25 bp, Rattus norvegicus
ggcgggtcaactccagacgctctag

SEQ ID NO: 520012 - DNA, 25 bp, Rattus norvegicus
taagccaggcctacggcccaggtga

SEQ ID NO: 520013 - DNA, 25 bp, Rattus norvegicus
tcgggcgcagctaagccaggcctac

SEQ ID NO: 520014 - DNA, 25 bp, Rattus norvegicus
aaacaagagcgaagacaggttaggc

SEQ ID NO: 520015 - DNA, 25 bp, Rattus norvegicus
cgctgacaagcgatggggaagaaac

SEQ ID NO: 520016 - DNA, 25 bp, Rattus norvegicus
ccacgagcgccgctgacaagcgatg

SEQ ID NO: 520017 - DNA, 25 bp, Rattus norvegicus
cagtgggtctgtgagacaccgaacc

SEQ ID NO: 520018 - DNA, 25 bp, Rattus norvegicus
gccctgtcccagtgcgcgggtctgt

SEQ ID NO: 520019 - DNA, 25 bp, Rattus norvegicus
gggctcacaccatatgtgccctgtc

SEQ ID NO: 520020 - DNA, 25 bp, Rattus norvegicus
cagctcaggaacttcgaagttgttc

SEQ ID NO: 520021 - DNA, 25 bp, Rattus norvegicus
gaagcgccgctctcgatgagccgcg

SEQ ID NO: 520022 - DNA, 25 bp, Rattus norvegicus
gagttcccacctggccggcgggtca

SEQ ID NO: 520023 - DNA, 25 bp, Rattus norvegicus
aacttcgaagttgttcggggctgcg

SEQ ID NO: 520024 - DNA, 25 bp, Rattus norvegicus
cgcttgcgtactgagggctcacacc

SEQ ID NO: 520025 - DNA, 25 bp, Rattus norvegicus
gcgcggcccacaacgttctgcggaa

SEQ ID NO: 520026 - DNA, 25 bp, Rattus norvegicus
cgctgctgcgcgctccgactgatgt

SEQ ID NO: 520027 - DNA, 25 bp, Rattus norvegicus
tccgactgatgtgcggcgccaccta

SEQ ID NO: 520028 - DNA, 25 bp, Rattus norvegicus
gccaggacgcacacaggctggcata

SEQ ID NO: 520029 - DNA, 25 bp, Rattus norvegicus
acaggctggcatatgctcgttgggc

SEQ ID NO: 520030 - DNA, 25 bp, Rattus norvegicus
ttctgcggaacgcagggtcgcttgc

SEQ ID NO: 520031 - DNA, 25 bp, Rattus norvegicus
taatcgtgctgcagcgacgcgcagc

SEQ ID NO: 520032 - DNA, 25 bp, Rattus norvegicus
ctggctaatcgtgctgcagcgacgc

SEQ ID NO: 520033 - DNA, 25 bp, Rattus norvegicus
ctcctgcccgggctggctggctaat

SEQ ID NO: 520034 - DNA, 25 bp, Rattus norvegicus
gccgcatcaccacgctgcctcctgc

SEQ ID NO: 520035 - DNA, 25 bp, Rattus norvegicus
tcaatgccctcgcagcggcagagga

SEQ ID NO: 520036 - DNA, 25 bp, Rattus norvegicus
ctcgcggcagcaccgcggactcacg

SEQ ID NO: 520037 - DNA, 25 bp, Rattus norvegicus
gtcacgcgttacataacccggcggc

SEQ ID NO: 520038 - DNA, 25 bp, Rattus norvegicus
ggaacgggaggtcacgcgttacata

SEQ ID NO: 520039 - DNA, 25 bp, Rattus norvegicus
ggtcactgaggagcgcagctccttg

SEQ ID NO: 520040 - DNA, 25 bp, Rattus norvegicus
cttgcctgctgacctgcgggtaggc

SEQ ID NO: 520041 - DNA, 25 bp, Rattus norvegicus
tggtgggcttcttgcctgctgacct

SEQ ID NO: 520042 - DNA, 25 bp, Rattus norvegicus
tctcggtgcgcctggtgggcttctt

SEQ ID NO: 520043 - DNA, 25 bp, Rattus norvegicus
cggctgaggtcctctcggtgcgcct

SEQ ID NO: 520044 - DNA, 25 bp, Rattus norvegicus
cctctggtcggtggcagttggcact

SEQ ID NO: 520045 - DNA, 25 bp, Rattus norvegicus
gtctggggccactggctcctctggt

SEQ ID NO: 520046 - DNA, 25 bp, Rattus norvegicus
ggctctaggggtcccactacgctcg

SEQ ID NO: 520047 - DNA, 25 bp, Rattus norvegicus
ctgctgttaccacagggcctggttt

SEQ ID NO: 520048 - DNA, 25 bp, Rattus norvegicus
actctccgtgggtgcgctgggcacc

SEQ ID NO: 520049 - DNA, 25 bp, Rattus norvegicus
ttctcacaggtcactgaggagcgca

SEQ ID NO: 520050 - DNA, 25 bp, Rattus norvegicus
cagctccttgcggtggcctgtcctg

SEQ ID NO: 520051 - DNA, 25 bp, Rattus norvegicus
ggtggcctgtcctgctgttaccaca

SEQ ID NO: 520052 - DNA, 25 bp, Rattus norvegicus
gtgcgacgcttctcacaggtcactg

SEQ ID NO: 520053 - DNA, 25 bp, Rattus norvegicus
cgccggcgttctgcctgaacctttt

SEQ ID NO: 520054 - DNA, 25 bp, Rattus norvegicus
tcagccaagtgaccgtgggagcgtt

SEQ ID NO: 520055 - DNA, 25 bp, Rattus norvegicus
cgtggtcaccctcgaggctgactca

SEQ ID NO: 520056 - DNA, 25 bp, Rattus norvegicus
ggaacgcggtttctgccctcttcgc

SEQ ID NO: 520057 - DNA, 25 bp, Rattus norvegicus
gccttcagccacgagcgtcagcgga

SEQ ID NO: 520058 - DNA, 25 bp, Rattus norvegicus
agctgcaagcacaggccgcgctctg

SEQ ID NO: 520059 - DNA, 25 bp, Rattus norvegicus
gcttgtagagcagccgcccacagcg

SEQ ID NO: 520060 - DNA, 25 bp, Rattus norvegicus
tggacagcgtcaccggcttgtagag

SEQ ID NO: 520061 - DNA, 25 bp, Rattus norvegicus
ttgcacaccgtgagcccgctggaca

SEQ ID NO: 520062 - DNA, 25 bp, Rattus norvegicus
tctacgcagcgcttgcacaccgtga

SEQ ID NO: 520063 - DNA, 25 bp, Rattus norvegicus
atatccagggcctgctggcacctga

SEQ ID NO: 520064 - DNA, 25 bp, Rattus norvegicus
gaggctgactcacccatatccaggg

SEQ ID NO: 520065 - DNA, 25 bp, Rattus norvegicus
cccagtggctcacgtcagccaagtg

SEQ ID NO: 520066 - DNA, 25 bp, Rattus norvegicus
cggccagcagcgagcgaaagagctc

SEQ ID NO: 520067 - DNA, 25 bp, Rattus norvegicus
aatctgattatccaacttgcgggtc

SEQ ID NO: 520068 - DNA, 25 bp, Rattus norvegicus
ggcactgcacgcctgtgcgtcatca

SEQ ID NO: 520069 - DNA, 25 bp, Rattus norvegicus
tggactccgcaatgcaggcactgca

SEQ ID NO: 520070 - DNA, 25 bp, Rattus norvegicus
gtcggcatgcgctcgtctctgtcca

SEQ ID NO: 520071 - DNA, 25 bp, Rattus norvegicus
tgtgcgtcatcacggcacgtcggca

SEQ ID NO: 520072 - DNA, 25 bp, Rattus norvegicus
gaggcggcctcacccaggattttat

SEQ ID NO: 520073 - DNA, 25 bp, Rattus norvegicus
cttgcgggtctttcagtcgaggaca

SEQ ID NO: 520074 - DNA, 25 bp, Rattus norvegicus
cagtggcactattagattcaggacc

SEQ ID NO: 520075 - DNA, 25 bp, Rattus norvegicus
attcaggaccgtaggatcccgtctg

SEQ ID NO: 520076 - DNA, 25 bp, Rattus norvegicus
aggatcccgtctgccgacatgaacg

SEQ ID NO: 520077 - DNA, 25 bp, Rattus norvegicus
tgccgacatgaacggacttgacagt

SEQ ID NO: 520078 - DNA, 25 bp, Rattus norvegicus
acttgacagtctgcagacagcactg

SEQ ID NO: 520079 - DNA, 25 bp, Rattus norvegicus
gcagacagcactggactccgcaatg

SEQ ID NO: 520080 - DNA, 25 bp, Rattus norvegicus
cccaggattttattgctgacgaatc

SEQ ID NO: 520081 - DNA, 25 bp, Rattus norvegicus
acataccggggtagctcgccaagaa

SEQ ID NO: 520082 - DNA, 25 bp, Rattus norvegicus
cgtccacgttgcaggaagcccggag

SEQ ID NO: 520083 - DNA, 25 bp, Rattus norvegicus
aggaaactgggtacgtgcgagctcc

SEQ ID NO: 520084 - DNA, 25 bp, Rattus norvegicus
cagccactccggaaggaggaaactg

SEQ ID NO: 520085 - DNA, 25 bp, Rattus norvegicus
ctgggtgcctgagtgcagccactcc

SEQ ID NO: 520086 - DNA, 25 bp, Rattus norvegicus
ggggaccgcacctcattgagaccct

SEQ ID NO: 520087 - DNA, 25 bp, Rattus norvegicus
gagatgaaggctcttcccaggaatc

SEQ ID NO: 520088 - DNA, 25 bp, Rattus norvegicus
acgccgcctcgttgcataattaaga

SEQ ID NO: 520089 - DNA, 25 bp, Rattus norvegicus
ttcatcactgcatccggcacaagga

SEQ ID NO: 520090 - DNA, 25 bp, Rattus norvegicus
ggttcaagtgtcaccgattccattc

SEQ ID NO: 520091 - DNA, 25 bp, Rattus norvegicus
ccgtagacgatggatggttcaagtg

SEQ ID NO: 520092 - DNA, 25 bp, Rattus norvegicus
cccaagcgggaaagtgttctcctct

SEQ ID NO: 520093 - DNA, 25 bp, Rattus norvegicus
attaacaaacgcaagtctccagccc

SEQ ID NO: 520094 - DNA, 25 bp, Rattus norvegicus
gaatctccatccagcgacgtcttta

SEQ ID NO: 520095 - DNA, 25 bp, Rattus norvegicus
tgcccacgtgcaccaggagacctgg

SEQ ID NO: 520096 - DNA, 25 bp, Rattus norvegicus
ggggacagatctatggaacgccaga

SEQ ID NO: 520097 - DNA, 25 bp, Rattus norvegicus
ggcaccggagctgctaggcaaaccc

SEQ ID NO: 520098 - DNA, 25 bp, Rattus norvegicus
aagcgacagcttctcgtggcaccgg

SEQ ID NO: 520099 - DNA, 25 bp, Rattus norvegicus
atcctggtgggcaagcgacagcttc

SEQ ID NO: 520100 - DNA, 25 bp, Rattus norvegicus
tcgccgctgctggtcgcctaaggta

SEQ ID NO: 520101 - DNA, 25 bp, Rattus norvegicus
gacgcagcacgctgtctccgggaac

SEQ ID NO: 520102 - DNA, 25 bp, Rattus norvegicus
gcttcgctggagaggtctactagaa

SEQ ID NO: 520103 - DNA, 25 bp, Rattus norvegicus
gtatccgctgctgtagtgggtaccc

SEQ ID NO: 520104 - DNA, 25 bp, Rattus norvegicus
agacctgggctagattctgggtaga

SEQ ID NO: 520105 - DNA, 25 bp, Rattus norvegicus
agcagatgggagttgccactgccca

SEQ ID NO: 520106 - DNA, 25 bp, Rattus norvegicus
acgccagattctgggccaacttttt

SEQ ID NO: 520107 - DNA, 25 bp, Rattus norvegicus
tagaggtgtgcgactcttgagagca

SEQ ID NO: 520108 - DNA, 25 bp, Rattus norvegicus
tacaggtgggtcagtatccgctgct

SEQ ID NO: 520109 - DNA, 25 bp, Rattus norvegicus
ggggagtcgcagaacctacgcgtac

SEQ ID NO: 520110 - DNA, 25 bp, Rattus norvegicus
gctcctgctagggtgcgtcctgtcc

SEQ ID NO: 520111 - DNA, 25 bp, Rattus norvegicus
gagctgggtctacccggattaatta

SEQ ID NO: 520112 - DNA, 25 bp, Rattus norvegicus
acttctggaagcaagatgcaggtga

SEQ ID NO: 520113 - DNA, 25 bp, Rattus norvegicus
ttcctgaagaccaggcgcagactcc

SEQ ID NO: 520114 - DNA, 25 bp, Rattus norvegicus
ggctggtcggaacttctggaagcaa

SEQ ID NO: 520115 - DNA, 25 bp, Rattus norvegicus
ttaattaccgaactcggaggactgc

SEQ ID NO: 520116 - DNA, 25 bp, Rattus norvegicus
tctttctccttggttcggcccagct

SEQ ID NO: 520117 - DNA, 25 bp, Rattus norvegicus
ctgtcactcaaaggcgctcagcctt

SEQ ID NO: 520118 - DNA, 25 bp, Rattus norvegicus
gggtcacggcctgtcactcaaaggc

SEQ ID NO: 520119 - DNA, 25 bp, Rattus norvegicus
ccggcttggccggagtgacgtcacc

SEQ ID NO: 520120 - DNA, 25 bp, Rattus norvegicus
cagccgctttccctaacatggtagc

SEQ ID NO: 520121 - DNA, 25 bp, Rattus norvegicus
agaacctacgcgtacctcgagccaa

SEQ ID NO: 520122 - DNA, 25 bp, Rattus norvegicus
gctcagcctttgcacgggttcctga

SEQ ID NO: 520123 - DNA, 25 bp, Rattus norvegicus
cgggatcatccccagtcggcggctg

SEQ ID NO: 520124 - DNA, 25 bp, Rattus norvegicus
ggctgcagagcttccaagctccgac

SEQ ID NO: 520125 - DNA, 25 bp, Rattus norvegicus
gacccacttcctttcttattctgag

SEQ ID NO: 520126 - DNA, 25 bp, Rattus norvegicus
ctttcttattctgagggcttcctcg

SEQ ID NO: 520127 - DNA, 25 bp, Rattus norvegicus
tattctgagggcttcctcggctctg

SEQ ID NO: 520128 - DNA, 25 bp, Rattus norvegicus
ttcctcggctctgctggaacccgaa

SEQ ID NO: 520129 - DNA, 25 bp, Rattus norvegicus
gtgggacaatgaatttatagcggcg

SEQ ID NO: 520130 - DNA, 25 bp, Rattus norvegicus
tcggctctgctggaacccgaaggcg

SEQ ID NO: 520131 - DNA, 25 bp, Rattus norvegicus
tgtttaaaatcaaaagctaggaggc

SEQ ID NO: 520132 - DNA, 25 bp, Rattus norvegicus
cgaggaggtgggacaatgaatttat

SEQ ID NO: 520133 - DNA, 25 bp, Rattus norvegicus
ctggtcccttccgttgccgcgttct

SEQ ID NO: 520134 - DNA, 25 bp, Rattus norvegicus
ctcaggcgctgtgaagatgcgagga

SEQ ID NO: 520135 - DNA, 25 bp, Rattus norvegicus
ggccggctgcagagcttccaagctc

SEQ ID NO: 520136 - DNA, 25 bp, Rattus norvegicus
aatcaaaagctaggaggcggcctgc

SEQ ID NO: 520137 - DNA, 25 bp, Rattus norvegicus
tctggtcacctgctcgctagcactg

SEQ ID NO: 520138 - DNA, 25 bp, Rattus norvegicus
ctctgcgcgcccaagagtttgcggc

SEQ ID NO: 520139 - DNA, 25 bp, Rattus norvegicus
cggcaagctctgagtgcacggctca

SEQ ID NO: 520140 - DNA, 25 bp, Rattus norvegicus
ttttcccaggtctgcgctaagcaca

SEQ ID NO: 520141 - DNA, 25 bp, Rattus norvegicus
cacggctcacactgggtttggaccc

SEQ ID NO: 520142 - DNA, 25 bp, Rattus norvegicus
gcccagtccggaccatattggccgg

SEQ ID NO: 520143 - DNA, 25 bp, Rattus norvegicus
gggcacgggattctttgctacccgc

SEQ ID NO: 520144 - DNA, 25 bp, Rattus norvegicus
caagcagcctcgtaggactcgcaga

SEQ ID NO: 520145 - DNA, 25 bp, Rattus norvegicus
cgagacagccacgttctagcaaaca

SEQ ID NO: 520146 - DNA, 25 bp, Rattus norvegicus
cccactcagtgacagcacagttgca

SEQ ID NO: 520147 - DNA, 25 bp, Rattus norvegicus
ttgcagtgggcacttcgatggttcc

SEQ ID NO: 520148 - DNA, 25 bp, Rattus norvegicus
atggttccattaagccggggcacgg

SEQ ID NO: 520149 - DNA, 25 bp, Rattus norvegicus
tataggcctgcccttagaggtcggc

SEQ ID NO: 520150 - DNA, 25 bp, Rattus norvegicus
ccagccgccagtgacaactttagcg

SEQ ID NO: 520151 - DNA, 25 bp, Rattus norvegicus
cctgcgtttagatggctcccgcaaa

SEQ ID NO: 520152 - DNA, 25 bp, Rattus norvegicus
cgtatttacgtcacagcctaacttc

SEQ ID NO: 520153 - DNA, 25 bp, Rattus norvegicus
catccatggagtgtgagtaccgggc

SEQ ID NO: 520154 - DNA, 25 bp, Rattus norvegicus
caaacgcatccatggagtgtgagta

SEQ ID NO: 520155 - DNA, 25 bp, Rattus norvegicus
tgacccggaagttgtacggctacgc

SEQ ID NO: 520156 - DNA, 25 bp, Rattus norvegicus
acctccctatccctgcgtttagatg

SEQ ID NO: 520157 - DNA, 25 bp, Rattus norvegicus
cgtggctctgaaatccggctccatc

SEQ ID NO: 520158 - DNA, 25 bp, Rattus norvegicus
ggcaagctcggtgtgatttctctgc

SEQ ID NO: 520159 - DNA, 25 bp, Rattus norvegicus
cgacgcgcaccgtatttacgtcaca

SEQ ID NO: 520160 - DNA, 25 bp, Rattus norvegicus
cggactttcccactgcctgcttaaa

SEQ ID NO: 520161 - DNA, 25 bp, Rattus norvegicus
tgccgaggtcaccttagcccggact

SEQ ID NO: 520162 - DNA, 25 bp, Rattus norvegicus
gaacagcctgccgaggtcaccttag

SEQ ID NO: 520163 - DNA, 25 bp, Rattus norvegicus
tcggtgtgatttctctgcggtccgg

SEQ ID NO: 520164 - DNA, 25 bp, Rattus norvegicus
gttgtacggctacgcgactttccat

SEQ ID NO: 520165 - DNA, 25 bp, Rattus norvegicus
gtagcagctgctcttctgggtcacc

SEQ ID NO: 520166 - DNA, 25 bp, Rattus norvegicus
cccgatctcgctgccttgggacaag

SEQ ID NO: 520167 - DNA, 25 bp, Rattus norvegicus
tgggacaagctctagaaactgcgtc

SEQ ID NO: 520168 - DNA, 25 bp, Rattus norvegicus
aactgcgtctccagcgttcgcgagc

SEQ ID NO: 520169 - DNA, 25 bp, Rattus norvegicus
ggcgccgctgcaagacgaagtagca

SEQ ID NO: 520170 - DNA, 25 bp, Rattus norvegicus
ttcgcgagccaggtcacatcagatg

SEQ ID NO: 520171 - DNA, 25 bp, Rattus norvegicus
tgggtccctgagctccaagcccgag

SEQ ID NO: 520172 - DNA, 25 bp, Rattus norvegicus
cggagctcgcgtgagaaacgcagaa

SEQ ID NO: 520173 - DNA, 25 bp, Rattus norvegicus
acaagccataggcagggccgtcctg

SEQ ID NO: 520174 - DNA, 25 bp, Rattus norvegicus
agtaactgcgcgagtcgtctccacg

SEQ ID NO: 520175 - DNA, 25 bp, Rattus norvegicus
cgagcccacttggaaggaggagaca

SEQ ID NO: 520176 - DNA, 25 bp, Rattus norvegicus
gcttgagccacatcgcggcgagcct

SEQ ID NO: 520177 - DNA, 25 bp, Rattus norvegicus
tctgggtcacccagagcttcagcgc

SEQ ID NO: 520178 - DNA, 25 bp, Rattus norvegicus
cttcagcgcgttcttgagcagcacc

SEQ ID NO: 520179 - DNA, 25 bp, Rattus norvegicus
ctactttagcaaggccgaccacttc

SEQ ID NO: 520180 - DNA, 25 bp, Rattus norvegicus
gcctgctgagcatcatctcggagga

SEQ ID NO: 520181 - DNA, 25 bp, Rattus norvegicus
acggcgctctaccttctctgggaga

SEQ ID NO: 520182 - DNA, 25 bp, Rattus norvegicus
ccgaaggagctctcgagcctgctga

SEQ ID NO: 520183 - DNA, 25 bp, Rattus norvegicus
ccggcttctctcagcggatccaaga

SEQ ID NO: 520184 - DNA, 25 bp, Rattus norvegicus
acgcgctgttttgtttgcgacgctg

SEQ ID NO: 520185 - DNA, 25 bp, Rattus norvegicus
ggcagcaccttcgagggcctgtcca

SEQ ID NO: 520186 - DNA, 25 bp, Rattus norvegicus
cgctcgccttacttacgcgctgttt

SEQ ID NO: 520187 - DNA, 25 bp, Rattus norvegicus
atgctgctgcagcaaccggacctgc

SEQ ID NO: 520188 - DNA, 25 bp, Rattus norvegicus
tctctgggagatgtaccgcaccgag

SEQ ID NO: 520189 - DNA, 25 bp, Rattus norvegicus
aggtacgacccgcagcctgctgttc

SEQ ID NO: 520190 - DNA, 25 bp, Rattus norvegicus
gagctcgtcggctgggaacatattc

SEQ ID NO: 520191 - DNA, 25 bp, Rattus norvegicus
ttgcgctgtttctccgttccgctcg

SEQ ID NO: 520192 - DNA, 25 bp, Rattus norvegicus
acgctgtcgcagaagggtgcgcttt

SEQ ID NO: 520193 - DNA, 25 bp, Rattus norvegicus
gcgggtccacgtactcgatgctcac

SEQ ID NO: 520194 - DNA, 25 bp, Rattus norvegicus
taagtgacccgtgatccgcaatccg

SEQ ID NO: 520195 - DNA, 25 bp, Rattus norvegicus
ccgcaatccggagacttacagcact

SEQ ID NO: 520196 - DNA, 25 bp, Rattus norvegicus
tacagcactcggtaggactttcctc

SEQ ID NO: 520197 - DNA, 25 bp, Rattus norvegicus
gactttcctccggtgtgtctgctcc

SEQ ID NO: 520198 - DNA, 25 bp, Rattus norvegicus
tgctttcgcacccacccgaggtgaa

SEQ ID NO: 520199 - DNA, 25 bp, Rattus norvegicus
ccgtagcgctcctggttgtagacca

SEQ ID NO: 520200 - DNA, 25 bp, Rattus norvegicus
gccgccagcaccttgtccttgaagg

SEQ ID NO: 520201 - DNA, 25 bp, Rattus norvegicus
ttggaaaacactcaggtacgcctcg

SEQ ID NO: 520202 - DNA, 25 bp, Rattus norvegicus
gcctcgtcgagaggaagacaccaca

SEQ ID NO: 520203 - DNA, 25 bp, Rattus norvegicus
ctcaaccaactttgggagacggtga

SEQ ID NO: 520204 - DNA, 25 bp, Rattus norvegicus
ctcaccgtggcggagtaccactcga

SEQ ID NO: 520205 - DNA, 25 bp, Rattus norvegicus
acggtgagccgacctttctaagtga

SEQ ID NO: 520206 - DNA, 25 bp, Rattus norvegicus
tccacaccgtcaggttcgactgcgg

SEQ ID NO: 520207 - DNA, 25 bp, Rattus norvegicus
gacaacagggcgctgcagcatagca

SEQ ID NO: 520208 - DNA, 25 bp, Rattus norvegicus
gcccaggacacggagctcacaatca

SEQ ID NO: 520209 - DNA, 25 bp, Rattus norvegicus
cgccggacagcgacatcttcttgaa

SEQ ID NO: 520210 - DNA, 25 bp, Rattus norvegicus
gtgagaacccacgtctgctgcaaga

SEQ ID NO: 520211 - DNA, 25 bp, Rattus norvegicus
agctctgctgccagatgctgctcga

SEQ ID NO: 520212 - DNA, 25 bp, Rattus norvegicus
acctcgttggtgacagcccaggaca

SEQ ID NO: 520213 - DNA, 25 bp, Rattus norvegicus
ctcccgccggtaggagaacatgcca

SEQ ID NO: 520214 - DNA, 25 bp, Rattus norvegicus
agctcacaatcacgtagccggcggc

SEQ ID NO: 520215 - DNA, 25 bp, Rattus norvegicus
tgcagcatagcaaccaggacaggcg

SEQ ID NO: 520216 - DNA, 25 bp, Rattus norvegicus
cttcttgaaggcgacgcgccctgtg

SEQ ID NO: 520217 - DNA, 25 bp, Rattus norvegicus
cggggaccactagccaagcagctgc

SEQ ID NO: 520218 - DNA, 25 bp, Rattus norvegicus
agcgtgaggcggaacctcttctccc

SEQ ID NO: 520219 - DNA, 25 bp, Rattus norvegicus
gggccaaggtctccttattgcctca

SEQ ID NO: 520220 - DNA, 25 bp, Rattus norvegicus
agctcctcgtctacctcgttggtga

SEQ ID NO: 520221 - DNA, 25 bp, Rattus norvegicus
gaagtgtgaccctccgggacagcta

SEQ ID NO: 520222 - DNA, 25 bp, Rattus norvegicus
aggatgctgggcacacgccctgcac

SEQ ID NO: 520223 - DNA, 25 bp, Rattus norvegicus
tgtttactttagagcggaggcgcgc

SEQ ID NO: 520224 - DNA, 25 bp, Rattus norvegicus
tcccgacgctcaccactggatgata

SEQ ID NO: 520225 - DNA, 25 bp, Rattus norvegicus
tgtcctccgcgggtgtctcctgaac

SEQ ID NO: 520226 - DNA, 25 bp, Rattus norvegicus
gtatgtgtgtgagcccgtgtcctcc

SEQ ID NO: 520227 - DNA, 25 bp, Rattus norvegicus
tccgggactgtatgtgtgtgagccc

SEQ ID NO: 520228 - DNA, 25 bp, Rattus norvegicus
ggcacacgccctgcactcagaggtg

SEQ ID NO: 520229 - DNA, 25 bp, Rattus norvegicus
gacagctaggtggaaaacccgcgcc

SEQ ID NO: 520230 - DNA, 25 bp, Rattus norvegicus
tcctctccgccgtgtttactttaga

SEQ ID NO: 520231 - DNA, 25 bp, Rattus norvegicus
ggtccgaacaggctggattgctccc

SEQ ID NO: 520232 - DNA, 25 bp, Rattus norvegicus
aaacccgcgccggatgcggatccgg

SEQ ID NO: 520233 - DNA, 25 bp, Rattus norvegicus
tctcctgaaccaggggtgctcctct

SEQ ID NO: 520234 - DNA, 25 bp, Rattus norvegicus
cgccctgcactcagaggtgcgggtt

SEQ ID NO: 520235 - DNA, 25 bp, Rattus norvegicus
gcggcatctttgtttcgcggcctcg

SEQ ID NO: 520236 - DNA, 25 bp, Rattus norvegicus
tgaatctttcaacagtaaccacgcc

SEQ ID NO: 520237 - DNA, 25 bp, Rattus norvegicus
tcaagtgatgctcggtgaatctttc

SEQ ID NO: 520238 - DNA, 25 bp, Rattus norvegicus
ctctctccggcaagcagcgcgagtg

SEQ ID NO: 520239 - DNA, 25 bp, Rattus norvegicus
gccgctcgtagtctctcagtcattg

SEQ ID NO: 520240 - DNA, 25 bp, Rattus norvegicus
ctgctgaatattcacgcgggcgggc

SEQ ID NO: 520241 - DNA, 25 bp, Rattus norvegicus
ttgtttcgcggcctcgcgttcgctt

SEQ ID NO: 520242 - DNA, 25 bp, Rattus norvegicus
cccggggaagatggcgaacgactct

SEQ ID NO: 520243 - DNA, 25 bp, Rattus norvegicus
ttcgcccggacgatcaagtgatgct

SEQ ID NO: 520244 - DNA, 25 bp, Rattus norvegicus
ggcgaacgactctccggctaaaagc

SEQ ID NO: 520245 - DNA, 25 bp, Rattus norvegicus
tccggctaaaagcttggtggacatc

SEQ ID NO: 520246 - DNA, 25 bp, Rattus norvegicus
cttggtggacatcgacctgtcgtcc

SEQ ID NO: 520247 - DNA, 25 bp, Rattus norvegicus
acctgtcgtccctgcgggtgagtgc

SEQ ID NO: 520248 - DNA, 25 bp, Rattus norvegicus
tctcagtcattgttagcggaggctg

SEQ ID NO: 520249 - DNA, 25 bp, Rattus norvegicus
tggagtctccgcctgctgcacgccc

SEQ ID NO: 520250 - DNA, 25 bp, Rattus norvegicus
ccggctaggagagggaacagcgtgc

SEQ ID NO: 520251 - DNA, 25 bp, Rattus norvegicus
ccgcccaggcggacagagctggtgc

SEQ ID NO: 520252 - DNA, 25 bp, Rattus norvegicus
accgcggcgccggatagagaagggc

SEQ ID NO: 520253 - DNA, 25 bp, Rattus norvegicus
ttgctcaggcctggacgggtttagc

SEQ ID NO: 520254 - DNA, 25 bp, Rattus norvegicus
cccagggctccggttgctcaggcct

SEQ ID NO: 520255 - DNA, 25 bp, Rattus norvegicus
ctcaggcctggacgggtttagctcc

SEQ ID NO: 520256 - DNA, 25 bp, Rattus norvegicus
gaacagcgtgccgcccaggcggaca

SEQ ID NO: 520257 - DNA, 25 bp, Rattus norvegicus
cgcctgtcccacgaacggcaggaat

SEQ ID NO: 520258 - DNA, 25 bp, Rattus norvegicus
ggaatgtgacccctcgagcgcgcgc

SEQ ID NO: 520259 - DNA, 25 bp, Rattus norvegicus
ctgtcccacgaacggcaggaatgtg

SEQ ID NO: 520260 - DNA, 25 bp, Rattus norvegicus
gccggatagagaagggcgggagccc

SEQ ID NO: 520261 - DNA, 25 bp, Rattus norvegicus
tcccacgaacggcaggaatgtgacc

SEQ ID NO: 520262 - DNA, 25 bp, Rattus norvegicus
cccacgaacggcaggaatgtgaccc

SEQ ID NO: 520263 - DNA, 25 bp, Rattus norvegicus
ctattggtcgtggaccaagaggacc

SEQ ID NO: 520264 - DNA, 25 bp, Rattus norvegicus
gaaaatctggatcgtttgcttcacc

SEQ ID NO: 520265 - DNA, 25 bp, Rattus norvegicus
tttgcttcaccatcaccggcggaga

SEQ ID NO: 520266 - DNA, 25 bp, Rattus norvegicus
cggagactccgtactgacccttgac

SEQ ID NO: 520267 - DNA, 25 bp, Rattus norvegicus
gacccttgacctttccgagtccaga

SEQ ID NO: 520268 - DNA, 25 bp, Rattus norvegicus
agacgccgctgccttagcaacagta

SEQ ID NO: 520269 - DNA, 25 bp, Rattus norvegicus
gctgccttagcaacagtaaccaaag

SEQ ID NO: 520270 - DNA, 25 bp, Rattus norvegicus
accgagcagggattgccgcgcatgt

SEQ ID NO: 520271 - DNA, 25 bp, Rattus norvegicus
gcctcctcgccctattggtcgtgga

SEQ ID NO: 520272 - DNA, 25 bp, Rattus norvegicus
gccctgtcctccctcgggattgtag

SEQ ID NO: 520273 - DNA, 25 bp, Rattus norvegicus
agtgtgctcacgtgtacccggcgct

SEQ ID NO: 520274 - DNA, 25 bp, Rattus norvegicus
gggcttcaccctagcgaaaatctgg

SEQ ID NO: 520275 - DNA, 25 bp, Rattus norvegicus
cgggattgtagtgtgcttgaccacc

SEQ ID NO: 520276 - DNA, 25 bp, Rattus norvegicus
agatgctacccaagcagcaccgcgg

SEQ ID NO: 520277 - DNA, 25 bp, Rattus norvegicus
ctgaccggactgtctcgggtgtccc

SEQ ID NO: 520278 - DNA, 25 bp, Rattus norvegicus
tccgggctcaccagccgactgagat

SEQ ID NO: 520279 - DNA, 25 bp, Rattus norvegicus
cgcgaccctagggacaaacgccttg

SEQ ID NO: 520280 - DNA, 25 bp, Rattus norvegicus
gggacaaacgccttgggctctccgc

SEQ ID NO: 520281 - DNA, 25 bp, Rattus norvegicus
gcctgtctctcttcgccttttctga

SEQ ID NO: 520282 - DNA, 25 bp, Rattus norvegicus
cttttctgagcccaggtccacaaca

SEQ ID NO: 520283 - DNA, 25 bp, Rattus norvegicus
accagtccgactctcgagggtctcg

SEQ ID NO: 520284 - DNA, 25 bp, Rattus norvegicus
cactcaccggggaaggggcgcttca

SEQ ID NO: 520285 - DNA, 25 bp, Rattus norvegicus
ttaagttgcctacgaagttggcgcc

SEQ ID NO: 520286 - DNA, 25 bp, Rattus norvegicus
tctaacgcccgagctgaccggactg

SEQ ID NO: 520287 - DNA, 25 bp, Rattus norvegicus
tgtctcgggtgtcccgcgtctgtct

SEQ ID NO: 520288 - DNA, 25 bp, Rattus norvegicus
gcgtctgtctccaccgtccttgccc

SEQ ID NO: 520289 - DNA, 25 bp, Rattus norvegicus
tgagatggagctcgccacctccggt

SEQ ID NO: 520290 - DNA, 25 bp, Rattus norvegicus
tcaccagccgactgagatggagctc

SEQ ID NO: 520291 - DNA, 25 bp, Rattus norvegicus
tgaggtaagaccgcggccgcgaacc

SEQ ID NO: 520292 - DNA, 25 bp, Rattus norvegicus
caagtgttgcatggtgaggtaagac

SEQ ID NO: 520293 - DNA, 25 bp, Rattus norvegicus
cgcgcaaccaagtgttgcatggtga

SEQ ID NO: 520294 - DNA, 25 bp, Rattus norvegicus
ccggcaagcgcgcaaccaagtgttg

SEQ ID NO: 520295 - DNA, 25 bp, Rattus norvegicus
aataagcggctaggagggagctccc

SEQ ID NO: 520296 - DNA, 25 bp, Rattus norvegicus
aaccctggtggctgcctgacgtctc

SEQ ID NO: 520297 - DNA, 25 bp, Rattus norvegicus
ccagagagggctgcaccgggagaac

SEQ ID NO: 520298 - DNA, 25 bp, Rattus norvegicus
tagcgggtagaggaggtagcctccc

SEQ ID NO: 520299 - DNA, 25 bp, Rattus norvegicus
cagagccgcagtgccgtagcgggta

SEQ ID NO: 520300 - DNA, 25 bp, Rattus norvegicus
gacttgccatgctgctagggacagg

SEQ ID NO: 520301 - DNA, 25 bp, Rattus norvegicus
ctggacttgccatgctgctagggac

SEQ ID NO: 520302 - DNA, 25 bp, Rattus norvegicus
ggcagctggacttgccatgctgcta

SEQ ID NO: 520303 - DNA, 25 bp, Rattus norvegicus
tcccaagtaagggaataagcggcta

SEQ ID NO: 520304 - DNA, 25 bp, Rattus norvegicus
ggcgccaaccctggtggctgcctga

SEQ ID NO: 520305 - DNA, 25 bp, Rattus norvegicus
acaggctgtgttcaatgtgcttttc

SEQ ID NO: 520306 - DNA, 25 bp, Rattus norvegicus
agggtgcccagatccctacactggc

SEQ ID NO: 520307 - DNA, 25 bp, Rattus norvegicus
gcgaggttcacagccacagagcttg

SEQ ID NO: 520308 - DNA, 25 bp, Rattus norvegicus
tcaatgtgcttttctcccgagggga

SEQ ID NO: 520309 - DNA, 25 bp, Rattus norvegicus
tcaggcactgcgcacagaatgcggg

SEQ ID NO: 520310 - DNA, 25 bp, Rattus norvegicus
cccgttgagttaatagcgctgtccc

SEQ ID NO: 520311 - DNA, 25 bp, Rattus norvegicus
tggtactctcgccatcccgttgagt

SEQ ID NO: 520312 - DNA, 25 bp, Rattus norvegicus
cgcgttggtcccagccctgatggac

SEQ ID NO: 520313 - DNA, 25 bp, Rattus norvegicus
agtggcgaaggctcaccagttccgc

SEQ ID NO: 520314 - DNA, 25 bp, Rattus norvegicus
agtaggtctccgcagcatcgggcag

SEQ ID NO: 520315 - DNA, 25 bp, Rattus norvegicus
caagcgactaggtgagtaggtctcc

SEQ ID NO: 520316 - DNA, 25 bp, Rattus norvegicus
ctctttccgaggacccaagcgacta

SEQ ID NO: 520317 - DNA, 25 bp, Rattus norvegicus
ggggagcgaagctcagctcttcttc

SEQ ID NO: 520318 - DNA, 25 bp, Rattus norvegicus
cgcactggctgagaccctgctggac

SEQ ID NO: 520319 - DNA, 25 bp, Rattus norvegicus
tggtttagtgatagctaccgcgggc

SEQ ID NO: 520320 - DNA, 25 bp, Rattus norvegicus
ccaggattgaccacgcccatagcgg

SEQ ID NO: 520321 - DNA, 25 bp, Rattus norvegicus
cactggacgatgctgtggccgtcac

SEQ ID NO: 520322 - DNA, 25 bp, Rattus norvegicus
atgctgtggccgtcaccggggtctc

SEQ ID NO: 520323 - DNA, 25 bp, Rattus norvegicus
caccggggtctctgaagttagatcc

SEQ ID NO: 520324 - DNA, 25 bp, Rattus norvegicus
gggtctctgaagttagatcctgccc

SEQ ID NO: 520325 - DNA, 25 bp, Rattus norvegicus
tgcggacagcctagccgctgcagac

SEQ ID NO: 520326 - DNA, 25 bp, Rattus norvegicus
gcgggagctcacagcactggacgat

SEQ ID NO: 520327 - DNA, 25 bp, Rattus norvegicus
ttgaccacgcccatagcggaagcga

SEQ ID NO: 520328 - DNA, 25 bp, Rattus norvegicus
cccatagcggaagcgatcgtcttgc

SEQ ID NO: 520329 - DNA, 25 bp, Rattus norvegicus
cggaagcgatcgtcttgcgcctgcg

SEQ ID NO: 520330 - DNA, 25 bp, Rattus norvegicus
cgcctgcgcagatggaagttcgcgc

SEQ ID NO: 520331 - DNA, 25 bp, Rattus norvegicus
gccagattactggtttagtgatagc

SEQ ID NO: 520332 - DNA, 25 bp, Rattus norvegicus
agccggctgccagattactggttta

SEQ ID NO: 520333 - DNA, 25 bp, Rattus norvegicus
gccgtccgcattgcataggcctttt

SEQ ID NO: 520334 - DNA, 25 bp, Rattus norvegicus
attccgctgctttcttcgagaggcc

SEQ ID NO: 520335 - DNA, 25 bp, Rattus norvegicus
ggattccgctgctttcttcgagagg

SEQ ID NO: 520336 - DNA, 25 bp, Rattus norvegicus
tcttcgagaggcctaggtgtacctc

SEQ ID NO: 520337 - DNA, 25 bp, Rattus norvegicus
cccattatgcccgtcgccggttgcg

SEQ ID NO: 520338 - DNA, 25 bp, Rattus norvegicus
agaggcctaggtgtacctctcttga

SEQ ID NO: 520339 - DNA, 25 bp, Rattus norvegicus
cgtccgcattgcataggccttttct

SEQ ID NO: 520340 - DNA, 25 bp, Rattus norvegicus
tcgccgtccgcattgcataggcctt

SEQ ID NO: 520341 - DNA, 25 bp, Rattus norvegicus
acctctcttgagctccgccgctcgc

SEQ ID NO: 520342 - DNA, 25 bp, Rattus norvegicus
ggtgtacctctcttgagctccgccg

SEQ ID NO: 520343 - DNA, 25 bp, Rattus norvegicus
taggtgtacctctcttgagctccgc

SEQ ID NO: 520344 - DNA, 25 bp, Rattus norvegicus
cctaggtgtacctctcttgagctcc

SEQ ID NO: 520345 - DNA, 25 bp, Rattus norvegicus
aggcctaggtgtacctctcttgagc

SEQ ID NO: 520346 - DNA, 25 bp, Rattus norvegicus
tgccttagcgcaaccaccgcgggcg

SEQ ID NO: 520347 - DNA, 25 bp, Rattus norvegicus
cgtctgctgccacacattgtcattg

SEQ ID NO: 520348 - DNA, 25 bp, Rattus norvegicus
attgcaggcacatcctctccatttc

SEQ ID NO: 520349 - DNA, 25 bp, Rattus norvegicus
caagtcgcagcctgggagccagcgc

SEQ ID NO: 520350 - DNA, 25 bp, Rattus norvegicus
ttagcgtgggaagaaacgttcgtgc

SEQ ID NO: 520351 - DNA, 25 bp, Rattus norvegicus
ccgcagaaaaggcaagtcgcagcct

SEQ ID NO: 520352 - DNA, 25 bp, Rattus norvegicus
tgcgacacgtctgctgccacacatt

SEQ ID NO: 520353 - DNA, 25 bp, Rattus norvegicus
tgctgccacacattgtcattgattg

SEQ ID NO: 520354 - DNA, 25 bp, Rattus norvegicus
ttgtcattgattgtgggaaagggcc

SEQ ID NO: 520355 - DNA, 25 bp, Rattus norvegicus
ctccaggccgccctaatgagggaac

SEQ ID NO: 520356 - DNA, 25 bp, Rattus norvegicus
gccctaatgagggaacaatcgtccc

SEQ ID NO: 520357 - DNA, 25 bp, Rattus norvegicus
aatcgtcccggcagggagcatgcga

SEQ ID NO: 520358 - DNA, 25 bp, Rattus norvegicus
gcatgcgaccgggtcagtgagccca

SEQ ID NO: 520359 - DNA, 25 bp, Rattus norvegicus
ggtcagtgagcccagcacaatgcac

SEQ ID NO: 520360 - DNA, 25 bp, Rattus norvegicus
tcctcacccgcctctgcgacacgtc

SEQ ID NO: 520361 - DNA, 25 bp, Rattus norvegicus
gctcacgcacactattcccaatggt

SEQ ID NO: 520362 - DNA, 25 bp, Rattus norvegicus
agctgggcacaagcgcgagccctct

SEQ ID NO: 520363 - DNA, 25 bp, Rattus norvegicus
agggacccaacgcagctgggcacaa

SEQ ID NO: 520364 - DNA, 25 bp, Rattus norvegicus
gcagttgagggacccaacgcagctg

SEQ ID NO: 520365 - DNA, 25 bp, Rattus norvegicus
cacgcgggcagttgagggacccaac

SEQ ID NO: 520366 - DNA, 25 bp, Rattus norvegicus
atcgcaccgcctgagttggggctgt

SEQ ID NO: 520367 - DNA, 25 bp, Rattus norvegicus
agtgactgatcgcaccgcctgagtt

SEQ ID NO: 520368 - DNA, 25 bp, Rattus norvegicus
agggcactaagtgactgatcgcacc

SEQ ID NO: 520369 - DNA, 25 bp, Rattus norvegicus
actcgccttggggagggcactaagt

SEQ ID NO: 520370 - DNA, 25 bp, Rattus norvegicus
ttggtagctctttcctgcagccgct

SEQ ID NO: 520371 - DNA, 25 bp, Rattus norvegicus
ggggtgcatttttggtagctctttc

SEQ ID NO: 520372 - DNA, 25 bp, Rattus norvegicus
attcccaatggtgtctctggccaga

SEQ ID NO: 520373 - DNA, 25 bp, Rattus norvegicus
acacgccttagcacacgcacacacg

SEQ ID NO: 520374 - DNA, 25 bp, Rattus norvegicus
cctcaaggaagtagagaggcactgc

SEQ ID NO: 520375 - DNA, 25 bp, Rattus norvegicus
tcagaacgggtgacaaaggcaggca

SEQ ID NO: 520376 - DNA, 25 bp, Rattus norvegicus
tccaaggcagcgctcctatggccgg

SEQ ID NO: 520377 - DNA, 25 bp, Rattus norvegicus
gcgacgggagaacagctcaattacg

SEQ ID NO: 520378 - DNA, 25 bp, Rattus norvegicus
caaggcagcgctcctatggccgggc

SEQ ID NO: 520379 - DNA, 25 bp, Rattus norvegicus
ggaacaaagcccgccgcgggagctc

SEQ ID NO: 520380 - DNA, 25 bp, Rattus norvegicus
ggtgccaagctccaaggcagcgctc

SEQ ID NO: 520381 - DNA, 25 bp, Rattus norvegicus
caggcggtgccaagctccaaggcag

SEQ ID NO: 520382 - DNA, 25 bp, Rattus norvegicus
gcaggcaggcggtgccaagctccaa

SEQ ID NO: 520383 - DNA, 25 bp, Rattus norvegicus
ggagaacagctcaattacgaaggga

SEQ ID NO: 520384 - DNA, 25 bp, Rattus norvegicus
caggtccccctttctgtagcgcgtt

SEQ ID NO: 520385 - DNA, 25 bp, Rattus norvegicus
ggctcaaacgccctgcccaccggag

SEQ ID NO: 520386 - DNA, 25 bp, Rattus norvegicus
gcaaagaaacgaaatcccgggctca

SEQ ID NO: 520387 - DNA, 25 bp, Rattus norvegicus
caattacgaagggagcaaagaaacg

SEQ ID NO: 520388 - DNA, 25 bp, Rattus norvegicus
ggccgcgctcagaacgggtgacaaa

SEQ ID NO: 520389 - DNA, 25 bp, Rattus norvegicus
acggagctcgcccggagaagcgatc

SEQ ID NO: 520390 - DNA, 25 bp, Rattus norvegicus
gctgctgaccgaggccagtcagcga

SEQ ID NO: 520391 - DNA, 25 bp, Rattus norvegicus
cggtaaaaccttcgcttagcaggtg

SEQ ID NO: 520392 - DNA, 25 bp, Rattus norvegicus
cgagcctcgctggagtcagccgatt

SEQ ID NO: 520393 - DNA, 25 bp, Rattus norvegicus
ctcccggagagagcgcccgaagtac

SEQ ID NO: 520394 - DNA, 25 bp, Rattus norvegicus
acccgcccgaggacaggagcagcag

SEQ ID NO: 520395 - DNA, 25 bp, Rattus norvegicus
acagagccctgtgcccgggcagagt

SEQ ID NO: 520396 - DNA, 25 bp, Rattus norvegicus
ttagcaggtggacagagccctgtgc

SEQ ID NO: 520397 - DNA, 25 bp, Rattus norvegicus
ttcgcttagcaggtggacagagccc

SEQ ID NO: 520398 - DNA, 25 bp, Rattus norvegicus
aaccttcgcttagcaggtggacaga

SEQ ID NO: 520399 - DNA, 25 bp, Rattus norvegicus
agtcagccgattgctcccggccagg

SEQ ID NO: 520400 - DNA, 25 bp, Rattus norvegicus
gcttcgtcctttgttgtctccggta

SEQ ID NO: 520401 - DNA, 25 bp, Rattus norvegicus
ctcgctggagtcagccgattgctcc

SEQ ID NO: 520402 - DNA, 25 bp, Rattus norvegicus
tctccggtaaaaccttcgcttagca

SEQ ID NO: 520403 - DNA, 25 bp, Rattus norvegicus
tccatcgaggttagcgtcaaaggcg

SEQ ID NO: 520404 - DNA, 25 bp, Rattus norvegicus
gctggagagccacttcctcaagtgc

SEQ ID NO: 520405 - DNA, 25 bp, Rattus norvegicus
aagtgccctaaaccctcggcgcagg

SEQ ID NO: 520406 - DNA, 25 bp, Rattus norvegicus
ctcggcgcaggagatcaccaacttg

SEQ ID NO: 520407 - DNA, 25 bp, Rattus norvegicus
ggttctgcaaccgacgccaaaagga

SEQ ID NO: 520408 - DNA, 25 bp, Rattus norvegicus
tgcagaccagcgtgcagtgaatgcc

SEQ ID NO: 520409 - DNA, 25 bp, Rattus norvegicus
agacgccggacgatgtctactcgca

SEQ ID NO: 520410 - DNA, 25 bp, Rattus norvegicus
gctctgggcactctgtatggcaatg

SEQ ID NO: 520411 - DNA, 25 bp, Rattus norvegicus
agcggggccaggactcaacagccac

SEQ ID NO: 520412 - DNA, 25 bp, Rattus norvegicus
gagctggcggagcatcatcaccacc

SEQ ID NO: 520413 - DNA, 25 bp, Rattus norvegicus
caagcgcaagaagcggacctccatc

SEQ ID NO: 520414 - DNA, 25 bp, Rattus norvegicus
gagtctgctgtactcgcagcccgga

SEQ ID NO: 520415 - DNA, 25 bp, Rattus norvegicus
gtggagcccaaagcctggttcaccc

SEQ ID NO: 520416 - DNA, 25 bp, Rattus norvegicus
tgacaagatcgcagcacagggccgc

SEQ ID NO: 520417 - DNA, 25 bp, Rattus norvegicus
tatggaaatgactggcgctggccta

SEQ ID NO: 520418 - DNA, 25 bp, Rattus norvegicus
cagggaggcaccgaagaaccgcagc

SEQ ID NO: 520419 - DNA, 25 bp, Rattus norvegicus
ccgcattaaatattcatagcaatcg

SEQ ID NO: 520420 - DNA, 25 bp, Rattus norvegicus
ctgggttgcggctttcttatggaaa

SEQ ID NO: 520421 - DNA, 25 bp, Rattus norvegicus
tagcaatcgctactttcttaaaggg

SEQ ID NO: 520422 - DNA, 25 bp, Rattus norvegicus
aatgactggcgctggcctactgaac

SEQ ID NO: 520423 - DNA, 25 bp, Rattus norvegicus
gcgctggcctactgaactcgatcgg

SEQ ID NO: 520424 - DNA, 25 bp, Rattus norvegicus
ggcctactgaactcgatcgggtccc

SEQ ID NO: 520425 - DNA, 25 bp, Rattus norvegicus
tctccaaagcttttcctcccgcaaa

SEQ ID NO: 520426 - DNA, 25 bp, Rattus norvegicus
tcctcctaacgtagctgaactggtg

SEQ ID NO: 520427 - DNA, 25 bp, Rattus norvegicus
ctaacgtagctgaactggtggggat

SEQ ID NO: 520428 - DNA, 25 bp, Rattus norvegicus
gatgagctagctagcggtgcgcccc

SEQ ID NO: 520429 - DNA, 25 bp, Rattus norvegicus
gctccagctccgcattaaatattca

SEQ ID NO: 520430 - DNA, 25 bp, Rattus norvegicus
aagaaccgcagcctccagctgggtt

SEQ ID NO: 520431 - DNA, 25 bp, Rattus norvegicus
tctccgcccgtcaggatctttctta

SEQ ID NO: 520432 - DNA, 25 bp, Rattus norvegicus
tgggctttcccttcggcttgctcac

SEQ ID NO: 520433 - DNA, 25 bp, Rattus norvegicus
cttgctcacgcggttagggctaacc

SEQ ID NO: 520434 - DNA, 25 bp, Rattus norvegicus
taagttcctgggagctgcagatggc

SEQ ID NO: 520435 - DNA, 25 bp, Rattus norvegicus
gggtgacatgaagccggcccacctt

SEQ ID NO: 520436 - DNA, 25 bp, Rattus norvegicus
ccttccagggctgacagtgccttca

SEQ ID NO: 520437 - DNA, 25 bp, Rattus norvegicus
ccttcaggtagaggtcggaggtcac

SEQ ID NO: 520438 - DNA, 25 bp, Rattus norvegicus
gagccgaactatggaacgacccgga

SEQ ID NO: 520439 - DNA, 25 bp, Rattus norvegicus
gcagaaccggtctgtaaagtgaaca

SEQ ID NO: 520440 - DNA, 25 bp, Rattus norvegicus
gtgaacagagactttacgagtgccc

SEQ ID NO: 520441 - DNA, 25 bp, Rattus norvegicus
ggatctttcttacggccaacatggc

SEQ ID NO: 520442 - DNA, 25 bp, Rattus norvegicus
ctgcgatttctagcttgaacctttg

SEQ ID NO: 520443 - DNA, 25 bp, Rattus norvegicus
cctgaactttcgtgtgacatacgga

SEQ ID NO: 520444 - DNA, 25 bp, Rattus norvegicus
cgcggctgtggaatttaagttttcg

SEQ ID NO: 520445 - DNA, 25 bp, Rattus norvegicus
tcaaagggatttgtgcttccaaggc

SEQ ID NO: 520446 - DNA, 25 bp, Rattus norvegicus
tgcagagctcagagtcaattagccc

SEQ ID NO: 520447 - DNA, 25 bp, Rattus norvegicus
tagcctcttgcttgcagagctcaga

SEQ ID NO: 520448 - DNA, 25 bp, Rattus norvegicus
ccggatttctgactgtagcctcttg

SEQ ID NO: 520449 - DNA, 25 bp, Rattus norvegicus
ttgtgcttccaaggccctctaccgg

SEQ ID NO: 520450 - DNA, 25 bp, Rattus norvegicus
agcggtctaactgctcgcacgtttc

SEQ ID NO: 520451 - DNA, 25 bp, Rattus norvegicus
cgggaaggaagcaagcggtctaact

SEQ ID NO: 520452 - DNA, 25 bp, Rattus norvegicus
cttaaatggaaaacaagcagcccgg

SEQ ID NO: 520453 - DNA, 25 bp, Rattus norvegicus
catcttgcattcaacacttaaatgg

SEQ ID NO: 520454 - DNA, 25 bp, Rattus norvegicus
ttcgcaaacacaccatcttgcattc

SEQ ID NO: 520455 - DNA, 25 bp, Rattus norvegicus
cggttcccagctgcacgggatctaa

SEQ ID NO: 520456 - DNA, 25 bp, Rattus norvegicus
gcacgggatctaattcgcaaacaca

SEQ ID NO: 520457 - DNA, 25 bp, Rattus norvegicus
ctgctcgcacgtttcaaagggattt

SEQ ID NO: 520458 - DNA, 25 bp, Rattus norvegicus
tacggtccgcgaaccggatttctga

SEQ ID NO: 520459 - DNA, 25 bp, Rattus norvegicus
ctccttttcctcagcccatgcctcc

SEQ ID NO: 520460 - DNA, 25 bp, Rattus norvegicus
gctctccttgacctcagtggtgtgg

SEQ ID NO: 520461 - DNA, 25 bp, Rattus norvegicus
catctggagtgtccttgggcttctc

SEQ ID NO: 520462 - DNA, 25 bp, Rattus norvegicus
ctctccttgacctcagtggtgtggg

SEQ ID NO: 520463 - DNA, 25 bp, Rattus norvegicus
cccatctggagtgtccttgggcttc

SEQ ID NO: 520464 - DNA, 25 bp, Rattus norvegicus
tcctgctcaggcactggccggggct

SEQ ID NO: 520465 - DNA, 25 bp, Rattus norvegicus
gccaggccgcctcctgctcaggcac

SEQ ID NO: 520466 - DNA, 25 bp, Rattus norvegicus
agcgtctctgtggaccagggcgcgg

SEQ ID NO: 520467 - DNA, 25 bp, Rattus norvegicus
gccgcgagcgtctctgtggaccagg

SEQ ID NO: 520468 - DNA, 25 bp, Rattus norvegicus
ccatctggagtgtccttgggcttct

SEQ ID NO: 520469 - DNA, 25 bp, Rattus norvegicus
ctccttgacctcagtggtgtgggcg

SEQ ID NO: 520470 - DNA, 25 bp, Rattus norvegicus
acctcagtggtgtgggcggccgtct

SEQ ID NO: 520471 - DNA, 25 bp, Rattus norvegicus
gggcggccgtctggggttctctctc

SEQ ID NO: 520472 - DNA, 25 bp, Rattus norvegicus
tctccttgacctcagtggtgtgggc

SEQ ID NO: 520473 - DNA, 25 bp, Rattus norvegicus
gtgcgttctgcacatcagggtgaca

SEQ ID NO: 520474 - DNA, 25 bp, Rattus norvegicus
accaaccaatcagcgacggtcgtgc

SEQ ID NO: 520475 - DNA, 25 bp, Rattus norvegicus
ctggcaccgggtcattcataaggga

SEQ ID NO: 520476 - DNA, 25 bp, Rattus norvegicus
cagagcactctagcccgggacctgg

SEQ ID NO: 520477 - DNA, 25 bp, Rattus norvegicus
aagtgggcctccagagcactctagc

SEQ ID NO: 520478 - DNA, 25 bp, Rattus norvegicus
tacccggtctgaagtgggcctccag

SEQ ID NO: 520479 - DNA, 25 bp, Rattus norvegicus
gtcagcaaaggaagtacccggtctg

SEQ ID NO: 520480 - DNA, 25 bp, Rattus norvegicus
ccgcgccgccatgaagtcagcaaag

SEQ ID NO: 520481 - DNA, 25 bp, Rattus norvegicus
attagacctcaagagctgccgcagc

SEQ ID NO: 520482 - DNA, 25 bp, Rattus norvegicus
gctgcagctccgtacattagacctc

SEQ ID NO: 520483 - DNA, 25 bp, Rattus norvegicus
ggctcacctccctggtaggtctcga

SEQ ID NO: 520484 - DNA, 25 bp, Rattus norvegicus
acacgcttggatcgccctccaggta

SEQ ID NO: 520485 - DNA, 25 bp, Rattus norvegicus
cacatcagggtgacacgcttggatc

SEQ ID NO: 520486 - DNA, 25 bp, Rattus norvegicus
gaagttgtagtccacgcgttccgcc

SEQ ID NO: 520487 - DNA, 25 bp, Rattus norvegicus
cggacgtaaggcttgggtgcaaatc

SEQ ID NO: 520488 - DNA, 25 bp, Rattus norvegicus
tcacgattgaggagcaagcagcaca

SEQ ID NO: 520489 - DNA, 25 bp, Rattus norvegicus
taccctggtcccttgcggaggtctg

SEQ ID NO: 520490 - DNA, 25 bp, Rattus norvegicus
ctcgcgcccgcggacgtaaggcttg

SEQ ID NO: 520491 - DNA, 25 bp, Rattus norvegicus
ggcttgggtgcaaatcctgtttctc

SEQ ID NO: 520492 - DNA, 25 bp, Rattus norvegicus
gagagtctagcaggttcctagggtt

SEQ ID NO: 520493 - DNA, 25 bp, Rattus norvegicus
tgcaaatcctgtttctctgggcaga

SEQ ID NO: 520494 - DNA, 25 bp, Rattus norvegicus
tgtttctctgggcagaggccacgcg

SEQ ID NO: 520495 - DNA, 25 bp, Rattus norvegicus
tgcgaggacctgcagtcatggaaaa

SEQ ID NO: 520496 - DNA, 25 bp, Rattus norvegicus
agcaagcagcacacaggcgcactca

SEQ ID NO: 520497 - DNA, 25 bp, Rattus norvegicus
ccggccgctcaacgcagcgtaagtg

SEQ ID NO: 520498 - DNA, 25 bp, Rattus norvegicus
aggcggagagtctagcaggttccta

SEQ ID NO: 520499 - DNA, 25 bp, Rattus norvegicus
ccaggcaattgaggcggagagtcta

SEQ ID NO: 520500 - DNA, 25 bp, Rattus norvegicus
tggagacgatcacgattgaggagca

SEQ ID NO: 520501 - DNA, 25 bp, Rattus norvegicus
agccgcctaggcttcgctccgtacc

SEQ ID NO: 520502 - DNA, 25 bp, Rattus norvegicus
cgtgctcgtctacgaatttgttctc

SEQ ID NO: 520503 - DNA, 25 bp, Rattus norvegicus
cgtctacgaatttgttctcgtcaaa

SEQ ID NO: 520504 - DNA, 25 bp, Rattus norvegicus
tttgttctcgtcaaattcgtcgata

SEQ ID NO: 520505 - DNA, 25 bp, Rattus norvegicus
gtcaaattcgtcgatatccactcgg

SEQ ID NO: 520506 - DNA, 25 bp, Rattus norvegicus
aattcgtcgatatccactcggcgga

SEQ ID NO: 520507 - DNA, 25 bp, Rattus norvegicus
tcgtcgatatccactcggcggaagc

SEQ ID NO: 520508 - DNA, 25 bp, Rattus norvegicus
tcgatatccactcggcggaagcgtg

SEQ ID NO: 520509 - DNA, 25 bp, Rattus norvegicus
gtgaggacagtgtgttccgggccat

SEQ ID NO: 520510 - DNA, 25 bp, Rattus norvegicus
gctccgtaccggctccctccgcacc

SEQ ID NO: 520511 - DNA, 25 bp, Rattus norvegicus
gcctcttcgtgctcgtctacgaatt

SEQ ID NO: 520512 - DNA, 25 bp, Rattus norvegicus
agcccgtctacctcgcaggggtcgg

SEQ ID NO: 520513 - DNA, 25 bp, Rattus norvegicus
gcaggagcccgtctacctcgcaggg

SEQ ID NO: 520514 - DNA, 25 bp, Rattus norvegicus
tccactcggcggaagcgtgaggaca

SEQ ID NO: 520515 - DNA, 25 bp, Rattus norvegicus
acgatcctttccgatcccgatcttt

SEQ ID NO: 520516 - DNA, 25 bp, Rattus norvegicus
gatcctttccgatcccgatctttct

SEQ ID NO: 520517 - DNA, 25 bp, Rattus norvegicus
cccagaaacgcaagttcaaggacga

SEQ ID NO: 520518 - DNA, 25 bp, Rattus norvegicus
aacgcaagttcaaggacgaggtctc

SEQ ID NO: 520519 - DNA, 25 bp, Rattus norvegicus
caagttcaaggacgaggtctctcgg

SEQ ID NO: 520520 - DNA, 25 bp, Rattus norvegicus
cgaggtctctcggagtctccgcttc

SEQ ID NO: 520521 - DNA, 25 bp, Rattus norvegicus
gtctctcggagtctccgcttcctta

SEQ ID NO: 520522 - DNA, 25 bp, Rattus norvegicus
gagtctccgcttccttaccctgaca

SEQ ID NO: 520523 - DNA, 25 bp, Rattus norvegicus
cccagatcacagtgtacacagtgac

SEQ ID NO: 520524 - DNA, 25 bp, Rattus norvegicus
tgtacacagtgaccccgcacggtga

SEQ ID NO: 520525 - DNA, 25 bp, Rattus norvegicus
cagcagcacacctggcccagtcatg

SEQ ID NO: 520526 - DNA, 25 bp, Rattus norvegicus
gcccagtcatgcaggcactcgcctg

SEQ ID NO: 520527 - DNA, 25 bp, Rattus norvegicus
gcgtccgtcagagccggtcgcgcac

SEQ ID NO: 520528 - DNA, 25 bp, Rattus norvegicus
ccgtttctcacgggcgtagcgcagc

SEQ ID NO: 520529 - DNA, 25 bp, Rattus norvegicus
gcgctcagacccgaccgtggacgga

SEQ ID NO: 520530 - DNA, 25 bp, Rattus norvegicus
agctgctgtcccaggaattcctcct

SEQ ID NO: 520531 - DNA, 25 bp, Rattus norvegicus
tgcaccctgagctgctgtcccagga

SEQ ID NO: 520532 - DNA, 25 bp, Rattus norvegicus
tctcctggcgacaaccatggcgggg

SEQ ID NO: 520533 - DNA, 25 bp, Rattus norvegicus
gccaggggtctcctggcgacaacca

SEQ ID NO: 520534 - DNA, 25 bp, Rattus norvegicus
ctttcgccgcagtgccttgtgggta

SEQ ID NO: 520535 - DNA, 25 bp, Rattus norvegicus
ctccggcgcgctgggtgacaccaga

SEQ ID NO: 520536 - DNA, 25 bp, Rattus norvegicus
aaaaggcatagcgtctccggcgcgc

SEQ ID NO: 520537 - DNA, 25 bp, Rattus norvegicus
ccctctgtaaaaggcatagcgtctc

SEQ ID NO: 520538 - DNA, 25 bp, Rattus norvegicus
agccacgaactctaccctctgtaaa

SEQ ID NO: 520539 - DNA, 25 bp, Rattus norvegicus
aggtgcaacagccaggacgcccagc

SEQ ID NO: 520540 - DNA, 25 bp, Rattus norvegicus
ctcttggccgaggtgcaacagccag

SEQ ID NO: 520541 - DNA, 25 bp, Rattus norvegicus
tcgcgttgcttagcctcccgtgctt

SEQ ID NO: 520542 - DNA, 25 bp, Rattus norvegicus
accaatggcggccagctcgcgttgc

SEQ ID NO: 520543 - DNA, 25 bp, Rattus norvegicus
cgtcctagagcagctgtctggtggg

SEQ ID NO: 520544 - DNA, 25 bp, Rattus norvegicus
ttcgggaccctaccctgatgcggtc

SEQ ID NO: 520545 - DNA, 25 bp, Rattus norvegicus
accctgatgcggtctgcacagctct

SEQ ID NO: 520546 - DNA, 25 bp, Rattus norvegicus
ggtgtctctccacgcgtcctagagc

SEQ ID NO: 520547 - DNA, 25 bp, Rattus norvegicus
tctggtggggatcctcgtgttccaa

SEQ ID NO: 520548 - DNA, 25 bp, Rattus norvegicus
gatcctcgtgttccaagcagggctg

SEQ ID NO: 520549 - DNA, 25 bp, Rattus norvegicus
cgtgttccaagcagggctgtggcct

SEQ ID NO: 520550 - DNA, 25 bp, Rattus norvegicus
cctgggcggcgccaggagtactcac

SEQ ID NO: 520551 - DNA, 25 bp, Rattus norvegicus
ctcacacacggtgaggccggggtct

SEQ ID NO: 520552 - DNA, 25 bp, Rattus norvegicus
gaacccagcggactgtggaccggtg

SEQ ID NO: 520553 - DNA, 25 bp, Rattus norvegicus
cccgccgagtcatttgaccatataa

SEQ ID NO: 520554 - DNA, 25 bp, Rattus norvegicus
cgagtcatttgaccatataaggaca

SEQ ID NO: 520555 - DNA, 25 bp, Rattus norvegicus
cgccaggagtactcacacacggtga

SEQ ID NO: 520556 - DNA, 25 bp, Rattus norvegicus
tggccactggtgtctctccacgcgt

SEQ ID NO: 520557 - DNA, 25 bp, Rattus norvegicus
cgggaacacaagcaaccctggcctg

SEQ ID NO: 520558 - DNA, 25 bp, Rattus norvegicus
acttactgtacttcgtgatccggca

SEQ ID NO: 520559 - DNA, 25 bp, Rattus norvegicus
cgtgatccggcacaaagctgctgtc

SEQ ID NO: 520560 - DNA, 25 bp, Rattus norvegicus
tccgcgggcagacaacggggaccaa

SEQ ID NO: 520561 - DNA, 25 bp, Rattus norvegicus
agctgctgtcacgttctctaaagga

SEQ ID NO: 520562 - DNA, 25 bp, Rattus norvegicus
ttacggcttgaagcccgcaggcggc

SEQ ID NO: 520563 - DNA, 25 bp, Rattus norvegicus
ctaaaggaggtctttgcctcggctc

SEQ ID NO: 520564 - DNA, 25 bp, Rattus norvegicus
tcagggcgcttttgtgcctggttcc

SEQ ID NO: 520565 - DNA, 25 bp, Rattus norvegicus
gcgctttccctaggcctggccggga

SEQ ID NO: 520566 - DNA, 25 bp, Rattus norvegicus
tgggaccgaaccttggtcgagtcgc

SEQ ID NO: 520567 - DNA, 25 bp, Rattus norvegicus
tgcctgggaagaatagcctaggatc

SEQ ID NO: 520568 - DNA, 25 bp, Rattus norvegicus
atggccggggagaacttactgtact

SEQ ID NO: 520569 - DNA, 25 bp, Rattus norvegicus
gatccgagggctacagcgctaggaa

SEQ ID NO: 520570 - DNA, 25 bp, Rattus norvegicus
ccgggtccaattgcgtccgcttggt

SEQ ID NO: 520571 - DNA, 25 bp, Rattus norvegicus
ctttaacgggcagatcggctggttc

SEQ ID NO: 520572 - DNA, 25 bp, Rattus norvegicus
ctgcgctaagcaatgggcaaggtgc

SEQ ID NO: 520573 - DNA, 25 bp, Rattus norvegicus
cttcctgagcctgcgtcggggcact

SEQ ID NO: 520574 - DNA, 25 bp, Rattus norvegicus
tgatgcggaatacccagccaatggc

SEQ ID NO: 520575 - DNA, 25 bp, Rattus norvegicus
cttcgtcaagttcgcctacgtagca

SEQ ID NO: 520576 - DNA, 25 bp, Rattus norvegicus
ccagccaatggcagcggtgctgacc

SEQ ID NO: 520577 - DNA, 25 bp, Rattus norvegicus
gcgtggcagctttaacgggcagatc

SEQ ID NO: 520578 - DNA, 25 bp, Rattus norvegicus
caacgccaagcactgatgcggaata

SEQ ID NO: 520579 - DNA, 25 bp, Rattus norvegicus
aagccaagtgctcgggatgcgtccc

SEQ ID NO: 520580 - DNA, 25 bp, Rattus norvegicus
ggtgctgaccgcatctatgacctca

SEQ ID NO: 520581 - DNA, 25 bp, Rattus norvegicus
ttcgcctacgtagcagaacgagagg

SEQ ID NO: 520582 - DNA, 25 bp, Rattus norvegicus
agaacgagaggatgagctgtccctg

SEQ ID NO: 520583 - DNA, 25 bp, Rattus norvegicus
cccgggtcacagttatggagaaatg

SEQ ID NO: 520584 - DNA, 25 bp, Rattus norvegicus
ttatggagaaatgcagtgatggctg

SEQ ID NO: 520585 - DNA, 25 bp, Rattus norvegicus
tccgcccggttatagctgcgccatt

SEQ ID NO: 520586 - DNA, 25 bp, Rattus norvegicus
gtctgtctgtcccatagactcacag

SEQ ID NO: 520587 - DNA, 25 bp, Rattus norvegicus
tttgtcctatcagtcagtcagtcgg

SEQ ID NO: 520588 - DNA, 25 bp, Rattus norvegicus
cgcgcatctctattcggactttgtc

SEQ ID NO: 520589 - DNA, 25 bp, Rattus norvegicus
ctaccgcaaaagtgggtgtggccgt

SEQ ID NO: 520590 - DNA, 25 bp, Rattus norvegicus
gaggagccggccgtttccctagcaa

SEQ ID NO: 520591 - DNA, 25 bp, Rattus norvegicus
ctccaaacaagcatgcgcaggcgtc

SEQ ID NO: 520592 - DNA, 25 bp, Rattus norvegicus
ttcaagggcgaactccaaacaagca

SEQ ID NO: 520593 - DNA, 25 bp, Rattus norvegicus
ggtgctttggttccgacaccgccgc

SEQ ID NO: 520594 - DNA, 25 bp, Rattus norvegicus
gggccgcgttccaaaatggccgcga

SEQ ID NO: 520595 - DNA, 25 bp, Rattus norvegicus
cgtgggaccgcgcacattgaataac

SEQ ID NO: 520596 - DNA, 25 bp, Rattus norvegicus
tttccctagcaacgggatgctgctg

SEQ ID NO: 520597 - DNA, 25 bp, Rattus norvegicus
aatggccgcgacacgccactcaggt

SEQ ID NO: 520598 - DNA, 25 bp, Rattus norvegicus
ggctgatatcatcaagccgatttcc

SEQ ID NO: 520599 - DNA, 25 bp, Rattus norvegicus
ctgcctcgcaaaaggggtagtgatt

SEQ ID NO: 520600 - DNA, 25 bp, Rattus norvegicus
cggcccagctggatttgcctgaaga

SEQ ID NO: 520601 - DNA, 25 bp, Rattus norvegicus
ctgaatgtgggtgactttatgaatg

SEQ ID NO: 520602 - DNA, 25 bp, Rattus norvegicus
cttgggatgactcccggagctagcc

SEQ ID NO: 520603 - DNA, 25 bp, Rattus norvegicus
gaggctcgcgagaaaaaacgctccg

SEQ ID NO: 520604 - DNA, 25 bp, Rattus norvegicus
aaacgctccgcgactcttatgtggg

SEQ ID NO: 520605 - DNA, 25 bp, Rattus norvegicus
ccgagagttaaatgacaccgacatg

SEQ ID NO: 520606 - DNA, 25 bp, Rattus norvegicus
tgcttgaacttctgcaggcctggca

SEQ ID NO: 520607 - DNA, 25 bp, Rattus norvegicus
actcccttctctgagggcttgaggg

SEQ ID NO: 520608 - DNA, 25 bp, Rattus norvegicus
ctcgtgcatgattcggggtctgcct

SEQ ID NO: 520609 - DNA, 25 bp, Rattus norvegicus
aattagaggcggctggtatcgccca

SEQ ID NO: 520610 - DNA, 25 bp, Rattus norvegicus
agcgctgcacctcgttttctgaatg

SEQ ID NO: 520611 - DNA, 25 bp, Rattus norvegicus
ctgaagacagggtaaacaagaggtg

SEQ ID NO: 520612 - DNA, 25 bp, Rattus norvegicus
cccagagtgatgctggagcctcgtg

SEQ ID NO: 520613 - DNA, 25 bp, Rattus norvegicus
tggctagacatatctgaccgcatgc

SEQ ID NO: 520614 - DNA, 25 bp, Rattus norvegicus
ggtccgcagtgggttaagccaacaa

SEQ ID NO: 520615 - DNA, 25 bp, Rattus norvegicus
cgagagcctccaccgctcgagtaga

SEQ ID NO: 520616 - DNA, 25 bp, Rattus norvegicus
cctgtgccgctacccggagtatgac

SEQ ID NO: 520617 - DNA, 25 bp, Rattus norvegicus
gcgctgcctggcagtttacctcttc

SEQ ID NO: 520618 - DNA, 25 bp, Rattus norvegicus
tgcggcgccgttagcttacgttgaa

SEQ ID NO: 520619 - DNA, 25 bp, Rattus norvegicus
attcctgtgtcttgcctcgttgcgg

SEQ ID NO: 520620 - DNA, 25 bp, Rattus norvegicus
agcctgggtaacaaacattcctgtg

SEQ ID NO: 520621 - DNA, 25 bp, Rattus norvegicus
ttgtcattggcaccagcgcaaactc

SEQ ID NO: 520622 - DNA, 25 bp, Rattus norvegicus
acctccctccagtgcgttgtcattg

SEQ ID NO: 520623 - DNA, 25 bp, Rattus norvegicus
agctccgaatgcaagtcccggtttc

SEQ ID NO: 520624 - DNA, 25 bp, Rattus norvegicus
tattcctctcgcgacgtctcttgga

SEQ ID NO: 520625 - DNA, 25 bp, Rattus norvegicus
caacaaccgtggcttcatgaggatc

SEQ ID NO: 520626 - DNA, 25 bp, Rattus norvegicus
cgaggagcctttccctttccatggt

SEQ ID NO: 520627 - DNA, 25 bp, Rattus norvegicus
ctcgtctggaaggaggcttcgctct

SEQ ID NO: 520628 - DNA, 25 bp, Rattus norvegicus
cgttcatgtccacttccggtccgga

SEQ ID NO: 520629 - DNA, 25 bp, Rattus norvegicus
agcgcgggaaagacgttcatgtcca

SEQ ID NO: 520630 - DNA, 25 bp, Rattus norvegicus
tgtacgcttgtacagccgagcgcgg

SEQ ID NO: 520631 - DNA, 25 bp, Rattus norvegicus
tgtaatcctggtgctagagtctgta

SEQ ID NO: 520632 - DNA, 25 bp, Rattus norvegicus
gagagttttccgctggttttagctc

SEQ ID NO: 520633 - DNA, 25 bp, Rattus norvegicus
ctcactctcttcagggagctaacta

SEQ ID NO: 520634 - DNA, 25 bp, Rattus norvegicus
cgcttaccagcgaacgcacgagtga

SEQ ID NO: 520635 - DNA, 25 bp, Rattus norvegicus
agagcttccacagacgcctcaggcg

SEQ ID NO: 520636 - DNA, 25 bp, Rattus norvegicus
atcggctgctccacgtccgcagaga

SEQ ID NO: 520637 - DNA, 25 bp, Rattus norvegicus
cctcagcccggacagttcaacgaga

SEQ ID NO: 520638 - DNA, 25 bp, Rattus norvegicus
tcactcaacgaacgcgcgtgtcctg

SEQ ID NO: 520639 - DNA, 25 bp, Rattus norvegicus
ccaattctagtaatgccgggatcca

SEQ ID NO: 520640 - DNA, 25 bp, Rattus norvegicus
ccggcaaaacagaccatcggctgct

SEQ ID NO: 520641 - DNA, 25 bp, Rattus norvegicus
cgagacaggctcacgctaagcgctc

SEQ ID NO: 520642 - DNA, 25 bp, Rattus norvegicus
caggcagatggtggccccggaccat

SEQ ID NO: 520643 - DNA, 25 bp, Rattus norvegicus
agcgatccagcgaaggcaggcagat

SEQ ID NO: 520644 - DNA, 25 bp, Rattus norvegicus
cagctgcagcgatccagcgaaggca

SEQ ID NO: 520645 - DNA, 25 bp, Rattus norvegicus
aggctcacgctaagcgctccagctg

SEQ ID NO: 520646 - DNA, 25 bp, Rattus norvegicus
agctactcacctgggcaaggcggca

SEQ ID NO: 520647 - DNA, 25 bp, Rattus norvegicus
gcccgagacaggctcacgctaagcg

SEQ ID NO: 520648 - DNA, 25 bp, Rattus norvegicus
ctggcccgagacaggctcacgctaa

SEQ ID NO: 520649 - DNA, 25 bp, Rattus norvegicus
acgcatcgttcctggcccgagacag

SEQ ID NO: 520650 - DNA, 25 bp, Rattus norvegicus
cgcccgggctccttggctcggccac

SEQ ID NO: 520651 - DNA, 25 bp, Rattus norvegicus
tgggcaaggcggcacctacccgcgg

SEQ ID NO: 520652 - DNA, 25 bp, Rattus norvegicus
gcagcagcgacagctactcacctgg

SEQ ID NO: 520653 - DNA, 25 bp, Rattus norvegicus
gcgacagctactcacctgggcaagg

SEQ ID NO: 520654 - DNA, 25 bp, Rattus norvegicus
gctccagctgcagcgatccagcgaa

SEQ ID NO: 520655 - DNA, 25 bp, Rattus norvegicus
aaaggccctgcgaatccggctaaga

SEQ ID NO: 520656 - DNA, 25 bp, Rattus norvegicus
gacaggaggcagacttggctttacc

SEQ ID NO: 520657 - DNA, 25 bp, Rattus norvegicus
ttcccgtgttgcgtctcagtacttt

SEQ ID NO: 520658 - DNA, 25 bp, Rattus norvegicus
ctcagtactttttaggcgtgccaac

SEQ ID NO: 520659 - DNA, 25 bp, Rattus norvegicus
ccaacttttgggctgaagcgtttca

SEQ ID NO: 520660 - DNA, 25 bp, Rattus norvegicus
cgccgccatatttaaattccgccgt

SEQ ID NO: 520661 - DNA, 25 bp, Rattus norvegicus
ttcttccgggagaccaggtccgctc

SEQ ID NO: 520662 - DNA, 25 bp, Rattus norvegicus
gcgcggtgtttctctttcaagcctc

SEQ ID NO: 520663 - DNA, 25 bp, Rattus norvegicus
ttcaagcctctgagacccgggatcc

SEQ ID NO: 520664 - DNA, 25 bp, Rattus norvegicus
ccgggatcctagctggagagctgtt

SEQ ID NO: 520665 - DNA, 25 bp, Rattus norvegicus
gagagctgttccctctacgagtaga

SEQ ID NO: 520666 - DNA, 25 bp, Rattus norvegicus
tcctaaagtgaaacaaaggccctgc

SEQ ID NO: 520667 - DNA, 25 bp, Rattus norvegicus
aatccggctaagagcgcctgcgcca

SEQ ID NO: 520668 - DNA, 25 bp, Rattus norvegicus
gcttgatcccggagcgtcctttatc

SEQ ID NO: 520669 - DNA, 25 bp, Rattus norvegicus
ccttgctactgcgtctgtgtgcctt

SEQ ID NO: 520670 - DNA, 25 bp, Rattus norvegicus
ctctgtatcgaatagctgtagcggc

SEQ ID NO: 520671 - DNA, 25 bp, Rattus norvegicus
tgtagcggcatctggtatgaattta

SEQ ID NO: 520672 - DNA, 25 bp, Rattus norvegicus
gaatttaatttcgtgcgtggctgca

SEQ ID NO: 520673 - DNA, 25 bp, Rattus norvegicus
cgtggctgcatagcttcactctttc

SEQ ID NO: 520674 - DNA, 25 bp, Rattus norvegicus
gagctgtgttctctgtggattccaa

SEQ ID NO: 520675 - DNA, 25 bp, Rattus norvegicus
ggccgaagagagaacgctctgtatc

SEQ ID NO: 520676 - DNA, 25 bp, Rattus norvegicus
tgacttagaggctggattccacggc

SEQ ID NO: 520677 - DNA, 25 bp, Rattus norvegicus
ggttggaaaatggtccctcgctata

SEQ ID NO: 520678 - DNA, 25 bp, Rattus norvegicus
cgctataccgttccgctcttgcaga

SEQ ID NO: 520679 - DNA, 25 bp, Rattus norvegicus
cgaatgttcgtgctcttcgtatgga

SEQ ID NO: 520680 - DNA, 25 bp, Rattus norvegicus
tgggcggagactcaagcctagtcta

SEQ ID NO: 520681 - DNA, 25 bp, Rattus norvegicus
ttcgtaatccgaccagtgctccgtg

SEQ ID NO: 520682 - DNA, 25 bp, Rattus norvegicus
tggattccaagtatgcagtaggcta

SEQ ID NO: 520683 - DNA, 25 bp, Rattus norvegicus
gcccgcacagtaggaaggggattgt

SEQ ID NO: 520684 - DNA, 25 bp, Rattus norvegicus
cgcgaacaaccagcgatccggctga

SEQ ID NO: 520685 - DNA, 25 bp, Rattus norvegicus
aggaggcgcgaacaaccagcgatcc

SEQ ID NO: 520686 - DNA, 25 bp, Rattus norvegicus
cccaggaggcgcgaacaaccagcga

SEQ ID NO: 520687 - DNA, 25 bp, Rattus norvegicus
ttatagggagccgtgggcggagctc

SEQ ID NO: 520688 - DNA, 25 bp, Rattus norvegicus
cagcgatccggctgagctaccgcag

SEQ ID NO: 520689 - DNA, 25 bp, Rattus norvegicus
ccggctgagctaccgcaggagaaac

SEQ ID NO: 520690 - DNA, 25 bp, Rattus norvegicus
ctgagctaccgcaggagaaacccga

SEQ ID NO: 520691 - DNA, 25 bp, Rattus norvegicus
taggaaggggattgtgtgcggaccc

SEQ ID NO: 520692 - DNA, 25 bp, Rattus norvegicus
ctaccgcaggagaaacccgagaagt

SEQ ID NO: 520693 - DNA, 25 bp, Rattus norvegicus
ccgcaggagaaacccgagaagtggc

SEQ ID NO: 520694 - DNA, 25 bp, Rattus norvegicus
agaaacccgagaagtggcccgcaca

SEQ ID NO: 520695 - DNA, 25 bp, Rattus norvegicus
aacaaccagcgatccggctgagcta

SEQ ID NO: 520696 - DNA, 25 bp, Rattus norvegicus
aacccgagaagtggcccgcacagta

SEQ ID NO: 520697 - DNA, 25 bp, Rattus norvegicus
gcactccattggtcgaggttccgga

SEQ ID NO: 520698 - DNA, 25 bp, Rattus norvegicus
ctccattggtcgaggttccggaagg

SEQ ID NO: 520699 - DNA, 25 bp, Rattus norvegicus
gggtcctgaaaggaacactggcttc

SEQ ID NO: 520700 - DNA, 25 bp, Rattus norvegicus
gaacactggcttccggttgggcctg

SEQ ID NO: 520701 - DNA, 25 bp, Rattus norvegicus
tgctgtttcatccaccgcggttcct

SEQ ID NO: 520702 - DNA, 25 bp, Rattus norvegicus
cgatgcctagcggtgcggagcaccc

SEQ ID NO: 520703 - DNA, 25 bp, Rattus norvegicus
gcgccgggacccacccgcacatcga

SEQ ID NO: 520704 - DNA, 25 bp, Rattus norvegicus
cacgccgaggcccttagcagtaagg

SEQ ID NO: 520705 - DNA, 25 bp, Rattus norvegicus
ccttagcagtaaggtgccgtgggac

SEQ ID NO: 520706 - DNA, 25 bp, Rattus norvegicus
ccgcggtcgcatcggtgcccagtag

SEQ ID NO: 520707 - DNA, 25 bp, Rattus norvegicus
atcggtgcccagtagcctcaccggt

SEQ ID NO: 520708 - DNA, 25 bp, Rattus norvegicus
tagcctcaccggtccattctcagca

SEQ ID NO: 520709 - DNA, 25 bp, Rattus norvegicus
attctcagcaccggccgctggtttc

SEQ ID NO: 520710 - DNA, 25 bp, Rattus norvegicus
gtaaatatgcgcactccattggtcg

SEQ ID NO: 520711 - DNA, 25 bp, Rattus norvegicus
tggcaggttacaggacaaatcccgc

SEQ ID NO: 520712 - DNA, 25 bp, Rattus norvegicus
gctccagggagccttcgagcttacc

SEQ ID NO: 520713 - DNA, 25 bp, Rattus norvegicus
caaatcccgcggcagctatagtagg

SEQ ID NO: 520714 - DNA, 25 bp, Rattus norvegicus
tcccggagccaggtgtaaatgtgca

SEQ ID NO: 520715 - DNA, 25 bp, Rattus norvegicus
ctctcacgagctagaaggtagtgta

SEQ ID NO: 520716 - DNA, 25 bp, Rattus norvegicus
gggtggtgaatctcataacctctca

SEQ ID NO: 520717 - DNA, 25 bp, Rattus norvegicus
ctccgggtctactgagtgcctgcag

SEQ ID NO: 520718 - DNA, 25 bp, Rattus norvegicus
acatcccgccaagtagggcctgctg

SEQ ID NO: 520719 - DNA, 25 bp, Rattus norvegicus
gcgctccaggagaaggacatcccgc

SEQ ID NO: 520720 - DNA, 25 bp, Rattus norvegicus
tagccgattggctaccagtctcgcc

SEQ ID NO: 520721 - DNA, 25 bp, Rattus norvegicus
aactgctcttgcgagtagccgattg

SEQ ID NO: 520722 - DNA, 25 bp, Rattus norvegicus
ttccggaaggctgccaaactgctct

SEQ ID NO: 520723 - DNA, 25 bp, Rattus norvegicus
agctatagtaggtgcccacgccaga

SEQ ID NO: 520724 - DNA, 25 bp, Rattus norvegicus
ccctgaagcagaggaagctcgctct

SEQ ID NO: 520725 - DNA, 25 bp, Rattus norvegicus
ggccaggcgacaggagatcacctgc

SEQ ID NO: 520726 - DNA, 25 bp, Rattus norvegicus
cctgctcccacgtggacggagatca

SEQ ID NO: 520727 - DNA, 25 bp, Rattus norvegicus
gaggcggccagctcacttagctttc

SEQ ID NO: 520728 - DNA, 25 bp, Rattus norvegicus
ccagcccttcaggtctcattggttg

SEQ ID NO: 520729 - DNA, 25 bp, Rattus norvegicus
tgatgtctcagtccaggtggctttg

SEQ ID NO: 520730 - DNA, 25 bp, Rattus norvegicus
tctcattggttgtggatgggatcga

SEQ ID NO: 520731 - DNA, 25 bp, Rattus norvegicus
tagcttttggcggtgccaacacgga

SEQ ID NO: 520732 - DNA, 25 bp, Rattus norvegicus
ccaacacggagggttgtgctccgta

SEQ ID NO: 520733 - DNA, 25 bp, Rattus norvegicus
ggccacgccgcaccttttcagattt

SEQ ID NO: 520734 - DNA, 25 bp, Rattus norvegicus
caccttttcagattttcggctcccg

SEQ ID NO: 520735 - DNA, 25 bp, Rattus norvegicus
tcggggaatgagaacagccaaacgc

SEQ ID NO: 520736 - DNA, 25 bp, Rattus norvegicus
caaggccgcgcagacttgcgatggc

SEQ ID NO: 520737 - DNA, 25 bp, Rattus norvegicus
aatgcgagctgtggcccagcccttc

SEQ ID NO: 520738 - DNA, 25 bp, Rattus norvegicus
tcctacttggtggtctagatcttgc

SEQ ID NO: 520739 - DNA, 25 bp, Rattus norvegicus
actggagccgccacacaaactgctg

SEQ ID NO: 520740 - DNA, 25 bp, Rattus norvegicus
gctgccaaacaagggcggctagatc

SEQ ID NO: 520741 - DNA, 25 bp, Rattus norvegicus
gctagatctgcgaggcctgagatga

SEQ ID NO: 520742 - DNA, 25 bp, Rattus norvegicus
cctgagatgacagtcgcgagccttt

SEQ ID NO: 520743 - DNA, 25 bp, Rattus norvegicus
cgcgagccttttcccaaggagagcc

SEQ ID NO: 520744 - DNA, 25 bp, Rattus norvegicus
gcttaccaactcacctcgactggag

SEQ ID NO: 520745 - DNA, 25 bp, Rattus norvegicus
cccatggcctaaaaccctagagatg

SEQ ID NO: 520746 - DNA, 25 bp, Rattus norvegicus
tagcagaacgtagcaactccacctg

SEQ ID NO: 520747 - DNA, 25 bp, Rattus norvegicus
caccgccgaccagaacctagaagag

SEQ ID NO: 520748 - DNA, 25 bp, Rattus norvegicus
cctagaagagccagggtcactgaca

SEQ ID NO: 520749 - DNA, 25 bp, Rattus norvegicus
ggtcactgacaattcctccggaggg

SEQ ID NO: 520750 - DNA, 25 bp, Rattus norvegicus
tgcacttccgctgcgctccagaggg

SEQ ID NO: 520751 - DNA, 25 bp, Rattus norvegicus
cggcggccagtgaattcagcagaag

SEQ ID NO: 520752 - DNA, 25 bp, Rattus norvegicus
cctagagatgaattagcagaacgta

SEQ ID NO: 520753 - DNA, 25 bp, Rattus norvegicus
ctcagggaggcaaggtagacgtcac

SEQ ID NO: 520754 - DNA, 25 bp, Rattus norvegicus
tagacgtcacgtccggcttgggaag

SEQ ID NO: 520755 - DNA, 25 bp, Rattus norvegicus
ccaagttaaagagcgtggcgtcaca

SEQ ID NO: 520756 - DNA, 25 bp, Rattus norvegicus
ccaaggaggctggtgaattcggtta

SEQ ID NO: 520757 - DNA, 25 bp, Rattus norvegicus
gcgtcacatccggtagcgttagacc

SEQ ID NO: 520758 - DNA, 25 bp, Rattus norvegicus
tgggatacgtgcctcgtacccgcca

SEQ ID NO: 520759 - DNA, 25 bp, Rattus norvegicus
ggcgagctgccagaggcacaaaatg

SEQ ID NO: 520760 - DNA, 25 bp, Rattus norvegicus
ttgggaagcgcctctgcaggagaaa

SEQ ID NO: 520761 - DNA, 25 bp, Rattus norvegicus
aggccacgtgtgacccggagcccaa

SEQ ID NO: 520762 - DNA, 25 bp, Rattus norvegicus
gagattaaaaatggccgcggcgtcc

SEQ ID NO: 520763 - DNA, 25 bp, Rattus norvegicus
gcctctcccgggctccagggtgaag

SEQ ID NO: 520764 - DNA, 25 bp, Rattus norvegicus
gatgggaacggtatcttatttcgcc

SEQ ID NO: 520765 - DNA, 25 bp, Rattus norvegicus
tttcgccgttgctctcctgcgaagc

SEQ ID NO: 520766 - DNA, 25 bp, Rattus norvegicus
cccggctgtagggagcctgacgtca

SEQ ID NO: 520767 - DNA, 25 bp, Rattus norvegicus
cctgcgaggtatagggtagccctag

SEQ ID NO: 520768 - DNA, 25 bp, Rattus norvegicus
caggtgagtcagtctccggccgaag

SEQ ID NO: 520769 - DNA, 25 bp, Rattus norvegicus
caaaggaagattgcgccgggtccca

SEQ ID NO: 520770 - DNA, 25 bp, Rattus norvegicus
gtgcgaccacctccaggcgttggca

SEQ ID NO: 520771 - DNA, 25 bp, Rattus norvegicus
tccgcttcttccgtttctctgggaa

SEQ ID NO: 520772 - DNA, 25 bp, Rattus norvegicus
tttctctgggaaaggctgtagcctc

SEQ ID NO: 520773 - DNA, 25 bp, Rattus norvegicus
aaggctgtagcctccttcggggctc

SEQ ID NO: 520774 - DNA, 25 bp, Rattus norvegicus
gtaatccgctttcctgctttcgcca

SEQ ID NO: 520775 - DNA, 25 bp, Rattus norvegicus
tccatcgccactgcggagggcaggt

SEQ ID NO: 520776 - DNA, 25 bp, Rattus norvegicus
cagaagccgccggaagaaagcgatc

SEQ ID NO: 520777 - DNA, 25 bp, Rattus norvegicus
ctcgtagctctgcagaagccgccgg

SEQ ID NO: 520778 - DNA, 25 bp, Rattus norvegicus
accgagaggctcagctcgcggatca

SEQ ID NO: 520779 - DNA, 25 bp, Rattus norvegicus
cgggctgtgcctgccaaaggaagat

SEQ ID NO: 520780 - DNA, 25 bp, Rattus norvegicus
atagggtagccctagcgaggcctct

SEQ ID NO: 520781 - DNA, 25 bp, Rattus norvegicus
ggcgcccgtctgaatccgatcccac

SEQ ID NO: 520782 - DNA, 25 bp, Rattus norvegicus
cagctcagccctgaaacgggtccag

SEQ ID NO: 520783 - DNA, 25 bp, Rattus norvegicus
tcagccctgaaacgggtccagccgg

SEQ ID NO: 520784 - DNA, 25 bp, Rattus norvegicus
gcgaagccaggcctgggactaaagc

SEQ ID NO: 520785 - DNA, 25 bp, Rattus norvegicus
ccaggagaggagcaagcgacccaac

SEQ ID NO: 520786 - DNA, 25 bp, Rattus norvegicus
aggagcaagcgacccaaccgacatg

SEQ ID NO: 520787 - DNA, 25 bp, Rattus norvegicus
gacccaaccgacatgcagcgttctg

SEQ ID NO: 520788 - DNA, 25 bp, Rattus norvegicus
aaccgacatgcagcgttctgacccg

SEQ ID NO: 520789 - DNA, 25 bp, Rattus norvegicus
tcttccgtgcacctgccgcggggtg

SEQ ID NO: 520790 - DNA, 25 bp, Rattus norvegicus
cccggagcctcagcgcctatctcgc

SEQ ID NO: 520791 - DNA, 25 bp, Rattus norvegicus
cgccgcctgtcatctcggggtgcag

SEQ ID NO: 520792 - DNA, 25 bp, Rattus norvegicus
tgcccgcagcacttccgtaaacgta

SEQ ID NO: 520793 - DNA, 25 bp, Rattus norvegicus
agcacttccgtaaacgtaattggag

SEQ ID NO: 520794 - DNA, 25 bp, Rattus norvegicus
gagtcggggaaaacaaaggcgctgc

SEQ ID NO: 520795 - DNA, 25 bp, Rattus norvegicus
ggggcggcagccaaagcaccagcca

SEQ ID NO: 520796 - DNA, 25 bp, Rattus norvegicus
tgctccagcgcccgcgtgcagagtt

SEQ ID NO: 520797 - DNA, 25 bp, Rattus norvegicus
ccagggggcactcacttgctttcct

SEQ ID NO: 520798 - DNA, 25 bp, Rattus norvegicus
cgactcgcccagtggcctccagggg

SEQ ID NO: 520799 - DNA, 25 bp, Rattus norvegicus
ggtcctccgcgcgactcgcccagtg

SEQ ID NO: 520800 - DNA, 25 bp, Rattus norvegicus
taacggaagtggcgcagcggaccct

SEQ ID NO: 520801 - DNA, 25 bp, Rattus norvegicus
tcacggccagtgtaacggaagtggc

SEQ ID NO: 520802 - DNA, 25 bp, Rattus norvegicus
ccgcgcccacgcgtgaccctgcggc

SEQ ID NO: 520803 - DNA, 25 bp, Rattus norvegicus
aagcaccagccaccacgacccgggg

SEQ ID NO: 520804 - DNA, 25 bp, Rattus norvegicus
ccaggggcggcagccaaagcaccag

SEQ ID NO: 520805 - DNA, 25 bp, Rattus norvegicus
ctggggcaccgcacccgctggcagc

SEQ ID NO: 520806 - DNA, 25 bp, Rattus norvegicus
ccgaggttacctgacattgccgcct

SEQ ID NO: 520807 - DNA, 25 bp, Rattus norvegicus
cccggagccgaggttacctgacatt

SEQ ID NO: 520808 - DNA, 25 bp, Rattus norvegicus
gggcatcacggccagtgtaacggaa

SEQ ID NO: 520809 - DNA, 25 bp, Rattus norvegicus
tgctgccgcctctcgtgcagagtac

SEQ ID NO: 520810 - DNA, 25 bp, Rattus norvegicus
aatccgaccgactgcgttggccagg

SEQ ID NO: 520811 - DNA, 25 bp, Rattus norvegicus
cagcggtgcagacagccttagagac

SEQ ID NO: 520812 - DNA, 25 bp, Rattus norvegicus
cctctcgtgcagagtacgccttgca

SEQ ID NO: 520813 - DNA, 25 bp, Rattus norvegicus
gaggaaaatccgaccgactgcgttg

SEQ ID NO: 520814 - DNA, 25 bp, Rattus norvegicus
ggcagctcctgcgtagggcgatccc

SEQ ID NO: 520815 - DNA, 25 bp, Rattus norvegicus
gcagtgacacggcagctcctgcgta

SEQ ID NO: 520816 - DNA, 25 bp, Rattus norvegicus
gatcctccgcgcagtgacacggcag

SEQ ID NO: 520817 - DNA, 25 bp, Rattus norvegicus
aatgggctagaactgcagccctgca

SEQ ID NO: 520818 - DNA, 25 bp, Rattus norvegicus
atcctcggttctggcagcgttggtt

SEQ ID NO: 520819 - DNA, 25 bp, Rattus norvegicus
cacagccgcggatcctcggttctgg

SEQ ID NO: 520820 - DNA, 25 bp, Rattus norvegicus
ttcagtcaggatccacagccgcgga

SEQ ID NO: 520821 - DNA, 25 bp, Rattus norvegicus
tgcagacagccttagagacccaagg

SEQ ID NO: 520822 - DNA, 25 bp, Rattus norvegicus
gcagagtacgccttgcacacagcca

SEQ ID NO: 520823 - DNA, 25 bp, Rattus norvegicus
cactctcctgggctggccgggttgc

SEQ ID NO: 520824 - DNA, 25 bp, Rattus norvegicus
caggcagcattgtgagccgctccac

SEQ ID NO: 520825 - DNA, 25 bp, Rattus norvegicus
ttgtgagccgctccacagaagcctg

SEQ ID NO: 520826 - DNA, 25 bp, Rattus norvegicus
gtgagccgctccacagaagcctgct

SEQ ID NO: 520827 - DNA, 25 bp, Rattus norvegicus
agaagcctgctcctccgacccgcgt

SEQ ID NO: 520828 - DNA, 25 bp, Rattus norvegicus
ctctcagctgccgtgggaatgggcc

SEQ ID NO: 520829 - DNA, 25 bp, Rattus norvegicus
ccacgctgggatctgcgtcactcgg

SEQ ID NO: 520830 - DNA, 25 bp, Rattus norvegicus
atctgcgtcactcggccgcgcgtgg

SEQ ID NO: 520831 - DNA, 25 bp, Rattus norvegicus
gcacctgcggttttgtgtcgctccc

SEQ ID NO: 520832 - DNA, 25 bp, Rattus norvegicus
aatggagcaagagcggaatctcccg

SEQ ID NO: 520833 - DNA, 25 bp, Rattus norvegicus
gcgcgctctcagctgccgtgggaat

SEQ ID NO: 520834 - DNA, 25 bp, Rattus norvegicus
gcgaatggagcaagagcggaatctc

SEQ ID NO: 520835 - DNA, 25 bp, Rattus norvegicus
caggccgcacctgcggttttgtgtc

SEQ ID NO: 520836 - DNA, 25 bp, Rattus norvegicus
gaatgggccaccctcgggaccgcgc

SEQ ID NO: 520837 - DNA, 25 bp, Rattus norvegicus
gccgttgtcgcggatcgctccgcag

SEQ ID NO: 520838 - DNA, 25 bp, Rattus norvegicus
cttcctaaaagtgccgctgagtctc

SEQ ID NO: 520839 - DNA, 25 bp, Rattus norvegicus
ggacttcctaaaagtgccgctgagt

SEQ ID NO: 520840 - DNA, 25 bp, Rattus norvegicus
cggggacttcctaaaagtgccgctg

SEQ ID NO: 520841 - DNA, 25 bp, Rattus norvegicus
tggggtgccagctccgcggcgaccg

SEQ ID NO: 520842 - DNA, 25 bp, Rattus norvegicus
tcggaccaacgcgtcctgccaggcg

SEQ ID NO: 520843 - DNA, 25 bp, Rattus norvegicus
tggctcggtcggaccaacgcgtcct

SEQ ID NO: 520844 - DNA, 25 bp, Rattus norvegicus
gttgtcgcggatcgctccgcagccg

SEQ ID NO: 520845 - DNA, 25 bp, Rattus norvegicus
cagagccgttgtcgcggatcgctcc

SEQ ID NO: 520846 - DNA, 25 bp, Rattus norvegicus
cccggcagagccgttgtcgcggatc

SEQ ID NO: 520847 - DNA, 25 bp, Rattus norvegicus
agcgcacgcccaccacgtccctgcc

SEQ ID NO: 520848 - DNA, 25 bp, Rattus norvegicus
gggacagagcgcacgcccaccacgt

SEQ ID NO: 520849 - DNA, 25 bp, Rattus norvegicus
cccgcgcggccaagcgagcgccgtc

SEQ ID NO: 520850 - DNA, 25 bp, Rattus norvegicus
acggacgcctggctcggtcggacca

SEQ ID NO: 520851 - DNA, 25 bp, Rattus norvegicus
ttggtgagagcggtatgtctccagc

SEQ ID NO: 520852 - DNA, 25 bp, Rattus norvegicus
ggcgcggagacgaatttgactgatt

SEQ ID NO: 520853 - DNA, 25 bp, Rattus norvegicus
cgaatttgactgattcgctcgccaa

SEQ ID NO: 520854 - DNA, 25 bp, Rattus norvegicus
tcctcccgccctcggttggtgagag

SEQ ID NO: 520855 - DNA, 25 bp, Rattus norvegicus
tgaatagccagactccggagccgcg

SEQ ID NO: 520856 - DNA, 25 bp, Rattus norvegicus
gagagcggtatgtctccagccctcc

SEQ ID NO: 520857 - DNA, 25 bp, Rattus norvegicus
cgcgtccgtctcagtgcggagctcg

SEQ ID NO: 520858 - DNA, 25 bp, Rattus norvegicus
ttcgctcgccaatcagaagagaggt

SEQ ID NO: 520859 - DNA, 25 bp, Rattus norvegicus
agcgtacctgcctggtgaatagcca

SEQ ID NO: 520860 - DNA, 25 bp, Rattus norvegicus
acgtgcttccctggagcgtacctgc

SEQ ID NO: 520861 - DNA, 25 bp, Rattus norvegicus
ctcaatagctcgaggacgtgcttcc

SEQ ID NO: 520862 - DNA, 25 bp, Rattus norvegicus
tccagcttcctcaatagctcgagga

SEQ ID NO: 520863 - DNA, 25 bp, Rattus norvegicus
ccagcgtggcctcaggtggcccgaa

SEQ ID NO: 520864 - DNA, 25 bp, Rattus norvegicus
gcggggctgacacacgtcagtcgcc

SEQ ID NO: 520865 - DNA, 25 bp, Rattus norvegicus
ggtcttgtctgctgcatcctcggcc

SEQ ID NO: 520866 - DNA, 25 bp, Rattus norvegicus
ctcggccgagcagaggctactgtcc

SEQ ID NO: 520867 - DNA, 25 bp, Rattus norvegicus
gcatcctcggccgagcagaggctac

SEQ ID NO: 520868 - DNA, 25 bp, Rattus norvegicus
ccgggatgatgggtgagctccggga

SEQ ID NO: 520869 - DNA, 25 bp, Rattus norvegicus
agggtcttgtctgctgcatcctcgg

SEQ ID NO: 520870 - DNA, 25 bp, Rattus norvegicus
agcagaggctactgtccgaccgcgt

SEQ ID NO: 520871 - DNA, 25 bp, Rattus norvegicus
ggagggtcttgtctgctgcatcctc

SEQ ID NO: 520872 - DNA, 25 bp, Rattus norvegicus
gccgagcagaggctactgtccgacc

SEQ ID NO: 520873 - DNA, 25 bp, Rattus norvegicus
tccgggagggtcttgtctgctgcat

SEQ ID NO: 520874 - DNA, 25 bp, Rattus norvegicus
gtcgcgtgctcagcgcccaggctct

SEQ ID NO: 520875 - DNA, 25 bp, Rattus norvegicus
aggctactgtccgaccgcgtcgcgt

SEQ ID NO: 520876 - DNA, 25 bp, Rattus norvegicus
ctgtccgaccgcgtcgcgtgctcag

SEQ ID NO: 520877 - DNA, 25 bp, Rattus norvegicus
atcctcggccgagcagaggctactg

SEQ ID NO: 520878 - DNA, 25 bp, Rattus norvegicus
agaggctactgtccgaccgcgtcgc

SEQ ID NO: 520879 - DNA, 25 bp, Rattus norvegicus
gtagcggcagcctagccttcctggc

SEQ ID NO: 520880 - DNA, 25 bp, Rattus norvegicus
tcactcactgcactcaggagctcga

SEQ ID NO: 520881 - DNA, 25 bp, Rattus norvegicus
agtctagacagatctccctgcgcca

SEQ ID NO: 520882 - DNA, 25 bp, Rattus norvegicus
gccactcagctacgtcccaagaggg

SEQ ID NO: 520883 - DNA, 25 bp, Rattus norvegicus
agctacgtcccaagagggtctgagg

SEQ ID NO: 520884 - DNA, 25 bp, Rattus norvegicus
gtctccagggagctttgacaggccc

SEQ ID NO: 520885 - DNA, 25 bp, Rattus norvegicus
ggagctttgacaggcccagcgcaga

SEQ ID NO: 520886 - DNA, 25 bp, Rattus norvegicus
ccagcgcagaaaaccgaaagtaccg

SEQ ID NO: 520887 - DNA, 25 bp, Rattus norvegicus
taccgggcaggagaaaaagccagaa

SEQ ID NO: 520888 - DNA, 25 bp, Rattus norvegicus
gagaaaaagccagaaggcgtcccgc

SEQ ID NO: 520889 - DNA, 25 bp, Rattus norvegicus
ggccggctgttccagcagcgtaaca

SEQ ID NO: 520890 - DNA, 25 bp, Rattus norvegicus
tcaggagctcgagtctagacagatc

SEQ ID NO: 520891 - DNA, 25 bp, Rattus norvegicus
ccgtgcctcggtagcggcagcctag

SEQ ID NO: 520892 - DNA, 25 bp, Rattus norvegicus
ggctgttccagcagcgtaacacctc

SEQ ID NO: 520893 - DNA, 25 bp, Rattus norvegicus
agttgctgctttgagaggaaaccga

SEQ ID NO: 520894 - DNA, 25 bp, Rattus norvegicus
gcgctgcggccacgcggttagcaaa

SEQ ID NO: 520895 - DNA, 25 bp, Rattus norvegicus
cggccacgcggttagcaaactgcgg

SEQ ID NO: 520896 - DNA, 25 bp, Rattus norvegicus
gctgctgggaagagccgcaccacgt

SEQ ID NO: 520897 - DNA, 25 bp, Rattus norvegicus
gaactgggcaagcaccgagaagttg

SEQ ID NO: 520898 - DNA, 25 bp, Rattus norvegicus
gcaccgagaagttgctgctttgaga

SEQ ID NO: 520899 - DNA, 25 bp, Rattus norvegicus
ccacgcggttagcaaactgcggcgg

SEQ ID NO: 520900 - DNA, 25 bp, Rattus norvegicus
gctgctttgagaggaaaccgaaaaa

SEQ ID NO: 520901 - DNA, 25 bp, Rattus norvegicus
aaccgaaaaacgaaagcgtctgctg

SEQ ID NO: 520902 - DNA, 25 bp, Rattus norvegicus
acgaaagcgtctgctgataggcgcg

SEQ ID NO: 520903 - DNA, 25 bp, Rattus norvegicus
ttgcacgccacagactgcgcaggct

SEQ ID NO: 520904 - DNA, 25 bp, Rattus norvegicus
ggcggcctgggctacgttcgccact

SEQ ID NO: 520905 - DNA, 25 bp, Rattus norvegicus
tgggcaagcaccgagaagttgctgc

SEQ ID NO: 520906 - DNA, 25 bp, Rattus norvegicus
gcaccacgtgctttcggggaactgg

SEQ ID NO: 520907 - DNA, 25 bp, Rattus norvegicus
ctgctcggccagaagcaccttttta

SEQ ID NO: 520908 - DNA, 25 bp, Rattus norvegicus
tgtccgattttattgagaagaactc

SEQ ID NO: 520909 - DNA, 25 bp, Rattus norvegicus
ctcccaagtcgcactcctttggaga

SEQ ID NO: 520910 - DNA, 25 bp, Rattus norvegicus
acgcggatgatgaacaagctgtaca

SEQ ID NO: 520911 - DNA, 25 bp, Rattus norvegicus
gacaggtcctactcaagtccggcta

SEQ ID NO: 520912 - DNA, 25 bp, Rattus norvegicus
agaactgggccatccgcgccatcga

SEQ ID NO: 520913 - DNA, 25 bp, Rattus norvegicus
ttcttcccatgcctcgtgccaaaga

SEQ ID NO: 520914 - DNA, 25 bp, Rattus norvegicus
agcgctcctatttttccctgaattt

SEQ ID NO: 520915 - DNA, 25 bp, Rattus norvegicus
tttcggcatctcctcgactaaatcg

SEQ ID NO: 520916 - DNA, 25 bp, Rattus norvegicus
cgactgaacccttcgaggtcttagg

SEQ ID NO: 520917 - DNA, 25 bp, Rattus norvegicus
ctcggtccttttcccgaagctcagt

SEQ ID NO: 520918 - DNA, 25 bp, Rattus norvegicus
tccggcagctcttcggggacaggaa

SEQ ID NO: 520919 - DNA, 25 bp, Rattus norvegicus
tctctggtctcggaagcgctcctat

SEQ ID NO: 520920 - DNA, 25 bp, Rattus norvegicus
tcgagaccctctcgggtgagcactc

SEQ ID NO: 520921 - DNA, 25 bp, Rattus norvegicus
cctttgttccgccacagcggagggg

SEQ ID NO: 520922 - DNA, 25 bp, Rattus norvegicus
tctcactttgtgatattggcttccc

SEQ ID NO: 520923 - DNA, 25 bp, Rattus norvegicus
ctgcacaggacgcacggtcggctga

SEQ ID NO: 520924 - DNA, 25 bp, Rattus norvegicus
gacccgatggatcgccctacgagtg

SEQ ID NO: 520925 - DNA, 25 bp, Rattus norvegicus
cgggttctgtggaaggacaagctta

SEQ ID NO: 520926 - DNA, 25 bp, Rattus norvegicus
atcgccctacgagtgcagctgcgct

SEQ ID NO: 520927 - DNA, 25 bp, Rattus norvegicus
ggggcttgcaaactaagttgctctc

SEQ ID NO: 520928 - DNA, 25 bp, Rattus norvegicus
tcccacgcgtgctcgaggtcgttga

SEQ ID NO: 520929 - DNA, 25 bp, Rattus norvegicus
gctccactgtgaacccacgcgtatt

SEQ ID NO: 520930 - DNA, 25 bp, Rattus norvegicus
tcatcagctcctggggcgctcttgt

SEQ ID NO: 520931 - DNA, 25 bp, Rattus norvegicus
agccgcagcctgtaatccctggtca

SEQ ID NO: 520932 - DNA, 25 bp, Rattus norvegicus
ccctggcaaaactgtggcacgaacc

SEQ ID NO: 520933 - DNA, 25 bp, Rattus norvegicus
ggcgccggatccctggcaaaactgt

SEQ ID NO: 520934 - DNA, 25 bp, Rattus norvegicus
acaagcttatggcttcctgtgggaa

SEQ ID NO: 520935 - DNA, 25 bp, Rattus norvegicus
agcgttgctgttttgctgtcacgta

SEQ ID NO: 520936 - DNA, 25 bp, Rattus norvegicus
ctgcgtgatcattggcgctgggctc

SEQ ID NO: 520937 - DNA, 25 bp, Rattus norvegicus
cgcggcttaataaagctgagggcgc

SEQ ID NO: 520938 - DNA, 25 bp, Rattus norvegicus
taataaagctgagggcgcattcgcc

SEQ ID NO: 520939 - DNA, 25 bp, Rattus norvegicus
cgcattcgccggttgctgtttcgga

SEQ ID NO: 520940 - DNA, 25 bp, Rattus norvegicus
tggttggtgtacagcgttgctgttt

SEQ ID NO: 520941 - DNA, 25 bp, Rattus norvegicus
ttttgctgtcacgtaccttcccgga

SEQ ID NO: 520942 - DNA, 25 bp, Rattus norvegicus
tgtcacgtaccttcccggagcctgg

SEQ ID NO: 520943 - DNA, 25 bp, Rattus norvegicus
ccttttcccttagcggaggcggcag

SEQ ID NO: 520944 - DNA, 25 bp, Rattus norvegicus
gaggcggcagtctgcacgctcgttt

SEQ ID NO: 520945 - DNA, 25 bp, Rattus norvegicus
ctcgccgcccacttgggagcggtct

SEQ ID NO: 520946 - DNA, 25 bp, Rattus norvegicus
tggccgagagcccattggacggcct

SEQ ID NO: 520947 - DNA, 25 bp, Rattus norvegicus
agtctgcacgctcgtttgctcgccg

SEQ ID NO: 520948 - DNA, 25 bp, Rattus norvegicus
tggtgacgtcgcgtgacgccataag

SEQ ID NO: 520949 - DNA, 25 bp, Rattus norvegicus
agaaggccggcgaccacagcaaaaa

SEQ ID NO: 520950 - DNA, 25 bp, Rattus norvegicus
acccacgacctcagagaagcagcag

SEQ ID NO: 520951 - DNA, 25 bp, Rattus norvegicus
aaacacccacgacctcagagaagca

SEQ ID NO: 520952 - DNA, 25 bp, Rattus norvegicus
tcaaaaacacccacgacctcagaga

SEQ ID NO: 520953 - DNA, 25 bp, Rattus norvegicus
aaaatcactctcaaaaacacccacg

SEQ ID NO: 520954 - DNA, 25 bp, Rattus norvegicus
ggcgaccacagcaaaaaaatcactc

SEQ ID NO: 520955 - DNA, 25 bp, Rattus norvegicus
gaaggccggcgaccacagcaaaaaa

SEQ ID NO: 520956 - DNA, 25 bp, Rattus norvegicus
ccgcagagacaccctgacgagcgcg

SEQ ID NO: 520957 - DNA, 25 bp, Rattus norvegicus
cgtccccagcgacagagaaagagga

SEQ ID NO: 520958 - DNA, 25 bp, Rattus norvegicus
aggaagcaccgagaccgctgaagga

SEQ ID NO: 520959 - DNA, 25 bp, Rattus norvegicus
acaggaagcaccgagaccgctgaag

SEQ ID NO: 520960 - DNA, 25 bp, Rattus norvegicus
aaacaggaagcaccgagaccgctga

SEQ ID NO: 520961 - DNA, 25 bp, Rattus norvegicus
ggaaacaggaagcaccgagaccgct

SEQ ID NO: 520962 - DNA, 25 bp, Rattus norvegicus
ggccggcgaccacagcaaaaaaatc

SEQ ID NO: 520963 - DNA, 25 bp, Rattus norvegicus
tgatctccggagtttcagcaacatc

SEQ ID NO: 520964 - DNA, 25 bp, Rattus norvegicus
cagggagctgctgccataggaacag

SEQ ID NO: 520965 - DNA, 25 bp, Rattus norvegicus
tttgcgcctctcttctgtgcgtgac

SEQ ID NO: 520966 - DNA, 25 bp, Rattus norvegicus
gctctctaggctctaacccgagtgg

SEQ ID NO: 520967 - DNA, 25 bp, Rattus norvegicus
cgatgccacagatgggctagctctc

SEQ ID NO: 520968 - DNA, 25 bp, Rattus norvegicus
ttgggaagcagcaggtccttagccc

SEQ ID NO: 520969 - DNA, 25 bp, Rattus norvegicus
tgcggccaaaggagcgcatgatctc

SEQ ID NO: 520970 - DNA, 25 bp, Rattus norvegicus
ggcttctgaagaacacgggatcgcg

SEQ ID NO: 520971 - DNA, 25 bp, Rattus norvegicus
actctgcagcaaccaacggcttctg

SEQ ID NO: 520972 - DNA, 25 bp, Rattus norvegicus
accatgactacttcgcgcaactctg

SEQ ID NO: 520973 - DNA, 25 bp, Rattus norvegicus
ggggactcccacagcaccatgacta

SEQ ID NO: 520974 - DNA, 25 bp, Rattus norvegicus
agcagaagccctcgcaaagtgtcca

SEQ ID NO: 520975 - DNA, 25 bp, Rattus norvegicus
gctatgataagcagcgtcaccggca

SEQ ID NO: 520976 - DNA, 25 bp, Rattus norvegicus
cccgcatccctctggcgtttgggaa

SEQ ID NO: 520977 - DNA, 25 bp, Rattus norvegicus
caggctttttgggatctggatactc

SEQ ID NO: 520978 - DNA, 25 bp, Rattus norvegicus
cccgctctctgtagtaaaggcttca

SEQ ID NO: 520979 - DNA, 25 bp, Rattus norvegicus
ccgctcaggcatgcgtaccgaaata

SEQ ID NO: 520980 - DNA, 25 bp, Rattus norvegicus
gggtcccagtggacgcttagatata

SEQ ID NO: 520981 - DNA, 25 bp, Rattus norvegicus
tcctctgtcggaaggcggtgtcaaa

SEQ ID NO: 520982 - DNA, 25 bp, Rattus norvegicus
attcgccattttgcgaggcagcggc

SEQ ID NO: 520983 - DNA, 25 bp, Rattus norvegicus
gtccggtactggagccaatcagcgc

SEQ ID NO: 520984 - DNA, 25 bp, Rattus norvegicus
gcgaggtccacgtaccctgagctct

SEQ ID NO: 520985 - DNA, 25 bp, Rattus norvegicus
cgggtctcgctgaccactcaggaga

SEQ ID NO: 520986 - DNA, 25 bp, Rattus norvegicus
agagcgcttgcgcatttggccctag

SEQ ID NO: 520987 - DNA, 25 bp, Rattus norvegicus
agccacatcctacggcctgttcttg

SEQ ID NO: 520988 - DNA, 25 bp, Rattus norvegicus
cctgagctctccacagttgggacta

SEQ ID NO: 520989 - DNA, 25 bp, Rattus norvegicus
tatgaggagccaatatccagcggcc

SEQ ID NO: 520990 - DNA, 25 bp, Rattus norvegicus
ctcagggcggtgtttaagaagacta

SEQ ID NO: 520991 - DNA, 25 bp, Rattus norvegicus
atccacagcgaagcggcatcccgga

SEQ ID NO: 520992 - DNA, 25 bp, Rattus norvegicus
agcagagcggtacccgccttctttc

SEQ ID NO: 520993 - DNA, 25 bp, Rattus norvegicus
agcagcagcgagaagcgtccctgca

SEQ ID NO: 520994 - DNA, 25 bp, Rattus norvegicus
agcgtccctgcattcaagctgagaa

SEQ ID NO: 520995 - DNA, 25 bp, Rattus norvegicus
gggttacagggcgaatccacagcga

SEQ ID NO: 520996 - DNA, 25 bp, Rattus norvegicus
catcccggaggagaggacttgcttg

SEQ ID NO: 520997 - DNA, 25 bp, Rattus norvegicus
cttggagtgctcaggcggtagaccc

SEQ ID NO: 520998 - DNA, 25 bp, Rattus norvegicus
tcaggcggtagacccgggcgctcta

SEQ ID NO: 520999 - DNA, 25 bp, Rattus norvegicus
cgctctacgccgcatctgtggatca

SEQ ID NO: 521000 - DNA, 25 bp, Rattus norvegicus
gcatctgtggatcaccggctacctg

SEQ ID NO: 521001 - DNA, 25 bp, Rattus norvegicus
atcaccggctacctgggagaggcaa

SEQ ID NO: 521002 - DNA, 25 bp, Rattus norvegicus
ccgcaggagtcattgcctccgcttg

SEQ ID NO: 521003 - DNA, 25 bp, Rattus norvegicus
cactggggaaacagcagagcggtac

SEQ ID NO: 521004 - DNA, 25 bp, Rattus norvegicus
tcaagctgagaatgggttacagggc

SEQ ID NO: 521005 - DNA, 25 bp, Rattus norvegicus
cagggcgccagaacagactgagtgc

SEQ ID NO: 521006 - DNA, 25 bp, Rattus norvegicus
actaggctccgcgacgcagatagcg

SEQ ID NO: 521007 - DNA, 25 bp, Rattus norvegicus
ggctcgtgtgttcgcagctgctgca

SEQ ID NO: 521008 - DNA, 25 bp, Rattus norvegicus
ggcactcgagtgtgaggtaactata

SEQ ID NO: 521009 - DNA, 25 bp, Rattus norvegicus
gagaggagatgcacacggcactcga

SEQ ID NO: 521010 - DNA, 25 bp, Rattus norvegicus
agaatacacgactgggtgcagccgg

SEQ ID NO: 521011 - DNA, 25 bp, Rattus norvegicus
gatataatttcttccagttccgcct

SEQ ID NO: 521012 - DNA, 25 bp, Rattus norvegicus
ccgcaacttgcgtagatataatttc

SEQ ID NO: 521013 - DNA, 25 bp, Rattus norvegicus
agctacagggctccgcaacttgcgt

SEQ ID NO: 521014 - DNA, 25 bp, Rattus norvegicus
aaactagcgcggagctacagggctc

SEQ ID NO: 521015 - DNA, 25 bp, Rattus norvegicus
cctttctccgaacaaaactagcgcg

SEQ ID NO: 521016 - DNA, 25 bp, Rattus norvegicus
cgagccctggtcgtgagacgaccgt

SEQ ID NO: 521017 - DNA, 25 bp, Rattus norvegicus
ccgggccaaccgaaaaggctcgatg

SEQ ID NO: 521018 - DNA, 25 bp, Rattus norvegicus
gcaggcggctttggagaatacacga

SEQ ID NO: 521019 - DNA, 25 bp, Rattus norvegicus
cacactgctcctgtgcgcctggccc

SEQ ID NO: 521020 - DNA, 25 bp, Rattus norvegicus
ccgagagtgttgtgtcccattgtta

SEQ ID NO: 521021 - DNA, 25 bp, Rattus norvegicus
tgtgtcccattgttacaacgacgtc

SEQ ID NO: 521022 - DNA, 25 bp, Rattus norvegicus
cccattgttacaacgacgtccagcg

SEQ ID NO: 521023 - DNA, 25 bp, Rattus norvegicus
ttgttacaacgacgtccagcggttg

SEQ ID NO: 521024 - DNA, 25 bp, Rattus norvegicus
acaacgacgtccagcggttgggaag

SEQ ID NO: 521025 - DNA, 25 bp, Rattus norvegicus
ggaacaggagggaaacacataacgc

SEQ ID NO: 521026 - DNA, 25 bp, Rattus norvegicus
ggaaacacataacgccgggatggta

SEQ ID NO: 521027 - DNA, 25 bp, Rattus norvegicus
actggagtccaggttctccgagggc

SEQ ID NO: 521028 - DNA, 25 bp, Rattus norvegicus
gggcgcagtccacactgctcctgtg

SEQ ID NO: 521029 - DNA, 25 bp, Rattus norvegicus
ctcgctgctcatggcggcaaggacc

SEQ ID NO: 521030 - DNA, 25 bp, Rattus norvegicus
acctgctcgctgctcatggcggcaa

SEQ ID NO: 521031 - DNA, 25 bp, Rattus norvegicus
gcattccgagagtgttgtgtcccat

SEQ ID NO: 521032 - DNA, 25 bp, Rattus norvegicus
caggttctccgagggcgcagtccac

SEQ ID NO: 521033 - DNA, 25 bp, Rattus norvegicus
ctgggactgacagcggcccacgcga

SEQ ID NO: 521034 - DNA, 25 bp, Rattus norvegicus
ctggccttcgggctcgccacagggt

SEQ ID NO: 521035 - DNA, 25 bp, Rattus norvegicus
ggcccacgcgatggccgcaaagttt

SEQ ID NO: 521036 - DNA, 25 bp, Rattus norvegicus
tgggacactgtacttcgctagactc

SEQ ID NO: 521037 - DNA, 25 bp, Rattus norvegicus
aggtttgaaaagtgcagcggcgtct

SEQ ID NO: 521038 - DNA, 25 bp, Rattus norvegicus
cgcttcttacagttgaggtttgaaa

SEQ ID NO: 521039 - DNA, 25 bp, Rattus norvegicus
gtttctctggggctgctgacccgag

SEQ ID NO: 521040 - DNA, 25 bp, Rattus norvegicus
cagacgctgactgacgcttcttaca

SEQ ID NO: 521041 - DNA, 25 bp, Rattus norvegicus
ctatgaggagactcccggcggcgac

SEQ ID NO: 521042 - DNA, 25 bp, Rattus norvegicus
gccgcggaggctatcggacacaacc

SEQ ID NO: 521043 - DNA, 25 bp, Rattus norvegicus
agccactccgaggaccacgtcgaga

SEQ ID NO: 521044 - DNA, 25 bp, Rattus norvegicus
cacagcacgcgagttcgggagccac

SEQ ID NO: 521045 - DNA, 25 bp, Rattus norvegicus
gacgtgaaggcgtcccgcgcgcaca

SEQ ID NO: 521046 - DNA, 25 bp, Rattus norvegicus
cggcgaccgcacagacgctgactga

SEQ ID NO: 521047 - DNA, 25 bp, Rattus norvegicus
gccttgtccgctagacgccggggct

SEQ ID NO: 521048 - DNA, 25 bp, Rattus norvegicus
ccagggagtttgacccagcaaggga

SEQ ID NO: 521049 - DNA, 25 bp, Rattus norvegicus
tgcatctgcctgcaccgcgctgggg

SEQ ID NO: 521050 - DNA, 25 bp, Rattus norvegicus
atcaccgaatcagcaggcgcgtccg

SEQ ID NO: 521051 - DNA, 25 bp, Rattus norvegicus
ccatgtctctctgagcttggggccc

SEQ ID NO: 521052 - DNA, 25 bp, Rattus norvegicus
cgcggagccatgtctctctgagctt

SEQ ID NO: 521053 - DNA, 25 bp, Rattus norvegicus
acccgccgattgtgtcgagtcagcg

SEQ ID NO: 521054 - DNA, 25 bp, Rattus norvegicus
ttcccagggatcaccgaatcagcag

SEQ ID NO: 521055 - DNA, 25 bp, Rattus norvegicus
gcacactcacctgggcaggcgggct

SEQ ID NO: 521056 - DNA, 25 bp, Rattus norvegicus
cgcaagggaacgagacaaagccacc

SEQ ID NO: 521057 - DNA, 25 bp, Rattus norvegicus
gaatgtcaaatgcttgaccgcgcca

SEQ ID NO: 521058 - DNA, 25 bp, Rattus norvegicus
cgcttcaggggcagaatgtcaaatg

SEQ ID NO: 521059 - DNA, 25 bp, Rattus norvegicus
gtcccagttcccagggatcaccgaa

SEQ ID NO: 521060 - DNA, 25 bp, Rattus norvegicus
ggcgagcgtctcagcgatcgtcctc

SEQ ID NO: 521061 - DNA, 25 bp, Rattus norvegicus
cagagggccctcagattcaacgttc

SEQ ID NO: 521062 - DNA, 25 bp, Rattus norvegicus
tccctgggctatgggaggactctct

SEQ ID NO: 521063 - DNA, 25 bp, Rattus norvegicus
aagcggtctccgtagtctgagcatg

SEQ ID NO: 521064 - DNA, 25 bp, Rattus norvegicus
gggccgctcacacaagcgaagaatg

SEQ ID NO: 521065 - DNA, 25 bp, Rattus norvegicus
cgagaaccttagtcagccatctgta

SEQ ID NO: 521066 - DNA, 25 bp, Rattus norvegicus
catctgtacattccaggcctgagca

SEQ ID NO: 521067 - DNA, 25 bp, Rattus norvegicus
atcaggcgcgggtttgtgacgccat

SEQ ID NO: 521068 - DNA, 25 bp, Rattus norvegicus
gcgaagaatggtgccgagaacctta

SEQ ID NO: 521069 - DNA, 25 bp, Rattus norvegicus
ggccggctccttgcaagcctagcaa

SEQ ID NO: 521070 - DNA, 25 bp, Rattus norvegicus
ctagcaacaggaagcgggacggaca

SEQ ID NO: 521071 - DNA, 25 bp, Rattus norvegicus
acaacaccgggcgacaggagccgta

SEQ ID NO: 521072 - DNA, 25 bp, Rattus norvegicus
caggagccgtatcccgcgagcagca

SEQ ID NO: 521073 - DNA, 25 bp, Rattus norvegicus
cgctcacagctagagggacggactc

SEQ ID NO: 521074 - DNA, 25 bp, Rattus norvegicus
ccgcttcggccgtagccaggatcag

SEQ ID NO: 521075 - DNA, 25 bp, Rattus norvegicus
aggtgcagcactctccggctctaca

SEQ ID NO: 521076 - DNA, 25 bp, Rattus norvegicus
actcgagttccgctggccgctctag

SEQ ID NO: 521077 - DNA, 25 bp, Rattus norvegicus
ggcaacccacgccacgccactgttt

SEQ ID NO: 521078 - DNA, 25 bp, Rattus norvegicus
ccagggcccagcggctcactttttt

SEQ ID NO: 521079 - DNA, 25 bp, Rattus norvegicus
tctccgcctttcgaactcttcaaag

SEQ ID NO: 521080 - DNA, 25 bp, Rattus norvegicus
tcgaactcttcaaaggagattttcc

SEQ ID NO: 521081 - DNA, 25 bp, Rattus norvegicus
gagattttcccttctaggtagtcga

SEQ ID NO: 521082 - DNA, 25 bp, Rattus norvegicus
tcccttctaggtagtcgataagttc

SEQ ID NO: 521083 - DNA, 25 bp, Rattus norvegicus
tctaggtagtcgataagttccgggc

SEQ ID NO: 521084 - DNA, 25 bp, Rattus norvegicus
tagtcgataagttccgggctgaacc

SEQ ID NO: 521085 - DNA, 25 bp, Rattus norvegicus
tgtctgcggggccaacacagcgcag

SEQ ID NO: 521086 - DNA, 25 bp, Rattus norvegicus
ggcgggtaaaggtgcagcactctcc

SEQ ID NO: 521087 - DNA, 25 bp, Rattus norvegicus
actctccggctctacagggcgcttt

SEQ ID NO: 521088 - DNA, 25 bp, Rattus norvegicus
tctacagggcgctttggagataagg

SEQ ID NO: 521089 - DNA, 25 bp, Rattus norvegicus
gccatacctggtactcggggtactc

SEQ ID NO: 521090 - DNA, 25 bp, Rattus norvegicus
ctcggggtactcgaacatgtagctc

SEQ ID NO: 521091 - DNA, 25 bp, Rattus norvegicus
catgtagctcatgctgcacttgttc

SEQ ID NO: 521092 - DNA, 25 bp, Rattus norvegicus
tgcacttgttctcctcgaagccgaa

SEQ ID NO: 521093 - DNA, 25 bp, Rattus norvegicus
gaagccgaagaagacatcccacagc

SEQ ID NO: 521094 - DNA, 25 bp, Rattus norvegicus
cccagggtcgccagaaacaccatga

SEQ ID NO: 521095 - DNA, 25 bp, Rattus norvegicus
catgaagacatagaacgccaggttc

SEQ ID NO: 521096 - DNA, 25 bp, Rattus norvegicus
ttgactgagtggagaaacatggtgc

SEQ ID NO: 521097 - DNA, 25 bp, Rattus norvegicus
acatggtgcagccaagcgcctctac

SEQ ID NO: 521098 - DNA, 25 bp, Rattus norvegicus
agaagctccgcagcccagacagagc

SEQ ID NO: 521099 - DNA, 25 bp, Rattus norvegicus
ccagacagagcgagggaaagacgcc

SEQ ID NO: 521100 - DNA, 25 bp, Rattus norvegicus
gaaagacgcccgtgctaagccgtgc

SEQ ID NO: 521101 - DNA, 25 bp, Rattus norvegicus
ctggcttcagttgccaggagggctc

SEQ ID NO: 521102 - DNA, 25 bp, Rattus norvegicus
cttgccggctgagcctgaaaggagc

SEQ ID NO: 521103 - DNA, 25 bp, Rattus norvegicus
cctacctgatcgcagagtttgagca

SEQ ID NO: 521104 - DNA, 25 bp, Rattus norvegicus
tctcctactcggagacctgggccga

SEQ ID NO: 521105 - DNA, 25 bp, Rattus norvegicus
ccctgggcaactaaagaggaagtcg

SEQ ID NO: 521106 - DNA, 25 bp, Rattus norvegicus
cggggtgttctatccaaccgatgaa

SEQ ID NO: 521107 - DNA, 25 bp, Rattus norvegicus
accgatgaaggcaggcttttgcacc

SEQ ID NO: 521108 - DNA, 25 bp, Rattus norvegicus
aagctgactgctcctgagtgcacga

SEQ ID NO: 521109 - DNA, 25 bp, Rattus norvegicus
gaacgcgcacttgcgacggtccagg

SEQ ID NO: 521110 - DNA, 25 bp, Rattus norvegicus
tttgagcactgccattcttccgttc

SEQ ID NO: 521111 - DNA, 25 bp, Rattus norvegicus
tacagctctccgcttcgtagatgtc

SEQ ID NO: 521112 - DNA, 25 bp, Rattus norvegicus
ttcgtagatgtcaacgccgggagcc

SEQ ID NO: 521113 - DNA, 25 bp, Rattus norvegicus
gctcgcgaaggtgacagccctgcca

SEQ ID NO: 521114 - DNA, 25 bp, Rattus norvegicus
tttatacaggaagtgccggccgctg

SEQ ID NO: 521115 - DNA, 25 bp, Rattus norvegicus
tgagtgcacgacacagcccgagtct

SEQ ID NO: 521116 - DNA, 25 bp, Rattus norvegicus
cccgcccgcctttatacaggaagtg

SEQ ID NO: 521117 - DNA, 25 bp, Rattus norvegicus
atccagcgcggaacaaagcaccagc

SEQ ID NO: 521118 - DNA, 25 bp, Rattus norvegicus
aggccgcttaccttcgtgagtcttg

SEQ ID NO: 521119 - DNA, 25 bp, Rattus norvegicus
tcccggcggcttccttaaacagcga

SEQ ID NO: 521120 - DNA, 25 bp, Rattus norvegicus
gcacgtagtccaactgccacctaaa

SEQ ID NO: 521121 - DNA, 25 bp, Rattus norvegicus
ctgagcctgcgcacacgagaacgcg

SEQ ID NO: 521122 - DNA, 25 bp, Rattus norvegicus
acagacggaactggcgctcccaagg

SEQ ID NO: 521123 - DNA, 25 bp, Rattus norvegicus
ccggagtgcaagaggacgccattac

SEQ ID NO: 521124 - DNA, 25 bp, Rattus norvegicus
cctccggccagagcaagagaagtcc

SEQ ID NO: 521125 - DNA, 25 bp, Rattus norvegicus
agcgagagagacgtccctcccatgt

SEQ ID NO: 521126 - DNA, 25 bp, Rattus norvegicus
tccaggtgcaaactgccaacgacag

SEQ ID NO: 521127 - DNA, 25 bp, Rattus norvegicus
cgtcattcagggctttccaggtgca

SEQ ID NO: 521128 - DNA, 25 bp, Rattus norvegicus
gcgatcttcgccattttgtccactc

SEQ ID NO: 521129 - DNA, 25 bp, Rattus norvegicus
ttgtccactcgaacacacagacgga

SEQ ID NO: 521130 - DNA, 25 bp, Rattus norvegicus
gagatgcctcgcgaagacgccgaaa

SEQ ID NO: 521131 - DNA, 25 bp, Rattus norvegicus
cgtcaggtagcgagtgaaggttttc

SEQ ID NO: 521132 - DNA, 25 bp, Rattus norvegicus
gctgaccctagtcggctccggagac

SEQ ID NO: 521133 - DNA, 25 bp, Rattus norvegicus
ccgcccttccggtctcttagaggtg

SEQ ID NO: 521134 - DNA, 25 bp, Rattus norvegicus
agcaatgagaagcagccaggcctcc

SEQ ID NO: 521135 - DNA, 25 bp, Rattus norvegicus
catattttcagggtgcgtcagcgac

SEQ ID NO: 521136 - DNA, 25 bp, Rattus norvegicus
ctcaaaaggcccgaggattggctga

SEQ ID NO: 521137 - DNA, 25 bp, Rattus norvegicus
gggatgccgtccgaagtcaaccaca

SEQ ID NO: 521138 - DNA, 25 bp, Rattus norvegicus
ctcggactagtcagaggactctggc

SEQ ID NO: 521139 - DNA, 25 bp, Rattus norvegicus
atgatcatggcagctcggactagtc

SEQ ID NO: 521140 - DNA, 25 bp, Rattus norvegicus
ccggcttcacaaagatgatcatggc

SEQ ID NO: 521141 - DNA, 25 bp, Rattus norvegicus
tgaacccaggaatacgtcacgaaga

SEQ ID NO: 521142 - DNA, 25 bp, Rattus norvegicus
tcaaccacagtgacggaagcccggg

SEQ ID NO: 521143 - DNA, 25 bp, Rattus norvegicus
cggcgttcgctaccggcttcacaaa

SEQ ID NO: 521144 - DNA, 25 bp, Rattus norvegicus
aggcgtgtccagttgctcaaaaggc

SEQ ID NO: 521145 - DNA, 25 bp, Rattus norvegicus
gcggaccaagtgctttccctggatg

SEQ ID NO: 521146 - DNA, 25 bp, Rattus norvegicus
cccagctccttgtctaagttgcgga

SEQ ID NO: 521147 - DNA, 25 bp, Rattus norvegicus
tcctaagtactgtctcccagcgggg

SEQ ID NO: 521148 - DNA, 25 bp, Rattus norvegicus
ggtgcgcccgcataattcgaatttc

SEQ ID NO: 521149 - DNA, 25 bp, Rattus norvegicus
gagttctgccgaacctcaaggccta

SEQ ID NO: 521150 - DNA, 25 bp, Rattus norvegicus
ccttaagggctaccgatggagttct

SEQ ID NO: 521151 - DNA, 25 bp, Rattus norvegicus
tgtctcagaggcatcgtgggatccc

SEQ ID NO: 521152 - DNA, 25 bp, Rattus norvegicus
gcgacctcgcctgtctgtctcagag

SEQ ID NO: 521153 - DNA, 25 bp, Rattus norvegicus
gatcttcaaaaacacgcggctcggg

SEQ ID NO: 521154 - DNA, 25 bp, Rattus norvegicus
ggttggggaccacttctatacatac

SEQ ID NO: 521155 - DNA, 25 bp, Rattus norvegicus
cagcgcgcgttcagcatgtgggaac

SEQ ID NO: 521156 - DNA, 25 bp, Rattus norvegicus
caccctcgcttgtattgctgttgga

SEQ ID NO: 521157 - DNA, 25 bp, Rattus norvegicus
ggtcggaccagggttagcatataac

SEQ ID NO: 521158 - DNA, 25 bp, Rattus norvegicus
aggcctgcagccaagctcgctttga

SEQ ID NO: 521159 - DNA, 25 bp, Rattus norvegicus
tccgatagagccctacagtgcgcca

SEQ ID NO: 521160 - DNA, 25 bp, Rattus norvegicus
acaggacaggggtccactcagtgtc

SEQ ID NO: 521161 - DNA, 25 bp, Rattus norvegicus
gcccatgtgcgctttgggactagca

SEQ ID NO: 521162 - DNA, 25 bp, Rattus norvegicus
ccacgggagtctccttgcagcagga

SEQ ID NO: 521163 - DNA, 25 bp, Rattus norvegicus
tgcgctgtcttttcacgtgtcctga

SEQ ID NO: 521164 - DNA, 25 bp, Rattus norvegicus
gtggccgccttctctcacgctaagg

SEQ ID NO: 521165 - DNA, 25 bp, Rattus norvegicus
gccctactgggcctgaacaagtgaa

SEQ ID NO: 521166 - DNA, 25 bp, Rattus norvegicus
cggcgtaagtcatggtgagtgtctc

SEQ ID NO: 521167 - DNA, 25 bp, Rattus norvegicus
cgccgcacgtgatgaaagcagtatg

SEQ ID NO: 521168 - DNA, 25 bp, Rattus norvegicus
aggggcttgttctttcacctcagcg

SEQ ID NO: 521169 - DNA, 25 bp, Rattus norvegicus
gcggcgtcgctgacagacttatccc

SEQ ID NO: 521170 - DNA, 25 bp, Rattus norvegicus
ggccgcgctcggttctagaaccttc

SEQ ID NO: 521171 - DNA, 25 bp, Rattus norvegicus
cgcgcttttcgtgggtgaaaggtca

SEQ ID NO: 521172 - DNA, 25 bp, Rattus norvegicus
aggtcaagtggcgtcatttccggga

SEQ ID NO: 521173 - DNA, 25 bp, Rattus norvegicus
agctgaggacctggggccctccctg

SEQ ID NO: 521174 - DNA, 25 bp, Rattus norvegicus
tgaggcggaacaggccaggcaccaa

SEQ ID NO: 521175 - DNA, 25 bp, Rattus norvegicus
agccgcccagactctggcactatgg

SEQ ID NO: 521176 - DNA, 25 bp, Rattus norvegicus
actctggcactatggtcatggcgga

SEQ ID NO: 521177 - DNA, 25 bp, Rattus norvegicus
cacctcaccgagagcaagcttggcg

SEQ ID NO: 521178 - DNA, 25 bp, Rattus norvegicus
ggcaccaaggcgcaggtatagtccc

SEQ ID NO: 521179 - DNA, 25 bp, Rattus norvegicus
aagcttggcgggtgacgtacctgca

SEQ ID NO: 521180 - DNA, 25 bp, Rattus norvegicus
gagacccgggactgacgcctgtcac

SEQ ID NO: 521181 - DNA, 25 bp, Rattus norvegicus
cgtcgagggctgtaaacactgccca

SEQ ID NO: 521182 - DNA, 25 bp, Rattus norvegicus
tgtcaccggcgactgctgctgcgct

SEQ ID NO: 521183 - DNA, 25 bp, Rattus norvegicus
aggaccctggcgtatccgccgagac

SEQ ID NO: 521184 - DNA, 25 bp, Rattus norvegicus
cgccctggaggcctgataggctcag

SEQ ID NO: 521185 - DNA, 25 bp, Rattus norvegicus
cctgctggcgggactctgtccagga

SEQ ID NO: 521186 - DNA, 25 bp, Rattus norvegicus
tagctttcctgtcaaggagttcgcg

SEQ ID NO: 521187 - DNA, 25 bp, Rattus norvegicus
gccgctacagttcgtgctcgccgag

SEQ ID NO: 521188 - DNA, 25 bp, Rattus norvegicus
aggagtcactgctcgtcgttcattg

SEQ ID NO: 521189 - DNA, 25 bp, Rattus norvegicus
tcgttcattggcttccgcgccggaa

SEQ ID NO: 521190 - DNA, 25 bp, Rattus norvegicus
acgcgccctctcacgtgcttgggaa

SEQ ID NO: 521191 - DNA, 25 bp, Rattus norvegicus
accatgctgcggcagtgcgctctgt

SEQ ID NO: 521192 - DNA, 25 bp, Rattus norvegicus
cggaacccattagccgactactcaa

SEQ ID NO: 521193 - DNA, 25 bp, Rattus norvegicus
ggaagcgcgggcctacttcaccaca

SEQ ID NO: 521194 - DNA, 25 bp, Rattus norvegicus
gctctgggtccacgcgtttttctac

SEQ ID NO: 521195 - DNA, 25 bp, Rattus norvegicus
actgccctgacacggaacccattag

SEQ ID NO: 521196 - DNA, 25 bp, Rattus norvegicus
tcctgcagcttttccgggaggctgg

SEQ ID NO: 521197 - DNA, 25 bp, Rattus norvegicus
tctaccggtacggacgagcacggcc

SEQ ID NO: 521198 - DNA, 25 bp, Rattus norvegicus
gggaggctggcatctcctccaccga

SEQ ID NO: 521199 - DNA, 25 bp, Rattus norvegicus
acgagcacggcctgaagatccagca

SEQ ID NO: 521200 - DNA, 25 bp, Rattus norvegicus
cgatcgagtgtctgcccagttcctg

SEQ ID NO: 521201 - DNA, 25 bp, Rattus norvegicus
accgtctactactgtgcgtggcttc

SEQ ID NO: 521202 - DNA, 25 bp, Rattus norvegicus
tttcttcaccactcttgagagcggc

SEQ ID NO: 521203 - DNA, 25 bp, Rattus norvegicus
ggcttctggggacttccgaagtcta

SEQ ID NO: 521204 - DNA, 25 bp, Rattus norvegicus
ggagagccagcttctaccgtctact

SEQ ID NO: 521205 - DNA, 25 bp, Rattus norvegicus
gagtcgtcccttccctggagagcca

SEQ ID NO: 521206 - DNA, 25 bp, Rattus norvegicus
agctcaagttggaaggcgcgttcgc

SEQ ID NO: 521207 - DNA, 25 bp, Rattus norvegicus
gggactcggtctccatctttcttca

SEQ ID NO: 521208 - DNA, 25 bp, Rattus norvegicus
acagcaaggctttcggctccaaagc

SEQ ID NO: 521209 - DNA, 25 bp, Rattus norvegicus
aaaacttcagggctgccgcttgcta

SEQ ID NO: 521210 - DNA, 25 bp, Rattus norvegicus
aatgtgtcctgaaagggcgagcgtc

SEQ ID NO: 521211 - DNA, 25 bp, Rattus norvegicus
gcgcattctgattggctgtcggcca

SEQ ID NO: 521212 - DNA, 25 bp, Rattus norvegicus
tcgtgcacagcaggccctagccttg

SEQ ID NO: 521213 - DNA, 25 bp, Rattus norvegicus
cctagccttgcgttggcgcattctg

SEQ ID NO: 521214 - DNA, 25 bp, Rattus norvegicus
gcggcacattaccaggctgcgctgg

SEQ ID NO: 521215 - DNA, 25 bp, Rattus norvegicus
gacctaaagaagaccggctcgctgt

SEQ ID NO: 521216 - DNA, 25 bp, Rattus norvegicus
agcgagactagctgagcgcaccaca

SEQ ID NO: 521217 - DNA, 25 bp, Rattus norvegicus
cgccgccaggttcctagaacactta

SEQ ID NO: 521218 - DNA, 25 bp, Rattus norvegicus
caacttccgcgtatgacgtcacttc

SEQ ID NO: 521219 - DNA, 25 bp, Rattus norvegicus
tttctcaaggcgctcctgcgacagc

SEQ ID NO: 521220 - DNA, 25 bp, Rattus norvegicus
cgcacgaccgcaagctttctcaagg

SEQ ID NO: 521221 - DNA, 25 bp, Rattus norvegicus
cgaagccgagttcgcacgaccgcaa

SEQ ID NO: 521222 - DNA, 25 bp, Rattus norvegicus
tatcacaggctcaggagtaggcagc

SEQ ID NO: 521223 - DNA, 25 bp, Rattus norvegicus
gttcacctctcgcaagacctaaaga

SEQ ID NO: 521224 - DNA, 25 bp, Rattus norvegicus
agtcgggcttttcactctgcccaaa

SEQ ID NO: 521225 - DNA, 25 bp, Rattus norvegicus
cggctacgccagtcgggcttttcac

SEQ ID NO: 521226 - DNA, 25 bp, Rattus norvegicus
cgggatgcactcagcggctacgcca

SEQ ID NO: 521227 - DNA, 25 bp, Rattus norvegicus
ctagcactcagaggcgggatgctga

SEQ ID NO: 521228 - DNA, 25 bp, Rattus norvegicus
tacttctaagttctcggcccgaagc

SEQ ID NO: 521229 - DNA, 25 bp, Rattus norvegicus
cttcctaaaatgtactccgagtgcc

SEQ ID NO: 521230 - DNA, 25 bp, Rattus norvegicus
gcccgctgtcttttgtctgcgcaga

SEQ ID NO: 521231 - DNA, 25 bp, Rattus norvegicus
acacattccattcttcgcgctcggg

SEQ ID NO: 521232 - DNA, 25 bp, Rattus norvegicus
agcatcatcaaggtaagcggagcca

SEQ ID NO: 521233 - DNA, 25 bp, Rattus norvegicus
aggctccgagcaacagaacacattc

SEQ ID NO: 521234 - DNA, 25 bp, Rattus norvegicus
gggctgtcaaaacaagtcttccctc

SEQ ID NO: 521235 - DNA, 25 bp, Rattus norvegicus
ctgcccgagtgatgtctcctctcta

SEQ ID NO: 521236 - DNA, 25 bp, Rattus norvegicus
tctcctctctacaaagttgcggccg

SEQ ID NO: 521237 - DNA, 25 bp, Rattus norvegicus
cgtcgcgcgctgaaacaaagtctag

SEQ ID NO: 521238 - DNA, 25 bp, Rattus norvegicus
aagtctagcggcgtttccttctggt

SEQ ID NO: 521239 - DNA, 25 bp, Rattus norvegicus
tttccttctggtgcctgagcgcacc

SEQ ID NO: 521240 - DNA, 25 bp, Rattus norvegicus
gagcgcacccttactcagggctgga

SEQ ID NO: 521241 - DNA, 25 bp, Rattus norvegicus
ctgtctcgccgggagcctagaacgt

SEQ ID NO: 521242 - DNA, 25 bp, Rattus norvegicus
tagaacgtgcttggccatggctgag

SEQ ID NO: 521243 - DNA, 25 bp, Rattus norvegicus
gctcccatggggctgccgttctgct

SEQ ID NO: 521244 - DNA, 25 bp, Rattus norvegicus
agctccgggctgttacctcccacgg

SEQ ID NO: 521245 - DNA, 25 bp, Rattus norvegicus
ccatgctgctccgatttggagacaa

SEQ ID NO: 521246 - DNA, 25 bp, Rattus norvegicus
tgttacctcccacggccttggccac

SEQ ID NO: 521247 - DNA, 25 bp, Rattus norvegicus
acaaagttcccaccggcaggtcgca

SEQ ID NO: 521248 - DNA, 25 bp, Rattus norvegicus
tgtcccgaagacacgggctctcgct

SEQ ID NO: 521249 - DNA, 25 bp, Rattus norvegicus
atggggctgccgttctgctccagcc

SEQ ID NO: 521250 - DNA, 25 bp, Rattus norvegicus
gttcccaccggcaggtcgcaataaa

SEQ ID NO: 521251 - DNA, 25 bp, Rattus norvegicus
tttggagacaaagttcccaccggca

SEQ ID NO: 521252 - DNA, 25 bp, Rattus norvegicus
tgctccgatttggagacaaagttcc

SEQ ID NO: 521253 - DNA, 25 bp, Rattus norvegicus
gccgctccatgctgctccgatttgg

SEQ ID NO: 521254 - DNA, 25 bp, Rattus norvegicus
ttcggtcggggctgtcccgaagaca

SEQ ID NO: 521255 - DNA, 25 bp, Rattus norvegicus
ctccagccgggccaccttcaccggg

SEQ ID NO: 521256 - DNA, 25 bp, Rattus norvegicus
ccaccggcaggtcgcaataaaacgc

SEQ ID NO: 521257 - DNA, 25 bp, Rattus norvegicus
tttccggctttgcttaggcgcgcac

SEQ ID NO: 521258 - DNA, 25 bp, Rattus norvegicus
tcactgaaacccgtgagaggaaccc

SEQ ID NO: 521259 - DNA, 25 bp, Rattus norvegicus
agacagagagggtaaggaaaactgc

SEQ ID NO: 521260 - DNA, 25 bp, Rattus norvegicus
gcactttccggctttgcttaggcgc

SEQ ID NO: 521261 - DNA, 25 bp, Rattus norvegicus
gtgaaggctccaccgcactttccgg

SEQ ID NO: 521262 - DNA, 25 bp, Rattus norvegicus
ggttgcgagtgaaggctccaccgca

SEQ ID NO: 521263 - DNA, 25 bp, Rattus norvegicus
ggtaaggaaaactgcgagagatgta

SEQ ID NO: 521264 - DNA, 25 bp, Rattus norvegicus
tcgccacggatccagacaaggtggg

SEQ ID NO: 521265 - DNA, 25 bp, Rattus norvegicus
gcgtagtcgccacggatccagacaa

SEQ ID NO: 521266 - DNA, 25 bp, Rattus norvegicus
gagaagcgtagtcgccacggatcca

SEQ ID NO: 521267 - DNA, 25 bp, Rattus norvegicus
actgagaatcctctagggcgctttg

SEQ ID NO: 521268 - DNA, 25 bp, Rattus norvegicus
cccgaatacgccagggacactgaga

SEQ ID NO: 521269 - DNA, 25 bp, Rattus norvegicus
tacattgtcactgaaacccgtgaga

SEQ ID NO: 521270 - DNA, 25 bp, Rattus norvegicus
cagggacactgagaatcctctaggg

SEQ ID NO: 521271 - DNA, 25 bp, Rattus norvegicus
aggcgctgacgaacgccagggccca

SEQ ID NO: 521272 - DNA, 25 bp, Rattus norvegicus
ttgtagcaagtccagggcgcagccg

SEQ ID NO: 521273 - DNA, 25 bp, Rattus norvegicus
ctccttgtagcaagtccagggcgca

SEQ ID NO: 521274 - DNA, 25 bp, Rattus norvegicus
tcctcctccttgtagcaagtccagg

SEQ ID NO: 521275 - DNA, 25 bp, Rattus norvegicus
ggtcctcctccttgtagcaagtcca

SEQ ID NO: 521276 - DNA, 25 bp, Rattus norvegicus
tgacgaacgccagggcccagggtct

SEQ ID NO: 521277 - DNA, 25 bp, Rattus norvegicus
tctaggcgctgacgaacgccagggc

SEQ ID NO: 521278 - DNA, 25 bp, Rattus norvegicus
tgcgtctaggcgctgacgaacgcca

SEQ ID NO: 521279 - DNA, 25 bp, Rattus norvegicus
aaggacggatggctgaggactgagt

SEQ ID NO: 521280 - DNA, 25 bp, Rattus norvegicus
accgcgcgacgaaggacggatggct

SEQ ID NO: 521281 - DNA, 25 bp, Rattus norvegicus
aggacctcaggcaccgcgcgacgaa

SEQ ID NO: 521282 - DNA, 25 bp, Rattus norvegicus
gtggcaaggacctcaggcaccgcgc

SEQ ID NO: 521283 - DNA, 25 bp, Rattus norvegicus
ccttgtagcaagtccagggcgcagc

SEQ ID NO: 521284 - DNA, 25 bp, Rattus norvegicus
tctggtcctcctccttgtagcaagt

SEQ ID NO: 521285 - DNA, 25 bp, Rattus norvegicus
taacgcggcgggagccgaactgcta

SEQ ID NO: 521286 - DNA, 25 bp, Rattus norvegicus
tctcgctccaggagttcgggacacc

SEQ ID NO: 521287 - DNA, 25 bp, Rattus norvegicus
cagtgccggacccaaagccggacgg

SEQ ID NO: 521288 - DNA, 25 bp, Rattus norvegicus
atcatgccttgtgcccacggagcaa

SEQ ID NO: 521289 - DNA, 25 bp, Rattus norvegicus
agtggcagtgatgcatcatgccttg

SEQ ID NO: 521290 - DNA, 25 bp, Rattus norvegicus
aacgtagcccttgtggccagagtgg

SEQ ID NO: 521291 - DNA, 25 bp, Rattus norvegicus
accgctcgcaacgtagcccttgtgg

SEQ ID NO: 521292 - DNA, 25 bp, Rattus norvegicus
ggccggcacgatgttctggcctctc

SEQ ID NO: 521293 - DNA, 25 bp, Rattus norvegicus
tcttcaggagctccggtgccgcaac

SEQ ID NO: 521294 - DNA, 25 bp, Rattus norvegicus
gactagctagggactcatcggcgcg

SEQ ID NO: 521295 - DNA, 25 bp, Rattus norvegicus
ggctcctaagccatagaaagactag

SEQ ID NO: 521296 - DNA, 25 bp, Rattus norvegicus
ccgcaaaagtttgtggctcctaagc

SEQ ID NO: 521297 - DNA, 25 bp, Rattus norvegicus
gccgcacccgatctgagggagaagt

SEQ ID NO: 521298 - DNA, 25 bp, Rattus norvegicus
tagggccgcgcgagtccgcaaaagt

SEQ ID NO: 521299 - DNA, 25 bp, Rattus norvegicus
cagaatccaggcgatgcctccctta

SEQ ID NO: 521300 - DNA, 25 bp, Rattus norvegicus
catcttggggctgagctgttttcct

SEQ ID NO: 521301 - DNA, 25 bp, Rattus norvegicus
ttttcctttggagaacgccgcgcga

SEQ ID NO: 521302 - DNA, 25 bp, Rattus norvegicus
cgccgcgcgagacctagaaattcag

SEQ ID NO: 521303 - DNA, 25 bp, Rattus norvegicus
ttcaggcccaaagcaaagatctaga

SEQ ID NO: 521304 - DNA, 25 bp, Rattus norvegicus
gatctagagaccaaggctagtagtc

SEQ ID NO: 521305 - DNA, 25 bp, Rattus norvegicus
ctagaccgggtcactgctaggggtc

SEQ ID NO: 521306 - DNA, 25 bp, Rattus norvegicus
accgcgtgggctgcggctgaaacct

SEQ ID NO: 521307 - DNA, 25 bp, Rattus norvegicus
gctgaaacctgctgcgctgcccgga

SEQ ID NO: 521308 - DNA, 25 bp, Rattus norvegicus
gagcctttccgcagcgccgagaatc

SEQ ID NO: 521309 - DNA, 25 bp, Rattus norvegicus
ccgagaatcctcaggttagtgagga

SEQ ID NO: 521310 - DNA, 25 bp, Rattus norvegicus
cagggcaccatcagactactcaaca

SEQ ID NO: 521311 - DNA, 25 bp, Rattus norvegicus
tactcaacaccgagatgggaccgcg

SEQ ID NO: 521312 - DNA, 25 bp, Rattus norvegicus
ggctagtagtcaaggtccctccacc

SEQ ID NO: 521313 - DNA, 25 bp, Rattus norvegicus
atccaaaccatgaacccgggcggcg

SEQ ID NO: 521314 - DNA, 25 bp, Rattus norvegicus
tcgggctgagtccaccaaccacaaa

SEQ ID NO: 521315 - DNA, 25 bp, Rattus norvegicus
ggctgagtccaccaaccacaaacgt

SEQ ID NO: 521316 - DNA, 25 bp, Rattus norvegicus
cacaaacgtccttcctccggccgtg

SEQ ID NO: 521317 - DNA, 25 bp, Rattus norvegicus
ccgctcgagcccatgaaggggtctc

SEQ ID NO: 521318 - DNA, 25 bp, Rattus norvegicus
tgaggccgctgctcgcttccggaga

SEQ ID NO: 521319 - DNA, 25 bp, Rattus norvegicus
tgcagatccaaaccatgaacccggg

SEQ ID NO: 521320 - DNA, 25 bp, Rattus norvegicus
gttcgaacttcccggctcgggctga

SEQ ID NO: 521321 - DNA, 25 bp, Rattus norvegicus
agagggcagccaccgtctactgcgc

SEQ ID NO: 521322 - DNA, 25 bp, Rattus norvegicus
cgtctactgcgcttcacggtgccgg

SEQ ID NO: 521323 - DNA, 25 bp, Rattus norvegicus
gcgcttcacggtgccgggctctgac

SEQ ID NO: 521324 - DNA, 25 bp, Rattus norvegicus
aatgaactgctcctgctgacggccg

SEQ ID NO: 521325 - DNA, 25 bp, Rattus norvegicus
agcagccgcaccacgtcctctactt

SEQ ID NO: 521326 - DNA, 25 bp, Rattus norvegicus
tgctcgcttccggagactccgtgtc

SEQ ID NO: 521327 - DNA, 25 bp, Rattus norvegicus
gggatcccaatagagacagaacttc

SEQ ID NO: 521328 - DNA, 25 bp, Rattus norvegicus
ttccgatgcgctcggatgtgccctt

SEQ ID NO: 521329 - DNA, 25 bp, Rattus norvegicus
ctggtgaacaaatcggggtggcttt

SEQ ID NO: 521330 - DNA, 25 bp, Rattus norvegicus
tggctacacacctgctcctgcttaa

SEQ ID NO: 521331 - DNA, 25 bp, Rattus norvegicus
ccttggccaggcttggagatctcca

SEQ ID NO: 521332 - DNA, 25 bp, Rattus norvegicus
gaagccggctttccggaggccttgc

SEQ ID NO: 521333 - DNA, 25 bp, Rattus norvegicus
ttaaccctgtgcttgctgagcgcta

SEQ ID NO: 521334 - DNA, 25 bp, Rattus norvegicus
ccagcagcagaagcaaaagggatcc

SEQ ID NO: 521335 - DNA, 25 bp, Rattus norvegicus
aagtccgctgctccacggtgttctc

SEQ ID NO: 521336 - DNA, 25 bp, Rattus norvegicus
aggcctggcacactgactcgctgca

SEQ ID NO: 521337 - DNA, 25 bp, Rattus norvegicus
aggcccggcaacaatggcactttta

SEQ ID NO: 521338 - DNA, 25 bp, Rattus norvegicus
ctcgcttccaggctaggcgctgcag

SEQ ID NO: 521339 - DNA, 25 bp, Rattus norvegicus
ggaccggccgcagcatctggctaca

SEQ ID NO: 521340 - DNA, 25 bp, Rattus norvegicus
tcgctgcacaatccgagcttgtttg

SEQ ID NO: 521341 - DNA, 25 bp, Rattus norvegicus
gacgagttcgtccacgcgtgatttc

SEQ ID NO: 521342 - DNA, 25 bp, Rattus norvegicus
tcggcctggattgagtgcgaacaca

SEQ ID NO: 521343 - DNA, 25 bp, Rattus norvegicus
cttctccaacaacggcgaacaggtt

SEQ ID NO: 521344 - DNA, 25 bp, Rattus norvegicus
tgctttcggtactgcacaggcatgc

SEQ ID NO: 521345 - DNA, 25 bp, Rattus norvegicus
gctcaggctagttttcccaggtctc

SEQ ID NO: 521346 - DNA, 25 bp, Rattus norvegicus
tgaaaggtcacaaacatggcgctgg

SEQ ID NO: 521347 - DNA, 25 bp, Rattus norvegicus
gatgctccatgaactgctcccgcga

SEQ ID NO: 521348 - DNA, 25 bp, Rattus norvegicus
ctcacctgcgggtaaagatgctcca

SEQ ID NO: 521349 - DNA, 25 bp, Rattus norvegicus
ccgctagtcccattcgcagttacag

SEQ ID NO: 521350 - DNA, 25 bp, Rattus norvegicus
tcggccgggcagaacattctccagc

SEQ ID NO: 521351 - DNA, 25 bp, Rattus norvegicus
ggctccgatccctcgctgtacttgg

SEQ ID NO: 521352 - DNA, 25 bp, Rattus norvegicus
ccgaggtgaagctgacgctcaatga

SEQ ID NO: 521353 - DNA, 25 bp, Rattus norvegicus
aggactctccgtaccaccgaggtga

SEQ ID NO: 521354 - DNA, 25 bp, Rattus norvegicus
taccggaagacgctgttcggccatg

SEQ ID NO: 521355 - DNA, 25 bp, Rattus norvegicus
gacacggaagtaagtcgtcgcctac

SEQ ID NO: 521356 - DNA, 25 bp, Rattus norvegicus
aacccggaaggctggggatcaccag

SEQ ID NO: 521357 - DNA, 25 bp, Rattus norvegicus
gtggcgaccgcctactgacctgcgg

SEQ ID NO: 521358 - DNA, 25 bp, Rattus norvegicus
taagtcgtcgcctactcggatgctc

SEQ ID NO: 521359 - DNA, 25 bp, Rattus norvegicus
ctactcggatgctccgcgactggta

SEQ ID NO: 521360 - DNA, 25 bp, Rattus norvegicus
ccgcgactggtagagcggatcaacc

SEQ ID NO: 521361 - DNA, 25 bp, Rattus norvegicus
gtagagcggatcaacccgcggcgcc

SEQ ID NO: 521362 - DNA, 25 bp, Rattus norvegicus
cccaaggcgcccgtgtcatcggaga

SEQ ID NO: 521363 - DNA, 25 bp, Rattus norvegicus
gaactgttctgcaactctcggcccg

SEQ ID NO: 521364 - DNA, 25 bp, Rattus norvegicus
cactgaagcctggtgcccaaggcgc

SEQ ID NO: 521365 - DNA, 25 bp, Rattus norvegicus
ccgacgtgcagtgcgccaaaaggaa

SEQ ID NO: 521366 - DNA, 25 bp, Rattus norvegicus
ctcaggatgcctcccaaggcttcgg

SEQ ID NO: 521367 - DNA, 25 bp, Rattus norvegicus
cgtggtcttcctgggccagcggtcc

SEQ ID NO: 521368 - DNA, 25 bp, Rattus norvegicus
caattcggtgcccactgaagcctgg

SEQ ID NO: 521369 - DNA, 25 bp, Rattus norvegicus
tcgccgtggactgtcgagctcctca

SEQ ID NO: 521370 - DNA, 25 bp, Rattus norvegicus
tggcgtctcaatcctcgccaacaag

SEQ ID NO: 521371 - DNA, 25 bp, Rattus norvegicus
tctcggctgcttctggcgtctcaat

SEQ ID NO: 521372 - DNA, 25 bp, Rattus norvegicus
ggagccctattccttctcggctgct

SEQ ID NO: 521373 - DNA, 25 bp, Rattus norvegicus
cgtcttccacttccggggagcggcg

SEQ ID NO: 521374 - DNA, 25 bp, Rattus norvegicus
aggagacctgctcggccagcaagtc

SEQ ID NO: 521375 - DNA, 25 bp, Rattus norvegicus
caactgctaactgccgcggcgttta

SEQ ID NO: 521376 - DNA, 25 bp, Rattus norvegicus
attggctggagcgtcaactgctaac

SEQ ID NO: 521377 - DNA, 25 bp, Rattus norvegicus
tgaagaactagccagtggacgcgga

SEQ ID NO: 521378 - DNA, 25 bp, Rattus norvegicus
gcgcctctttctaggaatctgattg

SEQ ID NO: 521379 - DNA, 25 bp, Rattus norvegicus
cggcgcgtctttgcgcctctttcta

SEQ ID NO: 521380 - DNA, 25 bp, Rattus norvegicus
gtgggcacccacagctgaagaacta

SEQ ID NO: 521381 - DNA, 25 bp, Rattus norvegicus
agctcctcaggcaagtgtgggcacc

SEQ ID NO: 521382 - DNA, 25 bp, Rattus norvegicus
ccagcaagtcctgcggagccctatt

SEQ ID NO: 521383 - DNA, 25 bp, Rattus norvegicus
tgtgccacgcacagccacggcaagt

SEQ ID NO: 521384 - DNA, 25 bp, Rattus norvegicus
gccacggcaagtgcttcaagctgca

SEQ ID NO: 521385 - DNA, 25 bp, Rattus norvegicus
accaggactagacccggtcggctgg

SEQ ID NO: 521386 - DNA, 25 bp, Rattus norvegicus
tgtcactgtaagtggagccgcgtcg

SEQ ID NO: 521387 - DNA, 25 bp, Rattus norvegicus
gtgctgtcacctgggatggtgtcac

SEQ ID NO: 521388 - DNA, 25 bp, Rattus norvegicus
gtagaccggacttccagccgtgcga

SEQ ID NO: 521389 - DNA, 25 bp, Rattus norvegicus
gcttcaagctgcactggtgctgtca

SEQ ID NO: 521390 - DNA, 25 bp, Rattus norvegicus
tccagccgtgcgacgggctgtccat

SEQ ID NO: 521391 - DNA, 25 bp, Rattus norvegicus
tctcgtcaccggcagagatgagtgc

SEQ ID NO: 521392 - DNA, 25 bp, Rattus norvegicus
ctccctcggcatccaggggcgtgtg

SEQ ID NO: 521393 - DNA, 25 bp, Rattus norvegicus
gacgtgtactgactgtcctcgccgc

SEQ ID NO: 521394 - DNA, 25 bp, Rattus norvegicus
agacccggtgcctaaaggttgcaga

SEQ ID NO: 521395 - DNA, 25 bp, Rattus norvegicus
cagtcgctccaggaccacggggcga

SEQ ID NO: 521396 - DNA, 25 bp, Rattus norvegicus
cgaagcctcaggtcaccgcgggcta

SEQ ID NO: 521397 - DNA, 25 bp, Rattus norvegicus
agcccgctgcattgcagagcaagga

SEQ ID NO: 521398 - DNA, 25 bp, Rattus norvegicus
gctcgcgttagttccggtcgcagag

SEQ ID NO: 521399 - DNA, 25 bp, Rattus norvegicus
tagttccggtcgcagaggagacagc

SEQ ID NO: 521400 - DNA, 25 bp, Rattus norvegicus
ttcctctcctgctgctcgcgttagt

SEQ ID NO: 521401 - DNA, 25 bp, Rattus norvegicus
agaaatctcgcgatagcagggctcc

SEQ ID NO: 521402 - DNA, 25 bp, Rattus norvegicus
cgaactggcgcagggtagaaatctc

SEQ ID NO: 521403 - DNA, 25 bp, Rattus norvegicus
gacttgcccttagcccgctgcattg

SEQ ID NO: 521404 - DNA, 25 bp, Rattus norvegicus
ttgcagagcaaggagaccaggctgc

SEQ ID NO: 521405 - DNA, 25 bp, Rattus norvegicus
aggctgcagtctgaacccccgtaga

SEQ ID NO: 521406 - DNA, 25 bp, Rattus norvegicus
gactggtccaactcgcggccatcga

SEQ ID NO: 521407 - DNA, 25 bp, Rattus norvegicus
gctttagagcgggatgagatgccta

SEQ ID NO: 521408 - DNA, 25 bp, Rattus norvegicus
cccggtacaagagtcagggtagcct

SEQ ID NO: 521409 - DNA, 25 bp, Rattus norvegicus
actcgcggccatcgaggggccgctt

SEQ ID NO: 521410 - DNA, 25 bp, Rattus norvegicus
atgagatgcctaccacccgctgtgc

SEQ ID NO: 521411 - DNA, 25 bp, Rattus norvegicus
gggccctgacagaaaccgcgtctta

SEQ ID NO: 521412 - DNA, 25 bp, Rattus norvegicus
ttcttgtccgaaaactggtgacgta

SEQ ID NO: 521413 - DNA, 25 bp, Rattus norvegicus
gcgccgagccaccaccgagattaaa

SEQ ID NO: 521414 - DNA, 25 bp, Rattus norvegicus
tcgagtttaagcgaaggccgcgccc

SEQ ID NO: 521415 - DNA, 25 bp, Rattus norvegicus
cattcggaaggacgaacgcggcctt

SEQ ID NO: 521416 - DNA, 25 bp, Rattus norvegicus
taccgccatcttaggtctgaccgcg

SEQ ID NO: 521417 - DNA, 25 bp, Rattus norvegicus
acatacacagaagctggcggccaga

SEQ ID NO: 521418 - DNA, 25 bp, Rattus norvegicus
tcgcatggctgcgacaggaagagct

SEQ ID NO: 521419 - DNA, 25 bp, Rattus norvegicus
accgcgtcttacctttccgcagaga

SEQ ID NO: 521420 - DNA, 25 bp, Rattus norvegicus
tccgcagagactccaaccctgaaga

SEQ ID NO: 521421 - DNA, 25 bp, Rattus norvegicus
gtgcaagcggcagcaactacctctc

SEQ ID NO: 521422 - DNA, 25 bp, Rattus norvegicus
tgaagacaaagctctcaaggcgacg

SEQ ID NO: 521423 - DNA, 25 bp, Rattus norvegicus
ccagagctctacagtcgaggcagag

SEQ ID NO: 521424 - DNA, 25 bp, Rattus norvegicus
tgcgaacaacaccagcaagagattc

SEQ ID NO: 521425 - DNA, 25 bp, Rattus norvegicus
gcgcccagatacctcatacagtcgt

SEQ ID NO: 521426 - DNA, 25 bp, Rattus norvegicus
cggacaaccttacagcgcccagata

SEQ ID NO: 521427 - DNA, 25 bp, Rattus norvegicus
cgcgagagggttctacggacaacct

SEQ ID NO: 521428 - DNA, 25 bp, Rattus norvegicus
aggtggggcatgcacctcactcctc

SEQ ID NO: 521429 - DNA, 25 bp, Rattus norvegicus
ctcagcacacggactagggctcctg

SEQ ID NO: 521430 - DNA, 25 bp, Rattus norvegicus
ggggctctccgcagagaacgcccta

SEQ ID NO: 521431 - DNA, 25 bp, Rattus norvegicus
agagtgtcaatgcaccaccggaagt

SEQ ID NO: 521432 - DNA, 25 bp, Rattus norvegicus
gcgggttccaagagtgtcaatgcac

SEQ ID NO: 521433 - DNA, 25 bp, Rattus norvegicus
tgtctcattcacaggtgccggcatg

SEQ ID NO: 521434 - DNA, 25 bp, Rattus norvegicus
ccgctgctgcggtaacaaaaatgtc

SEQ ID NO: 521435 - DNA, 25 bp, Rattus norvegicus
gataaaagccgttactccgcactta

SEQ ID NO: 521436 - DNA, 25 bp, Rattus norvegicus
caggcgtttgagtggaggaataaaa

SEQ ID NO: 521437 - DNA, 25 bp, Rattus norvegicus
ggaagcaaagcgcaccggaccactt

SEQ ID NO: 521438 - DNA, 25 bp, Rattus norvegicus
acagtcgtctggagtcggaagcaaa

SEQ ID NO: 521439 - DNA, 25 bp, Rattus norvegicus
cagggtaatggaactgcgcgcagca

SEQ ID NO: 521440 - DNA, 25 bp, Rattus norvegicus
ttgactcgggccaaaaggacttagc

SEQ ID NO: 521441 - DNA, 25 bp, Rattus norvegicus
ttcaggagacctcgcgccacaggac

SEQ ID NO: 521442 - DNA, 25 bp, Rattus norvegicus
acaggacaggttcggctttcgcaga

SEQ ID NO: 521443 - DNA, 25 bp, Rattus norvegicus
tttcgcagacgtcgcctctcacaga

SEQ ID NO: 521444 - DNA, 25 bp, Rattus norvegicus
tctcacagatgaggcaccctagagg

SEQ ID NO: 521445 - DNA, 25 bp, Rattus norvegicus
cagcctgcgctctgcggtttcatca

SEQ ID NO: 521446 - DNA, 25 bp, Rattus norvegicus
ggtttcatcatttcccgccacggtg

SEQ ID NO: 521447 - DNA, 25 bp, Rattus norvegicus
agtgcatccgaactcacctcttgag

SEQ ID NO: 521448 - DNA, 25 bp, Rattus norvegicus
aagaacggccgcgaggctcacacgc

SEQ ID NO: 521449 - DNA, 25 bp, Rattus norvegicus
tcgactggcacaagccgaacctcgg

SEQ ID NO: 521450 - DNA, 25 bp, Rattus norvegicus
cggtgccctaagagaccaatgggga

SEQ ID NO: 521451 - DNA, 25 bp, Rattus norvegicus
ttagctcagtcggaaaacagatccc

SEQ ID NO: 521452 - DNA, 25 bp, Rattus norvegicus
aggccggcgtccaggaaaatatcga

SEQ ID NO: 521453 - DNA, 25 bp, Rattus norvegicus
agcctcaggcttcctaccgccaccg

SEQ ID NO: 521454 - DNA, 25 bp, Rattus norvegicus
cagcaccgccgcctacctgtcaccc

SEQ ID NO: 521455 - DNA, 25 bp, Rattus norvegicus
tcccgagcttgctctcaggtctgca

SEQ ID NO: 521456 - DNA, 25 bp, Rattus norvegicus
cgagcttgctctcaggtctgcaggg

SEQ ID NO: 521457 - DNA, 25 bp, Rattus norvegicus
tctgcagggtttcggatccgccaac

SEQ ID NO: 521458 - DNA, 25 bp, Rattus norvegicus
caccgtgcgttgtcgcccttcctac

SEQ ID NO: 521459 - DNA, 25 bp, Rattus norvegicus
cagccggagaagaaaaccctcttca

SEQ ID NO: 521460 - DNA, 25 bp, Rattus norvegicus
ctaccatgtccgcagccggagaaga

SEQ ID NO: 521461 - DNA, 25 bp, Rattus norvegicus
gatccgccaacattcctgctgccgc

SEQ ID NO: 521462 - DNA, 25 bp, Rattus norvegicus
cctcaccttcgtcagctcccggcta

SEQ ID NO: 521463 - DNA, 25 bp, Rattus norvegicus
gccttctcacgaccctcccgagctt

SEQ ID NO: 521464 - DNA, 25 bp, Rattus norvegicus
cggctaccatgtccgcagccggaga

SEQ ID NO: 521465 - DNA, 25 bp, Rattus norvegicus
accatgtccgcagccggagaagaaa

SEQ ID NO: 521466 - DNA, 25 bp, Rattus norvegicus
gcagggtttcggatccgccaacatt

SEQ ID NO: 521467 - DNA, 25 bp, Rattus norvegicus
ccggtacgtgacttgagcggtgtaa

SEQ ID NO: 521468 - DNA, 25 bp, Rattus norvegicus
tacgtgacttgagcggtgtaacccg

SEQ ID NO: 521469 - DNA, 25 bp, Rattus norvegicus
tgagcggtgtaacccgcgcgctact

SEQ ID NO: 521470 - DNA, 25 bp, Rattus norvegicus
ctactagcggcgcagcgcgagcctg

SEQ ID NO: 521471 - DNA, 25 bp, Rattus norvegicus
cagcgcgagcctgggaccctaagtc

SEQ ID NO: 521472 - DNA, 25 bp, Rattus norvegicus
tgggaccctaagtcccgggctgctg

SEQ ID NO: 521473 - DNA, 25 bp, Rattus norvegicus
ctaagtcccgggctgctgtgcctgg

SEQ ID NO: 521474 - DNA, 25 bp, Rattus norvegicus
ctgtgcctggcgcattctagtaggc

SEQ ID NO: 521475 - DNA, 25 bp, Rattus norvegicus
ctggcgcattctagtaggccctgga

SEQ ID NO: 521476 - DNA, 25 bp, Rattus norvegicus
cgcattctagtaggccctggaggtc

SEQ ID NO: 521477 - DNA, 25 bp, Rattus norvegicus
tagtaggccctggaggtctcagaga

SEQ ID NO: 521478 - DNA, 25 bp, Rattus norvegicus
tcagagagccctgcgccggcgcgca

SEQ ID NO: 521479 - DNA, 25 bp, Rattus norvegicus
gactgcagctcctccacaggctggg

SEQ ID NO: 521480 - DNA, 25 bp, Rattus norvegicus
agggcacggaggactgcagctcctc

SEQ ID NO: 521481 - DNA, 25 bp, Rattus norvegicus
tgcggccatcggagtacggtcatcg

SEQ ID NO: 521482 - DNA, 25 bp, Rattus norvegicus
ggtggcaatctagcctgacgctccc

SEQ ID NO: 521483 - DNA, 25 bp, Rattus norvegicus
acggtggcaatctagcctgacgctc

SEQ ID NO: 521484 - DNA, 25 bp, Rattus norvegicus
tcccaacggtggcaatctagcctga

SEQ ID NO: 521485 - DNA, 25 bp, Rattus norvegicus
ccgcgatcccaacggtggcaatcta

SEQ ID NO: 521486 - DNA, 25 bp, Rattus norvegicus
cagcaggccgcgatcccaacggtgg

SEQ ID NO: 521487 - DNA, 25 bp, Rattus norvegicus
ggttcgttcctctcctaccagcagg

SEQ ID NO: 521488 - DNA, 25 bp, Rattus norvegicus
cagagtagtccggttcgttcctctc

SEQ ID NO: 521489 - DNA, 25 bp, Rattus norvegicus
ctgcagagtagtccggttcgttcct

SEQ ID NO: 521490 - DNA, 25 bp, Rattus norvegicus
tgagtgctgcagagtagtccggttc

SEQ ID NO: 521491 - DNA, 25 bp, Rattus norvegicus
gactcggcgacaggtgagtgctgca

SEQ ID NO: 521492 - DNA, 25 bp, Rattus norvegicus
tctcccaggggttgctcgcccgaga

SEQ ID NO: 521493 - DNA, 25 bp, Rattus norvegicus
agagcgtctcccaggggttgctcgc

SEQ ID NO: 521494 - DNA, 25 bp, Rattus norvegicus
cgaaatgcggccatcggagtacggt

SEQ ID NO: 521495 - DNA, 25 bp, Rattus norvegicus
cacctggagaaacaggagccggact

SEQ ID NO: 521496 - DNA, 25 bp, Rattus norvegicus
ctgtgaggctccctcgctaaatctt

SEQ ID NO: 521497 - DNA, 25 bp, Rattus norvegicus
ggcgataattcacccgggcgtcctg

SEQ ID NO: 521498 - DNA, 25 bp, Rattus norvegicus
gactcggtgtaacctgagcctcccg

SEQ ID NO: 521499 - DNA, 25 bp, Rattus norvegicus
ctgtcttcgactcggtgtaacctga

SEQ ID NO: 521500 - DNA, 25 bp, Rattus norvegicus
gaggctccctcgctaaatcttcctg

SEQ ID NO: 521501 - DNA, 25 bp, Rattus norvegicus
caaatggcgcactgtgcggctgtga

SEQ ID NO: 521502 - DNA, 25 bp, Rattus norvegicus
tttcaaaggcggacaaatggcgcac

SEQ ID NO: 521503 - DNA, 25 bp, Rattus norvegicus
ctcagcctccggtttcaaaggcgga

SEQ ID NO: 521504 - DNA, 25 bp, Rattus norvegicus
cgagcgggcgataattcacccgggc

SEQ ID NO: 521505 - DNA, 25 bp, Rattus norvegicus
gcaaattaacacgtagcaaaacacc

SEQ ID NO: 521506 - DNA, 25 bp, Rattus norvegicus
ctggggcaaattaacacgtagcaaa

SEQ ID NO: 521507 - DNA, 25 bp, Rattus norvegicus
ggcgcgtcaactggggcaaattaac

SEQ ID NO: 521508 - DNA, 25 bp, Rattus norvegicus
gctaaatcttcctgtcttcgactcg

SEQ ID NO: 521509 - DNA, 25 bp, Rattus norvegicus
cgggagcttactcacgggaatggcc

SEQ ID NO: 521510 - DNA, 25 bp, Rattus norvegicus
gctgaagctaccactgctgcagcta

SEQ ID NO: 521511 - DNA, 25 bp, Rattus norvegicus
gacgcgggacagaaaagcttctctg

SEQ ID NO: 521512 - DNA, 25 bp, Rattus norvegicus
agttcgaatcgcacgcgggagctta

SEQ ID NO: 521513 - DNA, 25 bp, Rattus norvegicus
aacgcccgcactcgctcagaaagaa

SEQ ID NO: 521514 - DNA, 25 bp, Rattus norvegicus
gccttgatcgctgcctaggtaatga

SEQ ID NO: 521515 - DNA, 25 bp, Rattus norvegicus
ctctgccttcgggagaagttgacaa

SEQ ID NO: 521516 - DNA, 25 bp, Rattus norvegicus
gtgcacggcgaaaaggccaatcctc

SEQ ID NO: 521517 - DNA, 25 bp, Rattus norvegicus
caggaactggtaggcgccctcacat

SEQ ID NO: 521518 - DNA, 25 bp, Rattus norvegicus
aagcaggcctagtgttctcgcctcg

SEQ ID NO: 521519 - DNA, 25 bp, Rattus norvegicus
ctcacatcatcacagggcgaccttg

SEQ ID NO: 521520 - DNA, 25 bp, Rattus norvegicus
cccacccagctagggaagctaaaag

SEQ ID NO: 521521 - DNA, 25 bp, Rattus norvegicus
agtgacgccggttcaatggcagccc

SEQ ID NO: 521522 - DNA, 25 bp, Rattus norvegicus
tcctcactaccgagctagaagctgg

SEQ ID NO: 521523 - DNA, 25 bp, Rattus norvegicus
aggccctgagtcgtccctcatgatg

SEQ ID NO: 521524 - DNA, 25 bp, Rattus norvegicus
aaacctcagcgtatgtcgacgtccc

SEQ ID NO: 521525 - DNA, 25 bp, Rattus norvegicus
agtttcccgggaggtcatcacgatt

SEQ ID NO: 521526 - DNA, 25 bp, Rattus norvegicus
atcacgatttgcgtggggatgagca

SEQ ID NO: 521527 - DNA, 25 bp, Rattus norvegicus
tgagcaccgcttgaccagaccagga

SEQ ID NO: 521528 - DNA, 25 bp, Rattus norvegicus
ccaggattcaagctcccaccggaaa

SEQ ID NO: 521529 - DNA, 25 bp, Rattus norvegicus
cgcccagaggtgtcgtcatggcaac

SEQ ID NO: 521530 - DNA, 25 bp, Rattus norvegicus
gtcatggcaacgctgacgggcactg

SEQ ID NO: 521531 - DNA, 25 bp, Rattus norvegicus
gcacagctgttctccgacttcgggc

SEQ ID NO: 521532 - DNA, 25 bp, Rattus norvegicus
gtcactgctggttaggacacctcca

SEQ ID NO: 521533 - DNA, 25 bp, Rattus norvegicus
tgtcctcttccagcggaggccctga

SEQ ID NO: 521534 - DNA, 25 bp, Rattus norvegicus
cctcatgatgctttcctgcgggcct

SEQ ID NO: 521535 - DNA, 25 bp, Rattus norvegicus
ggcctccttaggctcaaccgctgga

SEQ ID NO: 521536 - DNA, 25 bp, Rattus norvegicus
acagtgccacactccgggtcatggg

SEQ ID NO: 521537 - DNA, 25 bp, Rattus norvegicus
ttacctgagcctgcgtccgccttga

SEQ ID NO: 521538 - DNA, 25 bp, Rattus norvegicus
gaccggagtggaaactgctaaccta

SEQ ID NO: 521539 - DNA, 25 bp, Rattus norvegicus
acgcacgcgcactctctgcagctct

SEQ ID NO: 521540 - DNA, 25 bp, Rattus norvegicus
tgcagctctcaagctcgcttccttt

SEQ ID NO: 521541 - DNA, 25 bp, Rattus norvegicus
agcctctgcgtcacgccctccttaa

SEQ ID NO: 521542 - DNA, 25 bp, Rattus norvegicus
aagggagactccgtccggcttccag

SEQ ID NO: 521543 - DNA, 25 bp, Rattus norvegicus
ggcttccagggacgctcacggtcgc

SEQ ID NO: 521544 - DNA, 25 bp, Rattus norvegicus
ctgagcctgcgtccgccttgacggg

SEQ ID NO: 521545 - DNA, 25 bp, Rattus norvegicus
ccgttcggaatacgcgttacctgag

SEQ ID NO: 521546 - DNA, 25 bp, Rattus norvegicus
ccagactcctgagacagccggcggt

SEQ ID NO: 521547 - DNA, 25 bp, Rattus norvegicus
aatacgcgttacctgagcctgcgtc

SEQ ID NO: 521548 - DNA, 25 bp, Rattus norvegicus
actgctaacctagtccgaagccaga

SEQ ID NO: 521549 - DNA, 25 bp, Rattus norvegicus
tgtcctgtaccctcgcgagcgggcg

SEQ ID NO: 521550 - DNA, 25 bp, Rattus norvegicus
tccgaagccagactcctgagacagc

SEQ ID NO: 521551 - DNA, 25 bp, Rattus norvegicus
cgggtacgcgagatcagctgattca

SEQ ID NO: 521552 - DNA, 25 bp, Rattus norvegicus
cgcagctccgcgctcttcgcccggc

SEQ ID NO: 521553 - DNA, 25 bp, Rattus norvegicus
ttcgcccggcgcgagcccgactgca

SEQ ID NO: 521554 - DNA, 25 bp, Rattus norvegicus
agaggggacccaaaggaatgccaca

SEQ ID NO: 521555 - DNA, 25 bp, Rattus norvegicus
actgcaccgcgggtacgcgagatca

SEQ ID NO: 521556 - DNA, 25 bp, Rattus norvegicus
gcgcctcggccgacccgccttcgaa

SEQ ID NO: 521557 - DNA, 25 bp, Rattus norvegicus
tcccagcgcaatcccgcgcctcggc

SEQ ID NO: 521558 - DNA, 25 bp, Rattus norvegicus
cccgcatgccatcccagcgcaatcc

SEQ ID NO: 521559 - DNA, 25 bp, Rattus norvegicus
gagctctaccacaggcaggcgccat

SEQ ID NO: 521560 - DNA, 25 bp, Rattus norvegicus
acgtccggagctctaccacaggcag

SEQ ID NO: 521561 - DNA, 25 bp, Rattus norvegicus
ccgggccgagccaccacgtccggag

SEQ ID NO: 521562 - DNA, 25 bp, Rattus norvegicus
ggaatgccacacagctcggaccaca

SEQ ID NO: 521563 - DNA, 25 bp, Rattus norvegicus
gggacccaaaggaatgccacacagc

SEQ ID NO: 521564 - DNA, 25 bp, Rattus norvegicus
acgcgagatcagctgattcacgggg

SEQ ID NO: 521565 - DNA, 25 bp, Rattus norvegicus
atgctctatgtacgcacccgtgtgc

SEQ ID NO: 521566 - DNA, 25 bp, Rattus norvegicus
cgtgctaacggcctcatgtacttta

SEQ ID NO: 521567 - DNA, 25 bp, Rattus norvegicus
tctcttgcccgcgtcagctcaaggt

SEQ ID NO: 521568 - DNA, 25 bp, Rattus norvegicus
ccctcagatggcagaggccgctggt

SEQ ID NO: 521569 - DNA, 25 bp, Rattus norvegicus
gtgcaccgtgctcgaccaagccatt

SEQ ID NO: 521570 - DNA, 25 bp, Rattus norvegicus
cccgtctttttcctccagctgagaa

SEQ ID NO: 521571 - DNA, 25 bp, Rattus norvegicus
gctgcgcttcttcttatgctctatg

SEQ ID NO: 521572 - DNA, 25 bp, Rattus norvegicus
aaaggtgcagtgttctcccgagctg

SEQ ID NO: 521573 - DNA, 25 bp, Rattus norvegicus
gttctaccctctggtaaaggtgcag

SEQ ID NO: 521574 - DNA, 25 bp, Rattus norvegicus
ccgttgtgcacggatattgcctaca

SEQ ID NO: 521575 - DNA, 25 bp, Rattus norvegicus
aaaggcatctcggtaccggaccacg

SEQ ID NO: 521576 - DNA, 25 bp, Rattus norvegicus
ccataccacggcgagaaaggcatct

SEQ ID NO: 521577 - DNA, 25 bp, Rattus norvegicus
tctgtgccttggtgcttgctcttct

SEQ ID NO: 521578 - DNA, 25 bp, Rattus norvegicus
gcgctgcgagaacttcccggtgcac

SEQ ID NO: 521579 - DNA, 25 bp, Rattus norvegicus
ctttcctggagcaagagaaccgcta

SEQ ID NO: 521580 - DNA, 25 bp, Rattus norvegicus
ccaggttgctctcacggacaaggga

SEQ ID NO: 521581 - DNA, 25 bp, Rattus norvegicus
cagcgagcccgagagaaacctggga

SEQ ID NO: 521582 - DNA, 25 bp, Rattus norvegicus
acctgggagcagtcgaaagagaccc

SEQ ID NO: 521583 - DNA, 25 bp, Rattus norvegicus
attccaggggctcagccagcagccg

SEQ ID NO: 521584 - DNA, 25 bp, Rattus norvegicus
ccggtacctggtcagacatggtgtc

SEQ ID NO: 521585 - DNA, 25 bp, Rattus norvegicus
cagaaccgcactctgaggtttacaa

SEQ ID NO: 521586 - DNA, 25 bp, Rattus norvegicus
ctgaggtttacaaatccgtctcttc

SEQ ID NO: 521587 - DNA, 25 bp, Rattus norvegicus
acaacaccgcggctgcagggacttc

SEQ ID NO: 521588 - DNA, 25 bp, Rattus norvegicus
agggacttccgctacgtcttgcgtc

SEQ ID NO: 521589 - DNA, 25 bp, Rattus norvegicus
cagacatggtgtcggtggattcacc

SEQ ID NO: 521590 - DNA, 25 bp, Rattus norvegicus
gtcaaggttaagctactttcctgga

SEQ ID NO: 521591 - DNA, 25 bp, Rattus norvegicus
aaccgctaggtcttcagcggggccg

SEQ ID NO: 521592 - DNA, 25 bp, Rattus norvegicus
gcgggagatgaaatcgtcaaggtta

SEQ ID NO: 521593 - DNA, 25 bp, Rattus norvegicus
ccatgttggtcctatttgaaacgtc

SEQ ID NO: 521594 - DNA, 25 bp, Rattus norvegicus
gcgatatcttgagaccgccttcttc

SEQ ID NO: 521595 - DNA, 25 bp, Rattus norvegicus
ggaaatgacctcacgctctgcggca

SEQ ID NO: 521596 - DNA, 25 bp, Rattus norvegicus
cgctctgcggcattaatcgaccgga

SEQ ID NO: 521597 - DNA, 25 bp, Rattus norvegicus
atcgaccggaagtgacgttgacatc

SEQ ID NO: 521598 - DNA, 25 bp, Rattus norvegicus
tgacgttgacatcccagaatccttg

SEQ ID NO: 521599 - DNA, 25 bp, Rattus norvegicus
ccttggagaaggagactttcgtatt

SEQ ID NO: 521600 - DNA, 25 bp, Rattus norvegicus
tcgtatttgctgctccatgcggaga

SEQ ID NO: 521601 - DNA, 25 bp, Rattus norvegicus
gaacgtctaggcaacgtggtctccc

SEQ ID NO: 521602 - DNA, 25 bp, Rattus norvegicus
gcaaaggcgtttgcgcttcccagcg

SEQ ID NO: 521603 - DNA, 25 bp, Rattus norvegicus
cttcccagcgtctgaggcctaggga

SEQ ID NO: 521604 - DNA, 25 bp, Rattus norvegicus
gcctagggagccttcagtagccgaa

SEQ ID NO: 521605 - DNA, 25 bp, Rattus norvegicus
cagtagccgaaagttagtcttttgc

SEQ ID NO: 521606 - DNA, 25 bp, Rattus norvegicus
cccggatctggcctcaccatgttgg

SEQ ID NO: 521607 - DNA, 25 bp, Rattus norvegicus
ctcagggtgtttcgcaagctctgct

SEQ ID NO: 521608 - DNA, 25 bp, Rattus norvegicus
ctcggttgggattctcagggaaatc

SEQ ID NO: 521609 - DNA, 25 bp, Rattus norvegicus
gaggaagcgcccgatgctacaaaca

SEQ ID NO: 521610 - DNA, 25 bp, Rattus norvegicus
tgctacaaacaacggcagcgtgcct

SEQ ID NO: 521611 - DNA, 25 bp, Rattus norvegicus
gcgtgccttcgaggcttttcgccca

SEQ ID NO: 521612 - DNA, 25 bp, Rattus norvegicus
caccttcctgggtagcctttgacta

SEQ ID NO: 521613 - DNA, 25 bp, Rattus norvegicus
caaaaagattgtggccgcccttccg

SEQ ID NO: 521614 - DNA, 25 bp, Rattus norvegicus
ttccgtacacgcttgcacagatcgc

SEQ ID NO: 521615 - DNA, 25 bp, Rattus norvegicus
ctttgtgtctggtctgctcggaacc

SEQ ID NO: 521616 - DNA, 25 bp, Rattus norvegicus
gggactgtgattcgttcacgcaatc

SEQ ID NO: 521617 - DNA, 25 bp, Rattus norvegicus
ttcacgcaatcgacgggaggagacc

SEQ ID NO: 521618 - DNA, 25 bp, Rattus norvegicus
gaccgggctttcatggtggaattta

SEQ ID NO: 521619 - DNA, 25 bp, Rattus norvegicus
tttacttcaggcaagagcgaggggc

SEQ ID NO: 521620 - DNA, 25 bp, Rattus norvegicus
cacggcatccacgtgcggaacgttg

SEQ ID NO: 521621 - DNA, 25 bp, Rattus norvegicus
tgggcaccgtgtcgtcgcccagttc

SEQ ID NO: 521622 - DNA, 25 bp, Rattus norvegicus
cactattgttgatgaggagccgcgg

SEQ ID NO: 521623 - DNA, 25 bp, Rattus norvegicus
tggagcccgaagcagtcctccgcga

SEQ ID NO: 521624 - DNA, 25 bp, Rattus norvegicus
tgccgttccagctaaagcagcagca

SEQ ID NO: 521625 - DNA, 25 bp, Rattus norvegicus
ctatgagggcgacagtgccgttcca

SEQ ID NO: 521626 - DNA, 25 bp, Rattus norvegicus
ccgcttgcagcctatgagggcgaca

SEQ ID NO: 521627 - DNA, 25 bp, Rattus norvegicus
gtgaggcgcaatgggtctcccacgc

SEQ ID NO: 521628 - DNA, 25 bp, Rattus norvegicus
ctcttcccgaagtcaggcttcgtca

SEQ ID NO: 521629 - DNA, 25 bp, Rattus norvegicus
gcgggcctctttctctttaaagagc

SEQ ID NO: 521630 - DNA, 25 bp, Rattus norvegicus
gggagccgaccagcacgcagccaat

SEQ ID NO: 521631 - DNA, 25 bp, Rattus norvegicus
cgcagccaatcagcgagtccgaacg

SEQ ID NO: 521632 - DNA, 25 bp, Rattus norvegicus
agcgcgctgacgctgcaccaatgag

SEQ ID NO: 521633 - DNA, 25 bp, Rattus norvegicus
ggacaacggaggagacactattgtt

SEQ ID NO: 521634 - DNA, 25 bp, Rattus norvegicus
cctggagtggggactgcagcactcc

SEQ ID NO: 521635 - DNA, 25 bp, Rattus norvegicus
agaccctcgttgagccggggcatcc

SEQ ID NO: 521636 - DNA, 25 bp, Rattus norvegicus
gagatttaaacccgcggccctgcgc

SEQ ID NO: 521637 - DNA, 25 bp, Rattus norvegicus
tgcgcgctccggagtacctgtatcc

SEQ ID NO: 521638 - DNA, 25 bp, Rattus norvegicus
cctggctgtcgcttgccggtgagaa

SEQ ID NO: 521639 - DNA, 25 bp, Rattus norvegicus
gcgacgtacaaaggcggccaacagg

SEQ ID NO: 521640 - DNA, 25 bp, Rattus norvegicus
agtgacggacgccaggcgctgaacc

SEQ ID NO: 521641 - DNA, 25 bp, Rattus norvegicus
gcgctgaaccagagaccctcgttga

SEQ ID NO: 521642 - DNA, 25 bp, Rattus norvegicus
ggaagaccggcttggccttgcctcc

SEQ ID NO: 521643 - DNA, 25 bp, Rattus norvegicus
ttgtcgccactttgtactagggctc

SEQ ID NO: 521644 - DNA, 25 bp, Rattus norvegicus
cactttgtactagggctcagcgcga

SEQ ID NO: 521645 - DNA, 25 bp, Rattus norvegicus
ctcagcgcgaggcaaatgttcacgc

SEQ ID NO: 521646 - DNA, 25 bp, Rattus norvegicus
gccaacaggaaagcacgccgggctg

SEQ ID NO: 521647 - DNA, 25 bp, Rattus norvegicus
cacgccgggctgtgaacgtttgccc

SEQ ID NO: 521648 - DNA, 25 bp, Rattus norvegicus
atccggagctccaaggccggcctca

SEQ ID NO: 521649 - DNA, 25 bp, Rattus norvegicus
cctgcgcattgtggtggtctccacg

SEQ ID NO: 521650 - DNA, 25 bp, Rattus norvegicus
cgtcacctcctgaccctccggggct

SEQ ID NO: 521651 - DNA, 25 bp, Rattus norvegicus
tggcagagctgtccgcgcccacaga

SEQ ID NO: 521652 - DNA, 25 bp, Rattus norvegicus
agccagaggtctggcagagctgtcc

SEQ ID NO: 521653 - DNA, 25 bp, Rattus norvegicus
ccctctcgcgttgtggggctcactg

SEQ ID NO: 521654 - DNA, 25 bp, Rattus norvegicus
tttctcccttctgctacggcggact

SEQ ID NO: 521655 - DNA, 25 bp, Rattus norvegicus
tgaattttctcccttctgctacggc

SEQ ID NO: 521656 - DNA, 25 bp, Rattus norvegicus
ttgagtagtctcgttttgaattttc

SEQ ID NO: 521657 - DNA, 25 bp, Rattus norvegicus
ctcggagccaagacgaggttgagta

SEQ ID NO: 521658 - DNA, 25 bp, Rattus norvegicus
tcccggagagttgcgcctgcgcatt

SEQ ID NO: 521659 - DNA, 25 bp, Rattus norvegicus
aatctgatgagcctgcgctgcgcct

SEQ ID NO: 521660 - DNA, 25 bp, Rattus norvegicus
gtccaatctgatgagcctgcgctgc

SEQ ID NO: 521661 - DNA, 25 bp, Rattus norvegicus
ccgagacgggtccaatctgatgagc

SEQ ID NO: 521662 - DNA, 25 bp, Rattus norvegicus
agccaagacgaggttgagtagtctc

SEQ ID NO: 521663 - DNA, 25 bp, Rattus norvegicus
cctccttcctgagtgaaacctacgg

SEQ ID NO: 521664 - DNA, 25 bp, Rattus norvegicus
gggcgcctccttcctgagtgaaacc

SEQ ID NO: 521665 - DNA, 25 bp, Rattus norvegicus
ggcgcctccttcctgagtgaaacct

SEQ ID NO: 521666 - DNA, 25 bp, Rattus norvegicus
gcgcctccttcctgagtgaaaccta

SEQ ID NO: 521667 - DNA, 25 bp, Rattus norvegicus
gcctccttcctgagtgaaacctacg

SEQ ID NO: 521668 - DNA, 25 bp, Rattus norvegicus
tccttcctccgggaagaacctgcca

SEQ ID NO: 521669 - DNA, 25 bp, Rattus norvegicus
cggggctgggagcctccttcctccg

SEQ ID NO: 521670 - DNA, 25 bp, Rattus norvegicus
tgcgtggtggcacgcgcgggcaggg

SEQ ID NO: 521671 - DNA, 25 bp, Rattus norvegicus
ggggcgcctccttcctgagtgaaac

SEQ ID NO: 521672 - DNA, 25 bp, Rattus norvegicus
gcgtggtggcacgcgcgggcagggc

SEQ ID NO: 521673 - DNA, 25 bp, Rattus norvegicus
gtggtggcacgcgcgggcagggcgc

SEQ ID NO: 521674 - DNA, 25 bp, Rattus norvegicus
cagggcgcccgggattccgtctgcc

SEQ ID NO: 521675 - DNA, 25 bp, Rattus norvegicus
gcggggctgggagcctccttcctcc

SEQ ID NO: 521676 - DNA, 25 bp, Rattus norvegicus
ctgcgtggtggcacgcgcgggcagg

SEQ ID NO: 521677 - DNA, 25 bp, Rattus norvegicus
ccggcaggaattcgggcctcccaga

SEQ ID NO: 521678 - DNA, 25 bp, Rattus norvegicus
gagtgaaacctacggaatccggcag

SEQ ID NO: 521679 - DNA, 25 bp, Rattus norvegicus
atccggcaggaattcgggcctccca

SEQ ID NO: 521680 - DNA, 25 bp, Rattus norvegicus
gaatccggcaggaattcgggcctcc

SEQ ID NO: 521681 - DNA, 25 bp, Rattus norvegicus
ggaatccggcaggaattcgggcctc

SEQ ID NO: 521682 - DNA, 25 bp, Rattus norvegicus
cggaatccggcaggaattcgggcct

SEQ ID NO: 521683 - DNA, 25 bp, Rattus norvegicus
tacggaatccggcaggaattcgggc

SEQ ID NO: 521684 - DNA, 25 bp, Rattus norvegicus
tgaaacctacggaatccggcaggaa

SEQ ID NO: 521685 - DNA, 25 bp, Rattus norvegicus
gtgaaacctacggaatccggcagga

SEQ ID NO: 521686 - DNA, 25 bp, Rattus norvegicus
tccggcaggaattcgggcctcccag

SEQ ID NO: 521687 - DNA, 25 bp, Rattus norvegicus
acaaaggaaagattgtcagagaggg

SEQ ID NO: 521688 - DNA, 25 bp, Rattus norvegicus
aacaaaggaaagattgtcagagagg

SEQ ID NO: 521689 - DNA, 25 bp, Rattus norvegicus
gaattcgggcctcccagatttaaga

SEQ ID NO: 521690 - DNA, 25 bp, Rattus norvegicus
ggcaggaattcgggcctcccagatt

SEQ ID NO: 521691 - DNA, 25 bp, Rattus norvegicus
gcacgcctgacgtttgtctctcttg

SEQ ID NO: 521692 - DNA, 25 bp, Rattus norvegicus
taaatccggagaggccggaatgatt

SEQ ID NO: 521693 - DNA, 25 bp, Rattus norvegicus
cgcccgctcggcttgggagtgacac

SEQ ID NO: 521694 - DNA, 25 bp, Rattus norvegicus
agctaggcgcagtgctgcagcctga

SEQ ID NO: 521695 - DNA, 25 bp, Rattus norvegicus
cggggccgcgcttctgaagttgatt

SEQ ID NO: 521696 - DNA, 25 bp, Rattus norvegicus
ttctgaagttgattggcacgcctga

SEQ ID NO: 521697 - DNA, 25 bp, Rattus norvegicus
ctactgacctgagggtccaggctgg

SEQ ID NO: 521698 - DNA, 25 bp, Rattus norvegicus
ctgggagactactgacctgagggtc

SEQ ID NO: 521699 - DNA, 25 bp, Rattus norvegicus
tcctcgcgtccagctgggagactac

SEQ ID NO: 521700 - DNA, 25 bp, Rattus norvegicus
gacgtcagcacgttggtcctcgcgt

SEQ ID NO: 521701 - DNA, 25 bp, Rattus norvegicus
acgcctggcgaggaaagtaacgtct

SEQ ID NO: 521702 - DNA, 25 bp, Rattus norvegicus
ctctcttgttcttaacggggacgcg

SEQ ID NO: 521703 - DNA, 25 bp, Rattus norvegicus
gccggccctcagctgattcgcagag

SEQ ID NO: 521704 - DNA, 25 bp, Rattus norvegicus
caggctggctcggacccggttctca

SEQ ID NO: 521705 - DNA, 25 bp, Rattus norvegicus
cccggccaaaatgtccaggaggacg

SEQ ID NO: 521706 - DNA, 25 bp, Rattus norvegicus
ttgctgtcattagctaattgagccc

SEQ ID NO: 521707 - DNA, 25 bp, Rattus norvegicus
gagaaggctttgctgtcattagcta

SEQ ID NO: 521708 - DNA, 25 bp, Rattus norvegicus
accggagaaggctttgctgtcatta

SEQ ID NO: 521709 - DNA, 25 bp, Rattus norvegicus
tcagcgacaccggagaaggctttgc

SEQ ID NO: 521710 - DNA, 25 bp, Rattus norvegicus
tgctgcccaggggtcagcgacaccg

SEQ ID NO: 521711 - DNA, 25 bp, Rattus norvegicus
ggccgcagctgtataaataccgggg

SEQ ID NO: 521712 - DNA, 25 bp, Rattus norvegicus
gaggggccgcagctgtataaatacc

SEQ ID NO: 521713 - DNA, 25 bp, Rattus norvegicus
tccgccgagataacccagccaagcc

SEQ ID NO: 521714 - DNA, 25 bp, Rattus norvegicus
ggcggcggatctccgccgagataac

SEQ ID NO: 521715 - DNA, 25 bp, Rattus norvegicus
acggcgtgctaagccttttctttct

SEQ ID NO: 521716 - DNA, 25 bp, Rattus norvegicus
tgggacggcgtgctaagccttttct

SEQ ID NO: 521717 - DNA, 25 bp, Rattus norvegicus
ccagcccgagggctccagagaaggc

SEQ ID NO: 521718 - DNA, 25 bp, Rattus norvegicus
ttgagccccagatgttaagaaaagg

SEQ ID NO: 521719 - DNA, 25 bp, Rattus norvegicus
gattcgctgatatccggatgccacc

SEQ ID NO: 521720 - DNA, 25 bp, Rattus norvegicus
ctggacttcgccatcttcgccgtga

SEQ ID NO: 521721 - DNA, 25 bp, Rattus norvegicus
accgcggctccgattcgctgatatc

SEQ ID NO: 521722 - DNA, 25 bp, Rattus norvegicus
tgatatccggatgccacctccttct

SEQ ID NO: 521723 - DNA, 25 bp, Rattus norvegicus
aggaagcatgctggacttcgccatc

SEQ ID NO: 521724 - DNA, 25 bp, Rattus norvegicus
tcccgcgttccttgtgtgcggtacc

SEQ ID NO: 521725 - DNA, 25 bp, Rattus norvegicus
ccgtgcgcatgcgtgctctggtcgt

SEQ ID NO: 521726 - DNA, 25 bp, Rattus norvegicus
acattcggggttgcgcctgcgccgc

SEQ ID NO: 521727 - DNA, 25 bp, Rattus norvegicus
acctccgaggcgacattcggggttg

SEQ ID NO: 521728 - DNA, 25 bp, Rattus norvegicus
ccggtaacctccgaggcgacattcg

SEQ ID NO: 521729 - DNA, 25 bp, Rattus norvegicus
gcggtgctgtacctctacccggtaa

SEQ ID NO: 521730 - DNA, 25 bp, Rattus norvegicus
ccgtgacgttcctgctggcgctggt

SEQ ID NO: 521731 - DNA, 25 bp, Rattus norvegicus
catcttcgccgtgacgttcctgctg

SEQ ID NO: 521732 - DNA, 25 bp, Rattus norvegicus
acttcgccatcttcgccgtgacgtt

SEQ ID NO: 521733 - DNA, 25 bp, Rattus norvegicus
cagacctgagtcgtgtggtccgtga

SEQ ID NO: 521734 - DNA, 25 bp, Rattus norvegicus
gacaatcaccagagttacaacctta

SEQ ID NO: 521735 - DNA, 25 bp, Rattus norvegicus
agagctttgccgtttgaccgcagca

SEQ ID NO: 521736 - DNA, 25 bp, Rattus norvegicus
gaccgcagcagttctgtcaagcacg

SEQ ID NO: 521737 - DNA, 25 bp, Rattus norvegicus
gtcaagcacgacagcactgacaatc

SEQ ID NO: 521738 - DNA, 25 bp, Rattus norvegicus
gcaagtcacgtgcttcatgtcacca

SEQ ID NO: 521739 - DNA, 25 bp, Rattus norvegicus
ttcatgtcaccacagtgaggcgttc

SEQ ID NO: 521740 - DNA, 25 bp, Rattus norvegicus
cttagtgtccttggcgcagacctga

SEQ ID NO: 521741 - DNA, 25 bp, Rattus norvegicus
tggtccgtgacgaccgaatcttccc

SEQ ID NO: 521742 - DNA, 25 bp, Rattus norvegicus
ctggctcctcgatgtcctaaacgtg

SEQ ID NO: 521743 - DNA, 25 bp, Rattus norvegicus
tgtcctaaacgtggcataaatctcc

SEQ ID NO: 521744 - DNA, 25 bp, Rattus norvegicus
tctccacccgaattctgtgagtgtc

SEQ ID NO: 521745 - DNA, 25 bp, Rattus norvegicus
tgtgagtgtcctcgctctcttttgc

SEQ ID NO: 521746 - DNA, 25 bp, Rattus norvegicus
tgaggcgttctgcttcttagtgtcc

SEQ ID NO: 521747 - DNA, 25 bp, Rattus norvegicus
gctgtcctctcctgtcagtgttccg

SEQ ID NO: 521748 - DNA, 25 bp, Rattus norvegicus
tcttcgacagctacacgaacctgga

SEQ ID NO: 521749 - DNA, 25 bp, Rattus norvegicus
tctcctgtcagtgttccggatggcg

SEQ ID NO: 521750 - DNA, 25 bp, Rattus norvegicus
aactacatccaggtgcgacgcggcc

SEQ ID NO: 521751 - DNA, 25 bp, Rattus norvegicus
ccgcccggctaacaaaggctactga

SEQ ID NO: 521752 - DNA, 25 bp, Rattus norvegicus
ggctaacaaaggctactgaggactc

SEQ ID NO: 521753 - DNA, 25 bp, Rattus norvegicus
ctactgaggactcccagagcctgga

SEQ ID NO: 521754 - DNA, 25 bp, Rattus norvegicus
tcccgtcgctaggagacgccggaag

SEQ ID NO: 521755 - DNA, 25 bp, Rattus norvegicus
tgcagctcgctcctcccgattcccg

SEQ ID NO: 521756 - DNA, 25 bp, Rattus norvegicus
cgggctctcttcgacagctacacga

SEQ ID NO: 521757 - DNA, 25 bp, Rattus norvegicus
cagctacacgaacctggagcgggtg

SEQ ID NO: 521758 - DNA, 25 bp, Rattus norvegicus
gccgactactgcgagaacaactaca

SEQ ID NO: 521759 - DNA, 25 bp, Rattus norvegicus
ggtggccgactactgcgagaacaac

SEQ ID NO: 521760 - DNA, 25 bp, Rattus norvegicus
tgcgagaacaactacatccaggtgc

SEQ ID NO: 521761 - DNA, 25 bp, Rattus norvegicus
tggtcgggctcagcccaacgccaag

SEQ ID NO: 521762 - DNA, 25 bp, Rattus norvegicus
taggtctcattgtctgcacggtgca

SEQ ID NO: 521763 - DNA, 25 bp, Rattus norvegicus
tcccgaacgctgagagcgaccgcag

SEQ ID NO: 521764 - DNA, 25 bp, Rattus norvegicus
ggaaaatggagacggcagcgccttc

SEQ ID NO: 521765 - DNA, 25 bp, Rattus norvegicus
cttcggagcacccagatctctgtct

SEQ ID NO: 521766 - DNA, 25 bp, Rattus norvegicus
tgtctcccggacctcgagggccagg

SEQ ID NO: 521767 - DNA, 25 bp, Rattus norvegicus
aggcgtcggagcactcaccgcggca

SEQ ID NO: 521768 - DNA, 25 bp, Rattus norvegicus
ctgactgaccgacccacagagcggg

SEQ ID NO: 521769 - DNA, 25 bp, Rattus norvegicus
tttcctgcgcgcgtccttgtgagcc

SEQ ID NO: 521770 - DNA, 25 bp, Rattus norvegicus
gtgagccgcctccaggaaccaatga

SEQ ID NO: 521771 - DNA, 25 bp, Rattus norvegicus
agcctgcccaattgcttcggtccga

SEQ ID NO: 521772 - DNA, 25 bp, Rattus norvegicus
gccaccagcgccctagtgctgagta

SEQ ID NO: 521773 - DNA, 25 bp, Rattus norvegicus
cccaggcggacctaggtctcattgt

SEQ ID NO: 521774 - DNA, 25 bp, Rattus norvegicus
agtgctgagtatcagccctgccgca

SEQ ID NO: 521775 - DNA, 25 bp, Rattus norvegicus
accattcacagcagaggacgcggga

SEQ ID NO: 521776 - DNA, 25 bp, Rattus norvegicus
acacgtgggagtacaccgcagcacc

SEQ ID NO: 521777 - DNA, 25 bp, Rattus norvegicus
tacacgtgggagtacaccgcagcac

SEQ ID NO: 521778 - DNA, 25 bp, Rattus norvegicus
gtacatgtgggagtacaccgcacca

SEQ ID NO: 521779 - DNA, 25 bp, Rattus norvegicus
gcaccaccattcacagcagaggacg

SEQ ID NO: 521780 - DNA, 25 bp, Rattus norvegicus
tacacgtgggagtacaccgtagcac

SEQ ID NO: 521781 - DNA, 25 bp, Rattus norvegicus
gacgcgggagtacatcgcaccacca

SEQ ID NO: 521782 - DNA, 25 bp, Rattus norvegicus
agtacatgtgggagtacaccgcacc

SEQ ID NO: 521783 - DNA, 25 bp, Rattus norvegicus
cacgtgggagtacaccgtagcacca

SEQ ID NO: 521784 - DNA, 25 bp, Rattus norvegicus
gacacgggagtacatcgcaccacca

SEQ ID NO: 521785 - DNA, 25 bp, Rattus norvegicus
aggacacgggagtacaccgcaccac

SEQ ID NO: 521786 - DNA, 25 bp, Rattus norvegicus
gaggacacgggagtacatcgcacca

SEQ ID NO: 521787 - DNA, 25 bp, Rattus norvegicus
accactcacagcagaggacgcggga

SEQ ID NO: 521788 - DNA, 25 bp, Rattus norvegicus
tcacagcagaggacaccggagtaca

SEQ ID NO: 521789 - DNA, 25 bp, Rattus norvegicus
gggccgcgcccgcagtttcactttg

SEQ ID NO: 521790 - DNA, 25 bp, Rattus norvegicus
ataagtgtcctaggccacgcacctg

SEQ ID NO: 521791 - DNA, 25 bp, Rattus norvegicus
cgctgcagcggtacctgaagacccg

SEQ ID NO: 521792 - DNA, 25 bp, Rattus norvegicus
gagccggcgcaaaagtttcctccca

SEQ ID NO: 521793 - DNA, 25 bp, Rattus norvegicus
ggccagctgcgcgtcagcgagctca

SEQ ID NO: 521794 - DNA, 25 bp, Rattus norvegicus
gtgccctgcaaggacggccagctgc

SEQ ID NO: 521795 - DNA, 25 bp, Rattus norvegicus
ggaccggcatcgtggtgccctgcaa

SEQ ID NO: 521796 - DNA, 25 bp, Rattus norvegicus
caggatgaaagtgacagtgtgcttc

SEQ ID NO: 521797 - DNA, 25 bp, Rattus norvegicus
gacagcgtcgtatccgcctcaggtc

SEQ ID NO: 521798 - DNA, 25 bp, Rattus norvegicus
ggcacgcgccagacagcgtcgtatc

SEQ ID NO: 521799 - DNA, 25 bp, Rattus norvegicus
cagtttcactttggcgcgtggagcc

SEQ ID NO: 521800 - DNA, 25 bp, Rattus norvegicus
ggggctcactttataagtgtcctag

SEQ ID NO: 521801 - DNA, 25 bp, Rattus norvegicus
tggcccggggcaacaccttggagct

SEQ ID NO: 521802 - DNA, 25 bp, Rattus norvegicus
ggcgcgtggagcctctgactgcacc

SEQ ID NO: 521803 - DNA, 25 bp, Rattus norvegicus
ccacatgctgctcggcctgaaaagg

SEQ ID NO: 521804 - DNA, 25 bp, Rattus norvegicus
agaagactaagagccgggcgcctga

SEQ ID NO: 521805 - DNA, 25 bp, Rattus norvegicus
gcgaactcggagagccgctcgcaca

SEQ ID NO: 521806 - DNA, 25 bp, Rattus norvegicus
cggcacatcctcagaagcacagaca

SEQ ID NO: 521807 - DNA, 25 bp, Rattus norvegicus
cctccagagactggccaagcgggtg

SEQ ID NO: 521808 - DNA, 25 bp, Rattus norvegicus
gcggctctgacatccacatgctgct

SEQ ID NO: 521809 - DNA, 25 bp, Rattus norvegicus
gcgcgtaatcggatcgctctgccgc

SEQ ID NO: 521810 - DNA, 25 bp, Rattus norvegicus
ccgcggctgcctctttaatcaggaa

SEQ ID NO: 521811 - DNA, 25 bp, Rattus norvegicus
ccttaactttgatcgcgcggtcgca

SEQ ID NO: 521812 - DNA, 25 bp, Rattus norvegicus
gcagggtggtgtggcaccttaactt

SEQ ID NO: 521813 - DNA, 25 bp, Rattus norvegicus
tccttgctccgggtgtgacagacac

SEQ ID NO: 521814 - DNA, 25 bp, Rattus norvegicus
tcggagtttccctgcggcaagagca

SEQ ID NO: 521815 - DNA, 25 bp, Rattus norvegicus
tctcggaatttggtggggaacaaga

SEQ ID NO: 521816 - DNA, 25 bp, Rattus norvegicus
agaagcacagacactcggcccggcg

SEQ ID NO: 521817 - DNA, 25 bp, Rattus norvegicus
ccctggagaactggcatgtagaagc

SEQ ID NO: 521818 - DNA, 25 bp, Rattus norvegicus
aagacttggggaccatctcctatcc

SEQ ID NO: 521819 - DNA, 25 bp, Rattus norvegicus
cgaaagattccggtgctagcctggc

SEQ ID NO: 521820 - DNA, 25 bp, Rattus norvegicus
tggaaggccctgtgggcaccataca

SEQ ID NO: 521821 - DNA, 25 bp, Rattus norvegicus
cccgcaactgagctggtccgcagta

SEQ ID NO: 521822 - DNA, 25 bp, Rattus norvegicus
gctagacctctgactcaccctatga

SEQ ID NO: 521823 - DNA, 25 bp, Rattus norvegicus
catctgtccctaagcgctgcgtgga

SEQ ID NO: 521824 - DNA, 25 bp, Rattus norvegicus
gcatgtgtgtacgacacccgctcga

SEQ ID NO: 521825 - DNA, 25 bp, Rattus norvegicus
atccctggtcttactgcgtcacttc

SEQ ID NO: 521826 - DNA, 25 bp, Rattus norvegicus
gcgaagaagctcatcacccactaag

SEQ ID NO: 521827 - DNA, 25 bp, Rattus norvegicus
ggacccgcccggactagatattatc

SEQ ID NO: 521828 - DNA, 25 bp, Rattus norvegicus
ctccggtcatgttttcagtccaaaa

SEQ ID NO: 521829 - DNA, 25 bp, Rattus norvegicus
aattggtaccgggagacctagcctg

SEQ ID NO: 521830 - DNA, 25 bp, Rattus norvegicus
ttggcagcctaagccgcaggaatgc

SEQ ID NO: 521831 - DNA, 25 bp, Rattus norvegicus
gggtactgccgtacagtccctactc

SEQ ID NO: 521832 - DNA, 25 bp, Rattus norvegicus
cgcccagtcgctaataaagctaaga

SEQ ID NO: 521833 - DNA, 25 bp, Rattus norvegicus
tcaccctttcattctccgcccgcgg

SEQ ID NO: 521834 - DNA, 25 bp, Rattus norvegicus
cccgaacgcccagtcgctaataaag

SEQ ID NO: 521835 - DNA, 25 bp, Rattus norvegicus
cccggcctcacgtaagcgcgctcgc

SEQ ID NO: 521836 - DNA, 25 bp, Rattus norvegicus
gcggagtaccttgaacggacaggaa

SEQ ID NO: 521837 - DNA, 25 bp, Rattus norvegicus
taccttgaacggacaggaactggca

SEQ ID NO: 521838 - DNA, 25 bp, Rattus norvegicus
cggacaggaactggcaaagagtttc

SEQ ID NO: 521839 - DNA, 25 bp, Rattus norvegicus
gcaaagagtttcgagccagccgagt

SEQ ID NO: 521840 - DNA, 25 bp, Rattus norvegicus
accggggctccccagagagaaggca

SEQ ID NO: 521841 - DNA, 25 bp, Rattus norvegicus
cgcggctgcacctgactcctcgccg

SEQ ID NO: 521842 - DNA, 25 bp, Rattus norvegicus
cccacgcatgacaggccgcccgccc

SEQ ID NO: 521843 - DNA, 25 bp, Rattus norvegicus
ccagcgcaggatgcagcccgccagc

SEQ ID NO: 521844 - DNA, 25 bp, Rattus norvegicus
agtttcgagccagccgagtgctctc

SEQ ID NO: 521845 - DNA, 25 bp, Rattus norvegicus
aggctgagacctcactaacccgagg

SEQ ID NO: 521846 - DNA, 25 bp, Rattus norvegicus
gacgctccagctctttcaggagtgc

SEQ ID NO: 521847 - DNA, 25 bp, Rattus norvegicus
tctttcaggagtgcctcagcagcgc

SEQ ID NO: 521848 - DNA, 25 bp, Rattus norvegicus
ggctccatgggctccctggatgcac

SEQ ID NO: 521849 - DNA, 25 bp, Rattus norvegicus
ctccctggatgcacctcgttgggga

SEQ ID NO: 521850 - DNA, 25 bp, Rattus norvegicus
gatgcacctcgttggggacaagcga

SEQ ID NO: 521851 - DNA, 25 bp, Rattus norvegicus
gacaagcgaggagcaccgaggactc

SEQ ID NO: 521852 - DNA, 25 bp, Rattus norvegicus
ctgctgcgccggagagaagactaaa

SEQ ID NO: 521853 - DNA, 25 bp, Rattus norvegicus
cggagtcacgcaccaggctgagacc

SEQ ID NO: 521854 - DNA, 25 bp, Rattus norvegicus
tcactaacccgaggtcaccgtgaga

SEQ ID NO: 521855 - DNA, 25 bp, Rattus norvegicus
caccgtgagaggcacggggtacctt

SEQ ID NO: 521856 - DNA, 25 bp, Rattus norvegicus
acggggtaccttctgccacgcacag

SEQ ID NO: 521857 - DNA, 25 bp, Rattus norvegicus
atggcgcagtccacaccgtggcgct

SEQ ID NO: 521858 - DNA, 25 bp, Rattus norvegicus
gagaagactaaacgcccggagagga

SEQ ID NO: 521859 - DNA, 25 bp, Rattus norvegicus
agccaactgacacacccagggaagg

SEQ ID NO: 521860 - DNA, 25 bp, Rattus norvegicus
gcggtctcagtagcctccgcccttc

SEQ ID NO: 521861 - DNA, 25 bp, Rattus norvegicus
cggagtgtccctcactcgaggaggc

SEQ ID NO: 521862 - DNA, 25 bp, Rattus norvegicus
tcgaggaggctcgaccagaagttga

SEQ ID NO: 521863 - DNA, 25 bp, Rattus norvegicus
gaccagaagttgattccaagcgccc

SEQ ID NO: 521864 - DNA, 25 bp, Rattus norvegicus
gaagttgattccaagcgccctcctc

SEQ ID NO: 521865 - DNA, 25 bp, Rattus norvegicus
gtctgggaaagccaactgacacacc

SEQ ID NO: 521866 - DNA, 25 bp, Rattus norvegicus
tcaactgcagctagatgaaagctcg

SEQ ID NO: 521867 - DNA, 25 bp, Rattus norvegicus
ctagatgaaagctcgagtccgcctc

SEQ ID NO: 521868 - DNA, 25 bp, Rattus norvegicus
agtccgcctcggtaccggggcatct

SEQ ID NO: 521869 - DNA, 25 bp, Rattus norvegicus
gcatctgggactgcgtgcgacgaac

SEQ ID NO: 521870 - DNA, 25 bp, Rattus norvegicus
gtgcgacgaactgtcggctgccatc

SEQ ID NO: 521871 - DNA, 25 bp, Rattus norvegicus
cctgtaccgaggctgcatcctgggc

SEQ ID NO: 521872 - DNA, 25 bp, Rattus norvegicus
tgacctctgcctcgcctgggtctgg

SEQ ID NO: 521873 - DNA, 25 bp, Rattus norvegicus
agggaaacgcctccgtctctatata

SEQ ID NO: 521874 - DNA, 25 bp, Rattus norvegicus
ccctctttggacctgttcggcaatt

SEQ ID NO: 521875 - DNA, 25 bp, Rattus norvegicus
aacttggacctgcagttccgccgga

SEQ ID NO: 521876 - DNA, 25 bp, Rattus norvegicus
ccttgaggccgaatgctttcgttca

SEQ ID NO: 521877 - DNA, 25 bp, Rattus norvegicus
tgtaactacgttcagccggttcttc

SEQ ID NO: 521878 - DNA, 25 bp, Rattus norvegicus
cctttaacctctagccggtgcagtg

SEQ ID NO: 521879 - DNA, 25 bp, Rattus norvegicus
gggcttctagcgctcttttcctccg

SEQ ID NO: 521880 - DNA, 25 bp, Rattus norvegicus
cggttacagtcgacgccatgggttt

SEQ ID NO: 521881 - DNA, 25 bp, Rattus norvegicus
cggcctccaggtgctcaacgattac

SEQ ID NO: 521882 - DNA, 25 bp, Rattus norvegicus
tacctggcggacaagagctacattg

SEQ ID NO: 521883 - DNA, 25 bp, Rattus norvegicus
agccgagttaggtctcccgagtctc

SEQ ID NO: 521884 - DNA, 25 bp, Rattus norvegicus
gggctgccagcgcaataattgaaat

SEQ ID NO: 521885 - DNA, 25 bp, Rattus norvegicus
aatgcttgctctccgtgtaactacg

SEQ ID NO: 521886 - DNA, 25 bp, Rattus norvegicus
cgacctgtgggtcgtctaattcaca

SEQ ID NO: 521887 - DNA, 25 bp, Rattus norvegicus
gcccgctggagaccagatcaggctt

SEQ ID NO: 521888 - DNA, 25 bp, Rattus norvegicus
agccgggagtcgtggagtcacccgc

SEQ ID NO: 521889 - DNA, 25 bp, Rattus norvegicus
cttggagccagtgtcccgagccgag

SEQ ID NO: 521890 - DNA, 25 bp, Rattus norvegicus
gtgcccagcagcctcgtattcgtcg

SEQ ID NO: 521891 - DNA, 25 bp, Rattus norvegicus
gcgtgcccagcagcctcgtattcgt

SEQ ID NO: 521892 - DNA, 25 bp, Rattus norvegicus
gctggttttcgttagcccgccgagc

SEQ ID NO: 521893 - DNA, 25 bp, Rattus norvegicus
cagctggttttcgttagcccgccga

SEQ ID NO: 521894 - DNA, 25 bp, Rattus norvegicus
cgcgcggggttcaaaccagctggtt

SEQ ID NO: 521895 - DNA, 25 bp, Rattus norvegicus
gtcacgcgcggggttcaaaccagct

SEQ ID NO: 521896 - DNA, 25 bp, Rattus norvegicus
ccagtgtcccgagccgagcgggtca

SEQ ID NO: 521897 - DNA, 25 bp, Rattus norvegicus
ctggagaccagatcaggcttggagc

SEQ ID NO: 521898 - DNA, 25 bp, Rattus norvegicus
cgaagaggttgagcctcgaggaacg

SEQ ID NO: 521899 - DNA, 25 bp, Rattus norvegicus
atcaggcttggagccagtgtcccga

SEQ ID NO: 521900 - DNA, 25 bp, Rattus norvegicus
ccagatcaggcttggagccagtgtc

SEQ ID NO: 521901 - DNA, 25 bp, Rattus norvegicus
ccgcgcgaggtatttggcgccacct

SEQ ID NO: 521902 - DNA, 25 bp, Rattus norvegicus
gttaacgatctctttgctgccgtcg

SEQ ID NO: 521903 - DNA, 25 bp, Rattus norvegicus
tgagtgtgtgcgtgttaacgatctc

SEQ ID NO: 521904 - DNA, 25 bp, Rattus norvegicus
ttttgctggggactgtcgatgctgc

SEQ ID NO: 521905 - DNA, 25 bp, Rattus norvegicus
tttctcgccgcggagttttgctggg

SEQ ID NO: 521906 - DNA, 25 bp, Rattus norvegicus
gtatttggcgccacctgtccacaca

SEQ ID NO: 521907 - DNA, 25 bp, Rattus norvegicus
cagcgtagacggctcgcctgggctc

SEQ ID NO: 521908 - DNA, 25 bp, Rattus norvegicus
tttcctgcccgggagcagcgtagac

SEQ ID NO: 521909 - DNA, 25 bp, Rattus norvegicus
agctctgttccttcgctccggtcgg

SEQ ID NO: 521910 - DNA, 25 bp, Rattus norvegicus
cgcctgcaggaagtgtgcgctttaa

SEQ ID NO: 521911 - DNA, 25 bp, Rattus norvegicus
cgttcgcaccttcgctgacgtcaga

SEQ ID NO: 521912 - DNA, 25 bp, Rattus norvegicus
cttcgctgacgtcagagctgcagtg

SEQ ID NO: 521913 - DNA, 25 bp, Rattus norvegicus
agcccgagaccagtcgcgactcgga

SEQ ID NO: 521914 - DNA, 25 bp, Rattus norvegicus
gcttcgggacgcttcgagggtcctc

SEQ ID NO: 521915 - DNA, 25 bp, Rattus norvegicus
agagcatcagcatccgcacccgaaa

SEQ ID NO: 521916 - DNA, 25 bp, Rattus norvegicus
gggctccctcactcgagcatgcgca

SEQ ID NO: 521917 - DNA, 25 bp, Rattus norvegicus
atggccggtgccctttgcgttgcct

SEQ ID NO: 521918 - DNA, 25 bp, Rattus norvegicus
cctgccgcctgctcctcgtccttct

SEQ ID NO: 521919 - DNA, 25 bp, Rattus norvegicus
atgagccatgaagccgcccggcagc

SEQ ID NO: 521920 - DNA, 25 bp, Rattus norvegicus
cccgggagcgatgagccatgaagcc

SEQ ID NO: 521921 - DNA, 25 bp, Rattus norvegicus
cagcccggcgctctcgcgggtcact

SEQ ID NO: 521922 - DNA, 25 bp, Rattus norvegicus
cagcctggccttcgagcgcctccct

SEQ ID NO: 521923 - DNA, 25 bp, Rattus norvegicus
tcagcatcctcaggcccggcagcaa

SEQ ID NO: 521924 - DNA, 25 bp, Rattus norvegicus
cagcatctgcaagagcatcagcatc

SEQ ID NO: 521925 - DNA, 25 bp, Rattus norvegicus
cacgcaggtgcgtgtaccccggacg

SEQ ID NO: 521926 - DNA, 25 bp, Rattus norvegicus
gcggcccatgcaggctacagcatca

SEQ ID NO: 521927 - DNA, 25 bp, Rattus norvegicus
atgcaggctacagcatcagcatctg

SEQ ID NO: 521928 - DNA, 25 bp, Rattus norvegicus
cccgcagtcactggtgcggccgcgc

SEQ ID NO: 521929 - DNA, 25 bp, Rattus norvegicus
cataagcggaatcgtgggcagtatc

SEQ ID NO: 521930 - DNA, 25 bp, Rattus norvegicus
gaacgtcaccagacgcgccgcttga

SEQ ID NO: 521931 - DNA, 25 bp, Rattus norvegicus
taaccgaggccgaactgcccgagta

SEQ ID NO: 521932 - DNA, 25 bp, Rattus norvegicus
tctcgagcaggaagaatatcgcttc

SEQ ID NO: 521933 - DNA, 25 bp, Rattus norvegicus
cgtgtgtagtcacggggttctgttc

SEQ ID NO: 521934 - DNA, 25 bp, Rattus norvegicus
tggcaagtaagcataagcggaatcg

SEQ ID NO: 521935 - DNA, 25 bp, Rattus norvegicus
cgcttgaggcggaactgtcatggct

SEQ ID NO: 521936 - DNA, 25 bp, Rattus norvegicus
gggcagtatcgtagtattcttttta

SEQ ID NO: 521937 - DNA, 25 bp, Rattus norvegicus
agtttgagaagtgacctcgttctta

SEQ ID NO: 521938 - DNA, 25 bp, Rattus norvegicus
ttcttaagtttagggcgatgcgttg

SEQ ID NO: 521939 - DNA, 25 bp, Rattus norvegicus
cccatttgcggaaggacgctggctc

SEQ ID NO: 521940 - DNA, 25 bp, Rattus norvegicus
cgggatcttgatgaacctggctgat

SEQ ID NO: 521941 - DNA, 25 bp, Rattus norvegicus
cctggctgattgtagattctcgagc

SEQ ID NO: 521942 - DNA, 25 bp, Rattus norvegicus
tctgttctaaggtgagtggatggca

SEQ ID NO: 521943 - DNA, 25 bp, Rattus norvegicus
ttgctgcgacacttgcgctggctcc

SEQ ID NO: 521944 - DNA, 25 bp, Rattus norvegicus
ccgtgcatatccgagggaacgggtt

SEQ ID NO: 521945 - DNA, 25 bp, Rattus norvegicus
cccagtcctgggttaggatgcctcc

SEQ ID NO: 521946 - DNA, 25 bp, Rattus norvegicus
ggcaagtagctctttgtactcggca

SEQ ID NO: 521947 - DNA, 25 bp, Rattus norvegicus
gtactcggcattcctgccaagcatg

SEQ ID NO: 521948 - DNA, 25 bp, Rattus norvegicus
gccaggctcagaacagcgtcacgta

SEQ ID NO: 521949 - DNA, 25 bp, Rattus norvegicus
cccacagggtgcagaaatgaagtgc

SEQ ID NO: 521950 - DNA, 25 bp, Rattus norvegicus
gaccctagctgcagggctcgtccga

SEQ ID NO: 521951 - DNA, 25 bp, Rattus norvegicus
ggcaagctatttttagagggctata

SEQ ID NO: 521952 - DNA, 25 bp, Rattus norvegicus
ttacaaggcggtacaaggcaagcta

SEQ ID NO: 521953 - DNA, 25 bp, Rattus norvegicus
tgcggatctccctgctgccttacaa

SEQ ID NO: 521954 - DNA, 25 bp, Rattus norvegicus
gtcactgaggaccaatgcggcactc

SEQ ID NO: 521955 - DNA, 25 bp, Rattus norvegicus
gccgcgtgtgaccatgtaaggtaaa

SEQ ID NO: 521956 - DNA, 25 bp, Rattus norvegicus
caatggcagagaacaaaggcgagct

SEQ ID NO: 521957 - DNA, 25 bp, Rattus norvegicus
aggataggaccgttcctccagaacg

SEQ ID NO: 521958 - DNA, 25 bp, Rattus norvegicus
cagtgacggaggagcttgtaccacc

SEQ ID NO: 521959 - DNA, 25 bp, Rattus norvegicus
ctccacccgccatagcgaggatagg

SEQ ID NO: 521960 - DNA, 25 bp, Rattus norvegicus
ctccagaacgggtcttaatccgcct

SEQ ID NO: 521961 - DNA, 25 bp, Rattus norvegicus
tgcccggaagaagccgaaggctttc

SEQ ID NO: 521962 - DNA, 25 bp, Rattus norvegicus
tttcggtaggttccgcaagtagcgc

SEQ ID NO: 521963 - DNA, 25 bp, Rattus norvegicus
ctctcgagcggctccgggtcgagct

SEQ ID NO: 521964 - DNA, 25 bp, Rattus norvegicus
gtcgagctcggctgtttccgtgagt

SEQ ID NO: 521965 - DNA, 25 bp, Rattus norvegicus
tgagtggccgctgcgcactcggcac

SEQ ID NO: 521966 - DNA, 25 bp, Rattus norvegicus
ccgggccgcgaacgaaagcagtgac

SEQ ID NO: 521967 - DNA, 25 bp, Rattus norvegicus
tgtaccaccggtaagaggagcagga

SEQ ID NO: 521968 - DNA, 25 bp, Rattus norvegicus
gccgcggtaaagatggagcctccgc

SEQ ID NO: 521969 - DNA, 25 bp, Rattus norvegicus
cagcgaacaaagaataatggcggcg

SEQ ID NO: 521970 - DNA, 25 bp, Rattus norvegicus
taaaactccagcgagatccgggccg

SEQ ID NO: 521971 - DNA, 25 bp, Rattus norvegicus
tgccttgcgagggagaaacgccacc

SEQ ID NO: 521972 - DNA, 25 bp, Rattus norvegicus
ttttgaaccgaaccacgtgcagccg

SEQ ID NO: 521973 - DNA, 25 bp, Rattus norvegicus
tgagcatctctaaccaaggcgcggg

SEQ ID NO: 521974 - DNA, 25 bp, Rattus norvegicus
tgggaaaatcaccactgagcatctc

SEQ ID NO: 521975 - DNA, 25 bp, Rattus norvegicus
tcggtggccatgaagtgggaaaatc

SEQ ID NO: 521976 - DNA, 25 bp, Rattus norvegicus
gccggcaacgttggctcccacggat

SEQ ID NO: 521977 - DNA, 25 bp, Rattus norvegicus
accggctgagctcttggttcgatct

SEQ ID NO: 521978 - DNA, 25 bp, Rattus norvegicus
acctcgtcgcttaaaggccagattg

SEQ ID NO: 521979 - DNA, 25 bp, Rattus norvegicus
ctcacggttccgagaggttacgcgc

SEQ ID NO: 521980 - DNA, 25 bp, Rattus norvegicus
tgatgcccacgaaagagtcccgaga

SEQ ID NO: 521981 - DNA, 25 bp, Rattus norvegicus
cgatactggtcaacaacgcgcggga

SEQ ID NO: 521982 - DNA, 25 bp, Rattus norvegicus
ccacctcggtgcgtgctttcctgat

SEQ ID NO: 521983 - DNA, 25 bp, Rattus norvegicus
ttcgatcttgcggttagccggcaac

SEQ ID NO: 521984 - DNA, 25 bp, Rattus norvegicus
gcggcgccaccaatatggatgctca

SEQ ID NO: 521985 - DNA, 25 bp, Rattus norvegicus
atagggcacgtcgagctcggttcca

SEQ ID NO: 521986 - DNA, 25 bp, Rattus norvegicus
cctggggccaatcggaaatgctggt

SEQ ID NO: 521987 - DNA, 25 bp, Rattus norvegicus
gatgacagaggcctcgattggactg

SEQ ID NO: 521988 - DNA, 25 bp, Rattus norvegicus
cgagctctcagacctggatgacaga

SEQ ID NO: 521989 - DNA, 25 bp, Rattus norvegicus
gggaccgatcctgaacgagctctca

SEQ ID NO: 521990 - DNA, 25 bp, Rattus norvegicus
aaggctagccctttagggcttctgc

SEQ ID NO: 521991 - DNA, 25 bp, Rattus norvegicus
ggctatcacctgaaagccaaggcta

SEQ ID NO: 521992 - DNA, 25 bp, Rattus norvegicus
tggcgggaagagaatggctatcacc

SEQ ID NO: 521993 - DNA, 25 bp, Rattus norvegicus
ttcgaagacatctccgggtgacggg

SEQ ID NO: 521994 - DNA, 25 bp, Rattus norvegicus
ttcctgctaggccttcgaagacatc

SEQ ID NO: 521995 - DNA, 25 bp, Rattus norvegicus
gtcgggccacagtgaagttcctgct

SEQ ID NO: 521996 - DNA, 25 bp, Rattus norvegicus
tttagccaaagatgcgcctggatgg

SEQ ID NO: 521997 - DNA, 25 bp, Rattus norvegicus
tgcagggactctttagccaaagatg

SEQ ID NO: 521998 - DNA, 25 bp, Rattus norvegicus
ggtgcctcattcctggtcctgcaga

SEQ ID NO: 521999 - DNA, 25 bp, Rattus norvegicus
gctgcaaagtgactaatgaagtctg

SEQ ID NO: 522000 - DNA, 25 bp, Rattus norvegicus
cctgaaacttttgctgcaaagtgac

SEQ ID NO: 522001 - DNA, 25 bp, Rattus norvegicus
ggtttgatatcataatattcatatg

SEQ ID NO: 522002 - DNA, 25 bp, Rattus norvegicus
tgaaacttttgctgcaaagtgacta

SEQ ID NO: 522003 - DNA, 25 bp, Rattus norvegicus
caaagacctgaaacttttgctgcaa

SEQ ID NO: 522004 - DNA, 25 bp, Rattus norvegicus
acttttgctgcaaagtgactaatga

SEQ ID NO: 522005 - DNA, 25 bp, Rattus norvegicus
ttgctgcaaagtgactaatgaagtc

SEQ ID NO: 522006 - DNA, 25 bp, Rattus norvegicus
aagacctgaaacttttgctgcaaag

SEQ ID NO: 522007 - DNA, 25 bp, Rattus norvegicus
atcaaagacctgaaacttttgctgc

SEQ ID NO: 522008 - DNA, 25 bp, Rattus norvegicus
gacctgaaacttttgctgcaaagtg

SEQ ID NO: 522009 - DNA, 25 bp, Rattus norvegicus
actaatgaagtctggtttgatatca

SEQ ID NO: 522010 - DNA, 25 bp, Rattus norvegicus
aagtgactaatgaagtctggtttga

SEQ ID NO: 522011 - DNA, 25 bp, Rattus norvegicus
tgcaaagtgactaatgaagtctggt

SEQ ID NO: 522012 - DNA, 25 bp, Rattus norvegicus
tcataatattcatatgttattcaag

SEQ ID NO: 522013 - DNA, 25 bp, Rattus norvegicus
tcgaactccacgttgtcatcacagc

SEQ ID NO: 522014 - DNA, 25 bp, Rattus norvegicus
tccactcgaggatcagcgaggtctc

SEQ ID NO: 522015 - DNA, 25 bp, Rattus norvegicus
tgtcatcacagcgtgaacaggtcgc

SEQ ID NO: 522016 - DNA, 25 bp, Rattus norvegicus
gcgtgaacaggtcgccggacctcca

SEQ ID NO: 522017 - DNA, 25 bp, Rattus norvegicus
gctgccacggcacttcttacagata

SEQ ID NO: 522018 - DNA, 25 bp, Rattus norvegicus
ggcacttcttacagataacattata

SEQ ID NO: 522019 - DNA, 25 bp, Rattus norvegicus
ctcattcacattggagatcacaccc

SEQ ID NO: 522020 - DNA, 25 bp, Rattus norvegicus
tcaggcccagctgtcggggctcgaa

SEQ ID NO: 522021 - DNA, 25 bp, Rattus norvegicus
gaggatcagcgaggtctcattcaca

SEQ ID NO: 522022 - DNA, 25 bp, Rattus norvegicus
gaggtcatctcgtccgccaaggtcc

SEQ ID NO: 522023 - DNA, 25 bp, Rattus norvegicus
aaggaggtcatctcgtccgccaagg

SEQ ID NO: 522024 - DNA, 25 bp, Rattus norvegicus
cattataaaggaggtcatctcgtcc

SEQ ID NO: 522025 - DNA, 25 bp, Rattus norvegicus
ggggctcgaactccacgttgtcatc

SEQ ID NO: 522026 - DNA, 25 bp, Rattus norvegicus
agcgaggtctcattcacattggaga

SEQ ID NO: 522027 - DNA, 25 bp, Rattus norvegicus
agcgggccggcgtcgtgccaaggcc

SEQ ID NO: 522028 - DNA, 25 bp, Rattus norvegicus
cagggccatgctggcgctgacagag

SEQ ID NO: 522029 - DNA, 25 bp, Rattus norvegicus
tggaattgcgctgcgctcacggcca

SEQ ID NO: 522030 - DNA, 25 bp, Rattus norvegicus
agccgcggccagacgggcctgctgg

SEQ ID NO: 522031 - DNA, 25 bp, Rattus norvegicus
ggccaaggccgattgtttagtctgc

SEQ ID NO: 522032 - DNA, 25 bp, Rattus norvegicus
ccgccctaggtagcccagcgggccg

SEQ ID NO: 522033 - DNA, 25 bp, Rattus norvegicus
aattgcgctgcgctcacggccaagg

SEQ ID NO: 522034 - DNA, 25 bp, Rattus norvegicus
tctggaattgcgctgcgctcacggc

SEQ ID NO: 522035 - DNA, 25 bp, Rattus norvegicus
ggcatctggaattgcgctgcgctca

SEQ ID NO: 522036 - DNA, 25 bp, Rattus norvegicus
acgcggcatctggaattgcgctgcg

SEQ ID NO: 522037 - DNA, 25 bp, Rattus norvegicus
gcgacgcggcatctggaattgcgct

SEQ ID NO: 522038 - DNA, 25 bp, Rattus norvegicus
cgcggcccaattagcgctcggcgcg

SEQ ID NO: 522039 - DNA, 25 bp, Rattus norvegicus
gcgcccgcggcccaattagcgctcg

SEQ ID NO: 522040 - DNA, 25 bp, Rattus norvegicus
acggccaaggccgattgtttagtct

SEQ ID NO: 522041 - DNA, 25 bp, Rattus norvegicus
gaatggaaatcagagtccgcgcggc

SEQ ID NO: 522042 - DNA, 25 bp, Rattus norvegicus
cgtggagggaaatccaggtctgatt

SEQ ID NO: 522043 - DNA, 25 bp, Rattus norvegicus
aagcgcggcctcgagtaacaaactg

SEQ ID NO: 522044 - DNA, 25 bp, Rattus norvegicus
tcgagtaacaaactgccgcagctgc

SEQ ID NO: 522045 - DNA, 25 bp, Rattus norvegicus
gcagctgccaagctggagcccaact

SEQ ID NO: 522046 - DNA, 25 bp, Rattus norvegicus
ctcgcgatgaatggaaatcagagtc

SEQ ID NO: 522047 - DNA, 25 bp, Rattus norvegicus
gctttgtgagtcacgtgcctgggcc

SEQ ID NO: 522048 - DNA, 25 bp, Rattus norvegicus
attggctacccgtcaccaggtgacc

SEQ ID NO: 522049 - DNA, 25 bp, Rattus norvegicus
gcagtggctgcgtctcccagcgctt

SEQ ID NO: 522050 - DNA, 25 bp, Rattus norvegicus
ctgcgtctcccagcgcttgtcgggt

SEQ ID NO: 522051 - DNA, 25 bp, Rattus norvegicus
gctcagctcgcgatgaatggaaatc

SEQ ID NO: 522052 - DNA, 25 bp, Rattus norvegicus
aataagccgggctggtcgccgccct

SEQ ID NO: 522053 - DNA, 25 bp, Rattus norvegicus
gccctcgcagactagtccgctgtgg

SEQ ID NO: 522054 - DNA, 25 bp, Rattus norvegicus
gaaatccaggtctgattggctaccc

SEQ ID NO: 522055 - DNA, 25 bp, Rattus norvegicus
cttcctgccggagtatcctggcaca

SEQ ID NO: 522056 - DNA, 25 bp, Rattus norvegicus
ccggagtatcctggcacaggcctgg

SEQ ID NO: 522057 - DNA, 25 bp, Rattus norvegicus
cctgggcaccgggaatgaatgctgt

SEQ ID NO: 522058 - DNA, 25 bp, Rattus norvegicus
accgggaatgaatgctgtgactcgc

SEQ ID NO: 522059 - DNA, 25 bp, Rattus norvegicus
aatgctgtgactcgcgtttccaccc

SEQ ID NO: 522060 - DNA, 25 bp, Rattus norvegicus
ctcgggttccttcctgccggagtat

SEQ ID NO: 522061 - DNA, 25 bp, Rattus norvegicus
ggcagagcccgactacgagtccgag

SEQ ID NO: 522062 - DNA, 25 bp, Rattus norvegicus
agcccgactacgagtccgaggtcta

SEQ ID NO: 522063 - DNA, 25 bp, Rattus norvegicus
gccggctgagttggatttcggagcc

SEQ ID NO: 522064 - DNA, 25 bp, Rattus norvegicus
gagggccaccacctgcagcacatca

SEQ ID NO: 522065 - DNA, 25 bp, Rattus norvegicus
gcacatcagcgaccgagagatgccc

SEQ ID NO: 522066 - DNA, 25 bp, Rattus norvegicus
cagcgaccgagagatgcccgaaggt

SEQ ID NO: 522067 - DNA, 25 bp, Rattus norvegicus
gccgtggcgcacctctggcctccac

SEQ ID NO: 522068 - DNA, 25 bp, Rattus norvegicus
ctggcctccaccgactcccagggtc

SEQ ID NO: 522069 - DNA, 25 bp, Rattus norvegicus
tggtctcagtaaaccggctccaatc

SEQ ID NO: 522070 - DNA, 25 bp, Rattus norvegicus
ctctcagaggagagccaaccgcttg

SEQ ID NO: 522071 - DNA, 25 bp, Rattus norvegicus
ttagggctccgactccaaggacaga

SEQ ID NO: 522072 - DNA, 25 bp, Rattus norvegicus
aactgtttctggaaggcgctgcctc

SEQ ID NO: 522073 - DNA, 25 bp, Rattus norvegicus
cgggctggcaaccttgttggtttct

SEQ ID NO: 522074 - DNA, 25 bp, Rattus norvegicus
tccctctctggagtcttgactgtga

SEQ ID NO: 522075 - DNA, 25 bp, Rattus norvegicus
gggtctgcgttgaccgacgaatctg

SEQ ID NO: 522076 - DNA, 25 bp, Rattus norvegicus
gatttcctggcacactggggccttg

SEQ ID NO: 522077 - DNA, 25 bp, Rattus norvegicus
ggcacatgggcaccgtgatttcctg

SEQ ID NO: 522078 - DNA, 25 bp, Rattus norvegicus
caggcctgcttcgtcctgagtgtca

SEQ ID NO: 522079 - DNA, 25 bp, Rattus norvegicus
cggccagaattggtgcacctccagg

SEQ ID NO: 522080 - DNA, 25 bp, Rattus norvegicus
tggtggcttcacttcggttataatc

SEQ ID NO: 522081 - DNA, 25 bp, Rattus norvegicus
tgactccttcaggatgggcacgaag

SEQ ID NO: 522082 - DNA, 25 bp, Rattus norvegicus
gccggtgcgcaccttgttgtagagt

SEQ ID NO: 522083 - DNA, 25 bp, Rattus norvegicus
gctgagaaccagtccctcctgcggg

SEQ ID NO: 522084 - DNA, 25 bp, Rattus norvegicus
gagttcccagcgctgagaaccagtc

SEQ ID NO: 522085 - DNA, 25 bp, Rattus norvegicus
ttacacagagttcccagcgctgaga

SEQ ID NO: 522086 - DNA, 25 bp, Rattus norvegicus
ggcaaccggatcctattacacagag

SEQ ID NO: 522087 - DNA, 25 bp, Rattus norvegicus
gcagcccggcaaccggatcctatta

SEQ ID NO: 522088 - DNA, 25 bp, Rattus norvegicus
ctcgcggtcccacgcccaaatgctt

SEQ ID NO: 522089 - DNA, 25 bp, Rattus norvegicus
aaccagtccctcctgcgggaggagc

SEQ ID NO: 522090 - DNA, 25 bp, Rattus norvegicus
tgctcaccgcggctttggtcctgtc

SEQ ID NO: 522091 - DNA, 25 bp, Rattus norvegicus
cgaggcggatgctcaccgcggcttt

SEQ ID NO: 522092 - DNA, 25 bp, Rattus norvegicus
aggtccagggatgcgtcatcccgtc

SEQ ID NO: 522093 - DNA, 25 bp, Rattus norvegicus
agaaagcagtgcgtgggaagaaccc

SEQ ID NO: 522094 - DNA, 25 bp, Rattus norvegicus
cggctttggtcctgtcgcccgtgcg

SEQ ID NO: 522095 - DNA, 25 bp, Rattus norvegicus
ttacaagcggcttctcgcggtccca

SEQ ID NO: 522096 - DNA, 25 bp, Rattus norvegicus
catcccggccggttctgtttacaag

SEQ ID NO: 522097 - DNA, 25 bp, Rattus norvegicus
ccgcgcgtacacaagctgttctaac

SEQ ID NO: 522098 - DNA, 25 bp, Rattus norvegicus
cctcagcccacctcccgtagctccg

SEQ ID NO: 522099 - DNA, 25 bp, Rattus norvegicus
taactcttcccggctttgtctcctc

SEQ ID NO: 522100 - DNA, 25 bp, Rattus norvegicus
cacaaccttcgctccgacgcccggg

SEQ ID NO: 522101 - DNA, 25 bp, Rattus norvegicus
atccgccacaaccttcgctccgacg

SEQ ID NO: 522102 - DNA, 25 bp, Rattus norvegicus
cccagtcagatcagcatccgccaca

SEQ ID NO: 522103 - DNA, 25 bp, Rattus norvegicus
gtacacaagctgttctaacccggcc

SEQ ID NO: 522104 - DNA, 25 bp, Rattus norvegicus
gcgtacacaagctgttctaacccgg

SEQ ID NO: 522105 - DNA, 25 bp, Rattus norvegicus
cgcgcgtacacaagctgttctaacc

SEQ ID NO: 522106 - DNA, 25 bp, Rattus norvegicus
ctccacgacgccattcgtcgccgcg

SEQ ID NO: 522107 - DNA, 25 bp, Rattus norvegicus
cccgcgcgtacacaagctgttctaa

SEQ ID NO: 522108 - DNA, 25 bp, Rattus norvegicus
acccgcgcgtacacaagctgttcta

SEQ ID NO: 522109 - DNA, 25 bp, Rattus norvegicus
gctactcacccgctcacacccgcgc

SEQ ID NO: 522110 - DNA, 25 bp, Rattus norvegicus
gcgcgtacacaagctgttctaaccc

SEQ ID NO: 522111 - DNA, 25 bp, Rattus norvegicus
ccctgcgcttggctaaggcttcctg

SEQ ID NO: 522112 - DNA, 25 bp, Rattus norvegicus
acctgatgggaaccggctggcttct

SEQ ID NO: 522113 - DNA, 25 bp, Rattus norvegicus
aagacctgatgggaaccggctggct

SEQ ID NO: 522114 - DNA, 25 bp, Rattus norvegicus
actctgcggactctgcggccgaggc

SEQ ID NO: 522115 - DNA, 25 bp, Rattus norvegicus
caccgcctgagggatggcgaaggcc

SEQ ID NO: 522116 - DNA, 25 bp, Rattus norvegicus
cggagccttgaggtggtaggcagaa

SEQ ID NO: 522117 - DNA, 25 bp, Rattus norvegicus
tggtaggcagaagcgagaaaccgca

SEQ ID NO: 522118 - DNA, 25 bp, Rattus norvegicus
aggcagaagcgagaaaccgcagtta

SEQ ID NO: 522119 - DNA, 25 bp, Rattus norvegicus
cgagaaaccgcagttacagcgtata

SEQ ID NO: 522120 - DNA, 25 bp, Rattus norvegicus
gcctgaggaagccggccctgcgctt

SEQ ID NO: 522121 - DNA, 25 bp, Rattus norvegicus
tacagcgtatacctctgggctcctc

SEQ ID NO: 522122 - DNA, 25 bp, Rattus norvegicus
ctaaggcttcctggccgagagtggt

SEQ ID NO: 522123 - DNA, 25 bp, Rattus norvegicus
tggctaaggcttcctggccgagagt

SEQ ID NO: 522124 - DNA, 25 bp, Rattus norvegicus
tatacctctgggctcctcggcgcga

SEQ ID NO: 522125 - DNA, 25 bp, Rattus norvegicus
ctctagctctgagagtctgccgtga

SEQ ID NO: 522126 - DNA, 25 bp, Rattus norvegicus
ttccgtgcccaggtaagacatcgtc

SEQ ID NO: 522127 - DNA, 25 bp, Rattus norvegicus
aggagctctagctctgagagtctgc

SEQ ID NO: 522128 - DNA, 25 bp, Rattus norvegicus
agctctgagagtctgccgtgaccgc

SEQ ID NO: 522129 - DNA, 25 bp, Rattus norvegicus
ccgtgaccgcgggtgcgtccacttt

SEQ ID NO: 522130 - DNA, 25 bp, Rattus norvegicus
gtgcgtccactttccgtgcccaggt

SEQ ID NO: 522131 - DNA, 25 bp, Rattus norvegicus
gtccactttccgtgcccaggtaaga

SEQ ID NO: 522132 - DNA, 25 bp, Rattus norvegicus
gtaagacatcgtcccgcctagctca

SEQ ID NO: 522133 - DNA, 25 bp, Rattus norvegicus
tagctcagcccggtccttcctcctg

SEQ ID NO: 522134 - DNA, 25 bp, Rattus norvegicus
gcagccgggcgagtaggaaccggac

SEQ ID NO: 522135 - DNA, 25 bp, Rattus norvegicus
ggctggtctctgctggtccggtccc

SEQ ID NO: 522136 - DNA, 25 bp, Rattus norvegicus
ccctgtgccctggaagggagtccgc

SEQ ID NO: 522137 - DNA, 25 bp, Rattus norvegicus
ctcccacggaggagctctagctctg

SEQ ID NO: 522138 - DNA, 25 bp, Rattus norvegicus
gtgcccaggtaagacatcgtcccgc

SEQ ID NO: 522139 - DNA, 25 bp, Rattus norvegicus
agccgcctctgcctcagggaaggag

SEQ ID NO: 522140 - DNA, 25 bp, Rattus norvegicus
gcaaccaaccctgccactgaggccg

SEQ ID NO: 522141 - DNA, 25 bp, Rattus norvegicus
tcgtcgccaccgcaaccaaccctgc

SEQ ID NO: 522142 - DNA, 25 bp, Rattus norvegicus
cgtgccatgcggagcgtggactccc

SEQ ID NO: 522143 - DNA, 25 bp, Rattus norvegicus
ctccatcagccatgttccgcgcgcg

SEQ ID NO: 522144 - DNA, 25 bp, Rattus norvegicus
ttctgcggtaggactccccggagcc

SEQ ID NO: 522145 - DNA, 25 bp, Rattus norvegicus
ccatcatggtgaagaggaagagctc

SEQ ID NO: 522146 - DNA, 25 bp, Rattus norvegicus
ggaagagctccgagggccaggagca

SEQ ID NO: 522147 - DNA, 25 bp, Rattus norvegicus
cggccgcggcatccctctgcctatc

SEQ ID NO: 522148 - DNA, 25 bp, Rattus norvegicus
cagaccttcctgtggcggcaaacca

SEQ ID NO: 522149 - DNA, 25 bp, Rattus norvegicus
ttcctgtggcggcaaaccaggtgag

SEQ ID NO: 522150 - DNA, 25 bp, Rattus norvegicus
tcatggtgaagaggaagagctccga

SEQ ID NO: 522151 - DNA, 25 bp, Rattus norvegicus
tccacagtgggaggtgctgaaagca

SEQ ID NO: 522152 - DNA, 25 bp, Rattus norvegicus
cccggctctgttccgcggctgggct

SEQ ID NO: 522153 - DNA, 25 bp, Rattus norvegicus
actcgctctagggaaccggcaccat

SEQ ID NO: 522154 - DNA, 25 bp, Rattus norvegicus
gccgactacctgcacctggatgtaa

SEQ ID NO: 522155 - DNA, 25 bp, Rattus norvegicus
ccgtagggcagctgcttccggcaga

SEQ ID NO: 522156 - DNA, 25 bp, Rattus norvegicus
ttccggcagagtccggaagacagtg

SEQ ID NO: 522157 - DNA, 25 bp, Rattus norvegicus
cgcgcccaatcgagacgaagtcttg

SEQ ID NO: 522158 - DNA, 25 bp, Rattus norvegicus
acgaagtcttggctggcccgggctc

SEQ ID NO: 522159 - DNA, 25 bp, Rattus norvegicus
gctctcgtgggctcactcgctctag

SEQ ID NO: 522160 - DNA, 25 bp, Rattus norvegicus
gggctgcaagatcggcccgtccatc

SEQ ID NO: 522161 - DNA, 25 bp, Rattus norvegicus
cctggatgtaatggacgggtaactc

SEQ ID NO: 522162 - DNA, 25 bp, Rattus norvegicus
gggtcgcgtcgctgcacctcagcga

SEQ ID NO: 522163 - DNA, 25 bp, Rattus norvegicus
ctcagcgagcgcctgttgggtgcac

SEQ ID NO: 522164 - DNA, 25 bp, Rattus norvegicus
ctgtgcgacgggctgcctcgccaag

SEQ ID NO: 522165 - DNA, 25 bp, Rattus norvegicus
cttggctgacttcggggcccagtcc

SEQ ID NO: 522166 - DNA, 25 bp, Rattus norvegicus
gcaccatggcgtcgggctgcaagat

SEQ ID NO: 522167 - DNA, 25 bp, Rattus norvegicus
ggtaaacttcagctccacgtagacg

SEQ ID NO: 522168 - DNA, 25 bp, Rattus norvegicus
cgagaagctctcatctggcgcaatg

SEQ ID NO: 522169 - DNA, 25 bp, Rattus norvegicus
tacacacctgatacgtgcggatagg

SEQ ID NO: 522170 - DNA, 25 bp, Rattus norvegicus
gatgaaaccggtccgcagccagttg

SEQ ID NO: 522171 - DNA, 25 bp, Rattus norvegicus
tgcggataggattcatggcttcatc

SEQ ID NO: 522172 - DNA, 25 bp, Rattus norvegicus
gggatgctgttgcaatctctcacgg

SEQ ID NO: 522173 - DNA, 25 bp, Rattus norvegicus
tcgctatcagcctcgtagtaaaaaa

SEQ ID NO: 522174 - DNA, 25 bp, Rattus norvegicus
ggaggctgacgccacatcgctatca

SEQ ID NO: 522175 - DNA, 25 bp, Rattus norvegicus
ttcacgtaggggttctccatccaga

SEQ ID NO: 522176 - DNA, 25 bp, Rattus norvegicus
gcgcaatggtgtccactttcacgta

SEQ ID NO: 522177 - DNA, 25 bp, Rattus norvegicus
cccgaagctgcgcactttggtgtta

SEQ ID NO: 522178 - DNA, 25 bp, Rattus norvegicus
ctttggtgttaacgcgcccagcgtc

SEQ ID NO: 522179 - DNA, 25 bp, Rattus norvegicus
gcccagcgtctagccgcgagaagct

SEQ ID NO: 522180 - DNA, 25 bp, Rattus norvegicus
ggactcgcgcacgttacacacctga

SEQ ID NO: 522181 - DNA, 25 bp, Rattus norvegicus
atgtcgccgctagccagtcaagctc

SEQ ID NO: 522182 - DNA, 25 bp, Rattus norvegicus
gccgaggcgatctctagctgtccgc

SEQ ID NO: 522183 - DNA, 25 bp, Rattus norvegicus
cgcgatggccgaactctgctggctc

SEQ ID NO: 522184 - DNA, 25 bp, Rattus norvegicus
tagccgtttaaatttggctgcggtc

SEQ ID NO: 522185 - DNA, 25 bp, Rattus norvegicus
aaagccagtcctctcctctcttggg

SEQ ID NO: 522186 - DNA, 25 bp, Rattus norvegicus
tgccaaggctgttaggtttagccgt

SEQ ID NO: 522187 - DNA, 25 bp, Rattus norvegicus
cccgccgtatctgccaaggctgtta

SEQ ID NO: 522188 - DNA, 25 bp, Rattus norvegicus
caaaacaaaagggaggcctgccaag

SEQ ID NO: 522189 - DNA, 25 bp, Rattus norvegicus
ggagcgttctgaaagccgcctgagc

SEQ ID NO: 522190 - DNA, 25 bp, Rattus norvegicus
tcaagctccgagttatggaaagctc

SEQ ID NO: 522191 - DNA, 25 bp, Rattus norvegicus
gaagaaataaatgtcgccgctagcc

SEQ ID NO: 522192 - DNA, 25 bp, Rattus norvegicus
gctgcaacatcaactcggacccgtt

SEQ ID NO: 522193 - DNA, 25 bp, Rattus norvegicus
tctcttgggcacaagctgcaacatc

SEQ ID NO: 522194 - DNA, 25 bp, Rattus norvegicus
aaaccacgtgttccgacttctgcgc

SEQ ID NO: 522195 - DNA, 25 bp, Rattus norvegicus
cggtctccagctccgaacaaagcat

SEQ ID NO: 522196 - DNA, 25 bp, Rattus norvegicus
caaaggaccagtctcaagctctctc

SEQ ID NO: 522197 - DNA, 25 bp, Rattus norvegicus
gcaaaggaccagtctcaagctctct

SEQ ID NO: 522198 - DNA, 25 bp, Rattus norvegicus
cgcaaaggaccagtctcaagctctc

SEQ ID NO: 522199 - DNA, 25 bp, Rattus norvegicus
cgaacaaagcatggccgtcagaggt

SEQ ID NO: 522200 - DNA, 25 bp, Rattus norvegicus
gctccgaacaaagcatggccgtcag

SEQ ID NO: 522201 - DNA, 25 bp, Rattus norvegicus
ccgaacaaagcatggccgtcagagg

SEQ ID NO: 522202 - DNA, 25 bp, Rattus norvegicus
ctccgaacaaagcatggccgtcaga

SEQ ID NO: 522203 - DNA, 25 bp, Rattus norvegicus
tccagctccgaacaaagcatggccg

SEQ ID NO: 522204 - DNA, 25 bp, Rattus norvegicus
tctccagctccgaacaaagcatggc

SEQ ID NO: 522205 - DNA, 25 bp, Rattus norvegicus
gtctccagctccgaacaaagcatgg

SEQ ID NO: 522206 - DNA, 25 bp, Rattus norvegicus
ggtctccagctccgaacaaagcatg

SEQ ID NO: 522207 - DNA, 25 bp, Rattus norvegicus
aaaggaccagtctcaagctctctct

SEQ ID NO: 522208 - DNA, 25 bp, Rattus norvegicus
tccgaacaaagcatggccgtcagag

SEQ ID NO: 522209 - DNA, 25 bp, Rattus norvegicus
ccggagcactttgttccagctgggc

SEQ ID NO: 522210 - DNA, 25 bp, Rattus norvegicus
tcggaagtgccgagactagtcaacc

SEQ ID NO: 522211 - DNA, 25 bp, Rattus norvegicus
tcgcatcccttaatcagatctgaga

SEQ ID NO: 522212 - DNA, 25 bp, Rattus norvegicus
ctagtggataccctcctcattcgga

SEQ ID NO: 522213 - DNA, 25 bp, Rattus norvegicus
ctgttccctggctcactttgtgttt

SEQ ID NO: 522214 - DNA, 25 bp, Rattus norvegicus
ttcggacacagctcctgcgggaata

SEQ ID NO: 522215 - DNA, 25 bp, Rattus norvegicus
ttgtgtttgcaaactgcccgcccga

SEQ ID NO: 522216 - DNA, 25 bp, Rattus norvegicus
tcggcgctagaaagatcgcttcgga

SEQ ID NO: 522217 - DNA, 25 bp, Rattus norvegicus
tgaccctggtgagttgcgagaccct

SEQ ID NO: 522218 - DNA, 25 bp, Rattus norvegicus
ccctcccggagtgagacaaagaata

SEQ ID NO: 522219 - DNA, 25 bp, Rattus norvegicus
tttgcggaggtcacacttcggaagt

SEQ ID NO: 522220 - DNA, 25 bp, Rattus norvegicus
acacctcgtcgccttggtttgcgga

SEQ ID NO: 522221 - DNA, 25 bp, Rattus norvegicus
tgggaaacaatctcaaacacctcgt

SEQ ID NO: 522222 - DNA, 25 bp, Rattus norvegicus
acttgtgagagactggtaatggccc

SEQ ID NO: 522223 - DNA, 25 bp, Rattus norvegicus
agagagggctcggtctcttcttccg

SEQ ID NO: 522224 - DNA, 25 bp, Rattus norvegicus
agcattcggagggagccttgtcttt

SEQ ID NO: 522225 - DNA, 25 bp, Rattus norvegicus
agtcgccttggagcagcgcaacgcg

SEQ ID NO: 522226 - DNA, 25 bp, Rattus norvegicus
cgggacagccaactgcgggcctgca

SEQ ID NO: 522227 - DNA, 25 bp, Rattus norvegicus
agggctcggtctcttcttccggccg

SEQ ID NO: 522228 - DNA, 25 bp, Rattus norvegicus
cccaacggagagtcgccttggagca

SEQ ID NO: 522229 - DNA, 25 bp, Rattus norvegicus
gttctccatgccacagcgagaagcc

SEQ ID NO: 522230 - DNA, 25 bp, Rattus norvegicus
ccgagttctccatgccacagcgaga

SEQ ID NO: 522231 - DNA, 25 bp, Rattus norvegicus
cgcgacggactatagtggggacgcc

SEQ ID NO: 522232 - DNA, 25 bp, Rattus norvegicus
gactggcgggctcccttgtccgtgc

SEQ ID NO: 522233 - DNA, 25 bp, Rattus norvegicus
ctaaaggtcgcagctactcggtggc

SEQ ID NO: 522234 - DNA, 25 bp, Rattus norvegicus
gctacggctgggcagctctttcaaa

SEQ ID NO: 522235 - DNA, 25 bp, Rattus norvegicus
gctctttcaaagtcagttccccgga

SEQ ID NO: 522236 - DNA, 25 bp, Rattus norvegicus
tcccttgtccgtgcaggcggatggc

SEQ ID NO: 522237 - DNA, 25 bp, Rattus norvegicus
tctgagccatgacgccgcaagcgaa

SEQ ID NO: 522238 - DNA, 25 bp, Rattus norvegicus
cggacaataacagacgcggcgcgtt

SEQ ID NO: 522239 - DNA, 25 bp, Rattus norvegicus
cgcaaaccacgcagcgcggacaata

SEQ ID NO: 522240 - DNA, 25 bp, Rattus norvegicus
ggaggtgatgtagcccgcacgcctc

SEQ ID NO: 522241 - DNA, 25 bp, Rattus norvegicus
atacacggaggtgatgtagcccgca

SEQ ID NO: 522242 - DNA, 25 bp, Rattus norvegicus
gacgcgactgcaggcgctttgacag

SEQ ID NO: 522243 - DNA, 25 bp, Rattus norvegicus
cacttcctgtaagcctggccaatca

SEQ ID NO: 522244 - DNA, 25 bp, Rattus norvegicus
gccgcaagcgaacctgcagaacagg

SEQ ID NO: 522245 - DNA, 25 bp, Rattus norvegicus
ggcataaggattcggaaaggccctc

SEQ ID NO: 522246 - DNA, 25 bp, Rattus norvegicus
cgacttgttataatcggcataagga

SEQ ID NO: 522247 - DNA, 25 bp, Rattus norvegicus
ggccagcgacttgttataatcggca

SEQ ID NO: 522248 - DNA, 25 bp, Rattus norvegicus
acctgcagaacaggggaaagagaga

SEQ ID NO: 522249 - DNA, 25 bp, Rattus norvegicus
caatcagcgggcacgccgagccgga

SEQ ID NO: 522250 - DNA, 25 bp, Rattus norvegicus
tgtaagcctggccaatcagcgggca

SEQ ID NO: 522251 - DNA, 25 bp, Rattus norvegicus
gagaccgcgacccacctgactgaga

SEQ ID NO: 522252 - DNA, 25 bp, Rattus norvegicus
agcaaggtccctacggtccctcaag

SEQ ID NO: 522253 - DNA, 25 bp, Rattus norvegicus
gctcccagaaaacgcgccagaaaga

SEQ ID NO: 522254 - DNA, 25 bp, Rattus norvegicus
acaacgggcgccaccagaagcgatc

SEQ ID NO: 522255 - DNA, 25 bp, Rattus norvegicus
ggcccgaagaggtgcagagattctc

SEQ ID NO: 522256 - DNA, 25 bp, Rattus norvegicus
gtgccagcttgctcaggtgccaacc

SEQ ID NO: 522257 - DNA, 25 bp, Rattus norvegicus
ggaagaactcttcccggagccaaga

SEQ ID NO: 522258 - DNA, 25 bp, Rattus norvegicus
cttaagagatcttgctggcaggcga

SEQ ID NO: 522259 - DNA, 25 bp, Rattus norvegicus
ccaagttgcactactggaagaactc

SEQ ID NO: 522260 - DNA, 25 bp, Rattus norvegicus
cggggcagtaaacagaagttcaggc

SEQ ID NO: 522261 - DNA, 25 bp, Rattus norvegicus
gcccgcctcgggctaagtcaatgag

SEQ ID NO: 522262 - DNA, 25 bp, Rattus norvegicus
atcgggccaacagtggcggcactca

SEQ ID NO: 522263 - DNA, 25 bp, Rattus norvegicus
taagtcaatgagtgccacccgcggg

SEQ ID NO: 522264 - DNA, 25 bp, Rattus norvegicus
cgggctcagtatgccaggatttttt

SEQ ID NO: 522265 - DNA, 25 bp, Rattus norvegicus
gtgcgcttctatttcctcacacgtg

SEQ ID NO: 522266 - DNA, 25 bp, Rattus norvegicus
cttttacagctcagtggaggcggca

SEQ ID NO: 522267 - DNA, 25 bp, Rattus norvegicus
cacgcctgcgtgaagatgtgatgga

SEQ ID NO: 522268 - DNA, 25 bp, Rattus norvegicus
ggggcttcatcctcccggatgcttc

SEQ ID NO: 522269 - DNA, 25 bp, Rattus norvegicus
taccaccatgcctgtggccgaggtc

SEQ ID NO: 522270 - DNA, 25 bp, Rattus norvegicus
ctgcctcgtggtgtggaataccacc

SEQ ID NO: 522271 - DNA, 25 bp, Rattus norvegicus
agaggctcttccagcgcctggatca

SEQ ID NO: 522272 - DNA, 25 bp, Rattus norvegicus
gacgcatgcacaatggcgcccacta

SEQ ID NO: 522273 - DNA, 25 bp, Rattus norvegicus
tgtcgaagacatcctacagcagctg

SEQ ID NO: 522274 - DNA, 25 bp, Rattus norvegicus
cccgacttggtgatcgtgaactcct

SEQ ID NO: 522275 - DNA, 25 bp, Rattus norvegicus
catggcttcgatgtgctggatctcc

SEQ ID NO: 522276 - DNA, 25 bp, Rattus norvegicus
cctgtccaggtacagaagcaatttc

SEQ ID NO: 522277 - DNA, 25 bp, Rattus norvegicus
ctgagcttcgaacacgacgtgctgc

SEQ ID NO: 522278 - DNA, 25 bp, Rattus norvegicus
tgaactcctgcctctgggacctgtc

SEQ ID NO: 522279 - DNA, 25 bp, Rattus norvegicus
gattacaggacaagtgccgcgcggc

SEQ ID NO: 522280 - DNA, 25 bp, Rattus norvegicus
ccggcggagcccgagcacatctccc

SEQ ID NO: 522281 - DNA, 25 bp, Rattus norvegicus
ggcgcgctcaggcaatcgattacag

SEQ ID NO: 522282 - DNA, 25 bp, Rattus norvegicus
cgctcaggcaatcgattacaggaca

SEQ ID NO: 522283 - DNA, 25 bp, Rattus norvegicus
tcaggcaatcgattacaggacaagt

SEQ ID NO: 522284 - DNA, 25 bp, Rattus norvegicus
caatcgattacaggacaagtgccgc

SEQ ID NO: 522285 - DNA, 25 bp, Rattus norvegicus
tacaggacaagtgccgcgcggctcc

SEQ ID NO: 522286 - DNA, 25 bp, Rattus norvegicus
cgggctcctccagctcatgtcggcc

SEQ ID NO: 522287 - DNA, 25 bp, Rattus norvegicus
tgtcggccgcgggaagttttctatc

SEQ ID NO: 522288 - DNA, 25 bp, Rattus norvegicus
gccgcgggaagttttctatctggcc

SEQ ID NO: 522289 - DNA, 25 bp, Rattus norvegicus
ggaagttttctatctggcccggcac

SEQ ID NO: 522290 - DNA, 25 bp, Rattus norvegicus
agttttctatctggcccggcacctc

SEQ ID NO: 522291 - DNA, 25 bp, Rattus norvegicus
gagaaaccgatccggcggagcccga

SEQ ID NO: 522292 - DNA, 25 bp, Rattus norvegicus
cagctcacgttctccgctggccgcg

SEQ ID NO: 522293 - DNA, 25 bp, Rattus norvegicus
ttgctatagtaactgcggacgcgca

SEQ ID NO: 522294 - DNA, 25 bp, Rattus norvegicus
taacttgtcacccacgggcgaggtg

SEQ ID NO: 522295 - DNA, 25 bp, Rattus norvegicus
cagtggccgccgagggcgcctacta

SEQ ID NO: 522296 - DNA, 25 bp, Rattus norvegicus
gggcgcctactacctggagcgtatc

SEQ ID NO: 522297 - DNA, 25 bp, Rattus norvegicus
acctggagcgtatccttctggtggc

SEQ ID NO: 522298 - DNA, 25 bp, Rattus norvegicus
ggaagagctgggcattaacttgtca

SEQ ID NO: 522299 - DNA, 25 bp, Rattus norvegicus
tccttctggggtcccgccgatgcgg

SEQ ID NO: 522300 - DNA, 25 bp, Rattus norvegicus
ttgcaggcatggctgctccttctgg

SEQ ID NO: 522301 - DNA, 25 bp, Rattus norvegicus
cccgggatctcgcgagagttgcgac

SEQ ID NO: 522302 - DNA, 25 bp, Rattus norvegicus
tcaggtgctgagctagtcccgggta

SEQ ID NO: 522303 - DNA, 25 bp, Rattus norvegicus
ctggtcctcaggtgctgagctagtc

SEQ ID NO: 522304 - DNA, 25 bp, Rattus norvegicus
gagggcttgaccctggtcctcaggt

SEQ ID NO: 522305 - DNA, 25 bp, Rattus norvegicus
ggcattaacttgtcacccacgggcg

SEQ ID NO: 522306 - DNA, 25 bp, Rattus norvegicus
acgcgcagagggcttgaccctggtc

SEQ ID NO: 522307 - DNA, 25 bp, Rattus norvegicus
ccgtttgaatcctcttggctgcaga

SEQ ID NO: 522308 - DNA, 25 bp, Rattus norvegicus
gcgcaacaacttctccagacgggca

SEQ ID NO: 522309 - DNA, 25 bp, Rattus norvegicus
tcttaccagcgggagcagcgcaaca

SEQ ID NO: 522310 - DNA, 25 bp, Rattus norvegicus
gctgcagatgactggaaagccactc

SEQ ID NO: 522311 - DNA, 25 bp, Rattus norvegicus
gcagaaaatgcttacttacccggaa

SEQ ID NO: 522312 - DNA, 25 bp, Rattus norvegicus
caaggcagttctcccgcgaaaattc

SEQ ID NO: 522313 - DNA, 25 bp, Rattus norvegicus
agcctcaaagccacgccttcaaaga

SEQ ID NO: 522314 - DNA, 25 bp, Rattus norvegicus
ccgctgagcgcggagtttcagaatc

SEQ ID NO: 522315 - DNA, 25 bp, Rattus norvegicus
gaatccttgggtcacctagggctgg

SEQ ID NO: 522316 - DNA, 25 bp, Rattus norvegicus
gcgcaaatgcggtaaaattcccaga

SEQ ID NO: 522317 - DNA, 25 bp, Rattus norvegicus
aagccactcggaaaacacaggaatg

SEQ ID NO: 522318 - DNA, 25 bp, Rattus norvegicus
acgcgttcaaacttcctgagcggga

SEQ ID NO: 522319 - DNA, 25 bp, Rattus norvegicus
caaagcccgtcggtagctggttcca

SEQ ID NO: 522320 - DNA, 25 bp, Rattus norvegicus
ctcaagtactaggaggcgggacata

SEQ ID NO: 522321 - DNA, 25 bp, Rattus norvegicus
gcacagtccactgaggccgagctcg

SEQ ID NO: 522322 - DNA, 25 bp, Rattus norvegicus
cccaacccggtactcagggtagatg

SEQ ID NO: 522323 - DNA, 25 bp, Rattus norvegicus
gctctgtatctgaggtgtcgcccaa

SEQ ID NO: 522324 - DNA, 25 bp, Rattus norvegicus
gcacagtccaagagatcccggcagg

SEQ ID NO: 522325 - DNA, 25 bp, Rattus norvegicus
aggaagaaggctcgcgcacagtcca

SEQ ID NO: 522326 - DNA, 25 bp, Rattus norvegicus
ccggctcgagcctagagccttcttg

SEQ ID NO: 522327 - DNA, 25 bp, Rattus norvegicus
ggtatcagactgctccgctcacgta

SEQ ID NO: 522328 - DNA, 25 bp, Rattus norvegicus
ctgctttgactgtaggctattccta

SEQ ID NO: 522329 - DNA, 25 bp, Rattus norvegicus
agccttcttggacgtgtgctcagcc

SEQ ID NO: 522330 - DNA, 25 bp, Rattus norvegicus
aaacccacggccgaactgcagcttt

SEQ ID NO: 522331 - DNA, 25 bp, Rattus norvegicus
tcctcgccttccagaggtgcgaaac

SEQ ID NO: 522332 - DNA, 25 bp, Rattus norvegicus
aggggtctcgcttctctgctttgac

SEQ ID NO: 522333 - DNA, 25 bp, Rattus norvegicus
ccttgatgctgggtcgcccacattt

SEQ ID NO: 522334 - DNA, 25 bp, Rattus norvegicus
tgccgagtccagatgccagcagttc

SEQ ID NO: 522335 - DNA, 25 bp, Rattus norvegicus
cccacgcccagatctgggttctaaa

SEQ ID NO: 522336 - DNA, 25 bp, Rattus norvegicus
atctgggttctaaaagaggaagccg

SEQ ID NO: 522337 - DNA, 25 bp, Rattus norvegicus
cagatcgcgggctccagagttagcc

SEQ ID NO: 522338 - DNA, 25 bp, Rattus norvegicus
ccctaggctgcagctcagtggagga

SEQ ID NO: 522339 - DNA, 25 bp, Rattus norvegicus
ttagggtcacgtggggtcatcctgc

SEQ ID NO: 522340 - DNA, 25 bp, Rattus norvegicus
ctgaactgcggggtccggcctgcca

SEQ ID NO: 522341 - DNA, 25 bp, Rattus norvegicus
tgccagcctaggcacgtgtcctgtc

SEQ ID NO: 522342 - DNA, 25 bp, Rattus norvegicus
ggcacgtgtcctgtctgtctccaga

SEQ ID NO: 522343 - DNA, 25 bp, Rattus norvegicus
ccatggcttcctcccagcttggtga

SEQ ID NO: 522344 - DNA, 25 bp, Rattus norvegicus
ctcgcgatgcttcacaagggtcctg

SEQ ID NO: 522345 - DNA, 25 bp, Rattus norvegicus
aagggtcctgcctacactgtccctg

SEQ ID NO: 522346 - DNA, 25 bp, Rattus norvegicus
ccagacccggaagaacgcggtgcca

SEQ ID NO: 522347 - DNA, 25 bp, Rattus norvegicus
ggcctgcaatcgcttgagtcccttc

SEQ ID NO: 522348 - DNA, 25 bp, Rattus norvegicus
cccagcttggtgaggccctcgcgat

SEQ ID NO: 522349 - DNA, 25 bp, Rattus norvegicus
ctctccaggaggctagtggccacga

SEQ ID NO: 522350 - DNA, 25 bp, Rattus norvegicus
cctgtaagaagatggaaggaggaca

SEQ ID NO: 522351 - DNA, 25 bp, Rattus norvegicus
gcagaggcttatatgggacagtccc

SEQ ID NO: 522352 - DNA, 25 bp, Rattus norvegicus
ctagtggccacgaagtgtggttccc

SEQ ID NO: 522353 - DNA, 25 bp, Rattus norvegicus
ccctgagcatcttgagtggatggga

SEQ ID NO: 522354 - DNA, 25 bp, Rattus norvegicus
ccaggcacaggactgctagcagcag

SEQ ID NO: 522355 - DNA, 25 bp, Rattus norvegicus
ttgctcttcccggtttcggtgcagc

SEQ ID NO: 522356 - DNA, 25 bp, Rattus norvegicus
ctgcacgatttgctgagcctgcctc

SEQ ID NO: 522357 - DNA, 25 bp, Rattus norvegicus
ctctgactgacagccaccggggacg

SEQ ID NO: 522358 - DNA, 25 bp, Rattus norvegicus
cggtactcacgcttgctctgactga

SEQ ID NO: 522359 - DNA, 25 bp, Rattus norvegicus
gccggtttcagccagactgtcggta

SEQ ID NO: 522360 - DNA, 25 bp, Rattus norvegicus
agccacaacttctgcgggagccgag

SEQ ID NO: 522361 - DNA, 25 bp, Rattus norvegicus
acgcacgcgcgcaaaactttagcca

SEQ ID NO: 522362 - DNA, 25 bp, Rattus norvegicus
cctcgcagcctgcaggaaaagtcct

SEQ ID NO: 522363 - DNA, 25 bp, Rattus norvegicus
tttgccgcgggagcttttccctctg

SEQ ID NO: 522364 - DNA, 25 bp, Rattus norvegicus
gtctgcagcgcgtggccgaacccaa

SEQ ID NO: 522365 - DNA, 25 bp, Rattus norvegicus
gaacgcgctctagcgcagcgcagaa

SEQ ID NO: 522366 - DNA, 25 bp, Rattus norvegicus
ctctaaggagcgaacgcgctctagc

SEQ ID NO: 522367 - DNA, 25 bp, Rattus norvegicus
tgccgccctctaaggagcgaacgcg

SEQ ID NO: 522368 - DNA, 25 bp, Rattus norvegicus
ttaattccctgggtgccgcccgagc

SEQ ID NO: 522369 - DNA, 25 bp, Rattus norvegicus
agacgcaagccgcgcgtttgccgcg

SEQ ID NO: 522370 - DNA, 25 bp, Rattus norvegicus
ctcctccaggcaccggcacgggcag

SEQ ID NO: 522371 - DNA, 25 bp, Rattus norvegicus
tgaggcagcccggtacgcacctgac

SEQ ID NO: 522372 - DNA, 25 bp, Rattus norvegicus
ggtggcgccgctgcgtgacctcaca

SEQ ID NO: 522373 - DNA, 25 bp, Rattus norvegicus
tccgagacacacagtgcgggaaccg

SEQ ID NO: 522374 - DNA, 25 bp, Rattus norvegicus
gtcttgtccgagacacacagtgcgg

SEQ ID NO: 522375 - DNA, 25 bp, Rattus norvegicus
cgcgggagcttttccctctgtcttt

SEQ ID NO: 522376 - DNA, 25 bp, Rattus norvegicus
tctgtcttttaattccctgggtgcc

SEQ ID NO: 522377 - DNA, 25 bp, Rattus norvegicus
accctggtattgtgcctgtttgggg

SEQ ID NO: 522378 - DNA, 25 bp, Rattus norvegicus
agcgactgttaattaaaacgcggtg

SEQ ID NO: 522379 - DNA, 25 bp, Rattus norvegicus
ggtaattaatactccccacgccata

SEQ ID NO: 522380 - DNA, 25 bp, Rattus norvegicus
tacggctcagattaagcgactgtta

SEQ ID NO: 522381 - DNA, 25 bp, Rattus norvegicus
gtggcaaatgttacggctcagatta

SEQ ID NO: 522382 - DNA, 25 bp, Rattus norvegicus
cgcagtgtgtcgtggcaaatgttac

SEQ ID NO: 522383 - DNA, 25 bp, Rattus norvegicus
aattaattgatgagttggcagggcg

SEQ ID NO: 522384 - DNA, 25 bp, Rattus norvegicus
gatcgcggaggtgttaattggaaaa

SEQ ID NO: 522385 - DNA, 25 bp, Rattus norvegicus
ctaattagagatcgcggaggtgtta

SEQ ID NO: 522386 - DNA, 25 bp, Rattus norvegicus
ttgcactaattagagatcgcggagg

SEQ ID NO: 522387 - DNA, 25 bp, Rattus norvegicus
tcagtctgttaattgcactaattag

SEQ ID NO: 522388 - DNA, 25 bp, Rattus norvegicus
ggcatccatcagtctgttaattgca

SEQ ID NO: 522389 - DNA, 25 bp, Rattus norvegicus
cgcgggtaaactccgggcatccatc

SEQ ID NO: 522390 - DNA, 25 bp, Rattus norvegicus
aaaaccctggtattgtgcctgtttg

SEQ ID NO: 522391 - DNA, 25 bp, Rattus norvegicus
tgctggagacggagcaaggggtgaa

SEQ ID NO: 522392 - DNA, 25 bp, Rattus norvegicus
cacggacacggatcggacggcccga

SEQ ID NO: 522393 - DNA, 25 bp, Rattus norvegicus
atcggacggcccgacgctgaaccat

SEQ ID NO: 522394 - DNA, 25 bp, Rattus norvegicus
tgaaccatccatcacactcgtcaag

SEQ ID NO: 522395 - DNA, 25 bp, Rattus norvegicus
atcacactcgtcaagcaaccgcttc

SEQ ID NO: 522396 - DNA, 25 bp, Rattus norvegicus
aaaatgaagcattagtgcgcggcgc

SEQ ID NO: 522397 - DNA, 25 bp, Rattus norvegicus
agaaggctgcttggtgagagtcgcc

SEQ ID NO: 522398 - DNA, 25 bp, Rattus norvegicus
gtgaaggatgcagagacgagcggaa

SEQ ID NO: 522399 - DNA, 25 bp, Rattus norvegicus
acgagcggaaggagcaagaggccgt

SEQ ID NO: 522400 - DNA, 25 bp, Rattus norvegicus
aagaggccgtgggagaaacaggaag

SEQ ID NO: 522401 - DNA, 25 bp, Rattus norvegicus
ggttgagggtggtcaccacgaagta

SEQ ID NO: 522402 - DNA, 25 bp, Rattus norvegicus
cgctgagtatggctgcgtgctgggc

SEQ ID NO: 522403 - DNA, 25 bp, Rattus norvegicus
atgaagcattagtgcgcggcgcaga

SEQ ID NO: 522404 - DNA, 25 bp, Rattus norvegicus
gcgcagagactactgggaggaggct

SEQ ID NO: 522405 - DNA, 25 bp, Rattus norvegicus
ctctagagcattgcccaccacaatg

SEQ ID NO: 522406 - DNA, 25 bp, Rattus norvegicus
gcggagacacccatgcggtcgctaa

SEQ ID NO: 522407 - DNA, 25 bp, Rattus norvegicus
tgttcccaaaactcctgaacgcggc

SEQ ID NO: 522408 - DNA, 25 bp, Rattus norvegicus
atgccgcagccttcctccttggaga

SEQ ID NO: 522409 - DNA, 25 bp, Rattus norvegicus
ctcagaggcagcagtcagcaggcat

SEQ ID NO: 522410 - DNA, 25 bp, Rattus norvegicus
caaactaggaacagtaggtgtgccc

SEQ ID NO: 522411 - DNA, 25 bp, Rattus norvegicus
cagctcactcaaacgcaaactagga

SEQ ID NO: 522412 - DNA, 25 bp, Rattus norvegicus
agaagctcgtctgccagctcactca

SEQ ID NO: 522413 - DNA, 25 bp, Rattus norvegicus
ttccgcggatcggagaagctcgtct

SEQ ID NO: 522414 - DNA, 25 bp, Rattus norvegicus
cctctcgactcggaagttgaccttc

SEQ ID NO: 522415 - DNA, 25 bp, Rattus norvegicus
cggagtccgcgggattctatatccc

SEQ ID NO: 522416 - DNA, 25 bp, Rattus norvegicus
agaacggagtcagtctcgaagttgg

SEQ ID NO: 522417 - DNA, 25 bp, Rattus norvegicus
tgcggtcgctaagtgaccaggatag

SEQ ID NO: 522418 - DNA, 25 bp, Rattus norvegicus
ctccttggagaccaaagtaaaaatg

SEQ ID NO: 522419 - DNA, 25 bp, Rattus norvegicus
cctgtgaaaaaacagaggccggcgg

SEQ ID NO: 522420 - DNA, 25 bp, Rattus norvegicus
tcgcaagaggtgtggcgacctgcat

SEQ ID NO: 522421 - DNA, 25 bp, Rattus norvegicus
tgcaaatgagactcggcgtgcgcgc

SEQ ID NO: 522422 - DNA, 25 bp, Rattus norvegicus
ttgtagtgaaactgtggatgccgga

SEQ ID NO: 522423 - DNA, 25 bp, Rattus norvegicus
cggcgggaggttatttgcatgtcct

SEQ ID NO: 522424 - DNA, 25 bp, Rattus norvegicus
tgcatgtcctgcctcgtcgcaagag

SEQ ID NO: 522425 - DNA, 25 bp, Rattus norvegicus
tcctgccgggtcctgccgggtcttg

SEQ ID NO: 522426 - DNA, 25 bp, Rattus norvegicus
gaggtttgcgggtagtcaccacgat

SEQ ID NO: 522427 - DNA, 25 bp, Rattus norvegicus
cccttcaggtcgctggatttctggt

SEQ ID NO: 522428 - DNA, 25 bp, Rattus norvegicus
cgctggatttctggtggattccaaa

SEQ ID NO: 522429 - DNA, 25 bp, Rattus norvegicus
tctggtggattccaaatcggaattg

SEQ ID NO: 522430 - DNA, 25 bp, Rattus norvegicus
aatcggaattgtctgtgagtcagcc

SEQ ID NO: 522431 - DNA, 25 bp, Rattus norvegicus
ctgtgagtcagcctgtgaaaaaaca

SEQ ID NO: 522432 - DNA, 25 bp, Rattus norvegicus
cttttcggcttcgtctggccgtgga

SEQ ID NO: 522433 - DNA, 25 bp, Rattus norvegicus
taaaggttgcgggtggtcaccacga

SEQ ID NO: 522434 - DNA, 25 bp, Rattus norvegicus
gtagttgccaatctcggccaccacg

SEQ ID NO: 522435 - DNA, 25 bp, Rattus norvegicus
gaaccgcaggagaagcaggaagtaa

SEQ ID NO: 522436 - DNA, 25 bp, Rattus norvegicus
agacacccgggagtagttgccaatc

SEQ ID NO: 522437 - DNA, 25 bp, Rattus norvegicus
ggagtagttgccaatctcggccacc

SEQ ID NO: 522438 - DNA, 25 bp, Rattus norvegicus
atctcggccaccacgccctctaggg

SEQ ID NO: 522439 - DNA, 25 bp, Rattus norvegicus
cggggcatgcaaattagactgggtt

SEQ ID NO: 522440 - DNA, 25 bp, Rattus norvegicus
gcaaattagactgggttacgcgctc

SEQ ID NO: 522441 - DNA, 25 bp, Rattus norvegicus
tagactgggttacgcgctcgggaac

SEQ ID NO: 522442 - DNA, 25 bp, Rattus norvegicus
ccgaggtcgtggaaattgtagctga

SEQ ID NO: 522443 - DNA, 25 bp, Rattus norvegicus
cgtggaaattgtagctgaagctgtg

SEQ ID NO: 522444 - DNA, 25 bp, Rattus norvegicus
cacccgggagtagttgccaatctcg

SEQ ID NO: 522445 - DNA, 25 bp, Rattus norvegicus
gcttccgttttcagtggaggataaa

SEQ ID NO: 522446 - DNA, 25 bp, Rattus norvegicus
ccttgccgagacacccgggagtagt

SEQ ID NO: 522447 - DNA, 25 bp, Rattus norvegicus
tcggcgtcctggtgtctcccaggcg

SEQ ID NO: 522448 - DNA, 25 bp, Rattus norvegicus
cgagagctgaaagatgggctggtcc

SEQ ID NO: 522449 - DNA, 25 bp, Rattus norvegicus
gtcgcgactccaggcttcatgatcc

SEQ ID NO: 522450 - DNA, 25 bp, Rattus norvegicus
tgctccggctggtcctctggctgct

SEQ ID NO: 522451 - DNA, 25 bp, Rattus norvegicus
cgactccaggcttcatgatcctcct

SEQ ID NO: 522452 - DNA, 25 bp, Rattus norvegicus
ctggtcggcgtcctggtgtctccca

SEQ ID NO: 522453 - DNA, 25 bp, Rattus norvegicus
ctcctcctgctctgggtctgcacgc

SEQ ID NO: 522454 - DNA, 25 bp, Rattus norvegicus
tcttctgggtcgctgtcgccctcct

SEQ ID NO: 522455 - DNA, 25 bp, Rattus norvegicus
tcgtcctcttctgggtcgctgtcgc

SEQ ID NO: 522456 - DNA, 25 bp, Rattus norvegicus
tcctcgtcctcttctgggtcgctgt

SEQ ID NO: 522457 - DNA, 25 bp, Rattus norvegicus
agtggcctcgctttttcctcctcgt

SEQ ID NO: 522458 - DNA, 25 bp, Rattus norvegicus
tggaaagtggcctcgctttttcctc

SEQ ID NO: 522459 - DNA, 25 bp, Rattus norvegicus
cgggctggaaagtggcctcgctttt

SEQ ID NO: 522460 - DNA, 25 bp, Rattus norvegicus
cggtcgcgactccaggcttcatgat

SEQ ID NO: 522461 - DNA, 25 bp, Rattus norvegicus
tattcagcacctgggcgagtggaca

SEQ ID NO: 522462 - DNA, 25 bp, Rattus norvegicus
agcggagaagggacccagctacttc

SEQ ID NO: 522463 - DNA, 25 bp, Rattus norvegicus
cagcggccgtgaaagcgctgctgta

SEQ ID NO: 522464 - DNA, 25 bp, Rattus norvegicus
tgaaagcgctgctgtattcagcacc

SEQ ID NO: 522465 - DNA, 25 bp, Rattus norvegicus
tgctgtattcagcacctgggcgagt

SEQ ID NO: 522466 - DNA, 25 bp, Rattus norvegicus
ggcgagtggacagctcccacccaga

SEQ ID NO: 522467 - DNA, 25 bp, Rattus norvegicus
agaccacgcgcgtcacgccagtggg

SEQ ID NO: 522468 - DNA, 25 bp, Rattus norvegicus
ctggaaacaagcttcggagagcgga

SEQ ID NO: 522469 - DNA, 25 bp, Rattus norvegicus
ggtccgaggactggaaacaagcttc

SEQ ID NO: 522470 - DNA, 25 bp, Rattus norvegicus
gctgacggtccgaggactggaaaca

SEQ ID NO: 522471 - DNA, 25 bp, Rattus norvegicus
aaacaagcttcggagagcggagaag

SEQ ID NO: 522472 - DNA, 25 bp, Rattus norvegicus
ctcagttcccaaaggggtggtgctg

SEQ ID NO: 522473 - DNA, 25 bp, Rattus norvegicus
gagaagggacccagctacttccacc

SEQ ID NO: 522474 - DNA, 25 bp, Rattus norvegicus
ccctggctcagttcccaaaggggtg

SEQ ID NO: 522475 - DNA, 25 bp, Rattus norvegicus
attgtcctgagcactgtcagccttg

SEQ ID NO: 522476 - DNA, 25 bp, Rattus norvegicus
ttgagcgcagcaaagagactcgagc

SEQ ID NO: 522477 - DNA, 25 bp, Rattus norvegicus
agactcgagcacgagctaccgcctg

SEQ ID NO: 522478 - DNA, 25 bp, Rattus norvegicus
agtcttcgagaagaaaagattgtcc

SEQ ID NO: 522479 - DNA, 25 bp, Rattus norvegicus
cagccttgctgggaactcaaatttc

SEQ ID NO: 522480 - DNA, 25 bp, Rattus norvegicus
ctgcgctctgcatccgggataagga

SEQ ID NO: 522481 - DNA, 25 bp, Rattus norvegicus
ggtccagtcagcaacgccacaaagt

SEQ ID NO: 522482 - DNA, 25 bp, Rattus norvegicus
tgagaccaccggcttcagcaaggta

SEQ ID NO: 522483 - DNA, 25 bp, Rattus norvegicus
gtgtggccatcaccacgtgtccgct

SEQ ID NO: 522484 - DNA, 25 bp, Rattus norvegicus
ccagccggctgtggatctagattgc

SEQ ID NO: 522485 - DNA, 25 bp, Rattus norvegicus
tactcgaagaccaggccagccggct

SEQ ID NO: 522486 - DNA, 25 bp, Rattus norvegicus
tctgggtcccttggatactcgaaga

SEQ ID NO: 522487 - DNA, 25 bp, Rattus norvegicus
ctataactgcgatgctctgggtccc

SEQ ID NO: 522488 - DNA, 25 bp, Rattus norvegicus
cagcaaggtacaaggaggaccactc

SEQ ID NO: 522489 - DNA, 25 bp, Rattus norvegicus
acatggtgagtttttgcgtaactgc

SEQ ID NO: 522490 - DNA, 25 bp, Rattus norvegicus
gctcgccggtctaaaaccgcgcatg

SEQ ID NO: 522491 - DNA, 25 bp, Rattus norvegicus
cctagagaggatgcttacgtcactt

SEQ ID NO: 522492 - DNA, 25 bp, Rattus norvegicus
gaacaccgagttcgcgtcctagaga

SEQ ID NO: 522493 - DNA, 25 bp, Rattus norvegicus
gcgaatagacctctagaacaccgag

SEQ ID NO: 522494 - DNA, 25 bp, Rattus norvegicus
taccgccaggagacagcgaatagac

SEQ ID NO: 522495 - DNA, 25 bp, Rattus norvegicus
taaaaccgcgcatgcccgttgcgtc

SEQ ID NO: 522496 - DNA, 25 bp, Rattus norvegicus
ttccggcgacatggtgagtttttgc

SEQ ID NO: 522497 - DNA, 25 bp, Rattus norvegicus
gtaactgctttggaagtcgctatcc

SEQ ID NO: 522498 - DNA, 25 bp, Rattus norvegicus
agtcgctatccatctgcatctgccg

SEQ ID NO: 522499 - DNA, 25 bp, Rattus norvegicus
gctcgatgggacttggcccagcgcc

SEQ ID NO: 522500 - DNA, 25 bp, Rattus norvegicus
ctctcgtgttgtctggagttccgta

SEQ ID NO: 522501 - DNA, 25 bp, Rattus norvegicus
tctggagttccgtacgctgccggag

SEQ ID NO: 522502 - DNA, 25 bp, Rattus norvegicus
tagtctgtgccgtccggtgtcctgt

SEQ ID NO: 522503 - DNA, 25 bp, Rattus norvegicus
tgcgcccagacgttacgctgttacc

SEQ ID NO: 522504 - DNA, 25 bp, Rattus norvegicus
gctgcgcccagacgttacgctgtta

SEQ ID NO: 522505 - DNA, 25 bp, Rattus norvegicus
aagcttgcggcgtctacatcccgcg

SEQ ID NO: 522506 - DNA, 25 bp, Rattus norvegicus
agggcgaagcttgcggcgtctacat

SEQ ID NO: 522507 - DNA, 25 bp, Rattus norvegicus
ttgctgctccgtgtgcgcacgacag

SEQ ID NO: 522508 - DNA, 25 bp, Rattus norvegicus
cgccgcgctacggtttcccactagc

SEQ ID NO: 522509 - DNA, 25 bp, Rattus norvegicus
acccgacgcgccctgcgccgagctg

SEQ ID NO: 522510 - DNA, 25 bp, Rattus norvegicus
acatgctgccgagattgggcggccc

SEQ ID NO: 522511 - DNA, 25 bp, Rattus norvegicus
tcctgccgtcgctgctcttgctgct

SEQ ID NO: 522512 - DNA, 25 bp, Rattus norvegicus
ccgaggtgctgttccgctgcccacc

SEQ ID NO: 522513 - DNA, 25 bp, Rattus norvegicus
cctgcacgcccgagcgtctggccgc

SEQ ID NO: 522514 - DNA, 25 bp, Rattus norvegicus
agcccggctgcggttgctgctccgt

SEQ ID NO: 522515 - DNA, 25 bp, Rattus norvegicus
acctgcccgctagctcgccgcgcta

SEQ ID NO: 522516 - DNA, 25 bp, Rattus norvegicus
actagccaacatgctgccgagattg

SEQ ID NO: 522517 - DNA, 25 bp, Rattus norvegicus
cctcacgtggggaaagagagtcgac

SEQ ID NO: 522518 - DNA, 25 bp, Rattus norvegicus
tcaccggcgcgggtacctgtgaaaa

SEQ ID NO: 522519 - DNA, 25 bp, Rattus norvegicus
cgggtacctgtgaaaagagacgcgt

SEQ ID NO: 522520 - DNA, 25 bp, Rattus norvegicus
cccacagcaagttgcaggtaatgcg

SEQ ID NO: 522521 - DNA, 25 bp, Rattus norvegicus
taatgcggactgtgagcactagttc

SEQ ID NO: 522522 - DNA, 25 bp, Rattus norvegicus
ggttgggagaaactcgtagctcagc

SEQ ID NO: 522523 - DNA, 25 bp, Rattus norvegicus
tcttgagagcgggaacccgaaaggc

SEQ ID NO: 522524 - DNA, 25 bp, Rattus norvegicus
cggatccagggagaatcttgagagc

SEQ ID NO: 522525 - DNA, 25 bp, Rattus norvegicus
agcccagaccttgatcggatccagg

SEQ ID NO: 522526 - DNA, 25 bp, Rattus norvegicus
gaccctgggaccgttgtagacaaga

SEQ ID NO: 522527 - DNA, 25 bp, Rattus norvegicus
ctggcaatcctcacgtggggaaaga

SEQ ID NO: 522528 - DNA, 25 bp, Rattus norvegicus
gggtctcctggctggcaatcctcac

SEQ ID NO: 522529 - DNA, 25 bp, Rattus norvegicus
aactcgtagctcagcggggtctcct

SEQ ID NO: 522530 - DNA, 25 bp, Rattus norvegicus
ttgtagacaagaaagagcccagacc

SEQ ID NO: 522531 - DNA, 25 bp, Rattus norvegicus
ctccttccttctggcgttgggaggt

SEQ ID NO: 522532 - DNA, 25 bp, Rattus norvegicus
cgcagacctcgggtgagaaaagatc

SEQ ID NO: 522533 - DNA, 25 bp, Rattus norvegicus
ggtaaggatgcacgtggagaatgga

SEQ ID NO: 522534 - DNA, 25 bp, Rattus norvegicus
ctgtgccgctaagcgtctgggcctc

SEQ ID NO: 522535 - DNA, 25 bp, Rattus norvegicus
agggactccttccttctggcgttgg

SEQ ID NO: 522536 - DNA, 25 bp, Rattus norvegicus
cgaacggagggactccttccttctg

SEQ ID NO: 522537 - DNA, 25 bp, Rattus norvegicus
tgagaaaagatcgaacggagggact

SEQ ID NO: 522538 - DNA, 25 bp, Rattus norvegicus
ggagcgggctccatctgtgtaactt

SEQ ID NO: 522539 - DNA, 25 bp, Rattus norvegicus
acctcgggtgagaaaagatcgaacg

SEQ ID NO: 522540 - DNA, 25 bp, Rattus norvegicus
tgacaccgcagacctcgggtgagaa

SEQ ID NO: 522541 - DNA, 25 bp, Rattus norvegicus
gcgcaggtgacaccgcagacctcgg

SEQ ID NO: 522542 - DNA, 25 bp, Rattus norvegicus
tctgtgtaacttaagccggttggcc

SEQ ID NO: 522543 - DNA, 25 bp, Rattus norvegicus
ccggttggccagctgcattccggca

SEQ ID NO: 522544 - DNA, 25 bp, Rattus norvegicus
ggttggccagctgcattccggcacc

SEQ ID NO: 522545 - DNA, 25 bp, Rattus norvegicus
agcgctcagtgtagacgccacacga

SEQ ID NO: 522546 - DNA, 25 bp, Rattus norvegicus
ggaatcccggtagcgctcacctatc

SEQ ID NO: 522547 - DNA, 25 bp, Rattus norvegicus
gcgcaaagcgctcgagttcccaatc

SEQ ID NO: 522548 - DNA, 25 bp, Rattus norvegicus
aagcgctcgagttcccaatctatcc

SEQ ID NO: 522549 - DNA, 25 bp, Rattus norvegicus
ccagctcgcgtgtggtgcaactgga

SEQ ID NO: 522550 - DNA, 25 bp, Rattus norvegicus
tgcaactggaatcccggtagcgctc

SEQ ID NO: 522551 - DNA, 25 bp, Rattus norvegicus
ggtagcgctcacctatcttggtttg

SEQ ID NO: 522552 - DNA, 25 bp, Rattus norvegicus
cacctatcttggtttgctcgccgta

SEQ ID NO: 522553 - DNA, 25 bp, Rattus norvegicus
tgctcgccgtagctcttttcgttga

SEQ ID NO: 522554 - DNA, 25 bp, Rattus norvegicus
tagctcttttcgttgaggcaaaccc

SEQ ID NO: 522555 - DNA, 25 bp, Rattus norvegicus
tctcctcatcctgccgggggagaca

SEQ ID NO: 522556 - DNA, 25 bp, Rattus norvegicus
accctgggcgcagcgctcagtgtag

SEQ ID NO: 522557 - DNA, 25 bp, Rattus norvegicus
gtgtagacgccacacgactgtccct

SEQ ID NO: 522558 - DNA, 25 bp, Rattus norvegicus
ggagacagcgcaaaccctgggcgca

SEQ ID NO: 522559 - DNA, 25 bp, Rattus norvegicus
gagacaatcaggtcggctccgtctg

SEQ ID NO: 522560 - DNA, 25 bp, Rattus norvegicus
cctctctgcgcaggctgatggcggc

SEQ ID NO: 522561 - DNA, 25 bp, Rattus norvegicus
atagagcggcaatgatggtggagtc

SEQ ID NO: 522562 - DNA, 25 bp, Rattus norvegicus
agctgacagcaacggcgagatgagc

SEQ ID NO: 522563 - DNA, 25 bp, Rattus norvegicus
tctgcatcggagacaatcaggtcgg

SEQ ID NO: 522564 - DNA, 25 bp, Rattus norvegicus
gacgcctcaggcagggaagcggcca

SEQ ID NO: 522565 - DNA, 25 bp, Rattus norvegicus
ggcagcctctctgcgcaggctgatg

SEQ ID NO: 522566 - DNA, 25 bp, Rattus norvegicus
tcagaacggcgtgggcagcctctct

SEQ ID NO: 522567 - DNA, 25 bp, Rattus norvegicus
cggctccgtctggtcagaacggcgt

SEQ ID NO: 522568 - DNA, 25 bp, Rattus norvegicus
caggtcggctccgtctggtcagaac

SEQ ID NO: 522569 - DNA, 25 bp, Rattus norvegicus
aatcaggtcggctccgtctggtcag

SEQ ID NO: 522570 - DNA, 25 bp, Rattus norvegicus
gcatcggagacaatcaggtcggctc

SEQ ID NO: 522571 - DNA, 25 bp, Rattus norvegicus
ggtggagtctgcatcggagacaatc

SEQ ID NO: 522572 - DNA, 25 bp, Rattus norvegicus
ccagcggagctgacagcaacggcga

SEQ ID NO: 522573 - DNA, 25 bp, Rattus norvegicus
attgtgctcgcgctgcagtgagtgt

SEQ ID NO: 522574 - DNA, 25 bp, Rattus norvegicus
acaacagcattgtgctcgcgctgca

SEQ ID NO: 522575 - DNA, 25 bp, Rattus norvegicus
ctgcgggaaggagcgacaacagcat

SEQ ID NO: 522576 - DNA, 25 bp, Rattus norvegicus
taacttctgaggctgtggggacccg

SEQ ID NO: 522577 - DNA, 25 bp, Rattus norvegicus
cgctagagcccggtaacttctgagg

SEQ ID NO: 522578 - DNA, 25 bp, Rattus norvegicus
tcggcggcgacgtgtcagcctccag

SEQ ID NO: 522579 - DNA, 25 bp, Rattus norvegicus
tgcaggactcttccaccctaggggc

SEQ ID NO: 522580 - DNA, 25 bp, Rattus norvegicus
cccttcgggtagctgcaggactctt

SEQ ID NO: 522581 - DNA, 25 bp, Rattus norvegicus
ccagcctggtttcatctcttccgag

SEQ ID NO: 522582 - DNA, 25 bp, Rattus norvegicus
cggcgcggctccagcctggtttcat

SEQ ID NO: 522583 - DNA, 25 bp, Rattus norvegicus
cccaaggagtagagagtatcctgcc

SEQ ID NO: 522584 - DNA, 25 bp, Rattus norvegicus
accgagacgcctgttggggacctag

SEQ ID NO: 522585 - DNA, 25 bp, Rattus norvegicus
ctgctccgggcatctcccggggctt

SEQ ID NO: 522586 - DNA, 25 bp, Rattus norvegicus
ggggcagaaaatcagcgccctgctc

SEQ ID NO: 522587 - DNA, 25 bp, Rattus norvegicus
gcgacgtggggagaagggcaacgcc

SEQ ID NO: 522588 - DNA, 25 bp, Rattus norvegicus
gccacaagaaggcagaggctcgagc

SEQ ID NO: 522589 - DNA, 25 bp, Rattus norvegicus
gcagaggctcgagcgcctcgcagca

SEQ ID NO: 522590 - DNA, 25 bp, Rattus norvegicus
tcgagcgcctcgcagcacaccaggc

SEQ ID NO: 522591 - DNA, 25 bp, Rattus norvegicus
cctcgcagcacaccaggctcacggt

SEQ ID NO: 522592 - DNA, 25 bp, Rattus norvegicus
ccaggcgtctgcgacgtggggagaa

SEQ ID NO: 522593 - DNA, 25 bp, Rattus norvegicus
tccgctaccgctccgccaggcagtg

SEQ ID NO: 522594 - DNA, 25 bp, Rattus norvegicus
acacggacgctggaggcagtctgta

SEQ ID NO: 522595 - DNA, 25 bp, Rattus norvegicus
ctgtggcggaatccccgagactggc

SEQ ID NO: 522596 - DNA, 25 bp, Rattus norvegicus
ggaatccccgagactggctgagctg

SEQ ID NO: 522597 - DNA, 25 bp, Rattus norvegicus
ccgagactggctgagctgggagcgc

SEQ ID NO: 522598 - DNA, 25 bp, Rattus norvegicus
ctgggagcgcgtgaaagagagcaac

SEQ ID NO: 522599 - DNA, 25 bp, Rattus norvegicus
gagcgcgtgaaagagagcaacgccg

SEQ ID NO: 522600 - DNA, 25 bp, Rattus norvegicus
ggtgcagcccatccggcccggcacc

SEQ ID NO: 522601 - DNA, 25 bp, Rattus norvegicus
agaacagacgacctgtgggacgtga

SEQ ID NO: 522602 - DNA, 25 bp, Rattus norvegicus
gcgtgccagagaacagacgacctgt

SEQ ID NO: 522603 - DNA, 25 bp, Rattus norvegicus
caggagcaaggcgtgccagagaaca

SEQ ID NO: 522604 - DNA, 25 bp, Rattus norvegicus
cgcggtaagccgaaggcctaagatg

SEQ ID NO: 522605 - DNA, 25 bp, Rattus norvegicus
tttccttagcaggatggacgtggga

SEQ ID NO: 522606 - DNA, 25 bp, Rattus norvegicus
cgcggcttcagggtttccttagcag

SEQ ID NO: 522607 - DNA, 25 bp, Rattus norvegicus
tgaccctagctaaatcccgggtggc

SEQ ID NO: 522608 - DNA, 25 bp, Rattus norvegicus
cacgctcgaggtcgaagcggaaatg

SEQ ID NO: 522609 - DNA, 25 bp, Rattus norvegicus
cctgctggaggtgaacaaccgcatc

SEQ ID NO: 522610 - DNA, 25 bp, Rattus norvegicus
ccgccgccatgatcctgctggaggt

SEQ ID NO: 522611 - DNA, 25 bp, Rattus norvegicus
ggaggccgagttgaccctagctaaa

SEQ ID NO: 522612 - DNA, 25 bp, Rattus norvegicus
gcagccgaggccagaagtcacgtcc

SEQ ID NO: 522613 - DNA, 25 bp, Rattus norvegicus
gagacgctcgcgctcaagttcgaga

SEQ ID NO: 522614 - DNA, 25 bp, Rattus norvegicus
caaccgcatcatcgaggagacgctc

SEQ ID NO: 522615 - DNA, 25 bp, Rattus norvegicus
tggcgggagagtccaagctccaccc

SEQ ID NO: 522616 - DNA, 25 bp, Rattus norvegicus
ggcctcaggagcgtcagttctcacc

SEQ ID NO: 522617 - DNA, 25 bp, Rattus norvegicus
ggatccagctctaccacctcaatga

SEQ ID NO: 522618 - DNA, 25 bp, Rattus norvegicus
atgatctcttcatctccgtgaaagc

SEQ ID NO: 522619 - DNA, 25 bp, Rattus norvegicus
tgaaagctcagagtctccagaggcg

SEQ ID NO: 522620 - DNA, 25 bp, Rattus norvegicus
ttcggactccatgcggcgaaaccta

SEQ ID NO: 522621 - DNA, 25 bp, Rattus norvegicus
gaaacctaccgatccacttctctgg

SEQ ID NO: 522622 - DNA, 25 bp, Rattus norvegicus
cagagtcagctctgcgcgacgacgc

SEQ ID NO: 522623 - DNA, 25 bp, Rattus norvegicus
aggcgtaggtgactcccagccgaaa

SEQ ID NO: 522624 - DNA, 25 bp, Rattus norvegicus
aagagcgacggcatccgggccaata

SEQ ID NO: 522625 - DNA, 25 bp, Rattus norvegicus
aggtggactaacagagacgccaatc

SEQ ID NO: 522626 - DNA, 25 bp, Rattus norvegicus
gcccgctatgcggacttctgggaaa

SEQ ID NO: 522627 - DNA, 25 bp, Rattus norvegicus
gtttcgactctgtaggcaggacgga

SEQ ID NO: 522628 - DNA, 25 bp, Rattus norvegicus
ggccaatagcaacagaggtggacta

SEQ ID NO: 522629 - DNA, 25 bp, Rattus norvegicus
gtcagcttgcgggtgcgcaccgaat

SEQ ID NO: 522630 - DNA, 25 bp, Rattus norvegicus
ttccggaccctgagaactgcctggg

SEQ ID NO: 522631 - DNA, 25 bp, Rattus norvegicus
tgcgctgttccggaccctgagaact

SEQ ID NO: 522632 - DNA, 25 bp, Rattus norvegicus
agaaaagttcggacgcccaggcaca

SEQ ID NO: 522633 - DNA, 25 bp, Rattus norvegicus
cccgcgcatgccagaaaagttcgga

SEQ ID NO: 522634 - DNA, 25 bp, Rattus norvegicus
ttctgttcacgactggagccggccc

SEQ ID NO: 522635 - DNA, 25 bp, Rattus norvegicus
actctggcttctgttcacgactgga

SEQ ID NO: 522636 - DNA, 25 bp, Rattus norvegicus
ggacgaaaggattctactctggctt

SEQ ID NO: 522637 - DNA, 25 bp, Rattus norvegicus
ccagaacgggcaggacgaaaggatt

SEQ ID NO: 522638 - DNA, 25 bp, Rattus norvegicus
aggaaagtgaagaccagaacgggca

SEQ ID NO: 522639 - DNA, 25 bp, Rattus norvegicus
ctgcccaggcgcacaaggaaagtga

SEQ ID NO: 522640 - DNA, 25 bp, Rattus norvegicus
ctgagaactgcctgggcctccgggc

SEQ ID NO: 522641 - DNA, 25 bp, Rattus norvegicus
atatgccctgcccaggcgcacaagg

SEQ ID NO: 522642 - DNA, 25 bp, Rattus norvegicus
accgaatgcggttgcgccataagcc

SEQ ID NO: 522643 - DNA, 25 bp, Rattus norvegicus
tggcccgttttatgcccgcgccagg

SEQ ID NO: 522644 - DNA, 25 bp, Rattus norvegicus
taccctctagggtaggacgagcagc

SEQ ID NO: 522645 - DNA, 25 bp, Rattus norvegicus
cagcgttccgctaccctctagggta

SEQ ID NO: 522646 - DNA, 25 bp, Rattus norvegicus
ggacgagcagctgcgatatccactc

SEQ ID NO: 522647 - DNA, 25 bp, Rattus norvegicus
ggtgccacgtctcgtccaaggcata

SEQ ID NO: 522648 - DNA, 25 bp, Rattus norvegicus
tccggttgctcctgccgtaatgcct

SEQ ID NO: 522649 - DNA, 25 bp, Rattus norvegicus
gccgtaatgcctactccgggctctg

SEQ ID NO: 522650 - DNA, 25 bp, Rattus norvegicus
ccctctccctgtggatgtagacttg

SEQ ID NO: 522651 - DNA, 25 bp, Rattus norvegicus
tggatgtagacttgcccgagccaga

SEQ ID NO: 522652 - DNA, 25 bp, Rattus norvegicus
acaggcagtggctccttctcggaac

SEQ ID NO: 522653 - DNA, 25 bp, Rattus norvegicus
ctccttctcggaacggatgggcagt

SEQ ID NO: 522654 - DNA, 25 bp, Rattus norvegicus
gtacgccactctagtgccctaggcg

SEQ ID NO: 522655 - DNA, 25 bp, Rattus norvegicus
ctcctcttcagcaaacggggcgcgg

SEQ ID NO: 522656 - DNA, 25 bp, Rattus norvegicus
ggcataggacgccagcgttccgcta

SEQ ID NO: 522657 - DNA, 25 bp, Rattus norvegicus
tgggcggagccaagtgtccccgcac

SEQ ID NO: 522658 - DNA, 25 bp, Rattus norvegicus
cccatagcgcgcaggtgctaagagc

SEQ ID NO: 522659 - DNA, 25 bp, Rattus norvegicus
gcgcaggtgctaagagcccgcctct

SEQ ID NO: 522660 - DNA, 25 bp, Rattus norvegicus
ggctgctggctgctattcttcgcct

SEQ ID NO: 522661 - DNA, 25 bp, Rattus norvegicus
tggctgctattcttcgccttcgtgc

SEQ ID NO: 522662 - DNA, 25 bp, Rattus norvegicus
attcttcgccttcgtgctgcttttg

SEQ ID NO: 522663 - DNA, 25 bp, Rattus norvegicus
cgccttcgtgctgcttttgagtccc

SEQ ID NO: 522664 - DNA, 25 bp, Rattus norvegicus
gcggcctcctcatgacgcgcagcca

SEQ ID NO: 522665 - DNA, 25 bp, Rattus norvegicus
agccagcggctgctcttccgaatcg

SEQ ID NO: 522666 - DNA, 25 bp, Rattus norvegicus
agcggctgctcttccgaatcgggtt

SEQ ID NO: 522667 - DNA, 25 bp, Rattus norvegicus
gctcttccgaatcgggttagtgccc

SEQ ID NO: 522668 - DNA, 25 bp, Rattus norvegicus
gctccgatctgtgcaggctcgggaa

SEQ ID NO: 522669 - DNA, 25 bp, Rattus norvegicus
gcgtgccaggccacagctggcgaga

SEQ ID NO: 522670 - DNA, 25 bp, Rattus norvegicus
aggccgggttagaacgcgatgtagt

SEQ ID NO: 522671 - DNA, 25 bp, Rattus norvegicus
cgctctgctgtgaagccgccagacg

SEQ ID NO: 522672 - DNA, 25 bp, Rattus norvegicus
aggctctgtggggtgtgtcaccaca

SEQ ID NO: 522673 - DNA, 25 bp, Rattus norvegicus
cgcactccctgctggttgcggggca

SEQ ID NO: 522674 - DNA, 25 bp, Rattus norvegicus
caccgggctgatgtgcacgcagagc

SEQ ID NO: 522675 - DNA, 25 bp, Rattus norvegicus
ctgaatggttgcagtctcaggagcc

SEQ ID NO: 522676 - DNA, 25 bp, Rattus norvegicus
gacacgtgtgtttaaaatctgaatg

SEQ ID NO: 522677 - DNA, 25 bp, Rattus norvegicus
ccacagatccggtgacacgtgtgtt

SEQ ID NO: 522678 - DNA, 25 bp, Rattus norvegicus
tgatgtgcacgcagagcagcgtctc

SEQ ID NO: 522679 - DNA, 25 bp, Rattus norvegicus
caaggcgtggcattcgtgtttttta

SEQ ID NO: 522680 - DNA, 25 bp, Rattus norvegicus
ggcgaatgaaaggaactttgtaaga

SEQ ID NO: 522681 - DNA, 25 bp, Rattus norvegicus
ataaacgaaccgcagccctagagcg

SEQ ID NO: 522682 - DNA, 25 bp, Rattus norvegicus
gggcttcctgcgagaagattccgta

SEQ ID NO: 522683 - DNA, 25 bp, Rattus norvegicus
agaagattccgtatgcgaacgcaga

SEQ ID NO: 522684 - DNA, 25 bp, Rattus norvegicus
tggggtgtgtcaccacagatccggt

SEQ ID NO: 522685 - DNA, 25 bp, Rattus norvegicus
tgaaagctgcggctgagtcctagcc

SEQ ID NO: 522686 - DNA, 25 bp, Rattus norvegicus
gagcccgggttccatgtttgcatcc

SEQ ID NO: 522687 - DNA, 25 bp, Rattus norvegicus
cctcgcggggaggaaactccatgtt

SEQ ID NO: 522688 - DNA, 25 bp, Rattus norvegicus
tgttgtaacaaagtttcctccgcgc

SEQ ID NO: 522689 - DNA, 25 bp, Rattus norvegicus
agctcggccgtcattactcagatca

SEQ ID NO: 522690 - DNA, 25 bp, Rattus norvegicus
tttgaactccgcgagagtctgaggc

SEQ ID NO: 522691 - DNA, 25 bp, Rattus norvegicus
ctggcgccactagtgcgctcgcata

SEQ ID NO: 522692 - DNA, 25 bp, Rattus norvegicus
cgctcgcatatgcttctagtaggga

SEQ ID NO: 522693 - DNA, 25 bp, Rattus norvegicus
ccagtttggcgccaatgggactaga

SEQ ID NO: 522694 - DNA, 25 bp, Rattus norvegicus
gagtcttgcagagatctcccgccaa

SEQ ID NO: 522695 - DNA, 25 bp, Rattus norvegicus
ccaaacttgggcgtcactcgtggag

SEQ ID NO: 522696 - DNA, 25 bp, Rattus norvegicus
cggacgacaccctcgaaggcaaaga

SEQ ID NO: 522697 - DNA, 25 bp, Rattus norvegicus
gccgctagccttgcaagacagtctt

SEQ ID NO: 522698 - DNA, 25 bp, Rattus norvegicus
cagaggcttggtccaggcagtacac

SEQ ID NO: 522699 - DNA, 25 bp, Rattus norvegicus
caggccaagccgttgcttgccgcta

SEQ ID NO: 522700 - DNA, 25 bp, Rattus norvegicus
gcaggaagtaccaggccaagccgtt

SEQ ID NO: 522701 - DNA, 25 bp, Rattus norvegicus
actggagccgccctcagccaacagc

SEQ ID NO: 522702 - DNA, 25 bp, Rattus norvegicus
agccaacagccttccggccagtggg

SEQ ID NO: 522703 - DNA, 25 bp, Rattus norvegicus
ccttccggccagtggggccagcaag

SEQ ID NO: 522704 - DNA, 25 bp, Rattus norvegicus
gcccggagatcttctgcccgcattg

SEQ ID NO: 522705 - DNA, 25 bp, Rattus norvegicus
cggagatcttctgcccgcattggcc

SEQ ID NO: 522706 - DNA, 25 bp, Rattus norvegicus
gacgccgggctcctaagtttggcac

SEQ ID NO: 522707 - DNA, 25 bp, Rattus norvegicus
ctccggccaaattcgccttccgcga

SEQ ID NO: 522708 - DNA, 25 bp, Rattus norvegicus
gttgcttgccgctaggggcctccct

SEQ ID NO: 522709 - DNA, 25 bp, Rattus norvegicus
cgggctcctaagtttggcactcttc

SEQ ID NO: 522710 - DNA, 25 bp, Rattus norvegicus
ttggcactcttcttcggtctagaga

SEQ ID NO: 522711 - DNA, 25 bp, Rattus norvegicus
ttcggtctagagaatcccgagcgtg

SEQ ID NO: 522712 - DNA, 25 bp, Rattus norvegicus
ccgcggcctcctgccaacttggcta

SEQ ID NO: 522713 - DNA, 25 bp, Rattus norvegicus
cagagttcacgtttcttaggggata

SEQ ID NO: 522714 - DNA, 25 bp, Rattus norvegicus
gcccattttctagttcccagatttg

SEQ ID NO: 522715 - DNA, 25 bp, Rattus norvegicus
cgggaactgtgactagacgcaaaca

SEQ ID NO: 522716 - DNA, 25 bp, Rattus norvegicus
ccctgtcgtgactgtactgtaatac

SEQ ID NO: 522717 - DNA, 25 bp, Rattus norvegicus
agcatgcgcagtttttgtccttcca

SEQ ID NO: 522718 - DNA, 25 bp, Rattus norvegicus
tccttccaagactgctggccttttc

SEQ ID NO: 522719 - DNA, 25 bp, Rattus norvegicus
ccgcccttctctggccttaggagga

SEQ ID NO: 522720 - DNA, 25 bp, Rattus norvegicus
gaaagagctcccgtagtcccagaca

SEQ ID NO: 522721 - DNA, 25 bp, Rattus norvegicus
ttaggggatatacttgcgatgccgg

SEQ ID NO: 522722 - DNA, 25 bp, Rattus norvegicus
cgaggaccagtagtttgcagacgtc

SEQ ID NO: 522723 - DNA, 25 bp, Rattus norvegicus
gacgtcattttgatcctgaacctga

SEQ ID NO: 522724 - DNA, 25 bp, Rattus norvegicus
cctgaaggttcaagggacatacttt

SEQ ID NO: 522725 - DNA, 25 bp, Rattus norvegicus
cggatgtccgtctcagcccattttc

SEQ ID NO: 522726 - DNA, 25 bp, Rattus norvegicus
ttcggctgcagagccactaaagctg

SEQ ID NO: 522727 - DNA, 25 bp, Rattus norvegicus
cccggcgtgattaggctctttgtaa

SEQ ID NO: 522728 - DNA, 25 bp, Rattus norvegicus
ccctcgtggattagcaagcgagtcg

SEQ ID NO: 522729 - DNA, 25 bp, Rattus norvegicus
gtaattatcgctccgcgagattcca

SEQ ID NO: 522730 - DNA, 25 bp, Rattus norvegicus
gcctccctcgtggattagcaagcga

SEQ ID NO: 522731 - DNA, 25 bp, Rattus norvegicus
gctctttgtaattatcgctccgcga

SEQ ID NO: 522732 - DNA, 25 bp, Rattus norvegicus
cgaatcaggcttcgaaacgagggaa

SEQ ID NO: 522733 - DNA, 25 bp, Rattus norvegicus
aaattgccgttaatgtttcagcgta

SEQ ID NO: 522734 - DNA, 25 bp, Rattus norvegicus
attagtctctcgtcacgaatcaggc

SEQ ID NO: 522735 - DNA, 25 bp, Rattus norvegicus
caaatttattccgaggcaggagccc

SEQ ID NO: 522736 - DNA, 25 bp, Rattus norvegicus
ccctcggaaattggggtcattctca

SEQ ID NO: 522737 - DNA, 25 bp, Rattus norvegicus
tggggtcattctcatttgcaaggtg

SEQ ID NO: 522738 - DNA, 25 bp, Rattus norvegicus
ccgtaatgcgggcaaatttattccg

SEQ ID NO: 522739 - DNA, 25 bp, Rattus norvegicus
tttcagcgtaacgaattagtctctc

SEQ ID NO: 522740 - DNA, 25 bp, Rattus norvegicus
ctcatttgcaaggtggaggatcgga

SEQ ID NO: 522741 - DNA, 25 bp, Rattus norvegicus
cagccaagtcacgagatccagcgga

SEQ ID NO: 522742 - DNA, 25 bp, Rattus norvegicus
ttggaattctggatctcggctctga

SEQ ID NO: 522743 - DNA, 25 bp, Rattus norvegicus
gtggctgtccatgcaaaagtgtttt

SEQ ID NO: 522744 - DNA, 25 bp, Rattus norvegicus
caggagatcttcgtcagtggctgtc

SEQ ID NO: 522745 - DNA, 25 bp, Rattus norvegicus
tgacagatttctcccgaccacgttc

SEQ ID NO: 522746 - DNA, 25 bp, Rattus norvegicus
ccgagtacggactggcgaaaccatc

SEQ ID NO: 522747 - DNA, 25 bp, Rattus norvegicus
cctagaggcgcttattccgagtacg

SEQ ID NO: 522748 - DNA, 25 bp, Rattus norvegicus
cgccaaagcggaaccatcgagaatt

SEQ ID NO: 522749 - DNA, 25 bp, Rattus norvegicus
aggcccgtgccactctatggtttcc

SEQ ID NO: 522750 - DNA, 25 bp, Rattus norvegicus
gcggtcactctgtctctcttcgagg

SEQ ID NO: 522751 - DNA, 25 bp, Rattus norvegicus
gctgcatctctatggtccgactgga

SEQ ID NO: 522752 - DNA, 25 bp, Rattus norvegicus
ccaaggcctattcaagctggggcta

SEQ ID NO: 522753 - DNA, 25 bp, Rattus norvegicus
cggaggtcacggctgtcaattcacc

SEQ ID NO: 522754 - DNA, 25 bp, Rattus norvegicus
cctgcaaggcttgggatgatgcatc

SEQ ID NO: 522755 - DNA, 25 bp, Rattus norvegicus
ttcggacggtccgaagctgttgcta

SEQ ID NO: 522756 - DNA, 25 bp, Rattus norvegicus
gttcccggttcagtagctcgcctac

SEQ ID NO: 522757 - DNA, 25 bp, Rattus norvegicus
gtagctcgcctacgaaaggatgtca

SEQ ID NO: 522758 - DNA, 25 bp, Rattus norvegicus
cgaaaggatgtcagggtctcttcca

SEQ ID NO: 522759 - DNA, 25 bp, Rattus norvegicus
ctatgatccaccctttatgccggtg

SEQ ID NO: 522760 - DNA, 25 bp, Rattus norvegicus
atccaccctttatgccggtggttcg

SEQ ID NO: 522761 - DNA, 25 bp, Rattus norvegicus
ccgaagctgttgctagctcccagca

SEQ ID NO: 522762 - DNA, 25 bp, Rattus norvegicus
accagatccaggcagccagccaaaa

SEQ ID NO: 522763 - DNA, 25 bp, Rattus norvegicus
gccagccaaaacctatgacccaaag

SEQ ID NO: 522764 - DNA, 25 bp, Rattus norvegicus
tgacccaaagttaccagtcctcttc

SEQ ID NO: 522765 - DNA, 25 bp, Rattus norvegicus
ggcagctgtagacgcagacgccgcc

SEQ ID NO: 522766 - DNA, 25 bp, Rattus norvegicus
tctccggctcttggccggaaccgga

SEQ ID NO: 522767 - DNA, 25 bp, Rattus norvegicus
ctggccaggccgctgtagacccagt

SEQ ID NO: 522768 - DNA, 25 bp, Rattus norvegicus
ctgttgctagctcccagcaccagat

SEQ ID NO: 522769 - DNA, 25 bp, Rattus norvegicus
ctttctggccttgcgtctgtccgct

SEQ ID NO: 522770 - DNA, 25 bp, Rattus norvegicus
tgcctttctccggtgaggccgaaac

SEQ ID NO: 522771 - DNA, 25 bp, Rattus norvegicus
caccgtgacgcaggggtaccctagg

SEQ ID NO: 522772 - DNA, 25 bp, Rattus norvegicus
gtaccctaggtgagtgtggccgcat

SEQ ID NO: 522773 - DNA, 25 bp, Rattus norvegicus
ggccgcatagttggcgtccgaccct

SEQ ID NO: 522774 - DNA, 25 bp, Rattus norvegicus
tagttggcgtccgacccttgtcggc

SEQ ID NO: 522775 - DNA, 25 bp, Rattus norvegicus
gacgtccagccaccgtgacgcaggg

SEQ ID NO: 522776 - DNA, 25 bp, Rattus norvegicus
ggactcgctccggaatccttctcgg

SEQ ID NO: 522777 - DNA, 25 bp, Rattus norvegicus
cctccacgtggggagaacttcgttg

SEQ ID NO: 522778 - DNA, 25 bp, Rattus norvegicus
gaacttcgttggcttctcctcgggc

SEQ ID NO: 522779 - DNA, 25 bp, Rattus norvegicus
cagcctactgggtcttggtttcagc

SEQ ID NO: 522780 - DNA, 25 bp, Rattus norvegicus
tggtttcagcgagccctctttcccg

SEQ ID NO: 522781 - DNA, 25 bp, Rattus norvegicus
agcctggttgctagggacacctgag

SEQ ID NO: 522782 - DNA, 25 bp, Rattus norvegicus
gggacacctgaggtcgcacgctcgc

SEQ ID NO: 522783 - DNA, 25 bp, Rattus norvegicus
caccgccgccggagctctagtctcc

SEQ ID NO: 522784 - DNA, 25 bp, Rattus norvegicus
ccgcgccagactgcgggagagctct

SEQ ID NO: 522785 - DNA, 25 bp, Rattus norvegicus
gtttgccttgaagcccggtgccggc

SEQ ID NO: 522786 - DNA, 25 bp, Rattus norvegicus
tgctgctcttgtgccctgcgcacgt

SEQ ID NO: 522787 - DNA, 25 bp, Rattus norvegicus
actgcgggagagctctcaggatgct

SEQ ID NO: 522788 - DNA, 25 bp, Rattus norvegicus
ctcggtcgccgcgtttgccttgaag

SEQ ID NO: 522789 - DNA, 25 bp, Rattus norvegicus
tccgcaggagacacaggcgctggct

SEQ ID NO: 522790 - DNA, 25 bp, Rattus norvegicus
cagcgagctccgcaggagacacagg

SEQ ID NO: 522791 - DNA, 25 bp, Rattus norvegicus
tgatttcttctctccagcgagctcc

SEQ ID NO: 522792 - DNA, 25 bp, Rattus norvegicus
gccgcctgactgtcgcaactgccac

SEQ ID NO: 522793 - DNA, 25 bp, Rattus norvegicus
cctcccaagagtcccgccgcctgac

SEQ ID NO: 522794 - DNA, 25 bp, Rattus norvegicus
gggcgcacggctccctcccaagagt

SEQ ID NO: 522795 - DNA, 25 bp, Rattus norvegicus
cccgcccttcgcagcgctctgcgcc

SEQ ID NO: 522796 - DNA, 25 bp, Rattus norvegicus
tgccctcctgcctcggactgctgct

SEQ ID NO: 522797 - DNA, 25 bp, Rattus norvegicus
ctgggcacccagtttcctgaatgaa

SEQ ID NO: 522798 - DNA, 25 bp, Rattus norvegicus
cagacccgtctaagccgccagaaag

SEQ ID NO: 522799 - DNA, 25 bp, Rattus norvegicus
aggctctcagactgtcaccaaggtc

SEQ ID NO: 522800 - DNA, 25 bp, Rattus norvegicus
gcctagctgttccaggtgcaccttc

SEQ ID NO: 522801 - DNA, 25 bp, Rattus norvegicus
cggggcgtcagcagctactcaaatt

SEQ ID NO: 522802 - DNA, 25 bp, Rattus norvegicus
atgtggagcctcaatgtgccgtctc

SEQ ID NO: 522803 - DNA, 25 bp, Rattus norvegicus
ttcctccacaggtttctggacactg

SEQ ID NO: 522804 - DNA, 25 bp, Rattus norvegicus
aggtgctacgtcctctcattacagc

SEQ ID NO: 522805 - DNA, 25 bp, Rattus norvegicus
gcgacagcttgcagtaccttctttc

SEQ ID NO: 522806 - DNA, 25 bp, Rattus norvegicus
accggacattggactttcactggga

SEQ ID NO: 522807 - DNA, 25 bp, Rattus norvegicus
tccaaggaccctgaaagacaatgtg

SEQ ID NO: 522808 - DNA, 25 bp, Rattus norvegicus
tggctctgaccagctagacatcttc

SEQ ID NO: 522809 - DNA, 25 bp, Rattus norvegicus
tgtactaccctcttctggacactga

SEQ ID NO: 522810 - DNA, 25 bp, Rattus norvegicus
tgccaggatgtcactctcgggtaaa

SEQ ID NO: 522811 - DNA, 25 bp, Rattus norvegicus
agaactgcctgtgccgcttccactg

SEQ ID NO: 522812 - DNA, 25 bp, Rattus norvegicus
tgggcaccaacgacggcaaagctct

SEQ ID NO: 522813 - DNA, 25 bp, Rattus norvegicus
cgtacagctcgaggagaactgcctg

SEQ ID NO: 522814 - DNA, 25 bp, Rattus norvegicus
tgcgtggtgcaatgccaccgctgcc

SEQ ID NO: 522815 - DNA, 25 bp, Rattus norvegicus
gcaaagctctgttgcctgcggtccg

SEQ ID NO: 522816 - DNA, 25 bp, Rattus norvegicus
gcagaagctgccaccgttccgcgag

SEQ ID NO: 522817 - DNA, 25 bp, Rattus norvegicus
gtgctctgcgcacctgctggcagaa

SEQ ID NO: 522818 - DNA, 25 bp, Rattus norvegicus
atgggctttcgggttcctgtgctct

SEQ ID NO: 522819 - DNA, 25 bp, Rattus norvegicus
ccgagtgtaagtgccatgggctttc

SEQ ID NO: 522820 - DNA, 25 bp, Rattus norvegicus
gagccacacgcgcaccgagtgtaag

SEQ ID NO: 522821 - DNA, 25 bp, Rattus norvegicus
ttccactggtgctgcgtggtgcaat

SEQ ID NO: 522822 - DNA, 25 bp, Rattus norvegicus
acaccgccaggagagcgtacagctc

SEQ ID NO: 522823 - DNA, 25 bp, Rattus norvegicus
gaccttagcggctgcgacctgttgt

SEQ ID NO: 522824 - DNA, 25 bp, Rattus norvegicus
acctgttgtgctgcggtcgcggaca

SEQ ID NO: 522825 - DNA, 25 bp, Rattus norvegicus
ccaggcctgcaggactcctgggagt

SEQ ID NO: 522826 - DNA, 25 bp, Rattus norvegicus
acaacaaccgtgtgggcaggcaggt

SEQ ID NO: 522827 - DNA, 25 bp, Rattus norvegicus
cgcatgagactccacaacaaccgtg

SEQ ID NO: 522828 - DNA, 25 bp, Rattus norvegicus
cagagacatccacgcacgcatgaga

SEQ ID NO: 522829 - DNA, 25 bp, Rattus norvegicus
tggactcccgagagcctcacagaga

SEQ ID NO: 522830 - DNA, 25 bp, Rattus norvegicus
ggagaacgcttctccaaggactttc

SEQ ID NO: 522831 - DNA, 25 bp, Rattus norvegicus
acagcgcggaaagggcttgagccac

SEQ ID NO: 522832 - DNA, 25 bp, Rattus norvegicus
agctggacgccctacagcgcggaaa

SEQ ID NO: 522833 - DNA, 25 bp, Rattus norvegicus
aagaggcctttcgtcggaagctgca

SEQ ID NO: 522834 - DNA, 25 bp, Rattus norvegicus
ccctgggtaaactgaaggcttgcgg

SEQ ID NO: 522835 - DNA, 25 bp, Rattus norvegicus
cctacgccatagcagctgccggggt

SEQ ID NO: 522836 - DNA, 25 bp, Rattus norvegicus
ccaaggactttctggactcccgaga

SEQ ID NO: 522837 - DNA, 25 bp, Rattus norvegicus
gtggtgcacgcagtgtccaacgcgt

SEQ ID NO: 522838 - DNA, 25 bp, Rattus norvegicus
aaggcttgcggttgcgatgcctcca

SEQ ID NO: 522839 - DNA, 25 bp, Rattus norvegicus
gcagctgccagctcaagacctgctg

SEQ ID NO: 522840 - DNA, 25 bp, Rattus norvegicus
ccgcatcactgagtgggtcagcgtc

SEQ ID NO: 522841 - DNA, 25 bp, Rattus norvegicus
ctctgcaggcggtgatggagaacat

SEQ ID NO: 522842 - DNA, 25 bp, Rattus norvegicus
agtgccacggcacctcaggcagctg

SEQ ID NO: 522843 - DNA, 25 bp, Rattus norvegicus
aggtgacgccggagttccgcacagt

SEQ ID NO: 522844 - DNA, 25 bp, Rattus norvegicus
gcacaaccgcaacggtggccagttg

SEQ ID NO: 522845 - DNA, 25 bp, Rattus norvegicus
gccagcaccgggtactccagggctg

SEQ ID NO: 522846 - DNA, 25 bp, Rattus norvegicus
agaaatcgcccgacttctgtgagcg

SEQ ID NO: 522847 - DNA, 25 bp, Rattus norvegicus
agcctcgtctggactcggcaggcac

SEQ ID NO: 522848 - DNA, 25 bp, Rattus norvegicus
gggcgcctgtgcaataagagcagca

SEQ ID NO: 522849 - DNA, 25 bp, Rattus norvegicus
agagcagcacgggtccagacagctg

SEQ ID NO: 522850 - DNA, 25 bp, Rattus norvegicus
gtggccgcggtcacaacattctgcg

SEQ ID NO: 522851 - DNA, 25 bp, Rattus norvegicus
cgtggtctgcgaagaatgccgcatc

SEQ ID NO: 522852 - DNA, 25 bp, Rattus norvegicus
catgcggcgaaagtgcaagtgccac

SEQ ID NO: 522853 - DNA, 25 bp, Rattus norvegicus
tgggcaacgagatctcctacccact

SEQ ID NO: 522854 - DNA, 25 bp, Rattus norvegicus
acttcgtgtgccgacgctgctaccg

SEQ ID NO: 522855 - DNA, 25 bp, Rattus norvegicus
aaacggccgtccgtactcatctcgg

SEQ ID NO: 522856 - DNA, 25 bp, Rattus norvegicus
ctagtggcagcctcggccaagaaga

SEQ ID NO: 522857 - DNA, 25 bp, Rattus norvegicus
cagcaaaaaggtgacgcccaagcca

SEQ ID NO: 522858 - DNA, 25 bp, Rattus norvegicus
ctttggtccagcaacgcaaccggga

SEQ ID NO: 522859 - DNA, 25 bp, Rattus norvegicus
aaccttctccgcaagggtcgcgacg

SEQ ID NO: 522860 - DNA, 25 bp, Rattus norvegicus
tgctaccgcctcaaggagctgagtc

SEQ ID NO: 522861 - DNA, 25 bp, Rattus norvegicus
ggctggcaagaccaggccttcatta

SEQ ID NO: 522862 - DNA, 25 bp, Rattus norvegicus
gcctactcctacatgggcaacgaga

SEQ ID NO: 522863 - DNA, 25 bp, Rattus norvegicus
gagccggctcaaacggccgtccgta

SEQ ID NO: 522864 - DNA, 25 bp, Rattus norvegicus
cacttcttcacgcaagtctttcaag

SEQ ID NO: 522865 - DNA, 25 bp, Rattus norvegicus
tctttcaagacctcaagaacgaggg

SEQ ID NO: 522866 - DNA, 25 bp, Rattus norvegicus
gccaacctggtgttcgtgtacctgc

SEQ ID NO: 522867 - DNA, 25 bp, Rattus norvegicus
atcctcggtccagatttgtgaatcg

SEQ ID NO: 522868 - DNA, 25 bp, Rattus norvegicus
tccagatttgtgaatcgagttcccg

SEQ ID NO: 522869 - DNA, 25 bp, Rattus norvegicus
aaggcgggagcaaccgcccattggc

SEQ ID NO: 522870 - DNA, 25 bp, Rattus norvegicus
gagcaaccgcccattggctggaatt

SEQ ID NO: 522871 - DNA, 25 bp, Rattus norvegicus
cgcccattggctggaatttggcgca

SEQ ID NO: 522872 - DNA, 25 bp, Rattus norvegicus
agtcaacgcggtgccgtcatctttc

SEQ ID NO: 522873 - DNA, 25 bp, Rattus norvegicus
tcatctttctggatttgggaggagg

SEQ ID NO: 522874 - DNA, 25 bp, Rattus norvegicus
ggaaggaagatcactcgggtcactc

SEQ ID NO: 522875 - DNA, 25 bp, Rattus norvegicus
aagatcactcgggtcactccgcggc

SEQ ID NO: 522876 - DNA, 25 bp, Rattus norvegicus
cctggaggcggaaatcctcggtcca

SEQ ID NO: 522877 - DNA, 25 bp, Rattus norvegicus
ctatggcaaccagactgagcgggcg

SEQ ID NO: 522878 - DNA, 25 bp, Rattus norvegicus
tggaatttggcgcagtcaacgcggt

SEQ ID NO: 522879 - DNA, 25 bp, Rattus norvegicus
actccgcggctgtcgctatggcaac

SEQ ID NO: 522880 - DNA, 25 bp, Rattus norvegicus
aacgcggtgccgtcatctttctgga

SEQ ID NO: 522881 - DNA, 25 bp, Rattus norvegicus
ggccgtcccgtctagtgataatgac

SEQ ID NO: 522882 - DNA, 25 bp, Rattus norvegicus
catattgggcttgctcttgcgctcg

SEQ ID NO: 522883 - DNA, 25 bp, Rattus norvegicus
tagcttgtcgtagttcatattgggc

SEQ ID NO: 522884 - DNA, 25 bp, Rattus norvegicus
agcgcagtgctcgacttagcttgtc

SEQ ID NO: 522885 - DNA, 25 bp, Rattus norvegicus
ttgtcgtagtagtagcgcagtgctc

SEQ ID NO: 522886 - DNA, 25 bp, Rattus norvegicus
ccttgctcatgatgtttttgtcgta

SEQ ID NO: 522887 - DNA, 25 bp, Rattus norvegicus
agcgcttgccgtgcaccttgctcat

SEQ ID NO: 522888 - DNA, 25 bp, Rattus norvegicus
cctggaagtcaaagcggtaggcgta

SEQ ID NO: 522889 - DNA, 25 bp, Rattus norvegicus
tgccaggccctggaagtcaaagcgg

SEQ ID NO: 522890 - DNA, 25 bp, Rattus norvegicus
agcttgtaaagtgcgccatcctggg

SEQ ID NO: 522891 - DNA, 25 bp, Rattus norvegicus
gaccagccgggagcttgtaaagtgc

SEQ ID NO: 522892 - DNA, 25 bp, Rattus norvegicus
ccgaggctgccataaggttgagttt

SEQ ID NO: 522893 - DNA, 25 bp, Rattus norvegicus
tgagcttgaactcgccgtggccgcc

SEQ ID NO: 522894 - DNA, 25 bp, Rattus norvegicus
ttgggaccaggccagtaagagaagc

SEQ ID NO: 522895 - DNA, 25 bp, Rattus norvegicus
ggaagctccatccttggcgtcccag

SEQ ID NO: 522896 - DNA, 25 bp, Rattus norvegicus
tacaagagctgtaagtagtgacttc

SEQ ID NO: 522897 - DNA, 25 bp, Rattus norvegicus
aggagtgctcccaaactctgcgacg

SEQ ID NO: 522898 - DNA, 25 bp, Rattus norvegicus
ccagacagcagccagatctccgagg

SEQ ID NO: 522899 - DNA, 25 bp, Rattus norvegicus
gacggcgcccagaagacctacaaga

SEQ ID NO: 522900 - DNA, 25 bp, Rattus norvegicus
taagtagtgacttcgaggactggga

SEQ ID NO: 522901 - DNA, 25 bp, Rattus norvegicus
aggcactgtggggaagctccatcct

SEQ ID NO: 522902 - DNA, 25 bp, Rattus norvegicus
cgtcccagctttcctctcggttgta

SEQ ID NO: 522903 - DNA, 25 bp, Rattus norvegicus
tcctctcggttgtaacgcggactga

SEQ ID NO: 522904 - DNA, 25 bp, Rattus norvegicus
gcctccctaattagccctggtggtg

SEQ ID NO: 522905 - DNA, 25 bp, Rattus norvegicus
aattagccctggtggtgtggactca

SEQ ID NO: 522906 - DNA, 25 bp, Rattus norvegicus
gcagcaagcatccagacatccaggg

SEQ ID NO: 522907 - DNA, 25 bp, Rattus norvegicus
tgtggactcagacgccgggtttagt

SEQ ID NO: 522908 - DNA, 25 bp, Rattus norvegicus
gtcgcagtgactcagccgctaccag

SEQ ID NO: 522909 - DNA, 25 bp, Rattus norvegicus
ccctttcttttgtccatcgatcttg

SEQ ID NO: 522910 - DNA, 25 bp, Rattus norvegicus
agcgatgctcccagctacaaggccg

SEQ ID NO: 522911 - DNA, 25 bp, Rattus norvegicus
tcccatcgcaataaagtctccaacg

SEQ ID NO: 522912 - DNA, 25 bp, Rattus norvegicus
cctggtaggtacatgttgatcagca

SEQ ID NO: 522913 - DNA, 25 bp, Rattus norvegicus
ttctcggccggtaagaacacttgga

SEQ ID NO: 522914 - DNA, 25 bp, Rattus norvegicus
cgaagatgaggacccttgagggctc

SEQ ID NO: 522915 - DNA, 25 bp, Rattus norvegicus
acagcctctgggcaatgttggagcc

SEQ ID NO: 522916 - DNA, 25 bp, Rattus norvegicus
cgatcctgaatctgcgtgtcatcta

SEQ ID NO: 522917 - DNA, 25 bp, Rattus norvegicus
gaaaggggcacttggaattctcggc

SEQ ID NO: 522918 - DNA, 25 bp, Rattus norvegicus
agacttcccgcccagggtcttggtg

SEQ ID NO: 522919 - DNA, 25 bp, Rattus norvegicus
tgggctccagttcggagctcagacc

SEQ ID NO: 522920 - DNA, 25 bp, Rattus norvegicus
cgcgctagtcgagtctgagcgagca

SEQ ID NO: 522921 - DNA, 25 bp, Rattus norvegicus
aaacccagaggggatcgcgctagtc

SEQ ID NO: 522922 - DNA, 25 bp, Rattus norvegicus
tgcttgcagcctcctacgatcctga

SEQ ID NO: 522923 - DNA, 25 bp, Rattus norvegicus
gttctccctcaacttccttggcgga

SEQ ID NO: 522924 - DNA, 25 bp, Rattus norvegicus
cctcaacttccttggcggaggggcg

SEQ ID NO: 522925 - DNA, 25 bp, Rattus norvegicus
agtgcggcgtcgctcagcgatcccg

SEQ ID NO: 522926 - DNA, 25 bp, Rattus norvegicus
cccggggcttatgctgagaagccgc

SEQ ID NO: 522927 - DNA, 25 bp, Rattus norvegicus
ctgtggctgacacgtcggcgacagc

SEQ ID NO: 522928 - DNA, 25 bp, Rattus norvegicus
cagtctctgcgacccatatggtggc

SEQ ID NO: 522929 - DNA, 25 bp, Rattus norvegicus
tgaagggagccggtcgttctccctc

SEQ ID NO: 522930 - DNA, 25 bp, Rattus norvegicus
gccgaacgaacaaaacgctcaggtc

SEQ ID NO: 522931 - DNA, 25 bp, Rattus norvegicus
tgcctcacgcgagccgaacgaacaa

SEQ ID NO: 522932 - DNA, 25 bp, Rattus norvegicus
cagtcgtcgtcggagatgtccggtt

SEQ ID NO: 522933 - DNA, 25 bp, Rattus norvegicus
atgtccggttgatgagcttcttcga

SEQ ID NO: 522934 - DNA, 25 bp, Rattus norvegicus
tgatgagcttcttcgagtgcggcgt

SEQ ID NO: 522935 - DNA, 25 bp, Rattus norvegicus
cacctgctcactgctgtggctgaca

SEQ ID NO: 522936 - DNA, 25 bp, Rattus norvegicus
gggacaccctgctcagtctctgcga

SEQ ID NO: 522937 - DNA, 25 bp, Rattus norvegicus
gggtgagctccttgaagcgctcaga

SEQ ID NO: 522938 - DNA, 25 bp, Rattus norvegicus
gctcgacagcgaacctgcagcaagg

SEQ ID NO: 522939 - DNA, 25 bp, Rattus norvegicus
agctgctgccgtctgcggcgcagca

SEQ ID NO: 522940 - DNA, 25 bp, Rattus norvegicus
cgtttgttttggcaacgcggcgacg

SEQ ID NO: 522941 - DNA, 25 bp, Rattus norvegicus
tcgccggccgccaataaataggccg

SEQ ID NO: 522942 - DNA, 25 bp, Rattus norvegicus
cacagcttcggggactcaggcgtct

SEQ ID NO: 522943 - DNA, 25 bp, Rattus norvegicus
cacgagtttacgaggcggcctccgg

SEQ ID NO: 522944 - DNA, 25 bp, Rattus norvegicus
cttgtaggcaagaggcacgagttta

SEQ ID NO: 522945 - DNA, 25 bp, Rattus norvegicus
gcacgttggggctgaactgcttgta

SEQ ID NO: 522946 - DNA, 25 bp, Rattus norvegicus
gcccagggtcttctccggcacgttg

SEQ ID NO: 522947 - DNA, 25 bp, Rattus norvegicus
agctgcgcgcgatcttgccttcgta

SEQ ID NO: 522948 - DNA, 25 bp, Rattus norvegicus
cgtctttgaagatgatgtcgggatt

SEQ ID NO: 522949 - DNA, 25 bp, Rattus norvegicus
accggtgttctcctcgtctttgaag

SEQ ID NO: 522950 - DNA, 25 bp, Rattus norvegicus
atcttgccttcgtagcgcccgctgg

SEQ ID NO: 522951 - DNA, 25 bp, Rattus norvegicus
cgcctccgctagcaggaaaaagaga

SEQ ID NO: 522952 - DNA, 25 bp, Rattus norvegicus
aaaagagagcccgaagcaggatggt

SEQ ID NO: 522953 - DNA, 25 bp, Rattus norvegicus
ggaggggtcacacgaaccctcaatg

SEQ ID NO: 522954 - DNA, 25 bp, Rattus norvegicus
ctggcccagagaaaaggtgtatatc

SEQ ID NO: 522955 - DNA, 25 bp, Rattus norvegicus
aggtgtatatctccctggcaaccca

SEQ ID NO: 522956 - DNA, 25 bp, Rattus norvegicus
tggcaacccatcaccatgcaacagg

SEQ ID NO: 522957 - DNA, 25 bp, Rattus norvegicus
ccatgcaacagggtctcccgggata

SEQ ID NO: 522958 - DNA, 25 bp, Rattus norvegicus
tctcccgggatacggcctgggatgc

SEQ ID NO: 522959 - DNA, 25 bp, Rattus norvegicus
cctgggatgcgctgacgtcagcacc

SEQ ID NO: 522960 - DNA, 25 bp, Rattus norvegicus
aaggcgttagcaagccagcccgctg

SEQ ID NO: 522961 - DNA, 25 bp, Rattus norvegicus
acgaaccctcaatgtgaacgccaca

SEQ ID NO: 522962 - DNA, 25 bp, Rattus norvegicus
cccgccaaacatgcacagaaaaggc

SEQ ID NO: 522963 - DNA, 25 bp, Rattus norvegicus
aaaggcgcagcacctctggcaagtc

SEQ ID NO: 522964 - DNA, 25 bp, Rattus norvegicus
gacgtcagcaccgaaggcgttagca

SEQ ID NO: 522965 - DNA, 25 bp, Rattus norvegicus
tcctagccaagatcctggggacctg

SEQ ID NO: 522966 - DNA, 25 bp, Rattus norvegicus
gtagggttactccagcaattaaatg

SEQ ID NO: 522967 - DNA, 25 bp, Rattus norvegicus
cttacccgtgggagaactgtgaaca

SEQ ID NO: 522968 - DNA, 25 bp, Rattus norvegicus
cacgcgctggtgtttgtttatccgc

SEQ ID NO: 522969 - DNA, 25 bp, Rattus norvegicus
gaagcccacttccttcggtcggagc

SEQ ID NO: 522970 - DNA, 25 bp, Rattus norvegicus
acgggagatctccagtggctctgta

SEQ ID NO: 522971 - DNA, 25 bp, Rattus norvegicus
tggctctgtaaacaccgggaaaaga

SEQ ID NO: 522972 - DNA, 25 bp, Rattus norvegicus
gcacaacttcgtgggtgcaggatca

SEQ ID NO: 522973 - DNA, 25 bp, Rattus norvegicus
acgtcacatgacagcgcgctcggtc

SEQ ID NO: 522974 - DNA, 25 bp, Rattus norvegicus
tcacgtgacacttgaccgcaggttg

SEQ ID NO: 522975 - DNA, 25 bp, Rattus norvegicus
ccagactttggggtcgtggtacaga

SEQ ID NO: 522976 - DNA, 25 bp, Rattus norvegicus
acacgagattgcttcccaggtttta

SEQ ID NO: 522977 - DNA, 25 bp, Rattus norvegicus
gggaaggcgcactcaatcagcaatg

SEQ ID NO: 522978 - DNA, 25 bp, Rattus norvegicus
acagcgcctggaatgttttattttc

SEQ ID NO: 522979 - DNA, 25 bp, Rattus norvegicus
gctcgaagttgagggcgtgaccaaa

SEQ ID NO: 522980 - DNA, 25 bp, Rattus norvegicus
gctcactgttccgagccgagctgtc

SEQ ID NO: 522981 - DNA, 25 bp, Rattus norvegicus
cggacctcggggctcactgttccga

SEQ ID NO: 522982 - DNA, 25 bp, Rattus norvegicus
tccaggcgatggagtttccggacct

SEQ ID NO: 522983 - DNA, 25 bp, Rattus norvegicus
ttggcacgctcagctcccgtttctt

SEQ ID NO: 522984 - DNA, 25 bp, Rattus norvegicus
aacaggagtccttggcacgctcagc

SEQ ID NO: 522985 - DNA, 25 bp, Rattus norvegicus
gggactctccgcctgcaatctactg

SEQ ID NO: 522986 - DNA, 25 bp, Rattus norvegicus
acccggcccagaacaggagtccttg

SEQ ID NO: 522987 - DNA, 25 bp, Rattus norvegicus
cccggagttgctgtgttgcggaccc

SEQ ID NO: 522988 - DNA, 25 bp, Rattus norvegicus
acccaggcttcggtaacctgtgctg

SEQ ID NO: 522989 - DNA, 25 bp, Rattus norvegicus
tggacccgcccaacgtgatgacgtc

SEQ ID NO: 522990 - DNA, 25 bp, Rattus norvegicus
caatctactgttgcccgcgatggac

SEQ ID NO: 522991 - DNA, 25 bp, Rattus norvegicus
gtggctcaactcttctgggactctc

SEQ ID NO: 522992 - DNA, 25 bp, Rattus norvegicus
ggcgtgaccaaattgatcgagtacg

SEQ ID NO: 522993 - DNA, 25 bp, Rattus norvegicus
atcctgtgctcggtcctcagcgacg

SEQ ID NO: 522994 - DNA, 25 bp, Rattus norvegicus
cctcacgggtgtgagagctggacct

SEQ ID NO: 522995 - DNA, 25 bp, Rattus norvegicus
tcctcttgccgcctcttgttgctag

SEQ ID NO: 522996 - DNA, 25 bp, Rattus norvegicus
ccagaggtgggctcgagtcccgcac

SEQ ID NO: 522997 - DNA, 25 bp, Rattus norvegicus
tattggcagatcctgtgctcggtcc

SEQ ID NO: 522998 - DNA, 25 bp, Rattus norvegicus
gaagagtttgtattggcagatcctg

SEQ ID NO: 522999 - DNA, 25 bp, Rattus norvegicus
cctggccctttgcacaggcaggagc

SEQ ID NO: 523000 - DNA, 25 bp, Rattus norvegicus
ggtccctggccctttgcacaggcag

SEQ ID NO: 523001 - DNA, 25 bp, Rattus norvegicus
ggactgatgatgtcaccgtagcttc

SEQ ID NO: 523002 - DNA, 25 bp, Rattus norvegicus
ttcgacgcggactgatgatgtcacc

SEQ ID NO: 523003 - DNA, 25 bp, Rattus norvegicus
aggccgttacttcgacgcggactga

SEQ ID NO: 523004 - DNA, 25 bp, Rattus norvegicus
ctaggatacagcaggccgttacttc

SEQ ID NO: 523005 - DNA, 25 bp, Rattus norvegicus
tgccgcctcttgttgctaggataca

SEQ ID NO: 523006 - DNA, 25 bp, Rattus norvegicus
gatgtcaccgtagcttccggtccct

SEQ ID NO: 523007 - DNA, 25 bp, Rattus norvegicus
tagggcggatgaagctcaagcaatc

SEQ ID NO: 523008 - DNA, 25 bp, Rattus norvegicus
tggccaccaggagtgaagcctagtc

SEQ ID NO: 523009 - DNA, 25 bp, Rattus norvegicus
gtgccgcaccactcttatatgaagg

SEQ ID NO: 523010 - DNA, 25 bp, Rattus norvegicus
tgccggtccggatttcctcacctgt

SEQ ID NO: 523011 - DNA, 25 bp, Rattus norvegicus
ctcacctgtcgggtttggcttagaa

SEQ ID NO: 523012 - DNA, 25 bp, Rattus norvegicus
tggcttagaagctgcggcccgtatt

SEQ ID NO: 523013 - DNA, 25 bp, Rattus norvegicus
ggcccgtattcgctcctagttttga

SEQ ID NO: 523014 - DNA, 25 bp, Rattus norvegicus
cccatagtgcaggtgttccgattta

SEQ ID NO: 523015 - DNA, 25 bp, Rattus norvegicus
gatggcaggctttcgcccacacctg

SEQ ID NO: 523016 - DNA, 25 bp, Rattus norvegicus
ggccgaggacctagaactacagagc

SEQ ID NO: 523017 - DNA, 25 bp, Rattus norvegicus
agggtgccgattccgtacactgtcc

SEQ ID NO: 523018 - DNA, 25 bp, Rattus norvegicus
ccgacgcgagaatctgctacctttc

SEQ ID NO: 523019 - DNA, 25 bp, Rattus norvegicus
ggctccgtcattagcgccgtcacta

SEQ ID NO: 523020 - DNA, 25 bp, Rattus norvegicus
gcgtgtctcgattgcacctgcgtca

SEQ ID NO: 523021 - DNA, 25 bp, Rattus norvegicus
accagataaaggctgcgaagaagcc

SEQ ID NO: 523022 - DNA, 25 bp, Rattus norvegicus
tgacggctgagttgccatggcatcc

SEQ ID NO: 523023 - DNA, 25 bp, Rattus norvegicus
gccggccctctctgagtctctagta

SEQ ID NO: 523024 - DNA, 25 bp, Rattus norvegicus
tgagatagccctgggcatcggcctg

SEQ ID NO: 523025 - DNA, 25 bp, Rattus norvegicus
atgacatcaagaaggcgtaagtgcc

SEQ ID NO: 523026 - DNA, 25 bp, Rattus norvegicus
catggcatcctactacgagattcta

SEQ ID NO: 523027 - DNA, 25 bp, Rattus norvegicus
ctcgcagtgtcttctgcctgccggg

SEQ ID NO: 523028 - DNA, 25 bp, Rattus norvegicus
ggccggattccacctcgcagtgtct

SEQ ID NO: 523029 - DNA, 25 bp, Rattus norvegicus
aagaagcctagtcaccggccgcagg

SEQ ID NO: 523030 - DNA, 25 bp, Rattus norvegicus
cctgcgggaccagataaaggctgcg

SEQ ID NO: 523031 - DNA, 25 bp, Rattus norvegicus
ctccgatcgggttactggtgttagg

SEQ ID NO: 523032 - DNA, 25 bp, Rattus norvegicus
cgctgacgcatgcttgcgcacacaa

SEQ ID NO: 523033 - DNA, 25 bp, Rattus norvegicus
agtctctagtagtttccgcggcgct

SEQ ID NO: 523034 - DNA, 25 bp, Rattus norvegicus
cgagattctagacgtaccgcggagt

SEQ ID NO: 523035 - DNA, 25 bp, Rattus norvegicus
tatcccgcagggtctgagcgaacgt

SEQ ID NO: 523036 - DNA, 25 bp, Rattus norvegicus
tgccggccagctgaggaagtggaac

SEQ ID NO: 523037 - DNA, 25 bp, Rattus norvegicus
aactgagtgagcgtgcgcgtctcct

SEQ ID NO: 523038 - DNA, 25 bp, Rattus norvegicus
cgcgtctcctgggtctgcacgttct

SEQ ID NO: 523039 - DNA, 25 bp, Rattus norvegicus
cctgggtctgcacgttcttcaggta

SEQ ID NO: 523040 - DNA, 25 bp, Rattus norvegicus
tgcacgttcttcaggtagaagctcc

SEQ ID NO: 523041 - DNA, 25 bp, Rattus norvegicus
agaagctccgcaccaggaagtcctc

SEQ ID NO: 523042 - DNA, 25 bp, Rattus norvegicus
agtcctcgcaccagatgtgctcaga

SEQ ID NO: 523043 - DNA, 25 bp, Rattus norvegicus
ccagatgtgctcagacaccaggttc

SEQ ID NO: 523044 - DNA, 25 bp, Rattus norvegicus
aggttcacctgtcgggtatcccgca

SEQ ID NO: 523045 - DNA, 25 bp, Rattus norvegicus
agcgaacgtgcgcacgcgctctgct

SEQ ID NO: 523046 - DNA, 25 bp, Rattus norvegicus
ttcaggtagaagctccgcaccagga

SEQ ID NO: 523047 - DNA, 25 bp, Rattus norvegicus
tgtgctcagacaccaggttcacctg

SEQ ID NO: 523048 - DNA, 25 bp, Rattus norvegicus
accaggaagtcctcgcaccagatgt

SEQ ID NO: 523049 - DNA, 25 bp, Rattus norvegicus
ggtctctacctcgatgcctctggct

SEQ ID NO: 523050 - DNA, 25 bp, Rattus norvegicus
ggctcttaggcctatttgcgtcata

SEQ ID NO: 523051 - DNA, 25 bp, Rattus norvegicus
ggcgtgcaatgacgacatctccacc

SEQ ID NO: 523052 - DNA, 25 bp, Rattus norvegicus
ccggccaactgcaggcgtgcaatga

SEQ ID NO: 523053 - DNA, 25 bp, Rattus norvegicus
gagcctaggcggagtctgccactcc

SEQ ID NO: 523054 - DNA, 25 bp, Rattus norvegicus
tgggagtcaacccaggagcctaggc

SEQ ID NO: 523055 - DNA, 25 bp, Rattus norvegicus
tctccggccagagtctcagcgacgt

SEQ ID NO: 523056 - DNA, 25 bp, Rattus norvegicus
ggtggtcgccaattctccttctcgg

SEQ ID NO: 523057 - DNA, 25 bp, Rattus norvegicus
ggcggccgctcaacaacagcaggca

SEQ ID NO: 523058 - DNA, 25 bp, Rattus norvegicus
tcaagtttcctcctgaccgtgggca

SEQ ID NO: 523059 - DNA, 25 bp, Rattus norvegicus
ataagcttcttgctttcgcgacgcc

SEQ ID NO: 523060 - DNA, 25 bp, Rattus norvegicus
tgaacctagtcttccctggagccca

SEQ ID NO: 523061 - DNA, 25 bp, Rattus norvegicus
ctctggcttctcctacagtcctgta

SEQ ID NO: 523062 - DNA, 25 bp, Rattus norvegicus
cgattcttcatctcgggtctctacc

SEQ ID NO: 523063 - DNA, 25 bp, Rattus norvegicus
tgatattctggaaacttttacaaag

SEQ ID NO: 523064 - DNA, 25 bp, Rattus norvegicus
gcgatttgagggctactaccattca

SEQ ID NO: 523065 - DNA, 25 bp, Rattus norvegicus
gcaacgcgatttgagggctactacc

SEQ ID NO: 523066 - DNA, 25 bp, Rattus norvegicus
agggctactaccattcagaccattg

SEQ ID NO: 523067 - DNA, 25 bp, Rattus norvegicus
tgatctttggggcaacgcgatttga

SEQ ID NO: 523068 - DNA, 25 bp, Rattus norvegicus
aaccagacgagctggcttcctgtgg

SEQ ID NO: 523069 - DNA, 25 bp, Rattus norvegicus
tgtgcaacccgcgaggttctcccgg

SEQ ID NO: 523070 - DNA, 25 bp, Rattus norvegicus
tcagaccattgtcccagggtgattg

SEQ ID NO: 523071 - DNA, 25 bp, Rattus norvegicus
gtgtcttctttcttttgatattctg

SEQ ID NO: 523072 - DNA, 25 bp, Rattus norvegicus
gggtgattgtgtcttctttcttttg

SEQ ID NO: 523073 - DNA, 25 bp, Rattus norvegicus
tcccagggtgattgtgtcttctttc

SEQ ID NO: 523074 - DNA, 25 bp, Rattus norvegicus
attgctctgatctttggggcaacgc

SEQ ID NO: 523075 - DNA, 25 bp, Rattus norvegicus
ccattcagaccattgtcccagggtg

SEQ ID NO: 523076 - DNA, 25 bp, Rattus norvegicus
atctggggagactggagatcctggc

SEQ ID NO: 523077 - DNA, 25 bp, Rattus norvegicus
tccttccaaacacgcggactgttct

SEQ ID NO: 523078 - DNA, 25 bp, Rattus norvegicus
tgcttctcgctcagttcccgtcagg

SEQ ID NO: 523079 - DNA, 25 bp, Rattus norvegicus
gcactcctctccaggggtcggactt

SEQ ID NO: 523080 - DNA, 25 bp, Rattus norvegicus
ggcggcagccacctacctgcatagt

SEQ ID NO: 523081 - DNA, 25 bp, Rattus norvegicus
tctagacgaagttgaggcgcgaccg

SEQ ID NO: 523082 - DNA, 25 bp, Rattus norvegicus
cggccggctgtctagacgaagttga

SEQ ID NO: 523083 - DNA, 25 bp, Rattus norvegicus
cgcggaggctttcagttttactttg

SEQ ID NO: 523084 - DNA, 25 bp, Rattus norvegicus
tttgaaaccggagtacgctcgtctc

SEQ ID NO: 523085 - DNA, 25 bp, Rattus norvegicus
gcggactgttctgcgccaatcaggc

SEQ ID NO: 523086 - DNA, 25 bp, Rattus norvegicus
cgtggactagtcagcaccagtcata

SEQ ID NO: 523087 - DNA, 25 bp, Rattus norvegicus
tcagggtgcgttctaaccacgtgga

SEQ ID NO: 523088 - DNA, 25 bp, Rattus norvegicus
tgcctcctcccaatcagggtgcgtt

SEQ ID NO: 523089 - DNA, 25 bp, Rattus norvegicus
ttaggacatgttccggttccgctcc

SEQ ID NO: 523090 - DNA, 25 bp, Rattus norvegicus
gccgccttaagcgtagctccaaaag

SEQ ID NO: 523091 - DNA, 25 bp, Rattus norvegicus
cccacgagcaggcttcggtaccaag

SEQ ID NO: 523092 - DNA, 25 bp, Rattus norvegicus
tggagctgcaagagctcaatgaccg

SEQ ID NO: 523093 - DNA, 25 bp, Rattus norvegicus
cgacgtggagcgtgacaacctgata

SEQ ID NO: 523094 - DNA, 25 bp, Rattus norvegicus
agtggaggtcctcaccaaccagcgc

SEQ ID NO: 523095 - DNA, 25 bp, Rattus norvegicus
aggtcaaccggctcaagggccgaga

SEQ ID NO: 523096 - DNA, 25 bp, Rattus norvegicus
tttggaacagcagaacgccgcgctc

SEQ ID NO: 523097 - DNA, 25 bp, Rattus norvegicus
gagaaggtgcgctttttggaacagc

SEQ ID NO: 523098 - DNA, 25 bp, Rattus norvegicus
gccgacgcagtgaaccaggagttcc

SEQ ID NO: 523099 - DNA, 25 bp, Rattus norvegicus
cgggcgagctgctggacttctcgct

SEQ ID NO: 523100 - DNA, 25 bp, Rattus norvegicus
agcaccatcctatggcgcgggcgag

SEQ ID NO: 523101 - DNA, 25 bp, Rattus norvegicus
atcccgcgtgtaccaggtgtcgcgc

SEQ ID NO: 523102 - DNA, 25 bp, Rattus norvegicus
taccaagggctcctcgagctcagtg

SEQ ID NO: 523103 - DNA, 25 bp, Rattus norvegicus
gagctctccggtgttcccacgagca

SEQ ID NO: 523104 - DNA, 25 bp, Rattus norvegicus
agctcagtgacatcccgcgtgtacc

SEQ ID NO: 523105 - DNA, 25 bp, Rattus norvegicus
tacagcccatggcagggcacccagg

SEQ ID NO: 523106 - DNA, 25 bp, Rattus norvegicus
gcgcggggccgtgcccacccagaac

SEQ ID NO: 523107 - DNA, 25 bp, Rattus norvegicus
aacagggccggtgacgtaagcgcgg

SEQ ID NO: 523108 - DNA, 25 bp, Rattus norvegicus
gagcagcgcgtctgctgccgctccc

SEQ ID NO: 523109 - DNA, 25 bp, Rattus norvegicus
ccagggaggggacagcctgtgagaa

SEQ ID NO: 523110 - DNA, 25 bp, Rattus norvegicus
gtcgggccgcggtcaccaccaggga

SEQ ID NO: 523111 - DNA, 25 bp, Rattus norvegicus
ccatcgccttgcagagggtcgggcc

SEQ ID NO: 523112 - DNA, 25 bp, Rattus norvegicus
ctgaccggctgagcgccgagagcca

SEQ ID NO: 523113 - DNA, 25 bp, Rattus norvegicus
acccaggcacgctagcccgcgctcg

SEQ ID NO: 523114 - DNA, 25 bp, Rattus norvegicus
gcgccgagagccaatacagcccatg

SEQ ID NO: 523115 - DNA, 25 bp, Rattus norvegicus
cccacccagaacaggcggggcaagc

SEQ ID NO: 523116 - DNA, 25 bp, Rattus norvegicus
ccgggccatcgccttgcagagggtc

SEQ ID NO: 523117 - DNA, 25 bp, Rattus norvegicus
ctccgcctcttaccctgaccggctg

SEQ ID NO: 523118 - DNA, 25 bp, Rattus norvegicus
taccctgaccggctgagcgccgaga

SEQ ID NO: 523119 - DNA, 25 bp, Rattus norvegicus
caggacgccggcgtgtacagctgca

SEQ ID NO: 523120 - DNA, 25 bp, Rattus norvegicus
ggacacccgagcctagcctcagttg

SEQ ID NO: 523121 - DNA, 25 bp, Rattus norvegicus
ccctggtgaccttctgggtagcaca

SEQ ID NO: 523122 - DNA, 25 bp, Rattus norvegicus
atgggcagctcctgcctacaccggt

SEQ ID NO: 523123 - DNA, 25 bp, Rattus norvegicus
agcctagcctcagttggttccggga

SEQ ID NO: 523124 - DNA, 25 bp, Rattus norvegicus
cccagctgcctatggctgcggaact

SEQ ID NO: 523125 - DNA, 25 bp, Rattus norvegicus
gttgtgagcgggacacccgagccta

SEQ ID NO: 523126 - DNA, 25 bp, Rattus norvegicus
gccatgcaaaaagcccggggtacgc

SEQ ID NO: 523127 - DNA, 25 bp, Rattus norvegicus
ccagctcatagaggccatgcaaaaa

SEQ ID NO: 523128 - DNA, 25 bp, Rattus norvegicus
cctagtccagctcatagaggccatg

SEQ ID NO: 523129 - DNA, 25 bp, Rattus norvegicus
aacgtcccttgcctccctagtccag

SEQ ID NO: 523130 - DNA, 25 bp, Rattus norvegicus
aggactcatctcttaaggcaccata

SEQ ID NO: 523131 - DNA, 25 bp, Rattus norvegicus
cttctgggtagcacaggccgaaagc

SEQ ID NO: 523132 - DNA, 25 bp, Rattus norvegicus
ttccgggatgggcagctcctgccta

SEQ ID NO: 523133 - DNA, 25 bp, Rattus norvegicus
cggttgcagcctcagcacgtagcgc

SEQ ID NO: 523134 - DNA, 25 bp, Rattus norvegicus
aagcaaagcgcatggatccgagccg

SEQ ID NO: 523135 - DNA, 25 bp, Rattus norvegicus
cgccctggccggctactggaaagcg

SEQ ID NO: 523136 - DNA, 25 bp, Rattus norvegicus
tccggagatcgtgaaagcaaagcgc

SEQ ID NO: 523137 - DNA, 25 bp, Rattus norvegicus
tcggtattccggagatcgtgaaagc

SEQ ID NO: 523138 - DNA, 25 bp, Rattus norvegicus
ccactctgcagtcttcggtattccg

SEQ ID NO: 523139 - DNA, 25 bp, Rattus norvegicus
tcgtgaaagcaaagcgcatggatcc

SEQ ID NO: 523140 - DNA, 25 bp, Rattus norvegicus
cacgtagcgcccactggctgcttta

SEQ ID NO: 523141 - DNA, 25 bp, Rattus norvegicus
tgcagtcttcggtattccggagatc

SEQ ID NO: 523142 - DNA, 25 bp, Rattus norvegicus
gctgaagggcagaagccccccatca

SEQ ID NO: 523143 - DNA, 25 bp, Rattus norvegicus
gccggctactggaaagcgcaggccc

SEQ ID NO: 523144 - DNA, 25 bp, Rattus norvegicus
ctcccccgccatgaagaagctgtgg

SEQ ID NO: 523145 - DNA, 25 bp, Rattus norvegicus
agctgtgggtgaagaagcgtttcca

SEQ ID NO: 523146 - DNA, 25 bp, Rattus norvegicus
ggctgctttaccgtctcacccacat

SEQ ID NO: 523147 - DNA, 25 bp, Rattus norvegicus
agtctgtacagaggacgggcgctct

SEQ ID NO: 523148 - DNA, 25 bp, Rattus norvegicus
tctcgatccacgtgtaagtaattgc

SEQ ID NO: 523149 - DNA, 25 bp, Rattus norvegicus
gatccacgtgtaagtaattgcttcg

SEQ ID NO: 523150 - DNA, 25 bp, Rattus norvegicus
ggcgctctcgatccacgtgtaagta

SEQ ID NO: 523151 - DNA, 25 bp, Rattus norvegicus
cgagctaatctggtgggcgcaagct

SEQ ID NO: 523152 - DNA, 25 bp, Rattus norvegicus
ccaggcagcccaaggcaagcacaga

SEQ ID NO: 523153 - DNA, 25 bp, Rattus norvegicus
agcccaaggcaagcacagacaaccg

SEQ ID NO: 523154 - DNA, 25 bp, Rattus norvegicus
caagcacagacaaccggggccgggc

SEQ ID NO: 523155 - DNA, 25 bp, Rattus norvegicus
tggtgcgggcatcgcgagctaatct

SEQ ID NO: 523156 - DNA, 25 bp, Rattus norvegicus
atcgcgagctaatctggtgggcgca

SEQ ID NO: 523157 - DNA, 25 bp, Rattus norvegicus
tggcagcgcgttcagtctgtacaga

SEQ ID NO: 523158 - DNA, 25 bp, Rattus norvegicus
agtgacctgtatggcagcgcgttca

SEQ ID NO: 523159 - DNA, 25 bp, Rattus norvegicus
cctttcggtggccagtgacctgtat

SEQ ID NO: 523160 - DNA, 25 bp, Rattus norvegicus
tcagaggatagcctttcggtggcca

SEQ ID NO: 523161 - DNA, 25 bp, Rattus norvegicus
ccatcggtgtactcaggagccctcg

SEQ ID NO: 523162 - DNA, 25 bp, Rattus norvegicus
tcaagcgtcgggaccaattcccact

SEQ ID NO: 523163 - DNA, 25 bp, Rattus norvegicus
ggcccacagcaggagatcaagcgtc

SEQ ID NO: 523164 - DNA, 25 bp, Rattus norvegicus
atacccaagacctcacgggctgtga

SEQ ID NO: 523165 - DNA, 25 bp, Rattus norvegicus
atccgccgatctacgtcccgggagg

SEQ ID NO: 523166 - DNA, 25 bp, Rattus norvegicus
cttcgcccaggagctgggtcgcatc

SEQ ID NO: 523167 - DNA, 25 bp, Rattus norvegicus
aacgcagtgcaacctcggacctcga

SEQ ID NO: 523168 - DNA, 25 bp, Rattus norvegicus
gagcggcgtcgcctgttccaacaaa

SEQ ID NO: 523169 - DNA, 25 bp, Rattus norvegicus
gagcgaagcttcaggtcgcctgtca

SEQ ID NO: 523170 - DNA, 25 bp, Rattus norvegicus
aagcctaagtcatcggggccgtcgc

SEQ ID NO: 523171 - DNA, 25 bp, Rattus norvegicus
ctgttccaacaaaaggcggcctctc

SEQ ID NO: 523172 - DNA, 25 bp, Rattus norvegicus
tcctccagagagcaggacaaaagcc

SEQ ID NO: 523173 - DNA, 25 bp, Rattus norvegicus
cccagacgccattgagcgaagcttc

SEQ ID NO: 523174 - DNA, 25 bp, Rattus norvegicus
tcctggacaagctgcagttcttcga

SEQ ID NO: 523175 - DNA, 25 bp, Rattus norvegicus
ggcttcgcagactggtgccaccaca

SEQ ID NO: 523176 - DNA, 25 bp, Rattus norvegicus
ccgcacaatcagctggcttcgcaga

SEQ ID NO: 523177 - DNA, 25 bp, Rattus norvegicus
gacgcctcggtgttccgcacaatca

SEQ ID NO: 523178 - DNA, 25 bp, Rattus norvegicus
acgccgctgtttggacggctacgca

SEQ ID NO: 523179 - DNA, 25 bp, Rattus norvegicus
gtctgtccagccgtttgcagcgcag

SEQ ID NO: 523180 - DNA, 25 bp, Rattus norvegicus
gcctttcgctgtccctgtcgcagaa

SEQ ID NO: 523181 - DNA, 25 bp, Rattus norvegicus
ggacgatggcatataccggcccagc

SEQ ID NO: 523182 - DNA, 25 bp, Rattus norvegicus
tgaggctactaagccgctcgcgctc

SEQ ID NO: 523183 - DNA, 25 bp, Rattus norvegicus
ctaagtttaagcgtagccgcgaatc

SEQ ID NO: 523184 - DNA, 25 bp, Rattus norvegicus
gaggccgtgttcgaggctaagttta

SEQ ID NO: 523185 - DNA, 25 bp, Rattus norvegicus
cctcagcggtagcatcgagaacctc

SEQ ID NO: 523186 - DNA, 25 bp, Rattus norvegicus
agcctctgagaagcgcgtgccttcg

SEQ ID NO: 523187 - DNA, 25 bp, Rattus norvegicus
cgtccgctgagtctctgggctcaga

SEQ ID NO: 523188 - DNA, 25 bp, Rattus norvegicus
tgctagccgagaaagtccgagtccc

SEQ ID NO: 523189 - DNA, 25 bp, Rattus norvegicus
aggccgaacgttcgttgctaagatc

SEQ ID NO: 523190 - DNA, 25 bp, Rattus norvegicus
cggtcatgccgggagaatgctacag

SEQ ID NO: 523191 - DNA, 25 bp, Rattus norvegicus
ggagaatgctacaggccgaacgttc

SEQ ID NO: 523192 - DNA, 25 bp, Rattus norvegicus
ccgtatgctgccgagggcaagcgac

SEQ ID NO: 523193 - DNA, 25 bp, Rattus norvegicus
accacgagaggctcatgtccctgca

SEQ ID NO: 523194 - DNA, 25 bp, Rattus norvegicus
ttatcgccgagagctgtggcaaccg

SEQ ID NO: 523195 - DNA, 25 bp, Rattus norvegicus
cgttcgttgctaagatcgtgccgta

SEQ ID NO: 523196 - DNA, 25 bp, Rattus norvegicus
aagatcgtgccgtatgctgccgagg

SEQ ID NO: 523197 - DNA, 25 bp, Rattus norvegicus
cggtaccttgtgcttatcgccgaga

SEQ ID NO: 523198 - DNA, 25 bp, Rattus norvegicus
atgtccctgcacgaggcctacatca

SEQ ID NO: 523199 - DNA, 25 bp, Rattus norvegicus
gaatatgaggtgcttcggacactgc

SEQ ID NO: 523200 - DNA, 25 bp, Rattus norvegicus
gcaagcgacgagtgctgcaggaata

SEQ ID NO: 523201 - DNA, 25 bp, Rattus norvegicus
ttcggacactgcaccacgagaggct

SEQ ID NO: 523202 - DNA, 25 bp, Rattus norvegicus
tgctgcaggaatatgaggtgcttcg

SEQ ID NO: 523203 - DNA, 25 bp, Rattus norvegicus
tcaaggaattcctgggcgagcagcg

SEQ ID NO: 523204 - DNA, 25 bp, Rattus norvegicus
ggacattccagaacccgtgccgagc

SEQ ID NO: 523205 - DNA, 25 bp, Rattus norvegicus
cgctgccaagggacattccagaacc

SEQ ID NO: 523206 - DNA, 25 bp, Rattus norvegicus
ctcaacgctgccaagggacattcca

SEQ ID NO: 523207 - DNA, 25 bp, Rattus norvegicus
ggttctcactcaacgctgccaaggg

SEQ ID NO: 523208 - DNA, 25 bp, Rattus norvegicus
gtgctgctccgctcctaccctggca

SEQ ID NO: 523209 - DNA, 25 bp, Rattus norvegicus
ctgaggctgctacccgtcacaaggt

SEQ ID NO: 523210 - DNA, 25 bp, Rattus norvegicus
attcctgggcgagcagcgtcgacgt

SEQ ID NO: 523211 - DNA, 25 bp, Rattus norvegicus
tccagaacccgtgccgagctggacg

SEQ ID NO: 523212 - DNA, 25 bp, Rattus norvegicus
gacactcaccttcaccaccaaccgg

SEQ ID NO: 523213 - DNA, 25 bp, Rattus norvegicus
cttgggttctcactcaacgctgcca

SEQ ID NO: 523214 - DNA, 25 bp, Rattus norvegicus
caccaaccggctcaaggaattcctg

SEQ ID NO: 523215 - DNA, 25 bp, Rattus norvegicus
cgggctgaggctgctacccgtcaca

SEQ ID NO: 523216 - DNA, 25 bp, Rattus norvegicus
tgctacccgtcacaaggtgctgctc

SEQ ID NO: 523217 - DNA, 25 bp, Rattus norvegicus
gcccgacggtgaaacgctgttgaca

SEQ ID NO: 523218 - DNA, 25 bp, Rattus norvegicus
cacacgcaggggctgacagctgtgc

SEQ ID NO: 523219 - DNA, 25 bp, Rattus norvegicus
tgccagtgcccgacggtgaaacgct

SEQ ID NO: 523220 - DNA, 25 bp, Rattus norvegicus
ctgataagggaagccacaaggagac

SEQ ID NO: 523221 - DNA, 25 bp, Rattus norvegicus
tggcggagcagcgcttgctccctcg

SEQ ID NO: 523222 - DNA, 25 bp, Rattus norvegicus
gtgaaacgctgttgacatgtcctga

SEQ ID NO: 523223 - DNA, 25 bp, Rattus norvegicus
ccacaaggagacgatcgaggagaga

SEQ ID NO: 523224 - DNA, 25 bp, Rattus norvegicus
ctgacagctgtgcgggtgctgataa

SEQ ID NO: 523225 - DNA, 25 bp, Rattus norvegicus
gctcactcgcttgctcgcagggaca

SEQ ID NO: 523226 - DNA, 25 bp, Rattus norvegicus
ctccggagcacatgctgagcggagc

SEQ ID NO: 523227 - DNA, 25 bp, Rattus norvegicus
gaattattaagcacggggtgggctc

SEQ ID NO: 523228 - DNA, 25 bp, Rattus norvegicus
gtcctgaattattaagcacggggtg

SEQ ID NO: 523229 - DNA, 25 bp, Rattus norvegicus
cgctgttgacatgtcctgaattatt

SEQ ID NO: 523230 - DNA, 25 bp, Rattus norvegicus
tcgaggagagagacaagcggcagca

SEQ ID NO: 523231 - DNA, 25 bp, Rattus norvegicus
acacccaggtgtcgcatggcagggt

SEQ ID NO: 523232 - DNA, 25 bp, Rattus norvegicus
gccggcgacacccaggtgtcgcatg

SEQ ID NO: 523233 - DNA, 25 bp, Rattus norvegicus
cagggtccacgaggtgacctgcctg

SEQ ID NO: 523234 - DNA, 25 bp, Rattus norvegicus
agcagcgcgcagcttgcacgagtat

SEQ ID NO: 523235 - DNA, 25 bp, Rattus norvegicus
catggcagggtccacgaggtgacct

SEQ ID NO: 523236 - DNA, 25 bp, Rattus norvegicus
gcgcagcttgcacgagtatgcgcta

SEQ ID NO: 523237 - DNA, 25 bp, Rattus norvegicus
gagtatgcgctagggcacccactcc

SEQ ID NO: 523238 - DNA, 25 bp, Rattus norvegicus
ccacgcacacccgagggaggcctgc

SEQ ID NO: 523239 - DNA, 25 bp, Rattus norvegicus
cgcctgctgagcgctgttttctcca

SEQ ID NO: 523240 - DNA, 25 bp, Rattus norvegicus
aggtcccaggccgatgtcccaggtg

SEQ ID NO: 523241 - DNA, 25 bp, Rattus norvegicus
ccgatgtcccaggtgagcggtcagt

SEQ ID NO: 523242 - DNA, 25 bp, Rattus norvegicus
gtgagcggtcagtgcccttctcgct

SEQ ID NO: 523243 - DNA, 25 bp, Rattus norvegicus
ggtcagtgcccttctcgctgcgacg

SEQ ID NO: 523244 - DNA, 25 bp, Rattus norvegicus
ttgcacgagtatgcgctagggcacc

SEQ ID NO: 523245 - DNA, 25 bp, Rattus norvegicus
atgcctctggcgctgctgtgtgcac

SEQ ID NO: 523246 - DNA, 25 bp, Rattus norvegicus
ctgctgtgtgcacggaggtcacttt

SEQ ID NO: 523247 - DNA, 25 bp, Rattus norvegicus
ctgtgtgcacggaggtcactttgcc

SEQ ID NO: 523248 - DNA, 25 bp, Rattus norvegicus
tgtgcacggaggtcactttgccgag

SEQ ID NO: 523249 - DNA, 25 bp, Rattus norvegicus
ttgcccgtgggtgcagcctcgcagt

SEQ ID NO: 523250 - DNA, 25 bp, Rattus norvegicus
tcactttgccgaggagccgggagcc

SEQ ID NO: 523251 - DNA, 25 bp, Rattus norvegicus
ccgagggaatgcaaatgaggcgaac

SEQ ID NO: 523252 - DNA, 25 bp, Rattus norvegicus
tctccctccgcggtggatgcctctg

SEQ ID NO: 523253 - DNA, 25 bp, Rattus norvegicus
ccagggaggagagccgaggaacccg

SEQ ID NO: 523254 - DNA, 25 bp, Rattus norvegicus
aggaacccggaggagacagagggag

SEQ ID NO: 523255 - DNA, 25 bp, Rattus norvegicus
cgctgctcggtgatggatgcctgcc

SEQ ID NO: 523256 - DNA, 25 bp, Rattus norvegicus
tgatggatgcctgccccgcaggaga

SEQ ID NO: 523257 - DNA, 25 bp, Rattus norvegicus
gcggccagcgggaagcgttgcccgt

SEQ ID NO: 523258 - DNA, 25 bp, Rattus norvegicus
gaatgcaaatgaggcgaacccaggg

SEQ ID NO: 523259 - DNA, 25 bp, Rattus norvegicus
ctgctcctggaagacgatacgttgt

SEQ ID NO: 523260 - DNA, 25 bp, Rattus norvegicus
ttgtctctcgcctgtgccgctcaag

SEQ ID NO: 523261 - DNA, 25 bp, Rattus norvegicus
cgcctgtgccgctcaagcacttacg

SEQ ID NO: 523262 - DNA, 25 bp, Rattus norvegicus
tacgttgtctctcgcctgtgccgct

SEQ ID NO: 523263 - DNA, 25 bp, Rattus norvegicus
atacgttgtctctcgcctgtgccgc

SEQ ID NO: 523264 - DNA, 25 bp, Rattus norvegicus
cgatacgttgtctctcgcctgtgcc

SEQ ID NO: 523265 - DNA, 25 bp, Rattus norvegicus
acgatacgttgtctctcgcctgtgc

SEQ ID NO: 523266 - DNA, 25 bp, Rattus norvegicus
gacgatacgttgtctctcgcctgtg

SEQ ID NO: 523267 - DNA, 25 bp, Rattus norvegicus
aagacgatacgttgtctctcgcctg

SEQ ID NO: 523268 - DNA, 25 bp, Rattus norvegicus
tggaagacgatacgttgtctctcgc

SEQ ID NO: 523269 - DNA, 25 bp, Rattus norvegicus
cctggaagacgatacgttgtctctc

SEQ ID NO: 523270 - DNA, 25 bp, Rattus norvegicus
ctcctggaagacgatacgttgtctc

SEQ ID NO: 523271 - DNA, 25 bp, Rattus norvegicus
gttgtctctcgcctgtgccgctcaa

SEQ ID NO: 523272 - DNA, 25 bp, Rattus norvegicus
tgctcctggaagacgatacgttgtc

SEQ ID NO: 523273 - DNA, 25 bp, Rattus norvegicus
ggctttgacgggtgcgaagacatct

SEQ ID NO: 523274 - DNA, 25 bp, Rattus norvegicus
tgcttcttggagagtagatccatga

SEQ ID NO: 523275 - DNA, 25 bp, Rattus norvegicus
tcaggaagtcgggtgtgagcactgt

SEQ ID NO: 523276 - DNA, 25 bp, Rattus norvegicus
ccggccagcaggaacagagtgtcca

SEQ ID NO: 523277 - DNA, 25 bp, Rattus norvegicus
gaacagagtgtccagcgggtgcttc

SEQ ID NO: 523278 - DNA, 25 bp, Rattus norvegicus
cgggtgcttcttggagagtagatcc

SEQ ID NO: 523279 - DNA, 25 bp, Rattus norvegicus
cgtgcatgcggcagcggttcaggaa

SEQ ID NO: 523280 - DNA, 25 bp, Rattus norvegicus
ttggagagtagatccatgaggcgca

SEQ ID NO: 523281 - DNA, 25 bp, Rattus norvegicus
gcgcggatgtctgtacactgagcca

SEQ ID NO: 523282 - DNA, 25 bp, Rattus norvegicus
tacactgagccagggcactcgggca

SEQ ID NO: 523283 - DNA, 25 bp, Rattus norvegicus
ctagctcggccacgtgggctttgac

SEQ ID NO: 523284 - DNA, 25 bp, Rattus norvegicus
ttgacgggtgcgaagacatctgcgt

SEQ ID NO: 523285 - DNA, 25 bp, Rattus norvegicus
aagacatctgcgtgggctgcccgct

SEQ ID NO: 523286 - DNA, 25 bp, Rattus norvegicus
gcactcgggcaccagggaaacgccg

SEQ ID NO: 523287 - DNA, 25 bp, Rattus norvegicus
tgtagcccttagagcagcactgcgc

SEQ ID NO: 523288 - DNA, 25 bp, Rattus norvegicus
gtcccggatgacgtcaaagcagccc

SEQ ID NO: 523289 - DNA, 25 bp, Rattus norvegicus
atcagcaccaaaggccgccggcggg

SEQ ID NO: 523290 - DNA, 25 bp, Rattus norvegicus
aggccggagctgtccatcagcacca

SEQ ID NO: 523291 - DNA, 25 bp, Rattus norvegicus
tgcaccctgagtgacgtcaggagca

SEQ ID NO: 523292 - DNA, 25 bp, Rattus norvegicus
cccgcggagcagagatagtagctca

SEQ ID NO: 523293 - DNA, 25 bp, Rattus norvegicus
ccctgccaggatggtgcaccctgag

SEQ ID NO: 523294 - DNA, 25 bp, Rattus norvegicus
cggatgagtacctgacggccttctt

SEQ ID NO: 523295 - DNA, 25 bp, Rattus norvegicus
ctcagccgtcagctaccagaaaggg

SEQ ID NO: 523296 - DNA, 25 bp, Rattus norvegicus
ctgctgtccgacgtgtcaccgagag

SEQ ID NO: 523297 - DNA, 25 bp, Rattus norvegicus
agatagtagctcaagcccggaaccc

SEQ ID NO: 523298 - DNA, 25 bp, Rattus norvegicus
tgaagcccagagagatgcccacggc

SEQ ID NO: 523299 - DNA, 25 bp, Rattus norvegicus
ggcaagacacgaggctcccagcttt

SEQ ID NO: 523300 - DNA, 25 bp, Rattus norvegicus
ggccttcttggtagcctggcctggc

SEQ ID NO: 523301 - DNA, 25 bp, Rattus norvegicus
aactgctactgctggggcgctacgt

SEQ ID NO: 523302 - DNA, 25 bp, Rattus norvegicus
gactattttgccgaactgctactgc

SEQ ID NO: 523303 - DNA, 25 bp, Rattus norvegicus
ttgccaccgccgcagactattttgc

SEQ ID NO: 523304 - DNA, 25 bp, Rattus norvegicus
gtgacgggtgctgcactcattgcca

SEQ ID NO: 523305 - DNA, 25 bp, Rattus norvegicus
acccttgccactgccgtgacgggtg

SEQ ID NO: 523306 - DNA, 25 bp, Rattus norvegicus
agcctggctccgtatggggcccact

SEQ ID NO: 523307 - DNA, 25 bp, Rattus norvegicus
cctattaccagcctggctccgtatg

SEQ ID NO: 523308 - DNA, 25 bp, Rattus norvegicus
gctcggtctgctgctcgctgctgct

SEQ ID NO: 523309 - DNA, 25 bp, Rattus norvegicus
tcctggtggggctactgctcggtct

SEQ ID NO: 523310 - DNA, 25 bp, Rattus norvegicus
tggtacgcagcgtgggcctcttcct

SEQ ID NO: 523311 - DNA, 25 bp, Rattus norvegicus
actggtagccatgctggtacgcagc

SEQ ID NO: 523312 - DNA, 25 bp, Rattus norvegicus
gactgctctgcggactggtagccat

SEQ ID NO: 523313 - DNA, 25 bp, Rattus norvegicus
caagcgcgggcatcgcactgggcat

SEQ ID NO: 523314 - DNA, 25 bp, Rattus norvegicus
atcgcactgggcattggactgctct

SEQ ID NO: 523315 - DNA, 25 bp, Rattus norvegicus
tcgcagttcgctcagcaccagaatg

SEQ ID NO: 523316 - DNA, 25 bp, Rattus norvegicus
gtctcagccgcttcccgggagaatt

SEQ ID NO: 523317 - DNA, 25 bp, Rattus norvegicus
ccgaagtgtttcagcgcgcggaatt

SEQ ID NO: 523318 - DNA, 25 bp, Rattus norvegicus
gaggcccacaccttcctgtcggatg

SEQ ID NO: 523319 - DNA, 25 bp, Rattus norvegicus
tcccaggacgggagatgataccctt

SEQ ID NO: 523320 - DNA, 25 bp, Rattus norvegicus
gactccgacacggtgcactcgaatg

SEQ ID NO: 523321 - DNA, 25 bp, Rattus norvegicus
cactcgaatgtagcgctgtctcctt

SEQ ID NO: 523322 - DNA, 25 bp, Rattus norvegicus
gagtggcacccaagcaaagtcccgg

SEQ ID NO: 523323 - DNA, 25 bp, Rattus norvegicus
gcgctaagcgacctgagctcaccga

SEQ ID NO: 523324 - DNA, 25 bp, Rattus norvegicus
ggtcccgcctggaagcagacttctc

SEQ ID NO: 523325 - DNA, 25 bp, Rattus norvegicus
gagagatgcatcttccctacgacct

SEQ ID NO: 523326 - DNA, 25 bp, Rattus norvegicus
agtccgtttccctgcatgcccagtt

SEQ ID NO: 523327 - DNA, 25 bp, Rattus norvegicus
tcctcctgaggaaatgacctgctct

SEQ ID NO: 523328 - DNA, 25 bp, Rattus norvegicus
gcagcatctctaggaccagcggcta

SEQ ID NO: 523329 - DNA, 25 bp, Rattus norvegicus
ttcagcctgtggatgacgaggcgtc

SEQ ID NO: 523330 - DNA, 25 bp, Rattus norvegicus
cttcaatctgctcgtacttgcggca

SEQ ID NO: 523331 - DNA, 25 bp, Rattus norvegicus
ggtactttacactctaggactacga

SEQ ID NO: 523332 - DNA, 25 bp, Rattus norvegicus
atcgtcatctgccttcagcctgtgg

SEQ ID NO: 523333 - DNA, 25 bp, Rattus norvegicus
tctcgcacagatagacaccatcgtc

SEQ ID NO: 523334 - DNA, 25 bp, Rattus norvegicus
cagtgccttcttcaatctgctcgta

SEQ ID NO: 523335 - DNA, 25 bp, Rattus norvegicus
tcctgcagaggccttgtgaaccgga

SEQ ID NO: 523336 - DNA, 25 bp, Rattus norvegicus
taggactacgatcccatgctctcga

SEQ ID NO: 523337 - DNA, 25 bp, Rattus norvegicus
tgacgaggcgtctcacagtgccttc

SEQ ID NO: 523338 - DNA, 25 bp, Rattus norvegicus
tccgagagttgggtactttacactc

SEQ ID NO: 523339 - DNA, 25 bp, Rattus norvegicus
acagtcgctggtcctctcggaacca

SEQ ID NO: 523340 - DNA, 25 bp, Rattus norvegicus
tcgtacttgcggcagggtaacagtc

SEQ ID NO: 523341 - DNA, 25 bp, Rattus norvegicus
cagggtaacagtcgctggtcctctc

SEQ ID NO: 523342 - DNA, 25 bp, Rattus norvegicus
cctctcggaaccaggcggtgggaat

SEQ ID NO: 523343 - DNA, 25 bp, Rattus norvegicus
ggctctcccaggaccacgcatttga

SEQ ID NO: 523344 - DNA, 25 bp, Rattus norvegicus
ggaccacgcatttgagctcggcctc

SEQ ID NO: 523345 - DNA, 25 bp, Rattus norvegicus
tgggactggggtcccgtcagaaaca

SEQ ID NO: 523346 - DNA, 25 bp, Rattus norvegicus
tgaactggccttcattgcggccgct

SEQ ID NO: 523347 - DNA, 25 bp, Rattus norvegicus
tcccagtacagcttgggctccggga

SEQ ID NO: 523348 - DNA, 25 bp, Rattus norvegicus
ggcgcgcatttgagcggctctatca

SEQ ID NO: 523349 - DNA, 25 bp, Rattus norvegicus
ccaggatgcgtaacgtcaggcttgc

SEQ ID NO: 523350 - DNA, 25 bp, Rattus norvegicus
tcgatctcgggctcaggcttgccca

SEQ ID NO: 523351 - DNA, 25 bp, Rattus norvegicus
cgcctttctcccacaagacggtggg

SEQ ID NO: 523352 - DNA, 25 bp, Rattus norvegicus
acccagaaggtcttgggcgcgcatt

SEQ ID NO: 523353 - DNA, 25 bp, Rattus norvegicus
tgcttgccctcgttcacccagaagg

SEQ ID NO: 523354 - DNA, 25 bp, Rattus norvegicus
ggcggccctccaagtgccattcgat

SEQ ID NO: 523355 - DNA, 25 bp, Rattus norvegicus
gcccatcacgtagcagcggaacttg

SEQ ID NO: 523356 - DNA, 25 bp, Rattus norvegicus
agtggctgctgtcccacacttcgtc

SEQ ID NO: 523357 - DNA, 25 bp, Rattus norvegicus
ggggcaagagaagacgtcctttata

SEQ ID NO: 523358 - DNA, 25 bp, Rattus norvegicus
ttgacacatcggctcgtccagggcg

SEQ ID NO: 523359 - DNA, 25 bp, Rattus norvegicus
gcaggctttccggtttgtcctttgc

SEQ ID NO: 523360 - DNA, 25 bp, Rattus norvegicus
tttcccacggagactgactgccata

SEQ ID NO: 523361 - DNA, 25 bp, Rattus norvegicus
tgggctccggagtgcctatgttttt

SEQ ID NO: 523362 - DNA, 25 bp, Rattus norvegicus
tcctgagtgtggtcgatactgtcca

SEQ ID NO: 523363 - DNA, 25 bp, Rattus norvegicus
gccaactttttacattgcacgacgc

SEQ ID NO: 523364 - DNA, 25 bp, Rattus norvegicus
gcacgacgcctccatttgcacgaaa

SEQ ID NO: 523365 - DNA, 25 bp, Rattus norvegicus
tgcacgaaagctctgggtttttgtc

SEQ ID NO: 523366 - DNA, 25 bp, Rattus norvegicus
tttttgtcgacaccgcccacctgag

SEQ ID NO: 523367 - DNA, 25 bp, Rattus norvegicus
agcgtcccgtggctatgacgaccgc

SEQ ID NO: 523368 - DNA, 25 bp, Rattus norvegicus
cgtctcgctctgtcctattgacaca

SEQ ID NO: 523369 - DNA, 25 bp, Rattus norvegicus
atactgtccagaaacgccgggagtc

SEQ ID NO: 523370 - DNA, 25 bp, Rattus norvegicus
ggacttctggctaatctggttggga

SEQ ID NO: 523371 - DNA, 25 bp, Rattus norvegicus
gccggctggcagagccgagctctag

SEQ ID NO: 523372 - DNA, 25 bp, Rattus norvegicus
cccgcaatgcgtggggcgcctggaa

SEQ ID NO: 523373 - DNA, 25 bp, Rattus norvegicus
cccatgctggcccagtcggggtaag

SEQ ID NO: 523374 - DNA, 25 bp, Rattus norvegicus
ccagtcggggtaagtcaggaatcgt

SEQ ID NO: 523375 - DNA, 25 bp, Rattus norvegicus
tcggggtaagtcaggaatcgtccac

SEQ ID NO: 523376 - DNA, 25 bp, Rattus norvegicus
agtcaggaatcgtccactcccattg

SEQ ID NO: 523377 - DNA, 25 bp, Rattus norvegicus
gaatcgtccactcccattgtgcggc

SEQ ID NO: 523378 - DNA, 25 bp, Rattus norvegicus
ctgcgtccgacctgcccggctctgc

SEQ ID NO: 523379 - DNA, 25 bp, Rattus norvegicus
tacttaagggcaaggcgtgggccgc

SEQ ID NO: 523380 - DNA, 25 bp, Rattus norvegicus
gcctggtggggacatcggactaacc

SEQ ID NO: 523381 - DNA, 25 bp, Rattus norvegicus
tggggacatcggactaacctggacc

SEQ ID NO: 523382 - DNA, 25 bp, Rattus norvegicus
catcggactaacctggaccgggttg

SEQ ID NO: 523383 - DNA, 25 bp, Rattus norvegicus
gggcccaccagcgcgattattgacc

SEQ ID NO: 523384 - DNA, 25 bp, Rattus norvegicus
aggaatcgtccactcccattgtgcg

SEQ ID NO: 523385 - DNA, 25 bp, Rattus norvegicus
atcctaactggttctgagctcccga

SEQ ID NO: 523386 - DNA, 25 bp, Rattus norvegicus
taggtctgttctcccaccggagctc

SEQ ID NO: 523387 - DNA, 25 bp, Rattus norvegicus
ctccgtagctgtgataggtctgttc

SEQ ID NO: 523388 - DNA, 25 bp, Rattus norvegicus
cgccagtccggagcttgcgaccaat

SEQ ID NO: 523389 - DNA, 25 bp, Rattus norvegicus
ctaccgcttctatcccagtggaata

SEQ ID NO: 523390 - DNA, 25 bp, Rattus norvegicus
aaatcccagccatggttcgccggtg

SEQ ID NO: 523391 - DNA, 25 bp, Rattus norvegicus
accggtgacagcgtcgcaaattcca

SEQ ID NO: 523392 - DNA, 25 bp, Rattus norvegicus
gcgctaagccttcactgctcatctg

SEQ ID NO: 523393 - DNA, 25 bp, Rattus norvegicus
gagctcccgaaccattcatcagtga

SEQ ID NO: 523394 - DNA, 25 bp, Rattus norvegicus
ccctgcaggcggatgctgataaact

SEQ ID NO: 523395 - DNA, 25 bp, Rattus norvegicus
ggaaccttgtctcgatcctcgggga

SEQ ID NO: 523396 - DNA, 25 bp, Rattus norvegicus
cagagtggcagcttgcatcggtcac

SEQ ID NO: 523397 - DNA, 25 bp, Rattus norvegicus
ggctcttaccttcattcgccgggta

SEQ ID NO: 523398 - DNA, 25 bp, Rattus norvegicus
atctgcatttcccttctcgctggtg

SEQ ID NO: 523399 - DNA, 25 bp, Rattus norvegicus
agactgcttggagatatgcatggag

SEQ ID NO: 523400 - DNA, 25 bp, Rattus norvegicus
ccctcggtgcgtgaccaggaacacg

SEQ ID NO: 523401 - DNA, 25 bp, Rattus norvegicus
tctgccttcagacgcataacctggc

SEQ ID NO: 523402 - DNA, 25 bp, Rattus norvegicus
tcagccgcgaacaggtctgccttca

SEQ ID NO: 523403 - DNA, 25 bp, Rattus norvegicus
ccagagctgccgcacggagcctgat

SEQ ID NO: 523404 - DNA, 25 bp, Rattus norvegicus
ctcctgatgccacagggtggtccca

SEQ ID NO: 523405 - DNA, 25 bp, Rattus norvegicus
tgcttctcctcctgatgccacaggg

SEQ ID NO: 523406 - DNA, 25 bp, Rattus norvegicus
tatgcatggagtgttgcggactctg

SEQ ID NO: 523407 - DNA, 25 bp, Rattus norvegicus
cctgctgcgagtcggcagactgctt

SEQ ID NO: 523408 - DNA, 25 bp, Rattus norvegicus
atcctggatgcctgctgcgagtcgg

SEQ ID NO: 523409 - DNA, 25 bp, Rattus norvegicus
gagtgtgcggactgcgacctgccct

SEQ ID NO: 523410 - DNA, 25 bp, Rattus norvegicus
tgccctgcgacctggactgcggcat

SEQ ID NO: 523411 - DNA, 25 bp, Rattus norvegicus
agtgttgcggactctgcttctcctc

SEQ ID NO: 523412 - DNA, 25 bp, Rattus norvegicus
cctggactgcggcatcctggatgcc

SEQ ID NO: 523413 - DNA, 25 bp, Rattus norvegicus
cttggacaatgtatgggccctgcta

SEQ ID NO: 523414 - DNA, 25 bp, Rattus norvegicus
tcccgggactaagatggcagccaca

SEQ ID NO: 523415 - DNA, 25 bp, Rattus norvegicus
ctaaggccagacacccacatagctg

SEQ ID NO: 523416 - DNA, 25 bp, Rattus norvegicus
tctagagtcccgcatagcttcggca

SEQ ID NO: 523417 - DNA, 25 bp, Rattus norvegicus
ctgctgcgatgctcaccgctgaaga

SEQ ID NO: 523418 - DNA, 25 bp, Rattus norvegicus
gaggcgcccatgacaccgaaaaacg

SEQ ID NO: 523419 - DNA, 25 bp, Rattus norvegicus
tcggggttgttcttgatgtcagcca

SEQ ID NO: 523420 - DNA, 25 bp, Rattus norvegicus
tcagccatgtctgcaagcggggaga

SEQ ID NO: 523421 - DNA, 25 bp, Rattus norvegicus
cgctcgcgtcacatgatatgggcca

SEQ ID NO: 523422 - DNA, 25 bp, Rattus norvegicus
ctgggtcttcactggtccactgctc

SEQ ID NO: 523423 - DNA, 25 bp, Rattus norvegicus
ctgctccatgcagacgtcttctcga

SEQ ID NO: 523424 - DNA, 25 bp, Rattus norvegicus
ggccgtagcgctccatattagcata

SEQ ID NO: 523425 - DNA, 25 bp, Rattus norvegicus
tggagcgaatgatagcccgccttct

SEQ ID NO: 523426 - DNA, 25 bp, Rattus norvegicus
tcaggcgctgcgctctaaataccag

SEQ ID NO: 523427 - DNA, 25 bp, Rattus norvegicus
aagccggctgctccggccgtgatat

SEQ ID NO: 523428 - DNA, 25 bp, Rattus norvegicus
aatgaagccggctgctccggccgtg

SEQ ID NO: 523429 - DNA, 25 bp, Rattus norvegicus
gagtccggccgcaccagcaaggcgg

SEQ ID NO: 523430 - DNA, 25 bp, Rattus norvegicus
gaaaagcgcgagtccggccgcacca

SEQ ID NO: 523431 - DNA, 25 bp, Rattus norvegicus
gggaacacaagccaggaaaagcgcg

SEQ ID NO: 523432 - DNA, 25 bp, Rattus norvegicus
ggacaccgggttcggagcctgccgc

SEQ ID NO: 523433 - DNA, 25 bp, Rattus norvegicus
ggatcacaaatgaagccggctgctc

SEQ ID NO: 523434 - DNA, 25 bp, Rattus norvegicus
aggctcccggatcacaaatgaagcc

SEQ ID NO: 523435 - DNA, 25 bp, Rattus norvegicus
tctcgctggcaccaggctcccggat

SEQ ID NO: 523436 - DNA, 25 bp, Rattus norvegicus
ttccaggtctcgctggcaccaggct

SEQ ID NO: 523437 - DNA, 25 bp, Rattus norvegicus
aattccaggtctcgctggcaccagg

SEQ ID NO: 523438 - DNA, 25 bp, Rattus norvegicus
ggaaattccaggtctcgctggcacc

SEQ ID NO: 523439 - DNA, 25 bp, Rattus norvegicus
atcacaaatgaagccggctgctccg

SEQ ID NO: 523440 - DNA, 25 bp, Rattus norvegicus
ccgggaacacaagccaggaaaagcg

SEQ ID NO: 523441 - DNA, 25 bp, Rattus norvegicus
cccaaagctagatcaggagccctga

SEQ ID NO: 523442 - DNA, 25 bp, Rattus norvegicus
tgaggccctaacgtaccttccagtg

SEQ ID NO: 523443 - DNA, 25 bp, Rattus norvegicus
ggggcagcttcgctggcaaattata

SEQ ID NO: 523444 - DNA, 25 bp, Rattus norvegicus
ggcgctaatagctccaagtccactg

SEQ ID NO: 523445 - DNA, 25 bp, Rattus norvegicus
tccactggctccagaggagtccctt

SEQ ID NO: 523446 - DNA, 25 bp, Rattus norvegicus
gagtcccttgagtgcaggatcccaa

SEQ ID NO: 523447 - DNA, 25 bp, Rattus norvegicus
ccgacccagagtgggactagctcta

SEQ ID NO: 523448 - DNA, 25 bp, Rattus norvegicus
cggacaagtttggtgcgagtctagc

SEQ ID NO: 523449 - DNA, 25 bp, Rattus norvegicus
ccactggcaaaggtgctcaaggcac

SEQ ID NO: 523450 - DNA, 25 bp, Rattus norvegicus
gaggcaggagtacgtcccaagtctc

SEQ ID NO: 523451 - DNA, 25 bp, Rattus norvegicus
gtgaccctcgggaactctccggatc

SEQ ID NO: 523452 - DNA, 25 bp, Rattus norvegicus
cccgacgagggagcatttattagtt

SEQ ID NO: 523453 - DNA, 25 bp, Rattus norvegicus
ctgattgggcgacagaggctacttt

SEQ ID NO: 523454 - DNA, 25 bp, Rattus norvegicus
ccttgacacggagtgcagggatccc

SEQ ID NO: 523455 - DNA, 25 bp, Rattus norvegicus
agggatgacggtccgttgatcaata

SEQ ID NO: 523456 - DNA, 25 bp, Rattus norvegicus
aggccgcgggcccacactgtgccca

SEQ ID NO: 523457 - DNA, 25 bp, Rattus norvegicus
cggtccgttgatcaataggatcgaa

SEQ ID NO: 523458 - DNA, 25 bp, Rattus norvegicus
caataggatcgaagagagaaaactg

SEQ ID NO: 523459 - DNA, 25 bp, Rattus norvegicus
tgaaaaagttcaagcacggggtgtc

SEQ ID NO: 523460 - DNA, 25 bp, Rattus norvegicus
aaacctgggcgctcgtcacagggga

SEQ ID NO: 523461 - DNA, 25 bp, Rattus norvegicus
acactgtgcccaagctctcgtgact

SEQ ID NO: 523462 - DNA, 25 bp, Rattus norvegicus
gtgcccaagctctcgtgactctcgg

SEQ ID NO: 523463 - DNA, 25 bp, Rattus norvegicus
gctctcgtgactctcgggctttaaa

SEQ ID NO: 523464 - DNA, 25 bp, Rattus norvegicus
cgggctttaaaagcaagactggagc

SEQ ID NO: 523465 - DNA, 25 bp, Rattus norvegicus
taaaagcaagactggagcgggagac

SEQ ID NO: 523466 - DNA, 25 bp, Rattus norvegicus
tgacggtccgttgatcaataggatc

SEQ ID NO: 523467 - DNA, 25 bp, Rattus norvegicus
ggagacgccgcagtcaactgagccg

SEQ ID NO: 523468 - DNA, 25 bp, Rattus norvegicus
tcaagcacggggtgtccccgccaaa

SEQ ID NO: 523469 - DNA, 25 bp, Rattus norvegicus
cagcagatgattcaggtaactacca

SEQ ID NO: 523470 - DNA, 25 bp, Rattus norvegicus
tctctcgctcaaggtaagggaaaca

SEQ ID NO: 523471 - DNA, 25 bp, Rattus norvegicus
agactccgcagtggttcgttggttc

SEQ ID NO: 523472 - DNA, 25 bp, Rattus norvegicus
agctcactgagtccaaaaccgggtc

SEQ ID NO: 523473 - DNA, 25 bp, Rattus norvegicus
ctagccaccgacaggcaaatgggtc

SEQ ID NO: 523474 - DNA, 25 bp, Rattus norvegicus
cgggccggtacttgagccagcagat

SEQ ID NO: 523475 - DNA, 25 bp, Rattus norvegicus
caccgagaagagtgccaggatgcta

SEQ ID NO: 523476 - DNA, 25 bp, Rattus norvegicus
ccgccgtagtggttgacgaagatga

SEQ ID NO: 523477 - DNA, 25 bp, Rattus norvegicus
acgaagatgagaccggtgaacagca

SEQ ID NO: 523478 - DNA, 25 bp, Rattus norvegicus
ccatggagaggaacgagaagactac

SEQ ID NO: 523479 - DNA, 25 bp, Rattus norvegicus
agttctgacagctctcgtaggcgcc

SEQ ID NO: 523480 - DNA, 25 bp, Rattus norvegicus
aaggcctcggcaagcttggtgttgt

SEQ ID NO: 523481 - DNA, 25 bp, Rattus norvegicus
gcagctggctcaagcactcctggca

SEQ ID NO: 523482 - DNA, 25 bp, Rattus norvegicus
ccgggtgtgccttcccgctacgtat

SEQ ID NO: 523483 - DNA, 25 bp, Rattus norvegicus
agttgcaagcacaccctcctgctgg

SEQ ID NO: 523484 - DNA, 25 bp, Rattus norvegicus
cctgagggattcagagctcgtggca

SEQ ID NO: 523485 - DNA, 25 bp, Rattus norvegicus
attcagagctcgtggcacgcttcca

SEQ ID NO: 523486 - DNA, 25 bp, Rattus norvegicus
tcgtggcacgcttccagcggcgctg

SEQ ID NO: 523487 - DNA, 25 bp, Rattus norvegicus
cgtaggtcatgcacgtggactcgtc

SEQ ID NO: 523488 - DNA, 25 bp, Rattus norvegicus
agcggggaacagtcacccgctgcca

SEQ ID NO: 523489 - DNA, 25 bp, Rattus norvegicus
tggactcgtccacgcagttgcaagc

SEQ ID NO: 523490 - DNA, 25 bp, Rattus norvegicus
tggtggccgacacctggacttgccc

SEQ ID NO: 523491 - DNA, 25 bp, Rattus norvegicus
acacctggacttgcccgcgtgcagg

SEQ ID NO: 523492 - DNA, 25 bp, Rattus norvegicus
ctaggacccgggtggcgcacctgtt

SEQ ID NO: 523493 - DNA, 25 bp, Rattus norvegicus
gaggaacgcggtcgcggctcactat

SEQ ID NO: 523494 - DNA, 25 bp, Rattus norvegicus
cagcttccaccctagggagggtaca

SEQ ID NO: 523495 - DNA, 25 bp, Rattus norvegicus
ggctcactatggctgagctgctgcg

SEQ ID NO: 523496 - DNA, 25 bp, Rattus norvegicus
acaagcgcaaggtggtggccgacac

SEQ ID NO: 523497 - DNA, 25 bp, Rattus norvegicus
acccggcacgggctgatgatgcaat

SEQ ID NO: 523498 - DNA, 25 bp, Rattus norvegicus
tatgaacgccgccagcttggctctc

SEQ ID NO: 523499 - DNA, 25 bp, Rattus norvegicus
cactcactgtaggtccggcccagga

SEQ ID NO: 523500 - DNA, 25 bp, Rattus norvegicus
taattgagcccagccgagtctgctt

SEQ ID NO: 523501 - DNA, 25 bp, Rattus norvegicus
ctggttccgagaagctaattgagcc

SEQ ID NO: 523502 - DNA, 25 bp, Rattus norvegicus
tgcaatggagcgcagagctggttcc

SEQ ID NO: 523503 - DNA, 25 bp, Rattus norvegicus
tctgagtgaatgacgagaacccggc

SEQ ID NO: 523504 - DNA, 25 bp, Rattus norvegicus
acacgcagtaggagctcggtctctg

SEQ ID NO: 523505 - DNA, 25 bp, Rattus norvegicus
caaagtcggtgctagacacgcagta

SEQ ID NO: 523506 - DNA, 25 bp, Rattus norvegicus
ttgtgttccgacaccaaagtcggtg

SEQ ID NO: 523507 - DNA, 25 bp, Rattus norvegicus
gagcaggtctcgcttcacgctgaca

SEQ ID NO: 523508 - DNA, 25 bp, Rattus norvegicus
cttcacgctgacagtcggcatggtg

SEQ ID NO: 523509 - DNA, 25 bp, Rattus norvegicus
ctcagcgaccctagagcgaaggacc

SEQ ID NO: 523510 - DNA, 25 bp, Rattus norvegicus
cccaggacttggaagagcaggtctc

SEQ ID NO: 523511 - DNA, 25 bp, Rattus norvegicus
gcatattcaacgagcgccagcccgg

SEQ ID NO: 523512 - DNA, 25 bp, Rattus norvegicus
atttgataggccgaatcccgcacgc

SEQ ID NO: 523513 - DNA, 25 bp, Rattus norvegicus
cccaggcccgcatttgataggccga

SEQ ID NO: 523514 - DNA, 25 bp, Rattus norvegicus
cgtccgtgggaggaaccagcgccca

SEQ ID NO: 523515 - DNA, 25 bp, Rattus norvegicus
aatgacccatagtaacctcgctccg

SEQ ID NO: 523516 - DNA, 25 bp, Rattus norvegicus
gcggctccgcagaatgacccatagt

SEQ ID NO: 523517 - DNA, 25 bp, Rattus norvegicus
ggcggcggtctctttgcatattcaa

SEQ ID NO: 523518 - DNA, 25 bp, Rattus norvegicus
atgcgcgtcctggactgcggctcaa

SEQ ID NO: 523519 - DNA, 25 bp, Rattus norvegicus
tgcggctcaacagacgctgctcagc

SEQ ID NO: 523520 - DNA, 25 bp, Rattus norvegicus
cccggcagctgcgtcagggtcctga

SEQ ID NO: 523521 - DNA, 25 bp, Rattus norvegicus
ggcgtgcaagcgactcgccagtgtc

SEQ ID NO: 523522 - DNA, 25 bp, Rattus norvegicus
ctcgccagtgtctgaggagacgcct

SEQ ID NO: 523523 - DNA, 25 bp, Rattus norvegicus
ttctcagcgggagcaccctggacgc

SEQ ID NO: 523524 - DNA, 25 bp, Rattus norvegicus
aggaaagatgcatcgcggcctccgc

SEQ ID NO: 523525 - DNA, 25 bp, Rattus norvegicus
ccgacaacagcgatcgcccgggatg

SEQ ID NO: 523526 - DNA, 25 bp, Rattus norvegicus
cagaagagactgtagcagcccgggc

SEQ ID NO: 523527 - DNA, 25 bp, Rattus norvegicus
aggcgccagcctcagaccatggcta

SEQ ID NO: 523528 - DNA, 25 bp, Rattus norvegicus
ggctacttcccacaatgcccttgaa

SEQ ID NO: 523529 - DNA, 25 bp, Rattus norvegicus
tacccggagcaagactcggcgcgta

SEQ ID NO: 523530 - DNA, 25 bp, Rattus norvegicus
aactgaaagtttgcagactcctccc

SEQ ID NO: 523531 - DNA, 25 bp, Rattus norvegicus
ccggcttcccgcttgatcaagggtc

SEQ ID NO: 523532 - DNA, 25 bp, Rattus norvegicus
gggtctgctatccttgttctgctgc

SEQ ID NO: 523533 - DNA, 25 bp, Rattus norvegicus
gttctgctgccacattcaccaatag

SEQ ID NO: 523534 - DNA, 25 bp, Rattus norvegicus
ttcaccaataggacccgccgcggtg

SEQ ID NO: 523535 - DNA, 25 bp, Rattus norvegicus
gctcggaccaagtgatcagggaaaa

SEQ ID NO: 523536 - DNA, 25 bp, Rattus norvegicus
ctcgcaaggggaagacccgcactgt

SEQ ID NO: 523537 - DNA, 25 bp, Rattus norvegicus
cgcaggtgtcacctggaacgtgacc

SEQ ID NO: 523538 - DNA, 25 bp, Rattus norvegicus
atgctcagccctactcaccatggtg

SEQ ID NO: 523539 - DNA, 25 bp, Rattus norvegicus
tcccgtattccatggtgaagccgcg

SEQ ID NO: 523540 - DNA, 25 bp, Rattus norvegicus
cgcaacttcccgtattccatggtga

SEQ ID NO: 523541 - DNA, 25 bp, Rattus norvegicus
cgtaagctcgcgagcacagccgcaa

SEQ ID NO: 523542 - DNA, 25 bp, Rattus norvegicus
gcctggagtggatctcggccgccat

SEQ ID NO: 523543 - DNA, 25 bp, Rattus norvegicus
caatcttgctcagcagcaccgggcg

SEQ ID NO: 523544 - DNA, 25 bp, Rattus norvegicus
tggtggccctcaatcttgctcagca

SEQ ID NO: 523545 - DNA, 25 bp, Rattus norvegicus
tcctcgctagcggtgatcacgccgt

SEQ ID NO: 523546 - DNA, 25 bp, Rattus norvegicus
agaccttacctgtcctcgctagcgg

SEQ ID NO: 523547 - DNA, 25 bp, Rattus norvegicus
gtggccgctcgatccggagtgacaa

SEQ ID NO: 523548 - DNA, 25 bp, Rattus norvegicus
acggcaccaggatctcggtggacta

SEQ ID NO: 523549 - DNA, 25 bp, Rattus norvegicus
agacagatccgcctgacggcaccag

SEQ ID NO: 523550 - DNA, 25 bp, Rattus norvegicus
tcccagactaaaggagtaagacaga

SEQ ID NO: 523551 - DNA, 25 bp, Rattus norvegicus
tgatcacgccgtcctccttggggat

SEQ ID NO: 523552 - DNA, 25 bp, Rattus norvegicus
gcgttgggagataggtcccagacta

SEQ ID NO: 523553 - DNA, 25 bp, Rattus norvegicus
attgccctgttcttgccatggcttc

SEQ ID NO: 523554 - DNA, 25 bp, Rattus norvegicus
cgttcccactacaccggtccggctg

SEQ ID NO: 523555 - DNA, 25 bp, Rattus norvegicus
atggcgcctgctacgcagcccgcca

SEQ ID NO: 523556 - DNA, 25 bp, Rattus norvegicus
tctccattgccctgttcttgccatg

SEQ ID NO: 523557 - DNA, 25 bp, Rattus norvegicus
gcagctgcctgcctgcaactgcggt

SEQ ID NO: 523558 - DNA, 25 bp, Rattus norvegicus
ccatggcttctgctgtattccggct

SEQ ID NO: 523559 - DNA, 25 bp, Rattus norvegicus
cttctgctgtattccggctgctgca

SEQ ID NO: 523560 - DNA, 25 bp, Rattus norvegicus
gctgtattccggctgctgcagcagg

SEQ ID NO: 523561 - DNA, 25 bp, Rattus norvegicus
ttggttcctccagttcggggagtga

SEQ ID NO: 523562 - DNA, 25 bp, Rattus norvegicus
gttcctccagttcggggagtgaaga

SEQ ID NO: 523563 - DNA, 25 bp, Rattus norvegicus
agtgaagaagggattccgtgccgcc

SEQ ID NO: 523564 - DNA, 25 bp, Rattus norvegicus
aagggattccgtgccgccttccgct

SEQ ID NO: 523565 - DNA, 25 bp, Rattus norvegicus
tgccgccttccgcttccagaaggag

SEQ ID NO: 523566 - DNA, 25 bp, Rattus norvegicus
ggtccggctgtcttccttccgctct

SEQ ID NO: 523567 - DNA, 25 bp, Rattus norvegicus
ggagccgcgcacaagcaaagtatgg

SEQ ID NO: 523568 - DNA, 25 bp, Rattus norvegicus
gtgctacccgtgagtgcccagacgc

SEQ ID NO: 523569 - DNA, 25 bp, Rattus norvegicus
agacgcctccggttcagggtcacgt

SEQ ID NO: 523570 - DNA, 25 bp, Rattus norvegicus
agggtcacgttttgcagccctgctg

SEQ ID NO: 523571 - DNA, 25 bp, Rattus norvegicus
agccctgctgaacccactgtagcta

SEQ ID NO: 523572 - DNA, 25 bp, Rattus norvegicus
actgtagctacaccgagctcggcga

SEQ ID NO: 523573 - DNA, 25 bp, Rattus norvegicus
gagcgatccgccagcctggggcaca

SEQ ID NO: 523574 - DNA, 25 bp, Rattus norvegicus
cgtggcggctcgagaaagttcccgc

SEQ ID NO: 523575 - DNA, 25 bp, Rattus norvegicus
gggacagttcctggctcctttccga

SEQ ID NO: 523576 - DNA, 25 bp, Rattus norvegicus
gccgggatccggcagccagtactca

SEQ ID NO: 523577 - DNA, 25 bp, Rattus norvegicus
caaagtatggggtcggtgctacccg

SEQ ID NO: 523578 - DNA, 25 bp, Rattus norvegicus
gccaacccggggtagagctgcacgt

SEQ ID NO: 523579 - DNA, 25 bp, Rattus norvegicus
tgcaccgcaggggacttaaggacgc

SEQ ID NO: 523580 - DNA, 25 bp, Rattus norvegicus
agtactcacccgtcctcgcttggat

SEQ ID NO: 523581 - DNA, 25 bp, Rattus norvegicus
ccgaagaatgtaaaccggcctctga

SEQ ID NO: 523582 - DNA, 25 bp, Rattus norvegicus
cttcagcgacgtgtacgagccagcg

SEQ ID NO: 523583 - DNA, 25 bp, Rattus norvegicus
caacgcccgcccgtaagagcggaag

SEQ ID NO: 523584 - DNA, 25 bp, Rattus norvegicus
cgttcctgttactggacgcgctcga

SEQ ID NO: 523585 - DNA, 25 bp, Rattus norvegicus
tcctagaggcggaagccggaacttg

SEQ ID NO: 523586 - DNA, 25 bp, Rattus norvegicus
ttgccgccctcctccggaagtgatg

SEQ ID NO: 523587 - DNA, 25 bp, Rattus norvegicus
ggaagtgatgggtcggtccactttc

SEQ ID NO: 523588 - DNA, 25 bp, Rattus norvegicus
gtccactttctggtgattgacagca

SEQ ID NO: 523589 - DNA, 25 bp, Rattus norvegicus
cagagcaggataaaggaggagttcc

SEQ ID NO: 523590 - DNA, 25 bp, Rattus norvegicus
tgagagcatcgctctggtctccctc

SEQ ID NO: 523591 - DNA, 25 bp, Rattus norvegicus
ggttcgtgatcaccctgccctgtta

SEQ ID NO: 523592 - DNA, 25 bp, Rattus norvegicus
gcagcaagcctgacgcgtgcgtact

SEQ ID NO: 523593 - DNA, 25 bp, Rattus norvegicus
ccctgccctgttaatccgaagaatg

SEQ ID NO: 523594 - DNA, 25 bp, Rattus norvegicus
agccagcggaggacacgttcctgtt

SEQ ID NO: 523595 - DNA, 25 bp, Rattus norvegicus
acgactgggagctcaaggaagcaga

SEQ ID NO: 523596 - DNA, 25 bp, Rattus norvegicus
tctgaaggtcaatctgtccgccgcc

SEQ ID NO: 523597 - DNA, 25 bp, Rattus norvegicus
ttccctagggtgctgggatagtgca

SEQ ID NO: 523598 - DNA, 25 bp, Rattus norvegicus
gatagtgcaagaggagaagtctgcc

SEQ ID NO: 523599 - DNA, 25 bp, Rattus norvegicus
gaagtctgcctgagacatcagagtc

SEQ ID NO: 523600 - DNA, 25 bp, Rattus norvegicus
ccagaggtgtcttctgcaagaggtc

SEQ ID NO: 523601 - DNA, 25 bp, Rattus norvegicus
tcacctcgctctgaaggtcaatctg

SEQ ID NO: 523602 - DNA, 25 bp, Rattus norvegicus
gagggatgggacgttcacactaccc

SEQ ID NO: 523603 - DNA, 25 bp, Rattus norvegicus
ctcagagcccgggagtccctcaaaa

SEQ ID NO: 523604 - DNA, 25 bp, Rattus norvegicus
cgggagtccctcaaaacttcttgca

SEQ ID NO: 523605 - DNA, 25 bp, Rattus norvegicus
aacttcttgcaagttcactcctgca

SEQ ID NO: 523606 - DNA, 25 bp, Rattus norvegicus
ctgtctcaggcacccacaggatggg

SEQ ID NO: 523607 - DNA, 25 bp, Rattus norvegicus
tttccggaattgaggaccaagagtg

SEQ ID NO: 523608 - DNA, 25 bp, Rattus norvegicus
ctgaggttccggcaacttgtcccaa

SEQ ID NO: 523609 - DNA, 25 bp, Rattus norvegicus
atggcaagaccgctcctgactaagg

SEQ ID NO: 523610 - DNA, 25 bp, Rattus norvegicus
ctccgcctcagcgagacgagatccg

SEQ ID NO: 523611 - DNA, 25 bp, Rattus norvegicus
aaacatctcactgcgcaggccgaac

SEQ ID NO: 523612 - DNA, 25 bp, Rattus norvegicus
ggcggcgacggacaaacatctcact

SEQ ID NO: 523613 - DNA, 25 bp, Rattus norvegicus
tccgaggcgccggtgtcacattgaa

SEQ ID NO: 523614 - DNA, 25 bp, Rattus norvegicus
tcagattcgacatggtgctcggccc

SEQ ID NO: 523615 - DNA, 25 bp, Rattus norvegicus
tgcccgtgcctttgctcagattcga

SEQ ID NO: 523616 - DNA, 25 bp, Rattus norvegicus
ccgcatcttggtgtccttccggctg

SEQ ID NO: 523617 - DNA, 25 bp, Rattus norvegicus
aaaggcccggatccgcatcttggtg

SEQ ID NO: 523618 - DNA, 25 bp, Rattus norvegicus
gcgccgaggaccgactcaccggaaa

SEQ ID NO: 523619 - DNA, 25 bp, Rattus norvegicus
gcacgctaaaagttacacacacgcc

SEQ ID NO: 523620 - DNA, 25 bp, Rattus norvegicus
tctggaaaccgcacgctaaaagtta

SEQ ID NO: 523621 - DNA, 25 bp, Rattus norvegicus
gggtccttctggaaaccgcacgcta

SEQ ID NO: 523622 - DNA, 25 bp, Rattus norvegicus
accgctcctgactaaggagtcgggc

SEQ ID NO: 523623 - DNA, 25 bp, Rattus norvegicus
aactccgcctggctagggcgcatct

SEQ ID NO: 523624 - DNA, 25 bp, Rattus norvegicus
atagtgcctggcgaaggtgtcgctc

SEQ ID NO: 523625 - DNA, 25 bp, Rattus norvegicus
tcctcgattctttggtgatagtgcc

SEQ ID NO: 523626 - DNA, 25 bp, Rattus norvegicus
gctgctcatctaagcgtcccgcgtt

SEQ ID NO: 523627 - DNA, 25 bp, Rattus norvegicus
tgtagaggctcaccgggctagcgac

SEQ ID NO: 523628 - DNA, 25 bp, Rattus norvegicus
ttcaggaagcggaactcggagcctt

SEQ ID NO: 523629 - DNA, 25 bp, Rattus norvegicus
cgctcaactcacaagaggcgggttt

SEQ ID NO: 523630 - DNA, 25 bp, Rattus norvegicus
acaagaggcgggtttttctcgcgcg

SEQ ID NO: 523631 - DNA, 25 bp, Rattus norvegicus
tgtcgctctgtggaggagcaaatgc

SEQ ID NO: 523632 - DNA, 25 bp, Rattus norvegicus
gactttgcaaaactcggcgcctctc

SEQ ID NO: 523633 - DNA, 25 bp, Rattus norvegicus
gagggcaagctagcctccgtgtaga

SEQ ID NO: 523634 - DNA, 25 bp, Rattus norvegicus
cgagactgagactcggtgctgatcc

SEQ ID NO: 523635 - DNA, 25 bp, Rattus norvegicus
gtgctgatcccgagctgcctctgct

SEQ ID NO: 523636 - DNA, 25 bp, Rattus norvegicus
agctccgcggcgactttgcaaaact

SEQ ID NO: 523637 - DNA, 25 bp, Rattus norvegicus
tcggctgctacagccaacctcgagg

SEQ ID NO: 523638 - DNA, 25 bp, Rattus norvegicus
ggggagcccagagccaagcaaagag

SEQ ID NO: 523639 - DNA, 25 bp, Rattus norvegicus
tcgccgctgtctctcccacccgggg

SEQ ID NO: 523640 - DNA, 25 bp, Rattus norvegicus
gcaggaagcggaggtgacccgggaa

SEQ ID NO: 523641 - DNA, 25 bp, Rattus norvegicus
gtcccgcgaggaccgagccaggcga

SEQ ID NO: 523642 - DNA, 25 bp, Rattus norvegicus
gaaaagggaaagtgccagggctcgc

SEQ ID NO: 523643 - DNA, 25 bp, Rattus norvegicus
aaagtgccagggctcgcgggtccgc

SEQ ID NO: 523644 - DNA, 25 bp, Rattus norvegicus
cagccaacctcgaggcctgggaagg

SEQ ID NO: 523645 - DNA, 25 bp, Rattus norvegicus
acagccaacctcgaggcctgggaag

SEQ ID NO: 523646 - DNA, 25 bp, Rattus norvegicus
ggcacccagcgtccagcccaccggc

SEQ ID NO: 523647 - DNA, 25 bp, Rattus norvegicus
acccagcgtccagcccaccggcctg

SEQ ID NO: 523648 - DNA, 25 bp, Rattus norvegicus
gaggctcggctgctacagccaacct

SEQ ID NO: 523649 - DNA, 25 bp, Rattus norvegicus
tgctacagccaacctcgaggcctgg

SEQ ID NO: 523650 - DNA, 25 bp, Rattus norvegicus
ctacagccaacctcgaggcctggga

SEQ ID NO: 523651 - DNA, 25 bp, Rattus norvegicus
gctggaggaagcaagcagaaaccct

SEQ ID NO: 523652 - DNA, 25 bp, Rattus norvegicus
gactccgaaattcacgccgttcctg

SEQ ID NO: 523653 - DNA, 25 bp, Rattus norvegicus
tgcgccaaaggaagatagcctgatc

SEQ ID NO: 523654 - DNA, 25 bp, Rattus norvegicus
atccgagtttaagggcgtttcatgc

SEQ ID NO: 523655 - DNA, 25 bp, Rattus norvegicus
tgcagccgcaatcttccgaggacta

SEQ ID NO: 523656 - DNA, 25 bp, Rattus norvegicus
tccttgcagcagagaaggagctatg

SEQ ID NO: 523657 - DNA, 25 bp, Rattus norvegicus
aggagctatggtgcatcccttgccg

SEQ ID NO: 523658 - DNA, 25 bp, Rattus norvegicus
gctgccaagtcccaacgttgcacgg

SEQ ID NO: 523659 - DNA, 25 bp, Rattus norvegicus
taccagctcaatcgcagagaccgcg

SEQ ID NO: 523660 - DNA, 25 bp, Rattus norvegicus
agtggcttttccacgcgcaacgcta

SEQ ID NO: 523661 - DNA, 25 bp, Rattus norvegicus
acggtccagagggacaggctcatcc

SEQ ID NO: 523662 - DNA, 25 bp, Rattus norvegicus
cctagctccagtccgcaagggagga

SEQ ID NO: 523663 - DNA, 25 bp, Rattus norvegicus
cctcctcctcggagagttgccgaga

SEQ ID NO: 523664 - DNA, 25 bp, Rattus norvegicus
cgccgtctcactccagaggagcaaa

SEQ ID NO: 523665 - DNA, 25 bp, Rattus norvegicus
cttcttatctcctccggcggggatg

SEQ ID NO: 523666 - DNA, 25 bp, Rattus norvegicus
ccgggtctgggtcttcttatctcct

SEQ ID NO: 523667 - DNA, 25 bp, Rattus norvegicus
cgcccagcggaagcgcaacttcagg

SEQ ID NO: 523668 - DNA, 25 bp, Rattus norvegicus
gaagcgctactttggggccagctag

SEQ ID NO: 523669 - DNA, 25 bp, Rattus norvegicus
gtcgcttatgtgtggtgtcttcccg

SEQ ID NO: 523670 - DNA, 25 bp, Rattus norvegicus
cagccgagtttgtggcgtcgcttat

SEQ ID NO: 523671 - DNA, 25 bp, Rattus norvegicus
cttagagagagtgagtttccgcgtc

SEQ ID NO: 523672 - DNA, 25 bp, Rattus norvegicus
tacgtgaggacgctagcgggtctta

SEQ ID NO: 523673 - DNA, 25 bp, Rattus norvegicus
tctcccgattcggtgtccggacgtg

SEQ ID NO: 523674 - DNA, 25 bp, Rattus norvegicus
tgcgggaagtcgagtctcccgattc

SEQ ID NO: 523675 - DNA, 25 bp, Rattus norvegicus
ttccctaggtcaccggaagtggagc

SEQ ID NO: 523676 - DNA, 25 bp, Rattus norvegicus
tgcagcacttcttttccctaggtca

SEQ ID NO: 523677 - DNA, 25 bp, Rattus norvegicus
cgagcatgcgcagactgcagcactt

SEQ ID NO: 523678 - DNA, 25 bp, Rattus norvegicus
aaggacgtacgtagcaccgagcatg

SEQ ID NO: 523679 - DNA, 25 bp, Rattus norvegicus
aactgcggggtagcaggcagaccta

SEQ ID NO: 523680 - DNA, 25 bp, Rattus norvegicus
tagagctgccagcaaacccggcctc

SEQ ID NO: 523681 - DNA, 25 bp, Rattus norvegicus
gggtagcaggcagacctaacacgca

SEQ ID NO: 523682 - DNA, 25 bp, Rattus norvegicus
ggcagacctaacacgcacctcgagg

SEQ ID NO: 523683 - DNA, 25 bp, Rattus norvegicus
cacgcacctcgaggttgtggctgga

SEQ ID NO: 523684 - DNA, 25 bp, Rattus norvegicus
tgtggctggaggtaatccacccgtg

SEQ ID NO: 523685 - DNA, 25 bp, Rattus norvegicus
tggaggtaatccacccgtgaccgtg

SEQ ID NO: 523686 - DNA, 25 bp, Rattus norvegicus
agcctgtccagcctcaggtctgtgt

SEQ ID NO: 523687 - DNA, 25 bp, Rattus norvegicus
cagcctcaggtctgtgtgctggctg

SEQ ID NO: 523688 - DNA, 25 bp, Rattus norvegicus
ctgcgagttgaagaccggcagcaga

SEQ ID NO: 523689 - DNA, 25 bp, Rattus norvegicus
aagaccggcagcagatgggcagccc

SEQ ID NO: 523690 - DNA, 25 bp, Rattus norvegicus
ccagagtcgcagactcccgcgcgcc

SEQ ID NO: 523691 - DNA, 25 bp, Rattus norvegicus
caaacccggcctccagagtcgcaga

SEQ ID NO: 523692 - DNA, 25 bp, Rattus norvegicus
cggtaactgaaccgcgggaactgcg

SEQ ID NO: 523693 - DNA, 25 bp, Rattus norvegicus
aggcccagggtgagtgctctactcc

SEQ ID NO: 523694 - DNA, 25 bp, Rattus norvegicus
ctccgccgcttctttgcccgggcgc

SEQ ID NO: 523695 - DNA, 25 bp, Rattus norvegicus
tcggtcaacggcctctgcgagcgct

SEQ ID NO: 523696 - DNA, 25 bp, Rattus norvegicus
tcgacgtctcacgaatttgcgtgca

SEQ ID NO: 523697 - DNA, 25 bp, Rattus norvegicus
tcggtgcgctcggtcaacggcctct

SEQ ID NO: 523698 - DNA, 25 bp, Rattus norvegicus
gagtgctctactccccctaagcagg

SEQ ID NO: 523699 - DNA, 25 bp, Rattus norvegicus
agtcctggccgttctcgcgtctgtc

SEQ ID NO: 523700 - DNA, 25 bp, Rattus norvegicus
aaggggccagtcctggccgttctcg

SEQ ID NO: 523701 - DNA, 25 bp, Rattus norvegicus
acggctcctggaaggggccagtcct

SEQ ID NO: 523702 - DNA, 25 bp, Rattus norvegicus
ctacttccgctacggctcctggaag

SEQ ID NO: 523703 - DNA, 25 bp, Rattus norvegicus
tgaccaggaacctacttccgctacg

SEQ ID NO: 523704 - DNA, 25 bp, Rattus norvegicus
ccttctctcgtcacatgaccaggaa

SEQ ID NO: 523705 - DNA, 25 bp, Rattus norvegicus
gaatttgcgtgcaacatccgccctt

SEQ ID NO: 523706 - DNA, 25 bp, Rattus norvegicus
ggactctccagcaggcccagggtga

SEQ ID NO: 523707 - DNA, 25 bp, Rattus norvegicus
ggcatctgctcggtgcctcggaacc

SEQ ID NO: 523708 - DNA, 25 bp, Rattus norvegicus
caggaggagaagcacctgaagatgc

SEQ ID NO: 523709 - DNA, 25 bp, Rattus norvegicus
gcagtgactcctcccggccagtaga

SEQ ID NO: 523710 - DNA, 25 bp, Rattus norvegicus
agtagagggcgccagcccgcacttg

SEQ ID NO: 523711 - DNA, 25 bp, Rattus norvegicus
cgagcctcgtccagccgggaggaac

SEQ ID NO: 523712 - DNA, 25 bp, Rattus norvegicus
cggggcctttgtgcgacccgcagct

SEQ ID NO: 523713 - DNA, 25 bp, Rattus norvegicus
agcagagaccgagaccggagtccgc

SEQ ID NO: 523714 - DNA, 25 bp, Rattus norvegicus
acctgaagatgctgcgggacatgac

SEQ ID NO: 523715 - DNA, 25 bp, Rattus norvegicus
ggctgccgcacaaccgcaagtgctt

SEQ ID NO: 523716 - DNA, 25 bp, Rattus norvegicus
gcaagtgcttcgactgcgaccagcg

SEQ ID NO: 523717 - DNA, 25 bp, Rattus norvegicus
cctacgtgaacatgacggtcggctc

SEQ ID NO: 523718 - DNA, 25 bp, Rattus norvegicus
gtcggctcgttcgtgtgcacctctt

SEQ ID NO: 523719 - DNA, 25 bp, Rattus norvegicus
atgctcttgcgctttggccgggcga

SEQ ID NO: 523720 - DNA, 25 bp, Rattus norvegicus
tcgtgtgcacctcttgctccggcag

SEQ ID NO: 523721 - DNA, 25 bp, Rattus norvegicus
tgccggcaacttgtgggctccgctc

SEQ ID NO: 523722 - DNA, 25 bp, Rattus norvegicus
gagactctgtgggttgcgcccggaa

SEQ ID NO: 523723 - DNA, 25 bp, Rattus norvegicus
agcatgcccgggcgggcttctgcca

SEQ ID NO: 523724 - DNA, 25 bp, Rattus norvegicus
acctgcgcggtctgagcatgcccgg

SEQ ID NO: 523725 - DNA, 25 bp, Rattus norvegicus
cggacctgcgcggtctgagcatgcc

SEQ ID NO: 523726 - DNA, 25 bp, Rattus norvegicus
agctcagacgattgcgcagctccgc

SEQ ID NO: 523727 - DNA, 25 bp, Rattus norvegicus
cgcagctcagacgattgcgcagctc

SEQ ID NO: 523728 - DNA, 25 bp, Rattus norvegicus
gccgccagtcggtgcgcagctcaga

SEQ ID NO: 523729 - DNA, 25 bp, Rattus norvegicus
tccgctgccggcaacttgtgggctc

SEQ ID NO: 523730 - DNA, 25 bp, Rattus norvegicus
catctggggtcagcgtctgcaggct

SEQ ID NO: 523731 - DNA, 25 bp, Rattus norvegicus
gtcacatctggggtcagcgtctgca

SEQ ID NO: 523732 - DNA, 25 bp, Rattus norvegicus
ctgcggtcccgctgtcacatctggg

SEQ ID NO: 523733 - DNA, 25 bp, Rattus norvegicus
agggagctgcggtcccgctgtcaca

SEQ ID NO: 523734 - DNA, 25 bp, Rattus norvegicus
cagtcggtgcgcagctcagacgatt

SEQ ID NO: 523735 - DNA, 25 bp, Rattus norvegicus
gcagccgcacagacgtagtccacaa

SEQ ID NO: 523736 - DNA, 25 bp, Rattus norvegicus
agacgtagtccacaaccatttccgg

SEQ ID NO: 523737 - DNA, 25 bp, Rattus norvegicus
acgtagtccacaaccatttccggct

SEQ ID NO: 523738 - DNA, 25 bp, Rattus norvegicus
gcacagatcccgctcggcggccacc

SEQ ID NO: 523739 - DNA, 25 bp, Rattus norvegicus
ggccaccgcttctccgcaggcgcag

SEQ ID NO: 523740 - DNA, 25 bp, Rattus norvegicus
ctggggaagcacatgggatttgctc

SEQ ID NO: 523741 - DNA, 25 bp, Rattus norvegicus
gaagcacatgggatttgctccgccc

SEQ ID NO: 523742 - DNA, 25 bp, Rattus norvegicus
cctctgaggccctggcggttcttta

SEQ ID NO: 523743 - DNA, 25 bp, Rattus norvegicus
ctttagttcattcatactttgcggc

SEQ ID NO: 523744 - DNA, 25 bp, Rattus norvegicus
gttcattcatactttgcggcaagca

SEQ ID NO: 523745 - DNA, 25 bp, Rattus norvegicus
cattcatactttgcggcaagcattt

SEQ ID NO: 523746 - DNA, 25 bp, Rattus norvegicus
tttattgagcgcgtgagtgcaaagc

SEQ ID NO: 523747 - DNA, 25 bp, Rattus norvegicus
cgcgtgagtgcaaagcgaagtgccc

SEQ ID NO: 523748 - DNA, 25 bp, Rattus norvegicus
tgcaaagcgaagtgcccgcctggag

SEQ ID NO: 523749 - DNA, 25 bp, Rattus norvegicus
ccgggctcagcatcgaccgcaggat

SEQ ID NO: 523750 - DNA, 25 bp, Rattus norvegicus
ctctgggcggccgtagtgtccactt

SEQ ID NO: 523751 - DNA, 25 bp, Rattus norvegicus
gcggccgtagtgtccacttacctgg

SEQ ID NO: 523752 - DNA, 25 bp, Rattus norvegicus
gtgtccacttacctggcagtcggtg

SEQ ID NO: 523753 - DNA, 25 bp, Rattus norvegicus
acctggcagtcggtgccagaaaccc

SEQ ID NO: 523754 - DNA, 25 bp, Rattus norvegicus
agcgagcctagaggacgcagaagct

SEQ ID NO: 523755 - DNA, 25 bp, Rattus norvegicus
gctgtagccgggctcagcatcgacc

SEQ ID NO: 523756 - DNA, 25 bp, Rattus norvegicus
catcgaccgcaggatgctcttggtc

SEQ ID NO: 523757 - DNA, 25 bp, Rattus norvegicus
aggatgctcttggtcggtcaccgaa

SEQ ID NO: 523758 - DNA, 25 bp, Rattus norvegicus
tcggtcaccgaacgcggagtgcaca

SEQ ID NO: 523759 - DNA, 25 bp, Rattus norvegicus
ctggccaagcagctgctttggggcc

SEQ ID NO: 523760 - DNA, 25 bp, Rattus norvegicus
aagcagctgctttggggcccagcac

SEQ ID NO: 523761 - DNA, 25 bp, Rattus norvegicus
gcatagcgagcctagaggacgcaga

SEQ ID NO: 523762 - DNA, 25 bp, Rattus norvegicus
acaggtgcagctgtagccgggctca

SEQ ID NO: 523763 - DNA, 25 bp, Rattus norvegicus
ctttccttggtctgaagcacctgcc

SEQ ID NO: 523764 - DNA, 25 bp, Rattus norvegicus
gcttagccacgcagagaccctttcg

SEQ ID NO: 523765 - DNA, 25 bp, Rattus norvegicus
gccgacggcaggtctctgctgtaca

SEQ ID NO: 523766 - DNA, 25 bp, Rattus norvegicus
tgagacccacgagcgctttccttgg

SEQ ID NO: 523767 - DNA, 25 bp, Rattus norvegicus
agacagttcgcagcttggcggtaca

SEQ ID NO: 523768 - DNA, 25 bp, Rattus norvegicus
tgagggaccgaccactggggacaaa

SEQ ID NO: 523769 - DNA, 25 bp, Rattus norvegicus
taggagcaatctctcaagccgaaga

SEQ ID NO: 523770 - DNA, 25 bp, Rattus norvegicus
ggtccctttggaggactttgcagtc

SEQ ID NO: 523771 - DNA, 25 bp, Rattus norvegicus
cgcgcagcctagaaggtccctttgg

SEQ ID NO: 523772 - DNA, 25 bp, Rattus norvegicus
tcgctggctgcaccaacgagacgct

SEQ ID NO: 523773 - DNA, 25 bp, Rattus norvegicus
gcctgtctgcttagggctttctagg

SEQ ID NO: 523774 - DNA, 25 bp, Rattus norvegicus
ggacagagagcatgcgcagacgcca

SEQ ID NO: 523775 - DNA, 25 bp, Rattus norvegicus
ctctgctgtacagcgttgtcgctta

SEQ ID NO: 523776 - DNA, 25 bp, Rattus norvegicus
aagcggatctgaggagtctggacca

SEQ ID NO: 523777 - DNA, 25 bp, Rattus norvegicus
ctagggccttcctcatcgctggagg

SEQ ID NO: 523778 - DNA, 25 bp, Rattus norvegicus
actgccaactcaaaagcggacttcg

SEQ ID NO: 523779 - DNA, 25 bp, Rattus norvegicus
cccttcctggttgtcttagcgacgg

SEQ ID NO: 523780 - DNA, 25 bp, Rattus norvegicus
ttcgctttaaagtgaggctgcggcc

SEQ ID NO: 523781 - DNA, 25 bp, Rattus norvegicus
cccaggacctgactgtagaaatttc

SEQ ID NO: 523782 - DNA, 25 bp, Rattus norvegicus
ctccgcgctagcaggaactaaattc

SEQ ID NO: 523783 - DNA, 25 bp, Rattus norvegicus
acttcgtatccctccgctggggtca

SEQ ID NO: 523784 - DNA, 25 bp, Rattus norvegicus
ggactgtggcgctccacttcgtatc

SEQ ID NO: 523785 - DNA, 25 bp, Rattus norvegicus
ccagccggggactactttgtcctga

SEQ ID NO: 523786 - DNA, 25 bp, Rattus norvegicus
gcggcttgtcgtcccttcaattatc

SEQ ID NO: 523787 - DNA, 25 bp, Rattus norvegicus
cgccgctaggaacggcgtcccaatt

SEQ ID NO: 523788 - DNA, 25 bp, Rattus norvegicus
tcagacttttggctccggtttccca

SEQ ID NO: 523789 - DNA, 25 bp, Rattus norvegicus
cacgggcacgctgcctcagactttt

SEQ ID NO: 523790 - DNA, 25 bp, Rattus norvegicus
cgggagctctgtcgctacgatgaca

SEQ ID NO: 523791 - DNA, 25 bp, Rattus norvegicus
agcccagagtactcactgcacgcag

SEQ ID NO: 523792 - DNA, 25 bp, Rattus norvegicus
tcctgcagatacagtgcccggggct

SEQ ID NO: 523793 - DNA, 25 bp, Rattus norvegicus
tctcagctcgcaagggtctcaggaa

SEQ ID NO: 523794 - DNA, 25 bp, Rattus norvegicus
gtctcaggaagagccgcgaccgcca

SEQ ID NO: 523795 - DNA, 25 bp, Rattus norvegicus
gcgaccgccagtatcgaccggtatc

SEQ ID NO: 523796 - DNA, 25 bp, Rattus norvegicus
gaccggtatctaccagtattcgctg

SEQ ID NO: 523797 - DNA, 25 bp, Rattus norvegicus
agtattcgctggctcggagatgctc

SEQ ID NO: 523798 - DNA, 25 bp, Rattus norvegicus
ggagatgctccaaccctgcggtagc

SEQ ID NO: 523799 - DNA, 25 bp, Rattus norvegicus
gccaatcaacacagcccagagtact

SEQ ID NO: 523800 - DNA, 25 bp, Rattus norvegicus
agcccgagaggctacggtctcactc

SEQ ID NO: 523801 - DNA, 25 bp, Rattus norvegicus
acctgtgaacttgcaggtccgctcg

SEQ ID NO: 523802 - DNA, 25 bp, Rattus norvegicus
catggggattggtgacaatgtcgac

SEQ ID NO: 523803 - DNA, 25 bp, Rattus norvegicus
tcggctcccagtctcgacctgtgaa

SEQ ID NO: 523804 - DNA, 25 bp, Rattus norvegicus
aatgtcgaccagcatcctgcagata

SEQ ID NO: 523805 - DNA, 25 bp, Rattus norvegicus
agtaggcacgtcaaagccgggctca

SEQ ID NO: 523806 - DNA, 25 bp, Rattus norvegicus
gcgcagcctccctgttagcgggacg

SEQ ID NO: 523807 - DNA, 25 bp, Rattus norvegicus
tagcgggacgccgacactatctttg

SEQ ID NO: 523808 - DNA, 25 bp, Rattus norvegicus
cactatctttgtagggaacctttca

SEQ ID NO: 523809 - DNA, 25 bp, Rattus norvegicus
atttctggctaggaattgtgcggtc

SEQ ID NO: 523810 - DNA, 25 bp, Rattus norvegicus
tggagcaatccaaagcgccgactgc

SEQ ID NO: 523811 - DNA, 25 bp, Rattus norvegicus
tgccggagcgactccgaggtgaacc

SEQ ID NO: 523812 - DNA, 25 bp, Rattus norvegicus
cctgagagagtctggggcttcagta

SEQ ID NO: 523813 - DNA, 25 bp, Rattus norvegicus
tcgcgcgaaggctgaggcaacctca

SEQ ID NO: 523814 - DNA, 25 bp, Rattus norvegicus
aaggcagtgccggaccacacagcca

SEQ ID NO: 523815 - DNA, 25 bp, Rattus norvegicus
agacgacacggagagggagctccct

SEQ ID NO: 523816 - DNA, 25 bp, Rattus norvegicus
atactaggctctcgaggcctgccgg

SEQ ID NO: 523817 - DNA, 25 bp, Rattus norvegicus
cgcccttgtcctagccgatactagg

SEQ ID NO: 523818 - DNA, 25 bp, Rattus norvegicus
agctgtcactccagccgcactgggg

SEQ ID NO: 523819 - DNA, 25 bp, Rattus norvegicus
gcaagaagtaggcactgcgatcgag

SEQ ID NO: 523820 - DNA, 25 bp, Rattus norvegicus
aaccttggagtcacgagcggaagcg

SEQ ID NO: 523821 - DNA, 25 bp, Rattus norvegicus
ccagcggaaccttggagtcacgagc

SEQ ID NO: 523822 - DNA, 25 bp, Rattus norvegicus
ccgcggagaccagcggaaccttgga

SEQ ID NO: 523823 - DNA, 25 bp, Rattus norvegicus
aagctcggcgcaggcgtctggtcct

SEQ ID NO: 523824 - DNA, 25 bp, Rattus norvegicus
caggcgtctggtccttccgtggaag

SEQ ID NO: 523825 - DNA, 25 bp, Rattus norvegicus
ccgcggagattctgctgacgccggc

SEQ ID NO: 523826 - DNA, 25 bp, Rattus norvegicus
gaggactcccaagccatccaaactt

SEQ ID NO: 523827 - DNA, 25 bp, Rattus norvegicus
actgcgatcgaggttgcacgggcaa

SEQ ID NO: 523828 - DNA, 25 bp, Rattus norvegicus
gcagccatggtgaagatcagcttcc

SEQ ID NO: 523829 - DNA, 25 bp, Rattus norvegicus
tggtgaagatcagcttccagcccgc

SEQ ID NO: 523830 - DNA, 25 bp, Rattus norvegicus
ggccgaaaaagcagacaaagcagcg

SEQ ID NO: 523831 - DNA, 25 bp, Rattus norvegicus
caaagcagcggcgtctggtccggcc

SEQ ID NO: 523832 - DNA, 25 bp, Rattus norvegicus
tagaggcgaggactcccaagccatc

SEQ ID NO: 523833 - DNA, 25 bp, Rattus norvegicus
gtggctgagatcaccaagctaagca

SEQ ID NO: 523834 - DNA, 25 bp, Rattus norvegicus
ctcgggtcaccagaaaaaggacttg

SEQ ID NO: 523835 - DNA, 25 bp, Rattus norvegicus
cgagtcagtccatctcaggccgcgg

SEQ ID NO: 523836 - DNA, 25 bp, Rattus norvegicus
tcgggtgctgttagtaagagagttc

SEQ ID NO: 523837 - DNA, 25 bp, Rattus norvegicus
ttcaagcccgaagaaagctacacga

SEQ ID NO: 523838 - DNA, 25 bp, Rattus norvegicus
agctacacgaaccagcccgtctata

SEQ ID NO: 523839 - DNA, 25 bp, Rattus norvegicus
tgccaaagttgtggcggcagtgtcc

SEQ ID NO: 523840 - DNA, 25 bp, Rattus norvegicus
agtgtccggccaggacttaagcgca

SEQ ID NO: 523841 - DNA, 25 bp, Rattus norvegicus
tcctgcagcaggtacgggtccagga

SEQ ID NO: 523842 - DNA, 25 bp, Rattus norvegicus
gagaagtcgcagctctcgggtcacc

SEQ ID NO: 523843 - DNA, 25 bp, Rattus norvegicus
agcccggcaagcagctgctcctggt

SEQ ID NO: 523844 - DNA, 25 bp, Rattus norvegicus
gacttgttggattgcgaggcacctc

SEQ ID NO: 523845 - DNA, 25 bp, Rattus norvegicus
aggcacctcgggcttcacaagggaa

SEQ ID NO: 523846 - DNA, 25 bp, Rattus norvegicus
cttaagcgcactggcgacagcttgg

SEQ ID NO: 523847 - DNA, 25 bp, Rattus norvegicus
gacttcgcccgtgcggtgttccctc

SEQ ID NO: 523848 - DNA, 25 bp, Rattus norvegicus
gagctcccagcttggcgcaagaggc

SEQ ID NO: 523849 - DNA, 25 bp, Rattus norvegicus
cggcggagctcccagcttggcgcaa

SEQ ID NO: 523850 - DNA, 25 bp, Rattus norvegicus
agccgcccttccaggcgctcgtgga

SEQ ID NO: 523851 - DNA, 25 bp, Rattus norvegicus
ggcccgcgagctccacggagccgcc

SEQ ID NO: 523852 - DNA, 25 bp, Rattus norvegicus
agccgcatagggctccgggaacgaa

SEQ ID NO: 523853 - DNA, 25 bp, Rattus norvegicus
aacgaaggcggagcgcgttatccgc

SEQ ID NO: 523854 - DNA, 25 bp, Rattus norvegicus
aggcggagcgcgttatccgctcgcc

SEQ ID NO: 523855 - DNA, 25 bp, Rattus norvegicus
gtcttcgtgctctgccgcgccggat

SEQ ID NO: 523856 - DNA, 25 bp, Rattus norvegicus
tgacctcccgggagcctcggcgcca

SEQ ID NO: 523857 - DNA, 25 bp, Rattus norvegicus
gtgcaggctgcagccttccgtccgg

SEQ ID NO: 523858 - DNA, 25 bp, Rattus norvegicus
ggcctccagcctggcggtccaggag

SEQ ID NO: 523859 - DNA, 25 bp, Rattus norvegicus
ctgcagggccctgcaagctgcggga

SEQ ID NO: 523860 - DNA, 25 bp, Rattus norvegicus
atccgctcgccgctcgtcttcgtgc

SEQ ID NO: 523861 - DNA, 25 bp, Rattus norvegicus
cgaggtcctcggctagaagcgagcc

SEQ ID NO: 523862 - DNA, 25 bp, Rattus norvegicus
ccctattgcatggtatcgagaggcc

SEQ ID NO: 523863 - DNA, 25 bp, Rattus norvegicus
ggtcgctggacctttattctctctg

SEQ ID NO: 523864 - DNA, 25 bp, Rattus norvegicus
aggtagccacctgagcgtccctggc

SEQ ID NO: 523865 - DNA, 25 bp, Rattus norvegicus
ttcgtaggaataggaccaggtagcc

SEQ ID NO: 523866 - DNA, 25 bp, Rattus norvegicus
ctgggagactgaccaggctactgca

SEQ ID NO: 523867 - DNA, 25 bp, Rattus norvegicus
agggcgcagccatgatcacttcagc

SEQ ID NO: 523868 - DNA, 25 bp, Rattus norvegicus
tgtccgcttcttggtcgaatgaccc

SEQ ID NO: 523869 - DNA, 25 bp, Rattus norvegicus
actgactgagcagcgcacccgggaa

SEQ ID NO: 523870 - DNA, 25 bp, Rattus norvegicus
gaatttgcgtcaagcctcaggcgga

SEQ ID NO: 523871 - DNA, 25 bp, Rattus norvegicus
gccggagctgcctaaaagacacagg

SEQ ID NO: 523872 - DNA, 25 bp, Rattus norvegicus
gaccagatctatgacctcgcgagaa

SEQ ID NO: 523873 - DNA, 25 bp, Rattus norvegicus
ccgtaggtgtatcagcttgggatgc

SEQ ID NO: 523874 - DNA, 25 bp, Rattus norvegicus
agctgacagatccagggcttggcca

SEQ ID NO: 523875 - DNA, 25 bp, Rattus norvegicus
accgggcgccatgtctctgtggtga

SEQ ID NO: 523876 - DNA, 25 bp, Rattus norvegicus
cgccgcgtcaggatgttggcgatcc

SEQ ID NO: 523877 - DNA, 25 bp, Rattus norvegicus
tgttggcgatcctcaaggtctctga

SEQ ID NO: 523878 - DNA, 25 bp, Rattus norvegicus
gagattccggctcttcccttagcga

SEQ ID NO: 523879 - DNA, 25 bp, Rattus norvegicus
cgtgcctctgaggtgaacagagttg

SEQ ID NO: 523880 - DNA, 25 bp, Rattus norvegicus
cagccgcagggaaaaagaaagtctc

SEQ ID NO: 523881 - DNA, 25 bp, Rattus norvegicus
ggccgcagggtacctccgagcttca

SEQ ID NO: 523882 - DNA, 25 bp, Rattus norvegicus
ccagtttcccgggacatcgagggtg

SEQ ID NO: 523883 - DNA, 25 bp, Rattus norvegicus
ggccctgcgatctcactaacagata

SEQ ID NO: 523884 - DNA, 25 bp, Rattus norvegicus
ccgctttgctcctaaaaatggagtg

SEQ ID NO: 523885 - DNA, 25 bp, Rattus norvegicus
actggtacgtgcgagccagggccct

SEQ ID NO: 523886 - DNA, 25 bp, Rattus norvegicus
ggctggtccttactcggactccgga

SEQ ID NO: 523887 - DNA, 25 bp, Rattus norvegicus
ccacgtgtcccgaagaggagaggca

SEQ ID NO: 523888 - DNA, 25 bp, Rattus norvegicus
ccgcagagcgcaagggatgcacgct

SEQ ID NO: 523889 - DNA, 25 bp, Rattus norvegicus
tgaggcagccgggaaattactgttc

SEQ ID NO: 523890 - DNA, 25 bp, Rattus norvegicus
cgcactctgaggcagccgggaaatt

SEQ ID NO: 523891 - DNA, 25 bp, Rattus norvegicus
tactagtgttgggttagggtgtctc

SEQ ID NO: 523892 - DNA, 25 bp, Rattus norvegicus
gttccggcatctagccgaactacta

SEQ ID NO: 523893 - DNA, 25 bp, Rattus norvegicus
cgggaaattactgttccggcatcta

SEQ ID NO: 523894 - DNA, 25 bp, Rattus norvegicus
gcggatcccgagttccgcactctga

SEQ ID NO: 523895 - DNA, 25 bp, Rattus norvegicus
cgcgtcgtcctccagaccggaaacg

SEQ ID NO: 523896 - DNA, 25 bp, Rattus norvegicus
tcccagattgcaacgcgcgcgtcgt

SEQ ID NO: 523897 - DNA, 25 bp, Rattus norvegicus
cttttcccagattgcaacgcgcgcg

SEQ ID NO: 523898 - DNA, 25 bp, Rattus norvegicus
ctccgccactactgccggcctactg

SEQ ID NO: 523899 - DNA, 25 bp, Rattus norvegicus
gcacgggtgtcttgtctcgtccacc

SEQ ID NO: 523900 - DNA, 25 bp, Rattus norvegicus
cgctcgacttctcgtccgcgccgct

SEQ ID NO: 523901 - DNA, 25 bp, Rattus norvegicus
atcccgtcgctccttgccgctcgac

SEQ ID NO: 523902 - DNA, 25 bp, Rattus norvegicus
gcatctagccgaactactagtgttg

SEQ ID NO: 523903 - DNA, 25 bp, Rattus norvegicus
gtcctttgagtgttcctgagcgccc

SEQ ID NO: 523904 - DNA, 25 bp, Rattus norvegicus
cgacgaaggtgttctcgtgacctca

SEQ ID NO: 523905 - DNA, 25 bp, Rattus norvegicus
tagtcgcgcgagacttccctcagca

SEQ ID NO: 523906 - DNA, 25 bp, Rattus norvegicus
tctcagaaagcaggcctagtcgtcc

SEQ ID NO: 523907 - DNA, 25 bp, Rattus norvegicus
cgcgcgtcaggcctattacctttgc

SEQ ID NO: 523908 - DNA, 25 bp, Rattus norvegicus
tacctttgcgagtttcaccatgatg

SEQ ID NO: 523909 - DNA, 25 bp, Rattus norvegicus
cggaacccacgcgaagacgactgga

SEQ ID NO: 523910 - DNA, 25 bp, Rattus norvegicus
actctggagcacgtacaaccgcctg

SEQ ID NO: 523911 - DNA, 25 bp, Rattus norvegicus
tgagcttgcccagtaatcgcctctg

SEQ ID NO: 523912 - DNA, 25 bp, Rattus norvegicus
ttcccttgcgtagcggaaacctgcg

SEQ ID NO: 523913 - DNA, 25 bp, Rattus norvegicus
tctgggcatttctcggggatttccc

SEQ ID NO: 523914 - DNA, 25 bp, Rattus norvegicus
acgccgcatggacgtctgtgcttag

SEQ ID NO: 523915 - DNA, 25 bp, Rattus norvegicus
agccgcttaaggttggcccacttca

SEQ ID NO: 523916 - DNA, 25 bp, Rattus norvegicus
gattccctcaggtatccgtacgccg

SEQ ID NO: 523917 - DNA, 25 bp, Rattus norvegicus
ccgggtgacgtcagtccattgagtt

SEQ ID NO: 523918 - DNA, 25 bp, Rattus norvegicus
tgacaaccgtgacctcaacaccggg

SEQ ID NO: 523919 - DNA, 25 bp, Rattus norvegicus
aaggagagtccgtgccagttgctac

SEQ ID NO: 523920 - DNA, 25 bp, Rattus norvegicus
tggcgcagccgaggaagcgctctct

SEQ ID NO: 523921 - DNA, 25 bp, Rattus norvegicus
ttgctacgcgacgaccgggtgacgt

SEQ ID NO: 523922 - DNA, 25 bp, Rattus norvegicus
cgtcagtccattgagtttagttccc

SEQ ID NO: 523923 - DNA, 25 bp, Rattus norvegicus
cccaggcaactggtcggacagctgc

SEQ ID NO: 523924 - DNA, 25 bp, Rattus norvegicus
aactatttgtgtctgtccctagagg

SEQ ID NO: 523925 - DNA, 25 bp, Rattus norvegicus
ggcggccgcgacacagaggcccttt

SEQ ID NO: 523926 - DNA, 25 bp, Rattus norvegicus
cagctgcgccgggaactatttgtgt

SEQ ID NO: 523927 - DNA, 25 bp, Rattus norvegicus
tccgtgccagttgctacgcgacgac

SEQ ID NO: 523928 - DNA, 25 bp, Rattus norvegicus
gacacagaggccctttcaggctgtg

SEQ ID NO: 523929 - DNA, 25 bp, Rattus norvegicus
gtctccttgacaaccgtgacctcaa

SEQ ID NO: 523930 - DNA, 25 bp, Rattus norvegicus
atttgtgtctgtccctagaggggcg

SEQ ID NO: 523931 - DNA, 25 bp, Rattus norvegicus
agttgcagcggcgtcgcctactcgc

SEQ ID NO: 523932 - DNA, 25 bp, Rattus norvegicus
ctcgacggccgggacagagacccaa

SEQ ID NO: 523933 - DNA, 25 bp, Rattus norvegicus
acagagacccaaggacccggctgga

SEQ ID NO: 523934 - DNA, 25 bp, Rattus norvegicus
ggaagaggatgacacccgccgctcc

SEQ ID NO: 523935 - DNA, 25 bp, Rattus norvegicus
tgagtcactagagctgagggcccac

SEQ ID NO: 523936 - DNA, 25 bp, Rattus norvegicus
gcttctcacactggccgacgcggga

SEQ ID NO: 523937 - DNA, 25 bp, Rattus norvegicus
cgggctcgagttccgaggacttctt

SEQ ID NO: 523938 - DNA, 25 bp, Rattus norvegicus
ggctcctcacgaaccaaaacacaaa

SEQ ID NO: 523939 - DNA, 25 bp, Rattus norvegicus
actctgggtccagcgaaggaactgc

SEQ ID NO: 523940 - DNA, 25 bp, Rattus norvegicus
gaaggaactgcttccgccggctccg

SEQ ID NO: 523941 - DNA, 25 bp, Rattus norvegicus
ccacgtagccgcacgcagcaaagga

SEQ ID NO: 523942 - DNA, 25 bp, Rattus norvegicus
cagtggcttcctaaggggcggtcct

SEQ ID NO: 523943 - DNA, 25 bp, Rattus norvegicus
aagctgctggaaggatgagtcacta

SEQ ID NO: 523944 - DNA, 25 bp, Rattus norvegicus
caaaggacgtcgtgaggtcatttcc

SEQ ID NO: 523945 - DNA, 25 bp, Rattus norvegicus
cgtgcctcctcggatgacaagatca

SEQ ID NO: 523946 - DNA, 25 bp, Rattus norvegicus
ggcgggccttctcgctcacttatta

SEQ ID NO: 523947 - DNA, 25 bp, Rattus norvegicus
cgaccaagctttccagctcgatgga

SEQ ID NO: 523948 - DNA, 25 bp, Rattus norvegicus
gactgggctagccacactgtcagca

SEQ ID NO: 523949 - DNA, 25 bp, Rattus norvegicus
ccatgagcctccagggtgagctatc

SEQ ID NO: 523950 - DNA, 25 bp, Rattus norvegicus
aggacactttcttgggagcacatca

SEQ ID NO: 523951 - DNA, 25 bp, Rattus norvegicus
atcccattggtactgcacgctcttc

SEQ ID NO: 523952 - DNA, 25 bp, Rattus norvegicus
tctccaggaagcattgcgctatttg

SEQ ID NO: 523953 - DNA, 25 bp, Rattus norvegicus
gaaggctatttcttcggccagcgcc

SEQ ID NO: 523954 - DNA, 25 bp, Rattus norvegicus
tgcgcttccctctgcagtggcaatc

SEQ ID NO: 523955 - DNA, 25 bp, Rattus norvegicus
ggcccgcctcttgcacagagatttg

SEQ ID NO: 523956 - DNA, 25 bp, Rattus norvegicus
ggccagcgccttccagatctctgga

SEQ ID NO: 523957 - DNA, 25 bp, Rattus norvegicus
caatcccgagtgaggcgtccaaaca

SEQ ID NO: 523958 - DNA, 25 bp, Rattus norvegicus
tcaggcacgcgggacaatcccattg

SEQ ID NO: 523959 - DNA, 25 bp, Rattus norvegicus
gccttcccttgttcgcggtgactct

SEQ ID NO: 523960 - DNA, 25 bp, Rattus norvegicus
agagccattaagctcggcgaccgca

SEQ ID NO: 523961 - DNA, 25 bp, Rattus norvegicus
ccggaaggctgcaaggactcacaga

SEQ ID NO: 523962 - DNA, 25 bp, Rattus norvegicus
tgagtacaaattggcggtcaccctg

SEQ ID NO: 523963 - DNA, 25 bp, Rattus norvegicus
gtttctggcctcagtcccatgattg

SEQ ID NO: 523964 - DNA, 25 bp, Rattus norvegicus
ttacgcgcagctctgtgacccattc

SEQ ID NO: 523965 - DNA, 25 bp, Rattus norvegicus
cgcgctccagcttagagtcccagga

SEQ ID NO: 523966 - DNA, 25 bp, Rattus norvegicus
tgactctggggactagtgacccgtc

SEQ ID NO: 523967 - DNA, 25 bp, Rattus norvegicus
taccagcctggtacacgatcgtgag

SEQ ID NO: 523968 - DNA, 25 bp, Rattus norvegicus
gcccacgtgcgtgtaagtgatcatg

SEQ ID NO: 523969 - DNA, 25 bp, Rattus norvegicus
ggcgccctaacgagcctctatttca

SEQ ID NO: 523970 - DNA, 25 bp, Rattus norvegicus
atctctgaggttcctgtgtctagcc

SEQ ID NO: 523971 - DNA, 25 bp, Rattus norvegicus
cccagagccggcatctctaaaattg

SEQ ID NO: 523972 - DNA, 25 bp, Rattus norvegicus
gagacgagctctctgattacgcgca

SEQ ID NO: 523973 - DNA, 25 bp, Rattus norvegicus
agaaagtgggcgatcgtgcaccctc

SEQ ID NO: 523974 - DNA, 25 bp, Rattus norvegicus
gggaaacgctctctgtcggccatta

SEQ ID NO: 523975 - DNA, 25 bp, Rattus norvegicus
accctccggcatgggtttgctagtc

SEQ ID NO: 523976 - DNA, 25 bp, Rattus norvegicus
ccatggcgcccaagtacgggagaaa

SEQ ID NO: 523977 - DNA, 25 bp, Rattus norvegicus
tgatacaacaaaggccgaagtgtgc

SEQ ID NO: 523978 - DNA, 25 bp, Rattus norvegicus
tggacgcccggaagctgatacaaca

SEQ ID NO: 523979 - DNA, 25 bp, Rattus norvegicus
cgccatttcgtgttcggtcgccttt

SEQ ID NO: 523980 - DNA, 25 bp, Rattus norvegicus
cgctctttccctatagccctttgtg

SEQ ID NO: 523981 - DNA, 25 bp, Rattus norvegicus
gtcgctcatgacctgaagccattcc

SEQ ID NO: 523982 - DNA, 25 bp, Rattus norvegicus
gaaaatccgctccaggtcgctcatg

SEQ ID NO: 523983 - DNA, 25 bp, Rattus norvegicus
atgcatcccgcgaggtctttggaac

SEQ ID NO: 523984 - DNA, 25 bp, Rattus norvegicus
gaggatcctcatccttccaacgtga

SEQ ID NO: 523985 - DNA, 25 bp, Rattus norvegicus
cggccattaaaacgcgagggaagat

SEQ ID NO: 523986 - DNA, 25 bp, Rattus norvegicus
agccattccacagatctcggtcgcg

SEQ ID NO: 523987 - DNA, 25 bp, Rattus norvegicus
ggccttttggtctcgccgcctgttg

SEQ ID NO: 523988 - DNA, 25 bp, Rattus norvegicus
gggctcgtgccaatgtctcaaccaa

SEQ ID NO: 523989 - DNA, 25 bp, Rattus norvegicus
ctaggggctcagatttcggccttga

SEQ ID NO: 523990 - DNA, 25 bp, Rattus norvegicus
cccaggcacagcagggatgcaaacc

SEQ ID NO: 523991 - DNA, 25 bp, Rattus norvegicus
gtgtctgggactcgctacaggagtc

SEQ ID NO: 523992 - DNA, 25 bp, Rattus norvegicus
tgacactagattggccgtcgagctt

SEQ ID NO: 523993 - DNA, 25 bp, Rattus norvegicus
acgcgtgcaccctgacactagattg

SEQ ID NO: 523994 - DNA, 25 bp, Rattus norvegicus
gacccggtttctttccacgcgtgca

SEQ ID NO: 523995 - DNA, 25 bp, Rattus norvegicus
ttttgggaggcggtctttagattga

SEQ ID NO: 523996 - DNA, 25 bp, Rattus norvegicus
gggtctccggccttatgacttccgc

SEQ ID NO: 523997 - DNA, 25 bp, Rattus norvegicus
ccgcctgttggtgtccttgcacaca

SEQ ID NO: 523998 - DNA, 25 bp, Rattus norvegicus
ggaccaagccttgtgcggcgtagct

SEQ ID NO: 523999 - DNA, 25 bp, Rattus norvegicus
gtgtccttgcacacagtctcaactg

SEQ ID NO: 524000 - DNA, 25 bp, Rattus norvegicus
aatgtctcaaccaatcctgtctcgg

SEQ ID NO: 524001 - DNA, 25 bp, Rattus norvegicus
tggctgctccgaaaagccatctttg

SEQ ID NO: 524002 - DNA, 25 bp, Rattus norvegicus
ttgagccaatgagaaaacgcccgct

SEQ ID NO: 524003 - DNA, 25 bp, Rattus norvegicus
cttgcccattgttcggaattgagcc

SEQ ID NO: 524004 - DNA, 25 bp, Rattus norvegicus
ggcactgccgctttaagctcacttg

SEQ ID NO: 524005 - DNA, 25 bp, Rattus norvegicus
tcggaatggcgagacccaacatatt

SEQ ID NO: 524006 - DNA, 25 bp, Rattus norvegicus
gagcaccgcccactaatctatatta

SEQ ID NO: 524007 - DNA, 25 bp, Rattus norvegicus
atctttgcattgttcccgggtcgtg

SEQ ID NO: 524008 - DNA, 25 bp, Rattus norvegicus
ggactccggcagctttctcgccaga

SEQ ID NO: 524009 - DNA, 25 bp, Rattus norvegicus
cgccagagtcctcgaaactcgacta

SEQ ID NO: 524010 - DNA, 25 bp, Rattus norvegicus
caccatgtcagacgcggcagtggac

SEQ ID NO: 524011 - DNA, 25 bp, Rattus norvegicus
cagctccgagatcaccaccaaggtg

SEQ ID NO: 524012 - DNA, 25 bp, Rattus norvegicus
tggggaaagcatcacgcgaacgcta

SEQ ID NO: 524013 - DNA, 25 bp, Rattus norvegicus
tgggagggccgaatcgcaaattctc

SEQ ID NO: 524014 - DNA, 25 bp, Rattus norvegicus
ccgcgctttggctttctgcgtcaga

SEQ ID NO: 524015 - DNA, 25 bp, Rattus norvegicus
cccaggaaccgaggacagtcgcagc

SEQ ID NO: 524016 - DNA, 25 bp, Rattus norvegicus
ctagtcgtagagctcccgccctgaa

SEQ ID NO: 524017 - DNA, 25 bp, Rattus norvegicus
tgctcccgggcggatacagtttgaa

SEQ ID NO: 524018 - DNA, 25 bp, Rattus norvegicus
tgaaaccaatggcaagccagccttg

SEQ ID NO: 524019 - DNA, 25 bp, Rattus norvegicus
ccagccttggcgattggcatctcaa

SEQ ID NO: 524020 - DNA, 25 bp, Rattus norvegicus
cggccggacacctcaggtgagcagc

SEQ ID NO: 524021 - DNA, 25 bp, Rattus norvegicus
gcatctcaaatagccaatagcaacg

SEQ ID NO: 524022 - DNA, 25 bp, Rattus norvegicus
tagcaacgctcagcggcttcgctcg

SEQ ID NO: 524023 - DNA, 25 bp, Rattus norvegicus
ctcgcagacggtacccaggaaccga

SEQ ID NO: 524024 - DNA, 25 bp, Rattus norvegicus
ctctgcggggcctcgcagacggtac

SEQ ID NO: 524025 - DNA, 25 bp, Rattus norvegicus
tccttggctgacatgatgcggcgcc

SEQ ID NO: 524026 - DNA, 25 bp, Rattus norvegicus
ccgctcgtccttggctgacatgatg

SEQ ID NO: 524027 - DNA, 25 bp, Rattus norvegicus
tgaagcctctcaggatatccctggc

SEQ ID NO: 524028 - DNA, 25 bp, Rattus norvegicus
cggatacagtttgaagcctctcagg

SEQ ID NO: 524029 - DNA, 25 bp, Rattus norvegicus
gaagcttgacaacctgcaggcaggc

SEQ ID NO: 524030 - DNA, 25 bp, Rattus norvegicus
taagaaagcagatggccacgccgcc

SEQ ID NO: 524031 - DNA, 25 bp, Rattus norvegicus
ttccggcaagcgttcctaagaaagc

SEQ ID NO: 524032 - DNA, 25 bp, Rattus norvegicus
gcgttcctaagaaagcagatggcca

SEQ ID NO: 524033 - DNA, 25 bp, Rattus norvegicus
ctggtcttagctggacttccagctt

SEQ ID NO: 524034 - DNA, 25 bp, Rattus norvegicus
cgcgctggtcttagctggacttcca

SEQ ID NO: 524035 - DNA, 25 bp, Rattus norvegicus
catcggcgaagagaacagagtcggc

SEQ ID NO: 524036 - DNA, 25 bp, Rattus norvegicus
tgacaacctgcaggcaggctctggg

SEQ ID NO: 524037 - DNA, 25 bp, Rattus norvegicus
cgatcatggaagcttgacaacctgc

SEQ ID NO: 524038 - DNA, 25 bp, Rattus norvegicus
ccggtccgatcatggaagcttgaca

SEQ ID NO: 524039 - DNA, 25 bp, Rattus norvegicus
gccggacgccggtccgatcatggaa

SEQ ID NO: 524040 - DNA, 25 bp, Rattus norvegicus
cggagacagaaaagtgccggacgcc

SEQ ID NO: 524041 - DNA, 25 bp, Rattus norvegicus
aggccgagacatcggcgaagagaac

SEQ ID NO: 524042 - DNA, 25 bp, Rattus norvegicus
gcttcgttccggcaagcgttcctaa

SEQ ID NO: 524043 - DNA, 25 bp, Rattus norvegicus
tgcccggactctccaaatttcaaat

SEQ ID NO: 524044 - DNA, 25 bp, Rattus norvegicus
aatttcaaatttcaggccttctcca

SEQ ID NO: 524045 - DNA, 25 bp, Rattus norvegicus
tcaggccttctccaacacttttaaa

SEQ ID NO: 524046 - DNA, 25 bp, Rattus norvegicus
ccaacacttttaaacactgtagagg

SEQ ID NO: 524047 - DNA, 25 bp, Rattus norvegicus
tgctaatacttttgcccggactctc

SEQ ID NO: 524048 - DNA, 25 bp, Rattus norvegicus
tctccgaagcaagccggagtccctg

SEQ ID NO: 524049 - DNA, 25 bp, Rattus norvegicus
ggagtccctggcagacgctgccagc

SEQ ID NO: 524050 - DNA, 25 bp, Rattus norvegicus
ctcctgcagcgcgacgttcatggtg

SEQ ID NO: 524051 - DNA, 25 bp, Rattus norvegicus
aactacggcccaggccaactgctga

SEQ ID NO: 524052 - DNA, 25 bp, Rattus norvegicus
gcccagaccgcgttccgcacaaacg

SEQ ID NO: 524053 - DNA, 25 bp, Rattus norvegicus
acgctgctctccatcaagcctgaga

SEQ ID NO: 524054 - DNA, 25 bp, Rattus norvegicus
cctcaggcaagccaccggtaatttg

SEQ ID NO: 524055 - DNA, 25 bp, Rattus norvegicus
ttatttggttgaggcccgatcattg

SEQ ID NO: 524056 - DNA, 25 bp, Rattus norvegicus
ggcccgatcattgctaatacttttg

SEQ ID NO: 524057 - DNA, 25 bp, Rattus norvegicus
cgacaagcggttgcagagcaggatt

SEQ ID NO: 524058 - DNA, 25 bp, Rattus norvegicus
cgcctggagtcttgtcacccttttt

SEQ ID NO: 524059 - DNA, 25 bp, Rattus norvegicus
tccaacctgccgctgatgtcatctt

SEQ ID NO: 524060 - DNA, 25 bp, Rattus norvegicus
tcgcgatcggtctcccttgagattg

SEQ ID NO: 524061 - DNA, 25 bp, Rattus norvegicus
attgccaagcgagcacgggtcctac

SEQ ID NO: 524062 - DNA, 25 bp, Rattus norvegicus
cgaaccctagaagtccctgctttga

SEQ ID NO: 524063 - DNA, 25 bp, Rattus norvegicus
tgtgtcgacattctcccgaggctgg

SEQ ID NO: 524064 - DNA, 25 bp, Rattus norvegicus
cacgggagatgtgcatgtgtcgaca

SEQ ID NO: 524065 - DNA, 25 bp, Rattus norvegicus
gccactggtcctgctgggtacatta

SEQ ID NO: 524066 - DNA, 25 bp, Rattus norvegicus
caccgatgtagtgcggatgactttt

SEQ ID NO: 524067 - DNA, 25 bp, Rattus norvegicus
ctcgggacctgtcggagaaaagagt

SEQ ID NO: 524068 - DNA, 25 bp, Rattus norvegicus
ttctgattgccaccagctgcctggg

SEQ ID NO: 524069 - DNA, 25 bp, Rattus norvegicus
cccgggacttggtgtccacacgcag

SEQ ID NO: 524070 - DNA, 25 bp, Rattus norvegicus
tggctgggctggagcctttataatc

SEQ ID NO: 524071 - DNA, 25 bp, Rattus norvegicus
ggaagacgccgcttcccgaggcatg

SEQ ID NO: 524072 - DNA, 25 bp, Rattus norvegicus
tctccctagcaactgcgggtctgcg

SEQ ID NO: 524073 - DNA, 25 bp, Rattus norvegicus
actcaatcccttggtcctgcagcga

SEQ ID NO: 524074 - DNA, 25 bp, Rattus norvegicus
catgcgggatgagccttgcaccgcc

SEQ ID NO: 524075 - DNA, 25 bp, Rattus norvegicus
ccgcccatgcgggatgagccttgca

SEQ ID NO: 524076 - DNA, 25 bp, Rattus norvegicus
aacgctcgctcgtgacccggaagcg

SEQ ID NO: 524077 - DNA, 25 bp, Rattus norvegicus
ggaagcgcattctccctagcaactg

SEQ ID NO: 524078 - DNA, 25 bp, Rattus norvegicus
gaccgtgcgtcctcgcttcactggg

SEQ ID NO: 524079 - DNA, 25 bp, Rattus norvegicus
gccctttctttttgtagtgcaattc

SEQ ID NO: 524080 - DNA, 25 bp, Rattus norvegicus
ggtcctgcagcgaccaacaccttca

SEQ ID NO: 524081 - DNA, 25 bp, Rattus norvegicus
gccggtgtctaggaagacgccgctt

SEQ ID NO: 524082 - DNA, 25 bp, Rattus norvegicus
cttcccgaggcatgggtcacctggg

SEQ ID NO: 524083 - DNA, 25 bp, Rattus norvegicus
tcttgatggaggctgaccggcttgc

SEQ ID NO: 524084 - DNA, 25 bp, Rattus norvegicus
tgtagtgcaattcagtgagagagga

SEQ ID NO: 524085 - DNA, 25 bp, Rattus norvegicus
tggggcatcactgacaacctgtttc

SEQ ID NO: 524086 - DNA, 25 bp, Rattus norvegicus
tcaccacagagtagggatgcccgga

SEQ ID NO: 524087 - DNA, 25 bp, Rattus norvegicus
tactggaatcgtagcccttaacctg

SEQ ID NO: 524088 - DNA, 25 bp, Rattus norvegicus
ccaccttaggaagaagggctcagtt

SEQ ID NO: 524089 - DNA, 25 bp, Rattus norvegicus
ccattgtgccgaggctttggctgca

SEQ ID NO: 524090 - DNA, 25 bp, Rattus norvegicus
tggaggccacctgggatccacaacc

SEQ ID NO: 524091 - DNA, 25 bp, Rattus norvegicus
tcgcagctgtaggaagggaacatta

SEQ ID NO: 524092 - DNA, 25 bp, Rattus norvegicus
agagcgaccaggcacccaaactttg

SEQ ID NO: 524093 - DNA, 25 bp, Rattus norvegicus
cgctgtcatggaatacggggcctcc

SEQ ID NO: 524094 - DNA, 25 bp, Rattus norvegicus
ctggaactcatcatagtgcgctgtc

SEQ ID NO: 524095 - DNA, 25 bp, Rattus norvegicus
atccgctccagccaaaccaggtggg

SEQ ID NO: 524096 - DNA, 25 bp, Rattus norvegicus
gtgccacaccggctcacgtacttga

SEQ ID NO: 524097 - DNA, 25 bp, Rattus norvegicus
gcccaggtatttgagcgccagcatg

SEQ ID NO: 524098 - DNA, 25 bp, Rattus norvegicus
cccgcacgcgaacgagtagaagtcc

SEQ ID NO: 524099 - DNA, 25 bp, Rattus norvegicus
gggtgcttcatctccacctaatggc

SEQ ID NO: 524100 - DNA, 25 bp, Rattus norvegicus
tccacctaatggcaggcgacgcaga

SEQ ID NO: 524101 - DNA, 25 bp, Rattus norvegicus
cgcccgtgacgtcagcctgtgggct

SEQ ID NO: 524102 - DNA, 25 bp, Rattus norvegicus
tcagcctgtgggctgtgacgtcatt

SEQ ID NO: 524103 - DNA, 25 bp, Rattus norvegicus
cgcagggtgcttcatctccacctaa

SEQ ID NO: 524104 - DNA, 25 bp, Rattus norvegicus
cctgtgggctgtgacgtcattgccc

SEQ ID NO: 524105 - DNA, 25 bp, Rattus norvegicus
gttaattgaatcaggcggccggagc

SEQ ID NO: 524106 - DNA, 25 bp, Rattus norvegicus
aattagttaattgaatcaggcggcc

SEQ ID NO: 524107 - DNA, 25 bp, Rattus norvegicus
catctgtcttgtcgggaattagtta

SEQ ID NO: 524108 - DNA, 25 bp, Rattus norvegicus
tgcacatctgtcttgtcgggaatta

SEQ ID NO: 524109 - DNA, 25 bp, Rattus norvegicus
ggcgacgcagaattgcacatctgtc

SEQ ID NO: 524110 - DNA, 25 bp, Rattus norvegicus
ggcaggcgacgcagaattgcacatc

SEQ ID NO: 524111 - DNA, 25 bp, Rattus norvegicus
ggccttctaggtcgctgcgggacac

SEQ ID NO: 524112 - DNA, 25 bp, Rattus norvegicus
ttctaggtcgctgcgggacactgag

SEQ ID NO: 524113 - DNA, 25 bp, Rattus norvegicus
agcagccgcctcttgacctcgcgcc

SEQ ID NO: 524114 - DNA, 25 bp, Rattus norvegicus
ctgtccctgaggagtacgctgcggc

SEQ ID NO: 524115 - DNA, 25 bp, Rattus norvegicus
ccgcgggagctcttctcaaaccaga

SEQ ID NO: 524116 - DNA, 25 bp, Rattus norvegicus
cgcgctggccagctcctccagcagc

SEQ ID NO: 524117 - DNA, 25 bp, Rattus norvegicus
cacggccgcgggagctcttctcaaa

SEQ ID NO: 524118 - DNA, 25 bp, Rattus norvegicus
atctgcggctgtccctgaggagtac

SEQ ID NO: 524119 - DNA, 25 bp, Rattus norvegicus
agccgtgagcatctgcggctgtccc

SEQ ID NO: 524120 - DNA, 25 bp, Rattus norvegicus
taccacagagccgtgagcatctgcg

SEQ ID NO: 524121 - DNA, 25 bp, Rattus norvegicus
cgccggtaccacagagccgtgagca

SEQ ID NO: 524122 - DNA, 25 bp, Rattus norvegicus
tcttggccagcaagcgctggcgccg

SEQ ID NO: 524123 - DNA, 25 bp, Rattus norvegicus
agagccgcagcgtcttggccagcaa

SEQ ID NO: 524124 - DNA, 25 bp, Rattus norvegicus
tcttctcaaaccagagccgcagcgt

SEQ ID NO: 524125 - DNA, 25 bp, Rattus norvegicus
acgtcctcgcctgcagctgtggacc

SEQ ID NO: 524126 - DNA, 25 bp, Rattus norvegicus
aacacccggggccaccgccagctga

SEQ ID NO: 524127 - DNA, 25 bp, Rattus norvegicus
atagtcggtggcagcacggctccat

SEQ ID NO: 524128 - DNA, 25 bp, Rattus norvegicus
aagcgttgccaacacgacccgggct

SEQ ID NO: 524129 - DNA, 25 bp, Rattus norvegicus
gtttccttcatgacgccgtttctgc

SEQ ID NO: 524130 - DNA, 25 bp, Rattus norvegicus
gacgccgtttctgcctaggtccatg

SEQ ID NO: 524131 - DNA, 25 bp, Rattus norvegicus
ccgtttctgcctaggtccatgtgga

SEQ ID NO: 524132 - DNA, 25 bp, Rattus norvegicus
ctggccttggctagtgaggctgcaa

SEQ ID NO: 524133 - DNA, 25 bp, Rattus norvegicus
agacgccaaagcgttgccaacacga

SEQ ID NO: 524134 - DNA, 25 bp, Rattus norvegicus
gctcacggccgcatagtcggtggca

SEQ ID NO: 524135 - DNA, 25 bp, Rattus norvegicus
cacggctccattgggagcctggcct

SEQ ID NO: 524136 - DNA, 25 bp, Rattus norvegicus
cagcgtcctgggtgctcacggctgc

SEQ ID NO: 524137 - DNA, 25 bp, Rattus norvegicus
ggtgctcacggctgcacactgcttc

SEQ ID NO: 524138 - DNA, 25 bp, Rattus norvegicus
tgcacactgcttcgccgggtacgac

SEQ ID NO: 524139 - DNA, 25 bp, Rattus norvegicus
cttggctagtgaggctgcaacttgg

SEQ ID NO: 524140 - DNA, 25 bp, Rattus norvegicus
tccatgtggagaaagacgccaaagc

SEQ ID NO: 524141 - DNA, 25 bp, Rattus norvegicus
tgtgcgcgcctagcgctccaacagt

SEQ ID NO: 524142 - DNA, 25 bp, Rattus norvegicus
caggagcttggttccagaagccaaa

SEQ ID NO: 524143 - DNA, 25 bp, Rattus norvegicus
taactccgtggtctcctccaggatc

SEQ ID NO: 524144 - DNA, 25 bp, Rattus norvegicus
ccgaggcgtaaccactaactccgtg

SEQ ID NO: 524145 - DNA, 25 bp, Rattus norvegicus
tgccttctatgagcgccagtgccta

SEQ ID NO: 524146 - DNA, 25 bp, Rattus norvegicus
agtcatgtacactctccgaggcgta

SEQ ID NO: 524147 - DNA, 25 bp, Rattus norvegicus
cccagagtctcggagtcatgtacac

SEQ ID NO: 524148 - DNA, 25 bp, Rattus norvegicus
cgcgaacagcggttatactcaggta

SEQ ID NO: 524149 - DNA, 25 bp, Rattus norvegicus
ctccaggagctaccgggtcacaatg

SEQ ID NO: 524150 - DNA, 25 bp, Rattus norvegicus
ccggatcggtggctaacacctctga

SEQ ID NO: 524151 - DNA, 25 bp, Rattus norvegicus
ccaggatcccgagttgcaggagctt

SEQ ID NO: 524152 - DNA, 25 bp, Rattus norvegicus
cgcgagcctagctgcagagaacttc

SEQ ID NO: 524153 - DNA, 25 bp, Rattus norvegicus
ttctaaattggaacgctcgggaaga

SEQ ID NO: 524154 - DNA, 25 bp, Rattus norvegicus
ctccaacagtgtgtgcagcgccggc

SEQ ID NO: 524155 - DNA, 25 bp, Rattus norvegicus
atgtgagtcgttccggggcagaaaa

SEQ ID NO: 524156 - DNA, 25 bp, Rattus norvegicus
tgtccacaccgggtgcgcggtcatg

SEQ ID NO: 524157 - DNA, 25 bp, Rattus norvegicus
caggttggttttggtcctgtccaca

SEQ ID NO: 524158 - DNA, 25 bp, Rattus norvegicus
ttaaagcccttggtcaagactgcgg

SEQ ID NO: 524159 - DNA, 25 bp, Rattus norvegicus
tccggggcagaaaatgtaaagtaca

SEQ ID NO: 524160 - DNA, 25 bp, Rattus norvegicus
gcctcgccttcgatgtgagtcgttc

SEQ ID NO: 524161 - DNA, 25 bp, Rattus norvegicus
tgtggcgcagaaggcctcgccttcg

SEQ ID NO: 524162 - DNA, 25 bp, Rattus norvegicus
tcaggtcaggaactgtggcgcagaa

SEQ ID NO: 524163 - DNA, 25 bp, Rattus norvegicus
cgcagtctctcttcaggtcaggaac

SEQ ID NO: 524164 - DNA, 25 bp, Rattus norvegicus
tgctctccgcagtctctcttcaggt

SEQ ID NO: 524165 - DNA, 25 bp, Rattus norvegicus
ggaacagatcgctcagcagctgctc

SEQ ID NO: 524166 - DNA, 25 bp, Rattus norvegicus
tattagctgcgggaacagatcgctc

SEQ ID NO: 524167 - DNA, 25 bp, Rattus norvegicus
ggcctgcgggaagcttattagctgc

SEQ ID NO: 524168 - DNA, 25 bp, Rattus norvegicus
gtacagctggtgctctttaaagccc

SEQ ID NO: 524169 - DNA, 25 bp, Rattus norvegicus
agcgactccaccgagcgtcacaaag

SEQ ID NO: 524170 - DNA, 25 bp, Rattus norvegicus
ccctacacagagttcccggagttca

SEQ ID NO: 524171 - DNA, 25 bp, Rattus norvegicus
agtcgccgcctcctgaaggatctgg

SEQ ID NO: 524172 - DNA, 25 bp, Rattus norvegicus
atgttcaaaacgtgagggctcctcc

SEQ ID NO: 524173 - DNA, 25 bp, Rattus norvegicus
tcaggggtgcactgaacatctggcc

SEQ ID NO: 524174 - DNA, 25 bp, Rattus norvegicus
gcagccagatcgtgcgcaccaagtt

SEQ ID NO: 524175 - DNA, 25 bp, Rattus norvegicus
caccaagttcattgcgcgcgatgga

SEQ ID NO: 524176 - DNA, 25 bp, Rattus norvegicus
tcctctgtccagcagaaggtccggc

SEQ ID NO: 524177 - DNA, 25 bp, Rattus norvegicus
caggctgaacatccaccagggcgca

SEQ ID NO: 524178 - DNA, 25 bp, Rattus norvegicus
gcgcggactccgagctgaacctcaa

SEQ ID NO: 524179 - DNA, 25 bp, Rattus norvegicus
ttgagacgcgggcagaaacccacca

SEQ ID NO: 524180 - DNA, 25 bp, Rattus norvegicus
gtcacaaagccacgagcccgcaagg

SEQ ID NO: 524181 - DNA, 25 bp, Rattus norvegicus
cggccaccatgtccagcgaggagct

SEQ ID NO: 524182 - DNA, 25 bp, Rattus norvegicus
caggacgcacgaataccctcaagtc

SEQ ID NO: 524183 - DNA, 25 bp, Rattus norvegicus
tgcgtggcgacgtgtcggccatctt

SEQ ID NO: 524184 - DNA, 25 bp, Rattus norvegicus
ggccatcttgtgttgttgaggctga

SEQ ID NO: 524185 - DNA, 25 bp, Rattus norvegicus
agcctcggggtcctccggctaacag

SEQ ID NO: 524186 - DNA, 25 bp, Rattus norvegicus
tgagagactcctgtcccggaccgca

SEQ ID NO: 524187 - DNA, 25 bp, Rattus norvegicus
tgtcccggaccgcaggtaaccagtg

SEQ ID NO: 524188 - DNA, 25 bp, Rattus norvegicus
gtaaccagtggctcggtgtgtctcc

SEQ ID NO: 524189 - DNA, 25 bp, Rattus norvegicus
gagccggccgcatggacacactcag

SEQ ID NO: 524190 - DNA, 25 bp, Rattus norvegicus
atggacacactcaggctgcccggca

SEQ ID NO: 524191 - DNA, 25 bp, Rattus norvegicus
tgtcaggccggagggctcgccttcc

SEQ ID NO: 524192 - DNA, 25 bp, Rattus norvegicus
gattgacttgggttctgagagactc

SEQ ID NO: 524193 - DNA, 25 bp, Rattus norvegicus
gggaggtgcgcccttgccgtctcca

SEQ ID NO: 524194 - DNA, 25 bp, Rattus norvegicus
cctgcatccgggtctcagaaagggg

SEQ ID NO: 524195 - DNA, 25 bp, Rattus norvegicus
ctgctgcgagccgacagctgctctt

SEQ ID NO: 524196 - DNA, 25 bp, Rattus norvegicus
gtcctccggctaacagctgctgcga

SEQ ID NO: 524197 - DNA, 25 bp, Rattus norvegicus
ttggccaactgacggagacctacgc

SEQ ID NO: 524198 - DNA, 25 bp, Rattus norvegicus
cgccgcggttgcagtgtttaagatc

SEQ ID NO: 524199 - DNA, 25 bp, Rattus norvegicus
ctttccctgaaaggccgcgacgcag

SEQ ID NO: 524200 - DNA, 25 bp, Rattus norvegicus
ggacagaccctgtggtacacaaata

SEQ ID NO: 524201 - DNA, 25 bp, Rattus norvegicus
cacagaggtaggctgacagatgctc

SEQ ID NO: 524202 - DNA, 25 bp, Rattus norvegicus
tcagacagtcgtatacaaattggcc

SEQ ID NO: 524203 - DNA, 25 bp, Rattus norvegicus
cgtaactaggatacaggagcgcgcc

SEQ ID NO: 524204 - DNA, 25 bp, Rattus norvegicus
gcctttcagagtccagggccgtgtc

SEQ ID NO: 524205 - DNA, 25 bp, Rattus norvegicus
ttttgcgctcagctcccagttgctc

SEQ ID NO: 524206 - DNA, 25 bp, Rattus norvegicus
agttgctctctcctaaccgcagcgt

SEQ ID NO: 524207 - DNA, 25 bp, Rattus norvegicus
cgcagtcccggatgctgtatgactt

SEQ ID NO: 524208 - DNA, 25 bp, Rattus norvegicus
cgccaacagcggtcctacggtttgt

SEQ ID NO: 524209 - DNA, 25 bp, Rattus norvegicus
tgtatgacttcatccttccgccggc

SEQ ID NO: 524210 - DNA, 25 bp, Rattus norvegicus
ctctttgagtctggattttggcgcc

SEQ ID NO: 524211 - DNA, 25 bp, Rattus norvegicus
tccgagctaatcagggcgccagagc

SEQ ID NO: 524212 - DNA, 25 bp, Rattus norvegicus
ggtagtgggtggaaaactccagaca

SEQ ID NO: 524213 - DNA, 25 bp, Rattus norvegicus
ctgtgctccgctgcagtgcgtcaga

SEQ ID NO: 524214 - DNA, 25 bp, Rattus norvegicus
tctgctaggcaccactcgctgtgct

SEQ ID NO: 524215 - DNA, 25 bp, Rattus norvegicus
agcgcaggtgtctgctaggcaccac

SEQ ID NO: 524216 - DNA, 25 bp, Rattus norvegicus
gccacgtgcatgtgttgtgctccga

SEQ ID NO: 524217 - DNA, 25 bp, Rattus norvegicus
acatgtgtatgcgtggccacgtgca

SEQ ID NO: 524218 - DNA, 25 bp, Rattus norvegicus
ctccagacagggcaacatgtgtatg

SEQ ID NO: 524219 - DNA, 25 bp, Rattus norvegicus
ggaagttttctgcttcttgaagcca

SEQ ID NO: 524220 - DNA, 25 bp, Rattus norvegicus
tgactctgcaccttgtgctcttctt

SEQ ID NO: 524221 - DNA, 25 bp, Rattus norvegicus
ttgaagccaataaaagagccgcgca

SEQ ID NO: 524222 - DNA, 25 bp, Rattus norvegicus
tggtcgtcgcgctaaggaagttttc

SEQ ID NO: 524223 - DNA, 25 bp, Rattus norvegicus
ccacctgcgtggtgctggcactcgt

SEQ ID NO: 524224 - DNA, 25 bp, Rattus norvegicus
gccattgcagccatcgtgatcgccg

SEQ ID NO: 524225 - DNA, 25 bp, Rattus norvegicus
accttggctagatcgcaagaggcga

SEQ ID NO: 524226 - DNA, 25 bp, Rattus norvegicus
cgcgacggggtgattcactcccaca

SEQ ID NO: 524227 - DNA, 25 bp, Rattus norvegicus
ctagtgacctggaccaggacgcacc

SEQ ID NO: 524228 - DNA, 25 bp, Rattus norvegicus
accttcatgtttttcgagctcgcgg

SEQ ID NO: 524229 - DNA, 25 bp, Rattus norvegicus
ggtccgtgaacaccgcctacggtgc

SEQ ID NO: 524230 - DNA, 25 bp, Rattus norvegicus
gaaagttggcgtaccctggccgctc

SEQ ID NO: 524231 - DNA, 25 bp, Rattus norvegicus
ctccatggggaccagagacagggta

SEQ ID NO: 524232 - DNA, 25 bp, Rattus norvegicus
gcagcgctgaaagcggcagccagca

SEQ ID NO: 524233 - DNA, 25 bp, Rattus norvegicus
tttttaagcaacgacacaccttggc

SEQ ID NO: 524234 - DNA, 25 bp, Rattus norvegicus
caagaggcgactgtcggtccgtaca

SEQ ID NO: 524235 - DNA, 25 bp, Rattus norvegicus
ggtactgccctaagcgcttccaagc

SEQ ID NO: 524236 - DNA, 25 bp, Rattus norvegicus
ttgtcaccataccaaggcgcgacgg

SEQ ID NO: 524237 - DNA, 25 bp, Rattus norvegicus
gacgcgcacactctgggcgtccagg

SEQ ID NO: 524238 - DNA, 25 bp, Rattus norvegicus
aacgggtcctgctagccagctgcca

SEQ ID NO: 524239 - DNA, 25 bp, Rattus norvegicus
ggactttgaaacgatctttcccaca

SEQ ID NO: 524240 - DNA, 25 bp, Rattus norvegicus
ccgtgatctatgtagatcagacgcg

SEQ ID NO: 524241 - DNA, 25 bp, Rattus norvegicus
acgcctgccgtgatctatgtagatc

SEQ ID NO: 524242 - DNA, 25 bp, Rattus norvegicus
gccgaggttactttttcagacagaa

SEQ ID NO: 524243 - DNA, 25 bp, Rattus norvegicus
atctttcccacagtcgccgaggtta

SEQ ID NO: 524244 - DNA, 25 bp, Rattus norvegicus
catgcatgttgagaagtgggacttt

SEQ ID NO: 524245 - DNA, 25 bp, Rattus norvegicus
gtaccgtgggttttcatgcatgttg

SEQ ID NO: 524246 - DNA, 25 bp, Rattus norvegicus
tgcctcgactgagttggcagtgttg

SEQ ID NO: 524247 - DNA, 25 bp, Rattus norvegicus
gaaacgaacttcctgcctcgactga

SEQ ID NO: 524248 - DNA, 25 bp, Rattus norvegicus
tatctctacgaaacgaacttcctgc

SEQ ID NO: 524249 - DNA, 25 bp, Rattus norvegicus
gtcacacaaatatctctacgaaacg

SEQ ID NO: 524250 - DNA, 25 bp, Rattus norvegicus
ctcacgattccgtcacacaaatatc

SEQ ID NO: 524251 - DNA, 25 bp, Rattus norvegicus
ctagccagacgcctgccgtgatcta

SEQ ID NO: 524252 - DNA, 25 bp, Rattus norvegicus
cacagtcgccgaggttactttttca

SEQ ID NO: 524253 - DNA, 25 bp, Rattus norvegicus
tggaagcgccacatcgcggaggaac

SEQ ID NO: 524254 - DNA, 25 bp, Rattus norvegicus
cgcggcctacgacgttcggcaatga

SEQ ID NO: 524255 - DNA, 25 bp, Rattus norvegicus
caacacagacgcttccggcttcatg

SEQ ID NO: 524256 - DNA, 25 bp, Rattus norvegicus
ccggcttcatgattgcgtcatttga

SEQ ID NO: 524257 - DNA, 25 bp, Rattus norvegicus
tgcgtcatttgagagcgtcccacga

SEQ ID NO: 524258 - DNA, 25 bp, Rattus norvegicus
ttccggccttctccaacataatttc

SEQ ID NO: 524259 - DNA, 25 bp, Rattus norvegicus
ccaacataatttccggcagacaccg

SEQ ID NO: 524260 - DNA, 25 bp, Rattus norvegicus
ggcagacaccggaaaaccatcccag

SEQ ID NO: 524261 - DNA, 25 bp, Rattus norvegicus
tcccagatagcctcaggggtgcccg

SEQ ID NO: 524262 - DNA, 25 bp, Rattus norvegicus
cttctgttggctcgcgccttgcagc

SEQ ID NO: 524263 - DNA, 25 bp, Rattus norvegicus
attcgacatgtcgtcgggcctccgc

SEQ ID NO: 524264 - DNA, 25 bp, Rattus norvegicus
tctccttccgcgaaggcagggtgcc

SEQ ID NO: 524265 - DNA, 25 bp, Rattus norvegicus
aggcgttcgaggagatcattctgca

SEQ ID NO: 524266 - DNA, 25 bp, Rattus norvegicus
ttgcagcacgctgcaacctgcagtc

SEQ ID NO: 524267 - DNA, 25 bp, Rattus norvegicus
gccgccaacagaggcccggcgtttc

SEQ ID NO: 524268 - DNA, 25 bp, Rattus norvegicus
aacaggcaccgccatgccggcgagg

SEQ ID NO: 524269 - DNA, 25 bp, Rattus norvegicus
actacacttcccagggtgcgtcgcg

SEQ ID NO: 524270 - DNA, 25 bp, Rattus norvegicus
cgccacgcggagatttatgggtagt

SEQ ID NO: 524271 - DNA, 25 bp, Rattus norvegicus
tttatgggtagtgaaattgcggcgc

SEQ ID NO: 524272 - DNA, 25 bp, Rattus norvegicus
ggccacagcacagagtaaacgaact

SEQ ID NO: 524273 - DNA, 25 bp, Rattus norvegicus
agctcgcgagctggattcccgtcat

SEQ ID NO: 524274 - DNA, 25 bp, Rattus norvegicus
cccgacccttgacgcgccgccaaca

SEQ ID NO: 524275 - DNA, 25 bp, Rattus norvegicus
taaacgaactcgctccgaacaggca

SEQ ID NO: 524276 - DNA, 25 bp, Rattus norvegicus
gccctggccacagcacagagtaaac

SEQ ID NO: 524277 - DNA, 25 bp, Rattus norvegicus
gagtcaggcctcgagctcgcgagct

SEQ ID NO: 524278 - DNA, 25 bp, Rattus norvegicus
cccgagatgcggactacacttccca

SEQ ID NO: 524279 - DNA, 25 bp, Rattus norvegicus
gattcccgtcatgccattccagagg

SEQ ID NO: 524280 - DNA, 25 bp, Rattus norvegicus
tgcgtcgcgccacgcggagatttat

SEQ ID NO: 524281 - DNA, 25 bp, Rattus norvegicus
ggcgccttgtacttgacctcggccg

SEQ ID NO: 524282 - DNA, 25 bp, Rattus norvegicus
gccaggcgccttgtacttgacctcg

SEQ ID NO: 524283 - DNA, 25 bp, Rattus norvegicus
tccagggacaacctccgtgcgttca

SEQ ID NO: 524284 - DNA, 25 bp, Rattus norvegicus
ggacaacctccgtgcgttcaggcca

SEQ ID NO: 524285 - DNA, 25 bp, Rattus norvegicus
ccgcagagttgactcgtcgcatctc

SEQ ID NO: 524286 - DNA, 25 bp, Rattus norvegicus
gtcgcatctcaggtcctcctggctg

SEQ ID NO: 524287 - DNA, 25 bp, Rattus norvegicus
tcctggctgcggtccgaagcagtta

SEQ ID NO: 524288 - DNA, 25 bp, Rattus norvegicus
tcaggctgcggccagtagaaccacg

SEQ ID NO: 524289 - DNA, 25 bp, Rattus norvegicus
gcggccagtagaaccacgggacgtc

SEQ ID NO: 524290 - DNA, 25 bp, Rattus norvegicus
cgacgtacaggcgtttcttgatgag

SEQ ID NO: 524291 - DNA, 25 bp, Rattus norvegicus
ttcttgatgagcgagcgtccgctgc

SEQ ID NO: 524292 - DNA, 25 bp, Rattus norvegicus
tccgctgcccgagaagcgatccagg

SEQ ID NO: 524293 - DNA, 25 bp, Rattus norvegicus
agccacgagccggactgggtctcga

SEQ ID NO: 524294 - DNA, 25 bp, Rattus norvegicus
cccaagtcggagaagttgttcctgg

SEQ ID NO: 524295 - DNA, 25 bp, Rattus norvegicus
agtatctaacgaagcgaagccgccc

SEQ ID NO: 524296 - DNA, 25 bp, Rattus norvegicus
gggtgccacttgagcgcaagcttgc

SEQ ID NO: 524297 - DNA, 25 bp, Rattus norvegicus
gataagacctcgtaggcctgcgcca

SEQ ID NO: 524298 - DNA, 25 bp, Rattus norvegicus
gcagcggtcatacacctcgcgcttg

SEQ ID NO: 524299 - DNA, 25 bp, Rattus norvegicus
aagacatactggaaggcatcgtgga

SEQ ID NO: 524300 - DNA, 25 bp, Rattus norvegicus
gaagaactccctgaagacctcggcg

SEQ ID NO: 524301 - DNA, 25 bp, Rattus norvegicus
ggtgctcctccgatcgccgaaaaag

SEQ ID NO: 524302 - DNA, 25 bp, Rattus norvegicus
cccggagaaccgaaggatgtgaatc

SEQ ID NO: 524303 - DNA, 25 bp, Rattus norvegicus
caccgccgcaggacatggagaaaga

SEQ ID NO: 524304 - DNA, 25 bp, Rattus norvegicus
acaccgacttgtagttgcctgccgc

SEQ ID NO: 524305 - DNA, 25 bp, Rattus norvegicus
caagcttgcggtacgccttgcggat

SEQ ID NO: 524306 - DNA, 25 bp, Rattus norvegicus
agcacctcgtagtagtccaccatgg

SEQ ID NO: 524307 - DNA, 25 bp, Rattus norvegicus
cacacacccttgtgacgtggacgtc

SEQ ID NO: 524308 - DNA, 25 bp, Rattus norvegicus
tctcaagcgggtctccgaagaagtc

SEQ ID NO: 524309 - DNA, 25 bp, Rattus norvegicus
ggcgatcccgcagattcatagactc

SEQ ID NO: 524310 - DNA, 25 bp, Rattus norvegicus
tggccatctgcaccaacgggtcatc

SEQ ID NO: 524311 - DNA, 25 bp, Rattus norvegicus
cgggtcatcctcaaagggttggttg

SEQ ID NO: 524312 - DNA, 25 bp, Rattus norvegicus
tcagacgtgagggtgttggattccc

SEQ ID NO: 524313 - DNA, 25 bp, Rattus norvegicus
ccttcgctatcagccgctgcatgta

SEQ ID NO: 524314 - DNA, 25 bp, Rattus norvegicus
ctgcatgtacgtctggaagcgtcta

SEQ ID NO: 524315 - DNA, 25 bp, Rattus norvegicus
tgagacgctgatccagcgggcgatc

SEQ ID NO: 524316 - DNA, 25 bp, Rattus norvegicus
cgtctcgtaagtcagcgtggccatc

SEQ ID NO: 524317 - DNA, 25 bp, Rattus norvegicus
tcatagactccatggcgtgcgtggc

SEQ ID NO: 524318 - DNA, 25 bp, Rattus norvegicus
cccaagcgctgataggtcctttcga

SEQ ID NO: 524319 - DNA, 25 bp, Rattus norvegicus
acgcaaccgatcctgctcgagtttc

SEQ ID NO: 524320 - DNA, 25 bp, Rattus norvegicus
tcgagtttccgcctctctcagggag

SEQ ID NO: 524321 - DNA, 25 bp, Rattus norvegicus
tgcgcattacttcatgcggcacttc

SEQ ID NO: 524322 - DNA, 25 bp, Rattus norvegicus
gaagcgtctactgctttccttgaga

SEQ ID NO: 524323 - DNA, 25 bp, Rattus norvegicus
tgggcaccgtgttcacgaactcgtt

SEQ ID NO: 524324 - DNA, 25 bp, Rattus norvegicus
gttctcggcaaacttggtcaccttg

SEQ ID NO: 524325 - DNA, 25 bp, Rattus norvegicus
ggtcaccttgtgcagctccgttttg

SEQ ID NO: 524326 - DNA, 25 bp, Rattus norvegicus
gtccaccgaatccaccacgtagatg

SEQ ID NO: 524327 - DNA, 25 bp, Rattus norvegicus
acgtcccagaagtggcagctgatgc

SEQ ID NO: 524328 - DNA, 25 bp, Rattus norvegicus
atgcccttggcagtgccgttgctca

SEQ ID NO: 524329 - DNA, 25 bp, Rattus norvegicus
gttgcttctcaatctcggccaccgg

SEQ ID NO: 524330 - DNA, 25 bp, Rattus norvegicus
cgaactcgttgaacttgagccggta

SEQ ID NO: 524331 - DNA, 25 bp, Rattus norvegicus
agtccaagcccagcataacgatgtg

SEQ ID NO: 524332 - DNA, 25 bp, Rattus norvegicus
gcggctctgcagcaacctctggtct

SEQ ID NO: 524333 - DNA, 25 bp, Rattus norvegicus
taccggttagcgtagctgcctttgc

SEQ ID NO: 524334 - DNA, 25 bp, Rattus norvegicus
tttgctgtccctgcagtactcgcgc

SEQ ID NO: 524335 - DNA, 25 bp, Rattus norvegicus
ggacttccacaacggccgtagcttc

SEQ ID NO: 524336 - DNA, 25 bp, Rattus norvegicus
tgcagcggctgtaggacttccacaa

SEQ ID NO: 524337 - DNA, 25 bp, Rattus norvegicus
ggaggcgccagtcagccaagccttt

SEQ ID NO: 524338 - DNA, 25 bp, Rattus norvegicus
tcctcctcaaaagtgcgaatccgtc

SEQ ID NO: 524339 - DNA, 25 bp, Rattus norvegicus
tccgacagagactcctcctcaaaag

SEQ ID NO: 524340 - DNA, 25 bp, Rattus norvegicus
cacgtctgccccagtatcgtctagg

SEQ ID NO: 524341 - DNA, 25 bp, Rattus norvegicus
tttgagcacgccctgcccacgtctg

SEQ ID NO: 524342 - DNA, 25 bp, Rattus norvegicus
tcgctccagcctcaaattgcccacg

SEQ ID NO: 524343 - DNA, 25 bp, Rattus norvegicus
aatcgcgccggagcagtggaggcgc

SEQ ID NO: 524344 - DNA, 25 bp, Rattus norvegicus
gggcacagtccctactcgctccagc

SEQ ID NO: 524345 - DNA, 25 bp, Rattus norvegicus
cccagctccgggcacagtccctact

SEQ ID NO: 524346 - DNA, 25 bp, Rattus norvegicus
cccgcctttgctaagaactgccctc

SEQ ID NO: 524347 - DNA, 25 bp, Rattus norvegicus
ctaagtaaatcagccgctcagtcgt

SEQ ID NO: 524348 - DNA, 25 bp, Rattus norvegicus
ttttccctaagtaaatcagccgctc

SEQ ID NO: 524349 - DNA, 25 bp, Rattus norvegicus
ctcaaaagtgcgaatccgtcccggg

SEQ ID NO: 524350 - DNA, 25 bp, Rattus norvegicus
aggcgccagtcagccaagccttttt

SEQ ID NO: 524351 - DNA, 25 bp, Rattus norvegicus
agcaggtagggtccgcgggagagtt

SEQ ID NO: 524352 - DNA, 25 bp, Rattus norvegicus
cgggaacagacagtagagtagatct

SEQ ID NO: 524353 - DNA, 25 bp, Rattus norvegicus
gcggctgatgcgctttctccctgcg

SEQ ID NO: 524354 - DNA, 25 bp, Rattus norvegicus
gaccgcgcggctgatgcgctttctc

SEQ ID NO: 524355 - DNA, 25 bp, Rattus norvegicus
tgtcgcgggaacagacagtagagta

SEQ ID NO: 524356 - DNA, 25 bp, Rattus norvegicus
gcgggaacagacagtagagtagatc

SEQ ID NO: 524357 - DNA, 25 bp, Rattus norvegicus
ggcagagggtttcgagtggtgtcgc

SEQ ID NO: 524358 - DNA, 25 bp, Rattus norvegicus
aacagacagtagagtagatctgcgc

SEQ ID NO: 524359 - DNA, 25 bp, Rattus norvegicus
cagacagtagagtagatctgcgcgg

SEQ ID NO: 524360 - DNA, 25 bp, Rattus norvegicus
acagtagagtagatctgcgcggggc

SEQ ID NO: 524361 - DNA, 25 bp, Rattus norvegicus
tagagtagatctgcgcggggcgtga

SEQ ID NO: 524362 - DNA, 25 bp, Rattus norvegicus
ggcgtgaggacaccagccccactgt

SEQ ID NO: 524363 - DNA, 25 bp, Rattus norvegicus
agaccgcgcggctgatgcgctttct

SEQ ID NO: 524364 - DNA, 25 bp, Rattus norvegicus
tcgcgggaacagacagtagagtaga

SEQ ID NO: 524365 - DNA, 25 bp, Rattus norvegicus
tagaggagcgttgttctgcaagtgc

SEQ ID NO: 524366 - DNA, 25 bp, Rattus norvegicus
tggtgacaatgcacatttcaacttc

SEQ ID NO: 524367 - DNA, 25 bp, Rattus norvegicus
aacttcttcggatagccctcctgga

SEQ ID NO: 524368 - DNA, 25 bp, Rattus norvegicus
cctcctggaggatgaaattgaaaac

SEQ ID NO: 524369 - DNA, 25 bp, Rattus norvegicus
aaaactccagtttctgtcttggtga

SEQ ID NO: 524370 - DNA, 25 bp, Rattus norvegicus
tctgtcttggtgatcgagtgaccgc

SEQ ID NO: 524371 - DNA, 25 bp, Rattus norvegicus
tgcaagtgctgtttaccgggaagcc

SEQ ID NO: 524372 - DNA, 25 bp, Rattus norvegicus
ccagtgtgtcttgttagagggtttg

SEQ ID NO: 524373 - DNA, 25 bp, Rattus norvegicus
tctggcgttgtagtgtgcaggttta

SEQ ID NO: 524374 - DNA, 25 bp, Rattus norvegicus
ggctggccgctctgcgtacgcagaa

SEQ ID NO: 524375 - DNA, 25 bp, Rattus norvegicus
cgtacgcagaaggttgtggagcctc

SEQ ID NO: 524376 - DNA, 25 bp, Rattus norvegicus
aggttgtggagcctcgtggatctac

SEQ ID NO: 524377 - DNA, 25 bp, Rattus norvegicus
ctccgggttaaacttggtgacaatg

SEQ ID NO: 524378 - DNA, 25 bp, Rattus norvegicus
ctgcgccgcccagtgtgtcttgtta

SEQ ID NO: 524379 - DNA, 25 bp, Rattus norvegicus
ggcccagggctctcagcactcagat

SEQ ID NO: 524380 - DNA, 25 bp, Rattus norvegicus
cagtggtgataacagagagggccca

SEQ ID NO: 524381 - DNA, 25 bp, Rattus norvegicus
cctgcgtgtcgcagaggttccttaa

SEQ ID NO: 524382 - DNA, 25 bp, Rattus norvegicus
gtcgcagaggttccttaagcgctct

SEQ ID NO: 524383 - DNA, 25 bp, Rattus norvegicus
taagcgctctgctggcaaacaaaca

SEQ ID NO: 524384 - DNA, 25 bp, Rattus norvegicus
cgctctgctggcaaacaaacaaaag

SEQ ID NO: 524385 - DNA, 25 bp, Rattus norvegicus
tcgcgcgccaccttgtcgtacggag

SEQ ID NO: 524386 - DNA, 25 bp, Rattus norvegicus
agggctctcagcactcagatcagca

SEQ ID NO: 524387 - DNA, 25 bp, Rattus norvegicus
actcagatcagcaggctttaggggc

SEQ ID NO: 524388 - DNA, 25 bp, Rattus norvegicus
agatcagcaggctttaggggcgtcc

SEQ ID NO: 524389 - DNA, 25 bp, Rattus norvegicus
cagtgcgctgcgacgcgagcgcaga

SEQ ID NO: 524390 - DNA, 25 bp, Rattus norvegicus
gtcggcgcgatggactacaagtccc

SEQ ID NO: 524391 - DNA, 25 bp, Rattus norvegicus
acgtgggccagagccctgcgtgcca

SEQ ID NO: 524392 - DNA, 25 bp, Rattus norvegicus
ccaccttgtcgtacggaggcgttgg

SEQ ID NO: 524393 - DNA, 25 bp, Rattus norvegicus
accgcatctcggtgaccatggtcag

SEQ ID NO: 524394 - DNA, 25 bp, Rattus norvegicus
ctcatggctcggctctccgggtgcg

SEQ ID NO: 524395 - DNA, 25 bp, Rattus norvegicus
ccaggaagacggtctaccgcatctc

SEQ ID NO: 524396 - DNA, 25 bp, Rattus norvegicus
ggacttccgcgcctttcgcacacgc

SEQ ID NO: 524397 - DNA, 25 bp, Rattus norvegicus
tgaccatggtcaggaaggagcagct

SEQ ID NO: 524398 - DNA, 25 bp, Rattus norvegicus
ttcgcctgcggacacgatgtcgcgc

SEQ ID NO: 524399 - DNA, 25 bp, Rattus norvegicus
cgctccggctccacgtcctactcgg

SEQ ID NO: 524400 - DNA, 25 bp, Rattus norvegicus
tgcacctggccagctctgcgcctga

SEQ ID NO: 524401 - DNA, 25 bp, Rattus norvegicus
ccctggggtcatggacctgctggac

SEQ ID NO: 524402 - DNA, 25 bp, Rattus norvegicus
cgcgtcttcgcctgcggacacgatg

SEQ ID NO: 524403 - DNA, 25 bp, Rattus norvegicus
agaacccaccgacctgatgggtagc

SEQ ID NO: 524404 - DNA, 25 bp, Rattus norvegicus
gcacacgcagcaccgggcagctgga

SEQ ID NO: 524405 - DNA, 25 bp, Rattus norvegicus
gacacagaacccaccgacctgatgg

SEQ ID NO: 524406 - DNA, 25 bp, Rattus norvegicus
gcggccgtgcgcacacgacacagaa

SEQ ID NO: 524407 - DNA, 25 bp, Rattus norvegicus
cagtgtaatcgcatttcagccattg

SEQ ID NO: 524408 - DNA, 25 bp, Rattus norvegicus
acggggcggacttaataggatcaga

SEQ ID NO: 524409 - DNA, 25 bp, Rattus norvegicus
gggcggacttaataggatcagatca

SEQ ID NO: 524410 - DNA, 25 bp, Rattus norvegicus
cggacttaataggatcagatcagtg

SEQ ID NO: 524411 - DNA, 25 bp, Rattus norvegicus
ataggatcagatcagtgtaatcgca

SEQ ID NO: 524412 - DNA, 25 bp, Rattus norvegicus
cagatcagtgtaatcgcatttcagc

SEQ ID NO: 524413 - DNA, 25 bp, Rattus norvegicus
ctttaaggtgatgcgcggccgctag

SEQ ID NO: 524414 - DNA, 25 bp, Rattus norvegicus
gtgtaatcgcatttcagccattgtc

SEQ ID NO: 524415 - DNA, 25 bp, Rattus norvegicus
cgcatttcagccattgtcattcgaa

SEQ ID NO: 524416 - DNA, 25 bp, Rattus norvegicus
tttcagccattgtcattcgaactgc

SEQ ID NO: 524417 - DNA, 25 bp, Rattus norvegicus
gccattgtcattcgaactgccggga

SEQ ID NO: 524418 - DNA, 25 bp, Rattus norvegicus
gtcattcgaactgccgggagcccga

SEQ ID NO: 524419 - DNA, 25 bp, Rattus norvegicus
gccctttaaggtgatgcgcggccgc

SEQ ID NO: 524420 - DNA, 25 bp, Rattus norvegicus
ttgtcattcgaactgccgggagccc

SEQ ID NO: 524421 - DNA, 25 bp, Rattus norvegicus
tggagcgcctcggatttgtcgaagt

SEQ ID NO: 524422 - DNA, 25 bp, Rattus norvegicus
gtctgtccgtctccgagtccgtctt

SEQ ID NO: 524423 - DNA, 25 bp, Rattus norvegicus
tcggctcagctaccaacagtgcgtg

SEQ ID NO: 524424 - DNA, 25 bp, Rattus norvegicus
gcggtacccagagcgcagaccacga

SEQ ID NO: 524425 - DNA, 25 bp, Rattus norvegicus
tgcgctcatagacgcgttcgggaga

SEQ ID NO: 524426 - DNA, 25 bp, Rattus norvegicus
tgcatcatcatcagcgacggcggga

SEQ ID NO: 524427 - DNA, 25 bp, Rattus norvegicus
gtctatgctgaaggcggtactactc

SEQ ID NO: 524428 - DNA, 25 bp, Rattus norvegicus
gggctgccgatcagcgagtctatgc

SEQ ID NO: 524429 - DNA, 25 bp, Rattus norvegicus
taaacatggggtagccggtgtagac

SEQ ID NO: 524430 - DNA, 25 bp, Rattus norvegicus
atttgtcgaagttgccgcctccagg

SEQ ID NO: 524431 - DNA, 25 bp, Rattus norvegicus
caagaaggctttgccgtcctccgta

SEQ ID NO: 524432 - DNA, 25 bp, Rattus norvegicus
cagcgagccctccttggccaagaag

SEQ ID NO: 524433 - DNA, 25 bp, Rattus norvegicus
cttgcaccgcttcggccgcagagaa

SEQ ID NO: 524434 - DNA, 25 bp, Rattus norvegicus
caccggccggtagggcataaacatg

SEQ ID NO: 524435 - DNA, 25 bp, Rattus norvegicus
tttcgactatggtaaacagccggga

SEQ ID NO: 524436 - DNA, 25 bp, Rattus norvegicus
gagggagctctcaccctggctctgc

SEQ ID NO: 524437 - DNA, 25 bp, Rattus norvegicus
gctctgcgcagcgcgaggactcctg

SEQ ID NO: 524438 - DNA, 25 bp, Rattus norvegicus
ccctttgcgtactgctggatggagt

SEQ ID NO: 524439 - DNA, 25 bp, Rattus norvegicus
ctgctggatggagttgagtccctca

SEQ ID NO: 524440 - DNA, 25 bp, Rattus norvegicus
agttgagtccctcaagatatttccc

SEQ ID NO: 524441 - DNA, 25 bp, Rattus norvegicus
ctatggtaaacagccgggaatttgg

SEQ ID NO: 524442 - DNA, 25 bp, Rattus norvegicus
ggattgcagcaaaaggaaagtcttt

SEQ ID NO: 524443 - DNA, 25 bp, Rattus norvegicus
tcttttgggatcgtttcacggccga

SEQ ID NO: 524444 - DNA, 25 bp, Rattus norvegicus
gtttcacggccgaaggcagacccta

SEQ ID NO: 524445 - DNA, 25 bp, Rattus norvegicus
ggccgaaggcagaccctaccaagcg

SEQ ID NO: 524446 - DNA, 25 bp, Rattus norvegicus
aggcagaccctaccaagcgcgcggg

SEQ ID NO: 524447 - DNA, 25 bp, Rattus norvegicus
tggcaacggagggagctctcaccct

SEQ ID NO: 524448 - DNA, 25 bp, Rattus norvegicus
ttggagggattgcagcaaaaggaaa

SEQ ID NO: 524449 - DNA, 25 bp, Rattus norvegicus
cttcttgggtgaaaatccagggtgg

SEQ ID NO: 524450 - DNA, 25 bp, Rattus norvegicus
gcccattgttggcatggtgcgctgc

SEQ ID NO: 524451 - DNA, 25 bp, Rattus norvegicus
ctacctggacaggtaagaggctgcc

SEQ ID NO: 524452 - DNA, 25 bp, Rattus norvegicus
cctggaaatgcgagctacctggaca

SEQ ID NO: 524453 - DNA, 25 bp, Rattus norvegicus
aggggacactagcaggccatggccc

SEQ ID NO: 524454 - DNA, 25 bp, Rattus norvegicus
cctcctcttgggcttcttgggtgaa

SEQ ID NO: 524455 - DNA, 25 bp, Rattus norvegicus
cgatctgtcccggagggaaggactt

SEQ ID NO: 524456 - DNA, 25 bp, Rattus norvegicus
caccgcggggagcactcaccaaagt

SEQ ID NO: 524457 - DNA, 25 bp, Rattus norvegicus
tcatgctgctgcaggccgatctgtc

SEQ ID NO: 524458 - DNA, 25 bp, Rattus norvegicus
ggtctggttctttttcatgctgctg

SEQ ID NO: 524459 - DNA, 25 bp, Rattus norvegicus
gagtttgctgaaagtgccctgcatg

SEQ ID NO: 524460 - DNA, 25 bp, Rattus norvegicus
agcgcccaagtgacgccagagccag

SEQ ID NO: 524461 - DNA, 25 bp, Rattus norvegicus
gtccacaggttccaacgtgtccctg

SEQ ID NO: 524462 - DNA, 25 bp, Rattus norvegicus
gtgtgggcatgcttcttcccaaaga

SEQ ID NO: 524463 - DNA, 25 bp, Rattus norvegicus
acagtccttccagactggactcggc

SEQ ID NO: 524464 - DNA, 25 bp, Rattus norvegicus
tcttagtaactaggctcggagagcc

SEQ ID NO: 524465 - DNA, 25 bp, Rattus norvegicus
cccagctcagatcttagtaactagg

SEQ ID NO: 524466 - DNA, 25 bp, Rattus norvegicus
gcgcgggaaaaccacccagctcaga

SEQ ID NO: 524467 - DNA, 25 bp, Rattus norvegicus
aaccgcacagtccttccagactgga

SEQ ID NO: 524468 - DNA, 25 bp, Rattus norvegicus
gaattcctacctgcctagctccgaa

SEQ ID NO: 524469 - DNA, 25 bp, Rattus norvegicus
gatctgtccctcgaattcctacctg

SEQ ID NO: 524470 - DNA, 25 bp, Rattus norvegicus
acaggtacggggatctgtccctcga

SEQ ID NO: 524471 - DNA, 25 bp, Rattus norvegicus
tatacacgaggatcgacaggtacgg

SEQ ID NO: 524472 - DNA, 25 bp, Rattus norvegicus
ttgaagagatttatacacgaggatc

SEQ ID NO: 524473 - DNA, 25 bp, Rattus norvegicus
gctttcggaatcctgacggcgttga

SEQ ID NO: 524474 - DNA, 25 bp, Rattus norvegicus
gcggataacaaaagctttcggaatc

SEQ ID NO: 524475 - DNA, 25 bp, Rattus norvegicus
ggggctgcggataacaaaagctttc

SEQ ID NO: 524476 - DNA, 25 bp, Rattus norvegicus
cctgacggcgttgaagagatttata

SEQ ID NO: 524477 - DNA, 25 bp, Rattus norvegicus
gcgaagctcgctgtcatcctctgca

SEQ ID NO: 524478 - DNA, 25 bp, Rattus norvegicus
tcgacatcaataccagggccgcatc

SEQ ID NO: 524479 - DNA, 25 bp, Rattus norvegicus
ggcgtcggctgtaaacactcccttc

SEQ ID NO: 524480 - DNA, 25 bp, Rattus norvegicus
tctgatttcatttagggccatgggg

SEQ ID NO: 524481 - DNA, 25 bp, Rattus norvegicus
tgttcacgcaatcaagttcattagg

SEQ ID NO: 524482 - DNA, 25 bp, Rattus norvegicus
gcgttatccatcattttcgacatca

SEQ ID NO: 524483 - DNA, 25 bp, Rattus norvegicus
tcgcatttcggtttagggtggctcc

SEQ ID NO: 524484 - DNA, 25 bp, Rattus norvegicus
tggatctcccaggtccggagacata

SEQ ID NO: 524485 - DNA, 25 bp, Rattus norvegicus
aggcgcaagcgtcacctccttttgt

SEQ ID NO: 524486 - DNA, 25 bp, Rattus norvegicus
tgacaccctattcccgaggcctggg

SEQ ID NO: 524487 - DNA, 25 bp, Rattus norvegicus
ctcatcccggtgttgcccagtgaag

SEQ ID NO: 524488 - DNA, 25 bp, Rattus norvegicus
cgcaacgcctgggatgcgcgatcag

SEQ ID NO: 524489 - DNA, 25 bp, Rattus norvegicus
agtgcgtgcaagctccgtttctcca

SEQ ID NO: 524490 - DNA, 25 bp, Rattus norvegicus
tcattaggacttcaaatcgcatttc

SEQ ID NO: 524491 - DNA, 25 bp, Rattus norvegicus
gcacgctgcgcttagggccgtctcg

SEQ ID NO: 524492 - DNA, 25 bp, Rattus norvegicus
cgcacctgcggaaggccaaatcagt

SEQ ID NO: 524493 - DNA, 25 bp, Rattus norvegicus
tccagctggactgtcgcgccgtgct

SEQ ID NO: 524494 - DNA, 25 bp, Rattus norvegicus
gttggggccaccctccagctggact

SEQ ID NO: 524495 - DNA, 25 bp, Rattus norvegicus
ccacgtgtagcggtgtgtctcggtt

SEQ ID NO: 524496 - DNA, 25 bp, Rattus norvegicus
tgcgcgtgtttgtccaggccgcgct

SEQ ID NO: 524497 - DNA, 25 bp, Rattus norvegicus
cgcgccacagcccagatagagttgc

SEQ ID NO: 524498 - DNA, 25 bp, Rattus norvegicus
ccgttccgcagtaggagcgtgcaca

SEQ ID NO: 524499 - DNA, 25 bp, Rattus norvegicus
tagtagcgcctggacagtgcgctgc

SEQ ID NO: 524500 - DNA, 25 bp, Rattus norvegicus
gacgcgccaccgtagtcgagcgcgt

SEQ ID NO: 524501 - DNA, 25 bp, Rattus norvegicus
cgggatccgtgatttagtagcgcct

SEQ ID NO: 524502 - DNA, 25 bp, Rattus norvegicus
gccaaatcagtcaccagcgcgcggg

SEQ ID NO: 524503 - DNA, 25 bp, Rattus norvegicus
ccagatagagttgcgcgtgtttgtc

SEQ ID NO: 524504 - DNA, 25 bp, Rattus norvegicus
ttgtgcagcgggctgcgctcgtcct

SEQ ID NO: 524505 - DNA, 25 bp, Rattus norvegicus
aatctggtctgcagcccgggcagct

SEQ ID NO: 524506 - DNA, 25 bp, Rattus norvegicus
atcaatctggtctgcagcccgggca

SEQ ID NO: 524507 - DNA, 25 bp, Rattus norvegicus
ccaggcgcttcggagctgtccgctt

SEQ ID NO: 524508 - DNA, 25 bp, Rattus norvegicus
gctgccaggcgcttcggagctgtcc

SEQ ID NO: 524509 - DNA, 25 bp, Rattus norvegicus
tccgatcaatctggtctgcagcccg

SEQ ID NO: 524510 - DNA, 25 bp, Rattus norvegicus
tcctccgatcaatctggtctgcagc

SEQ ID NO: 524511 - DNA, 25 bp, Rattus norvegicus
actttagaacctcgggccgcagctc

SEQ ID NO: 524512 - DNA, 25 bp, Rattus norvegicus
ccgcacaccggaaccgacacagaga

SEQ ID NO: 524513 - DNA, 25 bp, Rattus norvegicus
cgcactcatgcactttagaacctcg

SEQ ID NO: 524514 - DNA, 25 bp, Rattus norvegicus
cgcttcggagctgtccgcttcagca

SEQ ID NO: 524515 - DNA, 25 bp, Rattus norvegicus
cggtagtggtggtgcggaccagccc

SEQ ID NO: 524516 - DNA, 25 bp, Rattus norvegicus
cgacgcactcatgcactttagaacc

SEQ ID NO: 524517 - DNA, 25 bp, Rattus norvegicus
cgccgacgcactcatgcactttaga

SEQ ID NO: 524518 - DNA, 25 bp, Rattus norvegicus
accggaaccgacacagagacccacg

SEQ ID NO: 524519 - DNA, 25 bp, Rattus norvegicus
gccttccgtgcggaggatttggccc

SEQ ID NO: 524520 - DNA, 25 bp, Rattus norvegicus
ctggacaaaggcagtcgggagcctt

SEQ ID NO: 524521 - DNA, 25 bp, Rattus norvegicus
cagctctgggctctggacaaaggca

SEQ ID NO: 524522 - DNA, 25 bp, Rattus norvegicus
tgctttgctccaaggcagctctggg

SEQ ID NO: 524523 - DNA, 25 bp, Rattus norvegicus
gcgcaggcgctttggcatcccaaac

SEQ ID NO: 524524 - DNA, 25 bp, Rattus norvegicus
ccgcacgagggcaggtctctgcttt

SEQ ID NO: 524525 - DNA, 25 bp, Rattus norvegicus
tcggccttggtctatgtatcgcggt

SEQ ID NO: 524526 - DNA, 25 bp, Rattus norvegicus
gcgctttggcatcccaaacggggcg

SEQ ID NO: 524527 - DNA, 25 bp, Rattus norvegicus
tggacatcctgggatggccgcacga

SEQ ID NO: 524528 - DNA, 25 bp, Rattus norvegicus
aacggtcccggttgtggacatcctg

SEQ ID NO: 524529 - DNA, 25 bp, Rattus norvegicus
tgagaagcagaacggtcccggttgt

SEQ ID NO: 524530 - DNA, 25 bp, Rattus norvegicus
tatgtatcgcggtgagaagcagaac

SEQ ID NO: 524531 - DNA, 25 bp, Rattus norvegicus
ccttggtctatgtatcgcggtgaga

SEQ ID NO: 524532 - DNA, 25 bp, Rattus norvegicus
caggtctctgctttgctccaaggca

SEQ ID NO: 524533 - DNA, 25 bp, Rattus norvegicus
gccacggcgtcgcttaggaaatgac

SEQ ID NO: 524534 - DNA, 25 bp, Rattus norvegicus
atcagtgcgagaaccaggagcttga

SEQ ID NO: 524535 - DNA, 25 bp, Rattus norvegicus
gagccagcttcttacgtcatcgagg

SEQ ID NO: 524536 - DNA, 25 bp, Rattus norvegicus
aagctgttggatcagtgcgagaacc

SEQ ID NO: 524537 - DNA, 25 bp, Rattus norvegicus
gggcagagcgctcgctgccctgctt

SEQ ID NO: 524538 - DNA, 25 bp, Rattus norvegicus
cgccttcagtttcagaaagctgttg

SEQ ID NO: 524539 - DNA, 25 bp, Rattus norvegicus
ggcggacaacgccttcagtttcaga

SEQ ID NO: 524540 - DNA, 25 bp, Rattus norvegicus
gcggtgatggcggacaacgccttca

SEQ ID NO: 524541 - DNA, 25 bp, Rattus norvegicus
cgagggccagcttgtgctttggtca

SEQ ID NO: 524542 - DNA, 25 bp, Rattus norvegicus
tcttacgtcatcgagggcgcgacgc

SEQ ID NO: 524543 - DNA, 25 bp, Rattus norvegicus
acacatttgcgcatgcgtacggaga

SEQ ID NO: 524544 - DNA, 25 bp, Rattus norvegicus
atgcgtacggagagccagcttctta

SEQ ID NO: 524545 - DNA, 25 bp, Rattus norvegicus
gcttctcagccacggcgtcgcttag

SEQ ID NO: 524546 - DNA, 25 bp, Rattus norvegicus
cgcttaggaaatgacgacacatttg

SEQ ID NO: 524547 - DNA, 25 bp, Rattus norvegicus
ggcctacggaccactcgccacccgc

SEQ ID NO: 524548 - DNA, 25 bp, Rattus norvegicus
gctcaaccagatcgcgcgtgaggtg

SEQ ID NO: 524549 - DNA, 25 bp, Rattus norvegicus
gaggacgacgcgctcaaccagatcg

SEQ ID NO: 524550 - DNA, 25 bp, Rattus norvegicus
cgtggccgatggacatgggcacaca

SEQ ID NO: 524551 - DNA, 25 bp, Rattus norvegicus
tccgagaccggtcccgcagcagctg

SEQ ID NO: 524552 - DNA, 25 bp, Rattus norvegicus
gagcaaggcgcggccacagctgtca

SEQ ID NO: 524553 - DNA, 25 bp, Rattus norvegicus
accagatcgcgcgtgaggtgagcaa

SEQ ID NO: 524554 - DNA, 25 bp, Rattus norvegicus
ccggctttcatccacggcctacgga

SEQ ID NO: 524555 - DNA, 25 bp, Rattus norvegicus
tggcgctactggcttcagctctaga

SEQ ID NO: 524556 - DNA, 25 bp, Rattus norvegicus
ctggcttcagctctagaccctggtc

SEQ ID NO: 524557 - DNA, 25 bp, Rattus norvegicus
ctctagaccctggtccttgtgggcc

SEQ ID NO: 524558 - DNA, 25 bp, Rattus norvegicus
accctggtccttgtgggccgctagt

SEQ ID NO: 524559 - DNA, 25 bp, Rattus norvegicus
ctagtcccggggaccgactcaatcg

SEQ ID NO: 524560 - DNA, 25 bp, Rattus norvegicus
agtggtccccagcagccgcgctttg

SEQ ID NO: 524561 - DNA, 25 bp, Rattus norvegicus
caacgtggtcaggttcggtagcctt

SEQ ID NO: 524562 - DNA, 25 bp, Rattus norvegicus
cacgtgctgcgagtctggtcactgt

SEQ ID NO: 524563 - DNA, 25 bp, Rattus norvegicus
tggtcactgtccagcgtggagacta

SEQ ID NO: 524564 - DNA, 25 bp, Rattus norvegicus
gagactagttccttgcggcatcctg

SEQ ID NO: 524565 - DNA, 25 bp, Rattus norvegicus
atcctgtcggatcgcagttgtcgtc

SEQ ID NO: 524566 - DNA, 25 bp, Rattus norvegicus
ttgatgctcactcctgtccaacgtg

SEQ ID NO: 524567 - DNA, 25 bp, Rattus norvegicus
agccacgtcggctcggaaaactgta

SEQ ID NO: 524568 - DNA, 25 bp, Rattus norvegicus
gaaaactgtagcagcggacgcagct

SEQ ID NO: 524569 - DNA, 25 bp, Rattus norvegicus
acgcagctgaactctgggaggctca

SEQ ID NO: 524570 - DNA, 25 bp, Rattus norvegicus
gaggctcatgccttgtggtaccagc

SEQ ID NO: 524571 - DNA, 25 bp, Rattus norvegicus
tggtaccagctcaagccacgcgtgt

SEQ ID NO: 524572 - DNA, 25 bp, Rattus norvegicus
ccacgcgtgtcctaactgaaggtgc

SEQ ID NO: 524573 - DNA, 25 bp, Rattus norvegicus
tggtctccagcactgactcaacggg

SEQ ID NO: 524574 - DNA, 25 bp, Rattus norvegicus
agttgtcgtcttggtttgatgctca

SEQ ID NO: 524575 - DNA, 25 bp, Rattus norvegicus
ccgggacaccactcgttggaaagca

SEQ ID NO: 524576 - DNA, 25 bp, Rattus norvegicus
tcgcgagaagatactcccagcgcgc

SEQ ID NO: 524577 - DNA, 25 bp, Rattus norvegicus
agaagatactcccagcgcgcccaat

SEQ ID NO: 524578 - DNA, 25 bp, Rattus norvegicus
caggcccgcggttccttcctgcgct

SEQ ID NO: 524579 - DNA, 25 bp, Rattus norvegicus
ttcctgcgcttttaaacctccatca

SEQ ID NO: 524580 - DNA, 25 bp, Rattus norvegicus
taaacctccatcaagccaatcacag

SEQ ID NO: 524581 - DNA, 25 bp, Rattus norvegicus
gccaatcacagtgccaatctgtttg

SEQ ID NO: 524582 - DNA, 25 bp, Rattus norvegicus
gccaatctgtttgcataagccaata

SEQ ID NO: 524583 - DNA, 25 bp, Rattus norvegicus
ttgcataagccaataggagctctcc

SEQ ID NO: 524584 - DNA, 25 bp, Rattus norvegicus
gccggcagccgttacccgacaagcc

SEQ ID NO: 524585 - DNA, 25 bp, Rattus norvegicus
cgacaggcgatgcttatggtgagcc

SEQ ID NO: 524586 - DNA, 25 bp, Rattus norvegicus
gacaccactcgttggaaagcagagg

SEQ ID NO: 524587 - DNA, 25 bp, Rattus norvegicus
acacaggcgacaggcgatgcttatg

SEQ ID NO: 524588 - DNA, 25 bp, Rattus norvegicus
taggagctctcctcgagcagtgggc

SEQ ID NO: 524589 - DNA, 25 bp, Rattus norvegicus
gtggccttctctccagcgggctcag

SEQ ID NO: 524590 - DNA, 25 bp, Rattus norvegicus
ctgactcgcggtgctcaggtgagct

SEQ ID NO: 524591 - DNA, 25 bp, Rattus norvegicus
gcccgcaaggtcacggtccggagct

SEQ ID NO: 524592 - DNA, 25 bp, Rattus norvegicus
gacggtcacctagttggccggtgta

SEQ ID NO: 524593 - DNA, 25 bp, Rattus norvegicus
agtttcctccgtctccggtgggcat

SEQ ID NO: 524594 - DNA, 25 bp, Rattus norvegicus
gtgtcacctggggtgtggccttctc

SEQ ID NO: 524595 - DNA, 25 bp, Rattus norvegicus
ggcttgcctcgcctgactcgcggtg

SEQ ID NO: 524596 - DNA, 25 bp, Rattus norvegicus
catgattttgggtgccggcttgcct

SEQ ID NO: 524597 - DNA, 25 bp, Rattus norvegicus
aaggccagcgcgactcggtgccgct

SEQ ID NO: 524598 - DNA, 25 bp, Rattus norvegicus
tgaccgctgcggtcacggcgcagtc

SEQ ID NO: 524599 - DNA, 25 bp, Rattus norvegicus
ttttttaaagtgaccgctgcggtca

SEQ ID NO: 524600 - DNA, 25 bp, Rattus norvegicus
gtggagctgccaataaagttcttta

SEQ ID NO: 524601 - DNA, 25 bp, Rattus norvegicus
cgcgcgtggagctgccaataaagtt

SEQ ID NO: 524602 - DNA, 25 bp, Rattus norvegicus
ccggtgtacgcgactgtccgcgcgt

SEQ ID NO: 524603 - DNA, 25 bp, Rattus norvegicus
tgaagcgcgacacgcagccaatgcg

SEQ ID NO: 524604 - DNA, 25 bp, Rattus norvegicus
gaacaggctaccaccaaagctaagg

SEQ ID NO: 524605 - DNA, 25 bp, Rattus norvegicus
acacgacccgggagagaacaggcta

SEQ ID NO: 524606 - DNA, 25 bp, Rattus norvegicus
cagacagaagcgtccggccacacga

SEQ ID NO: 524607 - DNA, 25 bp, Rattus norvegicus
atcccgcaaggcctgaggacacttg

SEQ ID NO: 524608 - DNA, 25 bp, Rattus norvegicus
aacaggtgcgctccctctggggatc

SEQ ID NO: 524609 - DNA, 25 bp, Rattus norvegicus
ttaccggccagcgatcagggagatg

SEQ ID NO: 524610 - DNA, 25 bp, Rattus norvegicus
caaagctaagggcacaaggggatcc

SEQ ID NO: 524611 - DNA, 25 bp, Rattus norvegicus
caactgtgccgtgtggccgcatcat

SEQ ID NO: 524612 - DNA, 25 bp, Rattus norvegicus
agccaatgcggataccctgggagcc

SEQ ID NO: 524613 - DNA, 25 bp, Rattus norvegicus
gaccaatcaaccagtcaggggcgga

SEQ ID NO: 524614 - DNA, 25 bp, Rattus norvegicus
gggtggccctactaatgtcttcagc

SEQ ID NO: 524615 - DNA, 25 bp, Rattus norvegicus
cccatcggagtctaaggggtgctca

SEQ ID NO: 524616 - DNA, 25 bp, Rattus norvegicus
ctcgcagattggctgaagcgcgaca

SEQ ID NO: 524617 - DNA, 25 bp, Rattus norvegicus
cgttatttcgctcttccgtggtcga

SEQ ID NO: 524618 - DNA, 25 bp, Rattus norvegicus
ctgctctgcgccttcggtactcaga

SEQ ID NO: 524619 - DNA, 25 bp, Rattus norvegicus
cactgacttcgggtaacagccgcgc

SEQ ID NO: 524620 - DNA, 25 bp, Rattus norvegicus
tggaaatccgggagcccgccactga

SEQ ID NO: 524621 - DNA, 25 bp, Rattus norvegicus
gctggaatgttctgccgaggagatc

SEQ ID NO: 524622 - DNA, 25 bp, Rattus norvegicus
ggccatcgaccgcagtttgctggaa

SEQ ID NO: 524623 - DNA, 25 bp, Rattus norvegicus
aggcgacttgacttctgggcgccga

SEQ ID NO: 524624 - DNA, 25 bp, Rattus norvegicus
ccctctcttggcgttgaacgcggta

SEQ ID NO: 524625 - DNA, 25 bp, Rattus norvegicus
ctgctctcccgcttgggtgtttttg

SEQ ID NO: 524626 - DNA, 25 bp, Rattus norvegicus
gcgcaggggacgactacagttccca

SEQ ID NO: 524627 - DNA, 25 bp, Rattus norvegicus
tagaggcttcgcttctctccctggc

SEQ ID NO: 524628 - DNA, 25 bp, Rattus norvegicus
tcgtgcgccgctccttaatagaggc

SEQ ID NO: 524629 - DNA, 25 bp, Rattus norvegicus
ggtcgagcccacctcacggattcta

SEQ ID NO: 524630 - DNA, 25 bp, Rattus norvegicus
tacaactcccatgatactcgtgcgc

SEQ ID NO: 524631 - DNA, 25 bp, Rattus norvegicus
ctgctgggcacctggaaagccatca

SEQ ID NO: 524632 - DNA, 25 bp, Rattus norvegicus
tggcgcctgaactcgaagcctccga

SEQ ID NO: 524633 - DNA, 25 bp, Rattus norvegicus
gcccttctggtgcagccacatcggt

SEQ ID NO: 524634 - DNA, 25 bp, Rattus norvegicus
tccctgctgctgaagggcatgaatg

SEQ ID NO: 524635 - DNA, 25 bp, Rattus norvegicus
tcaggacccaagcaaggagaccatg

SEQ ID NO: 524636 - DNA, 25 bp, Rattus norvegicus
acctggccaacctgcgcaaggaacg

SEQ ID NO: 524637 - DNA, 25 bp, Rattus norvegicus
gcatcgtcatgcttttcctcggcca

SEQ ID NO: 524638 - DNA, 25 bp, Rattus norvegicus
cgagcagttcttgcctcacgtggac

SEQ ID NO: 524639 - DNA, 25 bp, Rattus norvegicus
tggacctcttcatgctcggctactt

SEQ ID NO: 524640 - DNA, 25 bp, Rattus norvegicus
tcggctactttcagctcctggagtg

SEQ ID NO: 524641 - DNA, 25 bp, Rattus norvegicus
cggcacttgctatgctttgaggttt

SEQ ID NO: 524642 - DNA, 25 bp, Rattus norvegicus
gttttcgagcacctaggcgcacacg

SEQ ID NO: 524643 - DNA, 25 bp, Rattus norvegicus
gtggcatcatcacccacctgctggg

SEQ ID NO: 524644 - DNA, 25 bp, Rattus norvegicus
ctggaggctcaacgtgcacgatcca

SEQ ID NO: 524645 - DNA, 25 bp, Rattus norvegicus
tcactcagagcaacgtggaggcgct

SEQ ID NO: 524646 - DNA, 25 bp, Rattus norvegicus
ctgctggttggtgaccaggagctac

SEQ ID NO: 524647 - DNA, 25 bp, Rattus norvegicus
tggtgaccaggagctaccctgccac

SEQ ID NO: 524648 - DNA, 25 bp, Rattus norvegicus
caccgcagccttctggcgctgaata

SEQ ID NO: 524649 - DNA, 25 bp, Rattus norvegicus
ccatgtttgccggagactttgctga

SEQ ID NO: 524650 - DNA, 25 bp, Rattus norvegicus
ttgccggagactttgctgagagctt

SEQ ID NO: 524651 - DNA, 25 bp, Rattus norvegicus
tgctgagagcttttcggcacgtgtg

SEQ ID NO: 524652 - DNA, 25 bp, Rattus norvegicus
cttttcggcacgtgtggagctgaga

SEQ ID NO: 524653 - DNA, 25 bp, Rattus norvegicus
ggcagctcgtggacttcgtgtacac

SEQ ID NO: 524654 - DNA, 25 bp, Rattus norvegicus
ggccggttgaccatcactcagagca

SEQ ID NO: 524655 - DNA, 25 bp, Rattus norvegicus
gagcaacgtggaggcgctcacccgc

SEQ ID NO: 524656 - DNA, 25 bp, Rattus norvegicus
ccaccgtacagaaggtctgcggccg

SEQ ID NO: 524657 - DNA, 25 bp, Rattus norvegicus
tctgcccaagctggcggatgtcacg

SEQ ID NO: 524658 - DNA, 25 bp, Rattus norvegicus
gacttcgtgtacacgggccggttga

SEQ ID NO: 524659 - DNA, 25 bp, Rattus norvegicus
tagggtccggagtcggccgcatctt

SEQ ID NO: 524660 - DNA, 25 bp, Rattus norvegicus
cgtggctgggacactacccacctag

SEQ ID NO: 524661 - DNA, 25 bp, Rattus norvegicus
taactccggaggggacacaggagtc

SEQ ID NO: 524662 - DNA, 25 bp, Rattus norvegicus
tggacttggcggtactgtaagttcc

SEQ ID NO: 524663 - DNA, 25 bp, Rattus norvegicus
tcccagtattggacttggcggtact

SEQ ID NO: 524664 - DNA, 25 bp, Rattus norvegicus
agcgctggtcccagtattggacttg

SEQ ID NO: 524665 - DNA, 25 bp, Rattus norvegicus
agtcggccgcatctttgtagcgctg

SEQ ID NO: 524666 - DNA, 25 bp, Rattus norvegicus
agcgaagtccccgaaccactcgtag

SEQ ID NO: 524667 - DNA, 25 bp, Rattus norvegicus
gagggcacggaaggaagcgaagtcc

SEQ ID NO: 524668 - DNA, 25 bp, Rattus norvegicus
tcaggacacagctccggctctagga

SEQ ID NO: 524669 - DNA, 25 bp, Rattus norvegicus
acgaggatacggtcctcaggacaca

SEQ ID NO: 524670 - DNA, 25 bp, Rattus norvegicus
ccacctagcacgaggatacggtcct

SEQ ID NO: 524671 - DNA, 25 bp, Rattus norvegicus
tgggacactacccacctagcacgag

SEQ ID NO: 524672 - DNA, 25 bp, Rattus norvegicus
ccgcatctttgtagcgctggtccca

SEQ ID NO: 524673 - DNA, 25 bp, Rattus norvegicus
ggattcaagcgcgttataaggcgcc

SEQ ID NO: 524674 - DNA, 25 bp, Rattus norvegicus
cacggactggatccggcgcccgcct

SEQ ID NO: 524675 - DNA, 25 bp, Rattus norvegicus
tcaagcgcgttataaggcgccgacc

SEQ ID NO: 524676 - DNA, 25 bp, Rattus norvegicus
agcgcgttataaggcgccgacctga

SEQ ID NO: 524677 - DNA, 25 bp, Rattus norvegicus
ttataaggcgccgacctgaccagcc

SEQ ID NO: 524678 - DNA, 25 bp, Rattus norvegicus
tgaccagccctgcttgttgctgccg

SEQ ID NO: 524679 - DNA, 25 bp, Rattus norvegicus
cgagcccgtgggaacccaagcacga

SEQ ID NO: 524680 - DNA, 25 bp, Rattus norvegicus
gccagcatggcctcgacccgcagcc

SEQ ID NO: 524681 - DNA, 25 bp, Rattus norvegicus
ctgcgccagcctgctcgccgccatg

SEQ ID NO: 524682 - DNA, 25 bp, Rattus norvegicus
ccatgggcctcggtgtcccggagtc

SEQ ID NO: 524683 - DNA, 25 bp, Rattus norvegicus
ctcggtgtcccggagtccgccgagc

SEQ ID NO: 524684 - DNA, 25 bp, Rattus norvegicus
cctgcagagcgcaccctagccacga

SEQ ID NO: 524685 - DNA, 25 bp, Rattus norvegicus
cacgaccgcagccacccgggaccga

SEQ ID NO: 524686 - DNA, 25 bp, Rattus norvegicus
gtgggaacccaagcacgaccgcagc

SEQ ID NO: 524687 - DNA, 25 bp, Rattus norvegicus
gcaggtctgcacctatccgctgtgc

SEQ ID NO: 524688 - DNA, 25 bp, Rattus norvegicus
tgcgaccgagcaggcaaagcacctt

SEQ ID NO: 524689 - DNA, 25 bp, Rattus norvegicus
ctgacatttagactggcttttggcc

SEQ ID NO: 524690 - DNA, 25 bp, Rattus norvegicus
tggcgccgagcctgacatttagact

SEQ ID NO: 524691 - DNA, 25 bp, Rattus norvegicus
tgatgaattgttacggcgtttcccg

SEQ ID NO: 524692 - DNA, 25 bp, Rattus norvegicus
gcctagacatttggtctcgtgatga

SEQ ID NO: 524693 - DNA, 25 bp, Rattus norvegicus
cgcacaggcacttttagcctagaca

SEQ ID NO: 524694 - DNA, 25 bp, Rattus norvegicus
tcttgctgtggccatattaaagcca

SEQ ID NO: 524695 - DNA, 25 bp, Rattus norvegicus
agtacattcggctgggagtcttgct

SEQ ID NO: 524696 - DNA, 25 bp, Rattus norvegicus
ataggcccgggaccagtacattcgg

SEQ ID NO: 524697 - DNA, 25 bp, Rattus norvegicus
ctcgggatttccagtacgcagatag

SEQ ID NO: 524698 - DNA, 25 bp, Rattus norvegicus
cgcaccgaggtactgggagtcgaaa

SEQ ID NO: 524699 - DNA, 25 bp, Rattus norvegicus
agtcacagcgccctgcattggccgt

SEQ ID NO: 524700 - DNA, 25 bp, Rattus norvegicus
gcaaagcaccttctggccgctcgga

SEQ ID NO: 524701 - DNA, 25 bp, Rattus norvegicus
agcacctcggcgttctctagcttgg

SEQ ID NO: 524702 - DNA, 25 bp, Rattus norvegicus
ggggagccctcaccatgtacaggac

SEQ ID NO: 524703 - DNA, 25 bp, Rattus norvegicus
gacgcattaacgtgtcctgctctgg

SEQ ID NO: 524704 - DNA, 25 bp, Rattus norvegicus
agagccgcgcgctttgttaggctcc

SEQ ID NO: 524705 - DNA, 25 bp, Rattus norvegicus
tgaagactctcgttgatccgcgcgc

SEQ ID NO: 524706 - DNA, 25 bp, Rattus norvegicus
cacctgcgcagagggtaaaggagtt

SEQ ID NO: 524707 - DNA, 25 bp, Rattus norvegicus
gcctgtgggaaacggctactgagcc

SEQ ID NO: 524708 - DNA, 25 bp, Rattus norvegicus
ctactgtggttctgacgatccgctc

SEQ ID NO: 524709 - DNA, 25 bp, Rattus norvegicus
cggcatcccgcacagtgagcagtga

SEQ ID NO: 524710 - DNA, 25 bp, Rattus norvegicus
tagccagcagcgaagcgctcgcttg

SEQ ID NO: 524711 - DNA, 25 bp, Rattus norvegicus
catgcatgcattggatgtagccagc

SEQ ID NO: 524712 - DNA, 25 bp, Rattus norvegicus
cgaacgtgtgcacctcatgcatgca

SEQ ID NO: 524713 - DNA, 25 bp, Rattus norvegicus
gcgcgaggcagcctacagccaatga

SEQ ID NO: 524714 - DNA, 25 bp, Rattus norvegicus
agcagccgcaactcctgaagactct

SEQ ID NO: 524715 - DNA, 25 bp, Rattus norvegicus
cgtcgtcggcggtccatctgccggc

SEQ ID NO: 524716 - DNA, 25 bp, Rattus norvegicus
ttgtctcgctggctttgtcccgcag

SEQ ID NO: 524717 - DNA, 25 bp, Rattus norvegicus
ctgtgtccgccagacgcccaagccc

SEQ ID NO: 524718 - DNA, 25 bp, Rattus norvegicus
aacaggcacgcctgtgtccgccaga

SEQ ID NO: 524719 - DNA, 25 bp, Rattus norvegicus
tgtcccgcaggctgcaacaggcacg

SEQ ID NO: 524720 - DNA, 25 bp, Rattus norvegicus
ggctttgtcccgcaggctgcaacag

SEQ ID NO: 524721 - DNA, 25 bp, Rattus norvegicus
cgcgcctttgtctcgctggctttgt

SEQ ID NO: 524722 - DNA, 25 bp, Rattus norvegicus
agcgacaggtgttggccgcgccttt

SEQ ID NO: 524723 - DNA, 25 bp, Rattus norvegicus
cttcggcagagaaaagcggcagccc

SEQ ID NO: 524724 - DNA, 25 bp, Rattus norvegicus
ctgcagccgcttcggcagagaaaag

SEQ ID NO: 524725 - DNA, 25 bp, Rattus norvegicus
cccgtgacagttggcagctgcagcc

SEQ ID NO: 524726 - DNA, 25 bp, Rattus norvegicus
ccggtaacttgatgcccgtgacagt

SEQ ID NO: 524727 - DNA, 25 bp, Rattus norvegicus
catctgccggccctgccttgccgcg

SEQ ID NO: 524728 - DNA, 25 bp, Rattus norvegicus
cttgatgcccgtgacagttggcagc

SEQ ID NO: 524729 - DNA, 25 bp, Rattus norvegicus
tgcacagtcggcaactcctggctca

SEQ ID NO: 524730 - DNA, 25 bp, Rattus norvegicus
cccatctacattctgcggagttgca

SEQ ID NO: 524731 - DNA, 25 bp, Rattus norvegicus
ctgagggatcgagaaagctctcatc

SEQ ID NO: 524732 - DNA, 25 bp, Rattus norvegicus
ggtcctttgctcgacccgtcacttg

SEQ ID NO: 524733 - DNA, 25 bp, Rattus norvegicus
gctagtcactgtagcgccgctgcca

SEQ ID NO: 524734 - DNA, 25 bp, Rattus norvegicus
gccctccgctgtcacatagtggaaa

SEQ ID NO: 524735 - DNA, 25 bp, Rattus norvegicus
aacctgagagttccgcgcatcgatt

SEQ ID NO: 524736 - DNA, 25 bp, Rattus norvegicus
gcgggacttccattcacctggcatg

SEQ ID NO: 524737 - DNA, 25 bp, Rattus norvegicus
gcatcgattggtaaagacgcccgtc

SEQ ID NO: 524738 - DNA, 25 bp, Rattus norvegicus
gacgcccgtcgctctctttacataa

SEQ ID NO: 524739 - DNA, 25 bp, Rattus norvegicus
tcctcaatgaagacgttgcgcactc

SEQ ID NO: 524740 - DNA, 25 bp, Rattus norvegicus
agcgacgtgagcagcctcagcaatc

SEQ ID NO: 524741 - DNA, 25 bp, Rattus norvegicus
aggttcttggctgctgcgccactca

SEQ ID NO: 524742 - DNA, 25 bp, Rattus norvegicus
catttgcatactggtggggcggaac

SEQ ID NO: 524743 - DNA, 25 bp, Rattus norvegicus
tctcacacggaatggccgggtctct

SEQ ID NO: 524744 - DNA, 25 bp, Rattus norvegicus
tggagcgcgcttgtcctcctgcaca

SEQ ID NO: 524745 - DNA, 25 bp, Rattus norvegicus
gcttgtcctcctgcacagctagaga

SEQ ID NO: 524746 - DNA, 25 bp, Rattus norvegicus
ctcctgcacagctagagaggccgga

SEQ ID NO: 524747 - DNA, 25 bp, Rattus norvegicus
ctctgggcaaggttatccggaggcc

SEQ ID NO: 524748 - DNA, 25 bp, Rattus norvegicus
cgctcttttctcacacggaatggcc

SEQ ID NO: 524749 - DNA, 25 bp, Rattus norvegicus
aaggttatccggaggccgccgctca

SEQ ID NO: 524750 - DNA, 25 bp, Rattus norvegicus
cgctcaccgagaagctgctcaacaa

SEQ ID NO: 524751 - DNA, 25 bp, Rattus norvegicus
gaagctgctcaacaagccaccgttc

SEQ ID NO: 524752 - DNA, 25 bp, Rattus norvegicus
gctacctgcacgacatcatcactga

SEQ ID NO: 524753 - DNA, 25 bp, Rattus norvegicus
acatcatcactgaggtaggcgccga

SEQ ID NO: 524754 - DNA, 25 bp, Rattus norvegicus
atcactgaggtaggcgccgactagt

SEQ ID NO: 524755 - DNA, 25 bp, Rattus norvegicus
gttagaaacaaatgatcgctctttt

SEQ ID NO: 524756 - DNA, 25 bp, Rattus norvegicus
gcagcgccatgaacgcggcagtggt

SEQ ID NO: 524757 - DNA, 25 bp, Rattus norvegicus
agcagcgtaggccaacgtcactcca

SEQ ID NO: 524758 - DNA, 25 bp, Rattus norvegicus
caggagttcctgaggcattcgaaga

SEQ ID NO: 524759 - DNA, 25 bp, Rattus norvegicus
attcgaagacgcctccacctataga

SEQ ID NO: 524760 - DNA, 25 bp, Rattus norvegicus
cacctatagaggagaggcgtttccc

SEQ ID NO: 524761 - DNA, 25 bp, Rattus norvegicus
aaatcccggcgcttcctagtagacg

SEQ ID NO: 524762 - DNA, 25 bp, Rattus norvegicus
gacgcagttttgtcaaccttccctg

SEQ ID NO: 524763 - DNA, 25 bp, Rattus norvegicus
aaacgccggaggtgtttctctgaca

SEQ ID NO: 524764 - DNA, 25 bp, Rattus norvegicus
tctctgacagggttgctctttgaca

SEQ ID NO: 524765 - DNA, 25 bp, Rattus norvegicus
tgctctttgacaggctcgctgagga

SEQ ID NO: 524766 - DNA, 25 bp, Rattus norvegicus
ggcccgcaggtaacgtacgcggcta

SEQ ID NO: 524767 - DNA, 25 bp, Rattus norvegicus
aaggtattgcgtctccggtcagtca

SEQ ID NO: 524768 - DNA, 25 bp, Rattus norvegicus
tcctcgcgggccagggtcaataaat

SEQ ID NO: 524769 - DNA, 25 bp, Rattus norvegicus
taaatgtgtacgtcaggcttcgcgc

SEQ ID NO: 524770 - DNA, 25 bp, Rattus norvegicus
ttctcgaagaaaggacagcagcgta

SEQ ID NO: 524771 - DNA, 25 bp, Rattus norvegicus
ggaagcggcgctacagcaagaaatc

SEQ ID NO: 524772 - DNA, 25 bp, Rattus norvegicus
acgccttctccgtgtggcgcatgga

SEQ ID NO: 524773 - DNA, 25 bp, Rattus norvegicus
ccagctgcagctacgtggctcacga

SEQ ID NO: 524774 - DNA, 25 bp, Rattus norvegicus
ctgcaaagcgacgagatggacaata

SEQ ID NO: 524775 - DNA, 25 bp, Rattus norvegicus
ggccgccaggtacatagacttcctc

SEQ ID NO: 524776 - DNA, 25 bp, Rattus norvegicus
gagccagcgcatcctagccaacgtg

SEQ ID NO: 524777 - DNA, 25 bp, Rattus norvegicus
ggttttgcacaagccggcctcgaaa

SEQ ID NO: 524778 - DNA, 25 bp, Rattus norvegicus
ctctcccggagacctcggttttgca

SEQ ID NO: 524779 - DNA, 25 bp, Rattus norvegicus
gctatttagcaacccagccgggata

SEQ ID NO: 524780 - DNA, 25 bp, Rattus norvegicus
gccctcgctcctgacagctatttag

SEQ ID NO: 524781 - DNA, 25 bp, Rattus norvegicus
cgaagggcccagaacttgtcctgcc

SEQ ID NO: 524782 - DNA, 25 bp, Rattus norvegicus
gcctaggggtcagcaccgctgatta

SEQ ID NO: 524783 - DNA, 25 bp, Rattus norvegicus
gggccaaatctgctccaggagactc

SEQ ID NO: 524784 - DNA, 25 bp, Rattus norvegicus
aaatcagagcctttgcgagcgaccc

SEQ ID NO: 524785 - DNA, 25 bp, Rattus norvegicus
cgcctattggtttcttcgcgttaga

SEQ ID NO: 524786 - DNA, 25 bp, Rattus norvegicus
cggcggcgaagaagccgctcttctc

SEQ ID NO: 524787 - DNA, 25 bp, Rattus norvegicus
cgcctctgaagtcgctcgggtacca

SEQ ID NO: 524788 - DNA, 25 bp, Rattus norvegicus
caccaacgcgcgctgtgattggccg

SEQ ID NO: 524789 - DNA, 25 bp, Rattus norvegicus
ccgccatattctcttcgcctattgg

SEQ ID NO: 524790 - DNA, 25 bp, Rattus norvegicus
agcgaggaacagaaccgagtcgttc

SEQ ID NO: 524791 - DNA, 25 bp, Rattus norvegicus
ccctgccgcaggtcgtaggcagcga

SEQ ID NO: 524792 - DNA, 25 bp, Rattus norvegicus
ccgttccgttaggaccgactgcagc

SEQ ID NO: 524793 - DNA, 25 bp, Rattus norvegicus
gaagcgcttcttgggctgcagctcc

SEQ ID NO: 524794 - DNA, 25 bp, Rattus norvegicus
agccttgaaggcgaagcgcttcttg

SEQ ID NO: 524795 - DNA, 25 bp, Rattus norvegicus
gcagcatccttctttcgagccttga

SEQ ID NO: 524796 - DNA, 25 bp, Rattus norvegicus
atctacctgggcagtcccggcagca

SEQ ID NO: 524797 - DNA, 25 bp, Rattus norvegicus
cgagtcgttcaagagtttccgcagc

SEQ ID NO: 524798 - DNA, 25 bp, Rattus norvegicus
ggtgacgtcagatcccgccatattc

SEQ ID NO: 524799 - DNA, 25 bp, Rattus norvegicus
ttggctcccggccttgtcaatacta

SEQ ID NO: 524800 - DNA, 25 bp, Rattus norvegicus
tgacccacgttgaaccatgatgctg

SEQ ID NO: 524801 - DNA, 25 bp, Rattus norvegicus
ccattggctgcaacggctttgcgtc

SEQ ID NO: 524802 - DNA, 25 bp, Rattus norvegicus
ccctgcctggtttctaatgaagaaa

SEQ ID NO: 524803 - DNA, 25 bp, Rattus norvegicus
tatagtgtgcctgagttcatgtctc

SEQ ID NO: 524804 - DNA, 25 bp, Rattus norvegicus
cgctgcccgggtcaatatagtgtgc

SEQ ID NO: 524805 - DNA, 25 bp, Rattus norvegicus
tgctgttgacagacctcctcggcag

SEQ ID NO: 524806 - DNA, 25 bp, Rattus norvegicus
cacgtactgactgatgctgttgaca

SEQ ID NO: 524807 - DNA, 25 bp, Rattus norvegicus
tcaatactagtgagcggggcgtacc

SEQ ID NO: 524808 - DNA, 25 bp, Rattus norvegicus
gaaagcgtcaattacggctcggccc

SEQ ID NO: 524809 - DNA, 25 bp, Rattus norvegicus
ccgcctccaagaattcagttgctct

SEQ ID NO: 524810 - DNA, 25 bp, Rattus norvegicus
tccaggcgctagctctgagagcttc

SEQ ID NO: 524811 - DNA, 25 bp, Rattus norvegicus
ttcgatcggcctctctcaaaagtta

SEQ ID NO: 524812 - DNA, 25 bp, Rattus norvegicus
tccattggtccgagagtcctaagtc

SEQ ID NO: 524813 - DNA, 25 bp, Rattus norvegicus
tcagatgtgcaaaggtgtcgcggca

SEQ ID NO: 524814 - DNA, 25 bp, Rattus norvegicus
acgggaacatgcgtctcgggaagtc

SEQ ID NO: 524815 - DNA, 25 bp, Rattus norvegicus
cccgcttgaaaggttgcagtaggaa

SEQ ID NO: 524816 - DNA, 25 bp, Rattus norvegicus
agaggctgtagacccgcttgaaagg

SEQ ID NO: 524817 - DNA, 25 bp, Rattus norvegicus
ttcttgcctttcgtgactggagtgc

SEQ ID NO: 524818 - DNA, 25 bp, Rattus norvegicus
agctgaaagggctgcagtctttatc

SEQ ID NO: 524819 - DNA, 25 bp, Rattus norvegicus
gtggatgtccacagctgttcctgca

SEQ ID NO: 524820 - DNA, 25 bp, Rattus norvegicus
tggttaaccctccagtccaggcgta

SEQ ID NO: 524821 - DNA, 25 bp, Rattus norvegicus
gtcctcgcccgttacctgggtagca

SEQ ID NO: 524822 - DNA, 25 bp, Rattus norvegicus
tcagcgtcaggaaagctagctatgc

SEQ ID NO: 524823 - DNA, 25 bp, Rattus norvegicus
gcatggtgtccaccctgcgtcaaca

SEQ ID NO: 524824 - DNA, 25 bp, Rattus norvegicus
ccggctggcttgagactaggtagcc

SEQ ID NO: 524825 - DNA, 25 bp, Rattus norvegicus
agcgggagtccatgtgatctgtcta

SEQ ID NO: 524826 - DNA, 25 bp, Rattus norvegicus
tgtgatctgtctagagcggctctcc

SEQ ID NO: 524827 - DNA, 25 bp, Rattus norvegicus
caacaatgccggagtgtcaggtctc

SEQ ID NO: 524828 - DNA, 25 bp, Rattus norvegicus
tggaggcctcaagagctcgtagctc

SEQ ID NO: 524829 - DNA, 25 bp, Rattus norvegicus
ccaatcactgaacggatgagcacgc

SEQ ID NO: 524830 - DNA, 25 bp, Rattus norvegicus
aggcgttcgacaaagcagcttcacc

SEQ ID NO: 524831 - DNA, 25 bp, Rattus norvegicus
acccgagtctacaaggcgttcgaca

SEQ ID NO: 524832 - DNA, 25 bp, Rattus norvegicus
ccgaggatccaagcgaggaaagcca

SEQ ID NO: 524833 - DNA, 25 bp, Rattus norvegicus
ggcttaggtctagattgcggctctg

SEQ ID NO: 524834 - DNA, 25 bp, Rattus norvegicus
aactacccgagatggggcagagcca

SEQ ID NO: 524835 - DNA, 25 bp, Rattus norvegicus
atgacgtcacaaccgagtgtccgcg

SEQ ID NO: 524836 - DNA, 25 bp, Rattus norvegicus
aacctcaaggccattgcttcgctgc

SEQ ID NO: 524837 - DNA, 25 bp, Rattus norvegicus
cgtgaacgcgacagggtcctatctt

SEQ ID NO: 524838 - DNA, 25 bp, Rattus norvegicus
ctcgtagctcaagggtctgatcaac

SEQ ID NO: 524839 - DNA, 25 bp, Rattus norvegicus
tcaaggaccagagggacgtgaacgc

SEQ ID NO: 524840 - DNA, 25 bp, Rattus norvegicus
ccgggacaagtctcagcaacctcaa

SEQ ID NO: 524841 - DNA, 25 bp, Rattus norvegicus
atccacagctggtttcatctcgaga

SEQ ID NO: 524842 - DNA, 25 bp, Rattus norvegicus
actggcggcgttgcgctcacttccg

SEQ ID NO: 524843 - DNA, 25 bp, Rattus norvegicus
gtttcatctcgagactggcggcgtt

SEQ ID NO: 524844 - DNA, 25 bp, Rattus norvegicus
cacagctggtttcatctcgagactg

SEQ ID NO: 524845 - DNA, 25 bp, Rattus norvegicus
ggaaacatctcatccacagctggtt

SEQ ID NO: 524846 - DNA, 25 bp, Rattus norvegicus
tcgggaaacatctcatccacagctg

SEQ ID NO: 524847 - DNA, 25 bp, Rattus norvegicus
ccgcgccctcgggaaacatctcatc

SEQ ID NO: 524848 - DNA, 25 bp, Rattus norvegicus
acctcatccaagtctacatagggcc

SEQ ID NO: 524849 - DNA, 25 bp, Rattus norvegicus
acgcaggtttgtaggcgtgctccca

SEQ ID NO: 524850 - DNA, 25 bp, Rattus norvegicus
tgggctcccacgcaggtttgtaggc

SEQ ID NO: 524851 - DNA, 25 bp, Rattus norvegicus
tttgagtccccgaaggcctgggctc

SEQ ID NO: 524852 - DNA, 25 bp, Rattus norvegicus
cagtctctggcagattttgagtccc

SEQ ID NO: 524853 - DNA, 25 bp, Rattus norvegicus
cccagtctctggcagattttgagtc

SEQ ID NO: 524854 - DNA, 25 bp, Rattus norvegicus
ctggtttcatctcgagactggcggc

SEQ ID NO: 524855 - DNA, 25 bp, Rattus norvegicus
ttagtcaactgacgccagacgcccg

SEQ ID NO: 524856 - DNA, 25 bp, Rattus norvegicus
gccaagtgtcgcgtctcagcaaaga

SEQ ID NO: 524857 - DNA, 25 bp, Rattus norvegicus
gcttgttcctcgaactggcaacctc

SEQ ID NO: 524858 - DNA, 25 bp, Rattus norvegicus
aggctgtgcccagatctgcttgttc

SEQ ID NO: 524859 - DNA, 25 bp, Rattus norvegicus
ttctgggacccttgaaaagcttcgc

SEQ ID NO: 524860 - DNA, 25 bp, Rattus norvegicus
ttcatgaatgaatgcgagggtcttc

SEQ ID NO: 524861 - DNA, 25 bp, Rattus norvegicus
cgagggtcttcaccagcaatgttcc

SEQ ID NO: 524862 - DNA, 25 bp, Rattus norvegicus
gaccacacctgttactggggcactg

SEQ ID NO: 524863 - DNA, 25 bp, Rattus norvegicus
ccgcactgtgtctttctggaaggga

SEQ ID NO: 524864 - DNA, 25 bp, Rattus norvegicus
tgggcagtcaccaagtgcgcattaa

SEQ ID NO: 524865 - DNA, 25 bp, Rattus norvegicus
tggtccctgtcccttcgggaacaga

SEQ ID NO: 524866 - DNA, 25 bp, Rattus norvegicus
gcctgttttgcagtccgctccagca

SEQ ID NO: 524867 - DNA, 25 bp, Rattus norvegicus
tctcccatccgatgcacatttagtg

SEQ ID NO: 524868 - DNA, 25 bp, Rattus norvegicus
catccctctgggtagcatctctgca

SEQ ID NO: 524869 - DNA, 25 bp, Rattus norvegicus
cgttaggaatgagtcaagtttgtgc

SEQ ID NO: 524870 - DNA, 25 bp, Rattus norvegicus
cccggctaataagtgaccctctgta

SEQ ID NO: 524871 - DNA, 25 bp, Rattus norvegicus
cctctgtaaacgttaggaatgagtc

SEQ ID NO: 524872 - DNA, 25 bp, Rattus norvegicus
tgagtcaagtttgtgctgcgccgct

SEQ ID NO: 524873 - DNA, 25 bp, Rattus norvegicus
ctgctttcccgttagcgggtggcgc

SEQ ID NO: 524874 - DNA, 25 bp, Rattus norvegicus
cgacccatcgcaggcaccgggccac

SEQ ID NO: 524875 - DNA, 25 bp, Rattus norvegicus
gcctctcgggacgtcccggctaata

SEQ ID NO: 524876 - DNA, 25 bp, Rattus norvegicus
ggccacagctggaacctattacgcc

SEQ ID NO: 524877 - DNA, 25 bp, Rattus norvegicus
accgggccacagctggaacctatta

SEQ ID NO: 524878 - DNA, 25 bp, Rattus norvegicus
ggcggggcagccctcgcttgcaatc

SEQ ID NO: 524879 - DNA, 25 bp, Rattus norvegicus
gcttgcaatcctcccgtgcgcaggg

SEQ ID NO: 524880 - DNA, 25 bp, Rattus norvegicus
caatcctcccgtgcgcaggggactg

SEQ ID NO: 524881 - DNA, 25 bp, Rattus norvegicus
tctggctgggcgtcgacccatcgca

SEQ ID NO: 524882 - DNA, 25 bp, Rattus norvegicus
tgaccctctgtaaacgttaggaatg

SEQ ID NO: 524883 - DNA, 25 bp, Rattus norvegicus
ttcttcggcgccgagcactcaggac

SEQ ID NO: 524884 - DNA, 25 bp, Rattus norvegicus
cccgaagcaggacgacggcggctca

SEQ ID NO: 524885 - DNA, 25 bp, Rattus norvegicus
ggcccgccctctgatcttggcgatg

SEQ ID NO: 524886 - DNA, 25 bp, Rattus norvegicus
gccgtgcggtgactatagccacctg

SEQ ID NO: 524887 - DNA, 25 bp, Rattus norvegicus
tcgcaccttcctgagctgagcgggt

SEQ ID NO: 524888 - DNA, 25 bp, Rattus norvegicus
tcctcagagctacgggcaccgcagt

SEQ ID NO: 524889 - DNA, 25 bp, Rattus norvegicus
tggcagagttcgacaggcttcctca

SEQ ID NO: 524890 - DNA, 25 bp, Rattus norvegicus
acctgtttgggacgttggcagagtt

SEQ ID NO: 524891 - DNA, 25 bp, Rattus norvegicus
tgctcatggcccgacctgtttggga

SEQ ID NO: 524892 - DNA, 25 bp, Rattus norvegicus
gccagggcacctaggcgacagccag

SEQ ID NO: 524893 - DNA, 25 bp, Rattus norvegicus
tggaatgaggacagcgcttcctctc

SEQ ID NO: 524894 - DNA, 25 bp, Rattus norvegicus
cagcaacttggcaccgcggcaggca

SEQ ID NO: 524895 - DNA, 25 bp, Rattus norvegicus
actcaggactctacgtgagtaaccc

SEQ ID NO: 524896 - DNA, 25 bp, Rattus norvegicus
cgacttctacccgttcggcacgaag

SEQ ID NO: 524897 - DNA, 25 bp, Rattus norvegicus
cgcaggcgcggaataaactgttctc

SEQ ID NO: 524898 - DNA, 25 bp, Rattus norvegicus
tgtcagctcgcgcttctatactttg

SEQ ID NO: 524899 - DNA, 25 bp, Rattus norvegicus
gactttccgggatgtctacgttcgc

SEQ ID NO: 524900 - DNA, 25 bp, Rattus norvegicus
gaagtgtctcccatgctgcctgatg

SEQ ID NO: 524901 - DNA, 25 bp, Rattus norvegicus
ttacgcctccgaagtcagcacagtg

SEQ ID NO: 524902 - DNA, 25 bp, Rattus norvegicus
acctttggcctgtagagctctcctg

SEQ ID NO: 524903 - DNA, 25 bp, Rattus norvegicus
acacagcattgaggctccggaagtc

SEQ ID NO: 524904 - DNA, 25 bp, Rattus norvegicus
ggccgactggacctggaatcctgat

SEQ ID NO: 524905 - DNA, 25 bp, Rattus norvegicus
tttggcggccacattctcaaggcga

SEQ ID NO: 524906 - DNA, 25 bp, Rattus norvegicus
tgcctcggaggagccaaaagaaact

SEQ ID NO: 524907 - DNA, 25 bp, Rattus norvegicus
gggcctcagtgaaagcaagctgctg

SEQ ID NO: 524908 - DNA, 25 bp, Rattus norvegicus
ccaccgaccaatcgtaggcagagta

SEQ ID NO: 524909 - DNA, 25 bp, Rattus norvegicus
cagccggattcacaccgtaaagatc

SEQ ID NO: 524910 - DNA, 25 bp, Rattus norvegicus
cggggcatgtctattctgttttacc

SEQ ID NO: 524911 - DNA, 25 bp, Rattus norvegicus
acccatctcgcggtcatcagcaatg

SEQ ID NO: 524912 - DNA, 25 bp, Rattus norvegicus
tcctgccgcgtgtctactacagctg

SEQ ID NO: 524913 - DNA, 25 bp, Rattus norvegicus
gagcgcgcccaggacatcggcatct

SEQ ID NO: 524914 - DNA, 25 bp, Rattus norvegicus
tggcgccgctttttgccctactcaa

SEQ ID NO: 524915 - DNA, 25 bp, Rattus norvegicus
ttcctcaatttcacgctggcgcgtg

SEQ ID NO: 524916 - DNA, 25 bp, Rattus norvegicus
gtgtctactacagctggacgcgcgc

SEQ ID NO: 524917 - DNA, 25 bp, Rattus norvegicus
ggcacacaaccgcacttgccggtga

SEQ ID NO: 524918 - DNA, 25 bp, Rattus norvegicus
ccgcaggctttcctactggcctttt

SEQ ID NO: 524919 - DNA, 25 bp, Rattus norvegicus
tcatcagcaatgtgagcgcccggcc

SEQ ID NO: 524920 - DNA, 25 bp, Rattus norvegicus
catcggcatctggttccacatccta

SEQ ID NO: 524921 - DNA, 25 bp, Rattus norvegicus
cgcaagtttgtgtgcgagtaccggc

SEQ ID NO: 524922 - DNA, 25 bp, Rattus norvegicus
agatccgcctggatgcgcgcaagtt

SEQ ID NO: 524923 - DNA, 25 bp, Rattus norvegicus
tcaacaactgggtggagatccgcct

SEQ ID NO: 524924 - DNA, 25 bp, Rattus norvegicus
tgacctgcgtggcttcctcaatttc

SEQ ID NO: 524925 - DNA, 25 bp, Rattus norvegicus
gtcctcctgtgaccacgtagccaga

SEQ ID NO: 524926 - DNA, 25 bp, Rattus norvegicus
ctggggcgcatccaagtagtactag

SEQ ID NO: 524927 - DNA, 25 bp, Rattus norvegicus
gccatgcgcagagtgacacgtagcg

SEQ ID NO: 524928 - DNA, 25 bp, Rattus norvegicus
cccgggtaaagatctcagcttgacg

SEQ ID NO: 524929 - DNA, 25 bp, Rattus norvegicus
ttgacgcgaactagggcgccactga

SEQ ID NO: 524930 - DNA, 25 bp, Rattus norvegicus
ctgacctagctaggtccggtccaca

SEQ ID NO: 524931 - DNA, 25 bp, Rattus norvegicus
tgggaaagtttctgcgctccagcgc

SEQ ID NO: 524932 - DNA, 25 bp, Rattus norvegicus
gcccgatcctcactcgtgagtgtga

SEQ ID NO: 524933 - DNA, 25 bp, Rattus norvegicus
tgagtgtgaccacccgagagtctgt

SEQ ID NO: 524934 - DNA, 25 bp, Rattus norvegicus
ccctgcctttcatccaaattcggta

SEQ ID NO: 524935 - DNA, 25 bp, Rattus norvegicus
gggacaggcttaaagggacagtatc

SEQ ID NO: 524936 - DNA, 25 bp, Rattus norvegicus
atgtatttttcacccatggaccctg

SEQ ID NO: 524937 - DNA, 25 bp, Rattus norvegicus
cgctgctatatagggcggaggctcc

SEQ ID NO: 524938 - DNA, 25 bp, Rattus norvegicus
gacagtatcctgttcggcctccctg

SEQ ID NO: 524939 - DNA, 25 bp, Rattus norvegicus
gccgctcaggctgtgataacgagta

SEQ ID NO: 524940 - DNA, 25 bp, Rattus norvegicus
tccctttgaggacaactggacaggc

SEQ ID NO: 524941 - DNA, 25 bp, Rattus norvegicus
cgggatgacagcctgccatagagac

SEQ ID NO: 524942 - DNA, 25 bp, Rattus norvegicus
ccaagctcataaggtaggaactgtg

SEQ ID NO: 524943 - DNA, 25 bp, Rattus norvegicus
acggcgcgatgacgcaatctgttcg

SEQ ID NO: 524944 - DNA, 25 bp, Rattus norvegicus
ctctatatggccaaccgccgtggga

SEQ ID NO: 524945 - DNA, 25 bp, Rattus norvegicus
ccgtccagaggaagtgctagagttc

SEQ ID NO: 524946 - DNA, 25 bp, Rattus norvegicus
tggggcaatgtgaacccactgtcgc

SEQ ID NO: 524947 - DNA, 25 bp, Rattus norvegicus
ggatcctgtccacgcttgcgctctg

SEQ ID NO: 524948 - DNA, 25 bp, Rattus norvegicus
cattctctggcgtgttagcgggtaa

SEQ ID NO: 524949 - DNA, 25 bp, Rattus norvegicus
tgggctcacgaccacacaggaaggc

SEQ ID NO: 524950 - DNA, 25 bp, Rattus norvegicus
cccagggacaagcaccactctatgg

SEQ ID NO: 524951 - DNA, 25 bp, Rattus norvegicus
gcgcgtagccaataccgggatgaca

SEQ ID NO: 524952 - DNA, 25 bp, Rattus norvegicus
ggttgtctctcgctctcagtggaca

SEQ ID NO: 524953 - DNA, 25 bp, Rattus norvegicus
gggcagccaagaccgtgcagtctct

SEQ ID NO: 524954 - DNA, 25 bp, Rattus norvegicus
aggcgatggggaaacggtacattat

SEQ ID NO: 524955 - DNA, 25 bp, Rattus norvegicus
agtccggaccaacccgaggtgcgag

SEQ ID NO: 524956 - DNA, 25 bp, Rattus norvegicus
cgagcctagcctaaagtccggacca

SEQ ID NO: 524957 - DNA, 25 bp, Rattus norvegicus
tcaccggaagtgaacgagcctagcc

SEQ ID NO: 524958 - DNA, 25 bp, Rattus norvegicus
cggtacattatttctagaggtggtg

SEQ ID NO: 524959 - DNA, 25 bp, Rattus norvegicus
ccgactgtctttaggaaggcgatgg

SEQ ID NO: 524960 - DNA, 25 bp, Rattus norvegicus
ccctatagggccgactgtctttagg

SEQ ID NO: 524961 - DNA, 25 bp, Rattus norvegicus
cgtcttgctccctgacgcggtggca

SEQ ID NO: 524962 - DNA, 25 bp, Rattus norvegicus
tctttaatggccaattgctgcagtc

SEQ ID NO: 524963 - DNA, 25 bp, Rattus norvegicus
cgaggcaccgctaagggagagactt

SEQ ID NO: 524964 - DNA, 25 bp, Rattus norvegicus
tgcagtctctggcagaagcccaagg

SEQ ID NO: 524965 - DNA, 25 bp, Rattus norvegicus
gtggcatcctcgcatgctgccttca

SEQ ID NO: 524966 - DNA, 25 bp, Rattus norvegicus
gagagacttggttcctcgctggagc

SEQ ID NO: 524967 - DNA, 25 bp, Rattus norvegicus
ctggcgcacaaacatcacatcgttg

SEQ ID NO: 524968 - DNA, 25 bp, Rattus norvegicus
cttgcgctgcatcttggcgcattca

SEQ ID NO: 524969 - DNA, 25 bp, Rattus norvegicus
tggctgcccaacgtcatgtgctgca

SEQ ID NO: 524970 - DNA, 25 bp, Rattus norvegicus
tcttctggatcttggccttgccctt

SEQ ID NO: 524971 - DNA, 25 bp, Rattus norvegicus
tgcttgcgcctttccagcttcttct

SEQ ID NO: 524972 - DNA, 25 bp, Rattus norvegicus
ccatcctcggagaccttgaaggtgc

SEQ ID NO: 524973 - DNA, 25 bp, Rattus norvegicus
catcacatcgttgcccagctgcagg

SEQ ID NO: 524974 - DNA, 25 bp, Rattus norvegicus
aacatgtccctgagtggggcacggc

SEQ ID NO: 524975 - DNA, 25 bp, Rattus norvegicus
ctcgtccgagaggaacatgtccctg

SEQ ID NO: 524976 - DNA, 25 bp, Rattus norvegicus
ggcctgaatcggtgctgacctccga

SEQ ID NO: 524977 - DNA, 25 bp, Rattus norvegicus
taaacaaggagtcgtggcctgaatc

SEQ ID NO: 524978 - DNA, 25 bp, Rattus norvegicus
cttcgaaacaccatggtacccaggc

SEQ ID NO: 524979 - DNA, 25 bp, Rattus norvegicus
cgctgctcacatagttccttcgaaa

SEQ ID NO: 524980 - DNA, 25 bp, Rattus norvegicus
gcccgagagcgatcgcacgcttttg

SEQ ID NO: 524981 - DNA, 25 bp, Rattus norvegicus
ctgctttgcagcttggagactttcc

SEQ ID NO: 524982 - DNA, 25 bp, Rattus norvegicus
ccgtcaatttctgggaactcgctcc

SEQ ID NO: 524983 - DNA, 25 bp, Rattus norvegicus
agtcctttagtcctcggcattttgc

SEQ ID NO: 524984 - DNA, 25 bp, Rattus norvegicus
tcgctccgcaggatatcggcgcaag

SEQ ID NO: 524985 - DNA, 25 bp, Rattus norvegicus
atgttcactcgggatccagcctgcg

SEQ ID NO: 524986 - DNA, 25 bp, Rattus norvegicus
ttcgtcccaaggagcatgcgcacgg

SEQ ID NO: 524987 - DNA, 25 bp, Rattus norvegicus
ctgcgcagttccagttttgcgtata

SEQ ID NO: 524988 - DNA, 25 bp, Rattus norvegicus
tttgcgtatacgttaaccacctgta

SEQ ID NO: 524989 - DNA, 25 bp, Rattus norvegicus
cctgtaagggttttcgctgtctgca

SEQ ID NO: 524990 - DNA, 25 bp, Rattus norvegicus
cgctgtctgcaaagtgtaggttgta

SEQ ID NO: 524991 - DNA, 25 bp, Rattus norvegicus
gcgtggtagagtcacccaaggttta

SEQ ID NO: 524992 - DNA, 25 bp, Rattus norvegicus
agtcgaagacctgcccgtcaatttc

SEQ ID NO: 524993 - DNA, 25 bp, Rattus norvegicus
tcccgcctagactcagggtatcgtg

SEQ ID NO: 524994 - DNA, 25 bp, Rattus norvegicus
ccaaggtttatcatagcggggagca

SEQ ID NO: 524995 - DNA, 25 bp, Rattus norvegicus
ccacagcgttctcaggtcctaaagc

SEQ ID NO: 524996 - DNA, 25 bp, Rattus norvegicus
ggctggccgtccaccagagaaagtc

SEQ ID NO: 524997 - DNA, 25 bp, Rattus norvegicus
cccgccgtgccaaagtgaagactaa

SEQ ID NO: 524998 - DNA, 25 bp, Rattus norvegicus
aagtcccgcccaatgcctacgtagg

SEQ ID NO: 524999 - DNA, 25 bp, Rattus norvegicus
agagaaagtccacgcccggctctga

SEQ ID NO: 525000 - DNA, 25 bp, Rattus norvegicus
ccaatcagcgctaggtgctgcgctc

SEQ ID NO: 525001 - DNA, 25 bp, Rattus norvegicus
gcttctgactttctggcgctcactc

SEQ ID NO: 525002 - DNA, 25 bp, Rattus norvegicus
cccagcgtgtagagccctgttgcac

SEQ ID NO: 525003 - DNA, 25 bp, Rattus norvegicus
gaattcgcggctctcctaagtccca

SEQ ID NO: 525004 - DNA, 25 bp, Rattus norvegicus
ttgttccgaagctgcatccaagacg

SEQ ID NO: 525005 - DNA, 25 bp, Rattus norvegicus
gtagtcctcccttgttccgaagctg

SEQ ID NO: 525006 - DNA, 25 bp, Rattus norvegicus
cagagtcccaagtctggggtagtcc

SEQ ID NO: 525007 - DNA, 25 bp, Rattus norvegicus
gtagggcccactcgcgttccagagt

SEQ ID NO: 525008 - DNA, 25 bp, Rattus norvegicus
agctcctcacagaatccgcgtttga

SEQ ID NO: 525009 - DNA, 25 bp, Rattus norvegicus
tgacgtgaccagtccgtcgcagccg

SEQ ID NO: 525010 - DNA, 25 bp, Rattus norvegicus
tcagactacatgtcccaggagaaca

SEQ ID NO: 525011 - DNA, 25 bp, Rattus norvegicus
aagtggacaaatccgctccgacgcc

SEQ ID NO: 525012 - DNA, 25 bp, Rattus norvegicus
ggccagagctacaacggcccgaaga

SEQ ID NO: 525013 - DNA, 25 bp, Rattus norvegicus
gaaccttgagagacaacccgggctg

SEQ ID NO: 525014 - DNA, 25 bp, Rattus norvegicus
cgccacagactagatccgaaccttg

SEQ ID NO: 525015 - DNA, 25 bp, Rattus norvegicus
cgtgtggagaggcaataatacgcca

SEQ ID NO: 525016 - DNA, 25 bp, Rattus norvegicus
ggccctgatggcgtcagactacatg

SEQ ID NO: 525017 - DNA, 25 bp, Rattus norvegicus
acgcaagtgctctgaggccctgatg

SEQ ID NO: 525018 - DNA, 25 bp, Rattus norvegicus
gtaggcttcggagttacgcaagtgc

SEQ ID NO: 525019 - DNA, 25 bp, Rattus norvegicus
ccaggcacgcaaaattgagactaca

SEQ ID NO: 525020 - DNA, 25 bp, Rattus norvegicus
acggcggctcacaccgcaattcggt

SEQ ID NO: 525021 - DNA, 25 bp, Rattus norvegicus
tgcaagaaaccgcaggccgctgggt

SEQ ID NO: 525022 - DNA, 25 bp, Rattus norvegicus
caacattcaggcgaggcccgctggc

SEQ ID NO: 525023 - DNA, 25 bp, Rattus norvegicus
tcgctgcggagatcatggacgcctt

SEQ ID NO: 525024 - DNA, 25 bp, Rattus norvegicus
cgagcgggtcctgaaaccagaactc

SEQ ID NO: 525025 - DNA, 25 bp, Rattus norvegicus
gtagcaccatgggaacggcgacacc

SEQ ID NO: 525026 - DNA, 25 bp, Rattus norvegicus
caaacactggttctgcgaggtacgc

SEQ ID NO: 525027 - DNA, 25 bp, Rattus norvegicus
ccttccttaggaccggactcgcttg

SEQ ID NO: 525028 - DNA, 25 bp, Rattus norvegicus
ctccaatctggtcctcgagcctggg

SEQ ID NO: 525029 - DNA, 25 bp, Rattus norvegicus
gggcgctgtgaccaaagaacctatt

SEQ ID NO: 525030 - DNA, 25 bp, Rattus norvegicus
agaggctagcagaaaccggcccttt

SEQ ID NO: 525031 - DNA, 25 bp, Rattus norvegicus
ccagccgacctcctgtgaggtttga

SEQ ID NO: 525032 - DNA, 25 bp, Rattus norvegicus
tggtggcccaggctaaagcactagg

SEQ ID NO: 525033 - DNA, 25 bp, Rattus norvegicus
tgccgtttccttagaaggcgaagcc

SEQ ID NO: 525034 - DNA, 25 bp, Rattus norvegicus
atggacgcctttgatcgctcgccca

SEQ ID NO: 525035 - DNA, 25 bp, Rattus norvegicus
ctcgcccacagacaaggagctggtg

SEQ ID NO: 525036 - DNA, 25 bp, Rattus norvegicus
gatcccggccgaactcaagtctgtt

SEQ ID NO: 525037 - DNA, 25 bp, Rattus norvegicus
cttcccgtcgctgtgtcgcgcagta

SEQ ID NO: 525038 - DNA, 25 bp, Rattus norvegicus
cttgccctgcctgttggaacagttc

SEQ ID NO: 525039 - DNA, 25 bp, Rattus norvegicus
ggattaacctgagaacgcgccctag

SEQ ID NO: 525040 - DNA, 25 bp, Rattus norvegicus
ccgtaccgagacatgcgcgggtgac

SEQ ID NO: 525041 - DNA, 25 bp, Rattus norvegicus
tgttggaacagttcacggccgcgca

SEQ ID NO: 525042 - DNA, 25 bp, Rattus norvegicus
cgggtgactgtctgtacggaaagat

SEQ ID NO: 525043 - DNA, 25 bp, Rattus norvegicus
gagacagcgcgtttctcgcccttgc

SEQ ID NO: 525044 - DNA, 25 bp, Rattus norvegicus
cacagttgcactcggctagtcggtc

SEQ ID NO: 525045 - DNA, 25 bp, Rattus norvegicus
aggtcacaaagctccacgactcgtc

SEQ ID NO: 525046 - DNA, 25 bp, Rattus norvegicus
agcggtccgagccaaggtcacaaag

SEQ ID NO: 525047 - DNA, 25 bp, Rattus norvegicus
agcccaaatcagtgcgacgcccgtt

SEQ ID NO: 525048 - DNA, 25 bp, Rattus norvegicus
tactcctgaaattggcagcgccagc

SEQ ID NO: 525049 - DNA, 25 bp, Rattus norvegicus
cgcgccctagcagaatactcctgaa

SEQ ID NO: 525050 - DNA, 25 bp, Rattus norvegicus
cagatcaccattgcgggcctcggtc

SEQ ID NO: 525051 - DNA, 25 bp, Rattus norvegicus
acctactagggttttgcgggctctg

SEQ ID NO: 525052 - DNA, 25 bp, Rattus norvegicus
ttcttatcactcacacacatgcgcg

SEQ ID NO: 525053 - DNA, 25 bp, Rattus norvegicus
aggcactgcgtggtcttgccagcac

SEQ ID NO: 525054 - DNA, 25 bp, Rattus norvegicus
gcgcaccagggaaacgcagcagctc

SEQ ID NO: 525055 - DNA, 25 bp, Rattus norvegicus
acagctccagccaacctttcaggtt

SEQ ID NO: 525056 - DNA, 25 bp, Rattus norvegicus
tctaagcgcgctactggacggtttt

SEQ ID NO: 525057 - DNA, 25 bp, Rattus norvegicus
tcccgccaatgttagctgcagcaga

SEQ ID NO: 525058 - DNA, 25 bp, Rattus norvegicus
gctctggtcacgtggaagttctaga

SEQ ID NO: 525059 - DNA, 25 bp, Rattus norvegicus
gcgcgcacacgagccatcttatgat

SEQ ID NO: 525060 - DNA, 25 bp, Rattus norvegicus
gagcgaacgcctactccaggaactt

SEQ ID NO: 525061 - DNA, 25 bp, Rattus norvegicus
ccgcttccggacatgacgcaatcta

SEQ ID NO: 525062 - DNA, 25 bp, Rattus norvegicus
actgaagactgcagggaaccgcttc

SEQ ID NO: 525063 - DNA, 25 bp, Rattus norvegicus
cggacgcacctcttccggctggaag

SEQ ID NO: 525064 - DNA, 25 bp, Rattus norvegicus
tcaaattttctttcctctaagcgcg

SEQ ID NO: 525065 - DNA, 25 bp, Rattus norvegicus
agggcaccatcagggattggaaatc

SEQ ID NO: 525066 - DNA, 25 bp, Rattus norvegicus
tgcgtggcttcttcacgaagtgcta

SEQ ID NO: 525067 - DNA, 25 bp, Rattus norvegicus
aagtgctagtcagcgtggccacgcc

SEQ ID NO: 525068 - DNA, 25 bp, Rattus norvegicus
cctcgggactagacagccacaaaga

SEQ ID NO: 525069 - DNA, 25 bp, Rattus norvegicus
cgatgttaaccgatgccggagagga

SEQ ID NO: 525070 - DNA, 25 bp, Rattus norvegicus
gcgccaattccaggtgcgtcacgga

SEQ ID NO: 525071 - DNA, 25 bp, Rattus norvegicus
gcctagagctcgacagggcaccatc

SEQ ID NO: 525072 - DNA, 25 bp, Rattus norvegicus
cggctggagccagagaagtaccttc

SEQ ID NO: 525073 - DNA, 25 bp, Rattus norvegicus
ttgcaaactgcgaatcgagcccatc

SEQ ID NO: 525074 - DNA, 25 bp, Rattus norvegicus
cggagcacgcggctcatgaatagtg

SEQ ID NO: 525075 - DNA, 25 bp, Rattus norvegicus
ttggagcactatctggacagtaagc

SEQ ID NO: 525076 - DNA, 25 bp, Rattus norvegicus
agtaagcactctggccgagccgcca

SEQ ID NO: 525077 - DNA, 25 bp, Rattus norvegicus
tggcgactgccatgtacttggagca

SEQ ID NO: 525078 - DNA, 25 bp, Rattus norvegicus
gcgtggagccagcacacgtgcaagc

SEQ ID NO: 525079 - DNA, 25 bp, Rattus norvegicus
agcggaagccgcagccaaatagagc

SEQ ID NO: 525080 - DNA, 25 bp, Rattus norvegicus
actcggtgtttgcactcggacggaa

SEQ ID NO: 525081 - DNA, 25 bp, Rattus norvegicus
ctagcggaggcctacggttgtgcaa

SEQ ID NO: 525082 - DNA, 25 bp, Rattus norvegicus
cacagatcaggtgcgagccgagatg

SEQ ID NO: 525083 - DNA, 25 bp, Rattus norvegicus
tacacccacgggctgcaattggctg

SEQ ID NO: 525084 - DNA, 25 bp, Rattus norvegicus
gaatgcaaatagttgctcctctttg

SEQ ID NO: 525085 - DNA, 25 bp, Rattus norvegicus
ggcacagggcgcatgcgcaatctgt

SEQ ID NO: 525086 - DNA, 25 bp, Rattus norvegicus
caatctgtgcgcatgtcgtgctgtg

SEQ ID NO: 525087 - DNA, 25 bp, Rattus norvegicus
tgctgtgtttttccgtctcaggtaa

SEQ ID NO: 525088 - DNA, 25 bp, Rattus norvegicus
ctcctctttgacgtcacggcacagg

SEQ ID NO: 525089 - DNA, 25 bp, Rattus norvegicus
cagtccgggctgtggcctgtcaaat

SEQ ID NO: 525090 - DNA, 25 bp, Rattus norvegicus
ggcctgtcaaatgatggcacagatc

SEQ ID NO: 525091 - DNA, 25 bp, Rattus norvegicus
tccgtctcaggtaaagcggaagccg

SEQ ID NO: 525092 - DNA, 25 bp, Rattus norvegicus
ggatactcgcactgcttctcaccta

SEQ ID NO: 525093 - DNA, 25 bp, Rattus norvegicus
agagccaggagcgtgtcaaacactg

SEQ ID NO: 525094 - DNA, 25 bp, Rattus norvegicus
cagctggatgacatcgcgtccttca

SEQ ID NO: 525095 - DNA, 25 bp, Rattus norvegicus
cccagctgacgtggactatgttcgc

SEQ ID NO: 525096 - DNA, 25 bp, Rattus norvegicus
aagtgccttgcaaaggtggagcagc

SEQ ID NO: 525097 - DNA, 25 bp, Rattus norvegicus
gcagcgattccatctggtgctcatc

SEQ ID NO: 525098 - DNA, 25 bp, Rattus norvegicus
ggactatgttcgcaagtgccttgca

SEQ ID NO: 525099 - DNA, 25 bp, Rattus norvegicus
gtcaaacactggtgcgcgctggact

SEQ ID NO: 525100 - DNA, 25 bp, Rattus norvegicus
ggactggcacctctacgagcatttc

SEQ ID NO: 525101 - DNA, 25 bp, Rattus norvegicus
cgcagactactttgacgagtctatg

SEQ ID NO: 525102 - DNA, 25 bp, Rattus norvegicus
acctgacgcccgagagccaggagcg

SEQ ID NO: 525103 - DNA, 25 bp, Rattus norvegicus
acgagtctatggtgttgctgcgcag

SEQ ID NO: 525104 - DNA, 25 bp, Rattus norvegicus
acgtgcgcagccagagtaccatctc

SEQ ID NO: 525105 - DNA, 25 bp, Rattus norvegicus
gcgtccttcaagctgaacgtgcgca

SEQ ID NO: 525106 - DNA, 25 bp, Rattus norvegicus
tggtgctcatcgcagactactttga

SEQ ID NO: 525107 - DNA, 25 bp, Rattus norvegicus
tggtgctaccgtcgactgtgcccag

SEQ ID NO: 525108 - DNA, 25 bp, Rattus norvegicus
gctggtgtacttcgtggtcaggacc

SEQ ID NO: 525109 - DNA, 25 bp, Rattus norvegicus
tagcgacaagcccatgacccaaagg

SEQ ID NO: 525110 - DNA, 25 bp, Rattus norvegicus
gccgtgagtcccaatcctagcgaca

SEQ ID NO: 525111 - DNA, 25 bp, Rattus norvegicus
gagaaagctctctgggtggcagcct

SEQ ID NO: 525112 - DNA, 25 bp, Rattus norvegicus
gagagccgcaatggcagcattcccg

SEQ ID NO: 525113 - DNA, 25 bp, Rattus norvegicus
ggtgcaggagtccaagcctctcgaa

SEQ ID NO: 525114 - DNA, 25 bp, Rattus norvegicus
cgcgctgaaccagtccgtggtgcta

SEQ ID NO: 525115 - DNA, 25 bp, Rattus norvegicus
acttcctggcctcggctttcgtgct

SEQ ID NO: 525116 - DNA, 25 bp, Rattus norvegicus
ctacatattagcaaccggaggcgtc

SEQ ID NO: 525117 - DNA, 25 bp, Rattus norvegicus
ccacgcgtgcgcaataggctcgaac

SEQ ID NO: 525118 - DNA, 25 bp, Rattus norvegicus
ggctcgaacaccctgacgtcactga

SEQ ID NO: 525119 - DNA, 25 bp, Rattus norvegicus
cgcgaggccaagctcagtctgaagg

SEQ ID NO: 525120 - DNA, 25 bp, Rattus norvegicus
gagatgtacgaacttccggttgtcc

SEQ ID NO: 525121 - DNA, 25 bp, Rattus norvegicus
ctaggagagtaacgtcgcgagctcc

SEQ ID NO: 525122 - DNA, 25 bp, Rattus norvegicus
gtcaaggctccagatccgctagctt

SEQ ID NO: 525123 - DNA, 25 bp, Rattus norvegicus
ctaggacgcccaaacgtcaaggctc

SEQ ID NO: 525124 - DNA, 25 bp, Rattus norvegicus
caggatcacaccgtctcctaggacg

SEQ ID NO: 525125 - DNA, 25 bp, Rattus norvegicus
acgcggacgcgttctcgggcacaac

SEQ ID NO: 525126 - DNA, 25 bp, Rattus norvegicus
ggaagctcacagtcgcacgcggacg

SEQ ID NO: 525127 - DNA, 25 bp, Rattus norvegicus
gcgagctccgtctgcactattgcct

SEQ ID NO: 525128 - DNA, 25 bp, Rattus norvegicus
aaatgataagcaaggccagccaatc

SEQ ID NO: 525129 - DNA, 25 bp, Rattus norvegicus
tcctcgccgtagcagggaaatgata

SEQ ID NO: 525130 - DNA, 25 bp, Rattus norvegicus
caaatgtgacaccttgtgcatcgga

SEQ ID NO: 525131 - DNA, 25 bp, Rattus norvegicus
cggtggagctctcccggttctccag

SEQ ID NO: 525132 - DNA, 25 bp, Rattus norvegicus
ccagaatcaggtcgctaggacgttc

SEQ ID NO: 525133 - DNA, 25 bp, Rattus norvegicus
cgtggagccgagatcccagaatcag

SEQ ID NO: 525134 - DNA, 25 bp, Rattus norvegicus
gcactattgcctggggaggaagctc

SEQ ID NO: 525135 - DNA, 25 bp, Rattus norvegicus
catccgagtgccctaagtctagcaa

SEQ ID NO: 525136 - DNA, 25 bp, Rattus norvegicus
acgactgcctcagtgcgtcttgctg

SEQ ID NO: 525137 - DNA, 25 bp, Rattus norvegicus
ggctctaggattccggcccgagtct

SEQ ID NO: 525138 - DNA, 25 bp, Rattus norvegicus
taccgacagccttcgagacagagtc

SEQ ID NO: 525139 - DNA, 25 bp, Rattus norvegicus
cgtcttgctggcaacacgggtcatg

SEQ ID NO: 525140 - DNA, 25 bp, Rattus norvegicus
gctttcaagctgacacatccgagtg

SEQ ID NO: 525141 - DNA, 25 bp, Rattus norvegicus
gtcccgtcagtctccgaagctttca

SEQ ID NO: 525142 - DNA, 25 bp, Rattus norvegicus
tggccactctcggatcccaagatgt

SEQ ID NO: 525143 - DNA, 25 bp, Rattus norvegicus
agcttcccagctcacctggagtcag

SEQ ID NO: 525144 - DNA, 25 bp, Rattus norvegicus
ggatctctaagtcaagcttcccagc

SEQ ID NO: 525145 - DNA, 25 bp, Rattus norvegicus
cgccgcccggtaaggatctctaagt

SEQ ID NO: 525146 - DNA, 25 bp, Rattus norvegicus
gggcagttttccacccagcacagtg

SEQ ID NO: 525147 - DNA, 25 bp, Rattus norvegicus
cccggagacgcccagcgggttactg

SEQ ID NO: 525148 - DNA, 25 bp, Rattus norvegicus
cttcgagacagagtcgacgactgcc

SEQ ID NO: 525149 - DNA, 25 bp, Rattus norvegicus
gcaagcccggcctgccgtagcggtt

SEQ ID NO: 525150 - DNA, 25 bp, Rattus norvegicus
ctcggtccttctctcccactcgcct

SEQ ID NO: 525151 - DNA, 25 bp, Rattus norvegicus
ccactcgcctcctccgaggctctgg

SEQ ID NO: 525152 - DNA, 25 bp, Rattus norvegicus
gccggcccgagagcccgcttccatt

SEQ ID NO: 525153 - DNA, 25 bp, Rattus norvegicus
cgcttccatttgcacccgggcggtt

SEQ ID NO: 525154 - DNA, 25 bp, Rattus norvegicus
ggctccctgggcctcatccgggcct

SEQ ID NO: 525155 - DNA, 25 bp, Rattus norvegicus
ggagcgctttttgtgttttggtgat

SEQ ID NO: 525156 - DNA, 25 bp, Rattus norvegicus
cgacccagagggcttctcagggtcc

SEQ ID NO: 525157 - DNA, 25 bp, Rattus norvegicus
actggaggacgctaagatggcgctg

SEQ ID NO: 525158 - DNA, 25 bp, Rattus norvegicus
gccatcttccctcgtggcgcgggcg

SEQ ID NO: 525159 - DNA, 25 bp, Rattus norvegicus
tggaagctcggcctatgccaggagc

SEQ ID NO: 525160 - DNA, 25 bp, Rattus norvegicus
ctcggcctatgccaggagccgcgga

SEQ ID NO: 525161 - DNA, 25 bp, Rattus norvegicus
ccgcggagacccgtgcgaccaccac

SEQ ID NO: 525162 - DNA, 25 bp, Rattus norvegicus
cccgccgcacccgtccgcggagaga

SEQ ID NO: 525163 - DNA, 25 bp, Rattus norvegicus
cactatctcggatgcgagggcggca

SEQ ID NO: 525164 - DNA, 25 bp, Rattus norvegicus
acgaatgccgggttctcgactccct

SEQ ID NO: 525165 - DNA, 25 bp, Rattus norvegicus
ccctgcatggtcaagaaaggttctc

SEQ ID NO: 525166 - DNA, 25 bp, Rattus norvegicus
aaggttctctagactcctgtgtgtg

SEQ ID NO: 525167 - DNA, 25 bp, Rattus norvegicus
gtgatcggcgaaaggctggtttctt

SEQ ID NO: 525168 - DNA, 25 bp, Rattus norvegicus
gtgacagcgccctagggctggacta

SEQ ID NO: 525169 - DNA, 25 bp, Rattus norvegicus
tagggctggactagtctccgcctcc

SEQ ID NO: 525170 - DNA, 25 bp, Rattus norvegicus
cgcagctaccgggacgctcctggag

SEQ ID NO: 525171 - DNA, 25 bp, Rattus norvegicus
agctctgggtcctaggcacctggag

SEQ ID NO: 525172 - DNA, 25 bp, Rattus norvegicus
tgcgccacaccagttgccacaaagg

SEQ ID NO: 525173 - DNA, 25 bp, Rattus norvegicus
gccacaaaggaggaccggagtgctc

SEQ ID NO: 525174 - DNA, 25 bp, Rattus norvegicus
ggtgagagaacagagagacactatc

SEQ ID NO: 525175 - DNA, 25 bp, Rattus norvegicus
tcgactcccttggaaccctgcatgg

SEQ ID NO: 525176 - DNA, 25 bp, Rattus norvegicus
ccgacctcggtcaggtgagagaaca

SEQ ID NO: 525177 - DNA, 25 bp, Rattus norvegicus
actgacgcgggtctgcgcgatagcc

SEQ ID NO: 525178 - DNA, 25 bp, Rattus norvegicus
gggtctgcgcgatagccctcacagc

SEQ ID NO: 525179 - DNA, 25 bp, Rattus norvegicus
gccatgaagtagctgcggccgccag

SEQ ID NO: 525180 - DNA, 25 bp, Rattus norvegicus
ttcccacgcgtcgggagcggaccga

SEQ ID NO: 525181 - DNA, 25 bp, Rattus norvegicus
ctcgcccggggccatgaagtagctg

SEQ ID NO: 525182 - DNA, 25 bp, Rattus norvegicus
ccctggcattgcgagcgataaggac

SEQ ID NO: 525183 - DNA, 25 bp, Rattus norvegicus
ggctggccgcgcatcgccctcgccc

SEQ ID NO: 525184 - DNA, 25 bp, Rattus norvegicus
ggcattgcgagcgataaggaccctg

SEQ ID NO: 525185 - DNA, 25 bp, Rattus norvegicus
ttgcgagcgataaggaccctgctcc

SEQ ID NO: 525186 - DNA, 25 bp, Rattus norvegicus
gagcgataaggaccctgctcctcca

SEQ ID NO: 525187 - DNA, 25 bp, Rattus norvegicus
agagccgcttcccacgcgtcgggag

SEQ ID NO: 525188 - DNA, 25 bp, Rattus norvegicus
tggtcctgcgcggacatggccggac

SEQ ID NO: 525189 - DNA, 25 bp, Rattus norvegicus
ctggcattgcgagcgataaggaccc

SEQ ID NO: 525190 - DNA, 25 bp, Rattus norvegicus
aatgatgactgacgcgggtctgcgc

SEQ ID NO: 525191 - DNA, 25 bp, Rattus norvegicus
tgggctcaggcatctgccacagatc

SEQ ID NO: 525192 - DNA, 25 bp, Rattus norvegicus
cagagcagtcgaagggaaccgtttc

SEQ ID NO: 525193 - DNA, 25 bp, Rattus norvegicus
aagcgccacgcacgagttttgaatg

SEQ ID NO: 525194 - DNA, 25 bp, Rattus norvegicus
tgaatgcagtctagcgttcgccgcc

SEQ ID NO: 525195 - DNA, 25 bp, Rattus norvegicus
cgcctccaggtgtttgctttgtctc

SEQ ID NO: 525196 - DNA, 25 bp, Rattus norvegicus
tgccgaccctagacacgtgctcttg

SEQ ID NO: 525197 - DNA, 25 bp, Rattus norvegicus
ctggaagcctttggacacctcatta

SEQ ID NO: 525198 - DNA, 25 bp, Rattus norvegicus
tcttgcaagagccacaaacggtagc

SEQ ID NO: 525199 - DNA, 25 bp, Rattus norvegicus
gtgacagtacaacccgaggctcctt

SEQ ID NO: 525200 - DNA, 25 bp, Rattus norvegicus
ggaagattcaggtccacgcctccga

SEQ ID NO: 525201 - DNA, 25 bp, Rattus norvegicus
tgggcaccgtgaaacaggaagactc

SEQ ID NO: 525202 - DNA, 25 bp, Rattus norvegicus
tcgcgatttatctggtgctaccgga

SEQ ID NO: 525203 - DNA, 25 bp, Rattus norvegicus
ccatccgcggcgctgtgaagttcaa

SEQ ID NO: 525204 - DNA, 25 bp, Rattus norvegicus
gcggcctctgtacgaacatcctatc

SEQ ID NO: 525205 - DNA, 25 bp, Rattus norvegicus
acgtttgacggggagcgccactcct

SEQ ID NO: 525206 - DNA, 25 bp, Rattus norvegicus
actcctcctgcaaccttttgtgctg

SEQ ID NO: 525207 - DNA, 25 bp, Rattus norvegicus
caaccttttgtgctgcagaggtggc

SEQ ID NO: 525208 - DNA, 25 bp, Rattus norvegicus
cccagtcagcgagccacagtgccag

SEQ ID NO: 525209 - DNA, 25 bp, Rattus norvegicus
tcgcgagtgcagctggtccctcagc

SEQ ID NO: 525210 - DNA, 25 bp, Rattus norvegicus
gagcccgcagcttcctggcacaggg

SEQ ID NO: 525211 - DNA, 25 bp, Rattus norvegicus
ggaggcccattgagaagtagcgctc

SEQ ID NO: 525212 - DNA, 25 bp, Rattus norvegicus
cattgagaagtagcgctcgcccggc

SEQ ID NO: 525213 - DNA, 25 bp, Rattus norvegicus
ccctctggtcccaacggtgtgcgag

SEQ ID NO: 525214 - DNA, 25 bp, Rattus norvegicus
ctggtcccaacggtgtgcgagtcag

SEQ ID NO: 525215 - DNA, 25 bp, Rattus norvegicus
ctgcgggctacagatagcggccaga

SEQ ID NO: 525216 - DNA, 25 bp, Rattus norvegicus
gggctacagatagcggccagagaca

SEQ ID NO: 525217 - DNA, 25 bp, Rattus norvegicus
gacgaccttatctctgtcgcctgtg

SEQ ID NO: 525218 - DNA, 25 bp, Rattus norvegicus
ttgtgatcgaggagcgtctgtagac

SEQ ID NO: 525219 - DNA, 25 bp, Rattus norvegicus
agacaggaagcgcagaagcaccatt

SEQ ID NO: 525220 - DNA, 25 bp, Rattus norvegicus
ttcgccaggatagacaggaagcgca

SEQ ID NO: 525221 - DNA, 25 bp, Rattus norvegicus
gtcgtgcctcttcgccaggatagac

SEQ ID NO: 525222 - DNA, 25 bp, Rattus norvegicus
cctttctcctggatgtcggtcgtgc

SEQ ID NO: 525223 - DNA, 25 bp, Rattus norvegicus
ttgcttgctacctttctcctggatg

SEQ ID NO: 525224 - DNA, 25 bp, Rattus norvegicus
gggtcgcagtctctcttgcttgcta

SEQ ID NO: 525225 - DNA, 25 bp, Rattus norvegicus
ccacactgcgttgggtcgcagtctc

SEQ ID NO: 525226 - DNA, 25 bp, Rattus norvegicus
caagtgcctggccacactgcgttgg

SEQ ID NO: 525227 - DNA, 25 bp, Rattus norvegicus
tagcatgcccggtttcgaaggccgc

SEQ ID NO: 525228 - DNA, 25 bp, Rattus norvegicus
agttgtctcgctcgcacctagcatg

SEQ ID NO: 525229 - DNA, 25 bp, Rattus norvegicus
ttgccacgccctgagagttgtctcg

SEQ ID NO: 525230 - DNA, 25 bp, Rattus norvegicus
gggaaggcgttttgccacgccctga

SEQ ID NO: 525231 - DNA, 25 bp, Rattus norvegicus
agtcctatcggctgctaaccagaca

SEQ ID NO: 525232 - DNA, 25 bp, Rattus norvegicus
agcgagcagcaactgaagtcctatc

SEQ ID NO: 525233 - DNA, 25 bp, Rattus norvegicus
ttacagactgtaagacgaggggcct

SEQ ID NO: 525234 - DNA, 25 bp, Rattus norvegicus
catgatttgcgaagaagcgggcgtt

SEQ ID NO: 525235 - DNA, 25 bp, Rattus norvegicus
gttctgaaaaactaccacggcgtca

SEQ ID NO: 525236 - DNA, 25 bp, Rattus norvegicus
tcggtgtgtgggaagcgattttaaa

SEQ ID NO: 525237 - DNA, 25 bp, Rattus norvegicus
aataacgctgttcgttcggtgtgtg

SEQ ID NO: 525238 - DNA, 25 bp, Rattus norvegicus
aagtgcctaccctggtcgtggctca

SEQ ID NO: 525239 - DNA, 25 bp, Rattus norvegicus
gggcgttgccgcacgagtaacagaa

SEQ ID NO: 525240 - DNA, 25 bp, Rattus norvegicus
ttaaataatacccaacgagctcggc

SEQ ID NO: 525241 - DNA, 25 bp, Rattus norvegicus
atccgcgcttcatgatttgcgaaga

SEQ ID NO: 525242 - DNA, 25 bp, Rattus norvegicus
gccgggtaaaatccgcgcttcatga

SEQ ID NO: 525243 - DNA, 25 bp, Rattus norvegicus
ggcctgcgatctgccgggtaaaatc

SEQ ID NO: 525244 - DNA, 25 bp, Rattus norvegicus
tcgtggctcagctcaagacaaaaac

SEQ ID NO: 525245 - DNA, 25 bp, Rattus norvegicus
cggcgtcagtaacgaagtgcctacc

SEQ ID NO: 525246 - DNA, 25 bp, Rattus norvegicus
cgcacgagtaacagaaaataacgct

SEQ ID NO: 525247 - DNA, 25 bp, Rattus norvegicus
cggaatcagaagaatccgctggccc

SEQ ID NO: 525248 - DNA, 25 bp, Rattus norvegicus
ccctcgcctagagcgttagatgcgc

SEQ ID NO: 525249 - DNA, 25 bp, Rattus norvegicus
ggtgggaaacggaatcagaagaatc

SEQ ID NO: 525250 - DNA, 25 bp, Rattus norvegicus
agagccggaggcactagaaagggct

SEQ ID NO: 525251 - DNA, 25 bp, Rattus norvegicus
gcgttcttggagaaatctgctcttc

SEQ ID NO: 525252 - DNA, 25 bp, Rattus norvegicus
atttataacggagcgagagccggag

SEQ ID NO: 525253 - DNA, 25 bp, Rattus norvegicus
cctcggaatttataacggagcgaga

SEQ ID NO: 525254 - DNA, 25 bp, Rattus norvegicus
gactgaccctcgtcaaccgaggaaa

SEQ ID NO: 525255 - DNA, 25 bp, Rattus norvegicus
tgctgactgaccctcgtcaaccgag

SEQ ID NO: 525256 - DNA, 25 bp, Rattus norvegicus
cgcctagagcgttagatgcgccaca

SEQ ID NO: 525257 - DNA, 25 bp, Rattus norvegicus
gaaatctgctcttcgtccctgctga

SEQ ID NO: 525258 - DNA, 25 bp, Rattus norvegicus
agagcgttagatgcgccacaaccac

SEQ ID NO: 525259 - DNA, 25 bp, Rattus norvegicus
gatcctgagcgttcttggagaaatc

SEQ ID NO: 525260 - DNA, 25 bp, Rattus norvegicus
tctgctcttcgtccctgctgactga

SEQ ID NO: 525261 - DNA, 25 bp, Rattus norvegicus
aacatcacgcctagccagcggcaga

SEQ ID NO: 525262 - DNA, 25 bp, Rattus norvegicus
gaacacacacatccagagcaccaga

SEQ ID NO: 525263 - DNA, 25 bp, Rattus norvegicus
ggcgtcctggaactgcccaaagccg

SEQ ID NO: 525264 - DNA, 25 bp, Rattus norvegicus
atcacaagacggagagacgcgtgcg

SEQ ID NO: 525265 - DNA, 25 bp, Rattus norvegicus
tacccggaggtgctcagaagaaggt

SEQ ID NO: 525266 - DNA, 25 bp, Rattus norvegicus
agcccgggtcctggctgaacacaca

SEQ ID NO: 525267 - DNA, 25 bp, Rattus norvegicus
agcaccagaaagagcagcgtcaaca

SEQ ID NO: 525268 - DNA, 25 bp, Rattus norvegicus
agcgtcaacatctccacgtgcaaca

SEQ ID NO: 525269 - DNA, 25 bp, Rattus norvegicus
gagagcggacgccaaataaatagga

SEQ ID NO: 525270 - DNA, 25 bp, Rattus norvegicus
gctgcacagtcaccgggagttgagc

SEQ ID NO: 525271 - DNA, 25 bp, Rattus norvegicus
cccgctttgctccaagttactttgg

SEQ ID NO: 525272 - DNA, 25 bp, Rattus norvegicus
tccaagttactttggcggccggaga

SEQ ID NO: 525273 - DNA, 25 bp, Rattus norvegicus
cccggcaagccttgctggagtcctg

SEQ ID NO: 525274 - DNA, 25 bp, Rattus norvegicus
accttacctggggttgctgctgttc

SEQ ID NO: 525275 - DNA, 25 bp, Rattus norvegicus
cttgcaaaccatctcgaggaccgtg

SEQ ID NO: 525276 - DNA, 25 bp, Rattus norvegicus
acatgctttgcccagggagccggga

SEQ ID NO: 525277 - DNA, 25 bp, Rattus norvegicus
gcggttacgcggttccttcgagaga

SEQ ID NO: 525278 - DNA, 25 bp, Rattus norvegicus
cttccgcttgcaaaccatctcgagg

SEQ ID NO: 525279 - DNA, 25 bp, Rattus norvegicus
ccatctcgaggaccgtggtgggctc

SEQ ID NO: 525280 - DNA, 25 bp, Rattus norvegicus
ccagctccttgcagcaggacgcggg

SEQ ID NO: 525281 - DNA, 25 bp, Rattus norvegicus
ctccttgcagcaggacgcgggcgac

SEQ ID NO: 525282 - DNA, 25 bp, Rattus norvegicus
tacgcggttccttcgagagaaggtg

SEQ ID NO: 525283 - DNA, 25 bp, Rattus norvegicus
tcgagagaaggtggcccatatagaa

SEQ ID NO: 525284 - DNA, 25 bp, Rattus norvegicus
gagaaggtggcccatatagaaggcc

SEQ ID NO: 525285 - DNA, 25 bp, Rattus norvegicus
ccgcgcacccggcacacgcgacggc

SEQ ID NO: 525286 - DNA, 25 bp, Rattus norvegicus
gctacatgctttgcccagggagccg

SEQ ID NO: 525287 - DNA, 25 bp, Rattus norvegicus
caaaccatctcgaggaccgtggtgg

SEQ ID NO: 525288 - DNA, 25 bp, Rattus norvegicus
cgacgcgggctacatgctttgccca

SEQ ID NO: 525289 - DNA, 25 bp, Rattus norvegicus
agcacgggagccaaggccagagctc

SEQ ID NO: 525290 - DNA, 25 bp, Rattus norvegicus
ttcttgaagagggacgccatggtca

SEQ ID NO: 525291 - DNA, 25 bp, Rattus norvegicus
ctaggtcgggtagaaggacagatcc

SEQ ID NO: 525292 - DNA, 25 bp, Rattus norvegicus
agaaagacagggtctccaagcacga

SEQ ID NO: 525293 - DNA, 25 bp, Rattus norvegicus
tctccaagcacgacctgtggcgggc

SEQ ID NO: 525294 - DNA, 25 bp, Rattus norvegicus
aggctcccgtgaacgcgtcctcggt

SEQ ID NO: 525295 - DNA, 25 bp, Rattus norvegicus
tcaggtgaccgggaactaagacact

SEQ ID NO: 525296 - DNA, 25 bp, Rattus norvegicus
ctaagacactttttggagaagtcac

SEQ ID NO: 525297 - DNA, 25 bp, Rattus norvegicus
agaagtcacttctaggcggcgcctg

SEQ ID NO: 525298 - DNA, 25 bp, Rattus norvegicus
actctgcgagcacgcctgcgcattg

SEQ ID NO: 525299 - DNA, 25 bp, Rattus norvegicus
accgtccacggtcttcttcttgaag

SEQ ID NO: 525300 - DNA, 25 bp, Rattus norvegicus
tggtagccacgcgtccggaccaagg

SEQ ID NO: 525301 - DNA, 25 bp, Rattus norvegicus
agcgctgccctcacttcaaaggctg

SEQ ID NO: 525302 - DNA, 25 bp, Rattus norvegicus
tgcgcattgcgcgtctgaagccgca

SEQ ID NO: 525303 - DNA, 25 bp, Rattus norvegicus
caggccgacggccaagttcggagaa

SEQ ID NO: 525304 - DNA, 25 bp, Rattus norvegicus
tagagtccgctgcacagcctgctcg

SEQ ID NO: 525305 - DNA, 25 bp, Rattus norvegicus
caggttctaggtaggtgcgtttcac

SEQ ID NO: 525306 - DNA, 25 bp, Rattus norvegicus
ggacaagccatttcccggcttcggc

SEQ ID NO: 525307 - DNA, 25 bp, Rattus norvegicus
cgtaggcactgttgcccggggcaac

SEQ ID NO: 525308 - DNA, 25 bp, Rattus norvegicus
ccaagttcggagaagcgtgatcctc

SEQ ID NO: 525309 - DNA, 25 bp, Rattus norvegicus
tgatcctctaggaacgagacctcta

SEQ ID NO: 525310 - DNA, 25 bp, Rattus norvegicus
acgagacctctaagagctggcttca

SEQ ID NO: 525311 - DNA, 25 bp, Rattus norvegicus
taagagctggcttcaaccgggacca

SEQ ID NO: 525312 - DNA, 25 bp, Rattus norvegicus
cgcccgcctcctgggaggtattaga

SEQ ID NO: 525313 - DNA, 25 bp, Rattus norvegicus
ttcattggctgagctctccgggtgc

SEQ ID NO: 525314 - DNA, 25 bp, Rattus norvegicus
ggcgtctattggctgaagcagtccc

SEQ ID NO: 525315 - DNA, 25 bp, Rattus norvegicus
aggggctcctgcttgtcaggttcta

SEQ ID NO: 525316 - DNA, 25 bp, Rattus norvegicus
ggcctcagcttatcacccggacaag

SEQ ID NO: 525317 - DNA, 25 bp, Rattus norvegicus
tgcggaaacacctcgagcctcagga

SEQ ID NO: 525318 - DNA, 25 bp, Rattus norvegicus
accgggccacaagcacttccgggtg

SEQ ID NO: 525319 - DNA, 25 bp, Rattus norvegicus
caggagccggatccgcagacgaaag

SEQ ID NO: 525320 - DNA, 25 bp, Rattus norvegicus
accagatgcaggagctccgccaggg

SEQ ID NO: 525321 - DNA, 25 bp, Rattus norvegicus
caggaatcccttgggcctccatcga

SEQ ID NO: 525322 - DNA, 25 bp, Rattus norvegicus
cagacgaaagtgctccgctccggct

SEQ ID NO: 525323 - DNA, 25 bp, Rattus norvegicus
cctccatcgagttggtaggctgggc

SEQ ID NO: 525324 - DNA, 25 bp, Rattus norvegicus
ctcctcgatggtcggaggctgcgtc

SEQ ID NO: 525325 - DNA, 25 bp, Rattus norvegicus
tcctcgagtctagggcggcagtgca

SEQ ID NO: 525326 - DNA, 25 bp, Rattus norvegicus
cttggacttccgtgggagcagagac

SEQ ID NO: 525327 - DNA, 25 bp, Rattus norvegicus
cctccggatctcagttgcggaaaca

SEQ ID NO: 525328 - DNA, 25 bp, Rattus norvegicus
gagctcctggcccttctggaccaga

SEQ ID NO: 525329 - DNA, 25 bp, Rattus norvegicus
gtcgcagtgatgtggcgtttctcca

SEQ ID NO: 525330 - DNA, 25 bp, Rattus norvegicus
agcagagacaccgtgggttcaccgt

SEQ ID NO: 525331 - DNA, 25 bp, Rattus norvegicus
cctctgcaggggaaaggtacgtatc

SEQ ID NO: 525332 - DNA, 25 bp, Rattus norvegicus
gggaaaataactcgggctgtctctc

SEQ ID NO: 525333 - DNA, 25 bp, Rattus norvegicus
gtgacaatcgggaaggacgcaaata

SEQ ID NO: 525334 - DNA, 25 bp, Rattus norvegicus
aggccagaggcctctcagtcgccaa

SEQ ID NO: 525335 - DNA, 25 bp, Rattus norvegicus
ccctctgacatggagagagaaaaaa

SEQ ID NO: 525336 - DNA, 25 bp, Rattus norvegicus
ctcaccgagatgtgcagcggctcca

SEQ ID NO: 525337 - DNA, 25 bp, Rattus norvegicus
tccagagcgagaacagcgctcgatc

SEQ ID NO: 525338 - DNA, 25 bp, Rattus norvegicus
tcggagcgcagccaatagacttcac

SEQ ID NO: 525339 - DNA, 25 bp, Rattus norvegicus
caatagacttcacggccctctgcag

SEQ ID NO: 525340 - DNA, 25 bp, Rattus norvegicus
tcgctgtccgagaagtaggtttacg

SEQ ID NO: 525341 - DNA, 25 bp, Rattus norvegicus
cgtcatggttggacgtggcagaaaa

SEQ ID NO: 525342 - DNA, 25 bp, Rattus norvegicus
gctgtctctctgcttggctccgcag

SEQ ID NO: 525343 - DNA, 25 bp, Rattus norvegicus
ccctgcagcactgcgacgtttgggc

SEQ ID NO: 525344 - DNA, 25 bp, Rattus norvegicus
aggtacgtatccaatcgctgtccga

SEQ ID NO: 525345 - DNA, 25 bp, Rattus norvegicus
cgcctgcccttgtcgagaaaacttt

SEQ ID NO: 525346 - DNA, 25 bp, Rattus norvegicus
caagtttgtggggacccttgccttg

SEQ ID NO: 525347 - DNA, 25 bp, Rattus norvegicus
gctaccctgcaggagagcaagtttg

SEQ ID NO: 525348 - DNA, 25 bp, Rattus norvegicus
caggagggctccttcccgcaggtaa

SEQ ID NO: 525349 - DNA, 25 bp, Rattus norvegicus
tggacaggggtcacttggactaccc

SEQ ID NO: 525350 - DNA, 25 bp, Rattus norvegicus
tcactctacctgatgctggacaggg

SEQ ID NO: 525351 - DNA, 25 bp, Rattus norvegicus
cagcgcgatcttctgcgtcgtaatc

SEQ ID NO: 525352 - DNA, 25 bp, Rattus norvegicus
gaaaacttttcctgccgactcagtc

SEQ ID NO: 525353 - DNA, 25 bp, Rattus norvegicus
ggcccgagtccatcgaggaaaatga

SEQ ID NO: 525354 - DNA, 25 bp, Rattus norvegicus
cctgggtgtcccagcgctaagttgt

SEQ ID NO: 525355 - DNA, 25 bp, Rattus norvegicus
aggaaagtctcggatctcagcgccc

SEQ ID NO: 525356 - DNA, 25 bp, Rattus norvegicus
gaagtcgggcagagacctctcctct

SEQ ID NO: 525357 - DNA, 25 bp, Rattus norvegicus
cggacgcacgccctgaggaaagtct

SEQ ID NO: 525358 - DNA, 25 bp, Rattus norvegicus
ttaagccgccagttcaccgtgttcg

SEQ ID NO: 525359 - DNA, 25 bp, Rattus norvegicus
ggccaggctcacgattcccgaagct

SEQ ID NO: 525360 - DNA, 25 bp, Rattus norvegicus
cggacgccataggagacagcgcaga

SEQ ID NO: 525361 - DNA, 25 bp, Rattus norvegicus
ccaggatctgctcgtgcttcgccat

SEQ ID NO: 525362 - DNA, 25 bp, Rattus norvegicus
gcctacctttgaatttgaggtctga

SEQ ID NO: 525363 - DNA, 25 bp, Rattus norvegicus
tccaagtggaattccgaacggaaga

SEQ ID NO: 525364 - DNA, 25 bp, Rattus norvegicus
cagcagctccgggtgtcacaactga

SEQ ID NO: 525365 - DNA, 25 bp, Rattus norvegicus
cgtgacggccttacgtgtctccgtg

SEQ ID NO: 525366 - DNA, 25 bp, Rattus norvegicus
ccgaacggaagacagtcaagaagtg

SEQ ID NO: 525367 - DNA, 25 bp, Rattus norvegicus
tgctacctcacagcgttccaagtgg

SEQ ID NO: 525368 - DNA, 25 bp, Rattus norvegicus
tcaatctctgtagagcgtgcagggg

SEQ ID NO: 525369 - DNA, 25 bp, Rattus norvegicus
gctgcctgtcgggtcagcagctccg

SEQ ID NO: 525370 - DNA, 25 bp, Rattus norvegicus
tagcgccgactacgatgctacctca

SEQ ID NO: 525371 - DNA, 25 bp, Rattus norvegicus
aagtgccgggtacctcgactcccag

SEQ ID NO: 525372 - DNA, 25 bp, Rattus norvegicus
ccgcgctgctgtcaatctctgtaga

SEQ ID NO: 525373 - DNA, 25 bp, Rattus norvegicus
aggcgctccggagcatctgggaccc

SEQ ID NO: 525374 - DNA, 25 bp, Rattus norvegicus
cctgccggacctgcagcttggcgag

SEQ ID NO: 525375 - DNA, 25 bp, Rattus norvegicus
ccaacaacggacttgcgggcagacc

SEQ ID NO: 525376 - DNA, 25 bp, Rattus norvegicus
cggtgaccacccaacaacggacttg

SEQ ID NO: 525377 - DNA, 25 bp, Rattus norvegicus
gtctagtctagcctagccgcggggc

SEQ ID NO: 525378 - DNA, 25 bp, Rattus norvegicus
tcccgacgcgtctagtctagcctag

SEQ ID NO: 525379 - DNA, 25 bp, Rattus norvegicus
gcggctatttctgggccgcggcctc

SEQ ID NO: 525380 - DNA, 25 bp, Rattus norvegicus
gcggaaccgccgaggcggctatttc

SEQ ID NO: 525381 - DNA, 25 bp, Rattus norvegicus
atcgccatcatgtgctctgggtcgg

SEQ ID NO: 525382 - DNA, 25 bp, Rattus norvegicus
tttgagctcccgtatcgccatcatg

SEQ ID NO: 525383 - DNA, 25 bp, Rattus norvegicus
acaaaggcgcgtagaagccgggatc

SEQ ID NO: 525384 - DNA, 25 bp, Rattus norvegicus
ctcccgcgatcagctcggagtctgg

SEQ ID NO: 525385 - DNA, 25 bp, Rattus norvegicus
caaggttgccagacgcgcggccgca

SEQ ID NO: 525386 - DNA, 25 bp, Rattus norvegicus
cccgagaagacacactttgagctcc

SEQ ID NO: 525387 - DNA, 25 bp, Rattus norvegicus
ctaagaaccgccgagtgactggact

SEQ ID NO: 525388 - DNA, 25 bp, Rattus norvegicus
aggtagcaagcacggtgctggattc

SEQ ID NO: 525389 - DNA, 25 bp, Rattus norvegicus
gcacggtgctggattcctgacagtc

SEQ ID NO: 525390 - DNA, 25 bp, Rattus norvegicus
ggggcaggtatcctcggcgatcctc

SEQ ID NO: 525391 - DNA, 25 bp, Rattus norvegicus
ggcgatcctccctgcggtcacaagg

SEQ ID NO: 525392 - DNA, 25 bp, Rattus norvegicus
tcacaaggctaagaaccgccgagtg

SEQ ID NO: 525393 - DNA, 25 bp, Rattus norvegicus
acccggggccgctcagggtcagctt

SEQ ID NO: 525394 - DNA, 25 bp, Rattus norvegicus
tccaaagcccgtgccgcggctttaa

SEQ ID NO: 525395 - DNA, 25 bp, Rattus norvegicus
cgcggctttaacgtgccgcacggga

SEQ ID NO: 525396 - DNA, 25 bp, Rattus norvegicus
ggccggcggaacttttgtcactcaa

SEQ ID NO: 525397 - DNA, 25 bp, Rattus norvegicus
ttgtcactcaactgtcgtccggccg

SEQ ID NO: 525398 - DNA, 25 bp, Rattus norvegicus
ggcctgggctttgttcagtcactcg

SEQ ID NO: 525399 - DNA, 25 bp, Rattus norvegicus
ttgttcagtcactcgcgaggcctgg

SEQ ID NO: 525400 - DNA, 25 bp, Rattus norvegicus
ccctgcggtcacaaggctaagaacc

SEQ ID NO: 525401 - DNA, 25 bp, Rattus norvegicus
tgtgtgcggattacagacccgtgtt

SEQ ID NO: 525402 - DNA, 25 bp, Rattus norvegicus
ttccctcgccggagtgtgtgcggat

SEQ ID NO: 525403 - DNA, 25 bp, Rattus norvegicus
tttttcctgagtgtcttccgcaccc

SEQ ID NO: 525404 - DNA, 25 bp, Rattus norvegicus
tcttccgcaccctcgcccggaggaa

SEQ ID NO: 525405 - DNA, 25 bp, Rattus norvegicus
tttccgcaacgctttgggggctgcg

SEQ ID NO: 525406 - DNA, 25 bp, Rattus norvegicus
gtgcggattacagacccgtgtttta

SEQ ID NO: 525407 - DNA, 25 bp, Rattus norvegicus
acagacccgtgttttacttgagctc

SEQ ID NO: 525408 - DNA, 25 bp, Rattus norvegicus
gacccgtgttttacttgagctctga

SEQ ID NO: 525409 - DNA, 25 bp, Rattus norvegicus
ccgtgttttacttgagctctgagcc

SEQ ID NO: 525410 - DNA, 25 bp, Rattus norvegicus
cttgagctctgagccgttgtgggtc

SEQ ID NO: 525411 - DNA, 25 bp, Rattus norvegicus
tctgagccgttgtgggtccccacca

SEQ ID NO: 525412 - DNA, 25 bp, Rattus norvegicus
caccactcacacgtttgatttccga

SEQ ID NO: 525413 - DNA, 25 bp, Rattus norvegicus
tcacacgtttgatttccgattttcg

SEQ ID NO: 525414 - DNA, 25 bp, Rattus norvegicus
ctcagcccgccctctggggttccct

SEQ ID NO: 525415 - DNA, 25 bp, Rattus norvegicus
tgattgggacagaacaggacgagcc

SEQ ID NO: 525416 - DNA, 25 bp, Rattus norvegicus
atccaaggaagcagctgggctccca

SEQ ID NO: 525417 - DNA, 25 bp, Rattus norvegicus
cacagcagcacaggacacaccggga

SEQ ID NO: 525418 - DNA, 25 bp, Rattus norvegicus
gagtgaagccttcgcggacaacgta

SEQ ID NO: 525419 - DNA, 25 bp, Rattus norvegicus
aagcccagcacgctgcatgacaggc

SEQ ID NO: 525420 - DNA, 25 bp, Rattus norvegicus
agcctccgcctgtttacaatgattg

SEQ ID NO: 525421 - DNA, 25 bp, Rattus norvegicus
gtcctccgatccttggccgtgacgg

SEQ ID NO: 525422 - DNA, 25 bp, Rattus norvegicus
catcgcgcctcacgagatggaactc

SEQ ID NO: 525423 - DNA, 25 bp, Rattus norvegicus
atgcgccaagcgctaaggctctgca

SEQ ID NO: 525424 - DNA, 25 bp, Rattus norvegicus
ggggaccgagtggaacacacaccta

SEQ ID NO: 525425 - DNA, 25 bp, Rattus norvegicus
cctaccggagcgaatcccagtgaaa

SEQ ID NO: 525426 - DNA, 25 bp, Rattus norvegicus
cccagtgaaaacagtgtgggatccc

SEQ ID NO: 525427 - DNA, 25 bp, Rattus norvegicus
gtgagacccataaaccggaagactg

SEQ ID NO: 525428 - DNA, 25 bp, Rattus norvegicus
tgcaggcccgtgtctcggacacaaa

SEQ ID NO: 525429 - DNA, 25 bp, Rattus norvegicus
gcttcctgccctccgccggtgcgcc

SEQ ID NO: 525430 - DNA, 25 bp, Rattus norvegicus
gtcctcccgcgagccaggtgaccgc

SEQ ID NO: 525431 - DNA, 25 bp, Rattus norvegicus
tggttacaaaactatgagaaggcgc

SEQ ID NO: 525432 - DNA, 25 bp, Rattus norvegicus
caaaactatgagaaggcgccacacc

SEQ ID NO: 525433 - DNA, 25 bp, Rattus norvegicus
aaggcgccacaccacgggctttgca

SEQ ID NO: 525434 - DNA, 25 bp, Rattus norvegicus
cacaccacgggctttgcatggagta

SEQ ID NO: 525435 - DNA, 25 bp, Rattus norvegicus
ttgcatggagtatgactccgttctg

SEQ ID NO: 525436 - DNA, 25 bp, Rattus norvegicus
gcgtgttagaaagcggaccccgctg

SEQ ID NO: 525437 - DNA, 25 bp, Rattus norvegicus
gcgccgccgacacacaggcccgcgc

SEQ ID NO: 525438 - DNA, 25 bp, Rattus norvegicus
gccttcaagcagctcccgcgaaccc

SEQ ID NO: 525439 - DNA, 25 bp, Rattus norvegicus
ctcccggcggccgagccttcaagca

SEQ ID NO: 525440 - DNA, 25 bp, Rattus norvegicus
ccgctcccgctcaccgtggccgcgg

SEQ ID NO: 525441 - DNA, 25 bp, Rattus norvegicus
tccgaacgcccgcacgcctgcggag

SEQ ID NO: 525442 - DNA, 25 bp, Rattus norvegicus
ccacgggctttgcatggagtatgac

SEQ ID NO: 525443 - DNA, 25 bp, Rattus norvegicus
ccctcgcgccggaaggggactcatt

SEQ ID NO: 525444 - DNA, 25 bp, Rattus norvegicus
tgcgcgctccgtttcacagatccaa

SEQ ID NO: 525445 - DNA, 25 bp, Rattus norvegicus
cagatccaacgtgaaacgtcgtttg

SEQ ID NO: 525446 - DNA, 25 bp, Rattus norvegicus
gggaggtcacacgacaccctcacgg

SEQ ID NO: 525447 - DNA, 25 bp, Rattus norvegicus
acggccctctggacatgtgccacgg

SEQ ID NO: 525448 - DNA, 25 bp, Rattus norvegicus
cttggtccgctgcttgttcttcccg

SEQ ID NO: 525449 - DNA, 25 bp, Rattus norvegicus
gtctgcagaggcgaagttgacaccg

SEQ ID NO: 525450 - DNA, 25 bp, Rattus norvegicus
agccttttggctttcacttccgctc

SEQ ID NO: 525451 - DNA, 25 bp, Rattus norvegicus
cccgctgcctgaacggtaacaaaga

SEQ ID NO: 525452 - DNA, 25 bp, Rattus norvegicus
ggccacgcctgcatgagtggcgtaa

SEQ ID NO: 525453 - DNA, 25 bp, Rattus norvegicus
gtggcgtaaccgctaaccaataaga

SEQ ID NO: 525454 - DNA, 25 bp, Rattus norvegicus
gcgaagttgacaccgccggaccaca

SEQ ID NO: 525455 - DNA, 25 bp, Rattus norvegicus
gttcttcccgcccatggtggcggtg

SEQ ID NO: 525456 - DNA, 25 bp, Rattus norvegicus
aggggactcattgtagccacttccc

SEQ ID NO: 525457 - DNA, 25 bp, Rattus norvegicus
ccaccgcgaagtctcacagcacaca

SEQ ID NO: 525458 - DNA, 25 bp, Rattus norvegicus
gcgaagtctcacagcacacccaccg

SEQ ID NO: 525459 - DNA, 25 bp, Rattus norvegicus
acacccaccgcgaagtctcacagca

SEQ ID NO: 525460 - DNA, 25 bp, Rattus norvegicus
caccgcgaagtgtcacagcgcacac

SEQ ID NO: 525461 - DNA, 25 bp, Rattus norvegicus
acacccaccgcgaagtgtcacggca

SEQ ID NO: 525462 - DNA, 25 bp, Rattus norvegicus
tcacagcacacacccaccgcgaagt

SEQ ID NO: 525463 - DNA, 25 bp, Rattus norvegicus
tctcacagcacacccaccgcgaagt

SEQ ID NO: 525464 - DNA, 25 bp, Rattus norvegicus
gaagtctcacagcacacaccgcgaa

SEQ ID NO: 525465 - DNA, 25 bp, Rattus norvegicus
acccaccgcgaagtgtcacagcaca

SEQ ID NO: 525466 - DNA, 25 bp, Rattus norvegicus
acccaccgtgaagtctcacagcaca

SEQ ID NO: 525467 - DNA, 25 bp, Rattus norvegicus
agtctcacagcacacacccaccgtg

SEQ ID NO: 525468 - DNA, 25 bp, Rattus norvegicus
ccgcgaagtctcacagcacacaccg

SEQ ID NO: 525469 - DNA, 25 bp, Rattus norvegicus
ccaccgcgaagtgtcacggcacacc

SEQ ID NO: 525470 - DNA, 25 bp, Rattus norvegicus
acccaccgcgaagtgtcacggcaca

SEQ ID NO: 525471 - DNA, 25 bp, Rattus norvegicus
agcgaagtgtcacagcacccactca

SEQ ID NO: 525472 - DNA, 25 bp, Rattus norvegicus
gagcagcgaagtgtcacagcaccca

SEQ ID NO: 525473 - DNA, 25 bp, Rattus norvegicus
tcgagcagcgaagtgtcacagcacc

SEQ ID NO: 525474 - DNA, 25 bp, Rattus norvegicus
cctcgagcagcgaagtgtcacagca

SEQ ID NO: 525475 - DNA, 25 bp, Rattus norvegicus
tggcctcgagcagcgaagtgtcaca

SEQ ID NO: 525476 - DNA, 25 bp, Rattus norvegicus
gaaccaagatgagagagcacagctc

SEQ ID NO: 525477 - DNA, 25 bp, Rattus norvegicus
cggaaccaagatgagagagcacagc

SEQ ID NO: 525478 - DNA, 25 bp, Rattus norvegicus
cgagcggaaccaagatgagagagca

SEQ ID NO: 525479 - DNA, 25 bp, Rattus norvegicus
gctctggcctcgagcagcgaagtgt

SEQ ID NO: 525480 - DNA, 25 bp, Rattus norvegicus
gtcacagcacccactcaccgcaaag

SEQ ID NO: 525481 - DNA, 25 bp, Rattus norvegicus
cacagctctggcctcgagcagcgaa

SEQ ID NO: 525482 - DNA, 25 bp, Rattus norvegicus
gcacacccaccgcactcaaggttcc

SEQ ID NO: 525483 - DNA, 25 bp, Rattus norvegicus
gagcacagctctggcctcgagcagc

SEQ ID NO: 525484 - DNA, 25 bp, Rattus norvegicus
gtgcacaccgtgaagtgtcacggca

SEQ ID NO: 525485 - DNA, 25 bp, Rattus norvegicus
agcaatttcgctttcacgcacctct

SEQ ID NO: 525486 - DNA, 25 bp, Rattus norvegicus
acgcacatatttttgcagggtttga

SEQ ID NO: 525487 - DNA, 25 bp, Rattus norvegicus
gctcggcggaggaaacgcacatatt

SEQ ID NO: 525488 - DNA, 25 bp, Rattus norvegicus
gctccgcacacgcagcctggtacca

SEQ ID NO: 525489 - DNA, 25 bp, Rattus norvegicus
acggacacgtgactcctgcaggcac

SEQ ID NO: 525490 - DNA, 25 bp, Rattus norvegicus
gacccagacggacacgtgactcctg

SEQ ID NO: 525491 - DNA, 25 bp, Rattus norvegicus
gcagagcacgtgacccagacggaca

SEQ ID NO: 525492 - DNA, 25 bp, Rattus norvegicus
ttggacagcagttctccgcgattgg

SEQ ID NO: 525493 - DNA, 25 bp, Rattus norvegicus
acagcctccttgctcttggacagca

SEQ ID NO: 525494 - DNA, 25 bp, Rattus norvegicus
acctgcaccgcgacgggtcaggatg

SEQ ID NO: 525495 - DNA, 25 bp, Rattus norvegicus
ccatgttccggtaagcggcggccaa

SEQ ID NO: 525496 - DNA, 25 bp, Rattus norvegicus
cggccgcgccatgttccggtaagcg

SEQ ID NO: 525497 - DNA, 25 bp, Rattus norvegicus
ccgcgagccgcagcaatttcgcttt

SEQ ID NO: 525498 - DNA, 25 bp, Rattus norvegicus
tttgagttgggacggcaaaaccagc

SEQ ID NO: 525499 - DNA, 25 bp, Rattus norvegicus
gaagcaatcctgcaacgggtccgga

SEQ ID NO: 525500 - DNA, 25 bp, Rattus norvegicus
cgttagatttgcaacgcgcctttta

SEQ ID NO: 525501 - DNA, 25 bp, Rattus norvegicus
ctcccagctcgagtcgttagatttg

SEQ ID NO: 525502 - DNA, 25 bp, Rattus norvegicus
gtgagggttcgaggcacaatccttc

SEQ ID NO: 525503 - DNA, 25 bp, Rattus norvegicus
tggaggcgcgagcttctccagaacc

SEQ ID NO: 525504 - DNA, 25 bp, Rattus norvegicus
gatccagcggagatggagacctctc

SEQ ID NO: 525505 - DNA, 25 bp, Rattus norvegicus
ggcaccacgttccacagtcatggcg

SEQ ID NO: 525506 - DNA, 25 bp, Rattus norvegicus
tcctccgatctgagtctctgctgca

SEQ ID NO: 525507 - DNA, 25 bp, Rattus norvegicus
ccagggctcgggtttctgcaaccaa

SEQ ID NO: 525508 - DNA, 25 bp, Rattus norvegicus
ggtctcgaacccttggctagtccgc

SEQ ID NO: 525509 - DNA, 25 bp, Rattus norvegicus
gagactcgccagcttacaaaaggtg

SEQ ID NO: 525510 - DNA, 25 bp, Rattus norvegicus
caaaaggtgcaagctcacgcgtaca

SEQ ID NO: 525511 - DNA, 25 bp, Rattus norvegicus
gacgagatcttgttccggtcctttc

SEQ ID NO: 525512 - DNA, 25 bp, Rattus norvegicus
gccttttacaataaccgcgactgcg

SEQ ID NO: 525513 - DNA, 25 bp, Rattus norvegicus
ataaagagcggcgactatggcgaca

SEQ ID NO: 525514 - DNA, 25 bp, Rattus norvegicus
gcgtctggaagagtgcgcagctcca

SEQ ID NO: 525515 - DNA, 25 bp, Rattus norvegicus
ccgctctaggctgacagggaacgaa

SEQ ID NO: 525516 - DNA, 25 bp, Rattus norvegicus
gttctccgaccctggccgctctagg

SEQ ID NO: 525517 - DNA, 25 bp, Rattus norvegicus
ccaaggagaacatggcggggtacgc

SEQ ID NO: 525518 - DNA, 25 bp, Rattus norvegicus
ggcccgcagcgccaaggagaacatg

SEQ ID NO: 525519 - DNA, 25 bp, Rattus norvegicus
tcttacccactgagcggtgaggccg

SEQ ID NO: 525520 - DNA, 25 bp, Rattus norvegicus
cacccaggacgaaggccgcggcgtc

SEQ ID NO: 525521 - DNA, 25 bp, Rattus norvegicus
gactatggcgacagtgcccgcttca

SEQ ID NO: 525522 - DNA, 25 bp, Rattus norvegicus
ctaagagaaacataaagagcggcga

SEQ ID NO: 525523 - DNA, 25 bp, Rattus norvegicus
gtctccgggtaccaaagctaagaga

SEQ ID NO: 525524 - DNA, 25 bp, Rattus norvegicus
agctgacctatccagcaccctgggg

SEQ ID NO: 525525 - DNA, 25 bp, Rattus norvegicus
tccgccatcgccagctgacctatcc

SEQ ID NO: 525526 - DNA, 25 bp, Rattus norvegicus
gagcctcttacccactgagcggtga

SEQ ID NO: 525527 - DNA, 25 bp, Rattus norvegicus
acccttcggcgagcgttcggggcag

SEQ ID NO: 525528 - DNA, 25 bp, Rattus norvegicus
cggaagacggagaaccgagctgaaa

SEQ ID NO: 525529 - DNA, 25 bp, Rattus norvegicus
accagcgtccgagagacccggaaga

SEQ ID NO: 525530 - DNA, 25 bp, Rattus norvegicus
gaaatctgtgcggggatccagcccg

SEQ ID NO: 525531 - DNA, 25 bp, Rattus norvegicus
cagcgtccgagagacccggaagacg

SEQ ID NO: 525532 - DNA, 25 bp, Rattus norvegicus
gaagacggagaaccgagctgaaagc

SEQ ID NO: 525533 - DNA, 25 bp, Rattus norvegicus
aaccgagctgaaagcgggcggactc

SEQ ID NO: 525534 - DNA, 25 bp, Rattus norvegicus
tgaaagcgggcggactctaggaccc

SEQ ID NO: 525535 - DNA, 25 bp, Rattus norvegicus
gcggaacggtcctggaaatctgtgc

SEQ ID NO: 525536 - DNA, 25 bp, Rattus norvegicus
ctgcccaccggctggaggcgagtgg

SEQ ID NO: 525537 - DNA, 25 bp, Rattus norvegicus
tcctggaaatctgtgcggggatcca

SEQ ID NO: 525538 - DNA, 25 bp, Rattus norvegicus
gtcctggaaatctgtgcggggatcc

SEQ ID NO: 525539 - DNA, 25 bp, Rattus norvegicus
ctggaaatctgtgcggggatccagc

SEQ ID NO: 525540 - DNA, 25 bp, Rattus norvegicus
gggacgcgcacgtgaggacaccacc

SEQ ID NO: 525541 - DNA, 25 bp, Rattus norvegicus
gatgagagcgaatacggtcctgcgt

SEQ ID NO: 525542 - DNA, 25 bp, Rattus norvegicus
ctaaggtcggacttgtgggcggagg

SEQ ID NO: 525543 - DNA, 25 bp, Rattus norvegicus
cctaaggtcggacttgtgggcggag

SEQ ID NO: 525544 - DNA, 25 bp, Rattus norvegicus
caccctaaggtcggacttgtgggcg

SEQ ID NO: 525545 - DNA, 25 bp, Rattus norvegicus
gcaccctaaggtcggacttgtgggc

SEQ ID NO: 525546 - DNA, 25 bp, Rattus norvegicus
atgagagcgaatacggtcctgcgtg

SEQ ID NO: 525547 - DNA, 25 bp, Rattus norvegicus
taaggtcggacttgtgggcggaggc

SEQ ID NO: 525548 - DNA, 25 bp, Rattus norvegicus
cggatgagagcgaatacggtcctgc

SEQ ID NO: 525549 - DNA, 25 bp, Rattus norvegicus
tgcggatgagagcgaatacggtcct

SEQ ID NO: 525550 - DNA, 25 bp, Rattus norvegicus
ctgcggatgagagcgaatacggtcc

SEQ ID NO: 525551 - DNA, 25 bp, Rattus norvegicus
cctgcggatgagagcgaatacggtc

SEQ ID NO: 525552 - DNA, 25 bp, Rattus norvegicus
ccctgcggatgagagcgaatacggt

SEQ ID NO: 525553 - DNA, 25 bp, Rattus norvegicus
tggccggtttttccgtttgcgcatg

SEQ ID NO: 525554 - DNA, 25 bp, Rattus norvegicus
tgagagcgaatacggtcctgcgtga

SEQ ID NO: 525555 - DNA, 25 bp, Rattus norvegicus
cggggacgtacacgtgaggacgtgc

SEQ ID NO: 525556 - DNA, 25 bp, Rattus norvegicus
cgtacacgtgaggacgtgcgcgtgc

SEQ ID NO: 525557 - DNA, 25 bp, Rattus norvegicus
cgggaccgctccaccctgctgccca

SEQ ID NO: 525558 - DNA, 25 bp, Rattus norvegicus
tgctgcccaccgactgtagtcaagt

SEQ ID NO: 525559 - DNA, 25 bp, Rattus norvegicus
gctgcccaccgactgtagtcaagtg

SEQ ID NO: 525560 - DNA, 25 bp, Rattus norvegicus
tccaggaaggccatgaagggatccg

SEQ ID NO: 525561 - DNA, 25 bp, Rattus norvegicus
ctagaacccggggatgcaggtcacc

SEQ ID NO: 525562 - DNA, 25 bp, Rattus norvegicus
gtccaggaaggccatgaagggatcc

SEQ ID NO: 525563 - DNA, 25 bp, Rattus norvegicus
cgactgtagtcaagtgagggcgcct

SEQ ID NO: 525564 - DNA, 25 bp, Rattus norvegicus
accgactgtagtcaagtgagggcgc

SEQ ID NO: 525565 - DNA, 25 bp, Rattus norvegicus
cccaccgactgtagtcaagtgaggg

SEQ ID NO: 525566 - DNA, 25 bp, Rattus norvegicus
tgcccaccgactgtagtcaagtgag

SEQ ID NO: 525567 - DNA, 25 bp, Rattus norvegicus
gccatgaagggatccgggccgccac

SEQ ID NO: 525568 - DNA, 25 bp, Rattus norvegicus
agaacccggggatgcaggtcaccgc

SEQ ID NO: 525569 - DNA, 25 bp, Rattus norvegicus
atgagagcgaattcggccctgcctg

SEQ ID NO: 525570 - DNA, 25 bp, Rattus norvegicus
agagcgccctaaggtcgtacctggg

SEQ ID NO: 525571 - DNA, 25 bp, Rattus norvegicus
cgtgaacggagagcgccctaaggtc

SEQ ID NO: 525572 - DNA, 25 bp, Rattus norvegicus
tgcaaaaagaggctgccggggagcg

SEQ ID NO: 525573 - DNA, 25 bp, Rattus norvegicus
cagacttgagcggaggtgcaaaaag

SEQ ID NO: 525574 - DNA, 25 bp, Rattus norvegicus
gaagcgctgacaccgaagacagaga

SEQ ID NO: 525575 - DNA, 25 bp, Rattus norvegicus
ctgaagatgagagcgaattcggccc

SEQ ID NO: 525576 - DNA, 25 bp, Rattus norvegicus
ccctgcctgagtgaagcgctgacac

SEQ ID NO: 525577 - DNA, 25 bp, Rattus norvegicus
ctccttctgtgaagcttcaaatttt

SEQ ID NO: 525578 - DNA, 25 bp, Rattus norvegicus
aagtggcgggcttttctgtttgcgc

SEQ ID NO: 525579 - DNA, 25 bp, Rattus norvegicus
cttcaaattttatggcggctaccgg

SEQ ID NO: 525580 - DNA, 25 bp, Rattus norvegicus
ttatggcggctaccgggcttacttg

SEQ ID NO: 525581 - DNA, 25 bp, Rattus norvegicus
cgccctgaagatgagagcgaattcg

SEQ ID NO: 525582 - DNA, 25 bp, Rattus norvegicus
tgcctgagtgaagcgctgacaccga

SEQ ID NO: 525583 - DNA, 25 bp, Rattus norvegicus
catgcgcaaacggaaaaaccggcca

SEQ ID NO: 525584 - DNA, 25 bp, Rattus norvegicus
accgtattcgctctcatccgcaggg

SEQ ID NO: 525585 - DNA, 25 bp, Rattus norvegicus
gaccgtattcgctctcatccgcagg

SEQ ID NO: 525586 - DNA, 25 bp, Rattus norvegicus
acgcaggaccgtattcgctctcatc

SEQ ID NO: 525587 - DNA, 25 bp, Rattus norvegicus
aggaccgtattcgctctcatccgca

SEQ ID NO: 525588 - DNA, 25 bp, Rattus norvegicus
caggaccgtattcgctctcatccgc

SEQ ID NO: 525589 - DNA, 25 bp, Rattus norvegicus
gcccacaagtccgaccttagggtgc

SEQ ID NO: 525590 - DNA, 25 bp, Rattus norvegicus
gcctccgcccacaagtccgacctta

SEQ ID NO: 525591 - DNA, 25 bp, Rattus norvegicus
ggaccgtattcgctctcatccgcag

SEQ ID NO: 525592 - DNA, 25 bp, Rattus norvegicus
ctccgcccacaagtccgaccttagg

SEQ ID NO: 525593 - DNA, 25 bp, Rattus norvegicus
gcaggaccgtattcgctctcatccg

SEQ ID NO: 525594 - DNA, 25 bp, Rattus norvegicus
tcacgcaggaccgtattcgctctca

SEQ ID NO: 525595 - DNA, 25 bp, Rattus norvegicus
cacgcaggaccgtattcgctctcat

SEQ ID NO: 525596 - DNA, 25 bp, Rattus norvegicus
cctccgcccacaagtccgaccttag

SEQ ID NO: 525597 - DNA, 25 bp, Rattus norvegicus
tctgaaggctttccacttccaaagc

SEQ ID NO: 525598 - DNA, 25 bp, Rattus norvegicus
cccgcaggcctgagtcacggatgaa

SEQ ID NO: 525599 - DNA, 25 bp, Rattus norvegicus
cacggatgaagccatcggtgtccga

SEQ ID NO: 525600 - DNA, 25 bp, Rattus norvegicus
tgtccgagatgaggcgctccacagt

SEQ ID NO: 525601 - DNA, 25 bp, Rattus norvegicus
tgggcctcgagcttcatggtcacca

SEQ ID NO: 525602 - DNA, 25 bp, Rattus norvegicus
tcatggtcaccaggcactcggtgtc

SEQ ID NO: 525603 - DNA, 25 bp, Rattus norvegicus
tgtcctcccggactcttagcagttc

SEQ ID NO: 525604 - DNA, 25 bp, Rattus norvegicus
tggctcactcgcctctgaaggcttt

SEQ ID NO: 525605 - DNA, 25 bp, Rattus norvegicus
ccagatgcgcagcaaggtcacaccg

SEQ ID NO: 525606 - DNA, 25 bp, Rattus norvegicus
aggtcacaccgctgggcattggaca

SEQ ID NO: 525607 - DNA, 25 bp, Rattus norvegicus
cattggacagcagcagccggttctc

SEQ ID NO: 525608 - DNA, 25 bp, Rattus norvegicus
agcccgaggtcttctcaaacatatc

SEQ ID NO: 525609 - DNA, 25 bp, Rattus norvegicus
aacagggccttctcgctttggctgg

SEQ ID NO: 525610 - DNA, 25 bp, Rattus norvegicus
ttagcagttctgtcgggcatggctc

SEQ ID NO: 525611 - DNA, 25 bp, Rattus norvegicus
caaaatcgtcgtccatagacttgaa

SEQ ID NO: 525612 - DNA, 25 bp, Rattus norvegicus
ctcacccaaaatcgtcgtccataga

SEQ ID NO: 525613 - DNA, 25 bp, Rattus norvegicus
tccttgctggaagcggggttagaaa

SEQ ID NO: 525614 - DNA, 25 bp, Rattus norvegicus
cggcgctggctgcttgccgcagact

SEQ ID NO: 525615 - DNA, 25 bp, Rattus norvegicus
tgcaaaacgcccttaaagtccgcca

SEQ ID NO: 525616 - DNA, 25 bp, Rattus norvegicus
taaagtccgccaaggtgacgcgctc

SEQ ID NO: 525617 - DNA, 25 bp, Rattus norvegicus
caggttcactaggtgcggcgtctcc

SEQ ID NO: 525618 - DNA, 25 bp, Rattus norvegicus
tggcgaccgcgactcttccggtggc

SEQ ID NO: 525619 - DNA, 25 bp, Rattus norvegicus
tgatcttagtctcgcccatggctcc

SEQ ID NO: 525620 - DNA, 25 bp, Rattus norvegicus
gtagatgatcttagtctcgcccatg

SEQ ID NO: 525621 - DNA, 25 bp, Rattus norvegicus
ctggccgtccaagtggtagatgatc

SEQ ID NO: 525622 - DNA, 25 bp, Rattus norvegicus
aagaacttatagatgggccgctgca

SEQ ID NO: 525623 - DNA, 25 bp, Rattus norvegicus
tgcggcgtctcctggccgtccaagt

SEQ ID NO: 525624 - DNA, 25 bp, Rattus norvegicus
aagcggggttagaaaccagtgcagc

SEQ ID NO: 525625 - DNA, 25 bp, Rattus norvegicus
agcaggcgctgctcatcagacaagg

SEQ ID NO: 525626 - DNA, 25 bp, Rattus norvegicus
aatggcgctcgggtcctcctggcac

SEQ ID NO: 525627 - DNA, 25 bp, Rattus norvegicus
cctcgctcaggtcaatggcgctcgg

SEQ ID NO: 525628 - DNA, 25 bp, Rattus norvegicus
ctcagacgacccaagggagtgtgtc

SEQ ID NO: 525629 - DNA, 25 bp, Rattus norvegicus
cagggccgttcagcgtctccatggc

SEQ ID NO: 525630 - DNA, 25 bp, Rattus norvegicus
gtcgcgtgtgtagatccttgaggaa

SEQ ID NO: 525631 - DNA, 25 bp, Rattus norvegicus
cggcttgtccttcgcgccggggact

SEQ ID NO: 525632 - DNA, 25 bp, Rattus norvegicus
tttgcgacccttcgagagggcaggc

SEQ ID NO: 525633 - DNA, 25 bp, Rattus norvegicus
tgccggccaccgaggtcacagagag

SEQ ID NO: 525634 - DNA, 25 bp, Rattus norvegicus
catcagacaagggttcggaggcgca

SEQ ID NO: 525635 - DNA, 25 bp, Rattus norvegicus
gttcccggtcactggagccggtgcc

SEQ ID NO: 525636 - DNA, 25 bp, Rattus norvegicus
agctgctgtccgtgtggctgatacg

SEQ ID NO: 525637 - DNA, 25 bp, Rattus norvegicus
gagagatccgagctgctgtccgtgt

SEQ ID NO: 525638 - DNA, 25 bp, Rattus norvegicus
gcttggctttgcgacccttcgagag

SEQ ID NO: 525639 - DNA, 25 bp, Rattus norvegicus
gcggatgcatcacccaaacctcatg

SEQ ID NO: 525640 - DNA, 25 bp, Rattus norvegicus
ttgccctacatttgtgcagagaaca

SEQ ID NO: 525641 - DNA, 25 bp, Rattus norvegicus
ccgaagtgtagctttagcgcgaacg

SEQ ID NO: 525642 - DNA, 25 bp, Rattus norvegicus
cgcgaacgggtctctgcactaaacc

SEQ ID NO: 525643 - DNA, 25 bp, Rattus norvegicus
gcccgaatagctgcgaggtccaatc

SEQ ID NO: 525644 - DNA, 25 bp, Rattus norvegicus
gcgaggtccaatcccgcttaggata

SEQ ID NO: 525645 - DNA, 25 bp, Rattus norvegicus
cacaaagccgttttcctgggcgagc

SEQ ID NO: 525646 - DNA, 25 bp, Rattus norvegicus
agaagacagtcagagctcccacggg

SEQ ID NO: 525647 - DNA, 25 bp, Rattus norvegicus
gtacccacggtggacttgcaggcct

SEQ ID NO: 525648 - DNA, 25 bp, Rattus norvegicus
gaagcgctccatcaggctggtcttg

SEQ ID NO: 525649 - DNA, 25 bp, Rattus norvegicus
ccgatgatgatgacctgcagcttga

SEQ ID NO: 525650 - DNA, 25 bp, Rattus norvegicus
ggcgctcggatccatgcacgcatac

SEQ ID NO: 525651 - DNA, 25 bp, Rattus norvegicus
tcgcagaacgtgtcgtcggtgaagc

SEQ ID NO: 525652 - DNA, 25 bp, Rattus norvegicus
ggtggccttcggctctactttcagc

SEQ ID NO: 525653 - DNA, 25 bp, Rattus norvegicus
tcattagagtgaagccaggcgtaca

SEQ ID NO: 525654 - DNA, 25 bp, Rattus norvegicus
ctggctacacaacccgagtgcggtc

SEQ ID NO: 525655 - DNA, 25 bp, Rattus norvegicus
aggagccgctcacggtacattgaga

SEQ ID NO: 525656 - DNA, 25 bp, Rattus norvegicus
ttgggccctctttcaggatcgaagg

SEQ ID NO: 525657 - DNA, 25 bp, Rattus norvegicus
tttctaagaaggaaggtcacgcatc

SEQ ID NO: 525658 - DNA, 25 bp, Rattus norvegicus
agcaagcaccggtgtggctctaacg

SEQ ID NO: 525659 - DNA, 25 bp, Rattus norvegicus
tgtccagccggcgtttctaagaagg

SEQ ID NO: 525660 - DNA, 25 bp, Rattus norvegicus
acgtgcgcttggttcggttaccaga

SEQ ID NO: 525661 - DNA, 25 bp, Rattus norvegicus
gcgtacacagtgctcaggactcctt

SEQ ID NO: 525662 - DNA, 25 bp, Rattus norvegicus
cccagttttgctcggctttgcttca

SEQ ID NO: 525663 - DNA, 25 bp, Rattus norvegicus
tcattttaggtgaaaccgctccacg

SEQ ID NO: 525664 - DNA, 25 bp, Rattus norvegicus
cggtttcctgacacatccgtttcta

SEQ ID NO: 525665 - DNA, 25 bp, Rattus norvegicus
tgcgtgccaaatgccaaccatgcta

SEQ ID NO: 525666 - DNA, 25 bp, Rattus norvegicus
ggactccttcatttgtgaccggaaa

SEQ ID NO: 525667 - DNA, 25 bp, Rattus norvegicus
gagccttcgagagcccacggtggcc

SEQ ID NO: 525668 - DNA, 25 bp, Rattus norvegicus
aaaacgcgagtcagagcaactcccg

SEQ ID NO: 525669 - DNA, 25 bp, Rattus norvegicus
ggtagcagcagaaggagctactccc

SEQ ID NO: 525670 - DNA, 25 bp, Rattus norvegicus
cggccgctgcacagtgaccagagca

SEQ ID NO: 525671 - DNA, 25 bp, Rattus norvegicus
gtgaccagagcagcccgcgatcaga

SEQ ID NO: 525672 - DNA, 25 bp, Rattus norvegicus
tcagagctctgaacccgactagttc

SEQ ID NO: 525673 - DNA, 25 bp, Rattus norvegicus
cgactagttcctggcttcctcttcg

SEQ ID NO: 525674 - DNA, 25 bp, Rattus norvegicus
gggtctctccgtagagccttcgaga

SEQ ID NO: 525675 - DNA, 25 bp, Rattus norvegicus
tccgtagagccttcgagagcccacg

SEQ ID NO: 525676 - DNA, 25 bp, Rattus norvegicus
ctgacccgcgctctagggtcgtgga

SEQ ID NO: 525677 - DNA, 25 bp, Rattus norvegicus
actgcggcgctaagcctcaagtacc

SEQ ID NO: 525678 - DNA, 25 bp, Rattus norvegicus
gggacactgagaaatcgaaaaacgc

SEQ ID NO: 525679 - DNA, 25 bp, Rattus norvegicus
ccatctgggaagactgcggcgctaa

SEQ ID NO: 525680 - DNA, 25 bp, Rattus norvegicus
tcgaaaaacgcgagtcagagcaact

SEQ ID NO: 525681 - DNA, 25 bp, Rattus norvegicus
tcatgaagaaggtacaggagccgga

SEQ ID NO: 525682 - DNA, 25 bp, Rattus norvegicus
aaacattgtatctctttatatgggg

SEQ ID NO: 525683 - DNA, 25 bp, Rattus norvegicus
ggcagcgacagcggctttagcagca

SEQ ID NO: 525684 - DNA, 25 bp, Rattus norvegicus
gattcctcgctgacttgcctgtccg

SEQ ID NO: 525685 - DNA, 25 bp, Rattus norvegicus
acgggcatcatgaagaaggtacagg

SEQ ID NO: 525686 - DNA, 25 bp, Rattus norvegicus
tgcactcagcgccatgttaccgagc

SEQ ID NO: 525687 - DNA, 25 bp, Rattus norvegicus
tcagcgccatgttaccgagccaagc

SEQ ID NO: 525688 - DNA, 25 bp, Rattus norvegicus
atgttaccgagccaagctggggccg

SEQ ID NO: 525689 - DNA, 25 bp, Rattus norvegicus
cctcaagcggagtctgagcgagatg

SEQ ID NO: 525690 - DNA, 25 bp, Rattus norvegicus
gatggagttcatcgacaacaagctg

SEQ ID NO: 525691 - DNA, 25 bp, Rattus norvegicus
gccataaaaggaaacattgtatctc

SEQ ID NO: 525692 - DNA, 25 bp, Rattus norvegicus
cggcgttacacgaccttcagcaaga

SEQ ID NO: 525693 - DNA, 25 bp, Rattus norvegicus
ttcagcaagaggaagacgggcatca

SEQ ID NO: 525694 - DNA, 25 bp, Rattus norvegicus
atcgacaacaagctgcggcgttaca

SEQ ID NO: 525695 - DNA, 25 bp, Rattus norvegicus
tcgcagtgtcagtgtacatgaaatg

SEQ ID NO: 525696 - DNA, 25 bp, Rattus norvegicus
tgccaaagcctgcttgcgggccgcg

SEQ ID NO: 525697 - DNA, 25 bp, Rattus norvegicus
tgtagtaggtgccaaagcctgcttg

SEQ ID NO: 525698 - DNA, 25 bp, Rattus norvegicus
ccacgcacccgctttgtagtaggtg

SEQ ID NO: 525699 - DNA, 25 bp, Rattus norvegicus
tgtacatgaaatgcgcccgtgtccc

SEQ ID NO: 525700 - DNA, 25 bp, Rattus norvegicus
cctctgcgtggagatcgcagtgtca

SEQ ID NO: 525701 - DNA, 25 bp, Rattus norvegicus
gcaacttcccaggtgcctctgcgtg

SEQ ID NO: 525702 - DNA, 25 bp, Rattus norvegicus
atgcaggctcatgcgccgatcttcg

SEQ ID NO: 525703 - DNA, 25 bp, Rattus norvegicus
atgtgaacgtgatgcaggctcatgc

SEQ ID NO: 525704 - DNA, 25 bp, Rattus norvegicus
ctaaagagggacctgggatgtgaac

SEQ ID NO: 525705 - DNA, 25 bp, Rattus norvegicus
cacggttcctccaggacgagagcta

SEQ ID NO: 525706 - DNA, 25 bp, Rattus norvegicus
tacccacggttcctccaggacgaga

SEQ ID NO: 525707 - DNA, 25 bp, Rattus norvegicus
gagactcagccctccctacccacgg

SEQ ID NO: 525708 - DNA, 25 bp, Rattus norvegicus
ccgtgtccctcacccgtgagaaggg

SEQ ID NO: 525709 - DNA, 25 bp, Rattus norvegicus
tcctgctccgcgactgactggcgat

SEQ ID NO: 525710 - DNA, 25 bp, Rattus norvegicus
ggcaacagttgcacaagtccgaagt

SEQ ID NO: 525711 - DNA, 25 bp, Rattus norvegicus
tccaaatcctcgctgggatccggtg

SEQ ID NO: 525712 - DNA, 25 bp, Rattus norvegicus
cggccgcagttagcaaaagtccagc

SEQ ID NO: 525713 - DNA, 25 bp, Rattus norvegicus
ggcgtcccgcttacctgaaaatgtc

SEQ ID NO: 525714 - DNA, 25 bp, Rattus norvegicus
tgtgcccgtgcttgtcctgcgggct

SEQ ID NO: 525715 - DNA, 25 bp, Rattus norvegicus
tccagctaaagtcaccaggcaagtc

SEQ ID NO: 525716 - DNA, 25 bp, Rattus norvegicus
tacgacagcagcgaaacaccagacc

SEQ ID NO: 525717 - DNA, 25 bp, Rattus norvegicus
caggcaagtcccaagtgtcctcatg

SEQ ID NO: 525718 - DNA, 25 bp, Rattus norvegicus
gggaacgatagtggcgtcccgctta

SEQ ID NO: 525719 - DNA, 25 bp, Rattus norvegicus
gcctaagctgcaggcttccagggta

SEQ ID NO: 525720 - DNA, 25 bp, Rattus norvegicus
ccggctggaaggagcccacgtcacg

SEQ ID NO: 525721 - DNA, 25 bp, Rattus norvegicus
caagtgtcctcatggtgccgagtgc

SEQ ID NO: 525722 - DNA, 25 bp, Rattus norvegicus
cttccagggtagatacgacagcagc

SEQ ID NO: 525723 - DNA, 25 bp, Rattus norvegicus
tctgggtcaccgtgcggagccagca

SEQ ID NO: 525724 - DNA, 25 bp, Rattus norvegicus
tggtcgagaccttccttggagcgca

SEQ ID NO: 525725 - DNA, 25 bp, Rattus norvegicus
acgagcgtggtcgagaccttccttg

SEQ ID NO: 525726 - DNA, 25 bp, Rattus norvegicus
ctgtgaacgagcgtggtcgagacct

SEQ ID NO: 525727 - DNA, 25 bp, Rattus norvegicus
acacttgcgcggtgcctgtgaacga

SEQ ID NO: 525728 - DNA, 25 bp, Rattus norvegicus
aggaccacacttgcgcggtgcctgt

SEQ ID NO: 525729 - DNA, 25 bp, Rattus norvegicus
agggcctgcgtaccaggccagggtc

SEQ ID NO: 525730 - DNA, 25 bp, Rattus norvegicus
agcgacgacggcgtcatgcgcggca

SEQ ID NO: 525731 - DNA, 25 bp, Rattus norvegicus
acgggagtcgcgctcttggtgctcc

SEQ ID NO: 525732 - DNA, 25 bp, Rattus norvegicus
tcctggcctcggtgctctgggtcac

SEQ ID NO: 525733 - DNA, 25 bp, Rattus norvegicus
gccctgcggcgggaacaagggtgac

SEQ ID NO: 525734 - DNA, 25 bp, Rattus norvegicus
tgttgcggacaaagcgcggcgctca

SEQ ID NO: 525735 - DNA, 25 bp, Rattus norvegicus
cgagaccttccttggagcgcaggga

SEQ ID NO: 525736 - DNA, 25 bp, Rattus norvegicus
cgctcttggtgctcctggcctcggt

SEQ ID NO: 525737 - DNA, 25 bp, Rattus norvegicus
ggcaggacagcgatgactcagagtc

SEQ ID NO: 525738 - DNA, 25 bp, Rattus norvegicus
cgtcgagagaagacggtttagtctc

SEQ ID NO: 525739 - DNA, 25 bp, Rattus norvegicus
tgcagccaggcttgcgtcgagagaa

SEQ ID NO: 525740 - DNA, 25 bp, Rattus norvegicus
gcctccatcagcagtcagcgtgcag

SEQ ID NO: 525741 - DNA, 25 bp, Rattus norvegicus
tgactcagagtctgctgaaaaacgc

SEQ ID NO: 525742 - DNA, 25 bp, Rattus norvegicus
gatccgctgcggtttaggcaggaca

SEQ ID NO: 525743 - DNA, 25 bp, Rattus norvegicus
tggacttgaaaacggctggatccgc

SEQ ID NO: 525744 - DNA, 25 bp, Rattus norvegicus
gaaagctgtcataaagtggacttga

SEQ ID NO: 525745 - DNA, 25 bp, Rattus norvegicus
cattaacgagtggaaagctgtcata

SEQ ID NO: 525746 - DNA, 25 bp, Rattus norvegicus
gcattccggcgatcattaacgagtg

SEQ ID NO: 525747 - DNA, 25 bp, Rattus norvegicus
agacgttcttcatgtgcattccggc

SEQ ID NO: 525748 - DNA, 25 bp, Rattus norvegicus
cccacgatgttatgagacgttcttc

SEQ ID NO: 525749 - DNA, 25 bp, Rattus norvegicus
tctgtgggaaggcagcattcgatgt

SEQ ID NO: 525750 - DNA, 25 bp, Rattus norvegicus
cattcgatgtgtgcccacgatgtta

SEQ ID NO: 525751 - DNA, 25 bp, Rattus norvegicus
gctccgtacctgctgagcggatggc

SEQ ID NO: 525752 - DNA, 25 bp, Rattus norvegicus
cccaaggctctgaggctaggacggc

SEQ ID NO: 525753 - DNA, 25 bp, Rattus norvegicus
cagaacaaagacccggaccaacgag

SEQ ID NO: 525754 - DNA, 25 bp, Rattus norvegicus
caacgaggaccagctccgggaacgg

SEQ ID NO: 525755 - DNA, 25 bp, Rattus norvegicus
ctcccgcccgagggccacgcccaca

SEQ ID NO: 525756 - DNA, 25 bp, Rattus norvegicus
ccaaggctctgaggctaggacggcc

SEQ ID NO: 525757 - DNA, 25 bp, Rattus norvegicus
tccgtacctgctgagcggatggccg

SEQ ID NO: 525758 - DNA, 25 bp, Rattus norvegicus
cagctccgggaacgggtcagcggcc

SEQ ID NO: 525759 - DNA, 25 bp, Rattus norvegicus
cgcgccgacccagaacaaagacccg

SEQ ID NO: 525760 - DNA, 25 bp, Rattus norvegicus
gcccgagtcctccacctccatcctc

SEQ ID NO: 525761 - DNA, 25 bp, Rattus norvegicus
cggtcagcaccacgccgcccgagtc

SEQ ID NO: 525762 - DNA, 25 bp, Rattus norvegicus
cgtgcgagtggtaggcggtcagcac

SEQ ID NO: 525763 - DNA, 25 bp, Rattus norvegicus
tggctccgcgccctgcggttgcgag

SEQ ID NO: 525764 - DNA, 25 bp, Rattus norvegicus
gacgcgcagcgtggctccgcgccct

SEQ ID NO: 525765 - DNA, 25 bp, Rattus norvegicus
gcgtttgttcgctcggccgcctaca

SEQ ID NO: 525766 - DNA, 25 bp, Rattus norvegicus
gcagtcagcacgtccgccgggaagc

SEQ ID NO: 525767 - DNA, 25 bp, Rattus norvegicus
gtggctgccattttgcttcgcagtc

SEQ ID NO: 525768 - DNA, 25 bp, Rattus norvegicus
taggggacaaaaaggactcgcagtc

SEQ ID NO: 525769 - DNA, 25 bp, Rattus norvegicus
gctcggccgcctacagcgctgggaa

SEQ ID NO: 525770 - DNA, 25 bp, Rattus norvegicus
ctcctcctccgcaccttgggttcca

SEQ ID NO: 525771 - DNA, 25 bp, Rattus norvegicus
cactaaaactgcctggaggggcggc

SEQ ID NO: 525772 - DNA, 25 bp, Rattus norvegicus
atcggccactaaaactgcctggagg

SEQ ID NO: 525773 - DNA, 25 bp, Rattus norvegicus
ggcggtcgaagctatcggccactaa

SEQ ID NO: 525774 - DNA, 25 bp, Rattus norvegicus
gtcctcacccgaggctggtccttgg

SEQ ID NO: 525775 - DNA, 25 bp, Rattus norvegicus
cgggaagccacaccgcacgcagtag

SEQ ID NO: 525776 - DNA, 25 bp, Rattus norvegicus
gaaccgccgcagtggctgccatttt

SEQ ID NO: 525777 - DNA, 25 bp, Rattus norvegicus
ttttgcttcgcagtcagcacgtccg

SEQ ID NO: 525778 - DNA, 25 bp, Rattus norvegicus
caccgcacgcagtaggggacaaaaa

SEQ ID NO: 525779 - DNA, 25 bp, Rattus norvegicus
ttgttttcgctcctccgctggtggg

SEQ ID NO: 525780 - DNA, 25 bp, Rattus norvegicus
gaaccgaggcatctccggggaaagc

SEQ ID NO: 525781 - DNA, 25 bp, Rattus norvegicus
gaaagcccggactgcttgccacgcg

SEQ ID NO: 525782 - DNA, 25 bp, Rattus norvegicus
agcccggactgcttgccacgcggtg

SEQ ID NO: 525783 - DNA, 25 bp, Rattus norvegicus
agccaggcaggtgcggcaggagcat

SEQ ID NO: 525784 - DNA, 25 bp, Rattus norvegicus
ctctggggtaagcagggtgcgcgct

SEQ ID NO: 525785 - DNA, 25 bp, Rattus norvegicus
atgggttcctcgcttctctctcgcc

SEQ ID NO: 525786 - DNA, 25 bp, Rattus norvegicus
cctcgcttctctctcgccgcggggc

SEQ ID NO: 525787 - DNA, 25 bp, Rattus norvegicus
ggaggtgcgccccacttgtcttcca

SEQ ID NO: 525788 - DNA, 25 bp, Rattus norvegicus
ccacttgtcttccacttcgcttgtt

SEQ ID NO: 525789 - DNA, 25 bp, Rattus norvegicus
ttgtcttccacttcgcttgttttcg

SEQ ID NO: 525790 - DNA, 25 bp, Rattus norvegicus
tcttccacttcgcttgttttcgctc

SEQ ID NO: 525791 - DNA, 25 bp, Rattus norvegicus
ggggaaagcccggactgcttgccac

SEQ ID NO: 525792 - DNA, 25 bp, Rattus norvegicus
ttcgcttgttttcgctcctccgctg

SEQ ID NO: 525793 - DNA, 25 bp, Rattus norvegicus
ggttcagcggcgtccaaaaccctgc

SEQ ID NO: 525794 - DNA, 25 bp, Rattus norvegicus
acctggctcaagcacgcggttgcag

SEQ ID NO: 525795 - DNA, 25 bp, Rattus norvegicus
acgcggttgcaggtgtcatctaccc

SEQ ID NO: 525796 - DNA, 25 bp, Rattus norvegicus
ctcccgggaagagggacaagtcgct

SEQ ID NO: 525797 - DNA, 25 bp, Rattus norvegicus
atcctgccgcaatttccctgtgtca

SEQ ID NO: 525798 - DNA, 25 bp, Rattus norvegicus
atttccctgtgtcatggctccggtc

SEQ ID NO: 525799 - DNA, 25 bp, Rattus norvegicus
tcatggctccggtctcttagcaaca

SEQ ID NO: 525800 - DNA, 25 bp, Rattus norvegicus
ggtctcttagcaacagccgccagtc

SEQ ID NO: 525801 - DNA, 25 bp, Rattus norvegicus
gcgcgccgcagccacacaaaagagg

SEQ ID NO: 525802 - DNA, 25 bp, Rattus norvegicus
cgggtagcagaggacctgacacttc

SEQ ID NO: 525803 - DNA, 25 bp, Rattus norvegicus
ctgacacttcttgggaactcttgga

SEQ ID NO: 525804 - DNA, 25 bp, Rattus norvegicus
gaactcttggaaatggctcccgcca

SEQ ID NO: 525805 - DNA, 25 bp, Rattus norvegicus
gccaccaagcccgaggggactgcga

SEQ ID NO: 525806 - DNA, 25 bp, Rattus norvegicus
aaaaccctgcctttacacgatcgcg

SEQ ID NO: 525807 - DNA, 25 bp, Rattus norvegicus
cgggacgacagcatgcaccgccagg

SEQ ID NO: 525808 - DNA, 25 bp, Rattus norvegicus
cagcaccagtggactcccggagtac

SEQ ID NO: 525809 - DNA, 25 bp, Rattus norvegicus
agcatataccgcgagcgctccagtg

SEQ ID NO: 525810 - DNA, 25 bp, Rattus norvegicus
tccgcgccaaagatctggcagcagc

SEQ ID NO: 525811 - DNA, 25 bp, Rattus norvegicus
cagcgccgctcaatggctttcttaa

SEQ ID NO: 525812 - DNA, 25 bp, Rattus norvegicus
taactacgtgcaatcccgaggcctg

SEQ ID NO: 525813 - DNA, 25 bp, Rattus norvegicus
ttcgcagcggacctagactctggcc

SEQ ID NO: 525814 - DNA, 25 bp, Rattus norvegicus
tgaccgaggccgtgtatagcatata

SEQ ID NO: 525815 - DNA, 25 bp, Rattus norvegicus
tggctgcggctactgccactgtcac

SEQ ID NO: 525816 - DNA, 25 bp, Rattus norvegicus
gccctgcagcccaaccggtagttgg

SEQ ID NO: 525817 - DNA, 25 bp, Rattus norvegicus
cttcgccctgttgcccttgcatggg

SEQ ID NO: 525818 - DNA, 25 bp, Rattus norvegicus
gaaggcgcaagctgcagctggcaca

SEQ ID NO: 525819 - DNA, 25 bp, Rattus norvegicus
caggggagaactggacctaagcctg

SEQ ID NO: 525820 - DNA, 25 bp, Rattus norvegicus
ggacttggcttcatctccgcgctgt

SEQ ID NO: 525821 - DNA, 25 bp, Rattus norvegicus
tgcagccaactagcacacccggagg

SEQ ID NO: 525822 - DNA, 25 bp, Rattus norvegicus
tccgagctcagacccgggaaaagcc

SEQ ID NO: 525823 - DNA, 25 bp, Rattus norvegicus
agcgttccctattgcgaggccgaaa

SEQ ID NO: 525824 - DNA, 25 bp, Rattus norvegicus
tgccaccaacgctgcaggagaagcc

SEQ ID NO: 525825 - DNA, 25 bp, Rattus norvegicus
tcggcccacagttcgccgcgttgaa

SEQ ID NO: 525826 - DNA, 25 bp, Rattus norvegicus
ggtgcccttgcactactttgttttc

SEQ ID NO: 525827 - DNA, 25 bp, Rattus norvegicus
tcggagatttcgtgccagtgccaac

SEQ ID NO: 525828 - DNA, 25 bp, Rattus norvegicus
tctagcccgcggattcggagatttc

SEQ ID NO: 525829 - DNA, 25 bp, Rattus norvegicus
ccaaaggctctggaggacgtcatcc

SEQ ID NO: 525830 - DNA, 25 bp, Rattus norvegicus
ccgcgttgaagctgcagcgacagtg

SEQ ID NO: 525831 - DNA, 25 bp, Rattus norvegicus
tgctagcgcccttctggaatgcata

SEQ ID NO: 525832 - DNA, 25 bp, Rattus norvegicus
gtcgatccctgagaagcctggaaga

SEQ ID NO: 525833 - DNA, 25 bp, Rattus norvegicus
tctgctatccaggtgagcgcctttc

SEQ ID NO: 525834 - DNA, 25 bp, Rattus norvegicus
agctcgcgaatctctgtccctagga

SEQ ID NO: 525835 - DNA, 25 bp, Rattus norvegicus
ctagaggacctaggtgtcctaaaga

SEQ ID NO: 525836 - DNA, 25 bp, Rattus norvegicus
gtgtcctaaagaactgcggcggccc

SEQ ID NO: 525837 - DNA, 25 bp, Rattus norvegicus
tttttcgggttgctctctaatcgcg

SEQ ID NO: 525838 - DNA, 25 bp, Rattus norvegicus
gggcttgctttttcgggttgctctc

SEQ ID NO: 525839 - DNA, 25 bp, Rattus norvegicus
cctactagttgcgagtggcgcgcct

SEQ ID NO: 525840 - DNA, 25 bp, Rattus norvegicus
ccctctctagccatcggcgcggagc

SEQ ID NO: 525841 - DNA, 25 bp, Rattus norvegicus
aacgcgcccgggcatgcagaccagt

SEQ ID NO: 525842 - DNA, 25 bp, Rattus norvegicus
gagccctgagctgcggcttcctccc

SEQ ID NO: 525843 - DNA, 25 bp, Rattus norvegicus
ccagagctaggatctagaggaccta

SEQ ID NO: 525844 - DNA, 25 bp, Rattus norvegicus
gcggagctcggagcatctcggctcc

SEQ ID NO: 525845 - DNA, 25 bp, Rattus norvegicus
ccgttggccggtccgccaggttgct

SEQ ID NO: 525846 - DNA, 25 bp, Rattus norvegicus
ggccgcaggactcggatccctacta

SEQ ID NO: 525847 - DNA, 25 bp, Rattus norvegicus
catgcagaccagtgcacccgggcgg

SEQ ID NO: 525848 - DNA, 25 bp, Rattus norvegicus
ggactcggatccctactagttgcga

SEQ ID NO: 525849 - DNA, 25 bp, Rattus norvegicus
actggaaggtctcccaggtcctgtc

SEQ ID NO: 525850 - DNA, 25 bp, Rattus norvegicus
agctaatacgcatgctccactcacg

SEQ ID NO: 525851 - DNA, 25 bp, Rattus norvegicus
tcctccggaactggaaggtctccca

SEQ ID NO: 525852 - DNA, 25 bp, Rattus norvegicus
tcatcccttcctccggaactggaag

SEQ ID NO: 525853 - DNA, 25 bp, Rattus norvegicus
ggagctgtcccttctccttacccaa

SEQ ID NO: 525854 - DNA, 25 bp, Rattus norvegicus
cctgcggacccgctgctgggtgaca

SEQ ID NO: 525855 - DNA, 25 bp, Rattus norvegicus
gctttgccacgctcgctgtgggcca

SEQ ID NO: 525856 - DNA, 25 bp, Rattus norvegicus
aggtctcccaggtcctgtcagctcg

SEQ ID NO: 525857 - DNA, 25 bp, Rattus norvegicus
acccgtagtcgcctgggccgtgcgt

SEQ ID NO: 525858 - DNA, 25 bp, Rattus norvegicus
cggattcccgcagctaatacgcatg

SEQ ID NO: 525859 - DNA, 25 bp, Rattus norvegicus
gaaagactggttgcggattcccgca

SEQ ID NO: 525860 - DNA, 25 bp, Rattus norvegicus
caccgaactatctgggaaagactgg

SEQ ID NO: 525861 - DNA, 25 bp, Rattus norvegicus
atgcttcacacaccgaactatctgg

SEQ ID NO: 525862 - DNA, 25 bp, Rattus norvegicus
agcgcaggatgcttcacacaccgaa

SEQ ID NO: 525863 - DNA, 25 bp, Rattus norvegicus
ctgcccaaaagccaggacgagctca

SEQ ID NO: 525864 - DNA, 25 bp, Rattus norvegicus
aggacgagctcagcgcccgaacggt

SEQ ID NO: 525865 - DNA, 25 bp, Rattus norvegicus
cgcgcccaggggcagaaatggccca

SEQ ID NO: 525866 - DNA, 25 bp, Rattus norvegicus
cgatccggttccgtgcctgcgcaag

SEQ ID NO: 525867 - DNA, 25 bp, Rattus norvegicus
gctcacttaagaggcccgatccggt

SEQ ID NO: 525868 - DNA, 25 bp, Rattus norvegicus
agcgtccacccgtaaggtcccagat

SEQ ID NO: 525869 - DNA, 25 bp, Rattus norvegicus
ggggcacctgcccaaaagccaggac

SEQ ID NO: 525870 - DNA, 25 bp, Rattus norvegicus
cgttcccgatgcagtgccgaggccg

SEQ ID NO: 525871 - DNA, 25 bp, Rattus norvegicus
ctgctcgctcacttaagaggcccga

SEQ ID NO: 525872 - DNA, 25 bp, Rattus norvegicus
aagctcccgcgttcccgatgcagtg

SEQ ID NO: 525873 - DNA, 25 bp, Rattus norvegicus
catgcacacgcacgggagcgcaagc

SEQ ID NO: 525874 - DNA, 25 bp, Rattus norvegicus
gagagctgagctcgagcattcgctc

SEQ ID NO: 525875 - DNA, 25 bp, Rattus norvegicus
cagaaatggcccacgcacatgcaca

SEQ ID NO: 525876 - DNA, 25 bp, Rattus norvegicus
agcattcgctccctcgcggacgaag

SEQ ID NO: 525877 - DNA, 25 bp, Rattus norvegicus
cccggctgatcacgggcttcgaaat

SEQ ID NO: 525878 - DNA, 25 bp, Rattus norvegicus
ctgctgcgggccaaagaagagcctc

SEQ ID NO: 525879 - DNA, 25 bp, Rattus norvegicus
tggcctgtcgctggcgggcaccact

SEQ ID NO: 525880 - DNA, 25 bp, Rattus norvegicus
cactcaggggagcttttgtttagga

SEQ ID NO: 525881 - DNA, 25 bp, Rattus norvegicus
agggctcgttgcacccggctgatca

SEQ ID NO: 525882 - DNA, 25 bp, Rattus norvegicus
gcttcgaaatgcgagtgtgggctcc

SEQ ID NO: 525883 - DNA, 25 bp, Rattus norvegicus
ccaggtcttgcacggggtcccggat

SEQ ID NO: 525884 - DNA, 25 bp, Rattus norvegicus
tggtgtggccgccattgtcgcagct

SEQ ID NO: 525885 - DNA, 25 bp, Rattus norvegicus
cggctgcggctgcttatgtaagttt

SEQ ID NO: 525886 - DNA, 25 bp, Rattus norvegicus
agtttgctttgggaaagcctggctc

SEQ ID NO: 525887 - DNA, 25 bp, Rattus norvegicus
gaaagcctggctccctgctcggcga

SEQ ID NO: 525888 - DNA, 25 bp, Rattus norvegicus
tgctcggcgaggacgccttagagct

SEQ ID NO: 525889 - DNA, 25 bp, Rattus norvegicus
gtcgcagctgctccggaataaggag

SEQ ID NO: 525890 - DNA, 25 bp, Rattus norvegicus
tttaggaaagaatgctgagggctcg

SEQ ID NO: 525891 - DNA, 25 bp, Rattus norvegicus
ccgatgctcaggacgatgatgtgga

SEQ ID NO: 525892 - DNA, 25 bp, Rattus norvegicus
ctgatgatgtcgtccggtcagattc

SEQ ID NO: 525893 - DNA, 25 bp, Rattus norvegicus
tcgtccggtcagattcttggcatcc

SEQ ID NO: 525894 - DNA, 25 bp, Rattus norvegicus
agattcttggcatccgctttttgga

SEQ ID NO: 525895 - DNA, 25 bp, Rattus norvegicus
tccgctttttggataaactgtgttc

SEQ ID NO: 525896 - DNA, 25 bp, Rattus norvegicus
aactgtgttcccagaagcgcgacgt

SEQ ID NO: 525897 - DNA, 25 bp, Rattus norvegicus
gcccggatgaaagtaacggccagtc

SEQ ID NO: 525898 - DNA, 25 bp, Rattus norvegicus
ggatgacagcccttctgacgacacg

SEQ ID NO: 525899 - DNA, 25 bp, Rattus norvegicus
gaagaaatcggggaccaggatgaca

SEQ ID NO: 525900 - DNA, 25 bp, Rattus norvegicus
attggagacgctgccgatgctcagg

SEQ ID NO: 525901 - DNA, 25 bp, Rattus norvegicus
aggaggacgtcaacctgatgatgtc

SEQ ID NO: 525902 - DNA, 25 bp, Rattus norvegicus
cgcgacgtgtccagcccggatgaaa

SEQ ID NO: 525903 - DNA, 25 bp, Rattus norvegicus
taagtattgcctcaagttaaaccgc

SEQ ID NO: 525904 - DNA, 25 bp, Rattus norvegicus
acggccagtccaagagtaagtattg

SEQ ID NO: 525905 - DNA, 25 bp, Rattus norvegicus
gcaagagcaggaaacccacggagcc

SEQ ID NO: 525906 - DNA, 25 bp, Rattus norvegicus
cacgccgcaggacgtcatgctcgag

SEQ ID NO: 525907 - DNA, 25 bp, Rattus norvegicus
acgtcatgctcgaggtggatcctgg

SEQ ID NO: 525908 - DNA, 25 bp, Rattus norvegicus
tggtcgccaccggaagtacgtcact

SEQ ID NO: 525909 - DNA, 25 bp, Rattus norvegicus
agtacgtcactagagtaggccgggc

SEQ ID NO: 525910 - DNA, 25 bp, Rattus norvegicus
ctaggcctggcctaggctggagcac

SEQ ID NO: 525911 - DNA, 25 bp, Rattus norvegicus
cgaggccgtgtctctggaacttagt

SEQ ID NO: 525912 - DNA, 25 bp, Rattus norvegicus
tctggaacttagtgatcgaaatgcc

SEQ ID NO: 525913 - DNA, 25 bp, Rattus norvegicus
ctggcagcggagaactgcagcaaga

SEQ ID NO: 525914 - DNA, 25 bp, Rattus norvegicus
tggaactatccctcaccggtgcagg

SEQ ID NO: 525915 - DNA, 25 bp, Rattus norvegicus
gacgcttaaagggacagcgggtatc

SEQ ID NO: 525916 - DNA, 25 bp, Rattus norvegicus
tcacgccgcggtttaaccgctggtg

SEQ ID NO: 525917 - DNA, 25 bp, Rattus norvegicus
gggcttctgtgagttctagtgtttc

SEQ ID NO: 525918 - DNA, 25 bp, Rattus norvegicus
tcgaaatgccaacgccgaggggact

SEQ ID NO: 525919 - DNA, 25 bp, Rattus norvegicus
gtcggatgctgtcacaggctcactc

SEQ ID NO: 525920 - DNA, 25 bp, Rattus norvegicus
cccttcggtcttgcgcaagctttgt

SEQ ID NO: 525921 - DNA, 25 bp, Rattus norvegicus
agaagattccagacccggtatcaga

SEQ ID NO: 525922 - DNA, 25 bp, Rattus norvegicus
actcaggacggcagagaagattcca

SEQ ID NO: 525923 - DNA, 25 bp, Rattus norvegicus
gcatcagcggtgcttctgggaaacg

SEQ ID NO: 525924 - DNA, 25 bp, Rattus norvegicus
tgagggactacgattcccttcggtc

SEQ ID NO: 525925 - DNA, 25 bp, Rattus norvegicus
aggctcactcctttgggctctccga

SEQ ID NO: 525926 - DNA, 25 bp, Rattus norvegicus
tgcccagccctggtgactcaggacg

SEQ ID NO: 525927 - DNA, 25 bp, Rattus norvegicus
cttttccatgcagtgtcggatgctg

SEQ ID NO: 525928 - DNA, 25 bp, Rattus norvegicus
ggtagcggttcttgccttttccatg

SEQ ID NO: 525929 - DNA, 25 bp, Rattus norvegicus
aggcttgttttgctccgggtccgat

SEQ ID NO: 525930 - DNA, 25 bp, Rattus norvegicus
gggattatgccgctataaaggcttg

SEQ ID NO: 525931 - DNA, 25 bp, Rattus norvegicus
aagctttgtgcatcgcgcttgcgca

SEQ ID NO: 525932 - DNA, 25 bp, Rattus norvegicus
gaaacggggcctgtctcgccctgat

SEQ ID NO: 525933 - DNA, 25 bp, Rattus norvegicus
cagcatttggagtgagcgcgacacc

SEQ ID NO: 525934 - DNA, 25 bp, Rattus norvegicus
aaccgggcaattacctttctgtctg

SEQ ID NO: 525935 - DNA, 25 bp, Rattus norvegicus
aagtggcccacttgccagcatcgga

SEQ ID NO: 525936 - DNA, 25 bp, Rattus norvegicus
gactgcagcaggaggatgctactgc

SEQ ID NO: 525937 - DNA, 25 bp, Rattus norvegicus
tctgaaactctgtcgggactgcagc

SEQ ID NO: 525938 - DNA, 25 bp, Rattus norvegicus
ccctgtgaatttgggtctgaaactc

SEQ ID NO: 525939 - DNA, 25 bp, Rattus norvegicus
cccatccttagaagtggcaaagtgc

SEQ ID NO: 525940 - DNA, 25 bp, Rattus norvegicus
cgacaccttggcaagtggcccactt

SEQ ID NO: 525941 - DNA, 25 bp, Rattus norvegicus
ggagatcgtccggttgctcctctcc

SEQ ID NO: 525942 - DNA, 25 bp, Rattus norvegicus
gaagtcatggtgttcgctccaggta

SEQ ID NO: 525943 - DNA, 25 bp, Rattus norvegicus
acctctctaaactcaggggtgtagc

SEQ ID NO: 525944 - DNA, 25 bp, Rattus norvegicus
tccttcggcggtggatcgccaagct

SEQ ID NO: 525945 - DNA, 25 bp, Rattus norvegicus
ttccgtccttcctgctcgggtggaa

SEQ ID NO: 525946 - DNA, 25 bp, Rattus norvegicus
tagaagcgccctgctccttcggcgg

SEQ ID NO: 525947 - DNA, 25 bp, Rattus norvegicus
ctcggtgcctggcttttctgttccc

SEQ ID NO: 525948 - DNA, 25 bp, Rattus norvegicus
tcttccgtccgattgccactcggtg

SEQ ID NO: 525949 - DNA, 25 bp, Rattus norvegicus
tctattccgtcttccgtccgattgc

SEQ ID NO: 525950 - DNA, 25 bp, Rattus norvegicus
ttctattccgtcttccgtccgattg

SEQ ID NO: 525951 - DNA, 25 bp, Rattus norvegicus
gcacggtccgcccaggtttctattc

SEQ ID NO: 525952 - DNA, 25 bp, Rattus norvegicus
accgtgcatcctaggggccgggcac

SEQ ID NO: 525953 - DNA, 25 bp, Rattus norvegicus
cactcggtgcctggcttttctgttc

SEQ ID NO: 525954 - DNA, 25 bp, Rattus norvegicus
ggccgcgctccaccgtgcatcctag

SEQ ID NO: 525955 - DNA, 25 bp, Rattus norvegicus
tccaccgtgcatcctaggggccggg

SEQ ID NO: 525956 - DNA, 25 bp, Rattus norvegicus
gcccttccttcagtgtgtgcttgag

SEQ ID NO: 525957 - DNA, 25 bp, Rattus norvegicus
gggcaccgtgcccttccttcagtgt

SEQ ID NO: 525958 - DNA, 25 bp, Rattus norvegicus
gcaccgtgcccttccttcagtgtgt

SEQ ID NO: 525959 - DNA, 25 bp, Rattus norvegicus
accgtgcccttccttcagtgtgtgc

SEQ ID NO: 525960 - DNA, 25 bp, Rattus norvegicus
gtgcccttccttcagtgtgtgcttg

SEQ ID NO: 525961 - DNA, 25 bp, Rattus norvegicus
tgctgctcacctcccgttgcgaggt

SEQ ID NO: 525962 - DNA, 25 bp, Rattus norvegicus
gggtacggataggtcacgcccacta

SEQ ID NO: 525963 - DNA, 25 bp, Rattus norvegicus
ggcagccctcgcatcctagggactg

SEQ ID NO: 525964 - DNA, 25 bp, Rattus norvegicus
tcagggcgccgcaaacccgaggacg

SEQ ID NO: 525965 - DNA, 25 bp, Rattus norvegicus
gctcctcgctccgaggctcgaggga

SEQ ID NO: 525966 - DNA, 25 bp, Rattus norvegicus
cccgccgtattaacatgtactcagg

SEQ ID NO: 525967 - DNA, 25 bp, Rattus norvegicus
cttcacctcgctgagaggcgtccgg

SEQ ID NO: 525968 - DNA, 25 bp, Rattus norvegicus
agcgcttggcttctggccacggccg

SEQ ID NO: 525969 - DNA, 25 bp, Rattus norvegicus
ggacgtacttgccaacggaggctga

SEQ ID NO: 525970 - DNA, 25 bp, Rattus norvegicus
agcgtccactccgtagcagccagag

SEQ ID NO: 525971 - DNA, 25 bp, Rattus norvegicus
tggccgggaccaaggccagcgtcca

SEQ ID NO: 525972 - DNA, 25 bp, Rattus norvegicus
caagacgctgcgcaagggtacggat

SEQ ID NO: 525973 - DNA, 25 bp, Rattus norvegicus
taacatgtactcaggggcgggtgac

SEQ ID NO: 525974 - DNA, 25 bp, Rattus norvegicus
cagacaggagcggaagtttacttcc

SEQ ID NO: 525975 - DNA, 25 bp, Rattus norvegicus
gccatagctacgtgcgggctatcga

SEQ ID NO: 525976 - DNA, 25 bp, Rattus norvegicus
cgaggaattgggtgtcctcggcatc

SEQ ID NO: 525977 - DNA, 25 bp, Rattus norvegicus
gcagctgcgcacagccgaggaattg

SEQ ID NO: 525978 - DNA, 25 bp, Rattus norvegicus
ttggcagctccacattggccgcagc

SEQ ID NO: 525979 - DNA, 25 bp, Rattus norvegicus
accggtgagtgagcttggcagctcc

SEQ ID NO: 525980 - DNA, 25 bp, Rattus norvegicus
ggaccatccagagtagcaccggtga

SEQ ID NO: 525981 - DNA, 25 bp, Rattus norvegicus
ggtgaacggacagttcgaatccgta

SEQ ID NO: 525982 - DNA, 25 bp, Rattus norvegicus
gggctatcgagaagggctgctccca

SEQ ID NO: 525983 - DNA, 25 bp, Rattus norvegicus
cgcatgcggagccatagctacgtgc

SEQ ID NO: 525984 - DNA, 25 bp, Rattus norvegicus
atgcctggctgcttccgcatgcgga

SEQ ID NO: 525985 - DNA, 25 bp, Rattus norvegicus
aagcgctggacctgcccatgcctgg

SEQ ID NO: 525986 - DNA, 25 bp, Rattus norvegicus
ctgtgttcagcgaactggagtcgca

SEQ ID NO: 525987 - DNA, 25 bp, Rattus norvegicus
atccgtatgcgagtctgtgttcagc

SEQ ID NO: 525988 - DNA, 25 bp, Rattus norvegicus
accaccgtgaggaccatccagagta

SEQ ID NO: 525989 - DNA, 25 bp, Rattus norvegicus
actgcacgtttgttgactttgccta

SEQ ID NO: 525990 - DNA, 25 bp, Rattus norvegicus
attggcggctggcttcccggacaaa

SEQ ID NO: 525991 - DNA, 25 bp, Rattus norvegicus
ctgccatcactgcacgtttgttgac

SEQ ID NO: 525992 - DNA, 25 bp, Rattus norvegicus
aacggtgcacagctgccatcactgc

SEQ ID NO: 525993 - DNA, 25 bp, Rattus norvegicus
ggaatagcccatccgcaacggtgca

SEQ ID NO: 525994 - DNA, 25 bp, Rattus norvegicus
aatgcactttcaccggaatagccca

SEQ ID NO: 525995 - DNA, 25 bp, Rattus norvegicus
cgagagcgctctaaatgcactttca

SEQ ID NO: 525996 - DNA, 25 bp, Rattus norvegicus
ttccgcgaaggaacgagagcgctct

SEQ ID NO: 525997 - DNA, 25 bp, Rattus norvegicus
gattggtgccaaggaggaatcctta

SEQ ID NO: 525998 - DNA, 25 bp, Rattus norvegicus
cttgggaaccagaaggattggtgcc

SEQ ID NO: 525999 - DNA, 25 bp, Rattus norvegicus
tagtaacggctcatggacgccaggg

SEQ ID NO: 526000 - DNA, 25 bp, Rattus norvegicus
cggacaaaggcgtagtaacggctca

SEQ ID NO: 526001 - DNA, 25 bp, Rattus norvegicus
ctggcttcccggacaaaggcgtagt

SEQ ID NO: 526002 - DNA, 25 bp, Rattus norvegicus
ttgactttgcctaacgcagctgccg

SEQ ID NO: 526003 - DNA, 25 bp, Rattus norvegicus
gacgaggaccgtcccgcatccctgc

SEQ ID NO: 526004 - DNA, 25 bp, Rattus norvegicus
gctcgctggagagctcgcagcgcca

SEQ ID NO: 526005 - DNA, 25 bp, Rattus norvegicus
gcaagcgcctgatggccgccaagcg

SEQ ID NO: 526006 - DNA, 25 bp, Rattus norvegicus
aagcgcgcagcatcagtccgccaga

SEQ ID NO: 526007 - DNA, 25 bp, Rattus norvegicus
gtccgccagaactcggccaccgaga

SEQ ID NO: 526008 - DNA, 25 bp, Rattus norvegicus
gcatccctgccctcggccgtctccc

SEQ ID NO: 526009 - DNA, 25 bp, Rattus norvegicus
ccgccaccgtcgtggcgtagttgtc

SEQ ID NO: 526010 - DNA, 25 bp, Rattus norvegicus
caccgtcgtggcgtagttgtccacc

SEQ ID NO: 526011 - DNA, 25 bp, Rattus norvegicus
tcgtggcgtagttgtccacctcgca

SEQ ID NO: 526012 - DNA, 25 bp, Rattus norvegicus
tggcgtagttgtccacctcgcagga

SEQ ID NO: 526013 - DNA, 25 bp, Rattus norvegicus
cgtagttgtccacctcgcaggagcc

SEQ ID NO: 526014 - DNA, 25 bp, Rattus norvegicus
agttgtccacctcgcaggagccgtc

SEQ ID NO: 526015 - DNA, 25 bp, Rattus norvegicus
cccgcgccgttgatccgggagcgct

SEQ ID NO: 526016 - DNA, 25 bp, Rattus norvegicus
tctctgagctcagtgaccgccaccg

SEQ ID NO: 526017 - DNA, 25 bp, Rattus norvegicus
tgcagcccggcatgcgcgttcgcat

SEQ ID NO: 526018 - DNA, 25 bp, Rattus norvegicus
gtccatcttccagccgtgcctctca

SEQ ID NO: 526019 - DNA, 25 bp, Rattus norvegicus
aacctcagtgagcagggcgccttgc

SEQ ID NO: 526020 - DNA, 25 bp, Rattus norvegicus
atcctggatgactacgaagagatca

SEQ ID NO: 526021 - DNA, 25 bp, Rattus norvegicus
tgcgcgttcgcatcctggatgacta

SEQ ID NO: 526022 - DNA, 25 bp, Rattus norvegicus
tgactacgaagagatcagtgctggg

SEQ ID NO: 526023 - DNA, 25 bp, Rattus norvegicus
gtgaatatgttcagcagacggtgca

SEQ ID NO: 526024 - DNA, 25 bp, Rattus norvegicus
gcagtggttacggtgaatatgttca

SEQ ID NO: 526025 - DNA, 25 bp, Rattus norvegicus
ccagccgcagtggttacggtgaata

SEQ ID NO: 526026 - DNA, 25 bp, Rattus norvegicus
ttctgaattttccagccgcagtggt

SEQ ID NO: 526027 - DNA, 25 bp, Rattus norvegicus
ttccgcggccgttctgaattttcca

SEQ ID NO: 526028 - DNA, 25 bp, Rattus norvegicus
cgtcactacgcccaggaagccagga

SEQ ID NO: 526029 - DNA, 25 bp, Rattus norvegicus
ctgctgcccaccatcgtcactacgc

SEQ ID NO: 526030 - DNA, 25 bp, Rattus norvegicus
gcctctcaggccctccactgctgct

SEQ ID NO: 526031 - DNA, 25 bp, Rattus norvegicus
ctgcctcgtcgctttgtttgctaac

SEQ ID NO: 526032 - DNA, 25 bp, Rattus norvegicus
ttgctaacttggactgtggctttcg

SEQ ID NO: 526033 - DNA, 25 bp, Rattus norvegicus
cagcacgaggccgaaacgttccttc

SEQ ID NO: 526034 - DNA, 25 bp, Rattus norvegicus
tcagcctggctaatgaatgcgattc

SEQ ID NO: 526035 - DNA, 25 bp, Rattus norvegicus
aagcctctctcaaaccaggacgcga

SEQ ID NO: 526036 - DNA, 25 bp, Rattus norvegicus
aactcaccgtgacgcgaaggccagc

SEQ ID NO: 526037 - DNA, 25 bp, Rattus norvegicus
acctcctgctcgtgtaaatcatttc

SEQ ID NO: 526038 - DNA, 25 bp, Rattus norvegicus
atcatttcgaggcagttgggaagcc

SEQ ID NO: 526039 - DNA, 25 bp, Rattus norvegicus
aaatcctgtggtttgcagagcgctc

SEQ ID NO: 526040 - DNA, 25 bp, Rattus norvegicus
tcccggacctgactggggatgactc

SEQ ID NO: 526041 - DNA, 25 bp, Rattus norvegicus
tcacagtaagcaggcaggaatctca

SEQ ID NO: 526042 - DNA, 25 bp, Rattus norvegicus
agagcgctcgctcggtaagagagca

SEQ ID NO: 526043 - DNA, 25 bp, Rattus norvegicus
gccacgcggtggctctcattatgta

SEQ ID NO: 526044 - DNA, 25 bp, Rattus norvegicus
gccggtacagagtagaagaagcctc

SEQ ID NO: 526045 - DNA, 25 bp, Rattus norvegicus
atcggatgtcgcaggccctgtgcac

SEQ ID NO: 526046 - DNA, 25 bp, Rattus norvegicus
gcgtctagaacggatgcgcccagtt

SEQ ID NO: 526047 - DNA, 25 bp, Rattus norvegicus
cagttgcgctaactctcagcttgga

SEQ ID NO: 526048 - DNA, 25 bp, Rattus norvegicus
cttggacctaaagcctgcagacgcg

SEQ ID NO: 526049 - DNA, 25 bp, Rattus norvegicus
caccaggtgtcagtcatcggatgtc

SEQ ID NO: 526050 - DNA, 25 bp, Rattus norvegicus
tcgttcgaccaagggttcgccagca

SEQ ID NO: 526051 - DNA, 25 bp, Rattus norvegicus
ttcgccagcacaggaaccacgcagg

SEQ ID NO: 526052 - DNA, 25 bp, Rattus norvegicus
cgagagccactcacctgacctgaag

SEQ ID NO: 526053 - DNA, 25 bp, Rattus norvegicus
ctgacctgaagctgcacgcacaaga

SEQ ID NO: 526054 - DNA, 25 bp, Rattus norvegicus
acattttgaagactccagggcccgg

SEQ ID NO: 526055 - DNA, 25 bp, Rattus norvegicus
agccagcggcggtgattaacttggc

SEQ ID NO: 526056 - DNA, 25 bp, Rattus norvegicus
tgattaacttggctgcgcggcctga

SEQ ID NO: 526057 - DNA, 25 bp, Rattus norvegicus
agctcagcccagatagccgtgaata

SEQ ID NO: 526058 - DNA, 25 bp, Rattus norvegicus
cgggcagcaatgcaccaggtgtcag

SEQ ID NO: 526059 - DNA, 25 bp, Rattus norvegicus
ctcgcaaaccggaaggaagcctggc

SEQ ID NO: 526060 - DNA, 25 bp, Rattus norvegicus
gttagcaactcaacagagctccgga

SEQ ID NO: 526061 - DNA, 25 bp, Rattus norvegicus
tcccgcaagtttacgttagcaactc

SEQ ID NO: 526062 - DNA, 25 bp, Rattus norvegicus
tgaatcagcctgtgggtcagcgcct

SEQ ID NO: 526063 - DNA, 25 bp, Rattus norvegicus
ccgcgagaaccaagagtgagcgtct

SEQ ID NO: 526064 - DNA, 25 bp, Rattus norvegicus
agggcgccgatgagaagtaccgaac

SEQ ID NO: 526065 - DNA, 25 bp, Rattus norvegicus
gaggacctctcggtctaattactga

SEQ ID NO: 526066 - DNA, 25 bp, Rattus norvegicus
actgactcttcgtctttctcgcgtc

SEQ ID NO: 526067 - DNA, 25 bp, Rattus norvegicus
cgcgtctccgtttgaactgtgattc

SEQ ID NO: 526068 - DNA, 25 bp, Rattus norvegicus
ctcttcggcagatggttgcgcctgt

SEQ ID NO: 526069 - DNA, 25 bp, Rattus norvegicus
gcccgcattccagagcgtggagata

SEQ ID NO: 526070 - DNA, 25 bp, Rattus norvegicus
cgggtctcacgtgactagccttggc

SEQ ID NO: 526071 - DNA, 25 bp, Rattus norvegicus
ctgcgcgggaaactagtgtgaatca

SEQ ID NO: 526072 - DNA, 25 bp, Rattus norvegicus
gcgctggcgagctaagcaacatttc

SEQ ID NO: 526073 - DNA, 25 bp, Rattus norvegicus
ggtggtgctctaggccgctcctcca

SEQ ID NO: 526074 - DNA, 25 bp, Rattus norvegicus
ccggttttcccttgagctggagtcg

SEQ ID NO: 526075 - DNA, 25 bp, Rattus norvegicus
gacgcaggtaatggctgccgcttcc

SEQ ID NO: 526076 - DNA, 25 bp, Rattus norvegicus
cggcagctgcttggacgcaggtaat

SEQ ID NO: 526077 - DNA, 25 bp, Rattus norvegicus
taccgggagctctctgcgacccagg

SEQ ID NO: 526078 - DNA, 25 bp, Rattus norvegicus
tgggctgccgctctccattgtttac

SEQ ID NO: 526079 - DNA, 25 bp, Rattus norvegicus
cagaggttgttaagatggcgttgta

SEQ ID NO: 526080 - DNA, 25 bp, Rattus norvegicus
aactgttcggcctccaggtggtgct

SEQ ID NO: 526081 - DNA, 25 bp, Rattus norvegicus
ttgtatagttgggtacagcgaggct

SEQ ID NO: 526082 - DNA, 25 bp, Rattus norvegicus
tccattgtttacgaggtctttccta

SEQ ID NO: 526083 - DNA, 25 bp, Rattus norvegicus
ggtctttcctaaagctgcctcattc

SEQ ID NO: 526084 - DNA, 25 bp, Rattus norvegicus
tcgctcctgcccgagcggtgtctgg

SEQ ID NO: 526085 - DNA, 25 bp, Rattus norvegicus
cttggcttctggaggtgtcgctcct

SEQ ID NO: 526086 - DNA, 25 bp, Rattus norvegicus
agtccttcgttcctcttggcttctg

SEQ ID NO: 526087 - DNA, 25 bp, Rattus norvegicus
cgttacgcgggagacaacgtttgca

SEQ ID NO: 526088 - DNA, 25 bp, Rattus norvegicus
acgcagcagaccgtttgcacttttt

SEQ ID NO: 526089 - DNA, 25 bp, Rattus norvegicus
tcacgcagcagaccgtttgcacttt

SEQ ID NO: 526090 - DNA, 25 bp, Rattus norvegicus
acaccatcacgcagcagaccgtttg

SEQ ID NO: 526091 - DNA, 25 bp, Rattus norvegicus
cgtttgcacaccatcacgcagcaga

SEQ ID NO: 526092 - DNA, 25 bp, Rattus norvegicus
gagacaacgtttgcacaccatcacg

SEQ ID NO: 526093 - DNA, 25 bp, Rattus norvegicus
tacgcgggagacaacgtttgcacac

SEQ ID NO: 526094 - DNA, 25 bp, Rattus norvegicus
ccatgatggtgcactcgcgttacgc

SEQ ID NO: 526095 - DNA, 25 bp, Rattus norvegicus
atcccatgatggtgcactcgcgtta

SEQ ID NO: 526096 - DNA, 25 bp, Rattus norvegicus
tgcagcgatcccatgatggtgcact

SEQ ID NO: 526097 - DNA, 25 bp, Rattus norvegicus
ttctgcagcgatcccatgatggtgc

SEQ ID NO: 526098 - DNA, 25 bp, Rattus norvegicus
gggttctgcagcgatcccatgatgg

SEQ ID NO: 526099 - DNA, 25 bp, Rattus norvegicus
tgcactcgcgttacgcgggagacaa

SEQ ID NO: 526100 - DNA, 25 bp, Rattus norvegicus
cgggagacaacgtttgcacaccatc

SEQ ID NO: 526101 - DNA, 25 bp, Rattus norvegicus
cgtggaccaggttcagatgtgagta

SEQ ID NO: 526102 - DNA, 25 bp, Rattus norvegicus
gccggagctctacggcccagttttg

SEQ ID NO: 526103 - DNA, 25 bp, Rattus norvegicus
tgcagttattccctcaggccgttgg

SEQ ID NO: 526104 - DNA, 25 bp, Rattus norvegicus
ggtgcagttattccctcaggccgtt

SEQ ID NO: 526105 - DNA, 25 bp, Rattus norvegicus
ctcctgcaggccgtggaccaggttc

SEQ ID NO: 526106 - DNA, 25 bp, Rattus norvegicus
gctctacggcccagttttgagcgcc

SEQ ID NO: 526107 - DNA, 25 bp, Rattus norvegicus
gagccggagctctacggcccagttt

SEQ ID NO: 526108 - DNA, 25 bp, Rattus norvegicus
tcctggttgttgtgggagccggagc

SEQ ID NO: 526109 - DNA, 25 bp, Rattus norvegicus
gtgagtagcctgctgctggcgaccc

SEQ ID NO: 526110 - DNA, 25 bp, Rattus norvegicus
cagatgtgagtagcctgctgctggc

SEQ ID NO: 526111 - DNA, 25 bp, Rattus norvegicus
ttcagatgtgagtagcctgctgctg

SEQ ID NO: 526112 - DNA, 25 bp, Rattus norvegicus
gaccaggttcagatgtgagtagcct

SEQ ID NO: 526113 - DNA, 25 bp, Rattus norvegicus
caggccgtggaccaggttcagatgt

SEQ ID NO: 526114 - DNA, 25 bp, Rattus norvegicus
gttattccctcaggccgttggcttg

SEQ ID NO: 526115 - DNA, 25 bp, Rattus norvegicus
cctcgatgtaaaagcaatgctcttc

SEQ ID NO: 526116 - DNA, 25 bp, Rattus norvegicus
attcagcatcctagtggcctcggca

SEQ ID NO: 526117 - DNA, 25 bp, Rattus norvegicus
ttcttttgaccgtcgcagcagcttg

SEQ ID NO: 526118 - DNA, 25 bp, Rattus norvegicus
ctgtgggccaaaatcgccgttcttt

SEQ ID NO: 526119 - DNA, 25 bp, Rattus norvegicus
atctagtgtcttgatctgtgggcca

SEQ ID NO: 526120 - DNA, 25 bp, Rattus norvegicus
ggcctcggcaactctctcaattttc

SEQ ID NO: 526121 - DNA, 25 bp, Rattus norvegicus
gaggtccgcgatgtcctttttcagg

SEQ ID NO: 526122 - DNA, 25 bp, Rattus norvegicus
attgtccagccgtccattcagcatc

SEQ ID NO: 526123 - DNA, 25 bp, Rattus norvegicus
gagaggcggtcgaattcattgtcca

SEQ ID NO: 526124 - DNA, 25 bp, Rattus norvegicus
caaagtctgcgtctggctctggaaa

SEQ ID NO: 526125 - DNA, 25 bp, Rattus norvegicus
gctcgttccatctcgcatcaaagtc

SEQ ID NO: 526126 - DNA, 25 bp, Rattus norvegicus
gttgatccttgcgtccagctcgttc

SEQ ID NO: 526127 - DNA, 25 bp, Rattus norvegicus
tctgcgttcttctccgtcacgttga

SEQ ID NO: 526128 - DNA, 25 bp, Rattus norvegicus
cccgcagagtctcctcgatgtaaaa

SEQ ID NO: 526129 - DNA, 25 bp, Rattus norvegicus
gaaaagagaagacctcgcggctctc

SEQ ID NO: 526130 - DNA, 25 bp, Rattus norvegicus
cccagggtctatgctggctccggct

SEQ ID NO: 526131 - DNA, 25 bp, Rattus norvegicus
ctagttccctgacctgagagctggc

SEQ ID NO: 526132 - DNA, 25 bp, Rattus norvegicus
ggggtgcctcacgtcacttccgcga

SEQ ID NO: 526133 - DNA, 25 bp, Rattus norvegicus
ttcaaacgctcttctgccggggtgc

SEQ ID NO: 526134 - DNA, 25 bp, Rattus norvegicus
gagacgcagactccgcgcgtgtcct

SEQ ID NO: 526135 - DNA, 25 bp, Rattus norvegicus
gtacaccgtcctacagccgtcgatg

SEQ ID NO: 526136 - DNA, 25 bp, Rattus norvegicus
ttcccgcgccggtcaaacaagtaca

SEQ ID NO: 526137 - DNA, 25 bp, Rattus norvegicus
gctccgggacctgcagtgctctatc

SEQ ID NO: 526138 - DNA, 25 bp, Rattus norvegicus
acctgacacacagacgcgcggaact

SEQ ID NO: 526139 - DNA, 25 bp, Rattus norvegicus
tctgacaagtttatggcggtgaccc

SEQ ID NO: 526140 - DNA, 25 bp, Rattus norvegicus
gaatcccggccatctgacaagttta

SEQ ID NO: 526141 - DNA, 25 bp, Rattus norvegicus
gatcaaccgcaacgtgggcacccga

SEQ ID NO: 526142 - DNA, 25 bp, Rattus norvegicus
gggaaccgattcaaacgctcttctg

SEQ ID NO: 526143 - DNA, 25 bp, Rattus norvegicus
gccgccaaaacaagagctttagtct

SEQ ID NO: 526144 - DNA, 25 bp, Rattus norvegicus
gacccagcgcccagctttcagtaaa

SEQ ID NO: 526145 - DNA, 25 bp, Rattus norvegicus
ctgcacgcgaaaacagccgccaaaa

SEQ ID NO: 526146 - DNA, 25 bp, Rattus norvegicus
agctttagtctaggccaaccttggg

SEQ ID NO: 526147 - DNA, 25 bp, Rattus norvegicus
cggcgctgacatcaggactcctgcg

SEQ ID NO: 526148 - DNA, 25 bp, Rattus norvegicus
ctcttcgccggaagtgtgcacgtcc

SEQ ID NO: 526149 - DNA, 25 bp, Rattus norvegicus
atcttgccctttttggggagctggc

SEQ ID NO: 526150 - DNA, 25 bp, Rattus norvegicus
gtctaggacgagtagcgagcgccac

SEQ ID NO: 526151 - DNA, 25 bp, Rattus norvegicus
tggagtcgggttccgtacagcaata

SEQ ID NO: 526152 - DNA, 25 bp, Rattus norvegicus
gctgcgccctggaactagggaagca

SEQ ID NO: 526153 - DNA, 25 bp, Rattus norvegicus
tttgcttccgaaaagatggcggcca

SEQ ID NO: 526154 - DNA, 25 bp, Rattus norvegicus
ggcggccaggaccagttttatatga

SEQ ID NO: 526155 - DNA, 25 bp, Rattus norvegicus
tatatgagtgctgtttccacggggc

SEQ ID NO: 526156 - DNA, 25 bp, Rattus norvegicus
gtaaactccacgactgcacgcgaaa

SEQ ID NO: 526157 - DNA, 25 bp, Rattus norvegicus
ggatctgcgggctctcggtccataa

SEQ ID NO: 526158 - DNA, 25 bp, Rattus norvegicus
agagaaccgaccaatcatcaccaga

SEQ ID NO: 526159 - DNA, 25 bp, Rattus norvegicus
ctactccggcctcccacagagcggc

SEQ ID NO: 526160 - DNA, 25 bp, Rattus norvegicus
acagagcggctgaagacaccgggcc

SEQ ID NO: 526161 - DNA, 25 bp, Rattus norvegicus
cggctgaagacaccgggccaggtcc

SEQ ID NO: 526162 - DNA, 25 bp, Rattus norvegicus
gctcgcgaggccacccacggctcca

SEQ ID NO: 526163 - DNA, 25 bp, Rattus norvegicus
cccagtgcgttcgaaaaggagcgcg

SEQ ID NO: 526164 - DNA, 25 bp, Rattus norvegicus
gctctcggtccataacctgcgcttt

SEQ ID NO: 526165 - DNA, 25 bp, Rattus norvegicus
ggtccataacctgcgcttttctaca

SEQ ID NO: 526166 - DNA, 25 bp, Rattus norvegicus
tacatcgctaggtggtcacggctcc

SEQ ID NO: 526167 - DNA, 25 bp, Rattus norvegicus
gtcacggctccggcgccacggtaag

SEQ ID NO: 526168 - DNA, 25 bp, Rattus norvegicus
gccacagggttcacaggagcgaggc

SEQ ID NO: 526169 - DNA, 25 bp, Rattus norvegicus
cgcttttctacatcgctaggtggtc

SEQ ID NO: 526170 - DNA, 25 bp, Rattus norvegicus
cccacggctccagccgcaggctccc

SEQ ID NO: 526171 - DNA, 25 bp, Rattus norvegicus
gcctcttcctgctgggaagcttctg

SEQ ID NO: 526172 - DNA, 25 bp, Rattus norvegicus
gcttccgtgcgtggctgttgagcac

SEQ ID NO: 526173 - DNA, 25 bp, Rattus norvegicus
gagttctccatgctgcggggcttcc

SEQ ID NO: 526174 - DNA, 25 bp, Rattus norvegicus
cctgcctcaggtactggagttctcc

SEQ ID NO: 526175 - DNA, 25 bp, Rattus norvegicus
cgcagcgcataatgtgctccacctg

SEQ ID NO: 526176 - DNA, 25 bp, Rattus norvegicus
ctccttcttgaagccgcagcgcata

SEQ ID NO: 526177 - DNA, 25 bp, Rattus norvegicus
tgcccgtgcggtcctccttcttgaa

SEQ ID NO: 526178 - DNA, 25 bp, Rattus norvegicus
ctgcatgccgaacaccgacagggtg

SEQ ID NO: 526179 - DNA, 25 bp, Rattus norvegicus
aggctgtaccgtgcctgcatgccga

SEQ ID NO: 526180 - DNA, 25 bp, Rattus norvegicus
agcctccgttacctctcaggctgta

SEQ ID NO: 526181 - DNA, 25 bp, Rattus norvegicus
cggttgctcttttcctcctactcga

SEQ ID NO: 526182 - DNA, 25 bp, Rattus norvegicus
cttcaaccagcatcgcggagcagtc

SEQ ID NO: 526183 - DNA, 25 bp, Rattus norvegicus
tgagcaccggactgcagctcagagc

SEQ ID NO: 526184 - DNA, 25 bp, Rattus norvegicus
tggcagtgtagtcggcgccaaaacc

SEQ ID NO: 526185 - DNA, 25 bp, Rattus norvegicus
aaggggaccttttgctagctcgctc

SEQ ID NO: 526186 - DNA, 25 bp, Rattus norvegicus
accaagcggctccaactcagcatca

SEQ ID NO: 526187 - DNA, 25 bp, Rattus norvegicus
cgtgatctggaaagcgactcccgcg

SEQ ID NO: 526188 - DNA, 25 bp, Rattus norvegicus
taccacgtgatctggaaagcgactc

SEQ ID NO: 526189 - DNA, 25 bp, Rattus norvegicus
gagcgctgccgctaccacgtgatct

SEQ ID NO: 526190 - DNA, 25 bp, Rattus norvegicus
agtacacggagcatggagcctgctc

SEQ ID NO: 526191 - DNA, 25 bp, Rattus norvegicus
ggatgctcccgcagaagtacacgga

SEQ ID NO: 526192 - DNA, 25 bp, Rattus norvegicus
gccgcggatgctcccgcagaagtac

SEQ ID NO: 526193 - DNA, 25 bp, Rattus norvegicus
atacagtgcttggtcctcgcgcccg

SEQ ID NO: 526194 - DNA, 25 bp, Rattus norvegicus
acacgatccgcgcatacagtgcttg

SEQ ID NO: 526195 - DNA, 25 bp, Rattus norvegicus
catagcgtcgcagccgcgacacgat

SEQ ID NO: 526196 - DNA, 25 bp, Rattus norvegicus
tgagcaccttcccatagcgtcgcag

SEQ ID NO: 526197 - DNA, 25 bp, Rattus norvegicus
gcatcagccacgtgctcagtgagca

SEQ ID NO: 526198 - DNA, 25 bp, Rattus norvegicus
gggaccttttgctagctcgctcttc

SEQ ID NO: 526199 - DNA, 25 bp, Rattus norvegicus
tcggctcgtgggacgtctcccagag

SEQ ID NO: 526200 - DNA, 25 bp, Rattus norvegicus
gtcggctcgtgggacgtctcccaga

SEQ ID NO: 526201 - DNA, 25 bp, Rattus norvegicus
ctctttgactgtcacctgccgggtc

SEQ ID NO: 526202 - DNA, 25 bp, Rattus norvegicus
tggtgaagaaaaaaaggactagaca

SEQ ID NO: 526203 - DNA, 25 bp, Rattus norvegicus
ccatggtgaagaaaaaaaggactag

SEQ ID NO: 526204 - DNA, 25 bp, Rattus norvegicus
ggtggacacagactgtcccatggtg

SEQ ID NO: 526205 - DNA, 25 bp, Rattus norvegicus
cggggtggacacagactgtcccatg

SEQ ID NO: 526206 - DNA, 25 bp, Rattus norvegicus
aacggggtggacacagactgtccca

SEQ ID NO: 526207 - DNA, 25 bp, Rattus norvegicus
caacggggtggacacagactgtccc

SEQ ID NO: 526208 - DNA, 25 bp, Rattus norvegicus
tcaacggggtggacacagactgtcc

SEQ ID NO: 526209 - DNA, 25 bp, Rattus norvegicus
actcaacggggtggacacagactgt

SEQ ID NO: 526210 - DNA, 25 bp, Rattus norvegicus
gactcaacggggtggacacagactg

SEQ ID NO: 526211 - DNA, 25 bp, Rattus norvegicus
agtttgactcaacggggtggacaca

SEQ ID NO: 526212 - DNA, 25 bp, Rattus norvegicus
tgactcaacggggtggacacagact

SEQ ID NO: 526213 - DNA, 25 bp, Rattus norvegicus
tggcgtcctccgtattctcctcctc

SEQ ID NO: 526214 - DNA, 25 bp, Rattus norvegicus
tgccctcggtgctccgcatctcgcg

SEQ ID NO: 526215 - DNA, 25 bp, Rattus norvegicus
aaccacagactcgtgccctcggtgc

SEQ ID NO: 526216 - DNA, 25 bp, Rattus norvegicus
cctggccgccggcaaccacagactc

SEQ ID NO: 526217 - DNA, 25 bp, Rattus norvegicus
ctcggctgagagcagccccgttcgt

SEQ ID NO: 526218 - DNA, 25 bp, Rattus norvegicus
gcagccgctcggctgagagcagccc

SEQ ID NO: 526219 - DNA, 25 bp, Rattus norvegicus
gttccctcattcagcgcagccgctc

SEQ ID NO: 526220 - DNA, 25 bp, Rattus norvegicus
aggctcctccggttccctcattcag

SEQ ID NO: 526221 - DNA, 25 bp, Rattus norvegicus
gctggagacggagcactaccctcac

SEQ ID NO: 526222 - DNA, 25 bp, Rattus norvegicus
cctccacgctggagacggagcacta

SEQ ID NO: 526223 - DNA, 25 bp, Rattus norvegicus
gacgactggcgtcctccgtattctc

SEQ ID NO: 526224 - DNA, 25 bp, Rattus norvegicus
gcgacgactggcgtcctccgtattc

SEQ ID NO: 526225 - DNA, 25 bp, Rattus norvegicus
ggggcactccctcccgcggtacagc

SEQ ID NO: 526226 - DNA, 25 bp, Rattus norvegicus
acgctggagacggagcactaccctc

SEQ ID NO: 526227 - DNA, 25 bp, Rattus norvegicus
gctgccgcagaggaacgcttcgaat

SEQ ID NO: 526228 - DNA, 25 bp, Rattus norvegicus
tggccctgcatcagccggctgtgct

SEQ ID NO: 526229 - DNA, 25 bp, Rattus norvegicus
gaaccagctggaccgctcggacgta

SEQ ID NO: 526230 - DNA, 25 bp, Rattus norvegicus
cggacgtagcggtgccgctgactct

SEQ ID NO: 526231 - DNA, 25 bp, Rattus norvegicus
gctgactctgcacggttacccggac

SEQ ID NO: 526232 - DNA, 25 bp, Rattus norvegicus
agccaggcgcggactgcagcgtctc

SEQ ID NO: 526233 - DNA, 25 bp, Rattus norvegicus
tcacccagtaccagcgcgatttcgg

SEQ ID NO: 526234 - DNA, 25 bp, Rattus norvegicus
cgcgatttcggtgtgcgaactgctc

SEQ ID NO: 526235 - DNA, 25 bp, Rattus norvegicus
atgctgctcaagagcgcgcaccggg

SEQ ID NO: 526236 - DNA, 25 bp, Rattus norvegicus
aacccggacggtctacgtgctgccg

SEQ ID NO: 526237 - DNA, 25 bp, Rattus norvegicus
gacgcggacgcaactgtagtagcga

SEQ ID NO: 526238 - DNA, 25 bp, Rattus norvegicus
cacgtcttataggtgggtagctggc

SEQ ID NO: 526239 - DNA, 25 bp, Rattus norvegicus
cgcttcgaatgtcgacctgcggtgg

SEQ ID NO: 526240 - DNA, 25 bp, Rattus norvegicus
actgtagtagcgaccacgtcttata

SEQ ID NO: 526241 - DNA, 25 bp, Rattus norvegicus
ccgaacccgggtagaaaagcatgca

SEQ ID NO: 526242 - DNA, 25 bp, Rattus norvegicus
ggtgggacacggacacgcacccacg

SEQ ID NO: 526243 - DNA, 25 bp, Rattus norvegicus
cacgcgcacacgaccgtgcactggc

SEQ ID NO: 526244 - DNA, 25 bp, Rattus norvegicus
cttagtgtatatagcggcgtcaggg

SEQ ID NO: 526245 - DNA, 25 bp, Rattus norvegicus
ggctgcgtcctccttagtgtatata

SEQ ID NO: 526246 - DNA, 25 bp, Rattus norvegicus
tgcgtcctccttagtgtatatagcg

SEQ ID NO: 526247 - DNA, 25 bp, Rattus norvegicus
cggcgccgccacaggggtgggacac

SEQ ID NO: 526248 - DNA, 25 bp, Rattus norvegicus
ctccttagtgtatatagcggcgtca

SEQ ID NO: 526249 - DNA, 25 bp, Rattus norvegicus
cacttgaaaccgacacgcacacgcg

SEQ ID NO: 526250 - DNA, 25 bp, Rattus norvegicus
atccaacacttgaaaccgacacgca

SEQ ID NO: 526251 - DNA, 25 bp, Rattus norvegicus
gagtactgtacaaatccaacacttg

SEQ ID NO: 526252 - DNA, 25 bp, Rattus norvegicus
cccagactgcgagtactgtacaaat

SEQ ID NO: 526253 - DNA, 25 bp, Rattus norvegicus
ccgggtagaaaagcatgcactgagc

SEQ ID NO: 526254 - DNA, 25 bp, Rattus norvegicus
acccgggtagaaaagcatgcactga

SEQ ID NO: 526255 - DNA, 25 bp, Rattus norvegicus
ttccagcacagccttacgcgcccgc

SEQ ID NO: 526256 - DNA, 25 bp, Rattus norvegicus
gcagccggccacactggagcagctt

SEQ ID NO: 526257 - DNA, 25 bp, Rattus norvegicus
aacagataatgacacccgcccgcgg

SEQ ID NO: 526258 - DNA, 25 bp, Rattus norvegicus
tctgcgcgcagcaaccaaaggccgg

SEQ ID NO: 526259 - DNA, 25 bp, Rattus norvegicus
agactctgcgcgcagcaaccaaagg

SEQ ID NO: 526260 - DNA, 25 bp, Rattus norvegicus
ggaaacaactgcagactctgcgcgc

SEQ ID NO: 526261 - DNA, 25 bp, Rattus norvegicus
aagtcagatctcagtcggaggcctc

SEQ ID NO: 526262 - DNA, 25 bp, Rattus norvegicus
ccggcctggtttccctccatctcgg

SEQ ID NO: 526263 - DNA, 25 bp, Rattus norvegicus
ccctcgcatcaagcccggcctggtt

SEQ ID NO: 526264 - DNA, 25 bp, Rattus norvegicus
ccctgtcccgcaaagagagctcctc

SEQ ID NO: 526265 - DNA, 25 bp, Rattus norvegicus
tccaccgcgcgccactccagcgggt

SEQ ID NO: 526266 - DNA, 25 bp, Rattus norvegicus
ccaggtcgcgcccaagtctccaagc

SEQ ID NO: 526267 - DNA, 25 bp, Rattus norvegicus
ttcccgcctgcacccaccaggacgc

SEQ ID NO: 526268 - DNA, 25 bp, Rattus norvegicus
ggtcctccaagtcagatctcagtcg

SEQ ID NO: 526269 - DNA, 25 bp, Rattus norvegicus
aaggagctctcagcagagaccggga

SEQ ID NO: 526270 - DNA, 25 bp, Rattus norvegicus
ggctcccatcctggcgggctgcaga

SEQ ID NO: 526271 - DNA, 25 bp, Rattus norvegicus
tcgggccggcataggtaacaaagct

SEQ ID NO: 526272 - DNA, 25 bp, Rattus norvegicus
aggtaacaaagctccgcgccaggcg

SEQ ID NO: 526273 - DNA, 25 bp, Rattus norvegicus
cccatgtcagttcggtcgggatcgg

SEQ ID NO: 526274 - DNA, 25 bp, Rattus norvegicus
ggcgctgctcctccaaaaaggagct

SEQ ID NO: 526275 - DNA, 25 bp, Rattus norvegicus
acgagcggcgaagtacaaggcagtc

SEQ ID NO: 526276 - DNA, 25 bp, Rattus norvegicus
tccgggcaacgctcgagcaaactct

SEQ ID NO: 526277 - DNA, 25 bp, Rattus norvegicus
gggagaactcggagcaaacgcatcc

SEQ ID NO: 526278 - DNA, 25 bp, Rattus norvegicus
caaggcccttccagtccttgggtct

SEQ ID NO: 526279 - DNA, 25 bp, Rattus norvegicus
cgcgcttctcaaagcccgggtcgga

SEQ ID NO: 526280 - DNA, 25 bp, Rattus norvegicus
ggactcaccggccagcaacggcaga

SEQ ID NO: 526281 - DNA, 25 bp, Rattus norvegicus
caacggcagaagcagggctctgagc

SEQ ID NO: 526282 - DNA, 25 bp, Rattus norvegicus
gtccgcaccctctcacgggatggga

SEQ ID NO: 526283 - DNA, 25 bp, Rattus norvegicus
gcgctggctagtgctctgcgctcct

SEQ ID NO: 526284 - DNA, 25 bp, Rattus norvegicus
gtgcccgcctctcttacgtcattga

SEQ ID NO: 526285 - DNA, 25 bp, Rattus norvegicus
gcctctcttacgtcattgaaaagcg

SEQ ID NO: 526286 - DNA, 25 bp, Rattus norvegicus
tacgtcattgaaaagcgacggtacc

SEQ ID NO: 526287 - DNA, 25 bp, Rattus norvegicus
cccgaatgaaacgtcatttaagagc

SEQ ID NO: 526288 - DNA, 25 bp, Rattus norvegicus
cgtcatttaagagcaccaggctctg

SEQ ID NO: 526289 - DNA, 25 bp, Rattus norvegicus
gcaccaggctctgggtaaaggtaaa

SEQ ID NO: 526290 - DNA, 25 bp, Rattus norvegicus
caggctctgggtaaaggtaaaagcg

SEQ ID NO: 526291 - DNA, 25 bp, Rattus norvegicus
aaagcgagttctgtacggaggaatc

SEQ ID NO: 526292 - DNA, 25 bp, Rattus norvegicus
tctgtacggaggaatctgaccattc

SEQ ID NO: 526293 - DNA, 25 bp, Rattus norvegicus
tccatggccctgtgcgcgctggcta

SEQ ID NO: 526294 - DNA, 25 bp, Rattus norvegicus
tgctctgcgctccttgagcctggca

SEQ ID NO: 526295 - DNA, 25 bp, Rattus norvegicus
ttgagcctggcatccccggccatta

SEQ ID NO: 526296 - DNA, 25 bp, Rattus norvegicus
tctgaccattccatggccctgtgcg

SEQ ID NO: 526297 - DNA, 25 bp, Rattus norvegicus
caggtcttgattcccatccaccaag

SEQ ID NO: 526298 - DNA, 25 bp, Rattus norvegicus
cgtcgtccaggtggcactcgctact

SEQ ID NO: 526299 - DNA, 25 bp, Rattus norvegicus
gcccgaagccctagccaggactagg

SEQ ID NO: 526300 - DNA, 25 bp, Rattus norvegicus
aggactaggctccaccctgcagcag

SEQ ID NO: 526301 - DNA, 25 bp, Rattus norvegicus
gcgccgtgaaatctcctgctggcca

SEQ ID NO: 526302 - DNA, 25 bp, Rattus norvegicus
ggggcccaaacactcgtcagcgcag

SEQ ID NO: 526303 - DNA, 25 bp, Rattus norvegicus
agcagccgccatcgtgtgcagcgcg

SEQ ID NO: 526304 - DNA, 25 bp, Rattus norvegicus
agcgcgtccctatctctgcaaagga

SEQ ID NO: 526305 - DNA, 25 bp, Rattus norvegicus
tctgcaaaggacaggcctcgcgcca

SEQ ID NO: 526306 - DNA, 25 bp, Rattus norvegicus
caggatcccggtggacttctgaggt

SEQ ID NO: 526307 - DNA, 25 bp, Rattus norvegicus
ttttctgggcttccgatcgcccgcg

SEQ ID NO: 526308 - DNA, 25 bp, Rattus norvegicus
ttgggactctcctttatcgggccta

SEQ ID NO: 526309 - DNA, 25 bp, Rattus norvegicus
cgttcccgaccttctcaggtcttga

SEQ ID NO: 526310 - DNA, 25 bp, Rattus norvegicus
ctaaatctggcggaaacgagcggtg

SEQ ID NO: 526311 - DNA, 25 bp, Rattus norvegicus
gattctggggtgataagggactcta

SEQ ID NO: 526312 - DNA, 25 bp, Rattus norvegicus
gccgaggattccctttgtgttcaga

SEQ ID NO: 526313 - DNA, 25 bp, Rattus norvegicus
ttcctgctgccgaggattccctttg

SEQ ID NO: 526314 - DNA, 25 bp, Rattus norvegicus
gtgatgcacttcctgctgccgagga

SEQ ID NO: 526315 - DNA, 25 bp, Rattus norvegicus
tggaaagagaatggaggcggctcct

SEQ ID NO: 526316 - DNA, 25 bp, Rattus norvegicus
ggaggctctttgctcgaatccctgg

SEQ ID NO: 526317 - DNA, 25 bp, Rattus norvegicus
cccgaagcatctggcggaggctctt

SEQ ID NO: 526318 - DNA, 25 bp, Rattus norvegicus
cgcaggtgcaaacggccccgaagca

SEQ ID NO: 526319 - DNA, 25 bp, Rattus norvegicus
ccgcctcaaggattcgggcgcggcc

SEQ ID NO: 526320 - DNA, 25 bp, Rattus norvegicus
tgtctgaggtgctgcagcgaccgct

SEQ ID NO: 526321 - DNA, 25 bp, Rattus norvegicus
tgtgttcagattccagatccgccca

SEQ ID NO: 526322 - DNA, 25 bp, Rattus norvegicus
ccctttgtgttcagattccagatcc

SEQ ID NO: 526323 - DNA, 25 bp, Rattus norvegicus
cagatccgcccacacacgctggagc

SEQ ID NO: 526324 - DNA, 25 bp, Rattus norvegicus
ccctttatcggtgatgcacttcctg

SEQ ID NO: 526325 - DNA, 25 bp, Rattus norvegicus
acagagcaacgacggcatgcctccg

SEQ ID NO: 526326 - DNA, 25 bp, Rattus norvegicus
tttcaggaggtcaaggcggtttcgc

SEQ ID NO: 526327 - DNA, 25 bp, Rattus norvegicus
ggtcaaggcggtttcgcccgcgcac

SEQ ID NO: 526328 - DNA, 25 bp, Rattus norvegicus
gcccgcgcaccgcatttgcgagtgt

SEQ ID NO: 526329 - DNA, 25 bp, Rattus norvegicus
ccgcatttgcgagtgtcaacaccta

SEQ ID NO: 526330 - DNA, 25 bp, Rattus norvegicus
cgagtgtcaacacctatgccttgta

SEQ ID NO: 526331 - DNA, 25 bp, Rattus norvegicus
acctatgccttgtatgtgcgggata

SEQ ID NO: 526332 - DNA, 25 bp, Rattus norvegicus
tgccttgtatgtgcgggatacgcta

SEQ ID NO: 526333 - DNA, 25 bp, Rattus norvegicus
tatgtgcgggatacgctacggcccg

SEQ ID NO: 526334 - DNA, 25 bp, Rattus norvegicus
atgctggaggatttcgaggagatca

SEQ ID NO: 526335 - DNA, 25 bp, Rattus norvegicus
gacgaaggccagttccgacagagca

SEQ ID NO: 526336 - DNA, 25 bp, Rattus norvegicus
ttccgacagagcaacgacggcatgc

SEQ ID NO: 526337 - DNA, 25 bp, Rattus norvegicus
gtgcccagcgtttcaggaggtcaag

SEQ ID NO: 526338 - DNA, 25 bp, Rattus norvegicus
aaggccagttccgacagagcaacga

SEQ ID NO: 526339 - DNA, 25 bp, Rattus norvegicus
ataaacgcgcaacttccgctcactg

SEQ ID NO: 526340 - DNA, 25 bp, Rattus norvegicus
acaaccttcttttcgcatgttttgc

SEQ ID NO: 526341 - DNA, 25 bp, Rattus norvegicus
ctcagggcggctttccgttcccgca

SEQ ID NO: 526342 - DNA, 25 bp, Rattus norvegicus
cgtagtccggttgataaacgcgcaa

SEQ ID NO: 526343 - DNA, 25 bp, Rattus norvegicus
tccggttgataaacgcgcaacttcc

SEQ ID NO: 526344 - DNA, 25 bp, Rattus norvegicus
cgcatgttttgcgtagtccggttga

SEQ ID NO: 526345 - DNA, 25 bp, Rattus norvegicus
agcattacaaccttcttttcgcatg

SEQ ID NO: 526346 - DNA, 25 bp, Rattus norvegicus
gagccttagcattacaaccttcttt

SEQ ID NO: 526347 - DNA, 25 bp, Rattus norvegicus
gcccgagccttagcattacaacctt

SEQ ID NO: 526348 - DNA, 25 bp, Rattus norvegicus
tcggcccgagccttagcattacaac

SEQ ID NO: 526349 - DNA, 25 bp, Rattus norvegicus
gaccgtcggcccgagccttagcatt

SEQ ID NO: 526350 - DNA, 25 bp, Rattus norvegicus
acccttcggccggtcgccaatcgca

SEQ ID NO: 526351 - DNA, 25 bp, Rattus norvegicus
ctcaaccctagaccctcacccttcg

SEQ ID NO: 526352 - DNA, 25 bp, Rattus norvegicus
catgttttgcgtagtccggttgata

SEQ ID NO: 526353 - DNA, 25 bp, Rattus norvegicus
tgcgcatgcgcataagaccagaaca

SEQ ID NO: 526354 - DNA, 25 bp, Rattus norvegicus
ttgtagtccagaaattacctcaggc

SEQ ID NO: 526355 - DNA, 25 bp, Rattus norvegicus
gctgccagcagcctagaacccgttg

SEQ ID NO: 526356 - DNA, 25 bp, Rattus norvegicus
aacgagataaacactgccagacttc

SEQ ID NO: 526357 - DNA, 25 bp, Rattus norvegicus
tgccagacttcgtccttccggcgag

SEQ ID NO: 526358 - DNA, 25 bp, Rattus norvegicus
acgcgcacgtgcagtgagaactctg

SEQ ID NO: 526359 - DNA, 25 bp, Rattus norvegicus
ccagaacatgccgtgcgcctaaggg

SEQ ID NO: 526360 - DNA, 25 bp, Rattus norvegicus
cgcctaagggtcactgggtaatgta

SEQ ID NO: 526361 - DNA, 25 bp, Rattus norvegicus
aatgtagttctttgtggtccgggca

SEQ ID NO: 526362 - DNA, 25 bp, Rattus norvegicus
cggggcaatcgtcctcgcttgcgtc

SEQ ID NO: 526363 - DNA, 25 bp, Rattus norvegicus
gcgaggaaaaccaacgccgagaatc

SEQ ID NO: 526364 - DNA, 25 bp, Rattus norvegicus
ttttgtcaggcggtactgcactccc

SEQ ID NO: 526365 - DNA, 25 bp, Rattus norvegicus
ctatcgcgggtagtctagggaccta

SEQ ID NO: 526366 - DNA, 25 bp, Rattus norvegicus
ggcccgacagctttagggatttgta

SEQ ID NO: 526367 - DNA, 25 bp, Rattus norvegicus
gctcaccttatccttcttcagttta

SEQ ID NO: 526368 - DNA, 25 bp, Rattus norvegicus
tggagtggaaggtcccgccctagaa

SEQ ID NO: 526369 - DNA, 25 bp, Rattus norvegicus
accgccagggttcggctcctagaat

SEQ ID NO: 526370 - DNA, 25 bp, Rattus norvegicus
tcattggaaagaacgagtacaaacc

SEQ ID NO: 526371 - DNA, 25 bp, Rattus norvegicus
ttggtcattggagccaagcagcttc

SEQ ID NO: 526372 - DNA, 25 bp, Rattus norvegicus
ccgcctcctcggattggtcattgga

SEQ ID NO: 526373 - DNA, 25 bp, Rattus norvegicus
ttggcccgaactcttacaaacctgc

SEQ ID NO: 526374 - DNA, 25 bp, Rattus norvegicus
tggctgcgcttccaattggcccgaa

SEQ ID NO: 526375 - DNA, 25 bp, Rattus norvegicus
cttcttcagtttatagggcatctcg

SEQ ID NO: 526376 - DNA, 25 bp, Rattus norvegicus
tgcactccggcgtcgccttatgcgt

SEQ ID NO: 526377 - DNA, 25 bp, Rattus norvegicus
taggggaaaggccacgctcacctta

SEQ ID NO: 526378 - DNA, 25 bp, Rattus norvegicus
cagagggtcagtctgaggctgtccc

SEQ ID NO: 526379 - DNA, 25 bp, Rattus norvegicus
tttatagggcatctcggccggtcca

SEQ ID NO: 526380 - DNA, 25 bp, Rattus norvegicus
gctcctagaattggctggagtggaa

SEQ ID NO: 526381 - DNA, 25 bp, Rattus norvegicus
cacttggacacgttgccgactacta

SEQ ID NO: 526382 - DNA, 25 bp, Rattus norvegicus
gccgtcacagacagggtccagggca

SEQ ID NO: 526383 - DNA, 25 bp, Rattus norvegicus
gtccagggcagcgtatcagtgaatc

SEQ ID NO: 526384 - DNA, 25 bp, Rattus norvegicus
atcggggagaccagatgagatcgtc

SEQ ID NO: 526385 - DNA, 25 bp, Rattus norvegicus
tctactaaggcgcaaggttactctg

SEQ ID NO: 526386 - DNA, 25 bp, Rattus norvegicus
ctgcgaatacttctagaccatcgtc

SEQ ID NO: 526387 - DNA, 25 bp, Rattus norvegicus
tttacagacgagcaagggagacaga

SEQ ID NO: 526388 - DNA, 25 bp, Rattus norvegicus
gggagacagaactccagagcctttc

SEQ ID NO: 526389 - DNA, 25 bp, Rattus norvegicus
agagcctttctcctacagcatgacc

SEQ ID NO: 526390 - DNA, 25 bp, Rattus norvegicus
agcatctctcgggtactcacttgga

SEQ ID NO: 526391 - DNA, 25 bp, Rattus norvegicus
gccgactactattgtcttctttacg

SEQ ID NO: 526392 - DNA, 25 bp, Rattus norvegicus
tctttacgaacagtcgggaagtctc

SEQ ID NO: 526393 - DNA, 25 bp, Rattus norvegicus
gggaagtctcatctcctgcgaggtc

SEQ ID NO: 526394 - DNA, 25 bp, Rattus norvegicus
gcatgaccacggtaaagcagcagtg

SEQ ID NO: 526395 - DNA, 25 bp, Rattus norvegicus
ccggggactttctctgctccttatt

SEQ ID NO: 526396 - DNA, 25 bp, Rattus norvegicus
gacaacggaggtggccatcgaacca

SEQ ID NO: 526397 - DNA, 25 bp, Rattus norvegicus
tacgtcttcttagcgacccgactcg

SEQ ID NO: 526398 - DNA, 25 bp, Rattus norvegicus
ggcgcttgctgtattgcatgtccta

SEQ ID NO: 526399 - DNA, 25 bp, Rattus norvegicus
ttgcatgtcctagaacccttcccga

SEQ ID NO: 526400 - DNA, 25 bp, Rattus norvegicus
tgcccggttctcgagtgttggagac

SEQ ID NO: 526401 - DNA, 25 bp, Rattus norvegicus
ccggagagtagggaccacaaccatc

SEQ ID NO: 526402 - DNA, 25 bp, Rattus norvegicus
tcaatccggcagctccgaggagttc

SEQ ID NO: 526403 - DNA, 25 bp, Rattus norvegicus
gcccgagtcggagagttaccaaaca

SEQ ID NO: 526404 - DNA, 25 bp, Rattus norvegicus
gcacttggctcaagtacaggttcta

SEQ ID NO: 526405 - DNA, 25 bp, Rattus norvegicus
tgtccgcgagactgggacccaactc

SEQ ID NO: 526406 - DNA, 25 bp, Rattus norvegicus
ttcccgactgagacaccaccgttgg

SEQ ID NO: 526407 - DNA, 25 bp, Rattus norvegicus
acaggttctagagcctcgctgggac

SEQ ID NO: 526408 - DNA, 25 bp, Rattus norvegicus
cacggctagctgtaactgagctcca

SEQ ID NO: 526409 - DNA, 25 bp, Rattus norvegicus
tccgactgggccatggagtccatgt

SEQ ID NO: 526410 - DNA, 25 bp, Rattus norvegicus
gttagatggccgtgagatcgctata

SEQ ID NO: 526411 - DNA, 25 bp, Rattus norvegicus
tgagatcgctatagggcgccaaatc

SEQ ID NO: 526412 - DNA, 25 bp, Rattus norvegicus
tatagggcgccaaatccaccatccg

SEQ ID NO: 526413 - DNA, 25 bp, Rattus norvegicus
ctctgattggccgagatggaaaaaa

SEQ ID NO: 526414 - DNA, 25 bp, Rattus norvegicus
ttcccattggctagaaagcagacgc

SEQ ID NO: 526415 - DNA, 25 bp, Rattus norvegicus
agcagacgccgagcgaacccattgg

SEQ ID NO: 526416 - DNA, 25 bp, Rattus norvegicus
gaacccattggatgcgtcgcctgcg

SEQ ID NO: 526417 - DNA, 25 bp, Rattus norvegicus
ttggtccgtttcgaaagccgctaga

SEQ ID NO: 526418 - DNA, 25 bp, Rattus norvegicus
tacaccgaggcacgtgtgcagaccc

SEQ ID NO: 526419 - DNA, 25 bp, Rattus norvegicus
atggagtccatgtctgagctcgcgc

SEQ ID NO: 526420 - DNA, 25 bp, Rattus norvegicus
gagaccgactgggtgcgattgccca

SEQ ID NO: 526421 - DNA, 25 bp, Rattus norvegicus
gattgcccagcaaatgcgaaggtga

SEQ ID NO: 526422 - DNA, 25 bp, Rattus norvegicus
ccgttgccgtggttacaccgaggca

SEQ ID NO: 526423 - DNA, 25 bp, Rattus norvegicus
tggacagcgtgtaccgtacccgctc

SEQ ID NO: 526424 - DNA, 25 bp, Rattus norvegicus
ccgcagccgtactgcagagtacaag

SEQ ID NO: 526425 - DNA, 25 bp, Rattus norvegicus
ccaagcgccgtcaggatggtggaca

SEQ ID NO: 526426 - DNA, 25 bp, Rattus norvegicus
ctgctgcgccagcacgggtgccacc

SEQ ID NO: 526427 - DNA, 25 bp, Rattus norvegicus
tgcggagctagtggcctgagagcca

SEQ ID NO: 526428 - DNA, 25 bp, Rattus norvegicus
tactgcagagtacaaggcgtggttg

SEQ ID NO: 526429 - DNA, 25 bp, Rattus norvegicus
acacccgcagccgtactgcagagta

SEQ ID NO: 526430 - DNA, 25 bp, Rattus norvegicus
tgtacatcggggacacccgcagccg

SEQ ID NO: 526431 - DNA, 25 bp, Rattus norvegicus
tgtggcagctgtacatcggggacac

SEQ ID NO: 526432 - DNA, 25 bp, Rattus norvegicus
ccgcacgtgtgtggcagctgtacat

SEQ ID NO: 526433 - DNA, 25 bp, Rattus norvegicus
cagtatgcggatggggaggccgcac

SEQ ID NO: 526434 - DNA, 25 bp, Rattus norvegicus
aagggatccccgaccagtatgcgga

SEQ ID NO: 526435 - DNA, 25 bp, Rattus norvegicus
atggtggacagcgtgtaccgtaccc

SEQ ID NO: 526436 - DNA, 25 bp, Rattus norvegicus
tgcagagtacaaggcgtggttgctt

SEQ ID NO: 526437 - DNA, 25 bp, Rattus norvegicus
gtgatgcatagaggaccgcctccca

SEQ ID NO: 526438 - DNA, 25 bp, Rattus norvegicus
ggaagcagggtagactcggacattc

SEQ ID NO: 526439 - DNA, 25 bp, Rattus norvegicus
ttgtgcaaacaaggcgcccagggct

SEQ ID NO: 526440 - DNA, 25 bp, Rattus norvegicus
ggtcccgaatccgttattgtgcaaa

SEQ ID NO: 526441 - DNA, 25 bp, Rattus norvegicus
tgggattacccgactgccgctgtcg

SEQ ID NO: 526442 - DNA, 25 bp, Rattus norvegicus
ctgtcgcctggatggtctccgcggc

SEQ ID NO: 526443 - DNA, 25 bp, Rattus norvegicus
gactcgcctcgaatgctgcctcgga

SEQ ID NO: 526444 - DNA, 25 bp, Rattus norvegicus
aatgctgcctcggaagccacccagg

SEQ ID NO: 526445 - DNA, 25 bp, Rattus norvegicus
ccacccaggccaggtgggtagtgtc

SEQ ID NO: 526446 - DNA, 25 bp, Rattus norvegicus
gaatccgcgcgagcaccagggacgc

SEQ ID NO: 526447 - DNA, 25 bp, Rattus norvegicus
cctctcggccggcaagatggcgact

SEQ ID NO: 526448 - DNA, 25 bp, Rattus norvegicus
gactcggacattcggactctggcgt

SEQ ID NO: 526449 - DNA, 25 bp, Rattus norvegicus
cccggcgaccacgtgatgcatagag

SEQ ID NO: 526450 - DNA, 25 bp, Rattus norvegicus
ttgaatgggacaagccaggtgtgtc

SEQ ID NO: 526451 - DNA, 25 bp, Rattus norvegicus
gcgggctctaactcaaggcggaagc

SEQ ID NO: 526452 - DNA, 25 bp, Rattus norvegicus
tccgcctaggtgagctgtctatgga

SEQ ID NO: 526453 - DNA, 25 bp, Rattus norvegicus
acacgctctcctcgccgtcctcagc

SEQ ID NO: 526454 - DNA, 25 bp, Rattus norvegicus
agctggtgctcagcgtccttccaca

SEQ ID NO: 526455 - DNA, 25 bp, Rattus norvegicus
actgcttcacccagctggtgctcag

SEQ ID NO: 526456 - DNA, 25 bp, Rattus norvegicus
aaggggacaccacgggccactgctt

SEQ ID NO: 526457 - DNA, 25 bp, Rattus norvegicus
ctcccgctctgggaaggggacacca

SEQ ID NO: 526458 - DNA, 25 bp, Rattus norvegicus
tctatggaggggctcctggcccagc

SEQ ID NO: 526459 - DNA, 25 bp, Rattus norvegicus
tgtcactctcggcttccgcctaggt

SEQ ID NO: 526460 - DNA, 25 bp, Rattus norvegicus
tggggactctgtcccgagccctgtc

SEQ ID NO: 526461 - DNA, 25 bp, Rattus norvegicus
taactcaaggcggaagccagaggcg

SEQ ID NO: 526462 - DNA, 25 bp, Rattus norvegicus
gtaccgcaagaatgggcgggctcta

SEQ ID NO: 526463 - DNA, 25 bp, Rattus norvegicus
gcgggctttaactggggactctgtc

SEQ ID NO: 526464 - DNA, 25 bp, Rattus norvegicus
cctggcccagctttgtggcacggat

SEQ ID NO: 526465 - DNA, 25 bp, Rattus norvegicus
gaacggccagacgtgtagacacctg

SEQ ID NO: 526466 - DNA, 25 bp, Rattus norvegicus
ggagcacgctcacctctggcaggct

SEQ ID NO: 526467 - DNA, 25 bp, Rattus norvegicus
aacagccagggctgcgatcgcgatc

SEQ ID NO: 526468 - DNA, 25 bp, Rattus norvegicus
gcagaggtcaacgtgccagcgaaga

SEQ ID NO: 526469 - DNA, 25 bp, Rattus norvegicus
tagatttcaccagcccgatggaatg

SEQ ID NO: 526470 - DNA, 25 bp, Rattus norvegicus
ttccaacgagagcacctagatttca

SEQ ID NO: 526471 - DNA, 25 bp, Rattus norvegicus
ggatgagcgtcccattccaacgaga

SEQ ID NO: 526472 - DNA, 25 bp, Rattus norvegicus
agacacctgtgggatggcattagct

SEQ ID NO: 526473 - DNA, 25 bp, Rattus norvegicus
agcggcactgataccggttccaagt

SEQ ID NO: 526474 - DNA, 25 bp, Rattus norvegicus
gaacccactagccaggtctgcagga

SEQ ID NO: 526475 - DNA, 25 bp, Rattus norvegicus
gggaccgcgtcttcctagcttctca

SEQ ID NO: 526476 - DNA, 25 bp, Rattus norvegicus
ctggctgcaagagatctctcgggtc

SEQ ID NO: 526477 - DNA, 25 bp, Rattus norvegicus
aacggctcccagttcctggctgcaa

SEQ ID NO: 526478 - DNA, 25 bp, Rattus norvegicus
gcacagcaggcacacgagatttagg

SEQ ID NO: 526479 - DNA, 25 bp, Rattus norvegicus
agtctgtgtccaccccgttgagtca

SEQ ID NO: 526480 - DNA, 25 bp, Rattus norvegicus
ctctgggagacgtcccacgagccga

SEQ ID NO: 526481 - DNA, 25 bp, Rattus norvegicus
tctgggagacgtcccacgagccgac

SEQ ID NO: 526482 - DNA, 25 bp, Rattus norvegicus
ctgggagacgtcccacgagccgact

SEQ ID NO: 526483 - DNA, 25 bp, Rattus norvegicus
gacccggcaggtgacagtcaaagag

SEQ ID NO: 526484 - DNA, 25 bp, Rattus norvegicus
caccatgggacagtctgtgtccacc

SEQ ID NO: 526485 - DNA, 25 bp, Rattus norvegicus
catgggacagtctgtgtccaccccg

SEQ ID NO: 526486 - DNA, 25 bp, Rattus norvegicus
tgggacagtctgtgtccaccccgtt

SEQ ID NO: 526487 - DNA, 25 bp, Rattus norvegicus
ggacagtctgtgtccaccccgttga

SEQ ID NO: 526488 - DNA, 25 bp, Rattus norvegicus
cagtctgtgtccaccccgttgagtc

SEQ ID NO: 526489 - DNA, 25 bp, Rattus norvegicus
tgtgtccaccccgttgagtcaaact

SEQ ID NO: 526490 - DNA, 25 bp, Rattus norvegicus
ctagtcctttttttcttcaccatgg

SEQ ID NO: 526491 - DNA, 25 bp, Rattus norvegicus
gacagtctgtgtccaccccgttgag

SEQ ID NO: 526492 - DNA, 25 bp, Rattus norvegicus
accatgggacagtctgtgtccaccc

SEQ ID NO: 526493 - DNA, 25 bp, Rattus norvegicus
agcaggcggcgagttcctatggcaa

SEQ ID NO: 526494 - DNA, 25 bp, Rattus norvegicus
atggcaacggttgcgtcactggccc

SEQ ID NO: 526495 - DNA, 25 bp, Rattus norvegicus
tgcgccagggacgtggctccagcta

SEQ ID NO: 526496 - DNA, 25 bp, Rattus norvegicus
tggctccagctagggcccggcagat

SEQ ID NO: 526497 - DNA, 25 bp, Rattus norvegicus
cgaagtcgcggtcgcacaggcgaca

SEQ ID NO: 526498 - DNA, 25 bp, Rattus norvegicus
atgtcccgcacctcggcgcctgaca

SEQ ID NO: 526499 - DNA, 25 bp, Rattus norvegicus
gcgggatgcagctcagcttcagctg

SEQ ID NO: 526500 - DNA, 25 bp, Rattus norvegicus
cccaggttaaggttgagctgcgcca

SEQ ID NO: 526501 - DNA, 25 bp, Rattus norvegicus
gcagctcagcttcagctgctgagct

SEQ ID NO: 526502 - DNA, 25 bp, Rattus norvegicus
ggcgagttcctatggcaacggttgc

SEQ ID NO: 526503 - DNA, 25 bp, Rattus norvegicus
tagcgcttctgccagctgcttgatg

SEQ ID NO: 526504 - DNA, 25 bp, Rattus norvegicus
ttctgccagctgcttgatgcggctg

SEQ ID NO: 526505 - DNA, 25 bp, Rattus norvegicus
ggggctagacacgacgcccaggtta

SEQ ID NO: 526506 - DNA, 25 bp, Rattus norvegicus
cacgacgcccaggttaaggttgagc

SEQ ID NO: 526507 - DNA, 25 bp, Rattus norvegicus
cccaattgacgtccggaagtgaagg

SEQ ID NO: 526508 - DNA, 25 bp, Rattus norvegicus
ttccgggccagcaccatttcggacg

SEQ ID NO: 526509 - DNA, 25 bp, Rattus norvegicus
cctggatgttttcttcgaagcctcc

SEQ ID NO: 526510 - DNA, 25 bp, Rattus norvegicus
ttgctggcagcaagagctctcaata

SEQ ID NO: 526511 - DNA, 25 bp, Rattus norvegicus
ttccacgccgcgagaaaaaatagca

SEQ ID NO: 526512 - DNA, 25 bp, Rattus norvegicus
ttcccgtcgctgaagctagcgctcg

SEQ ID NO: 526513 - DNA, 25 bp, Rattus norvegicus
cgcaaaagtgagaaacccggatgtt

SEQ ID NO: 526514 - DNA, 25 bp, Rattus norvegicus
cgggacaagatatcgcgacagtgaa

SEQ ID NO: 526515 - DNA, 25 bp, Rattus norvegicus
agattgccggagacggaacgttgcc

SEQ ID NO: 526516 - DNA, 25 bp, Rattus norvegicus
gcacgcacgcgctaacttggagcct

SEQ ID NO: 526517 - DNA, 25 bp, Rattus norvegicus
ttggagcctcctctcacggctgatg

SEQ ID NO: 526518 - DNA, 25 bp, Rattus norvegicus
ttcgcaatgtaagagatcggaccgc

SEQ ID NO: 526519 - DNA, 25 bp, Rattus norvegicus
tgagtcgccatgtccctcgaggctt

SEQ ID NO: 526520 - DNA, 25 bp, Rattus norvegicus
cgctcgtgggaatagtgtgagacct

SEQ ID NO: 526521 - DNA, 25 bp, Rattus norvegicus
cgacctcgtctagacgctgtcattt

SEQ ID NO: 526522 - DNA, 25 bp, Rattus norvegicus
gagcatcgctcttggcagtttgaca

SEQ ID NO: 526523 - DNA, 25 bp, Rattus norvegicus
gtctgtcgccttggtaagaacatta

SEQ ID NO: 526524 - DNA, 25 bp, Rattus norvegicus
ctggcgggaccacacgttgataccg

SEQ ID NO: 526525 - DNA, 25 bp, Rattus norvegicus
ggtccatcatgaccgtcaccgcttt

SEQ ID NO: 526526 - DNA, 25 bp, Rattus norvegicus
ttccttccagtggactcagcccgga

SEQ ID NO: 526527 - DNA, 25 bp, Rattus norvegicus
ctccatggctagtgccgggaaaacc

SEQ ID NO: 526528 - DNA, 25 bp, Rattus norvegicus
ggaacctactgacctgatcctggga

SEQ ID NO: 526529 - DNA, 25 bp, Rattus norvegicus
ggcagtaagtctctctcggaaccta

SEQ ID NO: 526530 - DNA, 25 bp, Rattus norvegicus
tgtgtcaccacaggcagtaagtctc

SEQ ID NO: 526531 - DNA, 25 bp, Rattus norvegicus
agggataactactcggttctgtgtc

SEQ ID NO: 526532 - DNA, 25 bp, Rattus norvegicus
aggctctgaaggctgtttgctcgga

SEQ ID NO: 526533 - DNA, 25 bp, Rattus norvegicus
ggggcgcaaaccttcaggctctgaa

SEQ ID NO: 526534 - DNA, 25 bp, Rattus norvegicus
gcgcggtgctgaactcctaatttcc

SEQ ID NO: 526535 - DNA, 25 bp, Rattus norvegicus
tgcttcgtcctggtgtccaaaggcc

SEQ ID NO: 526536 - DNA, 25 bp, Rattus norvegicus
cggcctgcctggcttctgcgaggtc

SEQ ID NO: 526537 - DNA, 25 bp, Rattus norvegicus
atagtccccgaagaggtgcgcctgc

SEQ ID NO: 526538 - DNA, 25 bp, Rattus norvegicus
cagggagagcgcttggccaaacctc

SEQ ID NO: 526539 - DNA, 25 bp, Rattus norvegicus
acctcggtgcgcacgcaggacgcga

SEQ ID NO: 526540 - DNA, 25 bp, Rattus norvegicus
tttggaatttttggcgcgagctggc

SEQ ID NO: 526541 - DNA, 25 bp, Rattus norvegicus
aatttttggcgcgagctggctccgc

SEQ ID NO: 526542 - DNA, 25 bp, Rattus norvegicus
cccaggtgagcccatacccgagtga

SEQ ID NO: 526543 - DNA, 25 bp, Rattus norvegicus
ccttcttggagggtgcttcgtcctg

SEQ ID NO: 526544 - DNA, 25 bp, Rattus norvegicus
atacccgagtgagatctcccggccg

SEQ ID NO: 526545 - DNA, 25 bp, Rattus norvegicus
ctccctgtttgtcacgggctcggct

SEQ ID NO: 526546 - DNA, 25 bp, Rattus norvegicus
acgggctcggctagccctcagatga

SEQ ID NO: 526547 - DNA, 25 bp, Rattus norvegicus
ctagccctcagatgacgccaggtca

SEQ ID NO: 526548 - DNA, 25 bp, Rattus norvegicus
cagatgacgccaggtcagcgctgtc

SEQ ID NO: 526549 - DNA, 25 bp, Rattus norvegicus
gaactggtcccgcatcccaatgaga

SEQ ID NO: 526550 - DNA, 25 bp, Rattus norvegicus
cccaccatgtcggaagaactggtcc

SEQ ID NO: 526551 - DNA, 25 bp, Rattus norvegicus
ggacctcgcagtgatcccttcaacc

SEQ ID NO: 526552 - DNA, 25 bp, Rattus norvegicus
gtatgacaccgacgtgttcgcgctg

SEQ ID NO: 526553 - DNA, 25 bp, Rattus norvegicus
tgttcgcgctgctcaccaccatgat

SEQ ID NO: 526554 - DNA, 25 bp, Rattus norvegicus
gctgtggataatcttctacctcctc

SEQ ID NO: 526555 - DNA, 25 bp, Rattus norvegicus
gctcaccaccatgatgctgctggca

SEQ ID NO: 526556 - DNA, 25 bp, Rattus norvegicus
gcgctctccagacgcggtgccttac

SEQ ID NO: 526557 - DNA, 25 bp, Rattus norvegicus
caacaaggtggctgtgtatgacacc

SEQ ID NO: 526558 - DNA, 25 bp, Rattus norvegicus
tcatcagcggcggggccttcaacaa

SEQ ID NO: 526559 - DNA, 25 bp, Rattus norvegicus
gcggtcaacgtgctgctgctcgcct

SEQ ID NO: 526560 - DNA, 25 bp, Rattus norvegicus
tgctgttggcggtcaacgtgctgct

SEQ ID NO: 526561 - DNA, 25 bp, Rattus norvegicus
atcccaatgagagcctgccggggcc

SEQ ID NO: 526562 - DNA, 25 bp, Rattus norvegicus
ggtcccgcatcccaatgagagcctg

SEQ ID NO: 526563 - DNA, 25 bp, Rattus norvegicus
aagcttccatacgacgcagcaccgt

SEQ ID NO: 526564 - DNA, 25 bp, Rattus norvegicus
acccgcaggtcaccgcgcaagctca

SEQ ID NO: 526565 - DNA, 25 bp, Rattus norvegicus
tgccgaggcgacctcttctcgggac

SEQ ID NO: 526566 - DNA, 25 bp, Rattus norvegicus
tccaaacttgccgaggcgacctctt

SEQ ID NO: 526567 - DNA, 25 bp, Rattus norvegicus
tttctttgggcaaatccaaacttgc

SEQ ID NO: 526568 - DNA, 25 bp, Rattus norvegicus
tcctaagccgcctcaggtttctttg

SEQ ID NO: 526569 - DNA, 25 bp, Rattus norvegicus
caaagagcccggtctgaggctgcgc

SEQ ID NO: 526570 - DNA, 25 bp, Rattus norvegicus
ccgtcctacgccctcgtgcagactc

SEQ ID NO: 526571 - DNA, 25 bp, Rattus norvegicus
tctccgaagcttccatacgacgcag

SEQ ID NO: 526572 - DNA, 25 bp, Rattus norvegicus
ggccaagttctcactctccgaagct

SEQ ID NO: 526573 - DNA, 25 bp, Rattus norvegicus
agctcaccgtctttccggccaagtt

SEQ ID NO: 526574 - DNA, 25 bp, Rattus norvegicus
gcgcggaagctcacgacacagcagc

SEQ ID NO: 526575 - DNA, 25 bp, Rattus norvegicus
ggctaaagctcaccgtctttccggc

SEQ ID NO: 526576 - DNA, 25 bp, Rattus norvegicus
gtgcagactcctcgcaaccttccta

SEQ ID NO: 526577 - DNA, 25 bp, Rattus norvegicus
cagttccgatactcgcgagtccatc

SEQ ID NO: 526578 - DNA, 25 bp, Rattus norvegicus
cagcagccgccgaacagttccgata

SEQ ID NO: 526579 - DNA, 25 bp, Rattus norvegicus
ctatgcgagagcaacaggtggcttc

SEQ ID NO: 526580 - DNA, 25 bp, Rattus norvegicus
ggccctcctagtcgcgtcagaacaa

SEQ ID NO: 526581 - DNA, 25 bp, Rattus norvegicus
gcgtcagaacaagccgcagggcatc

SEQ ID NO: 526582 - DNA, 25 bp, Rattus norvegicus
aagccgcagggcatcaagggatacc

SEQ ID NO: 526583 - DNA, 25 bp, Rattus norvegicus
tcaagggataccgagtccgcggcta

SEQ ID NO: 526584 - DNA, 25 bp, Rattus norvegicus
ccgagtccgcggctatgatatttaa

SEQ ID NO: 526585 - DNA, 25 bp, Rattus norvegicus
cccgagctttgaggtttccgcccat

SEQ ID NO: 526586 - DNA, 25 bp, Rattus norvegicus
ccgcggctatgatatttaatgctaa

SEQ ID NO: 526587 - DNA, 25 bp, Rattus norvegicus
tgctaaagaatgcaagtttgaacta

SEQ ID NO: 526588 - DNA, 25 bp, Rattus norvegicus
gaatgcaagtttgaactacaattcc

SEQ ID NO: 526589 - DNA, 25 bp, Rattus norvegicus
ctacaattcccaagagtcatcgcta

SEQ ID NO: 526590 - DNA, 25 bp, Rattus norvegicus
tcccaagagtcatcgctatgcgaga

SEQ ID NO: 526591 - DNA, 25 bp, Rattus norvegicus
tcgcacagggcctgagtgaggacca

SEQ ID NO: 526592 - DNA, 25 bp, Rattus norvegicus
gctctacaggtgaggcgactctgta

SEQ ID NO: 526593 - DNA, 25 bp, Rattus norvegicus
ccgccagaccagcttggaggggaac

SEQ ID NO: 526594 - DNA, 25 bp, Rattus norvegicus
gtgaggaccagctcgcaccacgcaa

SEQ ID NO: 526595 - DNA, 25 bp, Rattus norvegicus
tcgcagattactacatcgcacaggg

SEQ ID NO: 526596 - DNA, 25 bp, Rattus norvegicus
gcatcctcggccttgtcgcagatta

SEQ ID NO: 526597 - DNA, 25 bp, Rattus norvegicus
gggtcctcttctggggccgcatcct

SEQ ID NO: 526598 - DNA, 25 bp, Rattus norvegicus
ggattaccgcttcgcgcgggtcctc

SEQ ID NO: 526599 - DNA, 25 bp, Rattus norvegicus
tatgctggttaaacgggattaccgc

SEQ ID NO: 526600 - DNA, 25 bp, Rattus norvegicus
tcgctgctcacgtcccttatgctgg

SEQ ID NO: 526601 - DNA, 25 bp, Rattus norvegicus
cggacagcctcttgttgtcgctgga

SEQ ID NO: 526602 - DNA, 25 bp, Rattus norvegicus
ctggactgatggacgcggacagcct

SEQ ID NO: 526603 - DNA, 25 bp, Rattus norvegicus
atggagacggcttctacccgccaga

SEQ ID NO: 526604 - DNA, 25 bp, Rattus norvegicus
gcaccacgcaagacgctctacaggt

SEQ ID NO: 526605 - DNA, 25 bp, Rattus norvegicus
atgaactttctgctctcttgggtgc

SEQ ID NO: 526606 - DNA, 25 bp, Rattus norvegicus
ttgggatctttcatcggaccagtcg

SEQ ID NO: 526607 - DNA, 25 bp, Rattus norvegicus
cagtcgcgctgacggacagacagac

SEQ ID NO: 526608 - DNA, 25 bp, Rattus norvegicus
ctcgcgggattgcacggaaactttt

SEQ ID NO: 526609 - DNA, 25 bp, Rattus norvegicus
aacttctgggctcttctctctccgg

SEQ ID NO: 526610 - DNA, 25 bp, Rattus norvegicus
caaaccgatcggagctgggagaagt

SEQ ID NO: 526611 - DNA, 25 bp, Rattus norvegicus
actggaccctggctttactgctgta

SEQ ID NO: 526612 - DNA, 25 bp, Rattus norvegicus
tgctgtacctccaccatgccaaggt

SEQ ID NO: 526613 - DNA, 25 bp, Rattus norvegicus
ccaaggtaagcggtcgtgcccgcct

SEQ ID NO: 526614 - DNA, 25 bp, Rattus norvegicus
agggcgccaggatagtctcgccgcc

SEQ ID NO: 526615 - DNA, 25 bp, Rattus norvegicus
cgagctggcggcagaagtttgctct

SEQ ID NO: 526616 - DNA, 25 bp, Rattus norvegicus
acgggcctctgaaaccatgaacttt

SEQ ID NO: 526617 - DNA, 25 bp, Rattus norvegicus
agtcaccgcacgtacgatctgggcc

SEQ ID NO: 526618 - DNA, 25 bp, Rattus norvegicus
ctctctccggagtagccgtggtctg

SEQ ID NO: 526619 - DNA, 25 bp, Rattus norvegicus
ctgccgcgggagtcccttctctgtg

SEQ ID NO: 526620 - DNA, 25 bp, Rattus norvegicus
aggcattgcctcacctcgtacatca

SEQ ID NO: 526621 - DNA, 25 bp, Rattus norvegicus
tgactcacagcggagcaggcattgc

SEQ ID NO: 526622 - DNA, 25 bp, Rattus norvegicus
cctcgattccgagggtgactcacag

SEQ ID NO: 526623 - DNA, 25 bp, Rattus norvegicus
gggagtcccttctctgtggcctctg

SEQ ID NO: 526624 - DNA, 25 bp, Rattus norvegicus
tcaggccgggactcttggcctcctg

SEQ ID NO: 526625 - DNA, 25 bp, Rattus norvegicus
gagagatactcgtctcggagcgccc

SEQ ID NO: 526626 - DNA, 25 bp, Rattus norvegicus
tagggagagatactcgtctcggagc

SEQ ID NO: 526627 - DNA, 25 bp, Rattus norvegicus
ctgccttcgggtagcaggacgccct

SEQ ID NO: 526628 - DNA, 25 bp, Rattus norvegicus
atcagtgcacctgccttcgggtagc

SEQ ID NO: 526629 - DNA, 25 bp, Rattus norvegicus
gcatcatcagtgcacctgccttcgg

SEQ ID NO: 526630 - DNA, 25 bp, Rattus norvegicus
gcgaggaactgcgatgcacttgccc

SEQ ID NO: 526631 - DNA, 25 bp, Rattus norvegicus
cgtccagcctgcgaggaactgcgat

SEQ ID NO: 526632 - DNA, 25 bp, Rattus norvegicus
tgcgtccctgcctcgattccgaggg

SEQ ID NO: 526633 - DNA, 25 bp, Rattus norvegicus
atttcggcagcgagaagccattgcc

SEQ ID NO: 526634 - DNA, 25 bp, Rattus norvegicus
cgccggaggacagagccctaaccgg

SEQ ID NO: 526635 - DNA, 25 bp, Rattus norvegicus
acgcgacgccggcaggcagcgtggc

SEQ ID NO: 526636 - DNA, 25 bp, Rattus norvegicus
gactctggccgacagcctcccgcgc

SEQ ID NO: 526637 - DNA, 25 bp, Rattus norvegicus
cgcggtccggagcagctgaccggct

SEQ ID NO: 526638 - DNA, 25 bp, Rattus norvegicus
ggccgccaagttgcggcgggccgag

SEQ ID NO: 526639 - DNA, 25 bp, Rattus norvegicus
agccattgccataacggggaaaggg

SEQ ID NO: 526640 - DNA, 25 bp, Rattus norvegicus
gctatttcggcagcgagaagccatt

SEQ ID NO: 526641 - DNA, 25 bp, Rattus norvegicus
tcggcagcgagaagccattgccata

SEQ ID NO: 526642 - DNA, 25 bp, Rattus norvegicus
agaagccattgccataacggggaaa

SEQ ID NO: 526643 - DNA, 25 bp, Rattus norvegicus
gcagcgagaagccattgccataacg

SEQ ID NO: 526644 - DNA, 25 bp, Rattus norvegicus
cgagaagccattgccataacgggga

SEQ ID NO: 526645 - DNA, 25 bp, Rattus norvegicus
gccgagaggcagcaacgtgcggcgc

SEQ ID NO: 526646 - DNA, 25 bp, Rattus norvegicus
ggcgccggaggacagagccctaacc

SEQ ID NO: 526647 - DNA, 25 bp, Rattus norvegicus
cccgagttttgcattctagggtcgc

SEQ ID NO: 526648 - DNA, 25 bp, Rattus norvegicus
agggtctagatctgaggcctcgcga

SEQ ID NO: 526649 - DNA, 25 bp, Rattus norvegicus
gcctcgcgaagggtgagaacccttc

SEQ ID NO: 526650 - DNA, 25 bp, Rattus norvegicus
caaggggcccagtatggcttgtctc

SEQ ID NO: 526651 - DNA, 25 bp, Rattus norvegicus
ccactgcagagaagaaaccggaaga

SEQ ID NO: 526652 - DNA, 25 bp, Rattus norvegicus
ccatcgtaccgcgttgacagcctgg

SEQ ID NO: 526653 - DNA, 25 bp, Rattus norvegicus
agtgcgcgcgcactttctacgtgta

SEQ ID NO: 526654 - DNA, 25 bp, Rattus norvegicus
cccttacttggctcataggatctca

SEQ ID NO: 526655 - DNA, 25 bp, Rattus norvegicus
aaaagcacccggactcagctgcgcg

SEQ ID NO: 526656 - DNA, 25 bp, Rattus norvegicus
aggacccaacggaggcacgctttgt

SEQ ID NO: 526657 - DNA, 25 bp, Rattus norvegicus
ccgtccctggccagatgtgagtcct

SEQ ID NO: 526658 - DNA, 25 bp, Rattus norvegicus
tcgagtgccactctagttccacctg

SEQ ID NO: 526659 - DNA, 25 bp, Rattus norvegicus
ttgcattctagggtcgccaagtccg

SEQ ID NO: 526660 - DNA, 25 bp, Rattus norvegicus
gggctccagatgtgcgctttcctct

SEQ ID NO: 526661 - DNA, 25 bp, Rattus norvegicus
agagggataacggaacacctgaggt

SEQ ID NO: 526662 - DNA, 25 bp, Rattus norvegicus
cctgtctgtggaagagtcctgccgt

SEQ ID NO: 526663 - DNA, 25 bp, Rattus norvegicus
cggaaattagaggtacccagtgtgg

SEQ ID NO: 526664 - DNA, 25 bp, Rattus norvegicus
cttcggtgtcctcccaggcgacggt

SEQ ID NO: 526665 - DNA, 25 bp, Rattus norvegicus
cagcaggtgctcctatgacccgggt

SEQ ID NO: 526666 - DNA, 25 bp, Rattus norvegicus
ggtgtccttctccagcaggtgctcc

SEQ ID NO: 526667 - DNA, 25 bp, Rattus norvegicus
atttcgtcgccggaggtgtccttct

SEQ ID NO: 526668 - DNA, 25 bp, Rattus norvegicus
aaccgctggcggagcgagcagattt

SEQ ID NO: 526669 - DNA, 25 bp, Rattus norvegicus
atgcttgccatcgaagccagcagcc

SEQ ID NO: 526670 - DNA, 25 bp, Rattus norvegicus
caaagacatgcttgccatcgaagcc

SEQ ID NO: 526671 - DNA, 25 bp, Rattus norvegicus
tgggaaggatccaaagacatgcttg

SEQ ID NO: 526672 - DNA, 25 bp, Rattus norvegicus
taacggaacacctgaggtggagcgt

SEQ ID NO: 526673 - DNA, 25 bp, Rattus norvegicus
ctgtggaagagtcctgccgtggaac

SEQ ID NO: 526674 - DNA, 25 bp, Rattus norvegicus
gacggttgggaaggatccaaagaca

SEQ ID NO: 526675 - DNA, 25 bp, Rattus norvegicus
cgggatgcggacttacttggtgtcc

SEQ ID NO: 526676 - DNA, 25 bp, Rattus norvegicus
ttttctgcggatgcggaaccgatcc

SEQ ID NO: 526677 - DNA, 25 bp, Rattus norvegicus
ggcttgcctccgttttctgcggatg

SEQ ID NO: 526678 - DNA, 25 bp, Rattus norvegicus
gatgcggaaccgatccaaacttctc

SEQ ID NO: 526679 - DNA, 25 bp, Rattus norvegicus
gtgccgcggtcttgctagcccttct

SEQ ID NO: 526680 - DNA, 25 bp, Rattus norvegicus
taaacgcccacttcggatggggaga

SEQ ID NO: 526681 - DNA, 25 bp, Rattus norvegicus
cccgcagtccctggttagacacttt

SEQ ID NO: 526682 - DNA, 25 bp, Rattus norvegicus
gacactttcgtccaggtcgtgggca

SEQ ID NO: 526683 - DNA, 25 bp, Rattus norvegicus
gggtctctttctcggcttgcctccg

SEQ ID NO: 526684 - DNA, 25 bp, Rattus norvegicus
tgctgctcttgctctgggtctcttt

SEQ ID NO: 526685 - DNA, 25 bp, Rattus norvegicus
ttccacgcctgagtgagtcccgctt

SEQ ID NO: 526686 - DNA, 25 bp, Rattus norvegicus
ttgccattaacttccgcggcggccg

SEQ ID NO: 526687 - DNA, 25 bp, Rattus norvegicus
gagaggagacaacttgaagtcaagt

SEQ ID NO: 526688 - DNA, 25 bp, Rattus norvegicus
caaacttctcagtggctccagctgg

SEQ ID NO: 526689 - DNA, 25 bp, Rattus norvegicus
gggagcgcctacatcgaattttctg

SEQ ID NO: 526690 - DNA, 25 bp, Rattus norvegicus
cctagaatgtctccagtggctcatg

SEQ ID NO: 526691 - DNA, 25 bp, Rattus norvegicus
ctcgatgtgcgatttgtagggaaca

SEQ ID NO: 526692 - DNA, 25 bp, Rattus norvegicus
tcccttgaggactggactcttgagg

SEQ ID NO: 526693 - DNA, 25 bp, Rattus norvegicus
aggccgccaaagagtccctgctagc

SEQ ID NO: 526694 - DNA, 25 bp, Rattus norvegicus
tgcatgctccctggccatcttgagg

SEQ ID NO: 526695 - DNA, 25 bp, Rattus norvegicus
gggctacatgtcctactcatgcaga

SEQ ID NO: 526696 - DNA, 25 bp, Rattus norvegicus
tattgaattggccttgactcgcagc

SEQ ID NO: 526697 - DNA, 25 bp, Rattus norvegicus
ctagggctgtgcttcgccttatata

SEQ ID NO: 526698 - DNA, 25 bp, Rattus norvegicus
ctcggctttctcgtcaaggtaaggc

SEQ ID NO: 526699 - DNA, 25 bp, Rattus norvegicus
gggtctccgccaacatctcatctga

SEQ ID NO: 526700 - DNA, 25 bp, Rattus norvegicus
tctcatctgaactaaaggctccttg

SEQ ID NO: 526701 - DNA, 25 bp, Rattus norvegicus
ctgcggggataatgtgcctagaatg

SEQ ID NO: 526702 - DNA, 25 bp, Rattus norvegicus
tggcagccgaattggtcacctccgt

SEQ ID NO: 526703 - DNA, 25 bp, Rattus norvegicus
agctccgtgaggagcgtaggccaca

SEQ ID NO: 526704 - DNA, 25 bp, Rattus norvegicus
tgtccagccacataggtcgcctctg

SEQ ID NO: 526705 - DNA, 25 bp, Rattus norvegicus
ttcccgctccgaagcgccacagttc

SEQ ID NO: 526706 - DNA, 25 bp, Rattus norvegicus
gccacagttccgcatcccatccgag

SEQ ID NO: 526707 - DNA, 25 bp, Rattus norvegicus
gcgacaatcccgaagctccgtgagg

SEQ ID NO: 526708 - DNA, 25 bp, Rattus norvegicus
gtaggccacatgctgcgtgcccatc

SEQ ID NO: 526709 - DNA, 25 bp, Rattus norvegicus
gctgcgtgcccatccactctgggat

SEQ ID NO: 526710 - DNA, 25 bp, Rattus norvegicus
atccactctgggatcccgacagtgc

SEQ ID NO: 526711 - DNA, 25 bp, Rattus norvegicus
agcggaagtgctgcgctcttcccgc

SEQ ID NO: 526712 - DNA, 25 bp, Rattus norvegicus
tgccgcttgctctagcagccagcca

SEQ ID NO: 526713 - DNA, 25 bp, Rattus norvegicus
ccgggatctcggtcacgtggaccat

SEQ ID NO: 526714 - DNA, 25 bp, Rattus norvegicus
cgcaggccaggcagaacctcctccc

SEQ ID NO: 526715 - DNA, 25 bp, Rattus norvegicus
cacgtggaccatggctgcctgagcc

SEQ ID NO: 526716 - DNA, 25 bp, Rattus norvegicus
ccgacagtgccacgcggatctgcgg

SEQ ID NO: 526717 - DNA, 25 bp, Rattus norvegicus
gctcgaatgatcttggcctccggtt

SEQ ID NO: 526718 - DNA, 25 bp, Rattus norvegicus
cttggcctccggttttcaggatttg

SEQ ID NO: 526719 - DNA, 25 bp, Rattus norvegicus
cgtgctcccggtaaacaaaggctca

SEQ ID NO: 526720 - DNA, 25 bp, Rattus norvegicus
taagcaaaggcccacggagaaggaa

SEQ ID NO: 526721 - DNA, 25 bp, Rattus norvegicus
aatcccggccgctcgaatgatcttg

SEQ ID NO: 526722 - DNA, 25 bp, Rattus norvegicus
gatccttatccgtgctccgcgacag

SEQ ID NO: 526723 - DNA, 25 bp, Rattus norvegicus
cacggacacccaacggaaacgtcag

SEQ ID NO: 526724 - DNA, 25 bp, Rattus norvegicus
gaaacgtcaggtcccaggccgtagc

SEQ ID NO: 526725 - DNA, 25 bp, Rattus norvegicus
ggccgtagcactccagacgcttcta

SEQ ID NO: 526726 - DNA, 25 bp, Rattus norvegicus
ccagaggccgcaccgggtttctggc

SEQ ID NO: 526727 - DNA, 25 bp, Rattus norvegicus
ggatcagcgccgcagtcgcaagccg

SEQ ID NO: 526728 - DNA, 25 bp, Rattus norvegicus
tacctctcggcgcaggctggaagcg

SEQ ID NO: 526729 - DNA, 25 bp, Rattus norvegicus
ctccaggtcaccttcaggcgagggc

SEQ ID NO: 526730 - DNA, 25 bp, Rattus norvegicus
ggaacattgggaactaaaataagca

SEQ ID NO: 526731 - DNA, 25 bp, Rattus norvegicus
agggtccctagtcaggtcttctctc

SEQ ID NO: 526732 - DNA, 25 bp, Rattus norvegicus
ttcggagcatggctccaaggctgtg

SEQ ID NO: 526733 - DNA, 25 bp, Rattus norvegicus
cagccgctgtgcgatgatccagaga

SEQ ID NO: 526734 - DNA, 25 bp, Rattus norvegicus
tgatccagagactggggccgcagca

SEQ ID NO: 526735 - DNA, 25 bp, Rattus norvegicus
agcgcagcgactctatgccggaatc

SEQ ID NO: 526736 - DNA, 25 bp, Rattus norvegicus
gaatcgcactggctgtcgtccgcct

SEQ ID NO: 526737 - DNA, 25 bp, Rattus norvegicus
atccagggtccagcgggatctaact

SEQ ID NO: 526738 - DNA, 25 bp, Rattus norvegicus
gggcccaagaagtggccacaagcca

SEQ ID NO: 526739 - DNA, 25 bp, Rattus norvegicus
atctaactctgaggtgtgcggcgcg

SEQ ID NO: 526740 - DNA, 25 bp, Rattus norvegicus
gggtttgtgtgtccgcctaacagaa

SEQ ID NO: 526741 - DNA, 25 bp, Rattus norvegicus
agtccctctgcgagcgggttcatta

SEQ ID NO: 526742 - DNA, 25 bp, Rattus norvegicus
agcgggttcattacctggctgtgca

SEQ ID NO: 526743 - DNA, 25 bp, Rattus norvegicus
ctctggttccttgtccgtcttcgga

SEQ ID NO: 526744 - DNA, 25 bp, Rattus norvegicus
gctttgggcagctgaagggtcccta

SEQ ID NO: 526745 - DNA, 25 bp, Rattus norvegicus
ctggctccagctcggctcagacaaa

SEQ ID NO: 526746 - DNA, 25 bp, Rattus norvegicus
tccagctcggctcagacaaaaggcg

SEQ ID NO: 526747 - DNA, 25 bp, Rattus norvegicus
agctcggctcagacaaaaggcggcg

SEQ ID NO: 526748 - DNA, 25 bp, Rattus norvegicus
cgccgcgagggcctcaaggtgacac

SEQ ID NO: 526749 - DNA, 25 bp, Rattus norvegicus
gcgagggcctcaaggtgacacccgc

SEQ ID NO: 526750 - DNA, 25 bp, Rattus norvegicus
aggagcccatggcagcggcggacga

SEQ ID NO: 526751 - DNA, 25 bp, Rattus norvegicus
gcacctcgcgcggtccctgccggtt

SEQ ID NO: 526752 - DNA, 25 bp, Rattus norvegicus
gtccctgccggttccgccgcagagc

SEQ ID NO: 526753 - DNA, 25 bp, Rattus norvegicus
ttccgccgcagagcggccggcgccc

SEQ ID NO: 526754 - DNA, 25 bp, Rattus norvegicus
ccgcgcagtccgctgtggcgaggaa

SEQ ID NO: 526755 - DNA, 25 bp, Rattus norvegicus
gctccagctcggctcagacaaaagg

SEQ ID NO: 526756 - DNA, 25 bp, Rattus norvegicus
cttagcagcgaagggctaggccggc

SEQ ID NO: 526757 - DNA, 25 bp, Rattus norvegicus
cccgggcttagcagcgaagggctag

SEQ ID NO: 526758 - DNA, 25 bp, Rattus norvegicus
ggagcctcgcagaccccgggcttag

SEQ ID NO: 526759 - DNA, 25 bp, Rattus norvegicus
ggccaccttggtatgcctgctcgtc

SEQ ID NO: 526760 - DNA, 25 bp, Rattus norvegicus
ggtcagcagctcgtccatcttctcg

SEQ ID NO: 526761 - DNA, 25 bp, Rattus norvegicus
ctcgagtggcacatccgttccaatc

SEQ ID NO: 526762 - DNA, 25 bp, Rattus norvegicus
tgcgcactaccacgtggagaagctc

SEQ ID NO: 526763 - DNA, 25 bp, Rattus norvegicus
ctggcggagtatcgcacagcatatg

SEQ ID NO: 526764 - DNA, 25 bp, Rattus norvegicus
tgcaggtctaccacgagcgggtcaa

SEQ ID NO: 526765 - DNA, 25 bp, Rattus norvegicus
agcgggtcaacacacacgtggcgga

SEQ ID NO: 526766 - DNA, 25 bp, Rattus norvegicus
tactcggaggtgttgctcatggacc

SEQ ID NO: 526767 - DNA, 25 bp, Rattus norvegicus
tcatggacctagtcgagctgggctc

SEQ ID NO: 526768 - DNA, 25 bp, Rattus norvegicus
actttcgcgagttcatggtggcctt

SEQ ID NO: 526769 - DNA, 25 bp, Rattus norvegicus
agggcatgcatctcaagaacgtgga

SEQ ID NO: 526770 - DNA, 25 bp, Rattus norvegicus
cttcttcgccgagaacgagggcttg

SEQ ID NO: 526771 - DNA, 25 bp, Rattus norvegicus
tgagaacgcgtacctgtgccagcgc

SEQ ID NO: 526772 - DNA, 25 bp, Rattus norvegicus
agtgcttcagtttcgccagtgtgga

SEQ ID NO: 526773 - DNA, 25 bp, Rattus norvegicus
ccgtggcgatctcggaagaagctca

SEQ ID NO: 526774 - DNA, 25 bp, Rattus norvegicus
agcagccactgacgccgccatttta

SEQ ID NO: 526775 - DNA, 25 bp, Rattus norvegicus
gacgcctaggtttcctacagcggcc

SEQ ID NO: 526776 - DNA, 25 bp, Rattus norvegicus
tgacgtgcgaaaggacgcctaggtt

SEQ ID NO: 526777 - DNA, 25 bp, Rattus norvegicus
caaagagtgacgtgcgaaaggacgc

SEQ ID NO: 526778 - DNA, 25 bp, Rattus norvegicus
tttagctccgggcaacggcttcgcg

SEQ ID NO: 526779 - DNA, 25 bp, Rattus norvegicus
cgccattttagctccgggcaacggc

SEQ ID NO: 526780 - DNA, 25 bp, Rattus norvegicus
atgggcacgacctcccaatggctcg

SEQ ID NO: 526781 - DNA, 25 bp, Rattus norvegicus
ttgagaaccgctgccatgggcacga

SEQ ID NO: 526782 - DNA, 25 bp, Rattus norvegicus
ctcggaagaagctcaggaaggcgtc

SEQ ID NO: 526783 - DNA, 25 bp, Rattus norvegicus
cgacctggttcatgcctgcgttgac

SEQ ID NO: 526784 - DNA, 25 bp, Rattus norvegicus
gttcatgcctgcgttgacgaaaagc

SEQ ID NO: 526785 - DNA, 25 bp, Rattus norvegicus
tgacgaaaagcaggctggggtcgcc

SEQ ID NO: 526786 - DNA, 25 bp, Rattus norvegicus
agaagctcaggaaggcgtcccgcac

SEQ ID NO: 526787 - DNA, 25 bp, Rattus norvegicus
cgctcttggaggaagtggcctcttt

SEQ ID NO: 526788 - DNA, 25 bp, Rattus norvegicus
agcgccgttactactttctcgaagc

SEQ ID NO: 526789 - DNA, 25 bp, Rattus norvegicus
tcacctggctcaacctcgggaacga

SEQ ID NO: 526790 - DNA, 25 bp, Rattus norvegicus
tgctaggcccttgaacacttatttg

SEQ ID NO: 526791 - DNA, 25 bp, Rattus norvegicus
tatttgttcagttagggacgcgccc

SEQ ID NO: 526792 - DNA, 25 bp, Rattus norvegicus
cgcgcctgcgcagatctcatcaaag

SEQ ID NO: 526793 - DNA, 25 bp, Rattus norvegicus
tcgcgtctctcagggtacagttagg

SEQ ID NO: 526794 - DNA, 25 bp, Rattus norvegicus
atctgttcagcatcctcggcacttg

SEQ ID NO: 526795 - DNA, 25 bp, Rattus norvegicus
gcactgcgggttgtagttcccagaa

SEQ ID NO: 526796 - DNA, 25 bp, Rattus norvegicus
cgaagttcttgtcgcttagatgcca

SEQ ID NO: 526797 - DNA, 25 bp, Rattus norvegicus
agctcccatccgatctagcgtggtg

SEQ ID NO: 526798 - DNA, 25 bp, Rattus norvegicus
agttccacctctggcatctcgcgag

SEQ ID NO: 526799 - DNA, 25 bp, Rattus norvegicus
gcgctttggcctctacggtttgata

SEQ ID NO: 526800 - DNA, 25 bp, Rattus norvegicus
tcggcctctaagatctcgcgagatt

SEQ ID NO: 526801 - DNA, 25 bp, Rattus norvegicus
gctgtgttcgcacaatctgccaccg

SEQ ID NO: 526802 - DNA, 25 bp, Rattus norvegicus
ggctcggtgctgtgttcgcacaatc

SEQ ID NO: 526803 - DNA, 25 bp, Rattus norvegicus
aaaacctgagaaggtgcttggcgcc

SEQ ID NO: 526804 - DNA, 25 bp, Rattus norvegicus
cccgaggattagcaaagtgcagagg

SEQ ID NO: 526805 - DNA, 25 bp, Rattus norvegicus
ttcgcccgaggattagcaaagtgca

SEQ ID NO: 526806 - DNA, 25 bp, Rattus norvegicus
gcgattatgtttcgcccgaggatta

SEQ ID NO: 526807 - DNA, 25 bp, Rattus norvegicus
cctcgaacatttctctgcgattatg

SEQ ID NO: 526808 - DNA, 25 bp, Rattus norvegicus
gtgtccagcctcgaacatttctctg

SEQ ID NO: 526809 - DNA, 25 bp, Rattus norvegicus
gctgtgtccagcctcgaacatttct

SEQ ID NO: 526810 - DNA, 25 bp, Rattus norvegicus
ctcgttcctccctgctgtgtccagc

SEQ ID NO: 526811 - DNA, 25 bp, Rattus norvegicus
gggcccgagccagcgcctcgttcct

SEQ ID NO: 526812 - DNA, 25 bp, Rattus norvegicus
gtgttatttccactgggcccgagcc

SEQ ID NO: 526813 - DNA, 25 bp, Rattus norvegicus
gcccagcggagtgttatttccactg

SEQ ID NO: 526814 - DNA, 25 bp, Rattus norvegicus
tggagcccagcggagtgttatttcc

SEQ ID NO: 526815 - DNA, 25 bp, Rattus norvegicus
gaaaaggtgactgagctaggctaga

SEQ ID NO: 526816 - DNA, 25 bp, Rattus norvegicus
accgagcggcgcgtatccatgcggc

SEQ ID NO: 526817 - DNA, 25 bp, Rattus norvegicus
gggactgcgccttccacttccgcca

SEQ ID NO: 526818 - DNA, 25 bp, Rattus norvegicus
atgcgcaccgggctagacagcgcgc

SEQ ID NO: 526819 - DNA, 25 bp, Rattus norvegicus
aaggaccaacctgtgcggcgagagc

SEQ ID NO: 526820 - DNA, 25 bp, Rattus norvegicus
gtaagatggcgagagtgccactatg

SEQ ID NO: 526821 - DNA, 25 bp, Rattus norvegicus
gcgcgtatccatgcggcggagccta

SEQ ID NO: 526822 - DNA, 25 bp, Rattus norvegicus
ttgtagaaagggaaaaggtgactga

SEQ ID NO: 526823 - DNA, 25 bp, Rattus norvegicus
ttaagacacgtggaggcacggctgc

SEQ ID NO: 526824 - DNA, 25 bp, Rattus norvegicus
acaacctctgcttaagacacgtgga

SEQ ID NO: 526825 - DNA, 25 bp, Rattus norvegicus
atctttggctgccacgtccctgacg

SEQ ID NO: 526826 - DNA, 25 bp, Rattus norvegicus
cccggggccagatctttggctgcca

SEQ ID NO: 526827 - DNA, 25 bp, Rattus norvegicus
gcgaaacagtgcctctccgcctggc

SEQ ID NO: 526828 - DNA, 25 bp, Rattus norvegicus
actagagggaaggaccaacctgtgc

SEQ ID NO: 526829 - DNA, 25 bp, Rattus norvegicus
cggcactcggctttctcgaacttga

SEQ ID NO: 526830 - DNA, 25 bp, Rattus norvegicus
ggctgttgtgatgcgtattcccgta

SEQ ID NO: 526831 - DNA, 25 bp, Rattus norvegicus
caagatgagcgacgtgagcccggta

SEQ ID NO: 526832 - DNA, 25 bp, Rattus norvegicus
gcacgacaaccgcaccatggtggag

SEQ ID NO: 526833 - DNA, 25 bp, Rattus norvegicus
accatggtggagatcatcgcggacc

SEQ ID NO: 526834 - DNA, 25 bp, Rattus norvegicus
ggccttcaaggtaagagactggtta

SEQ ID NO: 526835 - DNA, 25 bp, Rattus norvegicus
gaatcttccgcgctgtggtctcggt

SEQ ID NO: 526836 - DNA, 25 bp, Rattus norvegicus
cgtgggtgccctccaagactctaac

SEQ ID NO: 526837 - DNA, 25 bp, Rattus norvegicus
accgaggtggccctgatcttcttac

SEQ ID NO: 526838 - DNA, 25 bp, Rattus norvegicus
tgattttctcacctcttctgtcccg

SEQ ID NO: 526839 - DNA, 25 bp, Rattus norvegicus
ctcttcacgtctcccaggcatggtt

SEQ ID NO: 526840 - DNA, 25 bp, Rattus norvegicus
tcccaggcatggttcttgcctcttt

SEQ ID NO: 526841 - DNA, 25 bp, Rattus norvegicus
gtgcccgctgtgagttgcaaacttc

SEQ ID NO: 526842 - DNA, 25 bp, Rattus norvegicus
ggttcccttgctcgttcactcttca

SEQ ID NO: 526843 - DNA, 25 bp, Rattus norvegicus
cgtccggggagctgcgctcacacga

SEQ ID NO: 526844 - DNA, 25 bp, Rattus norvegicus
cccagcgcggcacggcagcggccac

SEQ ID NO: 526845 - DNA, 25 bp, Rattus norvegicus
cgcggccgggatgagtcaactcctg

SEQ ID NO: 526846 - DNA, 25 bp, Rattus norvegicus
gtcaactcctggtttaatgggggca

SEQ ID NO: 526847 - DNA, 25 bp, Rattus norvegicus
actcctggtttaatgggggcagagc

SEQ ID NO: 526848 - DNA, 25 bp, Rattus norvegicus
accgcggccgggatgagtcaactcc

SEQ ID NO: 526849 - DNA, 25 bp, Rattus norvegicus
agccgtccggggagctgcgctcaca

SEQ ID NO: 526850 - DNA, 25 bp, Rattus norvegicus
ccgccggcgactccggcctcgccgc

SEQ ID NO: 526851 - DNA, 25 bp, Rattus norvegicus
ctgcagccgggcacccgccgccctc

SEQ ID NO: 526852 - DNA, 25 bp, Rattus norvegicus
ctccgcgcaactctgcatcagtttt

SEQ ID NO: 526853 - DNA, 25 bp, Rattus norvegicus
ccgcgcaactctgcatcagttttgg

SEQ ID NO: 526854 - DNA, 25 bp, Rattus norvegicus
gcgcaactctgcatcagttttgggg

SEQ ID NO: 526855 - DNA, 25 bp, Rattus norvegicus
tctgcatcagttttggggggcctcc

SEQ ID NO: 526856 - DNA, 25 bp, Rattus norvegicus
cgcgaggggacacgagcgaacgagc

SEQ ID NO: 526857 - DNA, 25 bp, Rattus norvegicus
taaacacgaggacgggcgcacgttc

SEQ ID NO: 526858 - DNA, 25 bp, Rattus norvegicus
ttcgccagcaggagaagccagtgcg

SEQ ID NO: 526859 - DNA, 25 bp, Rattus norvegicus
agcaagtgccgtctgttcgccagca

SEQ ID NO: 526860 - DNA, 25 bp, Rattus norvegicus
tcggctttgaaaagcaagtgccgtc

SEQ ID NO: 526861 - DNA, 25 bp, Rattus norvegicus
ttctgttggcaactcggctttgaaa

SEQ ID NO: 526862 - DNA, 25 bp, Rattus norvegicus
ctttgaccttctgttggcaactcgg

SEQ ID NO: 526863 - DNA, 25 bp, Rattus norvegicus
gaggctccgggctttgaccttctgt

SEQ ID NO: 526864 - DNA, 25 bp, Rattus norvegicus
gctcaaggtcccaaatttgtaagcc

SEQ ID NO: 526865 - DNA, 25 bp, Rattus norvegicus
gacatcatgctcaaggtcccaaatt

SEQ ID NO: 526866 - DNA, 25 bp, Rattus norvegicus
atcgctttaagacatgacatcatgc

SEQ ID NO: 526867 - DNA, 25 bp, Rattus norvegicus
ctcggctcagcttatcgctttaaga

SEQ ID NO: 526868 - DNA, 25 bp, Rattus norvegicus
ccgtttctttcctcggctcagctta

SEQ ID NO: 526869 - DNA, 25 bp, Rattus norvegicus
tgcaacatgcccgtttctttcctcg

SEQ ID NO: 526870 - DNA, 25 bp, Rattus norvegicus
gggcgcacgttctttgcaacatgcc

SEQ ID NO: 526871 - DNA, 25 bp, Rattus norvegicus
cccaccaggccgcagtgaacaaagg

SEQ ID NO: 526872 - DNA, 25 bp, Rattus norvegicus
cgcccatgtggactagcctctcctc

SEQ ID NO: 526873 - DNA, 25 bp, Rattus norvegicus
tttgctgcacctcgggaccgggcag

SEQ ID NO: 526874 - DNA, 25 bp, Rattus norvegicus
ccttttttgctgcacctcgggaccg

SEQ ID NO: 526875 - DNA, 25 bp, Rattus norvegicus
aggaaactctcccttttttgctgca

SEQ ID NO: 526876 - DNA, 25 bp, Rattus norvegicus
gcagtgaacaaaggcgctcgccgga

SEQ ID NO: 526877 - DNA, 25 bp, Rattus norvegicus
taccagcggcacaaaagcggcagct

SEQ ID NO: 526878 - DNA, 25 bp, Rattus norvegicus
ggtcggatcgtaccagcggcacaaa

SEQ ID NO: 526879 - DNA, 25 bp, Rattus norvegicus
tgacttgggaaacccggtgctctgg

SEQ ID NO: 526880 - DNA, 25 bp, Rattus norvegicus
ccgctgacttgggaaacccggtgct

SEQ ID NO: 526881 - DNA, 25 bp, Rattus norvegicus
gttttgtgaaccacagccacctctc

SEQ ID NO: 526882 - DNA, 25 bp, Rattus norvegicus
ggcggggttttgtgaaccacagcca

SEQ ID NO: 526883 - DNA, 25 bp, Rattus norvegicus
ggctctcaccaaagagccatctatc

SEQ ID NO: 526884 - DNA, 25 bp, Rattus norvegicus
aggcgctcgccggaggaaactctcc

SEQ ID NO: 526885 - DNA, 25 bp, Rattus norvegicus
gcgggtgcgcccaaaatagaccgca

SEQ ID NO: 526886 - DNA, 25 bp, Rattus norvegicus
tcacgaagagctcgatctcggggtc

SEQ ID NO: 526887 - DNA, 25 bp, Rattus norvegicus
cccattagctgtcgctgagtccgtc

SEQ ID NO: 526888 - DNA, 25 bp, Rattus norvegicus
ctgctcacagcgaggggcctctctt

SEQ ID NO: 526889 - DNA, 25 bp, Rattus norvegicus
ggcctctcttctgcacggcgtttaa

SEQ ID NO: 526890 - DNA, 25 bp, Rattus norvegicus
ttctccaagcaaggacagctatgtc

SEQ ID NO: 526891 - DNA, 25 bp, Rattus norvegicus
tgtctgagagaagagctcggagtcc

SEQ ID NO: 526892 - DNA, 25 bp, Rattus norvegicus
gaggaggcccacgaacgccgaccta

SEQ ID NO: 526893 - DNA, 25 bp, Rattus norvegicus
ctcggagtcccaggtgtcaaacgga

SEQ ID NO: 526894 - DNA, 25 bp, Rattus norvegicus
tgtcaaacggaaagagcagactcca

SEQ ID NO: 526895 - DNA, 25 bp, Rattus norvegicus
agcagactccaagatccagcagggg

SEQ ID NO: 526896 - DNA, 25 bp, Rattus norvegicus
agagcgagctaagggattgacaaca

SEQ ID NO: 526897 - DNA, 25 bp, Rattus norvegicus
aggtcccgagagcaacaagtgcctg

SEQ ID NO: 526898 - DNA, 25 bp, Rattus norvegicus
aggtgtcacaggatccgcgactgtc

SEQ ID NO: 526899 - DNA, 25 bp, Rattus norvegicus
gcggttccgctatcgccgagttccg

SEQ ID NO: 526900 - DNA, 25 bp, Rattus norvegicus
cgtactgcggcaggtggatgtcaac

SEQ ID NO: 526901 - DNA, 25 bp, Rattus norvegicus
ctgggagagtttctggtcccttctc

SEQ ID NO: 526902 - DNA, 25 bp, Rattus norvegicus
agagactgggagagtttctggtccc

SEQ ID NO: 526903 - DNA, 25 bp, Rattus norvegicus
ctcccttcccgagctcgccgagggc

SEQ ID NO: 526904 - DNA, 25 bp, Rattus norvegicus
agggaaatgccactcccttcccgag

SEQ ID NO: 526905 - DNA, 25 bp, Rattus norvegicus
cgagttccgcgcgccggaccgaagt

SEQ ID NO: 526906 - DNA, 25 bp, Rattus norvegicus
gagcgcgcggttccgctatcgccga

SEQ ID NO: 526907 - DNA, 25 bp, Rattus norvegicus
actgcgcaggcgtcccaggaagcgc

SEQ ID NO: 526908 - DNA, 25 bp, Rattus norvegicus
tcccgcacacagctgcgcactcgga

SEQ ID NO: 526909 - DNA, 25 bp, Rattus norvegicus
tccacagccggccacaagcgctctc

SEQ ID NO: 526910 - DNA, 25 bp, Rattus norvegicus
gagagtttctggtcccttctcctcc

SEQ ID NO: 526911 - DNA, 25 bp, Rattus norvegicus
gcgggtgagtcctgaagggaaatgc

SEQ ID NO: 526912 - DNA, 25 bp, Rattus norvegicus
caggtggatgtcaactgtggcgtta

SEQ ID NO: 526913 - DNA, 25 bp, Rattus norvegicus
cgctctccgggtcgcagggtcaccc

SEQ ID NO: 526914 - DNA, 25 bp, Rattus norvegicus
cacccaagccagtggagatgggcgc

SEQ ID NO: 526915 - DNA, 25 bp, Rattus norvegicus
cggctctcacccaagccagtggaga

SEQ ID NO: 526916 - DNA, 25 bp, Rattus norvegicus
cgtcacccgggacaaagcggctccg

SEQ ID NO: 526917 - DNA, 25 bp, Rattus norvegicus
tcgatggggcctgcgccgttacgta

SEQ ID NO: 526918 - DNA, 25 bp, Rattus norvegicus
cgggctgtgcctcctgctggtgctc

SEQ ID NO: 526919 - DNA, 25 bp, Rattus norvegicus
cgtggaaccgtgcgcactgagcgcc

SEQ ID NO: 526920 - DNA, 25 bp, Rattus norvegicus
cctgctcacctgacggccggggtga

SEQ ID NO: 526921 - DNA, 25 bp, Rattus norvegicus
caggacgtctgcgatgcgccgctgt

SEQ ID NO: 526922 - DNA, 25 bp, Rattus norvegicus
acctgcaggacgtctgcgatgcgcc

SEQ ID NO: 526923 - DNA, 25 bp, Rattus norvegicus
accgacctgcaggacgtctgcgatg

SEQ ID NO: 526924 - DNA, 25 bp, Rattus norvegicus
cgtaaccgacctgcaggacgtctgc

SEQ ID NO: 526925 - DNA, 25 bp, Rattus norvegicus
gccgttacgtaaccgacctgcagga

SEQ ID NO: 526926 - DNA, 25 bp, Rattus norvegicus
gtgctcccgcaacctccaccgccgt

SEQ ID NO: 526927 - DNA, 25 bp, Rattus norvegicus
cactggtcctgacctgctgctgaat

SEQ ID NO: 526928 - DNA, 25 bp, Rattus norvegicus
gcgtaatagaggcacatggtccttc

SEQ ID NO: 526929 - DNA, 25 bp, Rattus norvegicus
ctttccctgaggaggagtcgctaca

SEQ ID NO: 526930 - DNA, 25 bp, Rattus norvegicus
caaccgtggccgagctaggtaccgg

SEQ ID NO: 526931 - DNA, 25 bp, Rattus norvegicus
actagcggtgcccactggtcctgac

SEQ ID NO: 526932 - DNA, 25 bp, Rattus norvegicus
gttcccaggcgactagcggtgccca

SEQ ID NO: 526933 - DNA, 25 bp, Rattus norvegicus
atggtccttccctgacctctcttgg

SEQ ID NO: 526934 - DNA, 25 bp, Rattus norvegicus
gctgaatgcctttccctgaggagga

SEQ ID NO: 526935 - DNA, 25 bp, Rattus norvegicus
gtcgctacagccactcacgcagaga

SEQ ID NO: 526936 - DNA, 25 bp, Rattus norvegicus
gaccagcaagttcctactgtccggc

SEQ ID NO: 526937 - DNA, 25 bp, Rattus norvegicus
ggcgcctttgccgagcgtaatagag

SEQ ID NO: 526938 - DNA, 25 bp, Rattus norvegicus
ctggaccggtccagctaccaggcgg

SEQ ID NO: 526939 - DNA, 25 bp, Rattus norvegicus
aagttcctactgtccggctgcgccg

SEQ ID NO: 526940 - DNA, 25 bp, Rattus norvegicus
acctctcttgggctgaaaaggggcg

SEQ ID NO: 526941 - DNA, 25 bp, Rattus norvegicus
ttccacctgccctccgaagtgttgg

SEQ ID NO: 526942 - DNA, 25 bp, Rattus norvegicus
tgtccttcgtggacgtgcatcccga

SEQ ID NO: 526943 - DNA, 25 bp, Rattus norvegicus
ctggccgaaggatcgcctctccagg

SEQ ID NO: 526944 - DNA, 25 bp, Rattus norvegicus
ggccgcagccatgagttcgactccg

SEQ ID NO: 526945 - DNA, 25 bp, Rattus norvegicus
tgcatcccgaggtgatcccggtgca

SEQ ID NO: 526946 - DNA, 25 bp, Rattus norvegicus
aagacagccgcgtcttcctgctgga

SEQ ID NO: 526947 - DNA, 25 bp, Rattus norvegicus
gggcgcagcgagttcttccacctgc

SEQ ID NO: 526948 - DNA, 25 bp, Rattus norvegicus
gctgtggacttccttagcaaccttc

SEQ ID NO: 526949 - DNA, 25 bp, Rattus norvegicus
aaccttcagggtaaggaggtgcacg

SEQ ID NO: 526950 - DNA, 25 bp, Rattus norvegicus
ggtcctggacgtgctgctcctccat

SEQ ID NO: 526951 - DNA, 25 bp, Rattus norvegicus
aggtgccggttgtgtctcagcagat

SEQ ID NO: 526952 - DNA, 25 bp, Rattus norvegicus
gcctcttctgttcgctgctcaaacg

SEQ ID NO: 526953 - DNA, 25 bp, Rattus norvegicus
tcaaacgctatctgacggcggccgg

SEQ ID NO: 526954 - DNA, 25 bp, Rattus norvegicus
tcctgctggatgagggccgcaccat

SEQ ID NO: 526955 - DNA, 25 bp, Rattus norvegicus
tatctagtagaagtcctcctcggtc

SEQ ID NO: 526956 - DNA, 25 bp, Rattus norvegicus
gagcgacttcccatagcgaagcttc

SEQ ID NO: 526957 - DNA, 25 bp, Rattus norvegicus
tctccactgcggtagcatccggaca

SEQ ID NO: 526958 - DNA, 25 bp, Rattus norvegicus
catccggacatgacattgcagtagc

SEQ ID NO: 526959 - DNA, 25 bp, Rattus norvegicus
ttgcagtagcgacaaagcagcggcc

SEQ ID NO: 526960 - DNA, 25 bp, Rattus norvegicus
cctccaagcaaccagatggcaagaa

SEQ ID NO: 526961 - DNA, 25 bp, Rattus norvegicus
agcccatgtgcactgcagcagcaag

SEQ ID NO: 526962 - DNA, 25 bp, Rattus norvegicus
tcctcggtcttgctattgccctgta

SEQ ID NO: 526963 - DNA, 25 bp, Rattus norvegicus
cggcgacagtgctaaagagcgactt

SEQ ID NO: 526964 - DNA, 25 bp, Rattus norvegicus
tccgatcgctcaccaagagaaggga

SEQ ID NO: 526965 - DNA, 25 bp, Rattus norvegicus
ggcgaccatcgtggctccaacttgg

SEQ ID NO: 526966 - DNA, 25 bp, Rattus norvegicus
cagctggaatcggtggctgtttctg

SEQ ID NO: 526967 - DNA, 25 bp, Rattus norvegicus
tcacgggcggtgagcccatctacct

SEQ ID NO: 526968 - DNA, 25 bp, Rattus norvegicus
caactgacaggactactcgggcctc

SEQ ID NO: 526969 - DNA, 25 bp, Rattus norvegicus
actcttgcccgtgggttccaccttg

SEQ ID NO: 526970 - DNA, 25 bp, Rattus norvegicus
acccgcacctggacgagggtgttgt

SEQ ID NO: 526971 - DNA, 25 bp, Rattus norvegicus
cgcccagaccattctcgcgagattt

SEQ ID NO: 526972 - DNA, 25 bp, Rattus norvegicus
cgggtcccaattctcttcactcttg

SEQ ID NO: 526973 - DNA, 25 bp, Rattus norvegicus
agcatgggtaagcatcgccgcgccc

SEQ ID NO: 526974 - DNA, 25 bp, Rattus norvegicus
acaaagtggcgcttgccgctctgct

SEQ ID NO: 526975 - DNA, 25 bp, Rattus norvegicus
agggcgatcgcgaacttgacaaagt

SEQ ID NO: 526976 - DNA, 25 bp, Rattus norvegicus
acagcgtggctcgaacccgtgatcc

SEQ ID NO: 526977 - DNA, 25 bp, Rattus norvegicus
gtcgggtccagtcgggcgatctccc

SEQ ID NO: 526978 - DNA, 25 bp, Rattus norvegicus
ttcctcgccagagccgcagcatggg

SEQ ID NO: 526979 - DNA, 25 bp, Rattus norvegicus
ttccaccttggtcacgagcttggcg

SEQ ID NO: 526980 - DNA, 25 bp, Rattus norvegicus
gcatctccgggagaccaagtacccg

SEQ ID NO: 526981 - DNA, 25 bp, Rattus norvegicus
ccgcgcctgagacggtgcacagaag

SEQ ID NO: 526982 - DNA, 25 bp, Rattus norvegicus
tcgccggtccttcgcggacagcgtg

SEQ ID NO: 526983 - DNA, 25 bp, Rattus norvegicus
aggtggatttcctctcggtcgcgat

SEQ ID NO: 526984 - DNA, 25 bp, Rattus norvegicus
tgttgtaagaagcagacatgtgccc

SEQ ID NO: 526985 - DNA, 25 bp, Rattus norvegicus
gcccttcttcatgtcgccgctgcag

SEQ ID NO: 526986 - DNA, 25 bp, Rattus norvegicus
cgcggtgttgtaagaagcagacatg

SEQ ID NO: 526987 - DNA, 25 bp, Rattus norvegicus
gcctcgcggtgttgtaagaagcaga

SEQ ID NO: 526988 - DNA, 25 bp, Rattus norvegicus
taactgggaccatgtgcctcgcggt

SEQ ID NO: 526989 - DNA, 25 bp, Rattus norvegicus
tgtctaactgggaccatgtgcctcg

SEQ ID NO: 526990 - DNA, 25 bp, Rattus norvegicus
ttcggtgtctaactgggaccatgtg

SEQ ID NO: 526991 - DNA, 25 bp, Rattus norvegicus
gagcgtcccacagaggtggatttcc

SEQ ID NO: 526992 - DNA, 25 bp, Rattus norvegicus
atttcctctcggtcgcgatggggtt

SEQ ID NO: 526993 - DNA, 25 bp, Rattus norvegicus
cctccctcgctggaggtggcggttc

SEQ ID NO: 526994 - DNA, 25 bp, Rattus norvegicus
cggagcgtcccacagaggtggattt

SEQ ID NO: 526995 - DNA, 25 bp, Rattus norvegicus
tcgcgatggggttcggtgtctaact

SEQ ID NO: 526996 - DNA, 25 bp, Rattus norvegicus
cggttctgtgcggagcgtcccacag

SEQ ID NO: 526997 - DNA, 25 bp, Rattus norvegicus
tcttctctgtttcttcatcgactca

SEQ ID NO: 526998 - DNA, 25 bp, Rattus norvegicus
agtaagcccgttcgctgtggagcac

SEQ ID NO: 526999 - DNA, 25 bp, Rattus norvegicus
gctctagggcattggggttcgatct

SEQ ID NO: 527000 - DNA, 25 bp, Rattus norvegicus
cctgagttgactggctccggagctc

SEQ ID NO: 527001 - DNA, 25 bp, Rattus norvegicus
ttatacgtcatcagacgcgcgcccg

SEQ ID NO: 527002 - DNA, 25 bp, Rattus norvegicus
ggcgtatgtcttatacgtcatcaga

SEQ ID NO: 527003 - DNA, 25 bp, Rattus norvegicus
aggctggactaagggcgtatgtctt

SEQ ID NO: 527004 - DNA, 25 bp, Rattus norvegicus
actggtagaaaaaggctggactaag

SEQ ID NO: 527005 - DNA, 25 bp, Rattus norvegicus
tgaagaaacccgacacactggtaga

SEQ ID NO: 527006 - DNA, 25 bp, Rattus norvegicus
acctgggaaccggaagtgtcaatga

SEQ ID NO: 527007 - DNA, 25 bp, Rattus norvegicus
gagagacaacgtcaaggacctggga

SEQ ID NO: 527008 - DNA, 25 bp, Rattus norvegicus
catcgactcaaagagcgcgcgtctg

SEQ ID NO: 527009 - DNA, 25 bp, Rattus norvegicus
gcttaagcacttcgactcttctctg

SEQ ID NO: 527010 - DNA, 25 bp, Rattus norvegicus
gcgcgtctggtttactccgcccaaa

SEQ ID NO: 527011 - DNA, 25 bp, Rattus norvegicus
ctgcatgagccgctgaatcatgccc

SEQ ID NO: 527012 - DNA, 25 bp, Rattus norvegicus
cccttgcgctctgcgtacttgtctg

SEQ ID NO: 527013 - DNA, 25 bp, Rattus norvegicus
cgctctgcgtacttgtctgactcca

SEQ ID NO: 527014 - DNA, 25 bp, Rattus norvegicus
tgcgtacttgtctgactccagcagc

SEQ ID NO: 527015 - DNA, 25 bp, Rattus norvegicus
gctgctgcatgagccgctgaatcat

SEQ ID NO: 527016 - DNA, 25 bp, Rattus norvegicus
agcgtcctccttgacggcaggcaca

SEQ ID NO: 527017 - DNA, 25 bp, Rattus norvegicus
ctccttgacggcaggcacaagtggc

SEQ ID NO: 527018 - DNA, 25 bp, Rattus norvegicus
cagctggcgactgactcctggacct

SEQ ID NO: 527019 - DNA, 25 bp, Rattus norvegicus
actgactcctggacctgtgggagca

SEQ ID NO: 527020 - DNA, 25 bp, Rattus norvegicus
actcctggacctgtgggagcaagcg

SEQ ID NO: 527021 - DNA, 25 bp, Rattus norvegicus
agcaagcggccgtcccatcagtgac

SEQ ID NO: 527022 - DNA, 25 bp, Rattus norvegicus
tcccatcagtgactgcggctcctgg

SEQ ID NO: 527023 - DNA, 25 bp, Rattus norvegicus
gtacttgtctgactccagcagctgc

SEQ ID NO: 527024 - DNA, 25 bp, Rattus norvegicus
cggtaagcagctggcgactgactcc

SEQ ID NO: 527025 - DNA, 25 bp, Rattus norvegicus
agccctttggcgttaatcgattgtc

SEQ ID NO: 527026 - DNA, 25 bp, Rattus norvegicus
tggcgttaatcgattgtctgtaggg

SEQ ID NO: 527027 - DNA, 25 bp, Rattus norvegicus
tggtaccgatgctgctggcgcccag

SEQ ID NO: 527028 - DNA, 25 bp, Rattus norvegicus
tcacccattgtggtaccgatgctgc

SEQ ID NO: 527029 - DNA, 25 bp, Rattus norvegicus
agaccggaccggctgtcacccattg

SEQ ID NO: 527030 - DNA, 25 bp, Rattus norvegicus
gacaaacaggtaccggcgctgcgcc

SEQ ID NO: 527031 - DNA, 25 bp, Rattus norvegicus
atcatgcagaggacaaacaggtacc

SEQ ID NO: 527032 - DNA, 25 bp, Rattus norvegicus
ctcctatcgagaccgtgggaatagc

SEQ ID NO: 527033 - DNA, 25 bp, Rattus norvegicus
agaccgtgggaatagccttgcagca

SEQ ID NO: 527034 - DNA, 25 bp, Rattus norvegicus
aatagccttgcagcactcgcgcagc

SEQ ID NO: 527035 - DNA, 25 bp, Rattus norvegicus
cgcagcccggagaaccaaaggcctg

SEQ ID NO: 527036 - DNA, 25 bp, Rattus norvegicus
gcggccaccatgagcacaggactgc

SEQ ID NO: 527037 - DNA, 25 bp, Rattus norvegicus
cacaggactgcggtacaagagcaag

SEQ ID NO: 527038 - DNA, 25 bp, Rattus norvegicus
accacgacccggatcatgcagagga

SEQ ID NO: 527039 - DNA, 25 bp, Rattus norvegicus
gcgtactacagctaatgttcttgtc

SEQ ID NO: 527040 - DNA, 25 bp, Rattus norvegicus
caagcggcgtcgtctgaaggagcct

SEQ ID NO: 527041 - DNA, 25 bp, Rattus norvegicus
gtcacccagcagcaagcggcgtcgt

SEQ ID NO: 527042 - DNA, 25 bp, Rattus norvegicus
tgcggcgtcacccagcagcaagcgg

SEQ ID NO: 527043 - DNA, 25 bp, Rattus norvegicus
cagatatttctggtgggcgcccatg

SEQ ID NO: 527044 - DNA, 25 bp, Rattus norvegicus
agcgaggcgggaatctctgacagat

SEQ ID NO: 527045 - DNA, 25 bp, Rattus norvegicus
cgattgcctaagtctggcctcgagg

SEQ ID NO: 527046 - DNA, 25 bp, Rattus norvegicus
ggcctggaccgattgcctaagtctg

SEQ ID NO: 527047 - DNA, 25 bp, Rattus norvegicus
gagcgcttggggcttagacagacag

SEQ ID NO: 527048 - DNA, 25 bp, Rattus norvegicus
gcgctaaaagttggtgtaacggtca

SEQ ID NO: 527049 - DNA, 25 bp, Rattus norvegicus
tcttgtcttcaaaacggcgctaaaa

SEQ ID NO: 527050 - DNA, 25 bp, Rattus norvegicus
gctaatgttcttgtcttcaaaacgg

SEQ ID NO: 527051 - DNA, 25 bp, Rattus norvegicus
tctgaaggagcctgacggcgtctgt

SEQ ID NO: 527052 - DNA, 25 bp, Rattus norvegicus
ggcgggaatctctgacagatatttc

SEQ ID NO: 527053 - DNA, 25 bp, Rattus norvegicus
acaaatggctgtcaagaaatacttg

SEQ ID NO: 527054 - DNA, 25 bp, Rattus norvegicus
ttgcagcgagaacctcgccgccgcc

SEQ ID NO: 527055 - DNA, 25 bp, Rattus norvegicus
cactcggacggcatcttcacagaca

SEQ ID NO: 527056 - DNA, 25 bp, Rattus norvegicus
cggacggcatcttcacagacagcta

SEQ ID NO: 527057 - DNA, 25 bp, Rattus norvegicus
acggcatcttcacagacagctatag

SEQ ID NO: 527058 - DNA, 25 bp, Rattus norvegicus
cagacagctatagccgctaccgaaa

SEQ ID NO: 527059 - DNA, 25 bp, Rattus norvegicus
ctgtcaagaaatacttggcggccgt

SEQ ID NO: 527060 - DNA, 25 bp, Rattus norvegicus
ccgctaccgaaaacaaatggctgtc

SEQ ID NO: 527061 - DNA, 25 bp, Rattus norvegicus
cccttctccttgcagcgagaacctc

SEQ ID NO: 527062 - DNA, 25 bp, Rattus norvegicus
caaaggacgccgaatagcgtacttg

SEQ ID NO: 527063 - DNA, 25 bp, Rattus norvegicus
ggacgccgaatagcgtacttgtagc

SEQ ID NO: 527064 - DNA, 25 bp, Rattus norvegicus
cgtgctagggaaaaggtataaacag

SEQ ID NO: 527065 - DNA, 25 bp, Rattus norvegicus
ctatagccgctaccgaaaacaaatg

SEQ ID NO: 527066 - DNA, 25 bp, Rattus norvegicus
ttaccaaacgccactcggacggcat

SEQ ID NO: 527067 - DNA, 25 bp, Rattus norvegicus
ccgcaggatcgggaagtactggaca

SEQ ID NO: 527068 - DNA, 25 bp, Rattus norvegicus
cctccagccgctaggacgataaggg

SEQ ID NO: 527069 - DNA, 25 bp, Rattus norvegicus
ccctacctcagggtcgcgagtgact

SEQ ID NO: 527070 - DNA, 25 bp, Rattus norvegicus
gcgagtgactccacgcccttcagga

SEQ ID NO: 527071 - DNA, 25 bp, Rattus norvegicus
gcccttcaggactcagggtgcagcg

SEQ ID NO: 527072 - DNA, 25 bp, Rattus norvegicus
aggctggatcactgcacggactccc

SEQ ID NO: 527073 - DNA, 25 bp, Rattus norvegicus
ctctttggagagaggttgactgttc

SEQ ID NO: 527074 - DNA, 25 bp, Rattus norvegicus
agcaggtagtgagcccaggagacac

SEQ ID NO: 527075 - DNA, 25 bp, Rattus norvegicus
gtcagtcgcctacgttgcgaggcca

SEQ ID NO: 527076 - DNA, 25 bp, Rattus norvegicus
aggcctgtcagtgtcacgcctgccg

SEQ ID NO: 527077 - DNA, 25 bp, Rattus norvegicus
gcgcgcggactacctctacgagcga

SEQ ID NO: 527078 - DNA, 25 bp, Rattus norvegicus
tctacgagcgaagcagggctccgcc

SEQ ID NO: 527079 - DNA, 25 bp, Rattus norvegicus
gcctggctcacggaaacaccgaaga

SEQ ID NO: 527080 - DNA, 25 bp, Rattus norvegicus
gcggcaccacagaggctggatcact

SEQ ID NO: 527081 - DNA, 25 bp, Rattus norvegicus
ctgaaggcattctgatgggcctgtg

SEQ ID NO: 527082 - DNA, 25 bp, Rattus norvegicus
gccagcgccaaatgtaacgcacgcg

SEQ ID NO: 527083 - DNA, 25 bp, Rattus norvegicus
ctgccagcgccaaatgtaacgcacg

SEQ ID NO: 527084 - DNA, 25 bp, Rattus norvegicus
tctgatgggcctgtgagcccacatc

SEQ ID NO: 527085 - DNA, 25 bp, Rattus norvegicus
tgccagcgccaaatgtaacgcacgc

SEQ ID NO: 527086 - DNA, 25 bp, Rattus norvegicus
attctgatgggcctgtgagcccaca

SEQ ID NO: 527087 - DNA, 25 bp, Rattus norvegicus
cgccaaatgtaacgcacgcgccctg

SEQ ID NO: 527088 - DNA, 25 bp, Rattus norvegicus
ccaaatgtaacgcacgcgccctgtc

SEQ ID NO: 527089 - DNA, 25 bp, Rattus norvegicus
tcaagacccgcgctcaaccaggagc

SEQ ID NO: 527090 - DNA, 25 bp, Rattus norvegicus
cctgaaggcattctgatgggcctgt

SEQ ID NO: 527091 - DNA, 25 bp, Rattus norvegicus
tgaaggcattctgatgggcctgtga

SEQ ID NO: 527092 - DNA, 25 bp, Rattus norvegicus
aaggcattctgatgggcctgtgagc

SEQ ID NO: 527093 - DNA, 25 bp, Rattus norvegicus
aggcattctgatgggcctgtgagcc

SEQ ID NO: 527094 - DNA, 25 bp, Rattus norvegicus
agacccgcgctcaaccaggagctcc

SEQ ID NO: 527095 - DNA, 25 bp, Rattus norvegicus
cctcacctggatagcgggccgtgag

SEQ ID NO: 527096 - DNA, 25 bp, Rattus norvegicus
tcggaagagcgcctcacctggatag

SEQ ID NO: 527097 - DNA, 25 bp, Rattus norvegicus
cgacagctcggctcgggtcggtcct

SEQ ID NO: 527098 - DNA, 25 bp, Rattus norvegicus
ggtcggtcctgtcgcctgtagtccc

SEQ ID NO: 527099 - DNA, 25 bp, Rattus norvegicus
ccactaggtagctccctgccgcgct

SEQ ID NO: 527100 - DNA, 25 bp, Rattus norvegicus
agccagaggagccttttatagtccc

SEQ ID NO: 527101 - DNA, 25 bp, Rattus norvegicus
agctctcgctacgtgcgctcagtca

SEQ ID NO: 527102 - DNA, 25 bp, Rattus norvegicus
caagcccggggtgttccaagcccag

SEQ ID NO: 527103 - DNA, 25 bp, Rattus norvegicus
tgccacgccaccgttaccgtagtta

SEQ ID NO: 527104 - DNA, 25 bp, Rattus norvegicus
ttccttgtaggatttagcgccttca

SEQ ID NO: 527105 - DNA, 25 bp, Rattus norvegicus
ttagcgccttcattttagggtcagc

SEQ ID NO: 527106 - DNA, 25 bp, Rattus norvegicus
cattttagggtcagcggcagttctc

SEQ ID NO: 527107 - DNA, 25 bp, Rattus norvegicus
cggcagttctcagccttcgaagcca

SEQ ID NO: 527108 - DNA, 25 bp, Rattus norvegicus
ccaagatcggaagagcgcctcacct

SEQ ID NO: 527109 - DNA, 25 bp, Rattus norvegicus
tggtgatggtcagctccgtcttcca

SEQ ID NO: 527110 - DNA, 25 bp, Rattus norvegicus
gttgagtcgtggttttatccgtcca

SEQ ID NO: 527111 - DNA, 25 bp, Rattus norvegicus
ggttttatccgtccactcgagctgc

SEQ ID NO: 527112 - DNA, 25 bp, Rattus norvegicus
ttccacgaccggggagagtttgtga

SEQ ID NO: 527113 - DNA, 25 bp, Rattus norvegicus
ccatccctcggcgaggtggtggtga

SEQ ID NO: 527114 - DNA, 25 bp, Rattus norvegicus
ttgcttcctccagtccatccctcgg

SEQ ID NO: 527115 - DNA, 25 bp, Rattus norvegicus
gaatcttttgctttgcttcctccag

SEQ ID NO: 527116 - DNA, 25 bp, Rattus norvegicus
ttgcgacctgaatcttttgctttgc

SEQ ID NO: 527117 - DNA, 25 bp, Rattus norvegicus
aggctttgcgacctgaatcttttgc

SEQ ID NO: 527118 - DNA, 25 bp, Rattus norvegicus
atcggattttgttgagtcgtggttt

SEQ ID NO: 527119 - DNA, 25 bp, Rattus norvegicus
gtccactcgagctgcccgaggcttt

SEQ ID NO: 527120 - DNA, 25 bp, Rattus norvegicus
ccgaggctttgcgacctgaatcttt

SEQ ID NO: 527121 - DNA, 25 bp, Rattus norvegicus
ctgcccgaggctttgcgacctgaat

SEQ ID NO: 527122 - DNA, 25 bp, Rattus norvegicus
cgacctgaatcttttgctttgcttc

SEQ ID NO: 527123 - DNA, 25 bp, Rattus norvegicus
tcaggaaacaccaaagccggttctg

SEQ ID NO: 527124 - DNA, 25 bp, Rattus norvegicus
caactatctgctttgccggccggcg

SEQ ID NO: 527125 - DNA, 25 bp, Rattus norvegicus
agacgacagggaacggcgcgacctt

SEQ ID NO: 527126 - DNA, 25 bp, Rattus norvegicus
agctggggctcccacactgccgata

SEQ ID NO: 527127 - DNA, 25 bp, Rattus norvegicus
gccgtactcaccgagagctggggct

SEQ ID NO: 527128 - DNA, 25 bp, Rattus norvegicus
cttagctaaagcatccggggccgta

SEQ ID NO: 527129 - DNA, 25 bp, Rattus norvegicus
agagatgttcttagttccgcttagc

SEQ ID NO: 527130 - DNA, 25 bp, Rattus norvegicus
cccggcggagagatgttcttagttc

SEQ ID NO: 527131 - DNA, 25 bp, Rattus norvegicus
accaaagccggttctgaccaatgga

SEQ ID NO: 527132 - DNA, 25 bp, Rattus norvegicus
gcgggaagccaactatctgctttgc

SEQ ID NO: 527133 - DNA, 25 bp, Rattus norvegicus
tgacaacggactgggcagccgcaga

SEQ ID NO: 527134 - DNA, 25 bp, Rattus norvegicus
gcgcctgcgcgtgaggactcaagcc

SEQ ID NO: 527135 - DNA, 25 bp, Rattus norvegicus
gaccaatggagggaagtcctgcttc

SEQ ID NO: 527136 - DNA, 25 bp, Rattus norvegicus
cccgagtctggatgcgctcgcagct

SEQ ID NO: 527137 - DNA, 25 bp, Rattus norvegicus
gcccactccgagagacaactgtgga

SEQ ID NO: 527138 - DNA, 25 bp, Rattus norvegicus
ctcagtcacctcgatgcgcgggagt

SEQ ID NO: 527139 - DNA, 25 bp, Rattus norvegicus
ctcaccgccatgtggagggagttta

SEQ ID NO: 527140 - DNA, 25 bp, Rattus norvegicus
agtttaaggttctcactggatccgg

SEQ ID NO: 527141 - DNA, 25 bp, Rattus norvegicus
cctcccgtggcgagtctttactctg

SEQ ID NO: 527142 - DNA, 25 bp, Rattus norvegicus
agaaccttttcttgagatgcacata

SEQ ID NO: 527143 - DNA, 25 bp, Rattus norvegicus
gccactgcgttgaccagttccttga

SEQ ID NO: 527144 - DNA, 25 bp, Rattus norvegicus
agttccttgaagtgttcgcgggcgc

SEQ ID NO: 527145 - DNA, 25 bp, Rattus norvegicus
cgtccctgaagtgttgcaccaattc

SEQ ID NO: 527146 - DNA, 25 bp, Rattus norvegicus
cccgaagagcgtctggatcacagtg

SEQ ID NO: 527147 - DNA, 25 bp, Rattus norvegicus
tggcagcatgcgaacccagctttta

SEQ ID NO: 527148 - DNA, 25 bp, Rattus norvegicus
acttccgctggggactcaatctctg

SEQ ID NO: 527149 - DNA, 25 bp, Rattus norvegicus
ctgccctcgcatggtttcgctggaa

SEQ ID NO: 527150 - DNA, 25 bp, Rattus norvegicus
catacttggtaccatccgcgggatc

SEQ ID NO: 527151 - DNA, 25 bp, Rattus norvegicus
ttctccgcgagctttaggaagggac

SEQ ID NO: 527152 - DNA, 25 bp, Rattus norvegicus
ggctgcggtcgacatacaagatttc

SEQ ID NO: 527153 - DNA, 25 bp, Rattus norvegicus
ggtgaacccagctccagattttctt

SEQ ID NO: 527154 - DNA, 25 bp, Rattus norvegicus
caccgatgtgtgactgacgacgacg

SEQ ID NO: 527155 - DNA, 25 bp, Rattus norvegicus
acgactctggggagcacacttgctt

SEQ ID NO: 527156 - DNA, 25 bp, Rattus norvegicus
caggcatccttctggacgactctgg

SEQ ID NO: 527157 - DNA, 25 bp, Rattus norvegicus
gactgctttcttagccagcgctgga

SEQ ID NO: 527158 - DNA, 25 bp, Rattus norvegicus
acgtttcttctcaacgcctcggcga

SEQ ID NO: 527159 - DNA, 25 bp, Rattus norvegicus
tggctcctctggacgccagactctg

SEQ ID NO: 527160 - DNA, 25 bp, Rattus norvegicus
tgctgggaagcagacacctctcctg

SEQ ID NO: 527161 - DNA, 25 bp, Rattus norvegicus
acaagatttcttgccgtgtgctgcc

SEQ ID NO: 527162 - DNA, 25 bp, Rattus norvegicus
gtgaaagactccagcggccgctcta

SEQ ID NO: 527163 - DNA, 25 bp, Rattus norvegicus
tgcgagcatcatcccgactgctttc

SEQ ID NO: 527164 - DNA, 25 bp, Rattus norvegicus
tgccctctccagaatcaccgatgtg

SEQ ID NO: 527165 - DNA, 25 bp, Rattus norvegicus
aaagctcggaagtgtctagtgtcga

SEQ ID NO: 527166 - DNA, 25 bp, Rattus norvegicus
ggaaatctccactagccctgggtat

SEQ ID NO: 527167 - DNA, 25 bp, Rattus norvegicus
tctccactagccctgggtatcagta

SEQ ID NO: 527168 - DNA, 25 bp, Rattus norvegicus
cactagccctgggtatcagtaagca

SEQ ID NO: 527169 - DNA, 25 bp, Rattus norvegicus
ctagccctgggtatcagtaagcagg

SEQ ID NO: 527170 - DNA, 25 bp, Rattus norvegicus
ctgggtatcagtaagcagggaaagc

SEQ ID NO: 527171 - DNA, 25 bp, Rattus norvegicus
tatcagtaagcagggaaagctcgga

SEQ ID NO: 527172 - DNA, 25 bp, Rattus norvegicus
taagcagggaaagctcggaagtgtc

SEQ ID NO: 527173 - DNA, 25 bp, Rattus norvegicus
cggaagtgtctagtgtcgagttagc

SEQ ID NO: 527174 - DNA, 25 bp, Rattus norvegicus
tgtctagtgtcgagttagcacacga

SEQ ID NO: 527175 - DNA, 25 bp, Rattus norvegicus
ctagtgtcgagttagcacacgaaac

SEQ ID NO: 527176 - DNA, 25 bp, Rattus norvegicus
agtgtcgagttagcacacgaaacaa

SEQ ID NO: 527177 - DNA, 25 bp, Rattus norvegicus
ggaaagctcggaagtgtctagtgtc

SEQ ID NO: 527178 - DNA, 25 bp, Rattus norvegicus
agcagggaaagctcggaagtgtcta

SEQ ID NO: 527179 - DNA, 25 bp, Rattus norvegicus
caggtcaggtaggtaccggacaaga

SEQ ID NO: 527180 - DNA, 25 bp, Rattus norvegicus
ggtcaggtaggtaccggacaagagc

SEQ ID NO: 527181 - DNA, 25 bp, Rattus norvegicus
acaggtcaggtaggtaccggacaag

SEQ ID NO: 527182 - DNA, 25 bp, Rattus norvegicus
gaacaggtcaggtaggtaccggaca

SEQ ID NO: 527183 - DNA, 25 bp, Rattus norvegicus
gtcaggtaggtaccggacaagagcg

SEQ ID NO: 527184 - DNA, 25 bp, Rattus norvegicus
tttacccagcgcgagtcgctcgaga

SEQ ID NO: 527185 - DNA, 25 bp, Rattus norvegicus
agtccggagcgttccttagcgccct

SEQ ID NO: 527186 - DNA, 25 bp, Rattus norvegicus
ccggaggcagttccgcgaccgcaga

SEQ ID NO: 527187 - DNA, 25 bp, Rattus norvegicus
ctgcccatggcagccgttttctcga

SEQ ID NO: 527188 - DNA, 25 bp, Rattus norvegicus
agccgttttctcgaggctccgcctg

SEQ ID NO: 527189 - DNA, 25 bp, Rattus norvegicus
tgcggcccaatttccaggcgaccgt

SEQ ID NO: 527190 - DNA, 25 bp, Rattus norvegicus
caagggaatggctcgcaagacttct

SEQ ID NO: 527191 - DNA, 25 bp, Rattus norvegicus
caagacttctgaggtcagcggccta

SEQ ID NO: 527192 - DNA, 25 bp, Rattus norvegicus
gggcttcagttctcgcgtcttcaaa

SEQ ID NO: 527193 - DNA, 25 bp, Rattus norvegicus
agtcgctcgagatcgctggcctcga

SEQ ID NO: 527194 - DNA, 25 bp, Rattus norvegicus
gggcttaagagcaaatttacccagc

SEQ ID NO: 527195 - DNA, 25 bp, Rattus norvegicus
acctgaggcagaagagggcttaaga

SEQ ID NO: 527196 - DNA, 25 bp, Rattus norvegicus
gccgcgatggactcactggcagcac

SEQ ID NO: 527197 - DNA, 25 bp, Rattus norvegicus
tcgcgtcttcaaaacctgaggcaga

SEQ ID NO: 527198 - DNA, 25 bp, Rattus norvegicus
tggttgccaaggctgttaaccttgg

SEQ ID NO: 527199 - DNA, 25 bp, Rattus norvegicus
tatactaggaagagtgaaatagctc

SEQ ID NO: 527200 - DNA, 25 bp, Rattus norvegicus
ctaggaagagtgaaatagctcagta

SEQ ID NO: 527201 - DNA, 25 bp, Rattus norvegicus
gaagagtgaaatagctcagtaggta

SEQ ID NO: 527202 - DNA, 25 bp, Rattus norvegicus
ctcagtaggtaaagatattggttgc

SEQ ID NO: 527203 - DNA, 25 bp, Rattus norvegicus
cagtaggtaaagatattggttgcca

SEQ ID NO: 527204 - DNA, 25 bp, Rattus norvegicus
gtaaagatattggttgccaaggctg

SEQ ID NO: 527205 - DNA, 25 bp, Rattus norvegicus
aagatattggttgccaaggctgtta

SEQ ID NO: 527206 - DNA, 25 bp, Rattus norvegicus
attggttgccaaggctgttaacctt

SEQ ID NO: 527207 - DNA, 25 bp, Rattus norvegicus
tgccaaggctgttaaccttggtttg

SEQ ID NO: 527208 - DNA, 25 bp, Rattus norvegicus
tggtttggtccttgggacatacaga

SEQ ID NO: 527209 - DNA, 25 bp, Rattus norvegicus
ttggtccttgggacatacagaatgg

SEQ ID NO: 527210 - DNA, 25 bp, Rattus norvegicus
cttggtttggtccttgggacataca

SEQ ID NO: 527211 - DNA, 25 bp, Rattus norvegicus
atattggttgccaaggctgttaacc

SEQ ID NO: 527212 - DNA, 25 bp, Rattus norvegicus
gcactgtagggttataagcatctcg

SEQ ID NO: 527213 - DNA, 25 bp, Rattus norvegicus
cctgctgcactgtagggttataagc

SEQ ID NO: 527214 - DNA, 25 bp, Rattus norvegicus
ctgctgcactgtagggttataagca

SEQ ID NO: 527215 - DNA, 25 bp, Rattus norvegicus
tgctgcactgtagggttataagcat

SEQ ID NO: 527216 - DNA, 25 bp, Rattus norvegicus
tgcactgtagggttataagcatctc

SEQ ID NO: 527217 - DNA, 25 bp, Rattus norvegicus
cactgtagggttataagcatctcgg

SEQ ID NO: 527218 - DNA, 25 bp, Rattus norvegicus
actgtagggttataagcatctcggc

SEQ ID NO: 527219 - DNA, 25 bp, Rattus norvegicus
ctgtagggttataagcatctcggcg

SEQ ID NO: 527220 - DNA, 25 bp, Rattus norvegicus
tgtagggttataagcatctcggcgg

SEQ ID NO: 527221 - DNA, 25 bp, Rattus norvegicus
gtagggttataagcatctcggcgga

SEQ ID NO: 527222 - DNA, 25 bp, Rattus norvegicus
tagggttataagcatctcggcggac

SEQ ID NO: 527223 - DNA, 25 bp, Rattus norvegicus
agggttataagcatctcggcggact

SEQ ID NO: 527224 - DNA, 25 bp, Rattus norvegicus
ctgcactgtagggttataagcatct

SEQ ID NO: 527225 - DNA, 25 bp, Rattus norvegicus
gtctggttaatggatattgctgtta

SEQ ID NO: 527226 - DNA, 25 bp, Rattus norvegicus
gctacatatgtagggtaccagacca

SEQ ID NO: 527227 - DNA, 25 bp, Rattus norvegicus
ccctgaggggtctggttaatggata

SEQ ID NO: 527228 - DNA, 25 bp, Rattus norvegicus
ggatattgctgttaattacagtctc

SEQ ID NO: 527229 - DNA, 25 bp, Rattus norvegicus
aatctatggttggtggttagggcca

SEQ ID NO: 527230 - DNA, 25 bp, Rattus norvegicus
ccagaccatgtataatctatggttg

SEQ ID NO: 527231 - DNA, 25 bp, Rattus norvegicus
ggtaccagaccatgtataatctatg

SEQ ID NO: 527232 - DNA, 25 bp, Rattus norvegicus
gctgttaattacagtctccttcagc

SEQ ID NO: 527233 - DNA, 25 bp, Rattus norvegicus
gtagggtaccagaccatgtataatc

SEQ ID NO: 527234 - DNA, 25 bp, Rattus norvegicus
catatgtagggtaccagaccatgta

SEQ ID NO: 527235 - DNA, 25 bp, Rattus norvegicus
ctgatgtgagatggggccatcctct

SEQ ID NO: 527236 - DNA, 25 bp, Rattus norvegicus
ccactgatgtgagatggggccatcc

SEQ ID NO: 527237 - DNA, 25 bp, Rattus norvegicus
cccttccactgatgtgagatggggc

SEQ ID NO: 527238 - DNA, 25 bp, Rattus norvegicus
ctctgctacatatgtagggtaccag

SEQ ID NO: 527239 - DNA, 25 bp, Rattus norvegicus
agttgcctggccagaagtcttggga

SEQ ID NO: 527240 - DNA, 25 bp, Rattus norvegicus
cgtgatatttctgaaatattgaata

SEQ ID NO: 527241 - DNA, 25 bp, Rattus norvegicus
tgaatatgataaacaatggaaagta

SEQ ID NO: 527242 - DNA, 25 bp, Rattus norvegicus
tcgtatgcagttgcctggccagaag

SEQ ID NO: 527243 - DNA, 25 bp, Rattus norvegicus
gtatgcagttgcctggccagaagtc

SEQ ID NO: 527244 - DNA, 25 bp, Rattus norvegicus
cagttgcctggccagaagtcttggg

SEQ ID NO: 527245 - DNA, 25 bp, Rattus norvegicus
ttgcctggccagaagtcttgggatg

SEQ ID NO: 527246 - DNA, 25 bp, Rattus norvegicus
tgcctggccagaagtcttgggatgc

SEQ ID NO: 527247 - DNA, 25 bp, Rattus norvegicus
cctggccagaagtcttgggatgctt

SEQ ID NO: 527248 - DNA, 25 bp, Rattus norvegicus
tggccagaagtcttgggatgctttc

SEQ ID NO: 527249 - DNA, 25 bp, Rattus norvegicus
gccagaagtcttgggatgctttcaa

SEQ ID NO: 527250 - DNA, 25 bp, Rattus norvegicus
ttgcgttacaagcttgcttgtaaat

SEQ ID NO: 527251 - DNA, 25 bp, Rattus norvegicus
ggccagaagtcttgggatgctttca

SEQ ID NO: 527252 - DNA, 25 bp, Rattus norvegicus
atgcagttgcctggccagaagtctt

SEQ ID NO: 527253 - DNA, 25 bp, Rattus norvegicus
tcctgattgcggctgtttctcctag

SEQ ID NO: 527254 - DNA, 25 bp, Rattus norvegicus
gcaccccggggacggtctcagcgaa

SEQ ID NO: 527255 - DNA, 25 bp, Rattus norvegicus
ggggccgcgcacagccctcgggtgg

SEQ ID NO: 527256 - DNA, 25 bp, Rattus norvegicus
gaccgcgggaatgtctcctgattgc

SEQ ID NO: 527257 - DNA, 25 bp, Rattus norvegicus
tgggccatggctctcggcgccgcca

SEQ ID NO: 527258 - DNA, 25 bp, Rattus norvegicus
actgcaccggggagtgggccatggc

SEQ ID NO: 527259 - DNA, 25 bp, Rattus norvegicus
aatgtctcctgattgcggctgtttc

SEQ ID NO: 527260 - DNA, 25 bp, Rattus norvegicus
ctgattgcggctgtttctcctaggc

SEQ ID NO: 527261 - DNA, 25 bp, Rattus norvegicus
tgtctcctgattgcggctgtttctc

SEQ ID NO: 527262 - DNA, 25 bp, Rattus norvegicus
gtctcagcgaaggttggcgggccgc

SEQ ID NO: 527263 - DNA, 25 bp, Rattus norvegicus
cgccgcggtgctcggttcgagccgg

SEQ ID NO: 527264 - DNA, 25 bp, Rattus norvegicus
gattgcggctgtttctcctaggctc

SEQ ID NO: 527265 - DNA, 25 bp, Rattus norvegicus
accgcgggaatgtctcctgattgcg

SEQ ID NO: 527266 - DNA, 25 bp, Rattus norvegicus
gggaatgtctcctgattgcggctgt

SEQ ID NO: 527267 - DNA, 25 bp, Rattus norvegicus
tacgcaacatgctgatccgcacgca

SEQ ID NO: 527268 - DNA, 25 bp, Rattus norvegicus
gcacgcacatgcacgacctcaaaga

SEQ ID NO: 527269 - DNA, 25 bp, Rattus norvegicus
cacgacctcaaagacgtgacgtgcg

SEQ ID NO: 527270 - DNA, 25 bp, Rattus norvegicus
gccgttatcggcagcaacactgtgg

SEQ ID NO: 527271 - DNA, 25 bp, Rattus norvegicus
tgctgatccgcacgcacatgcacga

SEQ ID NO: 527272 - DNA, 25 bp, Rattus norvegicus
ttcgtgaagctacgcaacatgctga

SEQ ID NO: 527273 - DNA, 25 bp, Rattus norvegicus
cgcactgcgatttcgtgaagctacg

SEQ ID NO: 527274 - DNA, 25 bp, Rattus norvegicus
caggcgcactgcgatttcgtgaagc

SEQ ID NO: 527275 - DNA, 25 bp, Rattus norvegicus
cccgcagtggagaatcaggcgcact

SEQ ID NO: 527276 - DNA, 25 bp, Rattus norvegicus
ggcttctgcccgcagtggagaatca

SEQ ID NO: 527277 - DNA, 25 bp, Rattus norvegicus
taggctgacacctactcactgccgg

SEQ ID NO: 527278 - DNA, 25 bp, Rattus norvegicus
ggaggctcccgtaggctgacaccta

SEQ ID NO: 527279 - DNA, 25 bp, Rattus norvegicus
gatcgtcgaaggtgagacagaggca

SEQ ID NO: 527280 - DNA, 25 bp, Rattus norvegicus
cagcaacactgtggtggaggccaag

SEQ ID NO: 527281 - DNA, 25 bp, Rattus norvegicus
ccggaattgtccacattcgcgggaa

SEQ ID NO: 527282 - DNA, 25 bp, Rattus norvegicus
attgtccacattcgcgggaaagaga

SEQ ID NO: 527283 - DNA, 25 bp, Rattus norvegicus
gaccaggccactgcccggtgcagat

SEQ ID NO: 527284 - DNA, 25 bp, Rattus norvegicus
tttcctgagatcactcgagatttcc

SEQ ID NO: 527285 - DNA, 25 bp, Rattus norvegicus
gaattgtccacattcgcgggaaaga

SEQ ID NO: 527286 - DNA, 25 bp, Rattus norvegicus
cggaattgtccacattcgcgggaaa

SEQ ID NO: 527287 - DNA, 25 bp, Rattus norvegicus
ggaattgtccacattcgcgggaaag

SEQ ID NO: 527288 - DNA, 25 bp, Rattus norvegicus
tgccctttccattaattttgctact

SEQ ID NO: 527289 - DNA, 25 bp, Rattus norvegicus
ctttccattaattttgctacttcag

SEQ ID NO: 527290 - DNA, 25 bp, Rattus norvegicus
cctttccattaattttgctacttca

SEQ ID NO: 527291 - DNA, 25 bp, Rattus norvegicus
tccattaattttgctacttcaggag

SEQ ID NO: 527292 - DNA, 25 bp, Rattus norvegicus
ttgccctttccattaattttgctac

SEQ ID NO: 527293 - DNA, 25 bp, Rattus norvegicus
tttgccctttccattaattttgcta

SEQ ID NO: 527294 - DNA, 25 bp, Rattus norvegicus
ttccattaattttgctacttcagga

SEQ ID NO: 527295 - DNA, 25 bp, Rattus norvegicus
tttccattaattttgctacttcagg

SEQ ID NO: 527296 - DNA, 25 bp, Rattus norvegicus
taattttgctacttcaggagtcact

SEQ ID NO: 527297 - DNA, 25 bp, Rattus norvegicus
ttaattttgctacttcaggagtcac

SEQ ID NO: 527298 - DNA, 25 bp, Rattus norvegicus
attaattttgctacttcaggagtca

SEQ ID NO: 527299 - DNA, 25 bp, Rattus norvegicus
cattaattttgctacttcaggagtc

SEQ ID NO: 527300 - DNA, 25 bp, Rattus norvegicus
aattttgctacttcaggagtcactt

SEQ ID NO: 527301 - DNA, 25 bp, Rattus norvegicus
ccattaattttgctacttcaggagt

SEQ ID NO: 527302 - DNA, 25 bp, Rattus norvegicus
tttcacccgagacggtcatcgcgcc

SEQ ID NO: 527303 - DNA, 25 bp, Rattus norvegicus
tcacccgagacggtcatcgcgcctc

SEQ ID NO: 527304 - DNA, 25 bp, Rattus norvegicus
tcttcccgtgcagcagggacaggca

SEQ ID NO: 527305 - DNA, 25 bp, Rattus norvegicus
cttcccgtgcagcagggacaggcag

SEQ ID NO: 527306 - DNA, 25 bp, Rattus norvegicus
tgcagcagggacaggcaggggagct

SEQ ID NO: 527307 - DNA, 25 bp, Rattus norvegicus
acaggcaggggagctggtgccgttt

SEQ ID NO: 527308 - DNA, 25 bp, Rattus norvegicus
cccacctgagctttcgtggcctggg

SEQ ID NO: 527309 - DNA, 25 bp, Rattus norvegicus
ccacctgagctttcgtggcctgggg

SEQ ID NO: 527310 - DNA, 25 bp, Rattus norvegicus
cgagaggggctgtttcacccgagac

SEQ ID NO: 527311 - DNA, 25 bp, Rattus norvegicus
ggggctgtttcacccgagacggtca

SEQ ID NO: 527312 - DNA, 25 bp, Rattus norvegicus
gctgtttcacccgagacggtcatcg

SEQ ID NO: 527313 - DNA, 25 bp, Rattus norvegicus
tgtttcacccgagacggtcatcgcg

SEQ ID NO: 527314 - DNA, 25 bp, Rattus norvegicus
gtttcacccgagacggtcatcgcgc

SEQ ID NO: 527315 - DNA, 25 bp, Rattus norvegicus
ctgtttcacccgagacggtcatcgc

SEQ ID NO: 527316 - DNA, 25 bp, Rattus norvegicus
agaagctactgctaagtactgccag

SEQ ID NO: 527317 - DNA, 25 bp, Rattus norvegicus
taactggacaccttagaagctactg

SEQ ID NO: 527318 - DNA, 25 bp, Rattus norvegicus
tggacaccttagaagctactgctaa

SEQ ID NO: 527319 - DNA, 25 bp, Rattus norvegicus
ggacaccttagaagctactgctaag

SEQ ID NO: 527320 - DNA, 25 bp, Rattus norvegicus
acaccttagaagctactgctaagta

SEQ ID NO: 527321 - DNA, 25 bp, Rattus norvegicus
ccttagaagctactgctaagtactg

SEQ ID NO: 527322 - DNA, 25 bp, Rattus norvegicus
gaagctactgctaagtactgccagc

SEQ ID NO: 527323 - DNA, 25 bp, Rattus norvegicus
agctactgctaagtactgccagctt

SEQ ID NO: 527324 - DNA, 25 bp, Rattus norvegicus
gctactgctaagtactgccagcttc

SEQ ID NO: 527325 - DNA, 25 bp, Rattus norvegicus
cccaccttgagtctccggagcaggc

SEQ ID NO: 527326 - DNA, 25 bp, Rattus norvegicus
cttgagtctccggagcaggccactg

SEQ ID NO: 527327 - DNA, 25 bp, Rattus norvegicus
gagtctccggagcaggccactgtgc

SEQ ID NO: 527328 - DNA, 25 bp, Rattus norvegicus
tagaagctactgctaagtactgcca

SEQ ID NO: 527329 - DNA, 25 bp, Rattus norvegicus
ttagaagctactgctaagtactgcc

SEQ ID NO: 527330 - DNA, 25 bp, Rattus norvegicus
ttccttacgccatatttccggagcc

SEQ ID NO: 527331 - DNA, 25 bp, Rattus norvegicus
gcgcggtgaccgaccctggcgacag

SEQ ID NO: 527332 - DNA, 25 bp, Rattus norvegicus
cggtgaccgaccctggcgacagggc

SEQ ID NO: 527333 - DNA, 25 bp, Rattus norvegicus
cttccttacgccatatttccggagc

SEQ ID NO: 527334 - DNA, 25 bp, Rattus norvegicus
tccttacgccatatttccggagcca

SEQ ID NO: 527335 - DNA, 25 bp, Rattus norvegicus
cttacgccatatttccggagccacg

SEQ ID NO: 527336 - DNA, 25 bp, Rattus norvegicus
agtcgcatcagctcacggacgctgt

SEQ ID NO: 527337 - DNA, 25 bp, Rattus norvegicus
gtcgcatcagctcacggacgctgtg

SEQ ID NO: 527338 - DNA, 25 bp, Rattus norvegicus
tcgcatcagctcacggacgctgtgg

SEQ ID NO: 527339 - DNA, 25 bp, Rattus norvegicus
cgcatcagctcacggacgctgtggc

SEQ ID NO: 527340 - DNA, 25 bp, Rattus norvegicus
catcagctcacggacgctgtggcat

SEQ ID NO: 527341 - DNA, 25 bp, Rattus norvegicus
atcagctcacggacgctgtggcatc

SEQ ID NO: 527342 - DNA, 25 bp, Rattus norvegicus
tcagctcacggacgctgtggcatcc

SEQ ID NO: 527343 - DNA, 25 bp, Rattus norvegicus
tcttccttacgccatatttccggag

SEQ ID NO: 527344 - DNA, 25 bp, Rattus norvegicus
gagccacatcagaaggtgtcctagt

SEQ ID NO: 527345 - DNA, 25 bp, Rattus norvegicus
ttccctcccgacactacagaattgg

SEQ ID NO: 527346 - DNA, 25 bp, Rattus norvegicus
gcactcctactgagtcgcctgcgga

SEQ ID NO: 527347 - DNA, 25 bp, Rattus norvegicus
gactgtcgcttattgccgctgcgcg

SEQ ID NO: 527348 - DNA, 25 bp, Rattus norvegicus
ctccagaacgaagtaggcctccatc

SEQ ID NO: 527349 - DNA, 25 bp, Rattus norvegicus
ggtgctgaccgacaacaacctgacg

SEQ ID NO: 527350 - DNA, 25 bp, Rattus norvegicus
cgggcccaggagatagtaccctatc

SEQ ID NO: 527351 - DNA, 25 bp, Rattus norvegicus
ggcgttcccaaagatgctcccggct

SEQ ID NO: 527352 - DNA, 25 bp, Rattus norvegicus
gaaactacagtcagcgctcagggtg

SEQ ID NO: 527353 - DNA, 25 bp, Rattus norvegicus
gtgtcctagtatgggcagcaaaaga

SEQ ID NO: 527354 - DNA, 25 bp, Rattus norvegicus
tgcactttatgggaagagccacatc

SEQ ID NO: 527355 - DNA, 25 bp, Rattus norvegicus
ccaggcggcagaactgtggtctgtt

SEQ ID NO: 527356 - DNA, 25 bp, Rattus norvegicus
cggagttatttctggccaggcggca

SEQ ID NO: 527357 - DNA, 25 bp, Rattus norvegicus
taacccatggcgctgcgactgtcgc

SEQ ID NO: 527358 - DNA, 25 bp, Rattus norvegicus
cctcagtaaaccatccagtagcgaa

SEQ ID NO: 527359 - DNA, 25 bp, Rattus norvegicus
cgccatggctgtgggcccaccccgg

SEQ ID NO: 527360 - DNA, 25 bp, Rattus norvegicus
gcctcagtaaaccatccagtagcga

SEQ ID NO: 527361 - DNA, 25 bp, Rattus norvegicus
taaaccatccagtagcgaagggcgg

SEQ ID NO: 527362 - DNA, 25 bp, Rattus norvegicus
cagtaaaccatccagtagcgaaggg

SEQ ID NO: 527363 - DNA, 25 bp, Rattus norvegicus
gtaaaccatccagtagcgaagggcg

SEQ ID NO: 527364 - DNA, 25 bp, Rattus norvegicus
agtaaaccatccagtagcgaagggc

SEQ ID NO: 527365 - DNA, 25 bp, Rattus norvegicus
ggcctcagtaaaccatccagtagcg

SEQ ID NO: 527366 - DNA, 25 bp, Rattus norvegicus
gggcctcagtaaaccatccagtagc

SEQ ID NO: 527367 - DNA, 25 bp, Rattus norvegicus
tcagtaaaccatccagtagcgaagg

SEQ ID NO: 527368 - DNA, 25 bp, Rattus norvegicus
gagggcctcagtaaaccatccagta

SEQ ID NO: 527369 - DNA, 25 bp, Rattus norvegicus
ctcagtaaaccatccagtagcgaag

SEQ ID NO: 527370 - DNA, 25 bp, Rattus norvegicus
gcaagcttatgacccccgcacctac

SEQ ID NO: 527371 - DNA, 25 bp, Rattus norvegicus
agggcctcagtaaaccatccagtag

SEQ ID NO: 527372 - DNA, 25 bp, Rattus norvegicus
ttttccaggcagctgttacggaggc

SEQ ID NO: 527373 - DNA, 25 bp, Rattus norvegicus
gctttcggtatcctgtggaaaagtc

SEQ ID NO: 527374 - DNA, 25 bp, Rattus norvegicus
actctgccgagttacctggctttcg

SEQ ID NO: 527375 - DNA, 25 bp, Rattus norvegicus
gtaaagccgcggagaactctgccga

SEQ ID NO: 527376 - DNA, 25 bp, Rattus norvegicus
ttagactcctagaagtaaagccgcg

SEQ ID NO: 527377 - DNA, 25 bp, Rattus norvegicus
cggttcacggagaggagattagact

SEQ ID NO: 527378 - DNA, 25 bp, Rattus norvegicus
ggtgcctcctttcggttcacggaga

SEQ ID NO: 527379 - DNA, 25 bp, Rattus norvegicus
ccagaaggtactgggtgcctccttt

SEQ ID NO: 527380 - DNA, 25 bp, Rattus norvegicus
acatgtccggcactgcaggctgtca

SEQ ID NO: 527381 - DNA, 25 bp, Rattus norvegicus
caccgtgaccgcaggggacagacat

SEQ ID NO: 527382 - DNA, 25 bp, Rattus norvegicus
cgagggacttgaatcggttttccag

SEQ ID NO: 527383 - DNA, 25 bp, Rattus norvegicus
gacttgtccggctcttatttcggta

SEQ ID NO: 527384 - DNA, 25 bp, Rattus norvegicus
acctggctttcggtatcctgtggaa

SEQ ID NO: 527385 - DNA, 25 bp, Rattus norvegicus
ggggacagacatgtccggcactgca

SEQ ID NO: 527386 - DNA, 25 bp, Rattus norvegicus
ggcaggaggcatttctacaatctaa

SEQ ID NO: 527387 - DNA, 25 bp, Rattus norvegicus
gtaaacggcaggaggcatttctaca

SEQ ID NO: 527388 - DNA, 25 bp, Rattus norvegicus
ggaggcatttctacaatctaattgg

SEQ ID NO: 527389 - DNA, 25 bp, Rattus norvegicus
gtctgtaaacggcaggaggcatttc

SEQ ID NO: 527390 - DNA, 25 bp, Rattus norvegicus
aacggcaggaggcatttctacaatc

SEQ ID NO: 527391 - DNA, 25 bp, Rattus norvegicus
aggcatttctacaatctaattgggg

SEQ ID NO: 527392 - DNA, 25 bp, Rattus norvegicus
ctgtaaacggcaggaggcatttcta

SEQ ID NO: 527393 - DNA, 25 bp, Rattus norvegicus
cgagactgccccgtgattacctcga

SEQ ID NO: 527394 - DNA, 25 bp, Rattus norvegicus
ctttttccaagcaagagtgattgta

SEQ ID NO: 527395 - DNA, 25 bp, Rattus norvegicus
ttccaagcaagagtgattgtagata

SEQ ID NO: 527396 - DNA, 25 bp, Rattus norvegicus
gcaagagtgattgtagatatgtctg

SEQ ID NO: 527397 - DNA, 25 bp, Rattus norvegicus
gattgtagatatgtctgtaaacggc

SEQ ID NO: 527398 - DNA, 25 bp, Rattus norvegicus
gtagatatgtctgtaaacggcagga

SEQ ID NO: 527399 - DNA, 25 bp, Rattus norvegicus
cggcaggaggcatttctacaatcta

SEQ ID NO: 527400 - DNA, 25 bp, Rattus norvegicus
cgagacttgagtggggggctccctt

SEQ ID NO: 527401 - DNA, 25 bp, Rattus norvegicus
tacaataaatcttcctcgtgtgatt

SEQ ID NO: 527402 - DNA, 25 bp, Rattus norvegicus
ggcctgagctctcgtttcatctcgc

SEQ ID NO: 527403 - DNA, 25 bp, Rattus norvegicus
tggcctgagctctcgtttcatctcg

SEQ ID NO: 527404 - DNA, 25 bp, Rattus norvegicus
ctggcctgagctctcgtttcatctc

SEQ ID NO: 527405 - DNA, 25 bp, Rattus norvegicus
agcaggtcggtgtctgtgtcctact

SEQ ID NO: 527406 - DNA, 25 bp, Rattus norvegicus
tgctggcctgagctctcgtttcatc

SEQ ID NO: 527407 - DNA, 25 bp, Rattus norvegicus
caggtcggtgtctgtgtcctactgg

SEQ ID NO: 527408 - DNA, 25 bp, Rattus norvegicus
tactgggtgcgcgtctttcccgaga

SEQ ID NO: 527409 - DNA, 25 bp, Rattus norvegicus
tgggtgcgcgtctttcccgagactt

SEQ ID NO: 527410 - DNA, 25 bp, Rattus norvegicus
ggtgcgcgtctttcccgagacttga

SEQ ID NO: 527411 - DNA, 25 bp, Rattus norvegicus
cagcaggtcggtgtctgtgtcctac

SEQ ID NO: 527412 - DNA, 25 bp, Rattus norvegicus
gcatgctggcctgagctctcgtttc

SEQ ID NO: 527413 - DNA, 25 bp, Rattus norvegicus
catgctggcctgagctctcgtttca

SEQ ID NO: 527414 - DNA, 25 bp, Rattus norvegicus
cctctgaaaatacaccgccgatttc

SEQ ID NO: 527415 - DNA, 25 bp, Rattus norvegicus
ttaccctctgaaaatacaccgccga

SEQ ID NO: 527416 - DNA, 25 bp, Rattus norvegicus
taccctctgaaaatacaccgccgat

SEQ ID NO: 527417 - DNA, 25 bp, Rattus norvegicus
accctctgaaaatacaccgccgatt

SEQ ID NO: 527418 - DNA, 25 bp, Rattus norvegicus
ctctgaaaatacaccgccgatttcc

SEQ ID NO: 527419 - DNA, 25 bp, Rattus norvegicus
tctgaaaatacaccgccgatttccc

SEQ ID NO: 527420 - DNA, 25 bp, Rattus norvegicus
ctgtgcagaccttactactgcctcg

SEQ ID NO: 527421 - DNA, 25 bp, Rattus norvegicus
cccgaaagatggtgaactatgcctg

SEQ ID NO: 527422 - DNA, 25 bp, Rattus norvegicus
gggccacttttggtaagcagaactg

SEQ ID NO: 527423 - DNA, 25 bp, Rattus norvegicus
ctagtagctggttccctccgaagtt

SEQ ID NO: 527424 - DNA, 25 bp, Rattus norvegicus
atgcgagtgcctagtgggccacttt

SEQ ID NO: 527425 - DNA, 25 bp, Rattus norvegicus
taaatgggtaagaagcccggctcgc

SEQ ID NO: 527426 - DNA, 25 bp, Rattus norvegicus
tcttggggccgaaacgatctcaacc

SEQ ID NO: 527427 - DNA, 25 bp, Rattus norvegicus
ggtcgctcgacaacccgcagtttta

SEQ ID NO: 527428 - DNA, 25 bp, Rattus norvegicus
agcggtcctgacgtgcaaatcggtc

SEQ ID NO: 527429 - DNA, 25 bp, Rattus norvegicus
cgtacgcgttaggacccgaaagatg

SEQ ID NO: 527430 - DNA, 25 bp, Rattus norvegicus
acggaccaaggagtctaacgcgtgc

SEQ ID NO: 527431 - DNA, 25 bp, Rattus norvegicus
tccgctaaggagtgtgtaacaactc

SEQ ID NO: 527432 - DNA, 25 bp, Rattus norvegicus
tggccatggaagtcggaatccgcta

SEQ ID NO: 527433 - DNA, 25 bp, Rattus norvegicus
ggcgaaagactaatcgaaccatcta

SEQ ID NO: 527434 - DNA, 25 bp, Rattus norvegicus
ttccctcaggatagctggcgctctc

SEQ ID NO: 527435 - DNA, 25 bp, Rattus norvegicus
cagccagcgggaccatagacacttt

SEQ ID NO: 527436 - DNA, 25 bp, Rattus norvegicus
ccagccagcgggaccatagacactt

SEQ ID NO: 527437 - DNA, 25 bp, Rattus norvegicus
gccagcgggaccatagacacttttg

SEQ ID NO: 527438 - DNA, 25 bp, Rattus norvegicus
agcgggaccatagacacttttgagg

SEQ ID NO: 527439 - DNA, 25 bp, Rattus norvegicus
cgggaccatagacacttttgaggcc

SEQ ID NO: 527440 - DNA, 25 bp, Rattus norvegicus
ggaccatagacacttttgaggccga

SEQ ID NO: 527441 - DNA, 25 bp, Rattus norvegicus
catagacacttttgaggccgagagg

SEQ ID NO: 527442 - DNA, 25 bp, Rattus norvegicus
agccagcgggaccatagacactttt

SEQ ID NO: 527443 - DNA, 25 bp, Rattus norvegicus
ccagcgggaccatagacacttttga

SEQ ID NO: 527444 - DNA, 25 bp, Rattus norvegicus
cagcgggaccatagacacttttgag

SEQ ID NO: 527445 - DNA, 25 bp, Rattus norvegicus
gggaccatagacacttttgaggccg

SEQ ID NO: 527446 - DNA, 25 bp, Rattus norvegicus
accatagacacttttgaggccgaga

SEQ ID NO: 527447 - DNA, 25 bp, Rattus norvegicus
tagacacttttgaggccgagagggt

SEQ ID NO: 527448 - DNA, 25 bp, Rattus norvegicus
cggtcccagccagcgggaccataga

SEQ ID NO: 527449 - DNA, 25 bp, Rattus norvegicus
gtcgcggtgctctctcgtgcgacgg

SEQ ID NO: 527450 - DNA, 25 bp, Rattus norvegicus
cgtgcgacggggtgcctctgcgcgc

SEQ ID NO: 527451 - DNA, 25 bp, Rattus norvegicus
gtgtcgggggaggaagaggcgagtc

SEQ ID NO: 527452 - DNA, 25 bp, Rattus norvegicus
gaagaggcgagtcggtcgtgggacc

SEQ ID NO: 527453 - DNA, 25 bp, Rattus norvegicus
agaggcgagtcggtcgtgggaccgg

SEQ ID NO: 527454 - DNA, 25 bp, Rattus norvegicus
aggcgagtcggtcgtgggaccggcg

SEQ ID NO: 527455 - DNA, 25 bp, Rattus norvegicus
agtcggtcgtgggaccggcgcggcg

SEQ ID NO: 527456 - DNA, 25 bp, Rattus norvegicus
cggtcgcggtgctctctcgtgcgac

SEQ ID NO: 527457 - DNA, 25 bp, Rattus norvegicus
ggtcgcggtgctctctcgtgcgacg

SEQ ID NO: 527458 - DNA, 25 bp, Rattus norvegicus
tcgcggtgctctctcgtgcgacggg

SEQ ID NO: 527459 - DNA, 25 bp, Rattus norvegicus
ctctctcgtgcgacggggtgcctct

SEQ ID NO: 527460 - DNA, 25 bp, Rattus norvegicus
gctctctcgtgcgacggggtgcctc

SEQ ID NO: 527461 - DNA, 25 bp, Rattus norvegicus
ctctcgtgcgacggggtgcctctgc

SEQ ID NO: 527462 - DNA, 25 bp, Rattus norvegicus
tctctcgtgcgacggggtgcctctg

SEQ ID NO: 527463 - DNA, 25 bp, Rattus norvegicus
gcaacccaatcttggagtgcgctcc

SEQ ID NO: 527464 - DNA, 25 bp, Rattus norvegicus
cctcagcgccaagggtcagagatta

SEQ ID NO: 527465 - DNA, 25 bp, Rattus norvegicus
gacggtacctactttcttggctcca

SEQ ID NO: 527466 - DNA, 25 bp, Rattus norvegicus
actttcttggctccagccggagggc

SEQ ID NO: 527467 - DNA, 25 bp, Rattus norvegicus
ggagggcagcatcggcaagccaaac

SEQ ID NO: 527468 - DNA, 25 bp, Rattus norvegicus
cggcaagccaaacgccaagagcagc

SEQ ID NO: 527469 - DNA, 25 bp, Rattus norvegicus
tcgccatgagcttgggcgacgagtt

SEQ ID NO: 527470 - DNA, 25 bp, Rattus norvegicus
ggtggcgccaaggacaggacttccc

SEQ ID NO: 527471 - DNA, 25 bp, Rattus norvegicus
gggctccaattcctaccgcatcttg

SEQ ID NO: 527472 - DNA, 25 bp, Rattus norvegicus
cctaccgcatcttgggtcgaggagg

SEQ ID NO: 527473 - DNA, 25 bp, Rattus norvegicus
aggagggcacctgcgacccaggacc

SEQ ID NO: 527474 - DNA, 25 bp, Rattus norvegicus
tgcgacccaggacctggggaccaga

SEQ ID NO: 527475 - DNA, 25 bp, Rattus norvegicus
cagagacccgcaacccaatcttgga

SEQ ID NO: 527476 - DNA, 25 bp, Rattus norvegicus
gccaagggtcagagattaaagatta

SEQ ID NO: 527477 - DNA, 25 bp, Rattus norvegicus
ggatttaactttgcagccgcgccgc

SEQ ID NO: 527478 - DNA, 25 bp, Rattus norvegicus
ccctgacggtgagacgagaaactgc

SEQ ID NO: 527479 - DNA, 25 bp, Rattus norvegicus
gccgctcgttgaccttgcgtttctc

SEQ ID NO: 527480 - DNA, 25 bp, Rattus norvegicus
cacccgaaacttgtgggagggactg

SEQ ID NO: 527481 - DNA, 25 bp, Rattus norvegicus
ggcgcatctgaccaatagggattta

SEQ ID NO: 527482 - DNA, 25 bp, Rattus norvegicus
gcagctctggcgcatctgaccaata

SEQ ID NO: 527483 - DNA, 25 bp, Rattus norvegicus
aagcccggcctagaatgagcggacg

SEQ ID NO: 527484 - DNA, 25 bp, Rattus norvegicus
taagaacgcctagcaggctgcgggc

SEQ ID NO: 527485 - DNA, 25 bp, Rattus norvegicus
ggcgcggcgcctttaagaacgccta

SEQ ID NO: 527486 - DNA, 25 bp, Rattus norvegicus
gcgtttctctctctgagtgacaaca

SEQ ID NO: 527487 - DNA, 25 bp, Rattus norvegicus
aaagagcagccttctgagagtctga

SEQ ID NO: 527488 - DNA, 25 bp, Rattus norvegicus
ttcccaggcaggtctgcaaagagca

SEQ ID NO: 527489 - DNA, 25 bp, Rattus norvegicus
actggagcaggtgcaaccgctgtcc

SEQ ID NO: 527490 - DNA, 25 bp, Rattus norvegicus
gacgagaaactgcacccgaaacttg

SEQ ID NO: 527491 - DNA, 25 bp, Rattus norvegicus
tccggccaaccacctatgtagacag

SEQ ID NO: 527492 - DNA, 25 bp, Rattus norvegicus
ggctccggcgaaggtcgaactccca

SEQ ID NO: 527493 - DNA, 25 bp, Rattus norvegicus
cgcagcgcctacttctggctgggta

SEQ ID NO: 527494 - DNA, 25 bp, Rattus norvegicus
gggtacccagaatggctcggtttca

SEQ ID NO: 527495 - DNA, 25 bp, Rattus norvegicus
gcacgctctatctgcaagacccaga

SEQ ID NO: 527496 - DNA, 25 bp, Rattus norvegicus
tgtagacagaatgacgacggagcgc

SEQ ID NO: 527497 - DNA, 25 bp, Rattus norvegicus
tggctgggtacagcgtttgcacacg

SEQ ID NO: 527498 - DNA, 25 bp, Rattus norvegicus
acacgcggcgcttgtgttagggatt

SEQ ID NO: 527499 - DNA, 25 bp, Rattus norvegicus
tgttagggattgtatgtgcacgctc

SEQ ID NO: 527500 - DNA, 25 bp, Rattus norvegicus
tagcggctgaagaccagggtcattc

SEQ ID NO: 527501 - DNA, 25 bp, Rattus norvegicus
agcgcgctccgcagtacaacttacg

SEQ ID NO: 527502 - DNA, 25 bp, Rattus norvegicus
ccagattttgatggaacagagagcc

SEQ ID NO: 527503 - DNA, 25 bp, Rattus norvegicus
ccagctactgtgaggcacggttctc

SEQ ID NO: 527504 - DNA, 25 bp, Rattus norvegicus
gagagtctcccgatctgcctttgtc

SEQ ID NO: 527505 - DNA, 25 bp, Rattus norvegicus
actatgggcagcgaccactgcggca

SEQ ID NO: 527506 - DNA, 25 bp, Rattus norvegicus
ggtcgcctgttcgaggaactagaca

SEQ ID NO: 527507 - DNA, 25 bp, Rattus norvegicus
gtggactgcagagccggacgctttc

SEQ ID NO: 527508 - DNA, 25 bp, Rattus norvegicus
tgtgcaccattcgaacggtgacccg

SEQ ID NO: 527509 - DNA, 25 bp, Rattus norvegicus
tccgcttctctgtgcaccattcgaa

SEQ ID NO: 527510 - DNA, 25 bp, Rattus norvegicus
actagacagcaacaaggacggccgc

SEQ ID NO: 527511 - DNA, 25 bp, Rattus norvegicus
ccgtgcacagcaggtactatgggca

SEQ ID NO: 527512 - DNA, 25 bp, Rattus norvegicus
cgcgagacgagactgccaaggctcc

SEQ ID NO: 527513 - DNA, 25 bp, Rattus norvegicus
cagagtccgcccgtgccgtaacggg

SEQ ID NO: 527514 - DNA, 25 bp, Rattus norvegicus
cttattgccgcggatatagcggcca

SEQ ID NO: 527515 - DNA, 25 bp, Rattus norvegicus
tatagcggccacttgctacctgttg

SEQ ID NO: 527516 - DNA, 25 bp, Rattus norvegicus
ctggcctgacatcgtcgcgagacga

SEQ ID NO: 527517 - DNA, 25 bp, Rattus norvegicus
cacttgctacctgttggctggaccc

SEQ ID NO: 527518 - DNA, 25 bp, Rattus norvegicus
atccggaccgtgcacagcaggtact

SEQ ID NO: 527519 - DNA, 25 bp, Rattus norvegicus
gcccatatgtccacgtgacagacca

SEQ ID NO: 527520 - DNA, 25 bp, Rattus norvegicus
tcttaccctagagccgcccgagaat

SEQ ID NO: 527521 - DNA, 25 bp, Rattus norvegicus
cccgagaatggggaactcacgcttc

SEQ ID NO: 527522 - DNA, 25 bp, Rattus norvegicus
ggcctcctgacttctcgcgtgaatt

SEQ ID NO: 527523 - DNA, 25 bp, Rattus norvegicus
gtgaattccaattgcccgcccagag

SEQ ID NO: 527524 - DNA, 25 bp, Rattus norvegicus
atgtcggactacagcaccggaggtc

SEQ ID NO: 527525 - DNA, 25 bp, Rattus norvegicus
gcagccctcggtttattgagtttta

SEQ ID NO: 527526 - DNA, 25 bp, Rattus norvegicus
cgcccagctcatccgagagagcttt

SEQ ID NO: 527527 - DNA, 25 bp, Rattus norvegicus
tttatagtcgtcagtcacatcgtgc

SEQ ID NO: 527528 - DNA, 25 bp, Rattus norvegicus
tcttccggaactctgactggtcacc

SEQ ID NO: 527529 - DNA, 25 bp, Rattus norvegicus
cacccggatttacgacccaggattg

SEQ ID NO: 527530 - DNA, 25 bp, Rattus norvegicus
gatgtagagcgacagccgtatccta

SEQ ID NO: 527531 - DNA, 25 bp, Rattus norvegicus
gtatcctactggctgttccgcgccg

SEQ ID NO: 527532 - DNA, 25 bp, Rattus norvegicus
actcacgcttcattgggcctcctga

SEQ ID NO: 527533 - DNA, 25 bp, Rattus norvegicus
ggctcgtggccagagtctcccagag

SEQ ID NO: 527534 - DNA, 25 bp, Rattus norvegicus
accgtccatcctgccttagtgggta

SEQ ID NO: 527535 - DNA, 25 bp, Rattus norvegicus
tgccttagtgggtagcgccggaaac

SEQ ID NO: 527536 - DNA, 25 bp, Rattus norvegicus
gatgccagcctcgggctcgtggcca

SEQ ID NO: 527537 - DNA, 25 bp, Rattus norvegicus
ctgggaagcgctcgatgggtgcaga

SEQ ID NO: 527538 - DNA, 25 bp, Rattus norvegicus
tgcagaggctcactgaagaggcttc

SEQ ID NO: 527539 - DNA, 25 bp, Rattus norvegicus
gctcactgaagaggcttctccggta

SEQ ID NO: 527540 - DNA, 25 bp, Rattus norvegicus
ccatcctgccttagtgggtagcgcc

SEQ ID NO: 527541 - DNA, 25 bp, Rattus norvegicus
tagccactgttggtgcgacgttgtc

SEQ ID NO: 527542 - DNA, 25 bp, Rattus norvegicus
actgaagaggcttctccggtagcca

SEQ ID NO: 527543 - DNA, 25 bp, Rattus norvegicus
tctccggtagccactgttggtgcga

SEQ ID NO: 527544 - DNA, 25 bp, Rattus norvegicus
gaggcttctccggtagccactgttg

SEQ ID NO: 527545 - DNA, 25 bp, Rattus norvegicus
cagaggctcactgaagaggcttctc

SEQ ID NO: 527546 - DNA, 25 bp, Rattus norvegicus
cctgcggggtgtgcccttgatgcca

SEQ ID NO: 527547 - DNA, 25 bp, Rattus norvegicus
atcccgcccgcaatgctggggtacg

SEQ ID NO: 527548 - DNA, 25 bp, Rattus norvegicus
ttccacagagcgagcctcggttgcc

SEQ ID NO: 527549 - DNA, 25 bp, Rattus norvegicus
ccctgactccaggacacaaaagaaa

SEQ ID NO: 527550 - DNA, 25 bp, Rattus norvegicus
ctcattttgcaagatcctcgggatc

SEQ ID NO: 527551 - DNA, 25 bp, Rattus norvegicus
ctcggctccgctttacgtcacaagg

SEQ ID NO: 527552 - DNA, 25 bp, Rattus norvegicus
tccgctcccgcttcttggacattta

SEQ ID NO: 527553 - DNA, 25 bp, Rattus norvegicus
ttctcacgtgattataagttatccg

SEQ ID NO: 527554 - DNA, 25 bp, Rattus norvegicus
tttacgtcacaagggactcattttg

SEQ ID NO: 527555 - DNA, 25 bp, Rattus norvegicus
cttcttggacatttacgcttgcgcg

SEQ ID NO: 527556 - DNA, 25 bp, Rattus norvegicus
ttacgcttgcgcgagagtaccgagg

SEQ ID NO: 527557 - DNA, 25 bp, Rattus norvegicus
gagtaccgaggacgcgaacaccaga

SEQ ID NO: 527558 - DNA, 25 bp, Rattus norvegicus
gacgcgaacaccagaagactccatt

SEQ ID NO: 527559 - DNA, 25 bp, Rattus norvegicus
gggccgggtctctgccctgcaacga

SEQ ID NO: 527560 - DNA, 25 bp, Rattus norvegicus
tcacgaagtgacgtattctcacgtg

SEQ ID NO: 527561 - DNA, 25 bp, Rattus norvegicus
caagccattggctgacactgcgcca

SEQ ID NO: 527562 - DNA, 25 bp, Rattus norvegicus
cactcaccgagtcccagtggtcgta

SEQ ID NO: 527563 - DNA, 25 bp, Rattus norvegicus
agtcccagtggtcgtactcgtagcg

SEQ ID NO: 527564 - DNA, 25 bp, Rattus norvegicus
ccctcattatgtcccagtgggcgtc

SEQ ID NO: 527565 - DNA, 25 bp, Rattus norvegicus
ccgcagctggggctccagttcgcgt

SEQ ID NO: 527566 - DNA, 25 bp, Rattus norvegicus
agttcgcgtgtcagcgtgtcctctt

SEQ ID NO: 527567 - DNA, 25 bp, Rattus norvegicus
tcaggaagcctggatgcactacggc

SEQ ID NO: 527568 - DNA, 25 bp, Rattus norvegicus
atgcactacggcctcatcacgcagg

SEQ ID NO: 527569 - DNA, 25 bp, Rattus norvegicus
gcacccagaaagcaagcgcatcgct

SEQ ID NO: 527570 - DNA, 25 bp, Rattus norvegicus
aagcaagcgcatcgctagcctccag

SEQ ID NO: 527571 - DNA, 25 bp, Rattus norvegicus
agctgcccgccatcttcaggacaga

SEQ ID NO: 527572 - DNA, 25 bp, Rattus norvegicus
acagaccgcacaaggctgagccacg

SEQ ID NO: 527573 - DNA, 25 bp, Rattus norvegicus
tattgactctcctgttcgctgccgc

SEQ ID NO: 527574 - DNA, 25 bp, Rattus norvegicus
cttcaggacagaccgcacaaggctg

SEQ ID NO: 527575 - DNA, 25 bp, Rattus norvegicus
cgctcgcctcgaccctttgtgggaa

SEQ ID NO: 527576 - DNA, 25 bp, Rattus norvegicus
agttcccagctactttgagcccgtg

SEQ ID NO: 527577 - DNA, 25 bp, Rattus norvegicus
agtcggtcttgcagaactacagttc

SEQ ID NO: 527578 - DNA, 25 bp, Rattus norvegicus
aggtccacctgctggcctgtaacca

SEQ ID NO: 527579 - DNA, 25 bp, Rattus norvegicus
ccatgaaggttctcggacaagactg

SEQ ID NO: 527580 - DNA, 25 bp, Rattus norvegicus
cgtccacttccgagaacgaaatagg

SEQ ID NO: 527581 - DNA, 25 bp, Rattus norvegicus
gtgaatcgctcccagtactccatgg

SEQ ID NO: 527582 - DNA, 25 bp, Rattus norvegicus
cgttcccgcaacagcctcgagtata

SEQ ID NO: 527583 - DNA, 25 bp, Rattus norvegicus
gtaccgtctgctccaccactatagg

SEQ ID NO: 527584 - DNA, 25 bp, Rattus norvegicus
tcgagtatatgtcgtaagcgcgctc

SEQ ID NO: 527585 - DNA, 25 bp, Rattus norvegicus
tgaataaggaaaacccgcgtctctg

SEQ ID NO: 527586 - DNA, 25 bp, Rattus norvegicus
gtgactcccgcgtataggctcgcta

SEQ ID NO: 527587 - DNA, 25 bp, Rattus norvegicus
gtcgcagttccatgcaggttgcttc

SEQ ID NO: 527588 - DNA, 25 bp, Rattus norvegicus
tccaggcttggtttccggaactaca

SEQ ID NO: 527589 - DNA, 25 bp, Rattus norvegicus
cttctgacaggcttataggcttgtc

SEQ ID NO: 527590 - DNA, 25 bp, Rattus norvegicus
atcaggtaagaagcctccgcccggg

SEQ ID NO: 527591 - DNA, 25 bp, Rattus norvegicus
gccagtcatggacaatcaggtaaga

SEQ ID NO: 527592 - DNA, 25 bp, Rattus norvegicus
tataggcttgtctatcggcgaggcc

SEQ ID NO: 527593 - DNA, 25 bp, Rattus norvegicus
gtgctctggccttctgacaggctta

SEQ ID NO: 527594 - DNA, 25 bp, Rattus norvegicus
ttcgtcgttccgactgtagcccggc

SEQ ID NO: 527595 - DNA, 25 bp, Rattus norvegicus
tgatggcttcgtcgttccgactgta

SEQ ID NO: 527596 - DNA, 25 bp, Rattus norvegicus
cttcctattggctgatggcttcgtc

SEQ ID NO: 527597 - DNA, 25 bp, Rattus norvegicus
tgcggcgcctgcttcctattggctg

SEQ ID NO: 527598 - DNA, 25 bp, Rattus norvegicus
tatagggaccttccctctagagccg

SEQ ID NO: 527599 - DNA, 25 bp, Rattus norvegicus
ctcaactctttaggacctttatagg

SEQ ID NO: 527600 - DNA, 25 bp, Rattus norvegicus
gcagggttcgaacctcaactcttta

SEQ ID NO: 527601 - DNA, 25 bp, Rattus norvegicus
tgtcgcacagcagcaccgaccatcg

SEQ ID NO: 527602 - DNA, 25 bp, Rattus norvegicus
gcgggcgccagtcatggacaatcag

SEQ ID NO: 527603 - DNA, 25 bp, Rattus norvegicus
agcatacggtcccacacccacggga

SEQ ID NO: 527604 - DNA, 25 bp, Rattus norvegicus
gtcaatcttcctgcggaaggcggtg

SEQ ID NO: 527605 - DNA, 25 bp, Rattus norvegicus
atggcccagcggtcaatcttcctgc

SEQ ID NO: 527606 - DNA, 25 bp, Rattus norvegicus
cacccacgggatgccgcagaacgtg

SEQ ID NO: 527607 - DNA, 25 bp, Rattus norvegicus
agactgtccagcatacggtcccaca

SEQ ID NO: 527608 - DNA, 25 bp, Rattus norvegicus
tggtcttcagactgtccagcatacg

SEQ ID NO: 527609 - DNA, 25 bp, Rattus norvegicus
ccaggtgtttggtcttcagactgtc

SEQ ID NO: 527610 - DNA, 25 bp, Rattus norvegicus
cccatcatctgcctcttgttggtac

SEQ ID NO: 527611 - DNA, 25 bp, Rattus norvegicus
atgcgcatggcccagcggtcaatct

SEQ ID NO: 527612 - DNA, 25 bp, Rattus norvegicus
tactgaggcccatgcgcatggccca

SEQ ID NO: 527613 - DNA, 25 bp, Rattus norvegicus
cagcggtcaatcttcctgcggaagg

SEQ ID NO: 527614 - DNA, 25 bp, Rattus norvegicus
tgttggtactgaggcccatgcgcat

SEQ ID NO: 527615 - DNA, 25 bp, Rattus norvegicus
ctcttgttggtactgaggcccatgc

SEQ ID NO: 527616 - DNA, 25 bp, Rattus norvegicus
gtggagtccaggtgtttggtcttca

SEQ ID NO: 527617 - DNA, 25 bp, Rattus norvegicus
agcagcctgaagtagagcgcacagc

SEQ ID NO: 527618 - DNA, 25 bp, Rattus norvegicus
gtgattaacgatggcaactcctggc

SEQ ID NO: 527619 - DNA, 25 bp, Rattus norvegicus
cacctgccagctcttcttgtacttg

SEQ ID NO: 527620 - DNA, 25 bp, Rattus norvegicus
caactcctggcgtgagtgagcagcc

SEQ ID NO: 527621 - DNA, 25 bp, Rattus norvegicus
gcgccacactcacttgcacgtgaga

SEQ ID NO: 527622 - DNA, 25 bp, Rattus norvegicus
ggtctgtctgtaacacgcagcaatg

SEQ ID NO: 527623 - DNA, 25 bp, Rattus norvegicus
gcgctcatgatcaagtccggcactg

SEQ ID NO: 527624 - DNA, 25 bp, Rattus norvegicus
tgagtactttgtggccgcgctcatg

SEQ ID NO: 527625 - DNA, 25 bp, Rattus norvegicus
cgccaggtagtgtgagtactttgtg

SEQ ID NO: 527626 - DNA, 25 bp, Rattus norvegicus
cttgtacttggagccgatcgccagg

SEQ ID NO: 527627 - DNA, 25 bp, Rattus norvegicus
cgcagcaatgccagaagggtgagca

SEQ ID NO: 527628 - DNA, 25 bp, Rattus norvegicus
cacgtgagacgcaccttgaggaagg

SEQ ID NO: 527629 - DNA, 25 bp, Rattus norvegicus
ggcaggcctcgtagtactcgatgta

SEQ ID NO: 527630 - DNA, 25 bp, Rattus norvegicus
agcgaactcggtctgtctgtaacac

SEQ ID NO: 527631 - DNA, 25 bp, Rattus norvegicus
actgttacttaccaacgcggagcga

SEQ ID NO: 527632 - DNA, 25 bp, Rattus norvegicus
tgttacttaccaacgcggagcgaca

SEQ ID NO: 527633 - DNA, 25 bp, Rattus norvegicus
ttaccaacgcggagcgacacgcagc

SEQ ID NO: 527634 - DNA, 25 bp, Rattus norvegicus
gtagccgtggagactgttacttacc

SEQ ID NO: 527635 - DNA, 25 bp, Rattus norvegicus
caacgccgcgggagccgctacccga

SEQ ID NO: 527636 - DNA, 25 bp, Rattus norvegicus
acgcggagcgacacgcagcggccaa

SEQ ID NO: 527637 - DNA, 25 bp, Rattus norvegicus
ggagactgttacttaccaacgcgga

SEQ ID NO: 527638 - DNA, 25 bp, Rattus norvegicus
gctacccgaactccctgccgaactc

SEQ ID NO: 527639 - DNA, 25 bp, Rattus norvegicus
gccgtggagactgttacttaccaac

SEQ ID NO: 527640 - DNA, 25 bp, Rattus norvegicus
gagactgtagccgtggagactgtta

SEQ ID NO: 527641 - DNA, 25 bp, Rattus norvegicus
catagagactgtagccgtggagact

SEQ ID NO: 527642 - DNA, 25 bp, Rattus norvegicus
ccgccatagagactgtagccgtgga

SEQ ID NO: 527643 - DNA, 25 bp, Rattus norvegicus
cgccgccatagagactgtagccgtg

SEQ ID NO: 527644 - DNA, 25 bp, Rattus norvegicus
ctgtagccgtggagactgttactta

SEQ ID NO: 527645 - DNA, 25 bp, Rattus norvegicus
cgctgcggacaagaaccggtcgtga

SEQ ID NO: 527646 - DNA, 25 bp, Rattus norvegicus
gtggactcgcacttgcagggtttcg

SEQ ID NO: 527647 - DNA, 25 bp, Rattus norvegicus
taagagccgggtcctgtagtgcgta

SEQ ID NO: 527648 - DNA, 25 bp, Rattus norvegicus
gcggtcctaagagccgggtcctgta

SEQ ID NO: 527649 - DNA, 25 bp, Rattus norvegicus
tgcgcccaaggaaagggcggtccta

SEQ ID NO: 527650 - DNA, 25 bp, Rattus norvegicus
tcacagtttcggtgctgcgcccaag

SEQ ID NO: 527651 - DNA, 25 bp, Rattus norvegicus
aggcttcgacctcacagtttcggtg

SEQ ID NO: 527652 - DNA, 25 bp, Rattus norvegicus
tgggacaccaggcttcgacctcaca

SEQ ID NO: 527653 - DNA, 25 bp, Rattus norvegicus
acaagaaccggtcgtgagagcgtcg

SEQ ID NO: 527654 - DNA, 25 bp, Rattus norvegicus
ggttcattccttagcgctgcggaca

SEQ ID NO: 527655 - DNA, 25 bp, Rattus norvegicus
taggactaccgagtgggttcattcc

SEQ ID NO: 527656 - DNA, 25 bp, Rattus norvegicus
gtccgttctgaacctacgcgcgtgg

SEQ ID NO: 527657 - DNA, 25 bp, Rattus norvegicus
gggtaacactctgtgtccgttctga

SEQ ID NO: 527658 - DNA, 25 bp, Rattus norvegicus
gcgcaggccagttaatgggacacca

SEQ ID NO: 527659 - DNA, 25 bp, Rattus norvegicus
ctcgagagtgccgagtgcacatctg

SEQ ID NO: 527660 - DNA, 25 bp, Rattus norvegicus
catctcctgtcattcgggccattca

SEQ ID NO: 527661 - DNA, 25 bp, Rattus norvegicus
tctcctgtcattcgggccattcaga

SEQ ID NO: 527662 - DNA, 25 bp, Rattus norvegicus
cctgtcattcgggccattcagacct

SEQ ID NO: 527663 - DNA, 25 bp, Rattus norvegicus
cagacctcgagagtgccgagtgcac

SEQ ID NO: 527664 - DNA, 25 bp, Rattus norvegicus
gacctcgagagtgccgagtgcacat

SEQ ID NO: 527665 - DNA, 25 bp, Rattus norvegicus
cgagagtgccgagtgcacatctggc

SEQ ID NO: 527666 - DNA, 25 bp, Rattus norvegicus
agtgccgagtgcacatctggcgacg

SEQ ID NO: 527667 - DNA, 25 bp, Rattus norvegicus
tgccgagtgcacatctggcgacggc

SEQ ID NO: 527668 - DNA, 25 bp, Rattus norvegicus
cgagtgcacatctggcgacggccca

SEQ ID NO: 527669 - DNA, 25 bp, Rattus norvegicus
tgcacatctggcgacggcccagtgc

SEQ ID NO: 527670 - DNA, 25 bp, Rattus norvegicus
cacatctggcgacggcccagtgcag

SEQ ID NO: 527671 - DNA, 25 bp, Rattus norvegicus
gcatctcctgtcattcgggccattc

SEQ ID NO: 527672 - DNA, 25 bp, Rattus norvegicus
agagtgccgagtgcacatctggcga

SEQ ID NO: 527673 - DNA, 25 bp, Rattus norvegicus
gcccgtgtcttctggagcctacaga

SEQ ID NO: 527674 - DNA, 25 bp, Rattus norvegicus
accggaagtgctcaagagtcccggc

SEQ ID NO: 527675 - DNA, 25 bp, Rattus norvegicus
tgttatactcgagcgtcagcagagg

SEQ ID NO: 527676 - DNA, 25 bp, Rattus norvegicus
tcagcagagggtaggtaaaggcttt

SEQ ID NO: 527677 - DNA, 25 bp, Rattus norvegicus
gccgggaaggccacatcagcttcgc

SEQ ID NO: 527678 - DNA, 25 bp, Rattus norvegicus
tcagcttcgctgatgggcaccgcga

SEQ ID NO: 527679 - DNA, 25 bp, Rattus norvegicus
gggcaccgcgactcactgagcttta

SEQ ID NO: 527680 - DNA, 25 bp, Rattus norvegicus
cactgagctttaatgggcgccaccc

SEQ ID NO: 527681 - DNA, 25 bp, Rattus norvegicus
gcacgctcagaccacaccaataata

SEQ ID NO: 527682 - DNA, 25 bp, Rattus norvegicus
tggcaggaaagtcttccgggtcgcc

SEQ ID NO: 527683 - DNA, 25 bp, Rattus norvegicus
agcctacagaaaggcgcacgctcag

SEQ ID NO: 527684 - DNA, 25 bp, Rattus norvegicus
caccaataatactaaggcgcgcgtg

SEQ ID NO: 527685 - DNA, 25 bp, Rattus norvegicus
gccgctcaggaaccggaagtgctca

SEQ ID NO: 527686 - DNA, 25 bp, Rattus norvegicus
ctcgcactggctctggagtgtggca

SEQ ID NO: 527687 - DNA, 25 bp, Rattus norvegicus
agcatgcgagcaagtccgcctccag

SEQ ID NO: 527688 - DNA, 25 bp, Rattus norvegicus
gatgcgtttcccaccttcctgactt

SEQ ID NO: 527689 - DNA, 25 bp, Rattus norvegicus
aacgcagcatgcgagcaagtccgcc

SEQ ID NO: 527690 - DNA, 25 bp, Rattus norvegicus
tccagccctgcccaatgtgttaggt

SEQ ID NO: 527691 - DNA, 25 bp, Rattus norvegicus
cccaagctccttccgccgaagccgc

SEQ ID NO: 527692 - DNA, 25 bp, Rattus norvegicus
atgcgagcaagtccgcctccagccc

SEQ ID NO: 527693 - DNA, 25 bp, Rattus norvegicus
tgcccaggtggcctgcctgatgcgt

SEQ ID NO: 527694 - DNA, 25 bp, Rattus norvegicus
caggtggcctgcctgatgcgtttcc

SEQ ID NO: 527695 - DNA, 25 bp, Rattus norvegicus
ccttcctgacttcggcggcggctgg

SEQ ID NO: 527696 - DNA, 25 bp, Rattus norvegicus
gcgtgcgcaacgcagcatgcgagca

SEQ ID NO: 527697 - DNA, 25 bp, Rattus norvegicus
tgcgcaacgcagcatgcgagcaagt

SEQ ID NO: 527698 - DNA, 25 bp, Rattus norvegicus
cgcaacgcagcatgcgagcaagtcc

SEQ ID NO: 527699 - DNA, 25 bp, Rattus norvegicus
gtggcctgcctgatgcgtttcccac

SEQ ID NO: 527700 - DNA, 25 bp, Rattus norvegicus
cagccctgcccaatgtgttaggtcc

SEQ ID NO: 527701 - DNA, 25 bp, Rattus norvegicus
ggccatacgcatctacgacctgggc

SEQ ID NO: 527702 - DNA, 25 bp, Rattus norvegicus
cgcgtgcgtgtgatgctacctcacg

SEQ ID NO: 527703 - DNA, 25 bp, Rattus norvegicus
acacgctgcacgcagctgttcggcg

SEQ ID NO: 527704 - DNA, 25 bp, Rattus norvegicus
cgtacacagccgctaccacacgctg

SEQ ID NO: 527705 - DNA, 25 bp, Rattus norvegicus
ggacgaggtgtccttcctggacgta

SEQ ID NO: 527706 - DNA, 25 bp, Rattus norvegicus
gcgaggcggccatacgcatctacga

SEQ ID NO: 527707 - DNA, 25 bp, Rattus norvegicus
gaaaccgtcctgttccgctactgcg

SEQ ID NO: 527708 - DNA, 25 bp, Rattus norvegicus
ctacacgtcggacgaaaccgtcctg

SEQ ID NO: 527709 - DNA, 25 bp, Rattus norvegicus
gtctgggctacacgtcggacgaaac

SEQ ID NO: 527710 - DNA, 25 bp, Rattus norvegicus
cagcgacgacgcgtgcgcaaagagc

SEQ ID NO: 527711 - DNA, 25 bp, Rattus norvegicus
gcggtggagcttcgagaactttctc

SEQ ID NO: 527712 - DNA, 25 bp, Rattus norvegicus
ccacagatcgcgctctgctgcaggg

SEQ ID NO: 527713 - DNA, 25 bp, Rattus norvegicus
tcgagaactttctccctgggttgcc

SEQ ID NO: 527714 - DNA, 25 bp, Rattus norvegicus
tgtccttcctggacgtacacagccg

SEQ ID NO: 527715 - DNA, 25 bp, Rattus norvegicus
cgcgaggcagaattccacgtagtga

SEQ ID NO: 527716 - DNA, 25 bp, Rattus norvegicus
ggtgctcagtccacaagtgaatctg

SEQ ID NO: 527717 - DNA, 25 bp, Rattus norvegicus
cctagcagactttacggcgtttggg

SEQ ID NO: 527718 - DNA, 25 bp, Rattus norvegicus
cgagctcaaggttagcccgctaagc

SEQ ID NO: 527719 - DNA, 25 bp, Rattus norvegicus
gcgagattcacagcgcgcaacttta

SEQ ID NO: 527720 - DNA, 25 bp, Rattus norvegicus
cacagcgcaggttagtacggacgtc

SEQ ID NO: 527721 - DNA, 25 bp, Rattus norvegicus
cggacgtcctatttcgcgtagcaaa

SEQ ID NO: 527722 - DNA, 25 bp, Rattus norvegicus
tcaggcgggtcaatgctcgaaattg

SEQ ID NO: 527723 - DNA, 25 bp, Rattus norvegicus
tctggacagagacacccgtgacatc

SEQ ID NO: 527724 - DNA, 25 bp, Rattus norvegicus
atctggaccgcgtgtaactatttgg

SEQ ID NO: 527725 - DNA, 25 bp, Rattus norvegicus
actaggcccattctgcgctggtcta

SEQ ID NO: 527726 - DNA, 25 bp, Rattus norvegicus
tggtctacgtcctcgctgcacaagg

SEQ ID NO: 527727 - DNA, 25 bp, Rattus norvegicus
gcggggcctcttgagaatgtttgaa

SEQ ID NO: 527728 - DNA, 25 bp, Rattus norvegicus
tttgaattaatgcagcggcagcctg

SEQ ID NO: 527729 - DNA, 25 bp, Rattus norvegicus
cccgtctgctgcagaggggacactc

SEQ ID NO: 527730 - DNA, 25 bp, Rattus norvegicus
acagcggctccgctgctatgtgctc

SEQ ID NO: 527731 - DNA, 25 bp, Rattus norvegicus
agcagcagcctggtacagcggctcc

SEQ ID NO: 527732 - DNA, 25 bp, Rattus norvegicus
cagacgacgaagcagcagcctggta

SEQ ID NO: 527733 - DNA, 25 bp, Rattus norvegicus
agcagacagacgacgaagcagcagc

SEQ ID NO: 527734 - DNA, 25 bp, Rattus norvegicus
accaccatgacacggcctgcaggga

SEQ ID NO: 527735 - DNA, 25 bp, Rattus norvegicus
cggcaatagacaccaccatgacacg

SEQ ID NO: 527736 - DNA, 25 bp, Rattus norvegicus
cagaggggacactcggatccagcct

SEQ ID NO: 527737 - DNA, 25 bp, Rattus norvegicus
gtctgagtcccaagccgcatcctgg

SEQ ID NO: 527738 - DNA, 25 bp, Rattus norvegicus
tatgatgaggtctgagtcccaagcc

SEQ ID NO: 527739 - DNA, 25 bp, Rattus norvegicus
catcaatatgatgaggtctgagtcc

SEQ ID NO: 527740 - DNA, 25 bp, Rattus norvegicus
ctatgtgctcccagtagcctgacca

SEQ ID NO: 527741 - DNA, 25 bp, Rattus norvegicus
agtagcctgaccatcaccgtcatcg

SEQ ID NO: 527742 - DNA, 25 bp, Rattus norvegicus
gacactcggatccagcctgtggcca

SEQ ID NO: 527743 - DNA, 25 bp, Rattus norvegicus
acagtctgaggcgttcgcccttgga

SEQ ID NO: 527744 - DNA, 25 bp, Rattus norvegicus
agcaggcccggaggtctcgccacgt

SEQ ID NO: 527745 - DNA, 25 bp, Rattus norvegicus
ctcagcctgctttctgctgggagaa

SEQ ID NO: 527746 - DNA, 25 bp, Rattus norvegicus
cgttcgccaggtccgccattttact

SEQ ID NO: 527747 - DNA, 25 bp, Rattus norvegicus
tcgcccttggactctggggctctct

SEQ ID NO: 527748 - DNA, 25 bp, Rattus norvegicus
ccggactcccacagtctgaggcgtt

SEQ ID NO: 527749 - DNA, 25 bp, Rattus norvegicus
cagatcaaatgaagccggactccca

SEQ ID NO: 527750 - DNA, 25 bp, Rattus norvegicus
ggacccgttgggtgctcagatcaaa

SEQ ID NO: 527751 - DNA, 25 bp, Rattus norvegicus
ggcctcgtctcaggcccgttgggct

SEQ ID NO: 527752 - DNA, 25 bp, Rattus norvegicus
aggtctcgccacgttcgaggccgcg

SEQ ID NO: 527753 - DNA, 25 bp, Rattus norvegicus
acgaggaagagggttgctcgcacca

SEQ ID NO: 527754 - DNA, 25 bp, Rattus norvegicus
ggactctggggctctctcgacttcc

SEQ ID NO: 527755 - DNA, 25 bp, Rattus norvegicus
tgctgggagaattctgcgcctgcgc

SEQ ID NO: 527756 - DNA, 25 bp, Rattus norvegicus
agggttgctcgcaccagctagcgct

SEQ ID NO: 527757 - DNA, 25 bp, Rattus norvegicus
tccaagcacgcgagcgtcgtcacgt

SEQ ID NO: 527758 - DNA, 25 bp, Rattus norvegicus
acaagaagtcgtcccgtcccaactg

SEQ ID NO: 527759 - DNA, 25 bp, Rattus norvegicus
cctcgaatccgtcttcagtcaaatc

SEQ ID NO: 527760 - DNA, 25 bp, Rattus norvegicus
agttctgcctcctccgtcatgttta

SEQ ID NO: 527761 - DNA, 25 bp, Rattus norvegicus
ccgtcatgtttactcgagcttacta

SEQ ID NO: 527762 - DNA, 25 bp, Rattus norvegicus
tggtcacgcccactcactatattca

SEQ ID NO: 527763 - DNA, 25 bp, Rattus norvegicus
ctatattcaagctccgcctagcctg

SEQ ID NO: 527764 - DNA, 25 bp, Rattus norvegicus
cgagcagagatgacgtaagcgcgcc

SEQ ID NO: 527765 - DNA, 25 bp, Rattus norvegicus
ccgcgccgtcagtatggctgttcca

SEQ ID NO: 527766 - DNA, 25 bp, Rattus norvegicus
ttccatggcggcaagcacaggttac

SEQ ID NO: 527767 - DNA, 25 bp, Rattus norvegicus
gtctgcgacacgtcaactccctggg

SEQ ID NO: 527768 - DNA, 25 bp, Rattus norvegicus
ggatgtgtttcctcacctgccgctc

SEQ ID NO: 527769 - DNA, 25 bp, Rattus norvegicus
ggtgttcccgcgctttatcaagatc

SEQ ID NO: 527770 - DNA, 25 bp, Rattus norvegicus
cgcctatgaccgtcccggatgtgtt

SEQ ID NO: 527771 - DNA, 25 bp, Rattus norvegicus
gggaacacaacagcctgcaccctga

SEQ ID NO: 527772 - DNA, 25 bp, Rattus norvegicus
gacaggcgccctagggcgacctctg

SEQ ID NO: 527773 - DNA, 25 bp, Rattus norvegicus
atatgcgactcgctggccttttcgg

SEQ ID NO: 527774 - DNA, 25 bp, Rattus norvegicus
atcctgggatatatgcgactcgctg

SEQ ID NO: 527775 - DNA, 25 bp, Rattus norvegicus
cgagacggacttacctgcagctttc

SEQ ID NO: 527776 - DNA, 25 bp, Rattus norvegicus
tgagcccagacgagacggacttacc

SEQ ID NO: 527777 - DNA, 25 bp, Rattus norvegicus
cccgatggcggcagatgagcccaga

SEQ ID NO: 527778 - DNA, 25 bp, Rattus norvegicus
agcgactgagataccgtacctcggc

SEQ ID NO: 527779 - DNA, 25 bp, Rattus norvegicus
gcagcgggaataagacagcgactga

SEQ ID NO: 527780 - DNA, 25 bp, Rattus norvegicus
accctcagacgccaatcaacgatgg

SEQ ID NO: 527781 - DNA, 25 bp, Rattus norvegicus
acagacccgagaggtcaggcctttc

SEQ ID NO: 527782 - DNA, 25 bp, Rattus norvegicus
tgaggcgctacgagaacacagaccc

SEQ ID NO: 527783 - DNA, 25 bp, Rattus norvegicus
aggtactgctgcacccgtgagcccg

SEQ ID NO: 527784 - DNA, 25 bp, Rattus norvegicus
aacgatgggcccacgaaccactgcg

SEQ ID NO: 527785 - DNA, 25 bp, Rattus norvegicus
tggaggcccggagaaagttttctgc

SEQ ID NO: 527786 - DNA, 25 bp, Rattus norvegicus
ctagaacaatccagccttcgcgttg

SEQ ID NO: 527787 - DNA, 25 bp, Rattus norvegicus
tcccaagagtttcagcagcgacacc

SEQ ID NO: 527788 - DNA, 25 bp, Rattus norvegicus
ccattgcggctgacagtgaccacta

SEQ ID NO: 527789 - DNA, 25 bp, Rattus norvegicus
gtctaaggctattgccgctcccgga

SEQ ID NO: 527790 - DNA, 25 bp, Rattus norvegicus
cccgatgtacggagtctaaggctat

SEQ ID NO: 527791 - DNA, 25 bp, Rattus norvegicus
ttcccagaaggaattgcggcagcta

SEQ ID NO: 527792 - DNA, 25 bp, Rattus norvegicus
acctcctttggtcttctgcctaata

SEQ ID NO: 527793 - DNA, 25 bp, Rattus norvegicus
ggctcttgtctgtcgttcctccaga

SEQ ID NO: 527794 - DNA, 25 bp, Rattus norvegicus
ggggaatcttaccagggctcttgtc

SEQ ID NO: 527795 - DNA, 25 bp, Rattus norvegicus
tcagggactcaattctccgcgcggg

SEQ ID NO: 527796 - DNA, 25 bp, Rattus norvegicus
acttaggtttccttcatctcaggga

SEQ ID NO: 527797 - DNA, 25 bp, Rattus norvegicus
ttggtgtcgtgcgattgctcattcc

SEQ ID NO: 527798 - DNA, 25 bp, Rattus norvegicus
gcgttgccgtggtaaccatcactta

SEQ ID NO: 527799 - DNA, 25 bp, Rattus norvegicus
cctatctgcctcgtcattggctccc

SEQ ID NO: 527800 - DNA, 25 bp, Rattus norvegicus
cgagcggcgactgcgcagtctcgcg

SEQ ID NO: 527801 - DNA, 25 bp, Rattus norvegicus
aatcgatgggccttggagcccgagc

SEQ ID NO: 527802 - DNA, 25 bp, Rattus norvegicus
cagaaaaatcgatgggccttggagc

SEQ ID NO: 527803 - DNA, 25 bp, Rattus norvegicus
gtcaacagaaaaatcgatgggcctt

SEQ ID NO: 527804 - DNA, 25 bp, Rattus norvegicus
tgagattaccaaagtcaacagaaaa

SEQ ID NO: 527805 - DNA, 25 bp, Rattus norvegicus
gggattaatgagattaccaaagtca

SEQ ID NO: 527806 - DNA, 25 bp, Rattus norvegicus
ttaacgagggattaatgagattacc

SEQ ID NO: 527807 - DNA, 25 bp, Rattus norvegicus
gcgtcgaggcatctgtcccaggaca

SEQ ID NO: 527808 - DNA, 25 bp, Rattus norvegicus
attggctccccgacttgtgcccgag

SEQ ID NO: 527809 - DNA, 25 bp, Rattus norvegicus
gtcgaggcatctgtcccaggacacc

SEQ ID NO: 527810 - DNA, 25 bp, Rattus norvegicus
ctccctcctatctgcctcgtcattg

SEQ ID NO: 527811 - DNA, 25 bp, Rattus norvegicus
cggagtaattaacgagggattaatg

SEQ ID NO: 527812 - DNA, 25 bp, Rattus norvegicus
aaagggcgtcgaggcatctgtccca

SEQ ID NO: 527813 - DNA, 25 bp, Rattus norvegicus
agccgggatgcacttcagtacagtc

SEQ ID NO: 527814 - DNA, 25 bp, Rattus norvegicus
gcatcgcctctcttgttgcagccga

SEQ ID NO: 527815 - DNA, 25 bp, Rattus norvegicus
tgacgccataatcccttgagccctg

SEQ ID NO: 527816 - DNA, 25 bp, Rattus norvegicus
cccgggccaatattggctgaaaatg

SEQ ID NO: 527817 - DNA, 25 bp, Rattus norvegicus
atttccagggcgctccaactgttcg

SEQ ID NO: 527818 - DNA, 25 bp, Rattus norvegicus
ggacgcccaacctctgcagaagctg

SEQ ID NO: 527819 - DNA, 25 bp, Rattus norvegicus
accctccggatgtaaaagcgtcctg

SEQ ID NO: 527820 - DNA, 25 bp, Rattus norvegicus
tcgccgaatagaggggacgcccaac

SEQ ID NO: 527821 - DNA, 25 bp, Rattus norvegicus
gaaacttctcctttggggctgtaga

SEQ ID NO: 527822 - DNA, 25 bp, Rattus norvegicus
actgggactgagtgctcgagacata

SEQ ID NO: 527823 - DNA, 25 bp, Rattus norvegicus
agtgccctgccatctcagactggga

SEQ ID NO: 527824 - DNA, 25 bp, Rattus norvegicus
agccgctctcttacccaggtgcagg

SEQ ID NO: 527825 - DNA, 25 bp, Rattus norvegicus
agcaagctgacccaaggggcctgta

SEQ ID NO: 527826 - DNA, 25 bp, Rattus norvegicus
ccagggacatggaaggtgagccttc

SEQ ID NO: 527827 - DNA, 25 bp, Rattus norvegicus
gtgaatgcgctcttgctcacgcctc

SEQ ID NO: 527828 - DNA, 25 bp, Rattus norvegicus
cccactgggcctgcagcctttgctc

SEQ ID NO: 527829 - DNA, 25 bp, Rattus norvegicus
gggcaatctccagccgctctcgctc

SEQ ID NO: 527830 - DNA, 25 bp, Rattus norvegicus
ctcctgttcatagcgcagttcctgc

SEQ ID NO: 527831 - DNA, 25 bp, Rattus norvegicus
ctatgtcggtggaaagccaggcgct

SEQ ID NO: 527832 - DNA, 25 bp, Rattus norvegicus
tccagcctatgtcggtggaaagcca

SEQ ID NO: 527833 - DNA, 25 bp, Rattus norvegicus
gttcacgctccagcctatgtcggtg

SEQ ID NO: 527834 - DNA, 25 bp, Rattus norvegicus
gctcctgttccacatgcatgcgctc

SEQ ID NO: 527835 - DNA, 25 bp, Rattus norvegicus
tcgctctcggtgaatgcgctcttgc

SEQ ID NO: 527836 - DNA, 25 bp, Rattus norvegicus
cgaagctcctctcgctctcggtgaa

SEQ ID NO: 527837 - DNA, 25 bp, Rattus norvegicus
agttcctgctgacgccgaagctcct

SEQ ID NO: 527838 - DNA, 25 bp, Rattus norvegicus
agcaggcctccgctcctgttcatag

SEQ ID NO: 527839 - DNA, 25 bp, Rattus norvegicus
gttccctctccatgcgttcacgctc

SEQ ID NO: 527840 - DNA, 25 bp, Rattus norvegicus
atagcgcagttcctgctgacgccga

SEQ ID NO: 527841 - DNA, 25 bp, Rattus norvegicus
gcagggacgtcattacaagcgtcaa

SEQ ID NO: 527842 - DNA, 25 bp, Rattus norvegicus
gccgtgggcgctcgcaccagctcct

SEQ ID NO: 527843 - DNA, 25 bp, Rattus norvegicus
tgggcagccgtgctactctgttcaa

SEQ ID NO: 527844 - DNA, 25 bp, Rattus norvegicus
tctttgctatctcggggctcagggc

SEQ ID NO: 527845 - DNA, 25 bp, Rattus norvegicus
ctactgctaacagggcgtctgcctc

SEQ ID NO: 527846 - DNA, 25 bp, Rattus norvegicus
ttttcactactgctaacagggcgtc

SEQ ID NO: 527847 - DNA, 25 bp, Rattus norvegicus
ggctcccttttcactactgctaaca

SEQ ID NO: 527848 - DNA, 25 bp, Rattus norvegicus
ccgtgctactctgttcaactggctc

SEQ ID NO: 527849 - DNA, 25 bp, Rattus norvegicus
acaagcgtcaaaagcaaacttcttc

SEQ ID NO: 527850 - DNA, 25 bp, Rattus norvegicus
agcaaacttcttcacgtcgtctttg

SEQ ID NO: 527851 - DNA, 25 bp, Rattus norvegicus
ttcacgtcgtctttgctatctcggg

SEQ ID NO: 527852 - DNA, 25 bp, Rattus norvegicus
gtcgtctttgctatctcggggctca

SEQ ID NO: 527853 - DNA, 25 bp, Rattus norvegicus
cgtctgcctcgctccactgacatcg

SEQ ID NO: 527854 - DNA, 25 bp, Rattus norvegicus
tcctctagccctacaggctcgcggt

SEQ ID NO: 527855 - DNA, 25 bp, Rattus norvegicus
cagggctgtgaccattagacgcttc

SEQ ID NO: 527856 - DNA, 25 bp, Rattus norvegicus
ggagaagcgctacaagatgcaaatc

SEQ ID NO: 527857 - DNA, 25 bp, Rattus norvegicus
agcacgctcttgttgccgctcgagt

SEQ ID NO: 527858 - DNA, 25 bp, Rattus norvegicus
cgagtctcctaaacccgacagagtc

SEQ ID NO: 527859 - DNA, 25 bp, Rattus norvegicus
tctcggccctcttaccacaaaatgg

SEQ ID NO: 527860 - DNA, 25 bp, Rattus norvegicus
agacgcctctacacaagcgccgtga

SEQ ID NO: 527861 - DNA, 25 bp, Rattus norvegicus
tgtccacggaccacgacgcatgcgt

SEQ ID NO: 527862 - DNA, 25 bp, Rattus norvegicus
atgtgcatttgtaccaccgaggcta

SEQ ID NO: 527863 - DNA, 25 bp, Rattus norvegicus
cctgcgcattgaggggaaaacgaca

SEQ ID NO: 527864 - DNA, 25 bp, Rattus norvegicus
tcacggaagcgagaatggcagaacc

SEQ ID NO: 527865 - DNA, 25 bp, Rattus norvegicus
ttacgaccggttgcgcatgtgcatt

SEQ ID NO: 527866 - DNA, 25 bp, Rattus norvegicus
agagactgctttggtgtgcgaccta

SEQ ID NO: 527867 - DNA, 25 bp, Rattus norvegicus
aaccagtgcgttttcctctaaggcg

SEQ ID NO: 527868 - DNA, 25 bp, Rattus norvegicus
gcggcgccattttgtactcagagcc

SEQ ID NO: 527869 - DNA, 25 bp, Rattus norvegicus
gcgaaggcggaagcatcaggcagag

SEQ ID NO: 527870 - DNA, 25 bp, Rattus norvegicus
ggtggaggcggaggtactcagcact

SEQ ID NO: 527871 - DNA, 25 bp, Rattus norvegicus
gcggaggtactcagcactggcggaa

SEQ ID NO: 527872 - DNA, 25 bp, Rattus norvegicus
cagcactggcggaagcgaaagcgaa

SEQ ID NO: 527873 - DNA, 25 bp, Rattus norvegicus
aaagcgaaggcggaagcatcaggca

SEQ ID NO: 527874 - DNA, 25 bp, Rattus norvegicus
cacgggtggaggtacctggatgaac

SEQ ID NO: 527875 - DNA, 25 bp, Rattus norvegicus
gaggtacctggatgaaccgcgagcc

SEQ ID NO: 527876 - DNA, 25 bp, Rattus norvegicus
aggtacctggatgaaccgcgagcct

SEQ ID NO: 527877 - DNA, 25 bp, Rattus norvegicus
ggtacctggatgaaccgcgagcctg

SEQ ID NO: 527878 - DNA, 25 bp, Rattus norvegicus
gtacctggatgaaccgcgagcctgt

SEQ ID NO: 527879 - DNA, 25 bp, Rattus norvegicus
tacctggatgaaccgcgagcctgta

SEQ ID NO: 527880 - DNA, 25 bp, Rattus norvegicus
gaggcagaagctctgggcacgggtg

SEQ ID NO: 527881 - DNA, 25 bp, Rattus norvegicus
acctggatgaaccgcgagcctgtag

SEQ ID NO: 527882 - DNA, 25 bp, Rattus norvegicus
gcactggcggaagcgaaagcgaagg

SEQ ID NO: 527883 - DNA, 25 bp, Rattus norvegicus
ccaggagctggtgcgagcgcccacg

SEQ ID NO: 527884 - DNA, 25 bp, Rattus norvegicus
tgttagcagtagtgaaaagggagcc

SEQ ID NO: 527885 - DNA, 25 bp, Rattus norvegicus
gacgccctgttagcagtagtgaaaa

SEQ ID NO: 527886 - DNA, 25 bp, Rattus norvegicus
aggcagacgccctgttagcagtagt

SEQ ID NO: 527887 - DNA, 25 bp, Rattus norvegicus
gatgtcagtggagcgaggcagacgc

SEQ ID NO: 527888 - DNA, 25 bp, Rattus norvegicus
tgacgcttgtaatgacgtccctgcg

SEQ ID NO: 527889 - DNA, 25 bp, Rattus norvegicus
agtttgcttttgacgcttgtaatga

SEQ ID NO: 527890 - DNA, 25 bp, Rattus norvegicus
tgaagaagtttgcttttgacgcttg

SEQ ID NO: 527891 - DNA, 25 bp, Rattus norvegicus
cccgagatagcaaagacgacgtgaa

SEQ ID NO: 527892 - DNA, 25 bp, Rattus norvegicus
aacagagtagcacggctgcccagct

SEQ ID NO: 527893 - DNA, 25 bp, Rattus norvegicus
ttgaacagagtagcacggctgccca

SEQ ID NO: 527894 - DNA, 25 bp, Rattus norvegicus
gagccagttgaacagagtagcacgg

SEQ ID NO: 527895 - DNA, 25 bp, Rattus norvegicus
accgcgagcctgtagggctagagga

SEQ ID NO: 527896 - DNA, 25 bp, Rattus norvegicus
gacgacgtgaagaagtttgcttttg

SEQ ID NO: 527897 - DNA, 25 bp, Rattus norvegicus
gagaaggctcgtttgcagcgagaac

SEQ ID NO: 527898 - DNA, 25 bp, Rattus norvegicus
cgtctggatgccttccaggagcggc

SEQ ID NO: 527899 - DNA, 25 bp, Rattus norvegicus
ctcgtttgcagcgagaacggctgca

SEQ ID NO: 527900 - DNA, 25 bp, Rattus norvegicus
agaacggctgcagctccaatgccag

SEQ ID NO: 527901 - DNA, 25 bp, Rattus norvegicus
ggctgcagctccaatgccagcggca

SEQ ID NO: 527902 - DNA, 25 bp, Rattus norvegicus
agcagcgcattatgcgtgagcgtga

SEQ ID NO: 527903 - DNA, 25 bp, Rattus norvegicus
cgcaaggaacagcagcgcattatgc

SEQ ID NO: 527904 - DNA, 25 bp, Rattus norvegicus
agcgcatgcgagtggagcgtgaaag

SEQ ID NO: 527905 - DNA, 25 bp, Rattus norvegicus
aatgccagcggcagcgtctagaaag

SEQ ID NO: 527906 - DNA, 25 bp, Rattus norvegicus
gctccaatgccagcggcagcgtcta

SEQ ID NO: 527907 - DNA, 25 bp, Rattus norvegicus
gctgagcaggaacggcgagcattgc

SEQ ID NO: 527908 - DNA, 25 bp, Rattus norvegicus
gtgaggagctgcgacggcagcaaga

SEQ ID NO: 527909 - DNA, 25 bp, Rattus norvegicus
cgtgaaaggcgcaaggaacagcagc

SEQ ID NO: 527910 - DNA, 25 bp, Rattus norvegicus
cgagaacggctgcagctccaatgcc

SEQ ID NO: 527911 - DNA, 25 bp, Rattus norvegicus
atgcgtaccactgtcgctgcataga

SEQ ID NO: 527912 - DNA, 25 bp, Rattus norvegicus
tcccacaagggactcatcggagctc

SEQ ID NO: 527913 - DNA, 25 bp, Rattus norvegicus
ggacagtaccctgccgtcgctgcaa

SEQ ID NO: 527914 - DNA, 25 bp, Rattus norvegicus
ggcgttcgtgtcctctatgcaagca

SEQ ID NO: 527915 - DNA, 25 bp, Rattus norvegicus
gcgccatctgcctggacgactacga

SEQ ID NO: 527916 - DNA, 25 bp, Rattus norvegicus
gtgcgcacattcacgcgcctcagtg

SEQ ID NO: 527917 - DNA, 25 bp, Rattus norvegicus
aacccgagtgtcatcccgtagtggc

SEQ ID NO: 527918 - DNA, 25 bp, Rattus norvegicus
tccgcatggggaaccctgtcccgaa

SEQ ID NO: 527919 - DNA, 25 bp, Rattus norvegicus
tcagcacgcgtgctgcttccgcatg

SEQ ID NO: 527920 - DNA, 25 bp, Rattus norvegicus
ccacagcagcctcaatgggttctga

SEQ ID NO: 527921 - DNA, 25 bp, Rattus norvegicus
cgggcttgacaaccgctcactggac

SEQ ID NO: 527922 - DNA, 25 bp, Rattus norvegicus
ttaacctgagctctggggacttcct

SEQ ID NO: 527923 - DNA, 25 bp, Rattus norvegicus
gtcgcccacggacgctcaggttaac

SEQ ID NO: 527924 - DNA, 25 bp, Rattus norvegicus
tctatgcaagcagtcggtggccagc

SEQ ID NO: 527925 - DNA, 25 bp, Rattus norvegicus
gctttgcagagagcgctgcctgcga

SEQ ID NO: 527926 - DNA, 25 bp, Rattus norvegicus
gcgttgctcctctggcctctcgggt

SEQ ID NO: 527927 - DNA, 25 bp, Rattus norvegicus
aggtctcctgcgttgctcctctggc

SEQ ID NO: 527928 - DNA, 25 bp, Rattus norvegicus
ttcaggtctcctgcgttgctcctct

SEQ ID NO: 527929 - DNA, 25 bp, Rattus norvegicus
accacggagtctgtagccttcaggt

SEQ ID NO: 527930 - DNA, 25 bp, Rattus norvegicus
gaccacggagtctgtagccttcagg

SEQ ID NO: 527931 - DNA, 25 bp, Rattus norvegicus
cggggaccacggagtctgtagcctt

SEQ ID NO: 527932 - DNA, 25 bp, Rattus norvegicus
cgccatcagtgttcgcccgcggagg

SEQ ID NO: 527933 - DNA, 25 bp, Rattus norvegicus
ggcgccatcagtgttcgcccgcgga

SEQ ID NO: 527934 - DNA, 25 bp, Rattus norvegicus
aggcggcgccatcagtgttcgcccg

SEQ ID NO: 527935 - DNA, 25 bp, Rattus norvegicus
accaggcggcgccatcagtgttcgc

SEQ ID NO: 527936 - DNA, 25 bp, Rattus norvegicus
aggctttgcagagagcgctgcctgc

SEQ ID NO: 527937 - DNA, 25 bp, Rattus norvegicus
gggaccacggagtctgtagccttca

SEQ ID NO: 527938 - DNA, 25 bp, Rattus norvegicus
ctgcctgcgatgacaaggcgctggc

SEQ ID NO: 527939 - DNA, 25 bp, Rattus norvegicus
catcctccagtcctcgcggtgtagg

SEQ ID NO: 527940 - DNA, 25 bp, Rattus norvegicus
cgcagtactgtttacggccaggccc

SEQ ID NO: 527941 - DNA, 25 bp, Rattus norvegicus
gcagcatgcggagcccgcaggtacc

SEQ ID NO: 527942 - DNA, 25 bp, Rattus norvegicus
gcgccggctttgtgcttccaagctt

SEQ ID NO: 527943 - DNA, 25 bp, Rattus norvegicus
gcttccaagcttctcggcctttgtg

SEQ ID NO: 527944 - DNA, 25 bp, Rattus norvegicus
cagccctgatcggattctgcaagga

SEQ ID NO: 527945 - DNA, 25 bp, Rattus norvegicus
acagggactcagagagacgggaacc

SEQ ID NO: 527946 - DNA, 25 bp, Rattus norvegicus
gtgcccagggttgccaactgcacca

SEQ ID NO: 527947 - DNA, 25 bp, Rattus norvegicus
caactgcaccaaccgggcggggaca

SEQ ID NO: 527948 - DNA, 25 bp, Rattus norvegicus
acacagtgtgccgtgcaccgtgtcc

SEQ ID NO: 527949 - DNA, 25 bp, Rattus norvegicus
cgtgtccgcgtctggagctgcagac

SEQ ID NO: 527950 - DNA, 25 bp, Rattus norvegicus
agacacctcagctcacctggggctt

SEQ ID NO: 527951 - DNA, 25 bp, Rattus norvegicus
ccagatctggaattgggacttctca

SEQ ID NO: 527952 - DNA, 25 bp, Rattus norvegicus
gcctcactggacaggtctctgtgcg

SEQ ID NO: 527953 - DNA, 25 bp, Rattus norvegicus
tgaatcagtctcagagcctctgggg

SEQ ID NO: 527954 - DNA, 25 bp, Rattus norvegicus
cccgtgtccctcgtgtactcgaatg

SEQ ID NO: 527955 - DNA, 25 bp, Rattus norvegicus
acactgcagcgtggccatgactctc

SEQ ID NO: 527956 - DNA, 25 bp, Rattus norvegicus
actcttgggtacgtggcaggttcac

SEQ ID NO: 527957 - DNA, 25 bp, Rattus norvegicus
caatgggattgggaactcttgggta

SEQ ID NO: 527958 - DNA, 25 bp, Rattus norvegicus
gtctgtccgcggacccaatgggatt

SEQ ID NO: 527959 - DNA, 25 bp, Rattus norvegicus
gtatcgcgccctggagggtgacatc

SEQ ID NO: 527960 - DNA, 25 bp, Rattus norvegicus
ccgcttagcgagctctgcggccggt

SEQ ID NO: 527961 - DNA, 25 bp, Rattus norvegicus
ctcgaatgcggccaagtgcctcttg

SEQ ID NO: 527962 - DNA, 25 bp, Rattus norvegicus
agtgcctcttggtgactcggtttcc

SEQ ID NO: 527963 - DNA, 25 bp, Rattus norvegicus
cccttctgtgtttactctgtgtgtc

SEQ ID NO: 527964 - DNA, 25 bp, Rattus norvegicus
tgtgtctctcggtgtccggatctgt

SEQ ID NO: 527965 - DNA, 25 bp, Rattus norvegicus
tccctgtgtctcagccgctgggtca

SEQ ID NO: 527966 - DNA, 25 bp, Rattus norvegicus
tggccatgactctccgcacactgaa

SEQ ID NO: 527967 - DNA, 25 bp, Rattus norvegicus
tgatcgtcaccaaggcaggcaggtc

SEQ ID NO: 527968 - DNA, 25 bp, Rattus norvegicus
gcacttctgcgacgttgcagccttc

SEQ ID NO: 527969 - DNA, 25 bp, Rattus norvegicus
agccttcgcggccagcagtctgagc

SEQ ID NO: 527970 - DNA, 25 bp, Rattus norvegicus
aagaacccaaaggtggccagcgtga

SEQ ID NO: 527971 - DNA, 25 bp, Rattus norvegicus
cgtgcagctggaaatgaaggcgcta

SEQ ID NO: 527972 - DNA, 25 bp, Rattus norvegicus
cttcgggtcatgatctccgccgtgt

SEQ ID NO: 527973 - DNA, 25 bp, Rattus norvegicus
gagttcaatcagctgggcaccgaga

SEQ ID NO: 527974 - DNA, 25 bp, Rattus norvegicus
cctctgactgcgtgtccaagggatg

SEQ ID NO: 527975 - DNA, 25 bp, Rattus norvegicus
caccgcgaatcctgggactcttcga

SEQ ID NO: 527976 - DNA, 25 bp, Rattus norvegicus
tgggactcttcgagggaactctgtg

SEQ ID NO: 527977 - DNA, 25 bp, Rattus norvegicus
actctgtgggccgaaattgctccgg

SEQ ID NO: 527978 - DNA, 25 bp, Rattus norvegicus
ttaggcagccgccacctaggaaact

SEQ ID NO: 527979 - DNA, 25 bp, Rattus norvegicus
ctcccgcatgggtttcgttcggtct

SEQ ID NO: 527980 - DNA, 25 bp, Rattus norvegicus
aggcgctatgggacgagttcaatca

SEQ ID NO: 527981 - DNA, 25 bp, Rattus norvegicus
cccttacccgagtccttggagctga

SEQ ID NO: 527982 - DNA, 25 bp, Rattus norvegicus
acctccatgaggttgtctccctgtg

SEQ ID NO: 527983 - DNA, 25 bp, Rattus norvegicus
ccacgcctgtgggtgtttaatcgaa

SEQ ID NO: 527984 - DNA, 25 bp, Rattus norvegicus
ggcttaaatcagagggaggactata

SEQ ID NO: 527985 - DNA, 25 bp, Rattus norvegicus
agaggtccgagtgttcgcatcacga

SEQ ID NO: 527986 - DNA, 25 bp, Rattus norvegicus
cgggaccggatgtcacctccatgag

SEQ ID NO: 527987 - DNA, 25 bp, Rattus norvegicus
ataatctgtcccaggctgcccaggg

SEQ ID NO: 527988 - DNA, 25 bp, Rattus norvegicus
cgctgtgtctccctgctacataatc

SEQ ID NO: 527989 - DNA, 25 bp, Rattus norvegicus
tgggtttccagacctcgctgtgtct

SEQ ID NO: 527990 - DNA, 25 bp, Rattus norvegicus
tcccttttgcttttgggtgacctca

SEQ ID NO: 527991 - DNA, 25 bp, Rattus norvegicus
tcagtgggacttggagtttagaaca

SEQ ID NO: 527992 - DNA, 25 bp, Rattus norvegicus
gtcgccggggactgacatttctcag

SEQ ID NO: 527993 - DNA, 25 bp, Rattus norvegicus
ctttcacgagttcaggcgttcaggc

SEQ ID NO: 527994 - DNA, 25 bp, Rattus norvegicus
aggcgacggtggactccgctttaat

SEQ ID NO: 527995 - DNA, 25 bp, Rattus norvegicus
ccctagacggctttatcagaaaact

SEQ ID NO: 527996 - DNA, 25 bp, Rattus norvegicus
tatcagaaaactcgggcagtctcgg

SEQ ID NO: 527997 - DNA, 25 bp, Rattus norvegicus
gactcgaccgctactctatagcttg

SEQ ID NO: 527998 - DNA, 25 bp, Rattus norvegicus
agcttgcgccaagtctacgttgtgc

SEQ ID NO: 527999 - DNA, 25 bp, Rattus norvegicus
ggcatagacggacgcacggacgaac

SEQ ID NO: 528000 - DNA, 25 bp, Rattus norvegicus
tgagtcgttcgagccgatccctgac

SEQ ID NO: 528001 - DNA, 25 bp, Rattus norvegicus
gccgatccctgaccagcctttgtta

SEQ ID NO: 528002 - DNA, 25 bp, Rattus norvegicus
gcctttgttatcatactggtgtccc

SEQ ID NO: 528003 - DNA, 25 bp, Rattus norvegicus
gtctgtgtgcccgatctcggagaca

SEQ ID NO: 528004 - DNA, 25 bp, Rattus norvegicus
atctcggagacactcgggagcgatc

SEQ ID NO: 528005 - DNA, 25 bp, Rattus norvegicus
cgacacttggcagagctccggaccg

SEQ ID NO: 528006 - DNA, 25 bp, Rattus norvegicus
ctccggaccgttatgcttcgtggtc

SEQ ID NO: 528007 - DNA, 25 bp, Rattus norvegicus
ggcgccaggagcacagaaactttcc

SEQ ID NO: 528008 - DNA, 25 bp, Rattus norvegicus
cacagaaactttcccgctcgctggg

SEQ ID NO: 528009 - DNA, 25 bp, Rattus norvegicus
ggtgtctaccacgatggtccacgga

SEQ ID NO: 528010 - DNA, 25 bp, Rattus norvegicus
tgccagcctgctgtcatggtgtcta

SEQ ID NO: 528011 - DNA, 25 bp, Rattus norvegicus
gcaggatgtgagctctcaggaacta

SEQ ID NO: 528012 - DNA, 25 bp, Rattus norvegicus
ctctgaaactgtaagatggcaatta

SEQ ID NO: 528013 - DNA, 25 bp, Rattus norvegicus
tggtccacggactcaccctctgaaa

SEQ ID NO: 528014 - DNA, 25 bp, Rattus norvegicus
tctaccacgatggtccacggactca

SEQ ID NO: 528015 - DNA, 25 bp, Rattus norvegicus
tgctgtcatggtgtctaccacgatg

SEQ ID NO: 528016 - DNA, 25 bp, Rattus norvegicus
cagcctgctgtcatggtgtctacca

SEQ ID NO: 528017 - DNA, 25 bp, Rattus norvegicus
gcctgccagcctgctgtcatggtgt

SEQ ID NO: 528018 - DNA, 25 bp, Rattus norvegicus
tgtgagctctcaggaactactcagc

SEQ ID NO: 528019 - DNA, 25 bp, Rattus norvegicus
ctctcatctggggagcaggatgtga

SEQ ID NO: 528020 - DNA, 25 bp, Rattus norvegicus
gctctcaggaactactcagccaggc

SEQ ID NO: 528021 - DNA, 25 bp, Rattus norvegicus
tcatggtgtctaccacgatggtcca

SEQ ID NO: 528022 - DNA, 25 bp, Rattus norvegicus
gcctgctgtcatggtgtctaccacg

SEQ ID NO: 528023 - DNA, 25 bp, Rattus norvegicus
cagatccttctggaagctttggaga

SEQ ID NO: 528024 - DNA, 25 bp, Rattus norvegicus
cgtggtcgtccgcaccgatgaggac

SEQ ID NO: 528025 - DNA, 25 bp, Rattus norvegicus
gagagctcgcccgtggtcgtccgca

SEQ ID NO: 528026 - DNA, 25 bp, Rattus norvegicus
ttacacagaggtgggaccagggccc

SEQ ID NO: 528027 - DNA, 25 bp, Rattus norvegicus
tgtcaccgccgtggcttacacagag

SEQ ID NO: 528028 - DNA, 25 bp, Rattus norvegicus
gctttggagaaatggacggagtacc

SEQ ID NO: 528029 - DNA, 25 bp, Rattus norvegicus
gaggtgaacaacatacccccgacca

SEQ ID NO: 528030 - DNA, 25 bp, Rattus norvegicus
gtgggctacagcgtccgctaccgac

SEQ ID NO: 528031 - DNA, 25 bp, Rattus norvegicus
agaaactcacaacggggccctggtg

SEQ ID NO: 528032 - DNA, 25 bp, Rattus norvegicus
tattggtaagttggcgcccgccacc

SEQ ID NO: 528033 - DNA, 25 bp, Rattus norvegicus
gctccacggccatattggtaagttg

SEQ ID NO: 528034 - DNA, 25 bp, Rattus norvegicus
gtccgctaccgaccgctgggctcag

SEQ ID NO: 528035 - DNA, 25 bp, Rattus norvegicus
atggacggagtaccgtgtcaccgcc

SEQ ID NO: 528036 - DNA, 25 bp, Rattus norvegicus
accaccactcagatccttctggaag

SEQ ID NO: 528037 - DNA, 25 bp, Rattus norvegicus
gggcctgacgccctggtaacagccc

SEQ ID NO: 528038 - DNA, 25 bp, Rattus norvegicus
cgcgcatcaaggacatcatgctggc

SEQ ID NO: 528039 - DNA, 25 bp, Rattus norvegicus
gccaccgcgcatcaaggacatcatg

SEQ ID NO: 528040 - DNA, 25 bp, Rattus norvegicus
gggccaccgcgcatcaaggacatca

SEQ ID NO: 528041 - DNA, 25 bp, Rattus norvegicus
ccactatgtgcgcatggagggcgcc

SEQ ID NO: 528042 - DNA, 25 bp, Rattus norvegicus
ggctaccaggtccactatgtgcgca

SEQ ID NO: 528043 - DNA, 25 bp, Rattus norvegicus
cgcggctaccaggtccactatgtgc

SEQ ID NO: 528044 - DNA, 25 bp, Rattus norvegicus
atccgcggctaccaggtccactatg

SEQ ID NO: 528045 - DNA, 25 bp, Rattus norvegicus
agcacgggcagatccgcggctacca

SEQ ID NO: 528046 - DNA, 25 bp, Rattus norvegicus
ggcgctcgcccacgcccggcaggca

SEQ ID NO: 528047 - DNA, 25 bp, Rattus norvegicus
cggctatccgagtgctgtggcgctc

SEQ ID NO: 528048 - DNA, 25 bp, Rattus norvegicus
acgccacggctatccgagtgctgtg

SEQ ID NO: 528049 - DNA, 25 bp, Rattus norvegicus
ggaggcgctcaacgccacggctatc

SEQ ID NO: 528050 - DNA, 25 bp, Rattus norvegicus
tcaacgccacggctatccgagtgct

SEQ ID NO: 528051 - DNA, 25 bp, Rattus norvegicus
gcacagcggactgcagggacatcag

SEQ ID NO: 528052 - DNA, 25 bp, Rattus norvegicus
aggacccagtgcttggctaccgcct

SEQ ID NO: 528053 - DNA, 25 bp, Rattus norvegicus
ccgcaggtaagccttcacagactca

SEQ ID NO: 528054 - DNA, 25 bp, Rattus norvegicus
cgcctggaggccatgcccatggcta

SEQ ID NO: 528055 - DNA, 25 bp, Rattus norvegicus
gctgactgtctcttcctccatagtg

SEQ ID NO: 528056 - DNA, 25 bp, Rattus norvegicus
accgcctgcagtttgggcgcgaaga

SEQ ID NO: 528057 - DNA, 25 bp, Rattus norvegicus
caagggcgccacctatgtgtttcgg

SEQ ID NO: 528058 - DNA, 25 bp, Rattus norvegicus
tgagcatccctgaggacgctccgcg

SEQ ID NO: 528059 - DNA, 25 bp, Rattus norvegicus
ctccgtaatactgcgctggctgcca

SEQ ID NO: 528060 - DNA, 25 bp, Rattus norvegicus
cggcgccatcatcaagtacacggtg

SEQ ID NO: 528061 - DNA, 25 bp, Rattus norvegicus
ggcccgcgacagagaccgaactggc

SEQ ID NO: 528062 - DNA, 25 bp, Rattus norvegicus
gagacagcgctcacactacaggggc

SEQ ID NO: 528063 - DNA, 25 bp, Rattus norvegicus
ctgcgatacaggcttgcgcgggacc

SEQ ID NO: 528064 - DNA, 25 bp, Rattus norvegicus
cgaggctccagtcagtcggtcggtc

SEQ ID NO: 528065 - DNA, 25 bp, Rattus norvegicus
acctcactgagaagaacgccgattg

SEQ ID NO: 528066 - DNA, 25 bp, Rattus norvegicus
gctgcagagcatgcccgtcaagatg

SEQ ID NO: 528067 - DNA, 25 bp, Rattus norvegicus
tcctgcacaacatcagcgctgggtc

SEQ ID NO: 528068 - DNA, 25 bp, Rattus norvegicus
cggctgctgagtacgtgatttcctg

SEQ ID NO: 528069 - DNA, 25 bp, Rattus norvegicus
atcctgtcttgtgtgctccggactc

SEQ ID NO: 528070 - DNA, 25 bp, Rattus norvegicus
attgacaagtgcgttctcccggacc

SEQ ID NO: 528071 - DNA, 25 bp, Rattus norvegicus
gcccggagctcacgcagattgacaa

SEQ ID NO: 528072 - DNA, 25 bp, Rattus norvegicus
cccgactgctatcaggtgtaggcta

SEQ ID NO: 528073 - DNA, 25 bp, Rattus norvegicus
gcgcaggcactcgacttcttctctt

SEQ ID NO: 528074 - DNA, 25 bp, Rattus norvegicus
cacgcccgcacgctaattggtagtg

SEQ ID NO: 528075 - DNA, 25 bp, Rattus norvegicus
tggtctctacgctcctccgttggtt

SEQ ID NO: 528076 - DNA, 25 bp, Rattus norvegicus
agctcctatcttcgcctggtctcta

SEQ ID NO: 528077 - DNA, 25 bp, Rattus norvegicus
tccacccttgttatcgggcggctgc

SEQ ID NO: 528078 - DNA, 25 bp, Rattus norvegicus
accggctcagctctcagtggctgca

SEQ ID NO: 528079 - DNA, 25 bp, Rattus norvegicus
gccacgcgtgagaagagttcctttc

SEQ ID NO: 528080 - DNA, 25 bp, Rattus norvegicus
ctcaggttgctcctcaatgggtgca

SEQ ID NO: 528081 - DNA, 25 bp, Rattus norvegicus
cgactcgggcgcgacaattgaatct

SEQ ID NO: 528082 - DNA, 25 bp, Rattus norvegicus
ccacgcgcgggaaacttctgccaag

SEQ ID NO: 528083 - DNA, 25 bp, Rattus norvegicus
ccaagttttctgatgtgaccgcgtg

SEQ ID NO: 528084 - DNA, 25 bp, Rattus norvegicus
tcgggttcctctaacacgaggtgtg

SEQ ID NO: 528085 - DNA, 25 bp, Rattus norvegicus
cgtgggcaatggctctgcaaatcgc

SEQ ID NO: 528086 - DNA, 25 bp, Rattus norvegicus
gaatctccaggagtgtccgctcgca

SEQ ID NO: 528087 - DNA, 25 bp, Rattus norvegicus
gcgtataagacacccattggatttc

SEQ ID NO: 528088 - DNA, 25 bp, Rattus norvegicus
cgcgattggccgaaatgtactcaga

SEQ ID NO: 528089 - DNA, 25 bp, Rattus norvegicus
tgccactgtgtgaataagcgcgctc

SEQ ID NO: 528090 - DNA, 25 bp, Rattus norvegicus
actgattggttcctctcgggctacg

SEQ ID NO: 528091 - DNA, 25 bp, Rattus norvegicus
ctcccggagagtccactactgattg

SEQ ID NO: 528092 - DNA, 25 bp, Rattus norvegicus
ccgcgcgcggtaaaattttgcaaag

SEQ ID NO: 528093 - DNA, 25 bp, Rattus norvegicus
catgccatagccgtcgcgttccata

SEQ ID NO: 528094 - DNA, 25 bp, Rattus norvegicus
ccgctgtgtgtagatccatgctgga

SEQ ID NO: 528095 - DNA, 25 bp, Rattus norvegicus
ccgcgattagcagtggtgtgccacc

SEQ ID NO: 528096 - DNA, 25 bp, Rattus norvegicus
aggtactccaccacgtccaggtgtc

SEQ ID NO: 528097 - DNA, 25 bp, Rattus norvegicus
ccatcgaagtgtacggagccgctcg

SEQ ID NO: 528098 - DNA, 25 bp, Rattus norvegicus
gccctcaatagtctcgccatcgaag

SEQ ID NO: 528099 - DNA, 25 bp, Rattus norvegicus
cgcagaaggctacgcaccacagcta

SEQ ID NO: 528100 - DNA, 25 bp, Rattus norvegicus
ccacgtccaggtggccgtcaaagca

SEQ ID NO: 528101 - DNA, 25 bp, Rattus norvegicus
tggctacctctaggtccgccttgtg

SEQ ID NO: 528102 - DNA, 25 bp, Rattus norvegicus
ggctgccagattccgcacagtcgtg

SEQ ID NO: 528103 - DNA, 25 bp, Rattus norvegicus
ggctgttcctggatgaggtactcca

SEQ ID NO: 528104 - DNA, 25 bp, Rattus norvegicus
tgcgccgcattgtacaccgctgtgt

SEQ ID NO: 528105 - DNA, 25 bp, Rattus norvegicus
catgatatcataaggcacgtgtggc

SEQ ID NO: 528106 - DNA, 25 bp, Rattus norvegicus
gctggaagtcttgctgacggatcta

SEQ ID NO: 528107 - DNA, 25 bp, Rattus norvegicus
cccttagcatatttgccgaaatgtt

SEQ ID NO: 528108 - DNA, 25 bp, Rattus norvegicus
aggaaatggatgtccctccgcctcc

SEQ ID NO: 528109 - DNA, 25 bp, Rattus norvegicus
tttgccgaaatgttacgcggtctcg

SEQ ID NO: 528110 - DNA, 25 bp, Rattus norvegicus
tacgaagggcttgctgaccagcagg

SEQ ID NO: 528111 - DNA, 25 bp, Rattus norvegicus
ggcttctacgaagggcttgctgacc

SEQ ID NO: 528112 - DNA, 25 bp, Rattus norvegicus
caatccggagtgatgtggaaggggc

SEQ ID NO: 528113 - DNA, 25 bp, Rattus norvegicus
cggttactcgcagccaatccggagt

SEQ ID NO: 528114 - DNA, 25 bp, Rattus norvegicus
agcgggcactgacggttactcgcag

SEQ ID NO: 528115 - DNA, 25 bp, Rattus norvegicus
tttcccagcgggcactgacggttac

SEQ ID NO: 528116 - DNA, 25 bp, Rattus norvegicus
actacgtttcccagcgggcactgac

SEQ ID NO: 528117 - DNA, 25 bp, Rattus norvegicus
tccgcctcctctgcggactacgttt

SEQ ID NO: 528118 - DNA, 25 bp, Rattus norvegicus
ttcttccggttctcgtgggcgcgaa

SEQ ID NO: 528119 - DNA, 25 bp, Rattus norvegicus
cactgacggttactcgcagccaatc

SEQ ID NO: 528120 - DNA, 25 bp, Rattus norvegicus
cgcgaaggcaggaaatggatgtccc

SEQ ID NO: 528121 - DNA, 25 bp, Rattus norvegicus
cgaggcggaaggaaatggtatttat

SEQ ID NO: 528122 - DNA, 25 bp, Rattus norvegicus
tcacggcttcagcagttgcacaagg

SEQ ID NO: 528123 - DNA, 25 bp, Rattus norvegicus
ctgggatcgtgagatcccggccgca

SEQ ID NO: 528124 - DNA, 25 bp, Rattus norvegicus
cagcccaacggagcggacaaaggta

SEQ ID NO: 528125 - DNA, 25 bp, Rattus norvegicus
cagtgtagacgacccgagtgagccc

SEQ ID NO: 528126 - DNA, 25 bp, Rattus norvegicus
tggtatttattgttctccgcgagac

SEQ ID NO: 528127 - DNA, 25 bp, Rattus norvegicus
gccagtgccaaagctctcgtccgag

SEQ ID NO: 528128 - DNA, 25 bp, Rattus norvegicus
agcagccaacgtgtactcctcggcg

SEQ ID NO: 528129 - DNA, 25 bp, Rattus norvegicus
cccggctttccctgcagatgtggca

SEQ ID NO: 528130 - DNA, 25 bp, Rattus norvegicus
tacgaccactacctcggggccaaga

SEQ ID NO: 528131 - DNA, 25 bp, Rattus norvegicus
gcacgctgatctgcgcctggaggct

SEQ ID NO: 528132 - DNA, 25 bp, Rattus norvegicus
gtcccgctacctggcggatccggag

SEQ ID NO: 528133 - DNA, 25 bp, Rattus norvegicus
ccggcgcgagttcgaccgtgactct

SEQ ID NO: 528134 - DNA, 25 bp, Rattus norvegicus
ccggccggcaatagcagtgtagacg

SEQ ID NO: 528135 - DNA, 25 bp, Rattus norvegicus
gcttcttggcttctcttcatgcttg

SEQ ID NO: 528136 - DNA, 25 bp, Rattus norvegicus
cgcatgggtacagatgctgcttctt

SEQ ID NO: 528137 - DNA, 25 bp, Rattus norvegicus
ctcgggccttgactgcgcatacttg

SEQ ID NO: 528138 - DNA, 25 bp, Rattus norvegicus
cgggccttgactgcgcatacttgcg

SEQ ID NO: 528139 - DNA, 25 bp, Rattus norvegicus
gcatacttgcgcatgggtacagatg

SEQ ID NO: 528140 - DNA, 25 bp, Rattus norvegicus
catacttgcgcatgggtacagatgc

SEQ ID NO: 528141 - DNA, 25 bp, Rattus norvegicus
acttgcgcatgggtacagatgctgc

SEQ ID NO: 528142 - DNA, 25 bp, Rattus norvegicus
gagcttggacgcgtcactttggcca

SEQ ID NO: 528143 - DNA, 25 bp, Rattus norvegicus
tgcgcatgggtacagatgctgcttc

SEQ ID NO: 528144 - DNA, 25 bp, Rattus norvegicus
catgggtacagatgctgcttcttgg

SEQ ID NO: 528145 - DNA, 25 bp, Rattus norvegicus
tgggtacagatgctgcttcttggct

SEQ ID NO: 528146 - DNA, 25 bp, Rattus norvegicus
ttcttggcttctcttcatgcttggt

SEQ ID NO: 528147 - DNA, 25 bp, Rattus norvegicus
cttgcgcatgggtacagatgctgct

SEQ ID NO: 528148 - DNA, 25 bp, Rattus norvegicus
gcttggacgcgtcactttggccacg

SEQ ID NO: 528149 - DNA, 25 bp, Rattus norvegicus
atcgtcacgtgccaaggcaagtccc

SEQ ID NO: 528150 - DNA, 25 bp, Rattus norvegicus
tgcctctggactgccggcattgggc

SEQ ID NO: 528151 - DNA, 25 bp, Rattus norvegicus
gtacgtgctacaggggcatcgatgc

SEQ ID NO: 528152 - DNA, 25 bp, Rattus norvegicus
cttctcccaggacataggacccggg

SEQ ID NO: 528153 - DNA, 25 bp, Rattus norvegicus
tcagaggcgctgtagatcgtcacgt

SEQ ID NO: 528154 - DNA, 25 bp, Rattus norvegicus
gggcgaagcgagaacgtcacaattc

SEQ ID NO: 528155 - DNA, 25 bp, Rattus norvegicus
gaacgtcacaattccgcgccacgtg

SEQ ID NO: 528156 - DNA, 25 bp, Rattus norvegicus
cgccacgtgtccagcgcgggttgct

SEQ ID NO: 528157 - DNA, 25 bp, Rattus norvegicus
gttgctccacgttcgcgagcgcctg

SEQ ID NO: 528158 - DNA, 25 bp, Rattus norvegicus
cccagcagtggcttctggactgcgc

SEQ ID NO: 528159 - DNA, 25 bp, Rattus norvegicus
agacgtgagcgccaatcagaggcgc

SEQ ID NO: 528160 - DNA, 25 bp, Rattus norvegicus
tggcggccgctgtgtctgagcccac

SEQ ID NO: 528161 - DNA, 25 bp, Rattus norvegicus
cgtgccatttgacgtgaggcccgga

SEQ ID NO: 528162 - DNA, 25 bp, Rattus norvegicus
cggaggtgtcgtgcattccttctcc

SEQ ID NO: 528163 - DNA, 25 bp, Rattus norvegicus
tgcgacagagatccgagaggccaaa

SEQ ID NO: 528164 - DNA, 25 bp, Rattus norvegicus
gccaaagcgaagaaacacgcctccg

SEQ ID NO: 528165 - DNA, 25 bp, Rattus norvegicus
cagcacgcgtgcatagtgcgacaga

SEQ ID NO: 528166 - DNA, 25 bp, Rattus norvegicus
tgggacagagaaaaatgcagcacgc

SEQ ID NO: 528167 - DNA, 25 bp, Rattus norvegicus
caagagctgcccaaaggagtgctga

SEQ ID NO: 528168 - DNA, 25 bp, Rattus norvegicus
tgagtgcctaggcaagagctgccca

SEQ ID NO: 528169 - DNA, 25 bp, Rattus norvegicus
ggaacagcgctgagctgagtgccta

SEQ ID NO: 528170 - DNA, 25 bp, Rattus norvegicus
ggaattcctccggaacagcgctgag

SEQ ID NO: 528171 - DNA, 25 bp, Rattus norvegicus
agcctctgccaagaggtgctcggca

SEQ ID NO: 528172 - DNA, 25 bp, Rattus norvegicus
aggagccaatagcagcaagcctctg

SEQ ID NO: 528173 - DNA, 25 bp, Rattus norvegicus
caggcggtgtacaaaggagccaata

SEQ ID NO: 528174 - DNA, 25 bp, Rattus norvegicus
ctcagcaaatggtagctagcgcaca

SEQ ID NO: 528175 - DNA, 25 bp, Rattus norvegicus
agctagcgcacaggcggtgtacaaa

SEQ ID NO: 528176 - DNA, 25 bp, Rattus norvegicus
tagaccctcactggctcagcaaatg

SEQ ID NO: 528177 - DNA, 25 bp, Rattus norvegicus
gggcgttcacaaaatccgtactgga

SEQ ID NO: 528178 - DNA, 25 bp, Rattus norvegicus
cctgggccgcaacccgactgggtag

SEQ ID NO: 528179 - DNA, 25 bp, Rattus norvegicus
ccgcaacccgactgggtagaaggtg

SEQ ID NO: 528180 - DNA, 25 bp, Rattus norvegicus
cccgactgggtagaaggtgtctgta

SEQ ID NO: 528181 - DNA, 25 bp, Rattus norvegicus
tgtctgtagcctcgggcgttcacaa

SEQ ID NO: 528182 - DNA, 25 bp, Rattus norvegicus
gcctcgggcgttcacaaaatccgta

SEQ ID NO: 528183 - DNA, 25 bp, Rattus norvegicus
tggccggagcgaatctccgctgtgc

SEQ ID NO: 528184 - DNA, 25 bp, Rattus norvegicus
aatccgtactggaatcgctgccgcc

SEQ ID NO: 528185 - DNA, 25 bp, Rattus norvegicus
actggaatcgctgccgcctggagca

SEQ ID NO: 528186 - DNA, 25 bp, Rattus norvegicus
tgaggccgactatccctcctgcggt

SEQ ID NO: 528187 - DNA, 25 bp, Rattus norvegicus
tttgaggccgactatccctcctgcg

SEQ ID NO: 528188 - DNA, 25 bp, Rattus norvegicus
aatctccgctgtgcccgggcccaac

SEQ ID NO: 528189 - DNA, 25 bp, Rattus norvegicus
cggagcgaatctccgctgtgcccgg

SEQ ID NO: 528190 - DNA, 25 bp, Rattus norvegicus
gtagcctcgggcgttcacaaaatcc

SEQ ID NO: 528191 - DNA, 25 bp, Rattus norvegicus
ttcagggacagatgcagtggacatg

SEQ ID NO: 528192 - DNA, 25 bp, Rattus norvegicus
tggcttattggggtgacggcctact

SEQ ID NO: 528193 - DNA, 25 bp, Rattus norvegicus
tgacaatgggacaaaggagcgtctc

SEQ ID NO: 528194 - DNA, 25 bp, Rattus norvegicus
cacatagcgcgacctcctgtgggtc

SEQ ID NO: 528195 - DNA, 25 bp, Rattus norvegicus
cgctgcagcacagcccgaaactggg

SEQ ID NO: 528196 - DNA, 25 bp, Rattus norvegicus
gccgtggcatcgacagtggcttatt

SEQ ID NO: 528197 - DNA, 25 bp, Rattus norvegicus
cagtggacatgcacgcaccaggcgc

SEQ ID NO: 528198 - DNA, 25 bp, Rattus norvegicus
ttggacagatgcaccggggacagat

SEQ ID NO: 528199 - DNA, 25 bp, Rattus norvegicus
ggggacgcaccttggacagatgcac

SEQ ID NO: 528200 - DNA, 25 bp, Rattus norvegicus
ccgggttttgcggagctccgagctt

SEQ ID NO: 528201 - DNA, 25 bp, Rattus norvegicus
cttgatgatctgtgccgggttttgc

SEQ ID NO: 528202 - DNA, 25 bp, Rattus norvegicus
gtctgtgctccgctccttgatgatc

SEQ ID NO: 528203 - DNA, 25 bp, Rattus norvegicus
ccgcaactggcatgaacacagggcc

SEQ ID NO: 528204 - DNA, 25 bp, Rattus norvegicus
cagacgcagggacagatgcaggaac

SEQ ID NO: 528205 - DNA, 25 bp, Rattus norvegicus
tcctcacgacctggattcggggctg

SEQ ID NO: 528206 - DNA, 25 bp, Rattus norvegicus
accgagccctactggcgccgagtgg

SEQ ID NO: 528207 - DNA, 25 bp, Rattus norvegicus
gatgcctcgacggtgccaaccacag

SEQ ID NO: 528208 - DNA, 25 bp, Rattus norvegicus
acacacattcaacagcggcgaggcg

SEQ ID NO: 528209 - DNA, 25 bp, Rattus norvegicus
gtgggcgacgaccttccagggccat

SEQ ID NO: 528210 - DNA, 25 bp, Rattus norvegicus
cccttggactcttcttcggtgggcg

SEQ ID NO: 528211 - DNA, 25 bp, Rattus norvegicus
tgggaccacagccacgcgctgctgt

SEQ ID NO: 528212 - DNA, 25 bp, Rattus norvegicus
cactgctgcatggtggtcctcacga

SEQ ID NO: 528213 - DNA, 25 bp, Rattus norvegicus
atggctggacaaaggcggcactgct

SEQ ID NO: 528214 - DNA, 25 bp, Rattus norvegicus
cccgcttatgcagaatggctggaca

SEQ ID NO: 528215 - DNA, 25 bp, Rattus norvegicus
gacaaggaagccatcctggcgcatg

SEQ ID NO: 528216 - DNA, 25 bp, Rattus norvegicus
ccggcgcaaggacaaggaagccatc

SEQ ID NO: 528217 - DNA, 25 bp, Rattus norvegicus
tggtatcggtgaacctgctggtgac

SEQ ID NO: 528218 - DNA, 25 bp, Rattus norvegicus
ccgactgagtcaggcccggaatctc

SEQ ID NO: 528219 - DNA, 25 bp, Rattus norvegicus
tctgtgacaaggacctcgtggacct

SEQ ID NO: 528220 - DNA, 25 bp, Rattus norvegicus
caggatggtttcgatgtctcccaca

SEQ ID NO: 528221 - DNA, 25 bp, Rattus norvegicus
agaccgacccgcgatatgcaggatg

SEQ ID NO: 528222 - DNA, 25 bp, Rattus norvegicus
tggatctgtccaataactctctgtc

SEQ ID NO: 528223 - DNA, 25 bp, Rattus norvegicus
tcggggcctaaagcagctggatatg

SEQ ID NO: 528224 - DNA, 25 bp, Rattus norvegicus
tgggcgtcctgttcctgaatgacaa

SEQ ID NO: 528225 - DNA, 25 bp, Rattus norvegicus
tacagcgcctgcacctggaagggaa

SEQ ID NO: 528226 - DNA, 25 bp, Rattus norvegicus
acaacctgcttgagtcgctgcccga

SEQ ID NO: 528227 - DNA, 25 bp, Rattus norvegicus
ctcgaccttgggcacaacctgcttg

SEQ ID NO: 528228 - DNA, 25 bp, Rattus norvegicus
cctggatctgactcgcaatgctctc

SEQ ID NO: 528229 - DNA, 25 bp, Rattus norvegicus
tccagcaaccgcctgcaggaactgt

SEQ ID NO: 528230 - DNA, 25 bp, Rattus norvegicus
cactgtccatctgtcggtggaattc

SEQ ID NO: 528231 - DNA, 25 bp, Rattus norvegicus
gctggccgccaaccgacataagatg

SEQ ID NO: 528232 - DNA, 25 bp, Rattus norvegicus
ttctcgcagaacgacacactctgtg

SEQ ID NO: 528233 - DNA, 25 bp, Rattus norvegicus
ggcggcgtagtgaagcaaatccaaa

SEQ ID NO: 528234 - DNA, 25 bp, Rattus norvegicus
gcgggtagcccttcatcttggcaaa

SEQ ID NO: 528235 - DNA, 25 bp, Rattus norvegicus
ttcatcttggcaaacactaagtccc

SEQ ID NO: 528236 - DNA, 25 bp, Rattus norvegicus
catgctgtcggcagaggcccaggcc

SEQ ID NO: 528237 - DNA, 25 bp, Rattus norvegicus
agacgaaaggtttaagcggctacag

SEQ ID NO: 528238 - DNA, 25 bp, Rattus norvegicus
ccgccggccggcgtctacttattgg

SEQ ID NO: 528239 - DNA, 25 bp, Rattus norvegicus
ctacttattgggtttagcacggccg

SEQ ID NO: 528240 - DNA, 25 bp, Rattus norvegicus
tgtcgctcacgaccacagagctgcg

SEQ ID NO: 528241 - DNA, 25 bp, Rattus norvegicus
aggggttggatcagagctagttaac

SEQ ID NO: 528242 - DNA, 25 bp, Rattus norvegicus
cagagctagttaacgggattggata

SEQ ID NO: 528243 - DNA, 25 bp, Rattus norvegicus
cagaggctgtcggatgtaaaagacg

SEQ ID NO: 528244 - DNA, 25 bp, Rattus norvegicus
ttaagcggctacagggcggagccta

SEQ ID NO: 528245 - DNA, 25 bp, Rattus norvegicus
atccaaaagcgggagtcggacgcct

SEQ ID NO: 528246 - DNA, 25 bp, Rattus norvegicus
taacgggattggataacggagcaga

SEQ ID NO: 528247 - DNA, 25 bp, Rattus norvegicus
cgggacttccgtcgccgagatattt

SEQ ID NO: 528248 - DNA, 25 bp, Rattus norvegicus
ccaagctatacagagccggagcaga

SEQ ID NO: 528249 - DNA, 25 bp, Rattus norvegicus
agggagagcctgtcgtcctggcaac

SEQ ID NO: 528250 - DNA, 25 bp, Rattus norvegicus
tgtaaatcaggagggcggagcctaa

SEQ ID NO: 528251 - DNA, 25 bp, Rattus norvegicus
gtgtcagggatctctccaagctata

SEQ ID NO: 528252 - DNA, 25 bp, Rattus norvegicus
ttacggactccgcagggtgtgtgac

SEQ ID NO: 528253 - DNA, 25 bp, Rattus norvegicus
ggcccggccagaagcttacggactc

SEQ ID NO: 528254 - DNA, 25 bp, Rattus norvegicus
catcaagttcaaaagcgcggggccc

SEQ ID NO: 528255 - DNA, 25 bp, Rattus norvegicus
cttccaggagatcaaggctgacatc

SEQ ID NO: 528256 - DNA, 25 bp, Rattus norvegicus
cgagatattttctttccggtggttg

SEQ ID NO: 528257 - DNA, 25 bp, Rattus norvegicus
ccgcaaggcgattgtcacgtgtgcc

SEQ ID NO: 528258 - DNA, 25 bp, Rattus norvegicus
caacggcgtccgcagacaggaagat

SEQ ID NO: 528259 - DNA, 25 bp, Rattus norvegicus
gccgccatgaagaagttcttccagg

SEQ ID NO: 528260 - DNA, 25 bp, Rattus norvegicus
gcattacggataggcggacccgatg

SEQ ID NO: 528261 - DNA, 25 bp, Rattus norvegicus
aacaacgaaccctcagtcttgcagg

SEQ ID NO: 528262 - DNA, 25 bp, Rattus norvegicus
gcggagatgcaagcctgacgcagcc

SEQ ID NO: 528263 - DNA, 25 bp, Rattus norvegicus
ctcgcaggagtagggacggttccca

SEQ ID NO: 528264 - DNA, 25 bp, Rattus norvegicus
gctcagtactaagcggagaggcccg

SEQ ID NO: 528265 - DNA, 25 bp, Rattus norvegicus
gcgcaagctcagtactaagcggaga

SEQ ID NO: 528266 - DNA, 25 bp, Rattus norvegicus
gggagcgcaagctcagtactaagcg

SEQ ID NO: 528267 - DNA, 25 bp, Rattus norvegicus
tgcgccgtgaacaacgaaccctcag

SEQ ID NO: 528268 - DNA, 25 bp, Rattus norvegicus
caagttagccttcccgcgggtctgc

SEQ ID NO: 528269 - DNA, 25 bp, Rattus norvegicus
cgtacgcggccacccgcgacgtgcc

SEQ ID NO: 528270 - DNA, 25 bp, Rattus norvegicus
gcttgcgggtgcctcgtcagccacg

SEQ ID NO: 528271 - DNA, 25 bp, Rattus norvegicus
tgacgcagccggatcctaggagctt

SEQ ID NO: 528272 - DNA, 25 bp, Rattus norvegicus
ccgccgcggagatgcaagcctgacg

SEQ ID NO: 528273 - DNA, 25 bp, Rattus norvegicus
cgtgaacaacgaaccctcagtcttg

SEQ ID NO: 528274 - DNA, 25 bp, Rattus norvegicus
gatcctaggagcttgcgggtgcctc

SEQ ID NO: 528275 - DNA, 25 bp, Rattus norvegicus
ggtcctccatagttgttgccctcga

SEQ ID NO: 528276 - DNA, 25 bp, Rattus norvegicus
catatactacgcatgcgcaagcgca

SEQ ID NO: 528277 - DNA, 25 bp, Rattus norvegicus
gcgctccatcactacatatactacg

SEQ ID NO: 528278 - DNA, 25 bp, Rattus norvegicus
ggtcagcgctccatcactacatata

SEQ ID NO: 528279 - DNA, 25 bp, Rattus norvegicus
gacagcagccaattagtcctccgtg

SEQ ID NO: 528280 - DNA, 25 bp, Rattus norvegicus
cttggacgcagacagcagccaatta

SEQ ID NO: 528281 - DNA, 25 bp, Rattus norvegicus
ctccctgttcccgttccgtgcattc

SEQ ID NO: 528282 - DNA, 25 bp, Rattus norvegicus
ccttaaacctccttggacgcagaca

SEQ ID NO: 528283 - DNA, 25 bp, Rattus norvegicus
tcagctgtttctccaaacccttaaa

SEQ ID NO: 528284 - DNA, 25 bp, Rattus norvegicus
gttccgtgcattcctccgggtccta

SEQ ID NO: 528285 - DNA, 25 bp, Rattus norvegicus
tccatagttgttgccctcgatcgcc

SEQ ID NO: 528286 - DNA, 25 bp, Rattus norvegicus
cctctggtcctccatagttgttgcc

SEQ ID NO: 528287 - DNA, 25 bp, Rattus norvegicus
catgcgcaagcgcaagcgaccggcg

SEQ ID NO: 528288 - DNA, 25 bp, Rattus norvegicus
tgctgcgggtccctctcagctgttt

SEQ ID NO: 528289 - DNA, 25 bp, Rattus norvegicus
tctctgtagaaacatctagacgctg

SEQ ID NO: 528290 - DNA, 25 bp, Rattus norvegicus
cctcgcacattacactctctgtaga

SEQ ID NO: 528291 - DNA, 25 bp, Rattus norvegicus
cgctgagcacttacgtttaaaactt

SEQ ID NO: 528292 - DNA, 25 bp, Rattus norvegicus
cgacatcttcgcttcctgttcaacg

SEQ ID NO: 528293 - DNA, 25 bp, Rattus norvegicus
gttctcttagtcctcgtggagtttc

SEQ ID NO: 528294 - DNA, 25 bp, Rattus norvegicus
acttcctcagccgtcttactggttg

SEQ ID NO: 528295 - DNA, 25 bp, Rattus norvegicus
tcaggagcctcagtgtcgccacttc

SEQ ID NO: 528296 - DNA, 25 bp, Rattus norvegicus
cccgctttaccattctcattggctg

SEQ ID NO: 528297 - DNA, 25 bp, Rattus norvegicus
cattggctgcaatctttgtcgatcc

SEQ ID NO: 528298 - DNA, 25 bp, Rattus norvegicus
gtcgatccaaatcgtgtgtgctttc

SEQ ID NO: 528299 - DNA, 25 bp, Rattus norvegicus
gtgtgctttcgttcccttccgagtg

SEQ ID NO: 528300 - DNA, 25 bp, Rattus norvegicus
cgctagataaaggttccgggacatg

SEQ ID NO: 528301 - DNA, 25 bp, Rattus norvegicus
tggagtttctcggatcaggagcctc

SEQ ID NO: 528302 - DNA, 25 bp, Rattus norvegicus
tactggttggtgcttacccgcttta

SEQ ID NO: 528303 - DNA, 25 bp, Rattus norvegicus
tgcacctcccaagcggaagcggggc

SEQ ID NO: 528304 - DNA, 25 bp, Rattus norvegicus
ggtgtgattccgtttgttcctctga

SEQ ID NO: 528305 - DNA, 25 bp, Rattus norvegicus
atccgttgctgacgtcatcatgaag

SEQ ID NO: 528306 - DNA, 25 bp, Rattus norvegicus
cttgtgtgaaaaatatccgttgctg

SEQ ID NO: 528307 - DNA, 25 bp, Rattus norvegicus
tgcgcatagtatggggaacgggcct

SEQ ID NO: 528308 - DNA, 25 bp, Rattus norvegicus
aagcggggcgtcctacggcttagat

SEQ ID NO: 528309 - DNA, 25 bp, Rattus norvegicus
ttcctctgaggtccctgcacctccc

SEQ ID NO: 528310 - DNA, 25 bp, Rattus norvegicus
tgaaccggcggccagactcgaagcc

SEQ ID NO: 528311 - DNA, 25 bp, Rattus norvegicus
tcctacggcttagatcccctggctg

SEQ ID NO: 528312 - DNA, 25 bp, Rattus norvegicus
ccatggtgagcagggccgacgtccc

SEQ ID NO: 528313 - DNA, 25 bp, Rattus norvegicus
ctcgaagcccggtgtgattccgttt

SEQ ID NO: 528314 - DNA, 25 bp, Rattus norvegicus
atccacgccatggtgagcagggccg

SEQ ID NO: 528315 - DNA, 25 bp, Rattus norvegicus
attcgggatccacgccatggtgagc

SEQ ID NO: 528316 - DNA, 25 bp, Rattus norvegicus
ggcgattcgggatccacgccatggt

SEQ ID NO: 528317 - DNA, 25 bp, Rattus norvegicus
gccgagtccgcagtgtctacagctt

SEQ ID NO: 528318 - DNA, 25 bp, Rattus norvegicus
ctacagcttggggaacgtgaccacc

SEQ ID NO: 528319 - DNA, 25 bp, Rattus norvegicus
gccagaggctccactgcacaagttc

SEQ ID NO: 528320 - DNA, 25 bp, Rattus norvegicus
ttcagcctcgtggaagcggtgaacc

SEQ ID NO: 528321 - DNA, 25 bp, Rattus norvegicus
atgcacacactcacaggcggcgtag

SEQ ID NO: 528322 - DNA, 25 bp, Rattus norvegicus
agcgcgatgcccagcagaagcttca

SEQ ID NO: 528323 - DNA, 25 bp, Rattus norvegicus
gcttcatcttcctgcggttgactga

SEQ ID NO: 528324 - DNA, 25 bp, Rattus norvegicus
tgccggctaaaccactgcgcttgcg

SEQ ID NO: 528325 - DNA, 25 bp, Rattus norvegicus
ttcccgcaagcgcagtgtgatgcct

SEQ ID NO: 528326 - DNA, 25 bp, Rattus norvegicus
tcccagtgtgcttgcctgcattcga

SEQ ID NO: 528327 - DNA, 25 bp, Rattus norvegicus
atcgcggatgttcgcccgcaacttg

SEQ ID NO: 528328 - DNA, 25 bp, Rattus norvegicus
ttcgagctggtgtcagtcaacaagg

SEQ ID NO: 528329 - DNA, 25 bp, Rattus norvegicus
cagcgtttgatgcttagagcggatc

SEQ ID NO: 528330 - DNA, 25 bp, Rattus norvegicus
gcattcgatcataggacagcgtttg

SEQ ID NO: 528331 - DNA, 25 bp, Rattus norvegicus
tgctatctgatgacattcttagctt

SEQ ID NO: 528332 - DNA, 25 bp, Rattus norvegicus
ggattttttctatggccccacgatg

SEQ ID NO: 528333 - DNA, 25 bp, Rattus norvegicus
cccacgatgctatctgatgacattc

SEQ ID NO: 528334 - DNA, 25 bp, Rattus norvegicus
tcttagcttttggattggtggtagc

SEQ ID NO: 528335 - DNA, 25 bp, Rattus norvegicus
ttcttagcttttggattggtggtag

SEQ ID NO: 528336 - DNA, 25 bp, Rattus norvegicus
attcttagcttttggattggtggta

SEQ ID NO: 528337 - DNA, 25 bp, Rattus norvegicus
acattcttagcttttggattggtgg

SEQ ID NO: 528338 - DNA, 25 bp, Rattus norvegicus
cattcttagcttttggattggtggt

SEQ ID NO: 528339 - DNA, 25 bp, Rattus norvegicus
gacattcttagcttttggattggtg

SEQ ID NO: 528340 - DNA, 25 bp, Rattus norvegicus
gatgctatctgatgacattcttagc

SEQ ID NO: 528341 - DNA, 25 bp, Rattus norvegicus
cgatgctatctgatgacattcttag

SEQ ID NO: 528342 - DNA, 25 bp, Rattus norvegicus
acgatgctatctgatgacattctta

SEQ ID NO: 528343 - DNA, 25 bp, Rattus norvegicus
ccacgatgctatctgatgacattct

SEQ ID NO: 528344 - DNA, 25 bp, Rattus norvegicus
cacgatgctatctgatgacattctt

SEQ ID NO: 528345 - DNA, 25 bp, Rattus norvegicus
cgatgctatctgatgacattcttag

SEQ ID NO: 528346 - DNA, 25 bp, Rattus norvegicus
ggattttttctatggccccacgatg

SEQ ID NO: 528347 - DNA, 25 bp, Rattus norvegicus
gacattcttagcttttggattggtg

SEQ ID NO: 528348 - DNA, 25 bp, Rattus norvegicus
ttcttagcttttggattggtggtag

SEQ ID NO: 528349 - DNA, 25 bp, Rattus norvegicus
tctctgacatagattagttttgaca

SEQ ID NO: 528350 - DNA, 25 bp, Rattus norvegicus
acatagattagttttgacaaagagg

SEQ ID NO: 528351 - DNA, 25 bp, Rattus norvegicus
tgacaaagaggtaggcaaagaattc

SEQ ID NO: 528352 - DNA, 25 bp, Rattus norvegicus
caaagaggtaggcaaagaattctgg

SEQ ID NO: 528353 - DNA, 25 bp, Rattus norvegicus
caggtaagtagcctctggatgagaa

SEQ ID NO: 528354 - DNA, 25 bp, Rattus norvegicus
aagtagcctctggatgagaaacatt

SEQ ID NO: 528355 - DNA, 25 bp, Rattus norvegicus
cccacgatgctatctgatgacattc

SEQ ID NO: 528356 - DNA, 25 bp, Rattus norvegicus
acattcttagcttttggattggtgg

SEQ ID NO: 528357 - DNA, 25 bp, Rattus norvegicus
tcttagcttttggattggtggtagc

SEQ ID NO: 528358 - DNA, 25 bp, Rattus norvegicus
cacgatgctatctgatgacattctt

SEQ ID NO: 528359 - DNA, 25 bp, Rattus norvegicus
ccgttcaagcgtcgggatcggacct

SEQ ID NO: 528360 - DNA, 25 bp, Rattus norvegicus
cgcgctgcctgagccgttcaagcgt

SEQ ID NO: 528361 - DNA, 25 bp, Rattus norvegicus
cctgagccgttcaagcgtcgggatc

SEQ ID NO: 528362 - DNA, 25 bp, Rattus norvegicus
aagcgcccgctggatccgcgcagcg

SEQ ID NO: 528363 - DNA, 25 bp, Rattus norvegicus
tgtggacactcccacaggcgccctc

SEQ ID NO: 528364 - DNA, 25 bp, Rattus norvegicus
cttaggcggttagggctgcccttcg

SEQ ID NO: 528365 - DNA, 25 bp, Rattus norvegicus
cagcgccgccacaatcgccgccatg

SEQ ID NO: 528366 - DNA, 25 bp, Rattus norvegicus
aaacccgtgtctgcggccggaagcg

SEQ ID NO: 528367 - DNA, 25 bp, Rattus norvegicus
gccctctccgcgtgcaccgcccacg

SEQ ID NO: 528368 - DNA, 25 bp, Rattus norvegicus
tcaagcgtcgggatcggacctgtgc

SEQ ID NO: 528369 - DNA, 25 bp, Rattus norvegicus
gcccacgcggacacagtccagcaga

SEQ ID NO: 528370 - DNA, 25 bp, Rattus norvegicus
gttagggctgcccttcgcgctgcct

SEQ ID NO: 528371 - DNA, 25 bp, Rattus norvegicus
gcttttgcaccgcccggagctcaga

SEQ ID NO: 528372 - DNA, 25 bp, Rattus norvegicus
ccgcgtgttaaaacccgtgtctgcg

SEQ ID NO: 528373 - DNA, 25 bp, Rattus norvegicus
aacgcacgttcgtgtggaacctggc

SEQ ID NO: 528374 - DNA, 25 bp, Rattus norvegicus
cccactaatagggaacgtgagctgg

SEQ ID NO: 528375 - DNA, 25 bp, Rattus norvegicus
cgcaggttcagacatttggtgtatg

SEQ ID NO: 528376 - DNA, 25 bp, Rattus norvegicus
tcagtacgagaggaaccgcaggttc

SEQ ID NO: 528377 - DNA, 25 bp, Rattus norvegicus
caggttagttttaccctactgatga

SEQ ID NO: 528378 - DNA, 25 bp, Rattus norvegicus
gccaatggggcgaagctaccatctg

SEQ ID NO: 528379 - DNA, 25 bp, Rattus norvegicus
tgtcggctcttcctatcattgtgaa

SEQ ID NO: 528380 - DNA, 25 bp, Rattus norvegicus
cgctttttgatccttcgatgtcggc

SEQ ID NO: 528381 - DNA, 25 bp, Rattus norvegicus
gcggccaagcgttcatagcgacgtc

SEQ ID NO: 528382 - DNA, 25 bp, Rattus norvegicus
ttaccacagggataactggcttgtg

SEQ ID NO: 528383 - DNA, 25 bp, Rattus norvegicus
ggggcctcacgatccttctgacctt

SEQ ID NO: 528384 - DNA, 25 bp, Rattus norvegicus
atacagaccgtgaaagcggggcctc

SEQ ID NO: 528385 - DNA, 25 bp, Rattus norvegicus
caccaagcgttggattgttcaccca

SEQ ID NO: 528386 - DNA, 25 bp, Rattus norvegicus
tgccatggtaatcctgctcagtacg

SEQ ID NO: 528387 - DNA, 25 bp, Rattus norvegicus
cccggtccgcgaatgctcaagaaga

SEQ ID NO: 528388 - DNA, 25 bp, Rattus norvegicus
tgcgccttgaagaggcctggccctc

SEQ ID NO: 528389 - DNA, 25 bp, Rattus norvegicus
gccttctctagctatcttcggaaag

SEQ ID NO: 528390 - DNA, 25 bp, Rattus norvegicus
tttacgatctccgaggggcttctcc

SEQ ID NO: 528391 - DNA, 25 bp, Rattus norvegicus
ccggagaaagagacctttgccgata

SEQ ID NO: 528392 - DNA, 25 bp, Rattus norvegicus
gagacctttgccgataccgcagacc

SEQ ID NO: 528393 - DNA, 25 bp, Rattus norvegicus
tctgtcccgcgcctgttgctcgttt

SEQ ID NO: 528394 - DNA, 25 bp, Rattus norvegicus
tgttgctcgtttcccgttgcgtgca

SEQ ID NO: 528395 - DNA, 25 bp, Rattus norvegicus
ttcccgttgcgtgcacggagccctt

SEQ ID NO: 528396 - DNA, 25 bp, Rattus norvegicus
gagcccttggctgctcgtcggtgtt

SEQ ID NO: 528397 - DNA, 25 bp, Rattus norvegicus
ccctcagtgaggaatttgccttctc

SEQ ID NO: 528398 - DNA, 25 bp, Rattus norvegicus
gccttctgcgcgcagcgtttgctct

SEQ ID NO: 528399 - DNA, 25 bp, Rattus norvegicus
tatcttcggaaagggctttacgatc

SEQ ID NO: 528400 - DNA, 25 bp, Rattus norvegicus
gttcgtcccgccctcagtgaggaat

SEQ ID NO: 528401 - DNA, 25 bp, Rattus norvegicus
gctcgctcctctcctacttggataa

SEQ ID NO: 528402 - DNA, 25 bp, Rattus norvegicus
actctagataacctcgggccgatcg

SEQ ID NO: 528403 - DNA, 25 bp, Rattus norvegicus
ggcggctttggtgactctagataac

SEQ ID NO: 528404 - DNA, 25 bp, Rattus norvegicus
ttatggttcctttggtcgctcgctc

SEQ ID NO: 528405 - DNA, 25 bp, Rattus norvegicus
cagtgaaactgcgaatggctcatta

SEQ ID NO: 528406 - DNA, 25 bp, Rattus norvegicus
catgtctaagtacgcacggccggta

SEQ ID NO: 528407 - DNA, 25 bp, Rattus norvegicus
tgtctcaaagattaagccatgcatg

SEQ ID NO: 528408 - DNA, 25 bp, Rattus norvegicus
cctggttgatcctgccagtagcata

SEQ ID NO: 528409 - DNA, 25 bp, Rattus norvegicus
cgctcgcgctccttacctggttgat

SEQ ID NO: 528410 - DNA, 25 bp, Rattus norvegicus
ctagagctaatacatgccgacgggc

SEQ ID NO: 528411 - DNA, 25 bp, Rattus norvegicus
ggggacgcgtgcatttatcagatca

SEQ ID NO: 528412 - DNA, 25 bp, Rattus norvegicus
gaacgtctgccctatcaactttcga

SEQ ID NO: 528413 - DNA, 25 bp, Rattus norvegicus
ttatcagatcaaaaccaacccggtc

SEQ ID NO: 528414 - DNA, 25 bp, Rattus norvegicus
cggcgacgacccattcgaacgtctg

SEQ ID NO: 528415 - DNA, 25 bp, Rattus norvegicus
attcagatctcgctactgcctattg

SEQ ID NO: 528416 - DNA, 25 bp, Rattus norvegicus
gcctattgcaaacccgaggacagcc

SEQ ID NO: 528417 - DNA, 25 bp, Rattus norvegicus
tgcctattgcaaacccgaggacagc

SEQ ID NO: 528418 - DNA, 25 bp, Rattus norvegicus
ctgcctattgcaaacccgaggacag

SEQ ID NO: 528419 - DNA, 25 bp, Rattus norvegicus
actgcctattgcaaacccgaggaca

SEQ ID NO: 528420 - DNA, 25 bp, Rattus norvegicus
tactgcctattgcaaacccgaggac

SEQ ID NO: 528421 - DNA, 25 bp, Rattus norvegicus
ctactgcctattgcaaacccgagga

SEQ ID NO: 528422 - DNA, 25 bp, Rattus norvegicus
gctactgcctattgcaaacccgagg

SEQ ID NO: 528423 - DNA, 25 bp, Rattus norvegicus
cgctactgcctattgcaaacccgag

SEQ ID NO: 528424 - DNA, 25 bp, Rattus norvegicus
tcgctactgcctattgcaaacccga

SEQ ID NO: 528425 - DNA, 25 bp, Rattus norvegicus
gatctcgctactgcctattgcaaac

SEQ ID NO: 528426 - DNA, 25 bp, Rattus norvegicus
tcagatctcgctactgcctattgca

SEQ ID NO: 528427 - DNA, 25 bp, Rattus norvegicus
ttcagatctcgctactgcctattgc

SEQ ID NO: 528428 - DNA, 25 bp, Rattus norvegicus
tattgcaaacccgaggacagcccct

SEQ ID NO: 528429 - DNA, 25 bp, Rattus norvegicus
tggctgccagcgatgtcaccaagca

SEQ ID NO: 528430 - DNA, 25 bp, Rattus norvegicus
ctgtcgtgtgaagtgtgtaagccac

SEQ ID NO: 528431 - DNA, 25 bp, Rattus norvegicus
tgctgtttgacgtgagtgccaccgc

SEQ ID NO: 528432 - DNA, 25 bp, Rattus norvegicus
tgacatcatccctcctcaggtgggg

SEQ ID NO: 528433 - DNA, 25 bp, Rattus norvegicus
tgggcttccctgagcctgaaccgct

SEQ ID NO: 528434 - DNA, 25 bp, Rattus norvegicus
tttgctcaggagtatgcacctgctg

SEQ ID NO: 528435 - DNA, 25 bp, Rattus norvegicus
tgtcaccaagcactacgagctcgtg

SEQ ID NO: 528436 - DNA, 25 bp, Rattus norvegicus
tgctggggacctgtttgacatcatc

SEQ ID NO: 528437 - DNA, 25 bp, Rattus norvegicus
cgacctggtggcttacaagggcaca

SEQ ID NO: 528438 - DNA, 25 bp, Rattus norvegicus
ggcacaggcactaaaatggccctta

SEQ ID NO: 528439 - DNA, 25 bp, Rattus norvegicus
aacttcctgcgtgaggtgagcatca

SEQ ID NO: 528440 - DNA, 25 bp, Rattus norvegicus
aaagtcttcgacttggtcttccaga

SEQ ID NO: 528441 - DNA, 25 bp, Rattus norvegicus
cggaggagtgctatgtctttgctca

SEQ ID NO: 528442 - DNA, 25 bp, Rattus norvegicus
cactccctgtcttgctgtgggccga

SEQ ID NO: 528443 - DNA, 25 bp, Rattus norvegicus
gccacgttgtcgagagacctgctga

SEQ ID NO: 528444 - DNA, 25 bp, Rattus norvegicus
ggatcccagcggtcagcgaactacc

SEQ ID NO: 528445 - DNA, 25 bp, Rattus norvegicus
agcgaactacccacaggaggccgag

SEQ ID NO: 528446 - DNA, 25 bp, Rattus norvegicus
ggaggccgagccatttcccacaatg

SEQ ID NO: 528447 - DNA, 25 bp, Rattus norvegicus
tcccacaatgccgagttccggaagt

SEQ ID NO: 528448 - DNA, 25 bp, Rattus norvegicus
agttccggaagttgcctctcctgga

SEQ ID NO: 528449 - DNA, 25 bp, Rattus norvegicus
tggttccaccgcgtcgctctctatt

SEQ ID NO: 528450 - DNA, 25 bp, Rattus norvegicus
tctctattcgtcacctggaggaagc

SEQ ID NO: 528451 - DNA, 25 bp, Rattus norvegicus
ctcatctgctgcgagtgctgttggc

SEQ ID NO: 528452 - DNA, 25 bp, Rattus norvegicus
gcccggagacactgtgtgctttgta

SEQ ID NO: 528453 - DNA, 25 bp, Rattus norvegicus
aagcgcggctggtgctgtcacctat

SEQ ID NO: 528454 - DNA, 25 bp, Rattus norvegicus
tgggtgacagcctacgtccaaactc

SEQ ID NO: 528455 - DNA, 25 bp, Rattus norvegicus
cgtccaaactcgaaagccacgttgt

SEQ ID NO: 528456 - DNA, 25 bp, Rattus norvegicus
ccttacggattcgtgttggcgttgc

SEQ ID NO: 528457 - DNA, 25 bp, Rattus norvegicus
ggctccacggcttctgcgtctctat

SEQ ID NO: 528458 - DNA, 25 bp, Rattus norvegicus
cggcattctccgagttgctgctaaa

SEQ ID NO: 528459 - DNA, 25 bp, Rattus norvegicus
cttcagcgctggagttgcgcgatca

SEQ ID NO: 528460 - DNA, 25 bp, Rattus norvegicus
tcccgacaggcccagcggctaaggg

SEQ ID NO: 528461 - DNA, 25 bp, Rattus norvegicus
tggggacgagcctttcgagaagctc

SEQ ID NO: 528462 - DNA, 25 bp, Rattus norvegicus
gagcctttcgagaagctccgagatc

SEQ ID NO: 528463 - DNA, 25 bp, Rattus norvegicus
ttgctgctaaagctggagcgcggac

SEQ ID NO: 528464 - DNA, 25 bp, Rattus norvegicus
tgcgtctctatggttgtcagaggtg

SEQ ID NO: 528465 - DNA, 25 bp, Rattus norvegicus
ggcttctgcgtctctatggttgtca

SEQ ID NO: 528466 - DNA, 25 bp, Rattus norvegicus
atctggtcacttttcaagtccgccg

SEQ ID NO: 528467 - DNA, 25 bp, Rattus norvegicus
caggcccagcggctaagggagtcac

SEQ ID NO: 528468 - DNA, 25 bp, Rattus norvegicus
attttgatcgccgtgcggagacagg

SEQ ID NO: 528469 - DNA, 25 bp, Rattus norvegicus
cccgctctgtttcatcaagatcccg

SEQ ID NO: 528470 - DNA, 25 bp, Rattus norvegicus
gctccgagatctggtcacttttcaa

SEQ ID NO: 528471 - DNA, 25 bp, Rattus norvegicus
gcgaagcaccgatctggaaagctga

SEQ ID NO: 528472 - DNA, 25 bp, Rattus norvegicus
gccgctcccttctgagaactgattg

SEQ ID NO: 528473 - DNA, 25 bp, Rattus norvegicus
ggccggtagcctaactgaatctaaa

SEQ ID NO: 528474 - DNA, 25 bp, Rattus norvegicus
aacaccgggtaccagggctacagag

SEQ ID NO: 528475 - DNA, 25 bp, Rattus norvegicus
tagtaaggcgaacgactctcctgcc

SEQ ID NO: 528476 - DNA, 25 bp, Rattus norvegicus
gacagctgcctgttagcgcgagaca

SEQ ID NO: 528477 - DNA, 25 bp, Rattus norvegicus
gttcaccgcaggtacctagtaaggc

SEQ ID NO: 528478 - DNA, 25 bp, Rattus norvegicus
cgcgagacaggtacacagcctcttt

SEQ ID NO: 528479 - DNA, 25 bp, Rattus norvegicus
tccgtgctgttctacgaggtgtgca

SEQ ID NO: 528480 - DNA, 25 bp, Rattus norvegicus
aggtgtgcacgcgttcttggcttcc

SEQ ID NO: 528481 - DNA, 25 bp, Rattus norvegicus
cgcgtccaggagacagagtcccgaa

SEQ ID NO: 528482 - DNA, 25 bp, Rattus norvegicus
acagagtcccgaacgtccgcgcgtt

SEQ ID NO: 528483 - DNA, 25 bp, Rattus norvegicus
gcgcgttccaaagccacggtctcga

SEQ ID NO: 528484 - DNA, 25 bp, Rattus norvegicus
actgaatctaaagtcggggaggccg

SEQ ID NO: 528485 - DNA, 25 bp, Rattus norvegicus
actgtcctctcgtgactctactttg

SEQ ID NO: 528486 - DNA, 25 bp, Rattus norvegicus
atagggggaggctgtcacctgccaa

SEQ ID NO: 528487 - DNA, 25 bp, Rattus norvegicus
acccggtcgacaccagcgatagggg

SEQ ID NO: 528488 - DNA, 25 bp, Rattus norvegicus
cggggacccggtcgacaccagcgat

SEQ ID NO: 528489 - DNA, 25 bp, Rattus norvegicus
gcccagatgcccctaaggaaagccg

SEQ ID NO: 528490 - DNA, 25 bp, Rattus norvegicus
aggcaacgcgcacccagcccagatg

SEQ ID NO: 528491 - DNA, 25 bp, Rattus norvegicus
agccagaataaaatgggtccccaag

SEQ ID NO: 528492 - DNA, 25 bp, Rattus norvegicus
agaaaaatcaactgagccagaataa

SEQ ID NO: 528493 - DNA, 25 bp, Rattus norvegicus
ggttcacctgacactctgcagcaac

SEQ ID NO: 528494 - DNA, 25 bp, Rattus norvegicus
gatgcggttcacctgacactctgca

SEQ ID NO: 528495 - DNA, 25 bp, Rattus norvegicus
accgggatgcggttcacctgacact

SEQ ID NO: 528496 - DNA, 25 bp, Rattus norvegicus
gactctactttgacgcaccgggatg

SEQ ID NO: 528497 - DNA, 25 bp, Rattus norvegicus
agcatccgcccactgtcctctcgtg

SEQ ID NO: 528498 - DNA, 25 bp, Rattus norvegicus
ttgacgcaccgggatgcggttcacc

SEQ ID NO: 528499 - DNA, 25 bp, Rattus norvegicus
ccgagaactgctgctcggcagcgga

SEQ ID NO: 528500 - DNA, 25 bp, Rattus norvegicus
ggcctcttagcggagcggttgtccc

SEQ ID NO: 528501 - DNA, 25 bp, Rattus norvegicus
actgctgctcggcagcggaactgtg

SEQ ID NO: 528502 - DNA, 25 bp, Rattus norvegicus
agcatgcggacagccctgtgcggac

SEQ ID NO: 528503 - DNA, 25 bp, Rattus norvegicus
gcgaaggaagcatgcggacagccct

SEQ ID NO: 528504 - DNA, 25 bp, Rattus norvegicus
ccacgggaatgagtcggcgaaggaa

SEQ ID NO: 528505 - DNA, 25 bp, Rattus norvegicus
ctgaaggacggtgccacgggaatga

SEQ ID NO: 528506 - DNA, 25 bp, Rattus norvegicus
caagatgtgaatgcggctgaaggac

SEQ ID NO: 528507 - DNA, 25 bp, Rattus norvegicus
gctcctccgtagcaagatgtgaatg

SEQ ID NO: 528508 - DNA, 25 bp, Rattus norvegicus
cccgctcctccgtagcaagatgtga

SEQ ID NO: 528509 - DNA, 25 bp, Rattus norvegicus
tgtcccgctcctccgtagcaagatg

SEQ ID NO: 528510 - DNA, 25 bp, Rattus norvegicus
cttagcggagcggttgtcccgctcc

SEQ ID NO: 528511 - DNA, 25 bp, Rattus norvegicus
acttgcaaagatggcggtgatcggt

SEQ ID NO: 528512 - DNA, 25 bp, Rattus norvegicus
ctccgtagcaagatgtgaatgcggc

SEQ ID NO: 528513 - DNA, 25 bp, Rattus norvegicus
ggtagttcccaggtatgcactggac

SEQ ID NO: 528514 - DNA, 25 bp, Rattus norvegicus
cggggtagttcccaggtatgcactg

SEQ ID NO: 528515 - DNA, 25 bp, Rattus norvegicus
gtagttcccaggtatgcactggaca

SEQ ID NO: 528516 - DNA, 25 bp, Rattus norvegicus
tagttcccaggtatgcactggacag

SEQ ID NO: 528517 - DNA, 25 bp, Rattus norvegicus
gggtagttcccaggtatgcactgga

SEQ ID NO: 528518 - DNA, 25 bp, Rattus norvegicus
atggccagcacctcgggcagctcag

SEQ ID NO: 528519 - DNA, 25 bp, Rattus norvegicus
ggacctcattgtcacgggcagcccg

SEQ ID NO: 528520 - DNA, 25 bp, Rattus norvegicus
atggcagccttgttgtcggcatcgc

SEQ ID NO: 528521 - DNA, 25 bp, Rattus norvegicus
tgttgtcggcatcgcggccatagga

SEQ ID NO: 528522 - DNA, 25 bp, Rattus norvegicus
ccataggagaggttgcgcagtgccc

SEQ ID NO: 528523 - DNA, 25 bp, Rattus norvegicus
acctcagcccgagggtgatctagta

SEQ ID NO: 528524 - DNA, 25 bp, Rattus norvegicus
gggtgatctagtaacgccacgagta

SEQ ID NO: 528525 - DNA, 25 bp, Rattus norvegicus
taacgccacgagtaggggcagccca

SEQ ID NO: 528526 - DNA, 25 bp, Rattus norvegicus
acgcttgatgccctcgttctcaaag

SEQ ID NO: 528527 - DNA, 25 bp, Rattus norvegicus
ctcgttctcaaagcagaggtgctgc

SEQ ID NO: 528528 - DNA, 25 bp, Rattus norvegicus
gctttcacagggtccacggggtgcc

SEQ ID NO: 528529 - DNA, 25 bp, Rattus norvegicus
ctccttgcgggtgctgtctactgag

SEQ ID NO: 528530 - DNA, 25 bp, Rattus norvegicus
tactgagggtgagcgccgcactact

SEQ ID NO: 528531 - DNA, 25 bp, Rattus norvegicus
taggctgcggcgttggctttcacag

SEQ ID NO: 528532 - DNA, 25 bp, Rattus norvegicus
tctgaatggggaggaacaacgtcga

SEQ ID NO: 528533 - DNA, 25 bp, Rattus norvegicus
gcactccgggttataatcaactcgg

SEQ ID NO: 528534 - DNA, 25 bp, Rattus norvegicus
cactccgggttataatcaactcggg

SEQ ID NO: 528535 - DNA, 25 bp, Rattus norvegicus
ttctgaatggggaggaacaacgtcg

SEQ ID NO: 528536 - DNA, 25 bp, Rattus norvegicus
tttctgaatggggaggaacaacgtc

SEQ ID NO: 528537 - DNA, 25 bp, Rattus norvegicus
agtgactcctgaagtagcaaaatta

SEQ ID NO: 528538 - DNA, 25 bp, Rattus norvegicus
tgaagtagcaaaattaatggaaagg

SEQ ID NO: 528539 - DNA, 25 bp, Rattus norvegicus
gtagcaaaattaatggaaagggcaa

SEQ ID NO: 528540 - DNA, 25 bp, Rattus norvegicus
ctgaagtagcaaaattaatggaaag

SEQ ID NO: 528541 - DNA, 25 bp, Rattus norvegicus
cctgaagtagcaaaattaatggaaa

SEQ ID NO: 528542 - DNA, 25 bp, Rattus norvegicus
tcctgaagtagcaaaattaatggaa

SEQ ID NO: 528543 - DNA, 25 bp, Rattus norvegicus
actcctgaagtagcaaaattaatgg

SEQ ID NO: 528544 - DNA, 25 bp, Rattus norvegicus
tagcaaaattaatggaaagggcaaa

SEQ ID NO: 528545 - DNA, 25 bp, Rattus norvegicus
gtgactcctgaagtagcaaaattaa

SEQ ID NO: 528546 - DNA, 25 bp, Rattus norvegicus
aagtgactcctgaagtagcaaaatt

SEQ ID NO: 528547 - DNA, 25 bp, Rattus norvegicus
agtagcaaaattaatggaaagggca

SEQ ID NO: 528548 - DNA, 25 bp, Rattus norvegicus
ctcctgaagtagcaaaattaatgga

SEQ ID NO: 528549 - DNA, 25 bp, Rattus norvegicus
tgactcctgaagtagcaaaattaat

SEQ ID NO: 528550 - DNA, 25 bp, Rattus norvegicus
gactcctgaagtagcaaaattaatg

SEQ ID NO: 528551 - DNA, 25 bp, Rattus norvegicus
gaccgaagctgggaagctgcaagcc

SEQ ID NO: 528552 - DNA, 25 bp, Rattus norvegicus
ccggctccagagcagacaatagctg

SEQ ID NO: 528553 - DNA, 25 bp, Rattus norvegicus
tcgctctttggggaggggccattaa

SEQ ID NO: 528554 - DNA, 25 bp, Rattus norvegicus
ggggccattaagaaggctcagtgcc

SEQ ID NO: 528555 - DNA, 25 bp, Rattus norvegicus
gaccaagaccagcagccaatcggga

SEQ ID NO: 528556 - DNA, 25 bp, Rattus norvegicus
gagtcaccctcgattccagtgcagg

SEQ ID NO: 528557 - DNA, 25 bp, Rattus norvegicus
gggctggctgctcgccgaaacaaaa

SEQ ID NO: 528558 - DNA, 25 bp, Rattus norvegicus
tgctcgccgaaacaaaagcgggtct

SEQ ID NO: 528559 - DNA, 25 bp, Rattus norvegicus
tcttcccgggtaggccagggcctca

SEQ ID NO: 528560 - DNA, 25 bp, Rattus norvegicus
accgagttctttccaacctgtctga

SEQ ID NO: 528561 - DNA, 25 bp, Rattus norvegicus
aacctgtctgagttcggccggcatt

SEQ ID NO: 528562 - DNA, 25 bp, Rattus norvegicus
ttcggccggcattggaccgaagctg

SEQ ID NO: 528563 - DNA, 25 bp, Rattus norvegicus
gcggacctggcagcgaccaagacca

SEQ ID NO: 528564 - DNA, 25 bp, Rattus norvegicus
tgtcccacagacgaaggggtgcacc

SEQ ID NO: 528565 - DNA, 25 bp, Rattus norvegicus
ctcccgtggccgagatgatgcccaa

SEQ ID NO: 528566 - DNA, 25 bp, Rattus norvegicus
tcccgtggccgagatgatgcccaac

SEQ ID NO: 528567 - DNA, 25 bp, Rattus norvegicus
cccgtggccgagatgatgcccaacg

SEQ ID NO: 528568 - DNA, 25 bp, Rattus norvegicus
ccgtggccgagatgatgcccaacgc

SEQ ID NO: 528569 - DNA, 25 bp, Rattus norvegicus
cgtggccgagatgatgcccaacgcc

SEQ ID NO: 528570 - DNA, 25 bp, Rattus norvegicus
tgcagcttggacattgtcattgtgg

SEQ ID NO: 528571 - DNA, 25 bp, Rattus norvegicus
caagcctggatgtaccctggcagga

SEQ ID NO: 528572 - DNA, 25 bp, Rattus norvegicus
aagcctggatgtaccctggcaggac

SEQ ID NO: 528573 - DNA, 25 bp, Rattus norvegicus
ccaggcttgcagcttggacattgtc

SEQ ID NO: 528574 - DNA, 25 bp, Rattus norvegicus
caggcttgcagcttggacattgtca

SEQ ID NO: 528575 - DNA, 25 bp, Rattus norvegicus
aggcttgcagcttggacattgtcat

SEQ ID NO: 528576 - DNA, 25 bp, Rattus norvegicus
ggcttgcagcttggacattgtcatt

SEQ ID NO: 528577 - DNA, 25 bp, Rattus norvegicus
gcttgcagcttggacattgtcattg

SEQ ID NO: 528578 - DNA, 25 bp, Rattus norvegicus
cttgcagcttggacattgtcattgt

SEQ ID NO: 528579 - DNA, 25 bp, Rattus norvegicus
ttgcagcttggacattgtcattgtg

SEQ ID NO: 528580 - DNA, 25 bp, Rattus norvegicus
tctaggcgctttacccagctcgatc

SEQ ID NO: 528581 - DNA, 25 bp, Rattus norvegicus
tgactccgcatctcagtctaggcgc

SEQ ID NO: 528582 - DNA, 25 bp, Rattus norvegicus
tgcggggacattcccttggcatcac

SEQ ID NO: 528583 - DNA, 25 bp, Rattus norvegicus
cctgagtcccttaaagtttccatag

SEQ ID NO: 528584 - DNA, 25 bp, Rattus norvegicus
gtttccatagtcgtcaggtccctgc

SEQ ID NO: 528585 - DNA, 25 bp, Rattus norvegicus
gtccctgcttgcaggcgctgcagtg

SEQ ID NO: 528586 - DNA, 25 bp, Rattus norvegicus
tcgtaaagggccctgaggtcatgga

SEQ ID NO: 528587 - DNA, 25 bp, Rattus norvegicus
aggtcatggacaaagggactcgccc

SEQ ID NO: 528588 - DNA, 25 bp, Rattus norvegicus
ccggtgagcagaagaaccggcttct

SEQ ID NO: 528589 - DNA, 25 bp, Rattus norvegicus
ttcctattggtagagagacgcgccc

SEQ ID NO: 528590 - DNA, 25 bp, Rattus norvegicus
catccaaccgcgaattttcctattg

SEQ ID NO: 528591 - DNA, 25 bp, Rattus norvegicus
ttggcatcaccagggtcttgccctg

SEQ ID NO: 528592 - DNA, 25 bp, Rattus norvegicus
ccagtcctggcctggacccgagtgt

SEQ ID NO: 528593 - DNA, 25 bp, Rattus norvegicus
ccggggccacaacttatgcgggtgc

SEQ ID NO: 528594 - DNA, 25 bp, Rattus norvegicus
ttgggaacccactcaattcgccatg

SEQ ID NO: 528595 - DNA, 25 bp, Rattus norvegicus
caattcgccatgatacttggatttc

SEQ ID NO: 528596 - DNA, 25 bp, Rattus norvegicus
ctcaattcgccatgatacttggatt

SEQ ID NO: 528597 - DNA, 25 bp, Rattus norvegicus
cactcaattcgccatgatacttgga

SEQ ID NO: 528598 - DNA, 25 bp, Rattus norvegicus
acccactcaattcgccatgatactt

SEQ ID NO: 528599 - DNA, 25 bp, Rattus norvegicus
tcctattgggaacccactcaattcg

SEQ ID NO: 528600 - DNA, 25 bp, Rattus norvegicus
tgggaacccactcaattcgccatga

SEQ ID NO: 528601 - DNA, 25 bp, Rattus norvegicus
tattgggaacccactcaattcgcca

SEQ ID NO: 528602 - DNA, 25 bp, Rattus norvegicus
tcgccatgatacttggatttcgttc

SEQ ID NO: 528603 - DNA, 25 bp, Rattus norvegicus
gatttcgttccttaaaatattgctc

SEQ ID NO: 528604 - DNA, 25 bp, Rattus norvegicus
ggaacccactcaattcgccatgata

SEQ ID NO: 528605 - DNA, 25 bp, Rattus norvegicus
tggatttcgttccttaaaatattgc

SEQ ID NO: 528606 - DNA, 25 bp, Rattus norvegicus
gccatgatacttggatttcgttcct

SEQ ID NO: 528607 - DNA, 25 bp, Rattus norvegicus
cgccatgatacttggatttcgttcc

SEQ ID NO: 528608 - DNA, 25 bp, Rattus norvegicus
caaatttgaaggtgtgaataagtcc

SEQ ID NO: 528609 - DNA, 25 bp, Rattus norvegicus
tttgaaggtgtgaataagtcccagt

SEQ ID NO: 528610 - DNA, 25 bp, Rattus norvegicus
ggctagccatacatttaccatatcc

SEQ ID NO: 528611 - DNA, 25 bp, Rattus norvegicus
tctgaaaagttcagcaaatttgaag

SEQ ID NO: 528612 - DNA, 25 bp, Rattus norvegicus
acgttagaaatctgaaaagttcagc

SEQ ID NO: 528613 - DNA, 25 bp, Rattus norvegicus
ttgccacaaacgttagaaatctgaa

SEQ ID NO: 528614 - DNA, 25 bp, Rattus norvegicus
gcttttgccactcagtttgccacaa

SEQ ID NO: 528615 - DNA, 25 bp, Rattus norvegicus
agtgctcaacattcattgcttttgc

SEQ ID NO: 528616 - DNA, 25 bp, Rattus norvegicus
cccagggaagtgctcaacattcatt

SEQ ID NO: 528617 - DNA, 25 bp, Rattus norvegicus
acccttagctccatatgcactggac

SEQ ID NO: 528618 - DNA, 25 bp, Rattus norvegicus
tacacccttagctccatatgcactg

SEQ ID NO: 528619 - DNA, 25 bp, Rattus norvegicus
tttaccatatccatacacccttagc

SEQ ID NO: 528620 - DNA, 25 bp, Rattus norvegicus
gcaggctagccatacatttaccata

SEQ ID NO: 528621 - DNA, 25 bp, Rattus norvegicus
ttcattgcttttgccactcagtttg

SEQ ID NO: 528622 - DNA, 25 bp, Rattus norvegicus
agcaaggatcctccgccttgcatct

SEQ ID NO: 528623 - DNA, 25 bp, Rattus norvegicus
cacaaagctcccactgaaggactgc

SEQ ID NO: 528624 - DNA, 25 bp, Rattus norvegicus
agggtgcatgcagcaaggatcctcc

SEQ ID NO: 528625 - DNA, 25 bp, Rattus norvegicus
ttgcatctcgatcgcccgtggctcg

SEQ ID NO: 528626 - DNA, 25 bp, Rattus norvegicus
ctcccagatgcgtgtccctggggca

SEQ ID NO: 528627 - DNA, 25 bp, Rattus norvegicus
ctgcttggcgttgcgctcgcgctct

SEQ ID NO: 528628 - DNA, 25 bp, Rattus norvegicus
accgctgactctgcagctgctgttc

SEQ ID NO: 528629 - DNA, 25 bp, Rattus norvegicus
gaggattcaagtaccgccaccgctg

SEQ ID NO: 528630 - DNA, 25 bp, Rattus norvegicus
acttgggttgccgaggctccttacg

SEQ ID NO: 528631 - DNA, 25 bp, Rattus norvegicus
cgccggagatgagctgaggattcaa

SEQ ID NO: 528632 - DNA, 25 bp, Rattus norvegicus
ttgccgaggctccttacggcccagg

SEQ ID NO: 528633 - DNA, 25 bp, Rattus norvegicus
gcagctgctgttctccaagctcagc

SEQ ID NO: 528634 - DNA, 25 bp, Rattus norvegicus
accgagccagctgctcatggcggga

SEQ ID NO: 528635 - DNA, 25 bp, Rattus norvegicus
gccagctgctcatggcgggaacttg

SEQ ID NO: 528636 - DNA, 25 bp, Rattus norvegicus
cgcgaggtgtgcacgggacactcgt

SEQ ID NO: 528637 - DNA, 25 bp, Rattus norvegicus
cacagggcagtgacgagatctgcac

SEQ ID NO: 528638 - DNA, 25 bp, Rattus norvegicus
cagtgacgagatctgcacgggacaa

SEQ ID NO: 528639 - DNA, 25 bp, Rattus norvegicus
gacgagatctgcacgggacaatagc

SEQ ID NO: 528640 - DNA, 25 bp, Rattus norvegicus
gcacgtgacagtcgagaggtttgca

SEQ ID NO: 528641 - DNA, 25 bp, Rattus norvegicus
gtgacgagatctgcacgggacaata

SEQ ID NO: 528642 - DNA, 25 bp, Rattus norvegicus
acgtgacagtcgagaggtttgcaca

SEQ ID NO: 528643 - DNA, 25 bp, Rattus norvegicus
ttgcacgtgacagtcgagaggtttg

SEQ ID NO: 528644 - DNA, 25 bp, Rattus norvegicus
cgaggtttgcacgtgacagtcgaga

SEQ ID NO: 528645 - DNA, 25 bp, Rattus norvegicus
ctcgaggtttgcacgtgacagtcga

SEQ ID NO: 528646 - DNA, 25 bp, Rattus norvegicus
ctgcccgagccattcgcgaggtctg

SEQ ID NO: 528647 - DNA, 25 bp, Rattus norvegicus
tctgcccgagccattcgcgaggtct

SEQ ID NO: 528648 - DNA, 25 bp, Rattus norvegicus
gactctgcccgagccattcgcgagg

SEQ ID NO: 528649 - DNA, 25 bp, Rattus norvegicus
acagtcgagaggtttgcacagggca

SEQ ID NO: 528650 - DNA, 25 bp, Rattus norvegicus
tacggccaacaagaccacggctgtg

SEQ ID NO: 528651 - DNA, 25 bp, Rattus norvegicus
ctgcgctcaatagggagcgctctgg

SEQ ID NO: 528652 - DNA, 25 bp, Rattus norvegicus
aggtcgaggcggttctcaccttctc

SEQ ID NO: 528653 - DNA, 25 bp, Rattus norvegicus
cttggaacgcggtctggaccaggtt

SEQ ID NO: 528654 - DNA, 25 bp, Rattus norvegicus
gctccgggctcttggaacgcggtct

SEQ ID NO: 528655 - DNA, 25 bp, Rattus norvegicus
gctggggctagcagtctgcgctcct

SEQ ID NO: 528656 - DNA, 25 bp, Rattus norvegicus
acaagaccacggctgtgggttcggc

SEQ ID NO: 528657 - DNA, 25 bp, Rattus norvegicus
gcgacagcacttacggccaacaaga

SEQ ID NO: 528658 - DNA, 25 bp, Rattus norvegicus
tctctgagcgacagcacttacggcc

SEQ ID NO: 528659 - DNA, 25 bp, Rattus norvegicus
ctggatctctgagcgacagcactta

SEQ ID NO: 528660 - DNA, 25 bp, Rattus norvegicus
agctccagtcttggcgcagctgccg

SEQ ID NO: 528661 - DNA, 25 bp, Rattus norvegicus
ttggcgcagctccagtcttggcgca

SEQ ID NO: 528662 - DNA, 25 bp, Rattus norvegicus
caccgctccagccttggcgcagctc

SEQ ID NO: 528663 - DNA, 25 bp, Rattus norvegicus
ctcgctactgcgctcaatagggagc

SEQ ID NO: 528664 - DNA, 25 bp, Rattus norvegicus
cgtgctacactgacttacacaggtg

SEQ ID NO: 528665 - DNA, 25 bp, Rattus norvegicus
tctgggatgcccttacatgtccagg

SEQ ID NO: 528666 - DNA, 25 bp, Rattus norvegicus
ggtggagcgcgtcgaacttgactat

SEQ ID NO: 528667 - DNA, 25 bp, Rattus norvegicus
ctacactgacttacacaggtggcgc

SEQ ID NO: 528668 - DNA, 25 bp, Rattus norvegicus
acactgacttacacaggtggcgcgg

SEQ ID NO: 528669 - DNA, 25 bp, Rattus norvegicus
tgctacactgacttacacaggtggc

SEQ ID NO: 528670 - DNA, 25 bp, Rattus norvegicus
cgcgtgctacactgacttacacagg

SEQ ID NO: 528671 - DNA, 25 bp, Rattus norvegicus
cacgcgtgctacactgacttacaca

SEQ ID NO: 528672 - DNA, 25 bp, Rattus norvegicus
gcacgcgtgctacactgacttacac

SEQ ID NO: 528673 - DNA, 25 bp, Rattus norvegicus
catgtccagggctgcacgcgtgcta

SEQ ID NO: 528674 - DNA, 25 bp, Rattus norvegicus
acatgtccagggctgcacgcgtgct

SEQ ID NO: 528675 - DNA, 25 bp, Rattus norvegicus
tgggatgcccttacatgtccagggc

SEQ ID NO: 528676 - DNA, 25 bp, Rattus norvegicus
gtctgggatgcccttacatgtccag

SEQ ID NO: 528677 - DNA, 25 bp, Rattus norvegicus
ggatgcccttacatgtccagggctg

SEQ ID NO: 528678 - DNA, 25 bp, Rattus norvegicus
ccggcatataggcctgtctcgcgcc

SEQ ID NO: 528679 - DNA, 25 bp, Rattus norvegicus
ccagcagaagcgtgatggcccaccc

SEQ ID NO: 528680 - DNA, 25 bp, Rattus norvegicus
ccacaccagcagaagcgtgatggcc

SEQ ID NO: 528681 - DNA, 25 bp, Rattus norvegicus
cacaccagcagaagcgtgatggccc

SEQ ID NO: 528682 - DNA, 25 bp, Rattus norvegicus
cccacaccagcagaagcgtgatggc

SEQ ID NO: 528683 - DNA, 25 bp, Rattus norvegicus
agcagaagcgtgatggcccaccccg

SEQ ID NO: 528684 - DNA, 25 bp, Rattus norvegicus
ctcccacaccagcagaagcgtgatg

SEQ ID NO: 528685 - DNA, 25 bp, Rattus norvegicus
tacaaccggggcaggtcgctctctc

SEQ ID NO: 528686 - DNA, 25 bp, Rattus norvegicus
gcgtgatggcccaccccggcatata

SEQ ID NO: 528687 - DNA, 25 bp, Rattus norvegicus
ctacaaccggggcaggtcgctctct

SEQ ID NO: 528688 - DNA, 25 bp, Rattus norvegicus
ggcaggcactcgaccgggctgtccc

SEQ ID NO: 528689 - DNA, 25 bp, Rattus norvegicus
cagacgctgcggtatggcaggcggc

SEQ ID NO: 528690 - DNA, 25 bp, Rattus norvegicus
cccgccggcaggcactcgaccgggc

SEQ ID NO: 528691 - DNA, 25 bp, Rattus norvegicus
tcccacaccagcagaagcgtgatgg

SEQ ID NO: 528692 - DNA, 25 bp, Rattus norvegicus
accttaaggcactgggaattcgtag

SEQ ID NO: 528693 - DNA, 25 bp, Rattus norvegicus
agcctggactgagggcacacagagc

SEQ ID NO: 528694 - DNA, 25 bp, Rattus norvegicus
ctggactgagggcacacagagctct

SEQ ID NO: 528695 - DNA, 25 bp, Rattus norvegicus
tggactgagggcacacagagctctt

SEQ ID NO: 528696 - DNA, 25 bp, Rattus norvegicus
cgtgggaccttaaggcactgggaat

SEQ ID NO: 528697 - DNA, 25 bp, Rattus norvegicus
tgggaccttaaggcactgggaattc

SEQ ID NO: 528698 - DNA, 25 bp, Rattus norvegicus
gaccttaaggcactgggaattcgta

SEQ ID NO: 528699 - DNA, 25 bp, Rattus norvegicus
tgagcctggactgagggcacacaga

SEQ ID NO: 528700 - DNA, 25 bp, Rattus norvegicus
ctgcagtggcgcgtgtgcttgggcg

SEQ ID NO: 528701 - DNA, 25 bp, Rattus norvegicus
ccttaaggcactgggaattcgtagg

SEQ ID NO: 528702 - DNA, 25 bp, Rattus norvegicus
ttaaggcactgggaattcgtaggtg

SEQ ID NO: 528703 - DNA, 25 bp, Rattus norvegicus
taaggcactgggaattcgtaggtga

SEQ ID NO: 528704 - DNA, 25 bp, Rattus norvegicus
aggcactgggaattcgtaggtgagc

SEQ ID NO: 528705 - DNA, 25 bp, Rattus norvegicus
gcagtggcgcgtgtgcttgggcgtg

SEQ ID NO: 528706 - DNA, 25 bp, Rattus norvegicus
gacatggatgacaaggcgctcgcag

SEQ ID NO: 528707 - DNA, 25 bp, Rattus norvegicus
gcagcaggtggcatgaggactgcga

SEQ ID NO: 528708 - DNA, 25 bp, Rattus norvegicus
tggatgacaaggcgctcgcagaccc

SEQ ID NO: 528709 - DNA, 25 bp, Rattus norvegicus
catggatgacaaggcgctcgcagac

SEQ ID NO: 528710 - DNA, 25 bp, Rattus norvegicus
gcgagcggcgctggaggacatggat

SEQ ID NO: 528711 - DNA, 25 bp, Rattus norvegicus
aggacatggatgacaaggcgctcgc

SEQ ID NO: 528712 - DNA, 25 bp, Rattus norvegicus
ggacatggatgacaaggcgctcgca

SEQ ID NO: 528713 - DNA, 25 bp, Rattus norvegicus
acatggatgacaaggcgctcgcaga

SEQ ID NO: 528714 - DNA, 25 bp, Rattus norvegicus
cgggaatacctgggcccggcgcgct

SEQ ID NO: 528715 - DNA, 25 bp, Rattus norvegicus
ttcgtcttctttcgttggccgcctc

SEQ ID NO: 528716 - DNA, 25 bp, Rattus norvegicus
ggtgtctaggacttcccttgaactg

SEQ ID NO: 528717 - DNA, 25 bp, Rattus norvegicus
ctaggacttcccttgaactggcgtc

SEQ ID NO: 528718 - DNA, 25 bp, Rattus norvegicus
ttgaactggcgtcgtgccaagaggc

SEQ ID NO: 528719 - DNA, 25 bp, Rattus norvegicus
tcgtgccaagaggcgtgccaaggat

SEQ ID NO: 528720 - DNA, 25 bp, Rattus norvegicus
aggcgtgccaaggatggcagagttc

SEQ ID NO: 528721 - DNA, 25 bp, Rattus norvegicus
ttctagttggttccaagcgcgttcg

SEQ ID NO: 528722 - DNA, 25 bp, Rattus norvegicus
tcttctttcgttggccgcctctgaa

SEQ ID NO: 528723 - DNA, 25 bp, Rattus norvegicus
ccagtttggtgtctaggacttccct

SEQ ID NO: 528724 - DNA, 25 bp, Rattus norvegicus
cgcgacccataaaccagtttggtgt

SEQ ID NO: 528725 - DNA, 25 bp, Rattus norvegicus
tgaacgcgacccataaaccagtttg

SEQ ID NO: 528726 - DNA, 25 bp, Rattus norvegicus
ctctgaacgcgacccataaaccagt

SEQ ID NO: 528727 - DNA, 25 bp, Rattus norvegicus
ggcagagttctagttggttccaagc

SEQ ID NO: 528728 - DNA, 25 bp, Rattus norvegicus
acttcccttgaactggcgtcgtgcc

SEQ ID NO: 528729 - DNA, 25 bp, Rattus norvegicus
ggtgggcctgaagccatcacctcgc

SEQ ID NO: 528730 - DNA, 25 bp, Rattus norvegicus
tgctgtcggtctggtaacgaagccc

SEQ ID NO: 528731 - DNA, 25 bp, Rattus norvegicus
ccaggcatcacggacgtagggtgct

SEQ ID NO: 528732 - DNA, 25 bp, Rattus norvegicus
gcttgcaaaggccttcgcgggttgc

SEQ ID NO: 528733 - DNA, 25 bp, Rattus norvegicus
cgggtctcaagagccgagagcttgc

SEQ ID NO: 528734 - DNA, 25 bp, Rattus norvegicus
cgccttacaattgggccgcgcgctt

SEQ ID NO: 528735 - DNA, 25 bp, Rattus norvegicus
acgtggcctccatagcgccttacaa

SEQ ID NO: 528736 - DNA, 25 bp, Rattus norvegicus
cagccgttagctgtgcaaggtttgc

SEQ ID NO: 528737 - DNA, 25 bp, Rattus norvegicus
tcaaaagtgctacagaggccggctc

SEQ ID NO: 528738 - DNA, 25 bp, Rattus norvegicus
ccgaaagttggagctcgatggtcca

SEQ ID NO: 528739 - DNA, 25 bp, Rattus norvegicus
gatgggtatacctccaatttagtcc

SEQ ID NO: 528740 - DNA, 25 bp, Rattus norvegicus
ccgttgactttctgggatgggtata

SEQ ID NO: 528741 - DNA, 25 bp, Rattus norvegicus
ggtcctcagcatcgcgcatattgtc

SEQ ID NO: 528742 - DNA, 25 bp, Rattus norvegicus
cactgcgagtaaactccggtcctca

SEQ ID NO: 528743 - DNA, 25 bp, Rattus norvegicus
acacgcaaagaacgctagatactcg

SEQ ID NO: 528744 - DNA, 25 bp, Rattus norvegicus
ttgccatggtaacccgcggcctgtt

SEQ ID NO: 528745 - DNA, 25 bp, Rattus norvegicus
cgaataacgttagttcttagcaccg

SEQ ID NO: 528746 - DNA, 25 bp, Rattus norvegicus
ggctggaccactgcgttcgaagtga

SEQ ID NO: 528747 - DNA, 25 bp, Rattus norvegicus
actgcgttcgaagtgagctgagccc

SEQ ID NO: 528748 - DNA, 25 bp, Rattus norvegicus
caatgcaggaatcgcgcaggcactg

SEQ ID NO: 528749 - DNA, 25 bp, Rattus norvegicus
ccaggtacggaaatacacgcaaaga

SEQ ID NO: 528750 - DNA, 25 bp, Rattus norvegicus
catctgttgccatggtaacccgcgg

SEQ ID NO: 528751 - DNA, 25 bp, Rattus norvegicus
cagcagctctctgtggctccgggtt

SEQ ID NO: 528752 - DNA, 25 bp, Rattus norvegicus
cccacatcgccggtctggatgtgca

SEQ ID NO: 528753 - DNA, 25 bp, Rattus norvegicus
tcccagctatgaggacgtggctccc

SEQ ID NO: 528754 - DNA, 25 bp, Rattus norvegicus
cccgtttatcccagctatgaggacg

SEQ ID NO: 528755 - DNA, 25 bp, Rattus norvegicus
ttagcaccggggcttgccaatgatc

SEQ ID NO: 528756 - DNA, 25 bp, Rattus norvegicus
cccatggacacaccaggtacggaaa

SEQ ID NO: 528757 - DNA, 25 bp, Rattus norvegicus
agacccagaggattccagccgaccg

SEQ ID NO: 528758 - DNA, 25 bp, Rattus norvegicus
tggtcctccaagtgagtctcctgtg

SEQ ID NO: 528759 - DNA, 25 bp, Rattus norvegicus
ggcaagctggagtacctggtcaagt

SEQ ID NO: 528760 - DNA, 25 bp, Rattus norvegicus
tgcgccggacgttctgcgcgactca

SEQ ID NO: 528761 - DNA, 25 bp, Rattus norvegicus
ccgagtgcatcctgagcaagaggct

SEQ ID NO: 528762 - DNA, 25 bp, Rattus norvegicus
gcagctactcgacaccacgaagaga

SEQ ID NO: 528763 - DNA, 25 bp, Rattus norvegicus
acctgcgatcgggagccgcaggacc

SEQ ID NO: 528764 - DNA, 25 bp, Rattus norvegicus
caaacaatggctttccgcagggacc

SEQ ID NO: 528765 - DNA, 25 bp, Rattus norvegicus
tggggcagaaaacgccgcctgctcc

SEQ ID NO: 528766 - DNA, 25 bp, Rattus norvegicus
gcttctggcgcccatttgttgcatg

SEQ ID NO: 528767 - DNA, 25 bp, Rattus norvegicus
agcagggcggcctccaacccggagt

SEQ ID NO: 528768 - DNA, 25 bp, Rattus norvegicus
accggtgctgccctttgtttacgag

SEQ ID NO: 528769 - DNA, 25 bp, Rattus norvegicus
gaagtcctgtgcctcgagacccaga

SEQ ID NO: 528770 - DNA, 25 bp, Rattus norvegicus
tttacgagcccacggggagcgagca

SEQ ID NO: 528771 - DNA, 25 bp, Rattus norvegicus
tgctgctcggagtaaccaccagccg

SEQ ID NO: 528772 - DNA, 25 bp, Rattus norvegicus
ctggactttgaatgatgatagggag

SEQ ID NO: 528773 - DNA, 25 bp, Rattus norvegicus
agtccgcagtcccttgctgtccgga

SEQ ID NO: 528774 - DNA, 25 bp, Rattus norvegicus
gcagtcccttgctgtccggaacaca

SEQ ID NO: 528775 - DNA, 25 bp, Rattus norvegicus
cttgctgtccggaacacagttgcgc

SEQ ID NO: 528776 - DNA, 25 bp, Rattus norvegicus
ggccgctggactttgaatgatgata

SEQ ID NO: 528777 - DNA, 25 bp, Rattus norvegicus
ccggaacacagttgcgctgtctaca

SEQ ID NO: 528778 - DNA, 25 bp, Rattus norvegicus
cgggtcgaggccgattctcaaagac

SEQ ID NO: 528779 - DNA, 25 bp, Rattus norvegicus
cgaggccgattctcaaagacattga

SEQ ID NO: 528780 - DNA, 25 bp, Rattus norvegicus
tcaaagacattgagacgatgcctgg

SEQ ID NO: 528781 - DNA, 25 bp, Rattus norvegicus
tgagacgatgcctggcaagaggaaa

SEQ ID NO: 528782 - DNA, 25 bp, Rattus norvegicus
catcccgtctatccggaaccagagg

SEQ ID NO: 528783 - DNA, 25 bp, Rattus norvegicus
aagttcgggccgctggactttgaat

SEQ ID NO: 528784 - DNA, 25 bp, Rattus norvegicus
gacattgagacgatgcctggcaaga

SEQ ID NO: 528785 - DNA, 25 bp, Rattus norvegicus
cgactgtaggctaggggaacagatt

SEQ ID NO: 528786 - DNA, 25 bp, Rattus norvegicus
aacagatttgtgcttttgagtccga

SEQ ID NO: 528787 - DNA, 25 bp, Rattus norvegicus
gcttttgagtccgagctgcgcgcag

SEQ ID NO: 528788 - DNA, 25 bp, Rattus norvegicus
atggtctcggggcaccgatggtccc

SEQ ID NO: 528789 - DNA, 25 bp, Rattus norvegicus
cggagtctgaacgtggagttcacgt

SEQ ID NO: 528790 - DNA, 25 bp, Rattus norvegicus
cgtggagttcacgtagcgagcactc

SEQ ID NO: 528791 - DNA, 25 bp, Rattus norvegicus
gtagcgagcactccgtgaatcgaaa

SEQ ID NO: 528792 - DNA, 25 bp, Rattus norvegicus
gagggaaaacgctcaagttctactg

SEQ ID NO: 528793 - DNA, 25 bp, Rattus norvegicus
ggactataaataccagcttttgctt

SEQ ID NO: 528794 - DNA, 25 bp, Rattus norvegicus
acgagagtcccacctgaccaagttc

SEQ ID NO: 528795 - DNA, 25 bp, Rattus norvegicus
acaggcctggtacgcagcccgatgc

SEQ ID NO: 528796 - DNA, 25 bp, Rattus norvegicus
ggccgctcgctcctctaaaagcaga

SEQ ID NO: 528797 - DNA, 25 bp, Rattus norvegicus
ctccgtgaatcgaaaaggactataa

SEQ ID NO: 528798 - DNA, 25 bp, Rattus norvegicus
actgcgcattcttggatggaaaccc

SEQ ID NO: 528799 - DNA, 25 bp, Rattus norvegicus
gcactttctgtcttgggctcttcta

SEQ ID NO: 528800 - DNA, 25 bp, Rattus norvegicus
gtcgctagcgccgaacctactaatt

SEQ ID NO: 528801 - DNA, 25 bp, Rattus norvegicus
agcggaggttcaacagcggctatcc

SEQ ID NO: 528802 - DNA, 25 bp, Rattus norvegicus
cctgcggacactcaataacctttcg

SEQ ID NO: 528803 - DNA, 25 bp, Rattus norvegicus
cggtcgtgcagagacgcctaaagtc

SEQ ID NO: 528804 - DNA, 25 bp, Rattus norvegicus
ctagaagacgtaagcggaggacacc

SEQ ID NO: 528805 - DNA, 25 bp, Rattus norvegicus
cgcggctctactccagacttgggtg

SEQ ID NO: 528806 - DNA, 25 bp, Rattus norvegicus
tctatgaccatcgaggcagagccta

SEQ ID NO: 528807 - DNA, 25 bp, Rattus norvegicus
tccttggccctgagagaagtcaacc

SEQ ID NO: 528808 - DNA, 25 bp, Rattus norvegicus
tgtttaccgcctgaatccatcctgg

SEQ ID NO: 528809 - DNA, 25 bp, Rattus norvegicus
cagactggtgcatgccgatgtttac

SEQ ID NO: 528810 - DNA, 25 bp, Rattus norvegicus
ctcagaagcccaaagcagactggtg

SEQ ID NO: 528811 - DNA, 25 bp, Rattus norvegicus
tgctcttggtctccagtcgcacagt

SEQ ID NO: 528812 - DNA, 25 bp, Rattus norvegicus
ttcccaagatggcaagtcccaggta

SEQ ID NO: 528813 - DNA, 25 bp, Rattus norvegicus
cagctagttctttgggtatgtttca

SEQ ID NO: 528814 - DNA, 25 bp, Rattus norvegicus
caggcctcagctagttctttgggta

SEQ ID NO: 528815 - DNA, 25 bp, Rattus norvegicus
ttgggcgctccgatcctgggtatcc

SEQ ID NO: 528816 - DNA, 25 bp, Rattus norvegicus
ctccgatcctgggtatccggccaga

SEQ ID NO: 528817 - DNA, 25 bp, Rattus norvegicus
gggtatccggccagaccagcaagcc

SEQ ID NO: 528818 - DNA, 25 bp, Rattus norvegicus
agcgcgtcctccagcttgaggctga

SEQ ID NO: 528819 - DNA, 25 bp, Rattus norvegicus
gcgggcttcggacctgcccaatctt

SEQ ID NO: 528820 - DNA, 25 bp, Rattus norvegicus
aggccaggcctcagctagttctttg

SEQ ID NO: 528821 - DNA, 25 bp, Rattus norvegicus
agctgtgaagtgagcggttcctagg

SEQ ID NO: 528822 - DNA, 25 bp, Rattus norvegicus
gtatgtttcaactgcgcggcttggc

SEQ ID NO: 528823 - DNA, 25 bp, Rattus norvegicus
tcggacctgcccaatcttggctaca

SEQ ID NO: 528824 - DNA, 25 bp, Rattus norvegicus
aatcttggctacacactcacgcggg

SEQ ID NO: 528825 - DNA, 25 bp, Rattus norvegicus
gctacacactcacgcgggcggattt

SEQ ID NO: 528826 - DNA, 25 bp, Rattus norvegicus
tccagcttgaggctgaggccaggcc

SEQ ID NO: 528827 - DNA, 25 bp, Rattus norvegicus
cctggcgttggttgcgaaagccgtc

SEQ ID NO: 528828 - DNA, 25 bp, Rattus norvegicus
ttcccgggaaagcagcctgcctggc

SEQ ID NO: 528829 - DNA, 25 bp, Rattus norvegicus
cacagcggctaaaccagcacgcatg

SEQ ID NO: 528830 - DNA, 25 bp, Rattus norvegicus
agcggctaaaccagcacgcatgcgc

SEQ ID NO: 528831 - DNA, 25 bp, Rattus norvegicus
ccacgtgctagaaagaacgcttaga

SEQ ID NO: 528832 - DNA, 25 bp, Rattus norvegicus
ttgcgaaagccgtccctgggacgtc

SEQ ID NO: 528833 - DNA, 25 bp, Rattus norvegicus
aagaacgcttagacgccacactgca

SEQ ID NO: 528834 - DNA, 25 bp, Rattus norvegicus
caccacccacgtgctagaaagaacg

SEQ ID NO: 528835 - DNA, 25 bp, Rattus norvegicus
agtgaaattgctgcaccaccaccca

SEQ ID NO: 528836 - DNA, 25 bp, Rattus norvegicus
agcccgagagtgaaattgctgcacc

SEQ ID NO: 528837 - DNA, 25 bp, Rattus norvegicus
ctctcttggcctagaaggggagacg

SEQ ID NO: 528838 - DNA, 25 bp, Rattus norvegicus
tccctgggacgtcggaggctctctt

SEQ ID NO: 528839 - DNA, 25 bp, Rattus norvegicus
tcctcagctttttcccgggaaagca

SEQ ID NO: 528840 - DNA, 25 bp, Rattus norvegicus
agacgccacactgcagggccaagtc

SEQ ID NO: 528841 - DNA, 25 bp, Rattus norvegicus
cccaagtgttgtcctagaaggaggg

SEQ ID NO: 528842 - DNA, 25 bp, Rattus norvegicus
gttggcttcatcctcaccctttcgg

SEQ ID NO: 528843 - DNA, 25 bp, Rattus norvegicus
tgccagaactcgtggggccagcgtt

SEQ ID NO: 528844 - DNA, 25 bp, Rattus norvegicus
caagttccggggctgccagaactcg

SEQ ID NO: 528845 - DNA, 25 bp, Rattus norvegicus
gcacgaagttggattttcccgagga

SEQ ID NO: 528846 - DNA, 25 bp, Rattus norvegicus
ttggagcatgcccagacgcaagttc

SEQ ID NO: 528847 - DNA, 25 bp, Rattus norvegicus
gaagcacgagtagacgcacgaagtt

SEQ ID NO: 528848 - DNA, 25 bp, Rattus norvegicus
tcagcgctctgctgcttggagcatg

SEQ ID NO: 528849 - DNA, 25 bp, Rattus norvegicus
ttcccgaggatgcaaagaacagctg

SEQ ID NO: 528850 - DNA, 25 bp, Rattus norvegicus
cgtggacaactctggcggcaaccct

SEQ ID NO: 528851 - DNA, 25 bp, Rattus norvegicus
cgagagggcttcacaaaaccttagc

SEQ ID NO: 528852 - DNA, 25 bp, Rattus norvegicus
aaaccttagcatccgacactcagcg

SEQ ID NO: 528853 - DNA, 25 bp, Rattus norvegicus
acactcagcgtcgttggtgcactcg

SEQ ID NO: 528854 - DNA, 25 bp, Rattus norvegicus
gcggcaaccctcgagacagtagtga

SEQ ID NO: 528855 - DNA, 25 bp, Rattus norvegicus
ccgggagcgaagaacaaggtatagc

SEQ ID NO: 528856 - DNA, 25 bp, Rattus norvegicus
attggccgacgcgtctctcggcaac

SEQ ID NO: 528857 - DNA, 25 bp, Rattus norvegicus
gctcattggccgacgcgtctctcgg

SEQ ID NO: 528858 - DNA, 25 bp, Rattus norvegicus
atataaggacacacggcaggcgccg

SEQ ID NO: 528859 - DNA, 25 bp, Rattus norvegicus
cgagcggccgcaccatataaggaca

SEQ ID NO: 528860 - DNA, 25 bp, Rattus norvegicus
cgatgtgcacgagcgccagccgagc

SEQ ID NO: 528861 - DNA, 25 bp, Rattus norvegicus
tccttatatggcgatgtgcacgagc

SEQ ID NO: 528862 - DNA, 25 bp, Rattus norvegicus
ttcctgtccttatatggcgatgtgc

SEQ ID NO: 528863 - DNA, 25 bp, Rattus norvegicus
ctcatcgatcgcctaggccgggagc

SEQ ID NO: 528864 - DNA, 25 bp, Rattus norvegicus
caaggtatagcctgtatttaggttc

SEQ ID NO: 528865 - DNA, 25 bp, Rattus norvegicus
tctcacgagtggaaaggagccagcc

SEQ ID NO: 528866 - DNA, 25 bp, Rattus norvegicus
acgagtggaaaggagccagccgccc

SEQ ID NO: 528867 - DNA, 25 bp, Rattus norvegicus
gcaaccgggctctcacgagtggaaa

SEQ ID NO: 528868 - DNA, 25 bp, Rattus norvegicus
gcctgtatttaggttcctgtcctta

SEQ ID NO: 528869 - DNA, 25 bp, Rattus norvegicus
gtgatctttccattagcgtcggcca

SEQ ID NO: 528870 - DNA, 25 bp, Rattus norvegicus
aaccctcgctggcttgcgtattccg

SEQ ID NO: 528871 - DNA, 25 bp, Rattus norvegicus
gcgtcggccatccttcttccaattg

SEQ ID NO: 528872 - DNA, 25 bp, Rattus norvegicus
tgtcgtggcccacttgtgatctttc

SEQ ID NO: 528873 - DNA, 25 bp, Rattus norvegicus
ggccaaactgggctctcggcttcac

SEQ ID NO: 528874 - DNA, 25 bp, Rattus norvegicus
tgaccttgtggtctgcggaagaaca

SEQ ID NO: 528875 - DNA, 25 bp, Rattus norvegicus
cgagtccagactgatccttccacta

SEQ ID NO: 528876 - DNA, 25 bp, Rattus norvegicus
gaagctcgcgatctagcacagaata

SEQ ID NO: 528877 - DNA, 25 bp, Rattus norvegicus
agccagcgacgcctgagctaatcga

SEQ ID NO: 528878 - DNA, 25 bp, Rattus norvegicus
tcttttctctgagggcttggcttcc

SEQ ID NO: 528879 - DNA, 25 bp, Rattus norvegicus
cacgctagcgtcagaggcactcaca

SEQ ID NO: 528880 - DNA, 25 bp, Rattus norvegicus
cgccgtcagagccaataaagctgca

SEQ ID NO: 528881 - DNA, 25 bp, Rattus norvegicus
ctggttttgaatcactgcgcgtttc

SEQ ID NO: 528882 - DNA, 25 bp, Rattus norvegicus
acacgcttcgcctgcctttagtcgg

SEQ ID NO: 528883 - DNA, 25 bp, Rattus norvegicus
cgccatggcgcgagtagagcgagct

SEQ ID NO: 528884 - DNA, 25 bp, Rattus norvegicus
agtagagcgagctgcgacgcgtgca

SEQ ID NO: 528885 - DNA, 25 bp, Rattus norvegicus
gacgcgtgcagagcgcctgcgatcc

SEQ ID NO: 528886 - DNA, 25 bp, Rattus norvegicus
agcgcctgcgatcccaccctttccc

SEQ ID NO: 528887 - DNA, 25 bp, Rattus norvegicus
tctaggagacctcgggactggcgcc

SEQ ID NO: 528888 - DNA, 25 bp, Rattus norvegicus
cgactggcgccgctttggcagccat

SEQ ID NO: 528889 - DNA, 25 bp, Rattus norvegicus
actggcgccgctttggcagccattt

SEQ ID NO: 528890 - DNA, 25 bp, Rattus norvegicus
gcgccgctttggcagccattttctg

SEQ ID NO: 528891 - DNA, 25 bp, Rattus norvegicus
gccgctttggcagccattttctgca

SEQ ID NO: 528892 - DNA, 25 bp, Rattus norvegicus
ctttggcagccattttctgcagctg

SEQ ID NO: 528893 - DNA, 25 bp, Rattus norvegicus
ctgggtccgggctgatctcggcgag

SEQ ID NO: 528894 - DNA, 25 bp, Rattus norvegicus
ccggtcaatgcagggtcgcgggcag

SEQ ID NO: 528895 - DNA, 25 bp, Rattus norvegicus
cgggactctaggagacctcgggact

SEQ ID NO: 528896 - DNA, 25 bp, Rattus norvegicus
gactctaggagacctcgggactggc

SEQ ID NO: 528897 - DNA, 25 bp, Rattus norvegicus
cgggcgatgccgcaaatcgtttcaa

SEQ ID NO: 528898 - DNA, 25 bp, Rattus norvegicus
ttgtgcacgtgttttgaaggcccgc

SEQ ID NO: 528899 - DNA, 25 bp, Rattus norvegicus
cgcagcccacttgtgcacgtgtttt

SEQ ID NO: 528900 - DNA, 25 bp, Rattus norvegicus
tgggcgtgtggcctcgcagcccact

SEQ ID NO: 528901 - DNA, 25 bp, Rattus norvegicus
agaggaggaaaaagtccagttgttg

SEQ ID NO: 528902 - DNA, 25 bp, Rattus norvegicus
tgcggccgaacttgaatggtctcca

SEQ ID NO: 528903 - DNA, 25 bp, Rattus norvegicus
tagacatgggccactgagctgagtc

SEQ ID NO: 528904 - DNA, 25 bp, Rattus norvegicus
gcttatagtagacatgggccactga

SEQ ID NO: 528905 - DNA, 25 bp, Rattus norvegicus
ctccgctgctccagcttatagtaga

SEQ ID NO: 528906 - DNA, 25 bp, Rattus norvegicus
tgtgcgcacctgcagaagctccgct

SEQ ID NO: 528907 - DNA, 25 bp, Rattus norvegicus
gctcaatgtcctgtgcgcacctgca

SEQ ID NO: 528908 - DNA, 25 bp, Rattus norvegicus
gcgattccttgctcaatgtcctgtg

SEQ ID NO: 528909 - DNA, 25 bp, Rattus norvegicus
cacagccagagccaagcgattcctt

SEQ ID NO: 528910 - DNA, 25 bp, Rattus norvegicus
catcacgaaaaacaacgattttccg

SEQ ID NO: 528911 - DNA, 25 bp, Rattus norvegicus
accgcgactggggagtcctctcctt

SEQ ID NO: 528912 - DNA, 25 bp, Rattus norvegicus
tcctctccttgggaacctctgcgag

SEQ ID NO: 528913 - DNA, 25 bp, Rattus norvegicus
aacctctgcgagattgcaggtgcgg

SEQ ID NO: 528914 - DNA, 25 bp, Rattus norvegicus
tacaccgtcacgtattccttgaaag

SEQ ID NO: 528915 - DNA, 25 bp, Rattus norvegicus
ccttgaaagtgacggtgaggcagtt

SEQ ID NO: 528916 - DNA, 25 bp, Rattus norvegicus
cgccgtgacgtcagtgataattata

SEQ ID NO: 528917 - DNA, 25 bp, Rattus norvegicus
cgcatcttgacacagcgcaagtcta

SEQ ID NO: 528918 - DNA, 25 bp, Rattus norvegicus
gcgcaagtctatgggctcatccagg

SEQ ID NO: 528919 - DNA, 25 bp, Rattus norvegicus
tcatccaggtctgagtccaaaagga

SEQ ID NO: 528920 - DNA, 25 bp, Rattus norvegicus
caaaaggatgacctccggctgcgga

SEQ ID NO: 528921 - DNA, 25 bp, Rattus norvegicus
ggtcagccgcttcttgcagggctca

SEQ ID NO: 528922 - DNA, 25 bp, Rattus norvegicus
tcacgctcgccatgggtctcggaga

SEQ ID NO: 528923 - DNA, 25 bp, Rattus norvegicus
ttaaattcactcaggggctccgctg

SEQ ID NO: 528924 - DNA, 25 bp, Rattus norvegicus
gatggacagctcagtcgggatccca

SEQ ID NO: 528925 - DNA, 25 bp, Rattus norvegicus
acgcgcctcggattggcgcagcccg

SEQ ID NO: 528926 - DNA, 25 bp, Rattus norvegicus
cgagaactcatgcaaatcccggacg

SEQ ID NO: 528927 - DNA, 25 bp, Rattus norvegicus
cgaagacgtgctcgccaacagctgg

SEQ ID NO: 528928 - DNA, 25 bp, Rattus norvegicus
tcgccaacagctggcagctccatgg

SEQ ID NO: 528929 - DNA, 25 bp, Rattus norvegicus
tggcagctccatggccgaatccaag

SEQ ID NO: 528930 - DNA, 25 bp, Rattus norvegicus
ccgaatccaagcacgcaggggcgca

SEQ ID NO: 528931 - DNA, 25 bp, Rattus norvegicus
atccaagcacgcaggggcgcaagcg

SEQ ID NO: 528932 - DNA, 25 bp, Rattus norvegicus
tgctcgctctcgctcagacaactga

SEQ ID NO: 528933 - DNA, 25 bp, Rattus norvegicus
tctcgctcagacaactgagcccggg

SEQ ID NO: 528934 - DNA, 25 bp, Rattus norvegicus
cgccgcggcacgagaactcatgcaa

SEQ ID NO: 528935 - DNA, 25 bp, Rattus norvegicus
ggatccgcttcttctcgatgctctc

SEQ ID NO: 528936 - DNA, 25 bp, Rattus norvegicus
ttctcgatgctctccaccgcgaaga

SEQ ID NO: 528937 - DNA, 25 bp, Rattus norvegicus
tgcaaatcccggacgtcagcgggcg

SEQ ID NO: 528938 - DNA, 25 bp, Rattus norvegicus
cgatgctctccaccgcgaagacgtg

SEQ ID NO: 528939 - DNA, 25 bp, Rattus norvegicus
aggcagagtatctgggcttggtttc

SEQ ID NO: 528940 - DNA, 25 bp, Rattus norvegicus
ctacatcgtgtttgtggaactgggc

SEQ ID NO: 528941 - DNA, 25 bp, Rattus norvegicus
gcctggcctgcagattacgccttga

SEQ ID NO: 528942 - DNA, 25 bp, Rattus norvegicus
cgcaagctacgctgaacacctgggg

SEQ ID NO: 528943 - DNA, 25 bp, Rattus norvegicus
cctcacggcgcgcacagggttaagc

SEQ ID NO: 528944 - DNA, 25 bp, Rattus norvegicus
ccaaagagatcgtcagccgaggcgc

SEQ ID NO: 528945 - DNA, 25 bp, Rattus norvegicus
ccttgcattttgctctcgggtgccc

SEQ ID NO: 528946 - DNA, 25 bp, Rattus norvegicus
cgcaggacctaggaccgaacgaaga

SEQ ID NO: 528947 - DNA, 25 bp, Rattus norvegicus
cggcctcggcaaaccctgtgctttt

SEQ ID NO: 528948 - DNA, 25 bp, Rattus norvegicus
aatgaaatgaaaatcgctccggcgg

SEQ ID NO: 528949 - DNA, 25 bp, Rattus norvegicus
tatgatctttgaagccgacacaatc

SEQ ID NO: 528950 - DNA, 25 bp, Rattus norvegicus
ggggcccacacacaagccagatttc

SEQ ID NO: 528951 - DNA, 25 bp, Rattus norvegicus
taaccagagctagctgctgcagcca

SEQ ID NO: 528952 - DNA, 25 bp, Rattus norvegicus
gctgctgctagcacgcgcgaacaac

SEQ ID NO: 528953 - DNA, 25 bp, Rattus norvegicus
tcgaggcctagctctgcggcacaca

SEQ ID NO: 528954 - DNA, 25 bp, Rattus norvegicus
cgcgctgagtgccacacgcaccaca

SEQ ID NO: 528955 - DNA, 25 bp, Rattus norvegicus
cgagaatggcagtccacggtcaaca

SEQ ID NO: 528956 - DNA, 25 bp, Rattus norvegicus
cagtccacggtcaacactgcgggtg

SEQ ID NO: 528957 - DNA, 25 bp, Rattus norvegicus
aacactgcgggtggggcgtctccaa

SEQ ID NO: 528958 - DNA, 25 bp, Rattus norvegicus
ggcgtctccaacctctctgcatgtg

SEQ ID NO: 528959 - DNA, 25 bp, Rattus norvegicus
cctctctgcatgtgcagggagcgtc

SEQ ID NO: 528960 - DNA, 25 bp, Rattus norvegicus
caggccggcgagaatggcagtccac

SEQ ID NO: 528961 - DNA, 25 bp, Rattus norvegicus
gctgcacgaataatgacacgtcatt

SEQ ID NO: 528962 - DNA, 25 bp, Rattus norvegicus
gtataccagaggcacacgcgcgctg

SEQ ID NO: 528963 - DNA, 25 bp, Rattus norvegicus
acgcaccacaactacagagctgtta

SEQ ID NO: 528964 - DNA, 25 bp, Rattus norvegicus
gagctgttatcagtcctgcgccctc

SEQ ID NO: 528965 - DNA, 25 bp, Rattus norvegicus
gccctctccagctgcacgaataatg

SEQ ID NO: 528966 - DNA, 25 bp, Rattus norvegicus
cggcacacaggtcaagtataccaga

SEQ ID NO: 528967 - DNA, 25 bp, Rattus norvegicus
tcgcggacctaaactaaccctgata

SEQ ID NO: 528968 - DNA, 25 bp, Rattus norvegicus
agatccgggtccctccgcatcgccc

SEQ ID NO: 528969 - DNA, 25 bp, Rattus norvegicus
ggtcccgcgcatttgtcgatccctg

SEQ ID NO: 528970 - DNA, 25 bp, Rattus norvegicus
tctaacatcggggtcccgcgcattt

SEQ ID NO: 528971 - DNA, 25 bp, Rattus norvegicus
ccaccgccgccgctagcgaggcgcg

SEQ ID NO: 528972 - DNA, 25 bp, Rattus norvegicus
gctcgcggacctaaactaaccctga

SEQ ID NO: 528973 - DNA, 25 bp, Rattus norvegicus
gaaccgccacgttgtcccgagtgga

SEQ ID NO: 528974 - DNA, 25 bp, Rattus norvegicus
gcgtgcccaggaaccgccacgttgt

SEQ ID NO: 528975 - DNA, 25 bp, Rattus norvegicus
cagataccagcgtgcccaggaaccg

SEQ ID NO: 528976 - DNA, 25 bp, Rattus norvegicus
cgtgcagataccagcgtgcccagga

SEQ ID NO: 528977 - DNA, 25 bp, Rattus norvegicus
gtcccgtgcgtgcagataccagcgt

SEQ ID NO: 528978 - DNA, 25 bp, Rattus norvegicus
ggcccgcgtcccgtgcgtgcagata

SEQ ID NO: 528979 - DNA, 25 bp, Rattus norvegicus
cgccctgcgcccagtgccggttccc

SEQ ID NO: 528980 - DNA, 25 bp, Rattus norvegicus
gccgcgcccagcctctaacatcggg

SEQ ID NO: 528981 - DNA, 25 bp, Rattus norvegicus
cgcagctttctgtacgcaggtaccc

SEQ ID NO: 528982 - DNA, 25 bp, Rattus norvegicus
cgccggatgttgatggcgtctccta

SEQ ID NO: 528983 - DNA, 25 bp, Rattus norvegicus
ccaccagatgttatccgcagctttc

SEQ ID NO: 528984 - DNA, 25 bp, Rattus norvegicus
agggataataaacccaccagatgtt

SEQ ID NO: 528985 - DNA, 25 bp, Rattus norvegicus
cgctggagggataataaacccacca

SEQ ID NO: 528986 - DNA, 25 bp, Rattus norvegicus
gaggaccaggctgacgggtaagccc

SEQ ID NO: 528987 - DNA, 25 bp, Rattus norvegicus
cctagcaacgagagatggcggagcc

SEQ ID NO: 528988 - DNA, 25 bp, Rattus norvegicus
cggtccggacttcgccggatgttga

SEQ ID NO: 528989 - DNA, 25 bp, Rattus norvegicus
tgttatccgcagctttctgtacgca

SEQ ID NO: 528990 - DNA, 25 bp, Rattus norvegicus
tctgagcgcgcggtccggacttcgc

SEQ ID NO: 528991 - DNA, 25 bp, Rattus norvegicus
ctcctgcggtctctgagcgcgcggt

SEQ ID NO: 528992 - DNA, 25 bp, Rattus norvegicus
agaactggcggacgcagccaggccc

SEQ ID NO: 528993 - DNA, 25 bp, Rattus norvegicus
gatgttgatggcgtctcctagcaac

SEQ ID NO: 528994 - DNA, 25 bp, Rattus norvegicus
tctcctagcaacgagagatggcgga

SEQ ID NO: 528995 - DNA, 25 bp, Rattus norvegicus
tcgagcagagacacccggcataggt

SEQ ID NO: 528996 - DNA, 25 bp, Rattus norvegicus
agagcctccggaggaacggcctcct

SEQ ID NO: 528997 - DNA, 25 bp, Rattus norvegicus
cctcaaccactagggggcgcagcga

SEQ ID NO: 528998 - DNA, 25 bp, Rattus norvegicus
ggcgcagcgaaaactctcgcccgga

SEQ ID NO: 528999 - DNA, 25 bp, Rattus norvegicus
gactccggcgcctacgcaggaggtc

SEQ ID NO: 529000 - DNA, 25 bp, Rattus norvegicus
gccgcggacagtgtgaccttagtaa

SEQ ID NO: 529001 - DNA, 25 bp, Rattus norvegicus
tgagcgagctgttgaaggctgtttc

SEQ ID NO: 529002 - DNA, 25 bp, Rattus norvegicus
ccggccgactatcggcgagttcctg

SEQ ID NO: 529003 - DNA, 25 bp, Rattus norvegicus
ttcctgctggggagaatcgagcaga

SEQ ID NO: 529004 - DNA, 25 bp, Rattus norvegicus
ctggggagaatcgagcagagacacc

SEQ ID NO: 529005 - DNA, 25 bp, Rattus norvegicus
ccgacacaggcagccgcggacagtg

SEQ ID NO: 529006 - DNA, 25 bp, Rattus norvegicus
tgaccttagtaaggcagcgggctcc

SEQ ID NO: 529007 - DNA, 25 bp, Rattus norvegicus
cggcaaagtcctcccggattctagc

SEQ ID NO: 529008 - DNA, 25 bp, Rattus norvegicus
acgtgacccacgctgcccactgagc

SEQ ID NO: 529009 - DNA, 25 bp, Rattus norvegicus
ttcgtattcacgtgagtcggcgccg

SEQ ID NO: 529010 - DNA, 25 bp, Rattus norvegicus
gtgggatttcctccactgccgctgc

SEQ ID NO: 529011 - DNA, 25 bp, Rattus norvegicus
ctgctgatccggatggtcccggcgc

SEQ ID NO: 529012 - DNA, 25 bp, Rattus norvegicus
agcaccctcttcttcgtattcacgt

SEQ ID NO: 529013 - DNA, 25 bp, Rattus norvegicus
tggttggctccagcaccctcttctt

SEQ ID NO: 529014 - DNA, 25 bp, Rattus norvegicus
ccagagctggtagcagagagggact

SEQ ID NO: 529015 - DNA, 25 bp, Rattus norvegicus
ggacgcgcctcaaacccgccaagta

SEQ ID NO: 529016 - DNA, 25 bp, Rattus norvegicus
ccgtggggtgggatttcctccactg

SEQ ID NO: 529017 - DNA, 25 bp, Rattus norvegicus
ccgcaaaagaggagttggccgcccg

SEQ ID NO: 529018 - DNA, 25 bp, Rattus norvegicus
ttaaggggcgcgctgacatcagcgc

SEQ ID NO: 529019 - DNA, 25 bp, Rattus norvegicus
ggtccaccttaaggggcgcgctgac

SEQ ID NO: 529020 - DNA, 25 bp, Rattus norvegicus
attcacgtgagtcggcgccgggtcc

SEQ ID NO: 529021 - DNA, 25 bp, Rattus norvegicus
tggtcctgctgatccggatggtccc

SEQ ID NO: 529022 - DNA, 25 bp, Rattus norvegicus
cggcgctgttggttggctccagcac

SEQ ID NO: 529023 - DNA, 25 bp, Rattus norvegicus
ctaaatacgggaacgttcatgaata

SEQ ID NO: 529024 - DNA, 25 bp, Rattus norvegicus
ccgcggcactgtcggtattaagtta

SEQ ID NO: 529025 - DNA, 25 bp, Rattus norvegicus
atggctattattccgcggcactgtc

SEQ ID NO: 529026 - DNA, 25 bp, Rattus norvegicus
aggaaatggctattattccgcggca

SEQ ID NO: 529027 - DNA, 25 bp, Rattus norvegicus
ctgcgagtcagccaggaaatggcta

SEQ ID NO: 529028 - DNA, 25 bp, Rattus norvegicus
tctcattttctgaggcctgcgagtc

SEQ ID NO: 529029 - DNA, 25 bp, Rattus norvegicus
aagccgcggcaatctcattttctga

SEQ ID NO: 529030 - DNA, 25 bp, Rattus norvegicus
gagcgcacccgggaaaagacaagaa

SEQ ID NO: 529031 - DNA, 25 bp, Rattus norvegicus
ccgcactaaatacgggaacgttcat

SEQ ID NO: 529032 - DNA, 25 bp, Rattus norvegicus
cgttcatgaatatctattgagtccc

SEQ ID NO: 529033 - DNA, 25 bp, Rattus norvegicus
tctattgagtcccaggtacagaccc

SEQ ID NO: 529034 - DNA, 25 bp, Rattus norvegicus
ggcactgtcggtattaagttatttc

SEQ ID NO: 529035 - DNA, 25 bp, Rattus norvegicus
tgtcggtattaagttatttcccgca

SEQ ID NO: 529036 - DNA, 25 bp, Rattus norvegicus
gcagcgagcgcacccgggaaaagac

SEQ ID NO: 529037 - DNA, 25 bp, Rattus norvegicus
gtgtagcccacactaaaatgctttc

SEQ ID NO: 529038 - DNA, 25 bp, Rattus norvegicus
gcccacactaaaatgctttcgcttg

SEQ ID NO: 529039 - DNA, 25 bp, Rattus norvegicus
actaaaatgctttcgcttggtgtcg

SEQ ID NO: 529040 - DNA, 25 bp, Rattus norvegicus
aatgctttcgcttggtgtcgggagc

SEQ ID NO: 529041 - DNA, 25 bp, Rattus norvegicus
gtgtcgggagctgtagaaagtattc

SEQ ID NO: 529042 - DNA, 25 bp, Rattus norvegicus
gagtattcatgttggtgacatgccc

SEQ ID NO: 529043 - DNA, 25 bp, Rattus norvegicus
tgtcacatatcctcgagtattcatg

SEQ ID NO: 529044 - DNA, 25 bp, Rattus norvegicus
tcctcgagtattcatgttggtgaca

SEQ ID NO: 529045 - DNA, 25 bp, Rattus norvegicus
taaatggccagtgactgacagtctc

SEQ ID NO: 529046 - DNA, 25 bp, Rattus norvegicus
tcatttcttgtcacatatcctcgag

SEQ ID NO: 529047 - DNA, 25 bp, Rattus norvegicus
tgacccattaaatggccagtgactg

SEQ ID NO: 529048 - DNA, 25 bp, Rattus norvegicus
ggtctattgtgacccattaaatggc

SEQ ID NO: 529049 - DNA, 25 bp, Rattus norvegicus
gtctcccagtaagtgtagcccacac

SEQ ID NO: 529050 - DNA, 25 bp, Rattus norvegicus
gccagtgactgacagtctcccagta

SEQ ID NO: 529051 - DNA, 25 bp, Rattus norvegicus
tcctcgtcagggtctgtgtgaggtc

SEQ ID NO: 529052 - DNA, 25 bp, Rattus norvegicus
ccggaagtaatcctcgtcagggtct

SEQ ID NO: 529053 - DNA, 25 bp, Rattus norvegicus
aaatcacacagcaccggaagtaatc

SEQ ID NO: 529054 - DNA, 25 bp, Rattus norvegicus
tcgttggaaggagaagaaataaatc

SEQ ID NO: 529055 - DNA, 25 bp, Rattus norvegicus
caagtctgcaccttcgttggaagga

SEQ ID NO: 529056 - DNA, 25 bp, Rattus norvegicus
atggctcaagtctgcaccttcgttg

SEQ ID NO: 529057 - DNA, 25 bp, Rattus norvegicus
tgctgacaccggaaatggctcaagt

SEQ ID NO: 529058 - DNA, 25 bp, Rattus norvegicus
cggaacgacgtcatttcagtgctga

SEQ ID NO: 529059 - DNA, 25 bp, Rattus norvegicus
tgtgagaaaccggaacgacgtcatt

SEQ ID NO: 529060 - DNA, 25 bp, Rattus norvegicus
tagatgccggaagcgtgtgagaaac

SEQ ID NO: 529061 - DNA, 25 bp, Rattus norvegicus
actcaacctagatgccggaagcgtg

SEQ ID NO: 529062 - DNA, 25 bp, Rattus norvegicus
tgtcaaagactcaacctagatgccg

SEQ ID NO: 529063 - DNA, 25 bp, Rattus norvegicus
cggcggacgtcccatgtcaaagact

SEQ ID NO: 529064 - DNA, 25 bp, Rattus norvegicus
acgacgtcatttcagtgctgacacc

SEQ ID NO: 529065 - DNA, 25 bp, Rattus norvegicus
aggacatatataatttcatcgaaga

SEQ ID NO: 529066 - DNA, 25 bp, Rattus norvegicus
gtacttcaaatcacttaacatgatg

SEQ ID NO: 529067 - DNA, 25 bp, Rattus norvegicus
aacaagatagtgagagggaagtata

SEQ ID NO: 529068 - DNA, 25 bp, Rattus norvegicus
aacatgatgaagttaaaggaattta

SEQ ID NO: 529069 - DNA, 25 bp, Rattus norvegicus
gggaagtataatatccaaagcaatt

SEQ ID NO: 529070 - DNA, 25 bp, Rattus norvegicus
acaccctagagataacaagatagtg

SEQ ID NO: 529071 - DNA, 25 bp, Rattus norvegicus
aaagaaatgtttgtacttcaaatca

SEQ ID NO: 529072 - DNA, 25 bp, Rattus norvegicus
aaaaccaaggttacatgacatcatc

SEQ ID NO: 529073 - DNA, 25 bp, Rattus norvegicus
atgacatcatcagaacccagttctc

SEQ ID NO: 529074 - DNA, 25 bp, Rattus norvegicus
cagttctcaaaccaacacaaggcta

SEQ ID NO: 529075 - DNA, 25 bp, Rattus norvegicus
acacaaggctaggatactctcaaca

SEQ ID NO: 529076 - DNA, 25 bp, Rattus norvegicus
ggctaggatactctcaacacaacag

SEQ ID NO: 529077 - DNA, 25 bp, Rattus norvegicus
gatactctcaacacaacagaaaagg

SEQ ID NO: 529078 - DNA, 25 bp, Rattus norvegicus
atatccaaagcaattaaaaccaagg

SEQ ID NO: 529079 - DNA, 25 bp, Rattus norvegicus
tgtgcaacatgccacttctaccgtc

SEQ ID NO: 529080 - DNA, 25 bp, Rattus norvegicus
gacgaggacaaggaggatgacttcc

SEQ ID NO: 529081 - DNA, 25 bp, Rattus norvegicus
cactgtacaagaacgtggatgtgcg

SEQ ID NO: 529082 - DNA, 25 bp, Rattus norvegicus
tccgcatgaagtggtgtgcaacatg

SEQ ID NO: 529083 - DNA, 25 bp, Rattus norvegicus
gcagcgtctgcgacaactgtgtgga

SEQ ID NO: 529084 - DNA, 25 bp, Rattus norvegicus
cctgggtgaacaactgcatcggacg

SEQ ID NO: 529085 - DNA, 25 bp, Rattus norvegicus
gcatcggacgccgtaactaccgtta

SEQ ID NO: 529086 - DNA, 25 bp, Rattus norvegicus
taccgttacttcttcctgttcctgc

SEQ ID NO: 529087 - DNA, 25 bp, Rattus norvegicus
tgtcactcagcgcacacatggtggg

SEQ ID NO: 529088 - DNA, 25 bp, Rattus norvegicus
tacgtgctcaaccactcggaggggc

SEQ ID NO: 529089 - DNA, 25 bp, Rattus norvegicus
tcacgtatccttgtctccacgtggc

SEQ ID NO: 529090 - DNA, 25 bp, Rattus norvegicus
gcgggtacacgagtcttccggaaga

SEQ ID NO: 529091 - DNA, 25 bp, Rattus norvegicus
tccggaagagttgccgtgcttagac

SEQ ID NO: 529092 - DNA, 25 bp, Rattus norvegicus
tgcggggcatccaggtccgcatgaa

SEQ ID NO: 529093 - DNA, 25 bp, Rattus norvegicus
tccacgtggacatctggtgggcact

SEQ ID NO: 529094 - DNA, 25 bp, Rattus norvegicus
gcagctaaccgccttgttaaactgt

SEQ ID NO: 529095 - DNA, 25 bp, Rattus norvegicus
tggagcagctaaccgccttgttaaa

SEQ ID NO: 529096 - DNA, 25 bp, Rattus norvegicus
tgtggagcagctaaccgccttgtta

SEQ ID NO: 529097 - DNA, 25 bp, Rattus norvegicus
gtgtggagcagctaaccgccttgtt

SEQ ID NO: 529098 - DNA, 25 bp, Rattus norvegicus
cagggtgtggagcagctaaccgcct

SEQ ID NO: 529099 - DNA, 25 bp, Rattus norvegicus
cctggggacaccggctgccacagga

SEQ ID NO: 529100 - DNA, 25 bp, Rattus norvegicus
tgctgctgtccggatccggggctct

SEQ ID NO: 529101 - DNA, 25 bp, Rattus norvegicus
cacgtggacatctggtgggcactgt

SEQ ID NO: 529102 - DNA, 25 bp, Rattus norvegicus
cggaccgaaggtccacgtggacatc

SEQ ID NO: 529103 - DNA, 25 bp, Rattus norvegicus
tgcggaccgaaggtccacgtggaca

SEQ ID NO: 529104 - DNA, 25 bp, Rattus norvegicus
agctaaccgccttgttaaactgtca

SEQ ID NO: 529105 - DNA, 25 bp, Rattus norvegicus
tggacatctggtgggcactgtggcc

SEQ ID NO: 529106 - DNA, 25 bp, Rattus norvegicus
gtggagcagctaaccgccttgttaa

SEQ ID NO: 529107 - DNA, 25 bp, Rattus norvegicus
cctctgggcctctaatccggataca

SEQ ID NO: 529108 - DNA, 25 bp, Rattus norvegicus
tctaatccggatacaggagaaagcc

SEQ ID NO: 529109 - DNA, 25 bp, Rattus norvegicus
tccggatacaggagaaagcccgaga

SEQ ID NO: 529110 - DNA, 25 bp, Rattus norvegicus
cgtgctgtacttgttgttgttgccc

SEQ ID NO: 529111 - DNA, 25 bp, Rattus norvegicus
gtccaacttcacatagacctcatcg

SEQ ID NO: 529112 - DNA, 25 bp, Rattus norvegicus
ctcatcgcccgaatccaggtgcagg

SEQ ID NO: 529113 - DNA, 25 bp, Rattus norvegicus
cgaatccaggtgcaggaccacgctg

SEQ ID NO: 529114 - DNA, 25 bp, Rattus norvegicus
tgggctatggcgctggcacgcacct

SEQ ID NO: 529115 - DNA, 25 bp, Rattus norvegicus
ccacgctgttgctggcgtagtcata

SEQ ID NO: 529116 - DNA, 25 bp, Rattus norvegicus
gctggcgtagtcataattctggtcc

SEQ ID NO: 529117 - DNA, 25 bp, Rattus norvegicus
tcataattctggtccgcgtcctggg

SEQ ID NO: 529118 - DNA, 25 bp, Rattus norvegicus
attctggtccgcgtcctgggctatg

SEQ ID NO: 529119 - DNA, 25 bp, Rattus norvegicus
gcaggaccacgctgttgctggcgta

SEQ ID NO: 529120 - DNA, 25 bp, Rattus norvegicus
aaagcccgagaacgtgctgtacttg

SEQ ID NO: 529121 - DNA, 25 bp, Rattus norvegicus
ctgcagtagcagaggcaccgcgatt

SEQ ID NO: 529122 - DNA, 25 bp, Rattus norvegicus
ctctggctcctgttcttctgggatt

SEQ ID NO: 529123 - DNA, 25 bp, Rattus norvegicus
caccgctctggaactgatctggaga

SEQ ID NO: 529124 - DNA, 25 bp, Rattus norvegicus
ttcaacgagaggtatccggacccga

SEQ ID NO: 529125 - DNA, 25 bp, Rattus norvegicus
gccacccaactatttcaacgagagg

SEQ ID NO: 529126 - DNA, 25 bp, Rattus norvegicus
cctccttgccgcctggggaggtaat

SEQ ID NO: 529127 - DNA, 25 bp, Rattus norvegicus
agcatctcgtagtgagccgctcctg

SEQ ID NO: 529128 - DNA, 25 bp, Rattus norvegicus
acggtgtacgggtcacagatcatgc

SEQ ID NO: 529129 - DNA, 25 bp, Rattus norvegicus
gcataacttccagggcagcggtact

SEQ ID NO: 529130 - DNA, 25 bp, Rattus norvegicus
cgctgaggtcctgcataacttccag

SEQ ID NO: 529131 - DNA, 25 bp, Rattus norvegicus
cggatcaccctttggtccctggata

SEQ ID NO: 529132 - DNA, 25 bp, Rattus norvegicus
tgtcaactgcagtccgggtagccct

SEQ ID NO: 529133 - DNA, 25 bp, Rattus norvegicus
ccggctgcgctagttgtcaactgca

SEQ ID NO: 529134 - DNA, 25 bp, Rattus norvegicus
gcgttcggacgccaactccgcaggt

SEQ ID NO: 529135 - DNA, 25 bp, Rattus norvegicus
agagctggcgggtggccactaccct

SEQ ID NO: 529136 - DNA, 25 bp, Rattus norvegicus
tgaacggtcactactggtcgggaaa

SEQ ID NO: 529137 - DNA, 25 bp, Rattus norvegicus
gacgcaccctgaacggtcactactg

SEQ ID NO: 529138 - DNA, 25 bp, Rattus norvegicus
cctgtagcgttcttgccctgacgca

SEQ ID NO: 529139 - DNA, 25 bp, Rattus norvegicus
cgtgcgttaggctgtgcacagtccc

SEQ ID NO: 529140 - DNA, 25 bp, Rattus norvegicus
cctgtcccggctcgcgtgcgttagg

SEQ ID NO: 529141 - DNA, 25 bp, Rattus norvegicus
ctgccgaggtgagtgaccctgtccc

SEQ ID NO: 529142 - DNA, 25 bp, Rattus norvegicus
tccaagcggccagctgccgaggtga

SEQ ID NO: 529143 - DNA, 25 bp, Rattus norvegicus
ctcctcccgcgacctgcagctgcca

SEQ ID NO: 529144 - DNA, 25 bp, Rattus norvegicus
gaggagcctaagaccgagccaccgc

SEQ ID NO: 529145 - DNA, 25 bp, Rattus norvegicus
tcctccacttgtagtgtagggcggg

SEQ ID NO: 529146 - DNA, 25 bp, Rattus norvegicus
agaggaggagcctaagaccgagcca

SEQ ID NO: 529147 - DNA, 25 bp, Rattus norvegicus
tggttggtggcttcctccacttgta

SEQ ID NO: 529148 - DNA, 25 bp, Rattus norvegicus
ggtggcttcctccacttgtagtgta

SEQ ID NO: 529149 - DNA, 25 bp, Rattus norvegicus
aaaccgtagcgtgtccaacctgctc

SEQ ID NO: 529150 - DNA, 25 bp, Rattus norvegicus
ggctcctccctgtgcatgcgcaata

SEQ ID NO: 529151 - DNA, 25 bp, Rattus norvegicus
tgcatgcgcaataaactccctcttg

SEQ ID NO: 529152 - DNA, 25 bp, Rattus norvegicus
caataaactccctcttgtgtcgggg

SEQ ID NO: 529153 - DNA, 25 bp, Rattus norvegicus
ggagctctctgcctaggatggacac

SEQ ID NO: 529154 - DNA, 25 bp, Rattus norvegicus
ctcgcccgagctcagtaggaacgcg

SEQ ID NO: 529155 - DNA, 25 bp, Rattus norvegicus
gggttgtgcttttaaaggcgctagc

SEQ ID NO: 529156 - DNA, 25 bp, Rattus norvegicus
tttaaaggcgctagccggtacgctc

SEQ ID NO: 529157 - DNA, 25 bp, Rattus norvegicus
ccggtacgctctggaacttgattgc

SEQ ID NO: 529158 - DNA, 25 bp, Rattus norvegicus
tgattgcttccctcttctgagcttg

SEQ ID NO: 529159 - DNA, 25 bp, Rattus norvegicus
ttctgagcttgctcccgcgctttca

SEQ ID NO: 529160 - DNA, 25 bp, Rattus norvegicus
aggtcacctcgccagtatgtctcag

SEQ ID NO: 529161 - DNA, 25 bp, Rattus norvegicus
tatgtctcaggtactgtgcgtgccc

SEQ ID NO: 529162 - DNA, 25 bp, Rattus norvegicus
agcagatccgacttctgattggctg

SEQ ID NO: 529163 - DNA, 25 bp, Rattus norvegicus
aacgtgtgctgggtcaccgcatacc

SEQ ID NO: 529164 - DNA, 25 bp, Rattus norvegicus
ctgcatccaggggaagaacgtgtgc

SEQ ID NO: 529165 - DNA, 25 bp, Rattus norvegicus
agtcctcgaggaatctgcatccagg

SEQ ID NO: 529166 - DNA, 25 bp, Rattus norvegicus
gacttggactggaaccaaatttctc

SEQ ID NO: 529167 - DNA, 25 bp, Rattus norvegicus
atcctggcgggatcctccacttttt

SEQ ID NO: 529168 - DNA, 25 bp, Rattus norvegicus
gttaaacccgcgatccaaggtcaca

SEQ ID NO: 529169 - DNA, 25 bp, Rattus norvegicus
ctgagtcagcgtaaccggagcagcc

SEQ ID NO: 529170 - DNA, 25 bp, Rattus norvegicus
gaaccaaatttctcagtcctcgagg

SEQ ID NO: 529171 - DNA, 25 bp, Rattus norvegicus
ccgccggtgtagacggcagaatcct

SEQ ID NO: 529172 - DNA, 25 bp, Rattus norvegicus
agtgcgacagcaaggctaggcgaca

SEQ ID NO: 529173 - DNA, 25 bp, Rattus norvegicus
taggcgacagcgctgcctccgagag

SEQ ID NO: 529174 - DNA, 25 bp, Rattus norvegicus
tccgagagcgcagcatgacggccat

SEQ ID NO: 529175 - DNA, 25 bp, Rattus norvegicus
gagcagcccagtgatcgcgaagccc

SEQ ID NO: 529176 - DNA, 25 bp, Rattus norvegicus
actttttgcgcccaggtgctccttc

SEQ ID NO: 529177 - DNA, 25 bp, Rattus norvegicus
gagtgcagtgcagcctcctgtcgga

SEQ ID NO: 529178 - DNA, 25 bp, Rattus norvegicus
tccttgatgaagttggacagggcgc

SEQ ID NO: 529179 - DNA, 25 bp, Rattus norvegicus
acggcgtccttgatgaagttggaca

SEQ ID NO: 529180 - DNA, 25 bp, Rattus norvegicus
gagtacggcgtccttgatgaagttg

SEQ ID NO: 529181 - DNA, 25 bp, Rattus norvegicus
tccgaggagaagagtacggcgtcct

SEQ ID NO: 529182 - DNA, 25 bp, Rattus norvegicus
tgaaggacacgaacaggtgcatgtg

SEQ ID NO: 529183 - DNA, 25 bp, Rattus norvegicus
ttgcgagtgcagtgcagcctcctgt

SEQ ID NO: 529184 - DNA, 25 bp, Rattus norvegicus
aggacacgaacaggtgcatgtggat

SEQ ID NO: 529185 - DNA, 25 bp, Rattus norvegicus
tggggctgcgagatcacgagatcac

SEQ ID NO: 529186 - DNA, 25 bp, Rattus norvegicus
cctttgcatggagaaacgaaagccc

SEQ ID NO: 529187 - DNA, 25 bp, Rattus norvegicus
gatcacgagatcacggaaggagccg

SEQ ID NO: 529188 - DNA, 25 bp, Rattus norvegicus
ccctccctttgcatggagaaacgaa

SEQ ID NO: 529189 - DNA, 25 bp, Rattus norvegicus
gtgggtgctcgcacaggcacacccg

SEQ ID NO: 529190 - DNA, 25 bp, Rattus norvegicus
ctcctgtcggagagaacgtggggct

SEQ ID NO: 529191 - DNA, 25 bp, Rattus norvegicus
catcggtctaggtgcagcgtgtgca

SEQ ID NO: 529192 - DNA, 25 bp, Rattus norvegicus
gacacggagctgtgcattgtcacta

SEQ ID NO: 529193 - DNA, 25 bp, Rattus norvegicus
agctgtgcattgtcactaagatcta

SEQ ID NO: 529194 - DNA, 25 bp, Rattus norvegicus
ctaagatctagttgctccaggaggg

SEQ ID NO: 529195 - DNA, 25 bp, Rattus norvegicus
atctagttgctccaggagggtcaga

SEQ ID NO: 529196 - DNA, 25 bp, Rattus norvegicus
cagaccagtgaaggccgcggcatca

SEQ ID NO: 529197 - DNA, 25 bp, Rattus norvegicus
atcaatcccggccagcgcatttgag

SEQ ID NO: 529198 - DNA, 25 bp, Rattus norvegicus
gccagcgcatttgagtgcagccaca

SEQ ID NO: 529199 - DNA, 25 bp, Rattus norvegicus
cgcatttgagtgcagccacaggatg

SEQ ID NO: 529200 - DNA, 25 bp, Rattus norvegicus
tgcagccacaggatggtgagattcc

SEQ ID NO: 529201 - DNA, 25 bp, Rattus norvegicus
caggatggtgagattccggcatgac

SEQ ID NO: 529202 - DNA, 25 bp, Rattus norvegicus
attccggcatgactggaagctggcg

SEQ ID NO: 529203 - DNA, 25 bp, Rattus norvegicus
cggctggcacgtaagagattcggtt

SEQ ID NO: 529204 - DNA, 25 bp, Rattus norvegicus
tggcacgtaagagattcggttgccg

SEQ ID NO: 529205 - DNA, 25 bp, Rattus norvegicus
aaggggagtgtcagcaattgatcct

SEQ ID NO: 529206 - DNA, 25 bp, Rattus norvegicus
aggggagtgtcagcaattgatcctc

SEQ ID NO: 529207 - DNA, 25 bp, Rattus norvegicus
gaaggggagtgtcagcaattgatcc

SEQ ID NO: 529208 - DNA, 25 bp, Rattus norvegicus
cgaaggggagtgtcagcaattgatc

SEQ ID NO: 529209 - DNA, 25 bp, Rattus norvegicus
ccgaaggggagtgtcagcaattgat

SEQ ID NO: 529210 - DNA, 25 bp, Rattus norvegicus
accgaaggggagtgtcagcaattga

SEQ ID NO: 529211 - DNA, 25 bp, Rattus norvegicus
aaaccgaaggggagtgtcagcaatt

SEQ ID NO: 529212 - DNA, 25 bp, Rattus norvegicus
ctgtagccggtttcggctcaccgcg

SEQ ID NO: 529213 - DNA, 25 bp, Rattus norvegicus
aaccgaaggggagtgtcagcaattg

SEQ ID NO: 529214 - DNA, 25 bp, Rattus norvegicus
agacccgggcatggcgctaccggcc

SEQ ID NO: 529215 - DNA, 25 bp, Rattus norvegicus
ccgggcatggcgctaccggcctcac

SEQ ID NO: 529216 - DNA, 25 bp, Rattus norvegicus
taaattcagtgggtccccacagctg

SEQ ID NO: 529217 - DNA, 25 bp, Rattus norvegicus
aagacccgggcatggcgctaccggc

SEQ ID NO: 529218 - DNA, 25 bp, Rattus norvegicus
ccaggaagacccgggcatggcgcta

SEQ ID NO: 529219 - DNA, 25 bp, Rattus norvegicus
acagagctacacacgatggactgtg

SEQ ID NO: 529220 - DNA, 25 bp, Rattus norvegicus
tacacacgatggactgtgtggggac

SEQ ID NO: 529221 - DNA, 25 bp, Rattus norvegicus
tgcctagctggcacccttccggagt

SEQ ID NO: 529222 - DNA, 25 bp, Rattus norvegicus
agctggcacccttccggagtggtca

SEQ ID NO: 529223 - DNA, 25 bp, Rattus norvegicus
ctggccgcatctcattaacaacctg

SEQ ID NO: 529224 - DNA, 25 bp, Rattus norvegicus
ttaacaacctgcaagaacagagcta

SEQ ID NO: 529225 - DNA, 25 bp, Rattus norvegicus
tgcaagaacagagctacacacgatg

SEQ ID NO: 529226 - DNA, 25 bp, Rattus norvegicus
cacggcgcacctgggctgtgtccgc

SEQ ID NO: 529227 - DNA, 25 bp, Rattus norvegicus
gccgcagcaggatgagcctggccgc

SEQ ID NO: 529228 - DNA, 25 bp, Rattus norvegicus
cagggaagggcagcacaggggaccc

SEQ ID NO: 529229 - DNA, 25 bp, Rattus norvegicus
tgctgctgctttaagactgcagagc

SEQ ID NO: 529230 - DNA, 25 bp, Rattus norvegicus
cgactgcgtgatccgccgcactcct

SEQ ID NO: 529231 - DNA, 25 bp, Rattus norvegicus
tgggtcccgccgactgcgtgatccg

SEQ ID NO: 529232 - DNA, 25 bp, Rattus norvegicus
cgcatctcattaacaacctgcaaga

SEQ ID NO: 529233 - DNA, 25 bp, Rattus norvegicus
cgtggacacaaagtaaaaggacatg

SEQ ID NO: 529234 - DNA, 25 bp, Rattus norvegicus
cgagctcgtggacacaaagtaaaag

SEQ ID NO: 529235 - DNA, 25 bp, Rattus norvegicus
tccacaccgcgaggactgtgccagg

SEQ ID NO: 529236 - DNA, 25 bp, Rattus norvegicus
ttgcactccacaccgcgaggactgt

SEQ ID NO: 529237 - DNA, 25 bp, Rattus norvegicus
gtgtgcagccctctcttgcactcca

SEQ ID NO: 529238 - DNA, 25 bp, Rattus norvegicus
ccctggccctcgtgtgcagccctct

SEQ ID NO: 529239 - DNA, 25 bp, Rattus norvegicus
gcaaggagggcagcggccctggccc

SEQ ID NO: 529240 - DNA, 25 bp, Rattus norvegicus
acacaggacaaagcgctggcggcaa

SEQ ID NO: 529241 - DNA, 25 bp, Rattus norvegicus
tggcgacacaggacaaagcgctggc

SEQ ID NO: 529242 - DNA, 25 bp, Rattus norvegicus
ccctggcgacacaggacaaagcgct

SEQ ID NO: 529243 - DNA, 25 bp, Rattus norvegicus
cgagtgagtgcagcccctggcgaca

SEQ ID NO: 529244 - DNA, 25 bp, Rattus norvegicus
gtaaaaggacatggcgtcctggaca

SEQ ID NO: 529245 - DNA, 25 bp, Rattus norvegicus
gctcgtggacacaaagtaaaaggac

SEQ ID NO: 529246 - DNA, 25 bp, Rattus norvegicus
cacaaagtaaaaggacatggcgtcc

SEQ ID NO: 529247 - DNA, 25 bp, Rattus norvegicus
actgtgagagtcagccggtggatac

SEQ ID NO: 529248 - DNA, 25 bp, Rattus norvegicus
aggacgagaccactagcagcctgca

SEQ ID NO: 529249 - DNA, 25 bp, Rattus norvegicus
aggtgcggctgctccattcaccggc

SEQ ID NO: 529250 - DNA, 25 bp, Rattus norvegicus
tggatacggcctgagcagccgctca

SEQ ID NO: 529251 - DNA, 25 bp, Rattus norvegicus
gcatcagcaccagcagcgacaagta

SEQ ID NO: 529252 - DNA, 25 bp, Rattus norvegicus
gcgacaagtattcccatcgacactg

SEQ ID NO: 529253 - DNA, 25 bp, Rattus norvegicus
agtattcccatcgacactgcgctgg

SEQ ID NO: 529254 - DNA, 25 bp, Rattus norvegicus
actgcgctgggctctcgccgctgag

SEQ ID NO: 529255 - DNA, 25 bp, Rattus norvegicus
tcgctcactgccatctctggggctg

SEQ ID NO: 529256 - DNA, 25 bp, Rattus norvegicus
cactgccatctctggggctgcgact

SEQ ID NO: 529257 - DNA, 25 bp, Rattus norvegicus
acacagccgctgacgccttataagg

SEQ ID NO: 529258 - DNA, 25 bp, Rattus norvegicus
gcccacttttcagccaatagtcgta

SEQ ID NO: 529259 - DNA, 25 bp, Rattus norvegicus
cgaggccaagcctgcggggctcact

SEQ ID NO: 529260 - DNA, 25 bp, Rattus norvegicus
ccactagcagcctgcagtgggaggt

SEQ ID NO: 529261 - DNA, 25 bp, Rattus norvegicus
cgtcccgaagggagtcctggacatc

SEQ ID NO: 529262 - DNA, 25 bp, Rattus norvegicus
cgtggcggcataacctaaccgcgtc

SEQ ID NO: 529263 - DNA, 25 bp, Rattus norvegicus
caaaggcggcgcattcctgaagagg

SEQ ID NO: 529264 - DNA, 25 bp, Rattus norvegicus
aagagtcgctcagccacccagtgca

SEQ ID NO: 529265 - DNA, 25 bp, Rattus norvegicus
atcatgtggtttgacgcgcggaatc

SEQ ID NO: 529266 - DNA, 25 bp, Rattus norvegicus
agcggatgaatgttttatgggatca

SEQ ID NO: 529267 - DNA, 25 bp, Rattus norvegicus
acgccctcttcatcttcggggtcga

SEQ ID NO: 529268 - DNA, 25 bp, Rattus norvegicus
tccggcagcgcgaaccatactctgt

SEQ ID NO: 529269 - DNA, 25 bp, Rattus norvegicus
cagggcccagttactagcggccagc

SEQ ID NO: 529270 - DNA, 25 bp, Rattus norvegicus
ctttcccgcaaagccgcaacttttg

SEQ ID NO: 529271 - DNA, 25 bp, Rattus norvegicus
gtcgtcgctgtcaactttcccgcaa

SEQ ID NO: 529272 - DNA, 25 bp, Rattus norvegicus
ctggtccaacatctggaacctcgga

SEQ ID NO: 529273 - DNA, 25 bp, Rattus norvegicus
aaccggccctggtccaacatctgga

SEQ ID NO: 529274 - DNA, 25 bp, Rattus norvegicus
attcgccgcctttgcgctcgtaggt

SEQ ID NO: 529275 - DNA, 25 bp, Rattus norvegicus
gctgggcacactgccctggggctga

SEQ ID NO: 529276 - DNA, 25 bp, Rattus norvegicus
ggagcatcgtttgggctttgccccg

SEQ ID NO: 529277 - DNA, 25 bp, Rattus norvegicus
ttgctggggtcctggcttctccgct

SEQ ID NO: 529278 - DNA, 25 bp, Rattus norvegicus
caagagcagcatggattggggtacc

SEQ ID NO: 529279 - DNA, 25 bp, Rattus norvegicus
attggggtaccgagttgtgggtgag

SEQ ID NO: 529280 - DNA, 25 bp, Rattus norvegicus
cacggttctcccttgctggggtcct

SEQ ID NO: 529281 - DNA, 25 bp, Rattus norvegicus
ttctcccttgctggggtcctggctt

SEQ ID NO: 529282 - DNA, 25 bp, Rattus norvegicus
ttctccgctctttgtccccgaagta

SEQ ID NO: 529283 - DNA, 25 bp, Rattus norvegicus
ccgaagtatcttagcccggactccg

SEQ ID NO: 529284 - DNA, 25 bp, Rattus norvegicus
atcttagcccggactccgcgctttt

SEQ ID NO: 529285 - DNA, 25 bp, Rattus norvegicus
ctcgaaggggcatggtagtctaggc

SEQ ID NO: 529286 - DNA, 25 bp, Rattus norvegicus
cgcgcccagctagggtctccgcgga

SEQ ID NO: 529287 - DNA, 25 bp, Rattus norvegicus
catggtagtctaggctggtgggcgt

SEQ ID NO: 529288 - DNA, 25 bp, Rattus norvegicus
gagcggaggcgtggtaaggctcgaa

SEQ ID NO: 529289 - DNA, 25 bp, Rattus norvegicus
agtgctgagcctccctgtgttgcct

SEQ ID NO: 529290 - DNA, 25 bp, Rattus norvegicus
tggcccgcgcgctatttttggcatc

SEQ ID NO: 529291 - DNA, 25 bp, Rattus norvegicus
agagcagcctcgctatgacagcggc

SEQ ID NO: 529292 - DNA, 25 bp, Rattus norvegicus
tgggtcaagagcagcctcgctatga

SEQ ID NO: 529293 - DNA, 25 bp, Rattus norvegicus
tgtcacctgggtcaagagcagcctc

SEQ ID NO: 529294 - DNA, 25 bp, Rattus norvegicus
ccttgttggaggggagctctttgta

SEQ ID NO: 529295 - DNA, 25 bp, Rattus norvegicus
cctgtgcgatgtcctccttgttgga

SEQ ID NO: 529296 - DNA, 25 bp, Rattus norvegicus
tatttttggcatccgcaggggcgcc

SEQ ID NO: 529297 - DNA, 25 bp, Rattus norvegicus
ctggaccggtcccgcggcctgtaga

SEQ ID NO: 529298 - DNA, 25 bp, Rattus norvegicus
ccgcgcgctatttttggcatccgca

SEQ ID NO: 529299 - DNA, 25 bp, Rattus norvegicus
gagtgggcgtacgtgtccctaccac

SEQ ID NO: 529300 - DNA, 25 bp, Rattus norvegicus
gagcctccctgtgttgcctgcgctg

SEQ ID NO: 529301 - DNA, 25 bp, Rattus norvegicus
cgcgatgcggctcccagtgctgagc

SEQ ID NO: 529302 - DNA, 25 bp, Rattus norvegicus
cgctatttttggcatccgcaggggc

SEQ ID NO: 529303 - DNA, 25 bp, Rattus norvegicus
ccgcgacattttgcccgttggtggc

SEQ ID NO: 529304 - DNA, 25 bp, Rattus norvegicus
gacattttgcccgttggtggccagg

SEQ ID NO: 529305 - DNA, 25 bp, Rattus norvegicus
gtgtttcaaagcgtcttcagacacg

SEQ ID NO: 529306 - DNA, 25 bp, Rattus norvegicus
cctccgcgacattttgcccgttggt

SEQ ID NO: 529307 - DNA, 25 bp, Rattus norvegicus
ttcaaagcgtcttcagacacggttc

SEQ ID NO: 529308 - DNA, 25 bp, Rattus norvegicus
caaagcgtcttcagacacggttctg

SEQ ID NO: 529309 - DNA, 25 bp, Rattus norvegicus
aagcgtcttcagacacggttctggg

SEQ ID NO: 529310 - DNA, 25 bp, Rattus norvegicus
agcgtcttcagacacggttctgggg

SEQ ID NO: 529311 - DNA, 25 bp, Rattus norvegicus
tcttcagacacggttctgggggacc

SEQ ID NO: 529312 - DNA, 25 bp, Rattus norvegicus
cctcacctactcgggtgggcgtcgt

SEQ ID NO: 529313 - DNA, 25 bp, Rattus norvegicus
tgggcgtcgtgggtcctccagtccc

SEQ ID NO: 529314 - DNA, 25 bp, Rattus norvegicus
cgccacgctcgcttcccgactccat

SEQ ID NO: 529315 - DNA, 25 bp, Rattus norvegicus
cttcccgactccattgtctccgagg

SEQ ID NO: 529316 - DNA, 25 bp, Rattus norvegicus
tgcctccgcgacattttgcccgttg

SEQ ID NO: 529317 - DNA, 25 bp, Rattus norvegicus
cgcttccagatatggaggccgttca

SEQ ID NO: 529318 - DNA, 25 bp, Rattus norvegicus
ggacatgcagggctgctcagccgtc

SEQ ID NO: 529319 - DNA, 25 bp, Rattus norvegicus
atgcagggctgctcagccgtccacc

SEQ ID NO: 529320 - DNA, 25 bp, Rattus norvegicus
tctatcgcttccagatatggaggcc

SEQ ID NO: 529321 - DNA, 25 bp, Rattus norvegicus
tcgcttccagatatggaggccgttc

SEQ ID NO: 529322 - DNA, 25 bp, Rattus norvegicus
acatgcagggctgctcagccgtcca

SEQ ID NO: 529323 - DNA, 25 bp, Rattus norvegicus
cttccagatatggaggccgttcact

SEQ ID NO: 529324 - DNA, 25 bp, Rattus norvegicus
ttccagatatggaggccgttcactg

SEQ ID NO: 529325 - DNA, 25 bp, Rattus norvegicus
tccagatatggaggccgttcactgc

SEQ ID NO: 529326 - DNA, 25 bp, Rattus norvegicus
gatatggaggccgttcactgccgcc

SEQ ID NO: 529327 - DNA, 25 bp, Rattus norvegicus
tatggaggccgttcactgccgcctt

SEQ ID NO: 529328 - DNA, 25 bp, Rattus norvegicus
atggaggccgttcactgccgccttt

SEQ ID NO: 529329 - DNA, 25 bp, Rattus norvegicus
ctatcgcttccagatatggaggccg

SEQ ID NO: 529330 - DNA, 25 bp, Rattus norvegicus
ctctatcgcttccagatatggaggc

SEQ ID NO: 529331 - DNA, 25 bp, Rattus norvegicus
cacccacggcgcgtgtccgaggagg

SEQ ID NO: 529332 - DNA, 25 bp, Rattus norvegicus
ccgcgcgccacccacggcgcgtgtc

SEQ ID NO: 529333 - DNA, 25 bp, Rattus norvegicus
ccagatgtccgaagtagcgggcgac

SEQ ID NO: 529334 - DNA, 25 bp, Rattus norvegicus
cgcgtgtccgaggaggcgttggtct

SEQ ID NO: 529335 - DNA, 25 bp, Rattus norvegicus
aggcgttggtctcgggagcctcctt

SEQ ID NO: 529336 - DNA, 25 bp, Rattus norvegicus
gggtagaccagtactcccggcggca

SEQ ID NO: 529337 - DNA, 25 bp, Rattus norvegicus
gtagaccagtactcccggcggcact

SEQ ID NO: 529338 - DNA, 25 bp, Rattus norvegicus
ctcccggcggcactctgtctttttt

SEQ ID NO: 529339 - DNA, 25 bp, Rattus norvegicus
tcttgaaggaggtcgaccagatgtc

SEQ ID NO: 529340 - DNA, 25 bp, Rattus norvegicus
gtcgaccagatgtccgaagtagcgg

SEQ ID NO: 529341 - DNA, 25 bp, Rattus norvegicus
tcgaccagatgtccgaagtagcggg

SEQ ID NO: 529342 - DNA, 25 bp, Rattus norvegicus
gttcccgcgccggcgccattcccgc

SEQ ID NO: 529343 - DNA, 25 bp, Rattus norvegicus
gccccccgcgcggtcgaccagatac

SEQ ID NO: 529344 - DNA, 25 bp, Rattus norvegicus
accagatgtccgaagtagcgggcga

SEQ ID NO: 529345 - DNA, 25 bp, Rattus norvegicus
gtcgcacgtttgcaggcctttcgcg

SEQ ID NO: 529346 - DNA, 25 bp, Rattus norvegicus
aatcgaacgattaggccgatctcgg

SEQ ID NO: 529347 - DNA, 25 bp, Rattus norvegicus
ggttccagcagacagacccaatctg

SEQ ID NO: 529348 - DNA, 25 bp, Rattus norvegicus
cgcgagaacgagagtgagctccata

SEQ ID NO: 529349 - DNA, 25 bp, Rattus norvegicus
ctcatctgaagtatcgcgagaacga

SEQ ID NO: 529350 - DNA, 25 bp, Rattus norvegicus
tcacggtcttctatggccggtcgcc

SEQ ID NO: 529351 - DNA, 25 bp, Rattus norvegicus
tttgcgctgcctcacggtcttctat

SEQ ID NO: 529352 - DNA, 25 bp, Rattus norvegicus
gcaaagcctgctgggaaggtgcctt

SEQ ID NO: 529353 - DNA, 25 bp, Rattus norvegicus
tcacgcgctcgctccaaggaagcaa

SEQ ID NO: 529354 - DNA, 25 bp, Rattus norvegicus
gccacctacttttgctccatctttg

SEQ ID NO: 529355 - DNA, 25 bp, Rattus norvegicus
ccgatctcggttcgcaggcctgatt

SEQ ID NO: 529356 - DNA, 25 bp, Rattus norvegicus
atctgccgatctccgattaaatcga

SEQ ID NO: 529357 - DNA, 25 bp, Rattus norvegicus
aagcgccatggctagcccgcaatca

SEQ ID NO: 529358 - DNA, 25 bp, Rattus norvegicus
tgagctccatagagaggttccagca

SEQ ID NO: 529359 - DNA, 25 bp, Rattus norvegicus
gcagaccttgcgacttccccgtgga

SEQ ID NO: 529360 - DNA, 25 bp, Rattus norvegicus
aggcagctcctgactagtccgtgca

SEQ ID NO: 529361 - DNA, 25 bp, Rattus norvegicus
ttctcgggagagagacccatactca

SEQ ID NO: 529362 - DNA, 25 bp, Rattus norvegicus
cccgtggagacttcgcaagtgcccg

SEQ ID NO: 529363 - DNA, 25 bp, Rattus norvegicus
ccctatccaactttgtttcctgaga

SEQ ID NO: 529364 - DNA, 25 bp, Rattus norvegicus
agatcaaggttcactcgagattccc

SEQ ID NO: 529365 - DNA, 25 bp, Rattus norvegicus
ttttctttctggacttgtccacagt

SEQ ID NO: 529366 - DNA, 25 bp, Rattus norvegicus
cttccagaatcccttatctcggccc

SEQ ID NO: 529367 - DNA, 25 bp, Rattus norvegicus
agctcctgactagtccgtgcagacc

SEQ ID NO: 529368 - DNA, 25 bp, Rattus norvegicus
ctgacagagagcagatagcactctg

SEQ ID NO: 529369 - DNA, 25 bp, Rattus norvegicus
agagagcagatagcactctggactc

SEQ ID NO: 529370 - DNA, 25 bp, Rattus norvegicus
gatcgcgccgctactacaaatactg

SEQ ID NO: 529371 - DNA, 25 bp, Rattus norvegicus
cgcgccgctactacaaatactgaca

SEQ ID NO: 529372 - DNA, 25 bp, Rattus norvegicus
gcagctcctgactagtccgtgcaga

SEQ ID NO: 529373 - DNA, 25 bp, Rattus norvegicus
aagtctcgtcagcacacggacacca

SEQ ID NO: 529374 - DNA, 25 bp, Rattus norvegicus
gtctcgtcagcacacggacaccaca

SEQ ID NO: 529375 - DNA, 25 bp, Rattus norvegicus
ctcgtcagcacacggacaccacatc

SEQ ID NO: 529376 - DNA, 25 bp, Rattus norvegicus
gtcagcacacggacaccacatcgtc

SEQ ID NO: 529377 - DNA, 25 bp, Rattus norvegicus
acaagtctcgtcagcacacggacac

SEQ ID NO: 529378 - DNA, 25 bp, Rattus norvegicus
agcacacggacaccacatcgtcacg

SEQ ID NO: 529379 - DNA, 25 bp, Rattus norvegicus
acacggacaccacatcgtcacgcca

SEQ ID NO: 529380 - DNA, 25 bp, Rattus norvegicus
ctggtgcggtcagcgggaaactaaa

SEQ ID NO: 529381 - DNA, 25 bp, Rattus norvegicus
gagactcccgggcaccttcagagcc

SEQ ID NO: 529382 - DNA, 25 bp, Rattus norvegicus
cgggcaccttcagagccggacagct

SEQ ID NO: 529383 - DNA, 25 bp, Rattus norvegicus
cgtcagcacacggacaccacatcgt

SEQ ID NO: 529384 - DNA, 25 bp, Rattus norvegicus
gggcaccttcagagccggacagctg

SEQ ID NO: 529385 - DNA, 25 bp, Rattus norvegicus
agactcccgggcaccttcagagccg

SEQ ID NO: 529386 - DNA, 25 bp, Rattus norvegicus
tcagcacacggacaccacatcgtca

SEQ ID NO: 529387 - DNA, 25 bp, Rattus norvegicus
gcaggcttgacgctgaggcgtccat

SEQ ID NO: 529388 - DNA, 25 bp, Rattus norvegicus
cgctgaggcgtccatgtgctgacac

SEQ ID NO: 529389 - DNA, 25 bp, Rattus norvegicus
acgctgaggcgtccatgtgctgaca

SEQ ID NO: 529390 - DNA, 25 bp, Rattus norvegicus
gacgctgaggcgtccatgtgctgac

SEQ ID NO: 529391 - DNA, 25 bp, Rattus norvegicus
tgacgctgaggcgtccatgtgctga

SEQ ID NO: 529392 - DNA, 25 bp, Rattus norvegicus
gcttgacgctgaggcgtccatgtgc

SEQ ID NO: 529393 - DNA, 25 bp, Rattus norvegicus
aggcttgacgctgaggcgtccatgt

SEQ ID NO: 529394 - DNA, 25 bp, Rattus norvegicus
caggcttgacgctgaggcgtccatg

SEQ ID NO: 529395 - DNA, 25 bp, Rattus norvegicus
ctcacaccctagatagcggtggatc

SEQ ID NO: 529396 - DNA, 25 bp, Rattus norvegicus
atgcctaatcgctccggcgctcccg

SEQ ID NO: 529397 - DNA, 25 bp, Rattus norvegicus
acaccctagatagcggtggatcact

SEQ ID NO: 529398 - DNA, 25 bp, Rattus norvegicus
tcacaccctagatagcggtggatca

SEQ ID NO: 529399 - DNA, 25 bp, Rattus norvegicus
ctcttctccgtccttctgcccgcgg

SEQ ID NO: 529400 - DNA, 25 bp, Rattus norvegicus
cgctcacaccctagatagcggtgga

SEQ ID NO: 529401 - DNA, 25 bp, Rattus norvegicus
ccgctcacaccctagatagcggtgg

SEQ ID NO: 529402 - DNA, 25 bp, Rattus norvegicus
tccgctcacaccctagatagcggtg

SEQ ID NO: 529403 - DNA, 25 bp, Rattus norvegicus
agtccgctcacaccctagatagcgg

SEQ ID NO: 529404 - DNA, 25 bp, Rattus norvegicus
gctcacaccctagatagcggtggat

SEQ ID NO: 529405 - DNA, 25 bp, Rattus norvegicus
cacaccctagatagcggtggatcac

SEQ ID NO: 529406 - DNA, 25 bp, Rattus norvegicus
gccctcccagaggtgctgggttctg

SEQ ID NO: 529407 - DNA, 25 bp, Rattus norvegicus
ggccctcccagaggtgctgggttct

SEQ ID NO: 529408 - DNA, 25 bp, Rattus norvegicus
cggccctcccagaggtgctgggttc

SEQ ID NO: 529409 - DNA, 25 bp, Rattus norvegicus
ccggccctcccagaggtgctgggtt

SEQ ID NO: 529410 - DNA, 25 bp, Rattus norvegicus
atgctgcggcgtccgtgtgctgaca

SEQ ID NO: 529411 - DNA, 25 bp, Rattus norvegicus
ccctcccagaggtgctgggttctgg

SEQ ID NO: 529412 - DNA, 25 bp, Rattus norvegicus
ttcctgctggctggcccaaggtgga

SEQ ID NO: 529413 - DNA, 25 bp, Rattus norvegicus
cctatgtccttgactctgtgcacct

SEQ ID NO: 529414 - DNA, 25 bp, Rattus norvegicus
tatgtccttgactctgtgcacctgc

SEQ ID NO: 529415 - DNA, 25 bp, Rattus norvegicus
tctgccactggtgggctctcacagc

SEQ ID NO: 529416 - DNA, 25 bp, Rattus norvegicus
gcgtgcaggggatgcctctgccact

SEQ ID NO: 529417 - DNA, 25 bp, Rattus norvegicus
cccagatactgacacgacacttagt

SEQ ID NO: 529418 - DNA, 25 bp, Rattus norvegicus
cagatactgacacgacacttagtgg

SEQ ID NO: 529419 - DNA, 25 bp, Rattus norvegicus
gatactgacacgacacttagtggtg

SEQ ID NO: 529420 - DNA, 25 bp, Rattus norvegicus
atactgacacgacacttagtggtgg

SEQ ID NO: 529421 - DNA, 25 bp, Rattus norvegicus
ctgacacgacacttagtggtggatc

SEQ ID NO: 529422 - DNA, 25 bp, Rattus norvegicus
gacacgacacttagtggtggatcac

SEQ ID NO: 529423 - DNA, 25 bp, Rattus norvegicus
cacgacacttagtggtggatcactt

SEQ ID NO: 529424 - DNA, 25 bp, Rattus norvegicus
cgtgcaggggatgcctctgccactg

SEQ ID NO: 529425 - DNA, 25 bp, Rattus norvegicus
ctctgccactggtgggctctcacag

SEQ ID NO: 529426 - DNA, 25 bp, Rattus norvegicus
aactggtgatgcagcggcgttattc

SEQ ID NO: 529427 - DNA, 25 bp, Rattus norvegicus
aacagatgccaactggtgatgcagc

SEQ ID NO: 529428 - DNA, 25 bp, Rattus norvegicus
tgaactagactctggcacgctaact

SEQ ID NO: 529429 - DNA, 25 bp, Rattus norvegicus
gttattcccatgatagtcaagcagc

SEQ ID NO: 529430 - DNA, 25 bp, Rattus norvegicus
gtcaagcagcttctgggaaaccaaa

SEQ ID NO: 529431 - DNA, 25 bp, Rattus norvegicus
ttaacggaaatgactgaagggcacc

SEQ ID NO: 529432 - DNA, 25 bp, Rattus norvegicus
atgactgaagggcaccatcaggagt

SEQ ID NO: 529433 - DNA, 25 bp, Rattus norvegicus
acacaggaatcctaaccaggccagg

SEQ ID NO: 529434 - DNA, 25 bp, Rattus norvegicus
ccaggccaggacacagacagaattg

SEQ ID NO: 529435 - DNA, 25 bp, Rattus norvegicus
ggggtacataactaaacagatgcca

SEQ ID NO: 529436 - DNA, 25 bp, Rattus norvegicus
ttggtggagcaatatgtctggttag

SEQ ID NO: 529437 - DNA, 25 bp, Rattus norvegicus
gcaatatgtctggttagttccgata

SEQ ID NO: 529438 - DNA, 25 bp, Rattus norvegicus
gttccgataatgaactagactctgg

SEQ ID NO: 529439 - DNA, 25 bp, Rattus norvegicus
gcagcttaatttcactcaacacagg

SEQ ID NO: 529440 - DNA, 25 bp, Rattus norvegicus
ccgcagccgtcgaagctgggaactg

SEQ ID NO: 529441 - DNA, 25 bp, Rattus norvegicus
ttgctgcgtactttttcggacttcg

SEQ ID NO: 529442 - DNA, 25 bp, Rattus norvegicus
ctttttgctgcgctcggtggcacca

SEQ ID NO: 529443 - DNA, 25 bp, Rattus norvegicus
ctactcaagcatggtcaggctgagc

SEQ ID NO: 529444 - DNA, 25 bp, Rattus norvegicus
gtcgggtagggccactactcaagca

SEQ ID NO: 529445 - DNA, 25 bp, Rattus norvegicus
aactggcgcgcaacctgctagtgct

SEQ ID NO: 529446 - DNA, 25 bp, Rattus norvegicus
cacacaggaggcgtaccgcagccgt

SEQ ID NO: 529447 - DNA, 25 bp, Rattus norvegicus
gtgccagccgtggacttcaccaaca

SEQ ID NO: 529448 - DNA, 25 bp, Rattus norvegicus
tcccgcgaaccctgaggctttgcgg

SEQ ID NO: 529449 - DNA, 25 bp, Rattus norvegicus
ccatggctctgaagcgggtcttttt

SEQ ID NO: 529450 - DNA, 25 bp, Rattus norvegicus
aaccaaaccgcgagcccaggagcag

SEQ ID NO: 529451 - DNA, 25 bp, Rattus norvegicus
gcccaatgtacttaagcttcctgag

SEQ ID NO: 529452 - DNA, 25 bp, Rattus norvegicus
tccaaggcgtggctagcccaatgta

SEQ ID NO: 529453 - DNA, 25 bp, Rattus norvegicus
cgccggtgctgctagcgcaccatga

SEQ ID NO: 529454 - DNA, 25 bp, Rattus norvegicus
tgggcagaggcaaaagcgtttgcca

SEQ ID NO: 529455 - DNA, 25 bp, Rattus norvegicus
tagggattccgattctcaaaccatg

SEQ ID NO: 529456 - DNA, 25 bp, Rattus norvegicus
ccaggtcagttagggattccgattc

SEQ ID NO: 529457 - DNA, 25 bp, Rattus norvegicus
tgaacgtgggctgccgctcaacaac

SEQ ID NO: 529458 - DNA, 25 bp, Rattus norvegicus
ctcaacaacgggcagatcaggaatc

SEQ ID NO: 529459 - DNA, 25 bp, Rattus norvegicus
gatcaggaatcttaccaggcacgca

SEQ ID NO: 529460 - DNA, 25 bp, Rattus norvegicus
cgcacattgatacggagggaagtaa

SEQ ID NO: 529461 - DNA, 25 bp, Rattus norvegicus
ccgattctcaaaccatgacgcagcg

SEQ ID NO: 529462 - DNA, 25 bp, Rattus norvegicus
gcaaaagcgtttgccacggaggtaa

SEQ ID NO: 529463 - DNA, 25 bp, Rattus norvegicus
ggaggtaaacgcctctccgtatgta

SEQ ID NO: 529464 - DNA, 25 bp, Rattus norvegicus
gcctctccgtatgtatctcagccta

SEQ ID NO: 529465 - DNA, 25 bp, Rattus norvegicus
tgtatctcagcctacgcaagggacc

SEQ ID NO: 529466 - DNA, 25 bp, Rattus norvegicus
acgcaagggaccaccaggtcagtta

SEQ ID NO: 529467 - DNA, 25 bp, Rattus norvegicus
taccaggcacgcacattgatacgga

SEQ ID NO: 529468 - DNA, 25 bp, Rattus norvegicus
caatcctgcgcctgctcaggctgtg

SEQ ID NO: 529469 - DNA, 25 bp, Rattus norvegicus
tcctgcgcctgctcaggctgtgata

SEQ ID NO: 529470 - DNA, 25 bp, Rattus norvegicus
agtcattgcgatgtaagtggttata

SEQ ID NO: 529471 - DNA, 25 bp, Rattus norvegicus
agagtcattgcgatgtaagtggtta

SEQ ID NO: 529472 - DNA, 25 bp, Rattus norvegicus
ctggaagtagagtcattgcgatgta

SEQ ID NO: 529473 - DNA, 25 bp, Rattus norvegicus
tccactggaagtagagtcattgcga

SEQ ID NO: 529474 - DNA, 25 bp, Rattus norvegicus
tatccactggaagtagagtcattgc

SEQ ID NO: 529475 - DNA, 25 bp, Rattus norvegicus
tgtgatatccactggaagtagagtc

SEQ ID NO: 529476 - DNA, 25 bp, Rattus norvegicus
ggctgtgatatccactggaagtaga

SEQ ID NO: 529477 - DNA, 25 bp, Rattus norvegicus
caggctgtgatatccactggaagta

SEQ ID NO: 529478 - DNA, 25 bp, Rattus norvegicus
gctcaggctgtgatatccactggaa

SEQ ID NO: 529479 - DNA, 25 bp, Rattus norvegicus
cctgctcaggctgtgatatccactg

SEQ ID NO: 529480 - DNA, 25 bp, Rattus norvegicus
cgcctgctcaggctgtgatatccac

SEQ ID NO: 529481 - DNA, 25 bp, Rattus norvegicus
ctgcgcctgctcaggctgtgatatc

SEQ ID NO: 529482 - DNA, 25 bp, Rattus norvegicus
aactggaaggagcatggggtactta

SEQ ID NO: 529483 - DNA, 25 bp, Rattus norvegicus
tatggccatgctaaaggcctaccat

SEQ ID NO: 529484 - DNA, 25 bp, Rattus norvegicus
caaaattatggccatgctaaaggcc

SEQ ID NO: 529485 - DNA, 25 bp, Rattus norvegicus
tgcaaacaaaattatggccatgcta

SEQ ID NO: 529486 - DNA, 25 bp, Rattus norvegicus
gtagctaatgcaaacaaaattatgg

SEQ ID NO: 529487 - DNA, 25 bp, Rattus norvegicus
ggatcagtagctaatgcaaacaaaa

SEQ ID NO: 529488 - DNA, 25 bp, Rattus norvegicus
ggaggatcagtagctaatgcaaaca

SEQ ID NO: 529489 - DNA, 25 bp, Rattus norvegicus
ctaaaggaggatcagtagctaatgc

SEQ ID NO: 529490 - DNA, 25 bp, Rattus norvegicus
aaggagcatggggtacttatgacta

SEQ ID NO: 529491 - DNA, 25 bp, Rattus norvegicus
ctaactggaaggagcatggggtact

SEQ ID NO: 529492 - DNA, 25 bp, Rattus norvegicus
ccctaactggaaggagcatggggta

SEQ ID NO: 529493 - DNA, 25 bp, Rattus norvegicus
gcatggggtacttatgactaaagga

SEQ ID NO: 529494 - DNA, 25 bp, Rattus norvegicus
gggtacttatgactaaaggaggatc

SEQ ID NO: 529495 - DNA, 25 bp, Rattus norvegicus
ttatgactaaaggaggatcagtagc

SEQ ID NO: 529496 - DNA, 25 bp, Rattus norvegicus
tcaaacaccgttccgtcgagcagcg

SEQ ID NO: 529497 - DNA, 25 bp, Rattus norvegicus
ctgtgggcagaccaccgagttgaca

SEQ ID NO: 529498 - DNA, 25 bp, Rattus norvegicus
ggcagttccttgaccaggctctgta

SEQ ID NO: 529499 - DNA, 25 bp, Rattus norvegicus
tctgtagcgctgacagcagctggta

SEQ ID NO: 529500 - DNA, 25 bp, Rattus norvegicus
ggcgcccgcatagcggtccatagcg

SEQ ID NO: 529501 - DNA, 25 bp, Rattus norvegicus
ttacgtcattctccagcgcggatga

SEQ ID NO: 529502 - DNA, 25 bp, Rattus norvegicus
tctccggtcagtctcagtctggctc

SEQ ID NO: 529503 - DNA, 25 bp, Rattus norvegicus
cctccagggagacttagtaaacgct

SEQ ID NO: 529504 - DNA, 25 bp, Rattus norvegicus
gtcgttggttgtagaggctcttctc

SEQ ID NO: 529505 - DNA, 25 bp, Rattus norvegicus
cctctgtgttcgttctgcagccgca

SEQ ID NO: 529506 - DNA, 25 bp, Rattus norvegicus
cctgcggctagggacgccctagaaa

SEQ ID NO: 529507 - DNA, 25 bp, Rattus norvegicus
agctgaccttggaggtacgcgtccg

SEQ ID NO: 529508 - DNA, 25 bp, Rattus norvegicus
tagtaaacgctctttgtcctcggaa

SEQ ID NO: 529509 - DNA, 25 bp, Rattus norvegicus
tgcgtcacgcacattcaggcgcgtc

SEQ ID NO: 529510 - DNA, 25 bp, Rattus norvegicus
tattgtgaagggattgtggaacatc

SEQ ID NO: 529511 - DNA, 25 bp, Rattus norvegicus
attgtggaacatcttgaacacggag

SEQ ID NO: 529512 - DNA, 25 bp, Rattus norvegicus
gattgtggaacatcttgaacacgga

SEQ ID NO: 529513 - DNA, 25 bp, Rattus norvegicus
gggattgtggaacatcttgaacacg

SEQ ID NO: 529514 - DNA, 25 bp, Rattus norvegicus
agggattgtggaacatcttgaacac

SEQ ID NO: 529515 - DNA, 25 bp, Rattus norvegicus
aagggattgtggaacatcttgaaca

SEQ ID NO: 529516 - DNA, 25 bp, Rattus norvegicus
tgtgaagggattgtggaacatcttg

SEQ ID NO: 529517 - DNA, 25 bp, Rattus norvegicus
ccatattgtgaagggattgtggaac

SEQ ID NO: 529518 - DNA, 25 bp, Rattus norvegicus
cccatattgtgaagggattgtggaa

SEQ ID NO: 529519 - DNA, 25 bp, Rattus norvegicus
agttgctggccccatattgtgaagg

SEQ ID NO: 529520 - DNA, 25 bp, Rattus norvegicus
cacgggaaagtctgaggtctgcacg

SEQ ID NO: 529521 - DNA, 25 bp, Rattus norvegicus
ctgcacgggaaagtctgaggtctgc

SEQ ID NO: 529522 - DNA, 25 bp, Rattus norvegicus
tctgcacgggaaagtctgaggtctg

SEQ ID NO: 529523 - DNA, 25 bp, Rattus norvegicus
tgaagggattgtggaacatcttgaa

SEQ ID NO: 529524 - DNA, 25 bp, Rattus norvegicus
atcctttgatacagctctctctccc

SEQ ID NO: 529525 - DNA, 25 bp, Rattus norvegicus
tatcctttgatacagctctctctcc

SEQ ID NO: 529526 - DNA, 25 bp, Rattus norvegicus
cctttgatacagctctctctccctt

SEQ ID NO: 529527 - DNA, 25 bp, Rattus norvegicus
gtatcctttgatacagctctctctc

SEQ ID NO: 529528 - DNA, 25 bp, Rattus norvegicus
gctgtatcctttgatacagctctct

SEQ ID NO: 529529 - DNA, 25 bp, Rattus norvegicus
agctgtatcctttgatacagctctc

SEQ ID NO: 529530 - DNA, 25 bp, Rattus norvegicus
tatactcctaaatcaaaaataaagc

SEQ ID NO: 529531 - DNA, 25 bp, Rattus norvegicus
cacgagaacaaacacacaccggcac

SEQ ID NO: 529532 - DNA, 25 bp, Rattus norvegicus
acacgagaacaaacacacaccggca

SEQ ID NO: 529533 - DNA, 25 bp, Rattus norvegicus
cgagaacaaacacacaccggcacac

SEQ ID NO: 529534 - DNA, 25 bp, Rattus norvegicus
gagaacaaacacacaccggcacaca

SEQ ID NO: 529535 - DNA, 25 bp, Rattus norvegicus
gcacacgcaggcacagtcgggcaca

SEQ ID NO: 529536 - DNA, 25 bp, Rattus norvegicus
cacacgcaggcacagtcgggcacac

SEQ ID NO: 529537 - DNA, 25 bp, Rattus norvegicus
acacgcaggcacagtcgggcacaca

SEQ ID NO: 529538 - DNA, 25 bp, Rattus norvegicus
atatactcctaaatcaaaaataaag

SEQ ID NO: 529539 - DNA, 25 bp, Rattus norvegicus
ctcctaaatcaaaaataaagcccag

SEQ ID NO: 529540 - DNA, 25 bp, Rattus norvegicus
acgagaacaaacacacaccggcaca

SEQ ID NO: 529541 - DNA, 25 bp, Rattus norvegicus
tcctaaatcaaaaataaagcccaga

SEQ ID NO: 529542 - DNA, 25 bp, Rattus norvegicus
cgcaggcacagtcgggcacacacac

SEQ ID NO: 529543 - DNA, 25 bp, Rattus norvegicus
tgaggtgacccgcacgttgcatccc

SEQ ID NO: 529544 - DNA, 25 bp, Rattus norvegicus
gcaaacacctgatctggagcgtggc

SEQ ID NO: 529545 - DNA, 25 bp, Rattus norvegicus
cggcaaacacctgatctggagcgtg

SEQ ID NO: 529546 - DNA, 25 bp, Rattus norvegicus
gagggcggcaaacacctgatctgga

SEQ ID NO: 529547 - DNA, 25 bp, Rattus norvegicus
agcacttctcttcgcgcgtggcggc

SEQ ID NO: 529548 - DNA, 25 bp, Rattus norvegicus
gggtcagcacttctcttcgcgcgtg

SEQ ID NO: 529549 - DNA, 25 bp, Rattus norvegicus
tccggtccgggtcagcacttctctt

SEQ ID NO: 529550 - DNA, 25 bp, Rattus norvegicus
aattcttgtccggtccgggtcagca

SEQ ID NO: 529551 - DNA, 25 bp, Rattus norvegicus
aggctgtcgcgagcacaccgttcgc

SEQ ID NO: 529552 - DNA, 25 bp, Rattus norvegicus
aggtgtaggctgtcgcgagcacacc

SEQ ID NO: 529553 - DNA, 25 bp, Rattus norvegicus
tttcatgcccagatgtggaggtgta

SEQ ID NO: 529554 - DNA, 25 bp, Rattus norvegicus
gacggggctcccagtttcatgccca

SEQ ID NO: 529555 - DNA, 25 bp, Rattus norvegicus
tggagcttgaggtgacccgcacgtt

SEQ ID NO: 529556 - DNA, 25 bp, Rattus norvegicus
gctcccagtttcatgcccagatgtg

SEQ ID NO: 529557 - DNA, 25 bp, Rattus norvegicus
tcaactacagctagatgaacgcgcg

SEQ ID NO: 529558 - DNA, 25 bp, Rattus norvegicus
cactgctacccgctttggcaaagag

SEQ ID NO: 529559 - DNA, 25 bp, Rattus norvegicus
gactgcgtgcggcaaactgtccgca

SEQ ID NO: 529560 - DNA, 25 bp, Rattus norvegicus
gcaaagagttgctgtcccgagacca

SEQ ID NO: 529561 - DNA, 25 bp, Rattus norvegicus
atgaacgcgcgaacccaccgcggta

SEQ ID NO: 529562 - DNA, 25 bp, Rattus norvegicus
gagaccacgcctccggcggtgttct

SEQ ID NO: 529563 - DNA, 25 bp, Rattus norvegicus
ggtatccctagccacggatgtttga

SEQ ID NO: 529564 - DNA, 25 bp, Rattus norvegicus
ctgggtccactaggcaagggtatcc

SEQ ID NO: 529565 - DNA, 25 bp, Rattus norvegicus
ctagcaggtgggtcattcggaaccc

SEQ ID NO: 529566 - DNA, 25 bp, Rattus norvegicus
tccgggaaagccaaactgacgcacc

SEQ ID NO: 529567 - DNA, 25 bp, Rattus norvegicus
gaattggtcgcggtctctgtagcct

SEQ ID NO: 529568 - DNA, 25 bp, Rattus norvegicus
ccgcctccgggaccagaattggtcg

SEQ ID NO: 529569 - DNA, 25 bp, Rattus norvegicus
cggccattggttgatctcagctctc

SEQ ID NO: 529570 - DNA, 25 bp, Rattus norvegicus
aggagctagggtcctgaccgcgcct

SEQ ID NO: 529571 - DNA, 25 bp, Rattus norvegicus
gtgctgcgagcagagtctcagccac

SEQ ID NO: 529572 - DNA, 25 bp, Rattus norvegicus
cgacgagcccatcccccgccacgcc

SEQ ID NO: 529573 - DNA, 25 bp, Rattus norvegicus
ggtgctgcgagcagagtctcagcca

SEQ ID NO: 529574 - DNA, 25 bp, Rattus norvegicus
aggtgctgcgagcagagtctcagcc

SEQ ID NO: 529575 - DNA, 25 bp, Rattus norvegicus
agtcagcgcacggactcagtggcat

SEQ ID NO: 529576 - DNA, 25 bp, Rattus norvegicus
caagtcagcgcacggactcagtggc

SEQ ID NO: 529577 - DNA, 25 bp, Rattus norvegicus
accgccagcttcaggcgcagggtgc

SEQ ID NO: 529578 - DNA, 25 bp, Rattus norvegicus
ctcggtgtcatcacattcatcggtc

SEQ ID NO: 529579 - DNA, 25 bp, Rattus norvegicus
tgcgaggttgccctccaggactcag

SEQ ID NO: 529580 - DNA, 25 bp, Rattus norvegicus
taggctcagctctgcggcgcgcaga

SEQ ID NO: 529581 - DNA, 25 bp, Rattus norvegicus
ggcgttcattccgacctaggctcag

SEQ ID NO: 529582 - DNA, 25 bp, Rattus norvegicus
gcagcatcaactcgcggcgttcatt

SEQ ID NO: 529583 - DNA, 25 bp, Rattus norvegicus
cgggtgcctgcagtcgcagcatcaa

SEQ ID NO: 529584 - DNA, 25 bp, Rattus norvegicus
cagtgggaaacagcgtggccgccct

SEQ ID NO: 529585 - DNA, 25 bp, Rattus norvegicus
ggacagtcagagagcagcagttgca

SEQ ID NO: 529586 - DNA, 25 bp, Rattus norvegicus
cggaccgagcaattgcgcacgggca

SEQ ID NO: 529587 - DNA, 25 bp, Rattus norvegicus
atcgtgacaaagtctcggggccgcg

SEQ ID NO: 529588 - DNA, 25 bp, Rattus norvegicus
cggctgcactggactgatcgtgaca

SEQ ID NO: 529589 - DNA, 25 bp, Rattus norvegicus
ccagcgctgagtctggagccttggt

SEQ ID NO: 529590 - DNA, 25 bp, Rattus norvegicus
gtcgcaaagtgctgcgcccaactgc

SEQ ID NO: 529591 - DNA, 25 bp, Rattus norvegicus
aatccctgctgcgtgccacagtggc

SEQ ID NO: 529592 - DNA, 25 bp, Rattus norvegicus
agcttgatgatcaattgccaccccc

SEQ ID NO: 529593 - DNA, 25 bp, Rattus norvegicus
ggtctgggaggtgggccttgcccac

SEQ ID NO: 529594 - DNA, 25 bp, Rattus norvegicus
ccagtgcacgcgtgcacgcggagaa

SEQ ID NO: 529595 - DNA, 25 bp, Rattus norvegicus
cgcgtgcacgcggagaaagcgacct

SEQ ID NO: 529596 - DNA, 25 bp, Rattus norvegicus
cgaatccctgctgcgtgccacagtg

SEQ ID NO: 529597 - DNA, 25 bp, Rattus norvegicus
tccttaggatcgagcccagcccgtg

SEQ ID NO: 529598 - DNA, 25 bp, Rattus norvegicus
tgcgtgccacagtggcgcgggaaat

SEQ ID NO: 529599 - DNA, 25 bp, Rattus norvegicus
atccctgctgcgtgccacagtggcg

SEQ ID NO: 529600 - DNA, 25 bp, Rattus norvegicus
cgcttgtggggaggccaagtcctta

SEQ ID NO: 529601 - DNA, 25 bp, Rattus norvegicus
ggaggccaagtccttaggatcgagc

SEQ ID NO: 529602 - DNA, 25 bp, Rattus norvegicus
ggccaagtccttaggatcgagccca

SEQ ID NO: 529603 - DNA, 25 bp, Rattus norvegicus
caagtccttaggatcgagcccagcc

SEQ ID NO: 529604 - DNA, 25 bp, Rattus norvegicus
agtccttaggatcgagcccagcccg

SEQ ID NO: 529605 - DNA, 25 bp, Rattus norvegicus
aatcccggccgagcgcctgacttgc

SEQ ID NO: 529606 - DNA, 25 bp, Rattus norvegicus
cttgccgctcattgactggctgcca

SEQ ID NO: 529607 - DNA, 25 bp, Rattus norvegicus
ccgctcattgactggctgccactgg

SEQ ID NO: 529608 - DNA, 25 bp, Rattus norvegicus
gccgctcattgactggctgccactg

SEQ ID NO: 529609 - DNA, 25 bp, Rattus norvegicus
tgccgctcattgactggctgccact

SEQ ID NO: 529610 - DNA, 25 bp, Rattus norvegicus
cgctcattgactggctgccactggg

SEQ ID NO: 529611 - DNA, 25 bp, Rattus norvegicus
ttgccgctcattgactggctgccac

SEQ ID NO: 529612 - DNA, 25 bp, Rattus norvegicus
tgacttgccgctcattgactggctg

SEQ ID NO: 529613 - DNA, 25 bp, Rattus norvegicus
cctgacttgccgctcattgactggc

SEQ ID NO: 529614 - DNA, 25 bp, Rattus norvegicus
agcgcctgacttgccgctcattgac

SEQ ID NO: 529615 - DNA, 25 bp, Rattus norvegicus
cgagcgcctgacttgccgctcattg

SEQ ID NO: 529616 - DNA, 25 bp, Rattus norvegicus
ctcattgactggctgccactgggtg

SEQ ID NO: 529617 - DNA, 25 bp, Rattus norvegicus
gagcgcctgacttgccgctcattga

SEQ ID NO: 529618 - DNA, 25 bp, Rattus norvegicus
acttgccgctcattgactggctgcc

SEQ ID NO: 529619 - DNA, 25 bp, Rattus norvegicus
atcccgggatcaagtctggtcagca

SEQ ID NO: 529620 - DNA, 25 bp, Rattus norvegicus
ctttctccgtgtgcactggcaggtg

SEQ ID NO: 529621 - DNA, 25 bp, Rattus norvegicus
cacatcccgggatcaagtctggtca

SEQ ID NO: 529622 - DNA, 25 bp, Rattus norvegicus
gagggcctaggggagccctgtgagc

SEQ ID NO: 529623 - DNA, 25 bp, Rattus norvegicus
taccggagacaggtccctcgggtgc

SEQ ID NO: 529624 - DNA, 25 bp, Rattus norvegicus
ctcaggggggcggaaattgatcctc

SEQ ID NO: 529625 - DNA, 25 bp, Rattus norvegicus
cgggatcaagtctggtcagcacaca

SEQ ID NO: 529626 - DNA, 25 bp, Rattus norvegicus
gtcgctttctccgtgtgcactggca

SEQ ID NO: 529627 - DNA, 25 bp, Rattus norvegicus
cccgctggcacccaagcagtcggcc

SEQ ID NO: 529628 - DNA, 25 bp, Rattus norvegicus
gtcccgcccgctggcacccaagcag

SEQ ID NO: 529629 - DNA, 25 bp, Rattus norvegicus
ggtcagcacacagatgccgcggcgt

SEQ ID NO: 529630 - DNA, 25 bp, Rattus norvegicus
gtctggtcagcacacagatgccgcg

SEQ ID NO: 529631 - DNA, 25 bp, Rattus norvegicus
tcaagtctggtcagcacacagatgc

SEQ ID NO: 529632 - DNA, 25 bp, Rattus norvegicus
ctaaaggatgcaagtgaaaagaaag

SEQ ID NO: 529633 - DNA, 25 bp, Rattus norvegicus
gggcttatcccttccttccagatag

SEQ ID NO: 529634 - DNA, 25 bp, Rattus norvegicus
gagctaggggcttatcccttccttc

SEQ ID NO: 529635 - DNA, 25 bp, Rattus norvegicus
gctggttcctgcattcatttttcct

SEQ ID NO: 529636 - DNA, 25 bp, Rattus norvegicus
aagtgacccacagcttgtctgtatc

SEQ ID NO: 529637 - DNA, 25 bp, Rattus norvegicus
tgacccacagcttgtctgtatctgg

SEQ ID NO: 529638 - DNA, 25 bp, Rattus norvegicus
ccacagcttgtctgtatctgggatg

SEQ ID NO: 529639 - DNA, 25 bp, Rattus norvegicus
aggctggttcctgcattcatttttc

SEQ ID NO: 529640 - DNA, 25 bp, Rattus norvegicus
cagcttgtctgtatctgggatgtga

SEQ ID NO: 529641 - DNA, 25 bp, Rattus norvegicus
tcccttccttccagatagcctatga

SEQ ID NO: 529642 - DNA, 25 bp, Rattus norvegicus
cttccagatagcctatgagtcagca

SEQ ID NO: 529643 - DNA, 25 bp, Rattus norvegicus
gatagcctatgagtcagcactgata

SEQ ID NO: 529644 - DNA, 25 bp, Rattus norvegicus
gcctatgagtcagcactgataactc

SEQ ID NO: 529645 - DNA, 25 bp, Rattus norvegicus
agcactgataactcaggctggttcc

SEQ ID NO: 529646 - DNA, 25 bp, Rattus norvegicus
ataactcaggctggttcctgcattc

SEQ ID NO: 529647 - DNA, 25 bp, Rattus norvegicus
acgcagtgctgtaccgcgatcctca

SEQ ID NO: 529648 - DNA, 25 bp, Rattus norvegicus
aatgtatttcggatgggctacgacg

SEQ ID NO: 529649 - DNA, 25 bp, Rattus norvegicus
cctgaatgtatttcggatgggctac

SEQ ID NO: 529650 - DNA, 25 bp, Rattus norvegicus
cgtctgcctgaatgtatttcggatg

SEQ ID NO: 529651 - DNA, 25 bp, Rattus norvegicus
gtaccgtctgcctgaatgtatttcg

SEQ ID NO: 529652 - DNA, 25 bp, Rattus norvegicus
gctgtaccgtctgcctgaatgtatt

SEQ ID NO: 529653 - DNA, 25 bp, Rattus norvegicus
cagctgtaccgtctgcctgaatgta

SEQ ID NO: 529654 - DNA, 25 bp, Rattus norvegicus
ttcggcagctgtaccgtctgcctga

SEQ ID NO: 529655 - DNA, 25 bp, Rattus norvegicus
tgctcttcggcagctgtaccgtctg

SEQ ID NO: 529656 - DNA, 25 bp, Rattus norvegicus
ctccctggtgctcttcggcagctgt

SEQ ID NO: 529657 - DNA, 25 bp, Rattus norvegicus
ggccaggctccctggtgctcttcgg

SEQ ID NO: 529658 - DNA, 25 bp, Rattus norvegicus
acccgcccacgagcatctgtctatc

SEQ ID NO: 529659 - DNA, 25 bp, Rattus norvegicus
gctgtaccgcgatcctcacgcggga

SEQ ID NO: 529660 - DNA, 25 bp, Rattus norvegicus
cgatcctcacgcgggaccggtttgg

SEQ ID NO: 529661 - DNA, 25 bp, Rattus norvegicus
ggtccttagattttcccgcgctcgc

SEQ ID NO: 529662 - DNA, 25 bp, Rattus norvegicus
agcggcgcttgttgatgacatcaca

SEQ ID NO: 529663 - DNA, 25 bp, Rattus norvegicus
cagtctaatctggaggcacctcgcg

SEQ ID NO: 529664 - DNA, 25 bp, Rattus norvegicus
ggtttcactctctgccgccagtcta

SEQ ID NO: 529665 - DNA, 25 bp, Rattus norvegicus
tagatctgactaccgtagccttcgg

SEQ ID NO: 529666 - DNA, 25 bp, Rattus norvegicus
ggccgtggatgcaggaattgcaata

SEQ ID NO: 529667 - DNA, 25 bp, Rattus norvegicus
atgacatcacaaggacgcgcccgta

SEQ ID NO: 529668 - DNA, 25 bp, Rattus norvegicus
ccaaaccggagcaagccagctaata

SEQ ID NO: 529669 - DNA, 25 bp, Rattus norvegicus
ggcctccaagacagaagcacttcac

SEQ ID NO: 529670 - DNA, 25 bp, Rattus norvegicus
cttctggaagaaacgctacctagcg

SEQ ID NO: 529671 - DNA, 25 bp, Rattus norvegicus
cgaggtttccgggagttcacttctg

SEQ ID NO: 529672 - DNA, 25 bp, Rattus norvegicus
ccatggagagcacagaccgtctagt

SEQ ID NO: 529673 - DNA, 25 bp, Rattus norvegicus
tgcctgccttgacgtgcaccatgga

SEQ ID NO: 529674 - DNA, 25 bp, Rattus norvegicus
cagctaataagccaagcggcgcttg

SEQ ID NO: 529675 - DNA, 25 bp, Rattus norvegicus
atgggtgggcttgcgcgtcccgccc

SEQ ID NO: 529676 - DNA, 25 bp, Rattus norvegicus
tgcctgtgccatgggtgggcttgcg

SEQ ID NO: 529677 - DNA, 25 bp, Rattus norvegicus
cggccctcggcagacggaggtcatt

SEQ ID NO: 529678 - DNA, 25 bp, Rattus norvegicus
accgctctcctgctctgacggtgcc

SEQ ID NO: 529679 - DNA, 25 bp, Rattus norvegicus
atggccaggacgtgctcgctctcct

SEQ ID NO: 529680 - DNA, 25 bp, Rattus norvegicus
ctgcctccatcctcgctttcgtgcg

SEQ ID NO: 529681 - DNA, 25 bp, Rattus norvegicus
cgatggccaggacgtgctcgctctc

SEQ ID NO: 529682 - DNA, 25 bp, Rattus norvegicus
gcgatggccaggacgtgctcgctct

SEQ ID NO: 529683 - DNA, 25 bp, Rattus norvegicus
tcttcccgggcgatggccaggacgt

SEQ ID NO: 529684 - DNA, 25 bp, Rattus norvegicus
atcctcgctttcgtgcgcccacctc

SEQ ID NO: 529685 - DNA, 25 bp, Rattus norvegicus
ctctgcctccatcctcgctttcgtg

SEQ ID NO: 529686 - DNA, 25 bp, Rattus norvegicus
gcgtgccgtggtcggccagccaagt

SEQ ID NO: 529687 - DNA, 25 bp, Rattus norvegicus
acggccctcggcagacggaggtcat

SEQ ID NO: 529688 - DNA, 25 bp, Rattus norvegicus
cacggccctcggcagacggaggtca

SEQ ID NO: 529689 - DNA, 25 bp, Rattus norvegicus
catcatcaaggtagatgagagacca

SEQ ID NO: 529690 - DNA, 25 bp, Rattus norvegicus
ggtagatgagagaccagcgcccctc

SEQ ID NO: 529691 - DNA, 25 bp, Rattus norvegicus
catcaaggtagatgagagaccagcg

SEQ ID NO: 529692 - DNA, 25 bp, Rattus norvegicus
aggtagatgagagaccagcgcccct

SEQ ID NO: 529693 - DNA, 25 bp, Rattus norvegicus
aaggtagatgagagaccagcgcccc

SEQ ID NO: 529694 - DNA, 25 bp, Rattus norvegicus
atcaaggtagatgagagaccagcgc

SEQ ID NO: 529695 - DNA, 25 bp, Rattus norvegicus
gcatcatcaaggtagatgagagacc

SEQ ID NO: 529696 - DNA, 25 bp, Rattus norvegicus
tcctcctggtccatggcgccgcgcc

SEQ ID NO: 529697 - DNA, 25 bp, Rattus norvegicus
ccactggcttggtgcatccaccgcc

SEQ ID NO: 529698 - DNA, 25 bp, Rattus norvegicus
tgcggttttgccactgcggggtgtg

SEQ ID NO: 529699 - DNA, 25 bp, Rattus norvegicus
gccttgtcctcctggtccatggcgc

SEQ ID NO: 529700 - DNA, 25 bp, Rattus norvegicus
ctgccactcccgctaccatcctcgc

SEQ ID NO: 529701 - DNA, 25 bp, Rattus norvegicus
tctgccccaccgtggggacttgtcg

SEQ ID NO: 529702 - DNA, 25 bp, Rattus norvegicus
cctggcgcaggaaatgtgacgtacg

SEQ ID NO: 529703 - DNA, 25 bp, Rattus norvegicus
cacctcactctgctaggggctgacg

SEQ ID NO: 529704 - DNA, 25 bp, Rattus norvegicus
ctcactctgctaggggctgacggct

SEQ ID NO: 529705 - DNA, 25 bp, Rattus norvegicus
gttcagatgtgggaggcgtccagca

SEQ ID NO: 529706 - DNA, 25 bp, Rattus norvegicus
agggtagagaggtcgaggcccaggc

SEQ ID NO: 529707 - DNA, 25 bp, Rattus norvegicus
tgccctggcgcaggaaatgtgacgt

SEQ ID NO: 529708 - DNA, 25 bp, Rattus norvegicus
ccctggcgcaggaaatgtgacgtac

SEQ ID NO: 529709 - DNA, 25 bp, Rattus norvegicus
ggcttggtgcatccaccgccgccgc

SEQ ID NO: 529710 - DNA, 25 bp, Rattus norvegicus
ctagctgtcctcttccaatgtggaa

SEQ ID NO: 529711 - DNA, 25 bp, Rattus norvegicus
tagctgtcctcttccaatgtggaag

SEQ ID NO: 529712 - DNA, 25 bp, Rattus norvegicus
gctgtcctcttccaatgtggaagtt

SEQ ID NO: 529713 - DNA, 25 bp, Rattus norvegicus
gtgatctcatctcctatgcacctgc

SEQ ID NO: 529714 - DNA, 25 bp, Rattus norvegicus
gtacctagctgtcctcttccaatgt

SEQ ID NO: 529715 - DNA, 25 bp, Rattus norvegicus
tacctagctgtcctcttccaatgtg

SEQ ID NO: 529716 - DNA, 25 bp, Rattus norvegicus
acctagctgtcctcttccaatgtgg

SEQ ID NO: 529717 - DNA, 25 bp, Rattus norvegicus
cctagctgtcctcttccaatgtgga

SEQ ID NO: 529718 - DNA, 25 bp, Rattus norvegicus
ctgtcctcttccaatgtggaagttt

SEQ ID NO: 529719 - DNA, 25 bp, Rattus norvegicus
gtcctcttccaatgtggaagtttta

SEQ ID NO: 529720 - DNA, 25 bp, Rattus norvegicus
cctcttccaatgtggaagttttaag

SEQ ID NO: 529721 - DNA, 25 bp, Rattus norvegicus
tcttccaatgtggaagttttaagac

SEQ ID NO: 529722 - DNA, 25 bp, Rattus norvegicus
tgtcgcccgggtcgttcatctcacc

SEQ ID NO: 529723 - DNA, 25 bp, Rattus norvegicus
gcccgggtcgttcatctcacctcct

SEQ ID NO: 529724 - DNA, 25 bp, Rattus norvegicus
caaaaatggctacgggacttctggg

SEQ ID NO: 529725 - DNA, 25 bp, Rattus norvegicus
cgcacgcgccgggcccgttttcagt

SEQ ID NO: 529726 - DNA, 25 bp, Rattus norvegicus
tccaccgtggtggtgcgcaaaaatg

SEQ ID NO: 529727 - DNA, 25 bp, Rattus norvegicus
ccaccgtggtggtgcgcaaaaatgg

SEQ ID NO: 529728 - DNA, 25 bp, Rattus norvegicus
caccgtggtggtgcgcaaaaatggc

SEQ ID NO: 529729 - DNA, 25 bp, Rattus norvegicus
cgtggtggtgcgcaaaaatggctac

SEQ ID NO: 529730 - DNA, 25 bp, Rattus norvegicus
tggtgcgcaaaaatggctacgggac

SEQ ID NO: 529731 - DNA, 25 bp, Rattus norvegicus
ggtgcgcaaaaatggctacgggact

SEQ ID NO: 529732 - DNA, 25 bp, Rattus norvegicus
gtgcgcaaaaatggctacgggactt

SEQ ID NO: 529733 - DNA, 25 bp, Rattus norvegicus
gcgcaaaaatggctacgggacttct

SEQ ID NO: 529734 - DNA, 25 bp, Rattus norvegicus
cgcaaaaatggctacgggacttctg

SEQ ID NO: 529735 - DNA, 25 bp, Rattus norvegicus
aaatggctacgggacttctgggaag

SEQ ID NO: 529736 - DNA, 25 bp, Rattus norvegicus
gcaaaaatggctacgggacttctgg

SEQ ID NO: 529737 - DNA, 25 bp, Rattus norvegicus
atggctacgggacttctgggaaggc

SEQ ID NO: 529738 - DNA, 25 bp, Rattus norvegicus
gcattcatggcctgtgccgcggctg

SEQ ID NO: 529739 - DNA, 25 bp, Rattus norvegicus
tgtgccgcggctgccagccaagtga

SEQ ID NO: 529740 - DNA, 25 bp, Rattus norvegicus
ttcatggcctgtgccgcggctgcca

SEQ ID NO: 529741 - DNA, 25 bp, Rattus norvegicus
ctgtgccgcggctgccagccaagtg

SEQ ID NO: 529742 - DNA, 25 bp, Rattus norvegicus
tgccgcggctgccagccaagtgagc

SEQ ID NO: 529743 - DNA, 25 bp, Rattus norvegicus
cattcatggcctgtgccgcggctgc

SEQ ID NO: 529744 - DNA, 25 bp, Rattus norvegicus
tgcattcatggcctgtgccgcggct

SEQ ID NO: 529745 - DNA, 25 bp, Rattus norvegicus
ccggttgcattcatggcctgtgccg

SEQ ID NO: 529746 - DNA, 25 bp, Rattus norvegicus
cggttgcattcatggcctgtgccgc

SEQ ID NO: 529747 - DNA, 25 bp, Rattus norvegicus
ggttgcattcatggcctgtgccgcg

SEQ ID NO: 529748 - DNA, 25 bp, Rattus norvegicus
attcatggcctgtgccgcggctgcc

SEQ ID NO: 529749 - DNA, 25 bp, Rattus norvegicus
gtgccttcccagcctgggccttccc

SEQ ID NO: 529750 - DNA, 25 bp, Rattus norvegicus
ccgcagtgccttcccagcctgggcc

SEQ ID NO: 529751 - DNA, 25 bp, Rattus norvegicus
cgcagtgccttcccagcctgggcct

SEQ ID NO: 529752 - DNA, 25 bp, Rattus norvegicus
gcagtgccttcccagcctgggcctt

SEQ ID NO: 529753 - DNA, 25 bp, Rattus norvegicus
cagtgccttcccagcctgggccttc

SEQ ID NO: 529754 - DNA, 25 bp, Rattus norvegicus
agtgccttcccagcctgggccttcc

SEQ ID NO: 529755 - DNA, 25 bp, Rattus norvegicus
tccaggcacccaaccaacccatgcc

SEQ ID NO: 529756 - DNA, 25 bp, Rattus norvegicus
cgtccaggcacccaaccaacccatg

SEQ ID NO: 529757 - DNA, 25 bp, Rattus norvegicus
tggcgtccaggcacccaaccaaccc

SEQ ID NO: 529758 - DNA, 25 bp, Rattus norvegicus
ctctggcgtccaggcacccaaccaa

SEQ ID NO: 529759 - DNA, 25 bp, Rattus norvegicus
ggtgcgcgtgctgccgcggtctgac

SEQ ID NO: 529760 - DNA, 25 bp, Rattus norvegicus
cgcgcgaacgcttggcagtccgcat

SEQ ID NO: 529761 - DNA, 25 bp, Rattus norvegicus
atgcagcaccctgtactctgacgga

SEQ ID NO: 529762 - DNA, 25 bp, Rattus norvegicus
gccggggattagctctctgaggact

SEQ ID NO: 529763 - DNA, 25 bp, Rattus norvegicus
tctctgaggactggagacgggatta

SEQ ID NO: 529764 - DNA, 25 bp, Rattus norvegicus
ggtctggggattaccgcacctccca

SEQ ID NO: 529765 - DNA, 25 bp, Rattus norvegicus
cctatgtatatattgcgcctcttgc

SEQ ID NO: 529766 - DNA, 25 bp, Rattus norvegicus
atcgagcacatcctctctagtctgc

SEQ ID NO: 529767 - DNA, 25 bp, Rattus norvegicus
ggtaaggctagacggggatctctca

SEQ ID NO: 529768 - DNA, 25 bp, Rattus norvegicus
gagcacaggatctccggcgctgact

SEQ ID NO: 529769 - DNA, 25 bp, Rattus norvegicus
ggcgccaccgtaccatcttcagtga

SEQ ID NO: 529770 - DNA, 25 bp, Rattus norvegicus
ccatcttcagtgaggagcagctgca

SEQ ID NO: 529771 - DNA, 25 bp, Rattus norvegicus
gcgctcgaggcactcttcgtacaga

SEQ ID NO: 529772 - DNA, 25 bp, Rattus norvegicus
gcaaggctctctcttcgcaatgcag

SEQ ID NO: 529773 - DNA, 25 bp, Rattus norvegicus
cagaaccagtatcccgacgtaggca

SEQ ID NO: 529774 - DNA, 25 bp, Rattus norvegicus
tgtacagtccgtggctgggtagaaa

SEQ ID NO: 529775 - DNA, 25 bp, Rattus norvegicus
ccagatcttgggcttgctgtgaggc

SEQ ID NO: 529776 - DNA, 25 bp, Rattus norvegicus
atgcggtgcactgactcccaggaaa

SEQ ID NO: 529777 - DNA, 25 bp, Rattus norvegicus
actcccaggaaagatcgcatgttca

SEQ ID NO: 529778 - DNA, 25 bp, Rattus norvegicus
cgcatgttcaacagcgagccctgtg

SEQ ID NO: 529779 - DNA, 25 bp, Rattus norvegicus
tgcctatgtggcaggtgtacagtcc

SEQ ID NO: 529780 - DNA, 25 bp, Rattus norvegicus
gcgaatcttgggacttgagtgtctc

SEQ ID NO: 529781 - DNA, 25 bp, Rattus norvegicus
tcgtcttcgttgctctggtcgccat

SEQ ID NO: 529782 - DNA, 25 bp, Rattus norvegicus
ctggtcgccatcacgttcgtcaatc

SEQ ID NO: 529783 - DNA, 25 bp, Rattus norvegicus
tcgtcaatctgatcgatgtcaatgc

SEQ ID NO: 529784 - DNA, 25 bp, Rattus norvegicus
tgtcaatgctctccaggtcgatctc

SEQ ID NO: 529785 - DNA, 25 bp, Rattus norvegicus
tcgctgccaaagagggcgccgtctt

SEQ ID NO: 529786 - DNA, 25 bp, Rattus norvegicus
tgagacctccttagccaggcccaag

SEQ ID NO: 529787 - DNA, 25 bp, Rattus norvegicus
cagttggaaaacttgcctatgtggc

SEQ ID NO: 529788 - DNA, 25 bp, Rattus norvegicus
cctcagcccagtgctggttggcggc

SEQ ID NO: 529789 - DNA, 25 bp, Rattus norvegicus
caaccctttcaggatcgggtcttca

SEQ ID NO: 529790 - DNA, 25 bp, Rattus norvegicus
ggaacgaggtctccgccaccggatc

SEQ ID NO: 529791 - DNA, 25 bp, Rattus norvegicus
tttttccagacactgcctgcgggtc

SEQ ID NO: 529792 - DNA, 25 bp, Rattus norvegicus
catctgtgagaagaggctgaggtcc

SEQ ID NO: 529793 - DNA, 25 bp, Rattus norvegicus
gcatacatgcccagcaccgaggtga

SEQ ID NO: 529794 - DNA, 25 bp, Rattus norvegicus
gcgcttaggtattgcgggtagccca

SEQ ID NO: 529795 - DNA, 25 bp, Rattus norvegicus
ggccgggctctcagacacaatttga

SEQ ID NO: 529796 - DNA, 25 bp, Rattus norvegicus
tctactagcgcacaaccctttcagg

SEQ ID NO: 529797 - DNA, 25 bp, Rattus norvegicus
cgggcaaagagactggctgtcgatc

SEQ ID NO: 529798 - DNA, 25 bp, Rattus norvegicus
gcctgctctcgggtttctctctact

SEQ ID NO: 529799 - DNA, 25 bp, Rattus norvegicus
ggcaccctaactgcgcgggcaaaga

SEQ ID NO: 529800 - DNA, 25 bp, Rattus norvegicus
ccagctgcgggaaggacatgtccgc

SEQ ID NO: 529801 - DNA, 25 bp, Rattus norvegicus
aagttgatgctttgattggcatccc

SEQ ID NO: 529802 - DNA, 25 bp, Rattus norvegicus
cgttggtcaactcggactccgagga

SEQ ID NO: 529803 - DNA, 25 bp, Rattus norvegicus
ctaggtgatggcagctgtaactatc

SEQ ID NO: 529804 - DNA, 25 bp, Rattus norvegicus
taagttattgcctgacagctgcagc

SEQ ID NO: 529805 - DNA, 25 bp, Rattus norvegicus
ccgctggcctttatagtcgcttctg

SEQ ID NO: 529806 - DNA, 25 bp, Rattus norvegicus
atagtcgcttctgcattcatccgcc

SEQ ID NO: 529807 - DNA, 25 bp, Rattus norvegicus
cggggagactcgcatcgagccctct

SEQ ID NO: 529808 - DNA, 25 bp, Rattus norvegicus
cggagagacacccacacgcagattc

SEQ ID NO: 529809 - DNA, 25 bp, Rattus norvegicus
cgcagattctgggagaactcatatt

SEQ ID NO: 529810 - DNA, 25 bp, Rattus norvegicus
aagatattaaaaagctcgcgcgagc

SEQ ID NO: 529811 - DNA, 25 bp, Rattus norvegicus
cccaagctggttttgcgttggtcaa

SEQ ID NO: 529812 - DNA, 25 bp, Rattus norvegicus
ctgcagtgggcgagtcgcctgccca

SEQ ID NO: 529813 - DNA, 25 bp, Rattus norvegicus
aactcatatttctcttggccggccc

SEQ ID NO: 529814 - DNA, 25 bp, Rattus norvegicus
catcgagccctctcgcggagagaca

SEQ ID NO: 529815 - DNA, 25 bp, Rattus norvegicus
aggcgaggcgcatgcccaggcacac

SEQ ID NO: 529816 - DNA, 25 bp, Rattus norvegicus
gcatagaaccaaagcgcaggctcta

SEQ ID NO: 529817 - DNA, 25 bp, Rattus norvegicus
gaggaaagcggtccacccgctggta

SEQ ID NO: 529818 - DNA, 25 bp, Rattus norvegicus
agcgcccacgggagggaacagcata

SEQ ID NO: 529819 - DNA, 25 bp, Rattus norvegicus
cgcatgctctagaggccaaaacagc

SEQ ID NO: 529820 - DNA, 25 bp, Rattus norvegicus
ccacgaaagggaacagcatagaacc

SEQ ID NO: 529821 - DNA, 25 bp, Rattus norvegicus
cgcaggctctaagatacacaggtca

SEQ ID NO: 529822 - DNA, 25 bp, Rattus norvegicus
gcagagtccaccacccgggtcatag

SEQ ID NO: 529823 - DNA, 25 bp, Rattus norvegicus
acactaaccgtatgctagccacgcg

SEQ ID NO: 529824 - DNA, 25 bp, Rattus norvegicus
ccgtatgctagccacgcggaaggca

SEQ ID NO: 529825 - DNA, 25 bp, Rattus norvegicus
acccgctggtaacaacgcacctgta

SEQ ID NO: 529826 - DNA, 25 bp, Rattus norvegicus
tagccacgcggaaggcagagtccac

SEQ ID NO: 529827 - DNA, 25 bp, Rattus norvegicus
ctaagatacacaggtcagacttttc

SEQ ID NO: 529828 - DNA, 25 bp, Rattus norvegicus
tagaggccaaaacagcgccgtgcgc

SEQ ID NO: 529829 - DNA, 25 bp, Rattus norvegicus
cgctggtaacaacgcacctgtatcg

SEQ ID NO: 529830 - DNA, 25 bp, Rattus norvegicus
tcgcgaaagaaaatagccaaaagct

SEQ ID NO: 529831 - DNA, 25 bp, Rattus norvegicus
ccactagtcaattcgggaggatcga

SEQ ID NO: 529832 - DNA, 25 bp, Rattus norvegicus
ttcgggaggatcgaaacggcagatc

SEQ ID NO: 529833 - DNA, 25 bp, Rattus norvegicus
cggcagatcgcaaaaacagtacata

SEQ ID NO: 529834 - DNA, 25 bp, Rattus norvegicus
aaacagtacatacagaaggagacgt

SEQ ID NO: 529835 - DNA, 25 bp, Rattus norvegicus
gagacgtgtacatgagcatcagaaa

SEQ ID NO: 529836 - DNA, 25 bp, Rattus norvegicus
attgtaagacaagccacagttctga

SEQ ID NO: 529837 - DNA, 25 bp, Rattus norvegicus
gccacagttctgacttttacgactg

SEQ ID NO: 529838 - DNA, 25 bp, Rattus norvegicus
tgacttttacgactgcacttctggc

SEQ ID NO: 529839 - DNA, 25 bp, Rattus norvegicus
cacttctggcaggaggagcgactca

SEQ ID NO: 529840 - DNA, 25 bp, Rattus norvegicus
cgactcaggccttcgcgaaagaaaa

SEQ ID NO: 529841 - DNA, 25 bp, Rattus norvegicus
agctttcgagaaacgtacggcgtct

SEQ ID NO: 529842 - DNA, 25 bp, Rattus norvegicus
caggcctacccactagtcaattcgg

SEQ ID NO: 529843 - DNA, 25 bp, Rattus norvegicus
aacgtacggcgtcttcatattaccg

SEQ ID NO: 529844 - DNA, 25 bp, Rattus norvegicus
tgatgaccgagggtaggtcacggtg

SEQ ID NO: 529845 - DNA, 25 bp, Rattus norvegicus
gtgctcgcgctgacccctagaccaa

SEQ ID NO: 529846 - DNA, 25 bp, Rattus norvegicus
agggacgaaccccaggcgtgccctg

SEQ ID NO: 529847 - DNA, 25 bp, Rattus norvegicus
tgtccagggacgaaccccaggcgtg

SEQ ID NO: 529848 - DNA, 25 bp, Rattus norvegicus
ggtcagctcggtcaccagagggcgc

SEQ ID NO: 529849 - DNA, 25 bp, Rattus norvegicus
ttggaggtcagctcggtcaccagag

SEQ ID NO: 529850 - DNA, 25 bp, Rattus norvegicus
tttggaggtcagctcggtcaccaga

SEQ ID NO: 529851 - DNA, 25 bp, Rattus norvegicus
ctttggaggtcagctcggtcaccag

SEQ ID NO: 529852 - DNA, 25 bp, Rattus norvegicus
cggctttggaggtcagctcggtcac

SEQ ID NO: 529853 - DNA, 25 bp, Rattus norvegicus
ctccagaggtgatgaccgagggtag

SEQ ID NO: 529854 - DNA, 25 bp, Rattus norvegicus
cacatcgtccaaggctccagcctgg

SEQ ID NO: 529855 - DNA, 25 bp, Rattus norvegicus
aatcacatcgtccaaggctccagcc

SEQ ID NO: 529856 - DNA, 25 bp, Rattus norvegicus
acaatcacatcgtccaaggctccag

SEQ ID NO: 529857 - DNA, 25 bp, Rattus norvegicus
gctttggaggtcagctcggtcacca

SEQ ID NO: 529858 - DNA, 25 bp, Rattus norvegicus
gcgctcgggcagaccccttgccaga

SEQ ID NO: 529859 - DNA, 25 bp, Rattus norvegicus
cggtaatggcgtgggggtcacctcg

SEQ ID NO: 529860 - DNA, 25 bp, Rattus norvegicus
ccctggcctccgcagagcattgaga

SEQ ID NO: 529861 - DNA, 25 bp, Rattus norvegicus
agaccagggaaggtggcggtaatgg

SEQ ID NO: 529862 - DNA, 25 bp, Rattus norvegicus
agcattgagagggtactgacaggcc

SEQ ID NO: 529863 - DNA, 25 bp, Rattus norvegicus
ctggcctccgcagagcattgagagg

SEQ ID NO: 529864 - DNA, 25 bp, Rattus norvegicus
cctggcctccgcagagcattgagag

SEQ ID NO: 529865 - DNA, 25 bp, Rattus norvegicus
acaattgccattaccaagcctccag

SEQ ID NO: 529866 - DNA, 25 bp, Rattus norvegicus
aaccacaattgccattaccaagcct

SEQ ID NO: 529867 - DNA, 25 bp, Rattus norvegicus
gcaaccacaattgccattaccaagc

SEQ ID NO: 529868 - DNA, 25 bp, Rattus norvegicus
ggcaaccacaattgccattaccaag

SEQ ID NO: 529869 - DNA, 25 bp, Rattus norvegicus
gtggcaaccacaattgccattacca

SEQ ID NO: 529870 - DNA, 25 bp, Rattus norvegicus
agtggcaaccacaattgccattacc

SEQ ID NO: 529871 - DNA, 25 bp, Rattus norvegicus
attgccattaccaagcctccagcct

SEQ ID NO: 529872 - DNA, 25 bp, Rattus norvegicus
tcacagccaggtcaggatgccttca

SEQ ID NO: 529873 - DNA, 25 bp, Rattus norvegicus
tgggctcacagccaggtcaggatgc

SEQ ID NO: 529874 - DNA, 25 bp, Rattus norvegicus
ctcacagccaggtcaggatgccttc

SEQ ID NO: 529875 - DNA, 25 bp, Rattus norvegicus
gctcacagccaggtcaggatgcctt

SEQ ID NO: 529876 - DNA, 25 bp, Rattus norvegicus
gggctcacagccaggtcaggatgcc

SEQ ID NO: 529877 - DNA, 25 bp, Rattus norvegicus
tgtgggctcacagccaggtcaggat

SEQ ID NO: 529878 - DNA, 25 bp, Rattus norvegicus
atgtgggctcacagccaggtcagga

SEQ ID NO: 529879 - DNA, 25 bp, Rattus norvegicus
ggctcacagccaggtcaggatgcct

SEQ ID NO: 529880 - DNA, 25 bp, Rattus norvegicus
cgaggtaccagttcagtgcgagcac

SEQ ID NO: 529881 - DNA, 25 bp, Rattus norvegicus
gaagagtacatcgaggtaccagttc

SEQ ID NO: 529882 - DNA, 25 bp, Rattus norvegicus
cgggtcctggatgaagaagagtaca

SEQ ID NO: 529883 - DNA, 25 bp, Rattus norvegicus
caagcagcgggtcctggatgaagaa

SEQ ID NO: 529884 - DNA, 25 bp, Rattus norvegicus
ttgcgaaaagcaagcagcgggtcct

SEQ ID NO: 529885 - DNA, 25 bp, Rattus norvegicus
gtgctctctttctgtcctctgcgtc

SEQ ID NO: 529886 - DNA, 25 bp, Rattus norvegicus
tccattggctgactgttggagcggt

SEQ ID NO: 529887 - DNA, 25 bp, Rattus norvegicus
aaaatactgtttctccattggctga

SEQ ID NO: 529888 - DNA, 25 bp, Rattus norvegicus
cgccggctttgttacaaaaatactg

SEQ ID NO: 529889 - DNA, 25 bp, Rattus norvegicus
tggagcgccggctttgttacaaaaa

SEQ ID NO: 529890 - DNA, 25 bp, Rattus norvegicus
gtgacatcattggagcgccggcttt

SEQ ID NO: 529891 - DNA, 25 bp, Rattus norvegicus
tacaactcccttaatatccggcgct

SEQ ID NO: 529892 - DNA, 25 bp, Rattus norvegicus
gtctcggcgggtgctctctttctgt

SEQ ID NO: 529893 - DNA, 25 bp, Rattus norvegicus
tcagtgcgagcactggcgacttccg

SEQ ID NO: 529894 - DNA, 25 bp, Rattus norvegicus
ccatggcctcctcggtctgtgagca

SEQ ID NO: 529895 - DNA, 25 bp, Rattus norvegicus
gttccaggctatctaccatggcctc

SEQ ID NO: 529896 - DNA, 25 bp, Rattus norvegicus
cggtctgtgagcactcagggttcta

SEQ ID NO: 529897 - DNA, 25 bp, Rattus norvegicus
ctaaggtcgaccagttgttcctttg

SEQ ID NO: 529898 - DNA, 25 bp, Rattus norvegicus
tgccagcgggagcatggacttctga

SEQ ID NO: 529899 - DNA, 25 bp, Rattus norvegicus
ctgtgttccaggctatctaccatgg

SEQ ID NO: 529900 - DNA, 25 bp, Rattus norvegicus
cctgccagcgggagcatggacttct

SEQ ID NO: 529901 - DNA, 25 bp, Rattus norvegicus
ggctatctaccatggcctcctcggt

SEQ ID NO: 529902 - DNA, 25 bp, Rattus norvegicus
taccatggcctcctcggtctgtgag

SEQ ID NO: 529903 - DNA, 25 bp, Rattus norvegicus
tcctcggtctgtgagcactcagggt

SEQ ID NO: 529904 - DNA, 25 bp, Rattus norvegicus
tgtgagcactcagggttctaaggtc

SEQ ID NO: 529905 - DNA, 25 bp, Rattus norvegicus
gcactcagggttctaaggtcgacca

SEQ ID NO: 529906 - DNA, 25 bp, Rattus norvegicus
tcagggttctaaggtcgaccagttg

SEQ ID NO: 529907 - DNA, 25 bp, Rattus norvegicus
acttctgaggccgaggggaagctgt

SEQ ID NO: 529908 - DNA, 25 bp, Rattus norvegicus
tcctgacctggctgtgagcccacat

SEQ ID NO: 529909 - DNA, 25 bp, Rattus norvegicus
atcctgacctggctgtgagcccaca

SEQ ID NO: 529910 - DNA, 25 bp, Rattus norvegicus
gcatcctgacctggctgtgagccca

SEQ ID NO: 529911 - DNA, 25 bp, Rattus norvegicus
ggcatcctgacctggctgtgagccc

SEQ ID NO: 529912 - DNA, 25 bp, Rattus norvegicus
aggcatcctgacctggctgtgagcc

SEQ ID NO: 529913 - DNA, 25 bp, Rattus norvegicus
aaggcatcctgacctggctgtgagc

SEQ ID NO: 529914 - DNA, 25 bp, Rattus norvegicus
gaaggcatcctgacctggctgtgag

SEQ ID NO: 529915 - DNA, 25 bp, Rattus norvegicus
tgaaggcatcctgacctggctgtga

SEQ ID NO: 529916 - DNA, 25 bp, Rattus norvegicus
aagtagctactattcctcaggcacc

SEQ ID NO: 529917 - DNA, 25 bp, Rattus norvegicus
tgggacccagatgccaccaactctt

SEQ ID NO: 529918 - DNA, 25 bp, Rattus norvegicus
ggggtcacaggacttggccaacata

SEQ ID NO: 529919 - DNA, 25 bp, Rattus norvegicus
gccgcccaagctgcaaccagagaag

SEQ ID NO: 529920 - DNA, 25 bp, Rattus norvegicus
gagctgatcacgtcgcgcgtctaca

SEQ ID NO: 529921 - DNA, 25 bp, Rattus norvegicus
tgcgtgcctgcacccacagaataga

SEQ ID NO: 529922 - DNA, 25 bp, Rattus norvegicus
cccaatcgttgggaggactgaacct

SEQ ID NO: 529923 - DNA, 25 bp, Rattus norvegicus
acccactagggcagtgattcgcgcg

SEQ ID NO: 529924 - DNA, 25 bp, Rattus norvegicus
cgcttgtgacttgtgcttctttcca

SEQ ID NO: 529925 - DNA, 25 bp, Rattus norvegicus
gcttgaccttcaccgaggaggcgca

SEQ ID NO: 529926 - DNA, 25 bp, Rattus norvegicus
agggctctaccctactgcatttggc

SEQ ID NO: 529927 - DNA, 25 bp, Rattus norvegicus
ggtgctgcagccgatacgtgtctat

SEQ ID NO: 529928 - DNA, 25 bp, Rattus norvegicus
acgtgtctatccctctagatgagca

SEQ ID NO: 529929 - DNA, 25 bp, Rattus norvegicus
ctgcacaggtcgctggagtactgcg

SEQ ID NO: 529930 - DNA, 25 bp, Rattus norvegicus
cacgagtcccatcatccatagaaca

SEQ ID NO: 529931 - DNA, 25 bp, Rattus norvegicus
gcctcactgggcactctgctcgaag

SEQ ID NO: 529932 - DNA, 25 bp, Rattus norvegicus
ctgctcgaagtaccgcctttcctta

SEQ ID NO: 529933 - DNA, 25 bp, Rattus norvegicus
gcctttccttactgactgacgcgta

SEQ ID NO: 529934 - DNA, 25 bp, Rattus norvegicus
tgacgcgtatctacaccaataaacg

SEQ ID NO: 529935 - DNA, 25 bp, Rattus norvegicus
cctaaggctcgaaacctactcggag

SEQ ID NO: 529936 - DNA, 25 bp, Rattus norvegicus
acctactcggagtaaggcaggggca

SEQ ID NO: 529937 - DNA, 25 bp, Rattus norvegicus
cagtccctagcgagccacgtggctt

SEQ ID NO: 529938 - DNA, 25 bp, Rattus norvegicus
ccacgtggctttggaccaatcggaa

SEQ ID NO: 529939 - DNA, 25 bp, Rattus norvegicus
tcggaagtggtccagtctgtgcaca

SEQ ID NO: 529940 - DNA, 25 bp, Rattus norvegicus
tgtgcacgctttggcctcctaagca

SEQ ID NO: 529941 - DNA, 25 bp, Rattus norvegicus
cctcctaagcaggactgcgatagta

SEQ ID NO: 529942 - DNA, 25 bp, Rattus norvegicus
tgcagctacccgaggacgccacaaa

SEQ ID NO: 529943 - DNA, 25 bp, Rattus norvegicus
ccatagaacactgataggccgcctc

SEQ ID NO: 529944 - DNA, 25 bp, Rattus norvegicus
aggtactgctaacttcacagccggg

SEQ ID NO: 529945 - DNA, 25 bp, Rattus norvegicus
gttacacgttgaggttagttgctcc

SEQ ID NO: 529946 - DNA, 25 bp, Rattus norvegicus
ctgagaatgtatgccagcggctact

SEQ ID NO: 529947 - DNA, 25 bp, Rattus norvegicus
ggtactgctaacttcacagccgggg

SEQ ID NO: 529948 - DNA, 25 bp, Rattus norvegicus
cccgtgaggaaagagctccacagga

SEQ ID NO: 529949 - DNA, 25 bp, Rattus norvegicus
tgaggaaagagctccacaggacaca

SEQ ID NO: 529950 - DNA, 25 bp, Rattus norvegicus
ggaaagagctccacaggacacagag

SEQ ID NO: 529951 - DNA, 25 bp, Rattus norvegicus
aagagctccacaggacacagagccc

SEQ ID NO: 529952 - DNA, 25 bp, Rattus norvegicus
atgacagttacacgttgaggttagt

SEQ ID NO: 529953 - DNA, 25 bp, Rattus norvegicus
cgataggcggtgatggcgcctggct

SEQ ID NO: 529954 - DNA, 25 bp, Rattus norvegicus
taatgcggacccaaaaaccgcgctg

SEQ ID NO: 529955 - DNA, 25 bp, Rattus norvegicus
ctctgagaatgtatgccagcggcta

SEQ ID NO: 529956 - DNA, 25 bp, Rattus norvegicus
gaatgtatgccagcggctactacaa

SEQ ID NO: 529957 - DNA, 25 bp, Rattus norvegicus
acagttacacgttgaggttagttgc

SEQ ID NO: 529958 - DNA, 25 bp, Rattus norvegicus
tggaaaaattctttgcctggctggc

SEQ ID NO: 529959 - DNA, 25 bp, Rattus norvegicus
tgaacaggctaggtcaaatgctcta

SEQ ID NO: 529960 - DNA, 25 bp, Rattus norvegicus
gtcaaatgctctaaccgggtgcatg

SEQ ID NO: 529961 - DNA, 25 bp, Rattus norvegicus
ctggtcggactgttctctgcggtcc

SEQ ID NO: 529962 - DNA, 25 bp, Rattus norvegicus
ccggtcatcaccagaatggacactg

SEQ ID NO: 529963 - DNA, 25 bp, Rattus norvegicus
cctgcgtcctgagctcatgtatgta

SEQ ID NO: 529964 - DNA, 25 bp, Rattus norvegicus
atgtatgtaggtgccactccgccgc

SEQ ID NO: 529965 - DNA, 25 bp, Rattus norvegicus
actccgggaggaggctaccagccat

SEQ ID NO: 529966 - DNA, 25 bp, Rattus norvegicus
ggcgcgcttcttgatggagattcag

SEQ ID NO: 529967 - DNA, 25 bp, Rattus norvegicus
aggacgcgctccgagctgttcctct

SEQ ID NO: 529968 - DNA, 25 bp, Rattus norvegicus
gtgctagccctatgccaggcagctg

SEQ ID NO: 529969 - DNA, 25 bp, Rattus norvegicus
ccgcagctcggtttggaaaaattct

SEQ ID NO: 529970 - DNA, 25 bp, Rattus norvegicus
catcagcagccagatgaacaggcta

SEQ ID NO: 529971 - DNA, 25 bp, Rattus norvegicus
agactgggctctgacggctccctag

SEQ ID NO: 529972 - DNA, 25 bp, Rattus norvegicus
cctcttggtcacctgctgcctgatg

SEQ ID NO: 529973 - DNA, 25 bp, Rattus norvegicus
cctgcccatgtctgtgtacggagga

SEQ ID NO: 529974 - DNA, 25 bp, Rattus norvegicus
tatgcgattggggagaagttcgccc

SEQ ID NO: 529975 - DNA, 25 bp, Rattus norvegicus
cgagagtggcttcgtgtatgcgatt

SEQ ID NO: 529976 - DNA, 25 bp, Rattus norvegicus
tgaggaatacgcctatcccgactac

SEQ ID NO: 529977 - DNA, 25 bp, Rattus norvegicus
cacaccggagctgcctgaggaatac

SEQ ID NO: 529978 - DNA, 25 bp, Rattus norvegicus
gtctggaactcatgcccacaccgga

SEQ ID NO: 529979 - DNA, 25 bp, Rattus norvegicus
cgccgcccaggaagcgatcagtctg

SEQ ID NO: 529980 - DNA, 25 bp, Rattus norvegicus
caggaaaagcgcgagcacgcgtctc

SEQ ID NO: 529981 - DNA, 25 bp, Rattus norvegicus
cgagcatcccgctggagaagctggc

SEQ ID NO: 529982 - DNA, 25 bp, Rattus norvegicus
acctgctgcctgatggtggctctgt

SEQ ID NO: 529983 - DNA, 25 bp, Rattus norvegicus
ggatgcctagctcctctgcgatggc

SEQ ID NO: 529984 - DNA, 25 bp, Rattus norvegicus
agggctgtgaatgcgacttgctcaa

SEQ ID NO: 529985 - DNA, 25 bp, Rattus norvegicus
tggctctgtgcagtccgagcatccc

SEQ ID NO: 529986 - DNA, 25 bp, Rattus norvegicus
gcgattgagcctcaagagactatca

SEQ ID NO: 529987 - DNA, 25 bp, Rattus norvegicus
gctgcgttcttcatggacgcatgaa

SEQ ID NO: 529988 - DNA, 25 bp, Rattus norvegicus
caagagactatcagacaggtgtagc

SEQ ID NO: 529989 - DNA, 25 bp, Rattus norvegicus
gcctcaagagactatcagacaggtg

SEQ ID NO: 529990 - DNA, 25 bp, Rattus norvegicus
ctgcgttcttcatggacgcatgaac

SEQ ID NO: 529991 - DNA, 25 bp, Rattus norvegicus
gattgagcctcaagagactatcaga

SEQ ID NO: 529992 - DNA, 25 bp, Rattus norvegicus
cgattgagcctcaagagactatcag

SEQ ID NO: 529993 - DNA, 25 bp, Rattus norvegicus
ttgagcctcaagagactatcagaca

SEQ ID NO: 529994 - DNA, 25 bp, Rattus norvegicus
tgagcctcaagagactatcagacag

SEQ ID NO: 529995 - DNA, 25 bp, Rattus norvegicus
agcctcaagagactatcagacaggt

SEQ ID NO: 529996 - DNA, 25 bp, Rattus norvegicus
gagcctcaagagactatcagacagg

SEQ ID NO: 529997 - DNA, 25 bp, Rattus norvegicus
attgagcctcaagagactatcagac

SEQ ID NO: 529998 - DNA, 25 bp, Rattus norvegicus
tcgtactgtgtattgtgccatggtc

SEQ ID NO: 529999 - DNA, 25 bp, Rattus norvegicus
ttgtgcttctcgtactgtgtattgt

SEQ ID NO: 530000 - DNA, 25 bp, Rattus norvegicus
tgtgcttctcgtactgtgtattgtg

SEQ ID NO: 530001 - DNA, 25 bp, Rattus norvegicus
cgtactgtgtattgtgccatggtct

SEQ ID NO: 530002 - DNA, 25 bp, Rattus norvegicus
gtgcttctcgtactgtgtattgtgc

SEQ ID NO: 530003 - DNA, 25 bp, Rattus norvegicus
ctcgtactgtgtattgtgccatggt

SEQ ID NO: 530004 - DNA, 25 bp, Rattus norvegicus
tctcgtactgtgtattgtgccatgg

SEQ ID NO: 530005 - DNA, 25 bp, Rattus norvegicus
ttctcgtactgtgtattgtgccatg

SEQ ID NO: 530006 - DNA, 25 bp, Rattus norvegicus
cttctcgtactgtgtattgtgccat

SEQ ID NO: 530007 - DNA, 25 bp, Rattus norvegicus
gcttctcgtactgtgtattgtgcca

SEQ ID NO: 530008 - DNA, 25 bp, Rattus norvegicus
tgcttctcgtactgtgtattgtgcc

SEQ ID NO: 530009 - DNA, 25 bp, Rattus norvegicus
ctgctcttcctgctggttctcactg

SEQ ID NO: 530010 - DNA, 25 bp, Rattus norvegicus
gatgtcgcctttggacccaggttta

SEQ ID NO: 530011 - DNA, 25 bp, Rattus norvegicus
ccagtggcacgtctcatttctctta

SEQ ID NO: 530012 - DNA, 25 bp, Rattus norvegicus
attgccgctcagtccctgggtctga

SEQ ID NO: 530013 - DNA, 25 bp, Rattus norvegicus
ccggcgtctgaagctccggtactgc

SEQ ID NO: 530014 - DNA, 25 bp, Rattus norvegicus
gcccagctctgcgttcattggttaa

SEQ ID NO: 530015 - DNA, 25 bp, Rattus norvegicus
catcttgcgcgagccggaatctcat

SEQ ID NO: 530016 - DNA, 25 bp, Rattus norvegicus
catcccgcttctgcggcctagagtg

SEQ ID NO: 530017 - DNA, 25 bp, Rattus norvegicus
gtcggcattctcttgctgcgatcca

SEQ ID NO: 530018 - DNA, 25 bp, Rattus norvegicus
cggaggataaatggtgcccaaggca

SEQ ID NO: 530019 - DNA, 25 bp, Rattus norvegicus
cacaagttggagtgtaccagggttc

SEQ ID NO: 530020 - DNA, 25 bp, Rattus norvegicus
ttcagagcctcgaggatgtcgcctt

SEQ ID NO: 530021 - DNA, 25 bp, Rattus norvegicus
ggttctcactgtcaccgagccgctg

SEQ ID NO: 530022 - DNA, 25 bp, Rattus norvegicus
cgcgtgctcttggacccaatggcca

SEQ ID NO: 530023 - DNA, 25 bp, Rattus norvegicus
agcagacttgtatgcgagctaacaa

SEQ ID NO: 530024 - DNA, 25 bp, Rattus norvegicus
gcagacttgtatgcgagctaacaat

SEQ ID NO: 530025 - DNA, 25 bp, Rattus norvegicus
agacttgtatgcgagctaacaatgg

SEQ ID NO: 530026 - DNA, 25 bp, Rattus norvegicus
acttgtatgcgagctaacaatggca

SEQ ID NO: 530027 - DNA, 25 bp, Rattus norvegicus
cttgtatgcgagctaacaatggcac

SEQ ID NO: 530028 - DNA, 25 bp, Rattus norvegicus
ttgtatgcgagctaacaatggcacc

SEQ ID NO: 530029 - DNA, 25 bp, Rattus norvegicus
gacttgtatgcgagctaacaatggc

SEQ ID NO: 530030 - DNA, 25 bp, Rattus norvegicus
gagcagacttgtatgcgagctaaca

SEQ ID NO: 530031 - DNA, 25 bp, Rattus norvegicus
gtgacagtctgtattggtttgcttg

SEQ ID NO: 530032 - DNA, 25 bp, Rattus norvegicus
tgacagtctgtattggtttgcttga

SEQ ID NO: 530033 - DNA, 25 bp, Rattus norvegicus
acagtctgtattggtttgcttgatc

SEQ ID NO: 530034 - DNA, 25 bp, Rattus norvegicus
agtctgtattggtttgcttgatcga

SEQ ID NO: 530035 - DNA, 25 bp, Rattus norvegicus
gtctgtattggtttgcttgatcgag

SEQ ID NO: 530036 - DNA, 25 bp, Rattus norvegicus
tctgtattggtttgcttgatcgaga

SEQ ID NO: 530037 - DNA, 25 bp, Rattus norvegicus
ggcgcgtgacagtctgtattggttt

SEQ ID NO: 530038 - DNA, 25 bp, Rattus norvegicus
cgtgacagtctgtattggtttgctt

SEQ ID NO: 530039 - DNA, 25 bp, Rattus norvegicus
gacagtctgtattggtttgcttgat

SEQ ID NO: 530040 - DNA, 25 bp, Rattus norvegicus
gcgcgtgacagtctgtattggtttg

SEQ ID NO: 530041 - DNA, 25 bp, Rattus norvegicus
cgcgtgacagtctgtattggtttgc

SEQ ID NO: 530042 - DNA, 25 bp, Rattus norvegicus
cagtctgtattggtttgcttgatcg

SEQ ID NO: 530043 - DNA, 25 bp, Rattus norvegicus
cggcgcgtgacagtctgtattggtt

SEQ ID NO: 530044 - DNA, 25 bp, Rattus norvegicus
gcgtgacagtctgtattggtttgct

SEQ ID NO: 530045 - DNA, 25 bp, Rattus norvegicus
ctgtacgacctattgggacacaagg

SEQ ID NO: 530046 - DNA, 25 bp, Rattus norvegicus
ggtggctgtacgacctattgggaca

SEQ ID NO: 530047 - DNA, 25 bp, Rattus norvegicus
ctggatgaggtcgaccagaaggctt

SEQ ID NO: 530048 - DNA, 25 bp, Rattus norvegicus
atcgagatcgctgtcgggcgacacc

SEQ ID NO: 530049 - DNA, 25 bp, Rattus norvegicus
acgccgtcctgtctggggaccatct

SEQ ID NO: 530050 - DNA, 25 bp, Rattus norvegicus
tgcgcgacggagacgccgtcctgtc

SEQ ID NO: 530051 - DNA, 25 bp, Rattus norvegicus
gacaagtttccgcaacgctcctgtc

SEQ ID NO: 530052 - DNA, 25 bp, Rattus norvegicus
gtggcgacaagtttccgcaacgctc

SEQ ID NO: 530053 - DNA, 25 bp, Rattus norvegicus
cacctagtggcgacaagtttccgca

SEQ ID NO: 530054 - DNA, 25 bp, Rattus norvegicus
cgggcgacacctagtggcgacaagt

SEQ ID NO: 530055 - DNA, 25 bp, Rattus norvegicus
tttgcttgatcgagatcgctgtcgg

SEQ ID NO: 530056 - DNA, 25 bp, Rattus norvegicus
aggaggttgtacctggagaacttca

SEQ ID NO: 530057 - DNA, 25 bp, Rattus norvegicus
gtctggggaccatctctagctagga

SEQ ID NO: 530058 - DNA, 25 bp, Rattus norvegicus
ccatctctagctaggaggttgtacc

SEQ ID NO: 530059 - DNA, 25 bp, Rattus norvegicus
actgcagaacgtgcgcagctggatt

SEQ ID NO: 530060 - DNA, 25 bp, Rattus norvegicus
tgcaggcatcaccagcactgcagaa

SEQ ID NO: 530061 - DNA, 25 bp, Rattus norvegicus
cagcactgcagaacgtgcgcagctg

SEQ ID NO: 530062 - DNA, 25 bp, Rattus norvegicus
tcaccagcactgcagaacgtgcgca

SEQ ID NO: 530063 - DNA, 25 bp, Rattus norvegicus
ggcatcaccagcactgcagaacgtg

SEQ ID NO: 530064 - DNA, 25 bp, Rattus norvegicus
ctggattgaatcctgcgggcggact

SEQ ID NO: 530065 - DNA, 25 bp, Rattus norvegicus
ggaaagatctgcaggcatcaccagc

SEQ ID NO: 530066 - DNA, 25 bp, Rattus norvegicus
aaatagatatgtgggtggaggggtc

SEQ ID NO: 530067 - DNA, 25 bp, Rattus norvegicus
agtggagaggggaaatagatatgtg

SEQ ID NO: 530068 - DNA, 25 bp, Rattus norvegicus
tgcctgccgcctgagcgcccactga

SEQ ID NO: 530069 - DNA, 25 bp, Rattus norvegicus
agaacgtgcgcagctggattgaatc

SEQ ID NO: 530070 - DNA, 25 bp, Rattus norvegicus
cgtgcgcagctggattgaatcctgc

SEQ ID NO: 530071 - DNA, 25 bp, Rattus norvegicus
agatctgcaggcatcaccagcactg

SEQ ID NO: 530072 - DNA, 25 bp, Rattus norvegicus
acgtgcgcagctggattgaatcctg

SEQ ID NO: 530073 - DNA, 25 bp, Rattus norvegicus
tgacagagccaaatgcgcgccgccg

SEQ ID NO: 530074 - DNA, 25 bp, Rattus norvegicus
agccaaatgcgcgccgccggttgaa

SEQ ID NO: 530075 - DNA, 25 bp, Rattus norvegicus
aaaaaaggggatcactgacagagcc

SEQ ID NO: 530076 - DNA, 25 bp, Rattus norvegicus
cactgacagagccaaatgcgcgccg

SEQ ID NO: 530077 - DNA, 25 bp, Rattus norvegicus
tgttaatgatttcatgctctcttga

SEQ ID NO: 530078 - DNA, 25 bp, Rattus norvegicus
tttacctgttaatgatttcatgctc

SEQ ID NO: 530079 - DNA, 25 bp, Rattus norvegicus
acagagccaaatgcgcgccgccggt

SEQ ID NO: 530080 - DNA, 25 bp, Rattus norvegicus
actgacagagccaaatgcgcgccgc

SEQ ID NO: 530081 - DNA, 25 bp, Rattus norvegicus
aggggatcactgacagagccaaatg

SEQ ID NO: 530082 - DNA, 25 bp, Rattus norvegicus
tacctgttaatgatttcatgctctc

SEQ ID NO: 530083 - DNA, 25 bp, Rattus norvegicus
aaaggggatcactgacagagccaaa

SEQ ID NO: 530084 - DNA, 25 bp, Rattus norvegicus
ggggatcactgacagagccaaatgc

SEQ ID NO: 530085 - DNA, 25 bp, Rattus norvegicus
gatcactgacagagccaaatgcgcg

SEQ ID NO: 530086 - DNA, 25 bp, Rattus norvegicus
atcactgacagagccaaatgcgcgc

SEQ ID NO: 530087 - DNA, 25 bp, Rattus norvegicus
agcacccggcggcatcgtacaaggg

SEQ ID NO: 530088 - DNA, 25 bp, Rattus norvegicus
gcccagaaccacgacgaccgccgga

SEQ ID NO: 530089 - DNA, 25 bp, Rattus norvegicus
ggccagcccagaaccacgacgaccg

SEQ ID NO: 530090 - DNA, 25 bp, Rattus norvegicus
tgaggccagcccagaaccacgacga

SEQ ID NO: 530091 - DNA, 25 bp, Rattus norvegicus
tggatggcacccgaacggtcggccc

SEQ ID NO: 530092 - DNA, 25 bp, Rattus norvegicus
ccgctggatggcacccgaacggtcg

SEQ ID NO: 530093 - DNA, 25 bp, Rattus norvegicus
tgtcccgctggatggcacccgaacg

SEQ ID NO: 530094 - DNA, 25 bp, Rattus norvegicus
ggtgtcccgctggatggcacccgaa

SEQ ID NO: 530095 - DNA, 25 bp, Rattus norvegicus
gcacccggcggcatcgtacaaggga

SEQ ID NO: 530096 - DNA, 25 bp, Rattus norvegicus
cggcatcgtacaagggaggcgaggt

SEQ ID NO: 530097 - DNA, 25 bp, Rattus norvegicus
tgcggtgtcccgctggatggcaccc

SEQ ID NO: 530098 - DNA, 25 bp, Rattus norvegicus
gtgtcccgctggatggcacccgaac

SEQ ID NO: 530099 - DNA, 25 bp, Rattus norvegicus
cccggcggcatcgtacaagggaggc

SEQ ID NO: 530100 - DNA, 25 bp, Rattus norvegicus
cacccggcggcatcgtacaagggag

SEQ ID NO: 530101 - DNA, 25 bp, Rattus norvegicus
gcgcatcagcgcacggatgccgcag

SEQ ID NO: 530102 - DNA, 25 bp, Rattus norvegicus
aggcactggaccggccgccggggat

SEQ ID NO: 530103 - DNA, 25 bp, Rattus norvegicus
tggaccggccgccggggatgtgtcc

SEQ ID NO: 530104 - DNA, 25 bp, Rattus norvegicus
ccatgagaagggtggccgtcccgca

SEQ ID NO: 530105 - DNA, 25 bp, Rattus norvegicus
catgagaagggtggccgtcccgcag

SEQ ID NO: 530106 - DNA, 25 bp, Rattus norvegicus
ggcgcatcagcgcacggatgccgca

SEQ ID NO: 530107 - DNA, 25 bp, Rattus norvegicus
agcccaccggcccaccggctgagcg

SEQ ID NO: 530108 - DNA, 25 bp, Rattus norvegicus
cccaccggcccaccggctgagcgcc

SEQ ID NO: 530109 - DNA, 25 bp, Rattus norvegicus
ccggcccaccggctgagcgcccgcc

SEQ ID NO: 530110 - DNA, 25 bp, Rattus norvegicus
gcgcttggccatgggcggacggaca

SEQ ID NO: 530111 - DNA, 25 bp, Rattus norvegicus
ggacaaggcgcatcagcgcacggat

SEQ ID NO: 530112 - DNA, 25 bp, Rattus norvegicus
gacaaggcgcatcagcgcacggatg

SEQ ID NO: 530113 - DNA, 25 bp, Rattus norvegicus
acaaggcgcatcagcgcacggatgc

SEQ ID NO: 530114 - DNA, 25 bp, Rattus norvegicus
caaggcgcatcagcgcacggatgcc

SEQ ID NO: 530115 - DNA, 25 bp, Rattus norvegicus
agaactgacaccttccccgcaccgt

SEQ ID NO: 530116 - DNA, 25 bp, Rattus norvegicus
aaacgctcacttggcagacggccgc

SEQ ID NO: 530117 - DNA, 25 bp, Rattus norvegicus
aacgctcacttggcagacggccgcg

SEQ ID NO: 530118 - DNA, 25 bp, Rattus norvegicus
acgctcacttggcagacggccgcgg

SEQ ID NO: 530119 - DNA, 25 bp, Rattus norvegicus
gcagacggccgcggcacatgccacg

SEQ ID NO: 530120 - DNA, 25 bp, Rattus norvegicus
gatggaccagaactgacaccttccc

SEQ ID NO: 530121 - DNA, 25 bp, Rattus norvegicus
gaagccaaggcgttcaccgtgccga

SEQ ID NO: 530122 - DNA, 25 bp, Rattus norvegicus
acgcctcgcctcagcgcctctctaa

SEQ ID NO: 530123 - DNA, 25 bp, Rattus norvegicus
tctctaacgccgtacgcgccgcgca

SEQ ID NO: 530124 - DNA, 25 bp, Rattus norvegicus
tgagtccacgaacgcccggactctg

SEQ ID NO: 530125 - DNA, 25 bp, Rattus norvegicus
aggcactggagttttcttgtagttc

SEQ ID NO: 530126 - DNA, 25 bp, Rattus norvegicus
ttgcgggccacgactcggttcgcca

SEQ ID NO: 530127 - DNA, 25 bp, Rattus norvegicus
ctggaggacgaagccaaggcgttca

SEQ ID NO: 530128 - DNA, 25 bp, Rattus norvegicus
agggcgttcagctcgctccgcagct

SEQ ID NO: 530129 - DNA, 25 bp, Rattus norvegicus
tcacctctaggacaccggcggggta

SEQ ID NO: 530130 - DNA, 25 bp, Rattus norvegicus
gtcagggcaccagcctgcagcctag

SEQ ID NO: 530131 - DNA, 25 bp, Rattus norvegicus
aggcgttcaccgtgccgaggacccg

SEQ ID NO: 530132 - DNA, 25 bp, Rattus norvegicus
tctgccagctcagcgtagagggtca

SEQ ID NO: 530133 - DNA, 25 bp, Rattus norvegicus
ctggaggcactggagttttcttgta

SEQ ID NO: 530134 - DNA, 25 bp, Rattus norvegicus
ttatccgcggccctggaggacgaag

SEQ ID NO: 530135 - DNA, 25 bp, Rattus norvegicus
cggcgttagtgtgactccagacaaa

SEQ ID NO: 530136 - DNA, 25 bp, Rattus norvegicus
tcagattgaacatcccaggtctctc

SEQ ID NO: 530137 - DNA, 25 bp, Rattus norvegicus
ttgaacaagttgcagcagttggcca

SEQ ID NO: 530138 - DNA, 25 bp, Rattus norvegicus
tcgcggaagacggttctggtaacta

SEQ ID NO: 530139 - DNA, 25 bp, Rattus norvegicus
ttctgatcggccgaagactccttgc

SEQ ID NO: 530140 - DNA, 25 bp, Rattus norvegicus
ctgaaaacctgcgtccggggcttct

SEQ ID NO: 530141 - DNA, 25 bp, Rattus norvegicus
taccacaagcttctccaatcagagg

SEQ ID NO: 530142 - DNA, 25 bp, Rattus norvegicus
cccatccgagtctcgggacaggatg

SEQ ID NO: 530143 - DNA, 25 bp, Rattus norvegicus
tcaggaacaccggagcggcgttagt

SEQ ID NO: 530144 - DNA, 25 bp, Rattus norvegicus
cagaccgaacacaggctcaggaaca

SEQ ID NO: 530145 - DNA, 25 bp, Rattus norvegicus
ccgggacagaccgaacacaggctca

SEQ ID NO: 530146 - DNA, 25 bp, Rattus norvegicus
cagcagttggccatcagattgaaca

SEQ ID NO: 530147 - DNA, 25 bp, Rattus norvegicus
cctaggatggactagacaaagggca

SEQ ID NO: 530148 - DNA, 25 bp, Rattus norvegicus
caatcagaggctgaaaacctgcgtc

SEQ ID NO: 530149 - DNA, 25 bp, Rattus norvegicus
ccgccaagctcaggcaccgtcctcc

SEQ ID NO: 530150 - DNA, 25 bp, Rattus norvegicus
ctctccgccaagctcaggcaccgtc

SEQ ID NO: 530151 - DNA, 25 bp, Rattus norvegicus
aaatgtcccagtcgccgcttcgggc

SEQ ID NO: 530152 - DNA, 25 bp, Rattus norvegicus
cggccgcccgctcagcaatgagggt

SEQ ID NO: 530153 - DNA, 25 bp, Rattus norvegicus
gcccgctcagcaatgagggtcctga

SEQ ID NO: 530154 - DNA, 25 bp, Rattus norvegicus
tcagcaatgagggtcctgagcgtgc

SEQ ID NO: 530155 - DNA, 25 bp, Rattus norvegicus
agcagagttgggagagcagagccca

SEQ ID NO: 530156 - DNA, 25 bp, Rattus norvegicus
aggaaatgtcccagtcgccgcttcg

SEQ ID NO: 530157 - DNA, 25 bp, Rattus norvegicus
tccaggaaatgtcccagtcgccgct

SEQ ID NO: 530158 - DNA, 25 bp, Rattus norvegicus
cttccaggaaatgtcccagtcgccg

SEQ ID NO: 530159 - DNA, 25 bp, Rattus norvegicus
agcttccaggaaatgtcccagtcgc

SEQ ID NO: 530160 - DNA, 25 bp, Rattus norvegicus
agagcttccaggaaatgtcccagtc

SEQ ID NO: 530161 - DNA, 25 bp, Rattus norvegicus
agagcccaggctcgcagctcctctc

SEQ ID NO: 530162 - DNA, 25 bp, Rattus norvegicus
caggaaatgtcccagtcgccgcttc

SEQ ID NO: 530163 - DNA, 25 bp, Rattus norvegicus
ttatcttcataaacgtatttaccga

SEQ ID NO: 530164 - DNA, 25 bp, Rattus norvegicus
ccaagcggaagagaagcgcaacctc

SEQ ID NO: 530165 - DNA, 25 bp, Rattus norvegicus
cccgttgcgaagatggtgaacccac

SEQ ID NO: 530166 - DNA, 25 bp, Rattus norvegicus
caggagctgaactggctttcacacc

SEQ ID NO: 530167 - DNA, 25 bp, Rattus norvegicus
aggctgttgaacaattgtggggttc

SEQ ID NO: 530168 - DNA, 25 bp, Rattus norvegicus
ggctccgaaaggctgttgaacaatt

SEQ ID NO: 530169 - DNA, 25 bp, Rattus norvegicus
accgatcaggctccgaaaggctgtt

SEQ ID NO: 530170 - DNA, 25 bp, Rattus norvegicus
tgtcttcggaaaccgatcaggctcc

SEQ ID NO: 530171 - DNA, 25 bp, Rattus norvegicus
tccagattctgtcttcggaaaccga

SEQ ID NO: 530172 - DNA, 25 bp, Rattus norvegicus
gccgagctctcaaacgtggaagaca

SEQ ID NO: 530173 - DNA, 25 bp, Rattus norvegicus
atgtcctagtcgtccagattctgtc

SEQ ID NO: 530174 - DNA, 25 bp, Rattus norvegicus
gaacatacggttactcgcggtacga

SEQ ID NO: 530175 - DNA, 25 bp, Rattus norvegicus
gtggaagacatcagaacatacggtt

SEQ ID NO: 530176 - DNA, 25 bp, Rattus norvegicus
gtgaacccaccttcaggggagtctc

SEQ ID NO: 530177 - DNA, 25 bp, Rattus norvegicus
catgagcgccgatagaccgcgggcc

SEQ ID NO: 530178 - DNA, 25 bp, Rattus norvegicus
tggaactccgccttgagtctctgca

SEQ ID NO: 530179 - DNA, 25 bp, Rattus norvegicus
gatgtagcggtttgcctggaactcc

SEQ ID NO: 530180 - DNA, 25 bp, Rattus norvegicus
cgctgctccgtgatgtagcggtttg

SEQ ID NO: 530181 - DNA, 25 bp, Rattus norvegicus
atctgggactcgttcaggctgagct

SEQ ID NO: 530182 - DNA, 25 bp, Rattus norvegicus
cagatcttgatctgggactcgttca

SEQ ID NO: 530183 - DNA, 25 bp, Rattus norvegicus
ttggcacgcttgttttggaaccaga

SEQ ID NO: 530184 - DNA, 25 bp, Rattus norvegicus
ccggtggctttcttgatcttggcac

SEQ ID NO: 530185 - DNA, 25 bp, Rattus norvegicus
aggccgttcttgatgccggtggctt

SEQ ID NO: 530186 - DNA, 25 bp, Rattus norvegicus
tgtacagtccctgggccatgaggtg

SEQ ID NO: 530187 - DNA, 25 bp, Rattus norvegicus
tggtagagtggttgtacagtccctg

SEQ ID NO: 530188 - DNA, 25 bp, Rattus norvegicus
gtctttgtcctggaccgtggtggta

SEQ ID NO: 530189 - DNA, 25 bp, Rattus norvegicus
gctactcgctctcgtctttgtcctg

SEQ ID NO: 530190 - DNA, 25 bp, Rattus norvegicus
tctctgcagctgctcggccgtgaac

SEQ ID NO: 530191 - DNA, 25 bp, Rattus norvegicus
caggggctgttcctttttgcaacca

SEQ ID NO: 530192 - DNA, 25 bp, Rattus norvegicus
tttgcaaccaaaatcgggccttaga

SEQ ID NO: 530193 - DNA, 25 bp, Rattus norvegicus
cgagtcagtcttgactaccggccca

SEQ ID NO: 530194 - DNA, 25 bp, Rattus norvegicus
gacttttaggctccggctgctgttc

SEQ ID NO: 530195 - DNA, 25 bp, Rattus norvegicus
cgggccttagaatgttatcgatgaa

SEQ ID NO: 530196 - DNA, 25 bp, Rattus norvegicus
ggctgctgttcttccatgctcggcc

SEQ ID NO: 530197 - DNA, 25 bp, Rattus norvegicus
gctgcagccgaagccactaggagct

SEQ ID NO: 530198 - DNA, 25 bp, Rattus norvegicus
ccagagagtggacagggtctctacc

SEQ ID NO: 530199 - DNA, 25 bp, Rattus norvegicus
cccgaagctcgtgtgcccagagagt

SEQ ID NO: 530200 - DNA, 25 bp, Rattus norvegicus
catctggagcacacaagagcgaggc

SEQ ID NO: 530201 - DNA, 25 bp, Rattus norvegicus
tgggccacagttcgcatctggagca

SEQ ID NO: 530202 - DNA, 25 bp, Rattus norvegicus
gccactgtccgagggcttcgatgct

SEQ ID NO: 530203 - DNA, 25 bp, Rattus norvegicus
ccaccgttagccgaacccatgagta

SEQ ID NO: 530204 - DNA, 25 bp, Rattus norvegicus
gcccgagtcgcgctgacttttaggc

SEQ ID NO: 530205 - DNA, 25 bp, Rattus norvegicus
tcaaaccggaagcacgtgagtcagg

SEQ ID NO: 530206 - DNA, 25 bp, Rattus norvegicus
cgcacgtgtgtaggaccaatggcga

SEQ ID NO: 530207 - DNA, 25 bp, Rattus norvegicus
aaccggaagcacgtgagtcagggcc

SEQ ID NO: 530208 - DNA, 25 bp, Rattus norvegicus
aagcacgtgagtcagggccgcacgt

SEQ ID NO: 530209 - DNA, 25 bp, Rattus norvegicus
agggccgcacgtgtgtaggaccaat

SEQ ID NO: 530210 - DNA, 25 bp, Rattus norvegicus
gccgcacgtgtgtaggaccaatggc

SEQ ID NO: 530211 - DNA, 25 bp, Rattus norvegicus
cgcgcgggactttgcggataaataa

SEQ ID NO: 530212 - DNA, 25 bp, Rattus norvegicus
acgtgtgtaggaccaatggcgagcc

SEQ ID NO: 530213 - DNA, 25 bp, Rattus norvegicus
taggaccaatggcgagccgggactc

SEQ ID NO: 530214 - DNA, 25 bp, Rattus norvegicus
ccgggactcgcgctgacactcaggg

SEQ ID NO: 530215 - DNA, 25 bp, Rattus norvegicus
actcgcgctgacactcagggctcgg

SEQ ID NO: 530216 - DNA, 25 bp, Rattus norvegicus
acactcagggctcggcccaatgggc

SEQ ID NO: 530217 - DNA, 25 bp, Rattus norvegicus
cgggactttgcggataaataatccg

SEQ ID NO: 530218 - DNA, 25 bp, Rattus norvegicus
tgacactcagggctcggcccaatgg

SEQ ID NO: 530219 - DNA, 25 bp, Rattus norvegicus
tgccgcaaggcctgcaaccagagcg

SEQ ID NO: 530220 - DNA, 25 bp, Rattus norvegicus
accagagggcgcacacgggcaacga

SEQ ID NO: 530221 - DNA, 25 bp, Rattus norvegicus
ttcaagtgctcgagcccttcaaggg

SEQ ID NO: 530222 - DNA, 25 bp, Rattus norvegicus
ctgggactgcggcaaggccgtccac

SEQ ID NO: 530223 - DNA, 25 bp, Rattus norvegicus
cagcgacaaacccaagtgctgggac

SEQ ID NO: 530224 - DNA, 25 bp, Rattus norvegicus
cacgggcaacgaacccttcaagtgc

SEQ ID NO: 530225 - DNA, 25 bp, Rattus norvegicus
tacgcatgcgccgagtgccgcaagg

SEQ ID NO: 530226 - DNA, 25 bp, Rattus norvegicus
cacaccgggaagaggccgtacgcat

SEQ ID NO: 530227 - DNA, 25 bp, Rattus norvegicus
gcaaggcctgcaaccagagcgcgca

SEQ ID NO: 530228 - DNA, 25 bp, Rattus norvegicus
caccttcgcattcgcacgggcgaga

SEQ ID NO: 530229 - DNA, 25 bp, Rattus norvegicus
ggtggcaaggccttctcctgccact

SEQ ID NO: 530230 - DNA, 25 bp, Rattus norvegicus
tcctcgctcaccgtgcacgagaaga

SEQ ID NO: 530231 - DNA, 25 bp, Rattus norvegicus
accgtgcacgagaagagatccacca

SEQ ID NO: 530232 - DNA, 25 bp, Rattus norvegicus
gaagagatccaccacagcgacaaac

SEQ ID NO: 530233 - DNA, 25 bp, Rattus norvegicus
attctgaaggtgctggggtgtctct

SEQ ID NO: 530234 - DNA, 25 bp, Rattus norvegicus
ccagtgttagcatgcatatgagtcc

SEQ ID NO: 530235 - DNA, 25 bp, Rattus norvegicus
gtgccagtgttagcatgcatatgag

SEQ ID NO: 530236 - DNA, 25 bp, Rattus norvegicus
ggcattccatgtcctgtgtgtcccg

SEQ ID NO: 530237 - DNA, 25 bp, Rattus norvegicus
cggcattccatgtcctgtgtgtccc

SEQ ID NO: 530238 - DNA, 25 bp, Rattus norvegicus
tgcggcattccatgtcctgtgtgtc

SEQ ID NO: 530239 - DNA, 25 bp, Rattus norvegicus
tttgcggcattccatgtcctgtgtg

SEQ ID NO: 530240 - DNA, 25 bp, Rattus norvegicus
gggtttgcggcattccatgtcctgt

SEQ ID NO: 530241 - DNA, 25 bp, Rattus norvegicus
agcctttggggcctcgagtgtcagc

SEQ ID NO: 530242 - DNA, 25 bp, Rattus norvegicus
ccattctgaaggtgctggggtgtct

SEQ ID NO: 530243 - DNA, 25 bp, Rattus norvegicus
ctcccattctgaaggtgctggggtg

SEQ ID NO: 530244 - DNA, 25 bp, Rattus norvegicus
agtgttagcatgcatatgagtcctt

SEQ ID NO: 530245 - DNA, 25 bp, Rattus norvegicus
cctttggggcctcgagtgtcagccc

SEQ ID NO: 530246 - DNA, 25 bp, Rattus norvegicus
agctctcccattctgaaggtgctgg

SEQ ID NO: 530247 - DNA, 25 bp, Rattus norvegicus
gtgtcgcccaggtcagtcatcacgc

SEQ ID NO: 530248 - DNA, 25 bp, Rattus norvegicus
ggcggtgagccaaaactggctacag

SEQ ID NO: 530249 - DNA, 25 bp, Rattus norvegicus
ccacggcggtgagccaaaactggct

SEQ ID NO: 530250 - DNA, 25 bp, Rattus norvegicus
tccaccacggcggtgagccaaaact

SEQ ID NO: 530251 - DNA, 25 bp, Rattus norvegicus
gtgagactcatagcgagcccggccc

SEQ ID NO: 530252 - DNA, 25 bp, Rattus norvegicus
cagtgtgagactcatagcgagcccg

SEQ ID NO: 530253 - DNA, 25 bp, Rattus norvegicus
tggacagtgtgagactcatagcgag

SEQ ID NO: 530254 - DNA, 25 bp, Rattus norvegicus
tggagtgacgctccagcatggtgct

SEQ ID NO: 530255 - DNA, 25 bp, Rattus norvegicus
gctgtgtcgcccaggtcagtcatca

SEQ ID NO: 530256 - DNA, 25 bp, Rattus norvegicus
ggtcagtcatcacgcctccagtctg

SEQ ID NO: 530257 - DNA, 25 bp, Rattus norvegicus
tgtgtcgcccaggtcagtcatcacg

SEQ ID NO: 530258 - DNA, 25 bp, Rattus norvegicus
cggcggtgagccaaaactggctaca

SEQ ID NO: 530259 - DNA, 25 bp, Rattus norvegicus
ctggagtgacgctccagcatggtgc

SEQ ID NO: 530260 - DNA, 25 bp, Rattus norvegicus
caccacggcggtgagccaaaactgg

SEQ ID NO: 530261 - DNA, 25 bp, Rattus norvegicus
taagctcgggtggaagattgatacc

SEQ ID NO: 530262 - DNA, 25 bp, Rattus norvegicus
tcatgccttgttggagaggagacca

SEQ ID NO: 530263 - DNA, 25 bp, Rattus norvegicus
agctcgcctttttaggcagccgcgc

SEQ ID NO: 530264 - DNA, 25 bp, Rattus norvegicus
cgcagcagagtctgcaatcgctcta

SEQ ID NO: 530265 - DNA, 25 bp, Rattus norvegicus
atcgctctacgagaggcaggctctg

SEQ ID NO: 530266 - DNA, 25 bp, Rattus norvegicus
gcaggctctgcgtcgctaaagcgtc

SEQ ID NO: 530267 - DNA, 25 bp, Rattus norvegicus
tcaactctccagtgcctagcggcta

SEQ ID NO: 530268 - DNA, 25 bp, Rattus norvegicus
cggctgggattagctcgccttttta

SEQ ID NO: 530269 - DNA, 25 bp, Rattus norvegicus
gtgccaccgcggattggaacaatga

SEQ ID NO: 530270 - DNA, 25 bp, Rattus norvegicus
ggaacaatgagccacgcactgctaa

SEQ ID NO: 530271 - DNA, 25 bp, Rattus norvegicus
tgctaaaaggccaagctgcagcccg

SEQ ID NO: 530272 - DNA, 25 bp, Rattus norvegicus
cgcggtgacacggtcatgccttgtt

SEQ ID NO: 530273 - DNA, 25 bp, Rattus norvegicus
accaagccagcacggggtcgcctga

SEQ ID NO: 530274 - DNA, 25 bp, Rattus norvegicus
gctagggaggccgatcaactctcca

SEQ ID NO: 530275 - DNA, 25 bp, Rattus norvegicus
tgcgcaccttggacggcaaagaggc

SEQ ID NO: 530276 - DNA, 25 bp, Rattus norvegicus
gccatgcgctactacatgtccttta

SEQ ID NO: 530277 - DNA, 25 bp, Rattus norvegicus
gcgctactacatgtcctttaacaag

SEQ ID NO: 530278 - DNA, 25 bp, Rattus norvegicus
gtcctttaacaagcacggtgtgcgc

SEQ ID NO: 530279 - DNA, 25 bp, Rattus norvegicus
caagcacggtgtgcgcttcagcagg

SEQ ID NO: 530280 - DNA, 25 bp, Rattus norvegicus
aggcacgacgtacagggccagagct

SEQ ID NO: 530281 - DNA, 25 bp, Rattus norvegicus
cagagctgctgtgcgagatgcgcaa

SEQ ID NO: 530282 - DNA, 25 bp, Rattus norvegicus
gcgtgtgcgcaccttggacggcaaa

SEQ ID NO: 530283 - DNA, 25 bp, Rattus norvegicus
tgagccagttgcacccccgcggttt

SEQ ID NO: 530284 - DNA, 25 bp, Rattus norvegicus
cgcctgcagaaagccatgcgctact

SEQ ID NO: 530285 - DNA, 25 bp, Rattus norvegicus
ggacggcaaagaggcgcccttctca

SEQ ID NO: 530286 - DNA, 25 bp, Rattus norvegicus
aaagaggcgcccttctcagggctgg

SEQ ID NO: 530287 - DNA, 25 bp, Rattus norvegicus
ctggggtccctctgagccagttgca

SEQ ID NO: 530288 - DNA, 25 bp, Rattus norvegicus
agatgcgcaagcgtgtgcgtgtgcg

SEQ ID NO: 530289 - DNA, 25 bp, Rattus norvegicus
gcacacgcatacacacttacacgta

SEQ ID NO: 530290 - DNA, 25 bp, Rattus norvegicus
cacagagatacaaacacgggcacgc

SEQ ID NO: 530291 - DNA, 25 bp, Rattus norvegicus
agagacacaaacaccggcacacgca

SEQ ID NO: 530292 - DNA, 25 bp, Rattus norvegicus
gccagcaacgcatagcctactttct

SEQ ID NO: 530293 - DNA, 25 bp, Rattus norvegicus
atgcgcactcatacgtaccagaagc

SEQ ID NO: 530294 - DNA, 25 bp, Rattus norvegicus
tcacacgtaccaggagcccgtgacg

SEQ ID NO: 530295 - DNA, 25 bp, Rattus norvegicus
cttcattacatcatccagggctcga

SEQ ID NO: 530296 - DNA, 25 bp, Rattus norvegicus
agcgttcactcacaaacaaaacacg

SEQ ID NO: 530297 - DNA, 25 bp, Rattus norvegicus
cgactgtttcaacctgcgcagatgc

SEQ ID NO: 530298 - DNA, 25 bp, Rattus norvegicus
acgcagaatccttggcgactgtttc

SEQ ID NO: 530299 - DNA, 25 bp, Rattus norvegicus
ttacacgtaccggaagcctctgagg

SEQ ID NO: 530300 - DNA, 25 bp, Rattus norvegicus
agagacacaaacacgggcgcgcgcg

SEQ ID NO: 530301 - DNA, 25 bp, Rattus norvegicus
atgcgcactccaatcacactggcgg

SEQ ID NO: 530302 - DNA, 25 bp, Rattus norvegicus
ttctgacgttatcgccgccagcaac

SEQ ID NO: 530303 - DNA, 25 bp, Rattus norvegicus
tcctggtttgcctgctgtgactaaa

SEQ ID NO: 530304 - DNA, 25 bp, Rattus norvegicus
ctcaaatagccatgtgtgaccagtg

SEQ ID NO: 530305 - DNA, 25 bp, Rattus norvegicus
gtttagttcatctcaaatagccatg

SEQ ID NO: 530306 - DNA, 25 bp, Rattus norvegicus
gctgtgactaaagaggcagatttta

SEQ ID NO: 530307 - DNA, 25 bp, Rattus norvegicus
ggctgtttgcctcctggtttgcctg

SEQ ID NO: 530308 - DNA, 25 bp, Rattus norvegicus
attctggctggctgtttgcctcctg

SEQ ID NO: 530309 - DNA, 25 bp, Rattus norvegicus
tttctggctatggattctggctggc

SEQ ID NO: 530310 - DNA, 25 bp, Rattus norvegicus
tatctgcggtgtttctggctatgga

SEQ ID NO: 530311 - DNA, 25 bp, Rattus norvegicus
aaatattctatatctgcggtgtttc

SEQ ID NO: 530312 - DNA, 25 bp, Rattus norvegicus
gcgggaagaactcgcctccagcaag

SEQ ID NO: 530313 - DNA, 25 bp, Rattus norvegicus
gctttgtccttggacactgggaggc

SEQ ID NO: 530314 - DNA, 25 bp, Rattus norvegicus
acgcaagcggcaggcctcgaggtcc

SEQ ID NO: 530315 - DNA, 25 bp, Rattus norvegicus
aatgggtccacgcaagcggcaggcc

SEQ ID NO: 530316 - DNA, 25 bp, Rattus norvegicus
gaggcagattttagttctaagttta

SEQ ID NO: 530317 - DNA, 25 bp, Rattus norvegicus
cacggcgccttgcttgccgtggatc

SEQ ID NO: 530318 - DNA, 25 bp, Rattus norvegicus
cgcagctcggctgccagcatagagg

SEQ ID NO: 530319 - DNA, 25 bp, Rattus norvegicus
tgccgtggatccaggacaccttagg

SEQ ID NO: 530320 - DNA, 25 bp, Rattus norvegicus
gccggtggcttcttcggtcaggccc

SEQ ID NO: 530321 - DNA, 25 bp, Rattus norvegicus
tcccgcgtccgtgggctccaagaga

SEQ ID NO: 530322 - DNA, 25 bp, Rattus norvegicus
acgacggtgagaaacgcagtggctc

SEQ ID NO: 530323 - DNA, 25 bp, Rattus norvegicus
acaccttaggcttggtggcagggtc

SEQ ID NO: 530324 - DNA, 25 bp, Rattus norvegicus
ccaggctgcgagtcttgtcgcgcag

SEQ ID NO: 530325 - DNA, 25 bp, Rattus norvegicus
agcacggagcgcttggccttctgag

SEQ ID NO: 530326 - DNA, 25 bp, Rattus norvegicus
gcgctcgggccaatgaaatgccttc

SEQ ID NO: 530327 - DNA, 25 bp, Rattus norvegicus
tgctcttctttcgaggcggtttctg

SEQ ID NO: 530328 - DNA, 25 bp, Rattus norvegicus
ctccacgcttgatgctgagcgctcg

SEQ ID NO: 530329 - DNA, 25 bp, Rattus norvegicus
aaatgccttcgctgcgactgcgcgg

SEQ ID NO: 530330 - DNA, 25 bp, Rattus norvegicus
cttcttccgaggtgtctcgggctca

SEQ ID NO: 530331 - DNA, 25 bp, Rattus norvegicus
cactccggggtgcaggaacaccggg

SEQ ID NO: 530332 - DNA, 25 bp, Rattus norvegicus
gagcctaaggactggcgctggtctc

SEQ ID NO: 530333 - DNA, 25 bp, Rattus norvegicus
agcctaaggactggcgctggtctcc

SEQ ID NO: 530334 - DNA, 25 bp, Rattus norvegicus
ccactccggggtgcaggaacaccgg

SEQ ID NO: 530335 - DNA, 25 bp, Rattus norvegicus
ggaggccggggtggcgtctgtggcc

SEQ ID NO: 530336 - DNA, 25 bp, Rattus norvegicus
cccaggcatacagtgacttacccaa

SEQ ID NO: 530337 - DNA, 25 bp, Rattus norvegicus
atacagtgacttacccaaggccatc

SEQ ID NO: 530338 - DNA, 25 bp, Rattus norvegicus
tacagtgacttacccaaggccatca

SEQ ID NO: 530339 - DNA, 25 bp, Rattus norvegicus
ggcatacagtgacttacccaaggcc

SEQ ID NO: 530340 - DNA, 25 bp, Rattus norvegicus
ccaggcatacagtgacttacccaag

SEQ ID NO: 530341 - DNA, 25 bp, Rattus norvegicus
tctccattggtaaccccgtcgctgt

SEQ ID NO: 530342 - DNA, 25 bp, Rattus norvegicus
gcatacagtgacttacccaaggcca

SEQ ID NO: 530343 - DNA, 25 bp, Rattus norvegicus
aggcatacagtgacttacccaaggc

SEQ ID NO: 530344 - DNA, 25 bp, Rattus norvegicus
gcaggactggccaggggttcttccc

SEQ ID NO: 530345 - DNA, 25 bp, Rattus norvegicus
caggcatacagtgacttacccaagg

SEQ ID NO: 530346 - DNA, 25 bp, Rattus norvegicus
tgtagtctccattggtaaccccgtc

SEQ ID NO: 530347 - DNA, 25 bp, Rattus norvegicus
tagtctccattggtaaccccgtcgc

SEQ ID NO: 530348 - DNA, 25 bp, Rattus norvegicus
gaggctgtagtctccattggtaacc

SEQ ID NO: 530349 - DNA, 25 bp, Rattus norvegicus
caggactggccaggggttcttccct

SEQ ID NO: 530350 - DNA, 25 bp, Rattus norvegicus
cccaggctggagaattggtcagggc

SEQ ID NO: 530351 - DNA, 25 bp, Rattus norvegicus
ggctggagaattggtcagggcgatt

SEQ ID NO: 530352 - DNA, 25 bp, Rattus norvegicus
ctggagaattggtcagggcgattgt

SEQ ID NO: 530353 - DNA, 25 bp, Rattus norvegicus
caggctggagaattggtcagggcga

SEQ ID NO: 530354 - DNA, 25 bp, Rattus norvegicus
ttttgctcccgatgtggcgcctggt

SEQ ID NO: 530355 - DNA, 25 bp, Rattus norvegicus
ttgctcccgatgtggcgcctggtaa

SEQ ID NO: 530356 - DNA, 25 bp, Rattus norvegicus
tttgctcccgatgtggcgcctggta

SEQ ID NO: 530357 - DNA, 25 bp, Rattus norvegicus
gctcccgatgtggcgcctggtaaga

SEQ ID NO: 530358 - DNA, 25 bp, Rattus norvegicus
tgctcccgatgtggcgcctggtaag

SEQ ID NO: 530359 - DNA, 25 bp, Rattus norvegicus
cctgggtaccagacctgagttcggg

SEQ ID NO: 530360 - DNA, 25 bp, Rattus norvegicus
ctgggtaccagacctgagttcgggc

SEQ ID NO: 530361 - DNA, 25 bp, Rattus norvegicus
tgggtaccagacctgagttcgggct

SEQ ID NO: 530362 - DNA, 25 bp, Rattus norvegicus
gggtaccagacctgagttcgggcta

SEQ ID NO: 530363 - DNA, 25 bp, Rattus norvegicus
ggtaccagacctgagttcgggctag

SEQ ID NO: 530364 - DNA, 25 bp, Rattus norvegicus
gtaccagacctgagttcgggctagg

SEQ ID NO: 530365 - DNA, 25 bp, Rattus norvegicus
taccagacctgagttcgggctaggg

SEQ ID NO: 530366 - DNA, 25 bp, Rattus norvegicus
ccctgggtaccagacctgagttcgg

SEQ ID NO: 530367 - DNA, 25 bp, Rattus norvegicus
ccttggcccgaactctggtctgctc

SEQ ID NO: 530368 - DNA, 25 bp, Rattus norvegicus
gcgcggaaccttggcccgaactctg

SEQ ID NO: 530369 - DNA, 25 bp, Rattus norvegicus
cgcggaaccttggcccgaactctgg

SEQ ID NO: 530370 - DNA, 25 bp, Rattus norvegicus
gaaccttggcccgaactctggtctg

SEQ ID NO: 530371 - DNA, 25 bp, Rattus norvegicus
accttggcccgaactctggtctgct

SEQ ID NO: 530372 - DNA, 25 bp, Rattus norvegicus
cttggcccgaactctggtctgctcc

SEQ ID NO: 530373 - DNA, 25 bp, Rattus norvegicus
ttggcccgaactctggtctgctccc

SEQ ID NO: 530374 - DNA, 25 bp, Rattus norvegicus
aaccttggcccgaactctggtctgc

SEQ ID NO: 530375 - DNA, 25 bp, Rattus norvegicus
tagagatcctaccagcggagggcgt

SEQ ID NO: 530376 - DNA, 25 bp, Rattus norvegicus
agtgagtcacctgaccgccgcttgc

SEQ ID NO: 530377 - DNA, 25 bp, Rattus norvegicus
ccctttgttgtagctcgccgcacgt

SEQ ID NO: 530378 - DNA, 25 bp, Rattus norvegicus
cgccgcacgtttgtaatttagactc

SEQ ID NO: 530379 - DNA, 25 bp, Rattus norvegicus
cacagcataggcagagtggggtctc

SEQ ID NO: 530380 - DNA, 25 bp, Rattus norvegicus
tggggtctcgatgatagacatcagc

SEQ ID NO: 530381 - DNA, 25 bp, Rattus norvegicus
cagctttgtgttcgtgtctggtagc

SEQ ID NO: 530382 - DNA, 25 bp, Rattus norvegicus
cgcccaaggcgaaatagagatccta

SEQ ID NO: 530383 - DNA, 25 bp, Rattus norvegicus
tctccggtactttggtgtcatttag

SEQ ID NO: 530384 - DNA, 25 bp, Rattus norvegicus
gtcatttagtggaattgcgccgctg

SEQ ID NO: 530385 - DNA, 25 bp, Rattus norvegicus
tgcgccgctggcttttatgtagtga

SEQ ID NO: 530386 - DNA, 25 bp, Rattus norvegicus
gtgagctctctacgctcagcgtgcg

SEQ ID NO: 530387 - DNA, 25 bp, Rattus norvegicus
gttacaccgagttcgcccaaggcga

SEQ ID NO: 530388 - DNA, 25 bp, Rattus norvegicus
aacgcgttctcgatcttctccggta

SEQ ID NO: 530389 - DNA, 25 bp, Rattus norvegicus
ggcccactatgacctacccgagtcc

SEQ ID NO: 530390 - DNA, 25 bp, Rattus norvegicus
cttccggcctaaaggcccactatga

SEQ ID NO: 530391 - DNA, 25 bp, Rattus norvegicus
atgacctacccgagtccatcacctc

SEQ ID NO: 530392 - DNA, 25 bp, Rattus norvegicus
tatgacctacccgagtccatcacct

SEQ ID NO: 530393 - DNA, 25 bp, Rattus norvegicus
cactatgacctacccgagtccatca

SEQ ID NO: 530394 - DNA, 25 bp, Rattus norvegicus
ccactatgacctacccgagtccatc

SEQ ID NO: 530395 - DNA, 25 bp, Rattus norvegicus
gcccactatgacctacccgagtcca

SEQ ID NO: 530396 - DNA, 25 bp, Rattus norvegicus
ttccggcctaaaggcccactatgac

SEQ ID NO: 530397 - DNA, 25 bp, Rattus norvegicus
tcttccggcctaaaggcccactatg

SEQ ID NO: 530398 - DNA, 25 bp, Rattus norvegicus
aggcccactatgacctacccgagtc

SEQ ID NO: 530399 - DNA, 25 bp, Rattus norvegicus
aaggcccactatgacctacccgagt

SEQ ID NO: 530400 - DNA, 25 bp, Rattus norvegicus
aaaggcccactatgacctacccgag

SEQ ID NO: 530401 - DNA, 25 bp, Rattus norvegicus
taaaggcccactatgacctacccga

SEQ ID NO: 530402 - DNA, 25 bp, Rattus norvegicus
ggcctaaaggcccactatgacctac

SEQ ID NO: 530403 - DNA, 25 bp, Rattus norvegicus
cggttcaggcagtacctggaggcgg

SEQ ID NO: 530404 - DNA, 25 bp, Rattus norvegicus
tttgttttcaaagtggcgcctgcga

SEQ ID NO: 530405 - DNA, 25 bp, Rattus norvegicus
tccctggactctgccaggctgcaga

SEQ ID NO: 530406 - DNA, 25 bp, Rattus norvegicus
cctggactctgccaggctgcagact

SEQ ID NO: 530407 - DNA, 25 bp, Rattus norvegicus
ctggactctgccaggctgcagactc

SEQ ID NO: 530408 - DNA, 25 bp, Rattus norvegicus
tggactctgccaggctgcagactcc

SEQ ID NO: 530409 - DNA, 25 bp, Rattus norvegicus
gactctgccaggctgcagactccat

SEQ ID NO: 530410 - DNA, 25 bp, Rattus norvegicus
tctgccaggctgcagactccattgg

SEQ ID NO: 530411 - DNA, 25 bp, Rattus norvegicus
ctgccaggctgcagactccattgga

SEQ ID NO: 530412 - DNA, 25 bp, Rattus norvegicus
ctctggtggccggtgtgacccccaa

SEQ ID NO: 530413 - DNA, 25 bp, Rattus norvegicus
gacacatgtgcccaccccgcggttc

SEQ ID NO: 530414 - DNA, 25 bp, Rattus norvegicus
cccgcggttcaggcagtacctggag

SEQ ID NO: 530415 - DNA, 25 bp, Rattus norvegicus
caggcagtacctggaggcggggcat

SEQ ID NO: 530416 - DNA, 25 bp, Rattus norvegicus
tgccaggctgcagactccattggaa

SEQ ID NO: 530417 - DNA, 25 bp, Rattus norvegicus
cgcagtatccatggatgaagcccag

SEQ ID NO: 530418 - DNA, 25 bp, Rattus norvegicus
ccagcatccgtccttgggctggttc

SEQ ID NO: 530419 - DNA, 25 bp, Rattus norvegicus
agaccagcatccgtccttgggctgg

SEQ ID NO: 530420 - DNA, 25 bp, Rattus norvegicus
ggagaccagcatccgtccttgggct

SEQ ID NO: 530421 - DNA, 25 bp, Rattus norvegicus
aggagaccagcatccgtccttgggc

SEQ ID NO: 530422 - DNA, 25 bp, Rattus norvegicus
taggagaccagcatccgtccttggg

SEQ ID NO: 530423 - DNA, 25 bp, Rattus norvegicus
gcaggttccggcagccatggcgcct

SEQ ID NO: 530424 - DNA, 25 bp, Rattus norvegicus
cctcgcagtatccatggatgaagcc

SEQ ID NO: 530425 - DNA, 25 bp, Rattus norvegicus
tgcagcctcgcagtatccatggatg

SEQ ID NO: 530426 - DNA, 25 bp, Rattus norvegicus
gcagcctcgcagtatccatggatga

SEQ ID NO: 530427 - DNA, 25 bp, Rattus norvegicus
cagcctcgcagtatccatggatgaa

SEQ ID NO: 530428 - DNA, 25 bp, Rattus norvegicus
gcctcgcagtatccatggatgaagc

SEQ ID NO: 530429 - DNA, 25 bp, Rattus norvegicus
tcgcagtatccatggatgaagccca

SEQ ID NO: 530430 - DNA, 25 bp, Rattus norvegicus
ctcgcagtatccatggatgaagccc

SEQ ID NO: 530431 - DNA, 25 bp, Rattus norvegicus
cgtggacccattgcccgacctcggg

SEQ ID NO: 530432 - DNA, 25 bp, Rattus norvegicus
tgcgtggacccattgcccgacctcg

SEQ ID NO: 530433 - DNA, 25 bp, Rattus norvegicus
cttgctggaggcgagttcttcccgc

SEQ ID NO: 530434 - DNA, 25 bp, Rattus norvegicus
ccgcttgcgtggacccattgcccga

SEQ ID NO: 530435 - DNA, 25 bp, Rattus norvegicus
cctgccgcttgcgtggacccattgc

SEQ ID NO: 530436 - DNA, 25 bp, Rattus norvegicus
ggcctgccgcttgcgtggacccatt

SEQ ID NO: 530437 - DNA, 25 bp, Rattus norvegicus
aggcctgccgcttgcgtggacccat

SEQ ID NO: 530438 - DNA, 25 bp, Rattus norvegicus
gaggcctgccgcttgcgtggaccca

SEQ ID NO: 530439 - DNA, 25 bp, Rattus norvegicus
gacctcgaggcctgccgcttgcgtg

SEQ ID NO: 530440 - DNA, 25 bp, Rattus norvegicus
ggacctcgaggcctgccgcttgcgt

SEQ ID NO: 530441 - DNA, 25 bp, Rattus norvegicus
ctcccagtgtccaaggacaaagccc

SEQ ID NO: 530442 - DNA, 25 bp, Rattus norvegicus
gcctcccagtgtccaaggacaaagc

SEQ ID NO: 530443 - DNA, 25 bp, Rattus norvegicus
gagttcttcccgcgccacatcgcga

SEQ ID NO: 530444 - DNA, 25 bp, Rattus norvegicus
acctcgaggcctgccgcttgcgtgg

SEQ ID NO: 530445 - DNA, 25 bp, Rattus norvegicus
tgggcgcagtccacaccatggagcc

SEQ ID NO: 530446 - DNA, 25 bp, Rattus norvegicus
gttacattacagctgcaaagtttgg

SEQ ID NO: 530447 - DNA, 25 bp, Rattus norvegicus
cggcaggcacagcaacaaccgagca

SEQ ID NO: 530448 - DNA, 25 bp, Rattus norvegicus
gctgcaaagtttgggagtccagaat

SEQ ID NO: 530449 - DNA, 25 bp, Rattus norvegicus
ccggccgggcaagttacattacagc

SEQ ID NO: 530450 - DNA, 25 bp, Rattus norvegicus
tgggagtccagaatgcctcctttcc

SEQ ID NO: 530451 - DNA, 25 bp, Rattus norvegicus
attcctcgtgacagctgcaggcctg

SEQ ID NO: 530452 - DNA, 25 bp, Rattus norvegicus
ccgggtcgcatgattcctcgtgaca

SEQ ID NO: 530453 - DNA, 25 bp, Rattus norvegicus
cccggtgaccgggtcgcatgattcc

SEQ ID NO: 530454 - DNA, 25 bp, Rattus norvegicus
tggcccgacgttcttcacccactca

SEQ ID NO: 530455 - DNA, 25 bp, Rattus norvegicus
agcggctcagcgcaggatcacgcac

SEQ ID NO: 530456 - DNA, 25 bp, Rattus norvegicus
cctttgcgctgattggtctctgtgg

SEQ ID NO: 530457 - DNA, 25 bp, Rattus norvegicus
gcccatcacacctttgcgctgattg

SEQ ID NO: 530458 - DNA, 25 bp, Rattus norvegicus
cagcaacaaccgagcagcgagagca

SEQ ID NO: 530459 - DNA, 25 bp, Rattus norvegicus
atttcccaattctctggccttagtc

SEQ ID NO: 530460 - DNA, 25 bp, Rattus norvegicus
tcccaattctctggccttagtcttc

SEQ ID NO: 530461 - DNA, 25 bp, Rattus norvegicus
tgatttcccaattctctggccttag

SEQ ID NO: 530462 - DNA, 25 bp, Rattus norvegicus
gccttgatttcccaattctctggcc

SEQ ID NO: 530463 - DNA, 25 bp, Rattus norvegicus
tggccttgatttcccaattctctgg

SEQ ID NO: 530464 - DNA, 25 bp, Rattus norvegicus
ctggccttgatttcccaattctctg

SEQ ID NO: 530465 - DNA, 25 bp, Rattus norvegicus
gagataggatcttattatgcagccc

SEQ ID NO: 530466 - DNA, 25 bp, Rattus norvegicus
cttgacattttgagataggatctta

SEQ ID NO: 530467 - DNA, 25 bp, Rattus norvegicus
agtcttgacattttgagataggatc

SEQ ID NO: 530468 - DNA, 25 bp, Rattus norvegicus
tccagtcttgacattttgagatagg

SEQ ID NO: 530469 - DNA, 25 bp, Rattus norvegicus
cacatccagtcttgacattttgaga

SEQ ID NO: 530470 - DNA, 25 bp, Rattus norvegicus
gcccacatccagtcttgacattttg

SEQ ID NO: 530471 - DNA, 25 bp, Rattus norvegicus
gagcccacatccagtcttgacattt

SEQ ID NO: 530472 - DNA, 25 bp, Rattus norvegicus
agagcccacatccagtcttgacatt

SEQ ID NO: 530473 - DNA, 25 bp, Rattus norvegicus
agggagtgtgtcaccaggcttcttc

SEQ ID NO: 530474 - DNA, 25 bp, Rattus norvegicus
gggagtgtgtcaccaggcttcttcc

SEQ ID NO: 530475 - DNA, 25 bp, Rattus norvegicus
attacaaagtagataaggtgaaatc

SEQ ID NO: 530476 - DNA, 25 bp, Rattus norvegicus
ttacaaagtagataaggtgaaatct

SEQ ID NO: 530477 - DNA, 25 bp, Rattus norvegicus
caaagtagataaggtgaaatctatt

SEQ ID NO: 530478 - DNA, 25 bp, Rattus norvegicus
ggagtgtgtcaccaggcttcttccc

SEQ ID NO: 530479 - DNA, 25 bp, Rattus norvegicus
cagggagtgtgtcaccaggcttctt

SEQ ID NO: 530480 - DNA, 25 bp, Rattus norvegicus
gagtgtgtcaccaggcttcttccct

SEQ ID NO: 530481 - DNA, 25 bp, Rattus norvegicus
acgcgtaggcgcgtgttgtggagct

SEQ ID NO: 530482 - DNA, 25 bp, Rattus norvegicus
agtccgcaacagaggattcaacctg

SEQ ID NO: 530483 - DNA, 25 bp, Rattus norvegicus
gccgctgagtcccagcgctgacttg

SEQ ID NO: 530484 - DNA, 25 bp, Rattus norvegicus
caggacgtgggagctgaccgtggta

SEQ ID NO: 530485 - DNA, 25 bp, Rattus norvegicus
agagcccatcgctgagagagttcaa

SEQ ID NO: 530486 - DNA, 25 bp, Rattus norvegicus
agcccatcgctgagagagttcaaga

SEQ ID NO: 530487 - DNA, 25 bp, Rattus norvegicus
gcccatcgctgagagagttcaagag

SEQ ID NO: 530488 - DNA, 25 bp, Rattus norvegicus
tggggtcaactcagtccgcaacaga

SEQ ID NO: 530489 - DNA, 25 bp, Rattus norvegicus
cgggatgccgctgagtcccagcgct

SEQ ID NO: 530490 - DNA, 25 bp, Rattus norvegicus
caactcagtccgcaacagaggattc

SEQ ID NO: 530491 - DNA, 25 bp, Rattus norvegicus
ggatgccgctgagtcccagcgctga

SEQ ID NO: 530492 - DNA, 25 bp, Rattus norvegicus
ccgcaacagaggattcaacctgggg

SEQ ID NO: 530493 - DNA, 25 bp, Rattus norvegicus
ggaccgaccactcgggtgccagctg

SEQ ID NO: 530494 - DNA, 25 bp, Rattus norvegicus
gggaccgaccactcgggtgccagct

SEQ ID NO: 530495 - DNA, 25 bp, Rattus norvegicus
ggtcaactcagtccgcaacagagga

SEQ ID NO: 530496 - DNA, 25 bp, Rattus norvegicus
gatctcgccgtccactggtgccggg

SEQ ID NO: 530497 - DNA, 25 bp, Rattus norvegicus
atctcgccgtccactggtgccgggg

SEQ ID NO: 530498 - DNA, 25 bp, Rattus norvegicus
ctctgtctcccgacgttcagacttg

SEQ ID NO: 530499 - DNA, 25 bp, Rattus norvegicus
tgggcagcgtccgtttgtcgtccat

SEQ ID NO: 530500 - DNA, 25 bp, Rattus norvegicus
gggcagcgtccgtttgtcgtccatg

SEQ ID NO: 530501 - DNA, 25 bp, Rattus norvegicus
ggcagcgtccgtttgtcgtccatgc

SEQ ID NO: 530502 - DNA, 25 bp, Rattus norvegicus
gcagcgtccgtttgtcgtccatgcc

SEQ ID NO: 530503 - DNA, 25 bp, Rattus norvegicus
agcgtccgtttgtcgtccatgcccg

SEQ ID NO: 530504 - DNA, 25 bp, Rattus norvegicus
gtgggcgtcgatctcgccgtccact

SEQ ID NO: 530505 - DNA, 25 bp, Rattus norvegicus
tgggcgtcgatctcgccgtccactg

SEQ ID NO: 530506 - DNA, 25 bp, Rattus norvegicus
gggcgtcgatctcgccgtccactgg

SEQ ID NO: 530507 - DNA, 25 bp, Rattus norvegicus
ggcgtcgatctcgccgtccactggt

SEQ ID NO: 530508 - DNA, 25 bp, Rattus norvegicus
tccactggtgccgggggccggcaac

SEQ ID NO: 530509 - DNA, 25 bp, Rattus norvegicus
gcgtcgatctcgccgtccactggtg

SEQ ID NO: 530510 - DNA, 25 bp, Rattus norvegicus
cgttcataccggtgggtgcgatgtt

SEQ ID NO: 530511 - DNA, 25 bp, Rattus norvegicus
tccaattagtgcgatcccggcgcca

SEQ ID NO: 530512 - DNA, 25 bp, Rattus norvegicus
gcagcattgattaaacccgccttcc

SEQ ID NO: 530513 - DNA, 25 bp, Rattus norvegicus
cacgttccagggcagcattgattaa

SEQ ID NO: 530514 - DNA, 25 bp, Rattus norvegicus
gtcaagagccacatcacgttccagg

SEQ ID NO: 530515 - DNA, 25 bp, Rattus norvegicus
aagagggcacacatccgtcaagagc

SEQ ID NO: 530516 - DNA, 25 bp, Rattus norvegicus
cgatgactaagatcaagagggcaca

SEQ ID NO: 530517 - DNA, 25 bp, Rattus norvegicus
cgttacgagacaccgatgactaaga

SEQ ID NO: 530518 - DNA, 25 bp, Rattus norvegicus
cgcctaggctgaacgttacgagaca

SEQ ID NO: 530519 - DNA, 25 bp, Rattus norvegicus
gacacgcgtatgtcgcctaggctga

SEQ ID NO: 530520 - DNA, 25 bp, Rattus norvegicus
ggtgcgatgttagggacaagtctaa

SEQ ID NO: 530521 - DNA, 25 bp, Rattus norvegicus
acacgcagcagtgccgttcataccg

SEQ ID NO: 530522 - DNA, 25 bp, Rattus norvegicus
acagcacacggaagcacacgcagca

SEQ ID NO: 530523 - DNA, 25 bp, Rattus norvegicus
ggacaagtctaaccagacacgcgta

SEQ ID NO: 530524 - DNA, 25 bp, Rattus norvegicus
ttcgactactgtgcacggctgctgg

SEQ ID NO: 530525 - DNA, 25 bp, Rattus norvegicus
tacacttgccggtgacatggttgca

SEQ ID NO: 530526 - DNA, 25 bp, Rattus norvegicus
gttcgcacgtcagacagcggccttc

SEQ ID NO: 530527 - DNA, 25 bp, Rattus norvegicus
gcccgcattgcagtgcgtacacttg

SEQ ID NO: 530528 - DNA, 25 bp, Rattus norvegicus
attggccacacctacggaagggtca

SEQ ID NO: 530529 - DNA, 25 bp, Rattus norvegicus
acacccgaggccgtagaagccagcg

SEQ ID NO: 530530 - DNA, 25 bp, Rattus norvegicus
gggcatggctcacgacaatacttgc

SEQ ID NO: 530531 - DNA, 25 bp, Rattus norvegicus
cgcggaagcactggcaatagcgatc

SEQ ID NO: 530532 - DNA, 25 bp, Rattus norvegicus
atagcgatcacagcgcgcgccgaac

SEQ ID NO: 530533 - DNA, 25 bp, Rattus norvegicus
caggagcactggttgttgcagctgc

SEQ ID NO: 530534 - DNA, 25 bp, Rattus norvegicus
tggcactggcaagcatgctcgcagc

SEQ ID NO: 530535 - DNA, 25 bp, Rattus norvegicus
gcgtgacacgtacactgtccggtca

SEQ ID NO: 530536 - DNA, 25 bp, Rattus norvegicus
actgtccgtgcggatggcaactgca

SEQ ID NO: 530537 - DNA, 25 bp, Rattus norvegicus
tggtcacatttggttccgttccagc

SEQ ID NO: 530538 - DNA, 25 bp, Rattus norvegicus
aatcatcagccacgccgggcaaagg

SEQ ID NO: 530539 - DNA, 25 bp, Rattus norvegicus
gcatgcaaatacacccgggaccgtt

SEQ ID NO: 530540 - DNA, 25 bp, Rattus norvegicus
gggaccgttcaccaatcatcagcca

SEQ ID NO: 530541 - DNA, 25 bp, Rattus norvegicus
cgcgggttaccgacacagataggtc

SEQ ID NO: 530542 - DNA, 25 bp, Rattus norvegicus
aaggctgtgccaatggtttccgaga

SEQ ID NO: 530543 - DNA, 25 bp, Rattus norvegicus
acgccgggcaaaggctgtgccaatg

SEQ ID NO: 530544 - DNA, 25 bp, Rattus norvegicus
cgacacagataggtccacccgagca

SEQ ID NO: 530545 - DNA, 25 bp, Rattus norvegicus
cacaaacttctactgggcgcgggtt

SEQ ID NO: 530546 - DNA, 25 bp, Rattus norvegicus
cagccggtgagaaagcgctccacaa

SEQ ID NO: 530547 - DNA, 25 bp, Rattus norvegicus
aatcccgagagaatggggcggtcac

SEQ ID NO: 530548 - DNA, 25 bp, Rattus norvegicus
tcaccacagagaaggaatcccgaga

SEQ ID NO: 530549 - DNA, 25 bp, Rattus norvegicus
cgtctagagcgtccgtcaccacaga

SEQ ID NO: 530550 - DNA, 25 bp, Rattus norvegicus
cagcttcccttaccgagcgtctaga

SEQ ID NO: 530551 - DNA, 25 bp, Rattus norvegicus
cgtcccggaccagccggtgagaaag

SEQ ID NO: 530552 - DNA, 25 bp, Rattus norvegicus
ttaccgtacacgtgttaacagcgca

SEQ ID NO: 530553 - DNA, 25 bp, Rattus norvegicus
tgatggatgggccagcccgcctcgc

SEQ ID NO: 530554 - DNA, 25 bp, Rattus norvegicus
ccatcagaggaactgcaggtcaggg

SEQ ID NO: 530555 - DNA, 25 bp, Rattus norvegicus
tggccatcagaggaactgcaggtca

SEQ ID NO: 530556 - DNA, 25 bp, Rattus norvegicus
cggcgacaccgcgtggccatcagag

SEQ ID NO: 530557 - DNA, 25 bp, Rattus norvegicus
gcctcgcccgagtaccgcgggccga

SEQ ID NO: 530558 - DNA, 25 bp, Rattus norvegicus
gctccccgcattgtctgcgcagagg

SEQ ID NO: 530559 - DNA, 25 bp, Rattus norvegicus
atcctttgtaccgacagcgcgggcg

SEQ ID NO: 530560 - DNA, 25 bp, Rattus norvegicus
gcatcctttgtaccgacagcgcggg

SEQ ID NO: 530561 - DNA, 25 bp, Rattus norvegicus
acagcgcatcctttgtaccgacagc

SEQ ID NO: 530562 - DNA, 25 bp, Rattus norvegicus
gttaacagcgcatcctttgtaccga

SEQ ID NO: 530563 - DNA, 25 bp, Rattus norvegicus
ccgtacacgtgttaacagcgcatcc

SEQ ID NO: 530564 - DNA, 25 bp, Rattus norvegicus
gagcccattaccgtacacgtgttaa

SEQ ID NO: 530565 - DNA, 25 bp, Rattus norvegicus
acacgtgttaacagcgcatcctttg

SEQ ID NO: 530566 - DNA, 25 bp, Rattus norvegicus
tggcccgcccactcccacggcaaac

SEQ ID NO: 530567 - DNA, 25 bp, Rattus norvegicus
cttggctttcgtccgtgacctggcc

SEQ ID NO: 530568 - DNA, 25 bp, Rattus norvegicus
ggctttcaatcagactcgtccagtc

SEQ ID NO: 530569 - DNA, 25 bp, Rattus norvegicus
actcgtccagtcagcaaagcgggcc

SEQ ID NO: 530570 - DNA, 25 bp, Rattus norvegicus
ccagccttccaaattgaaaccacga

SEQ ID NO: 530571 - DNA, 25 bp, Rattus norvegicus
tccaaattgaaaccacgatcggctc

SEQ ID NO: 530572 - DNA, 25 bp, Rattus norvegicus
accatcagctggcttggctttcgtc

SEQ ID NO: 530573 - DNA, 25 bp, Rattus norvegicus
tgaaaccacgatcggctcgcagagg

SEQ ID NO: 530574 - DNA, 25 bp, Rattus norvegicus
atcggctcgcagaggttaatagaaa

SEQ ID NO: 530575 - DNA, 25 bp, Rattus norvegicus
actctgggaaataaataggttatcg

SEQ ID NO: 530576 - DNA, 25 bp, Rattus norvegicus
gaaataaataggttatcgatcgatc

SEQ ID NO: 530577 - DNA, 25 bp, Rattus norvegicus
ccacgatcggctcgcagaggttaat

SEQ ID NO: 530578 - DNA, 25 bp, Rattus norvegicus
tcgatcgatcataaccatcagctgg

SEQ ID NO: 530579 - DNA, 25 bp, Rattus norvegicus
gtcacgtcaggggccggctttcaat

SEQ ID NO: 530580 - DNA, 25 bp, Rattus norvegicus
cccgccagacgctcacgcagacctt

SEQ ID NO: 530581 - DNA, 25 bp, Rattus norvegicus
gcccgccagacgctcacgcagacct

SEQ ID NO: 530582 - DNA, 25 bp, Rattus norvegicus
gtgcccgccagacgctcacgcagac

SEQ ID NO: 530583 - DNA, 25 bp, Rattus norvegicus
agtgcccgccagacgctcacgcaga

SEQ ID NO: 530584 - DNA, 25 bp, Rattus norvegicus
acagtgcccgccagacgctcacgca

SEQ ID NO: 530585 - DNA, 25 bp, Rattus norvegicus
cacagtgcccgccagacgctcacgc

SEQ ID NO: 530586 - DNA, 25 bp, Rattus norvegicus
acgcccaagcacacgcgccactgca

SEQ ID NO: 530587 - DNA, 25 bp, Rattus norvegicus
tctgtgtgccctcagtccaggctca

SEQ ID NO: 530588 - DNA, 25 bp, Rattus norvegicus
gctctgtgtgccctcagtccaggct

SEQ ID NO: 530589 - DNA, 25 bp, Rattus norvegicus
agagctctgtgtgccctcagtccag

SEQ ID NO: 530590 - DNA, 25 bp, Rattus norvegicus
aagagctctgtgtgccctcagtcca

SEQ ID NO: 530591 - DNA, 25 bp, Rattus norvegicus
cccagtgccttaaggtcccacgctc

SEQ ID NO: 530592 - DNA, 25 bp, Rattus norvegicus
ttcccagtgccttaaggtcccacgc

SEQ ID NO: 530593 - DNA, 25 bp, Rattus norvegicus
attcccagtgccttaaggtcccacg

SEQ ID NO: 530594 - DNA, 25 bp, Rattus norvegicus
tacgaattcccagtgccttaaggtc

SEQ ID NO: 530595 - DNA, 25 bp, Rattus norvegicus
ctacgaattcccagtgccttaaggt

SEQ ID NO: 530596 - DNA, 25 bp, Rattus norvegicus
cctacgaattcccagtgccttaagg

SEQ ID NO: 530597 - DNA, 25 bp, Rattus norvegicus
cacctacgaattcccagtgccttaa

SEQ ID NO: 530598 - DNA, 25 bp, Rattus norvegicus
cccaagcacacgcgccactgcagtc

SEQ ID NO: 530599 - DNA, 25 bp, Rattus norvegicus
tcacctacgaattcccagtgcctta

SEQ ID NO: 530600 - DNA, 25 bp, Rattus norvegicus
agtcaagttcgacgcgctccaccag

SEQ ID NO: 530601 - DNA, 25 bp, Rattus norvegicus
atagtcaagttcgacgcgctccacc

SEQ ID NO: 530602 - DNA, 25 bp, Rattus norvegicus
tagtcaagttcgacgcgctccacca

SEQ ID NO: 530603 - DNA, 25 bp, Rattus norvegicus
gtcaagttcgacgcgctccaccagg

SEQ ID NO: 530604 - DNA, 25 bp, Rattus norvegicus
aagttcgacgcgctccaccagggcc

SEQ ID NO: 530605 - DNA, 25 bp, Rattus norvegicus
tcaagttcgacgcgctccaccaggg

SEQ ID NO: 530606 - DNA, 25 bp, Rattus norvegicus
gccttggcacacaccacgaatgcga

SEQ ID NO: 530607 - DNA, 25 bp, Rattus norvegicus
cttggctggccggccttggcacaca

SEQ ID NO: 530608 - DNA, 25 bp, Rattus norvegicus
ggcccacgcagaccctcggggcatg

SEQ ID NO: 530609 - DNA, 25 bp, Rattus norvegicus
ggcagaatgacctccttatgcccag

SEQ ID NO: 530610 - DNA, 25 bp, Rattus norvegicus
tggcacacaccacgaatgcgaccat

SEQ ID NO: 530611 - DNA, 25 bp, Rattus norvegicus
cagaatgacctccttatgcccaggg

SEQ ID NO: 530612 - DNA, 25 bp, Rattus norvegicus
ggccttggcacacaccacgaatgcg

SEQ ID NO: 530613 - DNA, 25 bp, Rattus norvegicus
ttggcacacaccacgaatgcgacca

SEQ ID NO: 530614 - DNA, 25 bp, Rattus norvegicus
accacgaatgcgaccatgacccgag

SEQ ID NO: 530615 - DNA, 25 bp, Rattus norvegicus
gaatgcgaccatgacccgaggacgt

SEQ ID NO: 530616 - DNA, 25 bp, Rattus norvegicus
aatgcgaccatgacccgaggacgtg

SEQ ID NO: 530617 - DNA, 25 bp, Rattus norvegicus
atgcgaccatgacccgaggacgtgc

SEQ ID NO: 530618 - DNA, 25 bp, Rattus norvegicus
gcgaccatgacccgaggacgtgcct

SEQ ID NO: 530619 - DNA, 25 bp, Rattus norvegicus
gcagaatgacctccttatgcccagg

SEQ ID NO: 530620 - DNA, 25 bp, Rattus norvegicus
tggaggacccacgacgcccacccga

SEQ ID NO: 530621 - DNA, 25 bp, Rattus norvegicus
cgacgcccacccgagtaggtgaggg

SEQ ID NO: 530622 - DNA, 25 bp, Rattus norvegicus
cgggcaaaatgtcgcggaggcagtg

SEQ ID NO: 530623 - DNA, 25 bp, Rattus norvegicus
ccacgacgcccacccgagtaggtga

SEQ ID NO: 530624 - DNA, 25 bp, Rattus norvegicus
gccaccaacgggcaaaatgtcgcgg

SEQ ID NO: 530625 - DNA, 25 bp, Rattus norvegicus
gggactggaggacccacgacgccca

SEQ ID NO: 530626 - DNA, 25 bp, Rattus norvegicus
ccaacgggcaaaatgtcgcggaggc

SEQ ID NO: 530627 - DNA, 25 bp, Rattus norvegicus
aatggagtcgggaagcgagcgtggc

SEQ ID NO: 530628 - DNA, 25 bp, Rattus norvegicus
cctggccaccaacgggcaaaatgtc

SEQ ID NO: 530629 - DNA, 25 bp, Rattus norvegicus
ctcggagacaatggagtcgggaagc

SEQ ID NO: 530630 - DNA, 25 bp, Rattus norvegicus
accaacgggcaaaatgtcgcggagg

SEQ ID NO: 530631 - DNA, 25 bp, Rattus norvegicus
caccaacgggcaaaatgtcgcggag

SEQ ID NO: 530632 - DNA, 25 bp, Rattus norvegicus
ccaccaacgggcaaaatgtcgcgga

SEQ ID NO: 530633 - DNA, 25 bp, Rattus norvegicus
caacgggcaaaatgtcgcggaggca

SEQ ID NO: 530634 - DNA, 25 bp, Rattus norvegicus
tgccattgttagctcgcatacaagt

SEQ ID NO: 530635 - DNA, 25 bp, Rattus norvegicus
gtgccattgttagctcgcatacaag

SEQ ID NO: 530636 - DNA, 25 bp, Rattus norvegicus
ccattgttagctcgcatacaagtct

SEQ ID NO: 530637 - DNA, 25 bp, Rattus norvegicus
tgttagctcgcatacaagtctgctc

SEQ ID NO: 530638 - DNA, 25 bp, Rattus norvegicus
ttgttagctcgcatacaagtctgct

SEQ ID NO: 530639 - DNA, 25 bp, Rattus norvegicus
gccattgttagctcgcatacaagtc

SEQ ID NO: 530640 - DNA, 25 bp, Rattus norvegicus
ggtgccattgttagctcgcatacaa

SEQ ID NO: 530641 - DNA, 25 bp, Rattus norvegicus
attgttagctcgcatacaagtctgc

SEQ ID NO: 530642 - DNA, 25 bp, Rattus norvegicus
tggatgttcgcacgcaagccatgta

SEQ ID NO: 530643 - DNA, 25 bp, Rattus norvegicus
tgtggccttcacacgtggatgttcg

SEQ ID NO: 530644 - DNA, 25 bp, Rattus norvegicus
atggaccaaggcttcgtgggactta

SEQ ID NO: 530645 - DNA, 25 bp, Rattus norvegicus
agaccggacgtgtcctctacacttg

SEQ ID NO: 530646 - DNA, 25 bp, Rattus norvegicus
agtcgtcggctggtaccattcgcac

SEQ ID NO: 530647 - DNA, 25 bp, Rattus norvegicus
tcggtcatcatcctgcgccgttctg

SEQ ID NO: 530648 - DNA, 25 bp, Rattus norvegicus
ggattcgatcagagtcgtccacatc

SEQ ID NO: 530649 - DNA, 25 bp, Rattus norvegicus
tccaaattcgcacacgccggaagtg

SEQ ID NO: 530650 - DNA, 25 bp, Rattus norvegicus
accacgccctgagtacggagaaaga

SEQ ID NO: 530651 - DNA, 25 bp, Rattus norvegicus
tccatctggagtcggacgcctttct

SEQ ID NO: 530652 - DNA, 25 bp, Rattus norvegicus
ctcgcacaggcggacagaagccctt

SEQ ID NO: 530653 - DNA, 25 bp, Rattus norvegicus
tgccttaagcccttggcggacgtga

SEQ ID NO: 530654 - DNA, 25 bp, Rattus norvegicus
acccgttcgcacaggctgccttaag

SEQ ID NO: 530655 - DNA, 25 bp, Rattus norvegicus
cgccgttctgacaagaggaaggacc

SEQ ID NO: 530656 - DNA, 25 bp, Rattus norvegicus
agcaatgcccgggagagtgttccca

SEQ ID NO: 530657 - DNA, 25 bp, Rattus norvegicus
cccaggcgcacctgagtcttggtag

SEQ ID NO: 530658 - DNA, 25 bp, Rattus norvegicus
gcacctgccgttcaggcctagaaga

SEQ ID NO: 530659 - DNA, 25 bp, Rattus norvegicus
agttcagcttggagtctgcagaccc

SEQ ID NO: 530660 - DNA, 25 bp, Rattus norvegicus
cctagaagatgtccgggagttctcc

SEQ ID NO: 530661 - DNA, 25 bp, Rattus norvegicus
gctccaggagtaggcacacgtcagc

SEQ ID NO: 530662 - DNA, 25 bp, Rattus norvegicus
tggtagtcagctggatcaccgcctt

SEQ ID NO: 530663 - DNA, 25 bp, Rattus norvegicus
gcccggctttgtttgcattgagtca

SEQ ID NO: 530664 - DNA, 25 bp, Rattus norvegicus
ccacgttccggtgagccatgttcac

SEQ ID NO: 530665 - DNA, 25 bp, Rattus norvegicus
tcccgttccggtgctgttctcagca

SEQ ID NO: 530666 - DNA, 25 bp, Rattus norvegicus
gggatggagccctagttacaaagga

SEQ ID NO: 530667 - DNA, 25 bp, Rattus norvegicus
tcagcctaaggtggcagcagcaatg

SEQ ID NO: 530668 - DNA, 25 bp, Rattus norvegicus
ctgtgtgtccgggaccatggtccct

SEQ ID NO: 530669 - DNA, 25 bp, Rattus norvegicus
ccgccttccggaagttcagcttgga

SEQ ID NO: 530670 - DNA, 25 bp, Rattus norvegicus
gcgatgcgaagcagatggctagcca

SEQ ID NO: 530671 - DNA, 25 bp, Rattus norvegicus
ctgccttagccgctgcattcctggg

SEQ ID NO: 530672 - DNA, 25 bp, Rattus norvegicus
ccaaaaccctagctgacgtttcgca

SEQ ID NO: 530673 - DNA, 25 bp, Rattus norvegicus
agtctggagtcccaaaacagcctcc

SEQ ID NO: 530674 - DNA, 25 bp, Rattus norvegicus
cctctgcgcagagatgccttgactg

SEQ ID NO: 530675 - DNA, 25 bp, Rattus norvegicus
gatgccttgactgcgtcgtggctca

SEQ ID NO: 530676 - DNA, 25 bp, Rattus norvegicus
tgcgcctactctgcgtcgctcttca

SEQ ID NO: 530677 - DNA, 25 bp, Rattus norvegicus
gcgtcgtggctcagatcagccaaca

SEQ ID NO: 530678 - DNA, 25 bp, Rattus norvegicus
gaccctagtctggagtcccaaaaca

SEQ ID NO: 530679 - DNA, 25 bp, Rattus norvegicus
ttagccgctgcattcctggggcccg

SEQ ID NO: 530680 - DNA, 25 bp, Rattus norvegicus
ggagtggtctgtgtcctctcaaccc

SEQ ID NO: 530681 - DNA, 25 bp, Rattus norvegicus
tgtgtcctctcaacccgatttcgga

SEQ ID NO: 530682 - DNA, 25 bp, Rattus norvegicus
gatcagccaacaggtccctcagctt

SEQ ID NO: 530683 - DNA, 25 bp, Rattus norvegicus
tgaccttccaaaaccctagctgacg

SEQ ID NO: 530684 - DNA, 25 bp, Rattus norvegicus
ggtcattgggcgcttgggactcctc

SEQ ID NO: 530685 - DNA, 25 bp, Rattus norvegicus
gggtctttcaacgcgacttgctcct

SEQ ID NO: 530686 - DNA, 25 bp, Rattus norvegicus
ggggtctttcaacgcgacttgctcc

SEQ ID NO: 530687 - DNA, 25 bp, Rattus norvegicus
tgggcgcttgggactcctcctgagg

SEQ ID NO: 530688 - DNA, 25 bp, Rattus norvegicus
ttgggcgcttgggactcctcctgag

SEQ ID NO: 530689 - DNA, 25 bp, Rattus norvegicus
cattgggcgcttgggactcctcctg

SEQ ID NO: 530690 - DNA, 25 bp, Rattus norvegicus
gtcattgggcgcttgggactcctcc

SEQ ID NO: 530691 - DNA, 25 bp, Rattus norvegicus
attgcatccgagtggactcggctcg

SEQ ID NO: 530692 - DNA, 25 bp, Rattus norvegicus
gattgcatccgagtggactcggctc

SEQ ID NO: 530693 - DNA, 25 bp, Rattus norvegicus
tgattgcatccgagtggactcggct

SEQ ID NO: 530694 - DNA, 25 bp, Rattus norvegicus
ctgattgcatccgagtggactcggc

SEQ ID NO: 530695 - DNA, 25 bp, Rattus norvegicus
tgctgattgcatccgagtggactcg

SEQ ID NO: 530696 - DNA, 25 bp, Rattus norvegicus
tcattgggcgcttgggactcctcct

SEQ ID NO: 530697 - DNA, 25 bp, Rattus norvegicus
aactgagcccagtgcaagttgtccc

SEQ ID NO: 530698 - DNA, 25 bp, Rattus norvegicus
tttgctccaatgctcccaaactgag

SEQ ID NO: 530699 - DNA, 25 bp, Rattus norvegicus
cgtcgtttctgacagctttgctcca

SEQ ID NO: 530700 - DNA, 25 bp, Rattus norvegicus
ggaaggcacgggacttgaacctctc

SEQ ID NO: 530701 - DNA, 25 bp, Rattus norvegicus
tgttcccgcaggactggggacgcca

SEQ ID NO: 530702 - DNA, 25 bp, Rattus norvegicus
cgacagcagggatgttcccgcagga

SEQ ID NO: 530703 - DNA, 25 bp, Rattus norvegicus
tgctttcccgggctgggcgtcagcc

SEQ ID NO: 530704 - DNA, 25 bp, Rattus norvegicus
cggagcgctgactgccggctgcttt

SEQ ID NO: 530705 - DNA, 25 bp, Rattus norvegicus
cgccgcaggtagatcgctcctgctg

SEQ ID NO: 530706 - DNA, 25 bp, Rattus norvegicus
tttccagttgagagatggcggccgc

SEQ ID NO: 530707 - DNA, 25 bp, Rattus norvegicus
ccagcgccgtttccagttgagagat

SEQ ID NO: 530708 - DNA, 25 bp, Rattus norvegicus
ttgactcagggctgcagttggcttg

SEQ ID NO: 530709 - DNA, 25 bp, Rattus norvegicus
cgccttttgattgggcttcacagga

SEQ ID NO: 530710 - DNA, 25 bp, Rattus norvegicus
agccgggattctcccgccttttgat

SEQ ID NO: 530711 - DNA, 25 bp, Rattus norvegicus
atcagtcgatcgctctctcgcttgc

SEQ ID NO: 530712 - DNA, 25 bp, Rattus norvegicus
ctctccatggtgaactacctgaagg

SEQ ID NO: 530713 - DNA, 25 bp, Rattus norvegicus
gtccttgatgctgaccaagaggccg

SEQ ID NO: 530714 - DNA, 25 bp, Rattus norvegicus
ctcccgcagagcaggagatgccgca

SEQ ID NO: 530715 - DNA, 25 bp, Rattus norvegicus
cattcctctgatgcgcgacagggtg

SEQ ID NO: 530716 - DNA, 25 bp, Rattus norvegicus
catctcccagcgatatcatgcgtca

SEQ ID NO: 530717 - DNA, 25 bp, Rattus norvegicus
ttcgcaggcttcgagggtgatctgc

SEQ ID NO: 530718 - DNA, 25 bp, Rattus norvegicus
cgccaaggctctccggactcggtag

SEQ ID NO: 530719 - DNA, 25 bp, Rattus norvegicus
gacctcgcgttgttcgccgggtcac

SEQ ID NO: 530720 - DNA, 25 bp, Rattus norvegicus
atctgcgcagttacggggtcctcag

SEQ ID NO: 530721 - DNA, 25 bp, Rattus norvegicus
gaccctgggcccactcaacaaggtg

SEQ ID NO: 530722 - DNA, 25 bp, Rattus norvegicus
ttcgtggttgatgtcaaaaccgacc

SEQ ID NO: 530723 - DNA, 25 bp, Rattus norvegicus
gtcaaaaccgaccacatcatgcgca

SEQ ID NO: 530724 - DNA, 25 bp, Rattus norvegicus
tatcatgcgtcaggccgactctcag

SEQ ID NO: 530725 - DNA, 25 bp, Rattus norvegicus
cccagcccgcttcgcgcccacgtct

SEQ ID NO: 530726 - DNA, 25 bp, Rattus norvegicus
cgcgtgaccagtttagggagatcct

SEQ ID NO: 530727 - DNA, 25 bp, Rattus norvegicus
cgtgaccagtttagggagatcctgg

SEQ ID NO: 530728 - DNA, 25 bp, Rattus norvegicus
gaccagtttagggagatcctggatg

SEQ ID NO: 530729 - DNA, 25 bp, Rattus norvegicus
cagtttagggagatcctggatggcc

SEQ ID NO: 530730 - DNA, 25 bp, Rattus norvegicus
ctggaacgaaatggggcaccgctac

SEQ ID NO: 530731 - DNA, 25 bp, Rattus norvegicus
gcccacgtctcggacaggcccagct

SEQ ID NO: 530732 - DNA, 25 bp, Rattus norvegicus
ggacaggcccagctcctacccgggc

SEQ ID NO: 530733 - DNA, 25 bp, Rattus norvegicus
ctacccgggcgtgcggcacacgttg

SEQ ID NO: 530734 - DNA, 25 bp, Rattus norvegicus
acacgttgcggcctcgcgggttcaa

SEQ ID NO: 530735 - DNA, 25 bp, Rattus norvegicus
acgttgcggcctcgcgggttcaagt

SEQ ID NO: 530736 - DNA, 25 bp, Rattus norvegicus
atggcctggaacgaaatggggcacc

SEQ ID NO: 530737 - DNA, 25 bp, Rattus norvegicus
ctcgcgtgaccagtttagggagatc

SEQ ID NO: 530738 - DNA, 25 bp, Rattus norvegicus
tcgcgggttcaagtcctgggccgcc

SEQ ID NO: 530739 - DNA, 25 bp, Rattus norvegicus
agcttcagaggttgaacagggcgct

SEQ ID NO: 530740 - DNA, 25 bp, Rattus norvegicus
attgctgctggccaagaggccccgg

SEQ ID NO: 530741 - DNA, 25 bp, Rattus norvegicus
ctcgtgggcttcgagggcgacctgc

SEQ ID NO: 530742 - DNA, 25 bp, Rattus norvegicus
gcgcctatggccacccggggctcgt

SEQ ID NO: 530743 - DNA, 25 bp, Rattus norvegicus
gaagggccgcgcactgggcgcctat

SEQ ID NO: 530744 - DNA, 25 bp, Rattus norvegicus
tcagtggtgcactacctgaagggcc

SEQ ID NO: 530745 - DNA, 25 bp, Rattus norvegicus
cgccgctcagtggtgcactacctga

SEQ ID NO: 530746 - DNA, 25 bp, Rattus norvegicus
aacggaaagcttcagaggttgaaca

SEQ ID NO: 530747 - DNA, 25 bp, Rattus norvegicus
tgaacagggcgctgggacttcttct

SEQ ID NO: 530748 - DNA, 25 bp, Rattus norvegicus
acaggccaagcggatgggccattgc

SEQ ID NO: 530749 - DNA, 25 bp, Rattus norvegicus
caggaaacggaaagcttcagaggtt

SEQ ID NO: 530750 - DNA, 25 bp, Rattus norvegicus
ggtagcaggaaacggaaagcttcag

SEQ ID NO: 530751 - DNA, 25 bp, Rattus norvegicus
gctgggacttcttcttcgcctgggc

SEQ ID NO: 530752 - DNA, 25 bp, Rattus norvegicus
gcgctgggacttcttcttcgcctgg

SEQ ID NO: 530753 - DNA, 25 bp, Rattus norvegicus
tcctcctccggccaaggaagggtca

SEQ ID NO: 530754 - DNA, 25 bp, Rattus norvegicus
gcgcttcggctacctctttaaatgt

SEQ ID NO: 530755 - DNA, 25 bp, Rattus norvegicus
ttaaatgtcgctccagtttccgccg

SEQ ID NO: 530756 - DNA, 25 bp, Rattus norvegicus
acgccgggctctgccaaaagaggac

SEQ ID NO: 530757 - DNA, 25 bp, Rattus norvegicus
ttcaagtgaggcgaccgcaaacgta

SEQ ID NO: 530758 - DNA, 25 bp, Rattus norvegicus
cccaaagcggcagaacggagagcga

SEQ ID NO: 530759 - DNA, 25 bp, Rattus norvegicus
ctcttccgagagcatcggggttgtc

SEQ ID NO: 530760 - DNA, 25 bp, Rattus norvegicus
tttccgccgacgtcaaagcggcttc

SEQ ID NO: 530761 - DNA, 25 bp, Rattus norvegicus
ggctccgctgcttcctggttcaagt

SEQ ID NO: 530762 - DNA, 25 bp, Rattus norvegicus
agaaagagcctaggagccgggcctc

SEQ ID NO: 530763 - DNA, 25 bp, Rattus norvegicus
gctcccgaacccacacaaagaaaga

SEQ ID NO: 530764 - DNA, 25 bp, Rattus norvegicus
ccacgccctaaggtctatccgaggg

SEQ ID NO: 530765 - DNA, 25 bp, Rattus norvegicus
ttgtccggaagagcccgaagcctgc

SEQ ID NO: 530766 - DNA, 25 bp, Rattus norvegicus
ggtgcctctggcactggacagtgaa

SEQ ID NO: 530767 - DNA, 25 bp, Rattus norvegicus
cggcgtttcaccttactctgccctc

SEQ ID NO: 530768 - DNA, 25 bp, Rattus norvegicus
tcttggctcgagtcccaggcgagcg

SEQ ID NO: 530769 - DNA, 25 bp, Rattus norvegicus
gccatcttggctcgagtcccaggcg

SEQ ID NO: 530770 - DNA, 25 bp, Rattus norvegicus
ggcggactctcacggcccgccatct

SEQ ID NO: 530771 - DNA, 25 bp, Rattus norvegicus
tccggacagatgtgcgagtgaaacc

SEQ ID NO: 530772 - DNA, 25 bp, Rattus norvegicus
gtgaaaccgaaagaaatcggagctg

SEQ ID NO: 530773 - DNA, 25 bp, Rattus norvegicus
agaaatctttcttctctggggcctg

SEQ ID NO: 530774 - DNA, 25 bp, Rattus norvegicus
tgtgcgagtgaaaccgaaagaaatc

SEQ ID NO: 530775 - DNA, 25 bp, Rattus norvegicus
gaggtctgccagtcgcctccggaca

SEQ ID NO: 530776 - DNA, 25 bp, Rattus norvegicus
tctttcttctctggggcctgtcctt

SEQ ID NO: 530777 - DNA, 25 bp, Rattus norvegicus
ttccacagtcgccaagaaatctttc

SEQ ID NO: 530778 - DNA, 25 bp, Rattus norvegicus
cggcgtttcacctctgcagctccct

SEQ ID NO: 530779 - DNA, 25 bp, Rattus norvegicus
cagtcgcctccggacagatgtgcga

SEQ ID NO: 530780 - DNA, 25 bp, Rattus norvegicus
gggcctgtccttcgctgtctccgag

SEQ ID NO: 530781 - DNA, 25 bp, Rattus norvegicus
gtgccgagcgaggacaggctctcac

SEQ ID NO: 530782 - DNA, 25 bp, Rattus norvegicus
cctagtccagagtcagtggctactg

SEQ ID NO: 530783 - DNA, 25 bp, Rattus norvegicus
ctcgctcaggagatggcagccggaa

SEQ ID NO: 530784 - DNA, 25 bp, Rattus norvegicus
gtccagagtcagtggctactggcca

SEQ ID NO: 530785 - DNA, 25 bp, Rattus norvegicus
tcagtggctactggccacgtggttc

SEQ ID NO: 530786 - DNA, 25 bp, Rattus norvegicus
tactggccacgtggttcgcgcagca

SEQ ID NO: 530787 - DNA, 25 bp, Rattus norvegicus
acgtggttcgcgcagcagagcaccc

SEQ ID NO: 530788 - DNA, 25 bp, Rattus norvegicus
cgggacctagtccagagtcagtggc

SEQ ID NO: 530789 - DNA, 25 bp, Rattus norvegicus
gaagacctggaagaccgtatccctg

SEQ ID NO: 530790 - DNA, 25 bp, Rattus norvegicus
gaggacaggctctcacgggctttag

SEQ ID NO: 530791 - DNA, 25 bp, Rattus norvegicus
gctctcacgggctttagggattcgg

SEQ ID NO: 530792 - DNA, 25 bp, Rattus norvegicus
cgtgcagctcgctcaggagatggca

SEQ ID NO: 530793 - DNA, 25 bp, Rattus norvegicus
actggtccgggacctagtccagagt

SEQ ID NO: 530794 - DNA, 25 bp, Rattus norvegicus
cccgcagaagacctggaagaccgta

SEQ ID NO: 530795 - DNA, 25 bp, Rattus norvegicus
gctcccggctgctggttagcctgca

SEQ ID NO: 530796 - DNA, 25 bp, Rattus norvegicus
atcgtcttcggcctcagggcaaagg

SEQ ID NO: 530797 - DNA, 25 bp, Rattus norvegicus
gcctgctttgctaggcgcggtgatt

SEQ ID NO: 530798 - DNA, 25 bp, Rattus norvegicus
gcgcggtgattcattccctcctttg

SEQ ID NO: 530799 - DNA, 25 bp, Rattus norvegicus
gtgattcattccctcctttgcccgg

SEQ ID NO: 530800 - DNA, 25 bp, Rattus norvegicus
ttcccggactgacggcgggacagac

SEQ ID NO: 530801 - DNA, 25 bp, Rattus norvegicus
gtgtgcagcgatctcgaacccgtga

SEQ ID NO: 530802 - DNA, 25 bp, Rattus norvegicus
tctcgaacccgtgagccagtaagca

SEQ ID NO: 530803 - DNA, 25 bp, Rattus norvegicus
cccgtgagccagtaagcagagcttc

SEQ ID NO: 530804 - DNA, 25 bp, Rattus norvegicus
aaggactccagcacacaccatggcg

SEQ ID NO: 530805 - DNA, 25 bp, Rattus norvegicus
gggacccgtatcgtcttcggcctca

SEQ ID NO: 530806 - DNA, 25 bp, Rattus norvegicus
accatggcggactctgagcgtctct

SEQ ID NO: 530807 - DNA, 25 bp, Rattus norvegicus
cagagcttctgcgtcccaaggactc

SEQ ID NO: 530808 - DNA, 25 bp, Rattus norvegicus
ggttagcctgcaccagcttctcgcg

SEQ ID NO: 530809 - DNA, 25 bp, Rattus norvegicus
tggagcgcgtacctgattcaccacg

SEQ ID NO: 530810 - DNA, 25 bp, Rattus norvegicus
gcaagcgccgggctctgtccacggt

SEQ ID NO: 530811 - DNA, 25 bp, Rattus norvegicus
gtcttttgcgtgagcgcctgcgcac

SEQ ID NO: 530812 - DNA, 25 bp, Rattus norvegicus
ccctgtctgtcttttgcgtgagcgc

SEQ ID NO: 530813 - DNA, 25 bp, Rattus norvegicus
gcaccctgtctgtcttttgcgtgag

SEQ ID NO: 530814 - DNA, 25 bp, Rattus norvegicus
tcggaacagcccagtcggcggcagc

SEQ ID NO: 530815 - DNA, 25 bp, Rattus norvegicus
cgatcgtcggaacagcccagtcggc

SEQ ID NO: 530816 - DNA, 25 bp, Rattus norvegicus
ggtgcgcgatcgtcggaacagccca

SEQ ID NO: 530817 - DNA, 25 bp, Rattus norvegicus
acgtccatgtctgccagcagcagca

SEQ ID NO: 530818 - DNA, 25 bp, Rattus norvegicus
gattcaccacgtccatgtctgccag

SEQ ID NO: 530819 - DNA, 25 bp, Rattus norvegicus
acctgattcaccacgtccatgtctg

SEQ ID NO: 530820 - DNA, 25 bp, Rattus norvegicus
ctctgtccacggtgctggagcgcgt

SEQ ID NO: 530821 - DNA, 25 bp, Rattus norvegicus
gcgtgagcgcctgcgcaccatggct

SEQ ID NO: 530822 - DNA, 25 bp, Rattus norvegicus
gcgtacctgattcaccacgtccatg

SEQ ID NO: 530823 - DNA, 25 bp, Rattus norvegicus
ccacgctcgggcgtcttcattggtt

SEQ ID NO: 530824 - DNA, 25 bp, Rattus norvegicus
tcgggcgtcttcattggttgctagc

SEQ ID NO: 530825 - DNA, 25 bp, Rattus norvegicus
cgtcttcattggttgctagcttctc

SEQ ID NO: 530826 - DNA, 25 bp, Rattus norvegicus
gtacctgtctttatctcaccgccta

SEQ ID NO: 530827 - DNA, 25 bp, Rattus norvegicus
tgatcatcccgcctcccacaccgcc

SEQ ID NO: 530828 - DNA, 25 bp, Rattus norvegicus
gttggctgtacctgtctttatctca

SEQ ID NO: 530829 - DNA, 25 bp, Rattus norvegicus
gcttgtcagtcaccttacgtcactc

SEQ ID NO: 530830 - DNA, 25 bp, Rattus norvegicus
gtcactcccgcgtggctgtccattg

SEQ ID NO: 530831 - DNA, 25 bp, Rattus norvegicus
gctgcccgccttttcaggccctgcc

SEQ ID NO: 530832 - DNA, 25 bp, Rattus norvegicus
ctggcgttttcattggctgcccgcc

SEQ ID NO: 530833 - DNA, 25 bp, Rattus norvegicus
tctcaccgcctacgctccactggag

SEQ ID NO: 530834 - DNA, 25 bp, Rattus norvegicus
ctgtccattggttgttggctgtacc

SEQ ID NO: 530835 - DNA, 25 bp, Rattus norvegicus
gctagcttctcctgcttgtcagtca

SEQ ID NO: 530836 - DNA, 25 bp, Rattus norvegicus
tggttgctagcttctcctgcttgtc

SEQ ID NO: 530837 - DNA, 25 bp, Rattus norvegicus
ttctagactagacaaccgttcggcc

SEQ ID NO: 530838 - DNA, 25 bp, Rattus norvegicus
gtagggctatttaaccgcctcagaa

SEQ ID NO: 530839 - DNA, 25 bp, Rattus norvegicus
gctcccgcctttattctcaaatatc

SEQ ID NO: 530840 - DNA, 25 bp, Rattus norvegicus
tcgtcctgtgtagggctatttaacc

SEQ ID NO: 530841 - DNA, 25 bp, Rattus norvegicus
ccgcctcagaaacgtttctagacta

SEQ ID NO: 530842 - DNA, 25 bp, Rattus norvegicus
cctcacaggctaggggaagctgccc

SEQ ID NO: 530843 - DNA, 25 bp, Rattus norvegicus
ctggaacgatggatgtcagagctcc

SEQ ID NO: 530844 - DNA, 25 bp, Rattus norvegicus
ccctcgagggcagtactagagggga

SEQ ID NO: 530845 - DNA, 25 bp, Rattus norvegicus
tcagagcagcgattggagctgagct

SEQ ID NO: 530846 - DNA, 25 bp, Rattus norvegicus
gcgccttaaagagactgcgcggtcc

SEQ ID NO: 530847 - DNA, 25 bp, Rattus norvegicus
ggagctgagctggaagcgccttaaa

SEQ ID NO: 530848 - DNA, 25 bp, Rattus norvegicus
gctggaagcgccttaaagagactgc

SEQ ID NO: 530849 - DNA, 25 bp, Rattus norvegicus
tctcaaatatcgtcctgtgtagggc

SEQ ID NO: 530850 - DNA, 25 bp, Rattus norvegicus
cagagctcccgcctttattctcaaa

SEQ ID NO: 530851 - DNA, 25 bp, Rattus norvegicus
aagagcgctcgtctgccaccgcggt

SEQ ID NO: 530852 - DNA, 25 bp, Rattus norvegicus
tggacaggctggttcctgccagagc

SEQ ID NO: 530853 - DNA, 25 bp, Rattus norvegicus
ccaggctgccgatcgaagtttcctt

SEQ ID NO: 530854 - DNA, 25 bp, Rattus norvegicus
agtttccttgccaagcggcgccaag

SEQ ID NO: 530855 - DNA, 25 bp, Rattus norvegicus
caagcccgcccagctttgaaagctg

SEQ ID NO: 530856 - DNA, 25 bp, Rattus norvegicus
gtcgcttctccagaagacagggctg

SEQ ID NO: 530857 - DNA, 25 bp, Rattus norvegicus
gtacaacgagcagggaagagcgctc

SEQ ID NO: 530858 - DNA, 25 bp, Rattus norvegicus
cgcatgcgcagactccgtcttggca

SEQ ID NO: 530859 - DNA, 25 bp, Rattus norvegicus
ccgtcttggcagagctaatactcca

SEQ ID NO: 530860 - DNA, 25 bp, Rattus norvegicus
actccaaggcgcctgtcacatgagc

SEQ ID NO: 530861 - DNA, 25 bp, Rattus norvegicus
ctcctcccggctgggctgtgtgaat

SEQ ID NO: 530862 - DNA, 25 bp, Rattus norvegicus
tgtgtgaatgaagctccgccggcta

SEQ ID NO: 530863 - DNA, 25 bp, Rattus norvegicus
cagcagcttcttggccgcgttttcc

SEQ ID NO: 530864 - DNA, 25 bp, Rattus norvegicus
cgctagctctactcgccgtgtggaa

SEQ ID NO: 530865 - DNA, 25 bp, Rattus norvegicus
ggcctgtacaggatctaaactagta

SEQ ID NO: 530866 - DNA, 25 bp, Rattus norvegicus
tcaccgtcacgtgtgatgctgcgca

SEQ ID NO: 530867 - DNA, 25 bp, Rattus norvegicus
agctgacctggtgctgccgcaagct

SEQ ID NO: 530868 - DNA, 25 bp, Rattus norvegicus
cacacggttcatgcctcgcagctga

SEQ ID NO: 530869 - DNA, 25 bp, Rattus norvegicus
caagctcggcgacgaaggcctgcca

SEQ ID NO: 530870 - DNA, 25 bp, Rattus norvegicus
gcgcccgtgatacttggcccgtatc

SEQ ID NO: 530871 - DNA, 25 bp, Rattus norvegicus
actggctatagagagtggtcgactg

SEQ ID NO: 530872 - DNA, 25 bp, Rattus norvegicus
ggctacactgtcgttggaccgctgg

SEQ ID NO: 530873 - DNA, 25 bp, Rattus norvegicus
acactcggacccacgactggctata

SEQ ID NO: 530874 - DNA, 25 bp, Rattus norvegicus
aatccctgctcccatagcttcgagg

SEQ ID NO: 530875 - DNA, 25 bp, Rattus norvegicus
cagcggctgaagagcctgaggtcac

SEQ ID NO: 530876 - DNA, 25 bp, Rattus norvegicus
caggtccgttcgttcggcctgtaca

SEQ ID NO: 530877 - DNA, 25 bp, Rattus norvegicus
ttttgcactgacagcgcgagctctc

SEQ ID NO: 530878 - DNA, 25 bp, Rattus norvegicus
acatcccggggattttgcactgaca

SEQ ID NO: 530879 - DNA, 25 bp, Rattus norvegicus
agaccagcttcctgcctgcaaagca

SEQ ID NO: 530880 - DNA, 25 bp, Rattus norvegicus
ggcttcagcgataattgttccctcc

SEQ ID NO: 530881 - DNA, 25 bp, Rattus norvegicus
ggagatacagccaaaggcttcagcg

SEQ ID NO: 530882 - DNA, 25 bp, Rattus norvegicus
aaagtgacccttgctggtgtcccgg

SEQ ID NO: 530883 - DNA, 25 bp, Rattus norvegicus
ggctcctctgccacctggagataca

SEQ ID NO: 530884 - DNA, 25 bp, Rattus norvegicus
tctgcttagttctcctgaaggaggc

SEQ ID NO: 530885 - DNA, 25 bp, Rattus norvegicus
cggcccttctgcttagttctcctga

SEQ ID NO: 530886 - DNA, 25 bp, Rattus norvegicus
ctcgccggtctttctgctttggtca

SEQ ID NO: 530887 - DNA, 25 bp, Rattus norvegicus
gccggctgccttcaagagttgtctg

SEQ ID NO: 530888 - DNA, 25 bp, Rattus norvegicus
aagggaggatctgccggctgccttc

SEQ ID NO: 530889 - DNA, 25 bp, Rattus norvegicus
agtgctcaccaaagctgagaaggga

SEQ ID NO: 530890 - DNA, 25 bp, Rattus norvegicus
aggcgtccaacctaagaagtgctca

SEQ ID NO: 530891 - DNA, 25 bp, Rattus norvegicus
gagggacaggcaaagtgacccttgc

SEQ ID NO: 530892 - DNA, 25 bp, Rattus norvegicus
tttctgctttggtcacgcggtgtcc

SEQ ID NO: 530893 - DNA, 25 bp, Rattus norvegicus
ttggccaccggggtcagtcgactct

SEQ ID NO: 530894 - DNA, 25 bp, Rattus norvegicus
agcaacggtcatttctcctgtgttg

SEQ ID NO: 530895 - DNA, 25 bp, Rattus norvegicus
acggtcatttctcctgtgttggcca

SEQ ID NO: 530896 - DNA, 25 bp, Rattus norvegicus
tcatttctcctgtgttggccaccgg

SEQ ID NO: 530897 - DNA, 25 bp, Rattus norvegicus
atttctcctgtgttggccaccgggg

SEQ ID NO: 530898 - DNA, 25 bp, Rattus norvegicus
tcctgtgttggccaccggggtcagt

SEQ ID NO: 530899 - DNA, 25 bp, Rattus norvegicus
actagcaacggtcatttctcctgtg

SEQ ID NO: 530900 - DNA, 25 bp, Rattus norvegicus
ccaccggggtcagtcgactcttggc

SEQ ID NO: 530901 - DNA, 25 bp, Rattus norvegicus
ggtcagtcgactcttggcggcagca

SEQ ID NO: 530902 - DNA, 25 bp, Rattus norvegicus
cagtcgactcttggcggcagcaggc

SEQ ID NO: 530903 - DNA, 25 bp, Rattus norvegicus
gcccagaacactagcaacggtcatt

SEQ ID NO: 530904 - DNA, 25 bp, Rattus norvegicus
agcgcccagaacactagcaacggtc

SEQ ID NO: 530905 - DNA, 25 bp, Rattus norvegicus
gcgagcgcccagaacactagcaacg

SEQ ID NO: 530906 - DNA, 25 bp, Rattus norvegicus
ccagaacactagcaacggtcatttc

SEQ ID NO: 530907 - DNA, 25 bp, Rattus norvegicus
tgcagagcccatcattggaggaggt

SEQ ID NO: 530908 - DNA, 25 bp, Rattus norvegicus
ggtcccttcgcctggccatctggcc

SEQ ID NO: 530909 - DNA, 25 bp, Rattus norvegicus
cgccttgtggctgcccagggccagc

SEQ ID NO: 530910 - DNA, 25 bp, Rattus norvegicus
ccagggccagcctgcggacccactg

SEQ ID NO: 530911 - DNA, 25 bp, Rattus norvegicus
cctgcggacccactgctcaggcgcg

SEQ ID NO: 530912 - DNA, 25 bp, Rattus norvegicus
ggagcccgcctttggaggaggtgca

SEQ ID NO: 530913 - DNA, 25 bp, Rattus norvegicus
agcccatcattggaggaggtgccac

SEQ ID NO: 530914 - DNA, 25 bp, Rattus norvegicus
aggtgcagagcccatcattggagga

SEQ ID NO: 530915 - DNA, 25 bp, Rattus norvegicus
tcattggaggaggtgccactgcgca

SEQ ID NO: 530916 - DNA, 25 bp, Rattus norvegicus
catcattggaggaggtgccactgcg

SEQ ID NO: 530917 - DNA, 25 bp, Rattus norvegicus
cccatcattggaggaggtgccactg

SEQ ID NO: 530918 - DNA, 25 bp, Rattus norvegicus
cagagcccatcattggaggaggtgc

SEQ ID NO: 530919 - DNA, 25 bp, Rattus norvegicus
gccactgcgcaggtcctcagtgcca

SEQ ID NO: 530920 - DNA, 25 bp, Rattus norvegicus
aggaggtgcagagcccatcattgga

SEQ ID NO: 530921 - DNA, 25 bp, Rattus norvegicus
tcagaagaggcagatggaaaacgaa

SEQ ID NO: 530922 - DNA, 25 bp, Rattus norvegicus
gaaacgacgaacaggagaagagctg

SEQ ID NO: 530923 - DNA, 25 bp, Rattus norvegicus
cgaacaggagaagagctggtcagaa

SEQ ID NO: 530924 - DNA, 25 bp, Rattus norvegicus
agaggcagatggaaaacgaaacgac

SEQ ID NO: 530925 - DNA, 25 bp, Rattus norvegicus
cagatggaaaacgaaacgacgaaca

SEQ ID NO: 530926 - DNA, 25 bp, Rattus norvegicus
acgaaacgacgaacaggagaagagc

SEQ ID NO: 530927 - DNA, 25 bp, Rattus norvegicus
acgacgaacaggagaagagctggtc

SEQ ID NO: 530928 - DNA, 25 bp, Rattus norvegicus
aacaggagaagagctggtcagaaga

SEQ ID NO: 530929 - DNA, 25 bp, Rattus norvegicus
gaggcagatggaaaacgaaacgacg

SEQ ID NO: 530930 - DNA, 25 bp, Rattus norvegicus
agatggaaaacgaaacgacgaacag

SEQ ID NO: 530931 - DNA, 25 bp, Rattus norvegicus
cgacgaacaggagaagagctggtca

SEQ ID NO: 530932 - DNA, 25 bp, Rattus norvegicus
aagaggcagatggaaaacgaaacga

SEQ ID NO: 530933 - DNA, 25 bp, Rattus norvegicus
agaagagctggtcagaagaggcaga

SEQ ID NO: 530934 - DNA, 25 bp, Rattus norvegicus
ctggtcagaagaggcagatggaaaa

SEQ ID NO: 530935 - DNA, 25 bp, Rattus norvegicus
tccaagtctgagttgctccgggatc

SEQ ID NO: 530936 - DNA, 25 bp, Rattus norvegicus
ttgaggatcagctcgccagactgcg

SEQ ID NO: 530937 - DNA, 25 bp, Rattus norvegicus
cgggatctcaatctcggagcctttg

SEQ ID NO: 530938 - DNA, 25 bp, Rattus norvegicus
tggtggtcaccaaggcttatcgctg

SEQ ID NO: 530939 - DNA, 25 bp, Rattus norvegicus
atcctggctcctgggcttcttgaga

SEQ ID NO: 530940 - DNA, 25 bp, Rattus norvegicus
gtcgagttgcgaccaccaaagtaga

SEQ ID NO: 530941 - DNA, 25 bp, Rattus norvegicus
ggtgggcaacagttcaaacttcttc

SEQ ID NO: 530942 - DNA, 25 bp, Rattus norvegicus
cctttggcctgagaacgcatttgag

SEQ ID NO: 530943 - DNA, 25 bp, Rattus norvegicus
cgggttactccataggtcggcctca

SEQ ID NO: 530944 - DNA, 25 bp, Rattus norvegicus
gccgctgagtcctttcaggccgaaa

SEQ ID NO: 530945 - DNA, 25 bp, Rattus norvegicus
cttttcccgagaggagaagccgctc

SEQ ID NO: 530946 - DNA, 25 bp, Rattus norvegicus
ggctacaggcatagactcgcgttta

SEQ ID NO: 530947 - DNA, 25 bp, Rattus norvegicus
gcgttgacgctccatcctgttgtgg

SEQ ID NO: 530948 - DNA, 25 bp, Rattus norvegicus
gccgcatagttgtgttgttcctgaa

SEQ ID NO: 530949 - DNA, 25 bp, Rattus norvegicus
aagactcggtcagcatcggcaggaa

SEQ ID NO: 530950 - DNA, 25 bp, Rattus norvegicus
ttcgagcagaaccaggaccgcaagc

SEQ ID NO: 530951 - DNA, 25 bp, Rattus norvegicus
gccacaagcccgtgcatgccgagta

SEQ ID NO: 530952 - DNA, 25 bp, Rattus norvegicus
atcaaggtcctgcagtgccacaagc

SEQ ID NO: 530953 - DNA, 25 bp, Rattus norvegicus
tggttcaagatcgaagatgccatca

SEQ ID NO: 530954 - DNA, 25 bp, Rattus norvegicus
gccagagagcgagccctagtatgta

SEQ ID NO: 530955 - DNA, 25 bp, Rattus norvegicus
catgccgagtacctggagaaactga

SEQ ID NO: 530956 - DNA, 25 bp, Rattus norvegicus
cttgctgggcgtcttcgagcagaac

SEQ ID NO: 530957 - DNA, 25 bp, Rattus norvegicus
gcaagccgaaccagacgcggaccta

SEQ ID NO: 530958 - DNA, 25 bp, Rattus norvegicus
ctgaggatgaagtgcaagccgaacc

SEQ ID NO: 530959 - DNA, 25 bp, Rattus norvegicus
ctaggcagctgcaagcgacctcaga

SEQ ID NO: 530960 - DNA, 25 bp, Rattus norvegicus
tagtatgtaccgctgccgcccggac

SEQ ID NO: 530961 - DNA, 25 bp, Rattus norvegicus
acgtgttcgtgctcaccgtcaccga

SEQ ID NO: 530962 - DNA, 25 bp, Rattus norvegicus
caagcaccggacctacgtgttcgtg

SEQ ID NO: 530963 - DNA, 25 bp, Rattus norvegicus
ccagccgctgaggtgtcactgcaga

SEQ ID NO: 530964 - DNA, 25 bp, Rattus norvegicus
caacgggagcttcaccttgaaacga

SEQ ID NO: 530965 - DNA, 25 bp, Rattus norvegicus
tgcagactgcgagaaccgaagcaac

SEQ ID NO: 530966 - DNA, 25 bp, Rattus norvegicus
acttcgacgccctggaaagcgctgc

SEQ ID NO: 530967 - DNA, 25 bp, Rattus norvegicus
tgcagactgcgagaaccgaagaagc

SEQ ID NO: 530968 - DNA, 25 bp, Rattus norvegicus
ccaagtcaacttccaggccctggaa

SEQ ID NO: 530969 - DNA, 25 bp, Rattus norvegicus
tgaggtgtcactgcagactgcgaga

SEQ ID NO: 530970 - DNA, 25 bp, Rattus norvegicus
cccaagtcaacttcgaggccctgga

SEQ ID NO: 530971 - DNA, 25 bp, Rattus norvegicus
caagtcaacttcgaggccctggaaa

SEQ ID NO: 530972 - DNA, 25 bp, Rattus norvegicus
gcgagaaccgaagcaacgggagctt

SEQ ID NO: 530973 - DNA, 25 bp, Rattus norvegicus
aacttcgacgccctggaaagcgctg

SEQ ID NO: 530974 - DNA, 25 bp, Rattus norvegicus
actgcagactgcgagaaccgaagaa

SEQ ID NO: 530975 - DNA, 25 bp, Rattus norvegicus
agccgctgaggtgtcactgcagact

SEQ ID NO: 530976 - DNA, 25 bp, Rattus norvegicus
acgggagcttcaccttgaaacgaga

SEQ ID NO: 530977 - DNA, 25 bp, Rattus norvegicus
cttccggcgcttgcgctgcgtgcag

SEQ ID NO: 530978 - DNA, 25 bp, Rattus norvegicus
cctttctgcagaatccgcagctgta

SEQ ID NO: 530979 - DNA, 25 bp, Rattus norvegicus
tgcagaatccgcagctgtaaccctg

SEQ ID NO: 530980 - DNA, 25 bp, Rattus norvegicus
tccgcagctgtaaccctgcactagg

SEQ ID NO: 530981 - DNA, 25 bp, Rattus norvegicus
gtaaccctgcactagggaggctgca

SEQ ID NO: 530982 - DNA, 25 bp, Rattus norvegicus
cccggacacgaagctttccgcagga

SEQ ID NO: 530983 - DNA, 25 bp, Rattus norvegicus
ttccgcaggaacttggctttagagc

SEQ ID NO: 530984 - DNA, 25 bp, Rattus norvegicus
gctttagagcctttagggccgaggc

SEQ ID NO: 530985 - DNA, 25 bp, Rattus norvegicus
tgggtcattggcaaaggcaagtagc

SEQ ID NO: 530986 - DNA, 25 bp, Rattus norvegicus
tcccttatgttacggggcttgattc

SEQ ID NO: 530987 - DNA, 25 bp, Rattus norvegicus
atcacggcttcccttatgttacggg

SEQ ID NO: 530988 - DNA, 25 bp, Rattus norvegicus
tagcgcaaggagcaatgcatccgcg

SEQ ID NO: 530989 - DNA, 25 bp, Rattus norvegicus
caagtagcgcaaggagcaatgcatc

SEQ ID NO: 530990 - DNA, 25 bp, Rattus norvegicus
gttacggggcttgattccgcagctt

SEQ ID NO: 530991 - DNA, 25 bp, Rattus norvegicus
catgcacgggcttgtggcactgcag

SEQ ID NO: 530992 - DNA, 25 bp, Rattus norvegicus
actgcaggaccttgatggcatcttc

SEQ ID NO: 530993 - DNA, 25 bp, Rattus norvegicus
tacatactagggctcgctctctggc

SEQ ID NO: 530994 - DNA, 25 bp, Rattus norvegicus
caatcctccagcagctcggtgacgg

SEQ ID NO: 530995 - DNA, 25 bp, Rattus norvegicus
gctcggtgacggtgagcacgaacac

SEQ ID NO: 530996 - DNA, 25 bp, Rattus norvegicus
cacgaacacgtaggtccggtgcttg

SEQ ID NO: 530997 - DNA, 25 bp, Rattus norvegicus
gtcctggttctgctcgaagacgccc

SEQ ID NO: 530998 - DNA, 25 bp, Rattus norvegicus
ggttcggcttgcacttcatcctcag

SEQ ID NO: 530999 - DNA, 25 bp, Rattus norvegicus
tgccgcctctgaggtcgcttgcagc

SEQ ID NO: 531000 - DNA, 25 bp, Rattus norvegicus
cttgcagctgcctagcgagctggcc

SEQ ID NO: 531001 - DNA, 25 bp, Rattus norvegicus
tgccgatgctgaccgagtcttccca

SEQ ID NO: 531002 - DNA, 25 bp, Rattus norvegicus
tggcatcttcgatcttgaaccactc

SEQ ID NO: 531003 - DNA, 25 bp, Rattus norvegicus
ttcccattagtaggggagccgccca

SEQ ID NO: 531004 - DNA, 25 bp, Rattus norvegicus
tttctccaggtactcggcatgcacg

SEQ ID NO: 531005 - DNA, 25 bp, Rattus norvegicus
ccaactttgaatgggctagcgggtg

SEQ ID NO: 531006 - DNA, 25 bp, Rattus norvegicus
actcacctcagtgtgggctgcagga

SEQ ID NO: 531007 - DNA, 25 bp, Rattus norvegicus
cggacgcacacacgctctttcagag

SEQ ID NO: 531008 - DNA, 25 bp, Rattus norvegicus
tgaggcatcgctggctttccgcagc

SEQ ID NO: 531009 - DNA, 25 bp, Rattus norvegicus
cgctctttcagagctggggcgttgc

SEQ ID NO: 531010 - DNA, 25 bp, Rattus norvegicus
tgcagtcacactcacggggcaccgg

SEQ ID NO: 531011 - DNA, 25 bp, Rattus norvegicus
cgcaggagctttgcgtgcagtcaca

SEQ ID NO: 531012 - DNA, 25 bp, Rattus norvegicus
ccactttgcgacttggccggccgga

SEQ ID NO: 531013 - DNA, 25 bp, Rattus norvegicus
ccgcgccagcgagatttcttgcacg

SEQ ID NO: 531014 - DNA, 25 bp, Rattus norvegicus
ctcacggcgtccaactttgaatggg

SEQ ID NO: 531015 - DNA, 25 bp, Rattus norvegicus
agccgctcacggtgtcgaaggtaag

SEQ ID NO: 531016 - DNA, 25 bp, Rattus norvegicus
gcttggagcactgcgagccgctcac

SEQ ID NO: 531017 - DNA, 25 bp, Rattus norvegicus
gtccttccagtacgtcccggtgcag

SEQ ID NO: 531018 - DNA, 25 bp, Rattus norvegicus
cccagccgagccgaggatggagaac

SEQ ID NO: 531019 - DNA, 25 bp, Rattus norvegicus
atcgctaggcttccgcgttccgggc

SEQ ID NO: 531020 - DNA, 25 bp, Rattus norvegicus
gacgcgagactccatttcccacaat

SEQ ID NO: 531021 - DNA, 25 bp, Rattus norvegicus
atcctctctgtacttccggtgtggc

SEQ ID NO: 531022 - DNA, 25 bp, Rattus norvegicus
cccagtagcgggatcgctaggcttc

SEQ ID NO: 531023 - DNA, 25 bp, Rattus norvegicus
taggcttccgcgttccgggcctgtc

SEQ ID NO: 531024 - DNA, 25 bp, Rattus norvegicus
actcgggctacaggagtagggctcc

SEQ ID NO: 531025 - DNA, 25 bp, Rattus norvegicus
cgtagcgccgcctttcggcagaagc

SEQ ID NO: 531026 - DNA, 25 bp, Rattus norvegicus
cctttcggcagaagctggtcagcca

SEQ ID NO: 531027 - DNA, 25 bp, Rattus norvegicus
gcagaagctggtcagccaaatgtga

SEQ ID NO: 531028 - DNA, 25 bp, Rattus norvegicus
ggccgagttagaccggctgttgacc

SEQ ID NO: 531029 - DNA, 25 bp, Rattus norvegicus
gctgttgaccctggcgagaacctgc

SEQ ID NO: 531030 - DNA, 25 bp, Rattus norvegicus
agaacctgcggcgtccgctaggcgc

SEQ ID NO: 531031 - DNA, 25 bp, Rattus norvegicus
gcatgcgtatacagacgcgagactc

SEQ ID NO: 531032 - DNA, 25 bp, Rattus norvegicus
ctgtacttccggtgtggcccagtag

SEQ ID NO: 531033 - DNA, 25 bp, Rattus norvegicus
gcctcgatagaaactcgccctctta

SEQ ID NO: 531034 - DNA, 25 bp, Rattus norvegicus
tcctgtgccacccagcgtgcgagct

SEQ ID NO: 531035 - DNA, 25 bp, Rattus norvegicus
ttcgaagccgccctacgtccctgtc

SEQ ID NO: 531036 - DNA, 25 bp, Rattus norvegicus
tggcagcccacgtctcttcgaagcc

SEQ ID NO: 531037 - DNA, 25 bp, Rattus norvegicus
gcactctgggcattccctggcagcc

SEQ ID NO: 531038 - DNA, 25 bp, Rattus norvegicus
cctgtcagcccgcactctgggcatt

SEQ ID NO: 531039 - DNA, 25 bp, Rattus norvegicus
tcgatagaaactcgccctcttaatt

SEQ ID NO: 531040 - DNA, 25 bp, Rattus norvegicus
tgggctcctgctcgcacttctctga

SEQ ID NO: 531041 - DNA, 25 bp, Rattus norvegicus
tgctcgcacttctctgatcttcatc

SEQ ID NO: 531042 - DNA, 25 bp, Rattus norvegicus
tggaaacagctgtgcccactgccct

SEQ ID NO: 531043 - DNA, 25 bp, Rattus norvegicus
cggggtggaaacagctgtgcccact

SEQ ID NO: 531044 - DNA, 25 bp, Rattus norvegicus
ctccgcgctcctgcgcgaggatcgc

SEQ ID NO: 531045 - DNA, 25 bp, Rattus norvegicus
acttctctgatcttcatcctgtgcc

SEQ ID NO: 531046 - DNA, 25 bp, Rattus norvegicus
agcctcggatcgctgggctcctgct

SEQ ID NO: 531047 - DNA, 25 bp, Rattus norvegicus
ctcgggagtagagcctcggactcca

SEQ ID NO: 531048 - DNA, 25 bp, Rattus norvegicus
gtagagcctcggactccagaagaaa

SEQ ID NO: 531049 - DNA, 25 bp, Rattus norvegicus
ccagaagaaattttcttcgatctcc

SEQ ID NO: 531050 - DNA, 25 bp, Rattus norvegicus
agtataaggcgcgttcctgctgagg

SEQ ID NO: 531051 - DNA, 25 bp, Rattus norvegicus
ataaggcgcgttcctgctgaggttc

SEQ ID NO: 531052 - DNA, 25 bp, Rattus norvegicus
cgggagatgctctcaccaggaccca

SEQ ID NO: 531053 - DNA, 25 bp, Rattus norvegicus
gaggttccgggagatgctctcacca

SEQ ID NO: 531054 - DNA, 25 bp, Rattus norvegicus
tcgctcgggagtagagcctcggact

SEQ ID NO: 531055 - DNA, 25 bp, Rattus norvegicus
gcacttacgtaaaagtcgcagagtc

SEQ ID NO: 531056 - DNA, 25 bp, Rattus norvegicus
cgttcctgctgaggttccgggagat

SEQ ID NO: 531057 - DNA, 25 bp, Rattus norvegicus
ctcggagctgcaaagcacttacgta

SEQ ID NO: 531058 - DNA, 25 bp, Rattus norvegicus
cctcggagctgcaaagcacttacgt

SEQ ID NO: 531059 - DNA, 25 bp, Rattus norvegicus
ggagatgctctcaccaggacccact

SEQ ID NO: 531060 - DNA, 25 bp, Rattus norvegicus
gttccgggagatgctctcaccagga

SEQ ID NO: 531061 - DNA, 25 bp, Rattus norvegicus
aggctgcaaccatccgggacctgtc

SEQ ID NO: 531062 - DNA, 25 bp, Rattus norvegicus
ttctaagcggacgaagaccaccacc

SEQ ID NO: 531063 - DNA, 25 bp, Rattus norvegicus
ctctagcatagtaactgacacctcc

SEQ ID NO: 531064 - DNA, 25 bp, Rattus norvegicus
ggctggggattgtttcactacccta

SEQ ID NO: 531065 - DNA, 25 bp, Rattus norvegicus
aagtcgacctcctgtgggcaacctg

SEQ ID NO: 531066 - DNA, 25 bp, Rattus norvegicus
gcaaccttgcgtctcagcagacgga

SEQ ID NO: 531067 - DNA, 25 bp, Rattus norvegicus
aaacggactcggctgcaatcgccca

SEQ ID NO: 531068 - DNA, 25 bp, Rattus norvegicus
cggcagctagacgagaaacggactc

SEQ ID NO: 531069 - DNA, 25 bp, Rattus norvegicus
ggggctccaacttaccgctagcgtc

SEQ ID NO: 531070 - DNA, 25 bp, Rattus norvegicus
cgacgccgacgacaatcgatgtgca

SEQ ID NO: 531071 - DNA, 25 bp, Rattus norvegicus
cctccgcccaaatctttaaggtctg

SEQ ID NO: 531072 - DNA, 25 bp, Rattus norvegicus
gagcgctctgagtcgcttctcacca

SEQ ID NO: 531073 - DNA, 25 bp, Rattus norvegicus
accagtgcggtcctccaggctgcaa

SEQ ID NO: 531074 - DNA, 25 bp, Rattus norvegicus
ttaaggtctgcgctagcaatgtcgc

SEQ ID NO: 531075 - DNA, 25 bp, Rattus norvegicus
tcctccaatgatgggctctgcacct

SEQ ID NO: 531076 - DNA, 25 bp, Rattus norvegicus
agatggccaggcgaagggaccccca

SEQ ID NO: 531077 - DNA, 25 bp, Rattus norvegicus
tggcacctcctccaatgatgggctc

SEQ ID NO: 531078 - DNA, 25 bp, Rattus norvegicus
gctggccctgggcagccacaaggcg

SEQ ID NO: 531079 - DNA, 25 bp, Rattus norvegicus
cccgcgcctgagcagtgggtccgca

SEQ ID NO: 531080 - DNA, 25 bp, Rattus norvegicus
tgcacctcctccaaaggcgggctcc

SEQ ID NO: 531081 - DNA, 25 bp, Rattus norvegicus
tccaatgatgggctctgcacctcct

SEQ ID NO: 531082 - DNA, 25 bp, Rattus norvegicus
acctcctccaatgatgggctctgca

SEQ ID NO: 531083 - DNA, 25 bp, Rattus norvegicus
gcacctcctccaatgatgggctctg

SEQ ID NO: 531084 - DNA, 25 bp, Rattus norvegicus
tggcactgaggacctgcgcagtggc

SEQ ID NO: 531085 - DNA, 25 bp, Rattus norvegicus
tgcgcagtggcacctcctccaatga

SEQ ID NO: 531086 - DNA, 25 bp, Rattus norvegicus
cgcagtggcacctcctccaatgatg

SEQ ID NO: 531087 - DNA, 25 bp, Rattus norvegicus
gcagtggcacctcctccaatgatgg

SEQ ID NO: 531088 - DNA, 25 bp, Rattus norvegicus
agtggcacctcctccaatgatgggc

SEQ ID NO: 531089 - DNA, 25 bp, Rattus norvegicus
tgaaggccgcctgacctcctggggc

SEQ ID NO: 531090 - DNA, 25 bp, Rattus norvegicus
actggagagcctgcgcgttatccca

SEQ ID NO: 531091 - DNA, 25 bp, Rattus norvegicus
ttcgccagagtccagcgggcctcca

SEQ ID NO: 531092 - DNA, 25 bp, Rattus norvegicus
atcacggagtagagtccgccgcgtg

SEQ ID NO: 531093 - DNA, 25 bp, Rattus norvegicus
caattgtttgaaagttccccgcctg

SEQ ID NO: 531094 - DNA, 25 bp, Rattus norvegicus
gcagatcaattgtttgaaagttccc

SEQ ID NO: 531095 - DNA, 25 bp, Rattus norvegicus
gccaacgtagcagatcaattgtttg

SEQ ID NO: 531096 - DNA, 25 bp, Rattus norvegicus
cttagccaacgtagcagatcaattg

SEQ ID NO: 531097 - DNA, 25 bp, Rattus norvegicus
gactcctgatcttagccaacgtagc

SEQ ID NO: 531098 - DNA, 25 bp, Rattus norvegicus
gttatcccagatctctcccagactc

SEQ ID NO: 531099 - DNA, 25 bp, Rattus norvegicus
taccatcacggagtagagtccgccg

SEQ ID NO: 531100 - DNA, 25 bp, Rattus norvegicus
gagagcctgcgcgttatcccagatc

SEQ ID NO: 531101 - DNA, 25 bp, Rattus norvegicus
ggaactaccatcacggagtagagtc

SEQ ID NO: 531102 - DNA, 25 bp, Rattus norvegicus
agcctgcgcgttatcccagatctct

SEQ ID NO: 531103 - DNA, 25 bp, Rattus norvegicus
gccagaggcgctcctgtacccgctc

SEQ ID NO: 531104 - DNA, 25 bp, Rattus norvegicus
aggctgccccgtcctcctgcttgcc

SEQ ID NO: 531105 - DNA, 25 bp, Rattus norvegicus
accgagctacagagcaggagcggct

SEQ ID NO: 531106 - DNA, 25 bp, Rattus norvegicus
caccgagctacagagcaggagcggc

SEQ ID NO: 531107 - DNA, 25 bp, Rattus norvegicus
gccaccgagctacagagcaggagcg

SEQ ID NO: 531108 - DNA, 25 bp, Rattus norvegicus
tggccaccgagctacagagcaggag

SEQ ID NO: 531109 - DNA, 25 bp, Rattus norvegicus
ctggccaccgagctacagagcagga

SEQ ID NO: 531110 - DNA, 25 bp, Rattus norvegicus
tgcggcttctttccacccctggcca

SEQ ID NO: 531111 - DNA, 25 bp, Rattus norvegicus
ccgcccgcctctgccgtgaggcgac

SEQ ID NO: 531112 - DNA, 25 bp, Rattus norvegicus
tgcggcttgcggcttctttccaccc

SEQ ID NO: 531113 - DNA, 25 bp, Rattus norvegicus
tctctgccaccacccaggggagggg

SEQ ID NO: 531114 - DNA, 25 bp, Rattus norvegicus
ggtctctgccaccacccaggggagg

SEQ ID NO: 531115 - DNA, 25 bp, Rattus norvegicus
gggtctctgccaccacccaggggag

SEQ ID NO: 531116 - DNA, 25 bp, Rattus norvegicus
cagaggcgctcctgtacccgctccc

SEQ ID NO: 531117 - DNA, 25 bp, Rattus norvegicus
ttagaggtcgcccacacaaacactg

SEQ ID NO: 531118 - DNA, 25 bp, Rattus norvegicus
tccgcggtaccggagccacagtaac

SEQ ID NO: 531119 - DNA, 25 bp, Rattus norvegicus
tcagagcctcagagcaacctgtttc

SEQ ID NO: 531120 - DNA, 25 bp, Rattus norvegicus
cgcggacagatgagccacgagcaaa

SEQ ID NO: 531121 - DNA, 25 bp, Rattus norvegicus
gcaaaaaccctttactggccagaga

SEQ ID NO: 531122 - DNA, 25 bp, Rattus norvegicus
cggaagcgctaaagggcaaccatta

SEQ ID NO: 531123 - DNA, 25 bp, Rattus norvegicus
gtcccaaggggtctgacaaagcttg

SEQ ID NO: 531124 - DNA, 25 bp, Rattus norvegicus
ccgagccacggaagcgagacataga

SEQ ID NO: 531125 - DNA, 25 bp, Rattus norvegicus
gcaacctgttactagcgtgcaagga

SEQ ID NO: 531126 - DNA, 25 bp, Rattus norvegicus
aacgctctcttcatcgcgcgggttc

SEQ ID NO: 531127 - DNA, 25 bp, Rattus norvegicus
tggtcccgacggtcacaaacgctct

SEQ ID NO: 531128 - DNA, 25 bp, Rattus norvegicus
ctgaaccgtatcgttggcgaccaca

SEQ ID NO: 531129 - DNA, 25 bp, Rattus norvegicus
aaccgagtttccttttcagcctgca

SEQ ID NO: 531130 - DNA, 25 bp, Rattus norvegicus
ggtgctgcagggaaaaccgatacca

SEQ ID NO: 531131 - DNA, 25 bp, Rattus norvegicus
acgagatcgattcctgacaaccttg

SEQ ID NO: 531132 - DNA, 25 bp, Rattus norvegicus
gagatcgattcctgacaaccttgct

SEQ ID NO: 531133 - DNA, 25 bp, Rattus norvegicus
cgagatcgattcctgacaaccttgc

SEQ ID NO: 531134 - DNA, 25 bp, Rattus norvegicus
cacgagatcgattcctgacaacctt

SEQ ID NO: 531135 - DNA, 25 bp, Rattus norvegicus
ctcacgagatcgattcctgacaacc

SEQ ID NO: 531136 - DNA, 25 bp, Rattus norvegicus
tcacgagatcgattcctgacaacct

SEQ ID NO: 531137 - DNA, 25 bp, Rattus norvegicus
tgttcggtccttccgggcctcacga

SEQ ID NO: 531138 - DNA, 25 bp, Rattus norvegicus
cctcacgagatcgattcctgacaac

SEQ ID NO: 531139 - DNA, 25 bp, Rattus norvegicus
gcctcacgagatcgattcctgacaa

SEQ ID NO: 531140 - DNA, 25 bp, Rattus norvegicus
ggcctcacgagatcgattcctgaca

SEQ ID NO: 531141 - DNA, 25 bp, Rattus norvegicus
cgggcctcacgagatcgattcctga

SEQ ID NO: 531142 - DNA, 25 bp, Rattus norvegicus
ccgggcctcacgagatcgattcctg

SEQ ID NO: 531143 - DNA, 25 bp, Rattus norvegicus
tccgggcctcacgagatcgattcct

SEQ ID NO: 531144 - DNA, 25 bp, Rattus norvegicus
gggcctcacgagatcgattcctgac

SEQ ID NO: 531145 - DNA, 25 bp, Rattus norvegicus
tcacctgtatggataccagcagccc

SEQ ID NO: 531146 - DNA, 25 bp, Rattus norvegicus
gccagctcgcctcacttatgggtcg

SEQ ID NO: 531147 - DNA, 25 bp, Rattus norvegicus
cctcacttatgggtcggaagcgctg

SEQ ID NO: 531148 - DNA, 25 bp, Rattus norvegicus
agaagcagaaactgtccagttcgcc

SEQ ID NO: 531149 - DNA, 25 bp, Rattus norvegicus
gctgtctccacctctgagctgcgga

SEQ ID NO: 531150 - DNA, 25 bp, Rattus norvegicus
cacctctgagctgcggagtgggaac

SEQ ID NO: 531151 - DNA, 25 bp, Rattus norvegicus
tgtcagcggagatgtgctgcttttg

SEQ ID NO: 531152 - DNA, 25 bp, Rattus norvegicus
cgcttcaccaacgagccctagtgag

SEQ ID NO: 531153 - DNA, 25 bp, Rattus norvegicus
gatgtgctctactgtcacctgtatg

SEQ ID NO: 531154 - DNA, 25 bp, Rattus norvegicus
aacgagccctagtgagtaccgcgct

SEQ ID NO: 531155 - DNA, 25 bp, Rattus norvegicus
ttgcgctaacttccaggagttttga

SEQ ID NO: 531156 - DNA, 25 bp, Rattus norvegicus
tgaggtaaagtgtaagtcctccgcc

SEQ ID NO: 531157 - DNA, 25 bp, Rattus norvegicus
gctgcttttgcttcgatgtgctcta

SEQ ID NO: 531158 - DNA, 25 bp, Rattus norvegicus
gaggaaagcccacactcggagcagg

SEQ ID NO: 531159 - DNA, 25 bp, Rattus norvegicus
agctagcgggcacgcgagctcctct

SEQ ID NO: 531160 - DNA, 25 bp, Rattus norvegicus
ggctcgtcttttccgggctcgcgct

SEQ ID NO: 531161 - DNA, 25 bp, Rattus norvegicus
gcgatcctcacctgagccggttgga

SEQ ID NO: 531162 - DNA, 25 bp, Rattus norvegicus
ctcgtggtgagcgaggcagcacctt

SEQ ID NO: 531163 - DNA, 25 bp, Rattus norvegicus
ggcctgttctgcagctctgggatac

SEQ ID NO: 531164 - DNA, 25 bp, Rattus norvegicus
ttttttccactggtcgccgaggctc

SEQ ID NO: 531165 - DNA, 25 bp, Rattus norvegicus
ctgcgattcggcaggctcagccaca

SEQ ID NO: 531166 - DNA, 25 bp, Rattus norvegicus
gcctctttggtggtgacgtccttag

SEQ ID NO: 531167 - DNA, 25 bp, Rattus norvegicus
ttgcagcagctgctagctccgctgg

SEQ ID NO: 531168 - DNA, 25 bp, Rattus norvegicus
taggcgcctttagcgacctgcgacc

SEQ ID NO: 531169 - DNA, 25 bp, Rattus norvegicus
tcgcgggctgttctgcccagcactg

SEQ ID NO: 531170 - DNA, 25 bp, Rattus norvegicus
tctgggatacaaggcgccaagccct

SEQ ID NO: 531171 - DNA, 25 bp, Rattus norvegicus
cccgattcctgtcgggagccgcgat

SEQ ID NO: 531172 - DNA, 25 bp, Rattus norvegicus
tccttgcaaggctgctccagagcta

SEQ ID NO: 531173 - DNA, 25 bp, Rattus norvegicus
gcatcgagcgttcatcaaactccta

SEQ ID NO: 531174 - DNA, 25 bp, Rattus norvegicus
ctcctacccggactgtctgcgaaga

SEQ ID NO: 531175 - DNA, 25 bp, Rattus norvegicus
accacgcaggaaggcggcagaaagc

SEQ ID NO: 531176 - DNA, 25 bp, Rattus norvegicus
gcagaaagccatgaccctggaggga

SEQ ID NO: 531177 - DNA, 25 bp, Rattus norvegicus
cccgagtcccatagcacgaggaaga

SEQ ID NO: 531178 - DNA, 25 bp, Rattus norvegicus
aggaagaacggagccagcctcgtcg

SEQ ID NO: 531179 - DNA, 25 bp, Rattus norvegicus
caaaccgcacggtgctgggctgcct

SEQ ID NO: 531180 - DNA, 25 bp, Rattus norvegicus
cgccactcacctgctttgctgatag

SEQ ID NO: 531181 - DNA, 25 bp, Rattus norvegicus
tttgctgatagcagaaatctcgagc

SEQ ID NO: 531182 - DNA, 25 bp, Rattus norvegicus
gaaatctcgagcttctcagaaacgg

SEQ ID NO: 531183 - DNA, 25 bp, Rattus norvegicus
tctcagaaacgggagctgccattcg

SEQ ID NO: 531184 - DNA, 25 bp, Rattus norvegicus
ctgccattcggctacttggcgccta

SEQ ID NO: 531185 - DNA, 25 bp, Rattus norvegicus
atgtcgtcatcaagctgcgccggga

SEQ ID NO: 531186 - DNA, 25 bp, Rattus norvegicus
ctacttggcgcctaatgtcgtcatc

SEQ ID NO: 531187 - DNA, 25 bp, Rattus norvegicus
ccaacagccatgaactgcagcgaga

SEQ ID NO: 531188 - DNA, 25 bp, Rattus norvegicus
acctcgctgtcgaagtctgtgcacc

SEQ ID NO: 531189 - DNA, 25 bp, Rattus norvegicus
aaccctcttgaaccgcttgctgctg

SEQ ID NO: 531190 - DNA, 25 bp, Rattus norvegicus
aaggtcaacggcgtcctggagcctc

SEQ ID NO: 531191 - DNA, 25 bp, Rattus norvegicus
gagccaacggctgcaaaccctcttg

SEQ ID NO: 531192 - DNA, 25 bp, Rattus norvegicus
ctggcctgtgttgccgagcaggaat

SEQ ID NO: 531193 - DNA, 25 bp, Rattus norvegicus
tcgtcgaggccaaggatgagccacc

SEQ ID NO: 531194 - DNA, 25 bp, Rattus norvegicus
tcccgcaagctcgtcgaggccaagg

SEQ ID NO: 531195 - DNA, 25 bp, Rattus norvegicus
tagccggaggcctcatcctggccta

SEQ ID NO: 531196 - DNA, 25 bp, Rattus norvegicus
ttctatgcttgcctagccggaggcc

SEQ ID NO: 531197 - DNA, 25 bp, Rattus norvegicus
ccagcgccaagggtaacgatgctta

SEQ ID NO: 531198 - DNA, 25 bp, Rattus norvegicus
tccctgaccctttcgtgggccgtga

SEQ ID NO: 531199 - DNA, 25 bp, Rattus norvegicus
tggagctgcatcatcgtggcaacgc

SEQ ID NO: 531200 - DNA, 25 bp, Rattus norvegicus
gaagtctgtgcaccctgcctgctct

SEQ ID NO: 531201 - DNA, 25 bp, Rattus norvegicus
tgccaggaagttccggctcagtgtc

SEQ ID NO: 531202 - DNA, 25 bp, Rattus norvegicus
ggcgcgtgatcatcctgtaccaatg

SEQ ID NO: 531203 - DNA, 25 bp, Rattus norvegicus
cgcactcattgggaccgggtcgtcc

SEQ ID NO: 531204 - DNA, 25 bp, Rattus norvegicus
caatgcttctccgtgagccagcgcg

SEQ ID NO: 531205 - DNA, 25 bp, Rattus norvegicus
gaggcgttacttcgtgctcaaactc

SEQ ID NO: 531206 - DNA, 25 bp, Rattus norvegicus
ttgccctctttacccaggacgagta

SEQ ID NO: 531207 - DNA, 25 bp, Rattus norvegicus
tccggctgtgtcttaccgacgaaga

SEQ ID NO: 531208 - DNA, 25 bp, Rattus norvegicus
ttttgcccactgctgtgagcccggt

SEQ ID NO: 531209 - DNA, 25 bp, Rattus norvegicus
accgtgcatcaccatggcgagttgc

SEQ ID NO: 531210 - DNA, 25 bp, Rattus norvegicus
gagttgctccttcgctggcgactaa

SEQ ID NO: 531211 - DNA, 25 bp, Rattus norvegicus
ccggctcggctcgaatactaccaaa

SEQ ID NO: 531212 - DNA, 25 bp, Rattus norvegicus
gcctccgcagctctagcagcagtgg

SEQ ID NO: 531213 - DNA, 25 bp, Rattus norvegicus
tgaagtctgcaaacgcggctacctg

SEQ ID NO: 531214 - DNA, 25 bp, Rattus norvegicus
cgactaagcgctaaggagactgaga

SEQ ID NO: 531215 - DNA, 25 bp, Rattus norvegicus
cggctttccctactgacagcttgga

SEQ ID NO: 531216 - DNA, 25 bp, Rattus norvegicus
aaccaagctgccaacggtgaggacc

SEQ ID NO: 531217 - DNA, 25 bp, Rattus norvegicus
caactatgacgatgaggatgacgac

SEQ ID NO: 531218 - DNA, 25 bp, Rattus norvegicus
gcctcgccaccatcgggtgctgaga

SEQ ID NO: 531219 - DNA, 25 bp, Rattus norvegicus
tggacagagactttcccgccgcttc

SEQ ID NO: 531220 - DNA, 25 bp, Rattus norvegicus
ccgtgattgctgctccagctggagc

SEQ ID NO: 531221 - DNA, 25 bp, Rattus norvegicus
cagcactggcgctgtctttgtcggc

SEQ ID NO: 531222 - DNA, 25 bp, Rattus norvegicus
cggcttcccagttgcggctggagac

SEQ ID NO: 531223 - DNA, 25 bp, Rattus norvegicus
gctcgctggttccaacctgttgcta

SEQ ID NO: 531224 - DNA, 25 bp, Rattus norvegicus
ctgttgctaatgctcctggtgccca

SEQ ID NO: 531225 - DNA, 25 bp, Rattus norvegicus
ccgaaagagaggtccgggacattgc

SEQ ID NO: 531226 - DNA, 25 bp, Rattus norvegicus
gggacattgccgcaggctggaatcc

SEQ ID NO: 531227 - DNA, 25 bp, Rattus norvegicus
gctggaatcctggaacccttaacca

SEQ ID NO: 531228 - DNA, 25 bp, Rattus norvegicus
gagcggattctgaggacaactatga

SEQ ID NO: 531229 - DNA, 25 bp, Rattus norvegicus
gcgtttagaaatcgcttccttgaac

SEQ ID NO: 531230 - DNA, 25 bp, Rattus norvegicus
ctgcacggtgctgttctcgggcacc

SEQ ID NO: 531231 - DNA, 25 bp, Rattus norvegicus
actttgatgattttgggctcggctg

SEQ ID NO: 531232 - DNA, 25 bp, Rattus norvegicus
ggggtcttcacagtgactttgatga

SEQ ID NO: 531233 - DNA, 25 bp, Rattus norvegicus
tgcggaacacagtacctcagagatg

SEQ ID NO: 531234 - DNA, 25 bp, Rattus norvegicus
acctcagagatgagggctgcggctc

SEQ ID NO: 531235 - DNA, 25 bp, Rattus norvegicus
tcggctgcgcactcggttcggcgta

SEQ ID NO: 531236 - DNA, 25 bp, Rattus norvegicus
tcggttcggcgtaggcctcggctaa

SEQ ID NO: 531237 - DNA, 25 bp, Rattus norvegicus
agagcaggtcctgcaggccgtctct

SEQ ID NO: 531238 - DNA, 25 bp, Rattus norvegicus
cggtttgcgatttgaagcgtttaga

SEQ ID NO: 531239 - DNA, 25 bp, Rattus norvegicus
tcagcacgagctgatcggtttgcga

SEQ ID NO: 531240 - DNA, 25 bp, Rattus norvegicus
cgcgcactcccagcgactcctgcag

SEQ ID NO: 531241 - DNA, 25 bp, Rattus norvegicus
cgcttccttgaactgctgcacggtg

SEQ ID NO: 531242 - DNA, 25 bp, Rattus norvegicus
gggcagtgcggaacacagtacctca

SEQ ID NO: 531243 - DNA, 25 bp, Rattus norvegicus
gaattcacgaaagcccgcgcaaaag

SEQ ID NO: 531244 - DNA, 25 bp, Rattus norvegicus
gcgcaaaggccagcattttaaaaag

SEQ ID NO: 531245 - DNA, 25 bp, Rattus norvegicus
cagcattttaaaaagcccgcgcaaa

SEQ ID NO: 531246 - DNA, 25 bp, Rattus norvegicus
cgcccaaaacgcaggcttacaaaag

SEQ ID NO: 531247 - DNA, 25 bp, Rattus norvegicus
agcatgcgcaaaagccagcctttgg

SEQ ID NO: 531248 - DNA, 25 bp, Rattus norvegicus
gccagcctttggaaaagcccgcaca

SEQ ID NO: 531249 - DNA, 25 bp, Rattus norvegicus
tggaaaagcccgcacaaaacccaga

SEQ ID NO: 531250 - DNA, 25 bp, Rattus norvegicus
ccagacttacaaaagcccgcgcaaa

SEQ ID NO: 531251 - DNA, 25 bp, Rattus norvegicus
ccgcgcaaaacccaggctatcaaaa

SEQ ID NO: 531252 - DNA, 25 bp, Rattus norvegicus
ccaggctatcaaaaaggccgcccaa

SEQ ID NO: 531253 - DNA, 25 bp, Rattus norvegicus
aaaggccgcccaaaagccaggatat

SEQ ID NO: 531254 - DNA, 25 bp, Rattus norvegicus
ggatatcgacaagcccgcccaaaag

SEQ ID NO: 531255 - DNA, 25 bp, Rattus norvegicus
agccaggctatcgaaaagccttgcc

SEQ ID NO: 531256 - DNA, 25 bp, Rattus norvegicus
cccataagccagaattcacgaaagc

SEQ ID NO: 531257 - DNA, 25 bp, Rattus norvegicus
cacgttcgagaagcgtcccggtcct

SEQ ID NO: 531258 - DNA, 25 bp, Rattus norvegicus
agccgatggcccacgttcgagaagc

SEQ ID NO: 531259 - DNA, 25 bp, Rattus norvegicus
tgcatcgagaatggagcagacgatg

SEQ ID NO: 531260 - DNA, 25 bp, Rattus norvegicus
gtcacaccagctccagctcggtttg

SEQ ID NO: 531261 - DNA, 25 bp, Rattus norvegicus
cccatagtcatagctcattcccaga

SEQ ID NO: 531262 - DNA, 25 bp, Rattus norvegicus
aggctaacggcaccgcggccatgac

SEQ ID NO: 531263 - DNA, 25 bp, Rattus norvegicus
cagacgcgtttcttcccaggcttgg

SEQ ID NO: 531264 - DNA, 25 bp, Rattus norvegicus
gctggccgtccacacgagttcctgt

SEQ ID NO: 531265 - DNA, 25 bp, Rattus norvegicus
caggcggctgagaatgcatcgagaa

SEQ ID NO: 531266 - DNA, 25 bp, Rattus norvegicus
gcccaagcccacgtcggagaactta

SEQ ID NO: 531267 - DNA, 25 bp, Rattus norvegicus
ccacgtcggagaacttaacaagtag

SEQ ID NO: 531268 - DNA, 25 bp, Rattus norvegicus
gcagcgatgagaaggtgctcccttc

SEQ ID NO: 531269 - DNA, 25 bp, Rattus norvegicus
aaggtgctcccttctatcccggctg

SEQ ID NO: 531270 - DNA, 25 bp, Rattus norvegicus
agctcattcccagacgcgtttcttc

SEQ ID NO: 531271 - DNA, 25 bp, Rattus norvegicus
acctttcccaggcaagctgacttgc

SEQ ID NO: 531272 - DNA, 25 bp, Rattus norvegicus
gaaccagtcgtttcggccacaaaga

SEQ ID NO: 531273 - DNA, 25 bp, Rattus norvegicus
cgagaaaccggagcagcattggccc

SEQ ID NO: 531274 - DNA, 25 bp, Rattus norvegicus
ccagcgaagtctttgaggcaagaac

SEQ ID NO: 531275 - DNA, 25 bp, Rattus norvegicus
gccgaaccgcaaacaccagcgaagt

SEQ ID NO: 531276 - DNA, 25 bp, Rattus norvegicus
cgctcaggtattcttcgggtgtgct

SEQ ID NO: 531277 - DNA, 25 bp, Rattus norvegicus
gcgtctgagaaaagtggctatctta

SEQ ID NO: 531278 - DNA, 25 bp, Rattus norvegicus
agaactctttctgcagcgtctgaga

SEQ ID NO: 531279 - DNA, 25 bp, Rattus norvegicus
cctgcagcacttggagaactctttc

SEQ ID NO: 531280 - DNA, 25 bp, Rattus norvegicus
aggcatggctccagcaaagcgatga

SEQ ID NO: 531281 - DNA, 25 bp, Rattus norvegicus
cctctgaggcctggatcttgcgatt

SEQ ID NO: 531282 - DNA, 25 bp, Rattus norvegicus
ccatcggggtcttagaagcctctga

SEQ ID NO: 531283 - DNA, 25 bp, Rattus norvegicus
caggaacttccgctagccgaaagga

SEQ ID NO: 531284 - DNA, 25 bp, Rattus norvegicus
tcttgcgattgttgcgattctcttc

SEQ ID NO: 531285 - DNA, 25 bp, Rattus norvegicus
tataccgattcccaaaggaagctta

SEQ ID NO: 531286 - DNA, 25 bp, Rattus norvegicus
tcgcaaggccgtgggactgttgctc

SEQ ID NO: 531287 - DNA, 25 bp, Rattus norvegicus
gtccaaaacgcgtcgcaaggccgtg

SEQ ID NO: 531288 - DNA, 25 bp, Rattus norvegicus
actgttgctcggttcctggcccgca

SEQ ID NO: 531289 - DNA, 25 bp, Rattus norvegicus
gcagcattttagtaaactataccga

SEQ ID NO: 531290 - DNA, 25 bp, Rattus norvegicus
ccttgcaggggactccggatcccat

SEQ ID NO: 531291 - DNA, 25 bp, Rattus norvegicus
gttccagcttaccacacgcagcatt

SEQ ID NO: 531292 - DNA, 25 bp, Rattus norvegicus
agcttaggcgggcaaaggcattgcc

SEQ ID NO: 531293 - DNA, 25 bp, Rattus norvegicus
ttcccaaaggaagcttaggcgggca

SEQ ID NO: 531294 - DNA, 25 bp, Rattus norvegicus
cttcgagttgagttcgcttaggcgg

SEQ ID NO: 531295 - DNA, 25 bp, Rattus norvegicus
cgggacttcgagttgagttcgctta

SEQ ID NO: 531296 - DNA, 25 bp, Rattus norvegicus
ggcaaaggcattgccgcccggaagt

SEQ ID NO: 531297 - DNA, 25 bp, Rattus norvegicus
cggatcccattgatgttccagctta

SEQ ID NO: 531298 - DNA, 25 bp, Rattus norvegicus
ccacacgcagcattttagtaaacta

SEQ ID NO: 531299 - DNA, 25 bp, Rattus norvegicus
tgatacgcaaggacggagataattg

SEQ ID NO: 531300 - DNA, 25 bp, Rattus norvegicus
ggacctcggagagcagctagaagta

SEQ ID NO: 531301 - DNA, 25 bp, Rattus norvegicus
cccgcgggcaaagaaatagcgaaga

SEQ ID NO: 531302 - DNA, 25 bp, Rattus norvegicus
ctgcccgcgggcaaagaaatagcga

SEQ ID NO: 531303 - DNA, 25 bp, Rattus norvegicus
aggacggagataattgcagcgccgc

SEQ ID NO: 531304 - DNA, 25 bp, Rattus norvegicus
tgcgtgatacgcaaggacggagata

SEQ ID NO: 531305 - DNA, 25 bp, Rattus norvegicus
gcctgatttgcgtgatacgcaagga

SEQ ID NO: 531306 - DNA, 25 bp, Rattus norvegicus
ctccgcctgatttgcgtgatacgca

SEQ ID NO: 531307 - DNA, 25 bp, Rattus norvegicus
tctttgctccgcctgatttgcgtga

SEQ ID NO: 531308 - DNA, 25 bp, Rattus norvegicus
ttgaggagcgcgcagctaggctccg

SEQ ID NO: 531309 - DNA, 25 bp, Rattus norvegicus
ctagaagtacaacgtcgcgggttga

SEQ ID NO: 531310 - DNA, 25 bp, Rattus norvegicus
agcagctagaagtacaacgtcgcgg

SEQ ID NO: 531311 - DNA, 25 bp, Rattus norvegicus
cctcggagagcagctagaagtacaa

SEQ ID NO: 531312 - DNA, 25 bp, Rattus norvegicus
ggagagcagctagaagtacaacgtc

SEQ ID NO: 531313 - DNA, 25 bp, Rattus norvegicus
cccagagaacccaggtcgattctca

SEQ ID NO: 531314 - DNA, 25 bp, Rattus norvegicus
ggactgcccgaaggcaagcctcgca

SEQ ID NO: 531315 - DNA, 25 bp, Rattus norvegicus
cgaaggcaagcctcgcagccggaga

SEQ ID NO: 531316 - DNA, 25 bp, Rattus norvegicus
tgggagagctcgcttctagcgcagc

SEQ ID NO: 531317 - DNA, 25 bp, Rattus norvegicus
gactggtcgtctattgggagagctc

SEQ ID NO: 531318 - DNA, 25 bp, Rattus norvegicus
gagaccctcttggtgggatccggct

SEQ ID NO: 531319 - DNA, 25 bp, Rattus norvegicus
ccggagaaagagaccctcttggtgg

SEQ ID NO: 531320 - DNA, 25 bp, Rattus norvegicus
gaacccttcccgactagcccagaga

SEQ ID NO: 531321 - DNA, 25 bp, Rattus norvegicus
agcatcgttccggaggactgcccga

SEQ ID NO: 531322 - DNA, 25 bp, Rattus norvegicus
tgcggctgtctcagcaacggctcgc

SEQ ID NO: 531323 - DNA, 25 bp, Rattus norvegicus
gcgggactccaataactgggtctca

SEQ ID NO: 531324 - DNA, 25 bp, Rattus norvegicus
gccaagctcaaatcccgacgagggg

SEQ ID NO: 531325 - DNA, 25 bp, Rattus norvegicus
gggcgtggccaagctcaaatcccga

SEQ ID NO: 531326 - DNA, 25 bp, Rattus norvegicus
ggtcgattctcattcccggagaaag

SEQ ID NO: 531327 - DNA, 25 bp, Rattus norvegicus
ttgacccacccatcgcgagattttg

SEQ ID NO: 531328 - DNA, 25 bp, Rattus norvegicus
aggagacagcgctttcctgaggtcg

SEQ ID NO: 531329 - DNA, 25 bp, Rattus norvegicus
ttgccgcaccttaggccgcgcagga

SEQ ID NO: 531330 - DNA, 25 bp, Rattus norvegicus
ctcacatgcgcaggcgcttggtgtt

SEQ ID NO: 531331 - DNA, 25 bp, Rattus norvegicus
tgcacacgggatacacgcgagactc

SEQ ID NO: 531332 - DNA, 25 bp, Rattus norvegicus
ctatagaacgagttaggacaggact

SEQ ID NO: 531333 - DNA, 25 bp, Rattus norvegicus
taccgctgacgggagtctatagaac

SEQ ID NO: 531334 - DNA, 25 bp, Rattus norvegicus
tcgcgagattttggcggcgcagcaa

SEQ ID NO: 531335 - DNA, 25 bp, Rattus norvegicus
gtcggagtctctctgctaccaactt

SEQ ID NO: 531336 - DNA, 25 bp, Rattus norvegicus
ctagtccaggaacgtgaaatcagca

SEQ ID NO: 531337 - DNA, 25 bp, Rattus norvegicus
gacacacaaggaggcgaaacgacta

SEQ ID NO: 531338 - DNA, 25 bp, Rattus norvegicus
gctctcagccattatcttggacaca

SEQ ID NO: 531339 - DNA, 25 bp, Rattus norvegicus
cactgcttcgtcctaacggcgggct

SEQ ID NO: 531340 - DNA, 25 bp, Rattus norvegicus
cgcagcaatggcaagaccgtgagta

SEQ ID NO: 531341 - DNA, 25 bp, Rattus norvegicus
ccgttccgagtttgggctgctccgc

SEQ ID NO: 531342 - DNA, 25 bp, Rattus norvegicus
ctcgctcagctaggggccgttccga

SEQ ID NO: 531343 - DNA, 25 bp, Rattus norvegicus
gctcctcgctcagctaggggccgtt

SEQ ID NO: 531344 - DNA, 25 bp, Rattus norvegicus
atccaccgcgctgcgctgagttcgg

SEQ ID NO: 531345 - DNA, 25 bp, Rattus norvegicus
gaattctctggcttcagtacgcgtg

SEQ ID NO: 531346 - DNA, 25 bp, Rattus norvegicus
tctctggcttcagtacgcgtgcgct

SEQ ID NO: 531347 - DNA, 25 bp, Rattus norvegicus
gcttcagtacgcgtgcgctcggtca

SEQ ID NO: 531348 - DNA, 25 bp, Rattus norvegicus
agtacgcgtgcgctcggtcagctgc

SEQ ID NO: 531349 - DNA, 25 bp, Rattus norvegicus
cgagcgcgagcttgggctcgcactc

SEQ ID NO: 531350 - DNA, 25 bp, Rattus norvegicus
gcgagcttgggctcgcactctgctc

SEQ ID NO: 531351 - DNA, 25 bp, Rattus norvegicus
ccctaaccgtggctgctggctcggt

SEQ ID NO: 531352 - DNA, 25 bp, Rattus norvegicus
cgcgcacgcgcacaggactcggaga

SEQ ID NO: 531353 - DNA, 25 bp, Rattus norvegicus
ctctccagtccatcagaattctctg

SEQ ID NO: 531354 - DNA, 25 bp, Rattus norvegicus
gcgcacaggactcggagacgagctc

SEQ ID NO: 531355 - DNA, 25 bp, Rattus norvegicus
cgcggctctatggtggctaccagac

SEQ ID NO: 531356 - DNA, 25 bp, Rattus norvegicus
cctggagctggtggtcatgttccct

SEQ ID NO: 531357 - DNA, 25 bp, Rattus norvegicus
ggagcggcagactgcgcaactgatc

SEQ ID NO: 531358 - DNA, 25 bp, Rattus norvegicus
tgcgcaactgatcgtgggacacgtg

SEQ ID NO: 531359 - DNA, 25 bp, Rattus norvegicus
ggacacgtgggcaacaagggcaccc

SEQ ID NO: 531360 - DNA, 25 bp, Rattus norvegicus
ggaatgccatgctgggctacttgtc

SEQ ID NO: 531361 - DNA, 25 bp, Rattus norvegicus
ctaccagacggattgggtttgtggc

SEQ ID NO: 531362 - DNA, 25 bp, Rattus norvegicus
tacttgtcagcgctgtgccaggctt

SEQ ID NO: 531363 - DNA, 25 bp, Rattus norvegicus
gcctgctgcctttggtgcttactcc

SEQ ID NO: 531364 - DNA, 25 bp, Rattus norvegicus
tggtgcctgtggacctcctcaaact

SEQ ID NO: 531365 - DNA, 25 bp, Rattus norvegicus
gcgtccagggcttccaagagttcct

SEQ ID NO: 531366 - DNA, 25 bp, Rattus norvegicus
ttcttctgcccacggaggaagcatg

SEQ ID NO: 531367 - DNA, 25 bp, Rattus norvegicus
ttgcgcagccgctgtttcttctgcc

SEQ ID NO: 531368 - DNA, 25 bp, Rattus norvegicus
tttgtggcggccagtggaatgccat

SEQ ID NO: 531369 - DNA, 25 bp, Rattus norvegicus
ggaactgcccgaatagcctctgctt

SEQ ID NO: 531370 - DNA, 25 bp, Rattus norvegicus
tcagaccacgggcactgcgtgacgc

SEQ ID NO: 531371 - DNA, 25 bp, Rattus norvegicus
ctaaagcccggtcagaccacgggca

SEQ ID NO: 531372 - DNA, 25 bp, Rattus norvegicus
acgcggcatgtggtttctaggagaa

SEQ ID NO: 531373 - DNA, 25 bp, Rattus norvegicus
tctaggagaaggcaagtaagcttca

SEQ ID NO: 531374 - DNA, 25 bp, Rattus norvegicus
taagcttcacagttttgcagcggca

SEQ ID NO: 531375 - DNA, 25 bp, Rattus norvegicus
gcctcgggccggaactgcccgaata

SEQ ID NO: 531376 - DNA, 25 bp, Rattus norvegicus
cagcctcgggcatgaagagatcttt

SEQ ID NO: 531377 - DNA, 25 bp, Rattus norvegicus
gcccgaatagcctctgcttagcgca

SEQ ID NO: 531378 - DNA, 25 bp, Rattus norvegicus
tgcttagcgcagagctgtgttgccc

SEQ ID NO: 531379 - DNA, 25 bp, Rattus norvegicus
cgagcctagccgctggcgagtctct

SEQ ID NO: 531380 - DNA, 25 bp, Rattus norvegicus
agtctctggggctgagctctgcgcc

SEQ ID NO: 531381 - DNA, 25 bp, Rattus norvegicus
agagatctttgtagcgtttgggacc

SEQ ID NO: 531382 - DNA, 25 bp, Rattus norvegicus
tgcagcggcaatcccagaattcacc

SEQ ID NO: 531383 - DNA, 25 bp, Rattus norvegicus
atccctaaaggacgagagcttcctc

SEQ ID NO: 531384 - DNA, 25 bp, Rattus norvegicus
catcgcgaggtttggtagcaagctc

SEQ ID NO: 531385 - DNA, 25 bp, Rattus norvegicus
tctcgccgaggttgaacgtaatatc

SEQ ID NO: 531386 - DNA, 25 bp, Rattus norvegicus
acctcgtggtaagcgagatccctaa

SEQ ID NO: 531387 - DNA, 25 bp, Rattus norvegicus
tggtgccggtaaatccttcctgaga

SEQ ID NO: 531388 - DNA, 25 bp, Rattus norvegicus
cgggcggtatcctgcagtgaattac

SEQ ID NO: 531389 - DNA, 25 bp, Rattus norvegicus
ccgtgaggttgtgcgtcatttgctt

SEQ ID NO: 531390 - DNA, 25 bp, Rattus norvegicus
acgggctgggctcaatttttcctgg

SEQ ID NO: 531391 - DNA, 25 bp, Rattus norvegicus
ggctgatgcctgtcttgctagtaca

SEQ ID NO: 531392 - DNA, 25 bp, Rattus norvegicus
ctctccgcgtttgtgacgcttctta

SEQ ID NO: 531393 - DNA, 25 bp, Rattus norvegicus
gacgcttcttaggtaccagacgtta

SEQ ID NO: 531394 - DNA, 25 bp, Rattus norvegicus
tacgcctccgttttcgtcgtcgcag

SEQ ID NO: 531395 - DNA, 25 bp, Rattus norvegicus
cgcgagatctcatgtttcctaaagg

SEQ ID NO: 531396 - DNA, 25 bp, Rattus norvegicus
tttttaggagcgtgcacctggtctc

SEQ ID NO: 531397 - DNA, 25 bp, Rattus norvegicus
ttcagaggttcaccgccatcattgg

SEQ ID NO: 531398 - DNA, 25 bp, Rattus norvegicus
agcgcctttgccatgggtttcctga

SEQ ID NO: 531399 - DNA, 25 bp, Rattus norvegicus
ggacccaatggctctggtgagatta

SEQ ID NO: 531400 - DNA, 25 bp, Rattus norvegicus
ttaaaaccggctgtgaccctgcgtg

SEQ ID NO: 531401 - DNA, 25 bp, Rattus norvegicus
tcctaggagtaaggcgcggcctctt

SEQ ID NO: 531402 - DNA, 25 bp, Rattus norvegicus
gggctaacctcgcttcctaggagta

SEQ ID NO: 531403 - DNA, 25 bp, Rattus norvegicus
actgcgctatttcccgcgcgggcta

SEQ ID NO: 531404 - DNA, 25 bp, Rattus norvegicus
cttggacttattatcgcgaggctta

SEQ ID NO: 531405 - DNA, 25 bp, Rattus norvegicus
gtgaccgcttctggacccggaaaca

SEQ ID NO: 531406 - DNA, 25 bp, Rattus norvegicus
agcgctatttcaggcggaagtgacc

SEQ ID NO: 531407 - DNA, 25 bp, Rattus norvegicus
cagcacgtgctctagccaggcaaca

SEQ ID NO: 531408 - DNA, 25 bp, Rattus norvegicus
tgcttcaacagttgcggcgtaacta

SEQ ID NO: 531409 - DNA, 25 bp, Rattus norvegicus
gcttcctcgacgtagttaccgctgc

SEQ ID NO: 531410 - DNA, 25 bp, Rattus norvegicus
atcgtacaagggtcgacaaattatc

SEQ ID NO: 531411 - DNA, 25 bp, Rattus norvegicus
gcacagtgaagacacgtgcacagtg

SEQ ID NO: 531412 - DNA, 25 bp, Rattus norvegicus
cacagtgaagacacgtgcacagtga

SEQ ID NO: 531413 - DNA, 25 bp, Rattus norvegicus
gcagagtgaagacacacacatgccg

SEQ ID NO: 531414 - DNA, 25 bp, Rattus norvegicus
tgaagacacgtgcacagtgaagaca

SEQ ID NO: 531415 - DNA, 25 bp, Rattus norvegicus
acacgtgcacagtgaagacacgtgc

SEQ ID NO: 531416 - DNA, 25 bp, Rattus norvegicus
cgtgcacagtgaagacacacacgtg

SEQ ID NO: 531417 - DNA, 25 bp, Rattus norvegicus
acagtgaagacacgtgcacagtgaa

SEQ ID NO: 531418 - DNA, 25 bp, Rattus norvegicus
agagtgaagacacgtgcacagtgaa

SEQ ID NO: 531419 - DNA, 25 bp, Rattus norvegicus
cgtgcagagtgaagacacgtgcaga

SEQ ID NO: 531420 - DNA, 25 bp, Rattus norvegicus
catgccgagtgaagacacgtgcaga

SEQ ID NO: 531421 - DNA, 25 bp, Rattus norvegicus
cagagtgaagacacacacatgccga

SEQ ID NO: 531422 - DNA, 25 bp, Rattus norvegicus
cagagtgaagacacgtgcagagtga

SEQ ID NO: 531423 - DNA, 25 bp, Rattus norvegicus
cacatgccgagtgaagacacgtgca

SEQ ID NO: 531424 - DNA, 25 bp, Rattus norvegicus
gcagagtgaagacacgtgcacagtg

SEQ ID NO: 531425 - DNA, 25 bp, Rattus norvegicus
cagcagctgttggagacccagcggc

SEQ ID NO: 531426 - DNA, 25 bp, Rattus norvegicus
catcatcgagagtcagcagcagctg

SEQ ID NO: 531427 - DNA, 25 bp, Rattus norvegicus
ttggaccagctcacccaggagaacc

SEQ ID NO: 531428 - DNA, 25 bp, Rattus norvegicus
ccagctgcaccgtggggaactgcac

SEQ ID NO: 531429 - DNA, 25 bp, Rattus norvegicus
gccgcgagagccagtaccagaacct

SEQ ID NO: 531430 - DNA, 25 bp, Rattus norvegicus
ttccaccaccgcgagctgcgggaga

SEQ ID NO: 531431 - DNA, 25 bp, Rattus norvegicus
ggagagccagttccaccaggcgtcc

SEQ ID NO: 531432 - DNA, 25 bp, Rattus norvegicus
ggatggcgcttaccagaaccgggaa

SEQ ID NO: 531433 - DNA, 25 bp, Rattus norvegicus
ccgggaagctatctatcgggataag

SEQ ID NO: 531434 - DNA, 25 bp, Rattus norvegicus
tcgggataaggagcgagaagcttcc

SEQ ID NO: 531435 - DNA, 25 bp, Rattus norvegicus
atcagctccaggacactaccggtta

SEQ ID NO: 531436 - DNA, 25 bp, Rattus norvegicus
gccgcgagaaggaagccggctattc

SEQ ID NO: 531437 - DNA, 25 bp, Rattus norvegicus
cctgctggagctgaacaacatcatc

SEQ ID NO: 531438 - DNA, 25 bp, Rattus norvegicus
agccgtggcgcatccagaagctcca

SEQ ID NO: 531439 - DNA, 25 bp, Rattus norvegicus
agaagtgcatcggtttcagacagcg

SEQ ID NO: 531440 - DNA, 25 bp, Rattus norvegicus
atcgccgagaagtccggcatttgca

SEQ ID NO: 531441 - DNA, 25 bp, Rattus norvegicus
gaaaatcagacccatcgccgagaag

SEQ ID NO: 531442 - DNA, 25 bp, Rattus norvegicus
cctctaggctacatcgcgaaaatca

SEQ ID NO: 531443 - DNA, 25 bp, Rattus norvegicus
tagctgggccgagttccgagaccct

SEQ ID NO: 531444 - DNA, 25 bp, Rattus norvegicus
ccggagtgtccggtgttcgagccta

SEQ ID NO: 531445 - DNA, 25 bp, Rattus norvegicus
gcccaccatggagctggggtccgac

SEQ ID NO: 531446 - DNA, 25 bp, Rattus norvegicus
cggtttcagacagcggcggcgccat

SEQ ID NO: 531447 - DNA, 25 bp, Rattus norvegicus
tggccgtcctgcttagggcctagac

SEQ ID NO: 531448 - DNA, 25 bp, Rattus norvegicus
gggcctagactctgagaagtgcatc

SEQ ID NO: 531449 - DNA, 25 bp, Rattus norvegicus
gtccggcatttgcaagatccgccca

SEQ ID NO: 531450 - DNA, 25 bp, Rattus norvegicus
ttcgagcctagctgggccgagttcc

SEQ ID NO: 531451 - DNA, 25 bp, Rattus norvegicus
ccatgagtccttaagggcggcctga

SEQ ID NO: 531452 - DNA, 25 bp, Rattus norvegicus
gagctggggtccgacgatttcctac

SEQ ID NO: 531453 - DNA, 25 bp, Rattus norvegicus
tactgtttttcttggaatacctcta

SEQ ID NO: 531454 - DNA, 25 bp, Rattus norvegicus
ggtagcgatgctccacacaaccgcg

SEQ ID NO: 531455 - DNA, 25 bp, Rattus norvegicus
ggcagggtagcgatgctccacacaa

SEQ ID NO: 531456 - DNA, 25 bp, Rattus norvegicus
tccgcctagccctggcagggtagcg

SEQ ID NO: 531457 - DNA, 25 bp, Rattus norvegicus
atacacggacgcttcacgcaacgct

SEQ ID NO: 531458 - DNA, 25 bp, Rattus norvegicus
atctcgcagatacacggacgcttca

SEQ ID NO: 531459 - DNA, 25 bp, Rattus norvegicus
ggcccacagcaagatctcgcagata

SEQ ID NO: 531460 - DNA, 25 bp, Rattus norvegicus
ggagaatggatacctggcccacagc

SEQ ID NO: 531461 - DNA, 25 bp, Rattus norvegicus
ttggaatacctctagtctccgtagg

SEQ ID NO: 531462 - DNA, 25 bp, Rattus norvegicus
cacaggcgttctgggccattctctc

SEQ ID NO: 531463 - DNA, 25 bp, Rattus norvegicus
cgcccaggtaaaagcgcgccaggtc

SEQ ID NO: 531464 - DNA, 25 bp, Rattus norvegicus
ctagagtcgaaaggccgcccaggta

SEQ ID NO: 531465 - DNA, 25 bp, Rattus norvegicus
ggacctagagtcgaaaggccgccca

SEQ ID NO: 531466 - DNA, 25 bp, Rattus norvegicus
ctccgtaggttctacggctgccaca

SEQ ID NO: 531467 - DNA, 25 bp, Rattus norvegicus
ggagccgccacacctcacgcgacca

SEQ ID NO: 531468 - DNA, 25 bp, Rattus norvegicus
agctcagctcaccacctcgctctga

SEQ ID NO: 531469 - DNA, 25 bp, Rattus norvegicus
agtcacacttgaagcggagccgcca

SEQ ID NO: 531470 - DNA, 25 bp, Rattus norvegicus
aggcaccagtcacacttgaagcgga

SEQ ID NO: 531471 - DNA, 25 bp, Rattus norvegicus
aggcctcaggcaccagtcacacttg

SEQ ID NO: 531472 - DNA, 25 bp, Rattus norvegicus
ttcggctctcagacaaggcctcagg

SEQ ID NO: 531473 - DNA, 25 bp, Rattus norvegicus
ctggcttttcggctctcagacaagg

SEQ ID NO: 531474 - DNA, 25 bp, Rattus norvegicus
ctcccacagcgccagtcgccgaggc

SEQ ID NO: 531475 - DNA, 25 bp, Rattus norvegicus
aagcactggcttttcggctctcaga

SEQ ID NO: 531476 - DNA, 25 bp, Rattus norvegicus
tgaccgcgctcaaagcactggcttt

SEQ ID NO: 531477 - DNA, 25 bp, Rattus norvegicus
cgctgacgggattccgagctgctca

SEQ ID NO: 531478 - DNA, 25 bp, Rattus norvegicus
ggtccatggtgaccgcgctcaaagc

SEQ ID NO: 531479 - DNA, 25 bp, Rattus norvegicus
acagcgcctgccctactcccacagc

SEQ ID NO: 531480 - DNA, 25 bp, Rattus norvegicus
ctcatccgggcggtccatggtgacc

SEQ ID NO: 531481 - DNA, 25 bp, Rattus norvegicus
tcgatacgtcacattctggaaagca

SEQ ID NO: 531482 - DNA, 25 bp, Rattus norvegicus
agccaggctcctcgcattatcatgt

SEQ ID NO: 531483 - DNA, 25 bp, Rattus norvegicus
ggaaagcatttttggccaagtctcg

SEQ ID NO: 531484 - DNA, 25 bp, Rattus norvegicus
cctttcaggaaacgcagtctggcta

SEQ ID NO: 531485 - DNA, 25 bp, Rattus norvegicus
acattctctaggcagcggcgagcta

SEQ ID NO: 531486 - DNA, 25 bp, Rattus norvegicus
ccggcatgccttgtagtcgggcttt

SEQ ID NO: 531487 - DNA, 25 bp, Rattus norvegicus
tccaggatgaggtttccgacttgca

SEQ ID NO: 531488 - DNA, 25 bp, Rattus norvegicus
tctgagcagctgtggtcaaagtcca

SEQ ID NO: 531489 - DNA, 25 bp, Rattus norvegicus
tgagcgtcaggtactcgacactgtc

SEQ ID NO: 531490 - DNA, 25 bp, Rattus norvegicus
ataggccaccaggttgcaggactca

SEQ ID NO: 531491 - DNA, 25 bp, Rattus norvegicus
ttcgaagggtccaaagttgagcgtc

SEQ ID NO: 531492 - DNA, 25 bp, Rattus norvegicus
gccgccagcgatgcacagtttcgaa

SEQ ID NO: 531493 - DNA, 25 bp, Rattus norvegicus
tgccatccctggttcaggccgaata

SEQ ID NO: 531494 - DNA, 25 bp, Rattus norvegicus
gcccgggccaagtcaaaggaccaca

SEQ ID NO: 531495 - DNA, 25 bp, Rattus norvegicus
gcactgactgcgcttgaggtccaaa

SEQ ID NO: 531496 - DNA, 25 bp, Rattus norvegicus
tccggactacctcagggctgtcacg

SEQ ID NO: 531497 - DNA, 25 bp, Rattus norvegicus
agtagccttaccttggtgatgacca

SEQ ID NO: 531498 - DNA, 25 bp, Rattus norvegicus
gatgaccagaggctcaccatgctcg

SEQ ID NO: 531499 - DNA, 25 bp, Rattus norvegicus
agtcgctaaggtccacgcccatgca

SEQ ID NO: 531500 - DNA, 25 bp, Rattus norvegicus
cggccaccgctgaacttgctttgca

SEQ ID NO: 531501 - DNA, 25 bp, Rattus norvegicus
gccggaaccgtacacctagggctga

SEQ ID NO: 531502 - DNA, 25 bp, Rattus norvegicus
ctagggctgaacagaacccagtacc

SEQ ID NO: 531503 - DNA, 25 bp, Rattus norvegicus
tggcggaagtgtccaaaccggacta

SEQ ID NO: 531504 - DNA, 25 bp, Rattus norvegicus
ccgcccagctctagaggcgctgatg

SEQ ID NO: 531505 - DNA, 25 bp, Rattus norvegicus
cgaaacctgcccgaactggacctgg

SEQ ID NO: 531506 - DNA, 25 bp, Rattus norvegicus
gcacactgggttttcgcactgactg

SEQ ID NO: 531507 - DNA, 25 bp, Rattus norvegicus
ggtttctcttgtgcgctcagccgct

SEQ ID NO: 531508 - DNA, 25 bp, Rattus norvegicus
gatcagccttctgggtccggactac

SEQ ID NO: 531509 - DNA, 25 bp, Rattus norvegicus
cgcgcgactatgacggccgggtctt

SEQ ID NO: 531510 - DNA, 25 bp, Rattus norvegicus
ttgagcgaaagtgccaccacggagg

SEQ ID NO: 531511 - DNA, 25 bp, Rattus norvegicus
gccgcgtaattgagcgaaagtgcca

SEQ ID NO: 531512 - DNA, 25 bp, Rattus norvegicus
cccgtgaccggtaagtgggccatcg

SEQ ID NO: 531513 - DNA, 25 bp, Rattus norvegicus
tcgccagacgtcgtggattgatccc

SEQ ID NO: 531514 - DNA, 25 bp, Rattus norvegicus
caccacggaggatgtgctggagata

SEQ ID NO: 531515 - DNA, 25 bp, Rattus norvegicus
acggccgggtcttctacatcgacca

SEQ ID NO: 531516 - DNA, 25 bp, Rattus norvegicus
gtgccctcggttctgcctcagccgc

SEQ ID NO: 531517 - DNA, 25 bp, Rattus norvegicus
cgttcccgcaccctcggtgccctcg

SEQ ID NO: 531518 - DNA, 25 bp, Rattus norvegicus
agccgtcatgccttggttgagcggc

SEQ ID NO: 531519 - DNA, 25 bp, Rattus norvegicus
gcccgagccgtcatgccttggttga

SEQ ID NO: 531520 - DNA, 25 bp, Rattus norvegicus
cagcagaggatgctcccgccgcaga

SEQ ID NO: 531521 - DNA, 25 bp, Rattus norvegicus
gatgtgctggagatacgtccagccc

SEQ ID NO: 531522 - DNA, 25 bp, Rattus norvegicus
cacaacactcgccagacgtcgtgga

SEQ ID NO: 531523 - DNA, 25 bp, Rattus norvegicus
gcagagttgaaaacaccgcccagcc

SEQ ID NO: 531524 - DNA, 25 bp, Rattus norvegicus
ccaggttaggctggagtctgtgacc

SEQ ID NO: 531525 - DNA, 25 bp, Rattus norvegicus
ggagtctgtgacctgtggacacctc

SEQ ID NO: 531526 - DNA, 25 bp, Rattus norvegicus
cggctcacgagaaagccggccgtga

SEQ ID NO: 531527 - DNA, 25 bp, Rattus norvegicus
ctgtggacacctcggaccggtagag

SEQ ID NO: 531528 - DNA, 25 bp, Rattus norvegicus
agtgtgttcggcttggcggttcaac

SEQ ID NO: 531529 - DNA, 25 bp, Rattus norvegicus
gtttctcaaagagagccgcagagtt

SEQ ID NO: 531530 - DNA, 25 bp, Rattus norvegicus
cccagcccttagaggcggagacgga

SEQ ID NO: 531531 - DNA, 25 bp, Rattus norvegicus
tgggaccgatcctccctgactgaca

SEQ ID NO: 531532 - DNA, 25 bp, Rattus norvegicus
ccctgactgacaagaggttcctttc

SEQ ID NO: 531533 - DNA, 25 bp, Rattus norvegicus
agaggttcctttcctcagcttgcgg

SEQ ID NO: 531534 - DNA, 25 bp, Rattus norvegicus
tttcctcagcttgcggtttgtgtca

SEQ ID NO: 531535 - DNA, 25 bp, Rattus norvegicus
tttgtgtcagggctcccggaagtcc

SEQ ID NO: 531536 - DNA, 25 bp, Rattus norvegicus
gaaaaggaagtaacggctcacgaga

SEQ ID NO: 531537 - DNA, 25 bp, Rattus norvegicus
tttggagaatcccttggtcgaggcc

SEQ ID NO: 531538 - DNA, 25 bp, Rattus norvegicus
tggcgcagcttccttttggagaatc

SEQ ID NO: 531539 - DNA, 25 bp, Rattus norvegicus
tgcagcaggctctgcgcggacatct

SEQ ID NO: 531540 - DNA, 25 bp, Rattus norvegicus
aatcccttggtcgaggccgtgccgc

SEQ ID NO: 531541 - DNA, 25 bp, Rattus norvegicus
cgggaaccgagactctctgcagaga

SEQ ID NO: 531542 - DNA, 25 bp, Rattus norvegicus
acctggtagcccgaaggtgctgact

SEQ ID NO: 531543 - DNA, 25 bp, Rattus norvegicus
caggagaagacactgtgcagcaggc

SEQ ID NO: 531544 - DNA, 25 bp, Rattus norvegicus
cagccactgatcagggctgggtcca

SEQ ID NO: 531545 - DNA, 25 bp, Rattus norvegicus
tgactccggggagaagaagctaagc

SEQ ID NO: 531546 - DNA, 25 bp, Rattus norvegicus
gctaagcgggaaccgagactctctg

SEQ ID NO: 531547 - DNA, 25 bp, Rattus norvegicus
tctctgcagagagctgcggagaatt

SEQ ID NO: 531548 - DNA, 25 bp, Rattus norvegicus
ctgcggagaattgagtcggcttact

SEQ ID NO: 531549 - DNA, 25 bp, Rattus norvegicus
attgagtcggcttactgtggagccc

SEQ ID NO: 531550 - DNA, 25 bp, Rattus norvegicus
tcccgcagccactgatcagggctgg

SEQ ID NO: 531551 - DNA, 25 bp, Rattus norvegicus
accgtgtttgctgcgtcccgggcct

SEQ ID NO: 531552 - DNA, 25 bp, Rattus norvegicus
cgcggtgagaactcttctggagctc

SEQ ID NO: 531553 - DNA, 25 bp, Rattus norvegicus
tcccgagttcagttgcccggctgcg

SEQ ID NO: 531554 - DNA, 25 bp, Rattus norvegicus
cccggtgcaccttcttggtgacttg

SEQ ID NO: 531555 - DNA, 25 bp, Rattus norvegicus
ctccggacgcggtgagaactcttct

SEQ ID NO: 531556 - DNA, 25 bp, Rattus norvegicus
gcaccttcttggtgacttggggacc

SEQ ID NO: 531557 - DNA, 25 bp, Rattus norvegicus
tctggagctcccgagttcagttgcc

SEQ ID NO: 531558 - DNA, 25 bp, Rattus norvegicus
acttggggacctcggctgtgctttg

SEQ ID NO: 531559 - DNA, 25 bp, Rattus norvegicus
ttctgactcacgaggctcaaaagtg

SEQ ID NO: 531560 - DNA, 25 bp, Rattus norvegicus
tctaagttcacgttcccgagcggtc

SEQ ID NO: 531561 - DNA, 25 bp, Rattus norvegicus
cccgagcggtcctggtgcccttagt

SEQ ID NO: 531562 - DNA, 25 bp, Rattus norvegicus
cccttagtggggcaccgtgtttgct

SEQ ID NO: 531563 - DNA, 25 bp, Rattus norvegicus
gccttgagcgggtccttggcgctcc

SEQ ID NO: 531564 - DNA, 25 bp, Rattus norvegicus
ctcaaaagtgtctctaagttcacgt

SEQ ID NO: 531565 - DNA, 25 bp, Rattus norvegicus
ttccactctggggagaaagtgctgt

SEQ ID NO: 531566 - DNA, 25 bp, Rattus norvegicus
gccctccgccacgatgagcaaatga

SEQ ID NO: 531567 - DNA, 25 bp, Rattus norvegicus
caccaaggcgcgagtgctgtacgat

SEQ ID NO: 531568 - DNA, 25 bp, Rattus norvegicus
ttctcgcgtggccacactcatgtgc

SEQ ID NO: 531569 - DNA, 25 bp, Rattus norvegicus
tcatgtgcgcgcaactccgccaagg

SEQ ID NO: 531570 - DNA, 25 bp, Rattus norvegicus
ggggtagacgccatccagcctcagc

SEQ ID NO: 531571 - DNA, 25 bp, Rattus norvegicus
cggggatacttgctcccagtccgca

SEQ ID NO: 531572 - DNA, 25 bp, Rattus norvegicus
cgcgagcaagggcatgaaatttcaa

SEQ ID NO: 531573 - DNA, 25 bp, Rattus norvegicus
aaagtgctgtgcttcgagcctgacc

SEQ ID NO: 531574 - DNA, 25 bp, Rattus norvegicus
agtgctgtacgatgccaaggtgccg

SEQ ID NO: 531575 - DNA, 25 bp, Rattus norvegicus
cgcgcgactgccctaactagaaagg

SEQ ID NO: 531576 - DNA, 25 bp, Rattus norvegicus
tagaaaggacccgtgttgcttccgc

SEQ ID NO: 531577 - DNA, 25 bp, Rattus norvegicus
ttgctaggccaggatggcagtttga

SEQ ID NO: 531578 - DNA, 25 bp, Rattus norvegicus
aacgttctgcaggaagacctcgggc

SEQ ID NO: 531579 - DNA, 25 bp, Rattus norvegicus
cctggagaaagttgctccgccatta

SEQ ID NO: 531580 - DNA, 25 bp, Rattus norvegicus
ggtcacgccaagaccctcaggttca

SEQ ID NO: 531581 - DNA, 25 bp, Rattus norvegicus
tgtcttctgtttagcgctgccacgc

SEQ ID NO: 531582 - DNA, 25 bp, Rattus norvegicus
tgccacgcgtcttctgtatcatcgg

SEQ ID NO: 531583 - DNA, 25 bp, Rattus norvegicus
agtgcacaccttaccggtagaattc

SEQ ID NO: 531584 - DNA, 25 bp, Rattus norvegicus
tgaaactgctgtgacctacgggacc

SEQ ID NO: 531585 - DNA, 25 bp, Rattus norvegicus
ttccggtcgtcacacctcttggtgg

SEQ ID NO: 531586 - DNA, 25 bp, Rattus norvegicus
tcttggtggtctctgctgcagtgaa

SEQ ID NO: 531587 - DNA, 25 bp, Rattus norvegicus
ttgccagaccgcgaacgccagttac

SEQ ID NO: 531588 - DNA, 25 bp, Rattus norvegicus
cgccagttacttttgggccctcgca

SEQ ID NO: 531589 - DNA, 25 bp, Rattus norvegicus
cgccgtcgcttcctactgagcggta

SEQ ID NO: 531590 - DNA, 25 bp, Rattus norvegicus
gtgtccactgcgtacatccacaagt

SEQ ID NO: 531591 - DNA, 25 bp, Rattus norvegicus
ctttgcggtctcgagagttcctcta

SEQ ID NO: 531592 - DNA, 25 bp, Rattus norvegicus
tccggccaggctttttgaagagaaa

SEQ ID NO: 531593 - DNA, 25 bp, Rattus norvegicus
ggtggtcaccaagaagtttagcaac

SEQ ID NO: 531594 - DNA, 25 bp, Rattus norvegicus
aacaagctgctgcagagccaccgcg

SEQ ID NO: 531595 - DNA, 25 bp, Rattus norvegicus
gtgagtcaccatgcccaacatcgtg

SEQ ID NO: 531596 - DNA, 25 bp, Rattus norvegicus
caacatcgtgctcttcagcggcagc

SEQ ID NO: 531597 - DNA, 25 bp, Rattus norvegicus
agcggcagctctcaccaggacctgt

SEQ ID NO: 531598 - DNA, 25 bp, Rattus norvegicus
tcaccaggacctgtcgcagcgcgtg

SEQ ID NO: 531599 - DNA, 25 bp, Rattus norvegicus
agctgggcaaggtggtcaccaagaa

SEQ ID NO: 531600 - DNA, 25 bp, Rattus norvegicus
cgggatggcaacaagctgctgcaga

SEQ ID NO: 531601 - DNA, 25 bp, Rattus norvegicus
agtttagcaaccaggagaccaggtg

SEQ ID NO: 531602 - DNA, 25 bp, Rattus norvegicus
caggagaccaggtgggagcttcact

SEQ ID NO: 531603 - DNA, 25 bp, Rattus norvegicus
ggtcaccctagagtctctgcgcgcg

SEQ ID NO: 531604 - DNA, 25 bp, Rattus norvegicus
cgtgctctcccttccggggcgggat

SEQ ID NO: 531605 - DNA, 25 bp, Rattus norvegicus
gtcgcggtcgctttctccttctctg

SEQ ID NO: 531606 - DNA, 25 bp, Rattus norvegicus
tgtcgcagcgcgtggccgatcgcct

SEQ ID NO: 531607 - DNA, 25 bp, Rattus norvegicus
gcccgctgccacagagcctgccagc

SEQ ID NO: 531608 - DNA, 25 bp, Rattus norvegicus
ctgaccagcgaagcagagacgaggc

SEQ ID NO: 531609 - DNA, 25 bp, Rattus norvegicus
aggcgggtcccagccagatgtgctc

SEQ ID NO: 531610 - DNA, 25 bp, Rattus norvegicus
ggtcccagccagatgtgctcagccg

SEQ ID NO: 531611 - DNA, 25 bp, Rattus norvegicus
ctcgctggtgcacccgagcgattca

SEQ ID NO: 531612 - DNA, 25 bp, Rattus norvegicus
cccgagcgattcacccagcagagta

SEQ ID NO: 531613 - DNA, 25 bp, Rattus norvegicus
gcgattcacccagcagagtacctcg

SEQ ID NO: 531614 - DNA, 25 bp, Rattus norvegicus
agcagagtacctcgccagggcgccc

SEQ ID NO: 531615 - DNA, 25 bp, Rattus norvegicus
cagccactcacagctccaaacgttc

SEQ ID NO: 531616 - DNA, 25 bp, Rattus norvegicus
gccagctgcgcgcaaaaccaaggtc

SEQ ID NO: 531617 - DNA, 25 bp, Rattus norvegicus
tgcgcgcaaaaccaaggtcctgacc

SEQ ID NO: 531618 - DNA, 25 bp, Rattus norvegicus
ccaaggtcctgaccagcgaagcaga

SEQ ID NO: 531619 - DNA, 25 bp, Rattus norvegicus
agctgcgcgcaaaaccaaggtcctg

SEQ ID NO: 531620 - DNA, 25 bp, Rattus norvegicus
gtcctgaccagcgaagcagagacga

SEQ ID NO: 531621 - DNA, 25 bp, Rattus norvegicus
tttcccttctgagccagggccttga

SEQ ID NO: 531622 - DNA, 25 bp, Rattus norvegicus
ggtggatttcttcaggctttgttta

SEQ ID NO: 531623 - DNA, 25 bp, Rattus norvegicus
tacgtggcggctcaaaaacagcaac

SEQ ID NO: 531624 - DNA, 25 bp, Rattus norvegicus
cagtggaagtccatcctggctcgca

SEQ ID NO: 531625 - DNA, 25 bp, Rattus norvegicus
ccattgcttgtacttcgggccgtta

SEQ ID NO: 531626 - DNA, 25 bp, Rattus norvegicus
gctgaagggccaactcccgtttcca

SEQ ID NO: 531627 - DNA, 25 bp, Rattus norvegicus
agtcgcgccgccattgcttgtactt

SEQ ID NO: 531628 - DNA, 25 bp, Rattus norvegicus
cacgcgctacggatcgctcagagca

SEQ ID NO: 531629 - DNA, 25 bp, Rattus norvegicus
gcgttccgccatttccgttagctcg

SEQ ID NO: 531630 - DNA, 25 bp, Rattus norvegicus
caggcgccatttccagagcacgtca

SEQ ID NO: 531631 - DNA, 25 bp, Rattus norvegicus
accggaatctctctgggcgggctac

SEQ ID NO: 531632 - DNA, 25 bp, Rattus norvegicus
aggctatgtcatccggccctgagaa

SEQ ID NO: 531633 - DNA, 25 bp, Rattus norvegicus
gctcgccggaacgttaggactgata

SEQ ID NO: 531634 - DNA, 25 bp, Rattus norvegicus
gagcacgtcagcgtcaaatcccacg

SEQ ID NO: 531635 - DNA, 25 bp, Rattus norvegicus
ctgcggctacactgcgggcccggag

SEQ ID NO: 531636 - DNA, 25 bp, Rattus norvegicus
cactcggccaccagggtagagatcc

SEQ ID NO: 531637 - DNA, 25 bp, Rattus norvegicus
actcggccaccagggtagagatccg

SEQ ID NO: 531638 - DNA, 25 bp, Rattus norvegicus
tcggccaccagggtagagatccgcg

SEQ ID NO: 531639 - DNA, 25 bp, Rattus norvegicus
cggccaccagggtagagatccgcga

SEQ ID NO: 531640 - DNA, 25 bp, Rattus norvegicus
gccaccagggtagagatccgcgagc

SEQ ID NO: 531641 - DNA, 25 bp, Rattus norvegicus
ccaccagggtagagatccgcgagcg

SEQ ID NO: 531642 - DNA, 25 bp, Rattus norvegicus
caccagggtagagatccgcgagcgc

SEQ ID NO: 531643 - DNA, 25 bp, Rattus norvegicus
tagagatccgcgagcgcgctggccc

SEQ ID NO: 531644 - DNA, 25 bp, Rattus norvegicus
cgctcacctggctcggccggcaggc

SEQ ID NO: 531645 - DNA, 25 bp, Rattus norvegicus
gccccgcagcaaaagtcaggtcgcg

SEQ ID NO: 531646 - DNA, 25 bp, Rattus norvegicus
cccactcggccaccagggtagagat

SEQ ID NO: 531647 - DNA, 25 bp, Rattus norvegicus
ccactcggccaccagggtagagatc

SEQ ID NO: 531648 - DNA, 25 bp, Rattus norvegicus
tgcgggacagggccaggcgcgctca

SEQ ID NO: 531649 - DNA, 25 bp, Rattus norvegicus
ctgggccctgctttaccactctagg

SEQ ID NO: 531650 - DNA, 25 bp, Rattus norvegicus
ccctacagctcttggcctggtgcta

SEQ ID NO: 531651 - DNA, 25 bp, Rattus norvegicus
cctggtcccgccctatgaatttagg

SEQ ID NO: 531652 - DNA, 25 bp, Rattus norvegicus
ttgtacccaggtgtgttggcgaata

SEQ ID NO: 531653 - DNA, 25 bp, Rattus norvegicus
tcactcgggacatatacgcgcgcgc

SEQ ID NO: 531654 - DNA, 25 bp, Rattus norvegicus
ggagcacacacccaatcactcggga

SEQ ID NO: 531655 - DNA, 25 bp, Rattus norvegicus
aaattggcgcgggtctatagacggc

SEQ ID NO: 531656 - DNA, 25 bp, Rattus norvegicus
ccagagctggttaagagcgcgtgca

SEQ ID NO: 531657 - DNA, 25 bp, Rattus norvegicus
tccgatttgagatccggccagagct

SEQ ID NO: 531658 - DNA, 25 bp, Rattus norvegicus
ttggcgaatagctcccaggacgtcc

SEQ ID NO: 531659 - DNA, 25 bp, Rattus norvegicus
cctgctggaagtgctctcgacattc

SEQ ID NO: 531660 - DNA, 25 bp, Rattus norvegicus
gccatattggtccttctgcccaagt

SEQ ID NO: 531661 - DNA, 25 bp, Rattus norvegicus
tgcccaagtcgctccctgctggaag

SEQ ID NO: 531662 - DNA, 25 bp, Rattus norvegicus
caggacgtcctgtgtgtgtctgcaa

SEQ ID NO: 531663 - DNA, 25 bp, Rattus norvegicus
aaactgcttacggagtggccgcttc

SEQ ID NO: 531664 - DNA, 25 bp, Rattus norvegicus
tttcaaactgggaggaagtgcgcgt

SEQ ID NO: 531665 - DNA, 25 bp, Rattus norvegicus
cgccctttcaaactgggaggaagtg

SEQ ID NO: 531666 - DNA, 25 bp, Rattus norvegicus
tattccatccagagtccctcctggg

SEQ ID NO: 531667 - DNA, 25 bp, Rattus norvegicus
cgtttccgtctttattccatccaga

SEQ ID NO: 531668 - DNA, 25 bp, Rattus norvegicus
gcagcgcgccaacccttggcgtgtg

SEQ ID NO: 531669 - DNA, 25 bp, Rattus norvegicus
aacccttggcgtgtgcggttggtca

SEQ ID NO: 531670 - DNA, 25 bp, Rattus norvegicus
acgagctgtggagcagtgaaaactg

SEQ ID NO: 531671 - DNA, 25 bp, Rattus norvegicus
cgcttctggtccttcgtttctcgtt

SEQ ID NO: 531672 - DNA, 25 bp, Rattus norvegicus
ggacttccggcctaagctcgcgcat

SEQ ID NO: 531673 - DNA, 25 bp, Rattus norvegicus
cggagcttctgcttggaaacccgga

SEQ ID NO: 531674 - DNA, 25 bp, Rattus norvegicus
ctcgcgagatgtggatgggacttcc

SEQ ID NO: 531675 - DNA, 25 bp, Rattus norvegicus
taagctcgcgcatgcgtcgcagcgc

SEQ ID NO: 531676 - DNA, 25 bp, Rattus norvegicus
ttggtcagagagacgttcggccagc

SEQ ID NO: 531677 - DNA, 25 bp, Rattus norvegicus
cacccaggtggctcaggtagcgcca

SEQ ID NO: 531678 - DNA, 25 bp, Rattus norvegicus
cacaagtttgcaggtctggcgggca

SEQ ID NO: 531679 - DNA, 25 bp, Rattus norvegicus
gaccctgcttgctacccttcgtagg

SEQ ID NO: 531680 - DNA, 25 bp, Rattus norvegicus
ccctcccgcaatggtctggactggg

SEQ ID NO: 531681 - DNA, 25 bp, Rattus norvegicus
tgggctggccgcttggctcttcgct

SEQ ID NO: 531682 - DNA, 25 bp, Rattus norvegicus
gcaggatagccggtggcacaagttt

SEQ ID NO: 531683 - DNA, 25 bp, Rattus norvegicus
cgcttacccatggttggagactggc

SEQ ID NO: 531684 - DNA, 25 bp, Rattus norvegicus
agcacgatcgcttacccatggttgg

SEQ ID NO: 531685 - DNA, 25 bp, Rattus norvegicus
tggggccagcacgatcgcttaccca

SEQ ID NO: 531686 - DNA, 25 bp, Rattus norvegicus
gcgcacccttgtgcgagacctggga

SEQ ID NO: 531687 - DNA, 25 bp, Rattus norvegicus
ctcaggtagcgccacctgagctggg

SEQ ID NO: 531688 - DNA, 25 bp, Rattus norvegicus
ctggactgggtcacccaggtggctc

SEQ ID NO: 531689 - DNA, 25 bp, Rattus norvegicus
ttagcccgcgccacggtgcagtgta

SEQ ID NO: 531690 - DNA, 25 bp, Rattus norvegicus
ttggctcttcgctcctggccggggt

SEQ ID NO: 531691 - DNA, 25 bp, Rattus norvegicus
ccagtctgttcgtaccacagtcgaa

SEQ ID NO: 531692 - DNA, 25 bp, Rattus norvegicus
acctcccgcggctgtaagcagaatc

SEQ ID NO: 531693 - DNA, 25 bp, Rattus norvegicus
ctccaaagcaccaatcagaagcgtc

SEQ ID NO: 531694 - DNA, 25 bp, Rattus norvegicus
gtagccaatcgcacagaggttctga

SEQ ID NO: 531695 - DNA, 25 bp, Rattus norvegicus
aattcacgtggaagagagacgccca

SEQ ID NO: 531696 - DNA, 25 bp, Rattus norvegicus
ccctactgtctaacgagggagtgta

SEQ ID NO: 531697 - DNA, 25 bp, Rattus norvegicus
agcgagcgcaggagcatgtctccta

SEQ ID NO: 531698 - DNA, 25 bp, Rattus norvegicus
tctcctaagagctgcggaaggtccc

SEQ ID NO: 531699 - DNA, 25 bp, Rattus norvegicus
cctggttgcctagttacggcgtctc

SEQ ID NO: 531700 - DNA, 25 bp, Rattus norvegicus
ttggaaaggacagacgagacacgta

SEQ ID NO: 531701 - DNA, 25 bp, Rattus norvegicus
cagggcgttttccagtctgttcgta

SEQ ID NO: 531702 - DNA, 25 bp, Rattus norvegicus
tacttacccgtgagtcccatggccg

SEQ ID NO: 531703 - DNA, 25 bp, Rattus norvegicus
cgtccagaagggaccgagaacgttg

SEQ ID NO: 531704 - DNA, 25 bp, Rattus norvegicus
acggcgtctcttttcaggaagccca

SEQ ID NO: 531705 - DNA, 25 bp, Rattus norvegicus
aacagcgtgtcaggagccagcccac

SEQ ID NO: 531706 - DNA, 25 bp, Rattus norvegicus
gcgcggaaattgaaatcggtaagta

SEQ ID NO: 531707 - DNA, 25 bp, Rattus norvegicus
ccaccgggatcgagcgcggaaattg

SEQ ID NO: 531708 - DNA, 25 bp, Rattus norvegicus
ccggagctgccgctaaccgggcaag

SEQ ID NO: 531709 - DNA, 25 bp, Rattus norvegicus
gctaaccgggcaagcgcctccaggg

SEQ ID NO: 531710 - DNA, 25 bp, Rattus norvegicus
gcaagcgcctccagggcgggacttc

SEQ ID NO: 531711 - DNA, 25 bp, Rattus norvegicus
ttatggaccaaaagcgggcgggtca

SEQ ID NO: 531712 - DNA, 25 bp, Rattus norvegicus
gtcagaggtcaagatctcgcgtagc

SEQ ID NO: 531713 - DNA, 25 bp, Rattus norvegicus
tcaagatctcgcgtagcggcgtgac

SEQ ID NO: 531714 - DNA, 25 bp, Rattus norvegicus
gtaaccaagctaccctcgcgccgga

SEQ ID NO: 531715 - DNA, 25 bp, Rattus norvegicus
tcgcgccggaaacagcgtgtcagga

SEQ ID NO: 531716 - DNA, 25 bp, Rattus norvegicus
cggagcaaaccggaaccggagctgc

SEQ ID NO: 531717 - DNA, 25 bp, Rattus norvegicus
gtgtcaggagccagcccaccgggat

SEQ ID NO: 531718 - DNA, 25 bp, Rattus norvegicus
gagccggagcgaaccggagcaaacc

SEQ ID NO: 531719 - DNA, 25 bp, Rattus norvegicus
cccgtcgccaggctgttgaagggaa

SEQ ID NO: 531720 - DNA, 25 bp, Rattus norvegicus
ctgtcctggcttcctcagtggcagg

SEQ ID NO: 531721 - DNA, 25 bp, Rattus norvegicus
tccgcactacaaagagctgacttcg

SEQ ID NO: 531722 - DNA, 25 bp, Rattus norvegicus
tgccggcaagaacgagaagccgatt

SEQ ID NO: 531723 - DNA, 25 bp, Rattus norvegicus
tgcaggctaaggatggtccgcacta

SEQ ID NO: 531724 - DNA, 25 bp, Rattus norvegicus
atcagcgaaccacaggtgccgcggg

SEQ ID NO: 531725 - DNA, 25 bp, Rattus norvegicus
ccgtcaaacttgaggcgatcagcga

SEQ ID NO: 531726 - DNA, 25 bp, Rattus norvegicus
gctaccgccgccagaagtgagtttt

SEQ ID NO: 531727 - DNA, 25 bp, Rattus norvegicus
ccgcctctagagtcagcacagttgc

SEQ ID NO: 531728 - DNA, 25 bp, Rattus norvegicus
cttcaacacttacggcggctgcggg

SEQ ID NO: 531729 - DNA, 25 bp, Rattus norvegicus
gagccaacagatcccgccctggagg

SEQ ID NO: 531730 - DNA, 25 bp, Rattus norvegicus
gcctgcgtacttatggccgtgccgc

SEQ ID NO: 531731 - DNA, 25 bp, Rattus norvegicus
agccgattggtcaaatggccacagg

SEQ ID NO: 531732 - DNA, 25 bp, Rattus norvegicus
cctcagcggacttcttcaacactta

SEQ ID NO: 531733 - DNA, 25 bp, Rattus norvegicus
tgctggactgaaaggtactgaaatc

SEQ ID NO: 531734 - DNA, 25 bp, Rattus norvegicus
ttacgtcacaaccagctgaaggcgc

SEQ ID NO: 531735 - DNA, 25 bp, Rattus norvegicus
gctatggaggccgtcctattgaccc

SEQ ID NO: 531736 - DNA, 25 bp, Rattus norvegicus
cgtgtggctatccactctgcagtga

SEQ ID NO: 531737 - DNA, 25 bp, Rattus norvegicus
taaccgcagggaagctgctagctga

SEQ ID NO: 531738 - DNA, 25 bp, Rattus norvegicus
tcataagagcagagcgtcactcgtc

SEQ ID NO: 531739 - DNA, 25 bp, Rattus norvegicus
ctcgtcactcgctggagatccactg

SEQ ID NO: 531740 - DNA, 25 bp, Rattus norvegicus
tcttcaaaacgcctgttcgggtcgc

SEQ ID NO: 531741 - DNA, 25 bp, Rattus norvegicus
tgctctgaagcgcagtcaactgctg

SEQ ID NO: 531742 - DNA, 25 bp, Rattus norvegicus
cgcggcacagggctacctgtttatc

SEQ ID NO: 531743 - DNA, 25 bp, Rattus norvegicus
cgcggagacagacagcttgacctaa

SEQ ID NO: 531744 - DNA, 25 bp, Rattus norvegicus
tacctgtttatcgatcggccgcgga

SEQ ID NO: 531745 - DNA, 25 bp, Rattus norvegicus
ccatggccgaggaagagtctgcctc

SEQ ID NO: 531746 - DNA, 25 bp, Rattus norvegicus
taaagcgccgcttggagaagatccg

SEQ ID NO: 531747 - DNA, 25 bp, Rattus norvegicus
ttcgagagctttggctgaagccact

SEQ ID NO: 531748 - DNA, 25 bp, Rattus norvegicus
gctcctcgacgaactgcgacgcttt

SEQ ID NO: 531749 - DNA, 25 bp, Rattus norvegicus
ccataataggcggacgaggatgaag

SEQ ID NO: 531750 - DNA, 25 bp, Rattus norvegicus
agggacgcgagtagccgccataata

SEQ ID NO: 531751 - DNA, 25 bp, Rattus norvegicus
gatgaagacgcgaacggggcactcc

SEQ ID NO: 531752 - DNA, 25 bp, Rattus norvegicus
actccgctgtgcagaaggccgttct

SEQ ID NO: 531753 - DNA, 25 bp, Rattus norvegicus
cgataagattggtttcgagagcttt

SEQ ID NO: 531754 - DNA, 25 bp, Rattus norvegicus
ctgaagccactcagcgaatggctga

SEQ ID NO: 531755 - DNA, 25 bp, Rattus norvegicus
aggcctcccgtacagggctacgcga

SEQ ID NO: 531756 - DNA, 25 bp, Rattus norvegicus
atggctgaggccattccggtcaccg

SEQ ID NO: 531757 - DNA, 25 bp, Rattus norvegicus
tccggtcaccgaaccgagaacaaga

SEQ ID NO: 531758 - DNA, 25 bp, Rattus norvegicus
ccgagaacaagagcgcgagcgagac

SEQ ID NO: 531759 - DNA, 25 bp, Rattus norvegicus
gaagatttgatggatttggggctcc

SEQ ID NO: 531760 - DNA, 25 bp, Rattus norvegicus
aggccgttctcgagaacgcgatcga

SEQ ID NO: 531761 - DNA, 25 bp, Rattus norvegicus
gacgactaccgcaggatgtgtacga

SEQ ID NO: 531762 - DNA, 25 bp, Rattus norvegicus
ctttagtggcctgaaccgcggcttt

SEQ ID NO: 531763 - DNA, 25 bp, Rattus norvegicus
tttatcggacgactaccgcaggatg

SEQ ID NO: 531764 - DNA, 25 bp, Rattus norvegicus
cgaagtaccgagaagtgcgagctga

SEQ ID NO: 531765 - DNA, 25 bp, Rattus norvegicus
taccgcaggatgtgtacgagcacca

SEQ ID NO: 531766 - DNA, 25 bp, Rattus norvegicus
tccgcctaatgatgacctttagtgg

SEQ ID NO: 531767 - DNA, 25 bp, Rattus norvegicus
aagtaccgagaagtgcgagctgacg

SEQ ID NO: 531768 - DNA, 25 bp, Rattus norvegicus
gccttcttgccagctcctggtatgc

SEQ ID NO: 531769 - DNA, 25 bp, Rattus norvegicus
tgcggccttcttgccagctcctggt

SEQ ID NO: 531770 - DNA, 25 bp, Rattus norvegicus
cattgctacgctgcacaaccaccag

SEQ ID NO: 531771 - DNA, 25 bp, Rattus norvegicus
tgcgcgctacagctcacggcgcggt

SEQ ID NO: 531772 - DNA, 25 bp, Rattus norvegicus
tatgcgcgctacagctcacggcgcg

SEQ ID NO: 531773 - DNA, 25 bp, Rattus norvegicus
cctaatgatgacctttagtggcctg

SEQ ID NO: 531774 - DNA, 25 bp, Rattus norvegicus
agttccgcctaatgatgacctttag

SEQ ID NO: 531775 - DNA, 25 bp, Rattus norvegicus
gaatccagagcggagaggcacaccc

SEQ ID NO: 531776 - DNA, 25 bp, Rattus norvegicus
agagactccgacagagcactgggca

SEQ ID NO: 531777 - DNA, 25 bp, Rattus norvegicus
cgggtctccacaaagcagagaaaaa

SEQ ID NO: 531778 - DNA, 25 bp, Rattus norvegicus
atcgcctaggttttcgaacactacg

SEQ ID NO: 531779 - DNA, 25 bp, Rattus norvegicus
ccactggatcgcctaggttttcgaa

SEQ ID NO: 531780 - DNA, 25 bp, Rattus norvegicus
tccgacagagcactgggcactagtg

SEQ ID NO: 531781 - DNA, 25 bp, Rattus norvegicus
actagccacctccaggcgagagact

SEQ ID NO: 531782 - DNA, 25 bp, Rattus norvegicus
ggtcactagccacctccaggcgaga

SEQ ID NO: 531783 - DNA, 25 bp, Rattus norvegicus
ttggatcccgggtcactagccacct

SEQ ID NO: 531784 - DNA, 25 bp, Rattus norvegicus
tgtcggtttggatcccgggtcacta

SEQ ID NO: 531785 - DNA, 25 bp, Rattus norvegicus
cacaccccagggacgtgtcggtttg

SEQ ID NO: 531786 - DNA, 25 bp, Rattus norvegicus
cagagaaaaatagggcttggggcgc

SEQ ID NO: 531787 - DNA, 25 bp, Rattus norvegicus
gccatctcgggtctccacaaagcag

SEQ ID NO: 531788 - DNA, 25 bp, Rattus norvegicus
aaggcccactggatcgcctaggttt

SEQ ID NO: 531789 - DNA, 25 bp, Rattus norvegicus
ggggacagaagcgagctccactccg

SEQ ID NO: 531790 - DNA, 25 bp, Rattus norvegicus
cgggcaagaaacttccctcgcaggc

SEQ ID NO: 531791 - DNA, 25 bp, Rattus norvegicus
gccgcgcgcagacaatagctggcga

SEQ ID NO: 531792 - DNA, 25 bp, Rattus norvegicus
cctcggaggatcgatcgcccagatc

SEQ ID NO: 531793 - DNA, 25 bp, Rattus norvegicus
gcagaaatttaatccgctcgcgggc

SEQ ID NO: 531794 - DNA, 25 bp, Rattus norvegicus
aggtagttgcccacgcgcttgtgat

SEQ ID NO: 531795 - DNA, 25 bp, Rattus norvegicus
tccgcagcctgagcactttcaaatc

SEQ ID NO: 531796 - DNA, 25 bp, Rattus norvegicus
agccgaactcgaccctcgctggaga

SEQ ID NO: 531797 - DNA, 25 bp, Rattus norvegicus
cttcctgctgccgatgaggtagttg

SEQ ID NO: 531798 - DNA, 25 bp, Rattus norvegicus
gagcctgagtgtgcgtctagctaca

SEQ ID NO: 531799 - DNA, 25 bp, Rattus norvegicus
tctagctacactgggttggaaaacc

SEQ ID NO: 531800 - DNA, 25 bp, Rattus norvegicus
aaaaccaggctgagtgctcgcggga

SEQ ID NO: 531801 - DNA, 25 bp, Rattus norvegicus
tcgcgggacagtgctcccgagtcct

SEQ ID NO: 531802 - DNA, 25 bp, Rattus norvegicus
acgcgcttgtgatgctggaagtccc

SEQ ID NO: 531803 - DNA, 25 bp, Rattus norvegicus
acaagctgtcgtcgggagccgcgcc

SEQ ID NO: 531804 - DNA, 25 bp, Rattus norvegicus
ccgcccagcggggacaagctgtcgt

SEQ ID NO: 531805 - DNA, 25 bp, Rattus norvegicus
ggttccggctagtctccctcgaaga

SEQ ID NO: 531806 - DNA, 25 bp, Rattus norvegicus
acgtgacgcatgcgcggccagctga

SEQ ID NO: 531807 - DNA, 25 bp, Rattus norvegicus
ggagccgcgcctcctgagaagagct

SEQ ID NO: 531808 - DNA, 25 bp, Rattus norvegicus
tctccctcgaagaccaacagtcagg

SEQ ID NO: 531809 - DNA, 25 bp, Rattus norvegicus
atgttccgagggttgagcagttggt

SEQ ID NO: 531810 - DNA, 25 bp, Rattus norvegicus
ttaacggtgccagggctcttgagtg

SEQ ID NO: 531811 - DNA, 25 bp, Rattus norvegicus
accgttaacggtgccagggctcttg

SEQ ID NO: 531812 - DNA, 25 bp, Rattus norvegicus
caacagtcaggtcacccaaccgtta

SEQ ID NO: 531813 - DNA, 25 bp, Rattus norvegicus
tctagctccggttccggctagtctc

SEQ ID NO: 531814 - DNA, 25 bp, Rattus norvegicus
cagttggttgggcttgaagcagcct

SEQ ID NO: 531815 - DNA, 25 bp, Rattus norvegicus
atcggaggtctagctccggttccgg

SEQ ID NO: 531816 - DNA, 25 bp, Rattus norvegicus
cggctggcatcggaggtctagctcc

SEQ ID NO: 531817 - DNA, 25 bp, Rattus norvegicus
gcagtaagataacagcgcaggagtc

SEQ ID NO: 531818 - DNA, 25 bp, Rattus norvegicus
cagagctgaggctgttgcgcagtaa

SEQ ID NO: 531819 - DNA, 25 bp, Rattus norvegicus
tacaggatcgccctcctggtgttgg

SEQ ID NO: 531820 - DNA, 25 bp, Rattus norvegicus
gtctcagcctgtgtggtcactgtga

SEQ ID NO: 531821 - DNA, 25 bp, Rattus norvegicus
gtcgtcaggtgttgtgtctcagcct

SEQ ID NO: 531822 - DNA, 25 bp, Rattus norvegicus
tcctttcagaagagtgacgatagtt

SEQ ID NO: 531823 - DNA, 25 bp, Rattus norvegicus
cgctacgattggttggtgtgtaaaa

SEQ ID NO: 531824 - DNA, 25 bp, Rattus norvegicus
gtcactgtgactgggactccgctgt

SEQ ID NO: 531825 - DNA, 25 bp, Rattus norvegicus
tggaaagactctcacgctacgattg

SEQ ID NO: 531826 - DNA, 25 bp, Rattus norvegicus
taccttaagctgtgggacgaacatc

SEQ ID NO: 531827 - DNA, 25 bp, Rattus norvegicus
gtgcctctggtccagccgcttgttt

SEQ ID NO: 531828 - DNA, 25 bp, Rattus norvegicus
gcttgtttggctgctgccgtcacct

SEQ ID NO: 531829 - DNA, 25 bp, Rattus norvegicus
tcacctcatggcgactcggcttgag

SEQ ID NO: 531830 - DNA, 25 bp, Rattus norvegicus
cgcagggatgattaggttacccttt

SEQ ID NO: 531831 - DNA, 25 bp, Rattus norvegicus
cgcactcctagctcggaaagcctga

SEQ ID NO: 531832 - DNA, 25 bp, Rattus norvegicus
tcgaccaatagcgtgcaacgggtgg

SEQ ID NO: 531833 - DNA, 25 bp, Rattus norvegicus
gcgtaagaagaatccgctgcgttta

SEQ ID NO: 531834 - DNA, 25 bp, Rattus norvegicus
gaagtgctctcagccctcggcgagc

SEQ ID NO: 531835 - DNA, 25 bp, Rattus norvegicus
actcgccatcttgcgtcgggtcgtt

SEQ ID NO: 531836 - DNA, 25 bp, Rattus norvegicus
ctcggacttctctcgctagtcaaga

SEQ ID NO: 531837 - DNA, 25 bp, Rattus norvegicus
tagtcaagagcagcccgatcgcagg

SEQ ID NO: 531838 - DNA, 25 bp, Rattus norvegicus
ccgagacggactaagaacaggcgta

SEQ ID NO: 531839 - DNA, 25 bp, Rattus norvegicus
aaagcctgagctcggtctggctgtc

SEQ ID NO: 531840 - DNA, 25 bp, Rattus norvegicus
gcgaggtctgagacgctctcctctc

SEQ ID NO: 531841 - DNA, 25 bp, Rattus norvegicus
tggaacgagacttttcaacccgcgc

SEQ ID NO: 531842 - DNA, 25 bp, Rattus norvegicus
aacggctcggatacctcgaccaata

SEQ ID NO: 531843 - DNA, 25 bp, Rattus norvegicus
caacgggtgggtctttcgcgatctt

SEQ ID NO: 531844 - DNA, 25 bp, Rattus norvegicus
ggcgcatccgccctgggaaactgga

SEQ ID NO: 531845 - DNA, 25 bp, Rattus norvegicus
cggagttgtgttccttacctggcaa

SEQ ID NO: 531846 - DNA, 25 bp, Rattus norvegicus
ccaggtgggattctgggctgtgatt

SEQ ID NO: 531847 - DNA, 25 bp, Rattus norvegicus
tcagtgccgcgcctgtctccatgtg

SEQ ID NO: 531848 - DNA, 25 bp, Rattus norvegicus
tgattggtcagtgccgcgcctgtct

SEQ ID NO: 531849 - DNA, 25 bp, Rattus norvegicus
gctgtgattggtcagtgccgcgcct

SEQ ID NO: 531850 - DNA, 25 bp, Rattus norvegicus
tccttacctggcaaaagggcggagc

SEQ ID NO: 531851 - DNA, 25 bp, Rattus norvegicus
tgtgttccttacctggcaaaagggc

SEQ ID NO: 531852 - DNA, 25 bp, Rattus norvegicus
gagttgtgttccttacctggcaaaa

SEQ ID NO: 531853 - DNA, 25 bp, Rattus norvegicus
cgactgcagagcaggtgaaaggctt

SEQ ID NO: 531854 - DNA, 25 bp, Rattus norvegicus
ggcctcgactgcagagcaggtgaaa

SEQ ID NO: 531855 - DNA, 25 bp, Rattus norvegicus
cccggcctcgactgcagagcaggtg

SEQ ID NO: 531856 - DNA, 25 bp, Rattus norvegicus
cgggcggagttgtgttccttacctg

SEQ ID NO: 531857 - DNA, 25 bp, Rattus norvegicus
gagggcgttggcagctgctctcccc

SEQ ID NO: 531858 - DNA, 25 bp, Rattus norvegicus
gaacagcgtgggcttggagggcgtt

SEQ ID NO: 531859 - DNA, 25 bp, Rattus norvegicus
gctactctgagctcttcgcgcgctg

SEQ ID NO: 531860 - DNA, 25 bp, Rattus norvegicus
tctatgggaagaatggagcaacaac

SEQ ID NO: 531861 - DNA, 25 bp, Rattus norvegicus
cacgggtctgtgtggacgtgtctat

SEQ ID NO: 531862 - DNA, 25 bp, Rattus norvegicus
tgcgctcttttatccctcacgggtc

SEQ ID NO: 531863 - DNA, 25 bp, Rattus norvegicus
ccaggtatgcctctgcgctctttta

SEQ ID NO: 531864 - DNA, 25 bp, Rattus norvegicus
ccggagacattgcaccaggtatgcc

SEQ ID NO: 531865 - DNA, 25 bp, Rattus norvegicus
cgtcgcagctgccaccggagacatt

SEQ ID NO: 531866 - DNA, 25 bp, Rattus norvegicus
ccgatctgtttcgagcgtcgcagct

SEQ ID NO: 531867 - DNA, 25 bp, Rattus norvegicus
gtccggtagccgatctgtttcgagc

SEQ ID NO: 531868 - DNA, 25 bp, Rattus norvegicus
ttcgcgcgctgtgcaggcgctgcaa

SEQ ID NO: 531869 - DNA, 25 bp, Rattus norvegicus
tggagcaacaacgactattcccggg

SEQ ID NO: 531870 - DNA, 25 bp, Rattus norvegicus
atagcgagcagcagtgctactctga

SEQ ID NO: 531871 - DNA, 25 bp, Rattus norvegicus
cgttgctgctgagcgatagcgagca

SEQ ID NO: 531872 - DNA, 25 bp, Rattus norvegicus
tggcattctcactgcggccgctggt

SEQ ID NO: 531873 - DNA, 25 bp, Rattus norvegicus
cagcagagcaggatcagcagccacc

SEQ ID NO: 531874 - DNA, 25 bp, Rattus norvegicus
ttccaggagctcgagagcgacatcc

SEQ ID NO: 531875 - DNA, 25 bp, Rattus norvegicus
cccatttatataggcggcggcagtg

SEQ ID NO: 531876 - DNA, 25 bp, Rattus norvegicus
cagaagcgatggagctgagccgact

SEQ ID NO: 531877 - DNA, 25 bp, Rattus norvegicus
ggacccaagcacagctcgagatttc

SEQ ID NO: 531878 - DNA, 25 bp, Rattus norvegicus
tcgagatttctttgcccagcgcttg

SEQ ID NO: 531879 - DNA, 25 bp, Rattus norvegicus
cccagcgcttgtcatctttcctaga

SEQ ID NO: 531880 - DNA, 25 bp, Rattus norvegicus
tgctcccggaggtcagactaagctg

SEQ ID NO: 531881 - DNA, 25 bp, Rattus norvegicus
tcagcgtctctggactgcccagatc

SEQ ID NO: 531882 - DNA, 25 bp, Rattus norvegicus
agatcgatccttgccggactcctgc

SEQ ID NO: 531883 - DNA, 25 bp, Rattus norvegicus
gcgccaggtccctagctcacaaggg

SEQ ID NO: 531884 - DNA, 25 bp, Rattus norvegicus
cttatgctagacctgtgcgcggtca

SEQ ID NO: 531885 - DNA, 25 bp, Rattus norvegicus
agccgaggctgtgctacttatgcta

SEQ ID NO: 531886 - DNA, 25 bp, Rattus norvegicus
tgcctttcgccaagcggatcgtgga

SEQ ID NO: 531887 - DNA, 25 bp, Rattus norvegicus
cggtcgcgctatcgcacaggtacaa

SEQ ID NO: 531888 - DNA, 25 bp, Rattus norvegicus
gggccaggcactcgatcccagcgtg

SEQ ID NO: 531889 - DNA, 25 bp, Rattus norvegicus
gctgtaaatcgaagctgtctacggc

SEQ ID NO: 531890 - DNA, 25 bp, Rattus norvegicus
cattcactgggctgtaaatcgaagc

SEQ ID NO: 531891 - DNA, 25 bp, Rattus norvegicus
tttggctgccgcagtccgtcccatt

SEQ ID NO: 531892 - DNA, 25 bp, Rattus norvegicus
tgcagccttgcctgctgcccgggag

SEQ ID NO: 531893 - DNA, 25 bp, Rattus norvegicus
agccaggcggctgtctgcgaagcat

SEQ ID NO: 531894 - DNA, 25 bp, Rattus norvegicus
attctttctatcctggttctctcta

SEQ ID NO: 531895 - DNA, 25 bp, Rattus norvegicus
cagcaggggacagattctttctatc

SEQ ID NO: 531896 - DNA, 25 bp, Rattus norvegicus
agccctcagctcgtggaagcgcaca

SEQ ID NO: 531897 - DNA, 25 bp, Rattus norvegicus
caagaaatccggatccgggatcctc

SEQ ID NO: 531898 - DNA, 25 bp, Rattus norvegicus
cgcacaggtacaagaaatccggatc

SEQ ID NO: 531899 - DNA, 25 bp, Rattus norvegicus
gaaactggagatgttagcggagcca

SEQ ID NO: 531900 - DNA, 25 bp, Rattus norvegicus
tgcgaagcattggtgcagccttgcc

SEQ ID NO: 531901 - DNA, 25 bp, Rattus norvegicus
ttctgtcatgctagctccgggagca

SEQ ID NO: 531902 - DNA, 25 bp, Rattus norvegicus
tgggctccgtctccagttccaaggg

SEQ ID NO: 531903 - DNA, 25 bp, Rattus norvegicus
agggccaccacgcaccactagtctc

SEQ ID NO: 531904 - DNA, 25 bp, Rattus norvegicus
aacacttctgtcatgctagctccgg

SEQ ID NO: 531905 - DNA, 25 bp, Rattus norvegicus
ctagctccgggagcagggaccagac

SEQ ID NO: 531906 - DNA, 25 bp, Rattus norvegicus
cagggaccagacttcacgttgcagc

SEQ ID NO: 531907 - DNA, 25 bp, Rattus norvegicus
cttcacgttgcagccgccatttttg

SEQ ID NO: 531908 - DNA, 25 bp, Rattus norvegicus
gcagccgccatttttgagaagccgc

SEQ ID NO: 531909 - DNA, 25 bp, Rattus norvegicus
ggactccaacatctgggctccgtct

SEQ ID NO: 531910 - DNA, 25 bp, Rattus norvegicus
gtccgccttgcaggctgccatcagg

SEQ ID NO: 531911 - DNA, 25 bp, Rattus norvegicus
gcaggctgccatcaggactccaaca

SEQ ID NO: 531912 - DNA, 25 bp, Rattus norvegicus
tccacccgagcaaaaacacttctgt

SEQ ID NO: 531913 - DNA, 25 bp, Rattus norvegicus
tgccatcaggactccaacatctggg

SEQ ID NO: 531914 - DNA, 25 bp, Rattus norvegicus
gggcgttcccagatcaggacttgcc

SEQ ID NO: 531915 - DNA, 25 bp, Rattus norvegicus
gccaaaggggacgataggcaagatc

SEQ ID NO: 531916 - DNA, 25 bp, Rattus norvegicus
gtgaaaccgggtgccttgaactctc

SEQ ID NO: 531917 - DNA, 25 bp, Rattus norvegicus
ctcgcgagatctcggggagcccaat

SEQ ID NO: 531918 - DNA, 25 bp, Rattus norvegicus
ctcggcttatcactagggctatttg

SEQ ID NO: 531919 - DNA, 25 bp, Rattus norvegicus
cggagctcctgagggctctacccta

SEQ ID NO: 531920 - DNA, 25 bp, Rattus norvegicus
ctagagtcataggtgcccggcgtaa

SEQ ID NO: 531921 - DNA, 25 bp, Rattus norvegicus
gtaacggcttagcagctgtgccacc

SEQ ID NO: 531922 - DNA, 25 bp, Rattus norvegicus
gctcttaagagcgtcaccgtggcca

SEQ ID NO: 531923 - DNA, 25 bp, Rattus norvegicus
gtcaccgtggccatgaaggaagaaa

SEQ ID NO: 531924 - DNA, 25 bp, Rattus norvegicus
taggcctaaggagaaacgagtgacc

SEQ ID NO: 531925 - DNA, 25 bp, Rattus norvegicus
aacgagtgaccctgttaacgcctca

SEQ ID NO: 531926 - DNA, 25 bp, Rattus norvegicus
ctacaggcggctgcattggagctac

SEQ ID NO: 531927 - DNA, 25 bp, Rattus norvegicus
tggagctaccgcagaaggcgccaaa

SEQ ID NO: 531928 - DNA, 25 bp, Rattus norvegicus
agttgctaatgacgcgctaaggggc

SEQ ID NO: 531929 - DNA, 25 bp, Rattus norvegicus
tcctcgggctgacagttctttgctc

SEQ ID NO: 531930 - DNA, 25 bp, Rattus norvegicus
cggtttgcacgcgtccagctgctgt

SEQ ID NO: 531931 - DNA, 25 bp, Rattus norvegicus
aggctgccgcggtttgcacgcgtcc

SEQ ID NO: 531932 - DNA, 25 bp, Rattus norvegicus
tgccgcggtttgcacgcgtccagct

SEQ ID NO: 531933 - DNA, 25 bp, Rattus norvegicus
tccagctgctgtgtaaggaatcctc

SEQ ID NO: 531934 - DNA, 25 bp, Rattus norvegicus
cagctgctgtgtaaggaatcctcgg

SEQ ID NO: 531935 - DNA, 25 bp, Rattus norvegicus
ctgctgtgtaaggaatcctcgggct

SEQ ID NO: 531936 - DNA, 25 bp, Rattus norvegicus
ctgtgtaaggaatcctcgggctgac

SEQ ID NO: 531937 - DNA, 25 bp, Rattus norvegicus
gtaaggaatcctcgggctgacagtt

SEQ ID NO: 531938 - DNA, 25 bp, Rattus norvegicus
aatcctcgggctgacagttctttgc

SEQ ID NO: 531939 - DNA, 25 bp, Rattus norvegicus
cgggctgacagttctttgctcttaa

SEQ ID NO: 531940 - DNA, 25 bp, Rattus norvegicus
gctgacagttctttgctcttaagtc

SEQ ID NO: 531941 - DNA, 25 bp, Rattus norvegicus
acagttctttgctcttaagtcaccc

SEQ ID NO: 531942 - DNA, 25 bp, Rattus norvegicus
ggaatcctcgggctgacagttcttt

SEQ ID NO: 531943 - DNA, 25 bp, Rattus norvegicus
gagataagccatccttcgtccttta

SEQ ID NO: 531944 - DNA, 25 bp, Rattus norvegicus
ggactcccgcccgaaatgtgctccc

SEQ ID NO: 531945 - DNA, 25 bp, Rattus norvegicus
tattttcaagcagcgcccggactcc

SEQ ID NO: 531946 - DNA, 25 bp, Rattus norvegicus
cacgcacagctgcaacagttaggca

SEQ ID NO: 531947 - DNA, 25 bp, Rattus norvegicus
cccagggaatcgcaggctgcgagat

SEQ ID NO: 531948 - DNA, 25 bp, Rattus norvegicus
gcaggctgcgagatgaacgtgcata

SEQ ID NO: 531949 - DNA, 25 bp, Rattus norvegicus
cctttattttcaagcagcgcccgga

SEQ ID NO: 531950 - DNA, 25 bp, Rattus norvegicus
gcgcgtgcacgcacagctgcaacag

SEQ ID NO: 531951 - DNA, 25 bp, Rattus norvegicus
agccatccttcgtcctttattttca

SEQ ID NO: 531952 - DNA, 25 bp, Rattus norvegicus
cagttaggcagcagcaatggacttc

SEQ ID NO: 531953 - DNA, 25 bp, Rattus norvegicus
ggcagcagcaatggacttcgttatc

SEQ ID NO: 531954 - DNA, 25 bp, Rattus norvegicus
cagcaatggacttcgttatcatttt

SEQ ID NO: 531955 - DNA, 25 bp, Rattus norvegicus
ttaaacctacgaccgagataagcca

SEQ ID NO: 531956 - DNA, 25 bp, Rattus norvegicus
cgagatgaacgtgcatatgaatgtg

SEQ ID NO: 531957 - DNA, 25 bp, Rattus norvegicus
ctctcgcttgctctggaagccttta

SEQ ID NO: 531958 - DNA, 25 bp, Rattus norvegicus
ccaggtagtggatcttgtagaactc

SEQ ID NO: 531959 - DNA, 25 bp, Rattus norvegicus
agaactccagcaaggccggcaaatg

SEQ ID NO: 531960 - DNA, 25 bp, Rattus norvegicus
ttctcggacacggacagtacatagt

SEQ ID NO: 531961 - DNA, 25 bp, Rattus norvegicus
ccggcaaatggtcaaactcctggtc

SEQ ID NO: 531962 - DNA, 25 bp, Rattus norvegicus
agtcccggactaggaacatgccatg

SEQ ID NO: 531963 - DNA, 25 bp, Rattus norvegicus
aagggcctcttctcgaacacttcga

SEQ ID NO: 531964 - DNA, 25 bp, Rattus norvegicus
agggcttggtcaggacgttcctcta

SEQ ID NO: 531965 - DNA, 25 bp, Rattus norvegicus
tccggagtaggatccagcgacttct

SEQ ID NO: 531966 - DNA, 25 bp, Rattus norvegicus
cttggtccagcgtactctatctgcg

SEQ ID NO: 531967 - DNA, 25 bp, Rattus norvegicus
ggggctcttcctttgacgtcactgg

SEQ ID NO: 531968 - DNA, 25 bp, Rattus norvegicus
gggttccagcctaagccactcgtgc

SEQ ID NO: 531969 - DNA, 25 bp, Rattus norvegicus
cgctggttcgattaaggtggtagta

SEQ ID NO: 531970 - DNA, 25 bp, Rattus norvegicus
tctgaagaatcaaacctggcggagg

SEQ ID NO: 531971 - DNA, 25 bp, Rattus norvegicus
gggaagcccttttctgctagcgcca

SEQ ID NO: 531972 - DNA, 25 bp, Rattus norvegicus
acccgcaggcagctttgactcgcag

SEQ ID NO: 531973 - DNA, 25 bp, Rattus norvegicus
gctagacttacggtaggtcgcggtc

SEQ ID NO: 531974 - DNA, 25 bp, Rattus norvegicus
ggggcggtgcaatcatcaaattagg

SEQ ID NO: 531975 - DNA, 25 bp, Rattus norvegicus
tcaaattaggctgcgcgtttgctcc

SEQ ID NO: 531976 - DNA, 25 bp, Rattus norvegicus
cggaggtttcgattacttgtcgcta

SEQ ID NO: 531977 - DNA, 25 bp, Rattus norvegicus
tgtcgctaccgctagggagaaggta

SEQ ID NO: 531978 - DNA, 25 bp, Rattus norvegicus
ccgtgtgtccactagcttgccttta

SEQ ID NO: 531979 - DNA, 25 bp, Rattus norvegicus
agtcggtccacttaggagggtgaca

SEQ ID NO: 531980 - DNA, 25 bp, Rattus norvegicus
caagctggagtctccctcggcgatc

SEQ ID NO: 531981 - DNA, 25 bp, Rattus norvegicus
ctcagtagggtgagtagttgcgtcc

SEQ ID NO: 531982 - DNA, 25 bp, Rattus norvegicus
gctggggctggaatttttggtacca

SEQ ID NO: 531983 - DNA, 25 bp, Rattus norvegicus
cgagtctctagggtcttcccggaag

SEQ ID NO: 531984 - DNA, 25 bp, Rattus norvegicus
tcggcgatccaccacgagtctctag

SEQ ID NO: 531985 - DNA, 25 bp, Rattus norvegicus
tgcaaggcgagccaaccagagtttc

SEQ ID NO: 531986 - DNA, 25 bp, Rattus norvegicus
gaacggagtcctttggtcacggcca

SEQ ID NO: 531987 - DNA, 25 bp, Rattus norvegicus
aatcccacccggaaggcacgcgttg

SEQ ID NO: 531988 - DNA, 25 bp, Rattus norvegicus
agaattgctcctgctccgcatctcg

SEQ ID NO: 531989 - DNA, 25 bp, Rattus norvegicus
cccgctggtgtccaacagagttgcc

SEQ ID NO: 531990 - DNA, 25 bp, Rattus norvegicus
cagagttgccgtctccaagctggcc

SEQ ID NO: 531991 - DNA, 25 bp, Rattus norvegicus
ggcctggtcctcaaaacactcagct

SEQ ID NO: 531992 - DNA, 25 bp, Rattus norvegicus
ggagcttggctctgaacggaaattc

SEQ ID NO: 531993 - DNA, 25 bp, Rattus norvegicus
ccgagggtttctagacccacagcca

SEQ ID NO: 531994 - DNA, 25 bp, Rattus norvegicus
cccggactaagcactaggccagaga

SEQ ID NO: 531995 - DNA, 25 bp, Rattus norvegicus
tccgcctaaggggagactatctaaa

SEQ ID NO: 531996 - DNA, 25 bp, Rattus norvegicus
tgtcgctgcctgatctgggaaaaaa

SEQ ID NO: 531997 - DNA, 25 bp, Rattus norvegicus
agaccggctcacaccacgaagagga

SEQ ID NO: 531998 - DNA, 25 bp, Rattus norvegicus
caatcgccgcggatgctaaaggaac

SEQ ID NO: 531999 - DNA, 25 bp, Rattus norvegicus
ctaagaggccacgtaagacgaaata

SEQ ID NO: 532000 - DNA, 25 bp, Rattus norvegicus
taaagagctcccagtcccgggagtc

SEQ ID NO: 532001 - DNA, 25 bp, Rattus norvegicus
cgttccgactccgtcactgcgttta

SEQ ID NO: 532002 - DNA, 25 bp, Rattus norvegicus
gactccgggcgcctcaaggagactt

SEQ ID NO: 532003 - DNA, 25 bp, Rattus norvegicus
gggtcgcccgaatcactccttttga

SEQ ID NO: 532004 - DNA, 25 bp, Rattus norvegicus
tctgctgcgctccatgaggaagatg

SEQ ID NO: 532005 - DNA, 25 bp, Rattus norvegicus
gcgggcaatcattctggttggtcta

SEQ ID NO: 532006 - DNA, 25 bp, Rattus norvegicus
aggaagatgcttgccgctgtgtccc

SEQ ID NO: 532007 - DNA, 25 bp, Rattus norvegicus
gcccgttgcttacggggcactgaga

SEQ ID NO: 532008 - DNA, 25 bp, Rattus norvegicus
cggagcttgggttcgctccaacctc

SEQ ID NO: 532009 - DNA, 25 bp, Rattus norvegicus
tccaacctctcgactcggatgactt

SEQ ID NO: 532010 - DNA, 25 bp, Rattus norvegicus
catcatgtcattgctcttggctaag

SEQ ID NO: 532011 - DNA, 25 bp, Rattus norvegicus
aggtttcgtgcgtactccgacttca

SEQ ID NO: 532012 - DNA, 25 bp, Rattus norvegicus
cggatgacttccactctccatcatg

SEQ ID NO: 532013 - DNA, 25 bp, Rattus norvegicus
gggctccgcagggacactaaagcaa

SEQ ID NO: 532014 - DNA, 25 bp, Rattus norvegicus
ctctacacagaagggctgaaggttc

SEQ ID NO: 532015 - DNA, 25 bp, Rattus norvegicus
acccattggcgccaagccgagctga

SEQ ID NO: 532016 - DNA, 25 bp, Rattus norvegicus
gccgagctgagtcgccaaagcagag

SEQ ID NO: 532017 - DNA, 25 bp, Rattus norvegicus
aagcagagtgaaagttggcggaacc

SEQ ID NO: 532018 - DNA, 25 bp, Rattus norvegicus
cggcttcttcctcagcggcggtggt

SEQ ID NO: 532019 - DNA, 25 bp, Rattus norvegicus
ctccgggtttcctgctctccgaaag

SEQ ID NO: 532020 - DNA, 25 bp, Rattus norvegicus
cctgctctccgaaagtggaaattgc

SEQ ID NO: 532021 - DNA, 25 bp, Rattus norvegicus
ggactcctgggcttgtcctctgttg

SEQ ID NO: 532022 - DNA, 25 bp, Rattus norvegicus
tgtcccagcctgagctcggcagcgg

SEQ ID NO: 532023 - DNA, 25 bp, Rattus norvegicus
tgccgcgagactcctcgagactgga

SEQ ID NO: 532024 - DNA, 25 bp, Rattus norvegicus
cacgtggaaaaggtggatcgaaagc

SEQ ID NO: 532025 - DNA, 25 bp, Rattus norvegicus
gccgaccctctacacagaagggctg

SEQ ID NO: 532026 - DNA, 25 bp, Rattus norvegicus
ctaaagcaagtgagagtgaatcggg

SEQ ID NO: 532027 - DNA, 25 bp, Rattus norvegicus
cgcgggccgaagaccaggaaccact

SEQ ID NO: 532028 - DNA, 25 bp, Rattus norvegicus
ggctcctgcagctagagcatctctc

SEQ ID NO: 532029 - DNA, 25 bp, Rattus norvegicus
tgaatccctggagagacaccgcacg

SEQ ID NO: 532030 - DNA, 25 bp, Rattus norvegicus
agacaccgcacgagactggcacctg

SEQ ID NO: 532031 - DNA, 25 bp, Rattus norvegicus
tgggacagccttggaacctgagaga

SEQ ID NO: 532032 - DNA, 25 bp, Rattus norvegicus
cctgagagaaaagccaagcgcgcgc

SEQ ID NO: 532033 - DNA, 25 bp, Rattus norvegicus
tgcggtaccctgaaaagccaagtcc

SEQ ID NO: 532034 - DNA, 25 bp, Rattus norvegicus
agcgggctctctagcgccttttgct

SEQ ID NO: 532035 - DNA, 25 bp, Rattus norvegicus
gcatctctcgcggacaaagcccgga

SEQ ID NO: 532036 - DNA, 25 bp, Rattus norvegicus
ttccttccggaatggtctggtccca

SEQ ID NO: 532037 - DNA, 25 bp, Rattus norvegicus
atagccgtcgctgtcgcccaaggct

SEQ ID NO: 532038 - DNA, 25 bp, Rattus norvegicus
tgagaaccgccactcacgggcgaaa

SEQ ID NO: 532039 - DNA, 25 bp, Rattus norvegicus
cagggaagttgtcaccatagccgtc

SEQ ID NO: 532040 - DNA, 25 bp, Rattus norvegicus
cccgccaaacttgctttcaaggaga

SEQ ID NO: 532041 - DNA, 25 bp, Rattus norvegicus
gccgtgttcactccacaagtcctta

SEQ ID NO: 532042 - DNA, 25 bp, Rattus norvegicus
ttagcactcctagcgtccgcaggca

SEQ ID NO: 532043 - DNA, 25 bp, Rattus norvegicus
agcgggctgcacaggcgcactgtcc

SEQ ID NO: 532044 - DNA, 25 bp, Rattus norvegicus
gtgttcactccacaagtccttaccg

SEQ ID NO: 532045 - DNA, 25 bp, Rattus norvegicus
aaatgcgcacgaagtgctgggaacg

SEQ ID NO: 532046 - DNA, 25 bp, Rattus norvegicus
cagcccgcgagactctcgggctggt

SEQ ID NO: 532047 - DNA, 25 bp, Rattus norvegicus
tgcacgtgctctgtgctcaccgctt

SEQ ID NO: 532048 - DNA, 25 bp, Rattus norvegicus
gggaactgcacgtgctctgtgctca

SEQ ID NO: 532049 - DNA, 25 bp, Rattus norvegicus
cgcgcaaagggaactgcacgtgctc

SEQ ID NO: 532050 - DNA, 25 bp, Rattus norvegicus
tgcgtcactcctcagccgccagcgg

SEQ ID NO: 532051 - DNA, 25 bp, Rattus norvegicus
gcgctgtcctcaccctgcctgggct

SEQ ID NO: 532052 - DNA, 25 bp, Rattus norvegicus
ggcctcccaccttgtgcgctgtcct

SEQ ID NO: 532053 - DNA, 25 bp, Rattus norvegicus
agtccttaccgcttagcactcctag

SEQ ID NO: 532054 - DNA, 25 bp, Rattus norvegicus
ccctcccgcactcgccggtgcgtca

SEQ ID NO: 532055 - DNA, 25 bp, Rattus norvegicus
ggggcgcctcacagctctcggtcag

SEQ ID NO: 532056 - DNA, 25 bp, Rattus norvegicus
agctctcggtcagtcgccctttctc

SEQ ID NO: 532057 - DNA, 25 bp, Rattus norvegicus
gggcgcctcacagctctcggtcagt

SEQ ID NO: 532058 - DNA, 25 bp, Rattus norvegicus
ggcgcctcacagctctcggtcagtc

SEQ ID NO: 532059 - DNA, 25 bp, Rattus norvegicus
gcgcctcacagctctcggtcagtcg

SEQ ID NO: 532060 - DNA, 25 bp, Rattus norvegicus
cgcctcacagctctcggtcagtcgc

SEQ ID NO: 532061 - DNA, 25 bp, Rattus norvegicus
gcctcacagctctcggtcagtcgcc

SEQ ID NO: 532062 - DNA, 25 bp, Rattus norvegicus
cctcacagctctcggtcagtcgccc

SEQ ID NO: 532063 - DNA, 25 bp, Rattus norvegicus
tcacagctctcggtcagtcgccctt

SEQ ID NO: 532064 - DNA, 25 bp, Rattus norvegicus
cacagctctcggtcagtcgcccttt

SEQ ID NO: 532065 - DNA, 25 bp, Rattus norvegicus
tctcggtcagtcgccctttctcggg

SEQ ID NO: 532066 - DNA, 25 bp, Rattus norvegicus
cagctctcggtcagtcgccctttct

SEQ ID NO: 532067 - DNA, 25 bp, Rattus norvegicus
ctctcggtcagtcgccctttctcgg

SEQ ID NO: 532068 - DNA, 25 bp, Rattus norvegicus
acagctctcggtcagtcgccctttc

SEQ ID NO: 532069 - DNA, 25 bp, Rattus norvegicus
tgccacggcggcctcaggctgcgtc

SEQ ID NO: 532070 - DNA, 25 bp, Rattus norvegicus
gctcatcccgatggagcgcagcggt

SEQ ID NO: 532071 - DNA, 25 bp, Rattus norvegicus
ctcatcccgatggagcgcagcggtg

SEQ ID NO: 532072 - DNA, 25 bp, Rattus norvegicus
ggctgcgaagggctcttcgctgctg

SEQ ID NO: 532073 - DNA, 25 bp, Rattus norvegicus
ctgcgaagtccacggaaggggccac

SEQ ID NO: 532074 - DNA, 25 bp, Rattus norvegicus
gccacggggcgattctcgcagtcca

SEQ ID NO: 532075 - DNA, 25 bp, Rattus norvegicus
acggggcgattctcgcagtccaccc

SEQ ID NO: 532076 - DNA, 25 bp, Rattus norvegicus
gagcgcctgggaaggccgcgcagag

SEQ ID NO: 532077 - DNA, 25 bp, Rattus norvegicus
aggctgcgtccctctttcggcaggt

SEQ ID NO: 532078 - DNA, 25 bp, Rattus norvegicus
tgcgtccctctttcggcaggtggca

SEQ ID NO: 532079 - DNA, 25 bp, Rattus norvegicus
tccctctttcggcaggtggcacgga

SEQ ID NO: 532080 - DNA, 25 bp, Rattus norvegicus
ctctttcggcaggtggcacggaccc

SEQ ID NO: 532081 - DNA, 25 bp, Rattus norvegicus
aggtggcacggacccctccggcttg

SEQ ID NO: 532082 - DNA, 25 bp, Rattus norvegicus
ctacaggtaaggccctgggagcgcc

SEQ ID NO: 532083 - DNA, 25 bp, Rattus norvegicus
tcactgcggcctgggttgacctcga

SEQ ID NO: 532084 - DNA, 25 bp, Rattus norvegicus
ctcccttggctctaaggcgcaggcg

SEQ ID NO: 532085 - DNA, 25 bp, Rattus norvegicus
attcttgggcatggcggcaaagacc

SEQ ID NO: 532086 - DNA, 25 bp, Rattus norvegicus
tggtgactcggacaggcgacactga

SEQ ID NO: 532087 - DNA, 25 bp, Rattus norvegicus
tcactggtgcttgcgagagccgcct

SEQ ID NO: 532088 - DNA, 25 bp, Rattus norvegicus
aaggaaagatggcaggaaggtcact

SEQ ID NO: 532089 - DNA, 25 bp, Rattus norvegicus
gcgtccttacctttattcttgggca

SEQ ID NO: 532090 - DNA, 25 bp, Rattus norvegicus
cgagcccacattctcacacaggagg

SEQ ID NO: 532091 - DNA, 25 bp, Rattus norvegicus
caggaggccctacaaaaatggcgtc

SEQ ID NO: 532092 - DNA, 25 bp, Rattus norvegicus
tacaaaaatggcgtcggctccaccc

SEQ ID NO: 532093 - DNA, 25 bp, Rattus norvegicus
cccaatgtggccaaactgggagcca

SEQ ID NO: 532094 - DNA, 25 bp, Rattus norvegicus
gccaggagtaacttccctgtgcttc

SEQ ID NO: 532095 - DNA, 25 bp, Rattus norvegicus
ctccgagtaggacgcagagaatgca

SEQ ID NO: 532096 - DNA, 25 bp, Rattus norvegicus
gcccacgctccgcagtggcaaatgg

SEQ ID NO: 532097 - DNA, 25 bp, Rattus norvegicus
caccgggaacgagataggagccaga

SEQ ID NO: 532098 - DNA, 25 bp, Rattus norvegicus
agcgatacctgtctctcagagcgag

SEQ ID NO: 532099 - DNA, 25 bp, Rattus norvegicus
tggcgtctaagcgatacctgtctct

SEQ ID NO: 532100 - DNA, 25 bp, Rattus norvegicus
acttccgcttacaacatggcgtcta

SEQ ID NO: 532101 - DNA, 25 bp, Rattus norvegicus
gagcgagctcgacgccgacactgac

SEQ ID NO: 532102 - DNA, 25 bp, Rattus norvegicus
cgcaaggcagagtccagaagcagca

SEQ ID NO: 532103 - DNA, 25 bp, Rattus norvegicus
cttcgctactcgagcgcaaggcaga

SEQ ID NO: 532104 - DNA, 25 bp, Rattus norvegicus
tcacctcagcgctgtcggaagggct

SEQ ID NO: 532105 - DNA, 25 bp, Rattus norvegicus
ccaaagcagaatcccgcaccgggaa

SEQ ID NO: 532106 - DNA, 25 bp, Rattus norvegicus
ggcaaagcccaacgacccaaagcag

SEQ ID NO: 532107 - DNA, 25 bp, Rattus norvegicus
cgggaatagacagataggcaaagcc

SEQ ID NO: 532108 - DNA, 25 bp, Rattus norvegicus
agcagcagcggatcagccgcggctc

SEQ ID NO: 532109 - DNA, 25 bp, Rattus norvegicus
tcggaagggctctccacagccatct

SEQ ID NO: 532110 - DNA, 25 bp, Rattus norvegicus
gatcccaacagaacagcgacggccg

SEQ ID NO: 532111 - DNA, 25 bp, Rattus norvegicus
gcagcgagtcatctacctaagctcc

SEQ ID NO: 532112 - DNA, 25 bp, Rattus norvegicus
ttgtggtggacgtgcgcagcattaa

SEQ ID NO: 532113 - DNA, 25 bp, Rattus norvegicus
aggcggctctcctgaggccggacac

SEQ ID NO: 532114 - DNA, 25 bp, Rattus norvegicus
gttcctaggcggctctcctgaggcc

SEQ ID NO: 532115 - DNA, 25 bp, Rattus norvegicus
tggtaagactatcggccgccatccg

SEQ ID NO: 532116 - DNA, 25 bp, Rattus norvegicus
atcctcgccatggtaagactatcgg

SEQ ID NO: 532117 - DNA, 25 bp, Rattus norvegicus
cgcctgattcagatcctcgccatgg

SEQ ID NO: 532118 - DNA, 25 bp, Rattus norvegicus
catcgtgcgctctgcgcctgattca

SEQ ID NO: 532119 - DNA, 25 bp, Rattus norvegicus
ttctcctttcctccgccatcgtgcg

SEQ ID NO: 532120 - DNA, 25 bp, Rattus norvegicus
aatcgcgttcttccggcctgtcctt

SEQ ID NO: 532121 - DNA, 25 bp, Rattus norvegicus
cttctaatcgcgttcttccggcctg

SEQ ID NO: 532122 - DNA, 25 bp, Rattus norvegicus
ctagcagcgtcttctaatcgcgttc

SEQ ID NO: 532123 - DNA, 25 bp, Rattus norvegicus
ctagggaagacgcagcgagtcatct

SEQ ID NO: 532124 - DNA, 25 bp, Rattus norvegicus
taagctccgcctctagcagcgtctt

SEQ ID NO: 532125 - DNA, 25 bp, Rattus norvegicus
tccgccgcattgtcccgggctgcga

SEQ ID NO: 532126 - DNA, 25 bp, Rattus norvegicus
accatcaggacctggagcagggtga

SEQ ID NO: 532127 - DNA, 25 bp, Rattus norvegicus
tggtacgaccatcaggacctggagc

SEQ ID NO: 532128 - DNA, 25 bp, Rattus norvegicus
ggaggagtcctggtacgaccatcag

SEQ ID NO: 532129 - DNA, 25 bp, Rattus norvegicus
ccaggccctgagctgccgcagcgcc

SEQ ID NO: 532130 - DNA, 25 bp, Rattus norvegicus
cgccacccggcgtcccagttcggcg

SEQ ID NO: 532131 - DNA, 25 bp, Rattus norvegicus
aactgtcgtcctgctttacagtccc

SEQ ID NO: 532132 - DNA, 25 bp, Rattus norvegicus
tggtcccaactgtcgtcctgcttta

SEQ ID NO: 532133 - DNA, 25 bp, Rattus norvegicus
gcggtctagggtggtcccaactgtc

SEQ ID NO: 532134 - DNA, 25 bp, Rattus norvegicus
cgccgctgcacccacattctgctga

SEQ ID NO: 532135 - DNA, 25 bp, Rattus norvegicus
acctcgtgattggtctccggcggca

SEQ ID NO: 532136 - DNA, 25 bp, Rattus norvegicus
atacacctcgtgattggtctccggc

SEQ ID NO: 532137 - DNA, 25 bp, Rattus norvegicus
ttatttgcatacacctcgtgattgg

SEQ ID NO: 532138 - DNA, 25 bp, Rattus norvegicus
tggaggagtactccgcagaggagga

SEQ ID NO: 532139 - DNA, 25 bp, Rattus norvegicus
tccagagctaaccactacgcggagc

SEQ ID NO: 532140 - DNA, 25 bp, Rattus norvegicus
ggcagtcccagagctacaaacccgg

SEQ ID NO: 532141 - DNA, 25 bp, Rattus norvegicus
ggcagtggcagtcccagagctacaa

SEQ ID NO: 532142 - DNA, 25 bp, Rattus norvegicus
gtaaggtccggcagtggcagtccca

SEQ ID NO: 532143 - DNA, 25 bp, Rattus norvegicus
tgcgcctgcgccgtaaggtccggca

SEQ ID NO: 532144 - DNA, 25 bp, Rattus norvegicus
aaccactacgcggagctgcagaggg

SEQ ID NO: 532145 - DNA, 25 bp, Rattus norvegicus
ctacttccgccagtactgcgctaga

SEQ ID NO: 532146 - DNA, 25 bp, Rattus norvegicus
aaccttggaagcaggaagggcagct

SEQ ID NO: 532147 - DNA, 25 bp, Rattus norvegicus
ccggcgacggcctgaaccttggaag

SEQ ID NO: 532148 - DNA, 25 bp, Rattus norvegicus
gattatagcttttaggatagccaga

SEQ ID NO: 532149 - DNA, 25 bp, Rattus norvegicus
tcatcgtcgaaaggattatagcttt

SEQ ID NO: 532150 - DNA, 25 bp, Rattus norvegicus
ttccacatcatcgtcgaaaggatta

SEQ ID NO: 532151 - DNA, 25 bp, Rattus norvegicus
gggtgtcctcgtcttccacatcatc

SEQ ID NO: 532152 - DNA, 25 bp, Rattus norvegicus
ccacccagtgcgagggcgaagaagg

SEQ ID NO: 532153 - DNA, 25 bp, Rattus norvegicus
agcctccggacggacacacaaaagc

SEQ ID NO: 532154 - DNA, 25 bp, Rattus norvegicus
tggtctccttttgtcttcagcctgg

SEQ ID NO: 532155 - DNA, 25 bp, Rattus norvegicus
gctctagcagggactcggggaccct

SEQ ID NO: 532156 - DNA, 25 bp, Rattus norvegicus
accgactgctgaggtcctccctggg

SEQ ID NO: 532157 - DNA, 25 bp, Rattus norvegicus
ctgggagctttcaaccgactgctga

SEQ ID NO: 532158 - DNA, 25 bp, Rattus norvegicus
ggcataacccgtcctgggagctttc

SEQ ID NO: 532159 - DNA, 25 bp, Rattus norvegicus
gagggacacccgacagggcataacc

SEQ ID NO: 532160 - DNA, 25 bp, Rattus norvegicus
tggatgaaaggtaatgccctctgtg

SEQ ID NO: 532161 - DNA, 25 bp, Rattus norvegicus
gacttggctttctgtccgagctccg

SEQ ID NO: 532162 - DNA, 25 bp, Rattus norvegicus
ggcggctcgagccatgaactgaagc

SEQ ID NO: 532163 - DNA, 25 bp, Rattus norvegicus
cacctggcccgcgtgtctgacagaa

SEQ ID NO: 532164 - DNA, 25 bp, Rattus norvegicus
cgccgcccatggctctgataatgga

SEQ ID NO: 532165 - DNA, 25 bp, Rattus norvegicus
ccagtgagcaaatggtctccgagtc

SEQ ID NO: 532166 - DNA, 25 bp, Rattus norvegicus
tctccgagtcaagtagtggactgga

SEQ ID NO: 532167 - DNA, 25 bp, Rattus norvegicus
catgcacaaactgtgggagtgtcct

SEQ ID NO: 532168 - DNA, 25 bp, Rattus norvegicus
tgcagcttttggctcctttccggga

SEQ ID NO: 532169 - DNA, 25 bp, Rattus norvegicus
tggcgcatccgtccggcggagtaaa

SEQ ID NO: 532170 - DNA, 25 bp, Rattus norvegicus
tctacgtgcactctaccgcgtggcg

SEQ ID NO: 532171 - DNA, 25 bp, Rattus norvegicus
ggccgaacgccaggagcttctaaca

SEQ ID NO: 532172 - DNA, 25 bp, Rattus norvegicus
gctccgtccttggtgtctacgtgca

SEQ ID NO: 532173 - DNA, 25 bp, Rattus norvegicus
cgcgcgcattttccggcatgcacaa

SEQ ID NO: 532174 - DNA, 25 bp, Rattus norvegicus
ggagtgtcctcaccggaagagtccg

SEQ ID NO: 532175 - DNA, 25 bp, Rattus norvegicus
cccggtagcaatttggttcctgagc

SEQ ID NO: 532176 - DNA, 25 bp, Rattus norvegicus
gccgtccatccgctgctactatgat

SEQ ID NO: 532177 - DNA, 25 bp, Rattus norvegicus
tgctactatgattccggtgtcgctg

SEQ ID NO: 532178 - DNA, 25 bp, Rattus norvegicus
tctacctggccgacttggtgttgaa

SEQ ID NO: 532179 - DNA, 25 bp, Rattus norvegicus
cctgtgttgcccaaggccttttctc

SEQ ID NO: 532180 - DNA, 25 bp, Rattus norvegicus
tctaacacgacgaagcccgggtgtc

SEQ ID NO: 532181 - DNA, 25 bp, Rattus norvegicus
caagcagggccgcagaaaaggacaa

SEQ ID NO: 532182 - DNA, 25 bp, Rattus norvegicus
tacctcccaaaatgctggctttaaa

SEQ ID NO: 532183 - DNA, 25 bp, Rattus norvegicus
ggggaccaggacgagcgccagacta

SEQ ID NO: 532184 - DNA, 25 bp, Rattus norvegicus
aagcagggccgcagaaaaggacaag

SEQ ID NO: 532185 - DNA, 25 bp, Rattus norvegicus
acaacggcaaatgccaaaacagcaa

SEQ ID NO: 532186 - DNA, 25 bp, Rattus norvegicus
acggacagccccacaacggcaaatg

SEQ ID NO: 532187 - DNA, 25 bp, Rattus norvegicus
tcctggtctgctcccctactgcttc

SEQ ID NO: 532188 - DNA, 25 bp, Rattus norvegicus
ccacctgtcaaggtcaggatttttt

SEQ ID NO: 532189 - DNA, 25 bp, Rattus norvegicus
tccaccacctgtcaaggtcaggatt

SEQ ID NO: 532190 - DNA, 25 bp, Rattus norvegicus
gtctccaccacctgtcaaggtcagg

SEQ ID NO: 532191 - DNA, 25 bp, Rattus norvegicus
tgtgtctccaccacctgtcaaggtc

SEQ ID NO: 532192 - DNA, 25 bp, Rattus norvegicus
aaggacaaggggaccaggacgagcg

SEQ ID NO: 532193 - DNA, 25 bp, Rattus norvegicus
cctcccaaaatgctggctttaaagg

SEQ ID NO: 532194 - DNA, 25 bp, Rattus norvegicus
ccacaacggcaaatgccaaaacagc

SEQ ID NO: 532195 - DNA, 25 bp, Rattus norvegicus
gaagtcgcgctgagcagtttaaagc

SEQ ID NO: 532196 - DNA, 25 bp, Rattus norvegicus
tactctgctgagcatgctgccggcc

SEQ ID NO: 532197 - DNA, 25 bp, Rattus norvegicus
agtgccttggctccttcgtttgagg

SEQ ID NO: 532198 - DNA, 25 bp, Rattus norvegicus
tttggtcctccgctgagcctgaccg

SEQ ID NO: 532199 - DNA, 25 bp, Rattus norvegicus
caggactggcaagaaaggcccgagc

SEQ ID NO: 532200 - DNA, 25 bp, Rattus norvegicus
ttagcgaggcctcacacccagcatt

SEQ ID NO: 532201 - DNA, 25 bp, Rattus norvegicus
gcccgcgattccaccattagcgagg

SEQ ID NO: 532202 - DNA, 25 bp, Rattus norvegicus
cattggtgacgcatgccagggagct

SEQ ID NO: 532203 - DNA, 25 bp, Rattus norvegicus
catggccagagctttagcacagggc

SEQ ID NO: 532204 - DNA, 25 bp, Rattus norvegicus
gcagtttaaagctgaggtgacctcc

SEQ ID NO: 532205 - DNA, 25 bp, Rattus norvegicus
acccagcatttcaagttcggggctg

SEQ ID NO: 532206 - DNA, 25 bp, Rattus norvegicus
cttgaggccacagggccaggctcct

SEQ ID NO: 532207 - DNA, 25 bp, Rattus norvegicus
gtgacctcctaacggatggcgaatg

SEQ ID NO: 532208 - DNA, 25 bp, Rattus norvegicus
cgccaaaggtgagggctccgctcgc

SEQ ID NO: 532209 - DNA, 25 bp, Rattus norvegicus
ggctcatcttggcgaacatttgcgc

SEQ ID NO: 532210 - DNA, 25 bp, Rattus norvegicus
tggctcatcttggcgaacatttgcg

SEQ ID NO: 532211 - DNA, 25 bp, Rattus norvegicus
ttggctcatcttggcgaacatttgc

SEQ ID NO: 532212 - DNA, 25 bp, Rattus norvegicus
tcttggctcatcttggcgaacattt

SEQ ID NO: 532213 - DNA, 25 bp, Rattus norvegicus
atcttggctcatcttggcgaacatt

SEQ ID NO: 532214 - DNA, 25 bp, Rattus norvegicus
catcttggctcatcttggcgaacat

SEQ ID NO: 532215 - DNA, 25 bp, Rattus norvegicus
gacatcttggctcatcttggcgaac

SEQ ID NO: 532216 - DNA, 25 bp, Rattus norvegicus
cgacatcttggctcatcttggcgaa

SEQ ID NO: 532217 - DNA, 25 bp, Rattus norvegicus
acgacatcttggctcatcttggcga

SEQ ID NO: 532218 - DNA, 25 bp, Rattus norvegicus
acgtcatactccacagagtcgaggg

SEQ ID NO: 532219 - DNA, 25 bp, Rattus norvegicus
cacgtcatactccacagagtcgagg

SEQ ID NO: 532220 - DNA, 25 bp, Rattus norvegicus
acacgtcatactccacagagtcgag

SEQ ID NO: 532221 - DNA, 25 bp, Rattus norvegicus
gacacgtcatactccacagagtcga

SEQ ID NO: 532222 - DNA, 25 bp, Rattus norvegicus
agacacgtcatactccacagagtcg

SEQ ID NO: 532223 - DNA, 25 bp, Rattus norvegicus
ttcgggtctccggagacacgtcata

SEQ ID NO: 532224 - DNA, 25 bp, Rattus norvegicus
cgtttggggtcgttgtactgaagca

SEQ ID NO: 532225 - DNA, 25 bp, Rattus norvegicus
tggggtcgttgtactgaagcagata

SEQ ID NO: 532226 - DNA, 25 bp, Rattus norvegicus
tcgttgtactgaagcagatactccc

SEQ ID NO: 532227 - DNA, 25 bp, Rattus norvegicus
gtactgaagcagatactcccgttta

SEQ ID NO: 532228 - DNA, 25 bp, Rattus norvegicus
tgaagcagatactcccgtttaagcc

SEQ ID NO: 532229 - DNA, 25 bp, Rattus norvegicus
gcgcctttcgggtctccggagacac

SEQ ID NO: 532230 - DNA, 25 bp, Rattus norvegicus
aggggtgcaggcttatacttggaaa

SEQ ID NO: 532231 - DNA, 25 bp, Rattus norvegicus
tacttggaaaacgacatcttggctc

SEQ ID NO: 532232 - DNA, 25 bp, Rattus norvegicus
aggcttatacttggaaaacgacatc

SEQ ID NO: 532233 - DNA, 25 bp, Rattus norvegicus
tgcaggcttatacttggaaaacgac

SEQ ID NO: 532234 - DNA, 25 bp, Rattus norvegicus
gggtctccggagacacgtcatactc

SEQ ID NO: 532235 - DNA, 25 bp, Rattus norvegicus
cggccaggggtgcaggcttatactt

SEQ ID NO: 532236 - DNA, 25 bp, Rattus norvegicus
gacctgcgcctttcgggtctccgga

SEQ ID NO: 532237 - DNA, 25 bp, Rattus norvegicus
caacgaatgatgatccttggggacc

SEQ ID NO: 532238 - DNA, 25 bp, Rattus norvegicus
gccagaaaatcttgaatagatgtca

SEQ ID NO: 532239 - DNA, 25 bp, Rattus norvegicus
aaatgccagcccatcctactatgtc

SEQ ID NO: 532240 - DNA, 25 bp, Rattus norvegicus
tcctactatgtccagcaaaactctc

SEQ ID NO: 532241 - DNA, 25 bp, Rattus norvegicus
caccatagatgaagaaacgaagatt

SEQ ID NO: 532242 - DNA, 25 bp, Rattus norvegicus
aggtgcggccgcgtcttgacttgtc

SEQ ID NO: 532243 - DNA, 25 bp, Rattus norvegicus
atccttggggaccttctgagcagct

SEQ ID NO: 532244 - DNA, 25 bp, Rattus norvegicus
tccaaagtttgagaagcaacgaatg

SEQ ID NO: 532245 - DNA, 25 bp, Rattus norvegicus
attcagagatcgagtccaaagtttg

SEQ ID NO: 532246 - DNA, 25 bp, Rattus norvegicus
tggcgacgttgaccctgacctggac

SEQ ID NO: 532247 - DNA, 25 bp, Rattus norvegicus
ccaccaatgtggttatgaattattc

SEQ ID NO: 532248 - DNA, 25 bp, Rattus norvegicus
ctcggggcacaatgctgaacatgtg

SEQ ID NO: 532249 - DNA, 25 bp, Rattus norvegicus
cgagccgggcctctcggggcacaat

SEQ ID NO: 532250 - DNA, 25 bp, Rattus norvegicus
ctgagcagctcatgggagagattgc

SEQ ID NO: 532251 - DNA, 25 bp, Rattus norvegicus
gatcgagcgcaacctagtcaacagc

SEQ ID NO: 532252 - DNA, 25 bp, Rattus norvegicus
gctagaccagcatcacacggacctg

SEQ ID NO: 532253 - DNA, 25 bp, Rattus norvegicus
agtcaacagcctattcccggtcaac

SEQ ID NO: 532254 - DNA, 25 bp, Rattus norvegicus
cacagcctagccaagatcgagcgca

SEQ ID NO: 532255 - DNA, 25 bp, Rattus norvegicus
ttcagccgctaccaggtggaagaga

SEQ ID NO: 532256 - DNA, 25 bp, Rattus norvegicus
agtcacccggtcttcttcgcttcgg

SEQ ID NO: 532257 - DNA, 25 bp, Rattus norvegicus
cttgaggacgtgtttctcccggctt

SEQ ID NO: 532258 - DNA, 25 bp, Rattus norvegicus
gcccgctctgctctaggatgctgcg

SEQ ID NO: 532259 - DNA, 25 bp, Rattus norvegicus
caggagagctcagggtcttgcctcc

SEQ ID NO: 532260 - DNA, 25 bp, Rattus norvegicus
gccatcccgtcgttggcttcgggga

SEQ ID NO: 532261 - DNA, 25 bp, Rattus norvegicus
gcagagtctcctggcactagcgcca

SEQ ID NO: 532262 - DNA, 25 bp, Rattus norvegicus
ttatccgtcctcgtgttccaggctg

SEQ ID NO: 532263 - DNA, 25 bp, Rattus norvegicus
actgggtgtagcctggaattatccg

SEQ ID NO: 532264 - DNA, 25 bp, Rattus norvegicus
cgggtcattgtcacctcctaccaga

SEQ ID NO: 532265 - DNA, 25 bp, Rattus norvegicus
gttcctgttacagactgaagctttg

SEQ ID NO: 532266 - DNA, 25 bp, Rattus norvegicus
agcgcgcccttttagctggctgcct

SEQ ID NO: 532267 - DNA, 25 bp, Rattus norvegicus
ttaactgagggatgtgttttcgtgc

SEQ ID NO: 532268 - DNA, 25 bp, Rattus norvegicus
gatgtgttttcgtgctcgcttggtc

SEQ ID NO: 532269 - DNA, 25 bp, Rattus norvegicus
ctcgcttggtcatggaaacgtggtc

SEQ ID NO: 532270 - DNA, 25 bp, Rattus norvegicus
tggaaacgtggtccaagctgctgga

SEQ ID NO: 532271 - DNA, 25 bp, Rattus norvegicus
tccaagctgctggacgggaccacgc

SEQ ID NO: 532272 - DNA, 25 bp, Rattus norvegicus
ccgtcccgtcgctggcgaaagctgg

SEQ ID NO: 532273 - DNA, 25 bp, Rattus norvegicus
cgcctctgctgctgttcctgttaca

SEQ ID NO: 532274 - DNA, 25 bp, Rattus norvegicus
agactgaagctttgcagggcttgga

SEQ ID NO: 532275 - DNA, 25 bp, Rattus norvegicus
gagagtgatgatcggttccggaccc

SEQ ID NO: 532276 - DNA, 25 bp, Rattus norvegicus
ttccggacccgcgaaaatgagtgcc

SEQ ID NO: 532277 - DNA, 25 bp, Rattus norvegicus
aatgagtgccacttctacgctggtg

SEQ ID NO: 532278 - DNA, 25 bp, Rattus norvegicus
aagctggtattgctcctgccgcctc

SEQ ID NO: 532279 - DNA, 25 bp, Rattus norvegicus
accgcgccggatggaattttgctcc

SEQ ID NO: 532280 - DNA, 25 bp, Rattus norvegicus
gacagcgcccttccacgccctgcca

SEQ ID NO: 532281 - DNA, 25 bp, Rattus norvegicus
gccctgccacctaccgcatcgctgc

SEQ ID NO: 532282 - DNA, 25 bp, Rattus norvegicus
tcgctgcccgcttcatggcactcca

SEQ ID NO: 532283 - DNA, 25 bp, Rattus norvegicus
actccactgcctacccacgggagga

SEQ ID NO: 532284 - DNA, 25 bp, Rattus norvegicus
gacaaccaacgtcctcccgtataga

SEQ ID NO: 532285 - DNA, 25 bp, Rattus norvegicus
gtcctcccgtatagagagacaaacg

SEQ ID NO: 532286 - DNA, 25 bp, Rattus norvegicus
agagacaaacgggagacagaagagc

SEQ ID NO: 532287 - DNA, 25 bp, Rattus norvegicus
agaagagcgtgagcgtgagcccacc

SEQ ID NO: 532288 - DNA, 25 bp, Rattus norvegicus
gcgtgagcgtgagcccacctccaaa

SEQ ID NO: 532289 - DNA, 25 bp, Rattus norvegicus
caaatccggcaaccgcgccggatgg

SEQ ID NO: 532290 - DNA, 25 bp, Rattus norvegicus
ccaccttctaggtgacgccacaaga

SEQ ID NO: 532291 - DNA, 25 bp, Rattus norvegicus
ccgtggcttcttccgcctcgtaagc

SEQ ID NO: 532292 - DNA, 25 bp, Rattus norvegicus
tgacgccacaagagcacccggggag

SEQ ID NO: 532293 - DNA, 25 bp, Rattus norvegicus
tgatcgctgggcacctcaaaggcgg

SEQ ID NO: 532294 - DNA, 25 bp, Rattus norvegicus
gcttccaaaggtcacgtggtccctc

SEQ ID NO: 532295 - DNA, 25 bp, Rattus norvegicus
gcagaacctgttctttgttaagagg

SEQ ID NO: 532296 - DNA, 25 bp, Rattus norvegicus
tctttgttaagaggtcagagcctgc

SEQ ID NO: 532297 - DNA, 25 bp, Rattus norvegicus
ttaagaggtcagagcctgcgcctgc

SEQ ID NO: 532298 - DNA, 25 bp, Rattus norvegicus
cctgcgctagctgggaaggaactac

SEQ ID NO: 532299 - DNA, 25 bp, Rattus norvegicus
gcgctagctgggaaggaactaccga

SEQ ID NO: 532300 - DNA, 25 bp, Rattus norvegicus
ctgggaaggaactaccgaggatctt

SEQ ID NO: 532301 - DNA, 25 bp, Rattus norvegicus
aggaactaccgaggatcttcaaaga

SEQ ID NO: 532302 - DNA, 25 bp, Rattus norvegicus
gatcttcaaagagctgcgcagtctc

SEQ ID NO: 532303 - DNA, 25 bp, Rattus norvegicus
aaagagctgcgcagtctcagcgccc

SEQ ID NO: 532304 - DNA, 25 bp, Rattus norvegicus
cccagctgggcctaggctgtgatcg

SEQ ID NO: 532305 - DNA, 25 bp, Rattus norvegicus
agcgcatgcttccaaaggtcacgtg

SEQ ID NO: 532306 - DNA, 25 bp, Rattus norvegicus
ggctgtgatcgctgggcacctcaaa

SEQ ID NO: 532307 - DNA, 25 bp, Rattus norvegicus
actgttcctgcagcttccgattgtg

SEQ ID NO: 532308 - DNA, 25 bp, Rattus norvegicus
tccgattgtgttgctcctgaagaca

SEQ ID NO: 532309 - DNA, 25 bp, Rattus norvegicus
cacgtacctggctggacagttcctc

SEQ ID NO: 532310 - DNA, 25 bp, Rattus norvegicus
gctggggaccaaactcatgagaacc

SEQ ID NO: 532311 - DNA, 25 bp, Rattus norvegicus
gcgccacaagctgagttccgagttg

SEQ ID NO: 532312 - DNA, 25 bp, Rattus norvegicus
aaggcccatactctgcccacgtgtg

SEQ ID NO: 532313 - DNA, 25 bp, Rattus norvegicus
gtgatgtcaagaacctgcaggcctc

SEQ ID NO: 532314 - DNA, 25 bp, Rattus norvegicus
tcctcggcctgcatgctgaatttgg

SEQ ID NO: 532315 - DNA, 25 bp, Rattus norvegicus
tgtccgctgcgtaccctagaagcca

SEQ ID NO: 532316 - DNA, 25 bp, Rattus norvegicus
ctgtcagaatagagaggccgcacct

SEQ ID NO: 532317 - DNA, 25 bp, Rattus norvegicus
gcgcctaccgatgcccttcaagttt

SEQ ID NO: 532318 - DNA, 25 bp, Rattus norvegicus
tcgacgaggctgtgagttccaccta

SEQ ID NO: 532319 - DNA, 25 bp, Rattus norvegicus
ctccataagtgagcccgagcagtcc

SEQ ID NO: 532320 - DNA, 25 bp, Rattus norvegicus
tccagatgtttcttccggaggattc

SEQ ID NO: 532321 - DNA, 25 bp, Rattus norvegicus
ggtctagcgttcgttggccttccaa

SEQ ID NO: 532322 - DNA, 25 bp, Rattus norvegicus
cgtgcaatagaatgagctcctcgtg

SEQ ID NO: 532323 - DNA, 25 bp, Rattus norvegicus
ccaggggcgctcacatcaaatggta

SEQ ID NO: 532324 - DNA, 25 bp, Rattus norvegicus
atcaaatggtagtccctggcgccta

SEQ ID NO: 532325 - DNA, 25 bp, Rattus norvegicus
tggcgcctagcaaaatcgtgcaata

SEQ ID NO: 532326 - DNA, 25 bp, Rattus norvegicus
cgctgtaaccagtgatcgggtcctc

SEQ ID NO: 532327 - DNA, 25 bp, Rattus norvegicus
cttcaaaacggcactcggcagctgc

SEQ ID NO: 532328 - DNA, 25 bp, Rattus norvegicus
gcgaactccaagtgctcttccgaca

SEQ ID NO: 532329 - DNA, 25 bp, Rattus norvegicus
gacagcttggcccttgtacctgcca

SEQ ID NO: 532330 - DNA, 25 bp, Rattus norvegicus
ggctaccgtagtccttactgtggga

SEQ ID NO: 532331 - DNA, 25 bp, Rattus norvegicus
cagagggttcctgtcttctagggcc

SEQ ID NO: 532332 - DNA, 25 bp, Rattus norvegicus
agcgtcttgagcaactgggctccga

SEQ ID NO: 532333 - DNA, 25 bp, Rattus norvegicus
ggcgtctaccttctgggtaccactc

SEQ ID NO: 532334 - DNA, 25 bp, Rattus norvegicus
cgtttgactcgcaaggctcgtccga

SEQ ID NO: 532335 - DNA, 25 bp, Rattus norvegicus
aggggagcctcattcatcctcgagg

SEQ ID NO: 532336 - DNA, 25 bp, Rattus norvegicus
aggtcactggccgtgtaggtccctc

SEQ ID NO: 532337 - DNA, 25 bp, Rattus norvegicus
agcgcccgctcttctcgtggactag

SEQ ID NO: 532338 - DNA, 25 bp, Rattus norvegicus
agtacgctgagtgcgcggccacttt

SEQ ID NO: 532339 - DNA, 25 bp, Rattus norvegicus
actttgcgcggccacaagttgcacg

SEQ ID NO: 532340 - DNA, 25 bp, Rattus norvegicus
ccacaagttgcacggctagcagcga

SEQ ID NO: 532341 - DNA, 25 bp, Rattus norvegicus
gctagcagcgaggtgagtacacgcc

SEQ ID NO: 532342 - DNA, 25 bp, Rattus norvegicus
caggggcgcaaacttctcgggccga

SEQ ID NO: 532343 - DNA, 25 bp, Rattus norvegicus
ctgaagcttcaggaggggcaagttc

SEQ ID NO: 532344 - DNA, 25 bp, Rattus norvegicus
tgcacgctgaacaatacctccgggg

SEQ ID NO: 532345 - DNA, 25 bp, Rattus norvegicus
aaaggcaagtttagggaagcgctgc

SEQ ID NO: 532346 - DNA, 25 bp, Rattus norvegicus
gaagcgctgctgttccgtcccagca

SEQ ID NO: 532347 - DNA, 25 bp, Rattus norvegicus
cagtctcgacgctccggagcgacaa

SEQ ID NO: 532348 - DNA, 25 bp, Rattus norvegicus
cagcatttctttgtctgaggctcca

SEQ ID NO: 532349 - DNA, 25 bp, Rattus norvegicus
gcaacgctcttcattcccggcggaa

SEQ ID NO: 532350 - DNA, 25 bp, Rattus norvegicus
aggctggatgcgatcccgagaaatc

SEQ ID NO: 532351 - DNA, 25 bp, Rattus norvegicus
cgagtccctccaggggtccacaatt

SEQ ID NO: 532352 - DNA, 25 bp, Rattus norvegicus
tgtctattgttacccgcgggaccca

SEQ ID NO: 532353 - DNA, 25 bp, Rattus norvegicus
ccctctttctgtgacgacgtcctgg

SEQ ID NO: 532354 - DNA, 25 bp, Rattus norvegicus
ggcgctgagatctttgcgtccacgg

SEQ ID NO: 532355 - DNA, 25 bp, Rattus norvegicus
cccacggtggctatggtgtcccaat

SEQ ID NO: 532356 - DNA, 25 bp, Rattus norvegicus
acgcacggtgtgacagcggcacaac

SEQ ID NO: 532357 - DNA, 25 bp, Rattus norvegicus
tccgccctctgagtacctgactggg

SEQ ID NO: 532358 - DNA, 25 bp, Rattus norvegicus
accctcctgatagctctgtgacgtg

SEQ ID NO: 532359 - DNA, 25 bp, Rattus norvegicus
tgtcccaatcttgtaacgagtgccc

SEQ ID NO: 532360 - DNA, 25 bp, Rattus norvegicus
agagaaatccgagggtcgctcctga

SEQ ID NO: 532361 - DNA, 25 bp, Rattus norvegicus
acaagttctcactcacccacggtgg

SEQ ID NO: 532362 - DNA, 25 bp, Rattus norvegicus
ctctggctgcaggatcttttacggc

SEQ ID NO: 532363 - DNA, 25 bp, Rattus norvegicus
atggccgggaaaccacttccgcatc

SEQ ID NO: 532364 - DNA, 25 bp, Rattus norvegicus
ccggccatgcacctcagtgtaaaca

SEQ ID NO: 532365 - DNA, 25 bp, Rattus norvegicus
tggtggcttggccacgcccaatgac

SEQ ID NO: 532366 - DNA, 25 bp, Rattus norvegicus
ccaatgacgtcacccggaatgccag

SEQ ID NO: 532367 - DNA, 25 bp, Rattus norvegicus
cgtcaattatagtgtcaggcaagga

SEQ ID NO: 532368 - DNA, 25 bp, Rattus norvegicus
gtcaaaactcccagagtggccattg

SEQ ID NO: 532369 - DNA, 25 bp, Rattus norvegicus
tcagtgtaaacatccgctgtcccgc

SEQ ID NO: 532370 - DNA, 25 bp, Rattus norvegicus
tgctgggagagaacctgacagagcc

SEQ ID NO: 532371 - DNA, 25 bp, Rattus norvegicus
ctgacagagccggtctaaccgaggc

SEQ ID NO: 532372 - DNA, 25 bp, Rattus norvegicus
gaggcggcaacaccgcgacctctga

SEQ ID NO: 532373 - DNA, 25 bp, Rattus norvegicus
ctgaacccgtgcctcagagacaaca

SEQ ID NO: 532374 - DNA, 25 bp, Rattus norvegicus
acctctgaccctgtgaccctgtggg

SEQ ID NO: 532375 - DNA, 25 bp, Rattus norvegicus
accctgtgggtgtgacctcacgacc

SEQ ID NO: 532376 - DNA, 25 bp, Rattus norvegicus
ggcaaggattcccagtcactcgacg

SEQ ID NO: 532377 - DNA, 25 bp, Rattus norvegicus
tgtcaaatgtcgcatggaagccatg

SEQ ID NO: 532378 - DNA, 25 bp, Rattus norvegicus
ggctgcagctctgctgcgcttccaa

SEQ ID NO: 532379 - DNA, 25 bp, Rattus norvegicus
tgtgcatgtgccacggccaccatgt

SEQ ID NO: 532380 - DNA, 25 bp, Rattus norvegicus
ccaggctctaatggctgcttctcca

SEQ ID NO: 532381 - DNA, 25 bp, Rattus norvegicus
ggctgcttctccacacacgtgtgca

SEQ ID NO: 532382 - DNA, 25 bp, Rattus norvegicus
actcgcatgccgctgtgctggcgac

SEQ ID NO: 532383 - DNA, 25 bp, Rattus norvegicus
gctaccctagaggaggcgcccaatc

SEQ ID NO: 532384 - DNA, 25 bp, Rattus norvegicus
tggaaggcgttttacttcacaccga

SEQ ID NO: 532385 - DNA, 25 bp, Rattus norvegicus
ggcgcccaatcagctttccatgtca

SEQ ID NO: 532386 - DNA, 25 bp, Rattus norvegicus
cgtgcacacgttgctaccctagagg

SEQ ID NO: 532387 - DNA, 25 bp, Rattus norvegicus
aacatggatgctgcggcccgtgcac

SEQ ID NO: 532388 - DNA, 25 bp, Rattus norvegicus
gagatcctgcgcaacatggatgctg

SEQ ID NO: 532389 - DNA, 25 bp, Rattus norvegicus
cgccatggtgagatcctgcgcaaca

SEQ ID NO: 532390 - DNA, 25 bp, Rattus norvegicus
acgcctgaaacagagccgcgccatg

SEQ ID NO: 532391 - DNA, 25 bp, Rattus norvegicus
tgcgccttcgtgtttcagggcttta

SEQ ID NO: 532392 - DNA, 25 bp, Rattus norvegicus
tctgggattctgaacaagcaccgcc

SEQ ID NO: 532393 - DNA, 25 bp, Rattus norvegicus
ccgcacggtcggtttagtccttatg

SEQ ID NO: 532394 - DNA, 25 bp, Rattus norvegicus
cccgcaatggttggacgcagtactt

SEQ ID NO: 532395 - DNA, 25 bp, Rattus norvegicus
tctgatgtcatcgttctgcgccttc

SEQ ID NO: 532396 - DNA, 25 bp, Rattus norvegicus
tgtggttgcgacttcacccaatgtg

SEQ ID NO: 532397 - DNA, 25 bp, Rattus norvegicus
tgcggacgaaaatgagcaccgtttt

SEQ ID NO: 532398 - DNA, 25 bp, Rattus norvegicus
gggcagacaacacacctcggcttca

SEQ ID NO: 532399 - DNA, 25 bp, Rattus norvegicus
cccaatgtggtagcgcagagcgact

SEQ ID NO: 532400 - DNA, 25 bp, Rattus norvegicus
aagcgcgcggcttatgaggtcataa

SEQ ID NO: 532401 - DNA, 25 bp, Rattus norvegicus
tcggtcctgaaatgagcgctgtttc

SEQ ID NO: 532402 - DNA, 25 bp, Rattus norvegicus
ctgcgccgacaggtttcggaaacta

SEQ ID NO: 532403 - DNA, 25 bp, Rattus norvegicus
ccgcggggctttcagaagtcatatt

SEQ ID NO: 532404 - DNA, 25 bp, Rattus norvegicus
agttccggtgttctgtcaaagcgcg

SEQ ID NO: 532405 - DNA, 25 bp, Rattus norvegicus
tgccgccgcttttctgttcgggaag

SEQ ID NO: 532406 - DNA, 25 bp, Rattus norvegicus
tgaccacgggattagtggcgagacc

SEQ ID NO: 532407 - DNA, 25 bp, Rattus norvegicus
agaccctcggtctctctggtaaggc

SEQ ID NO: 532408 - DNA, 25 bp, Rattus norvegicus
cgggcagatcgcttgctgaagattc

SEQ ID NO: 532409 - DNA, 25 bp, Rattus norvegicus
agcggacgacctccttagggctaga

SEQ ID NO: 532410 - DNA, 25 bp, Rattus norvegicus
cgtggccatccagggctcctctgtt

SEQ ID NO: 532411 - DNA, 25 bp, Rattus norvegicus
ttagggctagacgtcccagctaggc

SEQ ID NO: 532412 - DNA, 25 bp, Rattus norvegicus
gaagtccggttctgggctcttcgga

SEQ ID NO: 532413 - DNA, 25 bp, Rattus norvegicus
atcttcttggcgctgtgtctggatc

SEQ ID NO: 532414 - DNA, 25 bp, Rattus norvegicus
tggcattgcgagtccacgctcggca

SEQ ID NO: 532415 - DNA, 25 bp, Rattus norvegicus
accagtactacctgtccctgtggga

SEQ ID NO: 532416 - DNA, 25 bp, Rattus norvegicus
ggagtcctgcaggaagcccgccaac

SEQ ID NO: 532417 - DNA, 25 bp, Rattus norvegicus
ccaacctggatagctggcattgcga

SEQ ID NO: 532418 - DNA, 25 bp, Rattus norvegicus
gggtcaccgcggaccaccagtacta

SEQ ID NO: 532419 - DNA, 25 bp, Rattus norvegicus
cttggctctattgacccgaacaacc

SEQ ID NO: 532420 - DNA, 25 bp, Rattus norvegicus
gaactctgaaactccatctgctcta

SEQ ID NO: 532421 - DNA, 25 bp, Rattus norvegicus
ctcgaactctggaactcacttggct

SEQ ID NO: 532422 - DNA, 25 bp, Rattus norvegicus
gaactctggaactcactcggctcta

SEQ ID NO: 532423 - DNA, 25 bp, Rattus norvegicus
aactctggaactcactcggctctac

SEQ ID NO: 532424 - DNA, 25 bp, Rattus norvegicus
tggctctattgacccgaacaacctc

SEQ ID NO: 532425 - DNA, 25 bp, Rattus norvegicus
cagctttacccactcgaactctgga

SEQ ID NO: 532426 - DNA, 25 bp, Rattus norvegicus
gaactctggaactcactcgcctcta

SEQ ID NO: 532427 - DNA, 25 bp, Rattus norvegicus
gaactctggaactccctcggctcta

SEQ ID NO: 532428 - DNA, 25 bp, Rattus norvegicus
gaactctggaactcacttggctcta

SEQ ID NO: 532429 - DNA, 25 bp, Rattus norvegicus
ggctctacccactcgaactctgaaa

SEQ ID NO: 532430 - DNA, 25 bp, Rattus norvegicus
gactctacccactcgaactctggaa

SEQ ID NO: 532431 - DNA, 25 bp, Rattus norvegicus
acccgaaatctcttggctctattga

SEQ ID NO: 532432 - DNA, 25 bp, Rattus norvegicus
ggctctacccactcgaactctggaa

SEQ ID NO: 532433 - DNA, 25 bp, Rattus norvegicus
aggcgtccgacggaagccctgaagc

SEQ ID NO: 532434 - DNA, 25 bp, Rattus norvegicus
gatccaggaaatacgaggcgggcct

SEQ ID NO: 532435 - DNA, 25 bp, Rattus norvegicus
tccctgagaccggatccaggaaata

SEQ ID NO: 532436 - DNA, 25 bp, Rattus norvegicus
ccctgaagccggcagttctttggcc

SEQ ID NO: 532437 - DNA, 25 bp, Rattus norvegicus
ccatctttgtgtctggcgagcgaag

SEQ ID NO: 532438 - DNA, 25 bp, Rattus norvegicus
cgagatcgcctaccgcaggtccggg

SEQ ID NO: 532439 - DNA, 25 bp, Rattus norvegicus
tgggcaaagcctcgcgagatcgcct

SEQ ID NO: 532440 - DNA, 25 bp, Rattus norvegicus
cctctggttcccgtgggcaaagcct

SEQ ID NO: 532441 - DNA, 25 bp, Rattus norvegicus
tcatttatcacctttcctgtgggga

SEQ ID NO: 532442 - DNA, 25 bp, Rattus norvegicus
tccgacctaggcgagcattcgcggg

SEQ ID NO: 532443 - DNA, 25 bp, Rattus norvegicus
cgtactaagtttcccagtgcgggtg

SEQ ID NO: 532444 - DNA, 25 bp, Rattus norvegicus
cggtctcgcgcaggcgtactaagtt

SEQ ID NO: 532445 - DNA, 25 bp, Rattus norvegicus
cgcactttacgagaagctcggggaa

SEQ ID NO: 532446 - DNA, 25 bp, Rattus norvegicus
ttctttggccaacctctccctgaga

SEQ ID NO: 532447 - DNA, 25 bp, Rattus norvegicus
ttgcgcagggcctgtcgtggcggct

SEQ ID NO: 532448 - DNA, 25 bp, Rattus norvegicus
cggcccgggtaagtacctggctgcg

SEQ ID NO: 532449 - DNA, 25 bp, Rattus norvegicus
ctctggctcttagccggcccgggta

SEQ ID NO: 532450 - DNA, 25 bp, Rattus norvegicus
ctccgctcggcctctggctcttagc

SEQ ID NO: 532451 - DNA, 25 bp, Rattus norvegicus
cgtgtatgagactgcgggtgttggc

SEQ ID NO: 532452 - DNA, 25 bp, Rattus norvegicus
cgcccacgacgttgggcgtgtatga

SEQ ID NO: 532453 - DNA, 25 bp, Rattus norvegicus
ccgcgcccacgacgttgggcgtgta

SEQ ID NO: 532454 - DNA, 25 bp, Rattus norvegicus
gtgccttggggtcgtcctactgacc

SEQ ID NO: 532455 - DNA, 25 bp, Rattus norvegicus
gcacctgcccgaggccaggactttg

SEQ ID NO: 532456 - DNA, 25 bp, Rattus norvegicus
agcacctgcccgaggccaggacttt

SEQ ID NO: 532457 - DNA, 25 bp, Rattus norvegicus
cgacagcgagggctcggtgagtggt

SEQ ID NO: 532458 - DNA, 25 bp, Rattus norvegicus
cctagcggaggagctcggagcgaca

SEQ ID NO: 532459 - DNA, 25 bp, Rattus norvegicus
gactgagagcctagcggaggagctc

SEQ ID NO: 532460 - DNA, 25 bp, Rattus norvegicus
aagtacctggctgcgggaggtttgc

SEQ ID NO: 532461 - DNA, 25 bp, Rattus norvegicus
cgccatcttggaagcttgtgacgtc

SEQ ID NO: 532462 - DNA, 25 bp, Rattus norvegicus
gatcccgacccaggagccagaacga

SEQ ID NO: 532463 - DNA, 25 bp, Rattus norvegicus
ccagtggctgctggatagcgtaatg

SEQ ID NO: 532464 - DNA, 25 bp, Rattus norvegicus
aagcttgtgacgtcagctccacccg

SEQ ID NO: 532465 - DNA, 25 bp, Rattus norvegicus
aggcgcacagccgtttgcataatgg

SEQ ID NO: 532466 - DNA, 25 bp, Rattus norvegicus
cgcttacctcatgtgcctgccagtg

SEQ ID NO: 532467 - DNA, 25 bp, Rattus norvegicus
ccgcgtgcgcctcggttcaggacta

SEQ ID NO: 532468 - DNA, 25 bp, Rattus norvegicus
atgaaaaggcacaaagagccggcgc

SEQ ID NO: 532469 - DNA, 25 bp, Rattus norvegicus
gcccgacgccgttcggattagattg

SEQ ID NO: 532470 - DNA, 25 bp, Rattus norvegicus
ccctgactgggacgcagacaggatc

SEQ ID NO: 532471 - DNA, 25 bp, Rattus norvegicus
tgcataatgggaaaacgcccgcctg

SEQ ID NO: 532472 - DNA, 25 bp, Rattus norvegicus
agcgcagttctggaaaccgtaaagc

SEQ ID NO: 532473 - DNA, 25 bp, Rattus norvegicus
ccgtaaagcgttccagtgaggggca

SEQ ID NO: 532474 - DNA, 25 bp, Rattus norvegicus
ccacatctgaatgggcgagcgacgg

SEQ ID NO: 532475 - DNA, 25 bp, Rattus norvegicus
cgactacagaaagaggcccagcagc

SEQ ID NO: 532476 - DNA, 25 bp, Rattus norvegicus
gccggccaatgagcgactacagaaa

SEQ ID NO: 532477 - DNA, 25 bp, Rattus norvegicus
tctgctgaaggctcactgggctcct

SEQ ID NO: 532478 - DNA, 25 bp, Rattus norvegicus
ccagcagcaggccaatctgagggtt

SEQ ID NO: 532479 - DNA, 25 bp, Rattus norvegicus
ccaatctgagggttgtgagacgtca

SEQ ID NO: 532480 - DNA, 25 bp, Rattus norvegicus
cgggaggagcatctgcctttagcca

SEQ ID NO: 532481 - DNA, 25 bp, Rattus norvegicus
ccaagctaaggcttaacggagggcg

SEQ ID NO: 532482 - DNA, 25 bp, Rattus norvegicus
cctgagacttaagcccgcaggagca

SEQ ID NO: 532483 - DNA, 25 bp, Rattus norvegicus
ccgcaggagcaacctggagtgccga

SEQ ID NO: 532484 - DNA, 25 bp, Rattus norvegicus
cctcttccctctctggtaggctgta

SEQ ID NO: 532485 - DNA, 25 bp, Rattus norvegicus
gtaggctgtacagagcgcgacctga

SEQ ID NO: 532486 - DNA, 25 bp, Rattus norvegicus
cgcgacctgagtcgccattggacga

SEQ ID NO: 532487 - DNA, 25 bp, Rattus norvegicus
cgccattggacgacacggttctttc

SEQ ID NO: 532488 - DNA, 25 bp, Rattus norvegicus
ctgaggcttgaacagaaccctgaga

SEQ ID NO: 532489 - DNA, 25 bp, Rattus norvegicus
agcgtcctgcgctaaaaagcggctc

SEQ ID NO: 532490 - DNA, 25 bp, Rattus norvegicus
gaagcttcgcctccgccattttata

SEQ ID NO: 532491 - DNA, 25 bp, Rattus norvegicus
ttcgcctccgccattttataactta

SEQ ID NO: 532492 - DNA, 25 bp, Rattus norvegicus
tccaaacttctagaagcttcgcctc

SEQ ID NO: 532493 - DNA, 25 bp, Rattus norvegicus
acacacctcacggtgggccgcgcgc

SEQ ID NO: 532494 - DNA, 25 bp, Rattus norvegicus
agccacacgctctcttcgcccaatc

SEQ ID NO: 532495 - DNA, 25 bp, Rattus norvegicus
cctgcgctaaaaagcggctctggga

SEQ ID NO: 532496 - DNA, 25 bp, Rattus norvegicus
aaaccttcagcttgggtagtggcaa

SEQ ID NO: 532497 - DNA, 25 bp, Rattus norvegicus
aggcgagagaaaaaccttcagcttg

SEQ ID NO: 532498 - DNA, 25 bp, Rattus norvegicus
cgttctccattttgggccacccatg

SEQ ID NO: 532499 - DNA, 25 bp, Rattus norvegicus
gcgccgctgcgcgttctccattttg

SEQ ID NO: 532500 - DNA, 25 bp, Rattus norvegicus
gcggaggcgccgagcctccatcttg

SEQ ID NO: 532501 - DNA, 25 bp, Rattus norvegicus
agaggaagcgatcgagcaggctacg

SEQ ID NO: 532502 - DNA, 25 bp, Rattus norvegicus
agtggcaaggaagcgtcctgcgcta

SEQ ID NO: 532503 - DNA, 25 bp, Rattus norvegicus
ttcccacattagttggagcggtgtg

SEQ ID NO: 532504 - DNA, 25 bp, Rattus norvegicus
cgcgagatttcgttcgcgactttga

SEQ ID NO: 532505 - DNA, 25 bp, Rattus norvegicus
actttgaagttagagaccggctgcg

SEQ ID NO: 532506 - DNA, 25 bp, Rattus norvegicus
atgcgctgtggcctcacaacctcgg

SEQ ID NO: 532507 - DNA, 25 bp, Rattus norvegicus
tggcctcacaacctcggggtggcac

SEQ ID NO: 532508 - DNA, 25 bp, Rattus norvegicus
tgagagatctgagccggggaaccca

SEQ ID NO: 532509 - DNA, 25 bp, Rattus norvegicus
gaacccaccgtgctggtgcttcttc

SEQ ID NO: 532510 - DNA, 25 bp, Rattus norvegicus
tccttgccgctattctctcagtgtg

SEQ ID NO: 532511 - DNA, 25 bp, Rattus norvegicus
ctattctctcagtgtgtgggtctaa

SEQ ID NO: 532512 - DNA, 25 bp, Rattus norvegicus
ctgtgtggcaggacccaactccgct

SEQ ID NO: 532513 - DNA, 25 bp, Rattus norvegicus
ccctcacgttcccacattagttgga

SEQ ID NO: 532514 - DNA, 25 bp, Rattus norvegicus
cggcgtggcgacagccaccgttgac

SEQ ID NO: 532515 - DNA, 25 bp, Rattus norvegicus
ggccagtttgtaggcatcgtccctg

SEQ ID NO: 532516 - DNA, 25 bp, Rattus norvegicus
cccatatataaggaaaccctcacgt

SEQ ID NO: 532517 - DNA, 25 bp, Rattus norvegicus
gtataaataagtcccaagcggcggc

SEQ ID NO: 532518 - DNA, 25 bp, Rattus norvegicus
gggcagcatcctctacaatctgttg

SEQ ID NO: 532519 - DNA, 25 bp, Rattus norvegicus
tacagcttgctcactagtgcccagc

SEQ ID NO: 532520 - DNA, 25 bp, Rattus norvegicus
gggcaagccttgtcccttctgtacc

SEQ ID NO: 532521 - DNA, 25 bp, Rattus norvegicus
ccagggtggcatcctctactctatg

SEQ ID NO: 532522 - DNA, 25 bp, Rattus norvegicus
gaggcagggcagcatcttatacagc

SEQ ID NO: 532523 - DNA, 25 bp, Rattus norvegicus
tgctgcttttgtggggagaaccacc

SEQ ID NO: 532524 - DNA, 25 bp, Rattus norvegicus
gcaaacgcacgtgtctcgggaagta

SEQ ID NO: 532525 - DNA, 25 bp, Rattus norvegicus
gctgtcctactgtacccagagtgtg

SEQ ID NO: 532526 - DNA, 25 bp, Rattus norvegicus
tcagagcacacaggccatggcgttc

SEQ ID NO: 532527 - DNA, 25 bp, Rattus norvegicus
atggcgttcctgtaccgtagctatg

SEQ ID NO: 532528 - DNA, 25 bp, Rattus norvegicus
cacgcccgtgagagcagatcaaaca

SEQ ID NO: 532529 - DNA, 25 bp, Rattus norvegicus
cttgcgtgagcgttcagtataaata

SEQ ID NO: 532530 - DNA, 25 bp, Rattus norvegicus
tgcagcgtccgattgcactcaagga

SEQ ID NO: 532531 - DNA, 25 bp, Rattus norvegicus
agcgcctctcagcacgtggagcaga

SEQ ID NO: 532532 - DNA, 25 bp, Rattus norvegicus
agaggacgagctccggctgaggtca

SEQ ID NO: 532533 - DNA, 25 bp, Rattus norvegicus
ttaccgcttgtcctgagcgcggaga

SEQ ID NO: 532534 - DNA, 25 bp, Rattus norvegicus
ctacacttgttaccgcttgtcctga

SEQ ID NO: 532535 - DNA, 25 bp, Rattus norvegicus
gcagagagacaccagagctccgcgc

SEQ ID NO: 532536 - DNA, 25 bp, Rattus norvegicus
agccaatcagagagcgcctctcagc

SEQ ID NO: 532537 - DNA, 25 bp, Rattus norvegicus
cggcctctgtcgagagccaatcaga

SEQ ID NO: 532538 - DNA, 25 bp, Rattus norvegicus
ggcaggcctacgcagcccggcctct

SEQ ID NO: 532539 - DNA, 25 bp, Rattus norvegicus
agttcgcgctttgcgctttgccggc

SEQ ID NO: 532540 - DNA, 25 bp, Rattus norvegicus
tgaggtcagagtgggagcccgcatc

SEQ ID NO: 532541 - DNA, 25 bp, Rattus norvegicus
cctccagaatccagttcgcgctttg

SEQ ID NO: 532542 - DNA, 25 bp, Rattus norvegicus
ggctcactacacttgttaccgcttg

SEQ ID NO: 532543 - DNA, 25 bp, Rattus norvegicus
atccagttcgcgctttgcgctttgc

SEQ ID NO: 532544 - DNA, 25 bp, Rattus norvegicus
ctcagcacgtggagcagagagacac

SEQ ID NO: 532545 - DNA, 25 bp, Rattus norvegicus
aggcggcaaagcagccggctgccaa

SEQ ID NO: 532546 - DNA, 25 bp, Rattus norvegicus
gccggctgccaacagctgcaaggca

SEQ ID NO: 532547 - DNA, 25 bp, Rattus norvegicus
ccaacagctgcaaggcaggggaaca

SEQ ID NO: 532548 - DNA, 25 bp, Rattus norvegicus
cagctgcaaggcaggggaacaaacg

SEQ ID NO: 532549 - DNA, 25 bp, Rattus norvegicus
caaacggtcgggctagcgcgctgac

SEQ ID NO: 532550 - DNA, 25 bp, Rattus norvegicus
gggctagcgcgctgaccacttttcc

SEQ ID NO: 532551 - DNA, 25 bp, Rattus norvegicus
tagcgcgctgaccacttttccttgc

SEQ ID NO: 532552 - DNA, 25 bp, Rattus norvegicus
tgaccacttttccttgcccgcaggc

SEQ ID NO: 532553 - DNA, 25 bp, Rattus norvegicus
gcgccccgttcgaggctgagctgca

SEQ ID NO: 532554 - DNA, 25 bp, Rattus norvegicus
caaagcagccggctgccaacagctg

SEQ ID NO: 532555 - DNA, 25 bp, Rattus norvegicus
aagctgcggcgcctgtacggcccgg

SEQ ID NO: 532556 - DNA, 25 bp, Rattus norvegicus
cacggatccggcactacgtttctca

SEQ ID NO: 532557 - DNA, 25 bp, Rattus norvegicus
cagccggctgccaacagctgcaagg

SEQ ID NO: 532558 - DNA, 25 bp, Rattus norvegicus
tgccacccaagctgcggcgcctgta

SEQ ID NO: 532559 - DNA, 25 bp, Rattus norvegicus
tcctgaagcgcaaacagaggcgtta

SEQ ID NO: 532560 - DNA, 25 bp, Rattus norvegicus
cgctcaaaattagccaggcaccgca

SEQ ID NO: 532561 - DNA, 25 bp, Rattus norvegicus
ctgcctgggacacgctcaaaattag

SEQ ID NO: 532562 - DNA, 25 bp, Rattus norvegicus
attagccaggcaccgcaggtgagca

SEQ ID NO: 532563 - DNA, 25 bp, Rattus norvegicus
cgcaggtgagcatcagccgcagcaa

SEQ ID NO: 532564 - DNA, 25 bp, Rattus norvegicus
tcagccgcagcaagtcgtaccgcga

SEQ ID NO: 532565 - DNA, 25 bp, Rattus norvegicus
cagcaagtcgtaccgcgagaacggg

SEQ ID NO: 532566 - DNA, 25 bp, Rattus norvegicus
agctgctggaagacgatgcccgcgc

SEQ ID NO: 532567 - DNA, 25 bp, Rattus norvegicus
ccaaggaagagctgttgctgcaccc

SEQ ID NO: 532568 - DNA, 25 bp, Rattus norvegicus
agagctgttgctgcacccggaggac

SEQ ID NO: 532569 - DNA, 25 bp, Rattus norvegicus
tgaggacagcgtgtgcctgtccgcc

SEQ ID NO: 532570 - DNA, 25 bp, Rattus norvegicus
aggaggggctcctgaagcgcaaaca

SEQ ID NO: 532571 - DNA, 25 bp, Rattus norvegicus
caaacagaggcgttaccgcaccacg

SEQ ID NO: 532572 - DNA, 25 bp, Rattus norvegicus
ctggaagacgatgcccgcgcgctac

SEQ ID NO: 532573 - DNA, 25 bp, Rattus norvegicus
ggctctgctagcctgccgcccagcg

SEQ ID NO: 532574 - DNA, 25 bp, Rattus norvegicus
tgggagcagccgtgttccggcaccc

SEQ ID NO: 532575 - DNA, 25 bp, Rattus norvegicus
cagcgcttgactcggcctggaccgc

SEQ ID NO: 532576 - DNA, 25 bp, Rattus norvegicus
ggctgcagctgccttcccgagccta

SEQ ID NO: 532577 - DNA, 25 bp, Rattus norvegicus
gctgccttcccgagcctacctccgc

SEQ ID NO: 532578 - DNA, 25 bp, Rattus norvegicus
gagaaggctggcgcgcagacccacc

SEQ ID NO: 532579 - DNA, 25 bp, Rattus norvegicus
ttcccgggccactctcggctaccca

SEQ ID NO: 532580 - DNA, 25 bp, Rattus norvegicus
gccgctgggcctgagcactttcctg

SEQ ID NO: 532581 - DNA, 25 bp, Rattus norvegicus
cccgcatcacccagcgcttgactcg

SEQ ID NO: 532582 - DNA, 25 bp, Rattus norvegicus
cactctcggctacccaccctctcag

SEQ ID NO: 532583 - DNA, 25 bp, Rattus norvegicus
actttcctgggagcagccgtgttcc

SEQ ID NO: 532584 - DNA, 25 bp, Rattus norvegicus
tgagcactttcctgggagcagccgt

SEQ ID NO: 532585 - DNA, 25 bp, Rattus norvegicus
cctgagcactttcctgggagcagcc

SEQ ID NO: 532586 - DNA, 25 bp, Rattus norvegicus
ggcctgagcactttcctgggagcag

SEQ ID NO: 532587 - DNA, 25 bp, Rattus norvegicus
aatccctgcgtggagagtaatcccg

SEQ ID NO: 532588 - DNA, 25 bp, Rattus norvegicus
ggtacaagagtaatccctgcgtgga

SEQ ID NO: 532589 - DNA, 25 bp, Rattus norvegicus
ctccgggagcccaggtgggctattt

SEQ ID NO: 532590 - DNA, 25 bp, Rattus norvegicus
gctgaaacaccggagattcctcgag

SEQ ID NO: 532591 - DNA, 25 bp, Rattus norvegicus
ttgtggggaaggtacaagagtaatc

SEQ ID NO: 532592 - DNA, 25 bp, Rattus norvegicus
ttggcacgacgagtgaagagaaggc

SEQ ID NO: 532593 - DNA, 25 bp, Rattus norvegicus
agagtaatcccggtgccacccggag

SEQ ID NO: 532594 - DNA, 25 bp, Rattus norvegicus
tggttagaaaaacacgccacgccgc

SEQ ID NO: 532595 - DNA, 25 bp, Rattus norvegicus
gggctatttctaattgaggaaattc

SEQ ID NO: 532596 - DNA, 25 bp, Rattus norvegicus
ttgaggaaattctgaatcgaatcgc

SEQ ID NO: 532597 - DNA, 25 bp, Rattus norvegicus
tctgaatcgaatcgcgctcccggga

SEQ ID NO: 532598 - DNA, 25 bp, Rattus norvegicus
cgccacgccgccaaggtggagacga

SEQ ID NO: 532599 - DNA, 25 bp, Rattus norvegicus
gcccaggtgggctatttctaattga

SEQ ID NO: 532600 - DNA, 25 bp, Rattus norvegicus
caccggagattcctcgaggttggga

SEQ ID NO: 532601 - DNA, 25 bp, Rattus norvegicus
actcagcaccactcaagaccaaatg

SEQ ID NO: 532602 - DNA, 25 bp, Rattus norvegicus
cagctcactcccaagacggcaaaga

SEQ ID NO: 532603 - DNA, 25 bp, Rattus norvegicus
tgagacagcccacacccgcagtgga

SEQ ID NO: 532604 - DNA, 25 bp, Rattus norvegicus
caaggcagctcttggcgctaaagga

SEQ ID NO: 532605 - DNA, 25 bp, Rattus norvegicus
accctggacgcggacaaggcagctc

SEQ ID NO: 532606 - DNA, 25 bp, Rattus norvegicus
ggcaaagacagagcgcagccgcctt

SEQ ID NO: 532607 - DNA, 25 bp, Rattus norvegicus
ggcgctaaaggacgtggcacctctt

SEQ ID NO: 532608 - DNA, 25 bp, Rattus norvegicus
ccaaatggaaacagaggaccagctc

SEQ ID NO: 532609 - DNA, 25 bp, Rattus norvegicus
tcaaggctaaggagcacgccgcgca

SEQ ID NO: 532610 - DNA, 25 bp, Rattus norvegicus
aggtgtgctaaaggctgccctccgc

SEQ ID NO: 532611 - DNA, 25 bp, Rattus norvegicus
catagcggcgctgaggctcaaggct

SEQ ID NO: 532612 - DNA, 25 bp, Rattus norvegicus
cgcgcatcgagcatagcggcgctga

SEQ ID NO: 532613 - DNA, 25 bp, Rattus norvegicus
cagacagacgcgcatcgagcatagc

SEQ ID NO: 532614 - DNA, 25 bp, Rattus norvegicus
ttcgcagcagcctggaccctggacg

SEQ ID NO: 532615 - DNA, 25 bp, Rattus norvegicus
agttctgcctcaccagttcgtggta

SEQ ID NO: 532616 - DNA, 25 bp, Rattus norvegicus
ctttggggtgccatcagtattgctc

SEQ ID NO: 532617 - DNA, 25 bp, Rattus norvegicus
gggcttctaagggtggctcttccaa

SEQ ID NO: 532618 - DNA, 25 bp, Rattus norvegicus
ttggagcactcatggccctcaggtt

SEQ ID NO: 532619 - DNA, 25 bp, Rattus norvegicus
caccagtgttcaggctttcgaggga

SEQ ID NO: 532620 - DNA, 25 bp, Rattus norvegicus
gccagcggaagtgctctaggatgta

SEQ ID NO: 532621 - DNA, 25 bp, Rattus norvegicus
agttttcttcgcgtaggtcacagca

SEQ ID NO: 532622 - DNA, 25 bp, Rattus norvegicus
cgagtcttcgcagggcttgttctca

SEQ ID NO: 532623 - DNA, 25 bp, Rattus norvegicus
ggcttgttctccatcggtctcccag

SEQ ID NO: 532624 - DNA, 25 bp, Rattus norvegicus
tctcggggcaattcagtgtgttgtc

SEQ ID NO: 532625 - DNA, 25 bp, Rattus norvegicus
cgctcctggtgtagcaactgctgca

SEQ ID NO: 532626 - DNA, 25 bp, Rattus norvegicus
ttcgaggctctcacctggcattgga

SEQ ID NO: 532627 - DNA, 25 bp, Rattus norvegicus
tgcgccgcagctgcaagttttcttc

SEQ ID NO: 532628 - DNA, 25 bp, Rattus norvegicus
ggtcagctctgcgtgcttcacctta

SEQ ID NO: 532629 - DNA, 25 bp, Rattus norvegicus
gcaccgccaagacgctagcaaccgc

SEQ ID NO: 532630 - DNA, 25 bp, Rattus norvegicus
ttgcagcaattagcgcgccggacct

SEQ ID NO: 532631 - DNA, 25 bp, Rattus norvegicus
gagtagagaaccgccgcaccgccaa

SEQ ID NO: 532632 - DNA, 25 bp, Rattus norvegicus
actacgacggctggcggagtagaga

SEQ ID NO: 532633 - DNA, 25 bp, Rattus norvegicus
gctgcgcggcatgactacgacggct

SEQ ID NO: 532634 - DNA, 25 bp, Rattus norvegicus
cgccccttagggtgaccgctcggtg

SEQ ID NO: 532635 - DNA, 25 bp, Rattus norvegicus
caatttgcagcaattagcgcgccgg

SEQ ID NO: 532636 - DNA, 25 bp, Rattus norvegicus
gcttaattagtttcaatttgcagca

SEQ ID NO: 532637 - DNA, 25 bp, Rattus norvegicus
ggaagagaagcttaattagtttcaa

SEQ ID NO: 532638 - DNA, 25 bp, Rattus norvegicus
ccagggtgatgggaaagggaagaga

SEQ ID NO: 532639 - DNA, 25 bp, Rattus norvegicus
gtctcgccaatgctcccagggtgat

SEQ ID NO: 532640 - DNA, 25 bp, Rattus norvegicus
gctgggtctcgccaatgctcccagg

SEQ ID NO: 532641 - DNA, 25 bp, Rattus norvegicus
tgaccgctcggtggaagctcgcccg

SEQ ID NO: 532642 - DNA, 25 bp, Rattus norvegicus
ctcgccaatgctcccagggtgatgg

SEQ ID NO: 532643 - DNA, 25 bp, Rattus norvegicus
gccttcccgcgggactgcatttggc

SEQ ID NO: 532644 - DNA, 25 bp, Rattus norvegicus
gtctccgtgaacaggcgccatggtc

SEQ ID NO: 532645 - DNA, 25 bp, Rattus norvegicus
agaaacctcctgaagacactgcgca

SEQ ID NO: 532646 - DNA, 25 bp, Rattus norvegicus
tcgggcgctgaaaagaaacctcctg

SEQ ID NO: 532647 - DNA, 25 bp, Rattus norvegicus
gggactgcatttggcgccctgtgat

SEQ ID NO: 532648 - DNA, 25 bp, Rattus norvegicus
ccactgacgtgcagcgttgcgccgt

SEQ ID NO: 532649 - DNA, 25 bp, Rattus norvegicus
cgcccggaaggccactgacgtgcag

SEQ ID NO: 532650 - DNA, 25 bp, Rattus norvegicus
cgaaagccaatcagcggcctggaag

SEQ ID NO: 532651 - DNA, 25 bp, Rattus norvegicus
ggcgccagtacgaaagccaatcagc

SEQ ID NO: 532652 - DNA, 25 bp, Rattus norvegicus
cgagataggcgccagtacgaaagcc

SEQ ID NO: 532653 - DNA, 25 bp, Rattus norvegicus
aaccagcccgaaactggcgcggagg

SEQ ID NO: 532654 - DNA, 25 bp, Rattus norvegicus
cgatagtctaccgattccgcgccaa

SEQ ID NO: 532655 - DNA, 25 bp, Rattus norvegicus
gcgccatggtccgatagtctaccga

SEQ ID NO: 532656 - DNA, 25 bp, Rattus norvegicus
ggaaaagcgggaacctctgcaagga

SEQ ID NO: 532657 - DNA, 25 bp, Rattus norvegicus
gtgggtctcagcctgccaccagcca

SEQ ID NO: 532658 - DNA, 25 bp, Rattus norvegicus
caagccgtcccggactggagcagag

SEQ ID NO: 532659 - DNA, 25 bp, Rattus norvegicus
agcgggagtagcgctcgatctgctt

SEQ ID NO: 532660 - DNA, 25 bp, Rattus norvegicus
gaagagccgcatccttactggtgga

SEQ ID NO: 532661 - DNA, 25 bp, Rattus norvegicus
gagtgtgcagatccgccaagccgtc

SEQ ID NO: 532662 - DNA, 25 bp, Rattus norvegicus
cgccgccaagacacaaggaggaggc

SEQ ID NO: 532663 - DNA, 25 bp, Rattus norvegicus
gccgcggcacctacccaagcaccgg

SEQ ID NO: 532664 - DNA, 25 bp, Rattus norvegicus
aagcaccgggcagcagttaggcgcc

SEQ ID NO: 532665 - DNA, 25 bp, Rattus norvegicus
ccgcctagaaaaggcgggatctgcc

SEQ ID NO: 532666 - DNA, 25 bp, Rattus norvegicus
gcctccgccgccaaagcttccttaa

SEQ ID NO: 532667 - DNA, 25 bp, Rattus norvegicus
cttgagcagccggtagaagagccgc

SEQ ID NO: 532668 - DNA, 25 bp, Rattus norvegicus
agccagctagttgctgccggtcccg

SEQ ID NO: 532669 - DNA, 25 bp, Rattus norvegicus
aaggcgggatctgccgccgcacgta

SEQ ID NO: 532670 - DNA, 25 bp, Rattus norvegicus
ccttactggtggagtgtgcagatcc

SEQ ID NO: 532671 - DNA, 25 bp, Rattus norvegicus
gagcaccgagaggaacagcactacc

SEQ ID NO: 532672 - DNA, 25 bp, Rattus norvegicus
ggttacctcttgaagtccctcatga

SEQ ID NO: 532673 - DNA, 25 bp, Rattus norvegicus
ctggcagcgagaacggagctaatcg

SEQ ID NO: 532674 - DNA, 25 bp, Rattus norvegicus
cggaccgcagactcacccaaaaatg

SEQ ID NO: 532675 - DNA, 25 bp, Rattus norvegicus
gaccgcgttccaaaccattatgttg

SEQ ID NO: 532676 - DNA, 25 bp, Rattus norvegicus
attatgttgttctccgacggggctc

SEQ ID NO: 532677 - DNA, 25 bp, Rattus norvegicus
ccggaggatcctcttgtaaccttca

SEQ ID NO: 532678 - DNA, 25 bp, Rattus norvegicus
tcgacatggctttagcagggtcaga

SEQ ID NO: 532679 - DNA, 25 bp, Rattus norvegicus
cagggtcagaggtagggcatatacc

SEQ ID NO: 532680 - DNA, 25 bp, Rattus norvegicus
atataccagggtccgcggtccctga

SEQ ID NO: 532681 - DNA, 25 bp, Rattus norvegicus
actacctctccgaagccgagggtcg

SEQ ID NO: 532682 - DNA, 25 bp, Rattus norvegicus
ggccgaaccaacctgaggagaacgc

SEQ ID NO: 532683 - DNA, 25 bp, Rattus norvegicus
actgtaccaagtcggctacggggcg

SEQ ID NO: 532684 - DNA, 25 bp, Rattus norvegicus
ccaaagttgttctgtcagtcacgcc

SEQ ID NO: 532685 - DNA, 25 bp, Rattus norvegicus
agccggtaggcctcgcgcccgtccg

SEQ ID NO: 532686 - DNA, 25 bp, Rattus norvegicus
gagccggtaggcctcgcgcccgtcc

SEQ ID NO: 532687 - DNA, 25 bp, Rattus norvegicus
gccggtaggcctcgcgcccgtccgc

SEQ ID NO: 532688 - DNA, 25 bp, Rattus norvegicus
cccaggaaccggtaggcctcgcgct

SEQ ID NO: 532689 - DNA, 25 bp, Rattus norvegicus
cgtccgccgctcgatgcccaccctt

SEQ ID NO: 532690 - DNA, 25 bp, Rattus norvegicus
tccgtccgccgctcgatgcccaccc

SEQ ID NO: 532691 - DNA, 25 bp, Rattus norvegicus
ccaggaaccggtaggcctcgcgctc

SEQ ID NO: 532692 - DNA, 25 bp, Rattus norvegicus
tccgccgctcgatgcccacccttcc

SEQ ID NO: 532693 - DNA, 25 bp, Rattus norvegicus
gcccgtccgccgctcgatgcccacc

SEQ ID NO: 532694 - DNA, 25 bp, Rattus norvegicus
cctcgcgcccgtccgccgctcgatg

SEQ ID NO: 532695 - DNA, 25 bp, Rattus norvegicus
caggaaccggtaggcctcgcgcccg

SEQ ID NO: 532696 - DNA, 25 bp, Rattus norvegicus
gcccgtccgccgctcgatgtccacc

SEQ ID NO: 532697 - DNA, 25 bp, Rattus norvegicus
gtccgccgctcgatgcccacccttc

SEQ ID NO: 532698 - DNA, 25 bp, Rattus norvegicus
ccgtccgccgctcgatgcccaccct

SEQ ID NO: 532699 - DNA, 25 bp, Rattus norvegicus
tgggtgttttcagaaacttgcaaac

SEQ ID NO: 532700 - DNA, 25 bp, Rattus norvegicus
ggttcgctttgactcgtcttttctg

SEQ ID NO: 532701 - DNA, 25 bp, Rattus norvegicus
cttttctgttaagtcgaggtctctc

SEQ ID NO: 532702 - DNA, 25 bp, Rattus norvegicus
tctctcggtgcagcccagacgggct

SEQ ID NO: 532703 - DNA, 25 bp, Rattus norvegicus
ctttggcggcggctgagcgccaaaa

SEQ ID NO: 532704 - DNA, 25 bp, Rattus norvegicus
gcgccaaaagtacagtgcaggaatt

SEQ ID NO: 532705 - DNA, 25 bp, Rattus norvegicus
tacagtgcaggaattggaggcgtcc

SEQ ID NO: 532706 - DNA, 25 bp, Rattus norvegicus
tgtccacttccagcgcagagggcta

SEQ ID NO: 532707 - DNA, 25 bp, Rattus norvegicus
ttccagcgcagagggctaccggcct

SEQ ID NO: 532708 - DNA, 25 bp, Rattus norvegicus
ctaccggcctgcacacgggcagtga

SEQ ID NO: 532709 - DNA, 25 bp, Rattus norvegicus
ctccgaaggtatgggtgttttcaga

SEQ ID NO: 532710 - DNA, 25 bp, Rattus norvegicus
tgaggtagttttcggttcgctttga

SEQ ID NO: 532711 - DNA, 25 bp, Rattus norvegicus
ttgcaaacattttgaggtagttttc

SEQ ID NO: 532712 - DNA, 25 bp, Rattus norvegicus
acacgggcagtgacctccgaaggta

SEQ ID NO: 532713 - DNA, 25 bp, Rattus norvegicus
agcccgagaccggtctggtgccaaa

SEQ ID NO: 532714 - DNA, 25 bp, Rattus norvegicus
accggtctggtgtcaaagcccgcga

SEQ ID NO: 532715 - DNA, 25 bp, Rattus norvegicus
cgagaccggtctggtgtcaaagccc

SEQ ID NO: 532716 - DNA, 25 bp, Rattus norvegicus
gtctggtgtcaaagcccgagaccgg

SEQ ID NO: 532717 - DNA, 25 bp, Rattus norvegicus
tctggtgtcaaagcccgagaccggt

SEQ ID NO: 532718 - DNA, 25 bp, Rattus norvegicus
agcccgcgaccggtctggtgtcaaa

SEQ ID NO: 532719 - DNA, 25 bp, Rattus norvegicus
caaagcccgagaccggtctggtgtc

SEQ ID NO: 532720 - DNA, 25 bp, Rattus norvegicus
cggtctggtgtcaaagcccgcgacc

SEQ ID NO: 532721 - DNA, 25 bp, Rattus norvegicus
cgaccggtctggtgtcaaagcccga

SEQ ID NO: 532722 - DNA, 25 bp, Rattus norvegicus
tgtcaaagcccgagaccggtctggt

SEQ ID NO: 532723 - DNA, 25 bp, Rattus norvegicus
cccgagaccggtctggtgtcaaagc

SEQ ID NO: 532724 - DNA, 25 bp, Rattus norvegicus
agaccggtctggtgtcaaagcccga

SEQ ID NO: 532725 - DNA, 25 bp, Rattus norvegicus
accggtctggtgtcaaagcccgaga

SEQ ID NO: 532726 - DNA, 25 bp, Rattus norvegicus
cgcgaccggtctggtgtcaaagccc

SEQ ID NO: 532727 - DNA, 25 bp, Rattus norvegicus
cggactcaccggacagtcgtgcggc

SEQ ID NO: 532728 - DNA, 25 bp, Rattus norvegicus
acatagcgaaaatcggcccggccgg

SEQ ID NO: 532729 - DNA, 25 bp, Rattus norvegicus
aatggccgccatggggagcgaacac

SEQ ID NO: 532730 - DNA, 25 bp, Rattus norvegicus
ccggcctttctctggagcactgggc

SEQ ID NO: 532731 - DNA, 25 bp, Rattus norvegicus
ctcggagctgacaaaaagcggccca

SEQ ID NO: 532732 - DNA, 25 bp, Rattus norvegicus
agcacgtcacgtcaccgccggggag

SEQ ID NO: 532733 - DNA, 25 bp, Rattus norvegicus
agacccaggaaaatgcggaaggata

SEQ ID NO: 532734 - DNA, 25 bp, Rattus norvegicus
ccctcgccgatatttacatagcgaa

SEQ ID NO: 532735 - DNA, 25 bp, Rattus norvegicus
aggcgccgatcgtccgccatcttgt

SEQ ID NO: 532736 - DNA, 25 bp, Rattus norvegicus
ctcagacgccgccttcaaaatggcg

SEQ ID NO: 532737 - DNA, 25 bp, Rattus norvegicus
tagcggaattttctcctcagacgcc

SEQ ID NO: 532738 - DNA, 25 bp, Rattus norvegicus
cctcacgggctgtagcggaattttc

SEQ ID NO: 532739 - DNA, 25 bp, Rattus norvegicus
cggcctgagtttccgtgacagcgcc

SEQ ID NO: 532740 - DNA, 25 bp, Rattus norvegicus
gcactaggccctacggccgcagtgg

SEQ ID NO: 532741 - DNA, 25 bp, Rattus norvegicus
ctttcgcgagggagcttgtctgcga

SEQ ID NO: 532742 - DNA, 25 bp, Rattus norvegicus
cagtcgaaaggctttccgcaaggga

SEQ ID NO: 532743 - DNA, 25 bp, Rattus norvegicus
cacccagtcgaaaggctttccgcaa

SEQ ID NO: 532744 - DNA, 25 bp, Rattus norvegicus
aacgtgccttaagtgggacaggcga

SEQ ID NO: 532745 - DNA, 25 bp, Rattus norvegicus
aggcgaacgtgccttaagtgggaca

SEQ ID NO: 532746 - DNA, 25 bp, Rattus norvegicus
ttccaggcgaacgtgccttaagtgg

SEQ ID NO: 532747 - DNA, 25 bp, Rattus norvegicus
caggttccaggcgaacgtgccttaa

SEQ ID NO: 532748 - DNA, 25 bp, Rattus norvegicus
gcgatgcacgaaaccctgacccaga

SEQ ID NO: 532749 - DNA, 25 bp, Rattus norvegicus
agggagcttgtctgcgatgcacgaa

SEQ ID NO: 532750 - DNA, 25 bp, Rattus norvegicus
caccagagtcgcgacgtggggaccc

SEQ ID NO: 532751 - DNA, 25 bp, Rattus norvegicus
atgcacgaaaccctgacccagaagc

SEQ ID NO: 532752 - DNA, 25 bp, Rattus norvegicus
ctgactttcgcgagggagcttgtct

SEQ ID NO: 532753 - DNA, 25 bp, Rattus norvegicus
agcttgtctgcgatgcacgaaaccc

SEQ ID NO: 532754 - DNA, 25 bp, Rattus norvegicus
ttgtctgcgatgcacgaaaccctga

SEQ ID NO: 532755 - DNA, 25 bp, Rattus norvegicus
taatggctcggctagtaaagtcgtg

SEQ ID NO: 532756 - DNA, 25 bp, Rattus norvegicus
ctcagcggcggaatcgaatctagtc

SEQ ID NO: 532757 - DNA, 25 bp, Rattus norvegicus
gtcccaaaccgagtagcgtgataga

SEQ ID NO: 532758 - DNA, 25 bp, Rattus norvegicus
ctcagcagggcggatgtttgcccaa

SEQ ID NO: 532759 - DNA, 25 bp, Rattus norvegicus
cccaaggttggagtgcatagcagga

SEQ ID NO: 532760 - DNA, 25 bp, Rattus norvegicus
cgcgtctggaggttctggattcctc

SEQ ID NO: 532761 - DNA, 25 bp, Rattus norvegicus
tggattcctccatggcggatgaacg

SEQ ID NO: 532762 - DNA, 25 bp, Rattus norvegicus
caggccactcctcgttcattttaga

SEQ ID NO: 532763 - DNA, 25 bp, Rattus norvegicus
tcaaactgacggatctggacccacc

SEQ ID NO: 532764 - DNA, 25 bp, Rattus norvegicus
ggagtcaattatctttccgcgctga

SEQ ID NO: 532765 - DNA, 25 bp, Rattus norvegicus
tcctgtttgcctagcgcacgcttta

SEQ ID NO: 532766 - DNA, 25 bp, Rattus norvegicus
acgcaggctccgtagctcttcgaga

SEQ ID NO: 532767 - DNA, 25 bp, Rattus norvegicus
agtcgtacttccgttgcctactgcg

SEQ ID NO: 532768 - DNA, 25 bp, Rattus norvegicus
ctgatcaccctagcgtagcgcacta

SEQ ID NO: 532769 - DNA, 25 bp, Rattus norvegicus
tgccgcgttcggagagatctaacgg

SEQ ID NO: 532770 - DNA, 25 bp, Rattus norvegicus
caagctaggcgccctcggggaagaa

SEQ ID NO: 532771 - DNA, 25 bp, Rattus norvegicus
tcgaggacgccgttgatgtatgggc

SEQ ID NO: 532772 - DNA, 25 bp, Rattus norvegicus
atcagcttgagcagttctcgtgccc

SEQ ID NO: 532773 - DNA, 25 bp, Rattus norvegicus
ccgatcagcttgagcagttctcgtg

SEQ ID NO: 532774 - DNA, 25 bp, Rattus norvegicus
ccctccgatcagcttgagcagttct

SEQ ID NO: 532775 - DNA, 25 bp, Rattus norvegicus
ttcggagagatctaacggggccgcc

SEQ ID NO: 532776 - DNA, 25 bp, Rattus norvegicus
ctgggccgcggtcgccgttctctga

SEQ ID NO: 532777 - DNA, 25 bp, Rattus norvegicus
ctgtgccgcgttcggagagatctaa

SEQ ID NO: 532778 - DNA, 25 bp, Rattus norvegicus
gttcttcatccctcgttgcgtggcc

SEQ ID NO: 532779 - DNA, 25 bp, Rattus norvegicus
accgttcttcatccctcgttgcgtg

SEQ ID NO: 532780 - DNA, 25 bp, Rattus norvegicus
tggggcgacaccgttcttcatccct

SEQ ID NO: 532781 - DNA, 25 bp, Rattus norvegicus
ttccttggggcgacaccgttcttca

SEQ ID NO: 532782 - DNA, 25 bp, Rattus norvegicus
cggagagatctaacggggccgccta

SEQ ID NO: 532783 - DNA, 25 bp, Rattus norvegicus
gctggcgtttctattgccctcgacc

SEQ ID NO: 532784 - DNA, 25 bp, Rattus norvegicus
agactgccgtccactagaggctgga

SEQ ID NO: 532785 - DNA, 25 bp, Rattus norvegicus
tggcccgcttcttcctgatgcagac

SEQ ID NO: 532786 - DNA, 25 bp, Rattus norvegicus
aggcctgctctctaacctacggctt

SEQ ID NO: 532787 - DNA, 25 bp, Rattus norvegicus
cttctatcttggagaggcttgcttc

SEQ ID NO: 532788 - DNA, 25 bp, Rattus norvegicus
ttgcttccgcgtcctagagaccctg

SEQ ID NO: 532789 - DNA, 25 bp, Rattus norvegicus
tctatgtcgttaccgctggcgtttc

SEQ ID NO: 532790 - DNA, 25 bp, Rattus norvegicus
tctgaggagcctatcgtggtccagc

SEQ ID NO: 532791 - DNA, 25 bp, Rattus norvegicus
cagttcgtggccctaagtcggctct

SEQ ID NO: 532792 - DNA, 25 bp, Rattus norvegicus
ccgcgacgtccctcggtattggcaa

SEQ ID NO: 532793 - DNA, 25 bp, Rattus norvegicus
gcagcacgcctagcccaactgtttg

SEQ ID NO: 532794 - DNA, 25 bp, Rattus norvegicus
ttggactctccactcaatcgctgtc

SEQ ID NO: 532795 - DNA, 25 bp, Rattus norvegicus
atctggcgtgggacaactctcccgc

SEQ ID NO: 532796 - DNA, 25 bp, Rattus norvegicus
cccggagactccgtcgtctatgtcg

SEQ ID NO: 532797 - DNA, 25 bp, Rattus norvegicus
cgcgcctctcggttgctaagtaaca

SEQ ID NO: 532798 - DNA, 25 bp, Rattus norvegicus
ctggtgaagtctacgctcgtctgtc

SEQ ID NO: 532799 - DNA, 25 bp, Rattus norvegicus
gcgaggagccaaagaaccgccttct

SEQ ID NO: 532800 - DNA, 25 bp, Rattus norvegicus
gccttctctttaccacggcgtgcag

SEQ ID NO: 532801 - DNA, 25 bp, Rattus norvegicus
atcaggatctaacccggccaccgta

SEQ ID NO: 532802 - DNA, 25 bp, Rattus norvegicus
ttgaattcgttaggttcccgcgcgc

SEQ ID NO: 532803 - DNA, 25 bp, Rattus norvegicus
gctgcttctctctaccagactggtg

SEQ ID NO: 532804 - DNA, 25 bp, Rattus norvegicus
gctaagtaacacgacgcgccatcta

SEQ ID NO: 532805 - DNA, 25 bp, Rattus norvegicus
tctagcggcgtaagcttgagctttt

SEQ ID NO: 532806 - DNA, 25 bp, Rattus norvegicus
ggtaacctggcgtcacagcatcatc

SEQ ID NO: 532807 - DNA, 25 bp, Rattus norvegicus
agcatcatctcgtgcccgctcgtgg

SEQ ID NO: 532808 - DNA, 25 bp, Rattus norvegicus
gcggtcaggtcgatccgctgcttct

SEQ ID NO: 532809 - DNA, 25 bp, Rattus norvegicus
tcgtggtcaagggaatcaggatcta

SEQ ID NO: 532810 - DNA, 25 bp, Rattus norvegicus
tgggccgcctagcaacagcctgcaa

SEQ ID NO: 532811 - DNA, 25 bp, Rattus norvegicus
gggcaaaatcagatcctgccatttg

SEQ ID NO: 532812 - DNA, 25 bp, Rattus norvegicus
atcagatcctgccatttgcgcgacc

SEQ ID NO: 532813 - DNA, 25 bp, Rattus norvegicus
ccctattcgataaacgctagaaatt

SEQ ID NO: 532814 - DNA, 25 bp, Rattus norvegicus
atcctgccatttgcgcgacctgagg

SEQ ID NO: 532815 - DNA, 25 bp, Rattus norvegicus
ccatttgcgcgacctgaggggccag

SEQ ID NO: 532816 - DNA, 25 bp, Rattus norvegicus
tgggcgtaatctgtcagcaaggaaa

SEQ ID NO: 532817 - DNA, 25 bp, Rattus norvegicus
tgtcagcaaggaaaatggaggaatt

SEQ ID NO: 532818 - DNA, 25 bp, Rattus norvegicus
agcggggttctcacctggaagccgc

SEQ ID NO: 532819 - DNA, 25 bp, Rattus norvegicus
tctcacctggaagccgcggaggcct

SEQ ID NO: 532820 - DNA, 25 bp, Rattus norvegicus
tctaggccggaagaagggcaaaatc

SEQ ID NO: 532821 - DNA, 25 bp, Rattus norvegicus
tagaaatttgagagcccgcggagtc

SEQ ID NO: 532822 - DNA, 25 bp, Rattus norvegicus
cgctagaaatttgagagcccgcgga

SEQ ID NO: 532823 - DNA, 25 bp, Rattus norvegicus
gatggctgaaaagggccgcccctcc

SEQ ID NO: 532824 - DNA, 25 bp, Rattus norvegicus
ccggaagaagggcaaaatcagatcc

SEQ ID NO: 532825 - DNA, 25 bp, Rattus norvegicus
gtaggaccgaattgtgtgtgcgcgt

SEQ ID NO: 532826 - DNA, 25 bp, Rattus norvegicus
tctgaatgcggtagtttacaggggc

SEQ ID NO: 532827 - DNA, 25 bp, Rattus norvegicus
agcgctctgaatgcggtagtttaca

SEQ ID NO: 532828 - DNA, 25 bp, Rattus norvegicus
tggaatcagataagcgctctgaatg

SEQ ID NO: 532829 - DNA, 25 bp, Rattus norvegicus
cggtttggaatcagataagcgctct

SEQ ID NO: 532830 - DNA, 25 bp, Rattus norvegicus
caaatccgcggtttggaatcagata

SEQ ID NO: 532831 - DNA, 25 bp, Rattus norvegicus
caggtaaaagcttcaaatccgcggt

SEQ ID NO: 532832 - DNA, 25 bp, Rattus norvegicus
gctgacaggtaaaagcttcaaatcc

SEQ ID NO: 532833 - DNA, 25 bp, Rattus norvegicus
atctaaaatttccagaagctgacag

SEQ ID NO: 532834 - DNA, 25 bp, Rattus norvegicus
gtcccgatagacaatctaaaatttc

SEQ ID NO: 532835 - DNA, 25 bp, Rattus norvegicus
tggtcgtcccgatagacaatctaaa

SEQ ID NO: 532836 - DNA, 25 bp, Rattus norvegicus
aagtaaatggtcgtcccgatagaca

SEQ ID NO: 532837 - DNA, 25 bp, Rattus norvegicus
tacggggagaaacaggcctaactga

SEQ ID NO: 532838 - DNA, 25 bp, Rattus norvegicus
acaggcctaactgaagcgggaaaag

SEQ ID NO: 532839 - DNA, 25 bp, Rattus norvegicus
ggcaggaaggctggcgaggggctgc

SEQ ID NO: 532840 - DNA, 25 bp, Rattus norvegicus
acgagcgcgcggcaggaaggctggc

SEQ ID NO: 532841 - DNA, 25 bp, Rattus norvegicus
cctagaggcagtgcgcgacgagcgc

SEQ ID NO: 532842 - DNA, 25 bp, Rattus norvegicus
gccccctagaggcagtgcgcgacga

SEQ ID NO: 532843 - DNA, 25 bp, Rattus norvegicus
cgactaaactctcgcccgcgagcgc

SEQ ID NO: 532844 - DNA, 25 bp, Rattus norvegicus
gacgactaaactctcgcccgcgagc

SEQ ID NO: 532845 - DNA, 25 bp, Rattus norvegicus
gacgacgactaaactctcgcccgcg

SEQ ID NO: 532846 - DNA, 25 bp, Rattus norvegicus
gtgacgacgactaaactctcgcccg

SEQ ID NO: 532847 - DNA, 25 bp, Rattus norvegicus
ggtgacgacgactaaactctcgccc

SEQ ID NO: 532848 - DNA, 25 bp, Rattus norvegicus
tggtgacgacgactaaactctcgcc

SEQ ID NO: 532849 - DNA, 25 bp, Rattus norvegicus
gtggtgacgacgactaaactctcgc

SEQ ID NO: 532850 - DNA, 25 bp, Rattus norvegicus
cggtggtgacgacgactaaactctc

SEQ ID NO: 532851 - DNA, 25 bp, Rattus norvegicus
gcggtggtgacgacgactaaactct

SEQ ID NO: 532852 - DNA, 25 bp, Rattus norvegicus
ggtggtgacgacgactaaactctcg

SEQ ID NO: 532853 - DNA, 25 bp, Rattus norvegicus
tcacaccatggatctcggcagcagc

SEQ ID NO: 532854 - DNA, 25 bp, Rattus norvegicus
ccgactgctgggatcaggtggacat

SEQ ID NO: 532855 - DNA, 25 bp, Rattus norvegicus
tcctgccttactaccaccggtagaa

SEQ ID NO: 532856 - DNA, 25 bp, Rattus norvegicus
ccttcgcgctgctaaggttcgcgtc

SEQ ID NO: 532857 - DNA, 25 bp, Rattus norvegicus
ccgccgcagctgtgaatgcagcatc

SEQ ID NO: 532858 - DNA, 25 bp, Rattus norvegicus
tgcctagcgtaagcgcagcggagtt

SEQ ID NO: 532859 - DNA, 25 bp, Rattus norvegicus
agcatctgcgcttagctgccttcgc

SEQ ID NO: 532860 - DNA, 25 bp, Rattus norvegicus
gctccgagcggggatgaaatcgccc

SEQ ID NO: 532861 - DNA, 25 bp, Rattus norvegicus
aagccgaggcccagcgcaggcatct

SEQ ID NO: 532862 - DNA, 25 bp, Rattus norvegicus
aggcatctcagcttggccttcagca

SEQ ID NO: 532863 - DNA, 25 bp, Rattus norvegicus
gccaaacctttcgtgcctagcgtaa

SEQ ID NO: 532864 - DNA, 25 bp, Rattus norvegicus
cagcggagttcgtgccgtccttcct

SEQ ID NO: 532865 - DNA, 25 bp, Rattus norvegicus
tccagctgcgacgaaacctgcatcg

SEQ ID NO: 532866 - DNA, 25 bp, Rattus norvegicus
ggccttcagcagtcagctcaacatc

SEQ ID NO: 532867 - DNA, 25 bp, Rattus norvegicus
taacagggatgttggcggcaacgaa

SEQ ID NO: 532868 - DNA, 25 bp, Rattus norvegicus
tgtcaacgctgctgcggtcgcagaa

SEQ ID NO: 532869 - DNA, 25 bp, Rattus norvegicus
ggcagtagcacgtcttccagcagtt

SEQ ID NO: 532870 - DNA, 25 bp, Rattus norvegicus
tcagcttggccaatctgcgaaaccg

SEQ ID NO: 532871 - DNA, 25 bp, Rattus norvegicus
agcgcttgtcagcttggccaatctg

SEQ ID NO: 532872 - DNA, 25 bp, Rattus norvegicus
gcctgctcttggcagcgcttgtcag

SEQ ID NO: 532873 - DNA, 25 bp, Rattus norvegicus
ttccagcagtttgcgctttgcgcgg

SEQ ID NO: 532874 - DNA, 25 bp, Rattus norvegicus
cgaaagtgcaggcagtagcacgtct

SEQ ID NO: 532875 - DNA, 25 bp, Rattus norvegicus
taacgtggaccggagataacaggga

SEQ ID NO: 532876 - DNA, 25 bp, Rattus norvegicus
cgacagttaacgtggaccggagata

SEQ ID NO: 532877 - DNA, 25 bp, Rattus norvegicus
gcggtcgcagaacggcaccagagaa

SEQ ID NO: 532878 - DNA, 25 bp, Rattus norvegicus
cgccacttagctgttgtcaacgctg

SEQ ID NO: 532879 - DNA, 25 bp, Rattus norvegicus
gccagaatccgccacttagctgttg

SEQ ID NO: 532880 - DNA, 25 bp, Rattus norvegicus
gcaccagagaagaagtcgacagtta

SEQ ID NO: 532881 - DNA, 25 bp, Rattus norvegicus
agcagccactgttctgtggtcgcgg

SEQ ID NO: 532882 - DNA, 25 bp, Rattus norvegicus
cgcggttgctaagaaacggcgatcc

SEQ ID NO: 532883 - DNA, 25 bp, Rattus norvegicus
gcaaaccaactggtcggagatcaga

SEQ ID NO: 532884 - DNA, 25 bp, Rattus norvegicus
accaactggtcggagatcagaccgc

SEQ ID NO: 532885 - DNA, 25 bp, Rattus norvegicus
tcggagatcagaccgcggctccagt

SEQ ID NO: 532886 - DNA, 25 bp, Rattus norvegicus
tcagaccgcggctccagtggtccct

SEQ ID NO: 532887 - DNA, 25 bp, Rattus norvegicus
cgcatgcgcgcggttgctaagaaac

SEQ ID NO: 532888 - DNA, 25 bp, Rattus norvegicus
gttgctaagaaacggcgatccaggc

SEQ ID NO: 532889 - DNA, 25 bp, Rattus norvegicus
cgatccaggcgccgcggtggtaact

SEQ ID NO: 532890 - DNA, 25 bp, Rattus norvegicus
gccagaggaagaaggagcacgagga

SEQ ID NO: 532891 - DNA, 25 bp, Rattus norvegicus
agcacgaggatgcagctgcgaccgt

SEQ ID NO: 532892 - DNA, 25 bp, Rattus norvegicus
cagctgcgaccgtggccccaagagg

SEQ ID NO: 532893 - DNA, 25 bp, Rattus norvegicus
caagagggagcagccactgttctgt

SEQ ID NO: 532894 - DNA, 25 bp, Rattus norvegicus
agggagcagccactgttctgtggtc

SEQ ID NO: 532895 - DNA, 25 bp, Rattus norvegicus
tcagagcagcccgacagtttccagc

SEQ ID NO: 532896 - DNA, 25 bp, Rattus norvegicus
ccacgtggccggagtagcctctctg

SEQ ID NO: 532897 - DNA, 25 bp, Rattus norvegicus
cggaagcccggccacataaaggagc

SEQ ID NO: 532898 - DNA, 25 bp, Rattus norvegicus
ggccacataaaggagcgagcagcgc

SEQ ID NO: 532899 - DNA, 25 bp, Rattus norvegicus
aagtcgtggcccgttagcaggaagc

SEQ ID NO: 532900 - DNA, 25 bp, Rattus norvegicus
cccgttagcaggaagcggagcagtc

SEQ ID NO: 532901 - DNA, 25 bp, Rattus norvegicus
cccgacgctagagtgggacccaatc

SEQ ID NO: 532902 - DNA, 25 bp, Rattus norvegicus
tgggacccaatctgagcacccggtt

SEQ ID NO: 532903 - DNA, 25 bp, Rattus norvegicus
ttctcccgagtccttgccgaagtgt

SEQ ID NO: 532904 - DNA, 25 bp, Rattus norvegicus
gtgtactgcgcgctcagagcagccc

SEQ ID NO: 532905 - DNA, 25 bp, Rattus norvegicus
ttgccgccaccatgccgaagacggt

SEQ ID NO: 532906 - DNA, 25 bp, Rattus norvegicus
ccaccatgccgaagacggtgagtgc

SEQ ID NO: 532907 - DNA, 25 bp, Rattus norvegicus
cagtttccagccaaacttcagcaac

SEQ ID NO: 532908 - DNA, 25 bp, Rattus norvegicus
tccttgccgaagtgtactgcgcgct

SEQ ID NO: 532909 - DNA, 25 bp, Rattus norvegicus
agcgccctaggactccatctggaaa

SEQ ID NO: 532910 - DNA, 25 bp, Rattus norvegicus
gatatgtagtctttccgttcgctcg

SEQ ID NO: 532911 - DNA, 25 bp, Rattus norvegicus
tccctacggaaactggggagcagtc

SEQ ID NO: 532912 - DNA, 25 bp, Rattus norvegicus
cacaatagctgtggtagcccggcgc

SEQ ID NO: 532913 - DNA, 25 bp, Rattus norvegicus
gggcgacagcgctacacacaatagc

SEQ ID NO: 532914 - DNA, 25 bp, Rattus norvegicus
tttcctccaacaacacgacagcagg

SEQ ID NO: 532915 - DNA, 25 bp, Rattus norvegicus
ccagcggcaaggaaacgtagctttc

SEQ ID NO: 532916 - DNA, 25 bp, Rattus norvegicus
ccatcgtgatgtggggtttggcact

SEQ ID NO: 532917 - DNA, 25 bp, Rattus norvegicus
accgcctactggttcctgggagcca

SEQ ID NO: 532918 - DNA, 25 bp, Rattus norvegicus
tcagcaactgcagagaccgcctact

SEQ ID NO: 532919 - DNA, 25 bp, Rattus norvegicus
agcacgggctcccttcggatgtctt

SEQ ID NO: 532920 - DNA, 25 bp, Rattus norvegicus
gccctaactccgagaccgaacgaga

SEQ ID NO: 532921 - DNA, 25 bp, Rattus norvegicus
aagccaatgccaccgtttcacactg

SEQ ID NO: 532922 - DNA, 25 bp, Rattus norvegicus
cttagagagttaagcccagcggcaa

SEQ ID NO: 532923 - DNA, 25 bp, Rattus norvegicus
cagaggggagtctccatcgaccttc

SEQ ID NO: 532924 - DNA, 25 bp, Rattus norvegicus
tgggcgcatcaagccacgtacctgg

SEQ ID NO: 532925 - DNA, 25 bp, Rattus norvegicus
ggcacagacaccttgagcttcgcga

SEQ ID NO: 532926 - DNA, 25 bp, Rattus norvegicus
ctccgtctggtgctacgatgcgact

SEQ ID NO: 532927 - DNA, 25 bp, Rattus norvegicus
gacacgctggtcacagttcctgcca

SEQ ID NO: 532928 - DNA, 25 bp, Rattus norvegicus
tgcgactgctccagcctttgaacta

SEQ ID NO: 532929 - DNA, 25 bp, Rattus norvegicus
agagagtatacccagcgcccgcttt

SEQ ID NO: 532930 - DNA, 25 bp, Rattus norvegicus
cgcttttgacccaacgacttccatg

SEQ ID NO: 532931 - DNA, 25 bp, Rattus norvegicus
ccatgataccctctgggctgagatt

SEQ ID NO: 532932 - DNA, 25 bp, Rattus norvegicus
ggcaaagcaacgtctccagccgcta

SEQ ID NO: 532933 - DNA, 25 bp, Rattus norvegicus
taaggcctctcgaaatcccatcttg

SEQ ID NO: 532934 - DNA, 25 bp, Rattus norvegicus
gaacacctgacacacgcctgcttgg

SEQ ID NO: 532935 - DNA, 25 bp, Rattus norvegicus
ccgccgcgggcaataaccaaagtca

SEQ ID NO: 532936 - DNA, 25 bp, Rattus norvegicus
ctgtgccgttgaccagcagtgacac

SEQ ID NO: 532937 - DNA, 25 bp, Rattus norvegicus
ctcggctgaacgctaatgcgtttga

SEQ ID NO: 532938 - DNA, 25 bp, Rattus norvegicus
gctggtggtaggatagcccactttc

SEQ ID NO: 532939 - DNA, 25 bp, Rattus norvegicus
ggtggtaggatagcccactttcagc

SEQ ID NO: 532940 - DNA, 25 bp, Rattus norvegicus
taggatagcccactttcagcggggt

SEQ ID NO: 532941 - DNA, 25 bp, Rattus norvegicus
atagcccactttcagcggggtgctg

SEQ ID NO: 532942 - DNA, 25 bp, Rattus norvegicus
agcccactttcagcggggtgctgct

SEQ ID NO: 532943 - DNA, 25 bp, Rattus norvegicus
actttcagcggggtgctgctaggtt

SEQ ID NO: 532944 - DNA, 25 bp, Rattus norvegicus
ctgctaggttcggttgggatcgact

SEQ ID NO: 532945 - DNA, 25 bp, Rattus norvegicus
tcgactgggcgccactggactcagc

SEQ ID NO: 532946 - DNA, 25 bp, Rattus norvegicus
cgctaatgcgtttgacttcgttcat

SEQ ID NO: 532947 - DNA, 25 bp, Rattus norvegicus
gcgctcggctgaacgctaatgcgtt

SEQ ID NO: 532948 - DNA, 25 bp, Rattus norvegicus
gctgaacgctaatgcgtttgacttc

SEQ ID NO: 532949 - DNA, 25 bp, Rattus norvegicus
gcgctggtggtaggatagcccactt

SEQ ID NO: 532950 - DNA, 25 bp, Rattus norvegicus
gggcgccactggactcagcagcgct

SEQ ID NO: 532951 - DNA, 25 bp, Rattus norvegicus
ggctgtgctgccaaggctgcattca

SEQ ID NO: 532952 - DNA, 25 bp, Rattus norvegicus
tgcatcgtctgtgttcggctaggtt

SEQ ID NO: 532953 - DNA, 25 bp, Rattus norvegicus
gggctcagctgcatcgtctgtgttc

SEQ ID NO: 532954 - DNA, 25 bp, Rattus norvegicus
cgctgctgggctcagctgcatcgtc

SEQ ID NO: 532955 - DNA, 25 bp, Rattus norvegicus
accgacaatgttcggcggtgcgctg

SEQ ID NO: 532956 - DNA, 25 bp, Rattus norvegicus
ttcggctgtgaaccgacaatgttcg

SEQ ID NO: 532957 - DNA, 25 bp, Rattus norvegicus
acgttcggctactttcggctgtgaa

SEQ ID NO: 532958 - DNA, 25 bp, Rattus norvegicus
tgggctcggctacgttcggctactt

SEQ ID NO: 532959 - DNA, 25 bp, Rattus norvegicus
tctttggtatgctgctgggctcggc

SEQ ID NO: 532960 - DNA, 25 bp, Rattus norvegicus
ctgcattcagctaggttctttggta

SEQ ID NO: 532961 - DNA, 25 bp, Rattus norvegicus
ttaggtccggctgtgctgccaaggc

SEQ ID NO: 532962 - DNA, 25 bp, Rattus norvegicus
catctaggctcggttaggtccggct

SEQ ID NO: 532963 - DNA, 25 bp, Rattus norvegicus
cgttcatctaggctcggttaggtcc

SEQ ID NO: 532964 - DNA, 25 bp, Rattus norvegicus
taggttctttggtatgctgctgggc

SEQ ID NO: 532965 - DNA, 25 bp, Rattus norvegicus
cgacagcgcgctgaccagccttggt

SEQ ID NO: 532966 - DNA, 25 bp, Rattus norvegicus
tctcaggtttcgcaaagacgcatgg

SEQ ID NO: 532967 - DNA, 25 bp, Rattus norvegicus
tggtctccacgtctcaggtttcgca

SEQ ID NO: 532968 - DNA, 25 bp, Rattus norvegicus
tgtcaagctcaaaggctaccggacc

SEQ ID NO: 532969 - DNA, 25 bp, Rattus norvegicus
caggtttcgcaaagacgcatgggag

SEQ ID NO: 532970 - DNA, 25 bp, Rattus norvegicus
ctccacgtctcaggtttcgcaaaga

SEQ ID NO: 532971 - DNA, 25 bp, Rattus norvegicus
cagccttggtctccacgtctcaggt

SEQ ID NO: 532972 - DNA, 25 bp, Rattus norvegicus
tggtgacgcggtctccacgcgacag

SEQ ID NO: 532973 - DNA, 25 bp, Rattus norvegicus
gagcgctgcagcatccagcctcagg

SEQ ID NO: 532974 - DNA, 25 bp, Rattus norvegicus
accggctgagcgctgcagcatccag

SEQ ID NO: 532975 - DNA, 25 bp, Rattus norvegicus
ggaccaccggaaccggctgagcgct

SEQ ID NO: 532976 - DNA, 25 bp, Rattus norvegicus
gctcaaaggctaccggaccaccgga

SEQ ID NO: 532977 - DNA, 25 bp, Rattus norvegicus
acagacggaggtttaccaagatggc

SEQ ID NO: 532978 - DNA, 25 bp, Rattus norvegicus
gctcggtgtcaagctcaaaggctac

SEQ ID NO: 532979 - DNA, 25 bp, Rattus norvegicus
agtcctccgaggcagcagtccatgc

SEQ ID NO: 532980 - DNA, 25 bp, Rattus norvegicus
agaggactcgcagtctcaaacagtc

SEQ ID NO: 532981 - DNA, 25 bp, Rattus norvegicus
gtgagattcgcactgactgccgaca

SEQ ID NO: 532982 - DNA, 25 bp, Rattus norvegicus
ctccggctcaatcgccggggattaa

SEQ ID NO: 532983 - DNA, 25 bp, Rattus norvegicus
ccgaggcttcagaggcgcaaattga

SEQ ID NO: 532984 - DNA, 25 bp, Rattus norvegicus
tcagtagggccgtactagtctttta

SEQ ID NO: 532985 - DNA, 25 bp, Rattus norvegicus
ggccggtgctaaagtagaagctgtc

SEQ ID NO: 532986 - DNA, 25 bp, Rattus norvegicus
accgagctcgcattgttgggagaca

SEQ ID NO: 532987 - DNA, 25 bp, Rattus norvegicus
cttcccagaggcgtcaatcccagga

SEQ ID NO: 532988 - DNA, 25 bp, Rattus norvegicus
tcaatcccaggacggtcgaggcgtc

SEQ ID NO: 532989 - DNA, 25 bp, Rattus norvegicus
gggcaaccactgagcgctctgcaga

SEQ ID NO: 532990 - DNA, 25 bp, Rattus norvegicus
tgctaggggatcctgaagtgcatcc

SEQ ID NO: 532991 - DNA, 25 bp, Rattus norvegicus
ctcaaacagtctgggagagccgatc

SEQ ID NO: 532992 - DNA, 25 bp, Rattus norvegicus
agccgatcggaatccggcgggatca

SEQ ID NO: 532993 - DNA, 25 bp, Rattus norvegicus
gcgggcacccgcattctcaacaaga

SEQ ID NO: 532994 - DNA, 25 bp, Rattus norvegicus
tgacggcgctctcctcaggcctggg

SEQ ID NO: 532995 - DNA, 25 bp, Rattus norvegicus
taaggccagggcagtgtcccctccg

SEQ ID NO: 532996 - DNA, 25 bp, Rattus norvegicus
ccagccgcgaaagactcggggcggg

SEQ ID NO: 532997 - DNA, 25 bp, Rattus norvegicus
tgctggtggctgaactctgcagcga

SEQ ID NO: 532998 - DNA, 25 bp, Rattus norvegicus
ggtggctgaactctgcagcgatcct

SEQ ID NO: 532999 - DNA, 25 bp, Rattus norvegicus
gaattctgctgacggcgctctcctc

SEQ ID NO: 533000 - DNA, 25 bp, Rattus norvegicus
gcgcggaattctgctgacggcgctc

SEQ ID NO: 533001 - DNA, 25 bp, Rattus norvegicus
taaacacggcccacagcggggcgcg

SEQ ID NO: 533002 - DNA, 25 bp, Rattus norvegicus
cggcagggtaaacacggcccacagc

SEQ ID NO: 533003 - DNA, 25 bp, Rattus norvegicus
cttgggctgcgctgcagcgagacgc

SEQ ID NO: 533004 - DNA, 25 bp, Rattus norvegicus
cctccggggttgcgtgtccatcggt

SEQ ID NO: 533005 - DNA, 25 bp, Rattus norvegicus
cgcattctcaacaagaggggcctca

SEQ ID NO: 533006 - DNA, 25 bp, Rattus norvegicus
ttctcaacaagaggggcctcaaggg

SEQ ID NO: 533007 - DNA, 25 bp, Rattus norvegicus
cactcttggaaggagattcttccca

SEQ ID NO: 533008 - DNA, 25 bp, Rattus norvegicus
acccgcgggtcagccgagcaggaaa

SEQ ID NO: 533009 - DNA, 25 bp, Rattus norvegicus
tcccagagaaaaggccagaggcctg

SEQ ID NO: 533010 - DNA, 25 bp, Rattus norvegicus
ggttctagccgggacactcttggaa

SEQ ID NO: 533011 - DNA, 25 bp, Rattus norvegicus
gaaatggaaatcctgggttctagcc

SEQ ID NO: 533012 - DNA, 25 bp, Rattus norvegicus
cagcttgccagggagcattgaaatg

SEQ ID NO: 533013 - DNA, 25 bp, Rattus norvegicus
ttccgcgagcctttagccgagttcg

SEQ ID NO: 533014 - DNA, 25 bp, Rattus norvegicus
gaggcccaggaattgtttgtaatta

SEQ ID NO: 533015 - DNA, 25 bp, Rattus norvegicus
ggtgacaggcgcatgtaaatgaccc

SEQ ID NO: 533016 - DNA, 25 bp, Rattus norvegicus
ctttcactcaggagcggtgacaggc

SEQ ID NO: 533017 - DNA, 25 bp, Rattus norvegicus
agctcaagtcctagtccgctggggt

SEQ ID NO: 533018 - DNA, 25 bp, Rattus norvegicus
ccggaaggaaacaagagctcaagtc

SEQ ID NO: 533019 - DNA, 25 bp, Rattus norvegicus
catccacggaggctttcaagaaccc

SEQ ID NO: 533020 - DNA, 25 bp, Rattus norvegicus
gcggctttgtggaaccgcattccta

SEQ ID NO: 533021 - DNA, 25 bp, Rattus norvegicus
gactctggggcggagcaaagcaaat

SEQ ID NO: 533022 - DNA, 25 bp, Rattus norvegicus
ttatatagtggcagccaggcgctga

SEQ ID NO: 533023 - DNA, 25 bp, Rattus norvegicus
agcaaatggccgacttatatagtgg

SEQ ID NO: 533024 - DNA, 25 bp, Rattus norvegicus
cagcggcatctgtcatgttgaaagc

SEQ ID NO: 533025 - DNA, 25 bp, Rattus norvegicus
cggcatctgtcatgttgaaagcaaa

SEQ ID NO: 533026 - DNA, 25 bp, Rattus norvegicus
tctgtcatgttgaaagcaaaaaaga

SEQ ID NO: 533027 - DNA, 25 bp, Rattus norvegicus
caaaaaagaagaggcaggcgactgc

SEQ ID NO: 533028 - DNA, 25 bp, Rattus norvegicus
cgactgcaggacaggactgcgttga

SEQ ID NO: 533029 - DNA, 25 bp, Rattus norvegicus
caggacaggactgcgttgacaaccg

SEQ ID NO: 533030 - DNA, 25 bp, Rattus norvegicus
ctgcgttgacaaccggctttgactc

SEQ ID NO: 533031 - DNA, 25 bp, Rattus norvegicus
accggctttgactcccggactctgg

SEQ ID NO: 533032 - DNA, 25 bp, Rattus norvegicus
cggagcaaagcaaatggccgactta

SEQ ID NO: 533033 - DNA, 25 bp, Rattus norvegicus
ccgacttatatagtggcagccaggc

SEQ ID NO: 533034 - DNA, 25 bp, Rattus norvegicus
aatggcagagctgctgagtggctcg

SEQ ID NO: 533035 - DNA, 25 bp, Rattus norvegicus
cccgcaaaggggtcattgggattct

SEQ ID NO: 533036 - DNA, 25 bp, Rattus norvegicus
ccctctgtgaattggggtgggctca

SEQ ID NO: 533037 - DNA, 25 bp, Rattus norvegicus
aattggggtgggctcaaaagcgtca

SEQ ID NO: 533038 - DNA, 25 bp, Rattus norvegicus
ccgaagaggccataggcctcggcgt

SEQ ID NO: 533039 - DNA, 25 bp, Rattus norvegicus
agacgaacccgcaaaggggtcattg

SEQ ID NO: 533040 - DNA, 25 bp, Rattus norvegicus
gtcattgggattctgcttgtgccca

SEQ ID NO: 533041 - DNA, 25 bp, Rattus norvegicus
ggattctgcttgtgcccacccagca

SEQ ID NO: 533042 - DNA, 25 bp, Rattus norvegicus
cagcagcactctcccaccagcccgg

SEQ ID NO: 533043 - DNA, 25 bp, Rattus norvegicus
ttcctggccagtcgcgcgctcagag

SEQ ID NO: 533044 - DNA, 25 bp, Rattus norvegicus
cgcgctcagagctgcagagctgtcg

SEQ ID NO: 533045 - DNA, 25 bp, Rattus norvegicus
agagctgtcggacctctggacgcca

SEQ ID NO: 533046 - DNA, 25 bp, Rattus norvegicus
cccgctaaagagcactagggcaggc

SEQ ID NO: 533047 - DNA, 25 bp, Rattus norvegicus
cggctgctgccctctgtgaattggg

SEQ ID NO: 533048 - DNA, 25 bp, Rattus norvegicus
aggcctcggcgtgtggtcaagtccc

SEQ ID NO: 533049 - DNA, 25 bp, Rattus norvegicus
tgttctccgcacagcggaagatggc

SEQ ID NO: 533050 - DNA, 25 bp, Rattus norvegicus
gcgacaaaccttgcgccgattcgga

SEQ ID NO: 533051 - DNA, 25 bp, Rattus norvegicus
ctcccaggcagagcgacaaaccttg

SEQ ID NO: 533052 - DNA, 25 bp, Rattus norvegicus
tgggctcccaggcagagcgacaaac

SEQ ID NO: 533053 - DNA, 25 bp, Rattus norvegicus
gaaagacgccgccgcgctgactatc

SEQ ID NO: 533054 - DNA, 25 bp, Rattus norvegicus
aaatatgttcaggggcgcttggatg

SEQ ID NO: 533055 - DNA, 25 bp, Rattus norvegicus
ctcgcgcctgactactccctccagc

SEQ ID NO: 533056 - DNA, 25 bp, Rattus norvegicus
tgtctagccatgcagcccccgaggt

SEQ ID NO: 533057 - DNA, 25 bp, Rattus norvegicus
ccgacactatgaggagtgcggcgcc

SEQ ID NO: 533058 - DNA, 25 bp, Rattus norvegicus
cgcactaagtaaagccgggcgtccg

SEQ ID NO: 533059 - DNA, 25 bp, Rattus norvegicus
agcgagaggcgcactaagtaaagcc

SEQ ID NO: 533060 - DNA, 25 bp, Rattus norvegicus
ctgccacagcggtgcgaagcagagg

SEQ ID NO: 533061 - DNA, 25 bp, Rattus norvegicus
ggccatgcctttgggcggctgccac

SEQ ID NO: 533062 - DNA, 25 bp, Rattus norvegicus
aaccttgcgccgattcggagcgggc

SEQ ID NO: 533063 - DNA, 25 bp, Rattus norvegicus
gctcagccgctgaacaaggcccagg

SEQ ID NO: 533064 - DNA, 25 bp, Rattus norvegicus
tgtcaagccaaagcaggctgaggct

SEQ ID NO: 533065 - DNA, 25 bp, Rattus norvegicus
accctgtcaagccaaagcaggctga

SEQ ID NO: 533066 - DNA, 25 bp, Rattus norvegicus
ttggctttcccactaccctgtcaag

SEQ ID NO: 533067 - DNA, 25 bp, Rattus norvegicus
ccctccgcctctggcggccttggct

SEQ ID NO: 533068 - DNA, 25 bp, Rattus norvegicus
gcacccaggccctcagttgcctgct

SEQ ID NO: 533069 - DNA, 25 bp, Rattus norvegicus
gccgtttcccgccttcatccgcacc

SEQ ID NO: 533070 - DNA, 25 bp, Rattus norvegicus
gctttcctcgcgtctgggccgtttc

SEQ ID NO: 533071 - DNA, 25 bp, Rattus norvegicus
tacttcgtgctttcctcgcgtctgg

SEQ ID NO: 533072 - DNA, 25 bp, Rattus norvegicus
tctactacttcgtgctttcctcgcg

SEQ ID NO: 533073 - DNA, 25 bp, Rattus norvegicus
ggccactttctactacttcgtgctt

SEQ ID NO: 533074 - DNA, 25 bp, Rattus norvegicus
tccttggccactttctactacttcg

SEQ ID NO: 533075 - DNA, 25 bp, Rattus norvegicus
agccgctgaacaaggcccaggcgcg

SEQ ID NO: 533076 - DNA, 25 bp, Rattus norvegicus
gcagtccgccctgccggccttccct

SEQ ID NO: 533077 - DNA, 25 bp, Rattus norvegicus
cagaggcagtggctcccgggcctca

SEQ ID NO: 533078 - DNA, 25 bp, Rattus norvegicus
cctgcctgctgcagcgccaagggag

SEQ ID NO: 533079 - DNA, 25 bp, Rattus norvegicus
aggccatgggctaccctgaggtaga

SEQ ID NO: 533080 - DNA, 25 bp, Rattus norvegicus
cgggcctcagatagtggttgtctct

SEQ ID NO: 533081 - DNA, 25 bp, Rattus norvegicus
cccagccgatggcaggacagtagtc

SEQ ID NO: 533082 - DNA, 25 bp, Rattus norvegicus
cacatgcggctgctccctgttctgt

SEQ ID NO: 533083 - DNA, 25 bp, Rattus norvegicus
ccctcggagtggagctgcacatgcg

SEQ ID NO: 533084 - DNA, 25 bp, Rattus norvegicus
ctcaccaactgcaacggggcaagcg

SEQ ID NO: 533085 - DNA, 25 bp, Rattus norvegicus
caaagctgaacgacagccgcactca

SEQ ID NO: 533086 - DNA, 25 bp, Rattus norvegicus
gggtggagtccaaagctgaacgaca

SEQ ID NO: 533087 - DNA, 25 bp, Rattus norvegicus
agccaccgtcgctcaggaacgggtc

SEQ ID NO: 533088 - DNA, 25 bp, Rattus norvegicus
atagtggttgtctctggaggccatg

SEQ ID NO: 533089 - DNA, 25 bp, Rattus norvegicus
catagcggcgctgaagggttaaacc

SEQ ID NO: 533090 - DNA, 25 bp, Rattus norvegicus
acagtagtcgcctgtcaggggtcgt

SEQ ID NO: 533091 - DNA, 25 bp, Rattus norvegicus
aggcgtccgacgatgccaatagtta

SEQ ID NO: 533092 - DNA, 25 bp, Rattus norvegicus
tcacgcacgtgctcaccggcaagaa

SEQ ID NO: 533093 - DNA, 25 bp, Rattus norvegicus
ctagacgggcttttgggtcttgaca

SEQ ID NO: 533094 - DNA, 25 bp, Rattus norvegicus
atccaccacttagggtccggcctgg

SEQ ID NO: 533095 - DNA, 25 bp, Rattus norvegicus
agcccttcggatcctggagtggtaa

SEQ ID NO: 533096 - DNA, 25 bp, Rattus norvegicus
ggcagcggccaacagtcggtaaccg

SEQ ID NO: 533097 - DNA, 25 bp, Rattus norvegicus
ccaatagttactggcggattcgcgg

SEQ ID NO: 533098 - DNA, 25 bp, Rattus norvegicus
agcgccgaggtccaaagcaactgga

SEQ ID NO: 533099 - DNA, 25 bp, Rattus norvegicus
caacgccggattggctgctgttgag

SEQ ID NO: 533100 - DNA, 25 bp, Rattus norvegicus
tgcgggtcagtgctgaagctactca

SEQ ID NO: 533101 - DNA, 25 bp, Rattus norvegicus
gcggctgcactcacatgacatcaaa

SEQ ID NO: 533102 - DNA, 25 bp, Rattus norvegicus
acatcaaatacggatccggtgcgca

SEQ ID NO: 533103 - DNA, 25 bp, Rattus norvegicus
gaggcttaaagatcaggtggttcta

SEQ ID NO: 533104 - DNA, 25 bp, Rattus norvegicus
ttagtgttcaagtcgagggtctgga

SEQ ID NO: 533105 - DNA, 25 bp, Rattus norvegicus
cgtggtgcttgtttcttcgtgtccc

SEQ ID NO: 533106 - DNA, 25 bp, Rattus norvegicus
gattctctgcccgtggtgcttgttt

SEQ ID NO: 533107 - DNA, 25 bp, Rattus norvegicus
aacggcgagcagcttggcccctcgt

SEQ ID NO: 533108 - DNA, 25 bp, Rattus norvegicus
tcgtgccccctggtgagattctctg

SEQ ID NO: 533109 - DNA, 25 bp, Rattus norvegicus
cctggtgagattctctgcccgtggt

SEQ ID NO: 533110 - DNA, 25 bp, Rattus norvegicus
ctggtgagattctctgcccgtggtg

SEQ ID NO: 533111 - DNA, 25 bp, Rattus norvegicus
gtgagattctctgcccgtggtgctt

SEQ ID NO: 533112 - DNA, 25 bp, Rattus norvegicus
attctctgcccgtggtgcttgtttc

SEQ ID NO: 533113 - DNA, 25 bp, Rattus norvegicus
tctctgcccgtggtgcttgtttctt

SEQ ID NO: 533114 - DNA, 25 bp, Rattus norvegicus
ctctgcccgtggtgcttgtttcttc

SEQ ID NO: 533115 - DNA, 25 bp, Rattus norvegicus
ctgcccgtggtgcttgtttcttcgt

SEQ ID NO: 533116 - DNA, 25 bp, Rattus norvegicus
ccgtggtgcttgtttcttcgtgtcc

SEQ ID NO: 533117 - DNA, 25 bp, Rattus norvegicus
gtggtgcttgtttcttcgtgtcccg

SEQ ID NO: 533118 - DNA, 25 bp, Rattus norvegicus
gcccgtggtgcttgtttcttcgtgt

SEQ ID NO: 533119 - DNA, 25 bp, Rattus norvegicus
cacccatccgggcgcggaggtgtct

SEQ ID NO: 533120 - DNA, 25 bp, Rattus norvegicus
ttcgcgaaaagttggcctgccttgc

SEQ ID NO: 533121 - DNA, 25 bp, Rattus norvegicus
agttggaaagcccagcctgcacgcg

SEQ ID NO: 533122 - DNA, 25 bp, Rattus norvegicus
gggctgcttcgcgaaaagttggcct

SEQ ID NO: 533123 - DNA, 25 bp, Rattus norvegicus
gctgcttcgcgaaaagttggcctgc

SEQ ID NO: 533124 - DNA, 25 bp, Rattus norvegicus
ctgcttcgcgaaaagttggcctgcc

SEQ ID NO: 533125 - DNA, 25 bp, Rattus norvegicus
gtggccgtctaacggcgagcagctt

SEQ ID NO: 533126 - DNA, 25 bp, Rattus norvegicus
cttcgcgaaaagttggcctgccttg

SEQ ID NO: 533127 - DNA, 25 bp, Rattus norvegicus
tcgcgaaaagttggcctgccttgca

SEQ ID NO: 533128 - DNA, 25 bp, Rattus norvegicus
cgaaaagttggcctgccttgcaccc

SEQ ID NO: 533129 - DNA, 25 bp, Rattus norvegicus
aaaagttggcctgccttgcacccat

SEQ ID NO: 533130 - DNA, 25 bp, Rattus norvegicus
tgccttgcacccatccgggcgcgga

SEQ ID NO: 533131 - DNA, 25 bp, Rattus norvegicus
cccgtggccgtctaacggcgagcag

SEQ ID NO: 533132 - DNA, 25 bp, Rattus norvegicus
gcttcgcgaaaagttggcctgcctt

SEQ ID NO: 533133 - DNA, 25 bp, Rattus norvegicus
tgaatctcgagaatatgcctccacg

SEQ ID NO: 533134 - DNA, 25 bp, Rattus norvegicus
cagcaaagtcccagaaacgccgaga

SEQ ID NO: 533135 - DNA, 25 bp, Rattus norvegicus
acgccgagaccgaagagctaacctg

SEQ ID NO: 533136 - DNA, 25 bp, Rattus norvegicus
caagggaagacgaaagcagctgctc

SEQ ID NO: 533137 - DNA, 25 bp, Rattus norvegicus
agcagctggctgcttaccgtcgtga

SEQ ID NO: 533138 - DNA, 25 bp, Rattus norvegicus
atccgtcgccactatcgtgaaaaga

SEQ ID NO: 533139 - DNA, 25 bp, Rattus norvegicus
tcccgagagtggtgtggattcagtt

SEQ ID NO: 533140 - DNA, 25 bp, Rattus norvegicus
gttacaagctcatatccagaccctg

SEQ ID NO: 533141 - DNA, 25 bp, Rattus norvegicus
tgaaagcttccgtcccgaagaacga

SEQ ID NO: 533142 - DNA, 25 bp, Rattus norvegicus
gcacgagcaggagctggaaaaattt

SEQ ID NO: 533143 - DNA, 25 bp, Rattus norvegicus
tatcgcccgtctcgaggccgagatg

SEQ ID NO: 533144 - DNA, 25 bp, Rattus norvegicus
agcagctgctctctgatatcgcccg

SEQ ID NO: 533145 - DNA, 25 bp, Rattus norvegicus
gtggattcagttacagcggacctca

SEQ ID NO: 533146 - DNA, 25 bp, Rattus norvegicus
gcggacctcaaaaagatgaatctcg

SEQ ID NO: 533147 - DNA, 25 bp, Rattus norvegicus
ggcgcctctgggatcaatttgaaac

SEQ ID NO: 533148 - DNA, 25 bp, Rattus norvegicus
gcactcgcgaccacttaattcagcg

SEQ ID NO: 533149 - DNA, 25 bp, Rattus norvegicus
ttcagcgccaccttaccggtaagta

SEQ ID NO: 533150 - DNA, 25 bp, Rattus norvegicus
ggtaagtaggcctcccttagcgaca

SEQ ID NO: 533151 - DNA, 25 bp, Rattus norvegicus
agcgacagccaattccgccttggaa

SEQ ID NO: 533152 - DNA, 25 bp, Rattus norvegicus
gccttggaaccggaagcggatgctt

SEQ ID NO: 533153 - DNA, 25 bp, Rattus norvegicus
agcggatgcttgctaccacccagca

SEQ ID NO: 533154 - DNA, 25 bp, Rattus norvegicus
ttgctttgggcgagccagctctcta

SEQ ID NO: 533155 - DNA, 25 bp, Rattus norvegicus
tttcacaggctgtacgcgctccgat

SEQ ID NO: 533156 - DNA, 25 bp, Rattus norvegicus
taaagctccggttggaacagggcgc

SEQ ID NO: 533157 - DNA, 25 bp, Rattus norvegicus
ccgggcaccacgttagctcaaattc

SEQ ID NO: 533158 - DNA, 25 bp, Rattus norvegicus
agctcaaattccgtgcttcgtagca

SEQ ID NO: 533159 - DNA, 25 bp, Rattus norvegicus
cgtagcacttcagggcttggggtca

SEQ ID NO: 533160 - DNA, 25 bp, Rattus norvegicus
tgcgtgctcacgtccgtgtactttt

SEQ ID NO: 533161 - DNA, 25 bp, Rattus norvegicus
gcagccatccatagtcgctgaagga

SEQ ID NO: 533162 - DNA, 25 bp, Rattus norvegicus
agcaatccttgcttcggcagccatc

SEQ ID NO: 533163 - DNA, 25 bp, Rattus norvegicus
gccctgcgatagtagcaatccttgc

SEQ ID NO: 533164 - DNA, 25 bp, Rattus norvegicus
tgcttcggcagccatccatagtcgc

SEQ ID NO: 533165 - DNA, 25 bp, Rattus norvegicus
ttggccggagtcagagaggccgcca

SEQ ID NO: 533166 - DNA, 25 bp, Rattus norvegicus
tgccgccctgcgatagtagcaatcc

SEQ ID NO: 533167 - DNA, 25 bp, Rattus norvegicus
gccgttgaactggtcaggccggccg

SEQ ID NO: 533168 - DNA, 25 bp, Rattus norvegicus
caacggggagtttgccgccctgcga

SEQ ID NO: 533169 - DNA, 25 bp, Rattus norvegicus
agtggcccagatcggaaaatgcaga

SEQ ID NO: 533170 - DNA, 25 bp, Rattus norvegicus
ccatagtcgctgaaggaggcctttt

SEQ ID NO: 533171 - DNA, 25 bp, Rattus norvegicus
ccagatcggaaaatgcagatccggg

SEQ ID NO: 533172 - DNA, 25 bp, Rattus norvegicus
gtgaagcgtttatggggccgaggaa

SEQ ID NO: 533173 - DNA, 25 bp, Rattus norvegicus
agtttgccgccctgcgatagtagca

SEQ ID NO: 533174 - DNA, 25 bp, Rattus norvegicus
tagtcgctgaaggaggccttttagc

SEQ ID NO: 533175 - DNA, 25 bp, Rattus norvegicus
gctggcgctttctcgacactagacc

SEQ ID NO: 533176 - DNA, 25 bp, Rattus norvegicus
acactagacctggactccgactggg

SEQ ID NO: 533177 - DNA, 25 bp, Rattus norvegicus
cgacactagacctggactccgactg

SEQ ID NO: 533178 - DNA, 25 bp, Rattus norvegicus
ttctcgacactagacctggactccg

SEQ ID NO: 533179 - DNA, 25 bp, Rattus norvegicus
ctttctcgacactagacctggactc

SEQ ID NO: 533180 - DNA, 25 bp, Rattus norvegicus
tggcgctttctcgacactagacctg

SEQ ID NO: 533181 - DNA, 25 bp, Rattus norvegicus
actagacctggactccgactgggcg

SEQ ID NO: 533182 - DNA, 25 bp, Rattus norvegicus
gagctggcgctttctcgacactaga

SEQ ID NO: 533183 - DNA, 25 bp, Rattus norvegicus
gaccggccggagctggcgctttctc

SEQ ID NO: 533184 - DNA, 25 bp, Rattus norvegicus
tctctcgcgcgggacagagggaccg

SEQ ID NO: 533185 - DNA, 25 bp, Rattus norvegicus
tttgtgtccgtggtctctcgcgcgg

SEQ ID NO: 533186 - DNA, 25 bp, Rattus norvegicus
cccgctttgtgtccgtggtctctcg

SEQ ID NO: 533187 - DNA, 25 bp, Rattus norvegicus
ctctggtgtctcctcctctatcccc

SEQ ID NO: 533188 - DNA, 25 bp, Rattus norvegicus
gcgctttctcgacactagacctgga

SEQ ID NO: 533189 - DNA, 25 bp, Rattus norvegicus
cgtctgtggattaaagatgtctatc

SEQ ID NO: 533190 - DNA, 25 bp, Rattus norvegicus
catctttccgaagaagagaccggta

SEQ ID NO: 533191 - DNA, 25 bp, Rattus norvegicus
gagtgtcagccactgccgtgtctga

SEQ ID NO: 533192 - DNA, 25 bp, Rattus norvegicus
gttaaggcgccgagtgtcagccact

SEQ ID NO: 533193 - DNA, 25 bp, Rattus norvegicus
tcctggggcttcgagttaaggcgcc

SEQ ID NO: 533194 - DNA, 25 bp, Rattus norvegicus
gcccgtaagcgtcggtcaggtcctg

SEQ ID NO: 533195 - DNA, 25 bp, Rattus norvegicus
ctaggcggcccgtaagcgtcggtca

SEQ ID NO: 533196 - DNA, 25 bp, Rattus norvegicus
ccgcttcgtcctccctcagctgtct

SEQ ID NO: 533197 - DNA, 25 bp, Rattus norvegicus
tcacccgcatgcgaacctcataggt

SEQ ID NO: 533198 - DNA, 25 bp, Rattus norvegicus
gccgtgtctgacatctttccgaaga

SEQ ID NO: 533199 - DNA, 25 bp, Rattus norvegicus
gatgtctatctccaggaagttacta

SEQ ID NO: 533200 - DNA, 25 bp, Rattus norvegicus
ctccaggaagttactaggcggcccg

SEQ ID NO: 533201 - DNA, 25 bp, Rattus norvegicus
acgcccaccgtctgtggattaaaga

SEQ ID NO: 533202 - DNA, 25 bp, Rattus norvegicus
aacctcataggtggtgaagcgcgcg

SEQ ID NO: 533203 - DNA, 25 bp, Rattus norvegicus
tagttagagcagtccggccaggccc

SEQ ID NO: 533204 - DNA, 25 bp, Rattus norvegicus
attccctttccacagggctcttggc

SEQ ID NO: 533205 - DNA, 25 bp, Rattus norvegicus
gggctcttggcccttcggacagcca

SEQ ID NO: 533206 - DNA, 25 bp, Rattus norvegicus
ggacagccacacacggcgtccggtg

SEQ ID NO: 533207 - DNA, 25 bp, Rattus norvegicus
gtccggtggcccacagtccctggga

SEQ ID NO: 533208 - DNA, 25 bp, Rattus norvegicus
acagtccctgggagtggctttgcac

SEQ ID NO: 533209 - DNA, 25 bp, Rattus norvegicus
acttgggccagcacagtggcgagct

SEQ ID NO: 533210 - DNA, 25 bp, Rattus norvegicus
cttgcgaggtgaactcgggaagcca

SEQ ID NO: 533211 - DNA, 25 bp, Rattus norvegicus
cacctcgtggctggtgccctgggct

SEQ ID NO: 533212 - DNA, 25 bp, Rattus norvegicus
gtagccatccagacccagccctgtg

SEQ ID NO: 533213 - DNA, 25 bp, Rattus norvegicus
tctggctgccggttagccggccatc

SEQ ID NO: 533214 - DNA, 25 bp, Rattus norvegicus
cacaggaacctctggctgccggtta

SEQ ID NO: 533215 - DNA, 25 bp, Rattus norvegicus
cgcggtgagactaaggctgaacgcc

SEQ ID NO: 533216 - DNA, 25 bp, Rattus norvegicus
tgaactcgggaagccaggttcacac

SEQ ID NO: 533217 - DNA, 25 bp, Rattus norvegicus
gatatacgaatggatggtccgcacg

SEQ ID NO: 533218 - DNA, 25 bp, Rattus norvegicus
ctcgcccagatatacgaatggatgg

SEQ ID NO: 533219 - DNA, 25 bp, Rattus norvegicus
agcggctgacactcgcccagatata

SEQ ID NO: 533220 - DNA, 25 bp, Rattus norvegicus
catcagccaggccattgaaagcgcc

SEQ ID NO: 533221 - DNA, 25 bp, Rattus norvegicus
tcagtcatatgcagaactcatcagc

SEQ ID NO: 533222 - DNA, 25 bp, Rattus norvegicus
atcatagacctcgatcccgacttcg

SEQ ID NO: 533223 - DNA, 25 bp, Rattus norvegicus
tgcctggggaaatcagtcatatgca

SEQ ID NO: 533224 - DNA, 25 bp, Rattus norvegicus
tcgaccagagctcgctacggagcca

SEQ ID NO: 533225 - DNA, 25 bp, Rattus norvegicus
cgaaccgtccgaggtggagcccagt

SEQ ID NO: 533226 - DNA, 25 bp, Rattus norvegicus
agcccagtctgggacagaaggtacc

SEQ ID NO: 533227 - DNA, 25 bp, Rattus norvegicus
cagaaggtacccacggagggacact

SEQ ID NO: 533228 - DNA, 25 bp, Rattus norvegicus
ggacactccgaaccgaccctgttgc

SEQ ID NO: 533229 - DNA, 25 bp, Rattus norvegicus
tcccgccggaatgcctggggaaatc

SEQ ID NO: 533230 - DNA, 25 bp, Rattus norvegicus
ttcctcgaccagagctcgctacgga

SEQ ID NO: 533231 - DNA, 25 bp, Rattus norvegicus
tgcgtctaatgactgaccagctctt

SEQ ID NO: 533232 - DNA, 25 bp, Rattus norvegicus
tggaattttatctgaaggcgcgcgc

SEQ ID NO: 533233 - DNA, 25 bp, Rattus norvegicus
aaggcgcttctggaattttatctga

SEQ ID NO: 533234 - DNA, 25 bp, Rattus norvegicus
cccgccaaagagaaggcgcttctgg

SEQ ID NO: 533235 - DNA, 25 bp, Rattus norvegicus
tccctctgcgcaaaggtggcctttc

SEQ ID NO: 533236 - DNA, 25 bp, Rattus norvegicus
gatgactcatccctctgcgcaaagg

SEQ ID NO: 533237 - DNA, 25 bp, Rattus norvegicus
cccagagtctttttgatgactcatc

SEQ ID NO: 533238 - DNA, 25 bp, Rattus norvegicus
agctctttcccagctccgatgacta

SEQ ID NO: 533239 - DNA, 25 bp, Rattus norvegicus
gtgtgattgacactatctgcgtcta

SEQ ID NO: 533240 - DNA, 25 bp, Rattus norvegicus
ggcccgagagactcccagatcattg

SEQ ID NO: 533241 - DNA, 25 bp, Rattus norvegicus
cttcggatgtcagcggttttagacc

SEQ ID NO: 533242 - DNA, 25 bp, Rattus norvegicus
gccagcgcccaagcttcggatgtca

SEQ ID NO: 533243 - DNA, 25 bp, Rattus norvegicus
gcaaacgccatcttcctgccagggg

SEQ ID NO: 533244 - DNA, 25 bp, Rattus norvegicus
tccgatgactagttccgctcccttt

SEQ ID NO: 533245 - DNA, 25 bp, Rattus norvegicus
ggcttcctgcgacactctgtgaagg

SEQ ID NO: 533246 - DNA, 25 bp, Rattus norvegicus
tacacaggcaatgggttcggagggc

SEQ ID NO: 533247 - DNA, 25 bp, Rattus norvegicus
gagctccgtcggctcgtttccggcg

SEQ ID NO: 533248 - DNA, 25 bp, Rattus norvegicus
cggtcgcgcgctcttttctcgggac

SEQ ID NO: 533249 - DNA, 25 bp, Rattus norvegicus
cgcgctcttttctcgggacggtgga

SEQ ID NO: 533250 - DNA, 25 bp, Rattus norvegicus
aggccgtgcagcgtcgcccttagtc

SEQ ID NO: 533251 - DNA, 25 bp, Rattus norvegicus
agcgtcgcccttagtctgagcgaag

SEQ ID NO: 533252 - DNA, 25 bp, Rattus norvegicus
tttgggatggctctttggttgcttg

SEQ ID NO: 533253 - DNA, 25 bp, Rattus norvegicus
acagtggggcttcctgcgacactct

SEQ ID NO: 533254 - DNA, 25 bp, Rattus norvegicus
cgaggccgggattgtacacaggcaa

SEQ ID NO: 533255 - DNA, 25 bp, Rattus norvegicus
cctgcgacactctgtgaaggaaggt

SEQ ID NO: 533256 - DNA, 25 bp, Rattus norvegicus
aaggccttcgcagcccacccgtgag

SEQ ID NO: 533257 - DNA, 25 bp, Rattus norvegicus
acccgtgagatccagcgcgcgctgt

SEQ ID NO: 533258 - DNA, 25 bp, Rattus norvegicus
tccagcgcgcgctgtgctcttcacc

SEQ ID NO: 533259 - DNA, 25 bp, Rattus norvegicus
acaagatgtaagtcggcccgcgtct

SEQ ID NO: 533260 - DNA, 25 bp, Rattus norvegicus
tggcgcgtcgaattccggaagtagt

SEQ ID NO: 533261 - DNA, 25 bp, Rattus norvegicus
cgctagagcctgagtgtctgctgtg

SEQ ID NO: 533262 - DNA, 25 bp, Rattus norvegicus
tgatctcggttcgtcgccaccatgg

SEQ ID NO: 533263 - DNA, 25 bp, Rattus norvegicus
cgacagcaccagaaggacaagatgt

SEQ ID NO: 533264 - DNA, 25 bp, Rattus norvegicus
ttccggaagtagttgagaaagcgga

SEQ ID NO: 533265 - DNA, 25 bp, Rattus norvegicus
cgcgtctcttgtctcatctcgtcga

SEQ ID NO: 533266 - DNA, 25 bp, Rattus norvegicus
ctcttgtctcatctcgtcgaggtgc

SEQ ID NO: 533267 - DNA, 25 bp, Rattus norvegicus
tcgtcgaggtgctgaaggttctaaa

SEQ ID NO: 533268 - DNA, 25 bp, Rattus norvegicus
aggttctaaaaagcctcatctctca

SEQ ID NO: 533269 - DNA, 25 bp, Rattus norvegicus
tcatctctcacaggcgcggtatcgt

SEQ ID NO: 533270 - DNA, 25 bp, Rattus norvegicus
tcaccgcagcctgtgcgggccaagg

SEQ ID NO: 533271 - DNA, 25 bp, Rattus norvegicus
ccatggggaagcgacagcaccagaa

SEQ ID NO: 533272 - DNA, 25 bp, Rattus norvegicus
agtgtctgctgtgatctcggttcgt

SEQ ID NO: 533273 - DNA, 25 bp, Rattus norvegicus
cgcggggcacttgattgtaacagaa

SEQ ID NO: 533274 - DNA, 25 bp, Rattus norvegicus
ggtgttgtcgcatgcgctctctata

SEQ ID NO: 533275 - DNA, 25 bp, Rattus norvegicus
tgcgctctctatagtcatgtttgtc

SEQ ID NO: 533276 - DNA, 25 bp, Rattus norvegicus
catgtttgtcgcaatgaaccttggg

SEQ ID NO: 533277 - DNA, 25 bp, Rattus norvegicus
ttgtttcggtcgaggagccgtcgcc

SEQ ID NO: 533278 - DNA, 25 bp, Rattus norvegicus
cgcaatgaaccttgggcggaaggtt

SEQ ID NO: 533279 - DNA, 25 bp, Rattus norvegicus
ttccggcctgtgttgtttcggtcga

SEQ ID NO: 533280 - DNA, 25 bp, Rattus norvegicus
tgtaacagaaagtagttccggcctg

SEQ ID NO: 533281 - DNA, 25 bp, Rattus norvegicus
gagcaagtgactttgattacagtca

SEQ ID NO: 533282 - DNA, 25 bp, Rattus norvegicus
tacagtcattttgtcggtagtcttg

SEQ ID NO: 533283 - DNA, 25 bp, Rattus norvegicus
ttgtcggtagtcttgttacgcgcta

SEQ ID NO: 533284 - DNA, 25 bp, Rattus norvegicus
ttgccgagacggtgttgtcgcatgc

SEQ ID NO: 533285 - DNA, 25 bp, Rattus norvegicus
cttgttacgcgctacctccgcgggg

SEQ ID NO: 533286 - DNA, 25 bp, Rattus norvegicus
cggaaggttacgtaagagcaagtga

SEQ ID NO: 533287 - DNA, 25 bp, Rattus norvegicus
ccgattgttagacggctggtcttga

SEQ ID NO: 533288 - DNA, 25 bp, Rattus norvegicus
ctggtcttgagaagggcgtgagaaa

SEQ ID NO: 533289 - DNA, 25 bp, Rattus norvegicus
tgggacacagacgacctagaaggcc

SEQ ID NO: 533290 - DNA, 25 bp, Rattus norvegicus
acagacgacctagaaggccagtgga

SEQ ID NO: 533291 - DNA, 25 bp, Rattus norvegicus
tgcaggcgactgagaaggcagacaa

SEQ ID NO: 533292 - DNA, 25 bp, Rattus norvegicus
gagcgaccgggaaggctgacaagac

SEQ ID NO: 533293 - DNA, 25 bp, Rattus norvegicus
aaacaggcgactggcgtaggctgag

SEQ ID NO: 533294 - DNA, 25 bp, Rattus norvegicus
gccgacggccgattgttagacggct

SEQ ID NO: 533295 - DNA, 25 bp, Rattus norvegicus
acgggtgaaggtataggccgaggca

SEQ ID NO: 533296 - DNA, 25 bp, Rattus norvegicus
ttgttagacggctggtcttgagaag

SEQ ID NO: 533297 - DNA, 25 bp, Rattus norvegicus
agcggatgaaggtgtaggccgagga

SEQ ID NO: 533298 - DNA, 25 bp, Rattus norvegicus
gcggtgggacacagacgacctagaa

SEQ ID NO: 533299 - DNA, 25 bp, Rattus norvegicus
cgaaatatggccgacggccgattgt

SEQ ID NO: 533300 - DNA, 25 bp, Rattus norvegicus
gcgggcaaaggtggacacgggtgaa

SEQ ID NO: 533301 - DNA, 25 bp, Rattus norvegicus
gatctgtaaggttctggtcggtgca

SEQ ID NO: 533302 - DNA, 25 bp, Rattus norvegicus
cccgaggacgatgaagaattgcaag

SEQ ID NO: 533303 - DNA, 25 bp, Rattus norvegicus
tgcccggggcttagcctattccatc

SEQ ID NO: 533304 - DNA, 25 bp, Rattus norvegicus
ctacccgtggctgtccctctaagat

SEQ ID NO: 533305 - DNA, 25 bp, Rattus norvegicus
ctctaagatcgagggacacggcctc

SEQ ID NO: 533306 - DNA, 25 bp, Rattus norvegicus
gggacgccgcacagacagcctgtac

SEQ ID NO: 533307 - DNA, 25 bp, Rattus norvegicus
gatgccgttctatcggcgcacggtg

SEQ ID NO: 533308 - DNA, 25 bp, Rattus norvegicus
ccgccacctccggagtgtttggaga

SEQ ID NO: 533309 - DNA, 25 bp, Rattus norvegicus
tgcagaccaaatcgttccggtggcc

SEQ ID NO: 533310 - DNA, 25 bp, Rattus norvegicus
ccaggaactgagtggtcgcgcctga

SEQ ID NO: 533311 - DNA, 25 bp, Rattus norvegicus
cgcctgagtctcttgtgatgagcta

SEQ ID NO: 533312 - DNA, 25 bp, Rattus norvegicus
actttgtaaagtgcgctcgagctgc

SEQ ID NO: 533313 - DNA, 25 bp, Rattus norvegicus
tctgcagtcagacccgtgcgacctg

SEQ ID NO: 533314 - DNA, 25 bp, Rattus norvegicus
ctcagggttcccgagtgctacaagg

SEQ ID NO: 533315 - DNA, 25 bp, Rattus norvegicus
tccagagcctgttgcaaggtactgc

SEQ ID NO: 533316 - DNA, 25 bp, Rattus norvegicus
tgaacgtgttcctctcctcgggcag

SEQ ID NO: 533317 - DNA, 25 bp, Rattus norvegicus
ggcgcagctcaatctccagagcctg

SEQ ID NO: 533318 - DNA, 25 bp, Rattus norvegicus
cccgagtgtagaggaactgcttcgc

SEQ ID NO: 533319 - DNA, 25 bp, Rattus norvegicus
atggcgacagccagtgaacgtgttc

SEQ ID NO: 533320 - DNA, 25 bp, Rattus norvegicus
actgcccactcgaggtcgtcatggc

SEQ ID NO: 533321 - DNA, 25 bp, Rattus norvegicus
cagaggtgacgccaacagaagcagg

SEQ ID NO: 533322 - DNA, 25 bp, Rattus norvegicus
caggcgcaggaaaccgaagagaagc

SEQ ID NO: 533323 - DNA, 25 bp, Rattus norvegicus
cggcaggatctgtcgaggaaaaatc

SEQ ID NO: 533324 - DNA, 25 bp, Rattus norvegicus
aaatcttgcagacagcgatccctcg

SEQ ID NO: 533325 - DNA, 25 bp, Rattus norvegicus
gcgatccctcgccttttaagctcag

SEQ ID NO: 533326 - DNA, 25 bp, Rattus norvegicus
ctgcagctaactcgggtcgggaaaa

SEQ ID NO: 533327 - DNA, 25 bp, Rattus norvegicus
tcgggaaaatgcgacagcgactgcc

SEQ ID NO: 533328 - DNA, 25 bp, Rattus norvegicus
aactgcttcgcgaggcgcagctcaa

SEQ ID NO: 533329 - DNA, 25 bp, Rattus norvegicus
ggattctccaagtcgcgcttgaatt

SEQ ID NO: 533330 - DNA, 25 bp, Rattus norvegicus
taaccgcgcggcgatgagtgtgaat

SEQ ID NO: 533331 - DNA, 25 bp, Rattus norvegicus
ttgaatttcgctcgctcccgcctta

SEQ ID NO: 533332 - DNA, 25 bp, Rattus norvegicus
cttacccaggctgggcgtaggaact

SEQ ID NO: 533333 - DNA, 25 bp, Rattus norvegicus
ttgagagagtgagtaaaatgcgcgc

SEQ ID NO: 533334 - DNA, 25 bp, Rattus norvegicus
tgtgaatgtttgagtactgagagcg

SEQ ID NO: 533335 - DNA, 25 bp, Rattus norvegicus
cggtgttgatttcactcccaggcta

SEQ ID NO: 533336 - DNA, 25 bp, Rattus norvegicus
ctgctgaatcatgtgaccggtgttg

SEQ ID NO: 533337 - DNA, 25 bp, Rattus norvegicus
gcccttcattttgagctgctgaatc

SEQ ID NO: 533338 - DNA, 25 bp, Rattus norvegicus
ctaccttagctagtgtggcccttca

SEQ ID NO: 533339 - DNA, 25 bp, Rattus norvegicus
attggctctcgcttgctaccttagc

SEQ ID NO: 533340 - DNA, 25 bp, Rattus norvegicus
cctgcgcagttgagtattggctctc

SEQ ID NO: 533341 - DNA, 25 bp, Rattus norvegicus
gtgctcgagcgctgtttcctgagcc

SEQ ID NO: 533342 - DNA, 25 bp, Rattus norvegicus
ccaatcccggatctggtgctcgagc

SEQ ID NO: 533343 - DNA, 25 bp, Rattus norvegicus
actcgccttcttccggcgaacgaag

SEQ ID NO: 533344 - DNA, 25 bp, Rattus norvegicus
ctgccttaccatggctgcgctggga

SEQ ID NO: 533345 - DNA, 25 bp, Rattus norvegicus
aggatggaagccgatgcaacccaag

SEQ ID NO: 533346 - DNA, 25 bp, Rattus norvegicus
tggaagccgatgcaacccaagagct

SEQ ID NO: 533347 - DNA, 25 bp, Rattus norvegicus
gccgatgcaacccaagagctcgctg

SEQ ID NO: 533348 - DNA, 25 bp, Rattus norvegicus
atgcaacccaagagctcgctgtacc

SEQ ID NO: 533349 - DNA, 25 bp, Rattus norvegicus
ccgggcaacaccgatcagggaggat

SEQ ID NO: 533350 - DNA, 25 bp, Rattus norvegicus
ccttaccatggctgcgctgggaacg

SEQ ID NO: 533351 - DNA, 25 bp, Rattus norvegicus
accatggctgcgctgggaacggaaa

SEQ ID NO: 533352 - DNA, 25 bp, Rattus norvegicus
aaagagactcgccttcttccggcga

SEQ ID NO: 533353 - DNA, 25 bp, Rattus norvegicus
gagactcgccttcttccggcgaacg

SEQ ID NO: 533354 - DNA, 25 bp, Rattus norvegicus
gggagccttgataccccgggcaaca

SEQ ID NO: 533355 - DNA, 25 bp, Rattus norvegicus
acgaagaaattagggtcggaggctg

SEQ ID NO: 533356 - DNA, 25 bp, Rattus norvegicus
cagtcgcagcctttcacagcgggcg

SEQ ID NO: 533357 - DNA, 25 bp, Rattus norvegicus
ttctccggacaagtgggctccgcgt

SEQ ID NO: 533358 - DNA, 25 bp, Rattus norvegicus
aggcgcggacgaagcgacctagccc

SEQ ID NO: 533359 - DNA, 25 bp, Rattus norvegicus
ggcgcctgggaaaagcctgcaccgc

SEQ ID NO: 533360 - DNA, 25 bp, Rattus norvegicus
gtctgctgcgggtttctccggacaa

SEQ ID NO: 533361 - DNA, 25 bp, Rattus norvegicus
cggcctgatgcagtcccggctatag

SEQ ID NO: 533362 - DNA, 25 bp, Rattus norvegicus
cccaaggaaacaagagctttgtgtg

SEQ ID NO: 533363 - DNA, 25 bp, Rattus norvegicus
gctgaactcagccagaagcccttct

SEQ ID NO: 533364 - DNA, 25 bp, Rattus norvegicus
gaatgttccaacttccacctcgcag

SEQ ID NO: 533365 - DNA, 25 bp, Rattus norvegicus
aacgctaaaagtggcgtggccctga

SEQ ID NO: 533366 - DNA, 25 bp, Rattus norvegicus
ggtgtgataacttgacccaaggtca

SEQ ID NO: 533367 - DNA, 25 bp, Rattus norvegicus
agcgaagattcgaggtgctcacagg

SEQ ID NO: 533368 - DNA, 25 bp, Rattus norvegicus
gctcccagctggctagcgaagattc

SEQ ID NO: 533369 - DNA, 25 bp, Rattus norvegicus
gcagtcccggctataggcaaagtca

SEQ ID NO: 533370 - DNA, 25 bp, Rattus norvegicus
tgctgcgtagggaaagcaagttgcc

SEQ ID NO: 533371 - DNA, 25 bp, Rattus norvegicus
gcgcctgcgtcgctgtctcagatgc

SEQ ID NO: 533372 - DNA, 25 bp, Rattus norvegicus
aaggtacagcagctgctgaggcgcc

SEQ ID NO: 533373 - DNA, 25 bp, Rattus norvegicus
agcgtgaaggtacagcagctgctga

SEQ ID NO: 533374 - DNA, 25 bp, Rattus norvegicus
cagcggaaccaagcgtgaaggtaca

SEQ ID NO: 533375 - DNA, 25 bp, Rattus norvegicus
accaggagggttgatcgttgacgct

SEQ ID NO: 533376 - DNA, 25 bp, Rattus norvegicus
tcgcccgcagcagtctcagagagcg

SEQ ID NO: 533377 - DNA, 25 bp, Rattus norvegicus
gtcgcgaccattcaacagctggcct

SEQ ID NO: 533378 - DNA, 25 bp, Rattus norvegicus
ttcagtgtcgcgaccattcaacagc

SEQ ID NO: 533379 - DNA, 25 bp, Rattus norvegicus
ggcgttggcacagcacccgcgcctg

SEQ ID NO: 533380 - DNA, 25 bp, Rattus norvegicus
tctcagatgcggtgaggaggattca

SEQ ID NO: 533381 - DNA, 25 bp, Rattus norvegicus
agctctgcgaatccacccggcggct

SEQ ID NO: 533382 - DNA, 25 bp, Rattus norvegicus
tggcggtcccgctacctcagcggaa

SEQ ID NO: 533383 - DNA, 25 bp, Rattus norvegicus
aggaggattcagtgtcgcgaccatt

SEQ ID NO: 533384 - DNA, 25 bp, Rattus norvegicus
cagcagtctcagagagcgaccagga

SEQ ID NO: 533385 - DNA, 25 bp, Rattus norvegicus
cctagccaggtccgggctgcagcgt

SEQ ID NO: 533386 - DNA, 25 bp, Rattus norvegicus
gggctgcagcgtggtccccgcgaga

SEQ ID NO: 533387 - DNA, 25 bp, Rattus norvegicus
ggtccgggctgcagcgtggtccccg

SEQ ID NO: 533388 - DNA, 25 bp, Rattus norvegicus
caggtccgggctgcagcgtggtccc

SEQ ID NO: 533389 - DNA, 25 bp, Rattus norvegicus
gccaggtccgggctgcagcgtggtc

SEQ ID NO: 533390 - DNA, 25 bp, Rattus norvegicus
tcctagccaggtccgggctgcagcg

SEQ ID NO: 533391 - DNA, 25 bp, Rattus norvegicus
gctcctagccaggtccgggctgcag

SEQ ID NO: 533392 - DNA, 25 bp, Rattus norvegicus
ccagtgagagccgcctcgccgctct

SEQ ID NO: 533393 - DNA, 25 bp, Rattus norvegicus
tgccagtgagagccgcctcgccgct

SEQ ID NO: 533394 - DNA, 25 bp, Rattus norvegicus
ctgccagtgagagccgcctcgccgc

SEQ ID NO: 533395 - DNA, 25 bp, Rattus norvegicus
gctgccagtgagagccgcctcgccg

SEQ ID NO: 533396 - DNA, 25 bp, Rattus norvegicus
ggctgccagtgagagccgcctcgcc

SEQ ID NO: 533397 - DNA, 25 bp, Rattus norvegicus
gggctgccagtgagagccgcctcgc

SEQ ID NO: 533398 - DNA, 25 bp, Rattus norvegicus
ccaggtccgggctgcagcgtggtcc

SEQ ID NO: 533399 - DNA, 25 bp, Rattus norvegicus
tccaggcctgcggaaaccttctaag

SEQ ID NO: 533400 - DNA, 25 bp, Rattus norvegicus
ggcggccttggagtttcacttcagg

SEQ ID NO: 533401 - DNA, 25 bp, Rattus norvegicus
acacccgggacacttggactccagg

SEQ ID NO: 533402 - DNA, 25 bp, Rattus norvegicus
cgggacacttggactccaggcctgc

SEQ ID NO: 533403 - DNA, 25 bp, Rattus norvegicus
cggaaaccttctaagtgctcacttg

SEQ ID NO: 533404 - DNA, 25 bp, Rattus norvegicus
tgctcacttgctcgtgtagccaatg

SEQ ID NO: 533405 - DNA, 25 bp, Rattus norvegicus
tgtagccaatggtttccgcgcagca

SEQ ID NO: 533406 - DNA, 25 bp, Rattus norvegicus
tctaggcttcagtctgcgaagaccc

SEQ ID NO: 533407 - DNA, 25 bp, Rattus norvegicus
tcctccgcttgaccgaaggagaccg

SEQ ID NO: 533408 - DNA, 25 bp, Rattus norvegicus
agactcgggcgacaacagccggtct

SEQ ID NO: 533409 - DNA, 25 bp, Rattus norvegicus
aacagccggtctgcgccttgggcac

SEQ ID NO: 533410 - DNA, 25 bp, Rattus norvegicus
cccagaatgtgtcgcgtaggcgatg

SEQ ID NO: 533411 - DNA, 25 bp, Rattus norvegicus
tgtcgcgtaggcgatgtgtcctccc

SEQ ID NO: 533412 - DNA, 25 bp, Rattus norvegicus
agcctcccgcggtctaggcttcagt

SEQ ID NO: 533413 - DNA, 25 bp, Rattus norvegicus
cccatccggcccaggctcggtcagc

SEQ ID NO: 533414 - DNA, 25 bp, Rattus norvegicus
cgcctgcgcccaacaggtgcttccc

SEQ ID NO: 533415 - DNA, 25 bp, Rattus norvegicus
cgcagctcctcaggtctctgcagag

SEQ ID NO: 533416 - DNA, 25 bp, Rattus norvegicus
ctcaggtctctgcagagcgagcacc

SEQ ID NO: 533417 - DNA, 25 bp, Rattus norvegicus
cacccgtactcacggccgctcggcg

SEQ ID NO: 533418 - DNA, 25 bp, Rattus norvegicus
cagcgcgggctcagttttcaagcgg

SEQ ID NO: 533419 - DNA, 25 bp, Rattus norvegicus
cgggctcagttttcaagcggtccta

SEQ ID NO: 533420 - DNA, 25 bp, Rattus norvegicus
ctgtcccggcgcgaggcatcctcct

SEQ ID NO: 533421 - DNA, 25 bp, Rattus norvegicus
tgttttggagccgtagcccggccca

SEQ ID NO: 533422 - DNA, 25 bp, Rattus norvegicus
agccgccataaacggcctcggaacg

SEQ ID NO: 533423 - DNA, 25 bp, Rattus norvegicus
cataaacggcctcggaacgcggcgc

SEQ ID NO: 533424 - DNA, 25 bp, Rattus norvegicus
ctggccaatcagtgtccgcgccacg

SEQ ID NO: 533425 - DNA, 25 bp, Rattus norvegicus
ctcagttttcaagcggtcctagtag

SEQ ID NO: 533426 - DNA, 25 bp, Rattus norvegicus
tctctgcagagcgagcacccgggac

SEQ ID NO: 533427 - DNA, 25 bp, Rattus norvegicus
tggggtccacaaaggagctcgcaga

SEQ ID NO: 533428 - DNA, 25 bp, Rattus norvegicus
tctgcggccagattgctgtgggaac

SEQ ID NO: 533429 - DNA, 25 bp, Rattus norvegicus
aggagatgcgcgtccacgggcattc

SEQ ID NO: 533430 - DNA, 25 bp, Rattus norvegicus
cgcggacgttctcacctgcggcttt

SEQ ID NO: 533431 - DNA, 25 bp, Rattus norvegicus
tgggtgccacctctaccgcggacgt

SEQ ID NO: 533432 - DNA, 25 bp, Rattus norvegicus
ctctgagacccgcaggccctgggtg

SEQ ID NO: 533433 - DNA, 25 bp, Rattus norvegicus
ctcagaagaagtgctctcggggctc

SEQ ID NO: 533434 - DNA, 25 bp, Rattus norvegicus
ggtccacaaaggagctcgcagaagc

SEQ ID NO: 533435 - DNA, 25 bp, Rattus norvegicus
ccagcagcagctcagctactttcta

SEQ ID NO: 533436 - DNA, 25 bp, Rattus norvegicus
accagcaggtactgcgccagcagca

SEQ ID NO: 533437 - DNA, 25 bp, Rattus norvegicus
tcgcgttcttaaccagcaggtactg

SEQ ID NO: 533438 - DNA, 25 bp, Rattus norvegicus
gtcttcgcgttcttaaccagcaggt

SEQ ID NO: 533439 - DNA, 25 bp, Rattus norvegicus
tcagctactttctagctcccggggc

SEQ ID NO: 533440 - DNA, 25 bp, Rattus norvegicus
gggctacgtgcctcagaagaagtgc

SEQ ID NO: 533441 - DNA, 25 bp, Rattus norvegicus
gacagactcggctctgcgcgctccc

SEQ ID NO: 533442 - DNA, 25 bp, Rattus norvegicus
cggagacagactcggctctgcgcgc

SEQ ID NO: 533443 - DNA, 25 bp, Rattus norvegicus
tgcggagacagactcggctctgcgc

SEQ ID NO: 533444 - DNA, 25 bp, Rattus norvegicus
gctgcggagacagactcggctctgc

SEQ ID NO: 533445 - DNA, 25 bp, Rattus norvegicus
cagccagcccacgaccgagcgcggc

SEQ ID NO: 533446 - DNA, 25 bp, Rattus norvegicus
cgcacgccagccagcccacgaccga

SEQ ID NO: 533447 - DNA, 25 bp, Rattus norvegicus
tgcccggaccacagacgccaacacc

SEQ ID NO: 533448 - DNA, 25 bp, Rattus norvegicus
cagctgcccggaccacagacgccaa

SEQ ID NO: 533449 - DNA, 25 bp, Rattus norvegicus
gaagccttcccagctgcccggacca

SEQ ID NO: 533450 - DNA, 25 bp, Rattus norvegicus
agagacagaagccttcccagctgcc

SEQ ID NO: 533451 - DNA, 25 bp, Rattus norvegicus
cagggggaaccaaagagacagaagc

SEQ ID NO: 533452 - DNA, 25 bp, Rattus norvegicus
cagccacagggggaaccaaagagac

SEQ ID NO: 533453 - DNA, 25 bp, Rattus norvegicus
tgcgcactggtaccccagcccaggc

SEQ ID NO: 533454 - DNA, 25 bp, Rattus norvegicus
tgggcgccccagaggctgcgcactg

SEQ ID NO: 533455 - DNA, 25 bp, Rattus norvegicus
ccctggagaccatgaactttgacgt

SEQ ID NO: 533456 - DNA, 25 bp, Rattus norvegicus
ccagcgctgacttcaaggatttcga

SEQ ID NO: 533457 - DNA, 25 bp, Rattus norvegicus
ccgcaagattttcgtggggagattc

SEQ ID NO: 533458 - DNA, 25 bp, Rattus norvegicus
cgctgaatggcatgttcctgaacta

SEQ ID NO: 533459 - DNA, 25 bp, Rattus norvegicus
tacgggttcgtgcacttccagaagc

SEQ ID NO: 533460 - DNA, 25 bp, Rattus norvegicus
tggcaacatcctgtcctgcaaggtg

SEQ ID NO: 533461 - DNA, 25 bp, Rattus norvegicus
aaggcgctgtacaacatcttctcgg

SEQ ID NO: 533462 - DNA, 25 bp, Rattus norvegicus
ccagtgcgcatcatgtggtcccaga

SEQ ID NO: 533463 - DNA, 25 bp, Rattus norvegicus
taccagcaaccggtggacgccaagc

SEQ ID NO: 533464 - DNA, 25 bp, Rattus norvegicus
ctctgggctacgcatatgtcaacta

SEQ ID NO: 533465 - DNA, 25 bp, Rattus norvegicus
gtgaccgagtccatgctgtatgaga

SEQ ID NO: 533466 - DNA, 25 bp, Rattus norvegicus
ctcggacgatgggaacccagacttt

SEQ ID NO: 533467 - DNA, 25 bp, Rattus norvegicus
cgactcggatgacgaggccaccttc

SEQ ID NO: 533468 - DNA, 25 bp, Rattus norvegicus
gggtgggcaacgtcttcatcaagaa

SEQ ID NO: 533469 - DNA, 25 bp, Rattus norvegicus
catggcggagttcgacaccatctcg

SEQ ID NO: 533470 - DNA, 25 bp, Rattus norvegicus
gtccgaaacgcagaaacgcagtatg

SEQ ID NO: 533471 - DNA, 25 bp, Rattus norvegicus
cgcagtatgaagatcagcacccgca

SEQ ID NO: 533472 - DNA, 25 bp, Rattus norvegicus
tgaagatcagcacccgcagaccgga

SEQ ID NO: 533473 - DNA, 25 bp, Rattus norvegicus
cggacctcgagaattccctggagtt

SEQ ID NO: 533474 - DNA, 25 bp, Rattus norvegicus
ggcgcgcaagcgtacaccgaattta

SEQ ID NO: 533475 - DNA, 25 bp, Rattus norvegicus
cgaatttactccctggtccctcgtg

SEQ ID NO: 533476 - DNA, 25 bp, Rattus norvegicus
gcaggcgcgtctcctcaagcgcttt

SEQ ID NO: 533477 - DNA, 25 bp, Rattus norvegicus
agctccgcaggttcaaactcttctc

SEQ ID NO: 533478 - DNA, 25 bp, Rattus norvegicus
tcaaactcttctcccggagagtggc

SEQ ID NO: 533479 - DNA, 25 bp, Rattus norvegicus
cgcggtcacgtgatgagcatcctgc

SEQ ID NO: 533480 - DNA, 25 bp, Rattus norvegicus
cccaacatggcggagttcgacacca

SEQ ID NO: 533481 - DNA, 25 bp, Rattus norvegicus
attccctggagttcacctctaccgg

SEQ ID NO: 533482 - DNA, 25 bp, Rattus norvegicus
acccgcagaccggacctcgagaatt

SEQ ID NO: 533483 - DNA, 25 bp, Rattus norvegicus
agatgcttaaggttccggcgggaca

SEQ ID NO: 533484 - DNA, 25 bp, Rattus norvegicus
gtcagtggaacggtgtctgaagttc

SEQ ID NO: 533485 - DNA, 25 bp, Rattus norvegicus
cggtgtctgaagttcttgcgcgata

SEQ ID NO: 533486 - DNA, 25 bp, Rattus norvegicus
tctgaagttcttgcgcgatagtggg

SEQ ID NO: 533487 - DNA, 25 bp, Rattus norvegicus
cagcttcggcgagcaagtgatggaa

SEQ ID NO: 533488 - DNA, 25 bp, Rattus norvegicus
ggttaacatgcttggcgggtcagta

SEQ ID NO: 533489 - DNA, 25 bp, Rattus norvegicus
ggtacccactcctggcaggcagctt

SEQ ID NO: 533490 - DNA, 25 bp, Rattus norvegicus
aggtggctgaagttactgcgcgaca

SEQ ID NO: 533491 - DNA, 25 bp, Rattus norvegicus
tgtgttggacgggtacccactcctg

SEQ ID NO: 533492 - DNA, 25 bp, Rattus norvegicus
tcctgcagtagtttgtgttggacgg

SEQ ID NO: 533493 - DNA, 25 bp, Rattus norvegicus
gggacaagaaagatgcttaaggttc

SEQ ID NO: 533494 - DNA, 25 bp, Rattus norvegicus
ccgcttcttgagtcctgcagtagtt

SEQ ID NO: 533495 - DNA, 25 bp, Rattus norvegicus
ttgcgctctgccctttctccattcg

SEQ ID NO: 533496 - DNA, 25 bp, Rattus norvegicus
ctttccggactatctccgcttcttg

SEQ ID NO: 533497 - DNA, 25 bp, Rattus norvegicus
ggtcacgttgctggagcagccatta

SEQ ID NO: 533498 - DNA, 25 bp, Rattus norvegicus
gtttggctgtgacgcatgctctccc

SEQ ID NO: 533499 - DNA, 25 bp, Rattus norvegicus
gctcagtcatctgcggaagcaaccg

SEQ ID NO: 533500 - DNA, 25 bp, Rattus norvegicus
ttctataacttgtaagatggcggcg

SEQ ID NO: 533501 - DNA, 25 bp, Rattus norvegicus
tccgcggcgccagaaatccaggctt

SEQ ID NO: 533502 - DNA, 25 bp, Rattus norvegicus
caaggacggtttggctgtgacgcat

SEQ ID NO: 533503 - DNA, 25 bp, Rattus norvegicus
agatggcggcgtccacacgtatgct

SEQ ID NO: 533504 - DNA, 25 bp, Rattus norvegicus
caagcgctcagtcatctgcggaagc

SEQ ID NO: 533505 - DNA, 25 bp, Rattus norvegicus
gagcagccattagggaagagcgtga

SEQ ID NO: 533506 - DNA, 25 bp, Rattus norvegicus
tctgcggaagcaaccgctgacagtc

SEQ ID NO: 533507 - DNA, 25 bp, Rattus norvegicus
accgctgacagtctgggtcacgttg

SEQ ID NO: 533508 - DNA, 25 bp, Rattus norvegicus
gcggcgtccacacgtatgcttcctt

SEQ ID NO: 533509 - DNA, 25 bp, Rattus norvegicus
gaaatccaggcttctataacttgta

SEQ ID NO: 533510 - DNA, 25 bp, Rattus norvegicus
ggcgccagaaatccaggcttctata

SEQ ID NO: 533511 - DNA, 25 bp, Rattus norvegicus
gtgcacgggcaactacgaagagcgc

SEQ ID NO: 533512 - DNA, 25 bp, Rattus norvegicus
cacgggcaactacgaagagcgcgtg

SEQ ID NO: 533513 - DNA, 25 bp, Rattus norvegicus
atcttggagccagcgatcttggagc

SEQ ID NO: 533514 - DNA, 25 bp, Rattus norvegicus
ccagcgatcttggagcgagcgagca

SEQ ID NO: 533515 - DNA, 25 bp, Rattus norvegicus
aggcgagatcttggagccagcgatc

SEQ ID NO: 533516 - DNA, 25 bp, Rattus norvegicus
cctgacaggcgagatcttggagcca

SEQ ID NO: 533517 - DNA, 25 bp, Rattus norvegicus
ggagaacctgacaggcgagatcttg

SEQ ID NO: 533518 - DNA, 25 bp, Rattus norvegicus
actcattccttgatgtgcacgggca

SEQ ID NO: 533519 - DNA, 25 bp, Rattus norvegicus
attccttgatgtgcacgggcaacta

SEQ ID NO: 533520 - DNA, 25 bp, Rattus norvegicus
gggcgcctgtgtacctggcagcggt

SEQ ID NO: 533521 - DNA, 25 bp, Rattus norvegicus
ggccgctttcactcattccttgatg

SEQ ID NO: 533522 - DNA, 25 bp, Rattus norvegicus
cgggccgctttcactcattccttga

SEQ ID NO: 533523 - DNA, 25 bp, Rattus norvegicus
ctcgctccctgttcggcgcgggcct

SEQ ID NO: 533524 - DNA, 25 bp, Rattus norvegicus
ccttgatgtgcacgggcaactacga

SEQ ID NO: 533525 - DNA, 25 bp, Rattus norvegicus
tcgatccctaatgttaaactcactc

SEQ ID NO: 533526 - DNA, 25 bp, Rattus norvegicus
cgcaatcataattaccagaacgttg

SEQ ID NO: 533527 - DNA, 25 bp, Rattus norvegicus
ttaccagaacgttgcacgcctaccg

SEQ ID NO: 533528 - DNA, 25 bp, Rattus norvegicus
taccgccctcccagccaagccacag

SEQ ID NO: 533529 - DNA, 25 bp, Rattus norvegicus
acaggcaacacgcacgcgcagttct

SEQ ID NO: 533530 - DNA, 25 bp, Rattus norvegicus
ccctcgctatttcgcaatcataatt

SEQ ID NO: 533531 - DNA, 25 bp, Rattus norvegicus
gcgcagttctcgatccctaatgtta

SEQ ID NO: 533532 - DNA, 25 bp, Rattus norvegicus
taaactcactcaaacccgcgacatg

SEQ ID NO: 533533 - DNA, 25 bp, Rattus norvegicus
cgcgacatgcttccacttacgcatg

SEQ ID NO: 533534 - DNA, 25 bp, Rattus norvegicus
ttccacttacgcatgcgcattttta

SEQ ID NO: 533535 - DNA, 25 bp, Rattus norvegicus
cgcatttttattcccgcgcagaaga

SEQ ID NO: 533536 - DNA, 25 bp, Rattus norvegicus
tttattcccgcgcagaagacttttg

SEQ ID NO: 533537 - DNA, 25 bp, Rattus norvegicus
acttttgcaggcagggagcatgcgt

SEQ ID NO: 533538 - DNA, 25 bp, Rattus norvegicus
cccgcgcagaagacttttgcaggca

SEQ ID NO: 533539 - DNA, 25 bp, Rattus norvegicus
cgcgcagcgttcagtggctctgcaa

SEQ ID NO: 533540 - DNA, 25 bp, Rattus norvegicus
aacatcccgggccttcgagccttgc

SEQ ID NO: 533541 - DNA, 25 bp, Rattus norvegicus
acgccacgccttcgcggccacctaa

SEQ ID NO: 533542 - DNA, 25 bp, Rattus norvegicus
actccatcgtatcgccttagttcgg

SEQ ID NO: 533543 - DNA, 25 bp, Rattus norvegicus
gtggctctgcaagaaaagcctcgag

SEQ ID NO: 533544 - DNA, 25 bp, Rattus norvegicus
cgttcagtggctctgcaagaaaagc

SEQ ID NO: 533545 - DNA, 25 bp, Rattus norvegicus
taagcgaacagtggcgcgcagcgtt

SEQ ID NO: 533546 - DNA, 25 bp, Rattus norvegicus
tcctggactccatcgtatcgcctta

SEQ ID NO: 533547 - DNA, 25 bp, Rattus norvegicus
cgtacccggcccatagaacttgcgg

SEQ ID NO: 533548 - DNA, 25 bp, Rattus norvegicus
aagcttcagcctcattcgggcatcc

SEQ ID NO: 533549 - DNA, 25 bp, Rattus norvegicus
gagccttgctgtccctcccacccgc

SEQ ID NO: 533550 - DNA, 25 bp, Rattus norvegicus
ggcggagcctctacgccacgccttc

SEQ ID NO: 533551 - DNA, 25 bp, Rattus norvegicus
gctaccttcgaaaacttcaccaaca

SEQ ID NO: 533552 - DNA, 25 bp, Rattus norvegicus
gcggtttccaagcttcagcctcatt

SEQ ID NO: 533553 - DNA, 25 bp, Rattus norvegicus
gcccgagactaagatgcagccctaa

SEQ ID NO: 533554 - DNA, 25 bp, Rattus norvegicus
actgagcaatgttcagcaccggctc

SEQ ID NO: 533555 - DNA, 25 bp, Rattus norvegicus
cagcaccggctcagtgtgtctgtca

SEQ ID NO: 533556 - DNA, 25 bp, Rattus norvegicus
ccgatttggcccgagactaagatgc

SEQ ID NO: 533557 - DNA, 25 bp, Rattus norvegicus
gctgagcagcccagccggagtcaaa

SEQ ID NO: 533558 - DNA, 25 bp, Rattus norvegicus
taagatgcagccctaaccgagtccc

SEQ ID NO: 533559 - DNA, 25 bp, Rattus norvegicus
ccgcctgcactcctagatggttcta

SEQ ID NO: 533560 - DNA, 25 bp, Rattus norvegicus
cactcctagatggttctagggtgcg

SEQ ID NO: 533561 - DNA, 25 bp, Rattus norvegicus
cagggacgatgccactgagcaatgt

SEQ ID NO: 533562 - DNA, 25 bp, Rattus norvegicus
ggtgacaagcatccggctcgggccc

SEQ ID NO: 533563 - DNA, 25 bp, Rattus norvegicus
gcgcctggtgacaagcatccggctc

SEQ ID NO: 533564 - DNA, 25 bp, Rattus norvegicus
ctgtcactgcgggaacacacggggt

SEQ ID NO: 533565 - DNA, 25 bp, Rattus norvegicus
accggctcagtgtgtctgtcactgc

SEQ ID NO: 533566 - DNA, 25 bp, Rattus norvegicus
agtcaaagtcccacctcccgatttg

SEQ ID NO: 533567 - DNA, 25 bp, Rattus norvegicus
tgggcacgacggcaccacaatgcac

SEQ ID NO: 533568 - DNA, 25 bp, Rattus norvegicus
gctccggcttcaacgtggtccttgt

SEQ ID NO: 533569 - DNA, 25 bp, Rattus norvegicus
cgtcaacgccttcaaccaggaggtg

SEQ ID NO: 533570 - DNA, 25 bp, Rattus norvegicus
cgcaacgcgaacatggacgccgtca

SEQ ID NO: 533571 - DNA, 25 bp, Rattus norvegicus
ctcacagaactgagcaggggcccgc

SEQ ID NO: 533572 - DNA, 25 bp, Rattus norvegicus
cgccaccaccaaacggacatgttgg

SEQ ID NO: 533573 - DNA, 25 bp, Rattus norvegicus
ccgtgtcagcgcgacgcagagcgca

SEQ ID NO: 533574 - DNA, 25 bp, Rattus norvegicus
gagagacagagaggcccgcccgcta

SEQ ID NO: 533575 - DNA, 25 bp, Rattus norvegicus
gccgccatcctgctggcgaaagaga

SEQ ID NO: 533576 - DNA, 25 bp, Rattus norvegicus
ctgagcccagaagaacgggaccctc

SEQ ID NO: 533577 - DNA, 25 bp, Rattus norvegicus
ccgcgctttgtttgtcgcagcaacg

SEQ ID NO: 533578 - DNA, 25 bp, Rattus norvegicus
agatgctcatcctccgcgctttgtt

SEQ ID NO: 533579 - DNA, 25 bp, Rattus norvegicus
ccgagggctttagagcaccgagtcg

SEQ ID NO: 533580 - DNA, 25 bp, Rattus norvegicus
ctcaaccggcgggaaagcgcgctac

SEQ ID NO: 533581 - DNA, 25 bp, Rattus norvegicus
cttcttccaagagccggccgccaca

SEQ ID NO: 533582 - DNA, 25 bp, Rattus norvegicus
actggagccattctcacgcctgagg

SEQ ID NO: 533583 - DNA, 25 bp, Rattus norvegicus
attctcacgcctgaggcccagagtc

SEQ ID NO: 533584 - DNA, 25 bp, Rattus norvegicus
cctgaggcccagagtccaggatcgc

SEQ ID NO: 533585 - DNA, 25 bp, Rattus norvegicus
tgggagaggaagtcctacccgcttc

SEQ ID NO: 533586 - DNA, 25 bp, Rattus norvegicus
agaagcactggagccattctcacgc

SEQ ID NO: 533587 - DNA, 25 bp, Rattus norvegicus
caactaaaatggcagcggcgactac

SEQ ID NO: 533588 - DNA, 25 bp, Rattus norvegicus
ggccattttgagagccgcgacgccc

SEQ ID NO: 533589 - DNA, 25 bp, Rattus norvegicus
tccagcccgacatcccatttctcag

SEQ ID NO: 533590 - DNA, 25 bp, Rattus norvegicus
cgccacccaactaaaatggcagcgg

SEQ ID NO: 533591 - DNA, 25 bp, Rattus norvegicus
cgtgccttcacttactcgatgtttc

SEQ ID NO: 533592 - DNA, 25 bp, Rattus norvegicus
atttctcagcgtacccgtgccttca

SEQ ID NO: 533593 - DNA, 25 bp, Rattus norvegicus
gacctctgagtaaggagaagcactg

SEQ ID NO: 533594 - DNA, 25 bp, Rattus norvegicus
cggctggccactcgggccattttga

SEQ ID NO: 533595 - DNA, 25 bp, Rattus norvegicus
cgctccctcggaagcgtgccttggg

SEQ ID NO: 533596 - DNA, 25 bp, Rattus norvegicus
cgcggtctgcacactttcggggagt

SEQ ID NO: 533597 - DNA, 25 bp, Rattus norvegicus
tttcctagattgcagcgcacgctcg

SEQ ID NO: 533598 - DNA, 25 bp, Rattus norvegicus
cttgggccgtgccatgttcccggac

SEQ ID NO: 533599 - DNA, 25 bp, Rattus norvegicus
gcacctctgcagcttcggccgggat

SEQ ID NO: 533600 - DNA, 25 bp, Rattus norvegicus
gtacggcggagccttcgcacctctg

SEQ ID NO: 533601 - DNA, 25 bp, Rattus norvegicus
taacttcttgtcagtcgccggcggc

SEQ ID NO: 533602 - DNA, 25 bp, Rattus norvegicus
tttcctgcaaaggtgacaagcctgg

SEQ ID NO: 533603 - DNA, 25 bp, Rattus norvegicus
gggcagcgggccaatttcctgcaaa

SEQ ID NO: 533604 - DNA, 25 bp, Rattus norvegicus
acagcgtcaatctgacggctgggga

SEQ ID NO: 533605 - DNA, 25 bp, Rattus norvegicus
gagtcccggagaacagcgtcaatct

SEQ ID NO: 533606 - DNA, 25 bp, Rattus norvegicus
atcgagtcgcagcagcgtgcctgaa

SEQ ID NO: 533607 - DNA, 25 bp, Rattus norvegicus
cagggctggacaagatcgagtcgca

SEQ ID NO: 533608 - DNA, 25 bp, Rattus norvegicus
cggcggcacacaggcctttcctaga

SEQ ID NO: 533609 - DNA, 25 bp, Rattus norvegicus
ctgacgcgccgctctggtacgaact

SEQ ID NO: 533610 - DNA, 25 bp, Rattus norvegicus
gaactgccgaatgcttgtgcttttc

SEQ ID NO: 533611 - DNA, 25 bp, Rattus norvegicus
aggcctgagccgcagatggagacta

SEQ ID NO: 533612 - DNA, 25 bp, Rattus norvegicus
agccgcagatggagactagagaccg

SEQ ID NO: 533613 - DNA, 25 bp, Rattus norvegicus
ctagagaccgggtcagaactgccga

SEQ ID NO: 533614 - DNA, 25 bp, Rattus norvegicus
acagccgagcgcttcctgacgcgcc

SEQ ID NO: 533615 - DNA, 25 bp, Rattus norvegicus
ccgggtcagaactgccgaatgcttg

SEQ ID NO: 533616 - DNA, 25 bp, Rattus norvegicus
ccgaatgcttgtgcttttcgaaagc

SEQ ID NO: 533617 - DNA, 25 bp, Rattus norvegicus
cttttcgaaagcgaccgccgcggct

SEQ ID NO: 533618 - DNA, 25 bp, Rattus norvegicus
gctgcccagcgccaagaatgtatcg

SEQ ID NO: 533619 - DNA, 25 bp, Rattus norvegicus
gccaagaatgtatcgcgagcagcgc

SEQ ID NO: 533620 - DNA, 25 bp, Rattus norvegicus
ggtacgaactccaccgcaggcctga

SEQ ID NO: 533621 - DNA, 25 bp, Rattus norvegicus
cagcgccatcttgagcgagggaaaa

SEQ ID NO: 533622 - DNA, 25 bp, Rattus norvegicus
atgtatcgcgagcagcgccatcttg

SEQ ID NO: 533623 - DNA, 25 bp, Rattus norvegicus
gtaaactctacttctagcccaagtc

SEQ ID NO: 533624 - DNA, 25 bp, Rattus norvegicus
ccacggagttacagcgtccggactc

SEQ ID NO: 533625 - DNA, 25 bp, Rattus norvegicus
ttatccttttatccctagggcttga

SEQ ID NO: 533626 - DNA, 25 bp, Rattus norvegicus
tgtcacaaccggcaagtaaactcta

SEQ ID NO: 533627 - DNA, 25 bp, Rattus norvegicus
gagttacagcgtccggactccatgc

SEQ ID NO: 533628 - DNA, 25 bp, Rattus norvegicus
cccgtgtatggccacggagttacag

SEQ ID NO: 533629 - DNA, 25 bp, Rattus norvegicus
tcccgagcgcctgttagccgaggac

SEQ ID NO: 533630 - DNA, 25 bp, Rattus norvegicus
atgggacaaagcgtgcgaaaggacc

SEQ ID NO: 533631 - DNA, 25 bp, Rattus norvegicus
acaaagcgtgcgaaaggaccgcgga

SEQ ID NO: 533632 - DNA, 25 bp, Rattus norvegicus
agagggcaaccagggttagagatta

SEQ ID NO: 533633 - DNA, 25 bp, Rattus norvegicus
caaccagggttagagattaggagga

SEQ ID NO: 533634 - DNA, 25 bp, Rattus norvegicus
ccactgggaagcacgtgtccgtatc

SEQ ID NO: 533635 - DNA, 25 bp, Rattus norvegicus
acgtgtccgtatccctttcttcctg

SEQ ID NO: 533636 - DNA, 25 bp, Rattus norvegicus
catgccctgtcacaaccggcaagta

SEQ ID NO: 533637 - DNA, 25 bp, Rattus norvegicus
tagcctggcgggaaatcgtcctcga

SEQ ID NO: 533638 - DNA, 25 bp, Rattus norvegicus
cttcggctcgaagatcgaccaagca

SEQ ID NO: 533639 - DNA, 25 bp, Rattus norvegicus
gacgaggacaataacgagcactggc

SEQ ID NO: 533640 - DNA, 25 bp, Rattus norvegicus
ggacaataacgagcactggcaccca

SEQ ID NO: 533641 - DNA, 25 bp, Rattus norvegicus
acgagcactggcacccaggacagta

SEQ ID NO: 533642 - DNA, 25 bp, Rattus norvegicus
aggacagtacccggcggcagcaccg

SEQ ID NO: 533643 - DNA, 25 bp, Rattus norvegicus
ccgcatcttcggctcgaagatcgac

SEQ ID NO: 533644 - DNA, 25 bp, Rattus norvegicus
ctcgaagatcgaccaagcaggcctg

SEQ ID NO: 533645 - DNA, 25 bp, Rattus norvegicus
gaagatcgaccaagcaggcctgctg

SEQ ID NO: 533646 - DNA, 25 bp, Rattus norvegicus
atcgaccaagcaggcctgctggcgc

SEQ ID NO: 533647 - DNA, 25 bp, Rattus norvegicus
cgctgtgcggcgctccactgtttag

SEQ ID NO: 533648 - DNA, 25 bp, Rattus norvegicus
cgctccactgtttagcctggcggga

SEQ ID NO: 533649 - DNA, 25 bp, Rattus norvegicus
ggaaatcgtcctcgagccgctgcca

SEQ ID NO: 533650 - DNA, 25 bp, Rattus norvegicus
ccactgtttagcctggcgggaaatc

SEQ ID NO: 533651 - DNA, 25 bp, Rattus norvegicus
aagctggtctccgtttccgccctat

SEQ ID NO: 533652 - DNA, 25 bp, Rattus norvegicus
ccggataaggcggagccacagcttc

SEQ ID NO: 533653 - DNA, 25 bp, Rattus norvegicus
gccaccttgtctggcgcctgcgtgg

SEQ ID NO: 533654 - DNA, 25 bp, Rattus norvegicus
tctggcgcctgcgtggcccggataa

SEQ ID NO: 533655 - DNA, 25 bp, Rattus norvegicus
gggaagccgcacttacctagcggca

SEQ ID NO: 533656 - DNA, 25 bp, Rattus norvegicus
ggagccacagcttcctctgcaaagg

SEQ ID NO: 533657 - DNA, 25 bp, Rattus norvegicus
ttacctagcggcaacatggatgctg

SEQ ID NO: 533658 - DNA, 25 bp, Rattus norvegicus
cgcaacaggtcacttccgggaaggg

SEQ ID NO: 533659 - DNA, 25 bp, Rattus norvegicus
aagcagcgcgcgcaacaggtcactt

SEQ ID NO: 533660 - DNA, 25 bp, Rattus norvegicus
gctttcaattaactgttgaagcagc

SEQ ID NO: 533661 - DNA, 25 bp, Rattus norvegicus
ccgccctattgctttcaattaactg

SEQ ID NO: 533662 - DNA, 25 bp, Rattus norvegicus
tccgtttccgccctattgctttcaa

SEQ ID NO: 533663 - DNA, 25 bp, Rattus norvegicus
ccacagcttcctctgcaaagggagg

SEQ ID NO: 533664 - DNA, 25 bp, Rattus norvegicus
catggatgctgccagcgaaagcgaa

SEQ ID NO: 533665 - DNA, 25 bp, Rattus norvegicus
ccttctccgaggaatctggcatttc

SEQ ID NO: 533666 - DNA, 25 bp, Rattus norvegicus
cagagcacctgggtgccgcccatta

SEQ ID NO: 533667 - DNA, 25 bp, Rattus norvegicus
ctcggcttcggaggaatccgacatc

SEQ ID NO: 533668 - DNA, 25 bp, Rattus norvegicus
gcatctctgtgctgttctcggcttc

SEQ ID NO: 533669 - DNA, 25 bp, Rattus norvegicus
ctctaatggactgggcatcaacctg

SEQ ID NO: 533670 - DNA, 25 bp, Rattus norvegicus
ccgctagtaaggctccaagcacttc

SEQ ID NO: 533671 - DNA, 25 bp, Rattus norvegicus
cactatctcagaaggggcgagcatc

SEQ ID NO: 533672 - DNA, 25 bp, Rattus norvegicus
tgctcctaagggctcaaaggcctct

SEQ ID NO: 533673 - DNA, 25 bp, Rattus norvegicus
gggctgaacgctgctgcgtcaatca

SEQ ID NO: 533674 - DNA, 25 bp, Rattus norvegicus
ctggtaagccagaattcgcgccgcc

SEQ ID NO: 533675 - DNA, 25 bp, Rattus norvegicus
gggcctgtcagtgtcagcttcaaca

SEQ ID NO: 533676 - DNA, 25 bp, Rattus norvegicus
ccaatctcatgagggccctaacgtg

SEQ ID NO: 533677 - DNA, 25 bp, Rattus norvegicus
aaacctcgcgcccttgtctgtgaga

SEQ ID NO: 533678 - DNA, 25 bp, Rattus norvegicus
cggttccgtgcagaggcacctacaa

SEQ ID NO: 533679 - DNA, 25 bp, Rattus norvegicus
tgcaaggcttctcctcctctctggg

SEQ ID NO: 533680 - DNA, 25 bp, Rattus norvegicus
cccgccgctgagaagttctttggac

SEQ ID NO: 533681 - DNA, 25 bp, Rattus norvegicus
ggcgggcacccgaatcacttttatc

SEQ ID NO: 533682 - DNA, 25 bp, Rattus norvegicus
tgcctccttggactgggacctgcaa

SEQ ID NO: 533683 - DNA, 25 bp, Rattus norvegicus
atcacttttatcaagccgggacccg

SEQ ID NO: 533684 - DNA, 25 bp, Rattus norvegicus
tcctctctggggaacgtgcccttag

SEQ ID NO: 533685 - DNA, 25 bp, Rattus norvegicus
tttcctgaacgagcgcctgggccag

SEQ ID NO: 533686 - DNA, 25 bp, Rattus norvegicus
ttcgcccacctgaaggggatcctgc

SEQ ID NO: 533687 - DNA, 25 bp, Rattus norvegicus
gcacgggcttccaccttgaaatctt

SEQ ID NO: 533688 - DNA, 25 bp, Rattus norvegicus
accacagccgcttcggtgaggacgc

SEQ ID NO: 533689 - DNA, 25 bp, Rattus norvegicus
ctctgagagaccaacgtcgggcctc

SEQ ID NO: 533690 - DNA, 25 bp, Rattus norvegicus
agccttgaaggtggcagacccgtcg

SEQ ID NO: 533691 - DNA, 25 bp, Rattus norvegicus
gacccgtcggaactgatcgcccaga

SEQ ID NO: 533692 - DNA, 25 bp, Rattus norvegicus
tctttggacgcgaacagacgtgtgc

SEQ ID NO: 533693 - DNA, 25 bp, Rattus norvegicus
ccatgcctcgtggaacaaataaata

SEQ ID NO: 533694 - DNA, 25 bp, Rattus norvegicus
ggctcgccatgcctcgtggaacaaa

SEQ ID NO: 533695 - DNA, 25 bp, Rattus norvegicus
cgaaatgtgccccaaaccgccgtgg

SEQ ID NO: 533696 - DNA, 25 bp, Rattus norvegicus
ccggacttcactgaaaagtagtctg

SEQ ID NO: 533697 - DNA, 25 bp, Rattus norvegicus
cactgaaaagtagtctgcgctgttc

SEQ ID NO: 533698 - DNA, 25 bp, Rattus norvegicus
gtctgcgctgttctcagaaagcaca

SEQ ID NO: 533699 - DNA, 25 bp, Rattus norvegicus
tctcagaaagcacaagccggcatta

SEQ ID NO: 533700 - DNA, 25 bp, Rattus norvegicus
aagccggcattagccggccggtctc

SEQ ID NO: 533701 - DNA, 25 bp, Rattus norvegicus
ccgccctggaggataccctcaagga

SEQ ID NO: 533702 - DNA, 25 bp, Rattus norvegicus
aggataccctcaaggatctggagtc

SEQ ID NO: 533703 - DNA, 25 bp, Rattus norvegicus
tgatctaactacttcacgaaatgtg

SEQ ID NO: 533704 - DNA, 25 bp, Rattus norvegicus
agtcgagaaaaagataagacacctt

SEQ ID NO: 533705 - DNA, 25 bp, Rattus norvegicus
taagacaccttttccaggcaccttc

SEQ ID NO: 533706 - DNA, 25 bp, Rattus norvegicus
ccctcaaggatctggagtcgagaaa

SEQ ID NO: 533707 - DNA, 25 bp, Rattus norvegicus
acggggactcacctagacgaacagc

SEQ ID NO: 533708 - DNA, 25 bp, Rattus norvegicus
ctcggcggacaagctcaccatctgt

SEQ ID NO: 533709 - DNA, 25 bp, Rattus norvegicus
ctccaagttgttgctgccgagctcg

SEQ ID NO: 533710 - DNA, 25 bp, Rattus norvegicus
gctgactctcctacggccatcgatg

SEQ ID NO: 533711 - DNA, 25 bp, Rattus norvegicus
ctgcgtgagcaggactttgcactcc

SEQ ID NO: 533712 - DNA, 25 bp, Rattus norvegicus
tgcctctcggagagctgtcggtaca

SEQ ID NO: 533713 - DNA, 25 bp, Rattus norvegicus
cgccatcagctcgtcttgcgggata

SEQ ID NO: 533714 - DNA, 25 bp, Rattus norvegicus
ccgtgacacttcctgcacttaaagc

SEQ ID NO: 533715 - DNA, 25 bp, Rattus norvegicus
gcgctccaggcacagtttacaaaag

SEQ ID NO: 533716 - DNA, 25 bp, Rattus norvegicus
gccaccatgagtgcggagagcttga

SEQ ID NO: 533717 - DNA, 25 bp, Rattus norvegicus
agtaccacgttgactcgcagttgca

SEQ ID NO: 533718 - DNA, 25 bp, Rattus norvegicus
ttgcccaggagaccgctgagtacca

SEQ ID NO: 533719 - DNA, 25 bp, Rattus norvegicus
cgaacagcctcgttgtacttgagca

SEQ ID NO: 533720 - DNA, 25 bp, Rattus norvegicus
ctgtgcggtctgaagggaatccatt

SEQ ID NO: 533721 - DNA, 25 bp, Rattus norvegicus
gtggacgagcagtaccacgccctgc

SEQ ID NO: 533722 - DNA, 25 bp, Rattus norvegicus
ctgctggaaaaatacgaggagcttc

SEQ ID NO: 533723 - DNA, 25 bp, Rattus norvegicus
cgcaggcgcggtatgtctatcctga

SEQ ID NO: 533724 - DNA, 25 bp, Rattus norvegicus
actttgcatgccaacagtgtgcgca

SEQ ID NO: 533725 - DNA, 25 bp, Rattus norvegicus
ggcacgctggcaacctcactttgca

SEQ ID NO: 533726 - DNA, 25 bp, Rattus norvegicus
tgccatagtggccaaagacccagcc

SEQ ID NO: 533727 - DNA, 25 bp, Rattus norvegicus
agctgcagcgacacggcactcaatg

SEQ ID NO: 533728 - DNA, 25 bp, Rattus norvegicus
tacactctggtgctgcaggagtaca

SEQ ID NO: 533729 - DNA, 25 bp, Rattus norvegicus
agcgggcagaacgtgagtacactct

SEQ ID NO: 533730 - DNA, 25 bp, Rattus norvegicus
tgctccgttcccaggtgagccagga

SEQ ID NO: 533731 - DNA, 25 bp, Rattus norvegicus
acgaacgactgcagactttggttgg

SEQ ID NO: 533732 - DNA, 25 bp, Rattus norvegicus
ctacacagttcctcgctggagctgg

SEQ ID NO: 533733 - DNA, 25 bp, Rattus norvegicus
caagacctacctgctggcccgggat

SEQ ID NO: 533734 - DNA, 25 bp, Rattus norvegicus
cttctgagcaagtgccggcagcatg

SEQ ID NO: 533735 - DNA, 25 bp, Rattus norvegicus
ttccaacagcaaacgaagggtcagc

SEQ ID NO: 533736 - DNA, 25 bp, Rattus norvegicus
tcgcggttaccgctcgacttgtgct

SEQ ID NO: 533737 - DNA, 25 bp, Rattus norvegicus
cgctatgaactaggggacatggtgc

SEQ ID NO: 533738 - DNA, 25 bp, Rattus norvegicus
gacatggtgcacttccgttcccgac

SEQ ID NO: 533739 - DNA, 25 bp, Rattus norvegicus
taaccgccggtagaaccactgcctg

SEQ ID NO: 533740 - DNA, 25 bp, Rattus norvegicus
ggagaagcctcgaaagtacgcgctc

SEQ ID NO: 533741 - DNA, 25 bp, Rattus norvegicus
gcctcggtctgagatgcccttccaa

SEQ ID NO: 533742 - DNA, 25 bp, Rattus norvegicus
ctcaggaagcagcagagcaacactt

SEQ ID NO: 533743 - DNA, 25 bp, Rattus norvegicus
cgcagctgcgtccagatcagccata

SEQ ID NO: 533744 - DNA, 25 bp, Rattus norvegicus
gcctgcaaaccagcgcagacactta

SEQ ID NO: 533745 - DNA, 25 bp, Rattus norvegicus
acttaccaaaccatgccgtaggcgc

SEQ ID NO: 533746 - DNA, 25 bp, Rattus norvegicus
taggcgccttctccgatgtacgaga

SEQ ID NO: 533747 - DNA, 25 bp, Rattus norvegicus
acgagagattagtgtagcgcggccc

SEQ ID NO: 533748 - DNA, 25 bp, Rattus norvegicus
gctcgagaccaagcccgggagtctt

SEQ ID NO: 533749 - DNA, 25 bp, Rattus norvegicus
tgctggatcgtcctcacagctcaga

SEQ ID NO: 533750 - DNA, 25 bp, Rattus norvegicus
tgacaagggcttgcgttttacctca

SEQ ID NO: 533751 - DNA, 25 bp, Rattus norvegicus
ttacctcatgggctcagcggtcatg

SEQ ID NO: 533752 - DNA, 25 bp, Rattus norvegicus
cagcggtcatgtttttggctcggac

SEQ ID NO: 533753 - DNA, 25 bp, Rattus norvegicus
ttgggtaccgttctgcgctcctcag

SEQ ID NO: 533754 - DNA, 25 bp, Rattus norvegicus
agcgcccgtggctgaacgaaaagta

SEQ ID NO: 533755 - DNA, 25 bp, Rattus norvegicus
aaacgatgctgctgaccgcgaagcc

SEQ ID NO: 533756 - DNA, 25 bp, Rattus norvegicus
gggatcttagtagtcactgcagctg

SEQ ID NO: 533757 - DNA, 25 bp, Rattus norvegicus
gggcacctagcgcacgtctttgcaa

SEQ ID NO: 533758 - DNA, 25 bp, Rattus norvegicus
tgctgccagagccacggagacaaag

SEQ ID NO: 533759 - DNA, 25 bp, Rattus norvegicus
aggccgacgccgacgccattttgtt

SEQ ID NO: 533760 - DNA, 25 bp, Rattus norvegicus
acgccattttgttgggccgaggctc

SEQ ID NO: 533761 - DNA, 25 bp, Rattus norvegicus
ctcacctagagggaaaacgatgctg

SEQ ID NO: 533762 - DNA, 25 bp, Rattus norvegicus
tggctgaacgaaaagtactgggatc

SEQ ID NO: 533763 - DNA, 25 bp, Rattus norvegicus
gaatccaagtcacgcccagcacaga

SEQ ID NO: 533764 - DNA, 25 bp, Rattus norvegicus
agttgagaaagtccctgccgctggc

SEQ ID NO: 533765 - DNA, 25 bp, Rattus norvegicus
ctccttctttctttgggcagaggcc

SEQ ID NO: 533766 - DNA, 25 bp, Rattus norvegicus
ccgaaggaaccttggaaacgagcag

SEQ ID NO: 533767 - DNA, 25 bp, Rattus norvegicus
aggccatgttcgcttgtctctctcg

SEQ ID NO: 533768 - DNA, 25 bp, Rattus norvegicus
gaccgggcgaaactttcttccagca

SEQ ID NO: 533769 - DNA, 25 bp, Rattus norvegicus
tttcttccagcacggtccgagggtg

SEQ ID NO: 533770 - DNA, 25 bp, Rattus norvegicus
cgcttattacgtcacacgcagcaga

SEQ ID NO: 533771 - DNA, 25 bp, Rattus norvegicus
cagacgcccgcttaaaagaaccagt

SEQ ID NO: 533772 - DNA, 25 bp, Rattus norvegicus
cagttcttttccgattggtttctgg

SEQ ID NO: 533773 - DNA, 25 bp, Rattus norvegicus
ggagttttcttattggtccgctgaa

SEQ ID NO: 533774 - DNA, 25 bp, Rattus norvegicus
tggtccgctgaaaagactgcaccgc

SEQ ID NO: 533775 - DNA, 25 bp, Rattus norvegicus
cctttcgtgcgcgtagagatatagc

SEQ ID NO: 533776 - DNA, 25 bp, Rattus norvegicus
tagcgctcagcgaactttcaataca

SEQ ID NO: 533777 - DNA, 25 bp, Rattus norvegicus
gtgagtcccacagcggcttccgatc

SEQ ID NO: 533778 - DNA, 25 bp, Rattus norvegicus
tggaatcctaggtgagtcccacagc

SEQ ID NO: 533779 - DNA, 25 bp, Rattus norvegicus
ccagccctggaatcctaggtgagtc

SEQ ID NO: 533780 - DNA, 25 bp, Rattus norvegicus
tggttgatcgctgccgccctacgga

SEQ ID NO: 533781 - DNA, 25 bp, Rattus norvegicus
ctgcgtgctggttgatcgctgccgc

SEQ ID NO: 533782 - DNA, 25 bp, Rattus norvegicus
ttctctgtgtgcgatcgcggaggct

SEQ ID NO: 533783 - DNA, 25 bp, Rattus norvegicus
actcttctctgtgtgcgatcgcgga

SEQ ID NO: 533784 - DNA, 25 bp, Rattus norvegicus
cctagactcttctctgtgtgcgatc

SEQ ID NO: 533785 - DNA, 25 bp, Rattus norvegicus
gcctgcgcctagactcttctctgtg

SEQ ID NO: 533786 - DNA, 25 bp, Rattus norvegicus
cgggccctggcatcacccggaagtg

SEQ ID NO: 533787 - DNA, 25 bp, Rattus norvegicus
tggaccatttccctagtcggcccag

SEQ ID NO: 533788 - DNA, 25 bp, Rattus norvegicus
tcacgtgacgtggaccatttcccta

SEQ ID NO: 533789 - DNA, 25 bp, Rattus norvegicus
cgcgctccctttcacgtgacgtgga

SEQ ID NO: 533790 - DNA, 25 bp, Rattus norvegicus
tttgggcgcgcgctccctttcacgt

SEQ ID NO: 533791 - DNA, 25 bp, Rattus norvegicus
gcttcaaaagcgcacgtctgctgca

SEQ ID NO: 533792 - DNA, 25 bp, Rattus norvegicus
gtctgctgcagtgttctcctcttcc

SEQ ID NO: 533793 - DNA, 25 bp, Rattus norvegicus
gagcaatggaatcgggcaggccttt

SEQ ID NO: 533794 - DNA, 25 bp, Rattus norvegicus
cagatggacagcaccgccgagcaat

SEQ ID NO: 533795 - DNA, 25 bp, Rattus norvegicus
cccactagtctcgtgcagatggaca

SEQ ID NO: 533796 - DNA, 25 bp, Rattus norvegicus
atgaaagtcgcacgtcccactagtc

SEQ ID NO: 533797 - DNA, 25 bp, Rattus norvegicus
ctcgcgtcgtgctggacgtgacaaa

SEQ ID NO: 533798 - DNA, 25 bp, Rattus norvegicus
tcaggaagtttctgcagctcgcgtc

SEQ ID NO: 533799 - DNA, 25 bp, Rattus norvegicus
agtccggagcatgcgctttagcagc

SEQ ID NO: 533800 - DNA, 25 bp, Rattus norvegicus
ggcgcttttcccaaggcagtccgga

SEQ ID NO: 533801 - DNA, 25 bp, Rattus norvegicus
agctttgctgcttcgctttctggaa

SEQ ID NO: 533802 - DNA, 25 bp, Rattus norvegicus
tggggcagcgaccaatagcagcttt

SEQ ID NO: 533803 - DNA, 25 bp, Rattus norvegicus
ggtgttgccaaaatgtcgctttcta

SEQ ID NO: 533804 - DNA, 25 bp, Rattus norvegicus
ctctcgacctcacggtgttgccaaa

SEQ ID NO: 533805 - DNA, 25 bp, Rattus norvegicus
acgccaggcgctcggtctggcctgt

SEQ ID NO: 533806 - DNA, 25 bp, Rattus norvegicus
ggccacgtcgcccagctgcaaacag

SEQ ID NO: 533807 - DNA, 25 bp, Rattus norvegicus
gttccaatgccatcgagtgcgcctg

SEQ ID NO: 533808 - DNA, 25 bp, Rattus norvegicus
ttaccaaggcatccctcggagcgtt

SEQ ID NO: 533809 - DNA, 25 bp, Rattus norvegicus
ggcatccctcggagcgttcttgaga

SEQ ID NO: 533810 - DNA, 25 bp, Rattus norvegicus
cttgagaggcgccatcttgctgggc

SEQ ID NO: 533811 - DNA, 25 bp, Rattus norvegicus
cttcaaccgccgagatagagctgca

SEQ ID NO: 533812 - DNA, 25 bp, Rattus norvegicus
catcttgctgggctccattttctct

SEQ ID NO: 533813 - DNA, 25 bp, Rattus norvegicus
tccattttctctaccggctcttcaa

SEQ ID NO: 533814 - DNA, 25 bp, Rattus norvegicus
gtctggcctgtctcgcaggttccaa

SEQ ID NO: 533815 - DNA, 25 bp, Rattus norvegicus
ccggctcttcaaccgccgagataga

SEQ ID NO: 533816 - DNA, 25 bp, Rattus norvegicus
tgtctcgcaggttccaatgccatcg

SEQ ID NO: 533817 - DNA, 25 bp, Rattus norvegicus
agatagagctgcaggcggtttccac

SEQ ID NO: 533818 - DNA, 25 bp, Rattus norvegicus
ggagcgttcttgagaggcgccatct

SEQ ID NO: 533819 - DNA, 25 bp, Rattus norvegicus
tcagcattctccgacgcctcagcaa

SEQ ID NO: 533820 - DNA, 25 bp, Rattus norvegicus
ctcagcaacctctgacgcctcaaca

SEQ ID NO: 533821 - DNA, 25 bp, Rattus norvegicus
gcctcaacaatctgcgatgcctcaa

SEQ ID NO: 533822 - DNA, 25 bp, Rattus norvegicus
tctgcgatgcctcaacaatctccga

SEQ ID NO: 533823 - DNA, 25 bp, Rattus norvegicus
tcgacaatctgggacgccgcaacca

SEQ ID NO: 533824 - DNA, 25 bp, Rattus norvegicus
gcaaccacctccgacgcctcagcga

SEQ ID NO: 533825 - DNA, 25 bp, Rattus norvegicus
tgcaacacctcagcaatctccgaag

SEQ ID NO: 533826 - DNA, 25 bp, Rattus norvegicus
gcgacacctcaacgacctgcgacat

SEQ ID NO: 533827 - DNA, 25 bp, Rattus norvegicus
tccgacgcctcaatgacctgtgacg

SEQ ID NO: 533828 - DNA, 25 bp, Rattus norvegicus
gcctcaatgacctgtgacgcctcaa

SEQ ID NO: 533829 - DNA, 25 bp, Rattus norvegicus
aatgacctgtgacgcctcaacaacc

SEQ ID NO: 533830 - DNA, 25 bp, Rattus norvegicus
cggacgcctcagcaacctcggaggc

SEQ ID NO: 533831 - DNA, 25 bp, Rattus norvegicus
ctcggaggcctcagccacctcggac

SEQ ID NO: 533832 - DNA, 25 bp, Rattus norvegicus
aacgatctctgactcctcagcattc

SEQ ID NO: 533833 - DNA, 25 bp, Rattus norvegicus
ggcatcccaccagacttctagttct

SEQ ID NO: 533834 - DNA, 25 bp, Rattus norvegicus
ccaaaaggtcaagctcctgggcgtg

SEQ ID NO: 533835 - DNA, 25 bp, Rattus norvegicus
cttgaccgacggaaaggatactctc

SEQ ID NO: 533836 - DNA, 25 bp, Rattus norvegicus
aggatactctccatgttcgacatga

SEQ ID NO: 533837 - DNA, 25 bp, Rattus norvegicus
gacatgatctctccagttcaccggg

SEQ ID NO: 533838 - DNA, 25 bp, Rattus norvegicus
ctcggacgcgcagaagatagcagtt

SEQ ID NO: 533839 - DNA, 25 bp, Rattus norvegicus
gtttcgagggatcctagcccacttc

SEQ ID NO: 533840 - DNA, 25 bp, Rattus norvegicus
ctagcccacttcctgtttcggtttg

SEQ ID NO: 533841 - DNA, 25 bp, Rattus norvegicus
gacgacgctaacatggctgcagtga

SEQ ID NO: 533842 - DNA, 25 bp, Rattus norvegicus
agtccgagaactgaagcttaggtcc

SEQ ID NO: 533843 - DNA, 25 bp, Rattus norvegicus
agatgcttcacgtgcgctcaggata

SEQ ID NO: 533844 - DNA, 25 bp, Rattus norvegicus
gataactgcgctcaacctggtccgg

SEQ ID NO: 533845 - DNA, 25 bp, Rattus norvegicus
tttgtcaacccggacgccgcttagc

SEQ ID NO: 533846 - DNA, 25 bp, Rattus norvegicus
caaggcccgggtagcaccttgaccg

SEQ ID NO: 533847 - DNA, 25 bp, Rattus norvegicus
cgttcttctgccgaggtcaggtggt

SEQ ID NO: 533848 - DNA, 25 bp, Rattus norvegicus
ggagtgccgcactcacggcggctcc

SEQ ID NO: 533849 - DNA, 25 bp, Rattus norvegicus
actcacggcggctccgtcgcaggca

SEQ ID NO: 533850 - DNA, 25 bp, Rattus norvegicus
cggcggctccgtcgcaggcacggag

SEQ ID NO: 533851 - DNA, 25 bp, Rattus norvegicus
aggtcagcgtcatgaggagcctgcc

SEQ ID NO: 533852 - DNA, 25 bp, Rattus norvegicus
ggagcctgccgttcttctgccgagg

SEQ ID NO: 533853 - DNA, 25 bp, Rattus norvegicus
gagcctgccgttcttctgccgaggt

SEQ ID NO: 533854 - DNA, 25 bp, Rattus norvegicus
agcctgccgttcttctgccgaggtc

SEQ ID NO: 533855 - DNA, 25 bp, Rattus norvegicus
gcctgccgttcttctgccgaggtca

SEQ ID NO: 533856 - DNA, 25 bp, Rattus norvegicus
cctgccgttcttctgccgaggtcag

SEQ ID NO: 533857 - DNA, 25 bp, Rattus norvegicus
tgccgttcttctgccgaggtcaggt

SEQ ID NO: 533858 - DNA, 25 bp, Rattus norvegicus
ttcttctgccgaggtcaggtggtgc

SEQ ID NO: 533859 - DNA, 25 bp, Rattus norvegicus
agctcctgcggaatccccggctggt

SEQ ID NO: 533860 - DNA, 25 bp, Rattus norvegicus
tcaggtggtgcgtggcttcggccgc

SEQ ID NO: 533861 - DNA, 25 bp, Rattus norvegicus
actcttcgtcccagtttcggtctct

SEQ ID NO: 533862 - DNA, 25 bp, Rattus norvegicus
gctacccaccggcttcgatctgggt

SEQ ID NO: 533863 - DNA, 25 bp, Rattus norvegicus
acccaccggcttcgatctgggtagg

SEQ ID NO: 533864 - DNA, 25 bp, Rattus norvegicus
caccggcttcgatctgggtaggtgc

SEQ ID NO: 533865 - DNA, 25 bp, Rattus norvegicus
ggtctctctcggattcatcgcatca

SEQ ID NO: 533866 - DNA, 25 bp, Rattus norvegicus
cttcgatctgggtaggtgccgccgc

SEQ ID NO: 533867 - DNA, 25 bp, Rattus norvegicus
atctgggtaggtgccgccgccatcc

SEQ ID NO: 533868 - DNA, 25 bp, Rattus norvegicus
ttcgtcccagtttcggtctctctcg

SEQ ID NO: 533869 - DNA, 25 bp, Rattus norvegicus
ttcggtctctctcggattcatcgca

SEQ ID NO: 533870 - DNA, 25 bp, Rattus norvegicus
ggcgctgcctctattgtggtgaagc

SEQ ID NO: 533871 - DNA, 25 bp, Rattus norvegicus
cgctgcctctattgtggtgaagccc

SEQ ID NO: 533872 - DNA, 25 bp, Rattus norvegicus
cctctattgtggtgaagcccccatg

SEQ ID NO: 533873 - DNA, 25 bp, Rattus norvegicus
atgcttgggagtcccgccgcttccg

SEQ ID NO: 533874 - DNA, 25 bp, Rattus norvegicus
tctcggattcatcgcatcacgtttc

SEQ ID NO: 533875 - DNA, 25 bp, Rattus norvegicus
gcgagcgactgagttttcaatgaac

SEQ ID NO: 533876 - DNA, 25 bp, Rattus norvegicus
tgccggagtccacgcacttagcaga

SEQ ID NO: 533877 - DNA, 25 bp, Rattus norvegicus
tgactgcctctagggtgccggagtc

SEQ ID NO: 533878 - DNA, 25 bp, Rattus norvegicus
tgccggctttgactgcctctagggt

SEQ ID NO: 533879 - DNA, 25 bp, Rattus norvegicus
gaagccctcgtacgctgccggcttt

SEQ ID NO: 533880 - DNA, 25 bp, Rattus norvegicus
gcgtggcccgcgaacttgcccgaag

SEQ ID NO: 533881 - DNA, 25 bp, Rattus norvegicus
aatggttacccgaagtgggagccag

SEQ ID NO: 533882 - DNA, 25 bp, Rattus norvegicus
actacgtgaatggttacccgaagtg

SEQ ID NO: 533883 - DNA, 25 bp, Rattus norvegicus
cgccaagacgcaaccaaactacgtg

SEQ ID NO: 533884 - DNA, 25 bp, Rattus norvegicus
tggcaacattaaacacgccaagacg

SEQ ID NO: 533885 - DNA, 25 bp, Rattus norvegicus
aaatctctcgttattggcaacatta

SEQ ID NO: 533886 - DNA, 25 bp, Rattus norvegicus
tgcagcacgatatgtactcgcgtcc

SEQ ID NO: 533887 - DNA, 25 bp, Rattus norvegicus
tcaatgaactaattgcagcacgata

SEQ ID NO: 533888 - DNA, 25 bp, Rattus norvegicus
ttagcagacgcctagtgctccaacg

SEQ ID NO: 533889 - DNA, 25 bp, Rattus norvegicus
tccgcgcaagcgcagtcggacctcg

SEQ ID NO: 533890 - DNA, 25 bp, Rattus norvegicus
cccacgagctgctttgggccaaccc

SEQ ID NO: 533891 - DNA, 25 bp, Rattus norvegicus
cacctgccagcctgccgcaatgctc

SEQ ID NO: 533892 - DNA, 25 bp, Rattus norvegicus
ttaccctcgttcttcatctccagcg

SEQ ID NO: 533893 - DNA, 25 bp, Rattus norvegicus
caccctagtccgagtcttccaccct

SEQ ID NO: 533894 - DNA, 25 bp, Rattus norvegicus
tgccctcttgtttcggggaagacga

SEQ ID NO: 533895 - DNA, 25 bp, Rattus norvegicus
tcgtgcacctcaggcccgcacatga

SEQ ID NO: 533896 - DNA, 25 bp, Rattus norvegicus
tggcggtctctctgccctcttgttt

SEQ ID NO: 533897 - DNA, 25 bp, Rattus norvegicus
cgaaacccgtcttggccttagtgct

SEQ ID NO: 533898 - DNA, 25 bp, Rattus norvegicus
tcctttcgctctcgtgcacctcagg

SEQ ID NO: 533899 - DNA, 25 bp, Rattus norvegicus
atttcgtcctcagtctcctttcgct

SEQ ID NO: 533900 - DNA, 25 bp, Rattus norvegicus
cttagtgctttctcacctctccatt

SEQ ID NO: 533901 - DNA, 25 bp, Rattus norvegicus
ccgtcttggccttagtgctttctca

SEQ ID NO: 533902 - DNA, 25 bp, Rattus norvegicus
tggccttagtgctttctcacctctc

SEQ ID NO: 533903 - DNA, 25 bp, Rattus norvegicus
atccaacgggatccgggagactcaa

SEQ ID NO: 533904 - DNA, 25 bp, Rattus norvegicus
cacgaaaagctaagactagcgactt

SEQ ID NO: 533905 - DNA, 25 bp, Rattus norvegicus
gactagcgacttagcacagggcatc

SEQ ID NO: 533906 - DNA, 25 bp, Rattus norvegicus
ttagcacagggcatcgaacggacga

SEQ ID NO: 533907 - DNA, 25 bp, Rattus norvegicus
gggcatcgaacggacgaccacctca

SEQ ID NO: 533908 - DNA, 25 bp, Rattus norvegicus
gcgcaccctggccacagagatcgaa

SEQ ID NO: 533909 - DNA, 25 bp, Rattus norvegicus
agagatcgaactcctggcgtcccgc

SEQ ID NO: 533910 - DNA, 25 bp, Rattus norvegicus
ggggtcacactcacctgtggccagg

SEQ ID NO: 533911 - DNA, 25 bp, Rattus norvegicus
cacctgtggccagggcaacttggtc

SEQ ID NO: 533912 - DNA, 25 bp, Rattus norvegicus
caacttggtccagggaggcggcaaa

SEQ ID NO: 533913 - DNA, 25 bp, Rattus norvegicus
aggcggcaaaaagcagcagcaccaa

SEQ ID NO: 533914 - DNA, 25 bp, Rattus norvegicus
ggggcttccaccgagcgacacctgg

SEQ ID NO: 533915 - DNA, 25 bp, Rattus norvegicus
ccgggagactcaacacgaaaagcta

SEQ ID NO: 533916 - DNA, 25 bp, Rattus norvegicus
caggtccctcaaatccaacgggatc

SEQ ID NO: 533917 - DNA, 25 bp, Rattus norvegicus
ccagacgtcacttcctattttttat

SEQ ID NO: 533918 - DNA, 25 bp, Rattus norvegicus
tatggccgcggggtgacacccgctc

SEQ ID NO: 533919 - DNA, 25 bp, Rattus norvegicus
gtccggcgggtgatatgactaccca

SEQ ID NO: 533920 - DNA, 25 bp, Rattus norvegicus
gtgatatgactacccagagcgcagc

SEQ ID NO: 533921 - DNA, 25 bp, Rattus norvegicus
tgactacccagagcgcagcgggaga

SEQ ID NO: 533922 - DNA, 25 bp, Rattus norvegicus
ccagggccagcagtggattggtccc

SEQ ID NO: 533923 - DNA, 25 bp, Rattus norvegicus
ccagcagtggattggtcccgagctc

SEQ ID NO: 533924 - DNA, 25 bp, Rattus norvegicus
attggtcccgagctcggtcggcttc

SEQ ID NO: 533925 - DNA, 25 bp, Rattus norvegicus
cgggcccagacgtcacttcctattt

SEQ ID NO: 533926 - DNA, 25 bp, Rattus norvegicus
tcctattttttatctcttctggaaa

SEQ ID NO: 533927 - DNA, 25 bp, Rattus norvegicus
aaaaactagagcgttcagtgaaggc

SEQ ID NO: 533928 - DNA, 25 bp, Rattus norvegicus
ctagagcgttcagtgaaggcgagac

SEQ ID NO: 533929 - DNA, 25 bp, Rattus norvegicus
ctcttctggtttccctagcgctccg

SEQ ID NO: 533930 - DNA, 25 bp, Rattus norvegicus
agctcggtcggcttcgggcccagac

SEQ ID NO: 533931 - DNA, 25 bp, Rattus norvegicus
tccatttcttcgtcccagggatcct

SEQ ID NO: 533932 - DNA, 25 bp, Rattus norvegicus
actaacctcgctactgctcgtgctg

SEQ ID NO: 533933 - DNA, 25 bp, Rattus norvegicus
cagggatcctccacaggagcgaatg

SEQ ID NO: 533934 - DNA, 25 bp, Rattus norvegicus
agcgaatggtagcatcgccgcttca

SEQ ID NO: 533935 - DNA, 25 bp, Rattus norvegicus
cgccgcttcaggaacactcgaaaag

SEQ ID NO: 533936 - DNA, 25 bp, Rattus norvegicus
acactcgaaaagaagctgcttgtcc

SEQ ID NO: 533937 - DNA, 25 bp, Rattus norvegicus
agctggctcgtggtcttcttcgtag

SEQ ID NO: 533938 - DNA, 25 bp, Rattus norvegicus
ttcttcgtaggaccaggactcgcgc

SEQ ID NO: 533939 - DNA, 25 bp, Rattus norvegicus
ctgggtgactgctgacctcgccaaa

SEQ ID NO: 533940 - DNA, 25 bp, Rattus norvegicus
ctggggtgcagaaagagaagacaaa

SEQ ID NO: 533941 - DNA, 25 bp, Rattus norvegicus
gccatatgcggctgccgccgcgtta

SEQ ID NO: 533942 - DNA, 25 bp, Rattus norvegicus
gtcacccgcacgtcaatggaggttc

SEQ ID NO: 533943 - DNA, 25 bp, Rattus norvegicus
gcgaacagtagtaaagcccacagct

SEQ ID NO: 533944 - DNA, 25 bp, Rattus norvegicus
ggctgcagacttgtagccggtcccg

SEQ ID NO: 533945 - DNA, 25 bp, Rattus norvegicus
ttctcatcatgatcgtgacgtcaca

SEQ ID NO: 533946 - DNA, 25 bp, Rattus norvegicus
caatgggagcccgagatcagctccg

SEQ ID NO: 533947 - DNA, 25 bp, Rattus norvegicus
cgtgacgtcacaaaagacagcggcc

SEQ ID NO: 533948 - DNA, 25 bp, Rattus norvegicus
gcgtgtccgatcatcaattctcatc

SEQ ID NO: 533949 - DNA, 25 bp, Rattus norvegicus
acaatgaaatcagcgtgtccgatca

SEQ ID NO: 533950 - DNA, 25 bp, Rattus norvegicus
cactgccgcctcagacaatgaaatc

SEQ ID NO: 533951 - DNA, 25 bp, Rattus norvegicus
ttttttcctgggtctccactgccgc

SEQ ID NO: 533952 - DNA, 25 bp, Rattus norvegicus
gcggaatccgcgagattttttcctg

SEQ ID NO: 533953 - DNA, 25 bp, Rattus norvegicus
actagggccagatcaggcggaatcc

SEQ ID NO: 533954 - DNA, 25 bp, Rattus norvegicus
tccaagatgagactagggccagatc

SEQ ID NO: 533955 - DNA, 25 bp, Rattus norvegicus
tcagaggatccaagatgagactagg

SEQ ID NO: 533956 - DNA, 25 bp, Rattus norvegicus
cggtcacggaagagatcagaggatc

SEQ ID NO: 533957 - DNA, 25 bp, Rattus norvegicus
cttacctcgggcgtggtgcggtcac

SEQ ID NO: 533958 - DNA, 25 bp, Rattus norvegicus
tcacaaaagacagcggccaatggga

SEQ ID NO: 533959 - DNA, 25 bp, Rattus norvegicus
agagtcagaggaccaacctggcgcc

SEQ ID NO: 533960 - DNA, 25 bp, Rattus norvegicus
cctcccgaactgtcggaaaagctga

SEQ ID NO: 533961 - DNA, 25 bp, Rattus norvegicus
cgcctgagggaatctcacgacaata

SEQ ID NO: 533962 - DNA, 25 bp, Rattus norvegicus
aaacctccgcttgccgtcgacgtga

SEQ ID NO: 533963 - DNA, 25 bp, Rattus norvegicus
tcaagactctttcgcagctccagtc

SEQ ID NO: 533964 - DNA, 25 bp, Rattus norvegicus
tgaagccagcggaggaagaaaactt

SEQ ID NO: 533965 - DNA, 25 bp, Rattus norvegicus
gaggagcctgccttcaaagtttgcc

SEQ ID NO: 533966 - DNA, 25 bp, Rattus norvegicus
tggccgtgctcacagtcaactgccg

SEQ ID NO: 533967 - DNA, 25 bp, Rattus norvegicus
gcttttcctcagagggcgaactgca

SEQ ID NO: 533968 - DNA, 25 bp, Rattus norvegicus
agcccgcgaggtggcttttcctcag

SEQ ID NO: 533969 - DNA, 25 bp, Rattus norvegicus
cgacgtcaaggcagtgtccctgtca

SEQ ID NO: 533970 - DNA, 25 bp, Rattus norvegicus
tcttcacgcccgctggaagcgcgaa

SEQ ID NO: 533971 - DNA, 25 bp, Rattus norvegicus
agtcctcagccgaagttccgccttg

SEQ ID NO: 533972 - DNA, 25 bp, Rattus norvegicus
ttaagtcgaaagcaacaggtggccc

SEQ ID NO: 533973 - DNA, 25 bp, Rattus norvegicus
agctgcggaacctcggaatcccgaa

SEQ ID NO: 533974 - DNA, 25 bp, Rattus norvegicus
cggtgacaggtaaggagactcctga

SEQ ID NO: 533975 - DNA, 25 bp, Rattus norvegicus
tagcgtgacgtaatgcaacctcagc

SEQ ID NO: 533976 - DNA, 25 bp, Rattus norvegicus
cctcagcatgtaggagcgctataaa

SEQ ID NO: 533977 - DNA, 25 bp, Rattus norvegicus
cctctcagacgcagagtagctcgtg

SEQ ID NO: 533978 - DNA, 25 bp, Rattus norvegicus
ctcgtgattggctcgagctgcggaa

SEQ ID NO: 533979 - DNA, 25 bp, Rattus norvegicus
gccggctcccatgtacagcggggct

SEQ ID NO: 533980 - DNA, 25 bp, Rattus norvegicus
aagctagagccgtcgttgtggccgt

SEQ ID NO: 533981 - DNA, 25 bp, Rattus norvegicus
ccacgctcagcgtgtctcggtgagg

SEQ ID NO: 533982 - DNA, 25 bp, Rattus norvegicus
agtgagggtctcctcctcagtcagc

SEQ ID NO: 533983 - DNA, 25 bp, Rattus norvegicus
accattttgcttggtggccggctcc

SEQ ID NO: 533984 - DNA, 25 bp, Rattus norvegicus
cggcaacagtcgcttcagtcttatc

SEQ ID NO: 533985 - DNA, 25 bp, Rattus norvegicus
ttcagtcttatcaccaccattttgc

SEQ ID NO: 533986 - DNA, 25 bp, Rattus norvegicus
ggaacaatggaagtggcgtctagtc

SEQ ID NO: 533987 - DNA, 25 bp, Rattus norvegicus
tctcgtgcctggagccataggacaa

SEQ ID NO: 533988 - DNA, 25 bp, Rattus norvegicus
cgtgcctggagccataggacaagat

SEQ ID NO: 533989 - DNA, 25 bp, Rattus norvegicus
cagtgcccagatctcttgttcgttc

SEQ ID NO: 533990 - DNA, 25 bp, Rattus norvegicus
atctggggtgatacggttttggtat

SEQ ID NO: 533991 - DNA, 25 bp, Rattus norvegicus
gcgcgcccttgcagtggtgccgcat

SEQ ID NO: 533992 - DNA, 25 bp, Rattus norvegicus
ctgtaagctctgaggtggctaggga

SEQ ID NO: 533993 - DNA, 25 bp, Rattus norvegicus
agtgcccagatctcttgttcgttca

SEQ ID NO: 533994 - DNA, 25 bp, Rattus norvegicus
ctcgggcctgggctgtaagctctga

SEQ ID NO: 533995 - DNA, 25 bp, Rattus norvegicus
ccttgcagtggtgccgcatgggaca

SEQ ID NO: 533996 - DNA, 25 bp, Rattus norvegicus
atggcgctcgcaagatgaccgcgta

SEQ ID NO: 533997 - DNA, 25 bp, Rattus norvegicus
acgaatctggggtgatacggttttg

SEQ ID NO: 533998 - DNA, 25 bp, Rattus norvegicus
aggttctctcgtgcctggagccata

SEQ ID NO: 533999 - DNA, 25 bp, Rattus norvegicus
ctcgcaagatgaccgcgtaggcgct

SEQ ID NO: 534000 - DNA, 25 bp, Rattus norvegicus
ttctctcgtgcctggagccatagga

SEQ ID NO: 534001 - DNA, 25 bp, Rattus norvegicus
gcttcagacttgagaacagttcaga

SEQ ID NO: 534002 - DNA, 25 bp, Rattus norvegicus
gtgatctctgcaacttccaccagcg

SEQ ID NO: 534003 - DNA, 25 bp, Rattus norvegicus
gcacctccggtgatctctgcaactt

SEQ ID NO: 534004 - DNA, 25 bp, Rattus norvegicus
tggctgtctccgcacctccggtgat

SEQ ID NO: 534005 - DNA, 25 bp, Rattus norvegicus
cagagtgaccatggctgtctccgca

SEQ ID NO: 534006 - DNA, 25 bp, Rattus norvegicus
ctaagcttgagacagagtgaccatg

SEQ ID NO: 534007 - DNA, 25 bp, Rattus norvegicus
cgagagctctaagagctaagcttga

SEQ ID NO: 534008 - DNA, 25 bp, Rattus norvegicus
cagggcgagaaagcgagagctctaa

SEQ ID NO: 534009 - DNA, 25 bp, Rattus norvegicus
cctataggagtcagggcgagaaagc

SEQ ID NO: 534010 - DNA, 25 bp, Rattus norvegicus
agtgcaaggggacctataggagtca

SEQ ID NO: 534011 - DNA, 25 bp, Rattus norvegicus
tcagagagtcagaacgtgcccgaaa

SEQ ID NO: 534012 - DNA, 25 bp, Rattus norvegicus
gagccagtgcgcttcagacttgaga

SEQ ID NO: 534013 - DNA, 25 bp, Rattus norvegicus
gccattctgcgcgttcgggcgctga

SEQ ID NO: 534014 - DNA, 25 bp, Rattus norvegicus
gaacgtgcccgaaaaagagagagag

SEQ ID NO: 534015 - DNA, 25 bp, Rattus norvegicus
agctgtggcggtagatcccgctaca

SEQ ID NO: 534016 - DNA, 25 bp, Rattus norvegicus
gcccgcgcagcaaagcggaaagcca

SEQ ID NO: 534017 - DNA, 25 bp, Rattus norvegicus
cgcagcaaagcggaaagccaggcta

SEQ ID NO: 534018 - DNA, 25 bp, Rattus norvegicus
gaaagccaggctaccacagtgcaag

SEQ ID NO: 534019 - DNA, 25 bp, Rattus norvegicus
ctaccacagtgcaaggagtcgcgga

SEQ ID NO: 534020 - DNA, 25 bp, Rattus norvegicus
cggaggcagaagctactcaggcgac

SEQ ID NO: 534021 - DNA, 25 bp, Rattus norvegicus
aggcgacacaggcagccctgctagc

SEQ ID NO: 534022 - DNA, 25 bp, Rattus norvegicus
cagaagctactcaggcgacacaggc

SEQ ID NO: 534023 - DNA, 25 bp, Rattus norvegicus
cgctacagcaatcgcagtctctgtg

SEQ ID NO: 534024 - DNA, 25 bp, Rattus norvegicus
agacaaacagctgctccgcggactg

SEQ ID NO: 534025 - DNA, 25 bp, Rattus norvegicus
ggtagatcccgctacagcaatcgca

SEQ ID NO: 534026 - DNA, 25 bp, Rattus norvegicus
caatcgcagtctctgtggagcgggc

SEQ ID NO: 534027 - DNA, 25 bp, Rattus norvegicus
aaccaacctccaagacaaacagctg

SEQ ID NO: 534028 - DNA, 25 bp, Rattus norvegicus
cgggccgccagaccagcctcacaac

SEQ ID NO: 534029 - DNA, 25 bp, Rattus norvegicus
agccgctcgcaagagcctcagagag

SEQ ID NO: 534030 - DNA, 25 bp, Rattus norvegicus
agcaggccaacttgaggggcgccct

SEQ ID NO: 534031 - DNA, 25 bp, Rattus norvegicus
gctggttggagagcgagcgactagt

SEQ ID NO: 534032 - DNA, 25 bp, Rattus norvegicus
aatgacgtcagctgcagtgagggtc

SEQ ID NO: 534033 - DNA, 25 bp, Rattus norvegicus
ctggcaatgacgtcagctgcagtga

SEQ ID NO: 534034 - DNA, 25 bp, Rattus norvegicus
ttctctggcaatgacgtcagctgca

SEQ ID NO: 534035 - DNA, 25 bp, Rattus norvegicus
ctccttctctggcaatgacgtcagc

SEQ ID NO: 534036 - DNA, 25 bp, Rattus norvegicus
ttgtgctggggtcctcctcatcccg

SEQ ID NO: 534037 - DNA, 25 bp, Rattus norvegicus
gaacgtagtttgtgctggggtcctc

SEQ ID NO: 534038 - DNA, 25 bp, Rattus norvegicus
agcgagcacagggaacgtagtttgt

SEQ ID NO: 534039 - DNA, 25 bp, Rattus norvegicus
gcaagagcctcagagagcgagcaca

SEQ ID NO: 534040 - DNA, 25 bp, Rattus norvegicus
gctgagtttgccaagccgctcgcaa

SEQ ID NO: 534041 - DNA, 25 bp, Rattus norvegicus
cgcccagctcaagtcctggcgccgc

SEQ ID NO: 534042 - DNA, 25 bp, Rattus norvegicus
ctcagagagcgagcacagggaacgt

SEQ ID NO: 534043 - DNA, 25 bp, Rattus norvegicus
agcaaggcttccctgagccagtttc

SEQ ID NO: 534044 - DNA, 25 bp, Rattus norvegicus
cacttccggctctgtccgcttgtgg

SEQ ID NO: 534045 - DNA, 25 bp, Rattus norvegicus
ggccggcagcaagtagaaccttcga

SEQ ID NO: 534046 - DNA, 25 bp, Rattus norvegicus
ccttcgactaagaacgcggaccgca

SEQ ID NO: 534047 - DNA, 25 bp, Rattus norvegicus
cttttgtgggcagcaaggcttccct

SEQ ID NO: 534048 - DNA, 25 bp, Rattus norvegicus
gagccagtttccctaccctcaatta

SEQ ID NO: 534049 - DNA, 25 bp, Rattus norvegicus
ccctcaattagggagaaacatctca

SEQ ID NO: 534050 - DNA, 25 bp, Rattus norvegicus
agaaacatctcatcgcggggccgcg

SEQ ID NO: 534051 - DNA, 25 bp, Rattus norvegicus
gcgacagtcgcccactaaactcggt

SEQ ID NO: 534052 - DNA, 25 bp, Rattus norvegicus
gaccgggaaaaagccgcaccaggca

SEQ ID NO: 534053 - DNA, 25 bp, Rattus norvegicus
agctccgctaccattccggaaatgc

SEQ ID NO: 534054 - DNA, 25 bp, Rattus norvegicus
gaaatgcccgaagaaagccagcgtc

SEQ ID NO: 534055 - DNA, 25 bp, Rattus norvegicus
agaaagccagcgtcttccgcttcct

SEQ ID NO: 534056 - DNA, 25 bp, Rattus norvegicus
ccgcaggcccgagcttttgtgggca

SEQ ID NO: 534057 - DNA, 25 bp, Rattus norvegicus
tgccagcccggcagggaccgctggt

SEQ ID NO: 534058 - DNA, 25 bp, Rattus norvegicus
ggacttcaggggtagcgctccttgc

SEQ ID NO: 534059 - DNA, 25 bp, Rattus norvegicus
agggaccgctggtcacccctacaca

SEQ ID NO: 534060 - DNA, 25 bp, Rattus norvegicus
aagcggaacggcagctggggcgccg

SEQ ID NO: 534061 - DNA, 25 bp, Rattus norvegicus
cggagtcgcggaagcggaacggcag

SEQ ID NO: 534062 - DNA, 25 bp, Rattus norvegicus
gtcgcttaacctccgcgcgggcgga

SEQ ID NO: 534063 - DNA, 25 bp, Rattus norvegicus
gagtcgcttaacctccgcgcgggcg

SEQ ID NO: 534064 - DNA, 25 bp, Rattus norvegicus
aggagtcgcttaacctccgcgcggg

SEQ ID NO: 534065 - DNA, 25 bp, Rattus norvegicus
cccagcggaggagtcgcttaacctc

SEQ ID NO: 534066 - DNA, 25 bp, Rattus norvegicus
agcccagcggaggagtcgcttaacc

SEQ ID NO: 534067 - DNA, 25 bp, Rattus norvegicus
tcagcccagcggaggagtcgcttaa

SEQ ID NO: 534068 - DNA, 25 bp, Rattus norvegicus
aggggtagcgctccttgcccgcccg

SEQ ID NO: 534069 - DNA, 25 bp, Rattus norvegicus
acttcaggggtagcgctccttgccc

SEQ ID NO: 534070 - DNA, 25 bp, Rattus norvegicus
ccagcggaggagtcgcttaacctcc

SEQ ID NO: 534071 - DNA, 25 bp, Rattus norvegicus
tgtctgtgctcatcgcatccttccg

SEQ ID NO: 534072 - DNA, 25 bp, Rattus norvegicus
gtgtatccgcgctcaagtatgtctg

SEQ ID NO: 534073 - DNA, 25 bp, Rattus norvegicus
cccaggtgccctcctaaagagattc

SEQ ID NO: 534074 - DNA, 25 bp, Rattus norvegicus
attcggatctccttgtgccctcatc

SEQ ID NO: 534075 - DNA, 25 bp, Rattus norvegicus
ctcatctccagctctttgtgcgggg

SEQ ID NO: 534076 - DNA, 25 bp, Rattus norvegicus
gaggtgcgatctgaagctttctgcc

SEQ ID NO: 534077 - DNA, 25 bp, Rattus norvegicus
agcgcacgctagtggagcagtcaga

SEQ ID NO: 534078 - DNA, 25 bp, Rattus norvegicus
ctcagccgcttggtgaatttgcgca

SEQ ID NO: 534079 - DNA, 25 bp, Rattus norvegicus
gaatttgcgcacttcggccatggta

SEQ ID NO: 534080 - DNA, 25 bp, Rattus norvegicus
tgcctgtgtttacacgccgaccggc

SEQ ID NO: 534081 - DNA, 25 bp, Rattus norvegicus
agcttttgcaagctccgggtcctgc

SEQ ID NO: 534082 - DNA, 25 bp, Rattus norvegicus
tggggacccacgctctctgtgaaac

SEQ ID NO: 534083 - DNA, 25 bp, Rattus norvegicus
tgtgtgcgcgtatactcgatgtgta

SEQ ID NO: 534084 - DNA, 25 bp, Rattus norvegicus
agccggtagccagagcgaaaactta

SEQ ID NO: 534085 - DNA, 25 bp, Rattus norvegicus
cccgaactggggttgatgtccacca

SEQ ID NO: 534086 - DNA, 25 bp, Rattus norvegicus
cgcgctgctcctcttctactgagta

SEQ ID NO: 534087 - DNA, 25 bp, Rattus norvegicus
cttggccacattagcgatcacagtc

SEQ ID NO: 534088 - DNA, 25 bp, Rattus norvegicus
accacgcggaaagcagaagcctgtc

SEQ ID NO: 534089 - DNA, 25 bp, Rattus norvegicus
gtccatagtacagccagcagcaata

SEQ ID NO: 534090 - DNA, 25 bp, Rattus norvegicus
ggcacagcaggtctcggtcaatctt

SEQ ID NO: 534091 - DNA, 25 bp, Rattus norvegicus
gacctctagcgagatgatacacttg

SEQ ID NO: 534092 - DNA, 25 bp, Rattus norvegicus
ccagttcaatctgtgcggccggaaa

SEQ ID NO: 534093 - DNA, 25 bp, Rattus norvegicus
tggctgcctcagagatctccagttc

SEQ ID NO: 534094 - DNA, 25 bp, Rattus norvegicus
cgaaactgcctgagtccgggtcata

SEQ ID NO: 534095 - DNA, 25 bp, Rattus norvegicus
tcgtaggtctgcacaccgaaactgc

SEQ ID NO: 534096 - DNA, 25 bp, Rattus norvegicus
cgcgtctttatttccaggccaaaca

SEQ ID NO: 534097 - DNA, 25 bp, Rattus norvegicus
aggctcttctccaccacgagttcag

SEQ ID NO: 534098 - DNA, 25 bp, Rattus norvegicus
gaagcctgtcgggtatccatcgcga

SEQ ID NO: 534099 - DNA, 25 bp, Rattus norvegicus
tgagaagaaccggaaacaggagacg

SEQ ID NO: 534100 - DNA, 25 bp, Rattus norvegicus
caggagacgattttctagagggtca

SEQ ID NO: 534101 - DNA, 25 bp, Rattus norvegicus
tggggacgccatgactaccccgaga

SEQ ID NO: 534102 - DNA, 25 bp, Rattus norvegicus
gagaccctgcgcctctgcaccaggc

SEQ ID NO: 534103 - DNA, 25 bp, Rattus norvegicus
tgcaccaggcgatcggctggagcca

SEQ ID NO: 534104 - DNA, 25 bp, Rattus norvegicus
agccaggcgcgaaagttcccgagtt

SEQ ID NO: 534105 - DNA, 25 bp, Rattus norvegicus
aacttacgagtatctgctactgaga

SEQ ID NO: 534106 - DNA, 25 bp, Rattus norvegicus
ctgctactgagaagaaccggaaaca

SEQ ID NO: 534107 - DNA, 25 bp, Rattus norvegicus
aagttgcgacaatttcggagcgccc

SEQ ID NO: 534108 - DNA, 25 bp, Rattus norvegicus
gggtcattcttaggaggctgtcaca

SEQ ID NO: 534109 - DNA, 25 bp, Rattus norvegicus
acgattttctagagggtcattctta

SEQ ID NO: 534110 - DNA, 25 bp, Rattus norvegicus
ggctgtcacaagttgcgacaatttc

SEQ ID NO: 534111 - DNA, 25 bp, Rattus norvegicus
ccggaaacaggagacgattttctag

SEQ ID NO: 534112 - DNA, 25 bp, Rattus norvegicus
cttaggaggctgtcacaagttgcga

SEQ ID NO: 534113 - DNA, 25 bp, Rattus norvegicus
tcatcgatccgcgtcactttctgct

SEQ ID NO: 534114 - DNA, 25 bp, Rattus norvegicus
ccgtactcgagccaattagtttttg

SEQ ID NO: 534115 - DNA, 25 bp, Rattus norvegicus
ccgcggtctcttaggaggcgcatgc

SEQ ID NO: 534116 - DNA, 25 bp, Rattus norvegicus
ggtcccgcgcctttgaatctcagag

SEQ ID NO: 534117 - DNA, 25 bp, Rattus norvegicus
ctttgaatctcagaggcggcttttg

SEQ ID NO: 534118 - DNA, 25 bp, Rattus norvegicus
tctcagaggcggcttttgggcttcg

SEQ ID NO: 534119 - DNA, 25 bp, Rattus norvegicus
gagccgtactcgagccaattagttt

SEQ ID NO: 534120 - DNA, 25 bp, Rattus norvegicus
gccctagagccgtactcgagccaat

SEQ ID NO: 534121 - DNA, 25 bp, Rattus norvegicus
gctgaactaactcctccgcagccgc

SEQ ID NO: 534122 - DNA, 25 bp, Rattus norvegicus
gggccagccgcactgcgtcatcgat

SEQ ID NO: 534123 - DNA, 25 bp, Rattus norvegicus
atcgatccgcgtcactttctgctcg

SEQ ID NO: 534124 - DNA, 25 bp, Rattus norvegicus
ccgcagccgcggtctcttaggaggc

SEQ ID NO: 534125 - DNA, 25 bp, Rattus norvegicus
gccaattagtttttggctgaactaa

SEQ ID NO: 534126 - DNA, 25 bp, Rattus norvegicus
cgtcactttctgctcgctcgcgcgc

SEQ ID NO: 534127 - DNA, 25 bp, Rattus norvegicus
gctgcaaaccgcggtaacgtccggc

SEQ ID NO: 534128 - DNA, 25 bp, Rattus norvegicus
ccggcctttccctggagcgctgccg

SEQ ID NO: 534129 - DNA, 25 bp, Rattus norvegicus
aggacgaggaggactccatcccggc

SEQ ID NO: 534130 - DNA, 25 bp, Rattus norvegicus
gaggaggactccatcccggcacgac

SEQ ID NO: 534131 - DNA, 25 bp, Rattus norvegicus
tccatcccggcacgaccacgcgggc

SEQ ID NO: 534132 - DNA, 25 bp, Rattus norvegicus
ccgaagcgagcaaagaaccgactcg

SEQ ID NO: 534133 - DNA, 25 bp, Rattus norvegicus
agcaaagaaccgactcgccgacctt

SEQ ID NO: 534134 - DNA, 25 bp, Rattus norvegicus
gactcgccgaccttcacgtgtctgg

SEQ ID NO: 534135 - DNA, 25 bp, Rattus norvegicus
gccgaccttcacgtgtctgggtgac

SEQ ID NO: 534136 - DNA, 25 bp, Rattus norvegicus
cttcacgtgtctgggtgacggaacc

SEQ ID NO: 534137 - DNA, 25 bp, Rattus norvegicus
tctgggtgacggaaccggaactaca

SEQ ID NO: 534138 - DNA, 25 bp, Rattus norvegicus
gaccgccctgtgagctcaccgcgtc

SEQ ID NO: 534139 - DNA, 25 bp, Rattus norvegicus
cggggctgttgtccctgccggctct

SEQ ID NO: 534140 - DNA, 25 bp, Rattus norvegicus
ctccgcagtctctgcgagcgggatc

SEQ ID NO: 534141 - DNA, 25 bp, Rattus norvegicus
tcgcttacgtgagcagaagtagttc

SEQ ID NO: 534142 - DNA, 25 bp, Rattus norvegicus
tagtgatcccgagtttaagccgaga

SEQ ID NO: 534143 - DNA, 25 bp, Rattus norvegicus
taagccgagagttgctcacgtgacc

SEQ ID NO: 534144 - DNA, 25 bp, Rattus norvegicus
agttgctcacgtgaccgagatctca

SEQ ID NO: 534145 - DNA, 25 bp, Rattus norvegicus
cgtgaccgagatctcacatgacgta

SEQ ID NO: 534146 - DNA, 25 bp, Rattus norvegicus
ccgagatctcacatgacgtagatgc

SEQ ID NO: 534147 - DNA, 25 bp, Rattus norvegicus
gctcacgtgatcaatcgcttacgtg

SEQ ID NO: 534148 - DNA, 25 bp, Rattus norvegicus
cagaagtagttctggtcgtcgtcta

SEQ ID NO: 534149 - DNA, 25 bp, Rattus norvegicus
ggtcgtcgtctatcgtctcgctata

SEQ ID NO: 534150 - DNA, 25 bp, Rattus norvegicus
atcgtctcgctatagccgtttgagg

SEQ ID NO: 534151 - DNA, 25 bp, Rattus norvegicus
ctatagccgtttgagggaagaagga

SEQ ID NO: 534152 - DNA, 25 bp, Rattus norvegicus
gtcgcctccgcctttttcgtgctcc

SEQ ID NO: 534153 - DNA, 25 bp, Rattus norvegicus
ggcaccttagtgatcccgagtttaa

SEQ ID NO: 534154 - DNA, 25 bp, Rattus norvegicus
catgacgtagatgctcacgtgatca

SEQ ID NO: 534155 - DNA, 25 bp, Rattus norvegicus
ctgttgactgccttccgaccagtgg

SEQ ID NO: 534156 - DNA, 25 bp, Rattus norvegicus
gcgcgctgggactttgcgcacggac

SEQ ID NO: 534157 - DNA, 25 bp, Rattus norvegicus
actttgcgcacggacgcgaggaggg

SEQ ID NO: 534158 - DNA, 25 bp, Rattus norvegicus
ggggttgcctgtgcgtacagaaggg

SEQ ID NO: 534159 - DNA, 25 bp, Rattus norvegicus
tacagaagggggtcctgttgactgc

SEQ ID NO: 534160 - DNA, 25 bp, Rattus norvegicus
gtcctgttgactgccttccgaccag

SEQ ID NO: 534161 - DNA, 25 bp, Rattus norvegicus
ggggtcctgttgactgccttccgac

SEQ ID NO: 534162 - DNA, 25 bp, Rattus norvegicus
gggtcctgttgactgccttccgacc

SEQ ID NO: 534163 - DNA, 25 bp, Rattus norvegicus
ggtcctgttgactgccttccgacca

SEQ ID NO: 534164 - DNA, 25 bp, Rattus norvegicus
tcactctcgtctggccaccaactcc

SEQ ID NO: 534165 - DNA, 25 bp, Rattus norvegicus
cgatgacgcggggccctcacgtgac

SEQ ID NO: 534166 - DNA, 25 bp, Rattus norvegicus
gttgactgccttccgaccagtgggg

SEQ ID NO: 534167 - DNA, 25 bp, Rattus norvegicus
tgttgactgccttccgaccagtggg

SEQ ID NO: 534168 - DNA, 25 bp, Rattus norvegicus
cctgttgactgccttccgaccagtg

SEQ ID NO: 534169 - DNA, 25 bp, Rattus norvegicus
cttgtccaggtcgttgttcccgtct

SEQ ID NO: 534170 - DNA, 25 bp, Rattus norvegicus
tgcctgggatattccataaagtggg

SEQ ID NO: 534171 - DNA, 25 bp, Rattus norvegicus
aggtcagtgcctgggatattccata

SEQ ID NO: 534172 - DNA, 25 bp, Rattus norvegicus
aaaggaattgtcccggatccctgca

SEQ ID NO: 534173 - DNA, 25 bp, Rattus norvegicus
ctccctattaccctgagggcgggcg

SEQ ID NO: 534174 - DNA, 25 bp, Rattus norvegicus
gtaccagctccctattaccctgagg

SEQ ID NO: 534175 - DNA, 25 bp, Rattus norvegicus
tcgttgttcccgtctgagtaccagc

SEQ ID NO: 534176 - DNA, 25 bp, Rattus norvegicus
gaagtccttcttgtccaggtcgttg

SEQ ID NO: 534177 - DNA, 25 bp, Rattus norvegicus
ctgacgtgtgcagaagtccttcttg

SEQ ID NO: 534178 - DNA, 25 bp, Rattus norvegicus
ccaagagctgacgtgtgcagaagtc

SEQ ID NO: 534179 - DNA, 25 bp, Rattus norvegicus
ctctcacgtgaccaagagctgacgt

SEQ ID NO: 534180 - DNA, 25 bp, Rattus norvegicus
ttacgtcgctctcacgtgaccaaga

SEQ ID NO: 534181 - DNA, 25 bp, Rattus norvegicus
tggattacgtcgctctcacgtgacc

SEQ ID NO: 534182 - DNA, 25 bp, Rattus norvegicus
ccgtctgagtaccagctccctatta

SEQ ID NO: 534183 - DNA, 25 bp, Rattus norvegicus
ccctctcagtcgtggcctacggaga

SEQ ID NO: 534184 - DNA, 25 bp, Rattus norvegicus
ccagtggcgacagtgcggatgaccc

SEQ ID NO: 534185 - DNA, 25 bp, Rattus norvegicus
gaggccgctcactcgcaaagacgct

SEQ ID NO: 534186 - DNA, 25 bp, Rattus norvegicus
tcagtcgtggcctacggagaagaag

SEQ ID NO: 534187 - DNA, 25 bp, Rattus norvegicus
acagcctcgtgtggtggtgatcggc

SEQ ID NO: 534188 - DNA, 25 bp, Rattus norvegicus
cagtgcggatgaccctctcagtcgt

SEQ ID NO: 534189 - DNA, 25 bp, Rattus norvegicus
caaagttgtgaatccagtggcgaca

SEQ ID NO: 534190 - DNA, 25 bp, Rattus norvegicus
tatgcaaagttgtgaatccagtggc

SEQ ID NO: 534191 - DNA, 25 bp, Rattus norvegicus
cggacggtatgcaaagttgtgaatc

SEQ ID NO: 534192 - DNA, 25 bp, Rattus norvegicus
ctagaaagtgaggtacggacggtat

SEQ ID NO: 534193 - DNA, 25 bp, Rattus norvegicus
aggctcctagaaagtgaggtacgga

SEQ ID NO: 534194 - DNA, 25 bp, Rattus norvegicus
cgcagggaaaggctcctagaaagtg

SEQ ID NO: 534195 - DNA, 25 bp, Rattus norvegicus
ctccgcagggaaaggctcctagaaa

SEQ ID NO: 534196 - DNA, 25 bp, Rattus norvegicus
atgaccctctcagtcgtggcctacg

SEQ ID NO: 534197 - DNA, 25 bp, Rattus norvegicus
tggtcggcagataccaggactcctg

SEQ ID NO: 534198 - DNA, 25 bp, Rattus norvegicus
tcgaacactgagaagagagacccgg

SEQ ID NO: 534199 - DNA, 25 bp, Rattus norvegicus
ggtgtcctacgacccgaggcgccaa

SEQ ID NO: 534200 - DNA, 25 bp, Rattus norvegicus
gctcgcctttgccataccttgaagc

SEQ ID NO: 534201 - DNA, 25 bp, Rattus norvegicus
cttcaccaagtgcaggtggtcggca

SEQ ID NO: 534202 - DNA, 25 bp, Rattus norvegicus
tctgctgggccggtactgagatccg

SEQ ID NO: 534203 - DNA, 25 bp, Rattus norvegicus
tgagatccgttcctctgtgtatacg

SEQ ID NO: 534204 - DNA, 25 bp, Rattus norvegicus
tgtgtatacgtctccagggcaactg

SEQ ID NO: 534205 - DNA, 25 bp, Rattus norvegicus
ggcaactgaccgcaaccgggcgcaa

SEQ ID NO: 534206 - DNA, 25 bp, Rattus norvegicus
accgccagcaaaggtcgtgacgtca

SEQ ID NO: 534207 - DNA, 25 bp, Rattus norvegicus
tggtactgctcgaacactgagaaga

SEQ ID NO: 534208 - DNA, 25 bp, Rattus norvegicus
gtaagctctatcagcgtacagcgcg

SEQ ID NO: 534209 - DNA, 25 bp, Rattus norvegicus
ccaggatgcggaaggctagtaagct

SEQ ID NO: 534210 - DNA, 25 bp, Rattus norvegicus
attgcgtccgggctttctggtactg

SEQ ID NO: 534211 - DNA, 25 bp, Rattus norvegicus
cagcccggatttcgggccggctgca

SEQ ID NO: 534212 - DNA, 25 bp, Rattus norvegicus
gaggcgacagattagggagcttccc

SEQ ID NO: 534213 - DNA, 25 bp, Rattus norvegicus
ttctccacagcaccggcaagtgagc

SEQ ID NO: 534214 - DNA, 25 bp, Rattus norvegicus
gagctacagcttttcggcgacgcca

SEQ ID NO: 534215 - DNA, 25 bp, Rattus norvegicus
tggcgcgcacaattgcactggcgtc

SEQ ID NO: 534216 - DNA, 25 bp, Rattus norvegicus
cgccatagtggagccgccaaagctg

SEQ ID NO: 534217 - DNA, 25 bp, Rattus norvegicus
cactggcgtctggattccgttaggc

SEQ ID NO: 534218 - DNA, 25 bp, Rattus norvegicus
cctcgcttcctctttggcaactaga

SEQ ID NO: 534219 - DNA, 25 bp, Rattus norvegicus
ctttggcaactagagcctcgctctg

SEQ ID NO: 534220 - DNA, 25 bp, Rattus norvegicus
tggctcccagcgtaggccaatagga

SEQ ID NO: 534221 - DNA, 25 bp, Rattus norvegicus
aggccaataggagagcggtgaaccc

SEQ ID NO: 534222 - DNA, 25 bp, Rattus norvegicus
ggcaagggcaggtgtctactttaaa

SEQ ID NO: 534223 - DNA, 25 bp, Rattus norvegicus
gcttcccgaggggaagacctcgcca

SEQ ID NO: 534224 - DNA, 25 bp, Rattus norvegicus
cggcgaaggcgaacaggccaccttc

SEQ ID NO: 534225 - DNA, 25 bp, Rattus norvegicus
cagcacctccgagtggtccagcttg

SEQ ID NO: 534226 - DNA, 25 bp, Rattus norvegicus
acctccgagtggtccagcttggcct

SEQ ID NO: 534227 - DNA, 25 bp, Rattus norvegicus
gcagatggaggaaggcagtgatcca

SEQ ID NO: 534228 - DNA, 25 bp, Rattus norvegicus
aggcagtgatccaggatgagcgctc

SEQ ID NO: 534229 - DNA, 25 bp, Rattus norvegicus
cagtgatccaggatgagcgctcctg

SEQ ID NO: 534230 - DNA, 25 bp, Rattus norvegicus
ggatgagcgctcctggaaccacctc

SEQ ID NO: 534231 - DNA, 25 bp, Rattus norvegicus
gcgctcctggaaccacctcctagta

SEQ ID NO: 534232 - DNA, 25 bp, Rattus norvegicus
tcctggaaccacctcctagtagccc

SEQ ID NO: 534233 - DNA, 25 bp, Rattus norvegicus
acgtggcgtccacccagtcgcttgc

SEQ ID NO: 534234 - DNA, 25 bp, Rattus norvegicus
agtcgcttgccgcatctctgcggcc

SEQ ID NO: 534235 - DNA, 25 bp, Rattus norvegicus
gagcaacagtcccaactcccgcagg

SEQ ID NO: 534236 - DNA, 25 bp, Rattus norvegicus
tcccaactcccgcaggctctcgctc

SEQ ID NO: 534237 - DNA, 25 bp, Rattus norvegicus
ctactcaccgtgcgcgccatcagct

SEQ ID NO: 534238 - DNA, 25 bp, Rattus norvegicus
gtccagcttggcctgcgtgcgtgca

SEQ ID NO: 534239 - DNA, 25 bp, Rattus norvegicus
aattccggggcttagcgagacgatc

SEQ ID NO: 534240 - DNA, 25 bp, Rattus norvegicus
gcgagacgatcttccggctcccccg

SEQ ID NO: 534241 - DNA, 25 bp, Rattus norvegicus
tagcgagacgatcttccggctcccc

SEQ ID NO: 534242 - DNA, 25 bp, Rattus norvegicus
ttagcgagacgatcttccggctccc

SEQ ID NO: 534243 - DNA, 25 bp, Rattus norvegicus
cttagcgagacgatcttccggctcc

SEQ ID NO: 534244 - DNA, 25 bp, Rattus norvegicus
ggcttagcgagacgatcttccggct

SEQ ID NO: 534245 - DNA, 25 bp, Rattus norvegicus
cggggcttagcgagacgatcttccg

SEQ ID NO: 534246 - DNA, 25 bp, Rattus norvegicus
ccggggcttagcgagacgatcttcc

SEQ ID NO: 534247 - DNA, 25 bp, Rattus norvegicus
attccggggcttagcgagacgatct

SEQ ID NO: 534248 - DNA, 25 bp, Rattus norvegicus
gaattccggggcttagcgagacgat

SEQ ID NO: 534249 - DNA, 25 bp, Rattus norvegicus
cgagacgatcttccggctcccccgc

SEQ ID NO: 534250 - DNA, 25 bp, Rattus norvegicus
gcttagcgagacgatcttccggctc

SEQ ID NO: 534251 - DNA, 25 bp, Rattus norvegicus
ttccggggcttagcgagacgatctt

SEQ ID NO: 534252 - DNA, 25 bp, Rattus norvegicus
gggcttagcgagacgatcttccggc

SEQ ID NO: 534253 - DNA, 25 bp, Rattus norvegicus
catctagcggcagcgggctgccatt

SEQ ID NO: 534254 - DNA, 25 bp, Rattus norvegicus
cttactcagccgttgggacgcgctt

SEQ ID NO: 534255 - DNA, 25 bp, Rattus norvegicus
cgcctctcttactcagccgttggga

SEQ ID NO: 534256 - DNA, 25 bp, Rattus norvegicus
ggtaaacaagctggcgtgcccgcgc

SEQ ID NO: 534257 - DNA, 25 bp, Rattus norvegicus
cgcctgtgaactaggcgcccgcagg

SEQ ID NO: 534258 - DNA, 25 bp, Rattus norvegicus
gcctcctccctgtgtcgccgaccaa

SEQ ID NO: 534259 - DNA, 25 bp, Rattus norvegicus
aatccgcggccaggtcctgttggga

SEQ ID NO: 534260 - DNA, 25 bp, Rattus norvegicus
aggcgccatctgtcggccgcgaatc

SEQ ID NO: 534261 - DNA, 25 bp, Rattus norvegicus
atggaacgcgcaggcgccatctgtc

SEQ ID NO: 534262 - DNA, 25 bp, Rattus norvegicus
tcagcgacttggaggcgaatggaac

SEQ ID NO: 534263 - DNA, 25 bp, Rattus norvegicus
ctcttcagcgacttggaggcgaatg

SEQ ID NO: 534264 - DNA, 25 bp, Rattus norvegicus
ggtgttcgctcttcagcgacttgga

SEQ ID NO: 534265 - DNA, 25 bp, Rattus norvegicus
gattgtttggggtgttcgctcttca

SEQ ID NO: 534266 - DNA, 25 bp, Rattus norvegicus
cggcgactcggacgccgcctgtgaa

SEQ ID NO: 534267 - DNA, 25 bp, Rattus norvegicus
catttataggacacacccgcgggtg

SEQ ID NO: 534268 - DNA, 25 bp, Rattus norvegicus
cccaggcgactctgaagagggcaca

SEQ ID NO: 534269 - DNA, 25 bp, Rattus norvegicus
gctttccgacgccatttataggaca

SEQ ID NO: 534270 - DNA, 25 bp, Rattus norvegicus
gggaccaccctcagttgctgggcta

SEQ ID NO: 534271 - DNA, 25 bp, Rattus norvegicus
tatgacctgcaaagcgactgcccga

SEQ ID NO: 534272 - DNA, 25 bp, Rattus norvegicus
ctgtggctcttctcagtcccggaga

SEQ ID NO: 534273 - DNA, 25 bp, Rattus norvegicus
ctcccgcagcggcaattacagttgc

SEQ ID NO: 534274 - DNA, 25 bp, Rattus norvegicus
acagttgcagggaaagctactagcc

SEQ ID NO: 534275 - DNA, 25 bp, Rattus norvegicus
gcgcacctaacctcgcgagatttcg

SEQ ID NO: 534276 - DNA, 25 bp, Rattus norvegicus
gggcggtcccagagagacaatcttc

SEQ ID NO: 534277 - DNA, 25 bp, Rattus norvegicus
ttactaatgcgggagaagcctgtca

SEQ ID NO: 534278 - DNA, 25 bp, Rattus norvegicus
gcctgtcaaaatggcgcaagcgtgt

SEQ ID NO: 534279 - DNA, 25 bp, Rattus norvegicus
gtctcctcctcgtcagttaagagtg

SEQ ID NO: 534280 - DNA, 25 bp, Rattus norvegicus
agaaagggtgattccgagcgtctcc

SEQ ID NO: 534281 - DNA, 25 bp, Rattus norvegicus
taggtagatggtgttcagtcgcttc

SEQ ID NO: 534282 - DNA, 25 bp, Rattus norvegicus
gggcctccgtaatgacgtagccgcg

SEQ ID NO: 534283 - DNA, 25 bp, Rattus norvegicus
ccgtaatgacgtagccgcgcctagt

SEQ ID NO: 534284 - DNA, 25 bp, Rattus norvegicus
cgcctagtgcgtcccggcggatgta

SEQ ID NO: 534285 - DNA, 25 bp, Rattus norvegicus
agatggtgttcagtcgcttcgtgag

SEQ ID NO: 534286 - DNA, 25 bp, Rattus norvegicus
gtaccgaaaggtgatagtaatttgc

SEQ ID NO: 534287 - DNA, 25 bp, Rattus norvegicus
agtaatttgctagtcatggcccttc

SEQ ID NO: 534288 - DNA, 25 bp, Rattus norvegicus
ttcatcttgtcctacgtcccaagcg

SEQ ID NO: 534289 - DNA, 25 bp, Rattus norvegicus
ccctaaatacagtcgccgccattgt

SEQ ID NO: 534290 - DNA, 25 bp, Rattus norvegicus
acagtcgccgccattgtatcagctc

SEQ ID NO: 534291 - DNA, 25 bp, Rattus norvegicus
tcgccgccattgtatcagctcgctg

SEQ ID NO: 534292 - DNA, 25 bp, Rattus norvegicus
cattgtatcagctcgctgcgcctga

SEQ ID NO: 534293 - DNA, 25 bp, Rattus norvegicus
tatcagctcgctgcgcctgactgcg

SEQ ID NO: 534294 - DNA, 25 bp, Rattus norvegicus
atggcccttcatcttgtcctacgtc

SEQ ID NO: 534295 - DNA, 25 bp, Rattus norvegicus
catctcacacactgtgagtgtggct

SEQ ID NO: 534296 - DNA, 25 bp, Rattus norvegicus
tggaggcaaacaggtcacagctgct

SEQ ID NO: 534297 - DNA, 25 bp, Rattus norvegicus
ggggcaggacacagctctgccattc

SEQ ID NO: 534298 - DNA, 25 bp, Rattus norvegicus
ggcaggacacagctctgccattcca

SEQ ID NO: 534299 - DNA, 25 bp, Rattus norvegicus
tgtgtcatgggctccaggctgtcgc

SEQ ID NO: 534300 - DNA, 25 bp, Rattus norvegicus
gctccaggctgtcgcgcattgcgga

SEQ ID NO: 534301 - DNA, 25 bp, Rattus norvegicus
ctgtcgcgcattgcggacagctgcc

SEQ ID NO: 534302 - DNA, 25 bp, Rattus norvegicus
attgcggacagctgcctggccctga

SEQ ID NO: 534303 - DNA, 25 bp, Rattus norvegicus
agctgcctggccctgacagtccagt

SEQ ID NO: 534304 - DNA, 25 bp, Rattus norvegicus
tgcctggccctgacagtccagtgga

SEQ ID NO: 534305 - DNA, 25 bp, Rattus norvegicus
acactgtgagtgtggctccaaaaat

SEQ ID NO: 534306 - DNA, 25 bp, Rattus norvegicus
agctgctccctggagtgtgtgctgt

SEQ ID NO: 534307 - DNA, 25 bp, Rattus norvegicus
aaacaggtcacagctgctccctgga

SEQ ID NO: 534308 - DNA, 25 bp, Rattus norvegicus
cagtccagtggaggcaaacaggtca

SEQ ID NO: 534309 - DNA, 25 bp, Rattus norvegicus
ctacgcagcccttacccgtttggtg

SEQ ID NO: 534310 - DNA, 25 bp, Rattus norvegicus
tccactcgcgcgcaaagtggtgggg

SEQ ID NO: 534311 - DNA, 25 bp, Rattus norvegicus
ggggctccgtgaaaggatctgctaa

SEQ ID NO: 534312 - DNA, 25 bp, Rattus norvegicus
gggctccgtgaaaggatctgctaag

SEQ ID NO: 534313 - DNA, 25 bp, Rattus norvegicus
ggctccgtgaaaggatctgctaagg

SEQ ID NO: 534314 - DNA, 25 bp, Rattus norvegicus
gctccgtgaaaggatctgctaagga

SEQ ID NO: 534315 - DNA, 25 bp, Rattus norvegicus
ctccgtgaaaggatctgctaaggac

SEQ ID NO: 534316 - DNA, 25 bp, Rattus norvegicus
tccgtgaaaggatctgctaaggaca

SEQ ID NO: 534317 - DNA, 25 bp, Rattus norvegicus
ccgtgaaaggatctgctaaggacag

SEQ ID NO: 534318 - DNA, 25 bp, Rattus norvegicus
ccattccactcgcgcgcaaagtggt

SEQ ID NO: 534319 - DNA, 25 bp, Rattus norvegicus
ggggcgggacacgtccctgccattc

SEQ ID NO: 534320 - DNA, 25 bp, Rattus norvegicus
taggggcgggacacgtccctgccat

SEQ ID NO: 534321 - DNA, 25 bp, Rattus norvegicus
cgtttggtgcaaagacgtaggggcg

SEQ ID NO: 534322 - DNA, 25 bp, Rattus norvegicus
cagcccttacccgtttggtgcaaag

SEQ ID NO: 534323 - DNA, 25 bp, Rattus norvegicus
agggagccgccgattgatcctgcaa

SEQ ID NO: 534324 - DNA, 25 bp, Rattus norvegicus
ggcggcgctcaccttgggctgcatc

SEQ ID NO: 534325 - DNA, 25 bp, Rattus norvegicus
ctcaccttgggctgcatcctcacca

SEQ ID NO: 534326 - DNA, 25 bp, Rattus norvegicus
agcattccgcgcgagccacagggag

SEQ ID NO: 534327 - DNA, 25 bp, Rattus norvegicus
cattccgcgcgagccacagggaggc

SEQ ID NO: 534328 - DNA, 25 bp, Rattus norvegicus
agaaggaccgcggagccaacagcac

SEQ ID NO: 534329 - DNA, 25 bp, Rattus norvegicus
ggagccaacagcacgccagtgccga

SEQ ID NO: 534330 - DNA, 25 bp, Rattus norvegicus
acagcacgccagtgccgagcctgca

SEQ ID NO: 534331 - DNA, 25 bp, Rattus norvegicus
gccgccgattgatcctgcaagatga

SEQ ID NO: 534332 - DNA, 25 bp, Rattus norvegicus
ctgtcccgggccaactcgctgttcg

SEQ ID NO: 534333 - DNA, 25 bp, Rattus norvegicus
tcgctgttcgccttcacgctgagcg

SEQ ID NO: 534334 - DNA, 25 bp, Rattus norvegicus
ttcgccttcacgctgagcgtcatgg

SEQ ID NO: 534335 - DNA, 25 bp, Rattus norvegicus
gccgattgatcctgcaagatgaaca

SEQ ID NO: 534336 - DNA, 25 bp, Rattus norvegicus
ccttcacgctgagcgtcatggcggc

SEQ ID NO: 534337 - DNA, 25 bp, Rattus norvegicus
gagggcctcgcgtcactgccaagct

SEQ ID NO: 534338 - DNA, 25 bp, Rattus norvegicus
ccgcgcgcagacaagctctgagctg

SEQ ID NO: 534339 - DNA, 25 bp, Rattus norvegicus
acaagctctgagctggtggccagac

SEQ ID NO: 534340 - DNA, 25 bp, Rattus norvegicus
tctcaatcctctctgcgagacgcgc

SEQ ID NO: 534341 - DNA, 25 bp, Rattus norvegicus
caggaggccagtgcgacaggaggcc

SEQ ID NO: 534342 - DNA, 25 bp, Rattus norvegicus
tcgcgtcactgccaagctcgctccc

SEQ ID NO: 534343 - DNA, 25 bp, Rattus norvegicus
tcacgtgagggcctcgcgtcactgc

SEQ ID NO: 534344 - DNA, 25 bp, Rattus norvegicus
ctgtcgccttcagggccgctgcgtg

SEQ ID NO: 534345 - DNA, 25 bp, Rattus norvegicus
cgacgcctggctgtcgccttcaggg

SEQ ID NO: 534346 - DNA, 25 bp, Rattus norvegicus
gttccctccgcgatgcacaaagccg

SEQ ID NO: 534347 - DNA, 25 bp, Rattus norvegicus
tctccctggctagcgctctccgctg

SEQ ID NO: 534348 - DNA, 25 bp, Rattus norvegicus
cagcggtcgcccacgatctccagca

SEQ ID NO: 534349 - DNA, 25 bp, Rattus norvegicus
tcccggctagcagacctgcagacgg

SEQ ID NO: 534350 - DNA, 25 bp, Rattus norvegicus
gactcccggctagcagacctgcaga

SEQ ID NO: 534351 - DNA, 25 bp, Rattus norvegicus
ccctgatcatgtcgcggtcaggggc

SEQ ID NO: 534352 - DNA, 25 bp, Rattus norvegicus
ggcttcccggagtgaccgcaggcca

SEQ ID NO: 534353 - DNA, 25 bp, Rattus norvegicus
ccaccatgagcagcgagagcgacca

SEQ ID NO: 534354 - DNA, 25 bp, Rattus norvegicus
tgagcagcgagagcgaccataactt

SEQ ID NO: 534355 - DNA, 25 bp, Rattus norvegicus
agcgagagcgaccataacttcaggc

SEQ ID NO: 534356 - DNA, 25 bp, Rattus norvegicus
gaccataacttcaggcgggtggcca

SEQ ID NO: 534357 - DNA, 25 bp, Rattus norvegicus
aacttcaggcgggtggccatccggc

SEQ ID NO: 534358 - DNA, 25 bp, Rattus norvegicus
catccggcggaagtcaggctcctac

SEQ ID NO: 534359 - DNA, 25 bp, Rattus norvegicus
aggctcctacctgcctcccgggatc

SEQ ID NO: 534360 - DNA, 25 bp, Rattus norvegicus
agcaggccctcaccgcacttgcagc

SEQ ID NO: 534361 - DNA, 25 bp, Rattus norvegicus
acttgcagcgccctgatcatgtcgc

SEQ ID NO: 534362 - DNA, 25 bp, Rattus norvegicus
cagcgccctgatcatgtcgcggtca

SEQ ID NO: 534363 - DNA, 25 bp, Rattus norvegicus
cccaagcctcttgggcgcacgggcg

SEQ ID NO: 534364 - DNA, 25 bp, Rattus norvegicus
gctcagcctggacgcgcgcaggcga

SEQ ID NO: 534365 - DNA, 25 bp, Rattus norvegicus
aacggaggcacctgttcctggtggc

SEQ ID NO: 534366 - DNA, 25 bp, Rattus norvegicus
acctgttcctggtggcgcagctcct

SEQ ID NO: 534367 - DNA, 25 bp, Rattus norvegicus
cctcggggactaggagcatgcgccc

SEQ ID NO: 534368 - DNA, 25 bp, Rattus norvegicus
agaccctcggggactaggagcatgc

SEQ ID NO: 534369 - DNA, 25 bp, Rattus norvegicus
agcccgtcgtcggtgtcccgcagcc

SEQ ID NO: 534370 - DNA, 25 bp, Rattus norvegicus
ggagctttggcttctgacgcaaatc

SEQ ID NO: 534371 - DNA, 25 bp, Rattus norvegicus
ccctaacggaggcacctgttcctgg

SEQ ID NO: 534372 - DNA, 25 bp, Rattus norvegicus
ttctgcccgccatccctaacggagg

SEQ ID NO: 534373 - DNA, 25 bp, Rattus norvegicus
ctcgctcactctcttctgcccgcca

SEQ ID NO: 534374 - DNA, 25 bp, Rattus norvegicus
atcgcacgtgactagcccacgcagg

SEQ ID NO: 534375 - DNA, 25 bp, Rattus norvegicus
acgcaaatcgcacgtgactagccca

SEQ ID NO: 534376 - DNA, 25 bp, Rattus norvegicus
ttctgacgcaaatcgcacgtgacta

SEQ ID NO: 534377 - DNA, 25 bp, Rattus norvegicus
tggcttctgacgcaaatcgcacgtg

SEQ ID NO: 534378 - DNA, 25 bp, Rattus norvegicus
cagctcctggtggcgcagagcacgc

SEQ ID NO: 534379 - DNA, 25 bp, Rattus norvegicus
cacgtgcgatttgcgtcagaagcca

SEQ ID NO: 534380 - DNA, 25 bp, Rattus norvegicus
gcgcatgctcctagtccccgagggt

SEQ ID NO: 534381 - DNA, 25 bp, Rattus norvegicus
ctgcgggacaccgacgacgggctcc

SEQ ID NO: 534382 - DNA, 25 bp, Rattus norvegicus
gcgtgctctgcgccaccaggagctg

SEQ ID NO: 534383 - DNA, 25 bp, Rattus norvegicus
caggagctgcgccaccaggaacagg

SEQ ID NO: 534384 - DNA, 25 bp, Rattus norvegicus
ccaccaggaacaggtgcctccgtta

SEQ ID NO: 534385 - DNA, 25 bp, Rattus norvegicus
aggaacaggtgcctccgttagggat

SEQ ID NO: 534386 - DNA, 25 bp, Rattus norvegicus
cctccgttagggatggcgggcagaa

SEQ ID NO: 534387 - DNA, 25 bp, Rattus norvegicus
ggctagtcacgtgcgatttgcgtca

SEQ ID NO: 534388 - DNA, 25 bp, Rattus norvegicus
cacggggacggccacctgcagcctc

SEQ ID NO: 534389 - DNA, 25 bp, Rattus norvegicus
gatttgcgtcagaagccaaagctcc

SEQ ID NO: 534390 - DNA, 25 bp, Rattus norvegicus
tgtcgcggggcgcatgctcctagtc

SEQ ID NO: 534391 - DNA, 25 bp, Rattus norvegicus
tgcgtgggctagtcacgtgcgattt

SEQ ID NO: 534392 - DNA, 25 bp, Rattus norvegicus
tcctcctgctttccgcgctgcccgg

SEQ ID NO: 534393 - DNA, 25 bp, Rattus norvegicus
ccgcgccgagtccttcccatcccac

SEQ ID NO: 534394 - DNA, 25 bp, Rattus norvegicus
cccgcgccgagtccttcccatccca

SEQ ID NO: 534395 - DNA, 25 bp, Rattus norvegicus
gcccgcgccgagtccttcccatccc

SEQ ID NO: 534396 - DNA, 25 bp, Rattus norvegicus
cgcgccgagtccttcccatcccacc

SEQ ID NO: 534397 - DNA, 25 bp, Rattus norvegicus
ctgccggcctgcgggcagcggagag

SEQ ID NO: 534398 - DNA, 25 bp, Rattus norvegicus
agcccgcgccgagtccttcccatcc

SEQ ID NO: 534399 - DNA, 25 bp, Rattus norvegicus
acctgccggcctgcgggcagcggag

SEQ ID NO: 534400 - DNA, 25 bp, Rattus norvegicus
gacctgccggcctgcgggcagcgga

SEQ ID NO: 534401 - DNA, 25 bp, Rattus norvegicus
gcggctggacctgccggcctgcggg

SEQ ID NO: 534402 - DNA, 25 bp, Rattus norvegicus
gggcggctggacctgccggcctgcg

SEQ ID NO: 534403 - DNA, 25 bp, Rattus norvegicus
aaggggcggctggacctgccggcct

SEQ ID NO: 534404 - DNA, 25 bp, Rattus norvegicus
gaaaggggcggctggacctgccggc

SEQ ID NO: 534405 - DNA, 25 bp, Rattus norvegicus
gagcccgcgccgagtccttcccatc

SEQ ID NO: 534406 - DNA, 25 bp, Rattus norvegicus
ggagcccgcgccgagtccttcccat

SEQ ID NO: 534407 - DNA, 25 bp, Rattus norvegicus
tctgcaggtctgctagccgggagtc

SEQ ID NO: 534408 - DNA, 25 bp, Rattus norvegicus
cccgtctgcaggtctgctagccggg

SEQ ID NO: 534409 - DNA, 25 bp, Rattus norvegicus
gcgcgtctcgcagagaggattgaga

SEQ ID NO: 534410 - DNA, 25 bp, Rattus norvegicus
gctttgtgcatcgcggagggaaccc

SEQ ID NO: 534411 - DNA, 25 bp, Rattus norvegicus
ccctgaaggcgacagccaggcgtcg

SEQ ID NO: 534412 - DNA, 25 bp, Rattus norvegicus
cacgcagcggccctgaaggcgacag

SEQ ID NO: 534413 - DNA, 25 bp, Rattus norvegicus
caggtaaggggcctgcacgcagcgg

SEQ ID NO: 534414 - DNA, 25 bp, Rattus norvegicus
accagctcagagcttgtctgcgcgc

SEQ ID NO: 534415 - DNA, 25 bp, Rattus norvegicus
gtctggccaccagctcagagcttgt

SEQ ID NO: 534416 - DNA, 25 bp, Rattus norvegicus
gcagtgacgcgaggccctcacgtga

SEQ ID NO: 534417 - DNA, 25 bp, Rattus norvegicus
agcttggcagtgacgcgaggccctc

SEQ ID NO: 534418 - DNA, 25 bp, Rattus norvegicus
ggcctcctgtcgcactggcctcctg

SEQ ID NO: 534419 - DNA, 25 bp, Rattus norvegicus
cagctcagagcttgtctgcgcgcgg

SEQ ID NO: 534420 - DNA, 25 bp, Rattus norvegicus
cagcggagagcgctagccagggaga

SEQ ID NO: 534421 - DNA, 25 bp, Rattus norvegicus
gcagcgtgttcacgtggcccgtttt

SEQ ID NO: 534422 - DNA, 25 bp, Rattus norvegicus
cgaccaatgacggtcgcccttttag

SEQ ID NO: 534423 - DNA, 25 bp, Rattus norvegicus
gtccttcttcagtgcgggctccgac

SEQ ID NO: 534424 - DNA, 25 bp, Rattus norvegicus
cctccaagtgcgctacagccgttgg

SEQ ID NO: 534425 - DNA, 25 bp, Rattus norvegicus
cagaagtctatagggcagcgtgttc

SEQ ID NO: 534426 - DNA, 25 bp, Rattus norvegicus
cggatgcccggatgccttgagaact

SEQ ID NO: 534427 - DNA, 25 bp, Rattus norvegicus
cgtggcccgttttcacgacccagag

SEQ ID NO: 534428 - DNA, 25 bp, Rattus norvegicus
ccttctctcctgcagggaggcatta

SEQ ID NO: 534429 - DNA, 25 bp, Rattus norvegicus
caccacagggaaaggaagtgccgac

SEQ ID NO: 534430 - DNA, 25 bp, Rattus norvegicus
aagtgccgacgtggcctgcggaaat

SEQ ID NO: 534431 - DNA, 25 bp, Rattus norvegicus
cctgcggaaataggataggcggaaa

SEQ ID NO: 534432 - DNA, 25 bp, Rattus norvegicus
taggcggaaatgagctaaggttccc

SEQ ID NO: 534433 - DNA, 25 bp, Rattus norvegicus
atgccttgagaactggggtgtatgc

SEQ ID NO: 534434 - DNA, 25 bp, Rattus norvegicus
acagccgttgggtcagaagtctata

SEQ ID NO: 534435 - DNA, 25 bp, Rattus norvegicus
ctgggtgcagggactcggcaaacaa

SEQ ID NO: 534436 - DNA, 25 bp, Rattus norvegicus
ttcgctctttgcctcccgggcttat

SEQ ID NO: 534437 - DNA, 25 bp, Rattus norvegicus
agccttgcctctctttggccgagtg

SEQ ID NO: 534438 - DNA, 25 bp, Rattus norvegicus
cagcctggaaaagggactttggcaa

SEQ ID NO: 534439 - DNA, 25 bp, Rattus norvegicus
ttggcaaataactggagcggcgttc

SEQ ID NO: 534440 - DNA, 25 bp, Rattus norvegicus
tcgggttagggtaagcaatctccca

SEQ ID NO: 534441 - DNA, 25 bp, Rattus norvegicus
gcaatctcccactgtctgaagactg

SEQ ID NO: 534442 - DNA, 25 bp, Rattus norvegicus
tttggcctctgagcgcagctgctct

SEQ ID NO: 534443 - DNA, 25 bp, Rattus norvegicus
tgaggcaagattccgaagtctcggg

SEQ ID NO: 534444 - DNA, 25 bp, Rattus norvegicus
ggggctccatgagcttacccgcctt

SEQ ID NO: 534445 - DNA, 25 bp, Rattus norvegicus
tacccgccttctgcgcgactaggag

SEQ ID NO: 534446 - DNA, 25 bp, Rattus norvegicus
gttgggatctgtaccggaacggcaa

SEQ ID NO: 534447 - DNA, 25 bp, Rattus norvegicus
gcggggaacacgcttcgctctttgc

SEQ ID NO: 534448 - DNA, 25 bp, Rattus norvegicus
cggcaaacaaggtgaggcaagattc

SEQ ID NO: 534449 - DNA, 25 bp, Rattus norvegicus
gcccacctggcgacgtgacgctcca

SEQ ID NO: 534450 - DNA, 25 bp, Rattus norvegicus
ggcctggagaccgttagagagactc

SEQ ID NO: 534451 - DNA, 25 bp, Rattus norvegicus
cctggagaccgttagagagactccc

SEQ ID NO: 534452 - DNA, 25 bp, Rattus norvegicus
gcttcttcgtctccggacggacgga

SEQ ID NO: 534453 - DNA, 25 bp, Rattus norvegicus
cctgctgcgcggctgcccacctggc

SEQ ID NO: 534454 - DNA, 25 bp, Rattus norvegicus
tctggcttcttcgtctccggacgga

SEQ ID NO: 534455 - DNA, 25 bp, Rattus norvegicus
ggcgacgtgacgctccaccaatccc

SEQ ID NO: 534456 - DNA, 25 bp, Rattus norvegicus
tcctcaccctcaaaggcgcaccctg

SEQ ID NO: 534457 - DNA, 25 bp, Rattus norvegicus
aaaggcgcaccctgcccgggccact

SEQ ID NO: 534458 - DNA, 25 bp, Rattus norvegicus
ggccactctgcgctctcgccgcgga

SEQ ID NO: 534459 - DNA, 25 bp, Rattus norvegicus
gcggagcacccttctggcttcttcg

SEQ ID NO: 534460 - DNA, 25 bp, Rattus norvegicus
gagcacccttctggcttcttcgtct

SEQ ID NO: 534461 - DNA, 25 bp, Rattus norvegicus
cttctggcttcttcgtctccggacg

SEQ ID NO: 534462 - DNA, 25 bp, Rattus norvegicus
ggagaccgttagagagactccctct

SEQ ID NO: 534463 - DNA, 25 bp, Rattus norvegicus
gggtctcgcgccgagtgcacgccat

SEQ ID NO: 534464 - DNA, 25 bp, Rattus norvegicus
ccaatttcacggtgcccactgtttg

SEQ ID NO: 534465 - DNA, 25 bp, Rattus norvegicus
ttggccctcatccaacgcggcggag

SEQ ID NO: 534466 - DNA, 25 bp, Rattus norvegicus
gcaagtatcttggttggccctcatc

SEQ ID NO: 534467 - DNA, 25 bp, Rattus norvegicus
tgtaacccgcacaccaatttcacgg

SEQ ID NO: 534468 - DNA, 25 bp, Rattus norvegicus
cgtacctcaacgtgtcctggcgggt

SEQ ID NO: 534469 - DNA, 25 bp, Rattus norvegicus
aagctgtgtggaccgcgtacctcaa

SEQ ID NO: 534470 - DNA, 25 bp, Rattus norvegicus
ttccttctagctctgagtccgcacg

SEQ ID NO: 534471 - DNA, 25 bp, Rattus norvegicus
gcctcccgggatcggggtctactgc

SEQ ID NO: 534472 - DNA, 25 bp, Rattus norvegicus
ctgcagtagcctggccgctgacgct

SEQ ID NO: 534473 - DNA, 25 bp, Rattus norvegicus
cttgccggagctgcgtctgcagtag

SEQ ID NO: 534474 - DNA, 25 bp, Rattus norvegicus
atccctagtgcttgcttgccggagc

SEQ ID NO: 534475 - DNA, 25 bp, Rattus norvegicus
tcgcgagcgagcatccctagtgctt

SEQ ID NO: 534476 - DNA, 25 bp, Rattus norvegicus
ctgctggcttggtgcttccttctag

SEQ ID NO: 534477 - DNA, 25 bp, Rattus norvegicus
cctcatcttaaacccggggcgactg

SEQ ID NO: 534478 - DNA, 25 bp, Rattus norvegicus
gaggacaaataggtcgccgcttctg

SEQ ID NO: 534479 - DNA, 25 bp, Rattus norvegicus
aaggtggcgaggcaaacagttactc

SEQ ID NO: 534480 - DNA, 25 bp, Rattus norvegicus
cgccgccaacggaagacttggtagg

SEQ ID NO: 534481 - DNA, 25 bp, Rattus norvegicus
ttctgaggcggcacaaagttcttcg

SEQ ID NO: 534482 - DNA, 25 bp, Rattus norvegicus
tcttcgagatgtggctgaagcccga

SEQ ID NO: 534483 - DNA, 25 bp, Rattus norvegicus
cccgaggaagtgttgttgaaaaatg

SEQ ID NO: 534484 - DNA, 25 bp, Rattus norvegicus
actgactggggattctgctcccgcc

SEQ ID NO: 534485 - DNA, 25 bp, Rattus norvegicus
gatccaacgagtactttgtcctgca

SEQ ID NO: 534486 - DNA, 25 bp, Rattus norvegicus
acttacaggtaagcggtggccagca

SEQ ID NO: 534487 - DNA, 25 bp, Rattus norvegicus
tgtggccagccagctactctagctt

SEQ ID NO: 534488 - DNA, 25 bp, Rattus norvegicus
actctagctttagggctgggtccgc

SEQ ID NO: 534489 - DNA, 25 bp, Rattus norvegicus
ctgggtccgctgtcactgaaaaggt

SEQ ID NO: 534490 - DNA, 25 bp, Rattus norvegicus
aagctgtggctgatggaaagatcca

SEQ ID NO: 534491 - DNA, 25 bp, Rattus norvegicus
tcacgatccagacagaacaacagcg

SEQ ID NO: 534492 - DNA, 25 bp, Rattus norvegicus
cctaattaattcttggcgtttgcca

SEQ ID NO: 534493 - DNA, 25 bp, Rattus norvegicus
tatggcgatctcctgacagacgctc

SEQ ID NO: 534494 - DNA, 25 bp, Rattus norvegicus
ccctgggccgtacagaaatatggcg

SEQ ID NO: 534495 - DNA, 25 bp, Rattus norvegicus
gtgaagccggaggaacacagcgtct

SEQ ID NO: 534496 - DNA, 25 bp, Rattus norvegicus
gccaggataccggtttgctgctgcc

SEQ ID NO: 534497 - DNA, 25 bp, Rattus norvegicus
ctccgcgatggcactgaagggtcgc

SEQ ID NO: 534498 - DNA, 25 bp, Rattus norvegicus
caagagaacaccgtggccgaggccc

SEQ ID NO: 534499 - DNA, 25 bp, Rattus norvegicus
ctaaagtgactggaacatcacgatc

SEQ ID NO: 534500 - DNA, 25 bp, Rattus norvegicus
cgtcctcagctttcagggcacgatc

SEQ ID NO: 534501 - DNA, 25 bp, Rattus norvegicus
tcccactcgcagctggcagaggcgg

SEQ ID NO: 534502 - DNA, 25 bp, Rattus norvegicus
tttgccataggccaggcggccgagc

SEQ ID NO: 534503 - DNA, 25 bp, Rattus norvegicus
tcagggcacgatcttgtcctgtcgc

SEQ ID NO: 534504 - DNA, 25 bp, Rattus norvegicus
acctaccgtgctcaggcggatcctg

SEQ ID NO: 534505 - DNA, 25 bp, Rattus norvegicus
agcatcgcggagaccaacgcttttc

SEQ ID NO: 534506 - DNA, 25 bp, Rattus norvegicus
gggctctcggacagacccgctttcg

SEQ ID NO: 534507 - DNA, 25 bp, Rattus norvegicus
aggactgacctgctttctctccgac

SEQ ID NO: 534508 - DNA, 25 bp, Rattus norvegicus
ggagtccgcacaacacgtgtttctg

SEQ ID NO: 534509 - DNA, 25 bp, Rattus norvegicus
ggcccaggagtcctacctttctgtg

SEQ ID NO: 534510 - DNA, 25 bp, Rattus norvegicus
ctcgcgatccgctgaaggtactgaa

SEQ ID NO: 534511 - DNA, 25 bp, Rattus norvegicus
tgaaggtactgaattcccagaccgg

SEQ ID NO: 534512 - DNA, 25 bp, Rattus norvegicus
ggcggaaaagctcgccgcgaaaagc

SEQ ID NO: 534513 - DNA, 25 bp, Rattus norvegicus
cgcgaaaagcctgcggagcaaatgt

SEQ ID NO: 534514 - DNA, 25 bp, Rattus norvegicus
taatgtcctgctcttacctcctcgg

SEQ ID NO: 534515 - DNA, 25 bp, Rattus norvegicus
ttacctcctcggctgtgcaagctcg

SEQ ID NO: 534516 - DNA, 25 bp, Rattus norvegicus
gcaagctcgctatcccgtctacaaa

SEQ ID NO: 534517 - DNA, 25 bp, Rattus norvegicus
cgtctacaaagtgaaggcggaggcc

SEQ ID NO: 534518 - DNA, 25 bp, Rattus norvegicus
gcctagaagggacggagtccgcaca

SEQ ID NO: 534519 - DNA, 25 bp, Rattus norvegicus
cctaatggattttctggccacggtg

SEQ ID NO: 534520 - DNA, 25 bp, Rattus norvegicus
ctggttccagaagcagcacctaatg

SEQ ID NO: 534521 - DNA, 25 bp, Rattus norvegicus
gtgctcgacaatgcagcctggttcc

SEQ ID NO: 534522 - DNA, 25 bp, Rattus norvegicus
tggggcactttcacggtgctcgaca

SEQ ID NO: 534523 - DNA, 25 bp, Rattus norvegicus
aggctccacggctctcctgggagac

SEQ ID NO: 534524 - DNA, 25 bp, Rattus norvegicus
ccacaacgtgatcgcgctcgtggga

SEQ ID NO: 534525 - DNA, 25 bp, Rattus norvegicus
tgggtctgttccacttccagcgagc

SEQ ID NO: 534526 - DNA, 25 bp, Rattus norvegicus
cgtggggcacctgttaactttattg

SEQ ID NO: 534527 - DNA, 25 bp, Rattus norvegicus
cccagactgtgtactgcggtttcga

SEQ ID NO: 534528 - DNA, 25 bp, Rattus norvegicus
ccgagagcggcacgaagacagagct

SEQ ID NO: 534529 - DNA, 25 bp, Rattus norvegicus
atgctgagacacctgtgccgcgttc

SEQ ID NO: 534530 - DNA, 25 bp, Rattus norvegicus
agaggtccagcatgccttgcgtgta

SEQ ID NO: 534531 - DNA, 25 bp, Rattus norvegicus
ttccgcatgggcactctgcttagcc

SEQ ID NO: 534532 - DNA, 25 bp, Rattus norvegicus
cccgagcatgcgtagaagagacact

SEQ ID NO: 534533 - DNA, 25 bp, Rattus norvegicus
gttcctggggccatgttcacaagcg

SEQ ID NO: 534534 - DNA, 25 bp, Rattus norvegicus
caggggaatgcagcgcgttcattat

SEQ ID NO: 534535 - DNA, 25 bp, Rattus norvegicus
ctgctggaaggtggtcacttagcca

SEQ ID NO: 534536 - DNA, 25 bp, Rattus norvegicus
tctgaagcatgtgcgtggttcctgg

SEQ ID NO: 534537 - DNA, 25 bp, Rattus norvegicus
tccggcgaagcccaagccctgggga

SEQ ID NO: 534538 - DNA, 25 bp, Rattus norvegicus
cccagtgctcggtgagtctcgggct

SEQ ID NO: 534539 - DNA, 25 bp, Rattus norvegicus
ggccatgttcacaagcggacacaga

SEQ ID NO: 534540 - DNA, 25 bp, Rattus norvegicus
aagcggacacagacgcacactctca

SEQ ID NO: 534541 - DNA, 25 bp, Rattus norvegicus
acgaaacatacaggcgcgctggcgc

SEQ ID NO: 534542 - DNA, 25 bp, Rattus norvegicus
cattcgctgcgctcaaccacagtca

SEQ ID NO: 534543 - DNA, 25 bp, Rattus norvegicus
cccatccaaagacgaaacatacagg

SEQ ID NO: 534544 - DNA, 25 bp, Rattus norvegicus
cgttcattatggagcctttgtgtgc

SEQ ID NO: 534545 - DNA, 25 bp, Rattus norvegicus
ttagccagggtgtccggcgaagccc

SEQ ID NO: 534546 - DNA, 25 bp, Rattus norvegicus
gccagaaacagctgtctgaagcatg

SEQ ID NO: 534547 - DNA, 25 bp, Rattus norvegicus
gcggagttggccttttcggactcca

SEQ ID NO: 534548 - DNA, 25 bp, Rattus norvegicus
agtttcccaagtgcgagcgtggctc

SEQ ID NO: 534549 - DNA, 25 bp, Rattus norvegicus
cagttgcagcagtcgaggccgacag

SEQ ID NO: 534550 - DNA, 25 bp, Rattus norvegicus
cgctcagggtgcgaagagaaacagc

SEQ ID NO: 534551 - DNA, 25 bp, Rattus norvegicus
cccttctggtggtagcgctcagggt

SEQ ID NO: 534552 - DNA, 25 bp, Rattus norvegicus
ccaggtccaggcagcagttgcagca

SEQ ID NO: 534553 - DNA, 25 bp, Rattus norvegicus
cccggcaaaacaagctgtgaggaca

SEQ ID NO: 534554 - DNA, 25 bp, Rattus norvegicus
agaggctgcctgctcagggacgtca

SEQ ID NO: 534555 - DNA, 25 bp, Rattus norvegicus
ccctttctggagatcgcagcggttg

SEQ ID NO: 534556 - DNA, 25 bp, Rattus norvegicus
gccgcttctccctttctggagatcg

SEQ ID NO: 534557 - DNA, 25 bp, Rattus norvegicus
agcgcactcccaagtttcccaagtg

SEQ ID NO: 534558 - DNA, 25 bp, Rattus norvegicus
ctgggccatcttctggggctcagag

SEQ ID NO: 534559 - DNA, 25 bp, Rattus norvegicus
agctggacaaacagctcccagcggc

SEQ ID NO: 534560 - DNA, 25 bp, Rattus norvegicus
ggacagttggaaattagcgcctaaa

SEQ ID NO: 534561 - DNA, 25 bp, Rattus norvegicus
ccgagccgctcctcctcacttgtca

SEQ ID NO: 534562 - DNA, 25 bp, Rattus norvegicus
ccggcgacaggactgtctgtctccg

SEQ ID NO: 534563 - DNA, 25 bp, Rattus norvegicus
cccgtgcctcgttccacaccatctc

SEQ ID NO: 534564 - DNA, 25 bp, Rattus norvegicus
agctccgtctcgtttcccgggctca

SEQ ID NO: 534565 - DNA, 25 bp, Rattus norvegicus
cgcacggggtctcgggctctccaga

SEQ ID NO: 534566 - DNA, 25 bp, Rattus norvegicus
gactgtctgtctccgctccgtctgt

SEQ ID NO: 534567 - DNA, 25 bp, Rattus norvegicus
gctctccagagtgggccaaaggtcg

SEQ ID NO: 534568 - DNA, 25 bp, Rattus norvegicus
gcgctcacggcctgcccggagccat

SEQ ID NO: 534569 - DNA, 25 bp, Rattus norvegicus
gaagagccctggactcagtggtagc

SEQ ID NO: 534570 - DNA, 25 bp, Rattus norvegicus
ccctggactcagtggtagcgccggc

SEQ ID NO: 534571 - DNA, 25 bp, Rattus norvegicus
gtgccagaaaacaagaacacctgag

SEQ ID NO: 534572 - DNA, 25 bp, Rattus norvegicus
gaaaacaagaacacctgagaaacgc

SEQ ID NO: 534573 - DNA, 25 bp, Rattus norvegicus
aactccaaactcacagaaccatgtc

SEQ ID NO: 534574 - DNA, 25 bp, Rattus norvegicus
cgagacccacgcagcgccagcgccc

SEQ ID NO: 534575 - DNA, 25 bp, Rattus norvegicus
agatggctgacacccgggaacaata

SEQ ID NO: 534576 - DNA, 25 bp, Rattus norvegicus
tgctcccttagggtgtcagtctccg

SEQ ID NO: 534577 - DNA, 25 bp, Rattus norvegicus
ctccaccctcctttcgaagggattg

SEQ ID NO: 534578 - DNA, 25 bp, Rattus norvegicus
tctggactgagaggcgaaaactctt

SEQ ID NO: 534579 - DNA, 25 bp, Rattus norvegicus
tgtcatggagctgcctctggactga

SEQ ID NO: 534580 - DNA, 25 bp, Rattus norvegicus
ccgagccagcttgctgtggaggcca

SEQ ID NO: 534581 - DNA, 25 bp, Rattus norvegicus
ggcggagtcccagttgtctgtcaca

SEQ ID NO: 534582 - DNA, 25 bp, Rattus norvegicus
cccagttgtctgtcacacggtagtg

SEQ ID NO: 534583 - DNA, 25 bp, Rattus norvegicus
tagtgacccggactcctgctactgc

SEQ ID NO: 534584 - DNA, 25 bp, Rattus norvegicus
gccctcgtgggaaggagtttgcact

SEQ ID NO: 534585 - DNA, 25 bp, Rattus norvegicus
ttgcactcctagatcccaggctggg

SEQ ID NO: 534586 - DNA, 25 bp, Rattus norvegicus
agcggcttagctctcctggcgccta

SEQ ID NO: 534587 - DNA, 25 bp, Rattus norvegicus
tcctggcgcctaggcgcaagtctgg

SEQ ID NO: 534588 - DNA, 25 bp, Rattus norvegicus
cctagacgccggaacgtcgcggtct

SEQ ID NO: 534589 - DNA, 25 bp, Rattus norvegicus
gtagacctcgtgagtgcccggtgca

SEQ ID NO: 534590 - DNA, 25 bp, Rattus norvegicus
acagaccttgtcactgccctgtgta

SEQ ID NO: 534591 - DNA, 25 bp, Rattus norvegicus
agaccttgtcactgccctgtgtaga

SEQ ID NO: 534592 - DNA, 25 bp, Rattus norvegicus
gaccttgtcactgccctgtgtagac

SEQ ID NO: 534593 - DNA, 25 bp, Rattus norvegicus
ttgtcactgccctgtgtagacctcg

SEQ ID NO: 534594 - DNA, 25 bp, Rattus norvegicus
gtcactgccctgtgtagacctcgtg

SEQ ID NO: 534595 - DNA, 25 bp, Rattus norvegicus
cactgccctgtgtagacctcgtgag

SEQ ID NO: 534596 - DNA, 25 bp, Rattus norvegicus
tgtgccgactcgatcacagcacctc

SEQ ID NO: 534597 - DNA, 25 bp, Rattus norvegicus
gtgcacacgtcgtcactgcaccgtg

SEQ ID NO: 534598 - DNA, 25 bp, Rattus norvegicus
gtacagaccttgtcactgccctgtg

SEQ ID NO: 534599 - DNA, 25 bp, Rattus norvegicus
acacgtcgtcactgcaccgtgcaga

SEQ ID NO: 534600 - DNA, 25 bp, Rattus norvegicus
ctgccctgtgccgactcgatcacag

SEQ ID NO: 534601 - DNA, 25 bp, Rattus norvegicus
tgtgtagacctcgtgagtgcccggt

SEQ ID NO: 534602 - DNA, 25 bp, Rattus norvegicus
ccctgtgtagacctcgtgagtgccc

SEQ ID NO: 534603 - DNA, 25 bp, Rattus norvegicus
tggactcaccgctgcacggacgcga

SEQ ID NO: 534604 - DNA, 25 bp, Rattus norvegicus
gctctgtccgcggtactaaatccga

SEQ ID NO: 534605 - DNA, 25 bp, Rattus norvegicus
tcgtcgatgaccagcagcaccctgg

SEQ ID NO: 534606 - DNA, 25 bp, Rattus norvegicus
acctgctcactgaaggtggcggctg

SEQ ID NO: 534607 - DNA, 25 bp, Rattus norvegicus
tgcagctgctgtggtctgtttgacc

SEQ ID NO: 534608 - DNA, 25 bp, Rattus norvegicus
ctgtttgaccgcgttagacagcgag

SEQ ID NO: 534609 - DNA, 25 bp, Rattus norvegicus
tagacagcgaggagaagaagccacc

SEQ ID NO: 534610 - DNA, 25 bp, Rattus norvegicus
gaggcgcaatatcggcttaccagtc

SEQ ID NO: 534611 - DNA, 25 bp, Rattus norvegicus
ctgcaggtctgtcatatacccatta

SEQ ID NO: 534612 - DNA, 25 bp, Rattus norvegicus
tacccattaggcagattggccatga

SEQ ID NO: 534613 - DNA, 25 bp, Rattus norvegicus
ggccatgaagttgctgtccgacagg

SEQ ID NO: 534614 - DNA, 25 bp, Rattus norvegicus
actaaatccgacagtgcgcacgcgc

SEQ ID NO: 534615 - DNA, 25 bp, Rattus norvegicus
ttgcacctcttgtggtgcggcccga

SEQ ID NO: 534616 - DNA, 25 bp, Rattus norvegicus
ctctgccgccgcagagcgtatggtc

SEQ ID NO: 534617 - DNA, 25 bp, Rattus norvegicus
cccgaagttcagagtaaagacgatt

SEQ ID NO: 534618 - DNA, 25 bp, Rattus norvegicus
tctgagctcccagcagcagtttgca

SEQ ID NO: 534619 - DNA, 25 bp, Rattus norvegicus
gttcagagtaaagacgattccacgc

SEQ ID NO: 534620 - DNA, 25 bp, Rattus norvegicus
aagacgattccacgcggacacctga

SEQ ID NO: 534621 - DNA, 25 bp, Rattus norvegicus
gattccacgcggacacctgaccatg

SEQ ID NO: 534622 - DNA, 25 bp, Rattus norvegicus
ctgaccatgcgcctaccctgagtga

SEQ ID NO: 534623 - DNA, 25 bp, Rattus norvegicus
atgcgcctaccctgagtgaggccct

SEQ ID NO: 534624 - DNA, 25 bp, Rattus norvegicus
gccctccgggcatctgtattgtggg

SEQ ID NO: 534625 - DNA, 25 bp, Rattus norvegicus
tccgggcatctgtattgtgggcagc

SEQ ID NO: 534626 - DNA, 25 bp, Rattus norvegicus
catctgtattgtgggcagccgggct

SEQ ID NO: 534627 - DNA, 25 bp, Rattus norvegicus
agccgggctacacgctcaactctga

SEQ ID NO: 534628 - DNA, 25 bp, Rattus norvegicus
gggctacacgctcaactctgagctc

SEQ ID NO: 534629 - DNA, 25 bp, Rattus norvegicus
gagtaaagacgattccacgcggaca

SEQ ID NO: 534630 - DNA, 25 bp, Rattus norvegicus
tcaactctgagctcccagcagcagt

SEQ ID NO: 534631 - DNA, 25 bp, Rattus norvegicus
aaacgctgcggcatgtgtgcgccct

SEQ ID NO: 534632 - DNA, 25 bp, Rattus norvegicus
gcttctgccatcagctcgggcaaga

SEQ ID NO: 534633 - DNA, 25 bp, Rattus norvegicus
ccactgatgagcgaggcgggtgccg

SEQ ID NO: 534634 - DNA, 25 bp, Rattus norvegicus
tgccggcctgcccgacatggaggct

SEQ ID NO: 534635 - DNA, 25 bp, Rattus norvegicus
gaagccctcaatggccagtccgact

SEQ ID NO: 534636 - DNA, 25 bp, Rattus norvegicus
tcaatggccagtccgacttccctta

SEQ ID NO: 534637 - DNA, 25 bp, Rattus norvegicus
tcttcatcatgaccccagccggtgt

SEQ ID NO: 534638 - DNA, 25 bp, Rattus norvegicus
ccagccggtgtgttcctggctgaga

SEQ ID NO: 534639 - DNA, 25 bp, Rattus norvegicus
tcctggctgagagtgcgctgcacat

SEQ ID NO: 534640 - DNA, 25 bp, Rattus norvegicus
agagtgcgctgcacatggctggcct

SEQ ID NO: 534641 - DNA, 25 bp, Rattus norvegicus
cacatggctggcctggccgagtacc

SEQ ID NO: 534642 - DNA, 25 bp, Rattus norvegicus
tggcctggccgagtaccccatgcag

SEQ ID NO: 534643 - DNA, 25 bp, Rattus norvegicus
ccatgcagggagagctggcttctgc

SEQ ID NO: 534644 - DNA, 25 bp, Rattus norvegicus
tgtgtgcgccctgccggcggcgcat

SEQ ID NO: 534645 - DNA, 25 bp, Rattus norvegicus
attgatgaccgggatcagcgcctcc

SEQ ID NO: 534646 - DNA, 25 bp, Rattus norvegicus
tcgggagcacgcacccattgggcta

SEQ ID NO: 534647 - DNA, 25 bp, Rattus norvegicus
cgggagatgtagttcagactgaatg

SEQ ID NO: 534648 - DNA, 25 bp, Rattus norvegicus
gcaatgaatggggacgcagcccgca

SEQ ID NO: 534649 - DNA, 25 bp, Rattus norvegicus
gcctccatgactccggaaacactgg

SEQ ID NO: 534650 - DNA, 25 bp, Rattus norvegicus
gaagacgtcttgcagcttattgatg

SEQ ID NO: 534651 - DNA, 25 bp, Rattus norvegicus
ggcgcccacggtgttgaagacgtct

SEQ ID NO: 534652 - DNA, 25 bp, Rattus norvegicus
caatctgaggcagctggatgatgtc

SEQ ID NO: 534653 - DNA, 25 bp, Rattus norvegicus
gagttcccactacgacaatctgagg

SEQ ID NO: 534654 - DNA, 25 bp, Rattus norvegicus
tcgcggcctcatcttacctgagttc

SEQ ID NO: 534655 - DNA, 25 bp, Rattus norvegicus
tcggctgacacctgcaggcctgcga

SEQ ID NO: 534656 - DNA, 25 bp, Rattus norvegicus
cgagtgtaggctgcagggccactca

SEQ ID NO: 534657 - DNA, 25 bp, Rattus norvegicus
cgccggaaggaagcgacagcccaca

SEQ ID NO: 534658 - DNA, 25 bp, Rattus norvegicus
cccagcagaccactgcaatgaatgg

SEQ ID NO: 534659 - DNA, 25 bp, Rattus norvegicus
tcatcctctaggaccacgattgtgg

SEQ ID NO: 534660 - DNA, 25 bp, Rattus norvegicus
agggaggttcctgggcgacagcggt

SEQ ID NO: 534661 - DNA, 25 bp, Rattus norvegicus
tctggcatccgaggctgccacggtg

SEQ ID NO: 534662 - DNA, 25 bp, Rattus norvegicus
tcctctaggaccacgattgtggctc

SEQ ID NO: 534663 - DNA, 25 bp, Rattus norvegicus
ggaccacgattgtggctctggcatc

SEQ ID NO: 534664 - DNA, 25 bp, Rattus norvegicus
cacgattgtggctctggcatccgag

SEQ ID NO: 534665 - DNA, 25 bp, Rattus norvegicus
tggctctggcatccgaggctgccac

SEQ ID NO: 534666 - DNA, 25 bp, Rattus norvegicus
tgctcatcctctaggaccacgattg

SEQ ID NO: 534667 - DNA, 25 bp, Rattus norvegicus
gggctgctcatcctctaggaccacg

SEQ ID NO: 534668 - DNA, 25 bp, Rattus norvegicus
ggcccgggctgctcatcctctagga

SEQ ID NO: 534669 - DNA, 25 bp, Rattus norvegicus
tctcgcccttctcagtggccgtggt

SEQ ID NO: 534670 - DNA, 25 bp, Rattus norvegicus
ttcctatttacctccttcttctcgc

SEQ ID NO: 534671 - DNA, 25 bp, Rattus norvegicus
gctccatggcgttgggagcgggaaa

SEQ ID NO: 534672 - DNA, 25 bp, Rattus norvegicus
ctctgtggccgtgtccggctccatg

SEQ ID NO: 534673 - DNA, 25 bp, Rattus norvegicus
ctcgggtcagactctctcctcccgg

SEQ ID NO: 534674 - DNA, 25 bp, Rattus norvegicus
cgcggctcccgatcggagctcagcc

SEQ ID NO: 534675 - DNA, 25 bp, Rattus norvegicus
cgggaggcgccgctctctctcgggt

SEQ ID NO: 534676 - DNA, 25 bp, Rattus norvegicus
cgcgggttggggtgcagcatgtcct

SEQ ID NO: 534677 - DNA, 25 bp, Rattus norvegicus
aagggaggccatacaggcgtggggc

SEQ ID NO: 534678 - DNA, 25 bp, Rattus norvegicus
ccctggcagtatccgtctgagagaa

SEQ ID NO: 534679 - DNA, 25 bp, Rattus norvegicus
gccgccctgatggagccgcggctcc

SEQ ID NO: 534680 - DNA, 25 bp, Rattus norvegicus
cgtggaatccgctggcagtccgcag

SEQ ID NO: 534681 - DNA, 25 bp, Rattus norvegicus
gtgtcgtggaatccgctggcagtcc

SEQ ID NO: 534682 - DNA, 25 bp, Rattus norvegicus
ccgcaggaggcggtgtcgtggaatc

SEQ ID NO: 534683 - DNA, 25 bp, Rattus norvegicus
ttcctctccgcctaggcaaggcggg

SEQ ID NO: 534684 - DNA, 25 bp, Rattus norvegicus
ggggcgaaatctgcggcggcctggc

SEQ ID NO: 534685 - DNA, 25 bp, Rattus norvegicus
tctctctcgggtcagactctctcct

SEQ ID NO: 534686 - DNA, 25 bp, Rattus norvegicus
ctggcagtatccgtctgagagaagg

SEQ ID NO: 534687 - DNA, 25 bp, Rattus norvegicus
cccgcgctgtccgaagaagcaaagc

SEQ ID NO: 534688 - DNA, 25 bp, Rattus norvegicus
tgccctgtcaataggcctcccggtg

SEQ ID NO: 534689 - DNA, 25 bp, Rattus norvegicus
gcgcgtggctgctcctgcaagactc

SEQ ID NO: 534690 - DNA, 25 bp, Rattus norvegicus
tcctgcaagactcgcgccgggtttc

SEQ ID NO: 534691 - DNA, 25 bp, Rattus norvegicus
ccggagaaagcccaagcgagcaaga

SEQ ID NO: 534692 - DNA, 25 bp, Rattus norvegicus
cgagcaagagggcacgcactcacct

SEQ ID NO: 534693 - DNA, 25 bp, Rattus norvegicus
tccacacacggcagtcaaggagagc

SEQ ID NO: 534694 - DNA, 25 bp, Rattus norvegicus
cgcctgcacgcagaaactcagattc

SEQ ID NO: 534695 - DNA, 25 bp, Rattus norvegicus
ctcagattcatgctgcaactcggtc

SEQ ID NO: 534696 - DNA, 25 bp, Rattus norvegicus
gcaactcggtccgtggcagccctaa

SEQ ID NO: 534697 - DNA, 25 bp, Rattus norvegicus
tggcagccctaatgagccggcgagt

SEQ ID NO: 534698 - DNA, 25 bp, Rattus norvegicus
gccgggcaccctgacgcaaagaaag

SEQ ID NO: 534699 - DNA, 25 bp, Rattus norvegicus
cctgacgcaaagaaaggcgcgagcc

SEQ ID NO: 534700 - DNA, 25 bp, Rattus norvegicus
agcaaagcctacatggcacgtcgcc

SEQ ID NO: 534701 - DNA, 25 bp, Rattus norvegicus
tgaagcgccgccaatactttgcaaa

SEQ ID NO: 534702 - DNA, 25 bp, Rattus norvegicus
agcaaaaattgctttgcggcaggca

SEQ ID NO: 534703 - DNA, 25 bp, Rattus norvegicus
gacagtacggcccactggcaggcag

SEQ ID NO: 534704 - DNA, 25 bp, Rattus norvegicus
gcaggcagccgggttttaacatcga

SEQ ID NO: 534705 - DNA, 25 bp, Rattus norvegicus
taacatcgaccaatcctgaagcgcc

SEQ ID NO: 534706 - DNA, 25 bp, Rattus norvegicus
tactttgcaaacctctccctgggcg

SEQ ID NO: 534707 - DNA, 25 bp, Rattus norvegicus
cctgggcggaaatgacgagaatgtc

SEQ ID NO: 534708 - DNA, 25 bp, Rattus norvegicus
tcgtgcgtgattggcggaagcaaaa

SEQ ID NO: 534709 - DNA, 25 bp, Rattus norvegicus
tgcggcaggcaaagaggttgctctc

SEQ ID NO: 534710 - DNA, 25 bp, Rattus norvegicus
gttgctctctctttggcttccgttc

SEQ ID NO: 534711 - DNA, 25 bp, Rattus norvegicus
tggcttccgttcttgacccatgtga

SEQ ID NO: 534712 - DNA, 25 bp, Rattus norvegicus
gacccatgtgagttaccggctacta

SEQ ID NO: 534713 - DNA, 25 bp, Rattus norvegicus
ccggctactaagatgagcgcgatca

SEQ ID NO: 534714 - DNA, 25 bp, Rattus norvegicus
gcgcgatcaaagctacgaaggggta

SEQ ID NO: 534715 - DNA, 25 bp, Rattus norvegicus
cctttacattgcctggccctcggga

SEQ ID NO: 534716 - DNA, 25 bp, Rattus norvegicus
gaccctgtgcccgtcgaaagagtgt

SEQ ID NO: 534717 - DNA, 25 bp, Rattus norvegicus
ccaagagctcaaccagaactgggcc

SEQ ID NO: 534718 - DNA, 25 bp, Rattus norvegicus
gggcacctcacgagcagacccaaaa

SEQ ID NO: 534719 - DNA, 25 bp, Rattus norvegicus
ctcgttgcaaaggtgcgggcacctc

SEQ ID NO: 534720 - DNA, 25 bp, Rattus norvegicus
tcggggaagcctctctcgttgcaaa

SEQ ID NO: 534721 - DNA, 25 bp, Rattus norvegicus
gcagttttcgccctccttggtagct

SEQ ID NO: 534722 - DNA, 25 bp, Rattus norvegicus
actgtgcaaccagccctcggggaag

SEQ ID NO: 534723 - DNA, 25 bp, Rattus norvegicus
tgtctcctctttggtctctaagtcc

SEQ ID NO: 534724 - DNA, 25 bp, Rattus norvegicus
cgcgctctcttatgttgtcccttca

SEQ ID NO: 534725 - DNA, 25 bp, Rattus norvegicus
gggtccctctttctagcggactgtc

SEQ ID NO: 534726 - DNA, 25 bp, Rattus norvegicus
agggcagctttcaatcccagtcctc

SEQ ID NO: 534727 - DNA, 25 bp, Rattus norvegicus
cccactggtcttttggtcatcccaa

SEQ ID NO: 534728 - DNA, 25 bp, Rattus norvegicus
ttggtcatcccaaagggcagctttc

SEQ ID NO: 534729 - DNA, 25 bp, Rattus norvegicus
cttcgaagccagagaggttgtcggc

SEQ ID NO: 534730 - DNA, 25 bp, Rattus norvegicus
ccatacctggcgcagggcagacgcg

SEQ ID NO: 534731 - DNA, 25 bp, Rattus norvegicus
tgttggcttccatacctggcgcagg

SEQ ID NO: 534732 - DNA, 25 bp, Rattus norvegicus
ctgctggatgttggcttccatacct

SEQ ID NO: 534733 - DNA, 25 bp, Rattus norvegicus
gagtaatgagccacgccctggccgc

SEQ ID NO: 534734 - DNA, 25 bp, Rattus norvegicus
gggcacgcccgattagtccgctcgg

SEQ ID NO: 534735 - DNA, 25 bp, Rattus norvegicus
tcaggaaaagcttccaagggacagg

SEQ ID NO: 534736 - DNA, 25 bp, Rattus norvegicus
gggaaagttcaaagcttcgaagcca

SEQ ID NO: 534737 - DNA, 25 bp, Rattus norvegicus
gcagactgcttaactccccttggag

SEQ ID NO: 534738 - DNA, 25 bp, Rattus norvegicus
gttggccaatgaaaaggagacattc

SEQ ID NO: 534739 - DNA, 25 bp, Rattus norvegicus
ccagggagcggttggccaatgaaaa

SEQ ID NO: 534740 - DNA, 25 bp, Rattus norvegicus
tctagctcacctgcccgcaggagag

SEQ ID NO: 534741 - DNA, 25 bp, Rattus norvegicus
ttaggaagtccgcagccgggaagcc

SEQ ID NO: 534742 - DNA, 25 bp, Rattus norvegicus
aagcttccaagggacaggggcacgc

SEQ ID NO: 534743 - DNA, 25 bp, Rattus norvegicus
gcaccagagccaaccataatcgatg

SEQ ID NO: 534744 - DNA, 25 bp, Rattus norvegicus
gtgctatggagttccttctgcccaa

SEQ ID NO: 534745 - DNA, 25 bp, Rattus norvegicus
cgccattatgtgctcctggggattg

SEQ ID NO: 534746 - DNA, 25 bp, Rattus norvegicus
tctcatattgtgcacgacttctttc

SEQ ID NO: 534747 - DNA, 25 bp, Rattus norvegicus
gatgacgcatttccagcaccagagc

SEQ ID NO: 534748 - DNA, 25 bp, Rattus norvegicus
ggactagttcactcaccgatacgca

SEQ ID NO: 534749 - DNA, 25 bp, Rattus norvegicus
acgcaaccgcgacgttcacctaggg

SEQ ID NO: 534750 - DNA, 25 bp, Rattus norvegicus
ggggccaccagcaataactgttata

SEQ ID NO: 534751 - DNA, 25 bp, Rattus norvegicus
ctgttataacgaaccgcggcttccg

SEQ ID NO: 534752 - DNA, 25 bp, Rattus norvegicus
gacttctttcgactcgtgctatgga

SEQ ID NO: 534753 - DNA, 25 bp, Rattus norvegicus
cgttgagcgctccagtttaacttca

SEQ ID NO: 534754 - DNA, 25 bp, Rattus norvegicus
ttgccactcactgcaagtctcgctg

SEQ ID NO: 534755 - DNA, 25 bp, Rattus norvegicus
gtctcgctgcagtacgtcactgata

SEQ ID NO: 534756 - DNA, 25 bp, Rattus norvegicus
gataaaggcctcataccgcagcact

SEQ ID NO: 534757 - DNA, 25 bp, Rattus norvegicus
ggtctccaagtcataggtttacgtg

SEQ ID NO: 534758 - DNA, 25 bp, Rattus norvegicus
gaatcgagtgtggtgacttgcgacc

SEQ ID NO: 534759 - DNA, 25 bp, Rattus norvegicus
ccggttcaacctggccggagtcgct

SEQ ID NO: 534760 - DNA, 25 bp, Rattus norvegicus
taggctgaggcacacgcacccttct

SEQ ID NO: 534761 - DNA, 25 bp, Rattus norvegicus
ccgtcccagggtctgagacaccggt

SEQ ID NO: 534762 - DNA, 25 bp, Rattus norvegicus
gcgccatcgacgtacctgaggttca

SEQ ID NO: 534763 - DNA, 25 bp, Rattus norvegicus
cagtgccaggcttgtgaaagcccta

SEQ ID NO: 534764 - DNA, 25 bp, Rattus norvegicus
tcacgcaggcaaacttttcgaggtc

SEQ ID NO: 534765 - DNA, 25 bp, Rattus norvegicus
gtctcctcacagtccctaggctgag

SEQ ID NO: 534766 - DNA, 25 bp, Rattus norvegicus
ttctgcttgtgacctcaggagcccg

SEQ ID NO: 534767 - DNA, 25 bp, Rattus norvegicus
cagggctgacggaaagcgccttccc

SEQ ID NO: 534768 - DNA, 25 bp, Rattus norvegicus
tccacagaacctacgctgtccaggg

SEQ ID NO: 534769 - DNA, 25 bp, Rattus norvegicus
tctgccctcaggctttgcgatcggc

SEQ ID NO: 534770 - DNA, 25 bp, Rattus norvegicus
cgtgtcccaaaaagcggcgccatcg

SEQ ID NO: 534771 - DNA, 25 bp, Rattus norvegicus
gggaagtcccacacaatatctcgtg

SEQ ID NO: 534772 - DNA, 25 bp, Rattus norvegicus
tccgatggcttgatacctcggccgc

SEQ ID NO: 534773 - DNA, 25 bp, Rattus norvegicus
accactagcactccgcggtaccgag

SEQ ID NO: 534774 - DNA, 25 bp, Rattus norvegicus
tggcactccgatggcttgatacctc

SEQ ID NO: 534775 - DNA, 25 bp, Rattus norvegicus
ccctggcactccgatggcttgatac

SEQ ID NO: 534776 - DNA, 25 bp, Rattus norvegicus
cggtaccctggcactccgatggctt

SEQ ID NO: 534777 - DNA, 25 bp, Rattus norvegicus
ttctggaaggcggtaccctggcact

SEQ ID NO: 534778 - DNA, 25 bp, Rattus norvegicus
agctatcctggggattctggaaggc

SEQ ID NO: 534779 - DNA, 25 bp, Rattus norvegicus
ctcgtggagctatcctggggattct

SEQ ID NO: 534780 - DNA, 25 bp, Rattus norvegicus
gcttctcggcgggaagtcccacaca

SEQ ID NO: 534781 - DNA, 25 bp, Rattus norvegicus
ggcgggaagtcccacacaatatctc

SEQ ID NO: 534782 - DNA, 25 bp, Rattus norvegicus
cacacaatatctcgtggagctatcc

SEQ ID NO: 534783 - DNA, 25 bp, Rattus norvegicus
atatctcgtggagctatcctgggga

SEQ ID NO: 534784 - DNA, 25 bp, Rattus norvegicus
tctcggcgggaagtcccacacaata

SEQ ID NO: 534785 - DNA, 25 bp, Rattus norvegicus
aacatttcggcgaccgctcctagga

SEQ ID NO: 534786 - DNA, 25 bp, Rattus norvegicus
gcctccggatttgcaagtttccacg

SEQ ID NO: 534787 - DNA, 25 bp, Rattus norvegicus
gccgcattgcaattggtcccacagc

SEQ ID NO: 534788 - DNA, 25 bp, Rattus norvegicus
gttggcgcatgcgtccagctgccca

SEQ ID NO: 534789 - DNA, 25 bp, Rattus norvegicus
ccctactgcgcaggcgtaatactca

SEQ ID NO: 534790 - DNA, 25 bp, Rattus norvegicus
actgaggctggaaccctactgcgca

SEQ ID NO: 534791 - DNA, 25 bp, Rattus norvegicus
tggatagagaaaccggcccgctaga

SEQ ID NO: 534792 - DNA, 25 bp, Rattus norvegicus
cacacaccgccgaaggggtcaaaca

SEQ ID NO: 534793 - DNA, 25 bp, Rattus norvegicus
tccacgagttagtgacgctgtatta

SEQ ID NO: 534794 - DNA, 25 bp, Rattus norvegicus
tttctgcttgaaagcacccgccagg

SEQ ID NO: 534795 - DNA, 25 bp, Rattus norvegicus
caccaagggcaccagtttctgcttg

SEQ ID NO: 534796 - DNA, 25 bp, Rattus norvegicus
cccgagtggacattggatagagaaa

SEQ ID NO: 534797 - DNA, 25 bp, Rattus norvegicus
gttcctctgtttcggcctctggacg

SEQ ID NO: 534798 - DNA, 25 bp, Rattus norvegicus
gcgtaatactcagcgccgcattgca

SEQ ID NO: 534799 - DNA, 25 bp, Rattus norvegicus
gcttccaaagcaacagcacgtcgta

SEQ ID NO: 534800 - DNA, 25 bp, Rattus norvegicus
ttccaaagcaacagcacgtcgtacc

SEQ ID NO: 534801 - DNA, 25 bp, Rattus norvegicus
acatgtttaacaagcaccgtccgcc

SEQ ID NO: 534802 - DNA, 25 bp, Rattus norvegicus
ggcggcgggttccagacatgtttaa

SEQ ID NO: 534803 - DNA, 25 bp, Rattus norvegicus
cacgtcgtaccttggacacgccggg

SEQ ID NO: 534804 - DNA, 25 bp, Rattus norvegicus
aacagcacgtcgtaccttggacacg

SEQ ID NO: 534805 - DNA, 25 bp, Rattus norvegicus
caccaacgggctcgggccgatcaga

SEQ ID NO: 534806 - DNA, 25 bp, Rattus norvegicus
cgccggccctctgcttccaaagcaa

SEQ ID NO: 534807 - DNA, 25 bp, Rattus norvegicus
agaagcccacggaggttgcgcgccg

SEQ ID NO: 534808 - DNA, 25 bp, Rattus norvegicus
tcccttcacgcgactaggggcaggg

SEQ ID NO: 534809 - DNA, 25 bp, Rattus norvegicus
actgggcgcaccagctcccttcacg

SEQ ID NO: 534810 - DNA, 25 bp, Rattus norvegicus
gccgatcagactgggcgcaccagct

SEQ ID NO: 534811 - DNA, 25 bp, Rattus norvegicus
ctcgggccgatcagactgggcgcac

SEQ ID NO: 534812 - DNA, 25 bp, Rattus norvegicus
aagcaacagcacgtcgtaccttgga

SEQ ID NO: 534813 - DNA, 25 bp, Rattus norvegicus
gcggctactttcctcacctctgaag

SEQ ID NO: 534814 - DNA, 25 bp, Rattus norvegicus
ccgaaacaagatggtgggccacgca

SEQ ID NO: 534815 - DNA, 25 bp, Rattus norvegicus
tcctcacctctgaagccgggaggcg

SEQ ID NO: 534816 - DNA, 25 bp, Rattus norvegicus
ctgggcgcatatcgcggctactttc

SEQ ID NO: 534817 - DNA, 25 bp, Rattus norvegicus
gcacggaagccctgggcgcatatcg

SEQ ID NO: 534818 - DNA, 25 bp, Rattus norvegicus
tctctactatccagggcacggaagc

SEQ ID NO: 534819 - DNA, 25 bp, Rattus norvegicus
cttcgggtctctactatccagggca

SEQ ID NO: 534820 - DNA, 25 bp, Rattus norvegicus
gccacgcacgatcgggcttcgggtc

SEQ ID NO: 534821 - DNA, 25 bp, Rattus norvegicus
cgaggccacccatgcacagtccagg

SEQ ID NO: 534822 - DNA, 25 bp, Rattus norvegicus
attcgcgttgctcaggcgaccttcc

SEQ ID NO: 534823 - DNA, 25 bp, Rattus norvegicus
cagcccaagattcgcgttgctcagg

SEQ ID NO: 534824 - DNA, 25 bp, Rattus norvegicus
ggcttacccagaccgctgcaggacg

SEQ ID NO: 534825 - DNA, 25 bp, Rattus norvegicus
cgcggagtggcttacccagaccgct

SEQ ID NO: 534826 - DNA, 25 bp, Rattus norvegicus
cgatcgccaggagcagcccaagatt

SEQ ID NO: 534827 - DNA, 25 bp, Rattus norvegicus
cggagcgcgaagatgcgaatatgaa

SEQ ID NO: 534828 - DNA, 25 bp, Rattus norvegicus
tgagaaagcgcgtttgcgttactgc

SEQ ID NO: 534829 - DNA, 25 bp, Rattus norvegicus
gtttgcgttactgcgcatgtgccga

SEQ ID NO: 534830 - DNA, 25 bp, Rattus norvegicus
cgcatgtgccgaggcttagcgcgcc

SEQ ID NO: 534831 - DNA, 25 bp, Rattus norvegicus
tggctccaatctgagctgagtgttc

SEQ ID NO: 534832 - DNA, 25 bp, Rattus norvegicus
gttgcgcgcgcgcttcggagcctca

SEQ ID NO: 534833 - DNA, 25 bp, Rattus norvegicus
ctgatgtcttaagagcggagcgcga

SEQ ID NO: 534834 - DNA, 25 bp, Rattus norvegicus
gatgcgaatatgaagtaaggattta

SEQ ID NO: 534835 - DNA, 25 bp, Rattus norvegicus
ccctggagcaaaagcgtgagaaagc

SEQ ID NO: 534836 - DNA, 25 bp, Rattus norvegicus
ctccatttccgttggctccaatctg

SEQ ID NO: 534837 - DNA, 25 bp, Rattus norvegicus
taaggatttagtttctctgaggaca

SEQ ID NO: 534838 - DNA, 25 bp, Rattus norvegicus
atggattgaggagggccgcccataa

SEQ ID NO: 534839 - DNA, 25 bp, Rattus norvegicus
gcctcacccggaagctgatgtctta

SEQ ID NO: 534840 - DNA, 25 bp, Rattus norvegicus
aatctgagctgagtgttcgggttgc

SEQ ID NO: 534841 - DNA, 25 bp, Rattus norvegicus
tgccttttcgcatcggcctttgagc

SEQ ID NO: 534842 - DNA, 25 bp, Rattus norvegicus
ctaatggctccgcagaacgcggggc

SEQ ID NO: 534843 - DNA, 25 bp, Rattus norvegicus
ctacttagagcagtccttgcggggc

SEQ ID NO: 534844 - DNA, 25 bp, Rattus norvegicus
tgccgggcactcagcacgagttatg

SEQ ID NO: 534845 - DNA, 25 bp, Rattus norvegicus
gtggatgctggactgccttttcgca

SEQ ID NO: 534846 - DNA, 25 bp, Rattus norvegicus
caccttgtcgcagtgctggggtgct

SEQ ID NO: 534847 - DNA, 25 bp, Rattus norvegicus
ctcctttcccgctggcttttagcta

SEQ ID NO: 534848 - DNA, 25 bp, Rattus norvegicus
cccgctggcttttagctaattattc

SEQ ID NO: 534849 - DNA, 25 bp, Rattus norvegicus
ttattcttggctcaagggactgccc

SEQ ID NO: 534850 - DNA, 25 bp, Rattus norvegicus
gtcgaggacccgcataaatcaacta

SEQ ID NO: 534851 - DNA, 25 bp, Rattus norvegicus
atcaactagctttgccgggaactca

SEQ ID NO: 534852 - DNA, 25 bp, Rattus norvegicus
ccgggaactcagagcaatcgcacta

SEQ ID NO: 534853 - DNA, 25 bp, Rattus norvegicus
gcaatcgcactaatggctccgcaga

SEQ ID NO: 534854 - DNA, 25 bp, Rattus norvegicus
tcagcacgagttatggcgtggatgc

SEQ ID NO: 534855 - DNA, 25 bp, Rattus norvegicus
gatttggcgccgagacacagccagg

SEQ ID NO: 534856 - DNA, 25 bp, Rattus norvegicus
gaccaggtacaggacacgatttcta

SEQ ID NO: 534857 - DNA, 25 bp, Rattus norvegicus
aagacctcaggggtatgcgcacaga

SEQ ID NO: 534858 - DNA, 25 bp, Rattus norvegicus
tgcgcacagatttggctgcgggctc

SEQ ID NO: 534859 - DNA, 25 bp, Rattus norvegicus
cgctcccttaagactgggaagtgca

SEQ ID NO: 534860 - DNA, 25 bp, Rattus norvegicus
agctaggactgctaggcgcgcaccc

SEQ ID NO: 534861 - DNA, 25 bp, Rattus norvegicus
cacagccaggtgtcgccgattctct

SEQ ID NO: 534862 - DNA, 25 bp, Rattus norvegicus
ttctctcaccgcagcagagggagcg

SEQ ID NO: 534863 - DNA, 25 bp, Rattus norvegicus
cgcgtgagcgcttccgcagtaactt

SEQ ID NO: 534864 - DNA, 25 bp, Rattus norvegicus
agtaacttggcgaccctcacccgtg

SEQ ID NO: 534865 - DNA, 25 bp, Rattus norvegicus
cctcgcctgttgcatgatcgggagc

SEQ ID NO: 534866 - DNA, 25 bp, Rattus norvegicus
ctggcagtcaccactgcgggatttg

SEQ ID NO: 534867 - DNA, 25 bp, Rattus norvegicus
ccctgatgcagccagaactgagtga

SEQ ID NO: 534868 - DNA, 25 bp, Rattus norvegicus
agagacacgcgccaacctgggcaaa

SEQ ID NO: 534869 - DNA, 25 bp, Rattus norvegicus
ggaatgagcctactctgcccagaga

SEQ ID NO: 534870 - DNA, 25 bp, Rattus norvegicus
agttctggtgaacgagcttacccgc

SEQ ID NO: 534871 - DNA, 25 bp, Rattus norvegicus
tgaacgagcttacccgccgcaagca

SEQ ID NO: 534872 - DNA, 25 bp, Rattus norvegicus
cgcaagcaacgggaactgacagaca

SEQ ID NO: 534873 - DNA, 25 bp, Rattus norvegicus
cgggaactgacagacaacatgcagg

SEQ ID NO: 534874 - DNA, 25 bp, Rattus norvegicus
tgaagatatcaacggttccactgga

SEQ ID NO: 534875 - DNA, 25 bp, Rattus norvegicus
gtgcagagaatgtttggacgcatga

SEQ ID NO: 534876 - DNA, 25 bp, Rattus norvegicus
tttggacgcatgaggcgctttttca

SEQ ID NO: 534877 - DNA, 25 bp, Rattus norvegicus
ttcagtcgcaggaggaatgagccta

SEQ ID NO: 534878 - DNA, 25 bp, Rattus norvegicus
ccagagagttcactcgccgtgggcg

SEQ ID NO: 534879 - DNA, 25 bp, Rattus norvegicus
agacaacatgcaggttgaagatatc

SEQ ID NO: 534880 - DNA, 25 bp, Rattus norvegicus
tatccgcctggaagaagttctggtg

SEQ ID NO: 534881 - DNA, 25 bp, Rattus norvegicus
atgaggcgctttttcagtcgcagga

SEQ ID NO: 534882 - DNA, 25 bp, Rattus norvegicus
tccactggacgtcgtcgtcggggaa

SEQ ID NO: 534883 - DNA, 25 bp, Rattus norvegicus
ctctgcattcaggaagaggagcggc

SEQ ID NO: 534884 - DNA, 25 bp, Rattus norvegicus
agcagcgccgcgaaccgctcacctc

SEQ ID NO: 534885 - DNA, 25 bp, Rattus norvegicus
agcgtcagagaggtaaactgagtcc

SEQ ID NO: 534886 - DNA, 25 bp, Rattus norvegicus
aactgtccgaaagctaggcgggcga

SEQ ID NO: 534887 - DNA, 25 bp, Rattus norvegicus
aagaggagcggcaccgcaactgtcc

SEQ ID NO: 534888 - DNA, 25 bp, Rattus norvegicus
acgcacagctctgcattcaggaaga

SEQ ID NO: 534889 - DNA, 25 bp, Rattus norvegicus
cgcacgcacagctctgcattcagga

SEQ ID NO: 534890 - DNA, 25 bp, Rattus norvegicus
ggtcccagccactgccgcacgcaca

SEQ ID NO: 534891 - DNA, 25 bp, Rattus norvegicus
agagccgcatcactggagcccaggt

SEQ ID NO: 534892 - DNA, 25 bp, Rattus norvegicus
cgaggcgcagcagagccgcatcact

SEQ ID NO: 534893 - DNA, 25 bp, Rattus norvegicus
tcctaaagcggcgaggcgcagcaga

SEQ ID NO: 534894 - DNA, 25 bp, Rattus norvegicus
acctcctcttcctaaagcggcgagg

SEQ ID NO: 534895 - DNA, 25 bp, Rattus norvegicus
ggccgcctcccagcctaggcgttcg

SEQ ID NO: 534896 - DNA, 25 bp, Rattus norvegicus
cggcaccgcaactgtccgaaagcta

SEQ ID NO: 534897 - DNA, 25 bp, Rattus norvegicus
ttctgtcaagacaaggccatggcca

SEQ ID NO: 534898 - DNA, 25 bp, Rattus norvegicus
agggtttccctgacacactggttga

SEQ ID NO: 534899 - DNA, 25 bp, Rattus norvegicus
tccagtgccttcacgcctgaagcgg

SEQ ID NO: 534900 - DNA, 25 bp, Rattus norvegicus
ttcggggaaacctacagctccagtg

SEQ ID NO: 534901 - DNA, 25 bp, Rattus norvegicus
caatggccttgagaaagggcgcttc

SEQ ID NO: 534902 - DNA, 25 bp, Rattus norvegicus
acctcttcttcagggcgagccgggt

SEQ ID NO: 534903 - DNA, 25 bp, Rattus norvegicus
tggggaaagtcccacctcttcttca

SEQ ID NO: 534904 - DNA, 25 bp, Rattus norvegicus
gagactggacgcgttcacttccggt

SEQ ID NO: 534905 - DNA, 25 bp, Rattus norvegicus
ctggccttgctgctagcggacggac

SEQ ID NO: 534906 - DNA, 25 bp, Rattus norvegicus
agccgcccaggaggttctgtcaaga

SEQ ID NO: 534907 - DNA, 25 bp, Rattus norvegicus
cgcgttaggagtcgcctgacctcca

SEQ ID NO: 534908 - DNA, 25 bp, Rattus norvegicus
atgcccttcctataggaacccaagg

SEQ ID NO: 534909 - DNA, 25 bp, Rattus norvegicus
atgggatgctgatgcccttcctata

SEQ ID NO: 534910 - DNA, 25 bp, Rattus norvegicus
gccgcagggactccagttgaaccca

SEQ ID NO: 534911 - DNA, 25 bp, Rattus norvegicus
cccgccttaagtatggagccagcct

SEQ ID NO: 534912 - DNA, 25 bp, Rattus norvegicus
gataggaagacgaccctcaactggc

SEQ ID NO: 534913 - DNA, 25 bp, Rattus norvegicus
actgccgacgcaactgaagatagga

SEQ ID NO: 534914 - DNA, 25 bp, Rattus norvegicus
gctgtgtctctctgtcctcagcaga

SEQ ID NO: 534915 - DNA, 25 bp, Rattus norvegicus
ttgatccaggtctggcattgcctcg

SEQ ID NO: 534916 - DNA, 25 bp, Rattus norvegicus
ccgatttggcgccactgttgatcca

SEQ ID NO: 534917 - DNA, 25 bp, Rattus norvegicus
ccagctttcgccagctcgcagtgga

SEQ ID NO: 534918 - DNA, 25 bp, Rattus norvegicus
cgcaccgcttcatcctcagaatttg

SEQ ID NO: 534919 - DNA, 25 bp, Rattus norvegicus
tgcagtcccgactcccatggtcatt

SEQ ID NO: 534920 - DNA, 25 bp, Rattus norvegicus
tcaactggcacttccggattctgtc

SEQ ID NO: 534921 - DNA, 25 bp, Rattus norvegicus
cttcgagtactcgtaggccgttcct

SEQ ID NO: 534922 - DNA, 25 bp, Rattus norvegicus
ccgacgcaacgtttcgtaacacacg

SEQ ID NO: 534923 - DNA, 25 bp, Rattus norvegicus
cttccctaaaggttgagattcattc

SEQ ID NO: 534924 - DNA, 25 bp, Rattus norvegicus
gacgccaccaagctcgctgggttca

SEQ ID NO: 534925 - DNA, 25 bp, Rattus norvegicus
caatttggtttttgaggctcccgca

SEQ ID NO: 534926 - DNA, 25 bp, Rattus norvegicus
ccgcgctcgcaaccgtttggttcag

SEQ ID NO: 534927 - DNA, 25 bp, Rattus norvegicus
tttggttcagtccactcggagcaca

SEQ ID NO: 534928 - DNA, 25 bp, Rattus norvegicus
gagcgccttagctctctggccgcag

SEQ ID NO: 534929 - DNA, 25 bp, Rattus norvegicus
aggagcaggcacgaggctctcgcca

SEQ ID NO: 534930 - DNA, 25 bp, Rattus norvegicus
gctctcgccaccgaggctcgtggtt

SEQ ID NO: 534931 - DNA, 25 bp, Rattus norvegicus
gtcagaggcatgtcctaggttctcc

SEQ ID NO: 534932 - DNA, 25 bp, Rattus norvegicus
ttagcactcggccattccacagaga

SEQ ID NO: 534933 - DNA, 25 bp, Rattus norvegicus
tgaggctcccgcaaggcaactcacg

SEQ ID NO: 534934 - DNA, 25 bp, Rattus norvegicus
ggcaactcacgccaaactcctggag

SEQ ID NO: 534935 - DNA, 25 bp, Rattus norvegicus
aaactcctggagttgccggcaaccg

SEQ ID NO: 534936 - DNA, 25 bp, Rattus norvegicus
tcaccaagaggacgactccggcggc

SEQ ID NO: 534937 - DNA, 25 bp, Rattus norvegicus
ctgcgaggacgccacgcgcaggaac

SEQ ID NO: 534938 - DNA, 25 bp, Rattus norvegicus
tctggctcacactttagcactcggc

SEQ ID NO: 534939 - DNA, 25 bp, Rattus norvegicus
cggcaccctggaactttgagccttg

SEQ ID NO: 534940 - DNA, 25 bp, Rattus norvegicus
cctggccaagggaccgaaaatcttg

SEQ ID NO: 534941 - DNA, 25 bp, Rattus norvegicus
gctggcattctgtgccggggcacac

SEQ ID NO: 534942 - DNA, 25 bp, Rattus norvegicus
gcaccgcggtcagttgcgcgctcaa

SEQ ID NO: 534943 - DNA, 25 bp, Rattus norvegicus
tttgcaagcagaggcagcgcagccc

SEQ ID NO: 534944 - DNA, 25 bp, Rattus norvegicus
cgggctgcctgactttgcaagcaga

SEQ ID NO: 534945 - DNA, 25 bp, Rattus norvegicus
tgcccaccaggtggcctctagaagt

SEQ ID NO: 534946 - DNA, 25 bp, Rattus norvegicus
tgcgcgagctgcagaccctaaacgc

SEQ ID NO: 534947 - DNA, 25 bp, Rattus norvegicus
tcgttacgtcaatcccgcagcacgg

SEQ ID NO: 534948 - DNA, 25 bp, Rattus norvegicus
tttctcatccatgttcccgacgctg

SEQ ID NO: 534949 - DNA, 25 bp, Rattus norvegicus
caccaaagccagcagcagcttgtta

SEQ ID NO: 534950 - DNA, 25 bp, Rattus norvegicus
cacggcaaataggaagagcatcacc

SEQ ID NO: 534951 - DNA, 25 bp, Rattus norvegicus
gcacacgtattggaggacgatcacg

SEQ ID NO: 534952 - DNA, 25 bp, Rattus norvegicus
tcttggagaagatcgcactgagcac

SEQ ID NO: 534953 - DNA, 25 bp, Rattus norvegicus
gcatgcctgcctatcttcagaaata

SEQ ID NO: 534954 - DNA, 25 bp, Rattus norvegicus
tcttcagaaataaacgccgctttcg

SEQ ID NO: 534955 - DNA, 25 bp, Rattus norvegicus
ataaacgccgctatctggactcaga

SEQ ID NO: 534956 - DNA, 25 bp, Rattus norvegicus
tctggactcagaacacggaaatagc

SEQ ID NO: 534957 - DNA, 25 bp, Rattus norvegicus
cacggaaatagcgtcatcgagctgc

SEQ ID NO: 534958 - DNA, 25 bp, Rattus norvegicus
agcgtcatcgagctgcgcgtcatca

SEQ ID NO: 534959 - DNA, 25 bp, Rattus norvegicus
tcgagctgcgcgtcatcaagccaca

SEQ ID NO: 534960 - DNA, 25 bp, Rattus norvegicus
ggaaaagcggctcaaccactcggga

SEQ ID NO: 534961 - DNA, 25 bp, Rattus norvegicus
gccaaccaagttttgcggcagaagc

SEQ ID NO: 534962 - DNA, 25 bp, Rattus norvegicus
cctgcccagtggaaaagcggctcaa

SEQ ID NO: 534963 - DNA, 25 bp, Rattus norvegicus
ttttgcggcagaagcggttggccac

SEQ ID NO: 534964 - DNA, 25 bp, Rattus norvegicus
gtcgtttcgcatgcctgcctatctt

SEQ ID NO: 534965 - DNA, 25 bp, Rattus norvegicus
gaaaggcgcctgcaaaagcaaaagc

SEQ ID NO: 534966 - DNA, 25 bp, Rattus norvegicus
cggctcaaccactcgggaaaggcgc

SEQ ID NO: 534967 - DNA, 25 bp, Rattus norvegicus
agctctgccgctgattgactggccc

SEQ ID NO: 534968 - DNA, 25 bp, Rattus norvegicus
ggttaggattcccacttaccattga

SEQ ID NO: 534969 - DNA, 25 bp, Rattus norvegicus
ttgaagcctttggacacgtagagac

SEQ ID NO: 534970 - DNA, 25 bp, Rattus norvegicus
tagagacgtcgcacttccgaacaac

SEQ ID NO: 534971 - DNA, 25 bp, Rattus norvegicus
agaagcgcgagcaagcctaaccgtg

SEQ ID NO: 534972 - DNA, 25 bp, Rattus norvegicus
ccacctttaggggacagaatgagac

SEQ ID NO: 534973 - DNA, 25 bp, Rattus norvegicus
tgagactggatgcaaagcagcgctg

SEQ ID NO: 534974 - DNA, 25 bp, Rattus norvegicus
caaagaggcgcggagtcaacactca

SEQ ID NO: 534975 - DNA, 25 bp, Rattus norvegicus
tgacctcgggactctgaaggctaga

SEQ ID NO: 534976 - DNA, 25 bp, Rattus norvegicus
gtttctccctctaggctacctggtg

SEQ ID NO: 534977 - DNA, 25 bp, Rattus norvegicus
ggcttgcacagcgaggctccgcaaa

SEQ ID NO: 534978 - DNA, 25 bp, Rattus norvegicus
acaacttttcgacttgggctccgca

SEQ ID NO: 534979 - DNA, 25 bp, Rattus norvegicus
gactaggaaaaggatcggtgacctc

SEQ ID NO: 534980 - DNA, 25 bp, Rattus norvegicus
ctaaccgtgccatggtgcggaccct

SEQ ID NO: 534981 - DNA, 25 bp, Rattus norvegicus
gaatctgagaggtcatggctgatcc

SEQ ID NO: 534982 - DNA, 25 bp, Rattus norvegicus
acttcggtggaataattctgacgaa

SEQ ID NO: 534983 - DNA, 25 bp, Rattus norvegicus
agagaggtaggtgtaagaggcccgc

SEQ ID NO: 534984 - DNA, 25 bp, Rattus norvegicus
ttccacttcggtggaataattctga

SEQ ID NO: 534985 - DNA, 25 bp, Rattus norvegicus
tccacttcggtggaataattctgac

SEQ ID NO: 534986 - DNA, 25 bp, Rattus norvegicus
ccagagagaggtaggtgtaagaggc

SEQ ID NO: 534987 - DNA, 25 bp, Rattus norvegicus
ccacttcggtggaataattctgacg

SEQ ID NO: 534988 - DNA, 25 bp, Rattus norvegicus
cacttcggtggaataattctgacga

SEQ ID NO: 534989 - DNA, 25 bp, Rattus norvegicus
cggtggaataattctgacgaatctg

SEQ ID NO: 534990 - DNA, 25 bp, Rattus norvegicus
ggtggaataattctgacgaatctga

SEQ ID NO: 534991 - DNA, 25 bp, Rattus norvegicus
cgaatctgagaggtcatggctgatc

SEQ ID NO: 534992 - DNA, 25 bp, Rattus norvegicus
ctggctggtcctaggagccgaaggc

SEQ ID NO: 534993 - DNA, 25 bp, Rattus norvegicus
ttcggtggaataattctgacgaatc

SEQ ID NO: 534994 - DNA, 25 bp, Rattus norvegicus
tggaataattctgacgaatctgaga

SEQ ID NO: 534995 - DNA, 25 bp, Rattus norvegicus
tggctttccactgtgcgcggggaat

SEQ ID NO: 534996 - DNA, 25 bp, Rattus norvegicus
ctcagcaagtctggcagtagccttg

SEQ ID NO: 534997 - DNA, 25 bp, Rattus norvegicus
gcggtcccgagactcagcaagtctg

SEQ ID NO: 534998 - DNA, 25 bp, Rattus norvegicus
agagcacgagagagtggcaataaga

SEQ ID NO: 534999 - DNA, 25 bp, Rattus norvegicus
gtcccggccatcctgcttcttgggg

SEQ ID NO: 535000 - DNA, 25 bp, Rattus norvegicus
agcaagcacgcggtgcgcacggtcc

SEQ ID NO: 535001 - DNA, 25 bp, Rattus norvegicus
gtccgggctgcagtctctggaagaa

SEQ ID NO: 535002 - DNA, 25 bp, Rattus norvegicus
cacaggggtttctggaacccatttg

SEQ ID NO: 535003 - DNA, 25 bp, Rattus norvegicus
tgctcaagggacctctactcacctg

SEQ ID NO: 535004 - DNA, 25 bp, Rattus norvegicus
agcgcgctctgggaagagccaccac

SEQ ID NO: 535005 - DNA, 25 bp, Rattus norvegicus
tctctggaagaaagaacggacctgg

SEQ ID NO: 535006 - DNA, 25 bp, Rattus norvegicus
ttgcagagcaagagacgagccgcta

SEQ ID NO: 535007 - DNA, 25 bp, Rattus norvegicus
ggacctctactcacctggcacaggg

SEQ ID NO: 535008 - DNA, 25 bp, Rattus norvegicus
ggaacccatttgagtccgggctgca

SEQ ID NO: 535009 - DNA, 25 bp, Rattus norvegicus
gcatgcgcactacctcgcagctaga

SEQ ID NO: 535010 - DNA, 25 bp, Rattus norvegicus
gccacgtgcaggaagcccaccaaag

SEQ ID NO: 535011 - DNA, 25 bp, Rattus norvegicus
caccaaaggggacaacgcacagtta

SEQ ID NO: 535012 - DNA, 25 bp, Rattus norvegicus
ctcccagagtgtccgcacagcgata

SEQ ID NO: 535013 - DNA, 25 bp, Rattus norvegicus
ccgaagctggatgcctgggaaaagc

SEQ ID NO: 535014 - DNA, 25 bp, Rattus norvegicus
cgcccttcgcctttaatagcctagg

SEQ ID NO: 535015 - DNA, 25 bp, Rattus norvegicus
cacccggcccatacaggaattagga

SEQ ID NO: 535016 - DNA, 25 bp, Rattus norvegicus
cacagtgctccggtgacccatagga

SEQ ID NO: 535017 - DNA, 25 bp, Rattus norvegicus
ccacgggatgccagtcgaaaccagt

SEQ ID NO: 535018 - DNA, 25 bp, Rattus norvegicus
gaatggcggactcactactacctcg

SEQ ID NO: 535019 - DNA, 25 bp, Rattus norvegicus
ccacgcagttgtgggacccaggtgt

SEQ ID NO: 535020 - DNA, 25 bp, Rattus norvegicus
gaaagtgtccgtaaagcctgtaaga

SEQ ID NO: 535021 - DNA, 25 bp, Rattus norvegicus
cctcgcagctagattgaaagtgtcc

SEQ ID NO: 535022 - DNA, 25 bp, Rattus norvegicus
cactagagataggtgacgaggccca

SEQ ID NO: 535023 - DNA, 25 bp, Rattus norvegicus
tctcaacgtcctgtgggtcgtgtgc

SEQ ID NO: 535024 - DNA, 25 bp, Rattus norvegicus
cattgtcggtgctccctacagaggc

SEQ ID NO: 535025 - DNA, 25 bp, Rattus norvegicus
cccagaggcgccactcattgtcggt

SEQ ID NO: 535026 - DNA, 25 bp, Rattus norvegicus
tcgcggtggtctccttcattgtcag

SEQ ID NO: 535027 - DNA, 25 bp, Rattus norvegicus
aacagagctccgctcttcggcactg

SEQ ID NO: 535028 - DNA, 25 bp, Rattus norvegicus
cagcccgtctctcctcgaatgaaag

SEQ ID NO: 535029 - DNA, 25 bp, Rattus norvegicus
cccaaagcctaagccgggcggcaga

SEQ ID NO: 535030 - DNA, 25 bp, Rattus norvegicus
agaatagaaggtacgcgcgcgagca

SEQ ID NO: 535031 - DNA, 25 bp, Rattus norvegicus
cgaacctttcgaggggctggtctgt

SEQ ID NO: 535032 - DNA, 25 bp, Rattus norvegicus
ctggtctgtgcgcttgcgccatact

SEQ ID NO: 535033 - DNA, 25 bp, Rattus norvegicus
tgcgccatacttcggcggcttcaac

SEQ ID NO: 535034 - DNA, 25 bp, Rattus norvegicus
cagctcgttggccaatcagagtccc

SEQ ID NO: 535035 - DNA, 25 bp, Rattus norvegicus
ggcgcgctcgagacgtctcaacgtc

SEQ ID NO: 535036 - DNA, 25 bp, Rattus norvegicus
ccattctctgtctggcgggagaaga

SEQ ID NO: 535037 - DNA, 25 bp, Rattus norvegicus
accctcagtcccagcgtcgtggtga

SEQ ID NO: 535038 - DNA, 25 bp, Rattus norvegicus
agctctgcaagtttgggactcggcg

SEQ ID NO: 535039 - DNA, 25 bp, Rattus norvegicus
cagtcccagcgtcgtggtgagccag

SEQ ID NO: 535040 - DNA, 25 bp, Rattus norvegicus
ttggacttgacatgtgcggccagcg

SEQ ID NO: 535041 - DNA, 25 bp, Rattus norvegicus
cttcgggaatgatcccgcacgggga

SEQ ID NO: 535042 - DNA, 25 bp, Rattus norvegicus
ggttctgtcatgtcgaccctcagtc

SEQ ID NO: 535043 - DNA, 25 bp, Rattus norvegicus
tcagaccgcttttcccgcgagccga

SEQ ID NO: 535044 - DNA, 25 bp, Rattus norvegicus
ctgcttttcctagcggtagcacctc

SEQ ID NO: 535045 - DNA, 25 bp, Rattus norvegicus
cgttggacttacctcactgcttttc

SEQ ID NO: 535046 - DNA, 25 bp, Rattus norvegicus
gacgagcgttggacttacctcactg

SEQ ID NO: 535047 - DNA, 25 bp, Rattus norvegicus
cggcgaagacgagcgttggacttac

SEQ ID NO: 535048 - DNA, 25 bp, Rattus norvegicus
attcgtggcgtctctgaggtgttgt

SEQ ID NO: 535049 - DNA, 25 bp, Rattus norvegicus
tggaaatggcgttggacttgacatg

SEQ ID NO: 535050 - DNA, 25 bp, Rattus norvegicus
gaggcccagctctgcaagtttggga

SEQ ID NO: 535051 - DNA, 25 bp, Rattus norvegicus
tgcagtggccacgtacagagcctcg

SEQ ID NO: 535052 - DNA, 25 bp, Rattus norvegicus
gcagcagccctagaaaaagccggcc

SEQ ID NO: 535053 - DNA, 25 bp, Rattus norvegicus
gtggccacgtacagagcctcgtagc

SEQ ID NO: 535054 - DNA, 25 bp, Rattus norvegicus
ccattcgcctgctcactcggaggcc

SEQ ID NO: 535055 - DNA, 25 bp, Rattus norvegicus
tggccacgtacagagcctcgtagcc

SEQ ID NO: 535056 - DNA, 25 bp, Rattus norvegicus
cagtggccacgtacagagcctcgta

SEQ ID NO: 535057 - DNA, 25 bp, Rattus norvegicus
ccgtgcgagcgctcagcgccacagc

SEQ ID NO: 535058 - DNA, 25 bp, Rattus norvegicus
ggagcctgcagtggccacgtacaga

SEQ ID NO: 535059 - DNA, 25 bp, Rattus norvegicus
gcctgcagtggccacgtacagagcc

SEQ ID NO: 535060 - DNA, 25 bp, Rattus norvegicus
ctgcagtggccacgtacagagcctc

SEQ ID NO: 535061 - DNA, 25 bp, Rattus norvegicus
agcagccctagaaaaagccggcccg

SEQ ID NO: 535062 - DNA, 25 bp, Rattus norvegicus
agcgggagcagccagcgcccagtgg

SEQ ID NO: 535063 - DNA, 25 bp, Rattus norvegicus
ggccacgtacagagcctcgtagccg

SEQ ID NO: 535064 - DNA, 25 bp, Rattus norvegicus
ccgcagcagccctagaaaaagccgg

SEQ ID NO: 535065 - DNA, 25 bp, Rattus norvegicus
attggctctaatgacccgtgggacc

SEQ ID NO: 535066 - DNA, 25 bp, Rattus norvegicus
cccaaaatcttcctgcgtggcattg

SEQ ID NO: 535067 - DNA, 25 bp, Rattus norvegicus
atgcgccttacagctgctccaatgg

SEQ ID NO: 535068 - DNA, 25 bp, Rattus norvegicus
ttttgcctcccacgcttcagaaatg

SEQ ID NO: 535069 - DNA, 25 bp, Rattus norvegicus
aggcgtagtagcctctctccgcaaa

SEQ ID NO: 535070 - DNA, 25 bp, Rattus norvegicus
tgggaccctctggagctcaaactga

SEQ ID NO: 535071 - DNA, 25 bp, Rattus norvegicus
aggctctgcttctctctcttattgg

SEQ ID NO: 535072 - DNA, 25 bp, Rattus norvegicus
ctgcccgccttcaggaattagaaga

SEQ ID NO: 535073 - DNA, 25 bp, Rattus norvegicus
cctcagcgcagggatggcgcttttc

SEQ ID NO: 535074 - DNA, 25 bp, Rattus norvegicus
tccacatgctcagggtctctgtcca

SEQ ID NO: 535075 - DNA, 25 bp, Rattus norvegicus
cagcgctagcaacgaggacttgaca

SEQ ID NO: 535076 - DNA, 25 bp, Rattus norvegicus
agcgcggctcggctacatttacagt

SEQ ID NO: 535077 - DNA, 25 bp, Rattus norvegicus
aggggccagctcttccgcatcttgt

SEQ ID NO: 535078 - DNA, 25 bp, Rattus norvegicus
cgcatcttgtcgctcattgggcatt

SEQ ID NO: 535079 - DNA, 25 bp, Rattus norvegicus
tcccgctggaatccgggtgttcacg

SEQ ID NO: 535080 - DNA, 25 bp, Rattus norvegicus
gtcccagtagtcttcagccatggct

SEQ ID NO: 535081 - DNA, 25 bp, Rattus norvegicus
ctgcgtgtaccaaaagagccttctg

SEQ ID NO: 535082 - DNA, 25 bp, Rattus norvegicus
caaaagagccttctgtagcgggagg

SEQ ID NO: 535083 - DNA, 25 bp, Rattus norvegicus
ggcgcgcgagtaacctcagagccgc

SEQ ID NO: 535084 - DNA, 25 bp, Rattus norvegicus
tgttcacggcggctcgtgactcacg

SEQ ID NO: 535085 - DNA, 25 bp, Rattus norvegicus
tgactcacggcagacagctagcgga

SEQ ID NO: 535086 - DNA, 25 bp, Rattus norvegicus
cgcacgcacacgctgggaaaaaagg

SEQ ID NO: 535087 - DNA, 25 bp, Rattus norvegicus
ggagactcacctcggactgcgtgta

SEQ ID NO: 535088 - DNA, 25 bp, Rattus norvegicus
cgtgctcgcaagctcccgctggaat

SEQ ID NO: 535089 - DNA, 25 bp, Rattus norvegicus
catgagcttggccactgcgggcgat

SEQ ID NO: 535090 - DNA, 25 bp, Rattus norvegicus
gctcagccagccatgagcttggcca

SEQ ID NO: 535091 - DNA, 25 bp, Rattus norvegicus
cttcagccatggctgttgggcccgg

SEQ ID NO: 535092 - DNA, 25 bp, Rattus norvegicus
agctagcggagacgcagcagatccc

SEQ ID NO: 535093 - DNA, 25 bp, Rattus norvegicus
cacagtaaggacagcggggccacac

SEQ ID NO: 535094 - DNA, 25 bp, Rattus norvegicus
cggggccacacggtgcctcgagact

SEQ ID NO: 535095 - DNA, 25 bp, Rattus norvegicus
cacacggtgcctcgagactgcggcg

SEQ ID NO: 535096 - DNA, 25 bp, Rattus norvegicus
tgcggatcgagtgagcaaacgctcc

SEQ ID NO: 535097 - DNA, 25 bp, Rattus norvegicus
tgatgctcaacgtccgcctgcaggt

SEQ ID NO: 535098 - DNA, 25 bp, Rattus norvegicus
acatggtggcctccgtgatgctcaa

SEQ ID NO: 535099 - DNA, 25 bp, Rattus norvegicus
gccttttcgagccagacactgcgcg

SEQ ID NO: 535100 - DNA, 25 bp, Rattus norvegicus
ttcgagccagacactgcgcgcagct

SEQ ID NO: 535101 - DNA, 25 bp, Rattus norvegicus
tcctacagcgccttctgcaaggggc

SEQ ID NO: 535102 - DNA, 25 bp, Rattus norvegicus
ttctgcaaggggctcacacacacgc

SEQ ID NO: 535103 - DNA, 25 bp, Rattus norvegicus
aaggggctcacacacacgctgctca

SEQ ID NO: 535104 - DNA, 25 bp, Rattus norvegicus
tcaccttctaagacctgccctggcg

SEQ ID NO: 535105 - DNA, 25 bp, Rattus norvegicus
tcctggcggccacagtaaggacagc

SEQ ID NO: 535106 - DNA, 25 bp, Rattus norvegicus
ctacttctacatggtggcctccgtg

SEQ ID NO: 535107 - DNA, 25 bp, Rattus norvegicus
agggaccttaccctgcactgcagag

SEQ ID NO: 535108 - DNA, 25 bp, Rattus norvegicus
gcgcccttgcctctctgattggtca

SEQ ID NO: 535109 - DNA, 25 bp, Rattus norvegicus
tctcagggcacacctacatggcgtc

SEQ ID NO: 535110 - DNA, 25 bp, Rattus norvegicus
gagctacacgcctttgcctctgtga

SEQ ID NO: 535111 - DNA, 25 bp, Rattus norvegicus
ggttgttacacctacgtagccatta

SEQ ID NO: 535112 - DNA, 25 bp, Rattus norvegicus
ccacagattggtgcttgtactcagg

SEQ ID NO: 535113 - DNA, 25 bp, Rattus norvegicus
aggtctgtagcgcttaacttgtgca

SEQ ID NO: 535114 - DNA, 25 bp, Rattus norvegicus
gcgggaaccgctcacttatactctc

SEQ ID NO: 535115 - DNA, 25 bp, Rattus norvegicus
caggccacggatcagctggtaactg

SEQ ID NO: 535116 - DNA, 25 bp, Rattus norvegicus
acgggatattgactacacgcacgga

SEQ ID NO: 535117 - DNA, 25 bp, Rattus norvegicus
tgcgtgtttgcaactaacccggatc

SEQ ID NO: 535118 - DNA, 25 bp, Rattus norvegicus
tgaccaagccttataccacagattg

SEQ ID NO: 535119 - DNA, 25 bp, Rattus norvegicus
catagtgccggaaccgcttagcgca

SEQ ID NO: 535120 - DNA, 25 bp, Rattus norvegicus
gcgtgcaccagcctacaggtctgta

SEQ ID NO: 535121 - DNA, 25 bp, Rattus norvegicus
ccaagcgagaccaatgggaagatga

SEQ ID NO: 535122 - DNA, 25 bp, Rattus norvegicus
gtgagaacgcggaaaaaggaatgcc

SEQ ID NO: 535123 - DNA, 25 bp, Rattus norvegicus
gcgtccgcaaataagcacgggattt

SEQ ID NO: 535124 - DNA, 25 bp, Rattus norvegicus
tgcgcagtgcagtttccctaagaga

SEQ ID NO: 535125 - DNA, 25 bp, Rattus norvegicus
gaagatgaggtagagcgtccgcaaa

SEQ ID NO: 535126 - DNA, 25 bp, Rattus norvegicus
aagtgccggtagctgccagactcag

SEQ ID NO: 535127 - DNA, 25 bp, Rattus norvegicus
ggcacttacgctgcgcagctgaaaa

SEQ ID NO: 535128 - DNA, 25 bp, Rattus norvegicus
ttccacagcgatggcgccatgattc

SEQ ID NO: 535129 - DNA, 25 bp, Rattus norvegicus
gcgccatgattcagaaggagcggca

SEQ ID NO: 535130 - DNA, 25 bp, Rattus norvegicus
ggagcggcagcccaacaaaaggaga

SEQ ID NO: 535131 - DNA, 25 bp, Rattus norvegicus
ggcggctgaggtattccttctttca

SEQ ID NO: 535132 - DNA, 25 bp, Rattus norvegicus
ccacgcggcgcagaaacatgacgtc

SEQ ID NO: 535133 - DNA, 25 bp, Rattus norvegicus
catgacgtcaccaaagccctgggcg

SEQ ID NO: 535134 - DNA, 25 bp, Rattus norvegicus
acacggaaaaaggtcctgctgcctc

SEQ ID NO: 535135 - DNA, 25 bp, Rattus norvegicus
agagccatcggcaggacagcgccaa

SEQ ID NO: 535136 - DNA, 25 bp, Rattus norvegicus
ccctctggttgctcttcgcagtgag

SEQ ID NO: 535137 - DNA, 25 bp, Rattus norvegicus
cctcaccattctgacgatctggctt

SEQ ID NO: 535138 - DNA, 25 bp, Rattus norvegicus
cgggcccgcttcctgcacgaaaccg

SEQ ID NO: 535139 - DNA, 25 bp, Rattus norvegicus
cattctgacgatctggcttttcaag

SEQ ID NO: 535140 - DNA, 25 bp, Rattus norvegicus
cgccaacctgctcatcttcatcctg

SEQ ID NO: 535141 - DNA, 25 bp, Rattus norvegicus
acgaggagatcgtgtccgagaagca

SEQ ID NO: 535142 - DNA, 25 bp, Rattus norvegicus
acgaccagagccatggacgaggaga

SEQ ID NO: 535143 - DNA, 25 bp, Rattus norvegicus
ctctggacagctctgggggaacgac

SEQ ID NO: 535144 - DNA, 25 bp, Rattus norvegicus
tcgcagtgagcttctttggctgggc

SEQ ID NO: 535145 - DNA, 25 bp, Rattus norvegicus
ctttcccgtgagcccacggggagtg

SEQ ID NO: 535146 - DNA, 25 bp, Rattus norvegicus
actttaagagtggaggccctgctgg

SEQ ID NO: 535147 - DNA, 25 bp, Rattus norvegicus
ttgctcttcgcagtgagcttctttg

SEQ ID NO: 535148 - DNA, 25 bp, Rattus norvegicus
ggcactttaagagtggaggccctgc

SEQ ID NO: 535149 - DNA, 25 bp, Rattus norvegicus
catcgtgcacgcctagccggcagct

SEQ ID NO: 535150 - DNA, 25 bp, Rattus norvegicus
gccctacatcaaccgcccggccgag

SEQ ID NO: 535151 - DNA, 25 bp, Rattus norvegicus
tgagcatccccagacagtaagcccg

SEQ ID NO: 535152 - DNA, 25 bp, Rattus norvegicus
ccgctgcctgcagtgactcgtgact

SEQ ID NO: 535153 - DNA, 25 bp, Rattus norvegicus
tagccggcagctcggcctctcctga

SEQ ID NO: 535154 - DNA, 25 bp, Rattus norvegicus
gcgtgcccttcggacgctcacagag

SEQ ID NO: 535155 - DNA, 25 bp, Rattus norvegicus
tttccctccgcacgcgtgtgagtgt

SEQ ID NO: 535156 - DNA, 25 bp, Rattus norvegicus
tcggacgctcacagagggtgctccg

SEQ ID NO: 535157 - DNA, 25 bp, Rattus norvegicus
cgcggccacctctggcgcgcatcgt

SEQ ID NO: 535158 - DNA, 25 bp, Rattus norvegicus
gctttccctccgcacgcgtgtgagt

SEQ ID NO: 535159 - DNA, 25 bp, Rattus norvegicus
gtccctgccgcgctttgctctctga

SEQ ID NO: 535160 - DNA, 25 bp, Rattus norvegicus
agcggccgccggtgccgcctagaca

SEQ ID NO: 535161 - DNA, 25 bp, Rattus norvegicus
cctagacagctgcgcgggtgagcat

SEQ ID NO: 535162 - DNA, 25 bp, Rattus norvegicus
cccagcagccggtgaaggcctgagt

SEQ ID NO: 535163 - DNA, 25 bp, Rattus norvegicus
tcgcggacatatgacgccacgtggg

SEQ ID NO: 535164 - DNA, 25 bp, Rattus norvegicus
cattaagtatggacacgcggcggca

SEQ ID NO: 535165 - DNA, 25 bp, Rattus norvegicus
gcatttctgcaggttgcgtctctaa

SEQ ID NO: 535166 - DNA, 25 bp, Rattus norvegicus
aaggttcccgaggtgccacgcattt

SEQ ID NO: 535167 - DNA, 25 bp, Rattus norvegicus
cggcgaaattcgtccggagtgcaga

SEQ ID NO: 535168 - DNA, 25 bp, Rattus norvegicus
agagttccgcgtcctttttcaggca

SEQ ID NO: 535169 - DNA, 25 bp, Rattus norvegicus
acagccagctcgtctggaagagttc

SEQ ID NO: 535170 - DNA, 25 bp, Rattus norvegicus
ttcgcgaagcgggagaaacttgtcc

SEQ ID NO: 535171 - DNA, 25 bp, Rattus norvegicus
cgtctctaaggcgagttaccattaa

SEQ ID NO: 535172 - DNA, 25 bp, Rattus norvegicus
ctgaggcggacttcgttctcaaata

SEQ ID NO: 535173 - DNA, 25 bp, Rattus norvegicus
ttctcaaatagttgcctgacgtggc

SEQ ID NO: 535174 - DNA, 25 bp, Rattus norvegicus
ctggcagtttctagacgcatgcgtg

SEQ ID NO: 535175 - DNA, 25 bp, Rattus norvegicus
taccgcttagacttcccagggtctg

SEQ ID NO: 535176 - DNA, 25 bp, Rattus norvegicus
aatggcgaccgcatcagtctgaggc

SEQ ID NO: 535177 - DNA, 25 bp, Rattus norvegicus
gaggggcggctgcaactttgctcct

SEQ ID NO: 535178 - DNA, 25 bp, Rattus norvegicus
cgaaactggagagcccgctggtatg

SEQ ID NO: 535179 - DNA, 25 bp, Rattus norvegicus
ccaccagggcgaaactggagagccc

SEQ ID NO: 535180 - DNA, 25 bp, Rattus norvegicus
cggctgcaactttgctcctggacgc

SEQ ID NO: 535181 - DNA, 25 bp, Rattus norvegicus
ctgcaactttgctcctggacgcgtg

SEQ ID NO: 535182 - DNA, 25 bp, Rattus norvegicus
caactttgctcctggacgcgtgaga

SEQ ID NO: 535183 - DNA, 25 bp, Rattus norvegicus
ctttgctcctggacgcgtgagaagg

SEQ ID NO: 535184 - DNA, 25 bp, Rattus norvegicus
cggctgccaccagggcgaaactgga

SEQ ID NO: 535185 - DNA, 25 bp, Rattus norvegicus
ccagcccgtgccaaggctgcgggaa

SEQ ID NO: 535186 - DNA, 25 bp, Rattus norvegicus
ggctcgcccttcagagtcacggggc

SEQ ID NO: 535187 - DNA, 25 bp, Rattus norvegicus
tcgcccttcagagtcacggggctgc

SEQ ID NO: 535188 - DNA, 25 bp, Rattus norvegicus
ccttcagagtcacggggctgccgag

SEQ ID NO: 535189 - DNA, 25 bp, Rattus norvegicus
tgtccccagatggagctgggaccct

SEQ ID NO: 535190 - DNA, 25 bp, Rattus norvegicus
ccgagcggctgccaccagggcgaaa

SEQ ID NO: 535191 - DNA, 25 bp, Rattus norvegicus
ccgcagcttacctgttgctgcagga

SEQ ID NO: 535192 - DNA, 25 bp, Rattus norvegicus
gcacagcgccacaagctctgagctg

SEQ ID NO: 535193 - DNA, 25 bp, Rattus norvegicus
gcccgaacccagaggagctaagctg

SEQ ID NO: 535194 - DNA, 25 bp, Rattus norvegicus
gggcactgagcctatgcccgcacgt

SEQ ID NO: 535195 - DNA, 25 bp, Rattus norvegicus
gcgcgtgccaccttagttacctcta

SEQ ID NO: 535196 - DNA, 25 bp, Rattus norvegicus
gcggcttcttaaggcatcgcggtgc

SEQ ID NO: 535197 - DNA, 25 bp, Rattus norvegicus
tgtctggccacctttcggggcacag

SEQ ID NO: 535198 - DNA, 25 bp, Rattus norvegicus
atcgcggtgccctcaccttgaggcg

SEQ ID NO: 535199 - DNA, 25 bp, Rattus norvegicus
aaccagagcggaagcccgcagctta

SEQ ID NO: 535200 - DNA, 25 bp, Rattus norvegicus
tgtaggactcgctaaaaccagagcg

SEQ ID NO: 535201 - DNA, 25 bp, Rattus norvegicus
ctctagccttggcaaaggggtgctc

SEQ ID NO: 535202 - DNA, 25 bp, Rattus norvegicus
ccgtttgggatgtaggactcgctaa

SEQ ID NO: 535203 - DNA, 25 bp, Rattus norvegicus
tggtgacgcacgaggcccgaaccca

SEQ ID NO: 535204 - DNA, 25 bp, Rattus norvegicus
acaggcggctgcgagctcgcaccga

SEQ ID NO: 535205 - DNA, 25 bp, Rattus norvegicus
ggcggagcaaagagactgcactaaa

SEQ ID NO: 535206 - DNA, 25 bp, Rattus norvegicus
cgacgaaggcacaagtgacaaagta

SEQ ID NO: 535207 - DNA, 25 bp, Rattus norvegicus
ctcccactcgccttttggtcttgga

SEQ ID NO: 535208 - DNA, 25 bp, Rattus norvegicus
ctcgccttttggtcttggatgtggc

SEQ ID NO: 535209 - DNA, 25 bp, Rattus norvegicus
taaagacatgatttcaccgggcgcg

SEQ ID NO: 535210 - DNA, 25 bp, Rattus norvegicus
cgccagaggcagagaaagtgaacga

SEQ ID NO: 535211 - DNA, 25 bp, Rattus norvegicus
tagcagcggagcagtcgagaaagct

SEQ ID NO: 535212 - DNA, 25 bp, Rattus norvegicus
cgagaaagctcgagccctgcaaaaa

SEQ ID NO: 535213 - DNA, 25 bp, Rattus norvegicus
agtttaacggagctctggaatcctc

SEQ ID NO: 535214 - DNA, 25 bp, Rattus norvegicus
tctggaatcctcacctttcgccttg

SEQ ID NO: 535215 - DNA, 25 bp, Rattus norvegicus
tcacctttcgccttgctctggcagg

SEQ ID NO: 535216 - DNA, 25 bp, Rattus norvegicus
gccttgctctggcaggcggagcaaa

SEQ ID NO: 535217 - DNA, 25 bp, Rattus norvegicus
gagactgcactaaagacatgatttc

SEQ ID NO: 535218 - DNA, 25 bp, Rattus norvegicus
gcgagaggctctccaggagtttaac

SEQ ID NO: 535219 - DNA, 25 bp, Rattus norvegicus
tcacagcgggatctcttttctaaaa

SEQ ID NO: 535220 - DNA, 25 bp, Rattus norvegicus
ctggacgtgctggtaaaaatgcatc

SEQ ID NO: 535221 - DNA, 25 bp, Rattus norvegicus
ctgcggatcgcggtataaaagcaca

SEQ ID NO: 535222 - DNA, 25 bp, Rattus norvegicus
cagcggggtgagctgctttccaaaa

SEQ ID NO: 535223 - DNA, 25 bp, Rattus norvegicus
cccatcattcatttccctggacgtg

SEQ ID NO: 535224 - DNA, 25 bp, Rattus norvegicus
tttccaaaaaggatctcggtgattg

SEQ ID NO: 535225 - DNA, 25 bp, Rattus norvegicus
gcggttaccacgcaaagtgactaac

SEQ ID NO: 535226 - DNA, 25 bp, Rattus norvegicus
gggaagacacgcaagctttcacagc

SEQ ID NO: 535227 - DNA, 25 bp, Rattus norvegicus
gcgtttcacggctcgctttatggtg

SEQ ID NO: 535228 - DNA, 25 bp, Rattus norvegicus
gctcggcgtgattgacaagagctta

SEQ ID NO: 535229 - DNA, 25 bp, Rattus norvegicus
aagcgccgcacactataaggaaata

SEQ ID NO: 535230 - DNA, 25 bp, Rattus norvegicus
tgactaacacgtgagaaagtctctg

SEQ ID NO: 535231 - DNA, 25 bp, Rattus norvegicus
tctctgaggcacataatacggggca

SEQ ID NO: 535232 - DNA, 25 bp, Rattus norvegicus
atacggggcacctcgttagagccag

SEQ ID NO: 535233 - DNA, 25 bp, Rattus norvegicus
agcggctgccatgttctccgcttcg

SEQ ID NO: 535234 - DNA, 25 bp, Rattus norvegicus
aggttcaactctgtcccgccgcttg

SEQ ID NO: 535235 - DNA, 25 bp, Rattus norvegicus
gacggcagcgacaagtatcttctcg

SEQ ID NO: 535236 - DNA, 25 bp, Rattus norvegicus
gacaagtatcttctcgggtcaaaga

SEQ ID NO: 535237 - DNA, 25 bp, Rattus norvegicus
tctcgggtcaaagagtttctttagc

SEQ ID NO: 535238 - DNA, 25 bp, Rattus norvegicus
tttctttagcctaggcgggcacaga

SEQ ID NO: 535239 - DNA, 25 bp, Rattus norvegicus
gccaagccagggagaggttcaactc

SEQ ID NO: 535240 - DNA, 25 bp, Rattus norvegicus
tccgcttcgcgctgccaatcagtgt

SEQ ID NO: 535241 - DNA, 25 bp, Rattus norvegicus
ccaatcagctgtggtcgccggcagc

SEQ ID NO: 535242 - DNA, 25 bp, Rattus norvegicus
gccgctacccaatcagctgtggtcg

SEQ ID NO: 535243 - DNA, 25 bp, Rattus norvegicus
tctcagggacgctgagcagccgccg

SEQ ID NO: 535244 - DNA, 25 bp, Rattus norvegicus
ggcggaaccctctcagggacgctga

SEQ ID NO: 535245 - DNA, 25 bp, Rattus norvegicus
cttgcggaagcctggcctcagttcc

SEQ ID NO: 535246 - DNA, 25 bp, Rattus norvegicus
cagcctcccgctcggtttatgtgcg

SEQ ID NO: 535247 - DNA, 25 bp, Rattus norvegicus
cgacgggagccaatgcatgcaacta

SEQ ID NO: 535248 - DNA, 25 bp, Rattus norvegicus
ctgttagttcgacgggagccaatgc

SEQ ID NO: 535249 - DNA, 25 bp, Rattus norvegicus
ctccttcagaactgttagttcgacg

SEQ ID NO: 535250 - DNA, 25 bp, Rattus norvegicus
tcaagggagggctcccaggcatcac

SEQ ID NO: 535251 - DNA, 25 bp, Rattus norvegicus
cacgaccagcaacggcgctcacctt

SEQ ID NO: 535252 - DNA, 25 bp, Rattus norvegicus
cacgcgcccagctccttaacctctg

SEQ ID NO: 535253 - DNA, 25 bp, Rattus norvegicus
cccgcgcctcttctatgaacacctg

SEQ ID NO: 535254 - DNA, 25 bp, Rattus norvegicus
tgcgaactccgagcgtgcagtccgt

SEQ ID NO: 535255 - DNA, 25 bp, Rattus norvegicus
gctctgtgcgaactccgagcgtgca

SEQ ID NO: 535256 - DNA, 25 bp, Rattus norvegicus
gcaggcatccctcagctctgtgcga

SEQ ID NO: 535257 - DNA, 25 bp, Rattus norvegicus
tcaggtgcaggcatccctcagctct

SEQ ID NO: 535258 - DNA, 25 bp, Rattus norvegicus
cgcacgcgcttttgctttcataaga

SEQ ID NO: 535259 - DNA, 25 bp, Rattus norvegicus
gttccaatcgcgcacgcgcttttgc

SEQ ID NO: 535260 - DNA, 25 bp, Rattus norvegicus
gagccaatgcatgcaactaccaagt

SEQ ID NO: 535261 - DNA, 25 bp, Rattus norvegicus
agcctgagccgagctggaaccttgt

SEQ ID NO: 535262 - DNA, 25 bp, Rattus norvegicus
gataccgcctggaaggtcccggtga

SEQ ID NO: 535263 - DNA, 25 bp, Rattus norvegicus
cagacaggtgaacggcaccgagttc

SEQ ID NO: 535264 - DNA, 25 bp, Rattus norvegicus
gcctacgctggagcctgagccgagc

SEQ ID NO: 535265 - DNA, 25 bp, Rattus norvegicus
agctggaaccttgttgctcccgccg

SEQ ID NO: 535266 - DNA, 25 bp, Rattus norvegicus
tgtgctcgccggactctgcacagac

SEQ ID NO: 535267 - DNA, 25 bp, Rattus norvegicus
tctgcacagacaggtgaacggcacc

SEQ ID NO: 535268 - DNA, 25 bp, Rattus norvegicus
acggcaccgagttcaagagcatcta

SEQ ID NO: 535269 - DNA, 25 bp, Rattus norvegicus
tcaagagcatctacagcctggacaa

SEQ ID NO: 535270 - DNA, 25 bp, Rattus norvegicus
aatccaagggcgtggataccgcctg

SEQ ID NO: 535271 - DNA, 25 bp, Rattus norvegicus
aaagggcggttcctcttgctcctag

SEQ ID NO: 535272 - DNA, 25 bp, Rattus norvegicus
tcctcttgctcctaggtgacgcgtg

SEQ ID NO: 535273 - DNA, 25 bp, Rattus norvegicus
tgctcctaggtgacgcgtggaagcc

SEQ ID NO: 535274 - DNA, 25 bp, Rattus norvegicus
tctacagcctggacaagctgtaccc

SEQ ID NO: 535275 - DNA, 25 bp, Rattus norvegicus
gcttgcggactgagaaagttccaga

SEQ ID NO: 535276 - DNA, 25 bp, Rattus norvegicus
aggccgcggtgactcagcatttaac

SEQ ID NO: 535277 - DNA, 25 bp, Rattus norvegicus
tctgctcgaagtgaatgacgccctg

SEQ ID NO: 535278 - DNA, 25 bp, Rattus norvegicus
tcggaacctgggagagcaaaaagca

SEQ ID NO: 535279 - DNA, 25 bp, Rattus norvegicus
caaggagacgacagaagccgccgca

SEQ ID NO: 535280 - DNA, 25 bp, Rattus norvegicus
ccgccgcaggaaacgaaggtgcaaa

SEQ ID NO: 535281 - DNA, 25 bp, Rattus norvegicus
cgccgcggagcttttatatgcctgc

SEQ ID NO: 535282 - DNA, 25 bp, Rattus norvegicus
caccttggcagggaaccaatcgcta

SEQ ID NO: 535283 - DNA, 25 bp, Rattus norvegicus
tgcggattgcgactgactttgcagc

SEQ ID NO: 535284 - DNA, 25 bp, Rattus norvegicus
ggtctctgcctacccttcctgaagt

SEQ ID NO: 535285 - DNA, 25 bp, Rattus norvegicus
ctgggaaagtcgctattgtcttcta

SEQ ID NO: 535286 - DNA, 25 bp, Rattus norvegicus
ttctaactgtgacgtcggccgagtc

SEQ ID NO: 535287 - DNA, 25 bp, Rattus norvegicus
cgctctgtctagaaatgcggattgc

SEQ ID NO: 535288 - DNA, 25 bp, Rattus norvegicus
aaccaatcgctagccgcggtctctg

SEQ ID NO: 535289 - DNA, 25 bp, Rattus norvegicus
ctggtattcctgagcctcctagcta

SEQ ID NO: 535290 - DNA, 25 bp, Rattus norvegicus
gtaccctgccaccaagcggacttga

SEQ ID NO: 535291 - DNA, 25 bp, Rattus norvegicus
gggaagatttttgcccgctctgaga

SEQ ID NO: 535292 - DNA, 25 bp, Rattus norvegicus
ggcaagtccttcaaggcgaagtaca

SEQ ID NO: 535293 - DNA, 25 bp, Rattus norvegicus
aacaaccacgtctgctattgggagg

SEQ ID NO: 535294 - DNA, 25 bp, Rattus norvegicus
gaccggaccttcagcaccatgcatg

SEQ ID NO: 535295 - DNA, 25 bp, Rattus norvegicus
aggagctgtcctgcaagtggatcga

SEQ ID NO: 535296 - DNA, 25 bp, Rattus norvegicus
ttctttcgttacatgcggcagccca

SEQ ID NO: 535297 - DNA, 25 bp, Rattus norvegicus
acttgctctttcctgggcttcatga

SEQ ID NO: 535298 - DNA, 25 bp, Rattus norvegicus
agtcttcacgctccagctggtattc

SEQ ID NO: 535299 - DNA, 25 bp, Rattus norvegicus
acgcgcgactttctgttccgtcagc

SEQ ID NO: 535300 - DNA, 25 bp, Rattus norvegicus
ccgccgaggccattcagtacgaagc

SEQ ID NO: 535301 - DNA, 25 bp, Rattus norvegicus
agggcacgtggacaacaaccaggtc

SEQ ID NO: 535302 - DNA, 25 bp, Rattus norvegicus
gccagtgcgcagttccctaactaca

SEQ ID NO: 535303 - DNA, 25 bp, Rattus norvegicus
gcatcagtctgcaaacgccctcttg

SEQ ID NO: 535304 - DNA, 25 bp, Rattus norvegicus
cctggttattcctcagcgctggcgc

SEQ ID NO: 535305 - DNA, 25 bp, Rattus norvegicus
ccgcgctgtgttgtcgttgaaattc

SEQ ID NO: 535306 - DNA, 25 bp, Rattus norvegicus
ccttgcagccgtcgagcaggatttt

SEQ ID NO: 535307 - DNA, 25 bp, Rattus norvegicus
ctttgaagtgggtttttagcgcgca

SEQ ID NO: 535308 - DNA, 25 bp, Rattus norvegicus
gccctgactatgaggctgacccaaa

SEQ ID NO: 535309 - DNA, 25 bp, Rattus norvegicus
tctccgaagactacagcactgcgct

SEQ ID NO: 535310 - DNA, 25 bp, Rattus norvegicus
gggtcaattcgagcccaaacaatgg

SEQ ID NO: 535311 - DNA, 25 bp, Rattus norvegicus
agcagaaatcagcttcggcctaatc

SEQ ID NO: 535312 - DNA, 25 bp, Rattus norvegicus
ccggcgggactgtaaagcagaaatc

SEQ ID NO: 535313 - DNA, 25 bp, Rattus norvegicus
ggccataagctagcggatcgccttg

SEQ ID NO: 535314 - DNA, 25 bp, Rattus norvegicus
aattccttttccactggcaggggtg

SEQ ID NO: 535315 - DNA, 25 bp, Rattus norvegicus
ctcctcggcactgggaacacacttt

SEQ ID NO: 535316 - DNA, 25 bp, Rattus norvegicus
tcggccctccaagcgcatctgtggt

SEQ ID NO: 535317 - DNA, 25 bp, Rattus norvegicus
cggcaccgtcgcagcacaagaattc

SEQ ID NO: 535318 - DNA, 25 bp, Rattus norvegicus
ccggataagcgagctggcgatagcc

SEQ ID NO: 535319 - DNA, 25 bp, Rattus norvegicus
gcgggcttgtctcttttgccggata

SEQ ID NO: 535320 - DNA, 25 bp, Rattus norvegicus
caagaattcagtcgctgcaggcacc

SEQ ID NO: 535321 - DNA, 25 bp, Rattus norvegicus
acaggtaatggcctggcatcgtcgc

SEQ ID NO: 535322 - DNA, 25 bp, Rattus norvegicus
tcccgcagggatcaaacaggtaatg

SEQ ID NO: 535323 - DNA, 25 bp, Rattus norvegicus
tcggcaaaagttggccggtgccagc

SEQ ID NO: 535324 - DNA, 25 bp, Rattus norvegicus
cttcgcagcctgaagatcggcaaaa

SEQ ID NO: 535325 - DNA, 25 bp, Rattus norvegicus
gcgcttccactagtccttgcaactt

SEQ ID NO: 535326 - DNA, 25 bp, Rattus norvegicus
cagagagctgcgcttgtgactgcgt

SEQ ID NO: 535327 - DNA, 25 bp, Rattus norvegicus
tctggctgctttggtccgaaccgac

SEQ ID NO: 535328 - DNA, 25 bp, Rattus norvegicus
atgccttccgagctcctccgagggt

SEQ ID NO: 535329 - DNA, 25 bp, Rattus norvegicus
gtctccttagcctgcgcttgcttgg

SEQ ID NO: 535330 - DNA, 25 bp, Rattus norvegicus
tgcaggcaccctccagaagagcgcg

SEQ ID NO: 535331 - DNA, 25 bp, Rattus norvegicus
ctggacttgcgagagcgcttagggc

SEQ ID NO: 535332 - DNA, 25 bp, Rattus norvegicus
ctcctacccgccctcggagagccgc

SEQ ID NO: 535333 - DNA, 25 bp, Rattus norvegicus
cgcgctccagaagtgcagagacaaa

SEQ ID NO: 535334 - DNA, 25 bp, Rattus norvegicus
ctcgccgcgctccagaagtgcagag

SEQ ID NO: 535335 - DNA, 25 bp, Rattus norvegicus
cgcctgccaaagaatggggaggaaa

SEQ ID NO: 535336 - DNA, 25 bp, Rattus norvegicus
gccgccgcctgccaaagaatgggga

SEQ ID NO: 535337 - DNA, 25 bp, Rattus norvegicus
agagccgcgctcaggaacctccggg

SEQ ID NO: 535338 - DNA, 25 bp, Rattus norvegicus
ggcggaatccgcttttctcccgctg

SEQ ID NO: 535339 - DNA, 25 bp, Rattus norvegicus
tggctcccggcggaatccgcttttc

SEQ ID NO: 535340 - DNA, 25 bp, Rattus norvegicus
ctctcagtgtggctcccggcggaat

SEQ ID NO: 535341 - DNA, 25 bp, Rattus norvegicus
cgaccgcgagctctcagtgtggctc

SEQ ID NO: 535342 - DNA, 25 bp, Rattus norvegicus
gcggcaagtcgcgaccgcgagctct

SEQ ID NO: 535343 - DNA, 25 bp, Rattus norvegicus
ctgcccgggctctttgcgggtcgct

SEQ ID NO: 535344 - DNA, 25 bp, Rattus norvegicus
tttgcgggtcgctcgctccacgagc

SEQ ID NO: 535345 - DNA, 25 bp, Rattus norvegicus
ggcctgcctcaaggctgctggacgc

SEQ ID NO: 535346 - DNA, 25 bp, Rattus norvegicus
cggcggaacatctcgtccgaggctg

SEQ ID NO: 535347 - DNA, 25 bp, Rattus norvegicus
aacatctcgtccgaggctgcggggt

SEQ ID NO: 535348 - DNA, 25 bp, Rattus norvegicus
gcctcacactcgtcctgccgctaag

SEQ ID NO: 535349 - DNA, 25 bp, Rattus norvegicus
ggtctgtgagaagccacgctctccc

SEQ ID NO: 535350 - DNA, 25 bp, Rattus norvegicus
tggcaccgcttcactggcagtcctt

SEQ ID NO: 535351 - DNA, 25 bp, Rattus norvegicus
gctttccgaccagcacttctggctg

SEQ ID NO: 535352 - DNA, 25 bp, Rattus norvegicus
agagccttggcgtggcctgcctcaa

SEQ ID NO: 535353 - DNA, 25 bp, Rattus norvegicus
ctccctgagggaagactccggacta

SEQ ID NO: 535354 - DNA, 25 bp, Rattus norvegicus
agactccggactagccagggactga

SEQ ID NO: 535355 - DNA, 25 bp, Rattus norvegicus
tcctaggctacagacgggagacgct

SEQ ID NO: 535356 - DNA, 25 bp, Rattus norvegicus
ctctcgggtcccacctaagccgtct

SEQ ID NO: 535357 - DNA, 25 bp, Rattus norvegicus
taagccgtcttcacctcgtagtttg

SEQ ID NO: 535358 - DNA, 25 bp, Rattus norvegicus
cttctggctgagaagagccttggcg

SEQ ID NO: 535359 - DNA, 25 bp, Rattus norvegicus
cgcggcgaacggacggcgggagact

SEQ ID NO: 535360 - DNA, 25 bp, Rattus norvegicus
acctccgagccctcagtgcggcagg

SEQ ID NO: 535361 - DNA, 25 bp, Rattus norvegicus
tgccgagtgccgcatggagagagct

SEQ ID NO: 535362 - DNA, 25 bp, Rattus norvegicus
ggagagagctctgcaccaggccacc

SEQ ID NO: 535363 - DNA, 25 bp, Rattus norvegicus
gagagagctctgcaccaggccacct

SEQ ID NO: 535364 - DNA, 25 bp, Rattus norvegicus
tctgcaccaggccacctccgagccc

SEQ ID NO: 535365 - DNA, 25 bp, Rattus norvegicus
gctcgccgccggagcatcggaatct

SEQ ID NO: 535366 - DNA, 25 bp, Rattus norvegicus
tcggaatctcagctcccgcgtctgt

SEQ ID NO: 535367 - DNA, 25 bp, Rattus norvegicus
tcgccgccggagcatcggaatctca

SEQ ID NO: 535368 - DNA, 25 bp, Rattus norvegicus
cggagcggacggctcaggcctggcc

SEQ ID NO: 535369 - DNA, 25 bp, Rattus norvegicus
atcggaatctcagctcccgcgtctg

SEQ ID NO: 535370 - DNA, 25 bp, Rattus norvegicus
ccgccggagcatcggaatctcagct

SEQ ID NO: 535371 - DNA, 25 bp, Rattus norvegicus
gccggagcatcggaatctcagctcc

SEQ ID NO: 535372 - DNA, 25 bp, Rattus norvegicus
agcatcggaatctcagctcccgcgt

SEQ ID NO: 535373 - DNA, 25 bp, Rattus norvegicus
ctttcggtcctcctcatcttcggta

SEQ ID NO: 535374 - DNA, 25 bp, Rattus norvegicus
ttaacattggctttcgctgtcgcgc

SEQ ID NO: 535375 - DNA, 25 bp, Rattus norvegicus
ggggtcaacttcactcagtcctcga

SEQ ID NO: 535376 - DNA, 25 bp, Rattus norvegicus
tgcgacagaagaacctagggacctg

SEQ ID NO: 535377 - DNA, 25 bp, Rattus norvegicus
ggtttctccgcaaacaccacagcga

SEQ ID NO: 535378 - DNA, 25 bp, Rattus norvegicus
gcagctcaagcaagtcccatttccg

SEQ ID NO: 535379 - DNA, 25 bp, Rattus norvegicus
tcttcggtacaaggcaacggtccca

SEQ ID NO: 535380 - DNA, 25 bp, Rattus norvegicus
ctccgacagctacggcaaaactttc

SEQ ID NO: 535381 - DNA, 25 bp, Rattus norvegicus
gctaaacagcaaggcgtcccaacgt

SEQ ID NO: 535382 - DNA, 25 bp, Rattus norvegicus
acggtcccaggcgagcaaagctaaa

SEQ ID NO: 535383 - DNA, 25 bp, Rattus norvegicus
atgctgatcatgtcgcgcaggtcgc

SEQ ID NO: 535384 - DNA, 25 bp, Rattus norvegicus
cacacgcacacctggctataaatta

SEQ ID NO: 535385 - DNA, 25 bp, Rattus norvegicus
cgccaggtggcaggtacatgctgat

SEQ ID NO: 535386 - DNA, 25 bp, Rattus norvegicus
gctccggacttcttgcttttgtaca

SEQ ID NO: 535387 - DNA, 25 bp, Rattus norvegicus
cctcgtgattgacaggctcgctgtg

SEQ ID NO: 535388 - DNA, 25 bp, Rattus norvegicus
gctcgctgtgatgagtcctggccaa

SEQ ID NO: 535389 - DNA, 25 bp, Rattus norvegicus
gagtcctggccaatcaacaccgagc

SEQ ID NO: 535390 - DNA, 25 bp, Rattus norvegicus
tcgagtgacgtgatgagagttattc

SEQ ID NO: 535391 - DNA, 25 bp, Rattus norvegicus
tatatacctgctcagatccgggagg

SEQ ID NO: 535392 - DNA, 25 bp, Rattus norvegicus
ggcagcgagtacttgtccttcttga

SEQ ID NO: 535393 - DNA, 25 bp, Rattus norvegicus
gtccgggtactccttcatgtgcacg

SEQ ID NO: 535394 - DNA, 25 bp, Rattus norvegicus
gcttctccgcgtcggtcagcagttt

SEQ ID NO: 535395 - DNA, 25 bp, Rattus norvegicus
tcagcagtttccagtcggcgcccag

SEQ ID NO: 535396 - DNA, 25 bp, Rattus norvegicus
tgaaagcgttcatgggtctcttgac

SEQ ID NO: 535397 - DNA, 25 bp, Rattus norvegicus
ccacggggttcttgagttcagtctc

SEQ ID NO: 535398 - DNA, 25 bp, Rattus norvegicus
gtctccagcaggctgtacatcgccg

SEQ ID NO: 535399 - DNA, 25 bp, Rattus norvegicus
cgggcttctctcacctgatgcgttc

SEQ ID NO: 535400 - DNA, 25 bp, Rattus norvegicus
gcgttctctcgagctggtcgcattc

SEQ ID NO: 535401 - DNA, 25 bp, Rattus norvegicus
ggccttcagtccctctgcgcacaca

SEQ ID NO: 535402 - DNA, 25 bp, Rattus norvegicus
tgggtacccggcctgagcagcagcc

SEQ ID NO: 535403 - DNA, 25 bp, Rattus norvegicus
atgttttgccgcatcccggtgccca

SEQ ID NO: 535404 - DNA, 25 bp, Rattus norvegicus
tggcgcgtaccgcaatgttttgccg

SEQ ID NO: 535405 - DNA, 25 bp, Rattus norvegicus
acctcgacctggaggcgacgcggtt

SEQ ID NO: 535406 - DNA, 25 bp, Rattus norvegicus
cagagcagtacctcgacctggaggc

SEQ ID NO: 535407 - DNA, 25 bp, Rattus norvegicus
aacgacggagagatcggctgttgcc

SEQ ID NO: 535408 - DNA, 25 bp, Rattus norvegicus
cagcggacaagggaaaccttaactg

SEQ ID NO: 535409 - DNA, 25 bp, Rattus norvegicus
gacgcggctccagagcagcggacaa

SEQ ID NO: 535410 - DNA, 25 bp, Rattus norvegicus
tccgcaggtcgacgcggctccagag

SEQ ID NO: 535411 - DNA, 25 bp, Rattus norvegicus
gcaaaccactgccaaggggtccgca

SEQ ID NO: 535412 - DNA, 25 bp, Rattus norvegicus
cgagcctgcggagtgcaaaccactg

SEQ ID NO: 535413 - DNA, 25 bp, Rattus norvegicus
ctgtccaagcagagagagcgagcct

SEQ ID NO: 535414 - DNA, 25 bp, Rattus norvegicus
ctagcgctccctgtccaagcagaga

SEQ ID NO: 535415 - DNA, 25 bp, Rattus norvegicus
aaattcacccacctctggagcccaa

SEQ ID NO: 535416 - DNA, 25 bp, Rattus norvegicus
gcacctttacatacacgcgccgaat

SEQ ID NO: 535417 - DNA, 25 bp, Rattus norvegicus
cacgggctgcacctttacatacacg

SEQ ID NO: 535418 - DNA, 25 bp, Rattus norvegicus
cgcacacgggctgcacctttacata

SEQ ID NO: 535419 - DNA, 25 bp, Rattus norvegicus
cgcgcacccagaccctcgcacacgg

SEQ ID NO: 535420 - DNA, 25 bp, Rattus norvegicus
ttggagggcccactgcgttccgact

SEQ ID NO: 535421 - DNA, 25 bp, Rattus norvegicus
cagccggggcttgaaattcacccac

SEQ ID NO: 535422 - DNA, 25 bp, Rattus norvegicus
acgcagccggggcttgaaattcacc

SEQ ID NO: 535423 - DNA, 25 bp, Rattus norvegicus
tttccttgcagctcacgcagccggg

SEQ ID NO: 535424 - DNA, 25 bp, Rattus norvegicus
tgtgccaagcccagccaggaagaag

SEQ ID NO: 535425 - DNA, 25 bp, Rattus norvegicus
atgcactgtgccaagcccagccagg

SEQ ID NO: 535426 - DNA, 25 bp, Rattus norvegicus
ccaaagtccgttggagggcccactg

SEQ ID NO: 535427 - DNA, 25 bp, Rattus norvegicus
acccggccagacaccgcgcgcgcac

SEQ ID NO: 535428 - DNA, 25 bp, Rattus norvegicus
tgcgttccgactcgctcctcagttt

SEQ ID NO: 535429 - DNA, 25 bp, Rattus norvegicus
caggttggttcctagccctggtcgc

SEQ ID NO: 535430 - DNA, 25 bp, Rattus norvegicus
aagtgacgcgtgacgtcctgcgtgc

SEQ ID NO: 535431 - DNA, 25 bp, Rattus norvegicus
cctggtcgccgcgttctccctgctg

SEQ ID NO: 535432 - DNA, 25 bp, Rattus norvegicus
taccggcgatcagggtgccgcagcc

SEQ ID NO: 535433 - DNA, 25 bp, Rattus norvegicus
cgcgcccaccgtcagcggcggccct

SEQ ID NO: 535434 - DNA, 25 bp, Rattus norvegicus
ccgcgagtgtccgagcccgcggtga

SEQ ID NO: 535435 - DNA, 25 bp, Rattus norvegicus
gtgcgcagtacggagggccacgcga

SEQ ID NO: 535436 - DNA, 25 bp, Rattus norvegicus
ccacgcgggactgcgggtgcgcagt

SEQ ID NO: 535437 - DNA, 25 bp, Rattus norvegicus
tggttcctagccctggtcgccgcgt

SEQ ID NO: 535438 - DNA, 25 bp, Rattus norvegicus
tgtccacaggttggttcctagccct

SEQ ID NO: 535439 - DNA, 25 bp, Rattus norvegicus
cggtgcgtctggtagaaggagaaga

SEQ ID NO: 535440 - DNA, 25 bp, Rattus norvegicus
tctatgacggagagcagcgcgctgc

SEQ ID NO: 535441 - DNA, 25 bp, Rattus norvegicus
cctctatgacggagagcagcgcgct

SEQ ID NO: 535442 - DNA, 25 bp, Rattus norvegicus
cggtgtccacaggttggttcctagc

SEQ ID NO: 535443 - DNA, 25 bp, Rattus norvegicus
tgggaatcttccagggctgtaatcg

SEQ ID NO: 535444 - DNA, 25 bp, Rattus norvegicus
cgaaaacctctacgcgaaggtgaga

SEQ ID NO: 535445 - DNA, 25 bp, Rattus norvegicus
aacgggatgccttaggggccaatct

SEQ ID NO: 535446 - DNA, 25 bp, Rattus norvegicus
cttaggggccaatctggaacaggga

SEQ ID NO: 535447 - DNA, 25 bp, Rattus norvegicus
gcggcaaagagaaccgaccatggta

SEQ ID NO: 535448 - DNA, 25 bp, Rattus norvegicus
gcccgtgttcgctgggaatcttcca

SEQ ID NO: 535449 - DNA, 25 bp, Rattus norvegicus
agaggtcccggctgcccgtgttcgc

SEQ ID NO: 535450 - DNA, 25 bp, Rattus norvegicus
gacattctccggctcgaggcttgcg

SEQ ID NO: 535451 - DNA, 25 bp, Rattus norvegicus
aagcttgtatgctcgccgcctgtca

SEQ ID NO: 535452 - DNA, 25 bp, Rattus norvegicus
gcccggctgttaagcttgtatgctc

SEQ ID NO: 535453 - DNA, 25 bp, Rattus norvegicus
cagggaaactagtgtcgaagcggac

SEQ ID NO: 535454 - DNA, 25 bp, Rattus norvegicus
tgtcgaagcggacattctccggctc

SEQ ID NO: 535455 - DNA, 25 bp, Rattus norvegicus
cgcctgtcagtagcggcggcgatac

SEQ ID NO: 535456 - DNA, 25 bp, Rattus norvegicus
cgaccatggtatggcaggaggaccc

SEQ ID NO: 535457 - DNA, 25 bp, Rattus norvegicus
ccagcaacacccgtgcgggaggtga

SEQ ID NO: 535458 - DNA, 25 bp, Rattus norvegicus
gcaaggccttcagttccgggtttga

SEQ ID NO: 535459 - DNA, 25 bp, Rattus norvegicus
cgggagacgcaaggccttcagttcc

SEQ ID NO: 535460 - DNA, 25 bp, Rattus norvegicus
tgtttcaactcgctccttccgggac

SEQ ID NO: 535461 - DNA, 25 bp, Rattus norvegicus
agttgtttcaactcgctccttccgg

SEQ ID NO: 535462 - DNA, 25 bp, Rattus norvegicus
ttcactggctcagttgtttcaactc

SEQ ID NO: 535463 - DNA, 25 bp, Rattus norvegicus
ggcgctgctgtcattcactggctca

SEQ ID NO: 535464 - DNA, 25 bp, Rattus norvegicus
cactcgccttcctgaggggcgggtt

SEQ ID NO: 535465 - DNA, 25 bp, Rattus norvegicus
ccacagatactcgaggaggcgcggc

SEQ ID NO: 535466 - DNA, 25 bp, Rattus norvegicus
ccgcaggaccacagatactcgagga

SEQ ID NO: 535467 - DNA, 25 bp, Rattus norvegicus
atggcgccagcagcaaagggacagc

SEQ ID NO: 535468 - DNA, 25 bp, Rattus norvegicus
tgcccatggcgccagcagcaaaggg

SEQ ID NO: 535469 - DNA, 25 bp, Rattus norvegicus
cgacctgaggcgttcagatcgccgg

SEQ ID NO: 535470 - DNA, 25 bp, Rattus norvegicus
ggcaccgacctgaggcgttcagatc

SEQ ID NO: 535471 - DNA, 25 bp, Rattus norvegicus
cggggctccaatggcgctttctaca

SEQ ID NO: 535472 - DNA, 25 bp, Rattus norvegicus
cggcttagtcctgctttcccaaata

SEQ ID NO: 535473 - DNA, 25 bp, Rattus norvegicus
gcgcgccaaagtatctgcccagtta

SEQ ID NO: 535474 - DNA, 25 bp, Rattus norvegicus
tagatctggccatagggccggtgcc

SEQ ID NO: 535475 - DNA, 25 bp, Rattus norvegicus
gcgctttctacaaggtaacgggcta

SEQ ID NO: 535476 - DNA, 25 bp, Rattus norvegicus
tttcacttccggtgaggggccgcgc

SEQ ID NO: 535477 - DNA, 25 bp, Rattus norvegicus
gcctcagtcagtcttgcgctgggga

SEQ ID NO: 535478 - DNA, 25 bp, Rattus norvegicus
agagccctcggcctcagtcagtctt

SEQ ID NO: 535479 - DNA, 25 bp, Rattus norvegicus
ttgactgtttacaggaggcgcggca

SEQ ID NO: 535480 - DNA, 25 bp, Rattus norvegicus
tcacgtggtgtcgtttgactgttta

SEQ ID NO: 535481 - DNA, 25 bp, Rattus norvegicus
cgcgtgctcagctgcccaagagaga

SEQ ID NO: 535482 - DNA, 25 bp, Rattus norvegicus
aggtacccacgacggcgcatgcgcg

SEQ ID NO: 535483 - DNA, 25 bp, Rattus norvegicus
ataatcctctcctagtgggttcggg

SEQ ID NO: 535484 - DNA, 25 bp, Rattus norvegicus
tgcgaggacagtagatctggccata

SEQ ID NO: 535485 - DNA, 25 bp, Rattus norvegicus
gcggtcaggctcttgcctgcccggt

SEQ ID NO: 535486 - DNA, 25 bp, Rattus norvegicus
ccgccgaccgcagccagagagccgc

SEQ ID NO: 535487 - DNA, 25 bp, Rattus norvegicus
tgcctgcccggtgccatcgcttccg

SEQ ID NO: 535488 - DNA, 25 bp, Rattus norvegicus
cggtgccatcgcttccgccgccgcc

SEQ ID NO: 535489 - DNA, 25 bp, Rattus norvegicus
agcgcaggaccaggtacccggggct

SEQ ID NO: 535490 - DNA, 25 bp, Rattus norvegicus
cgctgccgctaatgcggccccagca

SEQ ID NO: 535491 - DNA, 25 bp, Rattus norvegicus
cccagcacttttaaccgggcaggag

SEQ ID NO: 535492 - DNA, 25 bp, Rattus norvegicus
ccagcacttttaaccgggcaggagg

SEQ ID NO: 535493 - DNA, 25 bp, Rattus norvegicus
cagcacttttaaccgggcaggaggg

SEQ ID NO: 535494 - DNA, 25 bp, Rattus norvegicus
tttaaccgggcaggagggccagaga

SEQ ID NO: 535495 - DNA, 25 bp, Rattus norvegicus
ccgcgccgccgaccgcagccagaga

SEQ ID NO: 535496 - DNA, 25 bp, Rattus norvegicus
cgcgcagctcagagccgcgccgaca

SEQ ID NO: 535497 - DNA, 25 bp, Rattus norvegicus
ccagctccaagcggccgccaccgca

SEQ ID NO: 535498 - DNA, 25 bp, Rattus norvegicus
agctcagagccgcgccgacaggcag

SEQ ID NO: 535499 - DNA, 25 bp, Rattus norvegicus
ctgggaaagcggcagtagcagtatt

SEQ ID NO: 535500 - DNA, 25 bp, Rattus norvegicus
gtgtcgcgcagtcttctctgagaca

SEQ ID NO: 535501 - DNA, 25 bp, Rattus norvegicus
cgcagtcttctctgagacagtcgcg

SEQ ID NO: 535502 - DNA, 25 bp, Rattus norvegicus
tcgcgtcggtgtcgcgcagtcttct

SEQ ID NO: 535503 - DNA, 25 bp, Rattus norvegicus
agtcgcgttcaagccagcgcccggg

SEQ ID NO: 535504 - DNA, 25 bp, Rattus norvegicus
aagcgcagtcgcgttcaagccagcg

SEQ ID NO: 535505 - DNA, 25 bp, Rattus norvegicus
tgcacaagcgcagtcgcgttcaagc

SEQ ID NO: 535506 - DNA, 25 bp, Rattus norvegicus
cagaagagagttgcacaagcgcagt

SEQ ID NO: 535507 - DNA, 25 bp, Rattus norvegicus
ccggcgccatcaggctccacccaca

SEQ ID NO: 535508 - DNA, 25 bp, Rattus norvegicus
cgaccgattacgctcggacctccgg

SEQ ID NO: 535509 - DNA, 25 bp, Rattus norvegicus
cgcccaccgcgaccgattacgctcg

SEQ ID NO: 535510 - DNA, 25 bp, Rattus norvegicus
cagtagcagtatttccggttaaggt

SEQ ID NO: 535511 - DNA, 25 bp, Rattus norvegicus
gcggcagtagcagtatttccggtta

SEQ ID NO: 535512 - DNA, 25 bp, Rattus norvegicus
tcgcgcagtcttctctgagacagtc

SEQ ID NO: 535513 - DNA, 25 bp, Rattus norvegicus
ccagctacggaaaccggaaggagtg

SEQ ID NO: 535514 - DNA, 25 bp, Rattus norvegicus
cgacaaggctgcctttagcagcatg

SEQ ID NO: 535515 - DNA, 25 bp, Rattus norvegicus
gcgcatcccagctacggaaaccgga

SEQ ID NO: 535516 - DNA, 25 bp, Rattus norvegicus
tgcctttagcagcatgaacccgctg

SEQ ID NO: 535517 - DNA, 25 bp, Rattus norvegicus
ttagcagcatgaacccgctgtgagg

SEQ ID NO: 535518 - DNA, 25 bp, Rattus norvegicus
aggaggacgtctaggcgaagttctc

SEQ ID NO: 535519 - DNA, 25 bp, Rattus norvegicus
taggcgaagttctccgccatgaacc

SEQ ID NO: 535520 - DNA, 25 bp, Rattus norvegicus
cgccatgaacctgaggggcctcttt

SEQ ID NO: 535521 - DNA, 25 bp, Rattus norvegicus
tgaggggcctctttcaggacttcaa

SEQ ID NO: 535522 - DNA, 25 bp, Rattus norvegicus
ctttcaggacttcaacccgaggtga

SEQ ID NO: 535523 - DNA, 25 bp, Rattus norvegicus
tcaacccgaggtgaggcggttatgc

SEQ ID NO: 535524 - DNA, 25 bp, Rattus norvegicus
agttggttgctctggcttctcccgt

SEQ ID NO: 535525 - DNA, 25 bp, Rattus norvegicus
gctctggcttctcccgtggcggcgt

SEQ ID NO: 535526 - DNA, 25 bp, Rattus norvegicus
gcatgcgcatcccagctacggaaac

SEQ ID NO: 535527 - DNA, 25 bp, Rattus norvegicus
cgccgggtctgatgcgtgatggaca

SEQ ID NO: 535528 - DNA, 25 bp, Rattus norvegicus
gatcctggacaggtgtgtggagctc

SEQ ID NO: 535529 - DNA, 25 bp, Rattus norvegicus
tgtggagctcgggtaacacagcctc

SEQ ID NO: 535530 - DNA, 25 bp, Rattus norvegicus
gaccctcgaggggtgcagctcccgg

SEQ ID NO: 535531 - DNA, 25 bp, Rattus norvegicus
gcagtccgagagatcgggggtcacc

SEQ ID NO: 535532 - DNA, 25 bp, Rattus norvegicus
gcctgacgcgggtgctcgaccgcgg

SEQ ID NO: 535533 - DNA, 25 bp, Rattus norvegicus
gacaacttgtgacggcggccgcctg

SEQ ID NO: 535534 - DNA, 25 bp, Rattus norvegicus
tgacaacttgtgacggcggccgcct

SEQ ID NO: 535535 - DNA, 25 bp, Rattus norvegicus
caggtgacaacttgtgacggcggcc

SEQ ID NO: 535536 - DNA, 25 bp, Rattus norvegicus
ctaccaggtgacaacttgtgacggc

SEQ ID NO: 535537 - DNA, 25 bp, Rattus norvegicus
gggctaccaggtgacaacttgtgac

SEQ ID NO: 535538 - DNA, 25 bp, Rattus norvegicus
gcggggctaccaggtgacaacttgt

SEQ ID NO: 535539 - DNA, 25 bp, Rattus norvegicus
ggagctcgggtaacacagcctcgcg

SEQ ID NO: 535540 - DNA, 25 bp, Rattus norvegicus
ggcaccccggcatggagatcctgga

SEQ ID NO: 535541 - DNA, 25 bp, Rattus norvegicus
ggtgcctcaacttttcgggtggctg

SEQ ID NO: 535542 - DNA, 25 bp, Rattus norvegicus
agaggccacgcccatctgctgaata

SEQ ID NO: 535543 - DNA, 25 bp, Rattus norvegicus
tttgaatgaatgagcccagaggcca

SEQ ID NO: 535544 - DNA, 25 bp, Rattus norvegicus
tatgcatgaggaccgcagccaatgg

SEQ ID NO: 535545 - DNA, 25 bp, Rattus norvegicus
ccgcgggttgtcctgtttgaatgaa

SEQ ID NO: 535546 - DNA, 25 bp, Rattus norvegicus
cgcccatctgctgaatatgcatgag

SEQ ID NO: 535547 - DNA, 25 bp, Rattus norvegicus
ccgagccgatggctctgcgtgaaca

SEQ ID NO: 535548 - DNA, 25 bp, Rattus norvegicus
ggaagacgccattcaggtgcctcaa

SEQ ID NO: 535549 - DNA, 25 bp, Rattus norvegicus
tctcctttttcgctgctcggcggca

SEQ ID NO: 535550 - DNA, 25 bp, Rattus norvegicus
aacaatacaggtacggcccgcaccg

SEQ ID NO: 535551 - DNA, 25 bp, Rattus norvegicus
cccagaccggcgaacaatacaggta

SEQ ID NO: 535552 - DNA, 25 bp, Rattus norvegicus
ctctcgtgcaggcagctagcgcgag

SEQ ID NO: 535553 - DNA, 25 bp, Rattus norvegicus
cgctggccaatcaggcggctctcgt

SEQ ID NO: 535554 - DNA, 25 bp, Rattus norvegicus
tctgcgtgaacatggccgtcgcgga

SEQ ID NO: 535555 - DNA, 25 bp, Rattus norvegicus
cggccgaactgtctccaagggagca

SEQ ID NO: 535556 - DNA, 25 bp, Rattus norvegicus
ggtagcctgttgactcctgtgccgt

SEQ ID NO: 535557 - DNA, 25 bp, Rattus norvegicus
agtaaagttcgcgagcggcctcagg

SEQ ID NO: 535558 - DNA, 25 bp, Rattus norvegicus
ctcctgtgccgtcggagaccagaca

SEQ ID NO: 535559 - DNA, 25 bp, Rattus norvegicus
agaccagacacggagggagtcagtc

SEQ ID NO: 535560 - DNA, 25 bp, Rattus norvegicus
cagtcgtcacaggagcggagagttt

SEQ ID NO: 535561 - DNA, 25 bp, Rattus norvegicus
agaggcactgaaggccggccgaact

SEQ ID NO: 535562 - DNA, 25 bp, Rattus norvegicus
agcagagaggtctgagcccgccaga

SEQ ID NO: 535563 - DNA, 25 bp, Rattus norvegicus
cccgctttgcgaagtaaagttcgcg

SEQ ID NO: 535564 - DNA, 25 bp, Rattus norvegicus
ccctgggacagtctgctgaactgga

SEQ ID NO: 535565 - DNA, 25 bp, Rattus norvegicus
cccgtcccagagtgagtggctggaa

SEQ ID NO: 535566 - DNA, 25 bp, Rattus norvegicus
tggccgcttccaagtgccacggatc

SEQ ID NO: 535567 - DNA, 25 bp, Rattus norvegicus
tctgtactggggtgtcccgaggacc

SEQ ID NO: 535568 - DNA, 25 bp, Rattus norvegicus
cccacgcccgagtgtctagcagaga

SEQ ID NO: 535569 - DNA, 25 bp, Rattus norvegicus
ctcaatgtggagtggctaggctact

SEQ ID NO: 535570 - DNA, 25 bp, Rattus norvegicus
ggccacgccatggagcgtcttgata

SEQ ID NO: 535571 - DNA, 25 bp, Rattus norvegicus
ggaaactgctcggttgcctagcacc

SEQ ID NO: 535572 - DNA, 25 bp, Rattus norvegicus
tgcctagcaccacagcggacagctg

SEQ ID NO: 535573 - DNA, 25 bp, Rattus norvegicus
tatccctgagttcggctgggtaacc

SEQ ID NO: 535574 - DNA, 25 bp, Rattus norvegicus
ctgcagcctccagagttcaggtatc

SEQ ID NO: 535575 - DNA, 25 bp, Rattus norvegicus
gcgtcttgataaagcggcactgaac

SEQ ID NO: 535576 - DNA, 25 bp, Rattus norvegicus
gctaattacctagcacctgctgttg

SEQ ID NO: 535577 - DNA, 25 bp, Rattus norvegicus
tgagtgtttgcagcacacccgcgcc

SEQ ID NO: 535578 - DNA, 25 bp, Rattus norvegicus
cccgtgggtaagtcacgtgagtgtt

SEQ ID NO: 535579 - DNA, 25 bp, Rattus norvegicus
ggacagctggctcatcctttccgcg

SEQ ID NO: 535580 - DNA, 25 bp, Rattus norvegicus
gaaggacaatgctgcgcggaaagtc

SEQ ID NO: 535581 - DNA, 25 bp, Rattus norvegicus
ctgctcctggagaacgatccactcg

SEQ ID NO: 535582 - DNA, 25 bp, Rattus norvegicus
ggctcctcaacctcgggtcactagg

SEQ ID NO: 535583 - DNA, 25 bp, Rattus norvegicus
aggcagccactctggagccgcagca

SEQ ID NO: 535584 - DNA, 25 bp, Rattus norvegicus
tgacgagcctcggatgcccatttac

SEQ ID NO: 535585 - DNA, 25 bp, Rattus norvegicus
acatctggatggagtcagccgccta

SEQ ID NO: 535586 - DNA, 25 bp, Rattus norvegicus
agccgcagcacatctggatggagtc

SEQ ID NO: 535587 - DNA, 25 bp, Rattus norvegicus
tcggatgcccatttactgcgcgagg

SEQ ID NO: 535588 - DNA, 25 bp, Rattus norvegicus
gagtcagccgcctagctccaggggc

SEQ ID NO: 535589 - DNA, 25 bp, Rattus norvegicus
tgctctggccgggattgacgagcct

SEQ ID NO: 535590 - DNA, 25 bp, Rattus norvegicus
accgcaattgctctggccgggattg

SEQ ID NO: 535591 - DNA, 25 bp, Rattus norvegicus
ggcggcccgcgagaccgcaattgct

SEQ ID NO: 535592 - DNA, 25 bp, Rattus norvegicus
gatcgcgcgtttccgcgtgccagcg

SEQ ID NO: 535593 - DNA, 25 bp, Rattus norvegicus
gtcctttctggatcgcgcgtttccg

SEQ ID NO: 535594 - DNA, 25 bp, Rattus norvegicus
cacggtcctttctggatcgcgcgtt

SEQ ID NO: 535595 - DNA, 25 bp, Rattus norvegicus
cattagtgtgcttctgcgccggggt

SEQ ID NO: 535596 - DNA, 25 bp, Rattus norvegicus
catttactgcgcgaggcagccactc

SEQ ID NO: 535597 - DNA, 25 bp, Rattus norvegicus
tggcgcaaaccctgcgaagacccgg

SEQ ID NO: 535598 - DNA, 25 bp, Rattus norvegicus
aagacccggctctttacgtgccctg

SEQ ID NO: 535599 - DNA, 25 bp, Rattus norvegicus
tgctgctcctctttgagcagggccc

SEQ ID NO: 535600 - DNA, 25 bp, Rattus norvegicus
cctggcccagaggtgactcctcgtg

SEQ ID NO: 535601 - DNA, 25 bp, Rattus norvegicus
tcaaggccggcgttccaggcgtctt

SEQ ID NO: 535602 - DNA, 25 bp, Rattus norvegicus
ctttacgtgccctgtcaaggccggc

SEQ ID NO: 535603 - DNA, 25 bp, Rattus norvegicus
gttccaggcgtcttggagccgcaga

SEQ ID NO: 535604 - DNA, 25 bp, Rattus norvegicus
agaggtgactcctcgtggcgcaaac

SEQ ID NO: 535605 - DNA, 25 bp, Rattus norvegicus
gccggctgaagcgacttagggctta

SEQ ID NO: 535606 - DNA, 25 bp, Rattus norvegicus
ttccctgatagccaggccgcgattg

SEQ ID NO: 535607 - DNA, 25 bp, Rattus norvegicus
aaaaccgcctttccctgatagccag

SEQ ID NO: 535608 - DNA, 25 bp, Rattus norvegicus
acttgcgagcgccaaaaccgccttt

SEQ ID NO: 535609 - DNA, 25 bp, Rattus norvegicus
ggcgtgccacttgcgagcgccaaaa

SEQ ID NO: 535610 - DNA, 25 bp, Rattus norvegicus
catcccagcggtctcctcccttagt

SEQ ID NO: 535611 - DNA, 25 bp, Rattus norvegicus
cattttgacgagtgtgtgcagccac

SEQ ID NO: 535612 - DNA, 25 bp, Rattus norvegicus
gttgcgtcttcgtggtgctcttcac

SEQ ID NO: 535613 - DNA, 25 bp, Rattus norvegicus
gcgtcttcgtggtgctcttcacctc

SEQ ID NO: 535614 - DNA, 25 bp, Rattus norvegicus
tgtgcagccacaacctgcgtggaga

SEQ ID NO: 535615 - DNA, 25 bp, Rattus norvegicus
caatgcgttgcgtcttcgtggtgct

SEQ ID NO: 535616 - DNA, 25 bp, Rattus norvegicus
tgtgtgcagccacaacctgcgtgga

SEQ ID NO: 535617 - DNA, 25 bp, Rattus norvegicus
ttcgtggtgctcttcacctcctcaa

SEQ ID NO: 535618 - DNA, 25 bp, Rattus norvegicus
tggtgctcttcacctcctcaatctt

SEQ ID NO: 535619 - DNA, 25 bp, Rattus norvegicus
aggcaatgcgttgcgtcttcgtggt

SEQ ID NO: 535620 - DNA, 25 bp, Rattus norvegicus
tcctcaatcttcattttgacgagtg

SEQ ID NO: 535621 - DNA, 25 bp, Rattus norvegicus
atcttcattttgacgagtgtgtgca

SEQ ID NO: 535622 - DNA, 25 bp, Rattus norvegicus
ttcattttgacgagtgtgtgcagcc

SEQ ID NO: 535623 - DNA, 25 bp, Rattus norvegicus
ccttcacgtggctgtgggaggcaat

SEQ ID NO: 535624 - DNA, 25 bp, Rattus norvegicus
cgcctgcttggccaggccgctctca

SEQ ID NO: 535625 - DNA, 25 bp, Rattus norvegicus
ggccacaaccgctagctagcgcgtt

SEQ ID NO: 535626 - DNA, 25 bp, Rattus norvegicus
cggaacgcctgtgcgcgtgacttct

SEQ ID NO: 535627 - DNA, 25 bp, Rattus norvegicus
caaccgctagctagcgcgtttttcc

SEQ ID NO: 535628 - DNA, 25 bp, Rattus norvegicus
tagctagcgcgtttttccccaagcc

SEQ ID NO: 535629 - DNA, 25 bp, Rattus norvegicus
cgtcggagatttccatcggggctca

SEQ ID NO: 535630 - DNA, 25 bp, Rattus norvegicus
tcggagatttccatcggggctcagg

SEQ ID NO: 535631 - DNA, 25 bp, Rattus norvegicus
tgggcctcacgctgcaggctcgcct

SEQ ID NO: 535632 - DNA, 25 bp, Rattus norvegicus
ccctcccgccctggctgtctggcag

SEQ ID NO: 535633 - DNA, 25 bp, Rattus norvegicus
ccagcctcgctcctcgctgccgcag

SEQ ID NO: 535634 - DNA, 25 bp, Rattus norvegicus
tcctcgctgccgcagcgatcacgtc

SEQ ID NO: 535635 - DNA, 25 bp, Rattus norvegicus
gcagcaaagtacccggaacgcctgt

SEQ ID NO: 535636 - DNA, 25 bp, Rattus norvegicus
tcacgtcgtcggagatttccatcgg

SEQ ID NO: 535637 - DNA, 25 bp, Rattus norvegicus
cgatcacgtcgtcggagatttccat

SEQ ID NO: 535638 - DNA, 25 bp, Rattus norvegicus
aggctcgcctcctccttactcctcc

SEQ ID NO: 535639 - DNA, 25 bp, Rattus norvegicus
tgcttccttcaggtctttccttagg

SEQ ID NO: 535640 - DNA, 25 bp, Rattus norvegicus
ctcttggcgcttgcgggattggctc

SEQ ID NO: 535641 - DNA, 25 bp, Rattus norvegicus
ctttttgtgcagctcttggcgcttg

SEQ ID NO: 535642 - DNA, 25 bp, Rattus norvegicus
agacgaagcgcaccttgcagtggca

SEQ ID NO: 535643 - DNA, 25 bp, Rattus norvegicus
accttgcagtggcacgccctgtgga

SEQ ID NO: 535644 - DNA, 25 bp, Rattus norvegicus
gctgcggagctgctgttctttcagg

SEQ ID NO: 535645 - DNA, 25 bp, Rattus norvegicus
tctttccttagggtcccaattctgc

SEQ ID NO: 535646 - DNA, 25 bp, Rattus norvegicus
gggtcccaattctgcggaaggacta

SEQ ID NO: 535647 - DNA, 25 bp, Rattus norvegicus
tgcggaaggactagggatcccgccc

SEQ ID NO: 535648 - DNA, 25 bp, Rattus norvegicus
caagagcaccgcagccatgggcatc

SEQ ID NO: 535649 - DNA, 25 bp, Rattus norvegicus
ccgagcggtgccagacgaagcgcac

SEQ ID NO: 535650 - DNA, 25 bp, Rattus norvegicus
aagcgcgcgcctttttgtgcagctc

SEQ ID NO: 535651 - DNA, 25 bp, Rattus norvegicus
catccgaggcatgctgcgagccgct

SEQ ID NO: 535652 - DNA, 25 bp, Rattus norvegicus
tggcacgccctgtggaccgctgcgt

SEQ ID NO: 535653 - DNA, 25 bp, Rattus norvegicus
ccaaagattggcctcattgggcaaa

SEQ ID NO: 535654 - DNA, 25 bp, Rattus norvegicus
ctgacctggcaaagcacgcccaagg

SEQ ID NO: 535655 - DNA, 25 bp, Rattus norvegicus
agcgtcaattggctacgccagaggc

SEQ ID NO: 535656 - DNA, 25 bp, Rattus norvegicus
cctcattgggcaaaatcgtgctgtg

SEQ ID NO: 535657 - DNA, 25 bp, Rattus norvegicus
gcgatgcgtaggcagccaaagattg

SEQ ID NO: 535658 - DNA, 25 bp, Rattus norvegicus
cccaagggccaaagggcgatgcgta

SEQ ID NO: 535659 - DNA, 25 bp, Rattus norvegicus
cacagcccgcttcccattggtttgg

SEQ ID NO: 535660 - DNA, 25 bp, Rattus norvegicus
gtactcgcggccttggcggctttcc

SEQ ID NO: 535661 - DNA, 25 bp, Rattus norvegicus
gtagtccaccgaacctccagcactt

SEQ ID NO: 535662 - DNA, 25 bp, Rattus norvegicus
tgttaagtcaacagcgtactcgcgg

SEQ ID NO: 535663 - DNA, 25 bp, Rattus norvegicus
acgctgccaccggttgttaagtcaa

SEQ ID NO: 535664 - DNA, 25 bp, Rattus norvegicus
ccaacagacgctgccaccggttgtt

SEQ ID NO: 535665 - DNA, 25 bp, Rattus norvegicus
atcgtgctgtgagcgtcaattggct

SEQ ID NO: 535666 - DNA, 25 bp, Rattus norvegicus
cgcttcccattggtttgggaacgag

SEQ ID NO: 535667 - DNA, 25 bp, Rattus norvegicus
cgccacgaccgcacctctctctgcc

SEQ ID NO: 535668 - DNA, 25 bp, Rattus norvegicus
tcgccgtcctaaagaagtgacccga

SEQ ID NO: 535669 - DNA, 25 bp, Rattus norvegicus
ttgagtcgccgtcctaaagaagtga

SEQ ID NO: 535670 - DNA, 25 bp, Rattus norvegicus
cagccggagaaaacctgtttgttct

SEQ ID NO: 535671 - DNA, 25 bp, Rattus norvegicus
ggagcccattccgtgcctcctcgcg

SEQ ID NO: 535672 - DNA, 25 bp, Rattus norvegicus
ccacccgagggagcccgcgcgccac

SEQ ID NO: 535673 - DNA, 25 bp, Rattus norvegicus
tgttgagtcgccgtcctaaagaagt

SEQ ID NO: 535674 - DNA, 25 bp, Rattus norvegicus
cacaagccggcacctgtaccaggta

SEQ ID NO: 535675 - DNA, 25 bp, Rattus norvegicus
ccggcacctgtaccaggtagggttg

SEQ ID NO: 535676 - DNA, 25 bp, Rattus norvegicus
cacctgtaccaggtagggttgttga

SEQ ID NO: 535677 - DNA, 25 bp, Rattus norvegicus
ctgtaccaggtagggttgttgagtc

SEQ ID NO: 535678 - DNA, 25 bp, Rattus norvegicus
taccaggtagggttgttgagtcgcc

SEQ ID NO: 535679 - DNA, 25 bp, Rattus norvegicus
tagggttgttgagtcgccgtcctaa

SEQ ID NO: 535680 - DNA, 25 bp, Rattus norvegicus
cccgctgggtccagcgctgcccacc

SEQ ID NO: 535681 - DNA, 25 bp, Rattus norvegicus
gctgctgcaggtcactttcaacgtg

SEQ ID NO: 535682 - DNA, 25 bp, Rattus norvegicus
gagacctgtcttgggctctaccttg

SEQ ID NO: 535683 - DNA, 25 bp, Rattus norvegicus
tgttgcgcagtcacctggtacactc

SEQ ID NO: 535684 - DNA, 25 bp, Rattus norvegicus
gcagcagctgccttctgtgcctcag

SEQ ID NO: 535685 - DNA, 25 bp, Rattus norvegicus
tttttacacgcatgcaacgcctggc

SEQ ID NO: 535686 - DNA, 25 bp, Rattus norvegicus
cactggcgccctggcggtttttaca

SEQ ID NO: 535687 - DNA, 25 bp, Rattus norvegicus
cggcccgacttttcctgaggcagga

SEQ ID NO: 535688 - DNA, 25 bp, Rattus norvegicus
tcaagagtgcctgccttatgccgcc

SEQ ID NO: 535689 - DNA, 25 bp, Rattus norvegicus
taccggcaggtgtccaacaagctca

SEQ ID NO: 535690 - DNA, 25 bp, Rattus norvegicus
attgtgattcttgcgtggactagtc

SEQ ID NO: 535691 - DNA, 25 bp, Rattus norvegicus
cctcaaccggaagtaagccagcgcg

SEQ ID NO: 535692 - DNA, 25 bp, Rattus norvegicus
cgcagcgtagcgatagtcataactg

SEQ ID NO: 535693 - DNA, 25 bp, Rattus norvegicus
tggtacactcggtgccttcgctgac

SEQ ID NO: 535694 - DNA, 25 bp, Rattus norvegicus
cgctgctgccgcactgtgcctagaa

SEQ ID NO: 535695 - DNA, 25 bp, Rattus norvegicus
gccgctcttcttctgtgagggcaca

SEQ ID NO: 535696 - DNA, 25 bp, Rattus norvegicus
tggacctcgagagaatttacgggga

SEQ ID NO: 535697 - DNA, 25 bp, Rattus norvegicus
agtgcgtggacctcgagagaattta

SEQ ID NO: 535698 - DNA, 25 bp, Rattus norvegicus
gcaaggatatgtggccgagagagct

SEQ ID NO: 535699 - DNA, 25 bp, Rattus norvegicus
attgtgcgcgtgagcaaggatatgt

SEQ ID NO: 535700 - DNA, 25 bp, Rattus norvegicus
gatcttgagattgtgcgcgtgagca

SEQ ID NO: 535701 - DNA, 25 bp, Rattus norvegicus
tgcagctcgagtgatcttgagattg

SEQ ID NO: 535702 - DNA, 25 bp, Rattus norvegicus
aggcggggcttcgatctcagtaccc

SEQ ID NO: 535703 - DNA, 25 bp, Rattus norvegicus
cttctgtgagggcacagagtcaggc

SEQ ID NO: 535704 - DNA, 25 bp, Rattus norvegicus
accgcgccgctcttcttctgtgagg

SEQ ID NO: 535705 - DNA, 25 bp, Rattus norvegicus
ccacgccgggcctgcttacaccgcg

SEQ ID NO: 535706 - DNA, 25 bp, Rattus norvegicus
ctgctgggctacagggctccgccag

SEQ ID NO: 535707 - DNA, 25 bp, Rattus norvegicus
tccggaaacgcgctgctgggctaca

SEQ ID NO: 535708 - DNA, 25 bp, Rattus norvegicus
agggatgtgcagctcgagtgatctt

SEQ ID NO: 535709 - DNA, 25 bp, Rattus norvegicus
aagccctttgcgtgcaaggcgtgca

SEQ ID NO: 535710 - DNA, 25 bp, Rattus norvegicus
aaaccctatgagtgcgacaagtgtg

SEQ ID NO: 535711 - DNA, 25 bp, Rattus norvegicus
ggcgcatccatagcggactgaaacc

SEQ ID NO: 535712 - DNA, 25 bp, Rattus norvegicus
tccgagggccttctgacctcatcaa

SEQ ID NO: 535713 - DNA, 25 bp, Rattus norvegicus
cggcgactgcagcaaggctttccga

SEQ ID NO: 535714 - DNA, 25 bp, Rattus norvegicus
agcacacgcgcatccacagtggtga

SEQ ID NO: 535715 - DNA, 25 bp, Rattus norvegicus
ccctatgagtgcaaccagtgcggca

SEQ ID NO: 535716 - DNA, 25 bp, Rattus norvegicus
agctcaccaagcaccggaggatcca

SEQ ID NO: 535717 - DNA, 25 bp, Rattus norvegicus
cctcactgcggcaagctgttccgga

SEQ ID NO: 535718 - DNA, 25 bp, Rattus norvegicus
aaaccctacgggtgtcctcactgcg

SEQ ID NO: 535719 - DNA, 25 bp, Rattus norvegicus
gcggcaagtccttccgtggtgtcaa

SEQ ID NO: 535720 - DNA, 25 bp, Rattus norvegicus
acctgcccttcgactgcgatgactg

SEQ ID NO: 535721 - DNA, 25 bp, Rattus norvegicus
caccgtcggatccacagtggggcta

SEQ ID NO: 535722 - DNA, 25 bp, Rattus norvegicus
ggaacttctcaagcaccagcggatg

SEQ ID NO: 535723 - DNA, 25 bp, Rattus norvegicus
agtagcatggtgacaggcaagccca

SEQ ID NO: 535724 - DNA, 25 bp, Rattus norvegicus
ctccagccacgccacagggagcgcg

SEQ ID NO: 535725 - DNA, 25 bp, Rattus norvegicus
gacaggcaagcccaggagtgcaaaa

SEQ ID NO: 535726 - DNA, 25 bp, Rattus norvegicus
caagcccaggagtgcaaaaatgaag

SEQ ID NO: 535727 - DNA, 25 bp, Rattus norvegicus
aaaatgaaggagaaggctttgcctg

SEQ ID NO: 535728 - DNA, 25 bp, Rattus norvegicus
aaggctttgcctgcatcggtcagtg

SEQ ID NO: 535729 - DNA, 25 bp, Rattus norvegicus
ctgcatcggtcagtggggtcctgta

SEQ ID NO: 535730 - DNA, 25 bp, Rattus norvegicus
agtggggtcctgtagccatagccca

SEQ ID NO: 535731 - DNA, 25 bp, Rattus norvegicus
cctgtagccatagcccacagtggtg

SEQ ID NO: 535732 - DNA, 25 bp, Rattus norvegicus
tagcccacagtggtgactagcatgc

SEQ ID NO: 535733 - DNA, 25 bp, Rattus norvegicus
gcccacagtggtgactagcatgctg

SEQ ID NO: 535734 - DNA, 25 bp, Rattus norvegicus
gcgccaagcgccaggtaccagctta

SEQ ID NO: 535735 - DNA, 25 bp, Rattus norvegicus
ctgaggcagtcagaagtagcatggt

SEQ ID NO: 535736 - DNA, 25 bp, Rattus norvegicus
ccaggtaccagcttaggcggctagg

SEQ ID NO: 535737 - DNA, 25 bp, Rattus norvegicus
cacaggcgttggcattcgatctttc

SEQ ID NO: 535738 - DNA, 25 bp, Rattus norvegicus
ttcaccttggccattcatgctgcgc

SEQ ID NO: 535739 - DNA, 25 bp, Rattus norvegicus
ctggatctgtccgtgtgtctcggta

SEQ ID NO: 535740 - DNA, 25 bp, Rattus norvegicus
tttaatcaacttctgggagggcgtg

SEQ ID NO: 535741 - DNA, 25 bp, Rattus norvegicus
cggcggcctcatctctatgtattta

SEQ ID NO: 535742 - DNA, 25 bp, Rattus norvegicus
gtgctggcgccgaatacaagtgaca

SEQ ID NO: 535743 - DNA, 25 bp, Rattus norvegicus
aggcacatctgtatggcgccaagga

SEQ ID NO: 535744 - DNA, 25 bp, Rattus norvegicus
cccagatcgggctttgcttgtattg

SEQ ID NO: 535745 - DNA, 25 bp, Rattus norvegicus
tgacgggcacgtcctgactcccatt

SEQ ID NO: 535746 - DNA, 25 bp, Rattus norvegicus
gtgctttacgtacgcgcttcggatc

SEQ ID NO: 535747 - DNA, 25 bp, Rattus norvegicus
agccctgacagttcccattggcaga

SEQ ID NO: 535748 - DNA, 25 bp, Rattus norvegicus
cttctcctatgcctgtgcacggtga

SEQ ID NO: 535749 - DNA, 25 bp, Rattus norvegicus
cgtcacaggtgagtaccctggccta

SEQ ID NO: 535750 - DNA, 25 bp, Rattus norvegicus
gcagaatcctttgggtgggcagaca

SEQ ID NO: 535751 - DNA, 25 bp, Rattus norvegicus
gcggcaaggcattcagcagaagctc

SEQ ID NO: 535752 - DNA, 25 bp, Rattus norvegicus
cctacgagtgctctgagtgcggcaa

SEQ ID NO: 535753 - DNA, 25 bp, Rattus norvegicus
cagcttcgcgctgcttgagcatgcg

SEQ ID NO: 535754 - DNA, 25 bp, Rattus norvegicus
tcagcagaagctccaacctcataga

SEQ ID NO: 535755 - DNA, 25 bp, Rattus norvegicus
acagcggccggaagccctacatctg

SEQ ID NO: 535756 - DNA, 25 bp, Rattus norvegicus
gcgggaaggccttcaagggcatctc

SEQ ID NO: 535757 - DNA, 25 bp, Rattus norvegicus
accaccagcgcagtcaccgtggtga

SEQ ID NO: 535758 - DNA, 25 bp, Rattus norvegicus
tccaacctcatagagcatcagcgca

SEQ ID NO: 535759 - DNA, 25 bp, Rattus norvegicus
gcaaggccttccgaggccactcagg

SEQ ID NO: 535760 - DNA, 25 bp, Rattus norvegicus
agggctcagccaacaccagcgggtc

SEQ ID NO: 535761 - DNA, 25 bp, Rattus norvegicus
accagcgggtccatagcggcgagaa

SEQ ID NO: 535762 - DNA, 25 bp, Rattus norvegicus
ccctatgagtgcagcgaatgcggcc

SEQ ID NO: 535763 - DNA, 25 bp, Rattus norvegicus
tcaagggcatctcgcagctcatcca

SEQ ID NO: 535764 - DNA, 25 bp, Rattus norvegicus
cctacatctgccaggagtgcgggaa

SEQ ID NO: 535765 - DNA, 25 bp, Rattus norvegicus
tttcttgggtctctccgcccactag

SEQ ID NO: 535766 - DNA, 25 bp, Rattus norvegicus
caggactgaagtcacaatggcccac

SEQ ID NO: 535767 - DNA, 25 bp, Rattus norvegicus
tgctaaaggttcaccagtttcttgg

SEQ ID NO: 535768 - DNA, 25 bp, Rattus norvegicus
ctgccgcactgctaaaggttcacca

SEQ ID NO: 535769 - DNA, 25 bp, Rattus norvegicus
ggctcctgccgcactgctaaaggtt

SEQ ID NO: 535770 - DNA, 25 bp, Rattus norvegicus
aagcttacaggctcctgccgcactg

SEQ ID NO: 535771 - DNA, 25 bp, Rattus norvegicus
tctgaaccgaaaatggttcacgccc

SEQ ID NO: 535772 - DNA, 25 bp, Rattus norvegicus
tcgcgctctgaaccgaaaatggttc

SEQ ID NO: 535773 - DNA, 25 bp, Rattus norvegicus
ccatgtttcgcgctctgaaccgaaa

SEQ ID NO: 535774 - DNA, 25 bp, Rattus norvegicus
cggagccatccgtcaggactgaagt

SEQ ID NO: 535775 - DNA, 25 bp, Rattus norvegicus
tgtcgctcagtcattgcctgcgcgc

SEQ ID NO: 535776 - DNA, 25 bp, Rattus norvegicus
tgaagtcacaatggcccaccctctt

SEQ ID NO: 535777 - DNA, 25 bp, Rattus norvegicus
tctttcccaacgagccttcccattg

SEQ ID NO: 535778 - DNA, 25 bp, Rattus norvegicus
ttcccattgggctgtcgctcagtca

SEQ ID NO: 535779 - DNA, 25 bp, Rattus norvegicus
cggcgcggagcactattgtattcct

SEQ ID NO: 535780 - DNA, 25 bp, Rattus norvegicus
caaccgctacgtggagctggagcga

SEQ ID NO: 535781 - DNA, 25 bp, Rattus norvegicus
agtatcttcccgctccgaaaggctc

SEQ ID NO: 535782 - DNA, 25 bp, Rattus norvegicus
cgaaaggctcaaacagccagggtgc

SEQ ID NO: 535783 - DNA, 25 bp, Rattus norvegicus
ggcagctgaaagagcatgccctctg

SEQ ID NO: 535784 - DNA, 25 bp, Rattus norvegicus
attgtattcctgacactgtgcgctc

SEQ ID NO: 535785 - DNA, 25 bp, Rattus norvegicus
cccatgagtccctgatagcacagga

SEQ ID NO: 535786 - DNA, 25 bp, Rattus norvegicus
ctgatagcacaggacaagcacggga

SEQ ID NO: 535787 - DNA, 25 bp, Rattus norvegicus
gactccgatgggaacggccgccaca

SEQ ID NO: 535788 - DNA, 25 bp, Rattus norvegicus
cggccgccacagttatggcgcttaa

SEQ ID NO: 535789 - DNA, 25 bp, Rattus norvegicus
tatggcgcttaacgcctccggaggt

SEQ ID NO: 535790 - DNA, 25 bp, Rattus norvegicus
gctgtagtccagctcgcgtgtccgt

SEQ ID NO: 535791 - DNA, 25 bp, Rattus norvegicus
ggcgactgggcactttacctcagcc

SEQ ID NO: 535792 - DNA, 25 bp, Rattus norvegicus
gctctccattccaaggctctcgggg

SEQ ID NO: 535793 - DNA, 25 bp, Rattus norvegicus
cgaaagctacagcagaggccgcggt

SEQ ID NO: 535794 - DNA, 25 bp, Rattus norvegicus
cttgcagcactatgggtgcgcgtca

SEQ ID NO: 535795 - DNA, 25 bp, Rattus norvegicus
gtgcgcgtcaccctggggcctcaga

SEQ ID NO: 535796 - DNA, 25 bp, Rattus norvegicus
gcctgtatgtccttgcagcactatg

SEQ ID NO: 535797 - DNA, 25 bp, Rattus norvegicus
acaggcctggcctgtatgtccttgc

SEQ ID NO: 535798 - DNA, 25 bp, Rattus norvegicus
aaggcacctgctccctacaggcctg

SEQ ID NO: 535799 - DNA, 25 bp, Rattus norvegicus
gtggggagcactcggccacagccct

SEQ ID NO: 535800 - DNA, 25 bp, Rattus norvegicus
cccatgccggggtaagtggtgccct

SEQ ID NO: 535801 - DNA, 25 bp, Rattus norvegicus
cagcaacagcgaaagctacagcaga

SEQ ID NO: 535802 - DNA, 25 bp, Rattus norvegicus
atcgttgctcgcagggagctctcct

SEQ ID NO: 535803 - DNA, 25 bp, Rattus norvegicus
tccttggagcggatcgttgctcgca

SEQ ID NO: 535804 - DNA, 25 bp, Rattus norvegicus
ggcctttccgtccttggagcggatc

SEQ ID NO: 535805 - DNA, 25 bp, Rattus norvegicus
gcggagggtcctgctccgcactgct

SEQ ID NO: 535806 - DNA, 25 bp, Rattus norvegicus
ggtacgcaggatcccgcccaaggca

SEQ ID NO: 535807 - DNA, 25 bp, Rattus norvegicus
tgtcttctcttgaaccactgtggtt

SEQ ID NO: 535808 - DNA, 25 bp, Rattus norvegicus
tccgtctctggccgctgcacggaga

SEQ ID NO: 535809 - DNA, 25 bp, Rattus norvegicus
cgtatggtgaccatccgcagggcca

SEQ ID NO: 535810 - DNA, 25 bp, Rattus norvegicus
ccctgacctgcgtatggtgaccatc

SEQ ID NO: 535811 - DNA, 25 bp, Rattus norvegicus
aaagaacaagtaccaccctgacctg

SEQ ID NO: 535812 - DNA, 25 bp, Rattus norvegicus
ctgcacggagaggagtcgcccccat

SEQ ID NO: 535813 - DNA, 25 bp, Rattus norvegicus
atgagtgcctctttccgtctctggc

SEQ ID NO: 535814 - DNA, 25 bp, Rattus norvegicus
tttgctataaaagtatgagtgcctc

SEQ ID NO: 535815 - DNA, 25 bp, Rattus norvegicus
acttggtagggaattgtttgctata

SEQ ID NO: 535816 - DNA, 25 bp, Rattus norvegicus
tatggagatgacttggtagggaatt

SEQ ID NO: 535817 - DNA, 25 bp, Rattus norvegicus
gaaaagaggctatggagatgacttg

SEQ ID NO: 535818 - DNA, 25 bp, Rattus norvegicus
aaccactgtggttagcataaactga

SEQ ID NO: 535819 - DNA, 25 bp, Rattus norvegicus
gcaatagttgaaatgtcttctcttg

SEQ ID NO: 535820 - DNA, 25 bp, Rattus norvegicus
ctgtggttagcataaactgaattta

SEQ ID NO: 535821 - DNA, 25 bp, Rattus norvegicus
cattcccagcggaaagagggttttg

SEQ ID NO: 535822 - DNA, 25 bp, Rattus norvegicus
aacgttgtctctgggagttgcgctc

SEQ ID NO: 535823 - DNA, 25 bp, Rattus norvegicus
ggtcagtttgggaccgagcacacgc

SEQ ID NO: 535824 - DNA, 25 bp, Rattus norvegicus
cacgcccgttcctgccttggaggaa

SEQ ID NO: 535825 - DNA, 25 bp, Rattus norvegicus
ggtctccctaaatcctgactgctgg

SEQ ID NO: 535826 - DNA, 25 bp, Rattus norvegicus
cgcgaggagccctacaaggaaaatc

SEQ ID NO: 535827 - DNA, 25 bp, Rattus norvegicus
caaccgaaatcctgccactgggctg

SEQ ID NO: 535828 - DNA, 25 bp, Rattus norvegicus
gcgggaatcctgcattttgctgcga

SEQ ID NO: 535829 - DNA, 25 bp, Rattus norvegicus
cattttgctgcgagtagtgccgctc

SEQ ID NO: 535830 - DNA, 25 bp, Rattus norvegicus
gctctcggtcatctcaagggacctg

SEQ ID NO: 535831 - DNA, 25 bp, Rattus norvegicus
tgggagcgcccacaacatgcagtgg

SEQ ID NO: 535832 - DNA, 25 bp, Rattus norvegicus
cccaggcagtcggaagtcctagagg

SEQ ID NO: 535833 - DNA, 25 bp, Rattus norvegicus
tgaccgggcagcgacaaccgaaatc

SEQ ID NO: 535834 - DNA, 25 bp, Rattus norvegicus
cttggaggaattcccagtcccgcga

SEQ ID NO: 535835 - DNA, 25 bp, Rattus norvegicus
ccacgctgcgggagtagagaaaact

SEQ ID NO: 535836 - DNA, 25 bp, Rattus norvegicus
ggggactccgtctccatgaacgata

SEQ ID NO: 535837 - DNA, 25 bp, Rattus norvegicus
atgaacgatacctgcgccctgcctt

SEQ ID NO: 535838 - DNA, 25 bp, Rattus norvegicus
ggatctcgctccaggtctctccttt

SEQ ID NO: 535839 - DNA, 25 bp, Rattus norvegicus
acctcggtgaccctcttgttctctg

SEQ ID NO: 535840 - DNA, 25 bp, Rattus norvegicus
tgttctctgggtcttcccggctaga

SEQ ID NO: 535841 - DNA, 25 bp, Rattus norvegicus
ggaactggttttagtcctcctagca

SEQ ID NO: 535842 - DNA, 25 bp, Rattus norvegicus
cttcattcaagaggccgctagacgc

SEQ ID NO: 535843 - DNA, 25 bp, Rattus norvegicus
acgcctagctatcttctggggtata

SEQ ID NO: 535844 - DNA, 25 bp, Rattus norvegicus
ggggtatatctcttgaaactccatg

SEQ ID NO: 535845 - DNA, 25 bp, Rattus norvegicus
ttccctcaggacaggggttgacttc

SEQ ID NO: 535846 - DNA, 25 bp, Rattus norvegicus
tgcgcgaccatggagagtctgagtc

SEQ ID NO: 535847 - DNA, 25 bp, Rattus norvegicus
cagcttctgatactggactgccgca

SEQ ID NO: 535848 - DNA, 25 bp, Rattus norvegicus
cgccttccttggtgttctcactgtg

SEQ ID NO: 535849 - DNA, 25 bp, Rattus norvegicus
ctcctagcgcagtagctgttgtgtc

SEQ ID NO: 535850 - DNA, 25 bp, Rattus norvegicus
gtcacgaccacagccacccacgcag

SEQ ID NO: 535851 - DNA, 25 bp, Rattus norvegicus
cgccgcaatgtctcctagcgcagta

SEQ ID NO: 535852 - DNA, 25 bp, Rattus norvegicus
gccggttccgctcgcctgtttgccc

SEQ ID NO: 535853 - DNA, 25 bp, Rattus norvegicus
taagatgccttggtccctgtacgcc

SEQ ID NO: 535854 - DNA, 25 bp, Rattus norvegicus
tagcgcagtagctgttgtgtcgccg

SEQ ID NO: 535855 - DNA, 25 bp, Rattus norvegicus
gcaatgtctcctagcgcagtagctg

SEQ ID NO: 535856 - DNA, 25 bp, Rattus norvegicus
ctgcggagctaagatgccttggtcc

SEQ ID NO: 535857 - DNA, 25 bp, Rattus norvegicus
tgcttgcagccacctgtcacgacca

SEQ ID NO: 535858 - DNA, 25 bp, Rattus norvegicus
gctcgaatgcacctgcgaccctgct

SEQ ID NO: 535859 - DNA, 25 bp, Rattus norvegicus
gtaggtcaccaacccgctcgaatgc

SEQ ID NO: 535860 - DNA, 25 bp, Rattus norvegicus
gcctgtgtccagagctgcgtgggct

SEQ ID NO: 535861 - DNA, 25 bp, Rattus norvegicus
ggactccgcaacctcagccgcctgt

SEQ ID NO: 535862 - DNA, 25 bp, Rattus norvegicus
gagctaagatgccttggtccctgta

SEQ ID NO: 535863 - DNA, 25 bp, Rattus norvegicus
caagtgcttcgtggactgcttctga

SEQ ID NO: 535864 - DNA, 25 bp, Rattus norvegicus
ggcgacagtgacatcaccaggagtc

SEQ ID NO: 535865 - DNA, 25 bp, Rattus norvegicus
gcgaatctttgagtccgccgcggcc

SEQ ID NO: 535866 - DNA, 25 bp, Rattus norvegicus
cgcttgcagacagtgggcgtccgat

SEQ ID NO: 535867 - DNA, 25 bp, Rattus norvegicus
gattcttcaggctcactttcaagtg

SEQ ID NO: 535868 - DNA, 25 bp, Rattus norvegicus
caggagtcggttcttaagcagcagc

SEQ ID NO: 535869 - DNA, 25 bp, Rattus norvegicus
acggtatctatagcgtgtctggaga

SEQ ID NO: 535870 - DNA, 25 bp, Rattus norvegicus
tctggagacgagaagaagggtcctc

SEQ ID NO: 535871 - DNA, 25 bp, Rattus norvegicus
aagaagggtcctctcatcgtgtccg

SEQ ID NO: 535872 - DNA, 25 bp, Rattus norvegicus
cgccgcgagagacttggacacgcca

SEQ ID NO: 535873 - DNA, 25 bp, Rattus norvegicus
gacacgccagatggacttcatcatg

SEQ ID NO: 535874 - DNA, 25 bp, Rattus norvegicus
cttcatcatgtcgtgcgtgggcttc

SEQ ID NO: 535875 - DNA, 25 bp, Rattus norvegicus
cccgacacacatgagattcttcagg

SEQ ID NO: 535876 - DNA, 25 bp, Rattus norvegicus
gctagtcgtgcccaagaccaccgga

SEQ ID NO: 535877 - DNA, 25 bp, Rattus norvegicus
gacatgcttcgtctctgtagtcaga

SEQ ID NO: 535878 - DNA, 25 bp, Rattus norvegicus
taaggccgcttctctagcctacgcg

SEQ ID NO: 535879 - DNA, 25 bp, Rattus norvegicus
cttaggcgcggctagttaccaaggt

SEQ ID NO: 535880 - DNA, 25 bp, Rattus norvegicus
cgggaaggctaaggccgcttctcta

SEQ ID NO: 535881 - DNA, 25 bp, Rattus norvegicus
ccgacacttcggacatgcaggggtg

SEQ ID NO: 535882 - DNA, 25 bp, Rattus norvegicus
tggcagctgaatgcctcgcctccga

SEQ ID NO: 535883 - DNA, 25 bp, Rattus norvegicus
gtagaggttggcagctgaatgcctc

SEQ ID NO: 535884 - DNA, 25 bp, Rattus norvegicus
gcggctagttaccaaggtcttgaaa

SEQ ID NO: 535885 - DNA, 25 bp, Rattus norvegicus
cggacgcagcttaccgagtttcagc

SEQ ID NO: 535886 - DNA, 25 bp, Rattus norvegicus
ctagcctacgcggacatgcttcgtc

SEQ ID NO: 535887 - DNA, 25 bp, Rattus norvegicus
tcttgaaaggaagtagaggttggca

SEQ ID NO: 535888 - DNA, 25 bp, Rattus norvegicus
taccgagtttcagcctacgcgcacg

SEQ ID NO: 535889 - DNA, 25 bp, Rattus norvegicus
aaactctcaccaaagctcagatccg

SEQ ID NO: 535890 - DNA, 25 bp, Rattus norvegicus
tgcaactaccaaactctcaccaaag

SEQ ID NO: 535891 - DNA, 25 bp, Rattus norvegicus
ttactggaagttggagagatggaac

SEQ ID NO: 535892 - DNA, 25 bp, Rattus norvegicus
gccgcctgggccctctcccaacaca

SEQ ID NO: 535893 - DNA, 25 bp, Rattus norvegicus
agcttcgaaaattcgatccattttc

SEQ ID NO: 535894 - DNA, 25 bp, Rattus norvegicus
caacacacccaaatgaccagattca

SEQ ID NO: 535895 - DNA, 25 bp, Rattus norvegicus
tgaccagattcatcatagcacgaaa

SEQ ID NO: 535896 - DNA, 25 bp, Rattus norvegicus
tcctgatttcagttactggaagttg

SEQ ID NO: 535897 - DNA, 25 bp, Rattus norvegicus
gcgggtgagcttcgaaaattcgatc

SEQ ID NO: 535898 - DNA, 25 bp, Rattus norvegicus
cgcctcgttgatccgcgggtgagct

SEQ ID NO: 535899 - DNA, 25 bp, Rattus norvegicus
gattcatcatagcacgaaacttcgc

SEQ ID NO: 535900 - DNA, 25 bp, Rattus norvegicus
tcatagcacgaaacttcgcaagtta

SEQ ID NO: 535901 - DNA, 25 bp, Rattus norvegicus
gaaacttcgcaagttacacccactc

SEQ ID NO: 535902 - DNA, 25 bp, Rattus norvegicus
acacccactccctcgccggcagcgg

SEQ ID NO: 535903 - DNA, 25 bp, Rattus norvegicus
ggctactgcttcctgatttcagtta

SEQ ID NO: 535904 - DNA, 25 bp, Rattus norvegicus
atccgcgggtgagcttcgaaaattc

SEQ ID NO: 535905 - DNA, 25 bp, Rattus norvegicus
tgagaaaaagctagcactacgcacg

SEQ ID NO: 535906 - DNA, 25 bp, Rattus norvegicus
cgccataacgaaaagtgaggacctc

SEQ ID NO: 535907 - DNA, 25 bp, Rattus norvegicus
tccggcctatcttgctgctcaggta

SEQ ID NO: 535908 - DNA, 25 bp, Rattus norvegicus
cggcgatggcatctttcggcgccct

SEQ ID NO: 535909 - DNA, 25 bp, Rattus norvegicus
cctctacaggtcaaaacgttaagca

SEQ ID NO: 535910 - DNA, 25 bp, Rattus norvegicus
tcctcgtctgctccgcatgttcagg

SEQ ID NO: 535911 - DNA, 25 bp, Rattus norvegicus
cgacacttcggcacgacgagaaatc

SEQ ID NO: 535912 - DNA, 25 bp, Rattus norvegicus
ccttccggtgcctgtagcactgttg

SEQ ID NO: 535913 - DNA, 25 bp, Rattus norvegicus
tccgcatgttcagggcggcttgctc

SEQ ID NO: 535914 - DNA, 25 bp, Rattus norvegicus
ctagggaaacggacacgtcagtgcc

SEQ ID NO: 535915 - DNA, 25 bp, Rattus norvegicus
tcgtcgctaccggtgttatctttcc

SEQ ID NO: 535916 - DNA, 25 bp, Rattus norvegicus
gtcttggcgaccgaagcaccacaaa

SEQ ID NO: 535917 - DNA, 25 bp, Rattus norvegicus
ccgccgacgcacgattgggtgctga

SEQ ID NO: 535918 - DNA, 25 bp, Rattus norvegicus
taagcaccgttctcgcgacacttcg

SEQ ID NO: 535919 - DNA, 25 bp, Rattus norvegicus
agaggaaggagtctttcactggtca

SEQ ID NO: 535920 - DNA, 25 bp, Rattus norvegicus
ttgtctctagctcctgcccgggaca

SEQ ID NO: 535921 - DNA, 25 bp, Rattus norvegicus
ttctctagctcacggcgctctctga

SEQ ID NO: 535922 - DNA, 25 bp, Rattus norvegicus
agggtcccgcttctctagctcacgg

SEQ ID NO: 535923 - DNA, 25 bp, Rattus norvegicus
cgcgccagctgtagcctcgcagggt

SEQ ID NO: 535924 - DNA, 25 bp, Rattus norvegicus
ccagggagtccagcctccgggcttg

SEQ ID NO: 535925 - DNA, 25 bp, Rattus norvegicus
cccatggctatcagcccagggagtc

SEQ ID NO: 535926 - DNA, 25 bp, Rattus norvegicus
cttaactctttgctggccgaggcca

SEQ ID NO: 535927 - DNA, 25 bp, Rattus norvegicus
gcctctcgacttaactctttgctgg

SEQ ID NO: 535928 - DNA, 25 bp, Rattus norvegicus
tccctgggaccagataacgcatatg

SEQ ID NO: 535929 - DNA, 25 bp, Rattus norvegicus
ctttcactggtcagcgcgtgggacc

SEQ ID NO: 535930 - DNA, 25 bp, Rattus norvegicus
cacagccggtcgcttgtctctagct

SEQ ID NO: 535931 - DNA, 25 bp, Rattus norvegicus
ccagataacgcatatgtccgatggc

SEQ ID NO: 535932 - DNA, 25 bp, Rattus norvegicus
aggaaggcagctccacgcctctcga

SEQ ID NO: 535933 - DNA, 25 bp, Rattus norvegicus
tcagagcctgagaactaagaacgtc

SEQ ID NO: 535934 - DNA, 25 bp, Rattus norvegicus
caagccgctgatttagccaaccaga

SEQ ID NO: 535935 - DNA, 25 bp, Rattus norvegicus
catcagcacgctgggtggaacaagc

SEQ ID NO: 535936 - DNA, 25 bp, Rattus norvegicus
gaacgtcaccggcttgcgaacagga

SEQ ID NO: 535937 - DNA, 25 bp, Rattus norvegicus
tgctgcagaaccaatcagagcctga

SEQ ID NO: 535938 - DNA, 25 bp, Rattus norvegicus
ggtgggtctagtgctgcagaaccaa

SEQ ID NO: 535939 - DNA, 25 bp, Rattus norvegicus
caccattagggcacggccgagccag

SEQ ID NO: 535940 - DNA, 25 bp, Rattus norvegicus
cgcctaaagaggatccgcaagctcc

SEQ ID NO: 535941 - DNA, 25 bp, Rattus norvegicus
agaagcttccttatgcgcctaaaga

SEQ ID NO: 535942 - DNA, 25 bp, Rattus norvegicus
ggccggcctcgagaagcttccttat

SEQ ID NO: 535943 - DNA, 25 bp, Rattus norvegicus
cctaagcaaccagcgcagagggccg

SEQ ID NO: 535944 - DNA, 25 bp, Rattus norvegicus
tggccgccaatgacacctaagcaac

SEQ ID NO: 535945 - DNA, 25 bp, Rattus norvegicus
cagcagagcttcagctggccgccaa

SEQ ID NO: 535946 - DNA, 25 bp, Rattus norvegicus
cttgcgaacaggaaccgacatcagc

SEQ ID NO: 535947 - DNA, 25 bp, Rattus norvegicus
cccgatcaggaaaaacacaactctg

SEQ ID NO: 535948 - DNA, 25 bp, Rattus norvegicus
agcagccctcgattagcgtcgcgct

SEQ ID NO: 535949 - DNA, 25 bp, Rattus norvegicus
aaaagccaaccagtgcagtccgcca

SEQ ID NO: 535950 - DNA, 25 bp, Rattus norvegicus
gtgcatccacgtcaggactttaaaa

SEQ ID NO: 535951 - DNA, 25 bp, Rattus norvegicus
ggaaccaagtgcatccacgtcagga

SEQ ID NO: 535952 - DNA, 25 bp, Rattus norvegicus
ctcgaagaccggaaccaagtgcatc

SEQ ID NO: 535953 - DNA, 25 bp, Rattus norvegicus
cagtccctttggagaaaactcgaag

SEQ ID NO: 535954 - DNA, 25 bp, Rattus norvegicus
gcaggacagtccctttggagaaaac

SEQ ID NO: 535955 - DNA, 25 bp, Rattus norvegicus
ttggccttcccaggcaggacagtcc

SEQ ID NO: 535956 - DNA, 25 bp, Rattus norvegicus
aacggaagtcactatgtctccctcc

SEQ ID NO: 535957 - DNA, 25 bp, Rattus norvegicus
gcctaggagaaggaaacggaagtca

SEQ ID NO: 535958 - DNA, 25 bp, Rattus norvegicus
aaacacaactctgctgggcggcggg

SEQ ID NO: 535959 - DNA, 25 bp, Rattus norvegicus
gcgccaagcaatccagtcctaacta

SEQ ID NO: 535960 - DNA, 25 bp, Rattus norvegicus
ctcgattagcgtcgcgctcgctcgg

SEQ ID NO: 535961 - DNA, 25 bp, Rattus norvegicus
cgaccgcggagtcatggagcctagt

SEQ ID NO: 535962 - DNA, 25 bp, Rattus norvegicus
aaggactggccgcccgccggacaga

SEQ ID NO: 535963 - DNA, 25 bp, Rattus norvegicus
tgctgccactgttgcccatgctgct

SEQ ID NO: 535964 - DNA, 25 bp, Rattus norvegicus
ccgcggagtcatggagcctagtgac

SEQ ID NO: 535965 - DNA, 25 bp, Rattus norvegicus
actgttgcccatgctgctgggtcgg

SEQ ID NO: 535966 - DNA, 25 bp, Rattus norvegicus
gcgtggaaaaggcacgggcgaccgc

SEQ ID NO: 535967 - DNA, 25 bp, Rattus norvegicus
gctcttgctggtccccgcgtggaaa

SEQ ID NO: 535968 - DNA, 25 bp, Rattus norvegicus
tggccaccggggttagtccgccgca

SEQ ID NO: 535969 - DNA, 25 bp, Rattus norvegicus
cccggctaggcgctagcagcgggag

SEQ ID NO: 535970 - DNA, 25 bp, Rattus norvegicus
gggatcctgcgcactgcgcgcgccc

SEQ ID NO: 535971 - DNA, 25 bp, Rattus norvegicus
tggccttgtcgctcctctaggcggg

SEQ ID NO: 535972 - DNA, 25 bp, Rattus norvegicus
agccgggtggccttgtcgctcctct

SEQ ID NO: 535973 - DNA, 25 bp, Rattus norvegicus
acagaggggaggatagagctcgccc

SEQ ID NO: 535974 - DNA, 25 bp, Rattus norvegicus
cccggcagagctgttccggggctgt

SEQ ID NO: 535975 - DNA, 25 bp, Rattus norvegicus
ctggagcccattcaacgagacctga

SEQ ID NO: 535976 - DNA, 25 bp, Rattus norvegicus
tcgatagcatgctcacgcggtcacc

SEQ ID NO: 535977 - DNA, 25 bp, Rattus norvegicus
tcacccggtaaagcgcccagtctgt

SEQ ID NO: 535978 - DNA, 25 bp, Rattus norvegicus
agtctgtgtgcacaaggctggctcc

SEQ ID NO: 535979 - DNA, 25 bp, Rattus norvegicus
tcacctcaccctagcattgcggatg

SEQ ID NO: 535980 - DNA, 25 bp, Rattus norvegicus
cggcggccactcagaaacagggtag

SEQ ID NO: 535981 - DNA, 25 bp, Rattus norvegicus
agccggcctacagcggaagtactca

SEQ ID NO: 535982 - DNA, 25 bp, Rattus norvegicus
gtactcagctatgggattcacctcc

SEQ ID NO: 535983 - DNA, 25 bp, Rattus norvegicus
gcacaaccaatgagcggggcactta

SEQ ID NO: 535984 - DNA, 25 bp, Rattus norvegicus
gcaaggcccaacagcatgaggagta

SEQ ID NO: 535985 - DNA, 25 bp, Rattus norvegicus
cgtggaacagggtcagctttatttc

SEQ ID NO: 535986 - DNA, 25 bp, Rattus norvegicus
ggctcccaaaatctgctcgcacatg

SEQ ID NO: 535987 - DNA, 25 bp, Rattus norvegicus
ggcggcgtgcaaaatgctccagttc

SEQ ID NO: 535988 - DNA, 25 bp, Rattus norvegicus
cgcgggataattgcgagatgtctaa

SEQ ID NO: 535989 - DNA, 25 bp, Rattus norvegicus
aaatgccgcggttgtctcagctccg

SEQ ID NO: 535990 - DNA, 25 bp, Rattus norvegicus
ctgcgggcgtcaatagcgactttta

SEQ ID NO: 535991 - DNA, 25 bp, Rattus norvegicus
gccgctgtgcagtaggctaaagaca

SEQ ID NO: 535992 - DNA, 25 bp, Rattus norvegicus
aggacccaaggctcataaggaatta

SEQ ID NO: 535993 - DNA, 25 bp, Rattus norvegicus
gcatgtcttagcctctgctcccaag

SEQ ID NO: 535994 - DNA, 25 bp, Rattus norvegicus
taacaactaaacatggcggctatcg

SEQ ID NO: 535995 - DNA, 25 bp, Rattus norvegicus
gccgccatcttgtgtgaagaagtaa

SEQ ID NO: 535996 - DNA, 25 bp, Rattus norvegicus
tgagtccgcctctgaattcaggctg

SEQ ID NO: 535997 - DNA, 25 bp, Rattus norvegicus
aggtttagcacctctcccttgagtc

SEQ ID NO: 535998 - DNA, 25 bp, Rattus norvegicus
gccgtatggctcgtaaggtttagca

SEQ ID NO: 535999 - DNA, 25 bp, Rattus norvegicus
gctggcgaaacggactcgaactccc

SEQ ID NO: 536000 - DNA, 25 bp, Rattus norvegicus
agcacttaagacaccgaccgcagaa

SEQ ID NO: 536001 - DNA, 25 bp, Rattus norvegicus
cacaattgtggaagccgccatcttg

SEQ ID NO: 536002 - DNA, 25 bp, Rattus norvegicus
tccgtcggcagtcagaccacaattg

SEQ ID NO: 536003 - DNA, 25 bp, Rattus norvegicus
cacacgcgcgttgcggttgatccag

SEQ ID NO: 536004 - DNA, 25 bp, Rattus norvegicus
gggcgtctcgtgaggcccttaactc

SEQ ID NO: 536005 - DNA, 25 bp, Rattus norvegicus
tgtgaacgaggtcagccacacgcgc

SEQ ID NO: 536006 - DNA, 25 bp, Rattus norvegicus
ttgatccagggccacaggacactgg

SEQ ID NO: 536007 - DNA, 25 bp, Rattus norvegicus
tgcgctgctcggagcgctcacacag

SEQ ID NO: 536008 - DNA, 25 bp, Rattus norvegicus
acacagccgcagctctgtctggtcg

SEQ ID NO: 536009 - DNA, 25 bp, Rattus norvegicus
ctggtcgcgcacgatcaaggccgct

SEQ ID NO: 536010 - DNA, 25 bp, Rattus norvegicus
acggggaacatcaggcttcagctcc

SEQ ID NO: 536011 - DNA, 25 bp, Rattus norvegicus
cttcagctccagaagcctgggtcca

SEQ ID NO: 536012 - DNA, 25 bp, Rattus norvegicus
cgaactggcaccagtcggcgggctc

SEQ ID NO: 536013 - DNA, 25 bp, Rattus norvegicus
gaaacggcacataacccagggaggc

SEQ ID NO: 536014 - DNA, 25 bp, Rattus norvegicus
agggaggcacctcgtacaagaaatg

SEQ ID NO: 536015 - DNA, 25 bp, Rattus norvegicus
acaagaaatgctgggcgccgggaac

SEQ ID NO: 536016 - DNA, 25 bp, Rattus norvegicus
ccagggcgtccatcactttgtagaa

SEQ ID NO: 536017 - DNA, 25 bp, Rattus norvegicus
gaaacccagacgacaagggcgcttg

SEQ ID NO: 536018 - DNA, 25 bp, Rattus norvegicus
gctgaggaccgtcgctcgcaattgc

SEQ ID NO: 536019 - DNA, 25 bp, Rattus norvegicus
gagatcgcgctgaggaccgtcgctc

SEQ ID NO: 536020 - DNA, 25 bp, Rattus norvegicus
attcgaaggtggctcgagggagatc

SEQ ID NO: 536021 - DNA, 25 bp, Rattus norvegicus
ccaacgggagatggactgcgcacgc

SEQ ID NO: 536022 - DNA, 25 bp, Rattus norvegicus
cccagacgacaagggcgcttgcaaa

SEQ ID NO: 536023 - DNA, 25 bp, Rattus norvegicus
ctggcgaaacccagacgacaagggc

SEQ ID NO: 536024 - DNA, 25 bp, Rattus norvegicus
ctcccaacgggagatggactgcgca

SEQ ID NO: 536025 - DNA, 25 bp, Rattus norvegicus
gacagcgcgatccagggagaggccg

SEQ ID NO: 536026 - DNA, 25 bp, Rattus norvegicus
agggcgtcattcgaaggtggctcga

SEQ ID NO: 536027 - DNA, 25 bp, Rattus norvegicus
aagatgcgcacagatggggcgggca

SEQ ID NO: 536028 - DNA, 25 bp, Rattus norvegicus
gctggggcccaagatgcgcacagat

SEQ ID NO: 536029 - DNA, 25 bp, Rattus norvegicus
ccaactggcgaaacccagacgacaa

SEQ ID NO: 536030 - DNA, 25 bp, Rattus norvegicus
acgacaagggcgcttgcaaaggctg

SEQ ID NO: 536031 - DNA, 25 bp, Rattus norvegicus
tcgcggaagcaggtgagagacttca

SEQ ID NO: 536032 - DNA, 25 bp, Rattus norvegicus
gacttcaatcaggtaagggaggatg

SEQ ID NO: 536033 - DNA, 25 bp, Rattus norvegicus
gaagtgacttctggctccgtccgct

SEQ ID NO: 536034 - DNA, 25 bp, Rattus norvegicus
tccgtccgctgtgagcgatcaccag

SEQ ID NO: 536035 - DNA, 25 bp, Rattus norvegicus
tgagcgatcaccagctctggacaga

SEQ ID NO: 536036 - DNA, 25 bp, Rattus norvegicus
ctggacagacccagcgagaggcctt

SEQ ID NO: 536037 - DNA, 25 bp, Rattus norvegicus
tgaaggctcttctgaacccgactgc

SEQ ID NO: 536038 - DNA, 25 bp, Rattus norvegicus
tccagaaacgtcacttccgttggga

SEQ ID NO: 536039 - DNA, 25 bp, Rattus norvegicus
cccagccgctgctggtgaggagctc

SEQ ID NO: 536040 - DNA, 25 bp, Rattus norvegicus
ggcgtgacgtgaaggctcttctgaa

SEQ ID NO: 536041 - DNA, 25 bp, Rattus norvegicus
ttccgttgggaactcgacacaagcc

SEQ ID NO: 536042 - DNA, 25 bp, Rattus norvegicus
agagccagcgcgtcacttccagaaa

SEQ ID NO: 536043 - DNA, 25 bp, Rattus norvegicus
gaactcgacacaagcccgccagggt

SEQ ID NO: 536044 - DNA, 25 bp, Rattus norvegicus
ccagggtctagtgcctctgtgagag

SEQ ID NO: 536045 - DNA, 25 bp, Rattus norvegicus
cccgggcgtgcattgtgtgtatgca

SEQ ID NO: 536046 - DNA, 25 bp, Rattus norvegicus
agtatctgcccaaccctgtggcagc

SEQ ID NO: 536047 - DNA, 25 bp, Rattus norvegicus
gttgtgcggaggtgatgtatcaccc

SEQ ID NO: 536048 - DNA, 25 bp, Rattus norvegicus
tagcagctggttcagcgacgcggac

SEQ ID NO: 536049 - DNA, 25 bp, Rattus norvegicus
ggatccgccttagccgcagtagcag

SEQ ID NO: 536050 - DNA, 25 bp, Rattus norvegicus
ttgaaaatgaaggtgcccgcgcatg

SEQ ID NO: 536051 - DNA, 25 bp, Rattus norvegicus
ccgtcgctatataagcgcgagcaga

SEQ ID NO: 536052 - DNA, 25 bp, Rattus norvegicus
gctacagcgtcgtcccgtcgctata

SEQ ID NO: 536053 - DNA, 25 bp, Rattus norvegicus
tgagcctgagcacagcgctgtcatg

SEQ ID NO: 536054 - DNA, 25 bp, Rattus norvegicus
gagtacgctcctgtctctgatgcca

SEQ ID NO: 536055 - DNA, 25 bp, Rattus norvegicus
actctagcggggatcctgctgcagc

SEQ ID NO: 536056 - DNA, 25 bp, Rattus norvegicus
tgcaaagcatcgcttggctcccggg

SEQ ID NO: 536057 - DNA, 25 bp, Rattus norvegicus
cccgcgctagtgataggacaagtcc

SEQ ID NO: 536058 - DNA, 25 bp, Rattus norvegicus
caccgggtatcggtgtcaggctcac

SEQ ID NO: 536059 - DNA, 25 bp, Rattus norvegicus
cagcgtcgcgcagtaggagaccgtt

SEQ ID NO: 536060 - DNA, 25 bp, Rattus norvegicus
aattcgggctgagcccttgcctctc

SEQ ID NO: 536061 - DNA, 25 bp, Rattus norvegicus
gcccagggaattcgggctgagccct

SEQ ID NO: 536062 - DNA, 25 bp, Rattus norvegicus
tcaccgcccagggaattcgggctga

SEQ ID NO: 536063 - DNA, 25 bp, Rattus norvegicus
cactcacctactcctgccgctgggg

SEQ ID NO: 536064 - DNA, 25 bp, Rattus norvegicus
aggctgctgctgcactcacctactc

SEQ ID NO: 536065 - DNA, 25 bp, Rattus norvegicus
ggtaaggtcaccctgcaggctgctg

SEQ ID NO: 536066 - DNA, 25 bp, Rattus norvegicus
agcctacaggtaaggtcaccctgca

SEQ ID NO: 536067 - DNA, 25 bp, Rattus norvegicus
ggagtgcagcctacaggtaaggtca

SEQ ID NO: 536068 - DNA, 25 bp, Rattus norvegicus
ctgaccgtgaaagcgctccagggca

SEQ ID NO: 536069 - DNA, 25 bp, Rattus norvegicus
tgcagctgaccgtgaaagcgctcca

SEQ ID NO: 536070 - DNA, 25 bp, Rattus norvegicus
gtggacaccatgcagctgaccgtga

SEQ ID NO: 536071 - DNA, 25 bp, Rattus norvegicus
tctccacctcggccggatcaggtgg

SEQ ID NO: 536072 - DNA, 25 bp, Rattus norvegicus
acggtgcggtggacaccatgcagct

SEQ ID NO: 536073 - DNA, 25 bp, Rattus norvegicus
tctgagccgcagcaatggcggagga

SEQ ID NO: 536074 - DNA, 25 bp, Rattus norvegicus
ctctcaattcgcacaggcgcctgtg

SEQ ID NO: 536075 - DNA, 25 bp, Rattus norvegicus
tcgcacaggcgcctgtggaatggca

SEQ ID NO: 536076 - DNA, 25 bp, Rattus norvegicus
caggcgcctgtggaatggcagcctt

SEQ ID NO: 536077 - DNA, 25 bp, Rattus norvegicus
ataaggcgggttctgagccgcagca

SEQ ID NO: 536078 - DNA, 25 bp, Rattus norvegicus
ctggtgacaggaggataggtttgaa

SEQ ID NO: 536079 - DNA, 25 bp, Rattus norvegicus
agcaacagcagccatgcagacggca

SEQ ID NO: 536080 - DNA, 25 bp, Rattus norvegicus
atgcagacggcacacgcagggttaa

SEQ ID NO: 536081 - DNA, 25 bp, Rattus norvegicus
agccatactgcaggtggcgccgaca

SEQ ID NO: 536082 - DNA, 25 bp, Rattus norvegicus
cagggttaagccatactgcaggtgg

SEQ ID NO: 536083 - DNA, 25 bp, Rattus norvegicus
catactgcaggtggcgccgacagtc

SEQ ID NO: 536084 - DNA, 25 bp, Rattus norvegicus
gcacacgcagggttaagccatactg

SEQ ID NO: 536085 - DNA, 25 bp, Rattus norvegicus
gagagtcctcttgccggctctctca

SEQ ID NO: 536086 - DNA, 25 bp, Rattus norvegicus
taggtttgaaggaggagcaacagca

SEQ ID NO: 536087 - DNA, 25 bp, Rattus norvegicus
gggtgtccacccgtagccacgtgga

SEQ ID NO: 536088 - DNA, 25 bp, Rattus norvegicus
ggctgactcagggtgtccacccgta

SEQ ID NO: 536089 - DNA, 25 bp, Rattus norvegicus
gcggctgactcagggtgtccacccg

SEQ ID NO: 536090 - DNA, 25 bp, Rattus norvegicus
ctgactcagggtgtccacccgtagc

SEQ ID NO: 536091 - DNA, 25 bp, Rattus norvegicus
tcagggtgtccacccgtagccacgt

SEQ ID NO: 536092 - DNA, 25 bp, Rattus norvegicus
gccgcccacacactgggctggcccg

SEQ ID NO: 536093 - DNA, 25 bp, Rattus norvegicus
tgtccacccgtagccacgtggacgt

SEQ ID NO: 536094 - DNA, 25 bp, Rattus norvegicus
gtagccacgtggacgtgcccccgtg

SEQ ID NO: 536095 - DNA, 25 bp, Rattus norvegicus
aaactcgccccgcacgttgcaaaat

SEQ ID NO: 536096 - DNA, 25 bp, Rattus norvegicus
ccgcacgttgcaaaatctgcaaccg

SEQ ID NO: 536097 - DNA, 25 bp, Rattus norvegicus
gcacgttgcaaaatctgcaaccgcc

SEQ ID NO: 536098 - DNA, 25 bp, Rattus norvegicus
gttgcaaaatctgcaaccgccgccg

SEQ ID NO: 536099 - DNA, 25 bp, Rattus norvegicus
acacactgggctggcccgcggccgc

SEQ ID NO: 536100 - DNA, 25 bp, Rattus norvegicus
gactcagggtgtccacccgtagcca

SEQ ID NO: 536101 - DNA, 25 bp, Rattus norvegicus
cacagtaccagtggcacctgctgct

SEQ ID NO: 536102 - DNA, 25 bp, Rattus norvegicus
ctgcagatcagatgaccgtcacctc

SEQ ID NO: 536103 - DNA, 25 bp, Rattus norvegicus
gactcatccacagcggcgcaccgca

SEQ ID NO: 536104 - DNA, 25 bp, Rattus norvegicus
atggcactcccgaacccaacctggc

SEQ ID NO: 536105 - DNA, 25 bp, Rattus norvegicus
ggccggccagcccaaccagacctgg

SEQ ID NO: 536106 - DNA, 25 bp, Rattus norvegicus
tggccctgtccgctcaccggtcact

SEQ ID NO: 536107 - DNA, 25 bp, Rattus norvegicus
cggtcactcgaccacagtaccagtg

SEQ ID NO: 536108 - DNA, 25 bp, Rattus norvegicus
agccacaggactggagcccaccgtg

SEQ ID NO: 536109 - DNA, 25 bp, Rattus norvegicus
aggactggagcccaccgtgtcccgg

SEQ ID NO: 536110 - DNA, 25 bp, Rattus norvegicus
cgtgtcccggttcgtatccgagata

SEQ ID NO: 536111 - DNA, 25 bp, Rattus norvegicus
atccgagataccactgttgccgcca

SEQ ID NO: 536112 - DNA, 25 bp, Rattus norvegicus
ctgtgccgctgcagatcagatgacc

SEQ ID NO: 536113 - DNA, 25 bp, Rattus norvegicus
caccaacgacagaagcagccacagg

SEQ ID NO: 536114 - DNA, 25 bp, Rattus norvegicus
agccttcagtgcctgtgccgctgca

SEQ ID NO: 536115 - DNA, 25 bp, Rattus norvegicus
gtcggcgactctgccggaaagcaag

SEQ ID NO: 536116 - DNA, 25 bp, Rattus norvegicus
gcggacctacgccagcctcgctccg

SEQ ID NO: 536117 - DNA, 25 bp, Rattus norvegicus
atgcctaggtcgcttgacggctgcc

SEQ ID NO: 536118 - DNA, 25 bp, Rattus norvegicus
cgcaaaacatgcctaggtcgcttga

SEQ ID NO: 536119 - DNA, 25 bp, Rattus norvegicus
ccttgactgttgtcgcaaaacatgc

SEQ ID NO: 536120 - DNA, 25 bp, Rattus norvegicus
ctctgccggaaagcaagtcggggaa

SEQ ID NO: 536121 - DNA, 25 bp, Rattus norvegicus
ctaaaaagcaagtcttggtggcctc

SEQ ID NO: 536122 - DNA, 25 bp, Rattus norvegicus
ctcaggggacgagacagggttgcaa

SEQ ID NO: 536123 - DNA, 25 bp, Rattus norvegicus
gggttgcaaagccacgcgcactaaa

SEQ ID NO: 536124 - DNA, 25 bp, Rattus norvegicus
gaagggtccttgactgttgtcgcaa

SEQ ID NO: 536125 - DNA, 25 bp, Rattus norvegicus
cgcgcactaaaaagcaagtcttggt

SEQ ID NO: 536126 - DNA, 25 bp, Rattus norvegicus
ctcaggtcggcgactctgccggaaa

SEQ ID NO: 536127 - DNA, 25 bp, Rattus norvegicus
ttggtggcctcaggtcggcgactct

SEQ ID NO: 536128 - DNA, 25 bp, Rattus norvegicus
agccacgcgcactaaaaagcaagtc

SEQ ID NO: 536129 - DNA, 25 bp, Rattus norvegicus
tccgggtgctggttaaagagttcac

SEQ ID NO: 536130 - DNA, 25 bp, Rattus norvegicus
tgccacatgggctcgtacaagtaga

SEQ ID NO: 536131 - DNA, 25 bp, Rattus norvegicus
tgcccggatacagtgcctgccacag

SEQ ID NO: 536132 - DNA, 25 bp, Rattus norvegicus
gcaggctttccgcattgcccggata

SEQ ID NO: 536133 - DNA, 25 bp, Rattus norvegicus
cgtacaggcggagcacagagaaatc

SEQ ID NO: 536134 - DNA, 25 bp, Rattus norvegicus
cggcgagcagatgaccttgttggtc

SEQ ID NO: 536135 - DNA, 25 bp, Rattus norvegicus
ggcaggtactttcacaggctttgtc

SEQ ID NO: 536136 - DNA, 25 bp, Rattus norvegicus
ttgatgaccaccaccgggtacttgc

SEQ ID NO: 536137 - DNA, 25 bp, Rattus norvegicus
agcagccgcacgtccttgatgacca

SEQ ID NO: 536138 - DNA, 25 bp, Rattus norvegicus
ggtctcggaagagctgcactacctt

SEQ ID NO: 536139 - DNA, 25 bp, Rattus norvegicus
agcacctggatgctttcgcgcagca

SEQ ID NO: 536140 - DNA, 25 bp, Rattus norvegicus
cgccaggtggcatgcacatagatgt

SEQ ID NO: 536141 - DNA, 25 bp, Rattus norvegicus
cgagcgcactggttaagaagaaatc

SEQ ID NO: 536142 - DNA, 25 bp, Rattus norvegicus
tcctcataacgcagccgcaggtagc

SEQ ID NO: 536143 - DNA, 25 bp, Rattus norvegicus
ggcggcctatcttccagtataagaa

SEQ ID NO: 536144 - DNA, 25 bp, Rattus norvegicus
aatagggagccgcatgctggcgaat

SEQ ID NO: 536145 - DNA, 25 bp, Rattus norvegicus
ctgaataccggaatagggagccgca

SEQ ID NO: 536146 - DNA, 25 bp, Rattus norvegicus
cggaccctattggtgactgaatacc

SEQ ID NO: 536147 - DNA, 25 bp, Rattus norvegicus
accgaaacatacacggaccctattg

SEQ ID NO: 536148 - DNA, 25 bp, Rattus norvegicus
tgtaccaggcgggaccgaaacatac

SEQ ID NO: 536149 - DNA, 25 bp, Rattus norvegicus
gtgctctgcgcatgtgtaccaggcg

SEQ ID NO: 536150 - DNA, 25 bp, Rattus norvegicus
taaaatcatagatgcggcggtgctc

SEQ ID NO: 536151 - DNA, 25 bp, Rattus norvegicus
gtcgacgctctatcagacactaaaa

SEQ ID NO: 536152 - DNA, 25 bp, Rattus norvegicus
ctggcgaatggggtttcgacacatc

SEQ ID NO: 536153 - DNA, 25 bp, Rattus norvegicus
agtataagaaccatagagtcccagc

SEQ ID NO: 536154 - DNA, 25 bp, Rattus norvegicus
gcatgccttatataggcggcctatc

SEQ ID NO: 536155 - DNA, 25 bp, Rattus norvegicus
ccacgcctgcgcatgccttatatag

SEQ ID NO: 536156 - DNA, 25 bp, Rattus norvegicus
ccaaggggtggtgtcgacgctctat

SEQ ID NO: 536157 - DNA, 25 bp, Rattus norvegicus
ccggctgcagcatacccacaatagg

SEQ ID NO: 536158 - DNA, 25 bp, Rattus norvegicus
accgcatagtcgtccatggcagaca

SEQ ID NO: 536159 - DNA, 25 bp, Rattus norvegicus
ctgggtctcgtactcgaagattttc

SEQ ID NO: 536160 - DNA, 25 bp, Rattus norvegicus
agcctgcccagacacagggtgcgaa

SEQ ID NO: 536161 - DNA, 25 bp, Rattus norvegicus
aagccgccgtcacgtttgcgtcaca

SEQ ID NO: 536162 - DNA, 25 bp, Rattus norvegicus
ccacaataggcccatgcgggatgtt

SEQ ID NO: 536163 - DNA, 25 bp, Rattus norvegicus
ttgtactggcgtagcactgcggcca

SEQ ID NO: 536164 - DNA, 25 bp, Rattus norvegicus
tgcggccagctcagtatcggacaaa

SEQ ID NO: 536165 - DNA, 25 bp, Rattus norvegicus
tcacagccgctgctacgcaggttgc

SEQ ID NO: 536166 - DNA, 25 bp, Rattus norvegicus
ccggcacctggaagcggtgttgaac

SEQ ID NO: 536167 - DNA, 25 bp, Rattus norvegicus
cggcacctatacacagggcccaaga

SEQ ID NO: 536168 - DNA, 25 bp, Rattus norvegicus
gggcccaagaaacagacagctcgga

SEQ ID NO: 536169 - DNA, 25 bp, Rattus norvegicus
cagctcggagcctagcagaggaagc

SEQ ID NO: 536170 - DNA, 25 bp, Rattus norvegicus
tttcgtagagcttgcgagtggagcc

SEQ ID NO: 536171 - DNA, 25 bp, Rattus norvegicus
catttacccgctggtgcaatgagca

SEQ ID NO: 536172 - DNA, 25 bp, Rattus norvegicus
tcgaggtcctcgagaacaaaggcgc

SEQ ID NO: 536173 - DNA, 25 bp, Rattus norvegicus
tcagccgccttgttcttcgaggtcc

SEQ ID NO: 536174 - DNA, 25 bp, Rattus norvegicus
cctagctgaagcacaaccaacgatt

SEQ ID NO: 536175 - DNA, 25 bp, Rattus norvegicus
ttcctggaccgtgagagcatcaagc

SEQ ID NO: 536176 - DNA, 25 bp, Rattus norvegicus
agcgcatcgccaatctgcagacgga

SEQ ID NO: 536177 - DNA, 25 bp, Rattus norvegicus
ttgatacacgggacgctgagatgcc

SEQ ID NO: 536178 - DNA, 25 bp, Rattus norvegicus
ctccggcaggcggtattgatacacg

SEQ ID NO: 536179 - DNA, 25 bp, Rattus norvegicus
ggttcctcgcgcctcaaaatgagta

SEQ ID NO: 536180 - DNA, 25 bp, Rattus norvegicus
tccgcagtgcaacctctgttctgtg

SEQ ID NO: 536181 - DNA, 25 bp, Rattus norvegicus
taaagggctcgctctttccgcagtg

SEQ ID NO: 536182 - DNA, 25 bp, Rattus norvegicus
aggctgagctcacatcctctgtagg

SEQ ID NO: 536183 - DNA, 25 bp, Rattus norvegicus
tctgtggcgcttgaattcctggacc

SEQ ID NO: 536184 - DNA, 25 bp, Rattus norvegicus
ccttaagtgcgtgagcaagcgcatc

SEQ ID NO: 536185 - DNA, 25 bp, Rattus norvegicus
acgcccacagacagtaggggccacg

SEQ ID NO: 536186 - DNA, 25 bp, Rattus norvegicus
tcaaaccggaactgaggaggagaga

SEQ ID NO: 536187 - DNA, 25 bp, Rattus norvegicus
aaggaagacggacgttacagcgagc

SEQ ID NO: 536188 - DNA, 25 bp, Rattus norvegicus
ggacgttacagcgagcgggaaaaca

SEQ ID NO: 536189 - DNA, 25 bp, Rattus norvegicus
cgagcgggaaaacatgcaggtgtcc

SEQ ID NO: 536190 - DNA, 25 bp, Rattus norvegicus
ggaaaacatgcaggtgtcccttgaa

SEQ ID NO: 536191 - DNA, 25 bp, Rattus norvegicus
atgcaggtgtcccttgaagacgatg

SEQ ID NO: 536192 - DNA, 25 bp, Rattus norvegicus
ttgaagacgatgaagactgacagtg

SEQ ID NO: 536193 - DNA, 25 bp, Rattus norvegicus
aagactgacagtgcgggcaacgccc

SEQ ID NO: 536194 - DNA, 25 bp, Rattus norvegicus
caacgcccaccctttctaggccacg

SEQ ID NO: 536195 - DNA, 25 bp, Rattus norvegicus
tttgtacaggggatggcgctgaaga

SEQ ID NO: 536196 - DNA, 25 bp, Rattus norvegicus
cgctgaagacggacagtgcaggcca

SEQ ID NO: 536197 - DNA, 25 bp, Rattus norvegicus
ggacgcgacctcaaaccggaactga

SEQ ID NO: 536198 - DNA, 25 bp, Rattus norvegicus
tgaagacggacagtgcaggccacgc

SEQ ID NO: 536199 - DNA, 25 bp, Rattus norvegicus
tgccggaatttggtgtcggatattc

SEQ ID NO: 536200 - DNA, 25 bp, Rattus norvegicus
gagactccgacgtacagtaattata

SEQ ID NO: 536201 - DNA, 25 bp, Rattus norvegicus
ccaccggctgctgtagagactccga

SEQ ID NO: 536202 - DNA, 25 bp, Rattus norvegicus
cggatattcccgatcttgcaaagca

SEQ ID NO: 536203 - DNA, 25 bp, Rattus norvegicus
ttgtatgctcagaagaactccgggg

SEQ ID NO: 536204 - DNA, 25 bp, Rattus norvegicus
acgaagaaatcttgggctccgcgga

SEQ ID NO: 536205 - DNA, 25 bp, Rattus norvegicus
ggacagcctggagttctcactctca

SEQ ID NO: 536206 - DNA, 25 bp, Rattus norvegicus
cgttcatggagacagcgagctttaa

SEQ ID NO: 536207 - DNA, 25 bp, Rattus norvegicus
aggaggcagcgtccctatacatcca

SEQ ID NO: 536208 - DNA, 25 bp, Rattus norvegicus
ctgtgcagagcatgccagactcgga

SEQ ID NO: 536209 - DNA, 25 bp, Rattus norvegicus
tcccagcgtagacggcagcatcgtc

SEQ ID NO: 536210 - DNA, 25 bp, Rattus norvegicus
accgagtggatatgggcttgagacc

SEQ ID NO: 536211 - DNA, 25 bp, Rattus norvegicus
tccctgtaggaagtcgcactgtctt

SEQ ID NO: 536212 - DNA, 25 bp, Rattus norvegicus
aactccctgggtgacttgtatgctc

SEQ ID NO: 536213 - DNA, 25 bp, Rattus norvegicus
aacttgtgaaaacaggaccgcgcga

SEQ ID NO: 536214 - DNA, 25 bp, Rattus norvegicus
ggagtctagggatacaccaccgcca

SEQ ID NO: 536215 - DNA, 25 bp, Rattus norvegicus
ggctactcgggtcttctccgctgtt

SEQ ID NO: 536216 - DNA, 25 bp, Rattus norvegicus
ctccgctgtttgctatgcggccgca

SEQ ID NO: 536217 - DNA, 25 bp, Rattus norvegicus
atgcggccgcactgctgttcacggc

SEQ ID NO: 536218 - DNA, 25 bp, Rattus norvegicus
ccctgcaggttctaggaaagattga

SEQ ID NO: 536219 - DNA, 25 bp, Rattus norvegicus
tctaggaaagattgaggcgcccact

SEQ ID NO: 536220 - DNA, 25 bp, Rattus norvegicus
ggcgaggcccacagaacttgtgaaa

SEQ ID NO: 536221 - DNA, 25 bp, Rattus norvegicus
acaggaccgcgcgagaattggttcc

SEQ ID NO: 536222 - DNA, 25 bp, Rattus norvegicus
cgagaattggttccgtacaaactgg

SEQ ID NO: 536223 - DNA, 25 bp, Rattus norvegicus
gtcgtcccgtagacctgaggaatcg

SEQ ID NO: 536224 - DNA, 25 bp, Rattus norvegicus
tgaggaatcgccgaggatctgtagc

SEQ ID NO: 536225 - DNA, 25 bp, Rattus norvegicus
gatctgtagctggatcgccaaaacg

SEQ ID NO: 536226 - DNA, 25 bp, Rattus norvegicus
gacacaccacgtgaggcgaggccca

SEQ ID NO: 536227 - DNA, 25 bp, Rattus norvegicus
ccgtcctgacgaccgctatcagtgt

SEQ ID NO: 536228 - DNA, 25 bp, Rattus norvegicus
aagacggtcagcagaatgggtacga

SEQ ID NO: 536229 - DNA, 25 bp, Rattus norvegicus
accggattagagaagacggtcagca

SEQ ID NO: 536230 - DNA, 25 bp, Rattus norvegicus
tgtgtagaaccggattagagaagac

SEQ ID NO: 536231 - DNA, 25 bp, Rattus norvegicus
gagcactctgtgtagaaccggatta

SEQ ID NO: 536232 - DNA, 25 bp, Rattus norvegicus
tcagcagaatgggtacgagggaacc

SEQ ID NO: 536233 - DNA, 25 bp, Rattus norvegicus
tgacgaccgctatcagtgtgctccg

SEQ ID NO: 536234 - DNA, 25 bp, Rattus norvegicus
gggtgacccgcagaaccgcccgcta

SEQ ID NO: 536235 - DNA, 25 bp, Rattus norvegicus
gaaccgcccgctaggacagcgcagg

SEQ ID NO: 536236 - DNA, 25 bp, Rattus norvegicus
cccgctaggacagcgcaggctacgt

SEQ ID NO: 536237 - DNA, 25 bp, Rattus norvegicus
acagcgcaggctacgtaaggactga

SEQ ID NO: 536238 - DNA, 25 bp, Rattus norvegicus
cgctatcagtgtgctccgggcccgg

SEQ ID NO: 536239 - DNA, 25 bp, Rattus norvegicus
actgaacggataagcgggacccatg

SEQ ID NO: 536240 - DNA, 25 bp, Rattus norvegicus
aggctacgtaaggactgaacggata

SEQ ID NO: 536241 - DNA, 25 bp, Rattus norvegicus
gtcccaaatggtcgcaccgagagcc

SEQ ID NO: 536242 - DNA, 25 bp, Rattus norvegicus
ggaaaatctcatcctcggtgccttc

SEQ ID NO: 536243 - DNA, 25 bp, Rattus norvegicus
gtaccggtcacccaattgctgaatc

SEQ ID NO: 536244 - DNA, 25 bp, Rattus norvegicus
caggcacgctcttctgtaccggtca

SEQ ID NO: 536245 - DNA, 25 bp, Rattus norvegicus
tctctatcggaacaggcacgctctt

SEQ ID NO: 536246 - DNA, 25 bp, Rattus norvegicus
gagccaccgaactttcagccgatca

SEQ ID NO: 536247 - DNA, 25 bp, Rattus norvegicus
aggagatcctcgcttaagcttcaga

SEQ ID NO: 536248 - DNA, 25 bp, Rattus norvegicus
gccgagccgtgatcttctgacaaga

SEQ ID NO: 536249 - DNA, 25 bp, Rattus norvegicus
agttgccctttctgaattccgccga

SEQ ID NO: 536250 - DNA, 25 bp, Rattus norvegicus
tgtcgcctccctggaaggaaagttg

SEQ ID NO: 536251 - DNA, 25 bp, Rattus norvegicus
agggctcgtctgtgtcagcttttca

SEQ ID NO: 536252 - DNA, 25 bp, Rattus norvegicus
cgatcatcggctattttggacagta

SEQ ID NO: 536253 - DNA, 25 bp, Rattus norvegicus
acagaaattttactcaccgcgagga

SEQ ID NO: 536254 - DNA, 25 bp, Rattus norvegicus
tggacgctcgatgaaactgctattg

SEQ ID NO: 536255 - DNA, 25 bp, Rattus norvegicus
tcgacctgtagttgtccgggcgcct

SEQ ID NO: 536256 - DNA, 25 bp, Rattus norvegicus
ccggcaaccggtgtcttctcggcca

SEQ ID NO: 536257 - DNA, 25 bp, Rattus norvegicus
tgaggccgtcaggaaaaacccggca

SEQ ID NO: 536258 - DNA, 25 bp, Rattus norvegicus
atgctgaggccgtcaggaaaaaccc

SEQ ID NO: 536259 - DNA, 25 bp, Rattus norvegicus
tccttatgctgaggccgtcaggaaa

SEQ ID NO: 536260 - DNA, 25 bp, Rattus norvegicus
acaggggtccttatgctgaggccgt

SEQ ID NO: 536261 - DNA, 25 bp, Rattus norvegicus
cccacaggggtccttatgctgaggc

SEQ ID NO: 536262 - DNA, 25 bp, Rattus norvegicus
cctcctcggctgctactcccgaccc

SEQ ID NO: 536263 - DNA, 25 bp, Rattus norvegicus
gacagctccctcctcggctgctact

SEQ ID NO: 536264 - DNA, 25 bp, Rattus norvegicus
tcgatacccggggaaggacagctcc

SEQ ID NO: 536265 - DNA, 25 bp, Rattus norvegicus
tccactgtcgatacccggggaagga

SEQ ID NO: 536266 - DNA, 25 bp, Rattus norvegicus
gcctccactgtcgatacccggggaa

SEQ ID NO: 536267 - DNA, 25 bp, Rattus norvegicus
ttgtccgggcgcctccactgtcgat

SEQ ID NO: 536268 - DNA, 25 bp, Rattus norvegicus
acctgtagttgtccgggcgcctcca

SEQ ID NO: 536269 - DNA, 25 bp, Rattus norvegicus
agacttttgggatactgacacggcc

SEQ ID NO: 536270 - DNA, 25 bp, Rattus norvegicus
tctggaggtctctgccgtgttaaag

SEQ ID NO: 536271 - DNA, 25 bp, Rattus norvegicus
agagccttccgtggacgccttatcc

SEQ ID NO: 536272 - DNA, 25 bp, Rattus norvegicus
gtggttccggtcttgttctaagctc

SEQ ID NO: 536273 - DNA, 25 bp, Rattus norvegicus
ggcagtgaacctccctggaacccga

SEQ ID NO: 536274 - DNA, 25 bp, Rattus norvegicus
tcccagttcggaatgatgttcgttc

SEQ ID NO: 536275 - DNA, 25 bp, Rattus norvegicus
tgacacggccaggatactatcattc

SEQ ID NO: 536276 - DNA, 25 bp, Rattus norvegicus
gtggtccacctactgcgatcgagaa

SEQ ID NO: 536277 - DNA, 25 bp, Rattus norvegicus
ttctcatcaccagggagagctggtc

SEQ ID NO: 536278 - DNA, 25 bp, Rattus norvegicus
ctccaggcgctgaatgtttctcatc

SEQ ID NO: 536279 - DNA, 25 bp, Rattus norvegicus
cccgtttgacgatggccacgaactc

SEQ ID NO: 536280 - DNA, 25 bp, Rattus norvegicus
atgcgttaggattcgcgactccttc

SEQ ID NO: 536281 - DNA, 25 bp, Rattus norvegicus
tccggtatccggtgatgcgttagga

SEQ ID NO: 536282 - DNA, 25 bp, Rattus norvegicus
tgaactcctgctgaaccatcacttg

SEQ ID NO: 536283 - DNA, 25 bp, Rattus norvegicus
cccgagtgacccagtcgggtcgagc

SEQ ID NO: 536284 - DNA, 25 bp, Rattus norvegicus
gggtcgagccacctctactgcggtc

SEQ ID NO: 536285 - DNA, 25 bp, Rattus norvegicus
ctcctgaggtttctcacggtccaaa

SEQ ID NO: 536286 - DNA, 25 bp, Rattus norvegicus
ggtctcaagtctccgcttctcctga

SEQ ID NO: 536287 - DNA, 25 bp, Rattus norvegicus
gtggctgctcaacactcctcggtct

SEQ ID NO: 536288 - DNA, 25 bp, Rattus norvegicus
caatgagatctgagacgggcctgcc

SEQ ID NO: 536289 - DNA, 25 bp, Rattus norvegicus
ctaggacccaacacacaatgagatc

SEQ ID NO: 536290 - DNA, 25 bp, Rattus norvegicus
cacgacgttcggagggattacgact

SEQ ID NO: 536291 - DNA, 25 bp, Rattus norvegicus
tatctgtagaggacgcacgacgttc

SEQ ID NO: 536292 - DNA, 25 bp, Rattus norvegicus
ccgaggcggagcacatagtgagaca

SEQ ID NO: 536293 - DNA, 25 bp, Rattus norvegicus
ttgctaggacagatccgtgtgccga

SEQ ID NO: 536294 - DNA, 25 bp, Rattus norvegicus
acactcacatgcagttttgctagga

SEQ ID NO: 536295 - DNA, 25 bp, Rattus norvegicus
gatgtggaccgacgcacactcacat

SEQ ID NO: 536296 - DNA, 25 bp, Rattus norvegicus
cgctgactcgcgctgattccgcaga

SEQ ID NO: 536297 - DNA, 25 bp, Rattus norvegicus
ttttcctcatcaccgaaagcggcgg

SEQ ID NO: 536298 - DNA, 25 bp, Rattus norvegicus
ctgtcctgagtagggttgtcaccga

SEQ ID NO: 536299 - DNA, 25 bp, Rattus norvegicus
ggatgctcgccagttctggtccgtg

SEQ ID NO: 536300 - DNA, 25 bp, Rattus norvegicus
gtggctccactcaacttgctagctg

SEQ ID NO: 536301 - DNA, 25 bp, Rattus norvegicus
ttgactcgcgtcagtcgtggctcca

SEQ ID NO: 536302 - DNA, 25 bp, Rattus norvegicus
ggcccacgtgacctttgttgactcg

SEQ ID NO: 536303 - DNA, 25 bp, Rattus norvegicus
gacgactcggctgtagggtcacatc

SEQ ID NO: 536304 - DNA, 25 bp, Rattus norvegicus
gggaccggcacaccaactttatctc

SEQ ID NO: 536305 - DNA, 25 bp, Rattus norvegicus
tttcaatctccgcacgggaccggca

SEQ ID NO: 536306 - DNA, 25 bp, Rattus norvegicus
ggagcccgcaaggacgctttcaatc

SEQ ID NO: 536307 - DNA, 25 bp, Rattus norvegicus
tggaaacgtagcgaattcacaactc

SEQ ID NO: 536308 - DNA, 25 bp, Rattus norvegicus
ctccgcaggatttcatggaaacgta

SEQ ID NO: 536309 - DNA, 25 bp, Rattus norvegicus
agcgagcgacactccgcaggatttc

SEQ ID NO: 536310 - DNA, 25 bp, Rattus norvegicus
gcagctggttaggttgtgctactta

SEQ ID NO: 536311 - DNA, 25 bp, Rattus norvegicus
ttagcggtttgtaaccgccacctca

SEQ ID NO: 536312 - DNA, 25 bp, Rattus norvegicus
agcccacaagatgcccgcagtcagg

SEQ ID NO: 536313 - DNA, 25 bp, Rattus norvegicus
tcacctgcgcagctgagcctgagca

SEQ ID NO: 536314 - DNA, 25 bp, Rattus norvegicus
tgcagtcgctggagccaggatcgcc

SEQ ID NO: 536315 - DNA, 25 bp, Rattus norvegicus
aggatcgccgcgtgaaaagtcagga

SEQ ID NO: 536316 - DNA, 25 bp, Rattus norvegicus
cgtgaaaagtcaggaccgccaatgc

SEQ ID NO: 536317 - DNA, 25 bp, Rattus norvegicus
cgccaatgcagggtccagacgagga

SEQ ID NO: 536318 - DNA, 25 bp, Rattus norvegicus
ccagacgaggacgactcaggtggca

SEQ ID NO: 536319 - DNA, 25 bp, Rattus norvegicus
ggcataggcctcaagctgccgatgc

SEQ ID NO: 536320 - DNA, 25 bp, Rattus norvegicus
gccgatgcccatcctaggtctcaga

SEQ ID NO: 536321 - DNA, 25 bp, Rattus norvegicus
cctaggtctcagagttcggcgactg

SEQ ID NO: 536322 - DNA, 25 bp, Rattus norvegicus
ctgagcctgagcagtgcagtcgctg

SEQ ID NO: 536323 - DNA, 25 bp, Rattus norvegicus
ccgcgtctgaatagcccacaagatg

SEQ ID NO: 536324 - DNA, 25 bp, Rattus norvegicus
cgactgaggttgaccacgacagctc

SEQ ID NO: 536325 - DNA, 25 bp, Rattus norvegicus
ggcttctccagatccgtcatggttt

SEQ ID NO: 536326 - DNA, 25 bp, Rattus norvegicus
cgactacgtcgaacatgtggcctgc

SEQ ID NO: 536327 - DNA, 25 bp, Rattus norvegicus
cgtcgaacatgtggcctgcgagatt

SEQ ID NO: 536328 - DNA, 25 bp, Rattus norvegicus
atgtggcctgcgagattgggcttct

SEQ ID NO: 536329 - DNA, 25 bp, Rattus norvegicus
tgcgagattgggcttctccagatcc

SEQ ID NO: 536330 - DNA, 25 bp, Rattus norvegicus
tccaatcacgactacgtcgaacatg

SEQ ID NO: 536331 - DNA, 25 bp, Rattus norvegicus
ttgggcttctccagatccgtcatgg

SEQ ID NO: 536332 - DNA, 25 bp, Rattus norvegicus
gcctgcgagattgggcttctccaga

SEQ ID NO: 536333 - DNA, 25 bp, Rattus norvegicus
tctccagatccgtcatggtttgggt

SEQ ID NO: 536334 - DNA, 25 bp, Rattus norvegicus
cccagggtgggacagacccttgcac

SEQ ID NO: 536335 - DNA, 25 bp, Rattus norvegicus
gggtgggacagacccttgcaccgcc

SEQ ID NO: 536336 - DNA, 25 bp, Rattus norvegicus
accgccccttgactggtgtccgagg

SEQ ID NO: 536337 - DNA, 25 bp, Rattus norvegicus
ccgagggcggagctgatgtatccag

SEQ ID NO: 536338 - DNA, 25 bp, Rattus norvegicus
agattgggcttctccagatccgtca

SEQ ID NO: 536339 - DNA, 25 bp, Rattus norvegicus
acataattctcacagcggcgggacg

SEQ ID NO: 536340 - DNA, 25 bp, Rattus norvegicus
aggccttgttttcggacataattct

SEQ ID NO: 536341 - DNA, 25 bp, Rattus norvegicus
aacgagctgctagggagactgccta

SEQ ID NO: 536342 - DNA, 25 bp, Rattus norvegicus
atcaacagcgctccgctttaagggc

SEQ ID NO: 536343 - DNA, 25 bp, Rattus norvegicus
gctttaagggcccagcagtttgtta

SEQ ID NO: 536344 - DNA, 25 bp, Rattus norvegicus
cccagcagtttgttaccagtcagca

SEQ ID NO: 536345 - DNA, 25 bp, Rattus norvegicus
ttaccagtcagcactcagaagccta

SEQ ID NO: 536346 - DNA, 25 bp, Rattus norvegicus
tcccagcctacaggcctcatttgta

SEQ ID NO: 536347 - DNA, 25 bp, Rattus norvegicus
cctcatttgtagaccgcccgctgga

SEQ ID NO: 536348 - DNA, 25 bp, Rattus norvegicus
gagccgggcgataccaccgccaaga

SEQ ID NO: 536349 - DNA, 25 bp, Rattus norvegicus
ttcgcgcggcgatgcggattattaa

SEQ ID NO: 536350 - DNA, 25 bp, Rattus norvegicus
gcggcgatgcggattattaacctgc

SEQ ID NO: 536351 - DNA, 25 bp, Rattus norvegicus
actcagaagcctaacccaagagcgc

SEQ ID NO: 536352 - DNA, 25 bp, Rattus norvegicus
agactgcctacacgggacgtttcca

SEQ ID NO: 536353 - DNA, 25 bp, Rattus norvegicus
ccaccaacagcgagagcctggagga

SEQ ID NO: 536354 - DNA, 25 bp, Rattus norvegicus
gacatcctgctgacggctgcgcagg

SEQ ID NO: 536355 - DNA, 25 bp, Rattus norvegicus
cagtcggacatcctgctgacggctg

SEQ ID NO: 536356 - DNA, 25 bp, Rattus norvegicus
ccgggccagtcggacatcctgctga

SEQ ID NO: 536357 - DNA, 25 bp, Rattus norvegicus
agcagagcagcggaaccctcagctc

SEQ ID NO: 536358 - DNA, 25 bp, Rattus norvegicus
gacgagcagagcagcggaaccctca

SEQ ID NO: 536359 - DNA, 25 bp, Rattus norvegicus
ctggctctgcgcacagcgacgagca

SEQ ID NO: 536360 - DNA, 25 bp, Rattus norvegicus
tgagcaccaccaacagcgagagcct

SEQ ID NO: 536361 - DNA, 25 bp, Rattus norvegicus
gagatgagcaccaccaacagcgaga

SEQ ID NO: 536362 - DNA, 25 bp, Rattus norvegicus
aacttcaggcgggaactggagatga

SEQ ID NO: 536363 - DNA, 25 bp, Rattus norvegicus
cacgccagggggtgtacgagaactt

SEQ ID NO: 536364 - DNA, 25 bp, Rattus norvegicus
cggcagcagttcgactggggatgct

SEQ ID NO: 536365 - DNA, 25 bp, Rattus norvegicus
ccgagcctttgtgggcagcgacagc

SEQ ID NO: 536366 - DNA, 25 bp, Rattus norvegicus
tctgcgcacagcgacgagcagagca

SEQ ID NO: 536367 - DNA, 25 bp, Rattus norvegicus
cttgaagaccttgaagaagccaatc

SEQ ID NO: 536368 - DNA, 25 bp, Rattus norvegicus
ggtgtagctcactcactgctcaaca

SEQ ID NO: 536369 - DNA, 25 bp, Rattus norvegicus
ggatgtctttctgacacggtgtagc

SEQ ID NO: 536370 - DNA, 25 bp, Rattus norvegicus
tggggagatgcacatccaaaggatg

SEQ ID NO: 536371 - DNA, 25 bp, Rattus norvegicus
ctgctcaacataccactgctatagg

SEQ ID NO: 536372 - DNA, 25 bp, Rattus norvegicus
tttacccgaaggaggcctcgaggca

SEQ ID NO: 536373 - DNA, 25 bp, Rattus norvegicus
acagccaccagtcgaatttacccga

SEQ ID NO: 536374 - DNA, 25 bp, Rattus norvegicus
gccaatccattctccttcaaagagt

SEQ ID NO: 536375 - DNA, 25 bp, Rattus norvegicus
cgcgctttggaggtgacaaacttga

SEQ ID NO: 536376 - DNA, 25 bp, Rattus norvegicus
agttcccgacgattttggctatgga

SEQ ID NO: 536377 - DNA, 25 bp, Rattus norvegicus
ttattatgaatgagagaggccggca

SEQ ID NO: 536378 - DNA, 25 bp, Rattus norvegicus
gaggcctccagcaaattgaaacttc

SEQ ID NO: 536379 - DNA, 25 bp, Rattus norvegicus
ctataggtgttaatgcagaggcctc

SEQ ID NO: 536380 - DNA, 25 bp, Rattus norvegicus
tcagcctgtcaaaagaagacacagc

SEQ ID NO: 536381 - DNA, 25 bp, Rattus norvegicus
agtaggggcgacgacctgcaccagc

SEQ ID NO: 536382 - DNA, 25 bp, Rattus norvegicus
acctcagcagctgcaacccgcaacc

SEQ ID NO: 536383 - DNA, 25 bp, Rattus norvegicus
cactgggagcgcctcttttttccct

SEQ ID NO: 536384 - DNA, 25 bp, Rattus norvegicus
gcgccactgggagcgcctctttttt

SEQ ID NO: 536385 - DNA, 25 bp, Rattus norvegicus
ttctccgtgacgttgagggcgctgc

SEQ ID NO: 536386 - DNA, 25 bp, Rattus norvegicus
gcccgccggttctccgtgacgttga

SEQ ID NO: 536387 - DNA, 25 bp, Rattus norvegicus
ctgtggaccttttgtcgcttctccc

SEQ ID NO: 536388 - DNA, 25 bp, Rattus norvegicus
agtgctgtggaccttttgtcgcttc

SEQ ID NO: 536389 - DNA, 25 bp, Rattus norvegicus
cacagtgctgtggaccttttgtcgc

SEQ ID NO: 536390 - DNA, 25 bp, Rattus norvegicus
tgcacagtgctgtggaccttttgtc

SEQ ID NO: 536391 - DNA, 25 bp, Rattus norvegicus
gtccaagaacgtgcacagtgctgtg

SEQ ID NO: 536392 - DNA, 25 bp, Rattus norvegicus
gccgtccaagaacgtgcacagtgct

SEQ ID NO: 536393 - DNA, 25 bp, Rattus norvegicus
gcttctccccttggttgcggcttgg

SEQ ID NO: 536394 - DNA, 25 bp, Rattus norvegicus
caacccgggaagctccgcttgccga

SEQ ID NO: 536395 - DNA, 25 bp, Rattus norvegicus
caagtgagtctccacgcgagggagc

SEQ ID NO: 536396 - DNA, 25 bp, Rattus norvegicus
agtgtggaaaaatgcttttcagcga

SEQ ID NO: 536397 - DNA, 25 bp, Rattus norvegicus
ttcagaaccctccacgctgcggccg

SEQ ID NO: 536398 - DNA, 25 bp, Rattus norvegicus
tgatcggcaagtgagtctccacgcg

SEQ ID NO: 536399 - DNA, 25 bp, Rattus norvegicus
gaggtgatcggcaagtgagtctcca

SEQ ID NO: 536400 - DNA, 25 bp, Rattus norvegicus
tgtgtacgagctgtgcgaggtgatc

SEQ ID NO: 536401 - DNA, 25 bp, Rattus norvegicus
ctgttcgaggatgtgtacgagctgt

SEQ ID NO: 536402 - DNA, 25 bp, Rattus norvegicus
acgtgctgttcgaggatgtgtacga

SEQ ID NO: 536403 - DNA, 25 bp, Rattus norvegicus
acgacgtgctgttcgaggatgtgta

SEQ ID NO: 536404 - DNA, 25 bp, Rattus norvegicus
ccgacgacgacgtgctgttcgagga

SEQ ID NO: 536405 - DNA, 25 bp, Rattus norvegicus
catggccgacgacgacgtgctgttc

SEQ ID NO: 536406 - DNA, 25 bp, Rattus norvegicus
cggaccatggccgacgacgacgtgc

SEQ ID NO: 536407 - DNA, 25 bp, Rattus norvegicus
aaccctccacgctgcggccgctgtc

SEQ ID NO: 536408 - DNA, 25 bp, Rattus norvegicus
cgggagtgtggaaaaatgcttttca

SEQ ID NO: 536409 - DNA, 25 bp, Rattus norvegicus
agatagcgtagctcaccattgtgcg

SEQ ID NO: 536410 - DNA, 25 bp, Rattus norvegicus
acggtcacagcgcactgagcagcca

SEQ ID NO: 536411 - DNA, 25 bp, Rattus norvegicus
agctctgccaggtcggagaaccagc

SEQ ID NO: 536412 - DNA, 25 bp, Rattus norvegicus
ccgcccagattgagggtgcgcagac

SEQ ID NO: 536413 - DNA, 25 bp, Rattus norvegicus
gccagcaggttatcgttgagcagca

SEQ ID NO: 536414 - DNA, 25 bp, Rattus norvegicus
ctcgaaatgcgcgtgcgtcaggtta

SEQ ID NO: 536415 - DNA, 25 bp, Rattus norvegicus
cacccggcggaagagattgtcgaag

SEQ ID NO: 536416 - DNA, 25 bp, Rattus norvegicus
aaggtccgcacgtgcagatagcgta

SEQ ID NO: 536417 - DNA, 25 bp, Rattus norvegicus
cgccaggcgtaataaaggacaggtt

SEQ ID NO: 536418 - DNA, 25 bp, Rattus norvegicus
gcagcgtaacgatggcagcgtgcca

SEQ ID NO: 536419 - DNA, 25 bp, Rattus norvegicus
ggccgcctcacacggaaactcagtg

SEQ ID NO: 536420 - DNA, 25 bp, Rattus norvegicus
tgagcagccacgctccacgttactg

SEQ ID NO: 536421 - DNA, 25 bp, Rattus norvegicus
cacgttactgcaagtgcaggccgca

SEQ ID NO: 536422 - DNA, 25 bp, Rattus norvegicus
caacccattccggtctaggtcgatg

SEQ ID NO: 536423 - DNA, 25 bp, Rattus norvegicus
cttgcgaaacctgggcagactctgc

SEQ ID NO: 536424 - DNA, 25 bp, Rattus norvegicus
agactctgcccgtaactgatgctgc

SEQ ID NO: 536425 - DNA, 25 bp, Rattus norvegicus
acgcctgagccggaaaccttagtca

SEQ ID NO: 536426 - DNA, 25 bp, Rattus norvegicus
ccaggcttgtccatcagagggcgct

SEQ ID NO: 536427 - DNA, 25 bp, Rattus norvegicus
gccttcccaggcttgtccatcagag

SEQ ID NO: 536428 - DNA, 25 bp, Rattus norvegicus
ccgctcccagcgtctgaaggggcag

SEQ ID NO: 536429 - DNA, 25 bp, Rattus norvegicus
tttccacctcaaggtcacgtccttg

SEQ ID NO: 536430 - DNA, 25 bp, Rattus norvegicus
gcaccaggggactttttccacctca

SEQ ID NO: 536431 - DNA, 25 bp, Rattus norvegicus
tcgtgacgcaccaggggactttttc

SEQ ID NO: 536432 - DNA, 25 bp, Rattus norvegicus
cgggttaacaaccactcgtgacgca

SEQ ID NO: 536433 - DNA, 25 bp, Rattus norvegicus
ttcagctcgctagcccgggttaaca

SEQ ID NO: 536434 - DNA, 25 bp, Rattus norvegicus
gaaaactagttcagctcgctagccc

SEQ ID NO: 536435 - DNA, 25 bp, Rattus norvegicus
cggaaaccttagtcacgcacctgaa

SEQ ID NO: 536436 - DNA, 25 bp, Rattus norvegicus
cacgtccttgcgaaacctgggcaga

SEQ ID NO: 536437 - DNA, 25 bp, Rattus norvegicus
tacctaaggcgactcctgcagtttg

SEQ ID NO: 536438 - DNA, 25 bp, Rattus norvegicus
ggcgaagccgcctctttgtcggcga

SEQ ID NO: 536439 - DNA, 25 bp, Rattus norvegicus
acatccgggccactgttactagcga

SEQ ID NO: 536440 - DNA, 25 bp, Rattus norvegicus
ttcccgcagagtggataaagaactg

SEQ ID NO: 536441 - DNA, 25 bp, Rattus norvegicus
ggagtttcgaactgcctgaggagca

SEQ ID NO: 536442 - DNA, 25 bp, Rattus norvegicus
gtctcgcttgttttgcctcagctca

SEQ ID NO: 536443 - DNA, 25 bp, Rattus norvegicus
cgcttcctttaggtctctcagcaga

SEQ ID NO: 536444 - DNA, 25 bp, Rattus norvegicus
actcggctccttttctctccgtggg

SEQ ID NO: 536445 - DNA, 25 bp, Rattus norvegicus
tgccatttctctgtctgtcccgttt

SEQ ID NO: 536446 - DNA, 25 bp, Rattus norvegicus
ggcctctcctgtgcccgaagtctta

SEQ ID NO: 536447 - DNA, 25 bp, Rattus norvegicus
cccgaagtcttaggagggcgaactg

SEQ ID NO: 536448 - DNA, 25 bp, Rattus norvegicus
gcgaactgtcccgaactctttctgg

SEQ ID NO: 536449 - DNA, 25 bp, Rattus norvegicus
gccctgtctctttttgtctgtctcg

SEQ ID NO: 536450 - DNA, 25 bp, Rattus norvegicus
gctgtttgggtccacacttgccatt

SEQ ID NO: 536451 - DNA, 25 bp, Rattus norvegicus
gctagcctgcgccacacaaaggagg

SEQ ID NO: 536452 - DNA, 25 bp, Rattus norvegicus
gccacgcggggcaatctatctacaa

SEQ ID NO: 536453 - DNA, 25 bp, Rattus norvegicus
caccgccggtcactaatcaactagg

SEQ ID NO: 536454 - DNA, 25 bp, Rattus norvegicus
ggctcgcctgcgcacagacacaaaa

SEQ ID NO: 536455 - DNA, 25 bp, Rattus norvegicus
ggccagggacaataccgcgaaccga

SEQ ID NO: 536456 - DNA, 25 bp, Rattus norvegicus
tggaggaccaacaggctctagcact

SEQ ID NO: 536457 - DNA, 25 bp, Rattus norvegicus
gcgtcacaaaactttccactcggga

SEQ ID NO: 536458 - DNA, 25 bp, Rattus norvegicus
gagcgcattttccactgccacatga

SEQ ID NO: 536459 - DNA, 25 bp, Rattus norvegicus
attcggagtcttccgctgctgagca

SEQ ID NO: 536460 - DNA, 25 bp, Rattus norvegicus
ctgagcaagtgctggctttaccgca

SEQ ID NO: 536461 - DNA, 25 bp, Rattus norvegicus
accaactcggaggactgctacgtca

SEQ ID NO: 536462 - DNA, 25 bp, Rattus norvegicus
gcgcggccaccgatcttatatacca

SEQ ID NO: 536463 - DNA, 25 bp, Rattus norvegicus
aaacccggctggcttgcataggagc

SEQ ID NO: 536464 - DNA, 25 bp, Rattus norvegicus
cgccctgaaatttctgcgtcacaaa

SEQ ID NO: 536465 - DNA, 25 bp, Rattus norvegicus
gagtaccacagcctcgtcaatatgg

SEQ ID NO: 536466 - DNA, 25 bp, Rattus norvegicus
gctctacgcgaaccgacaaggggtc

SEQ ID NO: 536467 - DNA, 25 bp, Rattus norvegicus
acacgctcattcacagacacggaca

SEQ ID NO: 536468 - DNA, 25 bp, Rattus norvegicus
ggagggacctcttacgcacgcacac

SEQ ID NO: 536469 - DNA, 25 bp, Rattus norvegicus
gccgtttaccgagaggttgcggctc

SEQ ID NO: 536470 - DNA, 25 bp, Rattus norvegicus
aaaggcagccgcctcccttgaggga

SEQ ID NO: 536471 - DNA, 25 bp, Rattus norvegicus
tctgagctcagtcaggctccgggca

SEQ ID NO: 536472 - DNA, 25 bp, Rattus norvegicus
gggctgacgagggacaaaaatatga

SEQ ID NO: 536473 - DNA, 25 bp, Rattus norvegicus
agcatcccaagccaggggctgacga

SEQ ID NO: 536474 - DNA, 25 bp, Rattus norvegicus
cgaggcctaacctgggagcatccca

SEQ ID NO: 536475 - DNA, 25 bp, Rattus norvegicus
ctcgatcctgggacgaggcctaacc

SEQ ID NO: 536476 - DNA, 25 bp, Rattus norvegicus
agcttccgcagctttgagtaccaca

SEQ ID NO: 536477 - DNA, 25 bp, Rattus norvegicus
gtggcccggcatcgccaagctaact

SEQ ID NO: 536478 - DNA, 25 bp, Rattus norvegicus
ggcagtgcgtttctcctgcgtcacc

SEQ ID NO: 536479 - DNA, 25 bp, Rattus norvegicus
ccacgaaccatatcggcggcgagga

SEQ ID NO: 536480 - DNA, 25 bp, Rattus norvegicus
acgttccaggatcgatgtgaggtct

SEQ ID NO: 536481 - DNA, 25 bp, Rattus norvegicus
actgacactgcagctcatccagctg

SEQ ID NO: 536482 - DNA, 25 bp, Rattus norvegicus
cctccgagacgagtgtggaagcgaa

SEQ ID NO: 536483 - DNA, 25 bp, Rattus norvegicus
aagcgaactgttgggcttcgaatct

SEQ ID NO: 536484 - DNA, 25 bp, Rattus norvegicus
tcttccagacgttccaggatcgatg

SEQ ID NO: 536485 - DNA, 25 bp, Rattus norvegicus
tgtgaggtctggatcgtcagagtcc

SEQ ID NO: 536486 - DNA, 25 bp, Rattus norvegicus
ggatcgtcagagtccacgaaccata

SEQ ID NO: 536487 - DNA, 25 bp, Rattus norvegicus
ccaggaactgacactgcagctcatc

SEQ ID NO: 536488 - DNA, 25 bp, Rattus norvegicus
tcacgatgcgcagccgctcgtggtc

SEQ ID NO: 536489 - DNA, 25 bp, Rattus norvegicus
cgctaggaactccagctcggcctta

SEQ ID NO: 536490 - DNA, 25 bp, Rattus norvegicus
taggaactccagctcggccttaagc

SEQ ID NO: 536491 - DNA, 25 bp, Rattus norvegicus
cctctcgggtcctccgagacgagtg

SEQ ID NO: 536492 - DNA, 25 bp, Rattus norvegicus
tgggcttcgaatcttccagacgttc

SEQ ID NO: 536493 - DNA, 25 bp, Rattus norvegicus
tcggcccagcaacatggacgctgta

SEQ ID NO: 536494 - DNA, 25 bp, Rattus norvegicus
tcgaatttctgctgcaccgggccta

SEQ ID NO: 536495 - DNA, 25 bp, Rattus norvegicus
gcagagcgcacgttggacagtaaca

SEQ ID NO: 536496 - DNA, 25 bp, Rattus norvegicus
cggcttagcacgctcatcgaatttc

SEQ ID NO: 536497 - DNA, 25 bp, Rattus norvegicus
gctgctagccctggataccggctta

SEQ ID NO: 536498 - DNA, 25 bp, Rattus norvegicus
tgaactccgcttcctgttcagaggc

SEQ ID NO: 536499 - DNA, 25 bp, Rattus norvegicus
gagacaggcggcttctctgccaacc

SEQ ID NO: 536500 - DNA, 25 bp, Rattus norvegicus
tgttcaccttcccactgcgcggttg

SEQ ID NO: 536501 - DNA, 25 bp, Rattus norvegicus
ggcacttggggactactgacgttac

SEQ ID NO: 536502 - DNA, 25 bp, Rattus norvegicus
ctgacgttactgtgacgaggctgct

SEQ ID NO: 536503 - DNA, 25 bp, Rattus norvegicus
tccttccgttctgtctggcgacttc

SEQ ID NO: 536504 - DNA, 25 bp, Rattus norvegicus
tcgcggaagcttccctcattgagtg

SEQ ID NO: 536505 - DNA, 25 bp, Rattus norvegicus
tcagaactgcacagcgcggggaacc

SEQ ID NO: 536506 - DNA, 25 bp, Rattus norvegicus
cgttttctccaaagcgtcgcgccag

SEQ ID NO: 536507 - DNA, 25 bp, Rattus norvegicus
gcctcacgggaaatagcacagctgc

SEQ ID NO: 536508 - DNA, 25 bp, Rattus norvegicus
atgcagttggtgtcctcctggctag

SEQ ID NO: 536509 - DNA, 25 bp, Rattus norvegicus
tagccacccaggtgagcgagtcgcc

SEQ ID NO: 536510 - DNA, 25 bp, Rattus norvegicus
gcgtacacaggaacaccagcgggtt

SEQ ID NO: 536511 - DNA, 25 bp, Rattus norvegicus
cttgccctggtggttacacgaacta

SEQ ID NO: 536512 - DNA, 25 bp, Rattus norvegicus
atgtaccagccatgacgaatttgcc

SEQ ID NO: 536513 - DNA, 25 bp, Rattus norvegicus
attagcttgttggaggtccttccgc

SEQ ID NO: 536514 - DNA, 25 bp, Rattus norvegicus
gccaatggcggctcgaatcttccga

SEQ ID NO: 536515 - DNA, 25 bp, Rattus norvegicus
gcctaaggcgcatgctcactatctg

SEQ ID NO: 536516 - DNA, 25 bp, Rattus norvegicus
tcactatctggctggagcgagccta

SEQ ID NO: 536517 - DNA, 25 bp, Rattus norvegicus
cgagcctagctcattgcgcctgcgt

SEQ ID NO: 536518 - DNA, 25 bp, Rattus norvegicus
gcgtcctggcgtcttcctaagcaaa

SEQ ID NO: 536519 - DNA, 25 bp, Rattus norvegicus
ggcccaaactgactgcgcaacagga

SEQ ID NO: 536520 - DNA, 25 bp, Rattus norvegicus
agggttccagagaaaatgtaccagc

SEQ ID NO: 536521 - DNA, 25 bp, Rattus norvegicus
ctttcatcgtggactgctgatcgca

SEQ ID NO: 536522 - DNA, 25 bp, Rattus norvegicus
tttgtaaaccgcgaagtgctctcct

SEQ ID NO: 536523 - DNA, 25 bp, Rattus norvegicus
cagctgtctgcagggttttgtaaac

SEQ ID NO: 536524 - DNA, 25 bp, Rattus norvegicus
ccttctgttgctacgcagctgtctg

SEQ ID NO: 536525 - DNA, 25 bp, Rattus norvegicus
ccagtgatgctaaacgctggacgtt

SEQ ID NO: 536526 - DNA, 25 bp, Rattus norvegicus
catcccagggtgctatgcgccctta

SEQ ID NO: 536527 - DNA, 25 bp, Rattus norvegicus
ttgcgccgaatacaaaaactgggtg

SEQ ID NO: 536528 - DNA, 25 bp, Rattus norvegicus
cagcgcgcctcaattgcgccgaata

SEQ ID NO: 536529 - DNA, 25 bp, Rattus norvegicus
agacatggtgctgtcggagctagca

SEQ ID NO: 536530 - DNA, 25 bp, Rattus norvegicus
cgaagtgctctcctttcatcgtgga

SEQ ID NO: 536531 - DNA, 25 bp, Rattus norvegicus
acgtttgctgggttgggctacgcct

SEQ ID NO: 536532 - DNA, 25 bp, Rattus norvegicus
gctacgcctgcgctgtacaggagca

SEQ ID NO: 536533 - DNA, 25 bp, Rattus norvegicus
tgtacaggagcatcccagggtgcta

SEQ ID NO: 536534 - DNA, 25 bp, Rattus norvegicus
gcaggacagtgccttctgttgctac

SEQ ID NO: 536535 - DNA, 25 bp, Rattus norvegicus
cgccatcagcaggtagtttcgaggc

SEQ ID NO: 536536 - DNA, 25 bp, Rattus norvegicus
tgatgatgtccggaggcgccttcat

SEQ ID NO: 536537 - DNA, 25 bp, Rattus norvegicus
gtcatgcggccgctgatgatgtccg

SEQ ID NO: 536538 - DNA, 25 bp, Rattus norvegicus
tggctccgccaccatagcggtggtt

SEQ ID NO: 536539 - DNA, 25 bp, Rattus norvegicus
caccatagcggtggttcaggtaacg

SEQ ID NO: 536540 - DNA, 25 bp, Rattus norvegicus
cctggatgctctgcgccagcacgtt

SEQ ID NO: 536541 - DNA, 25 bp, Rattus norvegicus
tggcacgccatcagcaggtagtttc

SEQ ID NO: 536542 - DNA, 25 bp, Rattus norvegicus
gctggactcggtaggcaaagcgcat

SEQ ID NO: 536543 - DNA, 25 bp, Rattus norvegicus
ctcggtaggcaaagcgcatgaaagc

SEQ ID NO: 536544 - DNA, 25 bp, Rattus norvegicus
cgcatgaaagccatggagtagaaga

SEQ ID NO: 536545 - DNA, 25 bp, Rattus norvegicus
ggaggcgccttcatatccttaaagg

SEQ ID NO: 536546 - DNA, 25 bp, Rattus norvegicus
tctgcgccagcacgttggtgaaatg

SEQ ID NO: 536547 - DNA, 25 bp, Rattus norvegicus
acgttggtgaaatggcacgccatca

SEQ ID NO: 536548 - DNA, 25 bp, Rattus norvegicus
ttcaggtaacggctcgcctggatgc

SEQ ID NO: 536549 - DNA, 25 bp, Rattus norvegicus
tggctactcactcgacaccagagaa

SEQ ID NO: 536550 - DNA, 25 bp, Rattus norvegicus
cggcccacaatgaccggtcacgaga

SEQ ID NO: 536551 - DNA, 25 bp, Rattus norvegicus
ctgccaataggagtcaaaggtttta

SEQ ID NO: 536552 - DNA, 25 bp, Rattus norvegicus
taacgtgatgagtggcatgctctgc

SEQ ID NO: 536553 - DNA, 25 bp, Rattus norvegicus
acgtagcctgggtgacgttcgcaat

SEQ ID NO: 536554 - DNA, 25 bp, Rattus norvegicus
aatcgccaactacgccgctacagga

SEQ ID NO: 536555 - DNA, 25 bp, Rattus norvegicus
aagacaaggtctcggccaatcgcca

SEQ ID NO: 536556 - DNA, 25 bp, Rattus norvegicus
cgcagtcagaccgagtgacgcgctc

SEQ ID NO: 536557 - DNA, 25 bp, Rattus norvegicus
tgagccacacgaaaagggacgccgg

SEQ ID NO: 536558 - DNA, 25 bp, Rattus norvegicus
gccatggtgccacggctgctaaagc

SEQ ID NO: 536559 - DNA, 25 bp, Rattus norvegicus
tctcgcagtgcttcctggctactca

SEQ ID NO: 536560 - DNA, 25 bp, Rattus norvegicus
cgcccgagccagatcaaggtccaga

SEQ ID NO: 536561 - DNA, 25 bp, Rattus norvegicus
ccgaaaggctgatgccagctccaga

SEQ ID NO: 536562 - DNA, 25 bp, Rattus norvegicus
ctgctaaagcggagatgagccacac

SEQ ID NO: 536563 - DNA, 25 bp, Rattus norvegicus
agatggaatccgaacgcgacggtta

SEQ ID NO: 536564 - DNA, 25 bp, Rattus norvegicus
cttccgggaggctgcattttttgca

SEQ ID NO: 536565 - DNA, 25 bp, Rattus norvegicus
tgtccttgccttccgggaggctgca

SEQ ID NO: 536566 - DNA, 25 bp, Rattus norvegicus
ccagcgtcgctctttctccgtgaag

SEQ ID NO: 536567 - DNA, 25 bp, Rattus norvegicus
cgctctttctccgtgaagcagaaga

SEQ ID NO: 536568 - DNA, 25 bp, Rattus norvegicus
ctccgtgaagcagaagatggaatcc

SEQ ID NO: 536569 - DNA, 25 bp, Rattus norvegicus
gaggctgcattttttgcaagcatcc

SEQ ID NO: 536570 - DNA, 25 bp, Rattus norvegicus
cgcgacggttagtctttccagttag

SEQ ID NO: 536571 - DNA, 25 bp, Rattus norvegicus
tagtctttccagttagccgcgttga

SEQ ID NO: 536572 - DNA, 25 bp, Rattus norvegicus
agttagccgcgttgagccgcccagc

SEQ ID NO: 536573 - DNA, 25 bp, Rattus norvegicus
agcggctcagctcgccagagccata

SEQ ID NO: 536574 - DNA, 25 bp, Rattus norvegicus
cgccagagccataacgttgtccttg

SEQ ID NO: 536575 - DNA, 25 bp, Rattus norvegicus
agagccataacgttgtccttgcctt

SEQ ID NO: 536576 - DNA, 25 bp, Rattus norvegicus
agagcctcccggtgctatgcgcgca

SEQ ID NO: 536577 - DNA, 25 bp, Rattus norvegicus
ggaacggccggaacagacatccctg

SEQ ID NO: 536578 - DNA, 25 bp, Rattus norvegicus
tccgctgtagcgtctgtttatggtc

SEQ ID NO: 536579 - DNA, 25 bp, Rattus norvegicus
cctcgtgttggtgttccagacacta

SEQ ID NO: 536580 - DNA, 25 bp, Rattus norvegicus
ctttaactattgaccctggagcgcg

SEQ ID NO: 536581 - DNA, 25 bp, Rattus norvegicus
cctcgaagctaggactggtgcatta

SEQ ID NO: 536582 - DNA, 25 bp, Rattus norvegicus
tctcgcgaaaggcacagaacagttg

SEQ ID NO: 536583 - DNA, 25 bp, Rattus norvegicus
tccacgatgctcaggtctgggccta

SEQ ID NO: 536584 - DNA, 25 bp, Rattus norvegicus
ttggtgtcgccctcattctctaatg

SEQ ID NO: 536585 - DNA, 25 bp, Rattus norvegicus
cacgtgcacaaagtggcgcgtaata

SEQ ID NO: 536586 - DNA, 25 bp, Rattus norvegicus
agggcgcatcctttagggtacctcg

SEQ ID NO: 536587 - DNA, 25 bp, Rattus norvegicus
tctctgaggcaaatcccggaacggc

SEQ ID NO: 536588 - DNA, 25 bp, Rattus norvegicus
ctgggctccctcctagcaagagcga

SEQ ID NO: 536589 - DNA, 25 bp, Rattus norvegicus
ggagacaaaccacctgcaccactga

SEQ ID NO: 536590 - DNA, 25 bp, Rattus norvegicus
tcttgcagtcatcggccttgttttc

SEQ ID NO: 536591 - DNA, 25 bp, Rattus norvegicus
atgataaatattgcgcagacagccc

SEQ ID NO: 536592 - DNA, 25 bp, Rattus norvegicus
aggcccgatgcggtttctcctccag

SEQ ID NO: 536593 - DNA, 25 bp, Rattus norvegicus
tccgtgctcatggtcccggaaggca

SEQ ID NO: 536594 - DNA, 25 bp, Rattus norvegicus
taatgaaaggcgagaggccgccctg

SEQ ID NO: 536595 - DNA, 25 bp, Rattus norvegicus
ctgctgctttcgtaggcccggtaat

SEQ ID NO: 536596 - DNA, 25 bp, Rattus norvegicus
agctacatatttgcctgggctgctg

SEQ ID NO: 536597 - DNA, 25 bp, Rattus norvegicus
caacgcagggcgattaattttaata

SEQ ID NO: 536598 - DNA, 25 bp, Rattus norvegicus
ttcagctgacaacgcagggcgatta

SEQ ID NO: 536599 - DNA, 25 bp, Rattus norvegicus
gcgcagacagcccataaataatttg

SEQ ID NO: 536600 - DNA, 25 bp, Rattus norvegicus
cctggagcctgcacgatgataaata

SEQ ID NO: 536601 - DNA, 25 bp, Rattus norvegicus
taggccagaaggcactaagcgcctg

SEQ ID NO: 536602 - DNA, 25 bp, Rattus norvegicus
gctgcagcctgcgttcatcttcggc

SEQ ID NO: 536603 - DNA, 25 bp, Rattus norvegicus
tgcgttcatcttcggcctccgcggg

SEQ ID NO: 536604 - DNA, 25 bp, Rattus norvegicus
tttgcattatgttcagctgacaacg

SEQ ID NO: 536605 - DNA, 25 bp, Rattus norvegicus
gcgctcaagaagcttaacaagaaca

SEQ ID NO: 536606 - DNA, 25 bp, Rattus norvegicus
ggcgctcaagaagcttaacaagaac

SEQ ID NO: 536607 - DNA, 25 bp, Rattus norvegicus
gctcaagaagcttaacaagaacaag

SEQ ID NO: 536608 - DNA, 25 bp, Rattus norvegicus
taacaagaacaagaagttggtcaaa

SEQ ID NO: 536609 - DNA, 25 bp, Rattus norvegicus
gcttaacaagaacaagaagttggtc

SEQ ID NO: 536610 - DNA, 25 bp, Rattus norvegicus
cttaacaagaacaagaagttggtca

SEQ ID NO: 536611 - DNA, 25 bp, Rattus norvegicus
catggacatcgaggcgctcaagaag

SEQ ID NO: 536612 - DNA, 25 bp, Rattus norvegicus
gacatcgaggcgctcaagaagctta

SEQ ID NO: 536613 - DNA, 25 bp, Rattus norvegicus
catcgaggcgctcaagaagcttaac

SEQ ID NO: 536614 - DNA, 25 bp, Rattus norvegicus
atcgaggcgctcaagaagcttaaca

SEQ ID NO: 536615 - DNA, 25 bp, Rattus norvegicus
tcgaggcgctcaagaagcttaacaa

SEQ ID NO: 536616 - DNA, 25 bp, Rattus norvegicus
cgaggcgctcaagaagcttaacaag

SEQ ID NO: 536617 - DNA, 25 bp, Rattus norvegicus
gaggcgctcaagaagcttaacaaga

SEQ ID NO: 536618 - DNA, 25 bp, Rattus norvegicus
acatggacatcgaggcgctcaagaa

SEQ ID NO: 536619 - DNA, 25 bp, Rattus norvegicus
tgccatggcgctatgtaacctccct

SEQ ID NO: 536620 - DNA, 25 bp, Rattus norvegicus
gtaatgccttccgtctgcgagagcg

SEQ ID NO: 536621 - DNA, 25 bp, Rattus norvegicus
ggcagcgccctgaaatctatttaaa

SEQ ID NO: 536622 - DNA, 25 bp, Rattus norvegicus
ccaaaagcttcgaggttcgcgatgc

SEQ ID NO: 536623 - DNA, 25 bp, Rattus norvegicus
ttcggaaactgattgcaactgcctg

SEQ ID NO: 536624 - DNA, 25 bp, Rattus norvegicus
tcgacccttggatcttctgccatgg

SEQ ID NO: 536625 - DNA, 25 bp, Rattus norvegicus
tgccgaggaaagatctcgacccttg

SEQ ID NO: 536626 - DNA, 25 bp, Rattus norvegicus
gggctgccttgtccgactatcccta

SEQ ID NO: 536627 - DNA, 25 bp, Rattus norvegicus
cggctcactcgagcggcctggttaa

SEQ ID NO: 536628 - DNA, 25 bp, Rattus norvegicus
agcggagcggaggacaatcatttaa

SEQ ID NO: 536629 - DNA, 25 bp, Rattus norvegicus
actgcctgttaacagcccgtactga

SEQ ID NO: 536630 - DNA, 25 bp, Rattus norvegicus
ccttggctgacctttcggaaactga

SEQ ID NO: 536631 - DNA, 25 bp, Rattus norvegicus
tgactgcagatacaaaagcggtttc

SEQ ID NO: 536632 - DNA, 25 bp, Rattus norvegicus
cgctgagggcttaatctgccatttg

SEQ ID NO: 536633 - DNA, 25 bp, Rattus norvegicus
aacttgatcccgtgtcggaaggaca

SEQ ID NO: 536634 - DNA, 25 bp, Rattus norvegicus
tcgcaaccgttcagtcgtggctgcc

SEQ ID NO: 536635 - DNA, 25 bp, Rattus norvegicus
cttctcggcggtacagctcggcctt

SEQ ID NO: 536636 - DNA, 25 bp, Rattus norvegicus
gtacagctcggccttagatcccgct

SEQ ID NO: 536637 - DNA, 25 bp, Rattus norvegicus
tgaattttctagatcgcaaccgttc

SEQ ID NO: 536638 - DNA, 25 bp, Rattus norvegicus
gcctgaaacttgatcccgtgtcgga

SEQ ID NO: 536639 - DNA, 25 bp, Rattus norvegicus
gtcggaaggacagtatgtaaacacc

SEQ ID NO: 536640 - DNA, 25 bp, Rattus norvegicus
aggacagtatgtaaacaccaggcgc

SEQ ID NO: 536641 - DNA, 25 bp, Rattus norvegicus
ggcagggccgctgcctagctctctg

SEQ ID NO: 536642 - DNA, 25 bp, Rattus norvegicus
tctgccttccctgttggctcagcta

SEQ ID NO: 536643 - DNA, 25 bp, Rattus norvegicus
tggctcagctaattggagccgccgc

SEQ ID NO: 536644 - DNA, 25 bp, Rattus norvegicus
cactgtggcggcctcttgttgaatt

SEQ ID NO: 536645 - DNA, 25 bp, Rattus norvegicus
tggcggcctcttgttgaattttcta

SEQ ID NO: 536646 - DNA, 25 bp, Rattus norvegicus
ctctagcgcggcctgaaacttgatc

SEQ ID NO: 536647 - DNA, 25 bp, Rattus norvegicus
tgggctgaaagccagcgaacacctg

SEQ ID NO: 536648 - DNA, 25 bp, Rattus norvegicus
gctcgcttcccggtgagaaccttta

SEQ ID NO: 536649 - DNA, 25 bp, Rattus norvegicus
cggctctcaggtctgtgctttgctc

SEQ ID NO: 536650 - DNA, 25 bp, Rattus norvegicus
gggcttttattagacctcctactgc

SEQ ID NO: 536651 - DNA, 25 bp, Rattus norvegicus
cctgaagaatttgggtacgctgtcc

SEQ ID NO: 536652 - DNA, 25 bp, Rattus norvegicus
ttcgctccgatccaggccgaaactg

SEQ ID NO: 536653 - DNA, 25 bp, Rattus norvegicus
aggcctcagggcaggtgacaccctt

SEQ ID NO: 536654 - DNA, 25 bp, Rattus norvegicus
gcggaaacacggtccaactccttga

SEQ ID NO: 536655 - DNA, 25 bp, Rattus norvegicus
taaacttgccgcgagctgccagggc

SEQ ID NO: 536656 - DNA, 25 bp, Rattus norvegicus
agctacagggcccaacttgcgaacc

SEQ ID NO: 536657 - DNA, 25 bp, Rattus norvegicus
ctgctgctcgctgccattgttactc

SEQ ID NO: 536658 - DNA, 25 bp, Rattus norvegicus
agagcctccactctggcgagagata

SEQ ID NO: 536659 - DNA, 25 bp, Rattus norvegicus
tcgccaagagagctcctcggatttc

SEQ ID NO: 536660 - DNA, 25 bp, Rattus norvegicus
ctctggagactgttagtcgccctga

SEQ ID NO: 536661 - DNA, 25 bp, Rattus norvegicus
gtgacggctacagtcccgaagctga

SEQ ID NO: 536662 - DNA, 25 bp, Rattus norvegicus
gcacagacatgcagtcctggggacc

SEQ ID NO: 536663 - DNA, 25 bp, Rattus norvegicus
aagagaaacgcgtggccgcaaaagc

SEQ ID NO: 536664 - DNA, 25 bp, Rattus norvegicus
cgtggccgcaaaagcacagacatgc

SEQ ID NO: 536665 - DNA, 25 bp, Rattus norvegicus
ctcaatcgtcggagcctctgttttc

SEQ ID NO: 536666 - DNA, 25 bp, Rattus norvegicus
ccgaagctgagtttggttctgtctc

SEQ ID NO: 536667 - DNA, 25 bp, Rattus norvegicus
ctgggttttgaaccgcacgccagtg

SEQ ID NO: 536668 - DNA, 25 bp, Rattus norvegicus
acgccagtgaactcctctgctcgag

SEQ ID NO: 536669 - DNA, 25 bp, Rattus norvegicus
tctgctcgagttcgcttggatgtgc

SEQ ID NO: 536670 - DNA, 25 bp, Rattus norvegicus
cacgcgaccggaaacactggcagca

SEQ ID NO: 536671 - DNA, 25 bp, Rattus norvegicus
aagccggtaaaagagccagtcttcg

SEQ ID NO: 536672 - DNA, 25 bp, Rattus norvegicus
ccagtcttcgggtgagaaagagcga

SEQ ID NO: 536673 - DNA, 25 bp, Rattus norvegicus
ctgcgcatccttcagctgggttttg

SEQ ID NO: 536674 - DNA, 25 bp, Rattus norvegicus
ggggaccctgtacgctcaatcgtcg

SEQ ID NO: 536675 - DNA, 25 bp, Rattus norvegicus
ccgtaggaacctcagggcatcgggc

SEQ ID NO: 536676 - DNA, 25 bp, Rattus norvegicus
ctccgtgcctaaaatgggtccattc

SEQ ID NO: 536677 - DNA, 25 bp, Rattus norvegicus
tccattccggggtgcggacgatcgc

SEQ ID NO: 536678 - DNA, 25 bp, Rattus norvegicus
cagctccggtctggaactgccctag

SEQ ID NO: 536679 - DNA, 25 bp, Rattus norvegicus
tctgcgctgacgctgcgaccaggct

SEQ ID NO: 536680 - DNA, 25 bp, Rattus norvegicus
ctctcggagcagagccgtaggaacc

SEQ ID NO: 536681 - DNA, 25 bp, Rattus norvegicus
cgtcgccctcgccttgtgcggggat

SEQ ID NO: 536682 - DNA, 25 bp, Rattus norvegicus
tgcgggtccaggaacacgaaaccaa

SEQ ID NO: 536683 - DNA, 25 bp, Rattus norvegicus
aaccgggccttgagaccgcgccaga

SEQ ID NO: 536684 - DNA, 25 bp, Rattus norvegicus
aactcgggctgactaatgggacgcg

SEQ ID NO: 536685 - DNA, 25 bp, Rattus norvegicus
agaggcccggctgtcagcagatgcc

SEQ ID NO: 536686 - DNA, 25 bp, Rattus norvegicus
gacaatccggctggctctgggcttt

SEQ ID NO: 536687 - DNA, 25 bp, Rattus norvegicus
tggaactgccctaggggccagcgct

SEQ ID NO: 536688 - DNA, 25 bp, Rattus norvegicus
ggctttgggtcctgtagcctgaccc

SEQ ID NO: 536689 - DNA, 25 bp, Rattus norvegicus
ccgcaacgccgctggagtttcaaaa

SEQ ID NO: 536690 - DNA, 25 bp, Rattus norvegicus
agcactttgtctatgagaaatttcc

SEQ ID NO: 536691 - DNA, 25 bp, Rattus norvegicus
tttaaagccgctttgcgcgcggggc

SEQ ID NO: 536692 - DNA, 25 bp, Rattus norvegicus
gtcctgcagagacgactgcgccttc

SEQ ID NO: 536693 - DNA, 25 bp, Rattus norvegicus
tcctggccctccagacgtgcagtgg

SEQ ID NO: 536694 - DNA, 25 bp, Rattus norvegicus
ttccacaggaactttgccaggccga

SEQ ID NO: 536695 - DNA, 25 bp, Rattus norvegicus
ggttcactccctgagaaggcgcaga

SEQ ID NO: 536696 - DNA, 25 bp, Rattus norvegicus
tgtcctgcccttgaactgacaagtg

SEQ ID NO: 536697 - DNA, 25 bp, Rattus norvegicus
caaagctcagcagccggggttcact

SEQ ID NO: 536698 - DNA, 25 bp, Rattus norvegicus
tgacaagtggatctccgcggctaga

SEQ ID NO: 536699 - DNA, 25 bp, Rattus norvegicus
gcagagagctctgacccagcggcca

SEQ ID NO: 536700 - DNA, 25 bp, Rattus norvegicus
gactcagcttgcagtttctgtcctg

SEQ ID NO: 536701 - DNA, 25 bp, Rattus norvegicus
tgggaccctatactaagaggcatcc

SEQ ID NO: 536702 - DNA, 25 bp, Rattus norvegicus
ctagagtcccggagagcctcagcag

SEQ ID NO: 536703 - DNA, 25 bp, Rattus norvegicus
acaggatcgacactagcagaggaca

SEQ ID NO: 536704 - DNA, 25 bp, Rattus norvegicus
cggcggtaaggttttctatcatttg

SEQ ID NO: 536705 - DNA, 25 bp, Rattus norvegicus
tttgcagggtctccctaagggcatg

SEQ ID NO: 536706 - DNA, 25 bp, Rattus norvegicus
ccatttctcgcatggagaggggaca

SEQ ID NO: 536707 - DNA, 25 bp, Rattus norvegicus
cacggcgacgcctcgcttaattgca

SEQ ID NO: 536708 - DNA, 25 bp, Rattus norvegicus
ccaaggccatgtgcgactgacagga

SEQ ID NO: 536709 - DNA, 25 bp, Rattus norvegicus
agcctgtgactaatcgcggggcctc

SEQ ID NO: 536710 - DNA, 25 bp, Rattus norvegicus
acaaatagatctcgcaggcccagga

SEQ ID NO: 536711 - DNA, 25 bp, Rattus norvegicus
cgaacgcactgaaacacttgtccta

SEQ ID NO: 536712 - DNA, 25 bp, Rattus norvegicus
taaggatttcgcctcccgcgttcga

SEQ ID NO: 536713 - DNA, 25 bp, Rattus norvegicus
aaactgctccgacaaccgaaggctc

SEQ ID NO: 536714 - DNA, 25 bp, Rattus norvegicus
ggatttcctctcatttctcggcaga

SEQ ID NO: 536715 - DNA, 25 bp, Rattus norvegicus
ccgccgtaagcgttgcacaggattt

SEQ ID NO: 536716 - DNA, 25 bp, Rattus norvegicus
tccagtgcagaaagccaccgcattc

SEQ ID NO: 536717 - DNA, 25 bp, Rattus norvegicus
tcagagctgcaagttattaaaaatg

SEQ ID NO: 536718 - DNA, 25 bp, Rattus norvegicus
gttcgctttcgtttttacatcagag

SEQ ID NO: 536719 - DNA, 25 bp, Rattus norvegicus
gcctacttcccgactggggatttca

SEQ ID NO: 536720 - DNA, 25 bp, Rattus norvegicus
accggaggaagccaaactttgctgc

SEQ ID NO: 536721 - DNA, 25 bp, Rattus norvegicus
ttcaaaacgccggatcgagggctcc

SEQ ID NO: 536722 - DNA, 25 bp, Rattus norvegicus
cgggctcctctgctctttagcgtag

SEQ ID NO: 536723 - DNA, 25 bp, Rattus norvegicus
aaactttgctgctcgctgcgctttc

SEQ ID NO: 536724 - DNA, 25 bp, Rattus norvegicus
aacggcggccgagctcttaagccga

SEQ ID NO: 536725 - DNA, 25 bp, Rattus norvegicus
gccggaacccagagcacgaccgaga

SEQ ID NO: 536726 - DNA, 25 bp, Rattus norvegicus
ggagggacgacttggccaacacact

SEQ ID NO: 536727 - DNA, 25 bp, Rattus norvegicus
gcgctctcggcgaaccgtcaacatg

SEQ ID NO: 536728 - DNA, 25 bp, Rattus norvegicus
aaccgtcaacatggcgctggggctc

SEQ ID NO: 536729 - DNA, 25 bp, Rattus norvegicus
ccgctgcagacagaggcgagcaagc

SEQ ID NO: 536730 - DNA, 25 bp, Rattus norvegicus
ggatttcaggtcagtgcccggaaca

SEQ ID NO: 536731 - DNA, 25 bp, Rattus norvegicus
gacctgagcagggtctccgcgctct

SEQ ID NO: 536732 - DNA, 25 bp, Rattus norvegicus
cagcgggcaggccaggataacttcg

SEQ ID NO: 536733 - DNA, 25 bp, Rattus norvegicus
gataacttcgcagggctgtgtgttg

SEQ ID NO: 536734 - DNA, 25 bp, Rattus norvegicus
cactgtgtctttaactcgctctagc

SEQ ID NO: 536735 - DNA, 25 bp, Rattus norvegicus
aactcgctctagctcgctttgctgc

SEQ ID NO: 536736 - DNA, 25 bp, Rattus norvegicus
cctcgcctatctcttgttctctaag

SEQ ID NO: 536737 - DNA, 25 bp, Rattus norvegicus
ttgttctctaagcacgacgcctgtg

SEQ ID NO: 536738 - DNA, 25 bp, Rattus norvegicus
gcccagtttgggattagacaagata

SEQ ID NO: 536739 - DNA, 25 bp, Rattus norvegicus
gataaaaataggactgcccagcgcg

SEQ ID NO: 536740 - DNA, 25 bp, Rattus norvegicus
ccagcgcgcagagctgtgacagtgc

SEQ ID NO: 536741 - DNA, 25 bp, Rattus norvegicus
cggggcggccagattcttattggac

SEQ ID NO: 536742 - DNA, 25 bp, Rattus norvegicus
ggactccttccgctgtgaaccgtgc

SEQ ID NO: 536743 - DNA, 25 bp, Rattus norvegicus
tctccgcgctctcgcgggtgttgtt

SEQ ID NO: 536744 - DNA, 25 bp, Rattus norvegicus
gccagattcttattggaccctcacc

SEQ ID NO: 536745 - DNA, 25 bp, Rattus norvegicus
caagtgtgaggccagcgctccacgt

SEQ ID NO: 536746 - DNA, 25 bp, Rattus norvegicus
gcgcactcttatctcggccgagtca

SEQ ID NO: 536747 - DNA, 25 bp, Rattus norvegicus
gagtcagacactcgccgcgcggaat

SEQ ID NO: 536748 - DNA, 25 bp, Rattus norvegicus
gccgcgcggaatctgttgacattta

SEQ ID NO: 536749 - DNA, 25 bp, Rattus norvegicus
gcgcggaatctgttgacatttacta

SEQ ID NO: 536750 - DNA, 25 bp, Rattus norvegicus
gttgacatttactattgttcgcagg

SEQ ID NO: 536751 - DNA, 25 bp, Rattus norvegicus
tattgttcgcaggagtcccgagcgc

SEQ ID NO: 536752 - DNA, 25 bp, Rattus norvegicus
cttatctcggccgagtcagacactc

SEQ ID NO: 536753 - DNA, 25 bp, Rattus norvegicus
aggccagcgctccacgtgtgtgtgc

SEQ ID NO: 536754 - DNA, 25 bp, Rattus norvegicus
cggaagcttccaagccggctgagca

SEQ ID NO: 536755 - DNA, 25 bp, Rattus norvegicus
agcccacgccgggaattgaagtggt

SEQ ID NO: 536756 - DNA, 25 bp, Rattus norvegicus
tgtcgcggagctcagggccaaccgc

SEQ ID NO: 536757 - DNA, 25 bp, Rattus norvegicus
gcccggaagcttccaagccggctga

SEQ ID NO: 536758 - DNA, 25 bp, Rattus norvegicus
tttactattgttcgcaggagtcccg

SEQ ID NO: 536759 - DNA, 25 bp, Rattus norvegicus
ctagccgtggtagggattaaagtgc

SEQ ID NO: 536760 - DNA, 25 bp, Rattus norvegicus
ggttttcgtcctcgtcttctcggca

SEQ ID NO: 536761 - DNA, 25 bp, Rattus norvegicus
cgggtatcttgaagagctcggttga

SEQ ID NO: 536762 - DNA, 25 bp, Rattus norvegicus
agtaatggggactcgcgggtatctt

SEQ ID NO: 536763 - DNA, 25 bp, Rattus norvegicus
ccctggccaaggcactgagtgcgtg

SEQ ID NO: 536764 - DNA, 25 bp, Rattus norvegicus
tgtttcgcaactgccgtcccggcga

SEQ ID NO: 536765 - DNA, 25 bp, Rattus norvegicus
gtgacccacaggacacaagtgcatt

SEQ ID NO: 536766 - DNA, 25 bp, Rattus norvegicus
caagtgcatttgtgcctagccgtgg

SEQ ID NO: 536767 - DNA, 25 bp, Rattus norvegicus
ttaaagtgccatacggcccgagcga

SEQ ID NO: 536768 - DNA, 25 bp, Rattus norvegicus
gggtagaaaacaacccgcgcgcaca

SEQ ID NO: 536769 - DNA, 25 bp, Rattus norvegicus
cgcgcgcacaaagcgcgcattgttc

SEQ ID NO: 536770 - DNA, 25 bp, Rattus norvegicus
gtcctcgtcttctcggcacttttcg

SEQ ID NO: 536771 - DNA, 25 bp, Rattus norvegicus
attgttccagccacctccattatgc

SEQ ID NO: 536772 - DNA, 25 bp, Rattus norvegicus
gcgctgcagccaagagcctgtttcg

SEQ ID NO: 536773 - DNA, 25 bp, Rattus norvegicus
tcgtccaggagtggtcgaatgaccc

SEQ ID NO: 536774 - DNA, 25 bp, Rattus norvegicus
tcaggctccgcaagctagcgaagtc

SEQ ID NO: 536775 - DNA, 25 bp, Rattus norvegicus
cgcaagctagcgaagtctggtttcc

SEQ ID NO: 536776 - DNA, 25 bp, Rattus norvegicus
ctagcgaagtctggtttcctttacg

SEQ ID NO: 536777 - DNA, 25 bp, Rattus norvegicus
atgagcgctgcgtccaagggcggct

SEQ ID NO: 536778 - DNA, 25 bp, Rattus norvegicus
agggcggcttctcgccgaatccggc

SEQ ID NO: 536779 - DNA, 25 bp, Rattus norvegicus
cttctcgccgaatccggcgggcggt

SEQ ID NO: 536780 - DNA, 25 bp, Rattus norvegicus
atctgggccaggagctggtcttaac

SEQ ID NO: 536781 - DNA, 25 bp, Rattus norvegicus
ccaggagctggtcttaacgcggcct

SEQ ID NO: 536782 - DNA, 25 bp, Rattus norvegicus
agctggtcttaacgcggcctgagcc

SEQ ID NO: 536783 - DNA, 25 bp, Rattus norvegicus
tcttaacgcggcctgagcccagggt

SEQ ID NO: 536784 - DNA, 25 bp, Rattus norvegicus
agtggtcgaatgaccctcctcttcc

SEQ ID NO: 536785 - DNA, 25 bp, Rattus norvegicus
aaagctcagaggtcgtccaggagtg

SEQ ID NO: 536786 - DNA, 25 bp, Rattus norvegicus
ggcgatggctcagggaaagctcaga

SEQ ID NO: 536787 - DNA, 25 bp, Rattus norvegicus
cgccctcgctaagatgtgcggagga

SEQ ID NO: 536788 - DNA, 25 bp, Rattus norvegicus
tggcgaccctttcacaaccggcaaa

SEQ ID NO: 536789 - DNA, 25 bp, Rattus norvegicus
ggcaaaatcgctccccaggctggta

SEQ ID NO: 536790 - DNA, 25 bp, Rattus norvegicus
gacgaagagtacgacggcctcgccc

SEQ ID NO: 536791 - DNA, 25 bp, Rattus norvegicus
ctcacagagagccagaagcctaggg

SEQ ID NO: 536792 - DNA, 25 bp, Rattus norvegicus
atgcgccggcgagctggtaaccgtc

SEQ ID NO: 536793 - DNA, 25 bp, Rattus norvegicus
agctggtaaccgtctgcagcgagga

SEQ ID NO: 536794 - DNA, 25 bp, Rattus norvegicus
tctgcagcgaggagtgtaattgccc

SEQ ID NO: 536795 - DNA, 25 bp, Rattus norvegicus
ccactccaccgcaggcgcggagctg

SEQ ID NO: 536796 - DNA, 25 bp, Rattus norvegicus
ctggccgccttttggctgagatgac

SEQ ID NO: 536797 - DNA, 25 bp, Rattus norvegicus
tttggctgagatgacgcgaagcacc

SEQ ID NO: 536798 - DNA, 25 bp, Rattus norvegicus
tgacgcgaagcacctacgaggcttg

SEQ ID NO: 536799 - DNA, 25 bp, Rattus norvegicus
acctacgaggcttggccctgtaccg

SEQ ID NO: 536800 - DNA, 25 bp, Rattus norvegicus
cagcgatctgggcagctcacagaga

SEQ ID NO: 536801 - DNA, 25 bp, Rattus norvegicus
cctgcgtctagagcagcctggtcca

SEQ ID NO: 536802 - DNA, 25 bp, Rattus norvegicus
cagcctggtccagagcgtaaccgag

SEQ ID NO: 536803 - DNA, 25 bp, Rattus norvegicus
ggggcattccattgggtacagctga

SEQ ID NO: 536804 - DNA, 25 bp, Rattus norvegicus
ccctcggggcattccattgggtaca

SEQ ID NO: 536805 - DNA, 25 bp, Rattus norvegicus
gtacagctgagcgtgccggttacgt

SEQ ID NO: 536806 - DNA, 25 bp, Rattus norvegicus
tgccggttacgtcaggtctgaattc

SEQ ID NO: 536807 - DNA, 25 bp, Rattus norvegicus
ttacgtcaggtctgaattcggggcg

SEQ ID NO: 536808 - DNA, 25 bp, Rattus norvegicus
aggcccttttggcttctcgcggagc

SEQ ID NO: 536809 - DNA, 25 bp, Rattus norvegicus
cccactgtcgtcagcttcctgtgtt

SEQ ID NO: 536810 - DNA, 25 bp, Rattus norvegicus
cttcctgtgttgctcgtcattaatg

SEQ ID NO: 536811 - DNA, 25 bp, Rattus norvegicus
gtcattaatgaaaccaacgagagga

SEQ ID NO: 536812 - DNA, 25 bp, Rattus norvegicus
tgggcgggcctaacacacgaacgcc

SEQ ID NO: 536813 - DNA, 25 bp, Rattus norvegicus
tccagagcgtaaccgagtgggccgt

SEQ ID NO: 536814 - DNA, 25 bp, Rattus norvegicus
aacgagaggataccgcctgcgtcta

SEQ ID NO: 536815 - DNA, 25 bp, Rattus norvegicus
gttggagggaacactttatccggca

SEQ ID NO: 536816 - DNA, 25 bp, Rattus norvegicus
gcatgacatgcgaccttgaacctgg

SEQ ID NO: 536817 - DNA, 25 bp, Rattus norvegicus
ctgtgagcatgacatgcgaccttga

SEQ ID NO: 536818 - DNA, 25 bp, Rattus norvegicus
gcagcgctgtgagcatgacatgcga

SEQ ID NO: 536819 - DNA, 25 bp, Rattus norvegicus
cggcagcagcgctgtgagcatgaca

SEQ ID NO: 536820 - DNA, 25 bp, Rattus norvegicus
agggaacactttatccggcagcagc

SEQ ID NO: 536821 - DNA, 25 bp, Rattus norvegicus
tgtgctgccgccttggcccaggcta

SEQ ID NO: 536822 - DNA, 25 bp, Rattus norvegicus
gaatgaattcgcgaccgcgggtccg

SEQ ID NO: 536823 - DNA, 25 bp, Rattus norvegicus
cacgaatgaattcgcgaccgcgggt

SEQ ID NO: 536824 - DNA, 25 bp, Rattus norvegicus
tgtgcacgaatgaattcgcgaccgc

SEQ ID NO: 536825 - DNA, 25 bp, Rattus norvegicus
ggagtgaatgtgcacgaatgaattc

SEQ ID NO: 536826 - DNA, 25 bp, Rattus norvegicus
tgccaggagtgaatgtgcacgaatg

SEQ ID NO: 536827 - DNA, 25 bp, Rattus norvegicus
tagtgtgccaggagtgaatgtgcac

SEQ ID NO: 536828 - DNA, 25 bp, Rattus norvegicus
ggaacactttatccggcagcagcgc

SEQ ID NO: 536829 - DNA, 25 bp, Rattus norvegicus
tcggtgccacaactatcagagcctg

SEQ ID NO: 536830 - DNA, 25 bp, Rattus norvegicus
cggcgtcccggacaagatttgctgt

SEQ ID NO: 536831 - DNA, 25 bp, Rattus norvegicus
agttaatttacaccctcgcgctgcg

SEQ ID NO: 536832 - DNA, 25 bp, Rattus norvegicus
ccgaggtccggacgcataataaata

SEQ ID NO: 536833 - DNA, 25 bp, Rattus norvegicus
agacaacgcggagctatcaccaacc

SEQ ID NO: 536834 - DNA, 25 bp, Rattus norvegicus
ggaggtcccgatcgctagacaacgc

SEQ ID NO: 536835 - DNA, 25 bp, Rattus norvegicus
cccgcggccttaatgacaactatta

SEQ ID NO: 536836 - DNA, 25 bp, Rattus norvegicus
gccgctgttcgcctccaattagaaa

SEQ ID NO: 536837 - DNA, 25 bp, Rattus norvegicus
gctccatccattagggccgctgttc

SEQ ID NO: 536838 - DNA, 25 bp, Rattus norvegicus
ccgcggtgttagcaagccgtatcga

SEQ ID NO: 536839 - DNA, 25 bp, Rattus norvegicus
tatcagagcctgagcccttttcccg

SEQ ID NO: 536840 - DNA, 25 bp, Rattus norvegicus
ccctgcagtatctcggaccacaaag

SEQ ID NO: 536841 - DNA, 25 bp, Rattus norvegicus
ttttcccgctgcagtcgctggaagg

SEQ ID NO: 536842 - DNA, 25 bp, Rattus norvegicus
tggggagttagtttcgagacaccga

SEQ ID NO: 536843 - DNA, 25 bp, Rattus norvegicus
tcccggaacagtgactgagcggccc

SEQ ID NO: 536844 - DNA, 25 bp, Rattus norvegicus
acgtgactatacctatcccggaaca

SEQ ID NO: 536845 - DNA, 25 bp, Rattus norvegicus
agcagctcctgcacttcatcaaata

SEQ ID NO: 536846 - DNA, 25 bp, Rattus norvegicus
gttgtccgtcgtcggagcagctcct

SEQ ID NO: 536847 - DNA, 25 bp, Rattus norvegicus
actggccgaagtcggatgagctttc

SEQ ID NO: 536848 - DNA, 25 bp, Rattus norvegicus
agcgccgccacttggaaactgcaga

SEQ ID NO: 536849 - DNA, 25 bp, Rattus norvegicus
agccgtgtccacgtggtccgtgata

SEQ ID NO: 536850 - DNA, 25 bp, Rattus norvegicus
agcgcgacgcgatgacgtgactata

SEQ ID NO: 536851 - DNA, 25 bp, Rattus norvegicus
ggggctgaccagagaagatttaaac

SEQ ID NO: 536852 - DNA, 25 bp, Rattus norvegicus
gctctgacctgggaacctgataacg

SEQ ID NO: 536853 - DNA, 25 bp, Rattus norvegicus
tcggatgagctttccgccagccacg

SEQ ID NO: 536854 - DNA, 25 bp, Rattus norvegicus
tatctcgcttatccggagaaaaacc

SEQ ID NO: 536855 - DNA, 25 bp, Rattus norvegicus
aaaccggacgatgacgcatggcgtc

SEQ ID NO: 536856 - DNA, 25 bp, Rattus norvegicus
atacgttccggtgaaggacttgccg

SEQ ID NO: 536857 - DNA, 25 bp, Rattus norvegicus
cccatttggtgcgatcggacgtact

SEQ ID NO: 536858 - DNA, 25 bp, Rattus norvegicus
cgcgtggtcaacagggtcatataga

SEQ ID NO: 536859 - DNA, 25 bp, Rattus norvegicus
gcgctgtcaactagaacccaccgga

SEQ ID NO: 536860 - DNA, 25 bp, Rattus norvegicus
accggaagctccatcggggcaaata

SEQ ID NO: 536861 - DNA, 25 bp, Rattus norvegicus
tcgtagcctcgtgatcaaccggttt

SEQ ID NO: 536862 - DNA, 25 bp, Rattus norvegicus
tcaaccggtttgaggctatcagctc

SEQ ID NO: 536863 - DNA, 25 bp, Rattus norvegicus
tgaggacccagtctcccatttggtg

SEQ ID NO: 536864 - DNA, 25 bp, Rattus norvegicus
acgctgctgcgttggttctaaagtg

SEQ ID NO: 536865 - DNA, 25 bp, Rattus norvegicus
gctcaagttgcgcagcatcgggatc

SEQ ID NO: 536866 - DNA, 25 bp, Rattus norvegicus
cgcgtggaaccagggagatttcttc

SEQ ID NO: 536867 - DNA, 25 bp, Rattus norvegicus
ttcagaagaaactacgcctcggcct

SEQ ID NO: 536868 - DNA, 25 bp, Rattus norvegicus
cgaccgcctaagaagctccagcaga

SEQ ID NO: 536869 - DNA, 25 bp, Rattus norvegicus
agccgagtacttagcacctgtcccg

SEQ ID NO: 536870 - DNA, 25 bp, Rattus norvegicus
tatcagctcgttcaggtccggactg

SEQ ID NO: 536871 - DNA, 25 bp, Rattus norvegicus
gtcgcgctccaaatggaaatgaatc

SEQ ID NO: 536872 - DNA, 25 bp, Rattus norvegicus
ccctggcacggccacagggtaattg

SEQ ID NO: 536873 - DNA, 25 bp, Rattus norvegicus
ccgagttccgcaagcatcgccatga

SEQ ID NO: 536874 - DNA, 25 bp, Rattus norvegicus
gttccgcaagcatcgccatgaagcc

SEQ ID NO: 536875 - DNA, 25 bp, Rattus norvegicus
ctccgcctggagcactgagtccttg

SEQ ID NO: 536876 - DNA, 25 bp, Rattus norvegicus
cggctccgcctgctcattagaggag

SEQ ID NO: 536877 - DNA, 25 bp, Rattus norvegicus
tccttggcatttctccggggacaac

SEQ ID NO: 536878 - DNA, 25 bp, Rattus norvegicus
ggctgcgagtcctggccgtgatctt

SEQ ID NO: 536879 - DNA, 25 bp, Rattus norvegicus
ggccacagggtaattggagaacctc

SEQ ID NO: 536880 - DNA, 25 bp, Rattus norvegicus
agtctagagacccgtccacccttgg

SEQ ID NO: 536881 - DNA, 25 bp, Rattus norvegicus
ggaaatgaatccagcgagcgagcga

SEQ ID NO: 536882 - DNA, 25 bp, Rattus norvegicus
gggcgtcgcgctccaaatggaaatg

SEQ ID NO: 536883 - DNA, 25 bp, Rattus norvegicus
gtaattggagaacctcggaggcctg

SEQ ID NO: 536884 - DNA, 25 bp, Rattus norvegicus
tggagcactgagtccttggcatttc

SEQ ID NO: 536885 - DNA, 25 bp, Rattus norvegicus
tacgagttgttattaccgaggcagc

SEQ ID NO: 536886 - DNA, 25 bp, Rattus norvegicus
ggccggtgtaatgcttcttttcatg

SEQ ID NO: 536887 - DNA, 25 bp, Rattus norvegicus
ggcttcgtggcaaacgtttctgatt

SEQ ID NO: 536888 - DNA, 25 bp, Rattus norvegicus
aaacgtttctgatttgtgccgcggc

SEQ ID NO: 536889 - DNA, 25 bp, Rattus norvegicus
tttctgatttgtgccgcggctctcc

SEQ ID NO: 536890 - DNA, 25 bp, Rattus norvegicus
cgagaggccggtgtaatgcttcttt

SEQ ID NO: 536891 - DNA, 25 bp, Rattus norvegicus
tcatgtggcaggatcggatatgacc

SEQ ID NO: 536892 - DNA, 25 bp, Rattus norvegicus
gatcggatatgaccagcgtgggttc

SEQ ID NO: 536893 - DNA, 25 bp, Rattus norvegicus
ggttctgtcagatattacgagttgt

SEQ ID NO: 536894 - DNA, 25 bp, Rattus norvegicus
gttgttattaccgaggcagcccagc

SEQ ID NO: 536895 - DNA, 25 bp, Rattus norvegicus
ttattaccgaggcagcccagctgcc

SEQ ID NO: 536896 - DNA, 25 bp, Rattus norvegicus
cccagctgccgtgcagggctcggcc

SEQ ID NO: 536897 - DNA, 25 bp, Rattus norvegicus
ccagcgtgggttctgtcagatatta

SEQ ID NO: 536898 - DNA, 25 bp, Rattus norvegicus
cttcttttcatgtggcaggatcgga

SEQ ID NO: 536899 - DNA, 25 bp, Rattus norvegicus
cagatttgcatcatggtggccgagc

SEQ ID NO: 536900 - DNA, 25 bp, Rattus norvegicus
accgagatagacctctggcgatgcc

SEQ ID NO: 536901 - DNA, 25 bp, Rattus norvegicus
ggcgatgcccgccttcaaacgctaa

SEQ ID NO: 536902 - DNA, 25 bp, Rattus norvegicus
ttcaaacgctaatgccgggagcctg

SEQ ID NO: 536903 - DNA, 25 bp, Rattus norvegicus
aagccggtgtgactggattcccaga

SEQ ID NO: 536904 - DNA, 25 bp, Rattus norvegicus
cgcggctgctctaagctttggctca

SEQ ID NO: 536905 - DNA, 25 bp, Rattus norvegicus
ctagccttgatctgctcgggagaca

SEQ ID NO: 536906 - DNA, 25 bp, Rattus norvegicus
ctccaatgctagcagaagacctttg

SEQ ID NO: 536907 - DNA, 25 bp, Rattus norvegicus
agcaaccatattagcccgggctgcc

SEQ ID NO: 536908 - DNA, 25 bp, Rattus norvegicus
ccctggttctcagtgctcgagttgc

SEQ ID NO: 536909 - DNA, 25 bp, Rattus norvegicus
gctgcggtcactgatcggactgtga

SEQ ID NO: 536910 - DNA, 25 bp, Rattus norvegicus
gcccatcccaggtgctcaatttata

SEQ ID NO: 536911 - DNA, 25 bp, Rattus norvegicus
ctccagcagcacagataaaaggtcc

SEQ ID NO: 536912 - DNA, 25 bp, Rattus norvegicus
aaggtcccagccctgaccgcgagta

SEQ ID NO: 536913 - DNA, 25 bp, Rattus norvegicus
gggtccaggccgcaaactgagcccg

SEQ ID NO: 536914 - DNA, 25 bp, Rattus norvegicus
ctgagtcattggtgcctggtgagta

SEQ ID NO: 536915 - DNA, 25 bp, Rattus norvegicus
cggcatggcagaacctgagtcattg

SEQ ID NO: 536916 - DNA, 25 bp, Rattus norvegicus
cagccttcggcatggcagaacctga

SEQ ID NO: 536917 - DNA, 25 bp, Rattus norvegicus
gcacagattccgttcgcagccttcg

SEQ ID NO: 536918 - DNA, 25 bp, Rattus norvegicus
gtctttccgaagcaggcacagattc

SEQ ID NO: 536919 - DNA, 25 bp, Rattus norvegicus
gtaccttaggcccaatcgagtcgcc

SEQ ID NO: 536920 - DNA, 25 bp, Rattus norvegicus
ctagggcagtaccttaggcccaatc

SEQ ID NO: 536921 - DNA, 25 bp, Rattus norvegicus
agcacagtagtggtcgatgccaaga

SEQ ID NO: 536922 - DNA, 25 bp, Rattus norvegicus
gttgacttccgggagcacagtagtg

SEQ ID NO: 536923 - DNA, 25 bp, Rattus norvegicus
gcatctgcgcttgcgccacatgaca

SEQ ID NO: 536924 - DNA, 25 bp, Rattus norvegicus
acctcgactacagcatctgcgcttg

SEQ ID NO: 536925 - DNA, 25 bp, Rattus norvegicus
ttccaatcacgaccgctagagggcg

SEQ ID NO: 536926 - DNA, 25 bp, Rattus norvegicus
gcagcgtggccgcttccaatcacga

SEQ ID NO: 536927 - DNA, 25 bp, Rattus norvegicus
ggcgccacagtcaagctcgacacag

SEQ ID NO: 536928 - DNA, 25 bp, Rattus norvegicus
caggctttaccaggcggcggcgcca

SEQ ID NO: 536929 - DNA, 25 bp, Rattus norvegicus
tcagtgccaggctttaccaggcggc

SEQ ID NO: 536930 - DNA, 25 bp, Rattus norvegicus
cccacaggctcagtgccaggcttta

SEQ ID NO: 536931 - DNA, 25 bp, Rattus norvegicus
ccctatcaggtagagggaccacggg

SEQ ID NO: 536932 - DNA, 25 bp, Rattus norvegicus
gagctggagccgatgcgcagaccct

SEQ ID NO: 536933 - DNA, 25 bp, Rattus norvegicus
tgctggggcacacgaacaccggcct

SEQ ID NO: 536934 - DNA, 25 bp, Rattus norvegicus
gggctccctcatctctcggactctc

SEQ ID NO: 536935 - DNA, 25 bp, Rattus norvegicus
acaggagtgactcacccactcgctt

SEQ ID NO: 536936 - DNA, 25 bp, Rattus norvegicus
ctaacccaagggacaggagtgactc

SEQ ID NO: 536937 - DNA, 25 bp, Rattus norvegicus
cagaccctgggaaaggagagaagtc

SEQ ID NO: 536938 - DNA, 25 bp, Rattus norvegicus
tcgacacagcttgctggggcacacg

SEQ ID NO: 536939 - DNA, 25 bp, Rattus norvegicus
gtcctgacgctcctaacccaaggga

SEQ ID NO: 536940 - DNA, 25 bp, Rattus norvegicus
gagagaagtcctgacgctcctaacc

SEQ ID NO: 536941 - DNA, 25 bp, Rattus norvegicus
ctggagcaggtgcataagcaacacc

SEQ ID NO: 536942 - DNA, 25 bp, Rattus norvegicus
aggccgggaatttcatctccgcgcc

SEQ ID NO: 536943 - DNA, 25 bp, Rattus norvegicus
ggcggtttccagagcggctcccagc

SEQ ID NO: 536944 - DNA, 25 bp, Rattus norvegicus
cgctaacactgaggccgggaatttc

SEQ ID NO: 536945 - DNA, 25 bp, Rattus norvegicus
gccctacacagctcgcgggagtgtc

SEQ ID NO: 536946 - DNA, 25 bp, Rattus norvegicus
gcgggccgcgaacctgcagcttctg

SEQ ID NO: 536947 - DNA, 25 bp, Rattus norvegicus
gcacgctgggccaaaatcccgagga

SEQ ID NO: 536948 - DNA, 25 bp, Rattus norvegicus
cgaggaagccgccaaccgagctggc

SEQ ID NO: 536949 - DNA, 25 bp, Rattus norvegicus
gtgcagggcatcaaggagaagaaca

SEQ ID NO: 536950 - DNA, 25 bp, Rattus norvegicus
gcggccattgtctcggccacgaaca

SEQ ID NO: 536951 - DNA, 25 bp, Rattus norvegicus
tcaaggagaagaacagcgtcagcgc

SEQ ID NO: 536952 - DNA, 25 bp, Rattus norvegicus
gccacgaacaggaacacggacgcta

SEQ ID NO: 536953 - DNA, 25 bp, Rattus norvegicus
tgctcaggtagagcgcggccattgt

SEQ ID NO: 536954 - DNA, 25 bp, Rattus norvegicus
agcgtcagcgcctgccacatgcggt

SEQ ID NO: 536955 - DNA, 25 bp, Rattus norvegicus
tcatcgaagcggttggcgaagcagc

SEQ ID NO: 536956 - DNA, 25 bp, Rattus norvegicus
aggctgccctggtagtcatcgaagc

SEQ ID NO: 536957 - DNA, 25 bp, Rattus norvegicus
tcggagccgcactccaggaaggaga

SEQ ID NO: 536958 - DNA, 25 bp, Rattus norvegicus
gcacagagcccggaacttgctgagg

SEQ ID NO: 536959 - DNA, 25 bp, Rattus norvegicus
gacaagtgtggccaccgcgtacacg

SEQ ID NO: 536960 - DNA, 25 bp, Rattus norvegicus
tctgcgagacgtggtagagcatgta

SEQ ID NO: 536961 - DNA, 25 bp, Rattus norvegicus
agcagcgcttggtgtccatgctgtc

SEQ ID NO: 536962 - DNA, 25 bp, Rattus norvegicus
cccaatgtcgagctggggacctttg

SEQ ID NO: 536963 - DNA, 25 bp, Rattus norvegicus
ggaccagtacctcctgctctcagag

SEQ ID NO: 536964 - DNA, 25 bp, Rattus norvegicus
ccaggcagctctgggaatgcgtgtc

SEQ ID NO: 536965 - DNA, 25 bp, Rattus norvegicus
gatctcttcaggcaggacccacgcg

SEQ ID NO: 536966 - DNA, 25 bp, Rattus norvegicus
tacctcctgggcaagcttctgcttg

SEQ ID NO: 536967 - DNA, 25 bp, Rattus norvegicus
gccgcagctctatggctctccaagg

SEQ ID NO: 536968 - DNA, 25 bp, Rattus norvegicus
agctcctgaaggatgcgttcgatgg

SEQ ID NO: 536969 - DNA, 25 bp, Rattus norvegicus
tgcatgaacacctcagccttggcct

SEQ ID NO: 536970 - DNA, 25 bp, Rattus norvegicus
cggcatcctcgcagtgccagtcata

SEQ ID NO: 536971 - DNA, 25 bp, Rattus norvegicus
ggatatgggtgttgacggcatcctc

SEQ ID NO: 536972 - DNA, 25 bp, Rattus norvegicus
catagagccgcagctggatatgggt

SEQ ID NO: 536973 - DNA, 25 bp, Rattus norvegicus
tgtacacataggaggcatagagccg

SEQ ID NO: 536974 - DNA, 25 bp, Rattus norvegicus
agacggccatagacatgtacacata

SEQ ID NO: 536975 - DNA, 25 bp, Rattus norvegicus
gggccacgtcatcacggtcaaagta

SEQ ID NO: 536976 - DNA, 25 bp, Rattus norvegicus
tgaagtttcccagggccacgtcatc

SEQ ID NO: 536977 - DNA, 25 bp, Rattus norvegicus
gcctggcattcgtgtgacttgctca

SEQ ID NO: 536978 - DNA, 25 bp, Rattus norvegicus
gagaggcagcctccacgcgtattct

SEQ ID NO: 536979 - DNA, 25 bp, Rattus norvegicus
ccggtctcgcgatgtcatgaaggga

SEQ ID NO: 536980 - DNA, 25 bp, Rattus norvegicus
gccagtcatagttctgtcgcacttg

SEQ ID NO: 536981 - DNA, 25 bp, Rattus norvegicus
ttctgtcgcacttgagagggcgctt

SEQ ID NO: 536982 - DNA, 25 bp, Rattus norvegicus
tgacttgctcaagaagaaacgcttg

SEQ ID NO: 536983 - DNA, 25 bp, Rattus norvegicus
cgtgaccggaagtggcgccatcttt

SEQ ID NO: 536984 - DNA, 25 bp, Rattus norvegicus
gagcgttccgggcacttcaagccgc

SEQ ID NO: 536985 - DNA, 25 bp, Rattus norvegicus
ggttcagaaacctccaatcaagagc

SEQ ID NO: 536986 - DNA, 25 bp, Rattus norvegicus
agcgccgaaggtgtctccaaggccc

SEQ ID NO: 536987 - DNA, 25 bp, Rattus norvegicus
ggcttcaggatctgggagctatgaa

SEQ ID NO: 536988 - DNA, 25 bp, Rattus norvegicus
ctgggagctatgaaaagtgtctgcc

SEQ ID NO: 536989 - DNA, 25 bp, Rattus norvegicus
agtgtctgcccaggcacttccggta

SEQ ID NO: 536990 - DNA, 25 bp, Rattus norvegicus
taagagcgatgtggcgcgaagctca

SEQ ID NO: 536991 - DNA, 25 bp, Rattus norvegicus
cgaagctcaccgcgggacccttaag

SEQ ID NO: 536992 - DNA, 25 bp, Rattus norvegicus
acccttaaggaacgggtggctgatg

SEQ ID NO: 536993 - DNA, 25 bp, Rattus norvegicus
gaacgggagccctagcaagcagccc

SEQ ID NO: 536994 - DNA, 25 bp, Rattus norvegicus
tagcaagcagccctgagcgagcgtt

SEQ ID NO: 536995 - DNA, 25 bp, Rattus norvegicus
acttccggtaagagcgatgtggcgc

SEQ ID NO: 536996 - DNA, 25 bp, Rattus norvegicus
atcaagagcgccgaaggtgtctcca

SEQ ID NO: 536997 - DNA, 25 bp, Rattus norvegicus
acctgcagaatacgcgtggaggctg

SEQ ID NO: 536998 - DNA, 25 bp, Rattus norvegicus
gtggaggctgcctctcccttcatga

SEQ ID NO: 536999 - DNA, 25 bp, Rattus norvegicus
aggccaaggctgaggtgttcatgca

SEQ ID NO: 537000 - DNA, 25 bp, Rattus norvegicus
aagtcacacgaatgccaggccaagg

SEQ ID NO: 537001 - DNA, 25 bp, Rattus norvegicus
agcgtttcttcttgagcaagtcaca

SEQ ID NO: 537002 - DNA, 25 bp, Rattus norvegicus
gatgacgtggccctgggaaacttca

SEQ ID NO: 537003 - DNA, 25 bp, Rattus norvegicus
tggccgtctactttgaccgtgatga

SEQ ID NO: 537004 - DNA, 25 bp, Rattus norvegicus
atgtgtacatgtctatggccgtcta

SEQ ID NO: 537005 - DNA, 25 bp, Rattus norvegicus
cggctctatgcctcctatgtgtaca

SEQ ID NO: 537006 - DNA, 25 bp, Rattus norvegicus
acccatatccagctgcggctctatg

SEQ ID NO: 537007 - DNA, 25 bp, Rattus norvegicus
cgaggatgccgtcaacacccatatc

SEQ ID NO: 537008 - DNA, 25 bp, Rattus norvegicus
agaactatgactggcactgcgagga

SEQ ID NO: 537009 - DNA, 25 bp, Rattus norvegicus
cgccctctcaagtgcgacagaacta

SEQ ID NO: 537010 - DNA, 25 bp, Rattus norvegicus
tcccttcatgacatcgcgagaccgg

SEQ ID NO: 537011 - DNA, 25 bp, Rattus norvegicus
atttagtctcactgcggtctaccgc

SEQ ID NO: 537012 - DNA, 25 bp, Rattus norvegicus
cagttcgttcgcacttccgggaagc

SEQ ID NO: 537013 - DNA, 25 bp, Rattus norvegicus
ccgctctcctctgagtcgagtggca

SEQ ID NO: 537014 - DNA, 25 bp, Rattus norvegicus
aggctactgcaaatcttcccgaatc

SEQ ID NO: 537015 - DNA, 25 bp, Rattus norvegicus
cgcctgcagcaagaactggctctca

SEQ ID NO: 537016 - DNA, 25 bp, Rattus norvegicus
gccctgagactaaccgctgcttcga

SEQ ID NO: 537017 - DNA, 25 bp, Rattus norvegicus
gctggatcactctgctcggtcacgc

SEQ ID NO: 537018 - DNA, 25 bp, Rattus norvegicus
gcacgctcctcgctaccggaagtag

SEQ ID NO: 537019 - DNA, 25 bp, Rattus norvegicus
agctataggcctgtacggaccgtcc

SEQ ID NO: 537020 - DNA, 25 bp, Rattus norvegicus
aactggtttcgcacaggcaccgatg

SEQ ID NO: 537021 - DNA, 25 bp, Rattus norvegicus
caccgatggcttccggaaatgccta

SEQ ID NO: 537022 - DNA, 25 bp, Rattus norvegicus
gaaatgcctacggtctccggaaata

SEQ ID NO: 537023 - DNA, 25 bp, Rattus norvegicus
tgctgcgcacagctgatttagtctc

SEQ ID NO: 537024 - DNA, 25 bp, Rattus norvegicus
ttcacgtgtagcaccaccatggctg

SEQ ID NO: 537025 - DNA, 25 bp, Rattus norvegicus
gcagtcctgctcagaccactttatc

SEQ ID NO: 537026 - DNA, 25 bp, Rattus norvegicus
actttatctgcagctccgccaacgg

SEQ ID NO: 537027 - DNA, 25 bp, Rattus norvegicus
ctaggccgctcggttcggtcagtca

SEQ ID NO: 537028 - DNA, 25 bp, Rattus norvegicus
ggctacatactttgggcccggaagc

SEQ ID NO: 537029 - DNA, 25 bp, Rattus norvegicus
caggcggccagaaacgggctacata

SEQ ID NO: 537030 - DNA, 25 bp, Rattus norvegicus
cgtgtgcctgcgacacaacaggagc

SEQ ID NO: 537031 - DNA, 25 bp, Rattus norvegicus
aggccgctagctgactgggcctctg

SEQ ID NO: 537032 - DNA, 25 bp, Rattus norvegicus
cctaggaaggggaacagaaatgagt

SEQ ID NO: 537033 - DNA, 25 bp, Rattus norvegicus
tggcccataaagacggccctaggaa

SEQ ID NO: 537034 - DNA, 25 bp, Rattus norvegicus
tcgaaagaaggtggcccataaagac

SEQ ID NO: 537035 - DNA, 25 bp, Rattus norvegicus
gcacggttccgaggctccttcgaaa

SEQ ID NO: 537036 - DNA, 25 bp, Rattus norvegicus
cttcttctggctcgcacggttccga

SEQ ID NO: 537037 - DNA, 25 bp, Rattus norvegicus
gcagcaacgaggcttcttctggctc

SEQ ID NO: 537038 - DNA, 25 bp, Rattus norvegicus
aggggcaatggcagtcctgctcaga

SEQ ID NO: 537039 - DNA, 25 bp, Rattus norvegicus
tccgattggaggaactcaactgcta

SEQ ID NO: 537040 - DNA, 25 bp, Rattus norvegicus
ccgctcccgctttccgattggagga

SEQ ID NO: 537041 - DNA, 25 bp, Rattus norvegicus
gggagccactgctggtcccggcctt

SEQ ID NO: 537042 - DNA, 25 bp, Rattus norvegicus
cgaacgttccagagcgggaatggca

SEQ ID NO: 537043 - DNA, 25 bp, Rattus norvegicus
accacggcttcctttctgccaggta

SEQ ID NO: 537044 - DNA, 25 bp, Rattus norvegicus
cctttctgccaggtaggtctccagc

SEQ ID NO: 537045 - DNA, 25 bp, Rattus norvegicus
ctgccaggtaggtctccagcagtgt

SEQ ID NO: 537046 - DNA, 25 bp, Rattus norvegicus
aaagggcaccggtgaaccttctgtg

SEQ ID NO: 537047 - DNA, 25 bp, Rattus norvegicus
gtgaaccttctgtgcgccaacgtgc

SEQ ID NO: 537048 - DNA, 25 bp, Rattus norvegicus
gatgctcgggctcactcctcctggt

SEQ ID NO: 537049 - DNA, 25 bp, Rattus norvegicus
ttctgtgcgccaacgtgctccagcg

SEQ ID NO: 537050 - DNA, 25 bp, Rattus norvegicus
ggaggaactcaactgctagcccgcc

SEQ ID NO: 537051 - DNA, 25 bp, Rattus norvegicus
tgctgctcctcctcgcgatgctcgg

SEQ ID NO: 537052 - DNA, 25 bp, Rattus norvegicus
tggcaagtggcctgaaaagggcacc

SEQ ID NO: 537053 - DNA, 25 bp, Rattus norvegicus
ccggttgtccagacgacggaagact

SEQ ID NO: 537054 - DNA, 25 bp, Rattus norvegicus
acagcgttttgcctgcaagccctgc

SEQ ID NO: 537055 - DNA, 25 bp, Rattus norvegicus
tccacaacagcgttttgcctgcaag

SEQ ID NO: 537056 - DNA, 25 bp, Rattus norvegicus
gtgagtgccctcagccagctagctt

SEQ ID NO: 537057 - DNA, 25 bp, Rattus norvegicus
atcgcgccgccttgggtgagtgccc

SEQ ID NO: 537058 - DNA, 25 bp, Rattus norvegicus
gcaagccagtgttaggaagtcgccc

SEQ ID NO: 537059 - DNA, 25 bp, Rattus norvegicus
ggaaagtcgcaagccagtgttagga

SEQ ID NO: 537060 - DNA, 25 bp, Rattus norvegicus
ctattagggagcctgcaggtcttcc

SEQ ID NO: 537061 - DNA, 25 bp, Rattus norvegicus
aactggggctattagggagcctgca

SEQ ID NO: 537062 - DNA, 25 bp, Rattus norvegicus
cttcactattggtccgcttcatcgg

SEQ ID NO: 537063 - DNA, 25 bp, Rattus norvegicus
agccaccttttccacttcactattg

SEQ ID NO: 537064 - DNA, 25 bp, Rattus norvegicus
tcctattggcagaagccaccttttc

SEQ ID NO: 537065 - DNA, 25 bp, Rattus norvegicus
ctgcgacgtacggaggactcctatt

SEQ ID NO: 537066 - DNA, 25 bp, Rattus norvegicus
agacgacggaagactcgcccgctcg

SEQ ID NO: 537067 - DNA, 25 bp, Rattus norvegicus
ttcgagctcgcctgtttaacgcggc

SEQ ID NO: 537068 - DNA, 25 bp, Rattus norvegicus
tcatccgtcagcagaggcacgtggc

SEQ ID NO: 537069 - DNA, 25 bp, Rattus norvegicus
tgtcaccgggacagataagatagcg

SEQ ID NO: 537070 - DNA, 25 bp, Rattus norvegicus
gccgccctcttgtctttttcgagct

SEQ ID NO: 537071 - DNA, 25 bp, Rattus norvegicus
ttgatgtcagcacgctgtggcctcc

SEQ ID NO: 537072 - DNA, 25 bp, Rattus norvegicus
agcgggttctggaacgttgatgtca

SEQ ID NO: 537073 - DNA, 25 bp, Rattus norvegicus
gcccgcactatagggtgtaagctgg

SEQ ID NO: 537074 - DNA, 25 bp, Rattus norvegicus
ggcgcatgctcaaaggcgacctcca

SEQ ID NO: 537075 - DNA, 25 bp, Rattus norvegicus
ggttcccggcaagagcactctaggc

SEQ ID NO: 537076 - DNA, 25 bp, Rattus norvegicus
ggccgacactggtacacaggcagta

SEQ ID NO: 537077 - DNA, 25 bp, Rattus norvegicus
accagaccaggacaggcgggaccta

SEQ ID NO: 537078 - DNA, 25 bp, Rattus norvegicus
tccggaagtagactgccaaaacaac

SEQ ID NO: 537079 - DNA, 25 bp, Rattus norvegicus
gcggcggctcatgaatccggaagta

SEQ ID NO: 537080 - DNA, 25 bp, Rattus norvegicus
gcctcggacttagcgtgctcggcag

SEQ ID NO: 537081 - DNA, 25 bp, Rattus norvegicus
ttccaggctcgaaggcaaaaatctc

SEQ ID NO: 537082 - DNA, 25 bp, Rattus norvegicus
ccgccgacatgtaggcttgagctcc

SEQ ID NO: 537083 - DNA, 25 bp, Rattus norvegicus
ttctcccggttccttagagctcgtc

SEQ ID NO: 537084 - DNA, 25 bp, Rattus norvegicus
agagctcgtcgtctctgcagtcttc

SEQ ID NO: 537085 - DNA, 25 bp, Rattus norvegicus
tgtcgtcaccgctacgcacacttta

SEQ ID NO: 537086 - DNA, 25 bp, Rattus norvegicus
tcaaccaatgagcacgcacgccagg

SEQ ID NO: 537087 - DNA, 25 bp, Rattus norvegicus
atatcggctgtctcttcccacgtga

SEQ ID NO: 537088 - DNA, 25 bp, Rattus norvegicus
cgccatcttgttctgcggggaaaga

SEQ ID NO: 537089 - DNA, 25 bp, Rattus norvegicus
taggcctgcgcgaccatacaaaatg

SEQ ID NO: 537090 - DNA, 25 bp, Rattus norvegicus
taggcatgcgcggtagtaatcatca

SEQ ID NO: 537091 - DNA, 25 bp, Rattus norvegicus
catcaaatggcggatgggctcaccc

SEQ ID NO: 537092 - DNA, 25 bp, Rattus norvegicus
gggaccatgcgccaacctatatcgg

SEQ ID NO: 537093 - DNA, 25 bp, Rattus norvegicus
gtgcgtttatcttgcccagtgatca

SEQ ID NO: 537094 - DNA, 25 bp, Rattus norvegicus
gcacactttatcaggcgtcttcccg

SEQ ID NO: 537095 - DNA, 25 bp, Rattus norvegicus
cactctctgagccgggcagtgctcg

SEQ ID NO: 537096 - DNA, 25 bp, Rattus norvegicus
accccccagcactgcgtcggcagta

SEQ ID NO: 537097 - DNA, 25 bp, Rattus norvegicus
ccccccagcactgcgtcggcagtac

SEQ ID NO: 537098 - DNA, 25 bp, Rattus norvegicus
ggccactctctgagccgggcagtgc

SEQ ID NO: 537099 - DNA, 25 bp, Rattus norvegicus
gccactctctgagccgggcagtgct

SEQ ID NO: 537100 - DNA, 25 bp, Rattus norvegicus
gcaccccccagcactgcgtcggcag

SEQ ID NO: 537101 - DNA, 25 bp, Rattus norvegicus
actctctgagccgggcagtgctcgt

SEQ ID NO: 537102 - DNA, 25 bp, Rattus norvegicus
ctctctgagccgggcagtgctcgtg

SEQ ID NO: 537103 - DNA, 25 bp, Rattus norvegicus
tctctgagccgggcagtgctcgtgc

SEQ ID NO: 537104 - DNA, 25 bp, Rattus norvegicus
ctctgagccgggcagtgctcgtgcc

SEQ ID NO: 537105 - DNA, 25 bp, Rattus norvegicus
ctgagccgggcagtgctcgtgccta

SEQ ID NO: 537106 - DNA, 25 bp, Rattus norvegicus
ggcaccccccagcactgcgtcggca

SEQ ID NO: 537107 - DNA, 25 bp, Rattus norvegicus
tgagccgggcagtgctcgtgcctat

SEQ ID NO: 537108 - DNA, 25 bp, Rattus norvegicus
tctgagccgggcagtgctcgtgcct

SEQ ID NO: 537109 - DNA, 25 bp, Rattus norvegicus
gtccacctccctcgatgccaccatg

SEQ ID NO: 537110 - DNA, 25 bp, Rattus norvegicus
gcagcatctccctgtgccagctggt

SEQ ID NO: 537111 - DNA, 25 bp, Rattus norvegicus
tggtccctctccaatgacatcctcg

SEQ ID NO: 537112 - DNA, 25 bp, Rattus norvegicus
tgctccatgtgctacggggccacac

SEQ ID NO: 537113 - DNA, 25 bp, Rattus norvegicus
cactgtgctccatgtgctacggggc

SEQ ID NO: 537114 - DNA, 25 bp, Rattus norvegicus
atcctcgtgtccacctccctcgatg

SEQ ID NO: 537115 - DNA, 25 bp, Rattus norvegicus
acccactgtgctccatgtgctacgg

SEQ ID NO: 537116 - DNA, 25 bp, Rattus norvegicus
atctgggcctccgaagacggccgct

SEQ ID NO: 537117 - DNA, 25 bp, Rattus norvegicus
aagacggccgctgcatccgtgagat

SEQ ID NO: 537118 - DNA, 25 bp, Rattus norvegicus
gccgctgcatccgtgagatccctga

SEQ ID NO: 537119 - DNA, 25 bp, Rattus norvegicus
atctccctgtgccagctggtgcctg

SEQ ID NO: 537120 - DNA, 25 bp, Rattus norvegicus
gggcctccgaagacggccgctgcat

SEQ ID NO: 537121 - DNA, 25 bp, Rattus norvegicus
agcatctccctgtgccagctggtgc

SEQ ID NO: 537122 - DNA, 25 bp, Rattus norvegicus
tgacgaccggcaccgcctggcctgc

SEQ ID NO: 537123 - DNA, 25 bp, Rattus norvegicus
tgaggaacggccaatagactgcgcg

SEQ ID NO: 537124 - DNA, 25 bp, Rattus norvegicus
ctgtggagaaagatggcggaaaatt

SEQ ID NO: 537125 - DNA, 25 bp, Rattus norvegicus
tagagacgcaagctactggcccggc

SEQ ID NO: 537126 - DNA, 25 bp, Rattus norvegicus
ataaaagcagcaggcacgggcgctc

SEQ ID NO: 537127 - DNA, 25 bp, Rattus norvegicus
gcgcaggcgcatgctgaataaaagc

SEQ ID NO: 537128 - DNA, 25 bp, Rattus norvegicus
ggctctcagtgaccgttaccctttc

SEQ ID NO: 537129 - DNA, 25 bp, Rattus norvegicus
caggcgcagcacattgaataaaagc

SEQ ID NO: 537130 - DNA, 25 bp, Rattus norvegicus
cctacgcgcgtgagagagtcctgaa

SEQ ID NO: 537131 - DNA, 25 bp, Rattus norvegicus
tcctgaagagaaggttgcggccacg

SEQ ID NO: 537132 - DNA, 25 bp, Rattus norvegicus
tgaataaaagcagcgagcaccggcg

SEQ ID NO: 537133 - DNA, 25 bp, Rattus norvegicus
acgggaggagtccagtcacagctcc

SEQ ID NO: 537134 - DNA, 25 bp, Rattus norvegicus
tctcttctcgcgaggccttttaggc

SEQ ID NO: 537135 - DNA, 25 bp, Rattus norvegicus
ttaggcccgaatgtcgttagctgtg

SEQ ID NO: 537136 - DNA, 25 bp, Rattus norvegicus
cggcgctcgagaccactcctggtga

SEQ ID NO: 537137 - DNA, 25 bp, Rattus norvegicus
tgctcagtaagtagggacaaaacga

SEQ ID NO: 537138 - DNA, 25 bp, Rattus norvegicus
aggtgtggtttgcacccgaagcgtt

SEQ ID NO: 537139 - DNA, 25 bp, Rattus norvegicus
tagaacaccacgcaggcgcagtagg

SEQ ID NO: 537140 - DNA, 25 bp, Rattus norvegicus
ggcagcagcaatccgaaccacagca

SEQ ID NO: 537141 - DNA, 25 bp, Rattus norvegicus
gatgcgaatccgtaggtcttctagg

SEQ ID NO: 537142 - DNA, 25 bp, Rattus norvegicus
tgctccacacaacacaactgatgcg

SEQ ID NO: 537143 - DNA, 25 bp, Rattus norvegicus
ggagcagacgtctcttccaaacatc

SEQ ID NO: 537144 - DNA, 25 bp, Rattus norvegicus
ctcaggaatcttgggagcagacgtc

SEQ ID NO: 537145 - DNA, 25 bp, Rattus norvegicus
gcgcgagctacgtcatcgccaaacg

SEQ ID NO: 537146 - DNA, 25 bp, Rattus norvegicus
tgtgggcggactagatcagttttgt

SEQ ID NO: 537147 - DNA, 25 bp, Rattus norvegicus
ggccacacaggtcgccgggaatttg

SEQ ID NO: 537148 - DNA, 25 bp, Rattus norvegicus
tctcgaacctgggagtagaacacca

SEQ ID NO: 537149 - DNA, 25 bp, Rattus norvegicus
atctcgaactagtcacccgctggcg

SEQ ID NO: 537150 - DNA, 25 bp, Rattus norvegicus
cctggaattgagaatggcggcagca

SEQ ID NO: 537151 - DNA, 25 bp, Rattus norvegicus
agggatcacgatgcgcctcctctct

SEQ ID NO: 537152 - DNA, 25 bp, Rattus norvegicus
cgtcacttgtcctgagggatcacga

SEQ ID NO: 537153 - DNA, 25 bp, Rattus norvegicus
attgtcggtccagtcgtcacttgtc

SEQ ID NO: 537154 - DNA, 25 bp, Rattus norvegicus
ggtgttcgttggaattgtcggtcca

SEQ ID NO: 537155 - DNA, 25 bp, Rattus norvegicus
ctttctcagggctgtgagggtgttc

SEQ ID NO: 537156 - DNA, 25 bp, Rattus norvegicus
cgcccgtgctttcgctttctcaggg

SEQ ID NO: 537157 - DNA, 25 bp, Rattus norvegicus
cctctggtcggtggtcgcccgtgct

SEQ ID NO: 537158 - DNA, 25 bp, Rattus norvegicus
gagtccgggcttctgcggtgcctct

SEQ ID NO: 537159 - DNA, 25 bp, Rattus norvegicus
tccagctgaagcagcgagtccgggc

SEQ ID NO: 537160 - DNA, 25 bp, Rattus norvegicus
ccctggtcttatgactccagctgaa

SEQ ID NO: 537161 - DNA, 25 bp, Rattus norvegicus
tctctccggttacgggctcgaagct

SEQ ID NO: 537162 - DNA, 25 bp, Rattus norvegicus
attggctgaaaggaataaagagccc

SEQ ID NO: 537163 - DNA, 25 bp, Rattus norvegicus
caaacacgctgattggctgaaagga

SEQ ID NO: 537164 - DNA, 25 bp, Rattus norvegicus
ctcgctctgctttcaaacacgctga

SEQ ID NO: 537165 - DNA, 25 bp, Rattus norvegicus
gcccgtgttgattcgtgcttgagtc

SEQ ID NO: 537166 - DNA, 25 bp, Rattus norvegicus
cagggtccgtgaagcctcggtcacc

SEQ ID NO: 537167 - DNA, 25 bp, Rattus norvegicus
atgcgaccagggtccgtgaagcctc

SEQ ID NO: 537168 - DNA, 25 bp, Rattus norvegicus
cacctagtttttgcggccgatgcga

SEQ ID NO: 537169 - DNA, 25 bp, Rattus norvegicus
ggaaggattatcacaccgcggactc

SEQ ID NO: 537170 - DNA, 25 bp, Rattus norvegicus
gcgtttgctggccacctagtttttg

SEQ ID NO: 537171 - DNA, 25 bp, Rattus norvegicus
gcccgctgggtgacagccgctgtca

SEQ ID NO: 537172 - DNA, 25 bp, Rattus norvegicus
gtgctgactgggttctttcccgccc

SEQ ID NO: 537173 - DNA, 25 bp, Rattus norvegicus
cctccattacgcacctcaagagatg

SEQ ID NO: 537174 - DNA, 25 bp, Rattus norvegicus
tcaccgtgacaaatagatcccaccg

SEQ ID NO: 537175 - DNA, 25 bp, Rattus norvegicus
gcagggaaagccacacaggtgaccg

SEQ ID NO: 537176 - DNA, 25 bp, Rattus norvegicus
cgtcactcaggcagttcccgggcgg

SEQ ID NO: 537177 - DNA, 25 bp, Rattus norvegicus
cttgagtcgggcatcaggaccaccc

SEQ ID NO: 537178 - DNA, 25 bp, Rattus norvegicus
tgtccagtcacgaagctcaccgtga

SEQ ID NO: 537179 - DNA, 25 bp, Rattus norvegicus
ggcgtgcagaatgtagtagcgctca

SEQ ID NO: 537180 - DNA, 25 bp, Rattus norvegicus
caggaggcacctcgggacccaaatc

SEQ ID NO: 537181 - DNA, 25 bp, Rattus norvegicus
ctcaggaggcacctcgggacccaaa

SEQ ID NO: 537182 - DNA, 25 bp, Rattus norvegicus
cccagtacgttctcaggaggcacct

SEQ ID NO: 537183 - DNA, 25 bp, Rattus norvegicus
tgacgcgtagcagagcccccagtac

SEQ ID NO: 537184 - DNA, 25 bp, Rattus norvegicus
cgagacgtttgacgcgtagcagagc

SEQ ID NO: 537185 - DNA, 25 bp, Rattus norvegicus
ttctcgagacgtttgacgcgtagca

SEQ ID NO: 537186 - DNA, 25 bp, Rattus norvegicus
gagttctcgagacgtttgacgcgta

SEQ ID NO: 537187 - DNA, 25 bp, Rattus norvegicus
tgcagaatgtagtagcgctcaggga

SEQ ID NO: 537188 - DNA, 25 bp, Rattus norvegicus
caaatcctggtccacagctcggcgg

SEQ ID NO: 537189 - DNA, 25 bp, Rattus norvegicus
ttccagggcgtgcagaatgtagtag

SEQ ID NO: 537190 - DNA, 25 bp, Rattus norvegicus
ctcctgggttccagggcgtgcagaa

SEQ ID NO: 537191 - DNA, 25 bp, Rattus norvegicus
gtaagcagccgtggacgtgctggca

SEQ ID NO: 537192 - DNA, 25 bp, Rattus norvegicus
cgaggagttctcgagacgtttgacg

SEQ ID NO: 537193 - DNA, 25 bp, Rattus norvegicus
atgctgcgctcagactgcggggttc

SEQ ID NO: 537194 - DNA, 25 bp, Rattus norvegicus
gctcctgtctctcggcctccagcag

SEQ ID NO: 537195 - DNA, 25 bp, Rattus norvegicus
tgcgctcagactgcggggttcctgc

SEQ ID NO: 537196 - DNA, 25 bp, Rattus norvegicus
tctcagccaagggcgcggatgctgc

SEQ ID NO: 537197 - DNA, 25 bp, Rattus norvegicus
gagtgctcgtctcagccaagggcgc

SEQ ID NO: 537198 - DNA, 25 bp, Rattus norvegicus
cacggcccgacgcaagcggagggga

SEQ ID NO: 537199 - DNA, 25 bp, Rattus norvegicus
cgccgcctctcctcggggcacggcc

SEQ ID NO: 537200 - DNA, 25 bp, Rattus norvegicus
cgcctcctgcgcctcagcacgctcg

SEQ ID NO: 537201 - DNA, 25 bp, Rattus norvegicus
acccgtgcctgctgatcctccgcct

SEQ ID NO: 537202 - DNA, 25 bp, Rattus norvegicus
gtgccaggacccgtgcctgctgatc

SEQ ID NO: 537203 - DNA, 25 bp, Rattus norvegicus
gcgtccgggtcgtcatccggggcca

SEQ ID NO: 537204 - DNA, 25 bp, Rattus norvegicus
gcgagctgtgcagcgggagcgtccg

SEQ ID NO: 537205 - DNA, 25 bp, Rattus norvegicus
agctcggagcagagcacgggcgagc

SEQ ID NO: 537206 - DNA, 25 bp, Rattus norvegicus
cctcagcacgctcgcgctcctgtct

SEQ ID NO: 537207 - DNA, 25 bp, Rattus norvegicus
tgtgcccatcgtcgtaccaaggttc

SEQ ID NO: 537208 - DNA, 25 bp, Rattus norvegicus
gactgtcctgaagcctgtgcccatc

SEQ ID NO: 537209 - DNA, 25 bp, Rattus norvegicus
cgtcgtaccaaggttcgcgagcgta

SEQ ID NO: 537210 - DNA, 25 bp, Rattus norvegicus
ttcgcgagcgtactcctccatggcg

SEQ ID NO: 537211 - DNA, 25 bp, Rattus norvegicus
cgctaaggcgccctgcgtagaccag

SEQ ID NO: 537212 - DNA, 25 bp, Rattus norvegicus
gcgccctgcgtagaccagggaaaca

SEQ ID NO: 537213 - DNA, 25 bp, Rattus norvegicus
caattggcttttccctgcttacgta

SEQ ID NO: 537214 - DNA, 25 bp, Rattus norvegicus
tttccctgcttacgtaaggccagtg

SEQ ID NO: 537215 - DNA, 25 bp, Rattus norvegicus
ctgcttacgtaaggccagtggcgcg

SEQ ID NO: 537216 - DNA, 25 bp, Rattus norvegicus
cagtggcgcgctcttattggatagc

SEQ ID NO: 537217 - DNA, 25 bp, Rattus norvegicus
cgcgctcttattggatagccaggtg

SEQ ID NO: 537218 - DNA, 25 bp, Rattus norvegicus
ttattggatagccaggtgggtcaca

SEQ ID NO: 537219 - DNA, 25 bp, Rattus norvegicus
tgtcgcgcggactgtcctgaagcct

SEQ ID NO: 537220 - DNA, 25 bp, Rattus norvegicus
accaaggttcgcgagcgtactcctc

SEQ ID NO: 537221 - DNA, 25 bp, Rattus norvegicus
ctctcttacctacaatttgcccaga

SEQ ID NO: 537222 - DNA, 25 bp, Rattus norvegicus
ggggagctctcttacctacaatttg

SEQ ID NO: 537223 - DNA, 25 bp, Rattus norvegicus
acagactacctgaagggcccgccag

SEQ ID NO: 537224 - DNA, 25 bp, Rattus norvegicus
agacccgccctgatgtccgttagcg

SEQ ID NO: 537225 - DNA, 25 bp, Rattus norvegicus
cgcagacaggttttctcacggagac

SEQ ID NO: 537226 - DNA, 25 bp, Rattus norvegicus
gccctgatgtccgttagcgttctcg

SEQ ID NO: 537227 - DNA, 25 bp, Rattus norvegicus
cacgggccggcacagactacctgaa

SEQ ID NO: 537228 - DNA, 25 bp, Rattus norvegicus
tcacggagacgcaaacccgctactg

SEQ ID NO: 537229 - DNA, 25 bp, Rattus norvegicus
ttacaggcccactaatttgcacagc

SEQ ID NO: 537230 - DNA, 25 bp, Rattus norvegicus
tttgcacagccgcagacaggttttc

SEQ ID NO: 537231 - DNA, 25 bp, Rattus norvegicus
tcaggtggggtcctttacaggccca

SEQ ID NO: 537232 - DNA, 25 bp, Rattus norvegicus
gaccggaacgggcagcgattgccac

SEQ ID NO: 537233 - DNA, 25 bp, Rattus norvegicus
acgggcagcgattgccacgagtctc

SEQ ID NO: 537234 - DNA, 25 bp, Rattus norvegicus
gcgattgccacgagtctcgctgcct

SEQ ID NO: 537235 - DNA, 25 bp, Rattus norvegicus
tccgagccagtccttatttgcatgc

SEQ ID NO: 537236 - DNA, 25 bp, Rattus norvegicus
aatacatgccaggttcttccgcgga

SEQ ID NO: 537237 - DNA, 25 bp, Rattus norvegicus
tatgcaaatgtagcagggtgcgcgc

SEQ ID NO: 537238 - DNA, 25 bp, Rattus norvegicus
tgcatgccaccctcaacgtttcaag

SEQ ID NO: 537239 - DNA, 25 bp, Rattus norvegicus
gcccacctggctttgatcaatccgg

SEQ ID NO: 537240 - DNA, 25 bp, Rattus norvegicus
gccaagtcggtattcggcctcgaaa

SEQ ID NO: 537241 - DNA, 25 bp, Rattus norvegicus
ggcctcgaaagctgcccgatccttg

SEQ ID NO: 537242 - DNA, 25 bp, Rattus norvegicus
cggtgtactctgatcccagccgtga

SEQ ID NO: 537243 - DNA, 25 bp, Rattus norvegicus
cacccaacctgcttgtgacagagga

SEQ ID NO: 537244 - DNA, 25 bp, Rattus norvegicus
gcgttaagattcgtcgcgcgcgcca

SEQ ID NO: 537245 - DNA, 25 bp, Rattus norvegicus
attgagcccgctgaatccgctgagc

SEQ ID NO: 537246 - DNA, 25 bp, Rattus norvegicus
tgcagacggcgcagcgttaagattc

SEQ ID NO: 537247 - DNA, 25 bp, Rattus norvegicus
gaagacggtgccaaagcctccctta

SEQ ID NO: 537248 - DNA, 25 bp, Rattus norvegicus
ttgatcaatccggacgcggcacctg

SEQ ID NO: 537249 - DNA, 25 bp, Rattus norvegicus
gtgcgtaaagccttgacaacaccca

SEQ ID NO: 537250 - DNA, 25 bp, Rattus norvegicus
ccgggattcagcttctgaggaaaca

SEQ ID NO: 537251 - DNA, 25 bp, Rattus norvegicus
caatccgggttgagcgctcactctc

SEQ ID NO: 537252 - DNA, 25 bp, Rattus norvegicus
agcttactgctaccttgttccggga

SEQ ID NO: 537253 - DNA, 25 bp, Rattus norvegicus
gtcgtagcctattctccctccaagt

SEQ ID NO: 537254 - DNA, 25 bp, Rattus norvegicus
cagtaagcaagtcacgcccagagga

SEQ ID NO: 537255 - DNA, 25 bp, Rattus norvegicus
gttcgagaaccgcaggcagtaagca

SEQ ID NO: 537256 - DNA, 25 bp, Rattus norvegicus
gcctggataaagagatcgggacacc

SEQ ID NO: 537257 - DNA, 25 bp, Rattus norvegicus
ggagaatagtcatggcggcaccgcc

SEQ ID NO: 537258 - DNA, 25 bp, Rattus norvegicus
acggctagtgcccaacgatgaagag

SEQ ID NO: 537259 - DNA, 25 bp, Rattus norvegicus
ccgcagttgtcgcaccaagagcgtc

SEQ ID NO: 537260 - DNA, 25 bp, Rattus norvegicus
gcagacaccagccaattgaagaagt

SEQ ID NO: 537261 - DNA, 25 bp, Rattus norvegicus
ctcggaagtacgtgggcaaaatgct

SEQ ID NO: 537262 - DNA, 25 bp, Rattus norvegicus
ccgcaggttcttgaactaccgggtg

SEQ ID NO: 537263 - DNA, 25 bp, Rattus norvegicus
gatgggccgtgagtcatcacccgcc

SEQ ID NO: 537264 - DNA, 25 bp, Rattus norvegicus
atcacccgccctgaacggaccgaca

SEQ ID NO: 537265 - DNA, 25 bp, Rattus norvegicus
ccgcacctgagcagctgggccgagt

SEQ ID NO: 537266 - DNA, 25 bp, Rattus norvegicus
acctgagcagctgggccgagtcagc

SEQ ID NO: 537267 - DNA, 25 bp, Rattus norvegicus
agtcagctggcctgcgctcttccaa

SEQ ID NO: 537268 - DNA, 25 bp, Rattus norvegicus
ttccaacagcacgaacacggctcga

SEQ ID NO: 537269 - DNA, 25 bp, Rattus norvegicus
acagcacgaacacggctcgagggcc

SEQ ID NO: 537270 - DNA, 25 bp, Rattus norvegicus
tacgccgtcccgagctgtctcagtt

SEQ ID NO: 537271 - DNA, 25 bp, Rattus norvegicus
cccgagctgtctcagttgcatgaga

SEQ ID NO: 537272 - DNA, 25 bp, Rattus norvegicus
ttgcatgagacatgacgcccggccc

SEQ ID NO: 537273 - DNA, 25 bp, Rattus norvegicus
gctgcctcctccgttaagccatgga

SEQ ID NO: 537274 - DNA, 25 bp, Rattus norvegicus
tccgttaagccatggagctagctct

SEQ ID NO: 537275 - DNA, 25 bp, Rattus norvegicus
taagccatggagctagctctgcgtg

SEQ ID NO: 537276 - DNA, 25 bp, Rattus norvegicus
atgggatgggccgtgagtcatcacc

SEQ ID NO: 537277 - DNA, 25 bp, Rattus norvegicus
ctagatccctttgggcctctacgga

SEQ ID NO: 537278 - DNA, 25 bp, Rattus norvegicus
tgcttgcggtcaaacgcggcccaga

SEQ ID NO: 537279 - DNA, 25 bp, Rattus norvegicus
cgaacgcttgtgcttgcggtcaaac

SEQ ID NO: 537280 - DNA, 25 bp, Rattus norvegicus
atctgctcctgaaggcgaacgcttg

SEQ ID NO: 537281 - DNA, 25 bp, Rattus norvegicus
gccagaaacggacgtcctgagttaa

SEQ ID NO: 537282 - DNA, 25 bp, Rattus norvegicus
gaaggcgcgcccactagatcccttt

SEQ ID NO: 537283 - DNA, 25 bp, Rattus norvegicus
aacctaagacccaagctggcgcctg

SEQ ID NO: 537284 - DNA, 25 bp, Rattus norvegicus
gtgctaggaccctcggtgagtaacc

SEQ ID NO: 537285 - DNA, 25 bp, Rattus norvegicus
gtgagtaaccgttcctgccaggaga

SEQ ID NO: 537286 - DNA, 25 bp, Rattus norvegicus
gggacgagtcctggaaacgcccaca

SEQ ID NO: 537287 - DNA, 25 bp, Rattus norvegicus
gcccacaatgatggacctgcgcgcg

SEQ ID NO: 537288 - DNA, 25 bp, Rattus norvegicus
ttctggtgctcccaaagcaggaaaa

SEQ ID NO: 537289 - DNA, 25 bp, Rattus norvegicus
cccgcttcttcttcgtttctggtgc

SEQ ID NO: 537290 - DNA, 25 bp, Rattus norvegicus
cctaggttcgcgctcagcagcggag

SEQ ID NO: 537291 - DNA, 25 bp, Rattus norvegicus
aagtggaccgttccaagatggccgc

SEQ ID NO: 537292 - DNA, 25 bp, Rattus norvegicus
gccgactcgatcctgccatccgcca

SEQ ID NO: 537293 - DNA, 25 bp, Rattus norvegicus
ctcgatcctgccatccgccagagtc

SEQ ID NO: 537294 - DNA, 25 bp, Rattus norvegicus
gatcctgccatccgccagagtcaaa

SEQ ID NO: 537295 - DNA, 25 bp, Rattus norvegicus
cgtttggggccaggcgccgcttcct

SEQ ID NO: 537296 - DNA, 25 bp, Rattus norvegicus
cccatcaacaagtggaccgttccaa

SEQ ID NO: 537297 - DNA, 25 bp, Rattus norvegicus
catcaacaagtggaccgttccaaga

SEQ ID NO: 537298 - DNA, 25 bp, Rattus norvegicus
tcaacaagtggaccgttccaagatg

SEQ ID NO: 537299 - DNA, 25 bp, Rattus norvegicus
acaagtggaccgttccaagatggcc

SEQ ID NO: 537300 - DNA, 25 bp, Rattus norvegicus
ggctccgctcccgatctccccccca

SEQ ID NO: 537301 - DNA, 25 bp, Rattus norvegicus
cgacacccctgtggttcagtccggg

SEQ ID NO: 537302 - DNA, 25 bp, Rattus norvegicus
gcggccgtgcttgtgccgggccgca

SEQ ID NO: 537303 - DNA, 25 bp, Rattus norvegicus
cgcaggggctgagacgtgggcgccc

SEQ ID NO: 537304 - DNA, 25 bp, Rattus norvegicus
aacaagtggaccgttccaagatggc

SEQ ID NO: 537305 - DNA, 25 bp, Rattus norvegicus
tgctgcaatacgtcggctgagctta

SEQ ID NO: 537306 - DNA, 25 bp, Rattus norvegicus
agccgttacgtgtggaagcctccca

SEQ ID NO: 537307 - DNA, 25 bp, Rattus norvegicus
ccacaggtcacaaagaggatcatcg

SEQ ID NO: 537308 - DNA, 25 bp, Rattus norvegicus
ccacgcagcgcttgcagggtaaaca

SEQ ID NO: 537309 - DNA, 25 bp, Rattus norvegicus
ctcctcgtcctggaagctcagcagg

SEQ ID NO: 537310 - DNA, 25 bp, Rattus norvegicus
gctgagcttacaccgagccgttacg

SEQ ID NO: 537311 - DNA, 25 bp, Rattus norvegicus
gtcgctgagcgtgttgctgcaatac

SEQ ID NO: 537312 - DNA, 25 bp, Rattus norvegicus
ctccagagttgttccacaggtcaca

SEQ ID NO: 537313 - DNA, 25 bp, Rattus norvegicus
cggagtctctttgcactgccctcta

SEQ ID NO: 537314 - DNA, 25 bp, Rattus norvegicus
cggctctagctaggtacggcgcaac

SEQ ID NO: 537315 - DNA, 25 bp, Rattus norvegicus
tttcacagccgctcgcagactgaga

SEQ ID NO: 537316 - DNA, 25 bp, Rattus norvegicus
gagtcattccgcttgcgcacgttca

SEQ ID NO: 537317 - DNA, 25 bp, Rattus norvegicus
gggcacctctttgttctcgcgaggc

SEQ ID NO: 537318 - DNA, 25 bp, Rattus norvegicus
acggaaccctccgactccagagttg

SEQ ID NO: 537319 - DNA, 25 bp, Rattus norvegicus
atgagacacggctgatggggtttcc

SEQ ID NO: 537320 - DNA, 25 bp, Rattus norvegicus
taccgtagtgctggacgacgtggag

SEQ ID NO: 537321 - DNA, 25 bp, Rattus norvegicus
tgacttggcccgggtgatgagacac

SEQ ID NO: 537322 - DNA, 25 bp, Rattus norvegicus
tgccggagcacagctaaaggggtcc

SEQ ID NO: 537323 - DNA, 25 bp, Rattus norvegicus
ccgcgggtgccggagcacagctaaa

SEQ ID NO: 537324 - DNA, 25 bp, Rattus norvegicus
gctgatggggtctctgttggtgacc

SEQ ID NO: 537325 - DNA, 25 bp, Rattus norvegicus
acgaggtgaaattcgggctgcgagc

SEQ ID NO: 537326 - DNA, 25 bp, Rattus norvegicus
ttcctggacgacgaggtgaaattcg

SEQ ID NO: 537327 - DNA, 25 bp, Rattus norvegicus
tacttggacttcctggacgacgagg

SEQ ID NO: 537328 - DNA, 25 bp, Rattus norvegicus
gagactacttggacttcctggacga

SEQ ID NO: 537329 - DNA, 25 bp, Rattus norvegicus
tgcgcgaagcgcagagagactactt

SEQ ID NO: 537330 - DNA, 25 bp, Rattus norvegicus
cagggaggagtcacacacgttttta

SEQ ID NO: 537331 - DNA, 25 bp, Rattus norvegicus
aagttttcgcgccagggaggagtca

SEQ ID NO: 537332 - DNA, 25 bp, Rattus norvegicus
gcgcagagagactacttggacttcc

SEQ ID NO: 537333 - DNA, 25 bp, Rattus norvegicus
gcgccagcaaggagcagcagattcc

SEQ ID NO: 537334 - DNA, 25 bp, Rattus norvegicus
cctcccgctacgagtgcgcagcgcc

SEQ ID NO: 537335 - DNA, 25 bp, Rattus norvegicus
tcggcctcactctggcctcccgcta

SEQ ID NO: 537336 - DNA, 25 bp, Rattus norvegicus
gtagtcaacctccaactggctcggc

SEQ ID NO: 537337 - DNA, 25 bp, Rattus norvegicus
ggcaggcgccgtagtcaacctccaa

SEQ ID NO: 537338 - DNA, 25 bp, Rattus norvegicus
tttttagcccttggcaggcgccgta

SEQ ID NO: 537339 - DNA, 25 bp, Rattus norvegicus
aggagctttttagcccttggcaggc

SEQ ID NO: 537340 - DNA, 25 bp, Rattus norvegicus
cccgcccactctacgaggccacacc

SEQ ID NO: 537341 - DNA, 25 bp, Rattus norvegicus
tccggctcagggtagcgcactggaa

SEQ ID NO: 537342 - DNA, 25 bp, Rattus norvegicus
ggaacagcgagaacctcaccgcacg

SEQ ID NO: 537343 - DNA, 25 bp, Rattus norvegicus
attccacctccggaacagcgagaac

SEQ ID NO: 537344 - DNA, 25 bp, Rattus norvegicus
gcagattccacctccggaacagcga

SEQ ID NO: 537345 - DNA, 25 bp, Rattus norvegicus
gagcagcagattccacctccggaac

SEQ ID NO: 537346 - DNA, 25 bp, Rattus norvegicus
ccagcaaggagcagcagattccacc

SEQ ID NO: 537347 - DNA, 25 bp, Rattus norvegicus
aaatctaggggccactcagtatcca

SEQ ID NO: 537348 - DNA, 25 bp, Rattus norvegicus
gccagcgggtcctggctgcttcctg

SEQ ID NO: 537349 - DNA, 25 bp, Rattus norvegicus
ctgcccagccagacagtccagtgga

SEQ ID NO: 537350 - DNA, 25 bp, Rattus norvegicus
tggtcgagcactggaaaccactgcc

SEQ ID NO: 537351 - DNA, 25 bp, Rattus norvegicus
ttccgggtggtcgagcactggaaac

SEQ ID NO: 537352 - DNA, 25 bp, Rattus norvegicus
tggacgggtttctgccattccactc

SEQ ID NO: 537353 - DNA, 25 bp, Rattus norvegicus
gctgcaccctcttgctcaccaactg

SEQ ID NO: 537354 - DNA, 25 bp, Rattus norvegicus
tgcaaataaatctaggggccactca

SEQ ID NO: 537355 - DNA, 25 bp, Rattus norvegicus
cctccttttgaagtgcaaataaatc

SEQ ID NO: 537356 - DNA, 25 bp, Rattus norvegicus
gtccagcctccttttgaagtgcaaa

SEQ ID NO: 537357 - DNA, 25 bp, Rattus norvegicus
gcactgtccagcctccttttgaagt

SEQ ID NO: 537358 - DNA, 25 bp, Rattus norvegicus
tccactggcgtcagaaaagggagga

SEQ ID NO: 537359 - DNA, 25 bp, Rattus norvegicus
ctcccattccactggcgtcagaaaa

SEQ ID NO: 537360 - DNA, 25 bp, Rattus norvegicus
aggactggacgggtttctgccattc

SEQ ID NO: 537361 - DNA, 25 bp, Rattus norvegicus
gagcaaaggccggcccttacacgca

SEQ ID NO: 537362 - DNA, 25 bp, Rattus norvegicus
gcaagccaggaactcccggagcccg

SEQ ID NO: 537363 - DNA, 25 bp, Rattus norvegicus
ggaatcggtgggaggtctgcgccct

SEQ ID NO: 537364 - DNA, 25 bp, Rattus norvegicus
tcttccgttttgaaggaggacgcca

SEQ ID NO: 537365 - DNA, 25 bp, Rattus norvegicus
agagtccgccccagccggtttggca

SEQ ID NO: 537366 - DNA, 25 bp, Rattus norvegicus
cgaaggcaacacaaaggagagggaa

SEQ ID NO: 537367 - DNA, 25 bp, Rattus norvegicus
ttgtgcgaaggcaacacaaaggaga

SEQ ID NO: 537368 - DNA, 25 bp, Rattus norvegicus
ggccttttgtgcgaaggcaacacaa

SEQ ID NO: 537369 - DNA, 25 bp, Rattus norvegicus
agccggtttggcactggctcctcct

SEQ ID NO: 537370 - DNA, 25 bp, Rattus norvegicus
acgcacccggccttttgtgcgaagg

SEQ ID NO: 537371 - DNA, 25 bp, Rattus norvegicus
cggtttggcactggctcctcctggg

SEQ ID NO: 537372 - DNA, 25 bp, Rattus norvegicus
tccgttttgaaggaggacgccaggc

SEQ ID NO: 537373 - DNA, 25 bp, Rattus norvegicus
cgttttgaaggaggacgccaggcaa

SEQ ID NO: 537374 - DNA, 25 bp, Rattus norvegicus
cccggccttttgtgcgaaggcaaca

SEQ ID NO: 537375 - DNA, 25 bp, Rattus norvegicus
ttatgggtcatcctcgtaaccgttg

SEQ ID NO: 537376 - DNA, 25 bp, Rattus norvegicus
acacgcggattggaaaacaatgccc

SEQ ID NO: 537377 - DNA, 25 bp, Rattus norvegicus
gcggttcgccgctgaaggcccaaga

SEQ ID NO: 537378 - DNA, 25 bp, Rattus norvegicus
tgaaggcccaagagcggttctcaca

SEQ ID NO: 537379 - DNA, 25 bp, Rattus norvegicus
agagcggttctcacatgcccaagct

SEQ ID NO: 537380 - DNA, 25 bp, Rattus norvegicus
tctgctaattgaacggttatgggtc

SEQ ID NO: 537381 - DNA, 25 bp, Rattus norvegicus
cagctgggaaacacgcggattggaa

SEQ ID NO: 537382 - DNA, 25 bp, Rattus norvegicus
tcctcgtaaccgttgggcgacatta

SEQ ID NO: 537383 - DNA, 25 bp, Rattus norvegicus
ttgggcgacattatcaccacgcttc

SEQ ID NO: 537384 - DNA, 25 bp, Rattus norvegicus
tatcaccacgcttcaattcttcatg

SEQ ID NO: 537385 - DNA, 25 bp, Rattus norvegicus
atatttaacggatggctgcagagcc

SEQ ID NO: 537386 - DNA, 25 bp, Rattus norvegicus
ctgcagagccagctgggaaacacgc

SEQ ID NO: 537387 - DNA, 25 bp, Rattus norvegicus
cagaaggcacgagactggggcaaac

SEQ ID NO: 537388 - DNA, 25 bp, Rattus norvegicus
cccgtgtgacagattctgctaattg

SEQ ID NO: 537389 - DNA, 25 bp, Rattus norvegicus
ctcaaccgcattggcaccgagtttc

SEQ ID NO: 537390 - DNA, 25 bp, Rattus norvegicus
gcattggccccgagtttctcatctc

SEQ ID NO: 537391 - DNA, 25 bp, Rattus norvegicus
cgcattggcaccgagtttctcatct

SEQ ID NO: 537392 - DNA, 25 bp, Rattus norvegicus
gtttctcatctcctcaaccgcattg

SEQ ID NO: 537393 - DNA, 25 bp, Rattus norvegicus
ggcaccgagtttctcatctcctcaa

SEQ ID NO: 537394 - DNA, 25 bp, Rattus norvegicus
ttggcaccgagtttctcatctcctc

SEQ ID NO: 537395 - DNA, 25 bp, Rattus norvegicus
aaccgcattggcaccgagtttctca

SEQ ID NO: 537396 - DNA, 25 bp, Rattus norvegicus
cctcaaccgcattggcaccgagttt

SEQ ID NO: 537397 - DNA, 25 bp, Rattus norvegicus
cgagtttctcatctcctcaaccgca

SEQ ID NO: 537398 - DNA, 25 bp, Rattus norvegicus
ccgcattggcaccgagtttctcatc

SEQ ID NO: 537399 - DNA, 25 bp, Rattus norvegicus
ttctcatctcctcaaccgcattggc

SEQ ID NO: 537400 - DNA, 25 bp, Rattus norvegicus
tggcaccgagtttctcatctcctca

SEQ ID NO: 537401 - DNA, 25 bp, Rattus norvegicus
tttctcatctcctcaaccgcattgg

SEQ ID NO: 537402 - DNA, 25 bp, Rattus norvegicus
accgcattggcaccgagtttctcat

SEQ ID NO: 537403 - DNA, 25 bp, Rattus norvegicus
ctcctgcggcctggaagcggacact

SEQ ID NO: 537404 - DNA, 25 bp, Rattus norvegicus
agcgtttggaatgtgaactcagtgc

SEQ ID NO: 537405 - DNA, 25 bp, Rattus norvegicus
aagtagcgtttggaatgtgaactca

SEQ ID NO: 537406 - DNA, 25 bp, Rattus norvegicus
cgtagaagtagcgtttggaatgtga

SEQ ID NO: 537407 - DNA, 25 bp, Rattus norvegicus
ggctagccgcgtgggcgtagaagta

SEQ ID NO: 537408 - DNA, 25 bp, Rattus norvegicus
ataacttgtcttgcgggtccgcggg

SEQ ID NO: 537409 - DNA, 25 bp, Rattus norvegicus
tccaataacttgtcttgcgggtccg

SEQ ID NO: 537410 - DNA, 25 bp, Rattus norvegicus
gtgtgagcgcgtgcccatgtttgct

SEQ ID NO: 537411 - DNA, 25 bp, Rattus norvegicus
ggcctggaagcggacactcaccgca

SEQ ID NO: 537412 - DNA, 25 bp, Rattus norvegicus
ggatcccgctcctgcggcctggaag

SEQ ID NO: 537413 - DNA, 25 bp, Rattus norvegicus
atgtgaactcagtgcgggctctagg

SEQ ID NO: 537414 - DNA, 25 bp, Rattus norvegicus
tggaatgtgaactcagtgcgggctc

SEQ ID NO: 537415 - DNA, 25 bp, Rattus norvegicus
tggaagcggacactcaccgcagcac

SEQ ID NO: 537416 - DNA, 25 bp, Rattus norvegicus
cccgggatccaataacttgtcttgc

SEQ ID NO: 537417 - DNA, 25 bp, Rattus norvegicus
gcttccagcactggggtggcatgcc

SEQ ID NO: 537418 - DNA, 25 bp, Rattus norvegicus
cagcagctgcgcctgaagatcaaca

SEQ ID NO: 537419 - DNA, 25 bp, Rattus norvegicus
gaagcagatgactgagcccgagctg

SEQ ID NO: 537420 - DNA, 25 bp, Rattus norvegicus
cggccacgtcttccaccaagaaaga

SEQ ID NO: 537421 - DNA, 25 bp, Rattus norvegicus
gcggtggcttcaagtcatcttcctc

SEQ ID NO: 537422 - DNA, 25 bp, Rattus norvegicus
ctgctggcgcgaaactacatcctga

SEQ ID NO: 537423 - DNA, 25 bp, Rattus norvegicus
gccagagctgagctccgagctgcga

SEQ ID NO: 537424 - DNA, 25 bp, Rattus norvegicus
ggagctgaaccactggctgagccta

SEQ ID NO: 537425 - DNA, 25 bp, Rattus norvegicus
ctgttgccagaaggggagctgaacc

SEQ ID NO: 537426 - DNA, 25 bp, Rattus norvegicus
tgatgctcaccaactcgctggagga

SEQ ID NO: 537427 - DNA, 25 bp, Rattus norvegicus
caccaccacgtgtcggctatgggcg

SEQ ID NO: 537428 - DNA, 25 bp, Rattus norvegicus
ggcctgctcaagtctccatcggcag

SEQ ID NO: 537429 - DNA, 25 bp, Rattus norvegicus
gcaagcgcatgcacgacctcaacat

SEQ ID NO: 537430 - DNA, 25 bp, Rattus norvegicus
ggctccgggactctgttgccagaag

SEQ ID NO: 537431 - DNA, 25 bp, Rattus norvegicus
ctccctaaacctgcgcgtgagaagc

SEQ ID NO: 537432 - DNA, 25 bp, Rattus norvegicus
gtttaaaggtgtcaggcgcgcactg

SEQ ID NO: 537433 - DNA, 25 bp, Rattus norvegicus
tctctggcaactctggctgtacctc

SEQ ID NO: 537434 - DNA, 25 bp, Rattus norvegicus
cggaagcgcatgcaggacctgaact

SEQ ID NO: 537435 - DNA, 25 bp, Rattus norvegicus
tgtacctctgcacaggcggccaatg

SEQ ID NO: 537436 - DNA, 25 bp, Rattus norvegicus
tgtgaccaagctcgcacctctattg

SEQ ID NO: 537437 - DNA, 25 bp, Rattus norvegicus
cccagatgtactatgcggtttccca

SEQ ID NO: 537438 - DNA, 25 bp, Rattus norvegicus
cttcgttgtacgagctggtgggtta

SEQ ID NO: 537439 - DNA, 25 bp, Rattus norvegicus
agaagcctgaagctccgctcgctga

SEQ ID NO: 537440 - DNA, 25 bp, Rattus norvegicus
aggacctgaacttggccatggacgc

SEQ ID NO: 537441 - DNA, 25 bp, Rattus norvegicus
cgctgcgcgaagttatcctacccta

SEQ ID NO: 537442 - DNA, 25 bp, Rattus norvegicus
agtacctgtctctagcgctcgacga

SEQ ID NO: 537443 - DNA, 25 bp, Rattus norvegicus
ggtgtgcaagttcccgcatctggtc

SEQ ID NO: 537444 - DNA, 25 bp, Rattus norvegicus
gcggccaatgaacactcgcctgtga

SEQ ID NO: 537445 - DNA, 25 bp, Rattus norvegicus
agataccctttgttctgggcagcca

SEQ ID NO: 537446 - DNA, 25 bp, Rattus norvegicus
ggtgtatcacagcatcggagagttg

SEQ ID NO: 537447 - DNA, 25 bp, Rattus norvegicus
ctgcagcagtgtccaggagttcatg

SEQ ID NO: 537448 - DNA, 25 bp, Rattus norvegicus
catcgctgtcttggctgtgcaattg

SEQ ID NO: 537449 - DNA, 25 bp, Rattus norvegicus
aatgctctgtacattcccggctgga

SEQ ID NO: 537450 - DNA, 25 bp, Rattus norvegicus
agccaggaggccaagactagtagtc

SEQ ID NO: 537451 - DNA, 25 bp, Rattus norvegicus
ctcgacgtccagtcttgagcggata

SEQ ID NO: 537452 - DNA, 25 bp, Rattus norvegicus
cgccgcgcccagtgataagagaact

SEQ ID NO: 537453 - DNA, 25 bp, Rattus norvegicus
gtccacgcccagcttgcaggttcaa

SEQ ID NO: 537454 - DNA, 25 bp, Rattus norvegicus
ggggccttcatactcctctgagttg

SEQ ID NO: 537455 - DNA, 25 bp, Rattus norvegicus
tagatggcgatgcacgtgacacttc

SEQ ID NO: 537456 - DNA, 25 bp, Rattus norvegicus
acgtgacacttccagcaggctaatg

SEQ ID NO: 537457 - DNA, 25 bp, Rattus norvegicus
ctaatgctctgttgaacgcgccgcg

SEQ ID NO: 537458 - DNA, 25 bp, Rattus norvegicus
acgagacttccacgggcagcactga

SEQ ID NO: 537459 - DNA, 25 bp, Rattus norvegicus
cgctgacatcaggagttaagcaacc

SEQ ID NO: 537460 - DNA, 25 bp, Rattus norvegicus
ggcctcccaagacgatgctcgctgt

SEQ ID NO: 537461 - DNA, 25 bp, Rattus norvegicus
aagatgtgagcaacgggtccggcct

SEQ ID NO: 537462 - DNA, 25 bp, Rattus norvegicus
agctccgctgtactgctgaagagga

SEQ ID NO: 537463 - DNA, 25 bp, Rattus norvegicus
cctggagtcatcttcagctccgctg

SEQ ID NO: 537464 - DNA, 25 bp, Rattus norvegicus
agagggcctagctaccctggagtca

SEQ ID NO: 537465 - DNA, 25 bp, Rattus norvegicus
ccgagctcagagcaccaggactgga

SEQ ID NO: 537466 - DNA, 25 bp, Rattus norvegicus
gtctaataactgtcgggtgcggtct

SEQ ID NO: 537467 - DNA, 25 bp, Rattus norvegicus
tgcaacccgctttcctctcaggagt

SEQ ID NO: 537468 - DNA, 25 bp, Rattus norvegicus
cggggtcctttgattcatgggctcc

SEQ ID NO: 537469 - DNA, 25 bp, Rattus norvegicus
caacgcctcggaagcctcgggacaa

SEQ ID NO: 537470 - DNA, 25 bp, Rattus norvegicus
catgggctccagagacgctgacatc

SEQ ID NO: 537471 - DNA, 25 bp, Rattus norvegicus
ctgcccgtagcctcaggtgagccga

SEQ ID NO: 537472 - DNA, 25 bp, Rattus norvegicus
aggcgcactaactgcaacccgcttt

SEQ ID NO: 537473 - DNA, 25 bp, Rattus norvegicus
tgggtgccgctgggagcctacaccc

SEQ ID NO: 537474 - DNA, 25 bp, Rattus norvegicus
atggccgctgcggtttcagtctgag

SEQ ID NO: 537475 - DNA, 25 bp, Rattus norvegicus
cttctccaggtaggtgcgacccaga

SEQ ID NO: 537476 - DNA, 25 bp, Rattus norvegicus
gcgccgcggtgtcttctccaggtag

SEQ ID NO: 537477 - DNA, 25 bp, Rattus norvegicus
cggtttcagtctgagcggcgtccac

SEQ ID NO: 537478 - DNA, 25 bp, Rattus norvegicus
cctggccacgccttggaggtcggct

SEQ ID NO: 537479 - DNA, 25 bp, Rattus norvegicus
tctctctacggtggtcctaaaagtc

SEQ ID NO: 537480 - DNA, 25 bp, Rattus norvegicus
gctggtctctctacggtggtcctaa

SEQ ID NO: 537481 - DNA, 25 bp, Rattus norvegicus
gatgggtgtccgctggtctctctac

SEQ ID NO: 537482 - DNA, 25 bp, Rattus norvegicus
caggtaggtgcgacccagaaggccc

SEQ ID NO: 537483 - DNA, 25 bp, Rattus norvegicus
gggtcttcggcggttcccgatctgc

SEQ ID NO: 537484 - DNA, 25 bp, Rattus norvegicus
gcggttcccgatctgcgggttgatc

SEQ ID NO: 537485 - DNA, 25 bp, Rattus norvegicus
cccgatctgcgggttgatcgcgatc

SEQ ID NO: 537486 - DNA, 25 bp, Rattus norvegicus
tgccgttgctgttgctctgtgggct

SEQ ID NO: 537487 - DNA, 25 bp, Rattus norvegicus
cagccggctcaacctcagcggtgga

SEQ ID NO: 537488 - DNA, 25 bp, Rattus norvegicus
ccttgagcagcaggacgaccaatca

SEQ ID NO: 537489 - DNA, 25 bp, Rattus norvegicus
acgtcagggccaaggaccgacgaga

SEQ ID NO: 537490 - DNA, 25 bp, Rattus norvegicus
gatagagggcgtggctttattttga

SEQ ID NO: 537491 - DNA, 25 bp, Rattus norvegicus
cagcaggacgaccaatcagagtgcg

SEQ ID NO: 537492 - DNA, 25 bp, Rattus norvegicus
cggggcataactcctagaggcggga

SEQ ID NO: 537493 - DNA, 25 bp, Rattus norvegicus
caccgtaggggccaatgggattgca

SEQ ID NO: 537494 - DNA, 25 bp, Rattus norvegicus
cgggtcacggctacgtcagggccaa

SEQ ID NO: 537495 - DNA, 25 bp, Rattus norvegicus
agcccaagctggagcagggacgtcc

SEQ ID NO: 537496 - DNA, 25 bp, Rattus norvegicus
ggctacctgcaacgtcctcgccgag

SEQ ID NO: 537497 - DNA, 25 bp, Rattus norvegicus
atcgcggaagcccaagacctgccaa

SEQ ID NO: 537498 - DNA, 25 bp, Rattus norvegicus
cccaggctccagacgagatgcgcgg

SEQ ID NO: 537499 - DNA, 25 bp, Rattus norvegicus
ctcgatcggcggatcgcggaagccc

SEQ ID NO: 537500 - DNA, 25 bp, Rattus norvegicus
cccgtgcgcaccgtaggggccaatg

SEQ ID NO: 537501 - DNA, 25 bp, Rattus norvegicus
cgggagcgccttctcctgtaatggc

SEQ ID NO: 537502 - DNA, 25 bp, Rattus norvegicus
tcagacttttctgctcctcgcgggc

SEQ ID NO: 537503 - DNA, 25 bp, Rattus norvegicus
cagagccacggctacctaattgtga

SEQ ID NO: 537504 - DNA, 25 bp, Rattus norvegicus
ccgtttagatcgcaggtcgcttgga

SEQ ID NO: 537505 - DNA, 25 bp, Rattus norvegicus
cacgtgacgccggttataggaagta

SEQ ID NO: 537506 - DNA, 25 bp, Rattus norvegicus
ggggaatttctttctcatgcaggtc

SEQ ID NO: 537507 - DNA, 25 bp, Rattus norvegicus
cgcgctatacaatctgaggcctttc

SEQ ID NO: 537508 - DNA, 25 bp, Rattus norvegicus
tactcgctacggaaagcctcttagg

SEQ ID NO: 537509 - DNA, 25 bp, Rattus norvegicus
ggcgcctgcgtcaaacactaacatg

SEQ ID NO: 537510 - DNA, 25 bp, Rattus norvegicus
gcggccgacatcgagcaggttttta

SEQ ID NO: 537511 - DNA, 25 bp, Rattus norvegicus
cggactagttcttgcgcggcgcaaa

SEQ ID NO: 537512 - DNA, 25 bp, Rattus norvegicus
gctttccaggtaaacgcttctcaga

SEQ ID NO: 537513 - DNA, 25 bp, Rattus norvegicus
ttagggcttcgtctatcctcccgtg

SEQ ID NO: 537514 - DNA, 25 bp, Rattus norvegicus
cctcccgtggcatctttcatgaaga

SEQ ID NO: 537515 - DNA, 25 bp, Rattus norvegicus
gctgctcacggactggaggctcccg

SEQ ID NO: 537516 - DNA, 25 bp, Rattus norvegicus
ctgcgaggccaggtgtcgcccagac

SEQ ID NO: 537517 - DNA, 25 bp, Rattus norvegicus
cccaacagatttcgcggtggccgct

SEQ ID NO: 537518 - DNA, 25 bp, Rattus norvegicus
agacccgcgctgctcacggactgga

SEQ ID NO: 537519 - DNA, 25 bp, Rattus norvegicus
gagacagccattgcgcagcaccgag

SEQ ID NO: 537520 - DNA, 25 bp, Rattus norvegicus
gaccgagacagccattgcgcagcac

SEQ ID NO: 537521 - DNA, 25 bp, Rattus norvegicus
cctcttgaagctgggcgagtagccg

SEQ ID NO: 537522 - DNA, 25 bp, Rattus norvegicus
cctcaggcggcctcttgaagctggg

SEQ ID NO: 537523 - DNA, 25 bp, Rattus norvegicus
cggcggtaccatggtcccgaggcct

SEQ ID NO: 537524 - DNA, 25 bp, Rattus norvegicus
gcagcccgaggtgctccttctgctg

SEQ ID NO: 537525 - DNA, 25 bp, Rattus norvegicus
aaagggacgcaagggcagcccagca

SEQ ID NO: 537526 - DNA, 25 bp, Rattus norvegicus
cagaccacttcaccggcccgcagca

SEQ ID NO: 537527 - DNA, 25 bp, Rattus norvegicus
gaggtgctccttctgctgcgaggcc

SEQ ID NO: 537528 - DNA, 25 bp, Rattus norvegicus
gaggacacggcggtaccatggtccc

SEQ ID NO: 537529 - DNA, 25 bp, Rattus norvegicus
ataggtgccgtggtcccgctagact

SEQ ID NO: 537530 - DNA, 25 bp, Rattus norvegicus
gatgttgctggtgcggccatctttt

SEQ ID NO: 537531 - DNA, 25 bp, Rattus norvegicus
ctgtcgggacagcacggatgttgct

SEQ ID NO: 537532 - DNA, 25 bp, Rattus norvegicus
ccgtcagcttctacctgtcgggaca

SEQ ID NO: 537533 - DNA, 25 bp, Rattus norvegicus
agcctcacacgcagcgctgggagtc

SEQ ID NO: 537534 - DNA, 25 bp, Rattus norvegicus
cacgaccctggtgggcggcttgacc

SEQ ID NO: 537535 - DNA, 25 bp, Rattus norvegicus
cccgggcagctgtaggtcaaaccca

SEQ ID NO: 537536 - DNA, 25 bp, Rattus norvegicus
gtcaaacccaagtaagagactagtg

SEQ ID NO: 537537 - DNA, 25 bp, Rattus norvegicus
aagagactagtgatgccagagcgca

SEQ ID NO: 537538 - DNA, 25 bp, Rattus norvegicus
tcgctcggttttctgggaaatgaac

SEQ ID NO: 537539 - DNA, 25 bp, Rattus norvegicus
ctgggaaatgaacgcaccaggagcc

SEQ ID NO: 537540 - DNA, 25 bp, Rattus norvegicus
taagaacctcttgcacgctgggagt

SEQ ID NO: 537541 - DNA, 25 bp, Rattus norvegicus
cgctagactcttgaacccgaacaag

SEQ ID NO: 537542 - DNA, 25 bp, Rattus norvegicus
tgcggccatcttttcccgggcagct

SEQ ID NO: 537543 - DNA, 25 bp, Rattus norvegicus
cagcgtccgcgatcagtacagcctt

SEQ ID NO: 537544 - DNA, 25 bp, Rattus norvegicus
tttgattctgaaagccatgcggcgg

SEQ ID NO: 537545 - DNA, 25 bp, Rattus norvegicus
agaagctgctcgtcgtcccgatcgc

SEQ ID NO: 537546 - DNA, 25 bp, Rattus norvegicus
ctccggagtccgatggaaggactgc

SEQ ID NO: 537547 - DNA, 25 bp, Rattus norvegicus
ggtgtgccaaatacgcagcgggcca

SEQ ID NO: 537548 - DNA, 25 bp, Rattus norvegicus
agtgaccttccctcagaccgagttc

SEQ ID NO: 537549 - DNA, 25 bp, Rattus norvegicus
atgcggcgggtaagtgaccttccct

SEQ ID NO: 537550 - DNA, 25 bp, Rattus norvegicus
gccagggagcctaccggctgcatct

SEQ ID NO: 537551 - DNA, 25 bp, Rattus norvegicus
cgcagctgccggagcctttaaaccg

SEQ ID NO: 537552 - DNA, 25 bp, Rattus norvegicus
cacgggctgctcaagaccgtgtcca

SEQ ID NO: 537553 - DNA, 25 bp, Rattus norvegicus
tacggagataggatacggcctccca

SEQ ID NO: 537554 - DNA, 25 bp, Rattus norvegicus
aagttccactggtttctagagccca

SEQ ID NO: 537555 - DNA, 25 bp, Rattus norvegicus
tctagagcccaaggttggtcggcgc

SEQ ID NO: 537556 - DNA, 25 bp, Rattus norvegicus
cccgctacgagttggctttgattct

SEQ ID NO: 537557 - DNA, 25 bp, Rattus norvegicus
caaggagatgctggttaggcgaacc

SEQ ID NO: 537558 - DNA, 25 bp, Rattus norvegicus
cttaggcaggtgatgcagagatgcc

SEQ ID NO: 537559 - DNA, 25 bp, Rattus norvegicus
gcgttcctttcggagctcgcggcaa

SEQ ID NO: 537560 - DNA, 25 bp, Rattus norvegicus
caccggtttggagctcgcgttcctt

SEQ ID NO: 537561 - DNA, 25 bp, Rattus norvegicus
cagagcacccgcagaatggggtttc

SEQ ID NO: 537562 - DNA, 25 bp, Rattus norvegicus
cggaagctggttgccggcagcaaaa

SEQ ID NO: 537563 - DNA, 25 bp, Rattus norvegicus
accacacagtgcaagggttccgctg

SEQ ID NO: 537564 - DNA, 25 bp, Rattus norvegicus
catggtcccttcttttaagggtctg

SEQ ID NO: 537565 - DNA, 25 bp, Rattus norvegicus
ccgcgctgcgtttccaaatcatggt

SEQ ID NO: 537566 - DNA, 25 bp, Rattus norvegicus
ctgtagaagcggagaaccgcgctgc

SEQ ID NO: 537567 - DNA, 25 bp, Rattus norvegicus
aggagcccgcagacactgtagaagc

SEQ ID NO: 537568 - DNA, 25 bp, Rattus norvegicus
gattaccttgtaacaggagcccgca

SEQ ID NO: 537569 - DNA, 25 bp, Rattus norvegicus
tcggtgggctaaatagtttcttctc

SEQ ID NO: 537570 - DNA, 25 bp, Rattus norvegicus
cccacgataccgctgctgcggtgtt

SEQ ID NO: 537571 - DNA, 25 bp, Rattus norvegicus
gggacatgtagttttcacgaccaga

SEQ ID NO: 537572 - DNA, 25 bp, Rattus norvegicus
acggtgcccttcatcatggcgcttc

SEQ ID NO: 537573 - DNA, 25 bp, Rattus norvegicus
agcgcctgcgcttggagcaacaccg

SEQ ID NO: 537574 - DNA, 25 bp, Rattus norvegicus
ggagcaacaccgtctttgccctcag

SEQ ID NO: 537575 - DNA, 25 bp, Rattus norvegicus
actgcgcctgcgtatcaaacggtgc

SEQ ID NO: 537576 - DNA, 25 bp, Rattus norvegicus
gcgtatcaaacggtgcccttcatca

SEQ ID NO: 537577 - DNA, 25 bp, Rattus norvegicus
tcatcatggcgcttcctttccgagc

SEQ ID NO: 537578 - DNA, 25 bp, Rattus norvegicus
cctttccgagcggtgcatttcggga

SEQ ID NO: 537579 - DNA, 25 bp, Rattus norvegicus
ttttcacgaccagattgtgggagtc

SEQ ID NO: 537580 - DNA, 25 bp, Rattus norvegicus
gtgcatttcgggacatgtagttttc

SEQ ID NO: 537581 - DNA, 25 bp, Rattus norvegicus
ttgtgagcaccaaacgaggaggccc

SEQ ID NO: 537582 - DNA, 25 bp, Rattus norvegicus
ggagtcgtggtttgtgagcaccaaa

SEQ ID NO: 537583 - DNA, 25 bp, Rattus norvegicus
tgtgtgattgaatctttggggcgct

SEQ ID NO: 537584 - DNA, 25 bp, Rattus norvegicus
cccgccgcattgaattgtaagtgtg

SEQ ID NO: 537585 - DNA, 25 bp, Rattus norvegicus
taaggtcggcctactcgggctatta

SEQ ID NO: 537586 - DNA, 25 bp, Rattus norvegicus
tcacagcccaagagcgttcccttta

SEQ ID NO: 537587 - DNA, 25 bp, Rattus norvegicus
agtcgtagctcgctcacagcccaag

SEQ ID NO: 537588 - DNA, 25 bp, Rattus norvegicus
tcgctccgctcagctgggatcggcg

SEQ ID NO: 537589 - DNA, 25 bp, Rattus norvegicus
agggtgcgaagggcctcaaagtcac

SEQ ID NO: 537590 - DNA, 25 bp, Rattus norvegicus
agtcgatgaagctccagtcgccgcc

SEQ ID NO: 537591 - DNA, 25 bp, Rattus norvegicus
tctcgcagtcgatgaagctccagtc

SEQ ID NO: 537592 - DNA, 25 bp, Rattus norvegicus
tcctccatctcgcagtcgatgaagc

SEQ ID NO: 537593 - DNA, 25 bp, Rattus norvegicus
gcgctcggcaggtcctgcagatcca

SEQ ID NO: 537594 - DNA, 25 bp, Rattus norvegicus
ggtagaatacgatctggactatgta

SEQ ID NO: 537595 - DNA, 25 bp, Rattus norvegicus
ccggcacaggccgtccacgaacacg

SEQ ID NO: 537596 - DNA, 25 bp, Rattus norvegicus
aggaagaccgcctccagagtcagag

SEQ ID NO: 537597 - DNA, 25 bp, Rattus norvegicus
cggtgcaaaaggaagaccgcctcca

SEQ ID NO: 537598 - DNA, 25 bp, Rattus norvegicus
tctggactatgtaggcggtgcaaaa

SEQ ID NO: 537599 - DNA, 25 bp, Rattus norvegicus
ccggtccacccatccgcgcttccca

SEQ ID NO: 537600 - DNA, 25 bp, Rattus norvegicus
ggcgcgttcaaactagccggtccac

SEQ ID NO: 537601 - DNA, 25 bp, Rattus norvegicus
cgcggcgcgttcaaactagccggtc

SEQ ID NO: 537602 - DNA, 25 bp, Rattus norvegicus
ctcgatcccaccgaaccaaccttct

SEQ ID NO: 537603 - DNA, 25 bp, Rattus norvegicus
gcgtcccgacactcgatcccaccga

SEQ ID NO: 537604 - DNA, 25 bp, Rattus norvegicus
gactcaagagagtgcgtcccgacac

SEQ ID NO: 537605 - DNA, 25 bp, Rattus norvegicus
ggccggcgcataagacggctccgca

SEQ ID NO: 537606 - DNA, 25 bp, Rattus norvegicus
ccaccgtggatcaaagcttaccttt

SEQ ID NO: 537607 - DNA, 25 bp, Rattus norvegicus
ctttcgtcggttcccgccgctggtg

SEQ ID NO: 537608 - DNA, 25 bp, Rattus norvegicus
tgttgcgggtcgcttacgcgtccct

SEQ ID NO: 537609 - DNA, 25 bp, Rattus norvegicus
ttacgcgtccctccgcctccgacag

SEQ ID NO: 537610 - DNA, 25 bp, Rattus norvegicus
cctccgacaggggagccctcagact

SEQ ID NO: 537611 - DNA, 25 bp, Rattus norvegicus
gccctcagactcaagagagtgcgtc

SEQ ID NO: 537612 - DNA, 25 bp, Rattus norvegicus
caagagagtgcgtcccgacactcga

SEQ ID NO: 537613 - DNA, 25 bp, Rattus norvegicus
tacagcggcgcgtcggtcccagcaa

SEQ ID NO: 537614 - DNA, 25 bp, Rattus norvegicus
tcttgttctgctctgcgattgcggc

SEQ ID NO: 537615 - DNA, 25 bp, Rattus norvegicus
ctgctctgcgattgcggcgcttgtt

SEQ ID NO: 537616 - DNA, 25 bp, Rattus norvegicus
tgcggcgcttgttcgagcgcttaca

SEQ ID NO: 537617 - DNA, 25 bp, Rattus norvegicus
cttgttcgagcgcttacagcggcgc

SEQ ID NO: 537618 - DNA, 25 bp, Rattus norvegicus
ttcgagcgcttacagcggcgcgtcg

SEQ ID NO: 537619 - DNA, 25 bp, Rattus norvegicus
gtgagagaagatggcccgaaccaag

SEQ ID NO: 537620 - DNA, 25 bp, Rattus norvegicus
aagatggcccgaaccaagcagaccg

SEQ ID NO: 537621 - DNA, 25 bp, Rattus norvegicus
gcccgaaccaagcagaccgctagga

SEQ ID NO: 537622 - DNA, 25 bp, Rattus norvegicus
gaaccaagcagaccgctaggaagtc

SEQ ID NO: 537623 - DNA, 25 bp, Rattus norvegicus
gctggccaccaaggcggcccggaaa

SEQ ID NO: 537624 - DNA, 25 bp, Rattus norvegicus
aaagcgcgccctctactggcggggt

SEQ ID NO: 537625 - DNA, 25 bp, Rattus norvegicus
cagagcggtttggtcgttcgttgga

SEQ ID NO: 537626 - DNA, 25 bp, Rattus norvegicus
gaaaagcgcgccctctactggcggg

SEQ ID NO: 537627 - DNA, 25 bp, Rattus norvegicus
tccgagggcgccttgatcccgcagg

SEQ ID NO: 537628 - DNA, 25 bp, Rattus norvegicus
aagtgcaggcgcaggacccgcgccc

SEQ ID NO: 537629 - DNA, 25 bp, Rattus norvegicus
ccgggacggagacaccgggcaccag

SEQ ID NO: 537630 - DNA, 25 bp, Rattus norvegicus
agacaccgggcaccagtggagctcc

SEQ ID NO: 537631 - DNA, 25 bp, Rattus norvegicus
acaccgggcaccagtggagctccgg

SEQ ID NO: 537632 - DNA, 25 bp, Rattus norvegicus
caccagtggagctccgggtgaagcg

SEQ ID NO: 537633 - DNA, 25 bp, Rattus norvegicus
ccagcaggtgcagggaacgagctcg

SEQ ID NO: 537634 - DNA, 25 bp, Rattus norvegicus
gggcgccttgatcccgcagggagcg

SEQ ID NO: 537635 - DNA, 25 bp, Rattus norvegicus
atgcgactccgagggcgccttgatc

SEQ ID NO: 537636 - DNA, 25 bp, Rattus norvegicus
ggtgcagggaacgagctcggggcta

SEQ ID NO: 537637 - DNA, 25 bp, Rattus norvegicus
aatgcgactccgagggcgccttgat

SEQ ID NO: 537638 - DNA, 25 bp, Rattus norvegicus
cggaatgcgactccgagggcgcctt

SEQ ID NO: 537639 - DNA, 25 bp, Rattus norvegicus
tgaagcggaggctgcggaatgcgac

SEQ ID NO: 537640 - DNA, 25 bp, Rattus norvegicus
cggaggaggcgccaagcgcccagca

SEQ ID NO: 537641 - DNA, 25 bp, Rattus norvegicus
cccgacggcagccttgatggagagg

SEQ ID NO: 537642 - DNA, 25 bp, Rattus norvegicus
agtcgcaagtggagctcagtaacca

SEQ ID NO: 537643 - DNA, 25 bp, Rattus norvegicus
aggaggccaaatccaccgggcacga

SEQ ID NO: 537644 - DNA, 25 bp, Rattus norvegicus
gagaggaggccaaatccaccgggca

SEQ ID NO: 537645 - DNA, 25 bp, Rattus norvegicus
acctagcggaggagaccagcgccca

SEQ ID NO: 537646 - DNA, 25 bp, Rattus norvegicus
ctcagtaaccacctagcggaggaga

SEQ ID NO: 537647 - DNA, 25 bp, Rattus norvegicus
gacgtagggagaacggcccagcttc

SEQ ID NO: 537648 - DNA, 25 bp, Rattus norvegicus
cacgaggagtcgcaagtggagctca

SEQ ID NO: 537649 - DNA, 25 bp, Rattus norvegicus
atccaccgggcacgaggagtcgcaa

SEQ ID NO: 537650 - DNA, 25 bp, Rattus norvegicus
agggaccctgcgaggaggccatcca

SEQ ID NO: 537651 - DNA, 25 bp, Rattus norvegicus
accctgcgaggaggccatccaagag

SEQ ID NO: 537652 - DNA, 25 bp, Rattus norvegicus
cgaggaggccatccaagagaaggcc

SEQ ID NO: 537653 - DNA, 25 bp, Rattus norvegicus
aggccaaatccaccgggcacgagga

SEQ ID NO: 537654 - DNA, 25 bp, Rattus norvegicus
aaccacctagcggaggagaccagcg

SEQ ID NO: 537655 - DNA, 25 bp, Rattus norvegicus
cgagaggtcgagctcatggctgaca

SEQ ID NO: 537656 - DNA, 25 bp, Rattus norvegicus
atgccaatgccgatgcccgatgtga

SEQ ID NO: 537657 - DNA, 25 bp, Rattus norvegicus
cgagctcatggctgacatgccaatg

SEQ ID NO: 537658 - DNA, 25 bp, Rattus norvegicus
atgccgatgcccgatgtgacaggag

SEQ ID NO: 537659 - DNA, 25 bp, Rattus norvegicus
agcctgccgaggtgccgtagtacag

SEQ ID NO: 537660 - DNA, 25 bp, Rattus norvegicus
catggagaattggtaggagcctgcc

SEQ ID NO: 537661 - DNA, 25 bp, Rattus norvegicus
cgccgcccaccatggagaattggta

SEQ ID NO: 537662 - DNA, 25 bp, Rattus norvegicus
ccaccacgtcgctctggctggggag

SEQ ID NO: 537663 - DNA, 25 bp, Rattus norvegicus
ggtttccaccacgtcgctctggctg

SEQ ID NO: 537664 - DNA, 25 bp, Rattus norvegicus
agttgctatggctgccctcggtttc

SEQ ID NO: 537665 - DNA, 25 bp, Rattus norvegicus
tgggcgagttgctatggctgccctc

SEQ ID NO: 537666 - DNA, 25 bp, Rattus norvegicus
agggccgccagacagcctcctccag

SEQ ID NO: 537667 - DNA, 25 bp, Rattus norvegicus
cagtcccccgaaggcgctcagtagg

SEQ ID NO: 537668 - DNA, 25 bp, Rattus norvegicus
gctgacatgccaatgccgatgcccg

SEQ ID NO: 537669 - DNA, 25 bp, Rattus norvegicus
gtatcgtgacgggaaagagcttgct

SEQ ID NO: 537670 - DNA, 25 bp, Rattus norvegicus
tgaccagagtgccatccggaacgtc

SEQ ID NO: 537671 - DNA, 25 bp, Rattus norvegicus
agggacaaaggcagacgtcagtgtc

SEQ ID NO: 537672 - DNA, 25 bp, Rattus norvegicus
tacgtgactgtgtgtggcacttaac

SEQ ID NO: 537673 - DNA, 25 bp, Rattus norvegicus
tgtggcacttaacggtgacgctttc

SEQ ID NO: 537674 - DNA, 25 bp, Rattus norvegicus
acggtgacgctttctagttttcaga

SEQ ID NO: 537675 - DNA, 25 bp, Rattus norvegicus
cgtcagtgtcataggtacgtgactg

SEQ ID NO: 537676 - DNA, 25 bp, Rattus norvegicus
tcattgcccgccaagacggtgacca

SEQ ID NO: 537677 - DNA, 25 bp, Rattus norvegicus
gaccgacaaacctgaggtcgttgaa

SEQ ID NO: 537678 - DNA, 25 bp, Rattus norvegicus
ggtcgttgaatctcgccacttggtt

SEQ ID NO: 537679 - DNA, 25 bp, Rattus norvegicus
tggcgtttctcagctccgccgagta

SEQ ID NO: 537680 - DNA, 25 bp, Rattus norvegicus
ccgccgagtagttttcgtcattgcc

SEQ ID NO: 537681 - DNA, 25 bp, Rattus norvegicus
gaaccgtcataactcgagtatcgtg

SEQ ID NO: 537682 - DNA, 25 bp, Rattus norvegicus
gtgacagatacgcacctctgccgct

SEQ ID NO: 537683 - DNA, 25 bp, Rattus norvegicus
tacggggatacgcatcacaacaagc

SEQ ID NO: 537684 - DNA, 25 bp, Rattus norvegicus
gtcgccgctcctcagcttgctggcc

SEQ ID NO: 537685 - DNA, 25 bp, Rattus norvegicus
agcggcagcgcctcgctcatcttgc

SEQ ID NO: 537686 - DNA, 25 bp, Rattus norvegicus
ctccaccatgctgcggtcgccgctc

SEQ ID NO: 537687 - DNA, 25 bp, Rattus norvegicus
ggtcagctagtacctccaccatgct

SEQ ID NO: 537688 - DNA, 25 bp, Rattus norvegicus
cggggtggtcagctagtacctccac

SEQ ID NO: 537689 - DNA, 25 bp, Rattus norvegicus
tgctggcatctacggggatacgcat

SEQ ID NO: 537690 - DNA, 25 bp, Rattus norvegicus
cgcatcacaacaagccgattgagta

SEQ ID NO: 537691 - DNA, 25 bp, Rattus norvegicus
caacaagccgattgagtaaggaccc

SEQ ID NO: 537692 - DNA, 25 bp, Rattus norvegicus
gccgattgagtaaggaccctgaaaa

SEQ ID NO: 537693 - DNA, 25 bp, Rattus norvegicus
gaccctgaaaacagctcctactaga

SEQ ID NO: 537694 - DNA, 25 bp, Rattus norvegicus
acagctcctactagacggcgacagg

SEQ ID NO: 537695 - DNA, 25 bp, Rattus norvegicus
gctcctactagacggcgacagggac

SEQ ID NO: 537696 - DNA, 25 bp, Rattus norvegicus
ctcgtgctggcatctacggggatac

SEQ ID NO: 537697 - DNA, 25 bp, Rattus norvegicus
gcccaggtttagactccacgccagg

SEQ ID NO: 537698 - DNA, 25 bp, Rattus norvegicus
tcagctcgtttgcataggggagacc

SEQ ID NO: 537699 - DNA, 25 bp, Rattus norvegicus
tgctccgccgcagaagttttgggtt

SEQ ID NO: 537700 - DNA, 25 bp, Rattus norvegicus
gtcatttaaatacggccagccgctg

SEQ ID NO: 537701 - DNA, 25 bp, Rattus norvegicus
tgagcgccctggacacatagctgcc

SEQ ID NO: 537702 - DNA, 25 bp, Rattus norvegicus
gaattccattccctcagctcgtttg

SEQ ID NO: 537703 - DNA, 25 bp, Rattus norvegicus
tgcttttactgtaagcccggcccga

SEQ ID NO: 537704 - DNA, 25 bp, Rattus norvegicus
gtgcctggaaatgaacgtgctttta

SEQ ID NO: 537705 - DNA, 25 bp, Rattus norvegicus
ctccgtggtacagttgctttattta

SEQ ID NO: 537706 - DNA, 25 bp, Rattus norvegicus
ggaggtccaacgcagatctaagaag

SEQ ID NO: 537707 - DNA, 25 bp, Rattus norvegicus
ctccggtagctcaggatggaagtgc

SEQ ID NO: 537708 - DNA, 25 bp, Rattus norvegicus
gtgcagtggcacagggtcatttaaa

SEQ ID NO: 537709 - DNA, 25 bp, Rattus norvegicus
gggtgactttcttgcgtctccggta

SEQ ID NO: 537710 - DNA, 25 bp, Rattus norvegicus
gcgcccgctggctctatgaatgaga

SEQ ID NO: 537711 - DNA, 25 bp, Rattus norvegicus
gttacaggaccgcatacaccgagtt

SEQ ID NO: 537712 - DNA, 25 bp, Rattus norvegicus
ttagcttttaaggtccgcaccttga

SEQ ID NO: 537713 - DNA, 25 bp, Rattus norvegicus
ccgcatacaccgagtttagctttta

SEQ ID NO: 537714 - DNA, 25 bp, Rattus norvegicus
gccggacgactatgctatagcaatg

SEQ ID NO: 537715 - DNA, 25 bp, Rattus norvegicus
ttgtctgtctggcagaagcctagga

SEQ ID NO: 537716 - DNA, 25 bp, Rattus norvegicus
ttagggttgtctgtctggcagaagc

SEQ ID NO: 537717 - DNA, 25 bp, Rattus norvegicus
tgagcgctgctcagctgagttacta

SEQ ID NO: 537718 - DNA, 25 bp, Rattus norvegicus
ctcgggcatccctggacctgtgcgg

SEQ ID NO: 537719 - DNA, 25 bp, Rattus norvegicus
atccctggacctgtgcgggttgtca

SEQ ID NO: 537720 - DNA, 25 bp, Rattus norvegicus
cgggttgtcactgagccactcgacg

SEQ ID NO: 537721 - DNA, 25 bp, Rattus norvegicus
tactaagttcaaagccggacgacta

SEQ ID NO: 537722 - DNA, 25 bp, Rattus norvegicus
gctcagctgagttactaagttcaaa

SEQ ID NO: 537723 - DNA, 25 bp, Rattus norvegicus
cgactatgctatagcaatgaaaagc

SEQ ID NO: 537724 - DNA, 25 bp, Rattus norvegicus
aaggtccgcaccttgagcgctgctc

SEQ ID NO: 537725 - DNA, 25 bp, Rattus norvegicus
ggcccaccggaagtgctctgtttaa

SEQ ID NO: 537726 - DNA, 25 bp, Rattus norvegicus
agccaacggaactcctctcctgtta

SEQ ID NO: 537727 - DNA, 25 bp, Rattus norvegicus
tggggtctgaatccagacagaactc

SEQ ID NO: 537728 - DNA, 25 bp, Rattus norvegicus
gttactcgcccgcacaggaaattgg

SEQ ID NO: 537729 - DNA, 25 bp, Rattus norvegicus
tgacttccggtcagggagaggttac

SEQ ID NO: 537730 - DNA, 25 bp, Rattus norvegicus
gcccaggaccaagccgatatcattc

SEQ ID NO: 537731 - DNA, 25 bp, Rattus norvegicus
cagtgatggccgcacgccacagagc

SEQ ID NO: 537732 - DNA, 25 bp, Rattus norvegicus
agccgcccaggcagttttaatctac

SEQ ID NO: 537733 - DNA, 25 bp, Rattus norvegicus
tggagcgggacaccaagtccgttca

SEQ ID NO: 537734 - DNA, 25 bp, Rattus norvegicus
cttgctttatgagtcagtctggagc

SEQ ID NO: 537735 - DNA, 25 bp, Rattus norvegicus
tctacctcggcaggaagacttgctt

SEQ ID NO: 537736 - DNA, 25 bp, Rattus norvegicus
cccaagcggtggagaaaacgactgc

SEQ ID NO: 537737 - DNA, 25 bp, Rattus norvegicus
cacgaggacgcgcagttccactaca

SEQ ID NO: 537738 - DNA, 25 bp, Rattus norvegicus
aagtccgttcaggagcccacgagtg

SEQ ID NO: 537739 - DNA, 25 bp, Rattus norvegicus
ccacggcattctcgccacgtggagg

SEQ ID NO: 537740 - DNA, 25 bp, Rattus norvegicus
ggcattctcaccacgtggaggggca

SEQ ID NO: 537741 - DNA, 25 bp, Rattus norvegicus
ccacggcattctcaccacgtggagg

SEQ ID NO: 537742 - DNA, 25 bp, Rattus norvegicus
cggcattctcaccacgtggaggggc

SEQ ID NO: 537743 - DNA, 25 bp, Rattus norvegicus
cattctcaccacgtggaggggcagc

SEQ ID NO: 537744 - DNA, 25 bp, Rattus norvegicus
gccacggcattctcaccacgtggag

SEQ ID NO: 537745 - DNA, 25 bp, Rattus norvegicus
cggcattctcaccacgtggagggta

SEQ ID NO: 537746 - DNA, 25 bp, Rattus norvegicus
acggcattctcaccacgtggagggt

SEQ ID NO: 537747 - DNA, 25 bp, Rattus norvegicus
cgccacggcattctcgccaggtgga

SEQ ID NO: 537748 - DNA, 25 bp, Rattus norvegicus
ggcattctcaccacgtggaggggta

SEQ ID NO: 537749 - DNA, 25 bp, Rattus norvegicus
cggcattctcaccacgtggaggggt

SEQ ID NO: 537750 - DNA, 25 bp, Rattus norvegicus
tagcgccacggcattctcgccaggt

SEQ ID NO: 537751 - DNA, 25 bp, Rattus norvegicus
attctcaccacgtggagggtagcgc

SEQ ID NO: 537752 - DNA, 25 bp, Rattus norvegicus
aggggtagcgccacggcattctcac

SEQ ID NO: 537753 - DNA, 25 bp, Rattus norvegicus
agtcacggggccacgaggcggtgaa

SEQ ID NO: 537754 - DNA, 25 bp, Rattus norvegicus
ccgtggcactggtgactggtgctaa

SEQ ID NO: 537755 - DNA, 25 bp, Rattus norvegicus
ttcgcgatcgtacgtgatctctgtc

SEQ ID NO: 537756 - DNA, 25 bp, Rattus norvegicus
atcggattcgcgatcgtacgtgatc

SEQ ID NO: 537757 - DNA, 25 bp, Rattus norvegicus
caaaggaatcggattcgcgatcgta

SEQ ID NO: 537758 - DNA, 25 bp, Rattus norvegicus
cgtacgtgatctctgtcgtaaattc

SEQ ID NO: 537759 - DNA, 25 bp, Rattus norvegicus
actggtgactggtgctaacaaagga

SEQ ID NO: 537760 - DNA, 25 bp, Rattus norvegicus
cgacagacccgtggcactggtgact

SEQ ID NO: 537761 - DNA, 25 bp, Rattus norvegicus
tcttccgacagacccgtggcactgg

SEQ ID NO: 537762 - DNA, 25 bp, Rattus norvegicus
gccatgtcttccgacagacccgtgg

SEQ ID NO: 537763 - DNA, 25 bp, Rattus norvegicus
tgatctctgtcgtaaattcttgggg

SEQ ID NO: 537764 - DNA, 25 bp, Rattus norvegicus
acacgcagccatgtcttccgacaga

SEQ ID NO: 537765 - DNA, 25 bp, Rattus norvegicus
gcgatcgtacgtgatctctgtcgta

SEQ ID NO: 537766 - DNA, 25 bp, Rattus norvegicus
tggtgctaacaaaggaatcggattc

SEQ ID NO: 537767 - DNA, 25 bp, Rattus norvegicus
tctccagcagaaaggaacggaagtg

SEQ ID NO: 537768 - DNA, 25 bp, Rattus norvegicus
cagtgacctcggtcgctctgccaga

SEQ ID NO: 537769 - DNA, 25 bp, Rattus norvegicus
cgctctgccagaggggcagctcgaa

SEQ ID NO: 537770 - DNA, 25 bp, Rattus norvegicus
gggcagctcgaaggcccgacgtcct

SEQ ID NO: 537771 - DNA, 25 bp, Rattus norvegicus
gagcaaggtctggaatataatacaa

SEQ ID NO: 537772 - DNA, 25 bp, Rattus norvegicus
gcgagcagggcaaagcagtgacctc

SEQ ID NO: 537773 - DNA, 25 bp, Rattus norvegicus
tcgtggagatcaaacgcaatacttc

SEQ ID NO: 537774 - DNA, 25 bp, Rattus norvegicus
taatacaaaagagttcgtggagatc

SEQ ID NO: 537775 - DNA, 25 bp, Rattus norvegicus
tcagatatcacccagtgagcatggg

SEQ ID NO: 537776 - DNA, 25 bp, Rattus norvegicus
ggaagttccctctttggccaatcca

SEQ ID NO: 537777 - DNA, 25 bp, Rattus norvegicus
ttggccaatccaaaagcgcaatagg

SEQ ID NO: 537778 - DNA, 25 bp, Rattus norvegicus
ccaaaagcgcaataggccggtctta

SEQ ID NO: 537779 - DNA, 25 bp, Rattus norvegicus
ggccggtcttatttcagatatcacc

SEQ ID NO: 537780 - DNA, 25 bp, Rattus norvegicus
tgcgccgtcagggtctctgctagtt

SEQ ID NO: 537781 - DNA, 25 bp, Rattus norvegicus
cgttgcactggtgaccggagctaac

SEQ ID NO: 537782 - DNA, 25 bp, Rattus norvegicus
actggtgaccggagctaacaagggc

SEQ ID NO: 537783 - DNA, 25 bp, Rattus norvegicus
tggtgaccggagctaacaagggcat

SEQ ID NO: 537784 - DNA, 25 bp, Rattus norvegicus
gtgaccggagctaacaagggcatcg

SEQ ID NO: 537785 - DNA, 25 bp, Rattus norvegicus
tgaccggagctaacaagggcatcgg

SEQ ID NO: 537786 - DNA, 25 bp, Rattus norvegicus
cggagctaacaagggcatcggcttt

SEQ ID NO: 537787 - DNA, 25 bp, Rattus norvegicus
cactggtgaccggagctaacaaggg

SEQ ID NO: 537788 - DNA, 25 bp, Rattus norvegicus
agctaacaagggcatcggctttgcg

SEQ ID NO: 537789 - DNA, 25 bp, Rattus norvegicus
aattcccgggggatgtagtgctcac

SEQ ID NO: 537790 - DNA, 25 bp, Rattus norvegicus
atgtagtgctcacagcgcgggacga

SEQ ID NO: 537791 - DNA, 25 bp, Rattus norvegicus
aggactggacgtgcttgtcaacaac

SEQ ID NO: 537792 - DNA, 25 bp, Rattus norvegicus
ggactggacgtgcttgtcaacaacg

SEQ ID NO: 537793 - DNA, 25 bp, Rattus norvegicus
ttgcactggtgaccggagctaacaa

SEQ ID NO: 537794 - DNA, 25 bp, Rattus norvegicus
ccggagctaacaagggcatcggctt

SEQ ID NO: 537795 - DNA, 25 bp, Rattus norvegicus
gcggacccttcaggaacgagggctc

SEQ ID NO: 537796 - DNA, 25 bp, Rattus norvegicus
agggaccgacttctcaggccttgtt

SEQ ID NO: 537797 - DNA, 25 bp, Rattus norvegicus
caggccttgttctctagcagtcgca

SEQ ID NO: 537798 - DNA, 25 bp, Rattus norvegicus
tgttctctagcagtcgcagcgccca

SEQ ID NO: 537799 - DNA, 25 bp, Rattus norvegicus
tcgcagcgcccagttccagaatcaa

SEQ ID NO: 537800 - DNA, 25 bp, Rattus norvegicus
ttccagaatcaagtcctacgccagg

SEQ ID NO: 537801 - DNA, 25 bp, Rattus norvegicus
tcctacgccagggttctgaccacgg

SEQ ID NO: 537802 - DNA, 25 bp, Rattus norvegicus
cagggttctgaccacggcgtgaccc

SEQ ID NO: 537803 - DNA, 25 bp, Rattus norvegicus
ggtggtccgtgtgtccctctgacat

SEQ ID NO: 537804 - DNA, 25 bp, Rattus norvegicus
tggggctaacaaaggcatcggcttc

SEQ ID NO: 537805 - DNA, 25 bp, Rattus norvegicus
ctttagaagtaggtgtggggctcca

SEQ ID NO: 537806 - DNA, 25 bp, Rattus norvegicus
tgcccagccggtctgacagtccggt

SEQ ID NO: 537807 - DNA, 25 bp, Rattus norvegicus
tgcgggcatcgcctttagaagtagg

SEQ ID NO: 537808 - DNA, 25 bp, Rattus norvegicus
tgtccctctgacatgtcgtcctgca

SEQ ID NO: 537809 - DNA, 25 bp, Rattus norvegicus
cccacaccgccaaacctcctctctc

SEQ ID NO: 537810 - DNA, 25 bp, Rattus norvegicus
agacccggccttcggcgcctggaag

SEQ ID NO: 537811 - DNA, 25 bp, Rattus norvegicus
gtgtgggcttcagacccggccttcg

SEQ ID NO: 537812 - DNA, 25 bp, Rattus norvegicus
gcagccgacgggctccgtcccacgc

SEQ ID NO: 537813 - DNA, 25 bp, Rattus norvegicus
gttctccgccgaaacgctgagccgc

SEQ ID NO: 537814 - DNA, 25 bp, Rattus norvegicus
cccagtcgcctagttcccgggagtg

SEQ ID NO: 537815 - DNA, 25 bp, Rattus norvegicus
aggcatcgcccttcggtcaaggctc

SEQ ID NO: 537816 - DNA, 25 bp, Rattus norvegicus
ccgcccacccgcctagagcccggct

SEQ ID NO: 537817 - DNA, 25 bp, Rattus norvegicus
tgtctttcggtgaccagggcgcaga

SEQ ID NO: 537818 - DNA, 25 bp, Rattus norvegicus
tcaagtgtctttcggtgaccagggc

SEQ ID NO: 537819 - DNA, 25 bp, Rattus norvegicus
cgtctcaagtgtctttcggtgacca

SEQ ID NO: 537820 - DNA, 25 bp, Rattus norvegicus
tctctctccgtctcaagtgtctttc

SEQ ID NO: 537821 - DNA, 25 bp, Rattus norvegicus
accagggcgcagaggccaaaccaac

SEQ ID NO: 537822 - DNA, 25 bp, Rattus norvegicus
aggagagaggcatcgcccttcggtc

SEQ ID NO: 537823 - DNA, 25 bp, Rattus norvegicus
gtagcttactcaagatggcggtgca

SEQ ID NO: 537824 - DNA, 25 bp, Rattus norvegicus
cagccgcccacagctgttgtgggag

SEQ ID NO: 537825 - DNA, 25 bp, Rattus norvegicus
ctgtgatgcgcggtccgtgcgctcc

SEQ ID NO: 537826 - DNA, 25 bp, Rattus norvegicus
ccactcagagaagcgactgtgatgc

SEQ ID NO: 537827 - DNA, 25 bp, Rattus norvegicus
accgggatccgcctcagcgcggtga

SEQ ID NO: 537828 - DNA, 25 bp, Rattus norvegicus
gccggtcctggctttgtagcttact

SEQ ID NO: 537829 - DNA, 25 bp, Rattus norvegicus
ccaattcggctttgcccgaggcgga

SEQ ID NO: 537830 - DNA, 25 bp, Rattus norvegicus
tccggcaagcctttgactgtaaccc

SEQ ID NO: 537831 - DNA, 25 bp, Rattus norvegicus
gtccgctccggcaagcctttgactg

SEQ ID NO: 537832 - DNA, 25 bp, Rattus norvegicus
acgcatgcgccctacgcctgagggt

SEQ ID NO: 537833 - DNA, 25 bp, Rattus norvegicus
ctcaaagtgcagctactcgccgcga

SEQ ID NO: 537834 - DNA, 25 bp, Rattus norvegicus
cgcgccaatcttcaatctcaaagtg

SEQ ID NO: 537835 - DNA, 25 bp, Rattus norvegicus
cagcaggtcaggtccgctccggcaa

SEQ ID NO: 537836 - DNA, 25 bp, Rattus norvegicus
cgccatgtcgctccactcagagaag

SEQ ID NO: 537837 - DNA, 25 bp, Rattus norvegicus
gcagcacttttcaccgggacccaga

SEQ ID NO: 537838 - DNA, 25 bp, Rattus norvegicus
agatgtctgcgcttctcgctgttta

SEQ ID NO: 537839 - DNA, 25 bp, Rattus norvegicus
ctgcctgtgcgagcgttttagctga

SEQ ID NO: 537840 - DNA, 25 bp, Rattus norvegicus
cggtacactggtggaagtctctgcc

SEQ ID NO: 537841 - DNA, 25 bp, Rattus norvegicus
agcccggcttttctttctacattca

SEQ ID NO: 537842 - DNA, 25 bp, Rattus norvegicus
ctccatctggggtctttggtttctt

SEQ ID NO: 537843 - DNA, 25 bp, Rattus norvegicus
tggaagccagttcgtcccaggcagc

SEQ ID NO: 537844 - DNA, 25 bp, Rattus norvegicus
tttctacattcagggcgggcagatc

SEQ ID NO: 537845 - DNA, 25 bp, Rattus norvegicus
ttagcacgtcaacgctggaccagcc

SEQ ID NO: 537846 - DNA, 25 bp, Rattus norvegicus
ggtcccacctagcaggagctacagg

SEQ ID NO: 537847 - DNA, 25 bp, Rattus norvegicus
ggacatcctacaactcgggttagca

SEQ ID NO: 537848 - DNA, 25 bp, Rattus norvegicus
ttgataccgggtttctgagcctctg

SEQ ID NO: 537849 - DNA, 25 bp, Rattus norvegicus
tgacgcgtggtaggtaggacatcct

SEQ ID NO: 537850 - DNA, 25 bp, Rattus norvegicus
ccgagtcctagcaggtaggttcctt

SEQ ID NO: 537851 - DNA, 25 bp, Rattus norvegicus
tcccgcagcgaacgcgattattttg

SEQ ID NO: 537852 - DNA, 25 bp, Rattus norvegicus
atccataaaccgcaagtttgtcagc

SEQ ID NO: 537853 - DNA, 25 bp, Rattus norvegicus
aggctccggagatggagatcaaaaa

SEQ ID NO: 537854 - DNA, 25 bp, Rattus norvegicus
ttgcttttgtcctcaagtgggcggg

SEQ ID NO: 537855 - DNA, 25 bp, Rattus norvegicus
tgtccctaaaaggacagtgacccgc

SEQ ID NO: 537856 - DNA, 25 bp, Rattus norvegicus
agtttgtcagctaacggatgctttc

SEQ ID NO: 537857 - DNA, 25 bp, Rattus norvegicus
agtccctgtacgcacccgcggggtg

SEQ ID NO: 537858 - DNA, 25 bp, Rattus norvegicus
gccaatcccgcagcgaacgcgatta

SEQ ID NO: 537859 - DNA, 25 bp, Rattus norvegicus
acggatgctttctccgaggacggac

SEQ ID NO: 537860 - DNA, 25 bp, Rattus norvegicus
acagtgacccgcagcttgggcgaca

SEQ ID NO: 537861 - DNA, 25 bp, Rattus norvegicus
gacaggccctggaacccgcctgata

SEQ ID NO: 537862 - DNA, 25 bp, Rattus norvegicus
ccgcctgataccaacgcgtttggga

SEQ ID NO: 537863 - DNA, 25 bp, Rattus norvegicus
cgaacaaaaccagtccctgtacgca

SEQ ID NO: 537864 - DNA, 25 bp, Rattus norvegicus
cgcgattattttgcttttgtcctca

SEQ ID NO: 537865 - DNA, 25 bp, Rattus norvegicus
tgcccggagcggctaaaggcaatgt

SEQ ID NO: 537866 - DNA, 25 bp, Rattus norvegicus
ctaaaggcaatgtcccactgaactc

SEQ ID NO: 537867 - DNA, 25 bp, Rattus norvegicus
cactgaactccggacaagggctgca

SEQ ID NO: 537868 - DNA, 25 bp, Rattus norvegicus
ctgcaggtttggacagagggtaccc

SEQ ID NO: 537869 - DNA, 25 bp, Rattus norvegicus
agagggtacccatgccacccgcaaa

SEQ ID NO: 537870 - DNA, 25 bp, Rattus norvegicus
gcccgtaccgtgcaagtgcacctta

SEQ ID NO: 537871 - DNA, 25 bp, Rattus norvegicus
tgcagaacccagaaaatcccactaa

SEQ ID NO: 537872 - DNA, 25 bp, Rattus norvegicus
aatcccactaactcagaacccagtt

SEQ ID NO: 537873 - DNA, 25 bp, Rattus norvegicus
ccagttccaaagtcggaagcgcaaa

SEQ ID NO: 537874 - DNA, 25 bp, Rattus norvegicus
aagcgtgagttcctctgtgctcccg

SEQ ID NO: 537875 - DNA, 25 bp, Rattus norvegicus
cgcaaactgcccgtaccgtgcaagt

SEQ ID NO: 537876 - DNA, 25 bp, Rattus norvegicus
tgtgctcccgcctggtgcgacttcg

SEQ ID NO: 537877 - DNA, 25 bp, Rattus norvegicus
cggaagcgcaaagcgtgagttcctc

SEQ ID NO: 537878 - DNA, 25 bp, Rattus norvegicus
gtgcaccttatcactgcagaaccca

SEQ ID NO: 537879 - DNA, 25 bp, Rattus norvegicus
tctgatcctctgcttgggctgtgga

SEQ ID NO: 537880 - DNA, 25 bp, Rattus norvegicus
tcgcccgggctaaggaagcagaacc

SEQ ID NO: 537881 - DNA, 25 bp, Rattus norvegicus
gaagagcgcaccgagctcaagctcg

SEQ ID NO: 537882 - DNA, 25 bp, Rattus norvegicus
ggactaaacagtgtcgccgactgct

SEQ ID NO: 537883 - DNA, 25 bp, Rattus norvegicus
ggaagcaggtccacaccggactgtc

SEQ ID NO: 537884 - DNA, 25 bp, Rattus norvegicus
ggtccgccataaacaaacgcagttc

SEQ ID NO: 537885 - DNA, 25 bp, Rattus norvegicus
gcgcaacgggtttgcgacggactca

SEQ ID NO: 537886 - DNA, 25 bp, Rattus norvegicus
cccgtgcagaaaccgttgggtgctc

SEQ ID NO: 537887 - DNA, 25 bp, Rattus norvegicus
tggacaatgtgtcccagttcacgac

SEQ ID NO: 537888 - DNA, 25 bp, Rattus norvegicus
gttcacgacagcaagcaagcattcc

SEQ ID NO: 537889 - DNA, 25 bp, Rattus norvegicus
gtgtctcagccttctcccatcttgg

SEQ ID NO: 537890 - DNA, 25 bp, Rattus norvegicus
ttggctcaccactgctccttaagac

SEQ ID NO: 537891 - DNA, 25 bp, Rattus norvegicus
aacgcagttcggtcacacgtggacc

SEQ ID NO: 537892 - DNA, 25 bp, Rattus norvegicus
cctcttgtgaatgggtttgactttt

SEQ ID NO: 537893 - DNA, 25 bp, Rattus norvegicus
gaagctcaactgaaggccgccttgg

SEQ ID NO: 537894 - DNA, 25 bp, Rattus norvegicus
ttgcagtggacgtgacctaaggcgt

SEQ ID NO: 537895 - DNA, 25 bp, Rattus norvegicus
tctggaactcacaggccgctctctg

SEQ ID NO: 537896 - DNA, 25 bp, Rattus norvegicus
ttacaaacagcgctggagccacgca

SEQ ID NO: 537897 - DNA, 25 bp, Rattus norvegicus
gcgccctcatctacgtgctgttaca

SEQ ID NO: 537898 - DNA, 25 bp, Rattus norvegicus
tgtaaacttcttgttgcacgtccgc

SEQ ID NO: 537899 - DNA, 25 bp, Rattus norvegicus
cccggtgcctggagtgtaaacttct

SEQ ID NO: 537900 - DNA, 25 bp, Rattus norvegicus
agattgacccgtacctgaagcccta

SEQ ID NO: 537901 - DNA, 25 bp, Rattus norvegicus
gagaagggctccgaagctcaactga

SEQ ID NO: 537902 - DNA, 25 bp, Rattus norvegicus
acacgggccactcgactttctcggg

SEQ ID NO: 537903 - DNA, 25 bp, Rattus norvegicus
tctgcggctataaagggcaagtccc

SEQ ID NO: 537904 - DNA, 25 bp, Rattus norvegicus
gccgacttctggagattgacccgta

SEQ ID NO: 537905 - DNA, 25 bp, Rattus norvegicus
ttcgcgcgccaatcatgtggtgggc

SEQ ID NO: 537906 - DNA, 25 bp, Rattus norvegicus
cttccagcgcaggtaccaggggacc

SEQ ID NO: 537907 - DNA, 25 bp, Rattus norvegicus
ctccgatttgcagatccgagcttta

SEQ ID NO: 537908 - DNA, 25 bp, Rattus norvegicus
gtgttttattcgctggcagtgagcg

SEQ ID NO: 537909 - DNA, 25 bp, Rattus norvegicus
acgtgttttattcgctggcagtgag

SEQ ID NO: 537910 - DNA, 25 bp, Rattus norvegicus
cgacctctttcacacgtgttttatt

SEQ ID NO: 537911 - DNA, 25 bp, Rattus norvegicus
gcagggctgccaccgacctctttca

SEQ ID NO: 537912 - DNA, 25 bp, Rattus norvegicus
taggcttttaaacccgcagggctgc

SEQ ID NO: 537913 - DNA, 25 bp, Rattus norvegicus
cgatttgcagatccgagctttaggc

SEQ ID NO: 537914 - DNA, 25 bp, Rattus norvegicus
aggtttctccgatttgcagatccga

SEQ ID NO: 537915 - DNA, 25 bp, Rattus norvegicus
gggccaggtttctccgatttgcaga

SEQ ID NO: 537916 - DNA, 25 bp, Rattus norvegicus
cagtgaacccgggtttgtgagagcc

SEQ ID NO: 537917 - DNA, 25 bp, Rattus norvegicus
aagagtcagtgaacccgggtttgtg

SEQ ID NO: 537918 - DNA, 25 bp, Rattus norvegicus
ctgcgcaggcgtaagagtcagtgaa

SEQ ID NO: 537919 - DNA, 25 bp, Rattus norvegicus
cgcaggcgtaagagtcagtgaaccc

SEQ ID NO: 537920 - DNA, 25 bp, Rattus norvegicus
gcagatccgagctttaggcttttaa

SEQ ID NO: 537921 - DNA, 25 bp, Rattus norvegicus
agccacagcctgtttttactttgtc

SEQ ID NO: 537922 - DNA, 25 bp, Rattus norvegicus
ggcgctgcacccgaaattggtaagc

SEQ ID NO: 537923 - DNA, 25 bp, Rattus norvegicus
agggctcctccactagtgctgttgc

SEQ ID NO: 537924 - DNA, 25 bp, Rattus norvegicus
agagtcgttactccgctggcgacag

SEQ ID NO: 537925 - DNA, 25 bp, Rattus norvegicus
acagggatttggagagtcgttactc

SEQ ID NO: 537926 - DNA, 25 bp, Rattus norvegicus
gcagagcaggcctcttggaaagcca

SEQ ID NO: 537927 - DNA, 25 bp, Rattus norvegicus
acattgtcagaaagcaccgggctcc

SEQ ID NO: 537928 - DNA, 25 bp, Rattus norvegicus
gggccgagggattttgacattgtca

SEQ ID NO: 537929 - DNA, 25 bp, Rattus norvegicus
ccttcgtcagacaccgcagagaatc

SEQ ID NO: 537930 - DNA, 25 bp, Rattus norvegicus
ccggtttgtaggaaatagcggcctg

SEQ ID NO: 537931 - DNA, 25 bp, Rattus norvegicus
gctctcctgcagactccggtttgta

SEQ ID NO: 537932 - DNA, 25 bp, Rattus norvegicus
agcgagcaattgtcgccggaccgca

SEQ ID NO: 537933 - DNA, 25 bp, Rattus norvegicus
ttgtgcgcaggacctcctggcttta

SEQ ID NO: 537934 - DNA, 25 bp, Rattus norvegicus
gctgaagttttctccaccacagtgg

SEQ ID NO: 537935 - DNA, 25 bp, Rattus norvegicus
cccggccacactacctgggcgcctc

SEQ ID NO: 537936 - DNA, 25 bp, Rattus norvegicus
cgagctgcggccactaccgcgagga

SEQ ID NO: 537937 - DNA, 25 bp, Rattus norvegicus
cactaccgcgaggagccgacgctgg

SEQ ID NO: 537938 - DNA, 25 bp, Rattus norvegicus
gacgctgggctccgccaaggcagct

SEQ ID NO: 537939 - DNA, 25 bp, Rattus norvegicus
gccaaggcagctcgccaggcgtccc

SEQ ID NO: 537940 - DNA, 25 bp, Rattus norvegicus
aggcgtcccgggacacagcccgact

SEQ ID NO: 537941 - DNA, 25 bp, Rattus norvegicus
cacagcccgactggcgctggcccga

SEQ ID NO: 537942 - DNA, 25 bp, Rattus norvegicus
agctgcccttcgtgctgctcaacta

SEQ ID NO: 537943 - DNA, 25 bp, Rattus norvegicus
gcaccctcaagcttcccgagctgcg

SEQ ID NO: 537944 - DNA, 25 bp, Rattus norvegicus
cccggtcgcagcctctgcacccggc

SEQ ID NO: 537945 - DNA, 25 bp, Rattus norvegicus
tgggcgcctcggtcatcatcaccaa

SEQ ID NO: 537946 - DNA, 25 bp, Rattus norvegicus
tcggtcatcatcaccaacggcaggt

SEQ ID NO: 537947 - DNA, 25 bp, Rattus norvegicus
accaacggcaggtgacccgccaggg

SEQ ID NO: 537948 - DNA, 25 bp, Rattus norvegicus
gctgctcaactaccaccgcgtgctg

SEQ ID NO: 537949 - DNA, 25 bp, Rattus norvegicus
agggcttcccatgctccagtgcacg

SEQ ID NO: 537950 - DNA, 25 bp, Rattus norvegicus
actctaggtgccacgagggatgtcc

SEQ ID NO: 537951 - DNA, 25 bp, Rattus norvegicus
ggccatcaccctccgacgggaccag

SEQ ID NO: 537952 - DNA, 25 bp, Rattus norvegicus
acgggaccagaagctagcccacgga

SEQ ID NO: 537953 - DNA, 25 bp, Rattus norvegicus
aatgctgccgccgtgccggatctac

SEQ ID NO: 537954 - DNA, 25 bp, Rattus norvegicus
cccacggaaactctaggtgccacga

SEQ ID NO: 537955 - DNA, 25 bp, Rattus norvegicus
tggctctcgccgacgcagaagacgc

SEQ ID NO: 537956 - DNA, 25 bp, Rattus norvegicus
tgccacgagggatgtccctgctaca

SEQ ID NO: 537957 - DNA, 25 bp, Rattus norvegicus
agggatgtccctgctacagctgcag

SEQ ID NO: 537958 - DNA, 25 bp, Rattus norvegicus
tgctacagctgcaggaccggagaca

SEQ ID NO: 537959 - DNA, 25 bp, Rattus norvegicus
gcccacggccaacagcgcgcagcag

SEQ ID NO: 537960 - DNA, 25 bp, Rattus norvegicus
gcagcagggcttcccatgctccagt

SEQ ID NO: 537961 - DNA, 25 bp, Rattus norvegicus
atgctccagtgcacgcgtgggctgt

SEQ ID NO: 537962 - DNA, 25 bp, Rattus norvegicus
cagaagctagcccacggaaactcta

SEQ ID NO: 537963 - DNA, 25 bp, Rattus norvegicus
ctcgcttacctcgtagcctggggcg

SEQ ID NO: 537964 - DNA, 25 bp, Rattus norvegicus
gcgggaatgcgcactgcgccaagca

SEQ ID NO: 537965 - DNA, 25 bp, Rattus norvegicus
tgcctcgcgtgccagacacatttgc

SEQ ID NO: 537966 - DNA, 25 bp, Rattus norvegicus
gacacatttgcctcggggtaccatc

SEQ ID NO: 537967 - DNA, 25 bp, Rattus norvegicus
ttgcctcggggtaccatcctgcggc

SEQ ID NO: 537968 - DNA, 25 bp, Rattus norvegicus
agagcggcgcctcgcttacctcgta

SEQ ID NO: 537969 - DNA, 25 bp, Rattus norvegicus
cggcggcacgcatgcgcaatgaaag

SEQ ID NO: 537970 - DNA, 25 bp, Rattus norvegicus
caatgaaagtggagcgaggtttccc

SEQ ID NO: 537971 - DNA, 25 bp, Rattus norvegicus
cgccgaagccagattcgcaacgcta

SEQ ID NO: 537972 - DNA, 25 bp, Rattus norvegicus
gcaacgctatggctgctgaccgcca

SEQ ID NO: 537973 - DNA, 25 bp, Rattus norvegicus
cacctacgctgcagtgccgggacga

SEQ ID NO: 537974 - DNA, 25 bp, Rattus norvegicus
cagtgccgggacgacgtacaggcca

SEQ ID NO: 537975 - DNA, 25 bp, Rattus norvegicus
ggcgagttcccgacacattccagag

SEQ ID NO: 537976 - DNA, 25 bp, Rattus norvegicus
gttcccgacacattccagagcggcg

SEQ ID NO: 537977 - DNA, 25 bp, Rattus norvegicus
ggccagaaaggtgagggtgtccaac

SEQ ID NO: 537978 - DNA, 25 bp, Rattus norvegicus
gatgatcccgggaggccaccgctgc

SEQ ID NO: 537979 - DNA, 25 bp, Rattus norvegicus
agggacgcatctcccactgtccggg

SEQ ID NO: 537980 - DNA, 25 bp, Rattus norvegicus
gaggcgcagggacgcatctcccact

SEQ ID NO: 537981 - DNA, 25 bp, Rattus norvegicus
gggactcgcgcgacgcccgcaccat

SEQ ID NO: 537982 - DNA, 25 bp, Rattus norvegicus
ctgtttttaaacctggcgcggagcg

SEQ ID NO: 537983 - DNA, 25 bp, Rattus norvegicus
agcctttctggtctccaccttctgc

SEQ ID NO: 537984 - DNA, 25 bp, Rattus norvegicus
cgctctcttccttgagcctttctgg

SEQ ID NO: 537985 - DNA, 25 bp, Rattus norvegicus
ttcttttgtctcttctccacacaca

SEQ ID NO: 537986 - DNA, 25 bp, Rattus norvegicus
tgcggggtcctaagcttcccgctcc

SEQ ID NO: 537987 - DNA, 25 bp, Rattus norvegicus
ctgtcgtccgcctgcggggtcctaa

SEQ ID NO: 537988 - DNA, 25 bp, Rattus norvegicus
gctcgtagccgccacccgtcatccc

SEQ ID NO: 537989 - DNA, 25 bp, Rattus norvegicus
ccacgagttgctgttgctcgggagt

SEQ ID NO: 537990 - DNA, 25 bp, Rattus norvegicus
ggcagcaggcccacgagttgctgtt

SEQ ID NO: 537991 - DNA, 25 bp, Rattus norvegicus
ctgcggggaaaaagcgcacctcgga

SEQ ID NO: 537992 - DNA, 25 bp, Rattus norvegicus
gagtcctgcccgctcacgaagggct

SEQ ID NO: 537993 - DNA, 25 bp, Rattus norvegicus
gaagggctctctccctgcctacgtg

SEQ ID NO: 537994 - DNA, 25 bp, Rattus norvegicus
cctgcctacgtgacgttcaaagaaa

SEQ ID NO: 537995 - DNA, 25 bp, Rattus norvegicus
agccctggacctagagtccttcaag

SEQ ID NO: 537996 - DNA, 25 bp, Rattus norvegicus
tcaggagcggctcagcgctcgctct

SEQ ID NO: 537997 - DNA, 25 bp, Rattus norvegicus
ctcggaccctctgagacgaggaagg

SEQ ID NO: 537998 - DNA, 25 bp, Rattus norvegicus
ggctcgcccgcattgttcctatgct

SEQ ID NO: 537999 - DNA, 25 bp, Rattus norvegicus
ccgcagccgagatgcctgggcatcg

SEQ ID NO: 538000 - DNA, 25 bp, Rattus norvegicus
tccctttgtccggtgttcctcgtgc

SEQ ID NO: 538001 - DNA, 25 bp, Rattus norvegicus
tgttcctcgtgcgtccgtaacggta

SEQ ID NO: 538002 - DNA, 25 bp, Rattus norvegicus
gcttttggtgcgcatcgcctggcgc

SEQ ID NO: 538003 - DNA, 25 bp, Rattus norvegicus
ctgcctcatccggagcgctcggaga

SEQ ID NO: 538004 - DNA, 25 bp, Rattus norvegicus
tatgctcgcccttccctgcggtggt

SEQ ID NO: 538005 - DNA, 25 bp, Rattus norvegicus
gtgctggcgacgtcattaaggcctg

SEQ ID NO: 538006 - DNA, 25 bp, Rattus norvegicus
gggacgccgagctggcccccaccca

SEQ ID NO: 538007 - DNA, 25 bp, Rattus norvegicus
agtgctggcgacgtcattaaggcct

SEQ ID NO: 538008 - DNA, 25 bp, Rattus norvegicus
tgctggcgacgtcattaaggcctgg

SEQ ID NO: 538009 - DNA, 25 bp, Rattus norvegicus
ctggcgacgtcattaaggcctgggc

SEQ ID NO: 538010 - DNA, 25 bp, Rattus norvegicus
agcagtgctggcgacgtcattaagg

SEQ ID NO: 538011 - DNA, 25 bp, Rattus norvegicus
cttgtcctacgcctgcgcaggggct

SEQ ID NO: 538012 - DNA, 25 bp, Rattus norvegicus
ttgtcctacgcctgcgcaggggctg

SEQ ID NO: 538013 - DNA, 25 bp, Rattus norvegicus
ctgctgctcagcagtgctggcgacg

SEQ ID NO: 538014 - DNA, 25 bp, Rattus norvegicus
ctgctcagcagtgctggcgacgtca

SEQ ID NO: 538015 - DNA, 25 bp, Rattus norvegicus
gctcagcagtgctggcgacgtcatt

SEQ ID NO: 538016 - DNA, 25 bp, Rattus norvegicus
ctcagcagtgctggcgacgtcatta

SEQ ID NO: 538017 - DNA, 25 bp, Rattus norvegicus
cagtgctggcgacgtcattaaggcc

SEQ ID NO: 538018 - DNA, 25 bp, Rattus norvegicus
agccttgtcctacgcctgcgcaggg

SEQ ID NO: 538019 - DNA, 25 bp, Rattus norvegicus
cccggcgtgatacactttattcgct

SEQ ID NO: 538020 - DNA, 25 bp, Rattus norvegicus
tctgggtattctccaggcgcctagc

SEQ ID NO: 538021 - DNA, 25 bp, Rattus norvegicus
gcgccaggccaaggtttcaggaagc

SEQ ID NO: 538022 - DNA, 25 bp, Rattus norvegicus
tccgggccgtagagtccaggccaac

SEQ ID NO: 538023 - DNA, 25 bp, Rattus norvegicus
ttccggaatgctgaagggagctctc

SEQ ID NO: 538024 - DNA, 25 bp, Rattus norvegicus
cttagcacggagaggacacgaaacc

SEQ ID NO: 538025 - DNA, 25 bp, Rattus norvegicus
ctccttccgcagtgttggcacgtga

SEQ ID NO: 538026 - DNA, 25 bp, Rattus norvegicus
ctactacacaggacaggaacgcagg

SEQ ID NO: 538027 - DNA, 25 bp, Rattus norvegicus
taatcttgatgtccagagtagtccc

SEQ ID NO: 538028 - DNA, 25 bp, Rattus norvegicus
ggaaaccgcggagcttgaagcccga

SEQ ID NO: 538029 - DNA, 25 bp, Rattus norvegicus
tggaatcccgctcggtgttcagtgc

SEQ ID NO: 538030 - DNA, 25 bp, Rattus norvegicus
cgctaacgacctgccggctgctgat

SEQ ID NO: 538031 - DNA, 25 bp, Rattus norvegicus
ggattatccacaaaggccgcaactt

SEQ ID NO: 538032 - DNA, 25 bp, Rattus norvegicus
gcgaggccgcttctcagcgtttttt

SEQ ID NO: 538033 - DNA, 25 bp, Rattus norvegicus
ggctagtatagttgtacactctctg

SEQ ID NO: 538034 - DNA, 25 bp, Rattus norvegicus
tctgaagaaacaatcaaggctagta

SEQ ID NO: 538035 - DNA, 25 bp, Rattus norvegicus
gcagagtcatgtgtctgaagaaaca

SEQ ID NO: 538036 - DNA, 25 bp, Rattus norvegicus
tgccaggagtgcagagtcatgtgtc

SEQ ID NO: 538037 - DNA, 25 bp, Rattus norvegicus
gatcaacgatcatgctctgccagga

SEQ ID NO: 538038 - DNA, 25 bp, Rattus norvegicus
gaggactgacatatgatcaacgatc

SEQ ID NO: 538039 - DNA, 25 bp, Rattus norvegicus
aggtagggaggactgacatatgatc

SEQ ID NO: 538040 - DNA, 25 bp, Rattus norvegicus
acggcggcctctcccggcagaaggt

SEQ ID NO: 538041 - DNA, 25 bp, Rattus norvegicus
cggatgccggcgatcgtcgtcgcct

SEQ ID NO: 538042 - DNA, 25 bp, Rattus norvegicus
cattccgatggagaagccggggaac

SEQ ID NO: 538043 - DNA, 25 bp, Rattus norvegicus
gttggtcctggcagggcattccgat

SEQ ID NO: 538044 - DNA, 25 bp, Rattus norvegicus
ccgaggtgacttatgacaggcaaga

SEQ ID NO: 538045 - DNA, 25 bp, Rattus norvegicus
atcgggaaaccgaggtgacttatga

SEQ ID NO: 538046 - DNA, 25 bp, Rattus norvegicus
ggccaagtgggcaaattaagaatcg

SEQ ID NO: 538047 - DNA, 25 bp, Rattus norvegicus
tgggcaaggacaatgcacgggttca

SEQ ID NO: 538048 - DNA, 25 bp, Rattus norvegicus
ccagacctccactggccgcccgggc

SEQ ID NO: 538049 - DNA, 25 bp, Rattus norvegicus
ttctgggcaaggacaatgcacgggt

SEQ ID NO: 538050 - DNA, 25 bp, Rattus norvegicus
ctgggcaaggacaatgcacgggttc

SEQ ID NO: 538051 - DNA, 25 bp, Rattus norvegicus
ggcaaggacaatgcacgggttcaga

SEQ ID NO: 538052 - DNA, 25 bp, Rattus norvegicus
ctgggagtcgaggacgcagggcccg

SEQ ID NO: 538053 - DNA, 25 bp, Rattus norvegicus
cccagccggcgaaggtcggcagcct

SEQ ID NO: 538054 - DNA, 25 bp, Rattus norvegicus
gcgaaggtcggcagcctgctgtctg

SEQ ID NO: 538055 - DNA, 25 bp, Rattus norvegicus
tgctgtctgtgaggcccagtgggcc

SEQ ID NO: 538056 - DNA, 25 bp, Rattus norvegicus
gatccggtgtgcttggaagtcgggc

SEQ ID NO: 538057 - DNA, 25 bp, Rattus norvegicus
gtgcttggaagtcgggcggccagca

SEQ ID NO: 538058 - DNA, 25 bp, Rattus norvegicus
cagcacgggcgacccagggcaccct

SEQ ID NO: 538059 - DNA, 25 bp, Rattus norvegicus
aagttgaggcgggtgggacccgctg

SEQ ID NO: 538060 - DNA, 25 bp, Rattus norvegicus
gcaaggacaatgcacgggttcagaa

SEQ ID NO: 538061 - DNA, 25 bp, Rattus norvegicus
acgctcggcgtagcgctggacttca

SEQ ID NO: 538062 - DNA, 25 bp, Rattus norvegicus
gcctgggagtcacctaccgtcgcaa

SEQ ID NO: 538063 - DNA, 25 bp, Rattus norvegicus
cgtcgcaacccttcgatgagcggtc

SEQ ID NO: 538064 - DNA, 25 bp, Rattus norvegicus
tgagcggtcgccaccgtcgcaacat

SEQ ID NO: 538065 - DNA, 25 bp, Rattus norvegicus
aacatcgtctacctgctgggccgca

SEQ ID NO: 538066 - DNA, 25 bp, Rattus norvegicus
tctggagtgggactctctcaagttc

SEQ ID NO: 538067 - DNA, 25 bp, Rattus norvegicus
tggcataacaacacgcagacggtgc

SEQ ID NO: 538068 - DNA, 25 bp, Rattus norvegicus
actcgtggatgtgcctgggagtcac

SEQ ID NO: 538069 - DNA, 25 bp, Rattus norvegicus
ccggctgcctgtccttctatggcgt

SEQ ID NO: 538070 - DNA, 25 bp, Rattus norvegicus
tcatggtcagcagcggagcctcgct

SEQ ID NO: 538071 - DNA, 25 bp, Rattus norvegicus
gagcctcgctcacactcaagcagta

SEQ ID NO: 538072 - DNA, 25 bp, Rattus norvegicus
gctgctaataaagttagactctacg

SEQ ID NO: 538073 - DNA, 25 bp, Rattus norvegicus
tctacgtaccgctaggcaggagttc

SEQ ID NO: 538074 - DNA, 25 bp, Rattus norvegicus
ctcaagttctccgtgtggcataaca

SEQ ID NO: 538075 - DNA, 25 bp, Rattus norvegicus
cagcgtgagagcagaaacttcagac

SEQ ID NO: 538076 - DNA, 25 bp, Rattus norvegicus
gcgagcctcggtagcatccaattcc

SEQ ID NO: 538077 - DNA, 25 bp, Rattus norvegicus
ccgaagcttccaggagcacggagta

SEQ ID NO: 538078 - DNA, 25 bp, Rattus norvegicus
ggagcacggagtaagactagccacc

SEQ ID NO: 538079 - DNA, 25 bp, Rattus norvegicus
agcttggttccgaggtgtgtaacgc

SEQ ID NO: 538080 - DNA, 25 bp, Rattus norvegicus
caactttgcaatcgccgcgcagcgg

SEQ ID NO: 538081 - DNA, 25 bp, Rattus norvegicus
catctgcggtcctgttgcggtccct

SEQ ID NO: 538082 - DNA, 25 bp, Rattus norvegicus
ccgcatcccgcgagtgatgggaaca

SEQ ID NO: 538083 - DNA, 25 bp, Rattus norvegicus
ttcgctccctcctggtgcgcagagt

SEQ ID NO: 538084 - DNA, 25 bp, Rattus norvegicus
tactcactggctctccggtagacgg

SEQ ID NO: 538085 - DNA, 25 bp, Rattus norvegicus
ctccggtagacggaggagcactttt

SEQ ID NO: 538086 - DNA, 25 bp, Rattus norvegicus
ggggtgcatctctccatttgctctc

SEQ ID NO: 538087 - DNA, 25 bp, Rattus norvegicus
cccacgagctgtcgagccgaaagga

SEQ ID NO: 538088 - DNA, 25 bp, Rattus norvegicus
ttcagacgctgtagctcccagcgga

SEQ ID NO: 538089 - DNA, 25 bp, Rattus norvegicus
tgcaagtgtgaatggagatcctcta

SEQ ID NO: 538090 - DNA, 25 bp, Rattus norvegicus
cagggtgctgagtggctcagctcct

SEQ ID NO: 538091 - DNA, 25 bp, Rattus norvegicus
tgctgagtggctcagctcctggtgt

SEQ ID NO: 538092 - DNA, 25 bp, Rattus norvegicus
gggaagctctggttcccgccaatca

SEQ ID NO: 538093 - DNA, 25 bp, Rattus norvegicus
tggttcccgccaatcactgagcagg

SEQ ID NO: 538094 - DNA, 25 bp, Rattus norvegicus
cccgccaatcactgagcagggctgg

SEQ ID NO: 538095 - DNA, 25 bp, Rattus norvegicus
tgcaaatgcgcgtgggcgtgcaagt

SEQ ID NO: 538096 - DNA, 25 bp, Rattus norvegicus
aatggagatcctctatgtgacggga

SEQ ID NO: 538097 - DNA, 25 bp, Rattus norvegicus
atcctctatgtgacgggactgcgtg

SEQ ID NO: 538098 - DNA, 25 bp, Rattus norvegicus
atgcggggaccaggtgcaaatgcgc

SEQ ID NO: 538099 - DNA, 25 bp, Rattus norvegicus
cccgcgtgtgcccacgcacatgccg

SEQ ID NO: 538100 - DNA, 25 bp, Rattus norvegicus
ctatgtgacgggactgcgtgtactc

SEQ ID NO: 538101 - DNA, 25 bp, Rattus norvegicus
gtctgtccagctcgtgggtgcccgc

SEQ ID NO: 538102 - DNA, 25 bp, Rattus norvegicus
gccgggcagcactgactctcagggt

SEQ ID NO: 538103 - DNA, 25 bp, Rattus norvegicus
taagagtcttttcacgtcggaggga

SEQ ID NO: 538104 - DNA, 25 bp, Rattus norvegicus
gtggacaccactaaggcccgccagt

SEQ ID NO: 538105 - DNA, 25 bp, Rattus norvegicus
tgctgagcacggagtggacaccact

SEQ ID NO: 538106 - DNA, 25 bp, Rattus norvegicus
gttacttcctccaccgcggtgctga

SEQ ID NO: 538107 - DNA, 25 bp, Rattus norvegicus
ggatcgggctggttacttcctccac

SEQ ID NO: 538108 - DNA, 25 bp, Rattus norvegicus
ggttcctaggcacccagtggcctca

SEQ ID NO: 538109 - DNA, 25 bp, Rattus norvegicus
ttgttttagggaagccagtggtcgc

SEQ ID NO: 538110 - DNA, 25 bp, Rattus norvegicus
gaaatcaggacccacacgtagctcc

SEQ ID NO: 538111 - DNA, 25 bp, Rattus norvegicus
ggagcctctccagctggttcctagg

SEQ ID NO: 538112 - DNA, 25 bp, Rattus norvegicus
gtagctccaaacacaggaccggttc

SEQ ID NO: 538113 - DNA, 25 bp, Rattus norvegicus
cttctagctgaacctcctgggcaca

SEQ ID NO: 538114 - DNA, 25 bp, Rattus norvegicus
ccagcttggacctgcagacggccgt

SEQ ID NO: 538115 - DNA, 25 bp, Rattus norvegicus
gaagcctaaccactcaatccaagtg

SEQ ID NO: 538116 - DNA, 25 bp, Rattus norvegicus
ggaccggttctaccgcagaagccta

SEQ ID NO: 538117 - DNA, 25 bp, Rattus norvegicus
gacacgcggcgtaacctaaagcgta

SEQ ID NO: 538118 - DNA, 25 bp, Rattus norvegicus
ttgtcagcgtcccagcgtgaacgca

SEQ ID NO: 538119 - DNA, 25 bp, Rattus norvegicus
tcccagcgtgaacgcagggcactcg

SEQ ID NO: 538120 - DNA, 25 bp, Rattus norvegicus
tcggcaggccaacaccgcctgatgc

SEQ ID NO: 538121 - DNA, 25 bp, Rattus norvegicus
cggagcctgacctcttccgcgcaag

SEQ ID NO: 538122 - DNA, 25 bp, Rattus norvegicus
tcctcagtcccagctcggcatggcc

SEQ ID NO: 538123 - DNA, 25 bp, Rattus norvegicus
ttcaccacctcaccaaagaacgtag

SEQ ID NO: 538124 - DNA, 25 bp, Rattus norvegicus
ccaaagaacgtagcagccatggcac

SEQ ID NO: 538125 - DNA, 25 bp, Rattus norvegicus
aggccacgccctcagcctgggtgaa

SEQ ID NO: 538126 - DNA, 25 bp, Rattus norvegicus
gcctgggtgaaggtctcagaacttc

SEQ ID NO: 538127 - DNA, 25 bp, Rattus norvegicus
aggtctcagaacttccggtccgccg

SEQ ID NO: 538128 - DNA, 25 bp, Rattus norvegicus
cagaacttccggtccgccgcgggat

SEQ ID NO: 538129 - DNA, 25 bp, Rattus norvegicus
ttccgtcaccctgctgacccgggca

SEQ ID NO: 538130 - DNA, 25 bp, Rattus norvegicus
aagcattgctgggttgtcagcgtcc

SEQ ID NO: 538131 - DNA, 25 bp, Rattus norvegicus
gcgggcgatgaggaagtacagctct

SEQ ID NO: 538132 - DNA, 25 bp, Rattus norvegicus
cgcgtcttacccgactcgatgagag

SEQ ID NO: 538133 - DNA, 25 bp, Rattus norvegicus
ggccgcgtcttacccgactcgatga

SEQ ID NO: 538134 - DNA, 25 bp, Rattus norvegicus
ttacccgactcgatgagaggcaccg

SEQ ID NO: 538135 - DNA, 25 bp, Rattus norvegicus
cgactcgatgagaggcaccggacgt

SEQ ID NO: 538136 - DNA, 25 bp, Rattus norvegicus
gtcgggctggcgaaggctccgccat

SEQ ID NO: 538137 - DNA, 25 bp, Rattus norvegicus
accgacgcgtccgcggcaggaagta

SEQ ID NO: 538138 - DNA, 25 bp, Rattus norvegicus
cacgacgcggatgtggctggcgccc

SEQ ID NO: 538139 - DNA, 25 bp, Rattus norvegicus
tgcgcgtcggggacgtgaagcgcaa

SEQ ID NO: 538140 - DNA, 25 bp, Rattus norvegicus
ggtcacctgggctcgccctgaagac

SEQ ID NO: 538141 - DNA, 25 bp, Rattus norvegicus
tggagcagcagaggctacgtcacca

SEQ ID NO: 538142 - DNA, 25 bp, Rattus norvegicus
gcagcagaggctacgtcaccacctg

SEQ ID NO: 538143 - DNA, 25 bp, Rattus norvegicus
aaggcgtcccgtgcgggtgatggaa

SEQ ID NO: 538144 - DNA, 25 bp, Rattus norvegicus
ccagctgagaggtagcgggcgatga

SEQ ID NO: 538145 - DNA, 25 bp, Rattus norvegicus
cgggcttctggcaaaagacaaatta

SEQ ID NO: 538146 - DNA, 25 bp, Rattus norvegicus
cctggcgcgagctagatacttacgg

SEQ ID NO: 538147 - DNA, 25 bp, Rattus norvegicus
atacttacggccgacagcctcgcgg

SEQ ID NO: 538148 - DNA, 25 bp, Rattus norvegicus
aaagaccgggttagcgactcagtga

SEQ ID NO: 538149 - DNA, 25 bp, Rattus norvegicus
tctgcgctaacctgcaggagaaagc

SEQ ID NO: 538150 - DNA, 25 bp, Rattus norvegicus
gctcaccttcctcttgggcatcgtg

SEQ ID NO: 538151 - DNA, 25 bp, Rattus norvegicus
acgttggatctgtcacggagctgca

SEQ ID NO: 538152 - DNA, 25 bp, Rattus norvegicus
cccgaataggcgcagcgaactgtca

SEQ ID NO: 538153 - DNA, 25 bp, Rattus norvegicus
agcgaactgtcactccaccgtattg

SEQ ID NO: 538154 - DNA, 25 bp, Rattus norvegicus
ctaggtagtttgtttgaagccgaca

SEQ ID NO: 538155 - DNA, 25 bp, Rattus norvegicus
agccgacagcaaaagtgcggtctgc

SEQ ID NO: 538156 - DNA, 25 bp, Rattus norvegicus
tcacgtggtcgcagcatcgttttcc

SEQ ID NO: 538157 - DNA, 25 bp, Rattus norvegicus
gcaggatttgccattagcccgggga

SEQ ID NO: 538158 - DNA, 25 bp, Rattus norvegicus
tttcggtttcgcgtccaccttggca

SEQ ID NO: 538159 - DNA, 25 bp, Rattus norvegicus
agttgacgacgctgtctcccaggcg

SEQ ID NO: 538160 - DNA, 25 bp, Rattus norvegicus
tgtcctcgtttgtaagtagttgtag

SEQ ID NO: 538161 - DNA, 25 bp, Rattus norvegicus
agcccggaaggcgaaaggcgaagct

SEQ ID NO: 538162 - DNA, 25 bp, Rattus norvegicus
gcaggcgcagttgacgacgctgtct

SEQ ID NO: 538163 - DNA, 25 bp, Rattus norvegicus
acgctgtctcccaggcgctgtcgta

SEQ ID NO: 538164 - DNA, 25 bp, Rattus norvegicus
tcccaggcgctgtcgtagcgtagca

SEQ ID NO: 538165 - DNA, 25 bp, Rattus norvegicus
tgggatccagaatgagcgcgtccga

SEQ ID NO: 538166 - DNA, 25 bp, Rattus norvegicus
tgagcgcgtccgagacagatcgctg

SEQ ID NO: 538167 - DNA, 25 bp, Rattus norvegicus
tgctgtgcttcgtgttcgggtgcaa

SEQ ID NO: 538168 - DNA, 25 bp, Rattus norvegicus
ggtgcaacgtgctgcgcatccttct

SEQ ID NO: 538169 - DNA, 25 bp, Rattus norvegicus
aacgtgctgcgcatccttctgccga

SEQ ID NO: 538170 - DNA, 25 bp, Rattus norvegicus
cttctgccgaccttgtcctcgtttg

SEQ ID NO: 538171 - DNA, 25 bp, Rattus norvegicus
tgccgaccttgtcctcgtttgtaag

SEQ ID NO: 538172 - DNA, 25 bp, Rattus norvegicus
tccttgcggtgttgccgtagtcgca

SEQ ID NO: 538173 - DNA, 25 bp, Rattus norvegicus
gcctcggtgaaggagtagtgcttac

SEQ ID NO: 538174 - DNA, 25 bp, Rattus norvegicus
agctcctccatgaggctgctctttc

SEQ ID NO: 538175 - DNA, 25 bp, Rattus norvegicus
ttctgtcgcggaatgccgtcgccct

SEQ ID NO: 538176 - DNA, 25 bp, Rattus norvegicus
ggtcctggccgccttgccgaatgag

SEQ ID NO: 538177 - DNA, 25 bp, Rattus norvegicus
cttgccgaatgagggctcgtagcca

SEQ ID NO: 538178 - DNA, 25 bp, Rattus norvegicus
gggctcgtagccagcaggctccagc

SEQ ID NO: 538179 - DNA, 25 bp, Rattus norvegicus
tgcatggtccgcatctcctgcatca

SEQ ID NO: 538180 - DNA, 25 bp, Rattus norvegicus
tacccgaggcttgtctgcaggaggt

SEQ ID NO: 538181 - DNA, 25 bp, Rattus norvegicus
agtgcttacgtgaccgcggggtctt

SEQ ID NO: 538182 - DNA, 25 bp, Rattus norvegicus
tcgctgtcctcgacgacatcgcgga

SEQ ID NO: 538183 - DNA, 25 bp, Rattus norvegicus
ggacatcgccggcatcacttgcatg

SEQ ID NO: 538184 - DNA, 25 bp, Rattus norvegicus
cggcatcacttgcatggtccgcatc

SEQ ID NO: 538185 - DNA, 25 bp, Rattus norvegicus
ggctgctctttctgtcgcggaatgc

SEQ ID NO: 538186 - DNA, 25 bp, Rattus norvegicus
tcgctgcggtgcttgcccgtgcagt

SEQ ID NO: 538187 - DNA, 25 bp, Rattus norvegicus
atgcaccacagagattcggggttcc

SEQ ID NO: 538188 - DNA, 25 bp, Rattus norvegicus
cctgagtgaaccgagagacccgcgt

SEQ ID NO: 538189 - DNA, 25 bp, Rattus norvegicus
atacgcatgcgtacttggcactgtg

SEQ ID NO: 538190 - DNA, 25 bp, Rattus norvegicus
acctctagcttgtgtatacgcatgc

SEQ ID NO: 538191 - DNA, 25 bp, Rattus norvegicus
gggcctcctgggacctctagcttgt

SEQ ID NO: 538192 - DNA, 25 bp, Rattus norvegicus
ggctacgttaccagctccgccaaag

SEQ ID NO: 538193 - DNA, 25 bp, Rattus norvegicus
tccgccaaagcaaggcgaggtcgga

SEQ ID NO: 538194 - DNA, 25 bp, Rattus norvegicus
cgggcgtcgccatggaaaccacgca

SEQ ID NO: 538195 - DNA, 25 bp, Rattus norvegicus
atggaaaccacgcagggcctcctgg

SEQ ID NO: 538196 - DNA, 25 bp, Rattus norvegicus
ttccgaagcaccgaggcttgggccc

SEQ ID NO: 538197 - DNA, 25 bp, Rattus norvegicus
caggggtggaaggaaaagcacacct

SEQ ID NO: 538198 - DNA, 25 bp, Rattus norvegicus
acggatgcaaaacgctccatggggc

SEQ ID NO: 538199 - DNA, 25 bp, Rattus norvegicus
ctagtaaggcggttcagacggatgc

SEQ ID NO: 538200 - DNA, 25 bp, Rattus norvegicus
cctgcgaggtggtgaatgcaccaca

SEQ ID NO: 538201 - DNA, 25 bp, Rattus norvegicus
tcagagtccctaagcgcattgccgc

SEQ ID NO: 538202 - DNA, 25 bp, Rattus norvegicus
tccaggggcccagactctgactgac

SEQ ID NO: 538203 - DNA, 25 bp, Rattus norvegicus
ctccatagcgtagctcgcagagctg

SEQ ID NO: 538204 - DNA, 25 bp, Rattus norvegicus
gttcctgctgcttctccatagcgta

SEQ ID NO: 538205 - DNA, 25 bp, Rattus norvegicus
cagcacactcgggaggcgggacctt

SEQ ID NO: 538206 - DNA, 25 bp, Rattus norvegicus
cagggaagatgctctggccagcaca

SEQ ID NO: 538207 - DNA, 25 bp, Rattus norvegicus
tctgcgcaaatgctggtgccaggga

SEQ ID NO: 538208 - DNA, 25 bp, Rattus norvegicus
ggctcgcaccgggagtaaattcaaa

SEQ ID NO: 538209 - DNA, 25 bp, Rattus norvegicus
ttctaagctccagccggacgacggt

SEQ ID NO: 538210 - DNA, 25 bp, Rattus norvegicus
aaacgcgggactctgcggtttggct

SEQ ID NO: 538211 - DNA, 25 bp, Rattus norvegicus
ggtcttccggaggtcactgaggtct

SEQ ID NO: 538212 - DNA, 25 bp, Rattus norvegicus
caaataccagtccagcttgcggctg

SEQ ID NO: 538213 - DNA, 25 bp, Rattus norvegicus
ctgcgggagtcaagtgcacctcctc

SEQ ID NO: 538214 - DNA, 25 bp, Rattus norvegicus
agactctgactgaccggctgctgct

SEQ ID NO: 538215 - DNA, 25 bp, Rattus norvegicus
gcttagctgcctcgaagagagctca

SEQ ID NO: 538216 - DNA, 25 bp, Rattus norvegicus
accgcagcaagcaccgaggatgcca

SEQ ID NO: 538217 - DNA, 25 bp, Rattus norvegicus
gggtctccgcggagcaccgcagcaa

SEQ ID NO: 538218 - DNA, 25 bp, Rattus norvegicus
tcgaagtcagctagcacgccgtcca

SEQ ID NO: 538219 - DNA, 25 bp, Rattus norvegicus
aaccctgcagaaggccggactcgaa

SEQ ID NO: 538220 - DNA, 25 bp, Rattus norvegicus
aagcgacggcggaaaccctgcagaa

SEQ ID NO: 538221 - DNA, 25 bp, Rattus norvegicus
ctgttccagcggcacatgcggttcc

SEQ ID NO: 538222 - DNA, 25 bp, Rattus norvegicus
agagagctcaaaactagaggttccc

SEQ ID NO: 538223 - DNA, 25 bp, Rattus norvegicus
gaactgtgaattcgcacagcttagc

SEQ ID NO: 538224 - DNA, 25 bp, Rattus norvegicus
gaggatgccagacccggaaacaagc

SEQ ID NO: 538225 - DNA, 25 bp, Rattus norvegicus
gcgcgttgtgtgagtaccctgtcaa

SEQ ID NO: 538226 - DNA, 25 bp, Rattus norvegicus
gtacgtgttcgtacgcgcgcgttgt

SEQ ID NO: 538227 - DNA, 25 bp, Rattus norvegicus
taccctgtcaagctttctggttcgg

SEQ ID NO: 538228 - DNA, 25 bp, Rattus norvegicus
ctccgtactgctcgctggcgaggaa

SEQ ID NO: 538229 - DNA, 25 bp, Rattus norvegicus
ttcttggctatggtggacaatcttc

SEQ ID NO: 538230 - DNA, 25 bp, Rattus norvegicus
ttgcactccagtttccctgggaaga

SEQ ID NO: 538231 - DNA, 25 bp, Rattus norvegicus
catccttgaccttggccacggagga

SEQ ID NO: 538232 - DNA, 25 bp, Rattus norvegicus
cagcggcagagaacttgctcaactc

SEQ ID NO: 538233 - DNA, 25 bp, Rattus norvegicus
gccaaggaccgcagaaccgcgcgtt

SEQ ID NO: 538234 - DNA, 25 bp, Rattus norvegicus
ggggccgcgaaccacagagcctcaa

SEQ ID NO: 538235 - DNA, 25 bp, Rattus norvegicus
agggctaccgccaacttcttggcta

SEQ ID NO: 538236 - DNA, 25 bp, Rattus norvegicus
cgcggctactacctggagatgctga

SEQ ID NO: 538237 - DNA, 25 bp, Rattus norvegicus
tacctggagatgctgattgggaccc

SEQ ID NO: 538238 - DNA, 25 bp, Rattus norvegicus
ccctccgcagaaggtaggatgtggt

SEQ ID NO: 538239 - DNA, 25 bp, Rattus norvegicus
tggggtgtctaggaattgactccgc

SEQ ID NO: 538240 - DNA, 25 bp, Rattus norvegicus
tgactccgcgtggtttaatgtcgcc

SEQ ID NO: 538241 - DNA, 25 bp, Rattus norvegicus
gtcatatccgttagccgtggcctcc

SEQ ID NO: 538242 - DNA, 25 bp, Rattus norvegicus
gcctcaactgttcccgggctcggga

SEQ ID NO: 538243 - DNA, 25 bp, Rattus norvegicus
gcagagagctgaaacaccggcactt

SEQ ID NO: 538244 - DNA, 25 bp, Rattus norvegicus
ctgcgtgcactcaccattgtggttg

SEQ ID NO: 538245 - DNA, 25 bp, Rattus norvegicus
tagcacccttaagaggcggaacgcc

SEQ ID NO: 538246 - DNA, 25 bp, Rattus norvegicus
ccaggttggcttcaagagcttcatt

SEQ ID NO: 538247 - DNA, 25 bp, Rattus norvegicus
cgctgggctcgattgcatgcataaa

SEQ ID NO: 538248 - DNA, 25 bp, Rattus norvegicus
ccatcaactcgagctattgggcatc

SEQ ID NO: 538249 - DNA, 25 bp, Rattus norvegicus
ggctccgagtccagcttagtaacta

SEQ ID NO: 538250 - DNA, 25 bp, Rattus norvegicus
tgcagtgtccaggtctctagttcta

SEQ ID NO: 538251 - DNA, 25 bp, Rattus norvegicus
atcccgtcaggcaatgcagtgtcca

SEQ ID NO: 538252 - DNA, 25 bp, Rattus norvegicus
ctggcaaagtcttgagatcccgtca

SEQ ID NO: 538253 - DNA, 25 bp, Rattus norvegicus
aaggcgggaatactctgctggcacc

SEQ ID NO: 538254 - DNA, 25 bp, Rattus norvegicus
agagcttcattgttcggccgctgcc

SEQ ID NO: 538255 - DNA, 25 bp, Rattus norvegicus
tctagttctacatccgcggctccga

SEQ ID NO: 538256 - DNA, 25 bp, Rattus norvegicus
tgaggcctgacagaccttacccggt

SEQ ID NO: 538257 - DNA, 25 bp, Rattus norvegicus
ccggccgatacaggcccgggtgact

SEQ ID NO: 538258 - DNA, 25 bp, Rattus norvegicus
ctccggacagtggagccggccgata

SEQ ID NO: 538259 - DNA, 25 bp, Rattus norvegicus
acttgggacagaagcgctccggaca

SEQ ID NO: 538260 - DNA, 25 bp, Rattus norvegicus
tggataccacttgggacagaagcgc

SEQ ID NO: 538261 - DNA, 25 bp, Rattus norvegicus
aggcggctcgtaattatggatacca

SEQ ID NO: 538262 - DNA, 25 bp, Rattus norvegicus
gctaagaagaaaagaggcggctcgt

SEQ ID NO: 538263 - DNA, 25 bp, Rattus norvegicus
gccgcttcttttcctgaaccttaca

SEQ ID NO: 538264 - DNA, 25 bp, Rattus norvegicus
ccgaaaggcatacgagtcatgactc

SEQ ID NO: 538265 - DNA, 25 bp, Rattus norvegicus
tcatgactcggacaagctaagaaga

SEQ ID NO: 538266 - DNA, 25 bp, Rattus norvegicus
agctcaccatgactgacagcgcttg

SEQ ID NO: 538267 - DNA, 25 bp, Rattus norvegicus
acagcgcttggtgatgccgcttctt

SEQ ID NO: 538268 - DNA, 25 bp, Rattus norvegicus
tgaaccttacaatagaaacccagag

SEQ ID NO: 538269 - DNA, 25 bp, Rattus norvegicus
atagaaacccagagctccctcttcg

SEQ ID NO: 538270 - DNA, 25 bp, Rattus norvegicus
agcgccaggggcagctctggcatca

SEQ ID NO: 538271 - DNA, 25 bp, Rattus norvegicus
ccgcaaggagttctacgagctagtc

SEQ ID NO: 538272 - DNA, 25 bp, Rattus norvegicus
gccggagtaacgatgttgcttcttt

SEQ ID NO: 538273 - DNA, 25 bp, Rattus norvegicus
cgagctagtccacaaccaggtgact

SEQ ID NO: 538274 - DNA, 25 bp, Rattus norvegicus
cgtgaccgatttccgcaaggagttc

SEQ ID NO: 538275 - DNA, 25 bp, Rattus norvegicus
gctgtggctatgttcgtgaccgatt

SEQ ID NO: 538276 - DNA, 25 bp, Rattus norvegicus
cagctctaggtatccggccgctgtg

SEQ ID NO: 538277 - DNA, 25 bp, Rattus norvegicus
tgtctcagcgccagctctaggtatc

SEQ ID NO: 538278 - DNA, 25 bp, Rattus norvegicus
acctccgggctgtcggtgtctcagc

SEQ ID NO: 538279 - DNA, 25 bp, Rattus norvegicus
tggaccaatcggaagagctgtgatt

SEQ ID NO: 538280 - DNA, 25 bp, Rattus norvegicus
aactattggctgctggcgtggacca

SEQ ID NO: 538281 - DNA, 25 bp, Rattus norvegicus
ggaaagactaagaactattggctgc

SEQ ID NO: 538282 - DNA, 25 bp, Rattus norvegicus
ctgcgaatcgcagagcattattggc

SEQ ID NO: 538283 - DNA, 25 bp, Rattus norvegicus
ggcggatcttatccagctgcgaatc

SEQ ID NO: 538284 - DNA, 25 bp, Rattus norvegicus
atttggcgggagtcttgaggacctc

SEQ ID NO: 538285 - DNA, 25 bp, Rattus norvegicus
ggcttcccacatcggtctttccgaa

SEQ ID NO: 538286 - DNA, 25 bp, Rattus norvegicus
actttgcattgcatgtgcccggtgc

SEQ ID NO: 538287 - DNA, 25 bp, Rattus norvegicus
gcgccagcacagactcatacacttt

SEQ ID NO: 538288 - DNA, 25 bp, Rattus norvegicus
tgagcgccggtcaaggtaacaaaga

SEQ ID NO: 538289 - DNA, 25 bp, Rattus norvegicus
gtgccagaagcccacacagggcata

SEQ ID NO: 538290 - DNA, 25 bp, Rattus norvegicus
cccggactacgatgttggcgaacca

SEQ ID NO: 538291 - DNA, 25 bp, Rattus norvegicus
ccggcaccgttggatcatagaactc

SEQ ID NO: 538292 - DNA, 25 bp, Rattus norvegicus
gcgcccagctcgtacttctgagaca

SEQ ID NO: 538293 - DNA, 25 bp, Rattus norvegicus
cttgactggaaaactgaactctgga

SEQ ID NO: 538294 - DNA, 25 bp, Rattus norvegicus
ccttggtgctgagtacttgactgga

SEQ ID NO: 538295 - DNA, 25 bp, Rattus norvegicus
ccgcccttagacgtagttcttcttg

SEQ ID NO: 538296 - DNA, 25 bp, Rattus norvegicus
gcaattcagcggtggtcgtcatcca

SEQ ID NO: 538297 - DNA, 25 bp, Rattus norvegicus
taacttgcctcggagtctgcgctgc

SEQ ID NO: 538298 - DNA, 25 bp, Rattus norvegicus
cttcttgtcgtaatcgccgttggcc

SEQ ID NO: 538299 - DNA, 25 bp, Rattus norvegicus
atcatatcgcggcagacccggatgg

SEQ ID NO: 538300 - DNA, 25 bp, Rattus norvegicus
tgcagatcgcccacgtataaggagg

SEQ ID NO: 538301 - DNA, 25 bp, Rattus norvegicus
cggagtgcagatcgcccacgtataa

SEQ ID NO: 538302 - DNA, 25 bp, Rattus norvegicus
tcgcccacgtataaggaggccatgg

SEQ ID NO: 538303 - DNA, 25 bp, Rattus norvegicus
ccacgtataaggaggccatggggta

SEQ ID NO: 538304 - DNA, 25 bp, Rattus norvegicus
agctgctggccgcagcgttcatctc

SEQ ID NO: 538305 - DNA, 25 bp, Rattus norvegicus
cgccaggacttcttgcagggcctac

SEQ ID NO: 538306 - DNA, 25 bp, Rattus norvegicus
cttgcagggcctactgcaggacaaa

SEQ ID NO: 538307 - DNA, 25 bp, Rattus norvegicus
cagcgcacaggtggcaccagcgacg

SEQ ID NO: 538308 - DNA, 25 bp, Rattus norvegicus
acaaaaggggctccgaagagctgtg

SEQ ID NO: 538309 - DNA, 25 bp, Rattus norvegicus
ctactgcaggacaaaaggggctccg

SEQ ID NO: 538310 - DNA, 25 bp, Rattus norvegicus
gagtgcgggacgacttacaccggac

SEQ ID NO: 538311 - DNA, 25 bp, Rattus norvegicus
agacccggatggacagcacaggccc

SEQ ID NO: 538312 - DNA, 25 bp, Rattus norvegicus
cttcggtgacatcggagtgcagatc

SEQ ID NO: 538313 - DNA, 25 bp, Rattus norvegicus
tggcgctgttggaaatcactttaaa

SEQ ID NO: 538314 - DNA, 25 bp, Rattus norvegicus
agagaaagcgaaggccggtcaaccg

SEQ ID NO: 538315 - DNA, 25 bp, Rattus norvegicus
cgcctgcgtgcagagaccaaactcg

SEQ ID NO: 538316 - DNA, 25 bp, Rattus norvegicus
agagaccaaactcgcgcctttgctg

SEQ ID NO: 538317 - DNA, 25 bp, Rattus norvegicus
cagtgcgcatgcgtgagctttccgg

SEQ ID NO: 538318 - DNA, 25 bp, Rattus norvegicus
tggcctcgtgcattgtcactaccca

SEQ ID NO: 538319 - DNA, 25 bp, Rattus norvegicus
ctcgagtctggcctcgtgcattgtc

SEQ ID NO: 538320 - DNA, 25 bp, Rattus norvegicus
cgatgccacctagagctcgagtctg

SEQ ID NO: 538321 - DNA, 25 bp, Rattus norvegicus
gtcccaataggaagacgatgccacc

SEQ ID NO: 538322 - DNA, 25 bp, Rattus norvegicus
gcactgggtcccaataggaagacga

SEQ ID NO: 538323 - DNA, 25 bp, Rattus norvegicus
tcgcgtgcataacgccgcgcgtgcg

SEQ ID NO: 538324 - DNA, 25 bp, Rattus norvegicus
ggtagacaaacaccgcactgcgcct

SEQ ID NO: 538325 - DNA, 25 bp, Rattus norvegicus
tcagtcccgggtagacaaacaccgc

SEQ ID NO: 538326 - DNA, 25 bp, Rattus norvegicus
tcaaccgcacgcctgcgtgcagaga

SEQ ID NO: 538327 - DNA, 25 bp, Rattus norvegicus
ccgcaatgtgctcccatctcggaaa

SEQ ID NO: 538328 - DNA, 25 bp, Rattus norvegicus
caacgctgcgaagcccgcgtcccgg

SEQ ID NO: 538329 - DNA, 25 bp, Rattus norvegicus
ttgtcctctcaccaacgctgcgaag

SEQ ID NO: 538330 - DNA, 25 bp, Rattus norvegicus
caatgagacgctgggaaggtcgccc

SEQ ID NO: 538331 - DNA, 25 bp, Rattus norvegicus
cccttggcaatgagacgctgggaag

SEQ ID NO: 538332 - DNA, 25 bp, Rattus norvegicus
gcgtggacgcccttggcaatgagac

SEQ ID NO: 538333 - DNA, 25 bp, Rattus norvegicus
atgtgctcccatctcggaaaggcga

SEQ ID NO: 538334 - DNA, 25 bp, Rattus norvegicus
tcccatctcggaaaggcgacctgga

SEQ ID NO: 538335 - DNA, 25 bp, Rattus norvegicus
tctcggaaaggcgacctggagctgt

SEQ ID NO: 538336 - DNA, 25 bp, Rattus norvegicus
agctgtgcagcgaagaccctggcct

SEQ ID NO: 538337 - DNA, 25 bp, Rattus norvegicus
tgtgcagcgaagaccctggcctcga

SEQ ID NO: 538338 - DNA, 25 bp, Rattus norvegicus
acccgcgacccgctaccgcgctggg

SEQ ID NO: 538339 - DNA, 25 bp, Rattus norvegicus
gacgaccctgcggtctccgacttgt

SEQ ID NO: 538340 - DNA, 25 bp, Rattus norvegicus
gacgcccttggcaatgagacgctgg

SEQ ID NO: 538341 - DNA, 25 bp, Rattus norvegicus
ggaaaagtgaactccaccctcctgc

SEQ ID NO: 538342 - DNA, 25 bp, Rattus norvegicus
aaagcctggagctggcgtagaacgc

SEQ ID NO: 538343 - DNA, 25 bp, Rattus norvegicus
ccgcaggcccgaaaagcctggagct

SEQ ID NO: 538344 - DNA, 25 bp, Rattus norvegicus
agtgcacgaccgtgctgggcgctac

SEQ ID NO: 538345 - DNA, 25 bp, Rattus norvegicus
ccaaatgcaggccatcaagtgtgtg

SEQ ID NO: 538346 - DNA, 25 bp, Rattus norvegicus
cacggagcggcccaaatgcaggcca

SEQ ID NO: 538347 - DNA, 25 bp, Rattus norvegicus
cttccagtccgctgagggccaggcg

SEQ ID NO: 538348 - DNA, 25 bp, Rattus norvegicus
tgtgctcgccttccagtccgctgag

SEQ ID NO: 538349 - DNA, 25 bp, Rattus norvegicus
ctgcagttttcctcagctttgggtg

SEQ ID NO: 538350 - DNA, 25 bp, Rattus norvegicus
agcggccatttcctgtttctctgca

SEQ ID NO: 538351 - DNA, 25 bp, Rattus norvegicus
gatgtgagtggagcggccatttcct

SEQ ID NO: 538352 - DNA, 25 bp, Rattus norvegicus
tgccgactgtttccgagctttcccg

SEQ ID NO: 538353 - DNA, 25 bp, Rattus norvegicus
ttagcgtgccaaaatggcggacgcc

SEQ ID NO: 538354 - DNA, 25 bp, Rattus norvegicus
gccctgctctggttggcacgtagac

SEQ ID NO: 538355 - DNA, 25 bp, Rattus norvegicus
agcgcatggccctcttgtgggacaa

SEQ ID NO: 538356 - DNA, 25 bp, Rattus norvegicus
ccggcgaagatgactccacaagctc

SEQ ID NO: 538357 - DNA, 25 bp, Rattus norvegicus
tgtctgagcgcagaaaaccgacttg

SEQ ID NO: 538358 - DNA, 25 bp, Rattus norvegicus
gagacccgatctctcctttgttagg

SEQ ID NO: 538359 - DNA, 25 bp, Rattus norvegicus
cactttgagaagaggacgctgatcc

SEQ ID NO: 538360 - DNA, 25 bp, Rattus norvegicus
ccggcgagtcaccacgaggaaaaga

SEQ ID NO: 538361 - DNA, 25 bp, Rattus norvegicus
aagagcctgcagaccagccggatca

SEQ ID NO: 538362 - DNA, 25 bp, Rattus norvegicus
tcaagggctcagatttgctcgcaga

SEQ ID NO: 538363 - DNA, 25 bp, Rattus norvegicus
ggtagactggccctgaaaacgccga

SEQ ID NO: 538364 - DNA, 25 bp, Rattus norvegicus
gctgttcctgctgttagggtctaca

SEQ ID NO: 538365 - DNA, 25 bp, Rattus norvegicus
ctcagccatcgctcccggggaaaaa

SEQ ID NO: 538366 - DNA, 25 bp, Rattus norvegicus
tccaacctgctgtacggcaaagggc

SEQ ID NO: 538367 - DNA, 25 bp, Rattus norvegicus
ggtggctgaaagacgatccttccgc

SEQ ID NO: 538368 - DNA, 25 bp, Rattus norvegicus
gggagacaagcccaccatcctgatc

SEQ ID NO: 538369 - DNA, 25 bp, Rattus norvegicus
ttaccacagcacacgcaggaacagc

SEQ ID NO: 538370 - DNA, 25 bp, Rattus norvegicus
caggaacagctcaaaagacccgggg

SEQ ID NO: 538371 - DNA, 25 bp, Rattus norvegicus
cgcaccctagggctgcagcgcttaa

SEQ ID NO: 538372 - DNA, 25 bp, Rattus norvegicus
aggaggcgcgacttttgtcgcttta

SEQ ID NO: 538373 - DNA, 25 bp, Rattus norvegicus
tagctagggaccagcgccggccgaa

SEQ ID NO: 538374 - DNA, 25 bp, Rattus norvegicus
gaacaccaggtcgtcgctagctagg

SEQ ID NO: 538375 - DNA, 25 bp, Rattus norvegicus
tctgactctgcgcttgtccggaggg

SEQ ID NO: 538376 - DNA, 25 bp, Rattus norvegicus
tttgtcgctttaaccagcgcgtccc

SEQ ID NO: 538377 - DNA, 25 bp, Rattus norvegicus
cggctgcccgttaagcaccgaggag

SEQ ID NO: 538378 - DNA, 25 bp, Rattus norvegicus
tcctaggtgcagaacgattgtgctc

SEQ ID NO: 538379 - DNA, 25 bp, Rattus norvegicus
gagactccacctatatcctaggtgc

SEQ ID NO: 538380 - DNA, 25 bp, Rattus norvegicus
ggcacacagagactccacctatatc

SEQ ID NO: 538381 - DNA, 25 bp, Rattus norvegicus
gacccttgtcaaaggcacacagaga

SEQ ID NO: 538382 - DNA, 25 bp, Rattus norvegicus
tgcagcgcttaagtccgggaccctt

SEQ ID NO: 538383 - DNA, 25 bp, Rattus norvegicus
caagcctccgaacgaccaagagatg

SEQ ID NO: 538384 - DNA, 25 bp, Rattus norvegicus
aggacccagagtcctccgcaatttc

SEQ ID NO: 538385 - DNA, 25 bp, Rattus norvegicus
ggccgtgagcaaccggaccctacat

SEQ ID NO: 538386 - DNA, 25 bp, Rattus norvegicus
gggcagttacgctagcgctctctga

SEQ ID NO: 538387 - DNA, 25 bp, Rattus norvegicus
agcgctctctgagcccgaacggatc

SEQ ID NO: 538388 - DNA, 25 bp, Rattus norvegicus
tgtgcacacgggagaggttttgtta

SEQ ID NO: 538389 - DNA, 25 bp, Rattus norvegicus
cgtctccagggtttccgcccaggtg

SEQ ID NO: 538390 - DNA, 25 bp, Rattus norvegicus
ccaagagatgaatgggtcggccgaa

SEQ ID NO: 538391 - DNA, 25 bp, Rattus norvegicus
gctcaccagcacaggagcgcgtctt

SEQ ID NO: 538392 - DNA, 25 bp, Rattus norvegicus
gagcgcgtcttccagatcttcagca

SEQ ID NO: 538393 - DNA, 25 bp, Rattus norvegicus
cttcagcagtaggatgacgatggcc

SEQ ID NO: 538394 - DNA, 25 bp, Rattus norvegicus
cccagtcagccggaagatgttcatg

SEQ ID NO: 538395 - DNA, 25 bp, Rattus norvegicus
agcgactcaggacgcggcgacagcc

SEQ ID NO: 538396 - DNA, 25 bp, Rattus norvegicus
aacggatcaagttcgcgagcggacc

SEQ ID NO: 538397 - DNA, 25 bp, Rattus norvegicus
ccggtgcttcttggggatgaagatc

SEQ ID NO: 538398 - DNA, 25 bp, Rattus norvegicus
gaccgcccagcagcgaggccgcctt

SEQ ID NO: 538399 - DNA, 25 bp, Rattus norvegicus
aagaaccgaccaccgagtcaggcgc

SEQ ID NO: 538400 - DNA, 25 bp, Rattus norvegicus
gcaaggcaagaaccgaccaccgagt

SEQ ID NO: 538401 - DNA, 25 bp, Rattus norvegicus
gatcctgcaaggcaagaaccgacca

SEQ ID NO: 538402 - DNA, 25 bp, Rattus norvegicus
cttcttggggatgaagatcctgcaa

SEQ ID NO: 538403 - DNA, 25 bp, Rattus norvegicus
aggagaccctgagacaccacctcgt

SEQ ID NO: 538404 - DNA, 25 bp, Rattus norvegicus
agcacggcacagcttgcccaggaga

SEQ ID NO: 538405 - DNA, 25 bp, Rattus norvegicus
gccctgcgccctccgagcacggcac

SEQ ID NO: 538406 - DNA, 25 bp, Rattus norvegicus
cggctccggcgcaaacgctgcgcgc

SEQ ID NO: 538407 - DNA, 25 bp, Rattus norvegicus
gcacgccgtgcgtacctgcgaggac

SEQ ID NO: 538408 - DNA, 25 bp, Rattus norvegicus
tggacactaagaggcgttccggacg

SEQ ID NO: 538409 - DNA, 25 bp, Rattus norvegicus
tgagacaccacctcgtcaaagcgcg

SEQ ID NO: 538410 - DNA, 25 bp, Rattus norvegicus
acactaagaggcgttccggacgctc

SEQ ID NO: 538411 - DNA, 25 bp, Rattus norvegicus
cggagcccgcgatgacagagagggc

SEQ ID NO: 538412 - DNA, 25 bp, Rattus norvegicus
gattccacgcgcctttgctgggcga

SEQ ID NO: 538413 - DNA, 25 bp, Rattus norvegicus
gaacgcgatggggaagctacctaaa

SEQ ID NO: 538414 - DNA, 25 bp, Rattus norvegicus
gcagaacgcgatggggaagctacct

SEQ ID NO: 538415 - DNA, 25 bp, Rattus norvegicus
ggacgcgaggcaagaggttcccagg

SEQ ID NO: 538416 - DNA, 25 bp, Rattus norvegicus
cccatctggatctgcgagggcggtg

SEQ ID NO: 538417 - DNA, 25 bp, Rattus norvegicus
tggtccttccccatctggatctgcg

SEQ ID NO: 538418 - DNA, 25 bp, Rattus norvegicus
ccacgcgcctttgctgggcgagcgt

SEQ ID NO: 538419 - DNA, 25 bp, Rattus norvegicus
tcccggccagtctccgcaccgtggc

SEQ ID NO: 538420 - DNA, 25 bp, Rattus norvegicus
agtgccgagagaagccctggtcctt

SEQ ID NO: 538421 - DNA, 25 bp, Rattus norvegicus
tgacagagagggcgcccgcgattcc

SEQ ID NO: 538422 - DNA, 25 bp, Rattus norvegicus
gaagctacctaaagtgccgagagaa

SEQ ID NO: 538423 - DNA, 25 bp, Rattus norvegicus
ggggaagctacctaaagtgccgaga

SEQ ID NO: 538424 - DNA, 25 bp, Rattus norvegicus
cgatggggaagctacctaaagtgcc

SEQ ID NO: 538425 - DNA, 25 bp, Rattus norvegicus
acgcaccaagttccctggggacagc

SEQ ID NO: 538426 - DNA, 25 bp, Rattus norvegicus
ttgacacccgctggcgacacaggct

SEQ ID NO: 538427 - DNA, 25 bp, Rattus norvegicus
ggcctggagacaaacgcaccaagtt

SEQ ID NO: 538428 - DNA, 25 bp, Rattus norvegicus
ccgcagcaccgagatgaaaccggga

SEQ ID NO: 538429 - DNA, 25 bp, Rattus norvegicus
atcctcccgctgagtctggcctgga

SEQ ID NO: 538430 - DNA, 25 bp, Rattus norvegicus
ctgagcgatcctcccgctgagtctg

SEQ ID NO: 538431 - DNA, 25 bp, Rattus norvegicus
ggaaatctgagcgatcctcccgctg

SEQ ID NO: 538432 - DNA, 25 bp, Rattus norvegicus
gctttttccactagaccacctcctc

SEQ ID NO: 538433 - DNA, 25 bp, Rattus norvegicus
tctgatcctcagctgacaggggcct

SEQ ID NO: 538434 - DNA, 25 bp, Rattus norvegicus
tgaaaccgggaaatctgagcgatcc

SEQ ID NO: 538435 - DNA, 25 bp, Rattus norvegicus
cgaaaagcagagaggcagacgccgc

SEQ ID NO: 538436 - DNA, 25 bp, Rattus norvegicus
agacgccgccgctgtcccgagagag

SEQ ID NO: 538437 - DNA, 25 bp, Rattus norvegicus
gagacaaacgcaccaagttccctgg

SEQ ID NO: 538438 - DNA, 25 bp, Rattus norvegicus
atcctcagctgacaggggcctctcg

SEQ ID NO: 538439 - DNA, 25 bp, Rattus norvegicus
caccgaggctgggtggcactcgagg

SEQ ID NO: 538440 - DNA, 25 bp, Rattus norvegicus
ctgtcaaggctgtggggccaccctc

SEQ ID NO: 538441 - DNA, 25 bp, Rattus norvegicus
gcactcgagggcagcgccgagccaa

SEQ ID NO: 538442 - DNA, 25 bp, Rattus norvegicus
agttcgcggcccagagggaagctgc

SEQ ID NO: 538443 - DNA, 25 bp, Rattus norvegicus
gaagctgcggccaaatcgcgggctt

SEQ ID NO: 538444 - DNA, 25 bp, Rattus norvegicus
ctgcggccaaatcgcgggcttagcc

SEQ ID NO: 538445 - DNA, 25 bp, Rattus norvegicus
ccaaatcgcgggcttagccaggctg

SEQ ID NO: 538446 - DNA, 25 bp, Rattus norvegicus
gcgggcttagccaggctgctgtcaa

SEQ ID NO: 538447 - DNA, 25 bp, Rattus norvegicus
agccaagcgcacaagctgctcacag

SEQ ID NO: 538448 - DNA, 25 bp, Rattus norvegicus
tagccaggctgctgtcaaggctgtg

SEQ ID NO: 538449 - DNA, 25 bp, Rattus norvegicus
gcgcacaagctgctcacagctcagg

SEQ ID NO: 538450 - DNA, 25 bp, Rattus norvegicus
cacccacggccagaccctccacttc

SEQ ID NO: 538451 - DNA, 25 bp, Rattus norvegicus
caccctcggggcctgggagcacacc

SEQ ID NO: 538452 - DNA, 25 bp, Rattus norvegicus
agcgccgagccaagcgcacaagctg

SEQ ID NO: 538453 - DNA, 25 bp, Rattus norvegicus
tgtttccgtcggaagtcgcctctat

SEQ ID NO: 538454 - DNA, 25 bp, Rattus norvegicus
ctcccgctactgtttccgtcggaag

SEQ ID NO: 538455 - DNA, 25 bp, Rattus norvegicus
aaacccagtaatctcctgcctcccg

SEQ ID NO: 538456 - DNA, 25 bp, Rattus norvegicus
ctcgcagaacgagaggccaaaccca

SEQ ID NO: 538457 - DNA, 25 bp, Rattus norvegicus
taacatgctcgcagaacgagaggcc

SEQ ID NO: 538458 - DNA, 25 bp, Rattus norvegicus
tagtttcgggaggttctgtgatatc

SEQ ID NO: 538459 - DNA, 25 bp, Rattus norvegicus
aagtcgcctctatcgcgggcactga

SEQ ID NO: 538460 - DNA, 25 bp, Rattus norvegicus
ggtcagctggcagcggctgacagtt

SEQ ID NO: 538461 - DNA, 25 bp, Rattus norvegicus
tgacagttggccaggcttggggtaa

SEQ ID NO: 538462 - DNA, 25 bp, Rattus norvegicus
tctatcgcgggcactgatgacgcca

SEQ ID NO: 538463 - DNA, 25 bp, Rattus norvegicus
cactgatgacgccatggacgcgccg

SEQ ID NO: 538464 - DNA, 25 bp, Rattus norvegicus
ggtacgaaacataacatgctcgcag

SEQ ID NO: 538465 - DNA, 25 bp, Rattus norvegicus
atgacgccatggacgcgccggaagt

SEQ ID NO: 538466 - DNA, 25 bp, Rattus norvegicus
cgccggaagtctccgggagcgctca

SEQ ID NO: 538467 - DNA, 25 bp, Rattus norvegicus
agtccagcggcgttcttcagccgcg

SEQ ID NO: 538468 - DNA, 25 bp, Rattus norvegicus
ttcagccgcgtgcccgtttctcaag

SEQ ID NO: 538469 - DNA, 25 bp, Rattus norvegicus
tccagcggcgttcttcagccgcgtg

SEQ ID NO: 538470 - DNA, 25 bp, Rattus norvegicus
tgcccatcgtggacaagggctcggt

SEQ ID NO: 538471 - DNA, 25 bp, Rattus norvegicus
cgctgcccatcgtggacaagggctc

SEQ ID NO: 538472 - DNA, 25 bp, Rattus norvegicus
ggccctgcagtccagcggcgttctt

SEQ ID NO: 538473 - DNA, 25 bp, Rattus norvegicus
cgccgctgcccatcgtggacaaggg

SEQ ID NO: 538474 - DNA, 25 bp, Rattus norvegicus
acaagggctcggtggagctgctgga

SEQ ID NO: 538475 - DNA, 25 bp, Rattus norvegicus
aggagttcgtgttccaggtgcccaa

SEQ ID NO: 538476 - DNA, 25 bp, Rattus norvegicus
agttcgtgttccaggtgcccaagga

SEQ ID NO: 538477 - DNA, 25 bp, Rattus norvegicus
cgtgttccaggtgcccaaggagcgc

SEQ ID NO: 538478 - DNA, 25 bp, Rattus norvegicus
ccatgccctcgctcggtgacaggcg

SEQ ID NO: 538479 - DNA, 25 bp, Rattus norvegicus
gtgacaggcgctcgccccgaggtct

SEQ ID NO: 538480 - DNA, 25 bp, Rattus norvegicus
cgaggtctcgctcctctttcagccc

SEQ ID NO: 538481 - DNA, 25 bp, Rattus norvegicus
ggaggcgcgcctcttttctcagcac

SEQ ID NO: 538482 - DNA, 25 bp, Rattus norvegicus
tccctaggcactgtggcctgaaacc

SEQ ID NO: 538483 - DNA, 25 bp, Rattus norvegicus
ggggtcagctctttgtcttccggag

SEQ ID NO: 538484 - DNA, 25 bp, Rattus norvegicus
gatcgctggcataggggaccaggct

SEQ ID NO: 538485 - DNA, 25 bp, Rattus norvegicus
aacgcgtgctgtgagcaggtggatc

SEQ ID NO: 538486 - DNA, 25 bp, Rattus norvegicus
atggtgcccacaggcggaggtgaac

SEQ ID NO: 538487 - DNA, 25 bp, Rattus norvegicus
agctctttgtcttccggagcccgtt

SEQ ID NO: 538488 - DNA, 25 bp, Rattus norvegicus
cggccaagctccctaggcactgtgg

SEQ ID NO: 538489 - DNA, 25 bp, Rattus norvegicus
tccgctctctctacccgaagctggg

SEQ ID NO: 538490 - DNA, 25 bp, Rattus norvegicus
cggagaacgagtgcgcgcatcctcc

SEQ ID NO: 538491 - DNA, 25 bp, Rattus norvegicus
ctcccggctctggacggagaacgag

SEQ ID NO: 538492 - DNA, 25 bp, Rattus norvegicus
tttctcagcaccctcggcacgctcc

SEQ ID NO: 538493 - DNA, 25 bp, Rattus norvegicus
ctttgtcttccggagcccgttcgcg

SEQ ID NO: 538494 - DNA, 25 bp, Rattus norvegicus
cacgctcccggctctggacggagaa

SEQ ID NO: 538495 - DNA, 25 bp, Rattus norvegicus
ctggggctcatcctgttcgaccaca

SEQ ID NO: 538496 - DNA, 25 bp, Rattus norvegicus
agctcgcactggaccgcttggccca

SEQ ID NO: 538497 - DNA, 25 bp, Rattus norvegicus
ttgaggagatcaacagactcgctga

SEQ ID NO: 538498 - DNA, 25 bp, Rattus norvegicus
cccgcttgttgaggagatcaacaga

SEQ ID NO: 538499 - DNA, 25 bp, Rattus norvegicus
agactcgctgacgaactgaaccctc

SEQ ID NO: 538500 - DNA, 25 bp, Rattus norvegicus
cgaccacatggtcccgcttgttgag

SEQ ID NO: 538501 - DNA, 25 bp, Rattus norvegicus
gctgacgaactgaaccctctcaatg

SEQ ID NO: 538502 - DNA, 25 bp, Rattus norvegicus
gctcatcctgttcgaccacatggtc

SEQ ID NO: 538503 - DNA, 25 bp, Rattus norvegicus
gagaagaacctgtacgggcgcctgg

SEQ ID NO: 538504 - DNA, 25 bp, Rattus norvegicus
catggtcccgcttgttgaggagatc

SEQ ID NO: 538505 - DNA, 25 bp, Rattus norvegicus
ctctcaatgcctcccaggagatcga

SEQ ID NO: 538506 - DNA, 25 bp, Rattus norvegicus
tgcctcccaggagatcgagctcgca

SEQ ID NO: 538507 - DNA, 25 bp, Rattus norvegicus
cccaggagatcgagctcgcactgga

SEQ ID NO: 538508 - DNA, 25 bp, Rattus norvegicus
gatcaacagactcgctgacgaactg

SEQ ID NO: 538509 - DNA, 25 bp, Rattus norvegicus
gattctccctttttacatcggcaga

SEQ ID NO: 538510 - DNA, 25 bp, Rattus norvegicus
ggattgcccgagcacacaccattga

SEQ ID NO: 538511 - DNA, 25 bp, Rattus norvegicus
cgctctcaactgagggacatcccga

SEQ ID NO: 538512 - DNA, 25 bp, Rattus norvegicus
atcggcagattaacgttcgactgta

SEQ ID NO: 538513 - DNA, 25 bp, Rattus norvegicus
tcctttgctgtcacggagaaataca

SEQ ID NO: 538514 - DNA, 25 bp, Rattus norvegicus
ttcgtgcaaatcttcccgtacgctg

SEQ ID NO: 538515 - DNA, 25 bp, Rattus norvegicus
ccgcagttcagcaaaatcaaatgtt

SEQ ID NO: 538516 - DNA, 25 bp, Rattus norvegicus
cctcgaaataagagtcggggccaga

SEQ ID NO: 538517 - DNA, 25 bp, Rattus norvegicus
gtgcccggagactgatgctcatccc

SEQ ID NO: 538518 - DNA, 25 bp, Rattus norvegicus
cgagggcgcgatttcaagttgagcc

SEQ ID NO: 538519 - DNA, 25 bp, Rattus norvegicus
agttgagcccgtgtctctgctcgca

SEQ ID NO: 538520 - DNA, 25 bp, Rattus norvegicus
acaagccacatggttcccgccaggg

SEQ ID NO: 538521 - DNA, 25 bp, Rattus norvegicus
tagttcagagcttattttcgccctc

SEQ ID NO: 538522 - DNA, 25 bp, Rattus norvegicus
tccggaatctcccattcgggattgc

SEQ ID NO: 538523 - DNA, 25 bp, Rattus norvegicus
agagctcggcgctcgtgcagcatca

SEQ ID NO: 538524 - DNA, 25 bp, Rattus norvegicus
aacaggccgaccgtctgtggggaat

SEQ ID NO: 538525 - DNA, 25 bp, Rattus norvegicus
atgtggcaagggtttcagccgcagc

SEQ ID NO: 538526 - DNA, 25 bp, Rattus norvegicus
gcagcacggacctggtgcgacacca

SEQ ID NO: 538527 - DNA, 25 bp, Rattus norvegicus
agaggccgtatctctgcagcgagtg

SEQ ID NO: 538528 - DNA, 25 bp, Rattus norvegicus
tctgcagcgagtgcggaaagagctt

SEQ ID NO: 538529 - DNA, 25 bp, Rattus norvegicus
gcggaaagagcttctcgcagcattc

SEQ ID NO: 538530 - DNA, 25 bp, Rattus norvegicus
ctccaagcgcttcagcgagagctcg

SEQ ID NO: 538531 - DNA, 25 bp, Rattus norvegicus
cgagtccggaacaggccgaccgtct

SEQ ID NO: 538532 - DNA, 25 bp, Rattus norvegicus
agaacggccctacgcctgtggcgac

SEQ ID NO: 538533 - DNA, 25 bp, Rattus norvegicus
agaaggtgcagatccgcaggcacga

SEQ ID NO: 538534 - DNA, 25 bp, Rattus norvegicus
agatccgcaggcacgagcgccagct

SEQ ID NO: 538535 - DNA, 25 bp, Rattus norvegicus
gagtgcggctctaactcccgccaga

SEQ ID NO: 538536 - DNA, 25 bp, Rattus norvegicus
ttctcgcagcattccaacctagtga

SEQ ID NO: 538537 - DNA, 25 bp, Rattus norvegicus
cgcttcggccagagcgcggcactaa

SEQ ID NO: 538538 - DNA, 25 bp, Rattus norvegicus
acagcaagaaggatcctgagccaga

SEQ ID NO: 538539 - DNA, 25 bp, Rattus norvegicus
aagagcttcgtgtacggctcgcacc

SEQ ID NO: 538540 - DNA, 25 bp, Rattus norvegicus
atctgctcggactgcggcaagacgt

SEQ ID NO: 538541 - DNA, 25 bp, Rattus norvegicus
atagtggcctgcgagcattcgcgcc

SEQ ID NO: 538542 - DNA, 25 bp, Rattus norvegicus
gtccgggctcgcagagaagaatgaa

SEQ ID NO: 538543 - DNA, 25 bp, Rattus norvegicus
cgctatccctgcagggcatggggtt

SEQ ID NO: 538544 - DNA, 25 bp, Rattus norvegicus
tcccaacgaggtggagatggcaatc

SEQ ID NO: 538545 - DNA, 25 bp, Rattus norvegicus
ctgcagaccgatgggcgccatctgc

SEQ ID NO: 538546 - DNA, 25 bp, Rattus norvegicus
cccgagttctctgaacggctgcaga

SEQ ID NO: 538547 - DNA, 25 bp, Rattus norvegicus
ctgagccagacaggaggtttcgtga

SEQ ID NO: 538548 - DNA, 25 bp, Rattus norvegicus
tggccgatggagacaatgaagttga

SEQ ID NO: 538549 - DNA, 25 bp, Rattus norvegicus
cactaacgcggcaccagtgggcgca

SEQ ID NO: 538550 - DNA, 25 bp, Rattus norvegicus
tcctggctgcatccggacggattcc

SEQ ID NO: 538551 - DNA, 25 bp, Rattus norvegicus
agctcgcactctccaaagctgcgga

SEQ ID NO: 538552 - DNA, 25 bp, Rattus norvegicus
tcggaccatgtacgcagcccaaagt

SEQ ID NO: 538553 - DNA, 25 bp, Rattus norvegicus
agcgtagagactcagacctcaggaa

SEQ ID NO: 538554 - DNA, 25 bp, Rattus norvegicus
tccaaagctgcggacgcgagcgtag

SEQ ID NO: 538555 - DNA, 25 bp, Rattus norvegicus
cacacaaacagaagtgcgcacgcgc

SEQ ID NO: 538556 - DNA, 25 bp, Rattus norvegicus
gcctgcaaaggtgcgtccgccagct

SEQ ID NO: 538557 - DNA, 25 bp, Rattus norvegicus
ggtctcgccgctcttgtcaacctgt

SEQ ID NO: 538558 - DNA, 25 bp, Rattus norvegicus
gcaagcaatcaaacggacccagcct

SEQ ID NO: 538559 - DNA, 25 bp, Rattus norvegicus
tgaggacatcagggagccaaggcct

SEQ ID NO: 538560 - DNA, 25 bp, Rattus norvegicus
tcccggatcccacacgctgaggaca

SEQ ID NO: 538561 - DNA, 25 bp, Rattus norvegicus
acgaacattgctaccatcccggatc

SEQ ID NO: 538562 - DNA, 25 bp, Rattus norvegicus
cgtgaacacgaacattgctaccatc

SEQ ID NO: 538563 - DNA, 25 bp, Rattus norvegicus
tacgcagcccaaagtcgtgaacacg

SEQ ID NO: 538564 - DNA, 25 bp, Rattus norvegicus
cgcgagcgtagagactcagacctca

SEQ ID NO: 538565 - DNA, 25 bp, Rattus norvegicus
ctgcgggaacgagaccggagcttcc

SEQ ID NO: 538566 - DNA, 25 bp, Rattus norvegicus
ggcggcagcgaacagactcagctgt

SEQ ID NO: 538567 - DNA, 25 bp, Rattus norvegicus
cgtcgcggtccgtgcgcgttcctgt

SEQ ID NO: 538568 - DNA, 25 bp, Rattus norvegicus
ccgtgcgcgttcctgtgcgtgtgca

SEQ ID NO: 538569 - DNA, 25 bp, Rattus norvegicus
tcctgtgcgtgtgcagggccactgc

SEQ ID NO: 538570 - DNA, 25 bp, Rattus norvegicus
actgcgccgctgtgactcctgcagg

SEQ ID NO: 538571 - DNA, 25 bp, Rattus norvegicus
tgactcctgcaggtccgtcgtcgag

SEQ ID NO: 538572 - DNA, 25 bp, Rattus norvegicus
caggtccgtcgtcgaggctaccttc

SEQ ID NO: 538573 - DNA, 25 bp, Rattus norvegicus
cgtcgaggctaccttccttcccaca

SEQ ID NO: 538574 - DNA, 25 bp, Rattus norvegicus
cacagcttttgcacccgctaagctg

SEQ ID NO: 538575 - DNA, 25 bp, Rattus norvegicus
cttttgcacccgctaagctggagtc

SEQ ID NO: 538576 - DNA, 25 bp, Rattus norvegicus
acccgctaagctggagtcgccgagc

SEQ ID NO: 538577 - DNA, 25 bp, Rattus norvegicus
ctaagctggagtcgccgagcctgcg

SEQ ID NO: 538578 - DNA, 25 bp, Rattus norvegicus
cagactcagctgtgctggcctggga

SEQ ID NO: 538579 - DNA, 25 bp, Rattus norvegicus
tgtgtgtctttcttgctctccagtc

SEQ ID NO: 538580 - DNA, 25 bp, Rattus norvegicus
tgggatatatctaaatttgttttaa

SEQ ID NO: 538581 - DNA, 25 bp, Rattus norvegicus
agggctgcagcagccttgtgtctct

SEQ ID NO: 538582 - DNA, 25 bp, Rattus norvegicus
tcattccgagttaggtttctaggac

SEQ ID NO: 538583 - DNA, 25 bp, Rattus norvegicus
agtcattccgagttaggtttctagg

SEQ ID NO: 538584 - DNA, 25 bp, Rattus norvegicus
ccagtcattccgagttaggtttcta

SEQ ID NO: 538585 - DNA, 25 bp, Rattus norvegicus
tctccagtcattccgagttaggttt

SEQ ID NO: 538586 - DNA, 25 bp, Rattus norvegicus
gctctccagtcattccgagttaggt

SEQ ID NO: 538587 - DNA, 25 bp, Rattus norvegicus
tgctctccagtcattccgagttagg

SEQ ID NO: 538588 - DNA, 25 bp, Rattus norvegicus
cttgctctccagtcattccgagtta

SEQ ID NO: 538589 - DNA, 25 bp, Rattus norvegicus
ctttcttgctctccagtcattccga

SEQ ID NO: 538590 - DNA, 25 bp, Rattus norvegicus
gtctttcttgctctccagtcattcc

SEQ ID NO: 538591 - DNA, 25 bp, Rattus norvegicus
gtgtgtctttcttgctctccagtca

SEQ ID NO: 538592 - DNA, 25 bp, Rattus norvegicus
gtgtctttcttgctctccagtcatt

SEQ ID NO: 538593 - DNA, 25 bp, Rattus norvegicus
tgccgccacttaaggaagtttctcg

SEQ ID NO: 538594 - DNA, 25 bp, Rattus norvegicus
ttcttcctgtcattagtcgggaggg

SEQ ID NO: 538595 - DNA, 25 bp, Rattus norvegicus
gcgctccggagcaaaagggactcga

SEQ ID NO: 538596 - DNA, 25 bp, Rattus norvegicus
ccgcgtgcctctatggttcttcctg

SEQ ID NO: 538597 - DNA, 25 bp, Rattus norvegicus
acgctgaagcaaggccggaaggaac

SEQ ID NO: 538598 - DNA, 25 bp, Rattus norvegicus
ccggaaggaacgcagtagcggcctc

SEQ ID NO: 538599 - DNA, 25 bp, Rattus norvegicus
cttttcgagcggatgcttcaggtga

SEQ ID NO: 538600 - DNA, 25 bp, Rattus norvegicus
cttcaggtgacttgagattgaactc

SEQ ID NO: 538601 - DNA, 25 bp, Rattus norvegicus
ttgagattgaactcccgggcgtcga

SEQ ID NO: 538602 - DNA, 25 bp, Rattus norvegicus
gagcgacgcagacgaccgctggcct

SEQ ID NO: 538603 - DNA, 25 bp, Rattus norvegicus
ttgacgcctgtcatcccaatcagcg

SEQ ID NO: 538604 - DNA, 25 bp, Rattus norvegicus
ctcgaaactcctgcagtcgggcgtc

SEQ ID NO: 538605 - DNA, 25 bp, Rattus norvegicus
caccttgggtgagcggcaagaccca

SEQ ID NO: 538606 - DNA, 25 bp, Rattus norvegicus
gcaagacccacgctggagtggacga

SEQ ID NO: 538607 - DNA, 25 bp, Rattus norvegicus
atcgccggtcctcttagtggaatcg

SEQ ID NO: 538608 - DNA, 25 bp, Rattus norvegicus
ctcttagtggaatcggggccatttc

SEQ ID NO: 538609 - DNA, 25 bp, Rattus norvegicus
tcggggccatttcgaaaggcaggac

SEQ ID NO: 538610 - DNA, 25 bp, Rattus norvegicus
atttcgaaaggcaggaccacacctc

SEQ ID NO: 538611 - DNA, 25 bp, Rattus norvegicus
gaaaggcaggaccacacctcgcatc

SEQ ID NO: 538612 - DNA, 25 bp, Rattus norvegicus
ggctccgctctcgaaacgggaagtc

SEQ ID NO: 538613 - DNA, 25 bp, Rattus norvegicus
ctctcgaaacgggaagtcgacggag

SEQ ID NO: 538614 - DNA, 25 bp, Rattus norvegicus
ccgccgccgcatgactaagtttggc

SEQ ID NO: 538615 - DNA, 25 bp, Rattus norvegicus
catgactaagtttggcgcgacctga

SEQ ID NO: 538616 - DNA, 25 bp, Rattus norvegicus
taagtttggcgcgacctgagctcct

SEQ ID NO: 538617 - DNA, 25 bp, Rattus norvegicus
tgagctccttgccttttatggacga

SEQ ID NO: 538618 - DNA, 25 bp, Rattus norvegicus
cttgccttttatggacgactcgtgg

SEQ ID NO: 538619 - DNA, 25 bp, Rattus norvegicus
ggcatcgccggtcctcttagtggaa

SEQ ID NO: 538620 - DNA, 25 bp, Rattus norvegicus
ttttatggacgactcgtgggcagcg

SEQ ID NO: 538621 - DNA, 25 bp, Rattus norvegicus
cgcgagtacaaccttcttgcagctc

SEQ ID NO: 538622 - DNA, 25 bp, Rattus norvegicus
gcggacactggcaaagcttaacttt

SEQ ID NO: 538623 - DNA, 25 bp, Rattus norvegicus
agagtgtttgcagtcgtattcccgc

SEQ ID NO: 538624 - DNA, 25 bp, Rattus norvegicus
gtagacactcgtgggcacgctcctg

SEQ ID NO: 538625 - DNA, 25 bp, Rattus norvegicus
tgttaagccgcatctgtccaccttg

SEQ ID NO: 538626 - DNA, 25 bp, Rattus norvegicus
ccaccttgaggggacacagtattgg

SEQ ID NO: 538627 - DNA, 25 bp, Rattus norvegicus
acagtattgggagtcaggcgttaca

SEQ ID NO: 538628 - DNA, 25 bp, Rattus norvegicus
atcacgctttgatggcctatgggtc

SEQ ID NO: 538629 - DNA, 25 bp, Rattus norvegicus
gtgcgcgctctatcactgggcattg

SEQ ID NO: 538630 - DNA, 25 bp, Rattus norvegicus
ttccgagttaagagttgcgcgtgcg

SEQ ID NO: 538631 - DNA, 25 bp, Rattus norvegicus
gggccagcgtttgccttttatggta

SEQ ID NO: 538632 - DNA, 25 bp, Rattus norvegicus
tatggtaataatgcggctgtcctgc

SEQ ID NO: 538633 - DNA, 25 bp, Rattus norvegicus
gcggtgaccatagccctcttttgtg

SEQ ID NO: 538634 - DNA, 25 bp, Rattus norvegicus
ttggccactacctcgctgcaggatc

SEQ ID NO: 538635 - DNA, 25 bp, Rattus norvegicus
ggcgactgggatcccctcggtgctt

SEQ ID NO: 538636 - DNA, 25 bp, Rattus norvegicus
tctatgcgggcgcaagcggaagtac

SEQ ID NO: 538637 - DNA, 25 bp, Rattus norvegicus
ggcgcaagcggaagtacgtaagaac

SEQ ID NO: 538638 - DNA, 25 bp, Rattus norvegicus
cgcaagcggaagtacgtaagaacgt

SEQ ID NO: 538639 - DNA, 25 bp, Rattus norvegicus
caagcggaagtacgtaagaacgtgc

SEQ ID NO: 538640 - DNA, 25 bp, Rattus norvegicus
gaagtacgtaagaacgtgcgccgca

SEQ ID NO: 538641 - DNA, 25 bp, Rattus norvegicus
cagctccggagaggtacgacctgca

SEQ ID NO: 538642 - DNA, 25 bp, Rattus norvegicus
gcggaagtacgtaagaacgtgcgcc

SEQ ID NO: 538643 - DNA, 25 bp, Rattus norvegicus
ggagaggtacgacctgcacctcccg

SEQ ID NO: 538644 - DNA, 25 bp, Rattus norvegicus
ccctcggtgcttcccagccgaccct

SEQ ID NO: 538645 - DNA, 25 bp, Rattus norvegicus
tgcttcccagccgaccctggcctta

SEQ ID NO: 538646 - DNA, 25 bp, Rattus norvegicus
cccagccgaccctggccttattccg

SEQ ID NO: 538647 - DNA, 25 bp, Rattus norvegicus
tccggagaggtacgacctgcacctc

SEQ ID NO: 538648 - DNA, 25 bp, Rattus norvegicus
gtacgtaagaacgtgcgccgcagcc

SEQ ID NO: 538649 - DNA, 25 bp, Rattus norvegicus
cgggtccagatgtccctatctcagg

SEQ ID NO: 538650 - DNA, 25 bp, Rattus norvegicus
tatctcaggtccacggctgaccttg

SEQ ID NO: 538651 - DNA, 25 bp, Rattus norvegicus
tcaggtccacggctgaccttggcgc

SEQ ID NO: 538652 - DNA, 25 bp, Rattus norvegicus
gtccacggctgaccttggcgctggc

SEQ ID NO: 538653 - DNA, 25 bp, Rattus norvegicus
cctccagtacgctgagcggcccgga

SEQ ID NO: 538654 - DNA, 25 bp, Rattus norvegicus
gacctggcaggccacagcagcagtg

SEQ ID NO: 538655 - DNA, 25 bp, Rattus norvegicus
ggccacagcagcagtgccacgagca

SEQ ID NO: 538656 - DNA, 25 bp, Rattus norvegicus
gcagcagtgccacgagcacaccgga

SEQ ID NO: 538657 - DNA, 25 bp, Rattus norvegicus
agtgccacgagcacaccggaggagc

SEQ ID NO: 538658 - DNA, 25 bp, Rattus norvegicus
agctccgcggttacgatagcgggcc

SEQ ID NO: 538659 - DNA, 25 bp, Rattus norvegicus
tccgcggttacgatagcgggcccga

SEQ ID NO: 538660 - DNA, 25 bp, Rattus norvegicus
gagggctgcgctacaatctccccgg

SEQ ID NO: 538661 - DNA, 25 bp, Rattus norvegicus
agatgtccctatctcaggtccacgg

SEQ ID NO: 538662 - DNA, 25 bp, Rattus norvegicus
tgtccctatctcaggtccacggctg

SEQ ID NO: 538663 - DNA, 25 bp, Rattus norvegicus
gagctcgactgcgagcccgcagtaa

SEQ ID NO: 538664 - DNA, 25 bp, Rattus norvegicus
ccggggccttcctcttgcctagtgt

SEQ ID NO: 538665 - DNA, 25 bp, Rattus norvegicus
ctcttgcctagtgtgggactgtcca

SEQ ID NO: 538666 - DNA, 25 bp, Rattus norvegicus
gccgcctgatctagtgggaacattc

SEQ ID NO: 538667 - DNA, 25 bp, Rattus norvegicus
gaacattccgtgaggaccggtggcc

SEQ ID NO: 538668 - DNA, 25 bp, Rattus norvegicus
tctaggttagaatagtaggagacgt

SEQ ID NO: 538669 - DNA, 25 bp, Rattus norvegicus
agacgtgtgtaaagctgcagaggcc

SEQ ID NO: 538670 - DNA, 25 bp, Rattus norvegicus
atttgttgcgttgagatgtgcaggc

SEQ ID NO: 538671 - DNA, 25 bp, Rattus norvegicus
atgtgcaggcgcttcggaagccgcc

SEQ ID NO: 538672 - DNA, 25 bp, Rattus norvegicus
aagccgccctgatggggtcctcttt

SEQ ID NO: 538673 - DNA, 25 bp, Rattus norvegicus
cctgagctgagaacagcagcaacgc

SEQ ID NO: 538674 - DNA, 25 bp, Rattus norvegicus
gcaccgcactatggaggagctcgac

SEQ ID NO: 538675 - DNA, 25 bp, Rattus norvegicus
gacagcaaggatctgcgcacgcgca

SEQ ID NO: 538676 - DNA, 25 bp, Rattus norvegicus
cccgcagtaactgtaaggacgcccg

SEQ ID NO: 538677 - DNA, 25 bp, Rattus norvegicus
agaacctgcgtgtcttctacgcacg

SEQ ID NO: 538678 - DNA, 25 bp, Rattus norvegicus
cgagatcctggaccgcacccgtgag

SEQ ID NO: 538679 - DNA, 25 bp, Rattus norvegicus
gaccgcacgcctgagaacctgcatg

SEQ ID NO: 538680 - DNA, 25 bp, Rattus norvegicus
tggctacatcaaccaggaggtggta

SEQ ID NO: 538681 - DNA, 25 bp, Rattus norvegicus
gagaacctgcatgccttcctcatct

SEQ ID NO: 538682 - DNA, 25 bp, Rattus norvegicus
ccagctcatggtgggccagagcaac

SEQ ID NO: 538683 - DNA, 25 bp, Rattus norvegicus
tcactggccatcgacgtgagccctg

SEQ ID NO: 538684 - DNA, 25 bp, Rattus norvegicus
ggcttcgacgccagccagctgagca

SEQ ID NO: 538685 - DNA, 25 bp, Rattus norvegicus
cagctgagcagtgagtgcaaggcca

SEQ ID NO: 538686 - DNA, 25 bp, Rattus norvegicus
tgcaggagctcaagcagacgctctt

SEQ ID NO: 538687 - DNA, 25 bp, Rattus norvegicus
ttcacaccgtcctacggcgtggtgc

SEQ ID NO: 538688 - DNA, 25 bp, Rattus norvegicus
cctgctgtgccagcctgcagaagct

SEQ ID NO: 538689 - DNA, 25 bp, Rattus norvegicus
aagctgctgctgtacttcgagatcc

SEQ ID NO: 538690 - DNA, 25 bp, Rattus norvegicus
aggtggtaaggctctacctcgctgt

SEQ ID NO: 538691 - DNA, 25 bp, Rattus norvegicus
cctgcaggtcgtcatgtgtcacatg

SEQ ID NO: 538692 - DNA, 25 bp, Rattus norvegicus
tatgccgggaggtcgtagacagtac

SEQ ID NO: 538693 - DNA, 25 bp, Rattus norvegicus
ttaccgctgtccctgtatgccggga

SEQ ID NO: 538694 - DNA, 25 bp, Rattus norvegicus
tgcaagagcctacagcagtcgctcc

SEQ ID NO: 538695 - DNA, 25 bp, Rattus norvegicus
ggagaatccctcaccacctgcaaga

SEQ ID NO: 538696 - DNA, 25 bp, Rattus norvegicus
tgtgtcacatgttcaccggagaatc

SEQ ID NO: 538697 - DNA, 25 bp, Rattus norvegicus
ctttatggcccgttgcctgcaggtc

SEQ ID NO: 538698 - DNA, 25 bp, Rattus norvegicus
cgtgttggcctttatggcccgttgc

SEQ ID NO: 538699 - DNA, 25 bp, Rattus norvegicus
ctgcagcccgatgccgtgttggcct

SEQ ID NO: 538700 - DNA, 25 bp, Rattus norvegicus
agtggcactctgcagcccgatgccg

SEQ ID NO: 538701 - DNA, 25 bp, Rattus norvegicus
aggtcgtagacagtaccgctgtctc

SEQ ID NO: 538702 - DNA, 25 bp, Rattus norvegicus
ctgtctccgtgtgccaggaggacgc

SEQ ID NO: 538703 - DNA, 25 bp, Rattus norvegicus
tggtgtcgcgcagtggcactctgca

SEQ ID NO: 538704 - DNA, 25 bp, Rattus norvegicus
cagtaccgctgtctccgtgtgccag

SEQ ID NO: 538705 - DNA, 25 bp, Rattus norvegicus
tacccagctgctgatgggccagccg

SEQ ID NO: 538706 - DNA, 25 bp, Rattus norvegicus
tgcgcaccaaatgcatctcgagcca

SEQ ID NO: 538707 - DNA, 25 bp, Rattus norvegicus
ccagatccttggttttgttggcggg

SEQ ID NO: 538708 - DNA, 25 bp, Rattus norvegicus
gctacccttggctggatgaacttca

SEQ ID NO: 538709 - DNA, 25 bp, Rattus norvegicus
cagtggaatgtaagacccgacccgg

SEQ ID NO: 538710 - DNA, 25 bp, Rattus norvegicus
gcgaggctctggcaccagatccttg

SEQ ID NO: 538711 - DNA, 25 bp, Rattus norvegicus
tgaacttcaggatacccagctgctg

SEQ ID NO: 538712 - DNA, 25 bp, Rattus norvegicus
tctcgagccaagacagtggaatgta

SEQ ID NO: 538713 - DNA, 25 bp, Rattus norvegicus
ccagccgcagcgagaaactgcgagc

SEQ ID NO: 538714 - DNA, 25 bp, Rattus norvegicus
tggcctctccgggttttagcggcgc

SEQ ID NO: 538715 - DNA, 25 bp, Rattus norvegicus
ccgggcagccggatttaggatctac

SEQ ID NO: 538716 - DNA, 25 bp, Rattus norvegicus
gatctacggaaacacccgccttaga

SEQ ID NO: 538717 - DNA, 25 bp, Rattus norvegicus
ccttagactctacggtggcagcacc

SEQ ID NO: 538718 - DNA, 25 bp, Rattus norvegicus
ctgagaggagcagaaatccgaagtg

SEQ ID NO: 538719 - DNA, 25 bp, Rattus norvegicus
cttgaaaaatgcaaacgccatcggc

SEQ ID NO: 538720 - DNA, 25 bp, Rattus norvegicus
aatgcaaacgccatcggcaaatccg

SEQ ID NO: 538721 - DNA, 25 bp, Rattus norvegicus
atgccacgccgacccggggcacact

SEQ ID NO: 538722 - DNA, 25 bp, Rattus norvegicus
tctgggtcggtatgccacgccgacc

SEQ ID NO: 538723 - DNA, 25 bp, Rattus norvegicus
aactctgggtcggtatgccacgccg

SEQ ID NO: 538724 - DNA, 25 bp, Rattus norvegicus
tgaaactctgggtcggtatgccacg

SEQ ID NO: 538725 - DNA, 25 bp, Rattus norvegicus
taatgaaactctgggtcggtatgcc

SEQ ID NO: 538726 - DNA, 25 bp, Rattus norvegicus
ctcagacctaatgaaactctgggtc

SEQ ID NO: 538727 - DNA, 25 bp, Rattus norvegicus
ccaacctcagacctaatgaaactct

SEQ ID NO: 538728 - DNA, 25 bp, Rattus norvegicus
gggacgtgtcatgttccgccccaac

SEQ ID NO: 538729 - DNA, 25 bp, Rattus norvegicus
ttccagagggggacgtgtcatgttc

SEQ ID NO: 538730 - DNA, 25 bp, Rattus norvegicus
ccggggagtcatacattccagaggg

SEQ ID NO: 538731 - DNA, 25 bp, Rattus norvegicus
ggaccggggagtcatacattccaga

SEQ ID NO: 538732 - DNA, 25 bp, Rattus norvegicus
cctaatgaaactctgggtcggtatg

SEQ ID NO: 538733 - DNA, 25 bp, Rattus norvegicus
attcagctcgcgttccgccgatcta

SEQ ID NO: 538734 - DNA, 25 bp, Rattus norvegicus
ttttataagatgcaactcaccgctg

SEQ ID NO: 538735 - DNA, 25 bp, Rattus norvegicus
gaaccctttttataagatgcaactc

SEQ ID NO: 538736 - DNA, 25 bp, Rattus norvegicus
ctataggaaccctttttataagatg

SEQ ID NO: 538737 - DNA, 25 bp, Rattus norvegicus
gcgttgcgcactcggccgcagagcc

SEQ ID NO: 538738 - DNA, 25 bp, Rattus norvegicus
agcgcccacgccaaaaggggctttg

SEQ ID NO: 538739 - DNA, 25 bp, Rattus norvegicus
gatctaatccttttttctgctctgg

SEQ ID NO: 538740 - DNA, 25 bp, Rattus norvegicus
gccgatctaatccttttttctgctc

SEQ ID NO: 538741 - DNA, 25 bp, Rattus norvegicus
tccgccgatctaatccttttttctg

SEQ ID NO: 538742 - DNA, 25 bp, Rattus norvegicus
gagagggattcagctcgcgttccgc

SEQ ID NO: 538743 - DNA, 25 bp, Rattus norvegicus
tcagctcgcgttccgccgatctaat

SEQ ID NO: 538744 - DNA, 25 bp, Rattus norvegicus
taagatgcaactcaccgctgccgtc

SEQ ID NO: 538745 - DNA, 25 bp, Rattus norvegicus
caactcaccgctgccgtccgccgcg

SEQ ID NO: 538746 - DNA, 25 bp, Rattus norvegicus
cgcgttccgccgatctaatcctttt

SEQ ID NO: 538747 - DNA, 25 bp, Rattus norvegicus
cggctcacgcggagatccaaaactc

SEQ ID NO: 538748 - DNA, 25 bp, Rattus norvegicus
ctgggcactgcctttttcgaaacgc

SEQ ID NO: 538749 - DNA, 25 bp, Rattus norvegicus
tcctggagcctttgagacaagtatc

SEQ ID NO: 538750 - DNA, 25 bp, Rattus norvegicus
ccgggctgtgacgatcgtagatttt

SEQ ID NO: 538751 - DNA, 25 bp, Rattus norvegicus
ctggtaaccagagcctgatatgagc

SEQ ID NO: 538752 - DNA, 25 bp, Rattus norvegicus
gggtctcccggaatcagaggatcta

SEQ ID NO: 538753 - DNA, 25 bp, Rattus norvegicus
ctcgggaacaggaaaacgacagatc

SEQ ID NO: 538754 - DNA, 25 bp, Rattus norvegicus
tagaagcgagatctttggagcaccc

SEQ ID NO: 538755 - DNA, 25 bp, Rattus norvegicus
tggagcacccttctatcttgtctga

SEQ ID NO: 538756 - DNA, 25 bp, Rattus norvegicus
aggctacatcctcccggcatcggta

SEQ ID NO: 538757 - DNA, 25 bp, Rattus norvegicus
gactcggattctgcgactcccagtg

SEQ ID NO: 538758 - DNA, 25 bp, Rattus norvegicus
gcccgtttcttatctgaccttggta

SEQ ID NO: 538759 - DNA, 25 bp, Rattus norvegicus
cccttattattttggcggctcacgc

SEQ ID NO: 538760 - DNA, 25 bp, Rattus norvegicus
cgacttccttaaagtggggcgcctg

SEQ ID NO: 538761 - DNA, 25 bp, Rattus norvegicus
cctgcgggagaaaagttcggtcatc

SEQ ID NO: 538762 - DNA, 25 bp, Rattus norvegicus
caggtgtctacaccgtgttccgtga

SEQ ID NO: 538763 - DNA, 25 bp, Rattus norvegicus
gaccctcctccgttgtttggcaaga

SEQ ID NO: 538764 - DNA, 25 bp, Rattus norvegicus
ttggcaagaaagacccacgggcacg

SEQ ID NO: 538765 - DNA, 25 bp, Rattus norvegicus
cttcttcgacaccagcaggtgtcta

SEQ ID NO: 538766 - DNA, 25 bp, Rattus norvegicus
ttccgtgaaccaggccgtgagcacc

SEQ ID NO: 538767 - DNA, 25 bp, Rattus norvegicus
tggtggcacccacctttgtgccttc

SEQ ID NO: 538768 - DNA, 25 bp, Rattus norvegicus
cctttgatgagcgtgtgggacccat

SEQ ID NO: 538769 - DNA, 25 bp, Rattus norvegicus
tgtgggacccatccagatagcatcc

SEQ ID NO: 538770 - DNA, 25 bp, Rattus norvegicus
tagcatcccaggctcgcgatgtccg

SEQ ID NO: 538771 - DNA, 25 bp, Rattus norvegicus
gggtcctgcaaggtccacctggatc

SEQ ID NO: 538772 - DNA, 25 bp, Rattus norvegicus
tccacgactggagcgaccagaggtc

SEQ ID NO: 538773 - DNA, 25 bp, Rattus norvegicus
aggaactactcaagcccgaggctga

SEQ ID NO: 538774 - DNA, 25 bp, Rattus norvegicus
accgaggatcttcacgcctggctga

SEQ ID NO: 538775 - DNA, 25 bp, Rattus norvegicus
cccagcaacgctgcgccggcaacca

SEQ ID NO: 538776 - DNA, 25 bp, Rattus norvegicus
gaggtgccccaagcccacgaaagga

SEQ ID NO: 538777 - DNA, 25 bp, Rattus norvegicus
gcaaccaagcctagccgctgtggca

SEQ ID NO: 538778 - DNA, 25 bp, Rattus norvegicus
atgcttctgctgcagtccaagcacc

SEQ ID NO: 538779 - DNA, 25 bp, Rattus norvegicus
agcgagcgcatcttcttacacgatg

SEQ ID NO: 538780 - DNA, 25 bp, Rattus norvegicus
acgcaggagcgagcgcatcttctta

SEQ ID NO: 538781 - DNA, 25 bp, Rattus norvegicus
acctgtggactcgacgcaggagcga

SEQ ID NO: 538782 - DNA, 25 bp, Rattus norvegicus
gatgatgacctgtggactcgacgca

SEQ ID NO: 538783 - DNA, 25 bp, Rattus norvegicus
gccagtgatgatgacctgtggactc

SEQ ID NO: 538784 - DNA, 25 bp, Rattus norvegicus
ggccagaggccagtgatgatgacct

SEQ ID NO: 538785 - DNA, 25 bp, Rattus norvegicus
tccaaggaacctggctttgaggcgg

SEQ ID NO: 538786 - DNA, 25 bp, Rattus norvegicus
gaagatacgcggctccaaggaacct

SEQ ID NO: 538787 - DNA, 25 bp, Rattus norvegicus
gcaaagcccggaagatacgcggctc

SEQ ID NO: 538788 - DNA, 25 bp, Rattus norvegicus
ttacacgatgcttctgctgcagtcc

SEQ ID NO: 538789 - DNA, 25 bp, Rattus norvegicus
ttctggctgcgaacgacaagttacc

SEQ ID NO: 538790 - DNA, 25 bp, Rattus norvegicus
cacacgtccgttttgccgatttgaa

SEQ ID NO: 538791 - DNA, 25 bp, Rattus norvegicus
acccagtccgggtgacaggcacaaa

SEQ ID NO: 538792 - DNA, 25 bp, Rattus norvegicus
cctggttcgtcggtcattgttctag

SEQ ID NO: 538793 - DNA, 25 bp, Rattus norvegicus
ttccggtcgactgcgcatgcataaa

SEQ ID NO: 538794 - DNA, 25 bp, Rattus norvegicus
actcttgtttatgctccagagccgg

SEQ ID NO: 538795 - DNA, 25 bp, Rattus norvegicus
actcaggatctgtacccggtccggg

SEQ ID NO: 538796 - DNA, 25 bp, Rattus norvegicus
gcgggagcacgctacactcaggatc

SEQ ID NO: 538797 - DNA, 25 bp, Rattus norvegicus
ctctggcttgccaggttcatggctg

SEQ ID NO: 538798 - DNA, 25 bp, Rattus norvegicus
ttatcctggttgaagttggcgaaca

SEQ ID NO: 538799 - DNA, 25 bp, Rattus norvegicus
agcccggccttacgtgttatcctgg

SEQ ID NO: 538800 - DNA, 25 bp, Rattus norvegicus
tcccaactttgcgaaaggcaaggtc

SEQ ID NO: 538801 - DNA, 25 bp, Rattus norvegicus
accggtgtgctcaattccttcccaa

SEQ ID NO: 538802 - DNA, 25 bp, Rattus norvegicus
cgcaccgcattgcttgaagagaata

SEQ ID NO: 538803 - DNA, 25 bp, Rattus norvegicus
gaggcagctgatccggtctgctccg

SEQ ID NO: 538804 - DNA, 25 bp, Rattus norvegicus
cgattggcagcgtgcgcccgagtcc

SEQ ID NO: 538805 - DNA, 25 bp, Rattus norvegicus
cccgacaccatctgctcaggatttg

SEQ ID NO: 538806 - DNA, 25 bp, Rattus norvegicus
caccatctgctcaggatttgcaatc

SEQ ID NO: 538807 - DNA, 25 bp, Rattus norvegicus
atctgctcaggatttgcaatcggga

SEQ ID NO: 538808 - DNA, 25 bp, Rattus norvegicus
ctcaggatttgcaatcgggagactc

SEQ ID NO: 538809 - DNA, 25 bp, Rattus norvegicus
caggatttgcaatcgggagactcca

SEQ ID NO: 538810 - DNA, 25 bp, Rattus norvegicus
tttgcaatcgggagactccaggctc

SEQ ID NO: 538811 - DNA, 25 bp, Rattus norvegicus
tggagctgcccgaggatacgacacc

SEQ ID NO: 538812 - DNA, 25 bp, Rattus norvegicus
agctgcccgaggatacgacaccctt

SEQ ID NO: 538813 - DNA, 25 bp, Rattus norvegicus
gaggatacgacacccttccaacctg

SEQ ID NO: 538814 - DNA, 25 bp, Rattus norvegicus
tacgacacccttccaacctgctgcg

SEQ ID NO: 538815 - DNA, 25 bp, Rattus norvegicus
gctccggaggcagctgatccggtct

SEQ ID NO: 538816 - DNA, 25 bp, Rattus norvegicus
tgcaatcgggagactccaggctcgg

SEQ ID NO: 538817 - DNA, 25 bp, Rattus norvegicus
gagcttgaggacacgcatcagggaa

SEQ ID NO: 538818 - DNA, 25 bp, Rattus norvegicus
ccctgctcgctaaggggtgtgaacg

SEQ ID NO: 538819 - DNA, 25 bp, Rattus norvegicus
cccggatactcactcagccaggatt

SEQ ID NO: 538820 - DNA, 25 bp, Rattus norvegicus
tggcgccctcaaacctcgcgagatt

SEQ ID NO: 538821 - DNA, 25 bp, Rattus norvegicus
tcgcgagattctgcgcgagcaggtc

SEQ ID NO: 538822 - DNA, 25 bp, Rattus norvegicus
cgccagactgtgtcggataccgcga

SEQ ID NO: 538823 - DNA, 25 bp, Rattus norvegicus
ataccgcgaggacgagaatgttttc

SEQ ID NO: 538824 - DNA, 25 bp, Rattus norvegicus
cccacgcttgggcaaactgtgcagg

SEQ ID NO: 538825 - DNA, 25 bp, Rattus norvegicus
actgtgcaggttttcatccgtatcc

SEQ ID NO: 538826 - DNA, 25 bp, Rattus norvegicus
actcaggcgcgctgtggacagccct

SEQ ID NO: 538827 - DNA, 25 bp, Rattus norvegicus
tccgaggtcctgatagcggccaaga

SEQ ID NO: 538828 - DNA, 25 bp, Rattus norvegicus
gaggtgtgctgtctggaaccttcca

SEQ ID NO: 538829 - DNA, 25 bp, Rattus norvegicus
cttccagggtgagaaggcaacgcgt

SEQ ID NO: 538830 - DNA, 25 bp, Rattus norvegicus
gatcgcgagctgcaggtgtcactcg

SEQ ID NO: 538831 - DNA, 25 bp, Rattus norvegicus
ctggcagccgcggaaggtgcagcag

SEQ ID NO: 538832 - DNA, 25 bp, Rattus norvegicus
agccggactctgctgctggcagccg

SEQ ID NO: 538833 - DNA, 25 bp, Rattus norvegicus
gtatctctggtggatcccgggctcc

SEQ ID NO: 538834 - DNA, 25 bp, Rattus norvegicus
agcgttgtgcagcacctgctgagcc

SEQ ID NO: 538835 - DNA, 25 bp, Rattus norvegicus
tcaggcgagcgttgtgcagcacctg

SEQ ID NO: 538836 - DNA, 25 bp, Rattus norvegicus
tggatcccgggctccgcttagcgat

SEQ ID NO: 538837 - DNA, 25 bp, Rattus norvegicus
ccgggctccgcttagcgatgctgaa

SEQ ID NO: 538838 - DNA, 25 bp, Rattus norvegicus
gctccgcttagcgatgctgaattgg

SEQ ID NO: 538839 - DNA, 25 bp, Rattus norvegicus
ccgcttagcgatgctgaattgggcc

SEQ ID NO: 538840 - DNA, 25 bp, Rattus norvegicus
ttagcgatgctgaattgggccgctg

SEQ ID NO: 538841 - DNA, 25 bp, Rattus norvegicus
aattgggccgctgggccgaattgct

SEQ ID NO: 538842 - DNA, 25 bp, Rattus norvegicus
gccgctgggccgaattgctttctcc

SEQ ID NO: 538843 - DNA, 25 bp, Rattus norvegicus
tgctttctcccctggacgaatcgcg

SEQ ID NO: 538844 - DNA, 25 bp, Rattus norvegicus
agcacctgctgagccggactctgct

SEQ ID NO: 538845 - DNA, 25 bp, Rattus norvegicus
gattatctttccctgtcagccaggc

SEQ ID NO: 538846 - DNA, 25 bp, Rattus norvegicus
atctcgaaagagctccaaggcggga

SEQ ID NO: 538847 - DNA, 25 bp, Rattus norvegicus
gtgcaatctaaccaggaacatctcg

SEQ ID NO: 538848 - DNA, 25 bp, Rattus norvegicus
tggtgccttggaggtgcaatctaac

SEQ ID NO: 538849 - DNA, 25 bp, Rattus norvegicus
cctcagtttacctggtggtgccttg

SEQ ID NO: 538850 - DNA, 25 bp, Rattus norvegicus
gtcactcgtggcagaggaacctttc

SEQ ID NO: 538851 - DNA, 25 bp, Rattus norvegicus
gttgccatggaaaccggcgagcgca

SEQ ID NO: 538852 - DNA, 25 bp, Rattus norvegicus
atagaggtaggcttgctcggttgcc

SEQ ID NO: 538853 - DNA, 25 bp, Rattus norvegicus
cgggttctgttcgtctcgcccgact

SEQ ID NO: 538854 - DNA, 25 bp, Rattus norvegicus
gccaggcccgctctaatacgtgtga

SEQ ID NO: 538855 - DNA, 25 bp, Rattus norvegicus
tggcgctagcgcacagattatcttt

SEQ ID NO: 538856 - DNA, 25 bp, Rattus norvegicus
atcgtccttaccgttgggtgccaga

SEQ ID NO: 538857 - DNA, 25 bp, Rattus norvegicus
gaaccacacttcttagggaatcgtc

SEQ ID NO: 538858 - DNA, 25 bp, Rattus norvegicus
tcgaggctccgtctctgcccattgg

SEQ ID NO: 538859 - DNA, 25 bp, Rattus norvegicus
ggaagccctgtagcgcgagaatttc

SEQ ID NO: 538860 - DNA, 25 bp, Rattus norvegicus
tgtagcgcgagaatttcctccaatc

SEQ ID NO: 538861 - DNA, 25 bp, Rattus norvegicus
tttcctccaatctcgtgagagcagc

SEQ ID NO: 538862 - DNA, 25 bp, Rattus norvegicus
caatctcgtgagagcagcagcggca

SEQ ID NO: 538863 - DNA, 25 bp, Rattus norvegicus
cagcagcggcatcgtccggtgcgca

SEQ ID NO: 538864 - DNA, 25 bp, Rattus norvegicus
tgcgctgtcggttctggaacgcgac

SEQ ID NO: 538865 - DNA, 25 bp, Rattus norvegicus
cccgaagcagtacggcatatcgtcc

SEQ ID NO: 538866 - DNA, 25 bp, Rattus norvegicus
ttctggaacgcgaccgctgaggagc

SEQ ID NO: 538867 - DNA, 25 bp, Rattus norvegicus
ctcgcgccttcggatcatgagccga

SEQ ID NO: 538868 - DNA, 25 bp, Rattus norvegicus
tcatgagccgagcagaggccaccga

SEQ ID NO: 538869 - DNA, 25 bp, Rattus norvegicus
gcgggagctagagatgatgccattt

SEQ ID NO: 538870 - DNA, 25 bp, Rattus norvegicus
atgatgccatttgcggtgaccaccc

SEQ ID NO: 538871 - DNA, 25 bp, Rattus norvegicus
cggtgaccacccaaggagcacaaca

SEQ ID NO: 538872 - DNA, 25 bp, Rattus norvegicus
gcgctcttccggaagccctgtagcg

SEQ ID NO: 538873 - DNA, 25 bp, Rattus norvegicus
agaatctggagcgttagctgccggc

SEQ ID NO: 538874 - DNA, 25 bp, Rattus norvegicus
acaccgggcctgagctacgcagcgg

SEQ ID NO: 538875 - DNA, 25 bp, Rattus norvegicus
agatccgcagacctggcctggtgca

SEQ ID NO: 538876 - DNA, 25 bp, Rattus norvegicus
aagcccaccggcgaccgaaatgttg

SEQ ID NO: 538877 - DNA, 25 bp, Rattus norvegicus
gaccgaaatgttgtcgcgggcttcc

SEQ ID NO: 538878 - DNA, 25 bp, Rattus norvegicus
cttccggggtcgtgtcacgtgacat

SEQ ID NO: 538879 - DNA, 25 bp, Rattus norvegicus
cctagctgcatcacgtgggagaatc

SEQ ID NO: 538880 - DNA, 25 bp, Rattus norvegicus
ggcttcctgtaccacaccacgtggg

SEQ ID NO: 538881 - DNA, 25 bp, Rattus norvegicus
cactagggacagaccaacttccggt

SEQ ID NO: 538882 - DNA, 25 bp, Rattus norvegicus
accaacttccggtcctgcggctgga

SEQ ID NO: 538883 - DNA, 25 bp, Rattus norvegicus
ggctggaagcctcggccaaaacgta

SEQ ID NO: 538884 - DNA, 25 bp, Rattus norvegicus
tcggccaaaacgtacagcccatctg

SEQ ID NO: 538885 - DNA, 25 bp, Rattus norvegicus
gtacagcccatctgccgggctttta

SEQ ID NO: 538886 - DNA, 25 bp, Rattus norvegicus
tgaccgggctgtgtttcccttcctc

SEQ ID NO: 538887 - DNA, 25 bp, Rattus norvegicus
gcaaaaccgcggatcgctggattta

SEQ ID NO: 538888 - DNA, 25 bp, Rattus norvegicus
tctccgcctagtgcgtcggtgcgca

SEQ ID NO: 538889 - DNA, 25 bp, Rattus norvegicus
tacataggcgcatgcgcagaggctc

SEQ ID NO: 538890 - DNA, 25 bp, Rattus norvegicus
gcaccgacggatacataggcgcatg

SEQ ID NO: 538891 - DNA, 25 bp, Rattus norvegicus
tcgctggatttagacccaggggaac

SEQ ID NO: 538892 - DNA, 25 bp, Rattus norvegicus
tataaacagaactcccggtgggagc

SEQ ID NO: 538893 - DNA, 25 bp, Rattus norvegicus
cggtcgcgcggtgtgtttataaaca

SEQ ID NO: 538894 - DNA, 25 bp, Rattus norvegicus
tagcgcgggtgcctgtctccgccta

SEQ ID NO: 538895 - DNA, 25 bp, Rattus norvegicus
tggcggaagcagttctctccgtctg

SEQ ID NO: 538896 - DNA, 25 bp, Rattus norvegicus
cctgatgcggccatccgagcatgcg

SEQ ID NO: 538897 - DNA, 25 bp, Rattus norvegicus
agctcagccgggacaccggaagacg

SEQ ID NO: 538898 - DNA, 25 bp, Rattus norvegicus
tcaggcaacggcgtgcagctcagcc

SEQ ID NO: 538899 - DNA, 25 bp, Rattus norvegicus
agtagccgccacacatgtgaccgcg

SEQ ID NO: 538900 - DNA, 25 bp, Rattus norvegicus
cgcatgcgcaccgacggatacatag

SEQ ID NO: 538901 - DNA, 25 bp, Rattus norvegicus
gcagtaataataatttcgggcattc

SEQ ID NO: 538902 - DNA, 25 bp, Rattus norvegicus
gtcgaactccgtttctcttccagtg

SEQ ID NO: 538903 - DNA, 25 bp, Rattus norvegicus
tacatcccggtgtctgctgatgtcg

SEQ ID NO: 538904 - DNA, 25 bp, Rattus norvegicus
tgtctgctgatgtcgggttgatgat

SEQ ID NO: 538905 - DNA, 25 bp, Rattus norvegicus
ctcccatagctgtgcagtccacttg

SEQ ID NO: 538906 - DNA, 25 bp, Rattus norvegicus
gcagtccacttgtgagtcgaactcc

SEQ ID NO: 538907 - DNA, 25 bp, Rattus norvegicus
cgtttctcttccagtgcacactcag

SEQ ID NO: 538908 - DNA, 25 bp, Rattus norvegicus
agtgcacactcagctcctccacggg

SEQ ID NO: 538909 - DNA, 25 bp, Rattus norvegicus
cggagtgtcgcctcgcacacgtaca

SEQ ID NO: 538910 - DNA, 25 bp, Rattus norvegicus
cgtggacggcagtaataataatttc

SEQ ID NO: 538911 - DNA, 25 bp, Rattus norvegicus
tcgcacacgtacatcccggtgtctg

SEQ ID NO: 538912 - DNA, 25 bp, Rattus norvegicus
tttcgggcattcagtgcgagagctg

SEQ ID NO: 538913 - DNA, 25 bp, Rattus norvegicus
ttcagtgcgagagctggacaaagcg

SEQ ID NO: 538914 - DNA, 25 bp, Rattus norvegicus
gcggtcacgtggacggcagtaataa

SEQ ID NO: 538915 - DNA, 25 bp, Rattus norvegicus
ccacggcgctcgcttgttttcaaac

SEQ ID NO: 538916 - DNA, 25 bp, Rattus norvegicus
cggggaaatgctcggcacgtcgtcc

SEQ ID NO: 538917 - DNA, 25 bp, Rattus norvegicus
acccgcggcgaagattgcagtcggc

SEQ ID NO: 538918 - DNA, 25 bp, Rattus norvegicus
tcgcttgttttcaaactcgccgcgc

SEQ ID NO: 538919 - DNA, 25 bp, Rattus norvegicus
cgcccgcttgcaatttcgtgccggg

SEQ ID NO: 538920 - DNA, 25 bp, Rattus norvegicus
ttgcaatttcgtgccggggcccaga

SEQ ID NO: 538921 - DNA, 25 bp, Rattus norvegicus
attggccgagcctggcgactctcgc

SEQ ID NO: 538922 - DNA, 25 bp, Rattus norvegicus
gaagattgcagtcggcgcgccgtct

SEQ ID NO: 538923 - DNA, 25 bp, Rattus norvegicus
tcaggccgggcggtgcctgctcttt

SEQ ID NO: 538924 - DNA, 25 bp, Rattus norvegicus
gcggtgcctgctctttgcccggagc

SEQ ID NO: 538925 - DNA, 25 bp, Rattus norvegicus
cgctgaggagaaagtgcgcccgccc

SEQ ID NO: 538926 - DNA, 25 bp, Rattus norvegicus
ctctctgaggggagctgagcagaac

SEQ ID NO: 538927 - DNA, 25 bp, Rattus norvegicus
tccgggctccggtgaacagcgagcc

SEQ ID NO: 538928 - DNA, 25 bp, Rattus norvegicus
gagctgagcagaacgcctctgccgc

SEQ ID NO: 538929 - DNA, 25 bp, Rattus norvegicus
cgcacctaccttgcgccagcgcccg

SEQ ID NO: 538930 - DNA, 25 bp, Rattus norvegicus
ggtcctgggtagctgcgcgcagccc

SEQ ID NO: 538931 - DNA, 25 bp, Rattus norvegicus
ttcaggagcccaccccgggattgcg

SEQ ID NO: 538932 - DNA, 25 bp, Rattus norvegicus
gcccacccacggaggcacccataaa

SEQ ID NO: 538933 - DNA, 25 bp, Rattus norvegicus
acggaggcacccataaagtccacct

SEQ ID NO: 538934 - DNA, 25 bp, Rattus norvegicus
ccataaagtccacctccgggtgtca

SEQ ID NO: 538935 - DNA, 25 bp, Rattus norvegicus
acctccgggtgtcaccgcgttcagg

SEQ ID NO: 538936 - DNA, 25 bp, Rattus norvegicus
gggtgtcaccgcgttcaggcccgca

SEQ ID NO: 538937 - DNA, 25 bp, Rattus norvegicus
tcaccgcgttcaggcccgcacctac

SEQ ID NO: 538938 - DNA, 25 bp, Rattus norvegicus
agcgcccgcagcaagtgcagctgga

SEQ ID NO: 538939 - DNA, 25 bp, Rattus norvegicus
gctggagcaacagcagtgcccacca

SEQ ID NO: 538940 - DNA, 25 bp, Rattus norvegicus
ccgcagcaagtgcagctggagcaac

SEQ ID NO: 538941 - DNA, 25 bp, Rattus norvegicus
tcaactttgccgaccgccggcccgc

SEQ ID NO: 538942 - DNA, 25 bp, Rattus norvegicus
cgcggcccggcctcaactttgccga

SEQ ID NO: 538943 - DNA, 25 bp, Rattus norvegicus
agatgcgcatcatccacggccggga

SEQ ID NO: 538944 - DNA, 25 bp, Rattus norvegicus
ggcaagtccaccttcctcaagcaga

SEQ ID NO: 538945 - DNA, 25 bp, Rattus norvegicus
gctcggcagtccaatgagaagctcc

SEQ ID NO: 538946 - DNA, 25 bp, Rattus norvegicus
gagaagctccctaaccgcaaagatc

SEQ ID NO: 538947 - DNA, 25 bp, Rattus norvegicus
caaggaccataggagtgcccgcctc

SEQ ID NO: 538948 - DNA, 25 bp, Rattus norvegicus
cttgtccaataaaaaggtgcgctcc

SEQ ID NO: 538949 - DNA, 25 bp, Rattus norvegicus
tgcgctccacaagatagacgacttc

SEQ ID NO: 538950 - DNA, 25 bp, Rattus norvegicus
tggagttccgcgacaccatcttcga

SEQ ID NO: 538951 - DNA, 25 bp, Rattus norvegicus
acatccttaaggtgacgcgcggccc

SEQ ID NO: 538952 - DNA, 25 bp, Rattus norvegicus
aatagggacctcaagccacgccagc

SEQ ID NO: 538953 - DNA, 25 bp, Rattus norvegicus
gccagccggggttactccaatgacc

SEQ ID NO: 538954 - DNA, 25 bp, Rattus norvegicus
tccaatgacctccaggggcgcgatt

SEQ ID NO: 538955 - DNA, 25 bp, Rattus norvegicus
gattggtttgcaaagccctggacgc

SEQ ID NO: 538956 - DNA, 25 bp, Rattus norvegicus
taaaagagtttttgcgaggcaccgc

SEQ ID NO: 538957 - DNA, 25 bp, Rattus norvegicus
gtcgccaaggctcgccaaaaccgct

SEQ ID NO: 538958 - DNA, 25 bp, Rattus norvegicus
tgaaatcccagtcgccaaggctcgc

SEQ ID NO: 538959 - DNA, 25 bp, Rattus norvegicus
gccctccggagctgtcccagagaag

SEQ ID NO: 538960 - DNA, 25 bp, Rattus norvegicus
gtggttgctctctgagcgcccccta

SEQ ID NO: 538961 - DNA, 25 bp, Rattus norvegicus
aaccggtgctggtgtgacgtcagca

SEQ ID NO: 538962 - DNA, 25 bp, Rattus norvegicus
acccacacccacaccggcaatcagg

SEQ ID NO: 538963 - DNA, 25 bp, Rattus norvegicus
gtaacacgtatgaaatcccagtcgc

SEQ ID NO: 538964 - DNA, 25 bp, Rattus norvegicus
ttgctggaatctccactccgcagcg

SEQ ID NO: 538965 - DNA, 25 bp, Rattus norvegicus
tggcttgcgcttgctggaatctcca

SEQ ID NO: 538966 - DNA, 25 bp, Rattus norvegicus
caagtacaccgagtacatcccatgg

SEQ ID NO: 538967 - DNA, 25 bp, Rattus norvegicus
accaaaccggtgctggtgtgacgtc

SEQ ID NO: 538968 - DNA, 25 bp, Rattus norvegicus
aaccgctatccaagtacaccgagta

SEQ ID NO: 538969 - DNA, 25 bp, Rattus norvegicus
ctgtcccagagaagcttggtgtgcg

SEQ ID NO: 538970 - DNA, 25 bp, Rattus norvegicus
catcccatggtctccctcatagggg

SEQ ID NO: 538971 - DNA, 25 bp, Rattus norvegicus
agcctcgaccatatcatccggcatg

SEQ ID NO: 538972 - DNA, 25 bp, Rattus norvegicus
atccggcatggagaatgctggccca

SEQ ID NO: 538973 - DNA, 25 bp, Rattus norvegicus
caggtgaactgggtcagagactccc

SEQ ID NO: 538974 - DNA, 25 bp, Rattus norvegicus
gcggatcctgataccagcagggctc

SEQ ID NO: 538975 - DNA, 25 bp, Rattus norvegicus
ggcgtttgccagtcctctcagccta

SEQ ID NO: 538976 - DNA, 25 bp, Rattus norvegicus
agcggctgagctcttctcgcgttgc

SEQ ID NO: 538977 - DNA, 25 bp, Rattus norvegicus
gctccctcgcttggcgcagagacag

SEQ ID NO: 538978 - DNA, 25 bp, Rattus norvegicus
agatcagcacccgacaactgcgaca

SEQ ID NO: 538979 - DNA, 25 bp, Rattus norvegicus
ctccgccttgtttctgaccgcaaaa

SEQ ID NO: 538980 - DNA, 25 bp, Rattus norvegicus
tttctgaccgcaaaagcctccgagc

SEQ ID NO: 538981 - DNA, 25 bp, Rattus norvegicus
cggacctgccttgcgtttcgcttga

SEQ ID NO: 538982 - DNA, 25 bp, Rattus norvegicus
ttgaagttcttggtcttgccgggtc

SEQ ID NO: 538983 - DNA, 25 bp, Rattus norvegicus
tcccttgcccggctcaggtgaactg

SEQ ID NO: 538984 - DNA, 25 bp, Rattus norvegicus
ttggcgcagagacagatcagcaccc

SEQ ID NO: 538985 - DNA, 25 bp, Rattus norvegicus
tgcttggagactggtgatgaccctg

SEQ ID NO: 538986 - DNA, 25 bp, Rattus norvegicus
aggcagtaggcggaacgtctccaag

SEQ ID NO: 538987 - DNA, 25 bp, Rattus norvegicus
ctcctaatttcgcaggcctcagcga

SEQ ID NO: 538988 - DNA, 25 bp, Rattus norvegicus
ggaagttcctctccgcgtggccaca

SEQ ID NO: 538989 - DNA, 25 bp, Rattus norvegicus
gattccttgccctgcgggagtctgt

SEQ ID NO: 538990 - DNA, 25 bp, Rattus norvegicus
ttcacccgctgtggttccggtgtct

SEQ ID NO: 538991 - DNA, 25 bp, Rattus norvegicus
aaattccgcttcacgctggccgagg

SEQ ID NO: 538992 - DNA, 25 bp, Rattus norvegicus
actaatctctcggagctatcgcgcc

SEQ ID NO: 538993 - DNA, 25 bp, Rattus norvegicus
gaccctgcggtttcgatcacttcta

SEQ ID NO: 538994 - DNA, 25 bp, Rattus norvegicus
ttcaaacctgtgaacgcgtgattta

SEQ ID NO: 538995 - DNA, 25 bp, Rattus norvegicus
cgcgtgatttacaaacgatgtgtgc

SEQ ID NO: 538996 - DNA, 25 bp, Rattus norvegicus
gtttgggactttcacactgtactaa

SEQ ID NO: 538997 - DNA, 25 bp, Rattus norvegicus
ttttagagttcgcactacgcaccgc

SEQ ID NO: 538998 - DNA, 25 bp, Rattus norvegicus
ccctaagtcagtaccacgtgacgga

SEQ ID NO: 538999 - DNA, 25 bp, Rattus norvegicus
tcagcccatcgaaagccagcgggtc

SEQ ID NO: 539000 - DNA, 25 bp, Rattus norvegicus
cataaatcggcgtacccacagggaa

SEQ ID NO: 539001 - DNA, 25 bp, Rattus norvegicus
caccaagcagctcctcatcagaaga

SEQ ID NO: 539002 - DNA, 25 bp, Rattus norvegicus
cctcatcagaagacggtagcgaatc

SEQ ID NO: 539003 - DNA, 25 bp, Rattus norvegicus
cggtagcgaatcctcgtccaggtgc

SEQ ID NO: 539004 - DNA, 25 bp, Rattus norvegicus
aatcctcgtccaggtgccgcgttag

SEQ ID NO: 539005 - DNA, 25 bp, Rattus norvegicus
tccaggtgccgcgttaggctcagcc

SEQ ID NO: 539006 - DNA, 25 bp, Rattus norvegicus
ttaggctcagcccatcgaaagccag

SEQ ID NO: 539007 - DNA, 25 bp, Rattus norvegicus
aaagccagcgggtcctcgaatgtgg

SEQ ID NO: 539008 - DNA, 25 bp, Rattus norvegicus
tgggcctttcagcaaccgaacctgg

SEQ ID NO: 539009 - DNA, 25 bp, Rattus norvegicus
tcagcaaccgaacctggagtgcgcg

SEQ ID NO: 539010 - DNA, 25 bp, Rattus norvegicus
cacccacgggttggaggcataaatc

SEQ ID NO: 539011 - DNA, 25 bp, Rattus norvegicus
gtcctcgaatgtgggtgggcctttc

SEQ ID NO: 539012 - DNA, 25 bp, Rattus norvegicus
ttggaggcataaatcggcgtaccca

SEQ ID NO: 539013 - DNA, 25 bp, Rattus norvegicus
ggccgaccggcgataaactcatctc

SEQ ID NO: 539014 - DNA, 25 bp, Rattus norvegicus
tgcacccggcgagaccaaaaacagc

SEQ ID NO: 539015 - DNA, 25 bp, Rattus norvegicus
cagccacaagagacaaggtgcgatt

SEQ ID NO: 539016 - DNA, 25 bp, Rattus norvegicus
caaggtgcgattgcgcagtgcaacc

SEQ ID NO: 539017 - DNA, 25 bp, Rattus norvegicus
cacacactgcgcgtgcacaggattc

SEQ ID NO: 539018 - DNA, 25 bp, Rattus norvegicus
ggcatcggaggaaggaccacatccg

SEQ ID NO: 539019 - DNA, 25 bp, Rattus norvegicus
ggcacggttgccatggtaccaggtt

SEQ ID NO: 539020 - DNA, 25 bp, Rattus norvegicus
ggcctcccaagctgagggccgagct

SEQ ID NO: 539021 - DNA, 25 bp, Rattus norvegicus
gccgctatgagcctgggcaccacag

SEQ ID NO: 539022 - DNA, 25 bp, Rattus norvegicus
ggcaccacagatctgacctcggaga

SEQ ID NO: 539023 - DNA, 25 bp, Rattus norvegicus
ccggcaggccgattgttaccgcaca

SEQ ID NO: 539024 - DNA, 25 bp, Rattus norvegicus
tgttaccgcacaagagccagctccg

SEQ ID NO: 539025 - DNA, 25 bp, Rattus norvegicus
gcggtggccactacttccaggaagc

SEQ ID NO: 539026 - DNA, 25 bp, Rattus norvegicus
tctcgtaagtgttgctgtaggctgc

SEQ ID NO: 539027 - DNA, 25 bp, Rattus norvegicus
ggtgagcctcttgcaccggctgccg

SEQ ID NO: 539028 - DNA, 25 bp, Rattus norvegicus
cgtgcatccggcagcgagggaagcc

SEQ ID NO: 539029 - DNA, 25 bp, Rattus norvegicus
ggaggccaccagcagccaattccgg

SEQ ID NO: 539030 - DNA, 25 bp, Rattus norvegicus
tagcaggcacgatgagggcagctga

SEQ ID NO: 539031 - DNA, 25 bp, Rattus norvegicus
gctaaagaccgggaggatggctgag

SEQ ID NO: 539032 - DNA, 25 bp, Rattus norvegicus
ggtctgcgagatgccggccaatagc

SEQ ID NO: 539033 - DNA, 25 bp, Rattus norvegicus
cagcggcggtgaacaaagaggcggc

SEQ ID NO: 539034 - DNA, 25 bp, Rattus norvegicus
ccctggtgggtgagcctcttgcacc

SEQ ID NO: 539035 - DNA, 25 bp, Rattus norvegicus
gctgccgcacttcgacctgcggtgg

SEQ ID NO: 539036 - DNA, 25 bp, Rattus norvegicus
caattccggcccgaggacgctgact

SEQ ID NO: 539037 - DNA, 25 bp, Rattus norvegicus
ggcccgaggacgctgactaccagca

SEQ ID NO: 539038 - DNA, 25 bp, Rattus norvegicus
gaggacgctgactaccagcaggtga

SEQ ID NO: 539039 - DNA, 25 bp, Rattus norvegicus
cgctgactaccagcaggtgacgcgc

SEQ ID NO: 539040 - DNA, 25 bp, Rattus norvegicus
agatgccggccaatagcggtgtgga

SEQ ID NO: 539041 - DNA, 25 bp, Rattus norvegicus
ccctcgcgggatgaaaggctacctt

SEQ ID NO: 539042 - DNA, 25 bp, Rattus norvegicus
gccggcggccgaacgtaatatcgcc

SEQ ID NO: 539043 - DNA, 25 bp, Rattus norvegicus
ggcgtaacctctagggcgatctcta

SEQ ID NO: 539044 - DNA, 25 bp, Rattus norvegicus
gcgatctctagttcccacgtgggac

SEQ ID NO: 539045 - DNA, 25 bp, Rattus norvegicus
ctgggtgatagagccagtgctcctc

SEQ ID NO: 539046 - DNA, 25 bp, Rattus norvegicus
cgcgagcgacatccttggcttctca

SEQ ID NO: 539047 - DNA, 25 bp, Rattus norvegicus
ccgtgctgaccgagccaaagtggta

SEQ ID NO: 539048 - DNA, 25 bp, Rattus norvegicus
caaagtggtagccagcagagtgtcc

SEQ ID NO: 539049 - DNA, 25 bp, Rattus norvegicus
cctgagcgattaattttgggctgcc

SEQ ID NO: 539050 - DNA, 25 bp, Rattus norvegicus
tgggctgcccttactgatacttatg

SEQ ID NO: 539051 - DNA, 25 bp, Rattus norvegicus
aattctatgtccctccgtcggtccg

SEQ ID NO: 539052 - DNA, 25 bp, Rattus norvegicus
aggagacactcggacagcctcttcc

SEQ ID NO: 539053 - DNA, 25 bp, Rattus norvegicus
ggctaccttctgttccatttggttc

SEQ ID NO: 539054 - DNA, 25 bp, Rattus norvegicus
cctcctccaggtaggtctgttttgg

SEQ ID NO: 539055 - DNA, 25 bp, Rattus norvegicus
tcgtagtctatctggcacgggtggc

SEQ ID NO: 539056 - DNA, 25 bp, Rattus norvegicus
aggcctgcgctgaaagcctcgctca

SEQ ID NO: 539057 - DNA, 25 bp, Rattus norvegicus
cagttcgtagttggggatgtcgtca

SEQ ID NO: 539058 - DNA, 25 bp, Rattus norvegicus
gcggtcgtccacaatcaggtggttc

SEQ ID NO: 539059 - DNA, 25 bp, Rattus norvegicus
gatcatcactcgcttccagttggtg

SEQ ID NO: 539060 - DNA, 25 bp, Rattus norvegicus
aggctctcgctcagcacgatcatca

SEQ ID NO: 539061 - DNA, 25 bp, Rattus norvegicus
cggcgccagaacttgttgaaggtca

SEQ ID NO: 539062 - DNA, 25 bp, Rattus norvegicus
cttcatgaggtgacgggagaacttc

SEQ ID NO: 539063 - DNA, 25 bp, Rattus norvegicus
gtacttcttcagcttgaccttcatg

SEQ ID NO: 539064 - DNA, 25 bp, Rattus norvegicus
cacgaacaggaacttggtgtacttc

SEQ ID NO: 539065 - DNA, 25 bp, Rattus norvegicus
aacttgctgcggaaggctgagatga

SEQ ID NO: 539066 - DNA, 25 bp, Rattus norvegicus
ctcctcgttttccagctcgaacttg

SEQ ID NO: 539067 - DNA, 25 bp, Rattus norvegicus
cgcgaacttgcggtaaaactcctcg

SEQ ID NO: 539068 - DNA, 25 bp, Rattus norvegicus
gagaacttcccgtagcggcgccaga

SEQ ID NO: 539069 - DNA, 25 bp, Rattus norvegicus
gacgcccggtcttctcggagaaaca

SEQ ID NO: 539070 - DNA, 25 bp, Rattus norvegicus
gccttcccgggagcagagggctcct

SEQ ID NO: 539071 - DNA, 25 bp, Rattus norvegicus
tctacgaaatcctcggggtcgctga

SEQ ID NO: 539072 - DNA, 25 bp, Rattus norvegicus
tcctcgctcacgtcgtctacgaaat

SEQ ID NO: 539073 - DNA, 25 bp, Rattus norvegicus
tggacataatcacgactcacagccc

SEQ ID NO: 539074 - DNA, 25 bp, Rattus norvegicus
gtggataccctcaccatggacataa

SEQ ID NO: 539075 - DNA, 25 bp, Rattus norvegicus
ctcgacgacttaagtggataccctc

SEQ ID NO: 539076 - DNA, 25 bp, Rattus norvegicus
gagacctcgcgctctcgacgactta

SEQ ID NO: 539077 - DNA, 25 bp, Rattus norvegicus
gccacgttctcagcgtcctgcatgg

SEQ ID NO: 539078 - DNA, 25 bp, Rattus norvegicus
cccttacagtagaggaaacagaggg

SEQ ID NO: 539079 - DNA, 25 bp, Rattus norvegicus
cctcttcggattgggccgccggctt

SEQ ID NO: 539080 - DNA, 25 bp, Rattus norvegicus
cgccgccgtttcctcttcggattgg

SEQ ID NO: 539081 - DNA, 25 bp, Rattus norvegicus
aaacagagggtcgttgcagcccgga

SEQ ID NO: 539082 - DNA, 25 bp, Rattus norvegicus
ggagggctcatctgcctctccgttc

SEQ ID NO: 539083 - DNA, 25 bp, Rattus norvegicus
gtggctttaatctcaatggacatcc

SEQ ID NO: 539084 - DNA, 25 bp, Rattus norvegicus
aagtcactgtggttcagtccgccgg

SEQ ID NO: 539085 - DNA, 25 bp, Rattus norvegicus
tagcggctcgcacgttagcccgcga

SEQ ID NO: 539086 - DNA, 25 bp, Rattus norvegicus
ttagcccgcgagatgaaagtcactg

SEQ ID NO: 539087 - DNA, 25 bp, Rattus norvegicus
agaacgcgatcacgtgggccagcgt

SEQ ID NO: 539088 - DNA, 25 bp, Rattus norvegicus
agtccgccggtgactgctatcttca

SEQ ID NO: 539089 - DNA, 25 bp, Rattus norvegicus
tgctatcttcacacgcgggagaacg

SEQ ID NO: 539090 - DNA, 25 bp, Rattus norvegicus
ttccaaaattacacgaggagctcgc

SEQ ID NO: 539091 - DNA, 25 bp, Rattus norvegicus
aggagctcgccgacagccagaggcc

SEQ ID NO: 539092 - DNA, 25 bp, Rattus norvegicus
gaggccgccaacatacagaaaaatg

SEQ ID NO: 539093 - DNA, 25 bp, Rattus norvegicus
cagaaaaatgactgcctgcacaatg

SEQ ID NO: 539094 - DNA, 25 bp, Rattus norvegicus
cctgcacaatgcagagtcgtgtgac

SEQ ID NO: 539095 - DNA, 25 bp, Rattus norvegicus
agtcgtgtgacgagtggctttaatc

SEQ ID NO: 539096 - DNA, 25 bp, Rattus norvegicus
atggacatcctcaccgtagcggctc

SEQ ID NO: 539097 - DNA, 25 bp, Rattus norvegicus
cgagcgggctcacatgactggccgc

SEQ ID NO: 539098 - DNA, 25 bp, Rattus norvegicus
cccagtgtggagagccaggtgcctc

SEQ ID NO: 539099 - DNA, 25 bp, Rattus norvegicus
gccctcgccggcagtcgctgcagca

SEQ ID NO: 539100 - DNA, 25 bp, Rattus norvegicus
gctcacatgactggccgcgcgatgg

SEQ ID NO: 539101 - DNA, 25 bp, Rattus norvegicus
gggaccacctgtcggcgccacacct

SEQ ID NO: 539102 - DNA, 25 bp, Rattus norvegicus
agcttggaacaacgcccgggccgag

SEQ ID NO: 539103 - DNA, 25 bp, Rattus norvegicus
ttggaccagagcttggaacaacgcc

SEQ ID NO: 539104 - DNA, 25 bp, Rattus norvegicus
gcactttgtcttggaccagagcttg

SEQ ID NO: 539105 - DNA, 25 bp, Rattus norvegicus
agcgctagcactttgtcttggacca

SEQ ID NO: 539106 - DNA, 25 bp, Rattus norvegicus
tgagtgacagccgctggctaagagc

SEQ ID NO: 539107 - DNA, 25 bp, Rattus norvegicus
gccacaccttgcctgaccgggggtg

SEQ ID NO: 539108 - DNA, 25 bp, Rattus norvegicus
tgctcttcagccctccgttagcgcg

SEQ ID NO: 539109 - DNA, 25 bp, Rattus norvegicus
gggcagtaaggagcgctagcacttt

SEQ ID NO: 539110 - DNA, 25 bp, Rattus norvegicus
agccaggtgcctcgcactcggggac

SEQ ID NO: 539111 - DNA, 25 bp, Rattus norvegicus
ggaagtctcgcgatacataggcacc

SEQ ID NO: 539112 - DNA, 25 bp, Rattus norvegicus
cctcaactcgggtaagtggccgagt

SEQ ID NO: 539113 - DNA, 25 bp, Rattus norvegicus
cgcatatttgattctttacgggccg

SEQ ID NO: 539114 - DNA, 25 bp, Rattus norvegicus
gagaccctcgcggaagtctcgcgat

SEQ ID NO: 539115 - DNA, 25 bp, Rattus norvegicus
gcctgtggcgcgcatatttgattct

SEQ ID NO: 539116 - DNA, 25 bp, Rattus norvegicus
ctcgcgatacataggcaccggcgga

SEQ ID NO: 539117 - DNA, 25 bp, Rattus norvegicus
gcactcggctcctcaactcgggtaa

SEQ ID NO: 539118 - DNA, 25 bp, Rattus norvegicus
ccgaccgtaccgacgccatgggaag

SEQ ID NO: 539119 - DNA, 25 bp, Rattus norvegicus
acgccatgggaaggagctgtccgct

SEQ ID NO: 539120 - DNA, 25 bp, Rattus norvegicus
ggcatgcacacagtccgagtcgatc

SEQ ID NO: 539121 - DNA, 25 bp, Rattus norvegicus
ccgagtcgatcctgtcgcgcgactt

SEQ ID NO: 539122 - DNA, 25 bp, Rattus norvegicus
cgcgcgacttccctttgcggggtct

SEQ ID NO: 539123 - DNA, 25 bp, Rattus norvegicus
cggggtcttccgtgtcgtgctcccg

SEQ ID NO: 539124 - DNA, 25 bp, Rattus norvegicus
ttacgggccgttttctcagatctcg

SEQ ID NO: 539125 - DNA, 25 bp, Rattus norvegicus
ctggccgcatcgtagttgttgccta

SEQ ID NO: 539126 - DNA, 25 bp, Rattus norvegicus
ccacgcgtggcaccgtggtataggt

SEQ ID NO: 539127 - DNA, 25 bp, Rattus norvegicus
agcaccgggatgagcaccaccagca

SEQ ID NO: 539128 - DNA, 25 bp, Rattus norvegicus
tgaaaaagtaggtgccaggaatgtt

SEQ ID NO: 539129 - DNA, 25 bp, Rattus norvegicus
taaacttgccgctggccgcatcgta

SEQ ID NO: 539130 - DNA, 25 bp, Rattus norvegicus
tgttgcctaggttggtgaccacgtc

SEQ ID NO: 539131 - DNA, 25 bp, Rattus norvegicus
tgcgctgcccgactgaacgcagcgg

SEQ ID NO: 539132 - DNA, 25 bp, Rattus norvegicus
gcggctgctagcagcgtcttccggc

SEQ ID NO: 539133 - DNA, 25 bp, Rattus norvegicus
gagcacctcgtaaccctcatgaggg

SEQ ID NO: 539134 - DNA, 25 bp, Rattus norvegicus
cagcatctcatagtggccatccggg

SEQ ID NO: 539135 - DNA, 25 bp, Rattus norvegicus
gcgggataagggtcgcacaccatgc

SEQ ID NO: 539136 - DNA, 25 bp, Rattus norvegicus
ggccaggcttgcctggttcaccctt

SEQ ID NO: 539137 - DNA, 25 bp, Rattus norvegicus
cctcatgagggttcttgaggccggc

SEQ ID NO: 539138 - DNA, 25 bp, Rattus norvegicus
caggaatgttgcatgtaaacttgcc

SEQ ID NO: 539139 - DNA, 25 bp, Rattus norvegicus
ccaacagagaggacttgcagtgccc

SEQ ID NO: 539140 - DNA, 25 bp, Rattus norvegicus
gttacgttgaaaggtgcccgttgca

SEQ ID NO: 539141 - DNA, 25 bp, Rattus norvegicus
tgcagcacatcggagcgccaacaga

SEQ ID NO: 539142 - DNA, 25 bp, Rattus norvegicus
agcactcacccacggagggccagga

SEQ ID NO: 539143 - DNA, 25 bp, Rattus norvegicus
tcaggaggtctgcagaatgtgcccg

SEQ ID NO: 539144 - DNA, 25 bp, Rattus norvegicus
cagcgttcactaggccaggagtaca

SEQ ID NO: 539145 - DNA, 25 bp, Rattus norvegicus
cctcatcatagcaggggtcggcaga

SEQ ID NO: 539146 - DNA, 25 bp, Rattus norvegicus
gtggccgctgtgagtcaaccagcca

SEQ ID NO: 539147 - DNA, 25 bp, Rattus norvegicus
cccaacgattctgccctcgaggaga

SEQ ID NO: 539148 - DNA, 25 bp, Rattus norvegicus
ctcgaggagagagcctagtccgata

SEQ ID NO: 539149 - DNA, 25 bp, Rattus norvegicus
agtccgatactctgcgtgccgggtc

SEQ ID NO: 539150 - DNA, 25 bp, Rattus norvegicus
gtgccgggtcttcagtgccaagata

SEQ ID NO: 539151 - DNA, 25 bp, Rattus norvegicus
cacaggccagaagtgggagcagcca

SEQ ID NO: 539152 - DNA, 25 bp, Rattus norvegicus
cgagtcctcctgctaggcctggagc

SEQ ID NO: 539153 - DNA, 25 bp, Rattus norvegicus
gcctcccaaaccctcatgagtgggt

SEQ ID NO: 539154 - DNA, 25 bp, Rattus norvegicus
tactcggggctggatgaatagctca

SEQ ID NO: 539155 - DNA, 25 bp, Rattus norvegicus
gatagatgcctttcggcctcccaaa

SEQ ID NO: 539156 - DNA, 25 bp, Rattus norvegicus
ggctccaagatagatgcctttcggc

SEQ ID NO: 539157 - DNA, 25 bp, Rattus norvegicus
ccgggtcagaggctccaagatagat

SEQ ID NO: 539158 - DNA, 25 bp, Rattus norvegicus
gacagttgcgagtagacgaggtctc

SEQ ID NO: 539159 - DNA, 25 bp, Rattus norvegicus
atgccctgcaggtgtactcggggct

SEQ ID NO: 539160 - DNA, 25 bp, Rattus norvegicus
tcccagatgcttggggatgccctgc

SEQ ID NO: 539161 - DNA, 25 bp, Rattus norvegicus
agtctgagacgctcccagatgcttg

SEQ ID NO: 539162 - DNA, 25 bp, Rattus norvegicus
ctccgccggcttagtctgagacgct

SEQ ID NO: 539163 - DNA, 25 bp, Rattus norvegicus
ccatgaactccgcatcatccttgtg

SEQ ID NO: 539164 - DNA, 25 bp, Rattus norvegicus
caaaccctcatgagtgggtggaggt

SEQ ID NO: 539165 - DNA, 25 bp, Rattus norvegicus
atcatccttgtgtctccgccggctt

SEQ ID NO: 539166 - DNA, 25 bp, Rattus norvegicus
agggcgtggccagccgccatgaact

SEQ ID NO: 539167 - DNA, 25 bp, Rattus norvegicus
ggccttcttgtgtttctcctcctgt

SEQ ID NO: 539168 - DNA, 25 bp, Rattus norvegicus
ggtctttttcaagctgccagcggct

SEQ ID NO: 539169 - DNA, 25 bp, Rattus norvegicus
ttcaatgatggtctttttcaagctg

SEQ ID NO: 539170 - DNA, 25 bp, Rattus norvegicus
caatgatggtctttttcaagctgcc

SEQ ID NO: 539171 - DNA, 25 bp, Rattus norvegicus
tcgcctccgctttcgcaggcagtag

SEQ ID NO: 539172 - DNA, 25 bp, Rattus norvegicus
atggtctttttcaagctgccagcgg

SEQ ID NO: 539173 - DNA, 25 bp, Rattus norvegicus
tctttttcaagctgccagcggctgc

SEQ ID NO: 539174 - DNA, 25 bp, Rattus norvegicus
ctttttcaagctgccagcggctgct

SEQ ID NO: 539175 - DNA, 25 bp, Rattus norvegicus
tgctgccacggccttcttgtgtttc

SEQ ID NO: 539176 - DNA, 25 bp, Rattus norvegicus
ctgccacggccttcttgtgtttctc

SEQ ID NO: 539177 - DNA, 25 bp, Rattus norvegicus
gccacggccttcttgtgtttctcct

SEQ ID NO: 539178 - DNA, 25 bp, Rattus norvegicus
acggccttcttgtgtttctcctcct

SEQ ID NO: 539179 - DNA, 25 bp, Rattus norvegicus
tgtcgcctccgctttcgcaggcagt

SEQ ID NO: 539180 - DNA, 25 bp, Rattus norvegicus
tgatggtctttttcaagctgccagc

SEQ ID NO: 539181 - DNA, 25 bp, Rattus norvegicus
gcgtctgctcgggggtcccgcaaac

SEQ ID NO: 539182 - DNA, 25 bp, Rattus norvegicus
gcggcccggcccctttcaatcagcc

SEQ ID NO: 539183 - DNA, 25 bp, Rattus norvegicus
ctgcgtcgtccgatgcccctacccg

SEQ ID NO: 539184 - DNA, 25 bp, Rattus norvegicus
ccctacccgcggtcgcgtctgctcg

SEQ ID NO: 539185 - DNA, 25 bp, Rattus norvegicus
gcggattctagaggcaaggcgaccc

SEQ ID NO: 539186 - DNA, 25 bp, Rattus norvegicus
ttctagaggcaaggcgaccccaggt

SEQ ID NO: 539187 - DNA, 25 bp, Rattus norvegicus
tagaggcaaggcgaccccaggtcat

SEQ ID NO: 539188 - DNA, 25 bp, Rattus norvegicus
cccaggtcatgctcctggcttggct

SEQ ID NO: 539189 - DNA, 25 bp, Rattus norvegicus
caggtcatgctcctggcttggcttc

SEQ ID NO: 539190 - DNA, 25 bp, Rattus norvegicus
aggtcatgctcctggcttggcttcc

SEQ ID NO: 539191 - DNA, 25 bp, Rattus norvegicus
cactgacgcccccaggagaagaggc

SEQ ID NO: 539192 - DNA, 25 bp, Rattus norvegicus
cctacctgcgccgagagcgccgcca

SEQ ID NO: 539193 - DNA, 25 bp, Rattus norvegicus
cctgcgccgagagcgccgccatcgc

SEQ ID NO: 539194 - DNA, 25 bp, Rattus norvegicus
ggtcatgctcctggcttggcttccc

SEQ ID NO: 539195 - DNA, 25 bp, Rattus norvegicus
ccaggaggaagtagcccgcgtagac

SEQ ID NO: 539196 - DNA, 25 bp, Rattus norvegicus
tcgcacaccgagagcttggtcaggc

SEQ ID NO: 539197 - DNA, 25 bp, Rattus norvegicus
ggttgctgtaaatctcgcacaccga

SEQ ID NO: 539198 - DNA, 25 bp, Rattus norvegicus
gcagtagaaagggttgctgtaaatc

SEQ ID NO: 539199 - DNA, 25 bp, Rattus norvegicus
cccagcagctcgcaggagcagtaga

SEQ ID NO: 539200 - DNA, 25 bp, Rattus norvegicus
agccagcgcaggaaacccagcagct

SEQ ID NO: 539201 - DNA, 25 bp, Rattus norvegicus
gccttggcccaggaggaagtagccc

SEQ ID NO: 539202 - DNA, 25 bp, Rattus norvegicus
gcgtagacgggaggagactcacact

SEQ ID NO: 539203 - DNA, 25 bp, Rattus norvegicus
gcgggccaagcacttcagcagtgta

SEQ ID NO: 539204 - DNA, 25 bp, Rattus norvegicus
acttcagcagtgtaggagccctcag

SEQ ID NO: 539205 - DNA, 25 bp, Rattus norvegicus
taggagccctcagtgcacacggact

SEQ ID NO: 539206 - DNA, 25 bp, Rattus norvegicus
cacacggactgcagcttgctaagga

SEQ ID NO: 539207 - DNA, 25 bp, Rattus norvegicus
tgctaaggatgctacgttggtggcc

SEQ ID NO: 539208 - DNA, 25 bp, Rattus norvegicus
gagactcacactgcacacggtcgtg

SEQ ID NO: 539209 - DNA, 25 bp, Rattus norvegicus
ggcagcaccactcccggtttgtgcg

SEQ ID NO: 539210 - DNA, 25 bp, Rattus norvegicus
tcgctctcggattgaaattcctccc

SEQ ID NO: 539211 - DNA, 25 bp, Rattus norvegicus
cgctcagtccggctgcgagagtcgc

SEQ ID NO: 539212 - DNA, 25 bp, Rattus norvegicus
ctctgcttggatcgccctcatgatc

SEQ ID NO: 539213 - DNA, 25 bp, Rattus norvegicus
cctcatgatcctgcgtgccagagct

SEQ ID NO: 539214 - DNA, 25 bp, Rattus norvegicus
cgctgccgtccttcaagctctaagt

SEQ ID NO: 539215 - DNA, 25 bp, Rattus norvegicus
gaatcccgagcttcacgcttacctg

SEQ ID NO: 539216 - DNA, 25 bp, Rattus norvegicus
cgacgcgagaatcccgagcttcacg

SEQ ID NO: 539217 - DNA, 25 bp, Rattus norvegicus
ggccatgctgcgacgcgagaatccc

SEQ ID NO: 539218 - DNA, 25 bp, Rattus norvegicus
ccaagctcggcttcgggccatgctg

SEQ ID NO: 539219 - DNA, 25 bp, Rattus norvegicus
aagctctaagttcgctctcggattg

SEQ ID NO: 539220 - DNA, 25 bp, Rattus norvegicus
agggacagtagctcacgctgcgcgc

SEQ ID NO: 539221 - DNA, 25 bp, Rattus norvegicus
ttcctctaccgccaagttgctacaa

SEQ ID NO: 539222 - DNA, 25 bp, Rattus norvegicus
agaagcgcaatgtcgccaaccagtc

SEQ ID NO: 539223 - DNA, 25 bp, Rattus norvegicus
tctcaggacgccgagatacagcctc

SEQ ID NO: 539224 - DNA, 25 bp, Rattus norvegicus
cgctgcatgtccatcggtggccctg

SEQ ID NO: 539225 - DNA, 25 bp, Rattus norvegicus
tggttcattttgtgagcgcgaggca

SEQ ID NO: 539226 - DNA, 25 bp, Rattus norvegicus
ctcactgcgtcaagagccggggacc

SEQ ID NO: 539227 - DNA, 25 bp, Rattus norvegicus
ctgcggcgctcactgcgtcaagagc

SEQ ID NO: 539228 - DNA, 25 bp, Rattus norvegicus
gttctcgctggctccagacagacct

SEQ ID NO: 539229 - DNA, 25 bp, Rattus norvegicus
tgaaagctcggtcgcccgctagcgc

SEQ ID NO: 539230 - DNA, 25 bp, Rattus norvegicus
ccagggctgaaagctcggtcgcccg

SEQ ID NO: 539231 - DNA, 25 bp, Rattus norvegicus
ttcctacctgaaccggcttgtggcc

SEQ ID NO: 539232 - DNA, 25 bp, Rattus norvegicus
aaagccggcaagagcgtatcctccc

SEQ ID NO: 539233 - DNA, 25 bp, Rattus norvegicus
gcgccacccggaaagccggcaagag

SEQ ID NO: 539234 - DNA, 25 bp, Rattus norvegicus
gactaaatgcgtcgcctccgaaacc

SEQ ID NO: 539235 - DNA, 25 bp, Rattus norvegicus
gcgccctggagcctcagactaaatg

SEQ ID NO: 539236 - DNA, 25 bp, Rattus norvegicus
ctcttcctccttggggttctcgctg

SEQ ID NO: 539237 - DNA, 25 bp, Rattus norvegicus
tgcagggcctcgtacttggagcgca

SEQ ID NO: 539238 - DNA, 25 bp, Rattus norvegicus
gctcatcgtcgctaagaacaggggc

SEQ ID NO: 539239 - DNA, 25 bp, Rattus norvegicus
catggacaccagctcatcgtcgcta

SEQ ID NO: 539240 - DNA, 25 bp, Rattus norvegicus
gagttacctcctccttggtgagccc

SEQ ID NO: 539241 - DNA, 25 bp, Rattus norvegicus
ttcagccgagttacctcctccttgg

SEQ ID NO: 539242 - DNA, 25 bp, Rattus norvegicus
acagctggcggcgtagcctcggttc

SEQ ID NO: 539243 - DNA, 25 bp, Rattus norvegicus
gtcacgcgcttgatgcgacagctgg

SEQ ID NO: 539244 - DNA, 25 bp, Rattus norvegicus
tcctccttctgtgtcacgcgcttga

SEQ ID NO: 539245 - DNA, 25 bp, Rattus norvegicus
gagcgcagggcatccagctccagac

SEQ ID NO: 539246 - DNA, 25 bp, Rattus norvegicus
tcgctaagaacaggggcgttctcgc

SEQ ID NO: 539247 - DNA, 25 bp, Rattus norvegicus
cgaaggtctgcagggcctcgtactt

SEQ ID NO: 539248 - DNA, 25 bp, Rattus norvegicus
ctgttctcacgagccagcttctcta

SEQ ID NO: 539249 - DNA, 25 bp, Rattus norvegicus
cgcatgctgctgttctcacgagcca

SEQ ID NO: 539250 - DNA, 25 bp, Rattus norvegicus
cagctccagacgcatgctgctgttc

SEQ ID NO: 539251 - DNA, 25 bp, Rattus norvegicus
ggctcctgtagacacgcactcttca

SEQ ID NO: 539252 - DNA, 25 bp, Rattus norvegicus
tgcgcgcttcggactactcgttccg

SEQ ID NO: 539253 - DNA, 25 bp, Rattus norvegicus
cttcagggtgctcctcccgcaggtg

SEQ ID NO: 539254 - DNA, 25 bp, Rattus norvegicus
cctaagccaggtcctgcgtggcacg

SEQ ID NO: 539255 - DNA, 25 bp, Rattus norvegicus
aaatggccaggtgcgcacggctccc

SEQ ID NO: 539256 - DNA, 25 bp, Rattus norvegicus
aatcctacgccgacggaaatggcca

SEQ ID NO: 539257 - DNA, 25 bp, Rattus norvegicus
acaccagttactcaggccctttcag

SEQ ID NO: 539258 - DNA, 25 bp, Rattus norvegicus
cgctggccggtcagctgattagaaa

SEQ ID NO: 539259 - DNA, 25 bp, Rattus norvegicus
cgataggctggccaagacggtcacc

SEQ ID NO: 539260 - DNA, 25 bp, Rattus norvegicus
atcgcgcgtcgaagcgcgtcaccgt

SEQ ID NO: 539261 - DNA, 25 bp, Rattus norvegicus
accgcttccgggatcgcgcgtcgaa

SEQ ID NO: 539262 - DNA, 25 bp, Rattus norvegicus
tcggcaaagaacaacaagtcccggc

SEQ ID NO: 539263 - DNA, 25 bp, Rattus norvegicus
gctgattagaaagtgacaccagtta

SEQ ID NO: 539264 - DNA, 25 bp, Rattus norvegicus
ggactactcgttccgactcggcaaa

SEQ ID NO: 539265 - DNA, 25 bp, Rattus norvegicus
tcccaggtgacggcgcttcgtcgag

SEQ ID NO: 539266 - DNA, 25 bp, Rattus norvegicus
gccgccaagccctcaggtgggtccc

SEQ ID NO: 539267 - DNA, 25 bp, Rattus norvegicus
caccaccgtacggaggcccagcgcg

SEQ ID NO: 539268 - DNA, 25 bp, Rattus norvegicus
agccaagcccaccaccgtacggagg

SEQ ID NO: 539269 - DNA, 25 bp, Rattus norvegicus
ccgcgggcaggatgaatcgagccaa

SEQ ID NO: 539270 - DNA, 25 bp, Rattus norvegicus
tgagcgagcgagtgactcccgccgc

SEQ ID NO: 539271 - DNA, 25 bp, Rattus norvegicus
aatgactgagcgagcgagtgactcc

SEQ ID NO: 539272 - DNA, 25 bp, Rattus norvegicus
cccggcgcgagggatgaatgactga

SEQ ID NO: 539273 - DNA, 25 bp, Rattus norvegicus
gccctgggcactcggcccagtggcc

SEQ ID NO: 539274 - DNA, 25 bp, Rattus norvegicus
tgcacttggccctgttctgtgaccc

SEQ ID NO: 539275 - DNA, 25 bp, Rattus norvegicus
tgggctgcacttggccctgttctgt

SEQ ID NO: 539276 - DNA, 25 bp, Rattus norvegicus
ttcgtctccgcagtcggccgtgtgt

SEQ ID NO: 539277 - DNA, 25 bp, Rattus norvegicus
gtggcattcgtctccgcagtcggcc

SEQ ID NO: 539278 - DNA, 25 bp, Rattus norvegicus
aggatgaatcgagccaagcccacca

SEQ ID NO: 539279 - DNA, 25 bp, Rattus norvegicus
cctgaacaaactggggcggtgcagc

SEQ ID NO: 539280 - DNA, 25 bp, Rattus norvegicus
ggccttctgcgctatcttgcaccga

SEQ ID NO: 539281 - DNA, 25 bp, Rattus norvegicus
agggcctgtggccagctcctcgagc

SEQ ID NO: 539282 - DNA, 25 bp, Rattus norvegicus
aattctccaagtcccaggaaagagg

SEQ ID NO: 539283 - DNA, 25 bp, Rattus norvegicus
tcttgtatgggcgtgtcttttctgg

SEQ ID NO: 539284 - DNA, 25 bp, Rattus norvegicus
tgcagccggaacaaggagcctgtat

SEQ ID NO: 539285 - DNA, 25 bp, Rattus norvegicus
aacaaggagcctgtatggagctggc

SEQ ID NO: 539286 - DNA, 25 bp, Rattus norvegicus
cgtctcgggccctagcagggcctgt

SEQ ID NO: 539287 - DNA, 25 bp, Rattus norvegicus
gactacctcgttccgcgatggcctg

SEQ ID NO: 539288 - DNA, 25 bp, Rattus norvegicus
catcaaagccctgcaagaatggtgc

SEQ ID NO: 539289 - DNA, 25 bp, Rattus norvegicus
ctgcaagaatggtgccggcagcagt

SEQ ID NO: 539290 - DNA, 25 bp, Rattus norvegicus
gctaccgggacgtgagcatcaccaa

SEQ ID NO: 539291 - DNA, 25 bp, Rattus norvegicus
gcatcaccaacatgactacctcgtt

SEQ ID NO: 539292 - DNA, 25 bp, Rattus norvegicus
ccggtctgctggagctctcttcttc

SEQ ID NO: 539293 - DNA, 25 bp, Rattus norvegicus
tgctggacacttgtcccgtttcggt

SEQ ID NO: 539294 - DNA, 25 bp, Rattus norvegicus
cctgctggacacttgtcccgtttcg

SEQ ID NO: 539295 - DNA, 25 bp, Rattus norvegicus
tcggtcccttcctgctggacacttg

SEQ ID NO: 539296 - DNA, 25 bp, Rattus norvegicus
tcctgctggacacttgtcccgtttc

SEQ ID NO: 539297 - DNA, 25 bp, Rattus norvegicus
cgtttcggtcccttcctgctggaca

SEQ ID NO: 539298 - DNA, 25 bp, Rattus norvegicus
cggtcccttcctgctggacacttgt

SEQ ID NO: 539299 - DNA, 25 bp, Rattus norvegicus
gtttcggtcccttcctgctggacac

SEQ ID NO: 539300 - DNA, 25 bp, Rattus norvegicus
ctggacacttgtcccgtttcagtcc

SEQ ID NO: 539301 - DNA, 25 bp, Rattus norvegicus
ctgctggacacttgtcccgtttcgg

SEQ ID NO: 539302 - DNA, 25 bp, Rattus norvegicus
cggtccctttctgctggacacttgt

SEQ ID NO: 539303 - DNA, 25 bp, Rattus norvegicus
tctgctggacacttgtcccgtttcg

SEQ ID NO: 539304 - DNA, 25 bp, Rattus norvegicus
gctggacacttgtcccgtttcggtc

SEQ ID NO: 539305 - DNA, 25 bp, Rattus norvegicus
ttcggtcccttcctgctggacactt

SEQ ID NO: 539306 - DNA, 25 bp, Rattus norvegicus
tcggtccctttctgctggacacttg

SEQ ID NO: 539307 - DNA, 25 bp, Rattus norvegicus
tcttcctttcaacactccgagcggg

SEQ ID NO: 539308 - DNA, 25 bp, Rattus norvegicus
ctgaggtaggttatgaaaacacaca

SEQ ID NO: 539309 - DNA, 25 bp, Rattus norvegicus
ggcaggccaggcgatcatccatcac

SEQ ID NO: 539310 - DNA, 25 bp, Rattus norvegicus
tgatttcgcggcagtcggcaggcca

SEQ ID NO: 539311 - DNA, 25 bp, Rattus norvegicus
gctgtcagcctgctcggtgatttcg

SEQ ID NO: 539312 - DNA, 25 bp, Rattus norvegicus
cgggcaaatttaggagctgtcagcc

SEQ ID NO: 539313 - DNA, 25 bp, Rattus norvegicus
tcaacactccgagcgggcaaattta

SEQ ID NO: 539314 - DNA, 25 bp, Rattus norvegicus
aggttatgaaaacacacattcttcc

SEQ ID NO: 539315 - DNA, 25 bp, Rattus norvegicus
cgagaggatgtttaatgcgcatttt

SEQ ID NO: 539316 - DNA, 25 bp, Rattus norvegicus
attgtgcgcgcgagaggatgtttaa

SEQ ID NO: 539317 - DNA, 25 bp, Rattus norvegicus
ctacagaggccgattgtgcgcgcga

SEQ ID NO: 539318 - DNA, 25 bp, Rattus norvegicus
cgaagctaattaaatctgcgcgggc

SEQ ID NO: 539319 - DNA, 25 bp, Rattus norvegicus
ggggaagcgaagctaattaaatctg

SEQ ID NO: 539320 - DNA, 25 bp, Rattus norvegicus
aaatatttattgtaactgaggtagg

SEQ ID NO: 539321 - DNA, 25 bp, Rattus norvegicus
tcagggacccgcaagtatttctttc

SEQ ID NO: 539322 - DNA, 25 bp, Rattus norvegicus
ccctcagattgccaaggcgggcgac

SEQ ID NO: 539323 - DNA, 25 bp, Rattus norvegicus
gtaaaaagaccgatcacgcagtgtg

SEQ ID NO: 539324 - DNA, 25 bp, Rattus norvegicus
cacgcagtgtgacaggtccctcaga

SEQ ID NO: 539325 - DNA, 25 bp, Rattus norvegicus
tttgataagaaatcagcggcgtttg

SEQ ID NO: 539326 - DNA, 25 bp, Rattus norvegicus
caggtccctcagattgccaaggcgg

SEQ ID NO: 539327 - DNA, 25 bp, Rattus norvegicus
cggttttacatttgataagaaatca

SEQ ID NO: 539328 - DNA, 25 bp, Rattus norvegicus
acgacggcccggtctggagtctgtc

SEQ ID NO: 539329 - DNA, 25 bp, Rattus norvegicus
tcagcggcgtttgtgtttgtaaaaa

SEQ ID NO: 539330 - DNA, 25 bp, Rattus norvegicus
gacccgcaagtatttctttcaaatg

SEQ ID NO: 539331 - DNA, 25 bp, Rattus norvegicus
agtgtgacaggtccctcagattgcc

SEQ ID NO: 539332 - DNA, 25 bp, Rattus norvegicus
tgacaggtccctcagattgccaagg

SEQ ID NO: 539333 - DNA, 25 bp, Rattus norvegicus
tggagtctgtcagggacccgcaagt

SEQ ID NO: 539334 - DNA, 25 bp, Rattus norvegicus
cgcaagtatttctttcaaatgggtt

SEQ ID NO: 539335 - DNA, 25 bp, Rattus norvegicus
aactttccgataaggctgggaggcg

SEQ ID NO: 539336 - DNA, 25 bp, Rattus norvegicus
tccgggctgcgaacaaaggcctccc

SEQ ID NO: 539337 - DNA, 25 bp, Rattus norvegicus
ctgcccacccagagcagtaggaaga

SEQ ID NO: 539338 - DNA, 25 bp, Rattus norvegicus
tctgcacagccccaagtggagtttg

SEQ ID NO: 539339 - DNA, 25 bp, Rattus norvegicus
cccagagcagtaggaagaggccgaa

SEQ ID NO: 539340 - DNA, 25 bp, Rattus norvegicus
agcagtaggaagaggccgaaccacg

SEQ ID NO: 539341 - DNA, 25 bp, Rattus norvegicus
cttggcccttaacggccaagctaga

SEQ ID NO: 539342 - DNA, 25 bp, Rattus norvegicus
ttaacggccaagctagaccaccggc

SEQ ID NO: 539343 - DNA, 25 bp, Rattus norvegicus
cttcggcgcgctgctccgggaagca

SEQ ID NO: 539344 - DNA, 25 bp, Rattus norvegicus
actgcaaactttccgataaggctgg

SEQ ID NO: 539345 - DNA, 25 bp, Rattus norvegicus
gggaagcactgcaaactttccgata

SEQ ID NO: 539346 - DNA, 25 bp, Rattus norvegicus
gcgctgctccgggaagcactgcaaa

SEQ ID NO: 539347 - DNA, 25 bp, Rattus norvegicus
cgcgctcgctcactgctctgcacag

SEQ ID NO: 539348 - DNA, 25 bp, Rattus norvegicus
gcggtccaccgcaggtcccgccttc

SEQ ID NO: 539349 - DNA, 25 bp, Rattus norvegicus
cggctctgacagtgctgcaccagct

SEQ ID NO: 539350 - DNA, 25 bp, Rattus norvegicus
agggcatctaggactcgggcgccca

SEQ ID NO: 539351 - DNA, 25 bp, Rattus norvegicus
gctcaggctcacctcagtgcggggc

SEQ ID NO: 539352 - DNA, 25 bp, Rattus norvegicus
ttgacgaacagcagcgcacccagca

SEQ ID NO: 539353 - DNA, 25 bp, Rattus norvegicus
aagcgtgcctggagctctgccacag

SEQ ID NO: 539354 - DNA, 25 bp, Rattus norvegicus
agaaaacgcggctctgacagtgctg

SEQ ID NO: 539355 - DNA, 25 bp, Rattus norvegicus
tcgtcgttggcctgctccagcttgt

SEQ ID NO: 539356 - DNA, 25 bp, Rattus norvegicus
agtgccttccacaccgcacccttga

SEQ ID NO: 539357 - DNA, 25 bp, Rattus norvegicus
cagcaccttggtctcacgccgagca

SEQ ID NO: 539358 - DNA, 25 bp, Rattus norvegicus
tcacgccgagcacccttttcacggg

SEQ ID NO: 539359 - DNA, 25 bp, Rattus norvegicus
tttcacgggccaccagggcatctag

SEQ ID NO: 539360 - DNA, 25 bp, Rattus norvegicus
gagcgccgacttcccgcgtgtgaaa

SEQ ID NO: 539361 - DNA, 25 bp, Rattus norvegicus
ggcagccaagcgtgcctggagctct

SEQ ID NO: 539362 - DNA, 25 bp, Rattus norvegicus
ttgtccgcctccttgccgaacagtg

SEQ ID NO: 539363 - DNA, 25 bp, Rattus norvegicus
agcgacagaacaatgagggatatca

SEQ ID NO: 539364 - DNA, 25 bp, Rattus norvegicus
tacaggcgacacatgatcaataggc

SEQ ID NO: 539365 - DNA, 25 bp, Rattus norvegicus
cacatgatcaataggctgataacgc

SEQ ID NO: 539366 - DNA, 25 bp, Rattus norvegicus
aggctgataacgcagcaacatcaat

SEQ ID NO: 539367 - DNA, 25 bp, Rattus norvegicus
gcaacatcaatataagcgacagaac

SEQ ID NO: 539368 - DNA, 25 bp, Rattus norvegicus
tgagggatatcattgggcatctatc

SEQ ID NO: 539369 - DNA, 25 bp, Rattus norvegicus
cattgggcatctatcttaatatagc

SEQ ID NO: 539370 - DNA, 25 bp, Rattus norvegicus
gcatctatcttaatatagcccgcta

SEQ ID NO: 539371 - DNA, 25 bp, Rattus norvegicus
atatagcccgctacaagcgcgctga

SEQ ID NO: 539372 - DNA, 25 bp, Rattus norvegicus
gctacaagcgcgctgacaaagagtg

SEQ ID NO: 539373 - DNA, 25 bp, Rattus norvegicus
atctccgctccaatatgcgcacgca

SEQ ID NO: 539374 - DNA, 25 bp, Rattus norvegicus
gagtgcagctcatgaaaattccgcc

SEQ ID NO: 539375 - DNA, 25 bp, Rattus norvegicus
ggcgcctgtcctattacaggcgaca

SEQ ID NO: 539376 - DNA, 25 bp, Rattus norvegicus
gcgcgctgacaaagagtgcagctca

SEQ ID NO: 539377 - DNA, 25 bp, Rattus norvegicus
tccttgggcaccaactcagggcctg

SEQ ID NO: 539378 - DNA, 25 bp, Rattus norvegicus
agttccttgcgagcgatctcctccg

SEQ ID NO: 539379 - DNA, 25 bp, Rattus norvegicus
cagtttcttctcgtgtttgcgtttc

SEQ ID NO: 539380 - DNA, 25 bp, Rattus norvegicus
gcggctctgactcttgagcagtttc

SEQ ID NO: 539381 - DNA, 25 bp, Rattus norvegicus
caccgctgtcgctgtctgagctagg

SEQ ID NO: 539382 - DNA, 25 bp, Rattus norvegicus
tggctctggagacaggcctccgcca

SEQ ID NO: 539383 - DNA, 25 bp, Rattus norvegicus
cgccgcttctttggctcgggtagaa

SEQ ID NO: 539384 - DNA, 25 bp, Rattus norvegicus
gcaagggaccgtgtccttgtccgcc

SEQ ID NO: 539385 - DNA, 25 bp, Rattus norvegicus
tagccttaggcaggcctgcagtcga

SEQ ID NO: 539386 - DNA, 25 bp, Rattus norvegicus
tctccacgctgaacgggctagcctt

SEQ ID NO: 539387 - DNA, 25 bp, Rattus norvegicus
gctgcctgtggcaccaggaagccga

SEQ ID NO: 539388 - DNA, 25 bp, Rattus norvegicus
tggcccaggggaggcaacaacctca

SEQ ID NO: 539389 - DNA, 25 bp, Rattus norvegicus
ccgctgctaggtcccggaaagaagc

SEQ ID NO: 539390 - DNA, 25 bp, Rattus norvegicus
ccttgccaatcagggtccgaggtgc

SEQ ID NO: 539391 - DNA, 25 bp, Rattus norvegicus
tgggcgacaccaatctttacctgaa

SEQ ID NO: 539392 - DNA, 25 bp, Rattus norvegicus
ggacctcggactccttgggcgacac

SEQ ID NO: 539393 - DNA, 25 bp, Rattus norvegicus
agcgctaatcggctctgacgtcaga

SEQ ID NO: 539394 - DNA, 25 bp, Rattus norvegicus
tgctgggtgcaaggaaacgttttcc

SEQ ID NO: 539395 - DNA, 25 bp, Rattus norvegicus
tttacctgaactcgggactcgacca

SEQ ID NO: 539396 - DNA, 25 bp, Rattus norvegicus
tcgcgcatgaacacgtccgggtagt

SEQ ID NO: 539397 - DNA, 25 bp, Rattus norvegicus
gtggctctcattgaatgccttctcc

SEQ ID NO: 539398 - DNA, 25 bp, Rattus norvegicus
aaggctcagccacccggcagaatct

SEQ ID NO: 539399 - DNA, 25 bp, Rattus norvegicus
ctgcaagcttgaagggctggctttc

SEQ ID NO: 539400 - DNA, 25 bp, Rattus norvegicus
gctccaggaggcgaccgtccatcat

SEQ ID NO: 539401 - DNA, 25 bp, Rattus norvegicus
gcgctccgccgctttactttatcaa

SEQ ID NO: 539402 - DNA, 25 bp, Rattus norvegicus
ttgggaccaataagaagcgctaatc

SEQ ID NO: 539403 - DNA, 25 bp, Rattus norvegicus
tgcacaggacgctgcaaggctcagc

SEQ ID NO: 539404 - DNA, 25 bp, Rattus norvegicus
ctctcgataattagccgcggcccgg

SEQ ID NO: 539405 - DNA, 25 bp, Rattus norvegicus
tttttctcatgtgctcgggacccta

SEQ ID NO: 539406 - DNA, 25 bp, Rattus norvegicus
aagcagcccttgacacgcggtcctg

SEQ ID NO: 539407 - DNA, 25 bp, Rattus norvegicus
cggttcctccaaacagctcaatggg

SEQ ID NO: 539408 - DNA, 25 bp, Rattus norvegicus
cggctttctggagcggtcgctttaa

SEQ ID NO: 539409 - DNA, 25 bp, Rattus norvegicus
cttccttgtcaattgcggctttctg

SEQ ID NO: 539410 - DNA, 25 bp, Rattus norvegicus
tgcgaccatttcaatcgcccagtgg

SEQ ID NO: 539411 - DNA, 25 bp, Rattus norvegicus
cgcccggctcgagagctcttcagag

SEQ ID NO: 539412 - DNA, 25 bp, Rattus norvegicus
tccctttttctacagccgagtgaca

SEQ ID NO: 539413 - DNA, 25 bp, Rattus norvegicus
cttgtagacaaaaggcccaggcctg

SEQ ID NO: 539414 - DNA, 25 bp, Rattus norvegicus
ggggagtcacttggctccaactgga

SEQ ID NO: 539415 - DNA, 25 bp, Rattus norvegicus
acacgactcgcattcaggacgcctg

SEQ ID NO: 539416 - DNA, 25 bp, Rattus norvegicus
cgctccgacggccttgtagacaaaa

SEQ ID NO: 539417 - DNA, 25 bp, Rattus norvegicus
gtgacattgtcagatgctagcttta

SEQ ID NO: 539418 - DNA, 25 bp, Rattus norvegicus
actttgatccgtgggttcgaggcta

SEQ ID NO: 539419 - DNA, 25 bp, Rattus norvegicus
acccgctggattggtctcatggtta

SEQ ID NO: 539420 - DNA, 25 bp, Rattus norvegicus
gtgggactccgactacccgtgaatg

SEQ ID NO: 539421 - DNA, 25 bp, Rattus norvegicus
tgaccacgaaggactctgccaggcg

SEQ ID NO: 539422 - DNA, 25 bp, Rattus norvegicus
cagtttctattgcagtgtcaccggg

SEQ ID NO: 539423 - DNA, 25 bp, Rattus norvegicus
cggcgattggagctgcagtttctat

SEQ ID NO: 539424 - DNA, 25 bp, Rattus norvegicus
aatgctacgtttcccggccttgcga

SEQ ID NO: 539425 - DNA, 25 bp, Rattus norvegicus
ctgcggataaatggccagggctgct

SEQ ID NO: 539426 - DNA, 25 bp, Rattus norvegicus
tgtatgactctggatctgtcggctg

SEQ ID NO: 539427 - DNA, 25 bp, Rattus norvegicus
cgggaacgcccaggatgtatgactc

SEQ ID NO: 539428 - DNA, 25 bp, Rattus norvegicus
gttagtgacgacatcacagcgccca

SEQ ID NO: 539429 - DNA, 25 bp, Rattus norvegicus
cccgtgaatgccaggtaccggtgtg

SEQ ID NO: 539430 - DNA, 25 bp, Rattus norvegicus
ccttgcgagaagtcgggtgcctcgc

SEQ ID NO: 539431 - DNA, 25 bp, Rattus norvegicus
gtcggcgagccaagcctagatgtta

SEQ ID NO: 539432 - DNA, 25 bp, Rattus norvegicus
agggctgctgtaggcgcaatgctac

SEQ ID NO: 539433 - DNA, 25 bp, Rattus norvegicus
gtatcctgcgccgaggctgagcccg

SEQ ID NO: 539434 - DNA, 25 bp, Rattus norvegicus
agatgacgccagtatcctgcgccga

SEQ ID NO: 539435 - DNA, 25 bp, Rattus norvegicus
actctcagctcagaagatgacgcca

SEQ ID NO: 539436 - DNA, 25 bp, Rattus norvegicus
cctgcactctcagctcagaagatga

SEQ ID NO: 539437 - DNA, 25 bp, Rattus norvegicus
ggagttgccccggtaactgcctgca

SEQ ID NO: 539438 - DNA, 25 bp, Rattus norvegicus
ctgcccacgccaccaggagttgccc

SEQ ID NO: 539439 - DNA, 25 bp, Rattus norvegicus
gacgccagtatcctgcgccgaggct

SEQ ID NO: 539440 - DNA, 25 bp, Rattus norvegicus
cagctacccggggagacggcgtact

SEQ ID NO: 539441 - DNA, 25 bp, Rattus norvegicus
cgtgacagcgcggaacctgcggagc

SEQ ID NO: 539442 - DNA, 25 bp, Rattus norvegicus
gtccaatggatagcggcggtcttct

SEQ ID NO: 539443 - DNA, 25 bp, Rattus norvegicus
acgcaggcctggtccaatggatagc

SEQ ID NO: 539444 - DNA, 25 bp, Rattus norvegicus
gaagacgaacgcaggcctggtccaa

SEQ ID NO: 539445 - DNA, 25 bp, Rattus norvegicus
gctattggctgggtggaagacgaac

SEQ ID NO: 539446 - DNA, 25 bp, Rattus norvegicus
cccgccatgcggcggctattggctg

SEQ ID NO: 539447 - DNA, 25 bp, Rattus norvegicus
aatgccaacgatggtggctgcgctg

SEQ ID NO: 539448 - DNA, 25 bp, Rattus norvegicus
tacaaatgccaacgatggtggctgc

SEQ ID NO: 539449 - DNA, 25 bp, Rattus norvegicus
cgcgtgagtacactgtccaggcgta

SEQ ID NO: 539450 - DNA, 25 bp, Rattus norvegicus
agtacactgtccaggcgtaccgggg

SEQ ID NO: 539451 - DNA, 25 bp, Rattus norvegicus
tctccgtgactccggggcagtggac

SEQ ID NO: 539452 - DNA, 25 bp, Rattus norvegicus
gggcagtggacaccccatgtacaaa

SEQ ID NO: 539453 - DNA, 25 bp, Rattus norvegicus
atgctcctggggtcaggtgtgccac

SEQ ID NO: 539454 - DNA, 25 bp, Rattus norvegicus
aggtgtgccacgtgagcatccgtcc

SEQ ID NO: 539455 - DNA, 25 bp, Rattus norvegicus
ggatacctgcccttctgtgttcgga

SEQ ID NO: 539456 - DNA, 25 bp, Rattus norvegicus
acctgcccttctgtgttcggacaca

SEQ ID NO: 539457 - DNA, 25 bp, Rattus norvegicus
gcccttctgtgttcggacacacgga

SEQ ID NO: 539458 - DNA, 25 bp, Rattus norvegicus
ttctgtgttcggacacacggagtgg

SEQ ID NO: 539459 - DNA, 25 bp, Rattus norvegicus
ggagggattcgccttcagtgcctct

SEQ ID NO: 539460 - DNA, 25 bp, Rattus norvegicus
ccatgtacaaatgccaacgatggtg

SEQ ID NO: 539461 - DNA, 25 bp, Rattus norvegicus
acctccctgacatcggcaaagcaga

SEQ ID NO: 539462 - DNA, 25 bp, Rattus norvegicus
gcccgcacgatgagggaatagcaca

SEQ ID NO: 539463 - DNA, 25 bp, Rattus norvegicus
ccgatgatggcgaagggcacaatga

SEQ ID NO: 539464 - DNA, 25 bp, Rattus norvegicus
gccaggtacctgtcgaagctcatcc

SEQ ID NO: 539465 - DNA, 25 bp, Rattus norvegicus
tgtgccgcagatgcacggccgtgaa

SEQ ID NO: 539466 - DNA, 25 bp, Rattus norvegicus
ggcggacactgaggccatccagatg

SEQ ID NO: 539467 - DNA, 25 bp, Rattus norvegicus
gccacagcgcatggctttggccagc

SEQ ID NO: 539468 - DNA, 25 bp, Rattus norvegicus
gacgctgctgtacatgttgatctgc

SEQ ID NO: 539469 - DNA, 25 bp, Rattus norvegicus
catgaaggtgcagagcacggcgata

SEQ ID NO: 539470 - DNA, 25 bp, Rattus norvegicus
acaatgaagcccagcgtgacctcca

SEQ ID NO: 539471 - DNA, 25 bp, Rattus norvegicus
cacggcgatatcgtagtactgctcg

SEQ ID NO: 539472 - DNA, 25 bp, Rattus norvegicus
gtactgctcgtccaggttgaacacc

SEQ ID NO: 539473 - DNA, 25 bp, Rattus norvegicus
aacacctcgatcagggagtcggcca

SEQ ID NO: 539474 - DNA, 25 bp, Rattus norvegicus
gccatccagatgaggccacagctga

SEQ ID NO: 539475 - DNA, 25 bp, Rattus norvegicus
cccttttcttggctcgcgtgcttag

SEQ ID NO: 539476 - DNA, 25 bp, Rattus norvegicus
cgctcggaagggacgaagcgtccta

SEQ ID NO: 539477 - DNA, 25 bp, Rattus norvegicus
cgcacctgcccgatcaaagtttgta

SEQ ID NO: 539478 - DNA, 25 bp, Rattus norvegicus
agtttgtaatttccacgactcgtgg

SEQ ID NO: 539479 - DNA, 25 bp, Rattus norvegicus
atggccggacaaggccgccttaata

SEQ ID NO: 539480 - DNA, 25 bp, Rattus norvegicus
cttgcaggaggcaacggagctcacg

SEQ ID NO: 539481 - DNA, 25 bp, Rattus norvegicus
tcccaggaccgagcactaggggctc

SEQ ID NO: 539482 - DNA, 25 bp, Rattus norvegicus
tcgggttcaggaccgtgcacccggc

SEQ ID NO: 539483 - DNA, 25 bp, Rattus norvegicus
cgtcctaggagagcctgtccgccta

SEQ ID NO: 539484 - DNA, 25 bp, Rattus norvegicus
ggtccgctatctctacacacgggtt

SEQ ID NO: 539485 - DNA, 25 bp, Rattus norvegicus
gatggcgcaaggtccgctatctcta

SEQ ID NO: 539486 - DNA, 25 bp, Rattus norvegicus
gttgcctcctatgcccggtgaatgt

SEQ ID NO: 539487 - DNA, 25 bp, Rattus norvegicus
ttaatactggagagccgcgcacctg

SEQ ID NO: 539488 - DNA, 25 bp, Rattus norvegicus
acgggttccaaatgtcctgacgctc

SEQ ID NO: 539489 - DNA, 25 bp, Rattus norvegicus
agaggccacgcccacgcgccaaggg

SEQ ID NO: 539490 - DNA, 25 bp, Rattus norvegicus
cggcgtcactgtccagccggctgaa

SEQ ID NO: 539491 - DNA, 25 bp, Rattus norvegicus
tccagccggctgaatctggttccgc

SEQ ID NO: 539492 - DNA, 25 bp, Rattus norvegicus
ccagtctggggctcactgctgtgaa

SEQ ID NO: 539493 - DNA, 25 bp, Rattus norvegicus
tggggctcactgctgtgaagtgtcc

SEQ ID NO: 539494 - DNA, 25 bp, Rattus norvegicus
tcactgctgtgaagtgtcctcagtc

SEQ ID NO: 539495 - DNA, 25 bp, Rattus norvegicus
tgtgaagtgtcctcagtccctgcag

SEQ ID NO: 539496 - DNA, 25 bp, Rattus norvegicus
tgcagttcgcaccaacgactcccgg

SEQ ID NO: 539497 - DNA, 25 bp, Rattus norvegicus
actcccggctgcctacaagcgaggt

SEQ ID NO: 539498 - DNA, 25 bp, Rattus norvegicus
tgcctacaagcgaggtcagtgcgtg

SEQ ID NO: 539499 - DNA, 25 bp, Rattus norvegicus
tacaagcgaggtcagtgcgtggccc

SEQ ID NO: 539500 - DNA, 25 bp, Rattus norvegicus
cccaaggcttcggtggcggtctcgc

SEQ ID NO: 539501 - DNA, 25 bp, Rattus norvegicus
gcggtctcgccctgtagcgacgcga

SEQ ID NO: 539502 - DNA, 25 bp, Rattus norvegicus
gccctgtagcgacgcgaggtcgtcc

SEQ ID NO: 539503 - DNA, 25 bp, Rattus norvegicus
tcccgctagaccacttcggtgaggc

SEQ ID NO: 539504 - DNA, 25 bp, Rattus norvegicus
agcttcccgctagaccacttcggtg

SEQ ID NO: 539505 - DNA, 25 bp, Rattus norvegicus
cagacaaaggcagcttcccgctaga

SEQ ID NO: 539506 - DNA, 25 bp, Rattus norvegicus
gggaccaaaagcttccagccgcggc

SEQ ID NO: 539507 - DNA, 25 bp, Rattus norvegicus
tgaacttcgggaccaaaagcttcca

SEQ ID NO: 539508 - DNA, 25 bp, Rattus norvegicus
atgtcgaccgcaatgaacttcggga

SEQ ID NO: 539509 - DNA, 25 bp, Rattus norvegicus
ccgtgatgtcgaccgcaatgaactt

SEQ ID NO: 539510 - DNA, 25 bp, Rattus norvegicus
ttcgccgtgatgtcgaccgcaatga

SEQ ID NO: 539511 - DNA, 25 bp, Rattus norvegicus
ccgctcttgatttcgccgtgatgtc

SEQ ID NO: 539512 - DNA, 25 bp, Rattus norvegicus
gctctccgctcttgatttcgccgtg

SEQ ID NO: 539513 - DNA, 25 bp, Rattus norvegicus
tgttcagctctctgacctgcgtcgc

SEQ ID NO: 539514 - DNA, 25 bp, Rattus norvegicus
tctcggtgttcagctctctgacctg

SEQ ID NO: 539515 - DNA, 25 bp, Rattus norvegicus
gggccctctcggtgttcagctctct

SEQ ID NO: 539516 - DNA, 25 bp, Rattus norvegicus
gctcgactagctcggcacttcctgg

SEQ ID NO: 539517 - DNA, 25 bp, Rattus norvegicus
tgctcgggacacacagaaaaaagac

SEQ ID NO: 539518 - DNA, 25 bp, Rattus norvegicus
ggattaggatggaccgtccggctcc

SEQ ID NO: 539519 - DNA, 25 bp, Rattus norvegicus
gggaagggagccatgcacaacgctc

SEQ ID NO: 539520 - DNA, 25 bp, Rattus norvegicus
ctacaaagcatgtcccaggggccgg

SEQ ID NO: 539521 - DNA, 25 bp, Rattus norvegicus
aacgctccactcggctgctctagga

SEQ ID NO: 539522 - DNA, 25 bp, Rattus norvegicus
ctctaggacgctcggctgggaccgc

SEQ ID NO: 539523 - DNA, 25 bp, Rattus norvegicus
cccaggaaaacccaaagcagactga

SEQ ID NO: 539524 - DNA, 25 bp, Rattus norvegicus
acccgggaacgctgctcgggacaca

SEQ ID NO: 539525 - DNA, 25 bp, Rattus norvegicus
cggaaaggtctcaaccggaactgtg

SEQ ID NO: 539526 - DNA, 25 bp, Rattus norvegicus
tctcaaccggaactgtgccgcggtg

SEQ ID NO: 539527 - DNA, 25 bp, Rattus norvegicus
ccgcggtgggttcagcggaacttct

SEQ ID NO: 539528 - DNA, 25 bp, Rattus norvegicus
ttcagcggaacttcttggtggcgtc

SEQ ID NO: 539529 - DNA, 25 bp, Rattus norvegicus
atgagctcgccggtgagtacacgga

SEQ ID NO: 539530 - DNA, 25 bp, Rattus norvegicus
ccaaagcagactgacccgggaacgc

SEQ ID NO: 539531 - DNA, 25 bp, Rattus norvegicus
gggtggcccatccttccgcagcacc

SEQ ID NO: 539532 - DNA, 25 bp, Rattus norvegicus
gaactcgcgctgcgctgactgcgga

SEQ ID NO: 539533 - DNA, 25 bp, Rattus norvegicus
ctgctgacgcgtccggggaactcgc

SEQ ID NO: 539534 - DNA, 25 bp, Rattus norvegicus
ccacgcgctgggtcctagctgggtt

SEQ ID NO: 539535 - DNA, 25 bp, Rattus norvegicus
acctgccggcggcagggactggcag

SEQ ID NO: 539536 - DNA, 25 bp, Rattus norvegicus
gcgcagcatccggagggcacctcgc

SEQ ID NO: 539537 - DNA, 25 bp, Rattus norvegicus
cgctgggctgcgtgtcacgctgtca

SEQ ID NO: 539538 - DNA, 25 bp, Rattus norvegicus
gggctgcgtgtcacgctgtcacccg

SEQ ID NO: 539539 - DNA, 25 bp, Rattus norvegicus
agctgctgacgcgtccggggaactc

SEQ ID NO: 539540 - DNA, 25 bp, Rattus norvegicus
gcgcgcgcagctccgttcagggcgg

SEQ ID NO: 539541 - DNA, 25 bp, Rattus norvegicus
aggccgctccctgaccgcgccgctg

SEQ ID NO: 539542 - DNA, 25 bp, Rattus norvegicus
ggctctcgaagaggccgctccctga

SEQ ID NO: 539543 - DNA, 25 bp, Rattus norvegicus
gctgggctctcgaagaggccgctcc

SEQ ID NO: 539544 - DNA, 25 bp, Rattus norvegicus
catccttccgcagcaccggttccct

SEQ ID NO: 539545 - DNA, 25 bp, Rattus norvegicus
aacgcagcgatgaggtgtctaattc

SEQ ID NO: 539546 - DNA, 25 bp, Rattus norvegicus
actacacgctgatctggggagagtc

SEQ ID NO: 539547 - DNA, 25 bp, Rattus norvegicus
ccgaagtcttgggagggactacacg

SEQ ID NO: 539548 - DNA, 25 bp, Rattus norvegicus
tcccgggaggaacttgctagttgtc

SEQ ID NO: 539549 - DNA, 25 bp, Rattus norvegicus
tagcactagccaggaaaagcccacg

SEQ ID NO: 539550 - DNA, 25 bp, Rattus norvegicus
tgcaaaggaccctgctagcactagc

SEQ ID NO: 539551 - DNA, 25 bp, Rattus norvegicus
actccttctacggtggccgcgagga

SEQ ID NO: 539552 - DNA, 25 bp, Rattus norvegicus
cttttcgacgctggcacgcagcttg

SEQ ID NO: 539553 - DNA, 25 bp, Rattus norvegicus
gcgcctcgtagtagtcgcccttttc

SEQ ID NO: 539554 - DNA, 25 bp, Rattus norvegicus
ccgcgcccacctgaagaagagggtc

SEQ ID NO: 539555 - DNA, 25 bp, Rattus norvegicus
cgcggcgcagccaatgaacaacagc

SEQ ID NO: 539556 - DNA, 25 bp, Rattus norvegicus
ggagagtcgtcactgcaccacgtaa

SEQ ID NO: 539557 - DNA, 25 bp, Rattus norvegicus
cagccacgtagcctgcgcaagtaaa

SEQ ID NO: 539558 - DNA, 25 bp, Rattus norvegicus
aggcagccgcacgaaccaatgagga

SEQ ID NO: 539559 - DNA, 25 bp, Rattus norvegicus
gcaaagttcgccatcagccatcggg

SEQ ID NO: 539560 - DNA, 25 bp, Rattus norvegicus
tacaccacggggagcagcaaagttc

SEQ ID NO: 539561 - DNA, 25 bp, Rattus norvegicus
tccaataaagctccagcgggccagc

SEQ ID NO: 539562 - DNA, 25 bp, Rattus norvegicus
tgaaggcaactagcttgggataacc

SEQ ID NO: 539563 - DNA, 25 bp, Rattus norvegicus
acctagttgcaaggtgttcaggcca

SEQ ID NO: 539564 - DNA, 25 bp, Rattus norvegicus
tccgggcttagcgtttgcaggaaac

SEQ ID NO: 539565 - DNA, 25 bp, Rattus norvegicus
ggggaacgaagactctccacatcta

SEQ ID NO: 539566 - DNA, 25 bp, Rattus norvegicus
agccatcgggctgcatccaataaag

SEQ ID NO: 539567 - DNA, 25 bp, Rattus norvegicus
ctgctgaagctctagaccaatggga

SEQ ID NO: 539568 - DNA, 25 bp, Rattus norvegicus
ctcctctcaggtcgcgttagcatta

SEQ ID NO: 539569 - DNA, 25 bp, Rattus norvegicus
cattaggattctgcgtggcgacgcc

SEQ ID NO: 539570 - DNA, 25 bp, Rattus norvegicus
gacgccggtgttgagttccagacag

SEQ ID NO: 539571 - DNA, 25 bp, Rattus norvegicus
agaagacccgactcctgctgaagga

SEQ ID NO: 539572 - DNA, 25 bp, Rattus norvegicus
ttcaggccagggactcactacccgg

SEQ ID NO: 539573 - DNA, 25 bp, Rattus norvegicus
gaacgcgttgcttgtctccaaggga

SEQ ID NO: 539574 - DNA, 25 bp, Rattus norvegicus
ccacggccaggtgaagcagttgcac

SEQ ID NO: 539575 - DNA, 25 bp, Rattus norvegicus
ttgcacgagggcaagacgcagctct

SEQ ID NO: 539576 - DNA, 25 bp, Rattus norvegicus
agacgcagctcttcgcagggttcag

SEQ ID NO: 539577 - DNA, 25 bp, Rattus norvegicus
cggcacggcgaaggcctaagtccag

SEQ ID NO: 539578 - DNA, 25 bp, Rattus norvegicus
taagtccagcaggtgagcagccagc

SEQ ID NO: 539579 - DNA, 25 bp, Rattus norvegicus
ccctggaaggcagcggaatccgttc

SEQ ID NO: 539580 - DNA, 25 bp, Rattus norvegicus
taacagacgacctagcgcgcgggtc

SEQ ID NO: 539581 - DNA, 25 bp, Rattus norvegicus
tctccaagggaaccggcgctagtac

SEQ ID NO: 539582 - DNA, 25 bp, Rattus norvegicus
tacgatggtcgtagcacgctttacg

SEQ ID NO: 539583 - DNA, 25 bp, Rattus norvegicus
acttccggctgactcggttgctcga

SEQ ID NO: 539584 - DNA, 25 bp, Rattus norvegicus
agcagacgagcccatgggccctgga

SEQ ID NO: 539585 - DNA, 25 bp, Rattus norvegicus
ttcggtctccagtcccggtaacaga

SEQ ID NO: 539586 - DNA, 25 bp, Rattus norvegicus
ttccagtgcgtgctccagagcttcc

SEQ ID NO: 539587 - DNA, 25 bp, Rattus norvegicus
tgtcccttcgcatcttcagaattcc

SEQ ID NO: 539588 - DNA, 25 bp, Rattus norvegicus
gcgattagaacggtgcctgcgccca

SEQ ID NO: 539589 - DNA, 25 bp, Rattus norvegicus
tgcatccaggcctagcttcattctg

SEQ ID NO: 539590 - DNA, 25 bp, Rattus norvegicus
attctggtccctgatgtcccttcgc

SEQ ID NO: 539591 - DNA, 25 bp, Rattus norvegicus
ccctgctgcgccaagagagtaaggg

SEQ ID NO: 539592 - DNA, 25 bp, Rattus norvegicus
tcctggattttcacatcgggtcgtc

SEQ ID NO: 539593 - DNA, 25 bp, Rattus norvegicus
cgtcgaaccgcaaagaggtgtcctc

SEQ ID NO: 539594 - DNA, 25 bp, Rattus norvegicus
aggtgtcctctggtcctctctgctt

SEQ ID NO: 539595 - DNA, 25 bp, Rattus norvegicus
cctctctgcttctgagaagggcttg

SEQ ID NO: 539596 - DNA, 25 bp, Rattus norvegicus
caggacgcgtagaacaatcgggata

SEQ ID NO: 539597 - DNA, 25 bp, Rattus norvegicus
gataaaacggtgaggaactcgactc

SEQ ID NO: 539598 - DNA, 25 bp, Rattus norvegicus
aactcgactcaggtccagcgtggtc

SEQ ID NO: 539599 - DNA, 25 bp, Rattus norvegicus
tcgctatgacgacgggtcgcggttt

SEQ ID NO: 539600 - DNA, 25 bp, Rattus norvegicus
tgcaacccgatcttcttcctggatt

SEQ ID NO: 539601 - DNA, 25 bp, Rattus norvegicus
ttcgaccgcaagatgccaagagacg

SEQ ID NO: 539602 - DNA, 25 bp, Rattus norvegicus
tcaatcaccacgttagcagccggca

SEQ ID NO: 539603 - DNA, 25 bp, Rattus norvegicus
gcctgactcagagcagcaccctgtg

SEQ ID NO: 539604 - DNA, 25 bp, Rattus norvegicus
agaccgacaccaggaaggaagcgcc

SEQ ID NO: 539605 - DNA, 25 bp, Rattus norvegicus
ccgcccgatcgcagaagcagcagag

SEQ ID NO: 539606 - DNA, 25 bp, Rattus norvegicus
agcagcagagcagcctagcttccgc

SEQ ID NO: 539607 - DNA, 25 bp, Rattus norvegicus
tatcgaagcaaagcaaagaggcctc

SEQ ID NO: 539608 - DNA, 25 bp, Rattus norvegicus
ggaaaaggcccagagcgcaagcgct

SEQ ID NO: 539609 - DNA, 25 bp, Rattus norvegicus
tgcgtgccggagcaagtgaattaca

SEQ ID NO: 539610 - DNA, 25 bp, Rattus norvegicus
gaatagcgctttccacactcgaata

SEQ ID NO: 539611 - DNA, 25 bp, Rattus norvegicus
tgacgtggttgccttgcaggtcaaa

SEQ ID NO: 539612 - DNA, 25 bp, Rattus norvegicus
gcaggtcaaaggagcatcaatcacc

SEQ ID NO: 539613 - DNA, 25 bp, Rattus norvegicus
cgaatagcgttctttctatcgaagc

SEQ ID NO: 539614 - DNA, 25 bp, Rattus norvegicus
tacagctctgctctagcggaatagc

SEQ ID NO: 539615 - DNA, 25 bp, Rattus norvegicus
ccgaggttggatggatttagctgcc

SEQ ID NO: 539616 - DNA, 25 bp, Rattus norvegicus
gatttagctgcctgcgtgagcgcgt

SEQ ID NO: 539617 - DNA, 25 bp, Rattus norvegicus
gagccggagacagccgtgcttctgc

SEQ ID NO: 539618 - DNA, 25 bp, Rattus norvegicus
gcgctgccctttactgccgctgggg

SEQ ID NO: 539619 - DNA, 25 bp, Rattus norvegicus
tagctctgggcgctgccctttactg

SEQ ID NO: 539620 - DNA, 25 bp, Rattus norvegicus
cctttttggcgcagtagctctgggc

SEQ ID NO: 539621 - DNA, 25 bp, Rattus norvegicus
agctgactctcatgccctttttggc

SEQ ID NO: 539622 - DNA, 25 bp, Rattus norvegicus
ggccaagctgactctcatgcccttt

SEQ ID NO: 539623 - DNA, 25 bp, Rattus norvegicus
tccttacagtgggaagcggcccgag

SEQ ID NO: 539624 - DNA, 25 bp, Rattus norvegicus
gctggagcactggatccttacagtg

SEQ ID NO: 539625 - DNA, 25 bp, Rattus norvegicus
ctccttttatggagaggggaaggct

SEQ ID NO: 539626 - DNA, 25 bp, Rattus norvegicus
cgtcaggtgagtgccctagacgcgc

SEQ ID NO: 539627 - DNA, 25 bp, Rattus norvegicus
tggcagccgtcaggtgagtgcccta

SEQ ID NO: 539628 - DNA, 25 bp, Rattus norvegicus
ccgcaggattgcagctggcactgaa

SEQ ID NO: 539629 - DNA, 25 bp, Rattus norvegicus
ccctcaggctaggttaaagtgttga

SEQ ID NO: 539630 - DNA, 25 bp, Rattus norvegicus
gctcggttcaggattcccagagtga

SEQ ID NO: 539631 - DNA, 25 bp, Rattus norvegicus
tccagtcgtggatgcgtgacgcatt

SEQ ID NO: 539632 - DNA, 25 bp, Rattus norvegicus
agcacggctgctttttgcctgaaca

SEQ ID NO: 539633 - DNA, 25 bp, Rattus norvegicus
tttgcgttccctacagcctctcaag

SEQ ID NO: 539634 - DNA, 25 bp, Rattus norvegicus
ctgcttgcaggaagccgagataccc

SEQ ID NO: 539635 - DNA, 25 bp, Rattus norvegicus
tcgaagtcagatccacagcatccgg

SEQ ID NO: 539636 - DNA, 25 bp, Rattus norvegicus
ccagcgactcttggagatagactcc

SEQ ID NO: 539637 - DNA, 25 bp, Rattus norvegicus
tagactccgtaggtaaatcgcgccc

SEQ ID NO: 539638 - DNA, 25 bp, Rattus norvegicus
gaaaggtcagactccactcgccggc

SEQ ID NO: 539639 - DNA, 25 bp, Rattus norvegicus
gtgacgcatttcgaccctctgtttc

SEQ ID NO: 539640 - DNA, 25 bp, Rattus norvegicus
gaggcgcgaggtggatatttaaccc

SEQ ID NO: 539641 - DNA, 25 bp, Rattus norvegicus
gctttgccgtgatgaatgactttcc

SEQ ID NO: 539642 - DNA, 25 bp, Rattus norvegicus
tgggaacttcgtggttgagtcctcc

SEQ ID NO: 539643 - DNA, 25 bp, Rattus norvegicus
cgggaatctgctagaagggaacttt

SEQ ID NO: 539644 - DNA, 25 bp, Rattus norvegicus
cgccgacggaagttgccattctcga

SEQ ID NO: 539645 - DNA, 25 bp, Rattus norvegicus
tctcgaaaaggtccaggagggattc

SEQ ID NO: 539646 - DNA, 25 bp, Rattus norvegicus
gagggattcgcagccgcccgcgaac

SEQ ID NO: 539647 - DNA, 25 bp, Rattus norvegicus
cgcgaacgtccagtagttacctttg

SEQ ID NO: 539648 - DNA, 25 bp, Rattus norvegicus
caggacgcacctcaggcaagtgtga

SEQ ID NO: 539649 - DNA, 25 bp, Rattus norvegicus
aactttggcgctggctgtgaaacca

SEQ ID NO: 539650 - DNA, 25 bp, Rattus norvegicus
ctctgcccgtcacaagggactactg

SEQ ID NO: 539651 - DNA, 25 bp, Rattus norvegicus
tcacaagggactactggggacactc

SEQ ID NO: 539652 - DNA, 25 bp, Rattus norvegicus
cggtaataggggaacttgcgcatga

SEQ ID NO: 539653 - DNA, 25 bp, Rattus norvegicus
cttgcgcatgataaagtcgtagatg

SEQ ID NO: 539654 - DNA, 25 bp, Rattus norvegicus
tagatgcctgacagggtcacgcggc

SEQ ID NO: 539655 - DNA, 25 bp, Rattus norvegicus
ccgcggggctctgttgaatggccat

SEQ ID NO: 539656 - DNA, 25 bp, Rattus norvegicus
ctttgcccttgtcgtggccctcggt

SEQ ID NO: 539657 - DNA, 25 bp, Rattus norvegicus
tcggtgtacaagcagctaccagctc

SEQ ID NO: 539658 - DNA, 25 bp, Rattus norvegicus
tgggtagcaggtcaacagcaatgtg

SEQ ID NO: 539659 - DNA, 25 bp, Rattus norvegicus
gattcctctgcgctgtcaggtagtg

SEQ ID NO: 539660 - DNA, 25 bp, Rattus norvegicus
ggcgggcaacaaagcgattcctctg

SEQ ID NO: 539661 - DNA, 25 bp, Rattus norvegicus
agccgatccagagcgtggtgctccc

SEQ ID NO: 539662 - DNA, 25 bp, Rattus norvegicus
ggcgaccacactcattgggcgtgta

SEQ ID NO: 539663 - DNA, 25 bp, Rattus norvegicus
ccagatttggacgtcgtggaggaca

SEQ ID NO: 539664 - DNA, 25 bp, Rattus norvegicus
cgggtcaaggtccattcggtgtaca

SEQ ID NO: 539665 - DNA, 25 bp, Rattus norvegicus
aagccggcaacgactcgcgggtcaa

SEQ ID NO: 539666 - DNA, 25 bp, Rattus norvegicus
aagatcatcttcatgaccgcgcagg

SEQ ID NO: 539667 - DNA, 25 bp, Rattus norvegicus
gcgaaacctgcgcaccaagatcatc

SEQ ID NO: 539668 - DNA, 25 bp, Rattus norvegicus
caccaagatgagcacgcgaaacctg

SEQ ID NO: 539669 - DNA, 25 bp, Rattus norvegicus
agccagtaggaataccaccaagatg

SEQ ID NO: 539670 - DNA, 25 bp, Rattus norvegicus
gcaatgtgcaaagcgcaagccagta

SEQ ID NO: 539671 - DNA, 25 bp, Rattus norvegicus
agcgcttcccgctcgcgcatcgtta

SEQ ID NO: 539672 - DNA, 25 bp, Rattus norvegicus
cctcatctggaaggacagggcgccc

SEQ ID NO: 539673 - DNA, 25 bp, Rattus norvegicus
cacagcccaggggatccagagcagc

SEQ ID NO: 539674 - DNA, 25 bp, Rattus norvegicus
cccgctctgtcacagcgcttcccgc

SEQ ID NO: 539675 - DNA, 25 bp, Rattus norvegicus
agtcgcctcatctggaaggacaggg

SEQ ID NO: 539676 - DNA, 25 bp, Rattus norvegicus
cgcatcgttacctccgggcgccaca

SEQ ID NO: 539677 - DNA, 25 bp, Rattus norvegicus
actcaccatgtccacttctcgggga

SEQ ID NO: 539678 - DNA, 25 bp, Rattus norvegicus
atgtccacttctcggggacttctta

SEQ ID NO: 539679 - DNA, 25 bp, Rattus norvegicus
acttctcggggacttcttaccatcg

SEQ ID NO: 539680 - DNA, 25 bp, Rattus norvegicus
ggggacttcttaccatcgcccagca

SEQ ID NO: 539681 - DNA, 25 bp, Rattus norvegicus
cccagcacccacagcgttactgcgc

SEQ ID NO: 539682 - DNA, 25 bp, Rattus norvegicus
gcgttactgcgccaccgaagctacg

SEQ ID NO: 539683 - DNA, 25 bp, Rattus norvegicus
gctgcagtcgcctcatctggaagga

SEQ ID NO: 539684 - DNA, 25 bp, Rattus norvegicus
agccgcccacgaggcctcaccgcag

SEQ ID NO: 539685 - DNA, 25 bp, Rattus norvegicus
gcaccacttcgttccacttcagggg

SEQ ID NO: 539686 - DNA, 25 bp, Rattus norvegicus
gcgaaactgtgtctccctctcctcg

SEQ ID NO: 539687 - DNA, 25 bp, Rattus norvegicus
cccaactttgttccgccagctgcaa

SEQ ID NO: 539688 - DNA, 25 bp, Rattus norvegicus
acaggcgagtccagctgggcccaag

SEQ ID NO: 539689 - DNA, 25 bp, Rattus norvegicus
caccgtcaggatctcggatcccaga

SEQ ID NO: 539690 - DNA, 25 bp, Rattus norvegicus
gatctcggatcccagaatccgtgca

SEQ ID NO: 539691 - DNA, 25 bp, Rattus norvegicus
gggcgccatcttcccctaaggagta

SEQ ID NO: 539692 - DNA, 25 bp, Rattus norvegicus
gggtcctctgttctcgcctctagga

SEQ ID NO: 539693 - DNA, 25 bp, Rattus norvegicus
cacttcaggggaaggcatagtgaca

SEQ ID NO: 539694 - DNA, 25 bp, Rattus norvegicus
catagtgacagggactcaaacgggc

SEQ ID NO: 539695 - DNA, 25 bp, Rattus norvegicus
actcaaacgggcagtcgccagtctg

SEQ ID NO: 539696 - DNA, 25 bp, Rattus norvegicus
gcagtcgccagtctgtgtgcgccct

SEQ ID NO: 539697 - DNA, 25 bp, Rattus norvegicus
ctaggaagttcggtcccagcagcac

SEQ ID NO: 539698 - DNA, 25 bp, Rattus norvegicus
ttctcgcctctaggaagttcggtcc

SEQ ID NO: 539699 - DNA, 25 bp, Rattus norvegicus
gactcctcgagctcgggcttcctga

SEQ ID NO: 539700 - DNA, 25 bp, Rattus norvegicus
atctactgtcactccgggaacgacc

SEQ ID NO: 539701 - DNA, 25 bp, Rattus norvegicus
gaacgacccgaaactctatccaatc

SEQ ID NO: 539702 - DNA, 25 bp, Rattus norvegicus
ctatccaatcggagatcctgacttg

SEQ ID NO: 539703 - DNA, 25 bp, Rattus norvegicus
tcctgacttgagtcgagtccaatcg

SEQ ID NO: 539704 - DNA, 25 bp, Rattus norvegicus
ccaatcggacacacagagggagggc

SEQ ID NO: 539705 - DNA, 25 bp, Rattus norvegicus
tggctgtcacccgtcttttgtctgg

SEQ ID NO: 539706 - DNA, 25 bp, Rattus norvegicus
agccgccatcttgggctcggtgttc

SEQ ID NO: 539707 - DNA, 25 bp, Rattus norvegicus
ctcggtgttcctgcccaggaggctc

SEQ ID NO: 539708 - DNA, 25 bp, Rattus norvegicus
tacccagggctctgagactcctcga

SEQ ID NO: 539709 - DNA, 25 bp, Rattus norvegicus
tgacgctcccgatgcggacttcagc

SEQ ID NO: 539710 - DNA, 25 bp, Rattus norvegicus
gctgtgcgttgtcgccatctactgt

SEQ ID NO: 539711 - DNA, 25 bp, Rattus norvegicus
cccgatgcggacttcagcgggctct

SEQ ID NO: 539712 - DNA, 25 bp, Rattus norvegicus
cgttcgcactggatacccagggctc

SEQ ID NO: 539713 - DNA, 25 bp, Rattus norvegicus
catttcgggactccagtgagcgccc

SEQ ID NO: 539714 - DNA, 25 bp, Rattus norvegicus
aacgcaccatttcgggactccagtg

SEQ ID NO: 539715 - DNA, 25 bp, Rattus norvegicus
ccacgctcgggcagtcacaggtccc

SEQ ID NO: 539716 - DNA, 25 bp, Rattus norvegicus
ctacctgggaggcatctgtagccgc

SEQ ID NO: 539717 - DNA, 25 bp, Rattus norvegicus
cggccagcctacctgggaggcatct

SEQ ID NO: 539718 - DNA, 25 bp, Rattus norvegicus
tctgtagccgccctggtcacgggcg

SEQ ID NO: 539719 - DNA, 25 bp, Rattus norvegicus
gtcacgggcgtcactgcgggtaccc

SEQ ID NO: 539720 - DNA, 25 bp, Rattus norvegicus
cccgtgagcagacgcgacaagaccc

SEQ ID NO: 539721 - DNA, 25 bp, Rattus norvegicus
gacaagacccccgagctgcagcagg

SEQ ID NO: 539722 - DNA, 25 bp, Rattus norvegicus
cagcctggccacagtgcaggaggca

SEQ ID NO: 539723 - DNA, 25 bp, Rattus norvegicus
cgcaagcgaccctgacgcggggctc

SEQ ID NO: 539724 - DNA, 25 bp, Rattus norvegicus
cgtccagacagtagggagtcacgcg

SEQ ID NO: 539725 - DNA, 25 bp, Rattus norvegicus
agggagtcacgcggcgacagatacc

SEQ ID NO: 539726 - DNA, 25 bp, Rattus norvegicus
gctgccgtgggtaaacgcaccattt

SEQ ID NO: 539727 - DNA, 25 bp, Rattus norvegicus
ctgttttgtttcctagcccaggagg

SEQ ID NO: 539728 - DNA, 25 bp, Rattus norvegicus
cgctacgcgtctatgccgtgggcgt

SEQ ID NO: 539729 - DNA, 25 bp, Rattus norvegicus
gtgacgatggtgcagttgctacgcc

SEQ ID NO: 539730 - DNA, 25 bp, Rattus norvegicus
tgggaaacgacggaaacacactggc

SEQ ID NO: 539731 - DNA, 25 bp, Rattus norvegicus
ggcggaaccggaagttgcatttcta

SEQ ID NO: 539732 - DNA, 25 bp, Rattus norvegicus
ggtcacgcgggaatttctggaaaca

SEQ ID NO: 539733 - DNA, 25 bp, Rattus norvegicus
ctggctcccggcgaaaccggaagtg

SEQ ID NO: 539734 - DNA, 25 bp, Rattus norvegicus
tcgtttgggatcatccgggtgtttc

SEQ ID NO: 539735 - DNA, 25 bp, Rattus norvegicus
ttctggggcgcacggatatatcggt

SEQ ID NO: 539736 - DNA, 25 bp, Rattus norvegicus
gacaaacgcggaggctgcatttctg

SEQ ID NO: 539737 - DNA, 25 bp, Rattus norvegicus
cgacgcctggcgactacatttctgt

SEQ ID NO: 539738 - DNA, 25 bp, Rattus norvegicus
aatgtcgcgtgcgtaggacaaacgc

SEQ ID NO: 539739 - DNA, 25 bp, Rattus norvegicus
ctgacagccgcggaatgtcgcgtgc

SEQ ID NO: 539740 - DNA, 25 bp, Rattus norvegicus
tttctggaaacagcggggaccgaga

SEQ ID NO: 539741 - DNA, 25 bp, Rattus norvegicus
tgcgccgaagcttctcctcccgacg

SEQ ID NO: 539742 - DNA, 25 bp, Rattus norvegicus
agcagtagccgacggggctctgcac

SEQ ID NO: 539743 - DNA, 25 bp, Rattus norvegicus
gcagggcagcaatgagccgcacaga

SEQ ID NO: 539744 - DNA, 25 bp, Rattus norvegicus
ggcctcgtctcttccgtgctcgttg

SEQ ID NO: 539745 - DNA, 25 bp, Rattus norvegicus
gtctcttccgtgctcgttgccgtgc

SEQ ID NO: 539746 - DNA, 25 bp, Rattus norvegicus
gttgccgtgcctctctgcgccgaag

SEQ ID NO: 539747 - DNA, 25 bp, Rattus norvegicus
gccgcacagactgcaggttgcgctg

SEQ ID NO: 539748 - DNA, 25 bp, Rattus norvegicus
acgccgtgcccgttgttgctgctct

SEQ ID NO: 539749 - DNA, 25 bp, Rattus norvegicus
gttgttgctgctctgcctcccgctg

SEQ ID NO: 539750 - DNA, 25 bp, Rattus norvegicus
tcactgggcgtgacatcgtgtgatg

SEQ ID NO: 539751 - DNA, 25 bp, Rattus norvegicus
acatcgtgtgatgcaatcgggtttg

SEQ ID NO: 539752 - DNA, 25 bp, Rattus norvegicus
tgcaatcgggtttggcgtcactaga

SEQ ID NO: 539753 - DNA, 25 bp, Rattus norvegicus
tagatatgacgtcattcaagcaacg

SEQ ID NO: 539754 - DNA, 25 bp, Rattus norvegicus
tcgggtttggcgtcactagatatga

SEQ ID NO: 539755 - DNA, 25 bp, Rattus norvegicus
agcatcgtgctcgaggtaggaccca

SEQ ID NO: 539756 - DNA, 25 bp, Rattus norvegicus
gcctactgcgccctctgagttctta

SEQ ID NO: 539757 - DNA, 25 bp, Rattus norvegicus
agttgcccacaacggacatggctgc

SEQ ID NO: 539758 - DNA, 25 bp, Rattus norvegicus
ggaaggcgcctcagagttgcccaca

SEQ ID NO: 539759 - DNA, 25 bp, Rattus norvegicus
tctttgactgattggcctgcgcgtc

SEQ ID NO: 539760 - DNA, 25 bp, Rattus norvegicus
caatcagcgtcgatatctttgactg

SEQ ID NO: 539761 - DNA, 25 bp, Rattus norvegicus
ctcatatttcaaccaatcagcgtcg

SEQ ID NO: 539762 - DNA, 25 bp, Rattus norvegicus
gaaacttcgccttcctcatatttca

SEQ ID NO: 539763 - DNA, 25 bp, Rattus norvegicus
gccaatgaaaaatcagaaacttcgc

SEQ ID NO: 539764 - DNA, 25 bp, Rattus norvegicus
cggcggttacagctgagcgcactaa

SEQ ID NO: 539765 - DNA, 25 bp, Rattus norvegicus
ataatcacgcaattccgccaggtcc

SEQ ID NO: 539766 - DNA, 25 bp, Rattus norvegicus
ccggtaacactttagagcaataatc

SEQ ID NO: 539767 - DNA, 25 bp, Rattus norvegicus
ctcgaggtaggacccaggcttcccg

SEQ ID NO: 539768 - DNA, 25 bp, Rattus norvegicus
gagttcttaccgaaggcaaggagcg

SEQ ID NO: 539769 - DNA, 25 bp, Rattus norvegicus
ccttttgcgcttaggctccgtgaca

SEQ ID NO: 539770 - DNA, 25 bp, Rattus norvegicus
gccttcgctcggatgtcacaacaaa

SEQ ID NO: 539771 - DNA, 25 bp, Rattus norvegicus
aggctatgctcacctgactccatta

SEQ ID NO: 539772 - DNA, 25 bp, Rattus norvegicus
ttcctccgtggagacaacgtctgtc

SEQ ID NO: 539773 - DNA, 25 bp, Rattus norvegicus
cgctcaccggtgacgtcaaatacga

SEQ ID NO: 539774 - DNA, 25 bp, Rattus norvegicus
agggcgataatcctgtgaccaaggc

SEQ ID NO: 539775 - DNA, 25 bp, Rattus norvegicus
tcccagacacaggaggttgcggctc

SEQ ID NO: 539776 - DNA, 25 bp, Rattus norvegicus
gcaggtttttgctctcgctcccaga

SEQ ID NO: 539777 - DNA, 25 bp, Rattus norvegicus
accagcagaatcagcggcactcagc

SEQ ID NO: 539778 - DNA, 25 bp, Rattus norvegicus
cggccgctgacaactgattttcgta

SEQ ID NO: 539779 - DNA, 25 bp, Rattus norvegicus
ctcgccaccgtctaaggccttttgg

SEQ ID NO: 539780 - DNA, 25 bp, Rattus norvegicus
ttagcttccggtgcccagactctag

SEQ ID NO: 539781 - DNA, 25 bp, Rattus norvegicus
tggtgacgtcacaacatctgaaaca

SEQ ID NO: 539782 - DNA, 25 bp, Rattus norvegicus
caaagggaacttccggcaccgctca

SEQ ID NO: 539783 - DNA, 25 bp, Rattus norvegicus
cacccaccgcacagcccacgcgcga

SEQ ID NO: 539784 - DNA, 25 bp, Rattus norvegicus
gagtcaacctcgtacctcgggcact

SEQ ID NO: 539785 - DNA, 25 bp, Rattus norvegicus
cttgggagtcaacctcgtacctcgg

SEQ ID NO: 539786 - DNA, 25 bp, Rattus norvegicus
acgcgcgacccttgggagtcaacct

SEQ ID NO: 539787 - DNA, 25 bp, Rattus norvegicus
gccgttcaccgtcactgtgatgagg

SEQ ID NO: 539788 - DNA, 25 bp, Rattus norvegicus
ctgccgttcaccgtcactgtgatga

SEQ ID NO: 539789 - DNA, 25 bp, Rattus norvegicus
atccgcgtcggtacaagacacgggc

SEQ ID NO: 539790 - DNA, 25 bp, Rattus norvegicus
ccatgtcgatatccgcgtcggtaca

SEQ ID NO: 539791 - DNA, 25 bp, Rattus norvegicus
cggcagccatgtcgatatccgcgtc

SEQ ID NO: 539792 - DNA, 25 bp, Rattus norvegicus
tcacccacggcagccatgtcgatat

SEQ ID NO: 539793 - DNA, 25 bp, Rattus norvegicus
gcgcgtgctataggctcacccacgg

SEQ ID NO: 539794 - DNA, 25 bp, Rattus norvegicus
gcattgcgcgtgctataggctcacc

SEQ ID NO: 539795 - DNA, 25 bp, Rattus norvegicus
tcgatatccgcgtcggtacaagaca

SEQ ID NO: 539796 - DNA, 25 bp, Rattus norvegicus
gcgacccttgggagtcaacctcgta

SEQ ID NO: 539797 - DNA, 25 bp, Rattus norvegicus
agcaattatctgaggctgtcgcctg

SEQ ID NO: 539798 - DNA, 25 bp, Rattus norvegicus
tatgcctgggttgcgatcatgatgt

SEQ ID NO: 539799 - DNA, 25 bp, Rattus norvegicus
cgtatctgtccagtggtggtggtca

SEQ ID NO: 539800 - DNA, 25 bp, Rattus norvegicus
ggtggtcagagtcagcctcaccctg

SEQ ID NO: 539801 - DNA, 25 bp, Rattus norvegicus
ggggcagaacttactgttatcttcc

SEQ ID NO: 539802 - DNA, 25 bp, Rattus norvegicus
ttatcttccgttcctgctctcagtg

SEQ ID NO: 539803 - DNA, 25 bp, Rattus norvegicus
tgagacacagagtgaccaccgcctg

SEQ ID NO: 539804 - DNA, 25 bp, Rattus norvegicus
gagtccacagacctcaaagcccagg

SEQ ID NO: 539805 - DNA, 25 bp, Rattus norvegicus
aggtctagccgcgaccctgtgactc

SEQ ID NO: 539806 - DNA, 25 bp, Rattus norvegicus
ggaaccggatccgaacgtatctgtc

SEQ ID NO: 539807 - DNA, 25 bp, Rattus norvegicus
tccggaaacgagaaacctgcacagc

SEQ ID NO: 539808 - DNA, 25 bp, Rattus norvegicus
cctgcacagcggcatccatgttgtg

SEQ ID NO: 539809 - DNA, 25 bp, Rattus norvegicus
ttctgacatcgcctcgaacatagta

SEQ ID NO: 539810 - DNA, 25 bp, Rattus norvegicus
ggccgcatccagtgttgagcaatta

SEQ ID NO: 539811 - DNA, 25 bp, Rattus norvegicus
ggctgcaagcttccgggtaaagcgc

SEQ ID NO: 539812 - DNA, 25 bp, Rattus norvegicus
aatggcgccgcgtctgaattaggtc

SEQ ID NO: 539813 - DNA, 25 bp, Rattus norvegicus
gtagttctgagtgtaatggcgccgc

SEQ ID NO: 539814 - DNA, 25 bp, Rattus norvegicus
gacccgcactgaacgctgggagttg

SEQ ID NO: 539815 - DNA, 25 bp, Rattus norvegicus
ccaggacccgcactgaacgctggga

SEQ ID NO: 539816 - DNA, 25 bp, Rattus norvegicus
ctccaatgggagcagagtagaggtc

SEQ ID NO: 539817 - DNA, 25 bp, Rattus norvegicus
gaacatgagctctcctccaatggga

SEQ ID NO: 539818 - DNA, 25 bp, Rattus norvegicus
actcgcgctccggactgatgggcgc

SEQ ID NO: 539819 - DNA, 25 bp, Rattus norvegicus
tacgcgtggcctcctgggaacatga

SEQ ID NO: 539820 - DNA, 25 bp, Rattus norvegicus
ccgaggctgcaagcttccgggtaaa

SEQ ID NO: 539821 - DNA, 25 bp, Rattus norvegicus
ctgaaacaagagatggacgggaccc

SEQ ID NO: 539822 - DNA, 25 bp, Rattus norvegicus
cactgcctgaaacaagagatggacg

SEQ ID NO: 539823 - DNA, 25 bp, Rattus norvegicus
ccagggtcgtccactgcctgaaaca

SEQ ID NO: 539824 - DNA, 25 bp, Rattus norvegicus
tggcctcctgggaacatgagctctc

SEQ ID NO: 539825 - DNA, 25 bp, Rattus norvegicus
taagaagacggagatgacacccatg

SEQ ID NO: 539826 - DNA, 25 bp, Rattus norvegicus
aggcaacgctggttgcacacccagc

SEQ ID NO: 539827 - DNA, 25 bp, Rattus norvegicus
ctctcggcggagcaaaggcaacgct

SEQ ID NO: 539828 - DNA, 25 bp, Rattus norvegicus
cagcaaaggcaggtgccgtagtcga

SEQ ID NO: 539829 - DNA, 25 bp, Rattus norvegicus
agacgccctggacacagcaaaggca

SEQ ID NO: 539830 - DNA, 25 bp, Rattus norvegicus
gcagtggtagaagacgccctggaca

SEQ ID NO: 539831 - DNA, 25 bp, Rattus norvegicus
tggttgcacacccagcaggagggca

SEQ ID NO: 539832 - DNA, 25 bp, Rattus norvegicus
gacggagatgacacccatggccgcc

SEQ ID NO: 539833 - DNA, 25 bp, Rattus norvegicus
gatgatcactggactgcccagccga

SEQ ID NO: 539834 - DNA, 25 bp, Rattus norvegicus
cgcagatgaagaggcgatgatcact

SEQ ID NO: 539835 - DNA, 25 bp, Rattus norvegicus
gcccgcactcctcgcagatgaagag

SEQ ID NO: 539836 - DNA, 25 bp, Rattus norvegicus
tagcagcacaggcagggtaagaaga

SEQ ID NO: 539837 - DNA, 25 bp, Rattus norvegicus
cagcccggccgtcggaggctgtcat

SEQ ID NO: 539838 - DNA, 25 bp, Rattus norvegicus
tcgtcggcgcagttgtcctcgtcgt

SEQ ID NO: 539839 - DNA, 25 bp, Rattus norvegicus
ggttttcgttttattgctgtcagtc

SEQ ID NO: 539840 - DNA, 25 bp, Rattus norvegicus
tccgcaaacatttccagatcacctg

SEQ ID NO: 539841 - DNA, 25 bp, Rattus norvegicus
atgaacgatgcagaagaccttgagc

SEQ ID NO: 539842 - DNA, 25 bp, Rattus norvegicus
gaccttgagctctgtacgcgttttg

SEQ ID NO: 539843 - DNA, 25 bp, Rattus norvegicus
tatcgccatttgctatagttgcagg

SEQ ID NO: 539844 - DNA, 25 bp, Rattus norvegicus
tgacatcatcctcgtataacatttc

SEQ ID NO: 539845 - DNA, 25 bp, Rattus norvegicus
gggtcagtggggaaccctttcatga

SEQ ID NO: 539846 - DNA, 25 bp, Rattus norvegicus
acggtgagtctcatggcggactctc

SEQ ID NO: 539847 - DNA, 25 bp, Rattus norvegicus
ccgctccggagactcacggtgagtc

SEQ ID NO: 539848 - DNA, 25 bp, Rattus norvegicus
aacctgggagtcagccgtgcttggt

SEQ ID NO: 539849 - DNA, 25 bp, Rattus norvegicus
tgcagtgcccttcggccgggttgaa

SEQ ID NO: 539850 - DNA, 25 bp, Rattus norvegicus
tacgcgttttgaggttccgcaaaca

SEQ ID NO: 539851 - DNA, 25 bp, Rattus norvegicus
ggtccttgaggatcgtgaaatgaac

SEQ ID NO: 539852 - DNA, 25 bp, Rattus norvegicus
ctcccagcgctgagcggaaagcgtt

SEQ ID NO: 539853 - DNA, 25 bp, Rattus norvegicus
gtgacgccactagagcacgactctc

SEQ ID NO: 539854 - DNA, 25 bp, Rattus norvegicus
gacgtcatctttcggcgcccagtga

SEQ ID NO: 539855 - DNA, 25 bp, Rattus norvegicus
ttctgtgagtgacgccactagagca

SEQ ID NO: 539856 - DNA, 25 bp, Rattus norvegicus
agagcaggccgtgctgtcaaagtga

SEQ ID NO: 539857 - DNA, 25 bp, Rattus norvegicus
agcacgactctcatctgtacctgga

SEQ ID NO: 539858 - DNA, 25 bp, Rattus norvegicus
ggtcattctgtgagtgacgccacta

SEQ ID NO: 539859 - DNA, 25 bp, Rattus norvegicus
ctctcatctgtacctggagagccag

SEQ ID NO: 539860 - DNA, 25 bp, Rattus norvegicus
ctgtcaaagtgaggtgcagccaata

SEQ ID NO: 539861 - DNA, 25 bp, Rattus norvegicus
tttaatagagcaggccgtgctgtca

SEQ ID NO: 539862 - DNA, 25 bp, Rattus norvegicus
caaaatttaatagagcaggccgtgc

SEQ ID NO: 539863 - DNA, 25 bp, Rattus norvegicus
ttccggtcacaaccttaactataca

SEQ ID NO: 539864 - DNA, 25 bp, Rattus norvegicus
cagtgacttccggtcacaaccttaa

SEQ ID NO: 539865 - DNA, 25 bp, Rattus norvegicus
ctgtctcggagagggcggtcattct

SEQ ID NO: 539866 - DNA, 25 bp, Rattus norvegicus
gcgctgcgacgtcatctttcggcgc

SEQ ID NO: 539867 - DNA, 25 bp, Rattus norvegicus
tgactcaggataccgagaactctcg

SEQ ID NO: 539868 - DNA, 25 bp, Rattus norvegicus
ccatggtggttctgggagattgtct

SEQ ID NO: 539869 - DNA, 25 bp, Rattus norvegicus
tcggggaattcttccatggtggttc

SEQ ID NO: 539870 - DNA, 25 bp, Rattus norvegicus
ctctggttctggttcggggaattct

SEQ ID NO: 539871 - DNA, 25 bp, Rattus norvegicus
cgggtttagccgctctggttctggt

SEQ ID NO: 539872 - DNA, 25 bp, Rattus norvegicus
agtcccaggttagcctagcggtcgg

SEQ ID NO: 539873 - DNA, 25 bp, Rattus norvegicus
tgagcctgcgagtcccaggttagcc

SEQ ID NO: 539874 - DNA, 25 bp, Rattus norvegicus
tctgagtcacggtgagcctgcgagt

SEQ ID NO: 539875 - DNA, 25 bp, Rattus norvegicus
ccaaagcggttctgagtcacggtga

SEQ ID NO: 539876 - DNA, 25 bp, Rattus norvegicus
aggattccagactccaaagcggttc

SEQ ID NO: 539877 - DNA, 25 bp, Rattus norvegicus
gttcagccgctgtgaggattccaga

SEQ ID NO: 539878 - DNA, 25 bp, Rattus norvegicus
ttgtgctatggttcagccgctgtga

SEQ ID NO: 539879 - DNA, 25 bp, Rattus norvegicus
ctctcggattcctagaggggcggct

SEQ ID NO: 539880 - DNA, 25 bp, Rattus norvegicus
cgcacttccggttgtgctatggttc

SEQ ID NO: 539881 - DNA, 25 bp, Rattus norvegicus
taaacgcgacacgagggatcacgcg

SEQ ID NO: 539882 - DNA, 25 bp, Rattus norvegicus
ggagacacaaaagcaagcccggagt

SEQ ID NO: 539883 - DNA, 25 bp, Rattus norvegicus
gacgctggcgactttaaacactggg

SEQ ID NO: 539884 - DNA, 25 bp, Rattus norvegicus
tggcgactttaaacactggggctgg

SEQ ID NO: 539885 - DNA, 25 bp, Rattus norvegicus
acggtgggagacacaaaagcaagcc

SEQ ID NO: 539886 - DNA, 25 bp, Rattus norvegicus
acacaaaagcaagcccggagtccca

SEQ ID NO: 539887 - DNA, 25 bp, Rattus norvegicus
agcaagcccggagtcccaataaacg

SEQ ID NO: 539888 - DNA, 25 bp, Rattus norvegicus
gcccggagtcccaataaacgcgaca

SEQ ID NO: 539889 - DNA, 25 bp, Rattus norvegicus
ccaataaacgcgacacgagggatca

SEQ ID NO: 539890 - DNA, 25 bp, Rattus norvegicus
agctggacagcgactgcaggaggaa

SEQ ID NO: 539891 - DNA, 25 bp, Rattus norvegicus
gcaggaggaaggtggacccagaacc

SEQ ID NO: 539892 - DNA, 25 bp, Rattus norvegicus
ggccgcggacgtgtgaacaccaacc

SEQ ID NO: 539893 - DNA, 25 bp, Rattus norvegicus
cccggcgaccacaacttccacctca

SEQ ID NO: 539894 - DNA, 25 bp, Rattus norvegicus
gagtcccaataaacgcgacacgagg

SEQ ID NO: 539895 - DNA, 25 bp, Rattus norvegicus
cccatgtgacccatacggctaaata

SEQ ID NO: 539896 - DNA, 25 bp, Rattus norvegicus
agggccactcggattcaccatactg

SEQ ID NO: 539897 - DNA, 25 bp, Rattus norvegicus
agagcagttatctccgatgccaccg

SEQ ID NO: 539898 - DNA, 25 bp, Rattus norvegicus
cgcgcggaaggacactgtttacaca

SEQ ID NO: 539899 - DNA, 25 bp, Rattus norvegicus
ctccgatcaggtagcgccatttccg

SEQ ID NO: 539900 - DNA, 25 bp, Rattus norvegicus
gcggccgaaaactaccaatcgcgga

SEQ ID NO: 539901 - DNA, 25 bp, Rattus norvegicus
gcgcagaggctggtctagtaaccca

SEQ ID NO: 539902 - DNA, 25 bp, Rattus norvegicus
actgaaggctccacgtcatctggtc

SEQ ID NO: 539903 - DNA, 25 bp, Rattus norvegicus
ttatcccaggtgcagttagcttgtc

SEQ ID NO: 539904 - DNA, 25 bp, Rattus norvegicus
ccgtgcggcaagacttaaatggttc

SEQ ID NO: 539905 - DNA, 25 bp, Rattus norvegicus
ttctgaagtctcactccggggaagc

SEQ ID NO: 539906 - DNA, 25 bp, Rattus norvegicus
gcgcagcggtacgtagctctccaac

SEQ ID NO: 539907 - DNA, 25 bp, Rattus norvegicus
gcgcgaaacgtcgtcacccatgtga

SEQ ID NO: 539908 - DNA, 25 bp, Rattus norvegicus
ccggtggaagattgcctgattctgc

SEQ ID NO: 539909 - DNA, 25 bp, Rattus norvegicus
agggctcactggtctcctctctacg

SEQ ID NO: 539910 - DNA, 25 bp, Rattus norvegicus
agcgaccttcgtccaagctcggaga

SEQ ID NO: 539911 - DNA, 25 bp, Rattus norvegicus
ccacctagtggtgagcgtcagagcg

SEQ ID NO: 539912 - DNA, 25 bp, Rattus norvegicus
tcagagcgacccacgatgtcacggc

SEQ ID NO: 539913 - DNA, 25 bp, Rattus norvegicus
tcagcaccagtgtgagtcggacagc

SEQ ID NO: 539914 - DNA, 25 bp, Rattus norvegicus
acccgaggtacacgtgtgcagattg

SEQ ID NO: 539915 - DNA, 25 bp, Rattus norvegicus
gccgaaagtctctggaccactccta

SEQ ID NO: 539916 - DNA, 25 bp, Rattus norvegicus
tctacgcatctcttccctgcaggtg

SEQ ID NO: 539917 - DNA, 25 bp, Rattus norvegicus
cctgcaggtggtaggacacaaagcc

SEQ ID NO: 539918 - DNA, 25 bp, Rattus norvegicus
ccagacgccaggtaaagtttcacta

SEQ ID NO: 539919 - DNA, 25 bp, Rattus norvegicus
ctcacaggtggatttacggtcagga

SEQ ID NO: 539920 - DNA, 25 bp, Rattus norvegicus
agctgggctctggtctagaccgaaa

SEQ ID NO: 539921 - DNA, 25 bp, Rattus norvegicus
acattgagctatgtccgcgacccga

SEQ ID NO: 539922 - DNA, 25 bp, Rattus norvegicus
tttgaaccaccatgaaggaacgccg

SEQ ID NO: 539923 - DNA, 25 bp, Rattus norvegicus
tctgctggcgtccagcggttcctac

SEQ ID NO: 539924 - DNA, 25 bp, Rattus norvegicus
acgggtatatgtccttcccttgcca

SEQ ID NO: 539925 - DNA, 25 bp, Rattus norvegicus
cttcccttgccatgagcggtccagt

SEQ ID NO: 539926 - DNA, 25 bp, Rattus norvegicus
atgagcggtccagtgcgcactgagc

SEQ ID NO: 539927 - DNA, 25 bp, Rattus norvegicus
gcactgagccgctgcacggcgagac

SEQ ID NO: 539928 - DNA, 25 bp, Rattus norvegicus
gtccgtggacgggtatatgtccttc

SEQ ID NO: 539929 - DNA, 25 bp, Rattus norvegicus
cgtccagcggttcctactcggtggt

SEQ ID NO: 539930 - DNA, 25 bp, Rattus norvegicus
ttcctactcggtggtggttctgctg

SEQ ID NO: 539931 - DNA, 25 bp, Rattus norvegicus
gcgtgcagatggcacggtgactctc

SEQ ID NO: 539932 - DNA, 25 bp, Rattus norvegicus
agatggcacggtgactctcgtcttg

SEQ ID NO: 539933 - DNA, 25 bp, Rattus norvegicus
tctcggataccagccgccgattggc

SEQ ID NO: 539934 - DNA, 25 bp, Rattus norvegicus
atttcggagggactggcagatgtcc

SEQ ID NO: 539935 - DNA, 25 bp, Rattus norvegicus
cgattggccccatctgcagacggcg

SEQ ID NO: 539936 - DNA, 25 bp, Rattus norvegicus
gggtctcggataccagccgccgatt

SEQ ID NO: 539937 - DNA, 25 bp, Rattus norvegicus
ccctcgctcaataactcttcagata

SEQ ID NO: 539938 - DNA, 25 bp, Rattus norvegicus
ccttatggcttgcactccgctgtca

SEQ ID NO: 539939 - DNA, 25 bp, Rattus norvegicus
acctacggctgccatggtgagtgag

SEQ ID NO: 539940 - DNA, 25 bp, Rattus norvegicus
ccggaagctacctatccggtagaca

SEQ ID NO: 539941 - DNA, 25 bp, Rattus norvegicus
gtgaaccacctgaccggagcctgga

SEQ ID NO: 539942 - DNA, 25 bp, Rattus norvegicus
tgggctagagtcagctggtgaacca

SEQ ID NO: 539943 - DNA, 25 bp, Rattus norvegicus
gcaccatccaatgcgcaagcgaagg

SEQ ID NO: 539944 - DNA, 25 bp, Rattus norvegicus
agtctgatgacgtacgcaccatcca

SEQ ID NO: 539945 - DNA, 25 bp, Rattus norvegicus
gcgctccgcagtggttgataaagtc

SEQ ID NO: 539946 - DNA, 25 bp, Rattus norvegicus
tccacgaatgtgtccggaaagcggc

SEQ ID NO: 539947 - DNA, 25 bp, Rattus norvegicus
gaaatgcaaccaatccacgaatgtg

SEQ ID NO: 539948 - DNA, 25 bp, Rattus norvegicus
tcctgagtggcgaggaaatgcaacc

SEQ ID NO: 539949 - DNA, 25 bp, Rattus norvegicus
gctggagaaggaaggctccgctacc

SEQ ID NO: 539950 - DNA, 25 bp, Rattus norvegicus
cttcagataatctcgcaggcgaatc

SEQ ID NO: 539951 - DNA, 25 bp, Rattus norvegicus
aatgactgaagagaaagcggaagcg

SEQ ID NO: 539952 - DNA, 25 bp, Rattus norvegicus
caccagcaggaagcggactgtctcc

SEQ ID NO: 539953 - DNA, 25 bp, Rattus norvegicus
actcctccggcgctgaccgaagcca

SEQ ID NO: 539954 - DNA, 25 bp, Rattus norvegicus
cagggcagtcgccagctcagtccag

SEQ ID NO: 539955 - DNA, 25 bp, Rattus norvegicus
tgtctcccccaggtacagatggttg

SEQ ID NO: 539956 - DNA, 25 bp, Rattus norvegicus
acatcgagtagtcgcattgggactc

SEQ ID NO: 539957 - DNA, 25 bp, Rattus norvegicus
gtcgcattgggactccattggatgg

SEQ ID NO: 539958 - DNA, 25 bp, Rattus norvegicus
ggcccgcgagttccaacaccggaga

SEQ ID NO: 539959 - DNA, 25 bp, Rattus norvegicus
cgagttccaacaccggagaaccgcg

SEQ ID NO: 539960 - DNA, 25 bp, Rattus norvegicus
cctagacccaaaggcgccggaacag

SEQ ID NO: 539961 - DNA, 25 bp, Rattus norvegicus
gcctacgaggctcctcggaggagtc

SEQ ID NO: 539962 - DNA, 25 bp, Rattus norvegicus
gtcagcatcctggtcgccggcgctg

SEQ ID NO: 539963 - DNA, 25 bp, Rattus norvegicus
cccagcaggcagcaggacacaccag

SEQ ID NO: 539964 - DNA, 25 bp, Rattus norvegicus
gcacagccgggaagtacatcgagta

SEQ ID NO: 539965 - DNA, 25 bp, Rattus norvegicus
ccggctagtctcttcccggggtgct

SEQ ID NO: 539966 - DNA, 25 bp, Rattus norvegicus
tcgggacatcgggactcgaagtatc

SEQ ID NO: 539967 - DNA, 25 bp, Rattus norvegicus
tcgaagtatccaactccgggttatg

SEQ ID NO: 539968 - DNA, 25 bp, Rattus norvegicus
tccgggttatggagctgctcgttca

SEQ ID NO: 539969 - DNA, 25 bp, Rattus norvegicus
ggagcccacgaccacaggcgacata

SEQ ID NO: 539970 - DNA, 25 bp, Rattus norvegicus
tccagattcccatagccgcaggagc

SEQ ID NO: 539971 - DNA, 25 bp, Rattus norvegicus
cctcctgggagagatctgccgccat

SEQ ID NO: 539972 - DNA, 25 bp, Rattus norvegicus
tctcggagctcccaaacctgcagga

SEQ ID NO: 539973 - DNA, 25 bp, Rattus norvegicus
gcttcagagcggctgtcatgccaca

SEQ ID NO: 539974 - DNA, 25 bp, Rattus norvegicus
cggctccactacgaaccagacggtg

SEQ ID NO: 539975 - DNA, 25 bp, Rattus norvegicus
cagattagtgcctgccgctgttgtg

SEQ ID NO: 539976 - DNA, 25 bp, Rattus norvegicus
gggcgttcttcctcagctgacgacc

SEQ ID NO: 539977 - DNA, 25 bp, Rattus norvegicus
tgacgacctccaagaccggctagtc

SEQ ID NO: 539978 - DNA, 25 bp, Rattus norvegicus
gccgccttcattcgagcagtagctg

SEQ ID NO: 539979 - DNA, 25 bp, Rattus norvegicus
gcgggacgtctcgaagaaaagaata

SEQ ID NO: 539980 - DNA, 25 bp, Rattus norvegicus
acggtagctggactaggaggcatct

SEQ ID NO: 539981 - DNA, 25 bp, Rattus norvegicus
ctggagcccgccaatgatcagaaga

SEQ ID NO: 539982 - DNA, 25 bp, Rattus norvegicus
tgaagccaatgtggagtgacaactc

SEQ ID NO: 539983 - DNA, 25 bp, Rattus norvegicus
cctgagtgaaattgagcccattgca

SEQ ID NO: 539984 - DNA, 25 bp, Rattus norvegicus
ccattgcaattgaggagccggactg

SEQ ID NO: 539985 - DNA, 25 bp, Rattus norvegicus
gcggtagcagaacgctgagccaatg

SEQ ID NO: 539986 - DNA, 25 bp, Rattus norvegicus
cgctaaagcccacgtgacaggaatg

SEQ ID NO: 539987 - DNA, 25 bp, Rattus norvegicus
aggaatgcacgccacatgcctggtg

SEQ ID NO: 539988 - DNA, 25 bp, Rattus norvegicus
acgtggttagcacgagctcgctctg

SEQ ID NO: 539989 - DNA, 25 bp, Rattus norvegicus
tctgtgccaagtctcgcgacacttc

SEQ ID NO: 539990 - DNA, 25 bp, Rattus norvegicus
tgccttcccgcgtttttctcagatt

SEQ ID NO: 539991 - DNA, 25 bp, Rattus norvegicus
agaacagttactctcgcgcctgcgc

SEQ ID NO: 539992 - DNA, 25 bp, Rattus norvegicus
tcagccgcgcgaagaacagttactc

SEQ ID NO: 539993 - DNA, 25 bp, Rattus norvegicus
atccataagcttgtggccttctggg

SEQ ID NO: 539994 - DNA, 25 bp, Rattus norvegicus
gcgttctattcttgagcgcttggaa

SEQ ID NO: 539995 - DNA, 25 bp, Rattus norvegicus
cgagatttgtgaattcgaagcgttc

SEQ ID NO: 539996 - DNA, 25 bp, Rattus norvegicus
ggatttattgacagaggcgggccca

SEQ ID NO: 539997 - DNA, 25 bp, Rattus norvegicus
gcagtctcttcagcaagggctacac

SEQ ID NO: 539998 - DNA, 25 bp, Rattus norvegicus
ctagctagcagaggcgggatttatt

SEQ ID NO: 539999 - DNA, 25 bp, Rattus norvegicus
cccttttctcgtgcgcgtgtgcgag

SEQ ID NO: 540000 - DNA, 25 bp, Rattus norvegicus
cgagggaattaagtctcgcgagatt

SEQ ID NO: 540001 - DNA, 25 bp, Rattus norvegicus
gtgcccttcactcgtgtgaacctcg

SEQ ID NO: 540002 - DNA, 25 bp, Rattus norvegicus
cgctccaagccggaatccataagct

SEQ ID NO: 540003 - DNA, 25 bp, Rattus norvegicus
cccgctgcccacgatatgcagaata

SEQ ID NO: 540004 - DNA, 25 bp, Rattus norvegicus
tgaacctcgccgaccgatccaagtg

SEQ ID NO: 540005 - DNA, 25 bp, Rattus norvegicus
aagggctacacactgcgcacgcgtg

SEQ ID NO: 540006 - DNA, 25 bp, Rattus norvegicus
tccgaacaggaacgccaggcagtct

SEQ ID NO: 540007 - DNA, 25 bp, Rattus norvegicus
attctggtcgccgaaccggggcctg

SEQ ID NO: 540008 - DNA, 25 bp, Rattus norvegicus
cccgcgctcagtccgaagtaacggt

SEQ ID NO: 540009 - DNA, 25 bp, Rattus norvegicus
ctcggctcgggtctcgtcgtctctg

SEQ ID NO: 540010 - DNA, 25 bp, Rattus norvegicus
ccgctacgtgccaagcacgattctg

SEQ ID NO: 540011 - DNA, 25 bp, Rattus norvegicus
tctctgctgtgtggcgtgtgcgcac

SEQ ID NO: 540012 - DNA, 25 bp, Rattus norvegicus
agctgcccgaaatgtcccgctcggg

SEQ ID NO: 540013 - DNA, 25 bp, Rattus norvegicus
tccgaagtaacggtcgcgtctctgg

SEQ ID NO: 540014 - DNA, 25 bp, Rattus norvegicus
cccactctgttcctcggggcgggag

SEQ ID NO: 540015 - DNA, 25 bp, Rattus norvegicus
caagcacgattctggtcgccgaacc

SEQ ID NO: 540016 - DNA, 25 bp, Rattus norvegicus
tccttatacacctcggttgccggcg

SEQ ID NO: 540017 - DNA, 25 bp, Rattus norvegicus
agctctgcgagcaccggaacaggcc

SEQ ID NO: 540018 - DNA, 25 bp, Rattus norvegicus
ggtaagctctgcgagcaccggaaca

SEQ ID NO: 540019 - DNA, 25 bp, Rattus norvegicus
tgcaagctgcccgaaatgtcccgct

SEQ ID NO: 540020 - DNA, 25 bp, Rattus norvegicus
ttatacacctcggttgccggcgcgc

SEQ ID NO: 540021 - DNA, 25 bp, Rattus norvegicus
cacgggtccgcactgacattaacga

SEQ ID NO: 540022 - DNA, 25 bp, Rattus norvegicus
ccaagtcgcacagcctcttggcggg

SEQ ID NO: 540023 - DNA, 25 bp, Rattus norvegicus
gctgcagaggaacgcatgtgcctgt

SEQ ID NO: 540024 - DNA, 25 bp, Rattus norvegicus
agttctctctggctcctgggtccac

SEQ ID NO: 540025 - DNA, 25 bp, Rattus norvegicus
gcatgtgcctgtttgcgttccctcg

SEQ ID NO: 540026 - DNA, 25 bp, Rattus norvegicus
gccgagcaggaagcttagaggccca

SEQ ID NO: 540027 - DNA, 25 bp, Rattus norvegicus
ttagaggcccagcttagcaaagacc

SEQ ID NO: 540028 - DNA, 25 bp, Rattus norvegicus
ttagcaaagaccgaaagctcgggga

SEQ ID NO: 540029 - DNA, 25 bp, Rattus norvegicus
cgccgccttggctctagagaaatcg

SEQ ID NO: 540030 - DNA, 25 bp, Rattus norvegicus
agagaaatcgtactggtccaatgac

SEQ ID NO: 540031 - DNA, 25 bp, Rattus norvegicus
ccaatgacttgatctcggggaccaa

SEQ ID NO: 540032 - DNA, 25 bp, Rattus norvegicus
caagaaagtcctccgcagtggcccg

SEQ ID NO: 540033 - DNA, 25 bp, Rattus norvegicus
ttactaataaagctgctgaggcgcc

SEQ ID NO: 540034 - DNA, 25 bp, Rattus norvegicus
ttaacgattccacgggtcctcctgc

SEQ ID NO: 540035 - DNA, 25 bp, Rattus norvegicus
gcacaaagcccgtgggagcctctca

SEQ ID NO: 540036 - DNA, 25 bp, Rattus norvegicus
taggcaaccgtcacccgaactgaga

SEQ ID NO: 540037 - DNA, 25 bp, Rattus norvegicus
tccggcacccgaaagacgttgccaa

SEQ ID NO: 540038 - DNA, 25 bp, Rattus norvegicus
acgttgccaaggaacaaatgacttc

SEQ ID NO: 540039 - DNA, 25 bp, Rattus norvegicus
ccggaaacaaagtgggaagtgcaag

SEQ ID NO: 540040 - DNA, 25 bp, Rattus norvegicus
tcccttcgaaaacagacctggcgtc

SEQ ID NO: 540041 - DNA, 25 bp, Rattus norvegicus
cccagctaagacagaggtggtgatg

SEQ ID NO: 540042 - DNA, 25 bp, Rattus norvegicus
ctgagagcacctcattggtgaagtg

SEQ ID NO: 540043 - DNA, 25 bp, Rattus norvegicus
gtttccaaggcaaccgcatccgcgg

SEQ ID NO: 540044 - DNA, 25 bp, Rattus norvegicus
ctcttacccagaaccggccagggtg

SEQ ID NO: 540045 - DNA, 25 bp, Rattus norvegicus
gggaaaagccgattgagcactaata

SEQ ID NO: 540046 - DNA, 25 bp, Rattus norvegicus
gcactaataggttcgggacggctca

SEQ ID NO: 540047 - DNA, 25 bp, Rattus norvegicus
ctctcagaagtaattagggctccga

SEQ ID NO: 540048 - DNA, 25 bp, Rattus norvegicus
ccattagcctctggtcagtgcggga

SEQ ID NO: 540049 - DNA, 25 bp, Rattus norvegicus
tgctcgcccagatctccaaggtttg

SEQ ID NO: 540050 - DNA, 25 bp, Rattus norvegicus
aatcctccgactcaggaagtccgcg

SEQ ID NO: 540051 - DNA, 25 bp, Rattus norvegicus
ttagctcttacctctgccatctggg

SEQ ID NO: 540052 - DNA, 25 bp, Rattus norvegicus
cagagacaccgttccgggacccttg

SEQ ID NO: 540053 - DNA, 25 bp, Rattus norvegicus
acaatcgtgttgactttcgggagca

SEQ ID NO: 540054 - DNA, 25 bp, Rattus norvegicus
ttgggactcgggtttgcacaatcgt

SEQ ID NO: 540055 - DNA, 25 bp, Rattus norvegicus
agtggcgctgagaacttgtcttttc

SEQ ID NO: 540056 - DNA, 25 bp, Rattus norvegicus
tctccaaggtttggctcgtcccgga

SEQ ID NO: 540057 - DNA, 25 bp, Rattus norvegicus
ggatccgagtccctaaggtttctca

SEQ ID NO: 540058 - DNA, 25 bp, Rattus norvegicus
gcccacctggctttacaggacttta

SEQ ID NO: 540059 - DNA, 25 bp, Rattus norvegicus
tgtatgtaaatcgtggcggctccgc

SEQ ID NO: 540060 - DNA, 25 bp, Rattus norvegicus
ggtaggctcgccctgtatgtaaatc

SEQ ID NO: 540061 - DNA, 25 bp, Rattus norvegicus
acaggactttatggggtgcggacca

SEQ ID NO: 540062 - DNA, 25 bp, Rattus norvegicus
ctcgtcccggagaaagacacctgta

SEQ ID NO: 540063 - DNA, 25 bp, Rattus norvegicus
atcccgggagctgtccggccgcctc

SEQ ID NO: 540064 - DNA, 25 bp, Rattus norvegicus
tacagccctgcatcccgaacccgcg

SEQ ID NO: 540065 - DNA, 25 bp, Rattus norvegicus
cccagccgggttattgtctcgcttc

SEQ ID NO: 540066 - DNA, 25 bp, Rattus norvegicus
ctcggcctggcctacagccctgcat

SEQ ID NO: 540067 - DNA, 25 bp, Rattus norvegicus
tcgtaaccaatcggccgcgccgttg

SEQ ID NO: 540068 - DNA, 25 bp, Rattus norvegicus
ccgcgagcagcgtagagagggcact

SEQ ID NO: 540069 - DNA, 25 bp, Rattus norvegicus
gggggatccagtgttctgattggcc

SEQ ID NO: 540070 - DNA, 25 bp, Rattus norvegicus
gtctcgcttcgtaaccaatcggccg

SEQ ID NO: 540071 - DNA, 25 bp, Rattus norvegicus
ttgtctcgcttcgtaaccaatcggc

SEQ ID NO: 540072 - DNA, 25 bp, Rattus norvegicus
gggttattgtctcgcttcgtaacca

SEQ ID NO: 540073 - DNA, 25 bp, Rattus norvegicus
gccgggttattgtctcgcttcgtaa

SEQ ID NO: 540074 - DNA, 25 bp, Rattus norvegicus
agccgggttattgtctcgcttcgta

SEQ ID NO: 540075 - DNA, 25 bp, Rattus norvegicus
ccagccgggttattgtctcgcttcg

SEQ ID NO: 540076 - DNA, 25 bp, Rattus norvegicus
gcagcgtagagagggcactatgagc

SEQ ID NO: 540077 - DNA, 25 bp, Rattus norvegicus
agcgccacgggcaacgccacggtga

SEQ ID NO: 540078 - DNA, 25 bp, Rattus norvegicus
acctcattgggtagcccagttggaa

SEQ ID NO: 540079 - DNA, 25 bp, Rattus norvegicus
cagttggaatactggcagcgaggcc

SEQ ID NO: 540080 - DNA, 25 bp, Rattus norvegicus
gcgaggcctcaccaatctccgcgtt

SEQ ID NO: 540081 - DNA, 25 bp, Rattus norvegicus
aatctccgcgttcccagggcaagct

SEQ ID NO: 540082 - DNA, 25 bp, Rattus norvegicus
ttcccagggcaagcttgtgtacgcc

SEQ ID NO: 540083 - DNA, 25 bp, Rattus norvegicus
caagcttgtgtacgcccactacggg

SEQ ID NO: 540084 - DNA, 25 bp, Rattus norvegicus
gaagtctactgtccctacagcgcca

SEQ ID NO: 540085 - DNA, 25 bp, Rattus norvegicus
aggatccggaagtctactgtcccta

SEQ ID NO: 540086 - DNA, 25 bp, Rattus norvegicus
taccgctggaggatccggaagtcta

SEQ ID NO: 540087 - DNA, 25 bp, Rattus norvegicus
caagagcagctaccgctggaggatc

SEQ ID NO: 540088 - DNA, 25 bp, Rattus norvegicus
gggagcgtccaagagcagctaccgc

SEQ ID NO: 540089 - DNA, 25 bp, Rattus norvegicus
tcccgggatggggagcccatcacga

SEQ ID NO: 540090 - DNA, 25 bp, Rattus norvegicus
ggggagcccatcacgacctcattgg

SEQ ID NO: 540091 - DNA, 25 bp, Rattus norvegicus
tccgccacattttcctaggccaagg

SEQ ID NO: 540092 - DNA, 25 bp, Rattus norvegicus
attttcctaggccaaggcgaccaca

SEQ ID NO: 540093 - DNA, 25 bp, Rattus norvegicus
agctgcctcttctgggttgagccca

SEQ ID NO: 540094 - DNA, 25 bp, Rattus norvegicus
ctcttctgggttgagcccaggtctg

SEQ ID NO: 540095 - DNA, 25 bp, Rattus norvegicus
gggcagccaacgcactcagtggcga

SEQ ID NO: 540096 - DNA, 25 bp, Rattus norvegicus
cccaggtctgggcttccaggagagt

SEQ ID NO: 540097 - DNA, 25 bp, Rattus norvegicus
caggagagtcgcttccggcgacagc

SEQ ID NO: 540098 - DNA, 25 bp, Rattus norvegicus
ttccggcgacagctggcgctgctca

SEQ ID NO: 540099 - DNA, 25 bp, Rattus norvegicus
ctgcgctccgatggctcaggagctg

SEQ ID NO: 540100 - DNA, 25 bp, Rattus norvegicus
aggcgaccacactttgggtgccctg

SEQ ID NO: 540101 - DNA, 25 bp, Rattus norvegicus
ttgggtgccctggtggaacacctac

SEQ ID NO: 540102 - DNA, 25 bp, Rattus norvegicus
actcagtggcgacgtttggaacatc

SEQ ID NO: 540103 - DNA, 25 bp, Rattus norvegicus
cgctgctcacgtggacgctacaggg

SEQ ID NO: 540104 - DNA, 25 bp, Rattus norvegicus
ggaacacctacggatgctgcgctcc

SEQ ID NO: 540105 - DNA, 25 bp, Rattus norvegicus
ctgtttctgaccacgccttttccgg

SEQ ID NO: 540106 - DNA, 25 bp, Rattus norvegicus
ctgatgtcaccgctgccttggaacc

SEQ ID NO: 540107 - DNA, 25 bp, Rattus norvegicus
tatggggcgctgtaaacccgccctg

SEQ ID NO: 540108 - DNA, 25 bp, Rattus norvegicus
tcccaatccgggacttctggtatgg

SEQ ID NO: 540109 - DNA, 25 bp, Rattus norvegicus
tggctaactctgtcccgcctagtcg

SEQ ID NO: 540110 - DNA, 25 bp, Rattus norvegicus
cccgctagatgtggatcctgcagcc

SEQ ID NO: 540111 - DNA, 25 bp, Rattus norvegicus
catgagcagaacgaggcctgatgtc

SEQ ID NO: 540112 - DNA, 25 bp, Rattus norvegicus
gctattggcgcgagggacgaaaaaa

SEQ ID NO: 540113 - DNA, 25 bp, Rattus norvegicus
tcttagagtttagggctattggcgc

SEQ ID NO: 540114 - DNA, 25 bp, Rattus norvegicus
agctcaggaggacaagagggtctta

SEQ ID NO: 540115 - DNA, 25 bp, Rattus norvegicus
tggtccgccctgaatactagatccg

SEQ ID NO: 540116 - DNA, 25 bp, Rattus norvegicus
ggtccacttctttggtccgccctga

SEQ ID NO: 540117 - DNA, 25 bp, Rattus norvegicus
ttcacctcggaagcgaagtgcagtt

SEQ ID NO: 540118 - DNA, 25 bp, Rattus norvegicus
gtggtcacgcccacatggctaactc

SEQ ID NO: 540119 - DNA, 25 bp, Rattus norvegicus
ggaccgcgaccctcatttgcatagc

SEQ ID NO: 540120 - DNA, 25 bp, Rattus norvegicus
ctcccgtacctcagtgtagtctaga

SEQ ID NO: 540121 - DNA, 25 bp, Rattus norvegicus
agtctagaattgagaggctccaccc

SEQ ID NO: 540122 - DNA, 25 bp, Rattus norvegicus
ctttaccgttttctgattggacacg

SEQ ID NO: 540123 - DNA, 25 bp, Rattus norvegicus
attggacacgtctaacgcatctgtg

SEQ ID NO: 540124 - DNA, 25 bp, Rattus norvegicus
cgcatctgtggttcgtgattggtcc

SEQ ID NO: 540125 - DNA, 25 bp, Rattus norvegicus
agctgcagcttcagtctccgtgcca

SEQ ID NO: 540126 - DNA, 25 bp, Rattus norvegicus
agccgtagcgcagaacgagccctag

SEQ ID NO: 540127 - DNA, 25 bp, Rattus norvegicus
agccctagaggaagctgtggccacc

SEQ ID NO: 540128 - DNA, 25 bp, Rattus norvegicus
cctgaacttgtccaaccggcgtttg

SEQ ID NO: 540129 - DNA, 25 bp, Rattus norvegicus
tccaaccggcgtttgaagcacttcc

SEQ ID NO: 540130 - DNA, 25 bp, Rattus norvegicus
cggcccgcagttacgacctgtcaga

SEQ ID NO: 540131 - DNA, 25 bp, Rattus norvegicus
ctgtcagacatcacccaggctggtg

SEQ ID NO: 540132 - DNA, 25 bp, Rattus norvegicus
agttgcgctagtgcccagagagcag

SEQ ID NO: 540133 - DNA, 25 bp, Rattus norvegicus
atagtgcaggcaccttccaggctaa

SEQ ID NO: 540134 - DNA, 25 bp, Rattus norvegicus
catccgcgcgcttgctaatagtgca

SEQ ID NO: 540135 - DNA, 25 bp, Rattus norvegicus
gcacctcgagcaaggcgctgtacca

SEQ ID NO: 540136 - DNA, 25 bp, Rattus norvegicus
aggcgctgtaccatgtttgctgctc

SEQ ID NO: 540137 - DNA, 25 bp, Rattus norvegicus
atgtttgctgctctgcttcactggc

SEQ ID NO: 540138 - DNA, 25 bp, Rattus norvegicus
cgcttgctaatagtgcaggcacctt

SEQ ID NO: 540139 - DNA, 25 bp, Rattus norvegicus
agccgctggccaagaacttcttctc

SEQ ID NO: 540140 - DNA, 25 bp, Rattus norvegicus
gctctcatagcactccagccgtggt

SEQ ID NO: 540141 - DNA, 25 bp, Rattus norvegicus
agcactccagccgtggtgggtcagc

SEQ ID NO: 540142 - DNA, 25 bp, Rattus norvegicus
tgggtcagcacgcagcacgaaaaag

SEQ ID NO: 540143 - DNA, 25 bp, Rattus norvegicus
gcgctgggacttctgcttcctcaga

SEQ ID NO: 540144 - DNA, 25 bp, Rattus norvegicus
acttctgcttcctcagatggccaca

SEQ ID NO: 540145 - DNA, 25 bp, Rattus norvegicus
tatagatgacgatcaggtggcgctg

SEQ ID NO: 540146 - DNA, 25 bp, Rattus norvegicus
ctgctgtcgctggtatagatgacga

SEQ ID NO: 540147 - DNA, 25 bp, Rattus norvegicus
ctgcacactgattggctagtctccc

SEQ ID NO: 540148 - DNA, 25 bp, Rattus norvegicus
agctgcccacggtgatgtccacata

SEQ ID NO: 540149 - DNA, 25 bp, Rattus norvegicus
tctgcagcaggcgaccttctacagc

SEQ ID NO: 540150 - DNA, 25 bp, Rattus norvegicus
attgccggggctacccttctgacct

SEQ ID NO: 540151 - DNA, 25 bp, Rattus norvegicus
gatccactcacaggaggccggagca

SEQ ID NO: 540152 - DNA, 25 bp, Rattus norvegicus
cgctgggcgcactcgaaacagtgac

SEQ ID NO: 540153 - DNA, 25 bp, Rattus norvegicus
gcaagtcagcggtagctctccttta

SEQ ID NO: 540154 - DNA, 25 bp, Rattus norvegicus
ttcctcgtcttgttctgcacactga

SEQ ID NO: 540155 - DNA, 25 bp, Rattus norvegicus
ctcctcgctctgattggttcgattc

SEQ ID NO: 540156 - DNA, 25 bp, Rattus norvegicus
agcctcctgcctattccattggttc

SEQ ID NO: 540157 - DNA, 25 bp, Rattus norvegicus
tgcaagtacagtgcgtgccatcctc

SEQ ID NO: 540158 - DNA, 25 bp, Rattus norvegicus
cggactcctatgctgactctgattg

SEQ ID NO: 540159 - DNA, 25 bp, Rattus norvegicus
actctgattggttgttaaggttgca

SEQ ID NO: 540160 - DNA, 25 bp, Rattus norvegicus
cggaccacgaccaggagacactctg

SEQ ID NO: 540161 - DNA, 25 bp, Rattus norvegicus
cgcgaaccccgtgcgccttagtgtt

SEQ ID NO: 540162 - DNA, 25 bp, Rattus norvegicus
taacctttgactccgtgggcgccgc

SEQ ID NO: 540163 - DNA, 25 bp, Rattus norvegicus
agcgtacaggggatcttgagaggaa

SEQ ID NO: 540164 - DNA, 25 bp, Rattus norvegicus
tactaacctttgactccgtgggcgc

SEQ ID NO: 540165 - DNA, 25 bp, Rattus norvegicus
ccaagtcatcccttactaacctttg

SEQ ID NO: 540166 - DNA, 25 bp, Rattus norvegicus
cgcggtccaagtcatcccttactaa

SEQ ID NO: 540167 - DNA, 25 bp, Rattus norvegicus
gctcaaagtcttccgcacgtccgcc

SEQ ID NO: 540168 - DNA, 25 bp, Rattus norvegicus
ttgttccaccgtgtggggctcaaag

SEQ ID NO: 540169 - DNA, 25 bp, Rattus norvegicus
gaccttgttccaccgtgtggggctc

SEQ ID NO: 540170 - DNA, 25 bp, Rattus norvegicus
ctggaggtcgcacccacccgcgaac

SEQ ID NO: 540171 - DNA, 25 bp, Rattus norvegicus
gggtctcccaatccctaagcagagc

SEQ ID NO: 540172 - DNA, 25 bp, Rattus norvegicus
ttgggtctcccaatccctaagcaga

SEQ ID NO: 540173 - DNA, 25 bp, Rattus norvegicus
ctactcagcggtgctgtgctgggtt

SEQ ID NO: 540174 - DNA, 25 bp, Rattus norvegicus
cttcgggcgtctggtcctcgccaac

SEQ ID NO: 540175 - DNA, 25 bp, Rattus norvegicus
agcccttgactgctgcctgccgtgg

SEQ ID NO: 540176 - DNA, 25 bp, Rattus norvegicus
tctccagctcagctcggtggccgag

SEQ ID NO: 540177 - DNA, 25 bp, Rattus norvegicus
gcgctaggccgccttaggattaaaa

SEQ ID NO: 540178 - DNA, 25 bp, Rattus norvegicus
gagatacatccagtggggccacgtg

SEQ ID NO: 540179 - DNA, 25 bp, Rattus norvegicus
agaacactgggcagcccttgactgc

SEQ ID NO: 540180 - DNA, 25 bp, Rattus norvegicus
agtgagatgcggacgccagagaaca

SEQ ID NO: 540181 - DNA, 25 bp, Rattus norvegicus
cgagatgcctcgcagagtgagatgc

SEQ ID NO: 540182 - DNA, 25 bp, Rattus norvegicus
tgcaaactttccaccgagatgcctc

SEQ ID NO: 540183 - DNA, 25 bp, Rattus norvegicus
ctggtttcttctcgtctcaactgca

SEQ ID NO: 540184 - DNA, 25 bp, Rattus norvegicus
agctgaggagccgagagatacatcc

SEQ ID NO: 540185 - DNA, 25 bp, Rattus norvegicus
tccaccgtggaagcgctggtttctt

SEQ ID NO: 540186 - DNA, 25 bp, Rattus norvegicus
ttaacggaggctgcgcctgggctcc

SEQ ID NO: 540187 - DNA, 25 bp, Rattus norvegicus
cagagaagacccgtggagtgttaac

SEQ ID NO: 540188 - DNA, 25 bp, Rattus norvegicus
cgagccactcaagggactggagtca

SEQ ID NO: 540189 - DNA, 25 bp, Rattus norvegicus
gtgaggtgcccgacaagcctcccgg

SEQ ID NO: 540190 - DNA, 25 bp, Rattus norvegicus
agagcgtcatgctggcacgcacata

SEQ ID NO: 540191 - DNA, 25 bp, Rattus norvegicus
tggcacgcacatagcgccacaggga

SEQ ID NO: 540192 - DNA, 25 bp, Rattus norvegicus
tagcgccacagggagcctgcccggt

SEQ ID NO: 540193 - DNA, 25 bp, Rattus norvegicus
gcccggtgggatacacagacacaga

SEQ ID NO: 540194 - DNA, 25 bp, Rattus norvegicus
tcagacacacttggaggcccggtca

SEQ ID NO: 540195 - DNA, 25 bp, Rattus norvegicus
cattagtgggtgatggttagtgatc

SEQ ID NO: 540196 - DNA, 25 bp, Rattus norvegicus
atacctggggccttcgggacattag

SEQ ID NO: 540197 - DNA, 25 bp, Rattus norvegicus
ggacgtaacgccacacgcagcctgt

SEQ ID NO: 540198 - DNA, 25 bp, Rattus norvegicus
gcaggtagcccgagagcgtcatgct

SEQ ID NO: 540199 - DNA, 25 bp, Rattus norvegicus
cctgagaacggacatacctggggcc

SEQ ID NO: 540200 - DNA, 25 bp, Rattus norvegicus
gcacagacacgctcagacacacttg

SEQ ID NO: 540201 - DNA, 25 bp, Rattus norvegicus
ctcgctgacctggaacgttgttaac

SEQ ID NO: 540202 - DNA, 25 bp, Rattus norvegicus
agcctgtgggctcgctgacctggaa

SEQ ID NO: 540203 - DNA, 25 bp, Rattus norvegicus
cctgcactctgagtggcggcttgtg

SEQ ID NO: 540204 - DNA, 25 bp, Rattus norvegicus
ggcctttggcaccagccacggtttc

SEQ ID NO: 540205 - DNA, 25 bp, Rattus norvegicus
tccagtcataaacggcggcctggtg

SEQ ID NO: 540206 - DNA, 25 bp, Rattus norvegicus
agccctttgtactggtgcagtgcca

SEQ ID NO: 540207 - DNA, 25 bp, Rattus norvegicus
tgaggcaggctttcagccctttgta

SEQ ID NO: 540208 - DNA, 25 bp, Rattus norvegicus
tttgtcaagtgagcaccgcatccgg

SEQ ID NO: 540209 - DNA, 25 bp, Rattus norvegicus
aggacctcctccacgaggtgctgtc

SEQ ID NO: 540210 - DNA, 25 bp, Rattus norvegicus
gcggatgacctgacacgacttccta

SEQ ID NO: 540211 - DNA, 25 bp, Rattus norvegicus
gctgtcccgcgtaaagtccctcaag

SEQ ID NO: 540212 - DNA, 25 bp, Rattus norvegicus
gtccctcaagaagtccctacgtcag

SEQ ID NO: 540213 - DNA, 25 bp, Rattus norvegicus
acctgctgcaggaccaggagggcta

SEQ ID NO: 540214 - DNA, 25 bp, Rattus norvegicus
cctacgtcagtcattccgtcggatg

SEQ ID NO: 540215 - DNA, 25 bp, Rattus norvegicus
ccgcagcagggcgtccagtcataaa

SEQ ID NO: 540216 - DNA, 25 bp, Rattus norvegicus
tttcggcctcttcgatcaccagcag

SEQ ID NO: 540217 - DNA, 25 bp, Rattus norvegicus
ttaggagagccttatcgacgaggtc

SEQ ID NO: 540218 - DNA, 25 bp, Rattus norvegicus
cggaatggctctccgccacctggag

SEQ ID NO: 540219 - DNA, 25 bp, Rattus norvegicus
tcccgtttccgggtggtgaagctgc

SEQ ID NO: 540220 - DNA, 25 bp, Rattus norvegicus
gtgaagctgccccaaggtttaggag

SEQ ID NO: 540221 - DNA, 25 bp, Rattus norvegicus
cccaaggtttaggagagccttatcg

SEQ ID NO: 540222 - DNA, 25 bp, Rattus norvegicus
aggtttaggagagccttatcgacga

SEQ ID NO: 540223 - DNA, 25 bp, Rattus norvegicus
aaccctgatccagggggcaggggca

SEQ ID NO: 540224 - DNA, 25 bp, Rattus norvegicus
taggagagccttatcgacgaggtcg

SEQ ID NO: 540225 - DNA, 25 bp, Rattus norvegicus
agccttatcgacgaggtcggtggac

SEQ ID NO: 540226 - DNA, 25 bp, Rattus norvegicus
ccttatcgacgaggtcggtggacgt

SEQ ID NO: 540227 - DNA, 25 bp, Rattus norvegicus
tcggtggacgtgtgtggatgtttac

SEQ ID NO: 540228 - DNA, 25 bp, Rattus norvegicus
gacgtgtgtggatgtttacgagaga

SEQ ID NO: 540229 - DNA, 25 bp, Rattus norvegicus
agacctggagcccccgagcttcggt

SEQ ID NO: 540230 - DNA, 25 bp, Rattus norvegicus
ccaaggtttaggagagccttatcga

SEQ ID NO: 540231 - DNA, 25 bp, Rattus norvegicus
gtcgccagcggccaatttaatgcct

SEQ ID NO: 540232 - DNA, 25 bp, Rattus norvegicus
cttgatgggaaaacgttgagcacct

SEQ ID NO: 540233 - DNA, 25 bp, Rattus norvegicus
acgtgccacgctctaagcggctcta

SEQ ID NO: 540234 - DNA, 25 bp, Rattus norvegicus
gcgctctcagggttgaacgtgccac

SEQ ID NO: 540235 - DNA, 25 bp, Rattus norvegicus
gagcagctgagaaagtcgttccaga

SEQ ID NO: 540236 - DNA, 25 bp, Rattus norvegicus
ctgctcccaggttcgttttcaactg

SEQ ID NO: 540237 - DNA, 25 bp, Rattus norvegicus
ttggacttgagtctgagcccgagcc

SEQ ID NO: 540238 - DNA, 25 bp, Rattus norvegicus
gcaccggaaccctgggtcctagaga

SEQ ID NO: 540239 - DNA, 25 bp, Rattus norvegicus
cccgttagagtccattgaaagcgaa

SEQ ID NO: 540240 - DNA, 25 bp, Rattus norvegicus
caagatgatgaacttcgggacgtcc

SEQ ID NO: 540241 - DNA, 25 bp, Rattus norvegicus
gcttgttgtcttacaccggtgggta

SEQ ID NO: 540242 - DNA, 25 bp, Rattus norvegicus
ccctgcccttaaaggcgaacaagtg

SEQ ID NO: 540243 - DNA, 25 bp, Rattus norvegicus
tgagcacctagggaaccgttgttct

SEQ ID NO: 540244 - DNA, 25 bp, Rattus norvegicus
tccagacccgctgtgtcctggagga

SEQ ID NO: 540245 - DNA, 25 bp, Rattus norvegicus
cgcatcgggagtgcgaaccaactta

SEQ ID NO: 540246 - DNA, 25 bp, Rattus norvegicus
agctggtgtgaaaaggtctccttga

SEQ ID NO: 540247 - DNA, 25 bp, Rattus norvegicus
ccggacaagccgaggaaccaactgc

SEQ ID NO: 540248 - DNA, 25 bp, Rattus norvegicus
tttccttaggttagatgcacgcagc

SEQ ID NO: 540249 - DNA, 25 bp, Rattus norvegicus
cgctgctaagtccaagccctactga

SEQ ID NO: 540250 - DNA, 25 bp, Rattus norvegicus
gccctactgatatcctttgtctctg

SEQ ID NO: 540251 - DNA, 25 bp, Rattus norvegicus
tgtgagatcccacccaccgtaggcg

SEQ ID NO: 540252 - DNA, 25 bp, Rattus norvegicus
gtgcgtcagcacgtttccaagggtt

SEQ ID NO: 540253 - DNA, 25 bp, Rattus norvegicus
ccaagggttgtgcattcccaggaaa

SEQ ID NO: 540254 - DNA, 25 bp, Rattus norvegicus
aaaggggcaagctcatgaattattc

SEQ ID NO: 540255 - DNA, 25 bp, Rattus norvegicus
tcccgcccatctcattagaattaga

SEQ ID NO: 540256 - DNA, 25 bp, Rattus norvegicus
cgaaggagtcgagcacactgtctca

SEQ ID NO: 540257 - DNA, 25 bp, Rattus norvegicus
cttccaccagcgaggaacatctaga

SEQ ID NO: 540258 - DNA, 25 bp, Rattus norvegicus
gacacccgacccttgttcctgagga

SEQ ID NO: 540259 - DNA, 25 bp, Rattus norvegicus
cacaagcagcagcacgcccatggta

SEQ ID NO: 540260 - DNA, 25 bp, Rattus norvegicus
ccatggtaacagcaaaaccagcttc

SEQ ID NO: 540261 - DNA, 25 bp, Rattus norvegicus
gagccttcgctctcctaacattcga

SEQ ID NO: 540262 - DNA, 25 bp, Rattus norvegicus
ttcgaccacctcttctgtgggactc

SEQ ID NO: 540263 - DNA, 25 bp, Rattus norvegicus
gggactcctcagtctctcgattctg

SEQ ID NO: 540264 - DNA, 25 bp, Rattus norvegicus
attctgtccttggtccgctatccct

SEQ ID NO: 540265 - DNA, 25 bp, Rattus norvegicus
agcacccggtcgatgttcctcacag

SEQ ID NO: 540266 - DNA, 25 bp, Rattus norvegicus
tggatccaatcctctgcgaccctgg

SEQ ID NO: 540267 - DNA, 25 bp, Rattus norvegicus
ggcccactgtcctgcgttactagta

SEQ ID NO: 540268 - DNA, 25 bp, Rattus norvegicus
tagtaccaggtcacggctcttccga

SEQ ID NO: 540269 - DNA, 25 bp, Rattus norvegicus
ggccactggcattactcaccggcga

SEQ ID NO: 540270 - DNA, 25 bp, Rattus norvegicus
tcaccggcgactcgagtagccgttg

SEQ ID NO: 540271 - DNA, 25 bp, Rattus norvegicus
tggccagcgctgaaccgcacaagca

SEQ ID NO: 540272 - DNA, 25 bp, Rattus norvegicus
accagcttcattttgcgcggctttc

SEQ ID NO: 540273 - DNA, 25 bp, Rattus norvegicus
ctgggaaatgtagttaggcacgagc

SEQ ID NO: 540274 - DNA, 25 bp, Rattus norvegicus
tcagccgggtaattaggaccagacc

SEQ ID NO: 540275 - DNA, 25 bp, Rattus norvegicus
gtgaggattttcagccgggtaatta

SEQ ID NO: 540276 - DNA, 25 bp, Rattus norvegicus
cagccttctacggtgaggattttca

SEQ ID NO: 540277 - DNA, 25 bp, Rattus norvegicus
tcgcggctcgaatcagccttctacg

SEQ ID NO: 540278 - DNA, 25 bp, Rattus norvegicus
ctccgcaggtgttcgcggctcgaat

SEQ ID NO: 540279 - DNA, 25 bp, Rattus norvegicus
ttaggaccagacccgggattggatg

SEQ ID NO: 540280 - DNA, 25 bp, Rattus norvegicus
ggcacgagcaagctaccgttagttg

SEQ ID NO: 540281 - DNA, 25 bp, Rattus norvegicus
cttgccgctgagagttctgggaaat

SEQ ID NO: 540282 - DNA, 25 bp, Rattus norvegicus
gctaacggacttgccgctgagagtt

SEQ ID NO: 540283 - DNA, 25 bp, Rattus norvegicus
ccggctggcaggctaacggacttgc

SEQ ID NO: 540284 - DNA, 25 bp, Rattus norvegicus
tgaattttctgtcgcgagcccagcc

SEQ ID NO: 540285 - DNA, 25 bp, Rattus norvegicus
gcggagccaatgaattttctgtcgc

SEQ ID NO: 540286 - DNA, 25 bp, Rattus norvegicus
ctaccgttagttgccggactgcggc

SEQ ID NO: 540287 - DNA, 25 bp, Rattus norvegicus
gtgctttctgtaacgcctgccgtta

SEQ ID NO: 540288 - DNA, 25 bp, Rattus norvegicus
tacccggaaattcaggcttcccaga

SEQ ID NO: 540289 - DNA, 25 bp, Rattus norvegicus
ttcccagagggacccaagcgtgctt

SEQ ID NO: 540290 - DNA, 25 bp, Rattus norvegicus
cccttgtagagcagcgcgcgttcac

SEQ ID NO: 540291 - DNA, 25 bp, Rattus norvegicus
gtaacgcctgccgttacttcttcta

SEQ ID NO: 540292 - DNA, 25 bp, Rattus norvegicus
gggacccaagcgtgctttctgtaac

SEQ ID NO: 540293 - DNA, 25 bp, Rattus norvegicus
aaggaggcgctacccggaaattcag

SEQ ID NO: 540294 - DNA, 25 bp, Rattus norvegicus
atcgagccgacttcctagagaagcc

SEQ ID NO: 540295 - DNA, 25 bp, Rattus norvegicus
cgggtcctccagagcatcgagccga

SEQ ID NO: 540296 - DNA, 25 bp, Rattus norvegicus
tcccagtggatcagctccgggtcct

SEQ ID NO: 540297 - DNA, 25 bp, Rattus norvegicus
tcaatacctcgctcttcccagtgga

SEQ ID NO: 540298 - DNA, 25 bp, Rattus norvegicus
gctactgcgcagactcaatacctcg

SEQ ID NO: 540299 - DNA, 25 bp, Rattus norvegicus
ctttgaaggccagctactgcgcaga

SEQ ID NO: 540300 - DNA, 25 bp, Rattus norvegicus
cgcgcgttcactggtcagcgcagtc

SEQ ID NO: 540301 - DNA, 25 bp, Rattus norvegicus
cgcttgaagccattacgtgatgttc

SEQ ID NO: 540302 - DNA, 25 bp, Rattus norvegicus
ttgttgaacccagacccgcggcgat

SEQ ID NO: 540303 - DNA, 25 bp, Rattus norvegicus
actcggaatctaggcgctaagctca

SEQ ID NO: 540304 - DNA, 25 bp, Rattus norvegicus
cgccgtctgcatctcgggttttagg

SEQ ID NO: 540305 - DNA, 25 bp, Rattus norvegicus
aatccttgccttgtctcgccgtctg

SEQ ID NO: 540306 - DNA, 25 bp, Rattus norvegicus
cctctctggggaattcggttcctca

SEQ ID NO: 540307 - DNA, 25 bp, Rattus norvegicus
ggtccagtcttcctccgggtcagag

SEQ ID NO: 540308 - DNA, 25 bp, Rattus norvegicus
cctaagcgtgctgctagccatggca

SEQ ID NO: 540309 - DNA, 25 bp, Rattus norvegicus
aggcaggttccgtggctttgttgaa

SEQ ID NO: 540310 - DNA, 25 bp, Rattus norvegicus
gccatctttgataggggcaaaccta

SEQ ID NO: 540311 - DNA, 25 bp, Rattus norvegicus
cgtgatgttcccttggagaccagca

SEQ ID NO: 540312 - DNA, 25 bp, Rattus norvegicus
tggtctaaacgcatcccttccggtg

SEQ ID NO: 540313 - DNA, 25 bp, Rattus norvegicus
acgcgtactaaccaccaactcttgg

SEQ ID NO: 540314 - DNA, 25 bp, Rattus norvegicus
gaccagcaagctttccgccatcttt

SEQ ID NO: 540315 - DNA, 25 bp, Rattus norvegicus
tctgcttccttctactcatccgggg

SEQ ID NO: 540316 - DNA, 25 bp, Rattus norvegicus
gagactttgacacccttatccaagg

SEQ ID NO: 540317 - DNA, 25 bp, Rattus norvegicus
caggctcgaatgtccgaaaacgttc

SEQ ID NO: 540318 - DNA, 25 bp, Rattus norvegicus
tgacccgagtcaatctggagagccc

SEQ ID NO: 540319 - DNA, 25 bp, Rattus norvegicus
ttcagtccgagtaatgctaagcgcc

SEQ ID NO: 540320 - DNA, 25 bp, Rattus norvegicus
gctggaggcactagcatccttgctc

SEQ ID NO: 540321 - DNA, 25 bp, Rattus norvegicus
ggcatcagaaatccaagcgtccgct

SEQ ID NO: 540322 - DNA, 25 bp, Rattus norvegicus
agtccgtgcgcagtcagacccatag

SEQ ID NO: 540323 - DNA, 25 bp, Rattus norvegicus
agaagctctgctgaccgagtccgtg

SEQ ID NO: 540324 - DNA, 25 bp, Rattus norvegicus
ctggcagcccgttggtcatgaaaac

SEQ ID NO: 540325 - DNA, 25 bp, Rattus norvegicus
gggcgctccgatgtttatcctcctc

SEQ ID NO: 540326 - DNA, 25 bp, Rattus norvegicus
tgaaaaccttcacgttgccagcatc

SEQ ID NO: 540327 - DNA, 25 bp, Rattus norvegicus
cgcctgcttcaacaagggttagctc

SEQ ID NO: 540328 - DNA, 25 bp, Rattus norvegicus
ccggccaaaggatgacagcgtccca

SEQ ID NO: 540329 - DNA, 25 bp, Rattus norvegicus
caggcgccaacgctgcagcacaccc

SEQ ID NO: 540330 - DNA, 25 bp, Rattus norvegicus
aaagcctaccatcctgcagcctccg

SEQ ID NO: 540331 - DNA, 25 bp, Rattus norvegicus
cccaatctcatacggcgcgcgggcg

SEQ ID NO: 540332 - DNA, 25 bp, Rattus norvegicus
ctgcgcaggcgccaacgctgcagca

SEQ ID NO: 540333 - DNA, 25 bp, Rattus norvegicus
gctccaggcgtggtctcactgcgca

SEQ ID NO: 540334 - DNA, 25 bp, Rattus norvegicus
tttccctccctctccgcctgaagcc

SEQ ID NO: 540335 - DNA, 25 bp, Rattus norvegicus
cactcccagtcggattcttttcttt

SEQ ID NO: 540336 - DNA, 25 bp, Rattus norvegicus
tccactcccagtcggattcttttct

SEQ ID NO: 540337 - DNA, 25 bp, Rattus norvegicus
agctccactcccagtcggattcttt

SEQ ID NO: 540338 - DNA, 25 bp, Rattus norvegicus
ggccaccgtagaagccagctccact

SEQ ID NO: 540339 - DNA, 25 bp, Rattus norvegicus
agcctccggcccggtgcgtccctct

SEQ ID NO: 540340 - DNA, 25 bp, Rattus norvegicus
cctctcctcaaagcctaccatcctg

SEQ ID NO: 540341 - DNA, 25 bp, Rattus norvegicus
ggaccctcgcaggtacagcccacgc

SEQ ID NO: 540342 - DNA, 25 bp, Rattus norvegicus
cctctccggccaccgtagaagccag

SEQ ID NO: 540343 - DNA, 25 bp, Rattus norvegicus
atgcgttgcagatgtttctccttcc

SEQ ID NO: 540344 - DNA, 25 bp, Rattus norvegicus
tggctttcggtgttcaaggctcttc

SEQ ID NO: 540345 - DNA, 25 bp, Rattus norvegicus
cggtgttcaaggctcttcgtgctcc

SEQ ID NO: 540346 - DNA, 25 bp, Rattus norvegicus
aaggctcttcgtgctcctgacaggg

SEQ ID NO: 540347 - DNA, 25 bp, Rattus norvegicus
ctaagaaaaccttcttggagcgatt

SEQ ID NO: 540348 - DNA, 25 bp, Rattus norvegicus
tttcacgcgaactcagcgcctcctt

SEQ ID NO: 540349 - DNA, 25 bp, Rattus norvegicus
cttccagccgcgaggtctcaaaggt

SEQ ID NO: 540350 - DNA, 25 bp, Rattus norvegicus
aggtctcaaaggtgagcctcgcaca

SEQ ID NO: 540351 - DNA, 25 bp, Rattus norvegicus
cgcacaaatgcgttgcagatgtttc

SEQ ID NO: 540352 - DNA, 25 bp, Rattus norvegicus
gcagatgtttctccttccagatcgg

SEQ ID NO: 540353 - DNA, 25 bp, Rattus norvegicus
gtttctccttccagatcggctaccg

SEQ ID NO: 540354 - DNA, 25 bp, Rattus norvegicus
caacttcccggcctcgtcagcccgc

SEQ ID NO: 540355 - DNA, 25 bp, Rattus norvegicus
ggtgagcctcgcacaaatgcgttgc

SEQ ID NO: 540356 - DNA, 25 bp, Rattus norvegicus
ttggagcgattttcctttcacgcga

SEQ ID NO: 540357 - DNA, 25 bp, Rattus norvegicus
gacacaccttgggacttccagagca

SEQ ID NO: 540358 - DNA, 25 bp, Rattus norvegicus
tccacaggctgtgagtagctcagtc

SEQ ID NO: 540359 - DNA, 25 bp, Rattus norvegicus
gcgagtgacgattcccagacagata

SEQ ID NO: 540360 - DNA, 25 bp, Rattus norvegicus
atccaggcagcgaaggacacacctt

SEQ ID NO: 540361 - DNA, 25 bp, Rattus norvegicus
ggcaaatgccctgatagcaaccatc

SEQ ID NO: 540362 - DNA, 25 bp, Rattus norvegicus
ctaactctggtgcagggcaaatgcc

SEQ ID NO: 540363 - DNA, 25 bp, Rattus norvegicus
tggagccttccgataccaactcaga

SEQ ID NO: 540364 - DNA, 25 bp, Rattus norvegicus
cagctcgtgcttggacagtgaagcc

SEQ ID NO: 540365 - DNA, 25 bp, Rattus norvegicus
actcgacgaggccatggaaagacgc

SEQ ID NO: 540366 - DNA, 25 bp, Rattus norvegicus
tccgagaacagttgtggggagcacc

SEQ ID NO: 540367 - DNA, 25 bp, Rattus norvegicus
agctctcagcgtctgggacacggac

SEQ ID NO: 540368 - DNA, 25 bp, Rattus norvegicus
ggggaaccaccgctgcagaagtgca

SEQ ID NO: 540369 - DNA, 25 bp, Rattus norvegicus
agcccgctacggaatctgaggaccc

SEQ ID NO: 540370 - DNA, 25 bp, Rattus norvegicus
gtctgctggggacagatgtctctca

SEQ ID NO: 540371 - DNA, 25 bp, Rattus norvegicus
ctctgacccggaggaggtcgtattc

SEQ ID NO: 540372 - DNA, 25 bp, Rattus norvegicus
gagacggcgctttgatctccgcgca

SEQ ID NO: 540373 - DNA, 25 bp, Rattus norvegicus
tctccgcgcaggcttcaacaaattc

SEQ ID NO: 540374 - DNA, 25 bp, Rattus norvegicus
aacggcccttcgaatcctcactttg

SEQ ID NO: 540375 - DNA, 25 bp, Rattus norvegicus
tagccttcgcaccaccaagaggatg

SEQ ID NO: 540376 - DNA, 25 bp, Rattus norvegicus
cagcacctgcggaacgaacggcaca

SEQ ID NO: 540377 - DNA, 25 bp, Rattus norvegicus
ccagggcctttcgaatcacctctga

SEQ ID NO: 540378 - DNA, 25 bp, Rattus norvegicus
cgtattcagctcgtgactcggtgtc

SEQ ID NO: 540379 - DNA, 25 bp, Rattus norvegicus
tctgcagaatgggtcaatgcctgtt

SEQ ID NO: 540380 - DNA, 25 bp, Rattus norvegicus
ggagcgactaaaccttcccagagac

SEQ ID NO: 540381 - DNA, 25 bp, Rattus norvegicus
gatgcatgccgggaaacgtagtttc

SEQ ID NO: 540382 - DNA, 25 bp, Rattus norvegicus
acaggctgggcaacgcatatccgtc

SEQ ID NO: 540383 - DNA, 25 bp, Rattus norvegicus
cccagagactaggtatcccgtgatg

SEQ ID NO: 540384 - DNA, 25 bp, Rattus norvegicus
gtttcgtcctcacacacggttctcg

SEQ ID NO: 540385 - DNA, 25 bp, Rattus norvegicus
acgcacctgcttcgggtggctcctg

SEQ ID NO: 540386 - DNA, 25 bp, Rattus norvegicus
aagcatccagactacaggctggctc

SEQ ID NO: 540387 - DNA, 25 bp, Rattus norvegicus
gccgcgtcaaagcatccagactaca

SEQ ID NO: 540388 - DNA, 25 bp, Rattus norvegicus
cctgcccttcaaaggctgcgacttg

SEQ ID NO: 540389 - DNA, 25 bp, Rattus norvegicus
aaaggctgcgacttggggttgcaac

SEQ ID NO: 540390 - DNA, 25 bp, Rattus norvegicus
cgacttggggttgcaactcggtccg

SEQ ID NO: 540391 - DNA, 25 bp, Rattus norvegicus
tgcggccacccgaggtccgcagtgt

SEQ ID NO: 540392 - DNA, 25 bp, Rattus norvegicus
ggctccggcgcctgacactcaggca

SEQ ID NO: 540393 - DNA, 25 bp, Rattus norvegicus
ctctaccgggcggtgctaacggagc

SEQ ID NO: 540394 - DNA, 25 bp, Rattus norvegicus
taagggagccgctgccctctaccgg

SEQ ID NO: 540395 - DNA, 25 bp, Rattus norvegicus
ctcaggacctgagtgtaagggagcc

SEQ ID NO: 540396 - DNA, 25 bp, Rattus norvegicus
gatcccggtcaaggcgtggccaagt

SEQ ID NO: 540397 - DNA, 25 bp, Rattus norvegicus
tggcgccgcgtcaaagcatccagac

SEQ ID NO: 540398 - DNA, 25 bp, Rattus norvegicus
gcctcgatcccggtcaaggcgtggc

SEQ ID NO: 540399 - DNA, 25 bp, Rattus norvegicus
cgctccgcgcgcacggtgcaaaaga

SEQ ID NO: 540400 - DNA, 25 bp, Rattus norvegicus
accgctgtggtctggaggtccccca

SEQ ID NO: 540401 - DNA, 25 bp, Rattus norvegicus
tttgcaggtgggctctgctcgctcc

SEQ ID NO: 540402 - DNA, 25 bp, Rattus norvegicus
ttgaccaacagcgaccgcgaccttt

SEQ ID NO: 540403 - DNA, 25 bp, Rattus norvegicus
tccgcgcgcacggtgcaaaagagcg

SEQ ID NO: 540404 - DNA, 25 bp, Rattus norvegicus
cacggtgcaaaagagcgcagcgccc

SEQ ID NO: 540405 - DNA, 25 bp, Rattus norvegicus
cggtgcaaaagagcgcagcgcccgc

SEQ ID NO: 540406 - DNA, 25 bp, Rattus norvegicus
ccacgccaagcgagggggactttct

SEQ ID NO: 540407 - DNA, 25 bp, Rattus norvegicus
ggactttctcccaaagcgttgacca

SEQ ID NO: 540408 - DNA, 25 bp, Rattus norvegicus
aggtcccccagctggagcgcacagg

SEQ ID NO: 540409 - DNA, 25 bp, Rattus norvegicus
ttctcccaaagcgttgaccaacagc

SEQ ID NO: 540410 - DNA, 25 bp, Rattus norvegicus
aagcgttgaccaacagcgaccgcga

SEQ ID NO: 540411 - DNA, 25 bp, Rattus norvegicus
ctgtcgcagcgcagtccaccgtccc

SEQ ID NO: 540412 - DNA, 25 bp, Rattus norvegicus
agcggagtgaggtcatccgcagccc

SEQ ID NO: 540413 - DNA, 25 bp, Rattus norvegicus
tgactgctcctcgatcggtctctgg

SEQ ID NO: 540414 - DNA, 25 bp, Rattus norvegicus
cccatcgcctcgaggggatggtatt

SEQ ID NO: 540415 - DNA, 25 bp, Rattus norvegicus
ccgctggactgtaaggagactgatt

SEQ ID NO: 540416 - DNA, 25 bp, Rattus norvegicus
tgccttctccaacccggttcttgaa

SEQ ID NO: 540417 - DNA, 25 bp, Rattus norvegicus
gggtgtgttctgtcctctttgcaaa

SEQ ID NO: 540418 - DNA, 25 bp, Rattus norvegicus
cctcactctctttcgcgaaggggtg

SEQ ID NO: 540419 - DNA, 25 bp, Rattus norvegicus
gacagacttagctgcgcgtctcagg

SEQ ID NO: 540420 - DNA, 25 bp, Rattus norvegicus
aggctgcaactttccaccgagcgca

SEQ ID NO: 540421 - DNA, 25 bp, Rattus norvegicus
ctcccgtgagggattgtcaaccggt

SEQ ID NO: 540422 - DNA, 25 bp, Rattus norvegicus
cctgcgtgtccagaggatgctattc

SEQ ID NO: 540423 - DNA, 25 bp, Rattus norvegicus
tcaccgatcggtgcagacagactta

SEQ ID NO: 540424 - DNA, 25 bp, Rattus norvegicus
ccgcgctcttttgtgtgtctgctgc

SEQ ID NO: 540425 - DNA, 25 bp, Rattus norvegicus
gaggatgctattccgcctgccactc

SEQ ID NO: 540426 - DNA, 25 bp, Rattus norvegicus
tgtctgctgcgtgaaagtgactgcg

SEQ ID NO: 540427 - DNA, 25 bp, Rattus norvegicus
agcgactcaccttcagctcgaagta

SEQ ID NO: 540428 - DNA, 25 bp, Rattus norvegicus
aaggcacagccactatcctcgggga

SEQ ID NO: 540429 - DNA, 25 bp, Rattus norvegicus
cccagctctgaaggcgacagttgtg

SEQ ID NO: 540430 - DNA, 25 bp, Rattus norvegicus
cccaggacaagacgacggtgaagac

SEQ ID NO: 540431 - DNA, 25 bp, Rattus norvegicus
gtctaggccacctcctgagggtctt

SEQ ID NO: 540432 - DNA, 25 bp, Rattus norvegicus
gaggagttctgcgttgccaagcacc

SEQ ID NO: 540433 - DNA, 25 bp, Rattus norvegicus
cgcgaaggcctagctctctgcagag

SEQ ID NO: 540434 - DNA, 25 bp, Rattus norvegicus
cagagcctctttggtctgcctgagg

SEQ ID NO: 540435 - DNA, 25 bp, Rattus norvegicus
tcatccaccgcctggagaaggctgc

SEQ ID NO: 540436 - DNA, 25 bp, Rattus norvegicus
ggctagccaggcctacttgcgccta

SEQ ID NO: 540437 - DNA, 25 bp, Rattus norvegicus
gcctagtcagcactggctagtggtg

SEQ ID NO: 540438 - DNA, 25 bp, Rattus norvegicus
caccgaggagccaggtggcaacata

SEQ ID NO: 540439 - DNA, 25 bp, Rattus norvegicus
ggacgtgttgcgcacttaccgccct

SEQ ID NO: 540440 - DNA, 25 bp, Rattus norvegicus
ggccgcgaacttgaacagcatcatc

SEQ ID NO: 540441 - DNA, 25 bp, Rattus norvegicus
gcgccgagctccgtatcccaaagag

SEQ ID NO: 540442 - DNA, 25 bp, Rattus norvegicus
atgcgccaccgggtccgaggatccc

SEQ ID NO: 540443 - DNA, 25 bp, Rattus norvegicus
ctacggcccggagggccatgcgcca

SEQ ID NO: 540444 - DNA, 25 bp, Rattus norvegicus
caccaccggccaccaagggcggagc

SEQ ID NO: 540445 - DNA, 25 bp, Rattus norvegicus
cgagcctcgcagactgcaggccagg

SEQ ID NO: 540446 - DNA, 25 bp, Rattus norvegicus
gagcgcacgagcctcgcagactgca

SEQ ID NO: 540447 - DNA, 25 bp, Rattus norvegicus
gctaagagcgcacgagcctcgcaga

SEQ ID NO: 540448 - DNA, 25 bp, Rattus norvegicus
ggactgctaagagcgcacgagcctc

SEQ ID NO: 540449 - DNA, 25 bp, Rattus norvegicus
gctgctcagactaggaggagggcca

SEQ ID NO: 540450 - DNA, 25 bp, Rattus norvegicus
gctccgtatcccaaagagggagaga

SEQ ID NO: 540451 - DNA, 25 bp, Rattus norvegicus
gccgaagctgcgcgcctgtaggtac

SEQ ID NO: 540452 - DNA, 25 bp, Rattus norvegicus
tctgggatcagagcgcgccgagctc

SEQ ID NO: 540453 - DNA, 25 bp, Rattus norvegicus
cccgggactgctaagagcgcacgag

SEQ ID NO: 540454 - DNA, 25 bp, Rattus norvegicus
aaggcgcgcgctgctcagactagga

SEQ ID NO: 540455 - DNA, 25 bp, Rattus norvegicus
tgctgtggacttcgctcacaagttc

SEQ ID NO: 540456 - DNA, 25 bp, Rattus norvegicus
agttctgccgcttccttcgggacaa

SEQ ID NO: 540457 - DNA, 25 bp, Rattus norvegicus
cgccactttgcagccaacttcttgg

SEQ ID NO: 540458 - DNA, 25 bp, Rattus norvegicus
acttcttggcagtcttcagcgagga

SEQ ID NO: 540459 - DNA, 25 bp, Rattus norvegicus
tcggcgctcaagactgcaacctatg

SEQ ID NO: 540460 - DNA, 25 bp, Rattus norvegicus
tctcgcagctccgaagatgtgtctg

SEQ ID NO: 540461 - DNA, 25 bp, Rattus norvegicus
cccgactggaggcaattctgcgagc

SEQ ID NO: 540462 - DNA, 25 bp, Rattus norvegicus
taccaaggcccgtgtccgcaaaggc

SEQ ID NO: 540463 - DNA, 25 bp, Rattus norvegicus
actgcgtaacatgagcctgtgtgta

SEQ ID NO: 540464 - DNA, 25 bp, Rattus norvegicus
tccgagcctcgtgacaaatggacgc

SEQ ID NO: 540465 - DNA, 25 bp, Rattus norvegicus
ccctggcagccaaagtggagttagt

SEQ ID NO: 540466 - DNA, 25 bp, Rattus norvegicus
gaaatgtcgcctgctcctccgaagg

SEQ ID NO: 540467 - DNA, 25 bp, Rattus norvegicus
tgtctgctcacgtggctaccaaggc

SEQ ID NO: 540468 - DNA, 25 bp, Rattus norvegicus
gcgcactgcgcttcatggtggcaga

SEQ ID NO: 540469 - DNA, 25 bp, Rattus norvegicus
gcgcgctcttttgtcgtcatcatga

SEQ ID NO: 540470 - DNA, 25 bp, Rattus norvegicus
gaagctcaagctagagcggctcatg

SEQ ID NO: 540471 - DNA, 25 bp, Rattus norvegicus
aatgcagccgaggagcagaagctca

SEQ ID NO: 540472 - DNA, 25 bp, Rattus norvegicus
cccaagaatgcagccgaggagcaga

SEQ ID NO: 540473 - DNA, 25 bp, Rattus norvegicus
gaaagagccgcagaccctcgtcatc

SEQ ID NO: 540474 - DNA, 25 bp, Rattus norvegicus
cccaggcccaagaaagagccgcaga

SEQ ID NO: 540475 - DNA, 25 bp, Rattus norvegicus
ttagaccgcccaggcccaagaaaga

SEQ ID NO: 540476 - DNA, 25 bp, Rattus norvegicus
tgccacttctgttagaccgcccagg

SEQ ID NO: 540477 - DNA, 25 bp, Rattus norvegicus
gagtcccgctgccacttctgttaga

SEQ ID NO: 540478 - DNA, 25 bp, Rattus norvegicus
catcatgacgcgtggccgtcggaaa

SEQ ID NO: 540479 - DNA, 25 bp, Rattus norvegicus
cttacttccggagagagagtgcgca

SEQ ID NO: 540480 - DNA, 25 bp, Rattus norvegicus
gtaccgcctcttacttccggagaga

SEQ ID NO: 540481 - DNA, 25 bp, Rattus norvegicus
cggctcatgaagaacccggtaagtg

SEQ ID NO: 540482 - DNA, 25 bp, Rattus norvegicus
ggaaagctgatatggcgagtcccgc

SEQ ID NO: 540483 - DNA, 25 bp, Rattus norvegicus
caagcgcgctgagggctagccagcc

SEQ ID NO: 540484 - DNA, 25 bp, Rattus norvegicus
acacagacgctagccacgagccgga

SEQ ID NO: 540485 - DNA, 25 bp, Rattus norvegicus
cccacggatgggtcacgtgacggcg

SEQ ID NO: 540486 - DNA, 25 bp, Rattus norvegicus
cacggatgggtcacgtgacggcggc

SEQ ID NO: 540487 - DNA, 25 bp, Rattus norvegicus
gtgacggcggcgcagcgttgcctag

SEQ ID NO: 540488 - DNA, 25 bp, Rattus norvegicus
cgcagcgttgcctaggcagcggctg

SEQ ID NO: 540489 - DNA, 25 bp, Rattus norvegicus
tgagggctagccagccagggtgagt

SEQ ID NO: 540490 - DNA, 25 bp, Rattus norvegicus
cagacgctagccacgagccggagcg

SEQ ID NO: 540491 - DNA, 25 bp, Rattus norvegicus
gagcggagaactggagccaagcgcg

SEQ ID NO: 540492 - DNA, 25 bp, Rattus norvegicus
ccggagcggagaactggagccaagc

SEQ ID NO: 540493 - DNA, 25 bp, Rattus norvegicus
agccggagcggagaactggagccaa

SEQ ID NO: 540494 - DNA, 25 bp, Rattus norvegicus
gacacagacgctagccacgagccgg

SEQ ID NO: 540495 - DNA, 25 bp, Rattus norvegicus
acagacgctagccacgagccggagc

SEQ ID NO: 540496 - DNA, 25 bp, Rattus norvegicus
ggcgagagcgtccatctgcgtctcg

SEQ ID NO: 540497 - DNA, 25 bp, Rattus norvegicus
ctcctgcaacgtgggcgacccaaga

SEQ ID NO: 540498 - DNA, 25 bp, Rattus norvegicus
cagtgaacctggagcgaacgccttt

SEQ ID NO: 540499 - DNA, 25 bp, Rattus norvegicus
ctggagtcgtctctcgcagatgaga

SEQ ID NO: 540500 - DNA, 25 bp, Rattus norvegicus
aggtccggatacctttacagccgca

SEQ ID NO: 540501 - DNA, 25 bp, Rattus norvegicus
cagccgcactcctgcaaatgagaaa

SEQ ID NO: 540502 - DNA, 25 bp, Rattus norvegicus
gccattgcaccctcggagcagctag

SEQ ID NO: 540503 - DNA, 25 bp, Rattus norvegicus
agttgtagtcctcgcacgcagaagc

SEQ ID NO: 540504 - DNA, 25 bp, Rattus norvegicus
ctcaaagggtttgttgtgcgccacc

SEQ ID NO: 540505 - DNA, 25 bp, Rattus norvegicus
cggccttagtgaccagacttcgtgg

SEQ ID NO: 540506 - DNA, 25 bp, Rattus norvegicus
tgggcggaatgcaagactcagactc

SEQ ID NO: 540507 - DNA, 25 bp, Rattus norvegicus
ttcgggccctagtcgaatctctatc

SEQ ID NO: 540508 - DNA, 25 bp, Rattus norvegicus
tattctgttatctggggttcgggcc

SEQ ID NO: 540509 - DNA, 25 bp, Rattus norvegicus
atgcgggagattagcagccacatcc

SEQ ID NO: 540510 - DNA, 25 bp, Rattus norvegicus
gaatctctatctcgcgcctaacgga

SEQ ID NO: 540511 - DNA, 25 bp, Rattus norvegicus
ctgcgcagctacatcaccgatgaca

SEQ ID NO: 540512 - DNA, 25 bp, Rattus norvegicus
gtggccgctctggaaccaggtatcc

SEQ ID NO: 540513 - DNA, 25 bp, Rattus norvegicus
ttccaggctggcagttcggctctgc

SEQ ID NO: 540514 - DNA, 25 bp, Rattus norvegicus
tgaaccatcgtttgggctcgccttc

SEQ ID NO: 540515 - DNA, 25 bp, Rattus norvegicus
tcgccttccaggctggcagttcggc

SEQ ID NO: 540516 - DNA, 25 bp, Rattus norvegicus
ggttacgtcatcgccctgcgcagct

SEQ ID NO: 540517 - DNA, 25 bp, Rattus norvegicus
accgtggggacctcattaggctgct

SEQ ID NO: 540518 - DNA, 25 bp, Rattus norvegicus
cagtttccaccgtggggacctcatt

SEQ ID NO: 540519 - DNA, 25 bp, Rattus norvegicus
cagtctcctcagtttccaccgtggg

SEQ ID NO: 540520 - DNA, 25 bp, Rattus norvegicus
ccgatgacaacagtctcctcagttt

SEQ ID NO: 540521 - DNA, 25 bp, Rattus norvegicus
tgggtgaaccatcgtttgggctcgc

SEQ ID NO: 540522 - DNA, 25 bp, Rattus norvegicus
agctacatcaccgatgacaacagtc

SEQ ID NO: 540523 - DNA, 25 bp, Rattus norvegicus
acctcattaggctgctgccggtggc

SEQ ID NO: 540524 - DNA, 25 bp, Rattus norvegicus
atcgtttgggctcgccttccaggct

SEQ ID NO: 540525 - DNA, 25 bp, Rattus norvegicus
cgttcatcctagcaaggcgctctca

SEQ ID NO: 540526 - DNA, 25 bp, Rattus norvegicus
cacttgttactgtctccgtttcacc

SEQ ID NO: 540527 - DNA, 25 bp, Rattus norvegicus
gcgccgggacttataccacttgtta

SEQ ID NO: 540528 - DNA, 25 bp, Rattus norvegicus
gcgcatactccagcgccgggactta

SEQ ID NO: 540529 - DNA, 25 bp, Rattus norvegicus
ctgtctgagtgtcttggcgcatact

SEQ ID NO: 540530 - DNA, 25 bp, Rattus norvegicus
tgcgtcagtctagaagccctgtctg

SEQ ID NO: 540531 - DNA, 25 bp, Rattus norvegicus
tcagagtaagcacctggccctgcgc

SEQ ID NO: 540532 - DNA, 25 bp, Rattus norvegicus
agcgcgaccacttccgggttactca

SEQ ID NO: 540533 - DNA, 25 bp, Rattus norvegicus
cgccctcgaagagcaagaacgactc

SEQ ID NO: 540534 - DNA, 25 bp, Rattus norvegicus
ggccggcaggctcctatacaaccgt

SEQ ID NO: 540535 - DNA, 25 bp, Rattus norvegicus
caactcggcgctttgctgaagctga

SEQ ID NO: 540536 - DNA, 25 bp, Rattus norvegicus
aataggagtcccagtggctgccgct

SEQ ID NO: 540537 - DNA, 25 bp, Rattus norvegicus
ccgtttcaccgactgaatgggaata

SEQ ID NO: 540538 - DNA, 25 bp, Rattus norvegicus
tcagcctcagccattcagagtaagc

SEQ ID NO: 540539 - DNA, 25 bp, Rattus norvegicus
gactaaagacagtcgcgcggtccta

SEQ ID NO: 540540 - DNA, 25 bp, Rattus norvegicus
acgcgacgcccagattcaaggattg

SEQ ID NO: 540541 - DNA, 25 bp, Rattus norvegicus
tagaagcattctgcccggggtagga

SEQ ID NO: 540542 - DNA, 25 bp, Rattus norvegicus
ccaggttccagaagccgaatgccca

SEQ ID NO: 540543 - DNA, 25 bp, Rattus norvegicus
catctccctgcactggactggagcg

SEQ ID NO: 540544 - DNA, 25 bp, Rattus norvegicus
ctcgtcacctgaagtcgcggagccg

SEQ ID NO: 540545 - DNA, 25 bp, Rattus norvegicus
aaaccctccggcatcagctgacatg

SEQ ID NO: 540546 - DNA, 25 bp, Rattus norvegicus
catcagctgacatgcgccgcggtca

SEQ ID NO: 540547 - DNA, 25 bp, Rattus norvegicus
cgcctgggtcgaacacgtgacaagc

SEQ ID NO: 540548 - DNA, 25 bp, Rattus norvegicus
cacgtgacaagcttgacgctgtcta

SEQ ID NO: 540549 - DNA, 25 bp, Rattus norvegicus
ggcagaacctcccagcagtgcgcat

SEQ ID NO: 540550 - DNA, 25 bp, Rattus norvegicus
tggcctctcgaggactaaagacagt

SEQ ID NO: 540551 - DNA, 25 bp, Rattus norvegicus
ccgcccaaggtcaggtatgtcgatg

SEQ ID NO: 540552 - DNA, 25 bp, Rattus norvegicus
catgcgtccatagctggcctctcga

SEQ ID NO: 540553 - DNA, 25 bp, Rattus norvegicus
ttcattggccgcctgaagtgaggag

SEQ ID NO: 540554 - DNA, 25 bp, Rattus norvegicus
ccttcccgaggtgtagcggatagta

SEQ ID NO: 540555 - DNA, 25 bp, Rattus norvegicus
gcaaaggtcgcgtatataaaaagga

SEQ ID NO: 540556 - DNA, 25 bp, Rattus norvegicus
ctactcgctactcacatgtccttgg

SEQ ID NO: 540557 - DNA, 25 bp, Rattus norvegicus
ctcacatgtccttggcgggcagatt

SEQ ID NO: 540558 - DNA, 25 bp, Rattus norvegicus
gcgggcagatttttcccttctacga

SEQ ID NO: 540559 - DNA, 25 bp, Rattus norvegicus
cccttctacgattcggatggacagc

SEQ ID NO: 540560 - DNA, 25 bp, Rattus norvegicus
ttcggatggacagcgaactgcgctt

SEQ ID NO: 540561 - DNA, 25 bp, Rattus norvegicus
cgaactgcgcttggccattgcgggt

SEQ ID NO: 540562 - DNA, 25 bp, Rattus norvegicus
gagggatctccgctactccattcac

SEQ ID NO: 540563 - DNA, 25 bp, Rattus norvegicus
agaaccaatcagaaggctggctttc

SEQ ID NO: 540564 - DNA, 25 bp, Rattus norvegicus
tcagaaggctggctttcccagagtg

SEQ ID NO: 540565 - DNA, 25 bp, Rattus norvegicus
gcctgtgaggctcgcgtccttcatt

SEQ ID NO: 540566 - DNA, 25 bp, Rattus norvegicus
tcccgaggtgtagcggatagtaccc

SEQ ID NO: 540567 - DNA, 25 bp, Rattus norvegicus
ccgctcaccgagtctgagggaagca

SEQ ID NO: 540568 - DNA, 25 bp, Rattus norvegicus
ttcaggaccctagcctgggcgccag

SEQ ID NO: 540569 - DNA, 25 bp, Rattus norvegicus
ccgacctccgggctcagctccggct

SEQ ID NO: 540570 - DNA, 25 bp, Rattus norvegicus
aggactcacccaacccgccggcacg

SEQ ID NO: 540571 - DNA, 25 bp, Rattus norvegicus
cttccggtctcagcttggctcaata

SEQ ID NO: 540572 - DNA, 25 bp, Rattus norvegicus
cggtctcagcttggctcaatagccc

SEQ ID NO: 540573 - DNA, 25 bp, Rattus norvegicus
caactgcgacttcccgcctccagga

SEQ ID NO: 540574 - DNA, 25 bp, Rattus norvegicus
aacaggttgagaggagcgccgacct

SEQ ID NO: 540575 - DNA, 25 bp, Rattus norvegicus
ccgagtatatctccgactccgagca

SEQ ID NO: 540576 - DNA, 25 bp, Rattus norvegicus
agtatatctccgactccgagcagga

SEQ ID NO: 540577 - DNA, 25 bp, Rattus norvegicus
ccggagtgaaactcggcgtcgcagc

SEQ ID NO: 540578 - DNA, 25 bp, Rattus norvegicus
gaaactcggcgtcgcagcctccaag

SEQ ID NO: 540579 - DNA, 25 bp, Rattus norvegicus
tccaagcgccgcgttgcgcatgtcc

SEQ ID NO: 540580 - DNA, 25 bp, Rattus norvegicus
aacgctcagagcgtcccaactgcga

SEQ ID NO: 540581 - DNA, 25 bp, Rattus norvegicus
acaacgttcactgcgaaggcgggga

SEQ ID NO: 540582 - DNA, 25 bp, Rattus norvegicus
ctggcagcctgccagagcctaggct

SEQ ID NO: 540583 - DNA, 25 bp, Rattus norvegicus
tggctgccaccactaacgccttttt

SEQ ID NO: 540584 - DNA, 25 bp, Rattus norvegicus
tgctggacaacgttcactgcgaagg

SEQ ID NO: 540585 - DNA, 25 bp, Rattus norvegicus
tatcctgctggacaacgttcactgc

SEQ ID NO: 540586 - DNA, 25 bp, Rattus norvegicus
accgggcatatcctgctggacaacg

SEQ ID NO: 540587 - DNA, 25 bp, Rattus norvegicus
tttcggctacggtaccgggcatatc

SEQ ID NO: 540588 - DNA, 25 bp, Rattus norvegicus
cggatgctgctgttgtgtgccgcca

SEQ ID NO: 540589 - DNA, 25 bp, Rattus norvegicus
cctctggggcactgtatgcgacgat

SEQ ID NO: 540590 - DNA, 25 bp, Rattus norvegicus
attctgcacggtggcctctggggca

SEQ ID NO: 540591 - DNA, 25 bp, Rattus norvegicus
agtggagattctgcacggtggcctc

SEQ ID NO: 540592 - DNA, 25 bp, Rattus norvegicus
gtgccagcccgtgtcaaggccgagt

SEQ ID NO: 540593 - DNA, 25 bp, Rattus norvegicus
gggcgtgcacaactgcggacaccac

SEQ ID NO: 540594 - DNA, 25 bp, Rattus norvegicus
tcaaggccgagtggagattctgcac

SEQ ID NO: 540595 - DNA, 25 bp, Rattus norvegicus
acaacgtaggctgcaccggtaccga

SEQ ID NO: 540596 - DNA, 25 bp, Rattus norvegicus
cggggcccgacgaataggaaatatg

SEQ ID NO: 540597 - DNA, 25 bp, Rattus norvegicus
ggctgcaataaggagcccgctgccc

SEQ ID NO: 540598 - DNA, 25 bp, Rattus norvegicus
gggcatccaccctagcactggcctg

SEQ ID NO: 540599 - DNA, 25 bp, Rattus norvegicus
acgatgactgggacttcgcggacgc

SEQ ID NO: 540600 - DNA, 25 bp, Rattus norvegicus
ccacgggccttggtcattttggcta

SEQ ID NO: 540601 - DNA, 25 bp, Rattus norvegicus
cattttggctatggccgaggccctg

SEQ ID NO: 540602 - DNA, 25 bp, Rattus norvegicus
ccgaggccctgtgctgctggacaac

SEQ ID NO: 540603 - DNA, 25 bp, Rattus norvegicus
gctgctggacaacgtaggctgcacc

SEQ ID NO: 540604 - DNA, 25 bp, Rattus norvegicus
taggctgcaccggtaccgaagcccg

SEQ ID NO: 540605 - DNA, 25 bp, Rattus norvegicus
agcgactgcttccatctgggctggg

SEQ ID NO: 540606 - DNA, 25 bp, Rattus norvegicus
cacaattgcggccaccacgaagacg

SEQ ID NO: 540607 - DNA, 25 bp, Rattus norvegicus
gcctcagcgactgcttccatctggg

SEQ ID NO: 540608 - DNA, 25 bp, Rattus norvegicus
gcggccaccacgaagacgctggagc

SEQ ID NO: 540609 - DNA, 25 bp, Rattus norvegicus
tgtcacgactgtagggtcacctcca

SEQ ID NO: 540610 - DNA, 25 bp, Rattus norvegicus
aggagcaaccgcgaatgttccaata

SEQ ID NO: 540611 - DNA, 25 bp, Rattus norvegicus
tccatctcactccttggagggattg

SEQ ID NO: 540612 - DNA, 25 bp, Rattus norvegicus
ctcaggggcatgtcttgtcacgact

SEQ ID NO: 540613 - DNA, 25 bp, Rattus norvegicus
agacaccgcgttccaccgcgtggaa

SEQ ID NO: 540614 - DNA, 25 bp, Rattus norvegicus
cggccatgaagaacgtgagtgtctc

SEQ ID NO: 540615 - DNA, 25 bp, Rattus norvegicus
cgctacgacgatatggccgcggcca

SEQ ID NO: 540616 - DNA, 25 bp, Rattus norvegicus
actagtgcagaaagcccggctggcc

SEQ ID NO: 540617 - DNA, 25 bp, Rattus norvegicus
tggaccgcgagcaactagtgcagaa

SEQ ID NO: 540618 - DNA, 25 bp, Rattus norvegicus
ttcgtgggtcggtccttccgacaca

SEQ ID NO: 540619 - DNA, 25 bp, Rattus norvegicus
tcgtcctcgccttagcagcttgctt

SEQ ID NO: 540620 - DNA, 25 bp, Rattus norvegicus
ttttacgtcactcgtgtgggcggga

SEQ ID NO: 540621 - DNA, 25 bp, Rattus norvegicus
cctagtaagtggctcctgtacccga

SEQ ID NO: 540622 - DNA, 25 bp, Rattus norvegicus
cgcgaatgggaggtgacttttacgt

SEQ ID NO: 540623 - DNA, 25 bp, Rattus norvegicus
ccacgagatcagcaaggagcacatg

SEQ ID NO: 540624 - DNA, 25 bp, Rattus norvegicus
gcctacagcgaagcccacgagatca

SEQ ID NO: 540625 - DNA, 25 bp, Rattus norvegicus
attaccgctacctggccgaagtggc

SEQ ID NO: 540626 - DNA, 25 bp, Rattus norvegicus
cccagtacgagagcaaggtgttcta

SEQ ID NO: 540627 - DNA, 25 bp, Rattus norvegicus
tggacaactacctgatcaagaactg

SEQ ID NO: 540628 - DNA, 25 bp, Rattus norvegicus
acctggccaagaccgccttcgatga

SEQ ID NO: 540629 - DNA, 25 bp, Rattus norvegicus
cgagcctaccgggaaaagattgaga

SEQ ID NO: 540630 - DNA, 25 bp, Rattus norvegicus
tgctccgagacaacctaacgctctg

SEQ ID NO: 540631 - DNA, 25 bp, Rattus norvegicus
ctctgatcatgcagctgctccgaga

SEQ ID NO: 540632 - DNA, 25 bp, Rattus norvegicus
tcgacactctgaacgaggactccta

SEQ ID NO: 540633 - DNA, 25 bp, Rattus norvegicus
tcctcctggagggtcatcagcagca

SEQ ID NO: 540634 - DNA, 25 bp, Rattus norvegicus
gcctggcgctcaactactccgtttt

SEQ ID NO: 540635 - DNA, 25 bp, Rattus norvegicus
acctcctgtcggtggcctacaagaa

SEQ ID NO: 540636 - DNA, 25 bp, Rattus norvegicus
ctacaagaacgtggttggggctcgc

SEQ ID NO: 540637 - DNA, 25 bp, Rattus norvegicus
cagcgatcggccgtctgtcggatct

SEQ ID NO: 540638 - DNA, 25 bp, Rattus norvegicus
cggatctctgagacaccgctgctga

SEQ ID NO: 540639 - DNA, 25 bp, Rattus norvegicus
taccagtcccggaacggctcccagc

SEQ ID NO: 540640 - DNA, 25 bp, Rattus norvegicus
cccgaaagcttgatcgaagaggcgg

SEQ ID NO: 540641 - DNA, 25 bp, Rattus norvegicus
ctgagaccactcatcgggaaaccga

SEQ ID NO: 540642 - DNA, 25 bp, Rattus norvegicus
gcggagctgaaccactgagaccact

SEQ ID NO: 540643 - DNA, 25 bp, Rattus norvegicus
gccaaccagcggagctgaaccactg

SEQ ID NO: 540644 - DNA, 25 bp, Rattus norvegicus
acatagccgggccaaccagcggagc

SEQ ID NO: 540645 - DNA, 25 bp, Rattus norvegicus
cagagggcgcacatagccgggccaa

SEQ ID NO: 540646 - DNA, 25 bp, Rattus norvegicus
aagtggttgacgtccagggacacgc

SEQ ID NO: 540647 - DNA, 25 bp, Rattus norvegicus
tctgagacaccgctgctgagttgcc

SEQ ID NO: 540648 - DNA, 25 bp, Rattus norvegicus
ggccgtctgtcggatctctgagaca

SEQ ID NO: 540649 - DNA, 25 bp, Rattus norvegicus
acgtccagggacacgcgccagcgat

SEQ ID NO: 540650 - DNA, 25 bp, Rattus norvegicus
acaccgctgctgagttgccggttga

SEQ ID NO: 540651 - DNA, 25 bp, Rattus norvegicus
ggggactctggctgtccttcccacg

SEQ ID NO: 540652 - DNA, 25 bp, Rattus norvegicus
ggcggtagagatccatgaggccacc

SEQ ID NO: 540653 - DNA, 25 bp, Rattus norvegicus
tcaccgttttccgtgtccgccgtga

SEQ ID NO: 540654 - DNA, 25 bp, Rattus norvegicus
tctgaactctaagtccgggatcttc

SEQ ID NO: 540655 - DNA, 25 bp, Rattus norvegicus
cacactattcccgttgggacactta

SEQ ID NO: 540656 - DNA, 25 bp, Rattus norvegicus
cacttaccggccaagaggtttcttg

SEQ ID NO: 540657 - DNA, 25 bp, Rattus norvegicus
cggctggagctccacgacccgggat

SEQ ID NO: 540658 - DNA, 25 bp, Rattus norvegicus
acgctcctgtgcagtgcaggcagga

SEQ ID NO: 540659 - DNA, 25 bp, Rattus norvegicus
gcctggcacggccttcgctgtcttt

SEQ ID NO: 540660 - DNA, 25 bp, Rattus norvegicus
ttgtccctgtgggatccagcatggt

SEQ ID NO: 540661 - DNA, 25 bp, Rattus norvegicus
attagtgaagggacgctcctgtgca

SEQ ID NO: 540662 - DNA, 25 bp, Rattus norvegicus
gaccaatgaggtcactgttttgggg

SEQ ID NO: 540663 - DNA, 25 bp, Rattus norvegicus
gggattccatgtggggttattaaca

SEQ ID NO: 540664 - DNA, 25 bp, Rattus norvegicus
aatggggcgccaaagagacaaattg

SEQ ID NO: 540665 - DNA, 25 bp, Rattus norvegicus
gctcgccgccgcaccgcgatccgcc

SEQ ID NO: 540666 - DNA, 25 bp, Rattus norvegicus
tctgtcagcccagccggattctccc

SEQ ID NO: 540667 - DNA, 25 bp, Rattus norvegicus
tgctggtgttcgttggctgcccgaa

SEQ ID NO: 540668 - DNA, 25 bp, Rattus norvegicus
ggggaacaatccaccagtcttcggc

SEQ ID NO: 540669 - DNA, 25 bp, Rattus norvegicus
taagctgctggtgttcgttggctgc

SEQ ID NO: 540670 - DNA, 25 bp, Rattus norvegicus
ggaacaatccaccagtcttcggcgg

SEQ ID NO: 540671 - DNA, 25 bp, Rattus norvegicus
aacaatccaccagtcttcggcggca

SEQ ID NO: 540672 - DNA, 25 bp, Rattus norvegicus
gcgtctctgtcagcccagccggatt

SEQ ID NO: 540673 - DNA, 25 bp, Rattus norvegicus
aatccaccagtcttcggcggcagag

SEQ ID NO: 540674 - DNA, 25 bp, Rattus norvegicus
gtgtggcgtctctgtcagcccagcc

SEQ ID NO: 540675 - DNA, 25 bp, Rattus norvegicus
gcggtgtggcgtctctgtcagccca

SEQ ID NO: 540676 - DNA, 25 bp, Rattus norvegicus
caaggcggccactcccgtgctcgcc

SEQ ID NO: 540677 - DNA, 25 bp, Rattus norvegicus
ccctaagctgctggtgttcgttggc

SEQ ID NO: 540678 - DNA, 25 bp, Rattus norvegicus
tccaccagtcttcggcggcagagga

SEQ ID NO: 540679 - DNA, 25 bp, Rattus norvegicus
cgtgtgggacccatcatgctcagct

SEQ ID NO: 540680 - DNA, 25 bp, Rattus norvegicus
ctcaaagttattgggatgggatggt

SEQ ID NO: 540681 - DNA, 25 bp, Rattus norvegicus
atcatgctcagctcaaagttattgg

SEQ ID NO: 540682 - DNA, 25 bp, Rattus norvegicus
tcagcttccgaagccggggatacag

SEQ ID NO: 540683 - DNA, 25 bp, Rattus norvegicus
ctgcagctgttatctcagcttccga

SEQ ID NO: 540684 - DNA, 25 bp, Rattus norvegicus
atctggctccagtctgcagctgtta

SEQ ID NO: 540685 - DNA, 25 bp, Rattus norvegicus
tcattaaatgtaaaagtgggcagtg

SEQ ID NO: 540686 - DNA, 25 bp, Rattus norvegicus
ctggcagagaactcatcacccaatc

SEQ ID NO: 540687 - DNA, 25 bp, Rattus norvegicus
tgagacacggtcaaaaagccgtttg

SEQ ID NO: 540688 - DNA, 25 bp, Rattus norvegicus
aagccgtttggaagagatttctcca

SEQ ID NO: 540689 - DNA, 25 bp, Rattus norvegicus
ttgacttgttgggtttttgaggctg

SEQ ID NO: 540690 - DNA, 25 bp, Rattus norvegicus
agatttctccacttgcctcatttca

SEQ ID NO: 540691 - DNA, 25 bp, Rattus norvegicus
aggctggatctcattgtgtagctca

SEQ ID NO: 540692 - DNA, 25 bp, Rattus norvegicus
gagaactcatcacccaatctggctc

SEQ ID NO: 540693 - DNA, 25 bp, Rattus norvegicus
tgcctgctgcctccgttctgctggg

SEQ ID NO: 540694 - DNA, 25 bp, Rattus norvegicus
gctgcctccgttctgctggggcgac

SEQ ID NO: 540695 - DNA, 25 bp, Rattus norvegicus
cgctggatcgctggctgcctgtctt

SEQ ID NO: 540696 - DNA, 25 bp, Rattus norvegicus
tggctgcctgtcttccgtccgtcat

SEQ ID NO: 540697 - DNA, 25 bp, Rattus norvegicus
tcgcgctttcacagtgagagcgccc

SEQ ID NO: 540698 - DNA, 25 bp, Rattus norvegicus
cctctgctagtgacctggttcccaa

SEQ ID NO: 540699 - DNA, 25 bp, Rattus norvegicus
caactcgcgctttcacagtgagagc

SEQ ID NO: 540700 - DNA, 25 bp, Rattus norvegicus
caagcgtacgtacatcgggcgggct

SEQ ID NO: 540701 - DNA, 25 bp, Rattus norvegicus
tcatctcgatgcttggggctcagcc

SEQ ID NO: 540702 - DNA, 25 bp, Rattus norvegicus
tgtcttccgtccgtcatctcgatgc

SEQ ID NO: 540703 - DNA, 25 bp, Rattus norvegicus
tggttcccaactcgcgctttcacag

SEQ ID NO: 540704 - DNA, 25 bp, Rattus norvegicus
gggcaagagatgtggcgaaccctcc

SEQ ID NO: 540705 - DNA, 25 bp, Rattus norvegicus
agatgtggcgaaccctccgcaaagc

SEQ ID NO: 540706 - DNA, 25 bp, Rattus norvegicus
ctccgcaaagccaagcgtacgtaca

SEQ ID NO: 540707 - DNA, 25 bp, Rattus norvegicus
cattcgtcgcggagtctctgccacg

SEQ ID NO: 540708 - DNA, 25 bp, Rattus norvegicus
tgtaaccccggtgcccgcggtagca

SEQ ID NO: 540709 - DNA, 25 bp, Rattus norvegicus
caggcgacggggcagtcgcaatcaa

SEQ ID NO: 540710 - DNA, 25 bp, Rattus norvegicus
cgacggggcagtcgcaatcaaccgg

SEQ ID NO: 540711 - DNA, 25 bp, Rattus norvegicus
ggcagtcgcaatcaaccgggccatc

SEQ ID NO: 540712 - DNA, 25 bp, Rattus norvegicus
agtcgcaatcaaccgggccatcgtc

SEQ ID NO: 540713 - DNA, 25 bp, Rattus norvegicus
catcgtcctcatcgaagggtgggta

SEQ ID NO: 540714 - DNA, 25 bp, Rattus norvegicus
cgtcctcatcgaagggtgggtactc

SEQ ID NO: 540715 - DNA, 25 bp, Rattus norvegicus
cctcatcgaagggtgggtactccag

SEQ ID NO: 540716 - DNA, 25 bp, Rattus norvegicus
aagccctccattcgtcgcggagtct

SEQ ID NO: 540717 - DNA, 25 bp, Rattus norvegicus
gtcgcggagtctctgccacgctacg

SEQ ID NO: 540718 - DNA, 25 bp, Rattus norvegicus
tgccacgctacggaaagacagagac

SEQ ID NO: 540719 - DNA, 25 bp, Rattus norvegicus
gccacgctacggaaagacagagacg

SEQ ID NO: 540720 - DNA, 25 bp, Rattus norvegicus
tcatcgaagggtgggtactccaggc

SEQ ID NO: 540721 - DNA, 25 bp, Rattus norvegicus
agttggagctctgcccaaaggcctt

SEQ ID NO: 540722 - DNA, 25 bp, Rattus norvegicus
caggtgtttaaggagcgcagagccc

SEQ ID NO: 540723 - DNA, 25 bp, Rattus norvegicus
gcaacgctgagctctgcccaaaggc

SEQ ID NO: 540724 - DNA, 25 bp, Rattus norvegicus
gcttgagcagtgtggaccgccagcc

SEQ ID NO: 540725 - DNA, 25 bp, Rattus norvegicus
ccttgccacacacggggcagtggtg

SEQ ID NO: 540726 - DNA, 25 bp, Rattus norvegicus
tgcgctgatgctggagcaacgctga

SEQ ID NO: 540727 - DNA, 25 bp, Rattus norvegicus
gggccagcaacgagccgtgaccgaa

SEQ ID NO: 540728 - DNA, 25 bp, Rattus norvegicus
tgcccaaaggccttggagcagtgtg

SEQ ID NO: 540729 - DNA, 25 bp, Rattus norvegicus
agagccctgcccaaagcctttagca

SEQ ID NO: 540730 - DNA, 25 bp, Rattus norvegicus
aggagtgccgaactctgcccaaagg

SEQ ID NO: 540731 - DNA, 25 bp, Rattus norvegicus
ctcgccagaatgcacgtggaggtgt

SEQ ID NO: 540732 - DNA, 25 bp, Rattus norvegicus
ctgacaacggtaggggcgctcgcca

SEQ ID NO: 540733 - DNA, 25 bp, Rattus norvegicus
gcctttagcacacaccgggcacttg

SEQ ID NO: 540734 - DNA, 25 bp, Rattus norvegicus
agccgtgaccgaaggccttgccaca

SEQ ID NO: 540735 - DNA, 25 bp, Rattus norvegicus
tggtccaggatctcccggtgcgcgc

SEQ ID NO: 540736 - DNA, 25 bp, Rattus norvegicus
ggcatgctggtagccccgttgttca

SEQ ID NO: 540737 - DNA, 25 bp, Rattus norvegicus
ttcacggtggaggacatgacacagg

SEQ ID NO: 540738 - DNA, 25 bp, Rattus norvegicus
ttgttcacggtggaggacatgacac

SEQ ID NO: 540739 - DNA, 25 bp, Rattus norvegicus
ccgttgttcacggtggaggacatga

SEQ ID NO: 540740 - DNA, 25 bp, Rattus norvegicus
cagcgtcgggaggagctggcatgct

SEQ ID NO: 540741 - DNA, 25 bp, Rattus norvegicus
ctgcgggaagccgttggcagcgtcg

SEQ ID NO: 540742 - DNA, 25 bp, Rattus norvegicus
cacggtggaggacatgacacaggtc

SEQ ID NO: 540743 - DNA, 25 bp, Rattus norvegicus
ggtgcgcgcgcttcaccaagcctgg

SEQ ID NO: 540744 - DNA, 25 bp, Rattus norvegicus
ctcgtggtccaggatctcccggtgc

SEQ ID NO: 540745 - DNA, 25 bp, Rattus norvegicus
tggaggacatgacacaggtcctcgg

SEQ ID NO: 540746 - DNA, 25 bp, Rattus norvegicus
ggacatgacacaggtcctcggcggc

SEQ ID NO: 540747 - DNA, 25 bp, Rattus norvegicus
cggtggaggacatgacacaggtcct

SEQ ID NO: 540748 - DNA, 25 bp, Rattus norvegicus
ttcaccaagcctggctcggcggcgc

SEQ ID NO: 540749 - DNA, 25 bp, Rattus norvegicus
cctcagagacagttgctcacagcgc

SEQ ID NO: 540750 - DNA, 25 bp, Rattus norvegicus
atgccgcggatacgagaccagcagg

SEQ ID NO: 540751 - DNA, 25 bp, Rattus norvegicus
ctattcccagcgctgcctatgagcg

SEQ ID NO: 540752 - DNA, 25 bp, Rattus norvegicus
cgggttgtgtctattcccagcgctg

SEQ ID NO: 540753 - DNA, 25 bp, Rattus norvegicus
ggagtacctgatgccgcggatacga

SEQ ID NO: 540754 - DNA, 25 bp, Rattus norvegicus
ctctctgcaggcgtggagtacctga

SEQ ID NO: 540755 - DNA, 25 bp, Rattus norvegicus
tggctagagcgcctcagagacagtt

SEQ ID NO: 540756 - DNA, 25 bp, Rattus norvegicus
gcaccatcatagaggcggcctcctg

SEQ ID NO: 540757 - DNA, 25 bp, Rattus norvegicus
ctggacagcgcaccatcatagaggc

SEQ ID NO: 540758 - DNA, 25 bp, Rattus norvegicus
gtgtctattcccagcgctgcctatg

SEQ ID NO: 540759 - DNA, 25 bp, Rattus norvegicus
ttgctgaaatgctggacagcgcacc

SEQ ID NO: 540760 - DNA, 25 bp, Rattus norvegicus
cgctgccgattgctgaaatgctgga

SEQ ID NO: 540761 - DNA, 25 bp, Rattus norvegicus
gcaagcgccgctgccgattgctgaa

SEQ ID NO: 540762 - DNA, 25 bp, Rattus norvegicus
agcgcctcagagacagttgctcaca

SEQ ID NO: 540763 - DNA, 25 bp, Rattus norvegicus
tctcgcgggaaaagcctgacgtcac

SEQ ID NO: 540764 - DNA, 25 bp, Rattus norvegicus
ccacggtcctgtggtgcgaagaaac

SEQ ID NO: 540765 - DNA, 25 bp, Rattus norvegicus
gtactcgcgttacttggcaacaggc

SEQ ID NO: 540766 - DNA, 25 bp, Rattus norvegicus
gttgagtttccaggcgttgcacaca

SEQ ID NO: 540767 - DNA, 25 bp, Rattus norvegicus
cacggagccaagcttgttgagtttc

SEQ ID NO: 540768 - DNA, 25 bp, Rattus norvegicus
gtcagagccgacctttccacagtta

SEQ ID NO: 540769 - DNA, 25 bp, Rattus norvegicus
tccagacagacgtcctgccgaagtc

SEQ ID NO: 540770 - DNA, 25 bp, Rattus norvegicus
tcacaggcatttggcggagtcttga

SEQ ID NO: 540771 - DNA, 25 bp, Rattus norvegicus
gtcacgcctccctatggtccaaagg

SEQ ID NO: 540772 - DNA, 25 bp, Rattus norvegicus
cggcccacttttcgagttctcgcgg

SEQ ID NO: 540773 - DNA, 25 bp, Rattus norvegicus
tggttctgcggcaccaaatctcgcg

SEQ ID NO: 540774 - DNA, 25 bp, Rattus norvegicus
cagagccacctgatctcgcgataga

SEQ ID NO: 540775 - DNA, 25 bp, Rattus norvegicus
agagtctcgacttcgctttgtcaga

SEQ ID NO: 540776 - DNA, 25 bp, Rattus norvegicus
tttggagatcgtgactcgggctttc

SEQ ID NO: 540777 - DNA, 25 bp, Rattus norvegicus
tcctgtccctggctccgattggctg

SEQ ID NO: 540778 - DNA, 25 bp, Rattus norvegicus
tcgggcagcactaggtcacacatag

SEQ ID NO: 540779 - DNA, 25 bp, Rattus norvegicus
tccaaggtatccaggtgagtgtccc

SEQ ID NO: 540780 - DNA, 25 bp, Rattus norvegicus
taggtcacacatagggtagttcgga

SEQ ID NO: 540781 - DNA, 25 bp, Rattus norvegicus
tctgcagcaggacttccaaggtatc

SEQ ID NO: 540782 - DNA, 25 bp, Rattus norvegicus
gcgcgcagattacgccgggcctttt

SEQ ID NO: 540783 - DNA, 25 bp, Rattus norvegicus
agccacgtctctgtctcggggacaa

SEQ ID NO: 540784 - DNA, 25 bp, Rattus norvegicus
ttctcggttccaggagacgccctgc

SEQ ID NO: 540785 - DNA, 25 bp, Rattus norvegicus
gctggacgcctaaatctgttctcgg

SEQ ID NO: 540786 - DNA, 25 bp, Rattus norvegicus
ctttgctggtaaaatgctggacgcc

SEQ ID NO: 540787 - DNA, 25 bp, Rattus norvegicus
aatggtccgaggaagccgactttgc

SEQ ID NO: 540788 - DNA, 25 bp, Rattus norvegicus
tcttaaatgtccgatggcagcccgg

SEQ ID NO: 540789 - DNA, 25 bp, Rattus norvegicus
ggcgggatctctctctaacgggata

SEQ ID NO: 540790 - DNA, 25 bp, Rattus norvegicus
gtggcgtggacaaagacatgcagtc

SEQ ID NO: 540791 - DNA, 25 bp, Rattus norvegicus
actcggccagacttcgcttcgtact

SEQ ID NO: 540792 - DNA, 25 bp, Rattus norvegicus
tcgcctgctggttccttggcccgaa

SEQ ID NO: 540793 - DNA, 25 bp, Rattus norvegicus
ttggcccgaagccagctagtggcca

SEQ ID NO: 540794 - DNA, 25 bp, Rattus norvegicus
gttcactcggccagacttcgcttcg

SEQ ID NO: 540795 - DNA, 25 bp, Rattus norvegicus
gaactgagatttgcgcacgaacatg

SEQ ID NO: 540796 - DNA, 25 bp, Rattus norvegicus
gtactccacggccacggcacagatg

SEQ ID NO: 540797 - DNA, 25 bp, Rattus norvegicus
cacggcacagatgtgcacggagttg

SEQ ID NO: 540798 - DNA, 25 bp, Rattus norvegicus
actggtgtgagccgggctccaaccc

SEQ ID NO: 540799 - DNA, 25 bp, Rattus norvegicus
ctcctcggcgggtatcccgcgtcca

SEQ ID NO: 540800 - DNA, 25 bp, Rattus norvegicus
gccattctcgcctgctggttccttg

SEQ ID NO: 540801 - DNA, 25 bp, Rattus norvegicus
ggtaccagggcgcggccgccattct

SEQ ID NO: 540802 - DNA, 25 bp, Rattus norvegicus
tgcgcacgaacatgggtaccagggc

SEQ ID NO: 540803 - DNA, 25 bp, Rattus norvegicus
tttgcgcacgaacatgggtaccagg

SEQ ID NO: 540804 - DNA, 25 bp, Rattus norvegicus
cacggccacggcacagatgtgcacg

SEQ ID NO: 540805 - DNA, 25 bp, Rattus norvegicus
tctcgccttccgcaagggtgagtcg

SEQ ID NO: 540806 - DNA, 25 bp, Rattus norvegicus
cctgctgttggtacagccctggtgg

SEQ ID NO: 540807 - DNA, 25 bp, Rattus norvegicus
ccttctaaatccctgctgttggtac

SEQ ID NO: 540808 - DNA, 25 bp, Rattus norvegicus
aggcaggccctctttcttttgctcc

SEQ ID NO: 540809 - DNA, 25 bp, Rattus norvegicus
cgctcttgaggcaggccctctttct

SEQ ID NO: 540810 - DNA, 25 bp, Rattus norvegicus
aggcgtggctaacaccgccgaggtc

SEQ ID NO: 540811 - DNA, 25 bp, Rattus norvegicus
ggcgctaccaccgaccagaaggctg

SEQ ID NO: 540812 - DNA, 25 bp, Rattus norvegicus
cggtcctgtaggtctctgaggcagt

SEQ ID NO: 540813 - DNA, 25 bp, Rattus norvegicus
cacaaaccggatagtcttagcgaca

SEQ ID NO: 540814 - DNA, 25 bp, Rattus norvegicus
gaggtgcgaagtctcgccttccgca

SEQ ID NO: 540815 - DNA, 25 bp, Rattus norvegicus
tcatccgctccacggaaaaggcacg

SEQ ID NO: 540816 - DNA, 25 bp, Rattus norvegicus
cttagcgacaagaggtgacccggta

SEQ ID NO: 540817 - DNA, 25 bp, Rattus norvegicus
aggtgacccggtatcgcggagctcc

SEQ ID NO: 540818 - DNA, 25 bp, Rattus norvegicus
tcgcgcggagatcggcccaaaaacc

SEQ ID NO: 540819 - DNA, 25 bp, Rattus norvegicus
cagggcctcggagcgcagagacagc

SEQ ID NO: 540820 - DNA, 25 bp, Rattus norvegicus
ttcctcggcaatttccgcctccttg

SEQ ID NO: 540821 - DNA, 25 bp, Rattus norvegicus
accttcccgcgtgccgcctcggcac

SEQ ID NO: 540822 - DNA, 25 bp, Rattus norvegicus
gccgcgagaccttcccgcgtgccgc

SEQ ID NO: 540823 - DNA, 25 bp, Rattus norvegicus
cgagcaccagaagcgactcgcgggc

SEQ ID NO: 540824 - DNA, 25 bp, Rattus norvegicus
cgggacacgagcaccagaagcgact

SEQ ID NO: 540825 - DNA, 25 bp, Rattus norvegicus
gcacctcgggacacgagcaccagaa

SEQ ID NO: 540826 - DNA, 25 bp, Rattus norvegicus
ccgacaccagcagcgagagcagggc

SEQ ID NO: 540827 - DNA, 25 bp, Rattus norvegicus
aggaacaggcgtgggcccgacacca

SEQ ID NO: 540828 - DNA, 25 bp, Rattus norvegicus
ctgcaacaggaacaggcgtgggccc

SEQ ID NO: 540829 - DNA, 25 bp, Rattus norvegicus
cgccagaggcggctgcaacaggaac

SEQ ID NO: 540830 - DNA, 25 bp, Rattus norvegicus
tgctcaccttgccagttgcgcaggg

SEQ ID NO: 540831 - DNA, 25 bp, Rattus norvegicus
accttgccagttgcgcagggcctcg

SEQ ID NO: 540832 - DNA, 25 bp, Rattus norvegicus
agggcacctcgggacacgagcacca

SEQ ID NO: 540833 - DNA, 25 bp, Rattus norvegicus
cggctagctccaaagtgccaatcca

SEQ ID NO: 540834 - DNA, 25 bp, Rattus norvegicus
aggttagataagactcgctcgtttc

SEQ ID NO: 540835 - DNA, 25 bp, Rattus norvegicus
attcccttctgtggcacgagactca

SEQ ID NO: 540836 - DNA, 25 bp, Rattus norvegicus
caggtactaggtgagcctcggaacc

SEQ ID NO: 540837 - DNA, 25 bp, Rattus norvegicus
tcggctaccagcctgagaacaggta

SEQ ID NO: 540838 - DNA, 25 bp, Rattus norvegicus
ttccggctaggctacccaatcttga

SEQ ID NO: 540839 - DNA, 25 bp, Rattus norvegicus
ttcgctccaactgccgctgttgatc

SEQ ID NO: 540840 - DNA, 25 bp, Rattus norvegicus
cagcgttcaagaccggctagctcca

SEQ ID NO: 540841 - DNA, 25 bp, Rattus norvegicus
gagactcaccgctgagcgcagtctg

SEQ ID NO: 540842 - DNA, 25 bp, Rattus norvegicus
ttttcttgccgccacaacggagtcc

SEQ ID NO: 540843 - DNA, 25 bp, Rattus norvegicus
aggctctgttggaacctcgaccacg

SEQ ID NO: 540844 - DNA, 25 bp, Rattus norvegicus
tgccggtagcaggtagcttgcttta

SEQ ID NO: 540845 - DNA, 25 bp, Rattus norvegicus
ctcgaccacgccaggttagataaga

SEQ ID NO: 540846 - DNA, 25 bp, Rattus norvegicus
tacccaatcttgagcacagcgttca

SEQ ID NO: 540847 - DNA, 25 bp, Rattus norvegicus
gtcggcgatcctccagaactggcag

SEQ ID NO: 540848 - DNA, 25 bp, Rattus norvegicus
cggaccacactgatgcggagttccc

SEQ ID NO: 540849 - DNA, 25 bp, Rattus norvegicus
gccggaccacactgatgcggagttc

SEQ ID NO: 540850 - DNA, 25 bp, Rattus norvegicus
tcgccggaccacactgatgcggagt

SEQ ID NO: 540851 - DNA, 25 bp, Rattus norvegicus
catcgccggaccacactgatgcgga

SEQ ID NO: 540852 - DNA, 25 bp, Rattus norvegicus
cactaaggccgccatcgccggacca

SEQ ID NO: 540853 - DNA, 25 bp, Rattus norvegicus
tcgagagccactaaggccgccatcg

SEQ ID NO: 540854 - DNA, 25 bp, Rattus norvegicus
ttcgagagccactaaggccgccatc

SEQ ID NO: 540855 - DNA, 25 bp, Rattus norvegicus
gacttcgagagccactaaggccgcc

SEQ ID NO: 540856 - DNA, 25 bp, Rattus norvegicus
ggagacttcgagagccactaaggcc

SEQ ID NO: 540857 - DNA, 25 bp, Rattus norvegicus
aggagacttcgagagccactaaggc

SEQ ID NO: 540858 - DNA, 25 bp, Rattus norvegicus
gggaggagacttcgagagccactaa

SEQ ID NO: 540859 - DNA, 25 bp, Rattus norvegicus
actggcagataggaatgcacgggga

SEQ ID NO: 540860 - DNA, 25 bp, Rattus norvegicus
cggcgatcctccagaactggcagat

SEQ ID NO: 540861 - DNA, 25 bp, Rattus norvegicus
ccagacaacatggaccggatggcca

SEQ ID NO: 540862 - DNA, 25 bp, Rattus norvegicus
gccagctccatgaagcaggtaccca

SEQ ID NO: 540863 - DNA, 25 bp, Rattus norvegicus
caacatggaccggatggccagctcc

SEQ ID NO: 540864 - DNA, 25 bp, Rattus norvegicus
tcacccagacaacatggaccggatg

SEQ ID NO: 540865 - DNA, 25 bp, Rattus norvegicus
tgttcacccagacaacatggaccgg

SEQ ID NO: 540866 - DNA, 25 bp, Rattus norvegicus
tgactctgttcacccagacaacatg

SEQ ID NO: 540867 - DNA, 25 bp, Rattus norvegicus
ggccgagggcccctgactctgttca

SEQ ID NO: 540868 - DNA, 25 bp, Rattus norvegicus
agctccatgaagcaggtacccaacc

SEQ ID NO: 540869 - DNA, 25 bp, Rattus norvegicus
accggatggccagctccatgaagca

SEQ ID NO: 540870 - DNA, 25 bp, Rattus norvegicus
cttcgagcggactcaggtgagattc

SEQ ID NO: 540871 - DNA, 25 bp, Rattus norvegicus
agcgcgagagcttcgagcggactca

SEQ ID NO: 540872 - DNA, 25 bp, Rattus norvegicus
caacccgctgcccaaagtgttgagc

SEQ ID NO: 540873 - DNA, 25 bp, Rattus norvegicus
catgaagcaggtacccaacccgctg

SEQ ID NO: 540874 - DNA, 25 bp, Rattus norvegicus
gatggccagctccatgaagcaggta

SEQ ID NO: 540875 - DNA, 25 bp, Rattus norvegicus
gaatctatcgctgggtgtcctcacc

SEQ ID NO: 540876 - DNA, 25 bp, Rattus norvegicus
ttgttgattcttcctgcctgttggc

SEQ ID NO: 540877 - DNA, 25 bp, Rattus norvegicus
tgaaagttttctggattgttgattc

SEQ ID NO: 540878 - DNA, 25 bp, Rattus norvegicus
gcagcgtgatccattgaaagttttc

SEQ ID NO: 540879 - DNA, 25 bp, Rattus norvegicus
ctaggctgcagcgtgatccattgaa

SEQ ID NO: 540880 - DNA, 25 bp, Rattus norvegicus
ggaagctctatctcggagctccctg

SEQ ID NO: 540881 - DNA, 25 bp, Rattus norvegicus
caagatggtaagtgagagctttgga

SEQ ID NO: 540882 - DNA, 25 bp, Rattus norvegicus
ttcggccatggatgtgaacaagatg

SEQ ID NO: 540883 - DNA, 25 bp, Rattus norvegicus
aggacaccctatcgcttcggccatg

SEQ ID NO: 540884 - DNA, 25 bp, Rattus norvegicus
tcgccaccagccttcactgggaggg

SEQ ID NO: 540885 - DNA, 25 bp, Rattus norvegicus
cggggctgcagtagtcgccaccagc

SEQ ID NO: 540886 - DNA, 25 bp, Rattus norvegicus
tgttgccagcaagcagcatggcacc

SEQ ID NO: 540887 - DNA, 25 bp, Rattus norvegicus
tgtcctcacctcttgcggcggatct

SEQ ID NO: 540888 - DNA, 25 bp, Rattus norvegicus
cgtcggccgctgttgccagcaagca

SEQ ID NO: 540889 - DNA, 25 bp, Rattus norvegicus
caccatgcactctgcaagaggtgca

SEQ ID NO: 540890 - DNA, 25 bp, Rattus norvegicus
gccaagcctttgtcccggctagggc

SEQ ID NO: 540891 - DNA, 25 bp, Rattus norvegicus
cgggccaagcctttgtcccggctag

SEQ ID NO: 540892 - DNA, 25 bp, Rattus norvegicus
ccgatccgctttcggggtcactcac

SEQ ID NO: 540893 - DNA, 25 bp, Rattus norvegicus
caatccgtcccgatccgctttcggg

SEQ ID NO: 540894 - DNA, 25 bp, Rattus norvegicus
gcccttagtgttgggggtctcctca

SEQ ID NO: 540895 - DNA, 25 bp, Rattus norvegicus
tgcaagaggtgcatagaggtagcct

SEQ ID NO: 540896 - DNA, 25 bp, Rattus norvegicus
gtcgagcgctggcaccatgcactct

SEQ ID NO: 540897 - DNA, 25 bp, Rattus norvegicus
ccaagtcgagcgctggcaccatgca

SEQ ID NO: 540898 - DNA, 25 bp, Rattus norvegicus
ctcccaccgcatccgccaccttgac

SEQ ID NO: 540899 - DNA, 25 bp, Rattus norvegicus
aacgtactaggcctgagctcctcgg

SEQ ID NO: 540900 - DNA, 25 bp, Rattus norvegicus
ggataaacgtactaggcctgagctc

SEQ ID NO: 540901 - DNA, 25 bp, Rattus norvegicus
tggcgggataaacgtactaggcctg

SEQ ID NO: 540902 - DNA, 25 bp, Rattus norvegicus
ccgcgccctgcccttagtgttgggg

SEQ ID NO: 540903 - DNA, 25 bp, Rattus norvegicus
ccacttttgcgaccttctcggaggc

SEQ ID NO: 540904 - DNA, 25 bp, Rattus norvegicus
atttaagtccgctccgcggcgcgga

SEQ ID NO: 540905 - DNA, 25 bp, Rattus norvegicus
ttccagccaagtcgccagtcaacgg

SEQ ID NO: 540906 - DNA, 25 bp, Rattus norvegicus
agtcgccagtcaacggtagcctctg

SEQ ID NO: 540907 - DNA, 25 bp, Rattus norvegicus
cagtcaacggtagcctctgcgaacc

SEQ ID NO: 540908 - DNA, 25 bp, Rattus norvegicus
cccgctgaactcttactcatgggca

SEQ ID NO: 540909 - DNA, 25 bp, Rattus norvegicus
gaactcttactcatgggcagctacc

SEQ ID NO: 540910 - DNA, 25 bp, Rattus norvegicus
ccgcaggaccctagagacaggccag

SEQ ID NO: 540911 - DNA, 25 bp, Rattus norvegicus
accctagagacaggccagggcgccg

SEQ ID NO: 540912 - DNA, 25 bp, Rattus norvegicus
cggcgcggtgtatcctgggatattt

SEQ ID NO: 540913 - DNA, 25 bp, Rattus norvegicus
ggcccagcgagtccaccacgtctac

SEQ ID NO: 540914 - DNA, 25 bp, Rattus norvegicus
cgttcgtgcgcgagtcgcgccgtca

SEQ ID NO: 540915 - DNA, 25 bp, Rattus norvegicus
gcctgtcgtcgttcgtgcgcgagtc

SEQ ID NO: 540916 - DNA, 25 bp, Rattus norvegicus
cctgggatatttaagtccgctccgc

SEQ ID NO: 540917 - DNA, 25 bp, Rattus norvegicus
acccggcctcactacctggaagttg

SEQ ID NO: 540918 - DNA, 25 bp, Rattus norvegicus
gcaataacttgtacgaccggatttc

SEQ ID NO: 540919 - DNA, 25 bp, Rattus norvegicus
cacggccgccgcaataacttgtacg

SEQ ID NO: 540920 - DNA, 25 bp, Rattus norvegicus
gacactgtcgcaaacctcggcctgg

SEQ ID NO: 540921 - DNA, 25 bp, Rattus norvegicus
ggcaaaggctttgcgacactgtcgc

SEQ ID NO: 540922 - DNA, 25 bp, Rattus norvegicus
catgctctcccttcggcaaaggctt

SEQ ID NO: 540923 - DNA, 25 bp, Rattus norvegicus
ggccgcagcttcttctcagcacgaa

SEQ ID NO: 540924 - DNA, 25 bp, Rattus norvegicus
tcttctcagcacgaaggagcccggc

SEQ ID NO: 540925 - DNA, 25 bp, Rattus norvegicus
ctgcgtggcagagaagagacccgct

SEQ ID NO: 540926 - DNA, 25 bp, Rattus norvegicus
cagcgcgtacaactgcttcagattc

SEQ ID NO: 540927 - DNA, 25 bp, Rattus norvegicus
gagtagcgctgcgtctcgcacacca

SEQ ID NO: 540928 - DNA, 25 bp, Rattus norvegicus
tcacggcgtccagcacggccgagta

SEQ ID NO: 540929 - DNA, 25 bp, Rattus norvegicus
cggatttccggagtcaaagggctcg

SEQ ID NO: 540930 - DNA, 25 bp, Rattus norvegicus
cctggaagttgctggaatacactaa

SEQ ID NO: 540931 - DNA, 25 bp, Rattus norvegicus
cctgccatgacgtgtgtagtgagtg

SEQ ID NO: 540932 - DNA, 25 bp, Rattus norvegicus
cacggccatgggtggtagcacccga

SEQ ID NO: 540933 - DNA, 25 bp, Rattus norvegicus
tcgcgagacgactgccaggtacgga

SEQ ID NO: 540934 - DNA, 25 bp, Rattus norvegicus
gaatcccaccgtcgcgagacgactg

SEQ ID NO: 540935 - DNA, 25 bp, Rattus norvegicus
ggaacggaatcccaccgtcgcgaga

SEQ ID NO: 540936 - DNA, 25 bp, Rattus norvegicus
cttctcgcgcctcaggaacggaatc

SEQ ID NO: 540937 - DNA, 25 bp, Rattus norvegicus
caagatgagtgtcttctcgcgcctc

SEQ ID NO: 540938 - DNA, 25 bp, Rattus norvegicus
tggtgcctgacttccgggagtcgtt

SEQ ID NO: 540939 - DNA, 25 bp, Rattus norvegicus
tgctgggagaccctcagcgcatgct

SEQ ID NO: 540940 - DNA, 25 bp, Rattus norvegicus
gctgcgccgatcacgtgctattttc

SEQ ID NO: 540941 - DNA, 25 bp, Rattus norvegicus
tgctattttctcgtgcacagcccgc

SEQ ID NO: 540942 - DNA, 25 bp, Rattus norvegicus
gcacagcccgcgtggtgcctgactt

SEQ ID NO: 540943 - DNA, 25 bp, Rattus norvegicus
tcgtttccggcgaggcctctggcga

SEQ ID NO: 540944 - DNA, 25 bp, Rattus norvegicus
gttgagcggcaagatgagtgtcttc

SEQ ID NO: 540945 - DNA, 25 bp, Rattus norvegicus
aggcacccgagaacgctaccgcagg

SEQ ID NO: 540946 - DNA, 25 bp, Rattus norvegicus
ggtctcggcgcgataaggacttcgc

SEQ ID NO: 540947 - DNA, 25 bp, Rattus norvegicus
gatcggccgctttgatccggagcgc

SEQ ID NO: 540948 - DNA, 25 bp, Rattus norvegicus
tccagtacgtggagaagagtcgctc

SEQ ID NO: 540949 - DNA, 25 bp, Rattus norvegicus
gcagtggaggcacctgcgacaaccc

SEQ ID NO: 540950 - DNA, 25 bp, Rattus norvegicus
gcctgggcatgcttcctgtagcacc

SEQ ID NO: 540951 - DNA, 25 bp, Rattus norvegicus
acgcgctctgcatggaggcacccga

SEQ ID NO: 540952 - DNA, 25 bp, Rattus norvegicus
cccatcatggagcaattcaatttcg

SEQ ID NO: 540953 - DNA, 25 bp, Rattus norvegicus
tagcggctgttcttccgaaggcgcc

SEQ ID NO: 540954 - DNA, 25 bp, Rattus norvegicus
tctcgtgcagtacggctgccacagc

SEQ ID NO: 540955 - DNA, 25 bp, Rattus norvegicus
ccgagttctcgcctctcgtgcagta

SEQ ID NO: 540956 - DNA, 25 bp, Rattus norvegicus
aacctactgggccacacgtcgcagg

SEQ ID NO: 540957 - DNA, 25 bp, Rattus norvegicus
cgcaccgtgccaagcgatggagatc

SEQ ID NO: 540958 - DNA, 25 bp, Rattus norvegicus
cccgcgaggccaccgggagattcag

SEQ ID NO: 540959 - DNA, 25 bp, Rattus norvegicus
gtcatgatcacagccggagccgtgt

SEQ ID NO: 540960 - DNA, 25 bp, Rattus norvegicus
gggtgaccgccttcatcggcagcaa

SEQ ID NO: 540961 - DNA, 25 bp, Rattus norvegicus
gcagcaacatcgtcacggcgcagac

SEQ ID NO: 540962 - DNA, 25 bp, Rattus norvegicus
gcccgagccctgatggtcatcagca

SEQ ID NO: 540963 - DNA, 25 bp, Rattus norvegicus
tcagcatcatcgtgggtgctctggg

SEQ ID NO: 540964 - DNA, 25 bp, Rattus norvegicus
ggggcaagtgcaccaactgcatgga

SEQ ID NO: 540965 - DNA, 25 bp, Rattus norvegicus
accgtcaaggccaaggtcatgatca

SEQ ID NO: 540966 - DNA, 25 bp, Rattus norvegicus
agccgtgttcatcgtggcaagcatg

SEQ ID NO: 540967 - DNA, 25 bp, Rattus norvegicus
catgctgattatggtgcctgtgtcc

SEQ ID NO: 540968 - DNA, 25 bp, Rattus norvegicus
gtcctggacggcacacaacgtcatc

SEQ ID NO: 540969 - DNA, 25 bp, Rattus norvegicus
cgcgacttctacaaccctctggtgg

SEQ ID NO: 540970 - DNA, 25 bp, Rattus norvegicus
tacaaccctctggtggcttccgggc

SEQ ID NO: 540971 - DNA, 25 bp, Rattus norvegicus
gggcctcgctttacatcggctgggc

SEQ ID NO: 540972 - DNA, 25 bp, Rattus norvegicus
aactgcatggaggacgagaccgtca

SEQ ID NO: 540973 - DNA, 25 bp, Rattus norvegicus
ctttggggataaaacgaggcgcaga

SEQ ID NO: 540974 - DNA, 25 bp, Rattus norvegicus
cgggtctgacagcggcagtcccgca

SEQ ID NO: 540975 - DNA, 25 bp, Rattus norvegicus
agtcccgcagcctggcgtcttgctg

SEQ ID NO: 540976 - DNA, 25 bp, Rattus norvegicus
cgcagcctggcgtcttgctgatcct

SEQ ID NO: 540977 - DNA, 25 bp, Rattus norvegicus
cagcctggcgtcttgctgatcctct

SEQ ID NO: 540978 - DNA, 25 bp, Rattus norvegicus
ttgctgatcctcttgctcaacctcc

SEQ ID NO: 540979 - DNA, 25 bp, Rattus norvegicus
cctccccgagatggcgggtctgaca

SEQ ID NO: 540980 - DNA, 25 bp, Rattus norvegicus
gggataaaacgaggcgcagagagca

SEQ ID NO: 540981 - DNA, 25 bp, Rattus norvegicus
tccatcccgcgcagcctggaggtaa

SEQ ID NO: 540982 - DNA, 25 bp, Rattus norvegicus
ccatcccgcgcagcctggaggtaag

SEQ ID NO: 540983 - DNA, 25 bp, Rattus norvegicus
cctcgctggtcccacgctatccaca

SEQ ID NO: 540984 - DNA, 25 bp, Rattus norvegicus
ggtcccacgctatccacaaccttcg

SEQ ID NO: 540985 - DNA, 25 bp, Rattus norvegicus
atccacaaccttcgggaccctgccg

SEQ ID NO: 540986 - DNA, 25 bp, Rattus norvegicus
cttgctcaacctcctccatcccgcg

SEQ ID NO: 540987 - DNA, 25 bp, Rattus norvegicus
cgcctgactcaccagcgcctccttc

SEQ ID NO: 540988 - DNA, 25 bp, Rattus norvegicus
gtcccactcaggtaggtgcagctcc

SEQ ID NO: 540989 - DNA, 25 bp, Rattus norvegicus
agtccgaggtagtcccactcaggta

SEQ ID NO: 540990 - DNA, 25 bp, Rattus norvegicus
ccaacgcagcccaagtccgaggtag

SEQ ID NO: 540991 - DNA, 25 bp, Rattus norvegicus
cgcccgcgcactcagctcgacccaa

SEQ ID NO: 540992 - DNA, 25 bp, Rattus norvegicus
gcccgtccataaagcactgctggct

SEQ ID NO: 540993 - DNA, 25 bp, Rattus norvegicus
tttggggcacgacctatcctcgcgc

SEQ ID NO: 540994 - DNA, 25 bp, Rattus norvegicus
aggtaggtgcagctcccactgcata

SEQ ID NO: 540995 - DNA, 25 bp, Rattus norvegicus
tatcctcgcgctgacacggagaggg

SEQ ID NO: 540996 - DNA, 25 bp, Rattus norvegicus
agctcccactgcatatccgagggca

SEQ ID NO: 540997 - DNA, 25 bp, Rattus norvegicus
gcacaggaatgcagcccgcctgact

SEQ ID NO: 540998 - DNA, 25 bp, Rattus norvegicus
tgcgcgcagcgcacaggaatgcagc

SEQ ID NO: 540999 - DNA, 25 bp, Rattus norvegicus
cagaggcagtgtattaagaagcggc

SEQ ID NO: 541000 - DNA, 25 bp, Rattus norvegicus
gggctcactgcccagaggcagtgta

SEQ ID NO: 541001 - DNA, 25 bp, Rattus norvegicus
ctgcagctgagaagtcgtggttacc

SEQ ID NO: 541002 - DNA, 25 bp, Rattus norvegicus
cgcgcttctgtagcagcggcaacgc

SEQ ID NO: 541003 - DNA, 25 bp, Rattus norvegicus
atgacagttcctacaggcagagccc

SEQ ID NO: 541004 - DNA, 25 bp, Rattus norvegicus
cgcttaatgggcgtggttatctcca

SEQ ID NO: 541005 - DNA, 25 bp, Rattus norvegicus
caattctgtcaatgccgcagctggc

SEQ ID NO: 541006 - DNA, 25 bp, Rattus norvegicus
gttccaagcggggacaattctgtca

SEQ ID NO: 541007 - DNA, 25 bp, Rattus norvegicus
cacgcagaggcagcttcggccttca

SEQ ID NO: 541008 - DNA, 25 bp, Rattus norvegicus
gacccgcatggcttccgccgaagag

SEQ ID NO: 541009 - DNA, 25 bp, Rattus norvegicus
gaaactgccttcgtagacccgcatg

SEQ ID NO: 541010 - DNA, 25 bp, Rattus norvegicus
cgctactttgttgcacctggaggga

SEQ ID NO: 541011 - DNA, 25 bp, Rattus norvegicus
agccggtgttcttcaagcctggtgt

SEQ ID NO: 541012 - DNA, 25 bp, Rattus norvegicus
agtgcatgaggttgacgctactttg

SEQ ID NO: 541013 - DNA, 25 bp, Rattus norvegicus
tgcagcggagcatcatcgccgaagc

SEQ ID NO: 541014 - DNA, 25 bp, Rattus norvegicus
ggcggagccacccaatgacagttcc

SEQ ID NO: 541015 - DNA, 25 bp, Rattus norvegicus
ggtgatttcccttccaattggcgtc

SEQ ID NO: 541016 - DNA, 25 bp, Rattus norvegicus
ccaattggcgtctggatcctgggac

SEQ ID NO: 541017 - DNA, 25 bp, Rattus norvegicus
atcctgggaccgtcggatccaccga

SEQ ID NO: 541018 - DNA, 25 bp, Rattus norvegicus
atccaccgagagagacagggagcgc

SEQ ID NO: 541019 - DNA, 25 bp, Rattus norvegicus
ccctgggttgcttctacgtgaagcc

SEQ ID NO: 541020 - DNA, 25 bp, Rattus norvegicus
ttcaagctagcacacaatgggcctc

SEQ ID NO: 541021 - DNA, 25 bp, Rattus norvegicus
cgtgcgatttgcgatcaggcagcgc

SEQ ID NO: 541022 - DNA, 25 bp, Rattus norvegicus
gaggagttatattgcggggtccttc

SEQ ID NO: 541023 - DNA, 25 bp, Rattus norvegicus
gttcctcaaggagcggagacggcaa

SEQ ID NO: 541024 - DNA, 25 bp, Rattus norvegicus
ggcaaatggcggacttcgataccta

SEQ ID NO: 541025 - DNA, 25 bp, Rattus norvegicus
tcgatacctacgacgatcgggccta

SEQ ID NO: 541026 - DNA, 25 bp, Rattus norvegicus
cgatcgggcctacagcagcttcggc

SEQ ID NO: 541027 - DNA, 25 bp, Rattus norvegicus
gctctagcttgctcgcggcgcacat

SEQ ID NO: 541028 - DNA, 25 bp, Rattus norvegicus
tccgaaagttagaccgcagcgacgc

SEQ ID NO: 541029 - DNA, 25 bp, Rattus norvegicus
gtggccacagagctcgcgtttgaga

SEQ ID NO: 541030 - DNA, 25 bp, Rattus norvegicus
gcgcagagagcacagcgtagccatc

SEQ ID NO: 541031 - DNA, 25 bp, Rattus norvegicus
caacgctgagagcaagcggaagtgc

SEQ ID NO: 541032 - DNA, 25 bp, Rattus norvegicus
caggtttccgggcaacgctgagagc

SEQ ID NO: 541033 - DNA, 25 bp, Rattus norvegicus
cttccacggaagtctggacccaggt

SEQ ID NO: 541034 - DNA, 25 bp, Rattus norvegicus
cccatgacgcttccacggaagtctg

SEQ ID NO: 541035 - DNA, 25 bp, Rattus norvegicus
gacaggcgagggctcctgcgtccca

SEQ ID NO: 541036 - DNA, 25 bp, Rattus norvegicus
accacggcagctcgtagtggccggt

SEQ ID NO: 541037 - DNA, 25 bp, Rattus norvegicus
tgcaggctcaccacggcagctcgta

SEQ ID NO: 541038 - DNA, 25 bp, Rattus norvegicus
gagcgttactatggctgcaggctca

SEQ ID NO: 541039 - DNA, 25 bp, Rattus norvegicus
tctacgcgagcgttactatggctgc

SEQ ID NO: 541040 - DNA, 25 bp, Rattus norvegicus
ttgccatccctctacgcgagcgtta

SEQ ID NO: 541041 - DNA, 25 bp, Rattus norvegicus
tggagttactgagcccgccctcact

SEQ ID NO: 541042 - DNA, 25 bp, Rattus norvegicus
aagccgggttcctggagttactgag

SEQ ID NO: 541043 - DNA, 25 bp, Rattus norvegicus
ttttgttcgctctctggccgctgag

SEQ ID NO: 541044 - DNA, 25 bp, Rattus norvegicus
gttgggctcggatcttcccgactca

SEQ ID NO: 541045 - DNA, 25 bp, Rattus norvegicus
agcagcggccgagcttacagaatcg

SEQ ID NO: 541046 - DNA, 25 bp, Rattus norvegicus
tctatcccttctggccgtagagcct

SEQ ID NO: 541047 - DNA, 25 bp, Rattus norvegicus
cccggactcagaacgcggagaacgg

SEQ ID NO: 541048 - DNA, 25 bp, Rattus norvegicus
gggaccggcacagcatccttgttcc

SEQ ID NO: 541049 - DNA, 25 bp, Rattus norvegicus
catccttgttcccaggacgcgcgga

SEQ ID NO: 541050 - DNA, 25 bp, Rattus norvegicus
cccagtttttgcgtgtcactattgc

SEQ ID NO: 541051 - DNA, 25 bp, Rattus norvegicus
tgttcgctgctggagctccaaggta

SEQ ID NO: 541052 - DNA, 25 bp, Rattus norvegicus
cgcgggcaacaaaggacgcagagtc

SEQ ID NO: 541053 - DNA, 25 bp, Rattus norvegicus
gcggcggcaccctatactggaaaga

SEQ ID NO: 541054 - DNA, 25 bp, Rattus norvegicus
ggggtgctatcaccgagccattgtc

SEQ ID NO: 541055 - DNA, 25 bp, Rattus norvegicus
cattgtcgccgcctgggcaaggaca

SEQ ID NO: 541056 - DNA, 25 bp, Rattus norvegicus
ctattgcctgagaaccgggagacca

SEQ ID NO: 541057 - DNA, 25 bp, Rattus norvegicus
cacctcggacacacgcttctgggta

SEQ ID NO: 541058 - DNA, 25 bp, Rattus norvegicus
cactgctcatccctttggaagaatg

SEQ ID NO: 541059 - DNA, 25 bp, Rattus norvegicus
gttgctcatctgcatgactctcgtg

SEQ ID NO: 541060 - DNA, 25 bp, Rattus norvegicus
ttccggtcacccgagggcatcgaat

SEQ ID NO: 541061 - DNA, 25 bp, Rattus norvegicus
ccgggaagtccttatgcgttgtgca

SEQ ID NO: 541062 - DNA, 25 bp, Rattus norvegicus
acgcttctgggtagcccactgctca

SEQ ID NO: 541063 - DNA, 25 bp, Rattus norvegicus
agctcatcccgcgacagtaatgtgg

SEQ ID NO: 541064 - DNA, 25 bp, Rattus norvegicus
cgcatgcaagtgcaggttgctcatc

SEQ ID NO: 541065 - DNA, 25 bp, Rattus norvegicus
aggacaggacgcgtatccgcatgca

SEQ ID NO: 541066 - DNA, 25 bp, Rattus norvegicus
gtcagattgtgcaacggacaggttg

SEQ ID NO: 541067 - DNA, 25 bp, Rattus norvegicus
ctcgggccagccatagtcagattgt

SEQ ID NO: 541068 - DNA, 25 bp, Rattus norvegicus
cgcttcggatgtcctcgtgagcgct

SEQ ID NO: 541069 - DNA, 25 bp, Rattus norvegicus
aatcccggtcaaagaggaggcgcgc

SEQ ID NO: 541070 - DNA, 25 bp, Rattus norvegicus
cgttgtgcactgcatagtgccatca

SEQ ID NO: 541071 - DNA, 25 bp, Rattus norvegicus
gaacctgtccctgcattctggcacg

SEQ ID NO: 541072 - DNA, 25 bp, Rattus norvegicus
tgttctcaacagctccgtgaagacg

SEQ ID NO: 541073 - DNA, 25 bp, Rattus norvegicus
cctgcgggagagtgttctcaacagc

SEQ ID NO: 541074 - DNA, 25 bp, Rattus norvegicus
gtgacgcccactcagtggaatccct

SEQ ID NO: 541075 - DNA, 25 bp, Rattus norvegicus
tgagggctccggcagtgacgcccac

SEQ ID NO: 541076 - DNA, 25 bp, Rattus norvegicus
gctctacagggcatcttcacacggc

SEQ ID NO: 541077 - DNA, 25 bp, Rattus norvegicus
ttcgagtgcccagctctacagggca

SEQ ID NO: 541078 - DNA, 25 bp, Rattus norvegicus
tcctgtgggcaagaacgatggagct

SEQ ID NO: 541079 - DNA, 25 bp, Rattus norvegicus
cttggatgatcctgtgggcaagaac

SEQ ID NO: 541080 - DNA, 25 bp, Rattus norvegicus
ccggcgtggtcttggatgatcctgt

SEQ ID NO: 541081 - DNA, 25 bp, Rattus norvegicus
gagacacagtttgcgccaggccagt

SEQ ID NO: 541082 - DNA, 25 bp, Rattus norvegicus
tgcagtacctgggtgagacacagtt

SEQ ID NO: 541083 - DNA, 25 bp, Rattus norvegicus
tgaagcccggcgtggtgcagtacct

SEQ ID NO: 541084 - DNA, 25 bp, Rattus norvegicus
gcgctacttcgagtgcccagctcta

SEQ ID NO: 541085 - DNA, 25 bp, Rattus norvegicus
ggcaatcttactgggattacagaac

SEQ ID NO: 541086 - DNA, 25 bp, Rattus norvegicus
cgtgcgggctaatcccgtatgtaaa

SEQ ID NO: 541087 - DNA, 25 bp, Rattus norvegicus
gggctaatcccgtatgtaaatgaca

SEQ ID NO: 541088 - DNA, 25 bp, Rattus norvegicus
tcccgtatgtaaatgacagccaatg

SEQ ID NO: 541089 - DNA, 25 bp, Rattus norvegicus
ccgtatgtaaatgacagccaatgga

SEQ ID NO: 541090 - DNA, 25 bp, Rattus norvegicus
taaatgacagccaatggagggtggt

SEQ ID NO: 541091 - DNA, 25 bp, Rattus norvegicus
gggcgaatggctggcaatcttactg

SEQ ID NO: 541092 - DNA, 25 bp, Rattus norvegicus
tctcaaggccccgaggttgtgggtc

SEQ ID NO: 541093 - DNA, 25 bp, Rattus norvegicus
cgaatggctggcaatcttactggga

SEQ ID NO: 541094 - DNA, 25 bp, Rattus norvegicus
ttacagaacaaagagagaacctccc

SEQ ID NO: 541095 - DNA, 25 bp, Rattus norvegicus
ggctggcaatcttactgggattaca

SEQ ID NO: 541096 - DNA, 25 bp, Rattus norvegicus
ctgggattacagaacaaagagagaa

SEQ ID NO: 541097 - DNA, 25 bp, Rattus norvegicus
gccgtgcgggctaatcccgtatgta

SEQ ID NO: 541098 - DNA, 25 bp, Rattus norvegicus
aagagagaacctcccagagcccggg

SEQ ID NO: 541099 - DNA, 25 bp, Rattus norvegicus
ctgcgagtggcaaggggacaacttc

SEQ ID NO: 541100 - DNA, 25 bp, Rattus norvegicus
cgggagctaccaggctccgaagcct

SEQ ID NO: 541101 - DNA, 25 bp, Rattus norvegicus
cttagggcagcaggccgcacgcgat

SEQ ID NO: 541102 - DNA, 25 bp, Rattus norvegicus
ttctccctcgctcctgattggctga

SEQ ID NO: 541103 - DNA, 25 bp, Rattus norvegicus
aacgagcggacgagtgagcgtaccc

SEQ ID NO: 541104 - DNA, 25 bp, Rattus norvegicus
tatacagaagcgtgtacggtggtcc

SEQ ID NO: 541105 - DNA, 25 bp, Rattus norvegicus
tgcgtacattgtatacagaagcgtg

SEQ ID NO: 541106 - DNA, 25 bp, Rattus norvegicus
gcgttttgcgcgtgcgtacattgta

SEQ ID NO: 541107 - DNA, 25 bp, Rattus norvegicus
agtccactccacttgggggccttgg

SEQ ID NO: 541108 - DNA, 25 bp, Rattus norvegicus
accgtgtgcacagactcgggtgtga

SEQ ID NO: 541109 - DNA, 25 bp, Rattus norvegicus
ggcgtctttattcgacactctgccc

SEQ ID NO: 541110 - DNA, 25 bp, Rattus norvegicus
acaggggcgtctttattcgacactc

SEQ ID NO: 541111 - DNA, 25 bp, Rattus norvegicus
tgccatggcgaacaggggcgtcttt

SEQ ID NO: 541112 - DNA, 25 bp, Rattus norvegicus
gggagacgacagttgcacgcgcaca

SEQ ID NO: 541113 - DNA, 25 bp, Rattus norvegicus
ggccatgcggcggtgacaggagcac

SEQ ID NO: 541114 - DNA, 25 bp, Rattus norvegicus
tatccgcttgctgtccgtatctccc

SEQ ID NO: 541115 - DNA, 25 bp, Rattus norvegicus
atatccgcttgctgtccgtatctcc

SEQ ID NO: 541116 - DNA, 25 bp, Rattus norvegicus
gctgtccgtatctccccctccccga

SEQ ID NO: 541117 - DNA, 25 bp, Rattus norvegicus
cggctgcacttcgggtgagttcccg

SEQ ID NO: 541118 - DNA, 25 bp, Rattus norvegicus
ccggctgcacttcgggtgagttccc

SEQ ID NO: 541119 - DNA, 25 bp, Rattus norvegicus
cccggctgcacttcgggtgagttcc

SEQ ID NO: 541120 - DNA, 25 bp, Rattus norvegicus
ggcctatatccgcttgctgtccgta

SEQ ID NO: 541121 - DNA, 25 bp, Rattus norvegicus
ctatatccgcttgctgtccgtatct

SEQ ID NO: 541122 - DNA, 25 bp, Rattus norvegicus
cctatatccgcttgctgtccgtatc

SEQ ID NO: 541123 - DNA, 25 bp, Rattus norvegicus
cccgttcaccagctcgccgaggccc

SEQ ID NO: 541124 - DNA, 25 bp, Rattus norvegicus
gcctatatccgcttgctgtccgtat

SEQ ID NO: 541125 - DNA, 25 bp, Rattus norvegicus
cgccctctcacctccaccccgttca

SEQ ID NO: 541126 - DNA, 25 bp, Rattus norvegicus
tatatccgcttgctgtccgtatctc

SEQ ID NO: 541127 - DNA, 25 bp, Rattus norvegicus
atcctgcaccgctgcacagagagca

SEQ ID NO: 541128 - DNA, 25 bp, Rattus norvegicus
gaggaaactgacgtccgccgtgtga

SEQ ID NO: 541129 - DNA, 25 bp, Rattus norvegicus
ctggggcttctgatgatcctgactt

SEQ ID NO: 541130 - DNA, 25 bp, Rattus norvegicus
cacagagagcaccaagaggaaactg

SEQ ID NO: 541131 - DNA, 25 bp, Rattus norvegicus
atcaggactagaaaattggggcagc

SEQ ID NO: 541132 - DNA, 25 bp, Rattus norvegicus
ttgcagacaatccatcgactccgcg

SEQ ID NO: 541133 - DNA, 25 bp, Rattus norvegicus
agagcatccaccagcgttctcggaa

SEQ ID NO: 541134 - DNA, 25 bp, Rattus norvegicus
ggccaggtcgaccatccgcaatgca

SEQ ID NO: 541135 - DNA, 25 bp, Rattus norvegicus
ggcactgacacctgcgtcctgctgg

SEQ ID NO: 541136 - DNA, 25 bp, Rattus norvegicus
tctcggaagcgcctcagccaggaca

SEQ ID NO: 541137 - DNA, 25 bp, Rattus norvegicus
gccctgactcaaagggtgagcgcca

SEQ ID NO: 541138 - DNA, 25 bp, Rattus norvegicus
aaattggggcagcttacaacaggga

SEQ ID NO: 541139 - DNA, 25 bp, Rattus norvegicus
tcctgactttcgtttgcagacaatc

SEQ ID NO: 541140 - DNA, 25 bp, Rattus norvegicus
aacagcgtccgattcctgcagcagc

SEQ ID NO: 541141 - DNA, 25 bp, Rattus norvegicus
cggacgaagacagcagcgttacagg

SEQ ID NO: 541142 - DNA, 25 bp, Rattus norvegicus
ggcggtgccaatgcggcccttcgtt

SEQ ID NO: 541143 - DNA, 25 bp, Rattus norvegicus
caatgcggcccttcgttgttcccaa

SEQ ID NO: 541144 - DNA, 25 bp, Rattus norvegicus
aatgcggcccttcgttgttcccaag

SEQ ID NO: 541145 - DNA, 25 bp, Rattus norvegicus
atgcggcccttcgttgttcccaagg

SEQ ID NO: 541146 - DNA, 25 bp, Rattus norvegicus
tgcggcccttcgttgttcccaaggc

SEQ ID NO: 541147 - DNA, 25 bp, Rattus norvegicus
cggctggaagttcgagcccctgctc

SEQ ID NO: 541148 - DNA, 25 bp, Rattus norvegicus
aggagctggacctgcggcgcgtcac

SEQ ID NO: 541149 - DNA, 25 bp, Rattus norvegicus
cccggaactcatcccacgcctgtcc

SEQ ID NO: 541150 - DNA, 25 bp, Rattus norvegicus
atcccacgcctgtccgccagcagcg

SEQ ID NO: 541151 - DNA, 25 bp, Rattus norvegicus
gcgctcggacgaagacagcagcgtt

SEQ ID NO: 541152 - DNA, 25 bp, Rattus norvegicus
ctcggacgaagacagcagcgttaca

SEQ ID NO: 541153 - DNA, 25 bp, Rattus norvegicus
ccgggaggtgactgcctcctcggcc

SEQ ID NO: 541154 - DNA, 25 bp, Rattus norvegicus
cgctcggacgaagacagcagcgtta

SEQ ID NO: 541155 - DNA, 25 bp, Rattus norvegicus
agggcctgctttcggtgcgcaaaat

SEQ ID NO: 541156 - DNA, 25 bp, Rattus norvegicus
caaaatggggttcggagctggccat

SEQ ID NO: 541157 - DNA, 25 bp, Rattus norvegicus
tcccgtcacaaccaatcaaaagaga

SEQ ID NO: 541158 - DNA, 25 bp, Rattus norvegicus
gggaatagttcttcccgcctcctca

SEQ ID NO: 541159 - DNA, 25 bp, Rattus norvegicus
tttctatacacagcgcaggtacgtc

SEQ ID NO: 541160 - DNA, 25 bp, Rattus norvegicus
aggtggcgtgtgacctcagcacgca

SEQ ID NO: 541161 - DNA, 25 bp, Rattus norvegicus
ttgcgtgcaaaggtcgcctaacggc

SEQ ID NO: 541162 - DNA, 25 bp, Rattus norvegicus
gcggaatacgcacctgaaggccctg

SEQ ID NO: 541163 - DNA, 25 bp, Rattus norvegicus
tttgcttcctggaaggtcggcttcc

SEQ ID NO: 541164 - DNA, 25 bp, Rattus norvegicus
acttccggtgcgcttcagcacggct

SEQ ID NO: 541165 - DNA, 25 bp, Rattus norvegicus
ttcagcacggcttccgcgaggctgc

SEQ ID NO: 541166 - DNA, 25 bp, Rattus norvegicus
tgcgtggcttgcacgtgtcttcacg

SEQ ID NO: 541167 - DNA, 25 bp, Rattus norvegicus
atcgggcgcctgaaggttccgccac

SEQ ID NO: 541168 - DNA, 25 bp, Rattus norvegicus
agagagcttttagtgcgcgccttgc

SEQ ID NO: 541169 - DNA, 25 bp, Rattus norvegicus
agtgcccagcttcgtggtgccgtcc

SEQ ID NO: 541170 - DNA, 25 bp, Rattus norvegicus
ccgaggcggacgctccggtgttcca

SEQ ID NO: 541171 - DNA, 25 bp, Rattus norvegicus
ctccggtgttccagtacgtgggcga

SEQ ID NO: 541172 - DNA, 25 bp, Rattus norvegicus
gctcgcgccgatcgcgtgttcgtat

SEQ ID NO: 541173 - DNA, 25 bp, Rattus norvegicus
gttcgtatggggcttcagcttctcc

SEQ ID NO: 541174 - DNA, 25 bp, Rattus norvegicus
ttctccggggctctcggagtgccca

SEQ ID NO: 541175 - DNA, 25 bp, Rattus norvegicus
cgtctggagctggaccataaggtga

SEQ ID NO: 541176 - DNA, 25 bp, Rattus norvegicus
cccataaacggttgaggcgtgaagc

SEQ ID NO: 541177 - DNA, 25 bp, Rattus norvegicus
gagggcactggcattctcgccgcct

SEQ ID NO: 541178 - DNA, 25 bp, Rattus norvegicus
taccggctcgcgagcactggagacc

SEQ ID NO: 541179 - DNA, 25 bp, Rattus norvegicus
ccctaccgtctggagctggaccata

SEQ ID NO: 541180 - DNA, 25 bp, Rattus norvegicus
cggtaccctaccgtctggagctgga

SEQ ID NO: 541181 - DNA, 25 bp, Rattus norvegicus
gacgtaggatccagccggtacccta

SEQ ID NO: 541182 - DNA, 25 bp, Rattus norvegicus
accataaggtgagggcactggcatt

SEQ ID NO: 541183 - DNA, 25 bp, Rattus norvegicus
tgcgcctctttgtctgtcccgggcg

SEQ ID NO: 541184 - DNA, 25 bp, Rattus norvegicus
ccagggttcctccacggcggatcat

SEQ ID NO: 541185 - DNA, 25 bp, Rattus norvegicus
gcagttccatcgtccgcccagggtt

SEQ ID NO: 541186 - DNA, 25 bp, Rattus norvegicus
agaatgtgcagttccatcgtccgcc

SEQ ID NO: 541187 - DNA, 25 bp, Rattus norvegicus
ccggtgttccagaatgtgcagttcc

SEQ ID NO: 541188 - DNA, 25 bp, Rattus norvegicus
actctttctctcacctggtcttgga

SEQ ID NO: 541189 - DNA, 25 bp, Rattus norvegicus
aacttgcagccggtgttccagaatg

SEQ ID NO: 541190 - DNA, 25 bp, Rattus norvegicus
gatactctccttggcgacgctggca

SEQ ID NO: 541191 - DNA, 25 bp, Rattus norvegicus
tccacggcggatcatccgcggtggc

SEQ ID NO: 541192 - DNA, 25 bp, Rattus norvegicus
ctctcacctggtcttggaagacagg

SEQ ID NO: 541193 - DNA, 25 bp, Rattus norvegicus
cgtaggtgaagagcgggatactctc

SEQ ID NO: 541194 - DNA, 25 bp, Rattus norvegicus
cttggaagacaggaaggcaagtttg

SEQ ID NO: 541195 - DNA, 25 bp, Rattus norvegicus
caagtttgatgaggccgtaggtgaa

SEQ ID NO: 541196 - DNA, 25 bp, Rattus norvegicus
cttggcgacgctggcaacttgcagc

SEQ ID NO: 541197 - DNA, 25 bp, Rattus norvegicus
aatcacgagcggagacagaggttgc

SEQ ID NO: 541198 - DNA, 25 bp, Rattus norvegicus
tgggagatgccgctcgctcactcgc

SEQ ID NO: 541199 - DNA, 25 bp, Rattus norvegicus
agatacaccggtgtggtgccgccgc

SEQ ID NO: 541200 - DNA, 25 bp, Rattus norvegicus
gtctccaacccgagatacaccggtg

SEQ ID NO: 541201 - DNA, 25 bp, Rattus norvegicus
aagcaaagagcagtctccaacccga

SEQ ID NO: 541202 - DNA, 25 bp, Rattus norvegicus
ggcgagtcagtcaatgaggaaagca

SEQ ID NO: 541203 - DNA, 25 bp, Rattus norvegicus
cgctgaagcagttgtgggatttttt

SEQ ID NO: 541204 - DNA, 25 bp, Rattus norvegicus
ggggagcataaccacgcaatcacga

SEQ ID NO: 541205 - DNA, 25 bp, Rattus norvegicus
aaatgtatccaagggaagccagggc

SEQ ID NO: 541206 - DNA, 25 bp, Rattus norvegicus
tcgcagaaaaactcactcccgggct

SEQ ID NO: 541207 - DNA, 25 bp, Rattus norvegicus
ctcacacactcgtctcgcagaaaaa

SEQ ID NO: 541208 - DNA, 25 bp, Rattus norvegicus
tgggtggcaatgaacttcacccgcc

SEQ ID NO: 541209 - DNA, 25 bp, Rattus norvegicus
gtccgaaaaggtcacggtgaagtga

SEQ ID NO: 541210 - DNA, 25 bp, Rattus norvegicus
gaagaattgcaaagcctggcgcgtg

SEQ ID NO: 541211 - DNA, 25 bp, Rattus norvegicus
cgggtttgcaggtttctgggctaat

SEQ ID NO: 541212 - DNA, 25 bp, Rattus norvegicus
cacctatttgaaagccggttccacg

SEQ ID NO: 541213 - DNA, 25 bp, Rattus norvegicus
agtcgccgcacacctatttgaaagc

SEQ ID NO: 541214 - DNA, 25 bp, Rattus norvegicus
gagtaggttccttacccgctcgctc

SEQ ID NO: 541215 - DNA, 25 bp, Rattus norvegicus
aagagcctggttggtctgcggacta

SEQ ID NO: 541216 - DNA, 25 bp, Rattus norvegicus
ctgggctaattggaaagaggatcat

SEQ ID NO: 541217 - DNA, 25 bp, Rattus norvegicus
agccgaagctgtgcgcgctctgcct

SEQ ID NO: 541218 - DNA, 25 bp, Rattus norvegicus
gcagccaatcggctggtgcactgcg

SEQ ID NO: 541219 - DNA, 25 bp, Rattus norvegicus
cgcgctctgcctgtgtgttgcggcc

SEQ ID NO: 541220 - DNA, 25 bp, Rattus norvegicus
cttcgccgcagccaatcggctggtg

SEQ ID NO: 541221 - DNA, 25 bp, Rattus norvegicus
tcttcgctagcagacggccgggttt

SEQ ID NO: 541222 - DNA, 25 bp, Rattus norvegicus
cgggtctcgggaataaattgtcaag

SEQ ID NO: 541223 - DNA, 25 bp, Rattus norvegicus
caccgcgggtgtcttcgctagcaga

SEQ ID NO: 541224 - DNA, 25 bp, Rattus norvegicus
gtgttgcggccgctgcaaccttcgc

SEQ ID NO: 541225 - DNA, 25 bp, Rattus norvegicus
tccagatcatgctggtaggcctggc

SEQ ID NO: 541226 - DNA, 25 bp, Rattus norvegicus
gatggccattcgctgcatctccacg

SEQ ID NO: 541227 - DNA, 25 bp, Rattus norvegicus
ttctcacgctcctggatggccattc

SEQ ID NO: 541228 - DNA, 25 bp, Rattus norvegicus
tgcagccggaactgcttctcacgct

SEQ ID NO: 541229 - DNA, 25 bp, Rattus norvegicus
cgttgccgctcttgctctagaagca

SEQ ID NO: 541230 - DNA, 25 bp, Rattus norvegicus
ccacgcgttgattgcagccggaact

SEQ ID NO: 541231 - DNA, 25 bp, Rattus norvegicus
tctagaagcaggttcccacgcgttg

SEQ ID NO: 541232 - DNA, 25 bp, Rattus norvegicus
gctcctcacgctgcttctcaaagtt

SEQ ID NO: 541233 - DNA, 25 bp, Rattus norvegicus
tggttttgcagcttctccacacccg

SEQ ID NO: 541234 - DNA, 25 bp, Rattus norvegicus
gttccaggcgctcacgttcacggtc

SEQ ID NO: 541235 - DNA, 25 bp, Rattus norvegicus
taggcctggcgctgtctctccagct

SEQ ID NO: 541236 - DNA, 25 bp, Rattus norvegicus
gcttctcaaagttgcgttgccgctc

SEQ ID NO: 541237 - DNA, 25 bp, Rattus norvegicus
acgttcacggtccactgctctctgg

SEQ ID NO: 541238 - DNA, 25 bp, Rattus norvegicus
tgggcctcgcgcagacgctccagat

SEQ ID NO: 541239 - DNA, 25 bp, Rattus norvegicus
tgcttctctcggagcagagcgccgc

SEQ ID NO: 541240 - DNA, 25 bp, Rattus norvegicus
cctctcttgctgttgggcgatcgaa

SEQ ID NO: 541241 - DNA, 25 bp, Rattus norvegicus
atgcacacactgcttctctcggagc

SEQ ID NO: 541242 - DNA, 25 bp, Rattus norvegicus
gcttcaagtcagagagctcggcacc

SEQ ID NO: 541243 - DNA, 25 bp, Rattus norvegicus
caggaggaaatgcacacactgcttc

SEQ ID NO: 541244 - DNA, 25 bp, Rattus norvegicus
ccgtggccaccaaagtggcgcttca

SEQ ID NO: 541245 - DNA, 25 bp, Rattus norvegicus
aaacccaactctgcctgttgccgtg

SEQ ID NO: 541246 - DNA, 25 bp, Rattus norvegicus
gcgaggcgataatgaacttgcagga

SEQ ID NO: 541247 - DNA, 25 bp, Rattus norvegicus
cgccgtcttgcctctcttgctgttg

SEQ ID NO: 541248 - DNA, 25 bp, Rattus norvegicus
gcgatcgaatcgttggaaactggga

SEQ ID NO: 541249 - DNA, 25 bp, Rattus norvegicus
taacggaggcatccgtgcgtgagtc

SEQ ID NO: 541250 - DNA, 25 bp, Rattus norvegicus
tccgtgcgtgagtctaacccatttc

SEQ ID NO: 541251 - DNA, 25 bp, Rattus norvegicus
taacccatttcacactgccgtcatg

SEQ ID NO: 541252 - DNA, 25 bp, Rattus norvegicus
ccgtcatgctttggcgaggcgataa

SEQ ID NO: 541253 - DNA, 25 bp, Rattus norvegicus
ctgccttgggttttggttgctctct

SEQ ID NO: 541254 - DNA, 25 bp, Rattus norvegicus
cgagaagtcccgctccgagagccgg

SEQ ID NO: 541255 - DNA, 25 bp, Rattus norvegicus
gagtaaggcgcgctccgtatagtcc

SEQ ID NO: 541256 - DNA, 25 bp, Rattus norvegicus
cgtatagtccggagagcgaagtcca

SEQ ID NO: 541257 - DNA, 25 bp, Rattus norvegicus
agcgaagtccagagcgcgagagcaa

SEQ ID NO: 541258 - DNA, 25 bp, Rattus norvegicus
ccgccgatggagttcacttgagcca

SEQ ID NO: 541259 - DNA, 25 bp, Rattus norvegicus
ccgtagcagcttcaacctcagcttt

SEQ ID NO: 541260 - DNA, 25 bp, Rattus norvegicus
cagatcgcgactcccggagcgtgtc

SEQ ID NO: 541261 - DNA, 25 bp, Rattus norvegicus
gcgggcccaggacccatcagatcag

SEQ ID NO: 541262 - DNA, 25 bp, Rattus norvegicus
catggtctcctttgtcctgtcgccg

SEQ ID NO: 541263 - DNA, 25 bp, Rattus norvegicus
cccgcaggagcaaccaggagagcgc

SEQ ID NO: 541264 - DNA, 25 bp, Rattus norvegicus
cgtgcctcggctttgagactttgga

SEQ ID NO: 541265 - DNA, 25 bp, Rattus norvegicus
acacacagacttgcggacctagccg

SEQ ID NO: 541266 - DNA, 25 bp, Rattus norvegicus
tggagaggaattagcaaaacacaca

SEQ ID NO: 541267 - DNA, 25 bp, Rattus norvegicus
cccggttgtatgaagccgaccgctc

SEQ ID NO: 541268 - DNA, 25 bp, Rattus norvegicus
gcgggccaccagaatggactactta

SEQ ID NO: 541269 - DNA, 25 bp, Rattus norvegicus
gggagcctcatgattacagccacca

SEQ ID NO: 541270 - DNA, 25 bp, Rattus norvegicus
cagggactttctgctcaggaatgac

SEQ ID NO: 541271 - DNA, 25 bp, Rattus norvegicus
ggacatgcaccgaagagaccctctg

SEQ ID NO: 541272 - DNA, 25 bp, Rattus norvegicus
ccttgagggatccttaccgtgactt

SEQ ID NO: 541273 - DNA, 25 bp, Rattus norvegicus
ccatttatgggcctcagtccgatcc

SEQ ID NO: 541274 - DNA, 25 bp, Rattus norvegicus
tctggacaggacacgcatgatgacc

SEQ ID NO: 541275 - DNA, 25 bp, Rattus norvegicus
cacgccatgaacagtatcggtagtc

SEQ ID NO: 541276 - DNA, 25 bp, Rattus norvegicus
gcacccagggcctctggcatcaatg

SEQ ID NO: 541277 - DNA, 25 bp, Rattus norvegicus
acagcacctctagtcgggaagccga

SEQ ID NO: 541278 - DNA, 25 bp, Rattus norvegicus
ggtgccatcgccctatgtgaggaca

SEQ ID NO: 541279 - DNA, 25 bp, Rattus norvegicus
tcgggatcccgaaaggacctgacca

SEQ ID NO: 541280 - DNA, 25 bp, Rattus norvegicus
aggactatgagcacccacggttgca

SEQ ID NO: 541281 - DNA, 25 bp, Rattus norvegicus
ctgtctcgtagaagggactgcgtgc

SEQ ID NO: 541282 - DNA, 25 bp, Rattus norvegicus
agcaggcatttcagcgacacttttg

SEQ ID NO: 541283 - DNA, 25 bp, Rattus norvegicus
gcatcctcccagtggtctctgtctg

SEQ ID NO: 541284 - DNA, 25 bp, Rattus norvegicus
attgcatctggtgatcgggacactc

SEQ ID NO: 541285 - DNA, 25 bp, Rattus norvegicus
cccgcgacatttagaaaggcgtgta

SEQ ID NO: 541286 - DNA, 25 bp, Rattus norvegicus
ctcgtgtacggacttggaacgtgtc

SEQ ID NO: 541287 - DNA, 25 bp, Rattus norvegicus
ccctccactttgagagagtcattga

SEQ ID NO: 541288 - DNA, 25 bp, Rattus norvegicus
tgaacaaagacacccgccctgagga

SEQ ID NO: 541289 - DNA, 25 bp, Rattus norvegicus
cctttgctggaagaccgcatttttc

SEQ ID NO: 541290 - DNA, 25 bp, Rattus norvegicus
gcaccggattgttcccgaaggtcta

SEQ ID NO: 541291 - DNA, 25 bp, Rattus norvegicus
tctccggaggaggtccaaaggcaac

SEQ ID NO: 541292 - DNA, 25 bp, Rattus norvegicus
cgggacctttatcgtttgctgtctc

SEQ ID NO: 541293 - DNA, 25 bp, Rattus norvegicus
tctgtctgctgagtatctgtggcca

SEQ ID NO: 541294 - DNA, 25 bp, Rattus norvegicus
gacacttttgtaagccagggtcttc

SEQ ID NO: 541295 - DNA, 25 bp, Rattus norvegicus
caccaggccctggttgtaatccgtg

SEQ ID NO: 541296 - DNA, 25 bp, Rattus norvegicus
ccatgacgctcgtctgcagcggggc

SEQ ID NO: 541297 - DNA, 25 bp, Rattus norvegicus
tccaagcagccatgacgctcgtctg

SEQ ID NO: 541298 - DNA, 25 bp, Rattus norvegicus
ggcggtctccaagcagccatgacgc

SEQ ID NO: 541299 - DNA, 25 bp, Rattus norvegicus
gccctggttgtaatccgtgtgctcc

SEQ ID NO: 541300 - DNA, 25 bp, Rattus norvegicus
ggacaactgcacgtcccggggtctc

SEQ ID NO: 541301 - DNA, 25 bp, Rattus norvegicus
gcaggccggaccagcacacacaagg

SEQ ID NO: 541302 - DNA, 25 bp, Rattus norvegicus
taagcgagcccttccctaccgcagg

SEQ ID NO: 541303 - DNA, 25 bp, Rattus norvegicus
ccgctagaccgcttcactccgcctt

SEQ ID NO: 541304 - DNA, 25 bp, Rattus norvegicus
cggggtctcgcatgtccgctagacc

SEQ ID NO: 541305 - DNA, 25 bp, Rattus norvegicus
gcttgagaaggcaatcgcgcccatc

SEQ ID NO: 541306 - DNA, 25 bp, Rattus norvegicus
aggcttcctgccttcgcacgtggac

SEQ ID NO: 541307 - DNA, 25 bp, Rattus norvegicus
ctgccttcgcacgtggacaactgca

SEQ ID NO: 541308 - DNA, 25 bp, Rattus norvegicus
tcggctccaaactcctccatgaagg

SEQ ID NO: 541309 - DNA, 25 bp, Rattus norvegicus
gcttagcccatgtgcgcggctgcct

SEQ ID NO: 541310 - DNA, 25 bp, Rattus norvegicus
tgtccttgtcctcgcctcccgtctg

SEQ ID NO: 541311 - DNA, 25 bp, Rattus norvegicus
ctcagcctggcgctcacacgcgtcc

SEQ ID NO: 541312 - DNA, 25 bp, Rattus norvegicus
gggcatccttcctctccgtagccgg

SEQ ID NO: 541313 - DNA, 25 bp, Rattus norvegicus
cactccggttgggaggccgctttgc

SEQ ID NO: 541314 - DNA, 25 bp, Rattus norvegicus
ttgggaggccgctttgcccaaccca

SEQ ID NO: 541315 - DNA, 25 bp, Rattus norvegicus
ttgcccaacccagcggcacccgaga

SEQ ID NO: 541316 - DNA, 25 bp, Rattus norvegicus
agagcccggcgcgagtctctccttt

SEQ ID NO: 541317 - DNA, 25 bp, Rattus norvegicus
gcgagtctctcctttcccttgagta

SEQ ID NO: 541318 - DNA, 25 bp, Rattus norvegicus
cctttcccttgagtatctcagctgg

SEQ ID NO: 541319 - DNA, 25 bp, Rattus norvegicus
ttgagtatctcagctggtctttgca

SEQ ID NO: 541320 - DNA, 25 bp, Rattus norvegicus
gacgcgaacccgagcgctcagcctg

SEQ ID NO: 541321 - DNA, 25 bp, Rattus norvegicus
agagcccgcggtgatctaggctgct

SEQ ID NO: 541322 - DNA, 25 bp, Rattus norvegicus
cggtgatctaggctgctcctttctc

SEQ ID NO: 541323 - DNA, 25 bp, Rattus norvegicus
tataaaaacaaggtcgtcggctggc

SEQ ID NO: 541324 - DNA, 25 bp, Rattus norvegicus
tagggcaatcgggtacgcagtagct

SEQ ID NO: 541325 - DNA, 25 bp, Rattus norvegicus
ggaagcgcttcgaaatcgcctgcta

SEQ ID NO: 541326 - DNA, 25 bp, Rattus norvegicus
gatccgactgaccaatgtagccgtg

SEQ ID NO: 541327 - DNA, 25 bp, Rattus norvegicus
gtgagcagccaccatgtcgatcttc

SEQ ID NO: 541328 - DNA, 25 bp, Rattus norvegicus
cccgcgagctcgagatctgtgagca

SEQ ID NO: 541329 - DNA, 25 bp, Rattus norvegicus
tgctgcgtccagagttcagcggacc

SEQ ID NO: 541330 - DNA, 25 bp, Rattus norvegicus
cgggtttgtacccacctgacgcatg

SEQ ID NO: 541331 - DNA, 25 bp, Rattus norvegicus
gcgcaggcgtagttgctttcttcta

SEQ ID NO: 541332 - DNA, 25 bp, Rattus norvegicus
atggagggcgcaaaagtcacactgc

SEQ ID NO: 541333 - DNA, 25 bp, Rattus norvegicus
cagaacgccttcctttgagggcgga

SEQ ID NO: 541334 - DNA, 25 bp, Rattus norvegicus
gcaagtaaatgacgtcaccaccgaa

SEQ ID NO: 541335 - DNA, 25 bp, Rattus norvegicus
cgcagggtcgtttcagctgagcact

SEQ ID NO: 541336 - DNA, 25 bp, Rattus norvegicus
gagccgcgcactctttgggcgttaa

SEQ ID NO: 541337 - DNA, 25 bp, Rattus norvegicus
tcctcctgccggtgaacgagggaaa

SEQ ID NO: 541338 - DNA, 25 bp, Rattus norvegicus
tatcttggccgtgcagccacgcgca

SEQ ID NO: 541339 - DNA, 25 bp, Rattus norvegicus
cgcatactgcggctttgtggagatt

SEQ ID NO: 541340 - DNA, 25 bp, Rattus norvegicus
gtgtgtccgtgcagcacaaacgcta

SEQ ID NO: 541341 - DNA, 25 bp, Rattus norvegicus
gcaggccctccttgtgtcttgaaag

SEQ ID NO: 541342 - DNA, 25 bp, Rattus norvegicus
tcttgaaaggcgctggaggtgataa

SEQ ID NO: 541343 - DNA, 25 bp, Rattus norvegicus
atgaagatcgagagggcgcacatgc

SEQ ID NO: 541344 - DNA, 25 bp, Rattus norvegicus
tcgtggagagtgaggactacagcca

SEQ ID NO: 541345 - DNA, 25 bp, Rattus norvegicus
ccagcagctggagatcgtaaggcga

SEQ ID NO: 541346 - DNA, 25 bp, Rattus norvegicus
ccgagagtgtgaccttgacccgtca

SEQ ID NO: 541347 - DNA, 25 bp, Rattus norvegicus
gcttttaccagagtagccgcgttcc

SEQ ID NO: 541348 - DNA, 25 bp, Rattus norvegicus
agccgcgttcctgaccgtaattcgt

SEQ ID NO: 541349 - DNA, 25 bp, Rattus norvegicus
cgtaattcgttcctgaccgtaatgc

SEQ ID NO: 541350 - DNA, 25 bp, Rattus norvegicus
gacccgtcattcttggcttttacca

SEQ ID NO: 541351 - DNA, 25 bp, Rattus norvegicus
ctcctcggggcgaaagcgacaacct

SEQ ID NO: 541352 - DNA, 25 bp, Rattus norvegicus
agttccgtcccgaagtgcatctgcg

SEQ ID NO: 541353 - DNA, 25 bp, Rattus norvegicus
acttgctcagttccgtcccgaagtg

SEQ ID NO: 541354 - DNA, 25 bp, Rattus norvegicus
tcgcggattgcagtgaacttgctca

SEQ ID NO: 541355 - DNA, 25 bp, Rattus norvegicus
gtgtatcactcgcattcgcggattg

SEQ ID NO: 541356 - DNA, 25 bp, Rattus norvegicus
cgaagctgcctgaagtgtatcactc

SEQ ID NO: 541357 - DNA, 25 bp, Rattus norvegicus
ggtatgggaatacgaagctgcctga

SEQ ID NO: 541358 - DNA, 25 bp, Rattus norvegicus
acagaattactccaggccgggaggc

SEQ ID NO: 541359 - DNA, 25 bp, Rattus norvegicus
gctccggagacagcgagcagctcct

SEQ ID NO: 541360 - DNA, 25 bp, Rattus norvegicus
cgaaagcgacaacctgaagacaggc

SEQ ID NO: 541361 - DNA, 25 bp, Rattus norvegicus
gctgtcttcattttgctaataggcg

SEQ ID NO: 541362 - DNA, 25 bp, Rattus norvegicus
gaagacaggccagagcgcgccaacg

SEQ ID NO: 541363 - DNA, 25 bp, Rattus norvegicus
cgggtgaaagcagaaaaccacgtca

SEQ ID NO: 541364 - DNA, 25 bp, Rattus norvegicus
ggcgccgcagggacagaattactcc

SEQ ID NO: 541365 - DNA, 25 bp, Rattus norvegicus
cacaactcagtactcggataggatc

SEQ ID NO: 541366 - DNA, 25 bp, Rattus norvegicus
tgagaccatcgctgacgtgtccgtg

SEQ ID NO: 541367 - DNA, 25 bp, Rattus norvegicus
gtgactcgcgaaaagccgccgtttc

SEQ ID NO: 541368 - DNA, 25 bp, Rattus norvegicus
acttcccagcgtgtagcgaatgcgg

SEQ ID NO: 541369 - DNA, 25 bp, Rattus norvegicus
taccaggaatgctgtagggacagtc

SEQ ID NO: 541370 - DNA, 25 bp, Rattus norvegicus
cctacgctctggaggttcactacca

SEQ ID NO: 541371 - DNA, 25 bp, Rattus norvegicus
cgtgacgcttcatacttccggggtt

SEQ ID NO: 541372 - DNA, 25 bp, Rattus norvegicus
agcgccgcttcaagtcagtcggctc

SEQ ID NO: 541373 - DNA, 25 bp, Rattus norvegicus
cactctgtctactagcttctgtttg

SEQ ID NO: 541374 - DNA, 25 bp, Rattus norvegicus
cttctgtttgcactagcctgagggc

SEQ ID NO: 541375 - DNA, 25 bp, Rattus norvegicus
cccgaggactgtcacagcacggatc

SEQ ID NO: 541376 - DNA, 25 bp, Rattus norvegicus
gcacggatccggacatcaaagtctg

SEQ ID NO: 541377 - DNA, 25 bp, Rattus norvegicus
gtctgagtccaggagacacttccca

SEQ ID NO: 541378 - DNA, 25 bp, Rattus norvegicus
cgtacgtgttgcgtcatttccgtga

SEQ ID NO: 541379 - DNA, 25 bp, Rattus norvegicus
gctccaggaagtcgtcttcggcttc

SEQ ID NO: 541380 - DNA, 25 bp, Rattus norvegicus
ggtgatcgccaactgacgacctcga

SEQ ID NO: 541381 - DNA, 25 bp, Rattus norvegicus
cgacgccagcctgcccagggatttg

SEQ ID NO: 541382 - DNA, 25 bp, Rattus norvegicus
attggctcttggctgacaagcgcga

SEQ ID NO: 541383 - DNA, 25 bp, Rattus norvegicus
tggccacaggcctacccaattctga

SEQ ID NO: 541384 - DNA, 25 bp, Rattus norvegicus
acagttccgccttaagcccaagtgg

SEQ ID NO: 541385 - DNA, 25 bp, Rattus norvegicus
agggacttcgcccaatcacagaaga

SEQ ID NO: 541386 - DNA, 25 bp, Rattus norvegicus
ctccgccctgattgtcagggacttc

SEQ ID NO: 541387 - DNA, 25 bp, Rattus norvegicus
cagccattggccgagccttcgctgg

SEQ ID NO: 541388 - DNA, 25 bp, Rattus norvegicus
gcttcagttagtcgctgggctgacc

SEQ ID NO: 541389 - DNA, 25 bp, Rattus norvegicus
gtctaacgaccaccgcgcttcagtt

SEQ ID NO: 541390 - DNA, 25 bp, Rattus norvegicus
ggatgtcgtgtgctaccctccaaca

SEQ ID NO: 541391 - DNA, 25 bp, Rattus norvegicus
gctggacatggcaccgtccgagtga

SEQ ID NO: 541392 - DNA, 25 bp, Rattus norvegicus
ggcggaggcctgaagaactaaagtc

SEQ ID NO: 541393 - DNA, 25 bp, Rattus norvegicus
acagcctctgtaggcctgcggcagg

SEQ ID NO: 541394 - DNA, 25 bp, Rattus norvegicus
aggaagtggctgtgcatgtccagta

SEQ ID NO: 541395 - DNA, 25 bp, Rattus norvegicus
ccacggtactcacagcctctgtagg

SEQ ID NO: 541396 - DNA, 25 bp, Rattus norvegicus
gaagacgcgccttactcccacggta

SEQ ID NO: 541397 - DNA, 25 bp, Rattus norvegicus
acacaggcgtgggaagacgcgcctt

SEQ ID NO: 541398 - DNA, 25 bp, Rattus norvegicus
tgcgcctctgtctgcatcagctctg

SEQ ID NO: 541399 - DNA, 25 bp, Rattus norvegicus
tgcgcacgtgatgcgcctctgtctg

SEQ ID NO: 541400 - DNA, 25 bp, Rattus norvegicus
gcatgatcttcagcgtgcgcacgtg

SEQ ID NO: 541401 - DNA, 25 bp, Rattus norvegicus
ggagtatactttcagcatgatcttc

SEQ ID NO: 541402 - DNA, 25 bp, Rattus norvegicus
cctgcagggctctggagtatacttt

SEQ ID NO: 541403 - DNA, 25 bp, Rattus norvegicus
tgcctggacgctgaactgcagctcc

SEQ ID NO: 541404 - DNA, 25 bp, Rattus norvegicus
cggctgactgcctggacgctgaact

SEQ ID NO: 541405 - DNA, 25 bp, Rattus norvegicus
ccagtaagtcgtcggcgcatgggaa

SEQ ID NO: 541406 - DNA, 25 bp, Rattus norvegicus
tgtgcatgtccagtaagtcgtcggc

SEQ ID NO: 541407 - DNA, 25 bp, Rattus norvegicus
gcttacctacgatggcggaggcgca

SEQ ID NO: 541408 - DNA, 25 bp, Rattus norvegicus
gcgtggccgcaggatctcacgcacg

SEQ ID NO: 541409 - DNA, 25 bp, Rattus norvegicus
aggatctcacgcacgccgccattgg

SEQ ID NO: 541410 - DNA, 25 bp, Rattus norvegicus
cgcgatgtgtctgcctctctgattt

SEQ ID NO: 541411 - DNA, 25 bp, Rattus norvegicus
ctctgatttgtcagttccgagggga

SEQ ID NO: 541412 - DNA, 25 bp, Rattus norvegicus
acatccgggcccagcgtttgtcgaa

SEQ ID NO: 541413 - DNA, 25 bp, Rattus norvegicus
gcccagcgtttgtcgaactcacaaa

SEQ ID NO: 541414 - DNA, 25 bp, Rattus norvegicus
agcatcttgggcttcggccgcttct

SEQ ID NO: 541415 - DNA, 25 bp, Rattus norvegicus
ggctcggcgccgcttacctacgatg

SEQ ID NO: 541416 - DNA, 25 bp, Rattus norvegicus
aacccaggactgctaggcgaaagga

SEQ ID NO: 541417 - DNA, 25 bp, Rattus norvegicus
gcagacacggcagtagaacccagga

SEQ ID NO: 541418 - DNA, 25 bp, Rattus norvegicus
aagtcggatgcctgctgggcagaca

SEQ ID NO: 541419 - DNA, 25 bp, Rattus norvegicus
accctgcgtggaaagtcggatgcct

SEQ ID NO: 541420 - DNA, 25 bp, Rattus norvegicus
ggagcgcgtcctctccgctaggcga

SEQ ID NO: 541421 - DNA, 25 bp, Rattus norvegicus
acgatctgttgacaggctttcctta

SEQ ID NO: 541422 - DNA, 25 bp, Rattus norvegicus
cgcgcaaacacccacgaaacaagtg

SEQ ID NO: 541423 - DNA, 25 bp, Rattus norvegicus
cgaaacaagtgagcagtgcctctga

SEQ ID NO: 541424 - DNA, 25 bp, Rattus norvegicus
gtgcctctgaattgccacacgcttg

SEQ ID NO: 541425 - DNA, 25 bp, Rattus norvegicus
gccacacgcttgacttaggagcgga

SEQ ID NO: 541426 - DNA, 25 bp, Rattus norvegicus
cttaggagcggaatgacgacaaacg

SEQ ID NO: 541427 - DNA, 25 bp, Rattus norvegicus
cgacaaacggaattgctaaagtgct

SEQ ID NO: 541428 - DNA, 25 bp, Rattus norvegicus
ttgctaaagtgctggaagcgccacc

SEQ ID NO: 541429 - DNA, 25 bp, Rattus norvegicus
gaagcgccaccaatccgtgttctga

SEQ ID NO: 541430 - DNA, 25 bp, Rattus norvegicus
ccgtgttctgaaaagataccctttg

SEQ ID NO: 541431 - DNA, 25 bp, Rattus norvegicus
tgactcgaaaaaagggaaagctcca

SEQ ID NO: 541432 - DNA, 25 bp, Rattus norvegicus
gggaaagctccaaagtcaatgaacg

SEQ ID NO: 541433 - DNA, 25 bp, Rattus norvegicus
aaagtcaatgaacgcctcacccacg

SEQ ID NO: 541434 - DNA, 25 bp, Rattus norvegicus
ggctttccttaaaagcacgcgcaaa

SEQ ID NO: 541435 - DNA, 25 bp, Rattus norvegicus
agctgattctgctttcccctggacg

SEQ ID NO: 541436 - DNA, 25 bp, Rattus norvegicus
gcactctgggaccgccgtggtgcat

SEQ ID NO: 541437 - DNA, 25 bp, Rattus norvegicus
tttctgtgtgtgtgccgcaaggcac

SEQ ID NO: 541438 - DNA, 25 bp, Rattus norvegicus
agaacctcacgttacgccagctctg

SEQ ID NO: 541439 - DNA, 25 bp, Rattus norvegicus
gctggaagagaagaacctcacgtta

SEQ ID NO: 541440 - DNA, 25 bp, Rattus norvegicus
acaaccgctggaagagaagaacctc

SEQ ID NO: 541441 - DNA, 25 bp, Rattus norvegicus
cgtcgtacacaaccgctggaagaga

SEQ ID NO: 541442 - DNA, 25 bp, Rattus norvegicus
tgcctcgtcgtacacaaccgctgga

SEQ ID NO: 541443 - DNA, 25 bp, Rattus norvegicus
gttgcctctgcctcgtcgtacacaa

SEQ ID NO: 541444 - DNA, 25 bp, Rattus norvegicus
ttccatgttgcctctgcctcgtcgt

SEQ ID NO: 541445 - DNA, 25 bp, Rattus norvegicus
ttacacttccatgttgcctctgcct

SEQ ID NO: 541446 - DNA, 25 bp, Rattus norvegicus
tggacgtgtcgcttacacttccatg

SEQ ID NO: 541447 - DNA, 25 bp, Rattus norvegicus
aggtctagccgccagccgcctcaca

SEQ ID NO: 541448 - DNA, 25 bp, Rattus norvegicus
ccctgctcgcgggtccggaggtcta

SEQ ID NO: 541449 - DNA, 25 bp, Rattus norvegicus
gcgctgacatctcccgacacaaagg

SEQ ID NO: 541450 - DNA, 25 bp, Rattus norvegicus
ctgtgagtcaccaccgggaagtaga

SEQ ID NO: 541451 - DNA, 25 bp, Rattus norvegicus
acacaaaggccgtacttcgggctcg

SEQ ID NO: 541452 - DNA, 25 bp, Rattus norvegicus
caccagagaaaggagggcgtcaacg

SEQ ID NO: 541453 - DNA, 25 bp, Rattus norvegicus
cgactttttcgattggcgggagctt

SEQ ID NO: 541454 - DNA, 25 bp, Rattus norvegicus
agtgcgtcacagaacccttatttgc

SEQ ID NO: 541455 - DNA, 25 bp, Rattus norvegicus
cttcacgctgcgtcagtgcgtcaca

SEQ ID NO: 541456 - DNA, 25 bp, Rattus norvegicus
cccgacgcctccatatttatagaga

SEQ ID NO: 541457 - DNA, 25 bp, Rattus norvegicus
cgcgaactcacccaaagctgaagtc

SEQ ID NO: 541458 - DNA, 25 bp, Rattus norvegicus
cctaatgactcaggctgcgccgagc

SEQ ID NO: 541459 - DNA, 25 bp, Rattus norvegicus
gcgacgttcaagctcaggtcacttg

SEQ ID NO: 541460 - DNA, 25 bp, Rattus norvegicus
tcacctgcgagacaagcgacgttca

SEQ ID NO: 541461 - DNA, 25 bp, Rattus norvegicus
gtttccagctctctgcctacctgta

SEQ ID NO: 541462 - DNA, 25 bp, Rattus norvegicus
agacggcggccaagtcattgtttcc

SEQ ID NO: 541463 - DNA, 25 bp, Rattus norvegicus
cgtttgttccggagtccatactctc

SEQ ID NO: 541464 - DNA, 25 bp, Rattus norvegicus
cctcacgtttgttccggagtccata

SEQ ID NO: 541465 - DNA, 25 bp, Rattus norvegicus
ccacacctcacgtttgttccggagt

SEQ ID NO: 541466 - DNA, 25 bp, Rattus norvegicus
gccagggtaaatttgaccctccaca

SEQ ID NO: 541467 - DNA, 25 bp, Rattus norvegicus
tgggcagccttcgccagggtaaatt

SEQ ID NO: 541468 - DNA, 25 bp, Rattus norvegicus
accagcgtcaacagctcctgggcag

SEQ ID NO: 541469 - DNA, 25 bp, Rattus norvegicus
tcgaccagcgtcaacagctcctggg

SEQ ID NO: 541470 - DNA, 25 bp, Rattus norvegicus
ggatctttctcgaccagcgtcaaca

SEQ ID NO: 541471 - DNA, 25 bp, Rattus norvegicus
ccgaggatctttctcgaccagcgtc

SEQ ID NO: 541472 - DNA, 25 bp, Rattus norvegicus
agacgccgaggatctttctcgacca

SEQ ID NO: 541473 - DNA, 25 bp, Rattus norvegicus
cagacagacgccgaggatctttctc

SEQ ID NO: 541474 - DNA, 25 bp, Rattus norvegicus
tgccttcagacagacgccgaggatc

SEQ ID NO: 541475 - DNA, 25 bp, Rattus norvegicus
gcagagcgttgccttcagacagacg

SEQ ID NO: 541476 - DNA, 25 bp, Rattus norvegicus
gttccggagtccatactctccaatc

SEQ ID NO: 541477 - DNA, 25 bp, Rattus norvegicus
ctggaagctttcagaagcgagggca

SEQ ID NO: 541478 - DNA, 25 bp, Rattus norvegicus
cgggatgctgttcccgaaggagacc

SEQ ID NO: 541479 - DNA, 25 bp, Rattus norvegicus
cccaagacggagtgtgtgttggttc

SEQ ID NO: 541480 - DNA, 25 bp, Rattus norvegicus
agagaacatgtgaccctccaaagtc

SEQ ID NO: 541481 - DNA, 25 bp, Rattus norvegicus
cccagagagcgaggctaaaaggccc

SEQ ID NO: 541482 - DNA, 25 bp, Rattus norvegicus
gcttcgagaagcagtggtaccggca

SEQ ID NO: 541483 - DNA, 25 bp, Rattus norvegicus
gccggccgcttctctagagaacatg

SEQ ID NO: 541484 - DNA, 25 bp, Rattus norvegicus
ggctaaaaggcccagccgctggacg

SEQ ID NO: 541485 - DNA, 25 bp, Rattus norvegicus
cgctacgggaggtgagcgctcctcc

SEQ ID NO: 541486 - DNA, 25 bp, Rattus norvegicus
cccttcgcgggaactcaaggtgctg

SEQ ID NO: 541487 - DNA, 25 bp, Rattus norvegicus
ctcgaacaatcggttgcagggcttc

SEQ ID NO: 541488 - DNA, 25 bp, Rattus norvegicus
cccggggtctggaagctttcagaag

SEQ ID NO: 541489 - DNA, 25 bp, Rattus norvegicus
tggagcttccgtgccgattactcga

SEQ ID NO: 541490 - DNA, 25 bp, Rattus norvegicus
gttggttcgtactgggccagctgct

SEQ ID NO: 541491 - DNA, 25 bp, Rattus norvegicus
ctccgcctccactcagacgccgccg

SEQ ID NO: 541492 - DNA, 25 bp, Rattus norvegicus
tggtactgagaaatggggttcgtta

SEQ ID NO: 541493 - DNA, 25 bp, Rattus norvegicus
ttctcccgctccacgtggtaggcgt

SEQ ID NO: 541494 - DNA, 25 bp, Rattus norvegicus
aggcgtagatggagagcaggatccc

SEQ ID NO: 541495 - DNA, 25 bp, Rattus norvegicus
gcacactgcataccgggccacccgt

SEQ ID NO: 541496 - DNA, 25 bp, Rattus norvegicus
gcggcaccgacacttcagcaggacg

SEQ ID NO: 541497 - DNA, 25 bp, Rattus norvegicus
acttcagcaggacgggcgccgccat

SEQ ID NO: 541498 - DNA, 25 bp, Rattus norvegicus
ctgagaaatggggttcgttagactg

SEQ ID NO: 541499 - DNA, 25 bp, Rattus norvegicus
ccattggctcggtcgcctcctaccg

SEQ ID NO: 541500 - DNA, 25 bp, Rattus norvegicus
tctaaaggagggaagcgcttgagaa

SEQ ID NO: 541501 - DNA, 25 bp, Rattus norvegicus
ctaggaaggcgcacataagtgtgga

SEQ ID NO: 541502 - DNA, 25 bp, Rattus norvegicus
aagaggcggaggttgtagccagcca

SEQ ID NO: 541503 - DNA, 25 bp, Rattus norvegicus
agccagccagggttgcgtggcgcaa

SEQ ID NO: 541504 - DNA, 25 bp, Rattus norvegicus
accgacacttcagcaggacgggcgc

SEQ ID NO: 541505 - DNA, 25 bp, Rattus norvegicus
gccgctggctactccggccaaaagg

SEQ ID NO: 541506 - DNA, 25 bp, Rattus norvegicus
ccgttgagcagtatctgtgccacct

SEQ ID NO: 541507 - DNA, 25 bp, Rattus norvegicus
cgccgcttgcgttgcccgttgagca

SEQ ID NO: 541508 - DNA, 25 bp, Rattus norvegicus
cactgtgtagttggtgcgtagctgc

SEQ ID NO: 541509 - DNA, 25 bp, Rattus norvegicus
agctcctcttctaagccgacagtgg

SEQ ID NO: 541510 - DNA, 25 bp, Rattus norvegicus
tgcgtagctgctgttcgcgccgcgt

SEQ ID NO: 541511 - DNA, 25 bp, Rattus norvegicus
gtatctgtgccaccttgcgctcgtg

SEQ ID NO: 541512 - DNA, 25 bp, Rattus norvegicus
taagccgacagtgggcagtgcctcc

SEQ ID NO: 541513 - DNA, 25 bp, Rattus norvegicus
catacccgttcatgcgaggcgtgtg

SEQ ID NO: 541514 - DNA, 25 bp, Rattus norvegicus
ctggagagtccatcgctattgcgct

SEQ ID NO: 541515 - DNA, 25 bp, Rattus norvegicus
aagtcacgcagatagtggtagtcca

SEQ ID NO: 541516 - DNA, 25 bp, Rattus norvegicus
tagtggtagtccaggcaatcgtaca

SEQ ID NO: 541517 - DNA, 25 bp, Rattus norvegicus
ggcaatcgtacagctcctcttctaa

SEQ ID NO: 541518 - DNA, 25 bp, Rattus norvegicus
ggcgtgcccatacccgttcatgcga

SEQ ID NO: 541519 - DNA, 25 bp, Rattus norvegicus
gccttcggagccctcaaactacgga

SEQ ID NO: 541520 - DNA, 25 bp, Rattus norvegicus
tcacccggccagaggggtcacacga

SEQ ID NO: 541521 - DNA, 25 bp, Rattus norvegicus
acgagaagtgcggattcggcttcca

SEQ ID NO: 541522 - DNA, 25 bp, Rattus norvegicus
ccacgtggcatcctaggtgtcccta

SEQ ID NO: 541523 - DNA, 25 bp, Rattus norvegicus
cacaggcgctggatatcattggatg

SEQ ID NO: 541524 - DNA, 25 bp, Rattus norvegicus
tcaaactacggaacgttgccctggc

SEQ ID NO: 541525 - DNA, 25 bp, Rattus norvegicus
tctcggggagtcctcagaagcggat

SEQ ID NO: 541526 - DNA, 25 bp, Rattus norvegicus
tggatgaatcagacatcaataacgg

SEQ ID NO: 541527 - DNA, 25 bp, Rattus norvegicus
atcagaactcaggagaggcacaggc

SEQ ID NO: 541528 - DNA, 25 bp, Rattus norvegicus
gcggagcctatgcacgtagccaatc

SEQ ID NO: 541529 - DNA, 25 bp, Rattus norvegicus
agcgcccagacacaacaaactcgga

SEQ ID NO: 541530 - DNA, 25 bp, Rattus norvegicus
ggtgtccctacgttcagcgcccaga

SEQ ID NO: 541531 - DNA, 25 bp, Rattus norvegicus
ccacgctgggaagttgcttggcgac

SEQ ID NO: 541532 - DNA, 25 bp, Rattus norvegicus
tcaataacgggcactgtccagccgc

SEQ ID NO: 541533 - DNA, 25 bp, Rattus norvegicus
ctccctggtggtttcggtagcaaat

SEQ ID NO: 541534 - DNA, 25 bp, Rattus norvegicus
tcatgctgcgcccaggctcctccgg

SEQ ID NO: 541535 - DNA, 25 bp, Rattus norvegicus
tccgagttgtaggttttggaggtga

SEQ ID NO: 541536 - DNA, 25 bp, Rattus norvegicus
ggctacggatctgggtattgggttc

SEQ ID NO: 541537 - DNA, 25 bp, Rattus norvegicus
tattgggttcggcagtgctacgtct

SEQ ID NO: 541538 - DNA, 25 bp, Rattus norvegicus
ttcggcagtgctacgtctcctgtta

SEQ ID NO: 541539 - DNA, 25 bp, Rattus norvegicus
tcctgttactctccctggtggtttc

SEQ ID NO: 541540 - DNA, 25 bp, Rattus norvegicus
gtggtttcggtagcaaatgattccc

SEQ ID NO: 541541 - DNA, 25 bp, Rattus norvegicus
tgttcctgtacaggaagctggctga

SEQ ID NO: 541542 - DNA, 25 bp, Rattus norvegicus
caaagtctcgttgttcctgtacagg

SEQ ID NO: 541543 - DNA, 25 bp, Rattus norvegicus
gcggctccgagtcaaagtctcgttg

SEQ ID NO: 541544 - DNA, 25 bp, Rattus norvegicus
tcccaaagcggctccgagtcaaagt

SEQ ID NO: 541545 - DNA, 25 bp, Rattus norvegicus
acgtctcctgttactctccctggtg

SEQ ID NO: 541546 - DNA, 25 bp, Rattus norvegicus
gcaaatgattcccaaagcggctccg

SEQ ID NO: 541547 - DNA, 25 bp, Rattus norvegicus
gccggcctccgagtcccaggcgacg

SEQ ID NO: 541548 - DNA, 25 bp, Rattus norvegicus
ccctgcactacagcggcctagcgcc

SEQ ID NO: 541549 - DNA, 25 bp, Rattus norvegicus
actacagcggcctagcgccctgccc

SEQ ID NO: 541550 - DNA, 25 bp, Rattus norvegicus
tcagcgacaccgaggcggtaggagc

SEQ ID NO: 541551 - DNA, 25 bp, Rattus norvegicus
cgaggcggtaggagcttcaggctcc

SEQ ID NO: 541552 - DNA, 25 bp, Rattus norvegicus
cttcaggctccggagcaagatggcg

SEQ ID NO: 541553 - DNA, 25 bp, Rattus norvegicus
cttaaatttgaaagcggagtggatt

SEQ ID NO: 541554 - DNA, 25 bp, Rattus norvegicus
ttcctgcccgggctccggtgagcag

SEQ ID NO: 541555 - DNA, 25 bp, Rattus norvegicus
ccttggggctcaaggtcacggtcct

SEQ ID NO: 541556 - DNA, 25 bp, Rattus norvegicus
ggctcaaggtcacggtcctgccggc

SEQ ID NO: 541557 - DNA, 25 bp, Rattus norvegicus
gacgcccgggatcgcgggccatgtc

SEQ ID NO: 541558 - DNA, 25 bp, Rattus norvegicus
agtagcgatgcctcgccccaggtcg

SEQ ID NO: 541559 - DNA, 25 bp, Rattus norvegicus
caggtcgcgaaagaatggcgggttc

SEQ ID NO: 541560 - DNA, 25 bp, Rattus norvegicus
tgctgctcgcgcgaggaggcctgct

SEQ ID NO: 541561 - DNA, 25 bp, Rattus norvegicus
gtggcattgccagctctggccacgc

SEQ ID NO: 541562 - DNA, 25 bp, Rattus norvegicus
agcgggcctcacttgtgcgcgcagt

SEQ ID NO: 541563 - DNA, 25 bp, Rattus norvegicus
tgacgggccgcgttgtttactggcc

SEQ ID NO: 541564 - DNA, 25 bp, Rattus norvegicus
tttactggccggagtcgagccctag

SEQ ID NO: 541565 - DNA, 25 bp, Rattus norvegicus
cgcaccttggtgagctctggactct

SEQ ID NO: 541566 - DNA, 25 bp, Rattus norvegicus
tctggactctgcgattgcggacaca

SEQ ID NO: 541567 - DNA, 25 bp, Rattus norvegicus
cgattgcggacacaggaccgggcct

SEQ ID NO: 541568 - DNA, 25 bp, Rattus norvegicus
gcgccacagtgttgcttgcagccga

SEQ ID NO: 541569 - DNA, 25 bp, Rattus norvegicus
cctgtgtgctcttcccaggactgtc

SEQ ID NO: 541570 - DNA, 25 bp, Rattus norvegicus
gcccgtaagccaccggcgtggaaga

SEQ ID NO: 541571 - DNA, 25 bp, Rattus norvegicus
tccagcgaccttctcgcggagtatg

SEQ ID NO: 541572 - DNA, 25 bp, Rattus norvegicus
gcgtgctctgatcgccggggtccca

SEQ ID NO: 541573 - DNA, 25 bp, Rattus norvegicus
gctcctactgctatgggctccggga

SEQ ID NO: 541574 - DNA, 25 bp, Rattus norvegicus
ggtcccagcgctcctactgctatgg

SEQ ID NO: 541575 - DNA, 25 bp, Rattus norvegicus
ggtcaatggccgcaaactccagtcg

SEQ ID NO: 541576 - DNA, 25 bp, Rattus norvegicus
tgcttcctgtcacgcccagtcgagt

SEQ ID NO: 541577 - DNA, 25 bp, Rattus norvegicus
atccctcacacacgagcagtagtgc

SEQ ID NO: 541578 - DNA, 25 bp, Rattus norvegicus
cttttcctgcaaaactggccgcgca

SEQ ID NO: 541579 - DNA, 25 bp, Rattus norvegicus
accgcaacgttgtgaggcgagcaca

SEQ ID NO: 541580 - DNA, 25 bp, Rattus norvegicus
tgcggattaccggagaacaagtttc

SEQ ID NO: 541581 - DNA, 25 bp, Rattus norvegicus
agtttctcggatgcgcaatgacgtc

SEQ ID NO: 541582 - DNA, 25 bp, Rattus norvegicus
agaccagcgtcaggataagccaatc

SEQ ID NO: 541583 - DNA, 25 bp, Rattus norvegicus
cgggccagatgcgtaagacttttcg

SEQ ID NO: 541584 - DNA, 25 bp, Rattus norvegicus
aagacccgcatagagcacgttgttc

SEQ ID NO: 541585 - DNA, 25 bp, Rattus norvegicus
gcggcggtgaagaccctaaatccca

SEQ ID NO: 541586 - DNA, 25 bp, Rattus norvegicus
cctgcaggatgttctgaggaccaac

SEQ ID NO: 541587 - DNA, 25 bp, Rattus norvegicus
caggccttcgcactagcattttcta

SEQ ID NO: 541588 - DNA, 25 bp, Rattus norvegicus
gccctaaaggcaccatgaagatgta

SEQ ID NO: 541589 - DNA, 25 bp, Rattus norvegicus
tcacccgggaagtgcggcttcggct

SEQ ID NO: 541590 - DNA, 25 bp, Rattus norvegicus
gggagtcctccccattagcggatcc

SEQ ID NO: 541591 - DNA, 25 bp, Rattus norvegicus
ccttcccgactgctcgctccgtctt

SEQ ID NO: 541592 - DNA, 25 bp, Rattus norvegicus
gtcttcccaccggtcgccttcgcag

SEQ ID NO: 541593 - DNA, 25 bp, Rattus norvegicus
cctcaagctacgaaatcgccctggc

SEQ ID NO: 541594 - DNA, 25 bp, Rattus norvegicus
cctggccgcccacgctcggtgccca

SEQ ID NO: 541595 - DNA, 25 bp, Rattus norvegicus
acgctcggtgcccagtcccgagggt

SEQ ID NO: 541596 - DNA, 25 bp, Rattus norvegicus
tcggtgcccagtcccgagggtctca

SEQ ID NO: 541597 - DNA, 25 bp, Rattus norvegicus
agtcccgagggtctcacctggccgg

SEQ ID NO: 541598 - DNA, 25 bp, Rattus norvegicus
tcacctggccggaggagtcacccgg

SEQ ID NO: 541599 - DNA, 25 bp, Rattus norvegicus
actgctcgctccgtcttcccaccgg

SEQ ID NO: 541600 - DNA, 25 bp, Rattus norvegicus
ccgggaagtgcggcttcggcttcca

SEQ ID NO: 541601 - DNA, 25 bp, Rattus norvegicus
tcccgagggtctcacctggccggag

SEQ ID NO: 541602 - DNA, 25 bp, Rattus norvegicus
tcgcagccctcaagctacgaaatcg

SEQ ID NO: 541603 - DNA, 25 bp, Rattus norvegicus
cagcaacctttgctgccgtgcgggg

SEQ ID NO: 541604 - DNA, 25 bp, Rattus norvegicus
cgacgctgtgccaacggtaaaattt

SEQ ID NO: 541605 - DNA, 25 bp, Rattus norvegicus
gaaaccgcagcactacacgtacgta

SEQ ID NO: 541606 - DNA, 25 bp, Rattus norvegicus
ggccgctaccgctcaggtgctgcag

SEQ ID NO: 541607 - DNA, 25 bp, Rattus norvegicus
aagacaggaccatgtcgaagggccc

SEQ ID NO: 541608 - DNA, 25 bp, Rattus norvegicus
cgaagaggcaggaagacaggaccat

SEQ ID NO: 541609 - DNA, 25 bp, Rattus norvegicus
cgcggaccgcgcagactgaataata

SEQ ID NO: 541610 - DNA, 25 bp, Rattus norvegicus
cttgcactttagcagcgacgctgtg

SEQ ID NO: 541611 - DNA, 25 bp, Rattus norvegicus
tcacccgaaaggaggaccacaactc

SEQ ID NO: 541612 - DNA, 25 bp, Rattus norvegicus
ggatcctcagcatccgggacaccgt

SEQ ID NO: 541613 - DNA, 25 bp, Rattus norvegicus
ggacaccgtccgcaaagatctctgg

SEQ ID NO: 541614 - DNA, 25 bp, Rattus norvegicus
atctctgggtattgtggtcttgcac

SEQ ID NO: 541615 - DNA, 25 bp, Rattus norvegicus
tcagcggccagcgtgagtcacgcgc

SEQ ID NO: 541616 - DNA, 25 bp, Rattus norvegicus
ctgaataataaaaggggagcggcga

SEQ ID NO: 541617 - DNA, 25 bp, Rattus norvegicus
cggctcaccgtgtaacccggagatc

SEQ ID NO: 541618 - DNA, 25 bp, Rattus norvegicus
agggcacaagtctggcagcccgatg

SEQ ID NO: 541619 - DNA, 25 bp, Rattus norvegicus
tctggcagcccgatggcgggatact

SEQ ID NO: 541620 - DNA, 25 bp, Rattus norvegicus
cccgtgtgcaagttctgcccgagaa

SEQ ID NO: 541621 - DNA, 25 bp, Rattus norvegicus
aaacactccggaacggctcaccgtg

SEQ ID NO: 541622 - DNA, 25 bp, Rattus norvegicus
tctgcccgagaaaagctttgggctg

SEQ ID NO: 541623 - DNA, 25 bp, Rattus norvegicus
ctcaccgtgtaacccggagatccgg

SEQ ID NO: 541624 - DNA, 25 bp, Rattus norvegicus
cggaatggaacaccgcggaaacgat

SEQ ID NO: 541625 - DNA, 25 bp, Rattus norvegicus
cgatccgttccggaatccggacatg

SEQ ID NO: 541626 - DNA, 25 bp, Rattus norvegicus
tccggaatccggacatggtgagtcg

SEQ ID NO: 541627 - DNA, 25 bp, Rattus norvegicus
tttgctgtagctgcagccgtgcagg

SEQ ID NO: 541628 - DNA, 25 bp, Rattus norvegicus
gcgagtcccgggtcgactccttctg

SEQ ID NO: 541629 - DNA, 25 bp, Rattus norvegicus
tcgactccttctggggcggctcttt

SEQ ID NO: 541630 - DNA, 25 bp, Rattus norvegicus
tgtgcaagttctgcccgagaaaagc

SEQ ID NO: 541631 - DNA, 25 bp, Rattus norvegicus
ctccaagaacaagggagagtctccc

SEQ ID NO: 541632 - DNA, 25 bp, Rattus norvegicus
tttgacacggcagaggttgtcaccc

SEQ ID NO: 541633 - DNA, 25 bp, Rattus norvegicus
taataagatatagccacgcccactc

SEQ ID NO: 541634 - DNA, 25 bp, Rattus norvegicus
gcacgctgtgcagaaagctcttcca

SEQ ID NO: 541635 - DNA, 25 bp, Rattus norvegicus
ccgtgtaatgtgctggaaaggtttg

SEQ ID NO: 541636 - DNA, 25 bp, Rattus norvegicus
gcgcacgaccgcacggaacgggaaa

SEQ ID NO: 541637 - DNA, 25 bp, Rattus norvegicus
gaccggtgtcctcctagatcttcaa

SEQ ID NO: 541638 - DNA, 25 bp, Rattus norvegicus
ggattcgcgcacctctccaagaaca

SEQ ID NO: 541639 - DNA, 25 bp, Rattus norvegicus
tccaacgtcctcagcggggcaaact

SEQ ID NO: 541640 - DNA, 25 bp, Rattus norvegicus
ccagcataagcaacagcggcggcaa

SEQ ID NO: 541641 - DNA, 25 bp, Rattus norvegicus
gtctctgtggagctgcttttaacca

SEQ ID NO: 541642 - DNA, 25 bp, Rattus norvegicus
tctgtcttggaaatgggtcgccctc

SEQ ID NO: 541643 - DNA, 25 bp, Rattus norvegicus
ggcagggccatgctaatgtatgcta

SEQ ID NO: 541644 - DNA, 25 bp, Rattus norvegicus
gggtctccgcactagccagcagcta

SEQ ID NO: 541645 - DNA, 25 bp, Rattus norvegicus
agccgccatagcgagccacaaaatg

SEQ ID NO: 541646 - DNA, 25 bp, Rattus norvegicus
tcaagccggccagagacagttcagg

SEQ ID NO: 541647 - DNA, 25 bp, Rattus norvegicus
gtttcggaggaacaaaagcgcactc

SEQ ID NO: 541648 - DNA, 25 bp, Rattus norvegicus
cggtcctggccatcaagtcaacatc

SEQ ID NO: 541649 - DNA, 25 bp, Rattus norvegicus
aaccgacctgtcgatgaggatcttg

SEQ ID NO: 541650 - DNA, 25 bp, Rattus norvegicus
gtgctgtccctgttcttgggccaaa

SEQ ID NO: 541651 - DNA, 25 bp, Rattus norvegicus
cgtcgcggaacaacttgcaggcata

SEQ ID NO: 541652 - DNA, 25 bp, Rattus norvegicus
gcaccgtacatgacagcgtccacga

SEQ ID NO: 541653 - DNA, 25 bp, Rattus norvegicus
aggcgccgcatcctcttcgtaactt

SEQ ID NO: 541654 - DNA, 25 bp, Rattus norvegicus
ttcgccacgatcacaagccgtttga

SEQ ID NO: 541655 - DNA, 25 bp, Rattus norvegicus
agcccgcactttccggaagtagtag

SEQ ID NO: 541656 - DNA, 25 bp, Rattus norvegicus
cagttcaggctaactcacggggtcc

SEQ ID NO: 541657 - DNA, 25 bp, Rattus norvegicus
tcacggggtccaaaagaagcttcta

SEQ ID NO: 541658 - DNA, 25 bp, Rattus norvegicus
ctgtgccgaacaacgtccctgatgc

SEQ ID NO: 541659 - DNA, 25 bp, Rattus norvegicus
caagtggcgcttcacgaacgtcgtc

SEQ ID NO: 541660 - DNA, 25 bp, Rattus norvegicus
tggcggaagcgcgattcaaatgccg

SEQ ID NO: 541661 - DNA, 25 bp, Rattus norvegicus
gcgcctgtccgactgaagctggaaa

SEQ ID NO: 541662 - DNA, 25 bp, Rattus norvegicus
ttccagaagagtctccgcgcctgtc

SEQ ID NO: 541663 - DNA, 25 bp, Rattus norvegicus
gcctcgctgctaccttccagaagag

SEQ ID NO: 541664 - DNA, 25 bp, Rattus norvegicus
ttgaactggacctgcggctctccct

SEQ ID NO: 541665 - DNA, 25 bp, Rattus norvegicus
cttctctgtcgcttgttgttgctta

SEQ ID NO: 541666 - DNA, 25 bp, Rattus norvegicus
cgcccaccaggacgagctaaagaga

SEQ ID NO: 541667 - DNA, 25 bp, Rattus norvegicus
ttcaaatgccggagacgcagcggac

SEQ ID NO: 541668 - DNA, 25 bp, Rattus norvegicus
tcttctcaaactcgcccgtcaagtg

SEQ ID NO: 541669 - DNA, 25 bp, Rattus norvegicus
gtccgcagacacagaagatctcgcg

SEQ ID NO: 541670 - DNA, 25 bp, Rattus norvegicus
gaacgcgcacgcagccagaacagga

SEQ ID NO: 541671 - DNA, 25 bp, Rattus norvegicus
tccctaaggcctgtgtccgcagaca

SEQ ID NO: 541672 - DNA, 25 bp, Rattus norvegicus
gtccgtacacgcaccttgaactgga

SEQ ID NO: 541673 - DNA, 25 bp, Rattus norvegicus
atgcgggaccggctgccggacctca

SEQ ID NO: 541674 - DNA, 25 bp, Rattus norvegicus
cagaaagccgcatagcggtccgggc

SEQ ID NO: 541675 - DNA, 25 bp, Rattus norvegicus
agcagaaagccgcatagcggtccgg

SEQ ID NO: 541676 - DNA, 25 bp, Rattus norvegicus
acggcggtgagcagaaagccgcata

SEQ ID NO: 541677 - DNA, 25 bp, Rattus norvegicus
tcacggcggtgagcagaaagccgca

SEQ ID NO: 541678 - DNA, 25 bp, Rattus norvegicus
ctcacggcggtgagcagaaagccgc

SEQ ID NO: 541679 - DNA, 25 bp, Rattus norvegicus
ccacccgagagtgtgcggcggggca

SEQ ID NO: 541680 - DNA, 25 bp, Rattus norvegicus
ctgccggacctcacggcggtgagca

SEQ ID NO: 541681 - DNA, 25 bp, Rattus norvegicus
aagcgcagagagtgcgggcgcggtt

SEQ ID NO: 541682 - DNA, 25 bp, Rattus norvegicus
ctccgccctgctggctggtggggat

SEQ ID NO: 541683 - DNA, 25 bp, Rattus norvegicus
acgcggccacccgagagtgtgcggc

SEQ ID NO: 541684 - DNA, 25 bp, Rattus norvegicus
acctcacggcggtgagcagaaagcc

SEQ ID NO: 541685 - DNA, 25 bp, Rattus norvegicus
gttgccgtggcagcgcctgcccgag

SEQ ID NO: 541686 - DNA, 25 bp, Rattus norvegicus
caggcgcaagcgcagagagtgcggg

SEQ ID NO: 541687 - DNA, 25 bp, Rattus norvegicus
cgaggccagcgatcacgaagatttt

SEQ ID NO: 541688 - DNA, 25 bp, Rattus norvegicus
ccgtgctcatccttttgttggtttt

SEQ ID NO: 541689 - DNA, 25 bp, Rattus norvegicus
gcttgccaaaccaatccgtgctcat

SEQ ID NO: 541690 - DNA, 25 bp, Rattus norvegicus
tggtgtgtcaagtaaccatcctccc

SEQ ID NO: 541691 - DNA, 25 bp, Rattus norvegicus
agacggccctttggtgtgtcaagta

SEQ ID NO: 541692 - DNA, 25 bp, Rattus norvegicus
gggcagctgagcgtctcacacagcc

SEQ ID NO: 541693 - DNA, 25 bp, Rattus norvegicus
aagcccagctatgcccgacagtagg

SEQ ID NO: 541694 - DNA, 25 bp, Rattus norvegicus
cacgaagattttcggggtgtctgga

SEQ ID NO: 541695 - DNA, 25 bp, Rattus norvegicus
tcaggagcgatgacacccagcccag

SEQ ID NO: 541696 - DNA, 25 bp, Rattus norvegicus
cagtgacgtcatcaggagcgatgac

SEQ ID NO: 541697 - DNA, 25 bp, Rattus norvegicus
cgacaaagcagcatcgaagaggact

SEQ ID NO: 541698 - DNA, 25 bp, Rattus norvegicus
cggaggacgctgacccgacaaagca

SEQ ID NO: 541699 - DNA, 25 bp, Rattus norvegicus
ctttggttccggttttggcgtgcat

SEQ ID NO: 541700 - DNA, 25 bp, Rattus norvegicus
ggtgtctggaggaaaagcccagcta

SEQ ID NO: 541701 - DNA, 25 bp, Rattus norvegicus
caccagcgtggtgctggacccacta

SEQ ID NO: 541702 - DNA, 25 bp, Rattus norvegicus
tgtctacccgcgtggggaagcacac

SEQ ID NO: 541703 - DNA, 25 bp, Rattus norvegicus
gcgtggggaagcacacgtcctatta

SEQ ID NO: 541704 - DNA, 25 bp, Rattus norvegicus
gggaagcacacgtcctattatgcta

SEQ ID NO: 541705 - DNA, 25 bp, Rattus norvegicus
agtccccctctgtgggcgactgctg

SEQ ID NO: 541706 - DNA, 25 bp, Rattus norvegicus
cctattatgctacaccagcgtggtg

SEQ ID NO: 541707 - DNA, 25 bp, Rattus norvegicus
agcctctcgtgtctacccgcgtggg

SEQ ID NO: 541708 - DNA, 25 bp, Rattus norvegicus
cgtggtgctggacccactagaagca

SEQ ID NO: 541709 - DNA, 25 bp, Rattus norvegicus
tggacccactagaagcaccgagccg

SEQ ID NO: 541710 - DNA, 25 bp, Rattus norvegicus
tgctccctgcttaccttgtgacttg

SEQ ID NO: 541711 - DNA, 25 bp, Rattus norvegicus
accttgtgacttggacgtggctccg

SEQ ID NO: 541712 - DNA, 25 bp, Rattus norvegicus
ttgtgacttggacgtggctccgact

SEQ ID NO: 541713 - DNA, 25 bp, Rattus norvegicus
ttggacgtggctccgactaccattc

SEQ ID NO: 541714 - DNA, 25 bp, Rattus norvegicus
acacgtcctattatgctacaccagc

SEQ ID NO: 541715 - DNA, 25 bp, Rattus norvegicus
aacacgtgctgggtcctgattggct

SEQ ID NO: 541716 - DNA, 25 bp, Rattus norvegicus
agggctgccaccacctcgcactgct

SEQ ID NO: 541717 - DNA, 25 bp, Rattus norvegicus
aggcgaacacgtgctgggtcctgat

SEQ ID NO: 541718 - DNA, 25 bp, Rattus norvegicus
tctgggttaacggtgaggcgaacac

SEQ ID NO: 541719 - DNA, 25 bp, Rattus norvegicus
ccgcagacctctgggttaacggtga

SEQ ID NO: 541720 - DNA, 25 bp, Rattus norvegicus
gagctacctccgcagacctctgggt

SEQ ID NO: 541721 - DNA, 25 bp, Rattus norvegicus
acctcccgcgggcacctgctaacag

SEQ ID NO: 541722 - DNA, 25 bp, Rattus norvegicus
ctgcagcaggcttctcgcgggcgca

SEQ ID NO: 541723 - DNA, 25 bp, Rattus norvegicus
cgggtcgctgcagcaggcttctcgc

SEQ ID NO: 541724 - DNA, 25 bp, Rattus norvegicus
tgaggctcctcacgccgggtcgctg

SEQ ID NO: 541725 - DNA, 25 bp, Rattus norvegicus
gtgctcagcacgcttaggtccgcag

SEQ ID NO: 541726 - DNA, 25 bp, Rattus norvegicus
gcagcgtctggtcctatcttggccc

SEQ ID NO: 541727 - DNA, 25 bp, Rattus norvegicus
tggtccagcagcgtctggtcctatc

SEQ ID NO: 541728 - DNA, 25 bp, Rattus norvegicus
ccgcacaggcctccgggagctacct

SEQ ID NO: 541729 - DNA, 25 bp, Rattus norvegicus
ggccttcgcgggtcagtagcactca

SEQ ID NO: 541730 - DNA, 25 bp, Rattus norvegicus
ctacgtgattttcgtcaagaccctg

SEQ ID NO: 541731 - DNA, 25 bp, Rattus norvegicus
tgattttcgtcaagaccctgctgtg

SEQ ID NO: 541732 - DNA, 25 bp, Rattus norvegicus
gtcacgtccaccacctgcacttgcg

SEQ ID NO: 541733 - DNA, 25 bp, Rattus norvegicus
aagaccctgctgtgcctgcggcctt

SEQ ID NO: 541734 - DNA, 25 bp, Rattus norvegicus
ggtcagtagcactcagcaggcgctc

SEQ ID NO: 541735 - DNA, 25 bp, Rattus norvegicus
agcaggcgctctgcaccagttcttg

SEQ ID NO: 541736 - DNA, 25 bp, Rattus norvegicus
accagttcttgggtgacagacactc

SEQ ID NO: 541737 - DNA, 25 bp, Rattus norvegicus
cttgggtgacagacactcctgtggc

SEQ ID NO: 541738 - DNA, 25 bp, Rattus norvegicus
acagacactcctgtggcgcagggcc

SEQ ID NO: 541739 - DNA, 25 bp, Rattus norvegicus
cagggcccgttcacaagtccggatt

SEQ ID NO: 541740 - DNA, 25 bp, Rattus norvegicus
cccgcgcattttcctgtcacgtcca

SEQ ID NO: 541741 - DNA, 25 bp, Rattus norvegicus
gcgctctgcaccagttcttgggtga

SEQ ID NO: 541742 - DNA, 25 bp, Rattus norvegicus
ttcgtcaagaccctgctgtgcctgc

SEQ ID NO: 541743 - DNA, 25 bp, Rattus norvegicus
cgttaagtttgcaaaatctcgtgcc

SEQ ID NO: 541744 - DNA, 25 bp, Rattus norvegicus
caccacccgacctggaatccagcgg

SEQ ID NO: 541745 - DNA, 25 bp, Rattus norvegicus
ggcgatcccgtaaggtctgcaccta

SEQ ID NO: 541746 - DNA, 25 bp, Rattus norvegicus
gtctgcacctaggagaggctctctg

SEQ ID NO: 541747 - DNA, 25 bp, Rattus norvegicus
aggctctctggggtgtcccagaccc

SEQ ID NO: 541748 - DNA, 25 bp, Rattus norvegicus
tgtcccagctgaagaatagggagcc

SEQ ID NO: 541749 - DNA, 25 bp, Rattus norvegicus
aggaatacgcctcgcactctgcatt

SEQ ID NO: 541750 - DNA, 25 bp, Rattus norvegicus
actctgcattcctagcgtcgccttt

SEQ ID NO: 541751 - DNA, 25 bp, Rattus norvegicus
ctagcgtcgcctttttgcaaaacgt

SEQ ID NO: 541752 - DNA, 25 bp, Rattus norvegicus
ttgcaaaatctcgtgccttccaggg

SEQ ID NO: 541753 - DNA, 25 bp, Rattus norvegicus
cttccagggcgatcccgtaaggtct

SEQ ID NO: 541754 - DNA, 25 bp, Rattus norvegicus
ctgaagaatagggagcccagagccc

SEQ ID NO: 541755 - DNA, 25 bp, Rattus norvegicus
aatctcgtgccttccagggcgatcc

SEQ ID NO: 541756 - DNA, 25 bp, Rattus norvegicus
tcctagcgtcgcctttttgcaaaac

SEQ ID NO: 541757 - DNA, 25 bp, Rattus norvegicus
caccaggatccttccgccgtgtttt

SEQ ID NO: 541758 - DNA, 25 bp, Rattus norvegicus
gtcagccaatcatagctcgtccgcg

SEQ ID NO: 541759 - DNA, 25 bp, Rattus norvegicus
cgttcgtattacagtcagccaatca

SEQ ID NO: 541760 - DNA, 25 bp, Rattus norvegicus
gcctctagtggcgtcgttcgtatta

SEQ ID NO: 541761 - DNA, 25 bp, Rattus norvegicus
gcgctggtctttggcccgcctctag

SEQ ID NO: 541762 - DNA, 25 bp, Rattus norvegicus
atgccctgcgcttgcgctggtcttt

SEQ ID NO: 541763 - DNA, 25 bp, Rattus norvegicus
cgagactcgcaatgccctgcgcttg

SEQ ID NO: 541764 - DNA, 25 bp, Rattus norvegicus
catagtctctccacaggggtcccga

SEQ ID NO: 541765 - DNA, 25 bp, Rattus norvegicus
cttgttgagcgccatagtctctcca

SEQ ID NO: 541766 - DNA, 25 bp, Rattus norvegicus
gtgattcttgttgagcgccatagtc

SEQ ID NO: 541767 - DNA, 25 bp, Rattus norvegicus
ccgccctctgagtgattcttgttga

SEQ ID NO: 541768 - DNA, 25 bp, Rattus norvegicus
tgttgttgacgatcactccgccgcc

SEQ ID NO: 541769 - DNA, 25 bp, Rattus norvegicus
gccgtgttttcacctctcagtgttg

SEQ ID NO: 541770 - DNA, 25 bp, Rattus norvegicus
cacctctcagtgttgttgacgatca

SEQ ID NO: 541771 - DNA, 25 bp, Rattus norvegicus
ccgcagctgttttgagctcggcgtc

SEQ ID NO: 541772 - DNA, 25 bp, Rattus norvegicus
tctgcgcgcaaactttggcctcttc

SEQ ID NO: 541773 - DNA, 25 bp, Rattus norvegicus
gcgcatgcccatccagtctggctgg

SEQ ID NO: 541774 - DNA, 25 bp, Rattus norvegicus
cctgcagcatcagccacaggcgtgg

SEQ ID NO: 541775 - DNA, 25 bp, Rattus norvegicus
atggccgcgcacgaacccatcatta

SEQ ID NO: 541776 - DNA, 25 bp, Rattus norvegicus
gggcgctctaagtccatggagctga

SEQ ID NO: 541777 - DNA, 25 bp, Rattus norvegicus
acttgccgtctccagggcgctctaa

SEQ ID NO: 541778 - DNA, 25 bp, Rattus norvegicus
tgggaatctccaccggctggcactt

SEQ ID NO: 541779 - DNA, 25 bp, Rattus norvegicus
gccgatgtccttgcacatgggaatc

SEQ ID NO: 541780 - DNA, 25 bp, Rattus norvegicus
gctggttctcgtggcccatcaggtt

SEQ ID NO: 541781 - DNA, 25 bp, Rattus norvegicus
actcatgcagttggatggccgcctc

SEQ ID NO: 541782 - DNA, 25 bp, Rattus norvegicus
agccgtactccacgagcggcgcgaa

SEQ ID NO: 541783 - DNA, 25 bp, Rattus norvegicus
tgggcgcgtacagcgagcacaagaa

SEQ ID NO: 541784 - DNA, 25 bp, Rattus norvegicus
cccactgctgctttgcatcagaaag

SEQ ID NO: 541785 - DNA, 25 bp, Rattus norvegicus
ttgttccttgcaacgcccgtgcgca

SEQ ID NO: 541786 - DNA, 25 bp, Rattus norvegicus
gcgtttcatcagaccaggctccgtg

SEQ ID NO: 541787 - DNA, 25 bp, Rattus norvegicus
aggctccgtgctcgcgagctttatt

SEQ ID NO: 541788 - DNA, 25 bp, Rattus norvegicus
gtgctcgcgagctttattacagctt

SEQ ID NO: 541789 - DNA, 25 bp, Rattus norvegicus
cagctttattctgtactttataatc

SEQ ID NO: 541790 - DNA, 25 bp, Rattus norvegicus
tactttataatcacatctctccggg

SEQ ID NO: 541791 - DNA, 25 bp, Rattus norvegicus
acatctctccgggtgcgtgttttta

SEQ ID NO: 541792 - DNA, 25 bp, Rattus norvegicus
gcgtgtttttagaacgcgcagtttc

SEQ ID NO: 541793 - DNA, 25 bp, Rattus norvegicus
acgcgcagtttcctagggacgtccg

SEQ ID NO: 541794 - DNA, 25 bp, Rattus norvegicus
agggacgtccggcttttctctagat

SEQ ID NO: 541795 - DNA, 25 bp, Rattus norvegicus
gtccggcttttctctagatttcaaa

SEQ ID NO: 541796 - DNA, 25 bp, Rattus norvegicus
ttcaaatttattagcgtagacctgc

SEQ ID NO: 541797 - DNA, 25 bp, Rattus norvegicus
gacctgctcacgtgttgttccttgc

SEQ ID NO: 541798 - DNA, 25 bp, Rattus norvegicus
ttagcgtagacctgctcacgtgttg

SEQ ID NO: 541799 - DNA, 25 bp, Rattus norvegicus
aggcggcctctttgcgccatcctag

SEQ ID NO: 541800 - DNA, 25 bp, Rattus norvegicus
ggaccctgaatttccgcacgtgctg

SEQ ID NO: 541801 - DNA, 25 bp, Rattus norvegicus
tgcagcgaggcctttgctgagcctc

SEQ ID NO: 541802 - DNA, 25 bp, Rattus norvegicus
tgcccaaagcccatgactgcagcga

SEQ ID NO: 541803 - DNA, 25 bp, Rattus norvegicus
tggcagtagccacagaactcggacc

SEQ ID NO: 541804 - DNA, 25 bp, Rattus norvegicus
ccatcggatgcacccagactctttg

SEQ ID NO: 541805 - DNA, 25 bp, Rattus norvegicus
tccgcacgtgctggaccatcggatg

SEQ ID NO: 541806 - DNA, 25 bp, Rattus norvegicus
cccaggcgagggatgctcaggtccc

SEQ ID NO: 541807 - DNA, 25 bp, Rattus norvegicus
gctacagccagggactgggccacca

SEQ ID NO: 541808 - DNA, 25 bp, Rattus norvegicus
acaggagccgcatgtcgctacagcc

SEQ ID NO: 541809 - DNA, 25 bp, Rattus norvegicus
tgaggcctcagtactgccaggaaca

SEQ ID NO: 541810 - DNA, 25 bp, Rattus norvegicus
accgcgttgccagtgtgaggcctca

SEQ ID NO: 541811 - DNA, 25 bp, Rattus norvegicus
tgcgccatcctagggcacagacagg

SEQ ID NO: 541812 - DNA, 25 bp, Rattus norvegicus
tagaggtggattcggtcccgcccgc

SEQ ID NO: 541813 - DNA, 25 bp, Rattus norvegicus
gcactgctgctcttcatgggcctca

SEQ ID NO: 541814 - DNA, 25 bp, Rattus norvegicus
tacccgaacctaagccatgactttg

SEQ ID NO: 541815 - DNA, 25 bp, Rattus norvegicus
atcacaccctttggagcggatcagg

SEQ ID NO: 541816 - DNA, 25 bp, Rattus norvegicus
tcgcgctcttttctctgcggggatc

SEQ ID NO: 541817 - DNA, 25 bp, Rattus norvegicus
catgactttgctgcgtgtccgccgc

SEQ ID NO: 541818 - DNA, 25 bp, Rattus norvegicus
gttattcttgaatggcgcgccgttc

SEQ ID NO: 541819 - DNA, 25 bp, Rattus norvegicus
gcgtcacggccaacctagtgttatt

SEQ ID NO: 541820 - DNA, 25 bp, Rattus norvegicus
agagctcagcaaccgggtccttagg

SEQ ID NO: 541821 - DNA, 25 bp, Rattus norvegicus
tccaatagactagcggcggggactc

SEQ ID NO: 541822 - DNA, 25 bp, Rattus norvegicus
cactgtcaagtgaaaggaccgcttc

SEQ ID NO: 541823 - DNA, 25 bp, Rattus norvegicus
tccacggatctcaacaagccactgt

SEQ ID NO: 541824 - DNA, 25 bp, Rattus norvegicus
cctcggagcatagggctcgagtttc

SEQ ID NO: 541825 - DNA, 25 bp, Rattus norvegicus
cgtggaactcctccagcaatcggaa

SEQ ID NO: 541826 - DNA, 25 bp, Rattus norvegicus
gtggccacggtcaaggccaacatca

SEQ ID NO: 541827 - DNA, 25 bp, Rattus norvegicus
ctaacggcggagtcgctggaaacca

SEQ ID NO: 541828 - DNA, 25 bp, Rattus norvegicus
ttagcgaccataagcggcaacgagc

SEQ ID NO: 541829 - DNA, 25 bp, Rattus norvegicus
cgaccgggctcacacaagagtaata

SEQ ID NO: 541830 - DNA, 25 bp, Rattus norvegicus
aagccagcggcttagatcttccagc

SEQ ID NO: 541831 - DNA, 25 bp, Rattus norvegicus
agccggtttgcacaagcctccagaa

SEQ ID NO: 541832 - DNA, 25 bp, Rattus norvegicus
gctgtctccgtagctggaggctcaa

SEQ ID NO: 541833 - DNA, 25 bp, Rattus norvegicus
ccagagcggtccgatgctttcaacg

SEQ ID NO: 541834 - DNA, 25 bp, Rattus norvegicus
gccaccgctcggtctaatatggggt

SEQ ID NO: 541835 - DNA, 25 bp, Rattus norvegicus
ccgagtacggtagctgcacagagtc

SEQ ID NO: 541836 - DNA, 25 bp, Rattus norvegicus
ggtgtatagccctgacccagagtcc

SEQ ID NO: 541837 - DNA, 25 bp, Rattus norvegicus
cggcggatccctaaccgtggctcaa

SEQ ID NO: 541838 - DNA, 25 bp, Rattus norvegicus
ccgtggctcaaatgctccaagctga

SEQ ID NO: 541839 - DNA, 25 bp, Rattus norvegicus
ggacaacttttctcgggctgcaacc

SEQ ID NO: 541840 - DNA, 25 bp, Rattus norvegicus
tcgcggactctaagtgcctgaagcc

SEQ ID NO: 541841 - DNA, 25 bp, Rattus norvegicus
cccgggacttgggacccaggcagca

SEQ ID NO: 541842 - DNA, 25 bp, Rattus norvegicus
cccagcgcgcgtaccatcccgccgc

SEQ ID NO: 541843 - DNA, 25 bp, Rattus norvegicus
ttccggggagccctgcctgtggctc

SEQ ID NO: 541844 - DNA, 25 bp, Rattus norvegicus
tcccggagccccaaaaggatgcgaa

SEQ ID NO: 541845 - DNA, 25 bp, Rattus norvegicus
cccaaaaggatgcgaagggcagctg

SEQ ID NO: 541846 - DNA, 25 bp, Rattus norvegicus
gactggagaggaggcaaaggagacg

SEQ ID NO: 541847 - DNA, 25 bp, Rattus norvegicus
aggcaaaggagacgcgcgcggggtt

SEQ ID NO: 541848 - DNA, 25 bp, Rattus norvegicus
tgggacccaggcagcaactttgcgc

SEQ ID NO: 541849 - DNA, 25 bp, Rattus norvegicus
gacccaggcagcaactttgcgcgcg

SEQ ID NO: 541850 - DNA, 25 bp, Rattus norvegicus
cccaggcagcaactttgcgcgcggg

SEQ ID NO: 541851 - DNA, 25 bp, Rattus norvegicus
ggccgcgttacctgcgcagcggagc

SEQ ID NO: 541852 - DNA, 25 bp, Rattus norvegicus
ctgggtaccgggcatcgtgagaagg

SEQ ID NO: 541853 - DNA, 25 bp, Rattus norvegicus
gcccgcatggtcctcccgggagccg

SEQ ID NO: 541854 - DNA, 25 bp, Rattus norvegicus
gacttgggacccaggcagcaacttt

SEQ ID NO: 541855 - DNA, 25 bp, Rattus norvegicus
agacggttttccctggcatacgaga

SEQ ID NO: 541856 - DNA, 25 bp, Rattus norvegicus
catacgagagaagactgagcctggc

SEQ ID NO: 541857 - DNA, 25 bp, Rattus norvegicus
tcctgtacttgctgccgttctcgtc

SEQ ID NO: 541858 - DNA, 25 bp, Rattus norvegicus
tgctgccgttctcgtcgttccagaa

SEQ ID NO: 541859 - DNA, 25 bp, Rattus norvegicus
tctcgtcgttccagaagtgcgtggg

SEQ ID NO: 541860 - DNA, 25 bp, Rattus norvegicus
ttccctggcatacgagagaagactg

SEQ ID NO: 541861 - DNA, 25 bp, Rattus norvegicus
cagggtatgggcttggtgcaaacca

SEQ ID NO: 541862 - DNA, 25 bp, Rattus norvegicus
ttggtgcaaaccagctcgccactcg

SEQ ID NO: 541863 - DNA, 25 bp, Rattus norvegicus
cccggcacacgcttccttcctgacg

SEQ ID NO: 541864 - DNA, 25 bp, Rattus norvegicus
agcctggcgtgctcatgagtacacc

SEQ ID NO: 541865 - DNA, 25 bp, Rattus norvegicus
agccttcctgtacttgctgccgttc

SEQ ID NO: 541866 - DNA, 25 bp, Rattus norvegicus
tttggagaagtaagccttcctgtac

SEQ ID NO: 541867 - DNA, 25 bp, Rattus norvegicus
gcctacctgggtatttggagaagta

SEQ ID NO: 541868 - DNA, 25 bp, Rattus norvegicus
tgctcccgcctacctgggtatttgg

SEQ ID NO: 541869 - DNA, 25 bp, Rattus norvegicus
gcctgcgggacatccggcctagtca

SEQ ID NO: 541870 - DNA, 25 bp, Rattus norvegicus
caaaaagagtgctcgcctgcgcagg

SEQ ID NO: 541871 - DNA, 25 bp, Rattus norvegicus
ggtgcgcttgctgccaaaaagagtg

SEQ ID NO: 541872 - DNA, 25 bp, Rattus norvegicus
ctccagaaggccacgcctcttgaga

SEQ ID NO: 541873 - DNA, 25 bp, Rattus norvegicus
aaccacagcgcgagactgagccagc

SEQ ID NO: 541874 - DNA, 25 bp, Rattus norvegicus
cagcgtggcgcggacgaaccacagc

SEQ ID NO: 541875 - DNA, 25 bp, Rattus norvegicus
tgcccgggctttagctgcggagaca

SEQ ID NO: 541876 - DNA, 25 bp, Rattus norvegicus
ccagcttggacatggttgcggagct

SEQ ID NO: 541877 - DNA, 25 bp, Rattus norvegicus
cgctcgagccgtgccagcttggaca

SEQ ID NO: 541878 - DNA, 25 bp, Rattus norvegicus
tggcactccatgatctcctcgcgct

SEQ ID NO: 541879 - DNA, 25 bp, Rattus norvegicus
ttcttgctgtcaggctcccacatca

SEQ ID NO: 541880 - DNA, 25 bp, Rattus norvegicus
ctgcgtgtccttcttgctgtcaggc

SEQ ID NO: 541881 - DNA, 25 bp, Rattus norvegicus
aagcggtccatctgcgtgtccttct

SEQ ID NO: 541882 - DNA, 25 bp, Rattus norvegicus
cgcgcctgcaactggtgcgcttgct

SEQ ID NO: 541883 - DNA, 25 bp, Rattus norvegicus
tggtgcggcactggctccacatcag

SEQ ID NO: 541884 - DNA, 25 bp, Rattus norvegicus
ggcgcttgcaacacagccttaattg

SEQ ID NO: 541885 - DNA, 25 bp, Rattus norvegicus
agccttaattgaagcccgacggcgg

SEQ ID NO: 541886 - DNA, 25 bp, Rattus norvegicus
cccgacggcggggacatcaggttct

SEQ ID NO: 541887 - DNA, 25 bp, Rattus norvegicus
aggaatttctttccaagctggagta

SEQ ID NO: 541888 - DNA, 25 bp, Rattus norvegicus
catcccggcggagggattctgagca

SEQ ID NO: 541889 - DNA, 25 bp, Rattus norvegicus
attctgagcacaggcacgcgccaca

SEQ ID NO: 541890 - DNA, 25 bp, Rattus norvegicus
cgatttgcacgttgattggctggtg

SEQ ID NO: 541891 - DNA, 25 bp, Rattus norvegicus
gcgattcaggcgcttgcaacacagc

SEQ ID NO: 541892 - DNA, 25 bp, Rattus norvegicus
gaaccggccagaacggtagccaatc

SEQ ID NO: 541893 - DNA, 25 bp, Rattus norvegicus
gaacggtagccaatcacatgacatg

SEQ ID NO: 541894 - DNA, 25 bp, Rattus norvegicus
atcacatgacatgccggtgagtggg

SEQ ID NO: 541895 - DNA, 25 bp, Rattus norvegicus
agtgggctgcgtccctcagccaatc

SEQ ID NO: 541896 - DNA, 25 bp, Rattus norvegicus
gcgccacaagcgatttgcacgttga

SEQ ID NO: 541897 - DNA, 25 bp, Rattus norvegicus
cgcgcggagcacacgttctttcgtt

SEQ ID NO: 541898 - DNA, 25 bp, Rattus norvegicus
gcgcacgttgtcctctccgaagagg

SEQ ID NO: 541899 - DNA, 25 bp, Rattus norvegicus
aaaccgaagggcaggtgtgtgtcac

SEQ ID NO: 541900 - DNA, 25 bp, Rattus norvegicus
ggacccggacatctccagtgcctgg

SEQ ID NO: 541901 - DNA, 25 bp, Rattus norvegicus
ccgtagagcctgtggggcttgcaaa

SEQ ID NO: 541902 - DNA, 25 bp, Rattus norvegicus
ctccgaagaggctgctcacgctctg

SEQ ID NO: 541903 - DNA, 25 bp, Rattus norvegicus
actctgctgcacaccgtagagcctg

SEQ ID NO: 541904 - DNA, 25 bp, Rattus norvegicus
ctggagctgatagtaacgactctgc

SEQ ID NO: 541905 - DNA, 25 bp, Rattus norvegicus
tcacgctctgggagaagctgctcgt

SEQ ID NO: 541906 - DNA, 25 bp, Rattus norvegicus
ttgcaaaggctctctcctggtctgg

SEQ ID NO: 541907 - DNA, 25 bp, Rattus norvegicus
agtagaaccgacagcagcacccgca

SEQ ID NO: 541908 - DNA, 25 bp, Rattus norvegicus
gtgcctggctcatagtggtcgacta

SEQ ID NO: 541909 - DNA, 25 bp, Rattus norvegicus
caggagccaccagcgacagcagcag

SEQ ID NO: 541910 - DNA, 25 bp, Rattus norvegicus
tccctctgcaactctggagctgata

SEQ ID NO: 541911 - DNA, 25 bp, Rattus norvegicus
gcatggtcagcgtactccaggcaga

SEQ ID NO: 541912 - DNA, 25 bp, Rattus norvegicus
tgcagacagcatgagtgtgcgtttc

SEQ ID NO: 541913 - DNA, 25 bp, Rattus norvegicus
gcccattccactgcagacagcatga

SEQ ID NO: 541914 - DNA, 25 bp, Rattus norvegicus
gcagaaccagactgagtacccacgc

SEQ ID NO: 541915 - DNA, 25 bp, Rattus norvegicus
agcctccgaagaaggctcagcttcc

SEQ ID NO: 541916 - DNA, 25 bp, Rattus norvegicus
ccgggaggctttgagcctccgaaga

SEQ ID NO: 541917 - DNA, 25 bp, Rattus norvegicus
aaggccagggcatggtcagcgtact

SEQ ID NO: 541918 - DNA, 25 bp, Rattus norvegicus
ccctctcgaacagcgtagaaggcca

SEQ ID NO: 541919 - DNA, 25 bp, Rattus norvegicus
tggtcagcgtactccaggcagaccc

SEQ ID NO: 541920 - DNA, 25 bp, Rattus norvegicus
ccaaccgtaggcgaaaaggcatggg

SEQ ID NO: 541921 - DNA, 25 bp, Rattus norvegicus
acagcatgagtgtgcgtttcggccc

SEQ ID NO: 541922 - DNA, 25 bp, Rattus norvegicus
tagtggggcttccagcccgcagaac

SEQ ID NO: 541923 - DNA, 25 bp, Rattus norvegicus
ccagcccgcagaaccagactgagta

SEQ ID NO: 541924 - DNA, 25 bp, Rattus norvegicus
tctcgaacagcgtagaaggccaggg

SEQ ID NO: 541925 - DNA, 25 bp, Rattus norvegicus
gctgggaaatccaaacggggcctga

SEQ ID NO: 541926 - DNA, 25 bp, Rattus norvegicus
ctgaagtggtcgctgcagttcccac

SEQ ID NO: 541927 - DNA, 25 bp, Rattus norvegicus
cagccagcgacttccggttagggag

SEQ ID NO: 541928 - DNA, 25 bp, Rattus norvegicus
tgcgacgtcatttccggcagccagc

SEQ ID NO: 541929 - DNA, 25 bp, Rattus norvegicus
gcgcgaaaggctgcgacgtcatttc

SEQ ID NO: 541930 - DNA, 25 bp, Rattus norvegicus
gacagacgagttttcccgcgagcgc

SEQ ID NO: 541931 - DNA, 25 bp, Rattus norvegicus
gcgagcccgtcaccaagacagacga

SEQ ID NO: 541932 - DNA, 25 bp, Rattus norvegicus
cccagaggctcatggctgcttcaca

SEQ ID NO: 541933 - DNA, 25 bp, Rattus norvegicus
cggtatttgtccacccagaggctca

SEQ ID NO: 541934 - DNA, 25 bp, Rattus norvegicus
agctcggccggtatttgtccaccca

SEQ ID NO: 541935 - DNA, 25 bp, Rattus norvegicus
atagtccagccgtgcaagggagctc

SEQ ID NO: 541936 - DNA, 25 bp, Rattus norvegicus
gctgcctgctccttgtgatagtcca

SEQ ID NO: 541937 - DNA, 25 bp, Rattus norvegicus
tcggcttaccaggttgcgcagctgt

SEQ ID NO: 541938 - DNA, 25 bp, Rattus norvegicus
tgcgccactacaccaacagtcgttg

SEQ ID NO: 541939 - DNA, 25 bp, Rattus norvegicus
agccacgcgcgtggcgaaggaacca

SEQ ID NO: 541940 - DNA, 25 bp, Rattus norvegicus
gcaacccggaagtctcgcagcttgg

SEQ ID NO: 541941 - DNA, 25 bp, Rattus norvegicus
aagggtcctgaagcgcctcccgtgc

SEQ ID NO: 541942 - DNA, 25 bp, Rattus norvegicus
cgcctcttccgctaggacctccctt

SEQ ID NO: 541943 - DNA, 25 bp, Rattus norvegicus
cgacgccgctacaacgtgaaggggc

SEQ ID NO: 541944 - DNA, 25 bp, Rattus norvegicus
ctgcgacgccgctacaacgtgaagg

SEQ ID NO: 541945 - DNA, 25 bp, Rattus norvegicus
aaccatggggaagctgcgacgccgc

SEQ ID NO: 541946 - DNA, 25 bp, Rattus norvegicus
ggttcaggttcccagagagtttgtc

SEQ ID NO: 541947 - DNA, 25 bp, Rattus norvegicus
agtctcgcagcttggttcaggttcc

SEQ ID NO: 541948 - DNA, 25 bp, Rattus norvegicus
cctcagctgctgaagtgcggctctt

SEQ ID NO: 541949 - DNA, 25 bp, Rattus norvegicus
ttgcgcatgcgcaacccggaagtct

SEQ ID NO: 541950 - DNA, 25 bp, Rattus norvegicus
aagtgcggctcttgcgcatgcgcaa

SEQ ID NO: 541951 - DNA, 25 bp, Rattus norvegicus
gcagcttggttcaggttcccagaga

SEQ ID NO: 541952 - DNA, 25 bp, Rattus norvegicus
agagtttgtctgagtgagccacgcg

SEQ ID NO: 541953 - DNA, 25 bp, Rattus norvegicus
cgccagttccgtctctactcttttg

SEQ ID NO: 541954 - DNA, 25 bp, Rattus norvegicus
gttttagcgccgatcacgtcacagg

SEQ ID NO: 541955 - DNA, 25 bp, Rattus norvegicus
ggctcgcttagccacagtgcgcctg

SEQ ID NO: 541956 - DNA, 25 bp, Rattus norvegicus
gcctgtcgcttccattgcagagatt

SEQ ID NO: 541957 - DNA, 25 bp, Rattus norvegicus
gcagagattggaccgggcattaaaa

SEQ ID NO: 541958 - DNA, 25 bp, Rattus norvegicus
ccaaccgcatttccgcggaggaatc

SEQ ID NO: 541959 - DNA, 25 bp, Rattus norvegicus
gcggggctcccgatgactatataaa

SEQ ID NO: 541960 - DNA, 25 bp, Rattus norvegicus
gcagctagttccgtggagaccgcca

SEQ ID NO: 541961 - DNA, 25 bp, Rattus norvegicus
tactcttttgtgaggactgcagcca

SEQ ID NO: 541962 - DNA, 25 bp, Rattus norvegicus
aactgaattcggttggcgcgctgta

SEQ ID NO: 541963 - DNA, 25 bp, Rattus norvegicus
gcctctgatgtgagaactgtgggta

SEQ ID NO: 541964 - DNA, 25 bp, Rattus norvegicus
tccggaattcgtcggttgctaaata

SEQ ID NO: 541965 - DNA, 25 bp, Rattus norvegicus
gcgatcttaatggttttagcctgtc

SEQ ID NO: 541966 - DNA, 25 bp, Rattus norvegicus
actatataaagagacgcctcgcgtc

SEQ ID NO: 541967 - DNA, 25 bp, Rattus norvegicus
cctagccggaatcccgcgccgaaca

SEQ ID NO: 541968 - DNA, 25 bp, Rattus norvegicus
gacatgggcgtcagctccagggcac

SEQ ID NO: 541969 - DNA, 25 bp, Rattus norvegicus
cttcaggtcctgagcccagcgactc

SEQ ID NO: 541970 - DNA, 25 bp, Rattus norvegicus
cggtttctgtcatctctgtggcctc

SEQ ID NO: 541971 - DNA, 25 bp, Rattus norvegicus
gctgctcggtttctgtcatctctgt

SEQ ID NO: 541972 - DNA, 25 bp, Rattus norvegicus
ggcacacaccttgctgctcggtttc

SEQ ID NO: 541973 - DNA, 25 bp, Rattus norvegicus
actgtcaggcacacaccttgctgct

SEQ ID NO: 541974 - DNA, 25 bp, Rattus norvegicus
tgcagggctactgctgctctggcca

SEQ ID NO: 541975 - DNA, 25 bp, Rattus norvegicus
gcggctcccgacataggccacgccc

SEQ ID NO: 541976 - DNA, 25 bp, Rattus norvegicus
ctgcccgggccatggcgcataaaac

SEQ ID NO: 541977 - DNA, 25 bp, Rattus norvegicus
cgggccatggcgcataaaacctctg

SEQ ID NO: 541978 - DNA, 25 bp, Rattus norvegicus
acgcccacgcctcaccatcagagca

SEQ ID NO: 541979 - DNA, 25 bp, Rattus norvegicus
cataaaacctctggccacctgcagg

SEQ ID NO: 541980 - DNA, 25 bp, Rattus norvegicus
cacctgcagggctactgctgctctg

SEQ ID NO: 541981 - DNA, 25 bp, Rattus norvegicus
ctgactgatggactcgtgttttgga

SEQ ID NO: 541982 - DNA, 25 bp, Rattus norvegicus
actcgtgttttggagagggccagta

SEQ ID NO: 541983 - DNA, 25 bp, Rattus norvegicus
cgtagcctgaggactgactgatgga

SEQ ID NO: 541984 - DNA, 25 bp, Rattus norvegicus
gatcctgcagcatcagggtggcgta

SEQ ID NO: 541985 - DNA, 25 bp, Rattus norvegicus
tccggtatgttttgaaggccaggcc

SEQ ID NO: 541986 - DNA, 25 bp, Rattus norvegicus
tggttcaggtcaggattccggagtc

SEQ ID NO: 541987 - DNA, 25 bp, Rattus norvegicus
agatggcatcagctaagacccagga

SEQ ID NO: 541988 - DNA, 25 bp, Rattus norvegicus
ccaggactcggggaccttctgagat

SEQ ID NO: 541989 - DNA, 25 bp, Rattus norvegicus
tttagggtggtacaagccaggactc

SEQ ID NO: 541990 - DNA, 25 bp, Rattus norvegicus
gaccagggaccctctgggatgaagc

SEQ ID NO: 541991 - DNA, 25 bp, Rattus norvegicus
tggcacggcctgaaaactggggaac

SEQ ID NO: 541992 - DNA, 25 bp, Rattus norvegicus
tggagcaggccaagacttagggacc

SEQ ID NO: 541993 - DNA, 25 bp, Rattus norvegicus
cttcgggaactctcgggaccttgca

SEQ ID NO: 541994 - DNA, 25 bp, Rattus norvegicus
agagttaagcactccgccatgcgcg

SEQ ID NO: 541995 - DNA, 25 bp, Rattus norvegicus
cagcggggacccaacacaggatgac

SEQ ID NO: 541996 - DNA, 25 bp, Rattus norvegicus
cgtgtgtcagttgcacgcgtgcatc

SEQ ID NO: 541997 - DNA, 25 bp, Rattus norvegicus
cacaggatgaccaggcacctccatg

SEQ ID NO: 541998 - DNA, 25 bp, Rattus norvegicus
gtacagtgatcgtgtgtcagttgca

SEQ ID NO: 541999 - DNA, 25 bp, Rattus norvegicus
cagttgcacgcgtgcatctggggca

SEQ ID NO: 542000 - DNA, 25 bp, Rattus norvegicus
ggggacccaacacaggatgaccagg

SEQ ID NO: 542001 - DNA, 25 bp, Rattus norvegicus
aggatgaccaggcacctccatgcca

SEQ ID NO: 542002 - DNA, 25 bp, Rattus norvegicus
cttaccgcatttggaaccaaagtct

SEQ ID NO: 542003 - DNA, 25 bp, Rattus norvegicus
tttggaaccaaagtctaagctgagc

SEQ ID NO: 542004 - DNA, 25 bp, Rattus norvegicus
aaccaaagtctaagctgagctcgcg

SEQ ID NO: 542005 - DNA, 25 bp, Rattus norvegicus
agtctaagctgagctcgcggccctg

SEQ ID NO: 542006 - DNA, 25 bp, Rattus norvegicus
ctcgcgctctggacagacagacgtt

SEQ ID NO: 542007 - DNA, 25 bp, Rattus norvegicus
tggacagacagacgttcccagctta

SEQ ID NO: 542008 - DNA, 25 bp, Rattus norvegicus
gacagacgttcccagcttatcctgc

SEQ ID NO: 542009 - DNA, 25 bp, Rattus norvegicus
ccagggtcagctgactgcggtagct

SEQ ID NO: 542010 - DNA, 25 bp, Rattus norvegicus
tctctctgaggcgtaggtgacctcg

SEQ ID NO: 542011 - DNA, 25 bp, Rattus norvegicus
cgcggaagtatctctctgaggcgta

SEQ ID NO: 542012 - DNA, 25 bp, Rattus norvegicus
atcttgtcgcggaagtatctctctg

SEQ ID NO: 542013 - DNA, 25 bp, Rattus norvegicus
cgtagaagatcttgtcgcggaagta

SEQ ID NO: 542014 - DNA, 25 bp, Rattus norvegicus
ggcaccggagcgtagaagatcttgt

SEQ ID NO: 542015 - DNA, 25 bp, Rattus norvegicus
ctatggtctcgctgtaggctgtgac

SEQ ID NO: 542016 - DNA, 25 bp, Rattus norvegicus
gcgccgctactatggtctcgctgta

SEQ ID NO: 542017 - DNA, 25 bp, Rattus norvegicus
ctggcctaggctacagtgcagcgtg

SEQ ID NO: 542018 - DNA, 25 bp, Rattus norvegicus
ctgactgcggtagctcctccaagta

SEQ ID NO: 542019 - DNA, 25 bp, Rattus norvegicus
aagatgatggcggtgcttccgaagc

SEQ ID NO: 542020 - DNA, 25 bp, Rattus norvegicus
ttcgggccagtttggggaagatgat

SEQ ID NO: 542021 - DNA, 25 bp, Rattus norvegicus
cctaggctacagtgcagcgtggtgc

SEQ ID NO: 542022 - DNA, 25 bp, Rattus norvegicus
tccaagtacagttgggcgccgctac

SEQ ID NO: 542023 - DNA, 25 bp, Rattus norvegicus
ccaactcgctcccaagtgtggctga

SEQ ID NO: 542024 - DNA, 25 bp, Rattus norvegicus
cggcgtctcttgaggaccgtgccgc

SEQ ID NO: 542025 - DNA, 25 bp, Rattus norvegicus
cgggtgcgactagccggacagccaa

SEQ ID NO: 542026 - DNA, 25 bp, Rattus norvegicus
cctcagacatcctcgggtgcgacta

SEQ ID NO: 542027 - DNA, 25 bp, Rattus norvegicus
tctcactagcagaccgctgtcgcgt

SEQ ID NO: 542028 - DNA, 25 bp, Rattus norvegicus
tccgcagagagagcatcgatccgcc

SEQ ID NO: 542029 - DNA, 25 bp, Rattus norvegicus
agtgcgcttgcgtgttactaacatc

SEQ ID NO: 542030 - DNA, 25 bp, Rattus norvegicus
ttcctcaggggacacctcacaggtg

SEQ ID NO: 542031 - DNA, 25 bp, Rattus norvegicus
acacctaatacgatcggccggtcca

SEQ ID NO: 542032 - DNA, 25 bp, Rattus norvegicus
cccggctgaatgatgggttgttttc

SEQ ID NO: 542033 - DNA, 25 bp, Rattus norvegicus
actagggcctgcaccgcagcgggca

SEQ ID NO: 542034 - DNA, 25 bp, Rattus norvegicus
atccgcggggcctcttcagcttcgt

SEQ ID NO: 542035 - DNA, 25 bp, Rattus norvegicus
cgcctcggcccggacaacaatgggg

SEQ ID NO: 542036 - DNA, 25 bp, Rattus norvegicus
ttacccagggcaaccgcagtgcggc

SEQ ID NO: 542037 - DNA, 25 bp, Rattus norvegicus
ggacaagtcgccatgctcacctgga

SEQ ID NO: 542038 - DNA, 25 bp, Rattus norvegicus
atgttcagtttgagcccgttcggcg

SEQ ID NO: 542039 - DNA, 25 bp, Rattus norvegicus
ataggtcgccctcatgttcagtttg

SEQ ID NO: 542040 - DNA, 25 bp, Rattus norvegicus
ggagatcttgaaataggtcgccctc

SEQ ID NO: 542041 - DNA, 25 bp, Rattus norvegicus
ctccagcatatcgtgggagatcttg

SEQ ID NO: 542042 - DNA, 25 bp, Rattus norvegicus
ggacactgctccagcatatcgtggg

SEQ ID NO: 542043 - DNA, 25 bp, Rattus norvegicus
ccagcacgtagaccaggggcttgaa

SEQ ID NO: 542044 - DNA, 25 bp, Rattus norvegicus
tcctctcctgtaccacggcgtggaa

SEQ ID NO: 542045 - DNA, 25 bp, Rattus norvegicus
gttccagccgatcttgccaaacttc

SEQ ID NO: 542046 - DNA, 25 bp, Rattus norvegicus
gtagtacacgttccagccgatcttg

SEQ ID NO: 542047 - DNA, 25 bp, Rattus norvegicus
ctcattgaaatcgtagtacacgttc

SEQ ID NO: 542048 - DNA, 25 bp, Rattus norvegicus
cctggaagtcagactcattgaaatc

SEQ ID NO: 542049 - DNA, 25 bp, Rattus norvegicus
tcgccatgctcacctggaagtcaga

SEQ ID NO: 542050 - DNA, 25 bp, Rattus norvegicus
tgtaccacggcgtggaagaaggcca

SEQ ID NO: 542051 - DNA, 25 bp, Rattus norvegicus
cgcggtcccagtaaaagcgcagttg

SEQ ID NO: 542052 - DNA, 25 bp, Rattus norvegicus
cagaccacggaaggacaggacagta

SEQ ID NO: 542053 - DNA, 25 bp, Rattus norvegicus
aagaagccatagctggcagaccacg

SEQ ID NO: 542054 - DNA, 25 bp, Rattus norvegicus
aaactcccgggcctcgaggatgctg

SEQ ID NO: 542055 - DNA, 25 bp, Rattus norvegicus
agcgcagttggctctcccactcaaa

SEQ ID NO: 542056 - DNA, 25 bp, Rattus norvegicus
ggacagtaaagcgatcccacgaacc

SEQ ID NO: 542057 - DNA, 25 bp, Rattus norvegicus
gtcggatgttcagctcgtccggctc

SEQ ID NO: 542058 - DNA, 25 bp, Rattus norvegicus
cccgtgcactgtcggatgttcagct

SEQ ID NO: 542059 - DNA, 25 bp, Rattus norvegicus
actcgtagccatagccgaaggtccc

SEQ ID NO: 542060 - DNA, 25 bp, Rattus norvegicus
ccgttcaggcccatgtactcgtagc

SEQ ID NO: 542061 - DNA, 25 bp, Rattus norvegicus
cgtaagcgtcaggtagatgcggtcc

SEQ ID NO: 542062 - DNA, 25 bp, Rattus norvegicus
cccggatgaaggagtccacgatgtc

SEQ ID NO: 542063 - DNA, 25 bp, Rattus norvegicus
cccgggcgtgtacatcgatgatcag

SEQ ID NO: 542064 - DNA, 25 bp, Rattus norvegicus
gcgtgatgaccagcctcccgttcag

SEQ ID NO: 542065 - DNA, 25 bp, Rattus norvegicus
cggagctgcagcaactcggacagcg

SEQ ID NO: 542066 - DNA, 25 bp, Rattus norvegicus
cagcaactcggacagcgtgtggttc

SEQ ID NO: 542067 - DNA, 25 bp, Rattus norvegicus
cccgatgctcctgagtggcgcaggc

SEQ ID NO: 542068 - DNA, 25 bp, Rattus norvegicus
ccacctcctgaagcgcgcgctcctg

SEQ ID NO: 542069 - DNA, 25 bp, Rattus norvegicus
cgctccacgcggcagtagcgctcca

SEQ ID NO: 542070 - DNA, 25 bp, Rattus norvegicus
ctgctccagcggcacgagctcgtgg

SEQ ID NO: 542071 - DNA, 25 bp, Rattus norvegicus
gccgtcgggaaaaggctcctggcaa

SEQ ID NO: 542072 - DNA, 25 bp, Rattus norvegicus
tcgggaaaaggctcctggcaaagtg

SEQ ID NO: 542073 - DNA, 25 bp, Rattus norvegicus
ccagagcgcgcccaggcaagcgaga

SEQ ID NO: 542074 - DNA, 25 bp, Rattus norvegicus
cccaggcaagcgagacagaagttgt

SEQ ID NO: 542075 - DNA, 25 bp, Rattus norvegicus
gccgcagggtagtgtcaccggctcc

SEQ ID NO: 542076 - DNA, 25 bp, Rattus norvegicus
gaaaggcccgctgccgtccatggct

SEQ ID NO: 542077 - DNA, 25 bp, Rattus norvegicus
cgccgcacccatcggtcagcagatg

SEQ ID NO: 542078 - DNA, 25 bp, Rattus norvegicus
tggcgcaggcctcgcaaaggcacac

SEQ ID NO: 542079 - DNA, 25 bp, Rattus norvegicus
aacggcatagggtcggtgatattga

SEQ ID NO: 542080 - DNA, 25 bp, Rattus norvegicus
cctagcaacgggcacctgggcaacg

SEQ ID NO: 542081 - DNA, 25 bp, Rattus norvegicus
agaacaccgcggaggcgttgtcctc

SEQ ID NO: 542082 - DNA, 25 bp, Rattus norvegicus
ttgtcctcgtcgcttgagtggttga

SEQ ID NO: 542083 - DNA, 25 bp, Rattus norvegicus
tgcaggatgaggtcctctgcctcgc

SEQ ID NO: 542084 - DNA, 25 bp, Rattus norvegicus
gaggtcctctgcctcgctgtcatca

SEQ ID NO: 542085 - DNA, 25 bp, Rattus norvegicus
tcgctgtcatcacggctcagcagct

SEQ ID NO: 542086 - DNA, 25 bp, Rattus norvegicus
agcagctcctcgaacggcatagggt

SEQ ID NO: 542087 - DNA, 25 bp, Rattus norvegicus
tcggtgatattgaaggccgtgtata

SEQ ID NO: 542088 - DNA, 25 bp, Rattus norvegicus
tatgcggtcgcgcatccacaggacc

SEQ ID NO: 542089 - DNA, 25 bp, Rattus norvegicus
ccacaggacccgtaggtcgtccatg

SEQ ID NO: 542090 - DNA, 25 bp, Rattus norvegicus
aaggccgtgtatatgcggtcgcgca

SEQ ID NO: 542091 - DNA, 25 bp, Rattus norvegicus
acctgagcagcgcagggcgcagaac

SEQ ID NO: 542092 - DNA, 25 bp, Rattus norvegicus
tcgtccatggcgcagacctgagcag

SEQ ID NO: 542093 - DNA, 25 bp, Rattus norvegicus
ccgaagaaccgaagcgcagtgtaca

SEQ ID NO: 542094 - DNA, 25 bp, Rattus norvegicus
caaccggaaccggactgcgaacgcg

SEQ ID NO: 542095 - DNA, 25 bp, Rattus norvegicus
cccggatatccagccttctggcgtg

SEQ ID NO: 542096 - DNA, 25 bp, Rattus norvegicus
gccaccggaagtgagcgctcagcta

SEQ ID NO: 542097 - DNA, 25 bp, Rattus norvegicus
tggcgctaccgcaccgagagccaga

SEQ ID NO: 542098 - DNA, 25 bp, Rattus norvegicus
ggctgaggaacactcggcgccagat

SEQ ID NO: 542099 - DNA, 25 bp, Rattus norvegicus
atgttctgaagggaggaagcacgcc

SEQ ID NO: 542100 - DNA, 25 bp, Rattus norvegicus
gagccgaggagtctctggaatgttc

SEQ ID NO: 542101 - DNA, 25 bp, Rattus norvegicus
tgcataaagcctaccagagccgagg

SEQ ID NO: 542102 - DNA, 25 bp, Rattus norvegicus
gcccttctggcggaatgcataaagc

SEQ ID NO: 542103 - DNA, 25 bp, Rattus norvegicus
gctcagagtaaccacaaaacccttc

SEQ ID NO: 542104 - DNA, 25 bp, Rattus norvegicus
cgaggaggcaggaactgtgttacta

SEQ ID NO: 542105 - DNA, 25 bp, Rattus norvegicus
agcgcggcccagaaatgaggaaaca

SEQ ID NO: 542106 - DNA, 25 bp, Rattus norvegicus
gagccttggaggttctgacttccga

SEQ ID NO: 542107 - DNA, 25 bp, Rattus norvegicus
tctcgctacggaagagggagcccat

SEQ ID NO: 542108 - DNA, 25 bp, Rattus norvegicus
gtcactacggctcagccaatcggcg

SEQ ID NO: 542109 - DNA, 25 bp, Rattus norvegicus
gcgggacactcacgtctcggaactg

SEQ ID NO: 542110 - DNA, 25 bp, Rattus norvegicus
tctcggaactgcaccaggcccttct

SEQ ID NO: 542111 - DNA, 25 bp, Rattus norvegicus
gccaagcgcgctcagacactcgtag

SEQ ID NO: 542112 - DNA, 25 bp, Rattus norvegicus
tcagacactcgtaggccgtgcccga

SEQ ID NO: 542113 - DNA, 25 bp, Rattus norvegicus
taggccgtgcccgactgcaggaaga

SEQ ID NO: 542114 - DNA, 25 bp, Rattus norvegicus
gcaggaagagctgcgccaggcacat

SEQ ID NO: 542115 - DNA, 25 bp, Rattus norvegicus
gccaggcacatgctctcgctacgga

SEQ ID NO: 542116 - DNA, 25 bp, Rattus norvegicus
cacactcgcaccatggggctctcct

SEQ ID NO: 542117 - DNA, 25 bp, Rattus norvegicus
cccaccgcagaatgaccaatgaacg

SEQ ID NO: 542118 - DNA, 25 bp, Rattus norvegicus
ccaatgaacggcaggaatcgtggca

SEQ ID NO: 542119 - DNA, 25 bp, Rattus norvegicus
cggggaaccgcccaccgcagaatga

SEQ ID NO: 542120 - DNA, 25 bp, Rattus norvegicus
aatcgtggcagtccgtcactacggc

SEQ ID NO: 542121 - DNA, 25 bp, Rattus norvegicus
actcagaagcgtggggtatacggta

SEQ ID NO: 542122 - DNA, 25 bp, Rattus norvegicus
cgcgacatcgtggagatctgactta

SEQ ID NO: 542123 - DNA, 25 bp, Rattus norvegicus
tggagatctgacttaactgacgata

SEQ ID NO: 542124 - DNA, 25 bp, Rattus norvegicus
aatggtccggggctactcagaagcg

SEQ ID NO: 542125 - DNA, 25 bp, Rattus norvegicus
tacggtattgtaaagagagcggctc

SEQ ID NO: 542126 - DNA, 25 bp, Rattus norvegicus
aagagagcggctctcgcctgtcgac

SEQ ID NO: 542127 - DNA, 25 bp, Rattus norvegicus
cgggtgctgccgctcaatcagaccg

SEQ ID NO: 542128 - DNA, 25 bp, Rattus norvegicus
aaacgccaaccacacgtgccgggtg

SEQ ID NO: 542129 - DNA, 25 bp, Rattus norvegicus
cggggttccatacccagtgcagagg

SEQ ID NO: 542130 - DNA, 25 bp, Rattus norvegicus
ttactcagtaacacggggttccata

SEQ ID NO: 542131 - DNA, 25 bp, Rattus norvegicus
cgagcgtggaggtgttactcagtaa

SEQ ID NO: 542132 - DNA, 25 bp, Rattus norvegicus
actgacgatagagcccgagcgtgga

SEQ ID NO: 542133 - DNA, 25 bp, Rattus norvegicus
cttaactgacgatagagcccgagcg

SEQ ID NO: 542134 - DNA, 25 bp, Rattus norvegicus
cgcctgtcgacatcgcgacatcgtg

SEQ ID NO: 542135 - DNA, 25 bp, Rattus norvegicus
ccgggtctggccctttaagagtcag

SEQ ID NO: 542136 - DNA, 25 bp, Rattus norvegicus
ctggcttccgggatccaaggagccc

SEQ ID NO: 542137 - DNA, 25 bp, Rattus norvegicus
tttttatgtggcctggcttccggga

SEQ ID NO: 542138 - DNA, 25 bp, Rattus norvegicus
ctttaagagtcagattcccggcctg

SEQ ID NO: 542139 - DNA, 25 bp, Rattus norvegicus
ccggatgaaaggtgggatgaaaact

SEQ ID NO: 542140 - DNA, 25 bp, Rattus norvegicus
acctcaggactggacatccggatga

SEQ ID NO: 542141 - DNA, 25 bp, Rattus norvegicus
tgcgtgtgctggtttttatgtggcc

SEQ ID NO: 542142 - DNA, 25 bp, Rattus norvegicus
cctcaggacgccctgcagcaggagg

SEQ ID NO: 542143 - DNA, 25 bp, Rattus norvegicus
tgagcggcgacagagaacccatacc

SEQ ID NO: 542144 - DNA, 25 bp, Rattus norvegicus
ttgcctcagaaacccaggataacct

SEQ ID NO: 542145 - DNA, 25 bp, Rattus norvegicus
ataacctgggagagaaaaagcggcg

SEQ ID NO: 542146 - DNA, 25 bp, Rattus norvegicus
ttaacgggtgcagaaccagtacctg

SEQ ID NO: 542147 - DNA, 25 bp, Rattus norvegicus
cagaaccagtacctggcgtgcgtgt

SEQ ID NO: 542148 - DNA, 25 bp, Rattus norvegicus
atacccggggccgatttgcctcaga

SEQ ID NO: 542149 - DNA, 25 bp, Rattus norvegicus
tgacttcagcacacgctgtccgagg

SEQ ID NO: 542150 - DNA, 25 bp, Rattus norvegicus
ggcgctgacaagtgacgtaaacgta

SEQ ID NO: 542151 - DNA, 25 bp, Rattus norvegicus
atggctccctatgcctcggtgaaga

SEQ ID NO: 542152 - DNA, 25 bp, Rattus norvegicus
cgccttgccctgctcgaagagatga

SEQ ID NO: 542153 - DNA, 25 bp, Rattus norvegicus
ctctgtgagcattaggaagcgcctt

SEQ ID NO: 542154 - DNA, 25 bp, Rattus norvegicus
gaggggccgcctccaaaattctggc

SEQ ID NO: 542155 - DNA, 25 bp, Rattus norvegicus
acttcccgctgtcactgttcttgtg

SEQ ID NO: 542156 - DNA, 25 bp, Rattus norvegicus
acgttgtccaaactcgagccacttc

SEQ ID NO: 542157 - DNA, 25 bp, Rattus norvegicus
tgagctcagggcgacgttgtccaaa

SEQ ID NO: 542158 - DNA, 25 bp, Rattus norvegicus
acggtggtgagtatctagccagagc

SEQ ID NO: 542159 - DNA, 25 bp, Rattus norvegicus
aaacccggcggcgacggaaatgatg

SEQ ID NO: 542160 - DNA, 25 bp, Rattus norvegicus
tgcagtcgacttccggcgctgacaa

SEQ ID NO: 542161 - DNA, 25 bp, Rattus norvegicus
tgcgtgagaagctcgacacgctgtc

SEQ ID NO: 542162 - DNA, 25 bp, Rattus norvegicus
ccctcggaagctcgcaaactgactt

SEQ ID NO: 542163 - DNA, 25 bp, Rattus norvegicus
gaccgatacctgcaccggcgtcatg

SEQ ID NO: 542164 - DNA, 25 bp, Rattus norvegicus
cagagctctctagacgtcgcagcca

SEQ ID NO: 542165 - DNA, 25 bp, Rattus norvegicus
gcgtcatgtgcaggaagcccaactc

SEQ ID NO: 542166 - DNA, 25 bp, Rattus norvegicus
tcacgtgttccatggcgcgcaagaa

SEQ ID NO: 542167 - DNA, 25 bp, Rattus norvegicus
cgcgcaagaagtctccgctgtttca

SEQ ID NO: 542168 - DNA, 25 bp, Rattus norvegicus
cgcgggagcaccaaccaaaaggact

SEQ ID NO: 542169 - DNA, 25 bp, Rattus norvegicus
ggtacccaagcgacgacattccgga

SEQ ID NO: 542170 - DNA, 25 bp, Rattus norvegicus
atcgccctgtcacttggccagtcta

SEQ ID NO: 542171 - DNA, 25 bp, Rattus norvegicus
ggccagtctagctttctttgagcaa

SEQ ID NO: 542172 - DNA, 25 bp, Rattus norvegicus
ccgcgtacctatagatgccaaattc

SEQ ID NO: 542173 - DNA, 25 bp, Rattus norvegicus
cgagagcttccgcaactaggataaa

SEQ ID NO: 542174 - DNA, 25 bp, Rattus norvegicus
cacgagctaaagatgctggtgactc

SEQ ID NO: 542175 - DNA, 25 bp, Rattus norvegicus
ctgaggacaatctggtaagcgaatc

SEQ ID NO: 542176 - DNA, 25 bp, Rattus norvegicus
gtgcggatagaagttcagagctctc

SEQ ID NO: 542177 - DNA, 25 bp, Rattus norvegicus
gccgagtccgcacccaagttacgaa

SEQ ID NO: 542178 - DNA, 25 bp, Rattus norvegicus
gcagcttccgatctactcttcaaag

SEQ ID NO: 542179 - DNA, 25 bp, Rattus norvegicus
cccggagaaccaagaacgacgctga

SEQ ID NO: 542180 - DNA, 25 bp, Rattus norvegicus
acggagcccgaagccgctcggaaag

SEQ ID NO: 542181 - DNA, 25 bp, Rattus norvegicus
aaagacgagcgctttccgagccgcg

SEQ ID NO: 542182 - DNA, 25 bp, Rattus norvegicus
gctcgaagaagcactcctcggcgtg

SEQ ID NO: 542183 - DNA, 25 bp, Rattus norvegicus
tgcgagcgtcaccatggtgcggcac

SEQ ID NO: 542184 - DNA, 25 bp, Rattus norvegicus
gccggagccgacagctgccacgtaa

SEQ ID NO: 542185 - DNA, 25 bp, Rattus norvegicus
tgccacgtaacggacgcacggcggc

SEQ ID NO: 542186 - DNA, 25 bp, Rattus norvegicus
gctctgaagagccaaaaaccgttca

SEQ ID NO: 542187 - DNA, 25 bp, Rattus norvegicus
accgttcagttcaagcccttcgacg

SEQ ID NO: 542188 - DNA, 25 bp, Rattus norvegicus
gcccttcgacgtgggttgatgatca

SEQ ID NO: 542189 - DNA, 25 bp, Rattus norvegicus
ttgatgatcacatggacgcgctgcg

SEQ ID NO: 542190 - DNA, 25 bp, Rattus norvegicus
tcaaagtttgtttccgcgccacgcc

SEQ ID NO: 542191 - DNA, 25 bp, Rattus norvegicus
actcggcgtcgccaaagtttgattc

SEQ ID NO: 542192 - DNA, 25 bp, Rattus norvegicus
ccctgtcggctctggagaagaacgt

SEQ ID NO: 542193 - DNA, 25 bp, Rattus norvegicus
ctgaccgtcatggacgtgtacgata

SEQ ID NO: 542194 - DNA, 25 bp, Rattus norvegicus
cgtgtacgatatcgcgtcgctcgtg

SEQ ID NO: 542195 - DNA, 25 bp, Rattus norvegicus
gccacgagttcgagagggtcatcga

SEQ ID NO: 542196 - DNA, 25 bp, Rattus norvegicus
cccaagttcacgagttaccggagtg

SEQ ID NO: 542197 - DNA, 25 bp, Rattus norvegicus
cgcattgaaaaggagcgcaagcatc

SEQ ID NO: 542198 - DNA, 25 bp, Rattus norvegicus
cgtagagaggatggaccgcattgaa

SEQ ID NO: 542199 - DNA, 25 bp, Rattus norvegicus
acgtcgctcccgagctggacgagct

SEQ ID NO: 542200 - DNA, 25 bp, Rattus norvegicus
atcctcgaggtgctggttagccgac

SEQ ID NO: 542201 - DNA, 25 bp, Rattus norvegicus
ctcatgcccaaggtcgtgagggtcc

SEQ ID NO: 542202 - DNA, 25 bp, Rattus norvegicus
ggctgcgaggccattgcacgcctca

SEQ ID NO: 542203 - DNA, 25 bp, Rattus norvegicus
gggtcatcgaccaacacggctgcga

SEQ ID NO: 542204 - DNA, 25 bp, Rattus norvegicus
gggacccaagtctccatcgctcgga

SEQ ID NO: 542205 - DNA, 25 bp, Rattus norvegicus
gctacgcgaggataaggctgctccc

SEQ ID NO: 542206 - DNA, 25 bp, Rattus norvegicus
ccgttgagcaatgtgtttttgtttg

SEQ ID NO: 542207 - DNA, 25 bp, Rattus norvegicus
aactgtcggagtgaagctggcctct

SEQ ID NO: 542208 - DNA, 25 bp, Rattus norvegicus
cccaggttacagctacgcgaggata

SEQ ID NO: 542209 - DNA, 25 bp, Rattus norvegicus
ctctgccaggcttcaacatggcgtc

SEQ ID NO: 542210 - DNA, 25 bp, Rattus norvegicus
ccaggcctgtttggggactctctcc

SEQ ID NO: 542211 - DNA, 25 bp, Rattus norvegicus
tccactcacctcagcaaaagttggg

SEQ ID NO: 542212 - DNA, 25 bp, Rattus norvegicus
cccgtttgccagaggctgcagattc

SEQ ID NO: 542213 - DNA, 25 bp, Rattus norvegicus
tccacagggagacaaaagtagtttc

SEQ ID NO: 542214 - DNA, 25 bp, Rattus norvegicus
gacctccactggaactctttattgg

SEQ ID NO: 542215 - DNA, 25 bp, Rattus norvegicus
tctttattggcagcagcagattcgc

SEQ ID NO: 542216 - DNA, 25 bp, Rattus norvegicus
gcagattcgccacgaccgttgagca

SEQ ID NO: 542217 - DNA, 25 bp, Rattus norvegicus
ctggcctctcggtacccaggttaca

SEQ ID NO: 542218 - DNA, 25 bp, Rattus norvegicus
ggctgcagattccttactccgacct

SEQ ID NO: 542219 - DNA, 25 bp, Rattus norvegicus
ttgcagcaactaaatatttggtttc

SEQ ID NO: 542220 - DNA, 25 bp, Rattus norvegicus
atttggtttctgctcctgcctgctc

SEQ ID NO: 542221 - DNA, 25 bp, Rattus norvegicus
gggcagcgcagcattgagattccgc

SEQ ID NO: 542222 - DNA, 25 bp, Rattus norvegicus
gcagaccctgacacgggccgggtaa

SEQ ID NO: 542223 - DNA, 25 bp, Rattus norvegicus
ccgggtaattgatctggaggtgcca

SEQ ID NO: 542224 - DNA, 25 bp, Rattus norvegicus
tccgcgctctgctcaaacaaacttc

SEQ ID NO: 542225 - DNA, 25 bp, Rattus norvegicus
tctggaggtgccaatttgcagcaac

SEQ ID NO: 542226 - DNA, 25 bp, Rattus norvegicus
attaaaagcgaaaagcaagcgtggg

SEQ ID NO: 542227 - DNA, 25 bp, Rattus norvegicus
cggccggatcgatggcaccgagcct

SEQ ID NO: 542228 - DNA, 25 bp, Rattus norvegicus
atcgatggcaccgagcctgagggct

SEQ ID NO: 542229 - DNA, 25 bp, Rattus norvegicus
acctccttacgagggcaggatcggc

SEQ ID NO: 542230 - DNA, 25 bp, Rattus norvegicus
aggatcggcgccctctttcggatcg

SEQ ID NO: 542231 - DNA, 25 bp, Rattus norvegicus
cctctttcggatcgccgagcactgg

SEQ ID NO: 542232 - DNA, 25 bp, Rattus norvegicus
cgggcggttagcacctccttacgag

SEQ ID NO: 542233 - DNA, 25 bp, Rattus norvegicus
ggggcatatcttttcgcaacagcgc

SEQ ID NO: 542234 - DNA, 25 bp, Rattus norvegicus
gtcctgtgtgcgcagacctcttaaa

SEQ ID NO: 542235 - DNA, 25 bp, Rattus norvegicus
cagtccaggaagatggcagtgcgca

SEQ ID NO: 542236 - DNA, 25 bp, Rattus norvegicus
tgggacaagtcaccaggtcctcctc

SEQ ID NO: 542237 - DNA, 25 bp, Rattus norvegicus
gtcgcagtagcgacccaggcagatg

SEQ ID NO: 542238 - DNA, 25 bp, Rattus norvegicus
acagttcccgcagaaggtgtgcccg

SEQ ID NO: 542239 - DNA, 25 bp, Rattus norvegicus
gcaacagcgccacgaatcctggata

SEQ ID NO: 542240 - DNA, 25 bp, Rattus norvegicus
ctccagcagctgaacggccatagcg

SEQ ID NO: 542241 - DNA, 25 bp, Rattus norvegicus
gctggcgacattcggggcatatctt

SEQ ID NO: 542242 - DNA, 25 bp, Rattus norvegicus
cagcttcacgttgcggctcagcttg

SEQ ID NO: 542243 - DNA, 25 bp, Rattus norvegicus
ccctgcaacaaggtgctcagcttca

SEQ ID NO: 542244 - DNA, 25 bp, Rattus norvegicus
gccctccgtgagacagaagaactcg

SEQ ID NO: 542245 - DNA, 25 bp, Rattus norvegicus
ggtggctacagtcgtgcaccgtgca

SEQ ID NO: 542246 - DNA, 25 bp, Rattus norvegicus
ttggcagggatccaagtcgcccttg

SEQ ID NO: 542247 - DNA, 25 bp, Rattus norvegicus
tgtgcgtgtccctcacttttggcgc

SEQ ID NO: 542248 - DNA, 25 bp, Rattus norvegicus
gactaccaggccttgggtgctcctc

SEQ ID NO: 542249 - DNA, 25 bp, Rattus norvegicus
acttttggcgcacggctgtgtagct

SEQ ID NO: 542250 - DNA, 25 bp, Rattus norvegicus
ttccatggttcggtggtacccgcta

SEQ ID NO: 542251 - DNA, 25 bp, Rattus norvegicus
ggccacacagactgctcacggcgtg

SEQ ID NO: 542252 - DNA, 25 bp, Rattus norvegicus
ctcggcccagagaaaagtttccctg

SEQ ID NO: 542253 - DNA, 25 bp, Rattus norvegicus
gcagccctgaaggtcgcagaagtcc

SEQ ID NO: 542254 - DNA, 25 bp, Rattus norvegicus
agctgatggccctgggcagcgaccc

SEQ ID NO: 542255 - DNA, 25 bp, Rattus norvegicus
cctgcagctgaccaccgaagacgtg

SEQ ID NO: 542256 - DNA, 25 bp, Rattus norvegicus
ccgaagacgtgtacgacatctccta

SEQ ID NO: 542257 - DNA, 25 bp, Rattus norvegicus
gcgtcacccggctgcagttcaagat

SEQ ID NO: 542258 - DNA, 25 bp, Rattus norvegicus
acgcgtaggtgacagcagccctgaa

SEQ ID NO: 542259 - DNA, 25 bp, Rattus norvegicus
ctgcagttcaagatcgtacgtgtga

SEQ ID NO: 542260 - DNA, 25 bp, Rattus norvegicus
acatctcctatgtggtgggccgcga

SEQ ID NO: 542261 - DNA, 25 bp, Rattus norvegicus
ccactccgcgcagcgactgcacggc

SEQ ID NO: 542262 - DNA, 25 bp, Rattus norvegicus
ccacggcgcccgcttcgcccatggc

SEQ ID NO: 542263 - DNA, 25 bp, Rattus norvegicus
catgcgtgggatgttcacgcgagcc

SEQ ID NO: 542264 - DNA, 25 bp, Rattus norvegicus
ctgcatgcgtgggatgttcacgcga

SEQ ID NO: 542265 - DNA, 25 bp, Rattus norvegicus
cgtctgcatgcgtgggatgttcacg

SEQ ID NO: 542266 - DNA, 25 bp, Rattus norvegicus
gcgtctgcatgcgtgggatgttcac

SEQ ID NO: 542267 - DNA, 25 bp, Rattus norvegicus
ctccgcgcagcgactgcacggcgcc

SEQ ID NO: 542268 - DNA, 25 bp, Rattus norvegicus
tcagcgcagcccctcacgcgcgcgc

SEQ ID NO: 542269 - DNA, 25 bp, Rattus norvegicus
ggccaatcctggctcagcgcagccc

SEQ ID NO: 542270 - DNA, 25 bp, Rattus norvegicus
cgagggttcgcgacggccaatcctg

SEQ ID NO: 542271 - DNA, 25 bp, Rattus norvegicus
gcgagggttcgcgacggccaatcct

SEQ ID NO: 542272 - DNA, 25 bp, Rattus norvegicus
cgcttcgcccatggcccgcagcagg

SEQ ID NO: 542273 - DNA, 25 bp, Rattus norvegicus
ccgcgtctgcatgcgtgggatgttc

SEQ ID NO: 542274 - DNA, 25 bp, Rattus norvegicus
atgcgtgggatgttcacgcgagccc

SEQ ID NO: 542275 - DNA, 25 bp, Rattus norvegicus
ctgccctgtgctatgaggactcttc

SEQ ID NO: 542276 - DNA, 25 bp, Rattus norvegicus
ccaggctgccctgtgctatgaggac

SEQ ID NO: 542277 - DNA, 25 bp, Rattus norvegicus
gtgctatgaggactcttctgagatg

SEQ ID NO: 542278 - DNA, 25 bp, Rattus norvegicus
ctgagatgagcagcccacgcagagc

SEQ ID NO: 542279 - DNA, 25 bp, Rattus norvegicus
agcccacgcagagcgctgtatgcgc

SEQ ID NO: 542280 - DNA, 25 bp, Rattus norvegicus
agagcgctgtatgcgcctctccgga

SEQ ID NO: 542281 - DNA, 25 bp, Rattus norvegicus
tgcgcctctccggagatcactgagc

SEQ ID NO: 542282 - DNA, 25 bp, Rattus norvegicus
tccggagatcactgagcgagcagct

SEQ ID NO: 542283 - DNA, 25 bp, Rattus norvegicus
atcactgagcgagcagctgcgggac

SEQ ID NO: 542284 - DNA, 25 bp, Rattus norvegicus
agcagctgcgggactccagcgccag

SEQ ID NO: 542285 - DNA, 25 bp, Rattus norvegicus
tgcgggactccagcgccagagcctg

SEQ ID NO: 542286 - DNA, 25 bp, Rattus norvegicus
atctgctgtggaggaacgtccgtga

SEQ ID NO: 542287 - DNA, 25 bp, Rattus norvegicus
agaggacgcctcgtagggcgcctga

SEQ ID NO: 542288 - DNA, 25 bp, Rattus norvegicus
ccctgtgctatgaggactcttctga

SEQ ID NO: 542289 - DNA, 25 bp, Rattus norvegicus
tacggatataccagctccgggaaga

SEQ ID NO: 542290 - DNA, 25 bp, Rattus norvegicus
tctttcgcgagctgcccgctgtgat

SEQ ID NO: 542291 - DNA, 25 bp, Rattus norvegicus
aactgctcagctagaccgcggctgc

SEQ ID NO: 542292 - DNA, 25 bp, Rattus norvegicus
ccatgagctttgacatacggatata

SEQ ID NO: 542293 - DNA, 25 bp, Rattus norvegicus
ctccgggaagactggctgaaccaca

SEQ ID NO: 542294 - DNA, 25 bp, Rattus norvegicus
ccacgcgtccagacggggaaagcgc

SEQ ID NO: 542295 - DNA, 25 bp, Rattus norvegicus
gctgcccaacaagggtaaccgcctg

SEQ ID NO: 542296 - DNA, 25 bp, Rattus norvegicus
ctagagtcccaagtccctctgggtc

SEQ ID NO: 542297 - DNA, 25 bp, Rattus norvegicus
actccaccgtaggaggatgcctgtg

SEQ ID NO: 542298 - DNA, 25 bp, Rattus norvegicus
ttgcattctcagcagtgcggctctc

SEQ ID NO: 542299 - DNA, 25 bp, Rattus norvegicus
tggccaccctaacaaatacctctag

SEQ ID NO: 542300 - DNA, 25 bp, Rattus norvegicus
tgtcaccgtctggaatctcccggga

SEQ ID NO: 542301 - DNA, 25 bp, Rattus norvegicus
ttgcaacaactgtagccaactgctc

SEQ ID NO: 542302 - DNA, 25 bp, Rattus norvegicus
gggcgctgcgctcaagtttccatga

SEQ ID NO: 542303 - DNA, 25 bp, Rattus norvegicus
ccagacactccaaccccgtccgctc

SEQ ID NO: 542304 - DNA, 25 bp, Rattus norvegicus
tgcctcgtgaagccgccgcggacat

SEQ ID NO: 542305 - DNA, 25 bp, Rattus norvegicus
ctgcctcgtgaagccgccgcggaca

SEQ ID NO: 542306 - DNA, 25 bp, Rattus norvegicus
ttctgcctcgtgaagccgccgcgga

SEQ ID NO: 542307 - DNA, 25 bp, Rattus norvegicus
tttctgcctcgtgaagccgccgcgg

SEQ ID NO: 542308 - DNA, 25 bp, Rattus norvegicus
gtttctgcctcgtgaagccgccgcg

SEQ ID NO: 542309 - DNA, 25 bp, Rattus norvegicus
gctcccgttaggccgcccggagtgc

SEQ ID NO: 542310 - DNA, 25 bp, Rattus norvegicus
cagacactccaaccccgtccgctcc

SEQ ID NO: 542311 - DNA, 25 bp, Rattus norvegicus
gcctcgtgaagccgccgcggacata

SEQ ID NO: 542312 - DNA, 25 bp, Rattus norvegicus
tctgcctcgtgaagccgccgcggac

SEQ ID NO: 542313 - DNA, 25 bp, Rattus norvegicus
cgctcccgttaggccgcccggagtg

SEQ ID NO: 542314 - DNA, 25 bp, Rattus norvegicus
ggaattcccttggatcccaactctg

SEQ ID NO: 542315 - DNA, 25 bp, Rattus norvegicus
ggggatcgccttccttgccttctct

SEQ ID NO: 542316 - DNA, 25 bp, Rattus norvegicus
ggaaacgttattctcgcgaggtctc

SEQ ID NO: 542317 - DNA, 25 bp, Rattus norvegicus
acacgtgactgtcctaggccgcctt

SEQ ID NO: 542318 - DNA, 25 bp, Rattus norvegicus
ccagagccgcggtaatggaccgttt

SEQ ID NO: 542319 - DNA, 25 bp, Rattus norvegicus
actgaggcggacaccctgttagact

SEQ ID NO: 542320 - DNA, 25 bp, Rattus norvegicus
gctggttccggcattttcagccaga

SEQ ID NO: 542321 - DNA, 25 bp, Rattus norvegicus
ggggatccgcttccttcacctagga

SEQ ID NO: 542322 - DNA, 25 bp, Rattus norvegicus
ggcccattgctcacggttccaggag

SEQ ID NO: 542323 - DNA, 25 bp, Rattus norvegicus
ccgacctggaacgtgtggcgaaact

SEQ ID NO: 542324 - DNA, 25 bp, Rattus norvegicus
tgtcccgagccggatagcagttccg

SEQ ID NO: 542325 - DNA, 25 bp, Rattus norvegicus
gcccgctgcttggtctcattctgct

SEQ ID NO: 542326 - DNA, 25 bp, Rattus norvegicus
agctattctttcgtcgggtccggcg

SEQ ID NO: 542327 - DNA, 25 bp, Rattus norvegicus
tcacggaccgggagaagctattctt

SEQ ID NO: 542328 - DNA, 25 bp, Rattus norvegicus
cgcccgatgtatgggtgatatactg

SEQ ID NO: 542329 - DNA, 25 bp, Rattus norvegicus
ccctcaacgccggtgagtgagcgcg

SEQ ID NO: 542330 - DNA, 25 bp, Rattus norvegicus
acaacaaaaagtgcgcgggctcccg

SEQ ID NO: 542331 - DNA, 25 bp, Rattus norvegicus
gacggccatatttgccggcgcggcc

SEQ ID NO: 542332 - DNA, 25 bp, Rattus norvegicus
cccgagccggcgacaacaaaaagtg

SEQ ID NO: 542333 - DNA, 25 bp, Rattus norvegicus
atacctcgggcggcgagctagccga

SEQ ID NO: 542334 - DNA, 25 bp, Rattus norvegicus
cgatgtatgggtgatatactgcggc

SEQ ID NO: 542335 - DNA, 25 bp, Rattus norvegicus
ccgcccgcggggatgtcgtacaagc

SEQ ID NO: 542336 - DNA, 25 bp, Rattus norvegicus
cggggatgtcgtacaagccgaactt

SEQ ID NO: 542337 - DNA, 25 bp, Rattus norvegicus
ggatgtcgtacaagccgaacttgac

SEQ ID NO: 542338 - DNA, 25 bp, Rattus norvegicus
gccgcgccgcaagtgccgccaagtt

SEQ ID NO: 542339 - DNA, 25 bp, Rattus norvegicus
aagccgaacttgaccgcgcacatgc

SEQ ID NO: 542340 - DNA, 25 bp, Rattus norvegicus
gcgcgcccgatgtatgggtgatata

SEQ ID NO: 542341 - DNA, 25 bp, Rattus norvegicus
ggctccgggagtcgcgcgatacctc

SEQ ID NO: 542342 - DNA, 25 bp, Rattus norvegicus
ctggatacgagagcgactcccggtt

SEQ ID NO: 542343 - DNA, 25 bp, Rattus norvegicus
ccgcgcgagccaaggggacctagtc

SEQ ID NO: 542344 - DNA, 25 bp, Rattus norvegicus
tctcccacgtgggtacgtgtccgga

SEQ ID NO: 542345 - DNA, 25 bp, Rattus norvegicus
ctcagatctcccacgtgggtacgtg

SEQ ID NO: 542346 - DNA, 25 bp, Rattus norvegicus
ccatctcagatctcccacgtgggta

SEQ ID NO: 542347 - DNA, 25 bp, Rattus norvegicus
agaagttgtagtgccggggcctcgt

SEQ ID NO: 542348 - DNA, 25 bp, Rattus norvegicus
cccttggaagaagttgtagtgccgg

SEQ ID NO: 542349 - DNA, 25 bp, Rattus norvegicus
agccgagagggagaccgacccgagt

SEQ ID NO: 542350 - DNA, 25 bp, Rattus norvegicus
gatacgagagcgactcccggttttc

SEQ ID NO: 542351 - DNA, 25 bp, Rattus norvegicus
gggcctggatacgagagcgactccc

SEQ ID NO: 542352 - DNA, 25 bp, Rattus norvegicus
cgagccaaggggacctagtctccct

SEQ ID NO: 542353 - DNA, 25 bp, Rattus norvegicus
gtacgtgtccggagggcctcgccgc

SEQ ID NO: 542354 - DNA, 25 bp, Rattus norvegicus
gagagcgactcccggttttcttcac

SEQ ID NO: 542355 - DNA, 25 bp, Rattus norvegicus
cagatctcccacgtgggtacgtgtc

SEQ ID NO: 542356 - DNA, 25 bp, Rattus norvegicus
ctaaacgacttcatccgagaggacc

SEQ ID NO: 542357 - DNA, 25 bp, Rattus norvegicus
gggtgcatgcgccttttctagactc

SEQ ID NO: 542358 - DNA, 25 bp, Rattus norvegicus
tgagggctgagtcctaaacgacttc

SEQ ID NO: 542359 - DNA, 25 bp, Rattus norvegicus
tgaggccaatctcccggtacggaca

SEQ ID NO: 542360 - DNA, 25 bp, Rattus norvegicus
ctccttggaatttaacggtcgcgtg

SEQ ID NO: 542361 - DNA, 25 bp, Rattus norvegicus
ctcttccgggcagccaatcgtgggt

SEQ ID NO: 542362 - DNA, 25 bp, Rattus norvegicus
gcgtctttcccgcagtttctagaga

SEQ ID NO: 542363 - DNA, 25 bp, Rattus norvegicus
gcacgcgagaaaccgcggcgtcttt

SEQ ID NO: 542364 - DNA, 25 bp, Rattus norvegicus
ggctcattctcactaactgcgcacg

SEQ ID NO: 542365 - DNA, 25 bp, Rattus norvegicus
tccaggtctgcgcatgcgtcatatc

SEQ ID NO: 542366 - DNA, 25 bp, Rattus norvegicus
ccgagatgtctgagttttccaggtc

SEQ ID NO: 542367 - DNA, 25 bp, Rattus norvegicus
ttcagcgagaaaataaaccacggtg

SEQ ID NO: 542368 - DNA, 25 bp, Rattus norvegicus
tcagcagaggtcttggcctcaagcc

SEQ ID NO: 542369 - DNA, 25 bp, Rattus norvegicus
ggttgatggctaccacagagctagc

SEQ ID NO: 542370 - DNA, 25 bp, Rattus norvegicus
cgcagcatgagcatggcggccagtt

SEQ ID NO: 542371 - DNA, 25 bp, Rattus norvegicus
cgcaagggcagcttcggtctgcctg

SEQ ID NO: 542372 - DNA, 25 bp, Rattus norvegicus
gtctgcctggccaaggtgacttcct

SEQ ID NO: 542373 - DNA, 25 bp, Rattus norvegicus
agccatcggcacgatcggacacaga

SEQ ID NO: 542374 - DNA, 25 bp, Rattus norvegicus
ggtgacttccttcgctcccggaatc

SEQ ID NO: 542375 - DNA, 25 bp, Rattus norvegicus
aacgcgcatggctttgcgcaagggc

SEQ ID NO: 542376 - DNA, 25 bp, Rattus norvegicus
acctggcccagctcaagtacaatca

SEQ ID NO: 542377 - DNA, 25 bp, Rattus norvegicus
tcaagtacaatcaccgggcgcggcc

SEQ ID NO: 542378 - DNA, 25 bp, Rattus norvegicus
agtgggcccagccatcggcacgatc

SEQ ID NO: 542379 - DNA, 25 bp, Rattus norvegicus
gcggccagcgcggaacacagcaacg

SEQ ID NO: 542380 - DNA, 25 bp, Rattus norvegicus
ggaacacagcaacgcgcatggcttt

SEQ ID NO: 542381 - DNA, 25 bp, Rattus norvegicus
atcggacacagacccagatggactt

SEQ ID NO: 542382 - DNA, 25 bp, Rattus norvegicus
agacccagatggacttggagcagcg

SEQ ID NO: 542383 - DNA, 25 bp, Rattus norvegicus
cgtgccatggcaggccggcttgaac

SEQ ID NO: 542384 - DNA, 25 bp, Rattus norvegicus
cacgtcaatgtcctcgttgggcatg

SEQ ID NO: 542385 - DNA, 25 bp, Rattus norvegicus
taggtcaccaaagacgccggtagga

SEQ ID NO: 542386 - DNA, 25 bp, Rattus norvegicus
gacacacgtgacaccagcgggtctc

SEQ ID NO: 542387 - DNA, 25 bp, Rattus norvegicus
ccgcacctgtctccttcaggaaata

SEQ ID NO: 542388 - DNA, 25 bp, Rattus norvegicus
tctccttcaggaaatactcccggta

SEQ ID NO: 542389 - DNA, 25 bp, Rattus norvegicus
taggtccgccaccagtgcggggcat

SEQ ID NO: 542390 - DNA, 25 bp, Rattus norvegicus
gtaccgctcgaagctccggtacttc

SEQ ID NO: 542391 - DNA, 25 bp, Rattus norvegicus
ccgctccaggttgctcacgtcaatg

SEQ ID NO: 542392 - DNA, 25 bp, Rattus norvegicus
ctgtggacacagaccggggcgtcat

SEQ ID NO: 542393 - DNA, 25 bp, Rattus norvegicus
cccggcatctcccagtgacggaaaa

SEQ ID NO: 542394 - DNA, 25 bp, Rattus norvegicus
tcatgcaggcttagggctgcgactg

SEQ ID NO: 542395 - DNA, 25 bp, Rattus norvegicus
gccatctttccctaggtcaccaaag

SEQ ID NO: 542396 - DNA, 25 bp, Rattus norvegicus
acgccggtaggacccagacagaggt

SEQ ID NO: 542397 - DNA, 25 bp, Rattus norvegicus
cggaaaacgcggcacgccaccaggg

SEQ ID NO: 542398 - DNA, 25 bp, Rattus norvegicus
aaactcgcgccaacgaggcctgatc

SEQ ID NO: 542399 - DNA, 25 bp, Rattus norvegicus
aggcctgatcctcggggtacctagt

SEQ ID NO: 542400 - DNA, 25 bp, Rattus norvegicus
gtacctagtacccattcctgccgga

SEQ ID NO: 542401 - DNA, 25 bp, Rattus norvegicus
gtacccattcctgccggagagagcc

SEQ ID NO: 542402 - DNA, 25 bp, Rattus norvegicus
gaccacgggaccgactgcgacttct

SEQ ID NO: 542403 - DNA, 25 bp, Rattus norvegicus
gcacgtccacagaggtgaatccaaa

SEQ ID NO: 542404 - DNA, 25 bp, Rattus norvegicus
agcgcttaacctgcgactcttctgg

SEQ ID NO: 542405 - DNA, 25 bp, Rattus norvegicus
tctcgagcgcttgcgagagctaacg

SEQ ID NO: 542406 - DNA, 25 bp, Rattus norvegicus
ggtgaatccaaactcgcgccaacga

SEQ ID NO: 542407 - DNA, 25 bp, Rattus norvegicus
ctagagaccggaagaaaagcgctta

SEQ ID NO: 542408 - DNA, 25 bp, Rattus norvegicus
gagctaacgtgagccatagcgaggc

SEQ ID NO: 542409 - DNA, 25 bp, Rattus norvegicus
actgcgacttctcgagcgcttgcga

SEQ ID NO: 542410 - DNA, 25 bp, Rattus norvegicus
cttgcgagagctaacgtgagccata

SEQ ID NO: 542411 - DNA, 25 bp, Rattus norvegicus
gcgactcttctggagcacgtccaca

SEQ ID NO: 542412 - DNA, 25 bp, Rattus norvegicus
ccgggatcctaggttccgcctctag

SEQ ID NO: 542413 - DNA, 25 bp, Rattus norvegicus
atcatccgggtgttctttgcgtcta

SEQ ID NO: 542414 - DNA, 25 bp, Rattus norvegicus
ccgggtgttctttgcgtctatgata

SEQ ID NO: 542415 - DNA, 25 bp, Rattus norvegicus
tcctggaagatcatccgggtgttct

SEQ ID NO: 542416 - DNA, 25 bp, Rattus norvegicus
tgatatctttagttccgggatccta

SEQ ID NO: 542417 - DNA, 25 bp, Rattus norvegicus
taggttccgcctctagggagcccat

SEQ ID NO: 542418 - DNA, 25 bp, Rattus norvegicus
agggagcccatctctaacaaggatc

SEQ ID NO: 542419 - DNA, 25 bp, Rattus norvegicus
gcccatctctaacaaggatccttga

SEQ ID NO: 542420 - DNA, 25 bp, Rattus norvegicus
aggagacagtcatggcccagcgcca

SEQ ID NO: 542421 - DNA, 25 bp, Rattus norvegicus
aaggatccttgaacctgcctccacg

SEQ ID NO: 542422 - DNA, 25 bp, Rattus norvegicus
gatccttgaacctgcctccacgtga

SEQ ID NO: 542423 - DNA, 25 bp, Rattus norvegicus
tccacgtgagtaggagacagtcatg

SEQ ID NO: 542424 - DNA, 25 bp, Rattus norvegicus
gcgtctatgatatctttagttccgg

SEQ ID NO: 542425 - DNA, 25 bp, Rattus norvegicus
aactgcggcgggtccaggtcttccg

SEQ ID NO: 542426 - DNA, 25 bp, Rattus norvegicus
cgtagcgcgccacatacaagttctg

SEQ ID NO: 542427 - DNA, 25 bp, Rattus norvegicus
caggccaagtgtgcacacgcgattt

SEQ ID NO: 542428 - DNA, 25 bp, Rattus norvegicus
aaaacgctccgttcggtgtcacatc

SEQ ID NO: 542429 - DNA, 25 bp, Rattus norvegicus
ttccgtatacgtcaccgctgagggc

SEQ ID NO: 542430 - DNA, 25 bp, Rattus norvegicus
cccagagggtgtctccacgaaaacg

SEQ ID NO: 542431 - DNA, 25 bp, Rattus norvegicus
gaagacgccctactcactgcgaatg

SEQ ID NO: 542432 - DNA, 25 bp, Rattus norvegicus
aggggccgctgagaactcctaattg

SEQ ID NO: 542433 - DNA, 25 bp, Rattus norvegicus
cacagtgcgggactgaaagccttta

SEQ ID NO: 542434 - DNA, 25 bp, Rattus norvegicus
aaacgctgccctgtctcctactaga

SEQ ID NO: 542435 - DNA, 25 bp, Rattus norvegicus
ctagaaatttcttggcggagcctcc

SEQ ID NO: 542436 - DNA, 25 bp, Rattus norvegicus
gattcctagatgagaccacggcgcc

SEQ ID NO: 542437 - DNA, 25 bp, Rattus norvegicus
ccctgaagcgaagatgcagcccgta

SEQ ID NO: 542438 - DNA, 25 bp, Rattus norvegicus
tgcacctcgggaaaagccattcctg

SEQ ID NO: 542439 - DNA, 25 bp, Rattus norvegicus
gcaccagcttcggtagcggtacttc

SEQ ID NO: 542440 - DNA, 25 bp, Rattus norvegicus
cagccgccataggtgtcctgcaggc

SEQ ID NO: 542441 - DNA, 25 bp, Rattus norvegicus
cagccagctcatggagcagcgtatc

SEQ ID NO: 542442 - DNA, 25 bp, Rattus norvegicus
tccggaggacgtcagagaacgaaca

SEQ ID NO: 542443 - DNA, 25 bp, Rattus norvegicus
acaggggctcacacagccacggtgc

SEQ ID NO: 542444 - DNA, 25 bp, Rattus norvegicus
tgattatccagataaggcgccgccc

SEQ ID NO: 542445 - DNA, 25 bp, Rattus norvegicus
atgcagcgacagcaaacggagcagc

SEQ ID NO: 542446 - DNA, 25 bp, Rattus norvegicus
cgcagggtgagcaacagcagatgca

SEQ ID NO: 542447 - DNA, 25 bp, Rattus norvegicus
tgtcgctggccacatctccagtgga

SEQ ID NO: 542448 - DNA, 25 bp, Rattus norvegicus
gcgtaatccctgaaatggtcggcca

SEQ ID NO: 542449 - DNA, 25 bp, Rattus norvegicus
cggcaggtcccaatggtacagagtg

SEQ ID NO: 542450 - DNA, 25 bp, Rattus norvegicus
tacagagtgaccaccggctgcacgc

SEQ ID NO: 542451 - DNA, 25 bp, Rattus norvegicus
acccgcgcccacgatatggagaagc

SEQ ID NO: 542452 - DNA, 25 bp, Rattus norvegicus
cggaagcagagctcggcgtaatccc

SEQ ID NO: 542453 - DNA, 25 bp, Rattus norvegicus
cgcggtagacgttgttgtaactgtc

SEQ ID NO: 542454 - DNA, 25 bp, Rattus norvegicus
tttttgacccttctgcgacgcggtc

SEQ ID NO: 542455 - DNA, 25 bp, Rattus norvegicus
ctctgcggagctcgcaacgggaatt

SEQ ID NO: 542456 - DNA, 25 bp, Rattus norvegicus
cgacgcggtctgtaggtaccttgcg

SEQ ID NO: 542457 - DNA, 25 bp, Rattus norvegicus
ccggctccgagcagagcggtgctca

SEQ ID NO: 542458 - DNA, 25 bp, Rattus norvegicus
ctcagtgagaggcaggatcctgtgt

SEQ ID NO: 542459 - DNA, 25 bp, Rattus norvegicus
aggcaggatcctgtgtctctgcgtc

SEQ ID NO: 542460 - DNA, 25 bp, Rattus norvegicus
atcctgtgtctctgcgtcccgggca

SEQ ID NO: 542461 - DNA, 25 bp, Rattus norvegicus
ggcacggcgcgtcaccttctgacga

SEQ ID NO: 542462 - DNA, 25 bp, Rattus norvegicus
gtcaccttctgacgactcacctggt

SEQ ID NO: 542463 - DNA, 25 bp, Rattus norvegicus
acgactcacctggtggcaggtggca

SEQ ID NO: 542464 - DNA, 25 bp, Rattus norvegicus
ctcgcaacgggaattcggctgtttt

SEQ ID NO: 542465 - DNA, 25 bp, Rattus norvegicus
acccttctgcgacgcggtctgtagg

SEQ ID NO: 542466 - DNA, 25 bp, Rattus norvegicus
tggcgacctctgagggctgcgaacg

SEQ ID NO: 542467 - DNA, 25 bp, Rattus norvegicus
ccttctgacgactcacctggtggca

SEQ ID NO: 542468 - DNA, 25 bp, Rattus norvegicus
ggcgctcttcgtatggacctacatc

SEQ ID NO: 542469 - DNA, 25 bp, Rattus norvegicus
tatgccttcagccacctggatcgca

SEQ ID NO: 542470 - DNA, 25 bp, Rattus norvegicus
tatggacctacatctcgctggctgc

SEQ ID NO: 542471 - DNA, 25 bp, Rattus norvegicus
ggacccatggttctgggcgctcttc

SEQ ID NO: 542472 - DNA, 25 bp, Rattus norvegicus
actcttctcagaggtgcgcaggccc

SEQ ID NO: 542473 - DNA, 25 bp, Rattus norvegicus
tgccatggccaaactgctactcttc

SEQ ID NO: 542474 - DNA, 25 bp, Rattus norvegicus
cctctttgtgggcatctatgccatg

SEQ ID NO: 542475 - DNA, 25 bp, Rattus norvegicus
atcaccctcgtgtgcctctttgtgg

SEQ ID NO: 542476 - DNA, 25 bp, Rattus norvegicus
ccaagaacagcgctctggggccacg

SEQ ID NO: 542477 - DNA, 25 bp, Rattus norvegicus
gctaccatcggtgtggccaagaaca

SEQ ID NO: 542478 - DNA, 25 bp, Rattus norvegicus
ctgcctgtaccgcagctgcttgctg

SEQ ID NO: 542479 - DNA, 25 bp, Rattus norvegicus
ctgctggaggacatccgacacttta

SEQ ID NO: 542480 - DNA, 25 bp, Rattus norvegicus
tcggcgtgaccacggccatctatgc

SEQ ID NO: 542481 - DNA, 25 bp, Rattus norvegicus
aacatcttcgactcggtgctggacc

SEQ ID NO: 542482 - DNA, 25 bp, Rattus norvegicus
gctgctggaggacgatgcccagctc

SEQ ID NO: 542483 - DNA, 25 bp, Rattus norvegicus
tcacacccagcgctggcgtcacgtg

SEQ ID NO: 542484 - DNA, 25 bp, Rattus norvegicus
cttgaaccgagacacggggtctttg

SEQ ID NO: 542485 - DNA, 25 bp, Rattus norvegicus
cgctgatgcagctgcacgagctgct

SEQ ID NO: 542486 - DNA, 25 bp, Rattus norvegicus
ctgggcggcgctttcgcgcgccgat

SEQ ID NO: 542487 - DNA, 25 bp, Rattus norvegicus
aggacgatgcccagctcggcgacat

SEQ ID NO: 542488 - DNA, 25 bp, Rattus norvegicus
acgatgcccagctcggcgacatggt

SEQ ID NO: 542489 - DNA, 25 bp, Rattus norvegicus
ccctgacgcgagattcgggggcacc

SEQ ID NO: 542490 - DNA, 25 bp, Rattus norvegicus
cccaggccggtttgagtcgtggatc

SEQ ID NO: 542491 - DNA, 25 bp, Rattus norvegicus
ccggtttgagtcgtggatcggactc

SEQ ID NO: 542492 - DNA, 25 bp, Rattus norvegicus
agtcgtggatcggactcttgaaccg

SEQ ID NO: 542493 - DNA, 25 bp, Rattus norvegicus
tggatcggactcttgaaccgagaca

SEQ ID NO: 542494 - DNA, 25 bp, Rattus norvegicus
ctcttgaaccgagacacggggtctt

SEQ ID NO: 542495 - DNA, 25 bp, Rattus norvegicus
ggctgtcgctgatgcagctgcacga

SEQ ID NO: 542496 - DNA, 25 bp, Rattus norvegicus
ccttcagctgcgagatgtaccgctg

SEQ ID NO: 542497 - DNA, 25 bp, Rattus norvegicus
ttcagctgggccagctcgtggcgca

SEQ ID NO: 542498 - DNA, 25 bp, Rattus norvegicus
gcctcctctcgcaggccctggttgc

SEQ ID NO: 542499 - DNA, 25 bp, Rattus norvegicus
ggttgcgcgcgccttccagctgcag

SEQ ID NO: 542500 - DNA, 25 bp, Rattus norvegicus
cgccttccagctgcagggctttcag

SEQ ID NO: 542501 - DNA, 25 bp, Rattus norvegicus
agctgcagggctttcagctgggcca

SEQ ID NO: 542502 - DNA, 25 bp, Rattus norvegicus
cagctcgtggcgcagctgctcgttg

SEQ ID NO: 542503 - DNA, 25 bp, Rattus norvegicus
agctgctcgttgtccaccagggcct

SEQ ID NO: 542504 - DNA, 25 bp, Rattus norvegicus
gctcgttgtccaccagggccttctg

SEQ ID NO: 542505 - DNA, 25 bp, Rattus norvegicus
tggcccttcagctgcgagatgtacc

SEQ ID NO: 542506 - DNA, 25 bp, Rattus norvegicus
gcgccacccgcggtacacactctcc

SEQ ID NO: 542507 - DNA, 25 bp, Rattus norvegicus
cagctgcgagatgtaccgctgggcc

SEQ ID NO: 542508 - DNA, 25 bp, Rattus norvegicus
ctgcgagatgtaccgctgggcctgc

SEQ ID NO: 542509 - DNA, 25 bp, Rattus norvegicus
tccagctctgcctccaggctgttca

SEQ ID NO: 542510 - DNA, 25 bp, Rattus norvegicus
tctggcgacatacgtgaaacttttc

SEQ ID NO: 542511 - DNA, 25 bp, Rattus norvegicus
gagcctgggaagtttccgtctgtca

SEQ ID NO: 542512 - DNA, 25 bp, Rattus norvegicus
tgtcaggcgccggtgtttaacaagg

SEQ ID NO: 542513 - DNA, 25 bp, Rattus norvegicus
cggctcgagcctaggcacccagagg

SEQ ID NO: 542514 - DNA, 25 bp, Rattus norvegicus
tggcagcctatttataagtgggccc

SEQ ID NO: 542515 - DNA, 25 bp, Rattus norvegicus
gcgggcaaacaagtctggcgacata

SEQ ID NO: 542516 - DNA, 25 bp, Rattus norvegicus
aaccgttcacgcagggccgagcgca

SEQ ID NO: 542517 - DNA, 25 bp, Rattus norvegicus
gcgctcgcctgcgtcttgtcgaact

SEQ ID NO: 542518 - DNA, 25 bp, Rattus norvegicus
tcttgtcgaactgctcgcgctcggc

SEQ ID NO: 542519 - DNA, 25 bp, Rattus norvegicus
ggcctctaggctatggcccggcctg

SEQ ID NO: 542520 - DNA, 25 bp, Rattus norvegicus
ccgcgccggcacattcttgatgctg

SEQ ID NO: 542521 - DNA, 25 bp, Rattus norvegicus
tccgcgcgaatgaggcgtcaccgac

SEQ ID NO: 542522 - DNA, 25 bp, Rattus norvegicus
acccagcagataataagatactgtc

SEQ ID NO: 542523 - DNA, 25 bp, Rattus norvegicus
ttgatgctgttcatgctgccgccga

SEQ ID NO: 542524 - DNA, 25 bp, Rattus norvegicus
cgggtcacctcagaaacgccatagg

SEQ ID NO: 542525 - DNA, 25 bp, Rattus norvegicus
tcgtcgaagggttcatggatgatgc

SEQ ID NO: 542526 - DNA, 25 bp, Rattus norvegicus
tggatgatgccctttccctcacaga

SEQ ID NO: 542527 - DNA, 25 bp, Rattus norvegicus
tgccaggagcgggtcacctcagaaa

SEQ ID NO: 542528 - DNA, 25 bp, Rattus norvegicus
cacctggcgccggtataaggtcgtc

SEQ ID NO: 542529 - DNA, 25 bp, Rattus norvegicus
acgccataggtgcttggccgcagtg

SEQ ID NO: 542530 - DNA, 25 bp, Rattus norvegicus
agcccacgacgctgtgccttcaaag

SEQ ID NO: 542531 - DNA, 25 bp, Rattus norvegicus
gtgccttcaaagtcacgcatgcgca

SEQ ID NO: 542532 - DNA, 25 bp, Rattus norvegicus
ggacgccctgagtctcgcgagactt

SEQ ID NO: 542533 - DNA, 25 bp, Rattus norvegicus
cgcggcctgagaacgcgaacttaca

SEQ ID NO: 542534 - DNA, 25 bp, Rattus norvegicus
gcgaacttacattcccacgctggaa

SEQ ID NO: 542535 - DNA, 25 bp, Rattus norvegicus
cgctggaaagctttggcgcctcaca

SEQ ID NO: 542536 - DNA, 25 bp, Rattus norvegicus
tcccggagcgtcacagcgggaaaga

SEQ ID NO: 542537 - DNA, 25 bp, Rattus norvegicus
ccctcacagagagttggtgccagga

SEQ ID NO: 542538 - DNA, 25 bp, Rattus norvegicus
gcccgcgagagtccggacaagatct

SEQ ID NO: 542539 - DNA, 25 bp, Rattus norvegicus
ggctatcctaaaaagcccgcctgga

SEQ ID NO: 542540 - DNA, 25 bp, Rattus norvegicus
tatcgctcggaattgacccgccttc

SEQ ID NO: 542541 - DNA, 25 bp, Rattus norvegicus
gctgtctattggcttatcgctcgga

SEQ ID NO: 542542 - DNA, 25 bp, Rattus norvegicus
cgcgaattcaaaccctggctgtcta

SEQ ID NO: 542543 - DNA, 25 bp, Rattus norvegicus
ttggttacatcaggacgcgaattca

SEQ ID NO: 542544 - DNA, 25 bp, Rattus norvegicus
tcctactggtaggaccacagggtta

SEQ ID NO: 542545 - DNA, 25 bp, Rattus norvegicus
ggtctctgttccgtgtgacccatcg

SEQ ID NO: 542546 - DNA, 25 bp, Rattus norvegicus
agtccgttctcctccggtctctgtt

SEQ ID NO: 542547 - DNA, 25 bp, Rattus norvegicus
cccgaggttaacaggagaggcataa

SEQ ID NO: 542548 - DNA, 25 bp, Rattus norvegicus
ttgctgggcagagaacctaaatggc

SEQ ID NO: 542549 - DNA, 25 bp, Rattus norvegicus
gggatcgcccacgacttcacaggta

SEQ ID NO: 542550 - DNA, 25 bp, Rattus norvegicus
ctgagatcgatctatatcacgggga

SEQ ID NO: 542551 - DNA, 25 bp, Rattus norvegicus
caagacttgtcctacctttggggag

SEQ ID NO: 542552 - DNA, 25 bp, Rattus norvegicus
gtcactcgagggtgcccagaatgca

SEQ ID NO: 542553 - DNA, 25 bp, Rattus norvegicus
ggaggcgcacgctacctatgagcaa

SEQ ID NO: 542554 - DNA, 25 bp, Rattus norvegicus
atgtcgcgagaagcctacgtgctgg

SEQ ID NO: 542555 - DNA, 25 bp, Rattus norvegicus
gctgaagcgacacatgcaactcctc

SEQ ID NO: 542556 - DNA, 25 bp, Rattus norvegicus
ctttatcgcgatatcccggcggccg

SEQ ID NO: 542557 - DNA, 25 bp, Rattus norvegicus
caaggtgcggcgacagcaaaatacc

SEQ ID NO: 542558 - DNA, 25 bp, Rattus norvegicus
taccgaaagagaccgagccagggga

SEQ ID NO: 542559 - DNA, 25 bp, Rattus norvegicus
acgagaatggaagtgccacggcctg

SEQ ID NO: 542560 - DNA, 25 bp, Rattus norvegicus
tgccacggcctggagagataaaatc

SEQ ID NO: 542561 - DNA, 25 bp, Rattus norvegicus
agatcccgggaacgccacaggaggc

SEQ ID NO: 542562 - DNA, 25 bp, Rattus norvegicus
cgctcgcgcgagacaataagccttt

SEQ ID NO: 542563 - DNA, 25 bp, Rattus norvegicus
agctgcccgaaatccgtctgctggg

SEQ ID NO: 542564 - DNA, 25 bp, Rattus norvegicus
ctatgagcaagaacgagcgagcggc

SEQ ID NO: 542565 - DNA, 25 bp, Rattus norvegicus
tcagaagccacagcagcgcgaacgc

SEQ ID NO: 542566 - DNA, 25 bp, Rattus norvegicus
tgtcttccctccgttccgtgtgtcg

SEQ ID NO: 542567 - DNA, 25 bp, Rattus norvegicus
catgcacgcgtgtggacgttcgaga

SEQ ID NO: 542568 - DNA, 25 bp, Rattus norvegicus
gtcacttgctccctcggttgtttat

SEQ ID NO: 542569 - DNA, 25 bp, Rattus norvegicus
ttatttagaacgtactgcctgtgtc

SEQ ID NO: 542570 - DNA, 25 bp, Rattus norvegicus
tccgttccgtgtgtcgggctccaca

SEQ ID NO: 542571 - DNA, 25 bp, Rattus norvegicus
tccacaggctctggggagacacata

SEQ ID NO: 542572 - DNA, 25 bp, Rattus norvegicus
ctctggggagacacataaggaaagc

SEQ ID NO: 542573 - DNA, 25 bp, Rattus norvegicus
gagacacataaggaaagcgccatta

SEQ ID NO: 542574 - DNA, 25 bp, Rattus norvegicus
agcgccattatgttcctgcacgttg

SEQ ID NO: 542575 - DNA, 25 bp, Rattus norvegicus
gaacgtactgcctgtgtcttccctc

SEQ ID NO: 542576 - DNA, 25 bp, Rattus norvegicus
tgctccctcggttgtttatttagaa

SEQ ID NO: 542577 - DNA, 25 bp, Rattus norvegicus
tgttcctgcacgttgcatgcacgcg

SEQ ID NO: 542578 - DNA, 25 bp, Rattus norvegicus
tgcacgttgcatgcacgcgtgtgga

SEQ ID NO: 542579 - DNA, 25 bp, Rattus norvegicus
gtctgcggtcacttgctccctcggt

SEQ ID NO: 542580 - DNA, 25 bp, Rattus norvegicus
tcatcccttttgtgccatccgggtc

SEQ ID NO: 542581 - DNA, 25 bp, Rattus norvegicus
tccgtgcttgtgtgtggacaaaatg

SEQ ID NO: 542582 - DNA, 25 bp, Rattus norvegicus
cagctataggggctgttgtccgtgc

SEQ ID NO: 542583 - DNA, 25 bp, Rattus norvegicus
ttgtttctttacacagagtcgggga

SEQ ID NO: 542584 - DNA, 25 bp, Rattus norvegicus
ggagcttgaagtccaggctattttt

SEQ ID NO: 542585 - DNA, 25 bp, Rattus norvegicus
cggtaggtactaactggagcttgaa

SEQ ID NO: 542586 - DNA, 25 bp, Rattus norvegicus
cctggactcaaaaacaatggcggta

SEQ ID NO: 542587 - DNA, 25 bp, Rattus norvegicus
cgccttagcggcctggactcaaaaa

SEQ ID NO: 542588 - DNA, 25 bp, Rattus norvegicus
actgttgagtgcgacaagcagaggc

SEQ ID NO: 542589 - DNA, 25 bp, Rattus norvegicus
cggccagtactgttgagtgcgacaa

SEQ ID NO: 542590 - DNA, 25 bp, Rattus norvegicus
gcgaagcttcgaggcggccagtact

SEQ ID NO: 542591 - DNA, 25 bp, Rattus norvegicus
gagatttagtctgtggcgaagcttc

SEQ ID NO: 542592 - DNA, 25 bp, Rattus norvegicus
ctctcgcgcaagagatttagtctgt

SEQ ID NO: 542593 - DNA, 25 bp, Rattus norvegicus
ccatccgggtctctcgcgcaagaga

SEQ ID NO: 542594 - DNA, 25 bp, Rattus norvegicus
ggattttggcgacctagagctattc

SEQ ID NO: 542595 - DNA, 25 bp, Rattus norvegicus
ctagagctattcgaggcgtttgatc

SEQ ID NO: 542596 - DNA, 25 bp, Rattus norvegicus
tttgatcctcaagaggagtcgaccc

SEQ ID NO: 542597 - DNA, 25 bp, Rattus norvegicus
ttcacacccgcttcaaggacgacga

SEQ ID NO: 542598 - DNA, 25 bp, Rattus norvegicus
tgacgcggaactgcaggagcagctt

SEQ ID NO: 542599 - DNA, 25 bp, Rattus norvegicus
cagcttcggcgctgtgaggaaacca

SEQ ID NO: 542600 - DNA, 25 bp, Rattus norvegicus
ctgtgaggaaaccatcgagcaactc

SEQ ID NO: 542601 - DNA, 25 bp, Rattus norvegicus
catcgagcaactccgcgccgagaat

SEQ ID NO: 542602 - DNA, 25 bp, Rattus norvegicus
gcgccgagaatatccttccggcttg

SEQ ID NO: 542603 - DNA, 25 bp, Rattus norvegicus
cttccggcttgttgggccctatcac

SEQ ID NO: 542604 - DNA, 25 bp, Rattus norvegicus
ttgggccctatcacctggcacttgg

SEQ ID NO: 542605 - DNA, 25 bp, Rattus norvegicus
tatcacctggcacttggggtctgtg

SEQ ID NO: 542606 - DNA, 25 bp, Rattus norvegicus
ttccaagagaatccgcattctaagt

SEQ ID NO: 542607 - DNA, 25 bp, Rattus norvegicus
attctaagtcatttctcccgcggcc

SEQ ID NO: 542608 - DNA, 25 bp, Rattus norvegicus
gctgctccaatcgaaccgcggcgga

SEQ ID NO: 542609 - DNA, 25 bp, Rattus norvegicus
aaatggcgccaagagcagctccgcg

SEQ ID NO: 542610 - DNA, 25 bp, Rattus norvegicus
tctccgcttcaaaatggcgccaaga

SEQ ID NO: 542611 - DNA, 25 bp, Rattus norvegicus
aggcgaggaagaggcgctccctttc

SEQ ID NO: 542612 - DNA, 25 bp, Rattus norvegicus
tcactttggtcctgtgcgagcggcg

SEQ ID NO: 542613 - DNA, 25 bp, Rattus norvegicus
acggatcactggctgcatagaagca

SEQ ID NO: 542614 - DNA, 25 bp, Rattus norvegicus
aaagcaaattggcacggatcactgg

SEQ ID NO: 542615 - DNA, 25 bp, Rattus norvegicus
tgacactacagcaggcaagactgtg

SEQ ID NO: 542616 - DNA, 25 bp, Rattus norvegicus
atgcctggaataaaatgacactaca

SEQ ID NO: 542617 - DNA, 25 bp, Rattus norvegicus
acacactgtacaaatgcctggaata

SEQ ID NO: 542618 - DNA, 25 bp, Rattus norvegicus
cctcaaggtctcattacacactgta

SEQ ID NO: 542619 - DNA, 25 bp, Rattus norvegicus
cagcagcactgtctgtaagaacaca

SEQ ID NO: 542620 - DNA, 25 bp, Rattus norvegicus
cccgactctcgagcagtgcggcgag

SEQ ID NO: 542621 - DNA, 25 bp, Rattus norvegicus
agtgtcagtggaataacggtgcaga

SEQ ID NO: 542622 - DNA, 25 bp, Rattus norvegicus
gttcgacctgttgccctggacgccg

SEQ ID NO: 542623 - DNA, 25 bp, Rattus norvegicus
taacccgaacctgccagcgcggtcg

SEQ ID NO: 542624 - DNA, 25 bp, Rattus norvegicus
tgccagatctctgaaatcaccgccg

SEQ ID NO: 542625 - DNA, 25 bp, Rattus norvegicus
cccggggtgccagatctctgaaatc

SEQ ID NO: 542626 - DNA, 25 bp, Rattus norvegicus
ccctggattctctgagaaggtggaa

SEQ ID NO: 542627 - DNA, 25 bp, Rattus norvegicus
tacctgagccttcctcgggcaggcc

SEQ ID NO: 542628 - DNA, 25 bp, Rattus norvegicus
gcccgccactcgctacctgagcctt

SEQ ID NO: 542629 - DNA, 25 bp, Rattus norvegicus
cacgcaccgggtccgcggctgaaga

SEQ ID NO: 542630 - DNA, 25 bp, Rattus norvegicus
tcccgccgcctcaagatggagcgtg

SEQ ID NO: 542631 - DNA, 25 bp, Rattus norvegicus
cgcctcaagatggagcgtggactcc

SEQ ID NO: 542632 - DNA, 25 bp, Rattus norvegicus
ctcctcagctctggaggggaggttc

SEQ ID NO: 542633 - DNA, 25 bp, Rattus norvegicus
aggttccggggaccgctctgtcgct

SEQ ID NO: 542634 - DNA, 25 bp, Rattus norvegicus
cgggtctggttcgacctgttgccct

SEQ ID NO: 542635 - DNA, 25 bp, Rattus norvegicus
accgctctgtcgctcgtggaggccg

SEQ ID NO: 542636 - DNA, 25 bp, Rattus norvegicus
cacggacatgtttgcgtgtgcatca

SEQ ID NO: 542637 - DNA, 25 bp, Rattus norvegicus
cccgagatcattttgtttagcaatc

SEQ ID NO: 542638 - DNA, 25 bp, Rattus norvegicus
ttagcgtgcagtgccgtggcattac

SEQ ID NO: 542639 - DNA, 25 bp, Rattus norvegicus
ttagcaatcctgacagacgtgactc

SEQ ID NO: 542640 - DNA, 25 bp, Rattus norvegicus
cgtgtgcatcacttccggttttaaa

SEQ ID NO: 542641 - DNA, 25 bp, Rattus norvegicus
atgttggctcatgcctgtgcgtgca

SEQ ID NO: 542642 - DNA, 25 bp, Rattus norvegicus
tttgcttgctgttccatgttggctc

SEQ ID NO: 542643 - DNA, 25 bp, Rattus norvegicus
ctggtgctctgagtgctttgcttgc

SEQ ID NO: 542644 - DNA, 25 bp, Rattus norvegicus
acggcaggtctcctgcctggtgctc

SEQ ID NO: 542645 - DNA, 25 bp, Rattus norvegicus
gagcatagaccatgctcagggcata

SEQ ID NO: 542646 - DNA, 25 bp, Rattus norvegicus
tcttagtgcaagagcatagaccatg

SEQ ID NO: 542647 - DNA, 25 bp, Rattus norvegicus
cgtgactcagaagttgtgactctta

SEQ ID NO: 542648 - DNA, 25 bp, Rattus norvegicus
ccgtggcattactttatgctgtaca

SEQ ID NO: 542649 - DNA, 25 bp, Rattus norvegicus
cggttttaaacactcttagcgtgca

SEQ ID NO: 542650 - DNA, 25 bp, Rattus norvegicus
tgcgtcagcgactcaggtcacgtga

SEQ ID NO: 542651 - DNA, 25 bp, Rattus norvegicus
gcatgcgcactaggaccttgaagga

SEQ ID NO: 542652 - DNA, 25 bp, Rattus norvegicus
ggaccttgaaggaagccggctgaaa

SEQ ID NO: 542653 - DNA, 25 bp, Rattus norvegicus
ggaagccggctgaaattcactgttc

SEQ ID NO: 542654 - DNA, 25 bp, Rattus norvegicus
cggctgaaattcactgttcgcgtta

SEQ ID NO: 542655 - DNA, 25 bp, Rattus norvegicus
cgcgttaaaggtgcgtcagcgactc

SEQ ID NO: 542656 - DNA, 25 bp, Rattus norvegicus
tgaacggtccgtcacgtgaccgtgg

SEQ ID NO: 542657 - DNA, 25 bp, Rattus norvegicus
cggctcacctgtcatacgggcgagt

SEQ ID NO: 542658 - DNA, 25 bp, Rattus norvegicus
tcatacgggcgagtgaacctgaacg

SEQ ID NO: 542659 - DNA, 25 bp, Rattus norvegicus
tgaacctgaacgtgctgcgcgaggc

SEQ ID NO: 542660 - DNA, 25 bp, Rattus norvegicus
gagctgcgcgagtttctggacaagt

SEQ ID NO: 542661 - DNA, 25 bp, Rattus norvegicus
cgcgagtttctggacaagtgcgctg

SEQ ID NO: 542662 - DNA, 25 bp, Rattus norvegicus
ctcaggtcacgtgaacggtccgtca

SEQ ID NO: 542663 - DNA, 25 bp, Rattus norvegicus
tcactgttcgcgttaaaggtgcgtc

SEQ ID NO: 542664 - DNA, 25 bp, Rattus norvegicus
ctgcttgctatgctgcgtcacttcc

SEQ ID NO: 542665 - DNA, 25 bp, Rattus norvegicus
gtccactatccacgtgctgcagttg

SEQ ID NO: 542666 - DNA, 25 bp, Rattus norvegicus
tcagctacaccgtgctcatcggggc

SEQ ID NO: 542667 - DNA, 25 bp, Rattus norvegicus
cggctggaccacctacttcttggtg

SEQ ID NO: 542668 - DNA, 25 bp, Rattus norvegicus
cttcttggtgctgaagtgacagcgc

SEQ ID NO: 542669 - DNA, 25 bp, Rattus norvegicus
ccggaggagcgcagttccttttcca

SEQ ID NO: 542670 - DNA, 25 bp, Rattus norvegicus
gcagttccttttccaagagcggccc

SEQ ID NO: 542671 - DNA, 25 bp, Rattus norvegicus
cctgcgccgaaaccggagcggttga

SEQ ID NO: 542672 - DNA, 25 bp, Rattus norvegicus
aagccaggtgcgaccgttaaagccg

SEQ ID NO: 542673 - DNA, 25 bp, Rattus norvegicus
cgctcgcgcttctgcttgctatgct

SEQ ID NO: 542674 - DNA, 25 bp, Rattus norvegicus
tggatgactcggagcgtaacctttc

SEQ ID NO: 542675 - DNA, 25 bp, Rattus norvegicus
tttctgttcaggtacggctgcggca

SEQ ID NO: 542676 - DNA, 25 bp, Rattus norvegicus
aggctcccggtctttgcagggcgat

SEQ ID NO: 542677 - DNA, 25 bp, Rattus norvegicus
taaagccgtttcctggtgttctggc

SEQ ID NO: 542678 - DNA, 25 bp, Rattus norvegicus
ctgggaagcaggcaccgcacaagct

SEQ ID NO: 542679 - DNA, 25 bp, Rattus norvegicus
tagcccgttgggttgccagcgccgc

SEQ ID NO: 542680 - DNA, 25 bp, Rattus norvegicus
caacccgaatctagagggctgcggt

SEQ ID NO: 542681 - DNA, 25 bp, Rattus norvegicus
ggcagaatgcggttcccgtccttcc

SEQ ID NO: 542682 - DNA, 25 bp, Rattus norvegicus
ttcccggcaacgggatccaggcgcg

SEQ ID NO: 542683 - DNA, 25 bp, Rattus norvegicus
tgagggcggagctccaaatcgagca

SEQ ID NO: 542684 - DNA, 25 bp, Rattus norvegicus
tccaaatcgagcaacggcgaggctc

SEQ ID NO: 542685 - DNA, 25 bp, Rattus norvegicus
tcgagcaacggcgaggctcttcgga

SEQ ID NO: 542686 - DNA, 25 bp, Rattus norvegicus
ctcttcggagaaggaactgcaggtc

SEQ ID NO: 542687 - DNA, 25 bp, Rattus norvegicus
accttggagtctgcacccggacgca

SEQ ID NO: 542688 - DNA, 25 bp, Rattus norvegicus
tgcacccggacgcacttgcgggttg

SEQ ID NO: 542689 - DNA, 25 bp, Rattus norvegicus
ttcctccaacccgaatctagagggc

SEQ ID NO: 542690 - DNA, 25 bp, Rattus norvegicus
cttccctagcccgttgggttgccag

SEQ ID NO: 542691 - DNA, 25 bp, Rattus norvegicus
ttggtggcagctacgacgccccttc

SEQ ID NO: 542692 - DNA, 25 bp, Rattus norvegicus
gtggaggattctaggaactgtagtc

SEQ ID NO: 542693 - DNA, 25 bp, Rattus norvegicus
cttaacgtcactcccgtgaagctcg

SEQ ID NO: 542694 - DNA, 25 bp, Rattus norvegicus
tcagccacagcggttccgggagtgc

SEQ ID NO: 542695 - DNA, 25 bp, Rattus norvegicus
catcccatcggaactcagatacagc

SEQ ID NO: 542696 - DNA, 25 bp, Rattus norvegicus
cggaactcagatacagccgtgcttc

SEQ ID NO: 542697 - DNA, 25 bp, Rattus norvegicus
ccgtgcttctccctagtcctttggg

SEQ ID NO: 542698 - DNA, 25 bp, Rattus norvegicus
ggccctgttaagagccgtcctttca

SEQ ID NO: 542699 - DNA, 25 bp, Rattus norvegicus
gtcctttcagaaacagagccacgga

SEQ ID NO: 542700 - DNA, 25 bp, Rattus norvegicus
gcctccggcctcaaatagaaggtgg

SEQ ID NO: 542701 - DNA, 25 bp, Rattus norvegicus
ggaactgtagtctgccgcccgttca

SEQ ID NO: 542702 - DNA, 25 bp, Rattus norvegicus
aaggcgtcagttggatgctccgcga

SEQ ID NO: 542703 - DNA, 25 bp, Rattus norvegicus
tccgcgagtcgctaggagctatctt

SEQ ID NO: 542704 - DNA, 25 bp, Rattus norvegicus
gcccgttcagtagtgggccgaacca

SEQ ID NO: 542705 - DNA, 25 bp, Rattus norvegicus
cgctaggagctatcttaacgtcact

SEQ ID NO: 542706 - DNA, 25 bp, Rattus norvegicus
gacagcctcggtaccgtggatctca

SEQ ID NO: 542707 - DNA, 25 bp, Rattus norvegicus
tcctcctgactgtccagaggctgca

SEQ ID NO: 542708 - DNA, 25 bp, Rattus norvegicus
aactgcgtcgactcctcctgactgt

SEQ ID NO: 542709 - DNA, 25 bp, Rattus norvegicus
cacattggattttgcagtctgaccg

SEQ ID NO: 542710 - DNA, 25 bp, Rattus norvegicus
gtaccgtggatctcaccgccgtctt

SEQ ID NO: 542711 - DNA, 25 bp, Rattus norvegicus
aaaactaatgacagcctcggtaccg

SEQ ID NO: 542712 - DNA, 25 bp, Rattus norvegicus
caggcacttcagagaaaaactaatg

SEQ ID NO: 542713 - DNA, 25 bp, Rattus norvegicus
ttcctaccttcaggcacttcagaga

SEQ ID NO: 542714 - DNA, 25 bp, Rattus norvegicus
ctttctcggccagcgcggagtgcaa

SEQ ID NO: 542715 - DNA, 25 bp, Rattus norvegicus
cctcgtggaaggctttctcggccag

SEQ ID NO: 542716 - DNA, 25 bp, Rattus norvegicus
accgctcctcgtggaaggctttctc

SEQ ID NO: 542717 - DNA, 25 bp, Rattus norvegicus
ttttgcagtctgaccgctcctcgtg

SEQ ID NO: 542718 - DNA, 25 bp, Rattus norvegicus
cggggaaggaagcacattggatttt

SEQ ID NO: 542719 - DNA, 25 bp, Rattus norvegicus
tgcaagggctgctggctctttgcct

SEQ ID NO: 542720 - DNA, 25 bp, Rattus norvegicus
cggcgcctcggctttaccatttgcg

SEQ ID NO: 542721 - DNA, 25 bp, Rattus norvegicus
caggctgcccaaagcgctaaattta

SEQ ID NO: 542722 - DNA, 25 bp, Rattus norvegicus
aaactccgcagactcgagggcgccg

SEQ ID NO: 542723 - DNA, 25 bp, Rattus norvegicus
cgctgcacaatggagctcgcgctct

SEQ ID NO: 542724 - DNA, 25 bp, Rattus norvegicus
aacgaaatggcttctggggccggct

SEQ ID NO: 542725 - DNA, 25 bp, Rattus norvegicus
ggctttaccatttgcgcactttctc

SEQ ID NO: 542726 - DNA, 25 bp, Rattus norvegicus
gcactttctccgatagccgccatga

SEQ ID NO: 542727 - DNA, 25 bp, Rattus norvegicus
tagccgccatgaccctcttgatatc

SEQ ID NO: 542728 - DNA, 25 bp, Rattus norvegicus
cttgatatcatcgttggcccggctc

SEQ ID NO: 542729 - DNA, 25 bp, Rattus norvegicus
ggctcctggtctcggctcgaaccga

SEQ ID NO: 542730 - DNA, 25 bp, Rattus norvegicus
tcgaaccgacctgcccgacatggtt

SEQ ID NO: 542731 - DNA, 25 bp, Rattus norvegicus
gctaaatttaaacggctcgcgctct

SEQ ID NO: 542732 - DNA, 25 bp, Rattus norvegicus
ctgcccgacatggttctagcgggga

SEQ ID NO: 542733 - DNA, 25 bp, Rattus norvegicus
aagccgctttcatgtgacttgcaca

SEQ ID NO: 542734 - DNA, 25 bp, Rattus norvegicus
tccagcctcccggtgtccgtagccg

SEQ ID NO: 542735 - DNA, 25 bp, Rattus norvegicus
atgtcgagtgaggaagtccggcacc

SEQ ID NO: 542736 - DNA, 25 bp, Rattus norvegicus
tccgcgatgtcgagtgaggaagtcc

SEQ ID NO: 542737 - DNA, 25 bp, Rattus norvegicus
cgttttaggctgaggtccgcgatgt

SEQ ID NO: 542738 - DNA, 25 bp, Rattus norvegicus
tccggcgttttaggctgaggtccgc

SEQ ID NO: 542739 - DNA, 25 bp, Rattus norvegicus
gctaattacgacgtcctcgagagcg

SEQ ID NO: 542740 - DNA, 25 bp, Rattus norvegicus
aaggctaattacgacgtcctcgaga

SEQ ID NO: 542741 - DNA, 25 bp, Rattus norvegicus
gcagatcaaggctaattacgacgtc

SEQ ID NO: 542742 - DNA, 25 bp, Rattus norvegicus
ctgatgcgacgcaaggaggaaatcg

SEQ ID NO: 542743 - DNA, 25 bp, Rattus norvegicus
acatccaggagctgatgcgacgcaa

SEQ ID NO: 542744 - DNA, 25 bp, Rattus norvegicus
gcggtcagcgacatccaggagctga

SEQ ID NO: 542745 - DNA, 25 bp, Rattus norvegicus
gtgcggccgcggtcagcgacatcca

SEQ ID NO: 542746 - DNA, 25 bp, Rattus norvegicus
cagagtcctctgaggcccgtgcggc

SEQ ID NO: 542747 - DNA, 25 bp, Rattus norvegicus
tcgaggcgcagatcaaggctaatta

SEQ ID NO: 542748 - DNA, 25 bp, Rattus norvegicus
tcgtaccgtttctccctcatgtctg

SEQ ID NO: 542749 - DNA, 25 bp, Rattus norvegicus
agggcttcaagtctgggcctgctcc

SEQ ID NO: 542750 - DNA, 25 bp, Rattus norvegicus
tcacctggtagcaaagagggcttca

SEQ ID NO: 542751 - DNA, 25 bp, Rattus norvegicus
ctcaatgaccatctcatcggcagcg

SEQ ID NO: 542752 - DNA, 25 bp, Rattus norvegicus
cctacctggcggatgttctgaccca

SEQ ID NO: 542753 - DNA, 25 bp, Rattus norvegicus
ccctcatgtctgcaatcacctggta

SEQ ID NO: 542754 - DNA, 25 bp, Rattus norvegicus
gatgccttcgtcctcgtaccgtttc

SEQ ID NO: 542755 - DNA, 25 bp, Rattus norvegicus
tgctaccgatgccttcgtcctcgta

SEQ ID NO: 542756 - DNA, 25 bp, Rattus norvegicus
accctgaacatgtagctgctaccga

SEQ ID NO: 542757 - DNA, 25 bp, Rattus norvegicus
tgtcgtggtctaccctgaacatgta

SEQ ID NO: 542758 - DNA, 25 bp, Rattus norvegicus
cgtcgatgatggtgtcgtggtctac

SEQ ID NO: 542759 - DNA, 25 bp, Rattus norvegicus
tgccgcacttggtggcgtcgatgat

SEQ ID NO: 542760 - DNA, 25 bp, Rattus norvegicus
caaagttgccgcacttggtggcgtc

SEQ ID NO: 542761 - DNA, 25 bp, Rattus norvegicus
gttctgacccacgtactcaatgacc

SEQ ID NO: 542762 - DNA, 25 bp, Rattus norvegicus
tatttattctgctgggactgaggtg

SEQ ID NO: 542763 - DNA, 25 bp, Rattus norvegicus
taatttatttattctgctgggactg

SEQ ID NO: 542764 - DNA, 25 bp, Rattus norvegicus
atttatttattctgctgggactgag

SEQ ID NO: 542765 - DNA, 25 bp, Rattus norvegicus
gggctacccttcgagctacggaaca

SEQ ID NO: 542766 - DNA, 25 bp, Rattus norvegicus
ttatttattctgctgggactgaggt

SEQ ID NO: 542767 - DNA, 25 bp, Rattus norvegicus
atttattctgctgggactgaggtgg

SEQ ID NO: 542768 - DNA, 25 bp, Rattus norvegicus
acggcttctacctcccccgcggctg

SEQ ID NO: 542769 - DNA, 25 bp, Rattus norvegicus
cagctgcgccgccaaagccccgggc

SEQ ID NO: 542770 - DNA, 25 bp, Rattus norvegicus
tggggctacccttcgagctacggaa

SEQ ID NO: 542771 - DNA, 25 bp, Rattus norvegicus
ctcgcgcgctcccacactgcctccc

SEQ ID NO: 542772 - DNA, 25 bp, Rattus norvegicus
cgcggctggggctacccttcgagct

SEQ ID NO: 542773 - DNA, 25 bp, Rattus norvegicus
cggctggggctacccttcgagctac

SEQ ID NO: 542774 - DNA, 25 bp, Rattus norvegicus
ctggggctacccttcgagctacgga

SEQ ID NO: 542775 - DNA, 25 bp, Rattus norvegicus
tttatttattctgctgggactgagg

SEQ ID NO: 542776 - DNA, 25 bp, Rattus norvegicus
tcgagctacggaacactccacggtg

SEQ ID NO: 542777 - DNA, 25 bp, Rattus norvegicus
tacggaacactccacggtgtgcgcc

SEQ ID NO: 542778 - DNA, 25 bp, Rattus norvegicus
tctaaactgcccagaccggaggtgg

SEQ ID NO: 542779 - DNA, 25 bp, Rattus norvegicus
aaactgcccagaccggaggtggacg

SEQ ID NO: 542780 - DNA, 25 bp, Rattus norvegicus
cggcgaaagggctgggtttcgagtg

SEQ ID NO: 542781 - DNA, 25 bp, Rattus norvegicus
ggtgattgtgtgtgttcgactacta

SEQ ID NO: 542782 - DNA, 25 bp, Rattus norvegicus
tgtgtgtgttcgactactaggagcc

SEQ ID NO: 542783 - DNA, 25 bp, Rattus norvegicus
tgttcgactactaggagcctgggga

SEQ ID NO: 542784 - DNA, 25 bp, Rattus norvegicus
ggaggcagacgtcgaccccaaacga

SEQ ID NO: 542785 - DNA, 25 bp, Rattus norvegicus
ccaaacgagttgcaatcgaggtatc

SEQ ID NO: 542786 - DNA, 25 bp, Rattus norvegicus
cgagttgcaatcgaggtatctccga

SEQ ID NO: 542787 - DNA, 25 bp, Rattus norvegicus
tgcaatcgaggtatctccgatcccg

SEQ ID NO: 542788 - DNA, 25 bp, Rattus norvegicus
ccgatcccgcttcctcttcggcccg

SEQ ID NO: 542789 - DNA, 25 bp, Rattus norvegicus
atcgaggtatctccgatcccgcttc

SEQ ID NO: 542790 - DNA, 25 bp, Rattus norvegicus
acttcccagaggttcgtgtattcgc

SEQ ID NO: 542791 - DNA, 25 bp, Rattus norvegicus
tcttgtgtatggaactgctccagtc

SEQ ID NO: 542792 - DNA, 25 bp, Rattus norvegicus
gtggcacgaggtaaactaggattgc

SEQ ID NO: 542793 - DNA, 25 bp, Rattus norvegicus
ccagctccgtttagtagctacgttt

SEQ ID NO: 542794 - DNA, 25 bp, Rattus norvegicus
ttggacggtctctcgacttcccaga

SEQ ID NO: 542795 - DNA, 25 bp, Rattus norvegicus
cgcgtctctttccagctccgtttag

SEQ ID NO: 542796 - DNA, 25 bp, Rattus norvegicus
aactgctccagtctcgcgtctcttt

SEQ ID NO: 542797 - DNA, 25 bp, Rattus norvegicus
gtaaactaggattgcagggaacgcc

SEQ ID NO: 542798 - DNA, 25 bp, Rattus norvegicus
gattgcagggaacgccggacttcaa

SEQ ID NO: 542799 - DNA, 25 bp, Rattus norvegicus
ataatgcctggcgtgagcccgcggt

SEQ ID NO: 542800 - DNA, 25 bp, Rattus norvegicus
gcggtgctgcatgggtaatccaaga

SEQ ID NO: 542801 - DNA, 25 bp, Rattus norvegicus
ctgcatgggtaatccaagaggtggc

SEQ ID NO: 542802 - DNA, 25 bp, Rattus norvegicus
tggcggccatcttgtgtatggaact

SEQ ID NO: 542803 - DNA, 25 bp, Rattus norvegicus
tagctacgttttggacggtctctcg

SEQ ID NO: 542804 - DNA, 25 bp, Rattus norvegicus
ctctcttttgggctgccgaggcgaa

SEQ ID NO: 542805 - DNA, 25 bp, Rattus norvegicus
cgtgggtaggtaattggctggagca

SEQ ID NO: 542806 - DNA, 25 bp, Rattus norvegicus
gtatttcatattggggctctttttc

SEQ ID NO: 542807 - DNA, 25 bp, Rattus norvegicus
ggtggtgtatttcatattggggctc

SEQ ID NO: 542808 - DNA, 25 bp, Rattus norvegicus
ggcttcgtggtggtgtatttcatat

SEQ ID NO: 542809 - DNA, 25 bp, Rattus norvegicus
cgaagcagccgcctcgccggggctt

SEQ ID NO: 542810 - DNA, 25 bp, Rattus norvegicus
agacctctcggtctctcttttgggc

SEQ ID NO: 542811 - DNA, 25 bp, Rattus norvegicus
ggatctgtttgcagacctctcggtc

SEQ ID NO: 542812 - DNA, 25 bp, Rattus norvegicus
tcgcgtggatctgtttgcagacctc

SEQ ID NO: 542813 - DNA, 25 bp, Rattus norvegicus
gctttcgcgtggatctgtttgcaga

SEQ ID NO: 542814 - DNA, 25 bp, Rattus norvegicus
tgtgagtgcaactctgaggcttccc

SEQ ID NO: 542815 - DNA, 25 bp, Rattus norvegicus
cattttgtgagtgcaactctgaggc

SEQ ID NO: 542816 - DNA, 25 bp, Rattus norvegicus
cgctcggcttccattttgtgagtgc

SEQ ID NO: 542817 - DNA, 25 bp, Rattus norvegicus
ggcttccattttgtgagtgcaactc

SEQ ID NO: 542818 - DNA, 25 bp, Rattus norvegicus
cggccgttcactactgctatggcta

SEQ ID NO: 542819 - DNA, 25 bp, Rattus norvegicus
gcccgcgatcctggtgacgggtctc

SEQ ID NO: 542820 - DNA, 25 bp, Rattus norvegicus
taagagcctgcgaggcacggcgccc

SEQ ID NO: 542821 - DNA, 25 bp, Rattus norvegicus
agtaccgggccctaagagcctgcga

SEQ ID NO: 542822 - DNA, 25 bp, Rattus norvegicus
actgctatggctaatggcggccggc

SEQ ID NO: 542823 - DNA, 25 bp, Rattus norvegicus
ccggcgtccatgttggcaccatgac

SEQ ID NO: 542824 - DNA, 25 bp, Rattus norvegicus
ccattcgattgtgggtgtttctgca

SEQ ID NO: 542825 - DNA, 25 bp, Rattus norvegicus
tttctgcacccggaagccagctctt

SEQ ID NO: 542826 - DNA, 25 bp, Rattus norvegicus
ttttcaggtttttgagccgagccga

SEQ ID NO: 542827 - DNA, 25 bp, Rattus norvegicus
acccggaagccagctcttcggggct

SEQ ID NO: 542828 - DNA, 25 bp, Rattus norvegicus
gggctccggggctcgtctgctcttc

SEQ ID NO: 542829 - DNA, 25 bp, Rattus norvegicus
caaaaggccggcgtccatgttggca

SEQ ID NO: 542830 - DNA, 25 bp, Rattus norvegicus
ttggcaccatgacgcagcatctctc

SEQ ID NO: 542831 - DNA, 25 bp, Rattus norvegicus
gggcgtcgcgcaccataattcccga

SEQ ID NO: 542832 - DNA, 25 bp, Rattus norvegicus
gcctcgtagccctggcctgtagccc

SEQ ID NO: 542833 - DNA, 25 bp, Rattus norvegicus
tggagcctcgtagccctggcctgta

SEQ ID NO: 542834 - DNA, 25 bp, Rattus norvegicus
atagtgatcgtaggtgacggcggct

SEQ ID NO: 542835 - DNA, 25 bp, Rattus norvegicus
gcctgtcgctctagtgggctctagc

SEQ ID NO: 542836 - DNA, 25 bp, Rattus norvegicus
cgctctagtgggctctagccaagcg

SEQ ID NO: 542837 - DNA, 25 bp, Rattus norvegicus
gaaggagctgaagatagtgatcgta

SEQ ID NO: 542838 - DNA, 25 bp, Rattus norvegicus
ctgtcgctctagtgggctctagcca

SEQ ID NO: 542839 - DNA, 25 bp, Rattus norvegicus
ccgggcctgtcgctctagtgggctc

SEQ ID NO: 542840 - DNA, 25 bp, Rattus norvegicus
gccagctgccggtgggtggagcctc

SEQ ID NO: 542841 - DNA, 25 bp, Rattus norvegicus
ctgaagatagtgatcgtaggtgacg

SEQ ID NO: 542842 - DNA, 25 bp, Rattus norvegicus
agcgctgcggctccgggctatggac

SEQ ID NO: 542843 - DNA, 25 bp, Rattus norvegicus
tagtgggctctagccaagcgcgcag

SEQ ID NO: 542844 - DNA, 25 bp, Rattus norvegicus
tctagtgggctctagccaagcgcgc

SEQ ID NO: 542845 - DNA, 25 bp, Rattus norvegicus
tgtcgctctagtgggctctagccaa

SEQ ID NO: 542846 - DNA, 25 bp, Rattus norvegicus
ggtagtcatgatccgtgtccagctg

SEQ ID NO: 542847 - DNA, 25 bp, Rattus norvegicus
caaactcggccagctcgttgagctc

SEQ ID NO: 542848 - DNA, 25 bp, Rattus norvegicus
ctcctggaactgtcggtccgtctta

SEQ ID NO: 542849 - DNA, 25 bp, Rattus norvegicus
tccgtcttatggctgaccagtgagc

SEQ ID NO: 542850 - DNA, 25 bp, Rattus norvegicus
gtgatgccaccgttgttgctgctgt

SEQ ID NO: 542851 - DNA, 25 bp, Rattus norvegicus
cctgcctcttgagcggtaagaactt

SEQ ID NO: 542852 - DNA, 25 bp, Rattus norvegicus
ttcacccagcagagcagcacgactt

SEQ ID NO: 542853 - DNA, 25 bp, Rattus norvegicus
cttcggccaggaaaagcagcgtccc

SEQ ID NO: 542854 - DNA, 25 bp, Rattus norvegicus
gacgttgctcacagcctcgatgttg

SEQ ID NO: 542855 - DNA, 25 bp, Rattus norvegicus
caggcgctgaagacgatgagtaacc

SEQ ID NO: 542856 - DNA, 25 bp, Rattus norvegicus
tggacttccaccatcgctacctggg

SEQ ID NO: 542857 - DNA, 25 bp, Rattus norvegicus
tcctcttccggttagatcggtcgtc

SEQ ID NO: 542858 - DNA, 25 bp, Rattus norvegicus
ctcggcttctgggagcgctaaagct

SEQ ID NO: 542859 - DNA, 25 bp, Rattus norvegicus
caggtactgatcatgagggcgaaca

SEQ ID NO: 542860 - DNA, 25 bp, Rattus norvegicus
atcttggtctccaccttggaccgct

SEQ ID NO: 542861 - DNA, 25 bp, Rattus norvegicus
ttcgggtccttctgggtgaccacca

SEQ ID NO: 542862 - DNA, 25 bp, Rattus norvegicus
tcctctccagcagcagatacttgtt

SEQ ID NO: 542863 - DNA, 25 bp, Rattus norvegicus
atacttgttctgcagctcgtagaca

SEQ ID NO: 542864 - DNA, 25 bp, Rattus norvegicus
ctcgtagacagcatcctcggcggct

SEQ ID NO: 542865 - DNA, 25 bp, Rattus norvegicus
tcggcctctttctccagcactggat

SEQ ID NO: 542866 - DNA, 25 bp, Rattus norvegicus
agcactggatccttctcatgcctca

SEQ ID NO: 542867 - DNA, 25 bp, Rattus norvegicus
tgcactacgatctgctcctcggggc

SEQ ID NO: 542868 - DNA, 25 bp, Rattus norvegicus
accacctctttgttcaccatcttgg

SEQ ID NO: 542869 - DNA, 25 bp, Rattus norvegicus
tgctcctcgtgcagcttcgggtcct

SEQ ID NO: 542870 - DNA, 25 bp, Rattus norvegicus
ccctggagccggatgagctgctctt

SEQ ID NO: 542871 - DNA, 25 bp, Rattus norvegicus
tgagctgctcttgacagcgcccgtg

SEQ ID NO: 542872 - DNA, 25 bp, Rattus norvegicus
accagttcattgagctgagccttga

SEQ ID NO: 542873 - DNA, 25 bp, Rattus norvegicus
ccgtgggtgttgaccagttcattga

SEQ ID NO: 542874 - DNA, 25 bp, Rattus norvegicus
ggctcatcacctcggagtaactctg

SEQ ID NO: 542875 - DNA, 25 bp, Rattus norvegicus
agcgcctgcatcgagtgctcgttga

SEQ ID NO: 542876 - DNA, 25 bp, Rattus norvegicus
taggacggcttagcccagctcttcc

SEQ ID NO: 542877 - DNA, 25 bp, Rattus norvegicus
aggctttgagcttggcgcggctcaa

SEQ ID NO: 542878 - DNA, 25 bp, Rattus norvegicus
ttggcgcggctcaagtagagcttgc

SEQ ID NO: 542879 - DNA, 25 bp, Rattus norvegicus
gcttgcgccaggacagcgcctgcat

SEQ ID NO: 542880 - DNA, 25 bp, Rattus norvegicus
ccaggcacgcccagcccgctcccaa

SEQ ID NO: 542881 - DNA, 25 bp, Rattus norvegicus
atcgagtgctcgttgaggctcatca

SEQ ID NO: 542882 - DNA, 25 bp, Rattus norvegicus
cgttgaggctcatcacctcggagta

SEQ ID NO: 542883 - DNA, 25 bp, Rattus norvegicus
cctcggagtaactctggccgatcca

SEQ ID NO: 542884 - DNA, 25 bp, Rattus norvegicus
gcctaggacggcttagcccagctct

SEQ ID NO: 542885 - DNA, 25 bp, Rattus norvegicus
ggccgatccagtccgggtagctgac

SEQ ID NO: 542886 - DNA, 25 bp, Rattus norvegicus
aactctggccgatccagtccgggta

SEQ ID NO: 542887 - DNA, 25 bp, Rattus norvegicus
ctcaagtagagcttgcgccaggaca

SEQ ID NO: 542888 - DNA, 25 bp, Rattus norvegicus
agcaggctcggctagcatttccgcg

SEQ ID NO: 542889 - DNA, 25 bp, Rattus norvegicus
atcggcaacaatgtttacgttccgg

SEQ ID NO: 542890 - DNA, 25 bp, Rattus norvegicus
cgcaagctcggagcccgatcggcaa

SEQ ID NO: 542891 - DNA, 25 bp, Rattus norvegicus
tgccaaggcgctaacggcgcccggt

SEQ ID NO: 542892 - DNA, 25 bp, Rattus norvegicus
acagcgatgccaaggcgctaacggc

SEQ ID NO: 542893 - DNA, 25 bp, Rattus norvegicus
gtgacccaacaacaaaacagcgatg

SEQ ID NO: 542894 - DNA, 25 bp, Rattus norvegicus
ggcgcactcgtgacccaacaacaaa

SEQ ID NO: 542895 - DNA, 25 bp, Rattus norvegicus
cgcctgcgtgcagaggcgcactcgt

SEQ ID NO: 542896 - DNA, 25 bp, Rattus norvegicus
cttcaaaagtcagctcccgggcggc

SEQ ID NO: 542897 - DNA, 25 bp, Rattus norvegicus
gcctgcaactcagcccttcaaaagt

SEQ ID NO: 542898 - DNA, 25 bp, Rattus norvegicus
ccgctgaggccatccgtgcaaattt

SEQ ID NO: 542899 - DNA, 25 bp, Rattus norvegicus
gctttcacgccagcaggctcggcta

SEQ ID NO: 542900 - DNA, 25 bp, Rattus norvegicus
agcccgatcggcaacaatgtttacg

SEQ ID NO: 542901 - DNA, 25 bp, Rattus norvegicus
ggccatccgtgcaaattttgatttc

SEQ ID NO: 542902 - DNA, 25 bp, Rattus norvegicus
gaagctttgtggtgggccggctgcc

SEQ ID NO: 542903 - DNA, 25 bp, Rattus norvegicus
cctcttcttgcactagcggtcggtc

SEQ ID NO: 542904 - DNA, 25 bp, Rattus norvegicus
agtctccttaggaagtgagtgtgcg

SEQ ID NO: 542905 - DNA, 25 bp, Rattus norvegicus
tctccttaggaagtgagtgtgcgcg

SEQ ID NO: 542906 - DNA, 25 bp, Rattus norvegicus
ctccttaggaagtgagtgtgcgcgc

SEQ ID NO: 542907 - DNA, 25 bp, Rattus norvegicus
gatgaggcagctgctggtgcgtttt

SEQ ID NO: 542908 - DNA, 25 bp, Rattus norvegicus
gtctctggtggaagctttgtggtgg

SEQ ID NO: 542909 - DNA, 25 bp, Rattus norvegicus
ctcctcttcttgcactagcggtcgg

SEQ ID NO: 542910 - DNA, 25 bp, Rattus norvegicus
tccgtttcagctttccagcttttct

SEQ ID NO: 542911 - DNA, 25 bp, Rattus norvegicus
ttccgtttcagctttccagcttttc

SEQ ID NO: 542912 - DNA, 25 bp, Rattus norvegicus
ccttccgtttcagctttccagcttt

SEQ ID NO: 542913 - DNA, 25 bp, Rattus norvegicus
gaggaagaaggatgcggggagtggt

SEQ ID NO: 542914 - DNA, 25 bp, Rattus norvegicus
cttcttgcactagcggtcggtcggc

SEQ ID NO: 542915 - DNA, 25 bp, Rattus norvegicus
ctcttcttgcactagcggtcggtcg

SEQ ID NO: 542916 - DNA, 25 bp, Rattus norvegicus
cccattccaggggatccggtgacga

SEQ ID NO: 542917 - DNA, 25 bp, Rattus norvegicus
tgtggctgggttcgtatttcgcgcc

SEQ ID NO: 542918 - DNA, 25 bp, Rattus norvegicus
ggctgggttcgtatttcgcgcccgc

SEQ ID NO: 542919 - DNA, 25 bp, Rattus norvegicus
cattccaggggatccggtgacgaaa

SEQ ID NO: 542920 - DNA, 25 bp, Rattus norvegicus
gggacttcgtgcatgccatggaagg

SEQ ID NO: 542921 - DNA, 25 bp, Rattus norvegicus
tgggttcgtatttcgcgcccgcgtc

SEQ ID NO: 542922 - DNA, 25 bp, Rattus norvegicus
actctgtgcagagggccagcgcgca

SEQ ID NO: 542923 - DNA, 25 bp, Rattus norvegicus
tgcactctgtgcagagggccagcgc

SEQ ID NO: 542924 - DNA, 25 bp, Rattus norvegicus
tggctgcactctgtgcagagggcca

SEQ ID NO: 542925 - DNA, 25 bp, Rattus norvegicus
tcctggctgcactctgtgcagaggg

SEQ ID NO: 542926 - DNA, 25 bp, Rattus norvegicus
ctctcctggctgcactctgtgcaga

SEQ ID NO: 542927 - DNA, 25 bp, Rattus norvegicus
ctgcctgtggctgggttcgtatttc

SEQ ID NO: 542928 - DNA, 25 bp, Rattus norvegicus
catggaaggcaaaggtaaggcaccc

SEQ ID NO: 542929 - DNA, 25 bp, Rattus norvegicus
ccatggaaggcaaaggtaaggcacc

SEQ ID NO: 542930 - DNA, 25 bp, Rattus norvegicus
tgaccgccagagatacgacgagaac

SEQ ID NO: 542931 - DNA, 25 bp, Rattus norvegicus
agcgtgcgattgaccgccagagata

SEQ ID NO: 542932 - DNA, 25 bp, Rattus norvegicus
cagcgtccgtggcttcagcctggag

SEQ ID NO: 542933 - DNA, 25 bp, Rattus norvegicus
ccagctataccagggggacttcgtg

SEQ ID NO: 542934 - DNA, 25 bp, Rattus norvegicus
gctacgtagccagctataccagggg

SEQ ID NO: 542935 - DNA, 25 bp, Rattus norvegicus
cgattgaccgccagagatacgacga

SEQ ID NO: 542936 - DNA, 25 bp, Rattus norvegicus
cctggaggagaagctacgtagccag

SEQ ID NO: 542937 - DNA, 25 bp, Rattus norvegicus
ccgccagagatacgacgagaacgaa

SEQ ID NO: 542938 - DNA, 25 bp, Rattus norvegicus
aattgtcagcgtccgtggcttcagc

SEQ ID NO: 542939 - DNA, 25 bp, Rattus norvegicus
aggaaattgtcagcgtccgtggctt

SEQ ID NO: 542940 - DNA, 25 bp, Rattus norvegicus
acgtggaggaaattgtcagcgtccg

SEQ ID NO: 542941 - DNA, 25 bp, Rattus norvegicus
agaacgaagacttgtcggacgtgga

SEQ ID NO: 542942 - DNA, 25 bp, Rattus norvegicus
gatacgacgagaacgaagacttgtc

SEQ ID NO: 542943 - DNA, 25 bp, Rattus norvegicus
aggagaagctacgtagccagctata

SEQ ID NO: 542944 - DNA, 25 bp, Rattus norvegicus
tggcgcgcgtcgagcctctgcagaa

SEQ ID NO: 542945 - DNA, 25 bp, Rattus norvegicus
cgagcctctgcagaaggggtcgcca

SEQ ID NO: 542946 - DNA, 25 bp, Rattus norvegicus
ggccagcgtcgctgagctgttcttt

SEQ ID NO: 542947 - DNA, 25 bp, Rattus norvegicus
gcgtcgctgagctgttctttgtgtc

SEQ ID NO: 542948 - DNA, 25 bp, Rattus norvegicus
tcgctgagctgttctttgtgtctcc

SEQ ID NO: 542949 - DNA, 25 bp, Rattus norvegicus
cgagggtaacctcctttgtggcgcg

SEQ ID NO: 542950 - DNA, 25 bp, Rattus norvegicus
ttgtgtctcccagggcgggttggaa

SEQ ID NO: 542951 - DNA, 25 bp, Rattus norvegicus
agggtaacctcctttgtggcgcgtg

SEQ ID NO: 542952 - DNA, 25 bp, Rattus norvegicus
tgccgtcgcctcacgggtctggcgc

SEQ ID NO: 542953 - DNA, 25 bp, Rattus norvegicus
cgagagggccccagcgtcctggact

SEQ ID NO: 542954 - DNA, 25 bp, Rattus norvegicus
ttcagtttcagcgtggggatgagca

SEQ ID NO: 542955 - DNA, 25 bp, Rattus norvegicus
gccgcgcggatgttcagtttcagcg

SEQ ID NO: 542956 - DNA, 25 bp, Rattus norvegicus
gatgctcggccagcgtcgctgagct

SEQ ID NO: 542957 - DNA, 25 bp, Rattus norvegicus
gagctcttgtctgtcgccgcggcct

SEQ ID NO: 542958 - DNA, 25 bp, Rattus norvegicus
cgccgaggacgacgactatgaatcg

SEQ ID NO: 542959 - DNA, 25 bp, Rattus norvegicus
tgcatttcctgtggcagcctgggca

SEQ ID NO: 542960 - DNA, 25 bp, Rattus norvegicus
cgacggcccgagcttttgtctgggc

SEQ ID NO: 542961 - DNA, 25 bp, Rattus norvegicus
tcatcgcctcttgcgggcaaagttg

SEQ ID NO: 542962 - DNA, 25 bp, Rattus norvegicus
cgaggctgggcccaccatgagccat

SEQ ID NO: 542963 - DNA, 25 bp, Rattus norvegicus
ctatgaatcggagcccgaccaggtc

SEQ ID NO: 542964 - DNA, 25 bp, Rattus norvegicus
atgagccatggccatgtccgtgagc

SEQ ID NO: 542965 - DNA, 25 bp, Rattus norvegicus
cccaagacgggtgtgcatttcctgt

SEQ ID NO: 542966 - DNA, 25 bp, Rattus norvegicus
ggcgccgtgcaagccacctatgtgt

SEQ ID NO: 542967 - DNA, 25 bp, Rattus norvegicus
catgcatatgcatgaacaccggccc

SEQ ID NO: 542968 - DNA, 25 bp, Rattus norvegicus
cctggctcgcctcatgcatatgcat

SEQ ID NO: 542969 - DNA, 25 bp, Rattus norvegicus
ctccctttgtgtgcgggccgagcac

SEQ ID NO: 542970 - DNA, 25 bp, Rattus norvegicus
acctatgtgtatcccgcagcgcacg

SEQ ID NO: 542971 - DNA, 25 bp, Rattus norvegicus
gagctcctgcctgacgcgctgaggc

SEQ ID NO: 542972 - DNA, 25 bp, Rattus norvegicus
ccatggaggacagttttttggaatc

SEQ ID NO: 542973 - DNA, 25 bp, Rattus norvegicus
gcgggcgcccaaattcgttcacttg

SEQ ID NO: 542974 - DNA, 25 bp, Rattus norvegicus
cagctttggctaagaccgtgacttc

SEQ ID NO: 542975 - DNA, 25 bp, Rattus norvegicus
acatggccggagagtcacaaaaaca

SEQ ID NO: 542976 - DNA, 25 bp, Rattus norvegicus
tcacttgcgaattgcgtaagcggcc

SEQ ID NO: 542977 - DNA, 25 bp, Rattus norvegicus
atcggcgcagcctgcgtctactttg

SEQ ID NO: 542978 - DNA, 25 bp, Rattus norvegicus
ccgctttgagatctggtggatcggc

SEQ ID NO: 542979 - DNA, 25 bp, Rattus norvegicus
tccactggcgctgtcaccggagcga

SEQ ID NO: 542980 - DNA, 25 bp, Rattus norvegicus
tggcgactgcagagaaacccgctcc

SEQ ID NO: 542981 - DNA, 25 bp, Rattus norvegicus
gcgccgccacagctttagaaaacac

SEQ ID NO: 542982 - DNA, 25 bp, Rattus norvegicus
ggctgagcctccaacagcggcagca

SEQ ID NO: 542983 - DNA, 25 bp, Rattus norvegicus
tttttggaatcgttcgggaggctga

SEQ ID NO: 542984 - DNA, 25 bp, Rattus norvegicus
accgtgacttcaggaagggagccca

SEQ ID NO: 542985 - DNA, 25 bp, Rattus norvegicus
accacgctggccaggtaatgagagc

SEQ ID NO: 542986 - DNA, 25 bp, Rattus norvegicus
gtgccacttttgcaaggacatgaag

SEQ ID NO: 542987 - DNA, 25 bp, Rattus norvegicus
tcgcggtgagtgcacagaaggcacc

SEQ ID NO: 542988 - DNA, 25 bp, Rattus norvegicus
cctcagcggtgaagttggctgccaa

SEQ ID NO: 542989 - DNA, 25 bp, Rattus norvegicus
gttggctgccaaccgaacaacagca

SEQ ID NO: 542990 - DNA, 25 bp, Rattus norvegicus
gccaaccgaacaacagcaggagctc

SEQ ID NO: 542991 - DNA, 25 bp, Rattus norvegicus
acaacagcaggagctcgcaggcgcc

SEQ ID NO: 542992 - DNA, 25 bp, Rattus norvegicus
acgcgatgccgcaagtgcgaggcct

SEQ ID NO: 542993 - DNA, 25 bp, Rattus norvegicus
tgccgcaagtgcgaggcctgcctgc

SEQ ID NO: 542994 - DNA, 25 bp, Rattus norvegicus
cagagctgcatcatgcggcagtgca

SEQ ID NO: 542995 - DNA, 25 bp, Rattus norvegicus
ggagagtgccacttttgcaaggaca

SEQ ID NO: 542996 - DNA, 25 bp, Rattus norvegicus
ctgggcgcatgaagcagagctgcat

SEQ ID NO: 542997 - DNA, 25 bp, Rattus norvegicus
atcatgcggcagtgcatcgcggtga

SEQ ID NO: 542998 - DNA, 25 bp, Rattus norvegicus
taagggcaagttgggcccggcctca

SEQ ID NO: 542999 - DNA, 25 bp, Rattus norvegicus
acggagtgtggagagtgccactttt

SEQ ID NO: 543000 - DNA, 25 bp, Rattus norvegicus
gaggatcggctgtcactggccaaca

SEQ ID NO: 543001 - DNA, 25 bp, Rattus norvegicus
gatcggctgtcactggccaacaagc

SEQ ID NO: 543002 - DNA, 25 bp, Rattus norvegicus
cgcttcaagcaggagccagaggacg

SEQ ID NO: 543003 - DNA, 25 bp, Rattus norvegicus
tcaagcaggagccagaggacgacct

SEQ ID NO: 543004 - DNA, 25 bp, Rattus norvegicus
gcaggagccagaggacgacctgcct

SEQ ID NO: 543005 - DNA, 25 bp, Rattus norvegicus
ctgaggcacctcctaagacccggga

SEQ ID NO: 543006 - DNA, 25 bp, Rattus norvegicus
gcacctcctaagacccgggagagtg

SEQ ID NO: 543007 - DNA, 25 bp, Rattus norvegicus
ctaagacccgggagagtgatcagtc

SEQ ID NO: 543008 - DNA, 25 bp, Rattus norvegicus
cccgggagagtgatcagtcacggtc

SEQ ID NO: 543009 - DNA, 25 bp, Rattus norvegicus
agtgatcagtcacggtccagctcgc

SEQ ID NO: 543010 - DNA, 25 bp, Rattus norvegicus
tccagctcgcccacagctgggccca

SEQ ID NO: 543011 - DNA, 25 bp, Rattus norvegicus
gaaggtgaagatgcgccggaaacgg

SEQ ID NO: 543012 - DNA, 25 bp, Rattus norvegicus
cggtcctggaagaacgctgaggatc

SEQ ID NO: 543013 - DNA, 25 bp, Rattus norvegicus
aagaacgctgaggatcggctgtcac

SEQ ID NO: 543014 - DNA, 25 bp, Rattus norvegicus
tccttccttctaaggcggcgaatgc

SEQ ID NO: 543015 - DNA, 25 bp, Rattus norvegicus
tacctagtggcgatgtagacacgtc

SEQ ID NO: 543016 - DNA, 25 bp, Rattus norvegicus
gagaccgactgagcgtccctacgta

SEQ ID NO: 543017 - DNA, 25 bp, Rattus norvegicus
tagcagactgctcacacaacggacc

SEQ ID NO: 543018 - DNA, 25 bp, Rattus norvegicus
cccgggaactcagcaccatagcaga

SEQ ID NO: 543019 - DNA, 25 bp, Rattus norvegicus
tgggcaaccgctgagacgaaaaata

SEQ ID NO: 543020 - DNA, 25 bp, Rattus norvegicus
ccaccatggtggtctctcaggaacc

SEQ ID NO: 543021 - DNA, 25 bp, Rattus norvegicus
acaccgaggcctgaggaaagctcta

SEQ ID NO: 543022 - DNA, 25 bp, Rattus norvegicus
ccgaggtctgggttagctcaaggac

SEQ ID NO: 543023 - DNA, 25 bp, Rattus norvegicus
gctctctgccttctgtctcgtgatg

SEQ ID NO: 543024 - DNA, 25 bp, Rattus norvegicus
ggctactctggtcctagcctcatca

SEQ ID NO: 543025 - DNA, 25 bp, Rattus norvegicus
tagacacgtctagcgctctaggtca

SEQ ID NO: 543026 - DNA, 25 bp, Rattus norvegicus
cctggcatttcaggccgggctactc

SEQ ID NO: 543027 - DNA, 25 bp, Rattus norvegicus
atcgggacgccgaaaagagcacagg

SEQ ID NO: 543028 - DNA, 25 bp, Rattus norvegicus
gaactcttggaaattgttctgcagc

SEQ ID NO: 543029 - DNA, 25 bp, Rattus norvegicus
cctggcagaactcttggaaattgtt

SEQ ID NO: 543030 - DNA, 25 bp, Rattus norvegicus
aattgttctgcagcgcaccgcacgc

SEQ ID NO: 543031 - DNA, 25 bp, Rattus norvegicus
tgttctgcagcgcaccgcacgcgtg

SEQ ID NO: 543032 - DNA, 25 bp, Rattus norvegicus
cggccttcagctgccggtgcagccc

SEQ ID NO: 543033 - DNA, 25 bp, Rattus norvegicus
aacacgcaggcctgctgctggagga

SEQ ID NO: 543034 - DNA, 25 bp, Rattus norvegicus
gctgctggaggagctctttccgctg

SEQ ID NO: 543035 - DNA, 25 bp, Rattus norvegicus
gctctttccgctggcgctgtggaga

SEQ ID NO: 543036 - DNA, 25 bp, Rattus norvegicus
aagggaggcagaatggagcacgctc

SEQ ID NO: 543037 - DNA, 25 bp, Rattus norvegicus
tccgggatacccagaccactccttc

SEQ ID NO: 543038 - DNA, 25 bp, Rattus norvegicus
ttccctcctatcaggacaccgcggc

SEQ ID NO: 543039 - DNA, 25 bp, Rattus norvegicus
taacggtcggtgagggctcgcactt

SEQ ID NO: 543040 - DNA, 25 bp, Rattus norvegicus
caggtcctggcagaactcttggaaa

SEQ ID NO: 543041 - DNA, 25 bp, Rattus norvegicus
cgcacgcgtgctccgcggccttcag

SEQ ID NO: 543042 - DNA, 25 bp, Rattus norvegicus
gccctataagatcgcggtcctggtg

SEQ ID NO: 543043 - DNA, 25 bp, Rattus norvegicus
accgggacacggaggacccgctgct

SEQ ID NO: 543044 - DNA, 25 bp, Rattus norvegicus
acccgctgctgtgggaaacagtcct

SEQ ID NO: 543045 - DNA, 25 bp, Rattus norvegicus
ggccttgaaggcctgtcattgccag

SEQ ID NO: 543046 - DNA, 25 bp, Rattus norvegicus
cctgtcattgccagcgtccacgaga

SEQ ID NO: 543047 - DNA, 25 bp, Rattus norvegicus
cagcgtccacgagagccaatacttc

SEQ ID NO: 543048 - DNA, 25 bp, Rattus norvegicus
cgagagccaatacttcaatccaatg

SEQ ID NO: 543049 - DNA, 25 bp, Rattus norvegicus
caatccaatgatgaccaacggggta

SEQ ID NO: 543050 - DNA, 25 bp, Rattus norvegicus
accaacggggtagtgcacgccaact

SEQ ID NO: 543051 - DNA, 25 bp, Rattus norvegicus
acgccaacttgtttggcatcaagga

SEQ ID NO: 543052 - DNA, 25 bp, Rattus norvegicus
tgctgctgaacgagatgggccgcac

SEQ ID NO: 543053 - DNA, 25 bp, Rattus norvegicus
ctgggtgacgccctataagatcgcg

SEQ ID NO: 543054 - DNA, 25 bp, Rattus norvegicus
cggtcctggtgctgctgaacgagat

SEQ ID NO: 543055 - DNA, 25 bp, Rattus norvegicus
gcatcaaggactgggtgacgcccta

SEQ ID NO: 543056 - DNA, 25 bp, Rattus norvegicus
tctggtatgaactgagacccactcc

SEQ ID NO: 543057 - DNA, 25 bp, Rattus norvegicus
gtgatgcattttagggcgagcctgc

SEQ ID NO: 543058 - DNA, 25 bp, Rattus norvegicus
gttcggagtgagtgatgcattttag

SEQ ID NO: 543059 - DNA, 25 bp, Rattus norvegicus
attttagggcgagcctgcaacagtg

SEQ ID NO: 543060 - DNA, 25 bp, Rattus norvegicus
cgcaggctgcaagtcactcggggac

SEQ ID NO: 543061 - DNA, 25 bp, Rattus norvegicus
cgcttgacaggtgcggaacctgagc

SEQ ID NO: 543062 - DNA, 25 bp, Rattus norvegicus
tggagttccgcaccgaggtccgccg

SEQ ID NO: 543063 - DNA, 25 bp, Rattus norvegicus
cagcgtggagcatctggtatgaact

SEQ ID NO: 543064 - DNA, 25 bp, Rattus norvegicus
caggaacaaagcagcgtggagcatc

SEQ ID NO: 543065 - DNA, 25 bp, Rattus norvegicus
tctccacgctcaggaacaaagcagc

SEQ ID NO: 543066 - DNA, 25 bp, Rattus norvegicus
ggggaacttctccacgctcaggaac

SEQ ID NO: 543067 - DNA, 25 bp, Rattus norvegicus
ggtttcctcataatgggcgttgccc

SEQ ID NO: 543068 - DNA, 25 bp, Rattus norvegicus
cggctgcggaaagggtttcctcata

SEQ ID NO: 543069 - DNA, 25 bp, Rattus norvegicus
ccctggcgcttgacaggtgcggaac

SEQ ID NO: 543070 - DNA, 25 bp, Rattus norvegicus
ggcgctgccaggtctccggcagtct

SEQ ID NO: 543071 - DNA, 25 bp, Rattus norvegicus
cgctgcctcttgaacttggggagga

SEQ ID NO: 543072 - DNA, 25 bp, Rattus norvegicus
agggcgtgtcgctgcctcttgaact

SEQ ID NO: 543073 - DNA, 25 bp, Rattus norvegicus
ttcaagccggttccaggtggctaga

SEQ ID NO: 543074 - DNA, 25 bp, Rattus norvegicus
tgagcagctgcaccgcgcggttcat

SEQ ID NO: 543075 - DNA, 25 bp, Rattus norvegicus
acgtaagccaggatgagcagctgca

SEQ ID NO: 543076 - DNA, 25 bp, Rattus norvegicus
gctcacccgatgacgtaagccagga

SEQ ID NO: 543077 - DNA, 25 bp, Rattus norvegicus
cccactttacggctgcggatgagca

SEQ ID NO: 543078 - DNA, 25 bp, Rattus norvegicus
ttacggctgcggatgagcacgatgc

SEQ ID NO: 543079 - DNA, 25 bp, Rattus norvegicus
atgcgcggcgtgtcgtactcgaaca

SEQ ID NO: 543080 - DNA, 25 bp, Rattus norvegicus
aggctcgctgcgacgcccggaaata

SEQ ID NO: 543081 - DNA, 25 bp, Rattus norvegicus
aaggacccgagcacggagcagcagc

SEQ ID NO: 543082 - DNA, 25 bp, Rattus norvegicus
gaggcctgaggatcgcgtctcctcc

SEQ ID NO: 543083 - DNA, 25 bp, Rattus norvegicus
tcgtactcgaacaggaaggacccga

SEQ ID NO: 543084 - DNA, 25 bp, Rattus norvegicus
tcacgctctggatccgggtgacttt

SEQ ID NO: 543085 - DNA, 25 bp, Rattus norvegicus
cagctgcagcaagccggcatggcga

SEQ ID NO: 543086 - DNA, 25 bp, Rattus norvegicus
ggcatggcgacaggctcactctgtt

SEQ ID NO: 543087 - DNA, 25 bp, Rattus norvegicus
gcaagatccacttgatggtgccgta

SEQ ID NO: 543088 - DNA, 25 bp, Rattus norvegicus
cctaacgtaggaaaagacggtcatg

SEQ ID NO: 543089 - DNA, 25 bp, Rattus norvegicus
gacggtcatgtgcaagatccacttg

SEQ ID NO: 543090 - DNA, 25 bp, Rattus norvegicus
ggtgccgtaattcacgctctggatc

SEQ ID NO: 543091 - DNA, 25 bp, Rattus norvegicus
ccgggtgactttgtttgtctcatac

SEQ ID NO: 543092 - DNA, 25 bp, Rattus norvegicus
tgtctcatactgaaagacatcgttc

SEQ ID NO: 543093 - DNA, 25 bp, Rattus norvegicus
gcgacaggctcactctgtttcggcg

SEQ ID NO: 543094 - DNA, 25 bp, Rattus norvegicus
tccagtgctgccgagatctgcccat

SEQ ID NO: 543095 - DNA, 25 bp, Rattus norvegicus
agacatcgttccagctgcagcaagc

SEQ ID NO: 543096 - DNA, 25 bp, Rattus norvegicus
cggcgctgtccagtgctgccgagat

SEQ ID NO: 543097 - DNA, 25 bp, Rattus norvegicus
ccacttgatggtgccgtaattcacg

SEQ ID NO: 543098 - DNA, 25 bp, Rattus norvegicus
aaccgttgccaaggagcggtctcta

SEQ ID NO: 543099 - DNA, 25 bp, Rattus norvegicus
ttgctaattttagcgcgcagcgccc

SEQ ID NO: 543100 - DNA, 25 bp, Rattus norvegicus
gagggagagtaattgcttttgctaa

SEQ ID NO: 543101 - DNA, 25 bp, Rattus norvegicus
agctcggcctcttgcgctggaagag

SEQ ID NO: 543102 - DNA, 25 bp, Rattus norvegicus
ctggtgaattagctcggcctcttgc

SEQ ID NO: 543103 - DNA, 25 bp, Rattus norvegicus
tgagtgctggtgaattagctcggcc

SEQ ID NO: 543104 - DNA, 25 bp, Rattus norvegicus
gccagaataacacgcgcgtcctggt

SEQ ID NO: 543105 - DNA, 25 bp, Rattus norvegicus
cccggctaggccagaataacacgcg

SEQ ID NO: 543106 - DNA, 25 bp, Rattus norvegicus
gccaactcgcggtcgggaacgccgc

SEQ ID NO: 543107 - DNA, 25 bp, Rattus norvegicus
tcgtgaggaggatttgaggtaaccc

SEQ ID NO: 543108 - DNA, 25 bp, Rattus norvegicus
tgccaaggagcggtctctaggaacc

SEQ ID NO: 543109 - DNA, 25 bp, Rattus norvegicus
tgacatcactgcatggcaaccgttg

SEQ ID NO: 543110 - DNA, 25 bp, Rattus norvegicus
cccaagccataggaagtgacatcac

SEQ ID NO: 543111 - DNA, 25 bp, Rattus norvegicus
gcggtctctaggaacccgctagcgc

SEQ ID NO: 543112 - DNA, 25 bp, Rattus norvegicus
ggacaccagtccctgcgcgcctcgg

SEQ ID NO: 543113 - DNA, 25 bp, Rattus norvegicus
gcgcggaggcaagccaaggacacca

SEQ ID NO: 543114 - DNA, 25 bp, Rattus norvegicus
ggcaagccaaggacaccagtccctg

SEQ ID NO: 543115 - DNA, 25 bp, Rattus norvegicus
gcgttccggcgcctccctgccacca

SEQ ID NO: 543116 - DNA, 25 bp, Rattus norvegicus
cggcgcctccctgccaccacgcggc

SEQ ID NO: 543117 - DNA, 25 bp, Rattus norvegicus
gcacagagcgcccacccgtgagctc

SEQ ID NO: 543118 - DNA, 25 bp, Rattus norvegicus
cgtgagctccgcgatctattcctgc

SEQ ID NO: 543119 - DNA, 25 bp, Rattus norvegicus
gagctccgcgatctattcctgcacg

SEQ ID NO: 543120 - DNA, 25 bp, Rattus norvegicus
cgcgatctattcctgcacgcggacg

SEQ ID NO: 543121 - DNA, 25 bp, Rattus norvegicus
cgatctattcctgcacgcggacgga

SEQ ID NO: 543122 - DNA, 25 bp, Rattus norvegicus
tctattcctgcacgcggacggaatg

SEQ ID NO: 543123 - DNA, 25 bp, Rattus norvegicus
tcctgcacgcggacggaatgggaaa

SEQ ID NO: 543124 - DNA, 25 bp, Rattus norvegicus
acggaatgggaaagccgcgaccgcg

SEQ ID NO: 543125 - DNA, 25 bp, Rattus norvegicus
cggaggcaagccaaggacaccagtc

SEQ ID NO: 543126 - DNA, 25 bp, Rattus norvegicus
ctcacacaaagaccgtggaggaggt

SEQ ID NO: 543127 - DNA, 25 bp, Rattus norvegicus
aggtgctgggccacttcggcgtcaa

SEQ ID NO: 543128 - DNA, 25 bp, Rattus norvegicus
cgcgcggcctcgatccgggttactg

SEQ ID NO: 543129 - DNA, 25 bp, Rattus norvegicus
gctgggctctctcggccaatgagcg

SEQ ID NO: 543130 - DNA, 25 bp, Rattus norvegicus
aatgagcggcgtccacatgccgcgg

SEQ ID NO: 543131 - DNA, 25 bp, Rattus norvegicus
gcctggagcaggtcaagaagctcaa

SEQ ID NO: 543132 - DNA, 25 bp, Rattus norvegicus
tcaacgagagcacggggctgagcct

SEQ ID NO: 543133 - DNA, 25 bp, Rattus norvegicus
attcagcgcccggtcaggcggaagc

SEQ ID NO: 543134 - DNA, 25 bp, Rattus norvegicus
cacttcggcgtcaacgagagcacgg

SEQ ID NO: 543135 - DNA, 25 bp, Rattus norvegicus
cgcagccatggagaacgctcacaca

SEQ ID NO: 543136 - DNA, 25 bp, Rattus norvegicus
aggcagcggcggataaatgctatta

SEQ ID NO: 543137 - DNA, 25 bp, Rattus norvegicus
atgctattagagcagcctccgcgga

SEQ ID NO: 543138 - DNA, 25 bp, Rattus norvegicus
cggctggcaacagaggcaacgcaca

SEQ ID NO: 543139 - DNA, 25 bp, Rattus norvegicus
cagaggcaacgcacactcgcggcgg

SEQ ID NO: 543140 - DNA, 25 bp, Rattus norvegicus
gctcctccgggaagtcaggcgcttc

SEQ ID NO: 543141 - DNA, 25 bp, Rattus norvegicus
cgctctgcgccgtgacgtcatgact

SEQ ID NO: 543142 - DNA, 25 bp, Rattus norvegicus
gaacggagcggctactgcggactcc

SEQ ID NO: 543143 - DNA, 25 bp, Rattus norvegicus
cgccagatccctgtgggaggacgcc

SEQ ID NO: 543144 - DNA, 25 bp, Rattus norvegicus
ggaggaggaaccagctcccgactga

SEQ ID NO: 543145 - DNA, 25 bp, Rattus norvegicus
cgccgtgacgtcatgactgcgcgac

SEQ ID NO: 543146 - DNA, 25 bp, Rattus norvegicus
taactaattacggagctgagacgca

SEQ ID NO: 543147 - DNA, 25 bp, Rattus norvegicus
gaagtcaggcgcttccctcactgca

SEQ ID NO: 543148 - DNA, 25 bp, Rattus norvegicus
cactgacacgctcgggttgcggccg

SEQ ID NO: 543149 - DNA, 25 bp, Rattus norvegicus
tcacttctcacgctcctgcgaaaag

SEQ ID NO: 543150 - DNA, 25 bp, Rattus norvegicus
gcaactgcagaacggagcggctact

SEQ ID NO: 543151 - DNA, 25 bp, Rattus norvegicus
cgttcggtaatccagcaactgcaga

SEQ ID NO: 543152 - DNA, 25 bp, Rattus norvegicus
gctgagacgcacacgttcggtaatc

SEQ ID NO: 543153 - DNA, 25 bp, Rattus norvegicus
accagctcccgactgaggtggagcc

SEQ ID NO: 543154 - DNA, 25 bp, Rattus norvegicus
gcggtgactgagtcagctggcttcc

SEQ ID NO: 543155 - DNA, 25 bp, Rattus norvegicus
gacgacaacttctccaccatcgtgg

SEQ ID NO: 543156 - DNA, 25 bp, Rattus norvegicus
gctcagggactgcagtggctaagac

SEQ ID NO: 543157 - DNA, 25 bp, Rattus norvegicus
cggaaatcgggattgccatgggctc

SEQ ID NO: 543158 - DNA, 25 bp, Rattus norvegicus
cgctctgaagaagtcggaaatcggg

SEQ ID NO: 543159 - DNA, 25 bp, Rattus norvegicus
cgcgcccgctctgaagaagtcggaa

SEQ ID NO: 543160 - DNA, 25 bp, Rattus norvegicus
acgacgcgcccgctctgaagaagtc

SEQ ID NO: 543161 - DNA, 25 bp, Rattus norvegicus
tgatggtgtgaacgacgcgcccgct

SEQ ID NO: 543162 - DNA, 25 bp, Rattus norvegicus
ccctttcagactggtgatggtgtga

SEQ ID NO: 543163 - DNA, 25 bp, Rattus norvegicus
ggcttccctttcagactggtgatgg

SEQ ID NO: 543164 - DNA, 25 bp, Rattus norvegicus
gctggcttccctttcagactggtga

SEQ ID NO: 543165 - DNA, 25 bp, Rattus norvegicus
tgagtcagctggcttccctttcaga

SEQ ID NO: 543166 - DNA, 25 bp, Rattus norvegicus
tgactgagtcagctggcttcccttt

SEQ ID NO: 543167 - DNA, 25 bp, Rattus norvegicus
tctccaccatcgtggccgctgttga

SEQ ID NO: 543168 - DNA, 25 bp, Rattus norvegicus
tataggttgctacggatgtgcctgc

SEQ ID NO: 543169 - DNA, 25 bp, Rattus norvegicus
cctgcgtaaaaagaggcagtcgtga

SEQ ID NO: 543170 - DNA, 25 bp, Rattus norvegicus
agaggactgcgtcgttctggaaata

SEQ ID NO: 543171 - DNA, 25 bp, Rattus norvegicus
cctccatgtctgactgggtggactg

SEQ ID NO: 543172 - DNA, 25 bp, Rattus norvegicus
tacgccagagcggaacctccatgtc

SEQ ID NO: 543173 - DNA, 25 bp, Rattus norvegicus
gccaagggtgctcccagtctcgaaa

SEQ ID NO: 543174 - DNA, 25 bp, Rattus norvegicus
ctgcgtcgggccttacaaaaggctg

SEQ ID NO: 543175 - DNA, 25 bp, Rattus norvegicus
agaccaccggaagaggccctcgcta

SEQ ID NO: 543176 - DNA, 25 bp, Rattus norvegicus
cgcctccactcacgggttgttatta

SEQ ID NO: 543177 - DNA, 25 bp, Rattus norvegicus
gttgttattactcatggtcagcagc

SEQ ID NO: 543178 - DNA, 25 bp, Rattus norvegicus
gagccgcacgttggagtgcagccca

SEQ ID NO: 543179 - DNA, 25 bp, Rattus norvegicus
gccatgtcccgcacatgatctatca

SEQ ID NO: 543180 - DNA, 25 bp, Rattus norvegicus
tggaaatagccagtcctccgagacc

SEQ ID NO: 543181 - DNA, 25 bp, Rattus norvegicus
gagccgagtctcagggaaagttcca

SEQ ID NO: 543182 - DNA, 25 bp, Rattus norvegicus
cccagatcgacacgtagtcattgcg

SEQ ID NO: 543183 - DNA, 25 bp, Rattus norvegicus
ttgatggtacactgacggactccgc

SEQ ID NO: 543184 - DNA, 25 bp, Rattus norvegicus
ttttctcgtgcctttgcggtgtgtt

SEQ ID NO: 543185 - DNA, 25 bp, Rattus norvegicus
cacgtagtcattgcgagttaggcca

SEQ ID NO: 543186 - DNA, 25 bp, Rattus norvegicus
cactgctctaggatactctccaaac

SEQ ID NO: 543187 - DNA, 25 bp, Rattus norvegicus
ggatactctccaaactcaggctatc

SEQ ID NO: 543188 - DNA, 25 bp, Rattus norvegicus
aactctttgtttgccttcgatccgg

SEQ ID NO: 543189 - DNA, 25 bp, Rattus norvegicus
ccttcgatccggctgaagggcgttc

SEQ ID NO: 543190 - DNA, 25 bp, Rattus norvegicus
tttattctcgtctcctccggcactg

SEQ ID NO: 543191 - DNA, 25 bp, Rattus norvegicus
ccctgagccgcaaagcaggatggga

SEQ ID NO: 543192 - DNA, 25 bp, Rattus norvegicus
cattgcgagttaggccactgctcta

SEQ ID NO: 543193 - DNA, 25 bp, Rattus norvegicus
cttcctggccgggttgatggtacac

SEQ ID NO: 543194 - DNA, 25 bp, Rattus norvegicus
cactgacggactccgcctcgttttt

SEQ ID NO: 543195 - DNA, 25 bp, Rattus norvegicus
cagcgggagagagcggcaccttcct

SEQ ID NO: 543196 - DNA, 25 bp, Rattus norvegicus
tgccctgtgaaacgcgtaccgagga

SEQ ID NO: 543197 - DNA, 25 bp, Rattus norvegicus
tccgggttctcacagcgatctgcca

SEQ ID NO: 543198 - DNA, 25 bp, Rattus norvegicus
gcgtgggtagaagccaatcgcaacc

SEQ ID NO: 543199 - DNA, 25 bp, Rattus norvegicus
aacccagatctcttgtccatcgctg

SEQ ID NO: 543200 - DNA, 25 bp, Rattus norvegicus
ttactacacctaggactacggagcg

SEQ ID NO: 543201 - DNA, 25 bp, Rattus norvegicus
gccggagcactgatttcttggcttt

SEQ ID NO: 543202 - DNA, 25 bp, Rattus norvegicus
tcttggctttgactcctagggtgac

SEQ ID NO: 543203 - DNA, 25 bp, Rattus norvegicus
aacccaaggtttgcagatcctccga

SEQ ID NO: 543204 - DNA, 25 bp, Rattus norvegicus
atcctccgagggtctagaatactga

SEQ ID NO: 543205 - DNA, 25 bp, Rattus norvegicus
tatggatttgccctgacgcgtcctg

SEQ ID NO: 543206 - DNA, 25 bp, Rattus norvegicus
gcaccatccgggagtcgtttgagca

SEQ ID NO: 543207 - DNA, 25 bp, Rattus norvegicus
ccgcctcgggtctagtttcaggatc

SEQ ID NO: 543208 - DNA, 25 bp, Rattus norvegicus
gacaagctgcgcataccgaggcatg

SEQ ID NO: 543209 - DNA, 25 bp, Rattus norvegicus
gcagagagcggaagcgaattaccca

SEQ ID NO: 543210 - DNA, 25 bp, Rattus norvegicus
cgggcggaaagtgagagcaacatcc

SEQ ID NO: 543211 - DNA, 25 bp, Rattus norvegicus
gcggccgttcttgctttgctactta

SEQ ID NO: 543212 - DNA, 25 bp, Rattus norvegicus
tttcccgtagccatgctgaagtgtg

SEQ ID NO: 543213 - DNA, 25 bp, Rattus norvegicus
aacggtgctgcgagaaattcctcgc

SEQ ID NO: 543214 - DNA, 25 bp, Rattus norvegicus
acgagtttgcgagagactgtcctac

SEQ ID NO: 543215 - DNA, 25 bp, Rattus norvegicus
ttccgccaccaatgagacgacgagt

SEQ ID NO: 543216 - DNA, 25 bp, Rattus norvegicus
ccgggattccgttcagtcaccacga

SEQ ID NO: 543217 - DNA, 25 bp, Rattus norvegicus
ggctcaccatcctgtcaccgggatt

SEQ ID NO: 543218 - DNA, 25 bp, Rattus norvegicus
caggaagaagacgtgtggccacacc

SEQ ID NO: 543219 - DNA, 25 bp, Rattus norvegicus
tgcagcggctacttcgcgctctgca

SEQ ID NO: 543220 - DNA, 25 bp, Rattus norvegicus
cacgagttcgctctatggggtcgca

SEQ ID NO: 543221 - DNA, 25 bp, Rattus norvegicus
ctaacgcctgtgaagggtctccatc

SEQ ID NO: 543222 - DNA, 25 bp, Rattus norvegicus
ggtctccatcgtcctcttaggcttc

SEQ ID NO: 543223 - DNA, 25 bp, Rattus norvegicus
actgacaccgcgaagccgggcctta

SEQ ID NO: 543224 - DNA, 25 bp, Rattus norvegicus
aagcagggaagcctcgcactccgga

SEQ ID NO: 543225 - DNA, 25 bp, Rattus norvegicus
ttccgctccactagcgtgttccggg

SEQ ID NO: 543226 - DNA, 25 bp, Rattus norvegicus
tacggaagtccttgccgaagccgca

SEQ ID NO: 543227 - DNA, 25 bp, Rattus norvegicus
acacattcccaaggcggtggtgacc

SEQ ID NO: 543228 - DNA, 25 bp, Rattus norvegicus
ctcaaccaaactggggtcccggctg

SEQ ID NO: 543229 - DNA, 25 bp, Rattus norvegicus
cccgtacgacaagaccgagaacatc

SEQ ID NO: 543230 - DNA, 25 bp, Rattus norvegicus
ttgagcaggcccttacggaagtcct

SEQ ID NO: 543231 - DNA, 25 bp, Rattus norvegicus
tagcacgcgcccttcttgagcaggc

SEQ ID NO: 543232 - DNA, 25 bp, Rattus norvegicus
atggtgaggcagaaaacgcgtctcg

SEQ ID NO: 543233 - DNA, 25 bp, Rattus norvegicus
tgcaccgggacagactggacacatt

SEQ ID NO: 543234 - DNA, 25 bp, Rattus norvegicus
gctgtgactaagaagagtgcggttc

SEQ ID NO: 543235 - DNA, 25 bp, Rattus norvegicus
ggcaaagcgaggttagcagcctgca

SEQ ID NO: 543236 - DNA, 25 bp, Rattus norvegicus
agctcgccaagaagcagggattccc

SEQ ID NO: 543237 - DNA, 25 bp, Rattus norvegicus
tctaccgcacgcactggagccagag

SEQ ID NO: 543238 - DNA, 25 bp, Rattus norvegicus
gcgagtagaccagtaagaacgtacg

SEQ ID NO: 543239 - DNA, 25 bp, Rattus norvegicus
taaactgctgcacctcttcgagcac

SEQ ID NO: 543240 - DNA, 25 bp, Rattus norvegicus
actccctggagcgagtagaccagta

SEQ ID NO: 543241 - DNA, 25 bp, Rattus norvegicus
tacaaagtgctaactccctggagcg

SEQ ID NO: 543242 - DNA, 25 bp, Rattus norvegicus
cacggacggtgggtacaaagtgcta

SEQ ID NO: 543243 - DNA, 25 bp, Rattus norvegicus
tcttcgagcacccaggtcgttgcca

SEQ ID NO: 543244 - DNA, 25 bp, Rattus norvegicus
tcctgctggtgctcctaaactgctg

SEQ ID NO: 543245 - DNA, 25 bp, Rattus norvegicus
atagtatgctagtccatggggtcgc

SEQ ID NO: 543246 - DNA, 25 bp, Rattus norvegicus
gcctagctctctggcgcgggatagt

SEQ ID NO: 543247 - DNA, 25 bp, Rattus norvegicus
tgttgcccggcaacagacaggccta

SEQ ID NO: 543248 - DNA, 25 bp, Rattus norvegicus
tagcgctcggctgtgactgttgccc

SEQ ID NO: 543249 - DNA, 25 bp, Rattus norvegicus
tttctccgcagactagcgtggcctc

SEQ ID NO: 543250 - DNA, 25 bp, Rattus norvegicus
gagccctttcccgtggtgcctagcg

SEQ ID NO: 543251 - DNA, 25 bp, Rattus norvegicus
tgatcggcgggccttaacccaatcc

SEQ ID NO: 543252 - DNA, 25 bp, Rattus norvegicus
gatgatactgtcgatgttgagttta

SEQ ID NO: 543253 - DNA, 25 bp, Rattus norvegicus
caagcggctcccgagaaagaccggc

SEQ ID NO: 543254 - DNA, 25 bp, Rattus norvegicus
ccagcagccgttggatgatactgtc

SEQ ID NO: 543255 - DNA, 25 bp, Rattus norvegicus
gttgagtttatcgatatccgccatc

SEQ ID NO: 543256 - DNA, 25 bp, Rattus norvegicus
tctcgccactggaaccacgagaaga

SEQ ID NO: 543257 - DNA, 25 bp, Rattus norvegicus
accacgagaagaacaaaatggccgc

SEQ ID NO: 543258 - DNA, 25 bp, Rattus norvegicus
gccgggacttctttacaggcccata

SEQ ID NO: 543259 - DNA, 25 bp, Rattus norvegicus
cgacgctgcaacagcgcgcgggatc

SEQ ID NO: 543260 - DNA, 25 bp, Rattus norvegicus
attgaccggcggctatgcgctgcaa

SEQ ID NO: 543261 - DNA, 25 bp, Rattus norvegicus
tatgcgctgcaagggtcaccctctc

SEQ ID NO: 543262 - DNA, 25 bp, Rattus norvegicus
ctcccgactctgctgctttgagaca

SEQ ID NO: 543263 - DNA, 25 bp, Rattus norvegicus
tttgagacagaagtcggtcgacctg

SEQ ID NO: 543264 - DNA, 25 bp, Rattus norvegicus
cagagacggttgagcgacgctgcaa

SEQ ID NO: 543265 - DNA, 25 bp, Rattus norvegicus
gaaagaccggcctctactgggcctg

SEQ ID NO: 543266 - DNA, 25 bp, Rattus norvegicus
atcgcacattgaaggccagacaagc

SEQ ID NO: 543267 - DNA, 25 bp, Rattus norvegicus
tgtccccggactaagatctcggctc

SEQ ID NO: 543268 - DNA, 25 bp, Rattus norvegicus
cgacctgggaaggaagccaaatgtc

SEQ ID NO: 543269 - DNA, 25 bp, Rattus norvegicus
gcgtcagatacgacctgggaaggaa

SEQ ID NO: 543270 - DNA, 25 bp, Rattus norvegicus
gccgcagccggcttcacacccgcgt

SEQ ID NO: 543271 - DNA, 25 bp, Rattus norvegicus
cacagcccgctttttctccgggaag

SEQ ID NO: 543272 - DNA, 25 bp, Rattus norvegicus
tgcgagctgtggcaccagaatccct

SEQ ID NO: 543273 - DNA, 25 bp, Rattus norvegicus
ccagaatgttgcgagctgtggcacc

SEQ ID NO: 543274 - DNA, 25 bp, Rattus norvegicus
gccagacaagcccagaatgttgcga

SEQ ID NO: 543275 - DNA, 25 bp, Rattus norvegicus
acccgcgtgccattccgagttcgtt

SEQ ID NO: 543276 - DNA, 25 bp, Rattus norvegicus
gctccaactctcaaaatcgcacatt

SEQ ID NO: 543277 - DNA, 25 bp, Rattus norvegicus
gtttcttctcgctccaactctcaaa

SEQ ID NO: 543278 - DNA, 25 bp, Rattus norvegicus
tgccattccgagttcgtttcttctc

SEQ ID NO: 543279 - DNA, 25 bp, Rattus norvegicus
ttgaaggccagacaagcccagaatg

SEQ ID NO: 543280 - DNA, 25 bp, Rattus norvegicus
gggttagtctctgcgtcttgtttcg

SEQ ID NO: 543281 - DNA, 25 bp, Rattus norvegicus
caagacggcgcctggacttacggcg

SEQ ID NO: 543282 - DNA, 25 bp, Rattus norvegicus
acttacggcggctgcaggtgagcag

SEQ ID NO: 543283 - DNA, 25 bp, Rattus norvegicus
caggtgagcagaccggcccgccttt

SEQ ID NO: 543284 - DNA, 25 bp, Rattus norvegicus
agaccggcccgcctttgttcgctgc

SEQ ID NO: 543285 - DNA, 25 bp, Rattus norvegicus
gcctttgttcgctgccgcctcgagc

SEQ ID NO: 543286 - DNA, 25 bp, Rattus norvegicus
cggcctctgggatgcgggagccgcc

SEQ ID NO: 543287 - DNA, 25 bp, Rattus norvegicus
gacgcggctgcgcagccatccagcc

SEQ ID NO: 543288 - DNA, 25 bp, Rattus norvegicus
cgcctcctccaccggctgctgcagc

SEQ ID NO: 543289 - DNA, 25 bp, Rattus norvegicus
gctgctgcagccaggacgctcggtg

SEQ ID NO: 543290 - DNA, 25 bp, Rattus norvegicus
cgggccgatccctgcgggttagtct

SEQ ID NO: 543291 - DNA, 25 bp, Rattus norvegicus
cgatccctgcgggttagtctctgcg

SEQ ID NO: 543292 - DNA, 25 bp, Rattus norvegicus
ccctgcgggttagtctctgcgtctt

SEQ ID NO: 543293 - DNA, 25 bp, Rattus norvegicus
tgcgggttagtctctgcgtcttgtt

SEQ ID NO: 543294 - DNA, 25 bp, Rattus norvegicus
aggcctgcgcagatctataaattga

SEQ ID NO: 543295 - DNA, 25 bp, Rattus norvegicus
cgatcgatcggcctgatttgattta

SEQ ID NO: 543296 - DNA, 25 bp, Rattus norvegicus
actctcctgattggccgatcgatcg

SEQ ID NO: 543297 - DNA, 25 bp, Rattus norvegicus
taatgcaccggctagactctcctga

SEQ ID NO: 543298 - DNA, 25 bp, Rattus norvegicus
ggcggtctgtcagagtcactcactg

SEQ ID NO: 543299 - DNA, 25 bp, Rattus norvegicus
tctagcttagaaggcgccggagata

SEQ ID NO: 543300 - DNA, 25 bp, Rattus norvegicus
gtgatctttaactgcggtgaacgtc

SEQ ID NO: 543301 - DNA, 25 bp, Rattus norvegicus
ggaaccggggcttatcttaatcaca

SEQ ID NO: 543302 - DNA, 25 bp, Rattus norvegicus
tcggctatgagacaggccaggcgct

SEQ ID NO: 543303 - DNA, 25 bp, Rattus norvegicus
gagaaatttactgctctcccgctgg

SEQ ID NO: 543304 - DNA, 25 bp, Rattus norvegicus
ctgctcctccatcggctgtttgatg

SEQ ID NO: 543305 - DNA, 25 bp, Rattus norvegicus
ctcactgcagcacaacagatgttcg

SEQ ID NO: 543306 - DNA, 25 bp, Rattus norvegicus
gcctccagcatcgattaccgttata

SEQ ID NO: 543307 - DNA, 25 bp, Rattus norvegicus
tcaaatttggcgtctgagaagctgc

SEQ ID NO: 543308 - DNA, 25 bp, Rattus norvegicus
gagaaacacggcttctcgggacagc

SEQ ID NO: 543309 - DNA, 25 bp, Rattus norvegicus
tctcgggacagcttagggacagtgt

SEQ ID NO: 543310 - DNA, 25 bp, Rattus norvegicus
atcaacgggtgctttgtggtgacgc

SEQ ID NO: 543311 - DNA, 25 bp, Rattus norvegicus
tttttgcctttcagatcaacgggtg

SEQ ID NO: 543312 - DNA, 25 bp, Rattus norvegicus
tgaaatatccgaattccctttttgc

SEQ ID NO: 543313 - DNA, 25 bp, Rattus norvegicus
gtgaaccgattattactcatgaaat

SEQ ID NO: 543314 - DNA, 25 bp, Rattus norvegicus
gggacagtgtgtgaaccgattatta

SEQ ID NO: 543315 - DNA, 25 bp, Rattus norvegicus
cttccacggcgtggaggacactgca

SEQ ID NO: 543316 - DNA, 25 bp, Rattus norvegicus
caagaagaacgttccggggtcagca

SEQ ID NO: 543317 - DNA, 25 bp, Rattus norvegicus
agtgcgggcctcgttctgactgcat

SEQ ID NO: 543318 - DNA, 25 bp, Rattus norvegicus
agctgtggtgcaagaagaacgttcc

SEQ ID NO: 543319 - DNA, 25 bp, Rattus norvegicus
gggtcagcaaaacaacaaggggaga

SEQ ID NO: 543320 - DNA, 25 bp, Rattus norvegicus
caacaaggggagaaacacggcttct

SEQ ID NO: 543321 - DNA, 25 bp, Rattus norvegicus
ttctgactgcatcctgtggccggag

SEQ ID NO: 543322 - DNA, 25 bp, Rattus norvegicus
tggctactttgatcaccactgggca

SEQ ID NO: 543323 - DNA, 25 bp, Rattus norvegicus
ccctggcctgcgtgaagcaggaaga

SEQ ID NO: 543324 - DNA, 25 bp, Rattus norvegicus
agagatcggcgacgctggctacttt

SEQ ID NO: 543325 - DNA, 25 bp, Rattus norvegicus
ggaagacgccatcaagaacattctg

SEQ ID NO: 543326 - DNA, 25 bp, Rattus norvegicus
catccgcaaggtgaagtcagagatc

SEQ ID NO: 543327 - DNA, 25 bp, Rattus norvegicus
acccgagcaatacgagctatacatg

SEQ ID NO: 543328 - DNA, 25 bp, Rattus norvegicus
ccactgggcatcagaccgtggtctg

SEQ ID NO: 543329 - DNA, 25 bp, Rattus norvegicus
tcagaccgtggtctgctcagccgtc

SEQ ID NO: 543330 - DNA, 25 bp, Rattus norvegicus
ctactcgggacagcccaatgggcga

SEQ ID NO: 543331 - DNA, 25 bp, Rattus norvegicus
ccgtggggacgaggcaaccattgcc

SEQ ID NO: 543332 - DNA, 25 bp, Rattus norvegicus
gccgcgaaatgcaagcccagcagca

SEQ ID NO: 543333 - DNA, 25 bp, Rattus norvegicus
tcgccagccactatgagccagaatg

SEQ ID NO: 543334 - DNA, 25 bp, Rattus norvegicus
actgccctactacccagcgtatgtg

SEQ ID NO: 543335 - DNA, 25 bp, Rattus norvegicus
tgcatttgtgcagcggatcatccgc

SEQ ID NO: 543336 - DNA, 25 bp, Rattus norvegicus
gtgagccactcaagtctaaagcaga

SEQ ID NO: 543337 - DNA, 25 bp, Rattus norvegicus
tcgattgcacctctctcggctgcgg

SEQ ID NO: 543338 - DNA, 25 bp, Rattus norvegicus
ctaaagcagagcgagtcccaggact

SEQ ID NO: 543339 - DNA, 25 bp, Rattus norvegicus
tccaggggcagtgagccactcaagt

SEQ ID NO: 543340 - DNA, 25 bp, Rattus norvegicus
gtggatctcttaaaggcgctccatc

SEQ ID NO: 543341 - DNA, 25 bp, Rattus norvegicus
tctcattccgagaatggggtggatc

SEQ ID NO: 543342 - DNA, 25 bp, Rattus norvegicus
gtgctcaccaagacccggacagctg

SEQ ID NO: 543343 - DNA, 25 bp, Rattus norvegicus
agcggcgtccactttggtgatacca

SEQ ID NO: 543344 - DNA, 25 bp, Rattus norvegicus
tgataccatgaatggctccggcagc

SEQ ID NO: 543345 - DNA, 25 bp, Rattus norvegicus
ggggtaccatcctacactctgggtg

SEQ ID NO: 543346 - DNA, 25 bp, Rattus norvegicus
ctggcagcctgaggcggtccttgta

SEQ ID NO: 543347 - DNA, 25 bp, Rattus norvegicus
ttttcgcgctcatcttcctcgtggg

SEQ ID NO: 543348 - DNA, 25 bp, Rattus norvegicus
agcgagggagcagcgtgctcaccaa

SEQ ID NO: 543349 - DNA, 25 bp, Rattus norvegicus
tggagtcagggtcattcgattgcac

SEQ ID NO: 543350 - DNA, 25 bp, Rattus norvegicus
cggctcgattccgactcgaagtaga

SEQ ID NO: 543351 - DNA, 25 bp, Rattus norvegicus
caggaagcccgcattgtccaccgga

SEQ ID NO: 543352 - DNA, 25 bp, Rattus norvegicus
acctcgagtccgtatcgctcatgca

SEQ ID NO: 543353 - DNA, 25 bp, Rattus norvegicus
cgctcatgcagctgggcgaaggata

SEQ ID NO: 543354 - DNA, 25 bp, Rattus norvegicus
ctacagcgggttgctcaggcagagc

SEQ ID NO: 543355 - DNA, 25 bp, Rattus norvegicus
tcacgcaccaccaagcgcaggtagt

SEQ ID NO: 543356 - DNA, 25 bp, Rattus norvegicus
tggctgtccgctgccagcacataag

SEQ ID NO: 543357 - DNA, 25 bp, Rattus norvegicus
attgtccaccggagcgtcacaggtc

SEQ ID NO: 543358 - DNA, 25 bp, Rattus norvegicus
acgcccagtggctctcggctcgatt

SEQ ID NO: 543359 - DNA, 25 bp, Rattus norvegicus
gtgcagccctccagcaggatgacgc

SEQ ID NO: 543360 - DNA, 25 bp, Rattus norvegicus
tcgaagtagaagagtatgttgccgc

SEQ ID NO: 543361 - DNA, 25 bp, Rattus norvegicus
atgttgccgcgaagcacgaaccacc

SEQ ID NO: 543362 - DNA, 25 bp, Rattus norvegicus
tcacaggtcgcgtagaaggccaggc

SEQ ID NO: 543363 - DNA, 25 bp, Rattus norvegicus
cgcccaccacgtttgtacaggaagc

SEQ ID NO: 543364 - DNA, 25 bp, Rattus norvegicus
ctgaagcacatacgcctgctcattg

SEQ ID NO: 543365 - DNA, 25 bp, Rattus norvegicus
aagcactcttaaagggaccgtgccg

SEQ ID NO: 543366 - DNA, 25 bp, Rattus norvegicus
ctgaaaagcactcttaaagggaccg

SEQ ID NO: 543367 - DNA, 25 bp, Rattus norvegicus
cgcgcctgaaaagcactcttaaagg

SEQ ID NO: 543368 - DNA, 25 bp, Rattus norvegicus
gcccgcgcctgaaaagcactcttaa

SEQ ID NO: 543369 - DNA, 25 bp, Rattus norvegicus
ctgctcattggtcagccccacaaga

SEQ ID NO: 543370 - DNA, 25 bp, Rattus norvegicus
acatacgcctgctcattggtcagcc

SEQ ID NO: 543371 - DNA, 25 bp, Rattus norvegicus
cttacctagaagtgggacagacgcg

SEQ ID NO: 543372 - DNA, 25 bp, Rattus norvegicus
tttgtctcccggaggccgagccgcg

SEQ ID NO: 543373 - DNA, 25 bp, Rattus norvegicus
ggctacgagagggcgctttgtctcc

SEQ ID NO: 543374 - DNA, 25 bp, Rattus norvegicus
tgtcccgcccatggcccggaaccac

SEQ ID NO: 543375 - DNA, 25 bp, Rattus norvegicus
ggacagacgcgatggcctgtcccgc

SEQ ID NO: 543376 - DNA, 25 bp, Rattus norvegicus
acctagaagtgggacagacgcgatg

SEQ ID NO: 543377 - DNA, 25 bp, Rattus norvegicus
ccggccttacctagaagtgggacag

SEQ ID NO: 543378 - DNA, 25 bp, Rattus norvegicus
ctgcgtccctgagcggggacaccta

SEQ ID NO: 543379 - DNA, 25 bp, Rattus norvegicus
gagagctcatctgggcctttctcgc

SEQ ID NO: 543380 - DNA, 25 bp, Rattus norvegicus
cctttctcgcgattcttcgtggcta

SEQ ID NO: 543381 - DNA, 25 bp, Rattus norvegicus
cccaggctctgtggcgagagctcat

SEQ ID NO: 543382 - DNA, 25 bp, Rattus norvegicus
cctccttagaggctgcgtccctgag

SEQ ID NO: 543383 - DNA, 25 bp, Rattus norvegicus
gtttgggcctcggagaaatctggca

SEQ ID NO: 543384 - DNA, 25 bp, Rattus norvegicus
cagggccggcctgtgattaaaaaga

SEQ ID NO: 543385 - DNA, 25 bp, Rattus norvegicus
tctccatttaactcagcagagctgc

SEQ ID NO: 543386 - DNA, 25 bp, Rattus norvegicus
tcagcagagctgcagtcggctacga

SEQ ID NO: 543387 - DNA, 25 bp, Rattus norvegicus
gctggcagattgcagccaccatttg

SEQ ID NO: 543388 - DNA, 25 bp, Rattus norvegicus
aaaggctgccaatgcccgatgcttc

SEQ ID NO: 543389 - DNA, 25 bp, Rattus norvegicus
gacttcactgaagccctccttagag

SEQ ID NO: 543390 - DNA, 25 bp, Rattus norvegicus
tgtgggccaatcaaggctcgacttc

SEQ ID NO: 543391 - DNA, 25 bp, Rattus norvegicus
gaggaagaaccacaagtctccattt

SEQ ID NO: 543392 - DNA, 25 bp, Rattus norvegicus
ccgagaggccgtgcaacgacgccat

SEQ ID NO: 543393 - DNA, 25 bp, Rattus norvegicus
acccggccgggagagctcagataag

SEQ ID NO: 543394 - DNA, 25 bp, Rattus norvegicus
gggcggagcttgtcaatattctacc

SEQ ID NO: 543395 - DNA, 25 bp, Rattus norvegicus
tcgcggtcggttcctctttacataa

SEQ ID NO: 543396 - DNA, 25 bp, Rattus norvegicus
cccaatcccagaccgcagtgatgtg

SEQ ID NO: 543397 - DNA, 25 bp, Rattus norvegicus
tcctctttacataacggcgtggggc

SEQ ID NO: 543398 - DNA, 25 bp, Rattus norvegicus
ctggcgtttcctcattctgtttctc

SEQ ID NO: 543399 - DNA, 25 bp, Rattus norvegicus
ccggggtttcctgcctgagctccga

SEQ ID NO: 543400 - DNA, 25 bp, Rattus norvegicus
ccgacccgcagcttgcgcggtaaga

SEQ ID NO: 543401 - DNA, 25 bp, Rattus norvegicus
aagccgcggtcgcagttgctagacc

SEQ ID NO: 543402 - DNA, 25 bp, Rattus norvegicus
cactgaggccctcggttactggcca

SEQ ID NO: 543403 - DNA, 25 bp, Rattus norvegicus
aaatgaggcgctggccgttttccga

SEQ ID NO: 543404 - DNA, 25 bp, Rattus norvegicus
cccagactgtcacgggccacggggt

SEQ ID NO: 543405 - DNA, 25 bp, Rattus norvegicus
tcccgcttctgttttctggcgtttc

SEQ ID NO: 543406 - DNA, 25 bp, Rattus norvegicus
agttgctaccctggagcctgcgaga

SEQ ID NO: 543407 - DNA, 25 bp, Rattus norvegicus
ggacgttccctgagctcattgcctt

SEQ ID NO: 543408 - DNA, 25 bp, Rattus norvegicus
ttgatttgtcttacagcccggctgc

SEQ ID NO: 543409 - DNA, 25 bp, Rattus norvegicus
atgaacgagcccaccgtgcagccgt

SEQ ID NO: 543410 - DNA, 25 bp, Rattus norvegicus
ctggagtgacttctgcgagcgacac

SEQ ID NO: 543411 - DNA, 25 bp, Rattus norvegicus
tctggcccgccagtactggctgttt

SEQ ID NO: 543412 - DNA, 25 bp, Rattus norvegicus
acctagtgtcgctgcagttcgccga

SEQ ID NO: 543413 - DNA, 25 bp, Rattus norvegicus
tcttccagcgccacttctgtcggga

SEQ ID NO: 543414 - DNA, 25 bp, Rattus norvegicus
gccaggtcacgactaccgtgctact

SEQ ID NO: 543415 - DNA, 25 bp, Rattus norvegicus
cctggtgcttcggtctccaggtcca

SEQ ID NO: 543416 - DNA, 25 bp, Rattus norvegicus
ggggctaccagtgacaccaatgaca

SEQ ID NO: 543417 - DNA, 25 bp, Rattus norvegicus
ctcaaggaggtggtattgcgctaca

SEQ ID NO: 543418 - DNA, 25 bp, Rattus norvegicus
tattgcgctacagcctggcggatga

SEQ ID NO: 543419 - DNA, 25 bp, Rattus norvegicus
caaggcacgcagctccgaggacctg

SEQ ID NO: 543420 - DNA, 25 bp, Rattus norvegicus
gacagtcctctttatcccgcatcga

SEQ ID NO: 543421 - DNA, 25 bp, Rattus norvegicus
tctacaaggctgcagtcgccggttg

SEQ ID NO: 543422 - DNA, 25 bp, Rattus norvegicus
cggtcctctgggttcacgcagaagg

SEQ ID NO: 543423 - DNA, 25 bp, Rattus norvegicus
tatcccgcatcgatgcagccggctt

SEQ ID NO: 543424 - DNA, 25 bp, Rattus norvegicus
tccctgtcctggacagtcctcttta

SEQ ID NO: 543425 - DNA, 25 bp, Rattus norvegicus
gtcccgcgatctttgcgcgcgtctt

SEQ ID NO: 543426 - DNA, 25 bp, Rattus norvegicus
tctgcaaccaggtgagactcgcggc

SEQ ID NO: 543427 - DNA, 25 bp, Rattus norvegicus
agcagcccgaggtcttctgcaacca

SEQ ID NO: 543428 - DNA, 25 bp, Rattus norvegicus
tcagttcagcatgctgcgcgccgca

SEQ ID NO: 543429 - DNA, 25 bp, Rattus norvegicus
gttctgctaagctccgctcagttca

SEQ ID NO: 543430 - DNA, 25 bp, Rattus norvegicus
ctaggctcctctctgctcggttcgg

SEQ ID NO: 543431 - DNA, 25 bp, Rattus norvegicus
gcggaggctaggactcgttctacaa

SEQ ID NO: 543432 - DNA, 25 bp, Rattus norvegicus
ggctggagttcctcggctacgtccc

SEQ ID NO: 543433 - DNA, 25 bp, Rattus norvegicus
gctcagctctgctcagttctgctaa

SEQ ID NO: 543434 - DNA, 25 bp, Rattus norvegicus
gtcgcgccctcttacgtcattaact

SEQ ID NO: 543435 - DNA, 25 bp, Rattus norvegicus
cgtcattaacttagcgcctcagtag

SEQ ID NO: 543436 - DNA, 25 bp, Rattus norvegicus
ttaacttagcgcctcagtagtggaa

SEQ ID NO: 543437 - DNA, 25 bp, Rattus norvegicus
tcttacgtcattaacttagcgcctc

SEQ ID NO: 543438 - DNA, 25 bp, Rattus norvegicus
cgcgccctcttacgtcattaactta

SEQ ID NO: 543439 - DNA, 25 bp, Rattus norvegicus
accgtgcaaccagccgtcgcgccct

SEQ ID NO: 543440 - DNA, 25 bp, Rattus norvegicus
cttctcaccgtgcaaccagccgtcg

SEQ ID NO: 543441 - DNA, 25 bp, Rattus norvegicus
tgcgttccgcttctcaccgtgcaac

SEQ ID NO: 543442 - DNA, 25 bp, Rattus norvegicus
catgcgtcccgcctgcgttccgctt

SEQ ID NO: 543443 - DNA, 25 bp, Rattus norvegicus
aagcctcggaaagcccggcggatgc

SEQ ID NO: 543444 - DNA, 25 bp, Rattus norvegicus
tgcacatcaaccacgcggcccgggg

SEQ ID NO: 543445 - DNA, 25 bp, Rattus norvegicus
gcgggcgcctgcacatcaaccacgc

SEQ ID NO: 543446 - DNA, 25 bp, Rattus norvegicus
tagcgcctcagtagtggaaggcccg

SEQ ID NO: 543447 - DNA, 25 bp, Rattus norvegicus
gccctcttacgtcattaacttagcg

SEQ ID NO: 543448 - DNA, 25 bp, Rattus norvegicus
agaacgccgcgaaacccagcctaga

SEQ ID NO: 543449 - DNA, 25 bp, Rattus norvegicus
gtgcgcgacagtcccacttcgcagg

SEQ ID NO: 543450 - DNA, 25 bp, Rattus norvegicus
cgacgggtctcaacggacctcatga

SEQ ID NO: 543451 - DNA, 25 bp, Rattus norvegicus
gacgccgccacgtcttgttccaagg

SEQ ID NO: 543452 - DNA, 25 bp, Rattus norvegicus
aattgttgaggctgcgcctcgcgcc

SEQ ID NO: 543453 - DNA, 25 bp, Rattus norvegicus
ccagcctagacgagtggcacggagt

SEQ ID NO: 543454 - DNA, 25 bp, Rattus norvegicus
gaagggcgcccttcccttggacaca

SEQ ID NO: 543455 - DNA, 25 bp, Rattus norvegicus
ttccaaggcgagagaaggcaacgag

SEQ ID NO: 543456 - DNA, 25 bp, Rattus norvegicus
gaggccgcctgagcctctccgagtg

SEQ ID NO: 543457 - DNA, 25 bp, Rattus norvegicus
ggacacagtcactttctacaaggta

SEQ ID NO: 543458 - DNA, 25 bp, Rattus norvegicus
tgtccgttctccttggcctgctgct

SEQ ID NO: 543459 - DNA, 25 bp, Rattus norvegicus
acaatccggcgtgatggctgccgcc

SEQ ID NO: 543460 - DNA, 25 bp, Rattus norvegicus
cgggacggccctcccagtgacgtga

SEQ ID NO: 543461 - DNA, 25 bp, Rattus norvegicus
tctccgagtggccacgtgcgctcat

SEQ ID NO: 543462 - DNA, 25 bp, Rattus norvegicus
gccgctggaataaagctacttggtg

SEQ ID NO: 543463 - DNA, 25 bp, Rattus norvegicus
gggctcctcgaaagccgctggaata

SEQ ID NO: 543464 - DNA, 25 bp, Rattus norvegicus
ttgtcacctgcaagaaagaccgcgg

SEQ ID NO: 543465 - DNA, 25 bp, Rattus norvegicus
tcagggaccagcaaccctgggccgg

SEQ ID NO: 543466 - DNA, 25 bp, Rattus norvegicus
tatcgcgatagtggagggccgtaac

SEQ ID NO: 543467 - DNA, 25 bp, Rattus norvegicus
tcgatctcgctgacgtatcgcgata

SEQ ID NO: 543468 - DNA, 25 bp, Rattus norvegicus
gttaaagggccagcgtcgatctcgc

SEQ ID NO: 543469 - DNA, 25 bp, Rattus norvegicus
ctctgggtactcaccgtaaatgggc

SEQ ID NO: 543470 - DNA, 25 bp, Rattus norvegicus
ctcggcttgccgcagtggctaacag

SEQ ID NO: 543471 - DNA, 25 bp, Rattus norvegicus
accgttgtcgcctcagggaccagca

SEQ ID NO: 543472 - DNA, 25 bp, Rattus norvegicus
tggcgcgatccgcacagcctgacag

SEQ ID NO: 543473 - DNA, 25 bp, Rattus norvegicus
tctccaagcagtggcgcgatccgca

SEQ ID NO: 543474 - DNA, 25 bp, Rattus norvegicus
gctacttggtggtagcgctggtctc

SEQ ID NO: 543475 - DNA, 25 bp, Rattus norvegicus
gtggctaacaggcaagctctgggta

SEQ ID NO: 543476 - DNA, 25 bp, Rattus norvegicus
gcgaagaaccgcttagtctaagacc

SEQ ID NO: 543477 - DNA, 25 bp, Rattus norvegicus
gtgcggggaccagctaacccgaaga

SEQ ID NO: 543478 - DNA, 25 bp, Rattus norvegicus
ccagctaacccgaagacaccgtaga

SEQ ID NO: 543479 - DNA, 25 bp, Rattus norvegicus
gaagacaccgtagacacgccacaga

SEQ ID NO: 543480 - DNA, 25 bp, Rattus norvegicus
gtagacacgccacagaccgcgttgg

SEQ ID NO: 543481 - DNA, 25 bp, Rattus norvegicus
ccacagaccgcgttgggccgagaaa

SEQ ID NO: 543482 - DNA, 25 bp, Rattus norvegicus
cgttgggccgagaaactcctctcta

SEQ ID NO: 543483 - DNA, 25 bp, Rattus norvegicus
gagaaactcctctctactaagcctc

SEQ ID NO: 543484 - DNA, 25 bp, Rattus norvegicus
tactaagcctccacccgcgagagag

SEQ ID NO: 543485 - DNA, 25 bp, Rattus norvegicus
cacccgcgagagaggaaatgggacc

SEQ ID NO: 543486 - DNA, 25 bp, Rattus norvegicus
tctccggcccagtgctcgcgaagaa

SEQ ID NO: 543487 - DNA, 25 bp, Rattus norvegicus
tgctcgcgaagaaccgcttagtcta

SEQ ID NO: 543488 - DNA, 25 bp, Rattus norvegicus
taaactgcccaacccgcggcctggc

SEQ ID NO: 543489 - DNA, 25 bp, Rattus norvegicus
cccagtgctcgcgaagaaccgctta

SEQ ID NO: 543490 - DNA, 25 bp, Rattus norvegicus
gttgcgcatcctttcacacctagtt

SEQ ID NO: 543491 - DNA, 25 bp, Rattus norvegicus
ttgcgcacacctcgaaacgcgctgg

SEQ ID NO: 543492 - DNA, 25 bp, Rattus norvegicus
cgcagctggccaacctgacagtatg

SEQ ID NO: 543493 - DNA, 25 bp, Rattus norvegicus
atggacctctgcaccttcgtcttta

SEQ ID NO: 543494 - DNA, 25 bp, Rattus norvegicus
cgtctttagctacctgctgccagtg

SEQ ID NO: 543495 - DNA, 25 bp, Rattus norvegicus
ctgccagtgctagtcctcagtctga

SEQ ID NO: 543496 - DNA, 25 bp, Rattus norvegicus
agtctgacctatgcgcgtaccctgc

SEQ ID NO: 543497 - DNA, 25 bp, Rattus norvegicus
ttcccagcgcgccaaacgcaaggtg

SEQ ID NO: 543498 - DNA, 25 bp, Rattus norvegicus
gatcatcatcgtggcggtgcttttc

SEQ ID NO: 543499 - DNA, 25 bp, Rattus norvegicus
gcgtgccacttacgcgttgcgcatc

SEQ ID NO: 543500 - DNA, 25 bp, Rattus norvegicus
gtttcctatgccaactcctgtgtca

SEQ ID NO: 543501 - DNA, 25 bp, Rattus norvegicus
catcgtttacgctctggtctccaag

SEQ ID NO: 543502 - DNA, 25 bp, Rattus norvegicus
tccgcaaaatctgcgcgggcctgct

SEQ ID NO: 543503 - DNA, 25 bp, Rattus norvegicus
cttatcctctgcgtgtggtttggtc

SEQ ID NO: 543504 - DNA, 25 bp, Rattus norvegicus
aacacgaagcgtggggatgtcgtca

SEQ ID NO: 543505 - DNA, 25 bp, Rattus norvegicus
gtgagcagagctggtaccttaggaa

SEQ ID NO: 543506 - DNA, 25 bp, Rattus norvegicus
tcgtcagctgttggtgagacggtcc

SEQ ID NO: 543507 - DNA, 25 bp, Rattus norvegicus
cagctgttggtgagacggtcctcct

SEQ ID NO: 543508 - DNA, 25 bp, Rattus norvegicus
ctgttggtgagacggtcctcctccc

SEQ ID NO: 543509 - DNA, 25 bp, Rattus norvegicus
cggctccacaaagccactgcccagg

SEQ ID NO: 543510 - DNA, 25 bp, Rattus norvegicus
aggcgcgcgtgtctcccggggcaat

SEQ ID NO: 543511 - DNA, 25 bp, Rattus norvegicus
ctggtaccttaggaagaggccgcga

SEQ ID NO: 543512 - DNA, 25 bp, Rattus norvegicus
taccttaggaagaggccgcgatgcc

SEQ ID NO: 543513 - DNA, 25 bp, Rattus norvegicus
accttaggaagaggccgcgatgcca

SEQ ID NO: 543514 - DNA, 25 bp, Rattus norvegicus
accgccgccgccagatgctccaccc

SEQ ID NO: 543515 - DNA, 25 bp, Rattus norvegicus
atgctccacccagggccgccgagtt

SEQ ID NO: 543516 - DNA, 25 bp, Rattus norvegicus
gctccgccgctgcacccgctcggct

SEQ ID NO: 543517 - DNA, 25 bp, Rattus norvegicus
cagagctggtaccttaggaagaggc

SEQ ID NO: 543518 - DNA, 25 bp, Rattus norvegicus
ctgagtcttccctgccgtcgataga

SEQ ID NO: 543519 - DNA, 25 bp, Rattus norvegicus
gtgtggctgggcctgcctccgcctc

SEQ ID NO: 543520 - DNA, 25 bp, Rattus norvegicus
ccctaagctccgtgagccaatggag

SEQ ID NO: 543521 - DNA, 25 bp, Rattus norvegicus
agctccgtgagccaatggaggatga

SEQ ID NO: 543522 - DNA, 25 bp, Rattus norvegicus
ggcccgaggaaacggcagcgctgcc

SEQ ID NO: 543523 - DNA, 25 bp, Rattus norvegicus
gtccaatgggcgtccgtcaaggccc

SEQ ID NO: 543524 - DNA, 25 bp, Rattus norvegicus
gtcaaggccccgtggctggccaatg

SEQ ID NO: 543525 - DNA, 25 bp, Rattus norvegicus
ccctcggcgacggtgggaagcggct

SEQ ID NO: 543526 - DNA, 25 bp, Rattus norvegicus
tgccctctttgtctgcgtgctttcc

SEQ ID NO: 543527 - DNA, 25 bp, Rattus norvegicus
gcccgcggagcgcagagcggtcgct

SEQ ID NO: 543528 - DNA, 25 bp, Rattus norvegicus
ttccctgccgtcgatagaggtccgt

SEQ ID NO: 543529 - DNA, 25 bp, Rattus norvegicus
tgccgtcgatagaggtccgtccgcc

SEQ ID NO: 543530 - DNA, 25 bp, Rattus norvegicus
tggcgttcccgctgggctctgaggt

SEQ ID NO: 543531 - DNA, 25 bp, Rattus norvegicus
gtcttccctgccgtcgatagaggtc

SEQ ID NO: 543532 - DNA, 25 bp, Rattus norvegicus
acgacaacgtcaaggttcttcgcgc

SEQ ID NO: 543533 - DNA, 25 bp, Rattus norvegicus
tcgatatcgtccaccgacatcgaca

SEQ ID NO: 543534 - DNA, 25 bp, Rattus norvegicus
tcaccgctcccgaacaacgagaagg

SEQ ID NO: 543535 - DNA, 25 bp, Rattus norvegicus
ctaggagaaggaagtacgacaacgt

SEQ ID NO: 543536 - DNA, 25 bp, Rattus norvegicus
ttcttcgcgcttgagaacgacatcg

SEQ ID NO: 543537 - DNA, 25 bp, Rattus norvegicus
gcttgagaacgacatcgtgactgta

SEQ ID NO: 543538 - DNA, 25 bp, Rattus norvegicus
atcgtgactgtactatgccactgtc

SEQ ID NO: 543539 - DNA, 25 bp, Rattus norvegicus
gtactatgccactgtcattgacacc

SEQ ID NO: 543540 - DNA, 25 bp, Rattus norvegicus
ttgacacccgccacggtcaacgttg

SEQ ID NO: 543541 - DNA, 25 bp, Rattus norvegicus
ccgccacggtcaacgttgtacgaca

SEQ ID NO: 543542 - DNA, 25 bp, Rattus norvegicus
gttgtacgacaacgctactgactct

SEQ ID NO: 543543 - DNA, 25 bp, Rattus norvegicus
acgctactgactctgcccactgatt

SEQ ID NO: 543544 - DNA, 25 bp, Rattus norvegicus
tccgacaccgccttatcgatatcgt

SEQ ID NO: 543545 - DNA, 25 bp, Rattus norvegicus
caacgagaaggaagaacgactagga

SEQ ID NO: 543546 - DNA, 25 bp, Rattus norvegicus
cgcactgtctaacgtgacacctgtc

SEQ ID NO: 543547 - DNA, 25 bp, Rattus norvegicus
gcgttcctcggagacaggcgcgcca

SEQ ID NO: 543548 - DNA, 25 bp, Rattus norvegicus
ctcagagctgcagcgcactgtctaa

SEQ ID NO: 543549 - DNA, 25 bp, Rattus norvegicus
agctgcagcgcactgtctaacgtga

SEQ ID NO: 543550 - DNA, 25 bp, Rattus norvegicus
acacctgtccttcctcagtggctga

SEQ ID NO: 543551 - DNA, 25 bp, Rattus norvegicus
cagtggctgagtcgcagactgcaga

SEQ ID NO: 543552 - DNA, 25 bp, Rattus norvegicus
gcagagaggcggcagtgtctcacct

SEQ ID NO: 543553 - DNA, 25 bp, Rattus norvegicus
gccgagcgcagtcccgatagagcat

SEQ ID NO: 543554 - DNA, 25 bp, Rattus norvegicus
gcgcagtcccgatagagcatcctga

SEQ ID NO: 543555 - DNA, 25 bp, Rattus norvegicus
agacaggcgcgccacctcagagctg

SEQ ID NO: 543556 - DNA, 25 bp, Rattus norvegicus
gtcccgatagagcatcctgagcctc

SEQ ID NO: 543557 - DNA, 25 bp, Rattus norvegicus
agagcatcctgagcctctcgcactg

SEQ ID NO: 543558 - DNA, 25 bp, Rattus norvegicus
ctctcgcactgcacctctacaactg

SEQ ID NO: 543559 - DNA, 25 bp, Rattus norvegicus
agtgtctcacctgtctccggtcggc

SEQ ID NO: 543560 - DNA, 25 bp, Rattus norvegicus
gggctcttactcacctccaggtcgg

SEQ ID NO: 543561 - DNA, 25 bp, Rattus norvegicus
gctccgcagccaactgtcagtaaga

SEQ ID NO: 543562 - DNA, 25 bp, Rattus norvegicus
tgcggagaccctgccgcttcagcaa

SEQ ID NO: 543563 - DNA, 25 bp, Rattus norvegicus
tgccgacgagcccatggttaagaga

SEQ ID NO: 543564 - DNA, 25 bp, Rattus norvegicus
aagcccgtcgtgcagaaagatggtc

SEQ ID NO: 543565 - DNA, 25 bp, Rattus norvegicus
cgccgagtatctcgctgggcagctc

SEQ ID NO: 543566 - DNA, 25 bp, Rattus norvegicus
caggccgcgatgtagcatccctttc

SEQ ID NO: 543567 - DNA, 25 bp, Rattus norvegicus
gcttccctgacaaaggccctggtgt

SEQ ID NO: 543568 - DNA, 25 bp, Rattus norvegicus
gccctggtgtcaatccgaggcactg

SEQ ID NO: 543569 - DNA, 25 bp, Rattus norvegicus
tccgaggcactgcacagacaggttg

SEQ ID NO: 543570 - DNA, 25 bp, Rattus norvegicus
agcagagcctgtgcaaccgttcaaa

SEQ ID NO: 543571 - DNA, 25 bp, Rattus norvegicus
aaatacaaaaggtctccggagcgca

SEQ ID NO: 543572 - DNA, 25 bp, Rattus norvegicus
gcggcccgaagatgctctccagaat

SEQ ID NO: 543573 - DNA, 25 bp, Rattus norvegicus
atcaacacagggctggggccgaaaa

SEQ ID NO: 543574 - DNA, 25 bp, Rattus norvegicus
cgacagaaatgaagctcccgagaga

SEQ ID NO: 543575 - DNA, 25 bp, Rattus norvegicus
ctataagcaatgacgggatgtgtcc

SEQ ID NO: 543576 - DNA, 25 bp, Rattus norvegicus
ggtttctcccttcagccgcaaagca

SEQ ID NO: 543577 - DNA, 25 bp, Rattus norvegicus
ttcagccgcaaagcacaacgtggcc

SEQ ID NO: 543578 - DNA, 25 bp, Rattus norvegicus
tacggcaaccggtagggcccagcga

SEQ ID NO: 543579 - DNA, 25 bp, Rattus norvegicus
ccaacccacgccgacagaaatgaag

SEQ ID NO: 543580 - DNA, 25 bp, Rattus norvegicus
tcccgagagacctggcgtgtgacct

SEQ ID NO: 543581 - DNA, 25 bp, Rattus norvegicus
tgtgacctcggccataggcgaccct

SEQ ID NO: 543582 - DNA, 25 bp, Rattus norvegicus
ccgccttcggatggacgaggattag

SEQ ID NO: 543583 - DNA, 25 bp, Rattus norvegicus
cccgagagtggctgccacacagaca

SEQ ID NO: 543584 - DNA, 25 bp, Rattus norvegicus
tcctaccttgcaagacgggaaagag

SEQ ID NO: 543585 - DNA, 25 bp, Rattus norvegicus
aaagaggactaagacagcggcttcc

SEQ ID NO: 543586 - DNA, 25 bp, Rattus norvegicus
agcggcttccggtctataagcaatg

SEQ ID NO: 543587 - DNA, 25 bp, Rattus norvegicus
gtctccgcgctacgttagctcttcg

SEQ ID NO: 543588 - DNA, 25 bp, Rattus norvegicus
cagtgtccgggatccaggcctgcca

SEQ ID NO: 543589 - DNA, 25 bp, Rattus norvegicus
tgcccgctcccgtgtcggctcccga

SEQ ID NO: 543590 - DNA, 25 bp, Rattus norvegicus
atgacttcacgtcggcgccggcggc

SEQ ID NO: 543591 - DNA, 25 bp, Rattus norvegicus
cctccatgtgacggcgcctcgtgga

SEQ ID NO: 543592 - DNA, 25 bp, Rattus norvegicus
gcctcgtggagcctgagtgagcagc

SEQ ID NO: 543593 - DNA, 25 bp, Rattus norvegicus
tcgcctcctggggattccgaaataa

SEQ ID NO: 543594 - DNA, 25 bp, Rattus norvegicus
gaggaacatgacatcccggaggtga

SEQ ID NO: 543595 - DNA, 25 bp, Rattus norvegicus
gccgcttctgtgttgcgcggccgct

SEQ ID NO: 543596 - DNA, 25 bp, Rattus norvegicus
gccgctgggggttacactcggactc

SEQ ID NO: 543597 - DNA, 25 bp, Rattus norvegicus
gcattcctgacccattgcctcatga

SEQ ID NO: 543598 - DNA, 25 bp, Rattus norvegicus
ttcctgacccattgcctcatgagcg

SEQ ID NO: 543599 - DNA, 25 bp, Rattus norvegicus
attgcctcatgagcgtcgcctcctg

SEQ ID NO: 543600 - DNA, 25 bp, Rattus norvegicus
ggcgtgatgacttcacgtcggcgcc

SEQ ID NO: 543601 - DNA, 25 bp, Rattus norvegicus
tgacccattgcctcatgagcgtcgc

SEQ ID NO: 543602 - DNA, 25 bp, Rattus norvegicus
cgcggagataacaccgccggggcta

SEQ ID NO: 543603 - DNA, 25 bp, Rattus norvegicus
aacctgggtgtctcctgcctgtcct

SEQ ID NO: 543604 - DNA, 25 bp, Rattus norvegicus
caattaaacccggagtgtgccagcg

SEQ ID NO: 543605 - DNA, 25 bp, Rattus norvegicus
gagactcacacgtccttggcgggca

SEQ ID NO: 543606 - DNA, 25 bp, Rattus norvegicus
gggtcccggaacagtactctcgctg

SEQ ID NO: 543607 - DNA, 25 bp, Rattus norvegicus
tactgagctggtattgggccctcca

SEQ ID NO: 543608 - DNA, 25 bp, Rattus norvegicus
ctacaggtagctgtgcgctgcgatc

SEQ ID NO: 543609 - DNA, 25 bp, Rattus norvegicus
ggacatgcgtccagagctacaggta

SEQ ID NO: 543610 - DNA, 25 bp, Rattus norvegicus
gcagtccacgggttcccacaggtac

SEQ ID NO: 543611 - DNA, 25 bp, Rattus norvegicus
caggaggtgaccctacatgtcatca

SEQ ID NO: 543612 - DNA, 25 bp, Rattus norvegicus
tcccaaactttccaggcaaggagtc

SEQ ID NO: 543613 - DNA, 25 bp, Rattus norvegicus
tggccatggcgcacagtcccaaact

SEQ ID NO: 543614 - DNA, 25 bp, Rattus norvegicus
tccaccacgcggatactcagagagc

SEQ ID NO: 543615 - DNA, 25 bp, Rattus norvegicus
tgcatcgtctcttcggctccaatta

SEQ ID NO: 543616 - DNA, 25 bp, Rattus norvegicus
gggcctgagggacataccaactagt

SEQ ID NO: 543617 - DNA, 25 bp, Rattus norvegicus
cggattttgtgctatgcgggcattt

SEQ ID NO: 543618 - DNA, 25 bp, Rattus norvegicus
ctcctgttgcccagcaagggctgta

SEQ ID NO: 543619 - DNA, 25 bp, Rattus norvegicus
ttgaggaatgtaccaactacgcagg

SEQ ID NO: 543620 - DNA, 25 bp, Rattus norvegicus
tcaggaacatacaactcaacgtgtg

SEQ ID NO: 543621 - DNA, 25 bp, Rattus norvegicus
tgcaaggacaccaaacgctaatagt

SEQ ID NO: 543622 - DNA, 25 bp, Rattus norvegicus
gggcggattgtaccaactgaacagt

SEQ ID NO: 543623 - DNA, 25 bp, Rattus norvegicus
gagacccaataagggcccgcgatta

SEQ ID NO: 543624 - DNA, 25 bp, Rattus norvegicus
ctaagagttgtaccagccgggcaga

SEQ ID NO: 543625 - DNA, 25 bp, Rattus norvegicus
ctcttcttcttccacggagccatgg

SEQ ID NO: 543626 - DNA, 25 bp, Rattus norvegicus
tgcttggatctcgaactcgccgtcc

SEQ ID NO: 543627 - DNA, 25 bp, Rattus norvegicus
cgggcgtcatcctctgcttggatct

SEQ ID NO: 543628 - DNA, 25 bp, Rattus norvegicus
ccgtggaacgtaccatcagcgcgag

SEQ ID NO: 543629 - DNA, 25 bp, Rattus norvegicus
ggcgcttaggagacctactaatttg

SEQ ID NO: 543630 - DNA, 25 bp, Rattus norvegicus
ctaggacagccagcgccacaacctt

SEQ ID NO: 543631 - DNA, 25 bp, Rattus norvegicus
ggtacgagagcctggagtcttcctc

SEQ ID NO: 543632 - DNA, 25 bp, Rattus norvegicus
tccgcccttagagtcccggcccgca

SEQ ID NO: 543633 - DNA, 25 bp, Rattus norvegicus
tcttaaagacgcagtctcccagccg

SEQ ID NO: 543634 - DNA, 25 bp, Rattus norvegicus
ggctgcgaagctcctcttacctcgg

SEQ ID NO: 543635 - DNA, 25 bp, Rattus norvegicus
ctcctcttacctcgggtggggcctg

SEQ ID NO: 543636 - DNA, 25 bp, Rattus norvegicus
ggagtcttcctctagctaggacagc

SEQ ID NO: 543637 - DNA, 25 bp, Rattus norvegicus
cgccacaaccttccgcccttagagt

SEQ ID NO: 543638 - DNA, 25 bp, Rattus norvegicus
cgtcccgcccacttaccagtcgagc

SEQ ID NO: 543639 - DNA, 25 bp, Rattus norvegicus
acttaccagtcgagccacgcccagg

SEQ ID NO: 543640 - DNA, 25 bp, Rattus norvegicus
gagccacgcccaggtctctctatcc

SEQ ID NO: 543641 - DNA, 25 bp, Rattus norvegicus
gcctagaacacgcccttaaggcgcg

SEQ ID NO: 543642 - DNA, 25 bp, Rattus norvegicus
cagctcttaaagacgcagtctccca

SEQ ID NO: 543643 - DNA, 25 bp, Rattus norvegicus
cgaagctcctcttacctcgggtggg

SEQ ID NO: 543644 - DNA, 25 bp, Rattus norvegicus
ttgtcctcgatctcccgccgccgag

SEQ ID NO: 543645 - DNA, 25 bp, Rattus norvegicus
cggaagcctcctgcgggggaatcat

SEQ ID NO: 543646 - DNA, 25 bp, Rattus norvegicus
gggaatcatcgcagcggacagcgct

SEQ ID NO: 543647 - DNA, 25 bp, Rattus norvegicus
gtagctcgcgaacgggctgcggatc

SEQ ID NO: 543648 - DNA, 25 bp, Rattus norvegicus
tgtgtgcctgcggtagctcgcgaac

SEQ ID NO: 543649 - DNA, 25 bp, Rattus norvegicus
agtggcaggcggaagtgtgtgcctg

SEQ ID NO: 543650 - DNA, 25 bp, Rattus norvegicus
ccggacgctccggtggcgccatgtt

SEQ ID NO: 543651 - DNA, 25 bp, Rattus norvegicus
ggcttccgtccctgtcacacccact

SEQ ID NO: 543652 - DNA, 25 bp, Rattus norvegicus
agctccaaaccctgctcggcttccg

SEQ ID NO: 543653 - DNA, 25 bp, Rattus norvegicus
tgtcttagctccaaaccctgctcgg

SEQ ID NO: 543654 - DNA, 25 bp, Rattus norvegicus
agcggacagcgctgttcccactccc

SEQ ID NO: 543655 - DNA, 25 bp, Rattus norvegicus
tcatcgcagcggacagcgctgttcc

SEQ ID NO: 543656 - DNA, 25 bp, Rattus norvegicus
gttcgatgctcctgcgcccttcttt

SEQ ID NO: 543657 - DNA, 25 bp, Rattus norvegicus
acctgcttcagcttgtcctcgatct

SEQ ID NO: 543658 - DNA, 25 bp, Rattus norvegicus
ggctttccgcagagagctcgagctc

SEQ ID NO: 543659 - DNA, 25 bp, Rattus norvegicus
gtggcctgggctaacctcaccaacg

SEQ ID NO: 543660 - DNA, 25 bp, Rattus norvegicus
cggtggcctgggctaacctcaccaa

SEQ ID NO: 543661 - DNA, 25 bp, Rattus norvegicus
gtacggcttccaccccgatgcggtg

SEQ ID NO: 543662 - DNA, 25 bp, Rattus norvegicus
agctgcgcctggagtacggcttcca

SEQ ID NO: 543663 - DNA, 25 bp, Rattus norvegicus
ttcgggccagctgcgcctggagtac

SEQ ID NO: 543664 - DNA, 25 bp, Rattus norvegicus
tgctggacgccgcttcgggccagct

SEQ ID NO: 543665 - DNA, 25 bp, Rattus norvegicus
tggccgggctattgctgagcggcct

SEQ ID NO: 543666 - DNA, 25 bp, Rattus norvegicus
ccatggaccggacccatggtggccg

SEQ ID NO: 543667 - DNA, 25 bp, Rattus norvegicus
acacagtcacgtggcccggctgcgg

SEQ ID NO: 543668 - DNA, 25 bp, Rattus norvegicus
tcgagacacagtcacgtggcccggc

SEQ ID NO: 543669 - DNA, 25 bp, Rattus norvegicus
agctcgagctctttaaggcaggccc

SEQ ID NO: 543670 - DNA, 25 bp, Rattus norvegicus
ttccgcagagagctcgagctcttta

SEQ ID NO: 543671 - DNA, 25 bp, Rattus norvegicus
gctaacctcaccaacgccatccgcg

SEQ ID NO: 543672 - DNA, 25 bp, Rattus norvegicus
tgaggaagaatggagatgcacgcca

SEQ ID NO: 543673 - DNA, 25 bp, Rattus norvegicus
cgcttctgcgcacgtcacacgaatt

SEQ ID NO: 543674 - DNA, 25 bp, Rattus norvegicus
cctagcctgccctggtcatggtcat

SEQ ID NO: 543675 - DNA, 25 bp, Rattus norvegicus
tcatggtcatggtcctgtgctccct

SEQ ID NO: 543676 - DNA, 25 bp, Rattus norvegicus
tgtgctccctcggagctacggtcca

SEQ ID NO: 543677 - DNA, 25 bp, Rattus norvegicus
agctacggtccactctgggcccgtg

SEQ ID NO: 543678 - DNA, 25 bp, Rattus norvegicus
cagtcgcggtcactcgctatgggct

SEQ ID NO: 543679 - DNA, 25 bp, Rattus norvegicus
tcgctatgggctgcgtgtttgcact

SEQ ID NO: 543680 - DNA, 25 bp, Rattus norvegicus
gatgcacgccacttctgtacacagg

SEQ ID NO: 543681 - DNA, 25 bp, Rattus norvegicus
aggacccgagatcgccgcctagcgt

SEQ ID NO: 543682 - DNA, 25 bp, Rattus norvegicus
gcctagcgtgctgctgttgggccct

SEQ ID NO: 543683 - DNA, 25 bp, Rattus norvegicus
ttctgtacacaggacccgagatcgc

SEQ ID NO: 543684 - DNA, 25 bp, Rattus norvegicus
tgccgttaaatctgccgccgcttct

SEQ ID NO: 543685 - DNA, 25 bp, Rattus norvegicus
ttgggccctgccgttaaatctgccg

SEQ ID NO: 543686 - DNA, 25 bp, Rattus norvegicus
ccaggtcccgatgctgccaagaagc

SEQ ID NO: 543687 - DNA, 25 bp, Rattus norvegicus
cctcccggagcgtagtagtcgcttt

SEQ ID NO: 543688 - DNA, 25 bp, Rattus norvegicus
agaaatcgtagttgcctcccggagc

SEQ ID NO: 543689 - DNA, 25 bp, Rattus norvegicus
ggccgtgcgcgaagaaatcgtagtt

SEQ ID NO: 543690 - DNA, 25 bp, Rattus norvegicus
ccaagaagcttgagtcggccggaga

SEQ ID NO: 543691 - DNA, 25 bp, Rattus norvegicus
caacgcgaaggggactcgagaactc

SEQ ID NO: 543692 - DNA, 25 bp, Rattus norvegicus
gttccagcgcgccaagcggcgtcga

SEQ ID NO: 543693 - DNA, 25 bp, Rattus norvegicus
tcggtgaacctagggttgtccgcgc

SEQ ID NO: 543694 - DNA, 25 bp, Rattus norvegicus
gtgcgagatcatgtcggtgaaccta

SEQ ID NO: 543695 - DNA, 25 bp, Rattus norvegicus
gctgaacacctctcccggcatgggg

SEQ ID NO: 543696 - DNA, 25 bp, Rattus norvegicus
ccatacggccgcttcgttgagctca

SEQ ID NO: 543697 - DNA, 25 bp, Rattus norvegicus
tagtcgctttggtagtctgccggag

SEQ ID NO: 543698 - DNA, 25 bp, Rattus norvegicus
actcgagaactcgaaggccagggcg

SEQ ID NO: 543699 - DNA, 25 bp, Rattus norvegicus
tgaggacagactgccagggccgaca

SEQ ID NO: 543700 - DNA, 25 bp, Rattus norvegicus
aggatctcccagtgcggattaggcg

SEQ ID NO: 543701 - DNA, 25 bp, Rattus norvegicus
ctaagcagggaaggccgcggcccta

SEQ ID NO: 543702 - DNA, 25 bp, Rattus norvegicus
ccgcggccctagagccgtgcgcgcc

SEQ ID NO: 543703 - DNA, 25 bp, Rattus norvegicus
ccggaggtaattggaacaaacgctg

SEQ ID NO: 543704 - DNA, 25 bp, Rattus norvegicus
ggtaattggaacaaacgctgtctga

SEQ ID NO: 543705 - DNA, 25 bp, Rattus norvegicus
ttggaacaaacgctgtctgaaaagg

SEQ ID NO: 543706 - DNA, 25 bp, Rattus norvegicus
acaaacgctgtctgaaaagggcaca

SEQ ID NO: 543707 - DNA, 25 bp, Rattus norvegicus
cgctgtctgaaaagggcacaaaagc

SEQ ID NO: 543708 - DNA, 25 bp, Rattus norvegicus
gtctgaaaagggcacaaaagccgca

SEQ ID NO: 543709 - DNA, 25 bp, Rattus norvegicus
aaagggcacaaaagccgcagctggg

SEQ ID NO: 543710 - DNA, 25 bp, Rattus norvegicus
cacaaaagccgcagctggggctttg

SEQ ID NO: 543711 - DNA, 25 bp, Rattus norvegicus
ctggggctttgtccgagctcccacg

SEQ ID NO: 543712 - DNA, 25 bp, Rattus norvegicus
ccaccaggatctcccagtgcggatt

SEQ ID NO: 543713 - DNA, 25 bp, Rattus norvegicus
ctttgtccgagctcccacggggagc

SEQ ID NO: 543714 - DNA, 25 bp, Rattus norvegicus
cagctgtttcatgcggcgttctttg

SEQ ID NO: 543715 - DNA, 25 bp, Rattus norvegicus
tcccgaaggccagagaggcttaagc

SEQ ID NO: 543716 - DNA, 25 bp, Rattus norvegicus
ggtgccggagttctgttcctcattc

SEQ ID NO: 543717 - DNA, 25 bp, Rattus norvegicus
ctccagctgcttggccttgatggta

SEQ ID NO: 543718 - DNA, 25 bp, Rattus norvegicus
ccctcatgttgaggccggtctcttg

SEQ ID NO: 543719 - DNA, 25 bp, Rattus norvegicus
ttacaggctacgctgcccaacggga

SEQ ID NO: 543720 - DNA, 25 bp, Rattus norvegicus
gtctggcgaccttgttcaaaattca

SEQ ID NO: 543721 - DNA, 25 bp, Rattus norvegicus
cggtctccttgtccgatgaggtcga

SEQ ID NO: 543722 - DNA, 25 bp, Rattus norvegicus
ggacttctcccttttctatgcttga

SEQ ID NO: 543723 - DNA, 25 bp, Rattus norvegicus
tccagccgattgtcgctttgccagc

SEQ ID NO: 543724 - DNA, 25 bp, Rattus norvegicus
gcccgaggccagacggctttataaa

SEQ ID NO: 543725 - DNA, 25 bp, Rattus norvegicus
gacccgtggggtgactcataaagac

SEQ ID NO: 543726 - DNA, 25 bp, Rattus norvegicus
cagcgcttaggcatgaggacttctc

SEQ ID NO: 543727 - DNA, 25 bp, Rattus norvegicus
ctcattctcgttgttagcggtctcc

SEQ ID NO: 543728 - DNA, 25 bp, Rattus norvegicus
cggtcacagcctcatgtcacgggtc

SEQ ID NO: 543729 - DNA, 25 bp, Rattus norvegicus
cgcgcatccttattcagatttggtg

SEQ ID NO: 543730 - DNA, 25 bp, Rattus norvegicus
gtttttacagtacagcttgccctcc

SEQ ID NO: 543731 - DNA, 25 bp, Rattus norvegicus
tctccgagaggttggttttgcactc

SEQ ID NO: 543732 - DNA, 25 bp, Rattus norvegicus
gcactcgcagcattgaacacatttg

SEQ ID NO: 543733 - DNA, 25 bp, Rattus norvegicus
cacatttgatatgccacgcgcggtc

SEQ ID NO: 543734 - DNA, 25 bp, Rattus norvegicus
cgcggtccagcacgttcagcagaaa

SEQ ID NO: 543735 - DNA, 25 bp, Rattus norvegicus
agccggcacagtgcaccatcatagc

SEQ ID NO: 543736 - DNA, 25 bp, Rattus norvegicus
cttcggtagggtcgagtccgataca

SEQ ID NO: 543737 - DNA, 25 bp, Rattus norvegicus
tacagatcaaccaagacttctcggg

SEQ ID NO: 543738 - DNA, 25 bp, Rattus norvegicus
tcggggtcaagtcctccgacgctct

SEQ ID NO: 543739 - DNA, 25 bp, Rattus norvegicus
agcggtcccgatcctcatctttgtc

SEQ ID NO: 543740 - DNA, 25 bp, Rattus norvegicus
ctcgctccagcttcgagcaggtgtc

SEQ ID NO: 543741 - DNA, 25 bp, Rattus norvegicus
actgcactgcccagagtggcgtgga

SEQ ID NO: 543742 - DNA, 25 bp, Rattus norvegicus
ttgtaaatttaaattgctctccgga

SEQ ID NO: 543743 - DNA, 25 bp, Rattus norvegicus
gaagcgcccgcctggtacttcagga

SEQ ID NO: 543744 - DNA, 25 bp, Rattus norvegicus
gcccgccgcccagaggcataggccc

SEQ ID NO: 543745 - DNA, 25 bp, Rattus norvegicus
gacactcagcatcccgtcgcgcacg

SEQ ID NO: 543746 - DNA, 25 bp, Rattus norvegicus
ctttgccgcaaagagcctgcgccta

SEQ ID NO: 543747 - DNA, 25 bp, Rattus norvegicus
tgttttgggtgtaaatataggcggc

SEQ ID NO: 543748 - DNA, 25 bp, Rattus norvegicus
agcctgcgcctaatcactggctttc

SEQ ID NO: 543749 - DNA, 25 bp, Rattus norvegicus
tgagaaactgctttgccgcaaagag

SEQ ID NO: 543750 - DNA, 25 bp, Rattus norvegicus
ctggtgtaccactgagaaactgctt

SEQ ID NO: 543751 - DNA, 25 bp, Rattus norvegicus
gaaaaattatactggtgtaccactg

SEQ ID NO: 543752 - DNA, 25 bp, Rattus norvegicus
tcagccagccgtgaaaaattatact

SEQ ID NO: 543753 - DNA, 25 bp, Rattus norvegicus
cctctttgatttcagccagccgtga

SEQ ID NO: 543754 - DNA, 25 bp, Rattus norvegicus
ttgctctccggattcattacttccc

SEQ ID NO: 543755 - DNA, 25 bp, Rattus norvegicus
ccctccgacaagagtgtaattattt

SEQ ID NO: 543756 - DNA, 25 bp, Rattus norvegicus
tgcagacgatggcatccccattccg

SEQ ID NO: 543757 - DNA, 25 bp, Rattus norvegicus
tgtttatttgggtaccacggcgagc

SEQ ID NO: 543758 - DNA, 25 bp, Rattus norvegicus
cttattactcaacgtcccctgcaga

SEQ ID NO: 543759 - DNA, 25 bp, Rattus norvegicus
cctcatccgtcaccagcttgtttat

SEQ ID NO: 543760 - DNA, 25 bp, Rattus norvegicus
ataacaaacacggggccacctctgc

SEQ ID NO: 543761 - DNA, 25 bp, Rattus norvegicus
caccagcttgtttatttgggtacca

SEQ ID NO: 543762 - DNA, 25 bp, Rattus norvegicus
gggtaccacggcgagcctttctcca

SEQ ID NO: 543763 - DNA, 25 bp, Rattus norvegicus
cccgcgtgtaagaaacgtgtgctgg

SEQ ID NO: 543764 - DNA, 25 bp, Rattus norvegicus
ttcacccgcgtgtaagaaacgtgtg

SEQ ID NO: 543765 - DNA, 25 bp, Rattus norvegicus
ggtgtttattcacccgcgtgtaaga

SEQ ID NO: 543766 - DNA, 25 bp, Rattus norvegicus
catccgtcaccagcttgtttatttg

SEQ ID NO: 543767 - DNA, 25 bp, Rattus norvegicus
acggcgagcctttctccacttatta

SEQ ID NO: 543768 - DNA, 25 bp, Rattus norvegicus
gcctttctccacttattactcaacg

SEQ ID NO: 543769 - DNA, 25 bp, Rattus norvegicus
aagaaacgtgtgctgggtgctagca

SEQ ID NO: 543770 - DNA, 25 bp, Rattus norvegicus
aagatctaaggagggtcaagccatc

SEQ ID NO: 543771 - DNA, 25 bp, Rattus norvegicus
ttccagcccgctggagctccgtgct

SEQ ID NO: 543772 - DNA, 25 bp, Rattus norvegicus
cgtgctccgggtgccttggtcccag

SEQ ID NO: 543773 - DNA, 25 bp, Rattus norvegicus
ctcctcggcgggtcagggagctcct

SEQ ID NO: 543774 - DNA, 25 bp, Rattus norvegicus
caagataaatggtactgagcgggat

SEQ ID NO: 543775 - DNA, 25 bp, Rattus norvegicus
ggcgaaggctaagaaagatctaagg

SEQ ID NO: 543776 - DNA, 25 bp, Rattus norvegicus
cgtacgctctcctcggcgggtcagg

SEQ ID NO: 543777 - DNA, 25 bp, Rattus norvegicus
tctaaggagggtcaagccatcgctc

SEQ ID NO: 543778 - DNA, 25 bp, Rattus norvegicus
aaggagggtcaagccatcgctcatg

SEQ ID NO: 543779 - DNA, 25 bp, Rattus norvegicus
agggtcaagccatcgctcatgccgg

SEQ ID NO: 543780 - DNA, 25 bp, Rattus norvegicus
agccatcgctcatgccggcctgaag

SEQ ID NO: 543781 - DNA, 25 bp, Rattus norvegicus
atgccggcctgaagcggccgctgac

SEQ ID NO: 543782 - DNA, 25 bp, Rattus norvegicus
cgcagaactggcgagccgaggcgaa

SEQ ID NO: 543783 - DNA, 25 bp, Rattus norvegicus
cccggagcaagataaatggtactga

SEQ ID NO: 543784 - DNA, 25 bp, Rattus norvegicus
tcgcaggacctgtctttggaatcag

SEQ ID NO: 543785 - DNA, 25 bp, Rattus norvegicus
tcagtctacaagctcggccggctct

SEQ ID NO: 543786 - DNA, 25 bp, Rattus norvegicus
gatggagacttgctgggagccccca

SEQ ID NO: 543787 - DNA, 25 bp, Rattus norvegicus
gggctcaggcctcagtctacaagct

SEQ ID NO: 543788 - DNA, 25 bp, Rattus norvegicus
tcaggctccagaggcgtgcgcgcca

SEQ ID NO: 543789 - DNA, 25 bp, Rattus norvegicus
aggccgaagccctcatctgcgtcgg

SEQ ID NO: 543790 - DNA, 25 bp, Rattus norvegicus
aagccctcatctgcgtcggccatgg

SEQ ID NO: 543791 - DNA, 25 bp, Rattus norvegicus
atctgcgtcggccatggtgcgcccg

SEQ ID NO: 543792 - DNA, 25 bp, Rattus norvegicus
cggctctccttacctgctgggtgaa

SEQ ID NO: 543793 - DNA, 25 bp, Rattus norvegicus
ctggtttcgaatcgcaggacctgtc

SEQ ID NO: 543794 - DNA, 25 bp, Rattus norvegicus
ccagcgcactctctggtttcgaatc

SEQ ID NO: 543795 - DNA, 25 bp, Rattus norvegicus
tccttacctgctgggtgaaggcggc

SEQ ID NO: 543796 - DNA, 25 bp, Rattus norvegicus
tttggaatcaggctccagaggcgtg

SEQ ID NO: 543797 - DNA, 25 bp, Rattus norvegicus
cctgtctttggaatcaggctccaga

SEQ ID NO: 543798 - DNA, 25 bp, Rattus norvegicus
gtgggagccagctccgccactagtt

SEQ ID NO: 543799 - DNA, 25 bp, Rattus norvegicus
cgcccggtgccttggcccaccacct

SEQ ID NO: 543800 - DNA, 25 bp, Rattus norvegicus
accaccttacccagagcggatcgga

SEQ ID NO: 543801 - DNA, 25 bp, Rattus norvegicus
acagctgttcccctgctgcgggaga

SEQ ID NO: 543802 - DNA, 25 bp, Rattus norvegicus
tacccagagcggatcggagccatca

SEQ ID NO: 543803 - DNA, 25 bp, Rattus norvegicus
atcggagccatcagagctgcagaag

SEQ ID NO: 543804 - DNA, 25 bp, Rattus norvegicus
agcgccgcgcagttggctcgcgtca

SEQ ID NO: 543805 - DNA, 25 bp, Rattus norvegicus
tggctcgcgtcaccgggatgcagcc

SEQ ID NO: 543806 - DNA, 25 bp, Rattus norvegicus
ctgcaggccgcgtctgcagctccca

SEQ ID NO: 543807 - DNA, 25 bp, Rattus norvegicus
cctaactaagacaccgccgcgagaa

SEQ ID NO: 543808 - DNA, 25 bp, Rattus norvegicus
accgccgcgagaactctgcgctagg

SEQ ID NO: 543809 - DNA, 25 bp, Rattus norvegicus
agaactctgcgctaggcccttccaa

SEQ ID NO: 543810 - DNA, 25 bp, Rattus norvegicus
gcttccgggtgatcctaaccgtaca

SEQ ID NO: 543811 - DNA, 25 bp, Rattus norvegicus
gtgatcctaaccgtacagctgttcc

SEQ ID NO: 543812 - DNA, 25 bp, Rattus norvegicus
ggcttcccttcacccgcgccgctac

SEQ ID NO: 543813 - DNA, 25 bp, Rattus norvegicus
atctccgcagagcttactggctggc

SEQ ID NO: 543814 - DNA, 25 bp, Rattus norvegicus
gctagcccaatctccgcagagctta

SEQ ID NO: 543815 - DNA, 25 bp, Rattus norvegicus
ggatcgctagcccaatctccgcaga

SEQ ID NO: 543816 - DNA, 25 bp, Rattus norvegicus
ggggctcagactcggcctcagcctg

SEQ ID NO: 543817 - DNA, 25 bp, Rattus norvegicus
taccggggctcagactcggcctcag

SEQ ID NO: 543818 - DNA, 25 bp, Rattus norvegicus
aacaaagcggttgcccgcggctgcc

SEQ ID NO: 543819 - DNA, 25 bp, Rattus norvegicus
tccggcagtggtctcgcgcgcagac

SEQ ID NO: 543820 - DNA, 25 bp, Rattus norvegicus
ctggctcgctgcacacaggcgggac

SEQ ID NO: 543821 - DNA, 25 bp, Rattus norvegicus
agcgtgcacgcggaccggacgtcca

SEQ ID NO: 543822 - DNA, 25 bp, Rattus norvegicus
cggaccggacgtccagccagcggaa

SEQ ID NO: 543823 - DNA, 25 bp, Rattus norvegicus
cgcagagcttactggctggctcgct

SEQ ID NO: 543824 - DNA, 25 bp, Rattus norvegicus
aatgcgccaaactcggccgcaacat

SEQ ID NO: 543825 - DNA, 25 bp, Rattus norvegicus
cgccaccgaggaaacaaagcggttg

SEQ ID NO: 543826 - DNA, 25 bp, Rattus norvegicus
cagttgcaatcctgggagtgctccc

SEQ ID NO: 543827 - DNA, 25 bp, Rattus norvegicus
gtgctcacaaccttgggcgtgctcc

SEQ ID NO: 543828 - DNA, 25 bp, Rattus norvegicus
agcgcgattccacaacccagttgca

SEQ ID NO: 543829 - DNA, 25 bp, Rattus norvegicus
ggcaatcagaaacgtcctcaggaac

SEQ ID NO: 543830 - DNA, 25 bp, Rattus norvegicus
gaagcctgctgggttccttgcccgc

SEQ ID NO: 543831 - DNA, 25 bp, Rattus norvegicus
agttgcacctccaggcacgttcctg

SEQ ID NO: 543832 - DNA, 25 bp, Rattus norvegicus
cctaatctcctagtctagtcggtga

SEQ ID NO: 543833 - DNA, 25 bp, Rattus norvegicus
gacctcgactgcgtcgtgctcacaa

SEQ ID NO: 543834 - DNA, 25 bp, Rattus norvegicus
tctagtcggtgatgcaaggaggtca

SEQ ID NO: 543835 - DNA, 25 bp, Rattus norvegicus
cagctgctagctctgacctcgactg

SEQ ID NO: 543836 - DNA, 25 bp, Rattus norvegicus
ggatcccgtgatccctaatctccta

SEQ ID NO: 543837 - DNA, 25 bp, Rattus norvegicus
gagtgctcccatagcccagttccag

SEQ ID NO: 543838 - DNA, 25 bp, Rattus norvegicus
tgcaggctgagctgaggcaatcaga

SEQ ID NO: 543839 - DNA, 25 bp, Rattus norvegicus
gcctgggtacaacccagttgcaatc

SEQ ID NO: 543840 - DNA, 25 bp, Rattus norvegicus
gtttgacagaaccaggccgtgtgcc

SEQ ID NO: 543841 - DNA, 25 bp, Rattus norvegicus
gtgtgccttgcaagcctcaacgctg

SEQ ID NO: 543842 - DNA, 25 bp, Rattus norvegicus
ggctcgggtaaaatctctgcaagtc

SEQ ID NO: 543843 - DNA, 25 bp, Rattus norvegicus
gctggagtccgccattctccgcttt

SEQ ID NO: 543844 - DNA, 25 bp, Rattus norvegicus
gagacgagcaagatgtggtttgaca

SEQ ID NO: 543845 - DNA, 25 bp, Rattus norvegicus
aatcccgggaagctcagagactggc

SEQ ID NO: 543846 - DNA, 25 bp, Rattus norvegicus
cggagcccttgccagaatcccggga

SEQ ID NO: 543847 - DNA, 25 bp, Rattus norvegicus
tgcaagtcagactctgcagaatgca

SEQ ID NO: 543848 - DNA, 25 bp, Rattus norvegicus
cagaatgcaagacagggctggagtc

SEQ ID NO: 543849 - DNA, 25 bp, Rattus norvegicus
ccggcttcctcttgccttgaaaggc

SEQ ID NO: 543850 - DNA, 25 bp, Rattus norvegicus
ccggccatctgttagtatgttagta

SEQ ID NO: 543851 - DNA, 25 bp, Rattus norvegicus
gttagtacggttacctcgctctgta

SEQ ID NO: 543852 - DNA, 25 bp, Rattus norvegicus
tcgctctgtacagcgggctgcattc

SEQ ID NO: 543853 - DNA, 25 bp, Rattus norvegicus
tttcccggccgactgttgctgcctg

SEQ ID NO: 543854 - DNA, 25 bp, Rattus norvegicus
agcaagcgagctccagggtaagtcc

SEQ ID NO: 543855 - DNA, 25 bp, Rattus norvegicus
cagaggattggagcagcagtgacac

SEQ ID NO: 543856 - DNA, 25 bp, Rattus norvegicus
cccagaagcatgacccggttttggt

SEQ ID NO: 543857 - DNA, 25 bp, Rattus norvegicus
tgggtctgcgtaagcttctacgtgc

SEQ ID NO: 543858 - DNA, 25 bp, Rattus norvegicus
caatgggcataatttctaagtggtc

SEQ ID NO: 543859 - DNA, 25 bp, Rattus norvegicus
tgtatcctgaggtttttgcgatccc

SEQ ID NO: 543860 - DNA, 25 bp, Rattus norvegicus
ccaacttcccgggtgtatcctgagg

SEQ ID NO: 543861 - DNA, 25 bp, Rattus norvegicus
ccctggggagccgaacttttcatct

SEQ ID NO: 543862 - DNA, 25 bp, Rattus norvegicus
cggcaattatttctggttggatcaa

SEQ ID NO: 543863 - DNA, 25 bp, Rattus norvegicus
tgcactgtgcggagggaaatttttt

SEQ ID NO: 543864 - DNA, 25 bp, Rattus norvegicus
tgagttacgaaaccgtgcagacttt

SEQ ID NO: 543865 - DNA, 25 bp, Rattus norvegicus
ttctacgtgcatttggaaacccatt

SEQ ID NO: 543866 - DNA, 25 bp, Rattus norvegicus
ccggcaataagctaggcctgcccta

SEQ ID NO: 543867 - DNA, 25 bp, Rattus norvegicus
cgaacttttcatctggacttgtccc

SEQ ID NO: 543868 - DNA, 25 bp, Rattus norvegicus
tacggcagggcacagagtatgcaca

SEQ ID NO: 543869 - DNA, 25 bp, Rattus norvegicus
cacacagcgggatactgggtatgca

SEQ ID NO: 543870 - DNA, 25 bp, Rattus norvegicus
gttgaacaaggtgggactcggaata

SEQ ID NO: 543871 - DNA, 25 bp, Rattus norvegicus
gactcggaatacgtacggccgggca

SEQ ID NO: 543872 - DNA, 25 bp, Rattus norvegicus
gcaccgggaatgcacacggcgaatc

SEQ ID NO: 543873 - DNA, 25 bp, Rattus norvegicus
cgcgggtatgcacatctagggagac

SEQ ID NO: 543874 - DNA, 25 bp, Rattus norvegicus
actatggggcccatgagtgcacagc

SEQ ID NO: 543875 - DNA, 25 bp, Rattus norvegicus
cacgggatacacacagtggggcgta

SEQ ID NO: 543876 - DNA, 25 bp, Rattus norvegicus
cacatagtgggtcgcgagctgtgca

SEQ ID NO: 543877 - DNA, 25 bp, Rattus norvegicus
aaagtttctagcagttgcgcggcgc

SEQ ID NO: 543878 - DNA, 25 bp, Rattus norvegicus
acttacccgcggagcagctgatttg

SEQ ID NO: 543879 - DNA, 25 bp, Rattus norvegicus
gtgtacgctcgcaaccgccgcggat

SEQ ID NO: 543880 - DNA, 25 bp, Rattus norvegicus
aggcgcggcctcttgcaaagtttct

SEQ ID NO: 543881 - DNA, 25 bp, Rattus norvegicus
acggggtgcacaactatggggccca

SEQ ID NO: 543882 - DNA, 25 bp, Rattus norvegicus
tttatggttacacactcaggaggac

SEQ ID NO: 543883 - DNA, 25 bp, Rattus norvegicus
accgcataaccctgacgcgaatcaa

SEQ ID NO: 543884 - DNA, 25 bp, Rattus norvegicus
tacgagcaggacaatgtagtcacgc

SEQ ID NO: 543885 - DNA, 25 bp, Rattus norvegicus
ggacaatgtagtcacgcccgtgatt

SEQ ID NO: 543886 - DNA, 25 bp, Rattus norvegicus
agtcacgcccgtgattgctcctaac

SEQ ID NO: 543887 - DNA, 25 bp, Rattus norvegicus
gtgattgctcctaaccagccgcaga

SEQ ID NO: 543888 - DNA, 25 bp, Rattus norvegicus
ctaaccagccgcagatgcaaacctg

SEQ ID NO: 543889 - DNA, 25 bp, Rattus norvegicus
tgctcctcacccgacctcacgcctg

SEQ ID NO: 543890 - DNA, 25 bp, Rattus norvegicus
cctgcgactttatggttacacactc

SEQ ID NO: 543891 - DNA, 25 bp, Rattus norvegicus
ccgcagatgcaaacctgcgacttta

SEQ ID NO: 543892 - DNA, 25 bp, Rattus norvegicus
cgtagcgtgtctcatgaaaacatta

SEQ ID NO: 543893 - DNA, 25 bp, Rattus norvegicus
tgtagagtcgtagcgtgtctcatga

SEQ ID NO: 543894 - DNA, 25 bp, Rattus norvegicus
ccctcacggtccagcacaccgcata

SEQ ID NO: 543895 - DNA, 25 bp, Rattus norvegicus
gaaaacattaacatacgagcaggac

SEQ ID NO: 543896 - DNA, 25 bp, Rattus norvegicus
agcacgcgcctgagatgaacccgta

SEQ ID NO: 543897 - DNA, 25 bp, Rattus norvegicus
gcctttaccgcgcttcccataggaa

SEQ ID NO: 543898 - DNA, 25 bp, Rattus norvegicus
cccgagtagagacccacgcttttca

SEQ ID NO: 543899 - DNA, 25 bp, Rattus norvegicus
gcgcacccagggttcaaagcaaacg

SEQ ID NO: 543900 - DNA, 25 bp, Rattus norvegicus
gtctcccgaagttccttatctgcta

SEQ ID NO: 543901 - DNA, 25 bp, Rattus norvegicus
ccgtaaaactcatggggtctggctg

SEQ ID NO: 543902 - DNA, 25 bp, Rattus norvegicus
ctccgagatctcaggccgtaaaact

SEQ ID NO: 543903 - DNA, 25 bp, Rattus norvegicus
ggtgtggtttccaccgcctcagtca

SEQ ID NO: 543904 - DNA, 25 bp, Rattus norvegicus
ttcccagcacggcttctttctagtc

SEQ ID NO: 543905 - DNA, 25 bp, Rattus norvegicus
tgctgttagcagtctctccgaagtg

SEQ ID NO: 543906 - DNA, 25 bp, Rattus norvegicus
tccgaagtggtagaaccctggcgtc

SEQ ID NO: 543907 - DNA, 25 bp, Rattus norvegicus
ctgttcgcagacaatcacgggtgaa

SEQ ID NO: 543908 - DNA, 25 bp, Rattus norvegicus
gcgacgagacccatgcgaatcactg

SEQ ID NO: 543909 - DNA, 25 bp, Rattus norvegicus
gtgcacgaccttcggggtaaattgc

SEQ ID NO: 543910 - DNA, 25 bp, Rattus norvegicus
gctcaggacagcgacgagatgccta

SEQ ID NO: 543911 - DNA, 25 bp, Rattus norvegicus
acagcgacgagatgcctagccaggc

SEQ ID NO: 543912 - DNA, 25 bp, Rattus norvegicus
tgccagcggccgctcaggacagcga

SEQ ID NO: 543913 - DNA, 25 bp, Rattus norvegicus
gatgcctagccaggccgttctggtt

SEQ ID NO: 543914 - DNA, 25 bp, Rattus norvegicus
ccaacaggtcggctgataagcagga

SEQ ID NO: 543915 - DNA, 25 bp, Rattus norvegicus
ccctccaacaggtcggctgataagc

SEQ ID NO: 543916 - DNA, 25 bp, Rattus norvegicus
gttctggttacaatcacctcacaca

SEQ ID NO: 543917 - DNA, 25 bp, Rattus norvegicus
tctcaggccagggagcttcgcccgg

SEQ ID NO: 543918 - DNA, 25 bp, Rattus norvegicus
cacaccttctcaggccagggagctt

SEQ ID NO: 543919 - DNA, 25 bp, Rattus norvegicus
tgaagtcacaccttctcaggccagg

SEQ ID NO: 543920 - DNA, 25 bp, Rattus norvegicus
tccttacccagagtctgaagtcaca

SEQ ID NO: 543921 - DNA, 25 bp, Rattus norvegicus
agccaggccgttctggttacaatca

SEQ ID NO: 543922 - DNA, 25 bp, Rattus norvegicus
tcacctcacacaccgcggcattccg

SEQ ID NO: 543923 - DNA, 25 bp, Rattus norvegicus
ggccgttctggttacaatcacctca

SEQ ID NO: 543924 - DNA, 25 bp, Rattus norvegicus
ccttgtatccgggtgctttgtacca

SEQ ID NO: 543925 - DNA, 25 bp, Rattus norvegicus
aacgccctctacagggttaagcgcg

SEQ ID NO: 543926 - DNA, 25 bp, Rattus norvegicus
tttaagccgtctgcgccttgtatcc

SEQ ID NO: 543927 - DNA, 25 bp, Rattus norvegicus
tgctttgtaccacggggcctgaaaa

SEQ ID NO: 543928 - DNA, 25 bp, Rattus norvegicus
gggcctgaaaatcgaacgccctcta

SEQ ID NO: 543929 - DNA, 25 bp, Rattus norvegicus
gaccgaggtcacttcgtgggtgctt

SEQ ID NO: 543930 - DNA, 25 bp, Rattus norvegicus
gcaacgccatcaatttctatcgtgg

SEQ ID NO: 543931 - DNA, 25 bp, Rattus norvegicus
atcgtggttattctgcgcgctttga

SEQ ID NO: 543932 - DNA, 25 bp, Rattus norvegicus
tgcgcgctttgaacgcccacatctg

SEQ ID NO: 543933 - DNA, 25 bp, Rattus norvegicus
cgcccacatctgcaacatatatttc

SEQ ID NO: 543934 - DNA, 25 bp, Rattus norvegicus
ttcttgattatacgcatcttgatta

SEQ ID NO: 543935 - DNA, 25 bp, Rattus norvegicus
tgattataaaacaaccgagtgcgtt

SEQ ID NO: 543936 - DNA, 25 bp, Rattus norvegicus
agtgcgttttacatccggaactgtc

SEQ ID NO: 543937 - DNA, 25 bp, Rattus norvegicus
gctcaggttaacgatttaagccgtc

SEQ ID NO: 543938 - DNA, 25 bp, Rattus norvegicus
tgctatcaggcaccgggactgggat

SEQ ID NO: 543939 - DNA, 25 bp, Rattus norvegicus
agcggctattcagttccgacccgga

SEQ ID NO: 543940 - DNA, 25 bp, Rattus norvegicus
acggtaacgcagtggccagcaagct

SEQ ID NO: 543941 - DNA, 25 bp, Rattus norvegicus
cagcggaagccatggacggtaacgc

SEQ ID NO: 543942 - DNA, 25 bp, Rattus norvegicus
gaccgccgatttgccgtctaggggc

SEQ ID NO: 543943 - DNA, 25 bp, Rattus norvegicus
ctggctgccaggaccgccgatttgc

SEQ ID NO: 543944 - DNA, 25 bp, Rattus norvegicus
ctattcagttccgacccggagtcca

SEQ ID NO: 543945 - DNA, 25 bp, Rattus norvegicus
gacagcgtggatgagcggctattca

SEQ ID NO: 543946 - DNA, 25 bp, Rattus norvegicus
tggccagcaagctgctgctatcagg

SEQ ID NO: 543947 - DNA, 25 bp, Rattus norvegicus
actgggatggaatacgggctgtaac

SEQ ID NO: 543948 - DNA, 25 bp, Rattus norvegicus
ctgttcaaattgaggaacgggtggc

SEQ ID NO: 543949 - DNA, 25 bp, Rattus norvegicus
ggaatacgggctgtaacgcagcctg

SEQ ID NO: 543950 - DNA, 25 bp, Rattus norvegicus
agcctggggcgcatgctgttcaaat

SEQ ID NO: 543951 - DNA, 25 bp, Rattus norvegicus
tccacagccaccgaggctgggctgg

SEQ ID NO: 543952 - DNA, 25 bp, Rattus norvegicus
atgcgcggtggcgtctgtctgcacc

SEQ ID NO: 543953 - DNA, 25 bp, Rattus norvegicus
tgtcgcaggcctcggggccatgctc

SEQ ID NO: 543954 - DNA, 25 bp, Rattus norvegicus
tggtggaaatcttggccgtgtcgca

SEQ ID NO: 543955 - DNA, 25 bp, Rattus norvegicus
ctggtggctggactgcccttgtcgc

SEQ ID NO: 543956 - DNA, 25 bp, Rattus norvegicus
gccttgtccagacgcgcagtgtctc

SEQ ID NO: 543957 - DNA, 25 bp, Rattus norvegicus
cccggaactcgggtgctagacgaga

SEQ ID NO: 543958 - DNA, 25 bp, Rattus norvegicus
agcgctcgagcctcatccaccttgg

SEQ ID NO: 543959 - DNA, 25 bp, Rattus norvegicus
cagcggagcaaaggcgtccttggcc

SEQ ID NO: 543960 - DNA, 25 bp, Rattus norvegicus
ggcgtctgtctgcaccgacagcgga

SEQ ID NO: 543961 - DNA, 25 bp, Rattus norvegicus
gggccatgctcctccttgctttcag

SEQ ID NO: 543962 - DNA, 25 bp, Rattus norvegicus
aacagctgcgccctggtggctggac

SEQ ID NO: 543963 - DNA, 25 bp, Rattus norvegicus
caccgacagcggagcaaaggcgtcc

SEQ ID NO: 543964 - DNA, 25 bp, Rattus norvegicus
cgagtctggcgatgccttgtccaga

SEQ ID NO: 543965 - DNA, 25 bp, Rattus norvegicus
ttgctttcagcctcggcgtcactct

SEQ ID NO: 543966 - DNA, 25 bp, Rattus norvegicus
cttgctttcacaggcagcgagatca

SEQ ID NO: 543967 - DNA, 25 bp, Rattus norvegicus
ggcctcagccatccaagccttggga

SEQ ID NO: 543968 - DNA, 25 bp, Rattus norvegicus
tcagctcagcccacgtctgaaaggc

SEQ ID NO: 543969 - DNA, 25 bp, Rattus norvegicus
tccagaagagagttcgcagcagcct

SEQ ID NO: 543970 - DNA, 25 bp, Rattus norvegicus
gcctctaggtggctgatccagaaga

SEQ ID NO: 543971 - DNA, 25 bp, Rattus norvegicus
gcgctcaccaaagtcgcctctaggt

SEQ ID NO: 543972 - DNA, 25 bp, Rattus norvegicus
acggcctgtcctgcgtttatgtcaa

SEQ ID NO: 543973 - DNA, 25 bp, Rattus norvegicus
cataggcgtggttttcacaggtcga

SEQ ID NO: 543974 - DNA, 25 bp, Rattus norvegicus
gctctttgacgctttcggaccaatt

SEQ ID NO: 543975 - DNA, 25 bp, Rattus norvegicus
cccgaggcttgttgattggctcttt

SEQ ID NO: 543976 - DNA, 25 bp, Rattus norvegicus
cccggctgtcttccttgtgctaaaa

SEQ ID NO: 543977 - DNA, 25 bp, Rattus norvegicus
tttccagcggagctttcaaaactcg

SEQ ID NO: 543978 - DNA, 25 bp, Rattus norvegicus
cttctctggctttctcgcaggaggc

SEQ ID NO: 543979 - DNA, 25 bp, Rattus norvegicus
cgactctggcttcggttcgtgatcc

SEQ ID NO: 543980 - DNA, 25 bp, Rattus norvegicus
ccagcgccatgtcggtgaacacgga

SEQ ID NO: 543981 - DNA, 25 bp, Rattus norvegicus
aaccacaacattcgccgggcggcgg

SEQ ID NO: 543982 - DNA, 25 bp, Rattus norvegicus
cgaatcgaacgtccgtgtgggagcc

SEQ ID NO: 543983 - DNA, 25 bp, Rattus norvegicus
tcacgccgctgcgtctcgtgtttgt

SEQ ID NO: 543984 - DNA, 25 bp, Rattus norvegicus
gcccgccgcaggattcgaatcgaac

SEQ ID NO: 543985 - DNA, 25 bp, Rattus norvegicus
accaggaacagccaaaacacggagg

SEQ ID NO: 543986 - DNA, 25 bp, Rattus norvegicus
gtcgctgtcagcctcgccggtgaca

SEQ ID NO: 543987 - DNA, 25 bp, Rattus norvegicus
gtaggccaatcagcgcgtcaggccc

SEQ ID NO: 543988 - DNA, 25 bp, Rattus norvegicus
caccacccgcagatggtaagtgtcc

SEQ ID NO: 543989 - DNA, 25 bp, Rattus norvegicus
gtgtttgtccgcagaccgccctaag

SEQ ID NO: 543990 - DNA, 25 bp, Rattus norvegicus
ggcgcgccgcgaatgtaaacaaaga

SEQ ID NO: 543991 - DNA, 25 bp, Rattus norvegicus
agagccaaaatgtcttccaggaaag

SEQ ID NO: 543992 - DNA, 25 bp, Rattus norvegicus
ttccaggaaagagcgctcccaggcc

SEQ ID NO: 543993 - DNA, 25 bp, Rattus norvegicus
tcgccggtgacagccatgttgccgg

SEQ ID NO: 543994 - DNA, 25 bp, Rattus norvegicus
gctcattactaccacttccctgctg

SEQ ID NO: 543995 - DNA, 25 bp, Rattus norvegicus
aggaaactgggctgagaactacacc

SEQ ID NO: 543996 - DNA, 25 bp, Rattus norvegicus
gcaattccgctcattactaccactt

SEQ ID NO: 543997 - DNA, 25 bp, Rattus norvegicus
cccattaaacgcaattccgctcatt

SEQ ID NO: 543998 - DNA, 25 bp, Rattus norvegicus
cccgagtcactccaacgtttcttag

SEQ ID NO: 543999 - DNA, 25 bp, Rattus norvegicus
tcttaggaaactgggctgagaacta

SEQ ID NO: 544000 - DNA, 25 bp, Rattus norvegicus
ccttggctctggtggttcgcgaatg

SEQ ID NO: 544001 - DNA, 25 bp, Rattus norvegicus
gggctgagaactacaccctccagga

SEQ ID NO: 544002 - DNA, 25 bp, Rattus norvegicus
actacaccctccaggaattacttgg

SEQ ID NO: 544003 - DNA, 25 bp, Rattus norvegicus
caggaattacttggacacgggttcg

SEQ ID NO: 544004 - DNA, 25 bp, Rattus norvegicus
ccctgccttggctctggtggttcgc

SEQ ID NO: 544005 - DNA, 25 bp, Rattus norvegicus
ggaatccctggccacgtagcaattc

SEQ ID NO: 544006 - DNA, 25 bp, Rattus norvegicus
ttcgcgaatggggaatccctggcca

SEQ ID NO: 544007 - DNA, 25 bp, Rattus norvegicus
cactccaacgtttcttaggaaactg

SEQ ID NO: 544008 - DNA, 25 bp, Rattus norvegicus
cgaacaaatatttgtcctgtggtta

SEQ ID NO: 544009 - DNA, 25 bp, Rattus norvegicus
aaggcaaacatgtagggccacagga

SEQ ID NO: 544010 - DNA, 25 bp, Rattus norvegicus
atgcgtacgcgttcccttggacttc

SEQ ID NO: 544011 - DNA, 25 bp, Rattus norvegicus
cagtggcacatcaggcgaacggacg

SEQ ID NO: 544012 - DNA, 25 bp, Rattus norvegicus
aatctgcgccaacgggtcaacaatc

SEQ ID NO: 544013 - DNA, 25 bp, Rattus norvegicus
cgctttgaatctgcgccaacgggtc

SEQ ID NO: 544014 - DNA, 25 bp, Rattus norvegicus
cttggacttcgtagcccgctttgaa

SEQ ID NO: 544015 - DNA, 25 bp, Rattus norvegicus
ggccacaggagtcgaacaaatattt

SEQ ID NO: 544016 - DNA, 25 bp, Rattus norvegicus
ctctcagagcgaaggcaaacatgta

SEQ ID NO: 544017 - DNA, 25 bp, Rattus norvegicus
ttccggtaactatggctctcagagc

SEQ ID NO: 544018 - DNA, 25 bp, Rattus norvegicus
acgtctctgtttgatgttacttccg

SEQ ID NO: 544019 - DNA, 25 bp, Rattus norvegicus
ccgcgtaagggaacgtctctgtttg

SEQ ID NO: 544020 - DNA, 25 bp, Rattus norvegicus
gtcaacaatccgcagtggcacatca

SEQ ID NO: 544021 - DNA, 25 bp, Rattus norvegicus
cctgtggttaatattaatgcgtacg

SEQ ID NO: 544022 - DNA, 25 bp, Rattus norvegicus
tgcatgcctcctcgccattggtttt

SEQ ID NO: 544023 - DNA, 25 bp, Rattus norvegicus
tagtacgctcccagcactgctttta

SEQ ID NO: 544024 - DNA, 25 bp, Rattus norvegicus
tgcttttaccttcccgcagcaagcg

SEQ ID NO: 544025 - DNA, 25 bp, Rattus norvegicus
cattggttttgcaggagccacggcc

SEQ ID NO: 544026 - DNA, 25 bp, Rattus norvegicus
agcgccgcaaggttcagcatcccgg

SEQ ID NO: 544027 - DNA, 25 bp, Rattus norvegicus
tgcgagccaggccactaaggcgctt

SEQ ID NO: 544028 - DNA, 25 bp, Rattus norvegicus
aggcctcactgtgcctgggtcctag

SEQ ID NO: 544029 - DNA, 25 bp, Rattus norvegicus
gtcctagcgccgaccatattctctg

SEQ ID NO: 544030 - DNA, 25 bp, Rattus norvegicus
catattctctgtggctgaaccggcc

SEQ ID NO: 544031 - DNA, 25 bp, Rattus norvegicus
ccgccctggtcacgccagtgattgg

SEQ ID NO: 544032 - DNA, 25 bp, Rattus norvegicus
ctggattagcagaggccgtgattgc

SEQ ID NO: 544033 - DNA, 25 bp, Rattus norvegicus
tctggcaggtaaaagaaggcgatgc

SEQ ID NO: 544034 - DNA, 25 bp, Rattus norvegicus
tcgagcccaagcgtcctgcagggac

SEQ ID NO: 544035 - DNA, 25 bp, Rattus norvegicus
gccacggccttccattggctaaata

SEQ ID NO: 544036 - DNA, 25 bp, Rattus norvegicus
caagcgcggtctgcttcagccaatg

SEQ ID NO: 544037 - DNA, 25 bp, Rattus norvegicus
ccggggtcaactagaatgcggactg

SEQ ID NO: 544038 - DNA, 25 bp, Rattus norvegicus
ggatctaccggccagactacgcttc

SEQ ID NO: 544039 - DNA, 25 bp, Rattus norvegicus
cccggcatgcaaggcactaggatct

SEQ ID NO: 544040 - DNA, 25 bp, Rattus norvegicus
gaggcctcaccactggactgcgttc

SEQ ID NO: 544041 - DNA, 25 bp, Rattus norvegicus
gagcagctgtcacgtcaccatggta

SEQ ID NO: 544042 - DNA, 25 bp, Rattus norvegicus
cagtctattgggtggaatctttctc

SEQ ID NO: 544043 - DNA, 25 bp, Rattus norvegicus
agccacagaagttcccgatccgtta

SEQ ID NO: 544044 - DNA, 25 bp, Rattus norvegicus
ctaggggcatctcttaagccacaga

SEQ ID NO: 544045 - DNA, 25 bp, Rattus norvegicus
ccggtgagtaaaatgccgcagattc

SEQ ID NO: 544046 - DNA, 25 bp, Rattus norvegicus
gtctccgcccttcagtagttctttg

SEQ ID NO: 544047 - DNA, 25 bp, Rattus norvegicus
ctggaaagttctcctcagtaggcta

SEQ ID NO: 544048 - DNA, 25 bp, Rattus norvegicus
tgaacgcagtctcgcagggtaagcc

SEQ ID NO: 544049 - DNA, 25 bp, Rattus norvegicus
gatccgttattcgtcgccggggtca

SEQ ID NO: 544050 - DNA, 25 bp, Rattus norvegicus
gcagcaccgaaggaagcacctacca

SEQ ID NO: 544051 - DNA, 25 bp, Rattus norvegicus
ggtggcggggatgtcttcatcccta

SEQ ID NO: 544052 - DNA, 25 bp, Rattus norvegicus
accaccgcggacactcggaggaagg

SEQ ID NO: 544053 - DNA, 25 bp, Rattus norvegicus
ggatgtcttcatccctatgccggcc

SEQ ID NO: 544054 - DNA, 25 bp, Rattus norvegicus
cttcatccctatgccggccaccagg

SEQ ID NO: 544055 - DNA, 25 bp, Rattus norvegicus
ccaccagggatgaggccggtggccg

SEQ ID NO: 544056 - DNA, 25 bp, Rattus norvegicus
gtggccgcagcaccgaaggaagcac

SEQ ID NO: 544057 - DNA, 25 bp, Rattus norvegicus
ggtcgacgagcagcccggaactccg

SEQ ID NO: 544058 - DNA, 25 bp, Rattus norvegicus
acactcggaggaaggggtcgacgag

SEQ ID NO: 544059 - DNA, 25 bp, Rattus norvegicus
gccgcagcaccgaaggaagcaccta

SEQ ID NO: 544060 - DNA, 25 bp, Rattus norvegicus
gctgcagcacgtgggaggggaccac

SEQ ID NO: 544061 - DNA, 25 bp, Rattus norvegicus
gaagcacctaccaccaccgccaggc

SEQ ID NO: 544062 - DNA, 25 bp, Rattus norvegicus
ggaccaccgcggacactcggaggaa

SEQ ID NO: 544063 - DNA, 25 bp, Rattus norvegicus
acttccaccacggtgcccaccgcgg

SEQ ID NO: 544064 - DNA, 25 bp, Rattus norvegicus
cgcagcagcggtacttttgaaaaga

SEQ ID NO: 544065 - DNA, 25 bp, Rattus norvegicus
ccagcttcataaggtgtctgcgcga

SEQ ID NO: 544066 - DNA, 25 bp, Rattus norvegicus
gccgcgccagcttcataaggtgtct

SEQ ID NO: 544067 - DNA, 25 bp, Rattus norvegicus
tccggctgccgcctctccctgcggc

SEQ ID NO: 544068 - DNA, 25 bp, Rattus norvegicus
tgtcgcccgcgctcccgactcacac

SEQ ID NO: 544069 - DNA, 25 bp, Rattus norvegicus
gcgggcccacgcgacatctgtcgcc

SEQ ID NO: 544070 - DNA, 25 bp, Rattus norvegicus
aagcgacagttctcttcgccagagc

SEQ ID NO: 544071 - DNA, 25 bp, Rattus norvegicus
acttttgaaaagaagagcggagagg

SEQ ID NO: 544072 - DNA, 25 bp, Rattus norvegicus
gggattccgcagcagcggtactttt

SEQ ID NO: 544073 - DNA, 25 bp, Rattus norvegicus
ttcataaggtgtctgcgcgaccgcg

SEQ ID NO: 544074 - DNA, 25 bp, Rattus norvegicus
agttctcttcgccagagcccgggct

SEQ ID NO: 544075 - DNA, 25 bp, Rattus norvegicus
cacggcgcacggaagcgacagttct

SEQ ID NO: 544076 - DNA, 25 bp, Rattus norvegicus
cgcgcatgggacctccctgggcgca

SEQ ID NO: 544077 - DNA, 25 bp, Rattus norvegicus
gcgcacggaagcgacagttctcttc

SEQ ID NO: 544078 - DNA, 25 bp, Rattus norvegicus
gtgctgacggcgctattattaatta

SEQ ID NO: 544079 - DNA, 25 bp, Rattus norvegicus
cttcgaggacgctggcccagggcgt

SEQ ID NO: 544080 - DNA, 25 bp, Rattus norvegicus
ttaaccctcgagacgccggcagggc

SEQ ID NO: 544081 - DNA, 25 bp, Rattus norvegicus
cttttaaccctcgagacgccggcag

SEQ ID NO: 544082 - DNA, 25 bp, Rattus norvegicus
gagtgtgtgcaggagaaaaagccga

SEQ ID NO: 544083 - DNA, 25 bp, Rattus norvegicus
aattaaagtgtcacatggtggaggg

SEQ ID NO: 544084 - DNA, 25 bp, Rattus norvegicus
gctgacggcgctattattaattaaa

SEQ ID NO: 544085 - DNA, 25 bp, Rattus norvegicus
gtttgttgtgctgacggcgctatta

SEQ ID NO: 544086 - DNA, 25 bp, Rattus norvegicus
cacatggcgtgcggaggagcctccc

SEQ ID NO: 544087 - DNA, 25 bp, Rattus norvegicus
cgcgatgccggggacacgggcacat

SEQ ID NO: 544088 - DNA, 25 bp, Rattus norvegicus
agcgtcgccgcaaccgcacacggcc

SEQ ID NO: 544089 - DNA, 25 bp, Rattus norvegicus
gcctcatggcgcgtcggtgcagctc

SEQ ID NO: 544090 - DNA, 25 bp, Rattus norvegicus
ccgcgcacagccatggccagcgggc

SEQ ID NO: 544091 - DNA, 25 bp, Rattus norvegicus
cggcgctattattaattaaagtgtc

SEQ ID NO: 544092 - DNA, 25 bp, Rattus norvegicus
gaattggcgcactcgcaggtgctga

SEQ ID NO: 544093 - DNA, 25 bp, Rattus norvegicus
agcccgagccgctggtggaccagct

SEQ ID NO: 544094 - DNA, 25 bp, Rattus norvegicus
taagagccgcggttccggaagtctc

SEQ ID NO: 544095 - DNA, 25 bp, Rattus norvegicus
ccggaagtctccagccgactacgga

SEQ ID NO: 544096 - DNA, 25 bp, Rattus norvegicus
cgactacggacacttccggcggatg

SEQ ID NO: 544097 - DNA, 25 bp, Rattus norvegicus
acttccggcggatggacagtccgtc

SEQ ID NO: 544098 - DNA, 25 bp, Rattus norvegicus
tggacagtccgtccacagctggctg

SEQ ID NO: 544099 - DNA, 25 bp, Rattus norvegicus
gcggcaagcatggaggaccataacc

SEQ ID NO: 544100 - DNA, 25 bp, Rattus norvegicus
tccgccagcgctggcaggaggaatt

SEQ ID NO: 544101 - DNA, 25 bp, Rattus norvegicus
tggctgcccggaacctaagagccgc

SEQ ID NO: 544102 - DNA, 25 bp, Rattus norvegicus
ccggaccgacaggaaggatgtgtcc

SEQ ID NO: 544103 - DNA, 25 bp, Rattus norvegicus
aaggatgtgtccagccgttcgcgct

SEQ ID NO: 544104 - DNA, 25 bp, Rattus norvegicus
agccgctggtggaccagctcatccg

SEQ ID NO: 544105 - DNA, 25 bp, Rattus norvegicus
accataacctggaggagttccgcca

SEQ ID NO: 544106 - DNA, 25 bp, Rattus norvegicus
ctcccattcctcagaggaggcaaac

SEQ ID NO: 544107 - DNA, 25 bp, Rattus norvegicus
gtatggtactcacaaccggtcttgc

SEQ ID NO: 544108 - DNA, 25 bp, Rattus norvegicus
aaggtgcccagccaccgtatggtac

SEQ ID NO: 544109 - DNA, 25 bp, Rattus norvegicus
cccatctgaagcagccggagaaaga

SEQ ID NO: 544110 - DNA, 25 bp, Rattus norvegicus
ctggcgggaacccatctgaagcagc

SEQ ID NO: 544111 - DNA, 25 bp, Rattus norvegicus
agagtcttgggtcatgtcgcctccc

SEQ ID NO: 544112 - DNA, 25 bp, Rattus norvegicus
agccgcagacttgcgggtgcaccgc

SEQ ID NO: 544113 - DNA, 25 bp, Rattus norvegicus
cgtcgcttccgagcccagggtcaag

SEQ ID NO: 544114 - DNA, 25 bp, Rattus norvegicus
ctggcagaactaacaaccggctctg

SEQ ID NO: 544115 - DNA, 25 bp, Rattus norvegicus
ggaggcaaactgagaccagaactga

SEQ ID NO: 544116 - DNA, 25 bp, Rattus norvegicus
ccggggtctttcaactcagcagcaa

SEQ ID NO: 544117 - DNA, 25 bp, Rattus norvegicus
tctgtccggccaccgaagcaagctg

SEQ ID NO: 544118 - DNA, 25 bp, Rattus norvegicus
agaccagaactgacgggcccaaggt

SEQ ID NO: 544119 - DNA, 25 bp, Rattus norvegicus
tctgggcagagtgcccaagcctgca

SEQ ID NO: 544120 - DNA, 25 bp, Rattus norvegicus
cttttcggtcttgactatcccggcg

SEQ ID NO: 544121 - DNA, 25 bp, Rattus norvegicus
ggaatgctcacctcacccggaactg

SEQ ID NO: 544122 - DNA, 25 bp, Rattus norvegicus
cctggcagttgcaccaggcagctgg

SEQ ID NO: 544123 - DNA, 25 bp, Rattus norvegicus
catcttgtccgcgtacctgaggggc

SEQ ID NO: 544124 - DNA, 25 bp, Rattus norvegicus
taggagcctaagaagccacgccacg

SEQ ID NO: 544125 - DNA, 25 bp, Rattus norvegicus
cacttgtcctggagctttgggaaga

SEQ ID NO: 544126 - DNA, 25 bp, Rattus norvegicus
gcggagatggtcttttcggtcttga

SEQ ID NO: 544127 - DNA, 25 bp, Rattus norvegicus
aggatgtactccagcacctcgcctg

SEQ ID NO: 544128 - DNA, 25 bp, Rattus norvegicus
acacgcggccgatgtcgagcgccgt

SEQ ID NO: 544129 - DNA, 25 bp, Rattus norvegicus
gatgccggcatcctaacgaaccagg

SEQ ID NO: 544130 - DNA, 25 bp, Rattus norvegicus
cgtaaacatcctgcaccgagtgggc

SEQ ID NO: 544131 - DNA, 25 bp, Rattus norvegicus
taacgaaccaggaatgcacgcaacg

SEQ ID NO: 544132 - DNA, 25 bp, Rattus norvegicus
tgggccacaaaagatgcgcgtcctc

SEQ ID NO: 544133 - DNA, 25 bp, Rattus norvegicus
tgcacgcaacgctgcctgcacgtaa

SEQ ID NO: 544134 - DNA, 25 bp, Rattus norvegicus
gcgctgtggctcaactcgactgaac

SEQ ID NO: 544135 - DNA, 25 bp, Rattus norvegicus
aactcgactgaacggcccgactcag

SEQ ID NO: 544136 - DNA, 25 bp, Rattus norvegicus
cccgactcagtcgatgggtagtgga

SEQ ID NO: 544137 - DNA, 25 bp, Rattus norvegicus
tggaagtcgataagtacctcttgga

SEQ ID NO: 544138 - DNA, 25 bp, Rattus norvegicus
ccacgatcagagtgtgcagggccgt

SEQ ID NO: 544139 - DNA, 25 bp, Rattus norvegicus
ccacctctggggtgccaattgccag

SEQ ID NO: 544140 - DNA, 25 bp, Rattus norvegicus
acctcttggaggttgaggctcttga

SEQ ID NO: 544141 - DNA, 25 bp, Rattus norvegicus
gcgcttctctttgctggttgacaca

SEQ ID NO: 544142 - DNA, 25 bp, Rattus norvegicus
aggctcttgagaatggccacgatca

SEQ ID NO: 544143 - DNA, 25 bp, Rattus norvegicus
tgtgcagggccgtaaagttcactgc

SEQ ID NO: 544144 - DNA, 25 bp, Rattus norvegicus
gtaaagttcactgcgcccacctctg

SEQ ID NO: 544145 - DNA, 25 bp, Rattus norvegicus
caattgccaggtcggctagctcccg

SEQ ID NO: 544146 - DNA, 25 bp, Rattus norvegicus
cggagggagaccctgttagccaaca

SEQ ID NO: 544147 - DNA, 25 bp, Rattus norvegicus
ttagccaacaacgacggcggcatcg

SEQ ID NO: 544148 - DNA, 25 bp, Rattus norvegicus
gaattagtggtgacgtccaaccggc

SEQ ID NO: 544149 - DNA, 25 bp, Rattus norvegicus
tccaaccggctggtttatgggcgtg

SEQ ID NO: 544150 - DNA, 25 bp, Rattus norvegicus
tatcaccgctgaaacgaattagtgg

SEQ ID NO: 544151 - DNA, 25 bp, Rattus norvegicus
gacatgggataccttcgggtccagg

SEQ ID NO: 544152 - DNA, 25 bp, Rattus norvegicus
tcgggtccagggctaagaactcacc

SEQ ID NO: 544153 - DNA, 25 bp, Rattus norvegicus
tgtggatcccgctgatcaccctgtc

SEQ ID NO: 544154 - DNA, 25 bp, Rattus norvegicus
cgggctccaacagcgccacagggta

SEQ ID NO: 544155 - DNA, 25 bp, Rattus norvegicus
cgccacagggtaggagcttccagag

SEQ ID NO: 544156 - DNA, 25 bp, Rattus norvegicus
ccaagttcaggactggaggctgcca

SEQ ID NO: 544157 - DNA, 25 bp, Rattus norvegicus
tcaatatgcaggaaccgcgcagcga

SEQ ID NO: 544158 - DNA, 25 bp, Rattus norvegicus
tctctgtgctaagtagccgctcgca

SEQ ID NO: 544159 - DNA, 25 bp, Rattus norvegicus
gccaggccgccaaggagagagccaa

SEQ ID NO: 544160 - DNA, 25 bp, Rattus norvegicus
cgcaccctgcggctgcatcaatatg

SEQ ID NO: 544161 - DNA, 25 bp, Rattus norvegicus
atgtccctgctttatcctatcaccg

SEQ ID NO: 544162 - DNA, 25 bp, Rattus norvegicus
ggtcggctggcttttatgtcaaaaa

SEQ ID NO: 544163 - DNA, 25 bp, Rattus norvegicus
tataaatctatttggtcggctggct

SEQ ID NO: 544164 - DNA, 25 bp, Rattus norvegicus
cgtgaagggcggaattatatgtata

SEQ ID NO: 544165 - DNA, 25 bp, Rattus norvegicus
ttcgcacaccggctccgtgaagggc

SEQ ID NO: 544166 - DNA, 25 bp, Rattus norvegicus
tttatgtcaaaaaggagcgcgcctg

SEQ ID NO: 544167 - DNA, 25 bp, Rattus norvegicus
ctcccggtcgcggtgacacggcatg

SEQ ID NO: 544168 - DNA, 25 bp, Rattus norvegicus
tgacacggcatggtccgcgggtccc

SEQ ID NO: 544169 - DNA, 25 bp, Rattus norvegicus
ctctcgggatgctgtgcgcaaggct

SEQ ID NO: 544170 - DNA, 25 bp, Rattus norvegicus
acaccgacatcttgcctgtcaatca

SEQ ID NO: 544171 - DNA, 25 bp, Rattus norvegicus
tcttgcctgtcaatcacagggcggg

SEQ ID NO: 544172 - DNA, 25 bp, Rattus norvegicus
atctcgcgagacgaggcccgagcgc

SEQ ID NO: 544173 - DNA, 25 bp, Rattus norvegicus
agcaggtgcgcgctcgcctcgctgt

SEQ ID NO: 544174 - DNA, 25 bp, Rattus norvegicus
ctctgtgcaccgttcctggctttgc

SEQ ID NO: 544175 - DNA, 25 bp, Rattus norvegicus
gcctcgctgtactctgtgcaccgtt

SEQ ID NO: 544176 - DNA, 25 bp, Rattus norvegicus
gaacctgccctggtaggagcggccc

SEQ ID NO: 544177 - DNA, 25 bp, Rattus norvegicus
tttgcgcgcggactccgagtccagt

SEQ ID NO: 544178 - DNA, 25 bp, Rattus norvegicus
gttcggtggccggtccctgcagcat

SEQ ID NO: 544179 - DNA, 25 bp, Rattus norvegicus
cggtccctgcagcatctgtcagtca

SEQ ID NO: 544180 - DNA, 25 bp, Rattus norvegicus
tccctgcagcatctgtcagtcatgg

SEQ ID NO: 544181 - DNA, 25 bp, Rattus norvegicus
tgcagcatctgtcagtcatggcggc

SEQ ID NO: 544182 - DNA, 25 bp, Rattus norvegicus
cgcgcggactccgagtccagtggtt

SEQ ID NO: 544183 - DNA, 25 bp, Rattus norvegicus
atctgtcagtcatggcggcggcgcc

SEQ ID NO: 544184 - DNA, 25 bp, Rattus norvegicus
ctcccttcttcctaggagctttgca

SEQ ID NO: 544185 - DNA, 25 bp, Rattus norvegicus
cccttcttcctaggagctttgcatg

SEQ ID NO: 544186 - DNA, 25 bp, Rattus norvegicus
tcttcctaggagctttgcatgtccc

SEQ ID NO: 544187 - DNA, 25 bp, Rattus norvegicus
ggccggatacctagcctttgcgccg

SEQ ID NO: 544188 - DNA, 25 bp, Rattus norvegicus
gatacctagcctttgcgccgcaagc

SEQ ID NO: 544189 - DNA, 25 bp, Rattus norvegicus
agcatctgtcagtcatggcggcggc

SEQ ID NO: 544190 - DNA, 25 bp, Rattus norvegicus
aacgccggactgatgggactcggag

SEQ ID NO: 544191 - DNA, 25 bp, Rattus norvegicus
aaacggtgcagaggggacacgaagc

SEQ ID NO: 544192 - DNA, 25 bp, Rattus norvegicus
ccgagccgaggagaagtgatgctga

SEQ ID NO: 544193 - DNA, 25 bp, Rattus norvegicus
ctgcttcccgtcacatggtggccgg

SEQ ID NO: 544194 - DNA, 25 bp, Rattus norvegicus
catcagctgcttcccgtcacatggt

SEQ ID NO: 544195 - DNA, 25 bp, Rattus norvegicus
agaggccatcagctgcttcccgtca

SEQ ID NO: 544196 - DNA, 25 bp, Rattus norvegicus
acctccggcctccatgaggacgcgc

SEQ ID NO: 544197 - DNA, 25 bp, Rattus norvegicus
agtgaaacaaagctgcgctcccgcc

SEQ ID NO: 544198 - DNA, 25 bp, Rattus norvegicus
cgaaagtgaaacaaagctgcgctcc

SEQ ID NO: 544199 - DNA, 25 bp, Rattus norvegicus
gctgctgtcagcgaaagtgaaacaa

SEQ ID NO: 544200 - DNA, 25 bp, Rattus norvegicus
ccggcggacgctgctgtcagcgaaa

SEQ ID NO: 544201 - DNA, 25 bp, Rattus norvegicus
cgtcctcccagtgggcttggggaat

SEQ ID NO: 544202 - DNA, 25 bp, Rattus norvegicus
cggcaatgccgcagacgaccagggc

SEQ ID NO: 544203 - DNA, 25 bp, Rattus norvegicus
ctgaggccaggagcccggcaatgcc

SEQ ID NO: 544204 - DNA, 25 bp, Rattus norvegicus
ggcggaggaattacgcgatccatcc

SEQ ID NO: 544205 - DNA, 25 bp, Rattus norvegicus
atccatcctggtagcgcgaacgctg

SEQ ID NO: 544206 - DNA, 25 bp, Rattus norvegicus
gcgaacgctgcagccttttaaacaa

SEQ ID NO: 544207 - DNA, 25 bp, Rattus norvegicus
ctaaatgagcggctggcggttttcc

SEQ ID NO: 544208 - DNA, 25 bp, Rattus norvegicus
gcggttttccagatggccaacgtga

SEQ ID NO: 544209 - DNA, 25 bp, Rattus norvegicus
ggagcccgcgcggataaaccaaggc

SEQ ID NO: 544210 - DNA, 25 bp, Rattus norvegicus
ccttgctttggaggagaggacaatc

SEQ ID NO: 544211 - DNA, 25 bp, Rattus norvegicus
aatccagcacaagacgaatgctctc

SEQ ID NO: 544212 - DNA, 25 bp, Rattus norvegicus
gacgaatgctctccctcggcttgga

SEQ ID NO: 544213 - DNA, 25 bp, Rattus norvegicus
tctccctcggcttggaaatcatgcg

SEQ ID NO: 544214 - DNA, 25 bp, Rattus norvegicus
aatcatgcgggtcaagtgccttgtc

SEQ ID NO: 544215 - DNA, 25 bp, Rattus norvegicus
agtgccttgtcacgcattaacagcc

SEQ ID NO: 544216 - DNA, 25 bp, Rattus norvegicus
acagccttttaagttgctaggcaga

SEQ ID NO: 544217 - DNA, 25 bp, Rattus norvegicus
ttgctaggcagatcgagaggagccc

SEQ ID NO: 544218 - DNA, 25 bp, Rattus norvegicus
agaccacacgggaagagcgagtttc

SEQ ID NO: 544219 - DNA, 25 bp, Rattus norvegicus
tcgggttctcgaatgaacttgggtc

SEQ ID NO: 544220 - DNA, 25 bp, Rattus norvegicus
agggaaagatgatcccgcgaccgtc

SEQ ID NO: 544221 - DNA, 25 bp, Rattus norvegicus
ccatcgctcagagcccagggaaaga

SEQ ID NO: 544222 - DNA, 25 bp, Rattus norvegicus
cttgtcatctgagttctcgggtgca

SEQ ID NO: 544223 - DNA, 25 bp, Rattus norvegicus
ctgcggctctatcgcgcttgtcatc

SEQ ID NO: 544224 - DNA, 25 bp, Rattus norvegicus
ttgtgcaacgatcccagtcccgcgg

SEQ ID NO: 544225 - DNA, 25 bp, Rattus norvegicus
ctggcggaaaacaacaggcgctgcc

SEQ ID NO: 544226 - DNA, 25 bp, Rattus norvegicus
atctactcccgggaaagcgcggagc

SEQ ID NO: 544227 - DNA, 25 bp, Rattus norvegicus
agcaggacgcgcaatccggccatca

SEQ ID NO: 544228 - DNA, 25 bp, Rattus norvegicus
aagtcaggtcccttacctgcggagc

SEQ ID NO: 544229 - DNA, 25 bp, Rattus norvegicus
cacagagctagcaacgaatgggata

SEQ ID NO: 544230 - DNA, 25 bp, Rattus norvegicus
cgggcaaagccagaacacagagcta

SEQ ID NO: 544231 - DNA, 25 bp, Rattus norvegicus
gagacgaacacaaaccgtagctttc

SEQ ID NO: 544232 - DNA, 25 bp, Rattus norvegicus
tgaccgtggcgctcggaccgcctag

SEQ ID NO: 544233 - DNA, 25 bp, Rattus norvegicus
gaagcttcgcagtgaccgtggcgct

SEQ ID NO: 544234 - DNA, 25 bp, Rattus norvegicus
tggcgtgagtcaactgcgcaatcgc

SEQ ID NO: 544235 - DNA, 25 bp, Rattus norvegicus
tgacgcccacccaggtacggtgtgg

SEQ ID NO: 544236 - DNA, 25 bp, Rattus norvegicus
gcaaagtgctgacgcccacccaggt

SEQ ID NO: 544237 - DNA, 25 bp, Rattus norvegicus
ctgtcactacaggaggtggatgagc

SEQ ID NO: 544238 - DNA, 25 bp, Rattus norvegicus
ccgggccgctgtcactacaggaggt

SEQ ID NO: 544239 - DNA, 25 bp, Rattus norvegicus
tggccgccgacatcagccagtgggc

SEQ ID NO: 544240 - DNA, 25 bp, Rattus norvegicus
gtcatggccgccgacatcagccagt

SEQ ID NO: 544241 - DNA, 25 bp, Rattus norvegicus
tctgttctctccatcgtcatggccg

SEQ ID NO: 544242 - DNA, 25 bp, Rattus norvegicus
cgtgtgtctgttctctccatcgtca

SEQ ID NO: 544243 - DNA, 25 bp, Rattus norvegicus
gcgtttaactgcactcgggactcgg

SEQ ID NO: 544244 - DNA, 25 bp, Rattus norvegicus
tgcgcaatcgccctgcgtttaactg

SEQ ID NO: 544245 - DNA, 25 bp, Rattus norvegicus
cctagctccggctcagccaatcaga

SEQ ID NO: 544246 - DNA, 25 bp, Rattus norvegicus
aagctctctgcacttgggttacggg

SEQ ID NO: 544247 - DNA, 25 bp, Rattus norvegicus
tcagccttgtttgtgctgcgccagg

SEQ ID NO: 544248 - DNA, 25 bp, Rattus norvegicus
tcttgcctgagaaaccagagcggtc

SEQ ID NO: 544249 - DNA, 25 bp, Rattus norvegicus
ggatctcctcgctcactccagggta

SEQ ID NO: 544250 - DNA, 25 bp, Rattus norvegicus
gtggctattttcctcacgccttggc

SEQ ID NO: 544251 - DNA, 25 bp, Rattus norvegicus
ccagggtcaaagttcgtggctattt

SEQ ID NO: 544252 - DNA, 25 bp, Rattus norvegicus
acgccttggcttgtcttgggagacc

SEQ ID NO: 544253 - DNA, 25 bp, Rattus norvegicus
cggggctttctctatcgcggaagct

SEQ ID NO: 544254 - DNA, 25 bp, Rattus norvegicus
caggccgcatataggcgttcgatta

SEQ ID NO: 544255 - DNA, 25 bp, Rattus norvegicus
taggctctctactgaccttccctga

SEQ ID NO: 544256 - DNA, 25 bp, Rattus norvegicus
cagccatgctctgataggctctcta

SEQ ID NO: 544257 - DNA, 25 bp, Rattus norvegicus
ctctggcgcactggtagaaccgcta

SEQ ID NO: 544258 - DNA, 25 bp, Rattus norvegicus
aagtcgcctcgctaatcccattgct

SEQ ID NO: 544259 - DNA, 25 bp, Rattus norvegicus
actccagggtaggtcgcagtccctc

SEQ ID NO: 544260 - DNA, 25 bp, Rattus norvegicus
gggcagcctacgacccggaagtagc

SEQ ID NO: 544261 - DNA, 25 bp, Rattus norvegicus
gccactccctcgaggacggctggat

SEQ ID NO: 544262 - DNA, 25 bp, Rattus norvegicus
agagaacgtggagcccggcgtctcc

SEQ ID NO: 544263 - DNA, 25 bp, Rattus norvegicus
ctgctgtgtcagagaacgtggagcc

SEQ ID NO: 544264 - DNA, 25 bp, Rattus norvegicus
cagcgatgacgacgctgctgtgtca

SEQ ID NO: 544265 - DNA, 25 bp, Rattus norvegicus
tgaggattcataagacagcgatgac

SEQ ID NO: 544266 - DNA, 25 bp, Rattus norvegicus
cccgtggccgattgaggattcataa

SEQ ID NO: 544267 - DNA, 25 bp, Rattus norvegicus
ggctgcccatggatatgcctgaccc

SEQ ID NO: 544268 - DNA, 25 bp, Rattus norvegicus
ctgactgcgggcacggctgcccatg

SEQ ID NO: 544269 - DNA, 25 bp, Rattus norvegicus
gatcaggctgtcaccgggcagccta

SEQ ID NO: 544270 - DNA, 25 bp, Rattus norvegicus
tttagttttgactccaggcgccgcc

SEQ ID NO: 544271 - DNA, 25 bp, Rattus norvegicus
gtcgcatcgatacactttagttttg

SEQ ID NO: 544272 - DNA, 25 bp, Rattus norvegicus
cccatcaggtcgcatcgatacactt

SEQ ID NO: 544273 - DNA, 25 bp, Rattus norvegicus
aggacggctggatcaggctgtcacc

SEQ ID NO: 544274 - DNA, 25 bp, Rattus norvegicus
agcctcccttttcaacgtcacattg

SEQ ID NO: 544275 - DNA, 25 bp, Rattus norvegicus
gggaccttcaaagcagtggccactc

SEQ ID NO: 544276 - DNA, 25 bp, Rattus norvegicus
tgagaagttctggaaagggaccttc

SEQ ID NO: 544277 - DNA, 25 bp, Rattus norvegicus
gcagcaaggcgagaaacagctgttt

SEQ ID NO: 544278 - DNA, 25 bp, Rattus norvegicus
tcttgggctttcaggatggcgagcc

SEQ ID NO: 544279 - DNA, 25 bp, Rattus norvegicus
tggaatccacgtttcagcacttcgg

SEQ ID NO: 544280 - DNA, 25 bp, Rattus norvegicus
gcgtgtcatcgggtttggaatccac

SEQ ID NO: 544281 - DNA, 25 bp, Rattus norvegicus
tgcctagaccagagacgtcccattc

SEQ ID NO: 544282 - DNA, 25 bp, Rattus norvegicus
ggtggaccaccttctttctccgctg

SEQ ID NO: 544283 - DNA, 25 bp, Rattus norvegicus
agccaagaggtgaacccagccggtg

SEQ ID NO: 544284 - DNA, 25 bp, Rattus norvegicus
cgcagctcagaaccaagccaagagg

SEQ ID NO: 544285 - DNA, 25 bp, Rattus norvegicus
gcggtagagaaagccggcccagctt

SEQ ID NO: 544286 - DNA, 25 bp, Rattus norvegicus
ctctcggttctctgcgcggtagaga

SEQ ID NO: 544287 - DNA, 25 bp, Rattus norvegicus
cccgagagcatcatcgtcgccagta

SEQ ID NO: 544288 - DNA, 25 bp, Rattus norvegicus
ggagcttcctggtgcgttcttccac

SEQ ID NO: 544289 - DNA, 25 bp, Rattus norvegicus
gcgcagacgcacgatccggaatgtt

SEQ ID NO: 544290 - DNA, 25 bp, Rattus norvegicus
caaacgactactgcctgctggacgc

SEQ ID NO: 544291 - DNA, 25 bp, Rattus norvegicus
cacgtttgtccagagcttagctaca

SEQ ID NO: 544292 - DNA, 25 bp, Rattus norvegicus
aatcccgctgcgagagtgaaattct

SEQ ID NO: 544293 - DNA, 25 bp, Rattus norvegicus
ccttctcttggtgacaggagtgaga

SEQ ID NO: 544294 - DNA, 25 bp, Rattus norvegicus
ccagtctgaagggactctatcgccc

SEQ ID NO: 544295 - DNA, 25 bp, Rattus norvegicus
cctgaggggacccagatcccagata

SEQ ID NO: 544296 - DNA, 25 bp, Rattus norvegicus
cgcgactgtatcctcctagtggtgc

SEQ ID NO: 544297 - DNA, 25 bp, Rattus norvegicus
ctgggctggatcgtgactctcactt

SEQ ID NO: 544298 - DNA, 25 bp, Rattus norvegicus
ctctcactttactcgctgcgggctg

SEQ ID NO: 544299 - DNA, 25 bp, Rattus norvegicus
ggcgagagcagaaagtagcaccttc

SEQ ID NO: 544300 - DNA, 25 bp, Rattus norvegicus
ctaatctcactaagggcttgggttc

SEQ ID NO: 544301 - DNA, 25 bp, Rattus norvegicus
ggctggagcagaaccgggaatctaa

SEQ ID NO: 544302 - DNA, 25 bp, Rattus norvegicus
cacgaggcgttaagcgaaggccctc

SEQ ID NO: 544303 - DNA, 25 bp, Rattus norvegicus
tgagctacagctcagcagaaagcta

SEQ ID NO: 544304 - DNA, 25 bp, Rattus norvegicus
ccggagcctgagctacagctcagca

SEQ ID NO: 544305 - DNA, 25 bp, Rattus norvegicus
agccgcagtcggaaccggagcctga

SEQ ID NO: 544306 - DNA, 25 bp, Rattus norvegicus
accaggagcaggacgcggaccagcc

SEQ ID NO: 544307 - DNA, 25 bp, Rattus norvegicus
cgaagccagaccaggagcaggacgc

SEQ ID NO: 544308 - DNA, 25 bp, Rattus norvegicus
gcagcagccgaagccagaccaggag

SEQ ID NO: 544309 - DNA, 25 bp, Rattus norvegicus
cagtcggaaccgcagcagccgaagc

SEQ ID NO: 544310 - DNA, 25 bp, Rattus norvegicus
cggagtcccagtcggaaccgcagca

SEQ ID NO: 544311 - DNA, 25 bp, Rattus norvegicus
agccgcagttactcccggagccgga

SEQ ID NO: 544312 - DNA, 25 bp, Rattus norvegicus
tctgctagccgcagttactcccgga

SEQ ID NO: 544313 - DNA, 25 bp, Rattus norvegicus
aagcgaaggccctccgtcgagccag

SEQ ID NO: 544314 - DNA, 25 bp, Rattus norvegicus
ctcagcagaaagctatgccagcacg

SEQ ID NO: 544315 - DNA, 25 bp, Rattus norvegicus
ctatgccagcacgaggcgttaagcg

SEQ ID NO: 544316 - DNA, 25 bp, Rattus norvegicus
ctcttcggctgtctcgttccttttc

SEQ ID NO: 544317 - DNA, 25 bp, Rattus norvegicus
tgacgtgggtgtgggctctctgcac

SEQ ID NO: 544318 - DNA, 25 bp, Rattus norvegicus
ggctgtctcgttccttttctgggca

SEQ ID NO: 544319 - DNA, 25 bp, Rattus norvegicus
tccttttctcttcggctgtctcgtt

SEQ ID NO: 544320 - DNA, 25 bp, Rattus norvegicus
ggacggctccttttctcttcggctg

SEQ ID NO: 544321 - DNA, 25 bp, Rattus norvegicus
tcgctagccaacgggacggctcctt

SEQ ID NO: 544322 - DNA, 25 bp, Rattus norvegicus
ctggcgagccaaccctcgctagcca

SEQ ID NO: 544323 - DNA, 25 bp, Rattus norvegicus
ctgtaaacatcaaacgccgtgggtg

SEQ ID NO: 544324 - DNA, 25 bp, Rattus norvegicus
caactgtaaacatcaaacgccgtgg

SEQ ID NO: 544325 - DNA, 25 bp, Rattus norvegicus
gtctctccgagtacaactgtaaaca

SEQ ID NO: 544326 - DNA, 25 bp, Rattus norvegicus
cttaaagtctctccgagtacaactg

SEQ ID NO: 544327 - DNA, 25 bp, Rattus norvegicus
tgcgaggcggtgtcttaaagtctct

SEQ ID NO: 544328 - DNA, 25 bp, Rattus norvegicus
tccttttctgggcaacgagctccct

SEQ ID NO: 544329 - DNA, 25 bp, Rattus norvegicus
gtaaacatcaaacgccgtgggtgtg

SEQ ID NO: 544330 - DNA, 25 bp, Rattus norvegicus
gaaaaacacacaggctgctatgccc

SEQ ID NO: 544331 - DNA, 25 bp, Rattus norvegicus
tacatacagtataaacaccactctc

SEQ ID NO: 544332 - DNA, 25 bp, Rattus norvegicus
tatgccccaacagcctgaggttttt

SEQ ID NO: 544333 - DNA, 25 bp, Rattus norvegicus
acacaggttgctatgccccaacagc

SEQ ID NO: 544334 - DNA, 25 bp, Rattus norvegicus
cacacagatgccacgcctcacaaga

SEQ ID NO: 544335 - DNA, 25 bp, Rattus norvegicus
tgctggaaaaacacacaggctgcta

SEQ ID NO: 544336 - DNA, 25 bp, Rattus norvegicus
gcttctgatgctggaaaaacacaca

SEQ ID NO: 544337 - DNA, 25 bp, Rattus norvegicus
acagcttgctctggagattcccatc

SEQ ID NO: 544338 - DNA, 25 bp, Rattus norvegicus
ggtttgttaaacagcttgctctgga

SEQ ID NO: 544339 - DNA, 25 bp, Rattus norvegicus
ctccgatatggatggtttgttaaac

SEQ ID NO: 544340 - DNA, 25 bp, Rattus norvegicus
ccgagctctccgatatggatggttt

SEQ ID NO: 544341 - DNA, 25 bp, Rattus norvegicus
actccgagctctccgatatggatgg

SEQ ID NO: 544342 - DNA, 25 bp, Rattus norvegicus
gattcccatctcctgcttctgatgc

SEQ ID NO: 544343 - DNA, 25 bp, Rattus norvegicus
acgcctcacaagactgccacgccca

SEQ ID NO: 544344 - DNA, 25 bp, Rattus norvegicus
gccgacatcttccacaccgaggaaa

SEQ ID NO: 544345 - DNA, 25 bp, Rattus norvegicus
agccgctgcggtccaagcaggtaaa

SEQ ID NO: 544346 - DNA, 25 bp, Rattus norvegicus
ggacgctcgcgccaagaacggaagc

SEQ ID NO: 544347 - DNA, 25 bp, Rattus norvegicus
tcaggaaactcgacctgggagcctc

SEQ ID NO: 544348 - DNA, 25 bp, Rattus norvegicus
gaagtgacatcacgctagcctccag

SEQ ID NO: 544349 - DNA, 25 bp, Rattus norvegicus
cccgaggagtgtcaggttacgctcc

SEQ ID NO: 544350 - DNA, 25 bp, Rattus norvegicus
tacgctcccgctcttgtcggagttc

SEQ ID NO: 544351 - DNA, 25 bp, Rattus norvegicus
ccgcagacacttcgccatgggcaat

SEQ ID NO: 544352 - DNA, 25 bp, Rattus norvegicus
catgggcaatacgagcagcgagcgc

SEQ ID NO: 544353 - DNA, 25 bp, Rattus norvegicus
caggctggccataagacgccgcgga

SEQ ID NO: 544354 - DNA, 25 bp, Rattus norvegicus
aggcccaagatcctgatggacagcc

SEQ ID NO: 544355 - DNA, 25 bp, Rattus norvegicus
accgaggaaatgaaggtgctgagtc

SEQ ID NO: 544356 - DNA, 25 bp, Rattus norvegicus
tcctgcctgccgtcaggaaactcga

SEQ ID NO: 544357 - DNA, 25 bp, Rattus norvegicus
accaaggatggggacaggcccaaga

SEQ ID NO: 544358 - DNA, 25 bp, Rattus norvegicus
agtctcccgccccagcgtttgaagg

SEQ ID NO: 544359 - DNA, 25 bp, Rattus norvegicus
ccgctatggccttgggtaggaaagt

SEQ ID NO: 544360 - DNA, 25 bp, Rattus norvegicus
ccttgggtaggaaagtggacatcga

SEQ ID NO: 544361 - DNA, 25 bp, Rattus norvegicus
cttgggtaggaaagtggacatcgat

SEQ ID NO: 544362 - DNA, 25 bp, Rattus norvegicus
gacatcgatgtggacggggccgacc

SEQ ID NO: 544363 - DNA, 25 bp, Rattus norvegicus
cccgagcctctccaaccccacaaca

SEQ ID NO: 544364 - DNA, 25 bp, Rattus norvegicus
acacacaaccgggactcacactccg

SEQ ID NO: 544365 - DNA, 25 bp, Rattus norvegicus
cccgctatggccttgggtaggaaag

SEQ ID NO: 544366 - DNA, 25 bp, Rattus norvegicus
aaccgggactcacactccgcagacc

SEQ ID NO: 544367 - DNA, 25 bp, Rattus norvegicus
cccagcgtttgaaggaaacgacgtg

SEQ ID NO: 544368 - DNA, 25 bp, Rattus norvegicus
ttgaaggaaacgacgtgggcaggtc

SEQ ID NO: 544369 - DNA, 25 bp, Rattus norvegicus
aggtctcggccgctcctaaaccaat

SEQ ID NO: 544370 - DNA, 25 bp, Rattus norvegicus
gtctcggccgctcctaaaccaatca

SEQ ID NO: 544371 - DNA, 25 bp, Rattus norvegicus
gtgggcaggtctcggccgctcctaa

SEQ ID NO: 544372 - DNA, 25 bp, Rattus norvegicus
atctgagggcccgaaacgccttcag

SEQ ID NO: 544373 - DNA, 25 bp, Rattus norvegicus
cagacacgtgatccggcatcaggca

SEQ ID NO: 544374 - DNA, 25 bp, Rattus norvegicus
tctggcatcagacacgtgatccggc

SEQ ID NO: 544375 - DNA, 25 bp, Rattus norvegicus
caggcacgtgatctggcatcagaca

SEQ ID NO: 544376 - DNA, 25 bp, Rattus norvegicus
aatgcgtgggctacagcggcatcag

SEQ ID NO: 544377 - DNA, 25 bp, Rattus norvegicus
ccatcaaaaaagaatgcgtgggcta

SEQ ID NO: 544378 - DNA, 25 bp, Rattus norvegicus
agcagacgacgtacaccatggagcc

SEQ ID NO: 544379 - DNA, 25 bp, Rattus norvegicus
aacgcagatccggtcggcaaaacct

SEQ ID NO: 544380 - DNA, 25 bp, Rattus norvegicus
acgacgtacaccatggagcccaata

SEQ ID NO: 544381 - DNA, 25 bp, Rattus norvegicus
gcccgaaacgccttcagctacagtg

SEQ ID NO: 544382 - DNA, 25 bp, Rattus norvegicus
gccttcagctacagtgggcttattc

SEQ ID NO: 544383 - DNA, 25 bp, Rattus norvegicus
tgggcttattcaccacaagaccgtc

SEQ ID NO: 544384 - DNA, 25 bp, Rattus norvegicus
ttattcaccacaagaccgtcggagc

SEQ ID NO: 544385 - DNA, 25 bp, Rattus norvegicus
tcaagaggaatgagcagacgacgta

SEQ ID NO: 544386 - DNA, 25 bp, Rattus norvegicus
gctgcgcggctaacgatgtcgagcc

SEQ ID NO: 544387 - DNA, 25 bp, Rattus norvegicus
agcagcaacagcgagcgtcgcagcg

SEQ ID NO: 544388 - DNA, 25 bp, Rattus norvegicus
cgagcttcagcacccgccgagccgg

SEQ ID NO: 544389 - DNA, 25 bp, Rattus norvegicus
caacagcgagcgtcgcagcgacatg

SEQ ID NO: 544390 - DNA, 25 bp, Rattus norvegicus
tcgcagcgacatgcggagcgcaacc

SEQ ID NO: 544391 - DNA, 25 bp, Rattus norvegicus
ggctaacgatgtcgagccgccgcct

SEQ ID NO: 544392 - DNA, 25 bp, Rattus norvegicus
cttaacgacgcgtgaggccacgtcg

SEQ ID NO: 544393 - DNA, 25 bp, Rattus norvegicus
atccgcttaacgacgcgtgaggcca

SEQ ID NO: 544394 - DNA, 25 bp, Rattus norvegicus
gcgcgcatccgcttaacgacgcgtg

SEQ ID NO: 544395 - DNA, 25 bp, Rattus norvegicus
cggcagcaacagggcggctgaaacc

SEQ ID NO: 544396 - DNA, 25 bp, Rattus norvegicus
ggccatgtccgccttttgcctgggc

SEQ ID NO: 544397 - DNA, 25 bp, Rattus norvegicus
atgtccgccttttgcctgggcttgg

SEQ ID NO: 544398 - DNA, 25 bp, Rattus norvegicus
cttttgcctgggcttggccggccga

SEQ ID NO: 544399 - DNA, 25 bp, Rattus norvegicus
tgccgccaagcctggggacatggag

SEQ ID NO: 544400 - DNA, 25 bp, Rattus norvegicus
acgccgtacgcagcgcggagtcagc

SEQ ID NO: 544401 - DNA, 25 bp, Rattus norvegicus
tccgtggggtgcaccctggtcgcct

SEQ ID NO: 544402 - DNA, 25 bp, Rattus norvegicus
ccagtacgagcggaagctcacctgc

SEQ ID NO: 544403 - DNA, 25 bp, Rattus norvegicus
gccgttacgccgtacgcagcgcgga

SEQ ID NO: 544404 - DNA, 25 bp, Rattus norvegicus
tagcggttccggattcggatccgtg

SEQ ID NO: 544405 - DNA, 25 bp, Rattus norvegicus
agcgagtgcggacgctacggccctc

SEQ ID NO: 544406 - DNA, 25 bp, Rattus norvegicus
caggcgcccgacctcctggcggaac

SEQ ID NO: 544407 - DNA, 25 bp, Rattus norvegicus
cgcctccgagcaccacgactccagg

SEQ ID NO: 544408 - DNA, 25 bp, Rattus norvegicus
cgctacggccctcgggagaaccgag

SEQ ID NO: 544409 - DNA, 25 bp, Rattus norvegicus
ctcgggagaaccgagccgtttagca

SEQ ID NO: 544410 - DNA, 25 bp, Rattus norvegicus
accgagccgtttagcaggcctgatg

SEQ ID NO: 544411 - DNA, 25 bp, Rattus norvegicus
ttagcaggcctgatggaagagagac

SEQ ID NO: 544412 - DNA, 25 bp, Rattus norvegicus
gattcggatccgtggggtgcaccct

SEQ ID NO: 544413 - DNA, 25 bp, Rattus norvegicus
agcactgggcggaactcgcctccga

SEQ ID NO: 544414 - DNA, 25 bp, Rattus norvegicus
ctgtggctgagacgcttcatagctt

SEQ ID NO: 544415 - DNA, 25 bp, Rattus norvegicus
aaccaagggcactgtgagcccggtc

SEQ ID NO: 544416 - DNA, 25 bp, Rattus norvegicus
cactcactggctgtggctgagacgc

SEQ ID NO: 544417 - DNA, 25 bp, Rattus norvegicus
agacgcttcatagcttaaaccaagg

SEQ ID NO: 544418 - DNA, 25 bp, Rattus norvegicus
catagcttaaaccaagggcactgtg

SEQ ID NO: 544419 - DNA, 25 bp, Rattus norvegicus
cagcaccgaacgatggggcaagaca

SEQ ID NO: 544420 - DNA, 25 bp, Rattus norvegicus
acgatggggcaagacagacagactg

SEQ ID NO: 544421 - DNA, 25 bp, Rattus norvegicus
cccggctcaccttctttggaaggca

SEQ ID NO: 544422 - DNA, 25 bp, Rattus norvegicus
tcaccttctttggaaggcagaagcc

SEQ ID NO: 544423 - DNA, 25 bp, Rattus norvegicus
ttctttggaaggcagaagcccggca

SEQ ID NO: 544424 - DNA, 25 bp, Rattus norvegicus
tggaaggcagaagcccggcacatgc

SEQ ID NO: 544425 - DNA, 25 bp, Rattus norvegicus
cgccacagagcagcaccgaacgatg

SEQ ID NO: 544426 - DNA, 25 bp, Rattus norvegicus
ccgaccactcactggctgtggctga

SEQ ID NO: 544427 - DNA, 25 bp, Rattus norvegicus
cctcggcactcgttgcctatgtagc

SEQ ID NO: 544428 - DNA, 25 bp, Rattus norvegicus
gcccagcccgaagtacttctgagtt

SEQ ID NO: 544429 - DNA, 25 bp, Rattus norvegicus
ggcaagcgcaggaaacctcttaatg

SEQ ID NO: 544430 - DNA, 25 bp, Rattus norvegicus
gtcccgaagcttctgctcccagatg

SEQ ID NO: 544431 - DNA, 25 bp, Rattus norvegicus
ttactcagtgatgcgcttggccagc

SEQ ID NO: 544432 - DNA, 25 bp, Rattus norvegicus
ctcggccgccatctcggaaaagggc

SEQ ID NO: 544433 - DNA, 25 bp, Rattus norvegicus
cctgtccggacaggtgcgtcattga

SEQ ID NO: 544434 - DNA, 25 bp, Rattus norvegicus
gactcgcgtgctcgcttcgttttga

SEQ ID NO: 544435 - DNA, 25 bp, Rattus norvegicus
tcccaggacaggcatttttaagttc

SEQ ID NO: 544436 - DNA, 25 bp, Rattus norvegicus
tcttggaggtacacacacgtttagt

SEQ ID NO: 544437 - DNA, 25 bp, Rattus norvegicus
gacgtcttcaaactgactgccagga

SEQ ID NO: 544438 - DNA, 25 bp, Rattus norvegicus
agcctcgcgcctctatgatgaacaa

SEQ ID NO: 544439 - DNA, 25 bp, Rattus norvegicus
ttgcgcaggctggtatttatttata

SEQ ID NO: 544440 - DNA, 25 bp, Rattus norvegicus
atcgtccgtctcgatagggtcggcc

SEQ ID NO: 544441 - DNA, 25 bp, Rattus norvegicus
ccggaaatggcgatggtcagacaca

SEQ ID NO: 544442 - DNA, 25 bp, Rattus norvegicus
agagcgccagctgccctgaggccaa

SEQ ID NO: 544443 - DNA, 25 bp, Rattus norvegicus
ctctggagaaccgtggcagattccg

SEQ ID NO: 544444 - DNA, 25 bp, Rattus norvegicus
ttccgagtggaagctctgcaaccgc

SEQ ID NO: 544445 - DNA, 25 bp, Rattus norvegicus
tggaagctctgcaaccgccgggacc

SEQ ID NO: 544446 - DNA, 25 bp, Rattus norvegicus
gctggctgtcctcagcccggcatcc

SEQ ID NO: 544447 - DNA, 25 bp, Rattus norvegicus
ggacccgaacacacccagcagagcg

SEQ ID NO: 544448 - DNA, 25 bp, Rattus norvegicus
tgccctgaggccaagcggatggcaa

SEQ ID NO: 544449 - DNA, 25 bp, Rattus norvegicus
aggccaagcggatggcaagatcctc

SEQ ID NO: 544450 - DNA, 25 bp, Rattus norvegicus
tggcaagatcctcgagcccagggtc

SEQ ID NO: 544451 - DNA, 25 bp, Rattus norvegicus
accgtggcagattccgagtggaagc

SEQ ID NO: 544452 - DNA, 25 bp, Rattus norvegicus
cgctccgagcctcgagcggtgacga

SEQ ID NO: 544453 - DNA, 25 bp, Rattus norvegicus
ttcctccaggcaccgcgtgctttca

SEQ ID NO: 544454 - DNA, 25 bp, Rattus norvegicus
gcatcctcggcgattcccggtccag

SEQ ID NO: 544455 - DNA, 25 bp, Rattus norvegicus
gatcctcgagcccagggtcgctctg

SEQ ID NO: 544456 - DNA, 25 bp, Rattus norvegicus
agttggacttccaggtcgccctgtc

SEQ ID NO: 544457 - DNA, 25 bp, Rattus norvegicus
ttttataggagaaccaggaggcctc

SEQ ID NO: 544458 - DNA, 25 bp, Rattus norvegicus
cagcgtaagccaggtaagtccgaca

SEQ ID NO: 544459 - DNA, 25 bp, Rattus norvegicus
agcaccgatccgaggcctaggccta

SEQ ID NO: 544460 - DNA, 25 bp, Rattus norvegicus
ggtgcggtcaccagtgccttttata

SEQ ID NO: 544461 - DNA, 25 bp, Rattus norvegicus
ccaggaggcctcgtaaactaggacg

SEQ ID NO: 544462 - DNA, 25 bp, Rattus norvegicus
taggacgacgtccatgcctattggc

SEQ ID NO: 544463 - DNA, 25 bp, Rattus norvegicus
tgcctattggctggcgccatcaacc

SEQ ID NO: 544464 - DNA, 25 bp, Rattus norvegicus
gtcccgcctcactagttaatctacg

SEQ ID NO: 544465 - DNA, 25 bp, Rattus norvegicus
gctgccactccgacaagtgggtaaa

SEQ ID NO: 544466 - DNA, 25 bp, Rattus norvegicus
gccctgcagcgtcgccaaatcagta

SEQ ID NO: 544467 - DNA, 25 bp, Rattus norvegicus
cgcggggtttaaagacgatgtcact

SEQ ID NO: 544468 - DNA, 25 bp, Rattus norvegicus
ccgctccgcacttacgatgatctta

SEQ ID NO: 544469 - DNA, 25 bp, Rattus norvegicus
cgccaatagcgcaagccggtgagct

SEQ ID NO: 544470 - DNA, 25 bp, Rattus norvegicus
gctcgtggtagtgcacctcacaata

SEQ ID NO: 544471 - DNA, 25 bp, Rattus norvegicus
ctcacaatatggctgcccgtcgtgc

SEQ ID NO: 544472 - DNA, 25 bp, Rattus norvegicus
acttcttggccatggcggtgatgca

SEQ ID NO: 544473 - DNA, 25 bp, Rattus norvegicus
aatgacctgccaaaggaccgtcgtc

SEQ ID NO: 544474 - DNA, 25 bp, Rattus norvegicus
accgtgtcaccctcgtaatggagga

SEQ ID NO: 544475 - DNA, 25 bp, Rattus norvegicus
cacacgaaatgctcggggtggaact

SEQ ID NO: 544476 - DNA, 25 bp, Rattus norvegicus
ccgtcgtcaccctcgtaatggagga

SEQ ID NO: 544477 - DNA, 25 bp, Rattus norvegicus
atgacctgcctttgctcaccgtttc

SEQ ID NO: 544478 - DNA, 25 bp, Rattus norvegicus
tcataatggaggactgtcacccttg

SEQ ID NO: 544479 - DNA, 25 bp, Rattus norvegicus
cgtcgtgctcgaagaagctgccatt

SEQ ID NO: 544480 - DNA, 25 bp, Rattus norvegicus
ctgccattgacgaagggtgtgaagc

SEQ ID NO: 544481 - DNA, 25 bp, Rattus norvegicus
ggtgtgaagcactcctgccagcaga

SEQ ID NO: 544482 - DNA, 25 bp, Rattus norvegicus
ggcgatgctcaaaggaccgtgtcac

SEQ ID NO: 544483 - DNA, 25 bp, Rattus norvegicus
tcacccttgtaatggaggaccgtca

SEQ ID NO: 544484 - DNA, 25 bp, Rattus norvegicus
gaaccgctgagttcggcttgaccga

SEQ ID NO: 544485 - DNA, 25 bp, Rattus norvegicus
agttcggcttgaccgaccttcaggc

SEQ ID NO: 544486 - DNA, 25 bp, Rattus norvegicus
tctccgggccatgaaccgctgagtt

SEQ ID NO: 544487 - DNA, 25 bp, Rattus norvegicus
gctagaggtttctccgggccatgaa

SEQ ID NO: 544488 - DNA, 25 bp, Rattus norvegicus
ggctgagtgtgctagaggtttctcc

SEQ ID NO: 544489 - DNA, 25 bp, Rattus norvegicus
gagcacgcccaatcccgcggtggag

SEQ ID NO: 544490 - DNA, 25 bp, Rattus norvegicus
caacttttccgcgtccagcctcggc

SEQ ID NO: 544491 - DNA, 25 bp, Rattus norvegicus
cgtccatggctggtcctcagacgtc

SEQ ID NO: 544492 - DNA, 25 bp, Rattus norvegicus
cactcaccgaggtcgtccatggctg

SEQ ID NO: 544493 - DNA, 25 bp, Rattus norvegicus
cagcttagagcgagcggcccgcaca

SEQ ID NO: 544494 - DNA, 25 bp, Rattus norvegicus
tctcaggcgccgcagcttagagcga

SEQ ID NO: 544495 - DNA, 25 bp, Rattus norvegicus
cccagtatgagatcggagtctcagg

SEQ ID NO: 544496 - DNA, 25 bp, Rattus norvegicus
aggtgagtccctgaaccccagtatg

SEQ ID NO: 544497 - DNA, 25 bp, Rattus norvegicus
atggctggtcctcagacgtcggccc

SEQ ID NO: 544498 - DNA, 25 bp, Rattus norvegicus
tcagtgtgaccctgacgctgcgttg

SEQ ID NO: 544499 - DNA, 25 bp, Rattus norvegicus
agccaacgtcatcgcgatggcccgg

SEQ ID NO: 544500 - DNA, 25 bp, Rattus norvegicus
ggctccatctcagtcacctgcgtgg

SEQ ID NO: 544501 - DNA, 25 bp, Rattus norvegicus
gccagaaagggatgaaatgagatgt

SEQ ID NO: 544502 - DNA, 25 bp, Rattus norvegicus
cattagaggagcgtgtcagtgtgac

SEQ ID NO: 544503 - DNA, 25 bp, Rattus norvegicus
tcatcacagtcacggtgagctcctg

SEQ ID NO: 544504 - DNA, 25 bp, Rattus norvegicus
ctcttatgcaaatcgagccaacgtc

SEQ ID NO: 544505 - DNA, 25 bp, Rattus norvegicus
acggtgagctcctgtccacgcgcga

SEQ ID NO: 544506 - DNA, 25 bp, Rattus norvegicus
cagggctgacaaccttcatcacagt

SEQ ID NO: 544507 - DNA, 25 bp, Rattus norvegicus
gggatgctggggactcttatgcaaa

SEQ ID NO: 544508 - DNA, 25 bp, Rattus norvegicus
aggctcctgcccgtgggctatctag

SEQ ID NO: 544509 - DNA, 25 bp, Rattus norvegicus
tatctagcgcccgaacgtccgtggt

SEQ ID NO: 544510 - DNA, 25 bp, Rattus norvegicus
acgtccgtggtttccagacaacgcg

SEQ ID NO: 544511 - DNA, 25 bp, Rattus norvegicus
tggtttccagacaacgcggcagccg

SEQ ID NO: 544512 - DNA, 25 bp, Rattus norvegicus
agccatggcggctgaccattgttcc

SEQ ID NO: 544513 - DNA, 25 bp, Rattus norvegicus
tcggtgctcagacacaaagacaccc

SEQ ID NO: 544514 - DNA, 25 bp, Rattus norvegicus
ggctctaatgctcggtgctcagaca

SEQ ID NO: 544515 - DNA, 25 bp, Rattus norvegicus
ctggatcagattagtgcgggctcta

SEQ ID NO: 544516 - DNA, 25 bp, Rattus norvegicus
tcacagctgctggatcagattagtg

SEQ ID NO: 544517 - DNA, 25 bp, Rattus norvegicus
ggcggcctccaatcacagctgctgg

SEQ ID NO: 544518 - DNA, 25 bp, Rattus norvegicus
ctgacggcttctcctggggcccggt

SEQ ID NO: 544519 - DNA, 25 bp, Rattus norvegicus
cccgaacaaaagacgcggccgctga

SEQ ID NO: 544520 - DNA, 25 bp, Rattus norvegicus
gccaacgccgatttaggcccgaaca

SEQ ID NO: 544521 - DNA, 25 bp, Rattus norvegicus
cctgctgaccagtgggagccgccaa

SEQ ID NO: 544522 - DNA, 25 bp, Rattus norvegicus
cggggcccttggcattcccggctgt

SEQ ID NO: 544523 - DNA, 25 bp, Rattus norvegicus
gctaagcctgagtggcagccatggc

SEQ ID NO: 544524 - DNA, 25 bp, Rattus norvegicus
agccgccaagttcggcggcggctaa

SEQ ID NO: 544525 - DNA, 25 bp, Rattus norvegicus
ggccggtttcacatgccaacgccga

SEQ ID NO: 544526 - DNA, 25 bp, Rattus norvegicus
cccgagggccgctagatttacagca

SEQ ID NO: 544527 - DNA, 25 bp, Rattus norvegicus
ggccgctagatttacagcatctaca

SEQ ID NO: 544528 - DNA, 25 bp, Rattus norvegicus
gcgcaagattattttcttcccggaa

SEQ ID NO: 544529 - DNA, 25 bp, Rattus norvegicus
tactccggtatccagccatcagggg

SEQ ID NO: 544530 - DNA, 25 bp, Rattus norvegicus
cagccatcaggggatgagaagcagc

SEQ ID NO: 544531 - DNA, 25 bp, Rattus norvegicus
ggagatcgtcgtggttatagttcta

SEQ ID NO: 544532 - DNA, 25 bp, Rattus norvegicus
cgtggttatagttctaatgtagttc

SEQ ID NO: 544533 - DNA, 25 bp, Rattus norvegicus
aatgtagttctcgaagtcgcttccg

SEQ ID NO: 544534 - DNA, 25 bp, Rattus norvegicus
ttacagcatctacagctgaggagga

SEQ ID NO: 544535 - DNA, 25 bp, Rattus norvegicus
aggttaggatgcgtctctattgatc

SEQ ID NO: 544536 - DNA, 25 bp, Rattus norvegicus
ctctattgatctggcgatcgtccta

SEQ ID NO: 544537 - DNA, 25 bp, Rattus norvegicus
ggcgatcgtcctactccggtatcca

SEQ ID NO: 544538 - DNA, 25 bp, Rattus norvegicus
caaagttaacggatgcggcggagcc

SEQ ID NO: 544539 - DNA, 25 bp, Rattus norvegicus
gtggagctagcgcaagattattttc

SEQ ID NO: 544540 - DNA, 25 bp, Rattus norvegicus
tcgtgccgagattgcgccagcactt

SEQ ID NO: 544541 - DNA, 25 bp, Rattus norvegicus
actcacctggatcttttggtcaggg

SEQ ID NO: 544542 - DNA, 25 bp, Rattus norvegicus
actgttttggagtcgagctcgtgcc

SEQ ID NO: 544543 - DNA, 25 bp, Rattus norvegicus
cccgagggccactcactgttttgga

SEQ ID NO: 544544 - DNA, 25 bp, Rattus norvegicus
agtattcgcgcagcccttctgtaac

SEQ ID NO: 544545 - DNA, 25 bp, Rattus norvegicus
ggggtcccgcatcaccagacactct

SEQ ID NO: 544546 - DNA, 25 bp, Rattus norvegicus
ttccgggactcacctggatcttttg

SEQ ID NO: 544547 - DNA, 25 bp, Rattus norvegicus
caggagaggtttccgggactcacct

SEQ ID NO: 544548 - DNA, 25 bp, Rattus norvegicus
atggttacaaggacagcgagtggcc

SEQ ID NO: 544549 - DNA, 25 bp, Rattus norvegicus
agaggcagatggttacaaggacagc

SEQ ID NO: 544550 - DNA, 25 bp, Rattus norvegicus
catgaaagtgacgaagccgaaaccc

SEQ ID NO: 544551 - DNA, 25 bp, Rattus norvegicus
cccgcctggtccatgaaagtgacga

SEQ ID NO: 544552 - DNA, 25 bp, Rattus norvegicus
agattgcgccagcactttatccacc

SEQ ID NO: 544553 - DNA, 25 bp, Rattus norvegicus
cccgaactggccgaagtattcgcgc

SEQ ID NO: 544554 - DNA, 25 bp, Rattus norvegicus
tccctcggggttcctgtgtgtcgag

SEQ ID NO: 544555 - DNA, 25 bp, Rattus norvegicus
ttcaaggtagctcggctttggatcg

SEQ ID NO: 544556 - DNA, 25 bp, Rattus norvegicus
gcgttcaaggtagctcggctttgga

SEQ ID NO: 544557 - DNA, 25 bp, Rattus norvegicus
ctccctcggggttcctgtgtgtcga

SEQ ID NO: 544558 - DNA, 25 bp, Rattus norvegicus
cagccgcgcggataaagcccggcga

SEQ ID NO: 544559 - DNA, 25 bp, Rattus norvegicus
ccctgattcctggtacggggctcgg

SEQ ID NO: 544560 - DNA, 25 bp, Rattus norvegicus
gctgggaacgccctcccgggatgaa

SEQ ID NO: 544561 - DNA, 25 bp, Rattus norvegicus
tgggaacgccctcccgggatgaagc

SEQ ID NO: 544562 - DNA, 25 bp, Rattus norvegicus
ctcccgggatgaagcgcttcccggt

SEQ ID NO: 544563 - DNA, 25 bp, Rattus norvegicus
gcttcccggtgcgttcaaggtagct

SEQ ID NO: 544564 - DNA, 25 bp, Rattus norvegicus
ttcccggtgcgttcaaggtagctcg

SEQ ID NO: 544565 - DNA, 25 bp, Rattus norvegicus
ccggtgcgttcaaggtagctcggct

SEQ ID NO: 544566 - DNA, 25 bp, Rattus norvegicus
ggtgcgttcaaggtagctcggcttt

SEQ ID NO: 544567 - DNA, 25 bp, Rattus norvegicus
cgcgcggataaagcccggcgagcgc

SEQ ID NO: 544568 - DNA, 25 bp, Rattus norvegicus
caggcccgagacagccgcacaaaga

SEQ ID NO: 544569 - DNA, 25 bp, Rattus norvegicus
tggggactcggcctattctcattag

SEQ ID NO: 544570 - DNA, 25 bp, Rattus norvegicus
ctcctttgtggctcggacaacggga

SEQ ID NO: 544571 - DNA, 25 bp, Rattus norvegicus
atccctctcctttgtggctcggaca

SEQ ID NO: 544572 - DNA, 25 bp, Rattus norvegicus
tcgcattgatccctctcctttgtgg

SEQ ID NO: 544573 - DNA, 25 bp, Rattus norvegicus
agacagccgcacaaagaggaggccc

SEQ ID NO: 544574 - DNA, 25 bp, Rattus norvegicus
gcggcgcaaacaggcccgagacagc

SEQ ID NO: 544575 - DNA, 25 bp, Rattus norvegicus
ccacatgcctgatcaatgggggcgc

SEQ ID NO: 544576 - DNA, 25 bp, Rattus norvegicus
cccgggaggcggaatctttccacat

SEQ ID NO: 544577 - DNA, 25 bp, Rattus norvegicus
gcaacgcggccacaaagggagcccg

SEQ ID NO: 544578 - DNA, 25 bp, Rattus norvegicus
cgcttactaaatccggcgatcgcca

SEQ ID NO: 544579 - DNA, 25 bp, Rattus norvegicus
gcagcctggcaacgcggccacaaag

SEQ ID NO: 544580 - DNA, 25 bp, Rattus norvegicus
ctattctcattaggggcgaaggccc

SEQ ID NO: 544581 - DNA, 25 bp, Rattus norvegicus
gggcctcctcgattttcgcttacta

SEQ ID NO: 544582 - DNA, 25 bp, Rattus norvegicus
gctgagtgatccagaggctgcatct

SEQ ID NO: 544583 - DNA, 25 bp, Rattus norvegicus
ccgtggcgaagttgagcaaaaagtt

SEQ ID NO: 544584 - DNA, 25 bp, Rattus norvegicus
tcaaccttggttccacccggagaga

SEQ ID NO: 544585 - DNA, 25 bp, Rattus norvegicus
gggtgcacaattctgtccagggatc

SEQ ID NO: 544586 - DNA, 25 bp, Rattus norvegicus
ttcctgagttgctcctccagcgtcg

SEQ ID NO: 544587 - DNA, 25 bp, Rattus norvegicus
agggtcctcagccagcgcagaacca

SEQ ID NO: 544588 - DNA, 25 bp, Rattus norvegicus
agactgcttcagactcggcggctga

SEQ ID NO: 544589 - DNA, 25 bp, Rattus norvegicus
ctttctcctgaaaggcgtgccagac

SEQ ID NO: 544590 - DNA, 25 bp, Rattus norvegicus
ctccacctttggaggttgctgacaa

SEQ ID NO: 544591 - DNA, 25 bp, Rattus norvegicus
gtgcccgaagcccactcggattctg

SEQ ID NO: 544592 - DNA, 25 bp, Rattus norvegicus
caggcctccatagtgttctctgggg

SEQ ID NO: 544593 - DNA, 25 bp, Rattus norvegicus
ttgccctgtccacactgctgggttc

SEQ ID NO: 544594 - DNA, 25 bp, Rattus norvegicus
gcctgtgcattttcacgcggagttc

SEQ ID NO: 544595 - DNA, 25 bp, Rattus norvegicus
gaccagtgcttcagttgtccctccg

SEQ ID NO: 544596 - DNA, 25 bp, Rattus norvegicus
gagagacccgagttcgtcgcctacc

SEQ ID NO: 544597 - DNA, 25 bp, Rattus norvegicus
tgtgcgcaggcgctacaattcctgg

SEQ ID NO: 544598 - DNA, 25 bp, Rattus norvegicus
attcctggccagtgagaaggcgttg

SEQ ID NO: 544599 - DNA, 25 bp, Rattus norvegicus
aggcgttgcccaatgaaacttcgtt

SEQ ID NO: 544600 - DNA, 25 bp, Rattus norvegicus
gaaacttcgtttggcgtctctgtcc

SEQ ID NO: 544601 - DNA, 25 bp, Rattus norvegicus
gcggccgaggctgacattctggccc

SEQ ID NO: 544602 - DNA, 25 bp, Rattus norvegicus
ccgctgcagctcgtatttggaaggc

SEQ ID NO: 544603 - DNA, 25 bp, Rattus norvegicus
ttggaaggccctcacctacttcgtg

SEQ ID NO: 544604 - DNA, 25 bp, Rattus norvegicus
aggactaaggtacgcgctgcgcctc

SEQ ID NO: 544605 - DNA, 25 bp, Rattus norvegicus
ttttcctgaagtcgcgacacgaaga

SEQ ID NO: 544606 - DNA, 25 bp, Rattus norvegicus
ccatctccgcatcaggactaaggta

SEQ ID NO: 544607 - DNA, 25 bp, Rattus norvegicus
tgcgcctctgctgtccttcaagcgt

SEQ ID NO: 544608 - DNA, 25 bp, Rattus norvegicus
tttggaccaggaccgaaaatgtgcg

SEQ ID NO: 544609 - DNA, 25 bp, Rattus norvegicus
gtgagcatgctcaacgttttcctga

SEQ ID NO: 544610 - DNA, 25 bp, Rattus norvegicus
tttgcttccaaagtgggtccacgcg

SEQ ID NO: 544611 - DNA, 25 bp, Rattus norvegicus
agcggcgacacccaagcaatttcgg

SEQ ID NO: 544612 - DNA, 25 bp, Rattus norvegicus
ggcgaagctcacctggacacactgt

SEQ ID NO: 544613 - DNA, 25 bp, Rattus norvegicus
catcccagtgtatcaagcggcgaca

SEQ ID NO: 544614 - DNA, 25 bp, Rattus norvegicus
cactggtgaacttcagcagccgcga

SEQ ID NO: 544615 - DNA, 25 bp, Rattus norvegicus
tcggttctggaggacaggtaagctc

SEQ ID NO: 544616 - DNA, 25 bp, Rattus norvegicus
tgcaatttcgggctcctctggaccg

SEQ ID NO: 544617 - DNA, 25 bp, Rattus norvegicus
caccgtttgtcgctacggaggccga

SEQ ID NO: 544618 - DNA, 25 bp, Rattus norvegicus
actctaatgtcgtcacgcgcgcgca

SEQ ID NO: 544619 - DNA, 25 bp, Rattus norvegicus
tgcagtgacggcgacgcactctaat

SEQ ID NO: 544620 - DNA, 25 bp, Rattus norvegicus
cgtactcgcgcttcatgtcagtgca

SEQ ID NO: 544621 - DNA, 25 bp, Rattus norvegicus
agcggttaaagcattggtcgtactc

SEQ ID NO: 544622 - DNA, 25 bp, Rattus norvegicus
ccgagccgtctcctttgagaaactt

SEQ ID NO: 544623 - DNA, 25 bp, Rattus norvegicus
acacactgttggtagcgtttgaaga

SEQ ID NO: 544624 - DNA, 25 bp, Rattus norvegicus
cttgtaaaacagatcctcgaggtcc

SEQ ID NO: 544625 - DNA, 25 bp, Rattus norvegicus
gtcggaggactttaaagctatctta

SEQ ID NO: 544626 - DNA, 25 bp, Rattus norvegicus
gggcgcttctccttagggcgccttc

SEQ ID NO: 544627 - DNA, 25 bp, Rattus norvegicus
cgcaagggccagtctcccaaggggt

SEQ ID NO: 544628 - DNA, 25 bp, Rattus norvegicus
ttacagccgccaaaggcaaccagtc

SEQ ID NO: 544629 - DNA, 25 bp, Rattus norvegicus
aggttgcccacgtagatgcgcccgt

SEQ ID NO: 544630 - DNA, 25 bp, Rattus norvegicus
ccttaggccgagtcctctgcagggc

SEQ ID NO: 544631 - DNA, 25 bp, Rattus norvegicus
ctcagccgcactgcactgtgggagc

SEQ ID NO: 544632 - DNA, 25 bp, Rattus norvegicus
tcggggccctctaatgaaggaagtg

SEQ ID NO: 544633 - DNA, 25 bp, Rattus norvegicus
ccgtgccggttcttgagctcaatct

SEQ ID NO: 544634 - DNA, 25 bp, Rattus norvegicus
ttgagctcaatctcgcggatgcgac

SEQ ID NO: 544635 - DNA, 25 bp, Rattus norvegicus
cggatgcgaccgtacttgtaaaaca

SEQ ID NO: 544636 - DNA, 25 bp, Rattus norvegicus
gtccttctcacgcacgtcggtcgga

SEQ ID NO: 544637 - DNA, 25 bp, Rattus norvegicus
gtggacgaatgtcgccttaggccga

SEQ ID NO: 544638 - DNA, 25 bp, Rattus norvegicus
ggcggctcctggtcttctagaacct

SEQ ID NO: 544639 - DNA, 25 bp, Rattus norvegicus
tccacggaccaatagggagaggcct

SEQ ID NO: 544640 - DNA, 25 bp, Rattus norvegicus
gacccggcacggcatagttccttct

SEQ ID NO: 544641 - DNA, 25 bp, Rattus norvegicus
cccatatcaagaaggtgaggacccg

SEQ ID NO: 544642 - DNA, 25 bp, Rattus norvegicus
actcaggcgttggagaagtacaaca

SEQ ID NO: 544643 - DNA, 25 bp, Rattus norvegicus
gcctcgggagctgtgcctcaaaagc

SEQ ID NO: 544644 - DNA, 25 bp, Rattus norvegicus
ctccacggtgagaccgggctcgagt

SEQ ID NO: 544645 - DNA, 25 bp, Rattus norvegicus
cgattccagaacacacccagggcta

SEQ ID NO: 544646 - DNA, 25 bp, Rattus norvegicus
acaaaatgcgggagaaagatcctga

SEQ ID NO: 544647 - DNA, 25 bp, Rattus norvegicus
cgcggtgcattgtggtctgcaacaa

SEQ ID NO: 544648 - DNA, 25 bp, Rattus norvegicus
agccttctagactgctgggtggtcc

SEQ ID NO: 544649 - DNA, 25 bp, Rattus norvegicus
gctaacctcagtgggccctagcgga

SEQ ID NO: 544650 - DNA, 25 bp, Rattus norvegicus
gtcttctagaacctgcgattccaga

SEQ ID NO: 544651 - DNA, 25 bp, Rattus norvegicus
tcctgagggaaccattgaatccacg

SEQ ID NO: 544652 - DNA, 25 bp, Rattus norvegicus
gggagcctgcagtctcctgctaatc

SEQ ID NO: 544653 - DNA, 25 bp, Rattus norvegicus
gtcaccagccgagtgacggctgccg

SEQ ID NO: 544654 - DNA, 25 bp, Rattus norvegicus
agaacgtcgggttgcgtcaccagcc

SEQ ID NO: 544655 - DNA, 25 bp, Rattus norvegicus
ccatcttgatatcccggcgacggtg

SEQ ID NO: 544656 - DNA, 25 bp, Rattus norvegicus
tccatagaacacagctcctgggcgc

SEQ ID NO: 544657 - DNA, 25 bp, Rattus norvegicus
tgcagtctcctgctaatcgcgacca

SEQ ID NO: 544658 - DNA, 25 bp, Rattus norvegicus
ccagccaagatctacgaaacccggg

SEQ ID NO: 544659 - DNA, 25 bp, Rattus norvegicus
acaaggaccgcgcactcagcgtggc

SEQ ID NO: 544660 - DNA, 25 bp, Rattus norvegicus
gctcgcttctcttgggacaaggacc

SEQ ID NO: 544661 - DNA, 25 bp, Rattus norvegicus
acccgaagtgagtttccgcggctcg

SEQ ID NO: 544662 - DNA, 25 bp, Rattus norvegicus
gacaccgtctcaaacccgaagtgag

SEQ ID NO: 544663 - DNA, 25 bp, Rattus norvegicus
acggctgccggcaggagacacatta

SEQ ID NO: 544664 - DNA, 25 bp, Rattus norvegicus
agacacattagtgggacgcagtcta

SEQ ID NO: 544665 - DNA, 25 bp, Rattus norvegicus
ccgtggccgcagtagctccatagaa

SEQ ID NO: 544666 - DNA, 25 bp, Rattus norvegicus
tccatccgggttcttggagatgctg

SEQ ID NO: 544667 - DNA, 25 bp, Rattus norvegicus
cccggatgtaggtgaaaactacaca

SEQ ID NO: 544668 - DNA, 25 bp, Rattus norvegicus
ttggcgactcgtcgccattcccgga

SEQ ID NO: 544669 - DNA, 25 bp, Rattus norvegicus
tgtcggtcgctgtgtcggagacccc

SEQ ID NO: 544670 - DNA, 25 bp, Rattus norvegicus
agcagctcggcctcggcccagaggc

SEQ ID NO: 544671 - DNA, 25 bp, Rattus norvegicus
tcttggagatgctgtttggcgactc

SEQ ID NO: 544672 - DNA, 25 bp, Rattus norvegicus
ctatataaatagtccatccgggttc

SEQ ID NO: 544673 - DNA, 25 bp, Rattus norvegicus
gcgtccacttggcaactatataaat

SEQ ID NO: 544674 - DNA, 25 bp, Rattus norvegicus
agaatgcatcgcgtccacttggcaa

SEQ ID NO: 544675 - DNA, 25 bp, Rattus norvegicus
gctaggacccggatgtaggtgaaaa

SEQ ID NO: 544676 - DNA, 25 bp, Rattus norvegicus
caggaacaagcggtacccggctagg

SEQ ID NO: 544677 - DNA, 25 bp, Rattus norvegicus
gcattggcaggaacaagcggtaccc

SEQ ID NO: 544678 - DNA, 25 bp, Rattus norvegicus
aggcaagagaggaaaagcattggca

SEQ ID NO: 544679 - DNA, 25 bp, Rattus norvegicus
gcatcgcgtccacttggcaactata

SEQ ID NO: 544680 - DNA, 25 bp, Rattus norvegicus
ggcgctgcttacctgtgcttgaacc

SEQ ID NO: 544681 - DNA, 25 bp, Rattus norvegicus
gtcccatcgcgtaaccggcattttc

SEQ ID NO: 544682 - DNA, 25 bp, Rattus norvegicus
tgctctgttctggactcgccgcact

SEQ ID NO: 544683 - DNA, 25 bp, Rattus norvegicus
gccgcactcttgcttttctagaacc

SEQ ID NO: 544684 - DNA, 25 bp, Rattus norvegicus
ttttctagaaccctccgctctcgta

SEQ ID NO: 544685 - DNA, 25 bp, Rattus norvegicus
cggacaccagctcgcacagaaggta

SEQ ID NO: 544686 - DNA, 25 bp, Rattus norvegicus
gggactaggctccaacaggccgaga

SEQ ID NO: 544687 - DNA, 25 bp, Rattus norvegicus
aggccgagagccctgtcaatctcca

SEQ ID NO: 544688 - DNA, 25 bp, Rattus norvegicus
cgctggggattttgcgctcaagttc

SEQ ID NO: 544689 - DNA, 25 bp, Rattus norvegicus
ttctgtgtgtactttgggtcgtcca

SEQ ID NO: 544690 - DNA, 25 bp, Rattus norvegicus
tttgggtcgtccagtgaacgtttgc

SEQ ID NO: 544691 - DNA, 25 bp, Rattus norvegicus
acgtttgcggacatccttgcactta

SEQ ID NO: 544692 - DNA, 25 bp, Rattus norvegicus
cttgcacttaaagcccgagagtgtc

SEQ ID NO: 544693 - DNA, 25 bp, Rattus norvegicus
gctctcgtacaaaacgcggcacatg

SEQ ID NO: 544694 - DNA, 25 bp, Rattus norvegicus
gaggtgtgacgtgtgcatcgccctc

SEQ ID NO: 544695 - DNA, 25 bp, Rattus norvegicus
cgatggcaaaccaaccaccgatctg

SEQ ID NO: 544696 - DNA, 25 bp, Rattus norvegicus
ccttacactgcgagggaggtgtgac

SEQ ID NO: 544697 - DNA, 25 bp, Rattus norvegicus
ccaccgatctgtatcttacacgaaa

SEQ ID NO: 544698 - DNA, 25 bp, Rattus norvegicus
tgtgcatcgccctcgagatgacaga

SEQ ID NO: 544699 - DNA, 25 bp, Rattus norvegicus
cctcgagatgacagacctcagaaca

SEQ ID NO: 544700 - DNA, 25 bp, Rattus norvegicus
cccggctagctgtctctgtgactgg

SEQ ID NO: 544701 - DNA, 25 bp, Rattus norvegicus
tctgtgactggctagcccgaatctc

SEQ ID NO: 544702 - DNA, 25 bp, Rattus norvegicus
ggctagcccgaatctctcctgtatt

SEQ ID NO: 544703 - DNA, 25 bp, Rattus norvegicus
atctctcctgtattcgcatcttcgc

SEQ ID NO: 544704 - DNA, 25 bp, Rattus norvegicus
tgtattcgcatcttcgcatcggccc

SEQ ID NO: 544705 - DNA, 25 bp, Rattus norvegicus
catcggccctcttcgctcccgatta

SEQ ID NO: 544706 - DNA, 25 bp, Rattus norvegicus
ttacacgaaaacatcccgctcctta

SEQ ID NO: 544707 - DNA, 25 bp, Rattus norvegicus
cgctccttacactgcgagggaggtg

SEQ ID NO: 544708 - DNA, 25 bp, Rattus norvegicus
ggctgtttgcaatcacccgggtccc

SEQ ID NO: 544709 - DNA, 25 bp, Rattus norvegicus
cggctcagcctctcccggtggtaat

SEQ ID NO: 544710 - DNA, 25 bp, Rattus norvegicus
cagcctctcccggtggtaattagcc

SEQ ID NO: 544711 - DNA, 25 bp, Rattus norvegicus
ggctccgccagcctctaattacagg

SEQ ID NO: 544712 - DNA, 25 bp, Rattus norvegicus
gcctctaattacaggtctcctaatg

SEQ ID NO: 544713 - DNA, 25 bp, Rattus norvegicus
gcggccgagcccattcttcacccac

SEQ ID NO: 544714 - DNA, 25 bp, Rattus norvegicus
aggccggcggctgtttgcaatcacc

SEQ ID NO: 544715 - DNA, 25 bp, Rattus norvegicus
cttagagaggcggacgcacgcacgc

SEQ ID NO: 544716 - DNA, 25 bp, Rattus norvegicus
caggcatgactcacacggggatgga

SEQ ID NO: 544717 - DNA, 25 bp, Rattus norvegicus
ctcacacggggatggagcctaatcc

SEQ ID NO: 544718 - DNA, 25 bp, Rattus norvegicus
acccagaggaagcacccggatccgg

SEQ ID NO: 544719 - DNA, 25 bp, Rattus norvegicus
cgagtggccgccacccagaggaagc

SEQ ID NO: 544720 - DNA, 25 bp, Rattus norvegicus
cctagtaaacaaacggcggcgagtg

SEQ ID NO: 544721 - DNA, 25 bp, Rattus norvegicus
tacaggtctcctaatgaggccggcg

SEQ ID NO: 544722 - DNA, 25 bp, Rattus norvegicus
ccaagagcgagtccaagacgtcgct

SEQ ID NO: 544723 - DNA, 25 bp, Rattus norvegicus
tcttcctgagctctgctcagccgag

SEQ ID NO: 544724 - DNA, 25 bp, Rattus norvegicus
gattcagcaccctgtgcgctgtcca

SEQ ID NO: 544725 - DNA, 25 bp, Rattus norvegicus
agccgagcctgcctcgcacctgcag

SEQ ID NO: 544726 - DNA, 25 bp, Rattus norvegicus
tgcaggagcgacctccgcaatcctc

SEQ ID NO: 544727 - DNA, 25 bp, Rattus norvegicus
ctggcctctggcgacccaaaggagc

SEQ ID NO: 544728 - DNA, 25 bp, Rattus norvegicus
gtgtctgattcagcaccctgtgcgc

SEQ ID NO: 544729 - DNA, 25 bp, Rattus norvegicus
gctccgccttcggtcaggtaagggc

SEQ ID NO: 544730 - DNA, 25 bp, Rattus norvegicus
attttccggggtcgtgagcagcgct

SEQ ID NO: 544731 - DNA, 25 bp, Rattus norvegicus
ctcagctccgccttcggtcaggtaa

SEQ ID NO: 544732 - DNA, 25 bp, Rattus norvegicus
ggacccgttcctccaccagctgcgc

SEQ ID NO: 544733 - DNA, 25 bp, Rattus norvegicus
ggctctcagtctacggggctccctg

SEQ ID NO: 544734 - DNA, 25 bp, Rattus norvegicus
cgactcgcctgcaacgtgcggggac

SEQ ID NO: 544735 - DNA, 25 bp, Rattus norvegicus
ccaagacgtcgctgctcaaggcggc

SEQ ID NO: 544736 - DNA, 25 bp, Rattus norvegicus
ccgaagtgcaccgagccgcggtaac

SEQ ID NO: 544737 - DNA, 25 bp, Rattus norvegicus
tgcagcatggacctccttcagcggt

SEQ ID NO: 544738 - DNA, 25 bp, Rattus norvegicus
catctgcccaacttcttcggtttta

SEQ ID NO: 544739 - DNA, 25 bp, Rattus norvegicus
tctttgttttggaagacccacagcc

SEQ ID NO: 544740 - DNA, 25 bp, Rattus norvegicus
ttccctccgggaagcacaatgcagc

SEQ ID NO: 544741 - DNA, 25 bp, Rattus norvegicus
gggctgtcagcaaaacgccgcacta

SEQ ID NO: 544742 - DNA, 25 bp, Rattus norvegicus
gccgcactagtgtaacgccgaacgc

SEQ ID NO: 544743 - DNA, 25 bp, Rattus norvegicus
tgaggccaacaccacagccgagcat

SEQ ID NO: 544744 - DNA, 25 bp, Rattus norvegicus
ggccttaccttggtctccttcacat

SEQ ID NO: 544745 - DNA, 25 bp, Rattus norvegicus
ggtaccactggacgcgcacgtagcc

SEQ ID NO: 544746 - DNA, 25 bp, Rattus norvegicus
atgaggcgcaccagcccgaagtgca

SEQ ID NO: 544747 - DNA, 25 bp, Rattus norvegicus
ccggacaccaggtcgtgagagaaca

SEQ ID NO: 544748 - DNA, 25 bp, Rattus norvegicus
gccataactgctctgcgcgagtctc

SEQ ID NO: 544749 - DNA, 25 bp, Rattus norvegicus
gagtccgagtcctcaccgtggatga

SEQ ID NO: 544750 - DNA, 25 bp, Rattus norvegicus
tccatgcagcgtgctctccctttca

SEQ ID NO: 544751 - DNA, 25 bp, Rattus norvegicus
tgtgaagcggaccagccacggagcc

SEQ ID NO: 544752 - DNA, 25 bp, Rattus norvegicus
tgaaaaccgggtgtgaagcggacca

SEQ ID NO: 544753 - DNA, 25 bp, Rattus norvegicus
tggacctcaatggagatggacgagt

SEQ ID NO: 544754 - DNA, 25 bp, Rattus norvegicus
tccgagacgtggacctcaatggaga

SEQ ID NO: 544755 - DNA, 25 bp, Rattus norvegicus
ggaaattatccgagacgtggacctc

SEQ ID NO: 544756 - DNA, 25 bp, Rattus norvegicus
tgggacaccgggacatagaggaaat

SEQ ID NO: 544757 - DNA, 25 bp, Rattus norvegicus
tttcacgctctccagtttgacacca

SEQ ID NO: 544758 - DNA, 25 bp, Rattus norvegicus
gctctccagtttgacaccaacggtg

SEQ ID NO: 544759 - DNA, 25 bp, Rattus norvegicus
caccaacggtgacggggagataagc

SEQ ID NO: 544760 - DNA, 25 bp, Rattus norvegicus
ctcctgggtcatcaggtgggacacc

SEQ ID NO: 544761 - DNA, 25 bp, Rattus norvegicus
agataagcacgagcgagctgcgaga

SEQ ID NO: 544762 - DNA, 25 bp, Rattus norvegicus
ctgcgagaggccatgaggaagctcc

SEQ ID NO: 544763 - DNA, 25 bp, Rattus norvegicus
acaccgggacatagaggaaattatc

SEQ ID NO: 544764 - DNA, 25 bp, Rattus norvegicus
tcagtgcgcccttctctaaatcttc

SEQ ID NO: 544765 - DNA, 25 bp, Rattus norvegicus
gactggctcctatgatccacacggg

SEQ ID NO: 544766 - DNA, 25 bp, Rattus norvegicus
ccacacggggacaagccactgtttc

SEQ ID NO: 544767 - DNA, 25 bp, Rattus norvegicus
ctgtacaaatggcatcccagggaga

SEQ ID NO: 544768 - DNA, 25 bp, Rattus norvegicus
tcgcgtcctgccacctgtacaaatg

SEQ ID NO: 544769 - DNA, 25 bp, Rattus norvegicus
cctgtgctcttgctttctgagggaa

SEQ ID NO: 544770 - DNA, 25 bp, Rattus norvegicus
cctttcctagtctgatgtgggattc

SEQ ID NO: 544771 - DNA, 25 bp, Rattus norvegicus
atggaaccgccgcttcaaccgaact

SEQ ID NO: 544772 - DNA, 25 bp, Rattus norvegicus
catagccaataggagggccgctcta

SEQ ID NO: 544773 - DNA, 25 bp, Rattus norvegicus
tgggtaattcatgagggccgcgccc

SEQ ID NO: 544774 - DNA, 25 bp, Rattus norvegicus
cccgagagcgtcatttgggcagtga

SEQ ID NO: 544775 - DNA, 25 bp, Rattus norvegicus
tgcacgggatccacttccgcaagga

SEQ ID NO: 544776 - DNA, 25 bp, Rattus norvegicus
ttcggagctgactgggtcccaagat

SEQ ID NO: 544777 - DNA, 25 bp, Rattus norvegicus
cccaagatctagagcaccggaagtg

SEQ ID NO: 544778 - DNA, 25 bp, Rattus norvegicus
cgcctcaaccgggtcaccgagagtg

SEQ ID NO: 544779 - DNA, 25 bp, Rattus norvegicus
tggcactggacacgatccgccctga

SEQ ID NO: 544780 - DNA, 25 bp, Rattus norvegicus
tcgtctctgggcctggtgcgaccct

SEQ ID NO: 544781 - DNA, 25 bp, Rattus norvegicus
tccgctcaggccgtgcttctgactg

SEQ ID NO: 544782 - DNA, 25 bp, Rattus norvegicus
aggccgtgcttctgactgccgggct

SEQ ID NO: 544783 - DNA, 25 bp, Rattus norvegicus
agacccggcgggcaaggcttctaga

SEQ ID NO: 544784 - DNA, 25 bp, Rattus norvegicus
aggggccgccacacacgtcggacga

SEQ ID NO: 544785 - DNA, 25 bp, Rattus norvegicus
cggcggcgtcctgaaccggcttaag

SEQ ID NO: 544786 - DNA, 25 bp, Rattus norvegicus
aggagctgctggcactggacacgat

SEQ ID NO: 544787 - DNA, 25 bp, Rattus norvegicus
atgagcgggtcgaacccgaaggcta

SEQ ID NO: 544788 - DNA, 25 bp, Rattus norvegicus
ctccatagttacggcgccctgaggt

SEQ ID NO: 544789 - DNA, 25 bp, Rattus norvegicus
caaggcttctagagttccgatcgtc

SEQ ID NO: 544790 - DNA, 25 bp, Rattus norvegicus
agagttccgatcgtctctgggcctg

SEQ ID NO: 544791 - DNA, 25 bp, Rattus norvegicus
gtcctgaaccggcttaaggcgcggc

SEQ ID NO: 544792 - DNA, 25 bp, Rattus norvegicus
atcgagcggcactacttccgggagc

SEQ ID NO: 544793 - DNA, 25 bp, Rattus norvegicus
tccggatgatcgagcggcactactt

SEQ ID NO: 544794 - DNA, 25 bp, Rattus norvegicus
gccggtgacaggcttccggatgatc

SEQ ID NO: 544795 - DNA, 25 bp, Rattus norvegicus
tagagttcaccgtgggcgacaggcc

SEQ ID NO: 544796 - DNA, 25 bp, Rattus norvegicus
ctcctacagggtagagttcaccgtg

SEQ ID NO: 544797 - DNA, 25 bp, Rattus norvegicus
agtctcacagggattctcctacagg

SEQ ID NO: 544798 - DNA, 25 bp, Rattus norvegicus
cgtaggaaatgaagtgagtctcaca

SEQ ID NO: 544799 - DNA, 25 bp, Rattus norvegicus
ggagcattccactcgctcgcaggga

SEQ ID NO: 544800 - DNA, 25 bp, Rattus norvegicus
ctgtttttctgaggcggagcattcc

SEQ ID NO: 544801 - DNA, 25 bp, Rattus norvegicus
tcggtgccacgtgagtgctgctgtt

SEQ ID NO: 544802 - DNA, 25 bp, Rattus norvegicus
gctatcagttcacgccagcgttcct

SEQ ID NO: 544803 - DNA, 25 bp, Rattus norvegicus
gcgtttcgtccgctatcagttcacg

SEQ ID NO: 544804 - DNA, 25 bp, Rattus norvegicus
tagacatcagcgtggggcgtttcgt

SEQ ID NO: 544805 - DNA, 25 bp, Rattus norvegicus
ctcgctcgcagggaagaggtgctct

SEQ ID NO: 544806 - DNA, 25 bp, Rattus norvegicus
cggagatcctgacggcgggtcctcc

SEQ ID NO: 544807 - DNA, 25 bp, Rattus norvegicus
gcgtggcccaggattggctctcgcc

SEQ ID NO: 544808 - DNA, 25 bp, Rattus norvegicus
cctgccatccggaactctagagctg

SEQ ID NO: 544809 - DNA, 25 bp, Rattus norvegicus
ccggaactctagagctgcttcagga

SEQ ID NO: 544810 - DNA, 25 bp, Rattus norvegicus
tctagagctgcttcaggaggtcccg

SEQ ID NO: 544811 - DNA, 25 bp, Rattus norvegicus
ctgcttcaggaggtcccggaggtct

SEQ ID NO: 544812 - DNA, 25 bp, Rattus norvegicus
aggtctgtgcccatggccatggccg

SEQ ID NO: 544813 - DNA, 25 bp, Rattus norvegicus
ctgcgcgcggcctttgtcctagttc

SEQ ID NO: 544814 - DNA, 25 bp, Rattus norvegicus
tggctctctcggcagaggtgagtac

SEQ ID NO: 544815 - DNA, 25 bp, Rattus norvegicus
ctcctatgactacgggcggacgagc

SEQ ID NO: 544816 - DNA, 25 bp, Rattus norvegicus
gagtacgcccgcagagcctcaggac

SEQ ID NO: 544817 - DNA, 25 bp, Rattus norvegicus
tgacggcgggtcctcctatgactac

SEQ ID NO: 544818 - DNA, 25 bp, Rattus norvegicus
ccctgcagcaagtgggcgtggccca

SEQ ID NO: 544819 - DNA, 25 bp, Rattus norvegicus
tctctcggcagaggtgagtacgccc

SEQ ID NO: 544820 - DNA, 25 bp, Rattus norvegicus
acgtgcccaaaacacgctcacgtga

SEQ ID NO: 544821 - DNA, 25 bp, Rattus norvegicus
cctccctcactacttgcaagttgtg

SEQ ID NO: 544822 - DNA, 25 bp, Rattus norvegicus
tgcaagttgtgcctcttaccacctg

SEQ ID NO: 544823 - DNA, 25 bp, Rattus norvegicus
cttaccacctgttctcgccagagtg

SEQ ID NO: 544824 - DNA, 25 bp, Rattus norvegicus
tgttctcgccagagtggggtacacc

SEQ ID NO: 544825 - DNA, 25 bp, Rattus norvegicus
aaagcccgcacttaccacgaatagg

SEQ ID NO: 544826 - DNA, 25 bp, Rattus norvegicus
tgcggctccaaacccaacatggcgg

SEQ ID NO: 544827 - DNA, 25 bp, Rattus norvegicus
ccagagtggggtacacctcagcccg

SEQ ID NO: 544828 - DNA, 25 bp, Rattus norvegicus
gcccatgcgcggagctctagctcag

SEQ ID NO: 544829 - DNA, 25 bp, Rattus norvegicus
gagctctagctcagcccgggctgga

SEQ ID NO: 544830 - DNA, 25 bp, Rattus norvegicus
tacggttagcggtcgctgtgtgata

SEQ ID NO: 544831 - DNA, 25 bp, Rattus norvegicus
ttagcggtcgctgtgtgataggccc

SEQ ID NO: 544832 - DNA, 25 bp, Rattus norvegicus
ggtctgctccgccatggtgctgcct

SEQ ID NO: 544833 - DNA, 25 bp, Rattus norvegicus
ccacgaataggtctgctccgccatg

SEQ ID NO: 544834 - DNA, 25 bp, Rattus norvegicus
ggctgcgggtctctccgcttcccgc

SEQ ID NO: 544835 - DNA, 25 bp, Rattus norvegicus
cggcaccgcgccaactcctcggcat

SEQ ID NO: 544836 - DNA, 25 bp, Rattus norvegicus
atcttggtagccgcaaagggttgtg

SEQ ID NO: 544837 - DNA, 25 bp, Rattus norvegicus
ctaccatcttggtagccgcaaaggg

SEQ ID NO: 544838 - DNA, 25 bp, Rattus norvegicus
tcaggacgccgtggtccgcacccca

SEQ ID NO: 544839 - DNA, 25 bp, Rattus norvegicus
tggcaccgctgggtgctaccatctt

SEQ ID NO: 544840 - DNA, 25 bp, Rattus norvegicus
ctcatggcaccgctgggtgctacca

SEQ ID NO: 544841 - DNA, 25 bp, Rattus norvegicus
tcgctcatggcaccgctgggtgcta

SEQ ID NO: 544842 - DNA, 25 bp, Rattus norvegicus
gcgttgccgcctcgcggcaccgcgc

SEQ ID NO: 544843 - DNA, 25 bp, Rattus norvegicus
tccgagtcgctcatggcaccgctgg

SEQ ID NO: 544844 - DNA, 25 bp, Rattus norvegicus
gctgctctccgagtcgctcatggca

SEQ ID NO: 544845 - DNA, 25 bp, Rattus norvegicus
tgctgctgctctccgagtcgctcat

SEQ ID NO: 544846 - DNA, 25 bp, Rattus norvegicus
accatcttggtagccgcaaagggtt

SEQ ID NO: 544847 - DNA, 25 bp, Rattus norvegicus
caactcctcggcatcgctgctgtca

SEQ ID NO: 544848 - DNA, 25 bp, Rattus norvegicus
actaagaagtactcgtgtgaacagc

SEQ ID NO: 544849 - DNA, 25 bp, Rattus norvegicus
atccgcgttccatgggaaaaatgtc

SEQ ID NO: 544850 - DNA, 25 bp, Rattus norvegicus
ggccacaggcggatccgcgttccat

SEQ ID NO: 544851 - DNA, 25 bp, Rattus norvegicus
tcactgggatatgtgggctccactc

SEQ ID NO: 544852 - DNA, 25 bp, Rattus norvegicus
tttcacagaccgtcactgggatatg

SEQ ID NO: 544853 - DNA, 25 bp, Rattus norvegicus
ctcgaggacttgattttcacagacc

SEQ ID NO: 544854 - DNA, 25 bp, Rattus norvegicus
tactcgtgtgaacagcgtgcggact

SEQ ID NO: 544855 - DNA, 25 bp, Rattus norvegicus
agaaaggcatgacctaacacagtta

SEQ ID NO: 544856 - DNA, 25 bp, Rattus norvegicus
agggatgctgactaagaagtactcg

SEQ ID NO: 544857 - DNA, 25 bp, Rattus norvegicus
cctgaaccatgttagtgagggatgc

SEQ ID NO: 544858 - DNA, 25 bp, Rattus norvegicus
gtctcttcctctgaggaacatcgtc

SEQ ID NO: 544859 - DNA, 25 bp, Rattus norvegicus
ggcatgacctaacacagttacggtc

SEQ ID NO: 544860 - DNA, 25 bp, Rattus norvegicus
ggaaaaatgtctcttcctctgagga

SEQ ID NO: 544861 - DNA, 25 bp, Rattus norvegicus
cgtgcggactcgaggacttgatttt

SEQ ID NO: 544862 - DNA, 25 bp, Rattus norvegicus
gccactgttcggagcccacgcggat

SEQ ID NO: 544863 - DNA, 25 bp, Rattus norvegicus
ctgttcggagcccacgcggattctg

SEQ ID NO: 544864 - DNA, 25 bp, Rattus norvegicus
agcccacgcggattctgggagccta

SEQ ID NO: 544865 - DNA, 25 bp, Rattus norvegicus
cccacgcggattctgggagcctaag

SEQ ID NO: 544866 - DNA, 25 bp, Rattus norvegicus
tctgggagcctaagccggcgccgcc

SEQ ID NO: 544867 - DNA, 25 bp, Rattus norvegicus
ctgctctgcggaggatttgctgggt

SEQ ID NO: 544868 - DNA, 25 bp, Rattus norvegicus
atttgctgggttcggcggctccgcc

SEQ ID NO: 544869 - DNA, 25 bp, Rattus norvegicus
gccctcgcgcagtctcagcccgcag

SEQ ID NO: 544870 - DNA, 25 bp, Rattus norvegicus
gcctcccgggagtccagggcggcga

SEQ ID NO: 544871 - DNA, 25 bp, Rattus norvegicus
gacgcccatgctggccgcggcaatg

SEQ ID NO: 544872 - DNA, 25 bp, Rattus norvegicus
tgctggccgcggcaatgtgtacaaa

SEQ ID NO: 544873 - DNA, 25 bp, Rattus norvegicus
tggccgcggcaatgtgtacaaagcg

SEQ ID NO: 544874 - DNA, 25 bp, Rattus norvegicus
gcaatgtgtacaaagcgcgcggccg

SEQ ID NO: 544875 - DNA, 25 bp, Rattus norvegicus
cggcaatgtgtacaaagcgcgcggc

SEQ ID NO: 544876 - DNA, 25 bp, Rattus norvegicus
gaagccggccctacacggtgctgcg

SEQ ID NO: 544877 - DNA, 25 bp, Rattus norvegicus
ctgcggttgtgtgccgcgctctgca

SEQ ID NO: 544878 - DNA, 25 bp, Rattus norvegicus
ctggccgcgcaaaggcagcttttag

SEQ ID NO: 544879 - DNA, 25 bp, Rattus norvegicus
ccgtggcaaccacgcgagcagagtg

SEQ ID NO: 544880 - DNA, 25 bp, Rattus norvegicus
gtcctgtttccgtggcaaccacgcg

SEQ ID NO: 544881 - DNA, 25 bp, Rattus norvegicus
tccggattggaggaaccttgtcctg

SEQ ID NO: 544882 - DNA, 25 bp, Rattus norvegicus
tattatgcggggaccactccggatt

SEQ ID NO: 544883 - DNA, 25 bp, Rattus norvegicus
tcggagtattatgcggggaccactc

SEQ ID NO: 544884 - DNA, 25 bp, Rattus norvegicus
ttccacagggaaggctgacgcgagc

SEQ ID NO: 544885 - DNA, 25 bp, Rattus norvegicus
gaaaagcaaagccttccacagggaa

SEQ ID NO: 544886 - DNA, 25 bp, Rattus norvegicus
cacgactgtgaaaagcaaagccttc

SEQ ID NO: 544887 - DNA, 25 bp, Rattus norvegicus
cttaattcgaaaacacacgactgtg

SEQ ID NO: 544888 - DNA, 25 bp, Rattus norvegicus
ggactgtggggacgacttaattcga

SEQ ID NO: 544889 - DNA, 25 bp, Rattus norvegicus
tgcgggtttgcagacagatcccggc

SEQ ID NO: 544890 - DNA, 25 bp, Rattus norvegicus
ccttaggcgtcctggtcctggcaga

SEQ ID NO: 544891 - DNA, 25 bp, Rattus norvegicus
ctgcgggcacagagtccacagcctt

SEQ ID NO: 544892 - DNA, 25 bp, Rattus norvegicus
ggggatcttagatttgatctccaac

SEQ ID NO: 544893 - DNA, 25 bp, Rattus norvegicus
gccacatttaaacacttgcctagtg

SEQ ID NO: 544894 - DNA, 25 bp, Rattus norvegicus
gctgcttcacttaaggccacattta

SEQ ID NO: 544895 - DNA, 25 bp, Rattus norvegicus
gacttggggttcctgctgcttcact

SEQ ID NO: 544896 - DNA, 25 bp, Rattus norvegicus
acgtcccgggaagcgcctgcgagca

SEQ ID NO: 544897 - DNA, 25 bp, Rattus norvegicus
cgcccagtcatctggtgactgtgcc

SEQ ID NO: 544898 - DNA, 25 bp, Rattus norvegicus
cctggcagaggccaaggatttgcgc

SEQ ID NO: 544899 - DNA, 25 bp, Rattus norvegicus
atttgatctccaacaacgcacgcgc

SEQ ID NO: 544900 - DNA, 25 bp, Rattus norvegicus
atttgcgcgagggatccagcggtcc

SEQ ID NO: 544901 - DNA, 25 bp, Rattus norvegicus
ggctacaagcctgggcaccggagct

SEQ ID NO: 544902 - DNA, 25 bp, Rattus norvegicus
aaaccacgcgcccagtcatctggtg

SEQ ID NO: 544903 - DNA, 25 bp, Rattus norvegicus
ggcagcccggtgactccgtagacac

SEQ ID NO: 544904 - DNA, 25 bp, Rattus norvegicus
tgccgcacccgctgctcagacaaga

SEQ ID NO: 544905 - DNA, 25 bp, Rattus norvegicus
cgcacccgctgctcagacaagaaca

SEQ ID NO: 544906 - DNA, 25 bp, Rattus norvegicus
gccgcacccgctgctcagacaagaa

SEQ ID NO: 544907 - DNA, 25 bp, Rattus norvegicus
ccgcacccgctgctcagacaagaac

SEQ ID NO: 544908 - DNA, 25 bp, Rattus norvegicus
cccgctgctcagacaagaacagggc

SEQ ID NO: 544909 - DNA, 25 bp, Rattus norvegicus
acccgctgctcagacaagaacaggg

SEQ ID NO: 544910 - DNA, 25 bp, Rattus norvegicus
cacccgctgctcagacaagaacagg

SEQ ID NO: 544911 - DNA, 25 bp, Rattus norvegicus
tgctcagacaagaacagggcgccgg

SEQ ID NO: 544912 - DNA, 25 bp, Rattus norvegicus
gctgctcagacaagaacagggcgcc

SEQ ID NO: 544913 - DNA, 25 bp, Rattus norvegicus
cgctgctcagacaagaacagggcgc

SEQ ID NO: 544914 - DNA, 25 bp, Rattus norvegicus
gcacccgctgctcagacaagaacag

SEQ ID NO: 544915 - DNA, 25 bp, Rattus norvegicus
ccgctgctcagacaagaacagggcg

SEQ ID NO: 544916 - DNA, 25 bp, Rattus norvegicus
cagacaagaacagggcgccggggct

SEQ ID NO: 544917 - DNA, 25 bp, Rattus norvegicus
ctgctcagacaagaacagggcgccg

SEQ ID NO: 544918 - DNA, 25 bp, Rattus norvegicus
ttgggaagcccgagatctccacgca

SEQ ID NO: 544919 - DNA, 25 bp, Rattus norvegicus
tgaacggaccgagtcccgctccatg

SEQ ID NO: 544920 - DNA, 25 bp, Rattus norvegicus
ggacctgacttcctgaacggaccga

SEQ ID NO: 544921 - DNA, 25 bp, Rattus norvegicus
accattttggaagtgggcagcgtga

SEQ ID NO: 544922 - DNA, 25 bp, Rattus norvegicus
gccgccttccgcgattggtcggaaa

SEQ ID NO: 544923 - DNA, 25 bp, Rattus norvegicus
gcctggaccaaaccatcggactgga

SEQ ID NO: 544924 - DNA, 25 bp, Rattus norvegicus
agggaagtacgcgaggcgttccatc

SEQ ID NO: 544925 - DNA, 25 bp, Rattus norvegicus
ttctccagtggtgcgctccacaatc

SEQ ID NO: 544926 - DNA, 25 bp, Rattus norvegicus
tcgggagtcgaaccgactctgactc

SEQ ID NO: 544927 - DNA, 25 bp, Rattus norvegicus
ccggtagtcgttgttccagaccaga

SEQ ID NO: 544928 - DNA, 25 bp, Rattus norvegicus
aggcgttccatcacgctccgcggag

SEQ ID NO: 544929 - DNA, 25 bp, Rattus norvegicus
gcgctgacagctagcgaaccgactg

SEQ ID NO: 544930 - DNA, 25 bp, Rattus norvegicus
cgaccaccaccgttctgtggaactg

SEQ ID NO: 544931 - DNA, 25 bp, Rattus norvegicus
aatcgggcctcttccatcggctctg

SEQ ID NO: 544932 - DNA, 25 bp, Rattus norvegicus
aggaagcgtgccctttccggtcaca

SEQ ID NO: 544933 - DNA, 25 bp, Rattus norvegicus
acatgacccgctggggctccgcagg

SEQ ID NO: 544934 - DNA, 25 bp, Rattus norvegicus
cccgttagagcggaagcgcagccgc

SEQ ID NO: 544935 - DNA, 25 bp, Rattus norvegicus
gtgggagccatgtcgaagcgtctcc

SEQ ID NO: 544936 - DNA, 25 bp, Rattus norvegicus
gagccatgtcgaagcgtctccggag

SEQ ID NO: 544937 - DNA, 25 bp, Rattus norvegicus
agcgtctccggagcaacgacgtgtg

SEQ ID NO: 544938 - DNA, 25 bp, Rattus norvegicus
agcaacgacgtgtgcgccgactgca

SEQ ID NO: 544939 - DNA, 25 bp, Rattus norvegicus
tgactgcggcccactcacgccgacc

SEQ ID NO: 544940 - DNA, 25 bp, Rattus norvegicus
gcgcgagaccgtcccgggcctgtca

SEQ ID NO: 544941 - DNA, 25 bp, Rattus norvegicus
ctgtcagcctcagggtccgaggctc

SEQ ID NO: 544942 - DNA, 25 bp, Rattus norvegicus
cgcggcccggcagaacgcagaagca

SEQ ID NO: 544943 - DNA, 25 bp, Rattus norvegicus
cagaacgcagaagcagagggcctgg

SEQ ID NO: 544944 - DNA, 25 bp, Rattus norvegicus
ccaggtggaggaccgccctactccg

SEQ ID NO: 544945 - DNA, 25 bp, Rattus norvegicus
ccggaaggccagtgacaggacagga

SEQ ID NO: 544946 - DNA, 25 bp, Rattus norvegicus
ttagctcgatctcgcgcccgcaggc

SEQ ID NO: 544947 - DNA, 25 bp, Rattus norvegicus
acggagcaccgcgaaggccaaacct

SEQ ID NO: 544948 - DNA, 25 bp, Rattus norvegicus
gcagccctcgggacgacggagcacc

SEQ ID NO: 544949 - DNA, 25 bp, Rattus norvegicus
gtttcctcgccggttgccgggcagc

SEQ ID NO: 544950 - DNA, 25 bp, Rattus norvegicus
tgcacagacgccagccgtttcctcg

SEQ ID NO: 544951 - DNA, 25 bp, Rattus norvegicus
ccgcaggctccgagggtcccgctgc

SEQ ID NO: 544952 - DNA, 25 bp, Rattus norvegicus
aggccaaacctccttccgcgcgaca

SEQ ID NO: 544953 - DNA, 25 bp, Rattus norvegicus
gacaccagccgctcttcaagaaaaa

SEQ ID NO: 544954 - DNA, 25 bp, Rattus norvegicus
ttgccggccttagctcgatctcgcg

SEQ ID NO: 544955 - DNA, 25 bp, Rattus norvegicus
agagttgccggccttagctcgatct

SEQ ID NO: 544956 - DNA, 25 bp, Rattus norvegicus
ttcgcggagaagagttgccggcctt

SEQ ID NO: 544957 - DNA, 25 bp, Rattus norvegicus
ctcggcccagcctaacctctgactc

SEQ ID NO: 544958 - DNA, 25 bp, Rattus norvegicus
ctaacctctgactcctgcgcctggc

SEQ ID NO: 544959 - DNA, 25 bp, Rattus norvegicus
ctgcgcccgctgcacagacgccagc

SEQ ID NO: 544960 - DNA, 25 bp, Rattus norvegicus
tggggcatcaccaagggcctcgacc

SEQ ID NO: 544961 - DNA, 25 bp, Rattus norvegicus
cccatgttggtagctgaggtggtca

SEQ ID NO: 544962 - DNA, 25 bp, Rattus norvegicus
gctgctggccgagcacctgctcaag

SEQ ID NO: 544963 - DNA, 25 bp, Rattus norvegicus
gcacctgctcaagccgctacccgca

SEQ ID NO: 544964 - DNA, 25 bp, Rattus norvegicus
ggcagatcgagaccgggcccttctt

SEQ ID NO: 544965 - DNA, 25 bp, Rattus norvegicus
acgagctcccattggtcgagagggc

SEQ ID NO: 544966 - DNA, 25 bp, Rattus norvegicus
ggtgagtctcgtgccgccagctctc

SEQ ID NO: 544967 - DNA, 25 bp, Rattus norvegicus
gcgacgagctcccattggtcgagag

SEQ ID NO: 544968 - DNA, 25 bp, Rattus norvegicus
agtgcctgacaagccttgcaccgtc

SEQ ID NO: 544969 - DNA, 25 bp, Rattus norvegicus
ctgaggtggtcagtgcctgacaagc

SEQ ID NO: 544970 - DNA, 25 bp, Rattus norvegicus
tcgaccccgaaatggcgctgctggc

SEQ ID NO: 544971 - DNA, 25 bp, Rattus norvegicus
gctacccgcagaccggcagatcgag

SEQ ID NO: 544972 - DNA, 25 bp, Rattus norvegicus
ttgcaccgtcccgaacctgggcgcg

SEQ ID NO: 544973 - DNA, 25 bp, Rattus norvegicus
gccgcccttcttcggtgagtctcgt

SEQ ID NO: 544974 - DNA, 25 bp, Rattus norvegicus
cgcagttcttccgtcggtctgtctg

SEQ ID NO: 544975 - DNA, 25 bp, Rattus norvegicus
ttgctgcttgctgctccaccatcag

SEQ ID NO: 544976 - DNA, 25 bp, Rattus norvegicus
ttctgccaatagaaccgtgcacgca

SEQ ID NO: 544977 - DNA, 25 bp, Rattus norvegicus
tttatcaaagtttgctgcttgctgc

SEQ ID NO: 544978 - DNA, 25 bp, Rattus norvegicus
agccagcttccgcattttgacttga

SEQ ID NO: 544979 - DNA, 25 bp, Rattus norvegicus
tgcgcgcctatctgtgccccagttt

SEQ ID NO: 544980 - DNA, 25 bp, Rattus norvegicus
ggcacagccagcttccgcattttga

SEQ ID NO: 544981 - DNA, 25 bp, Rattus norvegicus
cgtcggtctgtctgcgcgcctatct

SEQ ID NO: 544982 - DNA, 25 bp, Rattus norvegicus
acattgggcgggcacagccagcttc

SEQ ID NO: 544983 - DNA, 25 bp, Rattus norvegicus
tcctccgctccggtcacggccacgc

SEQ ID NO: 544984 - DNA, 25 bp, Rattus norvegicus
cgcacgcagctttgcggtggagcca

SEQ ID NO: 544985 - DNA, 25 bp, Rattus norvegicus
taggtggcgctgtccgcacgcagct

SEQ ID NO: 544986 - DNA, 25 bp, Rattus norvegicus
gaaccgtgcacgcagttcccgcgtg

SEQ ID NO: 544987 - DNA, 25 bp, Rattus norvegicus
ccgcattttgacttgaggtttatca

SEQ ID NO: 544988 - DNA, 25 bp, Rattus norvegicus
ctgcgcccgcgtcccaaggtaagtg

SEQ ID NO: 544989 - DNA, 25 bp, Rattus norvegicus
tagccttgacgggtgtgagctgtcc

SEQ ID NO: 544990 - DNA, 25 bp, Rattus norvegicus
acgtgcctcgcgggctagccttgac

SEQ ID NO: 544991 - DNA, 25 bp, Rattus norvegicus
tgagctgtccggcaagcgggctccc

SEQ ID NO: 544992 - DNA, 25 bp, Rattus norvegicus
aatggaagagcgaggcaccgagcca

SEQ ID NO: 544993 - DNA, 25 bp, Rattus norvegicus
ggggagtgcagatctaggtcaccta

SEQ ID NO: 544994 - DNA, 25 bp, Rattus norvegicus
cccaatgaccgggttcgaggctcgc

SEQ ID NO: 544995 - DNA, 25 bp, Rattus norvegicus
atagcgggaggtgacgccaccacga

SEQ ID NO: 544996 - DNA, 25 bp, Rattus norvegicus
gacgccaccacgaaggtcacctgtg

SEQ ID NO: 544997 - DNA, 25 bp, Rattus norvegicus
cacgaaggtcacctgtggattgggc

SEQ ID NO: 544998 - DNA, 25 bp, Rattus norvegicus
tcacctgtggattgggcgcctaccc

SEQ ID NO: 544999 - DNA, 25 bp, Rattus norvegicus
tggattgggcgcctacccgagcctg

SEQ ID NO: 545000 - DNA, 25 bp, Rattus norvegicus
gtgcagatctaggtcacctagaccc

SEQ ID NO: 545001 - DNA, 25 bp, Rattus norvegicus
ctgggcgcaggaactagggatgaat

SEQ ID NO: 545002 - DNA, 25 bp, Rattus norvegicus
cggcgaagtactggcccacggtgaa

SEQ ID NO: 545003 - DNA, 25 bp, Rattus norvegicus
tgctgctaccgtaggcccgcagcgg

SEQ ID NO: 545004 - DNA, 25 bp, Rattus norvegicus
cggcagcggctgcattgtaacagtc

SEQ ID NO: 545005 - DNA, 25 bp, Rattus norvegicus
ggctgcattgtaacagtcactagta

SEQ ID NO: 545006 - DNA, 25 bp, Rattus norvegicus
acagtcactagtaggcgtcaccaga

SEQ ID NO: 545007 - DNA, 25 bp, Rattus norvegicus
gtaggcgtcaccagaacactgttcc

SEQ ID NO: 545008 - DNA, 25 bp, Rattus norvegicus
aacactgttccaaggggcggcgaag

SEQ ID NO: 545009 - DNA, 25 bp, Rattus norvegicus
ccatgccacagttgtggggcgaccc

SEQ ID NO: 545010 - DNA, 25 bp, Rattus norvegicus
tggggcgacccgttggccctctcga

SEQ ID NO: 545011 - DNA, 25 bp, Rattus norvegicus
ggccctctcgaatgccctcccgctg

SEQ ID NO: 545012 - DNA, 25 bp, Rattus norvegicus
tcccgctgcaagtctctggggactt

SEQ ID NO: 545013 - DNA, 25 bp, Rattus norvegicus
acggtgctgctgctaccgtaggccc

SEQ ID NO: 545014 - DNA, 25 bp, Rattus norvegicus
agtactggcccacggtgaagccgcc

SEQ ID NO: 545015 - DNA, 25 bp, Rattus norvegicus
acttgctggcgacggtgctgctgct

SEQ ID NO: 545016 - DNA, 25 bp, Rattus norvegicus
agcctcgccggccatcccgaactgt

SEQ ID NO: 545017 - DNA, 25 bp, Rattus norvegicus
gggaaacgagcaagctcggctccca

SEQ ID NO: 545018 - DNA, 25 bp, Rattus norvegicus
ccacacctccggactggctcccagc

SEQ ID NO: 545019 - DNA, 25 bp, Rattus norvegicus
tgcccgaaccaaagcctcgcccagg

SEQ ID NO: 545020 - DNA, 25 bp, Rattus norvegicus
ggatgtgcagtttgtaccccctaat

SEQ ID NO: 545021 - DNA, 25 bp, Rattus norvegicus
ccctaatcgcgggaaacgagcaagc

SEQ ID NO: 545022 - DNA, 25 bp, Rattus norvegicus
tcccaaggcacagcagggtcgccag

SEQ ID NO: 545023 - DNA, 25 bp, Rattus norvegicus
aggcacagcagggtcgccagctctc

SEQ ID NO: 545024 - DNA, 25 bp, Rattus norvegicus
tccaccagaggcggaggcgtcctcg

SEQ ID NO: 545025 - DNA, 25 bp, Rattus norvegicus
gcagcctgtgacagctgtgggtctc

SEQ ID NO: 545026 - DNA, 25 bp, Rattus norvegicus
tcccgaactgttccctactcttgga

SEQ ID NO: 545027 - DNA, 25 bp, Rattus norvegicus
tactcttggaaacccaagccaaggc

SEQ ID NO: 545028 - DNA, 25 bp, Rattus norvegicus
tagccacgccctgcccgaaccaaag

SEQ ID NO: 545029 - DNA, 25 bp, Rattus norvegicus
gctctggccgcagcctgtgacagct

SEQ ID NO: 545030 - DNA, 25 bp, Rattus norvegicus
catagttcgttctttgggccctcgc

SEQ ID NO: 545031 - DNA, 25 bp, Rattus norvegicus
ttcagcggagggattacgctgccga

SEQ ID NO: 545032 - DNA, 25 bp, Rattus norvegicus
gccgtctcagcaaggaaagcaactt

SEQ ID NO: 545033 - DNA, 25 bp, Rattus norvegicus
ccaatgttgggcctcactggcaggc

SEQ ID NO: 545034 - DNA, 25 bp, Rattus norvegicus
atgggctcccatagttcgttctttg

SEQ ID NO: 545035 - DNA, 25 bp, Rattus norvegicus
agtggtagctgatccgatctctggc

SEQ ID NO: 545036 - DNA, 25 bp, Rattus norvegicus
tgattaaaattagtgcgcggccttc

SEQ ID NO: 545037 - DNA, 25 bp, Rattus norvegicus
ctacagagcctgcaaagtgtgagtg

SEQ ID NO: 545038 - DNA, 25 bp, Rattus norvegicus
ctccgcagaggcgtggcttgcccaa

SEQ ID NO: 545039 - DNA, 25 bp, Rattus norvegicus
aagacgagggcacttccggcaggct

SEQ ID NO: 545040 - DNA, 25 bp, Rattus norvegicus
gcagagagccctgcttgaaagcacg

SEQ ID NO: 545041 - DNA, 25 bp, Rattus norvegicus
tacaaacactttcctgcagagagcc

SEQ ID NO: 545042 - DNA, 25 bp, Rattus norvegicus
agcaacttccgcttgggagtccgcc

SEQ ID NO: 545043 - DNA, 25 bp, Rattus norvegicus
atctctggcgcgtaggcccaatgtt

SEQ ID NO: 545044 - DNA, 25 bp, Rattus norvegicus
tacagccgggcccacgtagcctgaa

SEQ ID NO: 545045 - DNA, 25 bp, Rattus norvegicus
atcccagagcagcttcgctcggcgg

SEQ ID NO: 545046 - DNA, 25 bp, Rattus norvegicus
tccatgagctgctccgatcccagag

SEQ ID NO: 545047 - DNA, 25 bp, Rattus norvegicus
gcactttctccatgagctgctccga

SEQ ID NO: 545048 - DNA, 25 bp, Rattus norvegicus
ctatctccatgtcgcccggcacttt

SEQ ID NO: 545049 - DNA, 25 bp, Rattus norvegicus
cctctccctgcgctctatctccatg

SEQ ID NO: 545050 - DNA, 25 bp, Rattus norvegicus
ggacagctcctcgttcctctccctg

SEQ ID NO: 545051 - DNA, 25 bp, Rattus norvegicus
gaaccgccttcctctccgcctcgga

SEQ ID NO: 545052 - DNA, 25 bp, Rattus norvegicus
ggcccacgtagcctgaaccgccttc

SEQ ID NO: 545053 - DNA, 25 bp, Rattus norvegicus
gcagttggcatacagccgggcccac

SEQ ID NO: 545054 - DNA, 25 bp, Rattus norvegicus
cacgtcctcgcagttggcatacagc

SEQ ID NO: 545055 - DNA, 25 bp, Rattus norvegicus
agcgacacctacctcaccaggatgg

SEQ ID NO: 545056 - DNA, 25 bp, Rattus norvegicus
gggagcgacacctacctcaccagga

SEQ ID NO: 545057 - DNA, 25 bp, Rattus norvegicus
gtcaagccgggagcgacacctacct

SEQ ID NO: 545058 - DNA, 25 bp, Rattus norvegicus
agctcgcggctgttttgaatctcta

SEQ ID NO: 545059 - DNA, 25 bp, Rattus norvegicus
tctctaaggcatcccagtctatctg

SEQ ID NO: 545060 - DNA, 25 bp, Rattus norvegicus
ccgcttctgattggaccacgcgaga

SEQ ID NO: 545061 - DNA, 25 bp, Rattus norvegicus
gccttgttcctctggatgcggacga

SEQ ID NO: 545062 - DNA, 25 bp, Rattus norvegicus
cccagcacggagctccgggattctt

SEQ ID NO: 545063 - DNA, 25 bp, Rattus norvegicus
ggtcttctggccgatcatgcctgca

SEQ ID NO: 545064 - DNA, 25 bp, Rattus norvegicus
gacgcgctgtacactgattggctca

SEQ ID NO: 545065 - DNA, 25 bp, Rattus norvegicus
tggctaataagctgcgcgtccggct

SEQ ID NO: 545066 - DNA, 25 bp, Rattus norvegicus
ccgtcgacgcgcaagactgttttga

SEQ ID NO: 545067 - DNA, 25 bp, Rattus norvegicus
attcccattggtggatgtctcggca

SEQ ID NO: 545068 - DNA, 25 bp, Rattus norvegicus
gcggccgagctccattcccattggt

SEQ ID NO: 545069 - DNA, 25 bp, Rattus norvegicus
ggcacgctgcataccgattggcttt

SEQ ID NO: 545070 - DNA, 25 bp, Rattus norvegicus
aagatgcccatggtccagccgaacc

SEQ ID NO: 545071 - DNA, 25 bp, Rattus norvegicus
caggctacgcgccaacttcaaaggc

SEQ ID NO: 545072 - DNA, 25 bp, Rattus norvegicus
ccgcttgtgctaggacgacttgagc

SEQ ID NO: 545073 - DNA, 25 bp, Rattus norvegicus
ggccgaggcagaccagattttccga

SEQ ID NO: 545074 - DNA, 25 bp, Rattus norvegicus
gcggaaggtctgaactgcgattaca

SEQ ID NO: 545075 - DNA, 25 bp, Rattus norvegicus
tggcaacactttcgcgcggaaggtc

SEQ ID NO: 545076 - DNA, 25 bp, Rattus norvegicus
cctacgggagaagcctcaggcgaca

SEQ ID NO: 545077 - DNA, 25 bp, Rattus norvegicus
cagattccttgtgagaccggaccga

SEQ ID NO: 545078 - DNA, 25 bp, Rattus norvegicus
gattacaccgtcctgttccgcaagg

SEQ ID NO: 545079 - DNA, 25 bp, Rattus norvegicus
ccgtcagtaggagaagcgtgaactc

SEQ ID NO: 545080 - DNA, 25 bp, Rattus norvegicus
ggatccctgcagttaggctcctgga

SEQ ID NO: 545081 - DNA, 25 bp, Rattus norvegicus
ttgtagcctgtgctcccattccgga

SEQ ID NO: 545082 - DNA, 25 bp, Rattus norvegicus
ctgccgagattcgtgcgtatgtgca

SEQ ID NO: 545083 - DNA, 25 bp, Rattus norvegicus
tcgtcccatgtgtagcctgaaggtt

SEQ ID NO: 545084 - DNA, 25 bp, Rattus norvegicus
cgccaggcacctcctaggagtttta

SEQ ID NO: 545085 - DNA, 25 bp, Rattus norvegicus
aatgcgctcgttttccttggtagga

SEQ ID NO: 545086 - DNA, 25 bp, Rattus norvegicus
gcccagtgtgcgaggttcccaaagt

SEQ ID NO: 545087 - DNA, 25 bp, Rattus norvegicus
ttctggggtcaccgagaagggctac

SEQ ID NO: 545088 - DNA, 25 bp, Rattus norvegicus
cagggaccaggaggcaacgctgggc

SEQ ID NO: 545089 - DNA, 25 bp, Rattus norvegicus
ttgtcggccgctgtcctcgccgcct

SEQ ID NO: 545090 - DNA, 25 bp, Rattus norvegicus
ccacgcccgctgcagcgtaatgtaa

SEQ ID NO: 545091 - DNA, 25 bp, Rattus norvegicus
taatgtaatgaggagcccagtgtgc

SEQ ID NO: 545092 - DNA, 25 bp, Rattus norvegicus
ggagacggaccggaaattggtcaca

SEQ ID NO: 545093 - DNA, 25 bp, Rattus norvegicus
cggaaattggtcacaccggactgca

SEQ ID NO: 545094 - DNA, 25 bp, Rattus norvegicus
ttggtcacaccggactgcaatagtg

SEQ ID NO: 545095 - DNA, 25 bp, Rattus norvegicus
tcacaccggactgcaatagtgcacg

SEQ ID NO: 545096 - DNA, 25 bp, Rattus norvegicus
ggactgcaatagtgcacggacgccc

SEQ ID NO: 545097 - DNA, 25 bp, Rattus norvegicus
gggaactcagcatcccggccactgc

SEQ ID NO: 545098 - DNA, 25 bp, Rattus norvegicus
gcagcgtaatgtaatgaggagccca

SEQ ID NO: 545099 - DNA, 25 bp, Rattus norvegicus
cccgctgcagcgtaatgtaatgagg

SEQ ID NO: 545100 - DNA, 25 bp, Rattus norvegicus
aggaggacctgttccagctcaggca

SEQ ID NO: 545101 - DNA, 25 bp, Rattus norvegicus
tgttccagctcaggcagttgccgtg

SEQ ID NO: 545102 - DNA, 25 bp, Rattus norvegicus
aagggtcatgcccaggctcgccctg

SEQ ID NO: 545103 - DNA, 25 bp, Rattus norvegicus
ccatgtaagggtcatgcccaggctc

SEQ ID NO: 545104 - DNA, 25 bp, Rattus norvegicus
cttcaccatgtaagggtcatgccca

SEQ ID NO: 545105 - DNA, 25 bp, Rattus norvegicus
gccctgcttcaccatgtaagggtca

SEQ ID NO: 545106 - DNA, 25 bp, Rattus norvegicus
gctgaaagccgaagcgccggccctg

SEQ ID NO: 545107 - DNA, 25 bp, Rattus norvegicus
cggagctgtccagcatcccggtgct

SEQ ID NO: 545108 - DNA, 25 bp, Rattus norvegicus
ctgccctgcgaggaagccgcggagc

SEQ ID NO: 545109 - DNA, 25 bp, Rattus norvegicus
ctggctttgtctcccgggcagggct

SEQ ID NO: 545110 - DNA, 25 bp, Rattus norvegicus
gcggcagcggctggctttgtctccc

SEQ ID NO: 545111 - DNA, 25 bp, Rattus norvegicus
tccgcccactcctgtcggtctccgg

SEQ ID NO: 545112 - DNA, 25 bp, Rattus norvegicus
atcccggtgctgaaagccgaagcgc

SEQ ID NO: 545113 - DNA, 25 bp, Rattus norvegicus
agctcaggcagttgccgtgagtacc

SEQ ID NO: 545114 - DNA, 25 bp, Rattus norvegicus
cgggcattcgggaagtacgtgaaca

SEQ ID NO: 545115 - DNA, 25 bp, Rattus norvegicus
ggagcctgcgcaccctcacattggt

SEQ ID NO: 545116 - DNA, 25 bp, Rattus norvegicus
ggcggcggcgttcccacccattgga

SEQ ID NO: 545117 - DNA, 25 bp, Rattus norvegicus
actgtaaacagagcctgcagggcgg

SEQ ID NO: 545118 - DNA, 25 bp, Rattus norvegicus
ctcaaccggaggaactgtaaacaga

SEQ ID NO: 545119 - DNA, 25 bp, Rattus norvegicus
gagcaacacccgttctcaaccggag

SEQ ID NO: 545120 - DNA, 25 bp, Rattus norvegicus
atgcgcagcacaaagctaacctggg

SEQ ID NO: 545121 - DNA, 25 bp, Rattus norvegicus
aagccgtactgagcaacacccgttc

SEQ ID NO: 545122 - DNA, 25 bp, Rattus norvegicus
gtccgtccaaagacaagccgtactg

SEQ ID NO: 545123 - DNA, 25 bp, Rattus norvegicus
gcccgaggcctctttttcatgtccg

SEQ ID NO: 545124 - DNA, 25 bp, Rattus norvegicus
agctttgcccggagcatgcgcagca

SEQ ID NO: 545125 - DNA, 25 bp, Rattus norvegicus
gtcatccacgaacgcgcacagcttt

SEQ ID NO: 545126 - DNA, 25 bp, Rattus norvegicus
tacgtgaacagaagcaaccgacaga

SEQ ID NO: 545127 - DNA, 25 bp, Rattus norvegicus
ggcctctttttcatgtccgtccaaa

SEQ ID NO: 545128 - DNA, 25 bp, Rattus norvegicus
tcacctcgctgttgcttgtccgaga

SEQ ID NO: 545129 - DNA, 25 bp, Rattus norvegicus
cccgactaggcatcaagagctcagg

SEQ ID NO: 545130 - DNA, 25 bp, Rattus norvegicus
gcacctcgggaacgcacagctcaga

SEQ ID NO: 545131 - DNA, 25 bp, Rattus norvegicus
gtcctggggaccacgactctccagt

SEQ ID NO: 545132 - DNA, 25 bp, Rattus norvegicus
cggcgcatgctcaatcaccgggacg

SEQ ID NO: 545133 - DNA, 25 bp, Rattus norvegicus
aaatcgcaccgacacgggcacgcag

SEQ ID NO: 545134 - DNA, 25 bp, Rattus norvegicus
cacgcaggggtgctgagcagacaca

SEQ ID NO: 545135 - DNA, 25 bp, Rattus norvegicus
tagcacagcctagggcaggccgtcc

SEQ ID NO: 545136 - DNA, 25 bp, Rattus norvegicus
gagagggcccagattccagctggca

SEQ ID NO: 545137 - DNA, 25 bp, Rattus norvegicus
tccagctggcaacttcctgggcctg

SEQ ID NO: 545138 - DNA, 25 bp, Rattus norvegicus
tcctgcagccgactgggtcatccgg

SEQ ID NO: 545139 - DNA, 25 bp, Rattus norvegicus
ggtttactcggaggccttaggctca

SEQ ID NO: 545140 - DNA, 25 bp, Rattus norvegicus
tgagcagacacacaacccggggaga

SEQ ID NO: 545141 - DNA, 25 bp, Rattus norvegicus
cagctcagagccgagcggagccctt

SEQ ID NO: 545142 - DNA, 25 bp, Rattus norvegicus
cgctccggttctaaagaactgggtg

SEQ ID NO: 545143 - DNA, 25 bp, Rattus norvegicus
ttctaaagaactgggtggggctcga

SEQ ID NO: 545144 - DNA, 25 bp, Rattus norvegicus
tgtgcttcgagcctccttgcgtctc

SEQ ID NO: 545145 - DNA, 25 bp, Rattus norvegicus
gctctaaggagcacccggcacctaa

SEQ ID NO: 545146 - DNA, 25 bp, Rattus norvegicus
cagctgggacttcggcggcgcctca

SEQ ID NO: 545147 - DNA, 25 bp, Rattus norvegicus
cgcggccgagcgctcacatgggact

SEQ ID NO: 545148 - DNA, 25 bp, Rattus norvegicus
ctggctcctggtgcatggcctcctg

SEQ ID NO: 545149 - DNA, 25 bp, Rattus norvegicus
atggcctcctggaccctgaagacct

SEQ ID NO: 545150 - DNA, 25 bp, Rattus norvegicus
tggctaggatgacatcagaggtaga

SEQ ID NO: 545151 - DNA, 25 bp, Rattus norvegicus
gtggggacgcctagcccagctctgc

SEQ ID NO: 545152 - DNA, 25 bp, Rattus norvegicus
gcgggcgttcgcacggcagccctat

SEQ ID NO: 545153 - DNA, 25 bp, Rattus norvegicus
tatctccagtgatgtgaatgcgctg

SEQ ID NO: 545154 - DNA, 25 bp, Rattus norvegicus
ggcagccctatctccagtgatgtga

SEQ ID NO: 545155 - DNA, 25 bp, Rattus norvegicus
gcgccgagatggctaggatgacatc

SEQ ID NO: 545156 - DNA, 25 bp, Rattus norvegicus
agcccgacgcaggttatgctagtga

SEQ ID NO: 545157 - DNA, 25 bp, Rattus norvegicus
atcgcggaggaactggaattttgtc

SEQ ID NO: 545158 - DNA, 25 bp, Rattus norvegicus
cctgggagtcccgaggaaagcaatt

SEQ ID NO: 545159 - DNA, 25 bp, Rattus norvegicus
tttctaattcaaaggcagccgtttc

SEQ ID NO: 545160 - DNA, 25 bp, Rattus norvegicus
caactgccggtatggctgccacttc

SEQ ID NO: 545161 - DNA, 25 bp, Rattus norvegicus
agatggcgtctggaccttaactatg

SEQ ID NO: 545162 - DNA, 25 bp, Rattus norvegicus
acttgcccgaggatgctcagactca

SEQ ID NO: 545163 - DNA, 25 bp, Rattus norvegicus
ggctgagccttgcagaaatccttta

SEQ ID NO: 545164 - DNA, 25 bp, Rattus norvegicus
agtgagcctttcttcctgacagtgg

SEQ ID NO: 545165 - DNA, 25 bp, Rattus norvegicus
tcctgtctcgttaaccttgctgatg

SEQ ID NO: 545166 - DNA, 25 bp, Rattus norvegicus
agacgccacggacagcctaatgttc

SEQ ID NO: 545167 - DNA, 25 bp, Rattus norvegicus
gcatcccgagacgatacttactgta

SEQ ID NO: 545168 - DNA, 25 bp, Rattus norvegicus
tcagactcaggcttatttgggattc

SEQ ID NO: 545169 - DNA, 25 bp, Rattus norvegicus
cccaaaagctgtccaaggtcgtagc

SEQ ID NO: 545170 - DNA, 25 bp, Rattus norvegicus
cagcatgctgggcttactcccgaag

SEQ ID NO: 545171 - DNA, 25 bp, Rattus norvegicus
cagcagccaataagcggcaggaggc

SEQ ID NO: 545172 - DNA, 25 bp, Rattus norvegicus
gtctcgtgcaggcagcagccaataa

SEQ ID NO: 545173 - DNA, 25 bp, Rattus norvegicus
ctgtcgcttgtttgcgtctcgtgca

SEQ ID NO: 545174 - DNA, 25 bp, Rattus norvegicus
tggctaactctacctgtccatccgt

SEQ ID NO: 545175 - DNA, 25 bp, Rattus norvegicus
gccgcggcggattggctaactctac

SEQ ID NO: 545176 - DNA, 25 bp, Rattus norvegicus
gaagcctcaccattggacggccagc

SEQ ID NO: 545177 - DNA, 25 bp, Rattus norvegicus
tgcggatcggcccaaggttcgcgcc

SEQ ID NO: 545178 - DNA, 25 bp, Rattus norvegicus
ccgtaaggtctctctgcggatcggc

SEQ ID NO: 545179 - DNA, 25 bp, Rattus norvegicus
gcttactcccgaagtgggaaactga

SEQ ID NO: 545180 - DNA, 25 bp, Rattus norvegicus
acgtcatcacttcgcgcggcctgtg

SEQ ID NO: 545181 - DNA, 25 bp, Rattus norvegicus
tgtgcagctgcttgagcccagcatg

SEQ ID NO: 545182 - DNA, 25 bp, Rattus norvegicus
ttccagggccttacccgtcacgtca

SEQ ID NO: 545183 - DNA, 25 bp, Rattus norvegicus
actgaggctgccgtaaggtctctct

SEQ ID NO: 545184 - DNA, 25 bp, Rattus norvegicus
tccttgcgtgctgtttggtcacaca

SEQ ID NO: 545185 - DNA, 25 bp, Rattus norvegicus
tgtgccggagaaagtgtttcaaacc

SEQ ID NO: 545186 - DNA, 25 bp, Rattus norvegicus
tgtgcatgagcgcatacaccgtacg

SEQ ID NO: 545187 - DNA, 25 bp, Rattus norvegicus
caccgtacgcacaaagcgtgtgttc

SEQ ID NO: 545188 - DNA, 25 bp, Rattus norvegicus
acaaagcgtgtgttccattctgccc

SEQ ID NO: 545189 - DNA, 25 bp, Rattus norvegicus
cccgacacagcagggcttgaaggcc

SEQ ID NO: 545190 - DNA, 25 bp, Rattus norvegicus
gcctgctcttcctcatggatatgtg

SEQ ID NO: 545191 - DNA, 25 bp, Rattus norvegicus
cccgtcggcaagtcggaagtcagga

SEQ ID NO: 545192 - DNA, 25 bp, Rattus norvegicus
aaagaaaggcttttgcctgcggcgg

SEQ ID NO: 545193 - DNA, 25 bp, Rattus norvegicus
ttgtctgccatcttgtccttgcgtg

SEQ ID NO: 545194 - DNA, 25 bp, Rattus norvegicus
acagcgagcgcacctgtgcatgagc

SEQ ID NO: 545195 - DNA, 25 bp, Rattus norvegicus
tttggtcacacaaacccacgtgaga

SEQ ID NO: 545196 - DNA, 25 bp, Rattus norvegicus
cccacgtgagagctgcggtaagttt

SEQ ID NO: 545197 - DNA, 25 bp, Rattus norvegicus
ggcgggcgatgtcatatttgtctgc

SEQ ID NO: 545198 - DNA, 25 bp, Rattus norvegicus
ctcggtttcctcatcggtccctgaa

SEQ ID NO: 545199 - DNA, 25 bp, Rattus norvegicus
cactaaagttatggccggtcctgtc

SEQ ID NO: 545200 - DNA, 25 bp, Rattus norvegicus
tcggtcgattttctgggagtctccc

SEQ ID NO: 545201 - DNA, 25 bp, Rattus norvegicus
ggagtctccctagacttcacgaagg

SEQ ID NO: 545202 - DNA, 25 bp, Rattus norvegicus
cttcacgaaggaaccaagccaaatg

SEQ ID NO: 545203 - DNA, 25 bp, Rattus norvegicus
gtcctctgccgcgtgcactaaagtt

SEQ ID NO: 545204 - DNA, 25 bp, Rattus norvegicus
gccgaagtgctccacagaccaagca

SEQ ID NO: 545205 - DNA, 25 bp, Rattus norvegicus
ttaccctttttcttcactcaggctg

SEQ ID NO: 545206 - DNA, 25 bp, Rattus norvegicus
actcaggctgaggtgagacgaccca

SEQ ID NO: 545207 - DNA, 25 bp, Rattus norvegicus
agacgacccactctcggcaacggta

SEQ ID NO: 545208 - DNA, 25 bp, Rattus norvegicus
ctcggcaacggtagctttagaacta

SEQ ID NO: 545209 - DNA, 25 bp, Rattus norvegicus
tacatttcccattgagcgtttctta

SEQ ID NO: 545210 - DNA, 25 bp, Rattus norvegicus
gcgtttcttaacatcgcgagagttc

SEQ ID NO: 545211 - DNA, 25 bp, Rattus norvegicus
gcgcgcaagcgcaatctcgttcttt

SEQ ID NO: 545212 - DNA, 25 bp, Rattus norvegicus
aaagtttattcgcaagacccgtgag

SEQ ID NO: 545213 - DNA, 25 bp, Rattus norvegicus
taatgatgcgcacccggatcgctgc

SEQ ID NO: 545214 - DNA, 25 bp, Rattus norvegicus
gccaccgatcccaactaatgatgcg

SEQ ID NO: 545215 - DNA, 25 bp, Rattus norvegicus
tttactgcttccaccgcggccagag

SEQ ID NO: 545216 - DNA, 25 bp, Rattus norvegicus
tatggcctttactgcttccaccgcg

SEQ ID NO: 545217 - DNA, 25 bp, Rattus norvegicus
ccgtgagaacccaatggtgcctata

SEQ ID NO: 545218 - DNA, 25 bp, Rattus norvegicus
tcgcaagacccgtgagaacccaatg

SEQ ID NO: 545219 - DNA, 25 bp, Rattus norvegicus
tacaccaatccagagggcttcaagg

SEQ ID NO: 545220 - DNA, 25 bp, Rattus norvegicus
ccacggtctacaccaatccagaggg

SEQ ID NO: 545221 - DNA, 25 bp, Rattus norvegicus
agaggcgccttttgatccgtccaag

SEQ ID NO: 545222 - DNA, 25 bp, Rattus norvegicus
gatcgctgcccagggtttcacggtc

SEQ ID NO: 545223 - DNA, 25 bp, Rattus norvegicus
ggctcccggtcctgtgagtccagag

SEQ ID NO: 545224 - DNA, 25 bp, Rattus norvegicus
ggcttcaaggaaaagtttattcgca

SEQ ID NO: 545225 - DNA, 25 bp, Rattus norvegicus
tcctgtgagtccagaggcgcctttt

SEQ ID NO: 545226 - DNA, 25 bp, Rattus norvegicus
tgatcacgaaataaggcaaaagtcc

SEQ ID NO: 545227 - DNA, 25 bp, Rattus norvegicus
ggagcggtttccaccgcacacatcg

SEQ ID NO: 545228 - DNA, 25 bp, Rattus norvegicus
agaaggacgctgctcgtagatttca

SEQ ID NO: 545229 - DNA, 25 bp, Rattus norvegicus
gctcgtagatttcacggtgcaccaa

SEQ ID NO: 545230 - DNA, 25 bp, Rattus norvegicus
tttcacggtgcaccaagaagaaagg

SEQ ID NO: 545231 - DNA, 25 bp, Rattus norvegicus
ttaagtggtccggtggcctgaaagc

SEQ ID NO: 545232 - DNA, 25 bp, Rattus norvegicus
cgggtagcattggagcggtttccac

SEQ ID NO: 545233 - DNA, 25 bp, Rattus norvegicus
ggcctgaaagccacaagcgtctgca

SEQ ID NO: 545234 - DNA, 25 bp, Rattus norvegicus
acaagcgtctgcatgtgggtgcagc

SEQ ID NO: 545235 - DNA, 25 bp, Rattus norvegicus
taagctcgtgatcacgaaataaggc

SEQ ID NO: 545236 - DNA, 25 bp, Rattus norvegicus
catgtgggtgcagcttaagttcgtc

SEQ ID NO: 545237 - DNA, 25 bp, Rattus norvegicus
tcgtcctcaaaaacataagctcgtg

SEQ ID NO: 545238 - DNA, 25 bp, Rattus norvegicus
ggtgcagcttaagttcgtcctcaaa

SEQ ID NO: 545239 - DNA, 25 bp, Rattus norvegicus
cgagaaagttacctgagatacgagg

SEQ ID NO: 545240 - DNA, 25 bp, Rattus norvegicus
cacgggaagataacctgcttcaaca

SEQ ID NO: 545241 - DNA, 25 bp, Rattus norvegicus
gtcttcatcatcacggcctgttacc

SEQ ID NO: 545242 - DNA, 25 bp, Rattus norvegicus
tgttacctcaccatcgtcttcaagt

SEQ ID NO: 545243 - DNA, 25 bp, Rattus norvegicus
catcgtcttcaagttgcagcgcaac

SEQ ID NO: 545244 - DNA, 25 bp, Rattus norvegicus
atgtggcggtcaccgtcacccgctt

SEQ ID NO: 545245 - DNA, 25 bp, Rattus norvegicus
tacagcagacatgtggcggtcaccg

SEQ ID NO: 545246 - DNA, 25 bp, Rattus norvegicus
tgcttcaacaacttcagcctggccg

SEQ ID NO: 545247 - DNA, 25 bp, Rattus norvegicus
caccagccacgggaagataacctgc

SEQ ID NO: 545248 - DNA, 25 bp, Rattus norvegicus
tcgtcttccgggacacggtcagcac

SEQ ID NO: 545249 - DNA, 25 bp, Rattus norvegicus
ttgtctgggtcctggctttcttcct

SEQ ID NO: 545250 - DNA, 25 bp, Rattus norvegicus
cctacatgacctgcgtggttgtctg

SEQ ID NO: 545251 - DNA, 25 bp, Rattus norvegicus
tgcgtctggcctacatgacctgcgt

SEQ ID NO: 545252 - DNA, 25 bp, Rattus norvegicus
agaaccaccgcagcgtgcgtctggc

SEQ ID NO: 545253 - DNA, 25 bp, Rattus norvegicus
acccggtagggtacagcagacatgt

SEQ ID NO: 545254 - DNA, 25 bp, Rattus norvegicus
ccaggcgctccctcctgtacctttg

SEQ ID NO: 545255 - DNA, 25 bp, Rattus norvegicus
atggtccgcccgcttcgccagtggt

SEQ ID NO: 545256 - DNA, 25 bp, Rattus norvegicus
gggtcttgatgcagatggtccgccc

SEQ ID NO: 545257 - DNA, 25 bp, Rattus norvegicus
tcgatctccttctggccgctctcgt

SEQ ID NO: 545258 - DNA, 25 bp, Rattus norvegicus
agcccgagtcgaaggcctcgatctc

SEQ ID NO: 545259 - DNA, 25 bp, Rattus norvegicus
atgagcaagatagcccgagtcgaag

SEQ ID NO: 545260 - DNA, 25 bp, Rattus norvegicus
ccatatttgcggttgaactctgcca

SEQ ID NO: 545261 - DNA, 25 bp, Rattus norvegicus
gttgcggatgagcaagatagcccga

SEQ ID NO: 545262 - DNA, 25 bp, Rattus norvegicus
gttgaactctgccatgagggccttg

SEQ ID NO: 545263 - DNA, 25 bp, Rattus norvegicus
ggcctccatatttgcggttgaactc

SEQ ID NO: 545264 - DNA, 25 bp, Rattus norvegicus
cggcaaagcctatgtggcctccata

SEQ ID NO: 545265 - DNA, 25 bp, Rattus norvegicus
ctttgcctttccagtgggcgtgggc

SEQ ID NO: 545266 - DNA, 25 bp, Rattus norvegicus
tgtacctttgcctttccagtgggcg

SEQ ID NO: 545267 - DNA, 25 bp, Rattus norvegicus
actctgccatgagggccttgtaggg

SEQ ID NO: 545268 - DNA, 25 bp, Rattus norvegicus
ggccgctgcttacctgaggatgcgc

SEQ ID NO: 545269 - DNA, 25 bp, Rattus norvegicus
ctcgtccgcggctagaggaaagttt

SEQ ID NO: 545270 - DNA, 25 bp, Rattus norvegicus
ccgcggctagaggaaagtttgtcat

SEQ ID NO: 545271 - DNA, 25 bp, Rattus norvegicus
gctagaggaaagtttgtcatctccc

SEQ ID NO: 545272 - DNA, 25 bp, Rattus norvegicus
ctagggacccgtggccgctgcttac

SEQ ID NO: 545273 - DNA, 25 bp, Rattus norvegicus
cttacctgaggatgcgccgagctct

SEQ ID NO: 545274 - DNA, 25 bp, Rattus norvegicus
gaggatgcgccgagctctccgtgcc

SEQ ID NO: 545275 - DNA, 25 bp, Rattus norvegicus
ccggccctgctggagcagtctgcag

SEQ ID NO: 545276 - DNA, 25 bp, Rattus norvegicus
cgcccgcgcttaactccttgcgttc

SEQ ID NO: 545277 - DNA, 25 bp, Rattus norvegicus
gtgcagtgcgctgagctccactcct

SEQ ID NO: 545278 - DNA, 25 bp, Rattus norvegicus
gctgcggctaaatgcgctgagaccc

SEQ ID NO: 545279 - DNA, 25 bp, Rattus norvegicus
taaatgcgctgagacccggcgaagg

SEQ ID NO: 545280 - DNA, 25 bp, Rattus norvegicus
cgccgcaagtcttggccctgagccc

SEQ ID NO: 545281 - DNA, 25 bp, Rattus norvegicus
ggagcctcctgtcgcctctctgcag

SEQ ID NO: 545282 - DNA, 25 bp, Rattus norvegicus
ggccaccctagggtgacagggccac

SEQ ID NO: 545283 - DNA, 25 bp, Rattus norvegicus
gtgacagggccaccgcggacacctg

SEQ ID NO: 545284 - DNA, 25 bp, Rattus norvegicus
tgctgcgcaccgtgaagaaggaggt

SEQ ID NO: 545285 - DNA, 25 bp, Rattus norvegicus
gagacccgccagaggctgctgcgca

SEQ ID NO: 545286 - DNA, 25 bp, Rattus norvegicus
cagaggccgagacccgccagaggct

SEQ ID NO: 545287 - DNA, 25 bp, Rattus norvegicus
accgcgcttccctgcttgtcccgca

SEQ ID NO: 545288 - DNA, 25 bp, Rattus norvegicus
ggcttcggtccctgcgggtaagcac

SEQ ID NO: 545289 - DNA, 25 bp, Rattus norvegicus
gggcacccggtaccgaccagcttga

SEQ ID NO: 545290 - DNA, 25 bp, Rattus norvegicus
gacgtccgcatcctgggctgtcatt

SEQ ID NO: 545291 - DNA, 25 bp, Rattus norvegicus
tgtcaggttctgacgtccgcatcct

SEQ ID NO: 545292 - DNA, 25 bp, Rattus norvegicus
tgacttgggcggtttgtcaggttct

SEQ ID NO: 545293 - DNA, 25 bp, Rattus norvegicus
ctctcacgggtgacttgggcggttt

SEQ ID NO: 545294 - DNA, 25 bp, Rattus norvegicus
ggcgctgagctctcacgggtgactt

SEQ ID NO: 545295 - DNA, 25 bp, Rattus norvegicus
accgaccagcttgagccatggcttc

SEQ ID NO: 545296 - DNA, 25 bp, Rattus norvegicus
cttcctgcgaagcaacaagatcgcg

SEQ ID NO: 545297 - DNA, 25 bp, Rattus norvegicus
gcacgtgcgcgttagctgccaacct

SEQ ID NO: 545298 - DNA, 25 bp, Rattus norvegicus
cttgactcctttggcgcacctgaca

SEQ ID NO: 545299 - DNA, 25 bp, Rattus norvegicus
tcctttggcgcacctgacaagccgg

SEQ ID NO: 545300 - DNA, 25 bp, Rattus norvegicus
cacgggtgcggtttctctgcactgt

SEQ ID NO: 545301 - DNA, 25 bp, Rattus norvegicus
ctctgcactgttgtcgctcttggtg

SEQ ID NO: 545302 - DNA, 25 bp, Rattus norvegicus
gctcttggtgctggggactgtacac

SEQ ID NO: 545303 - DNA, 25 bp, Rattus norvegicus
tgctggggactgtacacaagagaca

SEQ ID NO: 545304 - DNA, 25 bp, Rattus norvegicus
gtacacaagagacagggcagctagc

SEQ ID NO: 545305 - DNA, 25 bp, Rattus norvegicus
cgcgttagctgccaacctctcttga

SEQ ID NO: 545306 - DNA, 25 bp, Rattus norvegicus
ggccggcttcctgcgaagcaacaag

SEQ ID NO: 545307 - DNA, 25 bp, Rattus norvegicus
tgcgaagcaacaagatcgcggcgct

SEQ ID NO: 545308 - DNA, 25 bp, Rattus norvegicus
aacctctcttgactcctttggcgca

SEQ ID NO: 545309 - DNA, 25 bp, Rattus norvegicus
agggcagctagcgaccaccatgtcc

SEQ ID NO: 545310 - DNA, 25 bp, Rattus norvegicus
atgcttgcgctctgccgccacccgc

SEQ ID NO: 545311 - DNA, 25 bp, Rattus norvegicus
ggtgagagaccgatgcttgcgctct

SEQ ID NO: 545312 - DNA, 25 bp, Rattus norvegicus
gtgagagaccgatgcttgcgctctg

SEQ ID NO: 545313 - DNA, 25 bp, Rattus norvegicus
tgagagaccgatgcttgcgctctgc

SEQ ID NO: 545314 - DNA, 25 bp, Rattus norvegicus
cgatgcttgcgctctgccgccaccc

SEQ ID NO: 545315 - DNA, 25 bp, Rattus norvegicus
cgctggccattctgggaaccgcgcc

SEQ ID NO: 545316 - DNA, 25 bp, Rattus norvegicus
ccgctggccattctgggaaccgcgc

SEQ ID NO: 545317 - DNA, 25 bp, Rattus norvegicus
cccgctggccattctgggaaccgcg

SEQ ID NO: 545318 - DNA, 25 bp, Rattus norvegicus
acccgctggccattctgggaaccgc

SEQ ID NO: 545319 - DNA, 25 bp, Rattus norvegicus
cacccgctggccattctgggaaccg

SEQ ID NO: 545320 - DNA, 25 bp, Rattus norvegicus
ccacccgctggccattctgggaacc

SEQ ID NO: 545321 - DNA, 25 bp, Rattus norvegicus
ccgccacccgctggccattctggga

SEQ ID NO: 545322 - DNA, 25 bp, Rattus norvegicus
tgcttgcgctctgccgccacccgct

SEQ ID NO: 545323 - DNA, 25 bp, Rattus norvegicus
gagagaccgatgcttgcgctctgcc

SEQ ID NO: 545324 - DNA, 25 bp, Rattus norvegicus
gtagaaaacagcaggtgagagaccg

SEQ ID NO: 545325 - DNA, 25 bp, Rattus norvegicus
ccctgttcgagagggtcctggacaa

SEQ ID NO: 545326 - DNA, 25 bp, Rattus norvegicus
ggacaaaatcgtccactacctggta

SEQ ID NO: 545327 - DNA, 25 bp, Rattus norvegicus
gggtcctggacaaaatcgtccacta

SEQ ID NO: 545328 - DNA, 25 bp, Rattus norvegicus
cgtcttaaaggcgaaaccagatcca

SEQ ID NO: 545329 - DNA, 25 bp, Rattus norvegicus
atccgcaccgccctgttcgagaggg

SEQ ID NO: 545330 - DNA, 25 bp, Rattus norvegicus
atcaagcacctgtggatccgcaccg

SEQ ID NO: 545331 - DNA, 25 bp, Rattus norvegicus
ccgctggccatcaagcacctgtgga

SEQ ID NO: 545332 - DNA, 25 bp, Rattus norvegicus
gaagctgccgaagctacccaacctg

SEQ ID NO: 545333 - DNA, 25 bp, Rattus norvegicus
aacgtgcggaagctgccgaagctac

SEQ ID NO: 545334 - DNA, 25 bp, Rattus norvegicus
ctgcaagagaacgtgcggaagctgc

SEQ ID NO: 545335 - DNA, 25 bp, Rattus norvegicus
atccagggcctgcaagagaacgtgc

SEQ ID NO: 545336 - DNA, 25 bp, Rattus norvegicus
ggcgaaaccagatccagggcctgca

SEQ ID NO: 545337 - DNA, 25 bp, Rattus norvegicus
ccactacctggtagaaaacagcagg

SEQ ID NO: 545338 - DNA, 25 bp, Rattus norvegicus
ccgcggtgacaaagatgtgtaactt

SEQ ID NO: 545339 - DNA, 25 bp, Rattus norvegicus
ggcgcctgttgcagagagctgtccc

SEQ ID NO: 545340 - DNA, 25 bp, Rattus norvegicus
agggctgaccttcctcaggccagga

SEQ ID NO: 545341 - DNA, 25 bp, Rattus norvegicus
tggaggcttcaagcggccaactttc

SEQ ID NO: 545342 - DNA, 25 bp, Rattus norvegicus
aatgccgcgtccgtccagcagcggg

SEQ ID NO: 545343 - DNA, 25 bp, Rattus norvegicus
gcgtgcctcaggatcacgccgtgca

SEQ ID NO: 545344 - DNA, 25 bp, Rattus norvegicus
aatgaaccgaacaaggcagttgatc

SEQ ID NO: 545345 - DNA, 25 bp, Rattus norvegicus
cttggactttcttctactggggcga

SEQ ID NO: 545346 - DNA, 25 bp, Rattus norvegicus
accgagacttttggtggaggcttca

SEQ ID NO: 545347 - DNA, 25 bp, Rattus norvegicus
cagttgatcaggaatgcgcagtcgc

SEQ ID NO: 545348 - DNA, 25 bp, Rattus norvegicus
gcaggtgggcagtgctcagtcaccc

SEQ ID NO: 545349 - DNA, 25 bp, Rattus norvegicus
ccttgattgggaccatggcgcaatg

SEQ ID NO: 545350 - DNA, 25 bp, Rattus norvegicus
cgctggggctggttaatctgtaacc

SEQ ID NO: 545351 - DNA, 25 bp, Rattus norvegicus
ggaatcccgttgcatctgctgccgg

SEQ ID NO: 545352 - DNA, 25 bp, Rattus norvegicus
ttccaagaggcgctgcacttggtga

SEQ ID NO: 545353 - DNA, 25 bp, Rattus norvegicus
ggagccgagagtccttccgccgctt

SEQ ID NO: 545354 - DNA, 25 bp, Rattus norvegicus
ctcaggaagagacagccggactccg

SEQ ID NO: 545355 - DNA, 25 bp, Rattus norvegicus
ggttctcgtccctcaggaagagaca

SEQ ID NO: 545356 - DNA, 25 bp, Rattus norvegicus
cagaggttctcgtccctcaggaaga

SEQ ID NO: 545357 - DNA, 25 bp, Rattus norvegicus
agccagcagaggttctcgtccctca

SEQ ID NO: 545358 - DNA, 25 bp, Rattus norvegicus
tgaggcggtccttccaagaggcgct

SEQ ID NO: 545359 - DNA, 25 bp, Rattus norvegicus
ttctccgcacgcagccagcagaggt

SEQ ID NO: 545360 - DNA, 25 bp, Rattus norvegicus
gacacctggcctctcggagccgaga

SEQ ID NO: 545361 - DNA, 25 bp, Rattus norvegicus
gcacctcctccttcagacacctggc

SEQ ID NO: 545362 - DNA, 25 bp, Rattus norvegicus
gttcaagcgcacctcctccttcaga

SEQ ID NO: 545363 - DNA, 25 bp, Rattus norvegicus
cgctgcacttggtgacggccacggt

SEQ ID NO: 545364 - DNA, 25 bp, Rattus norvegicus
ggtccttccaagaggcgctgcactt

SEQ ID NO: 545365 - DNA, 25 bp, Rattus norvegicus
cacgcagccagcagaggttctcgtc

SEQ ID NO: 545366 - DNA, 25 bp, Rattus norvegicus
gactgatggccttcccggacagcct

SEQ ID NO: 545367 - DNA, 25 bp, Rattus norvegicus
gctggctcatggcatccaggcgcgc

SEQ ID NO: 545368 - DNA, 25 bp, Rattus norvegicus
ttcctccgcagtgggcgctgccagg

SEQ ID NO: 545369 - DNA, 25 bp, Rattus norvegicus
aggtccaggttcttgcggcggccct

SEQ ID NO: 545370 - DNA, 25 bp, Rattus norvegicus
tcacagatgtgctgcgaagctgcgc

SEQ ID NO: 545371 - DNA, 25 bp, Rattus norvegicus
ggatgcgccgctgaaaccacacgct

SEQ ID NO: 545372 - DNA, 25 bp, Rattus norvegicus
tcccggacagcctcgatgtgctgca

SEQ ID NO: 545373 - DNA, 25 bp, Rattus norvegicus
cgctccttgtgccacgtgcgtgagc

SEQ ID NO: 545374 - DNA, 25 bp, Rattus norvegicus
atgtgctgcacgaagactgtgatca

SEQ ID NO: 545375 - DNA, 25 bp, Rattus norvegicus
cgaagactgtgatcaagacagggtc

SEQ ID NO: 545376 - DNA, 25 bp, Rattus norvegicus
aagacagggtcagacgtcagccatg

SEQ ID NO: 545377 - DNA, 25 bp, Rattus norvegicus
agacgtcagccatggcgccatctgc

SEQ ID NO: 545378 - DNA, 25 bp, Rattus norvegicus
tgacccactcacagatgtgctgcga

SEQ ID NO: 545379 - DNA, 25 bp, Rattus norvegicus
tgggcgctgccaggtccaggttctt

SEQ ID NO: 545380 - DNA, 25 bp, Rattus norvegicus
tacagcatgaagagaatcccggagc

SEQ ID NO: 545381 - DNA, 25 bp, Rattus norvegicus
aggcagcacgagattaaggtggcaa

SEQ ID NO: 545382 - DNA, 25 bp, Rattus norvegicus
ttaaggtggcaaaaggcgtgtcgcc

SEQ ID NO: 545383 - DNA, 25 bp, Rattus norvegicus
gcgtgtcgccgctgcgaagtcactc

SEQ ID NO: 545384 - DNA, 25 bp, Rattus norvegicus
gaagtcactccaccgtgtccgcggg

SEQ ID NO: 545385 - DNA, 25 bp, Rattus norvegicus
cccgccgaggagtacagcatgaaga

SEQ ID NO: 545386 - DNA, 25 bp, Rattus norvegicus
cgcgaaaggccgtcgtgcagctact

SEQ ID NO: 545387 - DNA, 25 bp, Rattus norvegicus
aacattcgaaagagccagcggcgcg

SEQ ID NO: 545388 - DNA, 25 bp, Rattus norvegicus
ctgtgtcttcgccaggcctgaggtc

SEQ ID NO: 545389 - DNA, 25 bp, Rattus norvegicus
caggcctgaggtcgccgtaaactct

SEQ ID NO: 545390 - DNA, 25 bp, Rattus norvegicus
tgaggtcgccgtaaactctagagac

SEQ ID NO: 545391 - DNA, 25 bp, Rattus norvegicus
cgtaaactctagagacggagcgtca

SEQ ID NO: 545392 - DNA, 25 bp, Rattus norvegicus
tctagagacggagcgtcactagggc

SEQ ID NO: 545393 - DNA, 25 bp, Rattus norvegicus
cgacgagcagcaacattcgaaagag

SEQ ID NO: 545394 - DNA, 25 bp, Rattus norvegicus
gagtaacaggcattcccgggagaga

SEQ ID NO: 545395 - DNA, 25 bp, Rattus norvegicus
tcggagccacgcagctaagcaagtg

SEQ ID NO: 545396 - DNA, 25 bp, Rattus norvegicus
tgaccaagaacaactcgagtcgatg

SEQ ID NO: 545397 - DNA, 25 bp, Rattus norvegicus
taagcaagtgtcacacgtcccagtc

SEQ ID NO: 545398 - DNA, 25 bp, Rattus norvegicus
aacccaggcggagtaacaggcattc

SEQ ID NO: 545399 - DNA, 25 bp, Rattus norvegicus
agctcggcttccatgaccaagaaca

SEQ ID NO: 545400 - DNA, 25 bp, Rattus norvegicus
agacgaggagacgtctgcgctccac

SEQ ID NO: 545401 - DNA, 25 bp, Rattus norvegicus
cagtcactcagctcggcttccatga

SEQ ID NO: 545402 - DNA, 25 bp, Rattus norvegicus
tgcgctccacgaagcaaaccgcgtg

SEQ ID NO: 545403 - DNA, 25 bp, Rattus norvegicus
ccgcgggatagagacggcaataacc

SEQ ID NO: 545404 - DNA, 25 bp, Rattus norvegicus
cggcaataaccagaagaagcgtgta

SEQ ID NO: 545405 - DNA, 25 bp, Rattus norvegicus
gaagcgtgtaaaccggccatgcaga

SEQ ID NO: 545406 - DNA, 25 bp, Rattus norvegicus
gccatgcagacacgctacacggatg

SEQ ID NO: 545407 - DNA, 25 bp, Rattus norvegicus
ctcgagtcgatgtagaacccaggcg

SEQ ID NO: 545408 - DNA, 25 bp, Rattus norvegicus
aaatcaatttagttcaccaggcagc

SEQ ID NO: 545409 - DNA, 25 bp, Rattus norvegicus
ctccttcgcaagaagagccgttctg

SEQ ID NO: 545410 - DNA, 25 bp, Rattus norvegicus
acagattcattaagctcgctccaga

SEQ ID NO: 545411 - DNA, 25 bp, Rattus norvegicus
ttaagctcgctccagagcaacgata

SEQ ID NO: 545412 - DNA, 25 bp, Rattus norvegicus
ccagagcaacgataaaaaatcaatt

SEQ ID NO: 545413 - DNA, 25 bp, Rattus norvegicus
gccgtcactaacagattcattaagc

SEQ ID NO: 545414 - DNA, 25 bp, Rattus norvegicus
accaggcagcttgagcgggcgccaa

SEQ ID NO: 545415 - DNA, 25 bp, Rattus norvegicus
gcccatccgtgaacccggcagcaga

SEQ ID NO: 545416 - DNA, 25 bp, Rattus norvegicus
ggcagccgtcactaacagattcatt

SEQ ID NO: 545417 - DNA, 25 bp, Rattus norvegicus
cggagccaggagtgtagcgatactc

SEQ ID NO: 545418 - DNA, 25 bp, Rattus norvegicus
ggcaggcagccgtcactaacagatt

SEQ ID NO: 545419 - DNA, 25 bp, Rattus norvegicus
cactgagaggcttttggggcaggca

SEQ ID NO: 545420 - DNA, 25 bp, Rattus norvegicus
ttcgcaagaagagccgttctggtgg

SEQ ID NO: 545421 - DNA, 25 bp, Rattus norvegicus
cgctccagagcaacgataaaaaatc

SEQ ID NO: 545422 - DNA, 25 bp, Rattus norvegicus
gagctccgctttcccgtagcagctg

SEQ ID NO: 545423 - DNA, 25 bp, Rattus norvegicus
aatctcaacggctccgggccggagc

SEQ ID NO: 545424 - DNA, 25 bp, Rattus norvegicus
acagacaccatagagctccgctttc

SEQ ID NO: 545425 - DNA, 25 bp, Rattus norvegicus
ctcacacattcagatttgcgcgctg

SEQ ID NO: 545426 - DNA, 25 bp, Rattus norvegicus
ttgcgcgctgtttcaatcctcggtg

SEQ ID NO: 545427 - DNA, 25 bp, Rattus norvegicus
caatcctcggtgacgtgtcctcgca

SEQ ID NO: 545428 - DNA, 25 bp, Rattus norvegicus
gcgctggctggagagtaatgttaca

SEQ ID NO: 545429 - DNA, 25 bp, Rattus norvegicus
agcacgggccgcgaatctcaacggc

SEQ ID NO: 545430 - DNA, 25 bp, Rattus norvegicus
gctctcacagccattgcagtacatt

SEQ ID NO: 545431 - DNA, 25 bp, Rattus norvegicus
tgcagtacattgagctccatagaga

SEQ ID NO: 545432 - DNA, 25 bp, Rattus norvegicus
ctccatagagacagcgccggggcaa

SEQ ID NO: 545433 - DNA, 25 bp, Rattus norvegicus
ggcactgggcgactctgtgcctcgc

SEQ ID NO: 545434 - DNA, 25 bp, Rattus norvegicus
gcgcacgggctctggtcaggacaat

SEQ ID NO: 545435 - DNA, 25 bp, Rattus norvegicus
ggcagacgcaggcacacagacacca

SEQ ID NO: 545436 - DNA, 25 bp, Rattus norvegicus
ccgaagtgcccgaactgtggaagtc

SEQ ID NO: 545437 - DNA, 25 bp, Rattus norvegicus
tggcagctgcccttcagagtcagag

SEQ ID NO: 545438 - DNA, 25 bp, Rattus norvegicus
ctgctgaccaccgaagaagccgtgc

SEQ ID NO: 545439 - DNA, 25 bp, Rattus norvegicus
gctgaccgtgcattttggacaaacc

SEQ ID NO: 545440 - DNA, 25 bp, Rattus norvegicus
tggcgacccgcagcataatgtggca

SEQ ID NO: 545441 - DNA, 25 bp, Rattus norvegicus
tgtcaaaatgtcctgagggcggctc

SEQ ID NO: 545442 - DNA, 25 bp, Rattus norvegicus
cggctcgctcgggtaattgtattcc

SEQ ID NO: 545443 - DNA, 25 bp, Rattus norvegicus
attccagcgaatctacggctccttg

SEQ ID NO: 545444 - DNA, 25 bp, Rattus norvegicus
ccggggttccaagctgtgagaatcc

SEQ ID NO: 545445 - DNA, 25 bp, Rattus norvegicus
tccgccatgtgctcgtaactctctg

SEQ ID NO: 545446 - DNA, 25 bp, Rattus norvegicus
ggctccatattcaaacccaagatcg

SEQ ID NO: 545447 - DNA, 25 bp, Rattus norvegicus
aggggccttaaagtgagcgttcata

SEQ ID NO: 545448 - DNA, 25 bp, Rattus norvegicus
ttggacaaacccaccatgcctgagg

SEQ ID NO: 545449 - DNA, 25 bp, Rattus norvegicus
ccagagcgcttattgcagggtccac

SEQ ID NO: 545450 - DNA, 25 bp, Rattus norvegicus
tgcggtcataaagcagaaatgtctc

SEQ ID NO: 545451 - DNA, 25 bp, Rattus norvegicus
gcggtgatcgccgaacggctcgtaa

SEQ ID NO: 545452 - DNA, 25 bp, Rattus norvegicus
tcgttgggtcatgcgtgccacaggc

SEQ ID NO: 545453 - DNA, 25 bp, Rattus norvegicus
ccttcgttgggtcatgcgtgccaca

SEQ ID NO: 545454 - DNA, 25 bp, Rattus norvegicus
agctgagcggccttcgttgggtcat

SEQ ID NO: 545455 - DNA, 25 bp, Rattus norvegicus
agcagaaatgtctcctcgcaaaaaa

SEQ ID NO: 545456 - DNA, 25 bp, Rattus norvegicus
agagcgcatgcggtcataaagcaga

SEQ ID NO: 545457 - DNA, 25 bp, Rattus norvegicus
tcgccgaacggctcgtaaactgtgg

SEQ ID NO: 545458 - DNA, 25 bp, Rattus norvegicus
gccagggagcaacgggcacccagtt

SEQ ID NO: 545459 - DNA, 25 bp, Rattus norvegicus
ggagcaacgggcacccagttaattc

SEQ ID NO: 545460 - DNA, 25 bp, Rattus norvegicus
cgggcacccagttaattcattaaga

SEQ ID NO: 545461 - DNA, 25 bp, Rattus norvegicus
gcacccagttaattcattaagatga

SEQ ID NO: 545462 - DNA, 25 bp, Rattus norvegicus
ggaaagagagcgcatgcggtcataa

SEQ ID NO: 545463 - DNA, 25 bp, Rattus norvegicus
ctcgcaaaaaaacgggagagagctg

SEQ ID NO: 545464 - DNA, 25 bp, Rattus norvegicus
acgagacctccactgcggctgcgtg

SEQ ID NO: 545465 - DNA, 25 bp, Rattus norvegicus
atcttccgggaagccctcacagctg

SEQ ID NO: 545466 - DNA, 25 bp, Rattus norvegicus
attccttaatcagcaccatcttccg

SEQ ID NO: 545467 - DNA, 25 bp, Rattus norvegicus
ctcaaagagggagcctacgaagacc

SEQ ID NO: 545468 - DNA, 25 bp, Rattus norvegicus
cgcacagggccttgaggctcaaaga

SEQ ID NO: 545469 - DNA, 25 bp, Rattus norvegicus
caggctcgaattagagggcgacacc

SEQ ID NO: 545470 - DNA, 25 bp, Rattus norvegicus
ctacagtagggttcactgagcctgc

SEQ ID NO: 545471 - DNA, 25 bp, Rattus norvegicus
ttggcgcgctcctgaagcttggagt

SEQ ID NO: 545472 - DNA, 25 bp, Rattus norvegicus
cttggagtgcgcctgcgtacactcg

SEQ ID NO: 545473 - DNA, 25 bp, Rattus norvegicus
ctgtgtctctcaggccaactgtgca

SEQ ID NO: 545474 - DNA, 25 bp, Rattus norvegicus
gcagactgcgttttcgagtgaattc

SEQ ID NO: 545475 - DNA, 25 bp, Rattus norvegicus
ctcacacaggtgtggaagccggcga

SEQ ID NO: 545476 - DNA, 25 bp, Rattus norvegicus
ggggccctaaacgacatcatgctca

SEQ ID NO: 545477 - DNA, 25 bp, Rattus norvegicus
gtgaattctcctgtcggggccctaa

SEQ ID NO: 545478 - DNA, 25 bp, Rattus norvegicus
acagacagccgcaggtccaggaggt

SEQ ID NO: 545479 - DNA, 25 bp, Rattus norvegicus
atcctgcacccgcagtgactcgggg

SEQ ID NO: 545480 - DNA, 25 bp, Rattus norvegicus
tagcttcacagacagccgcaggtcc

SEQ ID NO: 545481 - DNA, 25 bp, Rattus norvegicus
tgctttccacatcacttgcgtcatc

SEQ ID NO: 545482 - DNA, 25 bp, Rattus norvegicus
aggaaggcccgtgtcagtgccacca

SEQ ID NO: 545483 - DNA, 25 bp, Rattus norvegicus
ttgcgtcatcctgcacccgcagtga

SEQ ID NO: 545484 - DNA, 25 bp, Rattus norvegicus
tgagcaccactagcttcacagacag

SEQ ID NO: 545485 - DNA, 25 bp, Rattus norvegicus
tcctgggaagagctgagcaccacta

SEQ ID NO: 545486 - DNA, 25 bp, Rattus norvegicus
ctgtgacgcggctgttggcctcctg

SEQ ID NO: 545487 - DNA, 25 bp, Rattus norvegicus
tgggcagtctgagatgctttccaca

SEQ ID NO: 545488 - DNA, 25 bp, Rattus norvegicus
ggccacagagccacgagtacgcact

SEQ ID NO: 545489 - DNA, 25 bp, Rattus norvegicus
caccagcagctaggaaggcccgtgt

SEQ ID NO: 545490 - DNA, 25 bp, Rattus norvegicus
tacgcactgcgcaccagcagctagg

SEQ ID NO: 545491 - DNA, 25 bp, Rattus norvegicus
aggccatccgctgtgacgcggctgt

SEQ ID NO: 545492 - DNA, 25 bp, Rattus norvegicus
ccattgtgtattttccgagggccat

SEQ ID NO: 545493 - DNA, 25 bp, Rattus norvegicus
cgtgtaagtacgtctagccctgttc

SEQ ID NO: 545494 - DNA, 25 bp, Rattus norvegicus
cgacggacaggtactgctcgtagta

SEQ ID NO: 545495 - DNA, 25 bp, Rattus norvegicus
gctcgtagtacttgatggcttcctc

SEQ ID NO: 545496 - DNA, 25 bp, Rattus norvegicus
gcacggactcgttcccactgagctg

SEQ ID NO: 545497 - DNA, 25 bp, Rattus norvegicus
gccagctgctgctcaaagtagccga

SEQ ID NO: 545498 - DNA, 25 bp, Rattus norvegicus
gatggcgtcctccaccacgttcatg

SEQ ID NO: 545499 - DNA, 25 bp, Rattus norvegicus
ggccttgtcatacttctggaccatg

SEQ ID NO: 545500 - DNA, 25 bp, Rattus norvegicus
agctgctcctggtaacacttgaacg

SEQ ID NO: 545501 - DNA, 25 bp, Rattus norvegicus
cgtgtgatagcccaaggccttgtca

SEQ ID NO: 545502 - DNA, 25 bp, Rattus norvegicus
ccggcaggtcgctcagttcctgata

SEQ ID NO: 545503 - DNA, 25 bp, Rattus norvegicus
tgatgcccatgttgccgtacacctg

SEQ ID NO: 545504 - DNA, 25 bp, Rattus norvegicus
agacctccagctcctgcgtgtgata

SEQ ID NO: 545505 - DNA, 25 bp, Rattus norvegicus
tggccaccgtacctgtgtccgtttc

SEQ ID NO: 545506 - DNA, 25 bp, Rattus norvegicus
cgtagataacccacgcgaaggcgcg

SEQ ID NO: 545507 - DNA, 25 bp, Rattus norvegicus
tgcaggcgtagataacccacgcgaa

SEQ ID NO: 545508 - DNA, 25 bp, Rattus norvegicus
gcagctgtgaaaatgcaggcgtaga

SEQ ID NO: 545509 - DNA, 25 bp, Rattus norvegicus
tgtggatttgaaccagcagcagctg

SEQ ID NO: 545510 - DNA, 25 bp, Rattus norvegicus
atgggccgttttgtgtctgtggatt

SEQ ID NO: 545511 - DNA, 25 bp, Rattus norvegicus
aacgctcagatgctcatgggccgtt

SEQ ID NO: 545512 - DNA, 25 bp, Rattus norvegicus
aagggaaacgaacgctcagatgctc

SEQ ID NO: 545513 - DNA, 25 bp, Rattus norvegicus
tggacttcaaccgagaattaacctc

SEQ ID NO: 545514 - DNA, 25 bp, Rattus norvegicus
aggctattctggacttcaaccgaga

SEQ ID NO: 545515 - DNA, 25 bp, Rattus norvegicus
gtagtctgaagaagtaaggctattc

SEQ ID NO: 545516 - DNA, 25 bp, Rattus norvegicus
tagcagcgtgctgaggtagtctgaa

SEQ ID NO: 545517 - DNA, 25 bp, Rattus norvegicus
ttatcacacgcgtgtagcagcgtgc

SEQ ID NO: 545518 - DNA, 25 bp, Rattus norvegicus
gagagcggagactttcgggcttccc

SEQ ID NO: 545519 - DNA, 25 bp, Rattus norvegicus
aacccagttatcacacgcgtgtagc

SEQ ID NO: 545520 - DNA, 25 bp, Rattus norvegicus
ttcttccggggctgccatttcatca

SEQ ID NO: 545521 - DNA, 25 bp, Rattus norvegicus
tctttcccggataggataggacgga

SEQ ID NO: 545522 - DNA, 25 bp, Rattus norvegicus
cactcactctccctcggggctagga

SEQ ID NO: 545523 - DNA, 25 bp, Rattus norvegicus
gaacggggcatgttccctgacccgc

SEQ ID NO: 545524 - DNA, 25 bp, Rattus norvegicus
cccgcgcctgcgaaaaggctccagg

SEQ ID NO: 545525 - DNA, 25 bp, Rattus norvegicus
tcggttcagcgcgaagtaccgcggc

SEQ ID NO: 545526 - DNA, 25 bp, Rattus norvegicus
tccaggaaggagctctccgatgggc

SEQ ID NO: 545527 - DNA, 25 bp, Rattus norvegicus
acagtcttcgtcttcggttcagcgc

SEQ ID NO: 545528 - DNA, 25 bp, Rattus norvegicus
taggataggacggacagtcttcgtc

SEQ ID NO: 545529 - DNA, 25 bp, Rattus norvegicus
gcaagtcatgctgcctccttgaacc

SEQ ID NO: 545530 - DNA, 25 bp, Rattus norvegicus
cggcgactgcaagtcatgctgcctc

SEQ ID NO: 545531 - DNA, 25 bp, Rattus norvegicus
gccgacccgggacgcatcaagaggt

SEQ ID NO: 545532 - DNA, 25 bp, Rattus norvegicus
cggggctgccatttcatcatatttg

SEQ ID NO: 545533 - DNA, 25 bp, Rattus norvegicus
atcatatttgtacagccgacccggg

SEQ ID NO: 545534 - DNA, 25 bp, Rattus norvegicus
cctgtgctgctgttgtagaaaaata

SEQ ID NO: 545535 - DNA, 25 bp, Rattus norvegicus
ttctccgctaggacagctgccctaa

SEQ ID NO: 545536 - DNA, 25 bp, Rattus norvegicus
gacagctgccctaactcgggcttta

SEQ ID NO: 545537 - DNA, 25 bp, Rattus norvegicus
actcgggctttaacttaatcacacg

SEQ ID NO: 545538 - DNA, 25 bp, Rattus norvegicus
tttaacttaatcacacgaggcggcg

SEQ ID NO: 545539 - DNA, 25 bp, Rattus norvegicus
aacttaatcacacgaggcggcggcg

SEQ ID NO: 545540 - DNA, 25 bp, Rattus norvegicus
cggcggaaaccagcgaacctcaaca

SEQ ID NO: 545541 - DNA, 25 bp, Rattus norvegicus
aacgtagaaaagaagctcccgcagc

SEQ ID NO: 545542 - DNA, 25 bp, Rattus norvegicus
agaaaagaagctcccgcagcttggc

SEQ ID NO: 545543 - DNA, 25 bp, Rattus norvegicus
cttggcgcgcgcctaggttctggtt

SEQ ID NO: 545544 - DNA, 25 bp, Rattus norvegicus
aggagtctgattagccggatgcttc

SEQ ID NO: 545545 - DNA, 25 bp, Rattus norvegicus
agccggatgcttctccgctaggaca

SEQ ID NO: 545546 - DNA, 25 bp, Rattus norvegicus
ggaaaccagcgaacctcaacatctg

SEQ ID NO: 545547 - DNA, 25 bp, Rattus norvegicus
ctcaacatctgggttcctgtgctgc

SEQ ID NO: 545548 - DNA, 25 bp, Rattus norvegicus
tcggcgtctgcctagagctaacggt

SEQ ID NO: 545549 - DNA, 25 bp, Rattus norvegicus
caccagtgtaggtgactcggcgaac

SEQ ID NO: 545550 - DNA, 25 bp, Rattus norvegicus
gggcgcgtaaagacgcaccagtgta

SEQ ID NO: 545551 - DNA, 25 bp, Rattus norvegicus
agagctaacggtcccgccagctagg

SEQ ID NO: 545552 - DNA, 25 bp, Rattus norvegicus
cggctcgcaccgacagagtttcaca

SEQ ID NO: 545553 - DNA, 25 bp, Rattus norvegicus
ctgcagaacatcgtcggccgccgag

SEQ ID NO: 545554 - DNA, 25 bp, Rattus norvegicus
agggtctgcctaatgcttcgctgcg

SEQ ID NO: 545555 - DNA, 25 bp, Rattus norvegicus
ggcaggctgatgatacacagggtct

SEQ ID NO: 545556 - DNA, 25 bp, Rattus norvegicus
aactgaggcaggcaggctgatgata

SEQ ID NO: 545557 - DNA, 25 bp, Rattus norvegicus
tccaggcacacagccgtggaaactg

SEQ ID NO: 545558 - DNA, 25 bp, Rattus norvegicus
aggtgtccactgcattccaggcaca

SEQ ID NO: 545559 - DNA, 25 bp, Rattus norvegicus
cgggaccttaggtgtccactgcatt

SEQ ID NO: 545560 - DNA, 25 bp, Rattus norvegicus
taatgcttcgctgcggggctcgaac

SEQ ID NO: 545561 - DNA, 25 bp, Rattus norvegicus
tcgctagctgttccgggctctgcgc

SEQ ID NO: 545562 - DNA, 25 bp, Rattus norvegicus
ctcatgaactggtacaggcggcgcg

SEQ ID NO: 545563 - DNA, 25 bp, Rattus norvegicus
ctgagcagcaatgccgcctcgggaa

SEQ ID NO: 545564 - DNA, 25 bp, Rattus norvegicus
gcgtcttggtttcccgcagctggtc

SEQ ID NO: 545565 - DNA, 25 bp, Rattus norvegicus
actcgggactacttcagcctcatga

SEQ ID NO: 545566 - DNA, 25 bp, Rattus norvegicus
ccgcctcgggaaagagcatcgagcc

SEQ ID NO: 545567 - DNA, 25 bp, Rattus norvegicus
ggatgagtttttctgcgcacactgc

SEQ ID NO: 545568 - DNA, 25 bp, Rattus norvegicus
gtaggagcctgctgagcagcaatgc

SEQ ID NO: 545569 - DNA, 25 bp, Rattus norvegicus
cgactggctaggttccttggtagga

SEQ ID NO: 545570 - DNA, 25 bp, Rattus norvegicus
ctgcagggctcggtccctgctgtgc

SEQ ID NO: 545571 - DNA, 25 bp, Rattus norvegicus
gcggccttacgaatgtggagctgca

SEQ ID NO: 545572 - DNA, 25 bp, Rattus norvegicus
tccggtctggtaacccgggccagca

SEQ ID NO: 545573 - DNA, 25 bp, Rattus norvegicus
aatcagcagcgagccactttcttcc

SEQ ID NO: 545574 - DNA, 25 bp, Rattus norvegicus
ggctccctagccaatcagcagcgag

SEQ ID NO: 545575 - DNA, 25 bp, Rattus norvegicus
catcgagccgcaatgctggaactgc

SEQ ID NO: 545576 - DNA, 25 bp, Rattus norvegicus
cccacgaggtgtccttcatttcgga

SEQ ID NO: 545577 - DNA, 25 bp, Rattus norvegicus
aagttcgagttctctcgcaaagacc

SEQ ID NO: 545578 - DNA, 25 bp, Rattus norvegicus
agtgagttccgactgtcagcgccgt

SEQ ID NO: 545579 - DNA, 25 bp, Rattus norvegicus
aagacctgattggacacggcgcctt

SEQ ID NO: 545580 - DNA, 25 bp, Rattus norvegicus
cgccttcgcggtggtcttcaagggt

SEQ ID NO: 545581 - DNA, 25 bp, Rattus norvegicus
tcttcaagggtcgacaccgcgaggt

SEQ ID NO: 545582 - DNA, 25 bp, Rattus norvegicus
tgctagctccgccacctaagaggtc

SEQ ID NO: 545583 - DNA, 25 bp, Rattus norvegicus
ccacctaagaggtcggggctccgca

SEQ ID NO: 545584 - DNA, 25 bp, Rattus norvegicus
gtgccgctgatcttttgtttccctg

SEQ ID NO: 545585 - DNA, 25 bp, Rattus norvegicus
ctgatcttttgtttccctgcggggc

SEQ ID NO: 545586 - DNA, 25 bp, Rattus norvegicus
agaccgtgggcaagttcgagttctc

SEQ ID NO: 545587 - DNA, 25 bp, Rattus norvegicus
tcgtctgttaggaccgagttggagc

SEQ ID NO: 545588 - DNA, 25 bp, Rattus norvegicus
ctgtcagcgccgtgagggtaccgca

SEQ ID NO: 545589 - DNA, 25 bp, Rattus norvegicus
ggctccgagccacatcgtctgttag

SEQ ID NO: 545590 - DNA, 25 bp, Rattus norvegicus
gctcattcacgggagcgtggaaatc

SEQ ID NO: 545591 - DNA, 25 bp, Rattus norvegicus
ccaactgtaattagaggccagagga

SEQ ID NO: 545592 - DNA, 25 bp, Rattus norvegicus
gcagcagcccaactgtaattagagg

SEQ ID NO: 545593 - DNA, 25 bp, Rattus norvegicus
ctcaggatttatgcctgagcggtgg

SEQ ID NO: 545594 - DNA, 25 bp, Rattus norvegicus
gggacccgctcaggatttatgcctg

SEQ ID NO: 545595 - DNA, 25 bp, Rattus norvegicus
agcgtggaaatcgagagaagcagca

SEQ ID NO: 545596 - DNA, 25 bp, Rattus norvegicus
gcacacactgcagctcattcacggg

SEQ ID NO: 545597 - DNA, 25 bp, Rattus norvegicus
tggctcaaagggcttgccctccgca

SEQ ID NO: 545598 - DNA, 25 bp, Rattus norvegicus
ggctggctcaaagggcttgccctcc

SEQ ID NO: 545599 - DNA, 25 bp, Rattus norvegicus
gttcaggcagctgcggctggctcaa

SEQ ID NO: 545600 - DNA, 25 bp, Rattus norvegicus
gacgccacccaggttcaggcagctg

SEQ ID NO: 545601 - DNA, 25 bp, Rattus norvegicus
ttgccaaggtcaggacgccacccag

SEQ ID NO: 545602 - DNA, 25 bp, Rattus norvegicus
agtgcggacatcgttgccaaggtca

SEQ ID NO: 545603 - DNA, 25 bp, Rattus norvegicus
gagagaagcagcagcccaactgtaa

SEQ ID NO: 545604 - DNA, 25 bp, Rattus norvegicus
gccgcactgctgagagcctggggac

SEQ ID NO: 545605 - DNA, 25 bp, Rattus norvegicus
tgcacgtggtcaacttcggggttcc

SEQ ID NO: 545606 - DNA, 25 bp, Rattus norvegicus
cagaaagacttttgtccgccttcgg

SEQ ID NO: 545607 - DNA, 25 bp, Rattus norvegicus
gccttcggccgccttccaacgcttg

SEQ ID NO: 545608 - DNA, 25 bp, Rattus norvegicus
cttccgccttcgtgcacgtggtcaa

SEQ ID NO: 545609 - DNA, 25 bp, Rattus norvegicus
cgccttcgtgcacgtggtcaacttc

SEQ ID NO: 545610 - DNA, 25 bp, Rattus norvegicus
cgctctggctgcgtgatctctaggg

SEQ ID NO: 545611 - DNA, 25 bp, Rattus norvegicus
ggggtcacaggtcagcctaggatca

SEQ ID NO: 545612 - DNA, 25 bp, Rattus norvegicus
tcagcctaggatcaggggtcctgca

SEQ ID NO: 545613 - DNA, 25 bp, Rattus norvegicus
tgcagggccggagcccagaaatcag

SEQ ID NO: 545614 - DNA, 25 bp, Rattus norvegicus
ccggagcccagaaatcaggaagaca

SEQ ID NO: 545615 - DNA, 25 bp, Rattus norvegicus
tgcagagttcggcagggatcgctga

SEQ ID NO: 545616 - DNA, 25 bp, Rattus norvegicus
gcgtgcccgggtaaagatcccgcga

SEQ ID NO: 545617 - DNA, 25 bp, Rattus norvegicus
atcaggaagacagggctgggatttc

SEQ ID NO: 545618 - DNA, 25 bp, Rattus norvegicus
tggtataccgggtggtcgtcttcag

SEQ ID NO: 545619 - DNA, 25 bp, Rattus norvegicus
gacgccgaggacctgagagagctcc

SEQ ID NO: 545620 - DNA, 25 bp, Rattus norvegicus
ttcgcgacgtagagccttgagctga

SEQ ID NO: 545621 - DNA, 25 bp, Rattus norvegicus
gcgcggcttccattcgcgacgtaga

SEQ ID NO: 545622 - DNA, 25 bp, Rattus norvegicus
tctccgttcttcactgtcgggtgcc

SEQ ID NO: 545623 - DNA, 25 bp, Rattus norvegicus
tcgtcttcagtggtgcttgccgccc

SEQ ID NO: 545624 - DNA, 25 bp, Rattus norvegicus
cgctacaggacaggcaccgttagtc

SEQ ID NO: 545625 - DNA, 25 bp, Rattus norvegicus
gctgcctggttaagaagccgcttca

SEQ ID NO: 545626 - DNA, 25 bp, Rattus norvegicus
taagccatttcggaggcggctctga

SEQ ID NO: 545627 - DNA, 25 bp, Rattus norvegicus
agccgttccgcttcgcacagataag

SEQ ID NO: 545628 - DNA, 25 bp, Rattus norvegicus
tgcgcgccgatttccctggtaccga

SEQ ID NO: 545629 - DNA, 25 bp, Rattus norvegicus
cgagtcaacgcaggctgcccggatc

SEQ ID NO: 545630 - DNA, 25 bp, Rattus norvegicus
ggtgcaagtgaaccggacagcgtca

SEQ ID NO: 545631 - DNA, 25 bp, Rattus norvegicus
ccgaggctctgccttgtacagacga

SEQ ID NO: 545632 - DNA, 25 bp, Rattus norvegicus
taggagacgtcaaacccgccgcgta

SEQ ID NO: 545633 - DNA, 25 bp, Rattus norvegicus
aacgcggtgttcgacatcttggctg

SEQ ID NO: 545634 - DNA, 25 bp, Rattus norvegicus
tgcgactacacttggcgcagacgtc

SEQ ID NO: 545635 - DNA, 25 bp, Rattus norvegicus
cctgcgacctagaagcgctggtgac

SEQ ID NO: 545636 - DNA, 25 bp, Rattus norvegicus
tttgatgacgtaagccagccctgcg

SEQ ID NO: 545637 - DNA, 25 bp, Rattus norvegicus
ggttcctcttcgacgctctttgatg

SEQ ID NO: 545638 - DNA, 25 bp, Rattus norvegicus
agcgccatagctgctgcacgccttg

SEQ ID NO: 545639 - DNA, 25 bp, Rattus norvegicus
cgcgtaccgcgctatgtggaacagc

SEQ ID NO: 545640 - DNA, 25 bp, Rattus norvegicus
ggctctgttctgcagtcgctccaga

SEQ ID NO: 545641 - DNA, 25 bp, Rattus norvegicus
gccgcgtatgcagaaagcctccatg

SEQ ID NO: 545642 - DNA, 25 bp, Rattus norvegicus
ctgctggaggcagtactgtcgaatc

SEQ ID NO: 545643 - DNA, 25 bp, Rattus norvegicus
gccgactcttcggtaccttgctgga

SEQ ID NO: 545644 - DNA, 25 bp, Rattus norvegicus
tttctgccgcttagccctaggagcc

SEQ ID NO: 545645 - DNA, 25 bp, Rattus norvegicus
tggtgacgtcacgagtgcgactaca

SEQ ID NO: 545646 - DNA, 25 bp, Rattus norvegicus
ggtcagtcagagcactcgccttgga

SEQ ID NO: 545647 - DNA, 25 bp, Rattus norvegicus
cagcgcctcagaacggtcctgcagg

SEQ ID NO: 545648 - DNA, 25 bp, Rattus norvegicus
cctgcaggcggcagtacaccgagaa

SEQ ID NO: 545649 - DNA, 25 bp, Rattus norvegicus
acaccgagaagagaatgatgcccac

SEQ ID NO: 545650 - DNA, 25 bp, Rattus norvegicus
actcgccttggagagccgattgcgc

SEQ ID NO: 545651 - DNA, 25 bp, Rattus norvegicus
acaccaggatgttgaccgtcagcaa

SEQ ID NO: 545652 - DNA, 25 bp, Rattus norvegicus
gttgaccgtcagcaaagttttgatc

SEQ ID NO: 545653 - DNA, 25 bp, Rattus norvegicus
aagttttgatcttcctggccaccgc

SEQ ID NO: 545654 - DNA, 25 bp, Rattus norvegicus
aagggcgggagctgttctttcagca

SEQ ID NO: 545655 - DNA, 25 bp, Rattus norvegicus
tgttctttcagcaccgccgcgcggg

SEQ ID NO: 545656 - DNA, 25 bp, Rattus norvegicus
cagcgcgcagaaaccgccgtgggat

SEQ ID NO: 545657 - DNA, 25 bp, Rattus norvegicus
tgatgcccacgaacaccaggatgtt

SEQ ID NO: 545658 - DNA, 25 bp, Rattus norvegicus
aggccttggctgctgcgtcccgttc

SEQ ID NO: 545659 - DNA, 25 bp, Rattus norvegicus
ccgattgcgcatccggcgatcagcg

SEQ ID NO: 545660 - DNA, 25 bp, Rattus norvegicus
caaccgcatgcacactggcttcgag

SEQ ID NO: 545661 - DNA, 25 bp, Rattus norvegicus
tcgcgagcaggagcaccaagggtat

SEQ ID NO: 545662 - DNA, 25 bp, Rattus norvegicus
ttccagagcacaggcgtcgcgagca

SEQ ID NO: 545663 - DNA, 25 bp, Rattus norvegicus
gtcgagccagcggttccagagcaca

SEQ ID NO: 545664 - DNA, 25 bp, Rattus norvegicus
ggaaatgccgctgggcggccacaca

SEQ ID NO: 545665 - DNA, 25 bp, Rattus norvegicus
ttcagctcctgcagctgtcgagcca

SEQ ID NO: 545666 - DNA, 25 bp, Rattus norvegicus
gaacctgtggaagccgtgaggacct

SEQ ID NO: 545667 - DNA, 25 bp, Rattus norvegicus
acacagttcagggtggaaatgccgc

SEQ ID NO: 545668 - DNA, 25 bp, Rattus norvegicus
atgcacactggcttcgagtggaaca

SEQ ID NO: 545669 - DNA, 25 bp, Rattus norvegicus
caagtacaaccagacgcactaggac

SEQ ID NO: 545670 - DNA, 25 bp, Rattus norvegicus
gacgcactaggacttcgcactagga

SEQ ID NO: 545671 - DNA, 25 bp, Rattus norvegicus
ttcgcactaggacttcgacaactcg

SEQ ID NO: 545672 - DNA, 25 bp, Rattus norvegicus
gctggacacgaacctgtggaagccg

SEQ ID NO: 545673 - DNA, 25 bp, Rattus norvegicus
gccgtgaggaccttcagctcctgca

SEQ ID NO: 545674 - DNA, 25 bp, Rattus norvegicus
cagctcagcgcagagccatctagtc

SEQ ID NO: 545675 - DNA, 25 bp, Rattus norvegicus
gcccgcttcctctggcactccggcc

SEQ ID NO: 545676 - DNA, 25 bp, Rattus norvegicus
tcaccgtcccggtgctcagaagctc

SEQ ID NO: 545677 - DNA, 25 bp, Rattus norvegicus
tctaaagagaagtgcgcaaacgggt

SEQ ID NO: 545678 - DNA, 25 bp, Rattus norvegicus
aggggcagctcagcgcagagccatc

SEQ ID NO: 545679 - DNA, 25 bp, Rattus norvegicus
gcgcagagccatctagtccggaagg

SEQ ID NO: 545680 - DNA, 25 bp, Rattus norvegicus
cagagccatctagtccggaagggcg

SEQ ID NO: 545681 - DNA, 25 bp, Rattus norvegicus
ggcggaagtgcgtcagttgttatcc

SEQ ID NO: 545682 - DNA, 25 bp, Rattus norvegicus
tgcgtcagttgttatccgctctggc

SEQ ID NO: 545683 - DNA, 25 bp, Rattus norvegicus
agttgttatccgctctggccgctgc

SEQ ID NO: 545684 - DNA, 25 bp, Rattus norvegicus
gctctggccgctgccactactgtgt

SEQ ID NO: 545685 - DNA, 25 bp, Rattus norvegicus
tggccgctgccactactgtgtctgc

SEQ ID NO: 545686 - DNA, 25 bp, Rattus norvegicus
tactgtgtctgcctcaccgtcccgg

SEQ ID NO: 545687 - DNA, 25 bp, Rattus norvegicus
gcttaatgtgaaagggcgaggggca

SEQ ID NO: 545688 - DNA, 25 bp, Rattus norvegicus
ctcgggaggctcatgcggcgcggga

SEQ ID NO: 545689 - DNA, 25 bp, Rattus norvegicus
gtgattccgagttcggaccttggga

SEQ ID NO: 545690 - DNA, 25 bp, Rattus norvegicus
cgccctcggggtgattccgagttcg

SEQ ID NO: 545691 - DNA, 25 bp, Rattus norvegicus
ctcgccctcggggtgattccgagtt

SEQ ID NO: 545692 - DNA, 25 bp, Rattus norvegicus
gagcctcgccgagaccacgcctctc

SEQ ID NO: 545693 - DNA, 25 bp, Rattus norvegicus
gccgccgagtgtcggccagccggga

SEQ ID NO: 545694 - DNA, 25 bp, Rattus norvegicus
ctccatcgcgccgtggccgccgagt

SEQ ID NO: 545695 - DNA, 25 bp, Rattus norvegicus
agcggcgactccatcgcgccgtggc

SEQ ID NO: 545696 - DNA, 25 bp, Rattus norvegicus
atcagcgcgggtagcgcggccagca

SEQ ID NO: 545697 - DNA, 25 bp, Rattus norvegicus
ccggtccgggtagtgctctccggag

SEQ ID NO: 545698 - DNA, 25 bp, Rattus norvegicus
ccagcagttcgagcggcgactccat

SEQ ID NO: 545699 - DNA, 25 bp, Rattus norvegicus
tgattccgagttcggaccttgggag

SEQ ID NO: 545700 - DNA, 25 bp, Rattus norvegicus
agcagcgccagcgccgtgatcagcg

SEQ ID NO: 545701 - DNA, 25 bp, Rattus norvegicus
cagcgccgtgatcagcgcgggtagc

SEQ ID NO: 545702 - DNA, 25 bp, Rattus norvegicus
gtcctgtgcgcgcagatctgcgcct

SEQ ID NO: 545703 - DNA, 25 bp, Rattus norvegicus
ccgagaggtcagttcgcgaagagca

SEQ ID NO: 545704 - DNA, 25 bp, Rattus norvegicus
tccaccggagcaggttcctcagagt

SEQ ID NO: 545705 - DNA, 25 bp, Rattus norvegicus
aggacgactctggaaatcccgctca

SEQ ID NO: 545706 - DNA, 25 bp, Rattus norvegicus
aaggaacggacaagaggacgactct

SEQ ID NO: 545707 - DNA, 25 bp, Rattus norvegicus
caggtggggaagcaccgactcctta

SEQ ID NO: 545708 - DNA, 25 bp, Rattus norvegicus
gcaaagcgggacttagggtatcgca

SEQ ID NO: 545709 - DNA, 25 bp, Rattus norvegicus
gaacgcagagaagcgcgcaggatct

SEQ ID NO: 545710 - DNA, 25 bp, Rattus norvegicus
ttgagaccatcgacgaacgcagaga

SEQ ID NO: 545711 - DNA, 25 bp, Rattus norvegicus
tgcagcacctaggattgagaccatc

SEQ ID NO: 545712 - DNA, 25 bp, Rattus norvegicus
ccgcgtccgtgcagcacctaggatt

SEQ ID NO: 545713 - DNA, 25 bp, Rattus norvegicus
gcgggagtttctctgccacccgcgt

SEQ ID NO: 545714 - DNA, 25 bp, Rattus norvegicus
tgggcatgcagaaagagactccctg

SEQ ID NO: 545715 - DNA, 25 bp, Rattus norvegicus
gttctggctaagctgggcatgcaga

SEQ ID NO: 545716 - DNA, 25 bp, Rattus norvegicus
agtgccaggtgactatccgcctcgc

SEQ ID NO: 545717 - DNA, 25 bp, Rattus norvegicus
ttttctcttgtagatcacgaactgc

SEQ ID NO: 545718 - DNA, 25 bp, Rattus norvegicus
cttgtagatcacgaactgctcaggc

SEQ ID NO: 545719 - DNA, 25 bp, Rattus norvegicus
tagatcacgaactgctcaggcaaga

SEQ ID NO: 545720 - DNA, 25 bp, Rattus norvegicus
cacgaactgctcaggcaagagctga

SEQ ID NO: 545721 - DNA, 25 bp, Rattus norvegicus
aggcaagagctgaacacgcggtttc

SEQ ID NO: 545722 - DNA, 25 bp, Rattus norvegicus
cacgcggtttctggtgcagaacgcg

SEQ ID NO: 545723 - DNA, 25 bp, Rattus norvegicus
ccacggccgacgtgcctctctgtct

SEQ ID NO: 545724 - DNA, 25 bp, Rattus norvegicus
ggccgagttccaccagcacacccac

SEQ ID NO: 545725 - DNA, 25 bp, Rattus norvegicus
gacgccgctcatgccgcccaccgca

SEQ ID NO: 545726 - DNA, 25 bp, Rattus norvegicus
accctcgccggtgcgtaggcctgag

SEQ ID NO: 545727 - DNA, 25 bp, Rattus norvegicus
taatgagcggccaccacggcttggc

SEQ ID NO: 545728 - DNA, 25 bp, Rattus norvegicus
tggcctgccgaacccgggagtgcca

SEQ ID NO: 545729 - DNA, 25 bp, Rattus norvegicus
ctgaacacgcggtttctggtgcaga

SEQ ID NO: 545730 - DNA, 25 bp, Rattus norvegicus
agactactcgccagcgtgcaatccg

SEQ ID NO: 545731 - DNA, 25 bp, Rattus norvegicus
tactgcaaggcagccctgggcgact

SEQ ID NO: 545732 - DNA, 25 bp, Rattus norvegicus
gcacagttccctgagtccgggagca

SEQ ID NO: 545733 - DNA, 25 bp, Rattus norvegicus
gcgagctggctcactttaaattctt

SEQ ID NO: 545734 - DNA, 25 bp, Rattus norvegicus
tgcagcctacatagtcgaggacttt

SEQ ID NO: 545735 - DNA, 25 bp, Rattus norvegicus
cctggcgaggcacgagactactcgc

SEQ ID NO: 545736 - DNA, 25 bp, Rattus norvegicus
gcgagtctcacgactacagcccgga

SEQ ID NO: 545737 - DNA, 25 bp, Rattus norvegicus
gctccgttcgagctttccgagcgcg

SEQ ID NO: 545738 - DNA, 25 bp, Rattus norvegicus
cacgtcaggcttcgtgtgggatccg

SEQ ID NO: 545739 - DNA, 25 bp, Rattus norvegicus
ggcgtcagcgtgcactccacagcta

SEQ ID NO: 545740 - DNA, 25 bp, Rattus norvegicus
cagggaagacgagacaccggacctc

SEQ ID NO: 545741 - DNA, 25 bp, Rattus norvegicus
tccgggaaacagacgcccgatcggc

SEQ ID NO: 545742 - DNA, 25 bp, Rattus norvegicus
ctacgcctggcaggcctactgggtc

SEQ ID NO: 545743 - DNA, 25 bp, Rattus norvegicus
attcttgggacctgagcacagttcc

SEQ ID NO: 545744 - DNA, 25 bp, Rattus norvegicus
cgttctgggactacgagacgcctaa

SEQ ID NO: 545745 - DNA, 25 bp, Rattus norvegicus
cctaaggtgatcgtggtgcggaatc

SEQ ID NO: 545746 - DNA, 25 bp, Rattus norvegicus
gaatcggcgcctgggattcgtgcac

SEQ ID NO: 545747 - DNA, 25 bp, Rattus norvegicus
ttcgtgcaccgcatggtgcagcttc

SEQ ID NO: 545748 - DNA, 25 bp, Rattus norvegicus
tggtgcagcttctcatcctgcttta

SEQ ID NO: 545749 - DNA, 25 bp, Rattus norvegicus
tcctgctttacttcgtgtggtgcgc

SEQ ID NO: 545750 - DNA, 25 bp, Rattus norvegicus
cttcaggagagggacatccaggtct

SEQ ID NO: 545751 - DNA, 25 bp, Rattus norvegicus
ggacatccaggtctctccagggttg

SEQ ID NO: 545752 - DNA, 25 bp, Rattus norvegicus
ctgtcccacaggtacgtcttcatcg

SEQ ID NO: 545753 - DNA, 25 bp, Rattus norvegicus
ttcatcgtgcagaaaagctaccagg

SEQ ID NO: 545754 - DNA, 25 bp, Rattus norvegicus
gctaccaggacagcgagaccggacc

SEQ ID NO: 545755 - DNA, 25 bp, Rattus norvegicus
ggagagctccatcatcaccaaagtc

SEQ ID NO: 545756 - DNA, 25 bp, Rattus norvegicus
caccaaagtcaaggggatcaccatg

SEQ ID NO: 545757 - DNA, 25 bp, Rattus norvegicus
tcaccatgtcggaagacaaagtgtg

SEQ ID NO: 545758 - DNA, 25 bp, Rattus norvegicus
cccgacaaagcagacccgacaaagt

SEQ ID NO: 545759 - DNA, 25 bp, Rattus norvegicus
cgcaaggtcgatgcgagacccgaca

SEQ ID NO: 545760 - DNA, 25 bp, Rattus norvegicus
cagaaccgtatgtatggcgcaaggt

SEQ ID NO: 545761 - DNA, 25 bp, Rattus norvegicus
taaagtggctctttgtctgcaggga

SEQ ID NO: 545762 - DNA, 25 bp, Rattus norvegicus
tgggagctgctcaaatggtgttaaa

SEQ ID NO: 545763 - DNA, 25 bp, Rattus norvegicus
agcgcggcgacagactgattaattg

SEQ ID NO: 545764 - DNA, 25 bp, Rattus norvegicus
tgattcgggccgagaactacaaagc

SEQ ID NO: 545765 - DNA, 25 bp, Rattus norvegicus
ggctcaccgccttatttggatgatt

SEQ ID NO: 545766 - DNA, 25 bp, Rattus norvegicus
ggccttgtagttcggtggctcttca

SEQ ID NO: 545767 - DNA, 25 bp, Rattus norvegicus
ccagtcgcagggtatcatgggcctt

SEQ ID NO: 545768 - DNA, 25 bp, Rattus norvegicus
cgtccagcggacagtagcaccagtc

SEQ ID NO: 545769 - DNA, 25 bp, Rattus norvegicus
agccctgacctgcaagatctaagtg

SEQ ID NO: 545770 - DNA, 25 bp, Rattus norvegicus
cagccacgaactaacggactccggg

SEQ ID NO: 545771 - DNA, 25 bp, Rattus norvegicus
ggttccttcctcatcgtgtccggtg

SEQ ID NO: 545772 - DNA, 25 bp, Rattus norvegicus
cagagcaggaaatgtcaggccgtcc

SEQ ID NO: 545773 - DNA, 25 bp, Rattus norvegicus
tggaatccgagctcgggtcgcttcc

SEQ ID NO: 545774 - DNA, 25 bp, Rattus norvegicus
cacctgccgcgtcaaggctgagggt

SEQ ID NO: 545775 - DNA, 25 bp, Rattus norvegicus
atcgcgatggcacctgccgcgtcaa

SEQ ID NO: 545776 - DNA, 25 bp, Rattus norvegicus
cccgggacgactcagagccgggatc

SEQ ID NO: 545777 - DNA, 25 bp, Rattus norvegicus
gggtcgcttcccaagcgagcgctcg

SEQ ID NO: 545778 - DNA, 25 bp, Rattus norvegicus
ggcgcgctctcatgtgctctcgcga

SEQ ID NO: 545779 - DNA, 25 bp, Rattus norvegicus
tccagctcccgggaaaatttggcgc

SEQ ID NO: 545780 - DNA, 25 bp, Rattus norvegicus
gctcgggatgcctccgtccactgtt

SEQ ID NO: 545781 - DNA, 25 bp, Rattus norvegicus
gtaggacaccggctctcaccggctg

SEQ ID NO: 545782 - DNA, 25 bp, Rattus norvegicus
tgccgccagcgccttcgcagtagga

SEQ ID NO: 545783 - DNA, 25 bp, Rattus norvegicus
ctcccgggaaaatttggcgcgctct

SEQ ID NO: 545784 - DNA, 25 bp, Rattus norvegicus
ttcgcagtaggacaccggctctcac

SEQ ID NO: 545785 - DNA, 25 bp, Rattus norvegicus
tacagctccggccaatgagaaggcg

SEQ ID NO: 545786 - DNA, 25 bp, Rattus norvegicus
gcgtctgggactccaactgggacag

SEQ ID NO: 545787 - DNA, 25 bp, Rattus norvegicus
ggacgtccactagccggaagcggaa

SEQ ID NO: 545788 - DNA, 25 bp, Rattus norvegicus
ctgggactccaactgggacaggtgc

SEQ ID NO: 545789 - DNA, 25 bp, Rattus norvegicus
ccgggcacggcgtctgggactccaa

SEQ ID NO: 545790 - DNA, 25 bp, Rattus norvegicus
gacacgcgcacgacagagccgctgg

SEQ ID NO: 545791 - DNA, 25 bp, Rattus norvegicus
tgcagacacgcgcacgacagagccg

SEQ ID NO: 545792 - DNA, 25 bp, Rattus norvegicus
cggggatgcagacacgcgcacgaca

SEQ ID NO: 545793 - DNA, 25 bp, Rattus norvegicus
ggccgctgttctcttctcggcggta

SEQ ID NO: 545794 - DNA, 25 bp, Rattus norvegicus
gtggctcggccgctgttctcttctc

SEQ ID NO: 545795 - DNA, 25 bp, Rattus norvegicus
caggctcttcagctggcggcctgtg

SEQ ID NO: 545796 - DNA, 25 bp, Rattus norvegicus
atggctttccggcaggctcttcagc

SEQ ID NO: 545797 - DNA, 25 bp, Rattus norvegicus
cttgcggcatggctttccggcaggc

SEQ ID NO: 545798 - DNA, 25 bp, Rattus norvegicus
ctgttctcttctcggcggtagcggt

SEQ ID NO: 545799 - DNA, 25 bp, Rattus norvegicus
aagcggaagcgtgtccctggcatcc

SEQ ID NO: 545800 - DNA, 25 bp, Rattus norvegicus
aaagattctccaggcgccggaccag

SEQ ID NO: 545801 - DNA, 25 bp, Rattus norvegicus
tcccgcagcggttcgggtcccgaga

SEQ ID NO: 545802 - DNA, 25 bp, Rattus norvegicus
agcgcacggcgatgagcagcaccga

SEQ ID NO: 545803 - DNA, 25 bp, Rattus norvegicus
atgagcagcaccgaggcgcccagga

SEQ ID NO: 545804 - DNA, 25 bp, Rattus norvegicus
tgtcccaacgaccaaggccagaacg

SEQ ID NO: 545805 - DNA, 25 bp, Rattus norvegicus
cagccggggtcctgattcatacgag

SEQ ID NO: 545806 - DNA, 25 bp, Rattus norvegicus
ctgattcatacgagcgcagcccggc

SEQ ID NO: 545807 - DNA, 25 bp, Rattus norvegicus
cgcgccgccatgagttgtttcttcg

SEQ ID NO: 545808 - DNA, 25 bp, Rattus norvegicus
catgagttgtttcttcgccgctggt

SEQ ID NO: 545809 - DNA, 25 bp, Rattus norvegicus
agagccagctcctgggccaccgaga

SEQ ID NO: 545810 - DNA, 25 bp, Rattus norvegicus
caccgagacgtgtgcatcctgaggc

SEQ ID NO: 545811 - DNA, 25 bp, Rattus norvegicus
caggaggccgagtccttgactggta

SEQ ID NO: 545812 - DNA, 25 bp, Rattus norvegicus
tcctgagtcggacgcggcgcactgc

SEQ ID NO: 545813 - DNA, 25 bp, Rattus norvegicus
gctgagcggacaccgctgcagacgc

SEQ ID NO: 545814 - DNA, 25 bp, Rattus norvegicus
gcgaccagtagccactatcgaatta

SEQ ID NO: 545815 - DNA, 25 bp, Rattus norvegicus
caacagggcaccagtctcgggcaac

SEQ ID NO: 545816 - DNA, 25 bp, Rattus norvegicus
tgccagtgttattcaccgccggacg

SEQ ID NO: 545817 - DNA, 25 bp, Rattus norvegicus
ccactgtacaggcaacttgttcgca

SEQ ID NO: 545818 - DNA, 25 bp, Rattus norvegicus
tatgatgatccacgtggccacgccc

SEQ ID NO: 545819 - DNA, 25 bp, Rattus norvegicus
gtgacgtaaccaggactcgccagga

SEQ ID NO: 545820 - DNA, 25 bp, Rattus norvegicus
cgaaaaaagtgcttccggcggcagt

SEQ ID NO: 545821 - DNA, 25 bp, Rattus norvegicus
caaccgcccggaaacaaactgtatg

SEQ ID NO: 545822 - DNA, 25 bp, Rattus norvegicus
attttgcgtgccttcccttcagaga

SEQ ID NO: 545823 - DNA, 25 bp, Rattus norvegicus
tggtacggatcttcgaacagaactg

SEQ ID NO: 545824 - DNA, 25 bp, Rattus norvegicus
tcgttccggaagacaagcagtcctc

SEQ ID NO: 545825 - DNA, 25 bp, Rattus norvegicus
tgtgccacgcgactgcattacaagc

SEQ ID NO: 545826 - DNA, 25 bp, Rattus norvegicus
ctgtatgcgatgtcttcgttccgga

SEQ ID NO: 545827 - DNA, 25 bp, Rattus norvegicus
ggtatccttcagaaactggccctaa

SEQ ID NO: 545828 - DNA, 25 bp, Rattus norvegicus
ggactcacatctacagagacccaga

SEQ ID NO: 545829 - DNA, 25 bp, Rattus norvegicus
tagagcggtgccaggaaaggctatc

SEQ ID NO: 545830 - DNA, 25 bp, Rattus norvegicus
tgcccaccgagagcgacggctagag

SEQ ID NO: 545831 - DNA, 25 bp, Rattus norvegicus
gacccagctgatccacgggaggcga

SEQ ID NO: 545832 - DNA, 25 bp, Rattus norvegicus
tcaacagacatctcggggacccagc

SEQ ID NO: 545833 - DNA, 25 bp, Rattus norvegicus
cggatcccggaaccggcagcacagt

SEQ ID NO: 545834 - DNA, 25 bp, Rattus norvegicus
gttcagggacgacttggaaagctca

SEQ ID NO: 545835 - DNA, 25 bp, Rattus norvegicus
agagacccagaaacgccggttcagg

SEQ ID NO: 545836 - DNA, 25 bp, Rattus norvegicus
tcctctgcgcctaggcgaagaagcc

SEQ ID NO: 545837 - DNA, 25 bp, Rattus norvegicus
tccaaagaaggatctggggttcgtc

SEQ ID NO: 545838 - DNA, 25 bp, Rattus norvegicus
tggtccactcgcgtttccaaagaag

SEQ ID NO: 545839 - DNA, 25 bp, Rattus norvegicus
caggaaaggctatccgaagagggcc

SEQ ID NO: 545840 - DNA, 25 bp, Rattus norvegicus
gacttggaaagctcagcaccgctgc

SEQ ID NO: 545841 - DNA, 25 bp, Rattus norvegicus
cccgtgtggctccataggactcaca

SEQ ID NO: 545842 - DNA, 25 bp, Rattus norvegicus
cagccaccaccggagcttcgggttg

SEQ ID NO: 545843 - DNA, 25 bp, Rattus norvegicus
ggccgcctgcttcctgtatttggtt

SEQ ID NO: 545844 - DNA, 25 bp, Rattus norvegicus
tacgcaatacttccgggtgcgcgtc

SEQ ID NO: 545845 - DNA, 25 bp, Rattus norvegicus
cgcgcgccaattgggcgccatgttg

SEQ ID NO: 545846 - DNA, 25 bp, Rattus norvegicus
ggggctcgaagctcccacgaatgag

SEQ ID NO: 545847 - DNA, 25 bp, Rattus norvegicus
attggcctcagcgacttgccaggtc

SEQ ID NO: 545848 - DNA, 25 bp, Rattus norvegicus
aatgagcgagttttgacagcccggc

SEQ ID NO: 545849 - DNA, 25 bp, Rattus norvegicus
gctcagcgggtagctctcatagtaa

SEQ ID NO: 545850 - DNA, 25 bp, Rattus norvegicus
cgtgcatcggcacccacgtggaagc

SEQ ID NO: 545851 - DNA, 25 bp, Rattus norvegicus
catagtaattgtgtcgcgtccagtc

SEQ ID NO: 545852 - DNA, 25 bp, Rattus norvegicus
tccctgctttggctacgcaatactt

SEQ ID NO: 545853 - DNA, 25 bp, Rattus norvegicus
gcgcctttaaagtcgccttccagaa

SEQ ID NO: 545854 - DNA, 25 bp, Rattus norvegicus
gcgcttcttgctcttgtggttcatc

SEQ ID NO: 545855 - DNA, 25 bp, Rattus norvegicus
cgcgtccagtcaagcgagtccttga

SEQ ID NO: 545856 - DNA, 25 bp, Rattus norvegicus
tggacacccgagcacgggatttgtg

SEQ ID NO: 545857 - DNA, 25 bp, Rattus norvegicus
cacggagttacatcaccgggcccta

SEQ ID NO: 545858 - DNA, 25 bp, Rattus norvegicus
gggacacgcacggtcatcaccacgt

SEQ ID NO: 545859 - DNA, 25 bp, Rattus norvegicus
cggttcaggcagtacgtcatcgtgt

SEQ ID NO: 545860 - DNA, 25 bp, Rattus norvegicus
aggacccggcccagcaagtgcagca

SEQ ID NO: 545861 - DNA, 25 bp, Rattus norvegicus
caaagcacaggttccgtgcggagcc

SEQ ID NO: 545862 - DNA, 25 bp, Rattus norvegicus
ccagcgccttcgtgtacatcatgtg

SEQ ID NO: 545863 - DNA, 25 bp, Rattus norvegicus
agccactcggctatctcggtgaggg

SEQ ID NO: 545864 - DNA, 25 bp, Rattus norvegicus
acgatgaccacctcgcgcgggtgca

SEQ ID NO: 545865 - DNA, 25 bp, Rattus norvegicus
cgaagtccctgcaggccacgatgac

SEQ ID NO: 545866 - DNA, 25 bp, Rattus norvegicus
agatcggagacttacggttcaggca

SEQ ID NO: 545867 - DNA, 25 bp, Rattus norvegicus
gcgatccgcaggtccaggtacctca

SEQ ID NO: 545868 - DNA, 25 bp, Rattus norvegicus
tagtcgtgcatctcgcgcgtcatcc

SEQ ID NO: 545869 - DNA, 25 bp, Rattus norvegicus
tgttcacgatgcagcccacgaggta

SEQ ID NO: 545870 - DNA, 25 bp, Rattus norvegicus
acggagcccttcacgtacgctcatg

SEQ ID NO: 545871 - DNA, 25 bp, Rattus norvegicus
catggggtacgcactgtggaaagtc

SEQ ID NO: 545872 - DNA, 25 bp, Rattus norvegicus
cactggggtgatctgatggacatcg

SEQ ID NO: 545873 - DNA, 25 bp, Rattus norvegicus
gaggagcggatccaaaacaagggca

SEQ ID NO: 545874 - DNA, 25 bp, Rattus norvegicus
aaccggtatggccagagtggagacc

SEQ ID NO: 545875 - DNA, 25 bp, Rattus norvegicus
cgcctcgcagcacaggtaaccggta

SEQ ID NO: 545876 - DNA, 25 bp, Rattus norvegicus
gtgcgtcctgcatcctgacgtcaaa

SEQ ID NO: 545877 - DNA, 25 bp, Rattus norvegicus
tgccctttgacgcacagcgcgtgtg

SEQ ID NO: 545878 - DNA, 25 bp, Rattus norvegicus
cccggaggatccacgtgaggacgaa

SEQ ID NO: 545879 - DNA, 25 bp, Rattus norvegicus
gtccttcctgtctgtcactgcttca

SEQ ID NO: 545880 - DNA, 25 bp, Rattus norvegicus
ctgcgcgctagcaccgttttttgtc

SEQ ID NO: 545881 - DNA, 25 bp, Rattus norvegicus
tggtacctggggctactccataggt

SEQ ID NO: 545882 - DNA, 25 bp, Rattus norvegicus
ctactctgagcgtggagtcggagtc

SEQ ID NO: 545883 - DNA, 25 bp, Rattus norvegicus
caacacgctctgagcctcgcgggga

SEQ ID NO: 545884 - DNA, 25 bp, Rattus norvegicus
cccaggtgagtcgttctcggaactg

SEQ ID NO: 545885 - DNA, 25 bp, Rattus norvegicus
ttcacagcaaggtggacctggtgcc

SEQ ID NO: 545886 - DNA, 25 bp, Rattus norvegicus
gatgtgagccatcccgacgcagaac

SEQ ID NO: 545887 - DNA, 25 bp, Rattus norvegicus
gtgcacgtgaccgatgtgagccatc

SEQ ID NO: 545888 - DNA, 25 bp, Rattus norvegicus
tgtgaccactgttctctcgattacc

SEQ ID NO: 545889 - DNA, 25 bp, Rattus norvegicus
ccgcttacaggcctgtctgtgacca

SEQ ID NO: 545890 - DNA, 25 bp, Rattus norvegicus
gtggttatagcctgactcctgcgca

SEQ ID NO: 545891 - DNA, 25 bp, Rattus norvegicus
tgcgtgtcagtccagtggttatagc

SEQ ID NO: 545892 - DNA, 25 bp, Rattus norvegicus
gtacgtggacaccattggcttcttg

SEQ ID NO: 545893 - DNA, 25 bp, Rattus norvegicus
cgccttcgtgtcctgtacgtggaca

SEQ ID NO: 545894 - DNA, 25 bp, Rattus norvegicus
caacgctcgacgtcacggtgcacga

SEQ ID NO: 545895 - DNA, 25 bp, Rattus norvegicus
gggaccagccattcgcaacgctcga

SEQ ID NO: 545896 - DNA, 25 bp, Rattus norvegicus
aagaccacgctcatccgggctctga

SEQ ID NO: 545897 - DNA, 25 bp, Rattus norvegicus
tctgtggtggggtacaccaactgcg

SEQ ID NO: 545898 - DNA, 25 bp, Rattus norvegicus
tgaccggttcgctcttcagccataa

SEQ ID NO: 545899 - DNA, 25 bp, Rattus norvegicus
ggtctcccatgagggctgcagctac

SEQ ID NO: 545900 - DNA, 25 bp, Rattus norvegicus
tgaactgtgctgagaacccgcgctc

SEQ ID NO: 545901 - DNA, 25 bp, Rattus norvegicus
ccctgtgaccctggaatttgtgttc

SEQ ID NO: 545902 - DNA, 25 bp, Rattus norvegicus
gcaggtttccactcgcgactgagga

SEQ ID NO: 545903 - DNA, 25 bp, Rattus norvegicus
cgtgtcctccgtgatgtcacgcaca

SEQ ID NO: 545904 - DNA, 25 bp, Rattus norvegicus
tgtcacgcacagtcagggcactggc

SEQ ID NO: 545905 - DNA, 25 bp, Rattus norvegicus
gcgcgcataccttcggtgcctactg

SEQ ID NO: 545906 - DNA, 25 bp, Rattus norvegicus
gatcgcgtgggaactggttctgacc

SEQ ID NO: 545907 - DNA, 25 bp, Rattus norvegicus
ttcagccataactctacccgggcgg

SEQ ID NO: 545908 - DNA, 25 bp, Rattus norvegicus
acccgggcggcatctgagatacaga

SEQ ID NO: 545909 - DNA, 25 bp, Rattus norvegicus
tcgccaggctccactgtgtcacagg

SEQ ID NO: 545910 - DNA, 25 bp, Rattus norvegicus
ctgagatggcttcccttacggggtc

SEQ ID NO: 545911 - DNA, 25 bp, Rattus norvegicus
acgcagcgcgttcctatgccctgag

SEQ ID NO: 545912 - DNA, 25 bp, Rattus norvegicus
tggcccggcgagcacctaccacaag

SEQ ID NO: 545913 - DNA, 25 bp, Rattus norvegicus
ggctgccggctaccggtctatgtcc

SEQ ID NO: 545914 - DNA, 25 bp, Rattus norvegicus
agcgcggcggtgtggggctctaatt

SEQ ID NO: 545915 - DNA, 25 bp, Rattus norvegicus
accacaagtccagcgcggcggtgtg

SEQ ID NO: 545916 - DNA, 25 bp, Rattus norvegicus
ctaccacaagtccagcgcggcggtg

SEQ ID NO: 545917 - DNA, 25 bp, Rattus norvegicus
tgcgacgtcagaagagtaagaggaa

SEQ ID NO: 545918 - DNA, 25 bp, Rattus norvegicus
cctgtgcgacgtcagaagagtaaga

SEQ ID NO: 545919 - DNA, 25 bp, Rattus norvegicus
gcccgcgcctgtgcgacgtcagaag

SEQ ID NO: 545920 - DNA, 25 bp, Rattus norvegicus
agcggctgccggctaccggtctatg

SEQ ID NO: 545921 - DNA, 25 bp, Rattus norvegicus
acgacaggcaccgacgcagcggctg

SEQ ID NO: 545922 - DNA, 25 bp, Rattus norvegicus
tagaaagtgtttctggtcctgacgc

SEQ ID NO: 545923 - DNA, 25 bp, Rattus norvegicus
gccatcccgcggctgaggacactcg

SEQ ID NO: 545924 - DNA, 25 bp, Rattus norvegicus
gtcctgacgccatcccgcggctgag

SEQ ID NO: 545925 - DNA, 25 bp, Rattus norvegicus
cgcctgtgcgacgtcagaagagtaa

SEQ ID NO: 545926 - DNA, 25 bp, Rattus norvegicus
ttgtctttaaaatcgcgtcctcagg

SEQ ID NO: 545927 - DNA, 25 bp, Rattus norvegicus
gggcatttgagcaaactgtttactt

SEQ ID NO: 545928 - DNA, 25 bp, Rattus norvegicus
cattctaaaggacagggacgaagga

SEQ ID NO: 545929 - DNA, 25 bp, Rattus norvegicus
tccgcattctaaaggacagggacga

SEQ ID NO: 545930 - DNA, 25 bp, Rattus norvegicus
ttcccctgaatcctgattaaatgtc

SEQ ID NO: 545931 - DNA, 25 bp, Rattus norvegicus
ctttaaaatcgcgtcctcaggagga

SEQ ID NO: 545932 - DNA, 25 bp, Rattus norvegicus
gaggagttgtctttaaaatcgcgtc

SEQ ID NO: 545933 - DNA, 25 bp, Rattus norvegicus
ttcagtcacgaggaggagttgtctt

SEQ ID NO: 545934 - DNA, 25 bp, Rattus norvegicus
ccttcagtcacgaggaggagttgtc

SEQ ID NO: 545935 - DNA, 25 bp, Rattus norvegicus
ctgctgtggcaatctccttcagtca

SEQ ID NO: 545936 - DNA, 25 bp, Rattus norvegicus
atgtcctgctgtggcaatctccttc

SEQ ID NO: 545937 - DNA, 25 bp, Rattus norvegicus
tctatgtcctgctgtggcaatctcc

SEQ ID NO: 545938 - DNA, 25 bp, Rattus norvegicus
ccggtctatgtcctgctgtggcaat

SEQ ID NO: 545939 - DNA, 25 bp, Rattus norvegicus
aatcgcgtcctcaggaggaacagaa

SEQ ID NO: 545940 - DNA, 25 bp, Rattus norvegicus
tggagagattccaccacctaacaga

SEQ ID NO: 545941 - DNA, 25 bp, Rattus norvegicus
tgtcaaaagccgagtggtctggccg

SEQ ID NO: 545942 - DNA, 25 bp, Rattus norvegicus
aaaagccgagtggtctggccgacga

SEQ ID NO: 545943 - DNA, 25 bp, Rattus norvegicus
actgccgagtgccaggcttttgctc

SEQ ID NO: 545944 - DNA, 25 bp, Rattus norvegicus
ccaggcttttgctcctgtgcaggga

SEQ ID NO: 545945 - DNA, 25 bp, Rattus norvegicus
agggctctcaaagcacccgaagccg

SEQ ID NO: 545946 - DNA, 25 bp, Rattus norvegicus
aagctgtgagtttggagagattcca

SEQ ID NO: 545947 - DNA, 25 bp, Rattus norvegicus
ttccaccacctaacagacggagcag

SEQ ID NO: 545948 - DNA, 25 bp, Rattus norvegicus
acctaacagacggagcagcagccac

SEQ ID NO: 545949 - DNA, 25 bp, Rattus norvegicus
cagcagccacgtgccaggagtgcct

SEQ ID NO: 545950 - DNA, 25 bp, Rattus norvegicus
acgtgccaggagtgccttcgggccc

SEQ ID NO: 545951 - DNA, 25 bp, Rattus norvegicus
cccggaacgtatggtgcgtgtccga

SEQ ID NO: 545952 - DNA, 25 bp, Rattus norvegicus
cgtgtccgagggctctcaaagcacc

SEQ ID NO: 545953 - DNA, 25 bp, Rattus norvegicus
tgctcctgtgcagggaaagctgtga

SEQ ID NO: 545954 - DNA, 25 bp, Rattus norvegicus
ggggccctaaggcatcgtagccgaa

SEQ ID NO: 545955 - DNA, 25 bp, Rattus norvegicus
gggccctaaggcatcgtagccgaat

SEQ ID NO: 545956 - DNA, 25 bp, Rattus norvegicus
ggggttaaacttcacatttgtcaca

SEQ ID NO: 545957 - DNA, 25 bp, Rattus norvegicus
cctaaggcatcgtagccgaatgcgg

SEQ ID NO: 545958 - DNA, 25 bp, Rattus norvegicus
ccctaaggcatcgtagccgaatgcg

SEQ ID NO: 545959 - DNA, 25 bp, Rattus norvegicus
gccctaaggcatcgtagccgaatgc

SEQ ID NO: 545960 - DNA, 25 bp, Rattus norvegicus
gtggagaggaaatcacacccgtacc

SEQ ID NO: 545961 - DNA, 25 bp, Rattus norvegicus
ggccctaaggcatcgtagccgaatg

SEQ ID NO: 545962 - DNA, 25 bp, Rattus norvegicus
ggagcgagataacatgtaaaaaaca

SEQ ID NO: 545963 - DNA, 25 bp, Rattus norvegicus
tggagaggaaatcacacccgtaccc

SEQ ID NO: 545964 - DNA, 25 bp, Rattus norvegicus
tgccgtagccgggtggggaatacga

SEQ ID NO: 545965 - DNA, 25 bp, Rattus norvegicus
atgtaaaaaacatgccgtagccggg

SEQ ID NO: 545966 - DNA, 25 bp, Rattus norvegicus
gggttaaacttcacatttgtcacac

SEQ ID NO: 545967 - DNA, 25 bp, Rattus norvegicus
ttaaacttcacatttgtcacactca

SEQ ID NO: 545968 - DNA, 25 bp, Rattus norvegicus
tgtgtagccacatagttatctgtac

SEQ ID NO: 545969 - DNA, 25 bp, Rattus norvegicus
gctactgctgctgacgatcgactcc

SEQ ID NO: 545970 - DNA, 25 bp, Rattus norvegicus
atgtccctgtgtcactcggctctgt

SEQ ID NO: 545971 - DNA, 25 bp, Rattus norvegicus
tccgagagggttccgttgtgacgaa

SEQ ID NO: 545972 - DNA, 25 bp, Rattus norvegicus
acatttcccgtgatgctccgagagg

SEQ ID NO: 545973 - DNA, 25 bp, Rattus norvegicus
cgtggcattgatgcccgcaaggacg

SEQ ID NO: 545974 - DNA, 25 bp, Rattus norvegicus
cgcgagtgaatcaccgcctgggccg

SEQ ID NO: 545975 - DNA, 25 bp, Rattus norvegicus
cctgagtcgcgagcgcgagtgaatc

SEQ ID NO: 545976 - DNA, 25 bp, Rattus norvegicus
tatctgtacacttcgtcgccggggc

SEQ ID NO: 545977 - DNA, 25 bp, Rattus norvegicus
tcggcgctcgatgtgtagccacata

SEQ ID NO: 545978 - DNA, 25 bp, Rattus norvegicus
agtacggacgcgatgtggcccgacc

SEQ ID NO: 545979 - DNA, 25 bp, Rattus norvegicus
ctgttcccaagctaagggaggagcc

SEQ ID NO: 545980 - DNA, 25 bp, Rattus norvegicus
tgtgacgaagggaacaagcgcagac

SEQ ID NO: 545981 - DNA, 25 bp, Rattus norvegicus
cggggctttaatgaggacctgagtc

SEQ ID NO: 545982 - DNA, 25 bp, Rattus norvegicus
gtctctacacagctcagcatcctga

SEQ ID NO: 545983 - DNA, 25 bp, Rattus norvegicus
ccgctgtctgggagaccttcccata

SEQ ID NO: 545984 - DNA, 25 bp, Rattus norvegicus
cggctgatgaaaccggctcggattc

SEQ ID NO: 545985 - DNA, 25 bp, Rattus norvegicus
ttcttatcctctccatctcgatggg

SEQ ID NO: 545986 - DNA, 25 bp, Rattus norvegicus
tggggcggacaccaatattccggtc

SEQ ID NO: 545987 - DNA, 25 bp, Rattus norvegicus
tggcatctgcagtcaccgctgtctg

SEQ ID NO: 545988 - DNA, 25 bp, Rattus norvegicus
gcgatccttgtgattgcccaggaaa

SEQ ID NO: 545989 - DNA, 25 bp, Rattus norvegicus
ctcctccgtgagtacgcgatccttg

SEQ ID NO: 545990 - DNA, 25 bp, Rattus norvegicus
tggactccgtcaggtcttccaggca

SEQ ID NO: 545991 - DNA, 25 bp, Rattus norvegicus
gagcggctttctgcccgcagtctct

SEQ ID NO: 545992 - DNA, 25 bp, Rattus norvegicus
tcttccaggcaggtcccgtatgacc

SEQ ID NO: 545993 - DNA, 25 bp, Rattus norvegicus
ccgtatgaccggagaccagagattc

SEQ ID NO: 545994 - DNA, 25 bp, Rattus norvegicus
tccatcttggtcctttgcaggcgcg

SEQ ID NO: 545995 - DNA, 25 bp, Rattus norvegicus
cgctgtcattggtgcctgggaagct

SEQ ID NO: 545996 - DNA, 25 bp, Rattus norvegicus
tcgccagtgagagcaattcaaactc

SEQ ID NO: 545997 - DNA, 25 bp, Rattus norvegicus
cagcacctgctctgagccgctggta

SEQ ID NO: 545998 - DNA, 25 bp, Rattus norvegicus
cagtgacaaacgatcgccagtgaga

SEQ ID NO: 545999 - DNA, 25 bp, Rattus norvegicus
cgctctgttggccctcccgtttgtt

SEQ ID NO: 546000 - DNA, 25 bp, Rattus norvegicus
ctcccggtccttctgcggtgttcat

SEQ ID NO: 546001 - DNA, 25 bp, Rattus norvegicus
tgagccgctggtaccgcgcgcttct

SEQ ID NO: 546002 - DNA, 25 bp, Rattus norvegicus
ggtccttctgcggtgttcatgaacg

SEQ ID NO: 546003 - DNA, 25 bp, Rattus norvegicus
caccaagcaacaaccgcagcacctg

SEQ ID NO: 546004 - DNA, 25 bp, Rattus norvegicus
ggcgctgccggacaccaagcaacaa

SEQ ID NO: 546005 - DNA, 25 bp, Rattus norvegicus
agcaattcaaactcggcctcagggg

SEQ ID NO: 546006 - DNA, 25 bp, Rattus norvegicus
aaacgatcgccagtgagagcaattc

SEQ ID NO: 546007 - DNA, 25 bp, Rattus norvegicus
tcccagtgacaaacgatcgccagtg

SEQ ID NO: 546008 - DNA, 25 bp, Rattus norvegicus
tttgtttcccagtgacaaacgatcg

SEQ ID NO: 546009 - DNA, 25 bp, Rattus norvegicus
gcgcttctctgctcaaccctcttca

SEQ ID NO: 546010 - DNA, 25 bp, Rattus norvegicus
ctgaggacgcctcgccggacaaaga

SEQ ID NO: 546011 - DNA, 25 bp, Rattus norvegicus
tcacctgagtctggaggagccaaga

SEQ ID NO: 546012 - DNA, 25 bp, Rattus norvegicus
tgcaacttgacagagcgcgggcaga

SEQ ID NO: 546013 - DNA, 25 bp, Rattus norvegicus
cacccgggtcttctgcaacttgaca

SEQ ID NO: 546014 - DNA, 25 bp, Rattus norvegicus
tggagtttgcaacgcgcccacgcgt

SEQ ID NO: 546015 - DNA, 25 bp, Rattus norvegicus
gcagctccttcgcagctggagtttg

SEQ ID NO: 546016 - DNA, 25 bp, Rattus norvegicus
ggacgacagtcgctcacctgagtct

SEQ ID NO: 546017 - DNA, 25 bp, Rattus norvegicus
tgtctccagccagatcgggacgcgc

SEQ ID NO: 546018 - DNA, 25 bp, Rattus norvegicus
tctctccggcggagcagaagatgtg

SEQ ID NO: 546019 - DNA, 25 bp, Rattus norvegicus
ggctaacccgctgtcgcctctgaaa

SEQ ID NO: 546020 - DNA, 25 bp, Rattus norvegicus
acggaccgaattatcccgagctggg

SEQ ID NO: 546021 - DNA, 25 bp, Rattus norvegicus
tgtcgcctctgaaacaccgtgctca

SEQ ID NO: 546022 - DNA, 25 bp, Rattus norvegicus
tgggagctcgtttaggctaacccgc

SEQ ID NO: 546023 - DNA, 25 bp, Rattus norvegicus
cgggcgctctgatgccagagaagcc

SEQ ID NO: 546024 - DNA, 25 bp, Rattus norvegicus
ccagatagttgatctcggaggcccg

SEQ ID NO: 546025 - DNA, 25 bp, Rattus norvegicus
catcacgcattgtgaggaccacacg

SEQ ID NO: 546026 - DNA, 25 bp, Rattus norvegicus
ggaccacacgaagtgcgttctataa

SEQ ID NO: 546027 - DNA, 25 bp, Rattus norvegicus
agcgccactctttggccttgatgtc

SEQ ID NO: 546028 - DNA, 25 bp, Rattus norvegicus
ttgatgtccagttggcgtccactgc

SEQ ID NO: 546029 - DNA, 25 bp, Rattus norvegicus
cggacgacgccgacaggaagtccca

SEQ ID NO: 546030 - DNA, 25 bp, Rattus norvegicus
tcccgcccgtgttcaggtgaggcca

SEQ ID NO: 546031 - DNA, 25 bp, Rattus norvegicus
gccaaccaatgaggatcggttcttc

SEQ ID NO: 546032 - DNA, 25 bp, Rattus norvegicus
ttaaccaatagtagagcgcgctggg

SEQ ID NO: 546033 - DNA, 25 bp, Rattus norvegicus
ttgattcagattggcgacaagccta

SEQ ID NO: 546034 - DNA, 25 bp, Rattus norvegicus
agtgagaaccgactctgtttgattc

SEQ ID NO: 546035 - DNA, 25 bp, Rattus norvegicus
acttccgaaagagtaggccgcgcca

SEQ ID NO: 546036 - DNA, 25 bp, Rattus norvegicus
agaggcttcggcgacttccgaaaga

SEQ ID NO: 546037 - DNA, 25 bp, Rattus norvegicus
gatagctactctgccactccactgg

SEQ ID NO: 546038 - DNA, 25 bp, Rattus norvegicus
agcgtacattggtcgggttgcttcc

SEQ ID NO: 546039 - DNA, 25 bp, Rattus norvegicus
gctcctcctcggctagcgtacattg

SEQ ID NO: 546040 - DNA, 25 bp, Rattus norvegicus
gaacagttgccgacctttgctcctc

SEQ ID NO: 546041 - DNA, 25 bp, Rattus norvegicus
gccgcttctcttgttttctcgtcag

SEQ ID NO: 546042 - DNA, 25 bp, Rattus norvegicus
tgcttccgtcatcgctgtgcgacga

SEQ ID NO: 546043 - DNA, 25 bp, Rattus norvegicus
tgacgacagagttgcgccagcgtcc

SEQ ID NO: 546044 - DNA, 25 bp, Rattus norvegicus
ggaatccggccgcatccgacatttg

SEQ ID NO: 546045 - DNA, 25 bp, Rattus norvegicus
atttggggaccttctgccaggcttg

SEQ ID NO: 546046 - DNA, 25 bp, Rattus norvegicus
ttgcgttccgcagctccgcagtgag

SEQ ID NO: 546047 - DNA, 25 bp, Rattus norvegicus
cagagcccgaagagagtgaggttca

SEQ ID NO: 546048 - DNA, 25 bp, Rattus norvegicus
tgatccctcatcgtttgctcggccg

SEQ ID NO: 546049 - DNA, 25 bp, Rattus norvegicus
gccgcgaccagtagcctgcaggact

SEQ ID NO: 546050 - DNA, 25 bp, Rattus norvegicus
ttctcgtcaggctggagacctaggc

SEQ ID NO: 546051 - DNA, 25 bp, Rattus norvegicus
acgccaggcccgacctgagtagtga

SEQ ID NO: 546052 - DNA, 25 bp, Rattus norvegicus
acctccaagccgagtgatgatgctc

SEQ ID NO: 546053 - DNA, 25 bp, Rattus norvegicus
cccagctggaaaaccgtgctgaaaa

SEQ ID NO: 546054 - DNA, 25 bp, Rattus norvegicus
gccagacccaatcacaagcgagcta

SEQ ID NO: 546055 - DNA, 25 bp, Rattus norvegicus
tgacactgcgttagaccaatcgctg

SEQ ID NO: 546056 - DNA, 25 bp, Rattus norvegicus
cgtgcctagcaggaagaccttaacc

SEQ ID NO: 546057 - DNA, 25 bp, Rattus norvegicus
tgggtaaccgagaacacagtgctga

SEQ ID NO: 546058 - DNA, 25 bp, Rattus norvegicus
ccttccgatcgagagctgcttttta

SEQ ID NO: 546059 - DNA, 25 bp, Rattus norvegicus
agacctccagtgtcccgttccaagg

SEQ ID NO: 546060 - DNA, 25 bp, Rattus norvegicus
tttggcttctaacagacctccagtg

SEQ ID NO: 546061 - DNA, 25 bp, Rattus norvegicus
cccggaggtgtgcttatctatcttt

SEQ ID NO: 546062 - DNA, 25 bp, Rattus norvegicus
ggagactgagtccagggccactaaa

SEQ ID NO: 546063 - DNA, 25 bp, Rattus norvegicus
ctagggcccaaagaaccagagtgca

SEQ ID NO: 546064 - DNA, 25 bp, Rattus norvegicus
gggccgaagattaccacctccaagc

SEQ ID NO: 546065 - DNA, 25 bp, Rattus norvegicus
acagtgctgagctcggtccaacctg

SEQ ID NO: 546066 - DNA, 25 bp, Rattus norvegicus
gttcgcgctcactcaccatcttgga

SEQ ID NO: 546067 - DNA, 25 bp, Rattus norvegicus
cgcagctagagtgtgctctggacgt

SEQ ID NO: 546068 - DNA, 25 bp, Rattus norvegicus
atccgccggaagtgcgtccgtccgg

SEQ ID NO: 546069 - DNA, 25 bp, Rattus norvegicus
caaggcgctcacttccgtttccggg

SEQ ID NO: 546070 - DNA, 25 bp, Rattus norvegicus
agtcggccagccaaggcgctcactt

SEQ ID NO: 546071 - DNA, 25 bp, Rattus norvegicus
acccgctatagtcggccagccaagg

SEQ ID NO: 546072 - DNA, 25 bp, Rattus norvegicus
tgcgaaaccctctgaacccgctata

SEQ ID NO: 546073 - DNA, 25 bp, Rattus norvegicus
gcggtccgacgggaaccagcaccac

SEQ ID NO: 546074 - DNA, 25 bp, Rattus norvegicus
tcaccatcttggaaacagctctgcg

SEQ ID NO: 546075 - DNA, 25 bp, Rattus norvegicus
gactgcgatcgttcgcgctcactca

SEQ ID NO: 546076 - DNA, 25 bp, Rattus norvegicus
aatacccaccgcgactgcgatcgtt

SEQ ID NO: 546077 - DNA, 25 bp, Rattus norvegicus
cgtgatcgtgcccgcaccacgaata

SEQ ID NO: 546078 - DNA, 25 bp, Rattus norvegicus
tggtcacgcccacgtcagacacccg

SEQ ID NO: 546079 - DNA, 25 bp, Rattus norvegicus
ggaaacagctctgcgaaaccctctg

SEQ ID NO: 546080 - DNA, 25 bp, Rattus norvegicus
agctctacgtgcagctctgtgaccc

SEQ ID NO: 546081 - DNA, 25 bp, Rattus norvegicus
ttaacttgccgaccagctctacgtg

SEQ ID NO: 546082 - DNA, 25 bp, Rattus norvegicus
cccgtcctcactgagaggcttgggg

SEQ ID NO: 546083 - DNA, 25 bp, Rattus norvegicus
tgagggacccgtcctcactgagagg

SEQ ID NO: 546084 - DNA, 25 bp, Rattus norvegicus
cagcgggcggttaacttgccgacca

SEQ ID NO: 546085 - DNA, 25 bp, Rattus norvegicus
tcacgtcccgaatgcagcgtctacg

SEQ ID NO: 546086 - DNA, 25 bp, Rattus norvegicus
tgggacacaggcctttagtcagtca

SEQ ID NO: 546087 - DNA, 25 bp, Rattus norvegicus
gcactcgtgggacacaggcctttag

SEQ ID NO: 546088 - DNA, 25 bp, Rattus norvegicus
ccgagtacccggctgggcactcgtg

SEQ ID NO: 546089 - DNA, 25 bp, Rattus norvegicus
cgatgctgatgtgcgctctcccagt

SEQ ID NO: 546090 - DNA, 25 bp, Rattus norvegicus
ttggccgaggccctgacctcgggct

SEQ ID NO: 546091 - DNA, 25 bp, Rattus norvegicus
ttagtcagtcacctgtgtctgggcg

SEQ ID NO: 546092 - DNA, 25 bp, Rattus norvegicus
gaggtgacactttggccgaggccct

SEQ ID NO: 546093 - DNA, 25 bp, Rattus norvegicus
ggcacttcacgtcccgaatgcagcg

SEQ ID NO: 546094 - DNA, 25 bp, Rattus norvegicus
ccgctggaagttggcatcactgttc

SEQ ID NO: 546095 - DNA, 25 bp, Rattus norvegicus
ccacactggtggacctttttgcatc

SEQ ID NO: 546096 - DNA, 25 bp, Rattus norvegicus
tggaagtgcagatcaccacactggt

SEQ ID NO: 546097 - DNA, 25 bp, Rattus norvegicus
gctcgctccgtagactctggaagtg

SEQ ID NO: 546098 - DNA, 25 bp, Rattus norvegicus
agattatctgcggagtgcacccgga

SEQ ID NO: 546099 - DNA, 25 bp, Rattus norvegicus
agactctccttagctccgcgctggg

SEQ ID NO: 546100 - DNA, 25 bp, Rattus norvegicus
gctggggtcagagccagattatctg

SEQ ID NO: 546101 - DNA, 25 bp, Rattus norvegicus
aggacgctgaacctgcgaacctgcc

SEQ ID NO: 546102 - DNA, 25 bp, Rattus norvegicus
cttgacgtcactagaaggaggtgcc

SEQ ID NO: 546103 - DNA, 25 bp, Rattus norvegicus
tcgcgctcaccatggtcagctgctg

SEQ ID NO: 546104 - DNA, 25 bp, Rattus norvegicus
agcgagactacaagcgggcaagcga

SEQ ID NO: 546105 - DNA, 25 bp, Rattus norvegicus
acacttgtagcagtgggtacgcctc

SEQ ID NO: 546106 - DNA, 25 bp, Rattus norvegicus
ggtacgcctcgggacacacatcttt

SEQ ID NO: 546107 - DNA, 25 bp, Rattus norvegicus
gggtgtctgcttctcacaggtgaga

SEQ ID NO: 546108 - DNA, 25 bp, Rattus norvegicus
ctctccgctgtccttaaaggggccg

SEQ ID NO: 546109 - DNA, 25 bp, Rattus norvegicus
gaactgacactcctctccgtagaag

SEQ ID NO: 546110 - DNA, 25 bp, Rattus norvegicus
gcagtacttgagcttcacgcccgca

SEQ ID NO: 546111 - DNA, 25 bp, Rattus norvegicus
ccttggcgtagtagcggcagtactt

SEQ ID NO: 546112 - DNA, 25 bp, Rattus norvegicus
agcacgtcttgtccttggcgtagta

SEQ ID NO: 546113 - DNA, 25 bp, Rattus norvegicus
ctcctctccgtagaagcacgtcttg

SEQ ID NO: 546114 - DNA, 25 bp, Rattus norvegicus
cgggtcctcgtgcaggaactgacac

SEQ ID NO: 546115 - DNA, 25 bp, Rattus norvegicus
agcgccagcgggacgctgttgctat

SEQ ID NO: 546116 - DNA, 25 bp, Rattus norvegicus
gcggcgagtagggattctccctctc

SEQ ID NO: 546117 - DNA, 25 bp, Rattus norvegicus
ttccattttcctcttcctgagacgg

SEQ ID NO: 546118 - DNA, 25 bp, Rattus norvegicus
cgcgctccggttcctccgagttgtt

SEQ ID NO: 546119 - DNA, 25 bp, Rattus norvegicus
tgtttttaaactctgcctccgctcg

SEQ ID NO: 546120 - DNA, 25 bp, Rattus norvegicus
ccgccaccatagacgagggcgggaa

SEQ ID NO: 546121 - DNA, 25 bp, Rattus norvegicus
tttaaactctgcctccgctcgtcgt

SEQ ID NO: 546122 - DNA, 25 bp, Rattus norvegicus
aacagcgcaggtagcccgggactcc

SEQ ID NO: 546123 - DNA, 25 bp, Rattus norvegicus
aaagtctgcaacagcgcaggtagcc

SEQ ID NO: 546124 - DNA, 25 bp, Rattus norvegicus
ctgccagcctcggaaagtctgcaac

SEQ ID NO: 546125 - DNA, 25 bp, Rattus norvegicus
tcgggcttggatgctctgccagcct

SEQ ID NO: 546126 - DNA, 25 bp, Rattus norvegicus
tgaacttggcttcggttcgtccacc

SEQ ID NO: 546127 - DNA, 25 bp, Rattus norvegicus
cctcccgcgcgtgtgaacttggctt

SEQ ID NO: 546128 - DNA, 25 bp, Rattus norvegicus
accggctgccgctgcttggtaaggc

SEQ ID NO: 546129 - DNA, 25 bp, Rattus norvegicus
ctgggaccgcatcacaggctgggcc

SEQ ID NO: 546130 - DNA, 25 bp, Rattus norvegicus
gtgacgcgcattcttcagcgagcca

SEQ ID NO: 546131 - DNA, 25 bp, Rattus norvegicus
ctctgcaccagtccgagggaatctg

SEQ ID NO: 546132 - DNA, 25 bp, Rattus norvegicus
tgcgccagttcagcccgcttggcag

SEQ ID NO: 546133 - DNA, 25 bp, Rattus norvegicus
gcattcttcagcgagccacctgcag

SEQ ID NO: 546134 - DNA, 25 bp, Rattus norvegicus
accagtccgagggaatctgtggtcg

SEQ ID NO: 546135 - DNA, 25 bp, Rattus norvegicus
aatctgtggtcggtgacgcgcattc

SEQ ID NO: 546136 - DNA, 25 bp, Rattus norvegicus
gaagccagctcagccgtccctagga

SEQ ID NO: 546137 - DNA, 25 bp, Rattus norvegicus
tgtgaatggatgaggaagccagctc

SEQ ID NO: 546138 - DNA, 25 bp, Rattus norvegicus
tccggattgctgcagacgctcaacc

SEQ ID NO: 546139 - DNA, 25 bp, Rattus norvegicus
ggccagcggcgaaacctttgtgaat

SEQ ID NO: 546140 - DNA, 25 bp, Rattus norvegicus
cggcgaaacctttgtgaatggatga

SEQ ID NO: 546141 - DNA, 25 bp, Rattus norvegicus
ctaggaagccaaggtatgcggtgct

SEQ ID NO: 546142 - DNA, 25 bp, Rattus norvegicus
ctcagccgtccctaggaagccaagg

SEQ ID NO: 546143 - DNA, 25 bp, Rattus norvegicus
aacgcggtagcccacggcctcaatg

SEQ ID NO: 546144 - DNA, 25 bp, Rattus norvegicus
tagcccacggcctcaatggtggctc

SEQ ID NO: 546145 - DNA, 25 bp, Rattus norvegicus
ggccgccgctatgggctacagcagc

SEQ ID NO: 546146 - DNA, 25 bp, Rattus norvegicus
ccgccgaataccacgcacaccatca

SEQ ID NO: 546147 - DNA, 25 bp, Rattus norvegicus
atcatcaccctcaccatccggccgc

SEQ ID NO: 546148 - DNA, 25 bp, Rattus norvegicus
ctgcgcctccggattgctgcagacg

SEQ ID NO: 546149 - DNA, 25 bp, Rattus norvegicus
ccgtccctaggaagccaaggtatgc

SEQ ID NO: 546150 - DNA, 25 bp, Rattus norvegicus
cagatgagaggtcgctgtgaagtcc

SEQ ID NO: 546151 - DNA, 25 bp, Rattus norvegicus
tctgcagagcgtcatctgtcaaggg

SEQ ID NO: 546152 - DNA, 25 bp, Rattus norvegicus
agagcgtcatctgtcaaggggcaga

SEQ ID NO: 546153 - DNA, 25 bp, Rattus norvegicus
tgccggagcccgactcctctgcaga

SEQ ID NO: 546154 - DNA, 25 bp, Rattus norvegicus
taatgtagggaagctgtggcccgca

SEQ ID NO: 546155 - DNA, 25 bp, Rattus norvegicus
cgccgggcgcccttgtgatgttaat

SEQ ID NO: 546156 - DNA, 25 bp, Rattus norvegicus
gggcgcccttgtgatgttaatgtag

SEQ ID NO: 546157 - DNA, 25 bp, Rattus norvegicus
agcccaggccgcgaggtcagcagat

SEQ ID NO: 546158 - DNA, 25 bp, Rattus norvegicus
gaggagaacctcaggagcccaggcc

SEQ ID NO: 546159 - DNA, 25 bp, Rattus norvegicus
ctggcgaaagaacttttgcgtttag

SEQ ID NO: 546160 - DNA, 25 bp, Rattus norvegicus
cttagactggcgaaagaacttttgc

SEQ ID NO: 546161 - DNA, 25 bp, Rattus norvegicus
agatcgccggtaggggtcttagact

SEQ ID NO: 546162 - DNA, 25 bp, Rattus norvegicus
tgttaatgtagggaagctgtggccc

SEQ ID NO: 546163 - DNA, 25 bp, Rattus norvegicus
tcgctgtgaagtcccgcgccgaggt

SEQ ID NO: 546164 - DNA, 25 bp, Rattus norvegicus
ggaaagtcacctctgcacactagtc

SEQ ID NO: 546165 - DNA, 25 bp, Rattus norvegicus
cgagaagcctgtgatctacggtagc

SEQ ID NO: 546166 - DNA, 25 bp, Rattus norvegicus
cccgacgctaaatagcagatgtctc

SEQ ID NO: 546167 - DNA, 25 bp, Rattus norvegicus
ggcagtcccgttcctcgagactcta

SEQ ID NO: 546168 - DNA, 25 bp, Rattus norvegicus
cactagtctctctgctttttcaagg

SEQ ID NO: 546169 - DNA, 25 bp, Rattus norvegicus
ctacggtagcactcggggacagaat

SEQ ID NO: 546170 - DNA, 25 bp, Rattus norvegicus
gcccacagtatcgtcaggaaagtca

SEQ ID NO: 546171 - DNA, 25 bp, Rattus norvegicus
acgctgcccttgcacctattggaga

SEQ ID NO: 546172 - DNA, 25 bp, Rattus norvegicus
aaggagctgcaagtccaccgcgtga

SEQ ID NO: 546173 - DNA, 25 bp, Rattus norvegicus
atgcacctgagaagggcggttcctt

SEQ ID NO: 546174 - DNA, 25 bp, Rattus norvegicus
agccgctcgaccaatcaaggaattc

SEQ ID NO: 546175 - DNA, 25 bp, Rattus norvegicus
ttcctggcgagaagcaaagtccggc

SEQ ID NO: 546176 - DNA, 25 bp, Rattus norvegicus
ctcccgagttagagtgagcgcgttc

SEQ ID NO: 546177 - DNA, 25 bp, Rattus norvegicus
cctgagccaatcaacggcgggcgaa

SEQ ID NO: 546178 - DNA, 25 bp, Rattus norvegicus
ctccaggccgggtgaaaacactctg

SEQ ID NO: 546179 - DNA, 25 bp, Rattus norvegicus
cagagttacacaaccaaccgtttca

SEQ ID NO: 546180 - DNA, 25 bp, Rattus norvegicus
gagtccactacccatcgcgagtttg

SEQ ID NO: 546181 - DNA, 25 bp, Rattus norvegicus
ctatcccgtgattgtggtgtcctgg

SEQ ID NO: 546182 - DNA, 25 bp, Rattus norvegicus
ctactccacggagcagaactttcta

SEQ ID NO: 546183 - DNA, 25 bp, Rattus norvegicus
ggtcctagctgtccgtgctactcca

SEQ ID NO: 546184 - DNA, 25 bp, Rattus norvegicus
ttgagcagaaaagcagctccgctgc

SEQ ID NO: 546185 - DNA, 25 bp, Rattus norvegicus
acagttcagctgaagggagctctgc

SEQ ID NO: 546186 - DNA, 25 bp, Rattus norvegicus
tttgttccgcggagaacagttcagc

SEQ ID NO: 546187 - DNA, 25 bp, Rattus norvegicus
gctgtcaggctaatccggctgcctg

SEQ ID NO: 546188 - DNA, 25 bp, Rattus norvegicus
tgtacctgatggacacttgaaaacc

SEQ ID NO: 546189 - DNA, 25 bp, Rattus norvegicus
cggttccagtttgagctgtacctga

SEQ ID NO: 546190 - DNA, 25 bp, Rattus norvegicus
cggggatcgcagaaacggttccagt

SEQ ID NO: 546191 - DNA, 25 bp, Rattus norvegicus
ctctgcctggacctttgagcagaaa

SEQ ID NO: 546192 - DNA, 25 bp, Rattus norvegicus
gggaaggactcgtaagcagcaacta

SEQ ID NO: 546193 - DNA, 25 bp, Rattus norvegicus
agcccgccaaatgctcttccgtggg

SEQ ID NO: 546194 - DNA, 25 bp, Rattus norvegicus
gcccgtggaggcagttagaaagccc

SEQ ID NO: 546195 - DNA, 25 bp, Rattus norvegicus
tcacgcttgtcgtggaaccggacga

SEQ ID NO: 546196 - DNA, 25 bp, Rattus norvegicus
gcgccacccggaaatgaatctcctg

SEQ ID NO: 546197 - DNA, 25 bp, Rattus norvegicus
tcgtggatcagccaagagccgcaag

SEQ ID NO: 546198 - DNA, 25 bp, Rattus norvegicus
tcggcagctacaatcctcgtggatc

SEQ ID NO: 546199 - DNA, 25 bp, Rattus norvegicus
gcttctctctggctttcggcagcta

SEQ ID NO: 546200 - DNA, 25 bp, Rattus norvegicus
tcgctctcaggaaacgcggcttctc

SEQ ID NO: 546201 - DNA, 25 bp, Rattus norvegicus
gaggtcatgccctccacatcgggag

SEQ ID NO: 546202 - DNA, 25 bp, Rattus norvegicus
ttgtccaccttgagggaggtcatgc

SEQ ID NO: 546203 - DNA, 25 bp, Rattus norvegicus
gacgcgcccgtacttctcgaagacg

SEQ ID NO: 546204 - DNA, 25 bp, Rattus norvegicus
aagccacgggactccttggtgtagc

SEQ ID NO: 546205 - DNA, 25 bp, Rattus norvegicus
cctgattggctcattcggccgcgtt

SEQ ID NO: 546206 - DNA, 25 bp, Rattus norvegicus
ttgaacgtgggcagttcgactatgc

SEQ ID NO: 546207 - DNA, 25 bp, Rattus norvegicus
tctgttgatggtgcgctgtgtacgc

SEQ ID NO: 546208 - DNA, 25 bp, Rattus norvegicus
tgctcgtggtgttggttctgttgat

SEQ ID NO: 546209 - DNA, 25 bp, Rattus norvegicus
tcgagcaacgcacggtgttcgcctt

SEQ ID NO: 546210 - DNA, 25 bp, Rattus norvegicus
atgagtgcgccgtggacactgtcac

SEQ ID NO: 546211 - DNA, 25 bp, Rattus norvegicus
tgagatacagcaaaggggcgactcc

SEQ ID NO: 546212 - DNA, 25 bp, Rattus norvegicus
tctggtctgtcccagtgcgttcgca

SEQ ID NO: 546213 - DNA, 25 bp, Rattus norvegicus
ctgggcagatctaagctgacctgtc

SEQ ID NO: 546214 - DNA, 25 bp, Rattus norvegicus
tggaccgaccacaaggaggcgcttg

SEQ ID NO: 546215 - DNA, 25 bp, Rattus norvegicus
ccggggaagaccagaacaaagcagc

SEQ ID NO: 546216 - DNA, 25 bp, Rattus norvegicus
cagcgcacgagtcccaagaaagaga

SEQ ID NO: 546217 - DNA, 25 bp, Rattus norvegicus
cggggaccagttccaacagtgcagc

SEQ ID NO: 546218 - DNA, 25 bp, Rattus norvegicus
gctgtgtacgcatactgctagaccc

SEQ ID NO: 546219 - DNA, 25 bp, Rattus norvegicus
tagcccggagacgacagcagggata

SEQ ID NO: 546220 - DNA, 25 bp, Rattus norvegicus
ttcctggtggattcccttgtgctgc

SEQ ID NO: 546221 - DNA, 25 bp, Rattus norvegicus
tggcgtagcccatcacatggcaata

SEQ ID NO: 546222 - DNA, 25 bp, Rattus norvegicus
tagtcctatttaagcggcgccgccg

SEQ ID NO: 546223 - DNA, 25 bp, Rattus norvegicus
cgtctttcagcaccactagcgctgg

SEQ ID NO: 546224 - DNA, 25 bp, Rattus norvegicus
agcagcagccaaggtgattccagcc

SEQ ID NO: 546225 - DNA, 25 bp, Rattus norvegicus
gcagagggaggccactgcagaatcc

SEQ ID NO: 546226 - DNA, 25 bp, Rattus norvegicus
tgcagaatccgcagttccctcgggc

SEQ ID NO: 546227 - DNA, 25 bp, Rattus norvegicus
cagtttcactgcatctccgtgggta

SEQ ID NO: 546228 - DNA, 25 bp, Rattus norvegicus
atgccgcgctctttcctggtggatt

SEQ ID NO: 546229 - DNA, 25 bp, Rattus norvegicus
tgccggatcccagacagtttcactg

SEQ ID NO: 546230 - DNA, 25 bp, Rattus norvegicus
ttcccttgtgctgcgggaagccagc

SEQ ID NO: 546231 - DNA, 25 bp, Rattus norvegicus
cgggaagccagcgacaagaaggctc

SEQ ID NO: 546232 - DNA, 25 bp, Rattus norvegicus
tctgtgtcaccgcttcgcagctgca

SEQ ID NO: 546233 - DNA, 25 bp, Rattus norvegicus
cttcggatcgcagtactgccacgca

SEQ ID NO: 546234 - DNA, 25 bp, Rattus norvegicus
ccgccgggtgaagcacaagaaagaa

SEQ ID NO: 546235 - DNA, 25 bp, Rattus norvegicus
aaggcaagggcagtaaccaccgcgg

SEQ ID NO: 546236 - DNA, 25 bp, Rattus norvegicus
gcgcgagttcgcctccaacatgtac

SEQ ID NO: 546237 - DNA, 25 bp, Rattus norvegicus
gagttcgcctccaacatgtacctct

SEQ ID NO: 546238 - DNA, 25 bp, Rattus norvegicus
aacatgtacctctcccgcctgcggc

SEQ ID NO: 546239 - DNA, 25 bp, Rattus norvegicus
agaaagaaggcaagggcagtaacca

SEQ ID NO: 546240 - DNA, 25 bp, Rattus norvegicus
gcgcatcgagatcgcgacctatctg

SEQ ID NO: 546241 - DNA, 25 bp, Rattus norvegicus
cgagatcgcgacctatctgaatctg

SEQ ID NO: 546242 - DNA, 25 bp, Rattus norvegicus
gcgacctatctgaatctgtccgaga

SEQ ID NO: 546243 - DNA, 25 bp, Rattus norvegicus
acctatctgaatctgtccgagaagc

SEQ ID NO: 546244 - DNA, 25 bp, Rattus norvegicus
tatctgaatctgtccgagaagcagg

SEQ ID NO: 546245 - DNA, 25 bp, Rattus norvegicus
aatctgtccgagaagcaggtgaaga

SEQ ID NO: 546246 - DNA, 25 bp, Rattus norvegicus
ctggagcgcgagttcgcctccaaca

SEQ ID NO: 546247 - DNA, 25 bp, Rattus norvegicus
gaaccgccgggtgaagcacaagaaa

SEQ ID NO: 546248 - DNA, 25 bp, Rattus norvegicus
gccagcgatgcagcccaggctctgg

SEQ ID NO: 546249 - DNA, 25 bp, Rattus norvegicus
cccagacatggtgagtggccgcatg

SEQ ID NO: 546250 - DNA, 25 bp, Rattus norvegicus
tctgggattttaaagagctcgggga

SEQ ID NO: 546251 - DNA, 25 bp, Rattus norvegicus
caggctctgggattttaaagagctc

SEQ ID NO: 546252 - DNA, 25 bp, Rattus norvegicus
cctgggtgacttggcgcgcctttgt

SEQ ID NO: 546253 - DNA, 25 bp, Rattus norvegicus
agccggctggatacgcgcggacaca

SEQ ID NO: 546254 - DNA, 25 bp, Rattus norvegicus
cccgctgcagaagagccggctggat

SEQ ID NO: 546255 - DNA, 25 bp, Rattus norvegicus
atcctccgctgtccctgggtgactt

SEQ ID NO: 546256 - DNA, 25 bp, Rattus norvegicus
gcttaatgtccttgggcaggaggta

SEQ ID NO: 546257 - DNA, 25 bp, Rattus norvegicus
agcaccgccagcttaatgtccttgg

SEQ ID NO: 546258 - DNA, 25 bp, Rattus norvegicus
ttgcccacacaactcgcgcccagca

SEQ ID NO: 546259 - DNA, 25 bp, Rattus norvegicus
gcctttgtcccactcaccgctcttg

SEQ ID NO: 546260 - DNA, 25 bp, Rattus norvegicus
ggcatccctgcggacggggatcctc

SEQ ID NO: 546261 - DNA, 25 bp, Rattus norvegicus
cgctagcagaaagtgcccagacatg

SEQ ID NO: 546262 - DNA, 25 bp, Rattus norvegicus
cacgcgcacaccaacctggaagatg

SEQ ID NO: 546263 - DNA, 25 bp, Rattus norvegicus
gtgagcatgctctcctttgcacaga

SEQ ID NO: 546264 - DNA, 25 bp, Rattus norvegicus
gcctgaagagaaacggccggcctga

SEQ ID NO: 546265 - DNA, 25 bp, Rattus norvegicus
ttgcacagattgaagacagcaggcc

SEQ ID NO: 546266 - DNA, 25 bp, Rattus norvegicus
tcgtgttaaacagcccagaatgggg

SEQ ID NO: 546267 - DNA, 25 bp, Rattus norvegicus
cttagagccagacgcgacttccgta

SEQ ID NO: 546268 - DNA, 25 bp, Rattus norvegicus
acttccgtagcgtgctgacgttacc

SEQ ID NO: 546269 - DNA, 25 bp, Rattus norvegicus
tgacgttaccctgcgtcatgtgacg

SEQ ID NO: 546270 - DNA, 25 bp, Rattus norvegicus
tcatgtgacgtgagggaccgcctct

SEQ ID NO: 546271 - DNA, 25 bp, Rattus norvegicus
cctctgtcttgtcctacgttctgtg

SEQ ID NO: 546272 - DNA, 25 bp, Rattus norvegicus
ctgcgtcttagtgttcgtagcgtga

SEQ ID NO: 546273 - DNA, 25 bp, Rattus norvegicus
cgtgagtcgcgtaggcaaacagtta

SEQ ID NO: 546274 - DNA, 25 bp, Rattus norvegicus
ccggcctgagaggatcttcgagaga

SEQ ID NO: 546275 - DNA, 25 bp, Rattus norvegicus
taacctagagactccgtgagcatgc

SEQ ID NO: 546276 - DNA, 25 bp, Rattus norvegicus
cgaccctgtcggtgcgtctggaaac

SEQ ID NO: 546277 - DNA, 25 bp, Rattus norvegicus
ttagcacgcccttctttccgaggcg

SEQ ID NO: 546278 - DNA, 25 bp, Rattus norvegicus
ttccgcatctgcagtgcgcaggtcc

SEQ ID NO: 546279 - DNA, 25 bp, Rattus norvegicus
gccgcggcgcatgagttccgcatct

SEQ ID NO: 546280 - DNA, 25 bp, Rattus norvegicus
ctagaagaactaaggcacgccactg

SEQ ID NO: 546281 - DNA, 25 bp, Rattus norvegicus
gtctcaggccttctttcaccatcta

SEQ ID NO: 546282 - DNA, 25 bp, Rattus norvegicus
aaagctgagagaagaccgtccggtc

SEQ ID NO: 546283 - DNA, 25 bp, Rattus norvegicus
gtgagactcacaaaatgacccttcc

SEQ ID NO: 546284 - DNA, 25 bp, Rattus norvegicus
atcttccactgaggcgcgaagctta

SEQ ID NO: 546285 - DNA, 25 bp, Rattus norvegicus
ttcgaaggcctctacgccctctaat

SEQ ID NO: 546286 - DNA, 25 bp, Rattus norvegicus
gcggaagattcactggccgagcctt

SEQ ID NO: 546287 - DNA, 25 bp, Rattus norvegicus
ctcccggaagtagtagtgagactca

SEQ ID NO: 546288 - DNA, 25 bp, Rattus norvegicus
gcggttgtcctcaccgaggcagtga

SEQ ID NO: 546289 - DNA, 25 bp, Rattus norvegicus
cttagagtctctgctgctgctcgga

SEQ ID NO: 546290 - DNA, 25 bp, Rattus norvegicus
gtccgacattatctcagcaccgacg

SEQ ID NO: 546291 - DNA, 25 bp, Rattus norvegicus
ggtaagtccgacattatctcagcac

SEQ ID NO: 546292 - DNA, 25 bp, Rattus norvegicus
cacgtggtaagtccgacattatctc

SEQ ID NO: 546293 - DNA, 25 bp, Rattus norvegicus
ggccacgtggtaagtccgacattat

SEQ ID NO: 546294 - DNA, 25 bp, Rattus norvegicus
ctgggccacgtggtaagtccgacat

SEQ ID NO: 546295 - DNA, 25 bp, Rattus norvegicus
gcgctttggctgcactgccgactgg

SEQ ID NO: 546296 - DNA, 25 bp, Rattus norvegicus
agagccttggcgctttggctgcact

SEQ ID NO: 546297 - DNA, 25 bp, Rattus norvegicus
ccgtgcacaagagccttggcgcttt

SEQ ID NO: 546298 - DNA, 25 bp, Rattus norvegicus
agccatccgtgcacaagagccttgg

SEQ ID NO: 546299 - DNA, 25 bp, Rattus norvegicus
ctacagcagccatccgtgcacaaga

SEQ ID NO: 546300 - DNA, 25 bp, Rattus norvegicus
atctgctacagcagccatccgtgca

SEQ ID NO: 546301 - DNA, 25 bp, Rattus norvegicus
cgtcatggtaaaatctgctacagca

SEQ ID NO: 546302 - DNA, 25 bp, Rattus norvegicus
gccgcgtcatggtaaaatctgctac

SEQ ID NO: 546303 - DNA, 25 bp, Rattus norvegicus
ccagcgcgtccctcggctgtcgcgc

SEQ ID NO: 546304 - DNA, 25 bp, Rattus norvegicus
cgacccgcatggatcttacctaaga

SEQ ID NO: 546305 - DNA, 25 bp, Rattus norvegicus
acccgcatggatcttacctaagatc

SEQ ID NO: 546306 - DNA, 25 bp, Rattus norvegicus
tcttacctaagatcacggctgtgcg

SEQ ID NO: 546307 - DNA, 25 bp, Rattus norvegicus
ttacctaagatcacggctgtgcgag

SEQ ID NO: 546308 - DNA, 25 bp, Rattus norvegicus
ctaagatcacggctgtgcgaggaga

SEQ ID NO: 546309 - DNA, 25 bp, Rattus norvegicus
gatcacggctgtgcgaggagataac

SEQ ID NO: 546310 - DNA, 25 bp, Rattus norvegicus
cggctgtgcgaggagataacgacct

SEQ ID NO: 546311 - DNA, 25 bp, Rattus norvegicus
gctgtgcgaggagataacgaccttc

SEQ ID NO: 546312 - DNA, 25 bp, Rattus norvegicus
cgaggagataacgaccttcgcagcc

SEQ ID NO: 546313 - DNA, 25 bp, Rattus norvegicus
gagataacgaccttcgcagccgctg

SEQ ID NO: 546314 - DNA, 25 bp, Rattus norvegicus
acctgctgcctgctccgtccagccc

SEQ ID NO: 546315 - DNA, 25 bp, Rattus norvegicus
cgcggccttgactgcgcgctcagca

SEQ ID NO: 546316 - DNA, 25 bp, Rattus norvegicus
ttgcgcggaccggaagtaggtggcg

SEQ ID NO: 546317 - DNA, 25 bp, Rattus norvegicus
ccgacccgcatggatcttacctaag

SEQ ID NO: 546318 - DNA, 25 bp, Rattus norvegicus
agcggaccacgagaccgagctgcca

SEQ ID NO: 546319 - DNA, 25 bp, Rattus norvegicus
ctggggtcgagcagatgattaacac

SEQ ID NO: 546320 - DNA, 25 bp, Rattus norvegicus
gtcctaggtgaggttcccggatgaa

SEQ ID NO: 546321 - DNA, 25 bp, Rattus norvegicus
tcacttccggcgacggaagtccgcg

SEQ ID NO: 546322 - DNA, 25 bp, Rattus norvegicus
agaaggctggcgctttacgtcactt

SEQ ID NO: 546323 - DNA, 25 bp, Rattus norvegicus
ccggggccactctcgattgccagaa

SEQ ID NO: 546324 - DNA, 25 bp, Rattus norvegicus
ctgagtctcaccagcctttccgggg

SEQ ID NO: 546325 - DNA, 25 bp, Rattus norvegicus
tcacggagacgctcctcgctgagtc

SEQ ID NO: 546326 - DNA, 25 bp, Rattus norvegicus
cctagagactgtcccgtcacggaga

SEQ ID NO: 546327 - DNA, 25 bp, Rattus norvegicus
agcctggtgtccttcagatccaagg

SEQ ID NO: 546328 - DNA, 25 bp, Rattus norvegicus
ctgggcttcgcgacgaacccgggat

SEQ ID NO: 546329 - DNA, 25 bp, Rattus norvegicus
ctacctacttccctttcaggcaaag

SEQ ID NO: 546330 - DNA, 25 bp, Rattus norvegicus
taacacgggatgaggattcgtagcc

SEQ ID NO: 546331 - DNA, 25 bp, Rattus norvegicus
ctcccacggagacgcgacaacggtt

SEQ ID NO: 546332 - DNA, 25 bp, Rattus norvegicus
aagtagccggccctgaggaggcgct

SEQ ID NO: 546333 - DNA, 25 bp, Rattus norvegicus
ccacctctcggcgttgggctttgtg

SEQ ID NO: 546334 - DNA, 25 bp, Rattus norvegicus
tgaaagtggaggaggactctcccgg

SEQ ID NO: 546335 - DNA, 25 bp, Rattus norvegicus
ggactctcccgggagtcaggagccc

SEQ ID NO: 546336 - DNA, 25 bp, Rattus norvegicus
gtcaggagccctccggttccggaga

SEQ ID NO: 546337 - DNA, 25 bp, Rattus norvegicus
agccctccggttccggagattggca

SEQ ID NO: 546338 - DNA, 25 bp, Rattus norvegicus
cggagattggcagaatcccgaaact

SEQ ID NO: 546339 - DNA, 25 bp, Rattus norvegicus
ggcagaatcccgaaacttctcgaaa

SEQ ID NO: 546340 - DNA, 25 bp, Rattus norvegicus
cgaaacttctcgaaaacagttcaga

SEQ ID NO: 546341 - DNA, 25 bp, Rattus norvegicus
ctcgaaaacagttcagacaattgcg

SEQ ID NO: 546342 - DNA, 25 bp, Rattus norvegicus
agttcagacaattgcgctaccagga

SEQ ID NO: 546343 - DNA, 25 bp, Rattus norvegicus
attgcgctaccaggaagtagccggc

SEQ ID NO: 546344 - DNA, 25 bp, Rattus norvegicus
gcgctgagccgactttgggagctct

SEQ ID NO: 546345 - DNA, 25 bp, Rattus norvegicus
cagacaattgcgctaccaggaagta

SEQ ID NO: 546346 - DNA, 25 bp, Rattus norvegicus
tcctcctcgcacagcctggagaggg

SEQ ID NO: 546347 - DNA, 25 bp, Rattus norvegicus
tcctcagagggaacaatgcggcgcc

SEQ ID NO: 546348 - DNA, 25 bp, Rattus norvegicus
catctttccctgcactttgcagtta

SEQ ID NO: 546349 - DNA, 25 bp, Rattus norvegicus
gcactttgcagttaccggagcggtc

SEQ ID NO: 546350 - DNA, 25 bp, Rattus norvegicus
ttaccggagcggtcttggctctccg

SEQ ID NO: 546351 - DNA, 25 bp, Rattus norvegicus
ttggctctccgggttgctggatgcc

SEQ ID NO: 546352 - DNA, 25 bp, Rattus norvegicus
gctggatgccctcggaagttacatg

SEQ ID NO: 546353 - DNA, 25 bp, Rattus norvegicus
cctcggaagttacatggttcaggga

SEQ ID NO: 546354 - DNA, 25 bp, Rattus norvegicus
ccacctcctcagagggaacaatgcg

SEQ ID NO: 546355 - DNA, 25 bp, Rattus norvegicus
acaatgcggcgcctcgggttgtagc

SEQ ID NO: 546356 - DNA, 25 bp, Rattus norvegicus
agccagcgagcctagcaggcagacg

SEQ ID NO: 546357 - DNA, 25 bp, Rattus norvegicus
agacacagagactgcccggcccgga

SEQ ID NO: 546358 - DNA, 25 bp, Rattus norvegicus
ttcccggttcccgaggcagctagag

SEQ ID NO: 546359 - DNA, 25 bp, Rattus norvegicus
tgagacctcggccaccagatggcgc

SEQ ID NO: 546360 - DNA, 25 bp, Rattus norvegicus
cagtcccgaggattgccacggagca

SEQ ID NO: 546361 - DNA, 25 bp, Rattus norvegicus
cagtcccaggatccaaggaaaggtc

SEQ ID NO: 546362 - DNA, 25 bp, Rattus norvegicus
gagcagtcccaggatccaaggaaag

SEQ ID NO: 546363 - DNA, 25 bp, Rattus norvegicus
cccgaggattgccacggagcagtcc

SEQ ID NO: 546364 - DNA, 25 bp, Rattus norvegicus
tcctgcagtcccgaggattgccacg

SEQ ID NO: 546365 - DNA, 25 bp, Rattus norvegicus
acagtcctgcagtcccgaggattgc

SEQ ID NO: 546366 - DNA, 25 bp, Rattus norvegicus
cgacacagtcctgcagtcccgagga

SEQ ID NO: 546367 - DNA, 25 bp, Rattus norvegicus
ttacgcgaacaaccgacacagtcct

SEQ ID NO: 546368 - DNA, 25 bp, Rattus norvegicus
gaattacgcgaacaaccgacacagt

SEQ ID NO: 546369 - DNA, 25 bp, Rattus norvegicus
actgaagaattacgcgaacaaccga

SEQ ID NO: 546370 - DNA, 25 bp, Rattus norvegicus
tcactgaagaattacgcgaacaacc

SEQ ID NO: 546371 - DNA, 25 bp, Rattus norvegicus
gcgttcactgaagaattacgcgaac

SEQ ID NO: 546372 - DNA, 25 bp, Rattus norvegicus
gaacaaccgacacagtcctgcagtc

SEQ ID NO: 546373 - DNA, 25 bp, Rattus norvegicus
aggattgccacggagcagtcccagg

SEQ ID NO: 546374 - DNA, 25 bp, Rattus norvegicus
agagcactatgcgtttgattttata

SEQ ID NO: 546375 - DNA, 25 bp, Rattus norvegicus
aactccatctttcacgcatatccgg

SEQ ID NO: 546376 - DNA, 25 bp, Rattus norvegicus
tatccggtgcgccaatgacttccgc

SEQ ID NO: 546377 - DNA, 25 bp, Rattus norvegicus
aatgacttccgcgaccgtcaacagc

SEQ ID NO: 546378 - DNA, 25 bp, Rattus norvegicus
ttagctcggccattcggcttcccgg

SEQ ID NO: 546379 - DNA, 25 bp, Rattus norvegicus
tagtctcagtaggtgccgcatctcg

SEQ ID NO: 546380 - DNA, 25 bp, Rattus norvegicus
gggccggtagcttcacctgtgtacc

SEQ ID NO: 546381 - DNA, 25 bp, Rattus norvegicus
gccgaagcggtcagacagagcacta

SEQ ID NO: 546382 - DNA, 25 bp, Rattus norvegicus
ctatggagctcttttctggtgggcg

SEQ ID NO: 546383 - DNA, 25 bp, Rattus norvegicus
ggagctccaccttagctcggccatt

SEQ ID NO: 546384 - DNA, 25 bp, Rattus norvegicus
cttcacctgtgtaccgtgcggggac

SEQ ID NO: 546385 - DNA, 25 bp, Rattus norvegicus
ttcatgccggaactctatggagctc

SEQ ID NO: 546386 - DNA, 25 bp, Rattus norvegicus
tccgccgtctctgcggtggcttcat

SEQ ID NO: 546387 - DNA, 25 bp, Rattus norvegicus
cgccgagcctggagtagtctcagta

SEQ ID NO: 546388 - DNA, 25 bp, Rattus norvegicus
tgagggtaagaacggcgtctctaag

SEQ ID NO: 546389 - DNA, 25 bp, Rattus norvegicus
cgcctgtttctctcggttccgattc

SEQ ID NO: 546390 - DNA, 25 bp, Rattus norvegicus
ttcctcttgcgtgctgagggtaaga

SEQ ID NO: 546391 - DNA, 25 bp, Rattus norvegicus
tgctgagggtaagaacggcgtctct

SEQ ID NO: 546392 - DNA, 25 bp, Rattus norvegicus
ggtcgcctgtttctctcggttccga

SEQ ID NO: 546393 - DNA, 25 bp, Rattus norvegicus
ctgtttctctcggttccgattcaga

SEQ ID NO: 546394 - DNA, 25 bp, Rattus norvegicus
tctcggttccgattcagacagaaca

SEQ ID NO: 546395 - DNA, 25 bp, Rattus norvegicus
ttccgattcagacagaacatgaggc

SEQ ID NO: 546396 - DNA, 25 bp, Rattus norvegicus
ttcagacagaacatgaggcggcgac

SEQ ID NO: 546397 - DNA, 25 bp, Rattus norvegicus
aggcggcgacgcaagtgcgcctgcg

SEQ ID NO: 546398 - DNA, 25 bp, Rattus norvegicus
tgcgcgggaccttcctcttgcgtgc

SEQ ID NO: 546399 - DNA, 25 bp, Rattus norvegicus
gggaccttcctcttgcgtgctgagg

SEQ ID NO: 546400 - DNA, 25 bp, Rattus norvegicus
gacagaacatgaggcggcgacgcaa

SEQ ID NO: 546401 - DNA, 25 bp, Rattus norvegicus
gactggtcgcctgtttctctcggtt

SEQ ID NO: 546402 - DNA, 25 bp, Rattus norvegicus
gcttctttattgacggcttccgctc

SEQ ID NO: 546403 - DNA, 25 bp, Rattus norvegicus
cgctccggtgagaaactcttcagaa

SEQ ID NO: 546404 - DNA, 25 bp, Rattus norvegicus
ctcgcccagagattgcgtcatctta

SEQ ID NO: 546405 - DNA, 25 bp, Rattus norvegicus
cgtagcgctgcctttgtagaatttc

SEQ ID NO: 546406 - DNA, 25 bp, Rattus norvegicus
gcacggctacgtgtctcctcagaca

SEQ ID NO: 546407 - DNA, 25 bp, Rattus norvegicus
gggcctctaagagatccgcgacgaa

SEQ ID NO: 546408 - DNA, 25 bp, Rattus norvegicus
gattcctggctgcacatattctggc

SEQ ID NO: 546409 - DNA, 25 bp, Rattus norvegicus
gggcctcgacgctcaattgtcctga

SEQ ID NO: 546410 - DNA, 25 bp, Rattus norvegicus
cctgactgggaatttgaggaccaca

SEQ ID NO: 546411 - DNA, 25 bp, Rattus norvegicus
ttgtcccggaggaaagcaggaacca

SEQ ID NO: 546412 - DNA, 25 bp, Rattus norvegicus
cgtctgaagtttgtcctcccatttg

SEQ ID NO: 546413 - DNA, 25 bp, Rattus norvegicus
ctgtctgcctcgagcataaaatgtg

SEQ ID NO: 546414 - DNA, 25 bp, Rattus norvegicus
tggccaggaattcaggcacctctta

SEQ ID NO: 546415 - DNA, 25 bp, Rattus norvegicus
tgaggtcccagttcctcgcagcagc

SEQ ID NO: 546416 - DNA, 25 bp, Rattus norvegicus
cctggacccctgctgagtgggcatg

SEQ ID NO: 546417 - DNA, 25 bp, Rattus norvegicus
gtctactcgcccagaccgggtgaga

SEQ ID NO: 546418 - DNA, 25 bp, Rattus norvegicus
tctactcgcccagaccgggtgagac

SEQ ID NO: 546419 - DNA, 25 bp, Rattus norvegicus
caggaacctggacccctgctgagtg

SEQ ID NO: 546420 - DNA, 25 bp, Rattus norvegicus
ggggcagggtgctagctcatttccc

SEQ ID NO: 546421 - DNA, 25 bp, Rattus norvegicus
tagctcatttcccggtctcaacaac

SEQ ID NO: 546422 - DNA, 25 bp, Rattus norvegicus
cggtctcaacaacccggaaggctgc

SEQ ID NO: 546423 - DNA, 25 bp, Rattus norvegicus
tcaacaacccggaaggctgcgaacc

SEQ ID NO: 546424 - DNA, 25 bp, Rattus norvegicus
caacccggaaggctgcgaaccaagg

SEQ ID NO: 546425 - DNA, 25 bp, Rattus norvegicus
gccctgcgcccaaagtaacggggca

SEQ ID NO: 546426 - DNA, 25 bp, Rattus norvegicus
tgcgcccaaagtaacggggcaactc

SEQ ID NO: 546427 - DNA, 25 bp, Rattus norvegicus
ggcaactcgggacgcgaggatagga

SEQ ID NO: 546428 - DNA, 25 bp, Rattus norvegicus
acgcgaggataggaaagcggggcca

SEQ ID NO: 546429 - DNA, 25 bp, Rattus norvegicus
tcgcccagaccgggtgagacccagg

SEQ ID NO: 546430 - DNA, 25 bp, Rattus norvegicus
tccggagcgaacgattcgcggactc

SEQ ID NO: 546431 - DNA, 25 bp, Rattus norvegicus
agagcagcctctttcggctgcccgc

SEQ ID NO: 546432 - DNA, 25 bp, Rattus norvegicus
attcgcggactctggtcagtcgacg

SEQ ID NO: 546433 - DNA, 25 bp, Rattus norvegicus
cggctgacagatcccggaagtggtc

SEQ ID NO: 546434 - DNA, 25 bp, Rattus norvegicus
tcagtcgacgcgaacaggctccggc

SEQ ID NO: 546435 - DNA, 25 bp, Rattus norvegicus
tctggtcagtcgacgcgaacaggct

SEQ ID NO: 546436 - DNA, 25 bp, Rattus norvegicus
ggactctggtcagtcgacgcgaaca

SEQ ID NO: 546437 - DNA, 25 bp, Rattus norvegicus
aacgattcgcggactctggtcagtc

SEQ ID NO: 546438 - DNA, 25 bp, Rattus norvegicus
ggccctgcagctccttacctggggt

SEQ ID NO: 546439 - DNA, 25 bp, Rattus norvegicus
gaggcgacccggaccagactctcgg

SEQ ID NO: 546440 - DNA, 25 bp, Rattus norvegicus
catacaagaaatggaggcgacccgg

SEQ ID NO: 546441 - DNA, 25 bp, Rattus norvegicus
cgtgccatagaacatacaagaaatg

SEQ ID NO: 546442 - DNA, 25 bp, Rattus norvegicus
cccgcgtgccatagaacatacaaga

SEQ ID NO: 546443 - DNA, 25 bp, Rattus norvegicus
ctgcagctccttacctggggtaggg

SEQ ID NO: 546444 - DNA, 25 bp, Rattus norvegicus
gctgcgaacccaaccctgcccggta

SEQ ID NO: 546445 - DNA, 25 bp, Rattus norvegicus
tcacaagggcttgcggaatggctcc

SEQ ID NO: 546446 - DNA, 25 bp, Rattus norvegicus
acatcacaagggcttgcggaatggc

SEQ ID NO: 546447 - DNA, 25 bp, Rattus norvegicus
gcataacatcacaagggcttgcgga

SEQ ID NO: 546448 - DNA, 25 bp, Rattus norvegicus
tcaagcataacatcacaagggcttg

SEQ ID NO: 546449 - DNA, 25 bp, Rattus norvegicus
tacatcaagcataacatcacaaggg

SEQ ID NO: 546450 - DNA, 25 bp, Rattus norvegicus
tctctgctacatcaagcataacatc

SEQ ID NO: 546451 - DNA, 25 bp, Rattus norvegicus
tctcatctctgctacatcaagcata

SEQ ID NO: 546452 - DNA, 25 bp, Rattus norvegicus
gcattctcatctctgctacatcaag

SEQ ID NO: 546453 - DNA, 25 bp, Rattus norvegicus
tcagcattctcatctctgctacatc

SEQ ID NO: 546454 - DNA, 25 bp, Rattus norvegicus
aatgtttcagcattctcatctctgc

SEQ ID NO: 546455 - DNA, 25 bp, Rattus norvegicus
gtttcaacaatgtttcagcattctc

SEQ ID NO: 546456 - DNA, 25 bp, Rattus norvegicus
tctaacttttaatgtttcaacaatg

SEQ ID NO: 546457 - DNA, 25 bp, Rattus norvegicus
gctccccgggtaaaagcgctgtctg

SEQ ID NO: 546458 - DNA, 25 bp, Rattus norvegicus
tccgtctgacaggtaggcacgacag

SEQ ID NO: 546459 - DNA, 25 bp, Rattus norvegicus
cagcgcggctgagcgctcagttcta

SEQ ID NO: 546460 - DNA, 25 bp, Rattus norvegicus
gagcgctcagttctacggttccagc

SEQ ID NO: 546461 - DNA, 25 bp, Rattus norvegicus
ttctacggttccagcccgtggtctc

SEQ ID NO: 546462 - DNA, 25 bp, Rattus norvegicus
cagcccgtggccgtaaccttgaggc

SEQ ID NO: 546463 - DNA, 25 bp, Rattus norvegicus
gggacccgtaggaacggctccagca

SEQ ID NO: 546464 - DNA, 25 bp, Rattus norvegicus
cggctccagcatcaagatccgtctg

SEQ ID NO: 546465 - DNA, 25 bp, Rattus norvegicus
atcaagatccgtctgacaggtaggc

SEQ ID NO: 546466 - DNA, 25 bp, Rattus norvegicus
gcctcgccctcgtcacatcaggaca

SEQ ID NO: 546467 - DNA, 25 bp, Rattus norvegicus
cgccctccttctgcgtcaagccacg

SEQ ID NO: 546468 - DNA, 25 bp, Rattus norvegicus
agccacgcctcgctgatctgcagta

SEQ ID NO: 546469 - DNA, 25 bp, Rattus norvegicus
acgcctcgctgatctgcagtactcg

SEQ ID NO: 546470 - DNA, 25 bp, Rattus norvegicus
cgtaggaacggctccagcatcaaga

SEQ ID NO: 546471 - DNA, 25 bp, Rattus norvegicus
ctccctctgcatcaggcctcgccct

SEQ ID NO: 546472 - DNA, 25 bp, Rattus norvegicus
gtggacccgtcgtgctgcaccgact

SEQ ID NO: 546473 - DNA, 25 bp, Rattus norvegicus
accgagaactaagctcgggcgcacc

SEQ ID NO: 546474 - DNA, 25 bp, Rattus norvegicus
ccagtagcctgcgtggaggcccgca

SEQ ID NO: 546475 - DNA, 25 bp, Rattus norvegicus
cgcgcttaccgggacctgcggacta

SEQ ID NO: 546476 - DNA, 25 bp, Rattus norvegicus
acttctccgtggacccgtcgtgctg

SEQ ID NO: 546477 - DNA, 25 bp, Rattus norvegicus
gctcggccaagcaaggacaaccttc

SEQ ID NO: 546478 - DNA, 25 bp, Rattus norvegicus
ctccagtgtggcagattgagccttg

SEQ ID NO: 546479 - DNA, 25 bp, Rattus norvegicus
ggactaaatgctccagtgtggcaga

SEQ ID NO: 546480 - DNA, 25 bp, Rattus norvegicus
gcgccgcggaggactaaatgctcca

SEQ ID NO: 546481 - DNA, 25 bp, Rattus norvegicus
agggccaatcttcgcggccgctagc

SEQ ID NO: 546482 - DNA, 25 bp, Rattus norvegicus
aacgccgagggccaatcttcgcggc

SEQ ID NO: 546483 - DNA, 25 bp, Rattus norvegicus
aggcctctgagctacggcgaacgcc

SEQ ID NO: 546484 - DNA, 25 bp, Rattus norvegicus
gcccgcagatgccaggatggctttg

SEQ ID NO: 546485 - DNA, 25 bp, Rattus norvegicus
ggacctgcggactagcctccagcat

SEQ ID NO: 546486 - DNA, 25 bp, Rattus norvegicus
gtctctacgcacaaccagacggagc

SEQ ID NO: 546487 - DNA, 25 bp, Rattus norvegicus
ctccctgagcatccgcccggcgccc

SEQ ID NO: 546488 - DNA, 25 bp, Rattus norvegicus
gagcgctgctgcgtctctacgcaca

SEQ ID NO: 546489 - DNA, 25 bp, Rattus norvegicus
tgcgtctctacgcacaaccagacgg

SEQ ID NO: 546490 - DNA, 25 bp, Rattus norvegicus
cacaaccagacggagccgccactgc

SEQ ID NO: 546491 - DNA, 25 bp, Rattus norvegicus
ccgccactgcggagctccagcccag

SEQ ID NO: 546492 - DNA, 25 bp, Rattus norvegicus
tccagcccagctccctgagcatccg

SEQ ID NO: 546493 - DNA, 25 bp, Rattus norvegicus
ccatggccaaggccaccaacgtctg

SEQ ID NO: 546494 - DNA, 25 bp, Rattus norvegicus
aacgtctggtcggacctcgtcctcg

SEQ ID NO: 546495 - DNA, 25 bp, Rattus norvegicus
tctggtcggacctcgtcctcgtctt

SEQ ID NO: 546496 - DNA, 25 bp, Rattus norvegicus
tcctcgtcttctgcttcgcctgtgt

SEQ ID NO: 546497 - DNA, 25 bp, Rattus norvegicus
cgtcttctgcttcgcctgtgtcctg

SEQ ID NO: 546498 - DNA, 25 bp, Rattus norvegicus
tgctgcgtctctacgcacaaccaga

SEQ ID NO: 546499 - DNA, 25 bp, Rattus norvegicus
cgctttccacgctgcgccatggcca

SEQ ID NO: 546500 - DNA, 25 bp, Rattus norvegicus
tcgatggtaagttttcacttccggc

SEQ ID NO: 546501 - DNA, 25 bp, Rattus norvegicus
tgtacacgaggtcccacagctcagg

SEQ ID NO: 546502 - DNA, 25 bp, Rattus norvegicus
gctcagggaaactctggccgctcta

SEQ ID NO: 546503 - DNA, 25 bp, Rattus norvegicus
tggccgctctaaccgcgtctagaac

SEQ ID NO: 546504 - DNA, 25 bp, Rattus norvegicus
ttaaggccgccctggatggcccaaa

SEQ ID NO: 546505 - DNA, 25 bp, Rattus norvegicus
agcgaccttctagcggccgtctcga

SEQ ID NO: 546506 - DNA, 25 bp, Rattus norvegicus
acttccggccggaaatgcgtttgcg

SEQ ID NO: 546507 - DNA, 25 bp, Rattus norvegicus
ccggggagaagaactcgcgtgcttc

SEQ ID NO: 546508 - DNA, 25 bp, Rattus norvegicus
cgcgtgcttcgtacagagtggaatg

SEQ ID NO: 546509 - DNA, 25 bp, Rattus norvegicus
gccgtggatacttcagaaggcgctc

SEQ ID NO: 546510 - DNA, 25 bp, Rattus norvegicus
cgctcgtgggatttggaagccactc

SEQ ID NO: 546511 - DNA, 25 bp, Rattus norvegicus
gctcccacgggaggaagctgacccg

SEQ ID NO: 546512 - DNA, 25 bp, Rattus norvegicus
tcatcaccggcggtgcacgaggtca

SEQ ID NO: 546513 - DNA, 25 bp, Rattus norvegicus
tggcccaaagcctagagcgaccttc

SEQ ID NO: 546514 - DNA, 25 bp, Rattus norvegicus
agcgactgccaggtatcgggttatc

SEQ ID NO: 546515 - DNA, 25 bp, Rattus norvegicus
gacgcccacgatgagagctgttggc

SEQ ID NO: 546516 - DNA, 25 bp, Rattus norvegicus
acggtcgtagaaagcgttgactggc

SEQ ID NO: 546517 - DNA, 25 bp, Rattus norvegicus
cgtctctaagctggccggggaagct

SEQ ID NO: 546518 - DNA, 25 bp, Rattus norvegicus
tctctgattggtcctccggcattcg

SEQ ID NO: 546519 - DNA, 25 bp, Rattus norvegicus
ccgcgcgccctttcttaagcttgga

SEQ ID NO: 546520 - DNA, 25 bp, Rattus norvegicus
tgccgtcgcagaatacagctctcca

SEQ ID NO: 546521 - DNA, 25 bp, Rattus norvegicus
cttccggctgagaaaccctgatgga

SEQ ID NO: 546522 - DNA, 25 bp, Rattus norvegicus
tatcgggttatcctgggcttgtccc

SEQ ID NO: 546523 - DNA, 25 bp, Rattus norvegicus
gttctcggatggcttctcgctgagc

SEQ ID NO: 546524 - DNA, 25 bp, Rattus norvegicus
ccagcttgctggtgagttctcggat

SEQ ID NO: 546525 - DNA, 25 bp, Rattus norvegicus
tcgaggctctccaagcggtccttga

SEQ ID NO: 546526 - DNA, 25 bp, Rattus norvegicus
agcgagcggctaagctgctccacga

SEQ ID NO: 546527 - DNA, 25 bp, Rattus norvegicus
cgctcacttcagcatgggtcgctgg

SEQ ID NO: 546528 - DNA, 25 bp, Rattus norvegicus
ggtagtgtgaagcacggagagcggc

SEQ ID NO: 546529 - DNA, 25 bp, Rattus norvegicus
ggggcggcaagcgagaaggggacca

SEQ ID NO: 546530 - DNA, 25 bp, Rattus norvegicus
gggcggcaagcgagaaggggaccag

SEQ ID NO: 546531 - DNA, 25 bp, Rattus norvegicus
ggcggcaagcgagaaggggaccagg

SEQ ID NO: 546532 - DNA, 25 bp, Rattus norvegicus
cggcaagcgagaaggggaccaggag

SEQ ID NO: 546533 - DNA, 25 bp, Rattus norvegicus
agaaggggaccaggagaggtagtgt

SEQ ID NO: 546534 - DNA, 25 bp, Rattus norvegicus
ggagaggtagtgtgaagcacggaga

SEQ ID NO: 546535 - DNA, 25 bp, Rattus norvegicus
agaggtagtgtgaagcacggagagc

SEQ ID NO: 546536 - DNA, 25 bp, Rattus norvegicus
aggtagtgtgaagcacggagagcgg

SEQ ID NO: 546537 - DNA, 25 bp, Rattus norvegicus
gtagtgtgaagcacggagagcggct

SEQ ID NO: 546538 - DNA, 25 bp, Rattus norvegicus
gcggcaagcgagaaggggaccagga

SEQ ID NO: 546539 - DNA, 25 bp, Rattus norvegicus
cacggagagcggctgagagacctga

SEQ ID NO: 546540 - DNA, 25 bp, Rattus norvegicus
gaggtagtgtgaagcacggagagcg

SEQ ID NO: 546541 - DNA, 25 bp, Rattus norvegicus
ggcaagcgagaaggggaccaggaga

SEQ ID NO: 546542 - DNA, 25 bp, Rattus norvegicus
aatcgccagcgtggatcacatcaag

SEQ ID NO: 546543 - DNA, 25 bp, Rattus norvegicus
agctcggggcgcagccgctgccctt

SEQ ID NO: 546544 - DNA, 25 bp, Rattus norvegicus
aatcgccgtggagcagcagctcggg

SEQ ID NO: 546545 - DNA, 25 bp, Rattus norvegicus
gtggatcacatcaagttcgacttgg

SEQ ID NO: 546546 - DNA, 25 bp, Rattus norvegicus
gcgtggatcacatcaagttcgactt

SEQ ID NO: 546547 - DNA, 25 bp, Rattus norvegicus
ccagcgtggatcacatcaagttcga

SEQ ID NO: 546548 - DNA, 25 bp, Rattus norvegicus
tcgccagcgtggatcacatcaagtt

SEQ ID NO: 546549 - DNA, 25 bp, Rattus norvegicus
ataatcgccagcgtggatcacatca

SEQ ID NO: 546550 - DNA, 25 bp, Rattus norvegicus
gaaataatcgccagcgtggatcaca

SEQ ID NO: 546551 - DNA, 25 bp, Rattus norvegicus
tgcaggaaataatcgccagcgtgga

SEQ ID NO: 546552 - DNA, 25 bp, Rattus norvegicus
catgcaggaaataatcgccagcgtg

SEQ ID NO: 546553 - DNA, 25 bp, Rattus norvegicus
gccatgcaggaaataatcgccagcg

SEQ ID NO: 546554 - DNA, 25 bp, Rattus norvegicus
ccgccatgcaggaaataatcgccag

SEQ ID NO: 546555 - DNA, 25 bp, Rattus norvegicus
cgccagcgtggatcacatcaagttc

SEQ ID NO: 546556 - DNA, 25 bp, Rattus norvegicus
cctgagggatcaagccatcaaggtc

SEQ ID NO: 546557 - DNA, 25 bp, Rattus norvegicus
tctggcagtgcaagaactgtactga

SEQ ID NO: 546558 - DNA, 25 bp, Rattus norvegicus
ttctactagcgaacccgcaacggtg

SEQ ID NO: 546559 - DNA, 25 bp, Rattus norvegicus
tcaaaggcactggtgtctggcggac

SEQ ID NO: 546560 - DNA, 25 bp, Rattus norvegicus
cggcaacggcttatctggcagtgca

SEQ ID NO: 546561 - DNA, 25 bp, Rattus norvegicus
ctcgttgtttaaggcgcccgcacct

SEQ ID NO: 546562 - DNA, 25 bp, Rattus norvegicus
actgaggcattgaataccgggcgca

SEQ ID NO: 546563 - DNA, 25 bp, Rattus norvegicus
tgcgacgctagcagcatccgggcgt

SEQ ID NO: 546564 - DNA, 25 bp, Rattus norvegicus
cacggagaagcaccagggcaggtcc

SEQ ID NO: 546565 - DNA, 25 bp, Rattus norvegicus
cgtgaagaaggcgttactgagcagc

SEQ ID NO: 546566 - DNA, 25 bp, Rattus norvegicus
ggttccgagactgctgtttctacta

SEQ ID NO: 546567 - DNA, 25 bp, Rattus norvegicus
aaacacatggctgtccgctggcacc

SEQ ID NO: 546568 - DNA, 25 bp, Rattus norvegicus
cgcacctgcacaaacacatggctgt

SEQ ID NO: 546569 - DNA, 25 bp, Rattus norvegicus
cccatcttggcgaaggacgggccag

SEQ ID NO: 546570 - DNA, 25 bp, Rattus norvegicus
ttgacattttggcaacggagacgca

SEQ ID NO: 546571 - DNA, 25 bp, Rattus norvegicus
gaggtgaaccggctcacggagaaca

SEQ ID NO: 546572 - DNA, 25 bp, Rattus norvegicus
tcccggaggctgcaccatgtctcgg

SEQ ID NO: 546573 - DNA, 25 bp, Rattus norvegicus
gagggccgctcagtcgcaagcccta

SEQ ID NO: 546574 - DNA, 25 bp, Rattus norvegicus
tctccggctgacagctgtggcggca

SEQ ID NO: 546575 - DNA, 25 bp, Rattus norvegicus
tttggcaacggagacgcacactggt

SEQ ID NO: 546576 - DNA, 25 bp, Rattus norvegicus
gctcacggagaacacgtaccgggta

SEQ ID NO: 546577 - DNA, 25 bp, Rattus norvegicus
agcgccgcaaagttttgacattttg

SEQ ID NO: 546578 - DNA, 25 bp, Rattus norvegicus
ttctcacagagcgaagcgccgcaaa

SEQ ID NO: 546579 - DNA, 25 bp, Rattus norvegicus
cgtttacctcacagcttctcacaga

SEQ ID NO: 546580 - DNA, 25 bp, Rattus norvegicus
aggctcggcaggctacgtttacctc

SEQ ID NO: 546581 - DNA, 25 bp, Rattus norvegicus
gtccctttgctagtcccaggctcgg

SEQ ID NO: 546582 - DNA, 25 bp, Rattus norvegicus
ctcaggtggggctgccggtcccttt

SEQ ID NO: 546583 - DNA, 25 bp, Rattus norvegicus
gcacactggttctctccggctgaca

SEQ ID NO: 546584 - DNA, 25 bp, Rattus norvegicus
cctaggctagagacttacctgcaga

SEQ ID NO: 546585 - DNA, 25 bp, Rattus norvegicus
gaagccaagtgcaaaccctccaaca

SEQ ID NO: 546586 - DNA, 25 bp, Rattus norvegicus
tgggctctggaagccaagtgcaaac

SEQ ID NO: 546587 - DNA, 25 bp, Rattus norvegicus
tccaactgggcagagcgcgcctgcg

SEQ ID NO: 546588 - DNA, 25 bp, Rattus norvegicus
agcgcagatcagcaccgggcgactc

SEQ ID NO: 546589 - DNA, 25 bp, Rattus norvegicus
cgactgtggatgttatagacccggg

SEQ ID NO: 546590 - DNA, 25 bp, Rattus norvegicus
tgaccgctcgactgtggatgttata

SEQ ID NO: 546591 - DNA, 25 bp, Rattus norvegicus
caggataccgggtgaccgctcgact

SEQ ID NO: 546592 - DNA, 25 bp, Rattus norvegicus
cacgacgatggagttggcaggatac

SEQ ID NO: 546593 - DNA, 25 bp, Rattus norvegicus
ggcagcctccgaccacgacgatgga

SEQ ID NO: 546594 - DNA, 25 bp, Rattus norvegicus
agacttacctgcagaccgggcagcc

SEQ ID NO: 546595 - DNA, 25 bp, Rattus norvegicus
ccgcgggcccacctgtgacgaggta

SEQ ID NO: 546596 - DNA, 25 bp, Rattus norvegicus
cgctcctgcaacaggggcttgtggt

SEQ ID NO: 546597 - DNA, 25 bp, Rattus norvegicus
caacaggggcttgtggtccatcgcg

SEQ ID NO: 546598 - DNA, 25 bp, Rattus norvegicus
cgcagcagtcaatcgtgagctccca

SEQ ID NO: 546599 - DNA, 25 bp, Rattus norvegicus
agttcagaagcctcggctgggaacc

SEQ ID NO: 546600 - DNA, 25 bp, Rattus norvegicus
ggacccgactgtagctaaagccttg

SEQ ID NO: 546601 - DNA, 25 bp, Rattus norvegicus
aatcgattattgcttccggcccgcc

SEQ ID NO: 546602 - DNA, 25 bp, Rattus norvegicus
ggccaatcagcgctgaatcgattat

SEQ ID NO: 546603 - DNA, 25 bp, Rattus norvegicus
agcgcgtccttacacgccggcaatt

SEQ ID NO: 546604 - DNA, 25 bp, Rattus norvegicus
gagctcccaggcagttgcgtcactc

SEQ ID NO: 546605 - DNA, 25 bp, Rattus norvegicus
agatcgccgctgagcgcagcagtca

SEQ ID NO: 546606 - DNA, 25 bp, Rattus norvegicus
cagtcgcagagagcgaccggctagc

SEQ ID NO: 546607 - DNA, 25 bp, Rattus norvegicus
ggacccatcgagtcacgtgtcctca

SEQ ID NO: 546608 - DNA, 25 bp, Rattus norvegicus
agagcggacgcagcaaccgcacctt

SEQ ID NO: 546609 - DNA, 25 bp, Rattus norvegicus
gcttcctgcgttccagcattctctt

SEQ ID NO: 546610 - DNA, 25 bp, Rattus norvegicus
tacacgccggcaattcctcagggca

SEQ ID NO: 546611 - DNA, 25 bp, Rattus norvegicus
gcgtcactccgagtctggccaatca

SEQ ID NO: 546612 - DNA, 25 bp, Rattus norvegicus
cgggaagcatgtaaatgagctcgct

SEQ ID NO: 546613 - DNA, 25 bp, Rattus norvegicus
tctgggtctgagagcccgcggcctc

SEQ ID NO: 546614 - DNA, 25 bp, Rattus norvegicus
aggacacgtcgctttagccaccaca

SEQ ID NO: 546615 - DNA, 25 bp, Rattus norvegicus
taaatgagctcgctgggcggggcca

SEQ ID NO: 546616 - DNA, 25 bp, Rattus norvegicus
tccctctgggtctgagagcccgcgg

SEQ ID NO: 546617 - DNA, 25 bp, Rattus norvegicus
aggccgtacgcgcagaggctgccca

SEQ ID NO: 546618 - DNA, 25 bp, Rattus norvegicus
acaaggacacgtcgctttagccacc

SEQ ID NO: 546619 - DNA, 25 bp, Rattus norvegicus
gacacgtcgctttagccaccacagg

SEQ ID NO: 546620 - DNA, 25 bp, Rattus norvegicus
cgtcgctttagccaccacaggcggg

SEQ ID NO: 546621 - DNA, 25 bp, Rattus norvegicus
tcgctttagccaccacaggcggggc

SEQ ID NO: 546622 - DNA, 25 bp, Rattus norvegicus
tttagccaccacaggcggggctgcg

SEQ ID NO: 546623 - DNA, 25 bp, Rattus norvegicus
ctgcgggaagcatgtaaatgagctc

SEQ ID NO: 546624 - DNA, 25 bp, Rattus norvegicus
agcatgtaaatgagctcgctgggcg

SEQ ID NO: 546625 - DNA, 25 bp, Rattus norvegicus
ggggacaaggacacgtcgctttagc

SEQ ID NO: 546626 - DNA, 25 bp, Rattus norvegicus
cgctcacctgcacctgtttgcggaa

SEQ ID NO: 546627 - DNA, 25 bp, Rattus norvegicus
ggccacagagccagcatcatccttc

SEQ ID NO: 546628 - DNA, 25 bp, Rattus norvegicus
ctcgttagccaaacgtcaaccctgt

SEQ ID NO: 546629 - DNA, 25 bp, Rattus norvegicus
ggacacacgtctcgttagccaaacg

SEQ ID NO: 546630 - DNA, 25 bp, Rattus norvegicus
ctgcttcgggacacacgtctcgtta

SEQ ID NO: 546631 - DNA, 25 bp, Rattus norvegicus
tcgggttgccgccttcagtcagtca

SEQ ID NO: 546632 - DNA, 25 bp, Rattus norvegicus
tgccgacggtcaagagcagaagcag

SEQ ID NO: 546633 - DNA, 25 bp, Rattus norvegicus
cgccatgatgggctgcgtcatgtga

SEQ ID NO: 546634 - DNA, 25 bp, Rattus norvegicus
ctgcacctgtttgcggaagtggcgc

SEQ ID NO: 546635 - DNA, 25 bp, Rattus norvegicus
gatccgtcgcagaggtggcccaacc

SEQ ID NO: 546636 - DNA, 25 bp, Rattus norvegicus
caggcctccgatccgtcgcagaggt

SEQ ID NO: 546637 - DNA, 25 bp, Rattus norvegicus
agaaatctccctaggatcgctcgca

SEQ ID NO: 546638 - DNA, 25 bp, Rattus norvegicus
tgcggcaagaaatctccctaggatc

SEQ ID NO: 546639 - DNA, 25 bp, Rattus norvegicus
ccgggcactgccgacggtcaagagc

SEQ ID NO: 546640 - DNA, 25 bp, Rattus norvegicus
ttccctaaggctgcggtctccgagc

SEQ ID NO: 546641 - DNA, 25 bp, Rattus norvegicus
ctgtcagcgaaggtccgtcaggtta

SEQ ID NO: 546642 - DNA, 25 bp, Rattus norvegicus
cgtaccagaaaaggacagcgcactg

SEQ ID NO: 546643 - DNA, 25 bp, Rattus norvegicus
agcgcactgcggtttttcttctggg

SEQ ID NO: 546644 - DNA, 25 bp, Rattus norvegicus
cttctgggtcagtctcgacctcttc

SEQ ID NO: 546645 - DNA, 25 bp, Rattus norvegicus
cggaagtgcggtgttccctaaggct

SEQ ID NO: 546646 - DNA, 25 bp, Rattus norvegicus
cagggacttgggcagcccaggaaaa

SEQ ID NO: 546647 - DNA, 25 bp, Rattus norvegicus
caacccacgtttcgggccgcgagag

SEQ ID NO: 546648 - DNA, 25 bp, Rattus norvegicus
ttagccgcacactgaggaaggtccc

SEQ ID NO: 546649 - DNA, 25 bp, Rattus norvegicus
tgctcagaagctgcagggtgcgtcc

SEQ ID NO: 546650 - DNA, 25 bp, Rattus norvegicus
cggcgctgttgagcttcttcatcta

SEQ ID NO: 546651 - DNA, 25 bp, Rattus norvegicus
tgttagtctcgcctgctctgacgga

SEQ ID NO: 546652 - DNA, 25 bp, Rattus norvegicus
ctccgcccagtttgaatgtctttcc

SEQ ID NO: 546653 - DNA, 25 bp, Rattus norvegicus
caggttaatccctccgcccagtttg

SEQ ID NO: 546654 - DNA, 25 bp, Rattus norvegicus
ctttggttcccaccatgccgatgta

SEQ ID NO: 546655 - DNA, 25 bp, Rattus norvegicus
gccactttaagtccgcgagcttgcc

SEQ ID NO: 546656 - DNA, 25 bp, Rattus norvegicus
ctctataaagaatgcgcccggtggg

SEQ ID NO: 546657 - DNA, 25 bp, Rattus norvegicus
cgcgccctcagttggttccatggaa

SEQ ID NO: 546658 - DNA, 25 bp, Rattus norvegicus
tgggccacccattggctgcttttga

SEQ ID NO: 546659 - DNA, 25 bp, Rattus norvegicus
tgacgctagaccagcccgaccaata

SEQ ID NO: 546660 - DNA, 25 bp, Rattus norvegicus
tgccgatgtaccaggtaaagcccta

SEQ ID NO: 546661 - DNA, 25 bp, Rattus norvegicus
acccacctagattagtgctgccgtg

SEQ ID NO: 546662 - DNA, 25 bp, Rattus norvegicus
tccttaccgttgattggccacctca

SEQ ID NO: 546663 - DNA, 25 bp, Rattus norvegicus
gcgaaggcgtgccaagacctcctta

SEQ ID NO: 546664 - DNA, 25 bp, Rattus norvegicus
agagcttccaacctgcatgtaccgg

SEQ ID NO: 546665 - DNA, 25 bp, Rattus norvegicus
agccctatcatggaggcagcgcacc

SEQ ID NO: 546666 - DNA, 25 bp, Rattus norvegicus
cgcacctctgcgtgtagagcttcca

SEQ ID NO: 546667 - DNA, 25 bp, Rattus norvegicus
tttccggaacgccagaagcagagtc

SEQ ID NO: 546668 - DNA, 25 bp, Rattus norvegicus
gttcgccgtcacacatgtcccgagg

SEQ ID NO: 546669 - DNA, 25 bp, Rattus norvegicus
gagtcgctaatgctggagaaaacca

SEQ ID NO: 546670 - DNA, 25 bp, Rattus norvegicus
ccctcagagtcgctaatgctggaga

SEQ ID NO: 546671 - DNA, 25 bp, Rattus norvegicus
catgtcccgaggcatgtaatttccc

SEQ ID NO: 546672 - DNA, 25 bp, Rattus norvegicus
agccgagccgccttggctctgcggt

SEQ ID NO: 546673 - DNA, 25 bp, Rattus norvegicus
cccgcccatcgcttccctgctgtgc

SEQ ID NO: 546674 - DNA, 25 bp, Rattus norvegicus
gtccactggcgaacactcggtccag

SEQ ID NO: 546675 - DNA, 25 bp, Rattus norvegicus
tccgggcccacagtttcattctgca

SEQ ID NO: 546676 - DNA, 25 bp, Rattus norvegicus
ggcccacagtttcattctgcataca

SEQ ID NO: 546677 - DNA, 25 bp, Rattus norvegicus
ttctgcatacaacagcagttaatgc

SEQ ID NO: 546678 - DNA, 25 bp, Rattus norvegicus
cagttaatgcgcatgtcacccgaga

SEQ ID NO: 546679 - DNA, 25 bp, Rattus norvegicus
atgcgcatgtcacccgagaaagttc

SEQ ID NO: 546680 - DNA, 25 bp, Rattus norvegicus
acccgagaaagttcgccgtcacaca

SEQ ID NO: 546681 - DNA, 25 bp, Rattus norvegicus
ggcatgtaatttccctcagagtcgc

SEQ ID NO: 546682 - DNA, 25 bp, Rattus norvegicus
cgcggataacaacctcgctctgcta

SEQ ID NO: 546683 - DNA, 25 bp, Rattus norvegicus
catcgttgccgcgagcgcggataac

SEQ ID NO: 546684 - DNA, 25 bp, Rattus norvegicus
cacctctgcggggaagtcgatggca

SEQ ID NO: 546685 - DNA, 25 bp, Rattus norvegicus
tccgacacctctgcggggaagtcga

SEQ ID NO: 546686 - DNA, 25 bp, Rattus norvegicus
atcccggtctcaccatcatacttgg

SEQ ID NO: 546687 - DNA, 25 bp, Rattus norvegicus
tcgctctgctagttccctgacgctg

SEQ ID NO: 546688 - DNA, 25 bp, Rattus norvegicus
aaattcaggtggacagcgaaccgtg

SEQ ID NO: 546689 - DNA, 25 bp, Rattus norvegicus
tcatacttggggtccgacacctctg

SEQ ID NO: 546690 - DNA, 25 bp, Rattus norvegicus
gggaccactggagcgcggaaattca

SEQ ID NO: 546691 - DNA, 25 bp, Rattus norvegicus
ctgcctggggcctttggtggccctc

SEQ ID NO: 546692 - DNA, 25 bp, Rattus norvegicus
tacagttctggacccgaattcgagc

SEQ ID NO: 546693 - DNA, 25 bp, Rattus norvegicus
cggtgccctacagttctggacccga

SEQ ID NO: 546694 - DNA, 25 bp, Rattus norvegicus
cgaaccgtgggactgcgcgagccat

SEQ ID NO: 546695 - DNA, 25 bp, Rattus norvegicus
gggactgcgcgagccatcccggtct

SEQ ID NO: 546696 - DNA, 25 bp, Rattus norvegicus
tacgcaccgcgcctcttgcgcgacg

SEQ ID NO: 546697 - DNA, 25 bp, Rattus norvegicus
tccgggaactccggacggaagctgc

SEQ ID NO: 546698 - DNA, 25 bp, Rattus norvegicus
tgtgcatgccgggacagtgtagccg

SEQ ID NO: 546699 - DNA, 25 bp, Rattus norvegicus
gttgccatggccaccgcgctcccac

SEQ ID NO: 546700 - DNA, 25 bp, Rattus norvegicus
tgccggacacccagccaatcagtgc

SEQ ID NO: 546701 - DNA, 25 bp, Rattus norvegicus
tgcccggatggaggcacgtcattgt

SEQ ID NO: 546702 - DNA, 25 bp, Rattus norvegicus
gccaatcagggcgtcggaccaatca

SEQ ID NO: 546703 - DNA, 25 bp, Rattus norvegicus
cttgccgggcccgttagctacgcac

SEQ ID NO: 546704 - DNA, 25 bp, Rattus norvegicus
cttagctgacgcgtgaggccagccc

SEQ ID NO: 546705 - DNA, 25 bp, Rattus norvegicus
cgcccggcgcttagctgacgcgtga

SEQ ID NO: 546706 - DNA, 25 bp, Rattus norvegicus
agtatgttttctccggcggcgcccg

SEQ ID NO: 546707 - DNA, 25 bp, Rattus norvegicus
atcagtatgttttctccggcggcgc

SEQ ID NO: 546708 - DNA, 25 bp, Rattus norvegicus
cgtcggaccaatcagtatgttttct

SEQ ID NO: 546709 - DNA, 25 bp, Rattus norvegicus
ccggatggaggcacgtcattgtccc

SEQ ID NO: 546710 - DNA, 25 bp, Rattus norvegicus
ggcctctacatggtcgtgagcatga

SEQ ID NO: 546711 - DNA, 25 bp, Rattus norvegicus
tcgaggacactatcggagccggaga

SEQ ID NO: 546712 - DNA, 25 bp, Rattus norvegicus
agcgccgctccctgagcaggtacag

SEQ ID NO: 546713 - DNA, 25 bp, Rattus norvegicus
ccgaccagaggaccatcaccataag

SEQ ID NO: 546714 - DNA, 25 bp, Rattus norvegicus
catcaccataagaagcggcgctgct

SEQ ID NO: 546715 - DNA, 25 bp, Rattus norvegicus
tgctacagccgagagcggcccaagc

SEQ ID NO: 546716 - DNA, 25 bp, Rattus norvegicus
aggagcgccaccctgctaacacata

SEQ ID NO: 546717 - DNA, 25 bp, Rattus norvegicus
agccaccatcactcacgggttagga

SEQ ID NO: 546718 - DNA, 25 bp, Rattus norvegicus
tggagccggtaccaccactcggaaa

SEQ ID NO: 546719 - DNA, 25 bp, Rattus norvegicus
actcggaaaatgagcctgcctgggc

SEQ ID NO: 546720 - DNA, 25 bp, Rattus norvegicus
gttctacccggacaagatgcgctgg

SEQ ID NO: 546721 - DNA, 25 bp, Rattus norvegicus
cgctgggacaagtgtaggtattacc

SEQ ID NO: 546722 - DNA, 25 bp, Rattus norvegicus
aggtattaccacgacaggtacacta

SEQ ID NO: 546723 - DNA, 25 bp, Rattus norvegicus
ggtacactacgaccctgtacacggc

SEQ ID NO: 546724 - DNA, 25 bp, Rattus norvegicus
tggttccgagaatggggcggtgcat

SEQ ID NO: 546725 - DNA, 25 bp, Rattus norvegicus
agccaccgaggatcccagcctgggg

SEQ ID NO: 546726 - DNA, 25 bp, Rattus norvegicus
agcctcgaagaacggggcacagcgc

SEQ ID NO: 546727 - DNA, 25 bp, Rattus norvegicus
cccaagcctcgaagaacggggcaca

SEQ ID NO: 546728 - DNA, 25 bp, Rattus norvegicus
tgagccgggctagctcgccgcagct

SEQ ID NO: 546729 - DNA, 25 bp, Rattus norvegicus
gagtcatacggtgggcggtgctatg

SEQ ID NO: 546730 - DNA, 25 bp, Rattus norvegicus
aaaagcatgactgaaggcgggagtt
